United States Patent 12,624,385 (RIBOREGULATORS AND METHODS OF USE THEREOF) - sequence listing, part 12

SEQ ID NO: 188221 - DNA, 103 bp, Artificial Sequence
  Synthetic Polynucleotide
taatacgactcactatagggtgttctggactcttcttccattattcttttaacagaggagaaaaagaatgatggaagaaaacctggcggcagcgcaaaagatg

SEQ ID NO: 188222 - DNA, 103 bp, Artificial Sequence
  Synthetic Polynucleotide
taatacgactcactatagggctttctggcctgttctggactcttcttccaaacagaggagatggaagatgagtccagaaaacctggcggcagcgcaaaagatg

SEQ ID NO: 188223 - DNA, 103 bp, Artificial Sequence
  Synthetic Polynucleotide
taatacgactcactatagggttccttttcacattcctatagcgagttttcaacagaggagagaaaacatgctataggaaaacctggcggcagcgcaaaagatg

SEQ ID NO: 188224 - DNA, 103 bp, Artificial Sequence
  Synthetic Polynucleotide
taatacgactcactatagggcctggattcactttctggcctgttctggacaacagaggagagtccagatgaggccagaaaacctggcggcagcgcaaaagatg

SEQ ID NO: 188225 - DNA, 103 bp, Artificial Sequence
  Synthetic Polynucleotide
taatacgactcactataggggcctgtgttccctggattcactttctggccaacagaggagaggccagatggtgaatccaaacctggcggcagcgcaaaagatg

SEQ ID NO: 188226 - DNA, 103 bp, Artificial Sequence
  Synthetic Polynucleotide
taatacgactcactatagggcaaataatttgcctgtgttccctggattcaaacagaggagatgaatcatgggaacacagaacctggcggcagcgcaaaagatg

SEQ ID NO: 188227 - DNA, 103 bp, Artificial Sequence
  Synthetic Polynucleotide
taatacgactcactatagggcctacccccacaaataatttgcctgtgttcaacagaggagagaacacatgcaaattattaacctggcggcagcgcaaaagatg

SEQ ID NO: 188228 - DNA, 103 bp, Artificial Sequence
  Synthetic Polynucleotide
taatacgactcactatagggtcttgagattcctacccccacaaataatttaacagaggagaaaattaatggtgggggtaaacctggcggcagcgcaaaagatg

SEQ ID NO: 188229 - DNA, 103 bp, Artificial Sequence
  Synthetic Polynucleotide
taatacgactcactatagggcttttgcaattcttgagattcctacccccaaacagaggagatgggggatggaatctcaaaacctggcggcagcgcaaaagatg

SEQ ID NO: 188230 - DNA, 103 bp, Artificial Sequence
  Synthetic Polynucleotide
taatacgactcactatagggccatacttgacttttgcaattcttgagattaacagaggagaaatctcatgaattgcaaaaacctggcggcagcgcaaaagatg

SEQ ID NO: 188231 - DNA, 103 bp, Artificial Sequence
  Synthetic Polynucleotide
taatacgactcactatagggtccacactctccatacttgacttttgcaataacagaggagaattgcaatggtcaagtataacctggcggcagcgcaaaagatg

SEQ ID NO: 188232 - DNA, 103 bp, Artificial Sequence
  Synthetic Polynucleotide
taatacgactcactatagggtgaaaccttgtccacactctccatacttgaaacagaggagatcaagtatggagagtgtgaacctggcggcagcgcaaaagatg

SEQ ID NO: 188233 - DNA, 103 bp, Artificial Sequence
  Synthetic Polynucleotide
taatacgactcactataggggatttaacactgaaaccttgtccacactctaacagaggagaagagtgatgacaaggtttaacctggcggcagcgcaaaagatg

SEQ ID NO: 188234 - DNA, 103 bp, Artificial Sequence
  Synthetic Polynucleotide
taatacgactcactatagggtgcattatagttccttttcacattcctataaacagaggagatataggatggtgaaaaggaacctggcggcagcgcaaaagatg

SEQ ID NO: 188235 - DNA, 103 bp, Artificial Sequence
  Synthetic Polynucleotide
taatacgactcactatagggaataacatctgatttaacactgaaaccttgaacagaggagacaaggtatgagtgttaaaaacctggcggcagcgcaaaagatg

SEQ ID NO: 188236 - DNA, 103 bp, Artificial Sequence
  Synthetic Polynucleotide
taatacgactcactatagggtttggtgtgtaataacatctgatttaacacaacagaggagagtgttaatgcagatgttaaacctggcggcagcgcaaaagatg

SEQ ID NO: 188237 - DNA, 103 bp, Artificial Sequence
  Synthetic Polynucleotide
taatacgactcactataggggtatgtgtcctttggtgtgtaataacatctaacagaggagaagatgtatgtacacaccaaacctggcggcagcgcaaaagatg

SEQ ID NO: 188238 - DNA, 103 bp, Artificial Sequence
  Synthetic Polynucleotide
taatacgactcactatagggcttctcccctgtatgtgtcctttggtgtgtaacagaggagaacacacatgaggacacataacctggcggcagcgcaaaagatg

SEQ ID NO: 188239 - DNA, 103 bp, Artificial Sequence
  Synthetic Polynucleotide
taatacgactcactatagggagacgtagagcttctcccctgtatgtgtccaacagaggagaggacacatgcaggggagaaacctggcggcagcgcaaaagatg

SEQ ID NO: 188240 - DNA, 103 bp, Artificial Sequence
  Synthetic Polynucleotide
taatacgactcactatagggcactccctgcagacgtagagcttctcccctaacagaggagaaggggaatggctctacgtaacctggcggcagcgcaaaagatg

SEQ ID NO: 188241 - DNA, 103 bp, Artificial Sequence
  Synthetic Polynucleotide
taatacgactcactataggggccccgcccacactccctgcagacgtagagaacagaggagactctacatgtgcagggagaacctggcggcagcgcaaaagatg

SEQ ID NO: 188242 - DNA, 103 bp, Artificial Sequence
  Synthetic Polynucleotide
taatacgactcactatagggtccagctaaagccccgcccacactccctgcaacagaggagagcagggatggtgggcgggaacctggcggcagcgcaaaagatg

SEQ ID NO: 188243 - DNA, 103 bp, Artificial Sequence
  Synthetic Polynucleotide
taatacgactcactatagggaggtgtgacttccagctaaagccccgcccaaacagaggagatgggcgatgctttagctgaacctggcggcagcgcaaaagatg

SEQ ID NO: 188244 - DNA, 103 bp, Artificial Sequence
  Synthetic Polynucleotide
taatacgactcactataggggtgaatgaggaggtgtgacttccagctaaaaacagaggagatttagcatgaagtcacacaacctggcggcagcgcaaaagatg

SEQ ID NO: 188245 - DNA, 103 bp, Artificial Sequence
  Synthetic Polynucleotide
taatacgactcactatagggtagtaatcagtgcattatagttccttttcaaacagaggagatgaaaaatgactataatgaacctggcggcagcgcaaaagatg

SEQ ID NO: 188246 - DNA, 103 bp, Artificial Sequence
  Synthetic Polynucleotide
taatacgactcactataggggtatcctctggtgaatgaggaggtgtgactaacagaggagaagtcacatgtcctcattcaacctggcggcagcgcaaaagatg

SEQ ID NO: 188247 - DNA, 103 bp, Artificial Sequence
  Synthetic Polynucleotide
taatacgactcactatagggtcccctgtgtgtatcctctggtgaatgaggaacagaggagacctcatatgccagaggataacctggcggcagcgcaaaagatg

SEQ ID NO: 188248 - DNA, 103 bp, Artificial Sequence
  Synthetic Polynucleotide
taatacgactcactatagggatagggcttctcccctgtgtgtatcctctgaacagaggagacagaggatgcacacagggaacctggcggcagcgcaaaagatg

SEQ ID NO: 188249 - DNA, 103 bp, Artificial Sequence
  Synthetic Polynucleotide
taatacgactcactatagggccctgcagacatagggcttctcccctgtgtaacagaggagaacacagatgagaagccctaacctggcggcagcgcaaaagatg

SEQ ID NO: 188250 - DNA, 103 bp, Artificial Sequence
  Synthetic Polynucleotide
taatacgactcactatagggcgcccacactccctgcagacatagggcttcaacagaggagagaagccatgtgtctgcagaacctggcggcagcgcaaaagatg

SEQ ID NO: 188251 - DNA, 103 bp, Artificial Sequence
  Synthetic Polynucleotide
taatacgactcactataggggctaaagccccgcccacactccctgcagacaacagaggagagtctgcatggagtgtgggaacctggcggcagcgcaaaagatg

SEQ ID NO: 188252 - DNA, 103 bp, Artificial Sequence
  Synthetic Polynucleotide
taatacgactcactatagggctgactgccagctaaagccccgcccacactaacagaggagaagtgtgatgggggctttaaacctggcggcagcgcaaaagatg

SEQ ID NO: 188253 - DNA, 103 bp, Artificial Sequence
  Synthetic Polynucleotide
taatacgactcactataggggtgaggaggactgactgccagctaaagcccaacagaggagagggcttatgctggcagtcaacctggcggcagcgcaaaagatg

SEQ ID NO: 188254 - DNA, 103 bp, Artificial Sequence
  Synthetic Polynucleotide
taatacgactcactatagggcctctggtgagtgaggaggactgactgccaaacagaggagatggcagatggtcctcctcaacctggcggcagcgcaaaagatg

SEQ ID NO: 188255 - DNA, 103 bp, Artificial Sequence
  Synthetic Polynucleotide
taatacgactcactatagggctgtgtgtgtcctctggtgagtgaggaggaaacagaggagatcctccatgctcaccagaaacctggcggcagcgcaaaagatg

SEQ ID NO: 188256 - DNA, 103 bp, Artificial Sequence
  Synthetic Polynucleotide
taatacgactcactatagggctgagacctatagtaatcagtgcattatagaacagaggagactataaatgactgattacaacctggcggcagcgcaaaagatg

SEQ ID NO: 188257 - DNA, 103 bp, Artificial Sequence
  Synthetic Polynucleotide
taatacgactcactatagggggcttctcccctgtgtgtgtcctctggtgaaacagaggagatcaccaatggacacacacaacctggcggcagcgcaaaagatg

SEQ ID NO: 188258 - DNA, 103 bp, Artificial Sequence
  Synthetic Polynucleotide
taatacgactcactataggggcagacatagggcttctcccctgtgtgtgtaacagaggagaacacacatgggggagaagaacctggcggcagcgcaaaagatg

SEQ ID NO: 188259 - DNA, 103 bp, Artificial Sequence
  Synthetic Polynucleotide
taatacgactcactatagggcacactccctgcagacatagggcttctcccaacagaggagagggagaatgcctatgtctaacctggcggcagcgcaaaagatg

SEQ ID NO: 188260 - DNA, 103 bp, Artificial Sequence
  Synthetic Polynucleotide
taatacgactcactatagggaagccccgcccacactccctgcagacatagaacagaggagactatgtatgcagggagtgaacctggcggcagcgcaaaagatg

SEQ ID NO: 188261 - DNA, 103 bp, Artificial Sequence
  Synthetic Polynucleotide
taatacgactcactatagggctgccggctaaagccccgcccacactccctaacagaggagaagggagatggggcggggcaacctggcggcagcgcaaaagatg

SEQ ID NO: 188262 - DNA, 103 bp, Artificial Sequence
  Synthetic Polynucleotide
taatacgactcactatagggggaggactgactgccggctaaagccccgccaacagaggagaggcgggatgttagccggcaacctggcggcagcgcaaaagatg

SEQ ID NO: 188263 - DNA, 103 bp, Artificial Sequence
  Synthetic Polynucleotide
taatacgactcactatagggtggtgagtgaggaggactgactgccggctaaacagaggagatagccgatggtcagtcctaacctggcggcagcgcaaaagatg

SEQ ID NO: 188264 - DNA, 103 bp, Artificial Sequence
  Synthetic Polynucleotide
taatacgactcactataggggtgtctcctctggtgagtgaggaggactgaaacagaggagatcagtcatgctcactcacaacctggcggcagcgcaaaagatg

SEQ ID NO: 188265 - DNA, 103 bp, Artificial Sequence
  Synthetic Polynucleotide
taatacgactcactatagggtctcccctgtgtgtctcctctggtgagtgaaacagaggagatcactcatgagaggagacaacctggcggcagcgcaaaagatg

SEQ ID NO: 188266 - DNA, 103 bp, Artificial Sequence
  Synthetic Polynucleotide
taatacgactcactatagggacatagggcttctcccctgtgtgtctcctcaacagaggagagaggagatgcacaggggaaacctggcggcagcgcaaaagatg

SEQ ID NO: 188267 - DNA, 103 bp, Artificial Sequence
  Synthetic Polynucleotide
taatacgactcactatagggtcgagtggctctgagacctatagtaatcagaacagaggagactgattatgataggtctcaacctggcggcagcgcaaaagatg

SEQ ID NO: 188268 - DNA, 103 bp, Artificial Sequence
  Synthetic Polynucleotide
taatacgactcactatagggctccctgcagacatagggcttctcccctgtaacagaggagaacagggatgaagccctataacctggcggcagcgcaaaagatg

SEQ ID NO: 188269 - DNA, 103 bp, Artificial Sequence
  Synthetic Polynucleotide
taatacgactcactatagggcccgcccacactccctgcagacatagggctaacagaggagaagccctatgtctgcagggaacctggcggcagcgcaaaagatg

SEQ ID NO: 188270 - DNA, 103 bp, Artificial Sequence
  Synthetic Polynucleotide
taatacgactcactatagggcggctaaagccccgcccacactccctgcagaacagaggagactgcagatggtgtgggcgaacctggcggcagcgcaaaagatg

SEQ ID NO: 188271 - DNA, 103 bp, Artificial Sequence
  Synthetic Polynucleotide
taatacgactcactataggggactgactgccggctaaagccccgcccacaaacagaggagatgtgggatgggctttagcaacctggcggcagcgcaaaagatg

SEQ ID NO: 188272 - DNA, 103 bp, Artificial Sequence
  Synthetic Polynucleotide
taatacgactcactataggggagtgaggaggactgactgccggctaaagcaacagaggagagctttaatgggcagtcagaacctggcggcagcgcaaaagatg

SEQ ID NO: 188273 - DNA, 103 bp, Artificial Sequence
  Synthetic Polynucleotide
taatacgactcactatagggctcctctggtgagtgaggaggactgactgcaacagaggagagcagtcatgcctcctcacaacctggcggcagcgcaaaagatg

SEQ ID NO: 188274 - DNA, 103 bp, Artificial Sequence
  Synthetic Polynucleotide
taatacgactcactatagggccctgtgtgtctcctctggtgagtgaggagaacagaggagactcctcatgcaccagaggaacctggcggcagcgcaaaagatg

SEQ ID NO: 188275 - DNA, 103 bp, Artificial Sequence
  Synthetic Polynucleotide
taatacgactcactatagggagggcttctcccctgtgtgtctcctctggtaacagaggagaaccagaatggacacacagaacctggcggcagcgcaaaagatg

SEQ ID NO: 188276 - DNA, 103 bp, Artificial Sequence
  Synthetic Polynucleotide
taatacgactcactatagggctgcagacatagggcttctcccctgtgtgtaacagaggagaacacacatgggagaagccaacctggcggcagcgcaaaagatg

SEQ ID NO: 188277 - DNA, 103 bp, Artificial Sequence
  Synthetic Polynucleotide
taatacgactcactatagggcccacactccctgcagacatagggcttctcaacagaggagagagaagatgtatgtctgcaacctggcggcagcgcaaaagatg

SEQ ID NO: 188278 - DNA, 103 bp, Artificial Sequence
  Synthetic Polynucleotide
taatacgactcactatagggcttcttctgggctctcctcttgggacttttaacagaggagaaaaagtatgaagaggagaaacctggcggcagcgcaaaagatg

SEQ ID NO: 188279 - DNA, 103 bp, Artificial Sequence; identical to SEQ ID NO: 188080
  Synthetic Polynucleotide

SEQ ID NO: 188280 - DNA, 103 bp, Artificial Sequence
  Synthetic Polynucleotide
taatacgactcactatagggtaaagccccgcccacactccctgcagacataacagaggagaatgtctatggggagtgtgaacctggcggcagcgcaaaagatg

SEQ ID NO: 188281 - DNA, 103 bp, Artificial Sequence
  Synthetic Polynucleotide
taatacgactcactataggggactgccagctaaagccccgcccacactccaacagaggagaggagtgatggcggggcttaacctggcggcagcgcaaaagatg

SEQ ID NO: 188282 - DNA, 103 bp, Artificial Sequence
  Synthetic Polynucleotide
taatacgactcactataggggaggaggactgactgccagctaaagccccgaacagaggagacggggcatgagctggcagaacctggcggcagcgcaaaagatg

SEQ ID NO: 188283 - DNA, 103 bp, Artificial Sequence
  Synthetic Polynucleotide
taatacgactcactatagggtctggtgagtgaggaggactgactgccagcaacagaggagagctggcatgcagtcctccaacctggcggcagcgcaaaagatg

SEQ ID NO: 188284 - DNA, 103 bp, Artificial Sequence
  Synthetic Polynucleotide
taatacgactcactataggggtgtgtgtcctctggtgagtgaggaggactaacagaggagaagtcctatgcactcaccaaacctggcggcagcgcaaaagatg

SEQ ID NO: 188285 - DNA, 103 bp, Artificial Sequence
  Synthetic Polynucleotide
taatacgactcactatagggcttctcccctgtgtgtgtcctctggtgagtaacagaggagaactcacatgaggacacacaacctggcggcagcgcaaaagatg

SEQ ID NO: 188286 - DNA, 103 bp, Artificial Sequence
  Synthetic Polynucleotide
taatacgactcactatagggagacatagggcttctcccctgtgtgtgtccaacagaggagaggacacatgcaggggagaaacctggcggcagcgcaaaagatg

SEQ ID NO: 188287 - DNA, 103 bp, Artificial Sequence
  Synthetic Polynucleotide
taatacgactcactatagggcactccctgcagacatagggcttctcccctaacagaggagaaggggaatggccctatgtaacctggcggcagcgcaaaagatg

SEQ ID NO: 188288 - DNA, 103 bp, Artificial Sequence
  Synthetic Polynucleotide
taatacgactcactataggggccccgcccacactccctgcagacatagggaacagaggagaccctatatgtgcagggagaacctggcggcagcgcaaaagatg

SEQ ID NO: 188289 - DNA, 103 bp, Artificial Sequence
  Synthetic Polynucleotide
taatacgactcactataggggccagctaaagccccgcccacactccctgcaacagaggagagcagggatggtgggcgggaacctggcggcagcgcaaaagatg

SEQ ID NO: 188290 - DNA, 103 bp, Artificial Sequence; identical to SEQ ID NO: 188081
  Synthetic Polynucleotide

SEQ ID NO: 188291 - DNA, 103 bp, Artificial Sequence
  Synthetic Polynucleotide
taatacgactcactatagggaggactgactgccagctaaagccccgcccaaacagaggagatgggcgatgctttagctgaacctggcggcagcgcaaaagatg

SEQ ID NO: 188292 - DNA, 103 bp, Artificial Sequence
  Synthetic Polynucleotide
taatacgactcactataggggtgagtgaggaggactgactgccagctaaaaacagaggagatttagcatgcagtcagtcaacctggcggcagcgcaaaagatg

SEQ ID NO: 188293 - DNA, 103 bp, Artificial Sequence
  Synthetic Polynucleotide
taatacgactcactataggggtgtcctctggtgagtgaggaggactgactaacagaggagaagtcagatgtcctcactcaacctggcggcagcgcaaaagatg

SEQ ID NO: 188294 - DNA, 103 bp, Artificial Sequence
  Synthetic Polynucleotide
taatacgactcactatagggtcccctgtgtgtgtcctctggtgagtgaggaacagaggagacctcacatgccagaggacaacctggcggcagcgcaaaagatg

SEQ ID NO: 188295 - DNA, 103 bp, Artificial Sequence
  Synthetic Polynucleotide
taatacgactcactatagggatagggcttctcccctgtgtgtgtcctctgaacagaggagacagaggatgcacacagggaacctggcggcagcgcaaaagatg

SEQ ID NO: 188296 - DNA, 103 bp, Artificial Sequence; identical to SEQ ID NO: 188249
  Synthetic Polynucleotide

SEQ ID NO: 188297 - DNA, 103 bp, Artificial Sequence; identical to SEQ ID NO: 188250
  Synthetic Polynucleotide

SEQ ID NO: 188298 - DNA, 103 bp, Artificial Sequence; identical to SEQ ID NO: 188251
  Synthetic Polynucleotide

SEQ ID NO: 188299 - DNA, 103 bp, Artificial Sequence
  Synthetic Polynucleotide
taatacgactcactataggggtgacttattgctaaagccccgcccacactaacagaggagaagtgtgatgggggctttaaacctggcggcagcgcaaaagatg

SEQ ID NO: 188300 - DNA, 103 bp, Artificial Sequence
  Synthetic Polynucleotide
taatacgactcactatagggctgaggaggtgtgacttattgctaaagcccaacagaggagagggcttatgcaataagtcaacctggcggcagcgcaaaagatg

SEQ ID NO: 188301 - DNA, 103 bp, Artificial Sequence; identical to SEQ ID NO: 188082
  Synthetic Polynucleotide

SEQ ID NO: 188302 - DNA, 103 bp, Artificial Sequence
  Synthetic Polynucleotide
taatacgactcactatagggcctctggtgtctgaggaggtgtgacttattaacagaggagaaataagatgcacctcctcaacctggcggcagcgcaaaagatg

SEQ ID NO: 188303 - DNA, 103 bp, Artificial Sequence
  Synthetic Polynucleotide
taatacgactcactatagggctgtgtgtgtcctctggtgtctgaggaggtaacagaggagaacctccatggacaccagaaacctggcggcagcgcaaaagatg

SEQ ID NO: 188304 - DNA, 103 bp, Artificial Sequence
  Synthetic Polynucleotide
taatacgactcactatagggggcttctcccctgtgtgtgtcctctggtgtaacagaggagaacaccaatggacacacacaacctggcggcagcgcaaaagatg

SEQ ID NO: 188305 - DNA, 103 bp, Artificial Sequence; identical to SEQ ID NO: 188258
  Synthetic Polynucleotide

SEQ ID NO: 188306 - DNA, 103 bp, Artificial Sequence; identical to SEQ ID NO: 188259
  Synthetic Polynucleotide

SEQ ID NO: 188307 - DNA, 103 bp, Artificial Sequence; identical to SEQ ID NO: 188260
  Synthetic Polynucleotide

SEQ ID NO: 188308 - DNA, 103 bp, Artificial Sequence
  Synthetic Polynucleotide
taatacgactcactatagggcttatcgcgaaagccccgcccacactccctaacagaggagaagggagatggggcggggcaacctggcggcagcgcaaaagatg

SEQ ID NO: 188309 - DNA, 103 bp, Artificial Sequence
  Synthetic Polynucleotide
taatacgactcactatagggggaggtgtgacttatcgcgaaagccccgccaacagaggagaggcgggatgttcgcgataaacctggcggcagcgcaaaagatg

SEQ ID NO: 188310 - DNA, 103 bp, Artificial Sequence
  Synthetic Polynucleotide
taatacgactcactatagggtggtgtctgaggaggtgtgacttatcgcgaaacagaggagatcgcgaatggtcacacctaacctggcggcagcgcaaaagatg

SEQ ID NO: 188311 - DNA, 103 bp, Artificial Sequence
  Synthetic Polynucleotide
taatacgactcactataggggtgtgtcctctggtgtctgaggaggtgtgaaacagaggagatcacacatgctcagacacaacctggcggcagcgcaaaagatg

SEQ ID NO: 188312 - DNA, 103 bp, Artificial Sequence; identical to SEQ ID NO: 188083
  Synthetic Polynucleotide

SEQ ID NO: 188313 - DNA, 103 bp, Artificial Sequence
  Synthetic Polynucleotide
taatacgactcactatagggtctcccctgtgtgtgtcctctggtgtctgaaacagaggagatcagacatgagaggacacaacctggcggcagcgcaaaagatg

SEQ ID NO: 188314 - DNA, 103 bp, Artificial Sequence
  Synthetic Polynucleotide
taatacgactcactatagggacatagggcttctcccctgtgtgtgtcctcaacagaggagagaggacatgcacaggggaaacctggcggcagcgcaaaagatg

SEQ ID NO: 188315 - DNA, 103 bp, Artificial Sequence; identical to SEQ ID NO: 188268
  Synthetic Polynucleotide

SEQ ID NO: 188316 - DNA, 103 bp, Artificial Sequence; identical to SEQ ID NO: 188269
  Synthetic Polynucleotide

SEQ ID NO: 188317 - DNA, 103 bp, Artificial Sequence
  Synthetic Polynucleotide
taatacgactcactatagggtctctaaagccccgcccacactccctgcagaacagaggagactgcagatggtgtgggcgaacctggcggcagcgcaaaagatg

SEQ ID NO: 188318 - DNA, 103 bp, Artificial Sequence
  Synthetic Polynucleotide
taatacgactcactataggggtttgacttatctctaaagccccgcccacaaacagaggagatgtgggatgggctttagaaacctggcggcagcgcaaaagatg

SEQ ID NO: 188319 - DNA, 103 bp, Artificial Sequence
  Synthetic Polynucleotide
taatacgactcactataggggactgaggaggtttgacttatctctaaagcaacagaggagagctttaatgataagtcaaaacctggcggcagcgcaaaagatg

SEQ ID NO: 188320 - DNA, 103 bp, Artificial Sequence
  Synthetic Polynucleotide
taatacgactcactataggggtcctctggtgactgaggaggtttgacttaaacagaggagataagtcatgcctcctcagaacctggcggcagcgcaaaagatg

SEQ ID NO: 188321 - DNA, 103 bp, Artificial Sequence
  Synthetic Polynucleotide
taatacgactcactatagggccctgtgtgtgtcctctggtgactgaggagaacagaggagactcctcatgcaccagaggaacctggcggcagcgcaaaagatg

SEQ ID NO: 188322 - DNA, 103 bp, Artificial Sequence
  Synthetic Polynucleotide
taatacgactcactatagggagggcttctcccctgtgtgtgtcctctggtaacagaggagaaccagaatgcacacacagaacctggcggcagcgcaaaagatg

SEQ ID NO: 188323 - DNA, 103 bp, Artificial Sequence; identical to SEQ ID NO: 188084
  Synthetic Polynucleotide

SEQ ID NO: 188324 - DNA, 103 bp, Artificial Sequence; identical to SEQ ID NO: 188276
  Synthetic Polynucleotide

SEQ ID NO: 188325 - DNA, 103 bp, Artificial Sequence; identical to SEQ ID NO: 188277
  Synthetic Polynucleotide

SEQ ID NO: 188326 - DNA, 103 bp, Artificial Sequence; identical to SEQ ID NO: 188280
  Synthetic Polynucleotide

SEQ ID NO: 188327 - DNA, 103 bp, Artificial Sequence
  Synthetic Polynucleotide
taatacgactcactataggggacttattgctaaagccccgcccacactccaacagaggagaggagtgatggcggggcttaacctggcggcagcgcaaaagatg

SEQ ID NO: 188328 - DNA, 103 bp, Artificial Sequence
  Synthetic Polynucleotide
taatacgactcactataggggaggaggtgtgacttattgctaaagccccgaacagaggagacggggcatgagcaataagaacctggcggcagcgcaaaagatg

SEQ ID NO: 188329 - DNA, 103 bp, Artificial Sequence
  Synthetic Polynucleotide
taatacgactcactatagggtctggtgtctgaggaggtgtgacttattgcaacagaggagagcaataatgcacacctccaacctggcggcagcgcaaaagatg

SEQ ID NO: 188330 - DNA, 103 bp, Artificial Sequence
  Synthetic Polynucleotide
taatacgactcactataggggtgtgtgtcctctggtgtctgaggaggtgtaacagaggagaacacctatgcagacaccaaacctggcggcagcgcaaaagatg

SEQ ID NO: 188331 - DNA, 103 bp, Artificial Sequence
  Synthetic Polynucleotide
taatacgactcactatagggcttctcccctgtgtgtgtcctctggtgtctaacagaggagaagacacatgaggacacacaacctggcggcagcgcaaaagatg

SEQ ID NO: 188332 - DNA, 103 bp, Artificial Sequence; identical to SEQ ID NO: 188286
  Synthetic Polynucleotide

SEQ ID NO: 188333 - DNA, 103 bp, Artificial Sequence; identical to SEQ ID NO: 188287
  Synthetic Polynucleotide

SEQ ID NO: 188334 - DNA, 103 bp, Artificial Sequence; identical to SEQ ID NO: 188085
  Synthetic Polynucleotide

SEQ ID NO: 188335 - DNA, 103 bp, Artificial Sequence; identical to SEQ ID NO: 188288
  Synthetic Polynucleotide

SEQ ID NO: 188336 - DNA, 103 bp, Artificial Sequence
  Synthetic Polynucleotide
taatacgactcactatagggtattgcgaaagccccgcccacactccctgcaacagaggagagcagggatggtgggcgggaacctggcggcagcgcaaaagatg

SEQ ID NO: 188337 - DNA, 103 bp, Artificial Sequence
  Synthetic Polynucleotide
taatacgactcactatagggaggtgtgacttattgcgaaagccccgcccaaacagaggagatgggcgatgctttcgcaaaacctggcggcagcgcaaaagatg

SEQ ID NO: 188338 - DNA, 103 bp, Artificial Sequence
  Synthetic Polynucleotide
taatacgactcactataggggtgtctgaggaggtgtgacttattgcgaaaaacagaggagatttcgcatgaagtcacacaacctggcggcagcgcaaaagatg

SEQ ID NO: 188339 - DNA, 103 bp, Artificial Sequence
  Synthetic Polynucleotide
taatacgactcactataggggtgtcctctggtgtctgaggaggtgtgactaacagaggagaagtcacatgtcctcagacaacctggcggcagcgcaaaagatg

SEQ ID NO: 188340 - DNA, 103 bp, Artificial Sequence
  Synthetic Polynucleotide
taatacgactcactatagggtcccctgtgtgtgtcctctggtgtctgaggaacagaggagacctcagatgccagaggacaacctggcggcagcgcaaaagatg

SEQ ID NO: 188341 - DNA, 103 bp, Artificial Sequence
  Synthetic Polynucleotide
taatacgactcactataggggtagggcttctcccctgtgtgtgtcctctgaacagaggagacagaggatgcacacagggaacctggcggcagcgcaaaagatg

SEQ ID NO: 188342 - DNA, 103 bp, Artificial Sequence
  Synthetic Polynucleotide
taatacgactcactatagggccctgcagacgtagggcttctcccctgtgtaacagaggagaacacagatgagaagccctaacctggcggcagcgcaaaagatg

SEQ ID NO: 188343 - DNA, 103 bp, Artificial Sequence
  Synthetic Polynucleotide
taatacgactcactatagggcgcccacactccctgcagacgtagggcttcaacagaggagagaagccatgcgtctgcagaacctggcggcagcgcaaaagatg

SEQ ID NO: 188344 - DNA, 103 bp, Artificial Sequence; identical to SEQ ID NO: 188251
  Synthetic Polynucleotide

SEQ ID NO: 188345 - DNA, 103 bp, Artificial Sequence
  Synthetic Polynucleotide
taatacgactcactatagggcttcatcagaatcttctgtgtcatccacctaacagaggagaaggtggatgacacagaagaacctggcggcagcgcaaaagatg

SEQ ID NO: 188346 - DNA, 103 bp, Artificial Sequence
  Synthetic Polynucleotide
taatacgactcactatagggttgacctatcgctaaagccccgcccacactaacagaggagaagtgtgatgggggctttaaacctggcggcagcgcaaaagatg

SEQ ID NO: 188347 - DNA, 103 bp, Artificial Sequence
  Synthetic Polynucleotide
taatacgactcactatagggtagcagaggcttgacctatcgctaaagcccaacagaggagagggcttatgcgataggtcaacctggcggcagcgcaaaagatg

SEQ ID NO: 188348 - DNA, 103 bp, Artificial Sequence
  Synthetic Polynucleotide
taatacgactcactatagggcctctggtgatagcagaggcttgacctatcaacagaggagagataggatgagcctctgcaacctggcggcagcgcaaaagatg

SEQ ID NO: 188349 - DNA, 103 bp, Artificial Sequence
  Synthetic Polynucleotide
taatacgactcactatagggctgtgtgtgtcctctggtgatagcagaggcaacagaggagagcctctatgatcaccagaaacctggcggcagcgcaaaagatg

SEQ ID NO: 188350 - DNA, 103 bp, Artificial Sequence; identical to SEQ ID NO: 188257
  Synthetic Polynucleotide

SEQ ID NO: 188351 - DNA, 103 bp, Artificial Sequence
  Synthetic Polynucleotide
taatacgactcactataggggcagacgtagggcttctcccctgtgtgtgtaacagaggagaacacacatgggggagaagaacctggcggcagcgcaaaagatg

SEQ ID NO: 188352 - DNA, 103 bp, Artificial Sequence
  Synthetic Polynucleotide
taatacgactcactatagggcatcctccctgcagacgtagggcttctcccaacagaggagagggagaatgcctacgtctaacctggcggcagcgcaaaagatg

SEQ ID NO: 188353 - DNA, 103 bp, Artificial Sequence
  Synthetic Polynucleotide
taatacgactcactatagggggggtccattcttcatcagaatcttctgtgaacagaggagacacagaatgttctgatgaaacctggcggcagcgcaaaagatg

SEQ ID NO: 188354 - DNA, 103 bp, Artificial Sequence
  Synthetic Polynucleotide
taatacgactcactatagggttgctgcctaggggtccattcttcatcagaaacagaggagatctgatatggaatggaccaacctggcggcagcgcaaaagatg

SEQ ID NO: 188355 - DNA, 103 bp, Artificial Sequence
  Synthetic Polynucleotide
taatacgactcactataggggaggtttgacttgctgcctaggggtccattaacagaggagaaatggaatgctaggcagcaacctggcggcagcgcaaaagatg

SEQ ID NO: 188356 - DNA, 103 bp, Artificial Sequence
  Synthetic Polynucleotide
taatacgactcactatagggctctctgtgtcttcttctgggctctcctctaacagaggagaagaggaatgcccagaagaaacctggcggcagcgcaaaagatg

SEQ ID NO: 188357 - DNA, 103 bp, Artificial Sequence; identical to SEQ ID NO: 188091
  Synthetic Polynucleotide

SEQ ID NO: 188358 - DNA, 103 bp, Artificial Sequence
  Synthetic Polynucleotide
taatacgactcactatagggcactcttaaggccatccaaggaggtttgacaacagaggagagtcaaaatgccttggatgaacctggcggcagcgcaaaagatg

SEQ ID NO: 188359 - DNA, 103 bp, Artificial Sequence
  Synthetic Polynucleotide
taatacgactcactatagggtacgctgttccactcttaaggccatccaagaacagaggagacttggaatgccttaagagaacctggcggcagcgcaaaagatg

SEQ ID NO: 188360 - DNA, 103 bp, Artificial Sequence
  Synthetic Polynucleotide
taatacgactcactatagggttctggtgtttacgctgttccactcttaagaacagaggagacttaagatgggaacagcgaacctggcggcagcgcaaaagatg

SEQ ID NO: 188361 - DNA, 103 bp, Artificial Sequence
  Synthetic Polynucleotide
taatacgactcactataggggggcattcccttctggtgtttacgctgttcaacagaggagagaacagatgaaacaccagaacctggcggcagcgcaaaagatg

SEQ ID NO: 188362 - DNA, 103 bp, Artificial Sequence; identical to SEQ ID NO: 188096
  Synthetic Polynucleotide

SEQ ID NO: 188363 - DNA, 103 bp, Artificial Sequence
  Synthetic Polynucleotide
taatacgactcactatagggtcattactgaatgacgccttgggcattcccaacagaggagagggaatatgcaaggcgtcaacctggcggcagcgcaaaagatg

SEQ ID NO: 188364 - DNA, 103 bp, Artificial Sequence
  Synthetic Polynucleotide
taatacgactcactatagggcaaactagattcattactgaatgacgccttaacagaggagaaaggcgatgttcagtaataacctggcggcagcgcaaaagatg

SEQ ID NO: 188365 - DNA, 103 bp, Artificial Sequence
  Synthetic Polynucleotide
taatacgactcactatagggacaattctttcaaactagattcattactgaaacagaggagatcagtaatgaatctagttaacctggcggcagcgcaaaagatg

SEQ ID NO: 188366 - DNA, 103 bp, Artificial Sequence
  Synthetic Polynucleotide
taatacgactcactataggggctgttcttgacaattctttcaaactagataacagaggagaatctagatggaaagaattaacctggcggcagcgcaaaagatg

SEQ ID NO: 188367 - DNA, 103 bp, Artificial Sequence
  Synthetic Polynucleotide
taatacgactcactatagggccgctctgttctctctgtgtcttcttctggaacagaggagaccagaaatggacacagagaacctggcggcagcgcaaaagatg

SEQ ID NO: 188368 - DNA, 103 bp, Artificial Sequence
  Synthetic Polynucleotide
taatacgactcactatagggcagtaaatttgctgttcttgacaattctttaacagaggagaaaagaaatgtcaagaacaaacctggcggcagcgcaaaagatg

SEQ ID NO: 188369 - DNA, 103 bp, Artificial Sequence
  Synthetic Polynucleotide
taatacgactcactatagggcacttgcattcagtaaatttgctgttcttgaacagaggagacaagaaatgcaaatttacaacctggcggcagcgcaaaagatg

SEQ ID NO: 188370 - DNA, 103 bp, Artificial Sequence
  Synthetic Polynucleotide
taatacgactcactatagggtgctctgagccacttgcattcagtaaatttaacagaggagaaaatttatggaatgcaagaacctggcggcagcgcaaaagatg

SEQ ID NO: 188371 - DNA, 103 bp, Artificial Sequence
  Synthetic Polynucleotide
taatacgactcactatagggtttctgagcctgctctgagccacttgcattaacagaggagaaatgcaatgggctcagagaacctggcggcagcgcaaaagatg

SEQ ID NO: 188372 - DNA, 103 bp, Artificial Sequence
  Synthetic Polynucleotide
taatacgactcactataggggggacactggtttctgagcctgctctgagcaacagaggagagctcagatgaggctcagaaacctggcggcagcgcaaaagatg

SEQ ID NO: 188373 - DNA, 103 bp, Artificial Sequence
  Synthetic Polynucleotide
taatacgactcactatagggtctccagaaggggacactggtttctgagccaacagaggagaggctcaatgaccagtgtcaacctggcggcagcgcaaaagatg

SEQ ID NO: 188374 - DNA, 103 bp, Artificial Sequence
  Synthetic Polynucleotide
taatacgactcactatagggggtacttgcttctccagaaggggacactggaacagaggagaccagtgatgccttctggaaacctggcggcagcgcaaaagatg

SEQ ID NO: 188375 - DNA, 103 bp, Artificial Sequence
  Synthetic Polynucleotide
taatacgactcactataggggctgtccagaggtacttgcttctccagaagaacagaggagacttctgatgaagcaagtaaacctggcggcagcgcaaaagatg

SEQ ID NO: 188376 - DNA, 103 bp, Artificial Sequence
  Synthetic Polynucleotide
taatacgactcactatagggagtcttgagtgctgtccagaggtacttgctaacagaggagaagcaagatgctctggacaaacctggcggcagcgcaaaagatg

SEQ ID NO: 188377 - DNA, 103 bp, Artificial Sequence
  Synthetic Polynucleotide
taatacgactcactatagggttccagttttagtcttgagtgctgtccagaaacagaggagatctggaatgcactcaagaaacctggcggcagcgcaaaagatg

SEQ ID NO: 188378 - DNA, 103 bp, Artificial Sequence; identical to SEQ ID NO: 188112
  Synthetic Polynucleotide

SEQ ID NO: 188379 - DNA, 103 bp, Artificial Sequence
  Synthetic Polynucleotide
taatacgactcactatagggtcttcctgagttccagttttagtcttgagtaacagaggagaactcaaatgtaaaactggaacctggcggcagcgcaaaagatg

SEQ ID NO: 188380 - DNA, 103 bp, Artificial Sequence
  Synthetic Polynucleotide
taatacgactcactatagggtcagtctccttcttcctgagttccagttttaacagaggagaaaaactatgactcaggaaaacctggcggcagcgcaaaagatg

SEQ ID NO: 188381 - DNA, 103 bp, Artificial Sequence
  Synthetic Polynucleotide
taatacgactcactatagggcatctttctttcagtctccttcttcctgagaacagaggagactcaggatgaaggagactaacctggcggcagcgcaaaagatg

SEQ ID NO: 188382 - DNA, 103 bp, Artificial Sequence
  Synthetic Polynucleotide
taatacgactcactataggggcaggctatacatctttctttcagtctcctaacagaggagaaggagaatgaaagaaagaaacctggcggcagcgcaaaagatg

SEQ ID NO: 188383 - DNA, 103 bp, Artificial Sequence
  Synthetic Polynucleotide
taatacgactcactatagggtttctttctcgcaggctatacatctttcttaacagaggagaaagaaaatggtatagcctaacctggcggcagcgcaaaagatg

SEQ ID NO: 188384 - DNA, 103 bp, Artificial Sequence; identical to SEQ ID NO: 188118
  Synthetic Polynucleotide

SEQ ID NO: 188385 - DNA, 103 bp, Artificial Sequence
  Synthetic Polynucleotide
taatacgactcactatagggcctctttgtatgcatgaccctttctttctcaacagaggagagagaaaatgagggtcatgaacctggcggcagcgcaaaagatg

SEQ ID NO: 188386 - DNA, 103 bp, Artificial Sequence
  Synthetic Polynucleotide
taatacgactcactatagggggctcgctgacctctttgtatgcatgacccaacagaggagagggtcaatgatacaaagaaacctggcggcagcgcaaaagatg

SEQ ID NO: 188387 - DNA, 103 bp, Artificial Sequence
  Synthetic Polynucleotide
taatacgactcactatagggatcatcctgcggctcgctgacctctttgtaaacagaggagatacaaaatggtcagcgagaacctggcggcagcgcaaaagatg

SEQ ID NO: 188388 - DNA, 103 bp, Artificial Sequence
  Synthetic Polynucleotide
taatacgactcactatagggagaggtaatcatcatcctgcggctcgctgaaacagaggagatcagcgatgcgcaggatgaacctggcggcagcgcaaaagatg

SEQ ID NO: 188389 - DNA, 103 bp, Artificial Sequence; identical to SEQ ID NO: 188123
  Synthetic Polynucleotide

SEQ ID NO: 188390 - DNA, 103 bp, Artificial Sequence
  Synthetic Polynucleotide
taatacgactcactatagggatctcacaatagaggtaatcatcatcctgcaacagaggagagcaggaatgtgattacctaacctggcggcagcgcaaaagatg

SEQ ID NO: 188391 - DNA, 103 bp, Artificial Sequence
  Synthetic Polynucleotide
taatacgactcactataggggttctgacacatctcacaatagaggtaatcaacagaggagagattacatgtattgtgagaacctggcggcagcgcaaaagatg

SEQ ID NO: 188392 - DNA, 103 bp, Artificial Sequence; identical to SEQ ID NO: 188126
  Synthetic Polynucleotide

SEQ ID NO: 188393 - DNA, 103 bp, Artificial Sequence; identical to SEQ ID NO: 188127
  Synthetic Polynucleotide

SEQ ID NO: 188394 - DNA, 103 bp, Artificial Sequence
  Synthetic Polynucleotide
taatacgactcactatagggcccatgggcagcacagctgtcaatgaagaaaacagaggagattcttcatggacagctgtaacctggcggcagcgcaaaagatg

SEQ ID NO: 188395 - DNA, 103 bp, Artificial Sequence
  Synthetic Polynucleotide
taatacgactcactatagggatgtagggggcccatgggcagcacagctgtaacagaggagaacagctatgctgcccatgaacctggcggcagcgcaaaagatg

SEQ ID NO: 188396 - DNA, 103 bp, Artificial Sequence
  Synthetic Polynucleotide
taatacgactcactatagggtcctttacaaatgtagggggcccatgggcaaacagaggagatgcccaatggccccctacaacctggcggcagcgcaaaagatg

SEQ ID NO: 188397 - DNA, 103 bp, Artificial Sequence; identical to SEQ ID NO: 188131
  Synthetic Polynucleotide

SEQ ID NO: 188398 - DNA, 103 bp, Artificial Sequence; identical to SEQ ID NO: 188132
  Synthetic Polynucleotide

SEQ ID NO: 188399 - DNA, 103 bp, Artificial Sequence
  Synthetic Polynucleotide
taatacgactcactatagggcggttggggtgccccttgtccactgcactgaacagaggagacagtgcatgggacaagggaacctggcggcagcgcaaaagatg

SEQ ID NO: 188400 - DNA, 103 bp, Artificial Sequence; identical to SEQ ID NO: 188134
  Synthetic Polynucleotide

SEQ ID NO: 188401 - DNA, 103 bp, Artificial Sequence
  Synthetic Polynucleotide
taatacgactcactataggggagggctgaacggttggggtgccccttgtcaacagaggagagacaagatgcaccccaacaacctggcggcagcgcaaaagatg

SEQ ID NO: 188402 - DNA, 103 bp, Artificial Sequence
  Synthetic Polynucleotide
taatacgactcactatagggggggcagactgagggctgaacggttggggtaacagaggagaaccccaatggttcagcccaacctggcggcagcgcaaaagatg

SEQ ID NO: 188403 - DNA, 103 bp, Artificial Sequence
  Synthetic Polynucleotide
taatacgactcactatagggctcagccctgggggcagactgagggctgaaaacagaggagattcagcatgcagtctgccaacctggcggcagcgcaaaagatg

SEQ ID NO: 188404 - DNA, 103 bp, Artificial Sequence
  Synthetic Polynucleotide
taatacgactcactatagggtggcccaattctcagccctgggggcagactaacagaggagaagtctgatgccagggctgaacctggcggcagcgcaaaagatg

SEQ ID NO: 188405 - DNA, 103 bp, Artificial Sequence
  Synthetic Polynucleotide
taatacgactcactatagggggatgcctgatggcccaattctcagccctgaacagaggagacagggcatggaattgggcaacctggcggcagcgcaaaagatg

SEQ ID NO: 188406 - DNA, 103 bp, Artificial Sequence; identical to SEQ ID NO: 188140
  Synthetic Polynucleotide

SEQ ID NO: 188407 - DNA, 103 bp, Artificial Sequence; identical to SEQ ID NO: 188141
  Synthetic Polynucleotide

SEQ ID NO: 188408 - DNA, 103 bp, Artificial Sequence
  Synthetic Polynucleotide
taatacgactcactatagggcctcattccatactccaagcccagcctgagaacagaggagactcaggatgggcttggagaacctggcggcagcgcaaaagatg

SEQ ID NO: 188409 - DNA, 103 bp, Artificial Sequence
  Synthetic Polynucleotide
taatacgactcactatagggagatcagatgcctcattccatactccaagcaacagaggagagcttggatgatggaatgaaacctggcggcagcgcaaaagatg

SEQ ID NO: 188410 - DNA, 103 bp, Artificial Sequence
  Synthetic Polynucleotide
taatacgactcactatagggacccagcggcagatcagatgcctcattccaaacagaggagatggaatatggcatctgataacctggcggcagcgcaaaagatg

SEQ ID NO: 188411 - DNA, 103 bp, Artificial Sequence; identical to SEQ ID NO: 188145
  Synthetic Polynucleotide

SEQ ID NO: 188412 - DNA, 103 bp, Artificial Sequence
  Synthetic Polynucleotide
taatacgactcactatagggcaaagtgcagacccagcggcagatcagatgaacagaggagacatctgatgtgccgctggaacctggcggcagcgcaaaagatg

SEQ ID NO: 188413 - DNA, 103 bp, Artificial Sequence
  Synthetic Polynucleotide
taatacgactcactatagggtcataagggccaaagtgcagacccagcggcaacagaggagagccgctatgtctgcacttaacctggcggcagcgcaaaagatg

SEQ ID NO: 188414 - DNA, 103 bp, Artificial Sequence
  Synthetic Polynucleotide
taatacgactcactatagggaattcggccctcataagggccaaagtgcagaacagaggagactgcacatgggcccttataacctggcggcagcgcaaaagatg

SEQ ID NO: 188415 - DNA, 103 bp, Artificial Sequence
  Synthetic Polynucleotide
taatacgactcactatagggcgtcttctgtaattcggccctcataagggcaacagaggagagcccttatgagggccgaaaacctggcggcagcgcaaaagatg

SEQ ID NO: 188416 - DNA, 103 bp, Artificial Sequence; identical to SEQ ID NO: 188150
  Synthetic Polynucleotide

SEQ ID NO: 188417 - DNA, 103 bp, Artificial Sequence
  Synthetic Polynucleotide
taatacgactcactatagggtccattgttggctgcctcttcgtcttctgtaacagaggagaacagaaatggaagaggcaaacctggcggcagcgcaaaagatg

SEQ ID NO: 188418 - DNA, 103 bp, Artificial Sequence
  Synthetic Polynucleotide
taatacgactcactataggggccaggagtatccattgttggctgcctcttaacagaggagaaagaggatgccaacaatgaacctggcggcagcgcaaaagatg

SEQ ID NO: 188419 - DNA, 103 bp, Artificial Sequence
  Synthetic Polynucleotide
taatacgactcactatagggttggtgatcagccaggagtatccattgttgaacagaggagacaacaaatgatactcctgaacctggcggcagcgcaaaagatg

SEQ ID NO: 188420 - DNA, 103 bp, Artificial Sequence
  Synthetic Polynucleotide
taatacgactcactataggggtttctccccttggtgatcagccaggagtaaacagaggagatactccatgctgatcaccaacctggcggcagcgcaaaagatg

SEQ ID NO: 188421 - DNA, 103 bp, Artificial Sequence
  Synthetic Polynucleotide
taatacgactcactatagggactcatagcagtttctccccttggtgatcaaacagaggagatgatcaatgaggggagaaaacctggcggcagcgcaaaagatg

SEQ ID NO: 188422 - DNA, 103 bp, Artificial Sequence; identical to SEQ ID NO: 188156
  Synthetic Polynucleotide

SEQ ID NO: 188423 - DNA, 103 bp, Artificial Sequence; identical to SEQ ID NO: 188157
  Synthetic Polynucleotide

SEQ ID NO: 188424 - DNA, 103 bp, Artificial Sequence; identical to SEQ ID NO: 188158
  Synthetic Polynucleotide

SEQ ID NO: 188425 - DNA, 103 bp, Artificial Sequence
  Synthetic Polynucleotide
taatacgactcactatagggtggcccaggatttatcttttccatccacataacagaggagaatgtggatggaaaagataaacctggcggcagcgcaaaagatg

SEQ ID NO: 188426 - DNA, 103 bp, Artificial Sequence
  Synthetic Polynucleotide
taatacgactcactatagggctcatccagttggcccaggatttatcttttaacagaggagaaaaagaatgatcctgggcaacctggcggcagcgcaaaagatg

SEQ ID NO: 188427 - DNA, 103 bp, Artificial Sequence
  Synthetic Polynucleotide
taatacgactcactataggggttcacatacctcatccagttggcccaggaaacagaggagatcctggatgaactggatgaacctggcggcagcgcaaaagatg

SEQ ID NO: 188428 - DNA, 103 bp, Artificial Sequence; identical to SEQ ID NO: 188162
  Synthetic Polynucleotide

SEQ ID NO: 188429 - DNA, 103 bp, Artificial Sequence; identical to SEQ ID NO: 188163
  Synthetic Polynucleotide

SEQ ID NO: 188430 - DNA, 103 bp, Artificial Sequence; identical to SEQ ID NO: 188164
  Synthetic Polynucleotide

SEQ ID NO: 188431 - DNA, 103 bp, Artificial Sequence; identical to SEQ ID NO: 188165
  Synthetic Polynucleotide

SEQ ID NO: 188432 - DNA, 103 bp, Artificial Sequence; identical to SEQ ID NO: 188166
  Synthetic Polynucleotide

SEQ ID NO: 188433 - DNA, 103 bp, Artificial Sequence
  Synthetic Polynucleotide
taatacgactcactatagggtctcagggcgcacacgccagctagtcccataacagaggagaatgggaatggctggcgtgaacctggcggcagcgcaaaagatg

SEQ ID NO: 188434 - DNA, 103 bp, Artificial Sequence
  Synthetic Polynucleotide
taatacgactcactatagggagacgcccactctccttcactgtaccgtctaacagaggagaagacggatgagtgaaggaaacctggcggcagcgcaaaagatg

SEQ ID NO: 188435 - DNA, 103 bp, Artificial Sequence
  Synthetic Polynucleotide
taatacgactcactatagggggaccccgccagacgcccactctccttcacaacagaggagagtgaagatgagtgggcgtaacctggcggcagcgcaaaagatg

SEQ ID NO: 188436 - DNA, 103 bp, Artificial Sequence
  Synthetic Polynucleotide
taatacgactcactatagggctgaaactgcggaccccgccagacgcccacaacagaggagagtgggcatgtggcggggtaacctggcggcagcgcaaaagatg

SEQ ID NO: 188437 - DNA, 103 bp, Artificial Sequence
  Synthetic Polynucleotide
taatacgactcactatagggagcggctctgctgaaactgcggaccccgccaacagaggagaggcgggatgcgcagtttcaacctggcggcagcgcaaaagatg

SEQ ID NO: 188438 - DNA, 103 bp, Artificial Sequence
  Synthetic Polynucleotide
taatacgactcactatagggccatggctgcagcggctctgctgaaactgcaacagaggagagcagttatggcagagccgaacctggcggcagcgcaaaagatg

SEQ ID NO: 188439 - DNA, 103 bp, Artificial Sequence
  Synthetic Polynucleotide
taatacgactcactatagggttgattggggccatggctgcagcggctctgaacagaggagacagagcatgtgcagccataacctggcggcagcgcaaaagatg

SEQ ID NO: 188440 - DNA, 103 bp, Artificial Sequence
  Synthetic Polynucleotide
taatacgactcactatagggatctcccaccttgattggggccatggctgcaacagaggagagcagccatggccccaatcaacctggcggcagcgcaaaagatg

SEQ ID NO: 188441 - DNA, 103 bp, Artificial Sequence
  Synthetic Polynucleotide
taatacgactcactatagggctgggatggcatctcccaccttgattggggaacagaggagaccccaaatgaggtgggagaacctggcggcagcgcaaaagatg

SEQ ID NO: 188442 - DNA, 103 bp, Artificial Sequence
  Synthetic Polynucleotide
taatacgactcactatagggacctccactgctgggatggcatctcccaccaacagaggagaggtgggatgtgccatcccaacctggcggcagcgcaaaagatg

SEQ ID NO: 188443 - DNA, 103 bp, Artificial Sequence
  Synthetic Polynucleotide
taatacgactcactatagggcccttcaaacacctccactgctgggatggcaacagaggagagccatcatggcagtggagaacctggcggcagcgcaaaagatg

SEQ ID NO: 188444 - DNA, 103 bp, Artificial Sequence
  Synthetic Polynucleotide
taatacgactcactatagggccgctgagcgtctcagggcgcacacgccagaacagaggagactggcgatggcgccctgaaacctggcggcagcgcaaaagatg

SEQ ID NO: 188445 - DNA, 103 bp, Artificial Sequence
  Synthetic Polynucleotide
taatacgactcactatagggtccctggctccccttcaaacacctccactgaacagaggagacagtggatgtgtttgaagaacctggcggcagcgcaaaagatg

SEQ ID NO: 188446 - DNA, 103 bp, Artificial Sequence
  Synthetic Polynucleotide
taatacgactcactatagggttcaccttgttccctggctccccttcaaacaacagaggagagtttgaatgggagccaggaacctggcggcagcgcaaaagatg

SEQ ID NO: 188447 - DNA, 103 bp, Artificial Sequence
  Synthetic Polynucleotide
taatacgactcactatagggctctgccaggttcaccttgttccctggctcaacagaggagagagccaatgaacaaggtgaacctggcggcagcgcaaaagatg

SEQ ID NO: 188448 - DNA, 103 bp, Artificial Sequence
  Synthetic Polynucleotide
taatacgactcactatagggccttgaacagctctgccaggttcaccttgtaacagaggagaacaaggatgacctggcagaacctggcggcagcgcaaaagatg

SEQ ID NO: 188449 - DNA, 103 bp, Artificial Sequence
  Synthetic Polynucleotide
taatacgactcactatagggcccttcttgcccttgaacagctctgccaggaacagaggagacctggcatggctgttcaaaacctggcggcagcgcaaaagatg

SEQ ID NO: 188450 - DNA, 103 bp, Artificial Sequence
  Synthetic Polynucleotide
taatacgactcactatagggaaacagcacacccttcttgcccttgaacagaacagaggagactgttcatgggcaagaagaacctggcggcagcgcaaaagatg

SEQ ID NO: 188451 - DNA, 103 bp, Artificial Sequence
  Synthetic Polynucleotide
taatacgactcactatagggcaggaactccaaacagcacacccttcttgcaacagaggagagcaagaatggtgtgctgtaacctggcggcagcgcaaaagatg

SEQ ID NO: 188452 - DNA, 103 bp, Artificial Sequence
  Synthetic Polynucleotide
taatacgactcactataggggtgaaggccccaggaactccaaacagcacaaacagaggagatgtgctatgtggagttccaacctggcggcagcgcaaaagatg

SEQ ID NO: 188453 - DNA, 103 bp, Artificial Sequence
  Synthetic Polynucleotide
taatacgactcactatagggacatccaggggtgaaggccccaggaactccaacagaggagaggagttatgggggccttcaacctggcggcagcgcaaaagatg

SEQ ID NO: 188454 - DNA, 103 bp, Artificial Sequence
  Synthetic Polynucleotide
taatacgactcactataggggtgtcttggaacatccaggggtgaaggcccaacagaggagagggcctatgcccctggataacctggcggcagcgcaaaagatg

SEQ ID NO: 188455 - DNA, 103 bp, Artificial Sequence
  Synthetic Polynucleotide
taatacgactcactatagggagtatatagcccgctgagcgtctcagggcgaacagaggagacgccctatgacgctcagcaacctggcggcagcgcaaaagatg

SEQ ID NO: 188456 - DNA, 103 bp, Artificial Sequence
  Synthetic Polynucleotide
taatacgactcactatagggcctggcaggtgtgtcttggaacatccagggaacagaggagaccctggatgttccaagacaacctggcggcagcgcaaaagatg

SEQ ID NO: 188457 - DNA, 103 bp, Artificial Sequence
  Synthetic Polynucleotide
taatacgactcactatagggctccacaaaccctggcaggtgtgtcttggaaacagaggagatccaagatgcacctgccaaacctggcggcagcgcaaaagatg

SEQ ID NO: 188458 - DNA, 103 bp, Artificial Sequence
  Synthetic Polynucleotide
taatacgactcactatagggcctcagcctgctccacaaaccctggcaggtaacagaggagaacctgcatgggtttgtggaacctggcggcagcgcaaaagatg

SEQ ID NO: 188459 - DNA, 103 bp, Artificial Sequence
  Synthetic Polynucleotide
taatacgactcactataggggccttcagagcctcagcctgctccacaaacaacagaggagagtttgtatggcaggctgaaacctggcggcagcgcaaaagatg

SEQ ID NO: 188460 - DNA, 103 bp, Artificial Sequence
  Synthetic Polynucleotide
taatacgactcactataggggactcccttggccttcagagcctcagcctgaacagaggagacaggctatggctctgaagaacctggcggcagcgcaaaagatg

SEQ ID NO: 188461 - DNA, 103 bp, Artificial Sequence
  Synthetic Polynucleotide
taatacgactcactatagggccaccacctggactcccttggccttcagagaacagaggagactctgaatgccaagggagaacctggcggcagcgcaaaagatg

SEQ ID NO: 188462 - DNA, 103 bp, Artificial Sequence
  Synthetic Polynucleotide
taatacgactcactatagggctcagacaggccaccacctggactcccttgaacagaggagacaagggatgccaggtggtaacctggcggcagcgcaaaagatg

SEQ ID NO: 188463 - DNA, 103 bp, Artificial Sequence
  Synthetic Polynucleotide
taatacgactcactatagggatcattaacactcagacaggccaccacctgaacagaggagacaggtgatggcctgtctgaacctggcggcagcgcaaaagatg

SEQ ID NO: 188464 - DNA, 103 bp, Artificial Sequence
  Synthetic Polynucleotide
taatacgactcactatagggtcacaaaggcatcattaacactcagacaggaacagaggagacctgtcatggtgttaatgaacctggcggcagcgcaaaagatg

SEQ ID NO: 188465 - DNA, 103 bp, Artificial Sequence
  Synthetic Polynucleotide
taatacgactcactatagggcactcgccagtcacaaaggcatcattaacaaacagaggagatgttaaatgtgcctttgtaacctggcggcagcgcaaaagatg

SEQ ID NO: 188466 - DNA, 103 bp, Artificial Sequence
  Synthetic Polynucleotide
taatacgactcactatagggcccaccgacgagtatatagcccgctgagcgaacagaggagacgctcaatgggctatataaacctggcggcagcgcaaaagatg

SEQ ID NO: 188467 - DNA, 103 bp, Artificial Sequence
  Synthetic Polynucleotide
taatacgactcactatagggggctcggccccactcgccagtcacaaaggcaacagaggagagcctttatgactggcgagaacctggcggcagcgcaaaagatg

SEQ ID NO: 188468 - DNA, 103 bp, Artificial Sequence
  Synthetic Polynucleotide
taatacgactcactatagggccgccttgtgggctcggccccactcgccagaacagaggagactggcgatgggggccgagaacctggcggcagcgcaaaagatg

SEQ ID NO: 188469 - DNA, 103 bp, Artificial Sequence
  Synthetic Polynucleotide
taatacgactcactatagggaccttgccttccgccttgtgggctcggcccaacagaggagagggccgatgccacaaggcaacctggcggcagcgcaaaagatg

SEQ ID NO: 188470 - DNA, 103 bp, Artificial Sequence
  Synthetic Polynucleotide
taatacgactcactatagggcaggagccgaaccttgccttccgccttgtgaacagaggagacacaagatggaaggcaagaacctggcggcagcgcaaaagatg

SEQ ID NO: 188471 - DNA, 103 bp, Artificial Sequence
  Synthetic Polynucleotide
taatacgactcactatagggtgggatcagccaggagccgaaccttgccttaacagaggagaaaggcaatgttcggctccaacctggcggcagcgcaaaagatg

SEQ ID NO: 188472 - DNA, 103 bp, Artificial Sequence
  Synthetic Polynucleotide
taatacgactcactatagggaaggccccagtgggatcagccaggagccgaaacagaggagatcggctatgggctgatccaacctggcggcagcgcaaaagatg

SEQ ID NO: 188473 - DNA, 103 bp, Artificial Sequence
  Synthetic Polynucleotide
taatacgactcactatagggctccttcccaaaggccccagtgggatcagcaacagaggagagctgatatgactggggccaacctggcggcagcgcaaaagatg

SEQ ID NO: 188474 - DNA, 103 bp, Artificial Sequence
  Synthetic Polynucleotide
taatacgactcactatagggataagtctgtctccttcccaaaggccccagaacagaggagactggggatgttgggaaggaacctggcggcagcgcaaaagatg

SEQ ID NO: 188475 - DNA, 103 bp, Artificial Sequence
  Synthetic Polynucleotide
taatacgactcactatagggtcatctagtaataagtctgtctccttcccaaacagaggagatgggaaatggacagacttaacctggcggcagcgcaaaagatg

SEQ ID NO: 188476 - DNA, 103 bp, Artificial Sequence
  Synthetic Polynucleotide
taatacgactcactatagggcaccagcgaatcatctagtaataagtctgtaacagaggagaacagacatgttactagataacctggcggcagcgcaaaagatg

SEQ ID NO: 188477 - DNA, 103 bp, Artificial Sequence
  Synthetic Polynucleotide
taatacgactcactataggggaccgccggccccaccgacgagtatatagcaacagaggagagctataatgtcgtcggtgaacctggcggcagcgcaaaagatg

SEQ ID NO: 188478 - DNA, 103 bp, Artificial Sequence
  Synthetic Polynucleotide
taatacgactcactatagggcaaagatggacaccagcgaatcatctagtaaacagaggagatactagatgattcgctggaacctggcggcagcgcaaaagatg

SEQ ID NO: 188479 - DNA, 103 bp, Artificial Sequence
  Synthetic Polynucleotide
taatacgactcactatagggcgtcgattcccaaagatggacaccagcgaaaacagaggagattcgctatggtccatcttaacctggcggcagcgcaaaagatg

SEQ ID NO: 188480 - DNA, 103 bp, Artificial Sequence
  Synthetic Polynucleotide
taatacgactcactatagggcctcttgagacgtcgattcccaaagatggaaacagaggagatccatcatggggaatcgaaacctggcggcagcgcaaaagatg

SEQ ID NO: 188481 - DNA, 103 bp, Artificial Sequence
  Synthetic Polynucleotide
taatacgactcactatagggccatggagaacctcttgagacgtcgattccaacagaggagaggaatcatggtctcaagaaacctggcggcagcgcaaaagatg

SEQ ID NO: 188482 - DNA, 103 bp, Artificial Sequence
  Synthetic Polynucleotide
taatacgactcactatagggtcctgtaccaccatggagaacctcttgagaaacagaggagatctcaaatggttctccataacctggcggcagcgcaaaagatg

SEQ ID NO: 188483 - DNA, 103 bp, Artificial Sequence
  Synthetic Polynucleotide
taatacgactcactatagggcactatgccatcctgtaccaccatggagaaaacagaggagattctccatggtggtacagaacctggcggcagcgcaaaagatg

SEQ ID NO: 188484 - DNA, 103 bp, Artificial Sequence
  Synthetic Polynucleotide
taatacgactcactatagggtcagggccttcactatgccatcctgtaccaaacagaggagatggtacatgatggcatagaacctggcggcagcgcaaaagatg

SEQ ID NO: 188485 - DNA, 103 bp, Artificial Sequence
  Synthetic Polynucleotide
taatacgactcactatagggggttccacattcagggccttcactatgccaaacagaggagatggcatatggaaggccctaacctggcggcagcgcaaaagatg

SEQ ID NO: 188486 - DNA, 103 bp, Artificial Sequence
  Synthetic Polynucleotide
taatacgactcactatagggtgtgccatctggttccacattcagggccttaacagaggagaaaggccatgaatgtggaaaacctggcggcagcgcaaaagatg

SEQ ID NO: 188487 - DNA, 103 bp, Artificial Sequence
  Synthetic Polynucleotide
taatacgactcactatagggaggtgaggcctgtgccatctggttccacataacagaggagaatgtggatgcagatggcaaacctggcggcagcgcaaaagatg

SEQ ID NO: 188488 - DNA, 103 bp, Artificial Sequence
  Synthetic Polynucleotide
taatacgactcactataggggccgcagactgaccgccggccccaccgacgaacagaggagacgtcggatgggccggcggaacctggcggcagcgcaaaagatg

SEQ ID NO: 188489 - DNA, 103 bp, Artificial Sequence
  Synthetic Polynucleotide
taatacgactcactataggggccaggctgcaggtgaggcctgtgccatctaacagaggagaagatggatgaggcctcacaacctggcggcagcgcaaaagatg

SEQ ID NO: 188490 - DNA, 103 bp, Artificial Sequence
  Synthetic Polynucleotide
taatacgactcactataggggatattgggtgccaggctgcaggtgaggccaacagaggagaggcctcatgtgcagcctgaacctggcggcagcgcaaaagatg

SEQ ID NO: 188491 - DNA, 103 bp, Artificial Sequence
  Synthetic Polynucleotide
taatacgactcactataggggctgtgagatgatattgggtgccaggctgcaacagaggagagcagccatgcacccaataaacctggcggcagcgcaaaagatg

SEQ ID NO: 188492 - DNA, 103 bp, Artificial Sequence
  Synthetic Polynucleotide
taatacgactcactatagggtgctgccgctgccgcagactgaccgccggcaacagaggagagccggcatgcagtctgcgaacctggcggcagcgcaaaagatg

SEQ ID NO: 188493 - DNA, 103 bp, Artificial Sequence
  Synthetic Polynucleotide
taatacgactcactatagggtgtaccgtcttgctgccgctgccgcagactaacagaggagaagtctgatgcagcggcagaacctggcggcagcgcaaaagatg

SEQ ID NO: 188494 - DNA, 103 bp, Artificial Sequence
  Synthetic Polynucleotide
taatacgactcactatagggtctccttcactgtaccgtcttgctgccgctaacagaggagaagcggcatgaagacggtaaacctggcggcagcgcaaaagatg

SEQ ID NO: 188495 - DNA, 103 bp, Artificial Sequence
  Synthetic Polynucleotide
taatacgactcactataggggcagtgtggggattggcattcaccactcataacagaggagaatgagtatggaatgccaaaacctggcggcagcgcaaaagatg

SEQ ID NO: 188496 - DNA, 103 bp, Artificial Sequence
  Synthetic Polynucleotide
taatacgactcactatagggtgttgcgatcaggtgcaaagctactgatgtaacagaggagaacatcaatggctttgcacaacctggcggcagcgcaaaagatg

SEQ ID NO: 188497 - DNA, 103 bp, Artificial Sequence
  Synthetic Polynucleotide
taatacgactcactatagggtccgactatttgttgcgatcaggtgcaaagaacagaggagactttgcatgtgatcgcaaaacctggcggcagcgcaaaagatg

SEQ ID NO: 188498 - DNA, 103 bp, Artificial Sequence
  Synthetic Polynucleotide
taatacgactcactatagggcaagtgatgttccgactatttgttgcgatcaacagaggagagatcgcatgaaatagtcgaacctggcggcagcgcaaaagatg

SEQ ID NO: 188499 - DNA, 103 bp, Artificial Sequence
  Synthetic Polynucleotide
taatacgactcactataggggcacgtaatgcaagtgatgttccgactattaacagaggagaaatagtatgaacatcactaacctggcggcagcgcaaaagatg

SEQ ID NO: 188500 - DNA, 103 bp, Artificial Sequence
  Synthetic Polynucleotide
taatacgactcactatagggtgacgtctgtgcacgtaatgcaagtgatgtaacagaggagaacatcaatggcattacgtaacctggcggcagcgcaaaagatg

SEQ ID NO: 188501 - DNA, 103 bp, Artificial Sequence
  Synthetic Polynucleotide
taatacgactcactatagggacggggctcctgacgtctgtgcacgtaatgaacagaggagacattacatgcacagacgtaacctggcggcagcgcaaaagatg

SEQ ID NO: 188502 - DNA, 103 bp, Artificial Sequence
  Synthetic Polynucleotide
taatacgactcactataggggaaaaccaggacggggctcctgacgtctgtaacagaggagaacagacatgaggagccccaacctggcggcagcgcaaaagatg

SEQ ID NO: 188503 - DNA, 103 bp, Artificial Sequence
  Synthetic Polynucleotide
taatacgactcactatagggagttgcactggaaaaccaggacggggctccaacagaggagaggagccatgtcctggtttaacctggcggcagcgcaaaagatg

SEQ ID NO: 188504 - DNA, 103 bp, Artificial Sequence
  Synthetic Polynucleotide
taatacgactcactatagggacgtggcgggagttgcactggaaaaccaggaacagaggagacctggtatgccagtgcaaaacctggcggcagcgcaaaagatg

SEQ ID NO: 188505 - DNA, 103 bp, Artificial Sequence
  Synthetic Polynucleotide
taatacgactcactatagggtaagcaaatcacgtggcgggagttgcactgaacagaggagacagtgcatgtcccgccacaacctggcggcagcgcaaaagatg

SEQ ID NO: 188506 - DNA, 103 bp, Artificial Sequence
  Synthetic Polynucleotide
taatacgactcactatagggtagtcccagggcagtgtggggattggcattaacagaggagaaatgccatgccccacactaacctggcggcagcgcaaaagatg

SEQ ID NO: 188507 - DNA, 103 bp, Artificial Sequence
  Synthetic Polynucleotide
taatacgactcactatagggggaaacagtctaagcaaatcacgtggcgggaacagaggagacccgccatgtgatttgctaacctggcggcagcgcaaaagatg

SEQ ID NO: 188508 - DNA, 103 bp, Artificial Sequence
  Synthetic Polynucleotide
taatacgactcactatagggcagtataagtggaaacagtctaagcaaatcaacagaggagagatttgatgagactgtttaacctggcggcagcgcaaaagatg

SEQ ID NO: 188509 - DNA, 103 bp, Artificial Sequence
  Synthetic Polynucleotide
taatacgactcactatagggtcttgtcacacagtataagtggaaacagtcaacagaggagagactgtatgcacttatacaacctggcggcagcgcaaaagatg

SEQ ID NO: 188510 - DNA, 103 bp, Artificial Sequence
  Synthetic Polynucleotide
taatacgactcactataggggatcattgagtcttgtcacacagtataagtaacagaggagaacttatatggtgtgacaaaacctggcggcagcgcaaaagatg

SEQ ID NO: 188511 - DNA, 103 bp, Artificial Sequence
  Synthetic Polynucleotide
taatacgactcactatagggacaaactgccgatcattgagtcttgtcacaaacagaggagatgtgacatgactcaatgaaacctggcggcagcgcaaaagatg

SEQ ID NO: 188512 - DNA, 103 bp, Artificial Sequence
  Synthetic Polynucleotide
taatacgactcactatagggagggtcgtgaacaaactgccgatcattgagaacagaggagactcaatatgcggcagtttaacctggcggcagcgcaaaagatg

SEQ ID NO: 188513 - DNA, 103 bp, Artificial Sequence
  Synthetic Polynucleotide
taatacgactcactatagggagccaagttgagggtcgtgaacaaactgccaacagaggagaggcagtatgttcacgaccaacctggcggcagcgcaaaagatg

SEQ ID NO: 188514 - DNA, 103 bp, Artificial Sequence
  Synthetic Polynucleotide
taatacgactcactatagggggcagggagtagccaagttgagggtcgtgaaacagaggagatcacgaatgtcaacttggaacctggcggcagcgcaaaagatg

SEQ ID NO: 188515 - DNA, 103 bp, Artificial Sequence
  Synthetic Polynucleotide
taatacgactcactatagggagccacacaaggcagggagtagccaagttgaacagaggagacaacttatgtactccctgaacctggcggcagcgcaaaagatg

SEQ ID NO: 188516 - DNA, 103 bp, Artificial Sequence
  Synthetic Polynucleotide
taatacgactcactatagggtgggacagccagccacacaaggcagggagtaacagaggagaactcccatgcttgtgtggaacctggcggcagcgcaaaagatg

SEQ ID NO: 188517 - DNA, 103 bp, Artificial Sequence
  Synthetic Polynucleotide
taatacgactcactatagggaattctgcactagtcccagggcagtgtgggaacagaggagacccacaatgccctgggacaacctggcggcagcgcaaaagatg

SEQ ID NO: 188518 - DNA, 103 bp, Artificial Sequence
  Synthetic Polynucleotide
taatacgactcactatagggatcaaggagttgggacagccagccacacaaaacagaggagattgtgtatgtggctgtccaacctggcggcagcgcaaaagatg

SEQ ID NO: 188519 - DNA, 103 bp, Artificial Sequence
  Synthetic Polynucleotide
taatacgactcactataggggagctctttaatcaaggagttgggacagccaacagaggagaggctgtatgaactccttgaacctggcggcagcgcaaaagatg

SEQ ID NO: 188520 - DNA, 103 bp, Artificial Sequence
  Synthetic Polynucleotide
taatacgactcactatagggtgaagtgatggagctctttaatcaaggagtaacagaggagaactcctatgttaaagagcaacctggcggcagcgcaaaagatg

SEQ ID NO: 188521 - DNA, 103 bp, Artificial Sequence
  Synthetic Polynucleotide
taatacgactcactatagggcccagaatcctgaagtgatggagctctttaaacagaggagataaagaatgccatcacttaacctggcggcagcgcaaaagatg

SEQ ID NO: 188522 - DNA, 103 bp, Artificial Sequence
  Synthetic Polynucleotide
taatacgactcactatagggctgctcttctcccagaatcctgaagtgatgaacagaggagacatcacatgaggattctgaacctggcggcagcgcaaaagatg

SEQ ID NO: 188523 - DNA, 103 bp, Artificial Sequence
  Synthetic Polynucleotide
taatacgactcactatagggaccggttgtactgctcttctcccagaatccaacagaggagaggattcatggagaagagcaacctggcggcagcgcaaaagatg

SEQ ID NO: 188524 - DNA, 103 bp, Artificial Sequence
  Synthetic Polynucleotide
taatacgactcactatagggtactgctggtaccggttgtactgctcttctaacagaggagaagaagaatggtacaaccgaacctggcggcagcgcaaaagatg

SEQ ID NO: 188525 - DNA, 103 bp, Artificial Sequence
  Synthetic Polynucleotide
taatacgactcactatagggctctgcaccatactgctggtaccggttgtaaacagaggagatacaacatgtaccagcagaacctggcggcagcgcaaaagatg

SEQ ID NO: 188526 - DNA, 103 bp, Artificial Sequence
  Synthetic Polynucleotide
taatacgactcactatagggggacacactcctctgcaccatactgctggtaacagaggagaaccagcatgatggtgcagaacctggcggcagcgcaaaagatg

SEQ ID NO: 188527 - DNA, 103 bp, Artificial Sequence
  Synthetic Polynucleotide
taatacgactcactatagggcccatctgcaggacacactcctctgcaccaaacagaggagatggtgcatgggagtgtgtaacctggcggcagcgcaaaagatg

SEQ ID NO: 188528 - DNA, 103 bp, Artificial Sequence
  Synthetic Polynucleotide
taatacgactcactatagggtttaaagaaaaattctgcactagtcccaggaacagaggagacctgggatgagtgcagaaaacctggcggcagcgcaaaagatg

SEQ ID NO: 188529 - DNA, 103 bp, Artificial Sequence
  Synthetic Polynucleotide
taatacgactcactatagggtaacacgccccccatctgcaggacacactcaacagaggagagagtgtatgctgcagatgaacctggcggcagcgcaaaagatg

SEQ ID NO: 188530 - DNA, 103 bp, Artificial Sequence
  Synthetic Polynucleotide
taatacgactcactatagggggcgggggcataacacgccccccatctgcaaacagaggagatgcagaatgggggcgtgtaacctggcggcagcgcaaaagatg

SEQ ID NO: 188531 - DNA, 103 bp, Artificial Sequence
  Synthetic Polynucleotide
taatacgactcactatagggccacagccagggcgggggcataacacgcccaacagaggagagggcgtatgatgcccccgaacctggcggcagcgcaaaagatg

SEQ ID NO: 188532 - DNA, 103 bp, Artificial Sequence
  Synthetic Polynucleotide
taatacgactcactatagggcagccccgctccacagccagggcgggggcaaacagaggagatgccccatgcctggctgtaacctggcggcagcgcaaaagatg

SEQ ID NO: 188533 - DNA, 103 bp, Artificial Sequence
  Synthetic Polynucleotide
taatacgactcactataggggctccggcagcagccccgctccacagccagaacagaggagactggctatggagcggggcaacctggcggcagcgcaaaagatg

SEQ ID NO: 188534 - DNA, 103 bp, Artificial Sequence
  Synthetic Polynucleotide
taatacgactcactatagggctctggtcaggctccggcagcagccccgctaacagaggagaagcgggatggctgccggaaacctggcggcagcgcaaaagatg

SEQ ID NO: 188535 - DNA, 103 bp, Artificial Sequence
  Synthetic Polynucleotide
taatacgactcactatagggggtgactttcctctggtcaggctccggcagaacagaggagactgccgatgcctgaccagaacctggcggcagcgcaaaagatg

SEQ ID NO: 188536 - DNA, 103 bp, Artificial Sequence
  Synthetic Polynucleotide
taatacgactcactatagggccccttcgcaggtgactttcctctggtcagaacagaggagactgaccatgggaaagtcaaacctggcggcagcgcaaaagatg

SEQ ID NO: 188537 - DNA, 103 bp, Artificial Sequence
  Synthetic Polynucleotide
taatacgactcactatagggaggccattgcccccttcgcaggtgactttcaacagaggagagaaagtatgctgcgaaggaacctggcggcagcgcaaaagatg

SEQ ID NO: 188538 - DNA, 103 bp, Artificial Sequence
  Synthetic Polynucleotide
taatacgactcactatagggcccacagcccaggccattgcccccttcgcaaacagaggagatgcgaaatgggcaatggcaacctggcggcagcgcaaaagatg

SEQ ID NO: 188539 - DNA, 103 bp, Artificial Sequence
  Synthetic Polynucleotide
taatacgactcactataggggtgctccacatttaaagaaaaattctgcacaacagaggagagtgcagatgttttctttaaacctggcggcagcgcaaaagatg

SEQ ID NO: 188540 - DNA, 103 bp, Artificial Sequence
  Synthetic Polynucleotide
taatacgactcactatagggagaaggcaaacccacagcccaggccattgcaacagaggagagcaatgatgtgggctgtgaacctggcggcagcgcaaaagatg

SEQ ID NO: 188541 - DNA, 103 bp, Artificial Sequence
  Synthetic Polynucleotide
taatacgactcactatagggcattcccggcagaaggcaaacccacagcccaacagaggagagggctgatggtttgccttaacctggcggcagcgcaaaagatg

SEQ ID NO: 188542 - DNA, 103 bp, Artificial Sequence
  Synthetic Polynucleotide
taatacgactcactatagggcgcttctttacattcccggcagaaggcaaaaacagaggagatttgccatgtgccgggaaaacctggcggcagcgcaaaagatg

SEQ ID NO: 188543 - DNA, 103 bp, Artificial Sequence
  Synthetic Polynucleotide
taatacgactcactatagggcttcatggtacgcttctttacattcccggcaacagaggagagccgggatggtaaagaagaacctggcggcagcgcaaaagatg

SEQ ID NO: 188544 - DNA, 103 bp, Artificial Sequence
  Synthetic Polynucleotide
taatacgactcactatagggctgcactccccttcatggtacgcttctttaaacagaggagataaagaatggtaccatgaaacctggcggcagcgcaaaagatg

SEQ ID NO: 188545 - DNA, 103 bp, Artificial Sequence
  Synthetic Polynucleotide
taatacgactcactatagggaaatacggcactgcactccccttcatggtaaacagaggagataccatatgggggagtgcaacctggcggcagcgcaaaagatg

SEQ ID NO: 188546 - DNA, 103 bp, Artificial Sequence
  Synthetic Polynucleotide
taatacgactcactatagggctgaggcttcaaatacggcactgcactcccaacagaggagagggagtatggtgccgtataacctggcggcagcgcaaaagatg

SEQ ID NO: 188547 - DNA, 103 bp, Artificial Sequence
  Synthetic Polynucleotide
taatacgactcactataggggtagttgttcctgaggcttcaaatacggcaaacagaggagatgccgtatgtgaagcctcaacctggcggcagcgcaaaagatg

SEQ ID NO: 188548 - DNA, 103 bp, Artificial Sequence
  Synthetic Polynucleotide
taatacgactcactataggggtaggcctgagtagttgttcctgaggcttcaacagaggagagaagccatgggaacaactaacctggcggcagcgcaaaagatg

SEQ ID NO: 188549 - DNA, 103 bp, Artificial Sequence
  Synthetic Polynucleotide
taatacgactcactatagggcatcgactctgtaggcctgagtagttgttcaacagaggagagaacaaatgctcaggcctaacctggcggcagcgcaaaagatg

SEQ ID NO: 188550 - DNA, 103 bp, Artificial Sequence
  Synthetic Polynucleotide
taatacgactcactataggggaggtggggtgtgctccacatttaaagaaaaacagaggagatttcttatgatgtggagcaacctggcggcagcgcaaaagatg

SEQ ID NO: 188551 - DNA, 103 bp, Artificial Sequence
  Synthetic Polynucleotide
taatacgactcactataggggcggctctttcatcgactctgtaggcctgaaacagaggagatcaggcatgcagagtcgaaacctggcggcagcgcaaaagatg

SEQ ID NO: 188552 - DNA, 103 bp, Artificial Sequence
  Synthetic Polynucleotide
taatacgactcactatagggagcctgctcggcggctctttcatcgactctaacagaggagaagagtcatggaaagagccaacctggcggcagcgcaaaagatg

SEQ ID NO: 188553 - DNA, 103 bp, Artificial Sequence
  Synthetic Polynucleotide
taatacgactcactatagggcttcccaacgagcctgctcggcggctctttaacagaggagaaaagagatgccgagcaggaacctggcggcagcgcaaaagatg

SEQ ID NO: 188554 - DNA, 103 bp, Artificial Sequence
  Synthetic Polynucleotide
taatacgactcactatagggttggaggctgcttcccaacgagcctgctcgaacagaggagacgagcaatgtcgttgggaaacctggcggcagcgcaaaagatg

SEQ ID NO: 188555 - DNA, 103 bp, Artificial Sequence
  Synthetic Polynucleotide
taatacgactcactataggggatggtttctttggaggctgcttcccaacgaacagaggagacgttggatggcagcctccaacctggcggcagcgcaaaagatg

SEQ ID NO: 188556 - DNA, 103 bp, Artificial Sequence
  Synthetic Polynucleotide
taatacgactcactatagggtggttttcttgatggtttctttggaggctgaacagaggagacagcctatgaagaaaccaaacctggcggcagcgcaaaagatg

SEQ ID NO: 188557 - DNA, 103 bp, Artificial Sequence
  Synthetic Polynucleotide
taatacgactcactatagggcagggcttggtggttttcttgatggtttctaacagaggagaagaaacatgcaagaaaacaacctggcggcagcgcaaaagatg

SEQ ID NO: 188558 - DNA, 103 bp, Artificial Sequence
  Synthetic Polynucleotide
taatacgactcactataggggcagcggggacagggcttggtggttttcttaacagaggagaaagaaaatgaccaagcccaacctggcggcagcgcaaaagatg

SEQ ID NO: 188559 - DNA, 103 bp, Artificial Sequence
  Synthetic Polynucleotide
taatacgactcactatagggctggtacatggcagcggggacagggcttggaacagaggagaccaagcatggtccccgctaacctggcggcagcgcaaaagatg

SEQ ID NO: 188560 - DNA, 103 bp, Artificial Sequence
  Synthetic Polynucleotide
taatacgactcactatagggtttttttccactggtacatggcagcggggaaacagaggagatccccgatgccatgtaccaacctggcggcagcgcaaaagatg

SEQ ID NO: 188561 - DNA, 103 bp, Artificial Sequence
  Synthetic Polynucleotide
taatacgactcactatagggttccttgtcagaggtggggtgtgctccacaaacagaggagatgtggaatgcaccccaccaacctggcggcagcgcaaaagatg

SEQ ID NO: 188562 - DNA, 103 bp, Artificial Sequence
  Synthetic Polynucleotide
taatacgactcactataggggcagcctccatttttttccactggtacatgaacagaggagacatgtaatggtggaaaaaaacctggcggcagcgcaaaagatg

SEQ ID NO: 188563 - DNA, 103 bp, Artificial Sequence
  Synthetic Polynucleotide
taatacgactcactatagggtcatgtgcatgcagcctccatttttttccaaacagaggagatggaaaatgatggaggctaacctggcggcagcgcaaaagatg

SEQ ID NO: 188564 - DNA, 103 bp, Artificial Sequence
  Synthetic Polynucleotide
taatacgactcactatagggtgcggacacttcatgtgcatgcagcctccaaacagaggagatggaggatgcatgcacataacctggcggcagcgcaaaagatg

SEQ ID NO: 188565 - DNA, 103 bp, Artificial Sequence
  Synthetic Polynucleotide
taatacgactcactataggggcactggggctgcggacacttcatgtgcataacagaggagaatgcacatgaagtgtccgaacctggcggcagcgcaaaagatg

SEQ ID NO: 188566 - DNA, 103 bp, Artificial Sequence
  Synthetic Polynucleotide
taatacgactcactatagggactcgagcctgcactggggctgcggacactaacagaggagaagtgtcatgagccccagtaacctggcggcagcgcaaaagatg

SEQ ID NO: 188567 - DNA, 103 bp, Artificial Sequence
  Synthetic Polynucleotide
taatacgactcactatagggttccagcaccactcgagcctgcactggggcaacagaggagagccccaatgcaggctcgaaacctggcggcagcgcaaaagatg

SEQ ID NO: 188568 - DNA, 103 bp, Artificial Sequence
  Synthetic Polynucleotide
taatacgactcactataggggcagccacagttccagcaccactcgagcctaacagaggagaaggctcatgtggtgctggaacctggcggcagcgcaaaagatg

SEQ ID NO: 188569 - DNA, 103 bp, Artificial Sequence
  Synthetic Polynucleotide
taatacgactcactatagggggttccactcgcagccacagttccagcaccaacagaggagaggtgctatgactgtggctaacctggcggcagcgcaaaagatg

SEQ ID NO: 188570 - DNA, 103 bp, Artificial Sequence
  Synthetic Polynucleotide
taatacgactcactatagggatgcagacgcggttccactcgcagccacagaacagaggagactgtggatgcgagtggaaaacctggcggcagcgcaaaagatg

SEQ ID NO: 188571 - DNA, 103 bp, Artificial Sequence
  Synthetic Polynucleotide
taatacgactcactataggggtggtcccccatgcagacgcggttccactcaacagaggagagagtggatgcgcgtctgcaacctggcggcagcgcaaaagatg

SEQ ID NO: 188572 - DNA, 103 bp, Artificial Sequence
  Synthetic Polynucleotide
taatacgactcactatagggctactgatgtttccttgtcagaggtggggtaacagaggagaaccccaatgctgacaaggaacctggcggcagcgcaaaagatg

SEQ ID NO: 188573 - DNA, 103 bp, Artificial Sequence
  Synthetic Polynucleotide
taatacgactcactatagggcgtcgaaccagtggtcccccatgcagacgcaacagaggagagcgtctatgtgggggaccaacctggcggcagcgcaaaagatg

SEQ ID NO: 188574 - DNA, 103 bp, Artificial Sequence
  Synthetic Polynucleotide
taatacgactcactatagggaggtgcaaagctactgatgtttccttgtcaaacagaggagatgacaaatgaacatcagtaacctggcggcagcgcaaaagatg

SEQ ID NO: 188575 - DNA, 103 bp, Artificial Sequence
  Synthetic Polynucleotide
taatacgactcactatagggcttctccgtccccgagttcggaccccgcataacagaggagaatgcggatgccgaactcgaacctggcggcagcgcaaaagatg

SEQ ID NO: 188576 - DNA, 103 bp, Artificial Sequence
  Synthetic Polynucleotide
taatacgactcactatagggttcctgaatgaactccctcttgaaacgcggaacagaggagaccgcgtatgaagagggagaacctggcggcagcgcaaaagatg

SEQ ID NO: 188577 - DNA, 103 bp, Artificial Sequence
  Synthetic Polynucleotide
taatacgactcactatagggtagcgtcaccacggcatttgggtttttctcaacagaggagagagaaaatgccaaatgccaacctggcggcagcgcaaaagatg

SEQ ID NO: 188578 - DNA, 103 bp, Artificial Sequence
  Synthetic Polynucleotide
taatacgactcactataggggccagttctctagcgtcaccacggcatttgaacagaggagacaaatgatgtggtgacgcaacctggcggcagcgcaaaagatg

SEQ ID NO: 188579 - DNA, 103 bp, Artificial Sequence
  Synthetic Polynucleotide
taatacgactcactatagggtcttcaaactgccagttctctagcgtcaccaacagaggagaggtgacatgagagaactgaacctggcggcagcgcaaaagatg

SEQ ID NO: 188580 - DNA, 103 bp, Artificial Sequence
  Synthetic Polynucleotide
taatacgactcactataggggcttccccattcttcaaactgccagttctcaacagaggagagagaacatgcagtttgaaaacctggcggcagcgcaaaagatg

SEQ ID NO: 188581 - DNA, 103 bp, Artificial Sequence
  Synthetic Polynucleotide
taatacgactcactatagggcggtcacttggcttccccattcttcaaactaacagaggagaagtttgatgaatggggaaaacctggcggcagcgcaaaagatg

SEQ ID NO: 188582 - DNA, 103 bp, Artificial Sequence
  Synthetic Polynucleotide
taatacgactcactataggggatgagactacggtcacttggcttccccataacagaggagaatggggatgccaagtgacaacctggcggcagcgcaaaagatg

SEQ ID NO: 188583 - DNA, 103 bp, Artificial Sequence
  Synthetic Polynucleotide
taatacgactcactatagggcctcatgtctgatgagactacggtcacttgaacagaggagacaagtgatggtagtctcaaacctggcggcagcgcaaaagatg

SEQ ID NO: 188584 - DNA, 103 bp, Artificial Sequence
  Synthetic Polynucleotide
taatacgactcactatagggccacccattccctcatgtctgatgagactaaacagaggagatagtctatgcagacatgaaacctggcggcagcgcaaaagatg

SEQ ID NO: 188585 - DNA, 103 bp, Artificial Sequence
  Synthetic Polynucleotide
taatacgactcactatagggttctctggagccacccattccctcatgtctaacagaggagaagacatatgggaatgggtaacctggcggcagcgcaaaagatg

SEQ ID NO: 188586 - DNA, 103 bp, Artificial Sequence
  Synthetic Polynucleotide
taatacgactcactataggggatgtctgctttctctggagccacccattcaacagaggagagaatggatggctccagagaacctggcggcagcgcaaaagatg

SEQ ID NO: 188587 - DNA, 103 bp, Artificial Sequence
  Synthetic Polynucleotide
taatacgactcactatagggtcttagcaggttcctgaatgaactccctctaacagaggagaagagggatgtcattcaggaacctggcggcagcgcaaaagatg

SEQ ID NO: 188588 - DNA, 103 bp, Artificial Sequence
  Synthetic Polynucleotide
taatacgactcactatagggcactgacaatgatgtctgctttctctggagaacagaggagactccagatgaagcagacaaacctggcggcagcgcaaaagatg

SEQ ID NO: 188589 - DNA, 103 bp, Artificial Sequence
  Synthetic Polynucleotide
taatacgactcactatagggcccagaagctcactgacaatgatgtctgctaacagaggagaagcagaatgcattgtcagaacctggcggcagcgcaaaagatg

SEQ ID NO: 188590 - DNA, 103 bp, Artificial Sequence
  Synthetic Polynucleotide
taatacgactcactatagggagcaaatgagcccagaagctcactgacaataacagaggagaattgtcatggagcttctgaacctggcggcagcgcaaaagatg

SEQ ID NO: 188591 - DNA, 103 bp, Artificial Sequence
  Synthetic Polynucleotide
taatacgactcactatagggattcattgtcagcaaatgagcccagaagctaacagaggagaagcttcatggctcatttgaacctggcggcagcgcaaaagatg

SEQ ID NO: 188592 - DNA, 103 bp, Artificial Sequence
  Synthetic Polynucleotide
taatacgactcactatagggtcaggcgacaattcattgtcagcaaatgagaacagaggagactcattatgtgacaatgaaacctggcggcagcgcaaaagatg

SEQ ID NO: 188593 - DNA, 103 bp, Artificial Sequence
  Synthetic Polynucleotide
taatacgactcactatagggatccaggcactcaggcgacaattcattgtcaacagaggagagacaatatgttgtcgcctaacctggcggcagcgcaaaagatg

SEQ ID NO: 188594 - DNA, 103 bp, Artificial Sequence
  Synthetic Polynucleotide
taatacgactcactataggggctgggctccatccaggcactcaggcgacaaacagaggagatgtcgcatgagtgcctggaacctggcggcagcgcaaaagatg

SEQ ID NO: 188595 - DNA, 103 bp, Artificial Sequence
  Synthetic Polynucleotide
taatacgactcactatagggtttaggaagtgctgggctccatccaggcacaacagaggagagtgcctatgtggagcccaaacctggcggcagcgcaaaagatg

SEQ ID NO: 188596 - DNA, 103 bp, Artificial Sequence
  Synthetic Polynucleotide
taatacgactcactatagggaccatcatcttttaggaagtgctgggctccaacagaggagaggagccatgcacttcctaaacctggcggcagcgcaaaagatg

SEQ ID NO: 188597 - DNA, 103 bp, Artificial Sequence
  Synthetic Polynucleotide
taatacgactcactatagggggatgctcacaccatcatcttttaggaagtaacagaggagaacttccatgaagatgatgaacctggcggcagcgcaaaagatg

SEQ ID NO: 188598 - DNA, 103 bp, Artificial Sequence
  Synthetic Polynucleotide
taatacgactcactatagggccgggccgattcttagcaggttcctgaatgaacagaggagacattcaatgacctgctaaaacctggcggcagcgcaaaagatg

SEQ ID NO: 188599 - DNA, 103 bp, Artificial Sequence
  Synthetic Polynucleotide
taatacgactcactatagggtactccccggggatgctcacaccatcatctaacagaggagaagatgaatgtgtgagcataacctggcggcagcgcaaaagatg

SEQ ID NO: 188600 - DNA, 103 bp, Artificial Sequence
  Synthetic Polynucleotide
taatacgactcactatagggaaaggaagtgtactccccggggatgctcacaacagaggagagtgagcatgcccggggagaacctggcggcagcgcaaaagatg

SEQ ID NO: 188601 - DNA, 103 bp, Artificial Sequence
  Synthetic Polynucleotide
taatacgactcactatagggtgggagccagaaaggaagtgtactccccggaacagaggagaccggggatgacacttcctaacctggcggcagcgcaaaagatg

SEQ ID NO: 188602 - DNA, 103 bp, Artificial Sequence
  Synthetic Polynucleotide
taatacgactcactataggggaggaagagatgggagccagaaaggaagtgaacagaggagacacttcatgtctggctccaacctggcggcagcgcaaaagatg

SEQ ID NO: 188603 - DNA, 103 bp, Artificial Sequence
  Synthetic Polynucleotide
taatacgactcactataggggtacagcttggaggaagagatgggagccagaacagaggagactggctatgatctcttccaacctggcggcagcgcaaaagatg

SEQ ID NO: 188604 - DNA, 103 bp, Artificial Sequence
  Synthetic Polynucleotide
taatacgactcactatagggggacctcattgtacagcttggaggaagagaaacagaggagatctcttatgccaagctgtaacctggcggcagcgcaaaagatg

SEQ ID NO: 188605 - DNA, 103 bp, Artificial Sequence
  Synthetic Polynucleotide
taatacgactcactatagggctacaggctcggacctcattgtacagcttgaacagaggagacaagctatgcaatgaggtaacctggcggcagcgcaaaagatg

SEQ ID NO: 188606 - DNA, 103 bp, Artificial Sequence
  Synthetic Polynucleotide
taatacgactcactataggggtccttctccctacaggctcggacctcattaacagaggagaaatgagatgcgagcctgtaacctggcggcagcgcaaaagatg

SEQ ID NO: 188607 - DNA, 103 bp, Artificial Sequence
  Synthetic Polynucleotide
taatacgactcactatagggcagggtcacggtccttctccctacaggctcaacagaggagagagcctatggggagaaggaacctggcggcagcgcaaaagatg

SEQ ID NO: 188608 - DNA, 103 bp, Artificial Sequence
  Synthetic Polynucleotide
taatacgactcactatagggaactgggcctcagggtcacggtccttctccaacagaggagaggagaaatgccgtgacccaacctggcggcagcgcaaaagatg

SEQ ID NO: 188609 - DNA, 103 bp, Artificial Sequence
  Synthetic Polynucleotide
taatacgactcactatagggtgtctggggaccgggccgattcttagcaggaacagaggagacctgctatgaatcggcccaacctggcggcagcgcaaaagatg

SEQ ID NO: 188610 - DNA, 103 bp, Artificial Sequence
  Synthetic Polynucleotide
taatacgactcactatagggaggcatctcaaactgggcctcagggtcacgaacagaggagacgtgacatggaggcccagaacctggcggcagcgcaaaagatg

SEQ ID NO: 188611 - DNA, 103 bp, Artificial Sequence
  Synthetic Polynucleotide
taatacgactcactataggggtaccacataaggcatctcaaactgggcctaacagaggagaaggcccatgttgagatgcaacctggcggcagcgcaaaagatg

SEQ ID NO: 188612 - DNA, 103 bp, Artificial Sequence
  Synthetic Polynucleotide
taatacgactcactatagggttgtgcagccgtaccacataaggcatctcaaacagaggagatgagatatgttatgtggtaacctggcggcagcgcaaaagatg

SEQ ID NO: 188613 - DNA, 103 bp, Artificial Sequence
  Synthetic Polynucleotide
taatacgactcactatagggctggtggaagttgtgcagccgtaccacataaacagaggagatatgtgatgcggctgcacaacctggcggcagcgcaaaagatg

SEQ ID NO: 188614 - DNA, 103 bp, Artificial Sequence
  Synthetic Polynucleotide
taatacgactcactataggggtgcagagagctggtggaagttgtgcagccaacagaggagaggctgcatgacttccaccaacctggcggcagcgcaaaagatg

SEQ ID NO: 188615 - DNA, 103 bp, Artificial Sequence
  Synthetic Polynucleotide
taatacgactcactatagggcagggctggggtgcagagagctggtggaagaacagaggagacttccaatggctctctgcaacctggcggcagcgcaaaagatg

SEQ ID NO: 188616 - DNA, 103 bp, Artificial Sequence
  Synthetic Polynucleotide
taatacgactcactataggggaaggtgaaacagggctggggtgcagagagaacagaggagactctctatgccccagcccaacctggcggcagcgcaaaagatg

SEQ ID NO: 188617 - DNA, 103 bp, Artificial Sequence
  Synthetic Polynucleotide
taatacgactcactatagggtgggatggctgaaggtgaaacagggctgggaacagaggagacccagcatggtttcacctaacctggcggcagcgcaaaagatg

SEQ ID NO: 188618 - DNA, 103 bp, Artificial Sequence
  Synthetic Polynucleotide
taatacgactcactatagggggatctctgttgggatggctgaaggtgaaaaacagaggagatttcacatgcagccatccaacctggcggcagcgcaaaagatg

SEQ ID NO: 188619 - DNA, 103 bp, Artificial Sequence
  Synthetic Polynucleotide
taatacgactcactataggggtcaatcataggatctctgttgggatggctaacagaggagaagccatatgaacagagataacctggcggcagcgcaaaagatg

SEQ ID NO: 188620 - DNA, 103 bp, Artificial Sequence
  Synthetic Polynucleotide
taatacgactcactatagggggtctgatcgtgtctggggaccgggccgataacagaggagaatcggcatggtccccagaaacctggcggcagcgcaaaagatg

SEQ ID NO: 188621 - DNA, 103 bp, Artificial Sequence
  Synthetic Polynucleotide
taatacgactcactatagggagcggttgttgtcaatcataggatctctgtaacagaggagaacagagatgctatgattgaacctggcggcagcgcaaaagatg

SEQ ID NO: 188622 - DNA, 103 bp, Artificial Sequence
  Synthetic Polynucleotide
taatacgactcactatagggaaggtgcaatagcggttgttgtcaatcataaacagaggagatatgatatgcaacaaccgaacctggcggcagcgcaaaagatg

SEQ ID NO: 188623 - DNA, 103 bp, Artificial Sequence
  Synthetic Polynucleotide
taatacgactcactatagggaggaaattccaaggtgcaatagcggttgttaacagaggagaaacaacatgtattgcaccaacctggcggcagcgcaaaagatg

SEQ ID NO: 188624 - DNA, 103 bp, Artificial Sequence
  Synthetic Polynucleotide
taatacgactcactatagggtcacctccacaggaaattccaaggtgcaataacagaggagaattgcaatgtggaatttcaacctggcggcagcgcaaaagatg

SEQ ID NO: 188625 - DNA, 103 bp, Artificial Sequence
  Synthetic Polynucleotide
taatacgactcactatagggagtactgtgttcacctccacaggaaattccaacagaggagaggaattatgtgtggaggtaacctggcggcagcgcaaaagatg

SEQ ID NO: 188626 - DNA, 103 bp, Artificial Sequence
  Synthetic Polynucleotide
taatacgactcactatagggaaagccatgtagtactgtgttcacctccacaacagaggagagtggagatgaacacagtaaacctggcggcagcgcaaaagatg

SEQ ID NO: 188627 - DNA, 103 bp, Artificial Sequence
  Synthetic Polynucleotide
taatacgactcactatagggagtagccggcaaagccatgtagtactgtgtaacagaggagaacacagatgtacatggctaacctggcggcagcgcaaaagatg

SEQ ID NO: 188628 - DNA, 103 bp, Artificial Sequence
  Synthetic Polynucleotide
taatacgactcactatagggacagtctcaaagtagccggcaaagccatgtaacagaggagaacatggatgtgccggctaaacctggcggcagcgcaaaagatg

SEQ ID NO: 188629 - DNA, 103 bp, Artificial Sequence
  Synthetic Polynucleotide
taatacgactcactatagggctgataaagcacagtctcaaagtagccggcaacagaggagagccggcatgtttgagactaacctggcggcagcgcaaaagatg

SEQ ID NO: 188630 - DNA, 103 bp, Artificial Sequence
  Synthetic Polynucleotide
taatacgactcactataggggagtgatgtcctgataaagcacagtctcaaaacagaggagattgagaatgtgctttatcaacctggcggcagcgcaaaagatg

SEQ ID NO: 188631 - DNA, 103 bp, Artificial Sequence
  Synthetic Polynucleotide
taatacgactcactataggggacagcagtaggtctgatcgtgtctggggaaacagaggagatccccaatgacgatcagaaacctggcggcagcgcaaaagatg

SEQ ID NO: 188632 - DNA, 103 bp, Artificial Sequence
  Synthetic Polynucleotide
taatacgactcactatagggcggatactcagagtgatgtcctgataaagcaacagaggagagctttaatgggacatcacaacctggcggcagcgcaaaagatg

SEQ ID NO: 188633 - DNA, 103 bp, Artificial Sequence
  Synthetic Polynucleotide
taatacgactcactatagggagtctctggacggatactcagagtgatgtcaacagaggagagacatcatgctgagtatcaacctggcggcagcgcaaaagatg

SEQ ID NO: 188634 - DNA, 103 bp, Artificial Sequence
  Synthetic Polynucleotide
taatacgactcactatagggcaggagagtgagtctctggacggatactcaaacagaggagatgagtaatggtccagagaaacctggcggcagcgcaaaagatg

SEQ ID NO: 188635 - DNA, 103 bp, Artificial Sequence
  Synthetic Polynucleotide
taatacgactcactataggggagaacatcccaggagagtgagtctctggaaacagaggagatccagaatgtcactctccaacctggcggcagcgcaaaagatg

SEQ ID NO: 188636 - DNA, 103 bp, Artificial Sequence
  Synthetic Polynucleotide
taatacgactcactataggggggaaaccatgagaacatcccaggagagtgaacagaggagacactctatggggatgttcaacctggcggcagcgcaaaagatg

SEQ ID NO: 188637 - DNA, 103 bp, Artificial Sequence
  Synthetic Polynucleotide
taatacgactcactatagggggaagaggatgggaaaccatgagaacatccaacagaggagaggatgtatgcatggtttcaacctggcggcagcgcaaaagatg

SEQ ID NO: 188638 - DNA, 103 bp, Artificial Sequence
  Synthetic Polynucleotide
taatacgactcactatagggtgcttaatagggaagaggatgggaaaccataacagaggagaatggttatgcatcctcttaacctggcggcagcgcaaaagatg

SEQ ID NO: 188639 - DNA, 103 bp, Artificial Sequence
  Synthetic Polynucleotide
taatacgactcactatagggcgttatgggctgcttaatagggaagaggataacagaggagaatcctcatgcctattaagaacctggcggcagcgcaaaagatg

SEQ ID NO: 188640 - DNA, 103 bp, Artificial Sequence
  Synthetic Polynucleotide
taatacgactcactatagggcttcacgtaccgttatgggctgcttaatagaacagaggagactattaatgagcccataaaacctggcggcagcgcaaaagatg

SEQ ID NO: 188641 - DNA, 103 bp, Artificial Sequence
  Synthetic Polynucleotide
taatacgactcactatagggatggtttggccttcacgtaccgttatgggcaacagaggagagcccatatgggtacgtgaaacctggcggcagcgcaaaagatg

SEQ ID NO: 188642 - DNA, 103 bp, Artificial Sequence
  Synthetic Polynucleotide
taatacgactcactatagggagcccttcctgacagcagtaggtctgatcgaacagaggagacgatcaatgctactgctgaacctggcggcagcgcaaaagatg

SEQ ID NO: 188643 - DNA, 103 bp, Artificial Sequence
  Synthetic Polynucleotide
taatacgactcactatagggacgcacacagatggtttggccttcacgtacaacagaggagagtacgtatgggccaaaccaacctggcggcagcgcaaaagatg

SEQ ID NO: 188644 - DNA, 103 bp, Artificial Sequence
  Synthetic Polynucleotide
taatacgactcactatagggatcgccagaaacgcacacagatggtttggcaacagaggagagccaaaatgtctgtgtgcaacctggcggcagcgcaaaagatg

SEQ ID NO: 188645 - DNA, 103 bp, Artificial Sequence
  Synthetic Polynucleotide
taatacgactcactataggggaattgctgcatcgccagaaacgcacacagaacagaggagactgtgtatgtttctggcgaacctggcggcagcgcaaaagatg

SEQ ID NO: 188646 - DNA, 103 bp, Artificial Sequence
  Synthetic Polynucleotide
taatacgactcactatagggcaccttcttggaattgctgcatcgccagaaaacagaggagattctggatgtgcagcaataacctggcggcagcgcaaaagatg

SEQ ID NO: 188647 - DNA, 103 bp, Artificial Sequence
  Synthetic Polynucleotide
taatacgactcactatagggactcataccacaccttcttggaattgctgcaacagaggagagcagcaatgccaagaaggaacctggcggcagcgcaaaagatg

SEQ ID NO: 188648 - DNA, 103 bp, Artificial Sequence
  Synthetic Polynucleotide
taatacgactcactataggggtcacagcccactcataccacaccttcttgaacagaggagacaagaaatggtggtatgaaacctggcggcagcgcaaaagatg

SEQ ID NO: 188649 - DNA, 103 bp, Artificial Sequence
  Synthetic Polynucleotide
taatacgactcactataggggactggtgctgtcacagcccactcataccaaacagaggagatggtatatgtgggctgtgaacctggcggcagcgcaaaagatg

SEQ ID NO: 188650 - DNA, 103 bp, Artificial Sequence
  Synthetic Polynucleotide
taatacgactcactatagggtagcagaacagactggtgctgtcacagcccaacagaggagagggctgatgcagcaccagaacctggcggcagcgcaaaagatg

SEQ ID NO: 188651 - DNA, 103 bp, Artificial Sequence
  Synthetic Polynucleotide
taatacgactcactataggggggttatgaatagcagaacagactggtgctaacagaggagaagcaccatgctgttctgcaacctggcggcagcgcaaaagatg

SEQ ID NO: 188652 - DNA, 103 bp, Artificial Sequence
  Synthetic Polynucleotide
taatacgactcactataggggcggcctgtggggttatgaatagcagaacaaacagaggagatgttctatgattcataacaacctggcggcagcgcaaaagatg

SEQ ID NO: 188653 - DNA, 103 bp, Artificial Sequence
  Synthetic Polynucleotide
taatacgactcactataggggcagcaggaaagcccttcctgacagcagtaaacagaggagatactgcatgcaggaagggaacctggcggcagcgcaaaagatg

SEQ ID NO: 188654 - DNA, 103 bp, Artificial Sequence
  Synthetic Polynucleotide
taatacgactcactatagggtggtatatgagcggcctgtggggttatgaaaacagaggagattcataatgccacaggccaacctggcggcagcgcaaaagatg

SEQ ID NO: 188655 - DNA, 103 bp, Artificial Sequence
  Synthetic Polynucleotide
taatacgactcactatagggtagaggccaatggtatatgagcggcctgtgaacagaggagacacaggatgctcatatacaacctggcggcagcgcaaaagatg

SEQ ID NO: 188656 - DNA, 103 bp, Artificial Sequence
  Synthetic Polynucleotide
taatacgactcactatagggtgattaaggggcagcaggaaagcccttcctaacagaggagaaggaagatgtttcctgctaacctggcggcagcgcaaaagatg

SEQ ID NO: 188657 - DNA, 103 bp, Artificial Sequence
  Synthetic Polynucleotide
taatacgactcactataggggttatcttcctgattaaggggcagcaggaaaacagaggagattcctgatgccccttaataacctggcggcagcgcaaaagatg

SEQ ID NO: 188658 - DNA, 103 bp, Artificial Sequence
  Synthetic Polynucleotide
taatacgactcactatagggctagtctgcccttctccgtccccgagttcgaacagaggagacgaactatgggacggagaaacctggcggcagcgcaaaagatg

SEQ ID NO: 188659 - DNA, 103 bp, Artificial Sequence
  Synthetic Polynucleotide
taatacgactcactatagggccaggttggtgttatcttcctgattaagggaacagaggagacccttaatgaggaagataaacctggcggcagcgcaaaagatg

SEQ ID NO: 188660 - DNA, 103 bp, Artificial Sequence
  Synthetic Polynucleotide
taatacgactcactatagggaaaactctggccaggttggtgttatcttccaacagaggagaggaagaatgcaccaacctaacctggcggcagcgcaaaagatg

SEQ ID NO: 188661 - DNA, 103 bp, Artificial Sequence
  Synthetic Polynucleotide
taatacgactcactataggggtggttggtcaaaactctggccaggttggtaacagaggagaaccaacatggccagagttaacctggcggcagcgcaaaagatg

SEQ ID NO: 188662 - DNA, 103 bp, Artificial Sequence
  Synthetic Polynucleotide
taatacgactcactatagggcagtgtggatgtggttggtcaaaactctggaacagaggagaccagagatgtgaccaaccaacctggcggcagcgcaaaagatg

SEQ ID NO: 188663 - DNA, 103 bp, Artificial Sequence
  Synthetic Polynucleotide
taatacgactcactataggggagtgatggccagtgtggatgtggttggtcaacagaggagagaccaaatgcatccacacaacctggcggcagcgcaaaagatg

SEQ ID NO: 188664 - DNA, 103 bp, Artificial Sequence
  Synthetic Polynucleotide
taatacgactcactataggggaacatggaagagtgatggccagtgtggataacagaggagaatccacatgggccatcacaacctggcggcagcgcaaaagatg

SEQ ID NO: 188665 - DNA, 103 bp, Artificial Sequence
  Synthetic Polynucleotide
taatacgactcactatagggcccgcatccagaacatggaagagtgatggcaacagaggagagccatcatgcttccatgtaacctggcggcagcgcaaaagatg

SEQ ID NO: 188666 - DNA, 103 bp, Artificial Sequence
  Synthetic Polynucleotide
taatacgactcactatagggaccaagggtacccgcatccagaacatggaaaacagaggagattccatatgctggatgcgaacctggcggcagcgcaaaagatg

SEQ ID NO: 188667 - DNA, 103 bp, Artificial Sequence
  Synthetic Polynucleotide
taatacgactcactatagggctctggtgccaccaagggtacccgcatccaaacagaggagatggatgatggtacccttgaacctggcggcagcgcaaaagatg

SEQ ID NO: 188668 - DNA, 103 bp, Artificial Sequence
  Synthetic Polynucleotide
taatacgactcactatagggctctcaggtcctctggtgccaccaagggtaaacagaggagataccctatgtggcaccagaacctggcggcagcgcaaaagatg

SEQ ID NO: 188669 - DNA, 103 bp, Artificial Sequence
  Synthetic Polynucleotide
taatacgactcactatagggtccgggatgactagtctgcccttctccgtcaacagaggagagacggaatggggcagactaacctggcggcagcgcaaaagatg

SEQ ID NO: 188670 - DNA, 103 bp, Artificial Sequence
  Synthetic Polynucleotide
taatacgactcactatagggattatatcatctctcaggtcctctggtgccaacagaggagaggcaccatgggacctgagaacctggcggcagcgcaaaagatg

SEQ ID NO: 188671 - DNA, 103 bp, Artificial Sequence
  Synthetic Polynucleotide
taatacgactcactatagggtgcattctcaattatatcatctctcaggtcaacagaggagagacctgatggatgatataaacctggcggcagcgcaaaagatg

SEQ ID NO: 188672 - DNA, 103 bp, Artificial Sequence
  Synthetic Polynucleotide
taatacgactcactataggggtgtagttggtgcattctcaattatatcataacagaggagaatgataatgttgagaatgaacctggcggcagcgcaaaagatg

SEQ ID NO: 188673 - DNA, 103 bp, Artificial Sequence
  Synthetic Polynucleotide
taatacgactcactatagggtcctctgtgtgtgtagttggtgcattctcaaacagaggagatgagaaatgaccaactacaacctggcggcagcgcaaaagatg

SEQ ID NO: 188674 - DNA, 103 bp, Artificial Sequence
  Synthetic Polynucleotide
taatacgactcactatagggcccactgtactcctctgtgtgtgtagttggaacagaggagaccaactatgcacacagagaacctggcggcagcgcaaaagatg

SEQ ID NO: 188675 - DNA, 103 bp, Artificial Sequence
  Synthetic Polynucleotide
taatacgactcactatagggttttctcctccccactgtactcctctgtgtaacagaggagaacacagatgagtacagtgaacctggcggcagcgcaaaagatg

SEQ ID NO: 188676 - DNA, 103 bp, Artificial Sequence
  Synthetic Polynucleotide
taatacgactcactatagggcacatccacgttttctcctccccactgtacaacagaggagagtacagatgggaggagaaaacctggcggcagcgcaaaagatg

SEQ ID NO: 188677 - DNA, 103 bp, Artificial Sequence
  Synthetic Polynucleotide
taatacgactcactataggggttgtgccaccacatccacgttttctcctcaacagaggagagaggagatgacgtggatgaacctggcggcagcgcaaaagatg

SEQ ID NO: 188678 - DNA, 103 bp, Artificial Sequence
  Synthetic Polynucleotide
taatacgactcactatagggaagtccggaagttgtgccaccacatccacgaacagaggagacgtggaatgggtggcacaaacctggcggcagcgcaaaagatg

SEQ ID NO: 188679 - DNA, 103 bp, Artificial Sequence
  Synthetic Polynucleotide
taatacgactcactatagggtagtcacacaaagtccggaagttgtgccacaacagaggagagtggcaatgcttccggacaacctggcggcagcgcaaaagatg

SEQ ID NO: 188680 - DNA, 103 bp, Artificial Sequence
  Synthetic Polynucleotide
taatacgactcactatagggcccctgcttctccgggatgactagtctgccaacagaggagaggcagaatggtcatcccgaacctggcggcagcgcaaaagatg

SEQ ID NO: 188681 - DNA, 103 bp, Artificial Sequence
  Synthetic Polynucleotide
taatacgactcactatagggcctcttactatagtcacacaaagtccggaaaacagaggagattccggatgttgtgtgacaacctggcggcagcgcaaaagatg

SEQ ID NO: 188682 - DNA, 103 bp, Artificial Sequence
  Synthetic Polynucleotide
taatacgactcactatagggccactgcaatcctcttactatagtcacacaaacagaggagatgtgtgatgatagtaagaaacctggcggcagcgcaaaagatg

SEQ ID NO: 188683 - DNA, 103 bp, Artificial Sequence
  Synthetic Polynucleotide
taatacgactcactatagggatttcaagagccactgcaatcctcttactaaacagaggagatagtaaatggattgcagtaacctggcggcagcgcaaaagatg

SEQ ID NO: 188684 - DNA, 103 bp, Artificial Sequence
  Synthetic Polynucleotide
taatacgactcactataggggtcagccccaatttcaagagccactgcaataacagaggagaattgcaatggctcttgaaaacctggcggcagcgcaaaagatg

SEQ ID NO: 188685 - DNA, 103 bp, Artificial Sequence
  Synthetic Polynucleotide
taatacgactcactatagggtagatgggaggtcagccccaatttcaagagaacagaggagactcttgatgttggggctgaacctggcggcagcgcaaaagatg

SEQ ID NO: 188686 - DNA, 103 bp, Artificial Sequence
  Synthetic Polynucleotide
taatacgactcactatagggatgacatgattagatgggaggtcagccccaaacagaggagatggggcatgcctcccatcaacctggcggcagcgcaaaagatg

SEQ ID NO: 188687 - DNA, 103 bp, Artificial Sequence
  Synthetic Polynucleotide
taatacgactcactatagggccagcgatcaatgacatgattagatgggagaacagaggagactcccaatgaatcatgtcaacctggcggcagcgcaaaagatg

SEQ ID NO: 188688 - DNA, 103 bp, Artificial Sequence
  Synthetic Polynucleotide
taatacgactcactataggggctccccaagccagcgatcaatgacatgataacagaggagaatcatgatgttgatcgctaacctggcggcagcgcaaaagatg

SEQ ID NO: 188689 - DNA, 103 bp, Artificial Sequence
  Synthetic Polynucleotide
taatacgactcactataggggctttgatgggctccccaagccagcgatcaaacagaggagatgatcgatggcttggggaaacctggcggcagcgcaaaagatg

SEQ ID NO: 188690 - DNA, 103 bp, Artificial Sequence
  Synthetic Polynucleotide
taatacgactcactataggggagaatggctgctttgatgggctccccaagaacagaggagacttgggatgcccatcaaaaacctggcggcagcgcaaaagatg

SEQ ID NO: 188691 - DNA, 103 bp, Artificial Sequence
  Synthetic Polynucleotide
taatacgactcactatagggggaaatcaaacccctgcttctccgggatgaaacagaggagatcatccatgagaagcaggaacctggcggcagcgcaaaagatg

SEQ ID NO: 188692 - DNA, 103 bp, Artificial Sequence
  Synthetic Polynucleotide
taatacgactcactatagggtgctagtggggagaatggctgctttgatggaacagaggagaccatcaatgcagccattcaacctggcggcagcgcaaaagatg

SEQ ID NO: 188693 - DNA, 103 bp, Artificial Sequence
  Synthetic Polynucleotide
taatacgactcactataggggtcaggaaaatgctagtggggagaatggctaacagaggagaagccatatgccccactagaacctggcggcagcgcaaaagatg

SEQ ID NO: 188694 - DNA, 103 bp, Artificial Sequence
  Synthetic Polynucleotide
taatacgactcactatagggcttcttattggtcaggaaaatgctagtgggaacagaggagacccactatgattttcctgaacctggcggcagcgcaaaagatg

SEQ ID NO: 188695 - DNA, 103 bp, Artificial Sequence
  Synthetic Polynucleotide
taatacgactcactatagggcaggaaatcccttcttattggtcaggaaaaaacagaggagattttccatgccaataagaaacctggcggcagcgcaaaagatg

SEQ ID NO: 188696 - DNA, 103 bp, Artificial Sequence
  Synthetic Polynucleotide
taatacgactcactatagggttagaaagaacaggaaatcccttcttattgaacagaggagacaataaatggggatttccaacctggcggcagcgcaaaagatg

SEQ ID NO: 188697 - DNA, 103 bp, Artificial Sequence
  Synthetic Polynucleotide
taatacgactcactatagggctggtgcatcttagaaagaacaggaaatccaacagaggagaggatttatggttctttctaacctggcggcagcgcaaaagatg

SEQ ID NO: 188698 - DNA, 103 bp, Artificial Sequence
  Synthetic Polynucleotide
taatacgactcactatagggagatgagcctctggtgcatcttagaaagaaaacagaggagattctttatgagatgcaccaacctggcggcagcgcaaaagatg

SEQ ID NO: 188699 - DNA, 103 bp, Artificial Sequence
  Synthetic Polynucleotide
taatacgactcactatagggaggagccggaagatgagcctctggtgcatcaacagaggagagatgcaatggaggctcataacctggcggcagcgcaaaagatg

SEQ ID NO: 188700 - DNA, 103 bp, Artificial Sequence
  Synthetic Polynucleotide
taatacgactcactatagggctccaacttgaggagccggaagatgagcctaacagaggagaaggctcatgttccggctcaacctggcggcagcgcaaaagatg

SEQ ID NO: 188701 - DNA, 103 bp, Artificial Sequence
  Synthetic Polynucleotide
taatacgactcactatagggtgaactgcacctccaacttgaggagccggaaacagaggagatccggcatgtcaagttggaacctggcggcagcgcaaaagatg

SEQ ID NO: 188702 - DNA, 103 bp, Artificial Sequence
  Synthetic Polynucleotide
taatacgactcactatagggggcatgcagaggaaatcaaacccctgcttcaacagaggagagaagcaatggtttgatttaacctggcggcagcgcaaaagatg

SEQ ID NO: 188703 - DNA, 103 bp, Artificial Sequence
  Synthetic Polynucleotide
taatacgactcactatagggcctgtgatgatgaactgcacctccaacttgaacagaggagacaagttatgggtgcagttaacctggcggcagcgcaaaagatg

SEQ ID NO: 188704 - DNA, 103 bp, Artificial Sequence
  Synthetic Polynucleotide
taatacgactcactataggggtggttggtgcctgtgatgatgaactgcacaacagaggagagtgcagatgatcatcacaaacctggcggcagcgcaaaagatg

SEQ ID NO: 188705 - DNA, 103 bp, Artificial Sequence
  Synthetic Polynucleotide
taatacgactcactatagggtctctgagtggtggttggtgcctgtgatgaaacagaggagatcatcaatggcaccaaccaacctggcggcagcgcaaaagatg

SEQ ID NO: 188706 - DNA, 103 bp, Artificial Sequence
  Synthetic Polynucleotide
taatacgactcactatagggcagaactccttctctgagtggtggttggtgaacagaggagacaccaaatgccactcagaaacctggcggcagcgcaaaagatg

SEQ ID NO: 188707 - DNA, 103 bp, Artificial Sequence
  Synthetic Polynucleotide
taatacgactcactataggggaggtaggagcagaactccttctctgagtgaacagaggagacactcaatgaaggagttcaacctggcggcagcgcaaaagatg

SEQ ID NO: 188708 - DNA, 103 bp, Artificial Sequence
  Synthetic Polynucleotide
taatacgactcactatagggccaggtattggaggtaggagcagaactcctaacagaggagaaggagtatggctcctaccaacctggcggcagcgcaaaagatg

SEQ ID NO: 188709 - DNA, 103 bp, Artificial Sequence
  Synthetic Polynucleotide
taatacgactcactatagggcttaagtattccaggtattggaggtaggagaacagaggagactcctaatgccaatacctaacctggcggcagcgcaaaagatg

SEQ ID NO: 188710 - DNA, 103 bp, Artificial Sequence
  Synthetic Polynucleotide
taatacgactcactatagggacggttctggcttaagtattccaggtattgaacagaggagacaatacatggaatacttaaacctggcggcagcgcaaaagatg

SEQ ID NO: 188711 - DNA, 103 bp, Artificial Sequence
  Synthetic Polynucleotide
taatacgactcactatagggtaggtggaggacggttctggcttaagtattaacagaggagaaatactatggccagaaccaacctggcggcagcgcaaaagatg

SEQ ID NO: 188712 - DNA, 103 bp, Artificial Sequence
  Synthetic Polynucleotide
taatacgactcactatagggtcataggcattaggtggaggacggttctggaacagaggagaccagaaatgtcctccaccaacctggcggcagcgcaaaagatg

SEQ ID NO: 188713 - DNA, 103 bp, Artificial Sequence
  Synthetic Polynucleotide
taatacgactcactatagggatggaagacaggcatgcagaggaaatcaaaaacagaggagatttgatatgctctgcatgaacctggcggcagcgcaaaagatg

SEQ ID NO: 188714 - DNA, 103 bp, Artificial Sequence
  Synthetic Polynucleotide
taatacgactcactatagggggcaaagagttcataggcattaggtggaggaacagaggagacctccaatgaatgcctataacctggcggcagcgcaaaagatg

SEQ ID NO: 188715 - DNA, 103 bp, Artificial Sequence
  Synthetic Polynucleotide
taatacgactcactatagggcatagcccttggcaaagagttcataggcataacagaggagaatgcctatgaactctttgaacctggcggcagcgcaaaagatg

SEQ ID NO: 188716 - DNA, 103 bp, Artificial Sequence
  Synthetic Polynucleotide
taatacgactcactatagggagatagtcttcatagcccttggcaaagagtaacagaggagaactcttatgcaagggctaaacctggcggcagcgcaaaagatg

SEQ ID NO: 188717 - DNA, 103 bp, Artificial Sequence
  Synthetic Polynucleotide
taatacgactcactatagggcggggactgcagatagtcttcatagcccttaacagaggagaaagggcatggaagactataacctggcggcagcgcaaaagatg

SEQ ID NO: 188718 - DNA, 103 bp, Artificial Sequence
  Synthetic Polynucleotide
taatacgactcactataggggtggctgaagcggggactgcagatagtcttaacagaggagaaagactatgtgcagtcccaacctggcggcagcgcaaaagatg

SEQ ID NO: 188719 - DNA, 103 bp, Artificial Sequence
  Synthetic Polynucleotide
taatacgactcactatagggttgtccatcagtggctgaagcggggactgcaacagaggagagcagtcatggcttcagccaacctggcggcagcgcaaaagatg

SEQ ID NO: 188720 - DNA, 103 bp, Artificial Sequence
  Synthetic Polynucleotide
taatacgactcactatagggagattccagattgtccatcagtggctgaagaacagaggagacttcagatgctgatggacaacctggcggcagcgcaaaagatg

SEQ ID NO: 188721 - DNA, 103 bp, Artificial Sequence
  Synthetic Polynucleotide
taatacgactcactatagggcatatgtctgagattccagattgtccatcaaacagaggagatgatggatgatctggaataacctggcggcagcgcaaaagatg

SEQ ID NO: 188722 - DNA, 103 bp, Artificial Sequence
  Synthetic Polynucleotide
taatacgactcactatagggtcaaacacttcatatgtctgagattccagaaacagaggagatctggaatgtcagacataaacctggcggcagcgcaaaagatg

SEQ ID NO: 188723 - DNA, 103 bp, Artificial Sequence
  Synthetic Polynucleotide
taatacgactcactatagggggggtccttttcaaacacttcatatgtctgaacagaggagacagacaatggaagtgtttaacctggcggcagcgcaaaagatg

SEQ ID NO: 188724 - DNA, 103 bp, Artificial Sequence
  Synthetic Polynucleotide
taatacgactcactatagggtgaaacgcggatggaagacaggcatgcagaaacagaggagatctgcaatgctgtcttccaacctggcggcagcgcaaaagatg

SEQ ID NO: 188725 - DNA, 103 bp, Artificial Sequence
  Synthetic Polynucleotide
taatacgactcactatagggagtatttgatggggtccttttcaaacacttaacagaggagaaagtgtatgaaaaggaccaacctggcggcagcgcaaaagatg

SEQ ID NO: 188726 - DNA, 103 bp, Artificial Sequence
  Synthetic Polynucleotide
taatacgactcactatagggtggtactgagagtatttgatggggtcctttaacagaggagaaaaggaatgcatcaaataaacctggcggcagcgcaaaagatg

SEQ ID NO: 188727 - DNA, 103 bp, Artificial Sequence
  Synthetic Polynucleotide
taatacgactcactataggggatggcctgctggtactgagagtatttgataacagaggagaatcaaaatgtctcagtacaacctggcggcagcgcaaaagatg

SEQ ID NO: 188728 - DNA, 103 bp, Artificial Sequence
  Synthetic Polynucleotide
taatacgactcactataggggacatttatagatggcctgctggtactgagaacagaggagactcagtatgagcaggccaaacctggcggcagcgcaaaagatg

SEQ ID NO: 188729 - DNA, 103 bp, Artificial Sequence
  Synthetic Polynucleotide
taatacgactcactatagggcggtctagcagacatttatagatggcctgcaacagaggagagcaggcatgctataaatgaacctggcggcagcgcaaaagatg

SEQ ID NO: 188730 - DNA, 103 bp, Artificial Sequence
  Synthetic Polynucleotide
taatacgactcactatagggttctggtactcggtctagcagacatttataaacagaggagatataaaatgctgctagacaacctggcggcagcgcaaaagatg

SEQ ID NO: 188731 - DNA, 103 bp, Artificial Sequence
  Synthetic Polynucleotide
taatacgactcactatagggccttctcctcttctggtactcggtctagcaaacagaggagatgctagatggagtaccagaacctggcggcagcgcaaaagatg

SEQ ID NO: 188732 - DNA, 103 bp, Artificial Sequence
  Synthetic Polynucleotide
taatacgactcactatagggacattggtatccttctcctcttctggtactaacagaggagaagtaccatgagaggagaaaacctggcggcagcgcaaaagatg

SEQ ID NO: 188733 - DNA, 103 bp, Artificial Sequence
  Synthetic Polynucleotide
taatacgactcactatagggcagtacctggacattggtatccttctcctcaacagaggagagaggagatggataccaataacctggcggcagcgcaaaagatg

SEQ ID NO: 188734 - DNA, 103 bp, Artificial Sequence
  Synthetic Polynucleotide
taatacgactcactatagggccagcaccatcagtacctggacattggtataacagaggagaataccaatgtccaggtacaacctggcggcagcgcaaaagatg

SEQ ID NO: 188735 - DNA, 103 bp, Artificial Sequence
  Synthetic Polynucleotide
taatacgactcactatagggaactccctcttgaaacgcggatggaagacaaacagaggagatgtcttatgtccgcgtttaacctggcggcagcgcaaaagatg

SEQ ID NO: 188736 - DNA, 103 bp, Artificial Sequence
  Synthetic Polynucleotide
taatacgactcactatagggcgtcctgctcccagcaccatcagtacctggaacagaggagaccaggtatggatggtgctaacctggcggcagcgcaaaagatg

SEQ ID NO: 188737 - DNA, 103 bp, Artificial Sequence
  Synthetic Polynucleotide
taatacgactcactatagggcaggggtccccgtcctgctcccagcaccataacagaggagaatggtgatgggagcaggaaacctggcggcagcgcaaaagatg

SEQ ID NO: 188738 - DNA, 103 bp, Artificial Sequence
  Synthetic Polynucleotide
taatacgactcactatagggaagcgttcaccaggggtccccgtcctgctcaacagaggagagagcagatgggggaccccaacctggcggcagcgcaaaagatg

SEQ ID NO: 188739 - DNA, 103 bp, Artificial Sequence
  Synthetic Polynucleotide
taatacgactcactataggggcccgcagggaagcgttcaccaggggtcccaacagaggagagggaccatgggtgaacgcaacctggcggcagcgcaaaagatg

SEQ ID NO: 188740 - DNA, 103 bp, Artificial Sequence
  Synthetic Polynucleotide
taatacgactcactatagggctgcttggctgcccgcagggaagcgttcacaacagaggagagtgaacatgtccctgcggaacctggcggcagcgcaaaagatg

SEQ ID NO: 188741 - DNA, 103 bp, Artificial Sequence
  Synthetic Polynucleotide
taatacgactcactataggggccggtcggcctgcttggctgcccgcagggaacagaggagaccctgcatgcagccaagcaacctggcggcagcgcaaaagatg

SEQ ID NO: 188742 - DNA, 103 bp, Artificial Sequence
  Synthetic Polynucleotide
taatacgactcactatagggagctttatccgccggtcggcctgcttggctaacagaggagaagccaaatgggccgaccgaacctggcggcagcgcaaaagatg

SEQ ID NO: 188743 - DNA, 103 bp, Artificial Sequence
  Synthetic Polynucleotide
taatacgactcactatagggcacagcatacagctttatccgccggtcggcaacagaggagagccgacatgcggataaagaacctggcggcagcgcaaaagatg

SEQ ID NO: 188744 - DNA, 103 bp, Artificial Sequence
  Synthetic Polynucleotide
taatacgactcactatagggggtttttctccacagcatacagctttatccaacagaggagaggataaatgtgtatgctgaacctggcggcagcgcaaaagatg

SEQ ID NO: 188745 - DNA, 103 bp, Artificial Sequence
  Synthetic Polynucleotide
taatacgactcactatagggacggcatttgggtttttctccacagcatacaacagaggagagtatgcatgggagaaaaaaacctggcggcagcgcaaaagatg

SEQ ID NO: 188746 - DNA, 103 bp, Artificial Sequence
  Synthetic Polynucleotide
taatacgactcactatagggctcagcctggcgcctcctttctgcttccataacagaggagaatggaaatggaaaggaggaacctggcggcagcgcaaaagatg

SEQ ID NO: 188747 - DNA, 103 bp, Artificial Sequence
  Synthetic Polynucleotide
taatacgactcactatagggagcactcgagtccaccgtggtggtcggggtaacagaggagaaccccgatgaccacggtgaacctggcggcagcgcaaaagatg

SEQ ID NO: 188748 - DNA, 103 bp, Artificial Sequence
  Synthetic Polynucleotide
taatacgactcactatagggtgcagggtggagcactcgagtccaccgtggaacagaggagaccacggatgactcgagtgaacctggcggcagcgcaaaagatg

SEQ ID NO: 188749 - DNA, 103 bp, Artificial Sequence
  Synthetic Polynucleotide
taatacgactcactataggggggagccttctgcagggtggagcactcgagaacagaggagactcgagatgtccaccctgaacctggcggcagcgcaaaagatg

SEQ ID NO: 188750 - DNA, 103 bp, Artificial Sequence
  Synthetic Polynucleotide
taatacgactcactatagggtcctgcaccagggagccttctgcagggtggaacagaggagaccacccatgagaaggctcaacctggcggcagcgcaaaagatg

SEQ ID NO: 188751 - DNA, 103 bp, Artificial Sequence
  Synthetic Polynucleotide
taatacgactcactatagggatctcccccctcctgcaccagggagccttcaacagaggagagaaggcatgctggtgcagaacctggcggcagcgcaaaagatg

SEQ ID NO: 188752 - DNA, 103 bp, Artificial Sequence
  Synthetic Polynucleotide
taatacgactcactataggggagaaccttgatctcccccctcctgcaccaaacagaggagatggtgcatgaggggggagaacctggcggcagcgcaaaagatg

SEQ ID NO: 188753 - DNA, 103 bp, Artificial Sequence
  Synthetic Polynucleotide
taatacgactcactatagggtccttgcggggagaaccttgatctccccccaacagaggagaggggggatgtcaaggttcaacctggcggcagcgcaaaagatg

SEQ ID NO: 188754 - DNA, 103 bp, Artificial Sequence
  Synthetic Polynucleotide
taatacgactcactatagggccctctgtcctccttgcggggagaaccttgaacagaggagacaaggtatgccccgcaagaacctggcggcagcgcaaaagatg

SEQ ID NO: 188755 - DNA, 103 bp, Artificial Sequence
  Synthetic Polynucleotide
taatacgactcactatagggtgcgggcggcccctctgtcctccttgcgggaacagaggagacccgcaatgaggacagagaacctggcggcagcgcaaaagatg

SEQ ID NO: 188756 - DNA, 103 bp, Artificial Sequence
  Synthetic Polynucleotide
taatacgactcactataggggcgccgggagtgcgggcggcccctctgtccaacagaggagaggacagatgggccgcccgaacctggcggcagcgcaaaagatg

SEQ ID NO: 188757 - DNA, 103 bp, Artificial Sequence
  Synthetic Polynucleotide
taatacgactcactatagggtctttggcttctcagcctggcgcctcctttaacagaggagaaaaggaatggccaggctgaacctggcggcagcgcaaaagatg

SEQ ID NO: 188758 - DNA, 103 bp, Artificial Sequence
  Synthetic Polynucleotide
taatacgactcactatagggtgcggtggcggcgccgggagtgcgggcggcaacagaggagagccgccatgactcccggcaacctggcggcagcgcaaaagatg

SEQ ID NO: 188759 - DNA, 103 bp, Artificial Sequence
  Synthetic Polynucleotide
taatacgactcactatagggctgaaggtggtgcggtggcggcgccgggagaacagaggagactcccgatgccgccaccgaacctggcggcagcgcaaaagatg

SEQ ID NO: 188760 - DNA, 103 bp, Artificial Sequence
  Synthetic Polynucleotide
taatacgactcactatagggctgcactgggctgaaggtggtgcggtggcgaacagaggagacgccacatgaccaccttcaacctggcggcagcgcaaaagatg

SEQ ID NO: 188761 - DNA, 103 bp, Artificial Sequence
  Synthetic Polynucleotide
taatacgactcactataggggctgttccaactgcactgggctgaaggtggaacagaggagaccacctatggcccagtgcaacctggcggcagcgcaaaagatg

SEQ ID NO: 188762 - DNA, 103 bp, Artificial Sequence
  Synthetic Polynucleotide
taatacgactcactataggggctgactccagctgttccaactgcactgggaacagaggagacccagtatggttggaacaaacctggcggcagcgcaaaagatg

SEQ ID NO: 188763 - DNA, 103 bp, Artificial Sequence
  Synthetic Polynucleotide
taatacgactcactatagggcctcccaaaggctgactccagctgttccaaaacagaggagattggaaatgctggagtcaaacctggcggcagcgcaaaagatg

SEQ ID NO: 188764 - DNA, 103 bp, Artificial Sequence
  Synthetic Polynucleotide
taatacgactcactatagggggtactggttcctcccaaaggctgactccaaacagaggagatggagtatgcctttgggaaacctggcggcagcgcaaaagatg

SEQ ID NO: 188765 - DNA, 103 bp, Artificial Sequence
  Synthetic Polynucleotide
taatacgactcactatagggcagatgtcggggtactggttcctcccaaagaacagaggagactttggatggaaccagtaaacctggcggcagcgcaaaagatg

SEQ ID NO: 188766 - DNA, 103 bp, Artificial Sequence
  Synthetic Polynucleotide
taatacgactcactatagggctctcgggcccagatgtcggggtactggttaacagaggagaaaccagatgcccgacatcaacctggcggcagcgcaaaagatg

SEQ ID NO: 188767 - DNA, 103 bp, Artificial Sequence
  Synthetic Polynucleotide
taatacgactcactataggggggcaagactctctcgggcccagatgtcggaacagaggagaccgacaatggggcccgagaacctggcggcagcgcaaaagatg

SEQ ID NO: 188768 - DNA, 103 bp, Artificial Sequence
  Synthetic Polynucleotide
taatacgactcactatagggactcgccccttctttggcttctcagcctggaacagaggagaccaggcatggaagccaaaaacctggcggcagcgcaaaagatg

SEQ ID NO: 188769 - DNA, 103 bp, Artificial Sequence
  Synthetic Polynucleotide
taatacgactcactatagggccagtgtcccgggcaagactctctcgggccaacagaggagaggcccgatggagtcttgcaacctggcggcagcgcaaaagatg

SEQ ID NO: 188770 - DNA, 103 bp, Artificial Sequence
  Synthetic Polynucleotide
taatacgactcactatagggctcactgaggccagtgtcccgggcaagactaacagaggagaagtcttatgcgggacactaacctggcggcagcgcaaaagatg

SEQ ID NO: 188771 - DNA, 103 bp, Artificial Sequence
  Synthetic Polynucleotide
taatacgactcactatagggggattcgggcctcactgaggccagtgtcccaacagaggagagggacaatggcctcagtgaacctggcggcagcgcaaaagatg

SEQ ID NO: 188772 - DNA, 103 bp, Artificial Sequence
  Synthetic Polynucleotide
taatacgactcactatagggaaccagacctggattcgggcctcactgaggaacagaggagacctcagatgggcccgaataacctggcggcagcgcaaaagatg

SEQ ID NO: 188773 - DNA, 103 bp, Artificial Sequence
  Synthetic Polynucleotide
taatacgactcactataggggcggttctggaaccagacctggattcgggcaacagaggagagcccgaatgcaggtctggaacctggcggcagcgcaaaagatg

SEQ ID NO: 188774 - DNA, 103 bp, Artificial Sequence
  Synthetic Polynucleotide
taatacgactcactataggggcttagctctgcggttctggaaccagacctaacagaggagaaggtctatgtccagaaccaacctggcggcagcgcaaaagatg

SEQ ID NO: 188775 - DNA, 103 bp, Artificial Sequence
  Synthetic Polynucleotide
taatacgactcactatagggtgcttccgttgcttagctctgcggttctggaacagaggagaccagaaatgcagagctaaaacctggcggcagcgcaaaagatg

SEQ ID NO: 188776 - DNA, 103 bp, Artificial Sequence
  Synthetic Polynucleotide
taatacgactcactatagggtgagcgctcttgcttccgttgcttagctctaacagaggagaagagctatgcaacggaagaacctggcggcagcgcaaaagatg

SEQ ID NO: 188777 - DNA, 103 bp, Artificial Sequence
  Synthetic Polynucleotide
taatacgactcactataggggctgaagcagtgagcgctcttgcttccgttaacagaggagaaacggaatgaagagcgctaacctggcggcagcgcaaaagatg

SEQ ID NO: 188778 - DNA, 103 bp, Artificial Sequence
  Synthetic Polynucleotide
taatacgactcactatagggtgggccagaggctgaagcagtgagcgctctaacagaggagaagagcgatgactgcttcaaacctggcggcagcgcaaaagatg

SEQ ID NO: 188779 - DNA, 103 bp, Artificial Sequence
  Synthetic Polynucleotide
taatacgactcactataggggttgctgccgactcgccccttctttggcttaacagaggagaaagccaatgaaggggcgaaacctggcggcagcgcaaaagatg

SEQ ID NO: 188780 - DNA, 103 bp, Artificial Sequence
  Synthetic Polynucleotide
taatacgactcactatagggaggagacagatgggccagaggctgaagcagaacagaggagactgcttatgcctctggccaacctggcggcagcgcaaaagatg

SEQ ID NO: 188781 - DNA, 103 bp, Artificial Sequence
  Synthetic Polynucleotide
taatacgactcactatagggaaaaggcggcaggagacagatgggccagagaacagaggagactctggatgatctgtctcaacctggcggcagcgcaaaagatg

SEQ ID NO: 188782 - DNA, 103 bp, Artificial Sequence
  Synthetic Polynucleotide
taatacgactcactatagggaagaagctggaaaaggcggcaggagacagaaacagaggagatctgtcatgtgccgccttaacctggcggcagcgcaaaagatg

SEQ ID NO: 188783 - DNA, 103 bp, Artificial Sequence
  Synthetic Polynucleotide
taatacgactcactatagggggactctggcaagaagctggaaaaggcggcaacagaggagagccgccatgtccagcttcaacctggcggcagcgcaaaagatg

SEQ ID NO: 188784 - DNA, 103 bp, Artificial Sequence
  Synthetic Polynucleotide
taatacgactcactatagggggcaagcagtggactctggcaagaagctggaacagaggagaccagctatgtgccagagtaacctggcggcagcgcaaaagatg

SEQ ID NO: 188785 - DNA, 103 bp, Artificial Sequence
  Synthetic Polynucleotide
taatacgactcactatagggtaagaataggggcaagcagtggactctggcaacagaggagagccagaatgcactgcttgaacctggcggcagcgcaaaagatg

SEQ ID NO: 188786 - DNA, 103 bp, Artificial Sequence
  Synthetic Polynucleotide
taatacgactcactatagggtggtgctgcgtaagaataggggcaagcagtaacagaggagaactgctatgccctattctaacctggcggcagcgcaaaagatg

SEQ ID NO: 188787 - DNA, 103 bp, Artificial Sequence
  Synthetic Polynucleotide
taatacgactcactatagggctggtggtggtggtgctgcgtaagaataggaacagaggagacctattatgacgcagcacaacctggcggcagcgcaaaagatg

SEQ ID NO: 188788 - DNA, 103 bp, Artificial Sequence
  Synthetic Polynucleotide
taatacgactcactatagggaagcaggtcactggtggtggtggtgctgcgaacagaggagacgcagcatgaccaccaccaacctggcggcagcgcaaaagatg

SEQ ID NO: 188789 - DNA, 103 bp, Artificial Sequence
  Synthetic Polynucleotide
taatacgactcactatagggggggtgagggaagcaggtcactggtggtggaacagaggagaccaccaatggtgacctgcaacctggcggcagcgcaaaagatg

SEQ ID NO: 188790 - DNA, 103 bp, Artificial Sequence
  Synthetic Polynucleotide
taatacgactcactatagggcaggcaacaggttgctgccgactcgcccctaacagaggagaaggggcatgtcggcagcaaacctggcggcagcgcaaaagatg

SEQ ID NO: 188791 - DNA, 103 bp, Artificial Sequence
  Synthetic Polynucleotide
taatacgactcactatagggcatggctgtaggggtgagggaagcaggtcaaacagaggagatgacctatgtccctcaccaacctggcggcagcgcaaaagatg

SEQ ID NO: 188792 - DNA, 103 bp, Artificial Sequence
  Synthetic Polynucleotide
taatacgactcactataggggaagggagggcatggctgtaggggtgagggaacagaggagaccctcaatgctacagccaaacctggcggcagcgcaaaagatg

SEQ ID NO: 188793 - DNA, 103 bp, Artificial Sequence
  Synthetic Polynucleotide
taatacgactcactatagggggagggctgggaagggagggcatggctgtaaacagaggagatacagcatggccctccctaacctggcggcagcgcaaaagatg

SEQ ID NO: 188794 - DNA, 103 bp, Artificial Sequence
  Synthetic Polynucleotide
taatacgactcactatagggcgcctcctgtggagggctgggaagggagggaacagaggagaccctccatgcccagccctaacctggcggcagcgcaaaagatg

SEQ ID NO: 188795 - DNA, 103 bp, Artificial Sequence
  Synthetic Polynucleotide
taatacgactcactatagggaaagcaaaggcgcctcctgtggagggctggaacagaggagaccagccatgcacaggaggaacctggcggcagcgcaaaagatg

SEQ ID NO: 188796 - DNA, 103 bp, Artificial Sequence
  Synthetic Polynucleotide
taatacgactcactatagggctggtgtgacaaagcaaaggcgcctcctgtaacagaggagaacaggaatggcctttgctaacctggcggcagcgcaaaagatg

SEQ ID NO: 188797 - DNA, 103 bp, Artificial Sequence
  Synthetic Polynucleotide
taatacgactcactatagggagtcctcagactggtgtgacaaagcaaaggaacagaggagacctttgatgtgtcacaccaacctggcggcagcgcaaaagatg

SEQ ID NO: 188798 - DNA, 103 bp, Artificial Sequence
  Synthetic Polynucleotide
taatacgactcactataggggtagggtaccagtcctcagactggtgtgacaacagaggagagtcacaatggtctgaggaaacctggcggcagcgcaaaagatg

SEQ ID NO: 188799 - DNA, 103 bp, Artificial Sequence
  Synthetic Polynucleotide
taatacgactcactatagggtgggtgcaaggtagggtaccagtcctcagaaacagaggagatctgagatgtggtaccctaacctggcggcagcgcaaaagatg

SEQ ID NO: 188800 - DNA, 103 bp, Artificial Sequence
  Synthetic Polynucleotide
taatacgactcactatagggcggcaggggctgggtgcaaggtagggtaccaacagaggagaggtaccatgccttgcaccaacctggcggcagcgcaaaagatg

SEQ ID NO: 188801 - DNA, 103 bp, Artificial Sequence
  Synthetic Polynucleotide
taatacgactcactataggggggtgtctctcaggcaacaggttgctgccgaacagaggagacggcagatgcctgttgccaacctggcggcagcgcaaaagatg

SEQ ID NO: 188802 - DNA, 103 bp, Artificial Sequence
  Synthetic Polynucleotide
taatacgactcactatagggggcagatggccggcaggggctgggtgcaagaacagaggagacttgcaatgagcccctgcaacctggcggcagcgcaaaagatg

SEQ ID NO: 188803 - DNA, 103 bp, Artificial Sequence
  Synthetic Polynucleotide
taatacgactcactatagggtggggggcagggcagatggccggcaggggcaacagaggagagcccctatgggccatctgaacctggcggcagcgcaaaagatg

SEQ ID NO: 188804 - DNA, 103 bp, Artificial Sequence
  Synthetic Polynucleotide
taatacgactcactatagggtgggagggggtggggggcagggcagatggcaacagaggagagccatcatgcctgcccccaacctggcggcagcgcaaaagatg

SEQ ID NO: 188805 - DNA, 103 bp, Artificial Sequence
  Synthetic Polynucleotide
taatacgactcactatagggagggggagcatgggagggggtggggggcagaacagaggagactgcccatgaccccctccaacctggcggcagcgcaaaagatg

SEQ ID NO: 188806 - DNA, 103 bp, Artificial Sequence
  Synthetic Polynucleotide
taatacgactcactatagggctcaaggctgagggggagcatgggagggggaacagaggagaccccctatgatgctccccaacctggcggcagcgcaaaagatg

SEQ ID NO: 188807 - DNA, 103 bp, Artificial Sequence
  Synthetic Polynucleotide
taatacgactcactatagggacttggatggctcaaggctgagggggagcaaacagaggagatgctccatgtcagccttgaacctggcggcagcgcaaaagatg

SEQ ID NO: 188808 - DNA, 103 bp, Artificial Sequence
  Synthetic Polynucleotide
taatacgactcactatagggcagttccaggacttggatggctcaaggctgaacagaggagacagcctatggccatccaaaacctggcggcagcgcaaaagatg

SEQ ID NO: 188809 - DNA, 103 bp, Artificial Sequence
  Synthetic Polynucleotide
taatacgactcactatagggcccagtggccgggtgtctctcaggcaacagaacagaggagactgttgatggagagacacaacctggcggcagcgcaaaagatg

SEQ ID NO: 188810 - DNA, 103 bp, Artificial Sequence
  Synthetic Polynucleotide
taatacgactcactatagggtggtcggggtcccagtggccgggtgtctctaacagaggagaagagacatgcggccactgaacctggcggcagcgcaaaagatg

SEQ ID NO: 188811 - DNA, 103 bp, Artificial Sequence
  Synthetic Polynucleotide
taatacgactcactatagggtccaccgtggtggtcggggtcccagtggccaacagaggagaggccacatggaccccgacaacctggcggcagcgcaaaagatg

SEQ ID NO: 188812 - DNA, 103 bp, Artificial Sequence
  Synthetic Polynucleotide
taatacgactcactatagggtaagagggctgtgctgtcatggtcaggcataacagaggagaatgcctatgcatgacagcaacctggcggcagcgcaaaagatg

SEQ ID NO: 188813 - DNA, 103 bp, Artificial Sequence
  Synthetic Polynucleotide
taatacgactcactatagggcgttgctcttgccttagcaaaaaatgcagaaacagaggagatctgcaatgtttgctaagaacctggcggcagcgcaaaagatg

SEQ ID NO: 188814 - DNA, 103 bp, Artificial Sequence
  Synthetic Polynucleotide
taatacgactcactatagggggagtttggcccatggtctctttctttgttaacagaggagaaacaaaatgagagaccataacctggcggcagcgcaaaagatg

SEQ ID NO: 188815 - DNA, 103 bp, Artificial Sequence
  Synthetic Polynucleotide
taatacgactcactatagggccggttgtaaggagtttggcccatggtctcaacagaggagagagaccatgggccaaactaacctggcggcagcgcaaaagatg

SEQ ID NO: 188816 - DNA, 103 bp, Artificial Sequence
  Synthetic Polynucleotide
taatacgactcactatagggtgtttgccttccggttgtaaggagtttggcaacagaggagagccaaaatgcttacaaccaacctggcggcagcgcaaaagatg

SEQ ID NO: 188817 - DNA, 103 bp, Artificial Sequence
  Synthetic Polynucleotide
taatacgactcactatagggctcagccaaatgtttgccttccggttgtaaaacagaggagattacaaatggaaggcaaaaacctggcggcagcgcaaaagatg

SEQ ID NO: 188818 - DNA, 103 bp, Artificial Sequence
  Synthetic Polynucleotide
taatacgactcactataggggtttcaaggtctcagccaaatgtttgccttaacagaggagaaaggcaatgatttggctgaacctggcggcagcgcaaaagatg

SEQ ID NO: 188819 - DNA, 103 bp, Artificial Sequence
  Synthetic Polynucleotide
taatacgactcactatagggttcagttcctgtttcaaggtctcagccaaaaacagaggagatttggcatggaccttgaaaacctggcggcagcgcaaaagatg

SEQ ID NO: 188820 - DNA, 103 bp, Artificial Sequence
  Synthetic Polynucleotide
taatacgactcactatagggcatggcagtgttcagttcctgtttcaaggtaacagaggagaaccttgatgcaggaactgaacctggcggcagcgcaaaagatg

SEQ ID NO: 188821 - DNA, 103 bp, Artificial Sequence
  Synthetic Polynucleotide
taatacgactcactatagggcaacttgcgacatggcagtgttcagttcctaacagaggagaaggaacatgacactgccaaacctggcggcagcgcaaaagatg

SEQ ID NO: 188822 - DNA, 103 bp, Artificial Sequence
  Synthetic Polynucleotide
taatacgactcactatagggacagtgtccacaacttgcgacatggcagtgaacagaggagacactgcatggtcgcaagtaacctggcggcagcgcaaaagatg

SEQ ID NO: 188823 - DNA, 103 bp, Artificial Sequence
  Synthetic Polynucleotide
taatacgactcactataggggactttgaccacagtgtccacaacttgcgaaacagaggagatcgcaaatggtggacactaacctggcggcagcgcaaaagatg

SEQ ID NO: 188824 - DNA, 103 bp, Artificial Sequence
  Synthetic Polynucleotide
taatacgactcactatagggcactaaaaaacgttgctcttgccttagcaaaacagaggagattgctaatgcaagagcaaaacctggcggcagcgcaaaagatg

SEQ ID NO: 188825 - DNA, 103 bp, Artificial Sequence
  Synthetic Polynucleotide
taatacgactcactatagggtggccgaaaagactttgaccacagtgtccaaacagaggagatggacaatgtggtcaaagaacctggcggcagcgcaaaagatg

SEQ ID NO: 188826 - DNA, 103 bp, Artificial Sequence
  Synthetic Polynucleotide
taatacgactcactatagggcgggagggcttggccgaaaagactttgaccaacagaggagaggtcaaatgcttttcggcaacctggcggcagcgcaaaagatg

SEQ ID NO: 188827 - DNA, 103 bp, Artificial Sequence
  Synthetic Polynucleotide
taatacgactcactatagggaggaacctggcgggagggcttggccgaaaaaacagaggagattttcgatgaagccctccaacctggcggcagcgcaaaagatg

SEQ ID NO: 188828 - DNA, 103 bp, Artificial Sequence
  Synthetic Polynucleotide
taatacgactcactatagggggaagacctgaggaacctggcgggagggctaacagaggagaagccctatggccaggttcaacctggcggcagcgcaaaagatg

SEQ ID NO: 188829 - DNA, 103 bp, Artificial Sequence
  Synthetic Polynucleotide
taatacgactcactatagggtggagaggtgggaagacctgaggaacctggaacagaggagaccaggtatgtcaggtcttaacctggcggcagcgcaaaagatg

SEQ ID NO: 188830 - DNA, 103 bp, Artificial Sequence
  Synthetic Polynucleotide
taatacgactcactatagggctgggggatctggagaggtgggaagacctgaacagaggagacaggtcatgccacctctcaacctggcggcagcgcaaaagatg

SEQ ID NO: 188831 - DNA, 103 bp, Artificial Sequence
  Synthetic Polynucleotide
taatacgactcactatagggcaaatctggcctgggggatctggagaggtgaacagaggagacacctcatgagatcccccaacctggcggcagcgcaaaagatg

SEQ ID NO: 188832 - DNA, 103 bp, Artificial Sequence
  Synthetic Polynucleotide
taatacgactcactatagggccattgactgcaaatctggcctgggggatcaacagaggagagatcccatgggccagattaacctggcggcagcgcaaaagatg

SEQ ID NO: 188833 - DNA, 103 bp, Artificial Sequence
  Synthetic Polynucleotide
taatacgactcactataggggtggttttccccattgactgcaaatctggcaacagaggagagccagaatggcagtcaataacctggcggcagcgcaaaagatg

SEQ ID NO: 188834 - DNA, 103 bp, Artificial Sequence
  Synthetic Polynucleotide
taatacgactcactatagggtgtggaaattgtggttttccccattgactgaacagaggagacagtcaatggggaaaaccaacctggcggcagcgcaaaagatg

SEQ ID NO: 188835 - DNA, 103 bp, Artificial Sequence
  Synthetic Polynucleotide
taatacgactcactatagggggattcatggcactaaaaaacgttgctcttaacagaggagaaagagcatggttttttagaacctggcggcagcgcaaaagatg

SEQ ID NO: 188836 - DNA, 103 bp, Artificial Sequence
  Synthetic Polynucleotide
taatacgactcactatagggtggttggcggtgtggaaattgtggttttccaacagaggagaggaaaaatgcaatttccaaacctggcggcagcgcaaaagatg

SEQ ID NO: 188837 - DNA, 103 bp, Artificial Sequence
  Synthetic Polynucleotide
taatacgactcactatagggctgcaggcgctggttggcggtgtggaaattaacagaggagaaatttcatgaccgccaacaacctggcggcagcgcaaaagatg

SEQ ID NO: 188838 - DNA, 103 bp, Artificial Sequence
  Synthetic Polynucleotide
taatacgactcactatagggcgccaaagcactgcaggcgctggttggcggaacagaggagaccgccaatgagcgcctgcaacctggcggcagcgcaaaagatg

SEQ ID NO: 188839 - DNA, 103 bp, Artificial Sequence
  Synthetic Polynucleotide
taatacgactcactatagggatgatgacgtcgccaaagcactgcaggcgcaacagaggagagcgcctatggtgctttggaacctggcggcagcgcaaaagatg

SEQ ID NO: 188840 - DNA, 103 bp, Artificial Sequence
  Synthetic Polynucleotide
taatacgactcactatagggggggttcggaatgatgacgtcgccaaagcaaacagaggagatgctttatggacgtcatcaacctggcggcagcgcaaaagatg

SEQ ID NO: 188841 - DNA, 103 bp, Artificial Sequence
  Synthetic Polynucleotide
taatacgactcactatagggaggtgtccagggggttcggaatgatgacgtaacagaggagaacgtcaatgttccgaaccaacctggcggcagcgcaaaagatg

SEQ ID NO: 188842 - DNA, 103 bp, Artificial Sequence
  Synthetic Polynucleotide
taatacgactcactatagggacattgccaaaggtgtccagggggttcggaaacagaggagatccgaaatgcctggacacaacctggcggcagcgcaaaagatg

SEQ ID NO: 188843 - DNA, 103 bp, Artificial Sequence
  Synthetic Polynucleotide
taatacgactcactatagggggccatctgcacattgccaaaggtgtccagaacagaggagactggacatgtttggcaataacctggcggcagcgcaaaagatg

SEQ ID NO: 188844 - DNA, 103 bp, Artificial Sequence
  Synthetic Polynucleotide
taatacgactcactatagggcagtggaactggccatctgcacattgccaaaacagaggagattggcaatgtgcagatggaacctggcggcagcgcaaaagatg

SEQ ID NO: 188845 - DNA, 103 bp, Artificial Sequence
  Synthetic Polynucleotide
taatacgactcactatagggtctgtctggtcagtggaactggccatctgcaacagaggagagcagatatgcagttccacaacctggcggcagcgcaaaagatg

SEQ ID NO: 188846 - DNA, 103 bp, Artificial Sequence
  Synthetic Polynucleotide
taatacgactcactatagggagaaccttggggattcatggcactaaaaaaaacagaggagattttttatggccatgaataacctggcggcagcgcaaaagatg

SEQ ID NO: 188847 - DNA, 103 bp, Artificial Sequence
  Synthetic Polynucleotide
taatacgactcactataggggggcagtgcttctgtctggtcagtggaactaacagaggagaagttccatggaccagacaaacctggcggcagcgcaaaagatg

SEQ ID NO: 188848 - DNA, 103 bp, Artificial Sequence
  Synthetic Polynucleotide
taatacgactcactatagggggacaaccaggggcagtgcttctgtctggtaacagaggagaaccagaatgaagcactgcaacctggcggcagcgcaaaagatg

SEQ ID NO: 188849 - DNA, 103 bp, Artificial Sequence
  Synthetic Polynucleotide
taatacgactcactataggggagtttttgcggacaaccaggggcagtgctaacagaggagaagcactatgcctggttgtaacctggcggcagcgcaaaagatg

SEQ ID NO: 188850 - DNA, 103 bp, Artificial Sequence
  Synthetic Polynucleotide
taatacgactcactatagggctggtcagaggagtttttgcggacaaccagaacagaggagactggttatgcgcaaaaacaacctggcggcagcgcaaaagatg

SEQ ID NO: 188851 - DNA, 103 bp, Artificial Sequence
  Synthetic Polynucleotide
taatacgactcactatagggcggaggcagactggtcagaggagtttttgcaacagaggagagcaaaaatgcctctgaccaacctggcggcagcgcaaaagatg

SEQ ID NO: 188852 - DNA, 103 bp, Artificial Sequence
  Synthetic Polynucleotide
taatacgactcactataggggcggcagggccggaggcagactggtcagagaacagaggagactctgaatggtctgcctcaacctggcggcagcgcaaaagatg

SEQ ID NO: 188853 - DNA, 103 bp, Artificial Sequence
  Synthetic Polynucleotide
taatacgactcactataggggtggccgccagcggcagggccggaggcagaaacagaggagatctgccatgggccctgccaacctggcggcagcgcaaaagatg

SEQ ID NO: 188854 - DNA, 103 bp, Artificial Sequence
  Synthetic Polynucleotide
taatacgactcactatagggggggctggtggtggccgccagcggcagggcaacagaggagagccctgatgctggcggccaacctggcggcagcgcaaaagatg

SEQ ID NO: 188855 - DNA, 103 bp, Artificial Sequence
  Synthetic Polynucleotide
taatacgactcactataggggactggtgcaggggctggtggtggccgccaaacagaggagatggcggatgccaccagccaacctggcggcagcgcaaaagatg

SEQ ID NO: 188856 - DNA, 103 bp, Artificial Sequence
  Synthetic Polynucleotide
taatacgactcactatagggagagagaggcgactggtgcaggggctggtgaacagaggagacaccagatgctgcaccagaacctggcggcagcgcaaaagatg

SEQ ID NO: 188857 - DNA, 103 bp, Artificial Sequence
  Synthetic Polynucleotide
taatacgactcactatagggcatcctgctcagaaccttggggattcatggaacagaggagaccatgaatgcccaaggttaacctggcggcagcgcaaaagatg

SEQ ID NO: 188858 - DNA, 103 bp, Artificial Sequence
  Synthetic Polynucleotide
taatacgactcactatagggccgtggtggcagagagaggcgactggtgcaaacagaggagatgcaccatgcgcctctctaacctggcggcagcgcaaaagatg

SEQ ID NO: 188859 - DNA, 103 bp, Artificial Sequence
  Synthetic Polynucleotide
taatacgactcactataggggtggtgaagcccgtggtggcagagagaggcaacagaggagagcctctatgtgccaccacaacctggcggcagcgcaaaagatg

SEQ ID NO: 188860 - DNA, 103 bp, Artificial Sequence
  Synthetic Polynucleotide
taatacgactcactataggggaaggtggacgtggtgaagcccgtggtggcaacagaggagagccaccatgggcttcaccaacctggcggcagcgcaaaagatg

SEQ ID NO: 188861 - DNA, 103 bp, Artificial Sequence
  Synthetic Polynucleotide
taatacgactcactatagggaggggtggcggaaggtggacgtggtgaagcaacagaggagagcttcaatgcgtccacctaacctggcggcagcgcaaaagatg

SEQ ID NO: 188862 - DNA, 103 bp, Artificial Sequence
  Synthetic Polynucleotide
taatacgactcactatagggggaagggggaaggggtggcggaaggtggacaacagaggagagtccacatgccgccacccaacctggcggcagcgcaaaagatg

SEQ ID NO: 188863 - DNA, 103 bp, Artificial Sequence
  Synthetic Polynucleotide
taatacgactcactatagggggccatcaagggaagggggaaggggtggcgaacagaggagacgccacatgttcccccttaacctggcggcagcgcaaaagatg

SEQ ID NO: 188864 - DNA, 103 bp, Artificial Sequence
  Synthetic Polynucleotide
taatacgactcactataggggaaatggataggccatcaagggaagggggaaacagaggagatcccccatgccttgatggaacctggcggcagcgcaaaagatg

SEQ ID NO: 188865 - DNA, 103 bp, Artificial Sequence
  Synthetic Polynucleotide
taatacgactcactatagggaatgggctctgaaatggataggccatcaagaacagaggagacttgatatgctatccattaacctggcggcagcgcaaaagatg

SEQ ID NO: 188866 - DNA, 103 bp, Artificial Sequence
  Synthetic Polynucleotide
taatacgactcactataggggggagcacctaatgggctctgaaatggataaacagaggagatatccaatgcagagcccaaacctggcggcagcgcaaaagatg

SEQ ID NO: 188867 - DNA, 103 bp, Artificial Sequence
  Synthetic Polynucleotide
taatacgactcactatagggaggagccggagggagcacctaatgggctctaacagaggagaagagccatgtaggtgctcaacctggcggcagcgcaaaagatg

SEQ ID NO: 188868 - DNA, 103 bp, Artificial Sequence
  Synthetic Polynucleotide
taatacgactcactataggggaatactcaacatcctgctcagaaccttggaacagaggagaccaaggatgtgagcaggaaacctggcggcagcgcaaaagatg

SEQ ID NO: 188869 - DNA, 103 bp, Artificial Sequence
  Synthetic Polynucleotide
taatacgactcactatagggtttccagagaaggagccggagggagcacctaacagaggagaaggtgcatgctccggctcaacctggcggcagcgcaaaagatg

SEQ ID NO: 188870 - DNA, 103 bp, Artificial Sequence
  Synthetic Polynucleotide
taatacgactcactatagggggctctgtcttttccagagaaggagccggaaacagaggagatccggcatgttctctggaaacctggcggcagcgcaaaagatg

SEQ ID NO: 188871 - DNA, 103 bp, Artificial Sequence
  Synthetic Polynucleotide
taatacgactcactatagggattcaggagaggctctgtcttttccagagaaacagaggagatctctgatgaagacagagaacctggcggcagcgcaaaagatg

SEQ ID NO: 188872 - DNA, 103 bp, Artificial Sequence
  Synthetic Polynucleotide
taatacgactcactatagggaagtctaaggattcaggagaggctctgtctaacagaggagaagacagatgctctcctgaaacctggcggcagcgcaaaagatg

SEQ ID NO: 188873 - DNA, 103 bp, Artificial Sequence
  Synthetic Polynucleotide
taatacgactcactatagggatccctagttaagtctaaggattcaggagaaacagaggagatctcctatgtccttagacaacctggcggcagcgcaaaagatg

SEQ ID NO: 188874 - DNA, 103 bp, Artificial Sequence
  Synthetic Polynucleotide
taatacgactcactataggggactcgtggtatccctagttaagtctaaggaacagaggagaccttagatgtaactagggaacctggcggcagcgcaaaagatg

SEQ ID NO: 188875 - DNA, 103 bp, Artificial Sequence
  Synthetic Polynucleotide
taatacgactcactatagggttggtcctcagactcgtggtatccctagttaacagaggagaaactagatgtaccacgagaacctggcggcagcgcaaaagatg

SEQ ID NO: 188876 - DNA, 103 bp, Artificial Sequence
  Synthetic Polynucleotide
taatacgactcactatagggagatgacatcttggtcctcagactcgtggtaacagaggagaaccacgatgctgaggaccaacctggcggcagcgcaaaagatg

SEQ ID NO: 188877 - DNA, 103 bp, Artificial Sequence
  Synthetic Polynucleotide
taatacgactcactatagggtcaggtggtgagatgacatcttggtcctcaaacagaggagatgaggaatgagatgtcataacctggcggcagcgcaaaagatg

SEQ ID NO: 188878 - DNA, 103 bp, Artificial Sequence
  Synthetic Polynucleotide
taatacgactcactataggggggtggtggctcaggtggtgagatgacatcaacagaggagagatgtcatgtcaccacctaacctggcggcagcgcaaaagatg

SEQ ID NO: 188879 - DNA, 103 bp, Artificial Sequence
  Synthetic Polynucleotide
taatacgactcactatagggctgcaccactgaatactcaacatcctgctcaacagaggagagagcagatggttgagtataacctggcggcagcgcaaaagatg

SEQ ID NO: 188880 - DNA, 103 bp, Artificial Sequence
  Synthetic Polynucleotide
taatacgactcactatagggtggtgaacaagggtggtggctcaggtggtgaacagaggagacaccacatgagccaccacaacctggcggcagcgcaaaagatg

SEQ ID NO: 188881 - DNA, 103 bp, Artificial Sequence
  Synthetic Polynucleotide
taatacgactcactataggggcgggtgtgctggtgaacaagggtggtggcaacagaggagagccaccatgcttgttcacaacctggcggcagcgcaaaagatg

SEQ ID NO: 188882 - DNA, 103 bp, Artificial Sequence
  Synthetic Polynucleotide
taatacgactcactataggggcggtgctgggcgggtgtgctggtgaacaaaacagaggagattgttcatgagcacacccaacctggcggcagcgcaaaagatg

SEQ ID NO: 188883 - DNA, 103 bp, Artificial Sequence
  Synthetic Polynucleotide
taatacgactcactataggggagcccttcggcggtgctgggcgggtgtgcaacagaggagagcacacatgcccagcaccaacctggcggcagcgcaaaagatg

SEQ ID NO: 188884 - DNA, 103 bp, Artificial Sequence
  Synthetic Polynucleotide
taatacgactcactataggggcgacaaggagagcccttcggcggtgctggaacagaggagaccagcaatgccgaagggcaacctggcggcagcgcaaaagatg

SEQ ID NO: 188885 - DNA, 103 bp, Artificial Sequence
  Synthetic Polynucleotide
taatacgactcactataggggactttatgagcgacaaggagagcccttcgaacagaggagacgaaggatgctccttgtcaacctggcggcagcgcaaaagatg

SEQ ID NO: 188886 - DNA, 103 bp, Artificial Sequence
  Synthetic Polynucleotide
taatacgactcactataggggccgcactcggactttatgagcgacaaggaaacagaggagatccttgatgctcataaagaacctggcggcagcgcaaaagatg

SEQ ID NO: 188887 - DNA, 103 bp, Artificial Sequence
  Synthetic Polynucleotide
taatacgactcactatagggcttgaagatcgccgcactcggactttatgaaacagaggagatcataaatgccgagtgcgaacctggcggcagcgcaaaagatg

SEQ ID NO: 188888 - DNA, 103 bp, Artificial Sequence
  Synthetic Polynucleotide
taatacgactcactatagggtcagacatatcttgaagatcgccgcactcgaacagaggagacgagtgatgcgatcttcaaacctggcggcagcgcaaaagatg

SEQ ID NO: 188889 - DNA, 103 bp, Artificial Sequence
  Synthetic Polynucleotide
taatacgactcactatagggaggtgatatttcagacatatcttgaagatcaacagaggagagatcttatggatatgtctaacctggcggcagcgcaaaagatg

SEQ ID NO: 188890 - DNA, 103 bp, Artificial Sequence
  Synthetic Polynucleotide
taatacgactcactatagggcatctgcatgctgcaccactgaatactcaaaacagaggagattgagtatgcagtggtgcaacctggcggcagcgcaaaagatg

SEQ ID NO: 188891 - DNA, 103 bp, Artificial Sequence
  Synthetic Polynucleotide
taatacgactcactatagggttcccgaataaggtgatatttcagacatataacagaggagaatatgtatgaaatatcacaacctggcggcagcgcaaaagatg

SEQ ID NO: 188892 - DNA, 103 bp, Artificial Sequence
  Synthetic Polynucleotide
taatacgactcactatagggtgcattgcacttcccgaataaggtgatattaacagaggagaaatatcatgttattcgggaacctggcggcagcgcaaaagatg

SEQ ID NO: 188893 - DNA, 103 bp, Artificial Sequence
  Synthetic Polynucleotide
taatacgactcactatagggcaatccttcctgcattgcacttcccgaataaacagaggagatattcgatgagtgcaatgaacctggcggcagcgcaaaagatg

SEQ ID NO: 188894 - DNA, 103 bp, Artificial Sequence
  Synthetic Polynucleotide
taatacgactcactataggggattgggtgacaatccttcctgcattgcacaacagaggagagtgcaaatgaggaaggataacctggcggcagcgcaaaagatg

SEQ ID NO: 188895 - DNA, 103 bp, Artificial Sequence
  Synthetic Polynucleotide
taatacgactcactatagggtttttcaagtgattgggtgacaatccttccaacagaggagaggaaggatggtcacccaaaacctggcggcagcgcaaaagatg

SEQ ID NO: 188896 - DNA, 103 bp, Artificial Sequence
  Synthetic Polynucleotide
taatacgactcactataggggagctttgcttttttcaagtgattgggtgaaacagaggagatcacccatgcacttgaaaaacctggcggcagcgcaaaagatg

SEQ ID NO: 188897 - DNA, 103 bp, Artificial Sequence
  Synthetic Polynucleotide
taatacgactcactatagggaaaaaaacatgagctttgcttttttcaagtaacagaggagaacttgaatgaagcaaagcaacctggcggcagcgcaaaagatg

SEQ ID NO: 188898 - DNA, 103 bp, Artificial Sequence
  Synthetic Polynucleotide
taatacgactcactatagggtaacgggtataaaaaaacatgagctttgctaacagaggagaagcaaaatgcatgtttttaacctggcggcagcgcaaaagatg

SEQ ID NO: 188899 - DNA, 103 bp, Artificial Sequence
  Synthetic Polynucleotide
taatacgactcactatagggggagctgggataacgggtataaaaaaacataacagaggagaatgtttatgtatacccgtaacctggcggcagcgcaaaagatg

SEQ ID NO: 188900 - DNA, 103 bp, Artificial Sequence
  Synthetic Polynucleotide
taatacgactcactatagggtcagcatattggagctgggataacgggtataacagaggagaatacccatgatcccagctaacctggcggcagcgcaaaagatg

SEQ ID NO: 188901 - DNA, 103 bp, Artificial Sequence
  Synthetic Polynucleotide
taatacgactcactataggggacttttccccatctgcatgctgcaccactaacagaggagaagtggtatggcatgcagaaacctggcggcagcgcaaaagatg

SEQ ID NO: 188902 - DNA, 103 bp, Artificial Sequence
  Synthetic Polynucleotide
taatacgactcactatagggaagtaggtcttcagcatattggagctgggaaacagaggagatcccagatgcaatatgctaacctggcggcagcgcaaaagatg

SEQ ID NO: 188903 - DNA, 103 bp, Artificial Sequence
  Synthetic Polynucleotide
taatacgactcactatagggtacgtcggagaagtaggtcttcagcatattaacagaggagaaatatgatgaagacctacaacctggcggcagcgcaaaagatg

SEQ ID NO: 188904 - DNA, 103 bp, Artificial Sequence
  Synthetic Polynucleotide
taatacgactcactatagggtgttgaactttacgtcggagaagtaggtctaacagaggagaagacctatgtctccgacgaacctggcggcagcgcaaaagatg

SEQ ID NO: 188905 - DNA, 103 bp, Artificial Sequence
  Synthetic Polynucleotide
taatacgactcactataggggtaatgcatctgttgaactttacgtcggagaacagaggagactccgaatgaaagttcaaaacctggcggcagcgcaaaagatg

SEQ ID NO: 188906 - DNA, 103 bp, Artificial Sequence
  Synthetic Polynucleotide
taatacgactcactataggggagctgagaggtaatgcatctgttgaacttaacagaggagaaagttcatgagatgcattaacctggcggcagcgcaaaagatg

SEQ ID NO: 188907 - DNA, 103 bp, Artificial Sequence
  Synthetic Polynucleotide
taatacgactcactatagggaccacttgatgagctgagaggtaatgcatcaacagaggagagatgcaatgcctctcagcaacctggcggcagcgcaaaagatg

SEQ ID NO: 188908 - DNA, 103 bp, Artificial Sequence
  Synthetic Polynucleotide
taatacgactcactatagggaaattgctaaaccacttgatgagctgagagaacagaggagactctcaatgcatcaagtgaacctggcggcagcgcaaaagatg

SEQ ID NO: 188909 - DNA, 103 bp, Artificial Sequence
  Synthetic Polynucleotide
taatacgactcactatagggaaactcacggaaattgctaaaccacttgataacagaggagaatcaagatgtttagcaataacctggcggcagcgcaaaagatg

SEQ ID NO: 188910 - DNA, 103 bp, Artificial Sequence
  Synthetic Polynucleotide
taatacgactcactataggggaatgtagtaaaactcacggaaattgctaaaacagaggagattagcaatgtccgtgagtaacctggcggcagcgcaaaagatg

SEQ ID NO: 188911 - DNA, 103 bp, Artificial Sequence
  Synthetic Polynucleotide
taatacgactcactatagggttctccatctgaatgtagtaaaactcacggaacagaggagaccgtgaatgttactacataacctggcggcagcgcaaaagatg

SEQ ID NO: 188912 - DNA, 103 bp, Artificial Sequence
  Synthetic Polynucleotide
taatacgactcactataggggagtacatttgacttttccccatctgcatgaacagaggagacatgcaatgggggaaaagaacctggcggcagcgcaaaagatg

SEQ ID NO: 188913 - DNA, 103 bp, Artificial Sequence
  Synthetic Polynucleotide
taatacgactcactatagggacgtgcgtacttctccatctgaatgtagtaaacagaggagatactacatgcagatggagaacctggcggcagcgcaaaagatg

SEQ ID NO: 188914 - DNA, 103 bp, Artificial Sequence
  Synthetic Polynucleotide
taatacgactcactatagggtgatggcttgacgtgcgtacttctccatctaacagaggagaagatggatgagtacgcacaacctggcggcagcgcaaaagatg

SEQ ID NO: 188915 - DNA, 103 bp, Artificial Sequence
  Synthetic Polynucleotide
taatacgactcactatagggaccccatcgttgatggcttgacgtgcgtacaacagaggagagtacgcatgtcaagccataacctggcggcagcgcaaaagatg

SEQ ID NO: 188916 - DNA, 103 bp, Artificial Sequence
  Synthetic Polynucleotide
taatacgactcactatagggagtactggtgaccccatcgttgatggcttgaacagaggagacaagccatgaacgatgggaacctggcggcagcgcaaaagatg

SEQ ID NO: 188917 - DNA, 103 bp, Artificial Sequence
  Synthetic Polynucleotide
taatacgactcactatagggacagctcttcagtactggtgaccccatcgtaacagaggagaacgatgatgtcaccagtaaacctggcggcagcgcaaaagatg

SEQ ID NO: 188918 - DNA, 103 bp, Artificial Sequence
  Synthetic Polynucleotide
taatacgactcactatagggctggttatagacagctcttcagtactggtgaacagaggagacaccagatgtgaagagctaacctggcggcagcgcaaaagatg

SEQ ID NO: 188919 - DNA, 103 bp, Artificial Sequence
  Synthetic Polynucleotide
taatacgactcactatagggctcacagtctctggttatagacagctcttcaacagaggagagaagagatgtctataaccaacctggcggcagcgcaaaagatg

SEQ ID NO: 188920 - DNA, 103 bp, Artificial Sequence
  Synthetic Polynucleotide
taatacgactcactatagggccctgtacagctcacagtctctggttatagaacagaggagactataaatggagactgtgaacctggcggcagcgcaaaagatg

SEQ ID NO: 188921 - DNA, 103 bp, Artificial Sequence
  Synthetic Polynucleotide
taatacgactcactatagggatgttcagagccctgtacagctcacagtctaacagaggagaagactgatggctgtacagaacctggcggcagcgcaaaagatg

SEQ ID NO: 188922 - DNA, 103 bp, Artificial Sequence
  Synthetic Polynucleotide
taatacgactcactatagggattgtagtgcatgttcagagccctgtacagaacagaggagactgtacatggctctgaacaacctggcggcagcgcaaaagatg

SEQ ID NO: 188923 - DNA, 103 bp, Artificial Sequence
  Synthetic Polynucleotide
taatacgactcactatagggtttgccggcttaagagggctgtgctgtcataacagaggagaatgacaatgcagccctctaacctggcggcagcgcaaaagatg

SEQ ID NO: 188924 - DNA, 103 bp, Artificial Sequence
  Synthetic Polynucleotide
taatacgactcactataggggcagcttgcggagtacatttgacttttcccaacagaggagagggaaaatgcaaatgtacaacctggcggcagcgcaaaagatg

SEQ ID NO: 188925 - DNA, 103 bp, Artificial Sequence
  Synthetic Polynucleotide
taatacgactcactatagggcatttgctttattgtagtgcatgttcagagaacagaggagactctgaatgtgcactacaaacctggcggcagcgcaaaagatg

SEQ ID NO: 188926 - DNA, 103 bp, Artificial Sequence
  Synthetic Polynucleotide
taatacgactcactatagggacctcaaagtcatttgctttattgtagtgcaacagaggagagcactaatgtaaagcaaaaacctggcggcagcgcaaaagatg

SEQ ID NO: 188927 - DNA, 103 bp, Artificial Sequence
  Synthetic Polynucleotide
taatacgactcactatagggtctctctggaacctcaaagtcatttgctttaacagaggagaaaagcaatggactttgagaacctggcggcagcgcaaaagatg

SEQ ID NO: 188928 - DNA, 103 bp, Artificial Sequence
  Synthetic Polynucleotide
taatacgactcactatagggcttccaggaatctctctggaacctcaaagtaacagaggagaactttgatgttccagagaaacctggcggcagcgcaaaagatg

SEQ ID NO: 188929 - DNA, 103 bp, Artificial Sequence
  Synthetic Polynucleotide
taatacgactcactatagggatctgagcaacttccaggaatctctctggaaacagaggagatccagaatgattcctggaaacctggcggcagcgcaaaagatg

SEQ ID NO: 188930 - DNA, 103 bp, Artificial Sequence
  Synthetic Polynucleotide
taatacgactcactatagggccgtaatgtgatctgagcaacttccaggaaaacagaggagattcctgatggttgctcagaacctggcggcagcgcaaaagatg

SEQ ID NO: 188931 - DNA, 103 bp, Artificial Sequence
  Synthetic Polynucleotide
taatacgactcactatagggtgaaaaactcccgtaatgtgatctgagcaaaacagaggagattgctcatgtcacattacaacctggcggcagcgcaaaagatg

SEQ ID NO: 188932 - DNA, 103 bp, Artificial Sequence
  Synthetic Polynucleotide
taatacgactcactatagggataatggcattgaaaaactcccgtaatgtgaacagaggagacacattatgggagtttttaacctggcggcagcgcaaaagatg

SEQ ID NO: 188933 - DNA, 103 bp, Artificial Sequence
  Synthetic Polynucleotide
taatacgactcactatagggtttgcctgcgataatggcattgaaaaactcaacagaggagagagtttatgaatgccattaacctggcggcagcgcaaaagatg

SEQ ID NO: 188934 - DNA, 103 bp, Artificial Sequence
  Synthetic Polynucleotide
taatacgactcactataggggatcaacatctttgcctgcgataatggcataacagaggagaatgccaatgtcgcaggcaaacctggcggcagcgcaaaagatg

SEQ ID NO: 188935 - DNA, 103 bp, Artificial Sequence
  Synthetic Polynucleotide
taatacgactcactataggggccctcttcagcagcttgcggagtacatttaacagaggagaaaatgtatgccgcaagctaacctggcggcagcgcaaaagatg

SEQ ID NO: 188936 - DNA, 103 bp, Artificial Sequence
  Synthetic Polynucleotide
taatacgactcactatagggttccaggaaggatcaacatctttgcctgcgaacagaggagacgcaggatgagatgttgaaacctggcggcagcgcaaaagatg

SEQ ID NO: 188937 - DNA, 103 bp, Artificial Sequence
  Synthetic Polynucleotide
taatacgactcactatagggtatggccttcttccaggaaggatcaacatcaacagaggagagatgttatgccttcctggaacctggcggcagcgcaaaagatg

SEQ ID NO: 188938 - DNA, 103 bp, Artificial Sequence
  Synthetic Polynucleotide
taatacgactcactatagggtgaccttgtatatggccttcttccaggaagaacagaggagacttcctatgagaaggccaaacctggcggcagcgcaaaagatg

SEQ ID NO: 188939 - DNA, 103 bp, Artificial Sequence
  Synthetic Polynucleotide
taatacgactcactatagggagcttgcagatgaccttgtatatggccttcaacagaggagagaaggcatgatacaaggtaacctggcggcagcgcaaaagatg

SEQ ID NO: 188940 - DNA, 103 bp, Artificial Sequence
  Synthetic Polynucleotide
taatacgactcactatagggttcactatccagcttgcagatgaccttgtaaacagaggagatacaagatgatctgcaagaacctggcggcagcgcaaaagatg

SEQ ID NO: 188941 - DNA, 103 bp, Artificial Sequence
  Synthetic Polynucleotide
taatacgactcactatagggtctcagggacttcactatccagcttgcagaaacagaggagatctgcaatgtggatagtgaacctggcggcagcgcaaaagatg

SEQ ID NO: 188942 - DNA, 103 bp, Artificial Sequence
  Synthetic Polynucleotide
taatacgactcactataggggatttgaaaatctcagggacttcactatccaacagaggagaggatagatgagtccctgaaacctggcggcagcgcaaaagatg

SEQ ID NO: 188943 - DNA, 103 bp, Artificial Sequence
  Synthetic Polynucleotide
taatacgactcactataggggcagttcggggatttgaaaatctcagggacaacagaggagagtccctatgattttcaaaaacctggcggcagcgcaaaagatg

SEQ ID NO: 188944 - DNA, 103 bp, Artificial Sequence
  Synthetic Polynucleotide
taatacgactcactataggggctcttgtaggcagttcggggatttgaaaaaacagaggagattttcaatgccccgaactaacctggcggcagcgcaaaagatg

SEQ ID NO: 188945 - DNA, 103 bp, Artificial Sequence
  Synthetic Polynucleotide
taatacgactcactatagggtcatgaagcagctcttgtaggcagttcgggaacagaggagacccgaaatgcctacaagaaacctggcggcagcgcaaaagatg

SEQ ID NO: 188946 - DNA, 103 bp, Artificial Sequence
  Synthetic Polynucleotide
taatacgactcactatagggatacgagttcgccctcttcagcagcttgcgaacagaggagacgcaagatgctgaagaggaacctggcggcagcgcaaaagatg

SEQ ID NO: 188947 - DNA, 103 bp, Artificial Sequence
  Synthetic Polynucleotide
taatacgactcactatagggtggcatcttcatacgagttcgccctcttcaaacagaggagatgaagaatgcgaactcgtaacctggcggcagcgcaaaagatg

SEQ ID NO: 188948 - DNA, 103 bp, Artificial Sequence
  Synthetic Polynucleotide
taatacgactcactatagggaaaggcatcatggcatcttcatacgagttcaacagaggagagaactcatgtgaagatgcaacctggcggcagcgcaaaagatg

SEQ ID NO: 188949 - DNA, 103 bp, Artificial Sequence
  Synthetic Polynucleotide
taatacgactcactatagggtgctcctggaaaaggcatcatggcatcttcaacagaggagagaagatatgatgatgcctaacctggcggcagcgcaaaagatg

SEQ ID NO: 188950 - DNA, 103 bp, Artificial Sequence
  Synthetic Polynucleotide
taatacgactcactatagggaaattatggttgctcctggaaaaggcatcaaacagaggagatgatgcatgttccaggagaacctggcggcagcgcaaaagatg

SEQ ID NO: 188951 - DNA, 103 bp, Artificial Sequence
  Synthetic Polynucleotide
taatacgactcactatagggaacagctgggaaattatggttgctcctggaaacagaggagatccaggatgaaccataataacctggcggcagcgcaaaagatg

SEQ ID NO: 188952 - DNA, 103 bp, Artificial Sequence
  Synthetic Polynucleotide
taatacgactcactataggggttatttttcaacagctgggaaattatggtaacagaggagaaccataatgtcccagctgaacctggcggcagcgcaaaagatg

SEQ ID NO: 188953 - DNA, 103 bp, Artificial Sequence
  Synthetic Polynucleotide
taatacgactcactatagggttttgttcatgttatttttcaacagctgggaacagaggagacccagcatgtgaaaaataaacctggcggcagcgcaaaagatg

SEQ ID NO: 188954 - DNA, 103 bp, Artificial Sequence
  Synthetic Polynucleotide
taatacgactcactatagggctcctcttggtttgccggcttaagagggctaacagaggagaagccctatgaagccggcaaacctggcggcagcgcaaaagatg

SEQ ID NO: 188955 - DNA, 103 bp, Artificial Sequence
  Synthetic Polynucleotide
taatacgactcactataggggtgccaccatttttgttcatgttatttttcaacagaggagagaaaaaatgcatgaacaaaacctggcggcagcgcaaaagatg

SEQ ID NO: 188956 - DNA, 103 bp, Artificial Sequence
  Synthetic Polynucleotide
taatacgactcactatagggactgggctccgtgccaccatttttgttcataacagaggagaatgaacatgaatggtggcaacctggcggcagcgcaaaagatg

SEQ ID NO: 188957 - DNA, 103 bp, Artificial Sequence
  Synthetic Polynucleotide
taatacgactcactatagggtggcttggaaactgggctccgtgccaccataacagaggagaatggtgatgcggagcccaaacctggcggcagcgcaaaagatg

SEQ ID NO: 188958 - DNA, 103 bp, Artificial Sequence
  Synthetic Polynucleotide
taatacgactcactataggggagagaccgctggcttggaaactgggctccaacagaggagaggagccatgtttccaagcaacctggcggcagcgcaaaagatg

SEQ ID NO: 188959 - DNA, 103 bp, Artificial Sequence
  Synthetic Polynucleotide
taatacgactcactataggggcctgtactagagagaccgctggcttggaaaacagaggagattccaaatgagcggtctcaacctggcggcagcgcaaaagatg

SEQ ID NO: 188960 - DNA, 103 bp, Artificial Sequence
  Synthetic Polynucleotide
taatacgactcactataggggtacttcggagcctgtactagagagaccgcaacagaggagagcggtcatgctagtacagaacctggcggcagcgcaaaagatg

SEQ ID NO: 188961 - DNA, 103 bp, Artificial Sequence
  Synthetic Polynucleotide
taatacgactcactatagggtcctcctgatgtacttcggagcctgtactaaacagaggagatagtacatgctccgaagtaacctggcggcagcgcaaaagatg

SEQ ID NO: 188962 - DNA, 103 bp, Artificial Sequence
  Synthetic Polynucleotide
taatacgactcactataggggctgcatatatcctcctgatgtacttcggaaacagaggagatccgaaatgcatcaggagaacctggcggcagcgcaaaagatg

SEQ ID NO: 188963 - DNA, 103 bp, Artificial Sequence
  Synthetic Polynucleotide
taatacgactcactatagggttgaagagttgctgcatatatcctcctgataacagaggagaatcaggatgatatatgcaaacctggcggcagcgcaaaagatg

SEQ ID NO: 188964 - DNA, 103 bp, Artificial Sequence
  Synthetic Polynucleotide
taatacgactcactataggggggctgtctcttgaagagttgctgcatataaacagaggagatatatgatgcaactcttcaacctggcggcagcgcaaaagatg

SEQ ID NO: 188965 - DNA, 103 bp, Artificial Sequence
  Synthetic Polynucleotide
taatacgactcactataggggtcaactcttctcctcttggtttgccggctaacagaggagaagccggatgaccaagaggaacctggcggcagcgcaaaagatg

SEQ ID NO: 188966 - DNA, 103 bp, Artificial Sequence
  Synthetic Polynucleotide
taatacgactcactatagggacactctggggggctgtctcttgaagagttaacagaggagaaactctatgagagacagcaacctggcggcagcgcaaaagatg

SEQ ID NO: 188967 - DNA, 103 bp, Artificial Sequence
  Synthetic Polynucleotide
taatacgactcactatagggaaggggaaagacactctggggggctgtctcaacagaggagagagacaatgccccagagtaacctggcggcagcgcaaaagatg

SEQ ID NO: 188968 - DNA, 103 bp, Artificial Sequence
  Synthetic Polynucleotide
taatacgactcactatagggggcctgccaaaaggggaaagacactctgggaacagaggagacccagaatgtctttccccaacctggcggcagcgcaaaagatg

SEQ ID NO: 188969 - DNA, 103 bp, Artificial Sequence
  Synthetic Polynucleotide
taatacgactcactataggggctcatagtaggcctgccaaaaggggaaagaacagaggagactttccatgtttggcaggaacctggcggcagcgcaaaagatg

SEQ ID NO: 188970 - DNA, 103 bp, Artificial Sequence
  Synthetic Polynucleotide
taatacgactcactatagggtatcaaactggctcatagtaggcctgccaaaacagaggagattggcaatgctactatgaaacctggcggcagcgcaaaagatg

SEQ ID NO: 188971 - DNA, 103 bp, Artificial Sequence
  Synthetic Polynucleotide
taatacgactcactatagggaagcgatccatatcaaactggctcatagtaaacagaggagatactatatgccagtttgaaacctggcggcagcgcaaaagatg

SEQ ID NO: 188972 - DNA, 103 bp, Artificial Sequence
  Synthetic Polynucleotide
taatacgactcactatagggctcatcacataagcgatccatatcaaactgaacagaggagacagtttatgatggatcgcaacctggcggcagcgcaaaagatg

SEQ ID NO: 188973 - DNA, 103 bp, Artificial Sequence
  Synthetic Polynucleotide
taatacgactcactatagggctctcaggtgctcatcacataagcgatccaaacagaggagatggatcatgtatgtgatgaacctggcggcagcgcaaaagatg

SEQ ID NO: 188974 - DNA, 103 bp, Artificial Sequence
  Synthetic Polynucleotide
taatacgactcactataggggcgcgctttgctctcaggtgctcatcacataacagaggagaatgtgaatggcacctgagaacctggcggcagcgcaaaagatg

SEQ ID NO: 188975 - DNA, 103 bp, Artificial Sequence
  Synthetic Polynucleotide
taatacgactcactatagggctcaacccgggcgcgctttgctctcaggtgaacagaggagacacctgatggcaaagcgcaacctggcggcagcgcaaaagatg

SEQ ID NO: 188976 - DNA, 103 bp, Artificial Sequence
  Synthetic Polynucleotide
taatacgactcactatagggtcactccaatgtcaactcttctcctcttggaacagaggagaccaagaatggaagagttgaacctggcggcagcgcaaaagatg

SEQ ID NO: 188977 - DNA, 103 bp, Artificial Sequence
  Synthetic Polynucleotide
taatacgactcactataggggaattatattctcaacccgggcgcgctttgaacagaggagacaaagcatgcccgggttgaacctggcggcagcgcaaaagatg

SEQ ID NO: 188978 - DNA, 103 bp, Artificial Sequence
  Synthetic Polynucleotide
taatacgactcactatagggctcataccccgaattatattctcaacccggaacagaggagaccgggtatggaatataataacctggcggcagcgcaaaagatg

SEQ ID NO: 188979 - DNA, 103 bp, Artificial Sequence
  Synthetic Polynucleotide
taatacgactcactataggggggggaatggctcataccccgaattatattaacagaggagaaatataatgcggggtatgaacctggcggcagcgcaaaagatg

SEQ ID NO: 188980 - DNA, 103 bp, Artificial Sequence
  Synthetic Polynucleotide
taatacgactcactatagggatgccacactgggggaatggctcataccccaacagaggagaggggtaatggccattcccaacctggcggcagcgcaaaagatg

SEQ ID NO: 188981 - DNA, 103 bp, Artificial Sequence
  Synthetic Polynucleotide
taatacgactcactatagggttgccccttaatgccacactgggggaatggaacagaggagaccattcatgcagtgtggcaacctggcggcagcgcaaaagatg

SEQ ID NO: 188982 - DNA, 103 bp, Artificial Sequence
  Synthetic Polynucleotide
taatacgactcactatagggttcattttcattgccccttaatgccacactaacagaggagaagtgtgatgttaaggggcaacctggcggcagcgcaaaagatg

SEQ ID NO: 188983 - DNA, 103 bp, Artificial Sequence
  Synthetic Polynucleotide
taatacgactcactatagggccatctctctttcattttcattgccccttaaacagaggagataagggatgatgaaaatgaacctggcggcagcgcaaaagatg

SEQ ID NO: 188984 - DNA, 103 bp, Artificial Sequence
  Synthetic Polynucleotide
taatacgactcactataggggactgcggggccatctctctttcattttcaaacagaggagatgaaaaatgaagagagataacctggcggcagcgcaaaagatg

SEQ ID NO: 188985 - DNA, 103 bp, Artificial Sequence
  Synthetic Polynucleotide
taatacgactcactataggggggactcacagactgcggggccatctctctaacagaggagaagagagatggccccgcagaacctggcggcagcgcaaaagatg

SEQ ID NO: 188986 - DNA, 103 bp, Artificial Sequence
  Synthetic Polynucleotide
taatacgactcactatagggaactttctcggggactcacagactgcggggaacagaggagaccccgcatgctgtgagtcaacctggcggcagcgcaaaagatg

SEQ ID NO: 188987 - DNA, 103 bp, Artificial Sequence
  Synthetic Polynucleotide
taatacgactcactatagggaccgtccttttcactccaatgtcaactcttaacagaggagaaagagtatgcattggagtaacctggcggcagcgcaaaagatg

SEQ ID NO: 188988 - DNA, 103 bp, Artificial Sequence
  Synthetic Polynucleotide
taatacgactcactatagggttttctctgtaactttctcggggactcacaaacagaggagatgtgagatgccgagaaagaacctggcggcagcgcaaaagatg

SEQ ID NO: 188989 - DNA, 103 bp, Artificial Sequence
  Synthetic Polynucleotide
taatacgactcactatagggcttgcgtttgttttctctgtaactttctcgaacagaggagacgagaaatgtacagagaaaacctggcggcagcgcaaaagatg

SEQ ID NO: 188990 - DNA, 103 bp, Artificial Sequence
  Synthetic Polynucleotide
taatacgactcactataggggaagcttttgcttgcgtttgttttctctgtaacagaggagaacagagatgacaaacgcaaacctggcggcagcgcaaaagatg

SEQ ID NO: 188991 - DNA, 103 bp, Artificial Sequence
  Synthetic Polynucleotide
taatacgactcactatagggtgctgctggggaagcttttgcttgcgtttgaacagaggagacaaacgatggcaaaagctaacctggcggcagcgcaaaagatg

SEQ ID NO: 188992 - DNA, 103 bp, Artificial Sequence
  Synthetic Polynucleotide
taatacgactcactatagggactctgttgctgctgctggggaagcttttgaacagaggagacaaaagatgccccagcagaacctggcggcagcgcaaaagatg

SEQ ID NO: 188993 - DNA, 103 bp, Artificial Sequence
  Synthetic Polynucleotide
taatacgactcactataggggctgctggaaactctgttgctgctgctgggaacagaggagacccagcatgagcaacagaaacctggcggcagcgcaaaagatg

SEQ ID NO: 188994 - DNA, 103 bp, Artificial Sequence
  Synthetic Polynucleotide
taatacgactcactataggggctgaaaccagctgctggaaactctgttgcaacagaggagagcaacaatgtttccagcaaacctggcggcagcgcaaaagatg

SEQ ID NO: 188995 - DNA, 103 bp, Artificial Sequence
  Synthetic Polynucleotide
taatacgactcactatagggttcttttcgggctgaaaccagctgctggaaaacagaggagattccagatgctggtttcaaacctggcggcagcgcaaaagatg

SEQ ID NO: 188996 - DNA, 103 bp, Artificial Sequence
  Synthetic Polynucleotide
taatacgactcactatagggctcgcttctgttcttttcgggctgaaaccaaacagaggagatggtttatgcccgaaaagaacctggcggcagcgcaaaagatg

SEQ ID NO: 188997 - DNA, 103 bp, Artificial Sequence
  Synthetic Polynucleotide
taatacgactcactatagggcggcgctcctctcgcttctgttcttttcggaacagaggagaccgaaaatgacagaagcgaacctggcggcagcgcaaaagatg

SEQ ID NO: 188998 - DNA, 103 bp, Artificial Sequence
  Synthetic Polynucleotide
taatacgactcactatagggtgctgtccctaccgtccttttcactccaataacagaggagaattggaatgaaaaggacgaacctggcggcagcgcaaaagatg

SEQ ID NO: 188999 - DNA, 103 bp, Artificial Sequence
  Synthetic Polynucleotide
taatacgactcactatagggtttcagctgtcggcgctcctctcgcttctgaacagaggagacagaagatggaggagcgcaacctggcggcagcgcaaaagatg

SEQ ID NO: 189000 - DNA, 103 bp, Artificial Sequence
  Synthetic Polynucleotide
taatacgactcactatagggccagctgctgtttcagctgtcggcgctcctaacagaggagaaggagcatggacagctgaaacctggcggcagcgcaaaagatg

SEQ ID NO: 189001 - DNA, 103 bp, Artificial Sequence
  Synthetic Polynucleotide
taatacgactcactatagggtgcatgtcctccagctgctgtttcagctgtaacagaggagaacagctatgacagcagctaacctggcggcagcgcaaaagatg

SEQ ID NO: 189002 - DNA, 103 bp, Artificial Sequence
  Synthetic Polynucleotide
taatacgactcactatagggcagctgtttctgcatgtcctccagctgctgaacagaggagacagcagatggaggacatgaacctggcggcagcgcaaaagatg

SEQ ID NO: 189003 - DNA, 103 bp, Artificial Sequence
  Synthetic Polynucleotide
taatacgactcactataggggcagctggcgcagctgtttctgcatgtcctaacagaggagaaggacaatgagaaacagcaacctggcggcagcgcaaaagatg

SEQ ID NO: 189004 - DNA, 103 bp, Artificial Sequence
  Synthetic Polynucleotide
taatacgactcactatagggaacttttcctgcagctggcgcagctgtttcaacagaggagagaaacaatggcgccagctaacctggcggcagcgcaaaagatg

SEQ ID NO: 189005 - DNA, 103 bp, Artificial Sequence
  Synthetic Polynucleotide
taatacgactcactataggggatttggtagaacttttcctgcagctggcgaacagaggagacgccagatgcaggaaaagaacctggcggcagcgcaaaagatg

SEQ ID NO: 189006 - DNA, 103 bp, Artificial Sequence
  Synthetic Polynucleotide
taatacgactcactatagggtgctgtcatagatttggtagaacttttcctaacagaggagaaggaaaatgtctaccaaaaacctggcggcagcgcaaaagatg

SEQ ID NO: 189007 - DNA, 103 bp, Artificial Sequence
  Synthetic Polynucleotide
taatacgactcactatagggtccgaatcagtgctgtcatagatttggtagaacagaggagactaccaatgctatgacagaacctggcggcagcgcaaaagatg

SEQ ID NO: 189008 - DNA, 103 bp, Artificial Sequence
  Synthetic Polynucleotide
taatacgactcactatagggttcatcattttccgaatcagtgctgtcataaacagaggagatatgacatgactgattcgaacctggcggcagcgcaaaagatg

SEQ ID NO: 189009 - DNA, 103 bp, Artificial Sequence
  Synthetic Polynucleotide
taatacgactcactatagggaaaatgcagatgctgtccctaccgtcctttaacagaggagaaaaggaatgtagggacagaacctggcggcagcgcaaaagatg

SEQ ID NO: 189010 - DNA, 103 bp, Artificial Sequence
  Synthetic Polynucleotide
taatacgactcactatagggggttaccatcttcatcattttccgaatcagaacagaggagactgattatgaaaatgatgaacctggcggcagcgcaaaagatg

SEQ ID NO: 189011 - DNA, 103 bp, Artificial Sequence
  Synthetic Polynucleotide
taatacgactcactatagggtcttcagacaggttaccatcttcatcatttaacagaggagaaaatgaatgagatggtaaaacctggcggcagcgcaaaagatg

SEQ ID NO: 189012 - DNA, 103 bp, Artificial Sequence
  Synthetic Polynucleotide
taatacgactcactataggggcgcatgctgtcttcagacaggttaccatcaacagaggagagatggtatgctgtctgaaaacctggcggcagcgcaaaagatg

SEQ ID NO: 189013 - DNA, 103 bp, Artificial Sequence
  Synthetic Polynucleotide
taatacgactcactatagggggatctccgagcgcatgctgtcttcagacaaacagaggagatgtctgatgacagcatgcaacctggcggcagcgcaaaagatg

SEQ ID NO: 189014 - DNA, 103 bp, Artificial Sequence
  Synthetic Polynucleotide
taatacgactcactatagggctggcatccaggatctccgagcgcatgctgaacagaggagacagcatatgctcggagataacctggcggcagcgcaaaagatg

SEQ ID NO: 189015 - DNA, 103 bp, Artificial Sequence
  Synthetic Polynucleotide
taatacgactcactataggggtcctgggccctggcatccaggatctccgaaacagaggagatcggagatgctggatgccaacctggcggcagcgcaaaagatg

SEQ ID NO: 189016 - DNA, 103 bp, Artificial Sequence
  Synthetic Polynucleotide
taatacgactcactatagggttccgacagagtcctgggccctggcatccaaacagaggagatggatgatggggcccaggaacctggcggcagcgcaaaagatg

SEQ ID NO: 189017 - DNA, 103 bp, Artificial Sequence
  Synthetic Polynucleotide
taatacgactcactatagggttatctgaccttccgacagagtcctgggccaacagaggagaggcccaatgctctgtcggaacctggcggcagcgcaaaagatg

SEQ ID NO: 189018 - DNA, 103 bp, Artificial Sequence
  Synthetic Polynucleotide
taatacgactcactataggggcacatctcattatctgaccttccgacagaaacagaggagatctgtcatgaggtcagataacctggcggcagcgcaaaagatg

SEQ ID NO: 189019 - DNA, 103 bp, Artificial Sequence
  Synthetic Polynucleotide
taatacgactcactatagggggtctagctcgcacatctcattatctgaccaacagaggagaggtcagatgatgagatgtaacctggcggcagcgcaaaagatg

SEQ ID NO: 189020 - DNA, 103 bp, Artificial Sequence
  Synthetic Polynucleotide
taatacgactcactataggggccttagcaaaaaatgcagatgctgtccctaacagaggagaagggacatgatctgcattaacctggcggcagcgcaaaagatg

SEQ ID NO: 189021 - DNA, 103 bp, Artificial Sequence
  Synthetic Polynucleotide
taatacgactcactatagggaactgtcctgggtctagctcgcacatctcaaacagaggagatgagatatgcgagctagaaacctggcggcagcgcaaaagatg

SEQ ID NO: 189022 - DNA, 103 bp, Artificial Sequence
  Synthetic Polynucleotide
taatacgactcactatagggtcggtcaataaactgtcctgggtctagctcaacagaggagagagctaatgccaggacagaacctggcggcagcgcaaaagatg

SEQ ID NO: 189023 - DNA, 103 bp, Artificial Sequence
  Synthetic Polynucleotide
taatacgactcactataggggggctcgagctcggtcaataaactgtcctgaacagaggagacaggacatgttattgaccaacctggcggcagcgcaaaagatg

SEQ ID NO: 189024 - DNA, 103 bp, Artificial Sequence
  Synthetic Polynucleotide
taatacgactcactatagggtctctgatcagggctcgagctcggtcaataaacagaggagatattgaatgagctcgagcaacctggcggcagcgcaaaagatg

SEQ ID NO: 189025 - DNA, 103 bp, Artificial Sequence
  Synthetic Polynucleotide
taatacgactcactatagggcatttcctgctctctgatcagggctcgagcaacagaggagagctcgaatgctgatcagaaacctggcggcagcgcaaaagatg

SEQ ID NO: 189026 - DNA, 103 bp, Artificial Sequence
  Synthetic Polynucleotide
taatacgactcactatagggtgttttcagccatttcctgctctctgatcaaacagaggagatgatcaatgagcaggaaaaacctggcggcagcgcaaaagatg

SEQ ID NO: 189027 - DNA, 103 bp, Artificial Sequence
  Synthetic Polynucleotide
taatacgactcactatagggcgcttcggcttgttttcagccatttcctgcaacagaggagagcaggaatgggctgaaaaaacctggcggcagcgcaaaagatg

SEQ ID NO: 189028 - DNA, 103 bp, Artificial Sequence
  Synthetic Polynucleotide
taatacgactcactataggggttgccttctcgcttcggcttgttttcagcaacagaggagagctgaaatgaagccgaagaacctggcggcagcgcaaaagatg

SEQ ID NO: 189029 - DNA, 103 bp, Artificial Sequence
  Synthetic Polynucleotide
taatacgactcactatagggtttctttgttgttgccttctcgcttcggctaacagaggagaagccgaatggagaaggcaaacctggcggcagcgcaaaagatg

SEQ ID NO: 189030 - DNA, 103 bp, Artificial Sequence
  Synthetic Polynucleotide
taatacgactcactatagggccatggtctctttctttgttgttgccttctaacagaggagaagaaggatgcaacaaagaaacctggcggcagcgcaaaagatg

SEQ ID NO: 189031 - DNA, 103 bp, Artificial Sequence
  Synthetic Polynucleotide
taatacgactcactatagggctccagaacgtgcccgtagctggaggtcataacagaggagaatgaccatgagctacgggaacctggcggcagcgcaaaagatg

SEQ ID NO: 189032 - DNA, 103 bp, Artificial Sequence
  Synthetic Polynucleotide
taatacgactcactatagggtagcaggtgactgacggagaagttctttttaacagaggagaaaaaagatgttctccgtcaacctggcggcagcgcaaaagatg

SEQ ID NO: 189033 - DNA, 103 bp, Artificial Sequence
  Synthetic Polynucleotide
taatacgactcactatagggcctccaggtctagcaggtgactgacggagaaacagaggagatctccgatggtcacctgcaacctggcggcagcgcaaaagatg

SEQ ID NO: 189034 - DNA, 103 bp, Artificial Sequence
  Synthetic Polynucleotide
taatacgactcactatagggtccccggcttcctccaggtctagcaggtgaaacagaggagatcacctatgagacctggaaacctggcggcagcgcaaaagatg

SEQ ID NO: 189035 - DNA, 103 bp, Artificial Sequence
  Synthetic Polynucleotide
taatacgactcactatagggcgccaccatgtccccggcttcctccaggtcaacagaggagagacctgatggaagccgggaacctggcggcagcgcaaaagatg

SEQ ID NO: 189036 - DNA, 103 bp, Artificial Sequence
  Synthetic Polynucleotide
taatacgactcactatagggccgcctgtgccgccaccatgtccccggcttaacagaggagaaagccgatgacatggtggaacctggcggcagcgcaaaagatg

SEQ ID NO: 189037 - DNA, 103 bp, Artificial Sequence
  Synthetic Polynucleotide
taatacgactcactatagggacgttctcatccgcctgtgccgccaccatgaacagaggagacatggtatgggcacaggcaacctggcggcagcgcaaaagatg

SEQ ID NO: 189038 - DNA, 103 bp, Artificial Sequence
  Synthetic Polynucleotide
taatacgactcactatagggagcctcgcccacgttctcatccgcctgtgcaacagaggagagcacagatggatgagaacaacctggcggcagcgcaaaagatg

SEQ ID NO: 189039 - DNA, 103 bp, Artificial Sequence
  Synthetic Polynucleotide
taatacgactcactatagggggctccggccagcctcgcccacgttctcataacagaggagaatgagaatgtgggcgaggaacctggcggcagcgcaaaagatg

SEQ ID NO: 189040 - DNA, 103 bp, Artificial Sequence
  Synthetic Polynucleotide
taatacgactcactataggggactccagcaggctccggccagcctcgcccaacagaggagagggcgaatgtggccggagaacctggcggcagcgcaaaagatg

SEQ ID NO: 189041 - DNA, 103 bp, Artificial Sequence
  Synthetic Polynucleotide
taatacgactcactataggggagtcccggcgactccagcaggctccggccaacagaggagaggccggatgctgctggagaacctggcggcagcgcaaaagatg

SEQ ID NO: 189042 - DNA, 103 bp, Artificial Sequence
  Synthetic Polynucleotide
taatacgactcactatagggccggttgccgctccagaacgtgcccgtagcaacagaggagagctacgatgacgttctggaacctggcggcagcgcaaaagatg

SEQ ID NO: 189043 - DNA, 103 bp, Artificial Sequence
  Synthetic Polynucleotide
taatacgactcactatagggtgccgctggtgagtcccggcgactccagcaaacagaggagatgctggatgcgccgggacaacctggcggcagcgcaaaagatg

SEQ ID NO: 189044 - DNA, 103 bp, Artificial Sequence
  Synthetic Polynucleotide
taatacgactcactatagggggggtgtcgctgccgctggtgagtcccggcaacagaggagagccgggatgcaccagcggaacctggcggcagcgcaaaagatg

SEQ ID NO: 189045 - DNA, 103 bp, Artificial Sequence
  Synthetic Polynucleotide
taatacgactcactataggggtcctgctgcggggtgtcgctgccgctggtaacagaggagaaccagcatgagcgacaccaacctggcggcagcgcaaaagatg

SEQ ID NO: 189046 - DNA, 103 bp, Artificial Sequence
  Synthetic Polynucleotide
taatacgactcactataggggctggtcattgtcctgctgcggggtgtcgcaacagaggagagcgacaatgcgcagcaggaacctggcggcagcgcaaaagatg

SEQ ID NO: 189047 - DNA, 103 bp, Artificial Sequence
  Synthetic Polynucleotide
taatacgactcactatagggtctgagttcagctggtcattgtcctgctgcaacagaggagagcagcaatgcaatgaccaaacctggcggcagcgcaaaagatg

SEQ ID NO: 189048 - DNA, 103 bp, Artificial Sequence
  Synthetic Polynucleotide
taatacgactcactatagggctttttttcttctgagttcagctggtcattaacagaggagaaatgacatgctgaactcaaacctggcggcagcgcaaaagatg

SEQ ID NO: 189049 - DNA, 103 bp, Artificial Sequence
  Synthetic Polynucleotide
taatacgactcactataggggctttctcttctttttttcttctgagttcaaacagaggagatgaactatgaagaaaaaaaacctggcggcagcgcaaaagatg

SEQ ID NO: 189050 - DNA, 103 bp, Artificial Sequence
  Synthetic Polynucleotide
taatacgactcactatagggttccttcgctgctttctcttctttttttctaacagaggagaagaaaaatggaagagaaaaacctggcggcagcgcaaaagatg

SEQ ID NO: 189051 - DNA, 103 bp, Artificial Sequence
  Synthetic Polynucleotide
taatacgactcactatagggggttgtcctattccttcgctgctttctcttaacagaggagaaagagaatgcagcgaaggaacctggcggcagcgcaaaagatg

SEQ ID NO: 189052 - DNA, 103 bp, Artificial Sequence
  Synthetic Polynucleotide
taatacgactcactatagggtgctattgaaggttgtcctattccttcgctaacagaggagaagcgaaatgataggacaaaacctggcggcagcgcaaaagatg

SEQ ID NO: 189053 - DNA, 103 bp, Artificial Sequence
  Synthetic Polynucleotide
taatacgactcactatagggccgcccagcgccggttgccgctccagaacgaacagaggagacgttctatggcggcaaccaacctggcggcagcgcaaaagatg

SEQ ID NO: 189054 - DNA, 103 bp, Artificial Sequence
  Synthetic Polynucleotide
taatacgactcactatagggtgcagctggctgctattgaaggttgtcctaaacagaggagataggacatgcttcaatagaacctggcggcagcgcaaaagatg

SEQ ID NO: 189055 - DNA, 103 bp, Artificial Sequence
  Synthetic Polynucleotide
taatacgactcactatagggctccaaagcctgcagctggctgctattgaaaacagaggagattcaatatgagccagctgaacctggcggcagcgcaaaagatg

SEQ ID NO: 189056 - DNA, 103 bp, Artificial Sequence
  Synthetic Polynucleotide
taatacgactcactatagggcaaagacacgctccaaagcctgcagctggcaacagaggagagccagcatgaggctttggaacctggcggcagcgcaaaagatg

SEQ ID NO: 189057 - DNA, 103 bp, Artificial Sequence
  Synthetic Polynucleotide
taatacgactcactatagggtgtgtccgctcaaagacacgctccaaagccaacagaggagaggctttatggcgtgtcttaacctggcggcagcgcaaaagatg

SEQ ID NO: 189058 - DNA, 103 bp, Artificial Sequence
  Synthetic Polynucleotide
taatacgactcactatagggatcaggatagtgtgtccgctcaaagacacgaacagaggagacgtgtcatggagcggacaaacctggcggcagcgcaaaagatg

SEQ ID NO: 189059 - DNA, 103 bp, Artificial Sequence
  Synthetic Polynucleotide
taatacgactcactataggggcacaaaagcatcaggatagtgtgtccgctaacagaggagaagcggaatgactatcctgaacctggcggcagcgcaaaagatg

SEQ ID NO: 189060 - DNA, 103 bp, Artificial Sequence
  Synthetic Polynucleotide
taatacgactcactatagggaggtcttctcgcacaaaagcatcaggatagaacagaggagactatccatgtgcttttgtaacctggcggcagcgcaaaagatg

SEQ ID NO: 189061 - DNA, 103 bp, Artificial Sequence
  Synthetic Polynucleotide
taatacgactcactatagggccggcgggcaaggtcttctcgcacaaaagcaacagaggagagcttttatgcgagaagacaacctggcggcagcgcaaaagatg

SEQ ID NO: 189062 - DNA, 103 bp, Artificial Sequence
  Synthetic Polynucleotide
taatacgactcactatagggtgaggttcacccggcgggcaaggtcttctcaacagaggagagagaagatgttgcccgccaacctggcggcagcgcaaaagatg

SEQ ID NO: 189063 - DNA, 103 bp, Artificial Sequence
  Synthetic Polynucleotide
taatacgactcactatagggctcgcctcggtgaggttcacccggcgggcaaacagaggagatgcccgatgggtgaacctaacctggcggcagcgcaaaagatg

SEQ ID NO: 189064 - DNA, 103 bp, Artificial Sequence
  Synthetic Polynucleotide
taatacgactcactataggggtccaagcggccgcccagcgccggttgccgaacagaggagacggcaaatggcgctgggcaacctggcggcagcgcaaaagatg

SEQ ID NO: 189065 - DNA, 103 bp, Artificial Sequence
  Synthetic Polynucleotide
taatacgactcactatagggcacctgcactctcgcctcggtgaggttcacaacagaggagagtgaacatgaccgaggcgaacctggcggcagcgcaaaagatg

SEQ ID NO: 189066 - DNA, 103 bp, Artificial Sequence
  Synthetic Polynucleotide
taatacgactcactatagggtctgaaaccacacctgcactctcgcctcggaacagaggagaccgaggatggagtgcaggaacctggcggcagcgcaaaagatg

SEQ ID NO: 189067 - DNA, 103 bp, Artificial Sequence
  Synthetic Polynucleotide
taatacgactcactataggggctcttcggttctgaaaccacacctgcactaacagaggagaagtgcaatggtggtttcaaacctggcggcagcgcaaaagatg

SEQ ID NO: 189068 - DNA, 103 bp, Artificial Sequence
  Synthetic Polynucleotide
taatacgactcactataggggcggaacttggctcttcggttctgaaaccaaacagaggagatggtttatgaaccgaagaaacctggcggcagcgcaaaagatg

SEQ ID NO: 189069 - DNA, 103 bp, Artificial Sequence
  Synthetic Polynucleotide
taatacgactcactatagggtctcattcctgcggaacttggctcttcggtaacagaggagaaccgaaatgccaagttccaacctggcggcagcgcaaaagatg

SEQ ID NO: 189070 - DNA, 103 bp, Artificial Sequence
  Synthetic Polynucleotide
taatacgactcactatagggagcatggctctctcattcctgcggaacttgaacagaggagacaagttatgcaggaatgaaacctggcggcagcgcaaaagatg

SEQ ID NO: 189071 - DNA, 103 bp, Artificial Sequence
  Synthetic Polynucleotide
taatacgactcactatagggtttattggctagcatggctctctcattcctaacagaggagaaggaatatgagagccatgaacctggcggcagcgcaaaagatg

SEQ ID NO: 189072 - DNA, 103 bp, Artificial Sequence
  Synthetic Polynucleotide
taatacgactcactataggggggaagcgtttttattggctagcatggctcaacagaggagagagccaatgtagccaataaacctggcggcagcgcaaaagatg

SEQ ID NO: 189073 - DNA, 103 bp, Artificial Sequence
  Synthetic Polynucleotide
taatacgactcactataggggatttgaggagggaagcgtttttattggctaacagaggagaagccaaatgaaacgcttcaacctggcggcagcgcaaaagatg

SEQ ID NO: 189074 - DNA, 103 bp, Artificial Sequence
  Synthetic Polynucleotide
taatacgactcactatagggtcctgagtaggatttgaggagggaagcgttaacagaggagaaacgctatgctcctcaaaaacctggcggcagcgcaaaagatg

SEQ ID NO: 189075 - DNA, 103 bp, Artificial Sequence
  Synthetic Polynucleotide
taatacgactcactatagggtgcccgggctgtccaagcggccgcccagcgaacagaggagacgctggatggccgcttggaacctggcggcagcgcaaaagatg

SEQ ID NO: 189076 - DNA, 103 bp, Artificial Sequence
  Synthetic Polynucleotide
taatacgactcactatagggcagtcacgtctcctgagtaggatttgaggaaacagaggagatcctcaatgcctactcagaacctggcggcagcgcaaaagatg

SEQ ID NO: 189077 - DNA, 103 bp, Artificial Sequence
  Synthetic Polynucleotide
taatacgactcactatagggtgctccacagcagtcacgtctcctgagtagaacagaggagactactcatgagacgtgacaacctggcggcagcgcaaaagatg

SEQ ID NO: 189078 - DNA, 103 bp, Artificial Sequence
  Synthetic Polynucleotide
taatacgactcactatagggtacgatgggctgctccacagcagtcacgtcaacagaggagagacgtgatggctgtggagaacctggcggcagcgcaaaagatg

SEQ ID NO: 189079 - DNA, 103 bp, Artificial Sequence
  Synthetic Polynucleotide
taatacgactcactatagggcaggacgaggtacgatgggctgctccacagaacagaggagactgtggatgagcccatcgaacctggcggcagcgcaaaagatg

SEQ ID NO: 189080 - DNA, 103 bp, Artificial Sequence
  Synthetic Polynucleotide
taatacgactcactatagggggtctcggagcaggacgaggtacgatgggcaacagaggagagcccatatgacctcgtccaacctggcggcagcgcaaaagatg

SEQ ID NO: 189081 - DNA, 103 bp, Artificial Sequence
  Synthetic Polynucleotide
taatacgactcactatagggataatcggtgggtctcggagcaggacgaggaacagaggagacctcgtatggctccgagaaacctggcggcagcgcaaaagatg

SEQ ID NO: 189082 - DNA, 103 bp, Artificial Sequence
  Synthetic Polynucleotide
taatacgactcactatagggcccaggagagataatcggtgggtctcggagaacagaggagactccgaatgccaccgattaacctggcggcagcgcaaaagatg

SEQ ID NO: 189083 - DNA, 103 bp, Artificial Sequence
  Synthetic Polynucleotide
taatacgactcactataggggacgctgtcccccaggagagataatcggtgaacagaggagacaccgaatgtctctcctgaacctggcggcagcgcaaaagatg

SEQ ID NO: 189084 - DNA, 103 bp, Artificial Sequence
  Synthetic Polynucleotide
taatacgactcactataggggctgtacggagacgctgtcccccaggagagaacagaggagactctccatggggacagcgaacctggcggcagcgcaaaagatg

SEQ ID NO: 189085 - DNA, 103 bp, Artificial Sequence
  Synthetic Polynucleotide
taatacgactcactatagggtagccatggcgctgtacggagacgctgtccaacagaggagaggacagatgctccgtacaaacctggcggcagcgcaaaagatg

SEQ ID NO: 189086 - DNA, 103 bp, Artificial Sequence
  Synthetic Polynucleotide
taatacgactcactataggggtgtcgaggttgcccgggctgtccaagcggaacagaggagaccgcttatgcagcccgggaacctggcggcagcgcaaaagatg

SEQ ID NO: 189087 - DNA, 103 bp, Artificial Sequence
  Synthetic Polynucleotide
taatacgactcactataggggcagaataagtagccatggcgctgtacggaaacagaggagatccgtaatgcgccatggcaacctggcggcagcgcaaaagatg

SEQ ID NO: 189088 - DNA, 103 bp, Artificial Sequence
  Synthetic Polynucleotide
taatacgactcactatagggggcacatgtggcagaataagtagccatggcaacagaggagagccatgatgacttattctaacctggcggcagcgcaaaagatg

SEQ ID NO: 189089 - DNA, 103 bp, Artificial Sequence
  Synthetic Polynucleotide
taatacgactcactatagggggctattgttggcacatgtggcagaataagaacagaggagacttattatgccacatgtgaacctggcggcagcgcaaaagatg

SEQ ID NO: 189090 - DNA, 103 bp, Artificial Sequence
  Synthetic Polynucleotide
taatacgactcactatagggccctgtgcagggctattgttggcacatgtgaacagaggagacacatgatgcaacaatagaacctggcggcagcgcaaaagatg

SEQ ID NO: 189091 - DNA, 103 bp, Artificial Sequence
  Synthetic Polynucleotide
taatacgactcactatagggcatgttgatgccctgtgcagggctattgttaacagaggagaaacaatatgcctgcacagaacctggcggcagcgcaaaagatg

SEQ ID NO: 189092 - DNA, 103 bp, Artificial Sequence
  Synthetic Polynucleotide
taatacgactcactatagggtgctgttggccatgttgatgccctgtgcagaacagaggagactgcacatggcatcaacaaacctggcggcagcgcaaaagatg

SEQ ID NO: 189093 - DNA, 103 bp, Artificial Sequence
  Synthetic Polynucleotide
taatacgactcactatagggaggttggcaatgctgttggccatgttgatgaacagaggagacatcaaatgggccaacagaacctggcggcagcgcaaaagatg

SEQ ID NO: 189094 - DNA, 103 bp, Artificial Sequence
  Synthetic Polynucleotide
taatacgactcactatagggcttcagtctcaggttggcaatgctgttggcaacagaggagagccaacatgattgccaacaacctggcggcagcgcaaaagatg

SEQ ID NO: 189095 - DNA, 103 bp, Artificial Sequence
  Synthetic Polynucleotide
taatacgactcactatagggattccttggccttcagtctcaggttggcaaaacagaggagattgccaatgtgagactgaaacctggcggcagcgcaaaagatg

SEQ ID NO: 189096 - DNA, 103 bp, Artificial Sequence
  Synthetic Polynucleotide
taatacgactcactatagggtgtaaactatattccttggccttcagtctcaacagaggagagagactatgggccaaggaaacctggcggcagcgcaaaagatg

SEQ ID NO: 189097 - DNA, 103 bp, Artificial Sequence
  Synthetic Polynucleotide
taatacgactcactatagggcgcctgcagggtgtcgaggttgcccgggctaacagaggagaagcccgatgaacctcgacaacctggcggcagcgcaaaagatg

SEQ ID NO: 189098 - DNA, 103 bp, Artificial Sequence
  Synthetic Polynucleotide
taatacgactcactatagggctggttcctctgtaaactatattccttggcaacagaggagagccaagatgtatagtttaaacctggcggcagcgcaaaagatg

SEQ ID NO: 189099 - DNA, 103 bp, Artificial Sequence
  Synthetic Polynucleotide
taatacgactcactatagggctgttggcacctggttcctctgtaaactataacagaggagaatagttatgagaggaaccaacctggcggcagcgcaaaagatg

SEQ ID NO: 189100 - DNA, 103 bp, Artificial Sequence
  Synthetic Polynucleotide
taatacgactcactatagggagttctttttcgcctgcagggtgtcgaggtaacagaggagaacctcgatgccctgcaggaacctggcggcagcgcaaaagatg

SEQ ID NO: 189101 - DNA, 103 bp, Artificial Sequence
  Synthetic Polynucleotide
taatacgactcactatagggctgacggagaagttctttttcgcctgcaggaacagaggagacctgcaatggaaaaagaaaacctggcggcagcgcaaaagatg

SEQ ID NO: 189102 - DNA, 103 bp, Artificial Sequence
  Synthetic Polynucleotide
taatacgactcactatagggcacttgcttcaggtttcctcttaacatcataacagaggagaatgatgatgagaggaaacaacctggcggcagcgcaaaagatg

SEQ ID NO: 189103 - DNA, 103 bp, Artificial Sequence
  Synthetic Polynucleotide
taatacgactcactatagggagcgagcgccatggctgccgcggccgccggaacagaggagaccggcgatggcggcagccaacctggcggcagcgcaaaagatg

SEQ ID NO: 189104 - DNA, 103 bp, Artificial Sequence
  Synthetic Polynucleotide
taatacgactcactatagggttggtttctgagttcttccaagcgtctgagaacagaggagactcagaatgttggaagaaaacctggcggcagcgcaaaagatg

SEQ ID NO: 189105 - DNA, 103 bp, Artificial Sequence
  Synthetic Polynucleotide
taatacgactcactatagggtttgcaactcttggtttctgagttcttccaaacagaggagatggaagatgtcagaaaccaacctggcggcagcgcaaaagatg

SEQ ID NO: 189106 - DNA, 103 bp, Artificial Sequence
  Synthetic Polynucleotide
taatacgactcactatagggtgcttccgtttttgcaactcttggtttctgaacagaggagacagaaaatgagagttgcaaacctggcggcagcgcaaaagatg

SEQ ID NO: 189107 - DNA, 103 bp, Artificial Sequence
  Synthetic Polynucleotide
taatacgactcactatagggtagttgtatttgcttccgtttttgcaactcaacagaggagagagttgatgaaacggaagaacctggcggcagcgcaaaagatg

SEQ ID NO: 189108 - DNA, 103 bp, Artificial Sequence
  Synthetic Polynucleotide
taatacgactcactatagggcttcatgtcttagttgtatttgcttccgttaacagaggagaaacggaatgaaatacaacaacctggcggcagcgcaaaagatg

SEQ ID NO: 189109 - DNA, 103 bp, Artificial Sequence
  Synthetic Polynucleotide
taatacgactcactatagggcgatgctcctcttcatgtcttagttgtattaacagaggagaaatacaatgaagacatgaaacctggcggcagcgcaaaagatg

SEQ ID NO: 189110 - DNA, 103 bp, Artificial Sequence
  Synthetic Polynucleotide
taatacgactcactatagggctcacgccgccgatgctcctcttcatgtctaacagaggagaagacatatggaggagcataacctggcggcagcgcaaaagatg

SEQ ID NO: 189111 - DNA, 103 bp, Artificial Sequence
  Synthetic Polynucleotide
taatacgactcactatagggtcatttcttcctcacgccgccgatgctcctaacagaggagaaggagcatgggcggcgtgaacctggcggcagcgcaaaagatg

SEQ ID NO: 189112 - DNA, 103 bp, Artificial Sequence
  Synthetic Polynucleotide
taatacgactcactatagggctgtgtcggatcatttcttcctcacgccgcaacagaggagagcggcgatgggaagaaataacctggcggcagcgcaaaagatg

SEQ ID NO: 189113 - DNA, 103 bp, Artificial Sequence
  Synthetic Polynucleotide
taatacgactcactatagggctcctgttctctgtgtcggatcatttcttcaacagaggagagaagaaatgatccgacacaacctggcggcagcgcaaaagatg

SEQ ID NO: 189114 - DNA, 103 bp, Artificial Sequence
  Synthetic Polynucleotide
taatacgactcactatagggccccggcaagagcgagcgccatggctgccgaacagaggagacggcagatgtggcgctcgaacctggcggcagcgcaaaagatg

SEQ ID NO: 189115 - DNA, 103 bp, Artificial Sequence
  Synthetic Polynucleotide
taatacgactcactataggggcctcagttcctcctgttctctgtgtcggaaacagaggagatccgacatggagaacaggaacctggcggcagcgcaaaagatg

SEQ ID NO: 189116 - DNA, 103 bp, Artificial Sequence
  Synthetic Polynucleotide
taatacgactcactatagggtcttgctgtcgcctcagttcctcctgttctaacagaggagaagaacaatgggaactgagaacctggcggcagcgcaaaagatg

SEQ ID NO: 189117 - DNA, 103 bp, Artificial Sequence
  Synthetic Polynucleotide
taatacgactcactatagggcttaaagccctcttgctgtcgcctcagttcaacagaggagagaactgatgcgacagcaaaacctggcggcagcgcaaaagatg

SEQ ID NO: 189118 - DNA, 103 bp, Artificial Sequence
  Synthetic Polynucleotide
taatacgactcactatagggtgtagtttggcttaaagccctcttgctgtcaacagaggagagacagcatgagggctttaaacctggcggcagcgcaaaagatg

SEQ ID NO: 189119 - DNA, 103 bp, Artificial Sequence
  Synthetic Polynucleotide
taatacgactcactatagggctattttccatgtagtttggcttaaagcccaacagaggagagggcttatggccaaactaaacctggcggcagcgcaaaagatg

SEQ ID NO: 189120 - DNA, 103 bp, Artificial Sequence
  Synthetic Polynucleotide
taatacgactcactatagggttcctgttctctattttccatgtagtttggaacagaggagaccaaacatgatggaaaataacctggcggcagcgcaaaagatg

SEQ ID NO: 189121 - DNA, 103 bp, Artificial Sequence
  Synthetic Polynucleotide
taatacgactcactatagggccattctcatttcctgttctctattttccaaacagaggagatggaaaatggagaacaggaacctggcggcagcgcaaaagatg

SEQ ID NO: 189122 - DNA, 103 bp, Artificial Sequence
  Synthetic Polynucleotide
taatacgactcactatagggcccatatcacccattctcatttcctgttctaacagaggagaagaacaatgaatgagaataacctggcggcagcgcaaaagatg

SEQ ID NO: 189123 - DNA, 103 bp, Artificial Sequence
  Synthetic Polynucleotide
taatacgactcactatagggtccacggggacccatatcacccattctcataacagaggagaatgagaatgggtgatatgaacctggcggcagcgcaaaagatg

SEQ ID NO: 189124 - DNA, 103 bp, Artificial Sequence
  Synthetic Polynucleotide
taatacgactcactatagggtgtttattgctccacggggacccatatcacaacagaggagagtgataatggtccccgtgaacctggcggcagcgcaaaagatg

SEQ ID NO: 189125 - DNA, 103 bp, Artificial Sequence
  Synthetic Polynucleotide
taatacgactcactatagggggtgccggctccccggcaagagcgagcgccaacagaggagaggcgctatgtcttgccggaacctggcggcagcgcaaaagatg

SEQ ID NO: 189126 - DNA, 103 bp, Artificial Sequence
  Synthetic Polynucleotide
taatacgactcactataggggcatctcccatgtttattgctccacggggaaacagaggagatccccgatgagcaataaaaacctggcggcagcgcaaaagatg

SEQ ID NO: 189127 - DNA, 103 bp, Artificial Sequence
  Synthetic Polynucleotide
taatacgactcactatagggtgggctaaacgcatctcccatgtttattgcaacagaggagagcaataatgatgggagataacctggcggcagcgcaaaagatg

SEQ ID NO: 189128 - DNA, 103 bp, Artificial Sequence
  Synthetic Polynucleotide
taatacgactcactatagggcagcaggggctgggctaaacgcatctcccaaacagaggagatgggagatgcgtttagccaacctggcggcagcgcaaaagatg

SEQ ID NO: 189129 - DNA, 103 bp, Artificial Sequence
  Synthetic Polynucleotide
taatacgactcactatagggccttggttaccagcaggggctgggctaaacaacagaggagagtttagatgagcccctgcaacctggcggcagcgcaaaagatg

SEQ ID NO: 189130 - DNA, 103 bp, Artificial Sequence
  Synthetic Polynucleotide
taatacgactcactatagggtggaggaggaccttggttaccagcaggggcaacagaggagagcccctatgggtaaccaaaacctggcggcagcgcaaaagatg

SEQ ID NO: 189131 - DNA, 103 bp, Artificial Sequence
  Synthetic Polynucleotide
taatacgactcactatagggtacccatcattggaggaggaccttggttacaacagaggagagtaaccatggtcctcctcaacctggcggcagcgcaaaagatg

SEQ ID NO: 189132 - DNA, 103 bp, Artificial Sequence
  Synthetic Polynucleotide
taatacgactcactatagggttcatattcatacccatcattggaggaggaaacagaggagatcctccatgaatgatgggaacctggcggcagcgcaaaagatg

SEQ ID NO: 189133 - DNA, 103 bp, Artificial Sequence
  Synthetic Polynucleotide
taatacgactcactatagggtgctctgttgttcatattcatacccatcataacagaggagaatgatgatgatgaatatgaacctggcggcagcgcaaaagatg

SEQ ID NO: 189134 - DNA, 103 bp, Artificial Sequence
  Synthetic Polynucleotide
taatacgactcactatagggcaggtatagttgctctgttgttcatattcaaacagaggagatgaataatgacaacagagaacctggcggcagcgcaaaagatg

SEQ ID NO: 189135 - DNA, 103 bp, Artificial Sequence
  Synthetic Polynucleotide
taatacgactcactatagggattggtgggccaggtatagttgctctgttgaacagaggagacaacagatgaactataccaacctggcggcagcgcaaaagatg

SEQ ID NO: 189136 - DNA, 103 bp, Artificial Sequence
  Synthetic Polynucleotide
taatacgactcactataggggggcgcgggcggtgccggctccccggcaagaacagaggagacttgccatggagccggcaaacctggcggcagcgcaaaagatg

SEQ ID NO: 189137 - DNA, 103 bp, Artificial Sequence
  Synthetic Polynucleotide
taatacgactcactatagggaccaggacccattggtgggccaggtatagtaacagaggagaactataatgggcccaccaaacctggcggcagcgcaaaagatg

SEQ ID NO: 189138 - DNA, 103 bp, Artificial Sequence
  Synthetic Polynucleotide
taatacgactcactatagggccatggcaggaccaggacccattggtgggcaacagaggagagcccacatgtgggtcctgaacctggcggcagcgcaaaagatg

SEQ ID NO: 189139 - DNA, 103 bp, Artificial Sequence
  Synthetic Polynucleotide
taatacgactcactatagggccttctggtcccatggcaggaccaggacccaacagaggagagggtccatgtcctgccataacctggcggcagcgcaaaagatg

SEQ ID NO: 189140 - DNA, 103 bp, Artificial Sequence
  Synthetic Polynucleotide
taatacgactcactatagggatttgcggctccttctggtcccatggcaggaacagaggagacctgccatgggaccagaaaacctggcggcagcgcaaaagatg

SEQ ID NO: 189141 - DNA, 103 bp, Artificial Sequence
  Synthetic Polynucleotide
taatacgactcactataggggagttcccatatttgcggctccttctggtcaacagaggagagaccagatggagccgcaaaacctggcggcagcgcaaaagatg

SEQ ID NO: 189142 - DNA, 103 bp, Artificial Sequence
  Synthetic Polynucleotide
taatacgactcactatagggggcatcattggagttcccatatttgcggctaacagaggagaagccgcatgtatgggaacaacctggcggcagcgcaaaagatg

SEQ ID NO: 189143 - DNA, 103 bp, Artificial Sequence
  Synthetic Polynucleotide
taatacgactcactatagggtccattatctggcatcattggagttcccataacagaggagaatgggaatgccaatgatgaacctggcggcagcgcaaaagatg

SEQ ID NO: 189144 - DNA, 103 bp, Artificial Sequence
  Synthetic Polynucleotide
taatacgactcactatagggtgtgcactgctccattatctggcatcattgaacagaggagacaatgaatgcagataatgaacctggcggcagcgcaaaagatg

SEQ ID NO: 189145 - DNA, 103 bp, Artificial Sequence
  Synthetic Polynucleotide
taatacgactcactatagggaatctgtcattgtgcactgctccattatctaacagaggagaagataaatgagcagtgcaaacctggcggcagcgcaaaagatg

SEQ ID NO: 189146 - DNA, 103 bp, Artificial Sequence
  Synthetic Polynucleotide
taatacgactcactatagggtccttgaggaaatctgtcattgtgcactgcaacagaggagagcagtgatgaatgacagaaacctggcggcagcgcaaaagatg

SEQ ID NO: 189147 - DNA, 103 bp, Artificial Sequence
  Synthetic Polynucleotide
taatacgactcactatagggctggaggcgcgggcgcgggcggtgccggctaacagaggagaagccggatgcgcccgcgcaacctggcggcagcgcaaaagatg

SEQ ID NO: 189148 - DNA, 103 bp, Artificial Sequence
  Synthetic Polynucleotide
taatacgactcactataggggagatggtggtccttgaggaaatctgtcataacagaggagaatgacaatgttcctcaagaacctggcggcagcgcaaaagatg

SEQ ID NO: 189149 - DNA, 103 bp, Artificial Sequence
  Synthetic Polynucleotide
taatacgactcactataggggaacccatctgagatggtggtccttgaggaaacagaggagatcctcaatgaccaccatcaacctggcggcagcgcaaaagatg

SEQ ID NO: 189150 - DNA, 103 bp, Artificial Sequence
  Synthetic Polynucleotide
taatacgactcactatagggccccataggtgaacccatctgagatggtggaacagaggagaccaccaatgcagatgggtaacctggcggcagcgcaaaagatg

SEQ ID NO: 189151 - DNA, 103 bp, Artificial Sequence
  Synthetic Polynucleotide
taatacgactcactatagggctgttctactccccataggtgaacccatctaacagaggagaagatggatgcacctatggaacctggcggcagcgcaaaagatg

SEQ ID NO: 189152 - DNA, 103 bp, Artificial Sequence
  Synthetic Polynucleotide
taatacgactcactataggggtttcagaacctgttctactccccataggtaacagaggagaacctatatggagtagaacaacctggcggcagcgcaaaagatg

SEQ ID NO: 189153 - DNA, 103 bp, Artificial Sequence
  Synthetic Polynucleotide
taatacgactcactatagggtgcttgaggggtttcagaacctgttctactaacagaggagaagtagaatgggttctgaaaacctggcggcagcgcaaaagatg

SEQ ID NO: 189154 - DNA, 103 bp, Artificial Sequence
  Synthetic Polynucleotide
taatacgactcactatagggcactcattggtgcttgaggggtttcagaacaacagaggagagttctgatgcccctcaagaacctggcggcagcgcaaaagatg

SEQ ID NO: 189155 - DNA, 103 bp, Artificial Sequence
  Synthetic Polynucleotide
taatacgactcactatagggggacctacaccactcattggtgcttgagggaacagaggagaccctcaatgaccaatgagaacctggcggcagcgcaaaagatg

SEQ ID NO: 189156 - DNA, 103 bp, Artificial Sequence
  Synthetic Polynucleotide
taatacgactcactatagggaccactcacaggacctacaccactcattggaacagaggagaccaatgatgggtgtaggtaacctggcggcagcgcaaaagatg

SEQ ID NO: 189157 - DNA, 103 bp, Artificial Sequence
  Synthetic Polynucleotide
taatacgactcactatagggcaccaggaccaccactcacaggacctacacaacagaggagagtgtagatgctgtgagtgaacctggcggcagcgcaaaagatg

SEQ ID NO: 189158 - DNA, 103 bp, Artificial Sequence
  Synthetic Polynucleotide
taatacgactcactataggggggtggtcctctggaggcgcgggcgcgggcaacagaggagagcccgcatgcgcgcctccaacctggcggcagcgcaaaagatg

SEQ ID NO: 189159 - DNA, 103 bp, Artificial Sequence
  Synthetic Polynucleotide
taatacgactcactatagggctaccaaagccaccaggaccaccactcacaaacagaggagatgtgagatgtggtcctggaacctggcggcagcgcaaaagatg

SEQ ID NO: 189160 - DNA, 103 bp, Artificial Sequence
  Synthetic Polynucleotide
taatacgactcactatagggttgacttcctctaccaaagccaccaggaccaacagaggagaggtcctatgggctttggtaacctggcggcagcgcaaaagatg

SEQ ID NO: 189161 - DNA, 103 bp, Artificial Sequence
  Synthetic Polynucleotide
taatacgactcactatagggagttgcccccttgacttcctctaccaaagcaacagaggagagctttgatggaggaagtcaacctggcggcagcgcaaaagatg

SEQ ID NO: 189162 - DNA, 103 bp, Artificial Sequence
  Synthetic Polynucleotide
taatacgactcactataggggggccttcaaagttgcccccttgacttcctaacagaggagaaggaagatgagggggcaaaacctggcggcagcgcaaaagatg

SEQ ID NO: 189163 - DNA, 103 bp, Artificial Sequence
  Synthetic Polynucleotide
taatacgactcactatagggacgcttattagggccttcaaagttgcccccaacagaggagagggggcatgtttgaaggcaacctggcggcagcgcaaaagatg

SEQ ID NO: 189164 - DNA, 103 bp, Artificial Sequence
  Synthetic Polynucleotide
taatacgactcactatagggaatatctacgacgcttattagggccttcaaaacagaggagattgaagatgctaataagcaacctggcggcagcgcaaaagatg

SEQ ID NO: 189165 - DNA, 103 bp, Artificial Sequence
  Synthetic Polynucleotide
taatacgactcactatagggctcctcgtccgggtggtcctctggaggcgcaacagaggagagcgcctatggaggaccacaacctggcggcagcgcaaaagatg

SEQ ID NO: 189166 - DNA, 103 bp, Artificial Sequence
  Synthetic Polynucleotide
taatacgactcactatagggtgaaccccatctcctcgtccgggtggtcctaacagaggagaaggaccatgcggacgaggaacctggcggcagcgcaaaagatg

SEQ ID NO: 189167 - DNA, 103 bp, Artificial Sequence
  Synthetic Polynucleotide
taatacgactcactatagggatgtcgatagtgaaccccatctcctcgtccaacagaggagaggacgaatggatggggttaacctggcggcagcgcaaaagatg

SEQ ID NO: 189168 - DNA, 103 bp, Artificial Sequence
  Synthetic Polynucleotide
taatacgactcactataggggaaactcttgatgtcgatagtgaaccccataacagaggagaatggggatgactatcgacaacctggcggcagcgcaaaagatg

SEQ ID NO: 189169 - DNA, 103 bp, Artificial Sequence
  Synthetic Polynucleotide
taatacgactcactatagggtctcaatgcgcacttgcttcaggtttcctcaacagaggagagaggaaatgtgaagcaagaacctggcggcagcgcaaaagatg

SEQ ID NO: 189170 - DNA, 103 bp, Artificial Sequence
  Synthetic Polynucleotide
taatacgactcactatagggccggcttgaggaaactcttgatgtcgatagaacagaggagactatcgatgtcaagagttaacctggcggcagcgcaaaagatg

SEQ ID NO: 189171 - DNA, 103 bp, Artificial Sequence
  Synthetic Polynucleotide
taatacgactcactataggggtcttctcgcccggcttgaggaaactcttgaacagaggagacaagagatgcctcaagccaacctggcggcagcgcaaaagatg

SEQ ID NO: 189172 - DNA, 103 bp, Artificial Sequence
  Synthetic Polynucleotide
taatacgactcactatagggctgcgtgtacgtcttctcgcccggcttgagaacagaggagactcaagatgggcgagaagaacctggcggcagcgcaaaagatg

SEQ ID NO: 189173 - DNA, 103 bp, Artificial Sequence
  Synthetic Polynucleotide
taatacgactcactatagggggcggcagcgctgcgtgtacgtcttctcgcaacagaggagagcgagaatgcgtacacgcaacctggcggcagcgcaaaagatg

SEQ ID NO: 189174 - DNA, 103 bp, Artificial Sequence
  Synthetic Polynucleotide
taatacgactcactatagggcccacgaagaggcggcagcgctgcgtgtacaacagaggagagtacacatggcgctgccgaacctggcggcagcgcaaaagatg

SEQ ID NO: 189175 - DNA, 103 bp, Artificial Sequence
  Synthetic Polynucleotide
taatacgactcactataggggggcagatttcccacgaagaggcggcagcgaacagaggagacgctgcatgctcttcgtgaacctggcggcagcgcaaaagatg

SEQ ID NO: 189176 - DNA, 103 bp, Artificial Sequence
  Synthetic Polynucleotide
taatacgactcactatagggtgatgtcggtgggcagatttcccacgaagaaacagaggagatcttcgatggaaatctgcaacctggcggcagcgcaaaagatg

SEQ ID NO: 189177 - DNA, 103 bp, Artificial Sequence
  Synthetic Polynucleotide
taatacgactcactatagggtcctcctccgtgatgtcggtgggcagatttaacagaggagaaaatctatgcaccgacataacctggcggcagcgcaaaagatg

SEQ ID NO: 189178 - DNA, 103 bp, Artificial Sequence
  Synthetic Polynucleotide
taatacgactcactatagggcctcttgaagtcctcctccgtgatgtcggtaacagaggagaaccgacatgacggaggagaacctggcggcagcgcaaaagatg

SEQ ID NO: 189179 - DNA, 103 bp, Artificial Sequence
  Synthetic Polynucleotide
taatacgactcactataggggttcgaagagcctcttgaagtcctcctccgaacagaggagacggaggatgacttcaagaaacctggcggcagcgcaaaagatg

SEQ ID NO: 189180 - DNA, 103 bp, Artificial Sequence
  Synthetic Polynucleotide
taatacgactcactataggggccgggtttttctcaatgcgcacttgcttcaacagaggagagaagcaatggcgcattgaaacctggcggcagcgcaaaagatg

SEQ ID NO: 189181 - DNA, 103 bp, Artificial Sequence
  Synthetic Polynucleotide
taatacgactcactatagggtcgccatagcgttcgaagagcctcttgaagaacagaggagacttcaaatggctcttcgaaacctggcggcagcgcaaaagatg

SEQ ID NO: 189182 - DNA, 103 bp, Artificial Sequence
  Synthetic Polynucleotide
taatacgactcactatagggttcgctgggctcgccatagcgttcgaagagaacagaggagactcttcatgcgctatggcaacctggcggcagcgcaaaagatg

SEQ ID NO: 189183 - DNA, 103 bp, Artificial Sequence
  Synthetic Polynucleotide
taatacgactcactatagggtgatgaagacttcgctgggctcgccatagcaacagaggagagctatgatgagcccagcgaacctggcggcagcgcaaaagatg

SEQ ID NO: 189184 - DNA, 103 bp, Artificial Sequence
  Synthetic Polynucleotide
taatacgactcactatagggcggtcccggttgatgaagacttcgctgggcaacagaggagagcccagatgagtcttcataacctggcggcagcgcaaaagatg

SEQ ID NO: 189185 - DNA, 103 bp, Artificial Sequence
  Synthetic Polynucleotide
taatacgactcactataggggccgaagccacggtcccggttgatgaagacaacagaggagagtcttcatgaaccgggacaacctggcggcagcgcaaaagatg

SEQ ID NO: 189186 - DNA, 103 bp, Artificial Sequence
  Synthetic Polynucleotide
taatacgactcactatagggagcggatgaagccgaagccacggtcccggtaacagaggagaaccgggatggtggcttcgaacctggcggcagcgcaaaagatg

SEQ ID NO: 189187 - DNA, 103 bp, Artificial Sequence
  Synthetic Polynucleotide
taatacgactcactatagggctggattccaagcggatgaagccgaagccaaacagaggagatggcttatgcttcatccgaacctggcggcagcgcaaaagatg

SEQ ID NO: 189188 - DNA, 103 bp, Artificial Sequence
  Synthetic Polynucleotide
taatacgactcactatagggagccagggttctggattccaagcggatgaaaacagaggagattcatcatgttggaatccaacctggcggcagcgcaaaagatg

SEQ ID NO: 189189 - DNA, 103 bp, Artificial Sequence
  Synthetic Polynucleotide
taatacgactcactatagggttgcaatttcagccagggttctggattccaaacagaggagatggaatatggaaccctggaacctggcggcagcgcaaaagatg

SEQ ID NO: 189190 - DNA, 103 bp, Artificial Sequence
  Synthetic Polynucleotide
taatacgactcactatagggagctctgcttttgcaatttcagccagggttaacagaggagaaaccctatgtgaaattgcaacctggcggcagcgcaaaagatg

SEQ ID NO: 189191 - DNA, 103 bp, Artificial Sequence
  Synthetic Polynucleotide
taatacgactcactataggggcgaaggcgggccgggtttttctcaatgcgaacagaggagacgcattatgaaaaacccgaacctggcggcagcgcaaaagatg

SEQ ID NO: 189192 - DNA, 103 bp, Artificial Sequence
  Synthetic Polynucleotide
taatacgactcactatagggggtgccgtccagctctgcttttgcaatttcaacagaggagagaaattatgaaagcagagaacctggcggcagcgcaaaagatg

SEQ ID NO: 189193 - DNA, 103 bp, Artificial Sequence
  Synthetic Polynucleotide
taatacgactcactatagggtcttgagaatggtgccgtccagctctgcttaacagaggagaaagcagatgtggacggcaaacctggcggcagcgcaaaagatg

SEQ ID NO: 189194 - DNA, 103 bp, Artificial Sequence
  Synthetic Polynucleotide
taatacgactcactatagggagaggtctgctcttgagaatggtgccgtccaacagaggagaggacggatgcattctcaaaacctggcggcagcgcaaaagatg

SEQ ID NO: 189195 - DNA, 103 bp, Artificial Sequence
  Synthetic Polynucleotide
taatacgactcactataggggcgaatccgtagaggtctgctcttgagaataacagaggagaattctcatgagcagacctaacctggcggcagcgcaaaagatg

SEQ ID NO: 189196 - DNA, 103 bp, Artificial Sequence
  Synthetic Polynucleotide
taatacgactcactataggggtgtagcgaagcgaatccgtagaggtctgcaacagaggagagcagacatgtacggattcaacctggcggcagcgcaaaagatg

SEQ ID NO: 189197 - DNA, 103 bp, Artificial Sequence
  Synthetic Polynucleotide
taatacgactcactataggggctgctccatgtgtagcgaagcgaatccgtaacagaggagaacggatatgcttcgctacaacctggcggcagcgcaaaagatg

SEQ ID NO: 189198 - DNA, 103 bp, Artificial Sequence
  Synthetic Polynucleotide
taatacgactcactataggggacagtcaaggctgctccatgtgtagcgaaaacagaggagattcgctatgcatggagcaaacctggcggcagcgcaaaagatg

SEQ ID NO: 189199 - DNA, 103 bp, Artificial Sequence
  Synthetic Polynucleotide
taatacgactcactatagggaaaggttcttgacagtcaaggctgctccataacagaggagaatggagatgccttgactgaacctggcggcagcgcaaaagatg

SEQ ID NO: 189200 - DNA, 103 bp, Artificial Sequence
  Synthetic Polynucleotide
taatacgactcactatagggacaactggagaaaggttcttgacagtcaagaacagaggagacttgacatgcaagaacctaacctggcggcagcgcaaaagatg

SEQ ID NO: 189201 - DNA, 103 bp, Artificial Sequence
  Synthetic Polynucleotide
taatacgactcactatagggctcattggaaacaactggagaaaggttcttaacagaggagaaagaacatgtctccagttaacctggcggcagcgcaaaagatg

SEQ ID NO: 189202 - DNA, 103 bp, Artificial Sequence
  Synthetic Polynucleotide
taatacgactcactatagggactccagggcgcgaaggcgggccgggttttaacagaggagaaaaaccatgcccgccttcaacctggcggcagcgcaaaagatg

SEQ ID NO: 189203 - DNA, 103 bp, Artificial Sequence
  Synthetic Polynucleotide
taatacgactcactataggggctctagcagctcattggaaacaactggagaacagaggagactccagatgtttccaatgaacctggcggcagcgcaaaagatg

SEQ ID NO: 189204 - DNA, 103 bp, Artificial Sequence
  Synthetic Polynucleotide
taatacgactcactataggggaaaatgcttgctctagcagctcattggaaaacagaggagattccaaatggctgctagaaacctggcggcagcgcaaaagatg

SEQ ID NO: 189205 - DNA, 103 bp, Artificial Sequence
  Synthetic Polynucleotide
taatacgactcactatagggaccaaactgagaaaatgcttgctctagcagaacagaggagactgctaatgcaagcatttaacctggcggcagcgcaaaagatg

SEQ ID NO: 189206 - DNA, 103 bp, Artificial Sequence
  Synthetic Polynucleotide
taatacgactcactatagggtctctactggaccaaactgagaaaatgcttaacagaggagaaagcatatgctcagtttgaacctggcggcagcgcaaaagatg

SEQ ID NO: 189207 - DNA, 103 bp, Artificial Sequence
  Synthetic Polynucleotide
taatacgactcactatagggacaacagctttctctactggaccaaactgaaacagaggagatcagttatgtccagtagaaacctggcggcagcgcaaaagatg

SEQ ID NO: 189208 - DNA, 103 bp, Artificial Sequence
  Synthetic Polynucleotide
taatacgactcactatagggatccacaaccacaacagctttctctactggaacagaggagaccagtaatgaaagctgttaacctggcggcagcgcaaaagatg

SEQ ID NO: 189209 - DNA, 103 bp, Artificial Sequence
  Synthetic Polynucleotide
taatacgactcactatagggtaccgcgatcatccacaaccacaacagcttaacagaggagaaagctgatgtggttgtggaacctggcggcagcgcaaaagatg

SEQ ID NO: 189210 - DNA, 103 bp, Artificial Sequence
  Synthetic Polynucleotide
taatacgactcactatagggcctgtagctctaccgcgatcatccacaaccaacagaggagaggttgtatgtgatcgcggaacctggcggcagcgcaaaagatg

SEQ ID NO: 189211 - DNA, 103 bp, Artificial Sequence
  Synthetic Polynucleotide
taatacgactcactatagggaaaaccttttcctgtagctctaccgcgatcaacagaggagagatcgcatgagagctacaaacctggcggcagcgcaaaagatg

SEQ ID NO: 189212 - DNA, 103 bp, Artificial Sequence
  Synthetic Polynucleotide
taatacgactcactatagggcaaactctacaaaaccttttcctgtagctcaacagaggagagagctaatggaaaaggttaacctggcggcagcgcaaaagatg

SEQ ID NO: 189213 - DNA, 103 bp, Artificial Sequence
  Synthetic Polynucleotide
taatacgactcactatagggcccaccgcggactccagggcgcgaaggcggaacagaggagaccgcctatgcgccctggaaacctggcggcagcgcaaaagatg

SEQ ID NO: 189214 - DNA, 103 bp, Artificial Sequence
  Synthetic Polynucleotide
taatacgactcactatagggggttttgctgcaaactctacaaaaccttttaacagaggagaaaaaggatgtgtagagttaacctggcggcagcgcaaaagatg

SEQ ID NO: 189215 - DNA, 103 bp, Artificial Sequence
  Synthetic Polynucleotide
taatacgactcactatagggtcgtgcaggaggttttgctgcaaactctacaacagaggagagtagagatggcagcaaaaaacctggcggcagcgcaaaagatg

SEQ ID NO: 189216 - DNA, 103 bp, Artificial Sequence
  Synthetic Polynucleotide
taatacgactcactatagggccagagcctttcgtgcaggaggttttgctgaacagaggagacagcaaatgctcctgcacaacctggcggcagcgcaaaagatg

SEQ ID NO: 189217 - DNA, 103 bp, Artificial Sequence
  Synthetic Polynucleotide
taatacgactcactatagggccacatctttccagagcctttcgtgcaggaaacagaggagatcctgcatgaaaggctctaacctggcggcagcgcaaaagatg

SEQ ID NO: 189218 - DNA, 103 bp, Artificial Sequence
  Synthetic Polynucleotide
taatacgactcactatagggtgccccatcaccacatctttccagagccttaacagaggagaaaggctatggaaagatgtaacctggcggcagcgcaaaagatg

SEQ ID NO: 189219 - DNA, 103 bp, Artificial Sequence
  Synthetic Polynucleotide
taatacgactcactatagggttagcaagaatgccccatcaccacatctttaacagaggagaaaagatatggtgatggggaacctggcggcagcgcaaaagatg

SEQ ID NO: 189220 - DNA, 103 bp, Artificial Sequence
  Synthetic Polynucleotide
taatacgactcactatagggggggtcgttgttagcaagaatgccccatcaaacagaggagatgatggatgattcttgctaacctggcggcagcgcaaaagatg

SEQ ID NO: 189221 - DNA, 103 bp, Artificial Sequence
  Synthetic Polynucleotide
taatacgactcactataggggactggacgaggggtcgttgttagcaagaaaacagaggagattcttgatgacaacgaccaacctggcggcagcgcaaaagatg

SEQ ID NO: 189222 - DNA, 103 bp, Artificial Sequence
  Synthetic Polynucleotide
taatacgactcactataggggttccacaatgactggacgaggggtcgttgaacagaggagacaacgaatgctcgtccagaacctggcggcagcgcaaaagatg

SEQ ID NO: 189223 - DNA, 103 bp, Artificial Sequence
  Synthetic Polynucleotide
taatacgactcactatagggtgctccatgggttccacaatgactggacgaaacagaggagatcgtccatgcattgtggaaacctggcggcagcgcaaaagatg

SEQ ID NO: 189224 - DNA, 103 bp, Artificial Sequence
  Synthetic Polynucleotide
taatacgactcactatagggctcgctctcgcccaccgcggactccagggcaacagaggagagccctgatgtccgcggtgaacctggcggcagcgcaaaagatg

SEQ ID NO: 189225 - DNA, 103 bp, Artificial Sequence
  Synthetic Polynucleotide
taatacgactcactatagggatcatcaaactgctccatgggttccacaataacagaggagaattgtgatgcccatggagaacctggcggcagcgcaaaagatg

SEQ ID NO: 189226 - DNA, 103 bp, Artificial Sequence
  Synthetic Polynucleotide
taatacgactcactatagggagccatcttcatcatcaaactgctccatggaacagaggagaccatggatgagtttgatgaacctggcggcagcgcaaaagatg

SEQ ID NO: 189227 - DNA, 103 bp, Artificial Sequence
  Synthetic Polynucleotide
taatacgactcactatagggttctctggcaagccatcttcatcatcaaacaacagaggagagtttgaatgtgaagatggaacctggcggcagcgcaaaagatg

SEQ ID NO: 189228 - DNA, 103 bp, Artificial Sequence
  Synthetic Polynucleotide
taatacgactcactatagggctgcatcagcttctctggcaagccatcttcaacagaggagagaagatatgttgccagagaacctggcggcagcgcaaaagatg

SEQ ID NO: 189229 - DNA, 103 bp, Artificial Sequence
  Synthetic Polynucleotide
taatacgactcactataggggttgagttttctgcatcagcttctctggcaaacagaggagatgccagatgagctgatgcaacctggcggcagcgcaaaagatg

SEQ ID NO: 189230 - DNA, 103 bp, Artificial Sequence
  Synthetic Polynucleotide
taatacgactcactatagggttatgatattgttgagttttctgcatcagcaacagaggagagctgatatggaaaactcaaacctggcggcagcgcaaaagatg

SEQ ID NO: 189231 - DNA, 103 bp, Artificial Sequence
  Synthetic Polynucleotide
taatacgactcactatagggttctctttccttatgatattgttgagttttaacagaggagaaaaactatgcaatatcataacctggcggcagcgcaaaagatg

SEQ ID NO: 189232 - DNA, 103 bp, Artificial Sequence
  Synthetic Polynucleotide
taatacgactcactataggggtggtggttgttctctttccttatgatattaacagaggagaaatatcatgaggaaagagaacctggcggcagcgcaaaagatg

SEQ ID NO: 189233 - DNA, 103 bp, Artificial Sequence
  Synthetic Polynucleotide
taatacgactcactatagggtgagcaaaacgtggtggttgttctctttccaacagaggagaggaaagatgacaaccaccaacctggcggcagcgcaaaagatg

SEQ ID NO: 189234 - DNA, 103 bp, Artificial Sequence
  Synthetic Polynucleotide
taatacgactcactatagggtgtcccaggttgagcaaaacgtggtggttgaacagaggagacaaccaatgcgttttgctaacctggcggcagcgcaaaagatg

SEQ ID NO: 189235 - DNA, 103 bp, Artificial Sequence
  Synthetic Polynucleotide
taatacgactcactatagggcggccgccggctcgctctcgcccaccgcggaacagaggagaccgcggatggcgagagcgaacctggcggcagcgcaaaagatg

SEQ ID NO: 189236 - DNA, 103 bp, Artificial Sequence
  Synthetic Polynucleotide
taatacgactcactatagggcaaattcaaatgtcccaggttgagcaaaacaacagaggagagttttgatgaacctgggaaacctggcggcagcgcaaaagatg

SEQ ID NO: 189237 - DNA, 103 bp, Artificial Sequence
  Synthetic Polynucleotide
taatacgactcactataggggatgcatactcaaattcaaatgtcccaggtaacagaggagaacctggatgatttgaattaacctggcggcagcgcaaaagatg

SEQ ID NO: 189238 - DNA, 103 bp, Artificial Sequence
  Synthetic Polynucleotide
taatacgactcactatagggcttccatcgagatgcatactcaaattcaaaaacagaggagatttgaaatggagtatgcaaacctggcggcagcgcaaaagatg

SEQ ID NO: 189239 - DNA, 103 bp, Artificial Sequence
  Synthetic Polynucleotide
taatacgactcactatagggcatcaagagccttccatcgagatgcatactaacagaggagaagtatgatgctcgatggaaacctggcggcagcgcaaaagatg

SEQ ID NO: 189240 - DNA, 103 bp, Artificial Sequence
  Synthetic Polynucleotide
taatacgactcactatagggttttccatttcatcaagagccttccatcgaaacagaggagatcgatgatgggctcttgaaacctggcggcagcgcaaaagatg

SEQ ID NO: 189241 - DNA, 103 bp, Artificial Sequence
  Synthetic Polynucleotide
taatacgactcactatagggacgctgctgcttttccatttcatcaagagcaacagaggagagctcttatggaaatggaaaacctggcggcagcgcaaaagatg

SEQ ID NO: 189242 - DNA, 103 bp, Artificial Sequence
  Synthetic Polynucleotide
taatacgactcactatagggcaacctgctcacgctgctgcttttccatttaacagaggagaaaatggatgagcagcagcaacctggcggcagcgcaaaagatg

SEQ ID NO: 189243 - DNA, 103 bp, Artificial Sequence
  Synthetic Polynucleotide
taatacgactcactatagggatgtttctatcaacctgctcacgctgctgcaacagaggagagcagcaatgtgagcaggtaacctggcggcagcgcaaaagatg

SEQ ID NO: 189244 - DNA, 103 bp, Artificial Sequence
  Synthetic Polynucleotide
taatacgactcactatagggggcttctctgatgtttctatcaacctgctcaacagaggagagagcagatggatagaaacaacctggcggcagcgcaaaagatg

SEQ ID NO: 189245 - DNA, 103 bp, Artificial Sequence
  Synthetic Polynucleotide
taatacgactcactataggggtttctctttggcttctctgatgtttctataacagaggagaatagaaatgtcagagaagaacctggcggcagcgcaaaagatg

SEQ ID NO: 189246 - DNA, 103 bp, Artificial Sequence
  Synthetic Polynucleotide
taatacgactcactatagggatggctgccgcggccgccggctcgctctcgaacagaggagacgagagatggccggcggcaacctggcggcagcgcaaaagatg

SEQ ID NO: 189247 - DNA, 103 bp, Artificial Sequence
  Synthetic Polynucleotide
taatacgactcactatagggtctgcctccagtttctctttggcttctctgaacagaggagacagagaatgcaaagagaaaacctggcggcagcgcaaaagatg

SEQ ID NO: 189248 - DNA, 103 bp, Artificial Sequence
  Synthetic Polynucleotide
taatacgactcactatagggtgcttccatttctgcctccagtttctctttaacagaggagaaaagagatgctggaggcaaacctggcggcagcgcaaaagatg

SEQ ID NO: 189249 - DNA, 103 bp, Artificial Sequence
  Synthetic Polynucleotide
taatacgactcactatagggcatgcctagctgcttccatttctgcctccaaacagaggagatggaggatgaaatggaagaacctggcggcagcgcaaaagatg

SEQ ID NO: 189250 - DNA, 103 bp, Artificial Sequence
  Synthetic Polynucleotide
taatacgactcactatagggaattggtgttcatgcctagctgcttccattaacagaggagaaatggaatgagctaggcaaacctggcggcagcgcaaaagatg

SEQ ID NO: 189251 - DNA, 103 bp, Artificial Sequence
  Synthetic Polynucleotide
taatacgactcactatagggcattagcattaattggtgttcatgcctagcaacagaggagagctaggatggaacaccaaaacctggcggcagcgcaaaagatg

SEQ ID NO: 189252 - DNA, 103 bp, Artificial Sequence
  Synthetic Polynucleotide
taatacgactcactataggggatcttgcctcattagcattaattggtgttaacagaggagaaacaccatgtaatgctaaaacctggcggcagcgcaaaagatg

SEQ ID NO: 189253 - DNA, 103 bp, Artificial Sequence
  Synthetic Polynucleotide
taatacgactcactatagggcgcctcattagatcttgcctcattagcattaacagaggagaaatgctatggaggcaagaaacctggcggcagcgcaaaagatg

SEQ ID NO: 189254 - DNA, 103 bp, Artificial Sequence
  Synthetic Polynucleotide
taatacgactcactatagggttcttcttgacgcctcattagatcttgcctaacagaggagaaggcaaatgctaatgaggaacctggcggcagcgcaaaagatg

SEQ ID NO: 189255 - DNA, 103 bp, Artificial Sequence
  Synthetic Polynucleotide
taatacgactcactatagggagcgtctgagttcttcttgacgcctcattaaacagaggagataatgaatggtcaagaagaacctggcggcagcgcaaaagatg

SEQ ID NO: 189256 - DNA, 103 bp, Artificial Sequence
  Synthetic Polynucleotide
taatacgactcactatagggagttcttccaagcgtctgagttcttcttgaaacagaggagatcaagaatgactcagacgaacctggcggcagcgcaaaagatg

SEQ ID NO: 189257 - DNA, 103 bp, Artificial Sequence
  Synthetic Polynucleotide
taatacgactcactatagggggggaagtgctccagcaacaccgcgtccataacagaggagaatggacatggtgttgctgaacctggcggcagcgcaaaagatg

SEQ ID NO: 189258 - DNA, 103 bp, Artificial Sequence
  Synthetic Polynucleotide
taatacgactcactatagggatcgccgtcctccagggggtcccgtgaagaaacagaggagatcttcaatggaccccctgaacctggcggcagcgcaaaagatg

SEQ ID NO: 189259 - DNA, 103 bp, Artificial Sequence
  Synthetic Polynucleotide
taatacgactcactatagggccagcagctcatcgccgtcctccagggggtaacagaggagaacccccatgaggacggcgaacctggcggcagcgcaaaagatg

SEQ ID NO: 189260 - DNA, 103 bp, Artificial Sequence
  Synthetic Polynucleotide
taatacgactcactatagggtgctcgtccgccagcagctcatcgccgtccaacagaggagaggacggatgtgagctgctaacctggcggcagcgcaaaagatg

SEQ ID NO: 189261 - DNA, 103 bp, Artificial Sequence
  Synthetic Polynucleotide
taatacgactcactatagggcacctcggcctgctcgtccgccagcagctcaacagaggagagagctgatggcggacgagaacctggcggcagcgcaaaagatg

SEQ ID NO: 189262 - DNA, 103 bp, Artificial Sequence
  Synthetic Polynucleotide
taatacgactcactatagggtaaggaactccacctcggcctgctcgtccgaacagaggagacggacgatgaggccgaggaacctggcggcagcgcaaaagatg

SEQ ID NO: 189263 - DNA, 103 bp, Artificial Sequence
  Synthetic Polynucleotide
taatacgactcactatagggagctggtggctaaggaactccacctcggccaacagaggagaggccgaatgggagttcctaacctggcggcagcgcaaaagatg

SEQ ID NO: 189264 - DNA, 103 bp, Artificial Sequence
  Synthetic Polynucleotide
taatacgactcactataggggtactcgtggagctggtggctaaggaactcaacagaggagagagttcatgagccaccagaacctggcggcagcgcaaaagatg

SEQ ID NO: 189265 - DNA, 103 bp, Artificial Sequence
  Synthetic Polynucleotide
taatacgactcactatagggcgcggtagcagtactcgtggagctggtggcaacagaggagagccaccatgtccacgagtaacctggcggcagcgcaaaagatg

SEQ ID NO: 189266 - DNA, 103 bp, Artificial Sequence
  Synthetic Polynucleotide
taatacgactcactatagggcacgccccgtcgcggtagcagtactcgtggaacagaggagaccacgaatgctgctaccgaacctggcggcagcgcaaaagatg

SEQ ID NO: 189267 - DNA, 103 bp, Artificial Sequence
  Synthetic Polynucleotide
taatacgactcactatagggcagcagcaggcacgccccgtcgcggtagcaaacagaggagatgctacatggacggggcgaacctggcggcagcgcaaaagatg

SEQ ID NO: 189268 - DNA, 103 bp, Artificial Sequence
  Synthetic Polynucleotide
taatacgactcactatagggctaggcccccggggaagtgctccagcaacaaacagaggagatgttgcatgagcacttccaacctggcggcagcgcaaaagatg

SEQ ID NO: 189269 - DNA, 103 bp, Artificial Sequence
  Synthetic Polynucleotide
taatacgactcactataggggcgcgggctgcagcagcaggcacgccccgtaacagaggagaacggggatggcctgctgcaacctggcggcagcgcaaaagatg

SEQ ID NO: 189270 - DNA, 103 bp, Artificial Sequence
  Synthetic Polynucleotide
taatacgactcactataggggcggccgggggcgcgggctgcagcagcaggaacagaggagacctgctatggcagcccgcaacctggcggcagcgcaaaagatg

SEQ ID NO: 189271 - DNA, 103 bp, Artificial Sequence
  Synthetic Polynucleotide
taatacgactcactatagggcgctagcggggcggccgggggcgcgggctgaacagaggagacagcccatgcccccggccaacctggcggcagcgcaaaagatg

SEQ ID NO: 189272 - DNA, 103 bp, Artificial Sequence
  Synthetic Polynucleotide
taatacgactcactataggggcggggcgagcgctagcggggcggccggggaacagaggagaccccggatgccccgctagaacctggcggcagcgcaaaagatg

SEQ ID NO: 189273 - DNA, 103 bp, Artificial Sequence
  Synthetic Polynucleotide
taatacgactcactatagggcccgaggacggcggggcgagcgctagcgggaacagaggagacccgctatggctcgccccaacctggcggcagcgcaaaagatg

SEQ ID NO: 189274 - DNA, 103 bp, Artificial Sequence
  Synthetic Polynucleotide
taatacgactcactatagggaccgaggccccccgaggacggcggggcgagaacagaggagactcgccatgccgtcctcgaacctggcggcagcgcaaaagatg

SEQ ID NO: 189275 - DNA, 103 bp, Artificial Sequence
  Synthetic Polynucleotide
taatacgactcactatagggcgtctggctcaccgaggccccccgaggacgaacagaggagacgtcctatgggggcctcgaacctggcggcagcgcaaaagatg

SEQ ID NO: 189276 - DNA, 103 bp, Artificial Sequence
  Synthetic Polynucleotide
taatacgactcactatagggccgccgccgtcgtctggctcaccgaggcccaacagaggagagggcctatgtgagccagaaacctggcggcagcgcaaaagatg

SEQ ID NO: 189277 - DNA, 103 bp, Artificial Sequence
  Synthetic Polynucleotide
taatacgactcactataggggtagccgccgccgccgccgtcgtctggctcaacagaggagagagccaatggacggcggcaacctggcggcagcgcaaaagatg

SEQ ID NO: 189278 - DNA, 103 bp, Artificial Sequence
  Synthetic Polynucleotide
taatacgactcactatagggtctcgcagcagtagccgccgccgccgccgtaacagaggagaacggcgatggcggcggctaacctggcggcagcgcaaaagatg

SEQ ID NO: 189279 - DNA, 103 bp, Artificial Sequence
  Synthetic Polynucleotide
taatacgactcactatagggggaaaggcgtctaggcccccggggaagtgcaacagaggagagcacttatgcgggggcctaacctggcggcagcgcaaaagatg

SEQ ID NO: 189280 - DNA, 103 bp, Artificial Sequence
  Synthetic Polynucleotide
taatacgactcactatagggggcgcccccgtctcgcagcagtagccgccgaacagaggagacggcggatgctgctgcgaaacctggcggcagcgcaaaagatg

SEQ ID NO: 189281 - DNA, 103 bp, Artificial Sequence
  Synthetic Polynucleotide
taatacgactcactataggggccgcctgggggcgcccccgtctcgcagcaaacagaggagatgctgcatgacgggggcgaacctggcggcagcgcaaaagatg

SEQ ID NO: 189282 - DNA, 103 bp, Artificial Sequence
  Synthetic Polynucleotide
taatacgactcactatagggagtaggggaagccgcctgggggcgcccccgaacagaggagacgggggatgccccaggcgaacctggcggcagcgcaaaagatg

SEQ ID NO: 189283 - DNA, 103 bp, Artificial Sequence
  Synthetic Polynucleotide
taatacgactcactataggggagccgggcgagtaggggaagccgcctgggaacagaggagacccaggatgcttcccctaaacctggcggcagcgcaaaagatg

SEQ ID NO: 189284 - DNA, 103 bp, Artificial Sequence
  Synthetic Polynucleotide
taatacgactcactatagggcgagggcggcgagccgggcgagtaggggaaaacagaggagattccccatgtcgcccggcaacctggcggcagcgcaaaagatg

SEQ ID NO: 189285 - DNA, 103 bp, Artificial Sequence
  Synthetic Polynucleotide
taatacgactcactatagggaggccaggcacgagggcggcgagccgggcgaacagaggagacgcccgatgcgccgccctaacctggcggcagcgcaaaagatg

SEQ ID NO: 189286 - DNA, 103 bp, Artificial Sequence
  Synthetic Polynucleotide
taatacgactcactataggggcgcacgggtaggccaggcacgagggcggcaacagaggagagccgccatggtgcctggcaacctggcggcagcgcaaaagatg

SEQ ID NO: 189287 - DNA, 103 bp, Artificial Sequence
  Synthetic Polynucleotide
taatacgactcactatagggtgccgccccggcgcacgggtaggccaggcaaacagaggagatgcctgatgtacccgtgcaacctggcggcagcgcaaaagatg

SEQ ID NO: 189288 - DNA, 103 bp, Artificial Sequence
  Synthetic Polynucleotide
taatacgactcactataggggagacagtactgccgccccggcgcacgggtaacagaggagaacccgtatgccggggcggaacctggcggcagcgcaaaagatg

SEQ ID NO: 189289 - DNA, 103 bp, Artificial Sequence
  Synthetic Polynucleotide
taatacgactcactatagggcgcgccccgggagacagtactgccgccccgaacagaggagacggggcatgagtactgtcaacctggcggcagcgcaaaagatg

SEQ ID NO: 189290 - DNA, 103 bp, Artificial Sequence
  Synthetic Polynucleotide
taatacgactcactataggggtacgaagaaggaaaggcgtctaggcccccaacagaggagagggggcatggacgcctttaacctggcggcagcgcaaaagatg

SEQ ID NO: 189291 - DNA, 103 bp, Artificial Sequence
  Synthetic Polynucleotide
taatacgactcactataggggccgcgcagccgcgccccgggagacagtacaacagaggagagtactgatgcccggggcgaacctggcggcagcgcaaaagatg

SEQ ID NO: 189292 - DNA, 103 bp, Artificial Sequence
  Synthetic Polynucleotide
taatacgactcactatagggctccgctcaggccgcgcagccgcgccccggaacagaggagaccggggatgggctgcgcgaacctggcggcagcgcaaaagatg

SEQ ID NO: 189293 - DNA, 103 bp, Artificial Sequence
  Synthetic Polynucleotide
taatacgactcactataggggcagccgccgctccgctcaggccgcgcagcaacagaggagagctgcgatgcctgagcggaacctggcggcagcgcaaaagatg

SEQ ID NO: 189294 - DNA, 103 bp, Artificial Sequence
  Synthetic Polynucleotide
taatacgactcactatagggccgcgccgccgcagccgccgctccgctcagaacagaggagactgagcatggcggcggctaacctggcggcagcgcaaaagatg

SEQ ID NO: 189295 - DNA, 103 bp, Artificial Sequence
  Synthetic Polynucleotide
taatacgactcactataggggccgccggcgccgcgccgccgcagccgccgaacagaggagacggcggatgcggcggcgcaacctggcggcagcgcaaaagatg

SEQ ID NO: 189296 - DNA, 103 bp, Artificial Sequence
  Synthetic Polynucleotide
taatacgactcactataggggagcgcacccgccgccggcgccgcgccgccaacagaggagaggcggcatggcgccggcgaacctggcggcagcgcaaaagatg

SEQ ID NO: 189297 - DNA, 103 bp, Artificial Sequence
  Synthetic Polynucleotide
taatacgactcactatagggctccgcctcggagcgcacccgccgccggcgaacagaggagacgccggatgcgggtgcgcaacctggcggcagcgcaaaagatg

SEQ ID NO: 189298 - DNA, 103 bp, Artificial Sequence
  Synthetic Polynucleotide
taatacgactcactataggggctgctgcagctccgcctcggagcgcacccaacagaggagagggtgcatgccgaggcggaacctggcggcagcgcaaaagatg

SEQ ID NO: 189299 - DNA, 103 bp, Artificial Sequence
  Synthetic Polynucleotide
taatacgactcactataggggcctgccgcagctgctgcagctccgcctcgaacagaggagacgaggcatggctgcagcaaacctggcggcagcgcaaaagatg

SEQ ID NO: 189300 - DNA, 103 bp, Artificial Sequence
  Synthetic Polynucleotide
taatacgactcactatagggcacgttggccgcctgccgcagctgctgcagaacagaggagactgcagatgctgcggcagaacctggcggcagcgcaaaagatg

SEQ ID NO: 189301 - DNA, 103 bp, Artificial Sequence
  Synthetic Polynucleotide
taatacgactcactatagggcctcgtcgaagtacgaagaaggaaaggcgtaacagaggagaacgcctatgcttcttcgtaacctggcggcagcgcaaaagatg

SEQ ID NO: 189302 - DNA, 103 bp, Artificial Sequence
  Synthetic Polynucleotide
taatacgactcactataggggccgctcgcgcacgttggccgcctgccgcaaacagaggagatgcggcatgcggccaacgaacctggcggcagcgcaaaagatg

SEQ ID NO: 189303 - DNA, 103 bp, Artificial Sequence
  Synthetic Polynucleotide
taatacgactcactatagggtgcatgcgccgccgctcgcgcacgttggccaacagaggagaggccaaatggcgcgagcgaacctggcggcagcgcaaaagatg

SEQ ID NO: 189304 - DNA, 103 bp, Artificial Sequence
  Synthetic Polynucleotide
taatacgactcactataggggttgatggactgcatgcgccgccgctcgcgaacagaggagacgcgagatgcggcgcatgaacctggcggcagcgcaaaagatg

SEQ ID NO: 189305 - DNA, 103 bp, Artificial Sequence
  Synthetic Polynucleotide
taatacgactcactatagggcgaaggcgtcgttgatggactgcatgcgccaacagaggagaggcgcaatgagtccatcaaacctggcggcagcgcaaaagatg

SEQ ID NO: 189306 - DNA, 103 bp, Artificial Sequence
  Synthetic Polynucleotide
taatacgactcactatagggcgcagcccctcgaaggcgtcgttgatggacaacagaggagagtccatatgcgacgccttaacctggcggcagcgcaaaagatg

SEQ ID NO: 189307 - DNA, 103 bp, Artificial Sequence
  Synthetic Polynucleotide
taatacgactcactataggggatgtgcgagcgcagcccctcgaaggcgtcaacagaggagagacgccatggaggggctgaacctggcggcagcgcaaaagatg

SEQ ID NO: 189308 - DNA, 103 bp, Artificial Sequence
  Synthetic Polynucleotide
taatacgactcactataggggcagcgtggggatgtgcgagcgcagcccctaacagaggagaaggggcatggctcgcacaaacctggcggcagcgcaaaagatg

SEQ ID NO: 189309 - DNA, 103 bp, Artificial Sequence
  Synthetic Polynucleotide
taatacgactcactatagggttctcgtagggcagcgtggggatgtgcgagaacagaggagactcgcaatgccccacgctaacctggcggcagcgcaaaagatg

SEQ ID NO: 189310 - DNA, 103 bp, Artificial Sequence
  Synthetic Polynucleotide
taatacgactcactatagggggagaggcgcttctcgtagggcagcgtgggaacagaggagacccacgatgccctacgagaacctggcggcagcgcaaaagatg

SEQ ID NO: 189311 - DNA, 103 bp, Artificial Sequence
  Synthetic Polynucleotide
taatacgactcactatagggtgtccaccttggagaggcgcttctcgtaggaacagaggagacctacgatgagcgcctctaacctggcggcagcgcaaaagatg

SEQ ID NO: 189312 - DNA, 103 bp, Artificial Sequence
  Synthetic Polynucleotide
taatacgactcactatagggaagaagtcgtcctcgtcgaagtacgaagaaaacagaggagattcttcatgcttcgacgaaacctggcggcagcgcaaaagatg

SEQ ID NO: 189313 - DNA, 103 bp, Artificial Sequence
  Synthetic Polynucleotide
taatacgactcactatagggaggcgcagcgtgtccaccttggagaggcgcaacagaggagagcgcctatgcaaggtggaaacctggcggcagcgcaaaagatg

SEQ ID NO: 189314 - DNA, 103 bp, Artificial Sequence
  Synthetic Polynucleotide
taatacgactcactataggggccgatggccaggcgcagcgtgtccaccttaacagaggagaaaggtgatgacgctgcgcaacctggcggcagcgcaaaagatg

SEQ ID NO: 189315 - DNA, 103 bp, Artificial Sequence
  Synthetic Polynucleotide
taatacgactcactatagggagttgatgtagccgatggccaggcgcagcgaacagaggagacgctgcatgtggccatcgaacctggcggcagcgcaaaagatg

SEQ ID NO: 189316 - DNA, 103 bp, Artificial Sequence
  Synthetic Polynucleotide
taatacgactcactatagggtcgctgaggaagttgatgtagccgatggccaacagaggagaggccatatgctacatcaaaacctggcggcagcgcaaaagatg

SEQ ID NO: 189317 - DNA, 103 bp, Artificial Sequence
  Synthetic Polynucleotide
taatacgactcactatagggctgcacgagctcgctgaggaagttgatgtaaacagaggagatacatcatgttcctcagcaacctggcggcagcgcaaaagatg

SEQ ID NO: 189318 - DNA, 103 bp, Artificial Sequence
  Synthetic Polynucleotide
taatacgactcactataggggcaggtcggcctgcacgagctcgctgaggaaacagaggagatcctcaatgagctcgtgcaacctggcggcagcgcaaaagatg

SEQ ID NO: 189319 - DNA, 103 bp, Artificial Sequence
  Synthetic Polynucleotide
taatacgactcactatagggccgcgcaagggcaggtcggcctgcacgagcaacagaggagagctcgtatgggccgacctaacctggcggcagcgcaaaagatg

SEQ ID NO: 189320 - DNA, 103 bp, Artificial Sequence
  Synthetic Polynucleotide
taatacgactcactatagggcgcgccaccgccgcgcaagggcaggtcggcaacagaggagagccgacatgcccttgcgcaacctggcggcagcgcaaaagatg

SEQ ID NO: 189321 - DNA, 103 bp, Artificial Sequence
  Synthetic Polynucleotide
taatacgactcactatagggcgcagccgcccgcgccaccgccgcgcaaggaacagaggagaccttgcatggcggtggcgaacctggcggcagcgcaaaagatg

SEQ ID NO: 189322 - DNA, 103 bp, Artificial Sequence
  Synthetic Polynucleotide
taatacgactcactatagggcccggccccccgcagccgcccgcgccaccgaacagaggagacggtggatggggcggctgaacctggcggcagcgcaaaagatg

SEQ ID NO: 189323 - DNA, 103 bp, Artificial Sequence
  Synthetic Polynucleotide
taatacgactcactatagggctggtcggtgaagaagtcgtcctcgtcgaaaacagaggagattcgacatggacgacttcaacctggcggcagcgcaaaagatg

SEQ ID NO: 189324 - DNA, 103 bp, Artificial Sequence
  Synthetic Polynucleotide
taatacgactcactatagggcccgccgccgcccggccccccgcagccgccaacagaggagaggcggcatgggggggccgaacctggcggcagcgcaaaagatg

SEQ ID NO: 189325 - DNA, 103 bp, Artificial Sequence
  Synthetic Polynucleotide
taatacgactcactatagggcgcccaggcgcccgccgccgcccggcccccaacagaggagagggggcatggcggcggcgaacctggcggcagcgcaaaagatg

SEQ ID NO: 189326 - DNA, 103 bp, Artificial Sequence
  Synthetic Polynucleotide
taatacgactcactataggggggctgtccccgcccaggcgcccgccgccgaacagaggagacggcggatggcgcctgggaacctggcggcagcgcaaaagatg

SEQ ID NO: 189327 - DNA, 103 bp, Artificial Sequence
  Synthetic Polynucleotide
taatacgactcactatagggctggctgcccgggctgtccccgcccaggcgaacagaggagacgcctgatgggggacagcaacctggcggcagcgcaaaagatg

SEQ ID NO: 189328 - DNA, 103 bp, Artificial Sequence
  Synthetic Polynucleotide
taatacgactcactatagggccttctgggcctggctgcccgggctgtcccaacagaggagagggacaatgcgggcagccaacctggcggcagcgcaaaagatg

SEQ ID NO: 189329 - DNA, 103 bp, Artificial Sequence
  Synthetic Polynucleotide
taatacgactcactatagggcagatgatgaccttctgggcctggctgcccaacagaggagagggcagatgggcccagaaaacctggcggcagcgcaaaagatg

SEQ ID NO: 189330 - DNA, 103 bp, Artificial Sequence
  Synthetic Polynucleotide
taatacgactcactataggggccccgatggcagatgatgaccttctgggcaacagaggagagcccagatggtcatcatcaacctggcggcagcgcaaaagatg

SEQ ID NO: 189331 - DNA, 103 bp, Artificial Sequence
  Synthetic Polynucleotide
taatacgactcactataggggggaccgggtgccccgatggcagatgatgaaacagaggagatcatcaatggccatcgggaacctggcggcagcgcaaaagatg

SEQ ID NO: 189332 - DNA, 103 bp, Artificial Sequence
  Synthetic Polynucleotide
taatacgactcactatagggctgggggagggggaccgggtgccccgatggaacagaggagaccatcgatgcacccggtcaacctggcggcagcgcaaaagatg

SEQ ID NO: 189333 - DNA, 103 bp, Artificial Sequence
  Synthetic Polynucleotide
taatacgactcactatagggatcagggtcgctgggggagggggaccgggtaacagaggagaacccggatgccctcccccaacctggcggcagcgcaaaagatg

SEQ ID NO: 189334 - DNA, 103 bp, Artificial Sequence
  Synthetic Polynucleotide
taatacgactcactatagggcccgtgaagactggtcggtgaagaagtcgtaacagaggagaacgactatgtcaccgaccaacctggcggcagcgcaaaagatg

SEQ ID NO: 189335 - DNA, 103 bp, Artificial Sequence
  Synthetic Polynucleotide
taatacgactcactatagggggaggccataatcagggtcgctgggggaggaacagaggagacctcccatggcgaccctgaacctggcggcagcgcaaaagatg

SEQ ID NO: 189336 - DNA, 103 bp, Artificial Sequence
  Synthetic Polynucleotide
taatacgactcactataggggctaggggagggaggccataatcagggtcgaacagaggagacgacccatgttatggcctaacctggcggcagcgcaaaagatg

SEQ ID NO: 189337 - DNA, 103 bp, Artificial Sequence
  Synthetic Polynucleotide
taatacgactcactatagggagagtgtcctgctaggggagggaggccataaacagaggagatatggcatgcctcccctaaacctggcggcagcgcaaaagatg

SEQ ID NO: 189338 - DNA, 103 bp, Artificial Sequence
  Synthetic Polynucleotide
taatacgactcactatagggtccatgagagagagtgtcctgctaggggagaacagaggagactccccatgcaggacactaacctggcggcagcgcaaaagatg

SEQ ID NO: 189339 - DNA, 103 bp, Artificial Sequence
  Synthetic Polynucleotide
taatacgactcactatagggttttcatcagtccatgagagagagtgtcctaacagaggagaaggacaatgtctctcatgaacctggcggcagcgcaaaagatg

SEQ ID NO: 189340 - DNA, 103 bp, Artificial Sequence
  Synthetic Polynucleotide
taatacgactcactatagggcttgagttgtttttcatcagtccatgagagaacagaggagactctcaatgactgatgaaaacctggcggcagcgcaaaagatg

SEQ ID NO: 189341 - DNA, 103 bp, Artificial Sequence
  Synthetic Polynucleotide
taatacgactcactatagggtattttgttccttgagttgtttttcatcagaacagaggagactgatgatgaacaactcaaacctggcggcagcgcaaaagatg

SEQ ID NO: 189342 - DNA, 103 bp, Artificial Sequence
  Synthetic Polynucleotide
taatacgactcactataggggttcggataatattttgttccttgagttgtaacagaggagaacaactatgggaacaaaaaacctggcggcagcgcaaaagatg

SEQ ID NO: 189343 - DNA, 103 bp, Artificial Sequence
  Synthetic Polynucleotide
taatacgactcactataggggactttggctgttcggataatattttgttcaacagaggagagaacaaatgattatccgaaacctggcggcagcgcaaaagatg

SEQ ID NO: 189344 - DNA, 103 bp, Artificial Sequence
  Synthetic Polynucleotide
taatacgactcactatagggctggggtccagactttggctgttcggataaaacagaggagattatccatgcagccaaagaacctggcggcagcgcaaaagatg

SEQ ID NO: 189345 - DNA, 103 bp, Artificial Sequence
  Synthetic Polynucleotide
taatacgactcactatagggtccagggggtcccgtgaagactggtcggtgaacagaggagacaccgaatggtcttcacgaacctggcggcagcgcaaaagatg

SEQ ID NO: 189346 - DNA, 103 bp, Artificial Sequence
  Synthetic Polynucleotide
taatacgactcactatagggctggggtcctctggggtccagactttggctaacagaggagaagccaaatgctggaccccaacctggcggcagcgcaaaagatg

SEQ ID NO: 189347 - DNA, 103 bp, Artificial Sequence
  Synthetic Polynucleotide
taatacgactcactataggggttgagttttctggggtcctctggggtccaaacagaggagatggaccatggaggaccccaacctggcggcagcgcaaaagatg

SEQ ID NO: 189348 - DNA, 103 bp, Artificial Sequence
  Synthetic Polynucleotide
taatacgactcactatagggaagatttgctgttgagttttctggggtcctaacagaggagaaggaccatggaaaactcaaacctggcggcagcgcaaaagatg

SEQ ID NO: 189349 - DNA, 103 bp, Artificial Sequence
  Synthetic Polynucleotide
taatacgactcactatagggttgttgaaggaagatttgctgttgagttttaacagaggagaaaaactatgcagcaaatcaacctggcggcagcgcaaaagatg

SEQ ID NO: 189350 - DNA, 103 bp, Artificial Sequence
  Synthetic Polynucleotide
taatacgactcactataggggttttctatgttgttgaaggaagatttgctaacagaggagaagcaaaatgtccttcaacaacctggcggcagcgcaaaagatg

SEQ ID NO: 189351 - DNA, 103 bp, Artificial Sequence
  Synthetic Polynucleotide
taatacgactcactatagggatggtggttcgttttctatgttgttgaaggaacagaggagaccttcaatgacatagaaaaacctggcggcagcgcaaaagatg

SEQ ID NO: 189352 - DNA, 103 bp, Artificial Sequence
  Synthetic Polynucleotide
taatacgactcactatagggacaaactcaaatggtggttcgttttctatgaacagaggagacatagaatgcgaaccaccaacctggcggcagcgcaaaagatg

SEQ ID NO: 189353 - DNA, 103 bp, Artificial Sequence
  Synthetic Polynucleotide
taatacgactcactatagggctgctcgctgccgctgtctcggtccgccataacagaggagaatggcgatgcgagacagcaacctggcggcagcgcaaaagatg

SEQ ID NO: 189354 - DNA, 103 bp, Artificial Sequence
  Synthetic Polynucleotide
taatacgactcactataggggccgcccccgccgccaccaccgcccccgccaacagaggagaggcgggatgggtggtggcaacctggcggcagcgcaaaagatg

SEQ ID NO: 189355 - DNA, 103 bp, Artificial Sequence
  Synthetic Polynucleotide
taatacgactcactatagggcactgccgccgccgcccccgccgccaccacaacagaggagagtggtgatggcgggggcgaacctggcggcagcgcaaaagatg

SEQ ID NO: 189356 - DNA, 103 bp, Artificial Sequence
  Synthetic Polynucleotide
taatacgactcactatagggccgccgccgccactgccgccgccgcccccgaacagaggagacgggggatgcggcggcagaacctggcggcagcgcaaaagatg

SEQ ID NO: 189357 - DNA, 103 bp, Artificial Sequence
  Synthetic Polynucleotide
taatacgactcactatagggggccccgccgccgccgccgccactgccgccaacagaggagaggcggcatgggcggcggcaacctggcggcagcgcaaaagatg

SEQ ID NO: 189358 - DNA, 103 bp, Artificial Sequence
  Synthetic Polynucleotide
taatacgactcactataggggcccccctggggccccgccgccgccgccgcaacagaggagagcggcgatggcggcggggaacctggcggcagcgcaaaagatg

SEQ ID NO: 189359 - DNA, 103 bp, Artificial Sequence
  Synthetic Polynucleotide
taatacgactcactatagggtcgtgctgcagcccccctggggccccgccgaacagaggagacggcggatgcccagggggaacctggcggcagcgcaaaagatg

SEQ ID NO: 189360 - DNA, 103 bp, Artificial Sequence
  Synthetic Polynucleotide
taatacgactcactatagggctcctgcgtctcgtgctgcagcccccctggaacagaggagaccagggatgctgcagcacaacctggcggcagcgcaaaagatg

SEQ ID NO: 189361 - DNA, 103 bp, Artificial Sequence
  Synthetic Polynucleotide
taatacgactcactatagggtggaggccagctcctgcgtctcgtgctgcaaacagaggagatgcagcatgagacgcaggaacctggcggcagcgcaaaagatg

SEQ ID NO: 189362 - DNA, 103 bp, Artificial Sequence
  Synthetic Polynucleotide
taatacgactcactatagggtccacccgcttggaggccagctcctgcgtcaacagaggagagacgcaatggctggcctcaacctggcggcagcgcaaaagatg

SEQ ID NO: 189363 - DNA, 103 bp, Artificial Sequence
  Synthetic Polynucleotide
taatacgactcactataggggttctggatgtccacccgcttggaggccagaacagaggagactggccatgaagcgggtgaacctggcggcagcgcaaaagatg

SEQ ID NO: 189364 - DNA, 103 bp, Artificial Sequence
  Synthetic Polynucleotide
taatacgactcactatagggccgcaccaccctgctcgctgccgctgtctcaacagaggagagagacaatggcagcgagcaacctggcggcagcgcaaaagatg

SEQ ID NO: 189365 - DNA, 103 bp, Artificial Sequence
  Synthetic Polynucleotide
taatacgactcactatagggagaagcgcttgttctggatgtccacccgctaacagaggagaagcgggatgacatccagaaacctggcggcagcgcaaaagatg

SEQ ID NO: 189366 - DNA, 103 bp, Artificial Sequence
  Synthetic Polynucleotide
taatacgactcactatagggacgtccaggtagaagcgcttgttctggatgaacagaggagacatccaatgcaagcgcttaacctggcggcagcgcaaaagatg

SEQ ID NO: 189367 - DNA, 103 bp, Artificial Sequence
  Synthetic Polynucleotide
taatacgactcactataggggttctgcttcacgtccaggtagaagcgcttaacagaggagaaagcgcatgtacctggacaacctggcggcagcgcaaaagatg

SEQ ID NO: 189368 - DNA, 103 bp, Artificial Sequence
  Synthetic Polynucleotide
taatacgactcactatagggggcccttggcgttctgcttcacgtccaggtaacagaggagaacctggatgtgaagcagaaacctggcggcagcgcaaaagatg

SEQ ID NO: 189369 - DNA, 103 bp, Artificial Sequence
  Synthetic Polynucleotide
taatacgactcactatagggttcaggaagcggcccttggcgttctgcttcaacagaggagagaagcaatgcgccaagggaacctggcggcagcgcaaaagatg

SEQ ID NO: 189370 - DNA, 103 bp, Artificial Sequence
  Synthetic Polynucleotide
taatacgactcactatagggctcggcgatcttcaggaagcggcccttggcaacagaggagagccaagatgcgcttcctgaacctggcggcagcgcaaaagatg

SEQ ID NO: 189371 - DNA, 103 bp, Artificial Sequence
  Synthetic Polynucleotide
taatacgactcactatagggccgcgcccacctcggcgatcttcaggaagcaacagaggagagcttccatgagatcgccgaacctggcggcagcgcaaaagatg

SEQ ID NO: 189372 - DNA, 103 bp, Artificial Sequence
  Synthetic Polynucleotide
taatacgactcactatagggttgttgccgcccgcgcccacctcggcgatcaacagaggagagatcgcatgggtgggcgcaacctggcggcagcgcaaaagatg

SEQ ID NO: 189373 - DNA, 103 bp, Artificial Sequence
  Synthetic Polynucleotide
taatacgactcactatagggaaggcggctcttgttgccgcccgcgcccacaacagaggagagtgggcatgggcggcaacaacctggcggcagcgcaaaagatg

SEQ ID NO: 189374 - DNA, 103 bp, Artificial Sequence
  Synthetic Polynucleotide
taatacgactcactatagggtggagagagtaaggcggctcttgttgccgcaacagaggagagcggcaatgagagccgccaacctggcggcagcgcaaaagatg

SEQ ID NO: 189375 - DNA, 103 bp, Artificial Sequence
  Synthetic Polynucleotide
taatacgactcactataggggaacccagcgccgcaccaccctgctcgctgaacagaggagacagcgaatggggtggtgcaacctggcggcagcgcaaaagatg

SEQ ID NO: 189376 - DNA, 103 bp, Artificial Sequence
  Synthetic Polynucleotide
taatacgactcactataggggccactgacatggagagagtaaggcggctcaacagaggagagagccgatgtactctctcaacctggcggcagcgcaaaagatg

SEQ ID NO: 189377 - DNA, 103 bp, Artificial Sequence
  Synthetic Polynucleotide
taatacgactcactataggggaactccacggccactgacatggagagagtaacagaggagaactctcatgatgtcagtgaacctggcggcagcgcaaaagatg

SEQ ID NO: 189378 - DNA, 103 bp, Artificial Sequence
  Synthetic Polynucleotide
taatacgactcactatagggggtagtcgcggaactccacggccactgacaaacagaggagatgtcagatgccgtggagtaacctggcggcagcgcaaaagatg

SEQ ID NO: 189379 - DNA, 103 bp, Artificial Sequence
  Synthetic Polynucleotide
taatacgactcactatagggaagtcgcccaggtagtcgcggaactccacgaacagaggagacgtggaatgccgcgactaaacctggcggcagcgcaaaagatg

SEQ ID NO: 189380 - DNA, 103 bp, Artificial Sequence
  Synthetic Polynucleotide
taatacgactcactataggggtgctcgatgaagtcgcccaggtagtcgcgaacagaggagacgcgacatgctgggcgacaacctggcggcagcgcaaaagatg

SEQ ID NO: 189381 - DNA, 103 bp, Artificial Sequence
  Synthetic Polynucleotide
taatacgactcactataggggctgcgcgtagtgctcgatgaagtcgcccaaacagaggagatgggcgatgtcatcgagcaacctggcggcagcgcaaaagatg

SEQ ID NO: 189382 - DNA, 103 bp, Artificial Sequence
  Synthetic Polynucleotide
taatacgactcactatagggctggggcccagctgcgcgtagtgctcgatgaacagaggagacatcgaatgctacgcgcaaacctggcggcagcgcaaaagatg

SEQ ID NO: 189383 - DNA, 103 bp, Artificial Sequence
  Synthetic Polynucleotide
taatacgactcactatagggcggcggctggctggggcccagctgcgcgtaaacagaggagatacgcgatgctgggccccaacctggcggcagcgcaaaagatg

SEQ ID NO: 189384 - DNA, 103 bp, Artificial Sequence
  Synthetic Polynucleotide
taatacgactcactataggggggccaggtccggcggctggctggggcccaaacagaggagatgggccatggccagccgcaacctggcggcagcgcaaaagatg

SEQ ID NO: 189385 - DNA, 103 bp, Artificial Sequence
  Synthetic Polynucleotide
taatacgactcactatagggtcctgcgcctgggccaggtccggcggctggaacagaggagaccagccatgggacctggcaacctggcggcagcgcaaaagatg

SEQ ID NO: 189386 - DNA, 103 bp, Artificial Sequence
  Synthetic Polynucleotide
taatacgactcactatagggggagccgcccgaacccagcgccgcaccaccaacagaggagaggtggtatggcgctgggtaacctggcggcagcgcaaaagatg

SEQ ID NO: 189387 - DNA, 103 bp, Artificial Sequence
  Synthetic Polynucleotide
taatacgactcactataggggcgcggctcgtcctgcgcctgggccaggtcaacagaggagagacctgatgcaggcgcagaacctggcggcagcgcaaaagatg

SEQ ID NO: 189388 - DNA, 103 bp, Artificial Sequence
  Synthetic Polynucleotide
taatacgactcactatagggtgagcgcccggcgcggctcgtcctgcgcctaacagaggagaaggcgcatgacgagccgcaacctggcggcagcgcaaaagatg

SEQ ID NO: 189389 - DNA, 103 bp, Artificial Sequence
  Synthetic Polynucleotide
taatacgactcactatagggaactcgcttttgagcgcccggcgcggctcgaacagaggagacgagccatgccgggcgctaacctggcggcagcgcaaaagatg

SEQ ID NO: 189390 - DNA, 103 bp, Artificial Sequence
  Synthetic Polynucleotide
taatacgactcactataggggcgcaccaggaactcgcttttgagcgcccgaacagaggagacgggcgatgaaaagcgagaacctggcggcagcgcaaaagatg

SEQ ID NO: 189391 - DNA, 103 bp, Artificial Sequence
  Synthetic Polynucleotide
taatacgactcactatagggtgcggttctcgcgcaccaggaactcgctttaacagaggagaaaagcgatgtcctggtgcaacctggcggcagcgcaaaagatg

SEQ ID NO: 189392 - DNA, 103 bp, Artificial Sequence
  Synthetic Polynucleotide
taatacgactcactatagggatgtagtacttgcggttctcgcgcaccaggaacagaggagacctggtatgcgagaaccgaacctggcggcagcgcaaaagatg

SEQ ID NO: 189393 - DNA, 103 bp, Artificial Sequence
  Synthetic Polynucleotide
taatacgactcactatagggcttgagatccatgtagtacttgcggttctcaacagaggagagagaacatgaagtactacaacctggcggcagcgcaaaagatg

SEQ ID NO: 189394 - DNA, 103 bp, Artificial Sequence
  Synthetic Polynucleotide
taatacgactcactataggggctggttctccttgagatccatgtagtactaacagaggagaagtactatgtggatctcaaacctggcggcagcgcaaaagatg

SEQ ID NO: 189395 - DNA, 103 bp, Artificial Sequence
  Synthetic Polynucleotide
taatacgactcactatagggaagcggccgcgctggttctccttgagatccaacagaggagaggatctatgggagaaccaaacctggcggcagcgcaaaagatg

SEQ ID NO: 189396 - DNA, 103 bp, Artificial Sequence
  Synthetic Polynucleotide
taatacgactcactataggggatgcgcaggaagcggccgcgctggttctcaacagaggagagagaacatgcgcggccgcaacctggcggcagcgcaaaagatg

SEQ ID NO: 189397 - DNA, 103 bp, Artificial Sequence
  Synthetic Polynucleotide
taatacgactcactatagggggtgccccagggagccgcccgaacccagcgaacagaggagacgctggatgcgggcggctaacctggcggcagcgcaaaagatg

SEQ ID NO: 189398 - DNA, 103 bp, Artificial Sequence
  Synthetic Polynucleotide
taatacgactcactatagggccgtctggcggatgcgcaggaagcggccgcaacagaggagagcggccatgtcctgcgcaaacctggcggcagcgcaaaagatg

SEQ ID NO: 189399 - DNA, 103 bp, Artificial Sequence
  Synthetic Polynucleotide
taatacgactcactatagggccccggttgaccgtctggcggatgcgcaggaacagaggagacctgcgatgccgccagacaacctggcggcagcgcaaaagatg

SEQ ID NO: 189400 - DNA, 103 bp, Artificial Sequence
  Synthetic Polynucleotide
taatacgactcactatagggcaggccaggcccccggttgaccgtctggcgaacagaggagacgccagatggtcaaccggaacctggcggcagcgcaaaagatg

SEQ ID NO: 189401 - DNA, 103 bp, Artificial Sequence
  Synthetic Polynucleotide
taatacgactcactataggggcgtggagcccaggccaggcccccggttgaaacagaggagatcaaccatgggcctggccaacctggcggcagcgcaaaagatg

SEQ ID NO: 189402 - DNA, 103 bp, Artificial Sequence
  Synthetic Polynucleotide
taatacgactcactataggggtctggccctgcgtggagcccaggccaggcaacagaggagagcctggatggggctccacaacctggcggcagcgcaaaagatg

SEQ ID NO: 189403 - DNA, 103 bp, Artificial Sequence
  Synthetic Polynucleotide
taatacgactcactatagggcagcgcaatggtctggccctgcgtggagccaacagaggagaggctccatgcagggccagaacctggcggcagcgcaaaagatg

SEQ ID NO: 189404 - DNA, 103 bp, Artificial Sequence
  Synthetic Polynucleotide
taatacgactcactatagggcctgcgcgggcagcgcaatggtctggccctaacagaggagaagggccatgccattgcgcaacctggcggcagcgcaaaagatg

SEQ ID NO: 189405 - DNA, 103 bp, Artificial Sequence
  Synthetic Polynucleotide
taatacgactcactatagggtcgatgagcccctgcgcgggcagcgcaatgaacagaggagacattgcatggcccgcgcaaacctggcggcagcgcaaaagatg

SEQ ID NO: 189406 - DNA, 103 bp, Artificial Sequence
  Synthetic Polynucleotide
taatacgactcactataggggtcacggaactcgatgagcccctgcgcgggaacagaggagacccgcgatggggctcatcaacctggcggcagcgcaaaagatg

SEQ ID NO: 189407 - DNA, 103 bp, Artificial Sequence
  Synthetic Polynucleotide
taatacgactcactatagggtggccagagcgtcacggaactcgatgagccaacagaggagaggctcaatgagttccgtgaacctggcggcagcgcaaaagatg

SEQ ID NO: 189408 - DNA, 103 bp, Artificial Sequence
  Synthetic Polynucleotide
taatacgactcactatagggcccgagccggggtgccccagggagccgcccaacagaggagagggcggatgcctggggcaaacctggcggcagcgcaaaagatg

SEQ ID NO: 189409 - DNA, 103 bp, Artificial Sequence
  Synthetic Polynucleotide
taatacgactcactatagggtcgatgagcttggccagagcgtcacggaacaacagaggagagttccgatgcgctctggcaacctggcggcagcgcaaaagatg

SEQ ID NO: 189410 - DNA, 103 bp, Artificial Sequence
  Synthetic Polynucleotide
taatacgactcactatagggtccgtagtcgtcgatgagcttggccagagcaacagaggagagctctgatgaagctcatcaacctggcggcagcgcaaaagatg

SEQ ID NO: 189411 - DNA, 103 bp, Artificial Sequence
  Synthetic Polynucleotide
taatacgactcactatagggcctcctccactccgtagtcgtcgatgagctaacagaggagaagctcaatgacgactacgaacctggcggcagcgcaaaagatg

SEQ ID NO: 189412 - DNA, 103 bp, Artificial Sequence
  Synthetic Polynucleotide
taatacgactcactatagggtcggccggctcctcctccactccgtagtcgaacagaggagacgactaatgagtggaggaaacctggcggcagcgcaaaagatg

SEQ ID NO: 189413 - DNA, 103 bp, Artificial Sequence
  Synthetic Polynucleotide
taatacgactcactatagggctcgggcagctcggccggctcctcctccacaacagaggagagtggagatggagccggccaacctggcggcagcgcaaaagatg

SEQ ID NO: 189414 - DNA, 103 bp, Artificial Sequence
  Synthetic Polynucleotide
taatacgactcactatagggaggaggtgccctcgggcagctcggccggctaacagaggagaagccggatgagctgcccgaacctggcggcagcgcaaaagatg

SEQ ID NO: 189415 - DNA, 103 bp, Artificial Sequence
  Synthetic Polynucleotide
taatacgactcactatagggtccacagtcaaggaggtgccctcgggcagcaacagaggagagctgccatggggcacctcaacctggcggcagcgcaaaagatg

SEQ ID NO: 189416 - DNA, 103 bp, Artificial Sequence
  Synthetic Polynucleotide
taatacgactcactataggggcgcttgttgtccacagtcaaggaggtgccaacagaggagaggcaccatgttgactgtgaacctggcggcagcgcaaaagatg

SEQ ID NO: 189417 - DNA, 103 bp, Artificial Sequence
  Synthetic Polynucleotide
taatacgactcactatagggcgaagaagaagcgcttgttgtccacagtcaaacagaggagatgactgatgacaacaagcaacctggcggcagcgcaaaagatg

SEQ ID NO: 189418 - DNA, 103 bp, Artificial Sequence
  Synthetic Polynucleotide
taatacgactcactataggggagcccacatcgaagaagaagcgcttgttgaacagaggagacaacaaatgcttcttcttaacctggcggcagcgcaaaagatg

SEQ ID NO: 189419 - DNA, 103 bp, Artificial Sequence
  Synthetic Polynucleotide
taatacgactcactatagggggagcctgagcccgagccggggtgccccagaacagaggagactggggatgcccggctcgaacctggcggcagcgcaaaagatg

SEQ ID NO: 189420 - DNA, 103 bp, Artificial Sequence
  Synthetic Polynucleotide
taatacgactcactataggggtacttgttggagcccacatcgaagaagaaaacagaggagattcttcatggatgtgggcaacctggcggcagcgcaaaagatg

SEQ ID NO: 189421 - DNA, 103 bp, Artificial Sequence
  Synthetic Polynucleotide
taatacgactcactatagggtaaacacgccgtacttgttggagcccacataacagaggagaatgtggatgccaacaagtaacctggcggcagcgcaaaagatg

SEQ ID NO: 189422 - DNA, 103 bp, Artificial Sequence
  Synthetic Polynucleotide
taatacgactcactatagggctcactcgcataaacacgccgtacttgttgaacagaggagacaacaaatgcggcgtgttaacctggcggcagcgcaaaagatg

SEQ ID NO: 189423 - DNA, 103 bp, Artificial Sequence
  Synthetic Polynucleotide
taatacgactcactatagggcttcacctcgctcactcgcataaacacgccaacagaggagaggcgtgatgatgcgagtgaacctggcggcagcgcaaaagatg

SEQ ID NO: 189424 - DNA, 103 bp, Artificial Sequence
  Synthetic Polynucleotide
taatacgactcactataggggataggtgggcttcacctcgctcactcgcaaacagaggagatgcgagatggcgaggtgaaacctggcggcagcgcaaaagatg

SEQ ID NO: 189425 - DNA, 103 bp, Artificial Sequence
  Synthetic Polynucleotide
taatacgactcactatagggatggagttgcgataggtgggcttcacctcgaacagaggagacgaggtatggcccacctaaacctggcggcagcgcaaaagatg

SEQ ID NO: 189426 - DNA, 103 bp, Artificial Sequence
  Synthetic Polynucleotide
taatacgactcactataggggggcacggtgatggagttgcgataggtgggaacagaggagacccaccatgcgcaactccaacctggcggcagcgcaaaagatg

SEQ ID NO: 189427 - DNA, 103 bp, Artificial Sequence
  Synthetic Polynucleotide
taatacgactcactatagggacaccttgtagggcacggtgatggagttgcaacagaggagagcaactatgtcaccgtgcaacctggcggcagcgcaaaagatg

SEQ ID NO: 189428 - DNA, 103 bp, Artificial Sequence
  Synthetic Polynucleotide
taatacgactcactatagggaacttggcccacaccttgtagggcacggtgaacagaggagacaccgtatgctacaaggtaacctggcggcagcgcaaaagatg

SEQ ID NO: 189429 - DNA, 103 bp, Artificial Sequence
  Synthetic Polynucleotide
taatacgactcactatagggggtgtgtccgaacttggcccacaccttgtaaacagaggagatacaagatgtgggccaagaacctggcggcagcgcaaaagatg

SEQ ID NO: 189430 - DNA, 103 bp, Artificial Sequence
  Synthetic Polynucleotide
taatacgactcactatagggcgcccccgccggagcctgagcccgagccggaacagaggagaccggctatggctcaggctaacctggcggcagcgcaaaagatg

SEQ ID NO: 189431 - DNA, 103 bp, Artificial Sequence
  Synthetic Polynucleotide
taatacgactcactatagggacttgcagaaggtgtgtccgaacttggcccaacagaggagagggccaatgtcggacacaaacctggcggcagcgcaaaagatg

SEQ ID NO: 189432 - DNA, 103 bp, Artificial Sequence
  Synthetic Polynucleotide
taatacgactcactatagggtcctccgagtacttgcagaaggtgtgtccgaacagaggagacggacaatgcttctgcaaaacctggcggcagcgcaaaagatg

SEQ ID NO: 189433 - DNA, 103 bp, Artificial Sequence
  Synthetic Polynucleotide
taatacgactcactatagggcttcttcatctcctccgagtacttgcagaaaacagaggagattctgcatgtactcggagaacctggcggcagcgcaaaagatg

SEQ ID NO: 189434 - DNA, 103 bp, Artificial Sequence
  Synthetic Polynucleotide
taatacgactcactatagggtctcttgaatcttcttcatctcctccgagtaacagaggagaactcggatgagatgaagaaacctggcggcagcgcaaaagatg

SEQ ID NO: 189435 - DNA, 103 bp, Artificial Sequence
  Synthetic Polynucleotide
taatacgactcactatagggtccctctgcttctcttgaatcttcttcatcaacagaggagagatgaaatggattcaagaaacctggcggcagcgcaaaagatg

SEQ ID NO: 189436 - DNA, 103 bp, Artificial Sequence
  Synthetic Polynucleotide
taatacgactcactatagggagcccgcttctccctctgcttctcttgaataacagaggagaattcaaatgaagcagaggaacctggcggcagcgcaaaagatg

SEQ ID NO: 189437 - DNA, 103 bp, Artificial Sequence
  Synthetic Polynucleotide
taatacgactcactataggggctcacaggcagcccgcttctccctctgctaacagaggagaagcagaatgagaagcgggaacctggcggcagcgcaaaagatg

SEQ ID NO: 189438 - DNA, 103 bp, Artificial Sequence
  Synthetic Polynucleotide
taatacgactcactatagggtggtgaagctgctcacaggcagcccgcttcaacagaggagagaagcgatgtgcctgtgaaacctggcggcagcgcaaaagatg

SEQ ID NO: 189439 - DNA, 103 bp, Artificial Sequence
  Synthetic Polynucleotide
taatacgactcactatagggctgttgctgctggtgaagctgctcacaggcaacagaggagagcctgtatgcagcttcacaacctggcggcagcgcaaaagatg

SEQ ID NO: 189440 - DNA, 103 bp, Artificial Sequence
  Synthetic Polynucleotide
taatacgactcactatagggcctgctgctgctgttgctgctggtgaagctaacagaggagaagcttcatgagcagcaacaacctggcggcagcgcaaaagatg

SEQ ID NO: 189441 - DNA, 103 bp, Artificial Sequence
  Synthetic Polynucleotide
taatacgactcactatagggccgccaccaccgcccccgccggagcctgagaacagaggagactcaggatgcggcgggggaacctggcggcagcgcaaaagatg

SEQ ID NO: 189442 - DNA, 103 bp, Artificial Sequence
  Synthetic Polynucleotide
taatacgactcactataggggcggtctcctcctgctgctgctgttgctgcaacagaggagagcagcaatggcagcagcaaacctggcggcagcgcaaaagatg

SEQ ID NO: 189443 - DNA, 103 bp, Artificial Sequence
  Synthetic Polynucleotide
taatacgactcactatagggggtggcagcggcggtctcctcctgctgctgaacagaggagacagcagatggaggagaccaacctggcggcagcgcaaaagatg

SEQ ID NO: 189444 - DNA, 103 bp, Artificial Sequence
  Synthetic Polynucleotide
taatacgactcactataggggcagtagcagggtggcagcggcggtctcctaacagaggagaaggagaatgccgctgccaaacctggcggcagcgcaaaagatg

SEQ ID NO: 189445 - DNA, 103 bp, Artificial Sequence
  Synthetic Polynucleotide
taatacgactcactatagggtcctcaccctgcagtagcagggtggcagcgaacagaggagacgctgcatgcctgctactaacctggcggcagcgcaaaagatg

SEQ ID NO: 189446 - DNA, 103 bp, Artificial Sequence
  Synthetic Polynucleotide
taatacgactcactatagggttccccttcttcctcaccctgcagtagcagaacagaggagactgctaatgcagggtgagaacctggcggcagcgcaaaagatg

SEQ ID NO: 189447 - DNA, 103 bp, Artificial Sequence
  Synthetic Polynucleotide
taatacgactcactataggggcgctcgctgccgctgtcgccgtccgccataacagaggagaatggcgatgggcgacagcaacctggcggcagcgcaaaagatg

SEQ ID NO: 189448 - DNA, 103 bp, Artificial Sequence
  Synthetic Polynucleotide
taatacgactcactataggggtccagccgcttcgaggccagctcctgcgtaacagaggagaacgcagatgctggcctcgaacctggcggcagcgcaaaagatg

SEQ ID NO: 189449 - DNA, 103 bp, Artificial Sequence
  Synthetic Polynucleotide
taatacgactcactatagggtgttctggatgtccagccgcttcgaggccaaacagaggagatggcctatgagcggctggaacctggcggcagcgcaaaagatg

SEQ ID NO: 189450 - DNA, 103 bp, Artificial Sequence
  Synthetic Polynucleotide
taatacgactcactatagggtagaagcgcttgttctggatgtccagccgcaacagaggagagcggctatgcatccagaaaacctggcggcagcgcaaaagatg

SEQ ID NO: 189451 - DNA, 103 bp, Artificial Sequence
  Synthetic Polynucleotide
taatacgactcactatagggcacatctaagtagaagcgcttgttctggataacagaggagaatccagatgaagcgcttcaacctggcggcagcgcaaaagatg

SEQ ID NO: 189452 - DNA, 103 bp, Artificial Sequence
  Synthetic Polynucleotide
taatacgactcactatagggcgttctgcttcacatctaagtagaagcgctaacagaggagaagcgctatgacttagatgaacctggcggcagcgcaaaagatg

SEQ ID NO: 189453 - DNA, 103 bp, Artificial Sequence
  Synthetic Polynucleotide
taatacgactcactatagggcggcccttggcgttctgcttcacatctaagaacagaggagacttagaatggaagcagaaaacctggcggcagcgcaaaagatg

SEQ ID NO: 189454 - DNA, 103 bp, Artificial Sequence
  Synthetic Polynucleotide
taatacgactcactatagggcttgaggaagcggcccttggcgttctgcttaacagaggagaaagcagatggccaagggcaacctggcggcagcgcaaaagatg

SEQ ID NO: 189455 - DNA, 103 bp, Artificial Sequence
  Synthetic Polynucleotide
taatacgactcactatagggcctcggcgatcttgaggaagcggcccttggaacagaggagaccaaggatggcttcctcaaacctggcggcagcgcaaaagatg

SEQ ID NO: 189456 - DNA, 103 bp, Artificial Sequence
  Synthetic Polynucleotide
taatacgactcactatagggcccgcgcccacctcggcgatcttgaggaagaacagaggagacttcctatggatcgccgaaacctggcggcagcgcaaaagatg

SEQ ID NO: 189457 - DNA, 103 bp, Artificial Sequence
  Synthetic Polynucleotide
taatacgactcactatagggcttggaaccgcccgcgcccacctcggcgataacagaggagaatcgccatggtgggcgcgaacctggcggcagcgcaaaagatg

SEQ ID NO: 189458 - DNA, 103 bp, Artificial Sequence
  Synthetic Polynucleotide
taatacgactcactatagggcgccgccgccgcgctcgctgccgctgtcgcaacagaggagagcgacaatggcagcgagcaacctggcggcagcgcaaaagatg

SEQ ID NO: 189459 - DNA, 103 bp, Artificial Sequence
  Synthetic Polynucleotide
taatacgactcactatagggtgaggcggctcttggaaccgcccgcgcccaaacagaggagatgggcgatggcggttccaaacctggcggcagcgcaaaagatg

SEQ ID NO: 189460 - DNA, 103 bp, Artificial Sequence
  Synthetic Polynucleotide
taatacgactcactatagggatggacagcgtgaggcggctcttggaaccgaacagaggagacggttcatggagccgcctaacctggcggcagcgcaaaagatg

SEQ ID NO: 189461 - DNA, 103 bp, Artificial Sequence
  Synthetic Polynucleotide
taatacgactcactatagggggccaccgccatggacagcgtgaggcggctaacagaggagaagccgcatgacgctgtccaacctggcggcagcgcaaaagatg

SEQ ID NO: 189462 - DNA, 103 bp, Artificial Sequence
  Synthetic Polynucleotide
taatacgactcactatagggggaactcggcggccaccgccatggacagcgaacagaggagacgctgtatgtggcggtggaacctggcggcagcgcaaaagatg

SEQ ID NO: 189463 - DNA, 103 bp, Artificial Sequence
  Synthetic Polynucleotide
taatacgactcactatagggagcgagtcgcggaactcggcggccaccgccaacagaggagaggcggtatgcgccgagttaacctggcggcagcgcaaaagatg

SEQ ID NO: 189464 - DNA, 103 bp, Artificial Sequence
  Synthetic Polynucleotide
taatacgactcactataggggaagtcgcccagcgagtcgcggaactcggcaacagaggagagccgagatgcgcgactcgaacctggcggcagcgcaaaagatg

SEQ ID NO: 189465 - DNA, 103 bp, Artificial Sequence
  Synthetic Polynucleotide
taatacgactcactatagggagtgttctatgaagtcgcccagcgagtcgcaacagaggagagcgactatgtgggcgactaacctggcggcagcgcaaaagatg

SEQ ID NO: 189466 - DNA, 103 bp, Artificial Sequence
  Synthetic Polynucleotide
taatacgactcactatagggagctgcgcgtagtgttctatgaagtcgcccaacagaggagagggcgaatgcatagaacaaacctggcggcagcgcaaaagatg

SEQ ID NO: 189467 - DNA, 103 bp, Artificial Sequence
  Synthetic Polynucleotide
taatacgactcactataggggctagggcccagctgcgcgtagtgttctataacagaggagaatagaaatgtacgcgcagaacctggcggcagcgcaaaagatg

SEQ ID NO: 189468 - DNA, 103 bp, Artificial Sequence
  Synthetic Polynucleotide
taatacgactcactataggggctcggggctgctagggcccagctgcgcgtaacagaggagaacgcgcatgtgggccctaaacctggcggcagcgcaaaagatg

SEQ ID NO: 189469 - DNA, 103 bp, Artificial Sequence
  Synthetic Polynucleotide
taatacgactcactatagggcacggcccaccgccgccgccgcgctcgctgaacagaggagacagcgaatgcggcggcggaacctggcggcagcgcaaaagatg

SEQ ID NO: 189470 - DNA, 103 bp, Artificial Sequence
  Synthetic Polynucleotide
taatacgactcactataggggccgccagctgctcggggctgctagggcccaacagaggagagggcccatgcagccccgaaacctggcggcagcgcaaaagatg

SEQ ID NO: 189471 - DNA, 103 bp, Artificial Sequence
  Synthetic Polynucleotide
taatacgactcactatagggctcggcgccagccgccagctgctcggggctaacagaggagaagccccatgcagctggcgaacctggcggcagcgcaaaagatg

SEQ ID NO: 189472 - DNA, 103 bp, Artificial Sequence
  Synthetic Polynucleotide
taatacgactcactatagggcgccgccctcctcggcgccagccgccagctaacagaggagaagctggatgctggcgccgaacctggcggcagcgcaaaagatg

SEQ ID NO: 189473 - DNA, 103 bp, Artificial Sequence
  Synthetic Polynucleotide
taatacgactcactatagggcgccgcggcccgccgccctcctcggcgccaaacagaggagatggcgcatgggagggcggaacctggcggcagcgcaaaagatg

SEQ ID NO: 189474 - DNA, 103 bp, Artificial Sequence
  Synthetic Polynucleotide
taatacgactcactatagggcttgagcgcgcgccgcggcccgccgccctcaacagaggagagagggcatggggccgcggaacctggcggcagcgcaaaagatg

SEQ ID NO: 189475 - DNA, 103 bp, Artificial Sequence
  Synthetic Polynucleotide
taatacgactcactatagggagaattcgctcttgagcgcgcgccgcggccaacagaggagaggccgcatggcgcgctcaaacctggcggcagcgcaaaagatg

SEQ ID NO: 189476 - DNA, 103 bp, Artificial Sequence
  Synthetic Polynucleotide
taatacgactcactatagggtcacgcaccaagaattcgctcttgagcgcgaacagaggagacgcgctatggagcgaattaacctggcggcagcgcaaaagatg

SEQ ID NO: 189477 - DNA, 103 bp, Artificial Sequence
  Synthetic Polynucleotide
taatacgactcactatagggcttgcggttctcacgcaccaagaattcgctaacagaggagaagcgaaatgttggtgcgtaacctggcggcagcgcaaaagatg

SEQ ID NO: 189478 - DNA, 103 bp, Artificial Sequence
  Synthetic Polynucleotide
taatacgactcactatagggccaggtagtacttgcggttctcacgcaccaaacagaggagatggtgcatgagaaccgcaaacctggcggcagcgcaaaagatg

SEQ ID NO: 189479 - DNA, 103 bp, Artificial Sequence
  Synthetic Polynucleotide
taatacgactcactatagggtccttgaggtccaggtagtacttgcggttcaacagaggagagaaccgatggtactacctaacctggcggcagcgcaaaagatg

SEQ ID NO: 189480 - DNA, 103 bp, Artificial Sequence
  Synthetic Polynucleotide
taatacgactcactatagggctggaacccgcacggcccaccgccgccgccaacagaggagaggcggcatgggtgggccgaacctggcggcagcgcaaaagatg

SEQ ID NO: 189481 - DNA, 103 bp, Artificial Sequence
  Synthetic Polynucleotide
taatacgactcactataggggcgctggttctccttgaggtccaggtagtaaacagaggagatactacatggacctcaagaacctggcggcagcgcaaaagatg

SEQ ID NO: 189482 - DNA, 103 bp, Artificial Sequence
  Synthetic Polynucleotide
taatacgactcactatagggggaagcggccgcgctggttctccttgaggtaacagaggagaacctcaatgagaaccagcaacctggcggcagcgcaaaagatg

SEQ ID NO: 189483 - DNA, 103 bp, Artificial Sequence
  Synthetic Polynucleotide
taatacgactcactatagggcggatgcgcaggaagcggccgcgctggttcaacagaggagagaaccaatgcggccgcttaacctggcggcagcgcaaaagatg

SEQ ID NO: 189484 - DNA, 103 bp, Artificial Sequence
  Synthetic Polynucleotide
taatacgactcactataggggaccgtttggcggatgcgcaggaagcggccaacagaggagaggccgcatgctgcgcatcaacctggcggcagcgcaaaagatg

SEQ ID NO: 189485 - DNA, 103 bp, Artificial Sequence
  Synthetic Polynucleotide
taatacgactcactatagggcgccgcggttgaccgtttggcggatgcgcaaacagaggagatgcgcaatggccaaacggaacctggcggcagcgcaaaagatg

SEQ ID NO: 189486 - DNA, 103 bp, Artificial Sequence
  Synthetic Polynucleotide
taatacgactcactatagggaagccgccaccgccgcggttgaccgtttggaacagaggagaccaaacatgcaaccgcggaacctggcggcagcgcaaaagatg

SEQ ID NO: 189487 - DNA, 103 bp, Artificial Sequence
  Synthetic Polynucleotide
taatacgactcactataggggcccgcgccgaagccgccaccgccgcggttaacagaggagaaaccgcatgggtggcggcaacctggcggcagcgcaaaagatg

SEQ ID NO: 189488 - DNA, 103 bp, Artificial Sequence
  Synthetic Polynucleotide
taatacgactcactatagggccggcccggggcccgcgccgaagccgccacaacagaggagagtggcgatgtcggcgcggaacctggcggcagcgcaaaagatg

SEQ ID NO: 189489 - DNA, 103 bp, Artificial Sequence
  Synthetic Polynucleotide
taatacgactcactatagggtgcaagccgcccggcccggggcccgcgccgaacagaggagacggcgcatgccccgggccaacctggcggcagcgcaaaagatg

SEQ ID NO: 189490 - DNA, 103 bp, Artificial Sequence
  Synthetic Polynucleotide
taatacgactcactatagggctggccgctctgcaagccgcccggcccgggaacagaggagacccgggatgggcggcttgaacctggcggcagcgcaaaagatg

SEQ ID NO: 189491 - DNA, 103 bp, Artificial Sequence
  Synthetic Polynucleotide
taatacgactcactataggggggacgcgggctggaacccgcacggcccacaacagaggagagtgggcatggcgggttccaacctggcggcagcgcaaaagatg

SEQ ID NO: 189492 - DNA, 103 bp, Artificial Sequence
  Synthetic Polynucleotide
taatacgactcactataggggcgcgatggtctggccgctctgcaagccgcaacagaggagagcggctatgagagcggccaacctggcggcagcgcaaaagatg

SEQ ID NO: 189493 - DNA, 103 bp, Artificial Sequence
  Synthetic Polynucleotide
taatacgactcactatagggtgcgcaggcagcgcgatggtctggccgctcaacagaggagagagcggatggaccatcgcaacctggcggcagcgcaaaagatg

SEQ ID NO: 189494 - DNA, 103 bp, Artificial Sequence
  Synthetic Polynucleotide
taatacgactcactataggggatgaggccctgcgcaggcagcgcgatggtaacagaggagaaccatcatgctgcctgcgaacctggcggcagcgcaaaagatg

SEQ ID NO: 189495 - DNA, 103 bp, Artificial Sequence
  Synthetic Polynucleotide
taatacgactcactatagggcgcggaactcgatgaggccctgcgcaggcaaacagaggagatgcctgatgagggcctcaaacctggcggcagcgcaaaagatg

SEQ ID NO: 189496 - DNA, 103 bp, Artificial Sequence
  Synthetic Polynucleotide
taatacgactcactataggggccagcgcgtcgcggaactcgatgaggcccaacagaggagagggcctatgcgagttccgaacctggcggcagcgcaaaagatg

SEQ ID NO: 189497 - DNA, 103 bp, Artificial Sequence
  Synthetic Polynucleotide
taatacgactcactatagggtatgagcttcgccagcgcgtcgcggaactcaacagaggagagagttcatggacgcgctgaacctggcggcagcgcaaaagatg

SEQ ID NO: 189498 - DNA, 103 bp, Artificial Sequence
  Synthetic Polynucleotide
taatacgactcactatagggcgtagtcgtctatgagcttcgccagcgcgtaacagaggagaacgcgcatgcgaagctcaaacctggcggcagcgcaaaagatg

SEQ ID NO: 189499 - DNA, 103 bp, Artificial Sequence
  Synthetic Polynucleotide
taatacgactcactatagggtcctcgcctccgtagtcgtctatgagcttcaacagaggagagaagctatgagacgactaaacctggcggcagcgcaaaagatg

SEQ ID NO: 189500 - DNA, 103 bp, Artificial Sequence
  Synthetic Polynucleotide
taatacgactcactatagggcagctcgtcgtcctcgcctccgtagtcgtcaacagaggagagacgacatgggaggcgagaacctggcggcagcgcaaaagatg

SEQ ID NO: 189501 - DNA, 103 bp, Artificial Sequence
  Synthetic Polynucleotide
taatacgactcactatagggggccgcctgccagctcgtcgtcctcgcctcaacagaggagagaggcgatgacgacgagcaacctggcggcagcgcaaaagatg

SEQ ID NO: 189502 - DNA, 103 bp, Artificial Sequence
  Synthetic Polynucleotide
taatacgactcactatagggccgccgccgcgggacgcgggctggaacccgaacagaggagacgggttatggcccgcgtcaacctggcggcagcgcaaaagatg

SEQ ID NO: 189503 - DNA, 103 bp, Artificial Sequence
  Synthetic Polynucleotide
taatacgactcactatagggccgcctcccgggccgcctgccagctcgtcgaacagaggagacgacgaatgggcaggcggaacctggcggcagcgcaaaagatg

SEQ ID NO: 189504 - DNA, 103 bp, Artificial Sequence
  Synthetic Polynucleotide
taatacgactcactataggggcccccggcgccgcctcccgggccgcctgcaacagaggagagcaggcatgccgggaggcaacctggcggcagcgcaaaagatg

SEQ ID NO: 189505 - DNA, 103 bp, Artificial Sequence
  Synthetic Polynucleotide
taatacgactcactatagggcgccccctgggcccccggcgccgcctcccgaacagaggagacgggagatggcgccggggaacctggcggcagcgcaaaagatg

SEQ ID NO: 189506 - DNA, 103 bp, Artificial Sequence
  Synthetic Polynucleotide
taatacgactcactatagggccatacaggccgccccctgggcccccggcgaacagaggagacgccggatgcccagggggaacctggcggcagcgcaaaagatg

SEQ ID NO: 189507 - DNA, 103 bp, Artificial Sequence
  Synthetic Polynucleotide
taatacgactcactatagggcgggagctctccatacaggccgccccctggaacagaggagaccagggatgggcctgtataacctggcggcagcgcaaaagatg

SEQ ID NO: 189508 - DNA, 103 bp, Artificial Sequence
  Synthetic Polynucleotide
taatacgactcactatagggaggtgccctccgggagctctccatacaggcaacagaggagagcctgtatggagagctccaacctggcggcagcgcaaaagatg

SEQ ID NO: 189509 - DNA, 103 bp, Artificial Sequence
  Synthetic Polynucleotide
taatacgactcactatagggacggtgatggaggtgccctccgggagctctaacagaggagaagagctatgggagggcacaacctggcggcagcgcaaaagatg

SEQ ID NO: 189510 - DNA, 103 bp, Artificial Sequence
  Synthetic Polynucleotide
taatacgactcactatagggcttggagtccacggtgatggaggtgccctcaacagaggagagagggcatgtccatcaccaacctggcggcagcgcaaaagatg

SEQ ID NO: 189511 - DNA, 103 bp, Artificial Sequence
  Synthetic Polynucleotide
taatacgactcactatagggagaagaagcgcttggagtccacggtgatggaacagaggagaccatcaatgtggactccaaacctggcggcagcgcaaaagatg

SEQ ID NO: 189512 - DNA, 103 bp, Artificial Sequence
  Synthetic Polynucleotide
taatacgactcactatagggcccacatcgaagaagaagcgcttggagtccaacagaggagaggactcatggcgcttcttaacctggcggcagcgcaaaagatg

SEQ ID NO: 189513 - DNA, 103 bp, Artificial Sequence
  Synthetic Polynucleotide
taatacgactcactatagggctcttgctcgccgccgccgcgggacgcgggaacagaggagacccgcgatgcgcggcggcaacctggcggcagcgcaaaagatg

SEQ ID NO: 189514 - DNA, 103 bp, Artificial Sequence
  Synthetic Polynucleotide
taatacgactcactatagggtttgttgcagcccacatcgaagaagaagcgaacagaggagacgcttcatgttcgatgtgaacctggcggcagcgcaaaagatg

SEQ ID NO: 189515 - DNA, 103 bp, Artificial Sequence
  Synthetic Polynucleotide
taatacgactcactatagggacaccccgtatttgttgcagcccacatcgaaacagaggagatcgatgatggctgcaacaaacctggcggcagcgcaaaagatg

SEQ ID NO: 189516 - DNA, 103 bp, Artificial Sequence
  Synthetic Polynucleotide
taatacgactcactatagggactcgcagaaacaccccgtatttgttgcagaacagaggagactgcaaatgatacggggtaacctggcggcagcgcaaaagatg

SEQ ID NO: 189517 - DNA, 103 bp, Artificial Sequence
  Synthetic Polynucleotide
taatacgactcactatagggcacctcgctcactcgcagaaacaccccgtaaacagaggagatacgggatgtttctgcgaaacctggcggcagcgcaaaagatg

SEQ ID NO: 189518 - DNA, 103 bp, Artificial Sequence
  Synthetic Polynucleotide
taatacgactcactatagggaggacggcttcacctcgctcactcgcagaaaacagaggagattctgcatgtgagcgaggaacctggcggcagcgcaaaagatg

SEQ ID NO: 189519 - DNA, 103 bp, Artificial Sequence
  Synthetic Polynucleotide
taatacgactcactataggggcattgcggtaggacggcttcacctcgctcaacagaggagagagcgaatggaagccgtcaacctggcggcagcgcaaaagatg

SEQ ID NO: 189520 - DNA, 103 bp, Artificial Sequence
  Synthetic Polynucleotide
taatacgactcactatagggtacggtgatggcattgcggtaggacggcttaacagaggagaaagccgatgtaccgcaataacctggcggcagcgcaaaagatg

SEQ ID NO: 189521 - DNA, 103 bp, Artificial Sequence
  Synthetic Polynucleotide
taatacgactcactatagggctttgaagggtacggtgatggcattgcggtaacagaggagaaccgcaatgccatcaccgaacctggcggcagcgcaaaagatg

SEQ ID NO: 189522 - DNA, 103 bp, Artificial Sequence
  Synthetic Polynucleotide
taatacgactcactatagggttgccccaggctttgaagggtacggtgatgaacagaggagacatcacatgacccttcaaaacctggcggcagcgcaaaagatg

SEQ ID NO: 189523 - DNA, 103 bp, Artificial Sequence
  Synthetic Polynucleotide
taatacgactcactataggggcctccgaacttgccccaggctttgaagggaacagaggagacccttcatggcctggggcaacctggcggcagcgcaaaagatg

SEQ ID NO: 189524 - DNA, 103 bp, Artificial Sequence
  Synthetic Polynucleotide
taatacgactcactataggggctcctgcgtctcttgctcgccgccgccgcaacagaggagagcggcgatggcgagcaagaacctggcggcagcgcaaaagatg

SEQ ID NO: 189525 - DNA, 103 bp, Artificial Sequence
  Synthetic Polynucleotide
taatacgactcactatagggggcaaaaggcgcctccgaacttgccccaggaacagaggagacctgggatgagttcggagaacctggcggcagcgcaaaagatg

SEQ ID NO: 189526 - DNA, 103 bp, Artificial Sequence
  Synthetic Polynucleotide
taatacgactcactatagggtccgcataccggcaaaaggcgcctccgaacaacagaggagagttcggatgcgccttttgaacctggcggcagcgcaaaagatg

SEQ ID NO: 189527 - DNA, 103 bp, Artificial Sequence
  Synthetic Polynucleotide
taatacgactcactatagggtttcatctcatccgcataccggcaaaaggcaacagaggagagcctttatgcggtatgcgaacctggcggcagcgcaaaagatg

SEQ ID NO: 189528 - DNA, 103 bp, Artificial Sequence
  Synthetic Polynucleotide
taatacgactcactatagggcctggatttctttcatctcatccgcataccaacagaggagaggtatgatgatgagatgaaacctggcggcagcgcaaaagatg

SEQ ID NO: 189529 - DNA, 103 bp, Artificial Sequence
  Synthetic Polynucleotide
taatacgactcactatagggctctgtcgttcctggatttctttcatctcaaacagaggagatgagatatgagaaatccaaacctggcggcagcgcaaaagatg

SEQ ID NO: 189530 - DNA, 103 bp, Artificial Sequence
  Synthetic Polynucleotide
taatacgactcactatagggaagcttatccctctgtcgttcctggatttcaacagaggagagaaatcatggaacgacagaacctggcggcagcgcaaaagatg

SEQ ID NO: 189531 - DNA, 103 bp, Artificial Sequence
  Synthetic Polynucleotide
taatacgactcactataggggtcgctcataaagcttatccctctgtcgttaacagaggagaaacgacatggggataagcaacctggcggcagcgcaaaagatg

SEQ ID NO: 189532 - DNA, 103 bp, Artificial Sequence
  Synthetic Polynucleotide
taatacgactcactatagggcccccaccacgtcgctcataaagcttatccaacagaggagaggataaatgttatgagcgaacctggcggcagcgcaaaagatg

SEQ ID NO: 189533 - DNA, 103 bp, Artificial Sequence
  Synthetic Polynucleotide
taatacgactcactataggggccgccgctgcccccaccacgtcgctcataaacagaggagatatgagatgcgtggtgggaacctggcggcagcgcaaaagatg

SEQ ID NO: 189534 - DNA, 103 bp, Artificial Sequence
  Synthetic Polynucleotide
taatacgactcactatagggactcttcgccgccgccgctgcccccaccacaacagaggagagtggtgatggcagcggcgaacctggcggcagcgcaaaagatg

SEQ ID NO: 189535 - DNA, 103 bp, Artificial Sequence
  Synthetic Polynucleotide
taatacgactcactatagggttcgaggccagctcctgcgtctcttgctcgaacagaggagacgagcaatggacgcaggaaacctggcggcagcgcaaaagatg

SEQ ID NO: 189536 - DNA, 103 bp, Artificial Sequence
  Synthetic Polynucleotide
taatacgactcactatagggtcaccctctgactcttcgccgccgccgctgaacagaggagacagcggatgcggcgaagaaacctggcggcagcgcaaaagatg

SEQ ID NO: 189537 - DNA, 103 bp, Artificial Sequence
  Synthetic Polynucleotide
taatacgactcactatagggatccacctcctcaccctctgactcttcgccaacagaggagaggcgaaatgtcagagggtaacctggcggcagcgcaaaagatg

SEQ ID NO: 189538 - DNA, 103 bp, Artificial Sequence
  Synthetic Polynucleotide
taatacgactcactataggggccgcctccccttcgcctggctctttccataacagaggagaatggaaatggccaggcgaaacctggcggcagcgcaaaagatg

SEQ ID NO: 189539 - DNA, 103 bp, Artificial Sequence
  Synthetic Polynucleotide
taatacgactcactatagggggggtagtgggagtgctgggcctggggataaacagaggagatatcccatggcccagcacaacctggcggcagcgcaaaagatg

SEQ ID NO: 189540 - DNA, 103 bp, Artificial Sequence
  Synthetic Polynucleotide
taatacgactcactatagggccgcgtagtgggggtagtgggagtgctgggaacagaggagacccagcatgcccactaccaacctggcggcagcgcaaaagatg

SEQ ID NO: 189541 - DNA, 103 bp, Artificial Sequence
  Synthetic Polynucleotide
taatacgactcactataggggtggctgaggccgcgtagtgggggtagtggaacagaggagaccactaatgccactacgcaacctggcggcagcgcaaaagatg

SEQ ID NO: 189542 - DNA, 103 bp, Artificial Sequence
  Synthetic Polynucleotide
taatacgactcactatagggctgattaggggtggctgaggccgcgtagtgaacagaggagacactacatggcctcagccaacctggcggcagcgcaaaagatg

SEQ ID NO: 189543 - DNA, 103 bp, Artificial Sequence
  Synthetic Polynucleotide
taatacgactcactatagggcgcccccggcctgattaggggtggctgaggaacagaggagacctcagatgcccctaatcaacctggcggcagcgcaaaagatg

SEQ ID NO: 189544 - DNA, 103 bp, Artificial Sequence
  Synthetic Polynucleotide
taatacgactcactatagggatttcggctgcgcccccggcctgattagggaacagaggagaccctaaatgggccgggggaacctggcggcagcgcaaaagatg

SEQ ID NO: 189545 - DNA, 103 bp, Artificial Sequence
  Synthetic Polynucleotide
taatacgactcactatagggcagctcctggatttcggctgcgcccccggcaacagaggagagccgggatggcagccgaaaacctggcggcagcgcaaaagatg

SEQ ID NO: 189546 - DNA, 103 bp, Artificial Sequence
  Synthetic Polynucleotide
taatacgactcactataggggtttggaggccagctcctggatttcggctgaacagaggagacagccgatgtccaggagcaacctggcggcagcgcaaaagatg

SEQ ID NO: 189547 - DNA, 103 bp, Artificial Sequence
  Synthetic Polynucleotide
taatacgactcactatagggatgtccactcgtttggaggccagctcctggaacagaggagaccaggaatgggcctccaaaacctggcggcagcgcaaaagatg

SEQ ID NO: 189548 - DNA, 103 bp, Artificial Sequence
  Synthetic Polynucleotide
taatacgactcactatagggctttttctggatgtccactcgtttggaggcaacagaggagagcctccatgcgagtggacaacctggcggcagcgcaaaagatg

SEQ ID NO: 189549 - DNA, 103 bp, Artificial Sequence
  Synthetic Polynucleotide
taatacgactcactatagggcgcggccgccgccgcctccccttcgcctggaacagaggagaccaggcatgggggaggcgaacctggcggcagcgcaaaagatg

SEQ ID NO: 189550 - DNA, 103 bp, Artificial Sequence
  Synthetic Polynucleotide
taatacgactcactatagggggtaaaacctctttttctggatgtccactcaacagaggagagagtggatgtccagaaaaaacctggcggcagcgcaaaagatg

SEQ ID NO: 189551 - DNA, 103 bp, Artificial Sequence
  Synthetic Polynucleotide
taatacgactcactatagggttcacgtctaggtaaaacctctttttctggaacagaggagaccagaaatggaggttttaaacctggcggcagcgcaaaagatg

SEQ ID NO: 189552 - DNA, 103 bp, Artificial Sequence
  Synthetic Polynucleotide
taatacgactcactatagggggagctttgcttcacgtctaggtaaaacctaacagaggagaaggtttatgctagacgtgaacctggcggcagcgcaaaagatg

SEQ ID NO: 189553 - DNA, 103 bp, Artificial Sequence
  Synthetic Polynucleotide
taatacgactcactatagggagcggccccgggagctttgcttcacgtctaaacagaggagatagacgatgagcaaagctaacctggcggcagcgcaaaagatg

SEQ ID NO: 189554 - DNA, 103 bp, Artificial Sequence
  Synthetic Polynucleotide
taatacgactcactatagggatctttaggaagcggccccgggagctttgcaacagaggagagcaaagatgccggggccgaacctggcggcagcgcaaaagatg

SEQ ID NO: 189555 - DNA, 103 bp, Artificial Sequence
  Synthetic Polynucleotide
taatacgactcactataggggacttcggctatctttaggaagcggccccgaacagaggagacggggcatgttcctaaagaacctggcggcagcgcaaaagatg

SEQ ID NO: 189556 - DNA, 103 bp, Artificial Sequence
  Synthetic Polynucleotide
taatacgactcactatagggtccctatccagacttcggctatctttaggaaacagaggagatcctaaatgtagccgaagaacctggcggcagcgcaaaagatg

SEQ ID NO: 189557 - DNA, 103 bp, Artificial Sequence
  Synthetic Polynucleotide
taatacgactcactatagggtgccggcctctccctatccagacttcggctaacagaggagaagccgaatgctggataggaacctggcggcagcgcaaaagatg

SEQ ID NO: 189558 - DNA, 103 bp, Artificial Sequence
  Synthetic Polynucleotide
taatacgactcactataggggatgttgtcctgccggcctctccctatccaaacagaggagatggataatgagaggccggaacctggcggcagcgcaaaagatg

SEQ ID NO: 189559 - DNA, 103 bp, Artificial Sequence
  Synthetic Polynucleotide
taatacgactcactatagggtactctttctgatgttgtcctgccggcctcaacagaggagagaggccatgaggacaacaaacctggcggcagcgcaaaagatg

SEQ ID NO: 189560 - DNA, 103 bp, Artificial Sequence
  Synthetic Polynucleotide
taatacgactcactatagggcctccgcggccgcggccgccgccgcctcccaacagaggagagggaggatgcggcggccgaacctggcggcagcgcaaaagatg

SEQ ID NO: 189561 - DNA, 103 bp, Artificial Sequence
  Synthetic Polynucleotide
taatacgactcactatagggagggtcagtttactctttctgatgttgtccaacagaggagaggacaaatgcagaaagagaacctggcggcagcgcaaaagatg

SEQ ID NO: 189562 - DNA, 103 bp, Artificial Sequence
  Synthetic Polynucleotide
taatacgactcactatagggagacagggagagggtcagtttactctttctaacagaggagaagaaagatgaaactgaccaacctggcggcagcgcaaaagatg

SEQ ID NO: 189563 - DNA, 103 bp, Artificial Sequence
  Synthetic Polynucleotide
taatacgactcactatagggccgctgccacagacagggagagggtcagttaacagaggagaaactgaatgtctccctgtaacctggcggcagcgcaaaagatg

SEQ ID NO: 189564 - DNA, 103 bp, Artificial Sequence
  Synthetic Polynucleotide
taatacgactcactatagggtccttcagctccgctgccacagacagggagaacagaggagactccctatgtgtggcagcaacctggcggcagcgcaaaagatg

SEQ ID NO: 189565 - DNA, 103 bp, Artificial Sequence
  Synthetic Polynucleotide
taatacgactcactatagggccctagacagtccttcagctccgctgccacaacagaggagagtggcaatggagctgaagaacctggcggcagcgcaaaagatg

SEQ ID NO: 189566 - DNA, 103 bp, Artificial Sequence
  Synthetic Polynucleotide
taatacgactcactatagggcgatgaagtcccctagacagtccttcagctaacagaggagaagctgaatgactgtctagaacctggcggcagcgcaaaagatg

SEQ ID NO: 189567 - DNA, 103 bp, Artificial Sequence
  Synthetic Polynucleotide
taatacgactcactataggggcatagtgctcgatgaagtcccctagacagaacagaggagactgtctatgggacttcataacctggcggcagcgcaaaagatg

SEQ ID NO: 189568 - DNA, 103 bp, Artificial Sequence
  Synthetic Polynucleotide
taatacgactcactataggggcccaggtgggcatagtgctcgatgaagtcaacagaggagagacttcatggagcactataacctggcggcagcgcaaaagatg

SEQ ID NO: 189569 - DNA, 103 bp, Artificial Sequence
  Synthetic Polynucleotide
taatacgactcactatagggggcctttcaggcccaggtgggcatagtgctaacagaggagaagcactatgcccacctggaacctggcggcagcgcaaaagatg

SEQ ID NO: 189570 - DNA, 103 bp, Artificial Sequence
  Synthetic Polynucleotide
taatacgactcactatagggtcttgccggtggcctttcaggcccaggtggaacagaggagaccacctatgcctgaaaggaacctggcggcagcgcaaaagatg

SEQ ID NO: 189571 - DNA, 103 bp, Artificial Sequence
  Synthetic Polynucleotide
taatacgactcactatagggtacattcttgcctccgcggccgcggccgccaacagaggagaggcggcatgggccgcggaaacctggcggcagcgcaaaagatg

SEQ ID NO: 189572 - DNA, 103 bp, Artificial Sequence
  Synthetic Polynucleotide
taatacgactcactataggggtggccatgctcttgccggtggcctttcagaacagaggagactgaaaatgcaccggcaaaacctggcggcagcgcaaaagatg

SEQ ID NO: 189573 - DNA, 103 bp, Artificial Sequence
  Synthetic Polynucleotide
taatacgactcactataggggctctttgctgtggccatgctcttgccggtaacagaggagaaccggcatgagcatggccaacctggcggcagcgcaaaagatg

SEQ ID NO: 189574 - DNA, 103 bp, Artificial Sequence
  Synthetic Polynucleotide
taatacgactcactatagggctggagccttgctctttgctgtggccatgcaacagaggagagcatggatgcagcaaagaaacctggcggcagcgcaaaagatg

SEQ ID NO: 189575 - DNA, 103 bp, Artificial Sequence
  Synthetic Polynucleotide
taatacgactcactatagggctgcctccttctggagccttgctctttgctaacagaggagaagcaaaatgcaaggctccaacctggcggcagcgcaaaagatg

SEQ ID NO: 189576 - DNA, 103 bp, Artificial Sequence
  Synthetic Polynucleotide
taatacgactcactatagggccgagtgcttctgcctccttctggagccttaacagaggagaaaggctatggaaggaggcaacctggcggcagcgcaaaagatg

SEQ ID NO: 189577 - DNA, 103 bp, Artificial Sequence
  Synthetic Polynucleotide
taatacgactcactatagggggggagggtgccgagtgcttctgcctccttaacagaggagaaaggagatggaagcactcaacctggcggcagcgcaaaagatg

SEQ ID NO: 189578 - DNA, 103 bp, Artificial Sequence
  Synthetic Polynucleotide
taatacgactcactatagggcgagactggtggggagggtgccgagtgcttaacagaggagaaagcacatggcaccctccaacctggcggcagcgcaaaagatg

SEQ ID NO: 189579 - DNA, 103 bp, Artificial Sequence
  Synthetic Polynucleotide
taatacgactcactatagggcggaccccaccgagactggtggggagggtgaacagaggagacaccctatgcaccagtctaacctggcggcagcgcaaaagatg

SEQ ID NO: 189580 - DNA, 103 bp, Artificial Sequence
  Synthetic Polynucleotide
taatacgactcactatagggggatgctcttcggaccccaccgagactggtaacagaggagaaccagtatgggtggggtcaacctggcggcagcgcaaaagatg

SEQ ID NO: 189581 - DNA, 103 bp, Artificial Sequence
  Synthetic Polynucleotide
taatacgactcactataggggacactgtgaggatgctcttcggaccccacaacagaggagagtggggatggaagagcataacctggcggcagcgcaaaagatg

SEQ ID NO: 189582 - DNA, 103 bp, Artificial Sequence
  Synthetic Polynucleotide
taatacgactcactatagggcagagccccctacattcttgcctccgcggcaacagaggagagccgcgatggcaagaatgaacctggcggcagcgcaaaagatg

SEQ ID NO: 189583 - DNA, 103 bp, Artificial Sequence
  Synthetic Polynucleotide
taatacgactcactatagggctgttttcaggacactgtgaggatgctcttaacagaggagaaagagcatgctcacagtgaacctggcggcagcgcaaaagatg

SEQ ID NO: 189584 - DNA, 103 bp, Artificial Sequence
  Synthetic Polynucleotide
taatacgactcactatagggtcgatatagtctgttttcaggacactgtgaaacagaggagatcacagatgcctgaaaacaacctggcggcagcgcaaaagatg

SEQ ID NO: 189585 - DNA, 103 bp, Artificial Sequence
  Synthetic Polynucleotide
taatacgactcactatagggattgtccctctcgatatagtctgttttcagaacagaggagactgaaaatggactatatcaacctggcggcagcgcaaaagatg

SEQ ID NO: 189586 - DNA, 103 bp, Artificial Sequence
  Synthetic Polynucleotide
taatacgactcactatagggaatatttcctattgtccctctcgatatagtaacagaggagaactataatgagagggacaaacctggcggcagcgcaaaagatg

SEQ ID NO: 189587 - DNA, 103 bp, Artificial Sequence
  Synthetic Polynucleotide
taatacgactcactatagggaggtctaggtaatatttcctattgtccctcaacagaggagagagggaatgtaggaaataaacctggcggcagcgcaaaagatg

SEQ ID NO: 189588 - DNA, 103 bp, Artificial Sequence
  Synthetic Polynucleotide
taatacgactcactatagggattttcctttaggtctaggtaatatttcctaacagaggagaaggaaaatgtacctagacaacctggcggcagcgcaaaagatg

SEQ ID NO: 189589 - DNA, 103 bp, Artificial Sequence
  Synthetic Polynucleotide
taatacgactcactataggggaccccgctgattttcctttaggtctaggtaacagaggagaacctagatgtaaaggaaaaacctggcggcagcgcaaaagatg

SEQ ID NO: 189590 - DNA, 103 bp, Artificial Sequence
  Synthetic Polynucleotide
taatacgactcactatagggcgtaggaagcgaccccgctgattttcctttaacagaggagaaaaggaatgtcagcggggaacctggcggcagcgcaaaagatg

SEQ ID NO: 189591 - DNA, 103 bp, Artificial Sequence
  Synthetic Polynucleotide
taatacgactcactatagggttgtctaatccgtaggaagcgaccccgctgaacagaggagacagcggatgcgcttcctaaacctggcggcagcgcaaaagatg

SEQ ID NO: 189592 - DNA, 103 bp, Artificial Sequence
  Synthetic Polynucleotide
taatacgactcactataggggcatcatggtttgtctaatccgtaggaagcaacagaggagagcttccatgggattagacaacctggcggcagcgcaaaagatg

SEQ ID NO: 189593 - DNA, 103 bp, Artificial Sequence
  Synthetic Polynucleotide
taatacgactcactatagggttgcttaggccagagccccctacattcttgaacagaggagacaagaaatgagggggctcaacctggcggcagcgcaaaagatg

SEQ ID NO: 189594 - DNA, 103 bp, Artificial Sequence
  Synthetic Polynucleotide
taatacgactcactatagggccagtcccccgcatcatggtttgtctaatcaacagaggagagattagatgaaccatgataacctggcggcagcgcaaaagatg

SEQ ID NO: 189595 - DNA, 103 bp, Artificial Sequence
  Synthetic Polynucleotide
taatacgactcactatagggacctatcatgccagtcccccgcatcatggtaacagaggagaaccatgatgcgggggactaacctggcggcagcgcaaaagatg

SEQ ID NO: 189596 - DNA, 103 bp, Artificial Sequence
  Synthetic Polynucleotide
taatacgactcactatagggggccaaaataacctatcatgccagtcccccaacagaggagagggggaatggcatgatagaacctggcggcagcgcaaaagatg

SEQ ID NO: 189597 - DNA, 103 bp, Artificial Sequence
  Synthetic Polynucleotide
taatacgactcactatagggcccaaactgtggccaaaataacctatcatgaacagaggagacatgatatgttattttggaacctggcggcagcgcaaaagatg

SEQ ID NO: 189598 - DNA, 103 bp, Artificial Sequence
  Synthetic Polynucleotide
taatacgactcactatagggctgttcttggcccaaactgtggccaaaataaacagaggagatattttatgcacagtttgaacctggcggcagcgcaaaagatg

SEQ ID NO: 189599 - DNA, 103 bp, Artificial Sequence
  Synthetic Polynucleotide
taatacgactcactatagggggacaatagtctgttcttggcccaaactgtaacagaggagaacagttatggccaagaacaacctggcggcagcgcaaaagatg

SEQ ID NO: 189600 - DNA, 103 bp, Artificial Sequence
  Synthetic Polynucleotide
taatacgactcactatagggtgtgctgggaggacaatagtctgttcttggaacagaggagaccaagaatggactattgtaacctggcggcagcgcaaaagatg

SEQ ID NO: 189601 - DNA, 103 bp, Artificial Sequence
  Synthetic Polynucleotide
taatacgactcactatagggaatcattccttgtgctgggaggacaatagtaacagaggagaactattatgctcccagcaaacctggcggcagcgcaaaagatg

SEQ ID NO: 189602 - DNA, 103 bp, Artificial Sequence
  Synthetic Polynucleotide
taatacgactcactatagggcacgaaactcaatcattccttgtgctgggaaacagaggagatcccagatgaaggaatgaaacctggcggcagcgcaaaagatg

SEQ ID NO: 189603 - DNA, 103 bp, Artificial Sequence
  Synthetic Polynucleotide
taatacgactcactatagggaccaaggcatcacgaaactcaatcattcctaacagaggagaaggaatatgtgagtttcgaacctggcggcagcgcaaaagatg

SEQ ID NO: 189604 - DNA, 103 bp, Artificial Sequence
  Synthetic Polynucleotide
taatacgactcactataggggagtctactcttgcttaggccagagcccccaacagaggagagggggcatgggcctaagcaacctggcggcagcgcaaaagatg

SEQ ID NO: 189605 - DNA, 103 bp, Artificial Sequence
  Synthetic Polynucleotide
taatacgactcactatagggaatcagctgaaccaaggcatcacgaaactcaacagaggagagagtttatggatgccttgaacctggcggcagcgcaaaagatg

SEQ ID NO: 189606 - DNA, 103 bp, Artificial Sequence
  Synthetic Polynucleotide
taatacgactcactatagggcatagtcttcaatcagctgaaccaaggcataacagaggagaatgcctatgttcagctgaaacctggcggcagcgcaaaagatg

SEQ ID NO: 189607 - DNA, 103 bp, Artificial Sequence
  Synthetic Polynucleotide
taatacgactcactatagggtctccttcgccatagtcttcaatcagctgaaacagaggagatcagctatgtgaagactaaacctggcggcagcgcaaaagatg

SEQ ID NO: 189608 - DNA, 103 bp, Artificial Sequence
  Synthetic Polynucleotide
taatacgactcactatagggttcttctatgtctccttcgccatagtcttcaacagaggagagaagacatgggcgaaggaaacctggcggcagcgcaaaagatg

SEQ ID NO: 189609 - DNA, 103 bp, Artificial Sequence
  Synthetic Polynucleotide
taatacgactcactatagggcacctcttcgttcttctatgtctccttcgcaacagaggagagcgaagatgacatagaagaacctggcggcagcgcaaaagatg

SEQ ID NO: 189610 - DNA, 103 bp, Artificial Sequence
  Synthetic Polynucleotide
taatacgactcactatagggtcatcgtctccacctcttcgttcttctatgaacagaggagacatagaatgacgaagaggaacctggcggcagcgcaaaagatg

SEQ ID NO: 189611 - DNA, 103 bp, Artificial Sequence
  Synthetic Polynucleotide
taatacgactcactatagggttcaagcgggtcatcgtctccacctcttcgaacagaggagacgaagaatgggagacgataacctggcggcagcgcaaaagatg

SEQ ID NO: 189612 - DNA, 103 bp, Artificial Sequence
  Synthetic Polynucleotide
taatacgactcactatagggcctctgggagttcaagcgggtcatcgtctcaacagaggagagagacgatgacccgcttgaacctggcggcagcgcaaaagatg

SEQ ID NO: 189613 - DNA, 103 bp, Artificial Sequence
  Synthetic Polynucleotide
taatacgactcactatagggaaagaagtcccctctgggagttcaagcgggaacagaggagacccgctatgactcccagaaacctggcggcagcgcaaaagatg

SEQ ID NO: 189614 - DNA, 103 bp, Artificial Sequence
  Synthetic Polynucleotide
taatacgactcactataggggtccactctgaaagaagtcccctctgggagaacagaggagactcccaatggggacttctaacctggcggcagcgcaaaagatg

SEQ ID NO: 189615 - DNA, 103 bp, Artificial Sequence
  Synthetic Polynucleotide
taatacgactcactatagggcctggggatagagtctactcttgcttaggcaacagaggagagcctaaatgagagtagacaacctggcggcagcgcaaaagatg

SEQ ID NO: 189616 - DNA, 103 bp, Artificial Sequence
  Synthetic Polynucleotide
taatacgactcactatagggaccttttattgtccactctgaaagaagtccaacagaggagaggacttatgtcagagtggaacctggcggcagcgcaaaagatg

SEQ ID NO: 189617 - DNA, 103 bp, Artificial Sequence
  Synthetic Polynucleotide
taatacgactcactatagggtcaaagtagaaccttttattgtccactctgaacagaggagacagagtatgcaataaaagaacctggcggcagcgcaaaagatg

SEQ ID NO: 189618 - DNA, 103 bp, Artificial Sequence
  Synthetic Polynucleotide
taatacgactcactatagggagagcccacatcaaagtagaaccttttattaacagaggagaaataaaatgttctactttaacctggcggcagcgcaaaagatg

SEQ ID NO: 189619 - DNA, 103 bp, Artificial Sequence
  Synthetic Polynucleotide
taatacgactcactatagggcatatttattagagcccacatcaaagtagaaacagaggagatctactatgatgtgggctaacctggcggcagcgcaaaagatg

SEQ ID NO: 189620 - DNA, 103 bp, Artificial Sequence
  Synthetic Polynucleotide
taatacgactcactatagggaggaaaattccatatttattagagcccacaaacagaggagatgtgggatgtaataaataaacctggcggcagcgcaaaagatg

SEQ ID NO: 189621 - DNA, 103 bp, Artificial Sequence
  Synthetic Polynucleotide
taatacgactcactatagggtgtgagcttcaggaaaattccatatttattaacagaggagaaataaaatgggaattttcaacctggcggcagcgcaaaagatg

SEQ ID NO: 189622 - DNA, 103 bp, Artificial Sequence
  Synthetic Polynucleotide
taatacgactcactatagggtggggtaatttgtgagcttcaggaaaattcaacagaggagagaatttatgtgaagctcaaacctggcggcagcgcaaaagatg

SEQ ID NO: 189623 - DNA, 103 bp, Artificial Sequence
  Synthetic Polynucleotide
taatacgactcactatagggtctctggatttggggtaatttgtgagcttcaacagaggagagaagctatgaaattacccaacctggcggcagcgcaaaagatg

SEQ ID NO: 189624 - DNA, 103 bp, Artificial Sequence
  Synthetic Polynucleotide
taatacgactcactataggggttgatattctctctggatttggggtaattaacagaggagaaattacatgaaatccagaaacctggcggcagcgcaaaagatg

SEQ ID NO: 189625 - DNA, 103 bp, Artificial Sequence
  Synthetic Polynucleotide
taatacgactcactatagggagtgaaaaaggttgatattctctctggattaacagaggagaaatccaatgagaatatcaaacctggcggcagcgcaaaagatg

SEQ ID NO: 189626 - DNA, 103 bp, Artificial Sequence
  Synthetic Polynucleotide
taatacgactcactataggggagtgctgggcctggggatagagtctactcaacagaggagagagtagatgctatccccaaacctggcggcagcgcaaaagatg

SEQ ID NO: 189627 - DNA, 103 bp, Artificial Sequence
  Synthetic Polynucleotide
taatacgactcactatagggatttgacaacagtgaaaaaggttgatattcaacagaggagagaatatatgcctttttcaaacctggcggcagcgcaaaagatg

SEQ ID NO: 189628 - DNA, 103 bp, Artificial Sequence
  Synthetic Polynucleotide
taatacgactcactatagggcttatgcttgatttgacaacagtgaaaaagaacagaggagactttttatgtgttgtcaaaacctggcggcagcgcaaaagatg

SEQ ID NO: 189629 - DNA, 103 bp, Artificial Sequence
  Synthetic Polynucleotide
taatacgactcactatagggggggctgttccttatgcttgatttgacaacaacagaggagagttgtcatgtcaagcataaacctggcggcagcgcaaaagatg

SEQ ID NO: 189630 - DNA, 103 bp, Artificial Sequence
  Synthetic Polynucleotide
taatacgactcactataggggtagtatcatggggctgttccttatgcttgaacagaggagacaagcaatgggaacagccaacctggcggcagcgcaaaagatg

SEQ ID NO: 189631 - DNA, 103 bp, Artificial Sequence
  Synthetic Polynucleotide
taatacgactcactatagggaactgtttttgtagtatcatggggctgttcaacagaggagagaacagatgcatgatactaacctggcggcagcgcaaaagatg

SEQ ID NO: 189632 - DNA, 103 bp, Artificial Sequence
  Synthetic Polynucleotide
taatacgactcactataggggaaaccacacctttctcgaaaagactgcataacagaggagaatgcagatgtttcgagaaaacctggcggcagcgcaaaagatg

SEQ ID NO: 189633 - DNA, 103 bp, Artificial Sequence
  Synthetic Polynucleotide
taatacgactcactataggggcagcttagcccggcctgactcggctgcctaacagaggagaaggcagatgagtcaggccaacctggcggcagcgcaaaagatg

SEQ ID NO: 189634 - DNA, 103 bp, Artificial Sequence
  Synthetic Polynucleotide
taatacgactcactatagggggggctgaaggtctggtagtactgctctggaacagaggagaccagagatgtactaccagaacctggcggcagcgcaaaagatg

SEQ ID NO: 189635 - DNA, 103 bp, Artificial Sequence
  Synthetic Polynucleotide
taatacgactcactatagggggctggagctggggctgaaggtctggtagtaacagaggagaactaccatgccttcagccaacctggcggcagcgcaaaagatg

SEQ ID NO: 189636 - DNA, 103 bp, Artificial Sequence
  Synthetic Polynucleotide
taatacgactcactataggggcgggtgagtggctggagctggggctgaagaacagaggagacttcagatgcagctccagaacctggcggcagcgcaaaagatg

SEQ ID NO: 189637 - DNA, 103 bp, Artificial Sequence
  Synthetic Polynucleotide
taatacgactcactatagggcacggagcgggcgggtgagtggctggagctaacagaggagaagctccatgcactcacccaacctggcggcagcgcaaaagatg

SEQ ID NO: 189638 - DNA, 103 bp, Artificial Sequence
  Synthetic Polynucleotide
taatacgactcactataggggtgagcggcccacggagcgggcgggtgagtaacagaggagaactcacatgcccgctccgaacctggcggcagcgcaaaagatg

SEQ ID NO: 189639 - DNA, 103 bp, Artificial Sequence
  Synthetic Polynucleotide
taatacgactcactatagggctgtaggaaggtgagcggcccacggagcggaacagaggagaccgctcatggggccgctcaacctggcggcagcgcaaaagatg

SEQ ID NO: 189640 - DNA, 103 bp, Artificial Sequence
  Synthetic Polynucleotide
taatacgactcactatagggcggtgtggaactgtaggaaggtgagcggccaacagaggagaggccgcatgccttcctacaacctggcggcagcgcaaaagatg

SEQ ID NO: 189641 - DNA, 103 bp, Artificial Sequence
  Synthetic Polynucleotide
taatacgactcactatagggtcagcggcgacggtgtggaactgtaggaagaacagaggagacttcctatggttccacacaacctggcggcagcgcaaaagatg

SEQ ID NO: 189642 - DNA, 103 bp, Artificial Sequence
  Synthetic Polynucleotide
taatacgactcactatagggaggtttggcatcagcggcgacggtgtggaaaacagaggagattccacatggtcgccgctaacctggcggcagcgcaaaagatg

SEQ ID NO: 189643 - DNA, 103 bp, Artificial Sequence
  Synthetic Polynucleotide
taatacgactcactatagggaaagttctccaggtttggcatcagcggcgaaacagaggagatcgccgatgatgccaaacaacctggcggcagcgcaaaagatg

SEQ ID NO: 189644 - DNA, 103 bp, Artificial Sequence
  Synthetic Polynucleotide
taatacgactcactataggggctgccggtcgcagcttagcccggcctgacaacagaggagagtcaggatgggctaagctaacctggcggcagcgcaaaagatg

SEQ ID NO: 189645 - DNA, 103 bp, Artificial Sequence
  Synthetic Polynucleotide
taatacgactcactatagggggctgtagggaaagttctccaggtttggcaaacagaggagatgccaaatgtggagaactaacctggcggcagcgcaaaagatg

SEQ ID NO: 189646 - DNA, 103 bp, Artificial Sequence
  Synthetic Polynucleotide
taatacgactcactatagggagcggctgctggctgtagggaaagttctccaacagaggagaggagaaatgtccctacagaacctggcggcagcgcaaaagatg

SEQ ID NO: 189647 - DNA, 103 bp, Artificial Sequence
  Synthetic Polynucleotide
taatacgactcactatagggcccggtgctgagcggctgctggctgtagggaacagaggagaccctacatgcagcagccgaacctggcggcagcgcaaaagatg

SEQ ID NO: 189648 - DNA, 103 bp, Artificial Sequence
  Synthetic Polynucleotide
taatacgactcactatagggcggggaaggccccggtgctgagcggctgctaacagaggagaagcagcatgtcagcaccgaacctggcggcagcgcaaaagatg

SEQ ID NO: 189649 - DNA, 103 bp, Artificial Sequence
  Synthetic Polynucleotide
taatacgactcactataggggtgatccctgcggggaaggccccggtgctgaacagaggagacagcacatgggccttcccaacctggcggcagcgcaaaagatg

SEQ ID NO: 189650 - DNA, 103 bp, Artificial Sequence
  Synthetic Polynucleotide
taatacgactcactataggggctgtggtcagtgatccctgcggggaaggcaacagaggagagccttcatggcagggatcaacctggcggcagcgcaaaagatg

SEQ ID NO: 189651 - DNA, 103 bp, Artificial Sequence
  Synthetic Polynucleotide
taatacgactcactataggggcatgaagtggctgtggtcagtgatccctgaacagaggagacagggaatgctgaccacaaacctggcggcagcgcaaaagatg

SEQ ID NO: 189652 - DNA, 103 bp, Artificial Sequence
  Synthetic Polynucleotide
taatacgactcactatagggttgagcaggggcatgaagtggctgtggtcaaacagaggagatgaccaatgccacttcataacctggcggcagcgcaaaagatg

SEQ ID NO: 189653 - DNA, 103 bp, Artificial Sequence
  Synthetic Polynucleotide
taatacgactcactatagggtggggagggattgagcaggggcatgaagtgaacagaggagacacttcatgcccctgctcaacctggcggcagcgcaaaagatg

SEQ ID NO: 189654 - DNA, 103 bp, Artificial Sequence
  Synthetic Polynucleotide
taatacgactcactatagggtggcatccgttggggagggattgagcagggaacagaggagaccctgcatgatccctcccaacctggcggcagcgcaaaagatg

SEQ ID NO: 189655 - DNA, 103 bp, Artificial Sequence
  Synthetic Polynucleotide
taatacgactcactataggggcgagcagccgctgccggtcgcagcttagcaacagaggagagctaagatgcgaccggcaaacctggcggcagcgcaaaagatg

SEQ ID NO: 189656 - DNA, 103 bp, Artificial Sequence
  Synthetic Polynucleotide
taatacgactcactatagggacagagctggtggcatccgttggggagggaaacagaggagatccctcatgaacggatgcaacctggcggcagcgcaaaagatg

SEQ ID NO: 189657 - DNA, 103 bp, Artificial Sequence
  Synthetic Polynucleotide
taatacgactcactatagggctgggtgtccacagagctggtggcatccgtaacagaggagaacggatatgaccagctctaacctggcggcagcgcaaaagatg

SEQ ID NO: 189658 - DNA, 103 bp, Artificial Sequence
  Synthetic Polynucleotide
taatacgactcactatagggagttgccagcctgggtgtccacagagctggaacagaggagaccagctatgtggacacccaacctggcggcagcgcaaaagatg

SEQ ID NO: 189659 - DNA, 103 bp, Artificial Sequence
  Synthetic Polynucleotide
taatacgactcactatagggaggggcttgcagttgccagcctgggtgtccaacagaggagaggacacatgggctggcaaaacctggcggcagcgcaaaagatg

SEQ ID NO: 189660 - DNA, 103 bp, Artificial Sequence
  Synthetic Polynucleotide
taatacgactcactataggggtccttctgaaggggcttgcagttgccagcaacagaggagagctggcatgtgcaagcccaacctggcggcagcgcaaaagatg

SEQ ID NO: 189661 - DNA, 103 bp, Artificial Sequence
  Synthetic Polynucleotide
taatacgactcactatagggcagggagcttgtccttctgaaggggcttgcaacagaggagagcaagcatgttcagaaggaacctggcggcagcgcaaaagatg

SEQ ID NO: 189662 - DNA, 103 bp, Artificial Sequence
  Synthetic Polynucleotide
taatacgactcactatagggagcaggttctcagggagcttgtccttctgaaacagaggagatcagaaatgcaagctcccaacctggcggcagcgcaaaagatg

SEQ ID NO: 189663 - DNA, 103 bp, Artificial Sequence
  Synthetic Polynucleotide
taatacgactcactataggggagatccgacagcaggttctcagggagcttaacagaggagaaagctcatggagaacctgaacctggcggcagcgcaaaagatg

SEQ ID NO: 189664 - DNA, 103 bp, Artificial Sequence
  Synthetic Polynucleotide
taatacgactcactatagggtctgcaggctgagatccgacagcaggttctaacagaggagaagaaccatgtgtcggatcaacctggcggcagcgcaaaagatg

SEQ ID NO: 189665 - DNA, 103 bp, Artificial Sequence
  Synthetic Polynucleotide
taatacgactcactataggggccgtgaggctctgcaggctgagatccgacaacagaggagagtcggaatgcagcctgcaaacctggcggcagcgcaaaagatg

SEQ ID NO: 189666 - DNA, 103 bp, Artificial Sequence
  Synthetic Polynucleotide
taatacgactcactatagggatagtccttggcgagcagccgctgccggtcaacagaggagagaccggatgcggctgctcaacctggcggcagcgcaaaagatg

SEQ ID NO: 189667 - DNA, 103 bp, Artificial Sequence
  Synthetic Polynucleotide
taatacgactcactatagggtgaggtcagcgccgtgaggctctgcaggctaacagaggagaagcctgatgagcctcacgaacctggcggcagcgcaaaagatg

SEQ ID NO: 189668 - DNA, 103 bp, Artificial Sequence
  Synthetic Polynucleotide
taatacgactcactatagggtctccacctgtgaggtcagcgccgtgaggcaacagaggagagcctcaatgcgctgacctaacctggcggcagcgcaaaagatg

SEQ ID NO: 189669 - DNA, 103 bp, Artificial Sequence
  Synthetic Polynucleotide
taatacgactcactatagggttggagatgttctccacctgtgaggtcagcaacagaggagagctgacatgacaggtggaaacctggcggcagcgcaaaagatg

SEQ ID NO: 189670 - DNA, 103 bp, Artificial Sequence
  Synthetic Polynucleotide
taatacgactcactatagggctggacggtgttggagatgttctccacctgaacagaggagacaggtgatgaacatctccaacctggcggcagcgcaaaagatg

SEQ ID NO: 189671 - DNA, 103 bp, Artificial Sequence
  Synthetic Polynucleotide
taatacgactcactataggggcagcagctgctggacggtgttggagatgtaacagaggagaacatctatgacaccgtccaacctggcggcagcgcaaaagatg

SEQ ID NO: 189672 - DNA, 103 bp, Artificial Sequence
  Synthetic Polynucleotide
taatacgactcactataggggccttggagagcagcagctgctggacggtgaacagaggagacaccgtatggcagctgctaacctggcggcagcgcaaaagatg

SEQ ID NO: 189673 - DNA, 103 bp, Artificial Sequence
  Synthetic Polynucleotide
taatacgactcactatagggcggcacagcagccttggagagcagcagctgaacagaggagacagctgatgctctccaagaacctggcggcagcgcaaaagatg

SEQ ID NO: 189674 - DNA, 103 bp, Artificial Sequence
  Synthetic Polynucleotide
taatacgactcactatagggctttcttctgcggcacagcagccttggagaaacagaggagatctccaatgctgctgtgcaacctggcggcagcgcaaaagatg

SEQ ID NO: 189675 - DNA, 103 bp, Artificial Sequence
  Synthetic Polynucleotide
taatacgactcactatagggttcttgacacctttcttctgcggcacagcaaacagaggagatgctgtatggcagaagaaaacctggcggcagcgcaaaagatg

SEQ ID NO: 189676 - DNA, 103 bp, Artificial Sequence
  Synthetic Polynucleotide
taatacgactcactatagggggacacgaggttcttgacacctttcttctgaacagaggagacagaagatgggtgtcaagaacctggcggcagcgcaaaagatg

SEQ ID NO: 189677 - DNA, 103 bp, Artificial Sequence
  Synthetic Polynucleotide
taatacgactcactataggggcgggttataatagtccttggcgagcagccaacagaggagaggctgcatgccaaggactaacctggcggcagcgcaaaagatg

SEQ ID NO: 189678 - DNA, 103 bp, Artificial Sequence
  Synthetic Polynucleotide
taatacgactcactatagggctggggtcctggacacgaggttcttgacacaacagaggagagtgtcaatgacctcgtgtaacctggcggcagcgcaaaagatg

SEQ ID NO: 189679 - DNA, 103 bp, Artificial Sequence
  Synthetic Polynucleotide
taatacgactcactatagggttatgctgctctggggtcctggacacgaggaacagaggagacctcgtatgcaggaccccaacctggcggcagcgcaaaagatg

SEQ ID NO: 189680 - DNA, 103 bp, Artificial Sequence
  Synthetic Polynucleotide
taatacgactcactataggggtgctggcttttatgctgctctggggtcctaacagaggagaaggaccatggagcagcataacctggcggcagcgcaaaagatg

SEQ ID NO: 189681 - DNA, 103 bp, Artificial Sequence
  Synthetic Polynucleotide
taatacgactcactatagggcggggctgcagtgctggcttttatgctgctaacagaggagaagcagcatgaaagccagcaacctggcggcagcgcaaaagatg

SEQ ID NO: 189682 - DNA, 103 bp, Artificial Sequence
  Synthetic Polynucleotide
taatacgactcactatagggccgctcccttcggggctgcagtgctggcttaacagaggagaaagccaatgctgcagcccaacctggcggcagcgcaaaagatg

SEQ ID NO: 189683 - DNA, 103 bp, Artificial Sequence
  Synthetic Polynucleotide
taatacgactcactatagggggctgagtagccgctcccttcggggctgcaaacagaggagatgcagcatggaagggagcaacctggcggcagcgcaaaagatg

SEQ ID NO: 189684 - DNA, 103 bp, Artificial Sequence
  Synthetic Polynucleotide
taatacgactcactatagggctgcgggctcggctgagtagccgctcccttaacagaggagaaagggaatggctactcagaacctggcggcagcgcaaaagatg

SEQ ID NO: 189685 - DNA, 103 bp, Artificial Sequence
  Synthetic Polynucleotide
taatacgactcactatagggagcggtgtgcctgcgggctcggctgagtagaacagaggagactactcatgcgagcccgcaacctggcggcagcgcaaaagatg

SEQ ID NO: 189686 - DNA, 103 bp, Artificial Sequence
  Synthetic Polynucleotide
taatacgactcactatagggcggctctgacagcggtgtgcctgcgggctcaacagaggagagagcccatgggcacaccgaacctggcggcagcgcaaaagatg

SEQ ID NO: 189687 - DNA, 103 bp, Artificial Sequence
  Synthetic Polynucleotide
taatacgactcactatagggtgctgctcggcggctctgacagcggtgtgcaacagaggagagcacacatgtgtcagagcaacctggcggcagcgcaaaagatg

SEQ ID NO: 189688 - DNA, 103 bp, Artificial Sequence
  Synthetic Polynucleotide
taatacgactcactataggggggtaaggctgcgggttataatagtccttgaacagaggagacaaggaatgttataacccaacctggcggcagcgcaaaagatg

SEQ ID NO: 189689 - DNA, 103 bp, Artificial Sequence
  Synthetic Polynucleotide
taatacgactcactataggggactgtggcgtgctgctcggcggctctgacaacagaggagagtcagaatggccgagcagaacctggcggcagcgcaaaagatg

SEQ ID NO: 189690 - DNA, 103 bp, Artificial Sequence
  Synthetic Polynucleotide
taatacgactcactatagggcgcatgcgtggactgtggcgtgctgctcggaacagaggagaccgagcatgacgccacagaacctggcggcagcgcaaaagatg

SEQ ID NO: 189691 - DNA, 103 bp, Artificial Sequence
  Synthetic Polynucleotide
taatacgactcactatagggcctgcggctccgcatgcgtggactgtggcgaacagaggagacgccacatgccacgcatgaacctggcggcagcgcaaaagatg

SEQ ID NO: 189692 - DNA, 103 bp, Artificial Sequence
  Synthetic Polynucleotide
taatacgactcactatagggtagtcggcctcctgcggctccgcatgcgtgaacagaggagacacgcaatgggagccgcaaacctggcggcagcgcaaaagatg

SEQ ID NO: 189693 - DNA, 103 bp, Artificial Sequence
  Synthetic Polynucleotide
taatacgactcactataggggccgctcaggtagtcggcctcctgcggctcaacagaggagagagccgatggaggccgacaacctggcggcagcgcaaaagatg

SEQ ID NO: 189694 - DNA, 103 bp, Artificial Sequence
  Synthetic Polynucleotide
taatacgactcactatagggggtcctcggagccgctcaggtagtcggcctaacagaggagaaggccgatgacctgagcgaacctggcggcagcgcaaaagatg

SEQ ID NO: 189695 - DNA, 103 bp, Artificial Sequence
  Synthetic Polynucleotide
taatacgactcactatagggcgctccagtgggtcctcggagccgctcaggaacagaggagacctgagatgctccgaggaaacctggcggcagcgcaaaagatg

SEQ ID NO: 189696 - DNA, 103 bp, Artificial Sequence
  Synthetic Polynucleotide
taatacgactcactataggggaggaagctgcgctccagtgggtcctcggaaacagaggagatccgagatgccactggagaacctggcggcagcgcaaaagatg

SEQ ID NO: 189697 - DNA, 103 bp, Artificial Sequence
  Synthetic Polynucleotide
taatacgactcactatagggggttgcagtagaggaagctgcgctccagtgaacagaggagacactggatggcagcttccaacctggcggcagcgcaaaagatg

SEQ ID NO: 189698 - DNA, 103 bp, Artificial Sequence
  Synthetic Polynucleotide
taatacgactcactatagggccacgggcctggttgcagtagaggaagctgaacagaggagacagcttatgctactgcaaaacctggcggcagcgcaaaagatg

SEQ ID NO: 189699 - DNA, 103 bp, Artificial Sequence
  Synthetic Polynucleotide
taatacgactcactatagggctcatagctcgggtaaggctgcgggttataaacagaggagatataacatgcagccttacaacctggcggcagcgcaaaagatg

SEQ ID NO: 189700 - DNA, 103 bp, Artificial Sequence
  Synthetic Polynucleotide
taatacgactcactatagggggcagggctgccacgggcctggttgcagtaaacagaggagatactgcatgcaggcccgtaacctggcggcagcgcaaaagatg

SEQ ID NO: 189701 - DNA, 103 bp, Artificial Sequence
  Synthetic Polynucleotide
taatacgactcactatagggtgttgaccctggcagggctgccacgggcctaacagaggagaaggcccatggcagccctgaacctggcggcagcgcaaaagatg

SEQ ID NO: 189702 - DNA, 103 bp, Artificial Sequence
  Synthetic Polynucleotide
taatacgactcactatagggttcgagttgctgttgaccctggcagggctgaacagaggagacagcccatgcagggtcaaaacctggcggcagcgcaaaagatg

SEQ ID NO: 189703 - DNA, 103 bp, Artificial Sequence
  Synthetic Polynucleotide
taatacgactcactataggggggcttggccttcgagttgctgttgaccctaacagaggagaagggtcatgagcaactcgaacctggcggcagcgcaaaagatg

SEQ ID NO: 189704 - DNA, 103 bp, Artificial Sequence
  Synthetic Polynucleotide
taatacgactcactatagggacacggactcgggcttggccttcgagttgcaacagaggagagcaactatgaggccaagcaacctggcggcagcgcaaaagatg

SEQ ID NO: 189705 - DNA, 103 bp, Artificial Sequence
  Synthetic Polynucleotide
taatacgactcactataggggaacaggtggacacggactcgggcttggccaacagaggagaggccaaatgcgagtccgtaacctggcggcagcgcaaaagatg

SEQ ID NO: 189706 - DNA, 103 bp, Artificial Sequence
  Synthetic Polynucleotide
taatacgactcactatagggagaggtcacagaacaggtggacacggactcaacagaggagagagtccatgtccacctgtaacctggcggcagcgcaaaagatg

SEQ ID NO: 189707 - DNA, 103 bp, Artificial Sequence
  Synthetic Polynucleotide
taatacgactcactatagggtgtcgtcaggagaggtcacagaacaggtggaacagaggagaccacctatgctgtgacctaacctggcggcagcgcaaaagatg

SEQ ID NO: 189708 - DNA, 103 bp, Artificial Sequence
  Synthetic Polynucleotide
taatacgactcactatagggttggtggacatgtcgtcaggagaggtcacaaacagaggagatgtgacatgtcctgacgaaacctggcggcagcgcaaaagatg

SEQ ID NO: 189709 - DNA, 103 bp, Artificial Sequence
  Synthetic Polynucleotide
taatacgactcactataggggtcgtcagatttggtggacatgtcgtcaggaacagaggagacctgacatgatgtccaccaacctggcggcagcgcaaaagatg

SEQ ID NO: 189710 - DNA, 103 bp, Artificial Sequence
  Synthetic Polynucleotide
taatacgactcactatagggcagcgccaccctcatagctcgggtaaggctaacagaggagaagccttatgcgagctatgaacctggcggcagcgcaaaagatg

SEQ ID NO: 189711 - DNA, 103 bp, Artificial Sequence
  Synthetic Polynucleotide
taatacgactcactatagggtctggaaggagtcgtcagatttggtggacaaacagaggagatgtccaatgaatctgacgaacctggcggcagcgcaaaagatg

SEQ ID NO: 189712 - DNA, 103 bp, Artificial Sequence
  Synthetic Polynucleotide
taatacgactcactatagggccgtgtaggctctggaaggagtcgtcagataacagaggagaatctgaatgctccttccaaacctggcggcagcgcaaaagatg

SEQ ID NO: 189713 - DNA, 103 bp, Artificial Sequence
  Synthetic Polynucleotide
taatacgactcactatagggcggcagactgccgtgtaggctctggaaggaaacagaggagatccttcatgagcctacacaacctggcggcagcgcaaaagatg

SEQ ID NO: 189714 - DNA, 103 bp, Artificial Sequence
  Synthetic Polynucleotide
taatacgactcactatagggagctgtcgagcggcagactgccgtgtaggcaacagaggagagcctacatggcagtctgcaacctggcggcagcgcaaaagatg

SEQ ID NO: 189715 - DNA, 103 bp, Artificial Sequence
  Synthetic Polynucleotide
taatacgactcactatagggaacttggagaagctgtcgagcggcagactgaacagaggagacagtctatggctcgacagaacctggcggcagcgcaaaagatg

SEQ ID NO: 189716 - DNA, 103 bp, Artificial Sequence
  Synthetic Polynucleotide
taatacgactcactatagggacccgccacgaacttggagaagctgtcgagaacagaggagactcgacatgttctccaagaacctggcggcagcgcaaaagatg

SEQ ID NO: 189717 - DNA, 103 bp, Artificial Sequence
  Synthetic Polynucleotide
taatacgactcactatagggagtcccgctcacccgccacgaacttggagaaacagaggagatctccaatgtcgtggcggaacctggcggcagcgcaaaagatg

SEQ ID NO: 189718 - DNA, 103 bp, Artificial Sequence
  Synthetic Polynucleotide
taatacgactcactatagggagccgcggacagtcccgctcacccgccacgaacagaggagacgtggcatgtgagcgggaaacctggcggcagcgcaaaagatg

SEQ ID NO: 189719 - DNA, 103 bp, Artificial Sequence
  Synthetic Polynucleotide
taatacgactcactataggggctgagcagcagccgcggacagtcccgctcaacagaggagagagcggatgtgtccgcggaacctggcggcagcgcaaaagatg

SEQ ID NO: 189720 - DNA, 103 bp, Artificial Sequence
  Synthetic Polynucleotide
taatacgactcactataggggtgccagggcgctgagcagcagccgcggacaacagaggagagtccgcatgtgctgctcaaacctggcggcagcgcaaaagatg

SEQ ID NO: 189721 - DNA, 103 bp, Artificial Sequence
  Synthetic Polynucleotide
taatacgactcactataggggagggcgtgccagcgccaccctcatagctcaacagaggagagagctaatggggtggcgcaacctggcggcagcgcaaaagatg

SEQ ID NO: 189722 - DNA, 103 bp, Artificial Sequence
  Synthetic Polynucleotide
taatacgactcactatagggaggtcctcctgtgccagggcgctgagcagcaacagaggagagctgctatgcgccctggcaacctggcggcagcgcaaaagatg

SEQ ID NO: 189723 - DNA, 103 bp, Artificial Sequence
  Synthetic Polynucleotide
taatacgactcactatagggctcggaggccaggtcctcctgtgccagggcaacagaggagagccctgatgcaggaggacaacctggcggcagcgcaaaagatg

SEQ ID NO: 189724 - DNA, 103 bp, Artificial Sequence
  Synthetic Polynucleotide
taatacgactcactataggggccccaggatctcggaggccaggtcctcctaacagaggagaaggaggatgtggcctccgaacctggcggcagcgcaaaagatg

SEQ ID NO: 189725 - DNA, 103 bp, Artificial Sequence
  Synthetic Polynucleotide
taatacgactcactataggggcttcctgcagccccaggatctcggaggccaacagaggagaggcctcatggatcctgggaacctggcggcagcgcaaaagatg

SEQ ID NO: 189726 - DNA, 103 bp, Artificial Sequence
  Synthetic Polynucleotide
taatacgactcactatagggctcaccgatggcttcctgcagccccaggataacagaggagaatcctgatgctgcaggaaaacctggcggcagcgcaaaagatg

SEQ ID NO: 189727 - DNA, 103 bp, Artificial Sequence
  Synthetic Polynucleotide
taatacgactcactatagggtgtcggccttctcaccgatggcttcctgcaaacagaggagatgcaggatgccatcggtgaacctggcggcagcgcaaaagatg

SEQ ID NO: 189728 - DNA, 103 bp, Artificial Sequence
  Synthetic Polynucleotide
taatacgactcactataggggcccaagctttgtcggccttctcaccgatgaacagaggagacatcggatggaaggccgaaacctggcggcagcgcaaaagatg

SEQ ID NO: 189729 - DNA, 103 bp, Artificial Sequence
  Synthetic Polynucleotide
taatacgactcactataggggggtgcttcagcccaagctttgtcggccttaacagaggagaaaggccatgaaagcttggaacctggcggcagcgcaaaagatg

SEQ ID NO: 189730 - DNA, 103 bp, Artificial Sequence
  Synthetic Polynucleotide
taatacgactcactatagggtgaccaggctgggtgcttcagcccaagcttaacagaggagaaagcttatgctgaagcacaacctggcggcagcgcaaaagatg

SEQ ID NO: 189731 - DNA, 103 bp, Artificial Sequence
  Synthetic Polynucleotide
taatacgactcactatagggctgctgtccttgaccaggctgggtgcttcaaacagaggagatgaagcatgcagcctggtaacctggcggcagcgcaaaagatg

SEQ ID NO: 189732 - DNA, 103 bp, Artificial Sequence
  Synthetic Polynucleotide
taatacgactcactatagggtgcagtgccagagggcgtgccagcgccaccaacagaggagaggtggcatgggcacgcccaacctggcggcagcgcaaaagatg

SEQ ID NO: 189733 - DNA, 103 bp, Artificial Sequence
  Synthetic Polynucleotide
taatacgactcactataggggggtggcttgctgctgtccttgaccaggctaacagaggagaagcctgatgaaggacagcaacctggcggcagcgcaaaagatg

SEQ ID NO: 189734 - DNA, 103 bp, Artificial Sequence
  Synthetic Polynucleotide
taatacgactcactatagggccagcgagaagggtggcttgctgctgtcctaacagaggagaaggacaatggcaagccacaacctggcggcagcgcaaaagatg

SEQ ID NO: 189735 - DNA, 103 bp, Artificial Sequence
  Synthetic Polynucleotide
taatacgactcactatagggctgtggttctccagcgagaagggtggcttgaacagaggagacaagccatgcttctcgctaacctggcggcagcgcaaaagatg

SEQ ID NO: 189736 - DNA, 103 bp, Artificial Sequence
  Synthetic Polynucleotide
taatacgactcactatagggcaggcaggcgctgtggttctccagcgagaaaacagaggagattctcgatggagaaccacaacctggcggcagcgcaaaagatg

SEQ ID NO: 189737 - DNA, 103 bp, Artificial Sequence
  Synthetic Polynucleotide
taatacgactcactatagggccacagagtccaggcaggcgctgtggttctaacagaggagaagaaccatggcgcctgccaacctggcggcagcgcaaaagatg

SEQ ID NO: 189738 - DNA, 103 bp, Artificial Sequence
  Synthetic Polynucleotide
taatacgactcactataggggcactcttggccacagagtccaggcaggcgaacagaggagacgcctgatgggactctgtaacctggcggcagcgcaaaagatg

SEQ ID NO: 189739 - DNA, 103 bp, Artificial Sequence
  Synthetic Polynucleotide
taatacgactcactatagggccggggccacgcactcttggccacagagtcaacagaggagagactctatggccaagagtaacctggcggcagcgcaaaagatg

SEQ ID NO: 189740 - DNA, 103 bp, Artificial Sequence
  Synthetic Polynucleotide
taatacgactcactataggggctccccaggccggggccacgcactcttggaacagaggagaccaagaatgcgtggccccaacctggcggcagcgcaaaagatg

SEQ ID NO: 189741 - DNA, 103 bp, Artificial Sequence
  Synthetic Polynucleotide
taatacgactcactatagggagggcctccggctccccaggccggggccacaacagaggagagtggccatggcctggggaaacctggcggcagcgcaaaagatg

SEQ ID NO: 189742 - DNA, 103 bp, Artificial Sequence
  Synthetic Polynucleotide
taatacgactcactatagggggagtcgggcagggcctccggctccccaggaacagaggagacctgggatgccggaggccaacctggcggcagcgcaaaagatg

SEQ ID NO: 189743 - DNA, 103 bp, Artificial Sequence
  Synthetic Polynucleotide
taatacgactcactataggggtttgccatggaaaccacacctttctcgaaaacagaggagattcgagatgggtgtggttaacctggcggcagcgcaaaagatg

SEQ ID NO: 189744 - DNA, 103 bp, Artificial Sequence
  Synthetic Polynucleotide
taatacgactcactatagggccaccgcggctgcagtgccagagggcgtgcaacagaggagagcacgcatgctggcactgaacctggcggcagcgcaaaagatg

SEQ ID NO: 189745 - DNA, 103 bp, Artificial Sequence
  Synthetic Polynucleotide
taatacgactcactatagggccagctgcaaggagtcgggcagggcctccgaacagaggagacggaggatgtgcccgactaacctggcggcagcgcaaaagatg

SEQ ID NO: 189746 - DNA, 103 bp, Artificial Sequence
  Synthetic Polynucleotide
taatacgactcactatagggccgcccttgtccagctgcaaggagtcgggcaacagaggagagcccgaatgcttgcagctaacctggcggcagcgcaaaagatg

SEQ ID NO: 189747 - DNA, 103 bp, Artificial Sequence
  Synthetic Polynucleotide
taatacgactcactatagggcttggcattgccgcccttgtccagctgcaaaacagaggagattgcagatggacaagggcaacctggcggcagcgcaaaagatg

SEQ ID NO: 189748 - DNA, 103 bp, Artificial Sequence
  Synthetic Polynucleotide
taatacgactcactatagggggctgaagtccttggcattgccgcccttgtaacagaggagaacaaggatggcaatgccaaacctggcggcagcgcaaaagatg

SEQ ID NO: 189749 - DNA, 103 bp, Artificial Sequence
  Synthetic Polynucleotide
taatacgactcactatagggaacagccctgggctgaagtccttggcattgaacagaggagacaatgcatgggacttcagaacctggcggcagcgcaaaagatg

SEQ ID NO: 189750 - DNA, 103 bp, Artificial Sequence
  Synthetic Polynucleotide
taatacgactcactatagggagggtcttcaaacagccctgggctgaagtcaacagaggagagacttcatgccagggctgaacctggcggcagcgcaaaagatg

SEQ ID NO: 189751 - DNA, 103 bp, Artificial Sequence
  Synthetic Polynucleotide
taatacgactcactatagggaggccacggaagggtcttcaaacagccctgaacagaggagacagggcatgttgaagaccaacctggcggcagcgcaaaagatg

SEQ ID NO: 189752 - DNA, 103 bp, Artificial Sequence
  Synthetic Polynucleotide
taatacgactcactatagggggcgtagcgaaggccacggaagggtcttcaaacagaggagatgaagaatgttccgtggcaacctggcggcagcgcaaaagatg

SEQ ID NO: 189753 - DNA, 103 bp, Artificial Sequence
  Synthetic Polynucleotide
taatacgactcactatagggtttggggtcaggcgtagcgaaggccacggaaacagaggagatccgtgatgttcgctacgaacctggcggcagcgcaaaagatg

SEQ ID NO: 189754 - DNA, 103 bp, Artificial Sequence
  Synthetic Polynucleotide
taatacgactcactatagggcagttgtctttttggggtcaggcgtagcgaaacagaggagatcgctaatgctgaccccaaacctggcggcagcgcaaaagatg

SEQ ID NO: 189755 - DNA, 103 bp, Artificial Sequence
  Synthetic Polynucleotide
taatacgactcactatagggttgtcggcggccaccgcggctgcagtgccaaacagaggagatggcacatgagccgcggtaacctggcggcagcgcaaaagatg

SEQ ID NO: 189756 - DNA, 103 bp, Artificial Sequence
  Synthetic Polynucleotide
taatacgactcactataggggagagaggaccagttgtctttttggggtcaaacagaggagatgacccatgaaagacaacaacctggcggcagcgcaaaagatg

SEQ ID NO: 189757 - DNA, 103 bp, Artificial Sequence
  Synthetic Polynucleotide
taatacgactcactatagggggtaccaaaggagagaggaccagttgtcttaacagaggagaaagacaatgggtcctctcaacctggcggcagcgcaaaagatg

SEQ ID NO: 189758 - DNA, 103 bp, Artificial Sequence
  Synthetic Polynucleotide
taatacgactcactataggggggtgggcttggtaccaaaggagagaggacaacagaggagagtcctcatgcctttggtaaacctggcggcagcgcaaaagatg

SEQ ID NO: 189759 - DNA, 103 bp, Artificial Sequence
  Synthetic Polynucleotide
taatacgactcactatagggggaaccccaagggtgggcttggtaccaaagaacagaggagactttggatgcaagcccacaacctggcggcagcgcaaaagatg

SEQ ID NO: 189760 - DNA, 103 bp, Artificial Sequence
  Synthetic Polynucleotide
taatacgactcactataggggtctggagcaggaaccccaagggtgggcttaacagaggagaaagcccatgcttggggttaacctggcggcagcgcaaaagatg

SEQ ID NO: 189761 - DNA, 103 bp, Artificial Sequence
  Synthetic Polynucleotide
taatacgactcactatagggctgtagtggggtctggagcaggaaccccaaaacagaggagattggggatgctgctccagaacctggcggcagcgcaaaagatg

SEQ ID NO: 189762 - DNA, 103 bp, Artificial Sequence
  Synthetic Polynucleotide
taatacgactcactatagggtcaaaagctgctgtagtggggtctggagcaaacagaggagatgctccatgccccactacaacctggcggcagcgcaaaagatg

SEQ ID NO: 189763 - DNA, 103 bp, Artificial Sequence
  Synthetic Polynucleotide
taatacgactcactatagggcgggaaacagtcaaaagctgctgtagtgggaacagaggagacccactatggcagcttttaacctggcggcagcgcaaaagatg

SEQ ID NO: 189764 - DNA, 103 bp, Artificial Sequence
  Synthetic Polynucleotide
taatacgactcactatagggcggttgtgtccgggaaacagtcaaaagctgaacagaggagacagcttatgactgtttccaacctggcggcagcgcaaaagatg

SEQ ID NO: 189765 - DNA, 103 bp, Artificial Sequence
  Synthetic Polynucleotide
taatacgactcactataggggagctggcagcggttgtgtccgggaaacagaacagaggagactgtttatgggacacaacaacctggcggcagcgcaaaagatg

SEQ ID NO: 189766 - DNA, 103 bp, Artificial Sequence
  Synthetic Polynucleotide
taatacgactcactatagggtcggtggtacttgtcggcggccaccgcggcaacagaggagagccgcgatggccgccgacaacctggcggcagcgcaaaagatg

SEQ ID NO: 189767 - DNA, 103 bp, Artificial Sequence
  Synthetic Polynucleotide
taatacgactcactataggggctgtccgctgagctggcagcggttgtgtcaacagaggagagacacaatggctgccagcaacctggcggcagcgcaaaagatg

SEQ ID NO: 189768 - DNA, 103 bp, Artificial Sequence
  Synthetic Polynucleotide
taatacgactcactatagggaggggttggcgctgtccgctgagctggcagaacagaggagactgccaatgcagcggacaaacctggcggcagcgcaaaagatg

SEQ ID NO: 189769 - DNA, 103 bp, Artificial Sequence
  Synthetic Polynucleotide
taatacgactcactatagggggccaggcaaaggggttggcgctgtccgctaacagaggagaagcggaatgcgccaacccaacctggcggcagcgcaaaagatg

SEQ ID NO: 189770 - DNA, 103 bp, Artificial Sequence
  Synthetic Polynucleotide
taatacgactcactataggggttttcctctggccaggcaaaggggttggcaacagaggagagccaacatgtttgcctggaacctggcggcagcgcaaaagatg

SEQ ID NO: 189771 - DNA, 103 bp, Artificial Sequence
  Synthetic Polynucleotide
taatacgactcactatagggcatcccccaggttttcctctggccaggcaaaacagaggagattgcctatgcagaggaaaaacctggcggcagcgcaaaagatg

SEQ ID NO: 189772 - DNA, 103 bp, Artificial Sequence
  Synthetic Polynucleotide
taatacgactcactatagggctgggacaagcatcccccaggttttcctctaacagaggagaagaggaatgcctgggggaaacctggcggcagcgcaaaagatg

SEQ ID NO: 189773 - DNA, 103 bp, Artificial Sequence
  Synthetic Polynucleotide
taatacgactcactatagggcaatccccacctgggacaagcatcccccagaacagaggagactggggatggcttgtcccaacctggcggcagcgcaaaagatg

SEQ ID NO: 189774 - DNA, 103 bp, Artificial Sequence
  Synthetic Polynucleotide
taatacgactcactatagggcgccagggtgcaatccccacctgggacaagaacagaggagacttgtcatgggtggggataacctggcggcagcgcaaaagatg

SEQ ID NO: 189775 - DNA, 103 bp, Artificial Sequence
  Synthetic Polynucleotide
taatacgactcactatagggttggtaagctcgccagggtgcaatccccacaacagaggagagtggggatggcaccctggaacctggcggcagcgcaaaagatg

SEQ ID NO: 189776 - DNA, 103 bp, Artificial Sequence
  Synthetic Polynucleotide
taatacgactcactatagggctccaggcccttggtaagctcgccagggtgaacagaggagacaccctatggagcttaccaacctggcggcagcgcaaaagatg

SEQ ID NO: 189777 - DNA, 103 bp, Artificial Sequence
  Synthetic Polynucleotide
taatacgactcactatagggccttgctgcctcggtggtacttgtcggcggaacagaggagaccgccgatgagtaccaccaacctggcggcagcgcaaaagatg

SEQ ID NO: 189778 - DNA, 103 bp, Artificial Sequence
  Synthetic Polynucleotide
taatacgactcactatagggtcccaccctgctccaggcccttggtaagctaacagaggagaagcttaatgagggcctggaacctggcggcagcgcaaaagatg

SEQ ID NO: 189779 - DNA, 103 bp, Artificial Sequence
  Synthetic Polynucleotide
taatacgactcactatagggtctgaggccttcccaccctgctccaggcccaacagaggagagggcctatggcagggtggaacctggcggcagcgcaaaagatg

SEQ ID NO: 189780 - DNA, 103 bp, Artificial Sequence
  Synthetic Polynucleotide
taatacgactcactataggggctgatgccatctgaggccttcccaccctgaacagaggagacagggtatgaaggcctcaaacctggcggcagcgcaaaagatg

SEQ ID NO: 189781 - DNA, 103 bp, Artificial Sequence
  Synthetic Polynucleotide
taatacgactcactatagggtgtcccctttgctgatgccatctgaggcctaacagaggagaaggcctatgatggcatcaaacctggcggcagcgcaaaagatg

SEQ ID NO: 189782 - DNA, 103 bp, Artificial Sequence
  Synthetic Polynucleotide
taatacgactcactataggggcctcatgggtgtcccctttgctgatgccaaacagaggagatggcatatgcaaaggggaaacctggcggcagcgcaaaagatg

SEQ ID NO: 189783 - DNA, 103 bp, Artificial Sequence
  Synthetic Polynucleotide
taatacgactcactataggggcaggccgaagcctcatgggtgtcccctttaacagaggagaaaagggatgacccatgagaacctggcggcagcgcaaaagatg

SEQ ID NO: 189784 - DNA, 103 bp, Artificial Sequence
  Synthetic Polynucleotide
taatacgactcactatagggggaagcccaggcaggccgaagcctcatgggaacagaggagacccatgatgcttcggcctaacctggcggcagcgcaaaagatg

SEQ ID NO: 189785 - DNA, 103 bp, Artificial Sequence
  Synthetic Polynucleotide
taatacgactcactatagggtcctcctcctggaagcccaggcaggccgaaaacagaggagattcggcatgcctgggcttaacctggcggcagcgcaaaagatg

SEQ ID NO: 189786 - DNA, 103 bp, Artificial Sequence
  Synthetic Polynucleotide
taatacgactcactatagggcccaggggggtcctcctcctggaagcccagaacagaggagactgggcatgcaggaggagaacctggcggcagcgcaaaagatg

SEQ ID NO: 189787 - DNA, 103 bp, Artificial Sequence
  Synthetic Polynucleotide
taatacgactcactatagggccaccttctccccaggggggtcctcctcctaacagaggagaaggaggatgacccccctgaacctggcggcagcgcaaaagatg

SEQ ID NO: 189788 - DNA, 103 bp, Artificial Sequence
  Synthetic Polynucleotide
taatacgactcactataggggtgggcagggccttgctgcctcggtggtacaacagaggagagtaccaatgaggcagcaaaacctggcggcagcgcaaaagatg

SEQ ID NO: 189789 - DNA, 103 bp, Artificial Sequence
  Synthetic Polynucleotide
taatacgactcactatagggggcaacgaggccaccttctccccaggggggaacagaggagaccccccatgggagaaggtaacctggcggcagcgcaaaagatg

SEQ ID NO: 189790 - DNA, 103 bp, Artificial Sequence
  Synthetic Polynucleotide
taatacgactcactataggggaagtccccgggcaacgaggccaccttctcaacagaggagagagaagatggcctcgttgaacctggcggcagcgcaaaagatg

SEQ ID NO: 189791 - DNA, 103 bp, Artificial Sequence
  Synthetic Polynucleotide
taatacgactcactatagggcctcctgcttgaagtccccgggcaacgaggaacagaggagacctcgtatgccggggactaacctggcggcagcgcaaaagatg

SEQ ID NO: 189792 - DNA, 103 bp, Artificial Sequence
  Synthetic Polynucleotide
taatacgactcactatagggccacccacctcctcctgcttgaagtccccgaacagaggagacggggaatgcaagcaggaaacctggcggcagcgcaaaagatg

SEQ ID NO: 189793 - DNA, 103 bp, Artificial Sequence
  Synthetic Polynucleotide
taatacgactcactatagggctccttcaccccacccacctcctcctgcttaacagaggagaaagcagatggaggtgggtaacctggcggcagcgcaaaagatg

SEQ ID NO: 189794 - DNA, 103 bp, Artificial Sequence
  Synthetic Polynucleotide
taatacgactcactatagggcacctgcctcctccttcaccccacccacctaacagaggagaaggtggatggggtgaaggaacctggcggcagcgcaaaagatg

SEQ ID NO: 189795 - DNA, 103 bp, Artificial Sequence
  Synthetic Polynucleotide
taatacgactcactatagggtgcagcagcccacctgcctcctccttcaccaacagaggagaggtgaaatgggaggcaggaacctggcggcagcgcaaaagatg

SEQ ID NO: 189796 - DNA, 103 bp, Artificial Sequence
  Synthetic Polynucleotide
taatacgactcactatagggctcggggcactgcagcagcccacctgcctcaacagaggagagaggcaatggggctgctgaacctggcggcagcgcaaaagatg

SEQ ID NO: 189797 - DNA, 103 bp, Artificial Sequence
  Synthetic Polynucleotide
taatacgactcactatagggccttggccacctcggggcactgcagcagccaacagaggagaggctgcatgagtgccccgaacctggcggcagcgcaaaagatg

SEQ ID NO: 189798 - DNA, 103 bp, Artificial Sequence
  Synthetic Polynucleotide
taatacgactcactatagggcaccggtcagccttggccacctcggggcacaacagaggagagtgcccatgggtggccaaaacctggcggcagcgcaaaagatg

SEQ ID NO: 189799 - DNA, 103 bp, Artificial Sequence
  Synthetic Polynucleotide
taatacgactcactataggggccttgctgtgtgggcagggccttgctgccaacagaggagaggcagcatggccctgcccaacctggcggcagcgcaaaagatg

SEQ ID NO: 189800 - DNA, 103 bp, Artificial Sequence
  Synthetic Polynucleotide
taatacgactcactataggggtcctccagccaccggtcagccttggccacaacagaggagagtggccatggctgaccggaacctggcggcagcgcaaaagatg

SEQ ID NO: 189801 - DNA, 103 bp, Artificial Sequence
  Synthetic Polynucleotide
taatacgactcactatagggagtgccggctgtcctccagccaccggtcagaacagaggagactgaccatgggctggaggaacctggcggcagcgcaaaagatg

SEQ ID NO: 189802 - DNA, 103 bp, Artificial Sequence
  Synthetic Polynucleotide
taatacgactcactataggggtggaacagcagtgccggctgtcctccagcaacagaggagagctggaatgcagccggcaaacctggcggcagcgcaaaagatg

SEQ ID NO: 189803 - DNA, 103 bp, Artificial Sequence
  Synthetic Polynucleotide
taatacgactcactataggggaagtcggcggtggaacagcagtgccggctaacagaggagaagccggatgtgctgttccaacctggcggcagcgcaaaagatg

SEQ ID NO: 189804 - DNA, 103 bp, Artificial Sequence
  Synthetic Polynucleotide
taatacgactcactatagggggaggtccccgaagtcggcggtggaacagcaacagaggagagctgttatgccgccgactaacctggcggcagcgcaaaagatg

SEQ ID NO: 189805 - DNA, 103 bp, Artificial Sequence
  Synthetic Polynucleotide
taatacgactcactatagggggcagcagtgggaggtccccgaagtcggcgaacagaggagacgccgaatgcggggacctaacctggcggcagcgcaaaagatg

SEQ ID NO: 189806 - DNA, 103 bp, Artificial Sequence
  Synthetic Polynucleotide
taatacgactcactataggggctggtgggtggcagcagtgggaggtccccaacagaggagaggggacatgccactgctgaacctggcggcagcgcaaaagatg

SEQ ID NO: 189807 - DNA, 103 bp, Artificial Sequence
  Synthetic Polynucleotide
taatacgactcactatagggcctccttcctgctggtgggtggcagcagtgaacagaggagacactgcatgcacccaccaaacctggcggcagcgcaaaagatg

SEQ ID NO: 189808 - DNA, 103 bp, Artificial Sequence
  Synthetic Polynucleotide
taatacgactcactataggggcttccaggtcctccttcctgctggtgggtaacagaggagaacccacatgcaggaaggaaacctggcggcagcgcaaaagatg

SEQ ID NO: 189809 - DNA, 103 bp, Artificial Sequence
  Synthetic Polynucleotide
taatacgactcactatagggctcctcctcagcttccaggtcctccttcctaacagaggagaaggaagatggacctggaaaacctggcggcagcgcaaaagatg

SEQ ID NO: 189810 - DNA, 103 bp, Artificial Sequence
  Synthetic Polynucleotide
taatacgactcactatagggtcccctgcaggccttgctgtgtgggcagggaacagaggagaccctgcatgcacagcaagaacctggcggcagcgcaaaagatg

SEQ ID NO: 189811 - DNA, 103 bp, Artificial Sequence
  Synthetic Polynucleotide
taatacgactcactataggggggaggagtactcctcctcagcttccaggtaacagaggagaacctggatgctgaggaggaacctggcggcagcgcaaaagatg

SEQ ID NO: 189812 - DNA, 103 bp, Artificial Sequence
  Synthetic Polynucleotide
taatacgactcactatagggagctcacatagggaggagtactcctcctcaaacagaggagatgaggaatggtactcctcaacctggcggcagcgcaaaagatg

SEQ ID NO: 189813 - DNA, 103 bp, Artificial Sequence
  Synthetic Polynucleotide
taatacgactcactataggggctgcccaggagctcacatagggaggagtaaacagaggagatactccatgctatgtgagaacctggcggcagcgcaaaagatg

SEQ ID NO: 189814 - DNA, 103 bp, Artificial Sequence
  Synthetic Polynucleotide
taatacgactcactatagggtctgctcggggctgcccaggagctcacataaacagaggagatatgtgatgtcctgggcaaacctggcggcagcgcaaaagatg

SEQ ID NO: 189815 - DNA, 103 bp, Artificial Sequence
  Synthetic Polynucleotide
taatacgactcactatagggatgccaggcctctgctcggggctgcccaggaacagaggagacctgggatgccccgagcaaacctggcggcagcgcaaaagatg

SEQ ID NO: 189816 - DNA, 103 bp, Artificial Sequence
  Synthetic Polynucleotide
taatacgactcactatagggcgggtcctgcatgccaggcctctgctcgggaacagaggagacccgagatgaggcctggcaacctggcggcagcgcaaaagatg

SEQ ID NO: 189817 - DNA, 103 bp, Artificial Sequence
  Synthetic Polynucleotide
taatacgactcactatagggtgggtgacagcgggtcctgcatgccaggccaacagaggagaggcctgatgtgcaggaccaacctggcggcagcgcaaaagatg

SEQ ID NO: 189818 - DNA, 103 bp, Artificial Sequence
  Synthetic Polynucleotide
taatacgactcactatagggagtggggccttgggtgacagcgggtcctgcaacagaggagagcaggaatggctgtcaccaacctggcggcagcgcaaaagatg

SEQ ID NO: 189819 - DNA, 103 bp, Artificial Sequence
  Synthetic Polynucleotide
taatacgactcactatagggggtgcagatgagtggggccttgggtgacagaacagaggagactgtcaatgaaggccccaaacctggcggcagcgcaaaagatg

SEQ ID NO: 189820 - DNA, 103 bp, Artificial Sequence
  Synthetic Polynucleotide
taatacgactcactatagggcctcctccttggtgcagatgagtggggcctaacagaggagaaggcccatgtcatctgcaaacctggcggcagcgcaaaagatg

SEQ ID NO: 189821 - DNA, 103 bp, Artificial Sequence
  Synthetic Polynucleotide
taatacgactcactatagggaaagccggcctcccctgcaggccttgctgtaacagaggagaacagcaatgcctgcagggaacctggcggcagcgcaaaagatg

SEQ ID NO: 189822 - DNA, 103 bp, Artificial Sequence
  Synthetic Polynucleotide
taatacgactcactatagggacctcctccacctcctccttggtgcagatgaacagaggagacatctgatgcaaggaggaaacctggcggcagcgcaaaagatg

SEQ ID NO: 189823 - DNA, 103 bp, Artificial Sequence
  Synthetic Polynucleotide
taatacgactcactatagggggagtccagcacctcctccacctcctccttaacagaggagaaaggagatggtggaggagaacctggcggcagcgcaaaagatg

SEQ ID NO: 189824 - DNA, 103 bp, Artificial Sequence
  Synthetic Polynucleotide
taatacgactcactatagggagccggccttggagtccagcacctcctccaaacagaggagatggaggatgtgctggactaacctggcggcagcgcaaaagatg

SEQ ID NO: 189825 - DNA, 103 bp, Artificial Sequence
  Synthetic Polynucleotide
taatacgactcactatagggggagagccccagccggccttggagtccagcaacagaggagagctggaatgcaaggccggaacctggcggcagcgcaaaagatg

SEQ ID NO: 189826 - DNA, 103 bp, Artificial Sequence
  Synthetic Polynucleotide
taatacgactcactataggggaggtggcacggagagccccagccggccttaacagaggagaaaggccatgtggggctctaacctggcggcagcgcaaaagatg

SEQ ID NO: 189827 - DNA, 103 bp, Artificial Sequence
  Synthetic Polynucleotide
taatacgactcactatagggactcccctgagaggtggcacggagagccccaacagaggagaggggctatgcgtgccaccaacctggcggcagcgcaaaagatg

SEQ ID NO: 189828 - DNA, 103 bp, Artificial Sequence
  Synthetic Polynucleotide
taatacgactcactatagggaggatgacggactcccctgagaggtggcacaacagaggagagtgccaatgctcaggggaaacctggcggcagcgcaaaagatg

SEQ ID NO: 189829 - DNA, 103 bp, Artificial Sequence
  Synthetic Polynucleotide
taatacgactcactatagggagggcccagcaggatgacggactcccctgaaacagaggagatcagggatgtccgtcatcaacctggcggcagcgcaaaagatg

SEQ ID NO: 189830 - DNA, 103 bp, Artificial Sequence
  Synthetic Polynucleotide
taatacgactcactatagggtgcccactgtagggcccagcaggatgacggaacagaggagaccgtcaatgtgctgggccaacctggcggcagcgcaaaagatg

SEQ ID NO: 189831 - DNA, 103 bp, Artificial Sequence
  Synthetic Polynucleotide
taatacgactcactatagggtttgactcggtgcccactgtagggcccagcaacagaggagagctgggatgtacagtgggaacctggcggcagcgcaaaagatg

SEQ ID NO: 189832 - DNA, 103 bp, Artificial Sequence
  Synthetic Polynucleotide
taatacgactcactataggggtagccagggaaagccggcctcccctgcagaacagaggagactgcagatgaggccggctaacctggcggcagcgcaaaagatg

SEQ ID NO: 189833 - DNA, 103 bp, Artificial Sequence
  Synthetic Polynucleotide
taatacgactcactataggggctctggacctttgactcggtgcccactgtaacagaggagaacagtgatgaccgagtcaaacctggcggcagcgcaaaagatg

SEQ ID NO: 189834 - DNA, 103 bp, Artificial Sequence
  Synthetic Polynucleotide
taatacgactcactatagggactcaaaccagctctggacctttgactcggaacagaggagaccgagtatgaggtccagaaacctggcggcagcgcaaaagatg

SEQ ID NO: 189835 - DNA, 103 bp, Artificial Sequence
  Synthetic Polynucleotide
taatacgactcactataggggacagagaggactcaaaccagctctggaccaacagaggagaggtccaatgctggtttgaaacctggcggcagcgcaaaagatg

SEQ ID NO: 189836 - DNA, 103 bp, Artificial Sequence
  Synthetic Polynucleotide
taatacgactcactatagggcttcatgtgtgacagagaggactcaaaccaaacagaggagatggtttatgtcctctctgaacctggcggcagcgcaaaagatg

SEQ ID NO: 189837 - DNA, 103 bp, Artificial Sequence
  Synthetic Polynucleotide
taatacgactcactatagggcttcacctggcttcatgtgtgacagagaggaacagaggagacctctcatgcacacatgaaacctggcggcagcgcaaaagatg

SEQ ID NO: 189838 - DNA, 103 bp, Artificial Sequence
  Synthetic Polynucleotide
taatacgactcactatagggtcaggcccctcttcacctggcttcatgtgtaacagaggagaacacatatggccaggtgaaacctggcggcagcgcaaaagatg

SEQ ID NO: 189839 - DNA, 103 bp, Artificial Sequence
  Synthetic Polynucleotide
taatacgactcactatagggtcgctccccatcaggcccctcttcacctggaacagaggagaccaggtatggaggggcctaacctggcggcagcgcaaaagatg

SEQ ID NO: 189840 - DNA, 103 bp, Artificial Sequence
  Synthetic Polynucleotide
taatacgactcactatagggcccctggagctcgctccccatcaggcccctaacagaggagaaggggcatgatggggagcaacctggcggcagcgcaaaagatg

SEQ ID NO: 189841 - DNA, 103 bp, Artificial Sequence
  Synthetic Polynucleotide
taatacgactcactataggggtggtggaatcccctggagctcgctccccaaacagaggagatggggaatgagctccaggaacctggcggcagcgcaaaagatg

SEQ ID NO: 189842 - DNA, 103 bp, Artificial Sequence
  Synthetic Polynucleotide
taatacgactcactatagggggcgtccgaggtggtggaatcccctggagcaacagaggagagctccaatggattccaccaacctggcggcagcgcaaaagatg

SEQ ID NO: 189843 - DNA, 103 bp, Artificial Sequence
  Synthetic Polynucleotide
taatacgactcactatagggcctggacgccgtagccagggaaagccggccaacagaggagaggccggatgtccctggctaacctggcggcagcgcaaaagatg

SEQ ID NO: 189844 - DNA, 103 bp, Artificial Sequence
  Synthetic Polynucleotide
taatacgactcactataggggggccagagaggcgtccgaggtggtggaataacagaggagaattccaatgcctcggacgaacctggcggcagcgcaaaagatg

SEQ ID NO: 189845 - DNA, 103 bp, Artificial Sequence
  Synthetic Polynucleotide
taatacgactcactatagggttgggcttctgggccagagaggcgtccgagaacagaggagactcggaatgctctctggcaacctggcggcagcgcaaaagatg

SEQ ID NO: 189846 - DNA, 103 bp, Artificial Sequence
  Synthetic Polynucleotide
taatacgactcactatagggagcaggcttgttgggcttctgggccagagaaacagaggagatctctgatgcagaagcccaacctggcggcagcgcaaaagatg

SEQ ID NO: 189847 - DNA, 103 bp, Artificial Sequence
  Synthetic Polynucleotide
taatacgactcactatagggcctcgggcacagcaggcttgttgggcttctaacagaggagaagaagcatgacaagcctgaacctggcggcagcgcaaaagatg

SEQ ID NO: 189848 - DNA, 103 bp, Artificial Sequence
  Synthetic Polynucleotide
taatacgactcactataggggcgatgggcgcctcgggcacagcaggcttgaacagaggagacaagccatgtgtgcccgaaacctggcggcagcgcaaaagatg

SEQ ID NO: 189849 - DNA, 103 bp, Artificial Sequence
  Synthetic Polynucleotide
taatacgactcactatagggctctttctttgcgatgggcgcctcgggcacaacagaggagagtgcccatggcgcccatcaacctggcggcagcgcaaaagatg

SEQ ID NO: 189850 - DNA, 103 bp, Artificial Sequence
  Synthetic Polynucleotide
taatacgactcactataggggtggcacaggctctttctttgcgatgggcgaacagaggagacgcccaatgcaaagaaagaacctggcggcagcgcaaaagatg

SEQ ID NO: 189851 - DNA, 103 bp, Artificial Sequence
  Synthetic Polynucleotide
taatacgactcactatagggcttttgccccgtggcacaggctctttctttaacagaggagaaaagaaatggcctgtgccaacctggcggcagcgcaaaagatg

SEQ ID NO: 189852 - DNA, 103 bp, Artificial Sequence
  Synthetic Polynucleotide
taatacgactcactataggggctccgtaagcttttgccccgtggcacaggaacagaggagacctgtgatgcggggcaaaaacctggcggcagcgcaaaagatg

SEQ ID NO: 189853 - DNA, 103 bp, Artificial Sequence
  Synthetic Polynucleotide
taatacgactcactataggggcacccgacggctccgtaagcttttgccccaacagaggagaggggcaatggcttacggaaacctggcggcagcgcaaaagatg

SEQ ID NO: 189854 - DNA, 103 bp, Artificial Sequence
  Synthetic Polynucleotide
taatacgactcactatagggtagttctgttgtttgccatggaaaccacacaacagaggagagtgtggatgccatggcaaaacctggcggcagcgcaaaagatg

SEQ ID NO: 189855 - DNA, 103 bp, Artificial Sequence
  Synthetic Polynucleotide
taatacgactcactataggggggctgctgtcctggacgccgtagccagggaacagaggagaccctggatgcggcgtccaaacctggcggcagcgcaaaagatg

SEQ ID NO: 189856 - DNA, 103 bp, Artificial Sequence
  Synthetic Polynucleotide
taatacgactcactatagggagcccccggtgcacccgacggctccgtaagaacagaggagacttacgatgccgtcgggtaacctggcggcagcgcaaaagatg

SEQ ID NO: 189857 - DNA, 103 bp, Artificial Sequence
  Synthetic Polynucleotide
taatacgactcactatagggggcctcgggcagcccccggtgcacccgacgaacagaggagacgtcggatgcaccgggggaacctggcggcagcgcaaaagatg

SEQ ID NO: 189858 - DNA, 103 bp, Artificial Sequence
  Synthetic Polynucleotide
taatacgactcactataggggggagtcctcggcctcgggcagcccccggtaacagaggagaaccgggatgtgcccgaggaacctggcggcagcgcaaaagatg

SEQ ID NO: 189859 - DNA, 103 bp, Artificial Sequence
  Synthetic Polynucleotide
taatacgactcactataggggccctgcatggggagtcctcggcctcgggcaacagaggagagcccgaatgcgaggactcaacctggcggcagcgcaaaagatg

SEQ ID NO: 189860 - DNA, 103 bp, Artificial Sequence
  Synthetic Polynucleotide
taatacgactcactatagggcagcactggtgccctgcatggggagtcctcaacagaggagagaggacatgccatgcaggaacctggcggcagcgcaaaagatg

SEQ ID NO: 189861 - DNA, 103 bp, Artificial Sequence
  Synthetic Polynucleotide
taatacgactcactatagggggtctttgggcagcactggtgccctgcatgaacagaggagacatgcaatgcaccagtgcaacctggcggcagcgcaaaagatg

SEQ ID NO: 189862 - DNA, 103 bp, Artificial Sequence
  Synthetic Polynucleotide
taatacgactcactataggggggagcaagaggtctttgggcagcactggtaacagaggagaaccagtatggcccaaagaaacctggcggcagcgcaaaagatg

SEQ ID NO: 189863 - DNA, 103 bp, Artificial Sequence
  Synthetic Polynucleotide
taatacgactcactataggggcaggattcagggagcaagaggtctttgggaacagaggagacccaaaatgctcttgctcaacctggcggcagcgcaaaagatg

SEQ ID NO: 189864 - DNA, 103 bp, Artificial Sequence
  Synthetic Polynucleotide
taatacgactcactatagggggggccctgtgcaggattcagggagcaagaaacagaggagatcttgcatgctgaatcctaacctggcggcagcgcaaaagatg

SEQ ID NO: 189865 - DNA, 103 bp, Artificial Sequence
  Synthetic Polynucleotide
taatacgactcactatagggtgtccctgggggggccctgtgcaggattcaaacagaggagatgaatcatgcacagggccaacctggcggcagcgcaaaagatg

SEQ ID NO: 189866 - DNA, 103 bp, Artificial Sequence
  Synthetic Polynucleotide
taatacgactcactataggggcctgggtaggggctgctgtcctggacgccaacagaggagaggcgtcatggacagcagcaacctggcggcagcgcaaaagatg

SEQ ID NO: 189867 - DNA, 103 bp, Artificial Sequence
  Synthetic Polynucleotide
taatacgactcactatagggcccttccatctgtccctgggggggccctgtaacagaggagaacagggatgccccagggaaacctggcggcagcgcaaaagatg

SEQ ID NO: 189868 - DNA, 103 bp, Artificial Sequence
  Synthetic Polynucleotide
taatacgactcactataggggggctccagccccttccatctgtccctgggaacagaggagacccaggatgagatggaagaacctggcggcagcgcaaaagatg

SEQ ID NO: 189869 - DNA, 103 bp, Artificial Sequence
  Synthetic Polynucleotide
taatacgactcactatagggccccggcctggggctccagccccttccatcaacagaggagagatggaatgggctggagcaacctggcggcagcgcaaaagatg

SEQ ID NO: 189870 - DNA, 103 bp, Artificial Sequence
  Synthetic Polynucleotide
taatacgactcactatagggttccgaggccccccggcctggggctccagcaacagaggagagctggaatgccaggccggaacctggcggcagcgcaaaagatg

SEQ ID NO: 189871 - DNA, 103 bp, Artificial Sequence
  Synthetic Polynucleotide
taatacgactcactatagggtggggagcccttccgaggccccccggcctgaacagaggagacaggccatggggcctcggaacctggcggcagcgcaaaagatg

SEQ ID NO: 189872 - DNA, 103 bp, Artificial Sequence
  Synthetic Polynucleotide
taatacgactcactataggggtacacatcctggggagcccttccgaggccaacagaggagaggcctcatgagggctcccaacctggcggcagcgcaaaagatg

SEQ ID NO: 189873 - DNA, 103 bp, Artificial Sequence
  Synthetic Polynucleotide
taatacgactcactataggggagagaacgagtacacatcctggggagcccaacagaggagagggctcatgaggatgtgtaacctggcggcagcgcaaaagatg

SEQ ID NO: 189874 - DNA, 103 bp, Artificial Sequence
  Synthetic Polynucleotide
taatacgactcactatagggtcagggccgtgagagaacgagtacacatccaacagaggagaggatgtatgctcgttctcaacctggcggcagcgcaaaagatg

SEQ ID NO: 189875 - DNA, 103 bp, Artificial Sequence
  Synthetic Polynucleotide
taatacgactcactatagggcggggctcactcagggccgtgagagaacgaaacagaggagatcgttcatgcacggccctaacctggcggcagcgcaaaagatg

SEQ ID NO: 189876 - DNA, 103 bp, Artificial Sequence
  Synthetic Polynucleotide
taatacgactcactatagggtccgggcgtgcggggctcactcagggccgtaacagaggagaacggccatgagtgagcccaacctggcggcagcgcaaaagatg

SEQ ID NO: 189877 - DNA, 103 bp, Artificial Sequence
  Synthetic Polynucleotide
taatacgactcactatagggcagcatagcggcctgggtaggggctgctgtaacagaggagaacagcaatgcctacccagaacctggcggcagcgcaaaagatg

SEQ ID NO: 189878 - DNA, 103 bp, Artificial Sequence
  Synthetic Polynucleotide
taatacgactcactatagggggcctgggggtccgggcgtgcggggctcacaacagaggagagtgagcatggcacgcccgaacctggcggcagcgcaaaagatg

SEQ ID NO: 189879 - DNA, 103 bp, Artificial Sequence
  Synthetic Polynucleotide
taatacgactcactataggggtggtggtcaggcctgggggtccgggcgtgaacagaggagacacgccatgacccccaggaacctggcggcagcgcaaaagatg

SEQ ID NO: 189880 - DNA, 103 bp, Artificial Sequence
  Synthetic Polynucleotide
taatacgactcactataggggggtgcaggggtggtggtcaggcctgggggaacagaggagacccccaatgctgaccaccaacctggcggcagcgcaaaagatg

SEQ ID NO: 189881 - DNA, 103 bp, Artificial Sequence
  Synthetic Polynucleotide
taatacgactcactataggggtttgtctgggggtgcaggggtggtggtcaaacagaggagatgaccaatgcccctgcacaacctggcggcagcgcaaaagatg

SEQ ID NO: 189882 - DNA, 103 bp, Artificial Sequence
  Synthetic Polynucleotide
taatacgactcactatagggttgccccccagtttgtctgggggtgcagggaacagaggagaccctgcatgcccagacaaaacctggcggcagcgcaaaagatg

SEQ ID NO: 189883 - DNA, 103 bp, Artificial Sequence
  Synthetic Polynucleotide
taatacgactcactatagggggctcgctgcttgccccccagtttgtctggaacagaggagaccagacatgctggggggcaacctggcggcagcgcaaaagatg

SEQ ID NO: 189884 - DNA, 103 bp, Artificial Sequence
  Synthetic Polynucleotide
taatacgactcactatagggacttgaaggcggctcgctgcttgccccccaaacagaggagatgggggatgagcagcgagaacctggcggcagcgcaaaagatg

SEQ ID NO: 189885 - DNA, 103 bp, Artificial Sequence
  Synthetic Polynucleotide
taatacgactcactatagggcgcttgcccgacttgaaggcggctcgctgcaacagaggagagcagcgatgcgccttcaaaacctggcggcagcgcaaaagatg

SEQ ID NO: 189886 - DNA, 103 bp, Artificial Sequence
  Synthetic Polynucleotide
taatacgactcactatagggcttccccacccgcttgcccgacttgaaggcaacagaggagagccttcatgtcgggcaagaacctggcggcagcgcaaaagatg

SEQ ID NO: 189887 - DNA, 103 bp, Artificial Sequence
  Synthetic Polynucleotide
taatacgactcactatagggtgggtgagggcttccccacccgcttgcccgaacagaggagacgggcaatggggtggggaaacctggcggcagcgcaaaagatg

SEQ ID NO: 189888 - DNA, 103 bp, Artificial Sequence
  Synthetic Polynucleotide
taatacgactcactatagggctctcctcaccagcatagcggcctgggtagaacagaggagactacccatgccgctatgcaacctggcggcagcgcaaaagatg

SEQ ID NO: 189889 - DNA, 103 bp, Artificial Sequence
  Synthetic Polynucleotide
taatacgactcactataggggaggcagccttgggtgagggcttccccaccaacagaggagaggtgggatggccctcaccaacctggcggcagcgcaaaagatg

SEQ ID NO: 189890 - DNA, 103 bp, Artificial Sequence
  Synthetic Polynucleotide
taatacgactcactataggggctggggctggaggcagccttgggtgagggaacagaggagaccctcaatgaaggctgccaacctggcggcagcgcaaaagatg

SEQ ID NO: 189891 - DNA, 103 bp, Artificial Sequence
  Synthetic Polynucleotide
taatacgactcactatagggcggccgggttgctggggctggaggcagcctaacagaggagaaggctgatgccagccccaaacctggcggcagcgcaaaagatg

SEQ ID NO: 189892 - DNA, 103 bp, Artificial Sequence
  Synthetic Polynucleotide
taatacgactcactatagggacaggcagggcggccgggttgctggggctgaacagaggagacagcccatgcaacccggcaacctggcggcagcgcaaaagatg

SEQ ID NO: 189893 - DNA, 103 bp, Artificial Sequence
  Synthetic Polynucleotide
taatacgactcactataggggtcggaggccacaggcagggcggccgggttaacagaggagaaacccgatggccctgcctaacctggcggcagcgcaaaagatg

SEQ ID NO: 189894 - DNA, 103 bp, Artificial Sequence
  Synthetic Polynucleotide
taatacgactcactatagggtcgggctgctgtcggaggccacaggcagggaacagaggagaccctgcatgtggcctccgaacctggcggcagcgcaaaagatg

SEQ ID NO: 189895 - DNA, 103 bp, Artificial Sequence
  Synthetic Polynucleotide
taatacgactcactatagggttggagcccatcgggctgctgtcggaggccaacagaggagaggcctcatgcagcagcccaacctggcggcagcgcaaaagatg

SEQ ID NO: 189896 - DNA, 103 bp, Artificial Sequence
  Synthetic Polynucleotide
taatacgactcactatagggctccttggtcttggagcccatcgggctgctaacagaggagaagcagcatgatgggctccaacctggcggcagcgcaaaagatg

SEQ ID NO: 189897 - DNA, 103 bp, Artificial Sequence
  Synthetic Polynucleotide
taatacgactcactataggggtgagtctgtctccttggtcttggagcccaaacagaggagatgggctatgagaccaaggaacctggcggcagcgcaaaagatg

SEQ ID NO: 189898 - DNA, 103 bp, Artificial Sequence
  Synthetic Polynucleotide
taatacgactcactatagggggcgtgctgggtgagtctgtctccttggtcaacagaggagagaccaaatggacagactcaacctggcggcagcgcaaaagatg

SEQ ID NO: 189899 - DNA, 103 bp, Artificial Sequence
  Synthetic Polynucleotide
taatacgactcactatagggagcctgaaggctctcctcaccagcatagcgaacagaggagacgctatatgggtgaggagaacctggcggcagcgcaaaagatg

SEQ ID NO: 189900 - DNA, 103 bp, Artificial Sequence
  Synthetic Polynucleotide
taatacgactcactataggggtccttgccaggcgtgctgggtgagtctgtaacagaggagaacagacatgcccagcacgaacctggcggcagcgcaaaagatg

SEQ ID NO: 189901 - DNA, 103 bp, Artificial Sequence
  Synthetic Polynucleotide
taatacgactcactatagggtggagcgctggtccttgccaggcgtgctggaacagaggagaccagcaatgctggcaaggaacctggcggcagcgcaaaagatg

SEQ ID NO: 189902 - DNA, 103 bp, Artificial Sequence
  Synthetic Polynucleotide
taatacgactcactatagggcgaaggatcatggagcgctggtccttgccaaacagaggagatggcaaatgccagcgctcaacctggcggcagcgcaaaagatg

SEQ ID NO: 189903 - DNA, 103 bp, Artificial Sequence
  Synthetic Polynucleotide
taatacgactcactatagggggtgcgtgaccgaaggatcatggagcgctgaacagaggagacagcgcatgatgatccttaacctggcggcagcgcaaaagatg

SEQ ID NO: 189904 - DNA, 103 bp, Artificial Sequence
  Synthetic Polynucleotide
taatacgactcactatagggcctgggttttggtgcgtgaccgaaggatcaaacagaggagatgatccatgggtcacgcaaacctggcggcagcgcaaaagatg

SEQ ID NO: 189905 - DNA, 103 bp, Artificial Sequence
  Synthetic Polynucleotide
taatacgactcactatagggtggaagatctcctgggttttggtgcgtgacaacagaggagagtcacgatgcaaaacccaaacctggcggcagcgcaaaagatg

SEQ ID NO: 189906 - DNA, 103 bp, Artificial Sequence
  Synthetic Polynucleotide
taatacgactcactatagggccgcttggagtggaagatctcctgggttttaacagaggagaaaaaccatggagatcttcaacctggcggcagcgcaaaagatg

SEQ ID NO: 189907 - DNA, 103 bp, Artificial Sequence
  Synthetic Polynucleotide
taatacgactcactatagggagggcctccgccgcttggagtggaagatctaacagaggagaagatctatgactccaagcaacctggcggcagcgcaaaagatg

SEQ ID NO: 189908 - DNA, 103 bp, Artificial Sequence
  Synthetic Polynucleotide
taatacgactcactatagggcggccctcagagggcctccgccgcttggagaacagaggagactccaaatggcggaggccaacctggcggcagcgcaaaagatg

SEQ ID NO: 189909 - DNA, 103 bp, Artificial Sequence
  Synthetic Polynucleotide
taatacgactcactataggggttggggagccggccctcagagggcctccgaacagaggagacggaggatgtctgagggcaacctggcggcagcgcaaaagatg

SEQ ID NO: 189910 - DNA, 103 bp, Artificial Sequence
  Synthetic Polynucleotide
taatacgactcactataggggggccccccaagcctgaaggctctcctcacaacagaggagagtgaggatggccttcaggaacctggcggcagcgcaaaagatg

SEQ ID NO: 189911 - DNA, 103 bp, Artificial Sequence
  Synthetic Polynucleotide
taatacgactcactatagggtggcacggcagttggggagccggccctcagaacagaggagactgaggatgggctccccaaacctggcggcagcgcaaaagatg

SEQ ID NO: 189912 - DNA, 103 bp, Artificial Sequence
  Synthetic Polynucleotide
taatacgactcactatagggagcttcttggtggcacggcagttggggagcaacagaggagagctcccatgctgccgtgcaacctggcggcagcgcaaaagatg

SEQ ID NO: 189913 - DNA, 103 bp, Artificial Sequence
  Synthetic Polynucleotide
taatacgactcactataggggttgtcgaggagcttcttggtggcacggcaaacagaggagatgccgtatgaccaagaagaacctggcggcagcgcaaaagatg

SEQ ID NO: 189914 - DNA, 103 bp, Artificial Sequence
  Synthetic Polynucleotide
taatacgactcactataggggcaagtggctgttgtcgaggagcttcttggaacagaggagaccaagaatgtcctcgacaaacctggcggcagcgcaaaagatg

SEQ ID NO: 189915 - DNA, 103 bp, Artificial Sequence
  Synthetic Polynucleotide
taatacgactcactatagggaatgtggcgggcaagtggctgttgtcgaggaacagaggagacctcgaatgcagccacttaacctggcggcagcgcaaaagatg

SEQ ID NO: 189916 - DNA, 103 bp, Artificial Sequence
  Synthetic Polynucleotide
taatacgactcactatagggggagaccttgaatgtggcgggcaagtggctaacagaggagaagccacatgcccgccacaaacctggcggcagcgcaaaagatg

SEQ ID NO: 189917 - DNA, 103 bp, Artificial Sequence
  Synthetic Polynucleotide
taatacgactcactataggggggggctgctggagaccttgaatgtggcggaacagaggagaccgccaatgtcaaggtctaacctggcggcagcgcaaaagatg

SEQ ID NO: 189918 - DNA, 103 bp, Artificial Sequence
  Synthetic Polynucleotide
taatacgactcactatagggccctccttctgggggctgctggagaccttgaacagaggagacaaggtatgcagcagcccaacctggcggcagcgcaaaagatg

SEQ ID NO: 189919 - DNA, 103 bp, Artificial Sequence
  Synthetic Polynucleotide
taatacgactcactataggggctcaccctgccctccttctgggggctgctaacagaggagaagcagcatgcagaaggagaacctggcggcagcgcaaaagatg

SEQ ID NO: 189920 - DNA, 103 bp, Artificial Sequence
  Synthetic Polynucleotide
taatacgactcactatagggttgcccgctggctcaccctgccctccttctaacagaggagaagaaggatggcagggtgaaacctggcggcagcgcaaaagatg

SEQ ID NO: 189921 - DNA, 103 bp, Artificial Sequence
  Synthetic Polynucleotide
taatacgactcactatagggggtggctgtggggccccccaagcctgaaggaacagaggagaccttcaatgttggggggcaacctggcggcagcgcaaaagatg

SEQ ID NO: 189922 - DNA, 103 bp, Artificial Sequence
  Synthetic Polynucleotide
taatacgactcactatagggttggggacccttgcccgctggctcaccctgaacagaggagacagggtatgccagcgggcaacctggcggcagcgcaaaagatg

SEQ ID NO: 189923 - DNA, 103 bp, Artificial Sequence
  Synthetic Polynucleotide
taatacgactcactatagggtgcaccaggtttggggacccttgcccgctgaacagaggagacagcggatgagggtccccaacctggcggcagcgcaaaagatg

SEQ ID NO: 189924 - DNA, 103 bp, Artificial Sequence
  Synthetic Polynucleotide
taatacgactcactataggggcttgctgcctgcaccaggtttggggacccaacagaggagagggtccatgaacctggtgaacctggcggcagcgcaaaagatg

SEQ ID NO: 189925 - DNA, 103 bp, Artificial Sequence
  Synthetic Polynucleotide
taatacgactcactatagggcggtcagagagcttgctgcctgcaccaggtaacagaggagaacctggatgaggcagcaaaacctggcggcagcgcaaaagatg

SEQ ID NO: 189926 - DNA, 103 bp, Artificial Sequence
  Synthetic Polynucleotide
taatacgactcactatagggatggaggggccggtcagagagcttgctgccaacagaggagaggcagcatgctctctgacaacctggcggcagcgcaaaagatg

SEQ ID NO: 189927 - DNA, 103 bp, Artificial Sequence
  Synthetic Polynucleotide
taatacgactcactatagggttttgagcgcatggaggggccggtcagagaaacagaggagatctctgatgggcccctccaacctggcggcagcgcaaaagatg

SEQ ID NO: 189928 - DNA, 103 bp, Artificial Sequence
  Synthetic Polynucleotide
taatacgactcactataggggccgacttccttttgagcgcatggaggggcaacagaggagagcccctatgtgcgctcaaaacctggcggcagcgcaaaagatg

SEQ ID NO: 189929 - DNA, 103 bp, Artificial Sequence
  Synthetic Polynucleotide
taatacgactcactatagggcgccatgaaggccgacttccttttgagcgcaacagaggagagcgctcatgaggaagtcgaacctggcggcagcgcaaaagatg

SEQ ID NO: 189930 - DNA, 103 bp, Artificial Sequence
  Synthetic Polynucleotide
taatacgactcactatagggtggggaccggcgccatgaaggccgacttccaacagaggagaggaagtatgccttcatggaacctggcggcagcgcaaaagatg

SEQ ID NO: 189931 - DNA, 103 bp, Artificial Sequence
  Synthetic Polynucleotide
taatacgactcactatagggcgcttcttggtggggaccggcgccatgaagaacagaggagacttcatatggccggtcccaacctggcggcagcgcaaaagatg

SEQ ID NO: 189932 - DNA, 103 bp, Artificial Sequence
  Synthetic Polynucleotide
taatacgactcactatagggctgtgggggtggtggctgtggggccccccaaacagaggagatgggggatgccacagccaaacctggcggcagcgcaaaagatg

SEQ ID NO: 189933 - DNA, 103 bp, Artificial Sequence
  Synthetic Polynucleotide
taatacgactcactataggggaccaggttccgcttcttggtggggaccggaacagaggagaccggtcatgaccaagaagaacctggcggcagcgcaaaagatg

SEQ ID NO: 189934 - DNA, 103 bp, Artificial Sequence
  Synthetic Polynucleotide
taatacgactcactatagggggctccgcaagaccaggttccgcttcttggaacagaggagaccaagaatgggaacctggaacctggcggcagcgcaaaagatg

SEQ ID NO: 189935 - DNA, 103 bp, Artificial Sequence
  Synthetic Polynucleotide
taatacgactcactatagggctgctgctgcggctccgcaagaccaggttcaacagaggagagaacctatgcttgcggagaacctggcggcagcgcaaaagatg

SEQ ID NO: 189936 - DNA, 103 bp, Artificial Sequence
  Synthetic Polynucleotide
taatacgactcactataggggttgctgctgctgctgctgcggctccgcaaaacagaggagattgcggatgcgcagcagcaacctggcggcagcgcaaaagatg

SEQ ID NO: 189937 - DNA, 103 bp, Artificial Sequence
  Synthetic Polynucleotide
taatacgactcactatagggtgccactggcgttgctgctgctgctgctgcaacagaggagagcagcaatggcagcagcaaacctggcggcagcgcaaaagatg

SEQ ID NO: 189938 - DNA, 103 bp, Artificial Sequence
  Synthetic Polynucleotide
taatacgactcactatagggtctcccccattgccactggcgttgctgctgaacagaggagacagcagatgcgccagtggaacctggcggcagcgcaaaagatg

SEQ ID NO: 189939 - DNA, 103 bp, Artificial Sequence
  Synthetic Polynucleotide
taatacgactcactatagggctccttcccatctcccccattgccactggcaacagaggagagccagtatgaatgggggaaacctggcggcagcgcaaaagatg

SEQ ID NO: 189940 - DNA, 103 bp, Artificial Sequence
  Synthetic Polynucleotide
taatacgactcactatagggcaggcctctcctccttcccatctcccccataacagaggagaatggggatgatgggaaggaacctggcggcagcgcaaaagatg

SEQ ID NO: 189941 - DNA, 103 bp, Artificial Sequence
  Synthetic Polynucleotide
taatacgactcactatagggggggaaccctcaggcctctcctccttcccaaacagaggagatgggaaatgggagaggccaacctggcggcagcgcaaaagatg

SEQ ID NO: 189942 - DNA, 103 bp, Artificial Sequence
  Synthetic Polynucleotide
taatacgactcactataggggaagagggtgggggaaccctcaggcctctcaacagaggagagagaggatggagggttccaacctggcggcagcgcaaaagatg

SEQ ID NO: 189943 - DNA, 103 bp, Artificial Sequence
  Synthetic Polynucleotide
taatacgactcactataggggtggctgcggctgtgggggtggtggctgtgaacagaggagacacagcatgcacccccacaacctggcggcagcgcaaaagatg

SEQ ID NO: 189944 - DNA, 103 bp, Artificial Sequence
  Synthetic Polynucleotide
taatacgactcactatagggacatcctcttgaagagggtgggggaaccctaacagaggagaagggttatgccaccctctaacctggcggcagcgcaaaagatg

SEQ ID NO: 189945 - DNA, 103 bp, Artificial Sequence
  Synthetic Polynucleotide
taatacgactcactatagggttgggagaagacatcctcttgaagagggtgaacagaggagacaccctatgcaagaggataacctggcggcagcgcaaaagatg

SEQ ID NO: 189946 - DNA, 103 bp, Artificial Sequence
  Synthetic Polynucleotide
taatacgactcactatagggcttggctttcttgggagaagacatcctcttaacagaggagaaagaggatgtcttctcccaacctggcggcagcgcaaaagatg

SEQ ID NO: 189947 - DNA, 103 bp, Artificial Sequence
  Synthetic Polynucleotide
taatacgactcactatagggccttggtgggcttggctttcttgggagaagaacagaggagacttctcatgagaaagccaaacctggcggcagcgcaaaagatg

SEQ ID NO: 189948 - DNA, 103 bp, Artificial Sequence
  Synthetic Polynucleotide
taatacgactcactatagggtcgccattgcccttggtgggcttggctttcaacagaggagagaaagcatggcccaccaaaacctggcggcagcgcaaaagatg

SEQ ID NO: 189949 - DNA, 103 bp, Artificial Sequence
  Synthetic Polynucleotide
taatacgactcactatagggtgtggcaggctcgccattgcccttggtgggaacagaggagacccaccatgggcaatggcaacctggcggcagcgcaaaagatg

SEQ ID NO: 189950 - DNA, 103 bp, Artificial Sequence
  Synthetic Polynucleotide
taatacgactcactataggggtgggagctttgtggcaggctcgccattgcaacagaggagagcaatgatgagcctgccaaacctggcggcagcgcaaaagatg

SEQ ID NO: 189951 - DNA, 103 bp, Artificial Sequence
  Synthetic Polynucleotide
taatacgactcactataggggtctccgggggtgggagctttgtggcaggcaacagaggagagcctgcatgaaagctcccaacctggcggcagcgcaaaagatg

SEQ ID NO: 189952 - DNA, 103 bp, Artificial Sequence
  Synthetic Polynucleotide
taatacgactcactatagggggcatcgggggtctccgggggtgggagcttaacagaggagaaagctcatgcccccggagaacctggcggcagcgcaaaagatg

SEQ ID NO: 189953 - DNA, 103 bp, Artificial Sequence
  Synthetic Polynucleotide
taatacgactcactataggggcttgaggcaggcatcgggggtctccggggaacagaggagaccccggatgcccccgatgaacctggcggcagcgcaaaagatg

SEQ ID NO: 189954 - DNA, 103 bp, Artificial Sequence
  Synthetic Polynucleotide
taatacgactcactatagggcctgcaggtagtggctgcggctgtgggggtaacagaggagaacccccatggccgcagccaacctggcggcagcgcaaaagatg

SEQ ID NO: 189955 - DNA, 103 bp, Artificial Sequence
  Synthetic Polynucleotide
taatacgactcactatagggcgagaggcgagcttgaggcaggcatcggggaacagaggagaccccgaatgctgcctcaaaacctggcggcagcgcaaaagatg

SEQ ID NO: 189956 - DNA, 103 bp, Artificial Sequence
  Synthetic Polynucleotide
taatacgactcactataggggaaggctgcccgagaggcgagcttgaggcaaacagaggagatgcctcatgctcgcctctaacctggcggcagcgcaaaagatg

SEQ ID NO: 189957 - DNA, 103 bp, Artificial Sequence
  Synthetic Polynucleotide
taatacgactcactatagggtggccccctggaaggctgcccgagaggcgaaacagaggagatcgcctatggggcagcctaacctggcggcagcgcaaaagatg

SEQ ID NO: 189958 - DNA, 103 bp, Artificial Sequence
  Synthetic Polynucleotide
taatacgactcactatagggttggtcttcatggccccctggaaggctgccaacagaggagaggcagcatgccagggggcaacctggcggcagcgcaaaagatg

SEQ ID NO: 189959 - DNA, 103 bp, Artificial Sequence
  Synthetic Polynucleotide
taatacgactcactatagggtggcagcaccttggtcttcatggccccctgaacagaggagacaggggatgatgaagaccaacctggcggcagcgcaaaagatg

SEQ ID NO: 189960 - DNA, 103 bp, Artificial Sequence
  Synthetic Polynucleotide
taatacgactcactatagggccttccggggtggcagcaccttggtcttcaaacagaggagatgaagaatgaggtgctgcaacctggcggcagcgcaaaagatg

SEQ ID NO: 189961 - DNA, 103 bp, Artificial Sequence
  Synthetic Polynucleotide
taatacgactcactatagggaggccccggcccttccggggtggcagcaccaacagaggagaggtgctatgaccccggaaaacctggcggcagcgcaaaagatg

SEQ ID NO: 189962 - DNA, 103 bp, Artificial Sequence
  Synthetic Polynucleotide
taatacgactcactatagggttccagcttcaggccccggcccttccggggaacagaggagaccccggatgggccggggcaacctggcggcagcgcaaaagatg

SEQ ID NO: 189963 - DNA, 103 bp, Artificial Sequence
  Synthetic Polynucleotide
taatacgactcactataggggcacgatggcttccagcttcaggccccggcaacagaggagagccgggatgtgaagctggaacctggcggcagcgcaaaagatg

SEQ ID NO: 189964 - DNA, 103 bp, Artificial Sequence
  Synthetic Polynucleotide
taatacgactcactataggggtgatcttctgcacgatggcttccagcttcaacagaggagagaagctatgagccatcgtaacctggcggcagcgcaaaagatg

SEQ ID NO: 189965 - DNA, 103 bp, Artificial Sequence
  Synthetic Polynucleotide
taatacgactcactatagggggtctgctggtagttctgttgtttgccatgaacagaggagacatggcatgcaacagaacaacctggcggcagcgcaaaagatg

SEQ ID NO: 189966 - DNA, 103 bp, Artificial Sequence
  Synthetic Polynucleotide
taatacgactcactatagggcttggccacccctgcaggtagtggctgcggaacagaggagaccgcagatgctacctgcaaacctggcggcagcgcaaaagatg

SEQ ID NO: 189967 - DNA, 103 bp, Artificial Sequence
  Synthetic Polynucleotide
taatacgactcactataggggctgggcgaggtgatcttctgcacgatggcaacagaggagagccatcatgcagaagatcaacctggcggcagcgcaaaagatg

SEQ ID NO: 189968 - DNA, 103 bp, Artificial Sequence
  Synthetic Polynucleotide
taatacgactcactatagggacttcttgaggctgggcgaggtgatcttctaacagaggagaagaagaatgcctcgcccaaacctggcggcagcgcaaaagatg

SEQ ID NO: 189969 - DNA, 103 bp, Artificial Sequence
  Synthetic Polynucleotide
taatacgactcactatagggttacatgcgaacttcttgaggctgggcgagaacagaggagactcgccatgcctcaagaaaacctggcggcagcgcaaaagatg

SEQ ID NO: 189970 - DNA, 103 bp, Artificial Sequence
  Synthetic Polynucleotide
taatacgactcactatagggccctggcgctttacatgcgaacttcttgagaacagaggagactcaagatgttcgcatgtaacctggcggcagcgcaaaagatg

SEQ ID NO: 189971 - DNA, 103 bp, Artificial Sequence
  Synthetic Polynucleotide
taatacgactcactatagggcaggagaggcccctggcgctttacatgcgaaacagaggagatcgcatatgaagcgccagaacctggcggcagcgcaaaagatg

SEQ ID NO: 189972 - DNA, 103 bp, Artificial Sequence
  Synthetic Polynucleotide
taatacgactcactatagggagaggattaccaggagaggcccctggcgctaacagaggagaagcgccatgggcctctccaacctggcggcagcgcaaaagatg

SEQ ID NO: 189973 - DNA, 103 bp, Artificial Sequence
  Synthetic Polynucleotide
taatacgactcactatagggggatgggctcagaggattaccaggagaggcaacagaggagagcctctatgggtaatcctaacctggcggcagcgcaaaagatg

SEQ ID NO: 189974 - DNA, 103 bp, Artificial Sequence
  Synthetic Polynucleotide
taatacgactcactatagggtgtcggaaagggatgggctcagaggattacaacagaggagagtaatcatgtgagcccataacctggcggcagcgcaaaagatg

SEQ ID NO: 189975 - DNA, 103 bp, Artificial Sequence
  Synthetic Polynucleotide
taatacgactcactatagggccacggtctttgtcggaaagggatgggctcaacagaggagagagcccatgcctttccgaaacctggcggcagcgcaaaagatg

SEQ ID NO: 189976 - DNA, 103 bp, Artificial Sequence
  Synthetic Polynucleotide
taatacgactcactatagggacccttgagcccacggtctttgtcggaaagaacagaggagactttccatgaaagaccgtaacctggcggcagcgcaaaagatg

SEQ ID NO: 189977 - DNA, 103 bp, Artificial Sequence
  Synthetic Polynucleotide
taatacgactcactatagggtctcatcatacttggccacccctgcaggtaaacagaggagatacctgatggggtggccaaacctggcggcagcgcaaaagatg

SEQ ID NO: 189978 - DNA, 103 bp, Artificial Sequence
  Synthetic Polynucleotide
taatacgactcactatagggtgcccccagcacccttgagcccacggtcttaacagaggagaaagaccatgggctcaaggaacctggcggcagcgcaaaagatg

SEQ ID NO: 189979 - DNA, 103 bp, Artificial Sequence
  Synthetic Polynucleotide
taatacgactcactatagggcccactgggctgcccccagcacccttgagcaacagaggagagctcaaatgtgctgggggaacctggcggcagcgcaaaagatg

SEQ ID NO: 189980 - DNA, 103 bp, Artificial Sequence
  Synthetic Polynucleotide
taatacgactcactatagggttcttccacccccactgggctgcccccagcaacagaggagagctgggatgagcccagtgaacctggcggcagcgcaaaagatg

SEQ ID NO: 189981 - DNA, 103 bp, Artificial Sequence
  Synthetic Polynucleotide
taatacgactcactatagggttaccaggccttcttccacccccactgggcaacagaggagagcccagatggggtggaagaacctggcggcagcgcaaaagatg

SEQ ID NO: 189982 - DNA, 103 bp, Artificial Sequence
  Synthetic Polynucleotide
taatacgactcactataggggtgcccacatttaccaggccttcttccaccaacagaggagaggtggaatgaggcctggtaacctggcggcagcgcaaaagatg

SEQ ID NO: 189983 - DNA, 103 bp, Artificial Sequence
  Synthetic Polynucleotide
taatacgactcactatagggcttctgcccggtgcccacatttaccaggccaacagaggagaggcctgatgaatgtgggcaacctggcggcagcgcaaaagatg

SEQ ID NO: 189984 - DNA, 103 bp, Artificial Sequence
  Synthetic Polynucleotide
taatacgactcactatagggaagttgggagcttctgcccggtgcccacataacagaggagaatgtggatgccgggcagaaacctggcggcagcgcaaaagatg

SEQ ID NO: 189985 - DNA, 103 bp, Artificial Sequence
  Synthetic Polynucleotide
taatacgactcactatagggtcagccccagaagttgggagcttctgcccgaacagaggagacgggcaatggctcccaacaacctggcggcagcgcaaaagatg

SEQ ID NO: 189986 - DNA, 103 bp, Artificial Sequence
  Synthetic Polynucleotide
taatacgactcactataggggcataacggatcagccccagaagttgggagaacagaggagactcccaatgtctggggctaacctggcggcagcgcaaaagatg

SEQ ID NO: 189987 - DNA, 103 bp, Artificial Sequence
  Synthetic Polynucleotide
taatacgactcactatagggttggatttctgcataacggatcagccccagaacagaggagactggggatgatccgttataacctggcggcagcgcaaaagatg

SEQ ID NO: 189988 - DNA, 103 bp, Artificial Sequence
  Synthetic Polynucleotide
taatacgactcactatagggttcatcaagttctcatcatacttggccaccaacagaggagaggtggcatggtatgatgaaacctggcggcagcgcaaaagatg

SEQ ID NO: 189989 - DNA, 103 bp, Artificial Sequence
  Synthetic Polynucleotide
taatacgactcactataggggatctgttggttggatttctgcataacggaaacagaggagatccgttatgcagaaatccaacctggcggcagcgcaaaagatg

SEQ ID NO: 189990 - DNA, 103 bp, Artificial Sequence
  Synthetic Polynucleotide
taatacgactcactataggggccttttaaggatctgttggttggatttctaacagaggagaagaaatatgaccaacagaaacctggcggcagcgcaaaagatg

SEQ ID NO: 189991 - DNA, 103 bp, Artificial Sequence
  Synthetic Polynucleotide
taatacgactcactatagggtcatgagtttgccttttaaggatctgttggaacagaggagaccaacaatgccttaaaagaacctggcggcagcgcaaaagatg

SEQ ID NO: 189992 - DNA, 103 bp, Artificial Sequence
  Synthetic Polynucleotide
taatacgactcactatagggttcttactgttcatgagtttgccttttaagaacagaggagacttaaaatgcaaactcataacctggcggcagcgcaaaagatg

SEQ ID NO: 189993 - DNA, 103 bp, Artificial Sequence
  Synthetic Polynucleotide
taatacgactcactatagggagaagacagtttcttactgttcatgagtttaacagaggagaaaactcatgaacagtaagaacctggcggcagcgcaaaagatg

SEQ ID NO: 189994 - DNA, 103 bp, Artificial Sequence
  Synthetic Polynucleotide
taatacgactcactatagggaacagtcagtagaagacagtttcttactgtaacagaggagaacagtaatgaactgtcttaacctggcggcagcgcaaaagatg

SEQ ID NO: 189995 - DNA, 103 bp, Artificial Sequence
  Synthetic Polynucleotide
taatacgactcactatagggtcggttttgaaacagtcagtagaagacagtaacagaggagaactgtcatgtactgactgaacctggcggcagcgcaaaagatg

SEQ ID NO: 189996 - DNA, 103 bp, Artificial Sequence
  Synthetic Polynucleotide
taatacgactcactatagggtgtgaaggcctcggttttgaaacagtcagtaacagaggagaactgacatgttcaaaaccaacctggcggcagcgcaaaagatg

SEQ ID NO: 189997 - DNA, 103 bp, Artificial Sequence
  Synthetic Polynucleotide
taatacgactcactatagggcctccggggatgtgaaggcctcggttttgaaacagaggagatcaaaaatgaggccttcaaacctggcggcagcgcaaaagatg

SEQ ID NO: 189998 - DNA, 103 bp, Artificial Sequence
  Synthetic Polynucleotide
taatacgactcactatagggggctgcagggcctccggggatgtgaaggccaacagaggagaggccttatgatccccggaaacctggcggcagcgcaaaagatg

SEQ ID NO: 189999 - DNA, 103 bp, Artificial Sequence
  Synthetic Polynucleotide
taatacgactcactatagggtgctgtctttttcatcaagttctcatcataaacagaggagatatgatatgaacttgatgaacctggcggcagcgcaaaagatg

SEQ ID NO: 190000 - DNA, 103 bp, Artificial Sequence
  Synthetic Polynucleotide
taatacgactcactatagggagtccccccaggctgcagggcctccggggaaacagaggagatccccgatggccctgcagaacctggcggcagcgcaaaagatg

SEQ ID NO: 190001 - DNA, 103 bp, Artificial Sequence
  Synthetic Polynucleotide
taatacgactcactataggggcgccagggcagtccccccaggctgcagggaacagaggagaccctgcatgctggggggaaacctggcggcagcgcaaaagatg

SEQ ID NO: 190002 - DNA, 103 bp, Artificial Sequence
  Synthetic Polynucleotide
taatacgactcactatagggctcttcttaggcgccagggcagtccccccaaacagaggagatgggggatgtgccctggcaacctggcggcagcgcaaaagatg

SEQ ID NO: 190003 - DNA, 103 bp, Artificial Sequence
  Synthetic Polynucleotide
taatacgactcactatagggtttccggctcctcttcttaggcgccagggcaacagaggagagccctgatgcctaagaagaacctggcggcagcgcaaaagatg

SEQ ID NO: 190004 - DNA, 103 bp, Artificial Sequence
  Synthetic Polynucleotide
taatacgactcactatagggctgcccggcctttccggctcctcttcttagaacagaggagactaagaatgggagccggaaacctggcggcagcgcaaaagatg

SEQ ID NO: 190005 - DNA, 103 bp, Artificial Sequence
  Synthetic Polynucleotide
taatacgactcactatagggccatgggcccctgcccggcctttccggctcaacagaggagagagccgatgaggccgggcaacctggcggcagcgcaaaagatg

SEQ ID NO: 190006 - DNA, 103 bp, Artificial Sequence
  Synthetic Polynucleotide
taatacgactcactatagggtttggagagtccatgggcccctgcccggccaacagaggagaggccggatgggggcccataacctggcggcagcgcaaaagatg

SEQ ID NO: 190007 - DNA, 103 bp, Artificial Sequence
  Synthetic Polynucleotide
taatacgactcactatagggccagcgggcctttggagagtccatgggcccaacagaggagagggcccatggactctccaaacctggcggcagcgcaaaagatg

SEQ ID NO: 190008 - DNA, 103 bp, Artificial Sequence
  Synthetic Polynucleotide
taatacgactcactatagggggccgcttctccagcgggcctttggagagtaacagaggagaactctcatgaggcccgctaacctggcggcagcgcaaaagatg

SEQ ID NO: 190009 - DNA, 103 bp, Artificial Sequence
  Synthetic Polynucleotide
taatacgactcactataggggccaagatagggccgcttctccagcgggccaacagaggagaggcccgatggagaagcggaacctggcggcagcgcaaaagatg

SEQ ID NO: 190010 - DNA, 103 bp, Artificial Sequence
  Synthetic Polynucleotide
taatacgactcactatagggtggggggcactgctgtctttttcatcaagtaacagaggagaacttgaatgaaaagacagaacctggcggcagcgcaaaagatg

SEQ ID NO: 190011 - DNA, 103 bp, Artificial Sequence
  Synthetic Polynucleotide
taatacgactcactataggggcagagccgggccaagatagggccgcttctaacagaggagaagaagcatgcctatcttgaacctggcggcagcgcaaaagatg

SEQ ID NO: 190012 - DNA, 103 bp, Artificial Sequence
  Synthetic Polynucleotide
taatacgactcactatagggggagtcaggagcagagccgggccaagatagaacagaggagactatctatgcccggctctaacctggcggcagcgcaaaagatg

SEQ ID NO: 190013 - DNA, 103 bp, Artificial Sequence
  Synthetic Polynucleotide
taatacgactcactatagggcctgtctcggggagtcaggagcagagccggaacagaggagaccggctatgctcctgactaacctggcggcagcgcaaaagatg

SEQ ID NO: 190014 - DNA, 103 bp, Artificial Sequence
  Synthetic Polynucleotide
taatacgactcactatagggtgccactggccctgtctcggggagtcaggaaacagaggagatcctgaatgcccgagacaaacctggcggcagcgcaaaagatg

SEQ ID NO: 190015 - DNA, 103 bp, Artificial Sequence
  Synthetic Polynucleotide
taatacgactcactataggggccccttgtgtgccactggccctgtctcggaacagaggagaccgagaatgggccagtggaacctggcggcagcgcaaaagatg

SEQ ID NO: 190016 - DNA, 103 bp, Artificial Sequence
  Synthetic Polynucleotide
taatacgactcactataggggtcctcactggccccttgtgtgccactggcaacagaggagagccagtatgacacaagggaacctggcggcagcgcaaaagatg

SEQ ID NO: 190017 - DNA, 103 bp, Artificial Sequence
  Synthetic Polynucleotide
taatacgactcactatagggcaccagagttgtcctcactggccccttgtgaacagaggagacacaagatgccagtgaggaacctggcggcagcgcaaaagatg

SEQ ID NO: 190018 - DNA, 103 bp, Artificial Sequence
  Synthetic Polynucleotide
taatacgactcactatagggttgcctcctccaccagagttgtcctcactgaacagaggagacagtgaatgcaactctggaacctggcggcagcgcaaaagatg

SEQ ID NO: 190019 - DNA, 103 bp, Artificial Sequence
  Synthetic Polynucleotide
taatacgactcactatagggctttggcttcttgcctcctccaccagagttaacagaggagaaactctatgggaggaggcaacctggcggcagcgcaaaagatg

SEQ ID NO: 190020 - DNA, 103 bp, Artificial Sequence
  Synthetic Polynucleotide
taatacgactcactataggggctcctccatctttggcttcttgcctcctcaacagaggagagaggagatgagaagccaaaacctggcggcagcgcaaaagatg

SEQ ID NO: 190021 - DNA, 103 bp, Artificial Sequence
  Synthetic Polynucleotide
taatacgactcactatagggtactgcctgctggggggcactgctgtctttaacagaggagaaaagacatgagtgcccccaacctggcggcagcgcaaaagatg

SEQ ID NO: 190022 - DNA, 103 bp, Artificial Sequence
  Synthetic Polynucleotide
taatacgactcactataggggccaggcccagctcctccatctttggcttcaacagaggagagaagccatggatggaggaaacctggcggcagcgcaaaagatg

SEQ ID NO: 190023 - DNA, 103 bp, Artificial Sequence
  Synthetic Polynucleotide
taatacgactcactataggggggctgggaggccaggcccagctcctccataacagaggagaatggagatgctgggcctgaacctggcggcagcgcaaaagatg

SEQ ID NO: 190024 - DNA, 103 bp, Artificial Sequence
  Synthetic Polynucleotide
taatacgactcactatagggtgccctccgggggctgggaggccaggcccaaacagaggagatgggccatgcctcccagcaacctggcggcagcgcaaaagatg

SEQ ID NO: 190025 - DNA, 103 bp, Artificial Sequence
  Synthetic Polynucleotide
taatacgactcactatagggtggcagggcctgccctccgggggctgggagaacagaggagactcccaatgcccggagggaacctggcggcagcgcaaaagatg

SEQ ID NO: 190026 - DNA, 103 bp, Artificial Sequence
  Synthetic Polynucleotide
taatacgactcactatagggtgtctggggctggcagggcctgccctccggaacagaggagaccggagatgaggccctgcaacctggcggcagcgcaaaagatg

SEQ ID NO: 190027 - DNA, 103 bp, Artificial Sequence
  Synthetic Polynucleotide
taatacgactcactatagggtctgtgcccttgtctggggctggcagggccaacagaggagaggccctatgagccccagaaacctggcggcagcgcaaaagatg

SEQ ID NO: 190028 - DNA, 103 bp, Artificial Sequence
  Synthetic Polynucleotide
taatacgactcactatagggcctggctgtttctgtgcccttgtctggggcaacagaggagagccccaatgaagggcacaaacctggcggcagcgcaaaagatg

SEQ ID NO: 190029 - DNA, 103 bp, Artificial Sequence
  Synthetic Polynucleotide
taatacgactcactataggggttggtgtggcctggctgtttctgtgccctaacagaggagaagggcaatgaaacagccaaacctggcggcagcgcaaaagatg

SEQ ID NO: 190030 - DNA, 103 bp, Artificial Sequence
  Synthetic Polynucleotide
taatacgactcactatagggagctgctgtagttggtgtggcctggctgttaacagaggagaaacagcatggccacaccaaacctggcggcagcgcaaaagatg

SEQ ID NO: 190031 - DNA, 103 bp, Artificial Sequence
  Synthetic Polynucleotide
taatacgactcactatagggcgcttggaatagctgctgtagttggtgtggaacagaggagaccacacatgctacagcagaacctggcggcagcgcaaaagatg

SEQ ID NO: 190032 - DNA, 103 bp, Artificial Sequence
  Synthetic Polynucleotide
taatacgactcactatagggctgctctgcatactgcctgctggggggcacaacagaggagagtgcccatgagcaggcagaacctggcggcagcgcaaaagatg

SEQ ID NO: 190033 - DNA, 103 bp, Artificial Sequence
  Synthetic Polynucleotide
taatacgactcactataggggaggcgcttccgcttggaatagctgctgtaaacagaggagatacagcatgtattccaagaacctggcggcagcgcaaaagatg

SEQ ID NO: 190034 - DNA, 103 bp, Artificial Sequence
  Synthetic Polynucleotide
taatacgactcactatagggggccccgagtgaggcgcttccgcttggaataacagaggagaattccaatgggaagcgccaacctggcggcagcgcaaaagatg

SEQ ID NO: 190035 - DNA, 103 bp, Artificial Sequence
  Synthetic Polynucleotide
taatacgactcactatagggttcttggcccggccccgagtgaggcgcttcaacagaggagagaagcgatgcactcggggaacctggcggcagcgcaaaagatg

SEQ ID NO: 190036 - DNA, 103 bp, Artificial Sequence
  Synthetic Polynucleotide
taatacgactcactatagggagaggtggtgttcttggcccggccccgagtaacagaggagaactcggatgcgggccaagaacctggcggcagcgcaaaagatg

SEQ ID NO: 190037 - DNA, 103 bp, Artificial Sequence
  Synthetic Polynucleotide
taatacgactcactatagggtacagggtgaagaggtggtgttcttggcccaacagaggagagggccaatgacaccacctaacctggcggcagcgcaaaagatg

SEQ ID NO: 190038 - DNA, 103 bp, Artificial Sequence
  Synthetic Polynucleotide
taatacgactcactataggggcacgccccttacagggtgaagaggtggtgaacagaggagacaccacatgttcaccctgaacctggcggcagcgcaaaagatg

SEQ ID NO: 190039 - DNA, 103 bp, Artificial Sequence
  Synthetic Polynucleotide
taatacgactcactatagggtcgtcgcttggcacgccccttacagggtgaaacagaggagatcacccatgaaggggcgtaacctggcggcagcgcaaaagatg

SEQ ID NO: 190040 - DNA, 103 bp, Artificial Sequence
  Synthetic Polynucleotide
taatacgactcactataggggctgctgtcgtcgtcgcttggcacgcccctaacagaggagaaggggcatgccaagcgacaacctggcggcagcgcaaaagatg

SEQ ID NO: 190041 - DNA, 103 bp, Artificial Sequence
  Synthetic Polynucleotide
taatacgactcactatagggggcagcacctgctgctgtcgtcgtcgcttgaacagaggagacaagcgatgacgacagcaaacctggcggcagcgcaaaagatg

SEQ ID NO: 190042 - DNA, 103 bp, Artificial Sequence
  Synthetic Polynucleotide
taatacgactcactataggggggatccaggggcagcacctgctgctgtcgaacagaggagacgacagatgcaggtgctgaacctggcggcagcgcaaaagatg

SEQ ID NO: 190043 - DNA, 103 bp, Artificial Sequence
  Synthetic Polynucleotide
taatacgactcactatagggcctgggcgccctgctctgcatactgcctgcaacagaggagagcaggcatgatgcagagcaacctggcggcagcgcaaaagatg

SEQ ID NO: 190044 - DNA, 103 bp, Artificial Sequence
  Synthetic Polynucleotide
taatacgactcactatagggcaggctctgcgggatccaggggcagcacctaacagaggagaaggtgcatgccctggatcaacctggcggcagcgcaaaagatg

SEQ ID NO: 190045 - DNA, 103 bp, Artificial Sequence
  Synthetic Polynucleotide
taatacgactcactatagggaggcggatttcaggctctgcgggatccaggaacagaggagacctggaatgcgcagagccaacctggcggcagcgcaaaagatg

SEQ ID NO: 190046 - DNA, 103 bp, Artificial Sequence
  Synthetic Polynucleotide
taatacgactcactatagggaatgtacttgaggcggatttcaggctctgcaacagaggagagcagagatggaaatccgcaacctggcggcagcgcaaaagatg

SEQ ID NO: 190047 - DNA, 103 bp, Artificial Sequence
  Synthetic Polynucleotide
taatacgactcactatagggtgcaagaggaaatgtacttgaggcggatttaacagaggagaaaatccatgtcaagtacaaacctggcggcagcgcaaaagatg

SEQ ID NO: 190048 - DNA, 103 bp, Artificial Sequence
  Synthetic Polynucleotide
taatacgactcactatagggctcagccgcttgcaagaggaaatgtacttgaacagaggagacaagtaatgttcctcttgaacctggcggcagcgcaaaagatg

SEQ ID NO: 190049 - DNA, 103 bp, Artificial Sequence
  Synthetic Polynucleotide
taatacgactcactataggggctgtctgacctcagccgcttgcaagaggaaacagaggagatcctctatgaagcggctgaacctggcggcagcgcaaaagatg

SEQ ID NO: 190050 - DNA, 103 bp, Artificial Sequence
  Synthetic Polynucleotide
taatacgactcactatagggcgggggtccggctgtctgacctcagccgctaacagaggagaagcggcatgggtcagacaaacctggcggcagcgcaaaagatg

SEQ ID NO: 190051 - DNA, 103 bp, Artificial Sequence
  Synthetic Polynucleotide
taatacgactcactatagggggtgagaaggcgggggtccggctgtctgacaacagaggagagtcagaatgccggaccccaacctggcggcagcgcaaaagatg

SEQ ID NO: 190052 - DNA, 103 bp, Artificial Sequence
  Synthetic Polynucleotide
taatacgactcactatagggccgcacgaagggtgagaaggcgggggtccgaacagaggagacggaccatggccttctcaaacctggcggcagcgcaaaagatg

SEQ ID NO: 190053 - DNA, 103 bp, Artificial Sequence
  Synthetic Polynucleotide
taatacgactcactataggggcttctccacccgcacgaagggtgagaaggaacagaggagaccttctatgccttcgtgcaacctggcggcagcgcaaaagatg

SEQ ID NO: 190054 - DNA, 103 bp, Artificial Sequence
  Synthetic Polynucleotide
taatacgactcactatagggcgaaagggcacctgggcgccctgctctgcaaacagaggagatgcagaatggggcgcccaaacctggcggcagcgcaaaagatg

SEQ ID NO: 190055 - DNA, 103 bp, Artificial Sequence
  Synthetic Polynucleotide
taatacgactcactatagggaacgcgtctcgcttctccacccgcacgaagaacagaggagacttcgtatgggtggagaaaacctggcggcagcgcaaaagatg

SEQ ID NO: 190056 - DNA, 103 bp, Artificial Sequence
  Synthetic Polynucleotide
taatacgactcactatagggtatggtggtgaacgcgtctcgcttctccacaacagaggagagtggagatgcgagacgcgaacctggcggcagcgcaaaagatg

SEQ ID NO: 190057 - DNA, 103 bp, Artificial Sequence
  Synthetic Polynucleotide
taatacgactcactatagggcaacagtgcatatggtggtgaacgcgtctcaacagaggagagagacgatgtcaccaccaaacctggcggcagcgcaaaagatg

SEQ ID NO: 190058 - DNA, 103 bp, Artificial Sequence
  Synthetic Polynucleotide
taatacgactcactatagggggggagttgacaacagtgcatatggtggtgaacagaggagacaccacatgatgcactgtaacctggcggcagcgcaaaagatg

SEQ ID NO: 190059 - DNA, 103 bp, Artificial Sequence
  Synthetic Polynucleotide
taatacgactcactatagggcgcatctccaggggagttgacaacagtgcaaacagaggagatgcactatggtcaactccaacctggcggcagcgcaaaagatg

SEQ ID NO: 190060 - DNA, 103 bp, Artificial Sequence
  Synthetic Polynucleotide
taatacgactcactatagggggggcttgggcgcatctccaggggagttgaaacagaggagatcaactatgctggagatgaacctggcggcagcgcaaaagatg

SEQ ID NO: 190061 - DNA, 103 bp, Artificial Sequence
  Synthetic Polynucleotide
taatacgactcactatagggggcttcctgtggggcttgggcgcatctccaaacagaggagatggagaatggcccaagccaacctggcggcagcgcaaaagatg

SEQ ID NO: 190062 - DNA, 103 bp, Artificial Sequence
  Synthetic Polynucleotide
taatacgactcactatagggagaggaggaaggcttcctgtggggcttgggaacagaggagacccaagatgcacaggaagaacctggcggcagcgcaaaagatg

SEQ ID NO: 190063 - DNA, 103 bp, Artificial Sequence
  Synthetic Polynucleotide
taatacgactcactatagggaagaggaggcagaggaggaaggcttcctgtaacagaggagaacaggaatgcttcctcctaacctggcggcagcgcaaaagatg

SEQ ID NO: 190064 - DNA, 103 bp, Artificial Sequence
  Synthetic Polynucleotide
taatacgactcactataggggaggatgaggaagaggaggcagaggaggaaaacagaggagattcctcatgtgcctcctcaacctggcggcagcgcaaaagatg

SEQ ID NO: 190065 - DNA, 103 bp, Artificial Sequence
  Synthetic Polynucleotide
taatacgactcactatagggggagtgagtccgaaagggcacctgggcgccaacagaggagaggcgccatggtgccctttaacctggcggcagcgcaaaagatg

SEQ ID NO: 190066 - DNA, 103 bp, Artificial Sequence
  Synthetic Polynucleotide
taatacgactcactataggggaacgaggacgaggatgaggaagaggaggcaacagaggagagcctccatgtcctcatccaacctggcggcagcgcaaaagatg

SEQ ID NO: 190067 - DNA, 103 bp, Artificial Sequence
  Synthetic Polynucleotide
taatacgactcactatagggcatccaaggagaacgaggacgaggatgaggaacagaggagacctcatatgcgtcctcgtaacctggcggcagcgcaaaagatg

SEQ ID NO: 190068 - DNA, 103 bp, Artificial Sequence
  Synthetic Polynucleotide
taatacgactcactataggggccccggctgcatccaaggagaacgaggacaacagaggagagtcctcatgctccttggaaacctggcggcagcgcaaaagatg

SEQ ID NO: 190069 - DNA, 103 bp, Artificial Sequence
  Synthetic Polynucleotide
taatacgactcactatagggggccagggaggccccggctgcatccaaggaaacagaggagatccttgatggcagccgggaacctggcggcagcgcaaaagatg

SEQ ID NO: 190070 - DNA, 103 bp, Artificial Sequence
  Synthetic Polynucleotide
taatacgactcactatagggcagggagtgtggccagggaggccccggctgaacagaggagacagccgatgcctccctggaacctggcggcagcgcaaaagatg

SEQ ID NO: 190071 - DNA, 103 bp, Artificial Sequence
  Synthetic Polynucleotide
taatacgactcactatagggatggagcctccagggagtgtggccagggagaacagaggagactccctatgcacactcccaacctggcggcagcgcaaaagatg

SEQ ID NO: 190072 - DNA, 103 bp, Artificial Sequence
  Synthetic Polynucleotide
taatacgactcactatagggcggctgcaggatggagcctccagggagtgtaacagaggagaacactcatgggaggctccaacctggcggcagcgcaaaagatg

SEQ ID NO: 190073 - DNA, 103 bp, Artificial Sequence
  Synthetic Polynucleotide
taatacgactcactatagggaggagggccgcggctgcaggatggagcctcaacagaggagagaggctatgtcctgcagcaacctggcggcagcgcaaaagatg

SEQ ID NO: 190074 - DNA, 103 bp, Artificial Sequence
  Synthetic Polynucleotide
taatacgactcactataggggagaggggcaaggagggccgcggctgcaggaacagaggagacctgcaatggcggccctcaacctggcggcagcgcaaaagatg

SEQ ID NO: 190075 - DNA, 103 bp, Artificial Sequence
  Synthetic Polynucleotide
taatacgactcactatagggcatcgtggaggagaggggcaaggagggccgaacagaggagacggcccatgttgcccctcaacctggcggcagcgcaaaagatg

SEQ ID NO: 190076 - DNA, 103 bp, Artificial Sequence
  Synthetic Polynucleotide
taatacgactcactatagggtttcctgcgaggtctgctggtagttctgttaacagaggagaaacagaatgaccagcagaaacctggcggcagcgcaaaagatg

SEQ ID NO: 190077 - DNA, 103 bp, Artificial Sequence
  Synthetic Polynucleotide
taatacgactcactatagggggacgtgcagggagtgagtccgaaagggcaaacagaggagatgccctatgggactcactaacctggcggcagcgcaaaagatg

SEQ ID NO: 190078 - DNA, 103 bp, Artificial Sequence
  Synthetic Polynucleotide
taatacgactcactataggggccccaagtgcatcgtggaggagaggggcaaacagaggagatgccccatgcctccacgaaacctggcggcagcgcaaaagatg

SEQ ID NO: 190079 - DNA, 103 bp, Artificial Sequence
  Synthetic Polynucleotide
taatacgactcactataggggaaaccacaggccccaagtgcatcgtggagaacagaggagactccacatggcacttgggaacctggcggcagcgcaaaagatg

SEQ ID NO: 190080 - DNA, 103 bp, Artificial Sequence
  Synthetic Polynucleotide
taatacgactcactatagggcagggccttggaaaccacaggccccaagtgaacagaggagacacttgatgcctgtggttaacctggcggcagcgcaaaagatg

SEQ ID NO: 190081 - DNA, 103 bp, Artificial Sequence
  Synthetic Polynucleotide
taatacgactcactatagggaagaggtactcagggccttggaaaccacagaacagaggagactgtggatgccaaggcccaacctggcggcagcgcaaaagatg

SEQ ID NO: 190082 - DNA, 103 bp, Artificial Sequence
  Synthetic Polynucleotide
taatacgactcactatagggcaaacaaggcaagaggtactcagggccttgaacagaggagacaaggcatggagtacctcaacctggcggcagcgcaaaagatg

SEQ ID NO: 190083 - DNA, 103 bp, Artificial Sequence
  Synthetic Polynucleotide
taatacgactcactataggggcagaggcagcaaacaaggcaagaggtactaacagaggagaagtaccatgtgccttgttaacctggcggcagcgcaaaagatg

SEQ ID NO: 190084 - DNA, 103 bp, Artificial Sequence
  Synthetic Polynucleotide
taatacgactcactatagggccgggttttggcagaggcagcaaacaaggcaacagaggagagccttgatggctgcctctaacctggcggcagcgcaaaagatg

SEQ ID NO: 190085 - DNA, 103 bp, Artificial Sequence
  Synthetic Polynucleotide
taatacgactcactatagggttgaagttggccgggttttggcagaggcagaacagaggagactgcctatgccaaaacccaacctggcggcagcgcaaaagatg

SEQ ID NO: 190086 - DNA, 103 bp, Artificial Sequence
  Synthetic Polynucleotide
taatacgactcactatagggcccaaggtccttgaagttggccgggttttgaacagaggagacaaaacatggccaacttcaacctggcggcagcgcaaaagatg

SEQ ID NO: 190087 - DNA, 103 bp, Artificial Sequence
  Synthetic Polynucleotide
taatacgactcactatagggcacagaggtccccaaggtccttgaagttggaacagaggagaccaactatgaggaccttgaacctggcggcagcgcaaaagatg

SEQ ID NO: 190088 - DNA, 103 bp, Artificial Sequence
  Synthetic Polynucleotide
taatacgactcactatagggggtggctgctggacgtgcagggagtgagtcaacagaggagagactcaatgcctgcacgtaacctggcggcagcgcaaaagatg

SEQ ID NO: 190089 - DNA, 103 bp, Artificial Sequence
  Synthetic Polynucleotide
taatacgactcactatagggtagtagggcccacagaggtccccaaggtccaacagaggagaggacctatgggacctctgaacctggcggcagcgcaaaagatg

SEQ ID NO: 190090 - DNA, 103 bp, Artificial Sequence
  Synthetic Polynucleotide
taatacgactcactataggggtgttcagggtagtagggcccacagaggtcaacagaggagagacctcatggggccctacaacctggcggcagcgcaaaagatg

SEQ ID NO: 190091 - DNA, 103 bp, Artificial Sequence
  Synthetic Polynucleotide
taatacgactcactatagggtggggaggcagtgttcagggtagtagggccaacagaggagaggccctatgaccctgaacaacctggcggcagcgcaaaagatg

SEQ ID NO: 190092 - DNA, 103 bp, Artificial Sequence
  Synthetic Polynucleotide
taatacgactcactatagggggcttctttttggggaggcagtgttcagggaacagaggagaccctgaatgctgcctcccaacctggcggcagcgcaaaagatg

SEQ ID NO: 190093 - DNA, 103 bp, Artificial Sequence
  Synthetic Polynucleotide
taatacgactcactatagggcttgagttttggcttctttttggggaggcaaacagaggagatgcctcatgaaaaagaagaacctggcggcagcgcaaaagatg

SEQ ID NO: 190094 - DNA, 103 bp, Artificial Sequence
  Synthetic Polynucleotide
taatacgactcactataggggcaccttctccttgagttttggcttcttttaacagaggagaaaaagaatgcaaaactcaaacctggcggcagcgcaaaagatg

SEQ ID NO: 190095 - DNA, 103 bp, Artificial Sequence
  Synthetic Polynucleotide
taatacgactcactatagggccttctggccgcaccttctccttgagttttaacagaggagaaaaactatgggagaaggtaacctggcggcagcgcaaaagatg

SEQ ID NO: 190096 - DNA, 103 bp, Artificial Sequence
  Synthetic Polynucleotide
taatacgactcactatagggctcacaggtgccttctggccgcaccttctcaacagaggagagagaagatgcggccagaaaacctggcggcagcgcaaaagatg

SEQ ID NO: 190097 - DNA, 103 bp, Artificial Sequence
  Synthetic Polynucleotide
taatacgactcactataggggcgaggcctcctcacaggtgccttctggccaacagaggagaggccagatggcacctgtgaacctggcggcagcgcaaaagatg

SEQ ID NO: 190098 - DNA, 103 bp, Artificial Sequence
  Synthetic Polynucleotide
taatacgactcactatagggtcaagcggcagcgaggcctcctcacaggtgaacagaggagacacctgatgggaggcctcaacctggcggcagcgcaaaagatg

SEQ ID NO: 190099 - DNA, 103 bp, Artificial Sequence
  Synthetic Polynucleotide
taatacgactcactatagggctggggcggcggtggctgctggacgtgcagaacagaggagactgcacatgcagcagccaaacctggcggcagcgcaaaagatg

SEQ ID NO: 190100 - DNA, 103 bp, Artificial Sequence
  Synthetic Polynucleotide
taatacgactcactataggggagtgttctctcaagcggcagcgaggcctcaacagaggagagaggccatgctgccgcttaacctggcggcagcgcaaaagatg

SEQ ID NO: 190101 - DNA, 103 bp, Artificial Sequence
  Synthetic Polynucleotide
taatacgactcactatagggcgggacctttgagtgttctctcaagcggcaaacagaggagatgccgcatgagagaacacaacctggcggcagcgcaaaagatg

SEQ ID NO: 190102 - DNA, 103 bp, Artificial Sequence
  Synthetic Polynucleotide
taatacgactcactataggggctgcacactcgggacctttgagtgttctcaacagaggagagagaacatgcaaaggtccaacctggcggcagcgcaaaagatg

SEQ ID NO: 190103 - DNA, 103 bp, Artificial Sequence
  Synthetic Polynucleotide
taatacgactcactatagggagtggcggcagctgcacactcgggacctttaacagaggagaaaaggtatggagtgtgcaaacctggcggcagcgcaaaagatg

SEQ ID NO: 190104 - DNA, 103 bp, Artificial Sequence
  Synthetic Polynucleotide
taatacgactcactataggggcttcccggcagtggcggcagctgcacactaacagaggagaagtgtgatgctgccgccaaacctggcggcagcgcaaaagatg

SEQ ID NO: 190105 - DNA, 103 bp, Artificial Sequence
  Synthetic Polynucleotide
taatacgactcactatagggggcctggggggcttcccggcagtggcggcaaacagaggagatgccgcatgtgccgggaaaacctggcggcagcgcaaaagatg

SEQ ID NO: 190106 - DNA, 103 bp, Artificial Sequence
  Synthetic Polynucleotide
taatacgactcactatagggtgggccgtcaggcctggggggcttcccggcaacagaggagagccgggatgccccccaggaacctggcggcagcgcaaaagatg

SEQ ID NO: 190107 - DNA, 103 bp, Artificial Sequence
  Synthetic Polynucleotide
taatacgactcactatagggccgggtcagctgggccgtcaggcctgggggaacagaggagacccccaatgctgacggccaacctggcggcagcgcaaaagatg

SEQ ID NO: 190108 - DNA, 103 bp, Artificial Sequence
  Synthetic Polynucleotide
taatacgactcactatagggccctgcttggccgggtcagctgggccgtcaaacagaggagatgacggatgagctgacccaacctggcggcagcgcaaaagatg

SEQ ID NO: 190109 - DNA, 103 bp, Artificial Sequence
  Synthetic Polynucleotide
taatacgactcactataggggcgcagtgggccctgcttggccgggtcagcaacagaggagagctgacatggccaagcagaacctggcggcagcgcaaaagatg

SEQ ID NO: 190110 - DNA, 103 bp, Artificial Sequence
  Synthetic Polynucleotide
taatacgactcactatagggccaggggctgctggggcggcggtggctgctaacagaggagaagcagcatgcgccgccccaacctggcggcagcgcaaaagatg

SEQ ID NO: 190111 - DNA, 103 bp, Artificial Sequence
  Synthetic Polynucleotide
taatacgactcactataggggggcactggtgcgcagtgggccctgcttggaacagaggagaccaagcatggcccactgcaacctggcggcagcgcaaaagatg

SEQ ID NO: 190112 - DNA, 103 bp, Artificial Sequence
  Synthetic Polynucleotide
taatacgactcactataggggacaggccccgggcactggtgcgcagtgggaacagaggagacccactatgcaccagtgcaacctggcggcagcgcaaaagatg

SEQ ID NO: 190113 - DNA, 103 bp, Artificial Sequence
  Synthetic Polynucleotide
taatacgactcactatagggcagcctccgggacaggccccgggcactggtaacagaggagaaccagtatgcggggcctgaacctggcggcagcgcaaaagatg

SEQ ID NO: 190114 - DNA, 103 bp, Artificial Sequence
  Synthetic Polynucleotide
taatacgactcactatagggagcagctctgcagcctccgggacaggccccaacagaggagaggggccatgcccggaggcaacctggcggcagcgcaaaagatg

SEQ ID NO: 190115 - DNA, 103 bp, Artificial Sequence
  Synthetic Polynucleotide
taatacgactcactatagggtcacagcagtagcagctctgcagcctccggaacagaggagaccggagatggcagagctgaacctggcggcagcgcaaaagatg

SEQ ID NO: 190116 - DNA, 103 bp, Artificial Sequence
  Synthetic Polynucleotide
taatacgactcactatagggctcccggccatcacagcagtagcagctctgaacagaggagacagagcatgtactgctgtaacctggcggcagcgcaaaagatg

SEQ ID NO: 190117 - DNA, 103 bp, Artificial Sequence
  Synthetic Polynucleotide
taatacgactcactatagggcgcccccatcctcccggccatcacagcagtaacagaggagaactgctatgatggccgggaacctggcggcagcgcaaaagatg

SEQ ID NO: 190118 - DNA, 103 bp, Artificial Sequence
  Synthetic Polynucleotide
taatacgactcactataggggctgcctcctcgcccccatcctcccggccaaacagaggagatggccgatgggatgggggaacctggcggcagcgcaaaagatg

SEQ ID NO: 190119 - DNA, 103 bp, Artificial Sequence
  Synthetic Polynucleotide
taatacgactcactataggggtcggctggggctgcctcctcgcccccatcaacagaggagagatgggatggaggaggcaaacctggcggcagcgcaaaagatg

SEQ ID NO: 190120 - DNA, 103 bp, Artificial Sequence
  Synthetic Polynucleotide
taatacgactcactatagggtgcgacccttgtcggctggggctgcctcctaacagaggagaaggaggatgccccagccgaacctggcggcagcgcaaaagatg

SEQ ID NO: 190121 - DNA, 103 bp, Artificial Sequence
  Synthetic Polynucleotide
taatacgactcactatagggttggggtatgccaggggctgctggggcggcaacagaggagagccgccatggcagcccctaacctggcggcagcgcaaaagatg

SEQ ID NO: 190122 - DNA, 103 bp, Artificial Sequence
  Synthetic Polynucleotide
taatacgactcactatagggcactcatgtttgcgacccttgtcggctgggaacagaggagacccagcatgcaagggtcgaacctggcggcagcgcaaaagatg

SEQ ID NO: 190123 - DNA, 103 bp, Artificial Sequence
  Synthetic Polynucleotide
taatacgactcactatagggctccttgctgcactcatgtttgcgacccttaacagaggagaaagggtatgaaacatgagaacctggcggcagcgcaaaagatg

SEQ ID NO: 190124 - DNA, 103 bp, Artificial Sequence
  Synthetic Polynucleotide
taatacgactcactatagggctgccggagcctccttgctgcactcatgttaacagaggagaaacatgatggcagcaaggaacctggcggcagcgcaaaagatg

SEQ ID NO: 190125 - DNA, 103 bp, Artificial Sequence
  Synthetic Polynucleotide
taatacgactcactatagggccgccgggctctgccggagcctccttgctgaacagaggagacagcaaatgggctccggcaacctggcggcagcgcaaaagatg

SEQ ID NO: 190126 - DNA, 103 bp, Artificial Sequence
  Synthetic Polynucleotide
taatacgactcactatagggctgggcctccccgccgggctctgccggagcaacagaggagagctccgatggagcccggcaacctggcggcagcgcaaaagatg

SEQ ID NO: 190127 - DNA, 103 bp, Artificial Sequence
  Synthetic Polynucleotide
taatacgactcactatagggcccagtgctcctgggcctccccgccgggctaacagaggagaagcccgatggggaggcccaacctggcggcagcgcaaaagatg

SEQ ID NO: 190128 - DNA, 103 bp, Artificial Sequence
  Synthetic Polynucleotide
taatacgactcactataggggcctcatgcacccagtgctcctgggcctccaacagaggagaggaggcatgggagcactgaacctggcggcagcgcaaaagatg

SEQ ID NO: 190129 - DNA, 103 bp, Artificial Sequence
  Synthetic Polynucleotide
taatacgactcactatagggcacggcacaggcctcatgcacccagtgctcaacagaggagagagcacatggtgcatgagaacctggcggcagcgcaaaagatg

SEQ ID NO: 190130 - DNA, 103 bp, Artificial Sequence
  Synthetic Polynucleotide
taatacgactcactatagggcgccggtccacacggcacaggcctcatgcaaacagaggagatgcatgatgcctgtgccgaacctggcggcagcgcaaaagatg

SEQ ID NO: 190131 - DNA, 103 bp, Artificial Sequence
  Synthetic Polynucleotide
taatacgactcactatagggaggtagacgccgccggtccacacggcacagaacagaggagactgtgcatggtggaccggaacctggcggcagcgcaaaagatg

SEQ ID NO: 190132 - DNA, 103 bp, Artificial Sequence
  Synthetic Polynucleotide
taatacgactcactatagggcctttggagcttggggtatgccaggggctgaacagaggagacagcccatggcataccccaacctggcggcagcgcaaaagatg

SEQ ID NO: 190133 - DNA, 103 bp, Artificial Sequence
  Synthetic Polynucleotide
taatacgactcactatagggcccggccaccaggtagacgccgccggtccaaacagaggagatggaccatgggcgtctacaacctggcggcagcgcaaaagatg

SEQ ID NO: 190134 - DNA, 103 bp, Artificial Sequence
  Synthetic Polynucleotide
taatacgactcactatagggcaaagagcttcccggccaccaggtagacgcaacagaggagagcgtctatgtggtggccgaacctggcggcagcgcaaaagatg

SEQ ID NO: 190135 - DNA, 103 bp, Artificial Sequence
  Synthetic Polynucleotide
taatacgactcactatagggtcctgcagcccaaagagcttcccggccaccaacagaggagaggtggcatggaagctcttaacctggcggcagcgcaaaagatg

SEQ ID NO: 190136 - DNA, 103 bp, Artificial Sequence
  Synthetic Polynucleotide
taatacgactcactatagggcttcatggcctcctgcagcccaaagagcttaacagaggagaaagctcatggggctgcagaacctggcggcagcgcaaaagatg

SEQ ID NO: 190137 - DNA, 103 bp, Artificial Sequence
  Synthetic Polynucleotide
taatacgactcactatagggccacggccaccttcatggcctcctgcagccaacagaggagaggctgcatgaggccatgaaacctggcggcagcgcaaaagatg

SEQ ID NO: 190138 - DNA, 103 bp, Artificial Sequence
  Synthetic Polynucleotide
taatacgactcactatagggcacatcatgtccacggccaccttcatggccaacagaggagaggccatatgggtggccgtaacctggcggcagcgcaaaagatg

SEQ ID NO: 190139 - DNA, 103 bp, Artificial Sequence
  Synthetic Polynucleotide
taatacgactcactataggggcagctggaacacatcatgtccacggccacaacagaggagagtggccatggacatgatgaacctggcggcagcgcaaaagatg

SEQ ID NO: 190140 - DNA, 103 bp, Artificial Sequence
  Synthetic Polynucleotide
taatacgactcactatagggcggcttcttggcagctggaacacatcatgtaacagaggagaacatgaatggttccagctaacctggcggcagcgcaaaagatg

SEQ ID NO: 190141 - DNA, 103 bp, Artificial Sequence
  Synthetic Polynucleotide
taatacgactcactatagggatggtggccccggcttcttggcagctggaaaacagaggagattccagatgccaagaagcaacctggcggcagcgcaaaagatg

SEQ ID NO: 190142 - DNA, 103 bp, Artificial Sequence
  Synthetic Polynucleotide
taatacgactcactataggggcagcacccaatggtggccccggcttcttgaacagaggagacaagaaatgggggccaccaacctggcggcagcgcaaaagatg

SEQ ID NO: 190143 - DNA, 103 bp, Artificial Sequence
  Synthetic Polynucleotide
taatacgactcactataggggcagcttctgcctttggagcttggggtatgaacagaggagacataccatgagctccaaaaacctggcggcagcgcaaaagatg

SEQ ID NO: 190144 - DNA, 103 bp, Artificial Sequence
  Synthetic Polynucleotide
taatacgactcactatagggatcctttgtggcagcacccaatggtggcccaacagaggagagggccaatgttgggtgctaacctggcggcagcgcaaaagatg

SEQ ID NO: 190145 - DNA, 103 bp, Artificial Sequence
  Synthetic Polynucleotide
taatacgactcactataggggtgtggaggcatcctttgtggcagcacccaaacagaggagatgggtgatgccacaaaggaacctggcggcagcgcaaaagatg

SEQ ID NO: 190146 - DNA, 103 bp, Artificial Sequence
  Synthetic Polynucleotide
taatacgactcactataggggtagtggtaggtgtggaggcatcctttgtgaacagaggagacacaaaatgtgcctccacaacctggcggcagcgcaaaagatg

SEQ ID NO: 190147 - DNA, 103 bp, Artificial Sequence
  Synthetic Polynucleotide
taatacgactcactatagggtggcacacgggtagtggtaggtgtggaggcaacagaggagagcctccatgcctaccactaacctggcggcagcgcaaaagatg

SEQ ID NO: 190148 - DNA, 103 bp, Artificial Sequence
  Synthetic Polynucleotide
taatacgactcactatagggcctgcatcgctggcacacgggtagtggtagaacagaggagactaccaatgcccgtgtgcaacctggcggcagcgcaaaagatg

SEQ ID NO: 190149 - DNA, 103 bp, Artificial Sequence
  Synthetic Polynucleotide
taatacgactcactataggggaatatgcaacctgcatcgctggcacacggaacagaggagaccgtgtatgagcgatgcaaacctggcggcagcgcaaaagatg

SEQ ID NO: 190150 - DNA, 103 bp, Artificial Sequence
  Synthetic Polynucleotide
taatacgactcactatagggtctcttcgatgaatatgcaacctgcatcgcaacagaggagagcgatgatggttgcatataacctggcggcagcgcaaaagatg

SEQ ID NO: 190151 - DNA, 103 bp, Artificial Sequence
  Synthetic Polynucleotide
taatacgactcactatagggaaagaaaagttctcttcgatgaatatgcaaaacagaggagattgcatatgcatcgaagaaacctggcggcagcgcaaaagatg

SEQ ID NO: 190152 - DNA, 103 bp, Artificial Sequence
  Synthetic Polynucleotide
taatacgactcactataggggggacatttcaaagaaaagttctcttcgataacagaggagaatcgaaatgaacttttctaacctggcggcagcgcaaaagatg

SEQ ID NO: 190153 - DNA, 103 bp, Artificial Sequence
  Synthetic Polynucleotide
taatacgactcactatagggtcttatgtttgggacatttcaaagaaaagtaacagaggagaacttttatgtgaaatgtcaacctggcggcagcgcaaaagatg

SEQ ID NO: 190154 - DNA, 103 bp, Artificial Sequence
  Synthetic Polynucleotide
taatacgactcactatagggatgtcgttctgcagcttctgcctttggagcaacagaggagagctccaatggcagaagctaacctggcggcagcgcaaaagatg

SEQ ID NO: 190155 - DNA, 103 bp, Artificial Sequence
  Synthetic Polynucleotide
taatacgactcactatagggtacggcagcctcttatgtttgggacatttcaacagaggagagaaatgatgcaaacataaaacctggcggcagcgcaaaagatg

SEQ ID NO: 190156 - DNA, 103 bp, Artificial Sequence
  Synthetic Polynucleotide
taatacgactcactatagggaggggaggcaatgtcgttctgcagcttctgaacagaggagacagaagatgcagaacgacaacctggcggcagcgcaaaagatg

SEQ ID NO: 190157 - DNA, 103 bp, Artificial Sequence
  Synthetic Polynucleotide
taatacgactcactatagggggaagggcagaggggaggcaatgtcgttctaacagaggagaagaacgatgttgcctcccaacctggcggcagcgcaaaagatg

SEQ ID NO: 190158 - DNA, 103 bp, Artificial Sequence
  Synthetic Polynucleotide
taatacgactcactatagggaggcgtgatgtttcctgcgaggtctgctggaacagaggagaccagcaatgctcgcaggaaacctggcggcagcgcaaaagatg

SEQ ID NO: 190159 - DNA, 103 bp, Artificial Sequence
  Synthetic Polynucleotide
taatacgactcactataggggtaccctgggggaagggcagaggggaggcaaacagaggagatgcctcatgtctgcccttaacctggcggcagcgcaaaagatg

SEQ ID NO: 190160 - DNA, 103 bp, Artificial Sequence
  Synthetic Polynucleotide
taatacgactcactatagggaggaaagtgggtaccctgggggaagggcagaacagaggagactgcccatgccccagggtaacctggcggcagcgcaaaagatg

SEQ ID NO: 190161 - DNA, 103 bp, Artificial Sequence
  Synthetic Polynucleotide
taatacgactcactataggggggaatgctgaggaaagtgggtaccctgggaacagaggagacccaggatgcccactttcaacctggcggcagcgcaaaagatg

SEQ ID NO: 190162 - DNA, 103 bp, Artificial Sequence
  Synthetic Polynucleotide
taatacgactcactataggggggaaggactgggaatgctgaggaaagtggaacagaggagaccacttatgtcagcattcaacctggcggcagcgcaaaagatg

SEQ ID NO: 190163 - DNA, 103 bp, Artificial Sequence
  Synthetic Polynucleotide
taatacgactcactatagggggaggaggtggggaaggactgggaatgctgaacagaggagacagcatatgcagtccttcaacctggcggcagcgcaaaagatg

SEQ ID NO: 190164 - DNA, 103 bp, Artificial Sequence
  Synthetic Polynucleotide
taatacgactcactatagggaggagtaggtggaggaggtggggaaggactaacagaggagaagtcctatgccacctcctaacctggcggcagcgcaaaagatg

SEQ ID NO: 190165 - DNA, 103 bp, Artificial Sequence
  Synthetic Polynucleotide
taatacgactcactatagggtggacagaggaggagtaggtggaggaggtgaacagaggagacacctcatgcacctactcaacctggcggcagcgcaaaagatg

SEQ ID NO: 190166 - DNA, 103 bp, Artificial Sequence
  Synthetic Polynucleotide
taatacgactcactatagggcccaccaccctggacagaggaggagtaggtaacagaggagaacctacatgtcctctgtcaacctggcggcagcgcaaaagatg

SEQ ID NO: 190167 - DNA, 103 bp, Artificial Sequence
  Synthetic Polynucleotide
taatacgactcactataggggggccccctgcccaccaccctggacagaggaacagaggagacctctgatgagggtggtgaacctggcggcagcgcaaaagatg

SEQ ID NO: 190168 - DNA, 103 bp, Artificial Sequence
  Synthetic Polynucleotide
taatacgactcactatagggttataggagtgggccccctgcccaccacccaacagaggagagggtggatggcagggggcaacctggcggcagcgcaaaagatg

SEQ ID NO: 190169 - DNA, 103 bp, Artificial Sequence
  Synthetic Polynucleotide
taatacgactcactataggggtaattctctaggcgtgatgtttcctgcgaaacagaggagatcgcagatgacatcacgcaacctggcggcagcgcaaaagatg

SEQ ID NO: 190170 - DNA, 103 bp, Artificial Sequence
  Synthetic Polynucleotide
taatacgactcactatagggtgtgcaactcttataggagtgggccccctgaacagaggagacaggggatgcactcctataacctggcggcagcgcaaaagatg

SEQ ID NO: 190171 - DNA, 103 bp, Artificial Sequence
  Synthetic Polynucleotide
taatacgactcactatagggcagtcggtgctgtgcaactcttataggagtaacagaggagaactcctatgagagttgcaaacctggcggcagcgcaaaagatg

SEQ ID NO: 190172 - DNA, 103 bp, Artificial Sequence
  Synthetic Polynucleotide
taatacgactcactatagggtggggctgggcagtcggtgctgtgcaactcaacagaggagagagttgatgagcaccgacaacctggcggcagcgcaaaagatg

SEQ ID NO: 190173 - DNA, 103 bp, Artificial Sequence
  Synthetic Polynucleotide
taatacgactcactatagggcggcctgtcatggggctgggcagtcggtgcaacagaggagagcaccgatggcccagcccaacctggcggcagcgcaaaagatg

SEQ ID NO: 190174 - DNA, 103 bp, Artificial Sequence
  Synthetic Polynucleotide
taatacgactcactatagggtggcagtcagcggcctgtcatggggctgggaacagaggagacccagcatgatgacaggcaacctggcggcagcgcaaaagatg

SEQ ID NO: 190175 - DNA, 103 bp, Artificial Sequence
  Synthetic Polynucleotide
taatacgactcactatagggaggctggagctggcagtcagcggcctgtcaaacagaggagatgacagatggctgactgcaacctggcggcagcgcaaaagatg

SEQ ID NO: 190176 - DNA, 103 bp, Artificial Sequence
  Synthetic Polynucleotide
taatacgactcactatagggccccggggccaggctggagctggcagtcagaacagaggagactgactatgagctccagcaacctggcggcagcgcaaaagatg

SEQ ID NO: 190177 - DNA, 103 bp, Artificial Sequence
  Synthetic Polynucleotide
taatacgactcactatagggggacccgctgccccggggccaggctggagcaacagaggagagctccaatgtggccccggaacctggcggcagcgcaaaagatg

SEQ ID NO: 190178 - DNA, 103 bp, Artificial Sequence
  Synthetic Polynucleotide
taatacgactcactatagggtgaagattctggacccgctgccccggggccaacagaggagaggccccatggcagcgggtaacctggcggcagcgcaaaagatg

SEQ ID NO: 190179 - DNA, 103 bp, Artificial Sequence
  Synthetic Polynucleotide
taatacgactcactatagggctggtaggcatgaagattctggacccgctgaacagaggagacagcggatgcagaatcttaacctggcggcagcgcaaaagatg

SEQ ID NO: 190180 - DNA, 103 bp, Artificial Sequence
  Synthetic Polynucleotide
taatacgactcactatagggtcggctgcctgtaattctctaggcgtgatgaacagaggagacatcacatgtagagaattaacctggcggcagcgcaaaagatg

SEQ ID NO: 190181 - DNA, 103 bp, Artificial Sequence
  Synthetic Polynucleotide
taatacgactcactatagggggcggcccgactggtaggcatgaagattctaacagaggagaagaatcatgatgcctaccaacctggcggcagcgcaaaagatg

SEQ ID NO: 190182 - DNA, 103 bp, Artificial Sequence
  Synthetic Polynucleotide
taatacgactcactatagggtcatagctgaggcggcccgactggtaggcaaacagaggagatgcctaatggtcgggccgaacctggcggcagcgcaaaagatg

SEQ ID NO: 190183 - DNA, 103 bp, Artificial Sequence
  Synthetic Polynucleotide
taatacgactcactatagggctgctgctggtcatagctgaggcggcccgaaacagaggagatcgggcatgctcagctataacctggcggcagcgcaaaagatg

SEQ ID NO: 190184 - DNA, 103 bp, Artificial Sequence
  Synthetic Polynucleotide
taatacgactcactataggggctgctgctgctgctgctggtcatagctgaaacagaggagatcagctatgaccagcagcaacctggcggcagcgcaaaagatg

SEQ ID NO: 190185 - DNA, 103 bp, Artificial Sequence; identical to SEQ ID NO: 96359
  Synthetic Polynucleotide

SEQ ID NO: 190186 - DNA, 103 bp, Artificial Sequence; identical to SEQ ID NO: 88564
  Synthetic Polynucleotide

SEQ ID NO: 190187 - DNA, 103 bp, Artificial Sequence
  Synthetic Polynucleotide
taatacgactcactataggggaagggcttgctgctgctgctgctgctgctaacagaggagaagcagcatgagcagcagcaacctggcggcagcgcaaaagatg

SEQ ID NO: 190188 - DNA, 103 bp, Artificial Sequence
  Synthetic Polynucleotide
taatacgactcactatagggtgccggctctgaagggcttgctgctgctgcaacagaggagagcagcaatggcaagccctaacctggcggcagcgcaaaagatg

SEQ ID NO: 190189 - DNA, 103 bp, Artificial Sequence
  Synthetic Polynucleotide
taatacgactcactatagggctgggcatggtgccggctctgaagggcttgaacagaggagacaagccatgcagagccggaacctggcggcagcgcaaaagatg

SEQ ID NO: 190190 - DNA, 103 bp, Artificial Sequence
  Synthetic Polynucleotide
taatacgactcactatagggggagggtttcctgggcatggtgccggctctaacagaggagaagagccatgaccatgcccaacctggcggcagcgcaaaagatg

SEQ ID NO: 190191 - DNA, 103 bp, Artificial Sequence
  Synthetic Polynucleotide
taatacgactcactatagggccggcctgactcggctgcctgtaattctctaacagaggagaagagaaatgcaggcagccaacctggcggcagcgcaaaagatg

SEQ ID NO: 190192 - DNA, 103 bp, Artificial Sequence
  Synthetic Polynucleotide
taatacgactcactatagggttttggtaatggagggtttcctgggcatggaacagaggagaccatgcatgggaaaccctaacctggcggcagcgcaaaagatg

SEQ ID NO: 190193 - DNA, 103 bp, Artificial Sequence
  Synthetic Polynucleotide
taatacgactcactatagggcttggcgaggttttggtaatggagggtttcaacagaggagagaaaccatgcattaccaaaacctggcggcagcgcaaaagatg

SEQ ID NO: 190194 - DNA, 103 bp, Artificial Sequence
  Synthetic Polynucleotide
taatacgactcactatagggagtgctgatacttggcgaggttttggtaataacagaggagaattaccatgacctcgccaaacctggcggcagcgcaaaagatg

SEQ ID NO: 190195 - DNA, 103 bp, Artificial Sequence
  Synthetic Polynucleotide
taatacgactcactatagggtgctgcccgtagtgctgatacttggcgaggaacagaggagacctcgcatggtatcagcaaacctggcggcagcgcaaaagatg

SEQ ID NO: 190196 - DNA, 103 bp, Artificial Sequence
  Synthetic Polynucleotide
taatacgactcactataggggccctggccttgctgcccgtagtgctgataaacagaggagatatcagatgtacgggcagaacctggcggcagcgcaaaagatg

SEQ ID NO: 190197 - DNA, 103 bp, Artificial Sequence
  Synthetic Polynucleotide
taatacgactcactataggggctggcagtagccctggccttgctgcccgtaacagaggagaacgggcatgaaggccaggaacctggcggcagcgcaaaagatg

SEQ ID NO: 190198 - DNA, 103 bp, Artificial Sequence
  Synthetic Polynucleotide
taatacgactcactataggggctgcgtccggctggcagtagccctggcctaacagaggagaaggccaatgctactgccaaacctggcggcagcgcaaaagatg

SEQ ID NO: 190199 - DNA, 103 bp, Artificial Sequence
  Synthetic Polynucleotide
taatacgactcactatagggggtccggacggctgcgtccggctggcagtaaacagaggagatactgcatgccggacgcaaacctggcggcagcgcaaaagatg

SEQ ID NO: 190200 - DNA, 103 bp, Artificial Sequence
  Synthetic Polynucleotide
taatacgactcactatagggactgctctggggtccggacggctgcgtccgaacagaggagacggacgatgccgtccggaaacctggcggcagcgcaaaagatg

SEQ ID NO: 190201 - DNA, 103 bp, Artificial Sequence
  Synthetic Polynucleotide
taatacgactcactataggggtctggtagtactgctctggggtccggacgaacagaggagacgtccgatgcccagagcaaacctggcggcagcgcaaaagatg

SEQ ID NO: 190202 - DNA, 103 bp, Artificial Sequence
  Synthetic Polynucleotide
taatacgactcactatagggtgtcgggcaggagctgctgttgctggccataacagaggagaatggccatgaacagcagcaacctggcggcagcgcaaaagatg

SEQ ID NO: 190203 - DNA, 103 bp, Artificial Sequence
  Synthetic Polynucleotide
taatacgactcactatagggagcgcctggcggggagagtccacccagcataacagaggagaatgctgatgggactctccaacctggcggcagcgcaaaagatg

SEQ ID NO: 190204 - DNA, 103 bp, Artificial Sequence
  Synthetic Polynucleotide
taatacgactcactatagggctggcggtctccgcagatgaggcagatggcaacagaggagagccatcatgctcatctgcaacctggcggcagcgcaaaagatg

SEQ ID NO: 190205 - DNA, 103 bp, Artificial Sequence
  Synthetic Polynucleotide
taatacgactcactataggggctccaggtcctggcggtctccgcagatgaaacagaggagatcatctatggagaccgccaacctggcggcagcgcaaaagatg

SEQ ID NO: 190206 - DNA, 103 bp, Artificial Sequence
  Synthetic Polynucleotide
taatacgactcactatagggcggtccggctgctccaggtcctggcggtctaacagaggagaagaccgatgggacctggaaacctggcggcagcgcaaaagatg

SEQ ID NO: 190207 - DNA, 103 bp, Artificial Sequence
  Synthetic Polynucleotide
taatacgactcactatagggcatgtccacccggtccggctgctccaggtcaacagaggagagacctgatgcagccggacaacctggcggcagcgcaaaagatg

SEQ ID NO: 190208 - DNA, 103 bp, Artificial Sequence
  Synthetic Polynucleotide
taatacgactcactataggggctcctgcagcatgtccacccggtccggctaacagaggagaagccggatggggtggacaaacctggcggcagcgcaaaagatg

SEQ ID NO: 190209 - DNA, 103 bp, Artificial Sequence
  Synthetic Polynucleotide
taatacgactcactatagggtccagcagcggctcctgcagcatgtccaccaacagaggagaggtggaatggctgcaggaaacctggcggcagcgcaaaagatg

SEQ ID NO: 190210 - DNA, 103 bp, Artificial Sequence
  Synthetic Polynucleotide
taatacgactcactatagggctttagcgcctccagcagcggctcctgcagaacagaggagactgcagatgccgctgctgaacctggcggcagcgcaaaagatg

SEQ ID NO: 190211 - DNA, 103 bp, Artificial Sequence
  Synthetic Polynucleotide
taatacgactcactataggggcacgtagacctttagcgcctccagcagcgaacagaggagacgctgcatgaggcgctaaaacctggcggcagcgcaaaagatg

SEQ ID NO: 190212 - DNA, 103 bp, Artificial Sequence
  Synthetic Polynucleotide
taatacgactcactatagggctccgcttccgcacgtagacctttagcgccaacagaggagaggcgctatgggtctacgtaacctggcggcagcgcaaaagatg

SEQ ID NO: 190213 - DNA, 103 bp, Artificial Sequence
  Synthetic Polynucleotide
taatacgactcactataggggcggctgggcctccgcttccgcacgtagacaacagaggagagtctacatgcggaagcggaacctggcggcagcgcaaaagatg

SEQ ID NO: 190214 - DNA, 103 bp, Artificial Sequence
  Synthetic Polynucleotide
taatacgactcactataggggagtggtcagagcgcctggcggggagagtcaacagaggagagactctatgcgccaggcgaacctggcggcagcgcaaaagatg

SEQ ID NO: 190215 - DNA, 103 bp, Artificial Sequence
  Synthetic Polynucleotide
taatacgactcactatagggacatgtgggggcggctgggcctccgcttccaacagaggagaggaagcatgggcccagccaacctggcggcagcgcaaaagatg

SEQ ID NO: 190216 - DNA, 103 bp, Artificial Sequence
  Synthetic Polynucleotide
taatacgactcactatagggatcttggggaacatgtgggggcggctgggcaacagaggagagcccagatgcccccacataacctggcggcagcgcaaaagatg

SEQ ID NO: 190217 - DNA, 103 bp, Artificial Sequence
  Synthetic Polynucleotide
taatacgactcactatagggcttcattagcatcttggggaacatgtggggaacagaggagaccccacatgttccccaagaacctggcggcagcgcaaaagatg

SEQ ID NO: 190218 - DNA, 103 bp, Artificial Sequence
  Synthetic Polynucleotide
taatacgactcactatagggggtcagtaatcttcattagcatcttggggaaacagaggagatccccaatgtgctaatgaaacctggcggcagcgcaaaagatg

SEQ ID NO: 190219 - DNA, 103 bp, Artificial Sequence
  Synthetic Polynucleotide
taatacgactcactatagggatgcttcgcaggtcagtaatcttcattagcaacagaggagagctaatatggattactgaaacctggcggcagcgcaaaagatg

SEQ ID NO: 190220 - DNA, 103 bp, Artificial Sequence
  Synthetic Polynucleotide
taatacgactcactatagggcttggcgctgatgcttcgcaggtcagtaataacagaggagaattactatgctgcgaagcaacctggcggcagcgcaaaagatg

SEQ ID NO: 190221 - DNA, 103 bp, Artificial Sequence
  Synthetic Polynucleotide
taatacgactcactataggggctcagcccccttggcgctgatgcttcgcaaacagaggagatgcgaaatgtcagcgccaaacctggcggcagcgcaaaagatg

SEQ ID NO: 190222 - DNA, 103 bp, Artificial Sequence
  Synthetic Polynucleotide
taatacgactcactataggggtgatcacccgctcagcccccttggcgctgaacagaggagacagcgcatggggggctgaaacctggcggcagcgcaaaagatg

SEQ ID NO: 190223 - DNA, 103 bp, Artificial Sequence
  Synthetic Polynucleotide
taatacgactcactatagggcatcttcagcgtgatcacccgctcagccccaacagaggagaggggctatgcgggtgatcaacctggcggcagcgcaaaagatg

SEQ ID NO: 190224 - DNA, 103 bp, Artificial Sequence
  Synthetic Polynucleotide
taatacgactcactatagggccgggatctccatcttcagcgtgatcacccaacagaggagagggtgaatgcgctgaagaaacctggcggcagcgcaaaagatg

SEQ ID NO: 190225 - DNA, 103 bp, Artificial Sequence
  Synthetic Polynucleotide
taatacgactcactatagggtggtgctggagagtggtcagagcgcctggcaacagaggagagccaggatgtctgaccacaacctggcggcagcgcaaaagatg

SEQ ID NO: 190226 - DNA, 103 bp, Artificial Sequence
  Synthetic Polynucleotide
taatacgactcactatagggggcatggagcccgggatctccatcttcagcaacagaggagagctgaaatgggagatcccaacctggcggcagcgcaaaagatg

SEQ ID NO: 190227 - DNA, 103 bp, Artificial Sequence
  Synthetic Polynucleotide
taatacgactcactataggggatgagaggcggcatggagcccgggatctcaacagaggagagagatcatgggctccatgaacctggcggcagcgcaaaagatg

SEQ ID NO: 190228 - DNA, 103 bp, Artificial Sequence
  Synthetic Polynucleotide
taatacgactcactatagggacatttcctggatgagaggcggcatggagcaacagaggagagctccaatgcgcctctcaaacctggcggcagcgcaaaagatg

SEQ ID NO: 190229 - DNA, 103 bp, Artificial Sequence
  Synthetic Polynucleotide
taatacgactcactataggggagttctccaacatttcctggatgagaggcaacagaggagagcctctatgccaggaaataacctggcggcagcgcaaaagatg

SEQ ID NO: 190230 - DNA, 103 bp, Artificial Sequence
  Synthetic Polynucleotide
taatacgactcactatagggcaggccctctgagttctccaacatttcctgaacagaggagacaggaaatgttggagaacaacctggcggcagcgcaaaagatg

SEQ ID NO: 190231 - DNA, 103 bp, Artificial Sequence
  Synthetic Polynucleotide
taatacgactcactatagggtcagagtgtccaggccctctgagttctccaaacagaggagatggagaatgcagagggccaacctggcggcagcgcaaaagatg

SEQ ID NO: 190232 - DNA, 103 bp, Artificial Sequence
  Synthetic Polynucleotide
taatacgactcactatagggggctgtccgctcagagtgtccaggccctctaacagaggagaagagggatgggacactctaacctggcggcagcgcaaaagatg

SEQ ID NO: 190233 - DNA, 103 bp, Artificial Sequence
  Synthetic Polynucleotide
taatacgactcactatagggcccaccccccggctgtccgctcagagtgtcaacagaggagagacactatgagcggacagaacctggcggcagcgcaaaagatg

SEQ ID NO: 190234 - DNA, 103 bp, Artificial Sequence
  Synthetic Polynucleotide
taatacgactcactatagggcgtcccgccccccaccccccggctgtccgcaacagaggagagcggacatgcggggggtgaacctggcggcagcgcaaaagatg

SEQ ID NO: 190235 - DNA, 103 bp, Artificial Sequence
  Synthetic Polynucleotide
taatacgactcactatagggaggccacccccgtcccgccccccaccccccaacagaggagaggggggatgggggcgggaaacctggcggcagcgcaaaagatg

SEQ ID NO: 190236 - DNA, 103 bp, Artificial Sequence
  Synthetic Polynucleotide
taatacgactcactatagggaactggaagctggtgctggagagtggtcagaacagaggagactgaccatgctccagcacaacctggcggcagcgcaaaagatg

SEQ ID NO: 190237 - DNA, 103 bp, Artificial Sequence
  Synthetic Polynucleotide
taatacgactcactatagggcgggggggccaggccacccccgtcccgcccaacagaggagagggcggatggggggtggcaacctggcggcagcgcaaaagatg

SEQ ID NO: 190238 - DNA, 103 bp, Artificial Sequence
  Synthetic Polynucleotide
taatacgactcactatagggagctgcctggcgggggggccaggccaccccaacagaggagaggggtgatgtggccccccaacctggcggcagcgcaaaagatg

SEQ ID NO: 190239 - DNA, 103 bp, Artificial Sequence
  Synthetic Polynucleotide
taatacgactcactatagggctggggctacagctgcctggcgggggggccaacagaggagaggccccatggccaggcagaacctggcggcagcgcaaaagatg

SEQ ID NO: 190240 - DNA, 103 bp, Artificial Sequence
  Synthetic Polynucleotide
taatacgactcactatagggggggctgaggctggggctacagctgcctggaacagaggagaccaggcatgtgtagccccaacctggcggcagcgcaaaagatg

SEQ ID NO: 190241 - DNA, 103 bp, Artificial Sequence
  Synthetic Polynucleotide
taatacgactcactatagggtgttggagctggggctgaggctggggctacaacagaggagagtagccatggcctcagccaacctggcggcagcgcaaaagatg

SEQ ID NO: 190242 - DNA, 103 bp, Artificial Sequence
  Synthetic Polynucleotide
taatacgactcactataggggggctgcttctgttggagctggggctgaggaacagaggagacctcagatgcagctccaaaacctggcggcagcgcaaaagatg

SEQ ID NO: 190243 - DNA, 103 bp, Artificial Sequence
  Synthetic Polynucleotide
taatacgactcactataggggtgggtggccgggctgcttctgttggagctaacagaggagaagctccatgagaagcagcaacctggcggcagcgcaaaagatg

SEQ ID NO: 190244 - DNA, 103 bp, Artificial Sequence
  Synthetic Polynucleotide
taatacgactcactatagggtatatccactaactggaagctggtgctggaaacagaggagatccagcatgagcttccagaacctggcggcagcgcaaaagatg

SEQ ID NO: 190245 - DNA, 103 bp, Artificial Sequence
  Synthetic Polynucleotide
taatacgactcactataggggatggtgtgctatatccactaactggaagcaacagaggagagcttccatgtagtggataaacctggcggcagcgcaaaagatg

SEQ ID NO: 190246 - DNA, 103 bp, Artificial Sequence
  Synthetic Polynucleotide
taatacgactcactatagggggtggctggggatggtgtgctatatccactaacagaggagaagtggaatgagcacaccaaacctggcggcagcgcaaaagatg

SEQ ID NO: 190247 - DNA, 103 bp, Artificial Sequence
  Synthetic Polynucleotide
taatacgactcactataggggggtctcaatggtggctggggatggtgtgcaacagaggagagcacacatgccccagccaaacctggcggcagcgcaaaagatg

SEQ ID NO: 190248 - DNA, 103 bp, Artificial Sequence
  Synthetic Polynucleotide
taatacgactcactatagggctgctgctctgggtctcaatggtggctgggaacagaggagacccagcatgcattgagacaacctggcggcagcgcaaaagatg

SEQ ID NO: 190249 - DNA, 103 bp, Artificial Sequence
  Synthetic Polynucleotide
taatacgactcactatagggctcttcagaactgctgctctgggtctcaataacagaggagaattgagatgcagagcagcaacctggcggcagcgcaaaagatg

SEQ ID NO: 190250 - DNA, 103 bp, Artificial Sequence
  Synthetic Polynucleotide
taatacgactcactatagggcgcccccaggtgtcgggcaggagctgctgtaacagaggagaacagcaatgcctgcccgaaacctggcggcagcgcaaaagatg

SEQ ID NO: 190251 - DNA, 103 bp, Artificial Sequence
  Synthetic Polynucleotide
taatacgactcactatagggtgggcactatctcttcagaactgctgctctaacagaggagaagagcaatggttctgaagaacctggcggcagcgcaaaagatg

SEQ ID NO: 190252 - DNA, 103 bp, Artificial Sequence
  Synthetic Polynucleotide
taatacgactcactataggggagggagggctgggcactatctcttcagaaaacagaggagattctgaatggatagtgccaacctggcggcagcgcaaaagatg

SEQ ID NO: 190253 - DNA, 103 bp, Artificial Sequence
  Synthetic Polynucleotide
taatacgactcactatagggagggggtggcgagggagggctgggcactataacagaggagaatagtgatgagccctcccaacctggcggcagcgcaaaagatg

SEQ ID NO: 190254 - DNA, 103 bp, Artificial Sequence
  Synthetic Polynucleotide
taatacgactcactatagggtgcggggtagagggggtggcgagggagggcaacagaggagagccctcatgcgccaccccaacctggcggcagcgcaaaagatg

SEQ ID NO: 190255 - DNA, 103 bp, Artificial Sequence
  Synthetic Polynucleotide
taatacgactcactatagggggcttgtagatgcggggtagagggggtggcaacagaggagagccaccatgtctaccccgaacctggcggcagcgcaaaagatg

SEQ ID NO: 190256 - DNA, 103 bp, Artificial Sequence
  Synthetic Polynucleotide
taatacgactcactataggggacaaagcaaggcttgtagatgcggggtagaacagaggagactacccatgatctacaagaacctggcggcagcgcaaaagatg

SEQ ID NO: 190257 - DNA, 103 bp, Artificial Sequence
  Synthetic Polynucleotide
taatacgactcactatagggtgtcctgacagacaaagcaaggcttgtagaaacagaggagatctacaatgcttgctttgaacctggcggcagcgcaaaagatg

SEQ ID NO: 190258 - DNA, 103 bp, Artificial Sequence
  Synthetic Polynucleotide
taatacgactcactatagggcctgaggacttgtcctgacagacaaagcaaaacagaggagattgcttatgctgtcaggaaacctggcggcagcgcaaaagatg

SEQ ID NO: 190259 - DNA, 103 bp, Artificial Sequence
  Synthetic Polynucleotide
taatacgactcactatagggatagtggtagcctgaggacttgtcctgacaaacagaggagatgtcagatgaagtcctcaaacctggcggcagcgcaaaagatg

SEQ ID NO: 190260 - DNA, 103 bp, Artificial Sequence
  Synthetic Polynucleotide
taatacgactcactatagggcgctgaccccatagtggtagcctgaggactaacagaggagaagtcctatggctaccactaacctggcggcagcgcaaaagatg

SEQ ID NO: 190261 - DNA, 103 bp, Artificial Sequence
  Synthetic Polynucleotide
taatacgactcactatagggttgaggtgcccgcccccaggtgtcgggcagaacagaggagactgcccatgacctgggggaacctggcggcagcgcaaaagatg

SEQ ID NO: 190262 - DNA, 103 bp, Artificial Sequence
  Synthetic Polynucleotide
taatacgactcactatagggccctcacaggcgctgaccccatagtggtagaacagaggagactaccaatgtggggtcagaacctggcggcagcgcaaaagatg

SEQ ID NO: 190263 - DNA, 103 bp, Artificial Sequence
  Synthetic Polynucleotide
taatacgactcactataggggcccttgcagccctcacaggcgctgaccccaacagaggagaggggtcatggcctgtgagaacctggcggcagcgcaaaagatg

SEQ ID NO: 190264 - DNA, 103 bp, Artificial Sequence
  Synthetic Polynucleotide
taatacgactcactatagggggcggaagaagcccttgcagccctcacaggaacagaggagacctgtgatggctgcaaggaacctggcggcagcgcaaaagatg

SEQ ID NO: 190265 - DNA, 103 bp, Artificial Sequence
  Synthetic Polynucleotide
taatacgactcactatagggtggatgctgcggcggaagaagcccttgcagaacagaggagactgcaaatgcttcttccgaacctggcggcagcgcaaaagatg

SEQ ID NO: 190266 - DNA, 103 bp, Artificial Sequence
  Synthetic Polynucleotide
taatacgactcactatagggcatgttcttctggatgctgcggcggaagaaaacagaggagattcttcatgcgcagcatcaacctggcggcagcgcaaaagatg

SEQ ID NO: 190267 - DNA, 103 bp, Artificial Sequence
  Synthetic Polynucleotide
taatacgactcactatagggacgtgtacaccatgttcttctggatgctgcaacagaggagagcagcaatgagaagaacaaacctggcggcagcgcaaaagatg

SEQ ID NO: 190268 - DNA, 103 bp, Artificial Sequence
  Synthetic Polynucleotide
taatacgactcactatagggtcccggtgacacgtgtacaccatgttcttcaacagaggagagaagaaatgggtgtacacaacctggcggcagcgcaaaagatg

SEQ ID NO: 190269 - DNA, 103 bp, Artificial Sequence
  Synthetic Polynucleotide
taatacgactcactataggggcagttcttgtcccggtgacacgtgtacacaacagaggagagtgtacatgtgtcaccggaacctggcggcagcgcaaaagatg

SEQ ID NO: 190270 - DNA, 103 bp, Artificial Sequence
  Synthetic Polynucleotide
taatacgactcactatagggtgttgatgatgcagttcttgtcccggtgacaacagaggagagtcaccatgacaagaactaacctggcggcagcgcaaaagatg

SEQ ID NO: 190271 - DNA, 103 bp, Artificial Sequence
  Synthetic Polynucleotide
taatacgactcactatagggcgggtcaccttgttgatgatgcagttcttgaacagaggagacaagaaatgcatcatcaaaacctggcggcagcgcaaaagatg

SEQ ID NO: 190272 - DNA, 103 bp, Artificial Sequence
  Synthetic Polynucleotide
taatacgactcactatagggcgggtacccattgaggtgcccgcccccaggaacagaggagacctgggatggggcacctcaacctggcggcagcgcaaaagatg

SEQ ID NO: 190273 - DNA, 103 bp, Artificial Sequence
  Synthetic Polynucleotide
taatacgactcactataggggcagcggttccgggtcaccttgttgatgataacagaggagaatcatcatgaaggtgaccaacctggcggcagcgcaaaagatg

SEQ ID NO: 190274 - DNA, 103 bp, Artificial Sequence
  Synthetic Polynucleotide
taatacgactcactatagggggcagtactggcagcggttccgggtcacctaacagaggagaaggtgaatgggaaccgctaacctggcggcagcgcaaaagatg

SEQ ID NO: 190275 - DNA, 103 bp, Artificial Sequence
  Synthetic Polynucleotide
taatacgactcactatagggttctgcagtcggcagtactggcagcggttcaacagaggagagaaccgatgccagtactgaacctggcggcagcgcaaaagatg

SEQ ID NO: 190276 - DNA, 103 bp, Artificial Sequence
  Synthetic Polynucleotide
taatacgactcactatagggttcaaagcacttctgcagtcggcagtactgaacagaggagacagtacatgcgactgcagaacctggcggcagcgcaaaagatg

SEQ ID NO: 190277 - DNA, 103 bp, Artificial Sequence
  Synthetic Polynucleotide
taatacgactcactatagggacatgcccacttcaaagcacttctgcagtcaacagaggagagactgcatgagtgctttgaacctggcggcagcgcaaaagatg

SEQ ID NO: 190278 - DNA, 103 bp, Artificial Sequence
  Synthetic Polynucleotide
taatacgactcactataggggactccttggacatgcccacttcaaagcacaacagaggagagtgcttatgagtgggcataacctggcggcagcgcaaaagatg

SEQ ID NO: 190279 - DNA, 103 bp, Artificial Sequence
  Synthetic Polynucleotide
taatacgactcactataggggtttctcacagactccttggacatgcccacaacagaggagagtgggcatgtccaaggagaacctggcggcagcgcaaaagatg

SEQ ID NO: 190280 - DNA, 103 bp, Artificial Sequence
  Synthetic Polynucleotide
taatacgactcactatagggtgtttcggtcgtttctcacagactccttggaacagaggagaccaaggatgctgtgagaaaacctggcggcagcgcaaaagatg

SEQ ID NO: 190281 - DNA, 103 bp, Artificial Sequence
  Synthetic Polynucleotide
taatacgactcactatagggttcttcttcttgtttcggtcgtttctcacaaacagaggagatgtgagatgcgaccgaaaaacctggcggcagcgcaaaagatg

SEQ ID NO: 190282 - DNA, 103 bp, Artificial Sequence
  Synthetic Polynucleotide
taatacgactcactataggggggcacctccttcttcttcttgtttcggtcaacagaggagagaccgaatgaagaagaagaacctggcggcagcgcaaaagatg

SEQ ID NO: 190283 - DNA, 103 bp, Artificial Sequence
  Synthetic Polynucleotide
taatacgactcactatagggagggaggcaccgggtacccattgaggtgccaacagaggagaggcaccatgatgggtaccaacctggcggcagcgcaaaagatg

SEQ ID NO: 190284 - DNA, 103 bp, Artificial Sequence
  Synthetic Polynucleotide
taatacgactcactatagggactcgggcttgggcacctccttcttcttctaacagaggagaagaagaatgaggaggtgcaacctggcggcagcgcaaaagatg

SEQ ID NO: 190285 - DNA, 103 bp, Artificial Sequence
  Synthetic Polynucleotide
taatacgactcactatagggctctcagagcactcgggcttgggcacctccaacagaggagaggaggtatgcaagcccgaaacctggcggcagcgcaaaagatg

SEQ ID NO: 190286 - DNA, 103 bp, Artificial Sequence
  Synthetic Polynucleotide
taatacgactcactatagggcagcgtgtagctctcagagcactcgggcttaacagaggagaaagcccatgtgctctgagaacctggcggcagcgcaaaagatg

SEQ ID NO: 190287 - DNA, 103 bp, Artificial Sequence
  Synthetic Polynucleotide
taatacgactcactatagggcctccggcgtcagcgtgtagctctcagagcaacagaggagagctctgatggctacacgcaacctggcggcagcgcaaaagatg

SEQ ID NO: 190288 - DNA, 103 bp, Artificial Sequence
  Synthetic Polynucleotide
taatacgactcactatagggagctcccccacctccggcgtcagcgtgtagaacagaggagactacacatggacgccggaaacctggcggcagcgcaaaagatg

SEQ ID NO: 190289 - DNA, 103 bp, Artificial Sequence
  Synthetic Polynucleotide
taatacgactcactatagggcttctcaatgagctcccccacctccggcgtaacagaggagaacgccgatggtgggggagaacctggcggcagcgcaaaagatg

SEQ ID NO: 190290 - DNA, 103 bp, Artificial Sequence
  Synthetic Polynucleotide
taatacgactcactatagggctttgcgcaccttctcaatgagctcccccaaacagaggagatgggggatgtcattgagaaacctggcggcagcgcaaaagatg

SEQ ID NO: 190291 - DNA, 103 bp, Artificial Sequence
  Synthetic Polynucleotide
taatacgactcactatagggtcctggtgcgctttgcgcaccttctcaatgaacagaggagacattgaatgggtgcgcaaaacctggcggcagcgcaaaagatg

SEQ ID NO: 190292 - DNA, 103 bp, Artificial Sequence
  Synthetic Polynucleotide
taatacgactcactatagggagggaaggtttcctggtgcgctttgcgcacaacagaggagagtgcgcatggcgcaccagaacctggcggcagcgcaaaagatg

SEQ ID NO: 190293 - DNA, 103 bp, Artificial Sequence
  Synthetic Polynucleotide
taatacgactcactatagggggcagagggcagggaaggtttcctggtgcgaacagaggagacgcaccatgaaaccttccaacctggcggcagcgcaaaagatg

SEQ ID NO: 190294 - DNA, 103 bp, Artificial Sequence
  Synthetic Polynucleotide
taatacgactcactatagggaagaaggcgtagggaggcaccgggtacccaaacagaggagatgggtaatgggtgcctccaacctggcggcagcgcaaaagatg

SEQ ID NO: 190295 - DNA, 103 bp, Artificial Sequence
  Synthetic Polynucleotide
taatacgactcactatagggttgcccagctggcagagggcagggaaggttaacagaggagaaaccttatgtgccctctgaacctggcggcagcgcaaaagatg

SEQ ID NO: 190296 - DNA, 103 bp, Artificial Sequence
  Synthetic Polynucleotide
taatacgactcactatagggcgtagtgtatttgcccagctggcagagggcaacagaggagagccctcatgcagctgggcaacctggcggcagcgcaaaagatg

SEQ ID NO: 190297 - DNA, 103 bp, Artificial Sequence
  Synthetic Polynucleotide
taatacgactcactatagggagctgttgttcgtagtgtatttgcccagctaacagaggagaagctggatgaatacactaaacctggcggcagcgcaaaagatg

SEQ ID NO: 190298 - DNA, 103 bp, Artificial Sequence
  Synthetic Polynucleotide
taatacgactcactatagggcgttgttctgagctgttgttcgtagtgtataacagaggagaatacacatggaacaacagaacctggcggcagcgcaaaagatg

SEQ ID NO: 190299 - DNA, 103 bp, Artificial Sequence
  Synthetic Polynucleotide
taatacgactcactatagggcagagagacacgttgttctgagctgttgttaacagaggagaaacaacatgtcagaacaaaacctggcggcagcgcaaaagatg

SEQ ID NO: 190300 - DNA, 103 bp, Artificial Sequence
  Synthetic Polynucleotide
taatacgactcactatagggggtcaatgtccagagagacacgttgttctgaacagaggagacagaacatggtgtctctcaacctggcggcagcgcaaaagatg

SEQ ID NO: 190301 - DNA, 103 bp, Artificial Sequence
  Synthetic Polynucleotide
taatacgactcactatagggttgtcccagaggtcaatgtccagagagacaaacagaggagatgtctcatgggacattgaaacctggcggcagcgcaaaagatg

SEQ ID NO: 190302 - DNA, 103 bp, Artificial Sequence
  Synthetic Polynucleotide
taatacgactcactatagggttcactgaacttgtcccagaggtcaatgtcaacagaggagagacattatgctctgggacaacctggcggcagcgcaaaagatg

SEQ ID NO: 190303 - DNA, 103 bp, Artificial Sequence
  Synthetic Polynucleotide
taatacgactcactatagggtggtggagagttcactgaacttgtcccagaaacagaggagatctgggatgagttcagtgaacctggcggcagcgcaaaagatg

SEQ ID NO: 190304 - DNA, 103 bp, Artificial Sequence
  Synthetic Polynucleotide
taatacgactcactatagggatgatgcacttggtggagagttcactgaacaacagaggagagttcagatgactctccacaacctggcggcagcgcaaaagatg

SEQ ID NO: 190305 - DNA, 103 bp, Artificial Sequence
  Synthetic Polynucleotide
taatacgactcactatagggaggggggaagaagaaggcgtagggaggcacaacagaggagagtgcctatgtacgccttcaacctggcggcagcgcaaaagatg

SEQ ID NO: 190306 - DNA, 103 bp, Artificial Sequence
  Synthetic Polynucleotide
taatacgactcactatagggcacagtcttaatgatgcacttggtggagagaacagaggagactctccatgaagtgcatcaacctggcggcagcgcaaaagatg

SEQ ID NO: 190307 - DNA, 103 bp, Artificial Sequence
  Synthetic Polynucleotide
taatacgactcactatagggtggcgaactccacagtcttaatgatgcactaacagaggagaagtgcaatgttaagactgaacctggcggcagcgcaaaagatg

SEQ ID NO: 190308 - DNA, 103 bp, Artificial Sequence
  Synthetic Polynucleotide
taatacgactcactatagggggcagctgcttggcgaactccacagtcttaaacagaggagataagacatgggagttcgcaacctggcggcagcgcaaaagatg

SEQ ID NO: 190309 - DNA, 103 bp, Artificial Sequence
  Synthetic Polynucleotide
taatacgactcactatagggggtgaagccgggcagctgcttggcgaactcaacagaggagagagttcatgaagcagctgaacctggcggcagcgcaaaagatg

SEQ ID NO: 190310 - DNA, 103 bp, Artificial Sequence
  Synthetic Polynucleotide
taatacgactcactatagggtggtgagggtggtgaagccgggcagctgctaacagaggagaagcagcatgccggcttcaaacctggcggcagcgcaaaagatg

SEQ ID NO: 190311 - DNA, 103 bp, Artificial Sequence
  Synthetic Polynucleotide
taatacgactcactatagggtggtcggcgatggtgagggtggtgaagccgaacagaggagacggcttatgcaccctcacaacctggcggcagcgcaaaagatg

SEQ ID NO: 190312 - DNA, 103 bp, Artificial Sequence
  Synthetic Polynucleotide
taatacgactcactataggggagggtgatctggtcggcgatggtgagggtaacagaggagaaccctcatgatcgccgacaacctggcggcagcgcaaaagatg

SEQ ID NO: 190313 - DNA, 103 bp, Artificial Sequence
  Synthetic Polynucleotide
taatacgactcactatagggcagccttgaggagggtgatctggtcggcgaaacagaggagatcgccgatgagatcacccaacctggcggcagcgcaaaagatg

SEQ ID NO: 190314 - DNA, 103 bp, Artificial Sequence
  Synthetic Polynucleotide
taatacgactcactatagggtccaggcaggcagccttgaggagggtgatcaacagaggagagatcacatgcctcaaggcaacctggcggcagcgcaaaagatg

SEQ ID NO: 190315 - DNA, 103 bp, Artificial Sequence
  Synthetic Polynucleotide
taatacgactcactataggggatcaggatgtccaggcaggcagccttgagaacagaggagactcaagatggcctgcctgaacctggcggcagcgcaaaagatg

SEQ ID NO: 190316 - DNA, 103 bp, Artificial Sequence
  Synthetic Polynucleotide
taatacgactcactatagggcacccagcataggggggaagaagaaggcgtaacagaggagaacgcctatgtcttcccccaacctggcggcagcgcaaaagatg

SEQ ID NO: 190317 - DNA, 103 bp, Artificial Sequence
  Synthetic Polynucleotide
taatacgactcactatagggagatccgcaggatcaggatgtccaggcaggaacagaggagacctgccatgacatcctgaaacctggcggcagcgcaaaagatg

SEQ ID NO: 190318 - DNA, 103 bp, Artificial Sequence
  Synthetic Polynucleotide
taatacgactcactatagggtaccgcgtgcagatccgcaggatcaggatgaacagaggagacatcctatgcctgcggataacctggcggcagcgcaaaagatg

SEQ ID NO: 190319 - DNA, 103 bp, Artificial Sequence
  Synthetic Polynucleotide
taatacgactcactatagggctcgggcgtgtaccgcgtgcagatccgcagaacagaggagactgcggatgtgcacgcggaacctggcggcagcgcaaaagatg

SEQ ID NO: 190320 - DNA, 103 bp, Artificial Sequence
  Synthetic Polynucleotide
taatacgactcactatagggtggtgtcctgctcgggcgtgtaccgcgtgcaacagaggagagcacgcatgacacgcccgaacctggcggcagcgcaaaagatg

SEQ ID NO: 190321 - DNA, 103 bp, Artificial Sequence
  Synthetic Polynucleotide
taatacgactcactataggggagaaggtcatggtgtcctgctcgggcgtgaacagaggagacacgccatggcaggacacaacctggcggcagcgcaaaagatg

SEQ ID NO: 190322 - DNA, 103 bp, Artificial Sequence
  Synthetic Polynucleotide
taatacgactcactatagggcagcccgtccgagaaggtcatggtgtcctgaacagaggagacaggacatgatgaccttcaacctggcggcagcgcaaaagatg

SEQ ID NO: 190323 - DNA, 103 bp, Artificial Sequence
  Synthetic Polynucleotide
taatacgactcactatagggggttcagggtcagcccgtccgagaaggtcaaacagaggagatgacctatgcggacgggcaacctggcggcagcgcaaaagatg

SEQ ID NO: 190324 - DNA, 103 bp, Artificial Sequence
  Synthetic Polynucleotide
taatacgactcactatagggatctgggtccggttcagggtcagcccgtccaacagaggagaggacggatggaccctgaaaacctggcggcagcgcaaaagatg

SEQ ID NO: 190325 - DNA, 103 bp, Artificial Sequence
  Synthetic Polynucleotide
taatacgactcactatagggagcgttgtgcatctgggtccggttcagggtaacagaggagaaccctgatgcggacccagaacctggcggcagcgcaaaagatg

SEQ ID NO: 190326 - DNA, 103 bp, Artificial Sequence
  Synthetic Polynucleotide
taatacgactcactatagggggccgaagccagcgttgtgcatctgggtccaacagaggagaggacccatgtgcacaacgaacctggcggcagcgcaaaagatg

SEQ ID NO: 190327 - DNA, 103 bp, Artificial Sequence
  Synthetic Polynucleotide
taatacgactcactatagggggggagagtccacccagcataggggggaagaacagaggagacttcccatgtatgctgggaacctggcggcagcgcaaaagatg

SEQ ID NO: 190328 - DNA, 103 bp, Artificial Sequence
  Synthetic Polynucleotide
taatacgactcactatagggtcggtgagggggccgaagccagcgttgtgcaacagaggagagcacaaatgtggcttcggaacctggcggcagcgcaaaagatg

SEQ ID NO: 190329 - DNA, 103 bp, Artificial Sequence
  Synthetic Polynucleotide
taatacgactcactatagggaaagaccaggtcggtgagggggccgaagccaacagaggagaggcttcatgcccctcaccaacctggcggcagcgcaaaagatg

SEQ ID NO: 190330 - DNA, 103 bp, Artificial Sequence
  Synthetic Polynucleotide
taatacgactcactatagggtggcgaaggcaaagaccaggtcggtgagggaacagaggagaccctcaatgacctggtctaacctggcggcagcgcaaaagatg

SEQ ID NO: 190331 - DNA, 103 bp, Artificial Sequence
  Synthetic Polynucleotide
taatacgactcactatagggagcagctggttggcgaaggcaaagaccaggaacagaggagacctggtatgtgccttcgcaacctggcggcagcgcaaaagatg

SEQ ID NO: 190332 - DNA, 103 bp, Artificial Sequence
  Synthetic Polynucleotide
taatacgactcactatagggctccaggggcagcagctggttggcgaaggcaacagaggagagccttcatgaaccagctgaacctggcggcagcgcaaaagatg

SEQ ID NO: 190333 - DNA, 103 bp, Artificial Sequence
  Synthetic Polynucleotide
taatacgactcactatagggcatcatccatctccaggggcagcagctggtaacagaggagaaccagcatgtgcccctggaacctggcggcagcgcaaaagatg

SEQ ID NO: 190334 - DNA, 103 bp, Artificial Sequence
  Synthetic Polynucleotide
taatacgactcactatagggcccgtctccgcatcatccatctccaggggcaacagaggagagcccctatggatggatgaaacctggcggcagcgcaaaagatg

SEQ ID NO: 190335 - DNA, 103 bp, Artificial Sequence
  Synthetic Polynucleotide
taatacgactcactataggggctgagcagccccgtctccgcatcatccataacagaggagaatggatatggcggagacgaacctggcggcagcgcaaaagatg

SEQ ID NO: 190336 - DNA, 103 bp, Artificial Sequence
  Synthetic Polynucleotide
taatacgactcactatagggggcagatggcgctgagcagccccgtctccgaacagaggagacggagaatgggctgctcaaacctggcggcagcgcaaaagatg

SEQ ID NO: 190337 - DNA, 103 bp, Artificial Sequence
  Synthetic Polynucleotide
taatacgactcactatagggccgcagatgaggcagatggcgctgagcagcaacagaggagagctgctatgcgccatctgaacctggcggcagcgcaaaagatg

SEQ ID NO: 190338 - DNA, 103 bp, Artificial Sequence
  Synthetic Polynucleotide
taatacgactcactatagggcactgacagaacatccatacagtcaaacataacagaggagaatgtttatgtgtatggataacctggcggcagcgcaaaagatg

SEQ ID NO: 190339 - DNA, 103 bp, Artificial Sequence
  Synthetic Polynucleotide
taatacgactcactatagggcaatccactgaagcatgctttgagagctttaacagaggagaaaagctatgaaagcatgcaacctggcggcagcgcaaaagatg

SEQ ID NO: 190340 - DNA, 103 bp, Artificial Sequence
  Synthetic Polynucleotide
taatacgactcactatagggttttgtcggttcctcaaggtcctggcggtcaacagaggagagaccgcatggaccttgagaacctggcggcagcgcaaaagatg

SEQ ID NO: 190341 - DNA, 103 bp, Artificial Sequence
  Synthetic Polynucleotide
taatacgactcactataggggcttatctacttttgtcggttcctcaaggtaacagaggagaaccttgatgaaccgacaaaacctggcggcagcgcaaaagatg

SEQ ID NO: 190342 - DNA, 103 bp, Artificial Sequence
  Synthetic Polynucleotide
taatacgactcactatagggggttcttgtagcttatctacttttgtcggtaacagaggagaaccgacatgagtagataaaacctggcggcagcgcaaaagatg

SEQ ID NO: 190343 - DNA, 103 bp, Artificial Sequence
  Synthetic Polynucleotide
taatacgactcactatagggttccagcaatggttcttgtagcttatctacaacagaggagagtagatatgctacaagaaaacctggcggcagcgcaaaagatg

SEQ ID NO: 190344 - DNA, 103 bp, Artificial Sequence
  Synthetic Polynucleotide
taatacgactcactatagggtttttagtgcttccagcaatggttcttgtaaacagaggagatacaagatgcattgctggaacctggcggcagcgcaaaagatg

SEQ ID NO: 190345 - DNA, 103 bp, Artificial Sequence
  Synthetic Polynucleotide
taatacgactcactatagggctgatataaatttttagtgcttccagcaataacagaggagaattgctatgagcactaaaaacctggcggcagcgcaaaagatg

SEQ ID NO: 190346 - DNA, 103 bp, Artificial Sequence
  Synthetic Polynucleotide
taatacgactcactatagggtcgtctttttctgatataaatttttagtgcaacagaggagagcactaatgatttatatcaacctggcggcagcgcaaaagatg

SEQ ID NO: 190347 - DNA, 103 bp, Artificial Sequence
  Synthetic Polynucleotide
taatacgactcactataggggcttgctgggtcgtctttttctgatataaaaacagaggagatttataatggaaaaagacaacctggcggcagcgcaaaagatg

SEQ ID NO: 190348 - DNA, 103 bp, Artificial Sequence
  Synthetic Polynucleotide
taatacgactcactatagggaacatgtgaggcttgctgggtcgtctttttaacagaggagaaaaaagatgacccagcaaaacctggcggcagcgcaaaagatg

SEQ ID NO: 190349 - DNA, 103 bp, Artificial Sequence
  Synthetic Polynucleotide
taatacgactcactataggggatctttggaaacatgtgaggcttgctgggaacagaggagacccagcatgcctcacatgaacctggcggcagcgcaaaagatg

SEQ ID NO: 190350 - DNA, 103 bp, Artificial Sequence
  Synthetic Polynucleotide
taatacgactcactatagggcggtttgggtcaatccactgaagcatgcttaacagaggagaaagcatatgtcagtggataacctggcggcagcgcaaaagatg

SEQ ID NO: 190351 - DNA, 103 bp, Artificial Sequence
  Synthetic Polynucleotide
taatacgactcactatagggttttcattaagatctttggaaacatgtgagaacagaggagactcacaatgttccaaagaaacctggcggcagcgcaaaagatg

SEQ ID NO: 190352 - DNA, 103 bp, Artificial Sequence
  Synthetic Polynucleotide
taatacgactcactatagggagatctgtgattttcattaagatctttggaaacagaggagatccaaaatgcttaatgaaaacctggcggcagcgcaaaagatg

SEQ ID NO: 190353 - DNA, 103 bp, Artificial Sequence
  Synthetic Polynucleotide
taatacgactcactataggggatgctacggagatctgtgattttcattaaaacagaggagattaatgatgatcacagataacctggcggcagcgcaaaagatg

SEQ ID NO: 190354 - DNA, 103 bp, Artificial Sequence
  Synthetic Polynucleotide
taatacgactcactatagggctttagcactgatgctacggagatctgtgaaacagaggagatcacagatgtccgtagcaaacctggcggcagcgcaaaagatg

SEQ ID NO: 190355 - DNA, 103 bp, Artificial Sequence
  Synthetic Polynucleotide
taatacgactcactatagggcgctctgcacctttagcactgatgctacggaacagaggagaccgtagatgcagtgctaaaacctggcggcagcgcaaaagatg

SEQ ID NO: 190356 - DNA, 103 bp, Artificial Sequence
  Synthetic Polynucleotide
taatacgactcactatagggggtaattacacgctctgcacctttagcactaacagaggagaagtgctatgggtgcagagaacctggcggcagcgcaaaagatg

SEQ ID NO: 190357 - DNA, 103 bp, Artificial Sequence
  Synthetic Polynucleotide
taatacgactcactatagggccattttcaaggtaattacacgctctgcacaacagaggagagtgcagatggtgtaattaaacctggcggcagcgcaaaagatg

SEQ ID NO: 190358 - DNA, 103 bp, Artificial Sequence
  Synthetic Polynucleotide
taatacgactcactatagggccaggaatttccattttcaaggtaattacaaacagaggagatgtaatatgcttgaaaataacctggcggcagcgcaaaagatg

SEQ ID NO: 190359 - DNA, 103 bp, Artificial Sequence
  Synthetic Polynucleotide
taatacgactcactatagggtggcattgatccaggaatttccattttcaaaacagaggagattgaaaatggaaattcctaacctggcggcagcgcaaaagatg

SEQ ID NO: 190360 - DNA, 103 bp, Artificial Sequence
  Synthetic Polynucleotide
taatacgactcactataggggaatgagaggtggcattgatccaggaatttaacagaggagaaaattcatggatcaatgcaacctggcggcagcgcaaaagatg

SEQ ID NO: 190361 - DNA, 103 bp, Artificial Sequence
  Synthetic Polynucleotide
taatacgactcactatagggtgctgccattcggtttgggtcaatccactgaacagaggagacagtggatggacccaaacaacctggcggcagcgcaaaagatg

SEQ ID NO: 190362 - DNA, 103 bp, Artificial Sequence
  Synthetic Polynucleotide
taatacgactcactatagggagcatttcttgaatgagaggtggcattgataacagaggagaatcaatatgacctctcataacctggcggcagcgcaaaagatg

SEQ ID NO: 190363 - DNA, 103 bp, Artificial Sequence
  Synthetic Polynucleotide
taatacgactcactatagggagaattctccagcatttcttgaatgagaggaacagaggagacctctcatgcaagaaatgaacctggcggcagcgcaaaagatg

SEQ ID NO: 190364 - DNA, 103 bp, Artificial Sequence
  Synthetic Polynucleotide
taatacgactcactatagggcatgtccttcagaattctccagcatttcttaacagaggagaaagaaaatgtggagaattaacctggcggcagcgcaaaagatg

SEQ ID NO: 190365 - DNA, 103 bp, Artificial Sequence
  Synthetic Polynucleotide
taatacgactcactataggggtcaagggttcatgtccttcagaattctccaacagaggagaggagaaatgtgaaggacaaacctggcggcagcgcaaaagatg

SEQ ID NO: 190366 - DNA, 103 bp, Artificial Sequence
  Synthetic Polynucleotide
taatacgactcactatagggtgaacttggggtcaagggttcatgtccttcaacagaggagagaaggaatggaacccttgaacctggcggcagcgcaaaagatg

SEQ ID NO: 190367 - DNA, 103 bp, Artificial Sequence
  Synthetic Polynucleotide
taatacgactcactatagggtgttcccacttgaacttggggtcaagggttaacagaggagaaaccctatgccccaagttaacctggcggcagcgcaaaagatg

SEQ ID NO: 190368 - DNA, 103 bp, Artificial Sequence
  Synthetic Polynucleotide
taatacgactcactatagggtgctctgctgtgttcccacttgaacttgggaacagaggagacccaagatgaagtgggaaaacctggcggcagcgcaaaagatg

SEQ ID NO: 190369 - DNA, 103 bp, Artificial Sequence
  Synthetic Polynucleotide
taatacgactcactataggggctaggactgtgctctgctgtgttcccactaacagaggagaagtgggatgacagcagagaacctggcggcagcgcaaaagatg

SEQ ID NO: 190370 - DNA, 103 bp, Artificial Sequence
  Synthetic Polynucleotide
taatacgactcactatagggtgggtgagatgctaggactgtgctctgctgaacagaggagacagcagatgacagtcctaaacctggcggcagcgcaaaagatg

SEQ ID NO: 190371 - DNA, 103 bp, Artificial Sequence
  Synthetic Polynucleotide
taatacgactcactatagggtccactgagctgggtgagatgctaggactgaacagaggagacagtccatgcatctcaccaacctggcggcagcgcaaaagatg

SEQ ID NO: 190372 - DNA, 103 bp, Artificial Sequence
  Synthetic Polynucleotide
taatacgactcactatagggagtgtgccgatgctgccattcggtttgggtaacagaggagaacccaaatggaatggcagaacctggcggcagcgcaaaagatg

SEQ ID NO: 190373 - DNA, 103 bp, Artificial Sequence
  Synthetic Polynucleotide
taatacgactcactatagggcccactgttttccactgagctgggtgagataacagaggagaatctcaatgagctcagtgaacctggcggcagcgcaaaagatg

SEQ ID NO: 190374 - DNA, 103 bp, Artificial Sequence
  Synthetic Polynucleotide
taatacgactcactatagggactgactgaccccactgttttccactgagcaacagaggagagctcagatgaaaacagtgaacctggcggcagcgcaaaagatg

SEQ ID NO: 190375 - DNA, 103 bp, Artificial Sequence
  Synthetic Polynucleotide
taatacgactcactatagggacgagtggtgactgactgaccccactgtttaacagaggagaaaacagatgggtcagtcaaacctggcggcagcgcaaaagatg

SEQ ID NO: 190376 - DNA, 103 bp, Artificial Sequence
  Synthetic Polynucleotide
taatacgactcactatagggttgattgagcagtgtgccgatgctgccattaacagaggagaaatggcatgatcggcacaaacctggcggcagcgcaaaagatg

SEQ ID NO: 190377 - DNA, 103 bp, Artificial Sequence
  Synthetic Polynucleotide
taatacgactcactatagggtgtgtttcaattgattgagcagtgtgccgaaacagaggagatcggcaatgtgctcaatcaacctggcggcagcgcaaaagatg

SEQ ID NO: 190378 - DNA, 103 bp, Artificial Sequence
  Synthetic Polynucleotide
taatacgactcactataggggctggtgctctgtgtttcaattgattgagcaacagaggagagctcaaatgattgaaacaaacctggcggcagcgcaaaagatg

SEQ ID NO: 190379 - DNA, 103 bp, Artificial Sequence
  Synthetic Polynucleotide
taatacgactcactataggggttcctcagagctggtgctctgtgtttcaaaacagaggagattgaaaatgagagcaccaaacctggcggcagcgcaaaagatg

SEQ ID NO: 190380 - DNA, 103 bp, Artificial Sequence
  Synthetic Polynucleotide
taatacgactcactatagggcttgggacgagttcctcagagctggtgctcaacagaggagagagcacatgctctgaggaaacctggcggcagcgcaaaagatg

SEQ ID NO: 190381 - DNA, 103 bp, Artificial Sequence
  Synthetic Polynucleotide
taatacgactcactatagggagatggggggcttgggacgagttcctcagaaacagaggagatctgagatgctcgtcccaaacctggcggcagcgcaaaagatg

SEQ ID NO: 190382 - DNA, 103 bp, Artificial Sequence
  Synthetic Polynucleotide
taatacgactcactataggggcccaggactcactgacagaacatccatacaacagaggagagtatggatgttctgtcagaacctggcggcagcgcaaaagatg

SEQ ID NO: 190383 - DNA, 103 bp, Artificial Sequence
  Synthetic Polynucleotide
taatacgactcactataggggaggaagtggagatggggggcttgggacgaaacagaggagatcgtccatggccccccataacctggcggcagcgcaaaagatg

SEQ ID NO: 190384 - DNA, 103 bp, Artificial Sequence
  Synthetic Polynucleotide
taatacgactcactatagggactcgagggggaggaagtggagatggggggaacagaggagaccccccatgtccacttccaacctggcggcagcgcaaaagatg

SEQ ID NO: 190385 - DNA, 103 bp, Artificial Sequence
  Synthetic Polynucleotide
taatacgactcactataggggggtttgtacactcgagggggaggaagtggaacagaggagaccacttatgccccctcgaaacctggcggcagcgcaaaagatg

SEQ ID NO: 190386 - DNA, 103 bp, Artificial Sequence
  Synthetic Polynucleotide
taatacgactcactatagggagacgaagcagggtttgtacactcgaggggaacagaggagacccctcatgtgtacaaacaacctggcggcagcgcaaaagatg

SEQ ID NO: 190387 - DNA, 103 bp, Artificial Sequence
  Synthetic Polynucleotide
taatacgactcactatagggttgtcctggcagacgaagcagggtttgtacaacagaggagagtacaaatgctgcttcgtaacctggcggcagcgcaaaagatg

SEQ ID NO: 190388 - DNA, 103 bp, Artificial Sequence
  Synthetic Polynucleotide
taatacgactcactatagggccctgatgatttgtcctggcagacgaagcaaacagaggagatgcttcatgtgccaggacaacctggcggcagcgcaaaagatg

SEQ ID NO: 190389 - DNA, 103 bp, Artificial Sequence
  Synthetic Polynucleotide
taatacgactcactatagggcatagtggtaccctgatgatttgtcctggcaacagaggagagccaggatgaatcatcagaacctggcggcagcgcaaaagatg

SEQ ID NO: 190390 - DNA, 103 bp, Artificial Sequence
  Synthetic Polynucleotide
taatacgactcactataggggcgctgaccccatagtggtaccctgatgataacagaggagaatcatcatggtaccactaaacctggcggcagcgcaaaagatg

SEQ ID NO: 190391 - DNA, 103 bp, Artificial Sequence
  Synthetic Polynucleotide
taatacgactcactatagggtccctcacaggcgctgaccccatagtggtaaacagaggagataccacatgggggtcagcaacctggcggcagcgcaaaagatg

SEQ ID NO: 190392 - DNA, 103 bp, Artificial Sequence
  Synthetic Polynucleotide
taatacgactcactatagggagcccttacatccctcacaggcgctgacccaacagaggagagggtcaatgcctgtgaggaacctggcggcagcgcaaaagatg

SEQ ID NO: 190393 - DNA, 103 bp, Artificial Sequence
  Synthetic Polynucleotide
taatacgactcactatagggtccaggatttgcccaggactcactgacagaaacagaggagatctgtcatggagtcctggaacctggcggcagcgcaaaagatg

SEQ ID NO: 190394 - DNA, 103 bp, Artificial Sequence
  Synthetic Polynucleotide
taatacgactcactatagggctgcggaaaaagcccttacatccctcacagaacagaggagactgtgaatgatgtaagggaacctggcggcagcgcaaaagatg

SEQ ID NO: 190395 - DNA, 103 bp, Artificial Sequence
  Synthetic Polynucleotide
taatacgactcactatagggctgaatacttctgcggaaaaagcccttacaaacagaggagatgtaagatgtttttccgcaacctggcggcagcgcaaaagatg

SEQ ID NO: 190396 - DNA, 103 bp, Artificial Sequence
  Synthetic Polynucleotide
taatacgactcactatagggtcatattcttctgaatacttctgcggaaaaaacagaggagattttccatggaagtattcaacctggcggcagcgcaaaagatg

SEQ ID NO: 190397 - DNA, 103 bp, Artificial Sequence
  Synthetic Polynucleotide
taatacgactcactatagggcaagtgtaaatcatattcttctgaatacttaacagaggagaaagtatatggaagaatataacctggcggcagcgcaaaagatg

SEQ ID NO: 190398 - DNA, 103 bp, Artificial Sequence
  Synthetic Polynucleotide
taatacgactcactatagggatctcggtgacaagtgtaaatcatattcttaacagaggagaaagaatatgatttacactaacctggcggcagcgcaaaagatg

SEQ ID NO: 190399 - DNA, 103 bp, Artificial Sequence
  Synthetic Polynucleotide
taatacgactcactatagggcacagttcttatctcggtgacaagtgtaaaaacagaggagatttacaatggtcaccgagaacctggcggcagcgcaaaagatg

SEQ ID NO: 190400 - DNA, 103 bp, Artificial Sequence
  Synthetic Polynucleotide
taatacgactcactatagggttattaataacacagttcttatctcggtgaaacagaggagatcaccgatgtaagaactgaacctggcggcagcgcaaaagatg

SEQ ID NO: 190401 - DNA, 103 bp, Artificial Sequence
  Synthetic Polynucleotide
taatacgactcactatagggcctggtgactttattaataacacagttcttaacagaggagaaagaacatggttattaataacctggcggcagcgcaaaagatg

SEQ ID NO: 190402 - DNA, 103 bp, Artificial Sequence
  Synthetic Polynucleotide
taatacgactcactatagggggcatcgattcctggtgactttattaataaaacagaggagattattaatgaagtcaccaaacctggcggcagcgcaaaagatg

SEQ ID NO: 190403 - DNA, 103 bp, Artificial Sequence
  Synthetic Polynucleotide
taatacgactcactatagggcgacagtattggcatcgattcctggtgactaacagaggagaagtcacatggaatcgatgaacctggcggcagcgcaaaagatg

SEQ ID NO: 190404 - DNA, 103 bp, Artificial Sequence
  Synthetic Polynucleotide
taatacgactcactatagggagtgtagaaatccaggatttgcccaggactaacagaggagaagtcctatgcaaatcctgaacctggcggcagcgcaaaagatg

SEQ ID NO: 190405 - DNA, 103 bp, Artificial Sequence
  Synthetic Polynucleotide
taatacgactcactatagggcttctggagtcgacagtattggcatcgattaacagaggagaaatcgaatgcaatactgtaacctggcggcagcgcaaaagatg

SEQ ID NO: 190406 - DNA, 103 bp, Artificial Sequence
  Synthetic Polynucleotide
taatacgactcactatagggcttcaaagcacttctggagtcgacagtattaacagaggagaaatactatggactccagaaacctggcggcagcgcaaaagatg

SEQ ID NO: 190407 - DNA, 103 bp, Artificial Sequence
  Synthetic Polynucleotide
taatacgactcactataggggacattcccacttcaaagcacttctggagtaacagaggagaactccaatggtgctttgaaacctggcggcagcgcaaaagatg

SEQ ID NO: 190408 - DNA, 103 bp, Artificial Sequence
  Synthetic Polynucleotide
taatacgactcactatagggagattctttggacattcccacttcaaagcaaacagaggagatgctttatggtgggaatgaacctggcggcagcgcaaaagatg

SEQ ID NO: 190409 - DNA, 103 bp, Artificial Sequence
  Synthetic Polynucleotide
taatacgactcactatagggcattcctgacagattctttggacattcccaaacagaggagatgggaaatgccaaagaataacctggcggcagcgcaaaagatg

SEQ ID NO: 190410 - DNA, 103 bp, Artificial Sequence
  Synthetic Polynucleotide
taatacgactcactatagggttgttcctgtcattcctgacagattctttgaacagaggagacaaagaatgtgtcaggaaaacctggcggcagcgcaaaagatg

SEQ ID NO: 190411 - DNA, 103 bp, Artificial Sequence
  Synthetic Polynucleotide
taatacgactcactatagggcttctttttcttgttcctgtcattcctgacaacagaggagagtcaggatggacaggaacaacctggcggcagcgcaaaagatg

SEQ ID NO: 190412 - DNA, 103 bp, Artificial Sequence
  Synthetic Polynucleotide
taatacgactcactatagggtcgaagtctccttctttttcttgttcctgtaacagaggagaacaggaatgagaaaaagaaacctggcggcagcgcaaaagatg

SEQ ID NO: 190413 - DNA, 103 bp, Artificial Sequence
  Synthetic Polynucleotide
taatacgactcactatagggcattcttgcttcgaagtctccttctttttcaacagaggagagaaaaaatgggagacttcaacctggcggcagcgcaaaagatg

SEQ ID NO: 190414 - DNA, 103 bp, Artificial Sequence
  Synthetic Polynucleotide
taatacgactcactataggggctctctgtgcattcttgcttcgaagtctcaacagaggagagagactatgaagcaagaaaacctggcggcagcgcaaaagatg

SEQ ID NO: 190415 - DNA, 103 bp, Artificial Sequence
  Synthetic Polynucleotide
taatacgactcactatagggacggactcgcagtgtagaaatccaggatttaacagaggagaaaatccatgatttctacaaacctggcggcagcgcaaaagatg

SEQ ID NO: 190416 - DNA, 103 bp, Artificial Sequence
  Synthetic Polynucleotide
taatacgactcactatagggtcatttcatagctctctgtgcattcttgctaacagaggagaagcaagatggcacagagaaacctggcggcagcgcaaaagatg

SEQ ID NO: 190417 - DNA, 103 bp, Artificial Sequence
  Synthetic Polynucleotide
taatacgactcactatagggaactcagctgtcatttcatagctctctgtgaacagaggagacacagaatgctatgaaataacctggcggcagcgcaaaagatg

SEQ ID NO: 190418 - DNA, 103 bp, Artificial Sequence
  Synthetic Polynucleotide
taatacgactcactataggggagatcgtccaactcagctgtcatttcataaacagaggagatatgaaatgacagctgagaacctggcggcagcgcaaaagatg

SEQ ID NO: 190419 - DNA, 103 bp, Artificial Sequence
  Synthetic Polynucleotide
taatacgactcactatagggtcttctctgtgagatcgtccaactcagctgaacagaggagacagctgatgtggacgatcaacctggcggcagcgcaaaagatg

SEQ ID NO: 190420 - DNA, 103 bp, Artificial Sequence
  Synthetic Polynucleotide
taatacgactcactataggggcttttcggatcttctctgtgagatcgtccaacagaggagaggacgaatgcacagagaaaacctggcggcagcgcaaaagatg

SEQ ID NO: 190421 - DNA, 103 bp, Artificial Sequence
  Synthetic Polynucleotide
taatacgactcactatagggttcctggtgagcttttcggatcttctctgtaacagaggagaacagagatgatccgaaaaaacctggcggcagcgcaaaagatg

SEQ ID NO: 190422 - DNA, 103 bp, Artificial Sequence
  Synthetic Polynucleotide
taatacgactcactatagggaagggaaagtttcctggtgagcttttcggaaacagaggagatccgaaatgctcaccaggaacctggcggcagcgcaaaagatg

SEQ ID NO: 190423 - DNA, 103 bp, Artificial Sequence
  Synthetic Polynucleotide
taatacgactcactatagggtggcagagtgaagggaaagtttcctggtgaaacagaggagatcaccaatgaactttcccaacctggcggcagcgcaaaagatg

SEQ ID NO: 190424 - DNA, 103 bp, Artificial Sequence
  Synthetic Polynucleotide
taatacgactcactatagggtttacccagctggcagagtgaagggaaagtaacagaggagaactttcatgtcactctgcaacctggcggcagcgcaaaagatg

SEQ ID NO: 190425 - DNA, 103 bp, Artificial Sequence
  Synthetic Polynucleotide
taatacgactcactatagggtcgtggtgtatttacccagctggcagagtgaacagaggagacactctatgagctgggtaaacctggcggcagcgcaaaagatg

SEQ ID NO: 190426 - DNA, 103 bp, Artificial Sequence
  Synthetic Polynucleotide
taatacgactcactatagggatgcaggaagacggactcgcagtgtagaaaaacagaggagatttctaatgtgcgagtccaacctggcggcagcgcaaaagatg

SEQ ID NO: 190427 - DNA, 103 bp, Artificial Sequence
  Synthetic Polynucleotide
taatacgactcactataggggcactggaattcgtggtgtatttacccagcaacagaggagagctgggatgatacaccacaacctggcggcagcgcaaaagatg

SEQ ID NO: 190428 - DNA, 103 bp, Artificial Sequence
  Synthetic Polynucleotide
taatacgactcactatagggtcgatggtcagcactggaattcgtggtgtaaacagaggagatacaccatgaattccagtaacctggcggcagcgcaaaagatg

SEQ ID NO: 190429 - DNA, 103 bp, Artificial Sequence
  Synthetic Polynucleotide
taatacgactcactatagggccagtcggactcgatggtcagcactggaataacagaggagaattccaatgctgaccatcaacctggcggcagcgcaaaagatg

SEQ ID NO: 190430 - DNA, 103 bp, Artificial Sequence
  Synthetic Polynucleotide
taatacgactcactatagggaggcccaggtccagtcggactcgatggtcaaacagaggagatgaccaatgagtccgactaacctggcggcagcgcaaaagatg

SEQ ID NO: 190431 - DNA, 103 bp, Artificial Sequence
  Synthetic Polynucleotide
taatacgactcactatagggtttgtcccagaggcccaggtccagtcggacaacagaggagagtccgaatggacctgggcaacctggcggcagcgcaaaagatg

SEQ ID NO: 190432 - DNA, 103 bp, Artificial Sequence
  Synthetic Polynucleotide
taatacgactcactataggggttcactgaatttgtcccagaggcccaggtaacagaggagaacctggatgtctgggacaaacctggcggcagcgcaaaagatg

SEQ ID NO: 190433 - DNA, 103 bp, Artificial Sequence
  Synthetic Polynucleotide
taatacgactcactatagggttggtggccagttcactgaatttgtcccagaacagaggagactgggaatgattcagtgaaacctggcggcagcgcaaaagatg

SEQ ID NO: 190434 - DNA, 103 bp, Artificial Sequence
  Synthetic Polynucleotide
taatacgactcactatagggaataatgcacttggtggccagttcactgaaaacagaggagattcagtatgctggccaccaacctggcggcagcgcaaaagatg

SEQ ID NO: 190435 - DNA, 103 bp, Artificial Sequence
  Synthetic Polynucleotide
taatacgactcactatagggccacgatcttaataatgcacttggtggccaaacagaggagatggccaatgagtgcattaaacctggcggcagcgcaaaagatg

SEQ ID NO: 190436 - DNA, 103 bp, Artificial Sequence
  Synthetic Polynucleotide
taatacgactcactatagggttagcaaactccacgatcttaataatgcacaacagaggagagtgcatatgtaagatcgtaacctggcggcagcgcaaaagatg

SEQ ID NO: 190437 - DNA, 103 bp, Artificial Sequence
  Synthetic Polynucleotide
taatacgactcactatagggctcctggagcatgcaggaagacggactcgcaacagaggagagcgagtatgtcttcctgcaacctggcggcagcgcaaaagatg

SEQ ID NO: 190438 - DNA, 103 bp, Artificial Sequence
  Synthetic Polynucleotide
taatacgactcactatagggaggcagacgtttagcaaactccacgatcttaacagaggagaaagatcatggagtttgctaacctggcggcagcgcaaaagatg

SEQ ID NO: 190439 - DNA, 103 bp, Artificial Sequence
  Synthetic Polynucleotide
taatacgactcactatagggcagtgaaaccaggcagacgtttagcaaactaacagaggagaagtttgatgaacgtctgcaacctggcggcagcgcaaaagatg

SEQ ID NO: 190440 - DNA, 103 bp, Artificial Sequence
  Synthetic Polynucleotide
taatacgactcactatagggatggtcaagccagtgaaaccaggcagacgtaacagaggagaacgtctatgtggtttcacaacctggcggcagcgcaaaagatg

SEQ ID NO: 190441 - DNA, 103 bp, Artificial Sequence
  Synthetic Polynucleotide
taatacgactcactatagggttggtctgcgatggtcaagccagtgaaaccaacagaggagaggtttcatgggcttgaccaacctggcggcagcgcaaaagatg

SEQ ID NO: 190442 - DNA, 103 bp, Artificial Sequence
  Synthetic Polynucleotide
taatacgactcactataggggcagggtaatttggtctgcgatggtcaagcaacagaggagagcttgaatgtcgcagaccaacctggcggcagcgcaaaagatg

SEQ ID NO: 190443 - DNA, 103 bp, Artificial Sequence
  Synthetic Polynucleotide
taatacgactcactataggggcggccttcagcagggtaatttggtctgcgaacagaggagacgcagaatgaattaccctaacctggcggcagcgcaaaagatg

SEQ ID NO: 190444 - DNA, 103 bp, Artificial Sequence
  Synthetic Polynucleotide
taatacgactcactataggggtccaggcaggcggccttcagcagggtaataacagaggagaattaccatgctgaaggccaacctggcggcagcgcaaaagatg

SEQ ID NO: 190445 - DNA, 103 bp, Artificial Sequence
  Synthetic Polynucleotide
taatacgactcactataggggaatcaggatgtccaggcaggcggccttcaaacagaggagatgaaggatgcctgcctggaacctggcggcagcgcaaaagatg

SEQ ID NO: 190446 - DNA, 103 bp, Artificial Sequence
  Synthetic Polynucleotide
taatacgactcactatagggcaaattctaagaatcaggatgtccaggcagaacagaggagactgcctatgcatcctgataacctggcggcagcgcaaaagatg

SEQ ID NO: 190447 - DNA, 103 bp, Artificial Sequence
  Synthetic Polynucleotide
taatacgactcactatagggatacctggtgcaaattctaagaatcaggataacagaggagaatcctgatgcttagaattaacctggcggcagcgcaaaagatg

SEQ ID NO: 190448 - DNA, 103 bp, Artificial Sequence
  Synthetic Polynucleotide
taatacgactcactatagggtgagagctttctcctggagcatgcaggaagaacagaggagacttcctatgtgctccaggaacctggcggcagcgcaaaagatg

SEQ ID NO: 190449 - DNA, 103 bp, Artificial Sequence
  Synthetic Polynucleotide
taatacgactcactataggggttctggggtatacctggtgcaaattctaaaacagaggagattagaaatggcaccaggtaacctggcggcagcgcaaaagatg

SEQ ID NO: 190450 - DNA, 103 bp, Artificial Sequence
  Synthetic Polynucleotide
taatacgactcactatagggatggtgtcttgttctggggtatacctggtgaacagaggagacaccagatgtaccccagaaacctggcggcagcgcaaaagatg

SEQ ID NO: 190451 - DNA, 103 bp, Artificial Sequence
  Synthetic Polynucleotide
taatacgactcactatagggtgagaaagtcatggtgtcttgttctggggtaacagaggagaaccccaatgcaagacaccaacctggcggcagcgcaaaagatg

SEQ ID NO: 190452 - DNA, 103 bp, Artificial Sequence
  Synthetic Polynucleotide
taatacgactcactatagggtaaggccgtctgagaaagtcatggtgtcttaacagaggagaaagacaatgtgactttctaacctggcggcagcgcaaaagatg

SEQ ID NO: 190453 - DNA, 103 bp, Artificial Sequence
  Synthetic Polynucleotide
taatacgactcactatagggcgatttagggtaaggccgtctgagaaagtcaacagaggagagactttatgagacggcctaacctggcggcagcgcaaaagatg

SEQ ID NO: 190454 - DNA, 103 bp, Artificial Sequence
  Synthetic Polynucleotide
taatacgactcactatagggcatctgagttcgatttagggtaaggccgtcaacagaggagagacggcatgaccctaaataacctggcggcagcgcaaaagatg

SEQ ID NO: 190455 - DNA, 103 bp, Artificial Sequence
  Synthetic Polynucleotide
taatacgactcactatagggcagcattgtgcatctgagttcgatttagggaacagaggagaccctaaatggaactcagaaacctggcggcagcgcaaaagatg

SEQ ID NO: 190456 - DNA, 103 bp, Artificial Sequence
  Synthetic Polynucleotide
taatacgactcactatagggggaccaaatccagcattgtgcatctgagttaacagaggagaaactcaatggcacaatgcaacctggcggcagcgcaaaagatg

SEQ ID NO: 190457 - DNA, 103 bp, Artificial Sequence
  Synthetic Polynucleotide
taatacgactcactataggggtcagtcagaggaccaaatccagcattgtgaacagaggagacacaatatgggatttggtaacctggcggcagcgcaaaagatg

SEQ ID NO: 190458 - DNA, 103 bp, Artificial Sequence
  Synthetic Polynucleotide
taatacgactcactatagggtgaacacaaggtcagtcagaggaccaaatcaacagaggagagatttgatgctctgactgaacctggcggcagcgcaaaagatg

SEQ ID NO: 190459 - DNA, 103 bp, Artificial Sequence
  Synthetic Polynucleotide
taatacgactcactatagggaagcatgctttgagagctttctcctggagcaacagaggagagctccaatggaaagctctaacctggcggcagcgcaaaagatg

SEQ ID NO: 190460 - DNA, 103 bp, Artificial Sequence
  Synthetic Polynucleotide
taatacgactcactatagggttggcaaaggtgaacacaaggtcagtcagaaacagaggagatctgacatgccttgtgttaacctggcggcagcgcaaaagatg

SEQ ID NO: 190461 - DNA, 103 bp, Artificial Sequence
  Synthetic Polynucleotide
taatacgactcactatagggcaggagctggttggcaaaggtgaacacaagaacagaggagacttgtgatgacctttgccaacctggcggcagcgcaaaagatg

SEQ ID NO: 190462 - DNA, 103 bp, Artificial Sequence
  Synthetic Polynucleotide
taatacgactcactatagggtttccaaaggcaggagctggttggcaaaggaacagaggagacctttgatgaccagctccaacctggcggcagcgcaaaagatg

SEQ ID NO: 190463 - DNA, 103 bp, Artificial Sequence
  Synthetic Polynucleotide
taatacgactcactataggggtgtcatccatttccaaaggcaggagctggaacagaggagaccagctatggcctttggaaacctggcggcagcgcaaaagatg

SEQ ID NO: 190464 - DNA, 103 bp, Artificial Sequence
  Synthetic Polynucleotide
taatacgactcactataggggcctgtttctgtgtcatccatttccaaaggaacagaggagacctttgatgatggatgacaacctggcggcagcgcaaaagatg

SEQ ID NO: 190465 - DNA, 103 bp, Artificial Sequence
  Synthetic Polynucleotide
taatacgactcactatagggcactgagaaggcctgtttctgtgtcatccaaacagaggagatggatgatgcagaaacagaacctggcggcagcgcaaaagatg

SEQ ID NO: 190466 - DNA, 103 bp, Artificial Sequence
  Synthetic Polynucleotide
taatacgactcactatagggaagcagatggcactgagaaggcctgtttctaacagaggagaagaaacatgccttctcagaacctggcggcagcgcaaaagatg

SEQ ID NO: 190467 - DNA, 103 bp, Artificial Sequence
  Synthetic Polynucleotide
taatacgactcactatagggtccacagattaagcagatggcactgagaagaacagaggagacttctcatggccatctgcaacctggcggcagcgcaaaagatg

SEQ ID NO: 190468 - DNA, 103 bp, Artificial Sequence
  Synthetic Polynucleotide
taatacgactcactatagggcctggcggtctccacagattaagcagatggaacagaggagaccatctatgtaatctgtgaacctggcggcagcgcaaaagatg

SEQ ID NO: 190469 - DNA, 103 bp, Artificial Sequence
  Synthetic Polynucleotide
taatacgactcactatagggtcctcaaggtcctggcggtctccacagattaacagaggagaaatctgatgagaccgccaaacctggcggcagcgcaaaagatg

SEQ ID NO: 190470 - DNA, 103 bp, Artificial Sequence
  Synthetic Polynucleotide
taatacgactcactatagggcggggcaaacgtttccatacagtcgtacataacagaggagaatgtacatgtgtatggaaaacctggcggcagcgcaaaagatg

SEQ ID NO: 190471 - DNA, 103 bp, Artificial Sequence
  Synthetic Polynucleotide
taatacgactcactatagggagattcaagtccggcgaaacaggagccgccaacagaggagaggcggcatgtgtttcgccaacctggcggcagcgcaaaagatg

SEQ ID NO: 190472 - DNA, 103 bp, Artificial Sequence
  Synthetic Polynucleotide
taatacgactcactataggggtccactttttcgggctcctccaggtccataacagaggagaatggacatggaggagcccaacctggcggcagcgcaaaagatg

SEQ ID NO: 190473 - DNA, 103 bp, Artificial Sequence
  Synthetic Polynucleotide
taatacgactcactatagggcctgcagcttgtccactttttcgggctcctaacagaggagaaggagcatgaaaaagtggaacctggcggcagcgcaaaagatg

SEQ ID NO: 190474 - DNA, 103 bp, Artificial Sequence
  Synthetic Polynucleotide
taatacgactcactatagggagcagtggctcctgcagcttgtccacttttaacagaggagaaaaagtatgcaagctgcaaacctggcggcagcgcaaaagatg

SEQ ID NO: 190475 - DNA, 103 bp, Artificial Sequence
  Synthetic Polynucleotide
taatacgactcactatagggcagggcttccagcagtggctcctgcagcttaacagaggagaaagctgatggagccactgaacctggcggcagcgcaaaagatg

SEQ ID NO: 190476 - DNA, 103 bp, Artificial Sequence
  Synthetic Polynucleotide
taatacgactcactatagggcgtacagcctcagggcttccagcagtggctaacagaggagaagccacatgtggaagcccaacctggcggcagcgcaaaagatg

SEQ ID NO: 190477 - DNA, 103 bp, Artificial Sequence
  Synthetic Polynucleotide
taatacgactcactatagggcggcgccgggcgtacagcctcagggcttccaacagaggagaggaagcatggaggctgtaaacctggcggcagcgcaaaagatg

SEQ ID NO: 190478 - DNA, 103 bp, Artificial Sequence
  Synthetic Polynucleotide
taatacgactcactataggggctgggccgccggcgccgggcgtacagcctaacagaggagaaggctgatggcccggcgcaacctggcggcagcgcaaaagatg

SEQ ID NO: 190479 - DNA, 103 bp, Artificial Sequence
  Synthetic Polynucleotide
taatacgactcactatagggtgtagggctggctgggccgccggcgccgggaacagaggagacccggcatgggcggcccaaacctggcggcagcgcaaaagatg

SEQ ID NO: 190480 - DNA, 103 bp, Artificial Sequence
  Synthetic Polynucleotide
taatacgactcactatagggcttgggaacatgtagggctggctgggccgcaacagaggagagcggccatgccagccctaaacctggcggcagcgcaaaagatg

SEQ ID NO: 190481 - DNA, 103 bp, Artificial Sequence
  Synthetic Polynucleotide
taatacgactcactatagggcattagcatccttgggaacatgtagggctgaacagaggagacagcccatgatgttcccaaacctggcggcagcgcaaaagatg

SEQ ID NO: 190482 - DNA, 103 bp, Artificial Sequence
  Synthetic Polynucleotide
taatacgactcactataggggccaggcaaaagattcaagtccggcgaaacaacagaggagagtttcgatggacttgaataacctggcggcagcgcaaaagatg

SEQ ID NO: 190483 - DNA, 103 bp, Artificial Sequence
  Synthetic Polynucleotide
taatacgactcactatagggcggtgattttcattagcatccttgggaacaaacagaggagatgttccatgggatgctaaaacctggcggcagcgcaaaagatg

SEQ ID NO: 190484 - DNA, 103 bp, Artificial Sequence
  Synthetic Polynucleotide
taatacgactcactatagggccccggaggtcggtgattttcattagcatcaacagaggagagatgctatggaaaatcacaacctggcggcagcgcaaaagatg

SEQ ID NO: 190485 - DNA, 103 bp, Artificial Sequence
  Synthetic Polynucleotide
taatacgactcactatagggagtgctgatgccccggaggtcggtgattttaacagaggagaaaaatcatggacctccggaacctggcggcagcgcaaaagatg

SEQ ID NO: 190486 - DNA, 103 bp, Artificial Sequence
  Synthetic Polynucleotide
taatacgactcactatagggcagctcccttagtgctgatgccccggaggtaacagaggagaacctccatggcatcagcaaacctggcggcagcgcaaaagatg

SEQ ID NO: 190487 - DNA, 103 bp, Artificial Sequence
  Synthetic Polynucleotide
taatacgactcactatagggatggccctttcagctcccttagtgctgatgaacagaggagacatcagatgtaagggagcaacctggcggcagcgcaaaagatg

SEQ ID NO: 190488 - DNA, 103 bp, Artificial Sequence
  Synthetic Polynucleotide
taatacgactcactatagggcttcagagtaatggccctttcagctcccttaacagaggagaaagggaatggaaagggccaacctggcggcagcgcaaaagatg

SEQ ID NO: 190489 - DNA, 103 bp, Artificial Sequence
  Synthetic Polynucleotide
taatacgactcactataggggaatctccatcttcagagtaatggccctttaacagaggagaaaagggatgttactctgaaacctggcggcagcgcaaaagatg

SEQ ID NO: 190490 - DNA, 103 bp, Artificial Sequence
  Synthetic Polynucleotide
taatacgactcactatagggatcgggcctggaatctccatcttcagagtaaacagaggagatactctatggatggagataacctggcggcagcgcaaaagatg

SEQ ID NO: 190491 - DNA, 103 bp, Artificial Sequence
  Synthetic Polynucleotide
taatacgactcactatagggtaagggaggcatcgggcctggaatctccataacagaggagaatggagatgccaggcccgaacctggcggcagcgcaaaagatg

SEQ ID NO: 190492 - DNA, 103 bp, Artificial Sequence
  Synthetic Polynucleotide
taatacgactcactatagggtctctcggattaagggaggcatcgggcctgaacagaggagacaggccatgtgcctccctaacctggcggcagcgcaaaagatg

SEQ ID NO: 190493 - DNA, 103 bp, Artificial Sequence
  Synthetic Polynucleotide
taatacgactcactataggggcgggttgcggccaggcaaaagattcaagtaacagaggagaacttgaatgttttgcctgaacctggcggcagcgcaaaagatg

SEQ ID NO: 190494 - DNA, 103 bp, Artificial Sequence
  Synthetic Polynucleotide
taatacgactcactatagggttctccagcatctctcggattaagggaggcaacagaggagagcctccatgaatccgagaaacctggcggcagcgcaaaagatg

SEQ ID NO: 190495 - DNA, 103 bp, Artificial Sequence
  Synthetic Polynucleotide
taatacgactcactatagggcatttcagggttctccagcatctctcggataacagaggagaatccgaatgatgctggagaacctggcggcagcgcaaaagatg

SEQ ID NO: 190496 - DNA, 103 bp, Artificial Sequence
  Synthetic Polynucleotide
taatacgactcactatagggcatcctcaaacatttcagggttctccagcaaacagaggagatgctggatgaccctgaaaaacctggcggcagcgcaaaagatg

SEQ ID NO: 190497 - DNA, 103 bp, Artificial Sequence
  Synthetic Polynucleotide
taatacgactcactatagggtgcgaggagtcatcctcaaacatttcagggaacagaggagaccctgaatggtttgaggaaacctggcggcagcgcaaaagatg

SEQ ID NO: 190498 - DNA, 103 bp, Artificial Sequence
  Synthetic Polynucleotide
taatacgactcactataggggggaccaggctgcgaggagtcatcctcaaaaacagaggagatttgagatggactcctcgaacctggcggcagcgcaaaagatg

SEQ ID NO: 190499 - DNA, 103 bp, Artificial Sequence
  Synthetic Polynucleotide
taatacgactcactatagggcattggggtggggaccaggctgcgaggagtaacagaggagaactcctatgagcctggtcaacctggcggcagcgcaaaagatg

SEQ ID NO: 190500 - DNA, 103 bp, Artificial Sequence
  Synthetic Polynucleotide
taatacgactcactatagggtcgctagaggcattggggtggggaccaggcaacagaggagagcctggatgccaccccaaaacctggcggcagcgcaaaagatg

SEQ ID NO: 190501 - DNA, 103 bp, Artificial Sequence
  Synthetic Polynucleotide
taatacgactcactatagggaacctcatcctcgctagaggcattggggtgaacagaggagacaccccatggcctctagcaacctggcggcagcgcaaaagatg

SEQ ID NO: 190502 - DNA, 103 bp, Artificial Sequence
  Synthetic Polynucleotide
taatacgactcactatagggggcccccaggaacctcatcctcgctagaggaacagaggagacctctaatgaggatgaggaacctggcggcagcgcaaaagatg

SEQ ID NO: 190503 - DNA, 103 bp, Artificial Sequence
  Synthetic Polynucleotide
taatacgactcactatagggcctttgccctggcccccaggaacctcatccaacagaggagaggatgaatgtcctgggggaacctggcggcagcgcaaaagatg

SEQ ID NO: 190504 - DNA, 103 bp, Artificial Sequence
  Synthetic Polynucleotide
taatacgactcactatagggttgcaggctggcgggttgcggccaggcaaaaacagaggagatttgccatgccgcaacccaacctggcggcagcgcaaaagatg

SEQ ID NO: 190505 - DNA, 103 bp, Artificial Sequence
  Synthetic Polynucleotide
taatacgactcactatagggcttcaggccccctttgccctggcccccaggaacagaggagacctgggatgcagggcaaaaacctggcggcagcgcaaaagatg

SEQ ID NO: 190506 - DNA, 103 bp, Artificial Sequence
  Synthetic Polynucleotide
taatacgactcactatagggaggctggggacttcaggccccctttgccctaacagaggagaagggcaatgggggcctgaaacctggcggcagcgcaaaagatg

SEQ ID NO: 190507 - DNA, 103 bp, Artificial Sequence
  Synthetic Polynucleotide
taatacgactcactatagggtctccaccgattgcaggctggcgggttgcgaacagaggagacgcaacatgccagcctgcaacctggcggcagcgcaaaagatg

SEQ ID NO: 190508 - DNA, 103 bp, Artificial Sequence
  Synthetic Polynucleotide
taatacgactcactataggggtgctctgtgtctccaccgattgcaggctgaacagaggagacagcctatgatcggtggaaacctggcggcagcgcaaaagatg

SEQ ID NO: 190509 - DNA, 103 bp, Artificial Sequence
  Synthetic Polynucleotide
taatacgactcactatagggctctgagctggtgctctgtgtctccaccgaaacagaggagatcggtgatgacacagagcaacctggcggcagcgcaaaagatg

SEQ ID NO: 190510 - DNA, 103 bp, Artificial Sequence
  Synthetic Polynucleotide
taatacgactcactataggggcaccatctcctctgagctggtgctctgtgaacagaggagacacagaatgccagctcagaacctggcggcagcgcaaaagatg

SEQ ID NO: 190511 - DNA, 103 bp, Artificial Sequence
  Synthetic Polynucleotide
taatacgactcactatagggggcgagctgggcaccatctcctctgagctgaacagaggagacagctcatgggagatggtaacctggcggcagcgcaaaagatg

SEQ ID NO: 190512 - DNA, 103 bp, Artificial Sequence
  Synthetic Polynucleotide
taatacgactcactatagggagggggcgagggcgagctgggcaccatctcaacagaggagagagatgatgcccagctcgaacctggcggcagcgcaaaagatg

SEQ ID NO: 190513 - DNA, 103 bp, Artificial Sequence
  Synthetic Polynucleotide
taatacgactcactataggggtcgcggacccggggcaaacgtttccatacaacagaggagagtatggatgcgtttgcccaacctggcggcagcgcaaaagatg

SEQ ID NO: 190514 - DNA, 103 bp, Artificial Sequence
  Synthetic Polynucleotide
taatacgactcactataggggaggaggcggagggggcgagggcgagctggaacagaggagaccagctatgcctcgccccaacctggcggcagcgcaaaagatg

SEQ ID NO: 190515 - DNA, 103 bp, Artificial Sequence
  Synthetic Polynucleotide
taatacgactcactatagggttgtagacccgaggaggcggagggggcgagaacagaggagactcgccatgtccgcctccaacctggcggcagcgcaaaagatg

SEQ ID NO: 190516 - DNA, 103 bp, Artificial Sequence
  Synthetic Polynucleotide
taatacgactcactataggggaagcatggcttgtagacccgaggaggcggaacagaggagaccgcctatgcgggtctacaacctggcggcagcgcaaaagatg

SEQ ID NO: 190517 - DNA, 103 bp, Artificial Sequence
  Synthetic Polynucleotide
taatacgactcactatagggcattgcacacgaagcatggcttgtagacccaacagaggagagggtctatgagccatgctaacctggcggcagcgcaaaagatg

SEQ ID NO: 190518 - DNA, 103 bp, Artificial Sequence
  Synthetic Polynucleotide
taatacgactcactataggggaggacttgtcattgcacacgaagcatggcaacagaggagagccatgatgcgtgtgcaaaacctggcggcagcgcaaaagatg

SEQ ID NO: 190519 - DNA, 103 bp, Artificial Sequence
  Synthetic Polynucleotide
taatacgactcactataggggtggtagccagaggacttgtcattgcacacaacagaggagagtgtgcatggacaagtccaacctggcggcagcgcaaaagatg

SEQ ID NO: 190520 - DNA, 103 bp, Artificial Sequence
  Synthetic Polynucleotide
taatacgactcactatagggtgaccccatagtggtagccagaggacttgtaacagaggagaacaagtatgctggctaccaacctggcggcagcgcaaaagatg

SEQ ID NO: 190521 - DNA, 103 bp, Artificial Sequence
  Synthetic Polynucleotide
taatacgactcactatagggtcacaagagctgaccccatagtggtagccaaacagaggagatggctaatgctatggggtaacctggcggcagcgcaaaagatg

SEQ ID NO: 190522 - DNA, 103 bp, Artificial Sequence
  Synthetic Polynucleotide
taatacgactcactatagggcttgcagccttcacaagagctgaccccataaacagaggagatatgggatgagctcttgtaacctggcggcagcgcaaaagatg

SEQ ID NO: 190523 - DNA, 103 bp, Artificial Sequence
  Synthetic Polynucleotide
taatacgactcactataggggaaagaagcccttgcagccttcacaagagcaacagaggagagctcttatgaaggctgcaaacctggcggcagcgcaaaagatg

SEQ ID NO: 190524 - DNA, 103 bp, Artificial Sequence
  Synthetic Polynucleotide
taatacgactcactatagggccgtacagccgtcgcggacccggggcaaacaacagaggagagtttgcatggggtccgcgaacctggcggcagcgcaaaagatg

SEQ ID NO: 190525 - DNA, 103 bp, Artificial Sequence
  Synthetic Polynucleotide
taatacgactcactatagggatgcttcggcgaaagaagcccttgcagcctaacagaggagaaggctgatggggcttcttaacctggcggcagcgcaaaagatg

SEQ ID NO: 190526 - DNA, 103 bp, Artificial Sequence
  Synthetic Polynucleotide
taatacgactcactataggggttcttctggatgcttcggcgaaagaagccaacagaggagaggcttcatgcgccgaagcaacctggcggcagcgcaaaagatg

SEQ ID NO: 190527 - DNA, 103 bp, Artificial Sequence
  Synthetic Polynucleotide
taatacgactcactatagggtgtacaccatgttcttctggatgcttcggcaacagaggagagccgaaatgtccagaagaaacctggcggcagcgcaaaagatg

SEQ ID NO: 190528 - DNA, 103 bp, Artificial Sequence
  Synthetic Polynucleotide
taatacgactcactatagggcggtgacacgtgtacaccatgttcttctggaacagaggagaccagaaatgcatggtgtaaacctggcggcagcgcaaaagatg

SEQ ID NO: 190529 - DNA, 103 bp, Artificial Sequence
  Synthetic Polynucleotide
taatacgactcactataggggtttttgtcgcggtgacacgtgtacaccataacagaggagaatggtgatgacgtgtcacaacctggcggcagcgcaaaagatg

SEQ ID NO: 190530 - DNA, 103 bp, Artificial Sequence
  Synthetic Polynucleotide
taatacgactcactatagggtgatgatacagtttttgtcgcggtgacacgaacagaggagacgtgtcatggcgacaaaaaacctggcggcagcgcaaaagatg

SEQ ID NO: 190531 - DNA, 103 bp, Artificial Sequence
  Synthetic Polynucleotide
taatacgactcactataggggtcaccttgttgatgatacagtttttgtcgaacagaggagacgacaaatgctgtatcataacctggcggcagcgcaaaagatg

SEQ ID NO: 190532 - DNA, 103 bp, Artificial Sequence
  Synthetic Polynucleotide
taatacgactcactataggggcgattcctggtcaccttgttgatgatacaaacagaggagatgtatcatgaacaaggtgaacctggcggcagcgcaaaagatg

SEQ ID NO: 190533 - DNA, 103 bp, Artificial Sequence
  Synthetic Polynucleotide
taatacgactcactatagggagtactggcagcgattcctggtcaccttgtaacagaggagaacaaggatgccaggaatcaacctggcggcagcgcaaaagatg

SEQ ID NO: 190534 - DNA, 103 bp, Artificial Sequence
  Synthetic Polynucleotide
taatacgactcactatagggtgtagccggcagtactggcagcgattcctgaacagaggagacaggaaatgctgccagtaaacctggcggcagcgcaaaagatg

SEQ ID NO: 190535 - DNA, 103 bp, Artificial Sequence
  Synthetic Polynucleotide
taatacgactcactatagggcccggccgccccgtacagccgtcgcggaccaacagaggagaggtccgatgcggctgtacaacctggcggcagcgcaaaagatg

SEQ ID NO: 190536 - DNA, 103 bp, Artificial Sequence
  Synthetic Polynucleotide
taatacgactcactataggggaagcacttctgtagccggcagtactggcaaacagaggagatgccagatgtgccggctaaacctggcggcagcgcaaaagatg

SEQ ID NO: 190537 - DNA, 103 bp, Artificial Sequence
  Synthetic Polynucleotide
taatacgactcactatagggtgcccacttcgaagcacttctgtagccggcaacagaggagagccggcatgagaagtgctaacctggcggcagcgcaaaagatg

SEQ ID NO: 190538 - DNA, 103 bp, Artificial Sequence
  Synthetic Polynucleotide
taatacgactcactatagggtccttggacatgcccacttcgaagcacttcaacagaggagagaagtgatgcgaagtgggaacctggcggcagcgcaaaagatg

SEQ ID NO: 190539 - DNA, 103 bp, Artificial Sequence
  Synthetic Polynucleotide
taatacgactcactatagggtcgcacagcttccttggacatgcccacttcaacagaggagagaagtgatgatgtccaagaacctggcggcagcgcaaaagatg

SEQ ID NO: 190540 - DNA, 103 bp, Artificial Sequence
  Synthetic Polynucleotide
taatacgactcactatagggtccggtcatttcgcacagcttccttggacaaacagaggagatgtccaatgaagctgtgcaacctggcggcagcgcaaaagatg

SEQ ID NO: 190541 - DNA, 103 bp, Artificial Sequence
  Synthetic Polynucleotide
taatacgactcactatagggttcttcttgttccggtcatttcgcacagctaacagaggagaagctgtatgaaatgaccgaacctggcggcagcgcaaaagatg

SEQ ID NO: 190542 - DNA, 103 bp, Artificial Sequence
  Synthetic Polynucleotide
taatacgactcactatagggcacctctttcttcttcttgttccggtcattaacagaggagaaatgacatgaacaagaagaacctggcggcagcgcaaaagatg

SEQ ID NO: 190543 - DNA, 103 bp, Artificial Sequence
  Synthetic Polynucleotide
taatacgactcactatagggcttcttccttcacctctttcttcttcttgtaacagaggagaacaagaatgagaaagaggaacctggcggcagcgcaaaagatg

SEQ ID NO: 190544 - DNA, 103 bp, Artificial Sequence
  Synthetic Polynucleotide
taatacgactcactatagggtcaggtgacccttcttccttcacctctttcaacagaggagagaaagaatggaaggaagaaacctggcggcagcgcaaaagatg

SEQ ID NO: 190545 - DNA, 103 bp, Artificial Sequence
  Synthetic Polynucleotide
taatacgactcactatagggctcatagctgtcaggtgacccttcttccttaacagaggagaaaggaaatggggtcacctaacctggcggcagcgcaaaagatg

SEQ ID NO: 190546 - DNA, 103 bp, Artificial Sequence
  Synthetic Polynucleotide
taatacgactcactatagggcggccccgggcccggccgccccgtacagccaacagaggagaggctgtatggggcggccgaacctggcggcagcgcaaaagatg

SEQ ID NO: 190547 - DNA, 103 bp, Artificial Sequence
  Synthetic Polynucleotide
taatacgactcactataggggagggctcagctcatagctgtcaggtgaccaacagaggagaggtcacatgacagctatgaacctggcggcagcgcaaaagatg

SEQ ID NO: 190548 - DNA, 103 bp, Artificial Sequence
  Synthetic Polynucleotide
taatacgactcactatagggtcttctaactgagggctcagctcatagctgaacagaggagacagctaatggctgagcccaacctggcggcagcgcaaaagatg

SEQ ID NO: 190549 - DNA, 103 bp, Artificial Sequence
  Synthetic Polynucleotide
taatacgactcactatagggggtgatgagctcttctaactgagggctcagaacagaggagactgagcatgcagttagaaaacctggcggcagcgcaaaagatg

SEQ ID NO: 190550 - DNA, 103 bp, Artificial Sequence
  Synthetic Polynucleotide
taatacgactcactatagggtgctgaccttggtgatgagctcttctaactaacagaggagaagttagatgagctcatcaaacctggcggcagcgcaaaagatg

SEQ ID NO: 190551 - DNA, 103 bp, Artificial Sequence
  Synthetic Polynucleotide
taatacgactcactatagggtgatgggctttgctgaccttggtgatgagcaacagaggagagctcatatgcaaggtcagaacctggcggcagcgcaaaagatg

SEQ ID NO: 190552 - DNA, 103 bp, Artificial Sequence
  Synthetic Polynucleotide
taatacgactcactataggggaaagtctcctgatgggctttgctgaccttaacagaggagaaaggtcatgaaagcccataacctggcggcagcgcaaaagatg

SEQ ID NO: 190553 - DNA, 103 bp, Artificial Sequence
  Synthetic Polynucleotide
taatacgactcactatagggagagcgaggggaaagtctcctgatgggcttaacagaggagaaagcccatgaggagacttaacctggcggcagcgcaaaagatg

SEQ ID NO: 190554 - DNA, 103 bp, Artificial Sequence
  Synthetic Polynucleotide
taatacgactcactatagggcccagctggcagagcgaggggaaagtctccaacagaggagaggagacatgcccctcgctaacctggcggcagcgcaaaagatg

SEQ ID NO: 190555 - DNA, 103 bp, Artificial Sequence
  Synthetic Polynucleotide
taatacgactcactatagggggtatacttgcccagctggcagagcgagggaacagaggagaccctcgatgtgccagctgaacctggcggcagcgcaaaagatg

SEQ ID NO: 190556 - DNA, 103 bp, Artificial Sequence
  Synthetic Polynucleotide
taatacgactcactatagggtggagttcgtggtatacttgcccagctggcaacagaggagagccagcatggcaagtataaacctggcggcagcgcaaaagatg

SEQ ID NO: 190557 - DNA, 103 bp, Artificial Sequence
  Synthetic Polynucleotide
taatacgactcactatagggcgcagcaagccggccccgggcccggccgccaacagaggagaggcggcatggcccggggcaacctggcggcagcgcaaaagatg

SEQ ID NO: 190558 - DNA, 103 bp, Artificial Sequence
  Synthetic Polynucleotide
taatacgactcactatagggtggtctgcactggagttcgtggtatacttgaacagaggagacaagtaatgcacgaactcaacctggcggcagcgcaaaagatg

SEQ ID NO: 190559 - DNA, 103 bp, Artificial Sequence
  Synthetic Polynucleotide
taatacgactcactatagggctgcacgcggtggtctgcactggagttcgtaacagaggagaacgaacatgagtgcagacaacctggcggcagcgcaaaagatg

SEQ ID NO: 190560 - DNA, 103 bp, Artificial Sequence
  Synthetic Polynucleotide
taatacgactcactatagggccagatccagctgcacgcggtggtctgcacaacagaggagagtgcagatgaccgcgtgcaacctggcggcagcgcaaaagatg

SEQ ID NO: 190561 - DNA, 103 bp, Artificial Sequence
  Synthetic Polynucleotide
taatacgactcactatagggtcccacagccccagatccagctgcacgcggaacagaggagaccgcgtatggctggatctaacctggcggcagcgcaaaagatg

SEQ ID NO: 190562 - DNA, 103 bp, Artificial Sequence
  Synthetic Polynucleotide
taatacgactcactatagggactgaacttgtcccacagccccagatccagaacagaggagactggatatggggctgtggaacctggcggcagcgcaaaagatg

SEQ ID NO: 190563 - DNA, 103 bp, Artificial Sequence
  Synthetic Polynucleotide
taatacgactcactatagggtagccagctcactgaacttgtcccacagccaacagaggagaggctgtatgacaagttcaaacctggcggcagcgcaaaagatg

SEQ ID NO: 190564 - DNA, 103 bp, Artificial Sequence
  Synthetic Polynucleotide
taatacgactcactatagggatgcacttggtagccagctcactgaacttgaacagaggagacaagttatgtgagctggcaacctggcggcagcgcaaaagatg

SEQ ID NO: 190565 - DNA, 103 bp, Artificial Sequence
  Synthetic Polynucleotide
taatacgactcactataggggatcttgatgatgcacttggtagccagctcaacagaggagagagctgatgaccaagtgcaacctggcggcagcgcaaaagatg

SEQ ID NO: 190566 - DNA, 103 bp, Artificial Sequence
  Synthetic Polynucleotide
taatacgactcactatagggcaaactccacgatcttgatgatgcacttggaacagaggagaccaagtatgtcatcaagaaacctggcggcagcgcaaaagatg

SEQ ID NO: 190567 - DNA, 103 bp, Artificial Sequence
  Synthetic Polynucleotide
taatacgactcactatagggaaccgcttggcaaactccacgatcttgatgaacagaggagacatcaaatgcgtggagttaacctggcggcagcgcaaaagatg

SEQ ID NO: 190568 - DNA, 103 bp, Artificial Sequence
  Synthetic Polynucleotide
taatacgactcactatagggggtggctctgcgcagcaagccggccccgggaacagaggagacccgggatgggcttgctgaacctggcggcagcgcaaaagatg

SEQ ID NO: 190569 - DNA, 103 bp, Artificial Sequence
  Synthetic Polynucleotide
taatacgactcactatagggaaagccaggcaaccgcttggcaaactccacaacagaggagagtggagatggccaagcggaacctggcggcagcgcaaaagatg

SEQ ID NO: 190570 - DNA, 103 bp, Artificial Sequence
  Synthetic Polynucleotide
taatacgactcactatagggtgagccctgtaaagccaggcaaccgcttggaacagaggagaccaagcatgtgcctggctaacctggcggcagcgcaaaagatg

SEQ ID NO: 190571 - DNA, 103 bp, Artificial Sequence
  Synthetic Polynucleotide
taatacgactcactatagggtcagcaatgctgagccctgtaaagccaggcaacagaggagagcctggatgtacagggctaacctggcggcagcgcaaaagatg

SEQ ID NO: 190572 - DNA, 103 bp, Artificial Sequence
  Synthetic Polynucleotide
taatacgactcactatagggagtgatctggtcagcaatgctgagccctgtaacagaggagaacagggatgagcattgctaacctggcggcagcgcaaaagatg

SEQ ID NO: 190573 - DNA, 103 bp, Artificial Sequence
  Synthetic Polynucleotide
taatacgactcactatagggctttgagcagagtgatctggtcagcaatgcaacagaggagagcattgatgaccagatcaaacctggcggcagcgcaaaagatg

SEQ ID NO: 190574 - DNA, 103 bp, Artificial Sequence
  Synthetic Polynucleotide
taatacgactcactatagggaggcaggcagctttgagcagagtgatctggaacagaggagaccagatatgtctgctcaaaacctggcggcagcgcaaaagatg

SEQ ID NO: 190575 - DNA, 103 bp, Artificial Sequence
  Synthetic Polynucleotide
taatacgactcactatagggcaggatatctaggcaggcagctttgagcagaacagaggagactgctcatggctgcctgcaacctggcggcagcgcaaaagatg

SEQ ID NO: 190576 - DNA, 103 bp, Artificial Sequence
  Synthetic Polynucleotide
taatacgactcactatagggtacgcagcatcaggatatctaggcaggcagaacagaggagactgcctatgtagatatccaacctggcggcagcgcaaaagatg

SEQ ID NO: 190577 - DNA, 103 bp, Artificial Sequence
  Synthetic Polynucleotide
taatacgactcactatagggcttgtgcagatacgcagcatcaggatatctaacagaggagaagatatatggatgctgcgaacctggcggcagcgcaaaagatg

SEQ ID NO: 190578 - DNA, 103 bp, Artificial Sequence
  Synthetic Polynucleotide
taatacgactcactatagggtggggtgtaccttgtgcagatacgcagcataacagaggagaatgctgatgatctgcacaaacctggcggcagcgcaaaagatg

SEQ ID NO: 190579 - DNA, 103 bp, Artificial Sequence
  Synthetic Polynucleotide
taatacgactcactatagggaggagccgccggtggctctgcgcagcaagcaacagaggagagcttgcatggcagagccaaacctggcggcagcgcaaaagatg

SEQ ID NO: 190580 - DNA, 103 bp, Artificial Sequence
  Synthetic Polynucleotide
taatacgactcactatagggtgtcctgctctggggtgtaccttgtgcagaaacagaggagatctgcaatgggtacacccaacctggcggcagcgcaaaagatg

SEQ ID NO: 190581 - DNA, 103 bp, Artificial Sequence
  Synthetic Polynucleotide
taatacgactcactatagggaaggtcatggtgtcctgctctggggtgtacaacagaggagagtacacatgagagcaggaaacctggcggcagcgcaaaagatg

SEQ ID NO: 190582 - DNA, 103 bp, Artificial Sequence
  Synthetic Polynucleotide
taatacgactcactatagggcccgtcggagaaggtcatggtgtcctgctcaacagaggagagagcagatgaccatgaccaacctggcggcagcgcaaaagatg

SEQ ID NO: 190583 - DNA, 103 bp, Artificial Sequence
  Synthetic Polynucleotide
taatacgactcactatagggtcagggtcagcccgtcggagaaggtcatggaacagaggagaccatgaatgtctccgacgaacctggcggcagcgcaaaagatg

SEQ ID NO: 190584 - DNA, 103 bp, Artificial Sequence
  Synthetic Polynucleotide
taatacgactcactatagggtgggtccggttcagggtcagcccgtcggagaacagaggagactccgaatggctgaccctaacctggcggcagcgcaaaagatg

SEQ ID NO: 190585 - DNA, 103 bp, Artificial Sequence
  Synthetic Polynucleotide
taatacgactcactatagggattgtgcatctgggtccggttcagggtcagaacagaggagactgaccatgaaccggaccaacctggcggcagcgcaaaagatg

SEQ ID NO: 190586 - DNA, 103 bp, Artificial Sequence
  Synthetic Polynucleotide
taatacgactcactatagggcgaagccggcattgtgcatctgggtccggtaacagaggagaaccggaatgagatgcacaaacctggcggcagcgcaaaagatg

SEQ ID NO: 190587 - DNA, 103 bp, Artificial Sequence
  Synthetic Polynucleotide
taatacgactcactataggggtgaggggcccgaagccggcattgtgcatcaacagaggagagatgcaatgtgccggcttaacctggcggcagcgcaaaagatg

SEQ ID NO: 190588 - DNA, 103 bp, Artificial Sequence
  Synthetic Polynucleotide
taatacgactcactataggggacaaggtctgtgaggggcccgaagccggcaacagaggagagccggcatggggcccctcaacctggcggcagcgcaaaagatg

SEQ ID NO: 190589 - DNA, 103 bp, Artificial Sequence
  Synthetic Polynucleotide
taatacgactcactatagggcaaaggcaaagacaaggtctgtgaggggccaacagaggagaggccccatgcagaccttgaacctggcggcagcgcaaaagatg

SEQ ID NO: 190590 - DNA, 103 bp, Artificial Sequence
  Synthetic Polynucleotide
taatacgactcactatagggccggcgaaacaggagccgccggtggctctgaacagaggagacagagcatgcggcggctcaacctggcggcagcgcaaaagatg

SEQ ID NO: 190591 - DNA, 103 bp, Artificial Sequence
  Synthetic Polynucleotide
taatacgactcactatagggagctgcccagcaaaggcaaagacaaggtctaacagaggagaagacctatgctttgccttaacctggcggcagcgcaaaagatg

SEQ ID NO: 190592 - DNA, 103 bp, Artificial Sequence
  Synthetic Polynucleotide
taatacgactcactatagggcaggggcaggagctgcccagcaaaggcaaaaacagaggagatttgccatggctgggcagaacctggcggcagcgcaaaagatg

SEQ ID NO: 190593 - DNA, 103 bp, Artificial Sequence
  Synthetic Polynucleotide
taatacgactcactatagggcatccatctccaggggcaggagctgcccagaacagaggagactgggcatgtcctgccccaacctggcggcagcgcaaaagatg

SEQ ID NO: 190594 - DNA, 103 bp, Artificial Sequence
  Synthetic Polynucleotide
taatacgactcactataggggtctcggtgtcatccatctccaggggcaggaacagaggagacctgccatgggagatggaaacctggcggcagcgcaaaagatg

SEQ ID NO: 190595 - DNA, 103 bp, Artificial Sequence
  Synthetic Polynucleotide
taatacgactcactataggggagcagccctgtctcggtgtcatccatctcaacagaggagagagatgatggacaccgagaacctggcggcagcgcaaaagatg

SEQ ID NO: 190596 - DNA, 103 bp, Artificial Sequence
  Synthetic Polynucleotide
taatacgactcactatagggagatggcgctgagcagccctgtctcggtgtaacagaggagaacaccgatgcagggctgcaacctggcggcagcgcaaaagatg

SEQ ID NO: 190597 - DNA, 103 bp, Artificial Sequence
  Synthetic Polynucleotide
taatacgactcactatagggcagatgaggcagatggcgctgagcagccctaacagaggagaagggctatgcagcgccataacctggcggcagcgcaaaagatg

SEQ ID NO: 190598 - DNA, 103 bp, Artificial Sequence
  Synthetic Polynucleotide
taatacgactcactataggggcggtctccgcagatgaggcagatggcgctaacagaggagaagcgccatgtgcctcatcaacctggcggcagcgcaaaagatg

SEQ ID NO: 190599 - DNA, 103 bp, Artificial Sequence
  Synthetic Polynucleotide
taatacgactcactatagggccaggtccatgcggtctccgcagatgaggcaacagaggagagcctcaatggcggagaccaacctggcggcagcgcaaaagatg

SEQ ID NO: 190600 - DNA, 103 bp, Artificial Sequence
  Synthetic Polynucleotide
taatacgactcactatagggtcgggctcctccaggtccatgcggtctccgaacagaggagacggagaatgcatggacctaacctggcggcagcgcaaaagatg

SEQ ID NO: 190601 - DNA, 103 bp, Artificial Sequence
  Synthetic Polynucleotide
taatacgactcactatagggcatggctggcgcgcagcccggcaggtgcataacagaggagaatgcacatgccgggctgcaacctggcggcagcgcaaaagatg

SEQ ID NO: 190602 - DNA, 103 bp, Artificial Sequence
  Synthetic Polynucleotide
taatacgactcactatagggccccaggatggcctcgatgctgtgaagtcgaacagaggagacgacttatgagcatcgagaacctggcggcagcgcaaaagatg

SEQ ID NO: 190603 - DNA, 103 bp, Artificial Sequence
  Synthetic Polynucleotide
taatacgactcactatagggccttggtaaaccccaggatggcctcgatgcaacagaggagagcatcgatgccatcctggaacctggcggcagcgcaaaagatg

SEQ ID NO: 190604 - DNA, 103 bp, Artificial Sequence
  Synthetic Polynucleotide
taatacgactcactatagggatcccgtcgtccttggtaaaccccaggatgaacagaggagacatcctatggtttaccaaaacctggcggcagcgcaaaagatg

SEQ ID NO: 190605 - DNA, 103 bp, Artificial Sequence
  Synthetic Polynucleotide
taatacgactcactatagggggtgccgaggatcccgtcgtccttggtaaaaacagaggagatttaccatggacgacgggaacctggcggcagcgcaaaagatg

SEQ ID NO: 190606 - DNA, 103 bp, Artificial Sequence
  Synthetic Polynucleotide
taatacgactcactatagggccgccgggaaggtgccgaggatcccgtcgtaacagaggagaacgacgatgtcctcggcaaacctggcggcagcgcaaaagatg

SEQ ID NO: 190607 - DNA, 103 bp, Artificial Sequence
  Synthetic Polynucleotide
taatacgactcactataggggcgccccgctccgccgggaaggtgccgaggaacagaggagacctcggatgcttcccggcaacctggcggcagcgcaaaagatg

SEQ ID NO: 190608 - DNA, 103 bp, Artificial Sequence
  Synthetic Polynucleotide
taatacgactcactatagggcgcgccccgggcgccccgctccgccgggaaaacagaggagattcccgatggagcggggcaacctggcggcagcgcaaaagatg

SEQ ID NO: 190609 - DNA, 103 bp, Artificial Sequence
  Synthetic Polynucleotide
taatacgactcactatagggcccgctccttcgcgccccgggcgccccgctaacagaggagaagcgggatgcccggggcgaacctggcggcagcgcaaaagatg

SEQ ID NO: 190610 - DNA, 103 bp, Artificial Sequence
  Synthetic Polynucleotide
taatacgactcactatagggagcctcctatcccgctccttcgcgccccggaacagaggagaccggggatggaaggagcgaacctggcggcagcgcaaaagatg

SEQ ID NO: 190611 - DNA, 103 bp, Artificial Sequence
  Synthetic Polynucleotide
taatacgactcactatagggccgcgcgcccagcctcctatcccgctccttaacagaggagaaaggagatggataggaggaacctggcggcagcgcaaaagatg

SEQ ID NO: 190612 - DNA, 103 bp, Artificial Sequence
  Synthetic Polynucleotide
taatacgactcactatagggtcccgtcggccatggctggcgcgcagcccgaacagaggagacgggctatgcgccagccaaacctggcggcagcgcaaaagatg

SEQ ID NO: 190613 - DNA, 103 bp, Artificial Sequence
  Synthetic Polynucleotide
taatacgactcactatagggggcaggcgggccgcgcgcccagcctcctataacagaggagaataggaatgtgggcgcgcaacctggcggcagcgcaaaagatg

SEQ ID NO: 190614 - DNA, 103 bp, Artificial Sequence
  Synthetic Polynucleotide
taatacgactcactatagggggcgccttggggcaggcgggccgcgcgcccaacagaggagagggcgcatggcccgcctgaacctggcggcagcgcaaaagatg

SEQ ID NO: 190615 - DNA, 103 bp, Artificial Sequence
  Synthetic Polynucleotide
taatacgactcactataggggccttcctcgggcgccttggggcaggcgggaacagaggagacccgccatgcccaaggcgaacctggcggcagcgcaaaagatg

SEQ ID NO: 190616 - DNA, 103 bp, Artificial Sequence
  Synthetic Polynucleotide
taatacgactcactatagggagggctcggagccttcctcgggcgccttggaacagaggagaccaaggatgccgaggaagaacctggcggcagcgcaaaagatg

SEQ ID NO: 190617 - DNA, 103 bp, Artificial Sequence
  Synthetic Polynucleotide
taatacgactcactatagggggcggcggggagggctcggagccttcctcgaacagaggagacgaggaatgctccgagccaacctggcggcagcgcaaaagatg

SEQ ID NO: 190618 - DNA, 103 bp, Artificial Sequence
  Synthetic Polynucleotide
taatacgactcactatagggcgccggggctggcggcggggagggctcggaaacagaggagatccgagatgtccccgccgaacctggcggcagcgcaaaagatg

SEQ ID NO: 190619 - DNA, 103 bp, Artificial Sequence
  Synthetic Polynucleotide
taatacgactcactatagggcgggggcgggcgccggggctggcggcggggaacagaggagaccccgcatgcagccccggaacctggcggcagcgcaaaagatg

SEQ ID NO: 190620 - DNA, 103 bp, Artificial Sequence
  Synthetic Polynucleotide
taatacgactcactatagggccttcgtactcgggggcgggcgccggggctaacagaggagaagccccatggcccgccccaacctggcggcagcgcaaaagatg

SEQ ID NO: 190621 - DNA, 103 bp, Artificial Sequence
  Synthetic Polynucleotide
taatacgactcactatagggtggaaccacaccttcgtactcgggggcgggaacagaggagacccgccatggagtacgaaaacctggcggcagcgcaaaagatg

SEQ ID NO: 190622 - DNA, 103 bp, Artificial Sequence
  Synthetic Polynucleotide
taatacgactcactatagggccgtcggttctggaaccacaccttcgtactaacagaggagaagtacgatggtgtggttcaacctggcggcagcgcaaaagatg

SEQ ID NO: 190623 - DNA, 103 bp, Artificial Sequence
  Synthetic Polynucleotide
taatacgactcactatagggagcgagaagctcccgtcggccatggctggcaacagaggagagccagcatgggccgacggaacctggcggcagcgcaaaagatg

SEQ ID NO: 190624 - DNA, 103 bp, Artificial Sequence
  Synthetic Polynucleotide
taatacgactcactataggggtggccggcaagcgagaagctcccgtcggcaacagaggagagccgacatgagcttctcgaacctggcggcagcgcaaaagatg

SEQ ID NO: 190625 - DNA, 103 bp, Artificial Sequence
  Synthetic Polynucleotide
taatacgactcactatagggtgcggagcaggtggccggcaagcgagaagcaacagaggagagcttctatgttgccggccaacctggcggcagcgcaaaagatg

SEQ ID NO: 190626 - DNA, 103 bp, Artificial Sequence
  Synthetic Polynucleotide
taatacgactcactatagggccgcccgggctgcggagcaggtggccggcaaacagaggagatgccggatgcctgctccgaacctggcggcagcgcaaaagatg

SEQ ID NO: 190627 - DNA, 103 bp, Artificial Sequence
  Synthetic Polynucleotide
taatacgactcactatagggcgaggtgctcccgcccgggctgcggagcagaacagaggagactgctcatgagcccgggcaacctggcggcagcgcaaaagatg

SEQ ID NO: 190628 - DNA, 103 bp, Artificial Sequence
  Synthetic Polynucleotide
taatacgactcactatagggtgtgaagtcgcgaggtgctcccgcccgggcaacagaggagagcccggatgggagcacctaacctggcggcagcgcaaaagatg

SEQ ID NO: 190629 - DNA, 103 bp, Artificial Sequence
  Synthetic Polynucleotide
taatacgactcactataggggcctcgatgctgtgaagtcgcgaggtgctcaacagaggagagagcacatggcgacttcaaacctggcggcagcgcaaaagatg

SEQ ID NO: 190630 - DNA, 103 bp, Artificial Sequence
  Synthetic Polynucleotide
taatacgactcactatagggtgccggcccctcgcccgggctcaggaacataacagaggagaatgttcatgagcccgggcaacctggcggcagcgcaaaagatg

SEQ ID NO: 190631 - DNA, 103 bp, Artificial Sequence
  Synthetic Polynucleotide
taatacgactcactataggggtgcagctggtaggtggtgaaggtggtgcgaacagaggagacgcaccatgttcaccaccaacctggcggcagcgcaaaagatg

SEQ ID NO: 190632 - DNA, 103 bp, Artificial Sequence
  Synthetic Polynucleotide
taatacgactcactataggggctccagctggtgcagctggtaggtggtgaaacagaggagatcaccaatgaccagctgcaacctggcggcagcgcaaaagatg

SEQ ID NO: 190633 - DNA, 103 bp, Artificial Sequence
  Synthetic Polynucleotide
taatacgactcactatagggtcgaacgcccgctccagctggtgcagctggaacagaggagaccagctatgccagctggaaacctggcggcagcgcaaaagatg

SEQ ID NO: 190634 - DNA, 103 bp, Artificial Sequence
  Synthetic Polynucleotide
taatacgactcactataggggtgagaggcctcgaacgcccgctccagctgaacagaggagacagctgatgcgggcgttcaacctggcggcagcgcaaaagatg

SEQ ID NO: 190635 - DNA, 103 bp, Artificial Sequence
  Synthetic Polynucleotide
taatacgactcactatagggcatccgggtagtgagaggcctcgaacgcccaacagaggagagggcgtatgaggcctctcaacctggcggcagcgcaaaagatg

SEQ ID NO: 190636 - DNA, 103 bp, Artificial Sequence
  Synthetic Polynucleotide
taatacgactcactatagggcggctgtacacatccgggtagtgagaggccaacagaggagaggcctcatgctacccggaaacctggcggcagcgcaaaagatg

SEQ ID NO: 190637 - DNA, 103 bp, Artificial Sequence
  Synthetic Polynucleotide
taatacgactcactatagggcagctcctcacggctgtacacatccgggtaaacagaggagatacccgatggtgtacagcaacctggcggcagcgcaaaagatg

SEQ ID NO: 190638 - DNA, 103 bp, Artificial Sequence
  Synthetic Polynucleotide
taatacgactcactatagggccttggctgccagctcctcacggctgtacaaacagaggagatgtacaatggtgaggagcaacctggcggcagcgcaaaagatg

SEQ ID NO: 190639 - DNA, 103 bp, Artificial Sequence
  Synthetic Polynucleotide
taatacgactcactatagggggtaggtgcaccttggctgccagctcctcaaacagaggagatgaggaatgggcagccaaaacctggcggcagcgcaaaagatg

SEQ ID NO: 190640 - DNA, 103 bp, Artificial Sequence
  Synthetic Polynucleotide
taatacgactcactataggggcgcacctcaggtaggtgcaccttggctgcaacagaggagagcagccatggtgcacctaaacctggcggcagcgcaaaagatg

SEQ ID NO: 190641 - DNA, 103 bp, Artificial Sequence
  Synthetic Polynucleotide
taatacgactcactatagggcaccctcggttgccggcccctcgcccgggcaacagaggagagcccggatgaggggccggaacctggcggcagcgcaaaagatg

SEQ ID NO: 190642 - DNA, 103 bp, Artificial Sequence
  Synthetic Polynucleotide
taatacgactcactatagggacacctgcacgcgcacctcaggtaggtgcaaacagaggagatgcaccatgctgaggtgcaacctggcggcagcgcaaaagatg

SEQ ID NO: 190643 - DNA, 103 bp, Artificial Sequence
  Synthetic Polynucleotide
taatacgactcactatagggttctggaaccacacctgcacgcgcacctcaaacagaggagatgaggtatgcgtgcaggtaacctggcggcagcgcaaaagatg

SEQ ID NO: 190644 - DNA, 103 bp, Artificial Sequence
  Synthetic Polynucleotide
taatacgactcactatagggggcccggcggttctggaaccacacctgcacaacagaggagagtgcagatgtggttccagaacctggcggcagcgcaaaagatg

SEQ ID NO: 190645 - DNA, 103 bp, Artificial Sequence
  Synthetic Polynucleotide
taatacgactcactatagggggcgccacttggcccggcggttctggaaccaacagaggagaggttccatgaccgccgggaacctggcggcagcgcaaaagatg

SEQ ID NO: 190646 - DNA, 103 bp, Artificial Sequence
  Synthetic Polynucleotide
taatacgactcactatagggcgctcctggcggcgccacttggcccggcggaacagaggagaccgccgatgcaagtggcgaacctggcggcagcgcaaaagatg

SEQ ID NO: 190647 - DNA, 103 bp, Artificial Sequence
  Synthetic Polynucleotide
taatacgactcactatagggtgactccagccgctcctggcggcgccacttaacagaggagaaagtggatgcgccaggagaacctggcggcagcgcaaaagatg

SEQ ID NO: 190648 - DNA, 103 bp, Artificial Sequence
  Synthetic Polynucleotide
taatacgactcactatagggcacccgagcctgactccagccgctcctggcaacagaggagagccaggatgggctggagtaacctggcggcagcgcaaaagatg

SEQ ID NO: 190649 - DNA, 103 bp, Artificial Sequence
  Synthetic Polynucleotide
taatacgactcactataggggctgccacggcacccgagcctgactccagcaacagaggagagctggaatgaggctcgggaacctggcggcagcgcaaaagatg

SEQ ID NO: 190650 - DNA, 103 bp, Artificial Sequence
  Synthetic Polynucleotide
taatacgactcactataggggagtctcggagctgccacggcacccgagccaacagaggagaggctcgatggccgtggcaaacctggcggcagcgcaaaagatg

SEQ ID NO: 190651 - DNA, 103 bp, Artificial Sequence
  Synthetic Polynucleotide
taatacgactcactataggggggcctcggggagtctcggagctgccacggaacagaggagaccgtggatgctccgagacaacctggcggcagcgcaaaagatg

SEQ ID NO: 190652 - DNA, 103 bp, Artificial Sequence
  Synthetic Polynucleotide
taatacgactcactatagggcccagacccccaccctcggttgccggccccaacagaggagaggggccatgaaccgagggaacctggcggcagcgcaaaagatg

SEQ ID NO: 190653 - DNA, 103 bp, Artificial Sequence
  Synthetic Polynucleotide
taatacgactcactatagggggcagcgctggggcctcggggagtctcggaaacagaggagatccgagatgccccgaggcaacctggcggcagcgcaaaagatg

SEQ ID NO: 190654 - DNA, 103 bp, Artificial Sequence
  Synthetic Polynucleotide
taatacgactcactataggggcgggcgaacggcagcgctggggcctcgggaacagaggagacccgagatgccagcgctgaacctggcggcagcgcaaaagatg

SEQ ID NO: 190655 - DNA, 103 bp, Artificial Sequence
  Synthetic Polynucleotide
taatacgactcactatagggtggccggggggcgggcgaacggcagcgctgaacagaggagacagcgcatgcgttcgcccaacctggcggcagcgcaaaagatg

SEQ ID NO: 190656 - DNA, 103 bp, Artificial Sequence
  Synthetic Polynucleotide
taatacgactcactatagggggcagcgacatggccggggggcgggcgaacaacagaggagagttcgcatgccccccggcaacctggcggcagcgcaaaagatg

SEQ ID NO: 190657 - DNA, 103 bp, Artificial Sequence
  Synthetic Polynucleotide
taatacgactcactataggggggctccaggggcagcgacatggccgggggaacagaggagacccccgatgatgtcgctgaacctggcggcagcgcaaaagatg

SEQ ID NO: 190658 - DNA, 103 bp, Artificial Sequence
  Synthetic Polynucleotide
taatacgactcactatagggggcccaaccagggctccaggggcagcgacaaacagaggagatgtcgcatgccctggagcaacctggcggcagcgcaaaagatg

SEQ ID NO: 190659 - DNA, 103 bp, Artificial Sequence
  Synthetic Polynucleotide
taatacgactcactatagggggcggtccggggcccaaccagggctccaggaacagaggagacctggaatgctggttgggaacctggcggcagcgcaaaagatg

SEQ ID NO: 190660 - DNA, 103 bp, Artificial Sequence
  Synthetic Polynucleotide
taatacgactcactatagggtggcacggccggcggtccggggcccaaccaaacagaggagatggttgatgcccggaccgaacctggcggcagcgcaaaagatg

SEQ ID NO: 190661 - DNA, 103 bp, Artificial Sequence
  Synthetic Polynucleotide
taatacgactcactataggggggggaggcctggcacggccggcggtccggaacagaggagaccggacatgcggccgtgcaacctggcggcagcgcaaaagatg

SEQ ID NO: 190662 - DNA, 103 bp, Artificial Sequence
  Synthetic Polynucleotide
taatacgactcactatagggcccaggaggcgggggaggcctggcacggccaacagaggagaggccgtatgaggcctcccaacctggcggcagcgcaaaagatg

SEQ ID NO: 190663 - DNA, 103 bp, Artificial Sequence
  Synthetic Polynucleotide
taatacgactcactatagggctcgcccggccccagacccccaccctcggtaacagaggagaaccgagatggggggtctgaacctggcggcagcgcaaaagatg

SEQ ID NO: 190664 - DNA, 103 bp, Artificial Sequence
  Synthetic Polynucleotide
taatacgactcactatagggcgggcccgggcccaggaggcgggggaggccaacagaggagaggcctcatgcgcctcctgaacctggcggcagcgcaaaagatg

SEQ ID NO: 190665 - DNA, 103 bp, Artificial Sequence
  Synthetic Polynucleotide
taatacgactcactatagggcttgcagccccgggcccgggcccaggaggcaacagaggagagcctccatggcccgggccaacctggcggcagcgcaaaagatg

SEQ ID NO: 190666 - DNA, 103 bp, Artificial Sequence
  Synthetic Polynucleotide
taatacgactcactatagggccgaaggacgcttgcagccccgggcccgggaacagaggagacccgggatgggggctgcaaacctggcggcagcgcaaaagatg

SEQ ID NO: 190667 - DNA, 103 bp, Artificial Sequence
  Synthetic Polynucleotide
taatacgactcactatagggggcatgaggcccgaaggacgcttgcagcccaacagaggagagggctgatggcgtccttcaacctggcggcagcgcaaaagatg

SEQ ID NO: 190668 - DNA, 103 bp, Artificial Sequence
  Synthetic Polynucleotide
taatacgactcactatagggtgggagcaaaggcatgaggcccgaaggacgaacagaggagacgtcctatgggcctcatgaacctggcggcagcgcaaaagatg

SEQ ID NO: 190669 - DNA, 103 bp, Artificial Sequence
  Synthetic Polynucleotide
taatacgactcactatagggtctgcgaaggtgggagcaaaggcatgaggcaacagaggagagcctcaatgctttgctccaacctggcggcagcgcaaaagatg

SEQ ID NO: 190670 - DNA, 103 bp, Artificial Sequence
  Synthetic Polynucleotide
taatacgactcactatagggggcgaagccatctgcgaaggtgggagcaaaaacagaggagatttgctatgaccttcgcaaacctggcggcagcgcaaaagatg

SEQ ID NO: 190671 - DNA, 103 bp, Artificial Sequence
  Synthetic Polynucleotide
taatacgactcactatagggcctcctccagggcgaagccatctgcgaaggaacagaggagaccttcgatgatggcttcgaacctggcggcagcgcaaaagatg

SEQ ID NO: 190672 - DNA, 103 bp, Artificial Sequence
  Synthetic Polynucleotide
taatacgactcactatagggcgcagggacgcctcctccagggcgaagccaaacagaggagatggcttatgcctggaggaaacctggcggcagcgcaaaagatg

SEQ ID NO: 190673 - DNA, 103 bp, Artificial Sequence
  Synthetic Polynucleotide
taatacgactcactatagggggccagcagccgcagggacgcctcctccagaacagaggagactggagatggcgtccctgaacctggcggcagcgcaaaagatg

SEQ ID NO: 190674 - DNA, 103 bp, Artificial Sequence
  Synthetic Polynucleotide
taatacgactcactatagggtgggggcctcctcgcccggccccagaccccaacagaggagaggggtcatgggccgggcgaacctggcggcagcgcaaaagatg

SEQ ID NO: 190675 - DNA, 103 bp, Artificial Sequence
  Synthetic Polynucleotide
taatacgactcactatagggcatgttccttggccagcagccgcagggacgaacagaggagacgtcccatgggctgctggaacctggcggcagcgcaaaagatg

SEQ ID NO: 190676 - DNA, 103 bp, Artificial Sequence
  Synthetic Polynucleotide
taatacgactcactatagggagagcctgtgcatgttccttggccagcagcaacagaggagagctgctatgcaaggaacaaacctggcggcagcgcaaaagatg

SEQ ID NO: 190677 - DNA, 103 bp, Artificial Sequence
  Synthetic Polynucleotide
taatacgactcactatagggggccctgtccagagcctgtgcatgttccttaacagaggagaaaggaaatggcacaggctaacctggcggcagcgcaaaagatg

SEQ ID NO: 190678 - DNA, 103 bp, Artificial Sequence
  Synthetic Polynucleotide
taatacgactcactatagggctggcggccaggccctgtccagagcctgtgaacagaggagacacaggatgtggacagggaacctggcggcagcgcaaaagatg

SEQ ID NO: 190679 - DNA, 103 bp, Artificial Sequence
  Synthetic Polynucleotide
taatacgactcactatagggtgcttcttcttgggggcctcctcgcccggcaacagaggagagccgggatgggaggccccaacctggcggcagcgcaaaagatg

SEQ ID NO: 190680 - DNA, 103 bp, Artificial Sequence
  Synthetic Polynucleotide
taatacgactcactataggggttcctccggtgcttcttcttgggggcctcaacagaggagagaggccatgaagaagaagaacctggcggcagcgcaaaagatg

SEQ ID NO: 190681 - DNA, 103 bp, Artificial Sequence
  Synthetic Polynucleotide
taatacgactcactatagggaggtggtgcggttcctccggtgcttcttctaacagaggagaagaagaatgaccggaggaaacctggcggcagcgcaaaagatg

SEQ ID NO: 190682 - DNA, 103 bp, Artificial Sequence
  Synthetic Polynucleotide
taatacgactcactatagggtaggtggtgaaggtggtgcggttcctccggaacagaggagaccggagatgccgcaccacaacctggcggcagcgcaaaagatg

SEQ ID NO: 190683 - DNA, 103 bp, Artificial Sequence
  Synthetic Polynucleotide
taatacgactcactatagggggccgtttttcggggggttttgggcggcataacagaggagaatgccgatgaaaacccccaacctggcggcagcgcaaaagatg

SEQ ID NO: 190684 - DNA, 103 bp, Artificial Sequence
  Synthetic Polynucleotide
taatacgactcactatagggctccgggccgctgtcctgctctgggtcctcaacagaggagagaggacatggagcaggacaacctggcggcagcgcaaaagatg

SEQ ID NO: 190685 - DNA, 103 bp, Artificial Sequence
  Synthetic Polynucleotide
taatacgactcactatagggatcatgatccaaaaataatcttgcatctagaacagaggagactagatatgagattatttaacctggcggcagcgcaaaagatg

SEQ ID NO: 190686 - DNA, 103 bp, Artificial Sequence
  Synthetic Polynucleotide
taatacgactcactataggggaagagttttatcatgatccaaaaataatcaacagaggagagattatatgtggatcatgaacctggcggcagcgcaaaagatg

SEQ ID NO: 190687 - DNA, 103 bp, Artificial Sequence
  Synthetic Polynucleotide
taatacgactcactataggggaatcagtctgaagagttttatcatgatccaacagaggagaggatcaatgtaaaactctaacctggcggcagcgcaaaagatg

SEQ ID NO: 190688 - DNA, 103 bp, Artificial Sequence
  Synthetic Polynucleotide
taatacgactcactatagggactgtctatagaatcagtctgaagagttttaacagaggagaaaaactatgcagactgataacctggcggcagcgcaaaagatg

SEQ ID NO: 190689 - DNA, 103 bp, Artificial Sequence
  Synthetic Polynucleotide
taatacgactcactataggggtgtttcaaaactgtctatagaatcagtctaacagaggagaagactgatgctatagacaaacctggcggcagcgcaaaagatg

SEQ ID NO: 190690 - DNA, 103 bp, Artificial Sequence
  Synthetic Polynucleotide
taatacgactcactatagggggtgttctctgtgtttcaaaactgtctataaacagaggagatatagaatgttttgaaacaacctggcggcagcgcaaaagatg

SEQ ID NO: 190691 - DNA, 103 bp, Artificial Sequence
  Synthetic Polynucleotide
taatacgactcactatagggactttttcgtggtgttctctgtgtttcaaaaacagaggagatttgaaatgcagagaacaaacctggcggcagcgcaaaagatg

SEQ ID NO: 190692 - DNA, 103 bp, Artificial Sequence
  Synthetic Polynucleotide
taatacgactcactatagggcatcaaggttactttttcgtggtgttctctaacagaggagaagagaaatgcacgaaaaaaacctggcggcagcgcaaaagatg

SEQ ID NO: 190693 - DNA, 103 bp, Artificial Sequence
  Synthetic Polynucleotide
taatacgactcactatagggttcacctcttcatcaaggttactttttcgtaacagaggagaacgaaaatgtaaccttgaaacctggcggcagcgcaaaagatg

SEQ ID NO: 190694 - DNA, 103 bp, Artificial Sequence
  Synthetic Polynucleotide
taatacgactcactatagggaggaattacattcacctcttcatcaaggttaacagaggagaaaccttatggaagaggtgaacctggcggcagcgcaaaagatg

SEQ ID NO: 190695 - DNA, 103 bp, Artificial Sequence
  Synthetic Polynucleotide
taatacgactcactataggggaggcaggtcctccgggccgctgtcctgctaacagaggagaagcaggatggcggcccggaacctggcggcagcgcaaaagatg

SEQ ID NO: 190696 - DNA, 103 bp, Artificial Sequence
  Synthetic Polynucleotide
taatacgactcactataggggagtgtgtggaggaattacattcacctcttaacagaggagaaagaggatgatgtaattcaacctggcggcagcgcaaaagatg

SEQ ID NO: 190697 - DNA, 103 bp, Artificial Sequence
  Synthetic Polynucleotide
taatacgactcactataggggtcctaactggagtgtgtggaggaattacaaacagaggagatgtaatatgtccacacacaacctggcggcagcgcaaaagatg

SEQ ID NO: 190698 - DNA, 103 bp, Artificial Sequence
  Synthetic Polynucleotide
taatacgactcactataggggttcataacagtcctaactggagtgtgtggaacagaggagaccacacatgccagttaggaacctggcggcagcgcaaaagatg

SEQ ID NO: 190699 - DNA, 103 bp, Artificial Sequence
  Synthetic Polynucleotide
taatacgactcactataggggttggatagtgttcataacagtcctaactgaacagaggagacagttaatgctgttatgaaacctggcggcagcgcaaaagatg

SEQ ID NO: 190700 - DNA, 103 bp, Artificial Sequence
  Synthetic Polynucleotide
taatacgactcactatagggatcattaattgttggatagtgttcataacaaacagaggagatgttatatgcactatccaaacctggcggcagcgcaaaagatg

SEQ ID NO: 190701 - DNA, 103 bp, Artificial Sequence
  Synthetic Polynucleotide
taatacgactcactatagggatttaaaatcatcattaattgttggatagtaacagaggagaactatcatgcaattaatgaacctggcggcagcgcaaaagatg

SEQ ID NO: 190702 - DNA, 103 bp, Artificial Sequence
  Synthetic Polynucleotide
taatacgactcactatagggcacttgctgaatttaaaatcatcattaattaacagaggagaaattaaatgtgattttaaaacctggcggcagcgcaaaagatg

SEQ ID NO: 190703 - DNA, 103 bp, Artificial Sequence
  Synthetic Polynucleotide
taatacgactcactataggggaaggttgatcacttgctgaatttaaaatcaacagaggagagattttatgttcagcaagaacctggcggcagcgcaaaagatg

SEQ ID NO: 190704 - DNA, 103 bp, Artificial Sequence
  Synthetic Polynucleotide
taatacgactcactatagggcagattttctgaaggttgatcacttgctgaaacagaggagatcagcaatggatcaacctaacctggcggcagcgcaaaagatg

SEQ ID NO: 190705 - DNA, 103 bp, Artificial Sequence
  Synthetic Polynucleotide
taatacgactcactatagggaataggaaatcagattttctgaaggttgataacagaggagaatcaacatgcagaaaatcaacctggcggcagcgcaaaagatg

SEQ ID NO: 190706 - DNA, 103 bp, Artificial Sequence
  Synthetic Polynucleotide
taatacgactcactatagggagcctgacgagaggcaggtcctccgggccgaacagaggagacggcccatgggacctgccaacctggcggcagcgcaaaagatg

SEQ ID NO: 190707 - DNA, 103 bp, Artificial Sequence
  Synthetic Polynucleotide
taatacgactcactatagggcagttgttaaaataggaaatcagattttctaacagaggagaagaaaaatggatttcctaaacctggcggcagcgcaaaagatg

SEQ ID NO: 190708 - DNA, 103 bp, Artificial Sequence
  Synthetic Polynucleotide
taatacgactcactatagggattcactgtgcagttgttaaaataggaaataacagaggagaatttccatgtttaacaacaacctggcggcagcgcaaaagatg

SEQ ID NO: 190709 - DNA, 103 bp, Artificial Sequence
  Synthetic Polynucleotide
taatacgactcactatagggtttcttttggattcactgtgcagttgttaaaacagaggagattaacaatggcacagtgaaacctggcggcagcgcaaaagatg

SEQ ID NO: 190710 - DNA, 103 bp, Artificial Sequence
  Synthetic Polynucleotide
taatacgactcactatagggttcagtatactttcttttggattcactgtgaacagaggagacacagtatgtccaaaagaaacctggcggcagcgcaaaagatg

SEQ ID NO: 190711 - DNA, 103 bp, Artificial Sequence
  Synthetic Polynucleotide
taatacgactcactatagggcttcactcttttcagtatactttcttttggaacagaggagaccaaaaatgagtatactgaacctggcggcagcgcaaaagatg

SEQ ID NO: 190712 - DNA, 103 bp, Artificial Sequence
  Synthetic Polynucleotide
taatacgactcactatagggatcctatatccttcactcttttcagtatacaacagaggagagtatacatgaaagagtgaaacctggcggcagcgcaaaagatg

SEQ ID NO: 190713 - DNA, 103 bp, Artificial Sequence
  Synthetic Polynucleotide
taatacgactcactatagggttaaagatgtatcctatatccttcactcttaacagaggagaaagagtatgggatataggaacctggcggcagcgcaaaagatg

SEQ ID NO: 190714 - DNA, 103 bp, Artificial Sequence
  Synthetic Polynucleotide
taatacgactcactatagggaaatttctctttaaagatgtatcctatatcaacagaggagagatataatgtacatctttaacctggcggcagcgcaaaagatg

SEQ ID NO: 190715 - DNA, 103 bp, Artificial Sequence
  Synthetic Polynucleotide
taatacgactcactatagggcagctttagcaaatttctctttaaagatgtaacagaggagaacatctatgaagagaaataacctggcggcagcgcaaaagatg

SEQ ID NO: 190716 - DNA, 103 bp, Artificial Sequence
  Synthetic Polynucleotide
taatacgactcactatagggccctgtcccacagctttagcaaatttctctaacagaggagaagagaaatgtgctaaagcaacctggcggcagcgcaaaagatg

SEQ ID NO: 190717 - DNA, 103 bp, Artificial Sequence
  Synthetic Polynucleotide
taatacgactcactatagggttcaaactcaagcctgacgagaggcaggtcaacagaggagagacctgatgctcgtcaggaacctggcggcagcgcaaaagatg

SEQ ID NO: 190718 - DNA, 103 bp, Artificial Sequence
  Synthetic Polynucleotide
taatacgactcactatagggttcgacacaaccctgtcccacagctttagcaacagaggagagctaaaatggtgggacagaacctggcggcagcgcaaaagatg

SEQ ID NO: 190719 - DNA, 103 bp, Artificial Sequence
  Synthetic Polynucleotide
taatacgactcactataggggtgatccaatttcgacacaaccctgtcccaaacagaggagatgggacatggttgtgtcgaacctggcggcagcgcaaaagatg

SEQ ID NO: 190720 - DNA, 103 bp, Artificial Sequence
  Synthetic Polynucleotide
taatacgactcactatagggttgtatcgctgtgatccaatttcgacacaaaacagaggagattgtgtatgaattggatcaacctggcggcagcgcaaaagatg

SEQ ID NO: 190721 - DNA, 103 bp, Artificial Sequence
  Synthetic Polynucleotide
taatacgactcactatagggaactccaagtttgtatcgctgtgatccaataacagaggagaattggaatgcagcgatacaacctggcggcagcgcaaaagatg

SEQ ID NO: 190722 - DNA, 103 bp, Artificial Sequence
  Synthetic Polynucleotide
taatacgactcactatagggaatacaagcgaactccaagtttgtatcgctaacagaggagaagcgatatgaacttggagaacctggcggcagcgcaaaagatg

SEQ ID NO: 190723 - DNA, 103 bp, Artificial Sequence
  Synthetic Polynucleotide
taatacgactcactatagggattactcggtaatacaagcgaactccaagtaacagaggagaacttggatgtcgcttgtaaacctggcggcagcgcaaaagatg

SEQ ID NO: 190724 - DNA, 103 bp, Artificial Sequence
  Synthetic Polynucleotide
taatacgactcactatagggcatggattccattactcggtaatacaagcgaacagaggagacgcttgatgtaccgagtaaacctggcggcagcgcaaaagatg

SEQ ID NO: 190725 - DNA, 103 bp, Artificial Sequence
  Synthetic Polynucleotide
taatacgactcactatagggctgatttaagcatggattccattactcggtaacagaggagaaccgagatgtggaatccaaacctggcggcagcgcaaaagatg

SEQ ID NO: 190726 - DNA, 103 bp, Artificial Sequence
  Synthetic Polynucleotide
taatacgactcactatagggcgttcttcttctgatttaagcatggattccaacagaggagaggaatcatggcttaaatcaacctggcggcagcgcaaaagatg

SEQ ID NO: 190727 - DNA, 103 bp, Artificial Sequence
  Synthetic Polynucleotide
taatacgactcactatagggaatggataatcgttcttcttctgatttaagaacagaggagacttaaaatggaagaagaaaacctggcggcagcgcaaaagatg

SEQ ID NO: 190728 - DNA, 103 bp, Artificial Sequence
  Synthetic Polynucleotide
taatacgactcactatagggcttctgtttcttcaaactcaagcctgacgaaacagaggagatcgtcaatgttgagtttgaacctggcggcagcgcaaaagatg

SEQ ID NO: 190729 - DNA, 103 bp, Artificial Sequence
  Synthetic Polynucleotide
taatacgactcactatagggtaaaattttgaatggataatcgttcttcttaacagaggagaaagaagatggattatccaaacctggcggcagcgcaaaagatg

SEQ ID NO: 190730 - DNA, 103 bp, Artificial Sequence
  Synthetic Polynucleotide
taatacgactcactatagggagaagtttgctaaaattttgaatggataataacagaggagaattatcatgtcaaaatttaacctggcggcagcgcaaaagatg

SEQ ID NO: 190731 - DNA, 103 bp, Artificial Sequence
  Synthetic Polynucleotide
taatacgactcactataggggttgtcattcagaagtttgctaaaattttgaacagaggagacaaaatatgagcaaacttaacctggcggcagcgcaaaagatg

SEQ ID NO: 190732 - DNA, 103 bp, Artificial Sequence
  Synthetic Polynucleotide
taatacgactcactatagggtatgaaaaatgttgtcattcagaagtttgcaacagaggagagcaaacatgtgaatgacaaacctggcggcagcgcaaaagatg

SEQ ID NO: 190733 - DNA, 103 bp, Artificial Sequence
  Synthetic Polynucleotide
taatacgactcactatagggaataaagacatatgaaaaatgttgtcattcaacagaggagagaatgaatgcatttttcaaacctggcggcagcgcaaaagatg

SEQ ID NO: 190734 - DNA, 103 bp, Artificial Sequence
  Synthetic Polynucleotide
taatacgactcactatagggagcgcacgccaataaagacatatgaaaaataacagaggagaatttttatgatgtctttaaacctggcggcagcgcaaaagatg

SEQ ID NO: 190735 - DNA, 103 bp, Artificial Sequence
  Synthetic Polynucleotide
taatacgactcactatagggcaacctcaagagcgcacgccaataaagacaaacagaggagatgtcttatgtggcgtgcgaacctggcggcagcgcaaaagatg

SEQ ID NO: 190736 - DNA, 103 bp, Artificial Sequence
  Synthetic Polynucleotide
taatacgactcactataggggtggccattacaacctcaagagcgcacgccaacagaggagaggcgtgatgtcttgaggtaacctggcggcagcgcaaaagatg

SEQ ID NO: 190737 - DNA, 103 bp, Artificial Sequence
  Synthetic Polynucleotide
taatacgactcactatagggtctgctatatgtggccattacaacctcaagaacagaggagacttgagatggtaatggccaacctggcggcagcgcaaaagatg

SEQ ID NO: 190738 - DNA, 103 bp, Artificial Sequence
  Synthetic Polynucleotide
taatacgactcactataggggagatgtacttctgctatatgtggccattaaacagaggagataatggatgcatatagcaaacctggcggcagcgcaaaagatg

SEQ ID NO: 190739 - DNA, 103 bp, Artificial Sequence
  Synthetic Polynucleotide
taatacgactcactatagggaaatcaggttcttctgtttcttcaaactcaaacagaggagatgagttatgagaaacagaaacctggcggcagcgcaaaagatg

SEQ ID NO: 190740 - DNA, 103 bp, Artificial Sequence
  Synthetic Polynucleotide
taatacgactcactatagggtcaagattctgagatgtacttctgctatataacagaggagaatatagatgaagtacatcaacctggcggcagcgcaaaagatg

SEQ ID NO: 190741 - DNA, 103 bp, Artificial Sequence
  Synthetic Polynucleotide
taatacgactcactatagggtgttccagaatcaagattctgagatgtactaacagaggagaagtacaatgcagaatcttaacctggcggcagcgcaaaagatg

SEQ ID NO: 190742 - DNA, 103 bp, Artificial Sequence
  Synthetic Polynucleotide
taatacgactcactatagggaagacaaatctgttccagaatcaagattctaacagaggagaagaatcatgattctggaaaacctggcggcagcgcaaaagatg

SEQ ID NO: 190743 - DNA, 103 bp, Artificial Sequence
  Synthetic Polynucleotide
taatacgactcactatagggatccatgggaaagacaaatctgttccagaaaacagaggagattctggatgagatttgtcaacctggcggcagcgcaaaagatg

SEQ ID NO: 190744 - DNA, 103 bp, Artificial Sequence
  Synthetic Polynucleotide
taatacgactcactatagggcacattcagaatccatgggaaagacaaatcaacagaggagagatttgatgttcccatggaacctggcggcagcgcaaaagatg

SEQ ID NO: 190745 - DNA, 103 bp, Artificial Sequence
  Synthetic Polynucleotide
taatacgactcactatagggttaaattaagcacattcagaatccatgggaaacagaggagatcccatatgttctgaatgaacctggcggcagcgcaaaagatg

SEQ ID NO: 190746 - DNA, 103 bp, Artificial Sequence
  Synthetic Polynucleotide
taatacgactcactatagggtcaaaggcttttaaattaagcacattcagaaacagaggagatctgaaatggcttaatttaacctggcggcagcgcaaaagatg

SEQ ID NO: 190747 - DNA, 103 bp, Artificial Sequence
  Synthetic Polynucleotide
taatacgactcactatagggtttgtaaaaatcaaaggcttttaaattaagaacagaggagacttaatatgaaagcctttaacctggcggcagcgcaaaagatg

SEQ ID NO: 190748 - DNA, 103 bp, Artificial Sequence
  Synthetic Polynucleotide
taatacgactcactatagggtttcgatcactttgtaaaaatcaaaggcttaacagaggagaaagcctatgatttttacaaacctggcggcagcgcaaaagatg

SEQ ID NO: 190749 - DNA, 103 bp, Artificial Sequence
  Synthetic Polynucleotide
taatacgactcactatagggttgataaaactttcgatcactttgtaaaaaaacagaggagatttttaatgagtgatcgaaacctggcggcagcgcaaaagatg

SEQ ID NO: 190750 - DNA, 103 bp, Artificial Sequence
  Synthetic Polynucleotide
taatacgactcactatagggtaatgcagtaaaatcaggttcttctgtttcaacagaggagagaaacaatggaacctgataacctggcggcagcgcaaaagatg

SEQ ID NO: 190751 - DNA, 103 bp, Artificial Sequence
  Synthetic Polynucleotide
taatacgactcactataggggccttctgctttgataaaactttcgatcacaacagaggagagtgatcatgagttttatcaacctggcggcagcgcaaaagatg

SEQ ID NO: 190752 - DNA, 103 bp, Artificial Sequence
  Synthetic Polynucleotide
taatacgactcactatagggttgtcaagttgccttctgctttgataaaacaacagaggagagttttaatgaagcagaagaacctggcggcagcgcaaaagatg

SEQ ID NO: 190753 - DNA, 103 bp, Artificial Sequence
  Synthetic Polynucleotide
taatacgactcactatagggatcatttctcttgtcaagttgccttctgctaacagaggagaagcagaatgcaacttgacaacctggcggcagcgcaaaagatg

SEQ ID NO: 190754 - DNA, 103 bp, Artificial Sequence
  Synthetic Polynucleotide
taatacgactcactatagggtaaatgttttatcatttctcttgtcaagttaacagaggagaaacttgatgagagaaatgaacctggcggcagcgcaaaagatg

SEQ ID NO: 190755 - DNA, 103 bp, Artificial Sequence
  Synthetic Polynucleotide
taatacgactcactatagggcacatcgttctaaatgttttatcatttctcaacagaggagagagaaaatgtaaaacattaacctggcggcagcgcaaaagatg

SEQ ID NO: 190756 - DNA, 103 bp, Artificial Sequence
  Synthetic Polynucleotide
taatacgactcactatagggattcgatgttcacatcgttctaaatgttttaacagaggagaaaaacaatgagaacgatgaacctggcggcagcgcaaaagatg

SEQ ID NO: 190757 - DNA, 103 bp, Artificial Sequence
  Synthetic Polynucleotide
taatacgactcactatagggggattccatgattcgatgttcacatcgttcaacagaggagagaacgaatggaacatcgaaacctggcggcagcgcaaaagatg

SEQ ID NO: 190758 - DNA, 103 bp, Artificial Sequence
  Synthetic Polynucleotide
taatacgactcactataggggccatgcaagggattccatgattcgatgttaacagaggagaaacatcatgtcatggaataacctggcggcagcgcaaaagatg

SEQ ID NO: 190759 - DNA, 103 bp, Artificial Sequence
  Synthetic Polynucleotide
taatacgactcactataggggaatctgagagccatgcaagggattccatgaacagaggagacatggaatgccttgcatgaacctggcggcagcgcaaaagatg

SEQ ID NO: 190760 - DNA, 103 bp, Artificial Sequence
  Synthetic Polynucleotide
taatacgactcactatagggaaataaaggtgaatctgagagccatgcaagaacagaggagacttgcaatgctctcagataacctggcggcagcgcaaaagatg

SEQ ID NO: 190761 - DNA, 103 bp, Artificial Sequence
  Synthetic Polynucleotide
taatacgactcactatagggatttctgacataatgcagtaaaatcaggttaacagaggagaaacctgatgttactgcataacctggcggcagcgcaaaagatg

SEQ ID NO: 190762 - DNA, 103 bp, Artificial Sequence
  Synthetic Polynucleotide
taatacgactcactatagggtaataagatcaaataaaggtgaatctgagaaacagaggagatctcagatgcacctttataacctggcggcagcgcaaaagatg

SEQ ID NO: 190763 - DNA, 103 bp, Artificial Sequence
  Synthetic Polynucleotide
taatacgactcactatagggtttgattgtttaataagatcaaataaaggtaacagaggagaacctttatgtgatcttataacctggcggcagcgcaaaagatg

SEQ ID NO: 190764 - DNA, 103 bp, Artificial Sequence
  Synthetic Polynucleotide
taatacgactcactatagggttctcggtcctttgattgtttaataagatcaacagaggagagatcttatgaaacaatcaaacctggcggcagcgcaaaagatg

SEQ ID NO: 190765 - DNA, 103 bp, Artificial Sequence
  Synthetic Polynucleotide
taatacgactcactatagggcagttggtccttctcggtcctttgattgttaacagaggagaaacaatatgaggaccgagaacctggcggcagcgcaaaagatg

SEQ ID NO: 190766 - DNA, 103 bp, Artificial Sequence
  Synthetic Polynucleotide
taatacgactcactatagggtcaaggtgatcagttggtccttctcggtccaacagaggagaggaccgatgaggaccaacaacctggcggcagcgcaaaagatg

SEQ ID NO: 190767 - DNA, 103 bp, Artificial Sequence
  Synthetic Polynucleotide
taatacgactcactatagggacaagcagattcaaggtgatcagttggtccaacagaggagaggaccaatggatcaccttaacctggcggcagcgcaaaagatg

SEQ ID NO: 190768 - DNA, 103 bp, Artificial Sequence
  Synthetic Polynucleotide
taatacgactcactataggggattaagaggacaagcagattcaaggtgataacagaggagaatcaccatgaatctgcttaacctggcggcagcgcaaaagatg

SEQ ID NO: 190769 - DNA, 103 bp, Artificial Sequence
  Synthetic Polynucleotide
taatacgactcactatagggtggagaggaagattaagaggacaagcagataacagaggagaatctgcatgtcctcttaaaacctggcggcagcgcaaaagatg

SEQ ID NO: 190770 - DNA, 103 bp, Artificial Sequence
  Synthetic Polynucleotide
taatacgactcactataggggtgattattctggagaggaagattaagaggaacagaggagacctcttatgcttcctctcaacctggcggcagcgcaaaagatg

SEQ ID NO: 190771 - DNA, 103 bp, Artificial Sequence
  Synthetic Polynucleotide
taatacgactcactatagggctgctgcagtgtgattattctggagaggaaaacagaggagattcctcatgagaataatcaacctggcggcagcgcaaaagatg

SEQ ID NO: 190772 - DNA, 103 bp, Artificial Sequence
  Synthetic Polynucleotide
taatacgactcactatagggggtatctttaatttctgacataatgcagtaaacagaggagatactgcatgatgtcagaaaacctggcggcagcgcaaaagatg

SEQ ID NO: 190773 - DNA, 103 bp, Artificial Sequence
  Synthetic Polynucleotide
taatacgactcactatagggagatacatatctgctgcagtgtgattattcaacagaggagagaataaatgcactgcagcaacctggcggcagcgcaaaagatg

SEQ ID NO: 190774 - DNA, 103 bp, Artificial Sequence
  Synthetic Polynucleotide
taatacgactcactatagggtacaggagaaagatacatatctgctgcagtaacagaggagaactgcaatggatatgtataacctggcggcagcgcaaaagatg

SEQ ID NO: 190775 - DNA, 103 bp, Artificial Sequence
  Synthetic Polynucleotide
taatacgactcactatagggttggagatcttacaggagaaagatacatataacagaggagaatatgtatgtttctcctgaacctggcggcagcgcaaaagatg

SEQ ID NO: 190776 - DNA, 103 bp, Artificial Sequence
  Synthetic Polynucleotide
taatacgactcactatagggccttttttctttggagatcttacaggagaaaacagaggagattctccatgaagatctccaacctggcggcagcgcaaaagatg

SEQ ID NO: 190777 - DNA, 103 bp, Artificial Sequence
  Synthetic Polynucleotide
taatacgactcactatagggcgtagttgaaccttttttctttggagatctaacagaggagaagatctatgaagaaaaaaaacctggcggcagcgcaaaagatg

SEQ ID NO: 190778 - DNA, 103 bp, Artificial Sequence
  Synthetic Polynucleotide
taatacgactcactatagggaatttacacgcgtagttgaaccttttttctaacagaggagaagaaaaatggttcaactaaacctggcggcagcgcaaaagatg

SEQ ID NO: 190779 - DNA, 103 bp, Artificial Sequence
  Synthetic Polynucleotide
taatacgactcactatagggtttgcagtagaatttacacgcgtagttgaaaacagaggagattcaacatggcgtgtaaaaacctggcggcagcgcaaaagatg

SEQ ID NO: 190780 - DNA, 103 bp, Artificial Sequence
  Synthetic Polynucleotide
taatacgactcactatagggtgtctctgcatttgcagtagaatttacacgaacagaggagacgtgtaatgtctactgcaaacctggcggcagcgcaaaagatg

SEQ ID NO: 190781 - DNA, 103 bp, Artificial Sequence
  Synthetic Polynucleotide
taatacgactcactatagggaggttgcttgtgtctctgcatttgcagtagaacagaggagactactgatgatgcagagaaacctggcggcagcgcaaaagatg

SEQ ID NO: 190782 - DNA, 103 bp, Artificial Sequence
  Synthetic Polynucleotide
taatacgactcactatagggtggaaggctgaggttgcttgtgtctctgcaaacagaggagatgcagaatgacaagcaacaacctggcggcagcgcaaaagatg

SEQ ID NO: 190783 - DNA, 103 bp, Artificial Sequence
  Synthetic Polynucleotide
taatacgactcactataggggacatgatctggtatctttaatttctgacaaacagaggagatgtcagatgttaaagataaacctggcggcagcgcaaaagatg

SEQ ID NO: 190784 - DNA, 103 bp, Artificial Sequence
  Synthetic Polynucleotide
taatacgactcactatagggcttctgggtctggaaggctgaggttgcttgaacagaggagacaagcaatgtcagccttcaacctggcggcagcgcaaaagatg

SEQ ID NO: 190785 - DNA, 103 bp, Artificial Sequence
  Synthetic Polynucleotide
taatacgactcactatagggatttcaatggcttctgggtctggaaggctgaacagaggagacagcctatgagacccagaaacctggcggcagcgcaaaagatg

SEQ ID NO: 190786 - DNA, 103 bp, Artificial Sequence
  Synthetic Polynucleotide
taatacgactcactatagggagagaggtagatttcaatggcttctgggtcaacagaggagagacccaatggccattgaaaacctggcggcagcgcaaaagatg

SEQ ID NO: 190787 - DNA, 103 bp, Artificial Sequence
  Synthetic Polynucleotide
taatacgactcactatagggaaacagtgaaagagaggtagatttcaatggaacagaggagaccattgatgtctacctctaacctggcggcagcgcaaaagatg

SEQ ID NO: 190788 - DNA, 103 bp, Artificial Sequence
  Synthetic Polynucleotide
taatacgactcactatagggcttttttataaaacagtgaaagagaggtagaacagaggagactacctatgtttcactgtaacctggcggcagcgcaaaagatg

SEQ ID NO: 190789 - DNA, 103 bp, Artificial Sequence
  Synthetic Polynucleotide
taatacgactcactatagggagccgatacacttttttataaaacagtgaaaacagaggagattcactatgttataaaaaaacctggcggcagcgcaaaagatg

SEQ ID NO: 190790 - DNA, 103 bp, Artificial Sequence
  Synthetic Polynucleotide
taatacgactcactataggggagataggctagccgatacacttttttataaacagaggagatataaaatggtgtatcggaacctggcggcagcgcaaaagatg

SEQ ID NO: 190791 - DNA, 103 bp, Artificial Sequence
  Synthetic Polynucleotide
taatacgactcactatagggtatttagccggagataggctagccgatacaaacagaggagatgtatcatgtagcctatcaacctggcggcagcgcaaaagatg

SEQ ID NO: 190792 - DNA, 103 bp, Artificial Sequence
  Synthetic Polynucleotide
taatacgactcactatagggtcacaaagtgtatttagccggagataggctaacagaggagaagcctaatgccggctaaaaacctggcggcagcgcaaaagatg

SEQ ID NO: 190793 - DNA, 103 bp, Artificial Sequence
  Synthetic Polynucleotide
taatacgactcactatagggcagaaggcgttcacaaagtgtatttagccgaacagaggagacggctaatgacactttgtaacctggcggcagcgcaaaagatg

SEQ ID NO: 190794 - DNA, 103 bp, Artificial Sequence
  Synthetic Polynucleotide
taatacgactcactatagggcggcggtggcggccgtttttcggggggtttaacagaggagaaaacccatggaaaaacggaacctggcggcagcgcaaaagatg

SEQ ID NO: 190795 - DNA, 103 bp, Artificial Sequence
  Synthetic Polynucleotide
taatacgactcactatagggctctctctctgacatgatctggtatctttaaacagaggagataaagaatgcagatcatgaacctggcggcagcgcaaaagatg

SEQ ID NO: 190796 - DNA, 103 bp, Artificial Sequence
  Synthetic Polynucleotide
taatacgactcactatagggggtgctcagacagaaggcgttcacaaagtgaacagaggagacactttatgaacgccttcaacctggcggcagcgcaaaagatg

SEQ ID NO: 190797 - DNA, 103 bp, Artificial Sequence
  Synthetic Polynucleotide
taatacgactcactatagggtctaattctgggtgctcagacagaaggcgtaacagaggagaacgcctatggtctgagcaaacctggcggcagcgcaaaagatg

SEQ ID NO: 190798 - DNA, 103 bp, Artificial Sequence
  Synthetic Polynucleotide
taatacgactcactataggggatgatatgttctaattctgggtgctcagaaacagaggagatctgagatgccagaattaaacctggcggcagcgcaaaagatg

SEQ ID NO: 190799 - DNA, 103 bp, Artificial Sequence
  Synthetic Polynucleotide
taatacgactcactatagggaaagggtccagatgatatgttctaattctgaacagaggagacagaatatgaacatatcaaacctggcggcagcgcaaaagatg

SEQ ID NO: 190800 - DNA, 103 bp, Artificial Sequence
  Synthetic Polynucleotide
taatacgactcactataggggtgtgctggaaaagggtccagatgatatgtaacagaggagaacatatatgctggaccctaacctggcggcagcgcaaaagatg

SEQ ID NO: 190801 - DNA, 103 bp, Artificial Sequence
  Synthetic Polynucleotide
taatacgactcactatagggattctgcagggtgtgctggaaaagggtccaaacagaggagatggaccatgttccagcacaacctggcggcagcgcaaaagatg

SEQ ID NO: 190802 - DNA, 103 bp, Artificial Sequence
  Synthetic Polynucleotide
taatacgactcactataggggttcatactcattctgcagggtgtgctggaaacagaggagatccagcatgccctgcagaaacctggcggcagcgcaaaagatg

SEQ ID NO: 190803 - DNA, 103 bp, Artificial Sequence
  Synthetic Polynucleotide
taatacgactcactatagggtctctcatgagttcatactcattctgcaggaacagaggagacctgcaatgtgagtatgaaacctggcggcagcgcaaaagatg

SEQ ID NO: 190804 - DNA, 103 bp, Artificial Sequence
  Synthetic Polynucleotide
taatacgactcactatagggcaaatgcctgtctctcatgagttcatactcaacagaggagagagtatatgctcatgagaaacctggcggcagcgcaaaagatg

SEQ ID NO: 190805 - DNA, 103 bp, Artificial Sequence
  Synthetic Polynucleotide
taatacgactcactatagggtaatttggtccaaatgcctgtctctcatgaaacagaggagatcatgaatgacaggcattaacctggcggcagcgcaaaagatg

SEQ ID NO: 190806 - DNA, 103 bp, Artificial Sequence
  Synthetic Polynucleotide
taatacgactcactataggggttaaccaagctctctctctgacatgatctaacagaggagaagatcaatgcagagagagaacctggcggcagcgcaaaagatg

SEQ ID NO: 190807 - DNA, 103 bp, Artificial Sequence
  Synthetic Polynucleotide
taatacgactcactataggggaacacatcataatttggtccaaatgcctgaacagaggagacaggcaatgggaccaaataacctggcggcagcgcaaaagatg

SEQ ID NO: 190808 - DNA, 103 bp, Artificial Sequence
  Synthetic Polynucleotide
taatacgactcactataggggccatacatggaacacatcataatttggtcaacagaggagagaccaaatgatgatgtgtaacctggcggcagcgcaaaagatg

SEQ ID NO: 190809 - DNA, 103 bp, Artificial Sequence
  Synthetic Polynucleotide
taatacgactcactatagggctttgcatatgccatacatggaacacatcaaacagaggagatgatgtatgccatgtatgaacctggcggcagcgcaaaagatg

SEQ ID NO: 190810 - DNA, 103 bp, Artificial Sequence
  Synthetic Polynucleotide
taatacgactcactatagggatattcttcactttgcatatgccatacatgaacagaggagacatgtaatgcatatgcaaaacctggcggcagcgcaaaagatg

SEQ ID NO: 190811 - DNA, 103 bp, Artificial Sequence
  Synthetic Polynucleotide
taatacgactcactatagggtttaaggtctatattcttcactttgcatataacagaggagaatatgcatggtgaagaataacctggcggcagcgcaaaagatg

SEQ ID NO: 190812 - DNA, 103 bp, Artificial Sequence
  Synthetic Polynucleotide
taatacgactcactatagggtgattttgaatttaaggtctatattcttcaaacagaggagatgaagaatgtagaccttaaacctggcggcagcgcaaaagatg

SEQ ID NO: 190813 - DNA, 103 bp, Artificial Sequence
  Synthetic Polynucleotide
taatacgactcactataggggctgttacaatgattttgaatttaaggtctaacagaggagaagacctatgattcaaaataacctggcggcagcgcaaaagatg

SEQ ID NO: 190814 - DNA, 103 bp, Artificial Sequence
  Synthetic Polynucleotide
taatacgactcactatagggatccttgtatgctgttacaatgattttgaaaacagaggagattcaaaatgattgtaacaaacctggcggcagcgcaaaagatg

SEQ ID NO: 190815 - DNA, 103 bp, Artificial Sequence
  Synthetic Polynucleotide
taatacgactcactatagggcatgaggaagatccttgtatgctgttacaaaacagaggagattgtaaatgcatacaaggaacctggcggcagcgcaaaagatg

SEQ ID NO: 190816 - DNA, 103 bp, Artificial Sequence
  Synthetic Polynucleotide
taatacgactcactatagggtcctgaacagcatgaggaagatccttgtataacagaggagaatacaaatgtcttcctcaaacctggcggcagcgcaaaagatg

SEQ ID NO: 190817 - DNA, 103 bp, Artificial Sequence
  Synthetic Polynucleotide
taatacgactcactatagggtttctcccaagttaaccaagctctctctctaacagaggagaagagagatggcttggttaaacctggcggcagcgcaaaagatg

SEQ ID NO: 190818 - DNA, 103 bp, Artificial Sequence
  Synthetic Polynucleotide
taatacgactcactatagggtttgaatgtctcctgaacagcatgaggaagaacagaggagacttcctatggctgttcagaacctggcggcagcgcaaaagatg

SEQ ID NO: 190819 - DNA, 103 bp, Artificial Sequence
  Synthetic Polynucleotide
taatacgactcactatagggtcaaaacacgtttgaatgtctcctgaacagaacagaggagactgttcatgagacattcaaacctggcggcagcgcaaaagatg

SEQ ID NO: 190820 - DNA, 103 bp, Artificial Sequence
  Synthetic Polynucleotide
taatacgactcactatagggtcttctttgatcaaaacacgtttgaatgtcaacagaggagagacattatgacgtgttttaacctggcggcagcgcaaaagatg

SEQ ID NO: 190821 - DNA, 103 bp, Artificial Sequence
  Synthetic Polynucleotide
taatacgactcactatagggatcatactcctcttctttgatcaaaacacgaacagaggagacgtgttatgatcaaagaaaacctggcggcagcgcaaaagatg

SEQ ID NO: 190822 - DNA, 103 bp, Artificial Sequence
  Synthetic Polynucleotide
taatacgactcactatagggctataatagaatcatactcctcttctttgaaacagaggagatcaaagatgaggagtatgaacctggcggcagcgcaaaagatg

SEQ ID NO: 190823 - DNA, 103 bp, Artificial Sequence
  Synthetic Polynucleotide
taatacgactcactatagggttatagaatactataatagaatcatactccaacagaggagaggagtaatgttctattataacctggcggcagcgcaaaagatg

SEQ ID NO: 190824 - DNA, 103 bp, Artificial Sequence
  Synthetic Polynucleotide
taatacgactcactataggggaagaccgagttatagaatactataatagaaacagaggagatctattatggtattctataacctggcggcagcgcaaaagatg

SEQ ID NO: 190825 - DNA, 103 bp, Artificial Sequence
  Synthetic Polynucleotide
taatacgactcactataggggtctctgcatgaagaccgagttatagaataaacagaggagatattctatgactcggtctaacctggcggcagcgcaaaagatg

SEQ ID NO: 190826 - DNA, 103 bp, Artificial Sequence
  Synthetic Polynucleotide
taatacgactcactatagggtttgttttcagtctctgcatgaagaccgagaacagaggagactcggtatgcatgcagagaacctggcggcagcgcaaaagatg

SEQ ID NO: 190827 - DNA, 103 bp, Artificial Sequence
  Synthetic Polynucleotide
taatacgactcactatagggctgcaaaatatttgttttcagtctctgcataacagaggagaatgcagatgctgaaaacaaacctggcggcagcgcaaaagatg

SEQ ID NO: 190828 - DNA, 103 bp, Artificial Sequence
  Synthetic Polynucleotide
taatacgactcactatagggcagatgaaactttctcccaagttaaccaagaacagaggagacttggtatgcttgggagaaacctggcggcagcgcaaaagatg

SEQ ID NO: 190829 - DNA, 103 bp, Artificial Sequence
  Synthetic Polynucleotide
taatacgactcactatagggtggaagcatactgcaaaatatttgttttcaaacagaggagatgaaaaatgatattttgcaacctggcggcagcgcaaaagatg

SEQ ID NO: 190830 - DNA, 103 bp, Artificial Sequence
  Synthetic Polynucleotide
taatacgactcactataggggggggcctggtggaagcatactgcaaaataaacagaggagatattttatggtatgcttcaacctggcggcagcgcaaaagatg

SEQ ID NO: 190831 - DNA, 103 bp, Artificial Sequence
  Synthetic Polynucleotide
taatacgactcactatagggtgacaaggtagggggcctggtggaagcataaacagaggagatatgctatgaccaggcccaacctggcggcagcgcaaaagatg

SEQ ID NO: 190832 - DNA, 103 bp, Artificial Sequence
  Synthetic Polynucleotide
taatacgactcactataggggaggtattggtgacaaggtagggggcctggaacagaggagaccaggcatgctaccttgtaacctggcggcagcgcaaaagatg

SEQ ID NO: 190833 - DNA, 103 bp, Artificial Sequence
  Synthetic Polynucleotide
taatacgactcactatagggcgaggaatgtgaggtattggtgacaaggtaaacagaggagataccttatgaccaataccaacctggcggcagcgcaaaagatg

SEQ ID NO: 190834 - DNA, 103 bp, Artificial Sequence
  Synthetic Polynucleotide
taatacgactcactataggggtaagggcttcgaggaatgtgaggtattggaacagaggagaccaataatgcacattcctaacctggcggcagcgcaaaagatg

SEQ ID NO: 190835 - DNA, 103 bp, Artificial Sequence
  Synthetic Polynucleotide
taatacgactcactatagggtaggaaacttgtaagggcttcgaggaatgtaacagaggagaacattcatggaagcccttaacctggcggcagcgcaaaagatg

SEQ ID NO: 190836 - DNA, 103 bp, Artificial Sequence
  Synthetic Polynucleotide
taatacgactcactatagggaagggtgaactaggaaacttgtaagggcttaacagaggagaaagcccatgcaagtttccaacctggcggcagcgcaaaagatg

SEQ ID NO: 190837 - DNA, 103 bp, Artificial Sequence
  Synthetic Polynucleotide
taatacgactcactatagggaggaatccgtaagggtgaactaggaaacttaacagaggagaaagtttatgagttcacccaacctggcggcagcgcaaaagatg

SEQ ID NO: 190838 - DNA, 103 bp, Artificial Sequence
  Synthetic Polynucleotide
taatacgactcactatagggtgttccctccaggaatccgtaagggtgaacaacagaggagagttcacatgtacggattcaacctggcggcagcgcaaaagatg

SEQ ID NO: 190839 - DNA, 103 bp, Artificial Sequence
  Synthetic Polynucleotide
taatacgactcactatagggactccatccacagatgaaactttctcccaaaacagaggagattgggaatgagtttcatcaacctggcggcagcgcaaaagatg

SEQ ID NO: 190840 - DNA, 103 bp, Artificial Sequence
  Synthetic Polynucleotide
taatacgactcactataggggaaatatagatgttccctccaggaatccgtaacagaggagaacggatatgtggagggaaaacctggcggcagcgcaaaagatg

SEQ ID NO: 190841 - DNA, 103 bp, Artificial Sequence
  Synthetic Polynucleotide
taatacgactcactatagggcttcaggggtgaaatatagatgttccctccaacagaggagaggagggatgatctatattaacctggcggcagcgcaaaagatg

SEQ ID NO: 190842 - DNA, 103 bp, Artificial Sequence
  Synthetic Polynucleotide
taatacgactcactatagggtatatggactcttcaggggtgaaatatagaaacagaggagatctataatgcacccctgaaacctggcggcagcgcaaaagatg

SEQ ID NO: 190843 - DNA, 103 bp, Artificial Sequence
  Synthetic Polynucleotide
taatacgactcactatagggtctgaaattttatatggactcttcaggggtaacagaggagaacccctatggagtccataaacctggcggcagcgcaaaagatg

SEQ ID NO: 190844 - DNA, 103 bp, Artificial Sequence
  Synthetic Polynucleotide
taatacgactcactatagggtggcagaccttctgaaattttatatggactaacagaggagaagtccaatgaaaatttcaaacctggcggcagcgcaaaagatg

SEQ ID NO: 190845 - DNA, 103 bp, Artificial Sequence
  Synthetic Polynucleotide
taatacgactcactatagggttgttggtgttggcagaccttctgaaatttaacagaggagaaaatttatgaaggtctgcaacctggcggcagcgcaaaagatg

SEQ ID NO: 190846 - DNA, 103 bp, Artificial Sequence
  Synthetic Polynucleotide
taatacgactcactatagggggagtcatttttgttggtgttggcagacctaacagaggagaaggtctatgaacaccaacaacctggcggcagcgcaaaagatg

SEQ ID NO: 190847 - DNA, 103 bp, Artificial Sequence
  Synthetic Polynucleotide
taatacgactcactatagggtcttgatcttggagtcatttttgttggtgtaacagaggagaacaccaatgaaaatgactaacctggcggcagcgcaaaagatg

SEQ ID NO: 190848 - DNA, 103 bp, Artificial Sequence
  Synthetic Polynucleotide
taatacgactcactatagggatactaagattcttgatcttggagtcatttaacagaggagaaaatgaatgcaagatcaaaacctggcggcagcgcaaaagatg

SEQ ID NO: 190849 - DNA, 103 bp, Artificial Sequence
  Synthetic Polynucleotide
taatacgactcactatagggtcaccaattgatactaagattcttgatcttaacagaggagaaagatcatgaatcttagtaacctggcggcagcgcaaaagatg

SEQ ID NO: 190850 - DNA, 103 bp, Artificial Sequence
  Synthetic Polynucleotide
taatacgactcactatagggacctcccaatactccatccacagatgaaacaacagaggagagtttcaatggtggatggaaacctggcggcagcgcaaaagatg

SEQ ID NO: 190851 - DNA, 103 bp, Artificial Sequence
  Synthetic Polynucleotide
taatacgactcactatagggcccgaatgattcaccaattgatactaagataacagaggagaatcttaatgtcaattggtaacctggcggcagcgcaaaagatg

SEQ ID NO: 190852 - DNA, 103 bp, Artificial Sequence
  Synthetic Polynucleotide
taatacgactcactatagggtctcagaagtcccgaatgattcaccaattgaacagaggagacaattgatgaatcattcgaacctggcggcagcgcaaaagatg

SEQ ID NO: 190853 - DNA, 103 bp, Artificial Sequence
  Synthetic Polynucleotide
taatacgactcactatagggttctggaacttctcagaagtcccgaatgataacagaggagaatcattatggacttctgaaacctggcggcagcgcaaaagatg

SEQ ID NO: 190854 - DNA, 103 bp, Artificial Sequence
  Synthetic Polynucleotide
taatacgactcactatagggctgatttattttctggaacttctcagaagtaacagaggagaacttctatgaagttccagaacctggcggcagcgcaaaagatg

SEQ ID NO: 190855 - DNA, 103 bp, Artificial Sequence
  Synthetic Polynucleotide
taatacgactcactatagggtacataccatctgatttattttctggaactaacagaggagaagttccatgaaataaatcaacctggcggcagcgcaaaagatg

SEQ ID NO: 190856 - DNA, 103 bp, Artificial Sequence
  Synthetic Polynucleotide
taatacgactcactatagggcggtcgctgttacataccatctgatttattaacagaggagaaataaaatggatggtatgaacctggcggcagcgcaaaagatg

SEQ ID NO: 190857 - DNA, 103 bp, Artificial Sequence
  Synthetic Polynucleotide
taatacgactcactatagggtttgagcacacggtcgctgttacataccataacagaggagaatggtaatgaacagcgacaacctggcggcagcgcaaaagatg

SEQ ID NO: 190858 - DNA, 103 bp, Artificial Sequence
  Synthetic Polynucleotide
taatacgactcactatagggcagcacttcttttgagcacacggtcgctgtaacagaggagaacagcgatggtgtgctcaaacctggcggcagcgcaaaagatg

SEQ ID NO: 190859 - DNA, 103 bp, Artificial Sequence
  Synthetic Polynucleotide
taatacgactcactatagggttgcttccttcagcacttcttttgagcacaaacagaggagatgtgctatgaagaagtgcaacctggcggcagcgcaaaagatg

SEQ ID NO: 190860 - DNA, 103 bp, Artificial Sequence
  Synthetic Polynucleotide
taatacgactcactatagggtttaggagggttgcttccttcagcacttctaacagaggagaagaagtatggaaggaagcaacctggcggcagcgcaaaagatg

SEQ ID NO: 190861 - DNA, 103 bp, Artificial Sequence
  Synthetic Polynucleotide
taatacgactcactatagggtttgaatataacctcccaatactccatccaaacagaggagatggatgatgtattgggagaacctggcggcagcgcaaaagatg

SEQ ID NO: 190862 - DNA, 103 bp, Artificial Sequence
  Synthetic Polynucleotide
taatacgactcactatagggttttcagtggtttaggagggttgcttccttaacagaggagaaaggaaatgaccctcctaaacctggcggcagcgcaaaagatg

SEQ ID NO: 190863 - DNA, 103 bp, Artificial Sequence
  Synthetic Polynucleotide
taatacgactcactatagggaagcgtagttttttcagtggtttaggagggaacagaggagaccctccatgaccactgaaaacctggcggcagcgcaaaagatg

SEQ ID NO: 190864 - DNA, 103 bp, Artificial Sequence
  Synthetic Polynucleotide
taatacgactcactatagggttcaatatcaaagcgtagttttttcagtggaacagaggagaccactgatgaaactacgcaacctggcggcagcgcaaaagatg

SEQ ID NO: 190865 - DNA, 103 bp, Artificial Sequence
  Synthetic Polynucleotide
taatacgactcactatagggcatctgatccttcaatatcaaagcgtagttaacagaggagaaactacatgttgatattgaacctggcggcagcgcaaaagatg

SEQ ID NO: 190866 - DNA, 103 bp, Artificial Sequence
  Synthetic Polynucleotide
taatacgactcactatagggccatctgcttcatctgatccttcaatatcaaacagaggagatgatatatgaggatcagaaacctggcggcagcgcaaaagatg

SEQ ID NO: 190867 - DNA, 103 bp, Artificial Sequence
  Synthetic Polynucleotide
taatacgactcactatagggatgtttacttccatctgcttcatctgatccaacagaggagaggatcaatggaagcagataacctggcggcagcgcaaaagatg

SEQ ID NO: 190868 - DNA, 103 bp, Artificial Sequence
  Synthetic Polynucleotide
taatacgactcactatagggctcctgggagatgtttacttccatctgcttaacagaggagaaagcagatggaagtaaacaacctggcggcagcgcaaaagatg

SEQ ID NO: 190869 - DNA, 103 bp, Artificial Sequence
  Synthetic Polynucleotide
taatacgactcactatagggaatttggactctcctgggagatgtttacttaacagaggagaaagtaaatgtctcccaggaacctggcggcagcgcaaaagatg

SEQ ID NO: 190870 - DNA, 103 bp, Artificial Sequence
  Synthetic Polynucleotide
taatacgactcactatagggtttctgctgaaatttggactctcctgggagaacagaggagactcccaatggagtccaaaaacctggcggcagcgcaaaagatg

SEQ ID NO: 190871 - DNA, 103 bp, Artificial Sequence
  Synthetic Polynucleotide
taatacgactcactatagggtttctgccagtttctgctgaaatttggactaacagaggagaagtccaatgttcagcagaaacctggcggcagcgcaaaagatg

SEQ ID NO: 190872 - DNA, 103 bp, Artificial Sequence
  Synthetic Polynucleotide
taatacgactcactatagggtcctttttcttttgaatataacctcccaataacagaggagaattgggatgttatattcaaacctggcggcagcgcaaaagatg

SEQ ID NO: 190873 - DNA, 103 bp, Artificial Sequence
  Synthetic Polynucleotide
taatacgactcactataggggtagaagtcatttctgccagtttctgctgaaacagaggagatcagcaatgactggcagaaacctggcggcagcgcaaaagatg

SEQ ID NO: 190874 - DNA, 103 bp, Artificial Sequence
  Synthetic Polynucleotide
taatacgactcactatagggtcgtgttcgagtagaagtcatttctgccagaacagaggagactggcaatgatgacttctaacctggcggcagcgcaaaagatg

SEQ ID NO: 190875 - DNA, 103 bp, Artificial Sequence
  Synthetic Polynucleotide
taatacgactcactataggggcttttgcattcgtgttcgagtagaagtcaaacagaggagatgacttatgctcgaacacaacctggcggcagcgcaaaagatg

SEQ ID NO: 190876 - DNA, 103 bp, Artificial Sequence
  Synthetic Polynucleotide
taatacgactcactatagggttcattttctgcttttgcattcgtgttcgaaacagaggagatcgaacatgaatgcaaaaaacctggcggcagcgcaaaagatg

SEQ ID NO: 190877 - DNA, 103 bp, Artificial Sequence
  Synthetic Polynucleotide
taatacgactcactatagggcatgctatcattcattttctgcttttgcataacagaggagaatgcaaatgcagaaaatgaacctggcggcagcgcaaaagatg

SEQ ID NO: 190878 - DNA, 103 bp, Artificial Sequence
  Synthetic Polynucleotide
taatacgactcactatagggttgaggtatccatgctatcattcattttctaacagaggagaagaaaaatgatgatagcaaacctggcggcagcgcaaaagatg

SEQ ID NO: 190879 - DNA, 103 bp, Artificial Sequence
  Synthetic Polynucleotide
taatacgactcactatagggtcttccttgtttgaggtatccatgctatcaaacagaggagatgatagatgggatacctcaacctggcggcagcgcaaaagatg

SEQ ID NO: 190880 - DNA, 103 bp, Artificial Sequence
  Synthetic Polynucleotide
taatacgactcactatagggtccccacagttcctttttcttttgaatataaacagaggagatatattatgaagaaaaagaacctggcggcagcgcaaaagatg

SEQ ID NO: 190881 - DNA, 103 bp, Artificial Sequence
  Synthetic Polynucleotide
taatacgactcactatagggagatacagattccccacagttcctttttctaacagaggagaagaaaaatgaactgtgggaacctggcggcagcgcaaaagatg

SEQ ID NO: 190882 - DNA, 103 bp, Artificial Sequence
  Synthetic Polynucleotide
taatacgactcactataggggcggcagcggcggcggtggcggccgtttttaacagaggagaaaaaacatgcgccaccgcaacctggcggcagcgcaaaagatg

SEQ ID NO: 190883 - DNA, 103 bp, Artificial Sequence
  Synthetic Polynucleotide
taatacgactcactataggggctgcaataaagatacagattccccacagtaacagaggagaactgtgatgaatctgtataacctggcggcagcgcaaaagatg

SEQ ID NO: 190884 - DNA, 103 bp, Artificial Sequence
  Synthetic Polynucleotide
taatacgactcactatagggtaggtcaactgctgcaataaagatacagataacagaggagaatctgtatgtttattgcaaacctggcggcagcgcaaaagatg

SEQ ID NO: 190885 - DNA, 103 bp, Artificial Sequence
  Synthetic Polynucleotide
taatacgactcactatagggacatctcatctaggtcaactgctgcaataaaacagaggagattattgatgcagttgaccaacctggcggcagcgcaaaagatg

SEQ ID NO: 190886 - DNA, 103 bp, Artificial Sequence
  Synthetic Polynucleotide
taatacgactcactatagggaaagtgaacgacatctcatctaggtcaactaacagaggagaagttgaatgagatgagataacctggcggcagcgcaaaagatg

SEQ ID NO: 190887 - DNA, 103 bp, Artificial Sequence
  Synthetic Polynucleotide
taatacgactcactatagggtagctcagtaaaagtgaacgacatctcatcaacagaggagagatgagatgtcgttcactaacctggcggcagcgcaaaagatg

SEQ ID NO: 190888 - DNA, 103 bp, Artificial Sequence
  Synthetic Polynucleotide
taatacgactcactatagggtgtttttctgtagctcagtaaaagtgaacgaacagaggagacgttcaatgttactgagcaacctggcggcagcgcaaaagatg

SEQ ID NO: 190889 - DNA, 103 bp, Artificial Sequence
  Synthetic Polynucleotide
taatacgactcactatagggctgatttctatgtttttctgtagctcagtaaacagaggagatactgaatgacagaaaaaaacctggcggcagcgcaaaagatg

SEQ ID NO: 190890 - DNA, 103 bp, Artificial Sequence
  Synthetic Polynucleotide
taatacgactcactatagggtttatggacactgatttctatgtttttctgaacagaggagacagaaaatgatagaaatcaacctggcggcagcgcaaaagatg

SEQ ID NO: 190891 - DNA, 103 bp, Artificial Sequence
  Synthetic Polynucleotide
taatacgactcactatagggagttaaagaatttatggacactgatttctaaacagaggagatagaaaatggtgtccataaacctggcggcagcgcaaaagatg

SEQ ID NO: 190892 - DNA, 103 bp, Artificial Sequence
  Synthetic Polynucleotide
taatacgactcactatagggtcttttagtaagttaaagaatttatggacaaacagaggagatgtccaatgattctttaaaacctggcggcagcgcaaaagatg

SEQ ID NO: 190893 - DNA, 103 bp, Artificial Sequence
  Synthetic Polynucleotide
taatacgactcactataggggggttccgcggcggcagcggcggcggtggcaacagaggagagccaccatggccgctgccaacctggcggcagcgcaaaagatg

SEQ ID NO: 190894 - DNA, 103 bp, Artificial Sequence
  Synthetic Polynucleotide
taatacgactcactatagggggtatcaatttcttttagtaagttaaagaaaacagaggagattctttatgttactaaaaaacctggcggcagcgcaaaagatg

SEQ ID NO: 190895 - DNA, 103 bp, Artificial Sequence
  Synthetic Polynucleotide
taatacgactcactatagggctttggtactggtatcaatttcttttagtaaacagaggagatactaaatgaaattgataaacctggcggcagcgcaaaagatg

SEQ ID NO: 190896 - DNA, 103 bp, Artificial Sequence
  Synthetic Polynucleotide
taatacgactcactataggggcattatcaactttggtactggtatcaattaacagaggagaaattgaatgcagtaccaaaacctggcggcagcgcaaaagatg

SEQ ID NO: 190897 - DNA, 103 bp, Artificial Sequence
  Synthetic Polynucleotide
taatacgactcactatagggtcttgacatagcattatcaactttggtactaacagaggagaagtaccatggttgataataacctggcggcagcgcaaaagatg

SEQ ID NO: 190898 - DNA, 103 bp, Artificial Sequence
  Synthetic Polynucleotide
taatacgactcactatagggtcttcaacagtcttgacatagcattatcaaaacagaggagattgataatgctatgtcaaaacctggcggcagcgcaaaagatg

SEQ ID NO: 190899 - DNA, 103 bp, Artificial Sequence
  Synthetic Polynucleotide
taatacgactcactatagggacatcatacttcttcaacagtcttgacataaacagaggagatatgtcatgactgttgaaaacctggcggcagcgcaaaagatg

SEQ ID NO: 190900 - DNA, 103 bp, Artificial Sequence
  Synthetic Polynucleotide
taatacgactcactatagggtgcaaacaatacatcatacttcttcaacagaacagaggagactgttgatgaagtatgataacctggcggcagcgcaaaagatg

SEQ ID NO: 190901 - DNA, 103 bp, Artificial Sequence
  Synthetic Polynucleotide
taatacgactcactatagggtgctgaagagtgcaaacaatacatcatactaacagaggagaagtatgatgtattgtttgaacctggcggcagcgcaaaagatg

SEQ ID NO: 190902 - DNA, 103 bp, Artificial Sequence
  Synthetic Polynucleotide
taatacgactcactatagggctttccaatttgctgaagagtgcaaacaataacagaggagaattgttatgactcttcagaacctggcggcagcgcaaaagatg

SEQ ID NO: 190903 - DNA, 103 bp, Artificial Sequence
  Synthetic Polynucleotide
taatacgactcactatagggttcacatgtcctttccaatttgctgaagagaacagaggagactcttcatgaaattggaaaacctggcggcagcgcaaaagatg

SEQ ID NO: 190904 - DNA, 103 bp, Artificial Sequence
  Synthetic Polynucleotide
taatacgactcactataggggcggtgccgggggttccgcggcggcagcggaacagaggagaccgctgatgccgcggaacaacctggcggcagcgcaaaagatg

SEQ ID NO: 190905 - DNA, 103 bp, Artificial Sequence
  Synthetic Polynucleotide
taatacgactcactatagggaatatataagttcacatgtcctttccaattaacagaggagaaattggatgggacatgtgaacctggcggcagcgcaaaagatg

SEQ ID NO: 190906 - DNA, 103 bp, Artificial Sequence
  Synthetic Polynucleotide
taatacgactcactatagggggttgtgtcaaatatataagttcacatgtcaacagaggagagacatgatgacttatataaacctggcggcagcgcaaaagatg

SEQ ID NO: 190907 - DNA, 103 bp, Artificial Sequence
  Synthetic Polynucleotide
taatacgactcactatagggcgaactgctgggttgtgtcaaatatataagaacagaggagacttataatgttgacacaaaacctggcggcagcgcaaaagatg

SEQ ID NO: 190908 - DNA, 103 bp, Artificial Sequence
  Synthetic Polynucleotide
taatacgactcactatagggcagtagatatcgaactgctgggttgtgtcaaacagaggagatgacacatgccagcagttaacctggcggcagcgcaaaagatg

SEQ ID NO: 190909 - DNA, 103 bp, Artificial Sequence
  Synthetic Polynucleotide
taatacgactcactataggggaatttatttcagtagatatcgaactgctgaacagaggagacagcagatggatatctacaacctggcggcagcgcaaaagatg

SEQ ID NO: 190910 - DNA, 103 bp, Artificial Sequence
  Synthetic Polynucleotide
taatacgactcactatagggcaccaatgcagaatttatttcagtagatataacagaggagaatatctatggaaataaataacctggcggcagcgcaaaagatg

SEQ ID NO: 190911 - DNA, 103 bp, Artificial Sequence
  Synthetic Polynucleotide
taatacgactcactatagggaaacttttagcaccaatgcagaatttatttaacagaggagaaaataaatgctgcattggaacctggcggcagcgcaaaagatg

SEQ ID NO: 190912 - DNA, 103 bp, Artificial Sequence
  Synthetic Polynucleotide
taatacgactcactataggggtgatccaagaaacttttagcaccaatgcaaacagaggagatgcattatggctaaaagtaacctggcggcagcgcaaaagatg

SEQ ID NO: 190913 - DNA, 103 bp, Artificial Sequence
  Synthetic Polynucleotide
taatacgactcactatagggtaataaaaatgtgatccaagaaacttttagaacagaggagactaaaaatgtcttggatcaacctggcggcagcgcaaaagatg

SEQ ID NO: 190914 - DNA, 103 bp, Artificial Sequence
  Synthetic Polynucleotide
taatacgactcactatagggcccctttagctaataaaaatgtgatccaagaacagaggagacttggaatgcatttttataacctggcggcagcgcaaaagatg

SEQ ID NO: 190915 - DNA, 103 bp, Artificial Sequence
  Synthetic Polynucleotide
taatacgactcactatagggggcggcggcggcggtgccgggggttccgcgaacagaggagacgcggaatgcccggcaccaacctggcggcagcgcaaaagatg

SEQ ID NO: 190916 - DNA, 103 bp, Artificial Sequence
  Synthetic Polynucleotide
taatacgactcactatagggtgtaatacttcccctttagctaataaaaataacagaggagaatttttatgagctaaaggaacctggcggcagcgcaaaagatg

SEQ ID NO: 190917 - DNA, 103 bp, Artificial Sequence
  Synthetic Polynucleotide
taatacgactcactatagggatcttccatttgtaatacttcccctttagcaacagaggagagctaaaatggaagtattaaacctggcggcagcgcaaaagatg

SEQ ID NO: 190918 - DNA, 103 bp, Artificial Sequence
  Synthetic Polynucleotide
taatacgactcactatagggtcaccagatcatcttccatttgtaatacttaacagaggagaaagtatatgaaatggaagaacctggcggcagcgcaaaagatg

SEQ ID NO: 190919 - DNA, 103 bp, Artificial Sequence
  Synthetic Polynucleotide
taatacgactcactatagggtgaaatgaaatcaccagatcatcttccattaacagaggagaaatggaatgtgatctggtaacctggcggcagcgcaaaagatg

SEQ ID NO: 190920 - DNA, 103 bp, Artificial Sequence
  Synthetic Polynucleotide
taatacgactcactatagggtagcattaactgaaatgaaatcaccagatcaacagaggagagatctgatgatttcatttaacctggcggcagcgcaaaagatg

SEQ ID NO: 190921 - DNA, 103 bp, Artificial Sequence
  Synthetic Polynucleotide
taatacgactcactatagggcaaggacacatagcattaactgaaatgaaaaacagaggagatttcatatgagttaatgcaacctggcggcagcgcaaaagatg

SEQ ID NO: 190922 - DNA, 103 bp, Artificial Sequence
  Synthetic Polynucleotide
taatacgactcactatagggataaaatagtcaaggacacatagcattaacaacagaggagagttaatatgatgtgtcctaacctggcggcagcgcaaaagatg

SEQ ID NO: 190923 - DNA, 103 bp, Artificial Sequence
  Synthetic Polynucleotide
taatacgactcactatagggtgagagtttaataaaatagtcaaggacacaaacagaggagatgtgtcatggactattttaacctggcggcagcgcaaaagatg

SEQ ID NO: 190924 - DNA, 103 bp, Artificial Sequence
  Synthetic Polynucleotide
taatacgactcactatagggacatgggaggtgagagtttaataaaatagtaacagaggagaactattatgttaaactctaacctggcggcagcgcaaaagatg

SEQ ID NO: 190925 - DNA, 103 bp, Artificial Sequence
  Synthetic Polynucleotide
taatacgactcactatagggtctttgagcaacatgggaggtgagagtttaaacagaggagataaactatgacctcccataacctggcggcagcgcaaaagatg

SEQ ID NO: 190926 - DNA, 103 bp, Artificial Sequence
  Synthetic Polynucleotide
taatacgactcactatagggctcaggagggggcggcggcggcggtgccggaacagaggagaccggcaatgccgccgccgaacctggcggcagcgcaaaagatg

SEQ ID NO: 190927 - DNA, 103 bp, Artificial Sequence
  Synthetic Polynucleotide
taatacgactcactatagggtttatatggttctttgagcaacatgggaggaacagaggagacctcccatgttgctcaaaaacctggcggcagcgcaaaagatg

SEQ ID NO: 190928 - DNA, 103 bp, Artificial Sequence
  Synthetic Polynucleotide
taatacgactcactatagggtaacagctgttttatatggttctttgagcaaacagaggagatgctcaatgaaccatataaacctggcggcagcgcaaaagatg

SEQ ID NO: 190929 - DNA, 103 bp, Artificial Sequence
  Synthetic Polynucleotide
taatacgactcactatagggttaatgggtataacagctgttttatatggtaacagaggagaaccataatgaacagctgtaacctggcggcagcgcaaaagatg

SEQ ID NO: 190930 - DNA, 103 bp, Artificial Sequence
  Synthetic Polynucleotide
taatacgactcactatagggaggtgaaccattaatgggtataacagctgtaacagaggagaacagctatgatacccattaacctggcggcagcgcaaaagatg

SEQ ID NO: 190931 - DNA, 103 bp, Artificial Sequence
  Synthetic Polynucleotide
taatacgactcactatagggtgggtgttcgaggtgaaccattaatgggtaaacagaggagatacccaatgatggttcacaacctggcggcagcgcaaaagatg

SEQ ID NO: 190932 - DNA, 103 bp, Artificial Sequence
  Synthetic Polynucleotide
taatacgactcactatagggtgacctcgcctgggtgttcgaggtgaaccaaacagaggagatggttcatgtcgaacaccaacctggcggcagcgcaaaagatg

SEQ ID NO: 190933 - DNA, 103 bp, Artificial Sequence
  Synthetic Polynucleotide
taatacgactcactatagggactcctgttctgacctcgcctgggtgttcgaacagaggagacgaacaatgaggcgaggtaacctggcggcagcgcaaaagatg

SEQ ID NO: 190934 - DNA, 103 bp, Artificial Sequence
  Synthetic Polynucleotide
taatacgactcactatagggctatccgtgcactcctgttctgacctcgccaacagaggagaggcgagatgagaacaggaaacctggcggcagcgcaaaagatg

SEQ ID NO: 190935 - DNA, 103 bp, Artificial Sequence
  Synthetic Polynucleotide
taatacgactcactatagggagttgttttgctatccgtgcactcctgttcaacagaggagagaacagatgtgcacggataacctggcggcagcgcaaaagatg

SEQ ID NO: 190936 - DNA, 103 bp, Artificial Sequence
  Synthetic Polynucleotide
taatacgactcactatagggatcattttctagttgttttgctatccgtgcaacagaggagagcacggatggcaaaacaaaacctggcggcagcgcaaaagatg

SEQ ID NO: 190937 - DNA, 103 bp, Artificial Sequence
  Synthetic Polynucleotide
taatacgactcactatagggctgggtcctcctcaggagggggcggcggcgaacagaggagacgccgcatgcccctcctgaacctggcggcagcgcaaaagatg

SEQ ID NO: 190938 - DNA, 103 bp, Artificial Sequence
  Synthetic Polynucleotide
taatacgactcactatagggtaattcttgtatcattttctagttgttttgaacagaggagacaaaacatgtagaaaatgaacctggcggcagcgcaaaagatg

SEQ ID NO: 190939 - DNA, 103 bp, Artificial Sequence
  Synthetic Polynucleotide
taatacgactcactatagggagaacttcaataattcttgtatcattttctaacagaggagaagaaaaatgtacaagaataacctggcggcagcgcaaaagatg

SEQ ID NO: 190940 - DNA, 103 bp, Artificial Sequence
  Synthetic Polynucleotide
taatacgactcactatagggttctttacagagaacttcaataattcttgtaacagaggagaacaagaatgattgaagttaacctggcggcagcgcaaaagatg

SEQ ID NO: 190941 - DNA, 103 bp, Artificial Sequence
  Synthetic Polynucleotide
taatacgactcactatagggtacattcatgttctttacagagaacttcaaaacagaggagattgaagatgtctgtaaagaacctggcggcagcgcaaaagatg

SEQ ID NO: 190942 - DNA, 103 bp, Artificial Sequence
  Synthetic Polynucleotide
taatacgactcactatagggtcatctatattacattcatgttctttacagaacagaggagactgtaaatgacatgaatgaacctggcggcagcgcaaaagatg

SEQ ID NO: 190943 - DNA, 103 bp, Artificial Sequence
  Synthetic Polynucleotide
taatacgactcactatagggatttttcacctcatctatattacattcatgaacagaggagacatgaaatgaatatagataacctggcggcagcgcaaaagatg

SEQ ID NO: 190944 - DNA, 103 bp, Artificial Sequence
  Synthetic Polynucleotide
taatacgactcactatagggtgaaataaacatttttcacctcatctatataacagaggagaatatagatgaggtgaaaaaacctggcggcagcgcaaaagatg

SEQ ID NO: 190945 - DNA, 103 bp, Artificial Sequence
  Synthetic Polynucleotide
taatacgactcactatagggataaaatttttgaaataaacatttttcaccaacagaggagaggtgaaatgtgtttatttaacctggcggcagcgcaaaagatg

SEQ ID NO: 190946 - DNA, 103 bp, Artificial Sequence
  Synthetic Polynucleotide
taatacgactcactatagggcataaaaggtataaaatttttgaaataaacaacagaggagagtttatatgaaaaattttaacctggcggcagcgcaaaagatg

SEQ ID NO: 190947 - DNA, 103 bp, Artificial Sequence
  Synthetic Polynucleotide
taatacgactcactatagggcaagagaattcataaaaggtataaaattttaacagaggagaaaaattatgtaccttttaaacctggcggcagcgcaaaagatg

SEQ ID NO: 190948 - DNA, 103 bp, Artificial Sequence
  Synthetic Polynucleotide
taatacgactcactatagggctgtcctgctctgggtcctcctcaggagggaacagaggagaccctccatgggaggacccaacctggcggcagcgcaaaagatg

SEQ ID NO: 190949 - DNA, 103 bp, Artificial Sequence
  Synthetic Polynucleotide
taatacgactcactataggggttacaagtccaagagaattcataaaaggtaacagaggagaacctttatggaattctctaacctggcggcagcgcaaaagatg

SEQ ID NO: 190950 - DNA, 103 bp, Artificial Sequence
  Synthetic Polynucleotide
taatacgactcactatagggtccattagatgttacaagtccaagagaattaacagaggagaaattctatgggacttgtaaacctggcggcagcgcaaaagatg

SEQ ID NO: 190951 - DNA, 103 bp, Artificial Sequence
  Synthetic Polynucleotide
taatacgactcactatagggcctctggaagtccattagatgttacaagtcaacagaggagagacttgatgcatctaatgaacctggcggcagcgcaaaagatg

SEQ ID NO: 190952 - DNA, 103 bp, Artificial Sequence
  Synthetic Polynucleotide
taatacgactcactatagggagattttcaacctctggaagtccattagataacagaggagaatctaaatgacttccagaaacctggcggcagcgcaaaagatg

SEQ ID NO: 190953 - DNA, 103 bp, Artificial Sequence
  Synthetic Polynucleotide
taatacgactcactatagggtcgtttagaaagattttcaacctctggaagaacagaggagacttccaatggttgaaaataacctggcggcagcgcaaaagatg

SEQ ID NO: 190954 - DNA, 103 bp, Artificial Sequence
  Synthetic Polynucleotide
taatacgactcactatagggtttcttcgtatcgtttagaaagattttcaaaacagaggagattgaaaatgtttctaaacaacctggcggcagcgcaaaagatg

SEQ ID NO: 190955 - DNA, 103 bp, Artificial Sequence
  Synthetic Polynucleotide
taatacgactcactatagggttaagataaatttcttcgtatcgtttagaaaacagaggagattctaaatgatacgaagaaacctggcggcagcgcaaaagatg

SEQ ID NO: 190956 - DNA, 103 bp, Artificial Sequence
  Synthetic Polynucleotide
taatacgactcactatagggatctttatttttaagataaatttcttcgtaaacagaggagatacgaaatgatttatcttaacctggcggcagcgcaaaagatg

SEQ ID NO: 190957 - DNA, 103 bp, Artificial Sequence
  Synthetic Polynucleotide
taatacgactcactatagggttgcatctagatctttatttttaagataaaaacagaggagatttatcatgaaaataaagaacctggcggcagcgcaaaagatg

SEQ ID NO: 190958 - DNA, 103 bp, Artificial Sequence
  Synthetic Polynucleotide
taatacgactcactatagggaaaaataatcttgcatctagatctttatttaacagaggagaaaataaatgtctagatgcaacctggcggcagcgcaaaagatg

SEQ ID NO: 190959 - DNA, 103 bp, Artificial Sequence
  Synthetic Polynucleotide
taatacgactcactatagggtgcgtcgtcgaaggcttccttgtcggccataacagaggagaatggccatgaaggaagccaacctggcggcagcgcaaaagatg

SEQ ID NO: 190960 - DNA, 103 bp, Artificial Sequence
  Synthetic Polynucleotide
taatacgactcactatagggctccagagcatgggtcatcaccaaatcataaacagaggagatatgatatggtgatgaccaacctggcggcagcgcaaaagatg

SEQ ID NO: 190961 - DNA, 103 bp, Artificial Sequence
  Synthetic Polynucleotide
taatacgactcactatagggtctgcgatcagtaccactggaagctaaaataacagaggagaattttaatgtccagtggtaacctggcggcagcgcaaaagatg

SEQ ID NO: 190962 - DNA, 103 bp, Artificial Sequence
  Synthetic Polynucleotide
taatacgactcactatagggagacattcagtctgcgatcagtaccactggaacagaggagaccagtgatgctgatcgcaaacctggcggcagcgcaaaagatg

SEQ ID NO: 190963 - DNA, 103 bp, Artificial Sequence
  Synthetic Polynucleotide
taatacgactcactatagggcttaaatcccagacattcagtctgcgatcaaacagaggagatgatcgatgactgaatgtaacctggcggcagcgcaaaagatg

SEQ ID NO: 190964 - DNA, 103 bp, Artificial Sequence
  Synthetic Polynucleotide
taatacgactcactatagggtccaattttacttaaatcccagacattcagaacagaggagactgaatatgtgggatttaaacctggcggcagcgcaaaagatg

SEQ ID NO: 190965 - DNA, 103 bp, Artificial Sequence
  Synthetic Polynucleotide
taatacgactcactatagggattgttcctctccaattttacttaaatcccaacagaggagagggattatggtaaaattgaacctggcggcagcgcaaaagatg

SEQ ID NO: 190966 - DNA, 103 bp, Artificial Sequence
  Synthetic Polynucleotide
taatacgactcactatagggtcttctggggattgttcctctccaattttaaacagaggagataaaatatgagaggaacaaacctggcggcagcgcaaaagatg

SEQ ID NO: 190967 - DNA, 103 bp, Artificial Sequence
  Synthetic Polynucleotide
taatacgactcactataggggtcttctgcatcttctggggattgttcctcaacagaggagagaggaaatgtccccagaaaacctggcggcagcgcaaaagatg

SEQ ID NO: 190968 - DNA, 103 bp, Artificial Sequence
  Synthetic Polynucleotide
taatacgactcactatagggctggtggcccgtcttctgcatcttctggggaacagaggagaccccagatgatgcagaagaacctggcggcagcgcaaaagatg

SEQ ID NO: 190969 - DNA, 103 bp, Artificial Sequence
  Synthetic Polynucleotide
taatacgactcactatagggaacaacaactctggtggcccgtcttctgcaaacagaggagatgcagaatgcgggccaccaacctggcggcagcgcaaaagatg

SEQ ID NO: 190970 - DNA, 103 bp, Artificial Sequence
  Synthetic Polynucleotide
taatacgactcactatagggaccatgaataaacaacaactctggtggcccaacagaggagagggccaatggagttgttgaacctggcggcagcgcaaaagatg

SEQ ID NO: 190971 - DNA, 103 bp, Artificial Sequence
  Synthetic Polynucleotide
taatacgactcactatagggggctgggccactccagagcatgggtcatcaaacagaggagatgatgaatgatgctctggaacctggcggcagcgcaaaagatg

SEQ ID NO: 190972 - DNA, 103 bp, Artificial Sequence
  Synthetic Polynucleotide
taatacgactcactatagggcagtatgaccaccatgaataaacaacaactaacagaggagaagttgtatgttattcatgaacctggcggcagcgcaaaagatg

SEQ ID NO: 190973 - DNA, 103 bp, Artificial Sequence
  Synthetic Polynucleotide
taatacgactcactataggggatatcttggcagtatgaccaccatgaataaacagaggagatattcaatgtggtcatacaacctggcggcagcgcaaaagatg

SEQ ID NO: 190974 - DNA, 103 bp, Artificial Sequence
  Synthetic Polynucleotide
taatacgactcactatagggggagaaatcagatatcttggcagtatgaccaacagaggagaggtcatatggccaagataaacctggcggcagcgcaaaagatg

SEQ ID NO: 190975 - DNA, 103 bp, Artificial Sequence
  Synthetic Polynucleotide
taatacgactcactatagggtgggattccaggagaaatcagatatcttggaacagaggagaccaagaatgctgatttctaacctggcggcagcgcaaaagatg

SEQ ID NO: 190976 - DNA, 103 bp, Artificial Sequence
  Synthetic Polynucleotide
taatacgactcactatagggcaaggttcattgggattccaggagaaatcaaacagaggagatgatttatgctggaatccaacctggcggcagcgcaaaagatg

SEQ ID NO: 190977 - DNA, 103 bp, Artificial Sequence
  Synthetic Polynucleotide
taatacgactcactatagggacaaatcacccaaggttcattgggattccaaacagaggagatggaatatgaatgaacctaacctggcggcagcgcaaaagatg

SEQ ID NO: 190978 - DNA, 103 bp, Artificial Sequence
  Synthetic Polynucleotide
taatacgactcactatagggctgatacagaacaaatcacccaaggttcataacagaggagaatgaacatggggtgatttaacctggcggcagcgcaaaagatg

SEQ ID NO: 190979 - DNA, 103 bp, Artificial Sequence
  Synthetic Polynucleotide
taatacgactcactatagggatattgtcttctgatacagaacaaatcaccaacagaggagaggtgatatgttctgtatcaacctggcggcagcgcaaaagatg

SEQ ID NO: 190980 - DNA, 103 bp, Artificial Sequence
  Synthetic Polynucleotide
taatacgactcactatagggcacttgcatgatattgtcttctgatacagaaacagaggagatctgtaatggaagacaataacctggcggcagcgcaaaagatg

SEQ ID NO: 190981 - DNA, 103 bp, Artificial Sequence
  Synthetic Polynucleotide
taatacgactcactatagggccatttgccacacttgcatgatattgtcttaacagaggagaaagacaatgtcatgcaagaacctggcggcagcgcaaaagatg

SEQ ID NO: 190982 - DNA, 103 bp, Artificial Sequence
  Synthetic Polynucleotide
taatacgactcactatagggtgggcagttaggctgggccactccagagcaaacagaggagatgctctatggtggcccagaacctggcggcagcgcaaaagatg

SEQ ID NO: 190983 - DNA, 103 bp, Artificial Sequence
  Synthetic Polynucleotide
taatacgactcactatagggatgttctctgccatttgccacacttgcatgaacagaggagacatgcaatggtggcaaataacctggcggcagcgcaaaagatg

SEQ ID NO: 190984 - DNA, 103 bp, Artificial Sequence
  Synthetic Polynucleotide
taatacgactcactatagggatcattataaatgttctctgccatttgccaaacagaggagatggcaaatggcagagaacaacctggcggcagcgcaaaagatg

SEQ ID NO: 190985 - DNA, 103 bp, Artificial Sequence
  Synthetic Polynucleotide
taatacgactcactatagggcagggtcttcatcattataaatgttctctgaacagaggagacagagaatgtttataatgaacctggcggcagcgcaaaagatg

SEQ ID NO: 190986 - DNA, 103 bp, Artificial Sequence
  Synthetic Polynucleotide
taatacgactcactatagggacgcttccttcagggtcttcatcattataaaacagaggagattataaatgtgaagacccaacctggcggcagcgcaaaagatg

SEQ ID NO: 190987 - DNA, 103 bp, Artificial Sequence
  Synthetic Polynucleotide
taatacgactcactatagggttctggatccacgcttccttcagggtcttcaacagaggagagaagacatggaaggaagcaacctggcggcagcgcaaaagatg

SEQ ID NO: 190988 - DNA, 103 bp, Artificial Sequence
  Synthetic Polynucleotide
taatacgactcactatagggacccttgtccttctggatccacgcttccttaacagaggagaaaggaaatgtggatccagaacctggcggcagcgcaaaagatg

SEQ ID NO: 190989 - DNA, 103 bp, Artificial Sequence
  Synthetic Polynucleotide
taatacgactcactatagggtggaagccactgggcagttaggctgggccaaacagaggagatggcccatgctaactgccaacctggcggcagcgcaaaagatg

SEQ ID NO: 190990 - DNA, 103 bp, Artificial Sequence
  Synthetic Polynucleotide
taatacgactcactatagggtggttacatctggaagccactgggcagttaaacagaggagataactgatgagtggcttcaacctggcggcagcgcaaaagatg

SEQ ID NO: 190991 - DNA, 103 bp, Artificial Sequence
  Synthetic Polynucleotide
taatacgactcactatagggccttctggtctggttacatctggaagccacaacagaggagagtggctatgagatgtaacaacctggcggcagcgcaaaagatg

SEQ ID NO: 190992 - DNA, 103 bp, Artificial Sequence
  Synthetic Polynucleotide
taatacgactcactataggggaaatctttcccttctggtctggttacatcaacagaggagagatgtaatgagaccagaaaacctggcggcagcgcaaaagatg

SEQ ID NO: 190993 - DNA, 103 bp, Artificial Sequence
  Synthetic Polynucleotide
taatacgactcactataggggatgaatgctgaaatctttcccttctggtcaacagaggagagaccagatgggaaagattaacctggcggcagcgcaaaagatg

SEQ ID NO: 190994 - DNA, 103 bp, Artificial Sequence
  Synthetic Polynucleotide
taatacgactcactatagggaggacaagtcgatgaatgctgaaatctttcaacagaggagagaaagaatgcagcattcaaacctggcggcagcgcaaaagatg

SEQ ID NO: 190995 - DNA, 103 bp, Artificial Sequence
  Synthetic Polynucleotide
taatacgactcactataggggtgtgtccccaggacaagtcgatgaatgctaacagaggagaagcattatgcgacttgtcaacctggcggcagcgcaaaagatg

SEQ ID NO: 190996 - DNA, 103 bp, Artificial Sequence
  Synthetic Polynucleotide
taatacgactcactataggggttcttccactgcgtcgtcgaaggcttcctaacagaggagaaggaagatgtcgacgacgaacctggcggcagcgcaaaagatg

SEQ ID NO: 190997 - DNA, 103 bp, Artificial Sequence
  Synthetic Polynucleotide
taatacgactcactatagggcatccgatgtgtgtgtccccaggacaagtcaacagaggagagacttgatgtggggacacaacctggcggcagcgcaaaagatg

SEQ ID NO: 190998 - DNA, 103 bp, Artificial Sequence
  Synthetic Polynucleotide
taatacgactcactatagggtggttttgttcatccgatgtgtgtgtccccaacagaggagaggggacatgcacatcggaaacctggcggcagcgcaaaagatg

SEQ ID NO: 190999 - DNA, 103 bp, Artificial Sequence
  Synthetic Polynucleotide
taatacgactcactatagggtataacaagatggttttgttcatccgatgtaacagaggagaacatcgatggaacaaaacaacctggcggcagcgcaaaagatg

SEQ ID NO: 191000 - DNA, 103 bp, Artificial Sequence
  Synthetic Polynucleotide
taatacgactcactataggggcacactggctataacaagatggttttgttaacagaggagaaacaaaatgatcttgttaaacctggcggcagcgcaaaagatg

SEQ ID NO: 191001 - DNA, 103 bp, Artificial Sequence
  Synthetic Polynucleotide
taatacgactcactatagggttagggagctgcacactggctataacaagaaacagaggagatcttgtatgagccagtgtaacctggcggcagcgcaaaagatg

SEQ ID NO: 191002 - DNA, 103 bp, Artificial Sequence
  Synthetic Polynucleotide
taatacgactcactatagggagcatcatcattagggagctgcacactggcaacagaggagagccagtatgcagctccctaacctggcggcagcgcaaaagatg

SEQ ID NO: 191003 - DNA, 103 bp, Artificial Sequence
  Synthetic Polynucleotide
taatacgactcactatagggcatcaaactgagcatcatcattagggagctaacagaggagaagctccatgatgatgatgaacctggcggcagcgcaaaagatg

SEQ ID NO: 191004 - DNA, 103 bp, Artificial Sequence
  Synthetic Polynucleotide
taatacgactcactatagggtagtgtgacgcatcaaactgagcatcatcaaacagaggagatgatgaatgtcagtttgaaacctggcggcagcgcaaaagatg

SEQ ID NO: 191005 - DNA, 103 bp, Artificial Sequence
  Synthetic Polynucleotide
taatacgactcactatagggctcactgtcgtagtgtgacgcatcaaactgaacagaggagacagtttatggcgtcacacaacctggcggcagcgcaaaagatg

SEQ ID NO: 191006 - DNA, 103 bp, Artificial Sequence
  Synthetic Polynucleotide
taatacgactcactatagggattctcctttctcactgtcgtagtgtgacgaacagaggagacgtcacatgacgacagtgaacctggcggcagcgcaaaagatg

SEQ ID NO: 191007 - DNA, 103 bp, Artificial Sequence
  Synthetic Polynucleotide
taatacgactcactatagggttgatcactcgttcttccactgcgtcgtcgaacagaggagacgacgaatgagtggaagaaacctggcggcagcgcaaaagatg

SEQ ID NO: 191008 - DNA, 103 bp, Artificial Sequence
  Synthetic Polynucleotide
taatacgactcactatagggaaacctccaaattctcctttctcactgtcgaacagaggagacgacagatggaaaggagaaacctggcggcagcgcaaaagatg

SEQ ID NO: 191009 - DNA, 103 bp, Artificial Sequence
  Synthetic Polynucleotide
taatacgactcactatagggaactgaaccaaaacctccaaattctcctttaacagaggagaaaaggaatgtttggaggtaacctggcggcagcgcaaaagatg

SEQ ID NO: 191010 - DNA, 103 bp, Artificial Sequence
  Synthetic Polynucleotide
taatacgactcactatagggtttttccactaactgaaccaaaacctccaaaacagaggagattggagatgttggttcagaacctggcggcagcgcaaaagatg

SEQ ID NO: 191011 - DNA, 103 bp, Artificial Sequence
  Synthetic Polynucleotide
taatacgactcactatagggtctatttcaatttttccactaactgaaccaaacagaggagatggttcatgtagtggaaaaacctggcggcagcgcaaaagatg

SEQ ID NO: 191012 - DNA, 103 bp, Artificial Sequence
  Synthetic Polynucleotide
taatacgactcactataggggatcttgatttctatttcaatttttccactaacagaggagaagtggaatgattgaaataaacctggcggcagcgcaaaagatg

SEQ ID NO: 191013 - DNA, 103 bp, Artificial Sequence
  Synthetic Polynucleotide
taatacgactcactatagggcttcatggttgatcttgatttctatttcaaaacagaggagattgaaaatgaaatcaagaaacctggcggcagcgcaaaagatg

SEQ ID NO: 191014 - DNA, 103 bp, Artificial Sequence
  Synthetic Polynucleotide
taatacgactcactatagggtttacttctccttcatggttgatcttgattaacagaggagaaatcaaatgcaaccatgaaacctggcggcagcgcaaaagatg

SEQ ID NO: 191015 - DNA, 103 bp, Artificial Sequence
  Synthetic Polynucleotide
taatacgactcactatagggacgggccctgtttacttctccttcatggttaacagaggagaaaccatatgggagaagtaaacctggcggcagcgcaaaagatg

SEQ ID NO: 191016 - DNA, 103 bp, Artificial Sequence
  Synthetic Polynucleotide
taatacgactcactatagggggggcatataacgggccctgtttacttctcaacagaggagagagaagatgacagggcccaacctggcggcagcgcaaaagatg

SEQ ID NO: 191017 - DNA, 103 bp, Artificial Sequence
  Synthetic Polynucleotide
taatacgactcactatagggcaagggttctggggcatataacgggccctgaacagaggagacagggcatgttatatgccaacctggcggcagcgcaaaagatg

SEQ ID NO: 191018 - DNA, 103 bp, Artificial Sequence
  Synthetic Polynucleotide
taatacgactcactataggggtattcctcgttgatcactcgttcttccacaacagaggagagtggaaatgcgagtgatcaacctggcggcagcgcaaaagatg

SEQ ID NO: 191019 - DNA, 103 bp, Artificial Sequence
  Synthetic Polynucleotide
taatacgactcactatagggtgcgatgatacaagggttctggggcatataaacagaggagatatatgatgcagaaccctaacctggcggcagcgcaaaagatg

SEQ ID NO: 191020 - DNA, 103 bp, Artificial Sequence
  Synthetic Polynucleotide
taatacgactcactataggggagtctttgttgcgatgatacaagggttctaacagaggagaagaaccatggtatcatcgaacctggcggcagcgcaaaagatg

SEQ ID NO: 191021 - DNA, 103 bp, Artificial Sequence
  Synthetic Polynucleotide
taatacgactcactatagggtcactggaaggagtctttgttgcgatgataaacagaggagatatcatatgaacaaagacaacctggcggcagcgcaaaagatg

SEQ ID NO: 191022 - DNA, 103 bp, Artificial Sequence
  Synthetic Polynucleotide
taatacgactcactatagggaacaagaacatcactggaaggagtctttgtaacagaggagaacaaagatgccttccagtaacctggcggcagcgcaaaagatg

SEQ ID NO: 191023 - DNA, 103 bp, Artificial Sequence
  Synthetic Polynucleotide
taatacgactcactatagggtatagtcaaaaacaagaacatcactggaagaacagaggagacttccaatgatgttcttgaacctggcggcagcgcaaaagatg

SEQ ID NO: 191024 - DNA, 103 bp, Artificial Sequence
  Synthetic Polynucleotide
taatacgactcactatagggggatgttttgtatagtcaaaaacaagaacaaacagaggagatgttctatgttttgactaaacctggcggcagcgcaaaagatg

SEQ ID NO: 191025 - DNA, 103 bp, Artificial Sequence
  Synthetic Polynucleotide
taatacgactcactatagggtggtttagaaggatgttttgtatagtcaaaaacagaggagatttgacatgacaaaacataacctggcggcagcgcaaaagatg

SEQ ID NO: 191026 - DNA, 103 bp, Artificial Sequence
  Synthetic Polynucleotide
taatacgactcactatagggcagaaggatctggtttagaaggatgttttgaacagaggagacaaaacatgcttctaaacaacctggcggcagcgcaaaagatg

SEQ ID NO: 191027 - DNA, 103 bp, Artificial Sequence
  Synthetic Polynucleotide
taatacgactcactatagggttgcactctccagaaggatctggtttagaaaacagaggagattctaaatgagatccttcaacctggcggcagcgcaaaagatg

SEQ ID NO: 191028 - DNA, 103 bp, Artificial Sequence
  Synthetic Polynucleotide
taatacgactcactatagggcaagtctgggttgcactctccagaaggatcaacagaggagagatcctatgggagagtgcaacctggcggcagcgcaaaagatg

SEQ ID NO: 191029 - DNA, 103 bp, Artificial Sequence
  Synthetic Polynucleotide
taatacgactcactatagggtccatattttgtattcctcgttgatcactcaacagaggagagagtgaatgacgaggaataacctggcggcagcgcaaaagatg

SEQ ID NO: 191030 - DNA, 103 bp, Artificial Sequence
  Synthetic Polynucleotide
taatacgactcactatagggcacggagacgcaagtctgggttgcactctcaacagaggagagagagtatgacccagactaacctggcggcagcgcaaaagatg

SEQ ID NO: 191031 - DNA, 103 bp, Artificial Sequence
  Synthetic Polynucleotide
taatacgactcactatagggttctgatgtccacggagacgcaagtctgggaacagaggagacccagaatggcgtctccgaacctggcggcagcgcaaaagatg

SEQ ID NO: 191032 - DNA, 103 bp, Artificial Sequence
  Synthetic Polynucleotide
taatacgactcactatagggatagccttccttctgatgtccacggagacgaacagaggagacgtctcatgggacatcagaacctggcggcagcgcaaaagatg

SEQ ID NO: 191033 - DNA, 103 bp, Artificial Sequence
  Synthetic Polynucleotide
taatacgactcactatagggaagaaagcccatagccttccttctgatgtcaacagaggagagacatcatgaggaaggctaacctggcggcagcgcaaaagatg

SEQ ID NO: 191034 - DNA, 103 bp, Artificial Sequence
  Synthetic Polynucleotide
taatacgactcactatagggtttgggttccaagaaagcccatagccttccaacagaggagaggaaggatgtgggctttcaacctggcggcagcgcaaaagatg

SEQ ID NO: 191035 - DNA, 103 bp, Artificial Sequence
  Synthetic Polynucleotide
taatacgactcactatagggcccactgagatttgggttccaagaaagcccaacagaggagagggcttatgtggaacccaaacctggcggcagcgcaaaagatg

SEQ ID NO: 191036 - DNA, 103 bp, Artificial Sequence
  Synthetic Polynucleotide
taatacgactcactatagggtaagtaagtgcccactgagatttgggttccaacagaggagaggaaccatgatctcagtgaacctggcggcagcgcaaaagatg

SEQ ID NO: 191037 - DNA, 103 bp, Artificial Sequence
  Synthetic Polynucleotide
taatacgactcactatagggtctgaagcactaagtaagtgcccactgagaaacagaggagatctcagatggcacttactaacctggcggcagcgcaaaagatg

SEQ ID NO: 191038 - DNA, 103 bp, Artificial Sequence
  Synthetic Polynucleotide
taatacgactcactatagggggtatggtcatctgaagcactaagtaagtgaacagaggagacacttaatgagtgcttcaaacctggcggcagcgcaaaagatg

SEQ ID NO: 191039 - DNA, 103 bp, Artificial Sequence
  Synthetic Polynucleotide
taatacgactcactatagggacaggcagatggtatggtcatctgaagcacaacagaggagagtgcttatgatgaccataaacctggcggcagcgcaaaagatg

SEQ ID NO: 191040 - DNA, 103 bp, Artificial Sequence
  Synthetic Polynucleotide
taatacgactcactataggggtgttctttttccatattttgtattcctcgaacagaggagacgaggaatgcaaaatatgaacctggcggcagcgcaaaagatg

SEQ ID NO: 191041 - DNA, 103 bp, Artificial Sequence
  Synthetic Polynucleotide
taatacgactcactatagggctgatgtcccacaggcagatggtatggtcaaacagaggagatgaccaatgcatctgcctaacctggcggcagcgcaaaagatg

SEQ ID NO: 191042 - DNA, 103 bp, Artificial Sequence
  Synthetic Polynucleotide
taatacgactcactatagggtggaacggcactgatgtcccacaggcagataacagaggagaatctgcatgtgggacatcaacctggcggcagcgcaaaagatg

SEQ ID NO: 191043 - DNA, 103 bp, Artificial Sequence
  Synthetic Polynucleotide
taatacgactcactatagggttccctcctttggaacggcactgatgtcccaacagaggagagggacaatggtgccgttcaacctggcggcagcgcaaaagatg

SEQ ID NO: 191044 - DNA, 103 bp, Artificial Sequence
  Synthetic Polynucleotide
taatacgactcactatagggtctaccacttttccctcctttggaacggcaaacagaggagatgccgtatgaaaggagggaacctggcggcagcgcaaaagatg

SEQ ID NO: 191045 - DNA, 103 bp, Artificial Sequence
  Synthetic Polynucleotide
taatacgactcactatagggggtcttcgcatctaccacttttccctccttaacagaggagaaaggagatgaaagtggtaaacctggcggcagcgcaaaagatg

SEQ ID NO: 191046 - DNA, 103 bp, Artificial Sequence
  Synthetic Polynucleotide
taatacgactcactatagggctgtaaagatggtcttcgcatctaccacttaacagaggagaaagtggatgatgcgaagaaacctggcggcagcgcaaaagatg

SEQ ID NO: 191047 - DNA, 103 bp, Artificial Sequence
  Synthetic Polynucleotide
taatacgactcactataggggccgtatgccctgtaaagatggtcttcgcaaacagaggagatgcgaaatgcatctttacaacctggcggcagcgcaaaagatg

SEQ ID NO: 191048 - DNA, 103 bp, Artificial Sequence
  Synthetic Polynucleotide
taatacgactcactatagggttctactactgccgtatgccctgtaaagataacagaggagaatctttatggggcatacgaacctggcggcagcgcaaaagatg

SEQ ID NO: 191049 - DNA, 103 bp, Artificial Sequence
  Synthetic Polynucleotide
taatacgactcactatagggaggaaacatcttctactactgccgtatgccaacagaggagaggcataatgcagtagtagaacctggcggcagcgcaaaagatg

SEQ ID NO: 191050 - DNA, 103 bp, Artificial Sequence
  Synthetic Polynucleotide
taatacgactcactatagggagtagatgccaggaaacatcttctactactaacagaggagaagtagtatgagatgtttcaacctggcggcagcgcaaaagatg

SEQ ID NO: 191051 - DNA, 103 bp, Artificial Sequence
  Synthetic Polynucleotide
taatacgactcactatagggaagaaaaggggtgttctttttccatattttaacagaggagaaaaataatgaaaaagaacaacctggcggcagcgcaaaagatg

SEQ ID NO: 191052 - DNA, 103 bp, Artificial Sequence
  Synthetic Polynucleotide
taatacgactcactatagggagactcatggagtagatgccaggaaacatcaacagaggagagatgttatgtggcatctaaacctggcggcagcgcaaaagatg

SEQ ID NO: 191053 - DNA, 103 bp, Artificial Sequence
  Synthetic Polynucleotide
taatacgactcactatagggacccaaacagagactcatggagtagatgccaacagaggagaggcatcatgtccatgagtaacctggcggcagcgcaaaagatg

SEQ ID NO: 191054 - DNA, 103 bp, Artificial Sequence
  Synthetic Polynucleotide
taatacgactcactatagggtcagcaactgacccaaacagagactcatggaacagaggagaccatgaatgtctgtttggaacctggcggcagcgcaaaagatg

SEQ ID NO: 191055 - DNA, 103 bp, Artificial Sequence
  Synthetic Polynucleotide
taatacgactcactatagggtttctgatcatcagcaactgacccaaacagaacagaggagactgtttatgtcagttgctaacctggcggcagcgcaaaagatg

SEQ ID NO: 191056 - DNA, 103 bp, Artificial Sequence
  Synthetic Polynucleotide
taatacgactcactatagggaaatcataagtttctgatcatcagcaactgaacagaggagacagttgatgatgatcagaaacctggcggcagcgcaaaagatg

SEQ ID NO: 191057 - DNA, 103 bp, Artificial Sequence
  Synthetic Polynucleotide
taatacgactcactatagggcgagtatcccaaatcataagtttctgatcaaacagaggagatgatcaatgacttatgataacctggcggcagcgcaaaagatg

SEQ ID NO: 191058 - DNA, 103 bp, Artificial Sequence
  Synthetic Polynucleotide
taatacgactcactatagggattgtttgaacgagtatcccaaatcataagaacagaggagacttatgatgtgggatactaacctggcggcagcgcaaaagatg

SEQ ID NO: 191059 - DNA, 103 bp, Artificial Sequence
  Synthetic Polynucleotide
taatacgactcactataggggtttggaagtattgtttgaacgagtatcccaacagaggagagggataatggttcaaacaaacctggcggcagcgcaaaagatg

SEQ ID NO: 191060 - DNA, 103 bp, Artificial Sequence
  Synthetic Polynucleotide
taatacgactcactataggggagtggcttggtttggaagtattgtttgaaaacagaggagattcaaaatgtacttccaaaacctggcggcagcgcaaaagatg

SEQ ID NO: 191061 - DNA, 103 bp, Artificial Sequence
  Synthetic Polynucleotide
taatacgactcactatagggagcatcaactgagtggcttggtttggaagtaacagaggagaacttccatgccaagccacaacctggcggcagcgcaaaagatg

SEQ ID NO: 191062 - DNA, 103 bp, Artificial Sequence
  Synthetic Polynucleotide
taatacgactcactatagggccaaatcataaagaaaaggggtgttcttttaacagaggagaaaaagaatgccccttttcaacctggcggcagcgcaaaagatg

SEQ ID NO: 191063 - DNA, 103 bp, Artificial Sequence
  Synthetic Polynucleotide
taatacgactcactatagggcagcagtgtgagcatcaactgagtggcttgaacagaggagacaagccatgcagttgatgaacctggcggcagcgcaaaagatg

SEQ ID NO: 191064 - DNA, 103 bp, Artificial Sequence
  Synthetic Polynucleotide
taatacgactcactatagggcagttcacttcagcagtgtgagcatcaactaacagaggagaagttgaatgtcacactgcaacctggcggcagcgcaaaagatg

SEQ ID NO: 191065 - DNA, 103 bp, Artificial Sequence
  Synthetic Polynucleotide
taatacgactcactataggggaaagaaaggcagttcacttcagcagtgtgaacagaggagacacactatggaagtgaacaacctggcggcagcgcaaaagatg

SEQ ID NO: 191066 - DNA, 103 bp, Artificial Sequence
  Synthetic Polynucleotide
taatacgactcactatagggtataaggattgaaagaaaggcagttcacttaacagaggagaaagtgaatggcctttcttaacctggcggcagcgcaaaagatg

SEQ ID NO: 191067 - DNA, 103 bp, Artificial Sequence
  Synthetic Polynucleotide
taatacgactcactatagggatgaactcactataaggattgaaagaaaggaacagaggagacctttcatgcaatccttaaacctggcggcagcgcaaaagatg

SEQ ID NO: 191068 - DNA, 103 bp, Artificial Sequence
  Synthetic Polynucleotide
taatacgactcactatagggtgtggcaagaatgaactcactataaggattaacagaggagaaatcctatgagtgagttcaacctggcggcagcgcaaaagatg

SEQ ID NO: 191069 - DNA, 103 bp, Artificial Sequence
  Synthetic Polynucleotide
taatacgactcactatagggcagctgatcctgtggcaagaatgaactcacaacagaggagagtgagtatgttcttgccaaacctggcggcagcgcaaaagatg

SEQ ID NO: 191070 - DNA, 103 bp, Artificial Sequence
  Synthetic Polynucleotide
taatacgactcactatagggacagtcttgtcagctgatcctgtggcaagaaacagaggagatcttgcatgaggatcagcaacctggcggcagcgcaaaagatg

SEQ ID NO: 191071 - DNA, 103 bp, Artificial Sequence
  Synthetic Polynucleotide
taatacgactcactatagggccacaaggcaacagtcttgtcagctgatccaacagaggagaggatcaatggacaagactaacctggcggcagcgcaaaagatg

SEQ ID NO: 191072 - DNA, 103 bp, Artificial Sequence
  Synthetic Polynucleotide
taatacgactcactatagggttctcagatcccacaaggcaacagtcttgtaacagaggagaacaagaatgttgccttgtaacctggcggcagcgcaaaagatg

SEQ ID NO: 191073 - DNA, 103 bp, Artificial Sequence
  Synthetic Polynucleotide
taatacgactcactatagggtgggtcatcaccaaatcataaagaaaagggaacagaggagaccctttatgttatgatttaacctggcggcagcgcaaaagatg

SEQ ID NO: 191074 - DNA, 103 bp, Artificial Sequence
  Synthetic Polynucleotide
taatacgactcactatagggagtttcagatttctcagatcccacaaggcaaacagaggagatgccttatgggatctgagaacctggcggcagcgcaaaagatg

SEQ ID NO: 191075 - DNA, 103 bp, Artificial Sequence
  Synthetic Polynucleotide
taatacgactcactatagggatgcaacttaagtttcagatttctcagatcaacagaggagagatctgatgaatctgaaaaacctggcggcagcgcaaaagatg

SEQ ID NO: 191076 - DNA, 103 bp, Artificial Sequence
  Synthetic Polynucleotide
taatacgactcactatagggactcaaaggaatgcaacttaagtttcagataacagaggagaatctgaatgttaagttgcaacctggcggcagcgcaaaagatg

SEQ ID NO: 191077 - DNA, 103 bp, Artificial Sequence
  Synthetic Polynucleotide
taatacgactcactatagggtccttatgtgactcaaaggaatgcaacttaaacagaggagataagttatgttcctttgaaacctggcggcagcgcaaaagatg

SEQ ID NO: 191078 - DNA, 103 bp, Artificial Sequence
  Synthetic Polynucleotide
taatacgactcactataggggaatatttcatccttatgtgactcaaaggaaacagaggagatcctttatgtcacataagaacctggcggcagcgcaaaagatg

SEQ ID NO: 191079 - DNA, 103 bp, Artificial Sequence
  Synthetic Polynucleotide
taatacgactcactatagggactgaacctggaatatttcatccttatgtgaacagaggagacacataatgatgaaatataacctggcggcagcgcaaaagatg

SEQ ID NO: 191080 - DNA, 103 bp, Artificial Sequence
  Synthetic Polynucleotide
taatacgactcactatagggtgaggtgaccactgaacctggaatatttcaaacagaggagatgaaatatgccaggttcaaacctggcggcagcgcaaaagatg

SEQ ID NO: 191081 - DNA, 103 bp, Artificial Sequence
  Synthetic Polynucleotide
taatacgactcactatagggagtctcattgtgaggtgaccactgaacctgaacagaggagacaggttatgtggtcacctaacctggcggcagcgcaaaagatg

SEQ ID NO: 191082 - DNA, 103 bp, Artificial Sequence
  Synthetic Polynucleotide
taatacgactcactatagggaagctaaaatagtctcattgtgaggtgaccaacagaggagaggtcacatgacaatgagaaacctggcggcagcgcaaaagatg

SEQ ID NO: 191083 - DNA, 103 bp, Artificial Sequence
  Synthetic Polynucleotide
taatacgactcactataggggtaccactggaagctaaaatagtctcattgaacagaggagacaatgaatgtattttagcaacctggcggcagcgcaaaagatg

SEQ ID NO: 191084 - DNA, 103 bp, Artificial Sequence
  Synthetic Polynucleotide
taatacgactcactatagggcccaaaggactccagcaactcgaggttcataacagaggagaatgaacatggagttgctgaacctggcggcagcgcaaaagatg

SEQ ID NO: 191085 - DNA, 103 bp, Artificial Sequence
  Synthetic Polynucleotide
taatacgactcactatagggtgcaagcagtgtgccccacctgttaaaggtaacagaggagaacctttatgaggtggggcaacctggcggcagcgcaaaagatg

SEQ ID NO: 191086 - DNA, 103 bp, Artificial Sequence
  Synthetic Polynucleotide
taatacgactcactatagggatccaattctttgaagtctggtgcaaatgcaacagaggagagcatttatgccagacttcaacctggcggcagcgcaaaagatg

SEQ ID NO: 191087 - DNA, 103 bp, Artificial Sequence
  Synthetic Polynucleotide
taatacgactcactatagggctacattttcatccaattctttgaagtctgaacagaggagacagactatgaagaattggaacctggcggcagcgcaaaagatg

SEQ ID NO: 191088 - DNA, 103 bp, Artificial Sequence
  Synthetic Polynucleotide
taatacgactcactatagggtcttcgtattctacattttcatccaattctaacagaggagaagaattatgtgaaaatgtaacctggcggcagcgcaaaagatg

SEQ ID NO: 191089 - DNA, 103 bp, Artificial Sequence
  Synthetic Polynucleotide
taatacgactcactatagggtgattccctttcttcgtattctacattttcaacagaggagagaaaatatggaatacgaaaacctggcggcagcgcaaaagatg

SEQ ID NO: 191090 - DNA, 103 bp, Artificial Sequence
  Synthetic Polynucleotide
taatacgactcactatagggtatcaaactctgattccctttcttcgtattaacagaggagaaatacgatgaaagggaataacctggcggcagcgcaaaagatg

SEQ ID NO: 191091 - DNA, 103 bp, Artificial Sequence
  Synthetic Polynucleotide
taatacgactcactatagggtcatcttcaatatcaaactctgattcccttaacagaggagaaagggaatgagagtttgaaacctggcggcagcgcaaaagatg

SEQ ID NO: 191092 - DNA, 103 bp, Artificial Sequence
  Synthetic Polynucleotide
taatacgactcactatagggactcttatcttcatcttcaatatcaaactcaacagaggagagagtttatgattgaagataacctggcggcagcgcaaaagatg

SEQ ID NO: 191093 - DNA, 103 bp, Artificial Sequence
  Synthetic Polynucleotide
taatacgactcactataggggctcaggctcactcttatcttcatcttcaaaacagaggagattgaagatgaagataagaaacctggcggcagcgcaaaagatg

SEQ ID NO: 191094 - DNA, 103 bp, Artificial Sequence
  Synthetic Polynucleotide
taatacgactcactataggggcccctgtctgctcaggctcactcttatctaacagaggagaagataaatgtgagcctgaaacctggcggcagcgcaaaagatg

SEQ ID NO: 191095 - DNA, 103 bp, Artificial Sequence
  Synthetic Polynucleotide
taatacgactcactatagggtgcagcatcagcccctgtctgctcaggctcaacagaggagagagcctatgcagacagggaacctggcggcagcgcaaaagatg

SEQ ID NO: 191096 - DNA, 103 bp, Artificial Sequence
  Synthetic Polynucleotide
taatacgactcactatagggtacagccaactgcaagcagtgtgccccaccaacagaggagaggtgggatgcactgcttgaacctggcggcagcgcaaaagatg

SEQ ID NO: 191097 - DNA, 103 bp, Artificial Sequence
  Synthetic Polynucleotide
taatacgactcactatagggcctcatcttctgcagcatcagcccctgtctaacagaggagaagacagatgctgatgctgaacctggcggcagcgcaaaagatg

SEQ ID NO: 191098 - DNA, 103 bp, Artificial Sequence
  Synthetic Polynucleotide
taatacgactcactatagggacatccacttcctcatcttctgcagcatcaaacagaggagatgatgcatgagaagatgaaacctggcggcagcgcaaaagatg

SEQ ID NO: 191099 - DNA, 103 bp, Artificial Sequence
  Synthetic Polynucleotide
taatacgactcactatagggcacgctggtgacatccacttcctcatcttcaacagaggagagaagatatggaagtggataacctggcggcagcgcaaaagatg

SEQ ID NO: 191100 - DNA, 103 bp, Artificial Sequence
  Synthetic Polynucleotide
taatacgactcactatagggcaatagggtccacgctggtgacatccacttaacagaggagaaagtggatgtcaccagcgaacctggcggcagcgcaaaagatg

SEQ ID NO: 191101 - DNA, 103 bp, Artificial Sequence
  Synthetic Polynucleotide
taatacgactcactatagggcagaaggcagcaatagggtccacgctggtgaacagaggagacaccagatgggaccctataacctggcggcagcgcaaaagatg

SEQ ID NO: 191102 - DNA, 103 bp, Artificial Sequence
  Synthetic Polynucleotide
taatacgactcactatagggatcactgctacagaaggcagcaatagggtcaacagaggagagaccctatggctgccttcaacctggcggcagcgcaaaagatg

SEQ ID NO: 191103 - DNA, 103 bp, Artificial Sequence
  Synthetic Polynucleotide
taatacgactcactatagggccagctcttcatcactgctacagaaggcagaacagaggagactgcctatggtagcagtgaacctggcggcagcgcaaaagatg

SEQ ID NO: 191104 - DNA, 103 bp, Artificial Sequence
  Synthetic Polynucleotide
taatacgactcactatagggtttgaatcttccagctcttcatcactgctaaacagaggagatagcagatgtgaagagctaacctggcggcagcgcaaaagatg

SEQ ID NO: 191105 - DNA, 103 bp, Artificial Sequence
  Synthetic Polynucleotide
taatacgactcactatagggcaatagagcctttgaatcttccagctcttcaacagaggagagaagagatggaagattcaaacctggcggcagcgcaaaagatg

SEQ ID NO: 191106 - DNA, 103 bp, Artificial Sequence
  Synthetic Polynucleotide
taatacgactcactatagggtgggtaaatacaatagagcctttgaatcttaacagaggagaaagattatgaggctctataacctggcggcagcgcaaaagatg

SEQ ID NO: 191107 - DNA, 103 bp, Artificial Sequence
  Synthetic Polynucleotide
taatacgactcactatagggcggccatcattacagccaactgcaagcagtaacagaggagaactgctatgagttggctgaacctggcggcagcgcaaaagatg

SEQ ID NO: 191108 - DNA, 103 bp, Artificial Sequence
  Synthetic Polynucleotide
taatacgactcactatagggtcaggggcaatgggtaaatacaatagagccaacagaggagaggctctatggtatttaccaacctggcggcagcgcaaaagatg

SEQ ID NO: 191109 - DNA, 103 bp, Artificial Sequence
  Synthetic Polynucleotide
taatacgactcactataggggtcttctacctcaggggcaatgggtaaataaacagaggagatatttaatgattgcccctaacctggcggcagcgcaaaagatg

SEQ ID NO: 191110 - DNA, 103 bp, Artificial Sequence
  Synthetic Polynucleotide
taatacgactcactatagggtttcttctgggtcttctacctcaggggcaaaacagaggagattgcccatgaggtagaagaacctggcggcagcgcaaaagatg

SEQ ID NO: 191111 - DNA, 103 bp, Artificial Sequence
  Synthetic Polynucleotide
taatacgactcactatagggccgtaaggattttcttctgggtcttctaccaacagaggagaggtagaatgcccagaagaaacctggcggcagcgcaaaagatg

SEQ ID NO: 191112 - DNA, 103 bp, Artificial Sequence
  Synthetic Polynucleotide
taatacgactcactatagggcggtggggggccgtaaggattttcttctggaacagaggagaccagaaatgaatccttacaacctggcggcagcgcaaaagatg

SEQ ID NO: 191113 - DNA, 103 bp, Artificial Sequence
  Synthetic Polynucleotide
taatacgactcactatagggggactgcatccggtggggggccgtaaggataacagaggagaatccttatggccccccacaacctggcggcagcgcaaaagatg

SEQ ID NO: 191114 - DNA, 103 bp, Artificial Sequence
  Synthetic Polynucleotide
taatacgactcactatagggaaggaggtttggactgcatccggtggggggaacagaggagaccccccatgggatgcagtaacctggcggcagcgcaaaagatg

SEQ ID NO: 191115 - DNA, 103 bp, Artificial Sequence
  Synthetic Polynucleotide
taatacgactcactatagggttcatccatcaaggaggtttggactgcatcaacagaggagagatgcaatgcaaacctccaacctggcggcagcgcaaaagatg

SEQ ID NO: 191116 - DNA, 103 bp, Artificial Sequence
  Synthetic Polynucleotide
taatacgactcactatagggaactagccccttcatccatcaaggaggtttaacagaggagaaaacctatgtgatggatgaacctggcggcagcgcaaaagatg

SEQ ID NO: 191117 - DNA, 103 bp, Artificial Sequence
  Synthetic Polynucleotide
taatacgactcactatagggttcttctctgaactagccccttcatccatcaacagaggagagatggaatgaggggctagaacctggcggcagcgcaaaagatg

SEQ ID NO: 191118 - DNA, 103 bp, Artificial Sequence
  Synthetic Polynucleotide
taatacgactcactataggggatgacaattcggccatcattacagccaacaacagaggagagttggcatgaatgatggcaacctggcggcagcgcaaaagatg

SEQ ID NO: 191119 - DNA, 103 bp, Artificial Sequence
  Synthetic Polynucleotide
taatacgactcactatagggggactgcctcttcttctctgaactagccccaacagaggagaggggctatgtcagagaagaacctggcggcagcgcaaaagatg

SEQ ID NO: 191120 - DNA, 103 bp, Artificial Sequence
  Synthetic Polynucleotide
taatacgactcactatagggcatctgctgaggactgcctcttcttctctgaacagaggagacagagaatgagaggcagtaacctggcggcagcgcaaaagatg

SEQ ID NO: 191121 - DNA, 103 bp, Artificial Sequence
  Synthetic Polynucleotide
taatacgactcactatagggggctgggacccatctgctgaggactgcctcaacagaggagagaggcaatgctcagcagaaacctggcggcagcgcaaaagatg

SEQ ID NO: 191122 - DNA, 103 bp, Artificial Sequence
  Synthetic Polynucleotide
taatacgactcactatagggcttcttaggtggctgggacccatctgctgaaacagaggagatcagcaatggggtcccagaacctggcggcagcgcaaaagatg

SEQ ID NO: 191123 - DNA, 103 bp, Artificial Sequence
  Synthetic Polynucleotide
taatacgactcactatagggttttgggtttcttcttaggtggctgggaccaacagaggagaggtcccatgcacctaagaaacctggcggcagcgcaaaagatg

SEQ ID NO: 191124 - DNA, 103 bp, Artificial Sequence
  Synthetic Polynucleotide
taatacgactcactatagggatattggttgttttgggtttcttcttaggtaacagaggagaacctaaatggaaacccaaaacctggcggcagcgcaaaagatg

SEQ ID NO: 191125 - DNA, 103 bp, Artificial Sequence
  Synthetic Polynucleotide
taatacgactcactatagggttgaagttctatattggttgttttgggtttaacagaggagaaaacccatgacaaccaataacctggcggcagcgcaaaagatg

SEQ ID NO: 191126 - DNA, 103 bp, Artificial Sequence
  Synthetic Polynucleotide
taatacgactcactatagggttggtactccttgaagttctatattggttgaacagaggagacaaccaatgtagaacttcaacctggcggcagcgcaaaagatg

SEQ ID NO: 191127 - DNA, 103 bp, Artificial Sequence
  Synthetic Polynucleotide
taatacgactcactatagggacttcatcatttggtactccttgaagttctaacagaggagaagaactatgaggagtaccaacctggcggcagcgcaaaagatg

SEQ ID NO: 191128 - DNA, 103 bp, Artificial Sequence
  Synthetic Polynucleotide
taatacgactcactatagggtagtggatggacttcatcatttggtactccaacagaggagaggagtaatgaatgatgaaaacctggcggcagcgcaaaagatg

SEQ ID NO: 191129 - DNA, 103 bp, Artificial Sequence
  Synthetic Polynucleotide
taatacgactcactatagggagaaatcccagatgacaattcggccatcataacagaggagaatgatgatggaattgtcaaacctggcggcagcgcaaaagatg

SEQ ID NO: 191130 - DNA, 103 bp, Artificial Sequence
  Synthetic Polynucleotide
taatacgactcactatagggtcacacccagtagtggatggacttcatcataacagaggagaatgatgatgtccatccacaacctggcggcagcgcaaaagatg

SEQ ID NO: 191131 - DNA, 103 bp, Artificial Sequence
  Synthetic Polynucleotide
taatacgactcactatagggccatcccccttcacacccagtagtggatggaacagaggagaccatccatgactgggtgtaacctggcggcagcgcaaaagatg

SEQ ID NO: 191132 - DNA, 103 bp, Artificial Sequence
  Synthetic Polynucleotide
taatacgactcactatagggcttggatttgccatcccccttcacacccagaacagaggagactgggtatgaagggggataacctggcggcagcgcaaaagatg

SEQ ID NO: 191133 - DNA, 103 bp, Artificial Sequence
  Synthetic Polynucleotide
taatacgactcactatagggcttgcttcttcttggatttgccatccccctaacagaggagaagggggatggcaaatccaaacctggcggcagcgcaaaagatg

SEQ ID NO: 191134 - DNA, 103 bp, Artificial Sequence
  Synthetic Polynucleotide
taatacgactcactatagggggccggcctgcttgcttcttcttggatttgaacagaggagacaaatcatggaagaagcaaacctggcggcagcgcaaaagatg

SEQ ID NO: 191135 - DNA, 103 bp, Artificial Sequence
  Synthetic Polynucleotide
taatacgactcactatagggtgatcctttaggccggcctgcttgcttcttaacagaggagaaagaagatggcaggccggaacctggcggcagcgcaaaagatg

SEQ ID NO: 191136 - DNA, 103 bp, Artificial Sequence
  Synthetic Polynucleotide
taatacgactcactatagggctttaccttttgatcctttaggccggcctgaacagaggagacaggccatgctaaaggataacctggcggcagcgcaaaagatg

SEQ ID NO: 191137 - DNA, 103 bp, Artificial Sequence
  Synthetic Polynucleotide
taatacgactcactataggggaatctttctctttaccttttgatcctttaaacagaggagataaaggatgaaaaggtaaaacctggcggcagcgcaaaagatg

SEQ ID NO: 191138 - DNA, 103 bp, Artificial Sequence
  Synthetic Polynucleotide
taatacgactcactatagggtttaaatggagaatctttctctttacctttaacagaggagaaaaggtatggagaaagataacctggcggcagcgcaaaagatg

SEQ ID NO: 191139 - DNA, 103 bp, Artificial Sequence
  Synthetic Polynucleotide
taatacgactcactatagggagagtttcggtttaaatggagaatctttctaacagaggagaagaaagatgctccatttaaacctggcggcagcgcaaaagatg

SEQ ID NO: 191140 - DNA, 103 bp, Artificial Sequence
  Synthetic Polynucleotide
taatacgactcactatagggcctcttgtcaagaaatcccagatgacaattaacagaggagaaattgtatgctgggatttaacctggcggcagcgcaaaagatg

SEQ ID NO: 191141 - DNA, 103 bp, Artificial Sequence
  Synthetic Polynucleotide
taatacgactcactatagggtcccctttgtagagtttcggtttaaatggaaacagaggagatccattatgaccgaaactaacctggcggcagcgcaaaagatg

SEQ ID NO: 191142 - DNA, 103 bp, Artificial Sequence
  Synthetic Polynucleotide
taatacgactcactatagggtaaacctctgtcccctttgtagagtttcggaacagaggagaccgaaaatgtacaaagggaacctggcggcagcgcaaaagatg

SEQ ID NO: 191143 - DNA, 103 bp, Artificial Sequence
  Synthetic Polynucleotide
taatacgactcactatagggcttccagaggtaaacctctgtcccctttgtaacagaggagaacaaagatgacagaggttaacctggcggcagcgcaaaagatg

SEQ ID NO: 191144 - DNA, 103 bp, Artificial Sequence
  Synthetic Polynucleotide
taatacgactcactatagggttcgctgatccttccagaggtaaacctctgaacagaggagacagaggatgacctctggaaacctggcggcagcgcaaaagatg

SEQ ID NO: 191145 - DNA, 103 bp, Artificial Sequence
  Synthetic Polynucleotide
taatacgactcactatagggcactttacccttcgctgatccttccagaggaacagaggagacctctgatgggatcagcgaacctggcggcagcgcaaaagatg

SEQ ID NO: 191146 - DNA, 103 bp, Artificial Sequence
  Synthetic Polynucleotide
taatacgactcactataggggttccgcctgcactttacccttcgctgatcaacagaggagagatcagatgagggtaaagaacctggcggcagcgcaaaagatg

SEQ ID NO: 191147 - DNA, 103 bp, Artificial Sequence
  Synthetic Polynucleotide
taatacgactcactatagggggctggctgagttccgcctgcactttacccaacagaggagagggtaaatggcaggcggaaacctggcggcagcgcaaaagatg

SEQ ID NO: 191148 - DNA, 103 bp, Artificial Sequence
  Synthetic Polynucleotide
taatacgactcactatagggtgctgtcaagggctggctgagttccgcctgaacagaggagacaggcgatgctcagccagaacctggcggcagcgcaaaagatg

SEQ ID NO: 191149 - DNA, 103 bp, Artificial Sequence
  Synthetic Polynucleotide
taatacgactcactatagggttgctcctcctgctgtcaagggctggctgaaacagaggagatcagccatgccttgacagaacctggcggcagcgcaaaagatg

SEQ ID NO: 191150 - DNA, 103 bp, Artificial Sequence
  Synthetic Polynucleotide
taatacgactcactatagggagttctgagattgctcctcctgctgtcaagaacagaggagacttgacatgaggaggagcaacctggcggcagcgcaaaagatg

SEQ ID NO: 191151 - DNA, 103 bp, Artificial Sequence
  Synthetic Polynucleotide
taatacgactcactatagggtttagcaatgcctcttgtcaagaaatcccaaacagaggagatgggatatgttgacaagaaacctggcggcagcgcaaaagatg

SEQ ID NO: 191152 - DNA, 103 bp, Artificial Sequence
  Synthetic Polynucleotide
taatacgactcactatagggcactaattattttagcaatgcctcttgtcaaacagaggagatgacaaatggcattgctaaacctggcggcagcgcaaaagatg

SEQ ID NO: 191153 - DNA, 103 bp, Artificial Sequence
  Synthetic Polynucleotide
taatacgactcactatagggtggatgtgtgcactaattattttagcaatgaacagaggagacattgcatgaataattagaacctggcggcagcgcaaaagatg

SEQ ID NO: 191154 - DNA, 103 bp, Artificial Sequence
  Synthetic Polynucleotide
taatacgactcactatagggacacactggatggatgtgtgcactaattataacagaggagaataattatggcacacatcaacctggcggcagcgcaaaagatg

SEQ ID NO: 191155 - DNA, 103 bp, Artificial Sequence
  Synthetic Polynucleotide
taatacgactcactataggggatagttctgcccaaaggactccagcaactaacagaggagaagttgcatgagtcctttgaacctggcggcagcgcaaaagatg

SEQ ID NO: 191156 - DNA, 103 bp, Artificial Sequence
  Synthetic Polynucleotide
taatacgactcactatagggagcataaagaacacactggatggatgtgtgaacagaggagacacacaatgatccagtgtaacctggcggcagcgcaaaagatg

SEQ ID NO: 191157 - DNA, 103 bp, Artificial Sequence
  Synthetic Polynucleotide
taatacgactcactatagggtctcggctccagcataaagaacacactggaaacagaggagatccagtatgttctttatgaacctggcggcagcgcaaaagatg

SEQ ID NO: 191158 - DNA, 103 bp, Artificial Sequence
  Synthetic Polynucleotide
taatacgactcactatagggtttatgaccatctcggctccagcataaagaaacagaggagatctttaatgtggagccgaaacctggcggcagcgcaaaagatg

SEQ ID NO: 191159 - DNA, 103 bp, Artificial Sequence
  Synthetic Polynucleotide
taatacgactcactatagggcactcacgagtttatgaccatctcggctccaacagaggagaggagccatgatggtcataaacctggcggcagcgcaaaagatg

SEQ ID NO: 191160 - DNA, 103 bp, Artificial Sequence
  Synthetic Polynucleotide
taatacgactcactatagggtcagtggaagcactcacgagtttatgaccaaacagaggagatggtcaatgactcgtgagaacctggcggcagcgcaaaagatg

SEQ ID NO: 191161 - DNA, 103 bp, Artificial Sequence
  Synthetic Polynucleotide
taatacgactcactatagggcactatgttatcagtggaagcactcacgagaacagaggagactcgtgatggcttccactaacctggcggcagcgcaaaagatg

SEQ ID NO: 191162 - DNA, 103 bp, Artificial Sequence
  Synthetic Polynucleotide
taatacgactcactatagggcccactgtgacactatgttatcagtggaagaacagaggagacttccaatgataacatagaacctggcggcagcgcaaaagatg

SEQ ID NO: 191163 - DNA, 103 bp, Artificial Sequence
  Synthetic Polynucleotide
taatacgactcactataggggaaagaacatcccactgtgacactatgttaaacagaggagataacatatggtcacagtgaacctggcggcagcgcaaaagatg

SEQ ID NO: 191164 - DNA, 103 bp, Artificial Sequence
  Synthetic Polynucleotide
taatacgactcactatagggacagtcgcctgaaagaacatcccactgtgaaacagaggagatcacagatggatgttcttaacctggcggcagcgcaaaagatg

SEQ ID NO: 191165 - DNA, 103 bp, Artificial Sequence
  Synthetic Polynucleotide
taatacgactcactatagggacctctggtcacagtcgcctgaaagaacataacagaggagaatgttcatgcaggcgactaacctggcggcagcgcaaaagatg

SEQ ID NO: 191166 - DNA, 103 bp, Artificial Sequence
  Synthetic Polynucleotide
taatacgactcactataggggcttcctctggatagttctgcccaaaggacaacagaggagagtccttatggcagaactaaacctggcggcagcgcaaaagatg

SEQ ID NO: 191167 - DNA, 103 bp, Artificial Sequence
  Synthetic Polynucleotide
taatacgactcactataggggggaatcgaaacctctggtcacagtcgcctaacagaggagaaggcgaatgtgaccagagaacctggcggcagcgcaaaagatg

SEQ ID NO: 191168 - DNA, 103 bp, Artificial Sequence
  Synthetic Polynucleotide
taatacgactcactataggggatgggtgaagggaatcgaaacctctggtcaacagaggagagaccagatgtttcgattcaacctggcggcagcgcaaaagatg

SEQ ID NO: 191169 - DNA, 103 bp, Artificial Sequence
  Synthetic Polynucleotide
taatacgactcactatagggggacttttaagatgggtgaagggaatcgaaaacagaggagattcgatatgcttcacccaaacctggcggcagcgcaaaagatg

SEQ ID NO: 191170 - DNA, 103 bp, Artificial Sequence
  Synthetic Polynucleotide
taatacgactcactatagggggatgatattggacttttaagatgggtgaaaacagaggagattcaccatgcttaaaagtaacctggcggcagcgcaaaagatg

SEQ ID NO: 191171 - DNA, 103 bp, Artificial Sequence
  Synthetic Polynucleotide
taatacgactcactatagggctgatctcgtggatgatattggacttttaaaacagaggagattaaaaatgcaatatcataacctggcggcagcgcaaaagatg

SEQ ID NO: 191172 - DNA, 103 bp, Artificial Sequence
  Synthetic Polynucleotide
taatacgactcactataggggaaccttgttctgatctcgtggatgatattaacagaggagaaatatcatgcacgagatcaacctggcggcagcgcaaaagatg

SEQ ID NO: 191173 - DNA, 103 bp, Artificial Sequence
  Synthetic Polynucleotide
taatacgactcactatagggggacacacgagaaccttgttctgatctcgtaacagaggagaacgagaatggaacaaggtaacctggcggcagcgcaaaagatg

SEQ ID NO: 191174 - DNA, 103 bp, Artificial Sequence
  Synthetic Polynucleotide
taatacgactcactatagggagatttcatgggacacacgagaaccttgttaacagaggagaaacaagatgctcgtgtgtaacctggcggcagcgcaaaagatg

SEQ ID NO: 191175 - DNA, 103 bp, Artificial Sequence
  Synthetic Polynucleotide
taatacgactcactatagggtgacaggagcagatttcatgggacacacgaaacagaggagatcgtgtatgccatgaaataacctggcggcagcgcaaaagatg

SEQ ID NO: 191176 - DNA, 103 bp, Artificial Sequence
  Synthetic Polynucleotide
taatacgactcactatagggagggtcaacatgacaggagcagatttcatgaacagaggagacatgaaatgtgctcctgtaacctggcggcagcgcaaaagatg

SEQ ID NO: 191177 - DNA, 103 bp, Artificial Sequence
  Synthetic Polynucleotide
taatacgactcactatagggagttccatcagcttcctctggatagttctgaacagaggagacagaacatgccagaggaaaacctggcggcagcgcaaaagatg

SEQ ID NO: 191178 - DNA, 103 bp, Artificial Sequence
  Synthetic Polynucleotide
taatacgactcactatagggggaatctgaaagggtcaacatgacaggagcaacagaggagagctcctatgatgttgaccaacctggcggcagcgcaaaagatg

SEQ ID NO: 191179 - DNA, 103 bp, Artificial Sequence
  Synthetic Polynucleotide
taatacgactcactatagggcaacatgtttggaatctgaaagggtcaacaaacagaggagatgttgaatgtttcagattaacctggcggcagcgcaaaagatg

SEQ ID NO: 191180 - DNA, 103 bp, Artificial Sequence
  Synthetic Polynucleotide
taatacgactcactatagggaccggcagaacaacatgtttggaatctgaaaacagaggagattcagaatgcaaacatgtaacctggcggcagcgcaaaagatg

SEQ ID NO: 191181 - DNA, 103 bp, Artificial Sequence
  Synthetic Polynucleotide
taatacgactcactataggggtcatcgtccaccggcagaacaacatgtttaacagaggagaaaacatatggttctgccgaacctggcggcagcgcaaaagatg

SEQ ID NO: 191182 - DNA, 103 bp, Artificial Sequence
  Synthetic Polynucleotide
taatacgactcactatagggtcaaatcggagtcatcgtccaccggcagaaaacagaggagattctgcatgtggacgatgaacctggcggcagcgcaaaagatg

SEQ ID NO: 191183 - DNA, 103 bp, Artificial Sequence
  Synthetic Polynucleotide
taatacgactcactataggggccacaacgttcaaatcggagtcatcgtccaacagaggagaggacgaatgctccgatttaacctggcggcagcgcaaaagatg

SEQ ID NO: 191184 - DNA, 103 bp, Artificial Sequence
  Synthetic Polynucleotide
taatacgactcactatagggatcaaaagatgccacaacgttcaaatcggaaacagaggagatccgatatgaacgttgtgaacctggcggcagcgcaaaagatg

SEQ ID NO: 191185 - DNA, 103 bp, Artificial Sequence
  Synthetic Polynucleotide
taatacgactcactatagggcccctcgcctatcaaaagatgccacaacgtaacagaggagaacgttgatgcatcttttgaacctggcggcagcgcaaaagatg

SEQ ID NO: 191186 - DNA, 103 bp, Artificial Sequence
  Synthetic Polynucleotide
taatacgactcactatagggtaaatatattcccctcgcctatcaaaagataacagaggagaatctttatgtaggcgaggaacctggcggcagcgcaaaagatg

SEQ ID NO: 191187 - DNA, 103 bp, Artificial Sequence
  Synthetic Polynucleotide
taatacgactcactataggggtttcccgtataaatatattcccctcgcctaacagaggagaaggcgaatggaatatattaacctggcggcagcgcaaaagatg

SEQ ID NO: 191188 - DNA, 103 bp, Artificial Sequence
  Synthetic Polynucleotide
taatacgactcactatagggtacaatccaaagttccatcagcttcctctgaacagaggagacagaggatgctgatggaaaacctggcggcagcgcaaaagatg

SEQ ID NO: 191189 - DNA, 103 bp, Artificial Sequence
  Synthetic Polynucleotide
taatacgactcactatagggtgccttttgcgtttcccgtataaatatattaacagaggagaaatataatgatacgggaaaacctggcggcagcgcaaaagatg

SEQ ID NO: 191190 - DNA, 103 bp, Artificial Sequence
  Synthetic Polynucleotide
taatacgactcactatagggaccaaaatcttgccttttgcgtttcccgtaaacagaggagatacgggatgcgcaaaaggaacctggcggcagcgcaaaagatg

SEQ ID NO: 191191 - DNA, 103 bp, Artificial Sequence
  Synthetic Polynucleotide
taatacgactcactatagggtgtttttaggaccaaaatcttgccttttgcaacagaggagagcaaaaatgaagattttgaacctggcggcagcgcaaaagatg

SEQ ID NO: 191192 - DNA, 103 bp, Artificial Sequence
  Synthetic Polynucleotide
taatacgactcactatagggcctgagaatctgtttttaggaccaaaatctaacagaggagaagatttatgtcctaaaaaaacctggcggcagcgcaaaagatg

SEQ ID NO: 191193 - DNA, 103 bp, Artificial Sequence
  Synthetic Polynucleotide
taatacgactcactataggggcaacaagatcctgagaatctgtttttaggaacagaggagacctaaaatgagattctcaaacctggcggcagcgcaaaagatg

SEQ ID NO: 191194 - DNA, 103 bp, Artificial Sequence
  Synthetic Polynucleotide
taatacgactcactatagggtctgaaggaagcaacaagatcctgagaatcaacagaggagagattctatggatcttgttaacctggcggcagcgcaaaagatg

SEQ ID NO: 191195 - DNA, 103 bp, Artificial Sequence
  Synthetic Polynucleotide
taatacgactcactatagggcagttgtcactctgaaggaagcaacaagataacagaggagaatcttgatgcttccttcaaacctggcggcagcgcaaaagatg

SEQ ID NO: 191196 - DNA, 103 bp, Artificial Sequence
  Synthetic Polynucleotide
taatacgactcactatagggttgcttgttccagttgtcactctgaaggaaaacagaggagattccttatgagtgacaacaacctggcggcagcgcaaaagatg

SEQ ID NO: 191197 - DNA, 103 bp, Artificial Sequence
  Synthetic Polynucleotide
taatacgactcactatagggggctgtggtattgcttgttccagttgtcacaacagaggagagtgacaatgggaacaagcaacctggcggcagcgcaaaagatg

SEQ ID NO: 191198 - DNA, 103 bp, Artificial Sequence
  Synthetic Polynucleotide
taatacgactcactatagggttgacttaatggctgtggtattgcttgttcaacagaggagagaacaaatgataccacagaacctggcggcagcgcaaaagatg

SEQ ID NO: 191199 - DNA, 103 bp, Artificial Sequence
  Synthetic Polynucleotide
taatacgactcactataggggccatgctgatacaatccaaagttccatcaaacagaggagatgatggatgtttggattgaacctggcggcagcgcaaaagatg

SEQ ID NO: 191200 - DNA, 103 bp, Artificial Sequence
  Synthetic Polynucleotide
taatacgactcactataggggcaaactcaattgacttaatggctgtggtaaacagaggagataccacatgcattaagtcaacctggcggcagcgcaaaagatg

SEQ ID NO: 191201 - DNA, 103 bp, Artificial Sequence
  Synthetic Polynucleotide
taatacgactcactatagggccccttccgggcaaactcaattgacttaataacagaggagaattaagatgattgagtttaacctggcggcagcgcaaaagatg

SEQ ID NO: 191202 - DNA, 103 bp, Artificial Sequence
  Synthetic Polynucleotide
taatacgactcactatagggaaaagcaactccccttccgggcaaactcaaaacagaggagattgagtatgcccggaaggaacctggcggcagcgcaaaagatg

SEQ ID NO: 191203 - DNA, 103 bp, Artificial Sequence
  Synthetic Polynucleotide
taatacgactcactataggggtgttaattaaaaagcaactccccttccggaacagaggagaccggaaatggagttgcttaacctggcggcagcgcaaaagatg

SEQ ID NO: 191204 - DNA, 103 bp, Artificial Sequence
  Synthetic Polynucleotide
taatacgactcactatagggtcgatctgccgtgttaattaaaaagcaactaacagaggagaagttgcatgttaattaacaacctggcggcagcgcaaaagatg

SEQ ID NO: 191205 - DNA, 103 bp, Artificial Sequence
  Synthetic Polynucleotide
taatacgactcactatagggctctgattattcgatctgccgtgttaattaaacagaggagataattaatgcggcagatcaacctggcggcagcgcaaaagatg

SEQ ID NO: 191206 - DNA, 103 bp, Artificial Sequence
  Synthetic Polynucleotide
taatacgactcactatagggccatcataaactctgattattcgatctgccaacagaggagaggcagaatgaataatcagaacctggcggcagcgcaaaagatg

SEQ ID NO: 191207 - DNA, 103 bp, Artificial Sequence
  Synthetic Polynucleotide
taatacgactcactataggggatttctctgccatcataaactctgattataacagaggagaataatcatggtttatgataacctggcggcagcgcaaaagatg

SEQ ID NO: 191208 - DNA, 103 bp, Artificial Sequence
  Synthetic Polynucleotide
taatacgactcactatagggcacatgttaagatttctctgccatcataaaaacagaggagatttatgatggcagagaaaaacctggcggcagcgcaaaagatg

SEQ ID NO: 191209 - DNA, 103 bp, Artificial Sequence
  Synthetic Polynucleotide
taatacgactcactatagggccatctcttccacatgttaagatttctctgaacagaggagacagagaatgcttaacatgaacctggcggcagcgcaaaagatg

SEQ ID NO: 191210 - DNA, 103 bp, Artificial Sequence
  Synthetic Polynucleotide
taatacgactcactataggggcaagtcaaagccatgctgatacaatccaaaacagaggagattggatatgatcagcatgaacctggcggcagcgcaaaagatg

SEQ ID NO: 191211 - DNA, 103 bp, Artificial Sequence
  Synthetic Polynucleotide
taatacgactcactatagggttcaggctctccatctcttccacatgttaaaacagaggagattaacaatgggaagagataacctggcggcagcgcaaaagatg

SEQ ID NO: 191212 - DNA, 103 bp, Artificial Sequence
  Synthetic Polynucleotide
taatacgactcactatagggtctgcataggttcaggctctccatctcttcaacagaggagagaagagatggagagcctgaacctggcggcagcgcaaaagatg

SEQ ID NO: 191213 - DNA, 103 bp, Artificial Sequence
  Synthetic Polynucleotide
taatacgactcactatagggtcctgcaatttctgcataggttcaggctctaacagaggagaagagccatgacctatgcaaacctggcggcagcgcaaaagatg

SEQ ID NO: 191214 - DNA, 103 bp, Artificial Sequence
  Synthetic Polynucleotide
taatacgactcactatagggattcaccaaatcctgcaatttctgcataggaacagaggagacctatgatgaaattgcagaacctggcggcagcgcaaaagatg

SEQ ID NO: 191215 - DNA, 103 bp, Artificial Sequence
  Synthetic Polynucleotide
taatacgactcactatagggatggggtcctattcaccaaatcctgcaattaacagaggagaaattgcatgatttggtgaaacctggcggcagcgcaaaagatg

SEQ ID NO: 191216 - DNA, 103 bp, Artificial Sequence
  Synthetic Polynucleotide
taatacgactcactatagggcatttcttccatggggtcctattcaccaaaaacagaggagatttggtatgtaggaccccaacctggcggcagcgcaaaagatg

SEQ ID NO: 191217 - DNA, 103 bp, Artificial Sequence
  Synthetic Polynucleotide
taatacgactcactatagggagagaaacaacatttcttccatggggtcctaacagaggagaaggaccatgtggaagaaaaacctggcggcagcgcaaaagatg

SEQ ID NO: 191218 - DNA, 103 bp, Artificial Sequence
  Synthetic Polynucleotide
taatacgactcactatagggccccatccccagagaaacaacatttcttccaacagaggagaggaagaatggttgtttctaacctggcggcagcgcaaaagatg

SEQ ID NO: 191219 - DNA, 103 bp, Artificial Sequence
  Synthetic Polynucleotide
taatacgactcactatagggacgatgtattccccatccccagagaaacaaaacagaggagattgtttatgtggggatggaacctggcggcagcgcaaaagatg

SEQ ID NO: 191220 - DNA, 103 bp, Artificial Sequence
  Synthetic Polynucleotide
taatacgactcactatagggagaacctgccacgatgtattccccatccccaacagaggagaggggatatggaatacatcaacctggcggcagcgcaaaagatg

SEQ ID NO: 191221 - DNA, 103 bp, Artificial Sequence
  Synthetic Polynucleotide
taatacgactcactatagggtgttaaaggtgcaagtcaaagccatgctgaaacagaggagatcagcaatgctttgacttaacctggcggcagcgcaaaagatg

SEQ ID NO: 191222 - DNA, 103 bp, Artificial Sequence
  Synthetic Polynucleotide
taatacgactcactataggggctgccgggcagaacctgccacgatgtattaacagaggagaaatacaatgtggcaggttaacctggcggcagcgcaaaagatg

SEQ ID NO: 191223 - DNA, 103 bp, Artificial Sequence
  Synthetic Polynucleotide
taatacgactcactatagggtacagggcatgctgccgggcagaacctgccaacagaggagaggcaggatgtgcccggcaaacctggcggcagcgcaaaagatg

SEQ ID NO: 191224 - DNA, 103 bp, Artificial Sequence
  Synthetic Polynucleotide
taatacgactcactatagggctcccagatgtacagggcatgctgccgggcaacagaggagagcccggatgcatgccctgaacctggcggcagcgcaaaagatg

SEQ ID NO: 191225 - DNA, 103 bp, Artificial Sequence
  Synthetic Polynucleotide
taatacgactcactatagggcaatgctcttctcccagatgtacagggcataacagaggagaatgcccatgacatctgggaacctggcggcagcgcaaaagatg

SEQ ID NO: 191226 - DNA, 103 bp, Artificial Sequence
  Synthetic Polynucleotide
taatacgactcactatagggaccaggttgccaatgctcttctcccagatgaacagaggagacatctgatggaagagcataacctggcggcagcgcaaaagatg

SEQ ID NO: 191227 - DNA, 103 bp, Artificial Sequence
  Synthetic Polynucleotide
taatacgactcactataggggagaatcttcaccaggttgccaatgctcttaacagaggagaaagagcatgggcaacctgaacctggcggcagcgcaaaagatg

SEQ ID NO: 191228 - DNA, 103 bp, Artificial Sequence
  Synthetic Polynucleotide
taatacgactcactatagggtcgtcccatggagaatcttcaccaggttgcaacagaggagagcaaccatgtgaagattcaacctggcggcagcgcaaaagatg

SEQ ID NO: 191229 - DNA, 103 bp, Artificial Sequence
  Synthetic Polynucleotide
taatacgactcactatagggagttctcctctcgtcccatggagaatcttcaacagaggagagaagatatgccatgggacaacctggcggcagcgcaaaagatg

SEQ ID NO: 191230 - DNA, 103 bp, Artificial Sequence
  Synthetic Polynucleotide
taatacgactcactatagggatccaagaggagttctcctctcgtcccatgaacagaggagacatgggatgagaggagaaaacctggcggcagcgcaaaagatg

SEQ ID NO: 191231 - DNA, 103 bp, Artificial Sequence
  Synthetic Polynucleotide
taatacgactcactataggggccaagctacatccaagaggagttctcctcaacagaggagagaggagatgtcctcttggaacctggcggcagcgcaaaagatg

SEQ ID NO: 191232 - DNA, 103 bp, Artificial Sequence
  Synthetic Polynucleotide
taatacgactcactataggggtgccccacctgttaaaggtgcaagtcaaaaacagaggagatttgacatgcacctttaaaacctggcggcagcgcaaaagatg

SEQ ID NO: 191233 - DNA, 103 bp, Artificial Sequence
  Synthetic Polynucleotide
taatacgactcactatagggcgaacaggatgccaagctacatccaagaggaacagaggagacctcttatgtgtagcttgaacctggcggcagcgcaaaagatg

SEQ ID NO: 191234 - DNA, 103 bp, Artificial Sequence
  Synthetic Polynucleotide
taatacgactcactatagggtatgatgggtcgaacaggatgccaagctacaacagaggagagtagctatgcatcctgttaacctggcggcagcgcaaaagatg

SEQ ID NO: 191235 - DNA, 103 bp, Artificial Sequence
  Synthetic Polynucleotide
taatacgactcactatagggaaatggatgctatgatgggtcgaacaggataacagaggagaatcctgatggacccatcaaacctggcggcagcgcaaaagatg

SEQ ID NO: 191236 - DNA, 103 bp, Artificial Sequence
  Synthetic Polynucleotide
taatacgactcactatagggactccactggaaatggatgctatgatgggtaacagaggagaacccatatgagcatccataacctggcggcagcgcaaaagatg

SEQ ID NO: 191237 - DNA, 103 bp, Artificial Sequence
  Synthetic Polynucleotide
taatacgactcactataggggatagataccactccactggaaatggatgcaacagaggagagcatccatgtccagtggaaacctggcggcagcgcaaaagatg

SEQ ID NO: 191238 - DNA, 103 bp, Artificial Sequence
  Synthetic Polynucleotide
taatacgactcactatagggtctgtgcccagatagataccactccactggaacagaggagaccagtgatgtggtatctaaacctggcggcagcgcaaaagatg

SEQ ID NO: 191239 - DNA, 103 bp, Artificial Sequence
  Synthetic Polynucleotide
taatacgactcactatagggtctacttgattctgtgcccagatagataccaacagaggagaggtatcatgctgggcacaaacctggcggcagcgcaaaagatg

SEQ ID NO: 191240 - DNA, 103 bp, Artificial Sequence
  Synthetic Polynucleotide
taatacgactcactatagggactccagttttctacttgattctgtgcccaaacagaggagatgggcaatgaatcaagtaaacctggcggcagcgcaaaagatg

SEQ ID NO: 191241 - DNA, 103 bp, Artificial Sequence
  Synthetic Polynucleotide
taatacgactcactataggggtgcaaatgcactccagttttctacttgataacagaggagaatcaagatgaaaactggaaacctggcggcagcgcaaaagatg

SEQ ID NO: 191242 - DNA, 103 bp, Artificial Sequence
  Synthetic Polynucleotide
taatacgactcactatagggttgaagtctggtgcaaatgcactccagtttaacagaggagaaaactgatgtgcatttgcaacctggcggcagcgcaaaagatg

SEQ ID NO: 191243 - DNA, 103 bp, Artificial Sequence
  Synthetic Polynucleotide
taatacgactcactatagggcccctcagcgtggggcttgtcctcgaacataacagaggagaatgttcatggacaagcccaacctggcggcagcgcaaaagatg

SEQ ID NO: 191244 - DNA, 103 bp, Artificial Sequence
  Synthetic Polynucleotide
taatacgactcactataggggtccagggcttcggccgcgctcccctcgtcaacagaggagagacgagatgagcgcggccaacctggcggcagcgcaaaagatg

SEQ ID NO: 191245 - DNA, 103 bp, Artificial Sequence
  Synthetic Polynucleotide
taatacgactcactatagggggtgtcacgagtgaactttcgaggtgttccaacagaggagaggaacaatgcgaaagttcaacctggcggcagcgcaaaagatg

SEQ ID NO: 191246 - DNA, 103 bp, Artificial Sequence
  Synthetic Polynucleotide
taatacgactcactatagggtccctaatggggtgtcacgagtgaactttcaacagaggagagaaagtatgctcgtgacaaacctggcggcagcgcaaaagatg

SEQ ID NO: 191247 - DNA, 103 bp, Artificial Sequence
  Synthetic Polynucleotide
taatacgactcactataggggctgtcagtttccctaatggggtgtcacgaaacagaggagatcgtgaatgcccattaggaacctggcggcagcgcaaaagatg

SEQ ID NO: 191248 - DNA, 103 bp, Artificial Sequence
  Synthetic Polynucleotide
taatacgactcactatagggattagcctgtgctgtcagtttccctaatggaacagaggagaccattaatgaaactgacaaacctggcggcagcgcaaaagatg

SEQ ID NO: 191249 - DNA, 103 bp, Artificial Sequence
  Synthetic Polynucleotide
taatacgactcactatagggtatactccacattagcctgtgctgtcagttaacagaggagaaactgaatgcacaggctaaacctggcggcagcgcaaaagatg

SEQ ID NO: 191250 - DNA, 103 bp, Artificial Sequence
  Synthetic Polynucleotide
taatacgactcactatagggtgttgaaggttatactccacattagcctgtaacagaggagaacaggcatgtgtggagtaaacctggcggcagcgcaaaagatg

SEQ ID NO: 191251 - DNA, 103 bp, Artificial Sequence
  Synthetic Polynucleotide
taatacgactcactatagggttcaaagtgctgttgaaggttatactccacaacagaggagagtggagatgaaccttcaaaacctggcggcagcgcaaaagatg

SEQ ID NO: 191252 - DNA, 103 bp, Artificial Sequence
  Synthetic Polynucleotide
taatacgactcactatagggacctttttttttcaaagtgctgttgaaggtaacagaggagaaccttcatgagcactttgaacctggcggcagcgcaaaagatg

SEQ ID NO: 191253 - DNA, 103 bp, Artificial Sequence
  Synthetic Polynucleotide
taatacgactcactatagggggtgcaaatgacctttttttttcaaagtgcaacagaggagagcacttatgaaaaaaaagaacctggcggcagcgcaaaagatg

SEQ ID NO: 191254 - DNA, 103 bp, Artificial Sequence
  Synthetic Polynucleotide
taatacgactcactatagggtggggtagaaggtgcaaatgacctttttttaacagaggagaaaaaaaatgtcatttgcaaacctggcggcagcgcaaaagatg

SEQ ID NO: 191255 - DNA, 103 bp, Artificial Sequence
  Synthetic Polynucleotide
taatacgactcactatagggcagtaaagtcgtccagggcttcggccgcgcaacagaggagagcgcggatgaagccctggaacctggcggcagcgcaaaagatg

SEQ ID NO: 191256 - DNA, 103 bp, Artificial Sequence
  Synthetic Polynucleotide
taatacgactcactataggggtccggtcagtggggtagaaggtgcaaatgaacagaggagacatttgatgcttctacccaacctggcggcagcgcaaaagatg

SEQ ID NO: 191257 - DNA, 103 bp, Artificial Sequence
  Synthetic Polynucleotide
taatacgactcactatagggaaatatctccgtccggtcagtggggtagaaaacagaggagattctacatgactgaccggaacctggcggcagcgcaaaagatg

SEQ ID NO: 191258 - DNA, 103 bp, Artificial Sequence
  Synthetic Polynucleotide
taatacgactcactatagggtttttctcgtaaatatctccgtccggtcagaacagaggagactgaccatgcggagatataacctggcggcagcgcaaaagatg

SEQ ID NO: 191259 - DNA, 103 bp, Artificial Sequence
  Synthetic Polynucleotide
taatacgactcactatagggtgactgcttctttttctcgtaaatatctccaacagaggagaggagatatgtacgagaaaaacctggcggcagcgcaaaagatg

SEQ ID NO: 191260 - DNA, 103 bp, Artificial Sequence
  Synthetic Polynucleotide
taatacgactcactatagggacaggagtaatgactgcttctttttctcgtaacagaggagaacgagaatgagaagcagtaacctggcggcagcgcaaaagatg

SEQ ID NO: 191261 - DNA, 103 bp, Artificial Sequence
  Synthetic Polynucleotide
taatacgactcactatagggggctgatgcaacaggagtaatgactgcttcaacagaggagagaagcaatgattactcctaacctggcggcagcgcaaaagatg

SEQ ID NO: 191262 - DNA, 103 bp, Artificial Sequence
  Synthetic Polynucleotide
taatacgactcactatagggcactttgggtggctgatgcaacaggagtaaaacagaggagattactcatgttgcatcagaacctggcggcagcgcaaaagatg

SEQ ID NO: 191263 - DNA, 103 bp, Artificial Sequence
  Synthetic Polynucleotide
taatacgactcactatagggaaccggctcacactttgggtggctgatgcaaacagaggagatgcatcatgcacccaaagaacctggcggcagcgcaaaagatg

SEQ ID NO: 191264 - DNA, 103 bp, Artificial Sequence
  Synthetic Polynucleotide
taatacgactcactatagggaatactctgtaaccggctcacactttgggtaacagaggagaacccaaatggtgagccggaacctggcggcagcgcaaaagatg

SEQ ID NO: 191265 - DNA, 103 bp, Artificial Sequence
  Synthetic Polynucleotide
taatacgactcactataggggaccagccacaatactctgtaaccggctcaaacagaggagatgagccatgtacagagtaaacctggcggcagcgcaaaagatg

SEQ ID NO: 191266 - DNA, 103 bp, Artificial Sequence
  Synthetic Polynucleotide
taatacgactcactatagggcctcggatggcagtaaagtcgtccagggctaacagaggagaagccctatgcgactttacaacctggcggcagcgcaaaagatg

SEQ ID NO: 191267 - DNA, 103 bp, Artificial Sequence
  Synthetic Polynucleotide
taatacgactcactataggggcatttttcagaccagccacaatactctgtaacagaggagaacagagatgtgtggctggaacctggcggcagcgcaaaagatg

SEQ ID NO: 191268 - DNA, 103 bp, Artificial Sequence
  Synthetic Polynucleotide
taatacgactcactataggggtcacttggtgcatttttcagaccagccacaacagaggagagtggctatgctgaaaaataacctggcggcagcgcaaaagatg

SEQ ID NO: 191269 - DNA, 103 bp, Artificial Sequence
  Synthetic Polynucleotide
taatacgactcactatagggttataagttggtcacttggtgcatttttcaaacagaggagatgaaaaatgcaccaagtgaacctggcggcagcgcaaaagatg

SEQ ID NO: 191270 - DNA, 103 bp, Artificial Sequence
  Synthetic Polynucleotide
taatacgactcactatagggtcaaaaatatttataagttggtcacttggtaacagaggagaaccaagatgccaacttataacctggcggcagcgcaaaagatg

SEQ ID NO: 191271 - DNA, 103 bp, Artificial Sequence
  Synthetic Polynucleotide
taatacgactcactatagggcacacaagattcaaaaatatttataagttgaacagaggagacaacttatgaatatttttaacctggcggcagcgcaaaagatg

SEQ ID NO: 191272 - DNA, 103 bp, Artificial Sequence
  Synthetic Polynucleotide
taatacgactcactatagggcaggattacgcacacaagattcaaaaatataacagaggagaatatttatgaatcttgtgaacctggcggcagcgcaaaagatg

SEQ ID NO: 191273 - DNA, 103 bp, Artificial Sequence
  Synthetic Polynucleotide
taatacgactcactatagggatgttttccacaggattacgcacacaagataacagaggagaatcttgatggcgtaatccaacctggcggcagcgcaaaagatg

SEQ ID NO: 191274 - DNA, 103 bp, Artificial Sequence
  Synthetic Polynucleotide
taatacgactcactatagggtattttcataatgttttccacaggattacgaacagaggagacgtaatatggtggaaaacaacctggcggcagcgcaaaagatg

SEQ ID NO: 191275 - DNA, 103 bp, Artificial Sequence
  Synthetic Polynucleotide
taatacgactcactatagggttccttttagtattttcataatgttttccaaacagaggagatggaaaatgttatgaaaaaacctggcggcagcgcaaaagatg

SEQ ID NO: 191276 - DNA, 103 bp, Artificial Sequence
  Synthetic Polynucleotide
taatacgactcactataggggtctctcctattccttttagtattttcataaacagaggagatatgaaatgactaaaaggaacctggcggcagcgcaaaagatg

SEQ ID NO: 191277 - DNA, 103 bp, Artificial Sequence
  Synthetic Polynucleotide
taatacgactcactataggggctgtagttgcctcggatggcagtaaagtcaacagaggagagactttatggccatccgaaacctggcggcagcgcaaaagatg

SEQ ID NO: 191278 - DNA, 103 bp, Artificial Sequence
  Synthetic Polynucleotide
taatacgactcactatagggttgacagaaagtctctcctattccttttagaacagaggagactaaaaatgataggagagaacctggcggcagcgcaaaagatg

SEQ ID NO: 191279 - DNA, 103 bp, Artificial Sequence
  Synthetic Polynucleotide
taatacgactcactataggggagtatagtgttgacagaaagtctctcctaaacagaggagataggagatgctttctgtcaacctggcggcagcgcaaaagatg

SEQ ID NO: 191280 - DNA, 103 bp, Artificial Sequence
  Synthetic Polynucleotide
taatacgactcactatagggtctgttgattgagtatagtgttgacagaaaaacagaggagatttctgatgacactatacaacctggcggcagcgcaaaagatg

SEQ ID NO: 191281 - DNA, 103 bp, Artificial Sequence
  Synthetic Polynucleotide
taatacgactcactatagggtggctgttcatctgttgattgagtatagtgaacagaggagacactatatgcaatcaacaaacctggcggcagcgcaaaagatg

SEQ ID NO: 191282 - DNA, 103 bp, Artificial Sequence
  Synthetic Polynucleotide
taatacgactcactatagggtgtgagatcctggctgttcatctgttgattaacagaggagaaatcaaatgatgaacagcaacctggcggcagcgcaaaagatg

SEQ ID NO: 191283 - DNA, 103 bp, Artificial Sequence
  Synthetic Polynucleotide
taatacgactcactataggggcaaagtctatgtgagatcctggctgttcaaacagaggagatgaacaatgaggatctcaaacctggcggcagcgcaaaagatg

SEQ ID NO: 191284 - DNA, 103 bp, Artificial Sequence
  Synthetic Polynucleotide
taatacgactcactatagggtctgtttacagcaaagtctatgtgagatccaacagaggagaggatctatgatagactttaacctggcggcagcgcaaaagatg

SEQ ID NO: 191285 - DNA, 103 bp, Artificial Sequence
  Synthetic Polynucleotide
taatacgactcactatagggccagctttagtctgtttacagcaaagtctaaacagaggagatagactatgctgtaaacaaacctggcggcagcgcaaaagatg

SEQ ID NO: 191286 - DNA, 103 bp, Artificial Sequence
  Synthetic Polynucleotide
taatacgactcactatagggaaaatttctgccagctttagtctgtttacaaacagaggagatgtaaaatgactaaagctaacctggcggcagcgcaaaagatg

SEQ ID NO: 191287 - DNA, 103 bp, Artificial Sequence
  Synthetic Polynucleotide
taatacgactcactatagggtttataatacaaaatttctgccagctttagaacagaggagactaaagatggcagaaattaacctggcggcagcgcaaaagatg

SEQ ID NO: 191288 - DNA, 103 bp, Artificial Sequence
  Synthetic Polynucleotide
taatacgactcactatagggctccctctaggctgtagttgcctcggatggaacagaggagaccatccatggcaactacaaacctggcggcagcgcaaaagatg

SEQ ID NO: 191289 - DNA, 103 bp, Artificial Sequence
  Synthetic Polynucleotide
taatacgactcactatagggtctctagtattttataatacaaaatttctgaacagaggagacagaaaatgtgtattataaacctggcggcagcgcaaaagatg

SEQ ID NO: 191290 - DNA, 103 bp, Artificial Sequence
  Synthetic Polynucleotide
taatacgactcactatagggaccattacagtctctagtattttataatacaacagaggagagtattaatgaatactagaaacctggcggcagcgcaaaagatg

SEQ ID NO: 191291 - DNA, 103 bp, Artificial Sequence
  Synthetic Polynucleotide
taatacgactcactatagggtgtttcctgaaccattacagtctctagtataacagaggagaatactaatgactgtaatgaacctggcggcagcgcaaaagatg

SEQ ID NO: 191292 - DNA, 103 bp, Artificial Sequence
  Synthetic Polynucleotide
taatacgactcactataggggaagtcttcgtgtttcctgaaccattacagaacagaggagactgtaaatgttcaggaaaaacctggcggcagcgcaaaagatg

SEQ ID NO: 191293 - DNA, 103 bp, Artificial Sequence
  Synthetic Polynucleotide
taatacgactcactatagggtccattccatgaagtcttcgtgtttcctgaaacagaggagatcaggaatgacgaagactaacctggcggcagcgcaaaagatg

SEQ ID NO: 191294 - DNA, 103 bp, Artificial Sequence
  Synthetic Polynucleotide
taatacgactcactatagggaactgacatgtccattccatgaagtcttcgaacagaggagacgaagaatgcatggaatgaacctggcggcagcgcaaaagatg

SEQ ID NO: 191295 - DNA, 103 bp, Artificial Sequence
  Synthetic Polynucleotide
taatacgactcactataggggctctaaaagaactgacatgtccattccataacagaggagaatggaaatgacatgtcagaacctggcggcagcgcaaaagatg

SEQ ID NO: 191296 - DNA, 103 bp, Artificial Sequence
  Synthetic Polynucleotide
taatacgactcactatagggaatatatcttgctctaaaagaactgacatgaacagaggagacatgtcatgtcttttagaaacctggcggcagcgcaaaagatg

SEQ ID NO: 191297 - DNA, 103 bp, Artificial Sequence
  Synthetic Polynucleotide
taatacgactcactatagggggaacgatgaaatatatcttgctctaaaagaacagaggagacttttaatgcaagatataaacctggcggcagcgcaaaagatg

SEQ ID NO: 191298 - DNA, 103 bp, Artificial Sequence
  Synthetic Polynucleotide
taatacgactcactatagggaagccatcaaggaacgatgaaatatatcttaacagaggagaaagataatgttcatcgttaacctggcggcagcgcaaaagatg

SEQ ID NO: 191299 - DNA, 103 bp, Artificial Sequence
  Synthetic Polynucleotide
taatacgactcactatagggtgtgtaacttctccctctaggctgtagttgaacagaggagacaactaatgcctagagggaacctggcggcagcgcaaaagatg

SEQ ID NO: 191300 - DNA, 103 bp, Artificial Sequence
  Synthetic Polynucleotide
taatacgactcactatagggtccaaacaacaagccatcaaggaacgatgaaacagaggagatcatcgatgcttgatggcaacctggcggcagcgcaaaagatg

SEQ ID NO: 191301 - DNA, 103 bp, Artificial Sequence
  Synthetic Polynucleotide
taatacgactcactataggggagcacaatttccaaacaacaagccatcaaaacagaggagattgatgatgtgttgtttgaacctggcggcagcgcaaaagatg

SEQ ID NO: 191302 - DNA, 103 bp, Artificial Sequence
  Synthetic Polynucleotide
taatacgactcactatagggtataggcaaagagcacaatttccaaacaacaacagaggagagttgttatgaaattgtgcaacctggcggcagcgcaaaagatg

SEQ ID NO: 191303 - DNA, 103 bp, Artificial Sequence
  Synthetic Polynucleotide
taatacgactcactatagggcgaggtgagctataggcaaagagcacaattaacagaggagaaattgtatgctttgcctaaacctggcggcagcgcaaaagatg

SEQ ID NO: 191304 - DNA, 103 bp, Artificial Sequence
  Synthetic Polynucleotide
taatacgactcactatagggaggaaaagtacgaggtgagctataggcaaaaacagaggagatttgccatgagctcacctaacctggcggcagcgcaaaagatg

SEQ ID NO: 191305 - DNA, 103 bp, Artificial Sequence
  Synthetic Polynucleotide
taatacgactcactatagggcaataatccaaggaaaagtacgaggtgagcaacagaggagagctcacatggtacttttcaacctggcggcagcgcaaaagatg

SEQ ID NO: 191306 - DNA, 103 bp, Artificial Sequence
  Synthetic Polynucleotide
taatacgactcactatagggttgagaacttcaataatccaaggaaaagtaaacagaggagatactttatgttggattataacctggcggcagcgcaaaagatg

SEQ ID NO: 191307 - DNA, 103 bp, Artificial Sequence
  Synthetic Polynucleotide
taatacgactcactatagggtggttgcaagttgagaacttcaataatccaaacagaggagatggattatggaagttctcaacctggcggcagcgcaaaagatg

SEQ ID NO: 191308 - DNA, 103 bp, Artificial Sequence
  Synthetic Polynucleotide
taatacgactcactatagggaaaagtaaaatggttgcaagttgagaacttaacagaggagaaagttcatgacttgcaacaacctggcggcagcgcaaaagatg

SEQ ID NO: 191309 - DNA, 103 bp, Artificial Sequence
  Synthetic Polynucleotide
taatacgactcactatagggataaccttataaaagtaaaatggttgcaagaacagaggagacttgcaatgattttacttaacctggcggcagcgcaaaagatg

SEQ ID NO: 191310 - DNA, 103 bp, Artificial Sequence
  Synthetic Polynucleotide
taatacgactcactatagggtgccaaccagtgtgtaacttctccctctagaacagaggagactagagatggaagttacaaacctggcggcagcgcaaaagatg

SEQ ID NO: 191311 - DNA, 103 bp, Artificial Sequence
  Synthetic Polynucleotide
taatacgactcactatagggcaccacctcaataaccttataaaagtaaaaaacagaggagattttacatgtataaggttaacctggcggcagcgcaaaagatg

SEQ ID NO: 191312 - DNA, 103 bp, Artificial Sequence
  Synthetic Polynucleotide
taatacgactcactatagggctgagcggatcaccacctcaataaccttataacagaggagaataaggatgttgaggtggaacctggcggcagcgcaaaagatg

SEQ ID NO: 191313 - DNA, 103 bp, Artificial Sequence
  Synthetic Polynucleotide
taatacgactcactatagggagcccctcttctgagcggatcaccacctcaaacagaggagatgaggtatggatccgctcaacctggcggcagcgcaaaagatg

SEQ ID NO: 191314 - DNA, 103 bp, Artificial Sequence
  Synthetic Polynucleotide
taatacgactcactataggggtcccttgagagcccctcttctgagcggataacagaggagaatccgcatggaagaggggaacctggcggcagcgcaaaagatg

SEQ ID NO: 191315 - DNA, 103 bp, Artificial Sequence
  Synthetic Polynucleotide
taatacgactcactataggggtttcaccatgtcccttgagagcccctcttaacagaggagaaagaggatgtctcaagggaacctggcggcagcgcaaaagatg

SEQ ID NO: 191316 - DNA, 103 bp, Artificial Sequence
  Synthetic Polynucleotide
taatacgactcactatagggctgtttaggtgtttcaccatgtcccttgagaacagaggagactcaagatgcatggtgaaaacctggcggcagcgcaaaagatg

SEQ ID NO: 191317 - DNA, 103 bp, Artificial Sequence
  Synthetic Polynucleotide
taatacgactcactatagggttcttcaatgctgtttaggtgtttcaccataacagaggagaatggtgatgcacctaaacaacctggcggcagcgcaaaagatg

SEQ ID NO: 191318 - DNA, 103 bp, Artificial Sequence
  Synthetic Polynucleotide
taatacgactcactatagggccaaaatctgttcttcaatgctgtttaggtaacagaggagaacctaaatggcattgaagaacctggcggcagcgcaaaagatg

SEQ ID NO: 191319 - DNA, 103 bp, Artificial Sequence
  Synthetic Polynucleotide
taatacgactcactataggggctaaactctccaaaatctgttcttcaatgaacagaggagacattgaatgacagattttaacctggcggcagcgcaaaagatg

SEQ ID NO: 191320 - DNA, 103 bp, Artificial Sequence
  Synthetic Polynucleotide
taatacgactcactataggggtgactccatgctaaactctccaaaatctgaacagaggagacagattatggagagtttaaacctggcggcagcgcaaaagatg

SEQ ID NO: 191321 - DNA, 103 bp, Artificial Sequence
  Synthetic Polynucleotide
taatacgactcactatagggataatgaacatgccaaccagtgtgtaacttaacagaggagaaagttaatgactggttggaacctggcggcagcgcaaaagatg

SEQ ID NO: 191322 - DNA, 103 bp, Artificial Sequence
  Synthetic Polynucleotide
taatacgactcactataggggtgcagaatcgtgactccatgctaaactctaacagaggagaagagttatgcatggagtcaacctggcggcagcgcaaaagatg

SEQ ID NO: 191323 - DNA, 103 bp, Artificial Sequence
  Synthetic Polynucleotide
taatacgactcactataggggcctcccacagtgcagaatcgtgactccataacagaggagaatggagatgcgattctgcaacctggcggcagcgcaaaagatg

SEQ ID NO: 191324 - DNA, 103 bp, Artificial Sequence
  Synthetic Polynucleotide
taatacgactcactatagggaacctggagagcctcccacagtgcagaatcaacagaggagagattctatgctgtgggagaacctggcggcagcgcaaaagatg

SEQ ID NO: 191325 - DNA, 103 bp, Artificial Sequence
  Synthetic Polynucleotide
taatacgactcactatagggtgtttgcagaaacctggagagcctcccacaaacagaggagatgtgggatgctctccaggaacctggcggcagcgcaaaagatg

SEQ ID NO: 191326 - DNA, 103 bp, Artificial Sequence
  Synthetic Polynucleotide
taatacgactcactataggggtaggaactttgtttgcagaaacctggagaaacagaggagatctccaatgttctgcaaaaacctggcggcagcgcaaaagatg

SEQ ID NO: 191327 - DNA, 103 bp, Artificial Sequence
  Synthetic Polynucleotide
taatacgactcactatagggttcttcacaggtaggaactttgtttgcagaaacagaggagatctgcaatgaaagttcctaacctggcggcagcgcaaaagatg

SEQ ID NO: 191328 - DNA, 103 bp, Artificial Sequence
  Synthetic Polynucleotide
taatacgactcactatagggggaatataacttcttcacaggtaggaacttaacagaggagaaagttcatgcctgtgaagaacctggcggcagcgcaaaagatg

SEQ ID NO: 191329 - DNA, 103 bp, Artificial Sequence
  Synthetic Polynucleotide
taatacgactcactatagggaagttatttgggaatataacttcttcacagaacagaggagactgtgaatgagttatattaacctggcggcagcgcaaaagatg

SEQ ID NO: 191330 - DNA, 103 bp, Artificial Sequence
  Synthetic Polynucleotide
taatacgactcactatagggtcctgtttcaaagttatttgggaatataacaacagaggagagttataatgccaaataacaacctggcggcagcgcaaaagatg

SEQ ID NO: 191331 - DNA, 103 bp, Artificial Sequence
  Synthetic Polynucleotide
taatacgactcactatagggttcctccatttcctgtttcaaagttatttgaacagaggagacaaataatgttgaaacagaacctggcggcagcgcaaaagatg

SEQ ID NO: 191332 - DNA, 103 bp, Artificial Sequence
  Synthetic Polynucleotide
taatacgactcactatagggcatgcaacatataatgaacatgccaaccagaacagaggagactggttatgatgttcattaacctggcggcagcgcaaaagatg

SEQ ID NO: 191333 - DNA, 103 bp, Artificial Sequence
  Synthetic Polynucleotide
taatacgactcactatagggccctgcacatttcctccatttcctgtttcaaacagaggagatgaaacatgaaatggaggaacctggcggcagcgcaaaagatg

SEQ ID NO: 191334 - DNA, 103 bp, Artificial Sequence
  Synthetic Polynucleotide
taatacgactcactataggggggaagatgtccctgcacatttcctccattaacagaggagaaatggaatgaatgtgcagaacctggcggcagcgcaaaagatg

SEQ ID NO: 191335 - DNA, 103 bp, Artificial Sequence
  Synthetic Polynucleotide
taatacgactcactatagggttggcatcaggggaagatgtccctgcacataacagaggagaatgtgcatggacatcttcaacctggcggcagcgcaaaagatg

SEQ ID NO: 191336 - DNA, 103 bp, Artificial Sequence
  Synthetic Polynucleotide
taatacgactcactatagggagaggagacattggcatcaggggaagatgtaacagaggagaacatctatgcctgatgccaacctggcggcagcgcaaaagatg

SEQ ID NO: 191337 - DNA, 103 bp, Artificial Sequence
  Synthetic Polynucleotide
taatacgactcactatagggtgggtgcattagaggagacattggcatcagaacagaggagactgatgatgatgtctcctaacctggcggcagcgcaaaagatg

SEQ ID NO: 191338 - DNA, 103 bp, Artificial Sequence
  Synthetic Polynucleotide
taatacgactcactatagggccttgactcttgggtgcattagaggagacaaacagaggagatgtctcatgtaatgcaccaacctggcggcagcgcaaaagatg

SEQ ID NO: 191339 - DNA, 103 bp, Artificial Sequence
  Synthetic Polynucleotide
taatacgactcactataggggttcgaacttccttgactcttgggtgcattaacagaggagaaatgcaatgaagagtcaaaacctggcggcagcgcaaaagatg

SEQ ID NO: 191340 - DNA, 103 bp, Artificial Sequence
  Synthetic Polynucleotide
taatacgactcactatagggcccactgtcagttcgaacttccttgactctaacagaggagaagagtcatggaagttcgaaacctggcggcagcgcaaaagatg

SEQ ID NO: 191341 - DNA, 103 bp, Artificial Sequence
  Synthetic Polynucleotide
taatacgactcactatagggttcgaagactcccactgtcagttcgaacttaacagaggagaaagttcatgctgacagtgaacctggcggcagcgcaaaagatg

SEQ ID NO: 191342 - DNA, 103 bp, Artificial Sequence
  Synthetic Polynucleotide
taatacgactcactatagggtgcatatctcttcgaagactcccactgtcaaacagaggagatgacagatggagtcttcgaacctggcggcagcgcaaaagatg

SEQ ID NO: 191343 - DNA, 103 bp, Artificial Sequence
  Synthetic Polynucleotide
taatacgactcactataggggcttttgcggcatgcaacatataatgaacaaacagaggagatgttcaatgtatgttgcaaacctggcggcagcgcaaaagatg

SEQ ID NO: 191344 - DNA, 103 bp, Artificial Sequence
  Synthetic Polynucleotide
taatacgactcactatagggagacaatggttgcatatctcttcgaagactaacagaggagaagtcttatgagagatatgaacctggcggcagcgcaaaagatg

SEQ ID NO: 191345 - DNA, 103 bp, Artificial Sequence
  Synthetic Polynucleotide
taatacgactcactatagggcagaaattggagacaatggttgcatatctcaacagaggagagagataatgaaccattgtaacctggcggcagcgcaaaagatg

SEQ ID NO: 191346 - DNA, 103 bp, Artificial Sequence
  Synthetic Polynucleotide
taatacgactcactatagggcgttcatggacagaaattggagacaatggtaacagaggagaaccattatgtccaatttcaacctggcggcagcgcaaaagatg

SEQ ID NO: 191347 - DNA, 103 bp, Artificial Sequence
  Synthetic Polynucleotide
taatacgactcactatagggagaactgtagcgttcatggacagaaattggaacagaggagaccaattatggtccatgaaaacctggcggcagcgcaaaagatg

SEQ ID NO: 191348 - DNA, 103 bp, Artificial Sequence
  Synthetic Polynucleotide
taatacgactcactatagggctgcggtaggagaactgtagcgttcatggaaacagaggagatccatgatggctacagttaacctggcggcagcgcaaaagatg

SEQ ID NO: 191349 - DNA, 103 bp, Artificial Sequence
  Synthetic Polynucleotide
taatacgactcactatagggttagcactccctgcggtaggagaactgtagaacagaggagactacagatgtcctaccgcaacctggcggcagcgcaaaagatg

SEQ ID NO: 191350 - DNA, 103 bp, Artificial Sequence
  Synthetic Polynucleotide
taatacgactcactataggggagtcttctcttagcactccctgcggtaggaacagaggagacctaccatggggagtgctaacctggcggcagcgcaaaagatg

SEQ ID NO: 191351 - DNA, 103 bp, Artificial Sequence
  Synthetic Polynucleotide
taatacgactcactatagggcctctccaaagagtcttctcttagcactccaacagaggagaggagtgatgagagaagacaacctggcggcagcgcaaaagatg

SEQ ID NO: 191352 - DNA, 103 bp, Artificial Sequence
  Synthetic Polynucleotide
taatacgactcactatagggtttggggggtcctctccaaagagtcttctcaacagaggagagagaagatgctttggagaaacctggcggcagcgcaaaagatg

SEQ ID NO: 191353 - DNA, 103 bp, Artificial Sequence
  Synthetic Polynucleotide
taatacgactcactatagggaagcatttcctttggggggtcctctccaaaaacagaggagatttggaatggaccccccaaacctggcggcagcgcaaaagatg

SEQ ID NO: 191354 - DNA, 103 bp, Artificial Sequence
  Synthetic Polynucleotide
taatacgactcactatagggccaccgccgccccctcagcgtggggcttgtaacagaggagaacaagcatgacgctgaggaacctggcggcagcgcaaaagatg

SEQ ID NO: 191355 - DNA, 103 bp, Artificial Sequence
  Synthetic Polynucleotide
taatacgactcactatagggtgggaataatgcttttgcggcatgcaacataacagaggagaatgttgatggccgcaaaaaacctggcggcagcgcaaaagatg

SEQ ID NO: 191356 - DNA, 103 bp, Artificial Sequence
  Synthetic Polynucleotide
taatacgactcactatagggtcttgtccataagcatttcctttggggggtaacagaggagaacccccatgaggaaatgcaacctggcggcagcgcaaaagatg

SEQ ID NO: 191357 - DNA, 103 bp, Artificial Sequence
  Synthetic Polynucleotide
taatacgactcactatagggtctgttatgatcttgtccataagcatttccaacagaggagaggaaatatgtatggacaaaacctggcggcagcgcaaaagatg

SEQ ID NO: 191358 - DNA, 103 bp, Artificial Sequence
  Synthetic Polynucleotide
taatacgactcactatagggttttgttccttctgttatgatcttgtccataacagaggagaatggacatgatcataacaaacctggcggcagcgcaaaagatg

SEQ ID NO: 191359 - DNA, 103 bp, Artificial Sequence
  Synthetic Polynucleotide
taatacgactcactatagggcgattttcaattttgttccttctgttatgaaacagaggagatcataaatgaaggaacaaaacctggcggcagcgcaaaagatg

SEQ ID NO: 191360 - DNA, 103 bp, Artificial Sequence
  Synthetic Polynucleotide
taatacgactcactataggggaagaaggagcgattttcaattttgttcctaacagaggagaaggaacatgattgaaaataacctggcggcagcgcaaaagatg

SEQ ID NO: 191361 - DNA, 103 bp, Artificial Sequence
  Synthetic Polynucleotide
taatacgactcactatagggagtaatgcttgaagaaggagcgattttcaaaacagaggagattgaaaatggctccttctaacctggcggcagcgcaaaagatg

SEQ ID NO: 191362 - DNA, 103 bp, Artificial Sequence
  Synthetic Polynucleotide
taatacgactcactatagggcattttcagcagtaatgcttgaagaaggagaacagaggagactccttatgcaagcattaaacctggcggcagcgcaaaagatg

SEQ ID NO: 191363 - DNA, 103 bp, Artificial Sequence
  Synthetic Polynucleotide
taatacgactcactatagggaaaattgatacattttcagcagtaatgcttaacagaggagaaagcatatgtgctgaaaaaacctggcggcagcgcaaaagatg

SEQ ID NO: 191364 - DNA, 103 bp, Artificial Sequence
  Synthetic Polynucleotide
taatacgactcactatagggttgaccaggtaaaattgatacattttcagcaacagaggagagctgaaatggtatcaattaacctggcggcagcgcaaaagatg

SEQ ID NO: 191365 - DNA, 103 bp, Artificial Sequence
  Synthetic Polynucleotide
taatacgactcactatagggttagaagagtttgaccaggtaaaattgataaacagaggagatatcaaatgtacctggtcaacctggcggcagcgcaaaagatg

SEQ ID NO: 191366 - DNA, 103 bp, Artificial Sequence
  Synthetic Polynucleotide
taatacgactcactatagggtttccaaccgtgggaataatgcttttgcggaacagaggagaccgcaaatgcattattccaacctggcggcagcgcaaaagatg

SEQ ID NO: 191367 - DNA, 103 bp, Artificial Sequence
  Synthetic Polynucleotide
taatacgactcactataggggtggccattgttagaagagtttgaccaggtaacagaggagaacctggatgaactcttctaacctggcggcagcgcaaaagatg

SEQ ID NO: 191368 - DNA, 103 bp, Artificial Sequence
  Synthetic Polynucleotide
taatacgactcactatagggtactggggctgtggccattgttagaagagtaacagaggagaactcttatgacaatggccaacctggcggcagcgcaaaagatg

SEQ ID NO: 191369 - DNA, 103 bp, Artificial Sequence
  Synthetic Polynucleotide
taatacgactcactatagggttgttcctgttactggggctgtggccattgaacagaggagacaatggatgcagccccagaacctggcggcagcgcaaaagatg

SEQ ID NO: 191370 - DNA, 103 bp, Artificial Sequence
  Synthetic Polynucleotide
taatacgactcactatagggttatgtcctgttgttcctgttactggggctaacagaggagaagccccatgaacaggaacaacctggcggcagcgcaaaagatg

SEQ ID NO: 191371 - DNA, 103 bp, Artificial Sequence
  Synthetic Polynucleotide
taatacgactcactatagggaattgtaactttatgtcctgttgttcctgtaacagaggagaacaggaatgacaggacataacctggcggcagcgcaaaagatg

SEQ ID NO: 191372 - DNA, 103 bp, Artificial Sequence
  Synthetic Polynucleotide
taatacgactcactatagggcatgtaatggaattgtaactttatgtcctgaacagaggagacaggacatgaagttacaaaacctggcggcagcgcaaaagatg

SEQ ID NO: 191373 - DNA, 103 bp, Artificial Sequence
  Synthetic Polynucleotide
taatacgactcactatagggtttgcgacaccatgtaatggaattgtaactaacagaggagaagttacatgtccattacaaacctggcggcagcgcaaaagatg

SEQ ID NO: 191374 - DNA, 103 bp, Artificial Sequence
  Synthetic Polynucleotide
taatacgactcactatagggtccagcatcatttgcgacaccatgtaatggaacagaggagaccattaatgggtgtcgcaaacctggcggcagcgcaaaagatg

SEQ ID NO: 191375 - DNA, 103 bp, Artificial Sequence
  Synthetic Polynucleotide
taatacgactcactataggggtgtgatctctccagcatcatttgcgacacaacagaggagagtgtcgatgatgatgctgaacctggcggcagcgcaaaagatg

SEQ ID NO: 191376 - DNA, 103 bp, Artificial Sequence
  Synthetic Polynucleotide
taatacgactcactatagggagaggtatcagtgtgatctctccagcatcaaacagaggagatgatgcatgagagatcacaacctggcggcagcgcaaaagatg

SEQ ID NO: 191377 - DNA, 103 bp, Artificial Sequence
  Synthetic Polynucleotide
taatacgactcactatagggcatgataccctttccaaccgtgggaataataacagaggagaattattatgacggttggaaacctggcggcagcgcaaaagatg

SEQ ID NO: 191378 - DNA, 103 bp, Artificial Sequence
  Synthetic Polynucleotide
taatacgactcactatagggattcatggaaagaggtatcagtgtgatctcaacagaggagagagatcatgctgatacctaacctggcggcagcgcaaaagatg

SEQ ID NO: 191379 - DNA, 103 bp, Artificial Sequence
  Synthetic Polynucleotide
taatacgactcactatagggcctgatttgtattcatggaaagaggtatcaaacagaggagatgatacatgtttccatgaaacctggcggcagcgcaaaagatg

SEQ ID NO: 191380 - DNA, 103 bp, Artificial Sequence
  Synthetic Polynucleotide
taatacgactcactatagggactttggactcctgatttgtattcatggaaaacagaggagattccatatgtacaaatcaaacctggcggcagcgcaaaagatg

SEQ ID NO: 191381 - DNA, 103 bp, Artificial Sequence
  Synthetic Polynucleotide
taatacgactcactatagggaggactcttgactttggactcctgatttgtaacagaggagaacaaatatggagtccaaaaacctggcggcagcgcaaaagatg

SEQ ID NO: 191382 - DNA, 103 bp, Artificial Sequence
  Synthetic Polynucleotide
taatacgactcactatagggtaagtgatacaggactcttgactttggactaacagaggagaagtccaatgtcaagagtcaacctggcggcagcgcaaaagatg

SEQ ID NO: 191383 - DNA, 103 bp, Artificial Sequence
  Synthetic Polynucleotide
taatacgactcactataggggaatgagcagtaagtgatacaggactcttgaacagaggagacaagagatgtgtatcactaacctggcggcagcgcaaaagatg

SEQ ID NO: 191384 - DNA, 103 bp, Artificial Sequence
  Synthetic Polynucleotide
taatacgactcactatagggaccaattaatgaatgagcagtaagtgatacaacagaggagagtatcaatgactgctcataacctggcggcagcgcaaaagatg

SEQ ID NO: 191385 - DNA, 103 bp, Artificial Sequence
  Synthetic Polynucleotide
taatacgactcactatagggttggagaagcaccaattaatgaatgagcagaacagaggagactgctcatgcattaattgaacctggcggcagcgcaaaagatg

SEQ ID NO: 191386 - DNA, 103 bp, Artificial Sequence
  Synthetic Polynucleotide
taatacgactcactatagggttggtctgttttggagaagcaccaattaataacagaggagaattaatatgtgcttctccaacctggcggcagcgcaaaagatg

SEQ ID NO: 191387 - DNA, 103 bp, Artificial Sequence
  Synthetic Polynucleotide
taatacgactcactatagggtttagtcagattggtctgttttggagaagcaacagaggagagcttctatgaaacagaccaacctggcggcagcgcaaaagatg

SEQ ID NO: 191388 - DNA, 103 bp, Artificial Sequence
  Synthetic Polynucleotide
taatacgactcactatagggagttgccttccatgataccctttccaaccgaacagaggagacggttgatgagggtatcaaacctggcggcagcgcaaaagatg

SEQ ID NO: 191389 - DNA, 103 bp, Artificial Sequence
  Synthetic Polynucleotide
taatacgactcactatagggcctcttgtgctttagtcagattggtctgttaacagaggagaaacagaatgatctgactaaacctggcggcagcgcaaaagatg

SEQ ID NO: 191390 - DNA, 103 bp, Artificial Sequence
  Synthetic Polynucleotide
taatacgactcactataggggttgaatgtacctcttgtgctttagtcagaaacagaggagatctgacatgagcacaagaaacctggcggcagcgcaaaagatg

SEQ ID NO: 191391 - DNA, 103 bp, Artificial Sequence
  Synthetic Polynucleotide
taatacgactcactataggggtttattccagttgaatgtacctcttgtgcaacagaggagagcacaaatggtacattcaaacctggcggcagcgcaaaagatg

SEQ ID NO: 191392 - DNA, 103 bp, Artificial Sequence
  Synthetic Polynucleotide
taatacgactcactatagggtctttggcctgtttattccagttgaatgtaaacagaggagatacattatgctggaataaaacctggcggcagcgcaaaagatg

SEQ ID NO: 191393 - DNA, 103 bp, Artificial Sequence
  Synthetic Polynucleotide
taatacgactcactataggggacccagttctctttggcctgtttattccaaacagaggagatggaatatgcaggccaaaaacctggcggcagcgcaaaagatg

SEQ ID NO: 191394 - DNA, 103 bp, Artificial Sequence
  Synthetic Polynucleotide
taatacgactcactatagggtagtgctaaggacccagttctctttggcctaacagaggagaaggccaatgagaactgggaacctggcggcagcgcaaaagatg

SEQ ID NO: 191395 - DNA, 103 bp, Artificial Sequence
  Synthetic Polynucleotide
taatacgactcactatagggttctgtaaaatagtgctaaggacccagttcaacagaggagagaactgatgccttagcacaacctggcggcagcgcaaaagatg

SEQ ID NO: 191396 - DNA, 103 bp, Artificial Sequence
  Synthetic Polynucleotide
taatacgactcactatagggtgatagacctttctgtaaaatagtgctaagaacagaggagacttagcatgattttacagaacctggcggcagcgcaaaagatg

SEQ ID NO: 191397 - DNA, 103 bp, Artificial Sequence
  Synthetic Polynucleotide
taatacgactcactatagggacttgccaaatgatagacctttctgtaaaaaacagaggagattttacatgaaggtctataacctggcggcagcgcaaaagatg

SEQ ID NO: 191398 - DNA, 103 bp, Artificial Sequence
  Synthetic Polynucleotide
taatacgactcactataggggtaagcgtacacttgccaaatgatagacctaacagaggagaaggtctatgatttggcaaaacctggcggcagcgcaaaagatg

SEQ ID NO: 191399 - DNA, 103 bp, Artificial Sequence
  Synthetic Polynucleotide
taatacgactcactatagggagtgaaacacagttgccttccatgatacccaacagaggagagggtatatgggaaggcaaaacctggcggcagcgcaaaagatg

SEQ ID NO: 191400 - DNA, 103 bp, Artificial Sequence
  Synthetic Polynucleotide
taatacgactcactatagggcatagatcacgtaagcgtacacttgccaaaaacagaggagatttggcatgtgtacgcttaacctggcggcagcgcaaaagatg

SEQ ID NO: 191401 - DNA, 103 bp, Artificial Sequence
  Synthetic Polynucleotide
taatacgactcactatagggcagttttagacatagatcacgtaagcgtacaacagaggagagtacgcatgcgtgatctaaacctggcggcagcgcaaaagatg

SEQ ID NO: 191402 - DNA, 103 bp, Artificial Sequence
  Synthetic Polynucleotide
taatacgactcactatagggttgaaacatccagttttagacatagatcacaacagaggagagtgatcatggtctaaaacaacctggcggcagcgcaaaagatg

SEQ ID NO: 191403 - DNA, 103 bp, Artificial Sequence
  Synthetic Polynucleotide
taatacgactcactatagggcgtaactcatttgaaacatccagttttagaaacagaggagatctaaaatgggatgtttcaacctggcggcagcgcaaaagatg

SEQ ID NO: 191404 - DNA, 103 bp, Artificial Sequence
  Synthetic Polynucleotide
taatacgactcactatagggtatcttccttcgtaactcatttgaaacatcaacagaggagagatgttatgaatgagttaaacctggcggcagcgcaaaagatg

SEQ ID NO: 191405 - DNA, 103 bp, Artificial Sequence
  Synthetic Polynucleotide
taatacgactcactatagggaacacgtccatatcttccttcgtaactcataacagaggagaatgagtatggaaggaagaaacctggcggcagcgcaaaagatg

SEQ ID NO: 191406 - DNA, 103 bp, Artificial Sequence
  Synthetic Polynucleotide
taatacgactcactataggggtgaattcaaaacacgtccatatcttccttaacagaggagaaaggaaatgatggacgtgaacctggcggcagcgcaaaagatg

SEQ ID NO: 191407 - DNA, 103 bp, Artificial Sequence
  Synthetic Polynucleotide
taatacgactcactataggggtgaactaaagtgaattcaaaacacgtccaaacagaggagatggacgatgtttgaattcaacctggcggcagcgcaaaagatg

SEQ ID NO: 191408 - DNA, 103 bp, Artificial Sequence
  Synthetic Polynucleotide
taatacgactcactataggggatcaggacagtgaactaaagtgaattcaaaacagaggagattgaatatgctttagttcaacctggcggcagcgcaaaagatg

SEQ ID NO: 191409 - DNA, 103 bp, Artificial Sequence
  Synthetic Polynucleotide
taatacgactcactatagggtctttcattagatcaggacagtgaactaaaaacagaggagatttagtatgctgtcctgaaacctggcggcagcgcaaaagatg

SEQ ID NO: 191410 - DNA, 103 bp, Artificial Sequence
  Synthetic Polynucleotide
taatacgactcactatagggtattctggtaagtgaaacacagttgccttcaacagaggagagaaggcatgtgtgtttcaaacctggcggcagcgcaaaagatg

SEQ ID NO: 191411 - DNA, 103 bp, Artificial Sequence
  Synthetic Polynucleotide
taatacgactcactatagggcaaatgcctgtctttcattagatcaggacaaacagaggagatgtcctatgctaatgaaaaacctggcggcagcgcaaaagatg

SEQ ID NO: 191412 - DNA, 103 bp, Artificial Sequence
  Synthetic Polynucleotide
taatacgactcactatagggggagctgatccaaatgcctgtctttcattaaacagaggagataatgaatgacaggcattaacctggcggcagcgcaaaagatg

SEQ ID NO: 191413 - DNA, 103 bp, Artificial Sequence
  Synthetic Polynucleotide
taatacgactcactataggggcacaaaggaggagctgatccaaatgcctgaacagaggagacaggcaatgggatcagctaacctggcggcagcgcaaaagatg

SEQ ID NO: 191414 - DNA, 103 bp, Artificial Sequence
  Synthetic Polynucleotide
taatacgactcactataggggatataaaaggcacaaaggaggagctgatcaacagaggagagatcagatgctcctttgtaacctggcggcagcgcaaaagatg

SEQ ID NO: 191415 - DNA, 103 bp, Artificial Sequence
  Synthetic Polynucleotide
taatacgactcactatagggcctttgccatgatataaaaggcacaaaggaaacagaggagatcctttatgccttttataaacctggcggcagcgcaaaagatg

SEQ ID NO: 191416 - DNA, 103 bp, Artificial Sequence
  Synthetic Polynucleotide
taatacgactcactatagggtcttttgttacctttgccatgatataaaagaacagaggagacttttaatgcatggcaaaaacctggcggcagcgcaaaagatg

SEQ ID NO: 191417 - DNA, 103 bp, Artificial Sequence
  Synthetic Polynucleotide
taatacgactcactatagggagttctttcttcttttgttacctttgccataacagaggagaatggcaatggtaacaaaaaacctggcggcagcgcaaaagatg

SEQ ID NO: 191418 - DNA, 103 bp, Artificial Sequence
  Synthetic Polynucleotide
taatacgactcactatagggtttcttgaaaagttctttcttcttttgttaaacagaggagataacaaatgaagaaagaaaacctggcggcagcgcaaaagatg

SEQ ID NO: 191419 - DNA, 103 bp, Artificial Sequence
  Synthetic Polynucleotide
taatacgactcactatagggcttttcataatttcttgaaaagttctttctaacagaggagaagaaagatgttttcaagaaacctggcggcagcgcaaaagatg

SEQ ID NO: 191420 - DNA, 103 bp, Artificial Sequence
  Synthetic Polynucleotide
taatacgactcactatagggattcctataacttttcataatttcttgaaaaacagaggagatttcaaatgattatgaaaaacctggcggcagcgcaaaagatg

SEQ ID NO: 191421 - DNA, 103 bp, Artificial Sequence
  Synthetic Polynucleotide
taatacgactcactatagggctgaacgtagtattctggtaagtgaaacacaacagaggagagtgtttatgttaccagaaaacctggcggcagcgcaaaagatg

SEQ ID NO: 191422 - DNA, 103 bp, Artificial Sequence
  Synthetic Polynucleotide
taatacgactcactatagggcttggggctgattcctataacttttcataaaacagaggagattatgaatggttataggaaacctggcggcagcgcaaaagatg

SEQ ID NO: 191423 - DNA, 103 bp, Artificial Sequence
  Synthetic Polynucleotide
taatacgactcactatagggtgactattagcttggggctgattcctataaaacagaggagattatagatgtcagccccaaacctggcggcagcgcaaaagatg

SEQ ID NO: 191424 - DNA, 103 bp, Artificial Sequence
  Synthetic Polynucleotide
taatacgactcactatagggtctatatacgtgactattagcttggggctgaacagaggagacagcccatggctaatagtaacctggcggcagcgcaaaagatg

SEQ ID NO: 191425 - DNA, 103 bp, Artificial Sequence
  Synthetic Polynucleotide
taatacgactcactataggggcagaacacttctatatacgtgactattagaacagaggagactaataatgacgtatataaacctggcggcagcgcaaaagatg

SEQ ID NO: 191426 - DNA, 103 bp, Artificial Sequence
  Synthetic Polynucleotide
taatacgactcactatagggatacttttcagcagaacacttctatatacgaacagaggagacgtataatgaagtgttctaacctggcggcagcgcaaaagatg

SEQ ID NO: 191427 - DNA, 103 bp, Artificial Sequence
  Synthetic Polynucleotide
taatacgactcactatagggttctcttggaatacttttcagcagaacactaacagaggagaagtgttatgctgaaaagtaacctggcggcagcgcaaaagatg

SEQ ID NO: 191428 - DNA, 103 bp, Artificial Sequence
  Synthetic Polynucleotide
taatacgactcactatagggatgccacaacttctcttggaatacttttcaaacagaggagatgaaaaatgttccaagagaacctggcggcagcgcaaaagatg

SEQ ID NO: 191429 - DNA, 103 bp, Artificial Sequence
  Synthetic Polynucleotide
taatacgactcactatagggtttttattatatgccacaacttctcttggaaacagaggagatccaagatgagttgtggcaacctggcggcagcgcaaaagatg

SEQ ID NO: 191430 - DNA, 103 bp, Artificial Sequence
  Synthetic Polynucleotide
taatacgactcactatagggatcatttatatttttattatatgccacaacaacagaggagagttgtgatgtataataaaaacctggcggcagcgcaaaagatg

SEQ ID NO: 191431 - DNA, 103 bp, Artificial Sequence
  Synthetic Polynucleotide
taatacgactcactatagggtttcaaagtcatcatttatatttttattataacagaggagaataataatgatataaatgaacctggcggcagcgcaaaagatg

SEQ ID NO: 191432 - DNA, 103 bp, Artificial Sequence
  Synthetic Polynucleotide
taatacgactcactatagggcttaatttagctgaacgtagtattctggtaaacagaggagataccagatgactacgttcaacctggcggcagcgcaaaagatg

SEQ ID NO: 191433 - DNA, 103 bp, Artificial Sequence
  Synthetic Polynucleotide
taatacgactcactatagggcaatctatcatttcaaagtcatcatttataaacagaggagatataaaatgtgactttgaaacctggcggcagcgcaaaagatg

SEQ ID NO: 191434 - DNA, 103 bp, Artificial Sequence
  Synthetic Polynucleotide
taatacgactcactatagggttctaagtcacaatctatcatttcaaagtcaacagaggagagactttatgatgatagataacctggcggcagcgcaaaagatg

SEQ ID NO: 191435 - DNA, 103 bp, Artificial Sequence
  Synthetic Polynucleotide
taatacgactcactatagggttgtagcatcttctaagtcacaatctatcaaacagaggagatgatagatggtgacttagaacctggcggcagcgcaaaagatg

SEQ ID NO: 191436 - DNA, 103 bp, Artificial Sequence
  Synthetic Polynucleotide
taatacgactcactatagggtcaggtgtttttgtagcatcttctaagtcaaacagaggagatgacttatgagatgctacaacctggcggcagcgcaaaagatg

SEQ ID NO: 191437 - DNA, 103 bp, Artificial Sequence
  Synthetic Polynucleotide
taatacgactcactatagggactggaacagtcaggtgtttttgtagcatcaacagaggagagatgctatgaaaacacctaacctggcggcagcgcaaaagatg

SEQ ID NO: 191438 - DNA, 103 bp, Artificial Sequence
  Synthetic Polynucleotide
taatacgactcactatagggtcactggtccactggaacagtcaggtgtttaacagaggagaaaacacatgactgttccaaacctggcggcagcgcaaaagatg

SEQ ID NO: 191439 - DNA, 103 bp, Artificial Sequence
  Synthetic Polynucleotide
taatacgactcactatagggctttcctctttcactggtccactggaacagaacagaggagactgttcatgtggaccagtaacctggcggcagcgcaaaagatg

SEQ ID NO: 191440 - DNA, 103 bp, Artificial Sequence
  Synthetic Polynucleotide
taatacgactcactatagggaagatcacctctttcctctttcactggtccaacagaggagaggaccaatgaaagaggaaaacctggcggcagcgcaaaagatg

SEQ ID NO: 191441 - DNA, 103 bp, Artificial Sequence
  Synthetic Polynucleotide
taatacgactcactatagggaaaattttataagatcacctctttcctcttaacagaggagaaagaggatggaggtgatcaacctggcggcagcgcaaaagatg

SEQ ID NO: 191442 - DNA, 103 bp, Artificial Sequence
  Synthetic Polynucleotide
taatacgactcactatagggattgtattgtaaaattttataagatcacctaacagaggagaaggtgaatgtataaaattaacctggcggcagcgcaaaagatg

SEQ ID NO: 191443 - DNA, 103 bp, Artificial Sequence
  Synthetic Polynucleotide
taatacgactcactatagggttgtattaaacttaatttagctgaacgtagaacagaggagactacgtatggctaaattaaacctggcggcagcgcaaaagatg

SEQ ID NO: 191444 - DNA, 103 bp, Artificial Sequence
  Synthetic Polynucleotide
taatacgactcactatagggtcctacatatattgtattgtaaaattttataacagaggagaataaaaatgtacaatacaaacctggcggcagcgcaaaagatg

SEQ ID NO: 191445 - DNA, 103 bp, Artificial Sequence
  Synthetic Polynucleotide
taatacgactcactatagggacttcactcttcctacatatattgtattgtaacagaggagaacaataatgtatatgtagaacctggcggcagcgcaaaagatg

SEQ ID NO: 191446 - DNA, 103 bp, Artificial Sequence
  Synthetic Polynucleotide
taatacgactcactatagggagtgcaaatgacttcactcttcctacatataacagaggagaatatgtatgaagagtgaaaacctggcggcagcgcaaaagatg

SEQ ID NO: 191447 - DNA, 103 bp, Artificial Sequence
  Synthetic Polynucleotide
taatacgactcactataggggtcgtatttcagtgcaaatgacttcactctaacagaggagaagagtgatgtcatttgcaaacctggcggcagcgcaaaagatg

SEQ ID NO: 191448 - DNA, 103 bp, Artificial Sequence
  Synthetic Polynucleotide
taatacgactcactataggggattcgccaagtcgtatttcagtgcaaatgaacagaggagacatttgatgtgaaatacgaacctggcggcagcgcaaaagatg

SEQ ID NO: 191449 - DNA, 103 bp, Artificial Sequence
  Synthetic Polynucleotide
taatacgactcactatagggatatggtcctgattcgccaagtcgtatttcaacagaggagagaaataatgcttggcgaaaacctggcggcagcgcaaaagatg

SEQ ID NO: 191450 - DNA, 103 bp, Artificial Sequence
  Synthetic Polynucleotide
taatacgactcactatagggagcatccatcatatggtcctgattcgccaaaacagaggagattggcgatgcaggaccataacctggcggcagcgcaaaagatg

SEQ ID NO: 191451 - DNA, 103 bp, Artificial Sequence
  Synthetic Polynucleotide
taatacgactcactatagggagagtggtggagcatccatcatatggtcctaacagaggagaaggaccatgtgatggatgaacctggcggcagcgcaaaagatg

SEQ ID NO: 191452 - DNA, 103 bp, Artificial Sequence
  Synthetic Polynucleotide
taatacgactcactatagggggaaaaggagagagtggtggagcatccatcaacagaggagagatggaatgtccaccactaacctggcggcagcgcaaaagatg

SEQ ID NO: 191453 - DNA, 103 bp, Artificial Sequence
  Synthetic Polynucleotide
taatacgactcactatagggtttaatatgtggaaaaggagagagtggtggaacagaggagaccaccaatgtctccttttaacctggcggcagcgcaaaagatg

SEQ ID NO: 191454 - DNA, 103 bp, Artificial Sequence
  Synthetic Polynucleotide
taatacgactcactatagggtactaaaaaattgtattaaacttaatttagaacagaggagactaaatatggtttaatacaacctggcggcagcgcaaaagatg

SEQ ID NO: 191455 - DNA, 103 bp, Artificial Sequence
  Synthetic Polynucleotide
taatacgactcactatagggctggctgttgtttaatatgtggaaaaggagaacagaggagactccttatgcacatattaaacctggcggcagcgcaaaagatg

SEQ ID NO: 191456 - DNA, 103 bp, Artificial Sequence
  Synthetic Polynucleotide
taatacgactcactatagggcgtggtgagcctggctgttgtttaatatgtaacagaggagaacatatatgacaacagccaacctggcggcagcgcaaaagatg

SEQ ID NO: 191457 - DNA, 103 bp, Artificial Sequence
  Synthetic Polynucleotide
taatacgactcactatagggggaaatgcggcgtggtgagcctggctgttgaacagaggagacaacagatgggctcaccaaacctggcggcagcgcaaaagatg

SEQ ID NO: 191458 - DNA, 103 bp, Artificial Sequence
  Synthetic Polynucleotide
taatacgactcactatagggagtgctgctgggaaatgcggcgtggtgagcaacagaggagagctcacatggccgcatttaacctggcggcagcgcaaaagatg

SEQ ID NO: 191459 - DNA, 103 bp, Artificial Sequence
  Synthetic Polynucleotide
taatacgactcactatagggatataaatggagtgctgctgggaaatgcggaacagaggagaccgcatatgccagcagcaaacctggcggcagcgcaaaagatg

SEQ ID NO: 191460 - DNA, 103 bp, Artificial Sequence
  Synthetic Polynucleotide
taatacgactcactataggggtgcggggaaatataaatggagtgctgctgaacagaggagacagcagatgtccatttataacctggcggcagcgcaaaagatg

SEQ ID NO: 191461 - DNA, 103 bp, Artificial Sequence
  Synthetic Polynucleotide
taatacgactcactatagggacccattcttgtgcggggaaatataaatggaacagaggagaccatttatgtttccccgcaacctggcggcagcgcaaaagatg

SEQ ID NO: 191462 - DNA, 103 bp, Artificial Sequence
  Synthetic Polynucleotide
taatacgactcactataggggtaaggcctgacccattcttgtgcggggaaaacagaggagattccccatgcaagaatggaacctggcggcagcgcaaaagatg

SEQ ID NO: 191463 - DNA, 103 bp, Artificial Sequence
  Synthetic Polynucleotide
taatacgactcactataggggcttcttggtgtaaggcctgacccattcttaacagaggagaaagaatatgtcaggccttaacctggcggcagcgcaaaagatg

SEQ ID NO: 191464 - DNA, 103 bp, Artificial Sequence
  Synthetic Polynucleotide
taatacgactcactatagggacagcagagcgcttcttggtgtaaggcctgaacagaggagacaggccatgcaccaagaaaacctggcggcagcgcaaaagatg

SEQ ID NO: 191465 - DNA, 103 bp, Artificial Sequence
  Synthetic Polynucleotide
taatacgactcactataggggctgcggcgaccaccgccgccccctcagcgaacagaggagacgctgaatgggcggcggtaacctggcggcagcgcaaaagatg

SEQ ID NO: 191466 - DNA, 103 bp, Artificial Sequence
  Synthetic Polynucleotide
taatacgactcactatagggttcttcattttactaaaaaattgtattaaaaacagaggagatttaatatgattttttagaacctggcggcagcgcaaaagatg

SEQ ID NO: 191467 - DNA, 103 bp, Artificial Sequence
  Synthetic Polynucleotide
taatacgactcactatagggttgaacttgtacagcagagcgcttcttggtaacagaggagaaccaagatgcgctctgctaacctggcggcagcgcaaaagatg

SEQ ID NO: 191468 - DNA, 103 bp, Artificial Sequence
  Synthetic Polynucleotide
taatacgactcactatagggagggctgccattgaacttgtacagcagagcaacagaggagagctctgatgtacaagttcaacctggcggcagcgcaaaagatg

SEQ ID NO: 191469 - DNA, 103 bp, Artificial Sequence
  Synthetic Polynucleotide
taatacgactcactatagggttaccttagaagggctgccattgaacttgtaacagaggagaacaagtatgatggcagccaacctggcggcagcgcaaaagatg

SEQ ID NO: 191470 - DNA, 103 bp, Artificial Sequence
  Synthetic Polynucleotide
taatacgactcactataggggtccatccatttcttcattttactaaaaaaaacagaggagattttttatgaaaatgaagaacctggcggcagcgcaaaagatg

SEQ ID NO: 191471 - DNA, 103 bp, Artificial Sequence
  Synthetic Polynucleotide
taatacgactcactataggggatttgacatgtccatccatttcttcatttaacagaggagaaaatgaatgaatggatggaacctggcggcagcgcaaaagatg

SEQ ID NO: 191472 - DNA, 103 bp, Artificial Sequence
  Synthetic Polynucleotide
taatacgactcactatagggtcttgtggtagatttgacatgtccatccataacagaggagaatggatatgcatgtcaaaaacctggcggcagcgcaaaagatg

SEQ ID NO: 191473 - DNA, 103 bp, Artificial Sequence
  Synthetic Polynucleotide
taatacgactcactatagggttcacgaaattcttgtggtagatttgacataacagaggagaatgtcaatgctaccacaaaacctggcggcagcgcaaaagatg

SEQ ID NO: 191474 - DNA, 103 bp, Artificial Sequence
  Synthetic Polynucleotide
taatacgactcactatagggtttctatacgttcacgaaattcttgtggtaaacagaggagataccacatgaatttcgtgaacctggcggcagcgcaaaagatg

SEQ ID NO: 191475 - DNA, 103 bp, Artificial Sequence
  Synthetic Polynucleotide
taatacgactcactatagggctctctagcctttctatacgttcacgaaataacagaggagaatttcgatgacgtatagaaacctggcggcagcgcaaaagatg

SEQ ID NO: 191476 - DNA, 103 bp, Artificial Sequence
  Synthetic Polynucleotide
taatacgactcactatagggctcaaaatttctctctagcctttctatacgaacagaggagacgtataatgaggctagagaacctggcggcagcgcaaaagatg

SEQ ID NO: 191477 - DNA, 103 bp, Artificial Sequence
  Synthetic Polynucleotide
taatacgactcactatagggcagtagacacctcaaaatttctctctagccaacagaggagaggctagatggaaattttgaacctggcggcagcgcaaaagatg

SEQ ID NO: 191478 - DNA, 103 bp, Artificial Sequence
  Synthetic Polynucleotide
taatacgactcactatagggttgaatattacagtagacacctcaaaatttaacagaggagaaaatttatgggtgtctacaacctggcggcagcgcaaaagatg

SEQ ID NO: 191479 - DNA, 103 bp, Artificial Sequence
  Synthetic Polynucleotide
taatacgactcactatagggcgcctccccggctgcggcgaccaccgccgcaacagaggagagcggcgatggtcgccgcaaacctggcggcagcgcaaaagatg

SEQ ID NO: 191480 - DNA, 103 bp, Artificial Sequence
  Synthetic Polynucleotide
taatacgactcactatagggctcatattttttgaatattacagtagacacaacagaggagagtgtctatggtaatattcaacctggcggcagcgcaaaagatg

SEQ ID NO: 191481 - DNA, 103 bp, Artificial Sequence
  Synthetic Polynucleotide
taatacgactcactatagggaaaaaattggctcatattttttgaatattaaacagaggagataatatatgaaaaatatgaacctggcggcagcgcaaaagatg

SEQ ID NO: 191482 - DNA, 103 bp, Artificial Sequence
  Synthetic Polynucleotide
taatacgactcactatagggaatatatctaaaaaaattggctcatattttaacagaggagaaaaataatggccaattttaacctggcggcagcgcaaaagatg

SEQ ID NO: 191483 - DNA, 103 bp, Artificial Sequence
  Synthetic Polynucleotide
taatacgactcactatagggtggattttgaaatatatctaaaaaaattggaacagaggagaccaattatgttagatataaacctggcggcagcgcaaaagatg

SEQ ID NO: 191484 - DNA, 103 bp, Artificial Sequence
  Synthetic Polynucleotide
taatacgactcactataggggttcttcatatggattttgaaatatatctaaacagaggagatagataatgttcaaaatcaacctggcggcagcgcaaaagatg

SEQ ID NO: 191485 - DNA, 103 bp, Artificial Sequence
  Synthetic Polynucleotide
taatacgactcactatagggaactttggtggttcttcatatggattttgaaacagaggagatcaaaaatgatatgaagaaacctggcggcagcgcaaaagatg

SEQ ID NO: 191486 - DNA, 103 bp, Artificial Sequence
  Synthetic Polynucleotide
taatacgactcactataggggcttcgtggtaactttggtggttcttcataaacagaggagatatgaaatgccaccaaagaacctggcggcagcgcaaaagatg

SEQ ID NO: 191487 - DNA, 103 bp, Artificial Sequence
  Synthetic Polynucleotide
taatacgactcactatagggtctgcttccggcttcgtggtaactttggtgaacagaggagacaccaaatgtaccacgaaaacctggcggcagcgcaaaagatg

SEQ ID NO: 191488 - DNA, 103 bp, Artificial Sequence
  Synthetic Polynucleotide
taatacgactcactatagggggaatcctcctctgcttccggcttcgtggtaacagaggagaaccacgatgccggaagcaaacctggcggcagcgcaaaagatg

SEQ ID NO: 191489 - DNA, 103 bp, Artificial Sequence
  Synthetic Polynucleotide
taatacgactcactatagggaacactgcaaggaatcctcctctgcttccgaacagaggagacggaagatgaggaggattaacctggcggcagcgcaaaagatg

SEQ ID NO: 191490 - DNA, 103 bp, Artificial Sequence
  Synthetic Polynucleotide
taatacgactcactataggggggcctgtagcgcctccccggctgcggcgaaacagaggagatcgccgatgccggggaggaacctggcggcagcgcaaaagatg

SEQ ID NO: 191491 - DNA, 103 bp, Artificial Sequence
  Synthetic Polynucleotide
taatacgactcactatagggacagatccttaacactgcaaggaatcctccaacagaggagaggaggaatgcttgcagtgaacctggcggcagcgcaaaagatg

SEQ ID NO: 191492 - DNA, 103 bp, Artificial Sequence
  Synthetic Polynucleotide
taatacgactcactatagggcagaaattaaacagatccttaacactgcaaaacagaggagattgcagatgtaaggatctaacctggcggcagcgcaaaagatg

SEQ ID NO: 191493 - DNA, 103 bp, Artificial Sequence
  Synthetic Polynucleotide
taatacgactcactatagggaagtgtccaacagaaattaaacagatccttaacagaggagaaaggatatgtttaatttcaacctggcggcagcgcaaaagatg

SEQ ID NO: 191494 - DNA, 103 bp, Artificial Sequence
  Synthetic Polynucleotide
taatacgactcactatagggtataaacaaaaagtgtccaacagaaattaaaacagaggagattaattatggttggacacaacctggcggcagcgcaaaagatg

SEQ ID NO: 191495 - DNA, 103 bp, Artificial Sequence
  Synthetic Polynucleotide
taatacgactcactatagggttacccttagtataaacaaaaagtgtccaaaacagaggagattggacatgttttgtttaaacctggcggcagcgcaaaagatg

SEQ ID NO: 191496 - DNA, 103 bp, Artificial Sequence
  Synthetic Polynucleotide
taatacgactcactatagggcatccgaaaattacccttagtataaacaaaaacagaggagatttgttatgactaagggtaacctggcggcagcgcaaaagatg

SEQ ID NO: 191497 - DNA, 103 bp, Artificial Sequence
  Synthetic Polynucleotide
taatacgactcactatagggcatccccaatcatccgaaaattacccttagaacagaggagactaaggatgattttcggaaacctggcggcagcgcaaaagatg

SEQ ID NO: 191498 - DNA, 103 bp, Artificial Sequence
  Synthetic Polynucleotide
taatacgactcactatagggtttactaagtcatccccaatcatccgaaaaaacagaggagattttcgatggattggggaaacctggcggcagcgcaaaagatg

SEQ ID NO: 191499 - DNA, 103 bp, Artificial Sequence
  Synthetic Polynucleotide
taatacgactcactatagggatgataagagtttactaagtcatccccaataacagaggagaattgggatggacttagtaaacctggcggcagcgcaaaagatg

SEQ ID NO: 191500 - DNA, 103 bp, Artificial Sequence
  Synthetic Polynucleotide
taatacgactcactatagggatagaagtaaatgataagagtttactaagtaacagaggagaacttagatgactcttatcaacctggcggcagcgcaaaagatg

SEQ ID NO: 191501 - DNA, 103 bp, Artificial Sequence
  Synthetic Polynucleotide
taatacgactcactatagggtcctggcacagggcctgtagcgcctccccgaacagaggagacggggaatggctacaggcaacctggcggcagcgcaaaagatg

SEQ ID NO: 191502 - DNA, 103 bp, Artificial Sequence
  Synthetic Polynucleotide
taatacgactcactatagggtccaagcagcatagaagtaaatgataagagaacagaggagactcttaatgtttacttctaacctggcggcagcgcaaaagatg

SEQ ID NO: 191503 - DNA, 103 bp, Artificial Sequence
  Synthetic Polynucleotide
taatacgactcactatagggaaaaatcagatccaagcagcatagaagtaaaacagaggagattacttatgtgctgcttgaacctggcggcagcgcaaaagatg

SEQ ID NO: 191504 - DNA, 103 bp, Artificial Sequence
  Synthetic Polynucleotide
taatacgactcactatagggtcgcattggcaaaaatcagatccaagcagcaacagaggagagctgctatgatctgatttaacctggcggcagcgcaaaagatg

SEQ ID NO: 191505 - DNA, 103 bp, Artificial Sequence
  Synthetic Polynucleotide
taatacgactcactataggggggcacataatcgcattggcaaaaatcagaaacagaggagatctgatatgtgccaatgcaacctggcggcagcgcaaaagatg

SEQ ID NO: 191506 - DNA, 103 bp, Artificial Sequence
  Synthetic Polynucleotide
taatacgactcactatagggttgtctatttgggcacataatcgcattggcaacagaggagagccaatatgattatgtgcaacctggcggcagcgcaaaagatg

SEQ ID NO: 191507 - DNA, 103 bp, Artificial Sequence
  Synthetic Polynucleotide
taatacgactcactatagggttagcaagtcttgtctatttgggcacataaaacagaggagattatgtatgcaaatagacaacctggcggcagcgcaaaagatg

SEQ ID NO: 191508 - DNA, 103 bp, Artificial Sequence
  Synthetic Polynucleotide
taatacgactcactatagggaatgatggatttagcaagtcttgtctatttaacagaggagaaaatagatgagacttgctaacctggcggcagcgcaaaagatg

SEQ ID NO: 191509 - DNA, 103 bp, Artificial Sequence
  Synthetic Polynucleotide
taatacgactcactatagggtaaacctttaaatgatggatttagcaagtcaacagaggagagacttgatgaatccatcaaacctggcggcagcgcaaaagatg

SEQ ID NO: 191510 - DNA, 103 bp, Artificial Sequence
  Synthetic Polynucleotide
taatacgactcactatagggaatcagatggtaaacctttaaatgatggataacagaggagaatccatatgttaaaggttaacctggcggcagcgcaaaagatg

SEQ ID NO: 191511 - DNA, 103 bp, Artificial Sequence
  Synthetic Polynucleotide
taatacgactcactataggggcagtatgaaaatcagatggtaaacctttaaacagaggagataaaggatgaccatctgaaacctggcggcagcgcaaaagatg

SEQ ID NO: 191512 - DNA, 103 bp, Artificial Sequence
  Synthetic Polynucleotide
taatacgactcactatagggcaggttcagctcctggcacagggcctgtagaacagaggagactacagatgctgtgccagaacctggcggcagcgcaaaagatg

SEQ ID NO: 191513 - DNA, 103 bp, Artificial Sequence
  Synthetic Polynucleotide
taatacgactcactatagggcgtaaagtcagcagtatgaaaatcagatggaacagaggagaccatctatgtttcatactaacctggcggcagcgcaaaagatg

SEQ ID NO: 191514 - DNA, 103 bp, Artificial Sequence
  Synthetic Polynucleotide
taatacgactcactatagggcttcagaagccgtaaagtcagcagtatgaaaacagaggagattcataatgctgactttaaacctggcggcagcgcaaaagatg

SEQ ID NO: 191515 - DNA, 103 bp, Artificial Sequence
  Synthetic Polynucleotide
taatacgactcactatagggcagggtggctcttcagaagccgtaaagtcaaacagaggagatgacttatgggcttctgaaacctggcggcagcgcaaaagatg

SEQ ID NO: 191516 - DNA, 103 bp, Artificial Sequence
  Synthetic Polynucleotide
taatacgactcactatagggagcaatgatgcagggtggctcttcagaagcaacagaggagagcttctatggagccacccaacctggcggcagcgcaaaagatg

SEQ ID NO: 191517 - DNA, 103 bp, Artificial Sequence
  Synthetic Polynucleotide
taatacgactcactatagggcacacagtacagcaatgatgcagggtggctaacagaggagaagccacatggcatcattgaacctggcggcagcgcaaaagatg

SEQ ID NO: 191518 - DNA, 103 bp, Artificial Sequence
  Synthetic Polynucleotide
taatacgactcactatagggtcatgcagttcacacagtacagcaatgatgaacagaggagacatcatatgtgtactgtgaacctggcggcagcgcaaaagatg

SEQ ID NO: 191519 - DNA, 103 bp, Artificial Sequence
  Synthetic Polynucleotide
taatacgactcactataggggagaagtccatcatgcagttcacacagtacaacagaggagagtactgatggaactgcataacctggcggcagcgcaaaagatg

SEQ ID NO: 191520 - DNA, 103 bp, Artificial Sequence
  Synthetic Polynucleotide
taatacgactcactatagggttgcttctacgagaagtccatcatgcagttaacagaggagaaactgcatgatggacttcaacctggcggcagcgcaaaagatg

SEQ ID NO: 191521 - DNA, 103 bp, Artificial Sequence
  Synthetic Polynucleotide
taatacgactcactatagggtttattccttttgcttctacgagaagtccaaacagaggagatggactatgcgtagaagcaacctggcggcagcgcaaaagatg

SEQ ID NO: 191522 - DNA, 103 bp, Artificial Sequence
  Synthetic Polynucleotide
taatacgactcactataggggtagtgctcctttattccttttgcttctacaacagaggagagtagaaatgaaaggaataaacctggcggcagcgcaaaagatg

SEQ ID NO: 191523 - DNA, 103 bp, Artificial Sequence
  Synthetic Polynucleotide
taatacgactcactatagggtcccctcgtccaggttcagctcctggcacaaacagaggagatgtgccatgagctgaaccaacctggcggcagcgcaaaagatg

SEQ ID NO: 191524 - DNA, 103 bp, Artificial Sequence
  Synthetic Polynucleotide
taatacgactcactatagggatggcttaaagtagtgctcctttattccttaacagaggagaaaggaaatgaggagcactaacctggcggcagcgcaaaagatg

SEQ ID NO: 191525 - DNA, 103 bp, Artificial Sequence
  Synthetic Polynucleotide
taatacgactcactatagggtttgaaatatatggcttaaagtagtgctccaacagaggagaggagcaatgctttaagccaacctggcggcagcgcaaaagatg

SEQ ID NO: 191526 - DNA, 103 bp, Artificial Sequence
  Synthetic Polynucleotide
taatacgactcactataggggtcaaagagttttgaaatatatggcttaaaaacagaggagatttaagatgtatatttcaaacctggcggcagcgcaaaagatg

SEQ ID NO: 191527 - DNA, 103 bp, Artificial Sequence
  Synthetic Polynucleotide
taatacgactcactatagggatatcttcctgtcaaagagttttgaaatataacagaggagaatatttatgaactctttgaacctggcggcagcgcaaaagatg

SEQ ID NO: 191528 - DNA, 103 bp, Artificial Sequence
  Synthetic Polynucleotide
taatacgactcactatagggtctccttttaatatcttcctgtcaaagagtaacagaggagaactcttatgcaggaagataacctggcggcagcgcaaaagatg

SEQ ID NO: 191529 - DNA, 103 bp, Artificial Sequence
  Synthetic Polynucleotide
taatacgactcactatagggcaggaggcattctccttttaatatcttcctaacagaggagaaggaagatgttaaaaggaaacctggcggcagcgcaaaagatg

SEQ ID NO: 191530 - DNA, 103 bp, Artificial Sequence
  Synthetic Polynucleotide
taatacgactcactatagggttgaaaggtccaggaggcattctccttttaaacagaggagataaaagatgaatgcctccaacctggcggcagcgcaaaagatg

SEQ ID NO: 191531 - DNA, 103 bp, Artificial Sequence
  Synthetic Polynucleotide
taatacgactcactatagggtcagtaaaacttgaaaggtccaggaggcataacagaggagaatgcctatgggacctttcaacctggcggcagcgcaaaagatg

SEQ ID NO: 191532 - DNA, 103 bp, Artificial Sequence
  Synthetic Polynucleotide
taatacgactcactatagggtttgctattatcagtaaaacttgaaaggtcaacagaggagagaccttatgagttttactaacctggcggcagcgcaaaagatg

SEQ ID NO: 191533 - DNA, 103 bp, Artificial Sequence
  Synthetic Polynucleotide
taatacgactcactatagggtattcactgctttgctattatcagtaaaacaacagaggagagttttaatgataatagcaaacctggcggcagcgcaaaagatg

SEQ ID NO: 191534 - DNA, 103 bp, Artificial Sequence
  Synthetic Polynucleotide
taatacgactcactatagggtcggccgcgctcccctcgtccaggttcagcaacagaggagagctgaaatgggacgagggaacctggcggcagcgcaaaagatg

SEQ ID NO: 191535 - DNA, 103 bp, Artificial Sequence
  Synthetic Polynucleotide
taatacgactcactatagggtcatactccttattcactgctttgctattaaacagaggagataatagatgagcagtgaaaacctggcggcagcgcaaaagatg

SEQ ID NO: 191536 - DNA, 103 bp, Artificial Sequence
  Synthetic Polynucleotide
taatacgactcactatagggaacatactcttcatactccttattcactgcaacagaggagagcagtgatgaaggagtataacctggcggcagcgcaaaagatg

SEQ ID NO: 191537 - DNA, 103 bp, Artificial Sequence
  Synthetic Polynucleotide
taatacgactcactatagggcaacagttagaacatactcttcatactcctaacagaggagaaggagtatgaagagtatgaacctggcggcagcgcaaaagatg

SEQ ID NO: 191538 - DNA, 103 bp, Artificial Sequence
  Synthetic Polynucleotide
taatacgactcactatagggtcaaaatcaccaacagttagaacatactctaacagaggagaagagtaatgtctaactgtaacctggcggcagcgcaaaagatg

SEQ ID NO: 191539 - DNA, 103 bp, Artificial Sequence
  Synthetic Polynucleotide
taatacgactcactataggggatcctctcatcaaaatcaccaacagttagaacagaggagactaactatgggtgattttaacctggcggcagcgcaaaagatg

SEQ ID NO: 191540 - DNA, 103 bp, Artificial Sequence
  Synthetic Polynucleotide
taatacgactcactatagggctcccaaaaagatcctctcatcaaaatcacaacagaggagagtgattatgatgagaggaaacctggcggcagcgcaaaagatg

SEQ ID NO: 191541 - DNA, 103 bp, Artificial Sequence
  Synthetic Polynucleotide
taatacgactcactatagggtctgcgtctgctcccaaaaagatcctctcaaacagaggagatgagagatgctttttgggaacctggcggcagcgcaaaagatg

SEQ ID NO: 191542 - DNA, 103 bp, Artificial Sequence
  Synthetic Polynucleotide
taatacgactcactatagggaatttcctcttctgcgtctgctcccaaaaaaacagaggagatttttgatggcagacgcaaacctggcggcagcgcaaaagatg

SEQ ID NO: 191543 - DNA, 103 bp, Artificial Sequence
  Synthetic Polynucleotide
taatacgactcactataggggaggtgttccaatttcctcttctgcgtctgaacagaggagacagacgatgaagaggaaaaacctggcggcagcgcaaaagatg

SEQ ID NO: 191544 - DNA, 103 bp, Artificial Sequence
  Synthetic Polynucleotide
taatacgactcactataggggtgaactttcgaggtgttccaatttcctctaacagaggagaagaggaatgtggaacaccaacctggcggcagcgcaaaagatg

SEQ ID NO: 191545 - DNA, 103 bp, Artificial Sequence
  Synthetic Polynucleotide
taatacgactcactatagggcggtggcgactggtcacctcccgacggcataacagaggagaatgccgatgggaggtgacaacctggcggcagcgcaaaagatg

SEQ ID NO: 191546 - DNA, 103 bp, Artificial Sequence
  Synthetic Polynucleotide
taatacgactcactatagggcgactcggcaggcggcgcggcgtcttccgcaacagaggagagcggaaatggccgcgccgaacctggcggcagcgcaaaagatg

SEQ ID NO: 191547 - DNA, 103 bp, Artificial Sequence
  Synthetic Polynucleotide
taatacgactcactatagggctcctcataggccttattgatggctttaaaaacagaggagatttaaaatgatcaataagaacctggcggcagcgcaaaagatg

SEQ ID NO: 191548 - DNA, 103 bp, Artificial Sequence
  Synthetic Polynucleotide
taatacgactcactatagggataaaacatactcctcataggccttattgaaacagaggagatcaataatgcctatgaggaacctggcggcagcgcaaaagatg

SEQ ID NO: 191549 - DNA, 103 bp, Artificial Sequence
  Synthetic Polynucleotide
taatacgactcactatagggttcccaacagataaaacatactcctcatagaacagaggagactatgaatggtatgttttaacctggcggcagcgcaaaagatg

SEQ ID NO: 191550 - DNA, 103 bp, Artificial Sequence
  Synthetic Polynucleotide
taatacgactcactatagggctcatctaaattcccaacagataaaacataaacagaggagatatgttatgtctgttgggaacctggcggcagcgcaaaagatg

SEQ ID NO: 191551 - DNA, 103 bp, Artificial Sequence
  Synthetic Polynucleotide
taatacgactcactataggggaaatatccgctcatctaaattcccaacagaacagaggagactgttgatgatttagatgaacctggcggcagcgcaaaagatg

SEQ ID NO: 191552 - DNA, 103 bp, Artificial Sequence
  Synthetic Polynucleotide
taatacgactcactatagggtcctctccaagaaatatccgctcatctaaaaacagaggagatttagaatggcggatattaacctggcggcagcgcaaaagatg

SEQ ID NO: 191553 - DNA, 103 bp, Artificial Sequence
  Synthetic Polynucleotide
taatacgactcactatagggctcctcagcatcctctccaagaaatatccgaacagaggagacggataatgcttggagagaacctggcggcagcgcaaaagatg

SEQ ID NO: 191554 - DNA, 103 bp, Artificial Sequence
  Synthetic Polynucleotide
taatacgactcactatagggtcccaatttcctcctcagcatcctctccaaaacagaggagattggagatgatgctgaggaacctggcggcagcgcaaaagatg

SEQ ID NO: 191555 - DNA, 103 bp, Artificial Sequence
  Synthetic Polynucleotide
taatacgactcactatagggcttgagagagtcccaatttcctcctcagcaaacagaggagatgctgaatgggaaattggaacctggcggcagcgcaaaagatg

SEQ ID NO: 191556 - DNA, 103 bp, Artificial Sequence
  Synthetic Polynucleotide
taatacgactcactataggggttcagacaccttgagagagtcccaatttcaacagaggagagaaattatgactctctcaaacctggcggcagcgcaaaagatg

SEQ ID NO: 191557 - DNA, 103 bp, Artificial Sequence
  Synthetic Polynucleotide
taatacgactcactataggggaggggtgggcgactcggcaggcggcgcggaacagaggagaccgcgcatgctgccgagtaacctggcggcagcgcaaaagatg

SEQ ID NO: 191558 - DNA, 103 bp, Artificial Sequence
  Synthetic Polynucleotide
taatacgactcactatagggctgaaccagcgttcagacaccttgagagagaacagaggagactctctatgggtgtctgaaacctggcggcagcgcaaaagatg

SEQ ID NO: 191559 - DNA, 103 bp, Artificial Sequence
  Synthetic Polynucleotide
taatacgactcactataggggtctctgttcctgaaccagcgttcagacacaacagaggagagtgtctatgcgctggttcaacctggcggcagcgcaaaagatg

SEQ ID NO: 191560 - DNA, 103 bp, Artificial Sequence
  Synthetic Polynucleotide
taatacgactcactatagggcctttcagcagtctctgttcctgaaccagcaacagaggagagctggtatgggaacagagaacctggcggcagcgcaaaagatg

SEQ ID NO: 191561 - DNA, 103 bp, Artificial Sequence
  Synthetic Polynucleotide
taatacgactcactatagggtcatctgcaccctttcagcagtctctgttcaacagaggagagaacagatgctgctgaaaaacctggcggcagcgcaaaagatg

SEQ ID NO: 191562 - DNA, 103 bp, Artificial Sequence
  Synthetic Polynucleotide
taatacgactcactatagggaagatgtttttcatctgcaccctttcagcaaacagaggagatgctgaatgggtgcagataacctggcggcagcgcaaaagatg

SEQ ID NO: 191563 - DNA, 103 bp, Artificial Sequence
  Synthetic Polynucleotide
taatacgactcactatagggatgctgctgtaagatgtttttcatctgcacaacagaggagagtgcagatgaaaaacatcaacctggcggcagcgcaaaagatg

SEQ ID NO: 191564 - DNA, 103 bp, Artificial Sequence
  Synthetic Polynucleotide
taatacgactcactatagggacttgtcaaaatgctgctgtaagatgttttaacagaggagaaaaacaatgtacagcagcaacctggcggcagcgcaaaagatg

SEQ ID NO: 191565 - DNA, 103 bp, Artificial Sequence
  Synthetic Polynucleotide
taatacgactcactatagggagtgctttggacttgtcaaaatgctgctgtaacagaggagaacagcaatgttttgacaaaacctggcggcagcgcaaaagatg

SEQ ID NO: 191566 - DNA, 103 bp, Artificial Sequence
  Synthetic Polynucleotide
taatacgactcactatagggggagattctaagtgctttggacttgtcaaaaacagaggagatttgacatgtccaaagcaaacctggcggcagcgcaaaagatg

SEQ ID NO: 191567 - DNA, 103 bp, Artificial Sequence
  Synthetic Polynucleotide
taatacgactcactatagggttagtggtgtggagattctaagtgctttggaacagaggagaccaaagatgttagaatctaacctggcggcagcgcaaaagatg

SEQ ID NO: 191568 - DNA, 103 bp, Artificial Sequence
  Synthetic Polynucleotide
taatacgactcactatagggtgctggatctgaggggtgggcgactcggcaaacagaggagatgccgaatggcccaccccaacctggcggcagcgcaaaagatg

SEQ ID NO: 191569 - DNA, 103 bp, Artificial Sequence
  Synthetic Polynucleotide
taatacgactcactatagggctaacaccagttagtggtgtggagattctaaacagaggagatagaatatgcacaccactaacctggcggcagcgcaaaagatg

SEQ ID NO: 191570 - DNA, 103 bp, Artificial Sequence
  Synthetic Polynucleotide
taatacgactcactatagggcttaatgtacctaacaccagttagtggtgtaacagaggagaacaccaatgactggtgttaacctggcggcagcgcaaaagatg

SEQ ID NO: 191571 - DNA, 103 bp, Artificial Sequence
  Synthetic Polynucleotide
taatacgactcactatagggggctattctccttaatgtacctaacaccagaacagaggagactggtgatgggtacattaaacctggcggcagcgcaaaagatg

SEQ ID NO: 191572 - DNA, 103 bp, Artificial Sequence
  Synthetic Polynucleotide
taatacgactcactataggggtcacacaagggctattctccttaatgtacaacagaggagagtacatatgggagaatagaacctggcggcagcgcaaaagatg

SEQ ID NO: 191573 - DNA, 103 bp, Artificial Sequence
  Synthetic Polynucleotide
taatacgactcactatagggagaaactggagtcacacaagggctattctcaacagaggagagagaatatgccttgtgtgaacctggcggcagcgcaaaagatg

SEQ ID NO: 191574 - DNA, 103 bp, Artificial Sequence
  Synthetic Polynucleotide
taatacgactcactataggggcgtagctgtagaaactggagtcacacaagaacagaggagacttgtgatgctccagtttaacctggcggcagcgcaaaagatg

SEQ ID NO: 191575 - DNA, 103 bp, Artificial Sequence
  Synthetic Polynucleotide
taatacgactcactatagggctcaagctatgcgtagctgtagaaactggaaacagaggagatccagtatgtacagctacaacctggcggcagcgcaaaagatg

SEQ ID NO: 191576 - DNA, 103 bp, Artificial Sequence
  Synthetic Polynucleotide
taatacgactcactataggggtgaagacgactcaagctatgcgtagctgtaacagaggagaacagctatgcatagcttgaacctggcggcagcgcaaaagatg

SEQ ID NO: 191577 - DNA, 103 bp, Artificial Sequence
  Synthetic Polynucleotide
taatacgactcactatagggtcagcatggtgtgaagacgactcaagctataacagaggagaatagctatggtcgtcttcaacctggcggcagcgcaaaagatg

SEQ ID NO: 191578 - DNA, 103 bp, Artificial Sequence
  Synthetic Polynucleotide
taatacgactcactatagggctgaggcctgtcagcatggtgtgaagacgaaacagaggagatcgtctatgcaccatgctaacctggcggcagcgcaaaagatg

SEQ ID NO: 191579 - DNA, 103 bp, Artificial Sequence
  Synthetic Polynucleotide
taatacgactcactataggggtcgaaccgctgctggatctgaggggtgggaacagaggagacccaccatgcagatccagaacctggcggcagcgcaaaagatg

SEQ ID NO: 191580 - DNA, 103 bp, Artificial Sequence
  Synthetic Polynucleotide
taatacgactcactatagggtggtgcattcctgaggcctgtcagcatggtaacagaggagaaccatgatgacaggcctcaacctggcggcagcgcaaaagatg

SEQ ID NO: 191581 - DNA, 103 bp, Artificial Sequence
  Synthetic Polynucleotide
taatacgactcactataggggtttctcacttggtgcattcctgaggcctgaacagaggagacaggccatgggaatgcacaacctggcggcagcgcaaaagatg

SEQ ID NO: 191582 - DNA, 103 bp, Artificial Sequence
  Synthetic Polynucleotide
taatacgactcactatagggatctgttccagtttctcacttggtgcattcaacagaggagagaatgcatgaagtgagaaaacctggcggcagcgcaaaagatg

SEQ ID NO: 191583 - DNA, 103 bp, Artificial Sequence
  Synthetic Polynucleotide
taatacgactcactatagggtgtcctgagaatctgttccagtttctcactaacagaggagaagtgagatgctggaacagaacctggcggcagcgcaaaagatg

SEQ ID NO: 191584 - DNA, 103 bp, Artificial Sequence
  Synthetic Polynucleotide
taatacgactcactatagggctctggaacatgtcctgagaatctgttccaaacagaggagatggaacatgttctcaggaaacctggcggcagcgcaaaagatg

SEQ ID NO: 191585 - DNA, 103 bp, Artificial Sequence
  Synthetic Polynucleotide
taatacgactcactatagggtgggttggatctctggaacatgtcctgagaaacagaggagatctcagatgatgttccagaacctggcggcagcgcaaaagatg

SEQ ID NO: 191586 - DNA, 103 bp, Artificial Sequence
  Synthetic Polynucleotide
taatacgactcactatagggagcaatagcctgggttggatctctggaacaaacagaggagatgttccatggatccaaccaacctggcggcagcgcaaaagatg

SEQ ID NO: 191587 - DNA, 103 bp, Artificial Sequence
  Synthetic Polynucleotide
taatacgactcactatagggtcagtctgttagcaatagcctgggttggataacagaggagaatccaaatgaggctattgaacctggcggcagcgcaaaagatg

SEQ ID NO: 191588 - DNA, 103 bp, Artificial Sequence
  Synthetic Polynucleotide
taatacgactcactatagggaacatttctttcagtctgttagcaatagccaacagaggagaggctatatgtaacagactaacctggcggcagcgcaaaagatg

SEQ ID NO: 191589 - DNA, 103 bp, Artificial Sequence
  Synthetic Polynucleotide
taatacgactcactatagggatatatttcaaacatttctttcagtctgttaacagaggagaaacagaatgaaagaaatgaacctggcggcagcgcaaaagatg

SEQ ID NO: 191590 - DNA, 103 bp, Artificial Sequence
  Synthetic Polynucleotide
taatacgactcactatagggtgcacagctcgtcgaaccgctgctggatctaacagaggagaagatccatgagcggttcgaacctggcggcagcgcaaaagatg

SEQ ID NO: 191591 - DNA, 103 bp, Artificial Sequence
  Synthetic Polynucleotide
taatacgactcactatagggaatgctgagaatatatttcaaacatttcttaacagaggagaaagaaaatgttgaaatataacctggcggcagcgcaaaagatg

SEQ ID NO: 191592 - DNA, 103 bp, Artificial Sequence
  Synthetic Polynucleotide
taatacgactcactatagggtctggctggaaatgctgagaatatatttcaaacagaggagatgaaatatgttctcagcaaacctggcggcagcgcaaaagatg

SEQ ID NO: 191593 - DNA, 103 bp, Artificial Sequence
  Synthetic Polynucleotide
taatacgactcactataggggaaatcctcgtctggctggaaatgctgagaaacagaggagatctcagatgttccagccaaacctggcggcagcgcaaaagatg

SEQ ID NO: 191594 - DNA, 103 bp, Artificial Sequence
  Synthetic Polynucleotide
taatacgactcactatagggcacaattactgaaatcctcgtctggctggaaacagaggagatccagcatgacgaggattaacctggcggcagcgcaaaagatg

SEQ ID NO: 191595 - DNA, 103 bp, Artificial Sequence
  Synthetic Polynucleotide
taatacgactcactatagggatttctttagcacaattactgaaatcctcgaacagaggagacgaggaatgcagtaattgaacctggcggcagcgcaaaagatg

SEQ ID NO: 191596 - DNA, 103 bp, Artificial Sequence
  Synthetic Polynucleotide
taatacgactcactatagggtttgctggcaatttctttagcacaattactaacagaggagaagtaatatggctaaagaaaacctggcggcagcgcaaaagatg

SEQ ID NO: 191597 - DNA, 103 bp, Artificial Sequence
  Synthetic Polynucleotide
taatacgactcactatagggaacgaaaatgtttgctggcaatttctttagaacagaggagactaaagatgttgccagcaaacctggcggcagcgcaaaagatg

SEQ ID NO: 191598 - DNA, 103 bp, Artificial Sequence
  Synthetic Polynucleotide
taatacgactcactatagggatctccgcaaaacgaaaatgtttgctggcaaacagaggagatgccagatgacattttcgaacctggcggcagcgcaaaagatg

SEQ ID NO: 191599 - DNA, 103 bp, Artificial Sequence
  Synthetic Polynucleotide
taatacgactcactatagggatagtaaagcatctccgcaaaacgaaaatgaacagaggagacattttatgtttgcggagaacctggcggcagcgcaaaagatg

SEQ ID NO: 191600 - DNA, 103 bp, Artificial Sequence
  Synthetic Polynucleotide
taatacgactcactatagggctaatactttatagtaaagcatctccgcaaaacagaggagattgcggatgtgctttactaacctggcggcagcgcaaaagatg

SEQ ID NO: 191601 - DNA, 103 bp, Artificial Sequence
  Synthetic Polynucleotide
taatacgactcactatagggttgaggcggctgcacagctcgtcgaaccgcaacagaggagagcggttatgcgagctgtgaacctggcggcagcgcaaaagatg

SEQ ID NO: 191602 - DNA, 103 bp, Artificial Sequence
  Synthetic Polynucleotide
taatacgactcactatagggataacagattctaatactttatagtaaagcaacagaggagagctttaatgtaaagtattaacctggcggcagcgcaaaagatg

SEQ ID NO: 191603 - DNA, 103 bp, Artificial Sequence
  Synthetic Polynucleotide
taatacgactcactatagggttcctgctcaataacagattctaatactttaacagaggagaaaagtaatggaatctgttaacctggcggcagcgcaaaagatg

SEQ ID NO: 191604 - DNA, 103 bp, Artificial Sequence
  Synthetic Polynucleotide
taatacgactcactataggggtcttttttgttcctgctcaataacagattaacagaggagaaatctgatgttgagcaggaacctggcggcagcgcaaaagatg

SEQ ID NO: 191605 - DNA, 103 bp, Artificial Sequence
  Synthetic Polynucleotide
taatacgactcactatagggatgtctcctagtcttttttgttcctgctcaaacagaggagatgagcaatgacaaaaaagaacctggcggcagcgcaaaagatg

SEQ ID NO: 191606 - DNA, 103 bp, Artificial Sequence
  Synthetic Polynucleotide
taatacgactcactatagggagataaatccatgtctcctagtcttttttgaacagaggagacaaaaaatgctaggagacaacctggcggcagcgcaaaagatg

SEQ ID NO: 191607 - DNA, 103 bp, Artificial Sequence
  Synthetic Polynucleotide
taatacgactcactatagggccagaataccagataaatccatgtctcctaaacagaggagataggagatgtggatttataacctggcggcagcgcaaaagatg

SEQ ID NO: 191608 - DNA, 103 bp, Artificial Sequence
  Synthetic Polynucleotide
taatacgactcactataggggcatcttgttccagaataccagataaatccaacagaggagaggatttatgtggtattctaacctggcggcagcgcaaaagatg

SEQ ID NO: 191609 - DNA, 103 bp, Artificial Sequence
  Synthetic Polynucleotide
taatacgactcactatagggtctgtggaacgcatcttgttccagaataccaacagaggagaggtattatggaacaagataacctggcggcagcgcaaaagatg

SEQ ID NO: 191610 - DNA, 103 bp, Artificial Sequence
  Synthetic Polynucleotide
taatacgactcactatagggccaagagagatctgtggaacgcatcttgttaacagaggagaaacaagatgcgttccacaaacctggcggcagcgcaaaagatg

SEQ ID NO: 191611 - DNA, 103 bp, Artificial Sequence
  Synthetic Polynucleotide
taatacgactcactatagggaggcagcaggccaagagagatctgtggaacaacagaggagagttccaatgatctctcttaacctggcggcagcgcaaaagatg

SEQ ID NO: 191612 - DNA, 103 bp, Artificial Sequence
  Synthetic Polynucleotide
taatacgactcactatagggctcgtccatgttgaggcggctgcacagctcaacagaggagagagctgatgagccgcctcaacctggcggcagcgcaaaagatg

SEQ ID NO: 191613 - DNA, 103 bp, Artificial Sequence
  Synthetic Polynucleotide
taatacgactcactataggggacgacctcaaggcagcaggccaagagagaaacagaggagatctctcatggcctgctgcaacctggcggcagcgcaaaagatg

SEQ ID NO: 191614 - DNA, 103 bp, Artificial Sequence
  Synthetic Polynucleotide
taatacgactcactatagggaagaaaaagtgacgacctcaaggcagcaggaacagaggagacctgctatgttgaggtcgaacctggcggcagcgcaaaagatg

SEQ ID NO: 191615 - DNA, 103 bp, Artificial Sequence
  Synthetic Polynucleotide
taatacgactcactatagggggaggcttataagaaaaagtgacgacctcaaacagaggagatgaggtatgcactttttcaacctggcggcagcgcaaaagatg

SEQ ID NO: 191616 - DNA, 103 bp, Artificial Sequence
  Synthetic Polynucleotide
taatacgactcactatagggaaaattcccaggaggcttataagaaaaagtaacagaggagaacttttatgtataagcctaacctggcggcagcgcaaaagatg

SEQ ID NO: 191617 - DNA, 103 bp, Artificial Sequence
  Synthetic Polynucleotide
taatacgactcactatagggtaataaatggaaaattcccaggaggcttataacagaggagaataagcatgctgggaattaacctggcggcagcgcaaaagatg

SEQ ID NO: 191618 - DNA, 103 bp, Artificial Sequence
  Synthetic Polynucleotide
taatacgactcactatagggaatatttcagtaataaatggaaaattcccaaacagaggagatgggaaatgtccatttataacctggcggcagcgcaaaagatg

SEQ ID NO: 191619 - DNA, 103 bp, Artificial Sequence
  Synthetic Polynucleotide
taatacgactcactatagggaggcacatcaaatatttcagtaataaatggaacagaggagaccatttatgactgaaataaacctggcggcagcgcaaaagatg

SEQ ID NO: 191620 - DNA, 103 bp, Artificial Sequence
  Synthetic Polynucleotide
taatacgactcactatagggaatgataaagaggcacatcaaatatttcagaacagaggagactgaaaatgttgatgtgcaacctggcggcagcgcaaaagatg

SEQ ID NO: 191621 - DNA, 103 bp, Artificial Sequence
  Synthetic Polynucleotide
taatacgactcactatagggaccttataaaaatgataaagaggcacatcaaacagaggagatgatgtatgtctttatcaaacctggcggcagcgcaaaagatg

SEQ ID NO: 191622 - DNA, 103 bp, Artificial Sequence
  Synthetic Polynucleotide
taatacgactcactatagggtacttctatcaccttataaaaatgataaagaacagaggagactttatatgttttataagaacctggcggcagcgcaaaagatg

SEQ ID NO: 191623 - DNA, 103 bp, Artificial Sequence
  Synthetic Polynucleotide
taatacgactcactatagggcccgcgccgcctcgtccatgttgaggcggcaacagaggagagccgccatgacatggacgaacctggcggcagcgcaaaagatg

SEQ ID NO: 191624 - DNA, 103 bp, Artificial Sequence
  Synthetic Polynucleotide
taatacgactcactatagggctctaatgaatacttctatcaccttataaaaacagaggagatttataatgtgatagaagaacctggcggcagcgcaaaagatg

SEQ ID NO: 191625 - DNA, 103 bp, Artificial Sequence
  Synthetic Polynucleotide
taatacgactcactatagggccatcttctgctctaatgaatacttctatcaacagaggagagatagaatgattcattagaacctggcggcagcgcaaaagatg

SEQ ID NO: 191626 - DNA, 103 bp, Artificial Sequence
  Synthetic Polynucleotide
taatacgactcactatagggtctacaaaggccatcttctgctctaatgaaaacagaggagattcattatggcagaagataacctggcggcagcgcaaaagatg

SEQ ID NO: 191627 - DNA, 103 bp, Artificial Sequence
  Synthetic Polynucleotide
taatacgactcactatagggttaccacctctctacaaaggccatcttctgaacagaggagacagaagatggcctttgtaaacctggcggcagcgcaaaagatg

SEQ ID NO: 191628 - DNA, 103 bp, Artificial Sequence
  Synthetic Polynucleotide
taatacgactcactatagggttaaggtgttttaccacctctctacaaaggaacagaggagacctttgatgagaggtggtaacctggcggcagcgcaaaagatg

SEQ ID NO: 191629 - DNA, 103 bp, Artificial Sequence
  Synthetic Polynucleotide
taatacgactcactatagggttcaatctgattaaggtgttttaccacctcaacagaggagagaggtgatgaaacaccttaacctggcggcagcgcaaaagatg

SEQ ID NO: 191630 - DNA, 103 bp, Artificial Sequence
  Synthetic Polynucleotide
taatacgactcactatagggagatctgttcttcaatctgattaaggtgttaacagaggagaaacaccatgatcagattgaacctggcggcagcgcaaaagatg

SEQ ID NO: 191631 - DNA, 103 bp, Artificial Sequence
  Synthetic Polynucleotide
taatacgactcactatagggaaatgatctaagatctgttcttcaatctgaaacagaggagatcagatatgagaacagataacctggcggcagcgcaaaagatg

SEQ ID NO: 191632 - DNA, 103 bp, Artificial Sequence
  Synthetic Polynucleotide
taatacgactcactatagggtttccatgccaaatgatctaagatctgttcaacagaggagagaacagatgttagatcataacctggcggcagcgcaaaagatg

SEQ ID NO: 191633 - DNA, 103 bp, Artificial Sequence
  Synthetic Polynucleotide
taatacgactcactataggggagactctggtttccatgccaaatgatctaaacagaggagatagatcatgtggcatggaaacctggcggcagcgcaaaagatg

SEQ ID NO: 191634 - DNA, 103 bp, Artificial Sequence
  Synthetic Polynucleotide
taatacgactcactatagggcaggcctcggcccgcgccgcctcgtccatgaacagaggagacatggaatgggcggcgcgaacctggcggcagcgcaaaagatg

SEQ ID NO: 191635 - DNA, 103 bp, Artificial Sequence
  Synthetic Polynucleotide
taatacgactcactatagggtcccagagtggagactctggtttccatgccaacagaggagaggcatgatgaccagagtcaacctggcggcagcgcaaaagatg

SEQ ID NO: 191636 - DNA, 103 bp, Artificial Sequence
  Synthetic Polynucleotide
taatacgactcactatagggtctaattttttcccagagtggagactctggaacagaggagaccagagatgccactctggaacctggcggcagcgcaaaagatg

SEQ ID NO: 191637 - DNA, 103 bp, Artificial Sequence
  Synthetic Polynucleotide
taatacgactcactatagggtttcattgtctctaattttttcccagagtgaacagaggagacactctatgaaaaaattaaacctggcggcagcgcaaaagatg

SEQ ID NO: 191638 - DNA, 103 bp, Artificial Sequence
  Synthetic Polynucleotide
taatacgactcactatagggggaactctgttttcattgtctctaatttttaacagaggagaaaaaatatgagacaatgaaacctggcggcagcgcaaaagatg

SEQ ID NO: 191639 - DNA, 103 bp, Artificial Sequence
  Synthetic Polynucleotide
taatacgactcactatagggttcacatgtaggaactctgttttcattgtcaacagaggagagacaatatgaacagagttaacctggcggcagcgcaaaagatg

SEQ ID NO: 191640 - DNA, 103 bp, Artificial Sequence
  Synthetic Polynucleotide
taatacgactcactataggggcatgacctcttcacatgtaggaactctgtaacagaggagaacagagatgctacatgtgaacctggcggcagcgcaaaagatg

SEQ ID NO: 191641 - DNA, 103 bp, Artificial Sequence
  Synthetic Polynucleotide
taatacgactcactatagggttctgaggtggcatgacctcttcacatgtaaacagaggagatacatgatgagaggtcataacctggcggcagcgcaaaagatg

SEQ ID NO: 191642 - DNA, 103 bp, Artificial Sequence
  Synthetic Polynucleotide
taatacgactcactatagggcctttccaggttctgaggtggcatgacctcaacagaggagagaggtcatgccacctcagaacctggcggcagcgcaaaagatg

SEQ ID NO: 191643 - DNA, 103 bp, Artificial Sequence
  Synthetic Polynucleotide
taatacgactcactatagggtttcatctgccctttccaggttctgaggtgaacagaggagacacctcatgacctggaaaaacctggcggcagcgcaaaagatg

SEQ ID NO: 191644 - DNA, 103 bp, Artificial Sequence
  Synthetic Polynucleotide
taatacgactcactataggggcaatgcaaatttcatctgccctttccaggaacagaggagacctggaatgggcagatgaaacctggcggcagcgcaaaagatg

SEQ ID NO: 191645 - DNA, 103 bp, Artificial Sequence
  Synthetic Polynucleotide
taatacgactcactataggggtagctgtcccaggcctcggcccgcgccgcaacagaggagagcggcgatggccgaggccaacctggcggcagcgcaaaagatg

SEQ ID NO: 191646 - DNA, 103 bp, Artificial Sequence
  Synthetic Polynucleotide
taatacgactcactatagggaggggagccagcaatgcaaatttcatctgcaacagaggagagcagatatgatttgcattaacctggcggcagcgcaaaagatg

SEQ ID NO: 191647 - DNA, 103 bp, Artificial Sequence
  Synthetic Polynucleotide
taatacgactcactatagggtgggagtcaaaggggagccagcaatgcaaaaacagaggagatttgcaatgctggctcccaacctggcggcagcgcaaaagatg

SEQ ID NO: 191648 - DNA, 103 bp, Artificial Sequence
  Synthetic Polynucleotide
taatacgactcactataggggtcacccttctgggagtcaaaggggagccaaacagaggagatggctcatgtttgactccaacctggcggcagcgcaaaagatg

SEQ ID NO: 191649 - DNA, 103 bp, Artificial Sequence
  Synthetic Polynucleotide
taatacgactcactatagggacgaacttcagtcacccttctgggagtcaaaacagaggagattgactatgagaagggtgaacctggcggcagcgcaaaagatg

SEQ ID NO: 191650 - DNA, 103 bp, Artificial Sequence
  Synthetic Polynucleotide
taatacgactcactatagggcagtatcagcacgaacttcagtcacccttcaacagaggagagaagggatgctgaagttcaacctggcggcagcgcaaaagatg

SEQ ID NO: 191651 - DNA, 103 bp, Artificial Sequence
  Synthetic Polynucleotide
taatacgactcactatagggccaagtcctccagtatcagcacgaacttcaaacagaggagatgaagtatgtgctgatacaacctggcggcagcgcaaaagatg

SEQ ID NO: 191652 - DNA, 103 bp, Artificial Sequence
  Synthetic Polynucleotide
taatacgactcactatagggtatgctccttccaagtcctccagtatcagcaacagaggagagctgatatgggaggacttaacctggcggcagcgcaaaagatg

SEQ ID NO: 191653 - DNA, 103 bp, Artificial Sequence
  Synthetic Polynucleotide
taatacgactcactatagggttggagatgttatgctccttccaagtcctcaacagaggagagaggacatggaaggagcaaacctggcggcagcgcaaaagatg

SEQ ID NO: 191654 - DNA, 103 bp, Artificial Sequence
  Synthetic Polynucleotide
taatacgactcactatagggtataatgtggttggagatgttatgctccttaacagaggagaaaggagatgaacatctccaacctggcggcagcgcaaaagatg

SEQ ID NO: 191655 - DNA, 103 bp, Artificial Sequence
  Synthetic Polynucleotide
taatacgactcactataggggtacctatcgtataatgtggttggagatgtaacagaggagaacatctatgaccacattaaacctggcggcagcgcaaaagatg

SEQ ID NO: 191656 - DNA, 103 bp, Artificial Sequence
  Synthetic Polynucleotide
taatacgactcactataggggaggcgggggcggtggcgactggtcacctcaacagaggagagaggtgatgagtcgccacaacctggcggcagcgcaaaagatg

SEQ ID NO: 191657 - DNA, 103 bp, Artificial Sequence
  Synthetic Polynucleotide
taatacgactcactatagggtcatgctgcggtagctgtcccaggcctcggaacagaggagaccgaggatggggacagctaacctggcggcagcgcaaaagatg

SEQ ID NO: 191658 - DNA, 103 bp, Artificial Sequence
  Synthetic Polynucleotide
taatacgactcactataggggtggggagctgtacctatcgtataatgtggaacagaggagaccacatatgacgataggtaacctggcggcagcgcaaaagatg

SEQ ID NO: 191659 - DNA, 103 bp, Artificial Sequence
  Synthetic Polynucleotide
taatacgactcactataggggtgctggctggtggggagctgtacctatcgaacagaggagacgatagatgcagctccccaacctggcggcagcgcaaaagatg

SEQ ID NO: 191660 - DNA, 103 bp, Artificial Sequence
  Synthetic Polynucleotide
taatacgactcactatagggccttctggtagtgctggctggtggggagctaacagaggagaagctccatgccagccagcaacctggcggcagcgcaaaagatg

SEQ ID NO: 191661 - DNA, 103 bp, Artificial Sequence
  Synthetic Polynucleotide
taatacgactcactatagggcaaatagccgccttctggtagtgctggctgaacagaggagacagccaatgctaccagaaaacctggcggcagcgcaaaagatg

SEQ ID NO: 191662 - DNA, 103 bp, Artificial Sequence
  Synthetic Polynucleotide
taatacgactcactatagggtcattctcaacaaatagccgccttctggtaaacagaggagataccagatggcggctattaacctggcggcagcgcaaaagatg

SEQ ID NO: 191663 - DNA, 103 bp, Artificial Sequence
  Synthetic Polynucleotide
taatacgactcactatagggagaggggctatcattctcaacaaatagccgaacagaggagacggctaatggttgagaataacctggcggcagcgcaaaagatg

SEQ ID NO: 191664 - DNA, 103 bp, Artificial Sequence
  Synthetic Polynucleotide
taatacgactcactatagggtccctccatcagaggggctatcattctcaaaacagaggagattgagaatgatagcccctaacctggcggcagcgcaaaagatg

SEQ ID NO: 191665 - DNA, 103 bp, Artificial Sequence
  Synthetic Polynucleotide
taatacgactcactatagggcgcccaggcgtccctccatcagaggggctaaacagaggagatagcccatgtgatggaggaacctggcggcagcgcaaaagatg

SEQ ID NO: 191666 - DNA, 103 bp, Artificial Sequence
  Synthetic Polynucleotide
taatacgactcactatagggtgggggcatgcgcccaggcgtccctccatcaacagaggagagatggaatgacgcctgggaacctggcggcagcgcaaaagatg

SEQ ID NO: 191667 - DNA, 103 bp, Artificial Sequence
  Synthetic Polynucleotide
taatacgactcactatagggctaggggctgtgggggcatgcgcccaggcgaacagaggagacgcctgatggcatgccccaacctggcggcagcgcaaaagatg

SEQ ID NO: 191668 - DNA, 103 bp, Artificial Sequence
  Synthetic Polynucleotide
taatacgactcactatagggtagctttcgctcatgctgcggtagctgtccaacagaggagaggacagatgccgcagcataacctggcggcagcgcaaaagatg

SEQ ID NO: 191669 - DNA, 103 bp, Artificial Sequence
  Synthetic Polynucleotide
taatacgactcactatagggacagcattgactaggggctgtgggggcatgaacagaggagacatgccatgacagcccctaacctggcggcagcgcaaaagatg

SEQ ID NO: 191670 - DNA, 103 bp, Artificial Sequence
  Synthetic Polynucleotide
taatacgactcactatagggctgcacagggacagcattgactaggggctgaacagaggagacagcccatggtcaatgctaacctggcggcagcgcaaaagatg

SEQ ID NO: 191671 - DNA, 103 bp, Artificial Sequence
  Synthetic Polynucleotide
taatacgactcactatagggcagatacattctgcacagggacagcattgaaacagaggagatcaatgatgtccctgtgcaacctggcggcagcgcaaaagatg

SEQ ID NO: 191672 - DNA, 103 bp, Artificial Sequence
  Synthetic Polynucleotide
taatacgactcactatagggacagtctccccagatacattctgcacagggaacagaggagaccctgtatggaatgtatcaacctggcggcagcgcaaaagatg

SEQ ID NO: 191673 - DNA, 103 bp, Artificial Sequence
  Synthetic Polynucleotide
taatacgactcactatagggtgtgacagaaacagtctccccagatacattaacagaggagaaatgtaatgggggagactaacctggcggcagcgcaaaagatg

SEQ ID NO: 191674 - DNA, 103 bp, Artificial Sequence
  Synthetic Polynucleotide
taatacgactcactatagggcaggaactggtgtgacagaaacagtctcccaacagaggagagggagaatgtttctgtcaaacctggcggcagcgcaaaagatg

SEQ ID NO: 191675 - DNA, 103 bp, Artificial Sequence
  Synthetic Polynucleotide
taatacgactcactatagggaaagtctgtccaggaactggtgtgacagaaaacagaggagattctgtatgaccagttccaacctggcggcagcgcaaaagatg

SEQ ID NO: 191676 - DNA, 103 bp, Artificial Sequence
  Synthetic Polynucleotide
taatacgactcactatagggcatggtgaccaaagtctgtccaggaactggaacagaggagaccagttatgggacagactaacctggcggcagcgcaaaagatg

SEQ ID NO: 191677 - DNA, 103 bp, Artificial Sequence
  Synthetic Polynucleotide
taatacgactcactatagggtggcggttgccatggtgaccaaagtctgtcaacagaggagagacagaatgtggtcaccaaacctggcggcagcgcaaaagatg

SEQ ID NO: 191678 - DNA, 103 bp, Artificial Sequence
  Synthetic Polynucleotide
taatacgactcactataggggctgtgacagtggcggttgccatggtgaccaacagaggagaggtcacatgggcaaccgcaacctggcggcagcgcaaaagatg

SEQ ID NO: 191679 - DNA, 103 bp, Artificial Sequence
  Synthetic Polynucleotide
taatacgactcactatagggctccagcgtgtagctttcgctcatgctgcgaacagaggagacgcagcatgagcgaaagcaacctggcggcagcgcaaaagatg

SEQ ID NO: 191680 - DNA, 103 bp, Artificial Sequence
  Synthetic Polynucleotide
taatacgactcactatagggcccattgttggctgtgacagtggcggttgcaacagaggagagcaaccatgactgtcacaaacctggcggcagcgcaaaagatg

SEQ ID NO: 191681 - DNA, 103 bp, Artificial Sequence
  Synthetic Polynucleotide
taatacgactcactatagggttaccgtttgcccattgttggctgtgacagaacagaggagactgtcaatgccaacaatgaacctggcggcagcgcaaaagatg

SEQ ID NO: 191682 - DNA, 103 bp, Artificial Sequence
  Synthetic Polynucleotide
taatacgactcactatagggacaggaatggttaccgtttgcccattgttgaacagaggagacaacaaatggcaaacggtaacctggcggcagcgcaaaagatg

SEQ ID NO: 191683 - DNA, 103 bp, Artificial Sequence
  Synthetic Polynucleotide
taatacgactcactatagggaataccttgcacaggaatggttaccgtttgaacagaggagacaaacgatgaccattcctaacctggcggcagcgcaaaagatg

SEQ ID NO: 191684 - DNA, 103 bp, Artificial Sequence
  Synthetic Polynucleotide
taatacgactcactatagggtttcattggcaataccttgcacaggaatggaacagaggagaccattcatgtgcaaggtaaacctggcggcagcgcaaaagatg

SEQ ID NO: 191685 - DNA, 103 bp, Artificial Sequence
  Synthetic Polynucleotide
taatacgactcactatagggatccctccattttcattggcaataccttgcaacagaggagagcaaggatgtgccaatgaaacctggcggcagcgcaaaagatg

SEQ ID NO: 191686 - DNA, 103 bp, Artificial Sequence
  Synthetic Polynucleotide
taatacgactcactataggggaagaatgttatccctccattttcattggcaacagaggagagccaatatgaatggagggaacctggcggcagcgcaaaagatg

SEQ ID NO: 191687 - DNA, 103 bp, Artificial Sequence
  Synthetic Polynucleotide
taatacgactcactatagggcttggacagggaagaatgttatccctccataacagaggagaatggagatgtaacattctaacctggcggcagcgcaaaagatg

SEQ ID NO: 191688 - DNA, 103 bp, Artificial Sequence
  Synthetic Polynucleotide
taatacgactcactatagggccaacattgacttggacagggaagaatgttaacagaggagaaacattatgccctgtccaaacctggcggcagcgcaaaagatg

SEQ ID NO: 191689 - DNA, 103 bp, Artificial Sequence
  Synthetic Polynucleotide
taatacgactcactatagggtgcctgccccccaacattgacttggacaggaacagaggagacctgtcatggtcaatgttaacctggcggcagcgcaaaagatg

SEQ ID NO: 191690 - DNA, 103 bp, Artificial Sequence
  Synthetic Polynucleotide
taatacgactcactataggggatcatttccctccagcgtgtagctttcgcaacagaggagagcgaaaatgacacgctggaacctggcggcagcgcaaaagatg

SEQ ID NO: 191691 - DNA, 103 bp, Artificial Sequence
  Synthetic Polynucleotide
taatacgactcactatagggtcacagcttgtgcctgccccccaacattgaaacagaggagatcaatgatggggggcaggaacctggcggcagcgcaaaagatg

SEQ ID NO: 191692 - DNA, 103 bp, Artificial Sequence
  Synthetic Polynucleotide
taatacgactcactatagggatggagcctgtcacagcttgtgcctgccccaacagaggagaggggcaatgacaagctgtaacctggcggcagcgcaaaagatg

SEQ ID NO: 191693 - DNA, 103 bp, Artificial Sequence
  Synthetic Polynucleotide
taatacgactcactataggggaggggctggatggagcctgtcacagcttgaacagaggagacaagctatgacaggctccaacctggcggcagcgcaaaagatg

SEQ ID NO: 191694 - DNA, 103 bp, Artificial Sequence
  Synthetic Polynucleotide
taatacgactcactatagggcctgagcactgaggggctggatggagcctgaacagaggagacaggctatgtccagccccaacctggcggcagcgcaaaagatg

SEQ ID NO: 191695 - DNA, 103 bp, Artificial Sequence
  Synthetic Polynucleotide
taatacgactcactatagggccagccagggcctgagcactgaggggctggaacagaggagaccagccatgcagtgctcaaacctggcggcagcgcaaaagatg

SEQ ID NO: 191696 - DNA, 103 bp, Artificial Sequence
  Synthetic Polynucleotide
taatacgactcactataggggctcagacttccagccagggcctgagcactaacagaggagaagtgctatggccctggctaacctggcggcagcgcaaaagatg

SEQ ID NO: 191697 - DNA, 103 bp, Artificial Sequence
  Synthetic Polynucleotide
taatacgactcactatagggcctgttgagagctcagacttccagccagggaacagaggagaccctggatggaagtctgaaacctggcggcagcgcaaaagatg

SEQ ID NO: 191698 - DNA, 103 bp, Artificial Sequence
  Synthetic Polynucleotide
taatacgactcactataggggttcctgtcacctgttgagagctcagacttaacagaggagaaagtctatgctctcaacaaacctggcggcagcgcaaaagatg

SEQ ID NO: 191699 - DNA, 103 bp, Artificial Sequence
  Synthetic Polynucleotide
taatacgactcactatagggttgcaaagttgttcctgtcacctgttgagaaacagaggagatctcaaatggtgacaggaaacctggcggcagcgcaaaagatg

SEQ ID NO: 191700 - DNA, 103 bp, Artificial Sequence
  Synthetic Polynucleotide
taatacgactcactataggggaccagggacttgcaaagttgttcctgtcaaacagaggagatgacagatgcaactttgcaacctggcggcagcgcaaaagatg

SEQ ID NO: 191701 - DNA, 103 bp, Artificial Sequence
  Synthetic Polynucleotide
taatacgactcactatagggaaccaatgaagatcatttccctccagcgtgaacagaggagacacgctatggggaaatgaaacctggcggcagcgcaaaagatg

SEQ ID NO: 191702 - DNA, 103 bp, Artificial Sequence
  Synthetic Polynucleotide
taatacgactcactatagggatggccacttgaccagggacttgcaaagttaacagaggagaaactttatgagtccctggaacctggcggcagcgcaaaagatg

SEQ ID NO: 191703 - DNA, 103 bp, Artificial Sequence
  Synthetic Polynucleotide
taatacgactcactatagggaatctgttgaatggccacttgaccagggacaacagaggagagtccctatgcaagtggccaacctggcggcagcgcaaaagatg

SEQ ID NO: 191704 - DNA, 103 bp, Artificial Sequence
  Synthetic Polynucleotide
taatacgactcactatagggcacctggggaaatctgttgaatggccacttaacagaggagaaagtggatgttcaacagaaacctggcggcagcgcaaaagatg

SEQ ID NO: 191705 - DNA, 103 bp, Artificial Sequence
  Synthetic Polynucleotide
taatacgactcactatagggtgctgttggccacctggggaaatctgttgaaacagaggagatcaacaatgttccccaggaacctggcggcagcgcaaaagatg

SEQ ID NO: 191706 - DNA, 103 bp, Artificial Sequence
  Synthetic Polynucleotide
taatacgactcactataggggccttgcttctgctgttggccacctggggaaacagaggagatccccaatgggccaacagaacctggcggcagcgcaaaagatg

SEQ ID NO: 191707 - DNA, 103 bp, Artificial Sequence
  Synthetic Polynucleotide
taatacgactcactatagggttacagactggccttgcttctgctgttggcaacagaggagagccaacatgagaagcaagaacctggcggcagcgcaaaagatg

SEQ ID NO: 191708 - DNA, 103 bp, Artificial Sequence
  Synthetic Polynucleotide
taatacgactcactatagggctactgctggttacagactggccttgcttcaacagaggagagaagcaatgccagtctgtaacctggcggcagcgcaaaagatg

SEQ ID NO: 191709 - DNA, 103 bp, Artificial Sequence
  Synthetic Polynucleotide
taatacgactcactataggggggtctattactactgctggttacagactgaacagaggagacagtctatgaccagcagtaacctggcggcagcgcaaaagatg

SEQ ID NO: 191710 - DNA, 103 bp, Artificial Sequence
  Synthetic Polynucleotide
taatacgactcactatagggtggtcttcctgggtctattactactgctggaacagaggagaccagcaatggtaatagacaacctggcggcagcgcaaaagatg

SEQ ID NO: 191711 - DNA, 103 bp, Artificial Sequence
  Synthetic Polynucleotide
taatacgactcactataggggataaagagctggtcttcctgggtctattaaacagaggagataatagatgcaggaagacaacctggcggcagcgcaaaagatg

SEQ ID NO: 191712 - DNA, 103 bp, Artificial Sequence
  Synthetic Polynucleotide
taatacgactcactatagggggcacatgctaaccaatgaagatcatttccaacagaggagaggaaatatgcttcattggaacctggcggcagcgcaaaagatg

SEQ ID NO: 191713 - DNA, 103 bp, Artificial Sequence
  Synthetic Polynucleotide
taatacgactcactatagggaaagaaaagcgataaagagctggtcttcctaacagaggagaaggaagatgagctctttaaacctggcggcagcgcaaaagatg

SEQ ID NO: 191714 - DNA, 103 bp, Artificial Sequence
  Synthetic Polynucleotide
taatacgactcactatagggatacctttctaaagaaaagcgataaagagcaacagaggagagctcttatgcgcttttctaacctggcggcagcgcaaaagatg

SEQ ID NO: 191715 - DNA, 103 bp, Artificial Sequence
  Synthetic Polynucleotide
taatacgactcactataggggctaaatggtatacctttctaaagaaaagcaacagaggagagcttttatgtagaaaggtaacctggcggcagcgcaaaagatg

SEQ ID NO: 191716 - DNA, 103 bp, Artificial Sequence
  Synthetic Polynucleotide
taatacgactcactataggggcggacagctgctaaatggtatacctttctaacagaggagaagaaagatgtaccatttaaacctggcggcagcgcaaaagatg

SEQ ID NO: 191717 - DNA, 103 bp, Artificial Sequence
  Synthetic Polynucleotide
taatacgactcactataggggatcccgaaggcggacagctgctaaatggtaacagaggagaaccattatgcagctgtccaacctggcggcagcgcaaaagatg

SEQ ID NO: 191718 - DNA, 103 bp, Artificial Sequence
  Synthetic Polynucleotide
taatacgactcactatagggttggcacagagatcccgaaggcggacagctaacagaggagaagctgtatgccttcgggaaacctggcggcagcgcaaaagatg

SEQ ID NO: 191719 - DNA, 103 bp, Artificial Sequence
  Synthetic Polynucleotide
taatacgactcactatagggaatatctagtttggcacagagatcccgaagaacagaggagacttcggatgctctgtgccaacctggcggcagcgcaaaagatg

SEQ ID NO: 191720 - DNA, 103 bp, Artificial Sequence
  Synthetic Polynucleotide
taatacgactcactatagggattcatctgaaatatctagtttggcacagaaacagaggagatctgtgatgaactagataaacctggcggcagcgcaaaagatg

SEQ ID NO: 191721 - DNA, 103 bp, Artificial Sequence
  Synthetic Polynucleotide
taatacgactcactatagggtttttcctcaattcatctgaaatatctagtaacagaggagaactagaatgttcagatgaaacctggcggcagcgcaaaagatg

SEQ ID NO: 191722 - DNA, 103 bp, Artificial Sequence
  Synthetic Polynucleotide
taatacgactcactatagggggtccagatttttttcctcaattcatctgaaacagaggagatcagatatgttgaggaaaaacctggcggcagcgcaaaagatg

SEQ ID NO: 191723 - DNA, 103 bp, Artificial Sequence
  Synthetic Polynucleotide
taatacgactcactatagggccacatataaggcacatgctaaccaatgaaaacagaggagattcattatgtagcatgtgaacctggcggcagcgcaaaagatg

SEQ ID NO: 191724 - DNA, 103 bp, Artificial Sequence
  Synthetic Polynucleotide
taatacgactcactatagggattcaaagcaggtccagatttttttcctcaaacagaggagatgaggaatgaaatctggaaacctggcggcagcgcaaaagatg

SEQ ID NO: 191725 - DNA, 103 bp, Artificial Sequence
  Synthetic Polynucleotide
taatacgactcactatagggattatggagaattcaaagcaggtccagattaacagaggagaaatctgatgctgctttgaaacctggcggcagcgcaaaagatg

SEQ ID NO: 191726 - DNA, 103 bp, Artificial Sequence
  Synthetic Polynucleotide
taatacgactcactatagggaggacactgaattatggagaattcaaagcaaacagaggagatgctttatgttctccataaacctggcggcagcgcaaaagatg

SEQ ID NO: 191727 - DNA, 103 bp, Artificial Sequence
  Synthetic Polynucleotide
taatacgactcactatagggtcataagttcaggacactgaattatggagaaacagaggagatctccaatgttcagtgtcaacctggcggcagcgcaaaagatg

SEQ ID NO: 191728 - DNA, 103 bp, Artificial Sequence
  Synthetic Polynucleotide
taatacgactcactatagggtgtctgtccatcataagttcaggacactgaaacagaggagatcagtgatgtgaacttataacctggcggcagcgcaaaagatg

SEQ ID NO: 191729 - DNA, 103 bp, Artificial Sequence
  Synthetic Polynucleotide
taatacgactcactatagggctggtccagatgtctgtccatcataagttcaacagaggagagaacttatgatggacagaaacctggcggcagcgcaaaagatg

SEQ ID NO: 191730 - DNA, 103 bp, Artificial Sequence
  Synthetic Polynucleotide
taatacgactcactatagggacattaataactggtccagatgtctgtccaaacagaggagatggacaatgatctggaccaacctggcggcagcgcaaaagatg

SEQ ID NO: 191731 - DNA, 103 bp, Artificial Sequence
  Synthetic Polynucleotide
taatacgactcactatagggtaaatggcacacattaataactggtccagaaacagaggagatctggaatggttattaataacctggcggcagcgcaaaagatg

SEQ ID NO: 191732 - DNA, 103 bp, Artificial Sequence
  Synthetic Polynucleotide
taatacgactcactatagggtgccatcacataaatggcacacattaataaaacagaggagattattaatgtgtgccattaacctggcggcagcgcaaaagatg

SEQ ID NO: 191733 - DNA, 103 bp, Artificial Sequence
  Synthetic Polynucleotide
taatacgactcactatagggttgtgacctttgccatcacataaatggcacaacagaggagagtgccaatgatgtgatggaacctggcggcagcgcaaaagatg

SEQ ID NO: 191734 - DNA, 103 bp, Artificial Sequence
  Synthetic Polynucleotide
taatacgactcactatagggtttctgcaagccacatataaggcacatgctaacagaggagaagcatgatgcttatatgtaacctggcggcagcgcaaaagatg

SEQ ID NO: 191735 - DNA, 103 bp, Artificial Sequence
  Synthetic Polynucleotide
taatacgactcactatagggttatcttcttttgtgacctttgccatcacaaacagaggagatgtgatatgaaaggtcacaacctggcggcagcgcaaaagatg

SEQ ID NO: 191736 - DNA, 103 bp, Artificial Sequence
  Synthetic Polynucleotide
taatacgactcactatagggctggaaggacttatcttcttttgtgaccttaacagaggagaaaggtcatgaaagaagataacctggcggcagcgcaaaagatg

SEQ ID NO: 191737 - DNA, 103 bp, Artificial Sequence
  Synthetic Polynucleotide
taatacgactcactataggggcataatgttctggaaggacttatcttcttaacagaggagaaagaagatgagtccttccaacctggcggcagcgcaaaagatg

SEQ ID NO: 191738 - DNA, 103 bp, Artificial Sequence
  Synthetic Polynucleotide
taatacgactcactatagggctataacaacgcataatgttctggaaggacaacagaggagagtccttatggaacattataacctggcggcagcgcaaaagatg

SEQ ID NO: 191739 - DNA, 103 bp, Artificial Sequence
  Synthetic Polynucleotide
taatacgactcactatagggcggctgagtcctataacaacgcataatgttaacagaggagaaacattatgcgttgttataacctggcggcagcgcaaaagatg

SEQ ID NO: 191740 - DNA, 103 bp, Artificial Sequence
  Synthetic Polynucleotide
taatacgactcactatagggtccgggcctgcggctgagtcctataacaacaacagaggagagttgttatgggactcagcaacctggcggcagcgcaaaagatg

SEQ ID NO: 191741 - DNA, 103 bp, Artificial Sequence
  Synthetic Polynucleotide
taatacgactcactatagggtacacctggctccgggcctgcggctgagtcaacagaggagagactcaatggcaggcccgaacctggcggcagcgcaaaagatg

SEQ ID NO: 191742 - DNA, 103 bp, Artificial Sequence
  Synthetic Polynucleotide
taatacgactcactatagggaacacttctatacacctggctccgggcctgaacagaggagacaggccatgagccaggtgaacctggcggcagcgcaaaagatg

SEQ ID NO: 191743 - DNA, 103 bp, Artificial Sequence
  Synthetic Polynucleotide
taatacgactcactatagggcttttatcaaaacacttctatacacctggcaacagaggagagccaggatgatagaagtgaacctggcggcagcgcaaaagatg

SEQ ID NO: 191744 - DNA, 103 bp, Artificial Sequence
  Synthetic Polynucleotide
taatacgactcactatagggtttcttttcccttttatcaaaacacttctaaacagaggagatagaagatgtttgataaaaacctggcggcagcgcaaaagatg

SEQ ID NO: 191745 - DNA, 103 bp, Artificial Sequence
  Synthetic Polynucleotide
taatacgactcactatagggtggaacagattttctgcaagccacatataaaacagaggagattatatatggcttgcagaaacctggcggcagcgcaaaagatg

SEQ ID NO: 191746 - DNA, 103 bp, Artificial Sequence
  Synthetic Polynucleotide
taatacgactcactatagggatttcttctttttcttttcccttttatcaaaacagaggagattgataatggggaaaagaaacctggcggcagcgcaaaagatg

SEQ ID NO: 191747 - DNA, 103 bp, Artificial Sequence
  Synthetic Polynucleotide
taatacgactcactatagggtgctgccagaatttcttctttttcttttccaacagaggagaggaaaaatgaaagaagaaaacctggcggcagcgcaaaagatg

SEQ ID NO: 191748 - DNA, 103 bp, Artificial Sequence
  Synthetic Polynucleotide
taatacgactcactatagggctgctatcactgctgccagaatttcttcttaacagaggagaaagaagatgttctggcagaacctggcggcagcgcaaaagatg

SEQ ID NO: 191749 - DNA, 103 bp, Artificial Sequence
  Synthetic Polynucleotide
taatacgactcactatagggctgatggcttctgctatcactgctgccagaaacagaggagatctggcatgagtgatagcaacctggcggcagcgcaaaagatg

SEQ ID NO: 191750 - DNA, 103 bp, Artificial Sequence
  Synthetic Polynucleotide
taatacgactcactatagggttggagaattctgatggcttctgctatcacaacagaggagagtgataatggaagccatcaacctggcggcagcgcaaaagatg

SEQ ID NO: 191751 - DNA, 103 bp, Artificial Sequence
  Synthetic Polynucleotide
taatacgactcactatagggtttagttctgttggagaattctgatggcttaacagaggagaaagccaatggaattctccaacctggcggcagcgcaaaagatg

SEQ ID NO: 191752 - DNA, 103 bp, Artificial Sequence
  Synthetic Polynucleotide
taatacgactcactatagggtctatctttgtttagttctgttggagaattaacagaggagaaattctatgacagaactaaacctggcggcagcgcaaaagatg

SEQ ID NO: 191753 - DNA, 103 bp, Artificial Sequence
  Synthetic Polynucleotide
taatacgactcactatagggctctactggttctatctttgtttagttctgaacagaggagacagaacatgacaaagataaacctggcggcagcgcaaaagatg

SEQ ID NO: 191754 - DNA, 103 bp, Artificial Sequence
  Synthetic Polynucleotide
taatacgactcactatagggggactggagtctctactggttctatctttgaacagaggagacaaagaatgaaccagtagaacctggcggcagcgcaaaagatg

SEQ ID NO: 191755 - DNA, 103 bp, Artificial Sequence
  Synthetic Polynucleotide
taatacgactcactatagggcctcataactggactggagtctctactggtaacagaggagaaccagtatggactccagtaacctggcggcagcgcaaaagatg

SEQ ID NO: 191756 - DNA, 103 bp, Artificial Sequence
  Synthetic Polynucleotide
taatacgactcactatagggtgcttacagttggaacagattttctgcaagaacagaggagacttgcaatgaatctgttcaacctggcggcagcgcaaaagatg

SEQ ID NO: 191757 - DNA, 103 bp, Artificial Sequence
  Synthetic Polynucleotide
taatacgactcactatagggtgctgcttgacctcataactggactggagtaacagaggagaactccaatgcagttatgaaacctggcggcagcgcaaaagatg

SEQ ID NO: 191758 - DNA, 103 bp, Artificial Sequence
  Synthetic Polynucleotide
taatacgactcactatagggactggcaaggtgctgcttgacctcataactaacagaggagaagttatatggtcaagcagaacctggcggcagcgcaaaagatg

SEQ ID NO: 191759 - DNA, 103 bp, Artificial Sequence
  Synthetic Polynucleotide
taatacgactcactataggggggctgtggaactggcaaggtgctgcttgaaacagaggagatcaagcatgaccttgccaaacctggcggcagcgcaaaagatg

SEQ ID NO: 191760 - DNA, 103 bp, Artificial Sequence
  Synthetic Polynucleotide
taatacgactcactataggggagcactgctgggctgtggaactggcaaggaacagaggagaccttgcatgttccacagcaacctggcggcagcgcaaaagatg

SEQ ID NO: 191761 - DNA, 103 bp, Artificial Sequence
  Synthetic Polynucleotide
taatacgactcactatagggggtgtgggaggagcactgctgggctgtggaaacagaggagatccacaatgcagcagtgcaacctggcggcagcgcaaaagatg

SEQ ID NO: 191762 - DNA, 103 bp, Artificial Sequence
  Synthetic Polynucleotide
taatacgactcactataggggaggcgagtaggtgtgggaggagcactgctaacagaggagaagcagtatgcctcccacaaacctggcggcagcgcaaaagatg

SEQ ID NO: 191763 - DNA, 103 bp, Artificial Sequence
  Synthetic Polynucleotide
taatacgactcactatagggtggcacctgtgaggcgagtaggtgtgggagaacagaggagactcccaatgctactcgccaacctggcggcagcgcaaaagatg

SEQ ID NO: 191764 - DNA, 103 bp, Artificial Sequence
  Synthetic Polynucleotide
taatacgactcactatagggatgtcactgttggcacctgtgaggcgagtaaacagaggagatactcgatgcacaggtgcaacctggcggcagcgcaaaagatg

SEQ ID NO: 191765 - DNA, 103 bp, Artificial Sequence
  Synthetic Polynucleotide
taatacgactcactatagggctcttcttccatgtcactgttggcacctgtaacagaggagaacaggtatgaacagtgacaacctggcggcagcgcaaaagatg

SEQ ID NO: 191766 - DNA, 103 bp, Artificial Sequence
  Synthetic Polynucleotide
taatacgactcactatagggctcccctctcctcttcttccatgtcactgtaacagaggagaacagtgatgtggaagaagaacctggcggcagcgcaaaagatg

SEQ ID NO: 191767 - DNA, 103 bp, Artificial Sequence
  Synthetic Polynucleotide
taatacgactcactataggggccggagggggaggcgggggcggtggcgacaacagaggagagtcgccatggcccccgccaacctggcggcagcgcaaaagatg

SEQ ID NO: 191768 - DNA, 103 bp, Artificial Sequence
  Synthetic Polynucleotide
taatacgactcactatagggactgtccctttgcttacagttggaacagataacagaggagaatctgtatgaactgtaagaacctggcggcagcgcaaaagatg

SEQ ID NO: 191769 - DNA, 103 bp, Artificial Sequence
  Synthetic Polynucleotide
taatacgactcactatagggtgaatgaggtctcccctctcctcttcttccaacagaggagaggaagaatgggagaggggaacctggcggcagcgcaaaagatg

SEQ ID NO: 191770 - DNA, 103 bp, Artificial Sequence
  Synthetic Polynucleotide
taatacgactcactataggggttgtagaactgaatgaggtctcccctctcaacagaggagagagaggatggacctcattaacctggcggcagcgcaaaagatg

SEQ ID NO: 191771 - DNA, 103 bp, Artificial Sequence
  Synthetic Polynucleotide
taatacgactcactatagggtgtagatgttgttgtagaactgaatgaggtaacagaggagaacctcaatgagttctacaaacctggcggcagcgcaaaagatg

SEQ ID NO: 191772 - DNA, 103 bp, Artificial Sequence
  Synthetic Polynucleotide
taatacgactcactatagggatctgtttgatgtagatgttgttgtagaacaacagaggagagttctaatgcaacatctaaacctggcggcagcgcaaaagatg

SEQ ID NO: 191773 - DNA, 103 bp, Artificial Sequence
  Synthetic Polynucleotide
taatacgactcactatagggaaatgtcttaatctgtttgatgtagatgttaacagaggagaaacatcatgatcaaacagaacctggcggcagcgcaaaagatg

SEQ ID NO: 191774 - DNA, 103 bp, Artificial Sequence
  Synthetic Polynucleotide
taatacgactcactatagggacttcatggcaaatgtcttaatctgtttgaaacagaggagatcaaacatgttaagacataacctggcggcagcgcaaaagatg

SEQ ID NO: 191775 - DNA, 103 bp, Artificial Sequence
  Synthetic Polynucleotide
taatacgactcactataggggcctgtgagtacttcatggcaaatgtcttaaacagaggagataagacatgtgccatgaaaacctggcggcagcgcaaaagatg

SEQ ID NO: 191776 - DNA, 103 bp, Artificial Sequence
  Synthetic Polynucleotide
taatacgactcactatagggatccatatttgcctgtgagtacttcatggcaacagaggagagccatgatgtactcacagaacctggcggcagcgcaaaagatg

SEQ ID NO: 191777 - DNA, 103 bp, Artificial Sequence
  Synthetic Polynucleotide
taatacgactcactataggggtggaggagcatccatatttgcctgtgagtaacagaggagaactcacatgcaaatatggaacctggcggcagcgcaaaagatg

SEQ ID NO: 191778 - DNA, 103 bp, Artificial Sequence
  Synthetic Polynucleotide
taatacgactcactatagggtagggagagagtggaggagcatccatatttaacagaggagaaaatatatgtgctcctccaacctggcggcagcgcaaaagatg

SEQ ID NO: 191779 - DNA, 103 bp, Artificial Sequence
  Synthetic Polynucleotide
taatacgactcactataggggtttccttccactgtccctttgcttacagtaacagaggagaactgtaatgaaagggacaaacctggcggcagcgcaaaagatg

SEQ ID NO: 191780 - DNA, 103 bp, Artificial Sequence
  Synthetic Polynucleotide
taatacgactcactatagggtacaaatggatagggagagagtggaggagcaacagaggagagctcctatgctctctcccaacctggcggcagcgcaaaagatg

SEQ ID NO: 191781 - DNA, 103 bp, Artificial Sequence
  Synthetic Polynucleotide
taatacgactcactatagggagcctgttcttacaaatggatagggagagaaacagaggagatctctcatgatccatttgaacctggcggcagcgcaaaagatg

SEQ ID NO: 191782 - DNA, 103 bp, Artificial Sequence
  Synthetic Polynucleotide
taatacgactcactatagggcggcgaggggagcctgttcttacaaatggaaacagaggagatccattatgaagaacaggaacctggcggcagcgcaaaagatg

SEQ ID NO: 191783 - DNA, 103 bp, Artificial Sequence
  Synthetic Polynucleotide
taatacgactcactatagggcaactgtattcggcgaggggagcctgttctaacagaggagaagaacaatgtcccctcgcaacctggcggcagcgcaaaagatg

SEQ ID NO: 191784 - DNA, 103 bp, Artificial Sequence
  Synthetic Polynucleotide
taatacgactcactataggggattttgagacaactgtattcggcgaggggaacagaggagacccctcatggaatacagtaacctggcggcagcgcaaaagatg

SEQ ID NO: 191785 - DNA, 103 bp, Artificial Sequence
  Synthetic Polynucleotide
taatacgactcactatagggtagacaggatgattttgagacaactgtattaacagaggagaaatacaatggtctcaaaaaacctggcggcagcgcaaaagatg

SEQ ID NO: 191786 - DNA, 103 bp, Artificial Sequence
  Synthetic Polynucleotide
taatacgactcactatagggtggggaaatgtagacaggatgattttgagaaacagaggagatctcaaatgcatcctgtcaacctggcggcagcgcaaaagatg

SEQ ID NO: 191787 - DNA, 103 bp, Artificial Sequence
  Synthetic Polynucleotide
taatacgactcactatagggcatttttatgtggggaaatgtagacaggataacagaggagaatcctgatgacatttcccaacctggcggcagcgcaaaagatg

SEQ ID NO: 191788 - DNA, 103 bp, Artificial Sequence
  Synthetic Polynucleotide
taatacgactcactatagggagcattgtttcatttttatgtggggaaatgaacagaggagacatttcatgacataaaaaaacctggcggcagcgcaaaagatg

SEQ ID NO: 191789 - DNA, 103 bp, Artificial Sequence
  Synthetic Polynucleotide
taatacgactcactatagggtcgaggagaaagcattgtttcatttttatgaacagaggagacataaaatggaaacaatgaacctggcggcagcgcaaaagatg

SEQ ID NO: 191790 - DNA, 103 bp, Artificial Sequence
  Synthetic Polynucleotide
taatacgactcactatagggaagatacatagtttccttccactgtcccttaacagaggagaaagggaatgtggaaggaaaacctggcggcagcgcaaaagatg

SEQ ID NO: 191791 - DNA, 103 bp, Artificial Sequence
  Synthetic Polynucleotide
taatacgactcactatagggaaatcttttctcgaggagaaagcattgtttaacagaggagaaaacaaatgtttctcctcaacctggcggcagcgcaaaagatg

SEQ ID NO: 191792 - DNA, 103 bp, Artificial Sequence
  Synthetic Polynucleotide
taatacgactcactatagggaagtaatagaaaatcttttctcgaggagaaaacagaggagattctccatgagaaaagataacctggcggcagcgcaaaagatg

SEQ ID NO: 191793 - DNA, 103 bp, Artificial Sequence
  Synthetic Polynucleotide
taatacgactcactatagggactgttgctgaagtaatagaaaatcttttcaacagaggagagaaaagatgttctattacaacctggcggcagcgcaaaagatg

SEQ ID NO: 191794 - DNA, 103 bp, Artificial Sequence
  Synthetic Polynucleotide
taatacgactcactatagggtctttgaaggactgttgctgaagtaatagaaacagaggagatctattatgtcagcaacaaacctggcggcagcgcaaaagatg

SEQ ID NO: 191795 - DNA, 103 bp, Artificial Sequence
  Synthetic Polynucleotide
taatacgactcactatagggtctctcagtctctttgaaggactgttgctgaacagaggagacagcaaatgtccttcaaaaacctggcggcagcgcaaaagatg

SEQ ID NO: 191796 - DNA, 103 bp, Artificial Sequence
  Synthetic Polynucleotide
taatacgactcactatagggactattaatttctctcagtctctttgaaggaacagaggagaccttcaatgagactgagaaacctggcggcagcgcaaaagatg

SEQ ID NO: 191797 - DNA, 103 bp, Artificial Sequence
  Synthetic Polynucleotide
taatacgactcactatagggtgcgtatcatactattaatttctctcagtcaacagaggagagactgaatgaaattaataaacctggcggcagcgcaaaagatg

SEQ ID NO: 191798 - DNA, 103 bp, Artificial Sequence
  Synthetic Polynucleotide
taatacgactcactataggggtttctcctgtgcgtatcatactattaattaacagaggagaaattaaatgtatgatacgaacctggcggcagcgcaaaagatg

SEQ ID NO: 191799 - DNA, 103 bp, Artificial Sequence
  Synthetic Polynucleotide
taatacgactcactatagggtttagtaggagtttctcctgtgcgtatcataacagaggagaatgataatgacaggagaaaacctggcggcagcgcaaaagatg

SEQ ID NO: 191800 - DNA, 103 bp, Artificial Sequence
  Synthetic Polynucleotide
taatacgactcactatagggttcctctctttttagtaggagtttctcctgaacagaggagacaggagatgctcctactaaacctggcggcagcgcaaaagatg

SEQ ID NO: 191801 - DNA, 103 bp, Artificial Sequence
  Synthetic Polynucleotide
taatacgactcactatagggattctagttaaagatacatagtttccttccaacagaggagaggaaggatgctatgtatcaacctggcggcagcgcaaaagatg

SEQ ID NO: 191802 - DNA, 103 bp, Artificial Sequence
  Synthetic Polynucleotide
taatacgactcactatagggtccaaaagaattcctctctttttagtaggaaacagaggagatcctacatgaaagagaggaacctggcggcagcgcaaaagatg

SEQ ID NO: 191803 - DNA, 103 bp, Artificial Sequence
  Synthetic Polynucleotide
taatacgactcactatagggacttccatcttccaaaagaattcctctcttaacagaggagaaagagaatgattcttttgaacctggcggcagcgcaaaagatg

SEQ ID NO: 191804 - DNA, 103 bp, Artificial Sequence
  Synthetic Polynucleotide
taatacgactcactatagggcaggtgattcacttccatcttccaaaagaaaacagaggagattctttatgaagatggaaaacctggcggcagcgcaaaagatg

SEQ ID NO: 191805 - DNA, 103 bp, Artificial Sequence
  Synthetic Polynucleotide
taatacgactcactatagggattctttttgcaggtgattcacttccatctaacagaggagaagatggatgtgaatcaccaacctggcggcagcgcaaaagatg

SEQ ID NO: 191806 - DNA, 103 bp, Artificial Sequence
  Synthetic Polynucleotide
taatacgactcactatagggttctgggcaaattctttttgcaggtgattcaacagaggagagaatcaatggcaaaaagaaacctggcggcagcgcaaaagatg

SEQ ID NO: 191807 - DNA, 103 bp, Artificial Sequence
  Synthetic Polynucleotide
taatacgactcactatagggcagaatgattttctgggcaaattctttttgaacagaggagacaaaaaatgtttgcccagaacctggcggcagcgcaaaagatg

SEQ ID NO: 191808 - DNA, 103 bp, Artificial Sequence
  Synthetic Polynucleotide
taatacgactcactatagggcgtaataaggcagaatgattttctgggcaaaacagaggagattgcccatgaaatcattcaacctggcggcagcgcaaaagatg

SEQ ID NO: 191809 - DNA, 103 bp, Artificial Sequence
  Synthetic Polynucleotide
taatacgactcactatagggttggagacggcgtaataaggcagaatgattaacagaggagaaatcatatggccttattaaacctggcggcagcgcaaaagatg

SEQ ID NO: 191810 - DNA, 103 bp, Artificial Sequence
  Synthetic Polynucleotide
taatacgactcactatagggtagctacatcttggagacggcgtaataaggaacagaggagaccttatatggccgtctccaacctggcggcagcgcaaaagatg

SEQ ID NO: 191811 - DNA, 103 bp, Artificial Sequence
  Synthetic Polynucleotide
taatacgactcactatagggccacggtcattagctacatcttggagacggaacagaggagaccgtctatgagatgtagcaacctggcggcagcgcaaaagatg

SEQ ID NO: 191812 - DNA, 103 bp, Artificial Sequence
  Synthetic Polynucleotide
taatacgactcactatagggacatttcaggattctagttaaagatacataaacagaggagatatgtaatgttaactagaaacctggcggcagcgcaaaagatg

SEQ ID NO: 191813 - DNA, 103 bp, Artificial Sequence
  Synthetic Polynucleotide
taatacgactcactatagggtcagtgggaaccacggtcattagctacatcaacagaggagagatgtaatgaatgaccgtaacctggcggcagcgcaaaagatg

SEQ ID NO: 191814 - DNA, 103 bp, Artificial Sequence
  Synthetic Polynucleotide
taatacgactcactatagggtctgctctgaacatttcaggattctagttaaacagaggagataactaatgtcctgaaataacctggcggcagcgcaaaagatg

SEQ ID NO: 191815 - DNA, 103 bp, Artificial Sequence
  Synthetic Polynucleotide
taatacgactcactatagggtcgattaagctctgctctgaacatttcaggaacagaggagacctgaaatgttcagagcaaacctggcggcagcgcaaaagatg

SEQ ID NO: 191816 - DNA, 103 bp, Artificial Sequence
  Synthetic Polynucleotide
taatacgactcactatagggattaaaaaattcgattaagctctgctctgaaacagaggagatcagagatgagcttaatcaacctggcggcagcgcaaaagatg

SEQ ID NO: 191817 - DNA, 103 bp, Artificial Sequence
  Synthetic Polynucleotide
taatacgactcactatagggtcttcatcttattaaaaaattcgattaagcaacagaggagagcttaaatgaattttttaaacctggcggcagcgcaaaagatg

SEQ ID NO: 191818 - DNA, 103 bp, Artificial Sequence
  Synthetic Polynucleotide
taatacgactcactatagggtcttcccacttcttcatcttattaaaaaataacagaggagaatttttatgtaagatgaaaacctggcggcagcgcaaaagatg

SEQ ID NO: 191819 - DNA, 103 bp, Artificial Sequence
  Synthetic Polynucleotide
taatacgactcactatagggggctgccgccgccggagggggaggcgggggaacagaggagacccccgatgccccctccgaacctggcggcagcgcaaaagatg

SEQ ID NO: 191820 - DNA, 103 bp, Artificial Sequence
  Synthetic Polynucleotide
taatacgactcactatagggatttgccatgtcttcccacttcttcatcttaacagaggagaaagatgatgaagtgggaaaacctggcggcagcgcaaaagatg

SEQ ID NO: 191821 - DNA, 103 bp, Artificial Sequence
  Synthetic Polynucleotide
taatacgactcactataggggtgggggtagatttgccatgtcttcccactaacagaggagaagtgggatgacatggcaaaacctggcggcagcgcaaaagatg

SEQ ID NO: 191822 - DNA, 103 bp, Artificial Sequence
  Synthetic Polynucleotide
taatacgactcactatagggtctctgaaatgtgggggtagatttgccatgaacagaggagacatggcatgtctacccccaacctggcggcagcgcaaaagatg

SEQ ID NO: 191823 - DNA, 103 bp, Artificial Sequence
  Synthetic Polynucleotide
taatacgactcactatagggctcagtacgttctctgaaatgtgggggtagaacagaggagactacccatgcatttcagaaacctggcggcagcgcaaaagatg

SEQ ID NO: 191824 - DNA, 103 bp, Artificial Sequence
  Synthetic Polynucleotide
taatacgactcactatagggtttctaatctctcagtacgttctctgaaataacagaggagaatttcaatgaacgtactgaacctggcggcagcgcaaaagatg

SEQ ID NO: 191825 - DNA, 103 bp, Artificial Sequence
  Synthetic Polynucleotide
taatacgactcactataggggtgaagtttctttctaatctctcagtacgtaacagaggagaacgtacatggagattagaaacctggcggcagcgcaaaagatg

SEQ ID NO: 191826 - DNA, 103 bp, Artificial Sequence
  Synthetic Polynucleotide
taatacgactcactatagggagcagaaacagtgaagtttctttctaatctaacagaggagaagattaatgagaaacttcaacctggcggcagcgcaaaagatg

SEQ ID NO: 191827 - DNA, 103 bp, Artificial Sequence
  Synthetic Polynucleotide
taatacgactcactatagggtaaaaattacagcagaaacagtgaagtttcaacagaggagagaaactatgctgtttctgaacctggcggcagcgcaaaagatg

SEQ ID NO: 191828 - DNA, 103 bp, Artificial Sequence
  Synthetic Polynucleotide
taatacgactcactatagggtcatatttcttaaaaattacagcagaaacaaacagaggagatgtttcatgtgtaattttaacctggcggcagcgcaaaagatg

SEQ ID NO: 191829 - DNA, 103 bp, Artificial Sequence
  Synthetic Polynucleotide
taatacgactcactatagggaaaaatgggttcatatttcttaaaaattacaacagaggagagtaattatgaagaaatataacctggcggcagcgcaaaagatg

SEQ ID NO: 191830 - DNA, 103 bp, Artificial Sequence
  Synthetic Polynucleotide
taatacgactcactatagggcctcatccgaggctgccgccgccggaggggaacagaggagacccctcatgcggcggcagaacctggcggcagcgcaaaagatg

SEQ ID NO: 191831 - DNA, 103 bp, Artificial Sequence
  Synthetic Polynucleotide
taatacgactcactatagggagatgtcctgaaaaatgggttcatatttctaacagaggagaagaaatatgaacccatttaacctggcggcagcgcaaaagatg

SEQ ID NO: 191832 - DNA, 103 bp, Artificial Sequence
  Synthetic Polynucleotide
taatacgactcactataggggggtatttaaagatgtcctgaaaaatgggtaacagaggagaacccatatgtcaggacataacctggcggcagcgcaaaagatg

SEQ ID NO: 191833 - DNA, 103 bp, Artificial Sequence
  Synthetic Polynucleotide
taatacgactcactatagggctcctcttgagggtatttaaagatgtcctgaacagaggagacaggacatgtttaaatacaacctggcggcagcgcaaaagatg

SEQ ID NO: 191834 - DNA, 103 bp, Artificial Sequence
  Synthetic Polynucleotide
taatacgactcactataggggacgaggttgctcctcttgagggtatttaaaacagaggagattaaatatgctcaagaggaacctggcggcagcgcaaaagatg

SEQ ID NO: 191835 - DNA, 103 bp, Artificial Sequence
  Synthetic Polynucleotide
taatacgactcactatagggcctcgctgctgacgaggttgctcctcttgaaacagaggagatcaagaatggcaacctcgaacctggcggcagcgcaaaagatg

SEQ ID NO: 191836 - DNA, 103 bp, Artificial Sequence
  Synthetic Polynucleotide
taatacgactcactatagggctgtttccttcctcgctgctgacgaggttgaacagaggagacaacctatgcagcagcgaaacctggcggcagcgcaaaagatg

SEQ ID NO: 191837 - DNA, 103 bp, Artificial Sequence
  Synthetic Polynucleotide
taatacgactcactataggggctgtcgccgctgtttccttcctcgctgctaacagaggagaagcagcatggaaggaaacaacctggcggcagcgcaaaagatg

SEQ ID NO: 191838 - DNA, 103 bp, Artificial Sequence
  Synthetic Polynucleotide
taatacgactcactatagggacagtacagggctgtcgccgctgtttccttaacagaggagaaaggaaatggcggcgacaaacctggcggcagcgcaaaagatg

SEQ ID NO: 191839 - DNA, 103 bp, Artificial Sequence
  Synthetic Polynucleotide
taatacgactcactatagggaatttcagacacagtacagggctgtcgccgaacagaggagacggcgaatgccctgtactaacctggcggcagcgcaaaagatg

SEQ ID NO: 191840 - DNA, 103 bp, Artificial Sequence
  Synthetic Polynucleotide
taatacgactcactatagggaaaaatggaaaatttcagacacagtacaggaacagaggagacctgtaatgtgtctgaaaaacctggcggcagcgcaaaagatg

SEQ ID NO: 191841 - DNA, 103 bp, Artificial Sequence
  Synthetic Polynucleotide
taatacgactcactatagggtcctcctcctcctcatccgaggctgccgccaacagaggagaggcggcatgctcggatgaaacctggcggcagcgcaaaagatg

SEQ ID NO: 191842 - DNA, 103 bp, Artificial Sequence
  Synthetic Polynucleotide
taatacgactcactatagggagcacccaacaaaaatggaaaatttcagacaacagaggagagtctgaatgtttccatttaacctggcggcagcgcaaaagatg

SEQ ID NO: 191843 - DNA, 103 bp, Artificial Sequence
  Synthetic Polynucleotide
taatacgactcactatagggatatataaaaagcacccaacaaaaatggaaaacagaggagattccatatgtgttgggtgaacctggcggcagcgcaaaagatg

SEQ ID NO: 191844 - DNA, 103 bp, Artificial Sequence
  Synthetic Polynucleotide
taatacgactcactatagggtaccttttgcatatataaaaagcacccaacaacagaggagagttgggatgtttttatataacctggcggcagcgcaaaagatg

SEQ ID NO: 191845 - DNA, 103 bp, Artificial Sequence
  Synthetic Polynucleotide
taatacgactcactatagggatggggaaattaccttttgcatatataaaaaacagaggagattttatatgtgcaaaaggaacctggcggcagcgcaaaagatg

SEQ ID NO: 191846 - DNA, 103 bp, Artificial Sequence
  Synthetic Polynucleotide
taatacgactcactatagggatcactaatcatggggaaattaccttttgcaacagaggagagcaaaaatgaatttccccaacctggcggcagcgcaaaagatg

SEQ ID NO: 191847 - DNA, 103 bp, Artificial Sequence
  Synthetic Polynucleotide
taatacgactcactatagggtgaccaaatcatcactaatcatggggaaataacagaggagaatttccatgtgattagtgaacctggcggcagcgcaaaagatg

SEQ ID NO: 191848 - DNA, 103 bp, Artificial Sequence
  Synthetic Polynucleotide
taatacgactcactatagggtgataagaattgaccaaatcatcactaatcaacagaggagagattagatgtgatttggtaacctggcggcagcgcaaaagatg

SEQ ID NO: 191849 - DNA, 103 bp, Artificial Sequence
  Synthetic Polynucleotide
taatacgactcactatagggcagcagcaggtgataagaattgaccaaatcaacagaggagagatttgatgaattcttataacctggcggcagcgcaaaagatg

SEQ ID NO: 191850 - DNA, 103 bp, Artificial Sequence
  Synthetic Polynucleotide
taatacgactcactatagggccaaagcacacagcagcaggtgataagaataacagaggagaattcttatgacctgctgcaacctggcggcagcgcaaaagatg

SEQ ID NO: 191851 - DNA, 103 bp, Artificial Sequence
  Synthetic Polynucleotide
taatacgactcactatagggtaaactaagtccaaagcacacagcagcaggaacagaggagacctgctatggtgtgctttaacctggcggcagcgcaaaagatg

SEQ ID NO: 191852 - DNA, 103 bp, Artificial Sequence
  Synthetic Polynucleotide
taatacgactcactatagggctcgccgtcgtcctcctcctcctcatccgaaacagaggagatcggatatggaggaggagaacctggcggcagcgcaaaagatg

SEQ ID NO: 191853 - DNA, 103 bp, Artificial Sequence
  Synthetic Polynucleotide
taatacgactcactatagggtgcatttccataaactaagtccaaagcacaaacagaggagatgtgctatggacttagttaacctggcggcagcgcaaaagatg

SEQ ID NO: 191854 - DNA, 103 bp, Artificial Sequence
  Synthetic Polynucleotide
taatacgactcactatagggaacactgaagtgcatttccataaactaagtaacagaggagaacttagatgatggaaatgaacctggcggcagcgcaaaagatg

SEQ ID NO: 191855 - DNA, 103 bp, Artificial Sequence
  Synthetic Polynucleotide
taatacgactcactatagggttacgattagaacactgaagtgcatttccaaacagaggagatggaaaatgacttcagtgaacctggcggcagcgcaaaagatg

SEQ ID NO: 191856 - DNA, 103 bp, Artificial Sequence
  Synthetic Polynucleotide
taatacgactcactatagggcacaagttctttacgattagaacactgaagaacagaggagacttcagatgtctaatcgtaacctggcggcagcgcaaaagatg

SEQ ID NO: 191857 - DNA, 103 bp, Artificial Sequence
  Synthetic Polynucleotide
taatacgactcactatagggaattagggttcacaagttctttacgattagaacagaggagactaatcatgaagaacttgaacctggcggcagcgcaaaagatg

SEQ ID NO: 191858 - DNA, 103 bp, Artificial Sequence
  Synthetic Polynucleotide
taatacgactcactatagggaagcctttaaaattagggttcacaagttctaacagaggagaagaactatggaaccctaaaacctggcggcagcgcaaaagatg

SEQ ID NO: 191859 - DNA, 103 bp, Artificial Sequence
  Synthetic Polynucleotide
taatacgactcactatagggatcttcagataagcctttaaaattagggttaacagaggagaaaccctatgtttaaaggcaacctggcggcagcgcaaaagatg

SEQ ID NO: 191860 - DNA, 103 bp, Artificial Sequence
  Synthetic Polynucleotide
taatacgactcactatagggtagcatgaaaatcttcagataagcctttaaaacagaggagattaaagatgtatctgaagaacctggcggcagcgcaaaagatg

SEQ ID NO: 191861 - DNA, 103 bp, Artificial Sequence
  Synthetic Polynucleotide
taatacgactcactatagggttagaatctttagcatgaaaatcttcagataacagaggagaatctgaatgttttcatgcaacctggcggcagcgcaaaagatg

SEQ ID NO: 191862 - DNA, 103 bp, Artificial Sequence
  Synthetic Polynucleotide
taatacgactcactatagggagaggaaggtttagaatctttagcatgaaaaacagaggagatttcatatgaaagattctaacctggcggcagcgcaaaagatg

SEQ ID NO: 191863 - DNA, 103 bp, Artificial Sequence
  Synthetic Polynucleotide
taatacgactcactatagggcgtcttccgcctcgccgtcgtcctcctcctaacagaggagaaggaggatgacgacggcgaacctggcggcagcgcaaaagatg

SEQ ID NO: 191864 - DNA, 103 bp, Artificial Sequence
  Synthetic Polynucleotide
taatacgactcactatagggaaggggggtcagaggaaggtttagaatcttaacagaggagaaagattatgaaccttcctaacctggcggcagcgcaaaagatg

SEQ ID NO: 191865 - DNA, 103 bp, Artificial Sequence
  Synthetic Polynucleotide
taatacgactcactatagggtcaatgatacaaggggggtcagaggaaggtaacagaggagaaccttcatgtgaccccccaacctggcggcagcgcaaaagatg

SEQ ID NO: 191866 - DNA, 103 bp, Artificial Sequence
  Synthetic Polynucleotide
taatacgactcactatagggacacagtttctcaatgatacaaggggggtcaacagaggagagaccccatgtgtatcattaacctggcggcagcgcaaaagatg

SEQ ID NO: 191867 - DNA, 103 bp, Artificial Sequence
  Synthetic Polynucleotide
taatacgactcactatagggcatgtaaggaacacagtttctcaatgatacaacagaggagagtatcaatgagaaactgtaacctggcggcagcgcaaaagatg

SEQ ID NO: 191868 - DNA, 103 bp, Artificial Sequence
  Synthetic Polynucleotide
taatacgactcactatagggactaggccatcatgtaaggaacacagtttcaacagaggagagaaactatgttccttacaaacctggcggcagcgcaaaagatg

SEQ ID NO: 191869 - DNA, 103 bp, Artificial Sequence
  Synthetic Polynucleotide
taatacgactcactatagggtgcttccaaaactaggccatcatgtaaggaaacagaggagatccttaatggatggcctaaacctggcggcagcgcaaaagatg

SEQ ID NO: 191870 - DNA, 103 bp, Artificial Sequence
  Synthetic Polynucleotide
taatacgactcactatagggttatcccctttgcttccaaaactaggccataacagaggagaatggccatgttttggaagaacctggcggcagcgcaaaagatg

SEQ ID NO: 191871 - DNA, 103 bp, Artificial Sequence
  Synthetic Polynucleotide
taatacgactcactatagggaaatgttcctttatcccctttgcttccaaaaacagaggagatttggaatgaaaggggataacctggcggcagcgcaaaagatg

SEQ ID NO: 191872 - DNA, 103 bp, Artificial Sequence
  Synthetic Polynucleotide
taatacgactcactataggggggtttccagaaatgttcctttatccccttaacagaggagaaaggggatgaaggaacataacctggcggcagcgcaaaagatg

SEQ ID NO: 191873 - DNA, 103 bp, Artificial Sequence
  Synthetic Polynucleotide
taatacgactcactatagggtcctaatatagggtttccagaaatgttcctaacagaggagaaggaacatgtctggaaacaacctggcggcagcgcaaaagatg

SEQ ID NO: 191874 - DNA, 103 bp, Artificial Sequence
  Synthetic Polynucleotide
taatacgactcactatagggggcggcgcggcgtcttccgcctcgccgtcgaacagaggagacgacggatgggcggaagaaacctggcggcagcgcaaaagatg

SEQ ID NO: 191875 - DNA, 103 bp, Artificial Sequence
  Synthetic Polynucleotide
taatacgactcactatagggtcataaagtttcctaatatagggtttccagaacagaggagactggaaatgctatattagaacctggcggcagcgcaaaagatg

SEQ ID NO: 191876 - DNA, 103 bp, Artificial Sequence
  Synthetic Polynucleotide
taatacgactcactataggggagctttttttcataaagtttcctaatataaacagaggagatatattatgaaactttataacctggcggcagcgcaaaagatg

SEQ ID NO: 191877 - DNA, 103 bp, Artificial Sequence
  Synthetic Polynucleotide
taatacgactcactatagggttcccttaaggagctttttttcataaagttaacagaggagaaactttatgaaaaaaagcaacctggcggcagcgcaaaagatg

SEQ ID NO: 191878 - DNA, 103 bp, Artificial Sequence
  Synthetic Polynucleotide
taatacgactcactatagggttttcttcttttcccttaaggagcttttttaacagaggagaaaaaaaatgccttaagggaacctggcggcagcgcaaaagatg

SEQ ID NO: 191879 - DNA, 103 bp, Artificial Sequence
  Synthetic Polynucleotide
taatacgactcactatagggcccagtgagattttcttcttttcccttaagaacagaggagacttaagatgaaagaagaaaacctggcggcagcgcaaaagatg

SEQ ID NO: 191880 - DNA, 103 bp, Artificial Sequence
  Synthetic Polynucleotide
taatacgactcactataggggttctagaaacccagtgagattttcttcttaacagaggagaaagaagatgatctcactgaacctggcggcagcgcaaaagatg

SEQ ID NO: 191881 - DNA, 103 bp, Artificial Sequence
  Synthetic Polynucleotide
taatacgactcactatagggaagttcccaggttctagaaacccagtgagaaacagaggagatctcacatggtttctagaaacctggcggcagcgcaaaagatg

SEQ ID NO: 191882 - DNA, 103 bp, Artificial Sequence
  Synthetic Polynucleotide
taatacgactcactatagggactctctccaaagttcccaggttctagaaaaacagaggagatttctaatgcctgggaacaacctggcggcagcgcaaaagatg

SEQ ID NO: 191883 - DNA, 103 bp, Artificial Sequence
  Synthetic Polynucleotide
taatacgactcactatagggtggctttaaaactctctccaaagttcccagaacagaggagactgggaatgttggagagaaacctggcggcagcgcaaaagatg

SEQ ID NO: 191884 - DNA, 103 bp, Artificial Sequence
  Synthetic Polynucleotide
taatacgactcactataggggccttattgatggctttaaaactctctccaaacagaggagatggagaatgttttaaagcaacctggcggcagcgcaaaagatg

SEQ ID NO: 191885 - DNA, 103 bp, Artificial Sequence
  Synthetic Polynucleotide
taatacgactcactataggggagctttcctgggcgatctgcttcaaccataacagaggagaatggttatggcagatcgcaacctggcggcagcgcaaaagatg

SEQ ID NO: 191886 - DNA, 103 bp, Artificial Sequence
  Synthetic Polynucleotide
taatacgactcactatagggcatcaagagtacttccactattcgtccataaacagaggagatatggaatgatagtggaaaacctggcggcagcgcaaaagatg

SEQ ID NO: 191887 - DNA, 103 bp, Artificial Sequence
  Synthetic Polynucleotide
taatacgactcactatagggatcacgaccacttgagtagagatcacttcgaacagaggagacgaagtatgctctactcaaacctggcggcagcgcaaaagatg

SEQ ID NO: 191888 - DNA, 103 bp, Artificial Sequence
  Synthetic Polynucleotide
taatacgactcactatagggtgccaacccgatcacgaccacttgagtagaaacagaggagatctactatggtggtcgtgaacctggcggcagcgcaaaagatg

SEQ ID NO: 191889 - DNA, 103 bp, Artificial Sequence
  Synthetic Polynucleotide
taatacgactcactatagggctttcttgtctgccaacccgatcacgaccaaacagaggagatggtcgatgtcgggttggaacctggcggcagcgcaaaagatg

SEQ ID NO: 191890 - DNA, 103 bp, Artificial Sequence
  Synthetic Polynucleotide
taatacgactcactataggggggaagccctctttcttgtctgccaacccgaacagaggagacgggttatgagacaagaaaacctggcggcagcgcaaaagatg

SEQ ID NO: 191891 - DNA, 103 bp, Artificial Sequence
  Synthetic Polynucleotide
taatacgactcactatagggccatagaagggggaagccctctttcttgtcaacagaggagagacaagatggagggcttcaacctggcggcagcgcaaaagatg

SEQ ID NO: 191892 - DNA, 103 bp, Artificial Sequence
  Synthetic Polynucleotide
taatacgactcactatagggtaccccctttccatagaagggggaagccctaacagaggagaagggctatgcccttctataacctggcggcagcgcaaaagatg

SEQ ID NO: 191893 - DNA, 103 bp, Artificial Sequence
  Synthetic Polynucleotide
taatacgactcactatagggtggaggagggtaccccctttccatagaaggaacagaggagaccttctatggaaagggggaacctggcggcagcgcaaaagatg

SEQ ID NO: 191894 - DNA, 103 bp, Artificial Sequence
  Synthetic Polynucleotide
taatacgactcactatagggaggaatcacgtggaggagggtaccccctttaacagaggagaaaagggatgaccctcctcaacctggcggcagcgcaaaagatg

SEQ ID NO: 191895 - DNA, 103 bp, Artificial Sequence
  Synthetic Polynucleotide
taatacgactcactataggggaactgctgtaggaatcacgtggaggagggaacagaggagaccctccatgacgtgattcaacctggcggcagcgcaaaagatg

SEQ ID NO: 191896 - DNA, 103 bp, Artificial Sequence
  Synthetic Polynucleotide
taatacgactcactatagggtccgcggcttgaactgctgtaggaatcacgaacagaggagacgtgatatgtacagcagtaacctggcggcagcgcaaaagatg

SEQ ID NO: 191897 - DNA, 103 bp, Artificial Sequence
  Synthetic Polynucleotide
taatacgactcactatagggcacggtctttcatcaagagtacttccactaaacagaggagatagtggatgtactcttgaaacctggcggcagcgcaaaagatg

SEQ ID NO: 191898 - DNA, 103 bp, Artificial Sequence
  Synthetic Polynucleotide
taatacgactcactatagggctcttggtgctccgcggcttgaactgctgtaacagaggagaacagcaatgcaagccgcgaacctggcggcagcgcaaaagatg

SEQ ID NO: 191899 - DNA, 103 bp, Artificial Sequence
  Synthetic Polynucleotide
taatacgactcactatagggcggccaccacctcttggtgctccgcggcttaacagaggagaaagccgatgagcaccaagaacctggcggcagcgcaaaagatg

SEQ ID NO: 191900 - DNA, 103 bp, Artificial Sequence
  Synthetic Polynucleotide
taatacgactcactataggggcttcctccacggccaccacctcttggtgcaacagaggagagcaccaatgggtggtggcaacctggcggcagcgcaaaagatg

SEQ ID NO: 191901 - DNA, 103 bp, Artificial Sequence
  Synthetic Polynucleotide
taatacgactcactatagggtatcagatcggcttcctccacggccaccacaacagaggagagtggtgatggtggaggaaaacctggcggcagcgcaaaagatg

SEQ ID NO: 191902 - DNA, 103 bp, Artificial Sequence
  Synthetic Polynucleotide
taatacgactcactatagggcctccccctctatcagatcggcttcctccaaacagaggagatggaggatgccgatctgaaacctggcggcagcgcaaaagatg

SEQ ID NO: 191903 - DNA, 103 bp, Artificial Sequence
  Synthetic Polynucleotide
taatacgactcactatagggtctgcttctgcctccccctctatcagatcgaacagaggagacgatctatgagagggggaaacctggcggcagcgcaaaagatg

SEQ ID NO: 191904 - DNA, 103 bp, Artificial Sequence
  Synthetic Polynucleotide
taatacgactcactatagggttgttggtttcacggtctttcatcaagagtaacagaggagaactcttatggaaagaccgaacctggcggcagcgcaaaagatg

SEQ ID NO: 191905 - DNA, 103 bp, Artificial Sequence
  Synthetic Polynucleotide
taatacgactcactatagggtcctcttgatttgttggtttcacggtctttaacagaggagaaaagacatggaaaccaacaacctggcggcagcgcaaaagatg

SEQ ID NO: 191906 - DNA, 103 bp, Artificial Sequence
  Synthetic Polynucleotide
taatacgactcactatagggcaaaagcaaatcctcttgatttgttggtttaacagaggagaaaaccaatgaatcaagagaacctggcggcagcgcaaaagatg

SEQ ID NO: 191907 - DNA, 103 bp, Artificial Sequence
  Synthetic Polynucleotide
taatacgactcactatagggtcaaaggtgacaaaagcaaatcctcttgataacagaggagaatcaagatgatttgctttaacctggcggcagcgcaaaagatg

SEQ ID NO: 191908 - DNA, 103 bp, Artificial Sequence
  Synthetic Polynucleotide
taatacgactcactatagggtgctgggctttcaaaggtgacaaaagcaaaaacagaggagatttgctatggtcacctttaacctggcggcagcgcaaaagatg

SEQ ID NO: 191909 - DNA, 103 bp, Artificial Sequence
  Synthetic Polynucleotide
taatacgactcactatagggccttagcgtctgctgggctttcaaaggtgaaacagaggagatcacctatgaaagcccagaacctggcggcagcgcaaaagatg

SEQ ID NO: 191910 - DNA, 103 bp, Artificial Sequence
  Synthetic Polynucleotide
taatacgactcactatagggctggctgcatccttagcgtctgctgggcttaacagaggagaaagcccatgagacgctaaaacctggcggcagcgcaaaagatg

SEQ ID NO: 191911 - DNA, 103 bp, Artificial Sequence
  Synthetic Polynucleotide
taatacgactcactatagggattcatgtctctggctgcatccttagcgtcaacagaggagagacgctatggatgcagccaacctggcggcagcgcaaaagatg

SEQ ID NO: 191912 - DNA, 103 bp, Artificial Sequence
  Synthetic Polynucleotide
taatacgactcactatagggcaccaatgaagagctttcctgggcgatctgaacagaggagacagatcatgcaggaaagcaacctggcggcagcgcaaaagatg

SEQ ID NO: 191913 - DNA, 103 bp, Artificial Sequence
  Synthetic Polynucleotide
taatacgactcactatagggatgactttccattcatgtctctggctgcataacagaggagaatgcagatggagacatgaaacctggcggcagcgcaaaagatg

SEQ ID NO: 191914 - DNA, 103 bp, Artificial Sequence
  Synthetic Polynucleotide
taatacgactcactatagggtttccatctaatgactttccattcatgtctaacagaggagaagacatatgtggaaagtcaacctggcggcagcgcaaaagatg

SEQ ID NO: 191915 - DNA, 103 bp, Artificial Sequence
  Synthetic Polynucleotide
taatacgactcactatagggcttgatggcttttccatctaatgactttccaacagaggagaggaaagatgttagatggaaacctggcggcagcgcaaaagatg

SEQ ID NO: 191916 - DNA, 103 bp, Artificial Sequence
  Synthetic Polynucleotide
taatacgactcactatagggcttgttccaccttgatggcttttccatctaaacagaggagatagatgatgaagccatcaaacctggcggcagcgcaaaagatg

SEQ ID NO: 191917 - DNA, 103 bp, Artificial Sequence
  Synthetic Polynucleotide
taatacgactcactatagggggtttggtggcttgttccaccttgatggctaacagaggagaagccatatgggtggaacaaacctggcggcagcgcaaaagatg

SEQ ID NO: 191918 - DNA, 103 bp, Artificial Sequence
  Synthetic Polynucleotide
taatacgactcactatagggttcaaatgatggtttggtggcttgttccacaacagaggagagtggaaatggccaccaaaaacctggcggcagcgcaaaagatg

SEQ ID NO: 191919 - DNA, 103 bp, Artificial Sequence
  Synthetic Polynucleotide
taatacgactcactataggggtctaccactttcaaatgatggtttggtggaacagaggagaccaccaatgcatcatttgaacctggcggcagcgcaaaagatg

SEQ ID NO: 191920 - DNA, 103 bp, Artificial Sequence
  Synthetic Polynucleotide
taatacgactcactatagggggcggtccacgtctaccactttcaaatgataacagaggagaatcattatgaagtggtagaacctggcggcagcgcaaaagatg

SEQ ID NO: 191921 - DNA, 103 bp, Artificial Sequence
  Synthetic Polynucleotide
taatacgactcactatagggtggaggtggaggcggtccacgtctaccactaacagaggagaagtggtatgcgtggaccgaacctggcggcagcgcaaaagatg

SEQ ID NO: 191922 - DNA, 103 bp, Artificial Sequence
  Synthetic Polynucleotide
taatacgactcactatagggctctacttcttggaggtggaggcggtccacaacagaggagagtggacatgctccacctcaacctggcggcagcgcaaaagatg

SEQ ID NO: 191923 - DNA, 103 bp, Artificial Sequence
  Synthetic Polynucleotide
taatacgactcactataggggtattaagcccaccaatgaagagctttcctaacagaggagaaggaaaatgcttcattggaacctggcggcagcgcaaaagatg

SEQ ID NO: 191924 - DNA, 103 bp, Artificial Sequence
  Synthetic Polynucleotide
taatacgactcactatagggcttggagggcctctacttcttggaggtggaaacagaggagatccaccatgaagaagtagaacctggcggcagcgcaaaagatg

SEQ ID NO: 191925 - DNA, 103 bp, Artificial Sequence
  Synthetic Polynucleotide
taatacgactcactatagggtctaagacctcttggagggcctctacttctaacagaggagaagaagtatgggccctccaaacctggcggcagcgcaaaagatg

SEQ ID NO: 191926 - DNA, 103 bp, Artificial Sequence
  Synthetic Polynucleotide
taatacgactcactatagggctcttccacctctaagacctcttggagggcaacagaggagagccctcatggaggtcttaaacctggcggcagcgcaaaagatg

SEQ ID NO: 191927 - DNA, 103 bp, Artificial Sequence
  Synthetic Polynucleotide
taatacgactcactatagggccacttcctcctcttccacctctaagacctaacagaggagaaggtctatgaggtggaagaacctggcggcagcgcaaaagatg

SEQ ID NO: 191928 - DNA, 103 bp, Artificial Sequence
  Synthetic Polynucleotide
taatacgactcactatagggcctggttcctccacttcctcctcttccaccaacagaggagaggtggaatgggaggaagtaacctggcggcagcgcaaaagatg

SEQ ID NO: 191929 - DNA, 103 bp, Artificial Sequence
  Synthetic Polynucleotide
taatacgactcactatagggagggaggtcccctggttcctccacttcctcaacagaggagagaggaaatggaggaaccaaacctggcggcagcgcaaaagatg

SEQ ID NO: 191930 - DNA, 103 bp, Artificial Sequence
  Synthetic Polynucleotide
taatacgactcactatagggcctccccgtgagggaggtcccctggttcctaacagaggagaaggaacatggggacctccaacctggcggcagcgcaaaagatg

SEQ ID NO: 191931 - DNA, 103 bp, Artificial Sequence
  Synthetic Polynucleotide
taatacgactcactatagggatccatgtgtcctccccgtgagggaggtccaacagaggagaggacctatgtcacggggaaacctggcggcagcgcaaaagatg

SEQ ID NO: 191932 - DNA, 103 bp, Artificial Sequence
  Synthetic Polynucleotide
taatacgactcactatagggatccaccgtcatccatgtgtcctccccgtgaacagaggagacacgggatggacacatggaacctggcggcagcgcaaaagatg

SEQ ID NO: 191933 - DNA, 103 bp, Artificial Sequence
  Synthetic Polynucleotide
taatacgactcactatagggttcatggaatatccaccgtcatccatgtgtaacagaggagaacacatatgtgacggtggaacctggcggcagcgcaaaagatg

SEQ ID NO: 191934 - DNA, 103 bp, Artificial Sequence
  Synthetic Polynucleotide
taatacgactcactatagggatttgtttccgtattaagcccaccaatgaaaacagaggagattcattatggggcttaataacctggcggcagcgcaaaagatg

SEQ ID NO: 191935 - DNA, 103 bp, Artificial Sequence
  Synthetic Polynucleotide
taatacgactcactatagggcatgttaaaattcatggaatatccaccgtcaacagaggagagacggtatgtattccatgaacctggcggcagcgcaaaagatg

SEQ ID NO: 191936 - DNA, 103 bp, Artificial Sequence
  Synthetic Polynucleotide
taatacgactcactatagggtggaagaactcatgttaaaattcatggaataacagaggagaattccaatgattttaacaaacctggcggcagcgcaaaagatg

SEQ ID NO: 191937 - DNA, 103 bp, Artificial Sequence
  Synthetic Polynucleotide
taatacgactcactatagggagtggtcccctggaagaactcatgttaaaaaacagaggagattttaaatggagttcttcaacctggcggcagcgcaaaagatg

SEQ ID NO: 191938 - DNA, 103 bp, Artificial Sequence
  Synthetic Polynucleotide
taatacgactcactatagggttttactgggagtggtcccctggaagaactaacagaggagaagttctatgaggggaccaaacctggcggcagcgcaaaagatg

SEQ ID NO: 191939 - DNA, 103 bp, Artificial Sequence
  Synthetic Polynucleotide
taatacgactcactataggggtggtcctctttttactgggagtggtccccaacagaggagaggggacatgtcccagtaaaacctggcggcagcgcaaaagatg

SEQ ID NO: 191940 - DNA, 103 bp, Artificial Sequence
  Synthetic Polynucleotide
taatacgactcactatagggcttcttggtggtggtcctctttttactgggaacagaggagacccagtatgaagaggaccaacctggcggcagcgcaaaagatg

SEQ ID NO: 191941 - DNA, 103 bp, Artificial Sequence
  Synthetic Polynucleotide
taatacgactcactatagggaggacccccacttcttggtggtggtcctctaacagaggagaagaggaatgccaccaagaaacctggcggcagcgcaaaagatg

SEQ ID NO: 191942 - DNA, 103 bp, Artificial Sequence
  Synthetic Polynucleotide
taatacgactcactatagggtcttaggaggaggacccccacttcttggtgaacagaggagacaccaaatggtgggggtcaacctggcggcagcgcaaaagatg

SEQ ID NO: 191943 - DNA, 103 bp, Artificial Sequence
  Synthetic Polynucleotide
taatacgactcactatagggggtgcagatctcttaggaggaggacccccaaacagaggagatgggggatgtcctcctaaaacctggcggcagcgcaaaagatg

SEQ ID NO: 191944 - DNA, 103 bp, Artificial Sequence
  Synthetic Polynucleotide
taatacgactcactatagggtggtcctgaaggtgcagatctcttaggaggaacagaggagacctcctatgagatctgcaaacctggcggcagcgcaaaagatg

SEQ ID NO: 191945 - DNA, 103 bp, Artificial Sequence
  Synthetic Polynucleotide
taatacgactcactataggggagctttctcatttgtttccgtattaagccaacagaggagaggcttaatgcggaaacaaaacctggcggcagcgcaaaagatg

SEQ ID NO: 191946 - DNA, 103 bp, Artificial Sequence
  Synthetic Polynucleotide
taatacgactcactatagggtactgcgaactggtcctgaaggtgcagatcaacagaggagagatctgatgcttcaggacaacctggcggcagcgcaaaagatg

SEQ ID NO: 191947 - DNA, 103 bp, Artificial Sequence
  Synthetic Polynucleotide
taatacgactcactatagggattccactgctactgcgaactggtcctgaaaacagaggagattcaggatgagttcgcagaacctggcggcagcgcaaaagatg

SEQ ID NO: 191948 - DNA, 103 bp, Artificial Sequence
  Synthetic Polynucleotide
taatacgactcactatagggtcttcctcccattccactgctactgcgaacaacagaggagagttcgcatgagcagtggaaacctggcggcagcgcaaaagatg

SEQ ID NO: 191949 - DNA, 103 bp, Artificial Sequence
  Synthetic Polynucleotide
taatacgactcactatagggatacaggagctcttcctcccattccactgcaacagaggagagcagtgatgtgggaggaaaacctggcggcagcgcaaaagatg

SEQ ID NO: 191950 - DNA, 103 bp, Artificial Sequence
  Synthetic Polynucleotide
taatacgactcactatagggcttccacgtgatacaggagctcttcctcccaacagaggagagggaggatgagctcctgtaacctggcggcagcgcaaaagatg

SEQ ID NO: 191951 - DNA, 103 bp, Artificial Sequence
  Synthetic Polynucleotide
taatacgactcactatagggataactatctcttccacgtgatacaggagcaacagaggagagctcctatgtcacgtggaaacctggcggcagcgcaaaagatg

SEQ ID NO: 191952 - DNA, 103 bp, Artificial Sequence
  Synthetic Polynucleotide
taatacgactcactataggggtggacctccataactatctcttccacgtgaacagaggagacacgtgatggagatagttaacctggcggcagcgcaaaagatg

SEQ ID NO: 191953 - DNA, 103 bp, Artificial Sequence
  Synthetic Polynucleotide
taatacgactcactatagggtcccttcgaggtggacctccataactatctaacagaggagaagatagatgtggaggtccaacctggcggcagcgcaaaagatg

SEQ ID NO: 191954 - DNA, 103 bp, Artificial Sequence
  Synthetic Polynucleotide
taatacgactcactataggggggcagcggttcccttcgaggtggacctccaacagaggagaggaggtatgcctcgaaggaacctggcggcagcgcaaaagatg

SEQ ID NO: 191955 - DNA, 103 bp, Artificial Sequence
  Synthetic Polynucleotide
taatacgactcactatagggctctacgagagggcagcggttcccttcgagaacagaggagactcgaaatgaaccgctgcaacctggcggcagcgcaaaagatg

SEQ ID NO: 191956 - DNA, 103 bp, Artificial Sequence
  Synthetic Polynucleotide
taatacgactcactatagggactgcttcaagagctttctcatttgtttccaacagaggagaggaaacatgtgagaaagcaacctggcggcagcgcaaaagatg

SEQ ID NO: 191957 - DNA, 103 bp, Artificial Sequence
  Synthetic Polynucleotide
taatacgactcactatagggaaataaacatctctacgagagggcagcggtaacagaggagaaccgctatgctctcgtagaacctggcggcagcgcaaaagatg

SEQ ID NO: 191958 - DNA, 103 bp, Artificial Sequence
  Synthetic Polynucleotide
taatacgactcactatagggtcttggggacaaataaacatctctacgagaaacagaggagatctcgtatggatgtttataacctggcggcagcgcaaaagatg

SEQ ID NO: 191959 - DNA, 103 bp, Artificial Sequence
  Synthetic Polynucleotide
taatacgactcactatagggacccatcatctcttggggacaaataaacataacagaggagaatgtttatgtgtccccaaaacctggcggcagcgcaaaagatg

SEQ ID NO: 191960 - DNA, 103 bp, Artificial Sequence
  Synthetic Polynucleotide
taatacgactcactatagggttagtagaatacccatcatctcttggggacaacagaggagagtccccatgagatgatggaacctggcggcagcgcaaaagatg

SEQ ID NO: 191961 - DNA, 103 bp, Artificial Sequence
  Synthetic Polynucleotide
taatacgactcactatagggatagctgtctttagtagaatacccatcatcaacagaggagagatgatatgtattctactaacctggcggcagcgcaaaagatg

SEQ ID NO: 191962 - DNA, 103 bp, Artificial Sequence
  Synthetic Polynucleotide
taatacgactcactatagggctctgcttgaatagctgtctttagtagaataacagaggagaattctaatgaagacagctaacctggcggcagcgcaaaagatg

SEQ ID NO: 191963 - DNA, 103 bp, Artificial Sequence
  Synthetic Polynucleotide
taatacgactcactatagggcttgggtaatctctgcttgaatagctgtctaacagaggagaagacagatgttcaagcagaacctggcggcagcgcaaaagatg

SEQ ID NO: 191964 - DNA, 103 bp, Artificial Sequence
  Synthetic Polynucleotide
taatacgactcactatagggatcacgagaacttgggtaatctctgcttgaaacagaggagatcaagcatggattacccaaacctggcggcagcgcaaaagatg

SEQ ID NO: 191965 - DNA, 103 bp, Artificial Sequence
  Synthetic Polynucleotide
taatacgactcactatagggaatctctagtatcacgagaacttgggtaataacagaggagaattaccatggttctcgtgaacctggcggcagcgcaaaagatg

SEQ ID NO: 191966 - DNA, 103 bp, Artificial Sequence
  Synthetic Polynucleotide
taatacgactcactatagggggtggtgcataatctctagtatcacgagaaaacagaggagattctcgatgtactagagaaacctggcggcagcgcaaaagatg

SEQ ID NO: 191967 - DNA, 103 bp, Artificial Sequence
  Synthetic Polynucleotide
taatacgactcactatagggtttgccaaatactgcttcaagagctttctcaacagaggagagagaaaatgcttgaagcaaacctggcggcagcgcaaaagatg

SEQ ID NO: 191968 - DNA, 103 bp, Artificial Sequence
  Synthetic Polynucleotide
taatacgactcactatagggatctcgtggtggtggtgcataatctctagtaacagaggagaactagaatgtatgcaccaaacctggcggcagcgcaaaagatg

SEQ ID NO: 191969 - DNA, 103 bp, Artificial Sequence
  Synthetic Polynucleotide
taatacgactcactatagggggtaagtataatctcgtggtggtggtgcataacagaggagaatgcacatgcaccacgagaacctggcggcagcgcaaaagatg

SEQ ID NO: 191970 - DNA, 103 bp, Artificial Sequence
  Synthetic Polynucleotide
taatacgactcactatagggccataatcacggtaagtataatctcgtggtaacagaggagaaccacgatgttatacttaaacctggcggcagcgcaaaagatg

SEQ ID NO: 191971 - DNA, 103 bp, Artificial Sequence
  Synthetic Polynucleotide
taatacgactcactatagggactggaatgaccataatcacggtaagtataaacagaggagatatactatgcgtgattataacctggcggcagcgcaaaagatg

SEQ ID NO: 191972 - DNA, 103 bp, Artificial Sequence
  Synthetic Polynucleotide
taatacgactcactatagggcatcacgtgaactggaatgaccataatcacaacagaggagagtgattatggtcattccaaacctggcggcagcgcaaaagatg

SEQ ID NO: 191973 - DNA, 103 bp, Artificial Sequence
  Synthetic Polynucleotide
taatacgactcactataggggatggatagtcatcacgtgaactggaatgaaacagaggagatcattcatgttcacgtgaaacctggcggcagcgcaaaagatg

SEQ ID NO: 191974 - DNA, 103 bp, Artificial Sequence
  Synthetic Polynucleotide
taatacgactcactatagggatatcctcttgatggatagtcatcacgtgaaacagaggagatcacgtatggactatccaaacctggcggcagcgcaaaagatg

SEQ ID NO: 191975 - DNA, 103 bp, Artificial Sequence
  Synthetic Polynucleotide
taatacgactcactatagggctctatcgctatatcctcttgatggatagtaacagaggagaactatcatgcaagaggataacctggcggcagcgcaaaagatg

SEQ ID NO: 191976 - DNA, 103 bp, Artificial Sequence
  Synthetic Polynucleotide
taatacgactcactatagggccatatccatctctatcgctatatcctcttaacagaggagaaagaggatgtagcgatagaacctggcggcagcgcaaaagatg

SEQ ID NO: 191977 - DNA, 103 bp, Artificial Sequence
  Synthetic Polynucleotide
taatacgactcactatagggacgatcacgaccatatccatctctatcgctaacagaggagaagcgatatggatggatataacctggcggcagcgcaaaagatg

SEQ ID NO: 191978 - DNA, 103 bp, Artificial Sequence
  Synthetic Polynucleotide
taatacgactcactatagggttcgtccatatttgccaaatactgcttcaaaacagaggagattgaagatgtatttggcaaacctggcggcagcgcaaaagatg

SEQ ID NO: 191979 - DNA, 103 bp, Artificial Sequence
  Synthetic Polynucleotide
taatacgactcactatagggctgaatagtcacgatcacgaccatatccataacagaggagaatggatatggtcgtgatcaacctggcggcagcgcaaaagatg

SEQ ID NO: 191980 - DNA, 103 bp, Artificial Sequence
  Synthetic Polynucleotide
taatacgactcactatagggcttggatgatctgaatagtcacgatcacgaaacagaggagatcgtgaatgtgactattcaacctggcggcagcgcaaaagatg

SEQ ID NO: 191981 - DNA, 103 bp, Artificial Sequence
  Synthetic Polynucleotide
taatacgactcactatagggggaacctccacttggatgatctgaatagtcaacagaggagagactatatggatcatccaaacctggcggcagcgcaaaagatg

SEQ ID NO: 191982 - DNA, 103 bp, Artificial Sequence
  Synthetic Polynucleotide
taatacgactcactatagggaatctctgtaggaacctccacttggatgataacagaggagaatcatcatggtggaggttaacctggcggcagcgcaaaagatg

SEQ ID NO: 191983 - DNA, 103 bp, Artificial Sequence
  Synthetic Polynucleotide
taatacgactcactatagggctctcatatgaatctctgtaggaacctccaaacagaggagatggaggatgctacagagaaacctggcggcagcgcaaaagatg

SEQ ID NO: 191984 - DNA, 103 bp, Artificial Sequence
  Synthetic Polynucleotide
taatacgactcactataggggttaccataactctcatatgaatctctgtaaacagaggagatacagaatgtcatatgagaacctggcggcagcgcaaaagatg

SEQ ID NO: 191985 - DNA, 103 bp, Artificial Sequence
  Synthetic Polynucleotide
taatacgactcactatagggcactacgtgagttaccataactctcatatgaacagaggagacatatgatggttatggtaaacctggcggcagcgcaaaagatg

SEQ ID NO: 191986 - DNA, 103 bp, Artificial Sequence
  Synthetic Polynucleotide
taatacgactcactataggggtaggtggagcactacgtgagttaccataaaacagaggagattatggatgctcacgtagaacctggcggcagcgcaaaagatg

SEQ ID NO: 191987 - DNA, 103 bp, Artificial Sequence
  Synthetic Polynucleotide
taatacgactcactataggggggccctcgtgtaggtggagcactacgtgaaacagaggagatcacgtatggctccacctaacctggcggcagcgcaaaagatg

SEQ ID NO: 191988 - DNA, 103 bp, Artificial Sequence
  Synthetic Polynucleotide
taatacgactcactatagggaagatggcgggggccctcgtgtaggtggagaacagaggagactccacatgcacgagggcaacctggcggcagcgcaaaagatg

SEQ ID NO: 191989 - DNA, 103 bp, Artificial Sequence
  Synthetic Polynucleotide
taatacgactcactatagggacttccactattcgtccatatttgccaaataacagaggagaatttggatgatatggacgaacctggcggcagcgcaaaagatg

SEQ ID NO: 191990 - DNA, 103 bp, Artificial Sequence
  Synthetic Polynucleotide
taatacgactcactatagggcttccaccataagatggcgggggccctcgtaacagaggagaacgaggatgcccgccatcaacctggcggcagcgcaaaagatg

SEQ ID NO: 191991 - DNA, 103 bp, Artificial Sequence
  Synthetic Polynucleotide
taatacgactcactatagggatagcgactgcttccaccataagatggcggaacagaggagaccgccaatgtatggtggaaacctggcggcagcgcaaaagatg

SEQ ID NO: 191992 - DNA, 103 bp, Artificial Sequence
  Synthetic Polynucleotide
taatacgactcactatagggtgtaatcatcatagcgactgcttccaccataacagaggagaatggtgatggcagtcgctaacctggcggcagcgcaaaagatg

SEQ ID NO: 191993 - DNA, 103 bp, Artificial Sequence
  Synthetic Polynucleotide
taatacgactcactatagggcgtgagctgctgtaatcatcatagcgactgaacagaggagacagtcgatgtgatgattaaacctggcggcagcgcaaaagatg

SEQ ID NO: 191994 - DNA, 103 bp, Artificial Sequence
  Synthetic Polynucleotide
taatacgactcactatagggatatccgtcacgtgagctgctgtaatcatcaacagaggagagatgatatgagcagctcaaacctggcggcagcgcaaaagatg

SEQ ID NO: 191995 - DNA, 103 bp, Artificial Sequence
  Synthetic Polynucleotide
taatacgactcactataggggacttccaccatatccgtcacgtgagctgcaacagaggagagcagctatggtgacggataacctggcggcagcgcaaaagatg

SEQ ID NO: 191996 - DNA, 103 bp, Artificial Sequence
  Synthetic Polynucleotide
taatacgactcactatagggtaactgtctcgacttccaccatatccgtcaaacagaggagatgacggatgtggtggaagaacctggcggcagcgcaaaagatg

SEQ ID NO: 191997 - DNA, 103 bp, Artificial Sequence
  Synthetic Polynucleotide
taatacgactcactataggggctgcttgagtaactgtctcgacttccaccaacagaggagaggtggaatgcgagacagtaacctggcggcagcgcaaaagatg

SEQ ID NO: 191998 - DNA, 103 bp, Artificial Sequence
  Synthetic Polynucleotide
taatacgactcactataggggatcacttcggctgcttgagtaactgtctcaacagaggagagagacaatgactcaagcaaacctggcggcagcgcaaaagatg

SEQ ID NO: 191999 - DNA, 103 bp, Artificial Sequence
  Synthetic Polynucleotide
taatacgactcactatagggcttgagtagagatcacttcggctgcttgagaacagaggagactcaagatgccgaagtgaaacctggcggcagcgcaaaagatg

SEQ ID NO: 192000 - DNA, 103 bp, Artificial Sequence
  Synthetic Polynucleotide
taatacgactcactatagggctccgcgggcgagccctccgtgtggtccataacagaggagaatggacatgacggagggcaacctggcggcagcgcaaaagatg

SEQ ID NO: 192001 - DNA, 103 bp, Artificial Sequence
  Synthetic Polynucleotide
taatacgactcactatagggtaaataatttcgcatagcttccctagtaagaacagaggagacttactatggaagctatgaacctggcggcagcgcaaaagatg

SEQ ID NO: 192002 - DNA, 103 bp, Artificial Sequence
  Synthetic Polynucleotide
taatacgactcactatagggaaatgtatactctgccttatctgtgctaataacagaggagaattagcatggataaggcaaacctggcggcagcgcaaaagatg

SEQ ID NO: 192003 - DNA, 103 bp, Artificial Sequence
  Synthetic Polynucleotide
taatacgactcactatagggttccctcataaaatgtatactctgccttataacagaggagaataaggatgagtatacataacctggcggcagcgcaaaagatg

SEQ ID NO: 192004 - DNA, 103 bp, Artificial Sequence
  Synthetic Polynucleotide
taatacgactcactatagggacagggcccattccctcataaaatgtatacaacagaggagagtatacatgttatgagggaacctggcggcagcgcaaaagatg

SEQ ID NO: 192005 - DNA, 103 bp, Artificial Sequence
  Synthetic Polynucleotide
taatacgactcactatagggtggggcaaggacagggcccattccctcataaacagaggagatatgagatgatgggccctaacctggcggcagcgcaaaagatg

SEQ ID NO: 192006 - DNA, 103 bp, Artificial Sequence
  Synthetic Polynucleotide
taatacgactcactatagggcaggagtgactggggcaaggacagggcccaaacagaggagatgggccatgtccttgcccaacctggcggcagcgcaaaagatg

SEQ ID NO: 192007 - DNA, 103 bp, Artificial Sequence
  Synthetic Polynucleotide
taatacgactcactatagggaccacaggcacaggagtgactggggcaaggaacagaggagaccttgcatgagtcactccaacctggcggcagcgcaaaagatg

SEQ ID NO: 192008 - DNA, 103 bp, Artificial Sequence
  Synthetic Polynucleotide
taatacgactcactatagggaaggctctctaccacaggcacaggagtgacaacagaggagagtcactatggtgcctgtgaacctggcggcagcgcaaaagatg

SEQ ID NO: 192009 - DNA, 103 bp, Artificial Sequence
  Synthetic Polynucleotide
taatacgactcactatagggcattcaactgaaggctctctaccacaggcaaacagaggagatgcctgatgtagagagccaacctggcggcagcgcaaaagatg

SEQ ID NO: 192010 - DNA, 103 bp, Artificial Sequence
  Synthetic Polynucleotide
taatacgactcactatagggtccccaccgccattcaactgaaggctctctaacagaggagaagagagatgtcagttgaaaacctggcggcagcgcaaaagatg

SEQ ID NO: 192011 - DNA, 103 bp, Artificial Sequence
  Synthetic Polynucleotide
taatacgactcactatagggcattgctacgtccccaccgccattcaactgaacagaggagacagttgatgggcggtgggaacctggcggcagcgcaaaagatg

SEQ ID NO: 192012 - DNA, 103 bp, Artificial Sequence
  Synthetic Polynucleotide
taatacgactcactatagggctcgctcttttaaataatttcgcatagcttaacagaggagaaagctaatggaaattattaacctggcggcagcgcaaaagatg

SEQ ID NO: 192013 - DNA, 103 bp, Artificial Sequence
  Synthetic Polynucleotide
taatacgactcactatagggtaagttcaagcattgctacgtccccaccgcaacagaggagagcggtgatgacgtagcaaaacctggcggcagcgcaaaagatg

SEQ ID NO: 192014 - DNA, 103 bp, Artificial Sequence
  Synthetic Polynucleotide
taatacgactcactatagggttctgtcctgtaagttcaagcattgctacgaacagaggagacgtagcatggcttgaactaacctggcggcagcgcaaaagatg

SEQ ID NO: 192015 - DNA, 103 bp, Artificial Sequence
  Synthetic Polynucleotide
taatacgactcactatagggtggagtgaaattctgtcctgtaagttcaagaacagaggagacttgaaatgacaggacagaacctggcggcagcgcaaaagatg

SEQ ID NO: 192016 - DNA, 103 bp, Artificial Sequence
  Synthetic Polynucleotide
taatacgactcactatagggctcgtaaatttggagtgaaattctgtcctgaacagaggagacaggacatgatttcactcaacctggcggcagcgcaaaagatg

SEQ ID NO: 192017 - DNA, 103 bp, Artificial Sequence
  Synthetic Polynucleotide
taatacgactcactatagggccaaaccacactcgtaaatttggagtgaaaaacagaggagatttcacatgaaatttacgaacctggcggcagcgcaaaagatg

SEQ ID NO: 192018 - DNA, 103 bp, Artificial Sequence
  Synthetic Polynucleotide
taatacgactcactatagggttctacatccccaaaccacactcgtaaattaacagaggagaaatttaatggtgtggtttaacctggcggcagcgcaaaagatg

SEQ ID NO: 192019 - DNA, 103 bp, Artificial Sequence
  Synthetic Polynucleotide
taatacgactcactatagggtagtttcagcttctacatccccaaaccacaaacagaggagatgtggtatggggatgtagaacctggcggcagcgcaaaagatg

SEQ ID NO: 192020 - DNA, 103 bp, Artificial Sequence
  Synthetic Polynucleotide
taatacgactcactatagggcacctgtacatagtttcagcttctacatccaacagaggagaggatgtatgagctgaaacaacctggcggcagcgcaaaagatg

SEQ ID NO: 192021 - DNA, 103 bp, Artificial Sequence
  Synthetic Polynucleotide
taatacgactcactatagggactctctccacacctgtacatagtttcagcaacagaggagagctgaaatgatgtacaggaacctggcggcagcgcaaaagatg

SEQ ID NO: 192022 - DNA, 103 bp, Artificial Sequence
  Synthetic Polynucleotide
taatacgactcactatagggcacagagcatactctctccacacctgtacaaacagaggagatgtacaatggtggagagaaacctggcggcagcgcaaaagatg

SEQ ID NO: 192023 - DNA, 103 bp, Artificial Sequence
  Synthetic Polynucleotide
taatacgactcactataggggtttgatcccctcgctcttttaaataatttaacagaggagaaaattaatgaaaagagcgaacctggcggcagcgcaaaagatg

SEQ ID NO: 192024 - DNA, 103 bp, Artificial Sequence
  Synthetic Polynucleotide
taatacgactcactatagggtctgggacgacacagagcatactctctccaaacagaggagatggagaatgtatgctctgaacctggcggcagcgcaaaagatg

SEQ ID NO: 192025 - DNA, 103 bp, Artificial Sequence
  Synthetic Polynucleotide
taatacgactcactatagggtgcagaaatgtctgggacgacacagagcataacagaggagaatgctcatggtcgtcccaaacctggcggcagcgcaaaagatg

SEQ ID NO: 192026 - DNA, 103 bp, Artificial Sequence
  Synthetic Polynucleotide
taatacgactcactatagggcttctcggaatgcagaaatgtctgggacgaaacagaggagatcgtccatgacatttctgaacctggcggcagcgcaaaagatg

SEQ ID NO: 192027 - DNA, 103 bp, Artificial Sequence
  Synthetic Polynucleotide
taatacgactcactatagggcatctccaaccttctcggaatgcagaaatgaacagaggagacatttcatgattccgagaaacctggcggcagcgcaaaagatg

SEQ ID NO: 192028 - DNA, 103 bp, Artificial Sequence
  Synthetic Polynucleotide
taatacgactcactatagggttgccggacccatctccaaccttctcggaaaacagaggagattccgaatgggttggagaaacctggcggcagcgcaaaagatg

SEQ ID NO: 192029 - DNA, 103 bp, Artificial Sequence
  Synthetic Polynucleotide
taatacgactcactatagggcctggactggttgccggacccatctccaacaacagaggagagttggaatggggtccggcaacctggcggcagcgcaaaagatg

SEQ ID NO: 192030 - DNA, 103 bp, Artificial Sequence
  Synthetic Polynucleotide
taatacgactcactataggggttactggaacctggactggttgccggaccaacagaggagaggtccgatgaccagtccaaacctggcggcagcgcaaaagatg

SEQ ID NO: 192031 - DNA, 103 bp, Artificial Sequence
  Synthetic Polynucleotide
taatacgactcactatagggtcggaccaaagttactggaacctggactggaacagaggagaccagtcatggttccagtaaacctggcggcagcgcaaaagatg

SEQ ID NO: 192032 - DNA, 103 bp, Artificial Sequence
  Synthetic Polynucleotide
taatacgactcactatagggttccatcatttcggaccaaagttactggaaaacagaggagattccagatgctttggtccaacctggcggcagcgcaaaagatg

SEQ ID NO: 192033 - DNA, 103 bp, Artificial Sequence
  Synthetic Polynucleotide
taatacgactcactataggggaataaatgattccatcatttcggaccaaaaacagaggagatttggtatgaaatgatggaacctggcggcagcgcaaaagatg

SEQ ID NO: 192034 - DNA, 103 bp, Artificial Sequence
  Synthetic Polynucleotide
taatacgactcactatagggaataagtactgtttgatcccctcgctctttaacagaggagaaaagagatgggggatcaaaacctggcggcagcgcaaaagatg

SEQ ID NO: 192035 - DNA, 103 bp, Artificial Sequence
  Synthetic Polynucleotide
taatacgactcactatagggaaggctggtggaataaatgattccatcattaacagaggagaaatgatatgatcatttataacctggcggcagcgcaaaagatg

SEQ ID NO: 192036 - DNA, 103 bp, Artificial Sequence
  Synthetic Polynucleotide
taatacgactcactatagggaggtaaaggtaaggctggtggaataaatgaaacagaggagatcatttatgccaccagccaacctggcggcagcgcaaaagatg

SEQ ID NO: 192037 - DNA, 103 bp, Artificial Sequence
  Synthetic Polynucleotide
taatacgactcactatagggtctggtgtgtaggtaaaggtaaggctggtgaacagaggagacaccagatgtacctttacaacctggcggcagcgcaaaagatg

SEQ ID NO: 192038 - DNA, 103 bp, Artificial Sequence
  Synthetic Polynucleotide
taatacgactcactatagggcggccctggttctggtgtgtaggtaaaggtaacagaggagaacctttatgtacacaccaaacctggcggcagcgcaaaagatg

SEQ ID NO: 192039 - DNA, 103 bp, Artificial Sequence
  Synthetic Polynucleotide
taatacgactcactatagggaatgtggccgcggccctggttctggtgtgtaacagaggagaacacacatgaaccagggcaacctggcggcagcgcaaaagatg

SEQ ID NO: 192040 - DNA, 103 bp, Artificial Sequence
  Synthetic Polynucleotide
taatacgactcactataggggctgcactgcaatgtggccgcggccctggtaacagaggagaaccaggatggcggccacaaacctggcggcagcgcaaaagatg

SEQ ID NO: 192041 - DNA, 103 bp, Artificial Sequence
  Synthetic Polynucleotide
taatacgactcactataggggattgctcctgctgcactgcaatgtggccgaacagaggagacggccaatgtgcagtgcaaacctggcggcagcgcaaaagatg

SEQ ID NO: 192042 - DNA, 103 bp, Artificial Sequence
  Synthetic Polynucleotide
taatacgactcactatagggtggctcgaaggattgctcctgctgcactgcaacagaggagagcagtgatgcaggagcaaaacctggcggcagcgcaaaagatg

SEQ ID NO: 192043 - DNA, 103 bp, Artificial Sequence
  Synthetic Polynucleotide
taatacgactcactatagggtggcttgaattggctcgaaggattgctcctaacagaggagaaggagcatgccttcgagcaacctggcggcagcgcaaaagatg

SEQ ID NO: 192044 - DNA, 103 bp, Artificial Sequence
  Synthetic Polynucleotide
taatacgactcactatagggagggggcacctggcttgaattggctcgaagaacagaggagacttcgaatgaattcaagcaacctggcggcagcgcaaaagatg

SEQ ID NO: 192045 - DNA, 103 bp, Artificial Sequence
  Synthetic Polynucleotide
taatacgactcactatagggttgcatgaagaataagtactgtttgatcccaacagaggagagggatcatgcagtacttaaacctggcggcagcgcaaaagatg

SEQ ID NO: 192046 - DNA, 103 bp, Artificial Sequence
  Synthetic Polynucleotide
taatacgactcactatagggttgattcgttagggggcacctggcttgaataacagaggagaattcaaatgaggtgccccaacctggcggcagcgcaaaagatg

SEQ ID NO: 192047 - DNA, 103 bp, Artificial Sequence
  Synthetic Polynucleotide
taatacgactcactatagggctgtttgtgtttgattcgttagggggcaccaacagaggagaggtgccatgtaacgaatcaacctggcggcagcgcaaaagatg

SEQ ID NO: 192048 - DNA, 103 bp, Artificial Sequence
  Synthetic Polynucleotide
taatacgactcactatagggacttccctcgctgtttgtgtttgattcgttaacagaggagaaacgaaatgaacacaaacaacctggcggcagcgcaaaagatg

SEQ ID NO: 192049 - DNA, 103 bp, Artificial Sequence
  Synthetic Polynucleotide
taatacgactcactatagggcgtttgtgtaacttccctcgctgtttgtgtaacagaggagaacacaaatggcgagggaaaacctggcggcagcgcaaaagatg

SEQ ID NO: 192050 - DNA, 103 bp, Artificial Sequence
  Synthetic Polynucleotide
taatacgactcactatagggtttgtgctggcgtttgtgtaacttccctcgaacagaggagacgagggatgttacacaaaaacctggcggcagcgcaaaagatg

SEQ ID NO: 192051 - DNA, 103 bp, Artificial Sequence
  Synthetic Polynucleotide
taatacgactcactatagggactggttgaatttgtgctggcgtttgtgtaaacagaggagatacacaatggccagcacaaacctggcggcagcgcaaaagatg

SEQ ID NO: 192052 - DNA, 103 bp, Artificial Sequence
  Synthetic Polynucleotide
taatacgactcactatagggatgatgtgacactggttgaatttgtgctggaacagaggagaccagcaatgattcaaccaaacctggcggcagcgcaaaagatg

SEQ ID NO: 192053 - DNA, 103 bp, Artificial Sequence
  Synthetic Polynucleotide
taatacgactcactataggggtggctgtagatgatgtgacactggttgaaaacagaggagattcaacatgtgtcacatcaacctggcggcagcgcaaaagatg

SEQ ID NO: 192054 - DNA, 103 bp, Artificial Sequence
  Synthetic Polynucleotide
taatacgactcactatagggggataccactgtggctgtagatgatgtgacaacagaggagagtcacaatgtctacagccaacctggcggcagcgcaaaagatg

SEQ ID NO: 192055 - DNA, 103 bp, Artificial Sequence
  Synthetic Polynucleotide
taatacgactcactatagggtgtgcaacttttgcatgaagaataagtactaacagaggagaagtactatgtcttcatgcaacctggcggcagcgcaaaagatg

SEQ ID NO: 192056 - DNA, 103 bp, Artificial Sequence
  Synthetic Polynucleotide
taatacgactcactatagggatatgacttctgtgcaacttttgcatgaagaacagaggagacttcatatgaaagttgcaaacctggcggcagcgcaaaagatg

SEQ ID NO: 192057 - DNA, 103 bp, Artificial Sequence
  Synthetic Polynucleotide
taatacgactcactatagggtttcatttccatatgacttctgtgcaacttaacagaggagaaagttgatgagaagtcataacctggcggcagcgcaaaagatg

SEQ ID NO: 192058 - DNA, 103 bp, Artificial Sequence
  Synthetic Polynucleotide
taatacgactcactatagggaaaaaccttttttcatttccatatgacttcaacagaggagagaagtcatgtggaaatgaaacctggcggcagcgcaaaagatg

SEQ ID NO: 192059 - DNA, 103 bp, Artificial Sequence
  Synthetic Polynucleotide
taatacgactcactatagggaggtgggcaaaaaaaccttttttcatttccaacagaggagaggaaatatgaaaaggtttaacctggcggcagcgcaaaagatg

SEQ ID NO: 192060 - DNA, 103 bp, Artificial Sequence
  Synthetic Polynucleotide
taatacgactcactatagggcaggcggctcctccgcgggcgagccctccgaacagaggagacggaggatgcgcccgcggaacctggcggcagcgcaaaagatg

SEQ ID NO: 192061 - DNA, 103 bp, Artificial Sequence
  Synthetic Polynucleotide
taatacgactcactatagggatacacaaggaggtgggcaaaaaaacctttaacagaggagaaaaggtatgtttgcccacaacctggcggcagcgcaaaagatg

SEQ ID NO: 192062 - DNA, 103 bp, Artificial Sequence
  Synthetic Polynucleotide
taatacgactcactatagggcccataagatatacacaaggaggtgggcaaaacagaggagattgcccatgtccttgtgtaacctggcggcagcgcaaaagatg

SEQ ID NO: 192063 - DNA, 103 bp, Artificial Sequence
  Synthetic Polynucleotide
taatacgactcactatagggccatccactgcccataagatatacacaaggaacagaggagaccttgtatgtatcttatgaacctggcggcagcgcaaaagatg

SEQ ID NO: 192064 - DNA, 103 bp, Artificial Sequence
  Synthetic Polynucleotide
taatacgactcactatagggtttttttcttccatccactgcccataagataacagaggagaatcttaatggcagtggataacctggcggcagcgcaaaagatg

SEQ ID NO: 192065 - DNA, 103 bp, Artificial Sequence
  Synthetic Polynucleotide
taatacgactcactatagggatttgttctttttttttcttccatccactgaacagaggagacagtggatggaagaaaaaaacctggcggcagcgcaaaagatg

SEQ ID NO: 192066 - DNA, 103 bp, Artificial Sequence
  Synthetic Polynucleotide
taatacgactcactatagggatcgcgttccatttgttctttttttttcttaacagaggagaaagaaaatgaaagaacaaaacctggcggcagcgcaaaagatg

SEQ ID NO: 192067 - DNA, 103 bp, Artificial Sequence
  Synthetic Polynucleotide
taatacgactcactatagggcagaacaaccatcgcgttccatttgttcttaacagaggagaaagaacatgtggaacgcgaacctggcggcagcgcaaaagatg

SEQ ID NO: 192068 - DNA, 103 bp, Artificial Sequence
  Synthetic Polynucleotide
taatacgactcactataggggactcttgttcagaacaaccatcgcgttccaacagaggagaggaacgatgtggttgttcaacctggcggcagcgcaaaagatg

SEQ ID NO: 192069 - DNA, 103 bp, Artificial Sequence
  Synthetic Polynucleotide
taatacgactcactatagggacacggttgagactcttgttcagaacaaccaacagaggagaggttgtatggaacaagagaacctggcggcagcgcaaaagatg

SEQ ID NO: 192070 - DNA, 103 bp, Artificial Sequence
  Synthetic Polynucleotide
taatacgactcactatagggcaataaatgcacacggttgagactcttgttaacagaggagaaacaagatgctcaaccgtaacctggcggcagcgcaaaagatg

SEQ ID NO: 192071 - DNA, 103 bp, Artificial Sequence
  Synthetic Polynucleotide
taatacgactcactatagggggagcatgcgcaggcggctcctccgcgggcaacagaggagagcccgcatgggagccgccaacctggcggcagcgcaaaagatg

SEQ ID NO: 192072 - DNA, 103 bp, Artificial Sequence
  Synthetic Polynucleotide
taatacgactcactatagggtttcctatcccaataaatgcacacggttgaaacagaggagatcaaccatgtgcatttataacctggcggcagcgcaaaagatg

SEQ ID NO: 192073 - DNA, 103 bp, Artificial Sequence
  Synthetic Polynucleotide
taatacgactcactatagggttggtcactatttcctatcccaataaatgcaacagaggagagcatttatggggataggaaacctggcggcagcgcaaaagatg

SEQ ID NO: 192074 - DNA, 103 bp, Artificial Sequence
  Synthetic Polynucleotide
taatacgactcactataggggctgcatttcttggtcactatttcctatccaacagaggagaggatagatgatagtgaccaacctggcggcagcgcaaaagatg

SEQ ID NO: 192075 - DNA, 103 bp, Artificial Sequence
  Synthetic Polynucleotide
taatacgactcactatagggaagtttagctgctgcatttcttggtcactaaacagaggagatagtgaatgagaaatgcaaacctggcggcagcgcaaaagatg

SEQ ID NO: 192076 - DNA, 103 bp, Artificial Sequence
  Synthetic Polynucleotide
taatacgactcactatagggctttccttccaagtttagctgctgcatttcaacagaggagagaaatgatgcagctaaacaacctggcggcagcgcaaaagatg

SEQ ID NO: 192077 - DNA, 103 bp, Artificial Sequence
  Synthetic Polynucleotide
taatacgactcactatagggtgcaatagttctttccttccaagtttagctaacagaggagaagctaaatgtggaaggaaaacctggcggcagcgcaaaagatg

SEQ ID NO: 192078 - DNA, 103 bp, Artificial Sequence
  Synthetic Polynucleotide
taatacgactcactataggggttttggctgtgcaatagttctttccttccaacagaggagaggaaggatggaactattgaacctggcggcagcgcaaaagatg

SEQ ID NO: 192079 - DNA, 103 bp, Artificial Sequence
  Synthetic Polynucleotide
taatacgactcactatagggtatatacaatgttttggctgtgcaatagttaacagaggagaaactatatgacagccaaaaacctggcggcagcgcaaaagatg

SEQ ID NO: 192080 - DNA, 103 bp, Artificial Sequence
  Synthetic Polynucleotide
taatacgactcactatagggctgagtcagatatatacaatgttttggctgaacagaggagacagccaatgcattgtataaacctggcggcagcgcaaaagatg

SEQ ID NO: 192081 - DNA, 103 bp, Artificial Sequence
  Synthetic Polynucleotide
taatacgactcactatagggtttcgcttgtctgagtcagatatatacaataacagaggagaattgtaatgatctgactcaacctggcggcagcgcaaaagatg

SEQ ID NO: 192082 - DNA, 103 bp, Artificial Sequence
  Synthetic Polynucleotide
taatacgactcactatagggcccaggcgatggagcatgcgcaggcggctcaacagaggagagagccgatggcgcatgctaacctggcggcagcgcaaaagatg

SEQ ID NO: 192083 - DNA, 103 bp, Artificial Sequence
  Synthetic Polynucleotide
taatacgactcactatagggcatgaagtgctttcgcttgtctgagtcagaaacagaggagatctgacatggacaagcgaaacctggcggcagcgcaaaagatg

SEQ ID NO: 192084 - DNA, 103 bp, Artificial Sequence
  Synthetic Polynucleotide
taatacgactcactatagggttacagacaacatgaagtgctttcgcttgtaacagaggagaacaagcatgagcacttcaaacctggcggcagcgcaaaagatg

SEQ ID NO: 192085 - DNA, 103 bp, Artificial Sequence
  Synthetic Polynucleotide
taatacgactcactatagggtagaacatctttacagacaacatgaagtgcaacagaggagagcacttatggttgtctgtaacctggcggcagcgcaaaagatg

SEQ ID NO: 192086 - DNA, 103 bp, Artificial Sequence
  Synthetic Polynucleotide
taatacgactcactatagggactgttgccatagaacatctttacagacaaaacagaggagattgtctatgaagatgttcaacctggcggcagcgcaaaagatg

SEQ ID NO: 192087 - DNA, 103 bp, Artificial Sequence
  Synthetic Polynucleotide
taatacgactcactatagggcaatgtcatcactgttgccatagaacatctaacagaggagaagatgtatgatggcaacaaacctggcggcagcgcaaaagatg

SEQ ID NO: 192088 - DNA, 103 bp, Artificial Sequence
  Synthetic Polynucleotide
taatacgactcactatagggaggaacacaccaatgtcatcactgttgccaaacagaggagatggcaaatgtgatgacataacctggcggcagcgcaaaagatg

SEQ ID NO: 192089 - DNA, 103 bp, Artificial Sequence
  Synthetic Polynucleotide
taatacgactcactatagggccgcttgctgaggaacacaccaatgtcatcaacagaggagagatgacatgggtgtgttcaacctggcggcagcgcaaaagatg

SEQ ID NO: 192090 - DNA, 103 bp, Artificial Sequence
  Synthetic Polynucleotide
taatacgactcactatagggtgacttttatccgcttgctgaggaacacacaacagaggagagtgtgtatgtcagcaagcaacctggcggcagcgcaaaagatg

SEQ ID NO: 192091 - DNA, 103 bp, Artificial Sequence
  Synthetic Polynucleotide
taatacgactcactatagggggtttggagatgacttttatccgcttgctgaacagaggagacagcaaatggataaaagtaacctggcggcagcgcaaaagatg

SEQ ID NO: 192092 - DNA, 103 bp, Artificial Sequence
  Synthetic Polynucleotide
taatacgactcactatagggctttttggaaggtttggagatgacttttataacagaggagaataaaaatgatctccaaaaacctggcggcagcgcaaaagatg

SEQ ID NO: 192093 - DNA, 103 bp, Artificial Sequence
  Synthetic Polynucleotide
taatacgactcactatagggcaccaaatttcccaggcgatggagcatgcgaacagaggagacgcatgatgcatcgcctgaacctggcggcagcgcaaaagatg

SEQ ID NO: 192094 - DNA, 103 bp, Artificial Sequence
  Synthetic Polynucleotide
taatacgactcactatagggatgactgcttctttttggaaggtttggagaaacagaggagatctccaatgcttccaaaaaacctggcggcagcgcaaaagatg

SEQ ID NO: 192095 - DNA, 103 bp, Artificial Sequence
  Synthetic Polynucleotide
taatacgactcactataggggcatttttcaatgactgcttctttttggaaaacagaggagattccaaatggaagcagtcaacctggcggcagcgcaaaagatg

SEQ ID NO: 192096 - DNA, 103 bp, Artificial Sequence
  Synthetic Polynucleotide
taatacgactcactataggggcataagtcagcatttttcaatgactgcttaacagaggagaaagcagatgttgaaaaataacctggcggcagcgcaaaagatg

SEQ ID NO: 192097 - DNA, 103 bp, Artificial Sequence
  Synthetic Polynucleotide
taatacgactcactatagggctgaggcaatgcataagtcagcatttttcaaacagaggagatgaaaaatgctgacttataacctggcggcagcgcaaaagatg

SEQ ID NO: 192098 - DNA, 103 bp, Artificial Sequence
  Synthetic Polynucleotide
taatacgactcactatagggacctttgttcctgaggcaatgcataagtcaaacagaggagatgacttatgcattgcctcaacctggcggcagcgcaaaagatg

SEQ ID NO: 192099 - DNA, 103 bp, Artificial Sequence
  Synthetic Polynucleotide
taatacgactcactatagggaaacagagccacctttgttcctgaggcaataacagaggagaattgccatgggaacaaagaacctggcggcagcgcaaaagatg

SEQ ID NO: 192100 - DNA, 103 bp, Artificial Sequence
  Synthetic Polynucleotide
taatacgactcactataggggtagtcgattaaacagagccacctttgttcaacagaggagagaacaaatgtggctctgtaacctggcggcagcgcaaaagatg

SEQ ID NO: 192101 - DNA, 103 bp, Artificial Sequence
  Synthetic Polynucleotide
taatacgactcactataggggtctgggatcgtagtcgattaaacagagccaacagaggagaggctctatgtaatcgactaacctggcggcagcgcaaaagatg

SEQ ID NO: 192102 - DNA, 103 bp, Artificial Sequence
  Synthetic Polynucleotide
taatacgactcactatagggggtactaactgtctgggatcgtagtcgattaacagaggagaaatcgaatgcgatcccagaacctggcggcagcgcaaaagatg

SEQ ID NO: 192103 - DNA, 103 bp, Artificial Sequence
  Synthetic Polynucleotide
taatacgactcactataggggcaagtatctggtactaactgtctgggatcaacagaggagagatcccatgcagttagtaaacctggcggcagcgcaaaagatg

SEQ ID NO: 192104 - DNA, 103 bp, Artificial Sequence
  Synthetic Polynucleotide
taatacgactcactatagggggaggccgctcaccaaatttcccaggcgataacagaggagaatcgccatggaaatttggaacctggcggcagcgcaaaagatg

SEQ ID NO: 192105 - DNA, 103 bp, Artificial Sequence
  Synthetic Polynucleotide
taatacgactcactatagggccttctacatgcaagtatctggtactaactaacagaggagaagttagatgcagatacttaacctggcggcagcgcaaaagatg

SEQ ID NO: 192106 - DNA, 103 bp, Artificial Sequence
  Synthetic Polynucleotide
taatacgactcactatagggaaaattacctccttctacatgcaagtatctaacagaggagaagatacatgcatgtagaaaacctggcggcagcgcaaaagatg

SEQ ID NO: 192107 - DNA, 103 bp, Artificial Sequence
  Synthetic Polynucleotide
taatacgactcactatagggaactggcatgaaaattacctccttctacataacagaggagaatgtagatggaggtaattaacctggcggcagcgcaaaagatg

SEQ ID NO: 192108 - DNA, 103 bp, Artificial Sequence
  Synthetic Polynucleotide
taatacgactcactatagggcactgctgtgaactggcatgaaaattacctaacagaggagaaggtaaatgtcatgccagaacctggcggcagcgcaaaagatg

SEQ ID NO: 192109 - DNA, 103 bp, Artificial Sequence
  Synthetic Polynucleotide
taatacgactcactatagggaaaggctccccactgctgtgaactggcatgaacagaggagacatgccatgtcacagcagaacctggcggcagcgcaaaagatg

SEQ ID NO: 192110 - DNA, 103 bp, Artificial Sequence
  Synthetic Polynucleotide
taatacgactcactataggggatgaataaaaaaggctccccactgctgtgaacagaggagacacagcatgggggagcctaacctggcggcagcgcaaaagatg

SEQ ID NO: 192111 - DNA, 103 bp, Artificial Sequence
  Synthetic Polynucleotide
taatacgactcactatagggtcatccaagagatgaataaaaaaggctcccaacagaggagagggagcatgttttattcaaacctggcggcagcgcaaaagatg

SEQ ID NO: 192112 - DNA, 103 bp, Artificial Sequence
  Synthetic Polynucleotide
taatacgactcactatagggtgattcatcatcatccaagagatgaataaaaacagaggagatttattatgctcttggataacctggcggcagcgcaaaagatg

SEQ ID NO: 192113 - DNA, 103 bp, Artificial Sequence
  Synthetic Polynucleotide
taatacgactcactatagggcttctccttctgattcatcatcatccaagaaacagaggagatcttggatgatgatgaataacctggcggcagcgcaaaagatg

SEQ ID NO: 192114 - DNA, 103 bp, Artificial Sequence
  Synthetic Polynucleotide
taatacgactcactatagggactgtgaattcttctccttctgattcatcaaacagaggagatgatgaatgagaaggagaaacctggcggcagcgcaaaagatg

SEQ ID NO: 192115 - DNA, 103 bp, Artificial Sequence
  Synthetic Polynucleotide
taatacgactcactatagggtcgtttaggtggaggccgctcaccaaatttaacagaggagaaaatttatggagcggcctaacctggcggcagcgcaaaagatg

SEQ ID NO: 192116 - DNA, 103 bp, Artificial Sequence
  Synthetic Polynucleotide
taatacgactcactataggggccatctcggactgtgaattcttctccttcaacagaggagagaaggaatggaattcacaaacctggcggcagcgcaaaagatg

SEQ ID NO: 192117 - DNA, 103 bp, Artificial Sequence
  Synthetic Polynucleotide
taatacgactcactatagggaatggatgtagccatctcggactgtgaattaacagaggagaaattcaatgtccgagatgaacctggcggcagcgcaaaagatg

SEQ ID NO: 192118 - DNA, 103 bp, Artificial Sequence
  Synthetic Polynucleotide
taatacgactcactataggggtttgtccataatggatgtagccatctcggaacagaggagaccgagaatgctacatccaaacctggcggcagcgcaaaagatg

SEQ ID NO: 192119 - DNA, 103 bp, Artificial Sequence
  Synthetic Polynucleotide
taatacgactcactatagggaagtttgactgtttgtccataatggatgtaaacagaggagatacatcatgtatggacaaaacctggcggcagcgcaaaagatg

SEQ ID NO: 192120 - DNA, 103 bp, Artificial Sequence
  Synthetic Polynucleotide
taatacgactcactatagggctgagcacacaagtttgactgtttgtccataacagaggagaatggacatgcagtcaaacaacctggcggcagcgcaaaagatg

SEQ ID NO: 192121 - DNA, 103 bp, Artificial Sequence
  Synthetic Polynucleotide
taatacgactcactatagggatgccagtaactgagcacacaagtttgactaacagaggagaagtcaaatgtgtgtgctcaacctggcggcagcgcaaaagatg

SEQ ID NO: 192122 - DNA, 103 bp, Artificial Sequence
  Synthetic Polynucleotide
taatacgactcactatagggtgggagtgccatgccagtaactgagcacacaacagaggagagtgtgcatggttactggcaacctggcggcagcgcaaaagatg

SEQ ID NO: 192123 - DNA, 103 bp, Artificial Sequence
  Synthetic Polynucleotide
taatacgactcactatagggttatcaatcttgggagtgccatgccagtaaaacagaggagattactgatgtggcactccaacctggcggcagcgcaaaagatg

SEQ ID NO: 192124 - DNA, 103 bp, Artificial Sequence
  Synthetic Polynucleotide
taatacgactcactatagggactttcctaattatcaatcttgggagtgccaacagaggagaggcactatgaagattgataacctggcggcagcgcaaaagatg

SEQ ID NO: 192125 - DNA, 103 bp, Artificial Sequence
  Synthetic Polynucleotide
taatacgactcactatagggctgcttatcaactttcctaattatcaatctaacagaggagaagattgatgattaggaaaaacctggcggcagcgcaaaagatg

SEQ ID NO: 192126 - DNA, 103 bp, Artificial Sequence
  Synthetic Polynucleotide
taatacgactcactatagggccctagtaagtcgtttaggtggaggccgctaacagaggagaagcggcatgcacctaaacaacctggcggcagcgcaaaagatg

SEQ ID NO: 192127 - DNA, 103 bp, Artificial Sequence
  Synthetic Polynucleotide
taatacgactcactatagggataatgcggtctgcttatcaactttcctaaaacagaggagattaggaatgttgataagcaacctggcggcagcgcaaaagatg

SEQ ID NO: 192128 - DNA, 103 bp, Artificial Sequence
  Synthetic Polynucleotide
taatacgactcactatagggtctgcatccaataatgcggtctgcttatcaaacagaggagatgataaatggaccgcattaacctggcggcagcgcaaaagatg

SEQ ID NO: 192129 - DNA, 103 bp, Artificial Sequence
  Synthetic Polynucleotide
taatacgactcactatagggcacaggatcatctgcatccaataatgcggtaacagaggagaaccgcaatgttggatgcaaacctggcggcagcgcaaaagatg

SEQ ID NO: 192130 - DNA, 103 bp, Artificial Sequence
  Synthetic Polynucleotide
taatacgactcactatagggggagttgtgacacaggatcatctgcatccaaacagaggagatggatgatgatgatcctgaacctggcggcagcgcaaaagatg

SEQ ID NO: 192131 - DNA, 103 bp, Artificial Sequence
  Synthetic Polynucleotide
taatacgactcactataggggcacatttatggagttgtgacacaggatcaaacagaggagatgatccatggtcacaactaacctggcggcagcgcaaaagatg

SEQ ID NO: 192132 - DNA, 103 bp, Artificial Sequence
  Synthetic Polynucleotide
taatacgactcactatagggaaggtaaaatgcacatttatggagttgtgaaacagaggagatcacaaatgcataaatgtaacctggcggcagcgcaaaagatg

SEQ ID NO: 192133 - DNA, 103 bp, Artificial Sequence
  Synthetic Polynucleotide
taatacgactcactatagggctgtatccttaaggtaaaatgcacatttataacagaggagaataaatatgcattttaccaacctggcggcagcgcaaaagatg

SEQ ID NO: 192134 - DNA, 103 bp, Artificial Sequence
  Synthetic Polynucleotide
taatacgactcactatagggtacattctttctgtatccttaaggtaaaataacagaggagaattttaatgtaaggatacaacctggcggcagcgcaaaagatg

SEQ ID NO: 192135 - DNA, 103 bp, Artificial Sequence
  Synthetic Polynucleotide
taatacgactcactatagggaaggcacaaatacattctttctgtatccttaacagaggagaaaggatatggaaagaatgaacctggcggcagcgcaaaagatg

SEQ ID NO: 192136 - DNA, 103 bp, Artificial Sequence
  Synthetic Polynucleotide
taatacgactcactatagggtttcttgagaaaggcacaaatacattctttaacagaggagaaaagaaatgatttgtgccaacctggcggcagcgcaaaagatg

SEQ ID NO: 192137 - DNA, 103 bp, Artificial Sequence
  Synthetic Polynucleotide
taatacgactcactatagggcgcatagcttccctagtaagtcgtttaggtaacagaggagaacctaaatgacttactagaacctggcggcagcgcaaaagatg

SEQ ID NO: 192138 - DNA, 103 bp, Artificial Sequence
  Synthetic Polynucleotide
taatacgactcactatagggtgaattattctttcttgagaaaggcacaaaaacagaggagatttgtgatgttctcaagaaacctggcggcagcgcaaaagatg

SEQ ID NO: 192139 - DNA, 103 bp, Artificial Sequence
  Synthetic Polynucleotide
taatacgactcactatagggggcctgaaattgaattattctttcttgagaaacagaggagatctcaaatgagaataattaacctggcggcagcgcaaaagatg

SEQ ID NO: 192140 - DNA, 103 bp, Artificial Sequence
  Synthetic Polynucleotide
taatacgactcactataggggacatggagtggcctgaaattgaattattcaacagaggagagaataaatgaatttcaggaacctggcggcagcgcaaaagatg

SEQ ID NO: 192141 - DNA, 103 bp, Artificial Sequence
  Synthetic Polynucleotide
taatacgactcactatagggggttcttttggacatggagtggcctgaaataacagaggagaatttcaatgcactccatgaacctggcggcagcgcaaaagatg

SEQ ID NO: 192142 - DNA, 103 bp, Artificial Sequence
  Synthetic Polynucleotide
taatacgactcactatagggctctttatttggttcttttggacatggagtaacagaggagaactccaatgccaaaagaaaacctggcggcagcgcaaaagatg

SEQ ID NO: 192143 - DNA, 103 bp, Artificial Sequence
  Synthetic Polynucleotide
taatacgactcactatagggcatttatcatctctttatttggttcttttgaacagaggagacaaaagatgcaaataaagaacctggcggcagcgcaaaagatg

SEQ ID NO: 192144 - DNA, 103 bp, Artificial Sequence
  Synthetic Polynucleotide
taatacgactcactataggggaagcgccatcatttatcatctctttatttaacagaggagaaaataaatggatgataaaaacctggcggcagcgcaaaagatg

SEQ ID NO: 192145 - DNA, 103 bp, Artificial Sequence
  Synthetic Polynucleotide
taatacgactcactataggggattgtccaggaagcgccatcatttatcataacagaggagaatgataatggatggcgctaacctggcggcagcgcaaaagatg

SEQ ID NO: 192146 - DNA, 103 bp, Artificial Sequence
  Synthetic Polynucleotide
taatacgactcactatagggctgtgctaatgattgtccaggaagcgccataacagaggagaatggcgatgcctggacaaaacctggcggcagcgcaaaagatg

SEQ ID NO: 192147 - DNA, 103 bp, Artificial Sequence
  Synthetic Polynucleotide
taatacgactcactatagggtctgccttatctgtgctaatgattgtccagaacagaggagactggacatgcattagcacaacctggcggcagcgcaaaagatg

SEQ ID NO: 192148 - DNA, 103 bp, Artificial Sequence
  Synthetic Polynucleotide
taatacgactcactatagggtgaggggtctgctgcccctgcggggtccataacagaggagaatggacatggcaggggcaaacctggcggcagcgcaaaagatg

SEQ ID NO: 192149 - DNA, 103 bp, Artificial Sequence
  Synthetic Polynucleotide
taatacgactcactataggggcccgggaggctccgcctgtcggcttcgctaacagaggagaagcgaaatggacaggcggaacctggcggcagcgcaaaagatg

SEQ ID NO: 192150 - DNA, 103 bp, Artificial Sequence
  Synthetic Polynucleotide
taatacgactcactatagggctgaaattgcaccaccttctctgtggcaagaacagaggagacttgccatggagaaggtgaacctggcggcagcgcaaaagatg

SEQ ID NO: 192151 - DNA, 103 bp, Artificial Sequence
  Synthetic Polynucleotide
taatacgactcactatagggagggagaggcctgaaattgcaccaccttctaacagaggagaagaaggatgtgcaatttcaacctggcggcagcgcaaaagatg

SEQ ID NO: 192152 - DNA, 103 bp, Artificial Sequence
  Synthetic Polynucleotide
taatacgactcactatagggtccttggggcagggagaggcctgaaattgcaacagaggagagcaattatgggcctctccaacctggcggcagcgcaaaagatg

SEQ ID NO: 192153 - DNA, 103 bp, Artificial Sequence
  Synthetic Polynucleotide
taatacgactcactatagggcctgttcgcctccttggggcagggagaggcaacagaggagagcctctatgtgccccaagaacctggcggcagcgcaaaagatg

SEQ ID NO: 192154 - DNA, 103 bp, Artificial Sequence
  Synthetic Polynucleotide
taatacgactcactatagggtaagcagagccctgttcgcctccttggggcaacagaggagagccccaatgaggcgaacaaacctggcggcagcgcaaaagatg

SEQ ID NO: 192155 - DNA, 103 bp, Artificial Sequence
  Synthetic Polynucleotide
taatacgactcactataggggagctgtcgttaagcagagccctgttcgccaacagaggagaggcgaaatgggctctgctaacctggcggcagcgcaaaagatg

SEQ ID NO: 192156 - DNA, 103 bp, Artificial Sequence
  Synthetic Polynucleotide
taatacgactcactatagggggtccagcaagagctgtcgttaagcagagcaacagaggagagctctgatgaacgacagcaacctggcggcagcgcaaaagatg

SEQ ID NO: 192157 - DNA, 103 bp, Artificial Sequence
  Synthetic Polynucleotide
taatacgactcactatagggtgccgatgatggtccagcaagagctgtcgtaacagaggagaacgacaatgcttgctggaaacctggcggcagcgcaaaagatg

SEQ ID NO: 192158 - DNA, 103 bp, Artificial Sequence
  Synthetic Polynucleotide
taatacgactcactatagggaccgactcggtgccgatgatggtccagcaaaacagaggagattgctgatgcatcatcggaacctggcggcagcgcaaaagatg

SEQ ID NO: 192159 - DNA, 103 bp, Artificial Sequence
  Synthetic Polynucleotide
taatacgactcactatagggggaaaattccaccgactcggtgccgatgataacagaggagaatcatcatgaccgagtcgaacctggcggcagcgcaaaagatg

SEQ ID NO: 192160 - DNA, 103 bp, Artificial Sequence
  Synthetic Polynucleotide
taatacgactcactatagggtggtccaagtgcccgggaggctccgcctgtaacagaggagaacaggcatggcctcccggaacctggcggcagcgcaaaagatg

SEQ ID NO: 192161 - DNA, 103 bp, Artificial Sequence
  Synthetic Polynucleotide
taatacgactcactatagggtggtgctgaaggaaaattccaccgactcggaacagaggagaccgagtatgtggaattttaacctggcggcagcgcaaaagatg

SEQ ID NO: 192162 - DNA, 103 bp, Artificial Sequence
  Synthetic Polynucleotide
taatacgactcactatagggcacgccaggctggtgctgaaggaaaattccaacagaggagaggaattatgcttcagcacaacctggcggcagcgcaaaagatg

SEQ ID NO: 192163 - DNA, 103 bp, Artificial Sequence
  Synthetic Polynucleotide
taatacgactcactatagggctccagggtacacgccaggctggtgctgaaaacagaggagattcagcatgagcctggcgaacctggcggcagcgcaaaagatg

SEQ ID NO: 192164 - DNA, 103 bp, Artificial Sequence
  Synthetic Polynucleotide
taatacgactcactataggggagtgaccggctccagggtacacgccaggcaacagaggagagcctggatggtaccctggaacctggcggcagcgcaaaagatg

SEQ ID NO: 192165 - DNA, 103 bp, Artificial Sequence
  Synthetic Polynucleotide
taatacgactcactatagggagaggcaccggagtgaccggctccagggtaaacagaggagataccctatggccggtcacaacctggcggcagcgcaaaagatg

SEQ ID NO: 192166 - DNA, 103 bp, Artificial Sequence
  Synthetic Polynucleotide
taatacgactcactatagggggtgctgatgagaggcaccggagtgaccggaacagaggagaccggtcatgccggtgcctaacctggcggcagcgcaaaagatg

SEQ ID NO: 192167 - DNA, 103 bp, Artificial Sequence
  Synthetic Polynucleotide
taatacgactcactatagggtcagctctagggtgctgatgagaggcaccgaacagaggagacggtgcatgtcatcagcaaacctggcggcagcgcaaaagatg

SEQ ID NO: 192168 - DNA, 103 bp, Artificial Sequence
  Synthetic Polynucleotide
taatacgactcactatagggcccccgccgctcagctctagggtgctgatgaacagaggagacatcagatgcctagagctaacctggcggcagcgcaaaagatg

SEQ ID NO: 192169 - DNA, 103 bp, Artificial Sequence
  Synthetic Polynucleotide
taatacgactcactatagggggccacgtcgcccccgccgctcagctctagaacagaggagactagagatgagcggcgggaacctggcggcagcgcaaaagatg

SEQ ID NO: 192170 - DNA, 103 bp, Artificial Sequence
  Synthetic Polynucleotide
taatacgactcactataggggctccagcgtggccacgtcgcccccgccgcaacagaggagagcggcgatggcgacgtggaacctggcggcagcgcaaaagatg

SEQ ID NO: 192171 - DNA, 103 bp, Artificial Sequence
  Synthetic Polynucleotide
taatacgactcactatagggggggatgacctggtccaagtgcccgggaggaacagaggagacctcccatgcacttggacaacctggcggcagcgcaaaagatg

SEQ ID NO: 192172 - DNA, 103 bp, Artificial Sequence
  Synthetic Polynucleotide
taatacgactcactatagggtctccgtggagctccagcgtggccacgtcgaacagaggagacgacgtatgcacgctggaaacctggcggcagcgcaaaagatg

SEQ ID NO: 192173 - DNA, 103 bp, Artificial Sequence
  Synthetic Polynucleotide
taatacgactcactataggggtggaagttctctccgtggagctccagcgtaacagaggagaacgctgatgctccacggaaacctggcggcagcgcaaaagatg

SEQ ID NO: 192174 - DNA, 103 bp, Artificial Sequence
  Synthetic Polynucleotide
taatacgactcactatagggtgagccccgcgtggaagttctctccgtggaaacagaggagatccacgatgagaacttccaacctggcggcagcgcaaaagatg

SEQ ID NO: 192175 - DNA, 103 bp, Artificial Sequence
  Synthetic Polynucleotide
taatacgactcactatagggaaccacaccttgagccccgcgtggaagttcaacagaggagagaacttatgcgcggggctaacctggcggcagcgcaaaagatg

SEQ ID NO: 192176 - DNA, 103 bp, Artificial Sequence
  Synthetic Polynucleotide
taatacgactcactatagggcacgtccccaaaccacaccttgagccccgcaacagaggagagcggggatgaaggtgtggaacctggcggcagcgcaaaagatg

SEQ ID NO: 192177 - DNA, 103 bp, Artificial Sequence
  Synthetic Polynucleotide
taatacgactcactatagggtttctgcctccacgtccccaaaccacacctaacagaggagaaggtgtatgttggggacgaacctggcggcagcgcaaaagatg

SEQ ID NO: 192178 - DNA, 103 bp, Artificial Sequence
  Synthetic Polynucleotide
taatacgactcactatagggctgtacatggtttctgcctccacgtccccaaacagaggagatggggaatgggaggcagaaacctggcggcagcgcaaaagatg

SEQ ID NO: 192179 - DNA, 103 bp, Artificial Sequence
  Synthetic Polynucleotide
taatacgactcactatagggccgcgggctcctgtacatggtttctgcctcaacagaggagagaggcaatgaccatgtacaacctggcggcagcgcaaaagatg

SEQ ID NO: 192180 - DNA, 103 bp, Artificial Sequence
  Synthetic Polynucleotide
taatacgactcactatagggacaccagggaccgcgggctcctgtacatggaacagaggagaccatgtatgggagcccgcaacctggcggcagcgcaaaagatg

SEQ ID NO: 192181 - DNA, 103 bp, Artificial Sequence
  Synthetic Polynucleotide
taatacgactcactatagggggcaccacgcacaccagggaccgcgggctcaacagaggagagagcccatggtccctggtaacctggcggcagcgcaaaagatg

SEQ ID NO: 192182 - DNA, 103 bp, Artificial Sequence
  Synthetic Polynucleotide
taatacgactcactatagggggtgtgctctggggatgacctggtccaagtaacagaggagaacttggatgaggtcatccaacctggcggcagcgcaaaagatg

SEQ ID NO: 192183 - DNA, 103 bp, Artificial Sequence
  Synthetic Polynucleotide
taatacgactcactatagggcgccacgtccggcaccacgcacaccagggaaacagaggagatccctgatgtgcgtggtgaacctggcggcagcgcaaaagatg

SEQ ID NO: 192184 - DNA, 103 bp, Artificial Sequence
  Synthetic Polynucleotide
taatacgactcactatagggtgcagaaggccgccacgtccggcaccacgcaacagaggagagcgtggatgcggacgtggaacctggcggcagcgcaaaagatg

SEQ ID NO: 192185 - DNA, 103 bp, Artificial Sequence
  Synthetic Polynucleotide
taatacgactcactatagggcgccagtcgctgcagaaggccgccacgtccaacagaggagaggacgtatgggccttctgaacctggcggcagcgcaaaagatg

SEQ ID NO: 192186 - DNA, 103 bp, Artificial Sequence
  Synthetic Polynucleotide
taatacgactcactataggggcgcagccagcgccagtcgctgcagaaggcaacagaggagagccttcatgagcgactggaacctggcggcagcgcaaaagatg

SEQ ID NO: 192187 - DNA, 103 bp, Artificial Sequence
  Synthetic Polynucleotide
taatacgactcactatagggtgatgggagcgcgcagccagcgccagtcgcaacagaggagagcgactatggctggctgcaacctggcggcagcgcaaaagatg

SEQ ID NO: 192188 - DNA, 103 bp, Artificial Sequence
  Synthetic Polynucleotide
taatacgactcactatagggatggggattgtgatgggagcgcgcagccagaacagaggagactggctatgcgctcccataacctggcggcagcgcaaaagatg

SEQ ID NO: 192189 - DNA, 103 bp, Artificial Sequence
  Synthetic Polynucleotide
taatacgactcactatagggcaccaggctcatggggattgtgatgggagcaacagaggagagctcccatgacaatccccaacctggcggcagcgcaaaagatg

SEQ ID NO: 192190 - DNA, 103 bp, Artificial Sequence
  Synthetic Polynucleotide
taatacgactcactatagggcgtcggcgcgcaccaggctcatggggattgaacagaggagacaatccatgtgagcctggaacctggcggcagcgcaaaagatg

SEQ ID NO: 192191 - DNA, 103 bp, Artificial Sequence
  Synthetic Polynucleotide
taatacgactcactatagggtagaagagcccgtcggcgcgcaccaggctcaacagaggagagagcctatggcgcgccgaaacctggcggcagcgcaaaagatg

SEQ ID NO: 192192 - DNA, 103 bp, Artificial Sequence
  Synthetic Polynucleotide
taatacgactcactatagggggcactagggtagaagagcccgtcggcgcgaacagaggagacgcgccatggggctcttcaacctggcggcagcgcaaaagatg

SEQ ID NO: 192193 - DNA, 103 bp, Artificial Sequence
  Synthetic Polynucleotide
taatacgactcactatagggtcagaatggtggtgtgctctggggatgaccaacagaggagaggtcatatgcagagcacaaacctggcggcagcgcaaaagatg

SEQ ID NO: 192194 - DNA, 103 bp, Artificial Sequence
  Synthetic Polynucleotide
taatacgactcactatagggtgaaggagaaggcactagggtagaagagccaacagaggagaggctctatgaccctagtgaacctggcggcagcgcaaaagatg

SEQ ID NO: 192195 - DNA, 103 bp, Artificial Sequence
  Synthetic Polynucleotide
taatacgactcactatagggggggtgtaggtgaaggagaaggcactagggaacagaggagaccctagatgcttctccttaacctggcggcagcgcaaaagatg

SEQ ID NO: 192196 - DNA, 103 bp, Artificial Sequence
  Synthetic Polynucleotide
taatacgactcactataggggctgtattccggggtgtaggtgaaggagaaaacagaggagattctccatgacctacaccaacctggcggcagcgcaaaagatg

SEQ ID NO: 192197 - DNA, 103 bp, Artificial Sequence
  Synthetic Polynucleotide
taatacgactcactatagggccggccgcacgctgtattccggggtgtaggaacagaggagacctacaatgcggaatacaaacctggcggcagcgcaaaagatg

SEQ ID NO: 192198 - DNA, 103 bp, Artificial Sequence
  Synthetic Polynucleotide
taatacgactcactatagggccggggtgacccggccgcacgctgtattccaacagaggagaggaataatgcgtgcggccaacctggcggcagcgcaaaagatg

SEQ ID NO: 192199 - DNA, 103 bp, Artificial Sequence
  Synthetic Polynucleotide
taatacgactcactatagggctcggggacgccggggtgacccggccgcacaacagaggagagtgcggatgggtcaccccaacctggcggcagcgcaaaagatg

SEQ ID NO: 192200 - DNA, 103 bp, Artificial Sequence
  Synthetic Polynucleotide
taatacgactcactatagggcggtggcgggctcggggacgccggggtgacaacagaggagagtcaccatggcgtccccgaacctggcggcagcgcaaaagatg

SEQ ID NO: 192201 - DNA, 103 bp, Artificial Sequence
  Synthetic Polynucleotide
taatacgactcactataggggcgtcggcgtcggtggcgggctcggggacgaacagaggagacgtcccatggcccgccacaacctggcggcagcgcaaaagatg

SEQ ID NO: 192202 - DNA, 103 bp, Artificial Sequence
  Synthetic Polynucleotide
taatacgactcactatagggctccaggagcgcgtcggcgtcggtggcgggaacagaggagacccgccatggacgccgacaacctggcggcagcgcaaaagatg

SEQ ID NO: 192203 - DNA, 103 bp, Artificial Sequence
  Synthetic Polynucleotide
taatacgactcactataggggatggatgctctccaggagcgcgtcggcgtaacagaggagaacgccgatgcgctcctggaacctggcggcagcgcaaaagatg

SEQ ID NO: 192204 - DNA, 103 bp, Artificial Sequence
  Synthetic Polynucleotide
taatacgactcactatagggacgcctcccctcagaatggtggtgtgctctaacagaggagaagagcaatgcaccattctaacctggcggcagcgcaaaagatg

SEQ ID NO: 192205 - DNA, 103 bp, Artificial Sequence
  Synthetic Polynucleotide
taatacgactcactataggggtgaactcctgatggatgctctccaggagcaacagaggagagctcctatggagcatccaaacctggcggcagcgcaaaagatg

SEQ ID NO: 192206 - DNA, 103 bp, Artificial Sequence
  Synthetic Polynucleotide
taatacgactcactataggggttggtgcgcgtgaactcctgatggatgctaacagaggagaagcatcatgcaggagttcaacctggcggcagcgcaaaagatg

SEQ ID NO: 192207 - DNA, 103 bp, Artificial Sequence
  Synthetic Polynucleotide
taatacgactcactatagggagaggtggaagttggtgcgcgtgaactcctaacagaggagaaggagtatgcgcgcaccaaacctggcggcagcgcaaaagatg

SEQ ID NO: 192208 - DNA, 103 bp, Artificial Sequence
  Synthetic Polynucleotide
taatacgactcactataggggtctggatgaagaggtggaagttggtgcgcaacagaggagagcgcacatgcttccacctaacctggcggcagcgcaaaagatg

SEQ ID NO: 192209 - DNA, 103 bp, Artificial Sequence
  Synthetic Polynucleotide
taatacgactcactataggggcacctgcgcacgcctcccctcagaatggtaacagaggagaaccattatgaggggaggcaacctggcggcagcgcaaaagatg

SEQ ID NO: 192210 - DNA, 103 bp, Artificial Sequence
  Synthetic Polynucleotide
taatacgactcactataggggttgctgcaggcacctgcgcacgcctccccaacagaggagaggggagatgtgcgcaggtaacctggcggcagcgcaaaagatg

SEQ ID NO: 192211 - DNA, 103 bp, Artificial Sequence
  Synthetic Polynucleotide
taatacgactcactatagggtgttcacactgttgctgcaggcacctgcgcaacagaggagagcgcagatgcctgcagcaaacctggcggcagcgcaaaagatg

SEQ ID NO: 192212 - DNA, 103 bp, Artificial Sequence
  Synthetic Polynucleotide
taatacgactcactatagggccgcacagtctgttcacactgttgctgcagaacagaggagactgcagatgcagtgtgaaaacctggcggcagcgcaaaagatg

SEQ ID NO: 192213 - DNA, 103 bp, Artificial Sequence
  Synthetic Polynucleotide
taatacgactcactatagggtgggaggcactgaggggtctgctgcccctgaacagaggagacaggggatgcagacccctaacctggcggcagcgcaaaagatg

SEQ ID NO: 192214 - DNA, 103 bp, Artificial Sequence
  Synthetic Polynucleotide
taatacgactcactatagggcatgcaggatccgcacagtctgttcacactaacagaggagaagtgtgatgagactgtgcaacctggcggcagcgcaaaagatg

SEQ ID NO: 192215 - DNA, 103 bp, Artificial Sequence
  Synthetic Polynucleotide
taatacgactcactataggggccaccttggcatgcaggatccgcacagtcaacagaggagagactgtatggatcctgcaaacctggcggcagcgcaaaagatg

SEQ ID NO: 192216 - DNA, 103 bp, Artificial Sequence
  Synthetic Polynucleotide
taatacgactcactatagggtgatttctgggccaccttggcatgcaggataacagaggagaatcctgatggccaaggtgaacctggcggcagcgcaaaagatg

SEQ ID NO: 192217 - DNA, 103 bp, Artificial Sequence
  Synthetic Polynucleotide
taatacgactcactatagggcatttccgtatgatttctgggccaccttggaacagaggagaccaaggatgcccagaaataacctggcggcagcgcaaaagatg

SEQ ID NO: 192218 - DNA, 103 bp, Artificial Sequence
  Synthetic Polynucleotide
taatacgactcactatagggaaccgcttctcatttccgtatgatttctggaacagaggagaccagaaatgatacggaaaaacctggcggcagcgcaaaagatg

SEQ ID NO: 192219 - DNA, 103 bp, Artificial Sequence
  Synthetic Polynucleotide
taatacgactcactatagggggggcagaagaaccgcttctcatttccgtaaacagaggagatacggaatggagaagcggaacctggcggcagcgcaaaagatg

SEQ ID NO: 192220 - DNA, 103 bp, Artificial Sequence
  Synthetic Polynucleotide
taatacgactcactatagggcacagggcggggggcagaagaaccgcttctaacagaggagaagaagcatgtcttctgccaacctggcggcagcgcaaaagatg

SEQ ID NO: 192221 - DNA, 103 bp, Artificial Sequence
  Synthetic Polynucleotide
taatacgactcactataggggagaggtagacacagggcggggggcagaagaacagaggagacttctgatgcccgccctgaacctggcggcagcgcaaaagatg

SEQ ID NO: 192222 - DNA, 103 bp, Artificial Sequence
  Synthetic Polynucleotide
taatacgactcactataggggccaggccccgagaggtagacacagggcggaacagaggagaccgcccatggtctacctcaacctggcggcagcgcaaaagatg

SEQ ID NO: 192223 - DNA, 103 bp, Artificial Sequence
  Synthetic Polynucleotide
taatacgactcactatagggtcaccctccagccaggccccgagaggtagaaacagaggagatctaccatgcggggcctgaacctggcggcagcgcaaaagatg

SEQ ID NO: 192224 - DNA, 103 bp, Artificial Sequence
  Synthetic Polynucleotide
taatacgactcactataggggtcaaaggattgggaggcactgaggggtctaacagaggagaagacccatgagtgcctccaacctggcggcagcgcaaaagatg

SEQ ID NO: 192225 - DNA, 103 bp, Artificial Sequence
  Synthetic Polynucleotide
taatacgactcactatagggtgccctggcttcaccctccagccaggccccaacagaggagaggggccatgctggagggtaacctggcggcagcgcaaaagatg

SEQ ID NO: 192226 - DNA, 103 bp, Artificial Sequence
  Synthetic Polynucleotide
taatacgactcactatagggagcttgatcctgccctggcttcaccctccaaacagaggagatggaggatgaagccagggaacctggcggcagcgcaaaagatg

SEQ ID NO: 192227 - DNA, 103 bp, Artificial Sequence
  Synthetic Polynucleotide
taatacgactcactatagggccgcctggtgagcttgatcctgccctggctaacagaggagaagccagatgaggatcaagaacctggcggcagcgcaaaagatg

SEQ ID NO: 192228 - DNA, 103 bp, Artificial Sequence
  Synthetic Polynucleotide
taatacgactcactatagggcccgtttcccccgcctggtgagcttgatccaacagaggagaggatcaatgtcaccaggcaacctggcggcagcgcaaaagatg

SEQ ID NO: 192229 - DNA, 103 bp, Artificial Sequence
  Synthetic Polynucleotide
taatacgactcactataggggaccgtgggccccgtttcccccgcctggtgaacagaggagacaccagatgggggaaacgaacctggcggcagcgcaaaagatg

SEQ ID NO: 192230 - DNA, 103 bp, Artificial Sequence
  Synthetic Polynucleotide
taatacgactcactatagggtgtaaccgcagaccgtgggccccgtttcccaacagaggagagggaaaatgggcccacggaacctggcggcagcgcaaaagatg

SEQ ID NO: 192231 - DNA, 103 bp, Artificial Sequence
  Synthetic Polynucleotide
taatacgactcactatagggtccagtcccatgtaaccgcagaccgtgggcaacagaggagagcccacatgctgcggttaaacctggcggcagcgcaaaagatg

SEQ ID NO: 192232 - DNA, 103 bp, Artificial Sequence
  Synthetic Polynucleotide
taatacgactcactatagggggacgcgctgtccagtcccatgtaaccgcaaacagaggagatgcggtatgatgggactgaacctggcggcagcgcaaaagatg

SEQ ID NO: 192233 - DNA, 103 bp, Artificial Sequence
  Synthetic Polynucleotide
taatacgactcactatagggtggcgctgccggacgcgctgtccagtcccaaacagaggagatgggacatgacagcgcgtaacctggcggcagcgcaaaagatg

SEQ ID NO: 192234 - DNA, 103 bp, Artificial Sequence
  Synthetic Polynucleotide
taatacgactcactatagggtgcgtctcagtggcgctgccggacgcgctgaacagaggagacagcgcatgcggcagcgcaacctggcggcagcgcaaaagatg

SEQ ID NO: 192235 - DNA, 103 bp, Artificial Sequence
  Synthetic Polynucleotide
taatacgactcactataggggctcaggtgagtcaaaggattgggaggcacaacagaggagagtgcctatgaatcctttgaacctggcggcagcgcaaaagatg

SEQ ID NO: 192236 - DNA, 103 bp, Artificial Sequence
  Synthetic Polynucleotide
taatacgactcactatagggattcagcttctgcgtctcagtggcgctgccaacagaggagaggcagcatgactgagacgaacctggcggcagcgcaaaagatg

SEQ ID NO: 192237 - DNA, 103 bp, Artificial Sequence
  Synthetic Polynucleotide
taatacgactcactataggggctgctcgaaattcagcttctgcgtctcagaacagaggagactgagaatgagaagctgaaacctggcggcagcgcaaaagatg

SEQ ID NO: 192238 - DNA, 103 bp, Artificial Sequence
  Synthetic Polynucleotide
taatacgactcactataggggagtccggctgctgctcgaaattcagcttcaacagaggagagaagctatgtttcgagcaaacctggcggcagcgcaaaagatg

SEQ ID NO: 192239 - DNA, 103 bp, Artificial Sequence
  Synthetic Polynucleotide
taatacgactcactataggggaattccctggagtccggctgctgctcgaaaacagaggagattcgagatgcagccggacaacctggcggcagcgcaaaagatg

SEQ ID NO: 192240 - DNA, 103 bp, Artificial Sequence
  Synthetic Polynucleotide
taatacgactcactatagggtggcgcagccgaattccctggagtccggctaacagaggagaagccggatgccagggaataacctggcggcagcgcaaaagatg

SEQ ID NO: 192241 - DNA, 103 bp, Artificial Sequence
  Synthetic Polynucleotide
taatacgactcactatagggtacagggtcttggcgcagccgaattccctgaacagaggagacagggaatgcggctgcgcaacctggcggcagcgcaaaagatg

SEQ ID NO: 192242 - DNA, 103 bp, Artificial Sequence
  Synthetic Polynucleotide
taatacgactcactatagggatctgagatgtacagggtcttggcgcagccaacagaggagaggctgcatgaagaccctgaacctggcggcagcgcaaaagatg

SEQ ID NO: 192243 - DNA, 103 bp, Artificial Sequence
  Synthetic Polynucleotide
taatacgactcactatagggtcttgtctgcatctgagatgtacagggtctaacagaggagaagacccatgacatctcagaacctggcggcagcgcaaaagatg

SEQ ID NO: 192244 - DNA, 103 bp, Artificial Sequence
  Synthetic Polynucleotide
taatacgactcactatagggaagtgcttcctcttgtctgcatctgagatgaacagaggagacatctcatgtgcagacaaaacctggcggcagcgcaaaagatg

SEQ ID NO: 192245 - DNA, 103 bp, Artificial Sequence
  Synthetic Polynucleotide
taatacgactcactatagggcaccagccgaaagtgcttcctcttgtctgcaacagaggagagcagacatgaggaagcacaacctggcggcagcgcaaaagatg

SEQ ID NO: 192246 - DNA, 103 bp, Artificial Sequence
  Synthetic Polynucleotide
taatacgactcactatagggtgtcctgcaggctcaggtgagtcaaaggataacagaggagaatccttatgctcacctgaaacctggcggcagcgcaaaagatg

SEQ ID NO: 192247 - DNA, 103 bp, Artificial Sequence
  Synthetic Polynucleotide
taatacgactcactatagggccagccgcagcaccagccgaaagtgcttccaacagaggagaggaagcatgttcggctggaacctggcggcagcgcaaaagatg

SEQ ID NO: 192248 - DNA, 103 bp, Artificial Sequence
  Synthetic Polynucleotide
taatacgactcactatagggccgcgcagcaccagccgcagcaccagccgaaacagaggagatcggctatggctgcggctaacctggcggcagcgcaaaagatg

SEQ ID NO: 192249 - DNA, 103 bp, Artificial Sequence
  Synthetic Polynucleotide
taatacgactcactatagggctcccggcccccgcgcagcaccagccgcagaacagaggagactgcggatggtgctgcgcaacctggcggcagcgcaaaagatg

SEQ ID NO: 192250 - DNA, 103 bp, Artificial Sequence
  Synthetic Polynucleotide
taatacgactcactatagggaggtacccagctcccggcccccgcgcagcaaacagaggagatgctgcatgggggccgggaacctggcggcagcgcaaaagatg

SEQ ID NO: 192251 - DNA, 103 bp, Artificial Sequence
  Synthetic Polynucleotide
taatacgactcactatagggcggctgtggaaggtacccagctcccggcccaacagaggagagggccgatggctgggtacaacctggcggcagcgcaaaagatg

SEQ ID NO: 192252 - DNA, 103 bp, Artificial Sequence
  Synthetic Polynucleotide
taatacgactcactatagggcttgataaggcggctgtggaaggtacccagaacagaggagactgggtatgttccacagcaacctggcggcagcgcaaaagatg

SEQ ID NO: 192253 - DNA, 103 bp, Artificial Sequence
  Synthetic Polynucleotide
taatacgactcactatagggtcgagatgaccttgataaggcggctgtggaaacagaggagatccacaatggccttatcaaacctggcggcagcgcaaaagatg

SEQ ID NO: 192254 - DNA, 103 bp, Artificial Sequence
  Synthetic Polynucleotide
taatacgactcactatagggtgcgagggcttcgagatgaccttgataaggaacagaggagaccttatatgggtcatctcaacctggcggcagcgcaaaagatg

SEQ ID NO: 192255 - DNA, 103 bp, Artificial Sequence
  Synthetic Polynucleotide
taatacgactcactatagggctgcttcttctgcgagggcttcgagatgacaacagaggagagtcatcatgaagccctcgaacctggcggcagcgcaaaagatg

SEQ ID NO: 192256 - DNA, 103 bp, Artificial Sequence
  Synthetic Polynucleotide
taatacgactcactatagggttttcagcgactgcttcttctgcgagggctaacagaggagaagccctatgagaagaagcaacctggcggcagcgcaaaagatg

SEQ ID NO: 192257 - DNA, 103 bp, Artificial Sequence
  Synthetic Polynucleotide
taatacgactcactatagggatctctgatctgtcctgcaggctcaggtgaaacagaggagatcacctatgcctgcaggaaacctggcggcagcgcaaaagatg

SEQ ID NO: 192258 - DNA, 103 bp, Artificial Sequence
  Synthetic Polynucleotide
taatacgactcactatagggagatcggtgtttttcagcgactgcttcttcaacagaggagagaagaaatggtcgctgaaaacctggcggcagcgcaaaagatg

SEQ ID NO: 192259 - DNA, 103 bp, Artificial Sequence
  Synthetic Polynucleotide
taatacgactcactatagggggatatgcacagatcggtgtttttcagcgaaacagaggagatcgctgatgaacaccgataacctggcggcagcgcaaaagatg

SEQ ID NO: 192260 - DNA, 103 bp, Artificial Sequence
  Synthetic Polynucleotide
taatacgactcactatagggttgagccggaggatatgcacagatcggtgtaacagaggagaacaccgatgtgtgcatataacctggcggcagcgcaaaagatg

SEQ ID NO: 192261 - DNA, 103 bp, Artificial Sequence
  Synthetic Polynucleotide
taatacgactcactatagggagggagacctttgagccggaggatatgcacaacagaggagagtgcatatgctccggctcaacctggcggcagcgcaaaagatg

SEQ ID NO: 192262 - DNA, 103 bp, Artificial Sequence
  Synthetic Polynucleotide
taatacgactcactataggggcggttgaagagggagacctttgagccggaaacagaggagatccggcatgaaggtctccaacctggcggcagcgcaaaagatg

SEQ ID NO: 192263 - DNA, 103 bp, Artificial Sequence
  Synthetic Polynucleotide
taatacgactcactataggggagagcgcaggcggttgaagagggagacctaacagaggagaaggtctatgtcttcaaccaacctggcggcagcgcaaaagatg

SEQ ID NO: 192264 - DNA, 103 bp, Artificial Sequence
  Synthetic Polynucleotide
taatacgactcactataggggagaccgtctgagagcgcaggcggttgaagaacagaggagacttcaaatgcctgcgctcaacctggcggcagcgcaaaagatg

SEQ ID NO: 192265 - DNA, 103 bp, Artificial Sequence
  Synthetic Polynucleotide
taatacgactcactataggggtagcgtgtggagaccgtctgagagcgcagaacagaggagactgcgcatgcagacggtcaacctggcggcagcgcaaaagatg

SEQ ID NO: 192266 - DNA, 103 bp, Artificial Sequence
  Synthetic Polynucleotide
taatacgactcactatagggccacagagaggtagcgtgtggagaccgtctaacagaggagaagacggatgccacacgctaacctggcggcagcgcaaaagatg

SEQ ID NO: 192267 - DNA, 103 bp, Artificial Sequence
  Synthetic Polynucleotide
taatacgactcactataggggccccatcctccacagagaggtagcgtgtgaacagaggagacacacgatgcctctctgtaacctggcggcagcgcaaaagatg

SEQ ID NO: 192268 - DNA, 103 bp, Artificial Sequence
  Synthetic Polynucleotide
taatacgactcactatagggctgcagctgcatctctgatctgtcctgcagaacagaggagactgcagatgagatcagagaacctggcggcagcgcaaaagatg

SEQ ID NO: 192269 - DNA, 103 bp, Artificial Sequence
  Synthetic Polynucleotide
taatacgactcactatagggggccacaaaggccccatcctccacagagagaacagaggagactctctatggaggatgggaacctggcggcagcgcaaaagatg

SEQ ID NO: 192270 - DNA, 103 bp, Artificial Sequence
  Synthetic Polynucleotide
taatacgactcactataggggtcgtgcactggccacaaaggccccatcctaacagaggagaaggatgatgcctttgtggaacctggcggcagcgcaaaagatg

SEQ ID NO: 192271 - DNA, 103 bp, Artificial Sequence
  Synthetic Polynucleotide
taatacgactcactataggggcagcccactgtcgtgcactggccacaaagaacagaggagactttgtatgcagtgcacgaacctggcggcagcgcaaaagatg

SEQ ID NO: 192272 - DNA, 103 bp, Artificial Sequence
  Synthetic Polynucleotide
taatacgactcactataggggagcgtgaaggcagcccactgtcgtgcactaacagaggagaagtgcaatgcagtgggctaacctggcggcagcgcaaaagatg

SEQ ID NO: 192273 - DNA, 103 bp, Artificial Sequence
  Synthetic Polynucleotide
taatacgactcactatagggcagccaggtggagcgtgaaggcagcccactaacagaggagaagtgggatgccttcacgcaacctggcggcagcgcaaaagatg

SEQ ID NO: 192274 - DNA, 103 bp, Artificial Sequence
  Synthetic Polynucleotide
taatacgactcactataggggagtgcccatcagccaggtggagcgtgaagaacagaggagacttcacatgccacctggcaacctggcggcagcgcaaaagatg

SEQ ID NO: 192275 - DNA, 103 bp, Artificial Sequence
  Synthetic Polynucleotide
taatacgactcactatagggtccttgggcagagtgcccatcagccaggtgaacagaggagacacctgatggatgggcacaacctggcggcagcgcaaaagatg

SEQ ID NO: 192276 - DNA, 103 bp, Artificial Sequence
  Synthetic Polynucleotide
taatacgactcactataggggtgggaagtctccttgggcagagtgcccataacagaggagaatgggcatgctgcccaagaacctggcggcagcgcaaaagatg

SEQ ID NO: 192277 - DNA, 103 bp, Artificial Sequence
  Synthetic Polynucleotide
taatacgactcactatagggccctctcgcggtgggaagtctccttgggcaaacagaggagatgcccaatgagacttcccaacctggcggcagcgcaaaagatg

SEQ ID NO: 192278 - DNA, 103 bp, Artificial Sequence
  Synthetic Polynucleotide
taatacgactcactataggggcgaacgtagccctctcgcggtgggaagtcaacagaggagagacttcatgccgcgagagaacctggcggcagcgcaaaagatg

SEQ ID NO: 192279 - DNA, 103 bp, Artificial Sequence
  Synthetic Polynucleotide
taatacgactcactatagggcggcttcgctctgcagctgcatctctgatcaacagaggagagatcagatgtgcagctgcaacctggcggcagcgcaaaagatg

SEQ ID NO: 192280 - DNA, 103 bp, Artificial Sequence
  Synthetic Polynucleotide
taatacgactcactataggggggagccatagcgaacgtagccctctcgcgaacagaggagacgcgagatggctacgttcaacctggcggcagcgcaaaagatg

SEQ ID NO: 192281 - DNA, 103 bp, Artificial Sequence
  Synthetic Polynucleotide
taatacgactcactatagggagctgcaccagggagccatagcgaacgtagaacagaggagactacgtatgctatggctcaacctggcggcagcgcaaaagatg

SEQ ID NO: 192282 - DNA, 103 bp, Artificial Sequence
  Synthetic Polynucleotide
taatacgactcactatagggcgtgcagacgagctgcaccagggagccataaacagaggagatatggcatgctggtgcagaacctggcggcagcgcaaaagatg

SEQ ID NO: 192283 - DNA, 103 bp, Artificial Sequence
  Synthetic Polynucleotide
taatacgactcactatagggtgccggtgaccgtgcagacgagctgcaccaaacagaggagatggtgcatgtcgtctgcaaacctggcggcagcgcaaaagatg

SEQ ID NO: 192284 - DNA, 103 bp, Artificial Sequence
  Synthetic Polynucleotide
taatacgactcactatagggggtagtgtgatgccggtgaccgtgcagacgaacagaggagacgtctgatgggtcaccggaacctggcggcagcgcaaaagatg

SEQ ID NO: 192285 - DNA, 103 bp, Artificial Sequence
  Synthetic Polynucleotide
taatacgactcactataggggatcatgggaggtagtgtgatgccggtgacaacagaggagagtcaccatgatcacactaaacctggcggcagcgcaaaagatg

SEQ ID NO: 192286 - DNA, 103 bp, Artificial Sequence
  Synthetic Polynucleotide
taatacgactcactatagggctttacggatgatcatgggaggtagtgtgaaacagaggagatcacacatgctcccatgaaacctggcggcagcgcaaaagatg

SEQ ID NO: 192287 - DNA, 103 bp, Artificial Sequence
  Synthetic Polynucleotide
taatacgactcactatagggtgttttgctactttacggatgatcatgggaaacagaggagatcccatatgcatccgtaaaacctggcggcagcgcaaaagatg

SEQ ID NO: 192288 - DNA, 103 bp, Artificial Sequence
  Synthetic Polynucleotide
taatacgactcactataggggagcgcacactgttttgctactttacggataacagaggagaatccgtatggtagcaaaaaacctggcggcagcgcaaaagatg

SEQ ID NO: 192289 - DNA, 103 bp, Artificial Sequence
  Synthetic Polynucleotide
taatacgactcactatagggccacatcaaggagcgcacactgttttgctaaacagaggagatagcaaatgagtgtgcgcaacctggcggcagcgcaaaagatg

SEQ ID NO: 192290 - DNA, 103 bp, Artificial Sequence
  Synthetic Polynucleotide
taatacgactcactatagggctccgcctgtcggcttcgctctgcagctgcaacagaggagagcagctatggagcgaagcaacctggcggcagcgcaaaagatg

SEQ ID NO: 192291 - DNA, 103 bp, Artificial Sequence
  Synthetic Polynucleotide
taatacgactcactatagggatgggctcatccacatcaaggagcgcacacaacagaggagagtgtgcatgccttgatgtaacctggcggcagcgcaaaagatg

SEQ ID NO: 192292 - DNA, 103 bp, Artificial Sequence
  Synthetic Polynucleotide
taatacgactcactatagggcagctgggagatgggctcatccacatcaagaacagaggagacttgatatggatgagcccaacctggcggcagcgcaaaagatg

SEQ ID NO: 192293 - DNA, 103 bp, Artificial Sequence
  Synthetic Polynucleotide
taatacgactcactatagggcacacttgtgcagctgggagatgggctcataacagaggagaatgagcatgtctcccagcaacctggcggcagcgcaaaagatg

SEQ ID NO: 192294 - DNA, 103 bp, Artificial Sequence
  Synthetic Polynucleotide
taatacgactcactatagggaactggaatgcacacttgtgcagctgggagaacagaggagactcccaatggcacaagtgaacctggcggcagcgcaaaagatg

SEQ ID NO: 192295 - DNA, 103 bp, Artificial Sequence
  Synthetic Polynucleotide
taatacgactcactatagggactgcctggaaactggaatgcacacttgtgaacagaggagacacaagatggcattccagaacctggcggcagcgcaaaagatg

SEQ ID NO: 192296 - DNA, 103 bp, Artificial Sequence
  Synthetic Polynucleotide
taatacgactcactatagggctcctgggggactgcctggaaactggaatgaacagaggagacattccatgttccaggcaaacctggcggcagcgcaaaagatg

SEQ ID NO: 192297 - DNA, 103 bp, Artificial Sequence
  Synthetic Polynucleotide
taatacgactcactataggggtgccaccccctcctgggggactgcctggaaacagaggagatccaggatgtcccccaggaacctggcggcagcgcaaaagatg

SEQ ID NO: 192298 - DNA, 103 bp, Artificial Sequence
  Synthetic Polynucleotide
taatacgactcactataggggcataagtaggtgccaccccctcctgggggaacagaggagacccccaatggggggtggcaacctggcggcagcgcaaaagatg

SEQ ID NO: 192299 - DNA, 103 bp, Artificial Sequence
  Synthetic Polynucleotide
taatacgactcactatagggctgtggcaaggcataagtaggtgccaccccaacagaggagaggggtgatgcctacttataacctggcggcagcgcaaaagatg

SEQ ID NO: 192300 - DNA, 103 bp, Artificial Sequence
  Synthetic Polynucleotide
taatacgactcactatagggaccaccttctctgtggcaaggcataagtagaacagaggagactacttatgccttgccacaacctggcggcagcgcaaaagatg

SEQ ID NO: 192301 - DNA, 103 bp, Artificial Sequence
  Synthetic Polynucleotide
taatacgactcactatagggctcggggcccttctccaccatggccggcataacagaggagaatgccgatgatggtggagaacctggcggcagcgcaaaagatg

SEQ ID NO: 192302 - DNA, 103 bp, Artificial Sequence
  Synthetic Polynucleotide
taatacgactcactatagggcgaggcgcaggcggccgaggcggcggcggaaacagaggagatccgccatggcctcggccaacctggcggcagcgcaaaagatg

SEQ ID NO: 192303 - DNA, 103 bp, Artificial Sequence
  Synthetic Polynucleotide
taatacgactcactatagggttgtctcagcaccgtggtagcagcagtggcaacagaggagagccactatggctaccacgaacctggcggcagcgcaaaagatg

SEQ ID NO: 192304 - DNA, 103 bp, Artificial Sequence
  Synthetic Polynucleotide
taatacgactcactatagggccatgtctagttgtctcagcaccgtggtagaacagaggagactaccaatgtgctgagacaacctggcggcagcgcaaaagatg

SEQ ID NO: 192305 - DNA, 103 bp, Artificial Sequence
  Synthetic Polynucleotide
taatacgactcactataggggaaaccaattccatgtctagttgtctcagcaacagaggagagctgagatgactagacataacctggcggcagcgcaaaagatg

SEQ ID NO: 192306 - DNA, 103 bp, Artificial Sequence
  Synthetic Polynucleotide
taatacgactcactatagggtcgtttgactgaaaccaattccatgtctagaacagaggagactagacatggaattggttaacctggcggcagcgcaaaagatg

SEQ ID NO: 192307 - DNA, 103 bp, Artificial Sequence
  Synthetic Polynucleotide
taatacgactcactatagggtctggatctgtcgtttgactgaaaccaattaacagaggagaaattggatgcagtcaaacaacctggcggcagcgcaaaagatg

SEQ ID NO: 192308 - DNA, 103 bp, Artificial Sequence
  Synthetic Polynucleotide
taatacgactcactatagggtgtttaatattctggatctgtcgtttgactaacagaggagaagtcaaatgacagatccaaacctggcggcagcgcaaaagatg

SEQ ID NO: 192309 - DNA, 103 bp, Artificial Sequence
  Synthetic Polynucleotide
taatacgactcactatagggactgtttgtctgtttaatattctggatctgaacagaggagacagatcatgaatattaaaaacctggcggcagcgcaaaagatg

SEQ ID NO: 192310 - DNA, 103 bp, Artificial Sequence
  Synthetic Polynucleotide
taatacgactcactatagggctttgagagcactgtttgtctgtttaatataacagaggagaatattaatgagacaaacaaacctggcggcagcgcaaaagatg

SEQ ID NO: 192311 - DNA, 103 bp, Artificial Sequence
  Synthetic Polynucleotide
taatacgactcactatagggtcaagtttttctttgagagcactgtttgtcaacagaggagagacaaaatgtgctctcaaaacctggcggcagcgcaaaagatg

SEQ ID NO: 192312 - DNA, 103 bp, Artificial Sequence
  Synthetic Polynucleotide
taatacgactcactatagggtattccaccatcaagtttttctttgagagcaacagaggagagctctcatggaaaaacttaacctggcggcagcgcaaaagatg

SEQ ID NO: 192313 - DNA, 103 bp, Artificial Sequence
  Synthetic Polynucleotide
taatacgactcactatagggtggcggctggcgaggcgcaggcggccgaggaacagaggagacctcggatgcctgcgcctaacctggcggcagcgcaaaagatg

SEQ ID NO: 192314 - DNA, 103 bp, Artificial Sequence
  Synthetic Polynucleotide
taatacgactcactataggggatatggttctattccaccatcaagtttttaacagaggagaaaaaacatgatggtggaaaacctggcggcagcgcaaaagatg

SEQ ID NO: 192315 - DNA, 103 bp, Artificial Sequence
  Synthetic Polynucleotide
taatacgactcactatagggtctggaagtcgatatggttctattccaccaaacagaggagatggtggatgagaaccataaacctggcggcagcgcaaaagatg

SEQ ID NO: 192316 - DNA, 103 bp, Artificial Sequence
  Synthetic Polynucleotide
taatacgactcactatagggctgaatgacctctggaagtcgatatggttcaacagaggagagaaccaatgcgacttccaaacctggcggcagcgcaaaagatg

SEQ ID NO: 192317 - DNA, 103 bp, Artificial Sequence
  Synthetic Polynucleotide
taatacgactcactatagggcattacatttctgaatgacctctggaagtcaacagaggagagacttcatgaggtcattcaacctggcggcagcgcaaaagatg

SEQ ID NO: 192318 - DNA, 103 bp, Artificial Sequence
  Synthetic Polynucleotide
taatacgactcactataggggtccaacgtgcattacatttctgaatgaccaacagaggagaggtcatatggaaatgtaaaacctggcggcagcgcaaaagatg

SEQ ID NO: 192319 - DNA, 103 bp, Artificial Sequence
  Synthetic Polynucleotide
taatacgactcactatagggctcttctgtagtccaacgtgcattacatttaacagaggagaaaatgtatggcacgttggaacctggcggcagcgcaaaagatg

SEQ ID NO: 192320 - DNA, 103 bp, Artificial Sequence
  Synthetic Polynucleotide
taatacgactcactatagggcgagaagctgctcttctgtagtccaacgtgaacagaggagacacgttatgctacagaagaacctggcggcagcgcaaaagatg

SEQ ID NO: 192321 - DNA, 103 bp, Artificial Sequence
  Synthetic Polynucleotide
taatacgactcactataggggcttgtacggcgagaagctgctcttctgtaaacagaggagatacagaatggcagcttctaacctggcggcagcgcaaaagatg

SEQ ID NO: 192322 - DNA, 103 bp, Artificial Sequence
  Synthetic Polynucleotide
taatacgactcactatagggtttcctgatggcttgtacggcgagaagctgaacagaggagacagcttatggccgtacaaaacctggcggcagcgcaaaagatg

SEQ ID NO: 192323 - DNA, 103 bp, Artificial Sequence
  Synthetic Polynucleotide
taatacgactcactatagggctcggccatatttcctgatggcttgtacggaacagaggagaccgtacatgccatcaggaaacctggcggcagcgcaaaagatg

SEQ ID NO: 192324 - DNA, 103 bp, Artificial Sequence
  Synthetic Polynucleotide
taatacgactcactataggggaggcggcagtggcggctggcgaggcgcagaacagaggagactgcgcatggccagccgcaacctggcggcagcgcaaaagatg

SEQ ID NO: 192325 - DNA, 103 bp, Artificial Sequence
  Synthetic Polynucleotide
taatacgactcactataggggcctgaaaatctcggccatatttcctgatgaacagaggagacatcagatgatatggccgaacctggcggcagcgcaaaagatg

SEQ ID NO: 192326 - DNA, 103 bp, Artificial Sequence
  Synthetic Polynucleotide
taatacgactcactataggggtctgagattgcctgaaaatctcggccataaacagaggagatatggcatggattttcagaacctggcggcagcgcaaaagatg

SEQ ID NO: 192327 - DNA, 103 bp, Artificial Sequence
  Synthetic Polynucleotide
taatacgactcactatagggtcccaatcacgtctgagattgcctgaaaataacagaggagaattttcatgcaatctcagaacctggcggcagcgcaaaagatg

SEQ ID NO: 192328 - DNA, 103 bp, Artificial Sequence
  Synthetic Polynucleotide
taatacgactcactatagggactgatttgttcccaatcacgtctgagattaacagaggagaaatctcatgcgtgattggaacctggcggcagcgcaaaagatg

SEQ ID NO: 192329 - DNA, 103 bp, Artificial Sequence
  Synthetic Polynucleotide
taatacgactcactatagggcacttgtaccactgatttgttcccaatcacaacagaggagagtgattatgaacaaatcaaacctggcggcagcgcaaaagatg

SEQ ID NO: 192330 - DNA, 103 bp, Artificial Sequence
  Synthetic Polynucleotide
taatacgactcactatagggaaaagtttttcacttgtaccactgatttgtaacagaggagaacaaatatgtggtacaagaacctggcggcagcgcaaaagatg

SEQ ID NO: 192331 - DNA, 103 bp, Artificial Sequence
  Synthetic Polynucleotide
taatacgactcactatagggtaatttacaaaaaagtttttcacttgtaccaacagaggagaggtacaatggaaaaacttaacctggcggcagcgcaaaagatg

SEQ ID NO: 192332 - DNA, 103 bp, Artificial Sequence
  Synthetic Polynucleotide
taatacgactcactataggggcggcgtcgataatttacaaaaaagtttttaacagaggagaaaaaacatgtttgtaaataacctggcggcagcgcaaaagatg

SEQ ID NO: 192333 - DNA, 103 bp, Artificial Sequence
  Synthetic Polynucleotide
taatacgactcactatagggctatgttgaagcggcgtcgataatttacaaaacagaggagattgtaaatgatcgacgccaacctggcggcagcgcaaaagatg

SEQ ID NO: 192334 - DNA, 103 bp, Artificial Sequence
  Synthetic Polynucleotide
taatacgactcactatagggaaaacttcatctatgttgaagcggcgtcgaaacagaggagatcgacgatgcttcaacataacctggcggcagcgcaaaagatg

SEQ ID NO: 192335 - DNA, 103 bp, Artificial Sequence
  Synthetic Polynucleotide
taatacgactcactatagggggcggcgcccgaggcggcagtggcggctggaacagaggagaccagccatgactgccgccaacctggcggcagcgcaaaagatg

SEQ ID NO: 192336 - DNA, 103 bp, Artificial Sequence
  Synthetic Polynucleotide
taatacgactcactatagggccattcttgtaaaacttcatctatgttgaaaacagaggagattcaacatggatgaagttaacctggcggcagcgcaaaagatg

SEQ ID NO: 192337 - DNA, 103 bp, Artificial Sequence
  Synthetic Polynucleotide
taatacgactcactataggggttctgcctcccattcttgtaaaacttcataacagaggagaatgaagatgtacaagaataacctggcggcagcgcaaaagatg

SEQ ID NO: 192338 - DNA, 103 bp, Artificial Sequence
  Synthetic Polynucleotide
taatacgactcactatagggtctttaccatgttctgcctcccattcttgtaacagaggagaacaagaatgggaggcagaaacctggcggcagcgcaaaagatg

SEQ ID NO: 192339 - DNA, 103 bp, Artificial Sequence
  Synthetic Polynucleotide
taatacgactcactatagggattggtctcttctttaccatgttctgcctcaacagaggagagaggcaatgcatggtaaaaacctggcggcagcgcaaaagatg

SEQ ID NO: 192340 - DNA, 103 bp, Artificial Sequence
  Synthetic Polynucleotide
taatacgactcactatagggtactgggcccattggtctcttctttaccataacagaggagaatggtaatgaagagaccaaacctggcggcagcgcaaaagatg

SEQ ID NO: 192341 - DNA, 103 bp, Artificial Sequence
  Synthetic Polynucleotide
taatacgactcactatagggggcttctggttactgggcccattggtctctaacagaggagaagagacatgtgggcccagaacctggcggcagcgcaaaagatg

SEQ ID NO: 192342 - DNA, 103 bp, Artificial Sequence
  Synthetic Polynucleotide
taatacgactcactatagggggacttcacaggcttctggttactgggcccaacagaggagagggcccatgaaccagaagaacctggcggcagcgcaaaagatg

SEQ ID NO: 192343 - DNA, 103 bp, Artificial Sequence
  Synthetic Polynucleotide
taatacgactcactatagggaattatctggggacttcacaggcttctggtaacagaggagaaccagaatgctgtgaagtaacctggcggcagcgcaaaagatg

SEQ ID NO: 192344 - DNA, 103 bp, Artificial Sequence
  Synthetic Polynucleotide
taatacgactcactatagggatcttaatggaattatctggggacttcacaaacagaggagatgtgaaatgcccagataaaacctggcggcagcgcaaaagatg

SEQ ID NO: 192345 - DNA, 103 bp, Artificial Sequence
  Synthetic Polynucleotide
taatacgactcactatagggctcttcgggcatcttaatggaattatctggaacagaggagaccagatatgtccattaagaacctggcggcagcgcaaaagatg

SEQ ID NO: 192346 - DNA, 103 bp, Artificial Sequence
  Synthetic Polynucleotide
taatacgactcactatagggctgaggaggcggcggcgcccgaggcggcagaacagaggagactgccgatgcgggcgccgaacctggcggcagcgcaaaagatg

SEQ ID NO: 192347 - DNA, 103 bp, Artificial Sequence
  Synthetic Polynucleotide
taatacgactcactatagggcctcgtcttcctcttcgggcatcttaatggaacagaggagaccattaatgtgcccgaagaacctggcggcagcgcaaaagatg

SEQ ID NO: 192348 - DNA, 103 bp, Artificial Sequence
  Synthetic Polynucleotide
taatacgactcactatagggagaacaggagcctcgtcttcctcttcgggcaacagaggagagcccgaatgggaagacgaaacctggcggcagcgcaaaagatg

SEQ ID NO: 192349 - DNA, 103 bp, Artificial Sequence
  Synthetic Polynucleotide
taatacgactcactatagggtctgacatccagaacaggagcctcgtcttcaacagaggagagaagacatggctcctgttaacctggcggcagcgcaaaagatg

SEQ ID NO: 192350 - DNA, 103 bp, Artificial Sequence
  Synthetic Polynucleotide
taatacgactcactatagggcagatgcatatctgacatccagaacaggagaacagaggagactcctgatgtggatgtcaaacctggcggcagcgcaaaagatg

SEQ ID NO: 192351 - DNA, 103 bp, Artificial Sequence
  Synthetic Polynucleotide
taatacgactcactataggggcggccgaggctgaggaggcggcggcgcccaacagaggagagggcgcatgcgcctcctcaacctggcggcagcgcaaaagatg

SEQ ID NO: 192352 - DNA, 103 bp, Artificial Sequence
  Synthetic Polynucleotide
taatacgactcactatagggtgaggcggcggcggccgaggctgaggaggcaacagaggagagcctccatggcctcggccaacctggcggcagcgcaaaagatg

SEQ ID NO: 192353 - DNA, 103 bp, Artificial Sequence
  Synthetic Polynucleotide
taatacgactcactatagggcggcggcggctgaggcggcggcggccgaggaacagaggagacctcggatgccgccgcctaacctggcggcagcgcaaaagatg

SEQ ID NO: 192354 - DNA, 103 bp, Artificial Sequence
  Synthetic Polynucleotide
taatacgactcactatagggttattgggggcggcggcggctgaggcggcgaacagaggagacgccgcatgagccgccgcaacctggcggcagcgcaaaagatg

SEQ ID NO: 192355 - DNA, 103 bp, Artificial Sequence
  Synthetic Polynucleotide
taatacgactcactatagggattctggccattattgggggcggcggcggcaacagaggagagccgccatggcccccaataacctggcggcagcgcaaaagatg

SEQ ID NO: 192356 - DNA, 103 bp, Artificial Sequence
  Synthetic Polynucleotide
taatacgactcactatagggtccctgagacctcggggcccttctccaccaaacagaggagatggtggatgagggccccgaacctggcggcagcgcaaaagatg

SEQ ID NO: 192357 - DNA, 103 bp, Artificial Sequence
  Synthetic Polynucleotide
taatacgactcactatagggccaaacttttattctggccattattgggggaacagaggagacccccaatgatggccagaaacctggcggcagcgcaaaagatg

SEQ ID NO: 192358 - DNA, 103 bp, Artificial Sequence
  Synthetic Polynucleotide
taatacgactcactataggggccgccgccgccaaacttttattctggccaaacagaggagatggccaatgtaaaagtttaacctggcggcagcgcaaaagatg

SEQ ID NO: 192359 - DNA, 103 bp, Artificial Sequence
  Synthetic Polynucleotide
taatacgactcactataggggccattgggcgccgccgccgccaaacttttaacagaggagaaaaagtatggcggcggcgaacctggcggcagcgcaaaagatg

SEQ ID NO: 192360 - DNA, 103 bp, Artificial Sequence
  Synthetic Polynucleotide
taatacgactcactatagggtgctgctgttgccattgggcgccgccgccgaacagaggagacggcggatgcgcccaatgaacctggcggcagcgcaaaagatg

SEQ ID NO: 192361 - DNA, 103 bp, Artificial Sequence
  Synthetic Polynucleotide
taatacgactcactatagggcaggagttgctgctgctgttgccattgggcaacagaggagagcccaaatgcaacagcagaacctggcggcagcgcaaaagatg

SEQ ID NO: 192362 - DNA, 103 bp, Artificial Sequence
  Synthetic Polynucleotide
taatacgactcactataggggccttcctcccaggagttgctgctgctgttaacagaggagaaacagcatgagcaactccaacctggcggcagcgcaaaagatg

SEQ ID NO: 192363 - DNA, 103 bp, Artificial Sequence
  Synthetic Polynucleotide
taatacgactcactatagggagcccgagctgccttcctcccaggagttgcaacagaggagagcaactatggggaggaagaacctggcggcagcgcaaaagatg

SEQ ID NO: 192364 - DNA, 103 bp, Artificial Sequence
  Synthetic Polynucleotide
taatacgactcactatagggtcgctggacgagcccgagctgccttcctccaacagaggagaggaggaatgcagctcgggaacctggcggcagcgcaaaagatg

SEQ ID NO: 192365 - DNA, 103 bp, Artificial Sequence
  Synthetic Polynucleotide
taatacgactcactataggggtgctcctcgtcgctggacgagcccgagctaacagaggagaagctcgatgtcgtccagcaacctggcggcagcgcaaaagatg

SEQ ID NO: 192366 - DNA, 103 bp, Artificial Sequence
  Synthetic Polynucleotide
taatacgactcactatagggcaccgccaccgtgctcctcgtcgctggacgaacagaggagacgtccaatgacgaggagcaacctggcggcagcgcaaaagatg

SEQ ID NO: 192367 - DNA, 103 bp, Artificial Sequence
  Synthetic Polynucleotide
taatacgactcactatagggcctctccgcttccctgagacctcggggcccaacagaggagagggcccatgggtctcaggaacctggcggcagcgcaaaagatg

SEQ ID NO: 192368 - DNA, 103 bp, Artificial Sequence
  Synthetic Polynucleotide
taatacgactcactatagggaccctcatgccaccgccaccgtgctcctcgaacagaggagacgaggaatgcggtggcggaacctggcggcagcgcaaaagatg

SEQ ID NO: 192369 - DNA, 103 bp, Artificial Sequence
  Synthetic Polynucleotide
taatacgactcactatagggctggggtccgaccctcatgccaccgccaccaacagaggagaggtggcatgggcatgaggaacctggcggcagcgcaaaagatg

SEQ ID NO: 192370 - DNA, 103 bp, Artificial Sequence
  Synthetic Polynucleotide
taatacgactcactatagggccgcctggtactggggtccgaccctcatgcaacagaggagagcatgaatgtcggaccccaacctggcggcagcgcaaaagatg

SEQ ID NO: 192371 - DNA, 103 bp, Artificial Sequence
  Synthetic Polynucleotide
taatacgactcactatagggtcgggcaccaccgcctggtactggggtccgaacagaggagacggaccatggtaccaggcaacctggcggcagcgcaaaagatg

SEQ ID NO: 192372 - DNA, 103 bp, Artificial Sequence
  Synthetic Polynucleotide
taatacgactcactatagggggggtcgaagtcgggcaccaccgcctggtaaacagaggagataccagatggtggtgcccaacctggcggcagcgcaaaagatg

SEQ ID NO: 192373 - DNA, 103 bp, Artificial Sequence
  Synthetic Polynucleotide
taatacgactcactatagggccagtttggcggggtcgaagtcgggcaccaaacagaggagatggtgcatgacttcgaccaacctggcggcagcgcaaaagatg

SEQ ID NO: 192374 - DNA, 103 bp, Artificial Sequence
  Synthetic Polynucleotide
taatacgactcactatagggctgcgtcttgccagtttggcggggtcgaagaacagaggagacttcgaatgcgccaaactaacctggcggcagcgcaaaagatg

SEQ ID NO: 192375 - DNA, 103 bp, Artificial Sequence
  Synthetic Polynucleotide
taatacgactcactatagggccgttcttgactgcgtcttgccagtttggcaacagaggagagccaaaatggcaagacgcaacctggcggcagcgcaaaagatg

SEQ ID NO: 192376 - DNA, 103 bp, Artificial Sequence
  Synthetic Polynucleotide
taatacgactcactatagggcaagattgtcccgttcttgactgcgtcttgaacagaggagacaagacatggtcaagaacaacctggcggcagcgcaaaagatg

SEQ ID NO: 192377 - DNA, 103 bp, Artificial Sequence
  Synthetic Polynucleotide
taatacgactcactatagggaccaacatgccaagattgtcccgttcttgaaacagaggagatcaagaatgggacaatctaacctggcggcagcgcaaaagatg

SEQ ID NO: 192378 - DNA, 103 bp, Artificial Sequence
  Synthetic Polynucleotide
taatacgactcactataggggttgttcctccctctccgcttccctgagacaacagaggagagtctcaatgaagcggagaaacctggcggcagcgcaaaagatg

SEQ ID NO: 192379 - DNA, 103 bp, Artificial Sequence
  Synthetic Polynucleotide
taatacgactcactataggggggtgaccagaccaacatgccaagattgtcaacagaggagagacaatatgggcatgttgaacctggcggcagcgcaaaagatg

SEQ ID NO: 192380 - DNA, 103 bp, Artificial Sequence
  Synthetic Polynucleotide
taatacgactcactataggggattttgattgggtgaccagaccaacatgcaacagaggagagcatgtatgtctggtcacaacctggcggcagcgcaaaagatg

SEQ ID NO: 192381 - DNA, 103 bp, Artificial Sequence
  Synthetic Polynucleotide
taatacgactcactataggggcttctgacagattttgattgggtgaccagaacagaggagactggtcatgcaatcaaaaaacctggcggcagcgcaaaagatg

SEQ ID NO: 192382 - DNA, 103 bp, Artificial Sequence
  Synthetic Polynucleotide
taatacgactcactatagggatccaactttgcttctgacagattttgattaacagaggagaaatcaaatgctgtcagaaaacctggcggcagcgcaaaagatg

SEQ ID NO: 192383 - DNA, 103 bp, Artificial Sequence
  Synthetic Polynucleotide
taatacgactcactatagggcaatgtattcatccaactttgcttctgacaaacagaggagatgtcagatgcaaagttggaacctggcggcagcgcaaaagatg

SEQ ID NO: 192384 - DNA, 103 bp, Artificial Sequence
  Synthetic Polynucleotide
taatacgactcactatagggttggcaatggcaatgtattcatccaactttaacagaggagaaaagttatgtgaatacataacctggcggcagcgcaaaagatg

SEQ ID NO: 192385 - DNA, 103 bp, Artificial Sequence
  Synthetic Polynucleotide
taatacgactcactatagggatgcttttctttggcaatggcaatgtattcaacagaggagagaatacatggccattgccaacctggcggcagcgcaaaagatg

SEQ ID NO: 192386 - DNA, 103 bp, Artificial Sequence
  Synthetic Polynucleotide
taatacgactcactatagggtgttgtacccatgcttttctttggcaatggaacagaggagaccattgatgaagaaaagcaacctggcggcagcgcaaaagatg

SEQ ID NO: 192387 - DNA, 103 bp, Artificial Sequence
  Synthetic Polynucleotide
taatacgactcactataggggcctgttccatgttgtacccatgcttttctaacagaggagaagaaaaatgtgggtacaaaacctggcggcagcgcaaaagatg

SEQ ID NO: 192388 - DNA, 103 bp, Artificial Sequence
  Synthetic Polynucleotide
taatacgactcactatagggcatcccaagagcctgttccatgttgtacccaacagaggagagggtacatgatggaacagaacctggcggcagcgcaaaagatg

SEQ ID NO: 192389 - DNA, 103 bp, Artificial Sequence
  Synthetic Polynucleotide
taatacgactcactatagggaggcggccgcgttgttcctccctctccgctaacagaggagaagcggaatgggaggaacaaacctggcggcagcgcaaaagatg

SEQ ID NO: 192390 - DNA, 103 bp, Artificial Sequence
  Synthetic Polynucleotide
taatacgactcactataggggccagaagagcatcccaagagcctgttccaaacagaggagatggaacatgctcttgggaaacctggcggcagcgcaaaagatg

SEQ ID NO: 192391 - DNA, 103 bp, Artificial Sequence
  Synthetic Polynucleotide
taatacgactcactatagggttatgtttatgccagaagagcatcccaagaaacagaggagatcttggatggctcttctgaacctggcggcagcgcaaaagatg

SEQ ID NO: 192392 - DNA, 103 bp, Artificial Sequence
  Synthetic Polynucleotide
taatacgactcactatagggcttttcgatattatgtttatgccagaagagaacagaggagactcttcatgcataaacataacctggcggcagcgcaaaagatg

SEQ ID NO: 192393 - DNA, 103 bp, Artificial Sequence
  Synthetic Polynucleotide
taatacgactcactatagggcagccaatgacttttcgatattatgtttataacagaggagaataaacatgatatcgaaaaacctggcggcagcgcaaaagatg

SEQ ID NO: 192394 - DNA, 103 bp, Artificial Sequence
  Synthetic Polynucleotide
taatacgactcactatagggttgggcaaatcagccaatgacttttcgataaacagaggagatatcgaatggtcattggcaacctggcggcagcgcaaaagatg

SEQ ID NO: 192395 - DNA, 103 bp, Artificial Sequence
  Synthetic Polynucleotide
taatacgactcactatagggaggggtaaagttgggcaaatcagccaatgaaacagaggagatcattgatggatttgcccaacctggcggcagcgcaaaagatg

SEQ ID NO: 192396 - DNA, 103 bp, Artificial Sequence
  Synthetic Polynucleotide
taatacgactcactatagggcatctgggaaaggggtaaagttgggcaaataacagaggagaatttgcatgactttacccaacctggcggcagcgcaaaagatg

SEQ ID NO: 192397 - DNA, 103 bp, Artificial Sequence
  Synthetic Polynucleotide
taatacgactcactatagggacagtccactcatctgggaaaggggtaaagaacagaggagactttacatgtttcccagaaacctggcggcagcgcaaaagatg

SEQ ID NO: 192398 - DNA, 103 bp, Artificial Sequence
  Synthetic Polynucleotide
taatacgactcactatagggtttatcttccacagtccactcatctgggaaaacagaggagattcccaatggagtggactaacctggcggcagcgcaaaagatg

SEQ ID NO: 192399 - DNA, 103 bp, Artificial Sequence
  Synthetic Polynucleotide
taatacgactcactatagggcaaataagactttatcttccacagtccactaacagaggagaagtggaatgtggaagataaacctggcggcagcgcaaaagatg

SEQ ID NO: 192400 - DNA, 103 bp, Artificial Sequence
  Synthetic Polynucleotide
taatacgactcactataggggcggaggcggaggcggccgcgttgttcctcaacagaggagagaggaaatgcgcggccgcaacctggcggcagcgcaaaagatg

SEQ ID NO: 192401 - DNA, 103 bp, Artificial Sequence
  Synthetic Polynucleotide
taatacgactcactatagggaaggcttgctcaaataagactttatcttccaacagaggagaggaagaatgagtcttattaacctggcggcagcgcaaaagatg

SEQ ID NO: 192402 - DNA, 103 bp, Artificial Sequence
  Synthetic Polynucleotide
taatacgactcactatagggatgaaaactaaaggcttgctcaaataagacaacagaggagagtcttaatggagcaagccaacctggcggcagcgcaaaagatg

SEQ ID NO: 192403 - DNA, 103 bp, Artificial Sequence
  Synthetic Polynucleotide
taatacgactcactatagggaagttttcccatgaaaactaaaggcttgctaacagaggagaagcaagatgttagttttcaacctggcggcagcgcaaaagatg

SEQ ID NO: 192404 - DNA, 103 bp, Artificial Sequence
  Synthetic Polynucleotide
taatacgactcactatagggattctatgaaaagttttcccatgaaaactaaacagaggagatagtttatgtgggaaaacaacctggcggcagcgcaaaagatg

SEQ ID NO: 192405 - DNA, 103 bp, Artificial Sequence
  Synthetic Polynucleotide
taatacgactcactatagggcatttgttggattctatgaaaagttttcccaacagaggagagggaaaatgtttcatagaaacctggcggcagcgcaaaagatg

SEQ ID NO: 192406 - DNA, 103 bp, Artificial Sequence
  Synthetic Polynucleotide
taatacgactcactatagggtatctggaagcatttgttggattctatgaaaacagaggagattcataatgtccaacaaaaacctggcggcagcgcaaaagatg

SEQ ID NO: 192407 - DNA, 103 bp, Artificial Sequence
  Synthetic Polynucleotide
taatacgactcactataggggctatagatttatctggaagcatttgttggaacagaggagaccaacaatggcttccagaaacctggcggcagcgcaaaagatg

SEQ ID NO: 192408 - DNA, 103 bp, Artificial Sequence
  Synthetic Polynucleotide
taatacgactcactatagggcaccagacttgctatagatttatctggaagaacagaggagacttccaatgaaatctataaacctggcggcagcgcaaaagatg

SEQ ID NO: 192409 - DNA, 103 bp, Artificial Sequence
  Synthetic Polynucleotide
taatacgactcactatagggagtaaaatttcaccagacttgctatagattaacagaggagaaatctaatgcaagtctggaacctggcggcagcgcaaaagatg

SEQ ID NO: 192410 - DNA, 103 bp, Artificial Sequence
  Synthetic Polynucleotide
taatacgactcactatagggttccaagaatagtaaaatttcaccagacttaacagaggagaaagtctatggaaattttaaacctggcggcagcgcaaaagatg

SEQ ID NO: 192411 - DNA, 103 bp, Artificial Sequence
  Synthetic Polynucleotide
taatacgactcactatagggggcggcggcggcggaggcggaggcggccgcaacagaggagagcggccatgtccgcctccaacctggcggcagcgcaaaagatg

SEQ ID NO: 192412 - DNA, 103 bp, Artificial Sequence
  Synthetic Polynucleotide
taatacgactcactatagggcctcgtcttcttccaagaatagtaaaatttaacagaggagaaaatttatgtattcttggaacctggcggcagcgcaaaagatg

SEQ ID NO: 192413 - DNA, 103 bp, Artificial Sequence
  Synthetic Polynucleotide
taatacgactcactatagggtagttttagtcctcgtcttcttccaagaataacagaggagaattcttatgagaagacgaaacctggcggcagcgcaaaagatg

SEQ ID NO: 192414 - DNA, 103 bp, Artificial Sequence
  Synthetic Polynucleotide
taatacgactcactatagggtccatcacactagttttagtcctcgtcttcaacagaggagagaagacatggactaaaacaacctggcggcagcgcaaaagatg

SEQ ID NO: 192415 - DNA, 103 bp, Artificial Sequence
  Synthetic Polynucleotide
taatacgactcactatagggggcatggcgatccatcacactagttttagtaacagaggagaactaaaatgagtgtgatgaacctggcggcagcgcaaaagatg

SEQ ID NO: 192416 - DNA, 103 bp, Artificial Sequence
  Synthetic Polynucleotide
taatacgactcactatagggtttgtttccgggcatggcgatccatcacacaacagaggagagtgtgaatgatcgccatgaacctggcggcagcgcaaaagatg

SEQ ID NO: 192417 - DNA, 103 bp, Artificial Sequence
  Synthetic Polynucleotide
taatacgactcactatagggcgctcccgtttttgtttccgggcatggcgaaacagaggagatcgccaatgccggaaacaaacctggcggcagcgcaaaagatg

SEQ ID NO: 192418 - DNA, 103 bp, Artificial Sequence
  Synthetic Polynucleotide
taatacgactcactataggggctctcctcccgctcccgtttttgtttccgaacagaggagacggaaaatgaaacgggagaacctggcggcagcgcaaaagatg

SEQ ID NO: 192419 - DNA, 103 bp, Artificial Sequence
  Synthetic Polynucleotide
taatacgactcactataggggttcatcctcgctctcctcccgctcccgttaacagaggagaaacgggatggggaggagaaacctggcggcagcgcaaaagatg

SEQ ID NO: 192420 - DNA, 103 bp, Artificial Sequence
  Synthetic Polynucleotide
taatacgactcactataggggcctcttccagttcatcctcgctctcctccaacagaggagaggaggaatgcgaggatgaaacctggcggcagcgcaaaagatg

SEQ ID NO: 192421 - DNA, 103 bp, Artificial Sequence
  Synthetic Polynucleotide
taatacgactcactataggggtttccatttgcctcttccagttcatcctcaacagaggagagaggatatgctggaagagaacctggcggcagcgcaaaagatg

SEQ ID NO: 192422 - DNA, 103 bp, Artificial Sequence
  Synthetic Polynucleotide
taatacgactcactatagggcggcggcggaggcggcggcggcggaggcggaacagaggagaccgcctatgccgccgccgaacctggcggcagcgcaaaagatg

SEQ ID NO: 192423 - DNA, 103 bp, Artificial Sequence
  Synthetic Polynucleotide
taatacgactcactatagggcaatgggattgtttccatttgcctcttccaaacagaggagatggaagatgcaaatggaaaacctggcggcagcgcaaaagatg

SEQ ID NO: 192424 - DNA, 103 bp, Artificial Sequence
  Synthetic Polynucleotide
taatacgactcactatagggacctcaatgtcaatgggattgtttccatttaacagaggagaaaatggatgcaatcccataacctggcggcagcgcaaaagatg

SEQ ID NO: 192425 - DNA, 103 bp, Artificial Sequence
  Synthetic Polynucleotide
taatacgactcactataggggttttgatcaacctcaatgtcaatgggattaacagaggagaaatcccatggacattgagaacctggcggcagcgcaaaagatg

SEQ ID NO: 192426 - DNA, 103 bp, Artificial Sequence
  Synthetic Polynucleotide
taatacgactcactatagggtgctttccttgttttgatcaacctcaatgtaacagaggagaacattgatgttgatcaaaaacctggcggcagcgcaaaagatg

SEQ ID NO: 192427 - DNA, 103 bp, Artificial Sequence
  Synthetic Polynucleotide
taatacgactcactatagggacctcctttttgctttccttgttttgatcaaacagaggagatgatcaatgcaaggaaagaacctggcggcagcgcaaaagatg

SEQ ID NO: 192428 - DNA, 103 bp, Artificial Sequence
  Synthetic Polynucleotide
taatacgactcactatagggagtagggggaacctcctttttgctttccttaacagaggagaaaggaaatgaaaaaggagaacctggcggcagcgcaaaagatg

SEQ ID NO: 192429 - DNA, 103 bp, Artificial Sequence
  Synthetic Polynucleotide
taatacgactcactataggggaactgtctcagtagggggaacctccttttaacagaggagaaaaaggatgttccccctaaacctggcggcagcgcaaaagatg

SEQ ID NO: 192430 - DNA, 103 bp, Artificial Sequence
  Synthetic Polynucleotide
taatacgactcactatagggttgacctgaggaactgtctcagtagggggaaacagaggagatcccccatgtgagacagtaacctggcggcagcgcaaaagatg

SEQ ID NO: 192431 - DNA, 103 bp, Artificial Sequence
  Synthetic Polynucleotide
taatacgactcactatagggtttttcttttttgacctgaggaactgtctcaacagaggagagagacaatgcctcaggtcaacctggcggcagcgcaaaagatg

SEQ ID NO: 192432 - DNA, 103 bp, Artificial Sequence
  Synthetic Polynucleotide
taatacgactcactataggggtgtgctatgtttttcttttttgacctgagaacagaggagactcaggatgaaaaagaaaaacctggcggcagcgcaaaagatg

SEQ ID NO: 192433 - DNA, 103 bp, Artificial Sequence
  Synthetic Polynucleotide
taatacgactcactataggggcggccgaggcggcggcggaggcggcggcgaacagaggagacgccgcatgctccgccgcaacctggcggcagcgcaaaagatg

SEQ ID NO: 192434 - DNA, 103 bp, Artificial Sequence
  Synthetic Polynucleotide
taatacgactcactatagggtttttagcttgtgtgctatgtttttcttttaacagaggagaaaaagaatgacatagcacaacctggcggcagcgcaaaagatg

SEQ ID NO: 192435 - DNA, 103 bp, Artificial Sequence
  Synthetic Polynucleotide
taatacgactcactatagggttttgctctatttttagcttgtgtgctatgaacagaggagacatagcatgcaagctaaaaacctggcggcagcgcaaaagatg

SEQ ID NO: 192436 - DNA, 103 bp, Artificial Sequence
  Synthetic Polynucleotide
taatacgactcactataggggaggtttcctttttgctctatttttagcttaacagaggagaaagctaatgatagagcaaaacctggcggcagcgcaaaagatg

SEQ ID NO: 192437 - DNA, 103 bp, Artificial Sequence
  Synthetic Polynucleotide
taatacgactcactatagggattccttttggaggtttcctttttgctctaaacagaggagatagagcatgaaggaaaccaacctggcggcagcgcaaaagatg

SEQ ID NO: 192438 - DNA, 103 bp, Artificial Sequence
  Synthetic Polynucleotide
taatacgactcactatagggagaaagaaacattccttttggaggtttcctaacagaggagaaggaaaatgccaaaaggaaacctggcggcagcgcaaaagatg

SEQ ID NO: 192439 - DNA, 103 bp, Artificial Sequence
  Synthetic Polynucleotide
taatacgactcactatagggcatcttcttgagaaagaaacattccttttgaacagaggagacaaaagatgtgtttctttaacctggcggcagcgcaaaagatg

SEQ ID NO: 192440 - DNA, 103 bp, Artificial Sequence
  Synthetic Polynucleotide
taatacgactcactatagggacagcctccacatcttcttgagaaagaaacaacagaggagagtttctatgtcaagaagaaacctggcggcagcgcaaaagatg

SEQ ID NO: 192441 - DNA, 103 bp, Artificial Sequence
  Synthetic Polynucleotide
taatacgactcactatagggattggcagaaacagcctccacatcttcttgaacagaggagacaagaaatggtggaggctaacctggcggcagcgcaaaagatg

SEQ ID NO: 192442 - DNA, 103 bp, Artificial Sequence
  Synthetic Polynucleotide
taatacgactcactatagggcagcagtggcattggcagaaacagcctccaaacagaggagatggaggatgtttctgccaaacctggcggcagcgcaaaagatg

SEQ ID NO: 192443 - DNA, 103 bp, Artificial Sequence
  Synthetic Polynucleotide
taatacgactcactatagggaccgtggtagcagcagtggcattggcagaaaacagaggagattctgcatgtgccactgcaacctggcggcagcgcaaaagatg

SEQ ID NO: 192444 - DNA, 103 bp, Artificial Sequence
  Synthetic Polynucleotide
taatacgactcactatagggcgcgctcggcttctccatcactgagggcataacagaggagaatgcccatggtgatggagaacctggcggcagcgcaaaagatg

SEQ ID NO: 192445 - DNA, 103 bp, Artificial Sequence
  Synthetic Polynucleotide
taatacgactcactataggggtgctcctcctcgctgctgtcatcctccgaaacagaggagatcggagatggacagcagcaacctggcggcagcgcaaaagatg

SEQ ID NO: 192446 - DNA, 103 bp, Artificial Sequence
  Synthetic Polynucleotide
taatacgactcactatagggagccaaaagctgctcatctgtggtccagcgaacagaggagacgctggatgacagatgagaacctggcggcagcgcaaaagatg

SEQ ID NO: 192447 - DNA, 103 bp, Artificial Sequence
  Synthetic Polynucleotide
taatacgactcactatagggtggcttgaacagccaaaagctgctcatctgaacagaggagacagatgatgagcttttggaacctggcggcagcgcaaaagatg

SEQ ID NO: 192448 - DNA, 103 bp, Artificial Sequence
  Synthetic Polynucleotide
taatacgactcactatagggtacctacggatggcttgaacagccaaaagcaacagaggagagcttttatgtgttcaagcaacctggcggcagcgcaaaagatg

SEQ ID NO: 192449 - DNA, 103 bp, Artificial Sequence
  Synthetic Polynucleotide
taatacgactcactataggggtctttgccatacctacggatggcttgaacaacagaggagagttcaaatgatccgtaggaacctggcggcagcgcaaaagatg

SEQ ID NO: 192450 - DNA, 103 bp, Artificial Sequence
  Synthetic Polynucleotide
taatacgactcactatagggtagccccaaagtctttgccatacctacggaaacagaggagatccgtaatgatggcaaagaacctggcggcagcgcaaaagatg

SEQ ID NO: 192451 - DNA, 103 bp, Artificial Sequence
  Synthetic Polynucleotide
taatacgactcactatagggacctctgcaatagccccaaagtctttgccaaacagaggagatggcaaatgctttggggcaacctggcggcagcgcaaaagatg

SEQ ID NO: 192452 - DNA, 103 bp, Artificial Sequence
  Synthetic Polynucleotide
taatacgactcactataggggttcccaatcacctctgcaatagccccaaaaacagaggagatttgggatgattgcagagaacctggcggcagcgcaaaagatg

SEQ ID NO: 192453 - DNA, 103 bp, Artificial Sequence
  Synthetic Polynucleotide
taatacgactcactatagggtcagagtcttgttcccaatcacctctgcaaaacagaggagattgcagatgtgattgggaaacctggcggcagcgcaaaagatg

SEQ ID NO: 192454 - DNA, 103 bp, Artificial Sequence
  Synthetic Polynucleotide
taatacgactcactatagggttcacctgggtcagagtcttgttcccaatcaacagaggagagattggatgcaagactctaacctggcggcagcgcaaaagatg

SEQ ID NO: 192455 - DNA, 103 bp, Artificial Sequence
  Synthetic Polynucleotide
taatacgactcactatagggaaagaaagtcttcacctgggtcagagtcttaacagaggagaaagactatgacccaggtgaacctggcggcagcgcaaaagatg

SEQ ID NO: 192456 - DNA, 103 bp, Artificial Sequence
  Synthetic Polynucleotide
taatacgactcactatagggtgtcgtgcgagtgctcctcctcgctgctgtaacagaggagaacagcaatgaggaggagcaacctggcggcagcgcaaaagatg

SEQ ID NO: 192457 - DNA, 103 bp, Artificial Sequence
  Synthetic Polynucleotide
taatacgactcactatagggggtagctcacaaagaaagtcttcacctgggaacagaggagacccaggatgagactttctaacctggcggcagcgcaaaagatg

SEQ ID NO: 192458 - DNA, 103 bp, Artificial Sequence
  Synthetic Polynucleotide
taatacgactcactatagggaagcggcgccggtagctcacaaagaaagtcaacagaggagagactttatgtgtgagctaaacctggcggcagcgcaaaagatg

SEQ ID NO: 192459 - DNA, 103 bp, Artificial Sequence
  Synthetic Polynucleotide
taatacgactcactatagggctccagattgaagcggcgccggtagctcacaacagaggagagtgagcatgcggcgccgcaacctggcggcagcgcaaaagatg

SEQ ID NO: 192460 - DNA, 103 bp, Artificial Sequence
  Synthetic Polynucleotide
taatacgactcactataggggcagcacctcctccagattgaagcggcgccaacagaggagaggcgccatgtcaatctggaacctggcggcagcgcaaaagatg

SEQ ID NO: 192461 - DNA, 103 bp, Artificial Sequence
  Synthetic Polynucleotide
taatacgactcactatagggtcccattcctgcagcacctcctccagattgaacagaggagacaatctatgggaggtgctaacctggcggcagcgcaaaagatg

SEQ ID NO: 192462 - DNA, 103 bp, Artificial Sequence
  Synthetic Polynucleotide
taatacgactcactatagggctgctcagcctcccattcctgcagcacctcaacagaggagagaggtgatgcaggaatggaacctggcggcagcgcaaaagatg

SEQ ID NO: 192463 - DNA, 103 bp, Artificial Sequence
  Synthetic Polynucleotide
taatacgactcactataggggggccccatcctgctcagcctcccattcctaacagaggagaaggaatatgaggctgagcaacctggcggcagcgcaaaagatg

SEQ ID NO: 192464 - DNA, 103 bp, Artificial Sequence
  Synthetic Polynucleotide
taatacgactcactatagggggggctccaggggccccatcctgctcagccaacagaggagaggctgaatgggatggggcaacctggcggcagcgcaaaagatg

SEQ ID NO: 192465 - DNA, 103 bp, Artificial Sequence
  Synthetic Polynucleotide
taatacgactcactatagggcatggggactggggctccaggggccccatcaacagaggagagatgggatgcctggagccaacctggcggcagcgcaaaagatg

SEQ ID NO: 192466 - DNA, 103 bp, Artificial Sequence
  Synthetic Polynucleotide
taatacgactcactatagggtagcctcctccatggggactggggctccagaacagaggagactggagatgcagtccccaaacctggcggcagcgcaaaagatg

SEQ ID NO: 192467 - DNA, 103 bp, Artificial Sequence
  Synthetic Polynucleotide
taatacgactcactatagggcggatcatgctgtcgtgcgagtgctcctccaacagaggagaggaggaatgctcgcacgaaacctggcggcagcgcaaaagatg

SEQ ID NO: 192468 - DNA, 103 bp, Artificial Sequence
  Synthetic Polynucleotide
taatacgactcactataggggcccctctcctagcctcctccatggggactaacagaggagaagtcccatgggaggaggcaacctggcggcagcgcaaaagatg

SEQ ID NO: 192469 - DNA, 103 bp, Artificial Sequence
  Synthetic Polynucleotide
taatacgactcactatagggtggcaatggagcccctctcctagcctcctcaacagaggagagaggagatgaggagagggaacctggcggcagcgcaaaagatg

SEQ ID NO: 192470 - DNA, 103 bp, Artificial Sequence
  Synthetic Polynucleotide
taatacgactcactataggggggctggggctggcaatggagcccctctccaacagaggagaggagagatgctccattgcaacctggcggcagcgcaaaagatg

SEQ ID NO: 192471 - DNA, 103 bp, Artificial Sequence
  Synthetic Polynucleotide
taatacgactcactatagggtcttcctctagggctggggctggcaatggaaacagaggagatccattatgagccccagcaacctggcggcagcgcaaaagatg

SEQ ID NO: 192472 - DNA, 103 bp, Artificial Sequence
  Synthetic Polynucleotide
taatacgactcactataggggacctcatcatcttcctctagggctggggcaacagaggagagccccaatgctagaggaaaacctggcggcagcgcaaaagatg

SEQ ID NO: 192473 - DNA, 103 bp, Artificial Sequence
  Synthetic Polynucleotide
taatacgactcactatagggatgtaatctggacctcatcatcttcctctaaacagaggagatagaggatgatgatgaggaacctggcggcagcgcaaaagatg

SEQ ID NO: 192474 - DNA, 103 bp, Artificial Sequence
  Synthetic Polynucleotide
taatacgactcactataggggtggagaccgatgtaatctggacctcatcaaacagaggagatgatgaatgccagattacaacctggcggcagcgcaaaagatg

SEQ ID NO: 192475 - DNA, 103 bp, Artificial Sequence
  Synthetic Polynucleotide
taatacgactcactataggggggcacggacgtggagaccgatgtaatctgaacagaggagacagattatgtcggtctccaacctggcggcagcgcaaaagatg

SEQ ID NO: 192476 - DNA, 103 bp, Artificial Sequence
  Synthetic Polynucleotide
taatacgactcactataggggcactgatcggggcacggacgtggagaccgaacagaggagacggtctatgcgtccgtgcaacctggcggcagcgcaaaagatg

SEQ ID NO: 192477 - DNA, 103 bp, Artificial Sequence
  Synthetic Polynucleotide
taatacgactcactatagggggcgcagggggcactgatcggggcacggacaacagaggagagtccgtatgccgatcagtaacctggcggcagcgcaaaagatg

SEQ ID NO: 192478 - DNA, 103 bp, Artificial Sequence
  Synthetic Polynucleotide
taatacgactcactatagggggttccaacgcggatcatgctgtcgtgcgaaacagaggagatcgcacatgagcatgatcaacctggcggcagcgcaaaagatg

SEQ ID NO: 192479 - DNA, 103 bp, Artificial Sequence
  Synthetic Polynucleotide
taatacgactcactatagggagggggtggtggcgcagggggcactgatcgaacagaggagacgatcaatgccccctgcgaacctggcggcagcgcaaaagatg

SEQ ID NO: 192480 - DNA, 103 bp, Artificial Sequence
  Synthetic Polynucleotide
taatacgactcactatagggtgggaggtggagggggtggtggcgcaggggaacagaggagacccctgatgcaccaccccaacctggcggcagcgcaaaagatg

SEQ ID NO: 192481 - DNA, 103 bp, Artificial Sequence
  Synthetic Polynucleotide
taatacgactcactataggggacagcgaggtgggaggtggagggggtggtaacagaggagaaccaccatgtccacctccaacctggcggcagcgcaaaagatg

SEQ ID NO: 192482 - DNA, 103 bp, Artificial Sequence
  Synthetic Polynucleotide
taatacgactcactataggggggtggctgggacagcgaggtgggaggtggaacagaggagaccacctatgacctcgctgaacctggcggcagcgcaaaagatg

SEQ ID NO: 192483 - DNA, 103 bp, Artificial Sequence
  Synthetic Polynucleotide
taatacgactcactatagggtcagcagcgggggtggctgggacagcgaggaacagaggagacctcgcatgcccagccacaacctggcggcagcgcaaaagatg

SEQ ID NO: 192484 - DNA, 103 bp, Artificial Sequence
  Synthetic Polynucleotide
taatacgactcactatagggaaaggtggcctcagcagcgggggtggctggaacagaggagaccagccatgcccgctgctaacctggcggcagcgcaaaagatg

SEQ ID NO: 192485 - DNA, 103 bp, Artificial Sequence
  Synthetic Polynucleotide
taatacgactcactatagggagccgtgggcaaaggtggcctcagcagcggaacagaggagaccgctgatgaggccacctaacctggcggcagcgcaaaagatg

SEQ ID NO: 192486 - DNA, 103 bp, Artificial Sequence
  Synthetic Polynucleotide
taatacgactcactataggggcagagtgggagccgtgggcaaaggtggccaacagaggagaggccacatgtgcccacggaacctggcggcagcgcaaaagatg

SEQ ID NO: 192487 - DNA, 103 bp, Artificial Sequence
  Synthetic Polynucleotide
taatacgactcactatagggggctgtcggagcagagtgggagccgtgggcaacagaggagagcccacatgtcccactctaacctggcggcagcgcaaaagatg

SEQ ID NO: 192488 - DNA, 103 bp, Artificial Sequence
  Synthetic Polynucleotide
taatacgactcactatagggcagtgggggtggctgtcggagcagagtgggaacagaggagacccactatgctccgacagaacctggcggcagcgcaaaagatg

SEQ ID NO: 192489 - DNA, 103 bp, Artificial Sequence
  Synthetic Polynucleotide
taatacgactcactatagggcctggtaattggttccaacgcggatcatgcaacagaggagagcatgaatggcgttggaaaacctggcggcagcgcaaaagatg

SEQ ID NO: 192490 - DNA, 103 bp, Artificial Sequence
  Synthetic Polynucleotide
taatacgactcactatagggggccctgctgcagtgggggtggctgtcggaaacagaggagatccgacatgcacccccacaacctggcggcagcgcaaaagatg

SEQ ID NO: 192491 - DNA, 103 bp, Artificial Sequence
  Synthetic Polynucleotide
taatacgactcactatagggtggaggaagcggccctgctgcagtgggggtaacagaggagaacccccatggcagcagggaacctggcggcagcgcaaaagatg

SEQ ID NO: 192492 - DNA, 103 bp, Artificial Sequence
  Synthetic Polynucleotide
taatacgactcactatagggcagccggggctggaggaagcggccctgctgaacagaggagacagcagatgcgcttcctcaacctggcggcagcgcaaaagatg

SEQ ID NO: 192493 - DNA, 103 bp, Artificial Sequence
  Synthetic Polynucleotide
taatacgactcactatagggggttgggggccagccggggctggaggaagcaacagaggagagcttccatgagccccggcaacctggcggcagcgcaaaagatg

SEQ ID NO: 192494 - DNA, 103 bp, Artificial Sequence
  Synthetic Polynucleotide
taatacgactcactatagggggtgggggctggttgggggccagccggggcaacagaggagagccccgatgggcccccaaaacctggcggcagcgcaaaagatg

SEQ ID NO: 192495 - DNA, 103 bp, Artificial Sequence
  Synthetic Polynucleotide
taatacgactcactataggggatgagaggcggtgggggctggttgggggcaacagaggagagcccccatgcagcccccaaacctggcggcagcgcaaaagatg

SEQ ID NO: 192496 - DNA, 103 bp, Artificial Sequence
  Synthetic Polynucleotide
taatacgactcactataggggagcggggcggatgagaggcggtgggggctaacagaggagaagccccatgcgcctctcaaacctggcggcagcgcaaaagatg

SEQ ID NO: 192497 - DNA, 103 bp, Artificial Sequence
  Synthetic Polynucleotide
taatacgactcactatagggggggcagccagagcggggcggatgagaggcaacagaggagagcctctatgccgccccgcaacctggcggcagcgcaaaagatg

SEQ ID NO: 192498 - DNA, 103 bp, Artificial Sequence
  Synthetic Polynucleotide
taatacgactcactataggggctgtggcggggggcagccagagcggggcgaacagaggagacgccccatgctggctgccaacctggcggcagcgcaaaagatg

SEQ ID NO: 192499 - DNA, 103 bp, Artificial Sequence
  Synthetic Polynucleotide
taatacgactcactatagggcagggcgggcgctgtggcggggggcagccaaacagaggagatggctgatgcccgccacaaacctggcggcagcgcaaaagatg

SEQ ID NO: 192500 - DNA, 103 bp, Artificial Sequence
  Synthetic Polynucleotide
taatacgactcactatagggggaattacggcctggtaattggttccaacgaacagaggagacgttggatgcaattaccaaacctggcggcagcgcaaaagatg

SEQ ID NO: 192501 - DNA, 103 bp, Artificial Sequence
  Synthetic Polynucleotide
taatacgactcactatagggggctgagggccagggcgggcgctgtggcggaacagaggagaccgccaatgcgcccgcccaacctggcggcagcgcaaaagatg

SEQ ID NO: 192502 - DNA, 103 bp, Artificial Sequence
  Synthetic Polynucleotide
taatacgactcactatagggggtgggtgggggctgagggccagggcgggcaacagaggagagcccgcatgggccctcagaacctggcggcagcgcaaaagatg

SEQ ID NO: 192503 - DNA, 103 bp, Artificial Sequence
  Synthetic Polynucleotide
taatacgactcactatagggttccaatcagggtgggtgggggctgagggcaacagaggagagccctcatgccccacccaaacctggcggcagcgcaaaagatg

SEQ ID NO: 192504 - DNA, 103 bp, Artificial Sequence
  Synthetic Polynucleotide
taatacgactcactatagggtccagaggggttccaatcagggtgggtgggaacagaggagacccaccatgcctgattggaacctggcggcagcgcaaaagatg

SEQ ID NO: 192505 - DNA, 103 bp, Artificial Sequence
  Synthetic Polynucleotide
taatacgactcactatagggtgctgggggctccagaggggttccaatcagaacagaggagactgattatgacccctctgaacctggcggcagcgcaaaagatg

SEQ ID NO: 192506 - DNA, 103 bp, Artificial Sequence
  Synthetic Polynucleotide
taatacgactcactatagggagagtgagggtgctgggggctccagaggggaacagaggagacccctcatgagcccccagaacctggcggcagcgcaaaagatg

SEQ ID NO: 192507 - DNA, 103 bp, Artificial Sequence
  Synthetic Polynucleotide
taatacgactcactatagggcttgcactccggaattacggcctggtaattaacagaggagaaattacatggccgtaattaacctggcggcagcgcaaaagatg

SEQ ID NO: 192508 - DNA, 103 bp, Artificial Sequence
  Synthetic Polynucleotide
taatacgactcactatagggggctctcaggcttgcactccggaattacggaacagaggagaccgtaaatgcggagtgcaaacctggcggcagcgcaaaagatg

SEQ ID NO: 192509 - DNA, 103 bp, Artificial Sequence
  Synthetic Polynucleotide
taatacgactcactatagggtagcgtgcggggctctcaggcttgcactccaacagaggagaggagtgatggcctgagagaacctggcggcagcgcaaaagatg

SEQ ID NO: 192510 - DNA, 103 bp, Artificial Sequence
  Synthetic Polynucleotide
taatacgactcactatagggcttgttgctgtagcgtgcggggctctcaggaacagaggagacctgagatgcccgcacgcaacctggcggcagcgcaaaagatg

SEQ ID NO: 192511 - DNA, 103 bp, Artificial Sequence
  Synthetic Polynucleotide
taatacgactcactatagggtcccagagcccgcgctcggcttctccatcaaacagaggagatgatggatgagccgagcgaacctggcggcagcgcaaaagatg

SEQ ID NO: 192512 - DNA, 103 bp, Artificial Sequence
  Synthetic Polynucleotide
taatacgactcactatagggccttcagctccttgttgctgtagcgtgcggaacagaggagaccgcacatgacagcaacaaacctggcggcagcgcaaaagatg

SEQ ID NO: 192513 - DNA, 103 bp, Artificial Sequence
  Synthetic Polynucleotide
taatacgactcactatagggaccagcatccccttcagctccttgttgctgaacagaggagacagcaaatgggagctgaaaacctggcggcagcgcaaaagatg

SEQ ID NO: 192514 - DNA, 103 bp, Artificial Sequence
  Synthetic Polynucleotide
taatacgactcactataggggggtgaccacaccagcatccccttcagctcaacagaggagagagctgatggggatgctgaacctggcggcagcgcaaaagatg

SEQ ID NO: 192515 - DNA, 103 bp, Artificial Sequence
  Synthetic Polynucleotide
taatacgactcactatagggcacagtggttgggtgaccacaccagcatccaacagaggagaggatgcatgtgtggtcacaacctggcggcagcgcaaaagatg

SEQ ID NO: 192516 - DNA, 103 bp, Artificial Sequence
  Synthetic Polynucleotide
taatacgactcactataggggcatctgacacacagtggttgggtgaccacaacagaggagagtggtcatgcaaccactgaacctggcggcagcgcaaaagatg

SEQ ID NO: 192517 - DNA, 103 bp, Artificial Sequence
  Synthetic Polynucleotide
taatacgactcactataggggtcaagcttggcatctgacacacagtggttaacagaggagaaaccacatggtgtcagataacctggcggcagcgcaaaagatg

SEQ ID NO: 192518 - DNA, 103 bp, Artificial Sequence
  Synthetic Polynucleotide
taatacgactcactatagggcaatgtacttgtcaagcttggcatctgacaaacagaggagatgtcagatgccaagcttgaacctggcggcagcgcaaaagatg

SEQ ID NO: 192519 - DNA, 103 bp, Artificial Sequence
  Synthetic Polynucleotide
taatacgactcactatagggttggccatcgcaatgtacttgtcaagcttgaacagaggagacaagctatgcaagtacataacctggcggcagcgcaaaagatg

SEQ ID NO: 192520 - DNA, 103 bp, Artificial Sequence
  Synthetic Polynucleotide
taatacgactcactatagggatgcttctccttggccatcgcaatgtacttaacagaggagaaagtacatggcgatggccaacctggcggcagcgcaaaagatg

SEQ ID NO: 192521 - DNA, 103 bp, Artificial Sequence
  Synthetic Polynucleotide
taatacgactcactatagggtgttgtagccatgcttctccttggccatcgaacagaggagacgatggatgaggagaagcaacctggcggcagcgcaaaagatg

SEQ ID NO: 192522 - DNA, 103 bp, Artificial Sequence
  Synthetic Polynucleotide
taatacgactcactatagggcgggacaggatcccagagcccgcgctcggcaacagaggagagccgagatggggctctggaacctggcggcagcgcaaaagatg

SEQ ID NO: 192523 - DNA, 103 bp, Artificial Sequence
  Synthetic Polynucleotide
taatacgactcactataggggcctgctcaatgttgtagccatgcttctccaacagaggagaggagaaatgtggctacaaaacctggcggcagcgcaaaagatg

SEQ ID NO: 192524 - DNA, 103 bp, Artificial Sequence
  Synthetic Polynucleotide
taatacgactcactatagggcatgcccagcgcctgctcaatgttgtagccaacagaggagaggctacatgattgagcagaacctggcggcagcgcaaaagatg

SEQ ID NO: 192525 - DNA, 103 bp, Artificial Sequence
  Synthetic Polynucleotide
taatacgactcactataggggccacagaagcatgcccagcgcctgctcaaaacagaggagattgagcatgcgctgggcaaacctggcggcagcgcaaaagatg

SEQ ID NO: 192526 - DNA, 103 bp, Artificial Sequence
  Synthetic Polynucleotide
taatacgactcactatagggtcgtgcttatgccacagaagcatgcccagcaacagaggagagctgggatggcttctgtgaacctggcggcagcgcaaaagatg

SEQ ID NO: 192527 - DNA, 103 bp, Artificial Sequence
  Synthetic Polynucleotide
taatacgactcactatagggcttctccacatcgtgcttatgccacagaagaacagaggagacttctgatgcataagcacaacctggcggcagcgcaaaagatg

SEQ ID NO: 192528 - DNA, 103 bp, Artificial Sequence
  Synthetic Polynucleotide
taatacgactcactatagggcggccagcgacttctccacatcgtgcttataacagaggagaataagcatgatgtggagaaacctggcggcagcgcaaaagatg

SEQ ID NO: 192529 - DNA, 103 bp, Artificial Sequence
  Synthetic Polynucleotide
taatacgactcactatagggttggccaggtcggccagcgacttctccacaaacagaggagatgtggaatggtcgctggcaacctggcggcagcgcaaaagatg

SEQ ID NO: 192530 - DNA, 103 bp, Artificial Sequence
  Synthetic Polynucleotide
taatacgactcactatagggtggggtgaagttggccaggtcggccagcgaaacagaggagatcgctgatggacctggccaacctggcggcagcgcaaaagatg

SEQ ID NO: 192531 - DNA, 103 bp, Artificial Sequence
  Synthetic Polynucleotide
taatacgactcactatagggcgtcagggaatggggtgaagttggccaggtaacagaggagaacctggatgacttcacccaacctggcggcagcgcaaaagatg

SEQ ID NO: 192532 - DNA, 103 bp, Artificial Sequence
  Synthetic Polynucleotide
taatacgactcactatagggactgtccactcgtcagggaatggggtgaagaacagaggagacttcacatgattccctgaaacctggcggcagcgcaaaagatg

SEQ ID NO: 192533 - DNA, 103 bp, Artificial Sequence
  Synthetic Polynucleotide
taatacgactcactatagggggcccggctacgggacaggatcccagagccaacagaggagaggctctatgatcctgtccaacctggcggcagcgcaaaagatg

SEQ ID NO: 192534 - DNA, 103 bp, Artificial Sequence
  Synthetic Polynucleotide
taatacgactcactatagggcttgtcctctactgtccactcgtcagggaaaacagaggagattccctatggagtggacaaacctggcggcagcgcaaaagatg

SEQ ID NO: 192535 - DNA, 103 bp, Artificial Sequence
  Synthetic Polynucleotide
taatacgactcactatagggcaaacagcaccttgtcctctactgtccactaacagaggagaagtggaatgtagaggacaaacctggcggcagcgcaaaagatg

SEQ ID NO: 192536 - DNA, 103 bp, Artificial Sequence
  Synthetic Polynucleotide
taatacgactcactatagggaaggcctgttcaaacagcaccttgtcctctaacagaggagaagaggaatgggtgctgttaacctggcggcagcgcaaaagatg

SEQ ID NO: 192537 - DNA, 103 bp, Artificial Sequence
  Synthetic Polynucleotide
taatacgactcactatagggatggaagccaaaggcctgttcaaacagcacaacagaggagagtgctgatggaacaggccaacctggcggcagcgcaaaagatg

SEQ ID NO: 192538 - DNA, 103 bp, Artificial Sequence
  Synthetic Polynucleotide
taatacgactcactatagggagcatttgccatggaagccaaaggcctgttaacagaggagaaacaggatgttggcttccaacctggcggcagcgcaaaagatg

SEQ ID NO: 192539 - DNA, 103 bp, Artificial Sequence
  Synthetic Polynucleotide
taatacgactcactatagggatccgctggaagcatttgccatggaagccaaacagaggagatggcttatgtggcaaatgaacctggcggcagcgcaaaagatg

SEQ ID NO: 192540 - DNA, 103 bp, Artificial Sequence
  Synthetic Polynucleotide
taatacgactcactatagggcatctgctggatccgctggaagcatttgccaacagaggagaggcaaaatgttccagcggaacctggcggcagcgcaaaagatg

SEQ ID NO: 192541 - DNA, 103 bp, Artificial Sequence
  Synthetic Polynucleotide
taatacgactcactatagggtgtcaggcagcatctgctggatccgctggaaacagaggagatccagcatgtccagcagaaacctggcggcagcgcaaaagatg

SEQ ID NO: 192542 - DNA, 103 bp, Artificial Sequence
  Synthetic Polynucleotide
taatacgactcactatagggggaatcaacttgtcaggcagcatctgctggaacagaggagaccagcaatggctgcctgaaacctggcggcagcgcaaaagatg

SEQ ID NO: 192543 - DNA, 103 bp, Artificial Sequence
  Synthetic Polynucleotide
taatacgactcactatagggcaccaggctgggaatcaacttgtcaggcagaacagaggagactgcctatgaagttgattaacctggcggcagcgcaaaagatg

SEQ ID NO: 192544 - DNA, 103 bp, Artificial Sequence
  Synthetic Polynucleotide
taatacgactcactataggggcaccgtcttggcccggctacgggacaggaaacagaggagatcctgtatggtagccgggaacctggcggcagcgcaaaagatg

SEQ ID NO: 192545 - DNA, 103 bp, Artificial Sequence
  Synthetic Polynucleotide
taatacgactcactatagggagtagtatttcaccaggctgggaatcaactaacagaggagaagttgaatgccagcctggaacctggcggcagcgcaaaagatg

SEQ ID NO: 192546 - DNA, 103 bp, Artificial Sequence
  Synthetic Polynucleotide
taatacgactcactatagggttccaagagtagtagtatttcaccaggctgaacagaggagacagcctatggaaatactaaacctggcggcagcgcaaaagatg

SEQ ID NO: 192547 - DNA, 103 bp, Artificial Sequence
  Synthetic Polynucleotide
taatacgactcactataggggcgggtcttcttccaagagtagtagtatttaacagaggagaaaatacatgtactcttggaacctggcggcagcgcaaaagatg

SEQ ID NO: 192548 - DNA, 103 bp, Artificial Sequence
  Synthetic Polynucleotide
taatacgactcactatagggtagttcggctgcgggtcttcttccaagagtaacagaggagaactcttatgagaagacccaacctggcggcagcgcaaaagatg

SEQ ID NO: 192549 - DNA, 103 bp, Artificial Sequence
  Synthetic Polynucleotide
taatacgactcactatagggtccatcacactagttcggctgcgggtcttcaacagaggagagaagacatgcagccgaacaacctggcggcagcgcaaaagatg

SEQ ID NO: 192550 - DNA, 103 bp, Artificial Sequence
  Synthetic Polynucleotide
taatacgactcactatagggggcctgtctgtccatcacactagttcggctaacagaggagaagccgaatgagtgtgatgaacctggcggcagcgcaaaagatg

SEQ ID NO: 192551 - DNA, 103 bp, Artificial Sequence
  Synthetic Polynucleotide
taatacgactcactatagggccagccgccgggcctgtctgtccatcacacaacagaggagagtgtgaatgacagacaggaacctggcggcagcgcaaaagatg

SEQ ID NO: 192552 - DNA, 103 bp, Artificial Sequence
  Synthetic Polynucleotide
taatacgactcactatagggttgcggccccccagccgccgggcctgtctgaacagaggagacagacaatgccggcggctaacctggcggcagcgcaaaagatg

SEQ ID NO: 192553 - DNA, 103 bp, Artificial Sequence
  Synthetic Polynucleotide
taatacgactcactatagggttctttgtccttgcggccccccagccgccgaacagaggagacggcggatggggggccgcaacctggcggcagcgcaaaagatg

SEQ ID NO: 192554 - DNA, 103 bp, Artificial Sequence
  Synthetic Polynucleotide
taatacgactcactatagggcatcactgtcttctttgtccttgcggccccaacagaggagaggggccatgaggacaaagaacctggcggcagcgcaaaagatg

SEQ ID NO: 192555 - DNA, 103 bp, Artificial Sequence
  Synthetic Polynucleotide
taatacgactcactatagggccgccgttgggcaccgtcttggcccggctaaacagaggagatagccgatgcaagacggtaacctggcggcagcgcaaaagatg

SEQ ID NO: 192556 - DNA, 103 bp, Artificial Sequence
  Synthetic Polynucleotide
taatacgactcactatagggtcttcgagctcatcactgtcttctttgtccaacagaggagaggacaaatgagacagtgaaacctggcggcagcgcaaaagatg

SEQ ID NO: 192557 - DNA, 103 bp, Artificial Sequence
  Synthetic Polynucleotide
taatacgactcactatagggtcctcgaccctcttcgagctcatcactgtcaacagaggagagacagtatggagctcgaaaacctggcggcagcgcaaaagatg

SEQ ID NO: 192558 - DNA, 103 bp, Artificial Sequence
  Synthetic Polynucleotide
taatacgactcactatagggcactcacgcctcctcgaccctcttcgagctaacagaggagaagctcgatgagggtcgagaacctggcggcagcgcaaaagatg

SEQ ID NO: 192559 - DNA, 103 bp, Artificial Sequence
  Synthetic Polynucleotide
taatacgactcactatagggggctctccctcactcacgcctcctcgacccaacagaggagagggtcgatgaggcgtgagaacctggcggcagcgcaaaagatg

SEQ ID NO: 192560 - DNA, 103 bp, Artificial Sequence
  Synthetic Polynucleotide
taatacgactcactatagggtgcaggatcgggctctccctcactcacgccaacagaggagaggcgtgatggagggagagaacctggcggcagcgcaaaagatg

SEQ ID NO: 192561 - DNA, 103 bp, Artificial Sequence
  Synthetic Polynucleotide
taatacgactcactatagggtcttgggatctgcaggatcgggctctccctaacagaggagaagggagatgccgatcctgaacctggcggcagcgcaaaagatg

SEQ ID NO: 192562 - DNA, 103 bp, Artificial Sequence
  Synthetic Polynucleotide
taatacgactcactatagggagaggctctctcttgggatctgcaggatcgaacagaggagacgatccatgagatcccaaaacctggcggcagcgcaaaagatg

SEQ ID NO: 192563 - DNA, 103 bp, Artificial Sequence
  Synthetic Polynucleotide
taatacgactcactatagggccgagagggtagaggctctctcttgggatcaacagaggagagatcccatgagagagcctaacctggcggcagcgcaaaagatg

SEQ ID NO: 192564 - DNA, 103 bp, Artificial Sequence
  Synthetic Polynucleotide
taatacgactcactatagggcattcaggggccgagagggtagaggctctcaacagaggagagagagcatgtaccctctcaacctggcggcagcgcaaaagatg

SEQ ID NO: 192565 - DNA, 103 bp, Artificial Sequence
  Synthetic Polynucleotide
taatacgactcactatagggcctgggcgtgcattcaggggccgagagggtaacagaggagaaccctcatggcccctgaaaacctggcggcagcgcaaaagatg

SEQ ID NO: 192566 - DNA, 103 bp, Artificial Sequence
  Synthetic Polynucleotide
taatacgactcactataggggtggggctgtccgccgttgggcaccgtcttaacagaggagaaagacgatgcccaacggcaacctggcggcagcgcaaaagatg

SEQ ID NO: 192567 - DNA, 103 bp, Artificial Sequence
  Synthetic Polynucleotide
taatacgactcactatagggtttcccagggcctgggcgtgcattcaggggaacagaggagacccctgatggcacgcccaaacctggcggcagcgcaaaagatg

SEQ ID NO: 192568 - DNA, 103 bp, Artificial Sequence
  Synthetic Polynucleotide
taatacgactcactatagggggacctcctttttcccagggcctgggcgtgaacagaggagacacgccatggccctgggaaacctggcggcagcgcaaaagatg

SEQ ID NO: 192569 - DNA, 103 bp, Artificial Sequence
  Synthetic Polynucleotide
taatacgactcactatagggtgagacacctggacctcctttttcccagggaacagaggagaccctggatgaaaggaggtaacctggcggcagcgcaaaagatg

SEQ ID NO: 192570 - DNA, 103 bp, Artificial Sequence
  Synthetic Polynucleotide
taatacgactcactataggggtggcggtactgagacacctggacctccttaacagaggagaaaggagatgcaggtgtctaacctggcggcagcgcaaaagatg

SEQ ID NO: 192571 - DNA, 103 bp, Artificial Sequence
  Synthetic Polynucleotide
taatacgactcactataggggcaagggatggtggcggtactgagacacctaacagaggagaaggtgtatgagtaccgccaacctggcggcagcgcaaaagatg

SEQ ID NO: 192572 - DNA, 103 bp, Artificial Sequence
  Synthetic Polynucleotide
taatacgactcactatagggcgccgggttcgcaagggatggtggcggtacaacagaggagagtaccgatgccatcccttaacctggcggcagcgcaaaagatg

SEQ ID NO: 192573 - DNA, 103 bp, Artificial Sequence
  Synthetic Polynucleotide
taatacgactcactataggggggtgggcgacgccgggttcgcaagggatgaacagaggagacatcccatgcgaacccggaacctggcggcagcgcaaaagatg

SEQ ID NO: 192574 - DNA, 103 bp, Artificial Sequence
  Synthetic Polynucleotide
taatacgactcactatagggacatgcccttgggtgggcgacgccgggttcaacagaggagagaacccatggtcgcccacaacctggcggcagcgcaaaagatg

SEQ ID NO: 192575 - DNA, 103 bp, Artificial Sequence
  Synthetic Polynucleotide
taatacgactcactataggggggctcaggtacatgcccttgggtgggcgaaacagaggagatcgcccatgcaagggcataacctggcggcagcgcaaaagatg

SEQ ID NO: 192576 - DNA, 103 bp, Artificial Sequence
  Synthetic Polynucleotide
taatacgactcactataggggaggccttcagggctcaggtacatgcccttaacagaggagaaagggcatgtacctgagcaacctggcggcagcgcaaaagatg

SEQ ID NO: 192577 - DNA, 103 bp, Artificial Sequence
  Synthetic Polynucleotide
taatacgactcactatagggcatcctccgagtggggctgtccgccgttggaacagaggagaccaacgatggacagccccaacctggcggcagcgcaaaagatg

SEQ ID NO: 192578 - DNA, 103 bp, Artificial Sequence
  Synthetic Polynucleotide
taatacgactcactatagggacactgccgtgaggccttcagggctcaggtaacagaggagaacctgaatgctgaaggccaacctggcggcagcgcaaaagatg

SEQ ID NO: 192579 - DNA, 103 bp, Artificial Sequence
  Synthetic Polynucleotide
taatacgactcactataggggggcttcctgacactgccgtgaggccttcaaacagaggagatgaaggatgcacggcagtaacctggcggcagcgcaaaagatg

SEQ ID NO: 192580 - DNA, 103 bp, Artificial Sequence
  Synthetic Polynucleotide
taatacgactcactatagggggcaaggtccgggcttcctgacactgccgtaacagaggagaacggcaatgtcaggaagcaacctggcggcagcgcaaaagatg

SEQ ID NO: 192581 - DNA, 103 bp, Artificial Sequence
  Synthetic Polynucleotide
taatacgactcactataggggcgtgaggttggcaaggtccgggcttcctgaacagaggagacaggaaatgcggaccttgaacctggcggcagcgcaaaagatg

SEQ ID NO: 192582 - DNA, 103 bp, Artificial Sequence
  Synthetic Polynucleotide
taatacgactcactatagggagacctcggagcgtgaggttggcaaggtccaacagaggagaggacctatgcaacctcacaacctggcggcagcgcaaaagatg

SEQ ID NO: 192583 - DNA, 103 bp, Artificial Sequence
  Synthetic Polynucleotide
taatacgactcactatagggctgagagtcaagacctcggagcgtgaggttaacagaggagaaacctcatgctccgaggtaacctggcggcagcgcaaaagatg

SEQ ID NO: 192584 - DNA, 103 bp, Artificial Sequence
  Synthetic Polynucleotide
taatacgactcactataggggggagatgagctgagagtcaagacctcggaaacagaggagatccgagatgttgactctcaacctggcggcagcgcaaaagatg

SEQ ID NO: 192585 - DNA, 103 bp, Artificial Sequence
  Synthetic Polynucleotide
taatacgactcactatagggtggcgcttgagggagatgagctgagagtcaaacagaggagatgactcatggctcatctcaacctggcggcagcgcaaaagatg

SEQ ID NO: 192586 - DNA, 103 bp, Artificial Sequence
  Synthetic Polynucleotide
taatacgactcactataggggctctgtacctggcgcttgagggagatgagaacagaggagactcatcatgctcaagcgcaacctggcggcagcgcaaaagatg

SEQ ID NO: 192587 - DNA, 103 bp, Artificial Sequence
  Synthetic Polynucleotide
taatacgactcactatagggtctgcttcatgctctgtacctggcgcttgaaacagaggagatcaagcatgaggtacagaaacctggcggcagcgcaaaagatg

SEQ ID NO: 192588 - DNA, 103 bp, Artificial Sequence
  Synthetic Polynucleotide
taatacgactcactatagggtcgctgctgtcatcctccgagtggggctgtaacagaggagaacagccatgctcggaggaaacctggcggcagcgcaaaagatg

SEQ ID NO: 192589 - DNA, 103 bp, Artificial Sequence
  Synthetic Polynucleotide
taatacgactcactatagggctgctgttcgtctgcttcatgctctgtaccaacagaggagaggtacaatgcatgaagcaaacctggcggcagcgcaaaagatg

SEQ ID NO: 192590 - DNA, 103 bp, Artificial Sequence
  Synthetic Polynucleotide
taatacgactcactatagggttggcgcaggctgctgttcgtctgcttcataacagaggagaatgaagatgacgaacagcaacctggcggcagcgcaaaagatg

SEQ ID NO: 192591 - DNA, 103 bp, Artificial Sequence
  Synthetic Polynucleotide
taatacgactcactatagggcctccagggcttggcgcaggctgctgttcgaacagaggagacgaacaatggcctgcgccaacctggcggcagcgcaaaagatg

SEQ ID NO: 192592 - DNA, 103 bp, Artificial Sequence
  Synthetic Polynucleotide
taatacgactcactatagggtcaataccgccctccagggcttggcgcaggaacagaggagacctgcgatgagccctggaaacctggcggcagcgcaaaagatg

SEQ ID NO: 192593 - DNA, 103 bp, Artificial Sequence
  Synthetic Polynucleotide
taatacgactcactataggggcgtagtggatcaataccgccctccagggcaacagaggagagccctgatgggcggtattaacctggcggcagcgcaaaagatg

SEQ ID NO: 192594 - DNA, 103 bp, Artificial Sequence
  Synthetic Polynucleotide
taatacgactcactatagggcctccggggggcgtagtggatcaataccgcaacagaggagagcggtaatgatccactacaacctggcggcagcgcaaaagatg

SEQ ID NO: 192595 - DNA, 103 bp, Artificial Sequence
  Synthetic Polynucleotide
taatacgactcactatagggttggtgttggcctccggggggcgtagtggaaacagaggagatccactatgccccccggaaacctggcggcagcgcaaaagatg

SEQ ID NO: 192596 - DNA, 103 bp, Artificial Sequence
  Synthetic Polynucleotide
taatacgactcactatagggggagttgaacttggtgttggcctccgggggaacagaggagacccccgatggccaacaccaacctggcggcagcgcaaaagatg

SEQ ID NO: 192597 - DNA, 103 bp, Artificial Sequence
  Synthetic Polynucleotide
taatacgactcactatagggtggtccagcgggagttgaacttggtgttggaacagaggagaccaacaatgagttcaactaacctggcggcagcgcaaaagatg

SEQ ID NO: 192598 - DNA, 103 bp, Artificial Sequence
  Synthetic Polynucleotide
taatacgactcactatagggtgctcatctgtggtccagcgggagttgaacaacagaggagagttcaaatgccgctggacaacctggcggcagcgcaaaagatg

SEQ ID NO: 192599 - DNA, 103 bp, Artificial Sequence
  Synthetic Polynucleotide
taatacgactcactatagggccgagcttggtattcggctccgactctcataacagaggagaatgagaatgggagccgaaaacctggcggcagcgcaaaagatg

SEQ ID NO: 192600 - DNA, 103 bp, Artificial Sequence
  Synthetic Polynucleotide
taatacgactcactatagggatctgggatactgtgatatggagaccatacaacagaggagagtatggatgccatatcacaacctggcggcagcgcaaaagatg

SEQ ID NO: 192601 - DNA, 103 bp, Artificial Sequence
  Synthetic Polynucleotide
taatacgactcactatagggtacctcctctaagttaaaccgacgcctgtaaacagaggagatacaggatgcggtttaacaacctggcggcagcgcaaaagatg

SEQ ID NO: 192602 - DNA, 103 bp, Artificial Sequence
  Synthetic Polynucleotide
taatacgactcactatagggactcctgcaatacctcctctaagttaaaccaacagaggagaggtttaatgtagaggaggaacctggcggcagcgcaaaagatg

SEQ ID NO: 192603 - DNA, 103 bp, Artificial Sequence
  Synthetic Polynucleotide
taatacgactcactatagggtctgcttcccactcctgcaatacctcctctaacagaggagaagaggaatgattgcaggaaacctggcggcagcgcaaaagatg

SEQ ID NO: 192604 - DNA, 103 bp, Artificial Sequence
  Synthetic Polynucleotide
taatacgactcactatagggggttccttgttctgcttcccactcctgcaaaacagaggagattgcagatgtgggaagcaaacctggcggcagcgcaaaagatg

SEQ ID NO: 192605 - DNA, 103 bp, Artificial Sequence
  Synthetic Polynucleotide
taatacgactcactatagggtagaagcctgggttccttgttctgcttcccaacagaggagagggaagatgaacaaggaaaacctggcggcagcgcaaaagatg

SEQ ID NO: 192606 - DNA, 103 bp, Artificial Sequence
  Synthetic Polynucleotide
taatacgactcactataggggcatcaccattagaagcctgggttccttgtaacagaggagaacaaggatgccaggcttcaacctggcggcagcgcaaaagatg

SEQ ID NO: 192607 - DNA, 103 bp, Artificial Sequence
  Synthetic Polynucleotide
taatacgactcactatagggtaaagtagaagcatcaccattagaagcctgaacagaggagacaggctatgaatggtgataacctggcggcagcgcaaaagatg

SEQ ID NO: 192608 - DNA, 103 bp, Artificial Sequence
  Synthetic Polynucleotide
taatacgactcactatagggtctcctcccctaaagtagaagcatcaccataacagaggagaatggtgatgcttctacttaacctggcggcagcgcaaaagatg

SEQ ID NO: 192609 - DNA, 103 bp, Artificial Sequence
  Synthetic Polynucleotide
taatacgactcactataggggcactttttgtctcctcccctaaagtagaaaacagaggagattctacatgaggggaggaaacctggcggcagcgcaaaagatg

SEQ ID NO: 192610 - DNA, 103 bp, Artificial Sequence
  Synthetic Polynucleotide
taatacgactcactatagggcacattagaagcactttttgtctcctccccaacagaggagaggggagatgacaaaaagtaacctggcggcagcgcaaaagatg

SEQ ID NO: 192611 - DNA, 103 bp, Artificial Sequence
  Synthetic Polynucleotide
taatacgactcactatagggccaatttggcatctgggatactgtgatatgaacagaggagacatatcatggtatcccagaacctggcggcagcgcaaaagatg

SEQ ID NO: 192612 - DNA, 103 bp, Artificial Sequence
  Synthetic Polynucleotide
taatacgactcactatagggtccctgatggcacattagaagcactttttgaacagaggagacaaaaaatgcttctaatgaacctggcggcagcgcaaaagatg

SEQ ID NO: 192613 - DNA, 103 bp, Artificial Sequence
  Synthetic Polynucleotide
taatacgactcactatagggtcagtgctcttccctgatggcacattagaaaacagaggagattctaaatggccatcaggaacctggcggcagcgcaaaagatg

SEQ ID NO: 192614 - DNA, 103 bp, Artificial Sequence
  Synthetic Polynucleotide
taatacgactcactatagggctcttcttcatcagtgctcttccctgatggaacagaggagaccatcaatgaagagcactaacctggcggcagcgcaaaagatg

SEQ ID NO: 192615 - DNA, 103 bp, Artificial Sequence
  Synthetic Polynucleotide
taatacgactcactatagggtctgtgcctcctcttcttcatcagtgctctaacagaggagaagagcaatgatgaagaagaacctggcggcagcgcaaaagatg

SEQ ID NO: 192616 - DNA, 103 bp, Artificial Sequence
  Synthetic Polynucleotide
taatacgactcactataggggcctgtggggtctgtgcctcctcttcttcaaacagaggagatgaagaatgggaggcacaaacctggcggcagcgcaaaagatg

SEQ ID NO: 192617 - DNA, 103 bp, Artificial Sequence
  Synthetic Polynucleotide
taatacgactcactatagggtgtccgaggagcctgtggggtctgtgcctcaacagaggagagaggcaatgaccccacagaacctggcggcagcgcaaaagatg

SEQ ID NO: 192618 - DNA, 103 bp, Artificial Sequence
  Synthetic Polynucleotide
taatacgactcactatagggatggacccagtgtccgaggagcctgtggggaacagaggagaccccacatgctcctcggaaacctggcggcagcgcaaaagatg

SEQ ID NO: 192619 - DNA, 103 bp, Artificial Sequence
  Synthetic Polynucleotide
taatacgactcactataggggcaggaggtgatggacccagtgtccgaggaaacagaggagatcctcgatgactgggtccaacctggcggcagcgcaaaagatg

SEQ ID NO: 192620 - DNA, 103 bp, Artificial Sequence
  Synthetic Polynucleotide
taatacgactcactatagggggatgatggggcaggaggtgatggacccagaacagaggagactgggtatgtcacctcctaacctggcggcagcgcaaaagatg

SEQ ID NO: 192621 - DNA, 103 bp, Artificial Sequence
  Synthetic Polynucleotide
taatacgactcactataggggtgttggagtggatgatggggcaggaggtgaacagaggagacacctcatgccccatcataacctggcggcagcgcaaaagatg

SEQ ID NO: 192622 - DNA, 103 bp, Artificial Sequence
  Synthetic Polynucleotide
taatacgactcactatagggatgtattcatccaatttggcatctgggataaacagaggagatatcccatgtgccaaattaacctggcggcagcgcaaaagatg

SEQ ID NO: 192623 - DNA, 103 bp, Artificial Sequence
  Synthetic Polynucleotide
taatacgactcactatagggggggctgttggtgttggagtggatgatgggaacagaggagacccatcatgcactccaacaacctggcggcagcgcaaaagatg

SEQ ID NO: 192624 - DNA, 103 bp, Artificial Sequence
  Synthetic Polynucleotide
taatacgactcactatagggagtggcaataggggctgttggtgttggagtaacagaggagaactccaatgccaacagccaacctggcggcagcgcaaaagatg

SEQ ID NO: 192625 - DNA, 103 bp, Artificial Sequence
  Synthetic Polynucleotide
taatacgactcactataggggctggttcagagtggcaataggggctgttgaacagaggagacaacagatgctattgccaaacctggcggcagcgcaaaagatg

SEQ ID NO: 192626 - DNA, 103 bp, Artificial Sequence
  Synthetic Polynucleotide
taatacgactcactatagggagtggtggaggctggttcagagtggcaataaacagaggagatattgcatgtctgaaccaaacctggcggcagcgcaaaagatg

SEQ ID NO: 192627 - DNA, 103 bp, Artificial Sequence
  Synthetic Polynucleotide
taatacgactcactatagggtggacgaagaagtggtggaggctggttcagaacagaggagactgaacatgcctccaccaaacctggcggcagcgcaaaagatg

SEQ ID NO: 192628 - DNA, 103 bp, Artificial Sequence
  Synthetic Polynucleotide
taatacgactcactatagggcaggcagtgttggacgaagaagtggtggagaacagaggagactccacatgttcttcgtcaacctggcggcagcgcaaaagatg

SEQ ID NO: 192629 - DNA, 103 bp, Artificial Sequence
  Synthetic Polynucleotide
taatacgactcactataggggccggggcagcaggcagtgttggacgaagaaacagaggagatcttcgatgaacactgccaacctggcggcagcgcaaaagatg

SEQ ID NO: 192630 - DNA, 103 bp, Artificial Sequence
  Synthetic Polynucleotide
taatacgactcactatagggccggtgaagagccggggcagcaggcagtgtaacagaggagaacactgatggctgccccgaacctggcggcagcgcaaaagatg

SEQ ID NO: 192631 - DNA, 103 bp, Artificial Sequence
  Synthetic Polynucleotide
taatacgactcactataggggaggaggctgccggtgaagagccggggcagaacagaggagactgcccatgctcttcaccaacctggcggcagcgcaaaagatg

SEQ ID NO: 192632 - DNA, 103 bp, Artificial Sequence
  Synthetic Polynucleotide
taatacgactcactatagggtgctggagtggaggaggctgccggtgaagaaacagaggagatcttcaatggcagcctccaacctggcggcagcgcaaaagatg

SEQ ID NO: 192633 - DNA, 103 bp, Artificial Sequence
  Synthetic Polynucleotide
taatacgactcactatagggtgcaattgcaatgtattcatccaatttggcaacagaggagagccaaaatggatgaatacaacctggcggcagcgcaaaagatg

SEQ ID NO: 192634 - DNA, 103 bp, Artificial Sequence
  Synthetic Polynucleotide
taatacgactcactatagggccgagcctgctgctggagtggaggaggctgaacagaggagacagcctatgccactccagaacctggcggcagcgcaaaagatg

SEQ ID NO: 192635 - DNA, 103 bp, Artificial Sequence
  Synthetic Polynucleotide
taatacgactcactataggggctggatgaaccgagcctgctgctggagtgaacagaggagacactccatgagcaggctcaacctggcggcagcgcaaaagatg

SEQ ID NO: 192636 - DNA, 103 bp, Artificial Sequence
  Synthetic Polynucleotide
taatacgactcactataggggttggccggggctggatgaaccgagcctgcaacagaggagagcaggcatggttcatccaaacctggcggcagcgcaaaagatg

SEQ ID NO: 192637 - DNA, 103 bp, Artificial Sequence
  Synthetic Polynucleotide
taatacgactcactatagggctgatttaaagttggccggggctggatgaaaacagaggagattcatcatgccccggccaaacctggcggcagcgcaaaagatg

SEQ ID NO: 192638 - DNA, 103 bp, Artificial Sequence
  Synthetic Polynucleotide
taatacgactcactataggggtggtggaggctgatttaaagttggccgggaacagaggagacccggcatgctttaaatcaacctggcggcagcgcaaaagatg

SEQ ID NO: 192639 - DNA, 103 bp, Artificial Sequence
  Synthetic Polynucleotide
taatacgactcactatagggcgaataagaggtggtggaggctgatttaaaaacagaggagatttaaaatggcctccaccaacctggcggcagcgcaaaagatg

SEQ ID NO: 192640 - DNA, 103 bp, Artificial Sequence
  Synthetic Polynucleotide
taatacgactcactatagggattagcagggcgaataagaggtggtggaggaacagaggagacctccaatgcctcttattaacctggcggcagcgcaaaagatg

SEQ ID NO: 192641 - DNA, 103 bp, Artificial Sequence
  Synthetic Polynucleotide
taatacgactcactataggggtggcatggaattagcagggcgaataagagaacagaggagactcttaatggccctgctaaacctggcggcagcgcaaaagatg

SEQ ID NO: 192642 - DNA, 103 bp, Artificial Sequence
  Synthetic Polynucleotide
taatacgactcactatagggtttagacggggtggcatggaattagcagggaacagaggagaccctgcatgttccatgccaacctggcggcagcgcaaaagatg

SEQ ID NO: 192643 - DNA, 103 bp, Artificial Sequence
  Synthetic Polynucleotide
taatacgactcactatagggcggtcttgggtttagacggggtggcatggaaacagaggagatccatgatgccccgtctaaacctggcggcagcgcaaaagatg

SEQ ID NO: 192644 - DNA, 103 bp, Artificial Sequence
  Synthetic Polynucleotide
taatacgactcactataggggcttttcctttgcaattgcaatgtattcataacagaggagaatgaatatgttgcaattgaacctggcggcagcgcaaaagatg

SEQ ID NO: 192645 - DNA, 103 bp, Artificial Sequence
  Synthetic Polynucleotide
taatacgactcactatagggtggacaacaccggtcttgggtttagacgggaacagaggagacccgtcatgacccaagacaacctggcggcagcgcaaaagatg

SEQ ID NO: 192646 - DNA, 103 bp, Artificial Sequence
  Synthetic Polynucleotide
taatacgactcactatagggccaccaaccgtggacaacaccggtcttgggaacagaggagacccaagatgggtgttgtcaacctggcggcagcgcaaaagatg

SEQ ID NO: 192647 - DNA, 103 bp, Artificial Sequence
  Synthetic Polynucleotide
taatacgactcactatagggtggctgttgaccaccaaccgtggacaacacaacagaggagagtgttgatgacggttggtaacctggcggcagcgcaaaagatg

SEQ ID NO: 192648 - DNA, 103 bp, Artificial Sequence
  Synthetic Polynucleotide
taatacgactcactatagggtaagtgatggtggctgttgaccaccaaccgaacagaggagacggttgatggtcaacagcaacctggcggcagcgcaaaagatg

SEQ ID NO: 192649 - DNA, 103 bp, Artificial Sequence
  Synthetic Polynucleotide
taatacgactcactatagggtgaattccaataagtgatggtggctgttgaaacagaggagatcaacaatgaccatcactaacctggcggcagcgcaaaagatg

SEQ ID NO: 192650 - DNA, 103 bp, Artificial Sequence
  Synthetic Polynucleotide
taatacgactcactatagggtgaatctgtctgaattccaataagtgatggaacagaggagaccatcaatgattggaattaacctggcggcagcgcaaaagatg

SEQ ID NO: 192651 - DNA, 103 bp, Artificial Sequence
  Synthetic Polynucleotide
taatacgactcactataggggtgaggactgtgaatctgtctgaattccaaaacagaggagattggaaatgagacagattaacctggcggcagcgcaaaagatg

SEQ ID NO: 192652 - DNA, 103 bp, Artificial Sequence
  Synthetic Polynucleotide
taatacgactcactatagggttgtagccatgcttttcctttgcaattgcaaacagaggagatgcaatatgaaaggaaaaaacctggcggcagcgcaaaagatg

SEQ ID NO: 192653 - DNA, 103 bp, Artificial Sequence
  Synthetic Polynucleotide
taatacgactcactatagggctgttccacattgtagccatgcttttccttaacagaggagaaaggaaatgcatggctacaacctggcggcagcgcaaaagatg

SEQ ID NO: 192654 - DNA, 103 bp, Artificial Sequence
  Synthetic Polynucleotide
taatacgactcactatagggtgccaagtgcctgttccacattgtagccataacagaggagaatggctatgatgtggaacaacctggcggcagcgcaaaagatg

SEQ ID NO: 192655 - DNA, 103 bp, Artificial Sequence
  Synthetic Polynucleotide
taatacgactcactatagggcagaacaacatgccaagtgcctgttccacaaacagaggagatgtggaatgggcacttggaacctggcggcagcgcaaaagatg

SEQ ID NO: 192656 - DNA, 103 bp, Artificial Sequence
  Synthetic Polynucleotide
taatacgactcactatagggatgtttatgccagaacaacatgccaagtgcaacagaggagagcacttatgatgttgttcaacctggcggcagcgcaaaagatg

SEQ ID NO: 192657 - DNA, 103 bp, Artificial Sequence
  Synthetic Polynucleotide
taatacgactcactatagggattcagggatccgagcttggtattcggctcaacagaggagagagccgatgaccaagctcaacctggcggcagcgcaaaagatg

SEQ ID NO: 192658 - DNA, 103 bp, Artificial Sequence
  Synthetic Polynucleotide
taatacgactcactatagggtctcaatgttatgtttatgccagaacaacaaacagaggagatgttgtatgggcataaacaacctggcggcagcgcaaaagatg

SEQ ID NO: 192659 - DNA, 103 bp, Artificial Sequence
  Synthetic Polynucleotide
taatacgactcactataggggcaagggacttctcaatgttatgtttatgcaacagaggagagcataaatgtaacattgaaacctggcggcagcgcaaaagatg

SEQ ID NO: 192660 - DNA, 103 bp, Artificial Sequence
  Synthetic Polynucleotide
taatacgactcactatagggagggagatcagcaagggacttctcaatgttaacagaggagaaacattatgaagtcccttaacctggcggcagcgcaaaagatg

SEQ ID NO: 192661 - DNA, 103 bp, Artificial Sequence
  Synthetic Polynucleotide
taatacgactcactataggggagtgaaattagggagatcagcaagggactaacagaggagaagtcccatgctgatctccaacctggcggcagcgcaaaagatg

SEQ ID NO: 192662 - DNA, 103 bp, Artificial Sequence
  Synthetic Polynucleotide
taatacgactcactatagggtccggaaagggagtgaaattagggagatcaaacagaggagatgatctatgtaatttcacaacctggcggcagcgcaaaagatg

SEQ ID NO: 192663 - DNA, 103 bp, Artificial Sequence
  Synthetic Polynucleotide
taatacgactcactatagggtgtccactcatccggaaagggagtgaaattaacagaggagaaatttcatgccctttccgaacctggcggcagcgcaaaagatg

SEQ ID NO: 192664 - DNA, 103 bp, Artificial Sequence
  Synthetic Polynucleotide
taatacgactcactatagggtatcttccactgtccactcatccggaaaggaacagaggagacctttcatgatgagtggaaacctggcggcagcgcaaaagatg

SEQ ID NO: 192665 - DNA, 103 bp, Artificial Sequence
  Synthetic Polynucleotide
taatacgactcactatagggaataggactttatcttccactgtccactcaaacagaggagatgagtgatgagtggaagaaacctggcggcagcgcaaaagatg

SEQ ID NO: 192666 - DNA, 103 bp, Artificial Sequence
  Synthetic Polynucleotide
taatacgactcactatagggggcttgttcaaataggactttatcttccacaacagaggagagtggaaatgaaagtcctaaacctggcggcagcgcaaaagatg

SEQ ID NO: 192667 - DNA, 103 bp, Artificial Sequence
  Synthetic Polynucleotide
taatacgactcactataggggaaaactaaaggcttgttcaaataggacttaacagaggagaaagtccatgttgaacaagaacctggcggcagcgcaaaagatg

SEQ ID NO: 192668 - DNA, 103 bp, Artificial Sequence
  Synthetic Polynucleotide
taatacgactcactatagggcctggatcaaattcagggatccgagcttggaacagaggagaccaagcatggatccctgaaacctggcggcagcgcaaaagatg

SEQ ID NO: 192669 - DNA, 103 bp, Artificial Sequence
  Synthetic Polynucleotide
taatacgactcactatagggctctttccatgaaaactaaaggcttgttcaaacagaggagatgaacaatgctttagtttaacctggcggcagcgcaaaagatg

SEQ ID NO: 192670 - DNA, 103 bp, Artificial Sequence
  Synthetic Polynucleotide
taatacgactcactatagggcctgtgaaagctctttccatgaaaactaaaaacagaggagatttagtatgcatggaaagaacctggcggcagcgcaaaagatg

SEQ ID NO: 192671 - DNA, 103 bp, Artificial Sequence
  Synthetic Polynucleotide
taatacgactcactatagggtttgctgaatcctgtgaaagctctttccataacagaggagaatggaaatggctttcacaaacctggcggcagcgcaaaagatg

SEQ ID NO: 192672 - DNA, 103 bp, Artificial Sequence
  Synthetic Polynucleotide
taatacgactcactatagggtctggaagcatttgctgaatcctgtgaaagaacagaggagactttcaatggattcagcaaacctggcggcagcgcaaaagatg

SEQ ID NO: 192673 - DNA, 103 bp, Artificial Sequence
  Synthetic Polynucleotide
taatacgactcactatagggaattgtcttatctggaagcatttgctgaataacagaggagaattcagatgatgcttccaaacctggcggcagcgcaaaagatg

SEQ ID NO: 192674 - DNA, 103 bp, Artificial Sequence
  Synthetic Polynucleotide
taatacgactcactatagggcaaggcttgcaattgtcttatctggaagcaaacagaggagatgcttcatgataagacaaaacctggcggcagcgcaaaagatg

SEQ ID NO: 192675 - DNA, 103 bp, Artificial Sequence
  Synthetic Polynucleotide
taatacgactcactatagggtaatattttacaaggcttgcaattgtcttaaacagaggagataagacatgtgcaagcctaacctggcggcagcgcaaaagatg

SEQ ID NO: 192676 - DNA, 103 bp, Artificial Sequence
  Synthetic Polynucleotide
taatacgactcactatagggccaagaatagtaatattttacaaggcttgcaacagaggagagcaagcatggtaaaatataacctggcggcagcgcaaaagatg

SEQ ID NO: 192677 - DNA, 103 bp, Artificial Sequence
  Synthetic Polynucleotide
taatacgactcactataggggagtttttttccaagaatagtaatattttaaacagaggagataaaatatgactattcttaacctggcggcagcgcaaaagatg

SEQ ID NO: 192678 - DNA, 103 bp, Artificial Sequence
  Synthetic Polynucleotide
taatacgactcactataggggtcctagagcgagtttttttccaagaatagaacagaggagactattcatggaaaaaaacaacctggcggcagcgcaaaagatg

SEQ ID NO: 192679 - DNA, 103 bp, Artificial Sequence
  Synthetic Polynucleotide
taatacgactcactatagggctttgtagcacctggatcaaattcagggataacagaggagaatccctatgtttgatccaaacctggcggcagcgcaaaagatg

SEQ ID NO: 192680 - DNA, 103 bp, Artificial Sequence
  Synthetic Polynucleotide
taatacgactcactatagggcatcaaacttgtcctagagcgagtttttttaacagaggagaaaaaaaatgcgctctaggaacctggcggcagcgcaaaagatg

SEQ ID NO: 192681 - DNA, 103 bp, Artificial Sequence
  Synthetic Polynucleotide
taatacgactcactatagggcctggcgatccatcaaacttgtcctagagcaacagaggagagctctaatgcaagtttgaaacctggcggcagcgcaaaagatg

SEQ ID NO: 192682 - DNA, 103 bp, Artificial Sequence
  Synthetic Polynucleotide
taatacgactcactatagggagtttacgagcctggcgatccatcaaacttaacagaggagaaagtttatgggatcgccaaacctggcggcagcgcaaaagatg

SEQ ID NO: 192683 - DNA, 103 bp, Artificial Sequence
  Synthetic Polynucleotide
taatacgactcactatagggtctattagctagtttacgagcctggcgatcaacagaggagagatcgcatggctcgtaaaaacctggcggcagcgcaaaagatg

SEQ ID NO: 192684 - DNA, 103 bp, Artificial Sequence
  Synthetic Polynucleotide
taatacgactcactatagggcctgattatgtctattagctagtttacgagaacagaggagactcgtaatgtagctaataaacctggcggcagcgcaaaagatg

SEQ ID NO: 192685 - DNA, 103 bp, Artificial Sequence
  Synthetic Polynucleotide
taatacgactcactatagggtcactgtcaccctgattatgtctattagctaacagaggagaagctaaatgacataatcaaacctggcggcagcgcaaaagatg

SEQ ID NO: 192686 - DNA, 103 bp, Artificial Sequence
  Synthetic Polynucleotide
taatacgactcactatagggtacatcatcatcactgtcaccctgattatgaacagaggagacataatatgggtgacagtaacctggcggcagcgcaaaagatg

SEQ ID NO: 192687 - DNA, 103 bp, Artificial Sequence
  Synthetic Polynucleotide
taatacgactcactataggggtgtttcttctacatcatcatcactgtcacaacagaggagagtgacaatgatgatgatgaacctggcggcagcgcaaaagatg

SEQ ID NO: 192688 - DNA, 103 bp, Artificial Sequence
  Synthetic Polynucleotide
taatacgactcactatagggtccattggatgtgtttcttctacatcatcaaacagaggagatgatgaatgagaagaaacaacctggcggcagcgcaaaagatg

SEQ ID NO: 192689 - DNA, 103 bp, Artificial Sequence
  Synthetic Polynucleotide
taatacgactcactatagggatcattcccatccattggatgtgtttcttcaacagaggagagaagaaatgcatccaatgaacctggcggcagcgcaaaagatg

SEQ ID NO: 192690 - DNA, 103 bp, Artificial Sequence
  Synthetic Polynucleotide
taatacgactcactatagggtatctgtgtactttgtagcacctggatcaaaacagaggagattgatcatggtgctacaaaacctggcggcagcgcaaaagatg

SEQ ID NO: 192691 - DNA, 103 bp, Artificial Sequence
  Synthetic Polynucleotide
taatacgactcactatagggcataatcactatcattcccatccattggataacagaggagaatccaaatgatgggaatgaacctggcggcagcgcaaaagatg

SEQ ID NO: 192692 - DNA, 103 bp, Artificial Sequence
  Synthetic Polynucleotide
taatacgactcactatagggtttttgggatcataatcactatcattcccaaacagaggagatgggaaatgtagtgattaaacctggcggcagcgcaaaagatg

SEQ ID NO: 192693 - DNA, 103 bp, Artificial Sequence
  Synthetic Polynucleotide
taatacgactcactatagggtttggcttcttttttgggatcataatcactaacagaggagaagtgatatggatcccaaaaacctggcggcagcgcaaaagatg

SEQ ID NO: 192694 - DNA, 103 bp, Artificial Sequence
  Synthetic Polynucleotide
taatacgactcactatagggtaccctcttttttggcttcttttttgggataacagaggagaatcccaatgaagaagccaaacctggcggcagcgcaaaagatg

SEQ ID NO: 192695 - DNA, 103 bp, Artificial Sequence
  Synthetic Polynucleotide
taatacgactcactatagggtgttcagtattaccctcttttttggcttctaacagaggagaagaagcatgaaaagagggaacctggcggcagcgcaaaagatg

SEQ ID NO: 192696 - DNA, 103 bp, Artificial Sequence
  Synthetic Polynucleotide
taatacgactcactatagggttggacaggttgttcagtattaccctctttaacagaggagaaaagagatgaatactgaaaacctggcggcagcgcaaaagatg

SEQ ID NO: 192697 - DNA, 103 bp, Artificial Sequence
  Synthetic Polynucleotide
taatacgactcactatagggtcttgctagtttggacaggttgttcagtataacagaggagaatactgatgaacctgtccaacctggcggcagcgcaaaagatg

SEQ ID NO: 192698 - DNA, 103 bp, Artificial Sequence
  Synthetic Polynucleotide
taatacgactcactatagggccaagtccaatcttgctagtttggacaggtaacagaggagaacctgtatgaactagcaaaacctggcggcagcgcaaaagatg

SEQ ID NO: 192699 - DNA, 103 bp, Artificial Sequence
  Synthetic Polynucleotide
taatacgactcactatagggctctcttcttccaagtccaatcttgctagtaacagaggagaactagcatgattggacttaacctggcggcagcgcaaaagatg

SEQ ID NO: 192700 - DNA, 103 bp, Artificial Sequence
  Synthetic Polynucleotide
taatacgactcactatagggaactctgatactctcttcttccaagtccaaaacagaggagattggacatggaagaagagaacctggcggcagcgcaaaagatg

SEQ ID NO: 192701 - DNA, 103 bp, Artificial Sequence
  Synthetic Polynucleotide
taatacgactcactatagggccattgtctttatctgtgtactttgtagcaaacagaggagatgctacatggtacacagaaacctggcggcagcgcaaaagatg

SEQ ID NO: 192702 - DNA, 103 bp, Artificial Sequence
  Synthetic Polynucleotide
taatacgactcactatagggcgatgttgtaaactctgatactctcttcttaacagaggagaaagaagatggtatcagagaacctggcggcagcgcaaaagatg

SEQ ID NO: 192703 - DNA, 103 bp, Artificial Sequence
  Synthetic Polynucleotide
taatacgactcactatagggagaatgatggcgatgttgtaaactctgataaacagaggagatatcagatgttacaacataacctggcggcagcgcaaaagatg

SEQ ID NO: 192704 - DNA, 103 bp, Artificial Sequence
  Synthetic Polynucleotide
taatacgactcactatagggtagaacgctgagaatgatggcgatgttgtaaacagaggagatacaacatggccatcattaacctggcggcagcgcaaaagatg

SEQ ID NO: 192705 - DNA, 103 bp, Artificial Sequence
  Synthetic Polynucleotide
taatacgactcactatagggggacggcacttagaacgctgagaatgatggaacagaggagaccatcaatgtcagcgttcaacctggcggcagcgcaaaagatg

SEQ ID NO: 192706 - DNA, 103 bp, Artificial Sequence
  Synthetic Polynucleotide
taatacgactcactataggggcccttaggtggacggcacttagaacgctgaacagaggagacagcgtatgaagtgccgtaacctggcggcagcgcaaaagatg

SEQ ID NO: 192707 - DNA, 103 bp, Artificial Sequence
  Synthetic Polynucleotide
taatacgactcactatagggttaaatacatgcccttaggtggacggcactaacagaggagaagtgccatgcacctaaggaacctggcggcagcgcaaaagatg

SEQ ID NO: 192708 - DNA, 103 bp, Artificial Sequence
  Synthetic Polynucleotide
taatacgactcactatagggtcttcctgggttaaatacatgcccttaggtaacagaggagaacctaaatgcatgtatttaacctggcggcagcgcaaaagatg

SEQ ID NO: 192709 - DNA, 103 bp, Artificial Sequence
  Synthetic Polynucleotide
taatacgactcactatagggtgctaccacatcttcctgggttaaatacataacagaggagaatgtatatgacccaggaaaacctggcggcagcgcaaaagatg

SEQ ID NO: 192710 - DNA, 103 bp, Artificial Sequence
  Synthetic Polynucleotide
taatacgactcactatagggtacaggaaactgctaccacatcttcctgggaacagaggagacccaggatgatgtggtagaacctggcggcagcgcaaaagatg

SEQ ID NO: 192711 - DNA, 103 bp, Artificial Sequence
  Synthetic Polynucleotide
taatacgactcactataggggcattgggactacaggaaactgctaccacaaacagaggagatgtggtatgagtttcctgaacctggcggcagcgcaaaagatg

SEQ ID NO: 192712 - DNA, 103 bp, Artificial Sequence
  Synthetic Polynucleotide
taatacgactcactatagggaagcatccctccattgtctttatctgtgtaaacagaggagatacacaatgaaagacaataacctggcggcagcgcaaaagatg

SEQ ID NO: 192713 - DNA, 103 bp, Artificial Sequence
  Synthetic Polynucleotide
taatacgactcactatagggggtgttggctgcattgggactacaggaaacaacagaggagagtttccatgagtcccaataacctggcggcagcgcaaaagatg

SEQ ID NO: 192714 - DNA, 103 bp, Artificial Sequence
  Synthetic Polynucleotide
taatacgactcactataggggcctcaggatggtgttggctgcattgggacaacagaggagagtcccaatgcagccaacaaacctggcggcagcgcaaaagatg

SEQ ID NO: 192715 - DNA, 103 bp, Artificial Sequence
  Synthetic Polynucleotide
taatacgactcactatagggatgtccagttgcctcaggatggtgttggctaacagaggagaagccaaatgcatcctgagaacctggcggcagcgcaaaagatg

SEQ ID NO: 192716 - DNA, 103 bp, Artificial Sequence
  Synthetic Polynucleotide
taatacgactcactataggggatcaactccatgtccagttgcctcaggataacagaggagaatcctgatgcaactggacaacctggcggcagcgcaaaagatg

SEQ ID NO: 192717 - DNA, 103 bp, Artificial Sequence
  Synthetic Polynucleotide
taatacgactcactataggggttttagagagatcaactccatgtccagttaacagaggagaaactggatgtggagttgaaacctggcggcagcgcaaaagatg

SEQ ID NO: 192718 - DNA, 103 bp, Artificial Sequence
  Synthetic Polynucleotide
taatacgactcactatagggtgaacctgacgttttagagagatcaactccaacagaggagaggagttatgctctctaaaaacctggcggcagcgcaaaagatg

SEQ ID NO: 192719 - DNA, 103 bp, Artificial Sequence
  Synthetic Polynucleotide
taatacgactcactatagggcttagcattctgaacctgacgttttagagaaacagaggagatctctaatgcgtcaggttaacctggcggcagcgcaaaagatg

SEQ ID NO: 192720 - DNA, 103 bp, Artificial Sequence
  Synthetic Polynucleotide
taatacgactcactatagggtgtttacttgcttagcattctgaacctgacaacagaggagagtcaggatgagaatgctaaacctggcggcagcgcaaaagatg

SEQ ID NO: 192721 - DNA, 103 bp, Artificial Sequence
  Synthetic Polynucleotide
taatacgactcactatagggttaagtgcactgtttacttgcttagcattcaacagaggagagaatgcatggcaagtaaaaacctggcggcagcgcaaaagatg

SEQ ID NO: 192722 - DNA, 103 bp, Artificial Sequence
  Synthetic Polynucleotide
taatacgactcactatagggcattttctgtttaagtgcactgtttacttgaacagaggagacaagtaatgagtgcacttaacctggcggcagcgcaaaagatg

SEQ ID NO: 192723 - DNA, 103 bp, Artificial Sequence
  Synthetic Polynucleotide
taatacgactcactataggggagaccatacaagcatccctccattgtcttaacagaggagaaagacaatggagggatgcaacctggcggcagcgcaaaagatg

SEQ ID NO: 192724 - DNA, 103 bp, Artificial Sequence
  Synthetic Polynucleotide
taatacgactcactatagggttccaccttccattttctgtttaagtgcacaacagaggagagtgcacatgaacagaaaaaacctggcggcagcgcaaaagatg

SEQ ID NO: 192725 - DNA, 103 bp, Artificial Sequence
  Synthetic Polynucleotide
taatacgactcactatagggaattcttcaattccaccttccattttctgtaacagaggagaacagaaatgggaaggtggaacctggcggcagcgcaaaagatg

SEQ ID NO: 192726 - DNA, 103 bp, Artificial Sequence
  Synthetic Polynucleotide
taatacgactcactatagggaggaggtttgaattcttcaattccaccttcaacagaggagagaaggtatgattgaagaaaacctggcggcagcgcaaaagatg

SEQ ID NO: 192727 - DNA, 103 bp, Artificial Sequence
  Synthetic Polynucleotide
taatacgactcactataggggatttgactcaggaggtttgaattcttcaaaacagaggagattgaagatgtcaaacctcaacctggcggcagcgcaaaagatg

SEQ ID NO: 192728 - DNA, 103 bp, Artificial Sequence
  Synthetic Polynucleotide
taatacgactcactatagggttaattttctgatttgactcaggaggtttgaacagaggagacaaaccatgtgagtcaaaaacctggcggcagcgcaaaagatg

SEQ ID NO: 192729 - DNA, 103 bp, Artificial Sequence
  Synthetic Polynucleotide
taatacgactcactatagggccaacgggcattaattttctgatttgactcaacagaggagagagtcaatgcagaaaattaacctggcggcagcgcaaaagatg

SEQ ID NO: 192730 - DNA, 103 bp, Artificial Sequence
  Synthetic Polynucleotide
taatacgactcactatagggcctctgtggtccaacgggcattaattttctaacagaggagaagaaaaatgatgcccgttaacctggcggcagcgcaaaagatg

SEQ ID NO: 192731 - DNA, 103 bp, Artificial Sequence
  Synthetic Polynucleotide
taatacgactcactatagggagaagctgctcctctgtggtccaacgggcaaacagaggagatgcccgatggaccacagaaacctggcggcagcgcaaaagatg

SEQ ID NO: 192732 - DNA, 103 bp, Artificial Sequence
  Synthetic Polynucleotide
taatacgactcactatagggttgcactgctagaagctgctcctctgtggtaacagaggagaaccacaatggagcagcttaacctggcggcagcgcaaaagatg

SEQ ID NO: 192733 - DNA, 103 bp, Artificial Sequence
  Synthetic Polynucleotide
taatacgactcactatagggtgcggacaccttgcactgctagaagctgctaacagaggagaagcagcatgtagcagtgcaacctggcggcagcgcaaaagatg

SEQ ID NO: 192734 - DNA, 103 bp, Artificial Sequence
  Synthetic Polynucleotide
taatacgactcactatagggctgtgatatggagaccatacaagcatccctaacagaggagaagggatatgtgtatggtcaacctggcggcagcgcaaaagatg

SEQ ID NO: 192735 - DNA, 103 bp, Artificial Sequence
  Synthetic Polynucleotide
taatacgactcactatagggttaccatatttgcggacaccttgcactgctaacagaggagaagcagtatgaggtgtccgaacctggcggcagcgcaaaagatg

SEQ ID NO: 192736 - DNA, 103 bp, Artificial Sequence
  Synthetic Polynucleotide
taatacgactcactatagggttgaaaatctttaccatatttgcggacaccaacagaggagaggtgtcatgaaatatggtaacctggcggcagcgcaaaagatg

SEQ ID NO: 192737 - DNA, 103 bp, Artificial Sequence
  Synthetic Polynucleotide
taatacgactcactatagggctgcaatagcttgaaaatctttaccatattaacagaggagaaatatgatgaagattttcaacctggcggcagcgcaaaagatg

SEQ ID NO: 192738 - DNA, 103 bp, Artificial Sequence
  Synthetic Polynucleotide
taatacgactcactatagggccaattacatctgcaatagcttgaaaatctaacagaggagaagatttatgagctattgcaacctggcggcagcgcaaaagatg

SEQ ID NO: 192739 - DNA, 103 bp, Artificial Sequence
  Synthetic Polynucleotide
taatacgactcactatagggagtcttgttgccaattacatctgcaatagcaacagaggagagctattatggatgtaattaacctggcggcagcgcaaaagatg

SEQ ID NO: 192740 - DNA, 103 bp, Artificial Sequence
  Synthetic Polynucleotide
taatacgactcactatagggcttggccaacagtcttgttgccaattacataacagaggagaatgtaaatggcaacaagaaacctggcggcagcgcaaaagatg

SEQ ID NO: 192741 - DNA, 103 bp, Artificial Sequence
  Synthetic Polynucleotide
taatacgactcactatagggaagttcttcacttggccaacagtcttgttgaacagaggagacaacaaatgtgttggccaaacctggcggcagcgcaaaagatg

SEQ ID NO: 192742 - DNA, 103 bp, Artificial Sequence
  Synthetic Polynucleotide
taatacgactcactataggggtttacaaagaagttcttcacttggccaacaacagaggagagttggcatggtgaagaacaacctggcggcagcgcaaaagatg

SEQ ID NO: 192743 - DNA, 103 bp, Artificial Sequence
  Synthetic Polynucleotide
taatacgactcactataggggacgcctgtagtttacaaagaagttcttcaaacagaggagatgaagaatgtctttgtaaaacctggcggcagcgcaaaagatg

SEQ ID NO: 192744 - DNA, 103 bp, Artificial Sequence
  Synthetic Polynucleotide
taatacgactcactatagggaagttaaaccgacgcctgtagtttacaaagaacagaggagactttgtatgctacaggcgaacctggcggcagcgcaaaagatg

SEQ ID NO: 192745 - DNA, 103 bp, Artificial Sequence
  Synthetic Polynucleotide
taatacgactcactatagggtatatacgggttatacgcaccggaggccataacagaggagaatggccatgggtgcgtataacctggcggcagcgcaaaagatg

SEQ ID NO: 192746 - DNA, 103 bp, Artificial Sequence
  Synthetic Polynucleotide
taatacgactcactataggggctgtgctcccctggaatgctgcctgctgaaacagaggagatcagcaatgagcattccaaacctggcggcagcgcaaaagatg

SEQ ID NO: 192747 - DNA, 103 bp, Artificial Sequence
  Synthetic Polynucleotide
taatacgactcactatagggaactgtaatcccagcactttgggaggccaaaacagaggagattggccatgcaaagtgctaacctggcggcagcgcaaaagatg

SEQ ID NO: 192748 - DNA, 103 bp, Artificial Sequence
  Synthetic Polynucleotide
taatacgactcactatagggcaggaaaattaactgtaatcccagcactttaacagaggagaaaagtgatgggattacagaacctggcggcagcgcaaaagatg

SEQ ID NO: 192749 - DNA, 103 bp, Artificial Sequence
  Synthetic Polynucleotide
taatacgactcactatagggcttggtctctcaggaaaattaactgtaatcaacagaggagagattacatgtaattttccaacctggcggcagcgcaaaagatg

SEQ ID NO: 192750 - DNA, 103 bp, Artificial Sequence
  Synthetic Polynucleotide
taatacgactcactataggggagaccaggtcttggtctctcaggaaaattaacagaggagaaattttatggagagaccaaacctggcggcagcgcaaaagatg

SEQ ID NO: 192751 - DNA, 103 bp, Artificial Sequence
  Synthetic Polynucleotide
taatacgactcactatagggttgaaccgaggagaccaggtcttggtctctaacagaggagaagagacatggacctggtcaacctggcggcagcgcaaaagatg

SEQ ID NO: 192752 - DNA, 103 bp, Artificial Sequence
  Synthetic Polynucleotide
taatacgactcactatagggccttctccaattgaaccgaggagaccaggtaacagaggagaacctggatgcctcggttcaacctggcggcagcgcaaaagatg

SEQ ID NO: 192753 - DNA, 103 bp, Artificial Sequence
  Synthetic Polynucleotide
taatacgactcactataggggaagtatcttccttctccaattgaaccgagaacagaggagactcggtatgattggagaaaacctggcggcagcgcaaaagatg

SEQ ID NO: 192754 - DNA, 103 bp, Artificial Sequence
  Synthetic Polynucleotide
taatacgactcactataggggttcttttttgaagtatcttccttctccaaaacagaggagattggagatggaagatactaacctggcggcagcgcaaaagatg

SEQ ID NO: 192755 - DNA, 103 bp, Artificial Sequence
  Synthetic Polynucleotide
taatacgactcactatagggaacaagtttggttcttttttgaagtatcttaacagaggagaaagataatgcaaaaaagaaacctggcggcagcgcaaaagatg

SEQ ID NO: 192756 - DNA, 103 bp, Artificial Sequence
  Synthetic Polynucleotide
taatacgactcactatagggatcatgagaaaacaagtttggttcttttttaacagaggagaaaaaaaatgccaaacttgaacctggcggcagcgcaaaagatg

SEQ ID NO: 192757 - DNA, 103 bp, Artificial Sequence
  Synthetic Polynucleotide
taatacgactcactatagggtgttgtctgtgctgtgctcccctggaatgcaacagaggagagcattcatggggagcacaaacctggcggcagcgcaaaagatg

SEQ ID NO: 192758 - DNA, 103 bp, Artificial Sequence
  Synthetic Polynucleotide
taatacgactcactatagggtcacaactgcatcatgagaaaacaagtttgaacagaggagacaaactatgtttctcatgaacctggcggcagcgcaaaagatg

SEQ ID NO: 192759 - DNA, 103 bp, Artificial Sequence
  Synthetic Polynucleotide
taatacgactcactatagggggcatttctctcacaactgcatcatgagaaaacagaggagattctcaatgtgcagttgtaacctggcggcagcgcaaaagatg

SEQ ID NO: 192760 - DNA, 103 bp, Artificial Sequence
  Synthetic Polynucleotide
taatacgactcactatagggaacccctgtaggcatttctctcacaactgcaacagaggagagcagttatgagagaaatgaacctggcggcagcgcaaaagatg

SEQ ID NO: 192761 - DNA, 103 bp, Artificial Sequence
  Synthetic Polynucleotide
taatacgactcactatagggcttgacttgaaacccctgtaggcatttctcaacagaggagagagaaaatgctacaggggaacctggcggcagcgcaaaagatg

SEQ ID NO: 192762 - DNA, 103 bp, Artificial Sequence
  Synthetic Polynucleotide
taatacgactcactatagggtaggattctgcttgacttgaaacccctgtaaacagaggagatacaggatgttcaagtcaaacctggcggcagcgcaaaagatg

SEQ ID NO: 192763 - DNA, 103 bp, Artificial Sequence
  Synthetic Polynucleotide
taatacgactcactatagggtgagggatagtaggattctgcttgacttgaaacagaggagatcaagtatggcagaatccaacctggcggcagcgcaaaagatg

SEQ ID NO: 192764 - DNA, 103 bp, Artificial Sequence
  Synthetic Polynucleotide
taatacgactcactatagggtgggcccaggtgagggatagtaggattctgaacagaggagacagaatatgactatccctaacctggcggcagcgcaaaagatg

SEQ ID NO: 192765 - DNA, 103 bp, Artificial Sequence
  Synthetic Polynucleotide
taatacgactcactatagggccacttgagatgggcccaggtgagggatagaacagaggagactatccatgacctgggccaacctggcggcagcgcaaaagatg

SEQ ID NO: 192766 - DNA, 103 bp, Artificial Sequence
  Synthetic Polynucleotide
taatacgactcactatagggatgtgacaatccacttgagatgggcccaggaacagaggagacctgggatgatctcaagtaacctggcggcagcgcaaaagatg

SEQ ID NO: 192767 - DNA, 103 bp, Artificial Sequence
  Synthetic Polynucleotide
taatacgactcactatagggttgaggcatgatgtgacaatccacttgagaaacagaggagatctcaaatggattgtcacaacctggcggcagcgcaaaagatg

SEQ ID NO: 192768 - DNA, 103 bp, Artificial Sequence
  Synthetic Polynucleotide
taatacgactcactatagggtatgttcggttgttgtctgtgctgtgctccaacagaggagaggagcaatgcacagacaaaacctggcggcagcgcaaaagatg

SEQ ID NO: 192769 - DNA, 103 bp, Artificial Sequence
  Synthetic Polynucleotide
taatacgactcactatagggagaggtgccattgaggcatgatgtgacaataacagaggagaattgtcatgtcatgcctcaacctggcggcagcgcaaaagatg

SEQ ID NO: 192770 - DNA, 103 bp, Artificial Sequence
  Synthetic Polynucleotide
taatacgactcactatagggtgaagaaggcagaggtgccattgaggcatgaacagaggagacatgccatgatggcacctaacctggcggcagcgcaaaagatg

SEQ ID NO: 192771 - DNA, 103 bp, Artificial Sequence
  Synthetic Polynucleotide
taatacgactcactatagggatgaccagcttgaagaaggcagaggtgccaaacagaggagatggcacatgtgccttcttaacctggcggcagcgcaaaagatg

SEQ ID NO: 192772 - DNA, 103 bp, Artificial Sequence
  Synthetic Polynucleotide
taatacgactcactatagggtgggccactgatgaccagcttgaagaaggcaacagaggagagccttcatgaagctggtcaacctggcggcagcgcaaaagatg

SEQ ID NO: 192773 - DNA, 103 bp, Artificial Sequence
  Synthetic Polynucleotide
taatacgactcactatagggtggggtggggtgggccactgatgaccagctaacagaggagaagctggatgtcagtggccaacctggcggcagcgcaaaagatg

SEQ ID NO: 192774 - DNA, 103 bp, Artificial Sequence
  Synthetic Polynucleotide
taatacgactcactatagggtgcctgagcgtggggtggggtgggccactgaacagaggagacagtggatgaccccacccaacctggcggcagcgcaaaagatg

SEQ ID NO: 192775 - DNA, 103 bp, Artificial Sequence
  Synthetic Polynucleotide
taatacgactcactataggggggtttgtattgcctgagcgtggggtggggaacagaggagaccccacatgacgctcaggaacctggcggcagcgcaaaagatg

SEQ ID NO: 192776 - DNA, 103 bp, Artificial Sequence
  Synthetic Polynucleotide
taatacgactcactatagggactactcagtgggtttgtattgcctgagcgaacagaggagacgctcaatgaatacaaacaacctggcggcagcgcaaaagatg

SEQ ID NO: 192777 - DNA, 103 bp, Artificial Sequence
  Synthetic Polynucleotide
taatacgactcactatagggttgttgaaaaactactcagtgggtttgtataacagaggagaatacaaatgcactgagtaaacctggcggcagcgcaaaagatg

SEQ ID NO: 192778 - DNA, 103 bp, Artificial Sequence
  Synthetic Polynucleotide
taatacgactcactatagggggaagtgtccttgttgaaaaactactcagtaacagaggagaactgagatgtttttcaacaacctggcggcagcgcaaaagatg

SEQ ID NO: 192779 - DNA, 103 bp, Artificial Sequence
  Synthetic Polynucleotide
taatacgactcactataggggatagaagggtatgttcggttgttgtctgtaacagaggagaacagacatgaaccgaacaaacctggcggcagcgcaaaagatg

SEQ ID NO: 192780 - DNA, 103 bp, Artificial Sequence
  Synthetic Polynucleotide
taatacgactcactatagggcgaattagaaggaagtgtccttgttgaaaaaacagaggagattttcaatgaggacacttaacctggcggcagcgcaaaagatg

SEQ ID NO: 192781 - DNA, 103 bp, Artificial Sequence
  Synthetic Polynucleotide
taatacgactcactatagggggataccttgcgaattagaaggaagtgtccaacagaggagaggacacatgcttctaattaacctggcggcagcgcaaaagatg

SEQ ID NO: 192782 - DNA, 103 bp, Artificial Sequence
  Synthetic Polynucleotide
taatacgactcactatagggaggaatggtgggataccttgcgaattagaaaacagaggagattctaaatggcaaggtataacctggcggcagcgcaaaagatg

SEQ ID NO: 192783 - DNA, 103 bp, Artificial Sequence
  Synthetic Polynucleotide
taatacgactcactatagggaggtattctcaggaatggtgggataccttgaacagaggagacaaggtatgccaccattcaacctggcggcagcgcaaaagatg

SEQ ID NO: 192784 - DNA, 103 bp, Artificial Sequence
  Synthetic Polynucleotide
taatacgactcactatagggcattcccaacaggtattctcaggaatggtgaacagaggagacaccatatgtgagaatacaacctggcggcagcgcaaaagatg

SEQ ID NO: 192785 - DNA, 103 bp, Artificial Sequence
  Synthetic Polynucleotide
taatacgactcactataggggcatttaaatcattcccaacaggtattctcaacagaggagagagaatatgtgttgggaaaacctggcggcagcgcaaaagatg

SEQ ID NO: 192786 - DNA, 103 bp, Artificial Sequence
  Synthetic Polynucleotide
taatacgactcactatagggagcattagaagcatttaaatcattcccaacaacagaggagagttgggatggatttaaataacctggcggcagcgcaaaagatg

SEQ ID NO: 192787 - DNA, 103 bp, Artificial Sequence
  Synthetic Polynucleotide
taatacgactcactatagggtgtaaatgcaagcattagaagcatttaaataacagaggagaatttaaatgcttctaatgaacctggcggcagcgcaaaagatg

SEQ ID NO: 192788 - DNA, 103 bp, Artificial Sequence
  Synthetic Polynucleotide
taatacgactcactatagggtcggcattgttgtaaatgcaagcattagaaaacagaggagattctaaatgttgcatttaaacctggcggcagcgcaaaagatg

SEQ ID NO: 192789 - DNA, 103 bp, Artificial Sequence
  Synthetic Polynucleotide
taatacgactcactataggggactatgtcatcggcattgttgtaaatgcaaacagaggagatgcattatgaacaatgccaacctggcggcagcgcaaaagatg

SEQ ID NO: 192790 - DNA, 103 bp, Artificial Sequence
  Synthetic Polynucleotide
taatacgactcactatagggtcataatctggatagaagggtatgttcggtaacagaggagaaccgaaatgacccttctaaacctggcggcagcgcaaaagatg

SEQ ID NO: 192791 - DNA, 103 bp, Artificial Sequence
  Synthetic Polynucleotide
taatacgactcactatagggcttccattccgactatgtcatcggcattgtaacagaggagaacaatgatgatgacatagaacctggcggcagcgcaaaagatg

SEQ ID NO: 192792 - DNA, 103 bp, Artificial Sequence
  Synthetic Polynucleotide
taatacgactcactatagggatggatgacgcttccattccgactatgtcaaacagaggagatgacatatgcggaatggaaacctggcggcagcgcaaaagatg

SEQ ID NO: 192793 - DNA, 103 bp, Artificial Sequence
  Synthetic Polynucleotide
taatacgactcactatagggtgctgatggcatggatgacgcttccattccaacagaggagaggaatgatggcgtcatccaacctggcggcagcgcaaaagatg

SEQ ID NO: 192794 - DNA, 103 bp, Artificial Sequence
  Synthetic Polynucleotide
taatacgactcactatagggcatataaatctgctgatggcatggatgacgaacagaggagacgtcatatgtgccatcagaacctggcggcagcgcaaaagatg

SEQ ID NO: 192795 - DNA, 103 bp, Artificial Sequence
  Synthetic Polynucleotide
taatacgactcactatagggtcagaaataccatataaatctgctgatggcaacagaggagagccatcatgagatttataaacctggcggcagcgcaaaagatg

SEQ ID NO: 192796 - DNA, 103 bp, Artificial Sequence
  Synthetic Polynucleotide
taatacgactcactatagggcatgttgggatcagaaataccatataaatcaacagaggagagatttaatgggtatttctaacctggcggcagcgcaaaagatg

SEQ ID NO: 192797 - DNA, 103 bp, Artificial Sequence
  Synthetic Polynucleotide
taatacgactcactatagggaattagacagcatgttgggatcagaaatacaacagaggagagtatttatgatcccaacaaacctggcggcagcgcaaaagatg

SEQ ID NO: 192798 - DNA, 103 bp, Artificial Sequence
  Synthetic Polynucleotide
taatacgactcactatagggttcacagaacaattagacagcatgttgggaaacagaggagatcccaaatggctgtctaaaacctggcggcagcgcaaaagatg

SEQ ID NO: 192799 - DNA, 103 bp, Artificial Sequence
  Synthetic Polynucleotide
taatacgactcactatagggtgtcatcatattcacagaacaattagacagaacagaggagactgtctatgtgttctgtgaacctggcggcagcgcaaaagatg

SEQ ID NO: 192800 - DNA, 103 bp, Artificial Sequence
  Synthetic Polynucleotide
taatacgactcactatagggcactgctggttgtcatcatattcacagaacaacagaggagagttctgatgatatgatgaaacctggcggcagcgcaaaagatg

SEQ ID NO: 192801 - DNA, 103 bp, Artificial Sequence
  Synthetic Polynucleotide
taatacgactcactatagggccataatagttcataatctggatagaagggaacagaggagacccttcatgccagattataacctggcggcagcgcaaaagatg

SEQ ID NO: 192802 - DNA, 103 bp, Artificial Sequence
  Synthetic Polynucleotide
taatacgactcactatagggcccatgctgtcactgctggttgtcatcataaacagaggagatatgatatgaaccagcagaacctggcggcagcgcaaaagatg

SEQ ID NO: 192803 - DNA, 103 bp, Artificial Sequence
  Synthetic Polynucleotide
taatacgactcactatagggatcagtctctcccatgctgtcactgctggtaacagaggagaaccagcatggacagcatgaacctggcggcagcgcaaaagatg

SEQ ID NO: 192804 - DNA, 103 bp, Artificial Sequence
  Synthetic Polynucleotide
taatacgactcactataggggtcttggattatcagtctctcccatgctgtaacagaggagaacagcaatggagagactgaacctggcggcagcgcaaaagatg

SEQ ID NO: 192805 - DNA, 103 bp, Artificial Sequence
  Synthetic Polynucleotide
taatacgactcactatagggatgctcagaagtcttggattatcagtctctaacagaggagaagagacatgtaatccaagaacctggcggcagcgcaaaagatg

SEQ ID NO: 192806 - DNA, 103 bp, Artificial Sequence
  Synthetic Polynucleotide
taatacgactcactatagggttcaagattcatgctcagaagtcttggattaacagaggagaaatccaatgcttctgagcaacctggcggcagcgcaaaagatg

SEQ ID NO: 192807 - DNA, 103 bp, Artificial Sequence
  Synthetic Polynucleotide
taatacgactcactatagggatgaggggttttcaagattcatgctcagaaaacagaggagattctgaatgtgaatcttgaacctggcggcagcgcaaaagatg

SEQ ID NO: 192808 - DNA, 103 bp, Artificial Sequence
  Synthetic Polynucleotide
taatacgactcactatagggactgaattacatgaggggttttcaagattcaacagaggagagaatctatgaaacccctcaacctggcggcagcgcaaaagatg

SEQ ID NO: 192809 - DNA, 103 bp, Artificial Sequence
  Synthetic Polynucleotide
taatacgactcactatagggtgggtctaacactgaattacatgaggggttaacagaggagaaaccccatgtgtaattcaaacctggcggcagcgcaaaagatg

SEQ ID NO: 192810 - DNA, 103 bp, Artificial Sequence
  Synthetic Polynucleotide
taatacgactcactatagggtcaagtctcttgggtctaacactgaattacaacagaggagagtaattatgtgttagaccaacctggcggcagcgcaaaagatg

SEQ ID NO: 192811 - DNA, 103 bp, Artificial Sequence
  Synthetic Polynucleotide
taatacgactcactatagggtggagctgtctcaagtctcttgggtctaacaacagaggagagttagaatgaagagacttaacctggcggcagcgcaaaagatg

SEQ ID NO: 192812 - DNA, 103 bp, Artificial Sequence
  Synthetic Polynucleotide
taatacgactcactatagggttttccttttccataatagttcataatctgaacagaggagacagattatgaactattataacctggcggcagcgcaaaagatg

SEQ ID NO: 192813 - DNA, 103 bp, Artificial Sequence
  Synthetic Polynucleotide
taatacgactcactatagggggacatctgatggagctgtctcaagtctctaacagaggagaagagacatgagacagctcaacctggcggcagcgcaaaagatg

SEQ ID NO: 192814 - DNA, 103 bp, Artificial Sequence
  Synthetic Polynucleotide
taatacgactcactatagggtactggaagaggacatctgatggagctgtcaacagaggagagacagcatgatcagatgtaacctggcggcagcgcaaaagatg

SEQ ID NO: 192815 - DNA, 103 bp, Artificial Sequence
  Synthetic Polynucleotide
taatacgactcactatagggcctgctgacatactggaagaggacatctgaaacagaggagatcagatatgctcttccagaacctggcggcagcgcaaaagatg

SEQ ID NO: 192816 - DNA, 103 bp, Artificial Sequence
  Synthetic Polynucleotide
taatacgactcactatagggggaattggcgcctgctgacatactggaagaaacagaggagatcttccatgatgtcagcaaacctggcggcagcgcaaaagatg

SEQ ID NO: 192817 - DNA, 103 bp, Artificial Sequence
  Synthetic Polynucleotide
taatacgactcactatagggcagtagtattggaattggcgcctgctgacaaacagaggagatgtcagatggcgccaattaacctggcggcagcgcaaaagatg

SEQ ID NO: 192818 - DNA, 103 bp, Artificial Sequence
  Synthetic Polynucleotide
taatacgactcactataggggaaacaaaaacagtagtattggaattggcgaacagaggagacgccaaatgcaatactacaacctggcggcagcgcaaaagatg

SEQ ID NO: 192819 - DNA, 103 bp, Artificial Sequence
  Synthetic Polynucleotide
taatacgactcactatagggatctgattgtgaaacaaaaacagtagtattaacagaggagaaatactatggtttttgttaacctggcggcagcgcaaaagatg

SEQ ID NO: 192820 - DNA, 103 bp, Artificial Sequence
  Synthetic Polynucleotide
taatacgactcactatagggcctcaaatgcatctgattgtgaaacaaaaaaacagaggagatttttgatgcacaatcagaacctggcggcagcgcaaaagatg

SEQ ID NO: 192821 - DNA, 103 bp, Artificial Sequence
  Synthetic Polynucleotide
taatacgactcactatagggaagtcagatccctcaaatgcatctgattgtaacagaggagaacaatcatgtgcatttgaaacctggcggcagcgcaaaagatg

SEQ ID NO: 192822 - DNA, 103 bp, Artificial Sequence
  Synthetic Polynucleotide
taatacgactcactatagggtgcacaactgaagtcagatccctcaaatgcaacagaggagagcatttatgggatctgacaacctggcggcagcgcaaaagatg

SEQ ID NO: 192823 - DNA, 103 bp, Artificial Sequence
  Synthetic Polynucleotide
taatacgactcactatagggtaattctcacttttccttttccataatagtaacagaggagaactattatggaaaaggaaaacctggcggcagcgcaaaagatg

SEQ ID NO: 192824 - DNA, 103 bp, Artificial Sequence
  Synthetic Polynucleotide
taatacgactcactatagggtgctgttatctgcacaactgaagtcagatcaacagaggagagatctgatgtcagttgtgaacctggcggcagcgcaaaagatg

SEQ ID NO: 192825 - DNA, 103 bp, Artificial Sequence
  Synthetic Polynucleotide
taatacgactcactatagggtcatttatcatgctgttatctgcacaactgaacagaggagacagttgatgagataacagaacctggcggcagcgcaaaagatg

SEQ ID NO: 192826 - DNA, 103 bp, Artificial Sequence
  Synthetic Polynucleotide
taatacgactcactatagggtggtcccgactcatttatcatgctgttatcaacagaggagagataacatgatgataaataacctggcggcagcgcaaaagatg

SEQ ID NO: 192827 - DNA, 103 bp, Artificial Sequence
  Synthetic Polynucleotide
taatacgactcactatagggtactgtttgatggtcccgactcatttatcaaacagaggagatgataaatgagtcgggacaacctggcggcagcgcaaaagatg

SEQ ID NO: 192828 - DNA, 103 bp, Artificial Sequence
  Synthetic Polynucleotide
taatacgactcactatagggtttggattagtactgtttgatggtcccgacaacagaggagagtcgggatgatcaaacagaacctggcggcagcgcaaaagatg

SEQ ID NO: 192829 - DNA, 103 bp, Artificial Sequence
  Synthetic Polynucleotide
taatacgactcactatagggaccatgactgtttggattagtactgtttgaaacagaggagatcaaacatgactaatccaaacctggcggcagcgcaaaagatg

SEQ ID NO: 192830 - DNA, 103 bp, Artificial Sequence
  Synthetic Polynucleotide
taatacgactcactatagggcttgaacaaaaccatgactgtttggattagaacagaggagactaatcatgacagtcatgaacctggcggcagcgcaaaagatg

SEQ ID NO: 192831 - DNA, 103 bp, Artificial Sequence
  Synthetic Polynucleotide
taatacgactcactatagggtactgactatcttgaacaaaaccatgactgaacagaggagacagtcaatgttttgttcaaacctggcggcagcgcaaaagatg

SEQ ID NO: 192832 - DNA, 103 bp, Artificial Sequence
  Synthetic Polynucleotide
taatacgactcactatagggaatacctgaatactgactatcttgaacaaaaacagaggagatttgttatggatagtcagaacctggcggcagcgcaaaagatg

SEQ ID NO: 192833 - DNA, 103 bp, Artificial Sequence
  Synthetic Polynucleotide
taatacgactcactataggggcatactgccaatacctgaatactgactataacagaggagaatagtcatgattcaggtaaacctggcggcagcgcaaaagatg

SEQ ID NO: 192834 - DNA, 103 bp, Artificial Sequence
  Synthetic Polynucleotide
taatacgactcactataggggttactaatgtaattctcacttttccttttaacagaggagaaaaaggatgagtgagaataacctggcggcagcgcaaaagatg

SEQ ID NO: 192835 - DNA, 103 bp, Artificial Sequence
  Synthetic Polynucleotide
taatacgactcactatagggtgctcattttgcatactgccaatacctgaaaacagaggagattcaggatgtggcagtataacctggcggcagcgcaaaagatg

SEQ ID NO: 192836 - DNA, 103 bp, Artificial Sequence
  Synthetic Polynucleotide
taatacgactcactataggggtcactcaattgctcattttgcatactgccaacagaggagaggcagtatgcaaaatgagaacctggcggcagcgcaaaagatg

SEQ ID NO: 192837 - DNA, 103 bp, Artificial Sequence
  Synthetic Polynucleotide
taatacgactcactatagggatggaaaggagtcactcaattgctcattttaacagaggagaaaaatgatgaattgagtgaacctggcggcagcgcaaaagatg

SEQ ID NO: 192838 - DNA, 103 bp, Artificial Sequence
  Synthetic Polynucleotide
taatacgactcactatagggaaaaattcatatggaaaggagtcactcaataacagaggagaattgagatgctcctttccaacctggcggcagcgcaaaagatg

SEQ ID NO: 192839 - DNA, 103 bp, Artificial Sequence
  Synthetic Polynucleotide
taatacgactcactatagggttatacttgaaaaaattcatatggaaaggaaacagaggagatcctttatgtatgaatttaacctggcggcagcgcaaaagatg

SEQ ID NO: 192840 - DNA, 103 bp, Artificial Sequence
  Synthetic Polynucleotide
taatacgactcactataggggtcattctttgttactaatgtaattctcacaacagaggagagtgagaatgacattagtaaacctggcggcagcgcaaaagatg

SEQ ID NO: 192841 - DNA, 103 bp, Artificial Sequence
  Synthetic Polynucleotide
taatacgactcactatagggcaattatctctatatacgggttatacgcacaacagaggagagtgcgtatgacccgtataaacctggcggcagcgcaaaagatg

SEQ ID NO: 192842 - DNA, 103 bp, Artificial Sequence
  Synthetic Polynucleotide
taatacgactcactataggggtttatatgggtcattctttgttactaatgaacagaggagacattagatgcaaagaatgaacctggcggcagcgcaaaagatg

SEQ ID NO: 192843 - DNA, 103 bp, Artificial Sequence
  Synthetic Polynucleotide
taatacgactcactatagggtgaggatgaggtttatatgggtcattctttaacagaggagaaaagaaatgcccatataaaacctggcggcagcgcaaaagatg

SEQ ID NO: 192844 - DNA, 103 bp, Artificial Sequence
  Synthetic Polynucleotide
taatacgactcactatagggaactaaatcatgaggatgaggtttatatggaacagaggagaccatatatgcctcatcctaacctggcggcagcgcaaaagatg

SEQ ID NO: 192845 - DNA, 103 bp, Artificial Sequence
  Synthetic Polynucleotide
taatacgactcactatagggagtcttttccaactaaatcatgaggatgagaacagaggagactcatcatgatgatttagaacctggcggcagcgcaaaagatg

SEQ ID NO: 192846 - DNA, 103 bp, Artificial Sequence
  Synthetic Polynucleotide
taatacgactcactatagggccgtctctgcagtcttttccaactaaatcaaacagaggagatgatttatgtggaaaagaaacctggcggcagcgcaaaagatg

SEQ ID NO: 192847 - DNA, 103 bp, Artificial Sequence
  Synthetic Polynucleotide
taatacgactcactatagggttcatagtagccgtctctgcagtcttttccaacagaggagaggaaaaatgtgcagagacaacctggcggcagcgcaaaagatg

SEQ ID NO: 192848 - DNA, 103 bp, Artificial Sequence
  Synthetic Polynucleotide
taatacgactcactatagggcaaattctgcttcatagtagccgtctctgcaacagaggagagcagagatggctactatgaacctggcggcagcgcaaaagatg

SEQ ID NO: 192849 - DNA, 103 bp, Artificial Sequence
  Synthetic Polynucleotide
taatacgactcactatagggcgttcttgtccaaattctgcttcatagtagaacagaggagactactaatgagcagaattaacctggcggcagcgcaaaagatg

SEQ ID NO: 192850 - DNA, 103 bp, Artificial Sequence
  Synthetic Polynucleotide
taatacgactcactatagggcaaaggtctgcgttcttgtccaaattctgcaacagaggagagcagaaatgggacaagaaaacctggcggcagcgcaaaagatg

SEQ ID NO: 192851 - DNA, 103 bp, Artificial Sequence
  Synthetic Polynucleotide
taatacgactcactatagggtttggaaaaacaaaggtctgcgttcttgtcaacagaggagagacaagatggcagaccttaacctggcggcagcgcaaaagatg

SEQ ID NO: 192852 - DNA, 103 bp, Artificial Sequence
  Synthetic Polynucleotide
taatacgactcactatagggctgggttgttcaattatctctatatacgggaacagaggagacccgtaatgagagataataacctggcggcagcgcaaaagatg

SEQ ID NO: 192853 - DNA, 103 bp, Artificial Sequence
  Synthetic Polynucleotide
taatacgactcactatagggatacccaaattttggaaaaacaaaggtctgaacagaggagacagaccatggtttttccaaacctggcggcagcgcaaaagatg

SEQ ID NO: 192854 - DNA, 103 bp, Artificial Sequence
  Synthetic Polynucleotide
taatacgactcactatagggcacacatcgaatacccaaattttggaaaaaaacagaggagatttttcatgaatttgggtaacctggcggcagcgcaaaagatg

SEQ ID NO: 192855 - DNA, 103 bp, Artificial Sequence
  Synthetic Polynucleotide
taatacgactcactatagggcttttttcttcacacatcgaatacccaaataacagaggagaatttggatgttcgatgtgaacctggcggcagcgcaaaagatg

SEQ ID NO: 192856 - DNA, 103 bp, Artificial Sequence
  Synthetic Polynucleotide
taatacgactcactatagggtcttttacttcttttttcttcacacatcgaaacagaggagatcgatgatggaagaaaaaaacctggcggcagcgcaaaagatg

SEQ ID NO: 192857 - DNA, 103 bp, Artificial Sequence
  Synthetic Polynucleotide
taatacgactcactatagggaataatagcttcttttacttcttttttcttaacagaggagaaagaaaatggaagtaaaaaacctggcggcagcgcaaaagatg

SEQ ID NO: 192858 - DNA, 103 bp, Artificial Sequence
  Synthetic Polynucleotide
taatacgactcactatagggttattcttgtaataatagcttcttttacttaacagaggagaaagtaaatgaagctattaaacctggcggcagcgcaaaagatg

SEQ ID NO: 192859 - DNA, 103 bp, Artificial Sequence
  Synthetic Polynucleotide
taatacgactcactatagggattcctgcctttattcttgtaataatagctaacagaggagaagctatatgtacaagaataacctggcggcagcgcaaaagatg

SEQ ID NO: 192860 - DNA, 103 bp, Artificial Sequence
  Synthetic Polynucleotide
taatacgactcactataggggaatggattgattcctgcctttattcttgtaacagaggagaacaagaatgaaggcaggaaacctggcggcagcgcaaaagatg

SEQ ID NO: 192861 - DNA, 103 bp, Artificial Sequence
  Synthetic Polynucleotide
taatacgactcactatagggcagggacattgaatggattgattcctgcctaacagaggagaaggcagatgtcaatccataacctggcggcagcgcaaaagatg

SEQ ID NO: 192862 - DNA, 103 bp, Artificial Sequence
  Synthetic Polynucleotide
taatacgactcactatagggagctgtttttcagggacattgaatggattgaacagaggagacaatccatgcaatgtcccaacctggcggcagcgcaaaagatg

SEQ ID NO: 192863 - DNA, 103 bp, Artificial Sequence
  Synthetic Polynucleotide
taatacgactcactatagggtcccctctgcctgggttgttcaattatctcaacagaggagagagataatggaacaacccaacctggcggcagcgcaaaagatg

SEQ ID NO: 192864 - DNA, 103 bp, Artificial Sequence
  Synthetic Polynucleotide
taatacgactcactatagggaatatcattcagctgtttttcagggacattaacagaggagaaatgtcatggaaaaacagaacctggcggcagcgcaaaagatg

SEQ ID NO: 192865 - DNA, 103 bp, Artificial Sequence
  Synthetic Polynucleotide
taatacgactcactatagggcacaatcttcaatatcattcagctgtttttaacagaggagaaaaaacatgtgaatgataaacctggcggcagcgcaaaagatg

SEQ ID NO: 192866 - DNA, 103 bp, Artificial Sequence
  Synthetic Polynucleotide
taatacgactcactatagggacattgaggtcacaatcttcaatatcattcaacagaggagagaatgaatgtgaagattgaacctggcggcagcgcaaaagatg

SEQ ID NO: 192867 - DNA, 103 bp, Artificial Sequence
  Synthetic Polynucleotide
taatacgactcactatagggcagtctcaccacattgaggtcacaatcttcaacagaggagagaagatatggacctcaataacctggcggcagcgcaaaagatg

SEQ ID NO: 192868 - DNA, 103 bp, Artificial Sequence
  Synthetic Polynucleotide
taatacgactcactatagggcttgaaaacacagtctcaccacattgaggtaacagaggagaacctcaatgtggtgagacaacctggcggcagcgcaaaagatg

SEQ ID NO: 192869 - DNA, 103 bp, Artificial Sequence
  Synthetic Polynucleotide
taatacgactcactataggggggagaaaaacttgaaaacacagtctcaccaacagaggagaggtgagatggtgttttcaaacctggcggcagcgcaaaagatg

SEQ ID NO: 192870 - DNA, 103 bp, Artificial Sequence
  Synthetic Polynucleotide
taatacgactcactatagggatgttcatcagggagaaaaacttgaaaacaaacagaggagatgttttatggtttttctcaacctggcggcagcgcaaaagatg

SEQ ID NO: 192871 - DNA, 103 bp, Artificial Sequence
  Synthetic Polynucleotide
taatacgactcactatagggtcaaattaccatgttcatcagggagaaaaaaacagaggagatttttcatgctgatgaacaacctggcggcagcgcaaaagatg

SEQ ID NO: 192872 - DNA, 103 bp, Artificial Sequence
  Synthetic Polynucleotide
taatacgactcactatagggagagcagtcgtcaaattaccatgttcatcaaacagaggagatgatgaatgtggtaatttaacctggcggcagcgcaaaagatg

SEQ ID NO: 192873 - DNA, 103 bp, Artificial Sequence
  Synthetic Polynucleotide
taatacgactcactatagggaacaggaggaagagcagtcgtcaaattaccaacagaggagaggtaatatgacgactgctaacctggcggcagcgcaaaagatg

SEQ ID NO: 192874 - DNA, 103 bp, Artificial Sequence
  Synthetic Polynucleotide
taatacgactcactatagggtaaaacgcattcccctctgcctgggttgttaacagaggagaaacaacatgggcagagggaacctggcggcagcgcaaaagatg

SEQ ID NO: 192875 - DNA, 103 bp, Artificial Sequence
  Synthetic Polynucleotide
taatacgactcactatagggggttcgagacaacaggaggaagagcagtcgaacagaggagacgactgatgttcctcctgaacctggcggcagcgcaaaagatg

SEQ ID NO: 192876 - DNA, 103 bp, Artificial Sequence
  Synthetic Polynucleotide
taatacgactcactatagggtcataaattgggttcgagacaacaggaggaaacagaggagatcctccatgtgtctcgaaaacctggcggcagcgcaaaagatg

SEQ ID NO: 192877 - DNA, 103 bp, Artificial Sequence
  Synthetic Polynucleotide
taatacgactcactatagggagcacggttgtcataaattgggttcgagacaacagaggagagtctcgatgccaatttataacctggcggcagcgcaaaagatg

SEQ ID NO: 192878 - DNA, 103 bp, Artificial Sequence
  Synthetic Polynucleotide
taatacgactcactatagggcagtatttggagcacggttgtcataaattgaacagaggagacaatttatgacaaccgtgaacctggcggcagcgcaaaagatg

SEQ ID NO: 192879 - DNA, 103 bp, Artificial Sequence
  Synthetic Polynucleotide
taatacgactcactatagggcttaattctgcagtatttggagcacggttgaacagaggagacaaccgatgtccaaatacaacctggcggcagcgcaaaagatg

SEQ ID NO: 192880 - DNA, 103 bp, Artificial Sequence
  Synthetic Polynucleotide
taatacgactcactatagggacgacaaatccttaattctgcagtatttggaacagaggagaccaaatatggcagaattaaacctggcggcagcgcaaaagatg

SEQ ID NO: 192881 - DNA, 103 bp, Artificial Sequence
  Synthetic Polynucleotide
taatacgactcactatagggtcttgtttacacgacaaatccttaattctgaacagaggagacagaatatgggatttgtcaacctggcggcagcgcaaaagatg

SEQ ID NO: 192882 - DNA, 103 bp, Artificial Sequence
  Synthetic Polynucleotide
taatacgactcactatagggcttccacaattcttgtttacacgacaaatcaacagaggagagatttgatgtgtaaacaaaacctggcggcagcgcaaaagatg

SEQ ID NO: 192883 - DNA, 103 bp, Artificial Sequence
  Synthetic Polynucleotide
taatacgactcactatagggtcctctgacacttccacaattcttgtttacaacagaggagagtaaacatgaattgtggaaacctggcggcagcgcaaaagatg

SEQ ID NO: 192884 - DNA, 103 bp, Artificial Sequence
  Synthetic Polynucleotide
taatacgactcactatagggtttcatctcctcctctgacacttccacaataacagaggagaattgtgatggtgtcagagaacctggcggcagcgcaaaagatg

SEQ ID NO: 192885 - DNA, 103 bp, Artificial Sequence
  Synthetic Polynucleotide
taatacgactcactatagggcatttgtatctaaaacgcattcccctctgcaacagaggagagcagagatgaatgcgtttaacctggcggcagcgcaaaagatg

SEQ ID NO: 192886 - DNA, 103 bp, Artificial Sequence
  Synthetic Polynucleotide
taatacgactcactatagggagtagaaatatttcatctcctcctctgacaaacagaggagatgtcagatgaggagatgaaacctggcggcagcgcaaaagatg

SEQ ID NO: 192887 - DNA, 103 bp, Artificial Sequence
  Synthetic Polynucleotide
taatacgactcactatagggtttgtcacaaagtagaaatatttcatctccaacagaggagaggagatatgatatttctaaacctggcggcagcgcaaaagatg

SEQ ID NO: 192888 - DNA, 103 bp, Artificial Sequence
  Synthetic Polynucleotide
taatacgactcactatagggctttctgaactttgtcacaaagtagaaataaacagaggagatatttcatgtttgtgacaaacctggcggcagcgcaaaagatg

SEQ ID NO: 192889 - DNA, 103 bp, Artificial Sequence
  Synthetic Polynucleotide
taatacgactcactatagggtctatgtcatctttctgaactttgtcacaaaacagaggagattgtgaatgagttcagaaaacctggcggcagcgcaaaagatg

SEQ ID NO: 192890 - DNA, 103 bp, Artificial Sequence
  Synthetic Polynucleotide
taatacgactcactatagggaaaacgaacttctatgtcatctttctgaacaacagaggagagttcagatggatgacataaacctggcggcagcgcaaaagatg

SEQ ID NO: 192891 - DNA, 103 bp, Artificial Sequence
  Synthetic Polynucleotide
taatacgactcactatagggcgttcaacacaaaacgaacttctatgtcataacagaggagaatgacaatgaagttcgttaacctggcggcagcgcaaaagatg

SEQ ID NO: 192892 - DNA, 103 bp, Artificial Sequence
  Synthetic Polynucleotide
taatacgactcactataggggcttcccaatcgttcaacacaaaacgaactaacagaggagaagttcgatgtgtgttgaaaacctggcggcagcgcaaaagatg

SEQ ID NO: 192893 - DNA, 103 bp, Artificial Sequence
  Synthetic Polynucleotide
taatacgactcactataggggatgccttttgcttcccaatcgttcaacacaacagaggagagtgttgatggattgggaaaacctggcggcagcgcaaaagatg

SEQ ID NO: 192894 - DNA, 103 bp, Artificial Sequence
  Synthetic Polynucleotide
taatacgactcactatagggcttgtgaaaagatgccttttgcttcccaataacagaggagaattgggatgcaaaaggcaaacctggcggcagcgcaaaagatg

SEQ ID NO: 192895 - DNA, 103 bp, Artificial Sequence
  Synthetic Polynucleotide
taatacgactcactatagggtgtacatcagcttgtgaaaagatgccttttaacagaggagaaaaaggatgcttttcacaaacctggcggcagcgcaaaagatg

SEQ ID NO: 192896 - DNA, 103 bp, Artificial Sequence
  Synthetic Polynucleotide
taatacgactcactatagggtcgcccttcacatttgtatctaaaacgcataacagaggagaatgcgtatgagatacaaaaacctggcggcagcgcaaaagatg

SEQ ID NO: 192897 - DNA, 103 bp, Artificial Sequence
  Synthetic Polynucleotide
taatacgactcactatagggtacttgacggtgtacatcagcttgtgaaaaaacagaggagattttcaatggctgatgtaaacctggcggcagcgcaaaagatg

SEQ ID NO: 192898 - DNA, 103 bp, Artificial Sequence
  Synthetic Polynucleotide
taatacgactcactatagggaaacaatggctacttgacggtgtacatcagaacagaggagactgatgatgaccgtcaagaacctggcggcagcgcaaaagatg

SEQ ID NO: 192899 - DNA, 103 bp, Artificial Sequence
  Synthetic Polynucleotide
taatacgactcactatagggggagttttgaaaacaatggctacttgacggaacagaggagaccgtcaatgagccattgtaacctggcggcagcgcaaaagatg

SEQ ID NO: 192900 - DNA, 103 bp, Artificial Sequence
  Synthetic Polynucleotide
taatacgactcactataggggcaatatggtggagttttgaaaacaatggcaacagaggagagccattatgttcaaaactaacctggcggcagcgcaaaagatg

SEQ ID NO: 192901 - DNA, 103 bp, Artificial Sequence
  Synthetic Polynucleotide
taatacgactcactatagggtgatagctttgcaatatggtggagttttgaaacagaggagatcaaaaatgcaccatattaacctggcggcagcgcaaaagatg

SEQ ID NO: 192902 - DNA, 103 bp, Artificial Sequence
  Synthetic Polynucleotide
taatacgactcactatagggacgggttctgtgatagctttgcaatatggtaacagaggagaaccataatgcaaagctataacctggcggcagcgcaaaagatg

SEQ ID NO: 192903 - DNA, 103 bp, Artificial Sequence
  Synthetic Polynucleotide
taatacgactcactatagggttttactgttacgggttctgtgatagctttaacagaggagaaaagctatgacagaacccaacctggcggcagcgcaaaagatg

SEQ ID NO: 192904 - DNA, 103 bp, Artificial Sequence
  Synthetic Polynucleotide
taatacgactcactataggggcaactgcatttttactgttacgggttctgaacagaggagacagaacatgtaacagtaaaacctggcggcagcgcaaaagatg

SEQ ID NO: 192905 - DNA, 103 bp, Artificial Sequence
  Synthetic Polynucleotide
taatacgactcactataggggaaggtctccgcaactgcatttttactgttaacagaggagaaacagtatgaatgcagttaacctggcggcagcgcaaaagatg

SEQ ID NO: 192906 - DNA, 103 bp, Artificial Sequence
  Synthetic Polynucleotide
taatacgactcactatagggttcctggtcagaaggtctccgcaactgcataacagaggagaatgcagatgcggagacctaacctggcggcagcgcaaaagatg

SEQ ID NO: 192907 - DNA, 103 bp, Artificial Sequence
  Synthetic Polynucleotide
taatacgactcactatagggtgcctgctgatcgcccttcacatttgtatcaacagaggagagatacaatggtgaagggcaacctggcggcagcgcaaaagatg

SEQ ID NO: 192908 - DNA, 103 bp, Artificial Sequence
  Synthetic Polynucleotide
taatacgactcactatagggattcactaacttcctggtcagaaggtctccaacagaggagaggagacatgctgaccaggaacctggcggcagcgcaaaagatg

SEQ ID NO: 192909 - DNA, 103 bp, Artificial Sequence
  Synthetic Polynucleotide
taatacgactcactatagggaaatccatagattcactaacttcctggtcaaacagaggagatgaccaatgagttagtgaaacctggcggcagcgcaaaagatg

SEQ ID NO: 192910 - DNA, 103 bp, Artificial Sequence
  Synthetic Polynucleotide
taatacgactcactatagggcagatatctaaaatccatagattcactaacaacagaggagagttagtatgtctatggataacctggcggcagcgcaaaagatg

SEQ ID NO: 192911 - DNA, 103 bp, Artificial Sequence
  Synthetic Polynucleotide
taatacgactcactatagggtttcatctggcagatatctaaaatccatagaacagaggagactatggatgttagatatcaacctggcggcagcgcaaaagatg

SEQ ID NO: 192912 - DNA, 103 bp, Artificial Sequence
  Synthetic Polynucleotide
taatacgactcactatagggtaagtatctttttcatctggcagatatctaaacagaggagatagataatggccagatgaaacctggcggcagcgcaaaagatg

SEQ ID NO: 192913 - DNA, 103 bp, Artificial Sequence
  Synthetic Polynucleotide
taatacgactcactatagggtttattgccgtaagtatctttttcatctggaacagaggagaccagatatgaaagatactaacctggcggcagcgcaaaagatg

SEQ ID NO: 192914 - DNA, 103 bp, Artificial Sequence
  Synthetic Polynucleotide
taatacgactcactataggggtttctttgctttattgccgtaagtatcttaacagaggagaaagataatgacggcaataaacctggcggcagcgcaaaagatg

SEQ ID NO: 192915 - DNA, 103 bp, Artificial Sequence
  Synthetic Polynucleotide
taatacgactcactataggggttgtcttttgtttctttgctttattgccgaacagaggagacggcaaatgagcaaagaaaacctggcggcagcgcaaaagatg

SEQ ID NO: 192916 - DNA, 103 bp, Artificial Sequence
  Synthetic Polynucleotide
taatacgactcactataggggaaaagcagagttgtcttttgtttctttgcaacagaggagagcaaagatgcaaaagacaaacctggcggcagcgcaaaagatg

SEQ ID NO: 192917 - DNA, 103 bp, Artificial Sequence
  Synthetic Polynucleotide
taatacgactcactatagggacagtttctggaaaagcagagttgtcttttaacagaggagaaaaagaatgctctgctttaacctggcggcagcgcaaaagatg

SEQ ID NO: 192918 - DNA, 103 bp, Artificial Sequence
  Synthetic Polynucleotide
taatacgactcactatagggcctggaatgctgcctgctgatcgcccttcaaacagaggagatgaaggatgatcagcaggaacctggcggcagcgcaaaagatg

SEQ ID NO: 192919 - DNA, 103 bp, Artificial Sequence
  Synthetic Polynucleotide
taatacgactcactatagggtgatcctggcacagtttctggaaaagcagaaacagaggagatctgctatgccagaaactaacctggcggcagcgcaaaagatg

SEQ ID NO: 192920 - DNA, 103 bp, Artificial Sequence
  Synthetic Polynucleotide
taatacgactcactatagggtgtttctacgtgatcctggcacagtttctgaacagaggagacagaaaatgtgccaggataacctggcggcagcgcaaaagatg

SEQ ID NO: 192921 - DNA, 103 bp, Artificial Sequence
  Synthetic Polynucleotide
taatacgactcactatagggggcgaaaccctgtttctacgtgatcctggcaacagaggagagccaggatgacgtagaaaaacctggcggcagcgcaaaagatg

SEQ ID NO: 192922 - DNA, 103 bp, Artificial Sequence
  Synthetic Polynucleotide
taatacgactcactatagggtggtcaacatggcgaaaccctgtttctacgaacagaggagacgtagaatgagggtttcgaacctggcggcagcgcaaaagatg

SEQ ID NO: 192923 - DNA, 103 bp, Artificial Sequence
  Synthetic Polynucleotide
taatacgactcactatagggaagaccatcctggtcaacatggcgaaacccaacagaggagagggtttatgcatgttgacaacctggcggcagcgcaaaagatg

SEQ ID NO: 192924 - DNA, 103 bp, Artificial Sequence
  Synthetic Polynucleotide
taatacgactcactatagggtcaggagttcaagaccatcctggtcaacataacagaggagaatgttgatgaggatggtcaacctggcggcagcgcaaaagatg

SEQ ID NO: 192925 - DNA, 103 bp, Artificial Sequence
  Synthetic Polynucleotide
taatacgactcactatagggtcacctgatgtcaggagttcaagaccatccaacagaggagaggatggatgtgaactcctaacctggcggcagcgcaaaagatg

SEQ ID NO: 192926 - DNA, 103 bp, Artificial Sequence
  Synthetic Polynucleotide
taatacgactcactatagggggtgggtggatcacctgatgtcaggagttcaacagaggagagaactcatgacatcaggtaacctggcggcagcgcaaaagatg

SEQ ID NO: 192927 - DNA, 103 bp, Artificial Sequence
  Synthetic Polynucleotide
taatacgactcactataggggggaggccaaggtgggtggatcacctgatgaacagaggagacatcagatgatccacccaaacctggcggcagcgcaaaagatg

SEQ ID NO: 192928 - DNA, 103 bp, Artificial Sequence
  Synthetic Polynucleotide
taatacgactcactatagggccagcactttgggaggccaaggtgggtggaaacagaggagatccaccatgcttggcctcaacctggcggcagcgcaaaagatg

SEQ ID NO: 192929 - DNA, 103 bp, Artificial Sequence
  Synthetic Polynucleotide
taatacgactcactatagggcgggaagatgagggggaacagttcgtccataacagaggagaatggacatgctgttccccaacctggcggcagcgcaaaagatg

SEQ ID NO: 192930 - DNA, 103 bp, Artificial Sequence
  Synthetic Polynucleotide
taatacgactcactatagggcccctcgcacttgtagcggaagcgcatgccaacagaggagaggcatgatgttccgctacaacctggcggcagcgcaaaagatg

SEQ ID NO: 192931 - DNA, 103 bp, Artificial Sequence
  Synthetic Polynucleotide
taatacgactcactatagggcttggggacagaagctgagctgcgggaaggaacagaggagaccttccatgagctcagctaacctggcggcagcgcaaaagatg

SEQ ID NO: 192932 - DNA, 103 bp, Artificial Sequence
  Synthetic Polynucleotide
taatacgactcactatagggggggtgctggcttggggacagaagctgagcaacagaggagagctcagatgctgtccccaaacctggcggcagcgcaaaagatg

SEQ ID NO: 192933 - DNA, 103 bp, Artificial Sequence
  Synthetic Polynucleotide
taatacgactcactatagggggatagggctggggtgctggcttggggacaaacagaggagatgtcccatggccagcaccaacctggcggcagcgcaaaagatg

SEQ ID NO: 192934 - DNA, 103 bp, Artificial Sequence
  Synthetic Polynucleotide
taatacgactcactatagggtgacgtaaagggatagggctggggtgctggaacagaggagaccagcaatgcagccctataacctggcggcagcgcaaaagatg

SEQ ID NO: 192935 - DNA, 103 bp, Artificial Sequence
  Synthetic Polynucleotide
taatacgactcactatagggtgctcagggatgacgtaaagggatagggctaacagaggagaagccctatgcctttacgtaacctggcggcagcgcaaaagatg

SEQ ID NO: 192936 - DNA, 103 bp, Artificial Sequence
  Synthetic Polynucleotide
taatacgactcactatagggtagttgatggtgctcagggatgacgtaaagaacagaggagactttacatgatccctgagaacctggcggcagcgcaaaagatg

SEQ ID NO: 192937 - DNA, 103 bp, Artificial Sequence
  Synthetic Polynucleotide
taatacgactcactatagggaaactcatcatagttgatggtgctcagggaaacagaggagatccctgatgaccatcaacaacctggcggcagcgcaaaagatg

SEQ ID NO: 192938 - DNA, 103 bp, Artificial Sequence
  Synthetic Polynucleotide
taatacgactcactatagggccatggtgggaaactcatcatagttgatggaacagaggagaccatcaatgatgatgagtaacctggcggcagcgcaaaagatg

SEQ ID NO: 192939 - DNA, 103 bp, Artificial Sequence
  Synthetic Polynucleotide
taatacgactcactataggggaaggaaacaccatggtgggaaactcatcaaacagaggagatgatgaatgtcccaccataacctggcggcagcgcaaaagatg

SEQ ID NO: 192940 - DNA, 103 bp, Artificial Sequence
  Synthetic Polynucleotide
taatacgactcactataggggatctgcccagaaggaaacaccatggtgggaacagaggagacccaccatggtgtttcctaacctggcggcagcgcaaaagatg

SEQ ID NO: 192941 - DNA, 103 bp, Artificial Sequence
  Synthetic Polynucleotide
taatacgactcactatagggccgcggagcgcccctcgcacttgtagcggaaacagaggagatccgctatgagtgcgaggaacctggcggcagcgcaaaagatg

SEQ ID NO: 192942 - DNA, 103 bp, Artificial Sequence
  Synthetic Polynucleotide
taatacgactcactatagggaggcctggctgatctgcccagaaggaaacaaacagaggagatgtttcatgctgggcagaaacctggcggcagcgcaaaagatg

SEQ ID NO: 192943 - DNA, 103 bp, Artificial Sequence
  Synthetic Polynucleotide
taatacgactcactataggggccaaggccgaggcctggctgatctgcccaaacagaggagatgggcaatgcagccaggcaacctggcggcagcgcaaaagatg

SEQ ID NO: 192944 - DNA, 103 bp, Artificial Sequence
  Synthetic Polynucleotide
taatacgactcactatagggaggggccggggccaaggccgaggcctggctaacagaggagaagccagatgtcggccttgaacctggcggcagcgcaaaagatg

SEQ ID NO: 192945 - DNA, 103 bp, Artificial Sequence
  Synthetic Polynucleotide
taatacgactcactatagggggacttggggaggggccggggccaaggccgaacagaggagacggcctatgccccggcccaacctggcggcagcgcaaaagatg

SEQ ID NO: 192946 - DNA, 103 bp, Artificial Sequence
  Synthetic Polynucleotide
taatacgactcactataggggcctggggcaggacttggggaggggccgggaacagaggagacccggcatgtccccaagtaacctggcggcagcgcaaaagatg

SEQ ID NO: 192947 - DNA, 103 bp, Artificial Sequence
  Synthetic Polynucleotide
taatacgactcactatagggaggggctggagcctggggcaggacttggggaacagaggagaccccaaatgctgccccagaacctggcggcagcgcaaaagatg

SEQ ID NO: 192948 - DNA, 103 bp, Artificial Sequence
  Synthetic Polynucleotide
taatacgactcactataggggagcaggggcaggggctggagcctggggcaaacagaggagatgccccatgctccagcccaacctggcggcagcgcaaaagatg

SEQ ID NO: 192949 - DNA, 103 bp, Artificial Sequence
  Synthetic Polynucleotide
taatacgactcactatagggaccatggctggagcaggggcaggggctggaaacagaggagatccagcatgtgcccctgcaacctggcggcagcgcaaaagatg

SEQ ID NO: 192950 - DNA, 103 bp, Artificial Sequence
  Synthetic Polynucleotide
taatacgactcactatagggcagagctgataccatggctggagcaggggcaacagaggagagcccctatgccagccatgaacctggcggcagcgcaaaagatg

SEQ ID NO: 192951 - DNA, 103 bp, Artificial Sequence
  Synthetic Polynucleotide
taatacgactcactataggggggcctgggccagagctgataccatggctgaacagaggagacagccaatgtatcagctcaacctggcggcagcgcaaaagatg

SEQ ID NO: 192952 - DNA, 103 bp, Artificial Sequence
  Synthetic Polynucleotide
taatacgactcactataggggggatgctgcccgcggagcgcccctcgcacaacagaggagagtgcgaatggcgctccgcaacctggcggcagcgcaaaagatg

SEQ ID NO: 192953 - DNA, 103 bp, Artificial Sequence
  Synthetic Polynucleotide
taatacgactcactatagggacaggggctggggcctgggccagagctgataacagaggagaatcagcatgggcccaggcaacctggcggcagcgcaaaagatg

SEQ ID NO: 192954 - DNA, 103 bp, Artificial Sequence
  Synthetic Polynucleotide
taatacgactcactatagggtaggactgggacaggggctggggcctgggcaacagaggagagcccagatgccagcccctaacctggcggcagcgcaaaagatg

SEQ ID NO: 192955 - DNA, 103 bp, Artificial Sequence
  Synthetic Polynucleotide
taatacgactcactatagggggcctggggctaggactgggacaggggctgaacagaggagacagcccatgtcccagtccaacctggcggcagcgcaaaagatg

SEQ ID NO: 192956 - DNA, 103 bp, Artificial Sequence
  Synthetic Polynucleotide
taatacgactcactataggggcctgaggagggcctggggctaggactgggaacagaggagacccagtatgagccccaggaacctggcggcagcgcaaaagatg

SEQ ID NO: 192957 - DNA, 103 bp, Artificial Sequence
  Synthetic Polynucleotide
taatacgactcactatagggtggggccacagcctgaggagggcctggggcaacagaggagagccccaatgcctcctcagaacctggcggcagcgcaaaagatg

SEQ ID NO: 192958 - DNA, 103 bp, Artificial Sequence
  Synthetic Polynucleotide
taatacgactcactatagggtgggggcaggtggggccacagcctgaggagaacagaggagactcctcatgctgtggcccaacctggcggcagcgcaaaagatg

SEQ ID NO: 192959 - DNA, 103 bp, Artificial Sequence
  Synthetic Polynucleotide
taatacgactcactatagggtgggtgggcttgggggcaggtggggccacaaacagaggagatgtggcatgacctgccccaacctggcggcagcgcaaaagatg

SEQ ID NO: 192960 - DNA, 103 bp, Artificial Sequence
  Synthetic Polynucleotide
taatacgactcactatagggttccccagcctgggtgggcttgggggcaggaacagaggagacctgccatgaagcccaccaacctggcggcagcgcaaaagatg

SEQ ID NO: 192961 - DNA, 103 bp, Artificial Sequence
  Synthetic Polynucleotide
taatacgactcactatagggacagcgttccttccccagcctgggtgggctaacagaggagaagcccaatgaggctggggaacctggcggcagcgcaaaagatg

SEQ ID NO: 192962 - DNA, 103 bp, Artificial Sequence
  Synthetic Polynucleotide
taatacgactcactatagggagggcctctgacagcgttccttccccagccaacagaggagaggctggatgaggaacgctaacctggcggcagcgcaaaagatg

SEQ ID NO: 192963 - DNA, 103 bp, Artificial Sequence
  Synthetic Polynucleotide
taatacgactcactatagggcctctcgcctgggatgctgcccgcggagcgaacagaggagacgctccatgggcagcatcaacctggcggcagcgcaaaagatg

SEQ ID NO: 192964 - DNA, 103 bp, Artificial Sequence
  Synthetic Polynucleotide
taatacgactcactatagggcagctgcagcagggcctctgacagcgttccaacagaggagaggaacgatgtcagaggccaacctggcggcagcgcaaaagatg

SEQ ID NO: 192965 - DNA, 103 bp, Artificial Sequence
  Synthetic Polynucleotide
taatacgactcactatagggcatcaaactgcagctgcagcagggcctctgaacagaggagacagaggatgtgctgcagcaacctggcggcagcgcaaaagatg

SEQ ID NO: 192966 - DNA, 103 bp, Artificial Sequence
  Synthetic Polynucleotide
taatacgactcactatagggaggtcttcatcatcaaactgcagctgcagcaacagaggagagctgcaatggcagtttgaaacctggcggcagcgcaaaagatg

SEQ ID NO: 192967 - DNA, 103 bp, Artificial Sequence
  Synthetic Polynucleotide
taatacgactcactatagggcaaggcccccaggtcttcatcatcaaactgaacagaggagacagtttatggatgaagacaacctggcggcagcgcaaaagatg

SEQ ID NO: 192968 - DNA, 103 bp, Artificial Sequence
  Synthetic Polynucleotide
taatacgactcactatagggtgttgccaagcaaggcccccaggtcttcataacagaggagaatgaagatgtgggggcctaacctggcggcagcgcaaaagatg

SEQ ID NO: 192969 - DNA, 103 bp, Artificial Sequence
  Synthetic Polynucleotide
taatacgactcactataggggggtctgtgctgttgccaagcaaggcccccaacagaggagagggggcatggcttggcaaaacctggcggcagcgcaaaagatg

SEQ ID NO: 192970 - DNA, 103 bp, Artificial Sequence
  Synthetic Polynucleotide
taatacgactcactataggggaacacagctgggtctgtgctgttgccaagaacagaggagacttggcatgagcacagacaacctggcggcagcgcaaaagatg

SEQ ID NO: 192971 - DNA, 103 bp, Artificial Sequence
  Synthetic Polynucleotide
taatacgactcactatagggccaggtctgtgaacacagctgggtctgtgcaacagaggagagcacagatgcagctgtgtaacctggcggcagcgcaaaagatg

SEQ ID NO: 192972 - DNA, 103 bp, Artificial Sequence
  Synthetic Polynucleotide
taatacgactcactatagggtcgacggatgccaggtctgtgaacacagctaacagaggagaagctgtatgcacagacctaacctggcggcagcgcaaaagatg

SEQ ID NO: 192973 - DNA, 103 bp, Artificial Sequence
  Synthetic Polynucleotide
taatacgactcactatagggctcggagttgtcgacggatgccaggtctgtaacagaggagaacagacatggcatccgtcaacctggcggcagcgcaaaagatg

SEQ ID NO: 192974 - DNA, 103 bp, Artificial Sequence
  Synthetic Polynucleotide
taatacgactcactatagggtatctgtgctcctctcgcctgggatgctgcaacagaggagagcagcaatgcaggcgagaaacctggcggcagcgcaaaagatg

SEQ ID NO: 192975 - DNA, 103 bp, Artificial Sequence
  Synthetic Polynucleotide
taatacgactcactataggggctgctgaaactcggagttgtcgacggatgaacagaggagacatccgatgacaactccgaacctggcggcagcgcaaaagatg

SEQ ID NO: 192976 - DNA, 103 bp, Artificial Sequence
  Synthetic Polynucleotide
taatacgactcactatagggtggttcagcagctgctgaaactcggagttgaacagaggagacaactcatggtttcagcaaacctggcggcagcgcaaaagatg

SEQ ID NO: 192977 - DNA, 103 bp, Artificial Sequence
  Synthetic Polynucleotide
taatacgactcactatagggaggtatgccctggttcagcagctgctgaaaaacagaggagatttcagatgctgctgaacaacctggcggcagcgcaaaagatg

SEQ ID NO: 192978 - DNA, 103 bp, Artificial Sequence
  Synthetic Polynucleotide
taatacgactcactatagggggggggccacaggtatgccctggttcagcaaacagaggagatgctgaatgagggcatacaacctggcggcagcgcaaaagatg

SEQ ID NO: 192979 - DNA, 103 bp, Artificial Sequence
  Synthetic Polynucleotide
taatacgactcactatagggtcagttgtgtggggggccacaggtatgcccaacagaggagagggcatatgtgtggccccaacctggcggcagcgcaaaagatg

SEQ ID NO: 192980 - DNA, 103 bp, Artificial Sequence
  Synthetic Polynucleotide
taatacgactcactatagggcagcatgggctcagttgtgtggggggccacaacagaggagagtggccatgcacacaactaacctggcggcagcgcaaaagatg

SEQ ID NO: 192981 - DNA, 103 bp, Artificial Sequence
  Synthetic Polynucleotide
taatacgactcactatagggggtactccatcagcatgggctcagttgtgtaacagaggagaacacaaatgagcccatgcaacctggcggcagcgcaaaagatg

SEQ ID NO: 192982 - DNA, 103 bp, Artificial Sequence
  Synthetic Polynucleotide
taatacgactcactatagggatagcctcagggtactccatcagcatgggcaacagaggagagcccatatggatggagtaaacctggcggcagcgcaaaagatg

SEQ ID NO: 192983 - DNA, 103 bp, Artificial Sequence
  Synthetic Polynucleotide
taatacgactcactatagggtaggcgagttatagcctcagggtactccataacagaggagaatggagatgcctgaggctaacctggcggcagcgcaaaagatg

SEQ ID NO: 192984 - DNA, 103 bp, Artificial Sequence
  Synthetic Polynucleotide
taatacgactcactatagggcccctgtcactaggcgagttatagcctcagaacagaggagactgaggatgtaactcgccaacctggcggcagcgcaaaagatg

SEQ ID NO: 192985 - DNA, 103 bp, Artificial Sequence
  Synthetic Polynucleotide
taatacgactcactataggggtcttggtggtatctgtgctcctctcgcctaacagaggagaaggcgaatggagcacagaaacctggcggcagcgcaaaagatg

SEQ ID NO: 192986 - DNA, 103 bp, Artificial Sequence
  Synthetic Polynucleotide
taatacgactcactatagggggcctctgggcccctgtcactaggcgagttaacagaggagaaactcgatgagtgacaggaacctggcggcagcgcaaaagatg

SEQ ID NO: 192987 - DNA, 103 bp, Artificial Sequence
  Synthetic Polynucleotide
taatacgactcactatagggtgggtcggggggcctctgggcccctgtcacaacagaggagagtgacaatggcccagaggaacctggcggcagcgcaaaagatg

SEQ ID NO: 192988 - DNA, 103 bp, Artificial Sequence
  Synthetic Polynucleotide
taatacgactcactataggggagcaggagctgggtcggggggcctctgggaacagaggagacccagaatgcccccgaccaacctggcggcagcgcaaaagatg

SEQ ID NO: 192989 - DNA, 103 bp, Artificial Sequence
  Synthetic Polynucleotide
taatacgactcactataggggcccccagtggagcaggagctgggtcggggaacagaggagaccccgaatgagctcctgcaacctggcggcagcgcaaaagatg

SEQ ID NO: 192990 - DNA, 103 bp, Artificial Sequence
  Synthetic Polynucleotide
taatacgactcactataggggagccccggggcccccagtggagcaggagcaacagaggagagctcctatgccactggggaacctggcggcagcgcaaaagatg

SEQ ID NO: 192991 - DNA, 103 bp, Artificial Sequence
  Synthetic Polynucleotide
taatacgactcactatagggggccattggggagccccggggcccccagtgaacagaggagacactggatgccccggggcaacctggcggcagcgcaaaagatg

SEQ ID NO: 192992 - DNA, 103 bp, Artificial Sequence
  Synthetic Polynucleotide
taatacgactcactatagggcctgaaaggaggccattggggagccccgggaacagaggagacccgggatgccccaatggaacctggcggcagcgcaaaagatg

SEQ ID NO: 192993 - DNA, 103 bp, Artificial Sequence
  Synthetic Polynucleotide
taatacgactcactataggggtcttcatctcctgaaaggaggccattgggaacagaggagacccaatatgctcctttcaaacctggcggcagcgcaaaagatg

SEQ ID NO: 192994 - DNA, 103 bp, Artificial Sequence
  Synthetic Polynucleotide
taatacgactcactatagggtggaggagaagtcttcatctcctgaaaggaaacagaggagatcctttatggagatgaagaacctggcggcagcgcaaaagatg

SEQ ID NO: 192995 - DNA, 103 bp, Artificial Sequence
  Synthetic Polynucleotide
taatacgactcactatagggatgtccgcaatggaggagaagtcttcatctaacagaggagaagatgaatgcttctcctcaacctggcggcagcgcaaaagatg

SEQ ID NO: 192996 - DNA, 103 bp, Artificial Sequence
  Synthetic Polynucleotide
taatacgactcactatagggggtggggtgggtcttggtggtatctgtgctaacagaggagaagcacaatgaccaccaagaacctggcggcagcgcaaaagatg

SEQ ID NO: 192997 - DNA, 103 bp, Artificial Sequence
  Synthetic Polynucleotide
taatacgactcactatagggtgagaagtccatgtccgcaatggaggagaaaacagaggagattctccatgattgcggacaacctggcggcagcgcaaaagatg

SEQ ID NO: 192998 - DNA, 103 bp, Artificial Sequence
  Synthetic Polynucleotide
taatacgactcactatagggtcagcagggctgagaagtccatgtccgcaaaacagaggagattgcggatgtggacttctaacctggcggcagcgcaaaagatg

SEQ ID NO: 192999 - DNA, 103 bp, Artificial Sequence
  Synthetic Polynucleotide
taatacgactcactatagggctgatctgactcagcagggctgagaagtccaacagaggagaggacttatgagccctgctaacctggcggcagcgcaaaagatg

SEQ ID NO: 193000 - DNA, 103 bp, Artificial Sequence
  Synthetic Polynucleotide
taatacgactcactatagggtgatcttgatggtggggtgggtcttggtggaacagaggagaccaccaatgcccaccccaaacctggcggcagcgcaaaagatg

SEQ ID NO: 193001 - DNA, 103 bp, Artificial Sequence
  Synthetic Polynucleotide
taatacgactcactataggggtgtagccattgatcttgatggtggggtggaacagaggagaccacccatgcatcaagataacctggcggcagcgcaaaagatg

SEQ ID NO: 193002 - DNA, 103 bp, Artificial Sequence
  Synthetic Polynucleotide
taatacgactcactatagggccctggtcctgtgtagccattgatcttgataacagaggagaatcaagatgaatggctacaacctggcggcagcgcaaaagatg

SEQ ID NO: 193003 - DNA, 103 bp, Artificial Sequence
  Synthetic Polynucleotide
taatacgactcactatagggctggctctgccgggaagatgagggggaacaaacagaggagatgttccatgtcatcttccaacctggcggcagcgcaaaagatg

SEQ ID NO: 193004 - DNA, 103 bp, Artificial Sequence
  Synthetic Polynucleotide
taatacgactcactatagggtgcgcactgtccctggtcctgtgtagccataacagaggagaatggctatgcaggaccagaacctggcggcagcgcaaaagatg

SEQ ID NO: 193005 - DNA, 103 bp, Artificial Sequence
  Synthetic Polynucleotide
taatacgactcactatagggaccagggagatgcgcactgtccctggtcctaacagaggagaaggaccatggacagtgcgaacctggcggcagcgcaaaagatg

SEQ ID NO: 193006 - DNA, 103 bp, Artificial Sequence
  Synthetic Polynucleotide
taatacgactcactataggggtccttggtgaccagggagatgcgcactgtaacagaggagaacagtgatgatctccctgaacctggcggcagcgcaaaagatg

SEQ ID NO: 193007 - DNA, 103 bp, Artificial Sequence
  Synthetic Polynucleotide
taatacgactcactatagggggtgaggagggtccttggtgaccagggagaaacagaggagatctcccatgtcaccaaggaacctggcggcagcgcaaaagatg

SEQ ID NO: 193008 - DNA, 103 bp, Artificial Sequence
  Synthetic Polynucleotide
taatacgactcactataggggggtgaggccggtgaggagggtccttggtgaacagaggagacaccaaatgccctcctcaaacctggcggcagcgcaaaagatg

SEQ ID NO: 193009 - DNA, 103 bp, Artificial Sequence
  Synthetic Polynucleotide
taatacgactcactatagggaagctcgtgggggtgaggccggtgaggaggaacagaggagacctcctatgcggcctcacaacctggcggcagcgcaaaagatg

SEQ ID NO: 193010 - DNA, 103 bp, Artificial Sequence
  Synthetic Polynucleotide
taatacgactcactatagggcctttcctacaagctcgtgggggtgaggccaacagaggagaggcctcatgcccacgagcaacctggcggcagcgcaaaagatg

SEQ ID NO: 193011 - DNA, 103 bp, Artificial Sequence
  Synthetic Polynucleotide
taatacgactcactatagggtcccggcagtcctttcctacaagctcgtggaacagaggagaccacgaatgtgtaggaaaaacctggcggcagcgcaaaagatg

SEQ ID NO: 193012 - DNA, 103 bp, Artificial Sequence
  Synthetic Polynucleotide
taatacgactcactatagggatagaagccatcccggcagtcctttcctacaacagaggagagtaggaatggactgccggaacctggcggcagcgcaaaagatg

SEQ ID NO: 193013 - DNA, 103 bp, Artificial Sequence
  Synthetic Polynucleotide
taatacgactcactataggggctcagcctcatagaagccatcccggcagtaacagaggagaactgccatgatggcttctaacctggcggcagcgcaaaagatg

SEQ ID NO: 193014 - DNA, 103 bp, Artificial Sequence
  Synthetic Polynucleotide
taatacgactcactataggggaggcctgggctggctctgccgggaagatgaacagaggagacatcttatgggcagagccaacctggcggcagcgcaaaagatg

SEQ ID NO: 193015 - DNA, 103 bp, Artificial Sequence
  Synthetic Polynucleotide
taatacgactcactatagggtccgggcagagctcagcctcatagaagccaaacagaggagatggcttatgtgaggctgaaacctggcggcagcgcaaaagatg

SEQ ID NO: 193016 - DNA, 103 bp, Artificial Sequence
  Synthetic Polynucleotide
taatacgactcactataggggatgcagcggtccgggcagagctcagcctcaacagaggagagaggctatgctctgcccgaacctggcggcagcgcaaaagatg

SEQ ID NO: 193017 - DNA, 103 bp, Artificial Sequence
  Synthetic Polynucleotide
taatacgactcactatagggggaaactgtggatgcagcggtccgggcagaaacagaggagatctgccatgaccgctgcaaacctggcggcagcgcaaaagatg

SEQ ID NO: 193018 - DNA, 103 bp, Artificial Sequence
  Synthetic Polynucleotide
taatacgactcactatagggcccaggttctggaaactgtggatgcagcggaacagaggagaccgctgatgccacagtttaacctggcggcagcgcaaaagatg

SEQ ID NO: 193019 - DNA, 103 bp, Artificial Sequence
  Synthetic Polynucleotide
taatacgactcactatagggacactggattcccaggttctggaaactgtgaacagaggagacacagtatgcagaacctgaacctggcggcagcgcaaaagatg

SEQ ID NO: 193020 - DNA, 103 bp, Artificial Sequence
  Synthetic Polynucleotide
taatacgactcactataggggcttcttcacacactggattcccaggttctaacagaggagaagaaccatggaatccagtaacctggcggcagcgcaaaagatg

SEQ ID NO: 193021 - DNA, 103 bp, Artificial Sequence
  Synthetic Polynucleotide
taatacgactcactatagggtccaggtcccgcttcttcacacactggattaacagaggagaaatccaatgtgtgaagaaaacctggcggcagcgcaaaagatg

SEQ ID NO: 193022 - DNA, 103 bp, Artificial Sequence
  Synthetic Polynucleotide
taatacgactcactataggggatagcctgctccaggtcccgcttcttcacaacagaggagagtgaagatgcgggacctgaacctggcggcagcgcaaaagatg

SEQ ID NO: 193023 - DNA, 103 bp, Artificial Sequence
  Synthetic Polynucleotide
taatacgactcactatagggtgcgctgactgatagcctgctccaggtcccaacagaggagagggaccatgagcaggctaaacctggcggcagcgcaaaagatg

SEQ ID NO: 193024 - DNA, 103 bp, Artificial Sequence
  Synthetic Polynucleotide
taatacgactcactatagggttggtctggatgcgctgactgatagcctgcaacagaggagagcaggcatgcagtcagcgaacctggcggcagcgcaaaagatg

SEQ ID NO: 193025 - DNA, 103 bp, Artificial Sequence
  Synthetic Polynucleotide
taatacgactcactatagggataggggccagaggcctgggctggctctgcaacagaggagagcagagatggcccaggccaacctggcggcagcgcaaaagatg

SEQ ID NO: 193026 - DNA, 103 bp, Artificial Sequence
  Synthetic Polynucleotide
taatacgactcactatagggggggttgttgttggtctggatgcgctgactaacagaggagaagtcagatgatccagaccaacctggcggcagcgcaaaagatg

SEQ ID NO: 193027 - DNA, 103 bp, Artificial Sequence
  Synthetic Polynucleotide
taatacgactcactatagggcttcttggaaggggttgttgttggtctggaaacagaggagatccagaatgacaacaaccaacctggcggcagcgcaaaagatg

SEQ ID NO: 193028 - DNA, 103 bp, Artificial Sequence
  Synthetic Polynucleotide
taatacgactcactatagggccacgctgctcttcttggaaggggttgttgaacagaggagacaacaaatgcttccaagaaacctggcggcagcgcaaaagatg

SEQ ID NO: 193029 - DNA, 103 bp, Artificial Sequence
  Synthetic Polynucleotide
taatacgactcactataggggtcgtagtccccacgctgctcttcttggaaaacagaggagattccaaatggagcagcgtaacctggcggcagcgcaaaagatg

SEQ ID NO: 193030 - DNA, 103 bp, Artificial Sequence
  Synthetic Polynucleotide
taatacgactcactatagggcagcattcaggtcgtagtccccacgctgctaacagaggagaagcagcatggggactacgaacctggcggcagcgcaaaagatg

SEQ ID NO: 193031 - DNA, 103 bp, Artificial Sequence
  Synthetic Polynucleotide
taatacgactcactatagggcagagccgcacagcattcaggtcgtagtccaacagaggagaggactaatgcctgaatgcaacctggcggcagcgcaaaagatg

SEQ ID NO: 193032 - DNA, 103 bp, Artificial Sequence
  Synthetic Polynucleotide
taatacgactcactatagggcacctggaagcagagccgcacagcattcagaacagaggagactgaatatggtgcggctcaacctggcggcagcgcaaaagatg

SEQ ID NO: 193033 - DNA, 103 bp, Artificial Sequence
  Synthetic Polynucleotide
taatacgactcactatagggcccgcactgtcacctggaagcagagccgcaaacagaggagatgcggcatggcttccaggaacctggcggcagcgcaaaagatg

SEQ ID NO: 193034 - DNA, 103 bp, Artificial Sequence
  Synthetic Polynucleotide
taatacgactcactatagggcctgatgggtcccgcactgtcacctggaagaacagaggagacttccaatggacagtgcgaacctggcggcagcgcaaaagatg

SEQ ID NO: 193035 - DNA, 103 bp, Artificial Sequence
  Synthetic Polynucleotide
taatacgactcactataggggaggggcctgcctgatgggtcccgcactgtaacagaggagaacagtgatggacccatcaaacctggcggcagcgcaaaagatg

SEQ ID NO: 193036 - DNA, 103 bp, Artificial Sequence
  Synthetic Polynucleotide
taatacgactcactatagggtgatctccacataggggccagaggcctgggaacagaggagacccaggatgctggcccctaacctggcggcagcgcaaaagatg

SEQ ID NO: 193037 - DNA, 103 bp, Artificial Sequence
  Synthetic Polynucleotide
taatacgactcactataggggcggcaggcggaggggcctgcctgatgggtaacagaggagaacccatatggcaggccccaacctggcggcagcgcaaaagatg

SEQ ID NO: 193038 - DNA, 103 bp, Artificial Sequence
  Synthetic Polynucleotide
taatacgactcactataggggaaaggacaggcggcaggcggaggggcctgaacagaggagacaggccatgccgcctgccaacctggcggcagcgcaaaagatg

SEQ ID NO: 193039 - DNA, 103 bp, Artificial Sequence
  Synthetic Polynucleotide
taatacgactcactataggggatgggatgagaaaggacaggcggcaggcgaacagaggagacgcctgatgcctgtccttaacctggcggcagcgcaaaagatg

SEQ ID NO: 193040 - DNA, 103 bp, Artificial Sequence
  Synthetic Polynucleotide
taatacgactcactataggggattgtcaaagatgggatgagaaaggacagaacagaggagactgtccatgctcatcccaaacctggcggcagcgcaaaagatg

SEQ ID NO: 193041 - DNA, 103 bp, Artificial Sequence
  Synthetic Polynucleotide
taatacgactcactatagggttgggggcacgattgtcaaagatgggatgaaacagaggagatcatccatgctttgacaaaacctggcggcagcgcaaaagatg

SEQ ID NO: 193042 - DNA, 103 bp, Artificial Sequence
  Synthetic Polynucleotide
taatacgactcactatagggctcggcagtgttgggggcacgattgtcaaaaacagaggagatttgacatgcgtgcccccaacctggcggcagcgcaaaagatg

SEQ ID NO: 193043 - DNA, 103 bp, Artificial Sequence
  Synthetic Polynucleotide
taatacgactcactatagggagatcttgagctcggcagtgttgggggcacaacagaggagagtgcccatgacactgccgaacctggcggcagcgcaaaagatg

SEQ ID NO: 193044 - DNA, 103 bp, Artificial Sequence
  Synthetic Polynucleotide
taatacgactcactatagggttcactcggcagatcttgagctcggcagtgaacagaggagacactgcatggctcaagataacctggcggcagcgcaaaagatg

SEQ ID NO: 193045 - DNA, 103 bp, Artificial Sequence
  Synthetic Polynucleotide
taatacgactcactatagggagagtttcggttcactcggcagatcttgagaacagaggagactcaagatgtgccgagtgaacctggcggcagcgcaaaagatg

SEQ ID NO: 193046 - DNA, 103 bp, Artificial Sequence
  Synthetic Polynucleotide
taatacgactcactatagggggcagctgccagagtttcggttcactcggcaacagaggagagccgagatgaccgaaactaacctggcggcagcgcaaaagatg

SEQ ID NO: 193047 - DNA, 103 bp, Artificial Sequence
  Synthetic Polynucleotide
taatacgactcactatagggggctgctcaatgatctccacataggggccaaacagaggagatggcccatgtgtggagataacctggcggcagcgcaaaagatg

SEQ ID NO: 193048 - DNA, 103 bp, Artificial Sequence
  Synthetic Polynucleotide
taatacgactcactatagggtccccaccgaggcagctgccagagtttcggaacagaggagaccgaaaatgtggcagctgaacctggcggcagcgcaaaagatg

SEQ ID NO: 193049 - DNA, 103 bp, Artificial Sequence
  Synthetic Polynucleotide
taatacgactcactataggggaagatctcatccccaccgaggcagctgccaacagaggagaggcagcatgctcggtgggaacctggcggcagcgcaaaagatg

SEQ ID NO: 193050 - DNA, 103 bp, Artificial Sequence
  Synthetic Polynucleotide
taatacgactcactatagggcacacagtaggaagatctcatccccaccgaaacagaggagatcggtgatgatgagatctaacctggcggcagcgcaaaagatg

SEQ ID NO: 193051 - DNA, 103 bp, Artificial Sequence
  Synthetic Polynucleotide
taatacgactcactatagggtgcaccttgtcacacagtaggaagatctcaaacagaggagatgagatatgcctactgtgaacctggcggcagcgcaaaagatg

SEQ ID NO: 193052 - DNA, 103 bp, Artificial Sequence
  Synthetic Polynucleotide
taatacgactcactataggggtcctctttctgcaccttgtcacacagtagaacagaggagactactgatggacaaggtgaacctggcggcagcgcaaaagatg

SEQ ID NO: 193053 - DNA, 103 bp, Artificial Sequence
  Synthetic Polynucleotide
taatacgactcactatagggacacctcaatgtcctctttctgcaccttgtaacagaggagaacaaggatgagaaagaggaacctggcggcagcgcaaaagatg

SEQ ID NO: 193054 - DNA, 103 bp, Artificial Sequence
  Synthetic Polynucleotide
taatacgactcactatagggcccgtgaaatacacctcaatgtcctctttcaacagaggagagaaagaatgcattgaggtaacctggcggcagcgcaaaagatg

SEQ ID NO: 193055 - DNA, 103 bp, Artificial Sequence
  Synthetic Polynucleotide
taatacgactcactatagggccagcctggtcccgtgaaatacacctcaataacagaggagaattgagatgtatttcacgaacctggcggcagcgcaaaagatg

SEQ ID NO: 193056 - DNA, 103 bp, Artificial Sequence
  Synthetic Polynucleotide
taatacgactcactatagggctcgggcctcccagcctggtcccgtgaaataacagaggagaatttcaatggaccaggctaacctggcggcagcgcaaaagatg

SEQ ID NO: 193057 - DNA, 103 bp, Artificial Sequence
  Synthetic Polynucleotide
taatacgactcactataggggaaaaggagcctcgggcctcccagcctggtaacagaggagaaccaggatgggaggcccgaacctggcggcagcgcaaaagatg

SEQ ID NO: 193058 - DNA, 103 bp, Artificial Sequence
  Synthetic Polynucleotide
taatacgactcactatagggccgctgcttgggctgctcaatgatctccacaacagaggagagtggagatgattgagcagaacctggcggcagcgcaaaagatg

SEQ ID NO: 193059 - DNA, 103 bp, Artificial Sequence
  Synthetic Polynucleotide
taatacgactcactatagggatcagcttgcgaaaaggagcctcgggcctcaacagaggagagaggccatgggctcctttaacctggcggcagcgcaaaagatg

SEQ ID NO: 193060 - DNA, 103 bp, Artificial Sequence
  Synthetic Polynucleotide
taatacgactcactataggggtcggtgcacatcagcttgcgaaaaggagcaacagaggagagctcctatgcgcaagctgaacctggcggcagcgcaaaagatg

SEQ ID NO: 193061 - DNA, 103 bp, Artificial Sequence
  Synthetic Polynucleotide
taatacgactcactatagggatggccacttgtcggtgcacatcagcttgcaacagaggagagcaagcatgtgtgcaccgaacctggcggcagcgcaaaagatg

SEQ ID NO: 193062 - DNA, 103 bp, Artificial Sequence
  Synthetic Polynucleotide
taatacgactcactatagggccggaacacaatggccacttgtcggtgcacaacagaggagagtgcacatgcaagtggccaacctggcggcagcgcaaaagatg

SEQ ID NO: 193063 - DNA, 103 bp, Artificial Sequence
  Synthetic Polynucleotide
taatacgactcactatagggagggaggggtccggaacacaatggccacttaacagaggagaaagtggatgttgtgttccaacctggcggcagcgcaaaagatg

SEQ ID NO: 193064 - DNA, 103 bp, Artificial Sequence
  Synthetic Polynucleotide
taatacgactcactataggggggtctgcgtagggaggggtccggaacacaaacagaggagatgtgttatggacccctccaacctggcggcagcgcaaaagatg

SEQ ID NO: 193065 - DNA, 103 bp, Artificial Sequence
  Synthetic Polynucleotide
taatacgactcactatagggctgcaggctggggtctgcgtagggaggggtaacagaggagaacccctatgtacgcagacaacctggcggcagcgcaaaagatg

SEQ ID NO: 193066 - DNA, 103 bp, Artificial Sequence
  Synthetic Polynucleotide
taatacgactcactataggggcacaggagcctgcaggctggggtctgcgtaacagaggagaacgcagatgccagcctgcaacctggcggcagcgcaaaagatg

SEQ ID NO: 193067 - DNA, 103 bp, Artificial Sequence
  Synthetic Polynucleotide
taatacgactcactatagggatggagacacgcacaggagcctgcaggctgaacagaggagacagcctatgggctcctgtaacctggcggcagcgcaaaagatg

SEQ ID NO: 193068 - DNA, 103 bp, Artificial Sequence
  Synthetic Polynucleotide
taatacgactcactatagggccgcagctgcatggagacacgcacaggagcaacagaggagagctcctatgcgtgtctccaacctggcggcagcgcaaaagatg

SEQ ID NO: 193069 - DNA, 103 bp, Artificial Sequence
  Synthetic Polynucleotide
taatacgactcactatagggagcgcatgccccgctgcttgggctgctcaaaacagaggagattgagcatgccaagcagcaacctggcggcagcgcaaaagatg

SEQ ID NO: 193070 - DNA, 103 bp, Artificial Sequence
  Synthetic Polynucleotide
taatacgactcactatagggcggaaggccgccgcagctgcatggagacacaacagaggagagtgtctatgtgcagctgcaacctggcggcagcgcaaaagatg

SEQ ID NO: 193071 - DNA, 103 bp, Artificial Sequence
  Synthetic Polynucleotide
taatacgactcactatagggagctcccggtcggaaggccgccgcagctgcaacagaggagagcagctatggcggccttcaacctggcggcagcgcaaaagatg

SEQ ID NO: 193072 - DNA, 103 bp, Artificial Sequence
  Synthetic Polynucleotide
taatacgactcactataggggggctcactgagctcccggtcggaaggccgaacagaggagacggcctatggaccgggagaacctggcggcagcgcaaaagatg

SEQ ID NO: 193073 - DNA, 103 bp, Artificial Sequence
  Synthetic Polynucleotide
taatacgactcactatagggggaattccatgggctcactgagctcccggtaacagaggagaaccgggatgtcagtgagcaacctggcggcagcgcaaaagatg

SEQ ID NO: 193074 - DNA, 103 bp, Artificial Sequence
  Synthetic Polynucleotide
taatacgactcactatagggggcaggtactggaattccatgggctcactgaacagaggagacagtgaatgcatggaattaacctggcggcagcgcaaaagatg

SEQ ID NO: 193075 - DNA, 103 bp, Artificial Sequence
  Synthetic Polynucleotide
taatacgactcactataggggtctgtatctggcaggtactggaattccataacagaggagaatggaaatgcagtacctgaacctggcggcagcgcaaaagatg

SEQ ID NO: 193076 - DNA, 103 bp, Artificial Sequence
  Synthetic Polynucleotide
taatacgactcactatagggggtgacgatcgtctgtatctggcaggtactaacagaggagaagtaccatgcagatacagaacctggcggcagcgcaaaagatg

SEQ ID NO: 193077 - DNA, 103 bp, Artificial Sequence
  Synthetic Polynucleotide
taatacgactcactatagggtcctcaatccggtgacgatcgtctgtatctaacagaggagaagatacatgcgatcgtcaaacctggcggcagcgcaaaagatg

SEQ ID NO: 193078 - DNA, 103 bp, Artificial Sequence
  Synthetic Polynucleotide
taatacgactcactatagggtttacgtttctcctcaatccggtgacgatcaacagaggagagatcgtatgcggattgagaacctggcggcagcgcaaaagatg

SEQ ID NO: 193079 - DNA, 103 bp, Artificial Sequence
  Synthetic Polynucleotide
taatacgactcactatagggcatatgtccttttacgtttctcctcaatccaacagaggagaggattgatgagaaacgtaaacctggcggcagcgcaaaagatg

SEQ ID NO: 193080 - DNA, 103 bp, Artificial Sequence
  Synthetic Polynucleotide
taatacgactcactatagggttgtagcggaagcgcatgccccgctgcttgaacagaggagacaagcaatggggcatgcgaacctggcggcagcgcaaaagatg

SEQ ID NO: 193081 - DNA, 103 bp, Artificial Sequence
  Synthetic Polynucleotide
taatacgactcactatagggttgaaggtctcatatgtccttttacgtttcaacagaggagagaaacgatgaaggacataaacctggcggcagcgcaaaagatg

SEQ ID NO: 193082 - DNA, 103 bp, Artificial Sequence
  Synthetic Polynucleotide
taatacgactcactatagggcatgatgctcttgaaggtctcatatgtcctaacagaggagaaggacaatggagaccttcaacctggcggcagcgcaaaagatg

SEQ ID NO: 193083 - DNA, 103 bp, Artificial Sequence
  Synthetic Polynucleotide
taatacgactcactataggggactcttcttcatgatgctcttgaaggtctaacagaggagaagacctatgagagcatcaaacctggcggcagcgcaaaagatg

SEQ ID NO: 193084 - DNA, 103 bp, Artificial Sequence
  Synthetic Polynucleotide
taatacgactcactatagggccgctgaaaggactcttcttcatgatgctcaacagaggagagagcatatggaagaagagaacctggcggcagcgcaaaagatg

SEQ ID NO: 193085 - DNA, 103 bp, Artificial Sequence
  Synthetic Polynucleotide
taatacgactcactataggggtcggtgggtccgctgaaaggactcttcttaacagaggagaaagaagatgcctttcagcaacctggcggcagcgcaaaagatg

SEQ ID NO: 193086 - DNA, 103 bp, Artificial Sequence
  Synthetic Polynucleotide
taatacgactcactataggggaggccgggggtcggtgggtccgctgaaagaacagaggagactttcaatggacccaccgaacctggcggcagcgcaaaagatg

SEQ ID NO: 193087 - DNA, 103 bp, Artificial Sequence
  Synthetic Polynucleotide
taatacgactcactatagggcgtcgaggtggaggccgggggtcggtgggtaacagaggagaacccacatgcccccggccaacctggcggcagcgcaaaagatg

SEQ ID NO: 193088 - DNA, 103 bp, Artificial Sequence
  Synthetic Polynucleotide
taatacgactcactatagggcacagcaatgcgtcgaggtggaggccggggaacagaggagaccccggatgccacctcgaaacctggcggcagcgcaaaagatg

SEQ ID NO: 193089 - DNA, 103 bp, Artificial Sequence
  Synthetic Polynucleotide
taatacgactcactatagggtgcgggaaggcacagcaatgcgtcgaggtgaacagaggagacacctcatggcattgctgaacctggcggcagcgcaaaagatg

SEQ ID NO: 193090 - DNA, 103 bp, Artificial Sequence
  Synthetic Polynucleotide
taatacgactcactataggggaagctgagctgcgggaaggcacagcaatgaacagaggagacattgcatggccttcccgaacctggcggcagcgcaaaagatg

SEQ ID NO: 193091 - DNA, 103 bp, Artificial Sequence
  Synthetic Polynucleotide
taatacgactcactatagggcggcccagaggctggcccagaccgaagcataacagaggagaatgcttatgtctgggccaaacctggcggcagcgcaaaagatg

SEQ ID NO: 193092 - DNA, 103 bp, Artificial Sequence
  Synthetic Polynucleotide
taatacgactcactataggggaggtcgggggaccctaaggcccccagctcaacagaggagagagctgatggccttagggaacctggcggcagcgcaaaagatg

SEQ ID NO: 193093 - DNA, 103 bp, Artificial Sequence
  Synthetic Polynucleotide
taatacgactcactatagggggccctgctgaacaccactgatatgtcctcaacagaggagagaggacatgtcagtggtgaacctggcggcagcgcaaaagatg

SEQ ID NO: 193094 - DNA, 103 bp, Artificial Sequence
  Synthetic Polynucleotide
taatacgactcactatagggcttcccaggaggccctgctgaacaccactgaacagaggagacagtggatgtcagcagggaacctggcggcagcgcaaaagatg

SEQ ID NO: 193095 - DNA, 103 bp, Artificial Sequence
  Synthetic Polynucleotide
taatacgactcactatagggtcagcccgaccttcccaggaggccctgctgaacagaggagacagcagatgctcctgggaaacctggcggcagcgcaaaagatg

SEQ ID NO: 193096 - DNA, 103 bp, Artificial Sequence
  Synthetic Polynucleotide
taatacgactcactatagggctgggagaagtcagcccgaccttcccaggaaacagaggagatcctggatgggtcgggctaacctggcggcagcgcaaaagatg

SEQ ID NO: 193097 - DNA, 103 bp, Artificial Sequence
  Synthetic Polynucleotide
taatacgactcactataggggcacgtcggcctgggagaagtcagcccgacaacagaggagagtcgggatgacttctcccaacctggcggcagcgcaaaagatg

SEQ ID NO: 193098 - DNA, 103 bp, Artificial Sequence
  Synthetic Polynucleotide
taatacgactcactatagggatctggcggtgcacgtcggcctgggagaagaacagaggagacttctcatgggccgacgtaacctggcggcagcgcaaaagatg

SEQ ID NO: 193099 - DNA, 103 bp, Artificial Sequence
  Synthetic Polynucleotide
taatacgactcactatagggcacaatggcaatctggcggtgcacgtcggcaacagaggagagccgacatgcaccgccagaacctggcggcagcgcaaaagatg

SEQ ID NO: 193100 - DNA, 103 bp, Artificial Sequence
  Synthetic Polynucleotide
taatacgactcactataggggcgtcttgaacacaatggcaatctggcggtaacagaggagaaccgccatgttgccattgaacctggcggcagcgcaaaagatg

SEQ ID NO: 193101 - DNA, 103 bp, Artificial Sequence
  Synthetic Polynucleotide
taatacgactcactatagggtcgtagggcggcgtcttgaacacaatggcaaacagaggagatgccatatggttcaagacaacctggcggcagcgcaaaagatg

SEQ ID NO: 193102 - DNA, 103 bp, Artificial Sequence
  Synthetic Polynucleotide
taatacgactcactatagggctccaggtcctcgtagggcggcgtcttgaaaacagaggagattcaagatgccgccctacaacctggcggcagcgcaaaagatg

SEQ ID NO: 193103 - DNA, 103 bp, Artificial Sequence
  Synthetic Polynucleotide
taatacgactcactatagggagagtgaggagaggtcgggggaccctaaggaacagaggagaccttagatgcccccgaccaacctggcggcagcgcaaaagatg

SEQ ID NO: 193104 - DNA, 103 bp, Artificial Sequence
  Synthetic Polynucleotide
taatacgactcactataggggctcgacaatctccaggtcctcgtagggcgaacagaggagacgccctatgaggacctggaacctggcggcagcgcaaaagatg

SEQ ID NO: 193105 - DNA, 103 bp, Artificial Sequence
  Synthetic Polynucleotide
taatacgactcactatagggactgtcacgggctcgacaatctccaggtccaacagaggagaggacctatggattgtcgaaacctggcggcagcgcaaaagatg

SEQ ID NO: 193106 - DNA, 103 bp, Artificial Sequence
  Synthetic Polynucleotide
taatacgactcactataggggaagacgttgactgtcacgggctcgacaataacagaggagaattgtcatgcccgtgacaaacctggcggcagcgcaaaagatg

SEQ ID NO: 193107 - DNA, 103 bp, Artificial Sequence
  Synthetic Polynucleotide
taatacgactcactataggggccgctgcaggaagacgttgactgtcacggaacagaggagaccgtgaatgtcaacgtctaacctggcggcagcgcaaaagatg

SEQ ID NO: 193108 - DNA, 103 bp, Artificial Sequence
  Synthetic Polynucleotide
taatacgactcactatagggccatcggtgagccgctgcaggaagacgttgaacagaggagacaacgtatgcctgcagcgaacctggcggcagcgcaaaagatg

SEQ ID NO: 193109 - DNA, 103 bp, Artificial Sequence
  Synthetic Polynucleotide
taatacgactcactataggggctgcagaccccatcggtgagccgctgcagaacagaggagactgcagatgctcaccgataacctggcggcagcgcaaaagatg

SEQ ID NO: 193110 - DNA, 103 bp, Artificial Sequence
  Synthetic Polynucleotide
taatacgactcactataggggcaatggctcgctgcagaccccatcggtgaaacagaggagatcaccgatggggtctgcaaacctggcggcagcgcaaaagatg

SEQ ID NO: 193111 - DNA, 103 bp, Artificial Sequence
  Synthetic Polynucleotide
taatacgactcactatagggtacgtgaaaggcaatggctcgctgcagaccaacagaggagaggtctgatgcgagccattaacctggcggcagcgcaaaagatg

SEQ ID NO: 193112 - DNA, 103 bp, Artificial Sequence
  Synthetic Polynucleotide
taatacgactcactataggggcgaggcaggtacgtgaaaggcaatggctcaacagaggagagagccaatgcctttcacgaacctggcggcagcgcaaaagatg

SEQ ID NO: 193113 - DNA, 103 bp, Artificial Sequence
  Synthetic Polynucleotide
taatacgactcactatagggtgtcatggtcgcgaggcaggtacgtgaaagaacagaggagactttcaatgacctgcctcaacctggcggcagcgcaaaagatg

SEQ ID NO: 193114 - DNA, 103 bp, Artificial Sequence
  Synthetic Polynucleotide
taatacgactcactatagggacggcgagcgagagtgaggagaggtcggggaacagaggagaccccgaatgctcctcactaacctggcggcagcgcaaaagatg

SEQ ID NO: 193115 - DNA, 103 bp, Artificial Sequence
  Synthetic Polynucleotide
taatacgactcactatagggacgccgtagctgtcatggtcgcgaggcaggaacagaggagacctgccatgcgaccatgaaacctggcggcagcgcaaaagatg

SEQ ID NO: 193116 - DNA, 103 bp, Artificial Sequence
  Synthetic Polynucleotide
taatacgactcactatagggcttcttgtccacgccgtagctgtcatggtcaacagaggagagaccatatgagctacggcaacctggcggcagcgcaaaagatg

SEQ ID NO: 193117 - DNA, 103 bp, Artificial Sequence
  Synthetic Polynucleotide
taatacgactcactatagggcccgtttccgcttcttgtccacgccgtagcaacagaggagagctacgatgtggacaagaaacctggcggcagcgcaaaagatg

SEQ ID NO: 193118 - DNA, 103 bp, Artificial Sequence
  Synthetic Polynucleotide
taatacgactcactatagggtcgggcatcccccgtttccgcttcttgtccaacagaggagaggacaaatggcggaaacgaacctggcggcagcgcaaaagatg

SEQ ID NO: 193119 - DNA, 103 bp, Artificial Sequence
  Synthetic Polynucleotide
taatacgactcactatagggcccaaggacgtcgggcatcccccgtttccgaacagaggagacggaaaatggggatgcccaacctggcggcagcgcaaaagatg

SEQ ID NO: 193120 - DNA, 103 bp, Artificial Sequence
  Synthetic Polynucleotide
taatacgactcactatagggtgttcagctccccaaggacgtcgggcatccaacagaggagaggatgcatgacgtccttgaacctggcggcagcgcaaaagatg

SEQ ID NO: 193121 - DNA, 103 bp, Artificial Sequence
  Synthetic Polynucleotide
taatacgactcactataggggggtcagagctgttcagctccccaaggacgaacagaggagacgtcctatgggagctgaaaacctggcggcagcgcaaaagatg

SEQ ID NO: 193122 - DNA, 103 bp, Artificial Sequence
  Synthetic Polynucleotide
taatacgactcactataggggatgccatgggggtcagagctgttcagctcaacagaggagagagctgatgagctctgacaacctggcggcagcgcaaaagatg

SEQ ID NO: 193123 - DNA, 103 bp, Artificial Sequence
  Synthetic Polynucleotide
taatacgactcactataggggtttgctctcgatgccatgggggtcagagcaacagaggagagctctgatgcccatggcaaacctggcggcagcgcaaaagatg

SEQ ID NO: 193124 - DNA, 103 bp, Artificial Sequence
  Synthetic Polynucleotide
taatacgactcactatagggttcttccgccgtttgctctcgatgccatggaacagaggagaccatggatgcgagagcaaaacctggcggcagcgcaaaagatg

SEQ ID NO: 193125 - DNA, 103 bp, Artificial Sequence
  Synthetic Polynucleotide
taatacgactcactataggggctcctggaaacggcgagcgagagtgaggaaacagaggagatcctcaatgtcgctcgccaacctggcggcagcgcaaaagatg

SEQ ID NO: 193126 - DNA, 103 bp, Artificial Sequence
  Synthetic Polynucleotide
taatacgactcactatagggggccggctttttcttccgccgtttgctctcaacagaggagagagagcatgcggcggaagaacctggcggcagcgcaaaagatg

SEQ ID NO: 193127 - DNA, 103 bp, Artificial Sequence
  Synthetic Polynucleotide
taatacgactcactatagggggtccaggatggccggctttttcttccgccaacagaggagaggcggaatgaaaagccggaacctggcggcagcgcaaaagatg

SEQ ID NO: 193128 - DNA, 103 bp, Artificial Sequence
  Synthetic Polynucleotide
taatacgactcactatagggggcaggaagtggtccaggatggccggctttaacagaggagaaaagccatgcatcctggaaacctggcggcagcgcaaaagatg

SEQ ID NO: 193129 - DNA, 103 bp, Artificial Sequence
  Synthetic Polynucleotide
taatacgactcactataggggccgtggttgggcaggaagtggtccaggataacagaggagaatcctgatgcacttcctgaacctggcggcagcgcaaaagatg

SEQ ID NO: 193130 - DNA, 103 bp, Artificial Sequence
  Synthetic Polynucleotide
taatacgactcactatagggacgggcctgagccgtggttgggcaggaagtaacagaggagaacttccatgccaaccacgaacctggcggcagcgcaaaagatg

SEQ ID NO: 193131 - DNA, 103 bp, Artificial Sequence
  Synthetic Polynucleotide
taatacgactcactatagggggcgggaggaacgggcctgagccgtggttgaacagaggagacaaccaatgctcaggcccaacctggcggcagcgcaaaagatg

SEQ ID NO: 193132 - DNA, 103 bp, Artificial Sequence
  Synthetic Polynucleotide
taatacgactcactatagggcagggctgacggcgggaggaacgggcctgaaacagaggagatcaggcatgttcctcccgaacctggcggcagcgcaaaagatg

SEQ ID NO: 193133 - DNA, 103 bp, Artificial Sequence
  Synthetic Polynucleotide
taatacgactcactatagggggtctggcagcagggctgacggcgggaggaaacagaggagatcctccatgcgtcagcccaacctggcggcagcgcaaaagatg

SEQ ID NO: 193134 - DNA, 103 bp, Artificial Sequence
  Synthetic Polynucleotide
taatacgactcactatagggaagaagtcagggtctggcagcagggctgacaacagaggagagtcagcatggctgccagaaacctggcggcagcgcaaaagatg

SEQ ID NO: 193135 - DNA, 103 bp, Artificial Sequence
  Synthetic Polynucleotide
taatacgactcactatagggggtgccagagaagaagtcagggtctggcagaacagaggagactgccaatgcctgacttcaacctggcggcagcgcaaaagatg

SEQ ID NO: 193136 - DNA, 103 bp, Artificial Sequence
  Synthetic Polynucleotide
taatacgactcactatagggattcatctgtgctcctggaaacggcgagcgaacagaggagacgctcgatgtttccaggaaacctggcggcagcgcaaaagatg

SEQ ID NO: 193137 - DNA, 103 bp, Artificial Sequence
  Synthetic Polynucleotide
taatacgactcactataggggcagggacacggtgccagagaagaagtcagaacagaggagactgactatgtctctggcaaacctggcggcagcgcaaaagatg

SEQ ID NO: 193138 - DNA, 103 bp, Artificial Sequence
  Synthetic Polynucleotide
taatacgactcactatagggtccaggccgggcagggacacggtgccagagaacagaggagactctggatgcgtgtccctaacctggcggcagcgcaaaagatg

SEQ ID NO: 193139 - DNA, 103 bp, Artificial Sequence
  Synthetic Polynucleotide
taatacgactcactataggggccagggggctccaggccgggcagggacacaacagaggagagtgtccatgcccggcctgaacctggcggcagcgcaaaagatg

SEQ ID NO: 193140 - DNA, 103 bp, Artificial Sequence
  Synthetic Polynucleotide
taatacgactcactatagggggtcaggcccgccagggggctccaggccggaacagaggagaccggccatgagccccctgaacctggcggcagcgcaaaagatg

SEQ ID NO: 193141 - DNA, 103 bp, Artificial Sequence
  Synthetic Polynucleotide
taatacgactcactatagggtcgtccaggaggtcaggcccgccagggggcaacagaggagagcccccatgcgggcctgaaacctggcggcagcgcaaaagatg

SEQ ID NO: 193142 - DNA, 103 bp, Artificial Sequence
  Synthetic Polynucleotide
taatacgactcactatagggggcaaagccatcgtccaggaggtcaggcccaacagaggagagggcctatgctcctggacaacctggcggcagcgcaaaagatg

SEQ ID NO: 193143 - DNA, 103 bp, Artificial Sequence
  Synthetic Polynucleotide
taatacgactcactatagggtagggtcgtaggcaaagccatcgtccaggaaacagaggagatcctggatgatggctttgaacctggcggcagcgcaaaagatg

SEQ ID NO: 193144 - DNA, 103 bp, Artificial Sequence
  Synthetic Polynucleotide
taatacgactcactataggggtgggggccgtagggtcgtaggcaaagccaaacagaggagatggcttatgctacgacccaacctggcggcagcgcaaaagatg

SEQ ID NO: 193145 - DNA, 103 bp, Artificial Sequence
  Synthetic Polynucleotide
taatacgactcactatagggggtgaagagtgtgggggccgtagggtcgtaaacagaggagatacgacatgacggcccccaacctggcggcagcgcaaaagatg

SEQ ID NO: 193146 - DNA, 103 bp, Artificial Sequence
  Synthetic Polynucleotide
taatacgactcactatagggggtccagcatggtgaagagtgtgggggccgaacagaggagacggcccatgcactcttcaaacctggcggcagcgcaaaagatg

SEQ ID NO: 193147 - DNA, 103 bp, Artificial Sequence
  Synthetic Polynucleotide
taatacgactcactatagggatgatctccaattcatctgtgctcctggaaaacagaggagattccagatgcacagatgaaacctggcggcagcgcaaaagatg

SEQ ID NO: 193148 - DNA, 103 bp, Artificial Sequence
  Synthetic Polynucleotide
taatacgactcactataggggggggcagcaggtccagcatggtgaagagtaacagaggagaactcttatgcatgctggaaacctggcggcagcgcaaaagatg

SEQ ID NO: 193149 - DNA, 103 bp, Artificial Sequence
  Synthetic Polynucleotide
taatacgactcactatagggtggcggtgccgggggcagcaggtccagcataacagaggagaatgctgatgctgctgcccaacctggcggcagcgcaaaagatg

SEQ ID NO: 193150 - DNA, 103 bp, Artificial Sequence
  Synthetic Polynucleotide
taatacgactcactatagggcgctagcgtgtggcggtgccgggggcagcaaacagaggagatgctgcatgcggcaccgcaacctggcggcagcgcaaaagatg

SEQ ID NO: 193151 - DNA, 103 bp, Artificial Sequence
  Synthetic Polynucleotide
taatacgactcactatagggcacacaacagcgctagcgtgtggcggtgccaacagaggagaggcaccatgacacgctagaacctggcggcagcgcaaaagatg

SEQ ID NO: 193152 - DNA, 103 bp, Artificial Sequence
  Synthetic Polynucleotide
taatacgactcactatagggacctccgctgcacacaacagcgctagcgtgaacagaggagacacgctatggctgttgtgaacctggcggcagcgcaaaagatg

SEQ ID NO: 193153 - DNA, 103 bp, Artificial Sequence
  Synthetic Polynucleotide
taatacgactcactatagggcggccccggcacctccgctgcacacaacagaacagaggagactgttgatggcagcggagaacctggcggcagcgcaaaagatg

SEQ ID NO: 193154 - DNA, 103 bp, Artificial Sequence
  Synthetic Polynucleotide
taatacgactcactatagggtccccaaccacggccccggcacctccgctgaacagaggagacagcggatgtgccggggcaacctggcggcagcgcaaaagatg

SEQ ID NO: 193155 - DNA, 103 bp, Artificial Sequence
  Synthetic Polynucleotide
taatacgactcactataggggccgggggtctccccaaccacggccccggcaacagaggagagccgggatggtggttgggaacctggcggcagcgcaaaagatg

SEQ ID NO: 193156 - DNA, 103 bp, Artificial Sequence
  Synthetic Polynucleotide
taatacgactcactataggggtggttcagggccgggggtctccccaaccaaacagaggagatggttgatgagacccccgaacctggcggcagcgcaaaagatg

SEQ ID NO: 193157 - DNA, 103 bp, Artificial Sequence
  Synthetic Polynucleotide
taatacgactcactatagggtccagtgtcagtggttcagggccgggggtcaacagaggagagaccccatgccctgaaccaacctggcggcagcgcaaaagatg

SEQ ID NO: 193158 - DNA, 103 bp, Artificial Sequence
  Synthetic Polynucleotide
taatacgactcactataggggtactcgtcgatgatctccaattcatctgtaacagaggagaacagatatgttggagatcaacctggcggcagcgcaaaagatg

SEQ ID NO: 193159 - DNA, 103 bp, Artificial Sequence
  Synthetic Polynucleotide
taatacgactcactatagggctggtacgagtccagtgtcagtggttcaggaacagaggagacctgaaatgctgacactgaacctggcggcagcgcaaaagatg

SEQ ID NO: 193160 - DNA, 103 bp, Artificial Sequence
  Synthetic Polynucleotide
taatacgactcactatagggggcccggggcctggtacgagtccagtgtcaaacagaggagatgacacatgactcgtaccaacctggcggcagcgcaaaagatg

SEQ ID NO: 193161 - DNA, 103 bp, Artificial Sequence
  Synthetic Polynucleotide
taatacgactcactatagggccatccccggggcccggggcctggtacgagaacagaggagactcgtaatgggccccgggaacctggcggcagcgcaaaagatg

SEQ ID NO: 193162 - DNA, 103 bp, Artificial Sequence
  Synthetic Polynucleotide
taatacgactcactatagggggcggtgcctccatccccggggcccggggcaacagaggagagccccgatgcccggggataacctggcggcagcgcaaaagatg

SEQ ID NO: 193163 - DNA, 103 bp, Artificial Sequence
  Synthetic Polynucleotide
taatacgactcactatagggccacaaggctggcggtgcctccatccccggaacagaggagaccggggatggaggcaccgaacctggcggcagcgcaaaagatg

SEQ ID NO: 193164 - DNA, 103 bp, Artificial Sequence
  Synthetic Polynucleotide
taatacgactcactatagggatgttgctgcccacaaggctggcggtgcctaacagaggagaaggcacatgcagccttgtaacctggcggcagcgcaaaagatg

SEQ ID NO: 193165 - DNA, 103 bp, Artificial Sequence
  Synthetic Polynucleotide
taatacgactcactatagggattggggaacatgttgctgcccacaaggctaacagaggagaagccttatgggcagcaacaacctggcggcagcgcaaaagatg

SEQ ID NO: 193166 - DNA, 103 bp, Artificial Sequence
  Synthetic Polynucleotide
taatacgactcactatagggcgcggtaatgattggggaacatgttgctgcaacagaggagagcagcaatgtgttccccaaacctggcggcagcgcaaaagatg

SEQ ID NO: 193167 - DNA, 103 bp, Artificial Sequence
  Synthetic Polynucleotide
taatacgactcactatagggaaggccgcctcgcggtaatgattggggaacaacagaggagagttcccatgtcattaccgaacctggcggcagcgcaaaagatg

SEQ ID NO: 193168 - DNA, 103 bp, Artificial Sequence
  Synthetic Polynucleotide
taatacgactcactataggggccgcccccaaaggccgcctcgcggtaatgaacagaggagacattacatggaggcggccaacctggcggcagcgcaaaagatg

SEQ ID NO: 193169 - DNA, 103 bp, Artificial Sequence
  Synthetic Polynucleotide
taatacgactcactatagggtctccttgatgtactcgtcgatgatctccaaacagaggagatggagaatgtcgacgagtaacctggcggcagcgcaaaagatg

SEQ ID NO: 193170 - DNA, 103 bp, Artificial Sequence
  Synthetic Polynucleotide
taatacgactcactataggggggataggaggccgcccccaaaggccgcctaacagaggagaaggcggatgttgggggcgaacctggcggcagcgcaaaagatg

SEQ ID NO: 193171 - DNA, 103 bp, Artificial Sequence
  Synthetic Polynucleotide
taatacgactcactatagggtcaggccccggggataggaggccgcccccaaacagaggagatgggggatgcctcctatcaacctggcggcagcgcaaaagatg

SEQ ID NO: 193172 - DNA, 103 bp, Artificial Sequence
  Synthetic Polynucleotide
taatacgactcactatagggctacgtggcttcaggccccggggataggagaacagaggagactcctaatgccggggcctaacctggcggcagcgcaaaagatg

SEQ ID NO: 193173 - DNA, 103 bp, Artificial Sequence
  Synthetic Polynucleotide
taatacgactcactatagggccgaagccgttctccttgatgtactcgtcgaacagaggagacgacgaatgcatcaaggaaacctggcggcagcgcaaaagatg

SEQ ID NO: 193174 - DNA, 103 bp, Artificial Sequence
  Synthetic Polynucleotide
taatacgactcactatagggcccgtccaggccgaagccgttctccttgataacagaggagaatcaagatgaacggcttcaacctggcggcagcgcaaaagatg

SEQ ID NO: 193175 - DNA, 103 bp, Artificial Sequence
  Synthetic Polynucleotide
taatacgactcactatagggtggggacggacggcccagaggctggcccagaacagaggagactgggcatgcctctgggcaacctggcggcagcgcaaaagatg

SEQ ID NO: 193176 - DNA, 103 bp, Artificial Sequence
  Synthetic Polynucleotide
taatacgactcactatagggccggctgtcccccgtccaggccgaagccgtaacagaggagaacggctatggcctggacgaacctggcggcagcgcaaaagatg

SEQ ID NO: 193177 - DNA, 103 bp, Artificial Sequence
  Synthetic Polynucleotide
taatacgactcactatagggtcgcccgggcccggctgtcccccgtccaggaacagaggagacctggaatggggacagccaacctggcggcagcgcaaaagatg

SEQ ID NO: 193178 - DNA, 103 bp, Artificial Sequence
  Synthetic Polynucleotide
taatacgactcactatagggtggcagcccctcgcccgggcccggctgtccaacagaggagaggacagatgggcccgggcaacctggcggcagcgcaaaagatg

SEQ ID NO: 193179 - DNA, 103 bp, Artificial Sequence
  Synthetic Polynucleotide
taatacgactcactatagggacaccaggcgtggcagcccctcgcccgggcaacagaggagagcccggatgaggggctgcaacctggcggcagcgcaaaagatg

SEQ ID NO: 193180 - DNA, 103 bp, Artificial Sequence
  Synthetic Polynucleotide
taatacgactcactataggggccccgcgagacaccaggcgtggcagccccaacagaggagaggggctatgacgcctggtaacctggcggcagcgcaaaagatg

SEQ ID NO: 193181 - DNA, 103 bp, Artificial Sequence
  Synthetic Polynucleotide
taatacgactcactatagggcagggacgcagccccgcgagacaccaggcgaacagaggagacgcctgatgtctcgcgggaacctggcggcagcgcaaaagatg

SEQ ID NO: 193182 - DNA, 103 bp, Artificial Sequence
  Synthetic Polynucleotide
taatacgactcactatagggtgaccgtgctcagggacgcagccccgcgagaacagaggagactcgcgatgctgcgtcccaacctggcggcagcgcaaaagatg

SEQ ID NO: 193183 - DNA, 103 bp, Artificial Sequence
  Synthetic Polynucleotide
taatacgactcactataggggggcccagggtgaccgtgctcagggacgcaaacagaggagatgcgtcatggagcacggtaacctggcggcagcgcaaaagatg

SEQ ID NO: 193184 - DNA, 103 bp, Artificial Sequence
  Synthetic Polynucleotide
taatacgactcactataggggggcgccacagggcccagggtgaccgtgctaacagaggagaagcacgatgaccctgggcaacctggcggcagcgcaaaagatg

SEQ ID NO: 193185 - DNA, 103 bp, Artificial Sequence
  Synthetic Polynucleotide
taatacgactcactataggggcgtggctgggggcgccacagggcccagggaacagaggagaccctggatgctgtggcgcaacctggcggcagcgcaaaagatg

SEQ ID NO: 193186 - DNA, 103 bp, Artificial Sequence
  Synthetic Polynucleotide
taatacgactcactataggggcccggccagtggggacggacggcccagagaacagaggagactctggatggtccgtcccaacctggcggcagcgcaaaagatg

SEQ ID NO: 193187 - DNA, 103 bp, Artificial Sequence
  Synthetic Polynucleotide
taatacgactcactatagggcaaggcggcggcgtggctgggggcgccacaaacagaggagatgtggcatgcccagccacaacctggcggcagcgcaaaagatg

SEQ ID NO: 193188 - DNA, 103 bp, Artificial Sequence
  Synthetic Polynucleotide
taatacgactcactatagggggggcagccccaaggcggcggcgtggctggaacagaggagaccagccatgccgccgcctaacctggcggcagcgcaaaagatg

SEQ ID NO: 193189 - DNA, 103 bp, Artificial Sequence
  Synthetic Polynucleotide
taatacgactcactataggggtcggcccagggggcagccccaaggcggcgaacagaggagacgccgcatgggggctgccaacctggcggcagcgcaaaagatg

SEQ ID NO: 193190 - DNA, 103 bp, Artificial Sequence
  Synthetic Polynucleotide
taatacgactcactatagggggggacactagtcggcccagggggcagcccaacagaggagagggctgatgcctgggccgaacctggcggcagcgcaaaagatg

SEQ ID NO: 193191 - DNA, 103 bp, Artificial Sequence
  Synthetic Polynucleotide
taatacgactcactataggggcccggcgctggggacactagtcggcccagaacagaggagactgggcatgctagtgtccaacctggcggcagcgcaaaagatg

SEQ ID NO: 193192 - DNA, 103 bp, Artificial Sequence
  Synthetic Polynucleotide
taatacgactcactataggggcgggcccgggcccggcgctggggacactaaacagaggagatagtgtatgcagcgccggaacctggcggcagcgcaaaagatg

SEQ ID NO: 193193 - DNA, 103 bp, Artificial Sequence
  Synthetic Polynucleotide
taatacgactcactatagggaggtgcggctgcgggcccgggcccggcgctaacagaggagaagcgccatgcccgggcccaacctggcggcagcgcaaaagatg

SEQ ID NO: 193194 - DNA, 103 bp, Artificial Sequence
  Synthetic Polynucleotide
taatacgactcactatagggcgtgatgaccaggtgcggctgcgggcccggaacagaggagaccgggcatgcagccgcacaacctggcggcagcgcaaaagatg

SEQ ID NO: 193195 - DNA, 103 bp, Artificial Sequence
  Synthetic Polynucleotide
taatacgactcactatagggtgggctgctccgtgatgaccaggtgcggctaacagaggagaagccgcatgtggtcatcaaacctggcggcagcgcaaaagatg

SEQ ID NO: 193196 - DNA, 103 bp, Artificial Sequence
  Synthetic Polynucleotide
taatacgactcactatagggccgcgctgcttgggctgctccgtgatgaccaacagaggagaggtcatatgggagcagccaacctggcggcagcgcaaaagatg

SEQ ID NO: 193197 - DNA, 103 bp, Artificial Sequence
  Synthetic Polynucleotide
taatacgactcactatagggactcggcatggcccggccagtggggacggaaacagaggagatccgtcatgactggccggaacctggcggcagcgcaaaagatg

SEQ ID NO: 193198 - DNA, 103 bp, Artificial Sequence
  Synthetic Polynucleotide
taatacgactcactataggggaagcgcatgccgcgctgcttgggctgctcaacagaggagagagcagatgaagcagcgcaacctggcggcagcgcaaaagatg

SEQ ID NO: 193199 - DNA, 103 bp, Artificial Sequence
  Synthetic Polynucleotide
taatacgactcactatagggactcgtagcggaagcgcatgccgcgctgctaacagaggagaagcagcatggcatgcgctaacctggcggcagcgcaaaagatg

SEQ ID NO: 193200 - DNA, 103 bp, Artificial Sequence
  Synthetic Polynucleotide
taatacgactcactatagggcggccctcgcactcgtagcggaagcgcatgaacagaggagacatgcgatgccgctacgaaacctggcggcagcgcaaaagatg

SEQ ID NO: 193201 - DNA, 103 bp, Artificial Sequence
  Synthetic Polynucleotide
taatacgactcactataggggccggccgagcggccctcgcactcgtagcgaacagaggagacgctacatgtgcgagggcaacctggcggcagcgcaaaagatg

SEQ ID NO: 193202 - DNA, 103 bp, Artificial Sequence
  Synthetic Polynucleotide
taatacgactcactatagggcaaggatgctgccggccgagcggccctcgcaacagaggagagcgaggatggctcggccgaacctggcggcagcgcaaaagatg

SEQ ID NO: 193203 - DNA, 103 bp, Artificial Sequence
  Synthetic Polynucleotide
taatacgactcactatagggctgctctccccaaggatgctgccggccgagaacagaggagactcggcatgcagcatcctaacctggcggcagcgcaaaagatg

SEQ ID NO: 193204 - DNA, 103 bp, Artificial Sequence
  Synthetic Polynucleotide
taatacgactcactatagggggcctcggtgctgctctccccaaggatgctaacagaggagaagcatcatgggggagagcaacctggcggcagcgcaaaagatg

SEQ ID NO: 193205 - DNA, 103 bp, Artificial Sequence
  Synthetic Polynucleotide
taatacgactcactataggggcgtcttgctggcctcggtgctgctctcccaacagaggagagggagaatggcaccgaggaacctggcggcagcgcaaaagatg

SEQ ID NO: 193206 - DNA, 103 bp, Artificial Sequence
  Synthetic Polynucleotide
taatacgactcactatagggatggcgggcagcgtcttgctggcctcggtgaacagaggagacaccgaatgcagcaagacaacctggcggcagcgcaaaagatg

SEQ ID NO: 193207 - DNA, 103 bp, Artificial Sequence
  Synthetic Polynucleotide
taatacgactcactatagggccggagctcgatggcgggcagcgtcttgctaacagaggagaagcaagatgctgcccgccaacctggcggcagcgcaaaagatg

SEQ ID NO: 193208 - DNA, 103 bp, Artificial Sequence
  Synthetic Polynucleotide
taatacgactcactatagggcgacgcggcgactcggcatggcccggccagaacagaggagactggccatgccatgccgaaacctggcggcagcgcaaaagatg

SEQ ID NO: 193209 - DNA, 103 bp, Artificial Sequence
  Synthetic Polynucleotide
taatacgactcactatagggctccacaatcccggagctcgatggcgggcaaacagaggagatgcccgatgtcgagctccaacctggcggcagcgcaaaagatg

SEQ ID NO: 193210 - DNA, 103 bp, Artificial Sequence
  Synthetic Polynucleotide
taatacgactcactatagggtcccgcagccctccacaatcccggagctcgaacagaggagacgagctatgggattgtggaacctggcggcagcgcaaaagatg

SEQ ID NO: 193211 - DNA, 103 bp, Artificial Sequence
  Synthetic Polynucleotide
taatacgactcactatagggcacctccacctcccgcagccctccacaatcaacagaggagagattgtatggggctgcggaacctggcggcagcgcaaaagatg

SEQ ID NO: 193212 - DNA, 103 bp, Artificial Sequence
  Synthetic Polynucleotide
taatacgactcactatagggggcaggcagtcacctccacctcccgcagccaacagaggagaggctgcatgaggtggaggaacctggcggcagcgcaaaagatg

SEQ ID NO: 193213 - DNA, 103 bp, Artificial Sequence
  Synthetic Polynucleotide
taatacgactcactatagggttccacaccaggcaggcagtcacctccaccaacagaggagaggtggaatggactgcctgaacctggcggcagcgcaaaagatg

SEQ ID NO: 193214 - DNA, 103 bp, Artificial Sequence
  Synthetic Polynucleotide
taatacgactcactatagggaggccagtccttccacaccaggcaggcagtaacagaggagaactgccatgctggtgtggaacctggcggcagcgcaaaagatg

SEQ ID NO: 193215 - DNA, 103 bp, Artificial Sequence
  Synthetic Polynucleotide
taatacgactcactatagggggactcggtgaggccagtccttccacaccaaacagaggagatggtgtatgaggactggcaacctggcggcagcgcaaaagatg

SEQ ID NO: 193216 - DNA, 103 bp, Artificial Sequence
  Synthetic Polynucleotide
taatacgactcactatagggctgtgggggtggactcggtgaggccagtccaacagaggagaggactgatgtcaccgagtaacctggcggcagcgcaaaagatg

SEQ ID NO: 193217 - DNA, 103 bp, Artificial Sequence
  Synthetic Polynucleotide
taatacgactcactatagggccccacgaggctgtgggggtggactcggtgaacagaggagacaccgaatgcacccccacaacctggcggcagcgcaaaagatg

SEQ ID NO: 193218 - DNA, 103 bp, Artificial Sequence
  Synthetic Polynucleotide
taatacgactcactatagggtgcagtctttccccacgaggctgtgggggtaacagaggagaacccccatggcctcgtggaacctggcggcagcgcaaaagatg

SEQ ID NO: 193219 - DNA, 103 bp, Artificial Sequence
  Synthetic Polynucleotide
taatacgactcactatagggggcggtctggcgacgcggcgactcggcatgaacagaggagacatgccatgtcgccgcgtaacctggcggcagcgcaaaagatg

SEQ ID NO: 193220 - DNA, 103 bp, Artificial Sequence
  Synthetic Polynucleotide
taatacgactcactatagggatgccgtcggtgcagtctttccccacgaggaacagaggagacctcgtatggaaagactgaacctggcggcagcgcaaaagatg

SEQ ID NO: 193221 - DNA, 103 bp, Artificial Sequence
  Synthetic Polynucleotide
taatacgactcactatagggcaccctgcagatgccgtcggtgcagtctttaacagaggagaaaagacatgaccgacggcaacctggcggcagcgcaaaagatg

SEQ ID NO: 193222 - DNA, 103 bp, Artificial Sequence
  Synthetic Polynucleotide
taatacgactcactataggggccggagccgcaccctgcagatgccgtcggaacagaggagaccgacgatgtctgcagggaacctggcggcagcgcaaaagatg

SEQ ID NO: 193223 - DNA, 103 bp, Artificial Sequence
  Synthetic Polynucleotide
taatacgactcactatagggctgacgtgaggccggagccgcaccctgcagaacagaggagactgcagatggcggctccgaacctggcggcagcgcaaaagatg

SEQ ID NO: 193224 - DNA, 103 bp, Artificial Sequence
  Synthetic Polynucleotide
taatacgactcactataggggtgccgggggctgacgtgaggccggagccgaacagaggagacggctcatgcctcacgtcaacctggcggcagcgcaaaagatg

SEQ ID NO: 193225 - DNA, 103 bp, Artificial Sequence
  Synthetic Polynucleotide
taatacgactcactatagggtgttaaaactgtgccgggggctgacgtgagaacagaggagactcacgatggcccccggcaacctggcggcagcgcaaaagatg

SEQ ID NO: 193226 - DNA, 103 bp, Artificial Sequence
  Synthetic Polynucleotide
taatacgactcactatagggatgcccaggttgttaaaactgtgccgggggaacagaggagacccccgatgcagttttaaaacctggcggcagcgcaaaagatg

SEQ ID NO: 193227 - DNA, 103 bp, Artificial Sequence
  Synthetic Polynucleotide
taatacgactcactatagggcacacactggatgcccaggttgttaaaactaacagaggagaagttttatgaacctgggcaacctggcggcagcgcaaaagatg

SEQ ID NO: 193228 - DNA, 103 bp, Artificial Sequence
  Synthetic Polynucleotide
taatacgactcactatagggccttcttcctcacacactggatgcccaggtaacagaggagaacctggatgtccagtgtgaacctggcggcagcgcaaaagatg

SEQ ID NO: 193229 - DNA, 103 bp, Artificial Sequence
  Synthetic Polynucleotide
taatacgactcactataggggcctcaatctccttcttcctcacacactggaacagaggagaccagtgatggaggaagaaaacctggcggcagcgcaaaagatg

SEQ ID NO: 193230 - DNA, 103 bp, Artificial Sequence
  Synthetic Polynucleotide
taatacgactcactatagggcggcgcagccggcggtctggcgacgcggcgaacagaggagacgccgcatggccagaccgaacctggcggcagcgcaaaagatg

SEQ ID NO: 193231 - DNA, 103 bp, Artificial Sequence
  Synthetic Polynucleotide
taatacgactcactatagggctcaatggcagcctcaatctccttcttcctaacagaggagaaggaagatggagattgagaacctggcggcagcgcaaaagatg

SEQ ID NO: 193232 - DNA, 103 bp, Artificial Sequence
  Synthetic Polynucleotide
taatacgactcactataggggaatcttccgctcaatggcagcctcaatctaacagaggagaagattgatgctgccattgaacctggcggcagcgcaaaagatg

SEQ ID NO: 193233 - DNA, 103 bp, Artificial Sequence
  Synthetic Polynucleotide
taatacgactcactatagggatgcccagttgaatcttccgctcaatggcaaacagaggagatgccatatggcggaagataacctggcggcagcgcaaaagatg

SEQ ID NO: 193234 - DNA, 103 bp, Artificial Sequence
  Synthetic Polynucleotide
taatacgactcactataggggtaggggtcaatgcccagttgaatcttccgaacagaggagacggaagatgcaactgggcaacctggcggcagcgcaaaagatg

SEQ ID NO: 193235 - DNA, 103 bp, Artificial Sequence
  Synthetic Polynucleotide
taatacgactcactatagggacccagcgttgtaggggtcaatgcccagttaacagaggagaaactggatgttgacccctaacctggcggcagcgcaaaagatg

SEQ ID NO: 193236 - DNA, 103 bp, Artificial Sequence
  Synthetic Polynucleotide
taatacgactcactatagggttcttcagggacccagcgttgtaggggtcaaacagaggagatgacccatgcaacgctggaacctggcggcagcgcaaaagatg

SEQ ID NO: 193237 - DNA, 103 bp, Artificial Sequence
  Synthetic Polynucleotide
taatacgactcactatagggttcctgatggttcttcagggacccagcgttaacagaggagaaacgctatgtccctgaagaacctggcggcagcgcaaaagatg

SEQ ID NO: 193238 - DNA, 103 bp, Artificial Sequence
  Synthetic Polynucleotide
taatacgactcactatagggtcatgtctacttcctgatggttcttcagggaacagaggagaccctgaatgaccatcaggaacctggcggcagcgcaaaagatg

SEQ ID NO: 193239 - DNA, 103 bp, Artificial Sequence
  Synthetic Polynucleotide
taatacgactcactatagggctcaccacattcatgtctacttcctgatggaacagaggagaccatcaatgagtagacataacctggcggcagcgcaaaagatg

SEQ ID NO: 193240 - DNA, 103 bp, Artificial Sequence
  Synthetic Polynucleotide
taatacgactcactataggggaagcagatcctcaccacattcatgtctacaacagaggagagtagacatgaatgtggtgaacctggcggcagcgcaaaagatg

SEQ ID NO: 193241 - DNA, 103 bp, Artificial Sequence
  Synthetic Polynucleotide
taatacgactcactatagggcccccagctccggcgcagccggcggtctggaacagaggagaccagacatgcggctgcgcaacctggcggcagcgcaaaagatg

SEQ ID NO: 193242 - DNA, 103 bp, Artificial Sequence
  Synthetic Polynucleotide
taatacgactcactatagggatgaggcctggaagcagatcctcaccacataacagaggagaatgtggatgggatctgctaacctggcggcagcgcaaaagatg

SEQ ID NO: 193243 - DNA, 103 bp, Artificial Sequence
  Synthetic Polynucleotide
taatacgactcactatagggtggtcccgatatgaggcctggaagcagatcaacagaggagagatctgatgccaggcctcaacctggcggcagcgcaaaagatg

SEQ ID NO: 193244 - DNA, 103 bp, Artificial Sequence
  Synthetic Polynucleotide
taatacgactcactatagggctgtccctgctggtcccgatatgaggcctgaacagaggagacaggccatgtatcgggacaacctggcggcagcgcaaaagatg

SEQ ID NO: 193245 - DNA, 103 bp, Artificial Sequence
  Synthetic Polynucleotide
taatacgactcactatagggtccggcgcatctgtccctgctggtcccgataacagaggagaatcgggatgagcagggacaacctggcggcagcgcaaaagatg

SEQ ID NO: 193246 - DNA, 103 bp, Artificial Sequence
  Synthetic Polynucleotide
taatacgactcactatagggacaggatccatccggcgcatctgtccctgcaacagaggagagcagggatggatgcgccgaacctggcggcagcgcaaaagatg

SEQ ID NO: 193247 - DNA, 103 bp, Artificial Sequence
  Synthetic Polynucleotide
taatacgactcactatagggctcggaaagcacaggatccatccggcgcataacagaggagaatgcgcatgatggatcctaacctggcggcagcgcaaaagatg

SEQ ID NO: 193248 - DNA, 103 bp, Artificial Sequence
  Synthetic Polynucleotide
taatacgactcactatagggcatagacgggctcggaaagcacaggatccaaacagaggagatggatcatgtgctttccgaacctggcggcagcgcaaaagatg

SEQ ID NO: 193249 - DNA, 103 bp, Artificial Sequence
  Synthetic Polynucleotide
taatacgactcactataggggatttcttgtcatagacgggctcggaaagcaacagaggagagctttcatggcccgtctaaacctggcggcagcgcaaaagatg

SEQ ID NO: 193250 - DNA, 103 bp, Artificial Sequence
  Synthetic Polynucleotide
taatacgactcactatagggtgtgtttgtggatttcttgtcatagacgggaacagaggagacccgtcatggacaagaaaaacctggcggcagcgcaaaagatg

SEQ ID NO: 193251 - DNA, 103 bp, Artificial Sequence
  Synthetic Polynucleotide
taatacgactcactataggggcagctctgatgtgtttgtggatttcttgtaacagaggagaacaagaatgccacaaacaaacctggcggcagcgcaaaagatg

SEQ ID NO: 193252 - DNA, 103 bp, Artificial Sequence
  Synthetic Polynucleotide
taatacgactcactataggggaccctaaggcccccagctccggcgcagccaacagaggagaggctgcatgggagctgggaacctggcggcagcgcaaaagatg

SEQ ID NO: 193253 - DNA, 103 bp, Artificial Sequence
  Synthetic Polynucleotide
taatacgactcactatagggcggcaaatccgcagctctgatgtgtttgtgaacagaggagacacaaaatgatcagagctaacctggcggcagcgcaaaagatg

SEQ ID NO: 193254 - DNA, 103 bp, Artificial Sequence
  Synthetic Polynucleotide
taatacgactcactatagggcttgttaattcggcaaatccgcagctctgaaacagaggagatcagagatgcggatttgcaacctggcggcagcgcaaaagatg

SEQ ID NO: 193255 - DNA, 103 bp, Artificial Sequence
  Synthetic Polynucleotide
taatacgactcactataggggcccgctttccttgttaattcggcaaatccaacagaggagaggatttatggaattaacaaacctggcggcagcgcaaaagatg

SEQ ID NO: 193256 - DNA, 103 bp, Artificial Sequence
  Synthetic Polynucleotide
taatacgactcactatagggccggtgcacggcccgctttccttgttaattaacagaggagaaattaaatgggaaagcggaacctggcggcagcgcaaaagatg

SEQ ID NO: 193257 - DNA, 103 bp, Artificial Sequence
  Synthetic Polynucleotide
taatacgactcactatagggctcctcgccaccggtgcacggcccgctttcaacagaggagagaaagcatgccgtgcaccaacctggcggcagcgcaaaagatg

SEQ ID NO: 193258 - DNA, 103 bp, Artificial Sequence
  Synthetic Polynucleotide
taatacgactcactataggggcaagtagagctcctcgccaccggtgcacgaacagaggagacgtgcaatggtggcgaggaacctggcggcagcgcaaaagatg

SEQ ID NO: 193259 - DNA, 103 bp, Artificial Sequence
  Synthetic Polynucleotide
taatacgactcactatagggttgtcgcagagcaagtagagctcctcgccaaacagaggagatggcgaatggctctacttaacctggcggcagcgcaaaagatg

SEQ ID NO: 193260 - DNA, 103 bp, Artificial Sequence
  Synthetic Polynucleotide
taatacgactcactatagggtttctgcaccttgtcgcagagcaagtagagaacagaggagactctacatgctctgcgacaacctggcggcagcgcaaaagatg

SEQ ID NO: 193261 - DNA, 103 bp, Artificial Sequence
  Synthetic Polynucleotide
taatacgactcactatagggatatgtcctctttctgcaccttgtcgcagaaacagaggagatctgcgatgaggtgcagaaacctggcggcagcgcaaaagatg

SEQ ID NO: 193262 - DNA, 103 bp, Artificial Sequence
  Synthetic Polynucleotide
taatacgactcactatagggaacaccactgatatgtcctctttctgcaccaacagaggagaggtgcaatgagaggacataacctggcggcagcgcaaaagatg

SEQ ID NO: 193263 - DNA, 103 bp, Artificial Sequence
  Synthetic Polynucleotide
taatacgactcactatagggagaagactgccccattacctgggtggccataacagaggagaatggccatgcaggtaatgaacctggcggcagcgcaaaagatg

SEQ ID NO: 193264 - DNA, 103 bp, Artificial Sequence
  Synthetic Polynucleotide
taatacgactcactatagggttcagctttggaaaggtcatgcaagtcataaacagaggagatatgacatgcatgaccttaacctggcggcagcgcaaaagatg

SEQ ID NO: 193265 - DNA, 103 bp, Artificial Sequence
  Synthetic Polynucleotide
taatacgactcactatagggcacataactgcactgatcacatttaaatggaacagaggagaccatttatgtgtgatcagaacctggcggcagcgcaaaagatg

SEQ ID NO: 193266 - DNA, 103 bp, Artificial Sequence
  Synthetic Polynucleotide
taatacgactcactataggggattagaggccacataactgcactgatcacaacagaggagagtgatcatggcagttatgaacctggcggcagcgcaaaagatg

SEQ ID NO: 193267 - DNA, 103 bp, Artificial Sequence
  Synthetic Polynucleotide
taatacgactcactatagggacttcatgttgattagaggccacataactgaacagaggagacagttaatgggcctctaaaacctggcggcagcgcaaaagatg

SEQ ID NO: 193268 - DNA, 103 bp, Artificial Sequence
  Synthetic Polynucleotide
taatacgactcactatagggatggcgggttacttcatgttgattagaggcaacagaggagagcctctatgcaacatgaaaacctggcggcagcgcaaaagatg

SEQ ID NO: 193269 - DNA, 103 bp, Artificial Sequence
  Synthetic Polynucleotide
taatacgactcactatagggcctgtcttgcatggcgggttacttcatgttaacagaggagaaacatgatgtaacccgccaacctggcggcagcgcaaaagatg

SEQ ID NO: 193270 - DNA, 103 bp, Artificial Sequence
  Synthetic Polynucleotide
taatacgactcactatagggccattgtgaacctgtcttgcatggcgggttaacagaggagaaacccgatgtgcaagacaaacctggcggcagcgcaaaagatg

SEQ ID NO: 193271 - DNA, 103 bp, Artificial Sequence
  Synthetic Polynucleotide
taatacgactcactatagggaggtttaggcccattgtgaacctgtcttgcaacagaggagagcaagaatggttcacaataacctggcggcagcgcaaaagatg

SEQ ID NO: 193272 - DNA, 103 bp, Artificial Sequence
  Synthetic Polynucleotide
taatacgactcactatagggggcaattaagaggtttaggcccattgtgaaaacagaggagattcacaatgggcctaaacaacctggcggcagcgcaaaagatg

SEQ ID NO: 193273 - DNA, 103 bp, Artificial Sequence
  Synthetic Polynucleotide
taatacgactcactatagggtcacagtgtgggcaattaagaggtttaggcaacagaggagagcctaaatgtcttaattgaacctggcggcagcgcaaaagatg

SEQ ID NO: 193274 - DNA, 103 bp, Artificial Sequence
  Synthetic Polynucleotide
taatacgactcactatagggtgttttgtaatcacagtgtgggcaattaagaacagaggagacttaatatgccacactgtaacctggcggcagcgcaaaagatg

SEQ ID NO: 193275 - DNA, 103 bp, Artificial Sequence
  Synthetic Polynucleotide
taatacgactcactataggggtgcggccagttcagctttggaaaggtcataacagaggagaatgaccatgccaaagctgaacctggcggcagcgcaaaagatg

SEQ ID NO: 193276 - DNA, 103 bp, Artificial Sequence
  Synthetic Polynucleotide
taatacgactcactatagggttctatctgctgttttgtaatcacagtgtgaacagaggagacacactatgattacaaaaaacctggcggcagcgcaaaagatg

SEQ ID NO: 193277 - DNA, 103 bp, Artificial Sequence
  Synthetic Polynucleotide
taatacgactcactatagggttgaagttgcttctatctgctgttttgtaaaacagaggagattacaaatgagcagatagaacctggcggcagcgcaaaagatg

SEQ ID NO: 193278 - DNA, 103 bp, Artificial Sequence
  Synthetic Polynucleotide
taatacgactcactatagggtacatgttttttgaagttgcttctatctgcaacagaggagagcagatatgagcaacttcaacctggcggcagcgcaaaagatg

SEQ ID NO: 193279 - DNA, 103 bp, Artificial Sequence
  Synthetic Polynucleotide
taatacgactcactatagggcatgtagctctacatgttttttgaagttgcaacagaggagagcaactatgaaaaacatgaacctggcggcagcgcaaaagatg

SEQ ID NO: 193280 - DNA, 103 bp, Artificial Sequence
  Synthetic Polynucleotide
taatacgactcactatagggcgtgggttcacatgtagctctacatgttttaacagaggagaaaaacaatgagagctacaaacctggcggcagcgcaaaagatg

SEQ ID NO: 193281 - DNA, 103 bp, Artificial Sequence
  Synthetic Polynucleotide
taatacgactcactatagggattgaactgccgtgggttcacatgtagctcaacagaggagagagctaatggtgaacccaaacctggcggcagcgcaaaagatg

SEQ ID NO: 193282 - DNA, 103 bp, Artificial Sequence
  Synthetic Polynucleotide
taatacgactcactatagggatacagggcaattgaactgccgtgggttcaaacagaggagatgaaccatgggcagttcaaacctggcggcagcgcaaaagatg

SEQ ID NO: 193283 - DNA, 103 bp, Artificial Sequence
  Synthetic Polynucleotide
taatacgactcactataggggcatagtcacatacagggcaattgaactgcaacagaggagagcagttatgttgccctgtaacctggcggcagcgcaaaagatg

SEQ ID NO: 193284 - DNA, 103 bp, Artificial Sequence
  Synthetic Polynucleotide
taatacgactcactatagggcttggaagctgcatagtcacatacagggcaaacagaggagatgccctatgtgtgactataacctggcggcagcgcaaaagatg

SEQ ID NO: 193285 - DNA, 103 bp, Artificial Sequence
  Synthetic Polynucleotide
taatacgactcactataggggattacacttcttggaagctgcatagtcacaacagaggagagtgactatgcagcttccaaacctggcggcagcgcaaaagatg

SEQ ID NO: 193286 - DNA, 103 bp, Artificial Sequence
  Synthetic Polynucleotide
taatacgactcactatagggataagctgaggtgcggccagttcagctttgaacagaggagacaaagcatgactggccgcaacctggcggcagcgcaaaagatg

SEQ ID NO: 193287 - DNA, 103 bp, Artificial Sequence
  Synthetic Polynucleotide
taatacgactcactatagggtgatactgtagattacacttcttggaagctaacagaggagaagcttcatggaagtgtaaaacctggcggcagcgcaaaagatg

SEQ ID NO: 193288 - DNA, 103 bp, Artificial Sequence
  Synthetic Polynucleotide
taatacgactcactatagggagatttgaagtgatactgtagattacacttaacagaggagaaagtgtatgctacagtataacctggcggcagcgcaaaagatg

SEQ ID NO: 193289 - DNA, 103 bp, Artificial Sequence
  Synthetic Polynucleotide
taatacgactcactatagggtaggatgcttagatttgaagtgatactgtaaacagaggagatacagtatgacttcaaataacctggcggcagcgcaaaagatg

SEQ ID NO: 193290 - DNA, 103 bp, Artificial Sequence
  Synthetic Polynucleotide
taatacgactcactatagggttaggacaagtaggatgcttagatttgaagaacagaggagacttcaaatgtaagcatccaacctggcggcagcgcaaaagatg

SEQ ID NO: 193291 - DNA, 103 bp, Artificial Sequence
  Synthetic Polynucleotide
taatacgactcactatagggcattgttttattaggacaagtaggatgcttaacagaggagaaagcatatgacttgtcctaacctggcggcagcgcaaaagatg

SEQ ID NO: 193292 - DNA, 103 bp, Artificial Sequence
  Synthetic Polynucleotide
taatacgactcactatagggttgagacatccattgttttattaggacaagaacagaggagacttgtcatgataaaacaaaacctggcggcagcgcaaaagatg

SEQ ID NO: 193293 - DNA, 103 bp, Artificial Sequence
  Synthetic Polynucleotide
taatacgactcactatagggagtttcacttttgagacatccattgttttaaacagaggagataaaacatgggatgtctcaacctggcggcagcgcaaaagatg

SEQ ID NO: 193294 - DNA, 103 bp, Artificial Sequence
  Synthetic Polynucleotide
taatacgactcactatagggggttttctttagtttcacttttgagacatcaacagaggagagatgtcatgaaagtgaaaaacctggcggcagcgcaaaagatg

SEQ ID NO: 193295 - DNA, 103 bp, Artificial Sequence
  Synthetic Polynucleotide
taatacgactcactatagggctcgttttttggttttctttagtttcacttaacagaggagaaagtgaatgtaaagaaaaaacctggcggcagcgcaaaagatg

SEQ ID NO: 193296 - DNA, 103 bp, Artificial Sequence
  Synthetic Polynucleotide
taatacgactcactatagggaagtcagcctctcgttttttggttttctttaacagaggagaaaagaaatgcaaaaaacgaacctggcggcagcgcaaaagatg

SEQ ID NO: 193297 - DNA, 103 bp, Artificial Sequence
  Synthetic Polynucleotide
taatacgactcactatagggtgccagcataataagctgaggtgcggccagaacagaggagactggccatgcctcagcttaacctggcggcagcgcaaaagatg

SEQ ID NO: 193298 - DNA, 103 bp, Artificial Sequence
  Synthetic Polynucleotide
taatacgactcactatagggattatcaggcaagtcagcctctcgttttttaacagaggagaaaaaaaatggaggctgacaacctggcggcagcgcaaaagatg

SEQ ID NO: 193299 - DNA, 103 bp, Artificial Sequence
  Synthetic Polynucleotide
taatacgactcactatagggcattggtaatattatcaggcaagtcagcctaacagaggagaaggctgatgtgcctgataaacctggcggcagcgcaaaagatg

SEQ ID NO: 193300 - DNA, 103 bp, Artificial Sequence
  Synthetic Polynucleotide
taatacgactcactatagggtctgttttttcattggtaatattatcaggcaacagaggagagcctgaatgtattaccaaaacctggcggcagcgcaaaagatg

SEQ ID NO: 193301 - DNA, 103 bp, Artificial Sequence
  Synthetic Polynucleotide
taatacgactcactatagggttgttctatttctgttttttcattggtaataacagaggagaattaccatggaaaaaacaaacctggcggcagcgcaaaagatg

SEQ ID NO: 193302 - DNA, 103 bp, Artificial Sequence
  Synthetic Polynucleotide
taatacgactcactatagggttatttttgtttgttctatttctgttttttaacagaggagaaaaaaaatgaaatagaacaacctggcggcagcgcaaaagatg

SEQ ID NO: 193303 - DNA, 103 bp, Artificial Sequence
  Synthetic Polynucleotide
taatacgactcactatagggacatccccttttatttttgtttgttctattaacagaggagaaatagaatgaacaaaaataacctggcggcagcgcaaaagatg

SEQ ID NO: 193304 - DNA, 103 bp, Artificial Sequence
  Synthetic Polynucleotide
taatacgactcactatagggctttccagccacatccccttttatttttgtaacagaggagaacaaaaatgaaaggggataacctggcggcagcgcaaaagatg

SEQ ID NO: 193305 - DNA, 103 bp, Artificial Sequence
  Synthetic Polynucleotide
taatacgactcactatagggtttcatttttctttccagccacatccccttaacagaggagaaaggggatgtggctggaaaacctggcggcagcgcaaaagatg

SEQ ID NO: 193306 - DNA, 103 bp, Artificial Sequence
  Synthetic Polynucleotide
taatacgactcactatagggttgacggacttttcatttttctttccagccaacagaggagaggctggatggaaaaatgaaacctggcggcagcgcaaaagatg

SEQ ID NO: 193307 - DNA, 103 bp, Artificial Sequence
  Synthetic Polynucleotide
taatacgactcactatagggtttctctgctttgacggacttttcatttttaacagaggagaaaaaatatgaagtccgtcaacctggcggcagcgcaaaagatg

SEQ ID NO: 193308 - DNA, 103 bp, Artificial Sequence
  Synthetic Polynucleotide
taatacgactcactatagggaggccacatttgccagcataataagctgagaacagaggagactcagcatgttatgctggaacctggcggcagcgcaaaagatg

SEQ ID NO: 193309 - DNA, 103 bp, Artificial Sequence
  Synthetic Polynucleotide
taatacgactcactatagggagacatctcttttctctgctttgacggactaacagaggagaagtccgatgaagcagagaaacctggcggcagcgcaaaagatg

SEQ ID NO: 193310 - DNA, 103 bp, Artificial Sequence
  Synthetic Polynucleotide
taatacgactcactatagggttctcttttgagacatctcttttctctgctaacagaggagaagcagaatgaagagatgtaacctggcggcagcgcaaaagatg

SEQ ID NO: 193311 - DNA, 103 bp, Artificial Sequence
  Synthetic Polynucleotide
taatacgactcactatagggagaaggctttttctcttttgagacatctctaacagaggagaagagatatgtcaaaagagaacctggcggcagcgcaaaagatg

SEQ ID NO: 193312 - DNA, 103 bp, Artificial Sequence
  Synthetic Polynucleotide
taatacgactcactatagggacacattattagaaggctttttctcttttgaacagaggagacaaaagatgaaaagccttaacctggcggcagcgcaaaagatg

SEQ ID NO: 193313 - DNA, 103 bp, Artificial Sequence
  Synthetic Polynucleotide
taatacgactcactatagggtggatcactgacacattattagaaggctttaacagaggagaaaagccatgtaataatgtaacctggcggcagcgcaaaagatg

SEQ ID NO: 193314 - DNA, 103 bp, Artificial Sequence
  Synthetic Polynucleotide
taatacgactcactatagggggtagtcacctggatcactgacacattattaacagaggagaaataatatgtcagtgatcaacctggcggcagcgcaaaagatg

SEQ ID NO: 193315 - DNA, 103 bp, Artificial Sequence
  Synthetic Polynucleotide
taatacgactcactatagggttcgagttctggtagtcacctggatcactgaacagaggagacagtgaatgaggtgactaaacctggcggcagcgcaaaagatg

SEQ ID NO: 193316 - DNA, 103 bp, Artificial Sequence
  Synthetic Polynucleotide
taatacgactcactataggggttactgattttcgagttctggtagtcaccaacagaggagaggtgacatgcagaactcgaacctggcggcagcgcaaaagatg

SEQ ID NO: 193317 - DNA, 103 bp, Artificial Sequence
  Synthetic Polynucleotide
taatacgactcactatagggtttcacctctgttactgattttcgagttctaacagaggagaagaactatgaaatcagtaaacctggcggcagcgcaaaagatg

SEQ ID NO: 193318 - DNA, 103 bp, Artificial Sequence
  Synthetic Polynucleotide
taatacgactcactatagggcatccatctctttcacctctgttactgattaacagaggagaaatcagatgcagaggtgaaacctggcggcagcgcaaaagatg

SEQ ID NO: 193319 - DNA, 103 bp, Artificial Sequence
  Synthetic Polynucleotide
taatacgactcactatagggtccccagttaaggccacatttgccagcataaacagaggagatatgctatgaaatgtggcaacctggcggcagcgcaaaagatg

SEQ ID NO: 193320 - DNA, 103 bp, Artificial Sequence
  Synthetic Polynucleotide
taatacgactcactatagggcctgtatgcacatccatctctttcacctctaacagaggagaagaggtatgagagatggaaacctggcggcagcgcaaaagatg

SEQ ID NO: 193321 - DNA, 103 bp, Artificial Sequence
  Synthetic Polynucleotide
taatacgactcactatagggtgaattgcttcctgtatgcacatccatctcaacagaggagagagatgatggtgcatacaaacctggcggcagcgcaaaagatg

SEQ ID NO: 193322 - DNA, 103 bp, Artificial Sequence
  Synthetic Polynucleotide
taatacgactcactatagggtgaatttttctgaattgcttcctgtatgcaaacagaggagatgcataatggaagcaattaacctggcggcagcgcaaaagatg

SEQ ID NO: 193323 - DNA, 103 bp, Artificial Sequence
  Synthetic Polynucleotide
taatacgactcactatagggttagttttactgaatttttctgaattgcttaacagaggagaaagcaaatgagaaaaattaacctggcggcagcgcaaaagatg

SEQ ID NO: 193324 - DNA, 103 bp, Artificial Sequence
  Synthetic Polynucleotide
taatacgactcactatagggtttgcttttcttagttttactgaatttttcaacagaggagagaaaaaatgagtaaaactaacctggcggcagcgcaaaagatg

SEQ ID NO: 193325 - DNA, 103 bp, Artificial Sequence
  Synthetic Polynucleotide
taatacgactcactatagggccagcttccttttgcttttcttagttttacaacagaggagagtaaaaatgagaaaagcaaacctggcggcagcgcaaaagatg

SEQ ID NO: 193326 - DNA, 103 bp, Artificial Sequence
  Synthetic Polynucleotide
taatacgactcactatagggctgtcaacttccagcttccttttgcttttcaacagaggagagaaaagatgaaggaagctaacctggcggcagcgcaaaagatg

SEQ ID NO: 193327 - DNA, 103 bp, Artificial Sequence
  Synthetic Polynucleotide
taatacgactcactatagggtaaagaatggctgtcaacttccagcttcctaacagaggagaaggaagatggaagttgacaacctggcggcagcgcaaaagatg

SEQ ID NO: 193328 - DNA, 103 bp, Artificial Sequence
  Synthetic Polynucleotide
taatacgactcactatagggcaggaccatgtaaagaatggctgtcaacttaacagaggagaaagttgatggccattcttaacctggcggcagcgcaaaagatg

SEQ ID NO: 193329 - DNA, 103 bp, Artificial Sequence
  Synthetic Polynucleotide
taatacgactcactatagggtcatcattcacaggaccatgtaaagaatggaacagaggagaccattcatgacatggtccaacctggcggcagcgcaaaagatg

SEQ ID NO: 193330 - DNA, 103 bp, Artificial Sequence
  Synthetic Polynucleotide
taatacgactcactataggggccatttacttccccagttaaggccacattaacagaggagaaatgtgatgttaactgggaacctggcggcagcgcaaaagatg

SEQ ID NO: 193331 - DNA, 103 bp, Artificial Sequence
  Synthetic Polynucleotide
taatacgactcactatagggtgaagattcctcatcattcacaggaccatgaacagaggagacatggtatggtgaatgataacctggcggcagcgcaaaagatg

SEQ ID NO: 193332 - DNA, 103 bp, Artificial Sequence
  Synthetic Polynucleotide
taatacgactcactatagggtcttttttgttgaagattcctcatcattcaaacagaggagatgaatgatgaggaatcttaacctggcggcagcgcaaaagatg

SEQ ID NO: 193333 - DNA, 103 bp, Artificial Sequence
  Synthetic Polynucleotide
taatacgactcactatagggaccttctttttcttttttgttgaagattccaacagaggagaggaatcatgaacaaaaaaaacctggcggcagcgcaaaagatg

SEQ ID NO: 193334 - DNA, 103 bp, Artificial Sequence
  Synthetic Polynucleotide
taatacgactcactatagggtttgctttctaccttctttttcttttttgtaacagaggagaacaaaaatgaaaaagaagaacctggcggcagcgcaaaagatg

SEQ ID NO: 193335 - DNA, 103 bp, Artificial Sequence
  Synthetic Polynucleotide
taatacgactcactatagggtatttttggatttgctttctaccttcttttaacagaggagaaaaagaatgtagaaagcaaacctggcggcagcgcaaaagatg

SEQ ID NO: 193336 - DNA, 103 bp, Artificial Sequence
  Synthetic Polynucleotide
taatacgactcactatagggtcctgactattatttttggatttgctttctaacagaggagaagaaagatgatccaaaaaaacctggcggcagcgcaaaagatg

SEQ ID NO: 193337 - DNA, 103 bp, Artificial Sequence
  Synthetic Polynucleotide
taatacgactcactatagggctttggcacttcctgactattatttttggaaacagaggagatccaaaatgaatagtcagaacctggcggcagcgcaaaagatg

SEQ ID NO: 193338 - DNA, 103 bp, Artificial Sequence
  Synthetic Polynucleotide
taatacgactcactatagggtgctgtcaccctttggcacttcctgactataacagaggagaatagtcatgaagtgccaaaacctggcggcagcgcaaaagatg

SEQ ID NO: 193339 - DNA, 103 bp, Artificial Sequence
  Synthetic Polynucleotide
taatacgactcactatagggtcctccactttgctgtcaccctttggcactaacagaggagaagtgccatggggtgacagaacctggcggcagcgcaaaagatg

SEQ ID NO: 193340 - DNA, 103 bp, Artificial Sequence
  Synthetic Polynucleotide
taatacgactcactatagggctttttattctcctccactttgctgtcaccaacagaggagaggtgacatgaaagtggagaacctggcggcagcgcaaaagatg

SEQ ID NO: 193341 - DNA, 103 bp, Artificial Sequence
  Synthetic Polynucleotide
taatacgactcactatagggcacagcagctgccatttacttccccagttaaacagaggagataactgatgaagtaaatgaacctggcggcagcgcaaaagatg

SEQ ID NO: 193342 - DNA, 103 bp, Artificial Sequence
  Synthetic Polynucleotide
taatacgactcactatagggaagtattttgctttttattctcctccacttaacagaggagaaagtggatgagaataaaaaacctggcggcagcgcaaaagatg

SEQ ID NO: 193343 - DNA, 103 bp, Artificial Sequence
  Synthetic Polynucleotide
taatacgactcactatagggtttttcatgcaagtattttgctttttattcaacagaggagagaataaatggcaaaatacaacctggcggcagcgcaaaagatg

SEQ ID NO: 193344 - DNA, 103 bp, Artificial Sequence
  Synthetic Polynucleotide
taatacgactcactatagggctttgtactttttttcatgcaagtattttgaacagaggagacaaaatatgtgcatgaaaaacctggcggcagcgcaaaagatg

SEQ ID NO: 193345 - DNA, 103 bp, Artificial Sequence
  Synthetic Polynucleotide
taatacgactcactataggggagttttcttctttgtactttttttcatgcaacagaggagagcatgaatgaaagtacaaaacctggcggcagcgcaaaagatg

SEQ ID NO: 193346 - DNA, 103 bp, Artificial Sequence
  Synthetic Polynucleotide
taatacgactcactatagggttatttttcagagttttcttctttgtacttaacagaggagaaagtacatggaagaaaacaacctggcggcagcgcaaaagatg

SEQ ID NO: 193347 - DNA, 103 bp, Artificial Sequence
  Synthetic Polynucleotide
taatacgactcactatagggcttacttgatttatttttcagagttttcttaacagaggagaaagaaaatgctgaaaaataacctggcggcagcgcaaaagatg

SEQ ID NO: 193348 - DNA, 103 bp, Artificial Sequence
  Synthetic Polynucleotide
taatacgactcactatagggtactgcttttcttacttgatttatttttcaaacagaggagatgaaaaatgaatcaagtaaacctggcggcagcgcaaaagatg

SEQ ID NO: 193349 - DNA, 103 bp, Artificial Sequence
  Synthetic Polynucleotide
taatacgactcactatagggtgaggaggcttactgcttttcttacttgataacagaggagaatcaagatggaaaagcagaacctggcggcagcgcaaaagatg

SEQ ID NO: 193350 - DNA, 103 bp, Artificial Sequence
  Synthetic Polynucleotide
taatacgactcactatagggaggttccttctgaggaggcttactgcttttaacagaggagaaaaagcatgaagcctcctaacctggcggcagcgcaaaagatg

SEQ ID NO: 193351 - DNA, 103 bp, Artificial Sequence
  Synthetic Polynucleotide
taatacgactcactatagggccttctcaacaggttccttctgaggaggctaacagaggagaagcctcatgagaaggaacaacctggcggcagcgcaaaagatg

SEQ ID NO: 193352 - DNA, 103 bp, Artificial Sequence
  Synthetic Polynucleotide
taatacgactcactatagggaccaggtaatcacagcagctgccatttactaacagaggagaagtaaaatgcagctgctgaacctggcggcagcgcaaaagatg

SEQ ID NO: 193353 - DNA, 103 bp, Artificial Sequence
  Synthetic Polynucleotide
taatacgactcactatagggtgagcagatcccttctcaacaggttccttcaacagaggagagaaggaatgtgttgagaaaacctggcggcagcgcaaaagatg

SEQ ID NO: 193354 - DNA, 103 bp, Artificial Sequence
  Synthetic Polynucleotide
taatacgactcactatagggagggtccatctgagcagatcccttctcaacaacagaggagagttgagatgggatctgctaacctggcggcagcgcaaaagatg

SEQ ID NO: 193355 - DNA, 103 bp, Artificial Sequence
  Synthetic Polynucleotide
taatacgactcactatagggccatctgaggagggtccatctgagcagatcaacagaggagagatctgatgagatggaccaacctggcggcagcgcaaaagatg

SEQ ID NO: 193356 - DNA, 103 bp, Artificial Sequence
  Synthetic Polynucleotide
taatacgactcactatagggggagcaggccccatctgaggagggtccatcaacagaggagagatggaatgtcctcagataacctggcggcagcgcaaaagatg

SEQ ID NO: 193357 - DNA, 103 bp, Artificial Sequence
  Synthetic Polynucleotide
taatacgactcactatagggcgcctctgtgggagcaggccccatctgaggaacagaggagacctcagatggggcctgctaacctggcggcagcgcaaaagatg

SEQ ID NO: 193358 - DNA, 103 bp, Artificial Sequence
  Synthetic Polynucleotide
taatacgactcactatagggccttctgaaccgcctctgtgggagcaggccaacagaggagaggcctgatgccacagaggaacctggcggcagcgcaaaagatg

SEQ ID NO: 193359 - DNA, 103 bp, Artificial Sequence
  Synthetic Polynucleotide
taatacgactcactatagggtgaacgggccccttctgaaccgcctctgtgaacagaggagacacagaatgggttcagaaaacctggcggcagcgcaaaagatg

SEQ ID NO: 193360 - DNA, 103 bp, Artificial Sequence
  Synthetic Polynucleotide
taatacgactcactatagggcggctccacctgaacgggccccttctgaacaacagaggagagttcagatggggcccgttaacctggcggcagcgcaaaagatg

SEQ ID NO: 193361 - DNA, 103 bp, Artificial Sequence
  Synthetic Polynucleotide
taatacgactcactatagggtgggaggtggcggctccacctgaacgggccaacagaggagaggcccgatgaggtggagcaacctggcggcagcgcaaaagatg

SEQ ID NO: 193362 - DNA, 103 bp, Artificial Sequence
  Synthetic Polynucleotide
taatacgactcactataggggcatgctccatgggaggtggcggctccaccaacagaggagaggtggaatggccacctccaacctggcggcagcgcaaaagatg

SEQ ID NO: 193363 - DNA, 103 bp, Artificial Sequence
  Synthetic Polynucleotide
taatacgactcactatagggttcttcaccgaccaggtaatcacagcagctaacagaggagaagctgcatggattacctgaacctggcggcagcgcaaaagatg

SEQ ID NO: 193364 - DNA, 103 bp, Artificial Sequence
  Synthetic Polynucleotide
taatacgactcactatagggctccatctgagcatgctccatgggaggtggaacagaggagaccacctatgatggagcataacctggcggcagcgcaaaagatg

SEQ ID NO: 193365 - DNA, 103 bp, Artificial Sequence
  Synthetic Polynucleotide
taatacgactcactatagggtctgggcaccctccatctgagcatgctccaaacagaggagatggagcatgctcagatggaacctggcggcagcgcaaaagatg

SEQ ID NO: 193366 - DNA, 103 bp, Artificial Sequence
  Synthetic Polynucleotide
taatacgactcactataggggcaggccgtatctgggcaccctccatctgaaacagaggagatcagatatggggtgcccaaacctggcggcagcgcaaaagatg

SEQ ID NO: 193367 - DNA, 103 bp, Artificial Sequence
  Synthetic Polynucleotide
taatacgactcactatagggctcgtcaggagcaggccgtatctgggcaccaacagaggagaggtgccatgatacggcctaacctggcggcagcgcaaaagatg

SEQ ID NO: 193368 - DNA, 103 bp, Artificial Sequence
  Synthetic Polynucleotide
taatacgactcactatagggtctgaacaggctcgtcaggagcaggccgtaaacagaggagatacggcatgctcctgacgaacctggcggcagcgcaaaagatg

SEQ ID NO: 193369 - DNA, 103 bp, Artificial Sequence
  Synthetic Polynucleotide
taatacgactcactatagggaccacctccatctgaacaggctcgtcaggaaacagaggagatcctgaatggcctgttcaaacctggcggcagcgcaaaagatg

SEQ ID NO: 193370 - DNA, 103 bp, Artificial Sequence
  Synthetic Polynucleotide
taatacgactcactatagggcccctcctgaaccacctccatctgaacaggaacagaggagacctgttatgatggaggtgaacctggcggcagcgcaaaagatg

SEQ ID NO: 193371 - DNA, 103 bp, Artificial Sequence
  Synthetic Polynucleotide
taatacgactcactatagggtctgagcaggcccctcctgaaccacctccaaacagaggagatggaggatgttcaggaggaacctggcggcagcgcaaaagatg

SEQ ID NO: 193372 - DNA, 103 bp, Artificial Sequence
  Synthetic Polynucleotide
taatacgactcactatagggagcagctccttctgagcaggcccctcctgaaacagaggagatcaggaatggcctgctcaaacctggcggcagcgcaaaagatg

SEQ ID NO: 193373 - DNA, 103 bp, Artificial Sequence
  Synthetic Polynucleotide
taatacgactcactatagggcacgggaggcagcagctccttctgagcaggaacagaggagacctgctatgaaggagctgaacctggcggcagcgcaaaagatg

SEQ ID NO: 193374 - DNA, 103 bp, Artificial Sequence
  Synthetic Polynucleotide
taatacgactcactatagggctcctcctccagaagactgccccattacctaacagaggagaaggtaaatgggcagtcttaacctggcggcagcgcaaaagatg

SEQ ID NO: 193375 - DNA, 103 bp, Artificial Sequence
  Synthetic Polynucleotide
taatacgactcactatagggccatctgtctttcttcaccgaccaggtaataacagaggagaattaccatgtcggtgaagaacctggcggcagcgcaaaagatg

SEQ ID NO: 193376 - DNA, 103 bp, Artificial Sequence
  Synthetic Polynucleotide
taatacgactcactataggggagcaggctccacgggaggcagcagctcctaacagaggagaaggagcatgtgcctcccgaacctggcggcagcgcaaaagatg

SEQ ID NO: 193377 - DNA, 103 bp, Artificial Sequence
  Synthetic Polynucleotide
taatacgactcactatagggcccaccatctgagcaggctccacgggaggcaacagaggagagcctccatgggagcctgcaacctggcggcagcgcaaaagatg

SEQ ID NO: 193378 - DNA, 103 bp, Artificial Sequence
  Synthetic Polynucleotide
taatacgactcactatagggaatttgggcacccaccatctgagcaggctcaacagaggagagagcctatgcagatggtgaacctggcggcagcgcaaaagatg

SEQ ID NO: 193379 - DNA, 103 bp, Artificial Sequence
  Synthetic Polynucleotide
taatacgactcactataggggagcaagtacaatttgggcacccaccatctaacagaggagaagatggatggtgcccaaaaacctggcggcagcgcaaaagatg

SEQ ID NO: 193380 - DNA, 103 bp, Artificial Sequence
  Synthetic Polynucleotide
taatacgactcactatagggagctccatgtgagcaagtacaatttgggcaaacagaggagatgcccaatgtgtacttgcaacctggcggcagcgcaaaagatg

SEQ ID NO: 193381 - DNA, 103 bp, Artificial Sequence
  Synthetic Polynucleotide
taatacgactcactataggggggaggaggcagctccatgtgagcaagtacaacagaggagagtacttatgcacatggagaacctggcggcagcgcaaaagatg

SEQ ID NO: 193382 - DNA, 103 bp, Artificial Sequence
  Synthetic Polynucleotide
taatacgactcactatagggcagtctccatgggaggaggcagctccatgtaacagaggagaacatggatgtgcctcctcaacctggcggcagcgcaaaagatg

SEQ ID NO: 193383 - DNA, 103 bp, Artificial Sequence
  Synthetic Polynucleotide
taatacgactcactatagggtccgtctgagcagtctccatgggaggaggcaacagaggagagcctccatgcatggagacaacctggcggcagcgcaaaagatg

SEQ ID NO: 193384 - DNA, 103 bp, Artificial Sequence
  Synthetic Polynucleotide
taatacgactcactatagggttgggcaacctccgtctgagcagtctccataacagaggagaatggagatggctcagacgaacctggcggcagcgcaaaagatg

SEQ ID NO: 193385 - DNA, 103 bp, Artificial Sequence
  Synthetic Polynucleotide
taatacgactcactatagggcaggccccatttgggcaacctccgtctgagaacagaggagactcagaatgaggttgcccaacctggcggcagcgcaaaagatg

SEQ ID NO: 193386 - DNA, 103 bp, Artificial Sequence
  Synthetic Polynucleotide
taatacgactcactatagggatcagttctgccatctgtctttcttcaccgaacagaggagacggtgaatgaagacagataacctggcggcagcgcaaaagatg

SEQ ID NO: 193387 - DNA, 103 bp, Artificial Sequence
  Synthetic Polynucleotide
taatacgactcactatagggtccatgggagcaggccccatttgggcaaccaacagaggagaggttgcatgaatggggccaacctggcggcagcgcaaaagatg

SEQ ID NO: 193388 - DNA, 103 bp, Artificial Sequence
  Synthetic Polynucleotide
taatacgactcactatagggctgagcaggttccatgggagcaggccccataacagaggagaatggggatggctcccatgaacctggcggcagcgcaaaagatg

SEQ ID NO: 193389 - DNA, 103 bp, Artificial Sequence
  Synthetic Polynucleotide
taatacgactcactatagggcaacctccatctgagcaggttccatgggagaacagaggagactcccaatgaacctgctcaacctggcggcagcgcaaaagatg

SEQ ID NO: 193390 - DNA, 103 bp, Artificial Sequence
  Synthetic Polynucleotide
taatacgactcactatagggtctacctgggcaacctccatctgagcaggtaacagaggagaacctgcatggatggaggtaacctggcggcagcgcaaaagatg

SEQ ID NO: 193391 - DNA, 103 bp, Artificial Sequence
  Synthetic Polynucleotide
taatacgactcactataggggggagcagattctacctgggcaacctccataacagaggagaatggagatggcccaggtaaacctggcggcagcgcaaaagatg

SEQ ID NO: 193392 - DNA, 103 bp, Artificial Sequence
  Synthetic Polynucleotide
taatacgactcactatagggccacctgcatgggagcagattctacctgggaacagaggagacccaggatgaatctgctcaacctggcggcagcgcaaaagatg

SEQ ID NO: 193393 - DNA, 103 bp, Artificial Sequence
  Synthetic Polynucleotide
taatacgactcactatagggtccttctggaccacctgcatgggagcagataacagaggagaatctgcatgcatgcaggtaacctggcggcagcgcaaaagatg

SEQ ID NO: 193394 - DNA, 103 bp, Artificial Sequence
  Synthetic Polynucleotide
taatacgactcactatagggctgaacaggctccttctggaccacctgcataacagaggagaatgcagatggtccagaagaacctggcggcagcgcaaaagatg

SEQ ID NO: 193395 - DNA, 103 bp, Artificial Sequence
  Synthetic Polynucleotide
taatacgactcactatagggacagctccatctgaacaggctccttctggaaacagaggagatccagaatgagcctgttcaacctggcggcagcgcaaaagatg

SEQ ID NO: 193396 - DNA, 103 bp, Artificial Sequence
  Synthetic Polynucleotide
taatacgactcactatagggatgggaggagacagctccatctgaacaggcaacagaggagagcctgtatggatggagctaacctggcggcagcgcaaaagatg

SEQ ID NO: 193397 - DNA, 103 bp, Artificial Sequence
  Synthetic Polynucleotide
taatacgactcactatagggcccaaccggcatcagttctgccatctgtctaacagaggagaagacagatggcagaactgaacctggcggcagcgcaaaagatg

SEQ ID NO: 193398 - DNA, 103 bp, Artificial Sequence
  Synthetic Polynucleotide
taatacgactcactataggggaccacctccatgggaggagacagctccataacagaggagaatggagatgtctcctcccaacctggcggcagcgcaaaagatg

SEQ ID NO: 193399 - DNA, 103 bp, Artificial Sequence
  Synthetic Polynucleotide
taatacgactcactataggggctccttctggaccacctccatgggaggagaacagaggagactcctcatgtggaggtggaacctggcggcagcgcaaaagatg

SEQ ID NO: 193400 - DNA, 103 bp, Artificial Sequence
  Synthetic Polynucleotide
taatacgactcactatagggatctgaacaggctccttctggaccacctccaacagaggagaggaggtatgccagaaggaaacctggcggcagcgcaaaagatg

SEQ ID NO: 193401 - DNA, 103 bp, Artificial Sequence
  Synthetic Polynucleotide
taatacgactcactatagggagacagctctatctgaacaggctccttctgaacagaggagacagaagatgcctgttcagaacctggcggcagcgcaaaagatg

SEQ ID NO: 193402 - DNA, 103 bp, Artificial Sequence
  Synthetic Polynucleotide
taatacgactcactatagggccatgggaggagacagctctatctgaacagaacagaggagactgttcatgtagagctgtaacctggcggcagcgcaaaagatg

SEQ ID NO: 193403 - DNA, 103 bp, Artificial Sequence
  Synthetic Polynucleotide
taatacgactcactatagggtggaccacctccatgggaggagacagctctaacagaggagaagagctatgtcctcccataacctggcggcagcgcaaaagatg

SEQ ID NO: 193404 - DNA, 103 bp, Artificial Sequence
  Synthetic Polynucleotide
taatacgactcactatagggaggttccttctggaccacctccatgggaggaacagaggagacctcccatggaggtggtcaacctggcggcagcgcaaaagatg

SEQ ID NO: 193405 - DNA, 103 bp, Artificial Sequence
  Synthetic Polynucleotide
taatacgactcactatagggctatcttaacaggttccttctggaccacctaacagaggagaaggtggatgagaaggaacaacctggcggcagcgcaaaagatg

SEQ ID NO: 193406 - DNA, 103 bp, Artificial Sequence
  Synthetic Polynucleotide
taatacgactcactatagggggagacagctctatcttaacaggttccttcaacagaggagagaaggaatgtgttaagataacctggcggcagcgcaaaagatg

SEQ ID NO: 193407 - DNA, 103 bp, Artificial Sequence
  Synthetic Polynucleotide
taatacgactcactatagggctctatgggaggagacagctctatcttaacaacagaggagagttaagatggagctgtctaacctggcggcagcgcaaaagatg

SEQ ID NO: 193408 - DNA, 103 bp, Artificial Sequence
  Synthetic Polynucleotide
taatacgactcactatagggagttgttatccccaaccggcatcagttctgaacagaggagacagaacatgtgccggttgaacctggcggcagcgcaaaagatg

SEQ ID NO: 193409 - DNA, 103 bp, Artificial Sequence
  Synthetic Polynucleotide
taatacgactcactatagggtctggaccacctctatgggaggagacagctaacagaggagaagctgtatgctcccatagaacctggcggcagcgcaaaagatg

SEQ ID NO: 193410 - DNA, 103 bp, Artificial Sequence
  Synthetic Polynucleotide
taatacgactcactatagggacaggctccttctggaccacctctatgggaaacagaggagatcccatatgggtggtccaaacctggcggcagcgcaaaagatg

SEQ ID NO: 193411 - DNA, 103 bp, Artificial Sequence
  Synthetic Polynucleotide
taatacgactcactatagggctccatctgaacaggctccttctggaccacaacagaggagagtggtcatgaaggagcctaacctggcggcagcgcaaaagatg

SEQ ID NO: 193412 - DNA, 103 bp, Artificial Sequence
  Synthetic Polynucleotide
taatacgactcactataggggaggagacaactccatctgaacaggctcctaacagaggagaaggagcatgttcagatggaacctggcggcagcgcaaaagatg

SEQ ID NO: 193413 - DNA, 103 bp, Artificial Sequence
  Synthetic Polynucleotide
taatacgactcactatagggacccccatgggaggagacaactccatctgaaacagaggagatcagatatggttgtctccaacctggcggcagcgcaaaagatg

SEQ ID NO: 193414 - DNA, 103 bp, Artificial Sequence
  Synthetic Polynucleotide
taatacgactcactatagggcttctgaaccacccccatgggaggagacaaaacagaggagattgtctatgcccatggggaacctggcggcagcgcaaaagatg

SEQ ID NO: 193415 - DNA, 103 bp, Artificial Sequence
  Synthetic Polynucleotide
taatacgactcactataggggagcaggctccttctgaaccacccccatggaacagaggagaccatggatgtggttcagaaacctggcggcagcgcaaaagatg

SEQ ID NO: 193416 - DNA, 103 bp, Artificial Sequence
  Synthetic Polynucleotide
taatacgactcactatagggggctccctctgagcaggctccttctgaaccaacagaggagaggttcaatgggagcctgcaacctggcggcagcgcaaaagatg

SEQ ID NO: 193417 - DNA, 103 bp, Artificial Sequence
  Synthetic Polynucleotide
taatacgactcactataggggggaggaggtggctccctctgagcaggctcaacagaggagagagcctatgcagagggagaacctggcggcagcgcaaaagatg

SEQ ID NO: 193418 - DNA, 103 bp, Artificial Sequence
  Synthetic Polynucleotide
taatacgactcactataggggaggctctctgggaggaggtggctccctctaacagaggagaagagggatgcacctcctcaacctggcggcagcgcaaaagatg

SEQ ID NO: 193419 - DNA, 103 bp, Artificial Sequence
  Synthetic Polynucleotide
taatacgactcactatagggctatctgaaaagttgttatccccaaccggcaacagaggagagccggtatgggataacaaaacctggcggcagcgcaaaagatg

SEQ ID NO: 193420 - DNA, 103 bp, Artificial Sequence
  Synthetic Polynucleotide
taatacgactcactatagggatgtgaaggggaggctctctgggaggaggtaacagaggagaacctccatgcagagagccaacctggcggcagcgcaaaagatg

SEQ ID NO: 193421 - DNA, 103 bp, Artificial Sequence
  Synthetic Polynucleotide
taatacgactcactatagggaattggctccatgtgaaggggaggctctctaacagaggagaagagagatgccccttcacaacctggcggcagcgcaaaagatg

SEQ ID NO: 193422 - DNA, 103 bp, Artificial Sequence
  Synthetic Polynucleotide
taatacgactcactataggggctttttggaaattggctccatgtgaagggaacagaggagacccttcatgtggagccaaaacctggcggcagcgcaaaagatg

SEQ ID NO: 193423 - DNA, 103 bp, Artificial Sequence
  Synthetic Polynucleotide
taatacgactcactatagggcggagaggaggctttttggaaattggctccaacagaggagaggagccatgttccaaaaaaacctggcggcagcgcaaaagatg

SEQ ID NO: 193424 - DNA, 103 bp, Artificial Sequence
  Synthetic Polynucleotide
taatacgactcactatagggtttatcttttcggagaggaggctttttggaaacagaggagatccaaaatgcctcctctcaacctggcggcagcgcaaaagatg

SEQ ID NO: 193425 - DNA, 103 bp, Artificial Sequence
  Synthetic Polynucleotide
taatacgactcactatagggacttttcctttttatcttttcggagaggagaacagaggagactcctcatggaaaagataaacctggcggcagcgcaaaagatg

SEQ ID NO: 193426 - DNA, 103 bp, Artificial Sequence
  Synthetic Polynucleotide
taatacgactcactatagggtgcatgttagacttttcctttttatcttttaacagaggagaaaaagaatgaaaggaaaaaacctggcggcagcgcaaaagatg

SEQ ID NO: 193427 - DNA, 103 bp, Artificial Sequence
  Synthetic Polynucleotide
taatacgactcactatagggcctttcactctgcatgttagacttttccttaacagaggagaaaggaaatgtctaacatgaacctggcggcagcgcaaaagatg

SEQ ID NO: 193428 - DNA, 103 bp, Artificial Sequence
  Synthetic Polynucleotide
taatacgactcactatagggccttccgtgccctttcactctgcatgttagaacagaggagactaacaatgagagtgaaaaacctggcggcagcgcaaaagatg

SEQ ID NO: 193429 - DNA, 103 bp, Artificial Sequence
  Synthetic Polynucleotide
taatacgactcactatagggaggacttgctccttccgtgccctttcactcaacagaggagagagtgaatgggcacggaaaacctggcggcagcgcaaaagatg

SEQ ID NO: 193430 - DNA, 103 bp, Artificial Sequence
  Synthetic Polynucleotide
taatacgactcactatagggtccttcttcactatctgaaaagttgttatcaacagaggagagataacatgttttcagataacctggcggcagcgcaaaagatg

SEQ ID NO: 193431 - DNA, 103 bp, Artificial Sequence
  Synthetic Polynucleotide
taatacgactcactatagggaacttcaataaggacttgctccttccgtgcaacagaggagagcacggatggagcaagtcaacctggcggcagcgcaaaagatg

SEQ ID NO: 193432 - DNA, 103 bp, Artificial Sequence
  Synthetic Polynucleotide
taatacgactcactataggggcactaagccaacttcaataaggacttgctaacagaggagaagcaagatgttattgaagaacctggcggcagcgcaaaagatg

SEQ ID NO: 193433 - DNA, 103 bp, Artificial Sequence
  Synthetic Polynucleotide
taatacgactcactatagggtctttaacaggcactaagccaacttcaataaacagaggagatattgaatgtggcttagtaacctggcggcagcgcaaaagatg

SEQ ID NO: 193434 - DNA, 103 bp, Artificial Sequence
  Synthetic Polynucleotide
taatacgactcactatagggaagccagctatctttaacaggcactaagccaacagaggagaggcttaatgcctgttaaaaacctggcggcagcgcaaaagatg

SEQ ID NO: 193435 - DNA, 103 bp, Artificial Sequence
  Synthetic Polynucleotide
taatacgactcactatagggtttcctttagaagccagctatctttaacagaacagaggagactgttaatgatagctggcaacctggcggcagcgcaaaagatg

SEQ ID NO: 193436 - DNA, 103 bp, Artificial Sequence
  Synthetic Polynucleotide
taatacgactcactataggggtgcttacactttcctttagaagccagctaaacagaggagatagctgatgtctaaaggaaacctggcggcagcgcaaaagatg

SEQ ID NO: 193437 - DNA, 103 bp, Artificial Sequence
  Synthetic Polynucleotide
taatacgactcactataggggagatcctctgtgcttacactttcctttagaacagaggagactaaagatgagtgtaagcaacctggcggcagcgcaaaagatg

SEQ ID NO: 193438 - DNA, 103 bp, Artificial Sequence
  Synthetic Polynucleotide
taatacgactcactatagggatggtggtgagagatcctctgtgcttacacaacagaggagagtgtaaatgcagaggatcaacctggcggcagcgcaaaagatg

SEQ ID NO: 193439 - DNA, 103 bp, Artificial Sequence
  Synthetic Polynucleotide
taatacgactcactatagggagtggtggtgatggtggtgagagatcctctaacagaggagaagaggaatgctcaccaccaacctggcggcagcgcaaaagatg

SEQ ID NO: 193440 - DNA, 103 bp, Artificial Sequence
  Synthetic Polynucleotide
taatacgactcactatagggttcctttggcagtggtggtgatggtggtgaaacagaggagatcaccaatgtcaccaccaaacctggcggcagcgcaaaagatg

SEQ ID NO: 193441 - DNA, 103 bp, Artificial Sequence
  Synthetic Polynucleotide
taatacgactcactatagggcaagtccttctccttcttcactatctgaaaaacagaggagatttcagatggtgaagaagaacctggcggcagcgcaaaagatg

SEQ ID NO: 193442 - DNA, 103 bp, Artificial Sequence
  Synthetic Polynucleotide
taatacgactcactatagggctcttaaattttcctttggcagtggtggtgaacagaggagacaccacatgtgccaaaggaacctggcggcagcgcaaaagatg

SEQ ID NO: 193443 - DNA, 103 bp, Artificial Sequence
  Synthetic Polynucleotide
taatacgactcactataggggatgcctcttctcttaaattttcctttggcaacagaggagagccaaaatgaaatttaagaacctggcggcagcgcaaaagatg

SEQ ID NO: 193444 - DNA, 103 bp, Artificial Sequence
  Synthetic Polynucleotide
taatacgactcactatagggttggtctcctgatgcctcttctcttaaattaacagaggagaaatttaatggaagaggcaaacctggcggcagcgcaaaagatg

SEQ ID NO: 193445 - DNA, 103 bp, Artificial Sequence
  Synthetic Polynucleotide
taatacgactcactatagggtgagtaatttttggtctcctgatgcctcttaacagaggagaaagaggatgcaggagaccaacctggcggcagcgcaaaagatg

SEQ ID NO: 193446 - DNA, 103 bp, Artificial Sequence
  Synthetic Polynucleotide
taatacgactcactatagggtcacctgtgttgagtaatttttggtctcctaacagaggagaaggagaatgaaaattactaacctggcggcagcgcaaaagatg

SEQ ID NO: 193447 - DNA, 103 bp, Artificial Sequence
  Synthetic Polynucleotide
taatacgactcactatagggtttatttccttcacctgtgttgagtaatttaacagaggagaaaattaatgaacacaggtaacctggcggcagcgcaaaagatg

SEQ ID NO: 193448 - DNA, 103 bp, Artificial Sequence
  Synthetic Polynucleotide
taatacgactcactataggggaggggcttctttatttccttcacctgtgtaacagaggagaacacagatgaaggaaataaacctggcggcagcgcaaaagatg

SEQ ID NO: 193449 - DNA, 103 bp, Artificial Sequence
  Synthetic Polynucleotide
taatacgactcactatagggactttctgaagaggggcttctttatttcctaacagaggagaaggaaaatgagaagccccaacctggcggcagcgcaaaagatg

SEQ ID NO: 193450 - DNA, 103 bp, Artificial Sequence
  Synthetic Polynucleotide
taatacgactcactatagggttctgctcctactttctgaagaggggcttcaacagaggagagaagccatgcttcagaaaaacctggcggcagcgcaaaagatg

SEQ ID NO: 193451 - DNA, 103 bp, Artificial Sequence
  Synthetic Polynucleotide
taatacgactcactatagggcatctgcctcttctgctcctactttctgaaaacagaggagattcagaatgtaggagcagaacctggcggcagcgcaaaagatg

SEQ ID NO: 193452 - DNA, 103 bp, Artificial Sequence
  Synthetic Polynucleotide
taatacgactcactataggggcagactcttcaagtccttctccttcttcaaacagaggagatgaagaatgagaaggactaacctggcggcagcgcaaaagatg

SEQ ID NO: 193453 - DNA, 103 bp, Artificial Sequence
  Synthetic Polynucleotide
taatacgactcactatagggggtaggctctcatctgcctcttctgctcctaacagaggagaaggagcatgagaggcagaaacctggcggcagcgcaaaagatg

SEQ ID NO: 193454 - DNA, 103 bp, Artificial Sequence
  Synthetic Polynucleotide
taatacgactcactatagggagcaagaccaggtaggctctcatctgcctcaacagaggagagaggcaatggagagcctaaacctggcggcagcgcaaaagatg

SEQ ID NO: 193455 - DNA, 103 bp, Artificial Sequence
  Synthetic Polynucleotide
taatacgactcactatagggtgatattagcagcaagaccaggtaggctctaacagaggagaagagccatgctggtcttgaacctggcggcagcgcaaaagatg

SEQ ID NO: 193456 - DNA, 103 bp, Artificial Sequence
  Synthetic Polynucleotide
taatacgactcactataggggtagattcgttgatattagcagcaagaccaaacagaggagatggtctatgtgctaatataacctggcggcagcgcaaaagatg

SEQ ID NO: 193457 - DNA, 103 bp, Artificial Sequence
  Synthetic Polynucleotide
taatacgactcactatagggtgaaatatgggtagattcgttgatattagcaacagaggagagctaatatgaacgaatctaacctggcggcagcgcaaaagatg

SEQ ID NO: 193458 - DNA, 103 bp, Artificial Sequence
  Synthetic Polynucleotide
taatacgactcactataggggtccagaggatgaaatatgggtagattcgtaacagaggagaacgaatatgcccatatttaacctggcggcagcgcaaaagatg

SEQ ID NO: 193459 - DNA, 103 bp, Artificial Sequence
  Synthetic Polynucleotide
taatacgactcactatagggttcaagttttgtccagaggatgaaatatggaacagaggagaccatatatgatcctctggaacctggcggcagcgcaaaagatg

SEQ ID NO: 193460 - DNA, 103 bp, Artificial Sequence
  Synthetic Polynucleotide
taatacgactcactatagggctctggcgtattcaagttttgtccagaggaaacagaggagatcctctatgcaaaacttgaacctggcggcagcgcaaaagatg

SEQ ID NO: 193461 - DNA, 103 bp, Artificial Sequence
  Synthetic Polynucleotide
taatacgactcactatagggaagtttcaccctctggcgtattcaagttttaacagaggagaaaaactatgatacgccagaacctggcggcagcgcaaaagatg

SEQ ID NO: 193462 - DNA, 103 bp, Artificial Sequence
  Synthetic Polynucleotide
taatacgactcactatagggttaccatttaaagtttcaccctctggcgtaaacagaggagatacgccatggggtgaaacaacctggcggcagcgcaaaagatg

SEQ ID NO: 193463 - DNA, 103 bp, Artificial Sequence
  Synthetic Polynucleotide
taatacgactcactatagggttttatatcagcagactcttcaagtccttcaacagaggagagaaggaatggaagagtctaacctggcggcagcgcaaaagatg

SEQ ID NO: 193464 - DNA, 103 bp, Artificial Sequence
  Synthetic Polynucleotide
taatacgactcactatagggagtctgatgtttaccatttaaagtttcaccaacagaggagaggtgaaatgttaaatggtaacctggcggcagcgcaaaagatg

SEQ ID NO: 193465 - DNA, 103 bp, Artificial Sequence
  Synthetic Polynucleotide
taatacgactcactatagggctatactgtcagtctgatgtttaccatttaaacagaggagataaatgatgaacatcagaaacctggcggcagcgcaaaagatg

SEQ ID NO: 193466 - DNA, 103 bp, Artificial Sequence
  Synthetic Polynucleotide
taatacgactcactatagggatttcacaaactatactgtcagtctgatgtaacagaggagaacatcaatgtgacagtataacctggcggcagcgcaaaagatg

SEQ ID NO: 193467 - DNA, 103 bp, Artificial Sequence
  Synthetic Polynucleotide
taatacgactcactataggggtccattttcatttcacaaactatactgtcaacagaggagagacagtatggtttgtgaaaacctggcggcagcgcaaaagatg

SEQ ID NO: 193468 - DNA, 103 bp, Artificial Sequence
  Synthetic Polynucleotide
taatacgactcactatagggtctgatcagtgtccattttcatttcacaaaaacagaggagatttgtgatgtgaaaatggaacctggcggcagcgcaaaagatg

SEQ ID NO: 193469 - DNA, 103 bp, Artificial Sequence
  Synthetic Polynucleotide
taatacgactcactatagggtctcttgtgttctgatcagtgtccattttcaacagaggagagaaaatatgcactgatcaaacctggcggcagcgcaaaagatg

SEQ ID NO: 193470 - DNA, 103 bp, Artificial Sequence
  Synthetic Polynucleotide
taatacgactcactatagggagtgagattctctcttgtgttctgatcagtaacagaggagaactgatatgaacacaagaaacctggcggcagcgcaaaagatg

SEQ ID NO: 193471 - DNA, 103 bp, Artificial Sequence
  Synthetic Polynucleotide
taatacgactcactatagggaatttataccagtgagattctctcttgtgtaacagaggagaacacaaatgagaatctcaaacctggcggcagcgcaaaagatg

SEQ ID NO: 193472 - DNA, 103 bp, Artificial Sequence
  Synthetic Polynucleotide
taatacgactcactatagggtcaactgttgaatttataccagtgagattcaacagaggagagaatctatgtggtataaaaacctggcggcagcgcaaaagatg

SEQ ID NO: 193473 - DNA, 103 bp, Artificial Sequence
  Synthetic Polynucleotide
taatacgactcactatagggaactggttcttcaactgttgaatttataccaacagaggagaggtataatgtcaacagttaacctggcggcagcgcaaaagatg

SEQ ID NO: 193474 - DNA, 103 bp, Artificial Sequence
  Synthetic Polynucleotide
taatacgactcactataggggaggttcaccttttatatcagcagactcttaacagaggagaaagagtatgctgatataaaacctggcggcagcgcaaaagatg

SEQ ID NO: 193475 - DNA, 103 bp, Artificial Sequence
  Synthetic Polynucleotide
taatacgactcactataggggcattggtgaaactggttcttcaactgttgaacagaggagacaacagatgaagaaccagaacctggcggcagcgcaaaagatg

SEQ ID NO: 193476 - DNA, 103 bp, Artificial Sequence
  Synthetic Polynucleotide
taatacgactcactataggggaagggggaagcattggtgaaactggttctaacagaggagaagaaccatgttcaccaataacctggcggcagcgcaaaagatg

SEQ ID NO: 193477 - DNA, 103 bp, Artificial Sequence
  Synthetic Polynucleotide
taatacgactcactatagggttctactgctgaagggggaagcattggtgaaacagaggagatcaccaatgcttccccctaacctggcggcagcgcaaaagatg

SEQ ID NO: 193478 - DNA, 103 bp, Artificial Sequence
  Synthetic Polynucleotide
taatacgactcactatagggcttcacgttcttctactgctgaagggggaaaacagaggagattccccatgcagcagtagaacctggcggcagcgcaaaagatg

SEQ ID NO: 193479 - DNA, 103 bp, Artificial Sequence
  Synthetic Polynucleotide
taatacgactcactatagggttggacactgcttcacgttcttctactgctaacagaggagaagcagtatgagaacgtgaaacctggcggcagcgcaaaagatg

SEQ ID NO: 193480 - DNA, 103 bp, Artificial Sequence
  Synthetic Polynucleotide
taatacgactcactatagggcagtgcagttttggacactgcttcacgttcaacagaggagagaacgtatggcagtgtccaacctggcggcagcgcaaaagatg

SEQ ID NO: 193481 - DNA, 103 bp, Artificial Sequence
  Synthetic Polynucleotide
taatacgactcactataggggaggtgatgccagtgcagttttggacactgaacagaggagacagtgtatgaaactgcacaacctggcggcagcgcaaaagatg

SEQ ID NO: 193482 - DNA, 103 bp, Artificial Sequence
  Synthetic Polynucleotide
taatacgactcactatagggattgtagcaggaggtgatgccagtgcagttaacagaggagaaactgcatgggcatcaccaacctggcggcagcgcaaaagatg

SEQ ID NO: 193483 - DNA, 103 bp, Artificial Sequence
  Synthetic Polynucleotide
taatacgactcactatagggatttgctgccattgtagcaggaggtgatgcaacagaggagagcatcaatgcctgctacaaacctggcggcagcgcaaaagatg

SEQ ID NO: 193484 - DNA, 103 bp, Artificial Sequence
  Synthetic Polynucleotide
taatacgactcactatagggcctgagactcatttgctgccattgtagcagaacagaggagactgctaatgtggcagcaaaacctggcggcagcgcaaaagatg

SEQ ID NO: 193485 - DNA, 103 bp, Artificial Sequence
  Synthetic Polynucleotide
taatacgactcactataggggtaaacagccctcctcctccagaagactgcaacagaggagagcagtcatgtggaggaggaacctggcggcagcgcaaaagatg

SEQ ID NO: 193486 - DNA, 103 bp, Artificial Sequence
  Synthetic Polynucleotide
taatacgactcactatagggtccagtccatgaggttcaccttttatatcaaacagaggagatgatatatgaggtgaaccaacctggcggcagcgcaaaagatg

SEQ ID NO: 193487 - DNA, 103 bp, Artificial Sequence
  Synthetic Polynucleotide
taatacgactcactatagggtcatcaatttcctgagactcatttgctgccaacagaggagaggcagcatgtgagtctcaaacctggcggcagcgcaaaagatg

SEQ ID NO: 193488 - DNA, 103 bp, Artificial Sequence
  Synthetic Polynucleotide
taatacgactcactataggggccttcatcttcatcaatttcctgagactcaacagaggagagagtctatggaaattgataacctggcggcagcgcaaaagatg

SEQ ID NO: 193489 - DNA, 103 bp, Artificial Sequence
  Synthetic Polynucleotide
taatacgactcactatagggggctgtggatgccttcatcttcatcaatttaacagaggagaaaattgatgaagatgaagaacctggcggcagcgcaaaagatg

SEQ ID NO: 193490 - DNA, 103 bp, Artificial Sequence
  Synthetic Polynucleotide
taatacgactcactatagggcttccttcatggctgtggatgccttcatctaacagaggagaagatgaatgcatccacagaacctggcggcagcgcaaaagatg

SEQ ID NO: 193491 - DNA, 103 bp, Artificial Sequence
  Synthetic Polynucleotide
taatacgactcactatagggacttaggtcacttccttcatggctgtggataacagaggagaatccacatgcatgaaggaaacctggcggcagcgcaaaagatg

SEQ ID NO: 193492 - DNA, 103 bp, Artificial Sequence
  Synthetic Polynucleotide
taatacgactcactatagggacatgttgtcacttaggtcacttccttcataacagaggagaatgaagatggtgacctaaaacctggcggcagcgcaaaagatg

SEQ ID NO: 193493 - DNA, 103 bp, Artificial Sequence
  Synthetic Polynucleotide
taatacgactcactatagggctaccctctgacatgttgtcacttaggtcaaacagaggagatgacctatgtgacaacataacctggcggcagcgcaaaagatg

SEQ ID NO: 193494 - DNA, 103 bp, Artificial Sequence
  Synthetic Polynucleotide
taatacgactcactatagggagaatcatcactaccctctgacatgttgtcaacagaggagagacaacatgtcagagggtaacctggcggcagcgcaaaagatg

SEQ ID NO: 193495 - DNA, 103 bp, Artificial Sequence
  Synthetic Polynucleotide
taatacgactcactatagggcatgcaatccagaatcatcactaccctctgaacagaggagacagaggatggtgatgattaacctggcggcagcgcaaaagatg

SEQ ID NO: 193496 - DNA, 103 bp, Artificial Sequence
  Synthetic Polynucleotide
taatacgactcactatagggggccgagccccatgcaatccagaatcatcaaacagaggagatgatgaatgtggattgcaaacctggcggcagcgcaaaagatg

SEQ ID NO: 193497 - DNA, 103 bp, Artificial Sequence
  Synthetic Polynucleotide
taatacgactcactatagggttccatgttttccagtccatgaggttcaccaacagaggagaggtgaaatgcatggactgaacctggcggcagcgcaaaagatg

SEQ ID NO: 193498 - DNA, 103 bp, Artificial Sequence
  Synthetic Polynucleotide
taatacgactcactatagggttgtggaactggccgagccccatgcaatccaacagaggagaggattgatgggggctcggaacctggcggcagcgcaaaagatg

SEQ ID NO: 193499 - DNA, 103 bp, Artificial Sequence
  Synthetic Polynucleotide
taatacgactcactatagggtgctagattcttgtggaactggccgagcccaacagaggagagggctcatgcagttccacaacctggcggcagcgcaaaagatg

SEQ ID NO: 193500 - DNA, 103 bp, Artificial Sequence
  Synthetic Polynucleotide
taatacgactcactataggggcattttttctgctagattcttgtggaactaacagaggagaagttccatgagaatctagaacctggcggcagcgcaaaagatg

SEQ ID NO: 193501 - DNA, 103 bp, Artificial Sequence
  Synthetic Polynucleotide
taatacgactcactatagggggcttcctttgcattttttctgctagattcaacagaggagagaatctatgagaaaaaataacctggcggcagcgcaaaagatg

SEQ ID NO: 193502 - DNA, 103 bp, Artificial Sequence
  Synthetic Polynucleotide
taatacgactcactatagggtgactgccaaggcttcctttgcattttttcaacagaggagagaaaaaatgcaaaggaagaacctggcggcagcgcaaaagatg

SEQ ID NO: 193503 - DNA, 103 bp, Artificial Sequence
  Synthetic Polynucleotide
taatacgactcactatagggttagccgctttgactgccaaggcttcctttaacagaggagaaaaggaatgcttggcagtaacctggcggcagcgcaaaagatg

SEQ ID NO: 193504 - DNA, 103 bp, Artificial Sequence
  Synthetic Polynucleotide
taatacgactcactatagggaaaatctcccttagccgctttgactgccaaaacagaggagattggcaatgaaagcggctaacctggcggcagcgcaaaagatg

SEQ ID NO: 193505 - DNA, 103 bp, Artificial Sequence
  Synthetic Polynucleotide
taatacgactcactatagggagatacaaacaaaatctcccttagccgcttaacagaggagaaagcggatgagggagattaacctggcggcagcgcaaaagatg

SEQ ID NO: 193506 - DNA, 103 bp, Artificial Sequence
  Synthetic Polynucleotide
taatacgactcactatagggcgatcacagaagatacaaacaaaatctcccaacagaggagagggagaatgtgtttgtataacctggcggcagcgcaaaagatg

SEQ ID NO: 193507 - DNA, 103 bp, Artificial Sequence
  Synthetic Polynucleotide
taatacgactcactatagggtctgaaagaacgatcacagaagatacaaacaacagaggagagtttgtatgttctgtgataacctggcggcagcgcaaaagatg

SEQ ID NO: 193508 - DNA, 103 bp, Artificial Sequence
  Synthetic Polynucleotide
taatacgactcactatagggaacttctcagttccatgttttccagtccataacagaggagaatggacatgaaaacatggaacctggcggcagcgcaaaagatg

SEQ ID NO: 193509 - DNA, 103 bp, Artificial Sequence
  Synthetic Polynucleotide
taatacgactcactatagggcttttccctttctgaaagaacgatcacagaaacagaggagatctgtgatggttctttcaaacctggcggcagcgcaaaagatg

SEQ ID NO: 193510 - DNA, 103 bp, Artificial Sequence
  Synthetic Polynucleotide
taatacgactcactatagggttgctgtaatcttttccctttctgaaagaaaacagaggagattctttatgaaagggaaaaacctggcggcagcgcaaaagatg

SEQ ID NO: 193511 - DNA, 103 bp, Artificial Sequence
  Synthetic Polynucleotide
taatacgactcactatagggattgaggtgtttgctgtaatcttttcccttaacagaggagaaagggaatggattacagcaacctggcggcagcgcaaaagatg

SEQ ID NO: 193512 - DNA, 103 bp, Artificial Sequence
  Synthetic Polynucleotide
taatacgactcactatagggccaaatggcgattgaggtgtttgctgtaataacagaggagaattacaatgaacacctcaaacctggcggcagcgcaaaagatg

SEQ ID NO: 193513 - DNA, 103 bp, Artificial Sequence
  Synthetic Polynucleotide
taatacgactcactatagggtacacattaaccaaatggcgattgaggtgtaacagaggagaacacctatgtcgccatttaacctggcggcagcgcaaaagatg

SEQ ID NO: 193514 - DNA, 103 bp, Artificial Sequence
  Synthetic Polynucleotide
taatacgactcactatagggttcaagatagtacacattaaccaaatggcgaacagaggagacgccatatggttaatgtgaacctggcggcagcgcaaaagatg

SEQ ID NO: 193515 - DNA, 103 bp, Artificial Sequence
  Synthetic Polynucleotide
taatacgactcactataggggagctgcttcttcaagatagtacacattaaaacagaggagattaatgatgactatcttgaacctggcggcagcgcaaaagatg

SEQ ID NO: 193516 - DNA, 103 bp, Artificial Sequence
  Synthetic Polynucleotide
taatacgactcactatagggtcctgcccttgagctgcttcttcaagatagaacagaggagactatctatgagaagcagcaacctggcggcagcgcaaaagatg

SEQ ID NO: 193517 - DNA, 103 bp, Artificial Sequence
  Synthetic Polynucleotide
taatacgactcactatagggctgagttccaaacttctcagttccatgtttaacagaggagaaaacatatgactgagaagaacctggcggcagcgcaaaagatg

SEQ ID NO: 193518 - DNA, 103 bp, Artificial Sequence
  Synthetic Polynucleotide
taatacgactcactatagggttctacgacgctgagttccaaacttctcagaacagaggagactgagaatgttggaactcaacctggcggcagcgcaaaagatg

SEQ ID NO: 193519 - DNA, 103 bp, Artificial Sequence
  Synthetic Polynucleotide
taatacgactcactatagggcaggctgaggttctacgacgctgagttccaaacagaggagatggaacatggcgtcgtagaacctggcggcagcgcaaaagatg

SEQ ID NO: 193520 - DNA, 103 bp, Artificial Sequence
  Synthetic Polynucleotide
taatacgactcactataggggcctcaaatacaggctgaggttctacgacgaacagaggagacgtcgtatgacctcagccaacctggcggcagcgcaaaagatg

SEQ ID NO: 193521 - DNA, 103 bp, Artificial Sequence
  Synthetic Polynucleotide
taatacgactcactatagggagcacctgatgcctcaaatacaggctgaggaacagaggagacctcagatggtatttgagaacctggcggcagcgcaaaagatg

SEQ ID NO: 193522 - DNA, 103 bp, Artificial Sequence
  Synthetic Polynucleotide
taatacgactcactatagggaaatatctggagcacctgatgcctcaaataaacagaggagatatttgatgcatcaggtgaacctggcggcagcgcaaaagatg

SEQ ID NO: 193523 - DNA, 103 bp, Artificial Sequence
  Synthetic Polynucleotide
taatacgactcactatagggtttgaactgtaaatatctggagcacctgataacagaggagaatcaggatgtccagatataacctggcggcagcgcaaaagatg

SEQ ID NO: 193524 - DNA, 103 bp, Artificial Sequence
  Synthetic Polynucleotide
taatacgactcactataggggccactgctggtaaacagccctcctcctccaacagaggagaggaggaatggggctgtttaacctggcggcagcgcaaaagatg

SEQ ID NO: 193525 - DNA, 103 bp, Artificial Sequence
  Synthetic Polynucleotide
taatacgactcactatagggaagatctttatttgaactgtaaatatctggaacagaggagaccagatatgtacagttcaaacctggcggcagcgcaaaagatg

SEQ ID NO: 193526 - DNA, 103 bp, Artificial Sequence
  Synthetic Polynucleotide
taatacgactcactatagggtttcagggggaagatctttatttgaactgtaacagaggagaacagttatgataaagatcaacctggcggcagcgcaaaagatg

SEQ ID NO: 193527 - DNA, 103 bp, Artificial Sequence
  Synthetic Polynucleotide
taatacgactcactataggggctccaggtgtttcagggggaagatctttaaacagaggagataaagaatgtccccctgaaacctggcggcagcgcaaaagatg

SEQ ID NO: 193528 - DNA, 103 bp, Artificial Sequence
  Synthetic Polynucleotide
taatacgactcactatagggtttgtcctccgctccaggtgtttcagggggaacagaggagaccccctatgacacctggaaacctggcggcagcgcaaaagatg

SEQ ID NO: 193529 - DNA, 103 bp, Artificial Sequence
  Synthetic Polynucleotide
taatacgactcactatagggagctcttgcctttgtcctccgctccaggtgaacagaggagacacctgatgcggaggacaaacctggcggcagcgcaaaagatg

SEQ ID NO: 193530 - DNA, 103 bp, Artificial Sequence
  Synthetic Polynucleotide
taatacgactcactatagggttggtcttcgagctcttgcctttgtcctccaacagaggagaggaggaatgaggcaagagaacctggcggcagcgcaaaagatg

SEQ ID NO: 193531 - DNA, 103 bp, Artificial Sequence
  Synthetic Polynucleotide
taatacgactcactataggggcgaaagggtttggtcttcgagctcttgccaacagaggagaggcaagatgtcgaagaccaacctggcggcagcgcaaaagatg

SEQ ID NO: 193532 - DNA, 103 bp, Artificial Sequence
  Synthetic Polynucleotide
taatacgactcactatagggatggcttacagcgaaagggtttggtcttcgaacagaggagacgaagaatgaaccctttcaacctggcggcagcgcaaaagatg

SEQ ID NO: 193533 - DNA, 103 bp, Artificial Sequence
  Synthetic Polynucleotide
taatacgactcactatagggtcatattggcatggcttacagcgaaagggtaacagaggagaacccttatgctgtaagccaacctggcggcagcgcaaaagatg

SEQ ID NO: 193534 - DNA, 103 bp, Artificial Sequence
  Synthetic Polynucleotide
taatacgactcactatagggagattctgcttcatattggcatggcttacaaacagaggagatgtaagatgtgccaatataacctggcggcagcgcaaaagatg

SEQ ID NO: 193535 - DNA, 103 bp, Artificial Sequence
  Synthetic Polynucleotide
taatacgactcactatagggttccaatgttgccactgctggtaaacagccaacagaggagaggctgtatgccagcagtgaacctggcggcagcgcaaaagatg

SEQ ID NO: 193536 - DNA, 103 bp, Artificial Sequence
  Synthetic Polynucleotide
taatacgactcactatagggactgttcttcagattctgcttcatattggcaacagaggagagccaatatgaagcagaataacctggcggcagcgcaaaagatg

SEQ ID NO: 193537 - DNA, 103 bp, Artificial Sequence
  Synthetic Polynucleotide
taatacgactcactatagggtgatgcacaaactgttcttcagattctgctaacagaggagaagcagaatgtgaagaacaaacctggcggcagcgcaaaagatg

SEQ ID NO: 193538 - DNA, 103 bp, Artificial Sequence
  Synthetic Polynucleotide
taatacgactcactatagggaactctgatgtgatgcacaaactgttcttcaacagaggagagaagaaatgtttgtgcataacctggcggcagcgcaaaagatg

SEQ ID NO: 193539 - DNA, 103 bp, Artificial Sequence
  Synthetic Polynucleotide
taatacgactcactatagggtagcactgtgaactctgatgtgatgcacaaaacagaggagattgtgcatgacatcagagaacctggcggcagcgcaaaagatg

SEQ ID NO: 193540 - DNA, 103 bp, Artificial Sequence
  Synthetic Polynucleotide
taatacgactcactatagggaaaaatttcttagcactgtgaactctgatgaacagaggagacatcagatgtcacagtgcaacctggcggcagcgcaaaagatg

SEQ ID NO: 193541 - DNA, 103 bp, Artificial Sequence
  Synthetic Polynucleotide
taatacgactcactatagggctcttccacaaaaaatttcttagcactgtgaacagaggagacacagtatgaagaaatttaacctggcggcagcgcaaaagatg

SEQ ID NO: 193542 - DNA, 103 bp, Artificial Sequence
  Synthetic Polynucleotide
taatacgactcactatagggtctctgcactctcttccacaaaaaatttctaacagaggagaagaaatatgttgtggaagaacctggcggcagcgcaaaagatg

SEQ ID NO: 193543 - DNA, 103 bp, Artificial Sequence
  Synthetic Polynucleotide
taatacgactcactatagggtttgcctgcttctctgcactctcttccacaaacagaggagatgtggaatggagtgcagaaacctggcggcagcgcaaaagatg

SEQ ID NO: 193544 - DNA, 103 bp, Artificial Sequence
  Synthetic Polynucleotide
taatacgactcactatagggttccctggcttttgcctgcttctctgcactaacagaggagaagtgcaatgaagcaggcaaacctggcggcagcgcaaaagatg

SEQ ID NO: 193545 - DNA, 103 bp, Artificial Sequence
  Synthetic Polynucleotide
taatacgactcactatagggaagagccagattccctggcttttgcctgctaacagaggagaagcaggatgaagccagggaacctggcggcagcgcaaaagatg

SEQ ID NO: 193546 - DNA, 103 bp, Artificial Sequence
  Synthetic Polynucleotide
taatacgactcactatagggggcagggccattccaatgttgccactgctgaacagaggagacagcagatgcaacattggaacctggcggcagcgcaaaagatg

SEQ ID NO: 193547 - DNA, 103 bp, Artificial Sequence
  Synthetic Polynucleotide
taatacgactcactatagggtctgcagtggaagagccagattccctggctaacagaggagaagccagatgatctggctcaacctggcggcagcgcaaaagatg

SEQ ID NO: 193548 - DNA, 103 bp, Artificial Sequence
  Synthetic Polynucleotide
taatacgactcactatagggatctccctcttctgcagtggaagagccagaaacagaggagatctggcatgtccactgcaaacctggcggcagcgcaaaagatg

SEQ ID NO: 193549 - DNA, 103 bp, Artificial Sequence
  Synthetic Polynucleotide
taatacgactcactatagggccttggagaaatctccctcttctgcagtggaacagaggagaccactgatgaagagggagaacctggcggcagcgcaaaagatg

SEQ ID NO: 193550 - DNA, 103 bp, Artificial Sequence
  Synthetic Polynucleotide
taatacgactcactatagggcgaatggggcccttggagaaatctccctctaacagaggagaagagggatgtttctccaaaacctggcggcagcgcaaaagatg

SEQ ID NO: 193551 - DNA, 103 bp, Artificial Sequence
  Synthetic Polynucleotide
taatacgactcactataggggcggtcacagcgaatggggcccttggagaaaacagaggagattctccatgggccccattaacctggcggcagcgcaaaagatg

SEQ ID NO: 193552 - DNA, 103 bp, Artificial Sequence
  Synthetic Polynucleotide
taatacgactcactatagggtgtagccgcagcggtcacagcgaatggggcaacagaggagagccccaatggctgtgaccaacctggcggcagcgcaaaagatg

SEQ ID NO: 193553 - DNA, 103 bp, Artificial Sequence
  Synthetic Polynucleotide
taatacgactcactatagggcgattagtattgtagccgcagcggtcacagaacagaggagactgtgaatgctgcggctaaacctggcggcagcgcaaaagatg

SEQ ID NO: 193554 - DNA, 103 bp, Artificial Sequence
  Synthetic Polynucleotide
taatacgactcactataggggtgatcatatcgattagtattgtagccgcaaacagaggagatgcggcatgaatactaataacctggcggcagcgcaaaagatg

SEQ ID NO: 193555 - DNA, 103 bp, Artificial Sequence
  Synthetic Polynucleotide
taatacgactcactataggggtgctgtatagtgatcatatcgattagtataacagaggagaatactaatggatatgatcaacctggcggcagcgcaaaagatg

SEQ ID NO: 193556 - DNA, 103 bp, Artificial Sequence
  Synthetic Polynucleotide
taatacgactcactatagggtgtttcaggtgtgctgtatagtgatcatataacagaggagaatatgaatgctatacagcaacctggcggcagcgcaaaagatg

SEQ ID NO: 193557 - DNA, 103 bp, Artificial Sequence
  Synthetic Polynucleotide
taatacgactcactatagggcatgtcgttaggcagggccattccaatgttaacagaggagaaacattatgatggccctgaacctggcggcagcgcaaaagatg

SEQ ID NO: 193558 - DNA, 103 bp, Artificial Sequence
  Synthetic Polynucleotide
taatacgactcactatagggtctggtgtggtgtttcaggtgtgctgtataaacagaggagatatacaatgcacctgaaaaacctggcggcagcgcaaaagatg

SEQ ID NO: 193559 - DNA, 103 bp, Artificial Sequence
  Synthetic Polynucleotide
taatacgactcactatagggtatccccagctctggtgtggtgtttcaggtaacagaggagaacctgaatgaccacaccaaacctggcggcagcgcaaaagatg

SEQ ID NO: 193560 - DNA, 103 bp, Artificial Sequence
  Synthetic Polynucleotide
taatacgactcactatagggactcgctcattatccccagctctggtgtggaacagaggagaccacacatgagctggggaaacctggcggcagcgcaaaagatg

SEQ ID NO: 193561 - DNA, 103 bp, Artificial Sequence
  Synthetic Polynucleotide
taatacgactcactatagggacacttgtagactcgctcattatccccagcaacagaggagagctgggatgaatgagcgaaacctggcggcagcgcaaaagatg

SEQ ID NO: 193562 - DNA, 103 bp, Artificial Sequence
  Synthetic Polynucleotide
taatacgactcactatagggtgcaaatgatacacttgtagactcgctcataacagaggagaatgagcatgtctacaagtaacctggcggcagcgcaaaagatg

SEQ ID NO: 193563 - DNA, 103 bp, Artificial Sequence
  Synthetic Polynucleotide
taatacgactcactataggggttgtgtatgtgcaaatgatacacttgtagaacagaggagactacaaatgtatcatttgaacctggcggcagcgcaaaagatg

SEQ ID NO: 193564 - DNA, 103 bp, Artificial Sequence
  Synthetic Polynucleotide
taatacgactcactatagggctcgctcactgttgtgtatgtgcaaatgataacagaggagaatcattatgacatacacaaacctggcggcagcgcaaaagatg

SEQ ID NO: 193565 - DNA, 103 bp, Artificial Sequence
  Synthetic Polynucleotide
taatacgactcactatagggtccagtgatactcgctcactgttgtgtatgaacagaggagacatacaatgcagtgagcgaacctggcggcagcgcaaaagatg

SEQ ID NO: 193566 - DNA, 103 bp, Artificial Sequence
  Synthetic Polynucleotide
taatacgactcactatagggaaatgtttcctccagtgatactcgctcactaacagaggagaagtgagatggtatcactgaacctggcggcagcgcaaaagatg

SEQ ID NO: 193567 - DNA, 103 bp, Artificial Sequence
  Synthetic Polynucleotide
taatacgactcactatagggatggtttcttaaatgtttcctccagtgataaacagaggagatatcacatgaggaaacataacctggcggcagcgcaaaagatg

SEQ ID NO: 193568 - DNA, 103 bp, Artificial Sequence
  Synthetic Polynucleotide
taatacgactcactataggggcaagtcatacatgtcgttaggcagggccaaacagaggagatggcccatgctaacgacaaacctggcggcagcgcaaaagatg

SEQ ID NO: 193569 - DNA, 103 bp, Artificial Sequence
  Synthetic Polynucleotide
taatacgactcactatagggtccttggaaaatggtttcttaaatgtttccaacagaggagaggaaacatgtaagaaaccaacctggcggcagcgcaaaagatg

SEQ ID NO: 193570 - DNA, 103 bp, Artificial Sequence
  Synthetic Polynucleotide
taatacgactcactataggggtgtatactttccttggaaaatggtttcttaacagaggagaaagaaaatgttttccaagaacctggcggcagcgcaaaagatg

SEQ ID NO: 193571 - DNA, 103 bp, Artificial Sequence
  Synthetic Polynucleotide
taatacgactcactatagggttttccacatgtgtatactttccttggaaaaacagaggagatttccaatgaaagtatacaacctggcggcagcgcaaaagatg

SEQ ID NO: 193572 - DNA, 103 bp, Artificial Sequence
  Synthetic Polynucleotide
taatacgactcactatagggaatagttgcattttccacatgtgtatacttaacagaggagaaagtatatgcatgtggaaaacctggcggcagcgcaaaagatg

SEQ ID NO: 193573 - DNA, 103 bp, Artificial Sequence
  Synthetic Polynucleotide
taatacgactcactatagggctgtctgaaaaatagttgcattttccacataacagaggagaatgtggatgatgcaactaaacctggcggcagcgcaaaagatg

SEQ ID NO: 193574 - DNA, 103 bp, Artificial Sequence
  Synthetic Polynucleotide
taatacgactcactatagggattgttttttctgtctgaaaaatagttgcaaacagaggagatgcaacatgttttcagacaacctggcggcagcgcaaaagatg

SEQ ID NO: 193575 - DNA, 103 bp, Artificial Sequence
  Synthetic Polynucleotide
taatacgactcactataggggctgaacataattgttttttctgtctgaaaaacagaggagatttcagatggaaaaaacaaacctggcggcagcgcaaaagatg

SEQ ID NO: 193576 - DNA, 103 bp, Artificial Sequence
  Synthetic Polynucleotide
taatacgactcactataggggttctaacatgctgaacataattgttttttaacagaggagaaaaaaaatgttatgttcaaacctggcggcagcgcaaaagatg

SEQ ID NO: 193577 - DNA, 103 bp, Artificial Sequence
  Synthetic Polynucleotide
taatacgactcactatagggtcctgtatgagttctaacatgctgaacataaacagaggagatatgttatgcatgttagaaacctggcggcagcgcaaaagatg

SEQ ID NO: 193578 - DNA, 103 bp, Artificial Sequence
  Synthetic Polynucleotide
taatacgactcactatagggatgggcgttctcctgtatgagttctaacataacagaggagaatgttaatgctcatacagaacctggcggcagcgcaaaagatg

SEQ ID NO: 193579 - DNA, 103 bp, Artificial Sequence
  Synthetic Polynucleotide
taatacgactcactataggggaaaggtcatgcaagtcatacatgtcgttaaacagaggagataacgaatggtatgacttaacctggcggcagcgcaaaagatg

SEQ ID NO: 193580 - DNA, 103 bp, Artificial Sequence
  Synthetic Polynucleotide
taatacgactcactatagggtcacatttatatgggcgttctcctgtatgaaacagaggagatcatacatgagaacgcccaacctggcggcagcgcaaaagatg

SEQ ID NO: 193581 - DNA, 103 bp, Artificial Sequence
  Synthetic Polynucleotide
taatacgactcactatagggaggacaaagttcacatttatatgggcgttcaacagaggagagaacgcatgtataaatgtaacctggcggcagcgcaaaagatg

SEQ ID NO: 193582 - DNA, 103 bp, Artificial Sequence
  Synthetic Polynucleotide
taatacgactcactatagggaacttgagtaaggacaaagttcacatttataacagaggagaataaatatgaactttgtcaacctggcggcagcgcaaaagatg

SEQ ID NO: 193583 - DNA, 103 bp, Artificial Sequence
  Synthetic Polynucleotide
taatacgactcactataggggtcttctgagaacttgagtaaggacaaagtaacagaggagaactttgatgttactcaagaacctggcggcagcgcaaaagatg

SEQ ID NO: 193584 - DNA, 103 bp, Artificial Sequence
  Synthetic Polynucleotide
taatacgactcactatagggagttagatgagtcttctgagaacttgagtaaacagaggagatactcaatgtctcagaagaacctggcggcagcgcaaaagatg

SEQ ID NO: 193585 - DNA, 103 bp, Artificial Sequence
  Synthetic Polynucleotide
taatacgactcactataggggcatatgtctagttagatgagtcttctgagaacagaggagactcagaatgctcatctaaaacctggcggcagcgcaaaagatg

SEQ ID NO: 193586 - DNA, 103 bp, Artificial Sequence
  Synthetic Polynucleotide
taatacgactcactataggggaatgagtacgcatatgtctagttagatgaaacagaggagatcatctatgtagacatataacctggcggcagcgcaaaagatg

SEQ ID NO: 193587 - DNA, 103 bp, Artificial Sequence
  Synthetic Polynucleotide
taatacgactcactatagggcttctcacctgaatgagtacgcatatgtctaacagaggagaagacatatgcgtactcataacctggcggcagcgcaaaagatg

SEQ ID NO: 193588 - DNA, 103 bp, Artificial Sequence
  Synthetic Polynucleotide
taatacgactcactatagggatttaaatggcttctcacctgaatgagtacaacagaggagagtactcatgcaggtgagaaacctggcggcagcgcaaaagatg

SEQ ID NO: 193589 - DNA, 103 bp, Artificial Sequence
  Synthetic Polynucleotide
taatacgactcactatagggcactgatcacatttaaatggcttctcacctaacagaggagaaggtgaatggccatttaaaacctggcggcagcgcaaaagatg

SEQ ID NO: 193590 - DNA, 103 bp, Artificial Sequence
  Synthetic Polynucleotide
taatacgactcactatagggctgtagctcagtatacgcctgtgttgccataacagaggagaatggcaatgcaggcgtataacctggcggcagcgcaaaagatg

SEQ ID NO: 193591 - DNA, 103 bp, Artificial Sequence
  Synthetic Polynucleotide
taatacgactcactataggggggctggggtgccgctgggggtggtggcggaacagaggagaccgccaatgcccccagcgaacctggcggcagcgcaaaagatg

SEQ ID NO: 193592 - DNA, 103 bp, Artificial Sequence
  Synthetic Polynucleotide
taatacgactcactatagggctgggtggccgtgcctgcggcctcgtagtaaacagaggagatactacatggccgcaggcaacctggcggcagcgcaaaagatg

SEQ ID NO: 193593 - DNA, 103 bp, Artificial Sequence
  Synthetic Polynucleotide
taatacgactcactataggggggtgctgacctgggtggccgtgcctgcggaacagaggagaccgcagatgcggccacccaacctggcggcagcgcaaaagatg

SEQ ID NO: 193594 - DNA, 103 bp, Artificial Sequence
  Synthetic Polynucleotide
taatacgactcactataggggaggtggcgggggtgctgacctgggtggccaacagaggagaggccacatgggtcagcacaacctggcggcagcgcaaaagatg

SEQ ID NO: 193595 - DNA, 103 bp, Artificial Sequence
  Synthetic Polynucleotide
taatacgactcactatagggcaccgcctgggaggtggcgggggtgctgacaacagaggagagtcagcatgcccgccaccaacctggcggcagcgcaaaagatg

SEQ ID NO: 193596 - DNA, 103 bp, Artificial Sequence
  Synthetic Polynucleotide
taatacgactcactatagggcactgctggccaccgcctgggaggtggcggaacagaggagaccgccaatgcccaggcggaacctggcggcagcgcaaaagatg

SEQ ID NO: 193597 - DNA, 103 bp, Artificial Sequence
  Synthetic Polynucleotide
taatacgactcactatagggggcatggagccactgctggccaccgcctggaacagaggagaccaggcatgggccagcagaacctggcggcagcgcaaaagatg

SEQ ID NO: 193598 - DNA, 103 bp, Artificial Sequence
  Synthetic Polynucleotide
taatacgactcactatagggcacgtacatgggcatggagccactgctggcaacagaggagagccagcatgggctccatgaacctggcggcagcgcaaaagatg

SEQ ID NO: 193599 - DNA, 103 bp, Artificial Sequence
  Synthetic Polynucleotide
taatacgactcactatagggggctgccggacacgtacatgggcatggagcaacagaggagagctccaatgccatgtacgaacctggcggcagcgcaaaagatg

SEQ ID NO: 193600 - DNA, 103 bp, Artificial Sequence
  Synthetic Polynucleotide
taatacgactcactataggggcgacgacctggctgccggacacgtacatgaacagaggagacatgtaatggtccggcagaacctggcggcagcgcaaaagatg

SEQ ID NO: 193601 - DNA, 103 bp, Artificial Sequence
  Synthetic Polynucleotide
taatacgactcactatagggggtggagctggcgacgacctggctgccggaaacagaggagatccggcatgcaggtcgtcaacctggcggcagcgcaaaagatg

SEQ ID NO: 193602 - DNA, 103 bp, Artificial Sequence
  Synthetic Polynucleotide
taatacgactcactataggggtggctgcgggggctggggtgccgctggggaacagaggagaccccagatgcaccccagcaacctggcggcagcgcaaaagatg

SEQ ID NO: 193603 - DNA, 103 bp, Artificial Sequence
  Synthetic Polynucleotide
taatacgactcactatagggccccagtgctggtggagctggcgacgacctaacagaggagaaggtcgatgccagctccaaacctggcggcagcgcaaaagatg

SEQ ID NO: 193604 - DNA, 103 bp, Artificial Sequence
  Synthetic Polynucleotide
taatacgactcactatagggctggccccagccccagtgctggtggagctgaacagaggagacagctcatgcagcactggaacctggcggcagcgcaaaagatg

SEQ ID NO: 193605 - DNA, 103 bp, Artificial Sequence
  Synthetic Polynucleotide
taatacgactcactataggggctgctgttgctggccccagccccagtgctaacagaggagaagcactatggctggggccaacctggcggcagcgcaaaagatg

SEQ ID NO: 193606 - DNA, 103 bp, Artificial Sequence
  Synthetic Polynucleotide
taatacgactcactatagggcaccacctccgctgctgttgctggccccagaacagaggagactggggatggcaacagcaaacctggcggcagcgcaaaagatg

SEQ ID NO: 193607 - DNA, 103 bp, Artificial Sequence
  Synthetic Polynucleotide
taatacgactcactatagggccaccactgccaccacctccgctgctgttgaacagaggagacaacagatgcggaggtggaacctggcggcagcgcaaaagatg

SEQ ID NO: 193608 - DNA, 103 bp, Artificial Sequence
  Synthetic Polynucleotide
taatacgactcactataggggccgccgccaccaccactgccaccacctccaacagaggagaggaggtatgggcagtggtaacctggcggcagcgcaaaagatg

SEQ ID NO: 193609 - DNA, 103 bp, Artificial Sequence
  Synthetic Polynucleotide
taatacgactcactatagggctcccccgccgccgccgccaccaccactgcaacagaggagagcagtgatggtggcggcgaacctggcggcagcgcaaaagatg

SEQ ID NO: 193610 - DNA, 103 bp, Artificial Sequence
  Synthetic Polynucleotide
taatacgactcactatagggccgccaccgcctcccccgccgccgccgccaaacagaggagatggcggatgcggcgggggaacctggcggcagcgcaaaagatg

SEQ ID NO: 193611 - DNA, 103 bp, Artificial Sequence
  Synthetic Polynucleotide
taatacgactcactatagggactgccacccccgccaccgcctcccccgccaacagaggagaggcgggatgggcggtggcaacctggcggcagcgcaaaagatg

SEQ ID NO: 193612 - DNA, 103 bp, Artificial Sequence
  Synthetic Polynucleotide
taatacgactcactatagggcggtgctgccactgccacccccgccaccgcaacagaggagagcggtgatgggggtggcaaacctggcggcagcgcaaaagatg

SEQ ID NO: 193613 - DNA, 103 bp, Artificial Sequence
  Synthetic Polynucleotide
taatacgactcactataggggcagcggtgggtggctgcgggggctggggtaacagaggagaaccccaatgcccgcagccaacctggcggcagcgcaaaagatg

SEQ ID NO: 193614 - DNA, 103 bp, Artificial Sequence
  Synthetic Polynucleotide
taatacgactcactatagggccgccgcctccggtgctgccactgccacccaacagaggagagggtggatgtggcagcacaacctggcggcagcgcaaaagatg

SEQ ID NO: 193615 - DNA, 103 bp, Artificial Sequence
  Synthetic Polynucleotide
taatacgactcactatagggtgctccgctgccgccgcctccggtgctgccaacagaggagaggcagcatgggaggcggcaacctggcggcagcgcaaaagatg

SEQ ID NO: 193616 - DNA, 103 bp, Artificial Sequence
  Synthetic Polynucleotide
taatacgactcactatagggcgtaggtgcctgctccgctgccgccgcctcaacagaggagagaggcgatggcagcggagaacctggcggcagcgcaaaagatg

SEQ ID NO: 193617 - DNA, 103 bp, Artificial Sequence
  Synthetic Polynucleotide
taatacgactcactatagggccttggatcacgtaggtgcctgctccgctgaacagaggagacagcggatgaggcacctaaacctggcggcagcgcaaaagatg

SEQ ID NO: 193618 - DNA, 103 bp, Artificial Sequence
  Synthetic Polynucleotide
taatacgactcactatagggcatgtagccgccttggatcacgtaggtgccaacagaggagaggcaccatggtgatccaaaacctggcggcagcgcaaaagatg

SEQ ID NO: 193619 - DNA, 103 bp, Artificial Sequence
  Synthetic Polynucleotide
taatacgactcactatagggcactgcccagcatgtagccgccttggatcaaacagaggagatgatccatggcggctacaaacctggcggcagcgcaaaagatg

SEQ ID NO: 193620 - DNA, 103 bp, Artificial Sequence
  Synthetic Polynucleotide
taatacgactcactataggggactggctggcactgcccagcatgtagccgaacagaggagacggctaatggctgggcagaacctggcggcagcgcaaaagatg

SEQ ID NO: 193621 - DNA, 103 bp, Artificial Sequence
  Synthetic Polynucleotide
taatacgactcactataggggtgagagtaagactggctggcactgcccagaacagaggagactgggcatggccagccagaacctggcggcagcgcaaaagatg

SEQ ID NO: 193622 - DNA, 103 bp, Artificial Sequence
  Synthetic Polynucleotide
taatacgactcactatagggcacgggtggtgtgagagtaagactggctggaacagaggagaccagccatgcttactctcaacctggcggcagcgcaaaagatg

SEQ ID NO: 193623 - DNA, 103 bp, Artificial Sequence
  Synthetic Polynucleotide
taatacgactcactataggggctggcgaggcacgggtggtgtgagagtaaaacagaggagattactcatgcaccacccgaacctggcggcagcgcaaaagatg

SEQ ID NO: 193624 - DNA, 103 bp, Artificial Sequence
  Synthetic Polynucleotide
taatacgactcactatagggaggggtggcagcagcggtgggtggctgcggaacagaggagaccgcagatgcccaccgctaacctggcggcagcgcaaaagatg

SEQ ID NO: 193625 - DNA, 103 bp, Artificial Sequence
  Synthetic Polynucleotide
taatacgactcactatagggctggaccgtggctggcgaggcacgggtggtaacagaggagaaccaccatggcctcgccaaacctggcggcagcgcaaaagatg

SEQ ID NO: 193626 - DNA, 103 bp, Artificial Sequence
  Synthetic Polynucleotide
taatacgactcactatagggccaggagccactggaccgtggctggcgaggaacagaggagacctcgcatgccacggtccaacctggcggcagcgcaaaagatg

SEQ ID NO: 193627 - DNA, 103 bp, Artificial Sequence
  Synthetic Polynucleotide
taatacgactcactatagggtcatagttgtccaggagccactggaccgtgaacagaggagacacggtatggtggctcctaacctggcggcagcgcaaaagatg

SEQ ID NO: 193628 - DNA, 103 bp, Artificial Sequence
  Synthetic Polynucleotide
taatacgactcactatagggctcagccgtctcatagttgtccaggagccaaacagaggagatggctcatggacaactataacctggcggcagcgcaaaagatg

SEQ ID NO: 193629 - DNA, 103 bp, Artificial Sequence
  Synthetic Polynucleotide
taatacgactcactataggggactcacgccctcagccgtctcatagttgtaacagaggagaacaactatgagacggctgaacctggcggcagcgcaaaagatg

SEQ ID NO: 193630 - DNA, 103 bp, Artificial Sequence
  Synthetic Polynucleotide
taatacgactcactatagggctccgtggcagactcacgccctcagccgtcaacagaggagagacggcatggggcgtgagaacctggcggcagcgcaaaagatg

SEQ ID NO: 193631 - DNA, 103 bp, Artificial Sequence
  Synthetic Polynucleotide
taatacgactcactataggggtagagggtgctccgtggcagactcacgccaacagaggagaggcgtgatgctgccacggaacctggcggcagcgcaaaagatg

SEQ ID NO: 193632 - DNA, 103 bp, Artificial Sequence
  Synthetic Polynucleotide
taatacgactcactatagggagtagtggcagtagagggtgctccgtggcaaacagaggagatgccacatggcaccctctaacctggcggcagcgcaaaagatg

SEQ ID NO: 193633 - DNA, 103 bp, Artificial Sequence
  Synthetic Polynucleotide
taatacgactcactatagggcagtgcagtaagtagtggcagtagagggtgaacagaggagacaccctatgctgccactaaacctggcggcagcgcaaaagatg

SEQ ID NO: 193634 - DNA, 103 bp, Artificial Sequence
  Synthetic Polynucleotide
taatacgactcactatagggctgctcctggcagtgcagtaagtagtggcaaacagaggagatgccacatgttactgcacaacctggcggcagcgcaaaagatg

SEQ ID NO: 193635 - DNA, 103 bp, Artificial Sequence
  Synthetic Polynucleotide
taatacgactcactatagggattggggctgaggggtggcagcagcggtggaacagaggagaccaccgatgctgccacccaacctggcggcagcgcaaaagatg

SEQ ID NO: 193636 - DNA, 103 bp, Artificial Sequence
  Synthetic Polynucleotide
taatacgactcactataggggctccagcttctgctcctggcagtgcagtaaacagaggagatactgcatggccaggagcaacctggcggcagcgcaaaagatg

SEQ ID NO: 193637 - DNA, 103 bp, Artificial Sequence
  Synthetic Polynucleotide
taatacgactcactataggggcgttgacgggctccagcttctgctcctggaacagaggagaccaggaatggaagctggaaacctggcggcagcgcaaaagatg

SEQ ID NO: 193638 - DNA, 103 bp, Artificial Sequence
  Synthetic Polynucleotide
taatacgactcactataggggaaggaggcggcgttgacgggctccagcttaacagaggagaaagctgatgcccgtcaacaacctggcggcagcgcaaaagatg

SEQ ID NO: 193639 - DNA, 103 bp, Artificial Sequence
  Synthetic Polynucleotide
taatacgactcactatagggtgagcttgccgaaggaggcggcgttgacggaacagaggagaccgtcaatgccgcctcctaacctggcggcagcgcaaaagatg

SEQ ID NO: 193640 - DNA, 103 bp, Artificial Sequence
  Synthetic Polynucleotide
taatacgactcactatagggacggagcggatgagcttgccgaaggaggcgaacagaggagacgcctcatgcggcaagctaacctggcggcagcgcaaaagatg

SEQ ID NO: 193641 - DNA, 103 bp, Artificial Sequence
  Synthetic Polynucleotide
taatacgactcactataggggcccatgaagacggagcggatgagcttgccaacagaggagaggcaagatgatccgctccaacctggcggcagcgcaaaagatg

SEQ ID NO: 193642 - DNA, 103 bp, Artificial Sequence
  Synthetic Polynucleotide
taatacgactcactataggggggttcgcaggcccatgaagacggagcggaaacagaggagatccgctatgtcttcatggaacctggcggcagcgcaaaagatg

SEQ ID NO: 193643 - DNA, 103 bp, Artificial Sequence
  Synthetic Polynucleotide
taatacgactcactatagggcccagacggcgggttcgcaggcccatgaagaacagaggagacttcatatgcctgcgaacaacctggcggcagcgcaaaagatg

SEQ ID NO: 193644 - DNA, 103 bp, Artificial Sequence
  Synthetic Polynucleotide
taatacgactcactataggggcccctggtgcccagacggcgggttcgcagaacagaggagactgcgaatgcgccgtctgaacctggcggcagcgcaaaagatg

SEQ ID NO: 193645 - DNA, 103 bp, Artificial Sequence
  Synthetic Polynucleotide
taatacgactcactatagggacttggagttgcccctggtgcccagacggcaacagaggagagccgtcatggcaccagggaacctggcggcagcgcaaaagatg

SEQ ID NO: 193646 - DNA, 103 bp, Artificial Sequence
  Synthetic Polynucleotide
taatacgactcactatagggtcggtgacatattggggctgaggggtggcaaacagaggagatgccacatgtcagccccaaacctggcggcagcgcaaaagatg

SEQ ID NO: 193647 - DNA, 103 bp, Artificial Sequence
  Synthetic Polynucleotide
taatacgactcactatagggtagtagtggtacttggagttgcccctggtgaacagaggagacaccagatgcaactccaaaacctggcggcagcgcaaaagatg

SEQ ID NO: 193648 - DNA, 103 bp, Artificial Sequence
  Synthetic Polynucleotide
taatacgactcactataggggcgcaggccatagtagtggtacttggagttaacagaggagaaactccatgtaccactacaacctggcggcagcgcaaaagatg

SEQ ID NO: 193649 - DNA, 103 bp, Artificial Sequence
  Synthetic Polynucleotide
taatacgactcactatagggtggccttgatgcgcaggccatagtagtggtaacagaggagaaccactatgatggcctgcaacctggcggcagcgcaaaagatg

SEQ ID NO: 193650 - DNA, 103 bp, Artificial Sequence
  Synthetic Polynucleotide
taatacgactcactatagggaggggtgagctggccttgatgcgcaggccaaacagaggagatggcctatgcatcaaggcaacctggcggcagcgcaaaagatg

SEQ ID NO: 193651 - DNA, 103 bp, Artificial Sequence
  Synthetic Polynucleotide
taatacgactcactatagggcagccgcagcaggggtgagctggccttgataacagaggagaatcaagatgagctcacccaacctggcggcagcgcaaaagatg

SEQ ID NO: 193652 - DNA, 103 bp, Artificial Sequence
  Synthetic Polynucleotide
taatacgactcactatagggggtcctccatcagccgcagcaggggtgagcaacagaggagagctcacatgtgctgcggcaacctggcggcagcgcaaaagatg

SEQ ID NO: 193653 - DNA, 103 bp, Artificial Sequence
  Synthetic Polynucleotide
taatacgactcactatagggatgtgctgctggtcctccatcagccgcagcaacagaggagagctgcgatggatggaggaaacctggcggcagcgcaaaagatg

SEQ ID NO: 193654 - DNA, 103 bp, Artificial Sequence
  Synthetic Polynucleotide
taatacgactcactatagggccgcatggccatgtgctgctggtcctccataacagaggagaatggagatgcagcagcacaacctggcggcagcgcaaaagatg

SEQ ID NO: 193655 - DNA, 103 bp, Artificial Sequence
  Synthetic Polynucleotide
taatacgactcactatagggagggctggccccgcatggccatgtgctgctaacagaggagaagcagcatgtggccatgcaacctggcggcagcgcaaaagatg

SEQ ID NO: 193656 - DNA, 103 bp, Artificial Sequence
  Synthetic Polynucleotide
taatacgactcactatagggttctgcgagaagggctggccccgcatggccaacagaggagaggccatatggggccagccaacctggcggcagcgcaaaagatg

SEQ ID NO: 193657 - DNA, 103 bp, Artificial Sequence
  Synthetic Polynucleotide
taatacgactcactataggggctctgcagctcggtgacatattggggctgaacagaggagacagcccatgtatgtcaccaacctggcggcagcgcaaaagatg

SEQ ID NO: 193658 - DNA, 103 bp, Artificial Sequence
  Synthetic Polynucleotide
taatacgactcactataggggagcctctgcttctgcgagaagggctggccaacagaggagaggccagatgttctcgcagaacctggcggcagcgcaaaagatg

SEQ ID NO: 193659 - DNA, 103 bp, Artificial Sequence
  Synthetic Polynucleotide
taatacgactcactatagggggatgggcttgagcctctgcttctgcgagaaacagaggagatctcgcatgagcagaggcaacctggcggcagcgcaaaagatg

SEQ ID NO: 193660 - DNA, 103 bp, Artificial Sequence
  Synthetic Polynucleotide
taatacgactcactatagggtccatcttctggatgggcttgagcctctgcaacagaggagagcagagatgcaagcccataacctggcggcagcgcaaaagatg

SEQ ID NO: 193661 - DNA, 103 bp, Artificial Sequence
  Synthetic Polynucleotide
taatacgactcactatagggggtcatgccttccatcttctggatgggcttaacagaggagaaagcccatgcagaagatgaacctggcggcagcgcaaaagatg

SEQ ID NO: 193662 - DNA, 103 bp, Artificial Sequence
  Synthetic Polynucleotide
taatacgactcactatagggccacgccgttggtcatgccttccatcttctaacagaggagaagaagaatgaaggcatgaaacctggcggcagcgcaaaagatg

SEQ ID NO: 193663 - DNA, 103 bp, Artificial Sequence
  Synthetic Polynucleotide
taatacgactcactatagggtgccccaccgccacgccgttggtcatgcctaacagaggagaaggcatatgcaacggcgtaacctggcggcagcgcaaaagatg

SEQ ID NO: 193664 - DNA, 103 bp, Artificial Sequence
  Synthetic Polynucleotide
taatacgactcactataggggctcggctgctgccccaccgccacgccgttaacagaggagaaacggcatggcggtggggaacctggcggcagcgcaaaagatg

SEQ ID NO: 193665 - DNA, 103 bp, Artificial Sequence
  Synthetic Polynucleotide
taatacgactcactatagggacagccccgtgctcggctgctgccccaccgaacagaggagacggtggatgagcagccgaaacctggcggcagcgcaaaagatg

SEQ ID NO: 193666 - DNA, 103 bp, Artificial Sequence
  Synthetic Polynucleotide
taatacgactcactatagggctgatgtccgacagccccgtgctcggctgcaacagaggagagcagccatgcacggggctaacctggcggcagcgcaaaagatg

SEQ ID NO: 193667 - DNA, 103 bp, Artificial Sequence
  Synthetic Polynucleotide
taatacgactcactatagggcacctgggcgctgatgtccgacagccccgtaacagaggagaacggggatgtcggacatcaacctggcggcagcgcaaaagatg

SEQ ID NO: 193668 - DNA, 103 bp, Artificial Sequence
  Synthetic Polynucleotide
taatacgactcactatagggggggctgggggctctgcagctcggtgacataacagaggagaatgtcaatgagctgcagaaacctggcggcagcgcaaaagatg

SEQ ID NO: 193669 - DNA, 103 bp, Artificial Sequence
  Synthetic Polynucleotide
taatacgactcactatagggggtactgctgcacctgggcgctgatgtccgaacagaggagacggacaatggcgcccaggaacctggcggcagcgcaaaagatg

SEQ ID NO: 193670 - DNA, 103 bp, Artificial Sequence
  Synthetic Polynucleotide
taatacgactcactatagggaaaaattgctggtactgctgcacctgggcgaacagaggagacgcccaatggcagcagtaaacctggcggcagcgcaaaagatg

SEQ ID NO: 193671 - DNA, 103 bp, Artificial Sequence
  Synthetic Polynucleotide
taatacgactcactatagggagaggcatccaaaaattgctggtactgctgaacagaggagacagcagatgcagcaatttaacctggcggcagcgcaaaagatg

SEQ ID NO: 193672 - DNA, 103 bp, Artificial Sequence
  Synthetic Polynucleotide
taatacgactcactatagggggaggctccgagaggcatccaaaaattgctaacagaggagaagcaatatgtggatgcctaacctggcggcagcgcaaaagatg

SEQ ID NO: 193673 - DNA, 103 bp, Artificial Sequence
  Synthetic Polynucleotide
taatacgactcactataggggtgaagtcagggaggctccgagaggcatccaacagaggagaggatgcatgtcggagcctaacctggcggcagcgcaaaagatg

SEQ ID NO: 193674 - DNA, 103 bp, Artificial Sequence
  Synthetic Polynucleotide
taatacgactcactataggggtcgagctctgtgaagtcagggaggctccgaacagaggagacggagcatgcctgacttcaacctggcggcagcgcaaaagatg

SEQ ID NO: 193675 - DNA, 103 bp, Artificial Sequence
  Synthetic Polynucleotide
taatacgactcactatagggtgccctggaggtcgagctctgtgaagtcagaacagaggagactgactatgcagagctcgaacctggcggcagcgcaaaagatg

SEQ ID NO: 193676 - DNA, 103 bp, Artificial Sequence
  Synthetic Polynucleotide
taatacgactcactatagggggcagcaccttgccctggaggtcgagctctaacagaggagaagagctatgcctccagggaacctggcggcagcgcaaaagatg

SEQ ID NO: 193677 - DNA, 103 bp, Artificial Sequence
  Synthetic Polynucleotide
taatacgactcactataggggacgccctcaggcagcaccttgccctggagaacagaggagactccagatgaaggtgctgaacctggcggcagcgcaaaagatg

SEQ ID NO: 193678 - DNA, 103 bp, Artificial Sequence
  Synthetic Polynucleotide
taatacgactcactatagggccccgggcccgacgccctcaggcagcacctaacagaggagaaggtgcatgctgagggcgaacctggcggcagcgcaaaagatg

SEQ ID NO: 193679 - DNA, 103 bp, Artificial Sequence
  Synthetic Polynucleotide
taatacgactcactatagggggctgtgcctggggctgggggctctgcagcaacagaggagagctgcaatgcccccagccaacctggcggcagcgcaaaagatg

SEQ ID NO: 193680 - DNA, 103 bp, Artificial Sequence
  Synthetic Polynucleotide
taatacgactcactataggggctttgatgtccccgggcccgacgccctcaaacagaggagatgagggatgcgggcccggaacctggcggcagcgcaaaagatg

SEQ ID NO: 193681 - DNA, 103 bp, Artificial Sequence
  Synthetic Polynucleotide
taatacgactcactataggggacctggaaggctttgatgtccccgggcccaacagaggagagggcccatggacatcaaaaacctggcggcagcgcaaaagatg

SEQ ID NO: 193682 - DNA, 103 bp, Artificial Sequence
  Synthetic Polynucleotide
taatacgactcactatagggcccggtacaggacctggaaggctttgatgtaacagaggagaacatcaatgccttccaggaacctggcggcagcgcaaaagatg

SEQ ID NO: 193683 - DNA, 103 bp, Artificial Sequence
  Synthetic Polynucleotide
taatacgactcactatagggtcacagtgttcccggtacaggacctggaagaacagaggagacttccaatgcctgtaccgaacctggcggcagcgcaaaagatg

SEQ ID NO: 193684 - DNA, 103 bp, Artificial Sequence
  Synthetic Polynucleotide
taatacgactcactataggggacaatggcctcacagtgttcccggtacagaacagaggagactgtacatggaacactgtaacctggcggcagcgcaaaagatg

SEQ ID NO: 193685 - DNA, 103 bp, Artificial Sequence
  Synthetic Polynucleotide
taatacgactcactatagggccatgacgtcgacaatggcctcacagtgttaacagaggagaaacactatgaggccattgaacctggcggcagcgcaaaagatg

SEQ ID NO: 193686 - DNA, 103 bp, Artificial Sequence
  Synthetic Polynucleotide
taatacgactcactatagggtgcaggttcaccatgacgtcgacaatggccaacagaggagaggccatatgcgacgtcataacctggcggcagcgcaaaagatg

SEQ ID NO: 193687 - DNA, 103 bp, Artificial Sequence
  Synthetic Polynucleotide
taatacgactcactatagggcagggtgaactgcaggttcaccatgacgtcaacagaggagagacgtcatggtgaacctgaacctggcggcagcgcaaaagatg

SEQ ID NO: 193688 - DNA, 103 bp, Artificial Sequence
  Synthetic Polynucleotide
taatacgactcactataggggcgtctccaccagggtgaactgcaggttcaaacagaggagatgaaccatgagttcacccaacctggcggcagcgcaaaagatg

SEQ ID NO: 193689 - DNA, 103 bp, Artificial Sequence
  Synthetic Polynucleotide
taatacgactcactataggggtcttccacagcgtctccaccagggtgaacaacagaggagagttcacatgggtggagacaacctggcggcagcgcaaaagatg

SEQ ID NO: 193690 - DNA, 103 bp, Artificial Sequence
  Synthetic Polynucleotide
taatacgactcactataggggccacccggtggctgtgcctggggctggggaacagaggagaccccagatgcaggcacagaacctggcggcagcgcaaaagatg

SEQ ID NO: 193691 - DNA, 103 bp, Artificial Sequence
  Synthetic Polynucleotide
taatacgactcactatagggcctccagaaggtcttccacagcgtctccacaacagaggagagtggagatgctgtggaagaacctggcggcagcgcaaaagatg

SEQ ID NO: 193692 - DNA, 103 bp, Artificial Sequence
  Synthetic Polynucleotide
taatacgactcactatagggtgaggttgtacctccagaaggtcttccacaaacagaggagatgtggaatgccttctggaaacctggcggcagcgcaaaagatg

SEQ ID NO: 193693 - DNA, 103 bp, Artificial Sequence
  Synthetic Polynucleotide
taatacgactcactatagggctgggctggctgaggttgtacctccagaagaacagaggagacttctgatggtacaacctaacctggcggcagcgcaaaagatg

SEQ ID NO: 193694 - DNA, 103 bp, Artificial Sequence
  Synthetic Polynucleotide
taatacgactcactatagggtggcgcctcactgggctggctgaggttgtaaacagaggagatacaacatgagccagcccaacctggcggcagcgcaaaagatg

SEQ ID NO: 193695 - DNA, 103 bp, Artificial Sequence
  Synthetic Polynucleotide
taatacgactcactatagggcagccagcggtggcgcctcactgggctggcaacagaggagagccagcatggtgaggcgcaacctggcggcagcgcaaaagatg

SEQ ID NO: 193696 - DNA, 103 bp, Artificial Sequence
  Synthetic Polynucleotide
taatacgactcactatagggtcgtcatgtacagccagcggtggcgcctcaaacagaggagatgaggcatgaccgctggcaacctggcggcagcgcaaaagatg

SEQ ID NO: 193697 - DNA, 103 bp, Artificial Sequence
  Synthetic Polynucleotide
taatacgactcactatagggcttctcggcctcgtcatgtacagccagcggaacagaggagaccgctgatggtacatgacaacctggcggcagcgcaaaagatg

SEQ ID NO: 193698 - DNA, 103 bp, Artificial Sequence
  Synthetic Polynucleotide
taatacgactcactatagggtgggcagtcgcttctcggcctcgtcatgtaaacagaggagatacatgatgaggccgagaaacctggcggcagcgcaaaagatg

SEQ ID NO: 193699 - DNA, 103 bp, Artificial Sequence
  Synthetic Polynucleotide
taatacgactcactatagggaggatggctttgggcagtcgcttctcggccaacagaggagaggccgaatggcgactgccaacctggcggcagcgcaaaagatg

SEQ ID NO: 193700 - DNA, 103 bp, Artificial Sequence
  Synthetic Polynucleotide
taatacgactcactataggggaggagcaccaggatggctttgggcagtcgaacagaggagacgactgatgaaagccatcaacctggcggcagcgcaaaagatg

SEQ ID NO: 193701 - DNA, 103 bp, Artificial Sequence
  Synthetic Polynucleotide
taatacgactcactataggggcggggctgcctgtagctcagtatacgcctaacagaggagaaggcgtatgctgagctacaacctggcggcagcgcaaaagatg

SEQ ID NO: 193702 - DNA, 103 bp, Artificial Sequence
  Synthetic Polynucleotide
taatacgactcactatagggactgcttctggccacccggtggctgtgcctaacagaggagaaggcacatgcaccgggtgaacctggcggcagcgcaaaagatg

SEQ ID NO: 193703 - DNA, 103 bp, Artificial Sequence
  Synthetic Polynucleotide
taatacgactcactatagggcgaacttggagaggagcaccaggatggcttaacagaggagaaagccaatgtggtgctccaacctggcggcagcgcaaaagatg

SEQ ID NO: 193704 - DNA, 103 bp, Artificial Sequence
  Synthetic Polynucleotide
taatacgactcactatagggagcacgggctcgaacttggagaggagcaccaacagaggagaggtgctatgctccaagttaacctggcggcagcgcaaaagatg

SEQ ID NO: 193705 - DNA, 103 bp, Artificial Sequence
  Synthetic Polynucleotide
taatacgactcactatagggggtccattggagcacgggctcgaacttggaaacagaggagatccaagatggagcccgtgaacctggcggcagcgcaaaagatg

SEQ ID NO: 193706 - DNA, 103 bp, Artificial Sequence
  Synthetic Polynucleotide
taatacgactcactatagggcacagtgcttggtccattggagcacgggctaacagaggagaagcccgatgtccaatggaaacctggcggcagcgcaaaagatg

SEQ ID NO: 193707 - DNA, 103 bp, Artificial Sequence
  Synthetic Polynucleotide
taatacgactcactatagggagcacgttgtcacagtgcttggtccattggaacagaggagaccaatgatgcaagcactgaacctggcggcagcgcaaaagatg

SEQ ID NO: 193708 - DNA, 103 bp, Artificial Sequence
  Synthetic Polynucleotide
taatacgactcactataggggccctggtacagcacgttgtcacagtgcttaacagaggagaaagcacatggacaacgtgaacctggcggcagcgcaaaagatg

SEQ ID NO: 193709 - DNA, 103 bp, Artificial Sequence
  Synthetic Polynucleotide
taatacgactcactatagggtttccaccaggccctggtacagcacgttgtaacagaggagaacaacgatgtgtaccaggaacctggcggcagcgcaaaagatg

SEQ ID NO: 193710 - DNA, 103 bp, Artificial Sequence
  Synthetic Polynucleotide
taatacgactcactatagggggaatgaggatttccaccaggccctggtacaacagaggagagtaccaatgcctggtggaaacctggcggcagcgcaaaagatg

SEQ ID NO: 193711 - DNA, 103 bp, Artificial Sequence
  Synthetic Polynucleotide
taatacgactcactatagggcagcacgtcgggaatgaggatttccaccagaacagaggagactggtgatgatcctcattaacctggcggcagcgcaaaagatg

SEQ ID NO: 193712 - DNA, 103 bp, Artificial Sequence
  Synthetic Polynucleotide
taatacgactcactatagggggatgggccgcagcacgtcgggaatgaggaaacagaggagatcctcaatgccgacgtgcaacctggcggcagcgcaaaagatg

SEQ ID NO: 193713 - DNA, 103 bp, Artificial Sequence
  Synthetic Polynucleotide
taatacgactcactatagggtccgtcacgtactgcttctggccacccggtaacagaggagaaccgggatgccagaagcaaacctggcggcagcgcaaaagatg

SEQ ID NO: 193714 - DNA, 103 bp, Artificial Sequence
  Synthetic Polynucleotide
taatacgactcactatagggaaggcactggggatgggccgcagcacgtcgaacagaggagacgacgtatggcggcccataacctggcggcagcgcaaaagatg

SEQ ID NO: 193715 - DNA, 103 bp, Artificial Sequence
  Synthetic Polynucleotide
taatacgactcactatagggcgcttgggtcaaggcactggggatgggccgaacagaggagacggcccatgcccagtgccaacctggcggcagcgcaaaagatg

SEQ ID NO: 193716 - DNA, 103 bp, Artificial Sequence
  Synthetic Polynucleotide
taatacgactcactatagggagttccggatcgcttgggtcaaggcactggaacagaggagaccagtgatgtgacccaagaacctggcggcagcgcaaaagatg

SEQ ID NO: 193717 - DNA, 103 bp, Artificial Sequence
  Synthetic Polynucleotide
taatacgactcactatagggctcttggcaaagttccggatcgcttgggtcaacagaggagagacccaatggatccggaaaacctggcggcagcgcaaaagatg

SEQ ID NO: 193718 - DNA, 103 bp, Artificial Sequence
  Synthetic Polynucleotide
taatacgactcactataggggctctccaggctcttggcaaagttccggataacagaggagaatccggatgtttgccaagaacctggcggcagcgcaaaagatg

SEQ ID NO: 193719 - DNA, 103 bp, Artificial Sequence
  Synthetic Polynucleotide
taatacgactcactataggggggtgagccagctctccaggctcttggcaaaacagaggagattgccaatggcctggagaaacctggcggcagcgcaaaagatg

SEQ ID NO: 193720 - DNA, 103 bp, Artificial Sequence
  Synthetic Polynucleotide
taatacgactcactatagggaccatggcgtgggtgagccagctctccaggaacagaggagacctggaatgctggctcacaacctggcggcagcgcaaaagatg

SEQ ID NO: 193721 - DNA, 103 bp, Artificial Sequence
  Synthetic Polynucleotide
taatacgactcactatagggggggatgttgaccatggcgtgggtgagccaaacagaggagatggctcatgcacgccatgaacctggcggcagcgcaaaagatg

SEQ ID NO: 193722 - DNA, 103 bp, Artificial Sequence
  Synthetic Polynucleotide
taatacgactcactataggggcatctcctcggggatgttgaccatggcgtaacagaggagaacgccaatgtcaacatccaacctggcggcagcgcaaaagatg

SEQ ID NO: 193723 - DNA, 103 bp, Artificial Sequence
  Synthetic Polynucleotide
taatacgactcactatagggttcacccgcagcatctcctcggggatgttgaacagaggagacaacatatgcgaggagataacctggcggcagcgcaaaagatg

SEQ ID NO: 193724 - DNA, 103 bp, Artificial Sequence
  Synthetic Polynucleotide
taatacgactcactatagggagccgggagctccgtcacgtactgcttctgaacagaggagacagaagatgtacgtgacgaacctggcggcagcgcaaaagatg

SEQ ID NO: 193725 - DNA, 103 bp, Artificial Sequence
  Synthetic Polynucleotide
taatacgactcactatagggcgcggccaccttcacccgcagcatctcctcaacagaggagagaggagatgctgcgggtgaacctggcggcagcgcaaaagatg

SEQ ID NO: 193726 - DNA, 103 bp, Artificial Sequence
  Synthetic Polynucleotide
taatacgactcactatagggaggcgccagccgcggccaccttcacccgcaaacagaggagatgcgggatgaggtggccgaacctggcggcagcgcaaaagatg

SEQ ID NO: 193727 - DNA, 103 bp, Artificial Sequence
  Synthetic Polynucleotide
taatacgactcactataggggtctgcgcgaaggcgccagccgcggccaccaacagaggagaggtggcatgggctggcgcaacctggcggcagcgcaaaagatg

SEQ ID NO: 193728 - DNA, 103 bp, Artificial Sequence
  Synthetic Polynucleotide
taatacgactcactataggggcgccgcagtgtctgcgcgaaggcgccagcaacagaggagagctggcatgttcgcgcagaacctggcggcagcgcaaaagatg

SEQ ID NO: 193729 - DNA, 103 bp, Artificial Sequence
  Synthetic Polynucleotide
taatacgactcactataggggcgacgtgtagcgccgcagtgtctgcgcgaaacagaggagatcgcgcatgcactgcggcaacctggcggcagcgcaaaagatg

SEQ ID NO: 193730 - DNA, 103 bp, Artificial Sequence
  Synthetic Polynucleotide
taatacgactcactatagggaggtggttgagcgacgtgtagcgccgcagtaacagaggagaactgcgatgctacacgtcaacctggcggcagcgcaaaagatg

SEQ ID NO: 193731 - DNA, 103 bp, Artificial Sequence
  Synthetic Polynucleotide
taatacgactcactatagggcgcctgcgccaggtggttgagcgacgtgtaaacagaggagatacacgatgctcaaccacaacctggcggcagcgcaaaagatg

SEQ ID NO: 193732 - DNA, 103 bp, Artificial Sequence
  Synthetic Polynucleotide
taatacgactcactatagggcagcgcgcgccgcctgcgccaggtggttgaaacagaggagatcaaccatgtggcgcaggaacctggcggcagcgcaaaagatg

SEQ ID NO: 193733 - DNA, 103 bp, Artificial Sequence
  Synthetic Polynucleotide
taatacgactcactatagggttctgcagcacagcgcgcgccgcctgcgccaacagaggagaggcgcaatgggcgcgcgcaacctggcggcagcgcaaaagatg

SEQ ID NO: 193734 - DNA, 103 bp, Artificial Sequence
  Synthetic Polynucleotide
taatacgactcactatagggctgtgcggtgttctgcagcacagcgcgcgcaacagaggagagcgcgcatggtgctgcagaacctggcggcagcgcaaaagatg

SEQ ID NO: 193735 - DNA, 103 bp, Artificial Sequence
  Synthetic Polynucleotide
taatacgactcactataggggtgcgggtacagccgggagctccgtcacgtaacagaggagaacgtgaatgagctcccggaacctggcggcagcgcaaaagatg

SEQ ID NO: 193736 - DNA, 103 bp, Artificial Sequence
  Synthetic Polynucleotide
taatacgactcactatagggtctggttgatctgtgcggtgttctgcagcaaacagaggagatgctgcatgacaccgcacaacctggcggcagcgcaaaagatg

SEQ ID NO: 193737 - DNA, 103 bp, Artificial Sequence
  Synthetic Polynucleotide
taatacgactcactatagggtcgctcagcatctggttgatctgtgcggtgaacagaggagacaccgcatggatcaaccaaacctggcggcagcgcaaaagatg

SEQ ID NO: 193738 - DNA, 103 bp, Artificial Sequence
  Synthetic Polynucleotide
taatacgactcactataggggcggttgaggtcgctcagcatctggttgataacagaggagaatcaacatgatgctgagcaacctggcggcagcgcaaaagatg

SEQ ID NO: 193739 - DNA, 103 bp, Artificial Sequence
  Synthetic Polynucleotide
taatacgactcactatagggcgaagtccacgcggttgaggtcgctcagcaaacagaggagatgctgaatgacctcaaccaacctggcggcagcgcaaaagatg

SEQ ID NO: 193740 - DNA, 103 bp, Artificial Sequence
  Synthetic Polynucleotide
taatacgactcactatagggtgcacgttggcgaagtccacgcggttgaggaacagaggagacctcaaatgcgtggacttaacctggcggcagcgcaaaagatg

SEQ ID NO: 193741 - DNA, 103 bp, Artificial Sequence
  Synthetic Polynucleotide
taatacgactcactatagggggcctgctcctgcacgttggcgaagtccacaacagaggagagtggacatggccaacgtgaacctggcggcagcgcaaaagatg

SEQ ID NO: 193742 - DNA, 103 bp, Artificial Sequence
  Synthetic Polynucleotide
taatacgactcactatagggacacccacgaggcctgctcctgcacgttggaacagaggagaccaacgatgaggagcaggaacctggcggcagcgcaaaagatg

SEQ ID NO: 193743 - DNA, 103 bp, Artificial Sequence
  Synthetic Polynucleotide
taatacgactcactatagggtcgcagcggcacacccacgaggcctgctccaacagaggagaggagcaatgctcgtgggtaacctggcggcagcgcaaaagatg

SEQ ID NO: 193744 - DNA, 103 bp, Artificial Sequence
  Synthetic Polynucleotide
taatacgactcactatagggcacgcggtcctcgcagcggcacacccacgaaacagaggagatcgtggatgtgccgctgcaacctggcggcagcgcaaaagatg

SEQ ID NO: 193745 - DNA, 103 bp, Artificial Sequence
  Synthetic Polynucleotide
taatacgactcactataggggccgctgcaccacgcggtcctcgcagcggcaacagaggagagccgctatgaggaccgcgaacctggcggcagcgcaaaagatg

SEQ ID NO: 193746 - DNA, 103 bp, Artificial Sequence
  Synthetic Polynucleotide
taatacgactcactatagggggctgcgagggtgcgggtacagccgggagcaacagaggagagctcccatgtgtacccgcaacctggcggcagcgcaaaagatg

SEQ ID NO: 193747 - DNA, 103 bp, Artificial Sequence
  Synthetic Polynucleotide
taatacgactcactatagggtcctgctccagccgctgcaccacgcggtccaacagaggagaggaccgatgggtgcagcgaacctggcggcagcgcaaaagatg

SEQ ID NO: 193748 - DNA, 103 bp, Artificial Sequence
  Synthetic Polynucleotide
taatacgactcactatagggcaccttgaagtcctgctccagccgctgcacaacagaggagagtgcagatgctggagcagaacctggcggcagcgcaaaagatg

SEQ ID NO: 193749 - DNA, 103 bp, Artificial Sequence
  Synthetic Polynucleotide
taatacgactcactataggggctgcagcgtcaccttgaagtcctgctccaaacagaggagatggagcatgacttcaaggaacctggcggcagcgcaaaagatg

SEQ ID NO: 193750 - DNA, 103 bp, Artificial Sequence
  Synthetic Polynucleotide
taatacgactcactataggggagttctgctgctgcagcgtcaccttgaagaacagaggagacttcaaatggacgctgcaaacctggcggcagcgcaaaagatg

SEQ ID NO: 193751 - DNA, 103 bp, Artificial Sequence
  Synthetic Polynucleotide
taatacgactcactatagggctgctccagcgagttctgctgctgcagcgtaacagaggagaacgctgatgcagcagaacaacctggcggcagcgcaaaagatg

SEQ ID NO: 193752 - DNA, 103 bp, Artificial Sequence
  Synthetic Polynucleotide
taatacgactcactatagggaggccgcccactgctccagcgagttctgctaacagaggagaagcagaatgcgctggagcaacctggcggcagcgcaaaagatg

SEQ ID NO: 193753 - DNA, 103 bp, Artificial Sequence
  Synthetic Polynucleotide
taatacgactcactatagggccgtccagccaggccgcccactgctccagcaacagaggagagctggaatggtgggcggcaacctggcggcagcgcaaaagatg

SEQ ID NO: 193754 - DNA, 103 bp, Artificial Sequence
  Synthetic Polynucleotide
taatacgactcactataggggctcaccacgccgtccagccaggccgcccaaacagaggagatgggcgatgtggctggacaacctggcggcagcgcaaaagatg

SEQ ID NO: 193755 - DNA, 103 bp, Artificial Sequence
  Synthetic Polynucleotide
taatacgactcactatagggtgagcacctggctcaccacgccgtccagccaacagaggagaggctggatggcgtggtgaaacctggcggcagcgcaaaagatg

SEQ ID NO: 193756 - DNA, 103 bp, Artificial Sequence
  Synthetic Polynucleotide
taatacgactcactatagggtggtagggcttgagcacctggctcaccacgaacagaggagacgtggtatgccaggtgctaacctggcggcagcgcaaaagatg

SEQ ID NO: 193757 - DNA, 103 bp, Artificial Sequence
  Synthetic Polynucleotide
taatacgactcactatagggtgcaccggttggctgcgagggtgcgggtacaacagaggagagtacccatgccctcgcagaacctggcggcagcgcaaaagatg

SEQ ID NO: 193758 - DNA, 103 bp, Artificial Sequence
  Synthetic Polynucleotide
taatacgactcactatagggggcgctgccctggtagggcttgagcacctgaacagaggagacaggtgatgaagccctacaacctggcggcagcgcaaaagatg

SEQ ID NO: 193759 - DNA, 103 bp, Artificial Sequence
  Synthetic Polynucleotide
taatacgactcactatagggtggggaagccggcgctgccctggtagggctaacagaggagaagccctatgagggcagcgaacctggcggcagcgcaaaagatg

SEQ ID NO: 193760 - DNA, 103 bp, Artificial Sequence
  Synthetic Polynucleotide
taatacgactcactatagggttggcggccttggggaagccggcgctgcccaacagaggagagggcagatgcggcttcccaacctggcggcagcgcaaaagatg

SEQ ID NO: 193761 - DNA, 103 bp, Artificial Sequence
  Synthetic Polynucleotide
taatacgactcactataggggaggaagagcttggcggccttggggaagccaacagaggagaggcttcatgaaggccgccaacctggcggcagcgcaaaagatg

SEQ ID NO: 193762 - DNA, 103 bp, Artificial Sequence
  Synthetic Polynucleotide
taatacgactcactatagggaccacttgaggaggaagagcttggcggcctaacagaggagaaggccgatgagctcttccaacctggcggcagcgcaaaagatg

SEQ ID NO: 193763 - DNA, 103 bp, Artificial Sequence
  Synthetic Polynucleotide
taatacgactcactatagggctgtagaaggaccacttgaggaggaagagcaacagaggagagctcttatgcctcaagtgaacctggcggcagcgcaaaagatg

SEQ ID NO: 193764 - DNA, 103 bp, Artificial Sequence
  Synthetic Polynucleotide
taatacgactcactatagggcaccatggagctgtagaaggaccacttgagaacagaggagactcaagatgtccttctacaacctggcggcagcgcaaaagatg

SEQ ID NO: 193765 - DNA, 103 bp, Artificial Sequence
  Synthetic Polynucleotide
taatacgactcactatagggggtcccggatcaccatggagctgtagaaggaacagaggagaccttctatggctccatggaacctggcggcagcgcaaaagatg

SEQ ID NO: 193766 - DNA, 103 bp, Artificial Sequence
  Synthetic Polynucleotide
taatacgactcactatagggcgcagggtcaggtcccggatcaccatggagaacagaggagactccatatggatccgggaaacctggcggcagcgcaaaagatg

SEQ ID NO: 193767 - DNA, 103 bp, Artificial Sequence
  Synthetic Polynucleotide
taatacgactcactatagggggcggcgctgcgcagggtcaggtcccggataacagaggagaatccggatgctgaccctgaacctggcggcagcgcaaaagatg

SEQ ID NO: 193768 - DNA, 103 bp, Artificial Sequence
  Synthetic Polynucleotide
taatacgactcactatagggaaggggtgggtgcaccggttggctgcgaggaacagaggagacctcgcatgcaaccggtgaacctggcggcagcgcaaaagatg

SEQ ID NO: 193769 - DNA, 103 bp, Artificial Sequence
  Synthetic Polynucleotide
taatacgactcactatagggaaccgaagctggcggcgctgcgcagggtcaaacagaggagatgacccatggcagcgccgaacctggcggcagcgcaaaagatg

SEQ ID NO: 193770 - DNA, 103 bp, Artificial Sequence
  Synthetic Polynucleotide
taatacgactcactatagggaggtggaaggaaccgaagctggcggcgctgaacagaggagacagcgcatgcagcttcggaacctggcggcagcgcaaaagatg

SEQ ID NO: 193771 - DNA, 103 bp, Artificial Sequence
  Synthetic Polynucleotide
taatacgactcactatagggcagccggatgaggtggaaggaaccgaagctaacagaggagaagcttcatgtccttccacaacctggcggcagcgcaaaagatg

SEQ ID NO: 193772 - DNA, 103 bp, Artificial Sequence
  Synthetic Polynucleotide
taatacgactcactatagggcgtcgtagagcagccggatgaggtggaaggaacagaggagaccttccatgtcatccggcaacctggcggcagcgcaaaagatg

SEQ ID NO: 193773 - DNA, 103 bp, Artificial Sequence
  Synthetic Polynucleotide
taatacgactcactatagggtacatgtactcgtcgtagagcagccggatgaacagaggagacatccgatggctctacgaaacctggcggcagcgcaaaagatg

SEQ ID NO: 193774 - DNA, 103 bp, Artificial Sequence
  Synthetic Polynucleotide
taatacgactcactataggggatcaggtagtacatgtactcgtcgtagagaacagaggagactctacatggagtacatgaacctggcggcagcgcaaaagatg

SEQ ID NO: 193775 - DNA, 103 bp, Artificial Sequence
  Synthetic Polynucleotide
taatacgactcactatagggcgcggtgctcgatcaggtagtacatgtactaacagaggagaagtacaatgactacctgaaacctggcggcagcgcaaaagatg

SEQ ID NO: 193776 - DNA, 103 bp, Artificial Sequence
  Synthetic Polynucleotide
taatacgactcactataggggcctgggctacgcggtgctcgatcaggtagaacagaggagactacctatgcgagcaccgaacctggcggcagcgcaaaagatg

SEQ ID NO: 193777 - DNA, 103 bp, Artificial Sequence
  Synthetic Polynucleotide
taatacgactcactatagggctcgcccttggcctgggctacgcggtgctcaacagaggagagagcacatggtagcccagaacctggcggcagcgcaaaagatg

SEQ ID NO: 193778 - DNA, 103 bp, Artificial Sequence
  Synthetic Polynucleotide
taatacgactcactatagggcgatgggggtctcgcccttggcctgggctaaacagaggagatagcccatgccaagggcgaacctggcggcagcgcaaaagatg

SEQ ID NO: 193779 - DNA, 103 bp, Artificial Sequence
  Synthetic Polynucleotide
taatacgactcactatagggggtgcaggcgaaggggtgggtgcaccggttaacagaggagaaaccggatgacccaccccaacctggcggcagcgcaaaagatg

SEQ ID NO: 193780 - DNA, 103 bp, Artificial Sequence
  Synthetic Polynucleotide
taatacgactcactatagggcccatgacggcgatgggggtctcgcccttgaacagaggagacaagggatggacccccataacctggcggcagcgcaaaagatg

SEQ ID NO: 193781 - DNA, 103 bp, Artificial Sequence
  Synthetic Polynucleotide
taatacgactcactatagggggcgaactcgcccatgacggcgatgggggtaacagaggagaacccccatggccgtcatgaacctggcggcagcgcaaaagatg

SEQ ID NO: 193782 - DNA, 103 bp, Artificial Sequence
  Synthetic Polynucleotide
taatacgactcactatagggtggccagattggcgaactcgcccatgacggaacagaggagaccgtcaatggcgagttcgaacctggcggcagcgcaaaagatg

SEQ ID NO: 193783 - DNA, 103 bp, Artificial Sequence
  Synthetic Polynucleotide
taatacgactcactatagggttcagggaggtggccagattggcgaactcgaacagaggagacgagttatgcaatctggcaacctggcggcagcgcaaaagatg

SEQ ID NO: 193784 - DNA, 103 bp, Artificial Sequence
  Synthetic Polynucleotide
taatacgactcactataggggtccagggggttcagggaggtggccagattaacagaggagaaatctgatgacctccctgaacctggcggcagcgcaaaagatg

SEQ ID NO: 193785 - DNA, 103 bp, Artificial Sequence
  Synthetic Polynucleotide
taatacgactcactatagggctttgtcggggtccagggggttcagggaggaacagaggagacctcccatgaccccctggaacctggcggcagcgcaaaagatg

SEQ ID NO: 193786 - DNA, 103 bp, Artificial Sequence
  Synthetic Polynucleotide
taatacgactcactatagggtcctcctcgtctttgtcggggtccagggggaacagaggagaccccctatgccccgacaaaacctggcggcagcgcaaaagatg

SEQ ID NO: 193787 - DNA, 103 bp, Artificial Sequence
  Synthetic Polynucleotide
taatacgactcactatagggctcctcttcttcctcctcgtctttgtcgggaacagaggagacccgacatggacgaggagaacctggcggcagcgcaaaagatg

SEQ ID NO: 193788 - DNA, 103 bp, Artificial Sequence
  Synthetic Polynucleotide
taatacgactcactatagggcgctctcctcctcctcttcttcctcctcgtaacagaggagaacgaggatgaagaagaggaacctggcggcagcgcaaaagatg

SEQ ID NO: 193789 - DNA, 103 bp, Artificial Sequence
  Synthetic Polynucleotide
taatacgactcactatagggagctcgtcctcgctctcctcctcctcttctaacagaggagaagaagaatgggaggagagaacctggcggcagcgcaaaagatg

SEQ ID NO: 193790 - DNA, 103 bp, Artificial Sequence
  Synthetic Polynucleotide
taatacgactcactataggggtactgctggggtgcaggcgaaggggtgggaacagaggagacccaccatgtcgcctgcaaacctggcggcagcgcaaaagatg

SEQ ID NO: 193791 - DNA, 103 bp, Artificial Sequence
  Synthetic Polynucleotide
taatacgactcactataggggtcctgcggcagctcgtcctcgctctcctcaacagaggagagaggagatggaggacgagaacctggcggcagcgcaaaagatg

SEQ ID NO: 193792 - DNA, 103 bp, Artificial Sequence
  Synthetic Polynucleotide
taatacgactcactatagggccagtgagatgtcctgcggcagctcgtcctaacagaggagaaggacgatgtgccgcaggaacctggcggcagcgcaaaagatg

SEQ ID NO: 193793 - DNA, 103 bp, Artificial Sequence
  Synthetic Polynucleotide
taatacgactcactatagggccgccagccgccagtgagatgtcctgcggcaacagaggagagccgcaatgcatctcactaacctggcggcagcgcaaaagatg

SEQ ID NO: 193794 - DNA, 103 bp, Artificial Sequence
  Synthetic Polynucleotide
taatacgactcactataggggggtgactcgccgccagccgccagtgagataacagaggagaatctcaatggcggctggcaacctggcggcagcgcaaaagatg

SEQ ID NO: 193795 - DNA, 103 bp, Artificial Sequence
  Synthetic Polynucleotide
taatacgactcactatagggggcccagcgcgggtgactcgccgccagccgaacagaggagacggctgatggcgagtcacaacctggcggcagcgcaaaagatg

SEQ ID NO: 193796 - DNA, 103 bp, Artificial Sequence
  Synthetic Polynucleotide
taatacgactcactatagggagggtctccgggcccagcgcgggtgactcgaacagaggagacgagtcatgcgcgctgggaacctggcggcagcgcaaaagatg

SEQ ID NO: 193797 - DNA, 103 bp, Artificial Sequence
  Synthetic Polynucleotide
taatacgactcactatagggcggcggctccagggtctccgggcccagcgcaacagaggagagcgctgatgccggagaccaacctggcggcagcgcaaaagatg

SEQ ID NO: 193798 - DNA, 103 bp, Artificial Sequence
  Synthetic Polynucleotide
taatacgactcactatagggccagcttggccggcggctccagggtctccgaacagaggagacggagaatgtggagccgcaacctggcggcagcgcaaaagatg

SEQ ID NO: 193799 - DNA, 103 bp, Artificial Sequence
  Synthetic Polynucleotide
taatacgactcactatagggtcagtccgcgccagcttggccggcggctccaacagaggagaggagccatgggccaagctaacctggcggcagcgcaaaagatg

SEQ ID NO: 193800 - DNA, 103 bp, Artificial Sequence
  Synthetic Polynucleotide
taatacgactcactataggggccgcgcgcgtcagtccgcgccagcttggcaacagaggagagccaagatggcgcggactaacctggcggcagcgcaaaagatg

SEQ ID NO: 193801 - DNA, 103 bp, Artificial Sequence
  Synthetic Polynucleotide
taatacgactcactatagggtgaccacgatgtactgctggggtgcaggcgaacagaggagacgcctgatgcccagcagtaacctggcggcagcgcaaaagatg

SEQ ID NO: 193802 - DNA, 103 bp, Artificial Sequence
  Synthetic Polynucleotide
taatacgactcactataggggcacgaagaggccgcgcgcgtcagtccgcgaacagaggagacgcggaatgacgcgcgcgaacctggcggcagcgcaaaagatg

SEQ ID NO: 193803 - DNA, 103 bp, Artificial Sequence
  Synthetic Polynucleotide
taatacgactcactatagggggcagcgcctgcacgaagaggccgcgcgcgaacagaggagacgcgcgatgcctcttcgtaacctggcggcagcgcaaaagatg

SEQ ID NO: 193804 - DNA, 103 bp, Artificial Sequence
  Synthetic Polynucleotide
taatacgactcactatagggttagctggagggcagcgcctgcacgaagagaacagaggagactcttcatgcaggcgctgaacctggcggcagcgcaaaagatg

SEQ ID NO: 193805 - DNA, 103 bp, Artificial Sequence
  Synthetic Polynucleotide
taatacgactcactatagggtgggatggtggcggggctgcctgtagctcaaacagaggagatgagctatgggcagccccaacctggcggcagcgcaaaagatg

SEQ ID NO: 193806 - DNA, 103 bp, Artificial Sequence
  Synthetic Polynucleotide
taatacgactcactatagggtcagagacagtgaccacgatgtactgctggaacagaggagaccagcaatgcatcgtggtaacctggcggcagcgcaaaagatg

SEQ ID NO: 193807 - DNA, 103 bp, Artificial Sequence
  Synthetic Polynucleotide
taatacgactcactatagggcatggcaccttcagagacagtgaccacgataacagaggagaatcgtgatgactgtctctaacctggcggcagcgcaaaagatg

SEQ ID NO: 193808 - DNA, 103 bp, Artificial Sequence
  Synthetic Polynucleotide
taatacgactcactatagggcgctggcccgcatggcaccttcagagacagaacagaggagactgtctatgaaggtgccaaacctggcggcagcgcaaaagatg

SEQ ID NO: 193809 - DNA, 103 bp, Artificial Sequence
  Synthetic Polynucleotide
taatacgactcactataggggacactgtctcgctggcccgcatggcacctaacagaggagaaggtgcatggcgggccagaacctggcggcagcgcaaaagatg

SEQ ID NO: 193810 - DNA, 103 bp, Artificial Sequence
  Synthetic Polynucleotide
taatacgactcactataggggctggcctccgacactgtctcgctggcccgaacagaggagacgggccatggagacagtgaacctggcggcagcgcaaaagatg

SEQ ID NO: 193811 - DNA, 103 bp, Artificial Sequence
  Synthetic Polynucleotide
taatacgactcactatagggtggagccggggctggcctccgacactgtctaacagaggagaagacagatgcggaggccaaacctggcggcagcgcaaaagatg

SEQ ID NO: 193812 - DNA, 103 bp, Artificial Sequence
  Synthetic Polynucleotide
taatacgactcactatagggtggctggcggtggagccggggctggcctccaacagaggagaggaggcatgccccggctcaacctggcggcagcgcaaaagatg

SEQ ID NO: 193813 - DNA, 103 bp, Artificial Sequence
  Synthetic Polynucleotide
taatacgactcactatagggaacgccggtctggctggcggtggagccgggaacagaggagacccggcatgaccgccagcaacctggcggcagcgcaaaagatg

SEQ ID NO: 193814 - DNA, 103 bp, Artificial Sequence
  Synthetic Polynucleotide
taatacgactcactatagggcctgagtaggaacgccggtctggctggcggaacagaggagaccgccaatgagaccggcgaacctggcggcagcgcaaaagatg

SEQ ID NO: 193815 - DNA, 103 bp, Artificial Sequence
  Synthetic Polynucleotide
taatacgactcactatagggtgctgaaccacctgagtaggaacgccggtcaacagaggagagaccggatgtcctactcaaacctggcggcagcgcaaaagatg

SEQ ID NO: 193816 - DNA, 103 bp, Artificial Sequence
  Synthetic Polynucleotide
taatacgactcactatagggctgtggcggctgggatggtggcggggctgcaacagaggagagcagccatgccaccatccaacctggcggcagcgcaaaagatg

SEQ ID NO: 193817 - DNA, 103 bp, Artificial Sequence
  Synthetic Polynucleotide
taatacgactcactataggggccctgcacctgctgaaccacctgagtaggaacagaggagacctactatggtggttcagaacctggcggcagcgcaaaagatg

SEQ ID NO: 193818 - DNA, 103 bp, Artificial Sequence
  Synthetic Polynucleotide
taatacgactcactataggggctgctgggtgccctgcacctgctgaaccaaacagaggagatggttcatgaggtgcaggaacctggcggcagcgcaaaagatg

SEQ ID NO: 193819 - DNA, 103 bp, Artificial Sequence
  Synthetic Polynucleotide
taatacgactcactatagggaccagcagccgctgctgggtgccctgcaccaacagaggagaggtgcaatgcacccagcaaacctggcggcagcgcaaaagatg

SEQ ID NO: 193820 - DNA, 103 bp, Artificial Sequence
  Synthetic Polynucleotide
taatacgactcactataggggctcgtctggaccagcagccgctgctgggtaacagaggagaacccagatgcggctgctgaacctggcggcagcgcaaaagatg

SEQ ID NO: 193821 - DNA, 103 bp, Artificial Sequence
  Synthetic Polynucleotide
taatacgactcactatagggtggcctgcacgctcgtctggaccagcagccaacagaggagaggctgcatgtccagacgaaacctggcggcagcgcaaaagatg

SEQ ID NO: 193822 - DNA, 103 bp, Artificial Sequence
  Synthetic Polynucleotide
taatacgactcactatagggtggcctggcttggcctgcacgctcgtctggaacagaggagaccagacatgcgtgcaggcaacctggcggcagcgcaaaagatg

SEQ ID NO: 193823 - DNA, 103 bp, Artificial Sequence
  Synthetic Polynucleotide
taatacgactcactataggggggcgacacgtggcctggcttggcctgcacaacagaggagagtgcagatgaagccaggcaacctggcggcagcgcaaaagatg

SEQ ID NO: 193824 - DNA, 103 bp, Artificial Sequence
  Synthetic Polynucleotide
taatacgactcactatagggtcagctggaggggcgacacgtggcctggctaacagaggagaagccagatgacgtgtcgcaacctggcggcagcgcaaaagatg

SEQ ID NO: 193825 - DNA, 103 bp, Artificial Sequence
  Synthetic Polynucleotide
taatacgactcactatagggtggatgttggtcagctggaggggcgacacgaacagaggagacgtgtcatgcctccagctaacctggcggcagcgcaaaagatg

SEQ ID NO: 193826 - DNA, 103 bp, Artificial Sequence
  Synthetic Polynucleotide
taatacgactcactatagggctggggcacttggatgttggtcagctggagaacagaggagactccagatgaccaacatcaacctggcggcagcgcaaaagatg

SEQ ID NO: 193827 - DNA, 103 bp, Artificial Sequence
  Synthetic Polynucleotide
taatacgactcactataggggtggcggggcctgtggcggctgggatggtgaacagaggagacaccatatgagccgccacaacctggcggcagcgcaaaagatg

SEQ ID NO: 193828 - DNA, 103 bp, Artificial Sequence
  Synthetic Polynucleotide
taatacgactcactataggggaagagcctgctggggcacttggatgttggaacagaggagaccaacaatgaagtgccccaacctggcggcagcgcaaaagatg

SEQ ID NO: 193829 - DNA, 103 bp, Artificial Sequence
  Synthetic Polynucleotide
taatacgactcactatagggcgctgcgtgggaagagcctgctggggcactaacagaggagaagtgccatggcaggctctaacctggcggcagcgcaaaagatg

SEQ ID NO: 193830 - DNA, 103 bp, Artificial Sequence
  Synthetic Polynucleotide
taatacgactcactatagggcaccaccagacgctgcgtgggaagagcctgaacagaggagacaggctatgcccacgcagaacctggcggcagcgcaaaagatg

SEQ ID NO: 193831 - DNA, 103 bp, Artificial Sequence
  Synthetic Polynucleotide
taatacgactcactatagggctgcgctctgcaccaccagacgctgcgtggaacagaggagaccacgcatggtctggtggaacctggcggcagcgcaaaagatg

SEQ ID NO: 193832 - DNA, 103 bp, Artificial Sequence
  Synthetic Polynucleotide
taatacgactcactatagggctgcctggggctgcgctctgcaccaccagaaacagaggagatctggtatggcagagcgcaacctggcggcagcgcaaaagatg

SEQ ID NO: 193833 - DNA, 103 bp, Artificial Sequence
  Synthetic Polynucleotide
taatacgactcactataggggccacctttgctgcctggggctgcgctctgaacagaggagacagagcatggccccaggcaacctggcggcagcgcaaaagatg

SEQ ID NO: 193834 - DNA, 103 bp, Artificial Sequence
  Synthetic Polynucleotide
taatacgactcactataggggggagacctggccacctttgctgcctggggaacagaggagaccccagatggcaaaggtgaacctggcggcagcgcaaaagatg

SEQ ID NO: 193835 - DNA, 103 bp, Artificial Sequence
  Synthetic Polynucleotide
taatacgactcactatagggtggaccgtcagggagacctggccacctttgaacagaggagacaaaggatgccaggtctcaacctggcggcagcgcaaaagatg

SEQ ID NO: 193836 - DNA, 103 bp, Artificial Sequence
  Synthetic Polynucleotide
taatacgactcactatagggctgggtaccatggaccgtcagggagacctgaacagaggagacaggtcatgctgacggtcaacctggcggcagcgcaaaagatg

SEQ ID NO: 193837 - DNA, 103 bp, Artificial Sequence
  Synthetic Polynucleotide
taatacgactcactatagggagtgcacctgctgggtaccatggaccgtcaaacagaggagatgacggatgatggtacccaacctggcggcagcgcaaaagatg

SEQ ID NO: 193838 - DNA, 103 bp, Artificial Sequence
  Synthetic Polynucleotide
taatacgactcactatagggggctgggcttgtggcggggcctgtggcggcaacagaggagagccgccatgggccccgccaacctggcggcagcgcaaaagatg

SEQ ID NO: 193839 - DNA, 103 bp, Artificial Sequence
  Synthetic Polynucleotide
taatacgactcactatagggtctgggggcgagtgcacctgctgggtaccaaacagaggagatggtacatggcaggtgcaaacctggcggcagcgcaaaagatg

SEQ ID NO: 193840 - DNA, 103 bp, Artificial Sequence
  Synthetic Polynucleotide
taatacgactcactatagggcggcgactgctctgggggcgagtgcacctgaacagaggagacaggtgatgtcgcccccaaacctggcggcagcgcaaaagatg

SEQ ID NO: 193841 - DNA, 103 bp, Artificial Sequence
  Synthetic Polynucleotide
taatacgactcactatagggtggcctgcaccggcgactgctctgggggcgaacagaggagacgccccatgagcagtcgcaacctggcggcagcgcaaaagatg

SEQ ID NO: 193842 - DNA, 103 bp, Artificial Sequence
  Synthetic Polynucleotide
taatacgactcactataggggaagagctgttggcctgcaccggcgactgcaacagaggagagcagtcatgggtgcaggcaacctggcggcagcgcaaaagatg

SEQ ID NO: 193843 - DNA, 103 bp, Artificial Sequence
  Synthetic Polynucleotide
taatacgactcactatagggtgtcttgctggaagagctgttggcctgcacaacagaggagagtgcagatgaacagctctaacctggcggcagcgcaaaagatg

SEQ ID NO: 193844 - DNA, 103 bp, Artificial Sequence
  Synthetic Polynucleotide
taatacgactcactataggggggccccggctgtcttgctggaagagctgtaacagaggagaacagctatgccagcaagaaacctggcggcagcgcaaaagatg

SEQ ID NO: 193845 - DNA, 103 bp, Artificial Sequence
  Synthetic Polynucleotide
taatacgactcactataggggtgcccgtgggggccccggctgtcttgctgaacagaggagacagcaaatgagccggggcaacctggcggcagcgcaaaagatg

SEQ ID NO: 193846 - DNA, 103 bp, Artificial Sequence
  Synthetic Polynucleotide
taatacgactcactatagggctgtggcactgtgcccgtgggggccccggcaacagaggagagccgggatgcccacgggcaacctggcggcagcgcaaaagatg

SEQ ID NO: 193847 - DNA, 103 bp, Artificial Sequence
  Synthetic Polynucleotide
taatacgactcactatagggcctgcagctgctgtggcactgtgcccgtggaacagaggagaccacggatgcagtgccacaacctggcggcagcgcaaaagatg

SEQ ID NO: 193848 - DNA, 103 bp, Artificial Sequence
  Synthetic Polynucleotide
taatacgactcactatagggacgccgtggacctgcagctgctgtggcactaacagaggagaagtgccatggcagctgcaaacctggcggcagcgcaaaagatg

SEQ ID NO: 193849 - DNA, 103 bp, Artificial Sequence
  Synthetic Polynucleotide
taatacgactcactatagggtggcggctggggctgggcttgtggcggggcaacagaggagagccccgatgcaagcccagaacctggcggcagcgcaaaagatg

SEQ ID NO: 193850 - DNA, 103 bp, Artificial Sequence
  Synthetic Polynucleotide
taatacgactcactatagggactctgctggacgccgtggacctgcagctgaacagaggagacagctgatggtccacggcaacctggcggcagcgcaaaagatg

SEQ ID NO: 193851 - DNA, 103 bp, Artificial Sequence
  Synthetic Polynucleotide
taatacgactcactatagggtgacggggacactctgctggacgccgtggaaacagaggagatccacgatgtccagcagaaacctggcggcagcgcaaaagatg

SEQ ID NO: 193852 - DNA, 103 bp, Artificial Sequence
  Synthetic Polynucleotide
taatacgactcactatagggctctcttgggtgacggggacactctgctggaacagaggagaccagcaatgtgtccccgtaacctggcggcagcgcaaaagatg

SEQ ID NO: 193853 - DNA, 103 bp, Artificial Sequence
  Synthetic Polynucleotide
taatacgactcactataggggaccacagatctctcttgggtgacggggacaacagaggagagtccccatgacccaagagaacctggcggcagcgcaaaagatg

SEQ ID NO: 193854 - DNA, 103 bp, Artificial Sequence
  Synthetic Polynucleotide
taatacgactcactataggggagtggcctggaccacagatctctcttgggaacagaggagacccaagatggatctgtggaacctggcggcagcgcaaaagatg

SEQ ID NO: 193855 - DNA, 103 bp, Artificial Sequence
  Synthetic Polynucleotide
taatacgactcactatagggggcgcttgtggagtggcctggaccacagataacagaggagaatctgtatgccaggccacaacctggcggcagcgcaaaagatg

SEQ ID NO: 193856 - DNA, 103 bp, Artificial Sequence
  Synthetic Polynucleotide
taatacgactcactataggggccgggtttgggcgcttgtggagtggcctgaacagaggagacaggccatgccacaagcgaacctggcggcagcgcaaaagatg

SEQ ID NO: 193857 - DNA, 103 bp, Artificial Sequence
  Synthetic Polynucleotide
taatacgactcactataggggctgcaccgggccgggtttgggcgcttgtgaacagaggagacacaagatgccaaacccgaacctggcggcagcgcaaaagatg

SEQ ID NO: 193858 - DNA, 103 bp, Artificial Sequence
  Synthetic Polynucleotide
taatacgactcactatagggacggtcagcggctgcaccgggccgggtttgaacagaggagacaaaccatgcccggtgcaaacctggcggcagcgcaaaagatg

SEQ ID NO: 193859 - DNA, 103 bp, Artificial Sequence
  Synthetic Polynucleotide
taatacgactcactataggggaggccctgcacggtcagcggctgcaccggaacagaggagaccggtgatgccgctgaccaacctggcggcagcgcaaaagatg

SEQ ID NO: 193860 - DNA, 103 bp, Artificial Sequence
  Synthetic Polynucleotide
taatacgactcactataggggtggtggcggtggcggctggggctgggcttaacagaggagaaagcccatgcccagccgcaacctggcggcagcgcaaaagatg

SEQ ID NO: 193861 - DNA, 103 bp, Artificial Sequence
  Synthetic Polynucleotide
taatacgactcactatagggggactggctggaggccctgcacggtcagcgaacagaggagacgctgaatgtgcagggccaacctggcggcagcgcaaaagatg

SEQ ID NO: 193862 - DNA, 103 bp, Artificial Sequence
  Synthetic Polynucleotide
taatacgactcactatagggtgagccacgtggactggctggaggccctgcaacagaggagagcagggatgccagccagtaacctggcggcagcgcaaaagatg

SEQ ID NO: 193863 - DNA, 103 bp, Artificial Sequence
  Synthetic Polynucleotide
taatacgactcactatagggctgcacctcttgagccacgtggactggctgaacagaggagacagccaatgcacgtggctaacctggcggcagcgcaaaagatg

SEQ ID NO: 193864 - DNA, 103 bp, Artificial Sequence
  Synthetic Polynucleotide
taatacgactcactataggggctggagctgctgcacctcttgagccacgtaacagaggagaacgtggatgaagaggtgcaacctggcggcagcgcaaaagatg

SEQ ID NO: 193865 - DNA, 103 bp, Artificial Sequence
  Synthetic Polynucleotide
taatacgactcactatagggacgggcacctgctggagctgctgcacctctaacagaggagaagaggtatggcagctccaaacctggcggcagcgcaaaagatg

SEQ ID NO: 193866 - DNA, 103 bp, Artificial Sequence
  Synthetic Polynucleotide
taatacgactcactatagggcacgtgtgggacgggcacctgctggagctgaacagaggagacagctcatgcaggtgcccaacctggcggcagcgcaaaagatg

SEQ ID NO: 193867 - DNA, 103 bp, Artificial Sequence
  Synthetic Polynucleotide
taatacgactcactatagggggctggagtacacgtgtgggacgggcacctaacagaggagaaggtgcatgtcccacacgaacctggcggcagcgcaaaagatg

SEQ ID NO: 193868 - DNA, 103 bp, Artificial Sequence
  Synthetic Polynucleotide
taatacgactcactatagggtactgcacctggctggagtacacgtgtgggaacagaggagacccacaatggtactccagaacctggcggcagcgcaaaagatg

SEQ ID NO: 193869 - DNA, 103 bp, Artificial Sequence
  Synthetic Polynucleotide
taatacgactcactataggggccctccacatactgcacctggctggagtaaacagaggagatactccatgcaggtgcagaacctggcggcagcgcaaaagatg

SEQ ID NO: 193870 - DNA, 103 bp, Artificial Sequence
  Synthetic Polynucleotide
taatacgactcactatagggtggcatcgccgccctccacatactgcacctaacagaggagaaggtgcatgatgtggaggaacctggcggcagcgcaaaagatg

SEQ ID NO: 193871 - DNA, 103 bp, Artificial Sequence
  Synthetic Polynucleotide
taatacgactcactataggggccgctgggggtggtggcggtggcggctggaacagaggagaccagccatgaccgccaccaacctggcggcagcgcaaaagatg

SEQ ID NO: 193872 - DNA, 103 bp, Artificial Sequence
  Synthetic Polynucleotide
taatacgactcactataggggccgtgtagctggcatcgccgccctccacaaacagaggagatgtggaatgcggcgatgcaacctggcggcagcgcaaaagatg

SEQ ID NO: 193873 - DNA, 103 bp, Artificial Sequence
  Synthetic Polynucleotide
taatacgactcactataggggatggcactggccgtgtagctggcatcgccaacagaggagaggcgatatgagctacacgaacctggcggcagcgcaaaagatg

SEQ ID NO: 193874 - DNA, 103 bp, Artificial Sequence
  Synthetic Polynucleotide
taatacgactcactatagggtgctggaacggatggcactggccgtgtagcaacagaggagagctacaatgccagtgccaaacctggcggcagcgcaaaagatg

SEQ ID NO: 193875 - DNA, 103 bp, Artificial Sequence
  Synthetic Polynucleotide
taatacgactcactatagggtaggagtaggtgctggaacggatggcactgaacagaggagacagtgcatgccgttccagaacctggcggcagcgcaaaagatg

SEQ ID NO: 193876 - DNA, 103 bp, Artificial Sequence
  Synthetic Polynucleotide
taatacgactcactatagggcgtctcgggataggagtaggtgctggaacgaacagaggagacgttccatgacctactccaacctggcggcagcgcaaaagatg

SEQ ID NO: 193877 - DNA, 103 bp, Artificial Sequence
  Synthetic Polynucleotide
taatacgactcactatagggtgtacagcggcgtctcgggataggagtaggaacagaggagacctactatgatcccgagaaacctggcggcagcgcaaaagatg

SEQ ID NO: 193878 - DNA, 103 bp, Artificial Sequence
  Synthetic Polynucleotide
taatacgactcactataggggccgtctgcgtgtacagcggcgtctcgggaaacagaggagatcccgaatggccgctgtaaacctggcggcagcgcaaaagatg

SEQ ID NO: 193879 - DNA, 103 bp, Artificial Sequence
  Synthetic Polynucleotide
taatacgactcactataggggctggtgcttgccgtctgcgtgtacagcggaacagaggagaccgctgatgacgcagacgaacctggcggcagcgcaaaagatg

SEQ ID NO: 193880 - DNA, 103 bp, Artificial Sequence
  Synthetic Polynucleotide
taatacgactcactatagggcctcgtagtagctggtgcttgccgtctgcgaacagaggagacgcagaatgcaagcaccaaacctggcggcagcgcaaaagatg

SEQ ID NO: 193881 - DNA, 103 bp, Artificial Sequence
  Synthetic Polynucleotide
taatacgactcactataggggtgcctgcggcctcgtagtagctggtgcttaacagaggagaaagcacatgctactacgaaacctggcggcagcgcaaaagatg

SEQ ID NO: 193882 - DNA, 103 bp, Artificial Sequence
  Synthetic Polynucleotide
taatacgactcactatagggcgaatccgctccaccctcggaattctgcataacagaggagaatgcagatgtccgagggtaacctggcggcagcgcaaaagatg

SEQ ID NO: 193883 - DNA, 103 bp, Artificial Sequence
  Synthetic Polynucleotide
taatacgactcactatagggattggagctggctgcctggaccaacaccctaacagaggagaagggtgatggtccaggcaaacctggcggcagcgcaaaagatg

SEQ ID NO: 193884 - DNA, 103 bp, Artificial Sequence
  Synthetic Polynucleotide
taatacgactcactataggggacatctatgtactgctggtggtgctggctaacagaggagaagccagatgcaccagcagaacctggcggcagcgcaaaagatg

SEQ ID NO: 193885 - DNA, 103 bp, Artificial Sequence
  Synthetic Polynucleotide
taatacgactcactatagggagacgtgggagacatctatgtactgctggtaacagaggagaaccagcatgacatagatgaacctggcggcagcgcaaaagatg

SEQ ID NO: 193886 - DNA, 103 bp, Artificial Sequence
  Synthetic Polynucleotide
taatacgactcactatagggaactcggggaagacgtgggagacatctatgaacagaggagacatagaatgctcccacgtaacctggcggcagcgcaaaagatg

SEQ ID NO: 193887 - DNA, 103 bp, Artificial Sequence
  Synthetic Polynucleotide
taatacgactcactataggggggcgctgggaactcggggaagacgtgggaaacagaggagatcccacatgttccccgagaacctggcggcagcgcaaaagatg

SEQ ID NO: 193888 - DNA, 103 bp, Artificial Sequence
  Synthetic Polynucleotide
taatacgactcactatagggtgcccaggtcgggcgctgggaactcggggaaacagaggagatccccgatgtcccagcgcaacctggcggcagcgcaaaagatg

SEQ ID NO: 193889 - DNA, 103 bp, Artificial Sequence
  Synthetic Polynucleotide
taatacgactcactatagggagcaggaagctgcccaggtcgggcgctgggaacagaggagacccagcatgcgacctgggaacctggcggcagcgcaaaagatg

SEQ ID NO: 193890 - DNA, 103 bp, Artificial Sequence
  Synthetic Polynucleotide
taatacgactcactataggggccgtcctgcagcaggaagctgcccaggtcaacagaggagagacctgatgagcttcctgaacctggcggcagcgcaaaagatg

SEQ ID NO: 193891 - DNA, 103 bp, Artificial Sequence
  Synthetic Polynucleotide
taatacgactcactataggggcagtgtgacgccgtcctgcagcaggaagcaacagaggagagcttccatgtgcaggacgaacctggcggcagcgcaaaagatg

SEQ ID NO: 193892 - DNA, 103 bp, Artificial Sequence
  Synthetic Polynucleotide
taatacgactcactatagggttgacgtcgtgcagtgtgacgccgtcctgcaacagaggagagcaggaatgcgtcacactaacctggcggcagcgcaaaagatg

SEQ ID NO: 193893 - DNA, 103 bp, Artificial Sequence
  Synthetic Polynucleotide
taatacgactcactatagggctgcagggccttgacgtcgtgcagtgtgacaacagaggagagtcacaatgcacgacgtcaacctggcggcagcgcaaaagatg

SEQ ID NO: 193894 - DNA, 103 bp, Artificial Sequence
  Synthetic Polynucleotide
taatacgactcactatagggcccctttgggattggagctggctgcctggaaacagaggagatccaggatgccagctccaaacctggcggcagcgcaaaagatg

SEQ ID NO: 193895 - DNA, 103 bp, Artificial Sequence
  Synthetic Polynucleotide
taatacgactcactatagggtgtacaccagctgcagggccttgacgtcgtaacagaggagaacgacgatgaggccctgcaacctggcggcagcgcaaaagatg

SEQ ID NO: 193896 - DNA, 103 bp, Artificial Sequence
  Synthetic Polynucleotide
taatacgactcactatagggcagtgccgtctgtacaccagctgcagggccaacagaggagaggccctatggctggtgtaaacctggcggcagcgcaaaagatg

SEQ ID NO: 193897 - DNA, 103 bp, Artificial Sequence
  Synthetic Polynucleotide
taatacgactcactatagggagttgcctcgcagtgccgtctgtacaccagaacagaggagactggtgatgagacggcacaacctggcggcagcgcaaaagatg

SEQ ID NO: 193898 - DNA, 103 bp, Artificial Sequence
  Synthetic Polynucleotide
taatacgactcactatagggccacatctacagttgcctcgcagtgccgtcaacagaggagagacggcatggcgaggcaaaacctggcggcagcgcaaaagatg

SEQ ID NO: 193899 - DNA, 103 bp, Artificial Sequence
  Synthetic Polynucleotide
taatacgactcactatagggaggttcatcaccacatctacagttgcctcgaacagaggagacgaggcatgtgtagatgtaacctggcggcagcgcaaaagatg

SEQ ID NO: 193900 - DNA, 103 bp, Artificial Sequence
  Synthetic Polynucleotide
taatacgactcactataggggtggaactggaggttcatcaccacatctacaacagaggagagtagatatggtgatgaacaacctggcggcagcgcaaaagatg

SEQ ID NO: 193901 - DNA, 103 bp, Artificial Sequence
  Synthetic Polynucleotide
taatacgactcactatagggtctcgatgtagtggaactggaggttcatcaaacagaggagatgatgaatgtccagttccaacctggcggcagcgcaaaagatg

SEQ ID NO: 193902 - DNA, 103 bp, Artificial Sequence
  Synthetic Polynucleotide
taatacgactcactatagggagccacagcttctcgatgtagtggaactggaacagaggagaccagttatgctacatcgaaacctggcggcagcgcaaaagatg

SEQ ID NO: 193903 - DNA, 103 bp, Artificial Sequence
  Synthetic Polynucleotide
taatacgactcactatagggccagaaggagagccacagcttctcgatgtaaacagaggagatacatcatgaagctgtggaacctggcggcagcgcaaaagatg

SEQ ID NO: 193904 - DNA, 103 bp, Artificial Sequence
  Synthetic Polynucleotide
taatacgactcactatagggccttagagttccagaaggagagccacagctaacagaggagaagctgtatgtctccttctaacctggcggcagcgcaaaagatg

SEQ ID NO: 193905 - DNA, 103 bp, Artificial Sequence
  Synthetic Polynucleotide
taatacgactcactatagggtgcatctgggcccctttgggattggagctgaacagaggagacagctcatgtcccaaaggaacctggcggcagcgcaaaagatg

SEQ ID NO: 193906 - DNA, 103 bp, Artificial Sequence
  Synthetic Polynucleotide
taatacgactcactatagggctggaggaggccttagagttccagaaggagaacagaggagactccttatggaactctaaaacctggcggcagcgcaaaagatg

SEQ ID NO: 193907 - DNA, 103 bp, Artificial Sequence
  Synthetic Polynucleotide
taatacgactcactatagggggggccgtcgctggaggaggccttagagttaacagaggagaaactctatggcctcctccaacctggcggcagcgcaaaagatg

SEQ ID NO: 193908 - DNA, 103 bp, Artificial Sequence
  Synthetic Polynucleotide
taatacgactcactataggggaagagaggtggggccgtcgctggaggaggaacagaggagacctcctatggcgacggccaacctggcggcagcgcaaaagatg

SEQ ID NO: 193909 - DNA, 103 bp, Artificial Sequence
  Synthetic Polynucleotide
taatacgactcactatagggtcactggcaggaagagaggtggggccgtcgaacagaggagacgacggatgcacctctctaacctggcggcagcgcaaaagatg

SEQ ID NO: 193910 - DNA, 103 bp, Artificial Sequence
  Synthetic Polynucleotide
taatacgactcactatagggggggtcttcgtcactggcaggaagagaggtaacagaggagaacctctatgcctgccagtaacctggcggcagcgcaaaagatg

SEQ ID NO: 193911 - DNA, 103 bp, Artificial Sequence
  Synthetic Polynucleotide
taatacgactcactatagggcggcgccctcggggtcttcgtcactggcagaacagaggagactgccaatgacgaagaccaacctggcggcagcgcaaaagatg

SEQ ID NO: 193912 - DNA, 103 bp, Artificial Sequence
  Synthetic Polynucleotide
taatacgactcactatagggttgggcaggacggcgccctcggggtcttcgaacagaggagacgaagaatgcgagggcgcaacctggcggcagcgcaaaagatg

SEQ ID NO: 193913 - DNA, 103 bp, Artificial Sequence
  Synthetic Polynucleotide
taatacgactcactatagggaagcttgtccttgggcaggacggcgccctcaacagaggagagagggcatggtcctgcccaacctggcggcagcgcaaaagatg

SEQ ID NO: 193914 - DNA, 103 bp, Artificial Sequence
  Synthetic Polynucleotide
taatacgactcactatagggacagggagataagcttgtccttgggcaggaaacagaggagatcctgcatgaggacaagcaacctggcggcagcgcaaaagatg

SEQ ID NO: 193915 - DNA, 103 bp, Artificial Sequence
  Synthetic Polynucleotide
taatacgactcactatagggtcgcactgacacagggagataagcttgtccaacagaggagaggacaaatgtatctccctaacctggcggcagcgcaaaagatg

SEQ ID NO: 193916 - DNA, 103 bp, Artificial Sequence
  Synthetic Polynucleotide
taatacgactcactatagggggagatcggctgcatctgggcccctttgggaacagaggagacccaaaatggcccagatgaacctggcggcagcgcaaaagatg

SEQ ID NO: 193917 - DNA, 103 bp, Artificial Sequence
  Synthetic Polynucleotide
taatacgactcactataggggaggatggggtcgcactgacacagggagataacagaggagaatctccatgtgtcagtgcaacctggcggcagcgcaaaagatg

SEQ ID NO: 193918 - DNA, 103 bp, Artificial Sequence
  Synthetic Polynucleotide
taatacgactcactatagggtcatccacctgaggatggggtcgcactgacaacagaggagagtcagtatgaccccatccaacctggcggcagcgcaaaagatg

SEQ ID NO: 193919 - DNA, 103 bp, Artificial Sequence
  Synthetic Polynucleotide
taatacgactcactatagggtcgcagctcctcatccacctgaggatggggaacagaggagaccccatatgcaggtggataacctggcggcagcgcaaaagatg

SEQ ID NO: 193920 - DNA, 103 bp, Artificial Sequence
  Synthetic Polynucleotide
taatacgactcactataggggaggatgtggtcgcagctcctcatccacctaacagaggagaaggtggatgaggagctgcaacctggcggcagcgcaaaagatg

SEQ ID NO: 193921 - DNA, 103 bp, Artificial Sequence
  Synthetic Polynucleotide
taatacgactcactataggggcgcctggtagaggatgtggtcgcagctccaacagaggagaggagctatgaccacatccaacctggcggcagcgcaaaagatg

SEQ ID NO: 193922 - DNA, 103 bp, Artificial Sequence
  Synthetic Polynucleotide
taatacgactcactatagggatctccaccagcgcctggtagaggatgtggaacagaggagaccacatatgctaccaggcaacctggcggcagcgcaaaagatg

SEQ ID NO: 193923 - DNA, 103 bp, Artificial Sequence
  Synthetic Polynucleotide
taatacgactcactatagggggggatgagaatctccaccagcgcctggtaaacagaggagataccagatgctggtggagaacctggcggcagcgcaaaagatg

SEQ ID NO: 193924 - DNA, 103 bp, Artificial Sequence
  Synthetic Polynucleotide
taatacgactcactatagggtcagcacgtcggggatgagaatctccaccaaacagaggagatggtggatgttctcatccaacctggcggcagcgcaaaagatg

SEQ ID NO: 193925 - DNA, 103 bp, Artificial Sequence
  Synthetic Polynucleotide
taatacgactcactataggggggaccggcctcagcacgtcggggatgagaaacagaggagatctcatatgcgacgtgctaacctggcggcagcgcaaaagatg

SEQ ID NO: 193926 - DNA, 103 bp, Artificial Sequence
  Synthetic Polynucleotide
taatacgactcactatagggcaaggtactggggaccggcctcagcacgtcaacagaggagagacgtgatgaggccggtcaacctggcggcagcgcaaaagatg

SEQ ID NO: 193927 - DNA, 103 bp, Artificial Sequence
  Synthetic Polynucleotide
taatacgactcactatagggctctggggagggagatcggctgcatctgggaacagaggagacccagaatgagccgatctaacctggcggcagcgcaaaagatg

SEQ ID NO: 193928 - DNA, 103 bp, Artificial Sequence
  Synthetic Polynucleotide
taatacgactcactatagggtggcctgtgtcaaggtactggggaccggccaacagaggagaggccggatgccagtacctaacctggcggcagcgcaaaagatg

SEQ ID NO: 193929 - DNA, 103 bp, Artificial Sequence
  Synthetic Polynucleotide
taatacgactcactatagggaagttacggatggcctgtgtcaaggtactgaacagaggagacagtacatggacacaggcaacctggcggcagcgcaaaagatg

SEQ ID NO: 193930 - DNA, 103 bp, Artificial Sequence
  Synthetic Polynucleotide
taatacgactcactataggggctcttggcaaagttacggatggcctgtgtaacagaggagaacacagatgatccgtaacaacctggcggcagcgcaaaagatg

SEQ ID NO: 193931 - DNA, 103 bp, Artificial Sequence
  Synthetic Polynucleotide
taatacgactcactatagggagccttccaagctcttggcaaagttacggaaacagaggagatccgtaatgttgccaagaaacctggcggcagcgcaaaagatg

SEQ ID NO: 193932 - DNA, 103 bp, Artificial Sequence
  Synthetic Polynucleotide
taatacgactcactatagggtttgtcaaccagccttccaagctcttggcaaacagaggagatgccaaatgcttggaaggaacctggcggcagcgcaaaagatg

SEQ ID NO: 193933 - DNA, 103 bp, Artificial Sequence
  Synthetic Polynucleotide
taatacgactcactatagggactcatggcatttgtcaaccagccttccaaaacagaggagattggaaatgtggttgacaaacctggcggcagcgcaaaagatg

SEQ ID NO: 193934 - DNA, 103 bp, Artificial Sequence
  Synthetic Polynucleotide
taatacgactcactataggggtgggaagtcactcatggcatttgtcaaccaacagaggagaggttgaatgatgccatgaaacctggcggcagcgcaaaagatg

SEQ ID NO: 193935 - DNA, 103 bp, Artificial Sequence
  Synthetic Polynucleotide
taatacgactcactatagggatgacctgttgtgggaagtcactcatggcaaacagaggagatgccatatgtgacttcccaacctggcggcagcgcaaaagatg

SEQ ID NO: 193936 - DNA, 103 bp, Artificial Sequence
  Synthetic Polynucleotide
taatacgactcactatagggcttggtctggatgacctgttgtgggaagtcaacagaggagagacttcatgcaacaggtcaacctggcggcagcgcaaaagatg

SEQ ID NO: 193937 - DNA, 103 bp, Artificial Sequence
  Synthetic Polynucleotide
taatacgactcactatagggcgacgcccaccttggtctggatgacctgttaacagaggagaaacaggatgtccagaccaaacctggcggcagcgcaaaagatg

SEQ ID NO: 193938 - DNA, 103 bp, Artificial Sequence
  Synthetic Polynucleotide
taatacgactcactatagggacctgctgaactctggggagggagatcggcaacagaggagagccgatatgcctccccagaacctggcggcagcgcaaaagatg

SEQ ID NO: 193939 - DNA, 103 bp, Artificial Sequence
  Synthetic Polynucleotide
taatacgactcactatagggaaggcactgacgacgcccaccttggtctggaacagaggagaccagacatgggtgggcgtaacctggcggcagcgcaaaagatg

SEQ ID NO: 193940 - DNA, 103 bp, Artificial Sequence
  Synthetic Polynucleotide
taatacgactcactatagggcgtctgggcgaaggcactgacgacgcccacaacagaggagagtgggcatggtcagtgccaacctggcggcagcgcaaaagatg

SEQ ID NO: 193941 - DNA, 103 bp, Artificial Sequence
  Synthetic Polynucleotide
taatacgactcactatagggagcgccgcagcgtctgggcgaaggcactgaaacagaggagatcagtgatgtcgcccagaaacctggcggcagcgcaaaagatg

SEQ ID NO: 193942 - DNA, 103 bp, Artificial Sequence
  Synthetic Polynucleotide
taatacgactcactatagggagggacgtgtagcgccgcagcgtctgggcgaacagaggagacgcccaatggctgcggcgaacctggcggcagcgcaaaagatg

SEQ ID NO: 193943 - DNA, 103 bp, Artificial Sequence
  Synthetic Polynucleotide
taatacgactcactatagggcaggtggttgagggacgtgtagcgccgcagaacagaggagactgcggatgtacacgtccaacctggcggcagcgcaaaagatg

SEQ ID NO: 193944 - DNA, 103 bp, Artificial Sequence
  Synthetic Polynucleotide
taatacgactcactatagggccgcctgcgccaggtggttgagggacgtgtaacagaggagaacacgtatgtcaaccaccaacctggcggcagcgcaaaagatg

SEQ ID NO: 193945 - DNA, 103 bp, Artificial Sequence
  Synthetic Polynucleotide
taatacgactcactatagggaccgcccgggccgcctgcgccaggtggttgaacagaggagacaaccaatgggcgcaggcaacctggcggcagcgcaaaagatg

SEQ ID NO: 193946 - DNA, 103 bp, Artificial Sequence
  Synthetic Polynucleotide
taatacgactcactataggggttctgcagcaccgcccgggccgcctgcgcaacagaggagagcgcagatggcccgggcgaacctggcggcagcgcaaaagatg

SEQ ID NO: 193947 - DNA, 103 bp, Artificial Sequence
  Synthetic Polynucleotide
taatacgactcactatagggtctgggacgtgttctgcagcaccgcccgggaacagaggagacccgggatgtgctgcagaaacctggcggcagcgcaaaagatg

SEQ ID NO: 193948 - DNA, 103 bp, Artificial Sequence
  Synthetic Polynucleotide
taatacgactcactatagggatctggttgatctgggacgtgttctgcagcaacagaggagagctgcaatgcacgtcccaaacctggcggcagcgcaaaagatg

SEQ ID NO: 193949 - DNA, 103 bp, Artificial Sequence
  Synthetic Polynucleotide
taatacgactcactatagggctgctggggtacctgctgaactctggggagaacagaggagactccccatggttcagcagaacctggcggcagcgcaaaagatg

SEQ ID NO: 193950 - DNA, 103 bp, Artificial Sequence
  Synthetic Polynucleotide
taatacgactcactataggggtcgctgagcatctggttgatctgggacgtaacagaggagaacgtccatgatcaaccagaacctggcggcagcgcaaaagatg

SEQ ID NO: 193951 - DNA, 103 bp, Artificial Sequence
  Synthetic Polynucleotide
taatacgactcactatagggcgcggttgaggtcgctgagcatctggttgaaacagaggagatcaaccatgtgctcagcgaacctggcggcagcgcaaaagatg

SEQ ID NO: 193952 - DNA, 103 bp, Artificial Sequence
  Synthetic Polynucleotide
taatacgactcactataggggcaaagtccacgcggttgaggtcgctgagcaacagaggagagctcagatgcctcaaccgaacctggcggcagcgcaaaagatg

SEQ ID NO: 193953 - DNA, 103 bp, Artificial Sequence
  Synthetic Polynucleotide
taatacgactcactatagggctgcacgttggcaaagtccacgcggttgagaacagaggagactcaacatggtggactttaacctggcggcagcgcaaaagatg

SEQ ID NO: 193954 - DNA, 103 bp, Artificial Sequence
  Synthetic Polynucleotide
taatacgactcactatagggaggcctgctcctgcacgttggcaaagtccaaacagaggagatggactatgccaacgtgcaacctggcggcagcgcaaaagatg

SEQ ID NO: 193955 - DNA, 103 bp, Artificial Sequence
  Synthetic Polynucleotide
taatacgactcactatagggcacacccacgaggcctgctcctgcacgttgaacagaggagacaacgtatgggagcaggcaacctggcggcagcgcaaaagatg

SEQ ID NO: 193956 - DNA, 103 bp, Artificial Sequence
  Synthetic Polynucleotide
taatacgactcactatagggctcgcactggcacacccacgaggcctgctcaacagaggagagagcagatgtcgtgggtgaacctggcggcagcgcaaaagatg

SEQ ID NO: 193957 - DNA, 103 bp, Artificial Sequence
  Synthetic Polynucleotide
taatacgactcactatagggccacactctcctcgcactggcacacccacgaacagaggagacgtgggatggccagtgcgaacctggcggcagcgcaaaagatg

SEQ ID NO: 193958 - DNA, 103 bp, Artificial Sequence
  Synthetic Polynucleotide
taatacgactcactatagggagccgctgcaccacactctcctcgcactggaacagaggagaccagtgatgggagagtgtaacctggcggcagcgcaaaagatg

SEQ ID NO: 193959 - DNA, 103 bp, Artificial Sequence
  Synthetic Polynucleotide
taatacgactcactatagggatcctgctccagccgctgcaccacactctcaacagaggagagagagtatggtgcagcggaacctggcggcagcgcaaaagatg

SEQ ID NO: 193960 - DNA, 103 bp, Artificial Sequence
  Synthetic Polynucleotide
taatacgactcactatagggccggctgcacctgctggggtacctgctgaaaacagaggagattcagcatgtaccccagcaacctggcggcagcgcaaaagatg

SEQ ID NO: 193961 - DNA, 103 bp, Artificial Sequence
  Synthetic Polynucleotide
taatacgactcactatagggtcagcttgaaatcctgctccagccgctgcaaacagaggagatgcagcatgtggagcaggaacctggcggcagcgcaaaagatg

SEQ ID NO: 193962 - DNA, 103 bp, Artificial Sequence
  Synthetic Polynucleotide
taatacgactcactatagggtgctgcagggtcagcttgaaatcctgctccaacagaggagaggagcaatgtttcaagctaacctggcggcagcgcaaaagatg

SEQ ID NO: 193963 - DNA, 103 bp, Artificial Sequence
  Synthetic Polynucleotide
taatacgactcactatagggggagctctgctgctgcagggtcagcttgaaaacagaggagattcaagatgaccctgcagaacctggcggcagcgcaaaagatg

SEQ ID NO: 193964 - DNA, 103 bp, Artificial Sequence
  Synthetic Polynucleotide
taatacgactcactatagggactggtccagggagctctgctgctgcagggaacagaggagaccctgcatgagcagagctaacctggcggcagcgcaaaagatg

SEQ ID NO: 193965 - DNA, 103 bp, Artificial Sequence
  Synthetic Polynucleotide
taatacgactcactatagggcagctggcccactggtccagggagctctgcaacagaggagagcagagatgcctggaccaaacctggcggcagcgcaaaagatg

SEQ ID NO: 193966 - DNA, 103 bp, Artificial Sequence
  Synthetic Polynucleotide
taatacgactcactatagggactgtccagccagctggcccactggtccagaacagaggagactggacatgtgggccagcaacctggcggcagcgcaaaagatg

SEQ ID NO: 193967 - DNA, 103 bp, Artificial Sequence
  Synthetic Polynucleotide
taatacgactcactataggggggtgaccacactgtccagccagctggcccaacagaggagagggccaatgggctggacaaacctggcggcagcgcaaaagatg

SEQ ID NO: 193968 - DNA, 103 bp, Artificial Sequence
  Synthetic Polynucleotide
taatacgactcactatagggttcaggacctgggtgaccacactgtccagcaacagaggagagctggaatgtgtggtcacaacctggcggcagcgcaaaagatg

SEQ ID NO: 193969 - DNA, 103 bp, Artificial Sequence
  Synthetic Polynucleotide
taatacgactcactatagggggcatgctgcttcaggacctgggtgaccacaacagaggagagtggtcatgcaggtcctgaacctggcggcagcgcaaaagatg

SEQ ID NO: 193970 - DNA, 103 bp, Artificial Sequence
  Synthetic Polynucleotide
taatacgactcactatagggtggggctgccggcatgctgcttcaggacctaacagaggagaaggtccatgagcagcatgaacctggcggcagcgcaaaagatg

SEQ ID NO: 193971 - DNA, 103 bp, Artificial Sequence
  Synthetic Polynucleotide
taatacgactcactatagggacgtgctgcaccggctgcacctgctggggtaacagaggagaaccccaatgggtgcagccaacctggcggcagcgcaaaagatg

SEQ ID NO: 193972 - DNA, 103 bp, Artificial Sequence
  Synthetic Polynucleotide
taatacgactcactatagggttggggaagctggggctgccggcatgctgcaacagaggagagcagcaatgcggcagcccaacctggcggcagcgcaaaagatg

SEQ ID NO: 193973 - DNA, 103 bp, Artificial Sequence
  Synthetic Polynucleotide
taatacgactcactatagggccgggcggccttggggaagctggggctgccaacagaggagaggcagcatgagcttccccaacctggcggcagcgcaaaagatg

SEQ ID NO: 193974 - DNA, 103 bp, Artificial Sequence
  Synthetic Polynucleotide
taatacgactcactataggggcaagaactgccgggcggccttggggaagcaacagaggagagcttccatgaggccgcccaacctggcggcagcgcaaaagatg

SEQ ID NO: 193975 - DNA, 103 bp, Artificial Sequence
  Synthetic Polynucleotide
taatacgactcactataggggaccatttcagcaagaactgccgggcggccaacagaggagaggccgcatggcagttcttaacctggcggcagcgcaaaagatg

SEQ ID NO: 193976 - DNA, 103 bp, Artificial Sequence
  Synthetic Polynucleotide
taatacgactcactataggggctgtaaaaggaccatttcagcaagaactgaacagaggagacagttcatgctgaaatggaacctggcggcagcgcaaaagatg

SEQ ID NO: 193977 - DNA, 103 bp, Artificial Sequence
  Synthetic Polynucleotide
taatacgactcactatagggtcaccatggagctgtaaaaggaccatttcaaacagaggagatgaaatatgccttttacaaacctggcggcagcgcaaaagatg

SEQ ID NO: 193978 - DNA, 103 bp, Artificial Sequence
  Synthetic Polynucleotide
taatacgactcactatagggaggtcccggatcaccatggagctgtaaaagaacagaggagacttttaatgctccatggtaacctggcggcagcgcaaaagatg

SEQ ID NO: 193979 - DNA, 103 bp, Artificial Sequence
  Synthetic Polynucleotide
taatacgactcactataggggcgcagggtcaggtcccggatcaccatggaaacagaggagatccatgatgatccgggacaacctggcggcagcgcaaaagatg

SEQ ID NO: 193980 - DNA, 103 bp, Artificial Sequence
  Synthetic Polynucleotide
taatacgactcactatagggtggcagcgctgcgcagggtcaggtcccggaaacagaggagatccgggatgtgaccctgcaacctggcggcagcgcaaaagatg

SEQ ID NO: 193981 - DNA, 103 bp, Artificial Sequence
  Synthetic Polynucleotide
taatacgactcactataggggagccgaagctggcagcgctgcgcagggtcaacagaggagagaccctatgcagcgctgcaacctggcggcagcgcaaaagatg

SEQ ID NO: 193982 - DNA, 103 bp, Artificial Sequence
  Synthetic Polynucleotide
taatacgactcactatagggggcaggatacacgtgctgcaccggctgcacaacagaggagagtgcagatggtgcagcacaacctggcggcagcgcaaaagatg

SEQ ID NO: 193983 - DNA, 103 bp, Artificial Sequence
  Synthetic Polynucleotide
taatacgactcactataggggaggtggaaggagccgaagctggcagcgctaacagaggagaagcgctatgagcttcggcaacctggcggcagcgcaaaagatg

SEQ ID NO: 193984 - DNA, 103 bp, Artificial Sequence
  Synthetic Polynucleotide
taatacgactcactataggggcaggcggatgaggtggaaggagccgaagcaacagaggagagcttcgatgccttccaccaacctggcggcagcgcaaaagatg

SEQ ID NO: 193985 - DNA, 103 bp, Artificial Sequence
  Synthetic Polynucleotide
taatacgactcactatagggtcgtcgtagagcaggcggatgaggtggaagaacagaggagacttccaatgcatccgcctaacctggcggcagcgcaaaagatg

SEQ ID NO: 193986 - DNA, 103 bp, Artificial Sequence
  Synthetic Polynucleotide
taatacgactcactataggggaacatgtactcgtcgtagagcaggcggataacagaggagaatccgcatgctctacgacaacctggcggcagcgcaaaagatg

SEQ ID NO: 193987 - DNA, 103 bp, Artificial Sequence
  Synthetic Polynucleotide
taatacgactcactatagggccaccaggtagaacatgtactcgtcgtagaaacagaggagatctacgatgagtacatgtaacctggcggcagcgcaaaagatg

SEQ ID NO: 193988 - DNA, 103 bp, Artificial Sequence
  Synthetic Polynucleotide
taatacgactcactatagggacgcggtgctccaccaggtagaacatgtacaacagaggagagtacatatgctacctggtaacctggcggcagcgcaaaagatg

SEQ ID NO: 193989 - DNA, 103 bp, Artificial Sequence
  Synthetic Polynucleotide
taatacgactcactatagggggcctccgcgacgcggtgctccaccaggtaaacagaggagatacctgatggagcaccgcaacctggcggcagcgcaaaagatg

SEQ ID NO: 193990 - DNA, 103 bp, Artificial Sequence
  Synthetic Polynucleotide
taatacgactcactatagggtctctccggtggcctccgcgacgcggtgctaacagaggagaagcaccatgtcgcggaggaacctggcggcagcgcaaaagatg

SEQ ID NO: 193991 - DNA, 103 bp, Artificial Sequence
  Synthetic Polynucleotide
taatacgactcactataggggcgatcggcgtctctccggtggcctccgcgaacagaggagacgcggaatgcaccggagaaacctggcggcagcgcaaaagatg

SEQ ID NO: 193992 - DNA, 103 bp, Artificial Sequence
  Synthetic Polynucleotide
taatacgactcactatagggtcccatcacagcgatcggcgtctctccggtaacagaggagaaccggaatgacgccgatcaacctggcggcagcgcaaaagatg

SEQ ID NO: 193993 - DNA, 103 bp, Artificial Sequence
  Synthetic Polynucleotide
taatacgactcactatagggcggacgctggcgaatccgctccaccctcggaacagaggagaccgaggatggagcggattaacctggcggcagcgcaaaagatg

SEQ ID NO: 193994 - DNA, 103 bp, Artificial Sequence
  Synthetic Polynucleotide
taatacgactcactatagggactgcacctgggcaggatacacgtgctgcaaacagaggagatgcagcatgtgtatcctgaacctggcggcagcgcaaaagatg

SEQ ID NO: 193995 - DNA, 103 bp, Artificial Sequence
  Synthetic Polynucleotide
taatacgactcactatagggcgttgaactctcccatcacagcgatcggcgaacagaggagacgccgaatgctgtgatggaacctggcggcagcgcaaaagatg

SEQ ID NO: 193996 - DNA, 103 bp, Artificial Sequence
  Synthetic Polynucleotide
taatacgactcactataggggaggcgagatcgttgaactctcccatcacaaacagaggagatgtgatatgagagttcaaaacctggcggcagcgcaaaagatg

SEQ ID NO: 193997 - DNA, 103 bp, Artificial Sequence
  Synthetic Polynucleotide
taatacgactcactatagggcagcgacagagaggcgagatcgttgaactcaacagaggagagagttcatggatctcgccaacctggcggcagcgcaaaagatg

SEQ ID NO: 193998 - DNA, 103 bp, Artificial Sequence
  Synthetic Polynucleotide
taatacgactcactatagggcgagcagcgtcagcgacagagaggcgagataacagaggagaatctcgatgctctgtcgcaacctggcggcagcgcaaaagatg

SEQ ID NO: 193999 - DNA, 103 bp, Artificial Sequence
  Synthetic Polynucleotide
taatacgactcactatagggtcatctttgtcgagcagcgtcagcgacagaaacagaggagatctgtcatggacgctgctaacctggcggcagcgcaaaagatg

SEQ ID NO: 194000 - DNA, 103 bp, Artificial Sequence
  Synthetic Polynucleotide
taatacgactcactatagggatcgcccatgtcatctttgtcgagcagcgtaacagaggagaacgctgatggacaaagataacctggcggcagcgcaaaagatg

SEQ ID NO: 194001 - DNA, 103 bp, Artificial Sequence
  Synthetic Polynucleotide
taatacgactcactatagggcacgctgctcatcgcccatgtcatctttgtaacagaggagaacaaagatgacatgggcgaacctggcggcagcgcaaaagatg

SEQ ID NO: 194002 - DNA, 103 bp, Artificial Sequence
  Synthetic Polynucleotide
taatacgactcactataggggcctcgctgccacgctgctcatcgcccatgaacagaggagacatgggatgtgagcagcgaacctggcggcagcgcaaaagatg

SEQ ID NO: 194003 - DNA, 103 bp, Artificial Sequence
  Synthetic Polynucleotide
taatacgactcactataggggtctgggcccgcctcgctgccacgctgctcaacagaggagagagcagatgggcagcgagaacctggcggcagcgcaaaagatg

SEQ ID NO: 194004 - DNA, 103 bp, Artificial Sequence
  Synthetic Polynucleotide
taatacgactcactatagggggctgcgggcgtctgggcccgcctcgctgcaacagaggagagcagcgatgcgggcccagaacctggcggcagcgcaaaagatg

SEQ ID NO: 194005 - DNA, 103 bp, Artificial Sequence
  Synthetic Polynucleotide
taatacgactcactatagggccttccacgtactgcacctgggcaggatacaacagaggagagtatccatgccaggtgcaaacctggcggcagcgcaaaagatg

SEQ ID NO: 194006 - DNA, 103 bp, Artificial Sequence
  Synthetic Polynucleotide
taatacgactcactatagggggctcacccaggctgcgggcgtctgggcccaacagaggagagggcccatgcgcccgcagaacctggcggcagcgcaaaagatg

SEQ ID NO: 194007 - DNA, 103 bp, Artificial Sequence
  Synthetic Polynucleotide
taatacgactcactatagggctttaccaggggctcacccaggctgcgggcaacagaggagagcccgcatgctgggtgagaacctggcggcagcgcaaaagatg

SEQ ID NO: 194008 - DNA, 103 bp, Artificial Sequence
  Synthetic Polynucleotide
taatacgactcactatagggtgcgctcccgctttaccaggggctcacccaaacagaggagatgggtgatgccctggtaaaacctggcggcagcgcaaaagatg

SEQ ID NO: 194009 - DNA, 103 bp, Artificial Sequence
  Synthetic Polynucleotide
taatacgactcactatagggttggggtcactgcgctcccgctttaccaggaacagaggagacctggtatggcgggagcgaacctggcggcagcgcaaaagatg

SEQ ID NO: 194010 - DNA, 103 bp, Artificial Sequence
  Synthetic Polynucleotide
taatacgactcactatagggcagggagtggttggggtcactgcgctcccgaacagaggagacgggagatgagtgaccccaacctggcggcagcgcaaaagatg

SEQ ID NO: 194011 - DNA, 103 bp, Artificial Sequence
  Synthetic Polynucleotide
taatacgactcactatagggagatgccctgcagggagtggttggggtcacaacagaggagagtgaccatgaccactcccaacctggcggcagcgcaaaagatg

SEQ ID NO: 194012 - DNA, 103 bp, Artificial Sequence
  Synthetic Polynucleotide
taatacgactcactatagggggcgtctcccccttccacgtactgcacctgaacagaggagacaggtgatgtacgtggaaaacctggcggcagcgcaaaagatg

SEQ ID NO: 194013 - DNA, 103 bp, Artificial Sequence
  Synthetic Polynucleotide
taatacgactcactatagggtggtgtagacggcgtctcccccttccacgtaacagaggagaacgtggatgggggagacgaacctggcggcagcgcaaaagatg

SEQ ID NO: 194014 - DNA, 103 bp, Artificial Sequence
  Synthetic Polynucleotide
taatacgactcactatagggatggctccattggtgtagacggcgtctcccaacagaggagagggagaatgcgtctacacaacctggcggcagcgcaaaagatg

SEQ ID NO: 194015 - DNA, 103 bp, Artificial Sequence
  Synthetic Polynucleotide
taatacgactcactatagggggctgttcgtatggctccattggtgtagacaacagaggagagtctacatgaatggagccaacctggcggcagcgcaaaagatg

SEQ ID NO: 194016 - DNA, 103 bp, Artificial Sequence
  Synthetic Polynucleotide
taatacgactcactatagggtgtaggtgtaggctgttcgtatggctccataacagaggagaatggagatgtacgaacagaacctggcggcagcgcaaaagatg

SEQ ID NO: 194017 - DNA, 103 bp, Artificial Sequence
  Synthetic Polynucleotide
taatacgactcactatagggggctcggggttgtaggtgtaggctgttcgtaacagaggagaacgaacatgctacacctaaacctggcggcagcgcaaaagatg

SEQ ID NO: 194018 - DNA, 103 bp, Artificial Sequence
  Synthetic Polynucleotide
taatacgactcactataggggtacatctgaggctcggggttgtaggtgtaaacagaggagatacaccatgaaccccgagaacctggcggcagcgcaaaagatg

SEQ ID NO: 194019 - DNA, 103 bp, Artificial Sequence
  Synthetic Polynucleotide
taatacgactcactatagggtgctgggggcgtacatctgaggctcggggtaacagaggagaaccccgatgctcagatgtaacctggcggcagcgcaaaagatg

SEQ ID NO: 194020 - DNA, 103 bp, Artificial Sequence
  Synthetic Polynucleotide
taatacgactcactatagggcgcagagccacggacgctggcgaatccgctaacagaggagaagcggaatggccagcgtcaacctggcggcagcgcaaaagatg

SEQ ID NO: 194021 - DNA, 103 bp, Artificial Sequence
  Synthetic Polynucleotide
taatacgactcactataggggaagccgtgctgctgggggcgtacatctgaaacagaggagatcagatatgcgcccccagaacctggcggcagcgcaaaagatg

SEQ ID NO: 194022 - DNA, 103 bp, Artificial Sequence
  Synthetic Polynucleotide
taatacgactcactatagggctcgaagtaagaagccgtgctgctgggggcaacagaggagagcccccatgagcacggctaacctggcggcagcgcaaaagatg

SEQ ID NO: 194023 - DNA, 103 bp, Artificial Sequence
  Synthetic Polynucleotide
taatacgactcactatagggcgcctggggcctcgaagtaagaagccgtgcaacagaggagagcacggatgcttacttcgaacctggcggcagcgcaaaagatg

SEQ ID NO: 194024 - DNA, 103 bp, Artificial Sequence
  Synthetic Polynucleotide
taatacgactcactatagggacctgggcaccgcctggggcctcgaagtaaaacagaggagattacttatgggccccaggaacctggcggcagcgcaaaagatg

SEQ ID NO: 194025 - DNA, 103 bp, Artificial Sequence
  Synthetic Polynucleotide
taatacgactcactatagggtgccacggtcacctgggcaccgcctggggcaacagaggagagccccaatgggtgcccagaacctggcggcagcgcaaaagatg

SEQ ID NO: 194026 - DNA, 103 bp, Artificial Sequence
  Synthetic Polynucleotide
taatacgactcactataggggggacgaggctgccacggtcacctgggcacaacagaggagagtgcccatgtgaccgtggaacctggcggcagcgcaaaagatg

SEQ ID NO: 194027 - DNA, 103 bp, Artificial Sequence
  Synthetic Polynucleotide
taatacgactcactatagggaccgctggcggggacgaggctgccacggtcaacagaggagagaccgtatgagcctcgtcaacctggcggcagcgcaaaagatg

SEQ ID NO: 194028 - DNA, 103 bp, Artificial Sequence
  Synthetic Polynucleotide
taatacgactcactataggggtgggaggggaccgctggcggggacgaggcaacagaggagagcctcgatgccgccagcgaacctggcggcagcgcaaaagatg

SEQ ID NO: 194029 - DNA, 103 bp, Artificial Sequence
  Synthetic Polynucleotide
taatacgactcactatagggccaccatgctgtgggaggggaccgctggcgaacagaggagacgccagatgtcccctcccaacctggcggcagcgcaaaagatg

SEQ ID NO: 194030 - DNA, 103 bp, Artificial Sequence
  Synthetic Polynucleotide
taatacgactcactatagggatggtgatgcccaccatgctgtgggaggggaacagaggagacccctcatgcagcatggtaacctggcggcagcgcaaaagatg

SEQ ID NO: 194031 - DNA, 103 bp, Artificial Sequence
  Synthetic Polynucleotide
taatacgactcactatagggcgccgagggacgcagagccacggacgctggaacagaggagaccagcgatggtggctctgaacctggcggcagcgcaaaagatg

SEQ ID NO: 194032 - DNA, 103 bp, Artificial Sequence
  Synthetic Polynucleotide
taatacgactcactatagggcccgacatccatggtgatgcccaccatgctaacagaggagaagcatgatgggcatcaccaacctggcggcagcgcaaaagatg

SEQ ID NO: 194033 - DNA, 103 bp, Artificial Sequence
  Synthetic Polynucleotide
taatacgactcactatagggtggggctccccccgacatccatggtgatgcaacagaggagagcatcaatgtggatgtcgaacctggcggcagcgcaaaagatg

SEQ ID NO: 194034 - DNA, 103 bp, Artificial Sequence
  Synthetic Polynucleotide
taatacgactcactatagggctggagacgatggggctccccccgacatccaacagaggagaggatgtatgggggagcccaacctggcggcagcgcaaaagatg

SEQ ID NO: 194035 - DNA, 103 bp, Artificial Sequence
  Synthetic Polynucleotide
taatacgactcactatagggggctcccgcgctggagacgatggggctcccaacagaggagagggagcatgatcgtctccaacctggcggcagcgcaaaagatg

SEQ ID NO: 194036 - DNA, 103 bp, Artificial Sequence
  Synthetic Polynucleotide
taatacgactcactatagggggatgagataggctcccgcgctggagacgaaacagaggagatcgtctatggcgcgggagaacctggcggcagcgcaaaagatg

SEQ ID NO: 194037 - DNA, 103 bp, Artificial Sequence
  Synthetic Polynucleotide
taatacgactcactatagggatccccccgtggatgagataggctcccgcgaacagaggagacgcgggatgctatctcataacctggcggcagcgcaaaagatg

SEQ ID NO: 194038 - DNA, 103 bp, Artificial Sequence
  Synthetic Polynucleotide
taatacgactcactatagggggtgctgtccatccccccgtggatgagataaacagaggagatatctcatgcacggggggaacctggcggcagcgcaaaagatg

SEQ ID NO: 194039 - DNA, 103 bp, Artificial Sequence
  Synthetic Polynucleotide
taatacgactcactataggggggagtgtctggtgctgtccatccccccgtaacagaggagaacggggatgtggacagcaaacctggcggcagcgcaaaagatg

SEQ ID NO: 194040 - DNA, 103 bp, Artificial Sequence
  Synthetic Polynucleotide
taatacgactcactataggggtgtgggccagggagtgtctggtgctgtccaacagaggagaggacagatgcagacactcaacctggcggcagcgcaaaagatg

SEQ ID NO: 194041 - DNA, 103 bp, Artificial Sequence
  Synthetic Polynucleotide
taatacgactcactatagggtgagcgggaggtgtgggccagggagtgtctaacagaggagaagacacatgctggcccacaacctggcggcagcgcaaaagatg

SEQ ID NO: 194042 - DNA, 103 bp, Artificial Sequence
  Synthetic Polynucleotide
taatacgactcactataggggcggggctgccgccgagggacgcagagccaaacagaggagatggctcatggtccctcggaacctggcggcagcgcaaaagatg

SEQ ID NO: 194043 - DNA, 103 bp, Artificial Sequence
  Synthetic Polynucleotide
taatacgactcactatagggtggcgggcgatgagcgggaggtgtgggccaaacagaggagatggcccatgcctcccgctaacctggcggcagcgcaaaagatg

SEQ ID NO: 194044 - DNA, 103 bp, Artificial Sequence
  Synthetic Polynucleotide
taatacgactcactatagggatttcaagcgtggcgggcgatgagcgggagaacagaggagactcccgatgatcgcccgcaacctggcggcagcgcaaaagatg

SEQ ID NO: 194045 - DNA, 103 bp, Artificial Sequence
  Synthetic Polynucleotide
taatacgactcactatagggttcaatcgccatttcaagcgtggcgggcgaaacagaggagatcgcccatgacgcttgaaaacctggcggcagcgcaaaagatg

SEQ ID NO: 194046 - DNA, 103 bp, Artificial Sequence
  Synthetic Polynucleotide
taatacgactcactatagggtttggaggttttcaatcgccatttcaagcgaacagaggagacgcttgatgtggcgattgaacctggcggcagcgcaaaagatg

SEQ ID NO: 194047 - DNA, 103 bp, Artificial Sequence
  Synthetic Polynucleotide
taatacgactcactatagggccttcgcttttttggaggttttcaatcgccaacagaggagaggcgatatgaaacctccaaacctggcggcagcgcaaaagatg

SEQ ID NO: 194048 - DNA, 103 bp, Artificial Sequence
  Synthetic Polynucleotide
taatacgactcactatagggtgatgtgattccttcgcttttttggaggttaacagaggagaaacctcatgaaaagcgaaaacctggcggcagcgcaaaagatg

SEQ ID NO: 194049 - DNA, 103 bp, Artificial Sequence
  Synthetic Polynucleotide
taatacgactcactatagggcgcttttgtgtgatgtgattccttcgctttaacagaggagaaaagcgatggaatcacataacctggcggcagcgcaaaagatg

SEQ ID NO: 194050 - DNA, 103 bp, Artificial Sequence
  Synthetic Polynucleotide
taatacgactcactatagggttgagtaaaccgcttttgtgtgatgtgattaacagaggagaaatcacatgacacaaaagaacctggcggcagcgcaaaagatg

SEQ ID NO: 194051 - DNA, 103 bp, Artificial Sequence
  Synthetic Polynucleotide
taatacgactcactataggggagatggctgttgagtaaaccgcttttgtgaacagaggagacacaaaatgggtttactcaacctggcggcagcgcaaaagatg

SEQ ID NO: 194052 - DNA, 103 bp, Artificial Sequence
  Synthetic Polynucleotide
taatacgactcactatagggacagccactggagatggctgttgagtaaacaacagaggagagtttacatgacagccatcaacctggcggcagcgcaaaagatg

SEQ ID NO: 194053 - DNA, 103 bp, Artificial Sequence
  Synthetic Polynucleotide
taatacgactcactataggggctggcacaggcggggctgccgccgagggaaacagaggagatccctcatgggcagccccaacctggcggcagcgcaaaagatg

SEQ ID NO: 194054 - DNA, 103 bp, Artificial Sequence
  Synthetic Polynucleotide
taatacgactcactatagggtaattatccaacagccactggagatggctgaacagaggagacagccaatgccagtggctaacctggcggcagcgcaaaagatg

SEQ ID NO: 194055 - DNA, 103 bp, Artificial Sequence
  Synthetic Polynucleotide
taatacgactcactatagggcgctgtttcataattatccaacagccactgaacagaggagacagtggatgttggataataacctggcggcagcgcaaaagatg

SEQ ID NO: 194056 - DNA, 103 bp, Artificial Sequence
  Synthetic Polynucleotide
taatacgactcactatagggtcacaccttccgctgtttcataattatccaaacagaggagatggataatgatgaaacagaacctggcggcagcgcaaaagatg

SEQ ID NO: 194057 - DNA, 103 bp, Artificial Sequence
  Synthetic Polynucleotide
taatacgactcactatagggctggggagactcacaccttccgctgtttcaaacagaggagatgaaacatgggaaggtgtaacctggcggcagcgcaaaagatg

SEQ ID NO: 194058 - DNA, 103 bp, Artificial Sequence
  Synthetic Polynucleotide
taatacgactcactatagggaagagaacttctggggagactcacaccttcaacagaggagagaaggtatgagtctccccaacctggcggcagcgcaaaagatg

SEQ ID NO: 194059 - DNA, 103 bp, Artificial Sequence
  Synthetic Polynucleotide
taatacgactcactatagggagtggttgtaaagagaacttctggggagacaacagaggagagtctccatggaagttctcaacctggcggcagcgcaaaagatg

SEQ ID NO: 194060 - DNA, 103 bp, Artificial Sequence
  Synthetic Polynucleotide
taatacgactcactatagggtgccgaaggtagtggttgtaaagagaacttaacagaggagaaagttcatgttacaaccaaacctggcggcagcgcaaaagatg

SEQ ID NO: 194061 - DNA, 103 bp, Artificial Sequence
  Synthetic Polynucleotide
taatacgactcactatagggctcctggcagtgccgaaggtagtggttgtaaacagaggagatacaacatgtaccttcggaacctggcggcagcgcaaaagatg

SEQ ID NO: 194062 - DNA, 103 bp, Artificial Sequence
  Synthetic Polynucleotide
taatacgactcactatagggctagcttgtgctcctggcagtgccgaaggtaacagaggagaaccttcatgactgccaggaacctggcggcagcgcaaaagatg

SEQ ID NO: 194063 - DNA, 103 bp, Artificial Sequence
  Synthetic Polynucleotide
taatacgactcactatagggttcactgggtctagcttgtgctcctggcagaacagaggagactgccaatggcacaagctaacctggcggcagcgcaaaagatg

SEQ ID NO: 194064 - DNA, 103 bp, Artificial Sequence
  Synthetic Polynucleotide
taatacgactcactatagggctgcggggaggctggcacaggcggggctgcaacagaggagagcagccatgcctgtgccaaacctggcggcagcgcaaaagatg

SEQ ID NO: 194065 - DNA, 103 bp, Artificial Sequence
  Synthetic Polynucleotide
taatacgactcactatagggggaggcggcgttcactgggtctagcttgtgaacagaggagacacaagatggacccagtgaacctggcggcagcgcaaaagatg

SEQ ID NO: 194066 - DNA, 103 bp, Artificial Sequence
  Synthetic Polynucleotide
taatacgactcactataggggtttcccgaaggaggcggcgttcactgggtaacagaggagaacccagatgacgccgcctaacctggcggcagcgcaaaagatg

SEQ ID NO: 194067 - DNA, 103 bp, Artificial Sequence
  Synthetic Polynucleotide
taatacgactcactataggggaacggatcagtttcccgaaggaggcggcgaacagaggagacgccgcatgcttcgggaaaacctggcggcagcgcaaaagatg

SEQ ID NO: 194068 - DNA, 103 bp, Artificial Sequence
  Synthetic Polynucleotide
taatacgactcactatagggcataaacacagaacggatcagtttcccgaaaacagaggagattcgggatgctgatccgtaacctggcggcagcgcaaaagatg

SEQ ID NO: 194069 - DNA, 103 bp, Artificial Sequence
  Synthetic Polynucleotide
taatacgactcactatagggttctcagccccataaacacagaacggatcaaacagaggagatgatccatgctgtgtttaaacctggcggcagcgcaaaagatg

SEQ ID NO: 194070 - DNA, 103 bp, Artificial Sequence
  Synthetic Polynucleotide
taatacgactcactatagggagccgccgcgttctcagccccataaacacaaacagaggagatgtgttatgggggctgagaacctggcggcagcgcaaaagatg

SEQ ID NO: 194071 - DNA, 103 bp, Artificial Sequence
  Synthetic Polynucleotide
taatacgactcactatagggcctggtgcccagccgccgcgttctcagcccaacagaggagagggctgatgacgcggcggaacctggcggcagcgcaaaagatg

SEQ ID NO: 194072 - DNA, 103 bp, Artificial Sequence
  Synthetic Polynucleotide
taatacgactcactatagggtcgagttgcccctggtgcccagccgccgcgaacagaggagacgcggcatgtgggcaccaaacctggcggcagcgcaaaagatg

SEQ ID NO: 194073 - DNA, 103 bp, Artificial Sequence
  Synthetic Polynucleotide
taatacgactcactatagggtaatggtacttcgagttgcccctggtgcccaacagaggagagggcacatggggcaactcaacctggcggcagcgcaaaagatg

SEQ ID NO: 194074 - DNA, 103 bp, Artificial Sequence
  Synthetic Polynucleotide
taatacgactcactatagggaatcccatagtaatggtacttcgagttgccaacagaggagaggcaacatgaagtaccataacctggcggcagcgcaaaagatg

SEQ ID NO: 194075 - DNA, 103 bp, Artificial Sequence
  Synthetic Polynucleotide
taatacgactcactatagggccaacaccctctgcggggaggctggcacagaacagaggagactgtgcatgcctccccgcaacctggcggcagcgcaaaagatg

SEQ ID NO: 194076 - DNA, 103 bp, Artificial Sequence
  Synthetic Polynucleotide
taatacgactcactataggggcttcagacgaatcccatagtaatggtactaacagaggagaagtaccatgactatgggaaacctggcggcagcgcaaaagatg

SEQ ID NO: 194077 - DNA, 103 bp, Artificial Sequence
  Synthetic Polynucleotide
taatacgactcactatagggggtgagtccggcttcagacgaatcccatagaacagaggagactatggatgtcgtctgaaaacctggcggcagcgcaaaagatg

SEQ ID NO: 194078 - DNA, 103 bp, Artificial Sequence
  Synthetic Polynucleotide
taatacgactcactatagggccggttcagtggtgagtccggcttcagacgaacagaggagacgtctgatgccggactcaaacctggcggcagcgcaaaagatg

SEQ ID NO: 194079 - DNA, 103 bp, Artificial Sequence
  Synthetic Polynucleotide
taatacgactcactatagggcctcctgcagccggttcagtggtgagtccgaacagaggagacggactatgcactgaaccaacctggcggcagcgcaaaagatg

SEQ ID NO: 194080 - DNA, 103 bp, Artificial Sequence
  Synthetic Polynucleotide
taatacgactcactatagggtactgcgtgtcctcctgcagccggttcagtaacagaggagaactgaaatggctgcaggaaacctggcggcagcgcaaaagatg

SEQ ID NO: 194081 - DNA, 103 bp, Artificial Sequence
  Synthetic Polynucleotide
taatacgactcactatagggcatggccatgtactgcgtgtcctcctgcagaacagaggagactgcagatggacacgcagaacctggcggcagcgcaaaagatg

SEQ ID NO: 194082 - DNA, 103 bp, Artificial Sequence
  Synthetic Polynucleotide
taatacgactcactataggggctgctgccgcatggccatgtactgcgtgtaacagaggagaacacgcatgacatggccaaacctggcggcagcgcaaaagatg

SEQ ID NO: 194083 - DNA, 103 bp, Artificial Sequence
  Synthetic Polynucleotide
taatacgactcactatagggtggtgcatgggctgctgccgcatggccatgaacagaggagacatggcatggcggcagcaaacctggcggcagcgcaaaagatg

SEQ ID NO: 194084 - DNA, 103 bp, Artificial Sequence
  Synthetic Polynucleotide
taatacgactcactatagggcctgggcttctggtgcatgggctgctgccgaacagaggagacggcagatgcccatgcacaacctggcggcagcgcaaaagatg

SEQ ID NO: 194085 - DNA, 103 bp, Artificial Sequence
  Synthetic Polynucleotide
taatacgactcactatagggctggccggtacctgggcttctggtgcatggaacagaggagaccatgcatgagaagcccaaacctggcggcagcgcaaaagatg

SEQ ID NO: 194086 - DNA, 103 bp, Artificial Sequence
  Synthetic Polynucleotide
taatacgactcactataggggctgcctggaccaacaccctctgcggggagaacagaggagactccccatggagggtgttaacctggcggcagcgcaaaagatg

SEQ ID NO: 194087 - DNA, 103 bp, Artificial Sequence
  Synthetic Polynucleotide
taatacgactcactataggggtcttctgggctggccggtacctgggcttcaacagaggagagaagccatggtaccggccaacctggcggcagcgcaaaagatg

SEQ ID NO: 194088 - DNA, 103 bp, Artificial Sequence
  Synthetic Polynucleotide
taatacgactcactataggggaggctgtccgtcttctgggctggccggtaaacagaggagataccggatggcccagaagaacctggcggcagcgcaaaagatg

SEQ ID NO: 194089 - DNA, 103 bp, Artificial Sequence
  Synthetic Polynucleotide
taatacgactcactatagggcgctgtccccgaggctgtccgtcttctgggaacagaggagacccagaatgcggacagccaacctggcggcagcgcaaaagatg

SEQ ID NO: 194090 - DNA, 103 bp, Artificial Sequence
  Synthetic Polynucleotide
taatacgactcactatagggctgtgggagccgctgtccccgaggctgtccaacagaggagaggacagatgcggggacagaacctggcggcagcgcaaaagatg

SEQ ID NO: 194091 - DNA, 103 bp, Artificial Sequence
  Synthetic Polynucleotide
taatacgactcactataggggtgcaggccgctgtgggagccgctgtccccaacagaggagaggggacatgggctcccacaacctggcggcagcgcaaaagatg

SEQ ID NO: 194092 - DNA, 103 bp, Artificial Sequence
  Synthetic Polynucleotide
taatacgactcactatagggccggagtgctgtgcaggccgctgtgggagcaacagaggagagctcccatggcggcctgcaacctggcggcagcgcaaaagatg

SEQ ID NO: 194093 - DNA, 103 bp, Artificial Sequence
  Synthetic Polynucleotide
taatacgactcactatagggatggtctgttccggagtgctgtgcaggccgaacagaggagacggcctatgcagcactccaacctggcggcagcgcaaaagatg

SEQ ID NO: 194094 - DNA, 103 bp, Artificial Sequence
  Synthetic Polynucleotide
taatacgactcactatagggctgcacggccatggtctgttccggagtgctaacagaggagaagcactatggaacagaccaacctggcggcagcgcaaaagatg

SEQ ID NO: 194095 - DNA, 103 bp, Artificial Sequence
  Synthetic Polynucleotide
taatacgactcactatagggggtgctggctctgcacggccatggtctgttaacagaggagaaacagaatgtggccgtgcaacctggcggcagcgcaaaagatg

SEQ ID NO: 194096 - DNA, 103 bp, Artificial Sequence
  Synthetic Polynucleotide
taatacgactcactatagggtactgctggtggtgctggctctgcacggccaacagaggagaggccgtatggagccagcaaacctggcggcagcgcaaaagatg

SEQ ID NO: 194097 - DNA, 103 bp, Artificial Sequence
  Synthetic Polynucleotide
taatacgactcactatagggtgtgtccgacccagtctctgatgtctgcataacagaggagaatgcagatgtcagagactaacctggcggcagcgcaaaagatg

SEQ ID NO: 194098 - DNA, 103 bp, Artificial Sequence
  Synthetic Polynucleotide
taatacgactcactatagggtacctgttgttgtactggtacttgctgtacaacagaggagagtacagatggtaccagtaaacctggcggcagcgcaaaagatg

SEQ ID NO: 194099 - DNA, 103 bp, Artificial Sequence
  Synthetic Polynucleotide
taatacgactcactatagggagaagagatttcaacttctccaaactctggaacagaggagaccagagatgggagaagttaacctggcggcagcgcaaaagatg

SEQ ID NO: 194100 - DNA, 103 bp, Artificial Sequence
  Synthetic Polynucleotide
taatacgactcactatagggcatctggcagagaagagatttcaacttctcaacagaggagagagaagatgaaatctcttaacctggcggcagcgcaaaagatg

SEQ ID NO: 194101 - DNA, 103 bp, Artificial Sequence
  Synthetic Polynucleotide
taatacgactcactatagggaaggtagtaccatctggcagagaagagattaacagaggagaaatctcatgtctgccagaaacctggcggcagcgcaaaagatg

SEQ ID NO: 194102 - DNA, 103 bp, Artificial Sequence
  Synthetic Polynucleotide
taatacgactcactataggggatatcctcaaaggtagtaccatctggcagaacagaggagactgccaatgggtactaccaacctggcggcagcgcaaaagatg

SEQ ID NO: 194103 - DNA, 103 bp, Artificial Sequence
  Synthetic Polynucleotide
taatacgactcactataggggcagtgacttgatatcctcaaaggtagtacaacagaggagagtactaatgttgaggataaacctggcggcagcgcaaaagatg

SEQ ID NO: 194104 - DNA, 103 bp, Artificial Sequence
  Synthetic Polynucleotide
taatacgactcactatagggtaaagactctgcagtgacttgatatcctcaaacagaggagatgaggaatgcaagtcactaacctggcggcagcgcaaaagatg

SEQ ID NO: 194105 - DNA, 103 bp, Artificial Sequence
  Synthetic Polynucleotide
taatacgactcactataggggtgctctctataaagactctgcagtgacttaacagaggagaaagtcaatgcagagtcttaacctggcggcagcgcaaaagatg

SEQ ID NO: 194106 - DNA, 103 bp, Artificial Sequence
  Synthetic Polynucleotide
taatacgactcactatagggttgcctcacagtgctctctataaagactctaacagaggagaagagtcatgatagagagcaacctggcggcagcgcaaaagatg

SEQ ID NO: 194107 - DNA, 103 bp, Artificial Sequence
  Synthetic Polynucleotide
taatacgactcactatagggacgtccaatattgcctcacagtgctctctaaacagaggagatagagaatgctgtgaggcaacctggcggcagcgcaaaagatg

SEQ ID NO: 194108 - DNA, 103 bp, Artificial Sequence
  Synthetic Polynucleotide
taatacgactcactatagggattcacaacaacgtccaatattgcctcacaaacagaggagatgtgagatgatattggacaacctggcggcagcgcaaaagatg

SEQ ID NO: 194109 - DNA, 103 bp, Artificial Sequence
  Synthetic Polynucleotide
taatacgactcactataggggtacctgctgtacctgttgttgtactggtaaacagaggagataccagatgaacaacaggaacctggcggcagcgcaaaagatg

SEQ ID NO: 194110 - DNA, 103 bp, Artificial Sequence
  Synthetic Polynucleotide
taatacgactcactatagggtaaattgaagattcacaacaacgtccaataaacagaggagatattggatgttgttgtgaaacctggcggcagcgcaaaagatg

SEQ ID NO: 194111 - DNA, 103 bp, Artificial Sequence
  Synthetic Polynucleotide
taatacgactcactatagggtctatcaggctaaattgaagattcacaacaaacagaggagatgttgtatgtcttcaattaacctggcggcagcgcaaaagatg

SEQ ID NO: 194112 - DNA, 103 bp, Artificial Sequence
  Synthetic Polynucleotide
taatacgactcactatagggccacaatttttctatcaggctaaattgaagaacagaggagacttcaaatgagcctgataaacctggcggcagcgcaaaagatg

SEQ ID NO: 194113 - DNA, 103 bp, Artificial Sequence
  Synthetic Polynucleotide
taatacgactcactatagggagaatgtttgccacaatttttctatcaggcaacagaggagagcctgaatgaaaaattgtaacctggcggcagcgcaaaagatg

SEQ ID NO: 194114 - DNA, 103 bp, Artificial Sequence
  Synthetic Polynucleotide
taatacgactcactataggggaatagcgccagaatgtttgccacaattttaacagaggagaaaaattatggcaaacattaacctggcggcagcgcaaaagatg

SEQ ID NO: 194115 - DNA, 103 bp, Artificial Sequence
  Synthetic Polynucleotide
taatacgactcactatagggagtagagggagaatagcgccagaatgtttgaacagaggagacaaacaatgtggcgctataacctggcggcagcgcaaaagatg

SEQ ID NO: 194116 - DNA, 103 bp, Artificial Sequence
  Synthetic Polynucleotide
taatacgactcactatagggcatcagttggagtagagggagaatagcgccaacagaggagaggcgctatgctccctctaaacctggcggcagcgcaaaagatg

SEQ ID NO: 194117 - DNA, 103 bp, Artificial Sequence
  Synthetic Polynucleotide
taatacgactcactatagggatggtagtgccatcagttggagtagagggaaacagaggagatccctcatgtccaactgaaacctggcggcagcgcaaaagatg

SEQ ID NO: 194118 - DNA, 103 bp, Artificial Sequence
  Synthetic Polynucleotide
taatacgactcactatagggcgattcggtaatggtagtgccatcagttggaacagaggagaccaactatgggcactaccaacctggcggcagcgcaaaagatg

SEQ ID NO: 194119 - DNA, 103 bp, Artificial Sequence
  Synthetic Polynucleotide
taatacgactcactatagggattctgacctcgattcggtaatggtagtgcaacagaggagagcactaatgttaccgaataacctggcggcagcgcaaaagatg

SEQ ID NO: 194120 - DNA, 103 bp, Artificial Sequence
  Synthetic Polynucleotide
taatacgactcactatagggtgcacagtctgtacctgctgtacctgttgtaacagaggagaacaacaatgacagcaggtaacctggcggcagcgcaaaagatg

SEQ ID NO: 194121 - DNA, 103 bp, Artificial Sequence
  Synthetic Polynucleotide
taatacgactcactatagggaaagatgttgattctgacctcgattcggtaaacagaggagataccgaatggaggtcagaaacctggcggcagcgcaaaagatg

SEQ ID NO: 194122 - DNA, 103 bp, Artificial Sequence
  Synthetic Polynucleotide
taatacgactcactatagggatgaattggaaaagatgttgattctgacctaacagaggagaaggtcaatgtcaacatctaacctggcggcagcgcaaaagatg

SEQ ID NO: 194123 - DNA, 103 bp, Artificial Sequence
  Synthetic Polynucleotide
taatacgactcactatagggagccatgaaaatgaattggaaaagatgttgaacagaggagacaacatatgttccaattcaacctggcggcagcgcaaaagatg

SEQ ID NO: 194124 - DNA, 103 bp, Artificial Sequence
  Synthetic Polynucleotide
taatacgactcactatagggttgtacctgctgcacagtctgtacctgctgaacagaggagacagcagatgcagactgtgaacctggcggcagcgcaaaagatg

SEQ ID NO: 194125 - DNA, 103 bp, Artificial Sequence
  Synthetic Polynucleotide
taatacgactcactataggggatagacatgttgtacctgctgcacagtctaacagaggagaagactgatgagcaggtacaacctggcggcagcgcaaaagatg

SEQ ID NO: 194126 - DNA, 103 bp, Artificial Sequence
  Synthetic Polynucleotide
taatacgactcactatagggacctgagcgggatagacatgttgtacctgcaacagaggagagcaggtatgacatgtctaaacctggcggcagcgcaaaagatg

SEQ ID NO: 194127 - DNA, 103 bp, Artificial Sequence
  Synthetic Polynucleotide
taatacgactcactatagggcacatactgcacctgagcgggatagacatgaacagaggagacatgtcatgcccgctcagaacctggcggcagcgcaaaagatg

SEQ ID NO: 194128 - DNA, 103 bp, Artificial Sequence
  Synthetic Polynucleotide
taatacgactcactatagggcgcttccttccacatactgcacctgagcggaacagaggagaccgctcatgtgcagtatgaacctggcggcagcgcaaaagatg

SEQ ID NO: 194129 - DNA, 103 bp, Artificial Sequence
  Synthetic Polynucleotide
taatacgactcactatagggtagacagtatcgcttccttccacatactgcaacagaggagagcagtaatgggaaggaagaacctggcggcagcgcaaaagatg

SEQ ID NO: 194130 - DNA, 103 bp, Artificial Sequence
  Synthetic Polynucleotide
taatacgactcactatagggtccattggtatagacagtatcgcttccttcaacagaggagagaaggaatggatactgtcaacctggcggcagcgcaaaagatg

SEQ ID NO: 194131 - DNA, 103 bp, Artificial Sequence
  Synthetic Polynucleotide
taatacgactcactatagggctgtcgagcctgtgtccgacccagtctctgaacagaggagacagagaatgggtcggacaaacctggcggcagcgcaaaagatg

SEQ ID NO: 194132 - DNA, 103 bp, Artificial Sequence
  Synthetic Polynucleotide
taatacgactcactatagggttcggattgctccattggtatagacagtataacagaggagaatactgatgataccaatgaacctggcggcagcgcaaaagatg

SEQ ID NO: 194133 - DNA, 103 bp, Artificial Sequence
  Synthetic Polynucleotide
taatacgactcactatagggtacgttgttgttcggattgctccattggtaaacagaggagataccaaatgagcaatccgaacctggcggcagcgcaaaagatg

SEQ ID NO: 194134 - DNA, 103 bp, Artificial Sequence
  Synthetic Polynucleotide
taatacgactcactatagggtgtgtaaggatacgttgttgttcggattgcaacagaggagagcaatcatgacaacaacgaacctggcggcagcgcaaaagatg

SEQ ID NO: 194135 - DNA, 103 bp, Artificial Sequence
  Synthetic Polynucleotide
taatacgactcactatagggtctgtgtctctgtgtaaggatacgttgttgaacagaggagacaacaaatgatccttacaaacctggcggcagcgcaaaagatg

SEQ ID NO: 194136 - DNA, 103 bp, Artificial Sequence
  Synthetic Polynucleotide
taatacgactcactatagggtggctgtacatctgtgtctctgtgtaaggaaacagaggagatccttaatgagagacacaaacctggcggcagcgcaaaagatg

SEQ ID NO: 194137 - DNA, 103 bp, Artificial Sequence
  Synthetic Polynucleotide
taatacgactcactatagggtccagtattttggctgtacatctgtgtctcaacagaggagagagacaatgatgtacagcaacctggcggcagcgcaaaagatg

SEQ ID NO: 194138 - DNA, 103 bp, Artificial Sequence
  Synthetic Polynucleotide
taatacgactcactatagggagtaattccctccagtattttggctgtacaaacagaggagatgtacaatgaaaatactgaacctggcggcagcgcaaaagatg

SEQ ID NO: 194139 - DNA, 103 bp, Artificial Sequence
  Synthetic Polynucleotide
taatacgactcactatagggtgagtatcaaagtaattccctccagtatttaacagaggagaaaatacatgagggaattaaacctggcggcagcgcaaaagatg

SEQ ID NO: 194140 - DNA, 103 bp, Artificial Sequence
  Synthetic Polynucleotide
taatacgactcactatagggggaactcccttgagtatcaaagtaattcccaacagaggagagggaatatgtttgatactaacctggcggcagcgcaaaagatg

SEQ ID NO: 194141 - DNA, 103 bp, Artificial Sequence
  Synthetic Polynucleotide
taatacgactcactatagggtcacctgggcggaactcccttgagtatcaaaacagaggagattgataatgaagggagttaacctggcggcagcgcaaaagatg

SEQ ID NO: 194142 - DNA, 103 bp, Artificial Sequence
  Synthetic Polynucleotide
taatacgactcactatagggtgtaaggtcactgtcgagcctgtgtccgacaacagaggagagtcggaatgaggctcgacaacctggcggcagcgcaaaagatg

SEQ ID NO: 194143 - DNA, 103 bp, Artificial Sequence
  Synthetic Polynucleotide
taatacgactcactatagggaccacggtagtcacctgggcggaactccctaacagaggagaagggagatgcgcccaggtaacctggcggcagcgcaaaagatg

SEQ ID NO: 194144 - DNA, 103 bp, Artificial Sequence
  Synthetic Polynucleotide
taatacgactcactataggggtgggatgagaccacggtagtcacctgggcaacagaggagagcccagatgactaccgtgaacctggcggcagcgcaaaagatg

SEQ ID NO: 194145 - DNA, 103 bp, Artificial Sequence
  Synthetic Polynucleotide
taatacgactcactatagggccaccatactgtgggatgagaccacggtagaacagaggagactaccgatgtctcatcccaacctggcggcagcgcaaaagatg

SEQ ID NO: 194146 - DNA, 103 bp, Artificial Sequence
  Synthetic Polynucleotide
taatacgactcactatagggccaccagtgcccaccatactgtgggatgagaacagaggagactcatcatgcagtatggtaacctggcggcagcgcaaaagatg

SEQ ID NO: 194147 - DNA, 103 bp, Artificial Sequence
  Synthetic Polynucleotide
taatacgactcactatagggcatctgaatcccaccagtgcccaccatactaacagaggagaagtatgatgggcactggtaacctggcggcagcgcaaaagatg

SEQ ID NO: 194148 - DNA, 103 bp, Artificial Sequence
  Synthetic Polynucleotide
taatacgactcactatagggctgtgacgcccatctgaatcccaccagtgcaacagaggagagcactgatgggattcagaaacctggcggcagcgcaaaagatg

SEQ ID NO: 194149 - DNA, 103 bp, Artificial Sequence
  Synthetic Polynucleotide
taatacgactcactatagggagttgtcctcctgtgacgcccatctgaatcaacagaggagagattcaatggggcgtcacaacctggcggcagcgcaaaagatg

SEQ ID NO: 194150 - DNA, 103 bp, Artificial Sequence
  Synthetic Polynucleotide
taatacgactcactataggggctgctgatgagttgtcctcctgtgacgccaacagaggagaggcgtcatgggaggacaaaacctggcggcagcgcaaaagatg

SEQ ID NO: 194151 - DNA, 103 bp, Artificial Sequence
  Synthetic Polynucleotide
taatacgactcactatagggttcctccagagctgctgatgagttgtcctcaacagaggagagaggacatgtcatcagcaaacctggcggcagcgcaaaagatg

SEQ ID NO: 194152 - DNA, 103 bp, Artificial Sequence
  Synthetic Polynucleotide
taatacgactcactatagggatcagataggttcctccagagctgctgatgaacagaggagacatcagatgctctggaggaacctggcggcagcgcaaaagatg

SEQ ID NO: 194153 - DNA, 103 bp, Artificial Sequence
  Synthetic Polynucleotide
taatacgactcactatagggcacagatgtttgtaaggtcactgtcgagccaacagaggagaggctcgatggtgaccttaaacctggcggcagcgcaaaagatg

SEQ ID NO: 194154 - DNA, 103 bp, Artificial Sequence
  Synthetic Polynucleotide
taatacgactcactatagggtgagttgccgatcagataggttcctccagaaacagaggagatctggaatgacctatctgaacctggcggcagcgcaaaagatg

SEQ ID NO: 194155 - DNA, 103 bp, Artificial Sequence
  Synthetic Polynucleotide
taatacgactcactatagggaattctccattgagttgccgatcagataggaacagaggagacctatcatgtcggcaactaacctggcggcagcgcaaaagatg

SEQ ID NO: 194156 - DNA, 103 bp, Artificial Sequence
  Synthetic Polynucleotide
taatacgactcactataggggagtgaccagaattctccattgagttgccgaacagaggagacggcaaatgaatggagaaaacctggcggcagcgcaaaagatg

SEQ ID NO: 194157 - DNA, 103 bp, Artificial Sequence
  Synthetic Polynucleotide
taatacgactcactataggggtgtgtcactgagtgaccagaattctccataacagaggagaatggagatgtctggtcacaacctggcggcagcgcaaaagatg

SEQ ID NO: 194158 - DNA, 103 bp, Artificial Sequence
  Synthetic Polynucleotide
taatacgactcactatagggcccgagttgtgtgtgtcactgagtgaccagaacagaggagactggtcatgcagtgacacaacctggcggcagcgcaaaagatg

SEQ ID NO: 194159 - DNA, 103 bp, Artificial Sequence
  Synthetic Polynucleotide
taatacgactcactataggggctggggaggcccgagttgtgtgtgtcactaacagaggagaagtgacatgcacaactcgaacctggcggcagcgcaaaagatg

SEQ ID NO: 194160 - DNA, 103 bp, Artificial Sequence
  Synthetic Polynucleotide
taatacgactcactatagggttcaattgtcgctggggaggcccgagttgtaacagaggagaacaactatggcctccccaaacctggcggcagcgcaaaagatg

SEQ ID NO: 194161 - DNA, 103 bp, Artificial Sequence
  Synthetic Polynucleotide
taatacgactcactatagggcaatcgccatttcaattgtcgctggggaggaacagaggagacctcccatgcgacaattgaacctggcggcagcgcaaaagatg

SEQ ID NO: 194162 - DNA, 103 bp, Artificial Sequence
  Synthetic Polynucleotide
taatacgactcactatagggtgcagcgtctcaatcgccatttcaattgtcaacagaggagagacaatatgaatggcgataacctggcggcagcgcaaaagatg

SEQ ID NO: 194163 - DNA, 103 bp, Artificial Sequence
  Synthetic Polynucleotide
taatacgactcactataggggtcagacttttgcagcgtctcaatcgccataacagaggagaatggcgatggagacgctgaacctggcggcagcgcaaaagatg

SEQ ID NO: 194164 - DNA, 103 bp, Artificial Sequence
  Synthetic Polynucleotide
taatacgactcactatagggcttgactagccacagatgtttgtaaggtcaaacagaggagatgacctatgaaacatctgaacctggcggcagcgcaaaagatg

SEQ ID NO: 194165 - DNA, 103 bp, Artificial Sequence
  Synthetic Polynucleotide
taatacgactcactatagggtggacagaccgtcagacttttgcagcgtctaacagaggagaagacgcatgaaaagtctgaacctggcggcagcgcaaaagatg

SEQ ID NO: 194166 - DNA, 103 bp, Artificial Sequence
  Synthetic Polynucleotide
taatacgactcactatagggcttctgtgagtggacagaccgtcagactttaacagaggagaaaagtcatgcggtctgtcaacctggcggcagcgcaaaagatg

SEQ ID NO: 194167 - DNA, 103 bp, Artificial Sequence
  Synthetic Polynucleotide
taatacgactcactataggggagaagagagcttctgtgagtggacagaccaacagaggagaggtctgatgactcacagaaacctggcggcagcgcaaaagatg

SEQ ID NO: 194168 - DNA, 103 bp, Artificial Sequence
  Synthetic Polynucleotide
taatacgactcactataggggatggctgttgagaagagagcttctgtgagaacagaggagactcacaatggctctcttcaacctggcggcagcgcaaaagatg

SEQ ID NO: 194169 - DNA, 103 bp, Artificial Sequence
  Synthetic Polynucleotide
taatacgactcactatagggagccactggagatggctgttgagaagagagaacagaggagactctctatgcaacagccaaacctggcggcagcgcaaaagatg

SEQ ID NO: 194170 - DNA, 103 bp, Artificial Sequence
  Synthetic Polynucleotide
taatacgactcactatagggattgtccaacagccactggagatggctgttaacagaggagaaacagcatgctccagtggaacctggcggcagcgcaaaagatg

SEQ ID NO: 194171 - DNA, 103 bp, Artificial Sequence
  Synthetic Polynucleotide
taatacgactcactatagggctgtctcataattgtccaacagccactggaaacagaggagatccagtatgtgttggacaaacctggcggcagcgcaaaagatg

SEQ ID NO: 194172 - DNA, 103 bp, Artificial Sequence
  Synthetic Polynucleotide
taatacgactcactatagggactccttctgctgtctcataattgtccaacaacagaggagagttggaatgttatgagacaacctggcggcagcgcaaaagatg

SEQ ID NO: 194173 - DNA, 103 bp, Artificial Sequence
  Synthetic Polynucleotide
taatacgactcactataggggggaaggctcactccttctgctgtctcataaacagaggagatatgagatggcagaaggaaacctggcggcagcgcaaaagatg

SEQ ID NO: 194174 - DNA, 103 bp, Artificial Sequence
  Synthetic Polynucleotide
taatacgactcactataggggagtgcttctgggaaggctcactccttctgaacagaggagacagaagatgtgagccttcaacctggcggcagcgcaaaagatg

SEQ ID NO: 194175 - DNA, 103 bp, Artificial Sequence
  Synthetic Polynucleotide
taatacgactcactatagggggcactgctgcttgactagccacagatgttaacagaggagaaacatcatgggctagtcaaacctggcggcagcgcaaaagatg

SEQ ID NO: 194176 - DNA, 103 bp, Artificial Sequence
  Synthetic Polynucleotide
taatacgactcactatagggtggttgtacagagtgcttctgggaaggctcaacagaggagagagcctatgcagaagcacaacctggcggcagcgcaaaagatg

SEQ ID NO: 194177 - DNA, 103 bp, Artificial Sequence
  Synthetic Polynucleotide
taatacgactcactatagggtcgaaggtagtggttgtacagagtgcttctaacagaggagaagaagcatgctgtacaacaacctggcggcagcgcaaaagatg

SEQ ID NO: 194178 - DNA, 103 bp, Artificial Sequence
  Synthetic Polynucleotide
taatacgactcactatagggcctgacagtgtcgaaggtagtggttgtacaaacagaggagatgtacaatgactaccttcaacctggcggcagcgcaaaagatg

SEQ ID NO: 194179 - DNA, 103 bp, Artificial Sequence
  Synthetic Polynucleotide
taatacgactcactatagggagtttgtgttcctgacagtgtcgaaggtagaacagaggagactacctatgacactgtcaaacctggcggcagcgcaaaagatg

SEQ ID NO: 194180 - DNA, 103 bp, Artificial Sequence
  Synthetic Polynucleotide
taatacgactcactataggggactgggtccagtttgtgttcctgacagtgaacagaggagacactgtatggaacacaaaaacctggcggcagcgcaaaagatg

SEQ ID NO: 194181 - DNA, 103 bp, Artificial Sequence
  Synthetic Polynucleotide
taatacgactcactatagggaggcagcattgactgggtccagtttgtgttaacagaggagaaacacaatgtggacccagaacctggcggcagcgcaaaagatg

SEQ ID NO: 194182 - DNA, 103 bp, Artificial Sequence
  Synthetic Polynucleotide
taatacgactcactatagggtttccaaaagaggcagcattgactgggtccaacagaggagaggacccatgcaatgctgcaacctggcggcagcgcaaaagatg

SEQ ID NO: 194183 - DNA, 103 bp, Artificial Sequence
  Synthetic Polynucleotide
taatacgactcactatagggtcttattaattttccaaaagaggcagcattaacagaggagaaatgctatgtcttttggaaacctggcggcagcgcaaaagatg

SEQ ID NO: 194184 - DNA, 103 bp, Artificial Sequence
  Synthetic Polynucleotide
taatacgactcactatagggtaaaaattgatcttattaattttccaaaagaacagaggagacttttgatgaattaataaaacctggcggcagcgcaaaagatg

SEQ ID NO: 194185 - DNA, 103 bp, Artificial Sequence
  Synthetic Polynucleotide
taatacgactcactatagggcgtagccccataaaaattgatcttattaataacagaggagaattaatatgatcaattttaacctggcggcagcgcaaaagatg

SEQ ID NO: 194186 - DNA, 103 bp, Artificial Sequence
  Synthetic Polynucleotide
taatacgactcactatagggcacctgcgtaggcactgctgcttgactagcaacagaggagagctagtatggcagcagtgaacctggcggcagcgcaaaagatg

SEQ ID NO: 194187 - DNA, 103 bp, Artificial Sequence
  Synthetic Polynucleotide
taatacgactcactatagggtctcctggttcgtagccccataaaaattgaaacagaggagatcaattatgatggggctaaacctggcggcagcgcaaaagatg

SEQ ID NO: 194188 - DNA, 103 bp, Artificial Sequence
  Synthetic Polynucleotide
taatacgactcactatagggtagtgcccaatctcctggttcgtagccccaaacagaggagatggggcatggaaccaggaaacctggcggcagcgcaaaagatg

SEQ ID NO: 194189 - DNA, 103 bp, Artificial Sequence
  Synthetic Polynucleotide
taatacgactcactataggggagtttcctctagtgcccaatctcctggttaacagaggagaaaccagatgattgggcacaacctggcggcagcgcaaaagatg

SEQ ID NO: 194190 - DNA, 103 bp, Artificial Sequence
  Synthetic Polynucleotide
taatacgactcactataggggtggtatttggagtttcctctagtgcccaaaacagaggagattgggcatgagaggaaacaacctggcggcagcgcaaaagatg

SEQ ID NO: 194191 - DNA, 103 bp, Artificial Sequence
  Synthetic Polynucleotide
taatacgactcactatagggtcccatagtagtggtatttggagtttcctcaacagaggagagaggaaatgccaaataccaacctggcggcagcgcaaaagatg

SEQ ID NO: 194192 - DNA, 103 bp, Artificial Sequence
  Synthetic Polynucleotide
taatacgactcactatagggttgacacgaatcccatagtagtggtatttgaacagaggagacaaataatgctactatggaacctggcggcagcgcaaaagatg

SEQ ID NO: 194193 - DNA, 103 bp, Artificial Sequence
  Synthetic Polynucleotide
taatacgactcactatagggggaatctggcttgacacgaatcccatagtaaacagaggagatactatatgattcgtgtcaacctggcggcagcgcaaaagatg

SEQ ID NO: 194194 - DNA, 103 bp, Artificial Sequence
  Synthetic Polynucleotide
taatacgactcactataggggattaagaggggaatctggcttgacacgaaaacagaggagattcgtgatgagccagattaacctggcggcagcgcaaaagatg

SEQ ID NO: 194195 - DNA, 103 bp, Artificial Sequence
  Synthetic Polynucleotide
taatacgactcactatagggtcttgcagacgattaagaggggaatctggcaacagaggagagccagaatgccctcttaaaacctggcggcagcgcaaaagatg

SEQ ID NO: 194196 - DNA, 103 bp, Artificial Sequence
  Synthetic Polynucleotide
taatacgactcactatagggctgcatgtcttcttgcagacgattaagaggaacagaggagacctcttatgcgtctgcaaaacctggcggcagcgcaaaagatg

SEQ ID NO: 194197 - DNA, 103 bp, Artificial Sequence
  Synthetic Polynucleotide
taatacgactcactatagggcttgctgtaccacctgcgtaggcactgctgaacagaggagacagcagatgctacgcaggaacctggcggcagcgcaaaagatg

SEQ ID NO: 194198 - DNA, 103 bp, Artificial Sequence
  Synthetic Polynucleotide
taatacgactcactatagggtagccatatactgcatgtcttcttgcagacaacagaggagagtctgcatgaagacatgcaacctggcggcagcgcaaaagatg

SEQ ID NO: 194199 - DNA, 103 bp, Artificial Sequence
  Synthetic Polynucleotide
taatacgactcactatagggtgttgtctcatagccatatactgcatgtctaacagaggagaagacatatggtatatggcaacctggcggcagcgcaaaagatg

SEQ ID NO: 194200 - DNA, 103 bp, Artificial Sequence
  Synthetic Polynucleotide
taatacgactcactatagggttgcatgggttgttgtctcatagccatataaacagaggagatatatgatgatgagacaaaacctggcggcagcgcaaaagatg

SEQ ID NO: 194201 - DNA, 103 bp, Artificial Sequence
  Synthetic Polynucleotide
taatacgactcactatagggtttgtttctgttgcatgggttgttgtctcaaacagaggagatgagacatgaacccatgcaacctggcggcagcgcaaaagatg

SEQ ID NO: 194202 - DNA, 103 bp, Artificial Sequence
  Synthetic Polynucleotide
taatacgactcactatagggggcttgtacctttgtttctgttgcatgggtaacagaggagaacccatatgacagaaacaaacctggcggcagcgcaaaagatg

SEQ ID NO: 194203 - DNA, 103 bp, Artificial Sequence
  Synthetic Polynucleotide
taatacgactcactatagggtttctgcataggcttgtacctttgtttctgaacagaggagacagaaaatgaggtacaagaacctggcggcagcgcaaaagatg

SEQ ID NO: 194204 - DNA, 103 bp, Artificial Sequence
  Synthetic Polynucleotide
taatacgactcactatagggccccatccactttctgcataggcttgtaccaacagaggagaggtacaatgctatgcagaaacctggcggcagcgcaaaagatg

SEQ ID NO: 194205 - DNA, 103 bp, Artificial Sequence
  Synthetic Polynucleotide
taatacgactcactatagggccatctgcaaccccatccactttctgcataaacagaggagatatgcaatgagtggatggaacctggcggcagcgcaaaagatg

SEQ ID NO: 194206 - DNA, 103 bp, Artificial Sequence
  Synthetic Polynucleotide
taatacgactcactatagggtcctgtgaaaccatctgcaaccccatccacaacagaggagagtggatatggttgcagataacctggcggcagcgcaaaagatg

SEQ ID NO: 194207 - DNA, 103 bp, Artificial Sequence
  Synthetic Polynucleotide
taatacgactcactataggggttgaccacttcctgtgaaaccatctgcaaaacagaggagattgcagatggtttcacagaacctggcggcagcgcaaaagatg

SEQ ID NO: 194208 - DNA, 103 bp, Artificial Sequence
  Synthetic Polynucleotide
taatacgactcactatagggtgtactggtacttgctgtaccacctgcgtaaacagaggagatacgcaatgggtacagcaaacctggcggcagcgcaaaagatg

SEQ ID NO: 194209 - DNA, 103 bp, Artificial Sequence
  Synthetic Polynucleotide
taatacgactcactataggggtgcctgtctgttgaccacttcctgtgaaaaacagaggagatttcacatgaagtggtcaaacctggcggcagcgcaaaagatg

SEQ ID NO: 194210 - DNA, 103 bp, Artificial Sequence
  Synthetic Polynucleotide
taatacgactcactatagggctcaacagatgtgcctgtctgttgaccactaacagaggagaagtggtatgcagacaggcaacctggcggcagcgcaaaagatg

SEQ ID NO: 194211 - DNA, 103 bp, Artificial Sequence
  Synthetic Polynucleotide
taatacgactcactatagggttacagtttgctcaacagatgtgcctgtctaacagaggagaagacagatgcatctgttgaacctggcggcagcgcaaaagatg

SEQ ID NO: 194212 - DNA, 103 bp, Artificial Sequence
  Synthetic Polynucleotide
taatacgactcactatagggctttgggcaattacagtttgctcaacagataacagaggagaatctgtatggcaaactgtaacctggcggcagcgcaaaagatg

SEQ ID NO: 194213 - DNA, 103 bp, Artificial Sequence
  Synthetic Polynucleotide
taatacgactcactatagggatgatgttggctttgggcaattacagtttgaacagaggagacaaactatgattgcccaaaacctggcggcagcgcaaaagatg

SEQ ID NO: 194214 - DNA, 103 bp, Artificial Sequence
  Synthetic Polynucleotide
taatacgactcactatagggaaaactgttgatgatgttggctttgggcaaaacagaggagattgcccatggccaacatcaacctggcggcagcgcaaaagatg

SEQ ID NO: 194215 - DNA, 103 bp, Artificial Sequence
  Synthetic Polynucleotide
taatacgactcactataggggatgcatctaaaaactgttgatgatgttggaacagaggagaccaacaatgtcaacagttaacctggcggcagcgcaaaagatg

SEQ ID NO: 194216 - DNA, 103 bp, Artificial Sequence
  Synthetic Polynucleotide
taatacgactcactatagggaagtgctcgagatgcatctaaaaactgttgaacagaggagacaacagatgttagatgcaaacctggcggcagcgcaaaagatg

SEQ ID NO: 194217 - DNA, 103 bp, Artificial Sequence
  Synthetic Polynucleotide
taatacgactcactatagggcaaactctggaagtgctcgagatgcatctaaacagaggagatagatgatgctcgagcacaacctggcggcagcgcaaaagatg

SEQ ID NO: 194218 - DNA, 103 bp, Artificial Sequence
  Synthetic Polynucleotide
taatacgactcactatagggtcaacttctccaaactctggaagtgctcgaaacagaggagatcgagcatgtccagagttaacctggcggcagcgcaaaagatg

SEQ ID NO: 194219 - DNA, 103 bp, Artificial Sequence
  Synthetic Polynucleotide
taatacgactcactatagggttcagaccctccgaaggcagcccagttcataacagaggagaatgaacatggctgccttcaacctggcggcagcgcaaaagatg

SEQ ID NO: 194220 - DNA, 103 bp, Artificial Sequence
  Synthetic Polynucleotide
taatacgactcactatagggcactgcaatgccatagtaatggtaccattcaacagaggagagaatggatgcattactataacctggcggcagcgcaaaagatg

SEQ ID NO: 194221 - DNA, 103 bp, Artificial Sequence
  Synthetic Polynucleotide
taatacgactcactataggggaaacaggaccacatcaagaggaactgctgaacagaggagacagcagatgctcttgatgaacctggcggcagcgcaaaagatg

SEQ ID NO: 194222 - DNA, 103 bp, Artificial Sequence
  Synthetic Polynucleotide
taatacgactcactatagggcccttgtgccgaaacaggaccacatcaagaaacagaggagatcttgaatgggtcctgttaacctggcggcagcgcaaaagatg

SEQ ID NO: 194223 - DNA, 103 bp, Artificial Sequence
  Synthetic Polynucleotide
taatacgactcactatagggtcccggatcacccttgtgccgaaacaggacaacagaggagagtcctgatgcggcacaagaacctggcggcagcgcaaaagatg

SEQ ID NO: 194224 - DNA, 103 bp, Artificial Sequence
  Synthetic Polynucleotide
taatacgactcactatagggcaaggtcatgtcccggatcacccttgtgccaacagaggagaggcacaatggtgatccggaacctggcggcagcgcaaaagatg

SEQ ID NO: 194225 - DNA, 103 bp, Artificial Sequence
  Synthetic Polynucleotide
taatacgactcactataggggggcgctgtgcaaggtcatgtcccggatcaaacagaggagatgatccatgacatgacctaacctggcggcagcgcaaaagatg

SEQ ID NO: 194226 - DNA, 103 bp, Artificial Sequence
  Synthetic Polynucleotide
taatacgactcactatagggccgaagctgggggcgctgtgcaaggtcatgaacagaggagacatgacatggcacagcgcaacctggcggcagcgcaaaagatg

SEQ ID NO: 194227 - DNA, 103 bp, Artificial Sequence
  Synthetic Polynucleotide
taatacgactcactataggggtgaaaagacccgaagctgggggcgctgtgaacagaggagacacagcatgcccagcttcaacctggcggcagcgcaaaagatg

SEQ ID NO: 194228 - DNA, 103 bp, Artificial Sequence
  Synthetic Polynucleotide
taatacgactcactatagggagtgaattaggtgaaaagacccgaagctggaacagaggagaccagctatgggtcttttcaacctggcggcagcgcaaaagatg

SEQ ID NO: 194229 - DNA, 103 bp, Artificial Sequence
  Synthetic Polynucleotide
taatacgactcactatagggtcaaacattaagtgaattaggtgaaaagacaacagaggagagtctttatgcctaattcaaacctggcggcagcgcaaaagatg

SEQ ID NO: 194230 - DNA, 103 bp, Artificial Sequence
  Synthetic Polynucleotide
taatacgactcactatagggcacgtagtcatcaaacattaagtgaattagaacagaggagactaattatgttaatgtttaacctggcggcagcgcaaaagatg

SEQ ID NO: 194231 - DNA, 103 bp, Artificial Sequence
  Synthetic Polynucleotide
taatacgactcactatagggagctttctttcactgcaatgccatagtaataacagaggagaattactatggcattgcagaacctggcggcagcgcaaaagatg

SEQ ID NO: 194232 - DNA, 103 bp, Artificial Sequence
  Synthetic Polynucleotide
taatacgactcactatagggacaggtagagcacgtagtcatcaaacattaaacagaggagataatgtatgatgactacgaacctggcggcagcgcaaaagatg

SEQ ID NO: 194233 - DNA, 103 bp, Artificial Sequence
  Synthetic Polynucleotide
taatacgactcactatagggagagattctaacaggtagagcacgtagtcaaacagaggagatgactaatggctctacctaacctggcggcagcgcaaaagatg

SEQ ID NO: 194234 - DNA, 103 bp, Artificial Sequence
  Synthetic Polynucleotide
taatacgactcactatagggctgacagtgcagagattctaacaggtagagaacagaggagactctacatgttagaatctaacctggcggcagcgcaaaagatg

SEQ ID NO: 194235 - DNA, 103 bp, Artificial Sequence
  Synthetic Polynucleotide
taatacgactcactatagggtggcccgctcctgacagtgcagagattctaaacagaggagatagaatatgtgcactgtcaacctggcggcagcgcaaaagatg

SEQ ID NO: 194236 - DNA, 103 bp, Artificial Sequence
  Synthetic Polynucleotide
taatacgactcactatagggatgagctcattggcccgctcctgacagtgcaacagaggagagcactgatgggagcgggcaacctggcggcagcgcaaaagatg

SEQ ID NO: 194237 - DNA, 103 bp, Artificial Sequence
  Synthetic Polynucleotide
taatacgactcactatagggcatggctcgcatgagctcattggcccgctcaacagaggagagagcggatgaatgagctcaacctggcggcagcgcaaaagatg

SEQ ID NO: 194238 - DNA, 103 bp, Artificial Sequence
  Synthetic Polynucleotide
taatacgactcactatagggcttctcccttcatggctcgcatgagctcataacagaggagaatgagcatgtgcgagccaaacctggcggcagcgcaaaagatg

SEQ ID NO: 194239 - DNA, 103 bp, Artificial Sequence
  Synthetic Polynucleotide
taatacgactcactataggggcagtgcttccttctcccttcatggctcgcaacagaggagagcgagcatggaagggagaaacctggcggcagcgcaaaagatg

SEQ ID NO: 194240 - DNA, 103 bp, Artificial Sequence
  Synthetic Polynucleotide
taatacgactcactatagggtcggacttctgcagtgcttccttctcccttaacagaggagaaagggaatgggaagcactaacctggcggcagcgcaaaagatg

SEQ ID NO: 194241 - DNA, 103 bp, Artificial Sequence
  Synthetic Polynucleotide
taatacgactcactatagggtgatctcttctcggacttctgcagtgcttcaacagaggagagaagcaatgcagaagtccaacctggcggcagcgcaaaagatg

SEQ ID NO: 194242 - DNA, 103 bp, Artificial Sequence
  Synthetic Polynucleotide
taatacgactcactatagggtaatattgggagctttctttcactgcaatgaacagaggagacattgcatggaaagaaagaacctggcggcagcgcaaaagatg

SEQ ID NO: 194243 - DNA, 103 bp, Artificial Sequence
  Synthetic Polynucleotide
taatacgactcactatagggtctgtcaagatgatctcttctcggacttctaacagaggagaagaagtatgagaagagataacctggcggcagcgcaaaagatg

SEQ ID NO: 194244 - DNA, 103 bp, Artificial Sequence
  Synthetic Polynucleotide
taatacgactcactatagggtgcggcagcctctgtcaagatgatctcttcaacagaggagagaagagatgatcttgacaaacctggcggcagcgcaaaagatg

SEQ ID NO: 194245 - DNA, 103 bp, Artificial Sequence
  Synthetic Polynucleotide
taatacgactcactatagggaaggggttggtgcggcagcctctgtcaagaaacagaggagatcttgaatgaggctgccgaacctggcggcagcgcaaaagatg

SEQ ID NO: 194246 - DNA, 103 bp, Artificial Sequence
  Synthetic Polynucleotide
taatacgactcactatagggggcactggtgaaggggttggtgcggcagccaacagaggagaggctgcatgaccaaccccaacctggcggcagcgcaaaagatg

SEQ ID NO: 194247 - DNA, 103 bp, Artificial Sequence
  Synthetic Polynucleotide
taatacgactcactatagggagaaaacgatggcactggtgaaggggttggaacagaggagaccaaccatgtcaccagtgaacctggcggcagcgcaaaagatg

SEQ ID NO: 194248 - DNA, 103 bp, Artificial Sequence
  Synthetic Polynucleotide
taatacgactcactatagggattttgctggagaaaacgatggcactggtgaacagaggagacaccagatgcatcgttttaacctggcggcagcgcaaaagatg

SEQ ID NO: 194249 - DNA, 103 bp, Artificial Sequence
  Synthetic Polynucleotide
taatacgactcactataggggatgtggcagattttgctggagaaaacgataacagaggagaatcgttatgtccagcaaaaacctggcggcagcgcaaaagatg

SEQ ID NO: 194250 - DNA, 103 bp, Artificial Sequence
  Synthetic Polynucleotide
taatacgactcactatagggcacttccacagatgtggcagattttgctggaacagaggagaccagcaatgtctgccacaaacctggcggcagcgcaaaagatg

SEQ ID NO: 194251 - DNA, 103 bp, Artificial Sequence
  Synthetic Polynucleotide
taatacgactcactatagggagggaggtggcacttccacagatgtggcagaacagaggagactgccaatgctgtggaagaacctggcggcagcgcaaaagatg

SEQ ID NO: 194252 - DNA, 103 bp, Artificial Sequence
  Synthetic Polynucleotide
taatacgactcactatagggacaggggaagagggaggtggcacttccacaaacagaggagatgtggaatggccacctccaacctggcggcagcgcaaaagatg

SEQ ID NO: 194253 - DNA, 103 bp, Artificial Sequence
  Synthetic Polynucleotide
taatacgactcactatagggcatcacatcataatattgggagctttctttaacagaggagaaaagaaatgtcccaatataacctggcggcagcgcaaaagatg

SEQ ID NO: 194254 - DNA, 103 bp, Artificial Sequence
  Synthetic Polynucleotide
taatacgactcactatagggaggattgctaacaggggaagagggaggtggaacagaggagaccacctatgtcttcccctaacctggcggcagcgcaaaagatg

SEQ ID NO: 194255 - DNA, 103 bp, Artificial Sequence
  Synthetic Polynucleotide
taatacgactcactatagggactcaggggaaggattgctaacaggggaagaacagaggagacttcccatgttagcaatcaacctggcggcagcgcaaaagatg

SEQ ID NO: 194256 - DNA, 103 bp, Artificial Sequence
  Synthetic Polynucleotide
taatacgactcactatagggaggccagtgtactcaggggaaggattgctaaacagaggagatagcaaatgttcccctgaaacctggcggcagcgcaaaagatg

SEQ ID NO: 194257 - DNA, 103 bp, Artificial Sequence
  Synthetic Polynucleotide
taatacgactcactatagggtgtagtgctgaggccagtgtactcaggggaaacagaggagatcccctatgtacactggcaacctggcggcagcgcaaaagatg

SEQ ID NO: 194258 - DNA, 103 bp, Artificial Sequence
  Synthetic Polynucleotide
taatacgactcactataggggcattgctcctgtagtgctgaggccagtgtaacagaggagaacactgatgtcagcactaaacctggcggcagcgcaaaagatg

SEQ ID NO: 194259 - DNA, 103 bp, Artificial Sequence
  Synthetic Polynucleotide
taatacgactcactataggggtgtaagactgcattgctcctgtagtgctgaacagaggagacagcacatgaggagcaataacctggcggcagcgcaaaagatg

SEQ ID NO: 194260 - DNA, 103 bp, Artificial Sequence
  Synthetic Polynucleotide
taatacgactcactatagggtagagaccacgtgtaagactgcattgctccaacagaggagaggagcaatgcagtcttacaacctggcggcagcgcaaaagatg

SEQ ID NO: 194261 - DNA, 103 bp, Artificial Sequence
  Synthetic Polynucleotide
taatacgactcactatagggctgtgtatgttagagaccacgtgtaagactaacagaggagaagtcttatgcgtggtctcaacctggcggcagcgcaaaagatg

SEQ ID NO: 194262 - DNA, 103 bp, Artificial Sequence
  Synthetic Polynucleotide
taatacgactcactataggggccgtcgtcactgtgtatgttagagaccacaacagaggagagtggtcatgaacatacacaacctggcggcagcgcaaaagatg

SEQ ID NO: 194263 - DNA, 103 bp, Artificial Sequence
  Synthetic Polynucleotide
taatacgactcactatagggggacccagcagccgtcgtcactgtgtatgtaacagaggagaacatacatggtgacgacgaacctggcggcagcgcaaaagatg

SEQ ID NO: 194264 - DNA, 103 bp, Artificial Sequence
  Synthetic Polynucleotide
taatacgactcactatagggtcttggaatacatcacatcataatattgggaacagaggagacccaatatgatgatgtgaaacctggcggcagcgcaaaagatg

SEQ ID NO: 194265 - DNA, 103 bp, Artificial Sequence
  Synthetic Polynucleotide
taatacgactcactatagggtctcagctggggacccagcagccgtcgtcaaacagaggagatgacgaatgctgctgggtaacctggcggcagcgcaaaagatg

SEQ ID NO: 194266 - DNA, 103 bp, Artificial Sequence
  Synthetic Polynucleotide
taatacgactcactatagggtgttgggagttctcagctggggacccagcaaacagaggagatgctggatgcccagctgaaacctggcggcagcgcaaaagatg

SEQ ID NO: 194267 - DNA, 103 bp, Artificial Sequence
  Synthetic Polynucleotide
taatacgactcactatagggacagggcagctgttgggagttctcagctggaacagaggagaccagctatgaactcccaaaacctggcggcagcgcaaaagatg

SEQ ID NO: 194268 - DNA, 103 bp, Artificial Sequence
  Synthetic Polynucleotide
taatacgactcactatagggtgttcctcatacagggcagctgttgggagtaacagaggagaactcccatgagctgccctaacctggcggcagcgcaaaagatg

SEQ ID NO: 194269 - DNA, 103 bp, Artificial Sequence
  Synthetic Polynucleotide
taatacgactcactatagggggcacatgagtgttcctcatacagggcagcaacagaggagagctgccatgtatgaggaaaacctggcggcagcgcaaaagatg

SEQ ID NO: 194270 - DNA, 103 bp, Artificial Sequence
  Synthetic Polynucleotide
taatacgactcactatagggggaggaagaaggcacatgagtgttcctcataacagaggagaatgaggatgactcatgtgaacctggcggcagcgcaaaagatg

SEQ ID NO: 194271 - DNA, 103 bp, Artificial Sequence
  Synthetic Polynucleotide
taatacgactcactatagggtgtgtgtgacggaggaagaaggcacatgagaacagaggagactcatgatgcttcttcctaacctggcggcagcgcaaaagatg

SEQ ID NO: 194272 - DNA, 103 bp, Artificial Sequence
  Synthetic Polynucleotide
taatacgactcactatagggactggtatcctgtgtgtgacggaggaagaaaacagaggagattcttcatgcgtcacacaaacctggcggcagcgcaaaagatg

SEQ ID NO: 194273 - DNA, 103 bp, Artificial Sequence
  Synthetic Polynucleotide
taatacgactcactataggggtggggataaactggtatcctgtgtgtgacaacagaggagagtcacaatgaggataccaaacctggcggcagcgcaaaagatg

SEQ ID NO: 194274 - DNA, 103 bp, Artificial Sequence
  Synthetic Polynucleotide
taatacgactcactataggggttcctctctgtggggataaactggtatccaacagaggagaggatacatgtttatccccaacctggcggcagcgcaaaagatg

SEQ ID NO: 194275 - DNA, 103 bp, Artificial Sequence
  Synthetic Polynucleotide
taatacgactcactataggggcagctcctttcttggaatacatcacatcaaacagaggagatgatgtatggtattccaaaacctggcggcagcgcaaaagatg

SEQ ID NO: 194276 - DNA, 103 bp, Artificial Sequence
  Synthetic Polynucleotide
taatacgactcactataggggtgtatccatgttcctctctgtggggataaaacagaggagattatccatgcagagaggaaacctggcggcagcgcaaaagatg

SEQ ID NO: 194277 - DNA, 103 bp, Artificial Sequence
  Synthetic Polynucleotide
taatacgactcactatagggatagcttcccgtgtatccatgttcctctctaacagaggagaagagagatgcatggatacaacctggcggcagcgcaaaagatg

SEQ ID NO: 194278 - DNA, 103 bp, Artificial Sequence
  Synthetic Polynucleotide
taatacgactcactatagggtcccatagttatagcttcccgtgtatccataacagaggagaatggatatgcgggaagctaacctggcggcagcgcaaaagatg

SEQ ID NO: 194279 - DNA, 103 bp, Artificial Sequence
  Synthetic Polynucleotide
taatacgactcactatagggttgccatagctcccatagttatagcttcccaacagaggagagggaagatgtaactatggaacctggcggcagcgcaaaagatg

SEQ ID NO: 194280 - DNA, 103 bp, Artificial Sequence
  Synthetic Polynucleotide
taatacgactcactatagggaggatgctggttgccatagctcccatagttaacagaggagaaactatatgagctatggcaacctggcggcagcgcaaaagatg

SEQ ID NO: 194281 - DNA, 103 bp, Artificial Sequence
  Synthetic Polynucleotide
taatacgactcactataggggcatggggtgaggatgctggttgccatagcaacagaggagagctatgatgaccagcatcaacctggcggcagcgcaaaagatg

SEQ ID NO: 194282 - DNA, 103 bp, Artificial Sequence
  Synthetic Polynucleotide
taatacgactcactatagggtactggctctgcatggggtgaggatgctggaacagaggagaccagcaatgtcaccccataacctggcggcagcgcaaaagatg

SEQ ID NO: 194283 - DNA, 103 bp, Artificial Sequence
  Synthetic Polynucleotide
taatacgactcactataggggagggccggatactggctctgcatggggtgaacagaggagacaccccatgcagagccagaacctggcggcagcgcaaaagatg

SEQ ID NO: 194284 - DNA, 103 bp, Artificial Sequence
  Synthetic Polynucleotide
taatacgactcactatagggtgtcatgagggagggccggatactggctctaacagaggagaagagccatgatccggcccaacctggcggcagcgcaaaagatg

SEQ ID NO: 194285 - DNA, 103 bp, Artificial Sequence
  Synthetic Polynucleotide
taatacgactcactataggggagatagctgtgtcatgagggagggccggaaacagaggagatccggcatgccctcatgaaacctggcggcagcgcaaaagatg

SEQ ID NO: 194286 - DNA, 103 bp, Artificial Sequence
  Synthetic Polynucleotide
taatacgactcactatagggactcacccaggcagctcctttcttggaataaacagaggagatattccatgaaaggagctaacctggcggcagcgcaaaagatg

SEQ ID NO: 194287 - DNA, 103 bp, Artificial Sequence
  Synthetic Polynucleotide
taatacgactcactataggggagtggcccagagatagctgtgtcatgaggaacagaggagacctcatatgacagctatcaacctggcggcagcgcaaaagatg

SEQ ID NO: 194288 - DNA, 103 bp, Artificial Sequence
  Synthetic Polynucleotide
taatacgactcactataggggggcatagtggagtggcccagagatagctgaacagaggagacagctaatgctgggccacaacctggcggcagcgcaaaagatg

SEQ ID NO: 194289 - DNA, 103 bp, Artificial Sequence
  Synthetic Polynucleotide
taatacgactcactatagggctgtggtaaggggcatagtggagtggcccaaacagaggagatgggccatgccactatgcaacctggcggcagcgcaaaagatg

SEQ ID NO: 194290 - DNA, 103 bp, Artificial Sequence
  Synthetic Polynucleotide
taatacgactcactatagggtgcagagctcctgtggtaaggggcatagtgaacagaggagacactatatgccttaccacaacctggcggcagcgcaaaagatg

SEQ ID NO: 194291 - DNA, 103 bp, Artificial Sequence
  Synthetic Polynucleotide
taatacgactcactatagggaagggtactgtgcagagctcctgtggtaagaacagaggagacttaccatgggagctctgaacctggcggcagcgcaaaagatg

SEQ ID NO: 194292 - DNA, 103 bp, Artificial Sequence
  Synthetic Polynucleotide
taatacgactcactataggggggctattaaaagggtactgtgcagagctcaacagaggagagagctcatgacagtacccaacctggcggcagcgcaaaagatg

SEQ ID NO: 194293 - DNA, 103 bp, Artificial Sequence
  Synthetic Polynucleotide
taatacgactcactatagggccgggaagtggggctattaaaagggtactgaacagaggagacagtacatgtttaatagcaacctggcggcagcgcaaaagatg

SEQ ID NO: 194294 - DNA, 103 bp, Artificial Sequence
  Synthetic Polynucleotide
taatacgactcactatagggaaggttccatccgggaagtggggctattaaaacagaggagattaataatgccacttcccaacctggcggcagcgcaaaagatg

SEQ ID NO: 194295 - DNA, 103 bp, Artificial Sequence
  Synthetic Polynucleotide
taatacgactcactatagggctcatcaaacaaggttccatccgggaagtgaacagaggagacacttcatggatggaaccaacctggcggcagcgcaaaagatg

SEQ ID NO: 194296 - DNA, 103 bp, Artificial Sequence
  Synthetic Polynucleotide
taatacgactcactataggggggagtactgctcatcaaacaaggttccataacagaggagaatggaaatgtgtttgatgaacctggcggcagcgcaaaagatg

SEQ ID NO: 194297 - DNA, 103 bp, Artificial Sequence
  Synthetic Polynucleotide
taatacgactcactatagggtgcccgtctcactcacccaggcagctccttaacagaggagaaaggagatgcctgggtgaaacctggcggcagcgcaaaagatg

SEQ ID NO: 194298 - DNA, 103 bp, Artificial Sequence
  Synthetic Polynucleotide
taatacgactcactataggggatgcagtctgggagtactgctcatcaaacaacagaggagagtttgaatggcagtactcaacctggcggcagcgcaaaagatg

SEQ ID NO: 194299 - DNA, 103 bp, Artificial Sequence
  Synthetic Polynucleotide
taatacgactcactatagggactggggtaggatgcagtctgggagtactgaacagaggagacagtacatgcagactgcaaacctggcggcagcgcaaaagatg

SEQ ID NO: 194300 - DNA, 103 bp, Artificial Sequence
  Synthetic Polynucleotide
taatacgactcactataggggcggggagtgactggggtaggatgcagtctaacagaggagaagactgatgcctaccccaaacctggcggcagcgcaaaagatg

SEQ ID NO: 194301 - DNA, 103 bp, Artificial Sequence
  Synthetic Polynucleotide
taatacgactcactatagggcctctggccagcggggagtgactggggtagaacagaggagactacccatgtcactccccaacctggcggcagcgcaaaagatg

SEQ ID NO: 194302 - DNA, 103 bp, Artificial Sequence
  Synthetic Polynucleotide
taatacgactcactataggggctgagggcacctctggccagcggggagtgaacagaggagacactccatgctggccagaaacctggcggcagcgcaaaagatg

SEQ ID NO: 194303 - DNA, 103 bp, Artificial Sequence
  Synthetic Polynucleotide
taatacgactcactataggggcacgtgttggctgagggcacctctggccaaacagaggagatggccaatggtgccctcaaacctggcggcagcgcaaaagatg

SEQ ID NO: 194304 - DNA, 103 bp, Artificial Sequence
  Synthetic Polynucleotide
taatacgactcactatagggggcttgtgtagcacgtgttggctgagggcaaacagaggagatgccctatgccaacacgtaacctggcggcagcgcaaaagatg

SEQ ID NO: 194305 - DNA, 103 bp, Artificial Sequence
  Synthetic Polynucleotide
taatacgactcactatagggtgcacagacgggcttgtgtagcacgtgttgaacagaggagacaacacatgctacacaagaacctggcggcagcgcaaaagatg

SEQ ID NO: 194306 - DNA, 103 bp, Artificial Sequence
  Synthetic Polynucleotide
taatacgactcactatagggcctcgcagaatgcacagacgggcttgtgtaaacagaggagatacacaatgccgtctgtgaacctggcggcagcgcaaaagatg

SEQ ID NO: 194307 - DNA, 103 bp, Artificial Sequence
  Synthetic Polynucleotide
taatacgactcactatagggagtttccgtacctcgcagaatgcacagacgaacagaggagacgtctgatgattctgcgaaacctggcggcagcgcaaaagatg

SEQ ID NO: 194308 - DNA, 103 bp, Artificial Sequence
  Synthetic Polynucleotide
taatacgactcactatagggacttctttcttgcccgtctcactcacccagaacagaggagactgggtatgtgagacgggaacctggcggcagcgcaaaagatg

SEQ ID NO: 194309 - DNA, 103 bp, Artificial Sequence
  Synthetic Polynucleotide
taatacgactcactatagggatgtcactagagtttccgtacctcgcagaaaacagaggagattctgcatggtacggaaaaacctggcggcagcgcaaaagatg

SEQ ID NO: 194310 - DNA, 103 bp, Artificial Sequence
  Synthetic Polynucleotide
taatacgactcactatagggaggtgtatacatgtcactagagtttccgtaaacagaggagatacggaatgtctagtgacaacctggcggcagcgcaaaagatg

SEQ ID NO: 194311 - DNA, 103 bp, Artificial Sequence
  Synthetic Polynucleotide
taatacgactcactataggggcgttgtcagaggtgtatacatgtcactagaacagaggagactagtgatgtgtatacacaacctggcggcagcgcaaaagatg

SEQ ID NO: 194312 - DNA, 103 bp, Artificial Sequence
  Synthetic Polynucleotide
taatacgactcactataggggaattcctgcgcgttgtcagaggtgtatacaacagaggagagtatacatgtctgacaacaacctggcggcagcgcaaaagatg

SEQ ID NO: 194313 - DNA, 103 bp, Artificial Sequence
  Synthetic Polynucleotide
taatacgactcactatagggctcatattcagaattcctgcgcgttgtcagaacagaggagactgacaatgcgcaggaataacctggcggcagcgcaaaagatg

SEQ ID NO: 194314 - DNA, 103 bp, Artificial Sequence
  Synthetic Polynucleotide
taatacgactcactataggggttgcatgtgctcatattcagaattcctgcaacagaggagagcaggaatgctgaatatgaacctggcggcagcgcaaaagatg

SEQ ID NO: 194315 - DNA, 103 bp, Artificial Sequence
  Synthetic Polynucleotide
taatacgactcactatagggccaggaaagtgttgcatgtgctcatattcaaacagaggagatgaataatggcacatgcaaacctggcggcagcgcaaaagatg

SEQ ID NO: 194316 - DNA, 103 bp, Artificial Sequence
  Synthetic Polynucleotide
taatacgactcactataggggtaagcaaagccaggaaagtgttgcatgtgaacagaggagacacatgatgcactttcctaacctggcggcagcgcaaaagatg

SEQ ID NO: 194317 - DNA, 103 bp, Artificial Sequence
  Synthetic Polynucleotide
taatacgactcactatagggctccgttgatgtaagcaaagccaggaaagtaacagaggagaactttcatggctttgcttaacctggcggcagcgcaaaagatg

SEQ ID NO: 194318 - DNA, 103 bp, Artificial Sequence
  Synthetic Polynucleotide
taatacgactcactataggggtagaggcctctccgttgatgtaagcaaagaacagaggagactttgcatgcatcaacggaacctggcggcagcgcaaaagatg

SEQ ID NO: 194319 - DNA, 103 bp, Artificial Sequence
  Synthetic Polynucleotide
taatacgactcactatagggctgtttgctcacttctttcttgcccgtctcaacagaggagagagacgatgaagaaagaaaacctggcggcagcgcaaaagatg

SEQ ID NO: 194320 - DNA, 103 bp, Artificial Sequence
  Synthetic Polynucleotide
taatacgactcactatagggagcccatcctgtagaggcctctccgttgataacagaggagaatcaacatggaggcctctaacctggcggcagcgcaaaagatg

SEQ ID NO: 194321 - DNA, 103 bp, Artificial Sequence
  Synthetic Polynucleotide
taatacgactcactatagggggatgaagaattcagaccctccgaaggcagaacagaggagactgcctatggagggtctgaacctggcggcagcgcaaaagatg

SEQ ID NO: 194322 - DNA, 103 bp, Artificial Sequence
  Synthetic Polynucleotide
taatacgactcactatagggatgccactgtctgtttgctcacttctttctaacagaggagaagaaagatgtgagcaaacaacctggcggcagcgcaaaagatg

SEQ ID NO: 194323 - DNA, 103 bp, Artificial Sequence
  Synthetic Polynucleotide
taatacgactcactatagggcggggtgaatatgccactgtctgtttgctcaacagaggagagagcaaatggacagtggcaacctggcggcagcgcaaaagatg

SEQ ID NO: 194324 - DNA, 103 bp, Artificial Sequence
  Synthetic Polynucleotide
taatacgactcactataggggagtttggaccggggtgaatatgccactgtaacagaggagaacagtgatgtattcacccaacctggcggcagcgcaaaagatg

SEQ ID NO: 194325 - DNA, 103 bp, Artificial Sequence
  Synthetic Polynucleotide
taatacgactcactataggggcagtgttccgagtttggaccggggtgaataacagaggagaattcacatgggtccaaacaacctggcggcagcgcaaaagatg

SEQ ID NO: 194326 - DNA, 103 bp, Artificial Sequence
  Synthetic Polynucleotide
taatacgactcactatagggaattctggcagcagtgttccgagtttggacaacagaggagagtccaaatgcggaacactaacctggcggcagcgcaaaagatg

SEQ ID NO: 194327 - DNA, 103 bp, Artificial Sequence
  Synthetic Polynucleotide
taatacgactcactataggggacattgggaaattctggcagcagtgttccaacagaggagaggaacaatgctgccagaaaacctggcggcagcgcaaaagatg

SEQ ID NO: 194328 - DNA, 103 bp, Artificial Sequence
  Synthetic Polynucleotide
taatacgactcactatagggttagatctttgacattgggaaattctggcaaacagaggagatgccagatgttcccaatgaacctggcggcagcgcaaaagatg

SEQ ID NO: 194329 - DNA, 103 bp, Artificial Sequence
  Synthetic Polynucleotide
taatacgactcactataggggctggcagatttagatctttgacattgggaaacagaggagatcccaaatgcaaagatctaacctggcggcagcgcaaaagatg

SEQ ID NO: 194330 - DNA, 103 bp, Artificial Sequence
  Synthetic Polynucleotide
taatacgactcactatagggaggcaggctggctggcagatttagatctttaacagaggagaaaagatatgaatctgccaaacctggcggcagcgcaaaagatg

SEQ ID NO: 194331 - DNA, 103 bp, Artificial Sequence
  Synthetic Polynucleotide
taatacgactcactatagggccttctcctcaggcaggctggctggcagataacagaggagaatctgcatgccagcctgcaacctggcggcagcgcaaaagatg

SEQ ID NO: 194332 - DNA, 103 bp, Artificial Sequence
  Synthetic Polynucleotide
taatacgactcactatagggatgccttctgggatgaagaattcagaccctaacagaggagaagggtcatgattcttcataacctggcggcagcgcaaaagatg

SEQ ID NO: 194333 - DNA, 103 bp, Artificial Sequence
  Synthetic Polynucleotide
taatacgactcactatagggaaggtagaaaccttctcctcaggcaggctgaacagaggagacagcctatgtgaggagaaaacctggcggcagcgcaaaagatg

SEQ ID NO: 194334 - DNA, 103 bp, Artificial Sequence
  Synthetic Polynucleotide
taatacgactcactatagggcatcataataaaggtagaaaccttctcctcaacagaggagagaggagatggtttctaccaacctggcggcagcgcaaaagatg

SEQ ID NO: 194335 - DNA, 103 bp, Artificial Sequence
  Synthetic Polynucleotide
taatacgactcactataggggtgttctgtacatcataataaaggtagaaaaacagaggagatttctaatgttattatgaaacctggcggcagcgcaaaagatg

SEQ ID NO: 194336 - DNA, 103 bp, Artificial Sequence
  Synthetic Polynucleotide
taatacgactcactatagggctctgacagtgtgttctgtacatcataataaacagaggagatattatatggtacagaacaacctggcggcagcgcaaaagatg

SEQ ID NO: 194337 - DNA, 103 bp, Artificial Sequence
  Synthetic Polynucleotide
taatacgactcactataggggtccagtattctctgacagtgtgttctgtaaacagaggagatacagaatgcactgtcagaacctggcggcagcgcaaaagatg

SEQ ID NO: 194338 - DNA, 103 bp, Artificial Sequence
  Synthetic Polynucleotide
taatacgactcactatagggttattacagtgtccagtattctctgacagtaacagaggagaactgtcatggaatactggaacctggcggcagcgcaaaagatg

SEQ ID NO: 194339 - DNA, 103 bp, Artificial Sequence
  Synthetic Polynucleotide
taatacgactcactatagggaagttggctcttattacagtgtccagtattaacagaggagaaatactatgcactgtaataacctggcggcagcgcaaaagatg

SEQ ID NO: 194340 - DNA, 103 bp, Artificial Sequence
  Synthetic Polynucleotide
taatacgactcactatagggaacctcatcaaagttggctcttattacagtaacagaggagaactgtaatgagagccaacaacctggcggcagcgcaaaagatg

SEQ ID NO: 194341 - DNA, 103 bp, Artificial Sequence
  Synthetic Polynucleotide
taatacgactcactatagggggaaactttgaacctcatcaaagttggctcaacagaggagagagccaatgttgatgaggaacctggcggcagcgcaaaagatg

SEQ ID NO: 194342 - DNA, 103 bp, Artificial Sequence
  Synthetic Polynucleotide
taatacgactcactatagggaagtgcagaaggaaactttgaacctcatcaaacagaggagatgatgaatgtcaaagtttaacctggcggcagcgcaaaagatg

SEQ ID NO: 194343 - DNA, 103 bp, Artificial Sequence
  Synthetic Polynucleotide
taatacgactcactatagggatctatctgaatgccttctgggatgaagaaaacagaggagattcttcatgccagaaggcaacctggcggcagcgcaaaagatg

SEQ ID NO: 194344 - DNA, 103 bp, Artificial Sequence
  Synthetic Polynucleotide
taatacgactcactatagggtccttgccaaaagtgcagaaggaaactttgaacagaggagacaaagtatgcttctgcacaacctggcggcagcgcaaaagatg

SEQ ID NO: 194345 - DNA, 103 bp, Artificial Sequence
  Synthetic Polynucleotide
taatacgactcactatagggggggcggcattccttgccaaaagtgcagaaaacagaggagattctgcatgtttggcaagaacctggcggcagcgcaaaagatg

SEQ ID NO: 194346 - DNA, 103 bp, Artificial Sequence
  Synthetic Polynucleotide
taatacgactcactatagggggcagcatgtggggcggcattccttgccaaaacagaggagattggcaatgaatgccgccaacctggcggcagcgcaaaagatg

SEQ ID NO: 194347 - DNA, 103 bp, Artificial Sequence
  Synthetic Polynucleotide
taatacgactcactataggggcccagcacaggcagcatgtggggcggcataacagaggagaatgccgatgcacatgctgaacctggcggcagcgcaaaagatg

SEQ ID NO: 194348 - DNA, 103 bp, Artificial Sequence
  Synthetic Polynucleotide
taatacgactcactatagggccgtggaggagcccagcacaggcagcatgtaacagaggagaacatgcatgctgtgctggaacctggcggcagcgcaaaagatg

SEQ ID NO: 194349 - DNA, 103 bp, Artificial Sequence
  Synthetic Polynucleotide
taatacgactcactatagggatgttcaccaccgtggaggagcccagcacaaacagaggagatgtgctatgctcctccacaacctggcggcagcgcaaaagatg

SEQ ID NO: 194350 - DNA, 103 bp, Artificial Sequence
  Synthetic Polynucleotide
taatacgactcactatagggcacgccgacaatgttcaccaccgtggaggaaacagaggagatcctccatggtggtgaacaacctggcggcagcgcaaaagatg

SEQ ID NO: 194351 - DNA, 103 bp, Artificial Sequence
  Synthetic Polynucleotide
taatacgactcactatagggtggagtcacacacgccgacaatgttcaccaaacagaggagatggtgaatgttgtcggcgaacctggcggcagcgcaaaagatg

SEQ ID NO: 194352 - DNA, 103 bp, Artificial Sequence
  Synthetic Polynucleotide
taatacgactcactatagggttgtagaggatggagtcacacacgccgacaaacagaggagatgtcggatggtgtgactcaacctggcggcagcgcaaaagatg

SEQ ID NO: 194353 - DNA, 103 bp, Artificial Sequence
  Synthetic Polynucleotide
taatacgactcactatagggggagatagctttgtagaggatggagtcacaaacagaggagatgtgacatgatcctctacaacctggcggcagcgcaaaagatg

SEQ ID NO: 194354 - DNA, 103 bp, Artificial Sequence
  Synthetic Polynucleotide
taatacgactcactatagggggcatctcgaatctatctgaatgccttctgaacagaggagacagaagatgttcagatagaacctggcggcagcgcaaaagatg

SEQ ID NO: 194355 - DNA, 103 bp, Artificial Sequence
  Synthetic Polynucleotide
taatacgactcactatagggtcagcaccccggagatagctttgtagaggaaacagaggagatcctctatgaagctatctaacctggcggcagcgcaaaagatg

SEQ ID NO: 194356 - DNA, 103 bp, Artificial Sequence
  Synthetic Polynucleotide
taatacgactcactatagggacagtgggcatcagcaccccggagatagctaacagaggagaagctatatgcggggtgctaacctggcggcagcgcaaaagatg

SEQ ID NO: 194357 - DNA, 103 bp, Artificial Sequence
  Synthetic Polynucleotide
taatacgactcactatagggtgcctgcagcacagtgggcatcagcaccccaacagaggagaggggtgatgatgcccactaacctggcggcagcgcaaaagatg

SEQ ID NO: 194358 - DNA, 103 bp, Artificial Sequence
  Synthetic Polynucleotide
taatacgactcactatagggtgtcaggtaatgcctgcagcacagtgggcaaacagaggagatgcccaatgtgctgcaggaacctggcggcagcgcaaaagatg

SEQ ID NO: 194359 - DNA, 103 bp, Artificial Sequence
  Synthetic Polynucleotide
taatacgactcactatagggtgagttaagctgtcaggtaatgcctgcagcaacagaggagagctgcaatgattacctgaaacctggcggcagcgcaaaagatg

SEQ ID NO: 194360 - DNA, 103 bp, Artificial Sequence
  Synthetic Polynucleotide
taatacgactcactatagggtcgaatcacctgagttaagctgtcaggtaaaacagaggagattacctatgagcttaactaacctggcggcagcgcaaaagatg

SEQ ID NO: 194361 - DNA, 103 bp, Artificial Sequence
  Synthetic Polynucleotide
taatacgactcactatagggtggcaaactttcgaatcacctgagttaagcaacagaggagagcttaaatgaggtgattcaacctggcggcagcgcaaaagatg

SEQ ID NO: 194362 - DNA, 103 bp, Artificial Sequence
  Synthetic Polynucleotide
taatacgactcactatagggtccagttgcttggcaaactttcgaatcaccaacagaggagaggtgatatgaaagtttgcaacctggcggcagcgcaaaagatg

SEQ ID NO: 194363 - DNA, 103 bp, Artificial Sequence
  Synthetic Polynucleotide
taatacgactcactatagggtagccactcatccagttgcttggcaaacttaacagaggagaaagtttatgaagcaactgaacctggcggcagcgcaaaagatg

SEQ ID NO: 194364 - DNA, 103 bp, Artificial Sequence
  Synthetic Polynucleotide
taatacgactcactataggggagccacttttagccactcatccagttgctaacagaggagaagcaacatgatgagtggcaacctggcggcagcgcaaaagatg

SEQ ID NO: 194365 - DNA, 103 bp, Artificial Sequence
  Synthetic Polynucleotide
taatacgactcactatagggctgcttagtgggcatctcgaatctatctgaaacagaggagatcagatatgttcgagatgaacctggcggcagcgcaaaagatg

SEQ ID NO: 194366 - DNA, 103 bp, Artificial Sequence
  Synthetic Polynucleotide
taatacgactcactatagggaggtcgtggagagccacttttagccactcaaacagaggagatgagtgatgaaaagtggcaacctggcggcagcgcaaaagatg

SEQ ID NO: 194367 - DNA, 103 bp, Artificial Sequence
  Synthetic Polynucleotide
taatacgactcactataggggttttctgggaggtcgtggagagccactttaacagaggagaaaagtgatgctccacgacaacctggcggcagcgcaaaagatg

SEQ ID NO: 194368 - DNA, 103 bp, Artificial Sequence
  Synthetic Polynucleotide
taatacgactcactatagggtgtttcgcaagttttctgggaggtcgtggaaacagaggagatccacgatgtcccagaaaaacctggcggcagcgcaaaagatg

SEQ ID NO: 194369 - DNA, 103 bp, Artificial Sequence
  Synthetic Polynucleotide
taatacgactcactatagggtcgaacttgatgtttcgcaagttttctgggaacagaggagacccagaatgcttgcgaaaaacctggcggcagcgcaaaagatg

SEQ ID NO: 194370 - DNA, 103 bp, Artificial Sequence
  Synthetic Polynucleotide
taatacgactcactatagggtctcgacaattcgaacttgatgtttcgcaaaacagaggagattgcgaatgatcaagttcaacctggcggcagcgcaaaagatg

SEQ ID NO: 194371 - DNA, 103 bp, Artificial Sequence
  Synthetic Polynucleotide
taatacgactcactataggggggagaaccttctcgacaattcgaacttgaaacagaggagatcaagtatgaattgtcgaaacctggcggcagcgcaaaagatg

SEQ ID NO: 194372 - DNA, 103 bp, Artificial Sequence
  Synthetic Polynucleotide
taatacgactcactatagggctcagaatttgggagaaccttctcgacaataacagaggagaattgtcatgaaggttctcaacctggcggcagcgcaaaagatg

SEQ ID NO: 194373 - DNA, 103 bp, Artificial Sequence
  Synthetic Polynucleotide
taatacgactcactatagggtgtttgccgtctcagaatttgggagaacctaacagaggagaaggttcatgcaaattctgaacctggcggcagcgcaaaagatg

SEQ ID NO: 194374 - DNA, 103 bp, Artificial Sequence
  Synthetic Polynucleotide
taatacgactcactataggggatttagtgatgtttgccgtctcagaatttaacagaggagaaaattcatggacggcaaaaacctggcggcagcgcaaaagatg

SEQ ID NO: 194375 - DNA, 103 bp, Artificial Sequence
  Synthetic Polynucleotide
taatacgactcactatagggtggcagagatgatttagtgatgtttgccgtaacagaggagaacggcaatgatcactaaaaacctggcggcagcgcaaaagatg

SEQ ID NO: 194376 - DNA, 103 bp, Artificial Sequence
  Synthetic Polynucleotide
taatacgactcactatagggcgtgatatttctgcttagtgggcatctcgaaacagaggagatcgagaatgccactaagcaacctggcggcagcgcaaaagatg

SEQ ID NO: 194377 - DNA, 103 bp, Artificial Sequence
  Synthetic Polynucleotide
taatacgactcactatagggtcgagatgcctggcagagatgatttagtgaaacagaggagatcactaatgcatctctgcaacctggcggcagcgcaaaagatg

SEQ ID NO: 194378 - DNA, 103 bp, Artificial Sequence
  Synthetic Polynucleotide
taatacgactcactatagggggatcactgttcgagatgcctggcagagataacagaggagaatctctatgaggcatctcaacctggcggcagcgcaaaagatg

SEQ ID NO: 194379 - DNA, 103 bp, Artificial Sequence
  Synthetic Polynucleotide
taatacgactcactatagggtctgcactgtggatcactgttcgagatgccaacagaggagaggcatcatgaacagtgataacctggcggcagcgcaaaagatg

SEQ ID NO: 194380 - DNA, 103 bp, Artificial Sequence
  Synthetic Polynucleotide
taatacgactcactataggggaacgtgatgtctgcactgtggatcactgtaacagaggagaacagtgatgcacagtgcaaacctggcggcagcgcaaaagatg

SEQ ID NO: 194381 - DNA, 103 bp, Artificial Sequence
  Synthetic Polynucleotide
taatacgactcactatagggccagcatttggaacgtgatgtctgcactgtaacagaggagaacagtgatgacatcacgtaacctggcggcagcgcaaaagatg

SEQ ID NO: 194382 - DNA, 103 bp, Artificial Sequence
  Synthetic Polynucleotide
taatacgactcactatagggctccagtcttccagcatttggaacgtgatgaacagaggagacatcacatgccaaatgctaacctggcggcagcgcaaaagatg

SEQ ID NO: 194383 - DNA, 103 bp, Artificial Sequence
  Synthetic Polynucleotide
taatacgactcactataggggtccacgttcctccagtcttccagcatttgaacagaggagacaaatgatggaagactggaacctggcggcagcgcaaaagatg

SEQ ID NO: 194384 - DNA, 103 bp, Artificial Sequence
  Synthetic Polynucleotide
taatacgactcactatagggtgctgttcaggtccacgttcctccagtcttaacagaggagaaagactatgggaacgtggaacctggcggcagcgcaaaagatg

SEQ ID NO: 194385 - DNA, 103 bp, Artificial Sequence
  Synthetic Polynucleotide
taatacgactcactatagggtgcttggtgatgctgttcaggtccacgttcaacagaggagagaacgtatgcctgaacagaacctggcggcagcgcaaaagatg

SEQ ID NO: 194386 - DNA, 103 bp, Artificial Sequence
  Synthetic Polynucleotide
taatacgactcactataggggtaaagggtttgcttggtgatgctgttcagaacagaggagactgaacatgatcaccaagaacctggcggcagcgcaaaagatg

SEQ ID NO: 194387 - DNA, 103 bp, Artificial Sequence
  Synthetic Polynucleotide
taatacgactcactatagggggtaccattccgtgatatttctgcttagtgaacagaggagacactaaatggaaatatcaaacctggcggcagcgcaaaagatg

SEQ ID NO: 194388 - DNA, 103 bp, Artificial Sequence
  Synthetic Polynucleotide
taatacgactcactatagggcttccatggtgtaaagggtttgcttggtgaaacagaggagatcaccaatgaaaccctttaacctggcggcagcgcaaaagatg

SEQ ID NO: 194389 - DNA, 103 bp, Artificial Sequence
  Synthetic Polynucleotide
taatacgactcactatagggtcgcgagagtcttccatggtgtaaagggttaacagaggagaaaccctatgcaccatggaaacctggcggcagcgcaaaagatg

SEQ ID NO: 194390 - DNA, 103 bp, Artificial Sequence
  Synthetic Polynucleotide
taatacgactcactatagggccggtgctcatcgcgagagtcttccatggtaacagaggagaaccatgatggactctcgcaacctggcggcagcgcaaaagatg

SEQ ID NO: 194391 - DNA, 103 bp, Artificial Sequence
  Synthetic Polynucleotide
taatacgactcactatagggtgatgagtttccggtgctcatcgcgagagtaacagaggagaactctcatgatgagcaccaacctggcggcagcgcaaaagatg

SEQ ID NO: 194392 - DNA, 103 bp, Artificial Sequence
  Synthetic Polynucleotide
taatacgactcactatagggtataattgggtgatgagtttccggtgctcaaacagaggagatgagcaatggaaactcataacctggcggcagcgcaaaagatg

SEQ ID NO: 194393 - DNA, 103 bp, Artificial Sequence
  Synthetic Polynucleotide
taatacgactcactatagggaaactcctgatataattgggtgatgagtttaacagaggagaaaactcatgacccaattaaacctggcggcagcgcaaaagatg

SEQ ID NO: 194394 - DNA, 103 bp, Artificial Sequence
  Synthetic Polynucleotide
taatacgactcactatagggagagatggtcaaactcctgatataattgggaacagaggagacccaatatgatcaggagtaacctggcggcagcgcaaaagatg

SEQ ID NO: 194395 - DNA, 103 bp, Artificial Sequence
  Synthetic Polynucleotide
taatacgactcactatagggtgctcctccaagagatggtcaaactcctgaaacagaggagatcaggaatgtgaccatctaacctggcggcagcgcaaaagatg

SEQ ID NO: 194396 - DNA, 103 bp, Artificial Sequence
  Synthetic Polynucleotide
taatacgactcactataggggatgggagactgctcctccaagagatggtcaacagaggagagaccatatgttggaggagaacctggcggcagcgcaaaagatg

SEQ ID NO: 194397 - DNA, 103 bp, Artificial Sequence
  Synthetic Polynucleotide
taatacgactcactatagggtgtaggactcgatgggagactgctcctccaaacagaggagatggaggatgagtctcccaaacctggcggcagcgcaaaagatg

SEQ ID NO: 194398 - DNA, 103 bp, Artificial Sequence
  Synthetic Polynucleotide
taatacgactcactatagggccatagtaatggtaccattccgtgatatttaacagaggagaaaatatatgggaatggtaaacctggcggcagcgcaaaagatg

SEQ ID NO: 194399 - DNA, 103 bp, Artificial Sequence
  Synthetic Polynucleotide
taatacgactcactatagggagccactcaatgtaggactcgatgggagacaacagaggagagtctccatgcgagtcctaaacctggcggcagcgcaaaagatg

SEQ ID NO: 194400 - DNA, 103 bp, Artificial Sequence
  Synthetic Polynucleotide
taatacgactcactatagggcatggtatccagccactcaatgtaggactcaacagaggagagagtccatgattgagtggaacctggcggcagcgcaaaagatg

SEQ ID NO: 194401 - DNA, 103 bp, Artificial Sequence
  Synthetic Polynucleotide
taatacgactcactatagggagcggtcaaccatggtatccagccactcaaaacagaggagattgagtatgtggataccaaacctggcggcagcgcaaaagatg

SEQ ID NO: 194402 - DNA, 103 bp, Artificial Sequence
  Synthetic Polynucleotide
taatacgactcactatagggttcacaacacagcggtcaaccatggtatccaacagaggagaggatacatgggttgaccgaacctggcggcagcgcaaaagatg

SEQ ID NO: 194403 - DNA, 103 bp, Artificial Sequence
  Synthetic Polynucleotide
taatacgactcactatagggggcagccaccttcacaacacagcggtcaacaacagaggagagttgacatgtgtgttgtgaacctggcggcagcgcaaaagatg

SEQ ID NO: 194404 - DNA, 103 bp, Artificial Sequence
  Synthetic Polynucleotide
taatacgactcactatagggcttgtctcttggcagccaccttcacaacacaacagaggagagtgttgatgaggtggctgaacctggcggcagcgcaaaagatg

SEQ ID NO: 194405 - DNA, 103 bp, Artificial Sequence
  Synthetic Polynucleotide
taatacgactcactatagggttcaaggacccttgtctcttggcagccaccaacagaggagaggtggcatgcaagagacaaacctggcggcagcgcaaaagatg

SEQ ID NO: 194406 - DNA, 103 bp, Artificial Sequence
  Synthetic Polynucleotide
taatacgactcactatagggggccactttcttcaaggacccttgtctcttaacagaggagaaagagaatggggtccttgaacctggcggcagcgcaaaagatg

SEQ ID NO: 194407 - DNA, 103 bp, Artificial Sequence
  Synthetic Polynucleotide
taatacgactcactatagggggaactgctgggccactttcttcaaggaccaacagaggagaggtcctatgagaaagtggaacctggcggcagcgcaaaagatg

SEQ ID NO: 194408 - DNA, 103 bp, Artificial Sequence
  Synthetic Polynucleotide
taatacgactcactatagggcacatcaagaggaactgctgggccactttcaacagaggagagaaagtatgccagcagttaacctggcggcagcgcaaaagatg

SEQ ID NO: 194409 - DNA, 103 bp, Artificial Sequence
  Synthetic Polynucleotide
taatacgactcactataggggctcttagcatcaggctcatcttctgccataacagaggagaatggcaatggatgagcctaacctggcggcagcgcaaaagatg

SEQ ID NO: 194410 - DNA, 103 bp, Artificial Sequence
  Synthetic Polynucleotide
taatacgactcactatagggcttggaaatggtacctcggagcctctgaagaacagaggagacttcagatgctccgaggtaacctggcggcagcgcaaaagatg

SEQ ID NO: 194411 - DNA, 103 bp, Artificial Sequence
  Synthetic Polynucleotide
taatacgactcactatagggtagtgagcgaggggcccggggaaggagcagaacagaggagactgctcatgccccgggccaacctggcggcagcgcaaaagatg

SEQ ID NO: 194412 - DNA, 103 bp, Artificial Sequence
  Synthetic Polynucleotide
taatacgactcactatagggttggcggaattagtgagcgaggggcccgggaacagaggagacccgggatgctcgctcacaacctggcggcagcgcaaaagatg

SEQ ID NO: 194413 - DNA, 103 bp, Artificial Sequence
  Synthetic Polynucleotide
taatacgactcactataggggagactgggattggcggaattagtgagcgaaacagaggagatcgctcatgaattccgccaacctggcggcagcgcaaaagatg

SEQ ID NO: 194414 - DNA, 103 bp, Artificial Sequence
  Synthetic Polynucleotide
taatacgactcactatagggaataggtggagagactgggattggcggaataacagaggagaattccgatgatcccagtcaacctggcggcagcgcaaaagatg

SEQ ID NO: 194415 - DNA, 103 bp, Artificial Sequence
  Synthetic Polynucleotide
taatacgactcactatagggtgggggccagaataggtggagagactgggaaacagaggagatcccagatgctccacctaaacctggcggcagcgcaaaagatg

SEQ ID NO: 194416 - DNA, 103 bp, Artificial Sequence
  Synthetic Polynucleotide
taatacgactcactataggggaagaaagcctgggggccagaataggtggaaacagaggagatccaccatgtctggccccaacctggcggcagcgcaaaagatg

SEQ ID NO: 194417 - DNA, 103 bp, Artificial Sequence
  Synthetic Polynucleotide
taatacgactcactatagggcagggcacctgaagaaagcctgggggccagaacagaggagactggccatgaggctttctaacctggcggcagcgcaaaagatg

SEQ ID NO: 194418 - DNA, 103 bp, Artificial Sequence
  Synthetic Polynucleotide
taatacgactcactatagggtagccactttcagggcacctgaagaaagccaacagaggagaggctttatgcaggtgcccaacctggcggcagcgcaaaagatg

SEQ ID NO: 194419 - DNA, 103 bp, Artificial Sequence
  Synthetic Polynucleotide
taatacgactcactatagggagaggcagtgtagccactttcagggcacctaacagaggagaaggtgcatggaaagtggcaacctggcggcagcgcaaaagatg

SEQ ID NO: 194420 - DNA, 103 bp, Artificial Sequence
  Synthetic Polynucleotide
taatacgactcactatagggcctactagacagaggcagtgtagccactttaacagaggagaaaagtgatgacactgcctaacctggcggcagcgcaaaagatg

SEQ ID NO: 194421 - DNA, 103 bp, Artificial Sequence
  Synthetic Polynucleotide
taatacgactcactatagggtctgcacggccttggaaatggtacctcggaaacagaggagatccgagatgccatttccaaacctggcggcagcgcaaaagatg

SEQ ID NO: 194422 - DNA, 103 bp, Artificial Sequence
  Synthetic Polynucleotide
taatacgactcactataggggtgccccggccctactagacagaggcagtgaacagaggagacactgcatgtgtctagtaaacctggcggcagcgcaaaagatg

SEQ ID NO: 194423 - DNA, 103 bp, Artificial Sequence
  Synthetic Polynucleotide
taatacgactcactataggggctgctgggggtgccccggccctactagacaacagaggagagtctagatgggccggggcaacctggcggcagcgcaaaagatg

SEQ ID NO: 194424 - DNA, 103 bp, Artificial Sequence
  Synthetic Polynucleotide
taatacgactcactataggggatgggcacagctgctgggggtgccccggcaacagaggagagccgggatgcccccagcaaacctggcggcagcgcaaaagatg

SEQ ID NO: 194425 - DNA, 103 bp, Artificial Sequence
  Synthetic Polynucleotide
taatacgactcactatagggtcatgttaatgatgggcacagctgctggggaacagaggagaccccagatgctgtgcccaaacctggcggcagcgcaaaagatg

SEQ ID NO: 194426 - DNA, 103 bp, Artificial Sequence
  Synthetic Polynucleotide
taatacgactcactataggggttggtaagatcatgttaatgatgggcacaaacagaggagatgtgccatgcattaacataacctggcggcagcgcaaaagatg

SEQ ID NO: 194427 - DNA, 103 bp, Artificial Sequence
  Synthetic Polynucleotide
taatacgactcactatagggagcaggaacagttggtaagatcatgttaataacagaggagaattaacatgatcttaccaaacctggcggcagcgcaaaagatg

SEQ ID NO: 194428 - DNA, 103 bp, Artificial Sequence
  Synthetic Polynucleotide
taatacgactcactataggggtccaggcaaagcaggaacagttggtaagaaacagaggagatcttacatgctgttcctgaacctggcggcagcgcaaaagatg

SEQ ID NO: 194429 - DNA, 103 bp, Artificial Sequence
  Synthetic Polynucleotide
taatacgactcactatagggccaggtccaggtccaggcaaagcaggaacaaacagaggagatgttccatgtttgcctggaacctggcggcagcgcaaaagatg

SEQ ID NO: 194430 - DNA, 103 bp, Artificial Sequence
  Synthetic Polynucleotide
taatacgactcactatagggtcgcccaggcccaggtccaggtccaggcaaaacagaggagattgcctatgcctggacctaacctggcggcagcgcaaaagatg

SEQ ID NO: 194431 - DNA, 103 bp, Artificial Sequence
  Synthetic Polynucleotide
taatacgactcactatagggcaggtggagctcgcccaggcccaggtccagaacagaggagactggacatgggcctgggcaacctggcggcagcgcaaaagatg

SEQ ID NO: 194432 - DNA, 103 bp, Artificial Sequence
  Synthetic Polynucleotide
taatacgactcactatagggtctactttgttctgcacggccttggaaatgaacagaggagacatttcatgggccgtgcaaacctggcggcagcgcaaaagatg

SEQ ID NO: 194433 - DNA, 103 bp, Artificial Sequence
  Synthetic Polynucleotide
taatacgactcactataggggtgagtcccccaggtggagctcgcccaggcaacagaggagagcctggatgagctccaccaacctggcggcagcgcaaaagatg

SEQ ID NO: 194434 - DNA, 103 bp, Artificial Sequence
  Synthetic Polynucleotide
taatacgactcactatagggccggggctgagtgagtcccccaggtggagcaacagaggagagctccaatggggggactcaacctggcggcagcgcaaaagatg

SEQ ID NO: 194435 - DNA, 103 bp, Artificial Sequence
  Synthetic Polynucleotide
taatacgactcactatagggtctctgtgccccggggctgagtgagtccccaacagaggagaggggacatgctcagccccaacctggcggcagcgcaaaagatg

SEQ ID NO: 194436 - DNA, 103 bp, Artificial Sequence
  Synthetic Polynucleotide
taatacgactcactatagggacctctctgttctctgtgccccggggctgaaacagaggagatcagccatggggcacagaaacctggcggcagcgcaaaagatg

SEQ ID NO: 194437 - DNA, 103 bp, Artificial Sequence
  Synthetic Polynucleotide
taatacgactcactatagggacctatgcctacctctctgttctctgtgccaacagaggagaggcacaatgaacagagagaacctggcggcagcgcaaaagatg

SEQ ID NO: 194438 - DNA, 103 bp, Artificial Sequence
  Synthetic Polynucleotide
taatacgactcactatagggcttggtcaccacctatgcctacctctctgtaacagaggagaacagagatgtaggcatagaacctggcggcagcgcaaaagatg

SEQ ID NO: 194439 - DNA, 103 bp, Artificial Sequence
  Synthetic Polynucleotide
taatacgactcactatagggtcatgtggtccttggtcaccacctatgcctaacagaggagaaggcatatgtggtgaccaaacctggcggcagcgcaaaagatg

SEQ ID NO: 194440 - DNA, 103 bp, Artificial Sequence
  Synthetic Polynucleotide
taatacgactcactataggggacacccttgtcatgtggtccttggtcaccaacagaggagaggtgacatgggaccacataacctggcggcagcgcaaaagatg

SEQ ID NO: 194441 - DNA, 103 bp, Artificial Sequence
  Synthetic Polynucleotide
taatacgactcactatagggctgtcctcttgacacccttgtcatgtggtcaacagaggagagaccacatgacaagggtgaacctggcggcagcgcaaaagatg

SEQ ID NO: 194442 - DNA, 103 bp, Artificial Sequence
  Synthetic Polynucleotide
taatacgactcactatagggggtacttcagctgtcctcttgacacccttgaacagaggagacaagggatgcaagaggacaacctggcggcagcgcaaaagatg

SEQ ID NO: 194443 - DNA, 103 bp, Artificial Sequence
  Synthetic Polynucleotide
taatacgactcactatagggcaggatcccctctactttgttctgcacggcaacagaggagagccgtgatgaacaaagtaaacctggcggcagcgcaaaagatg

SEQ ID NO: 194444 - DNA, 103 bp, Artificial Sequence
  Synthetic Polynucleotide
taatacgactcactatagggctcactcacaggtacttcagctgtcctcttaacagaggagaaagaggatggctgaagtaaacctggcggcagcgcaaaagatg

SEQ ID NO: 194445 - DNA, 103 bp, Artificial Sequence
  Synthetic Polynucleotide
taatacgactcactataggggcccactggcctcactcacaggtacttcagaacagaggagactgaagatgctgtgagtgaacctggcggcagcgcaaaagatg

SEQ ID NO: 194446 - DNA, 103 bp, Artificial Sequence
  Synthetic Polynucleotide
taatacgactcactatagggggtggagcctgcccactggcctcactcacaaacagaggagatgtgagatgggccagtggaacctggcggcagcgcaaaagatg

SEQ ID NO: 194447 - DNA, 103 bp, Artificial Sequence
  Synthetic Polynucleotide
taatacgactcactatagggtgctttagctggtggagcctgcccactggcaacagaggagagccagtatgcaggctccaaacctggcggcagcgcaaaagatg

SEQ ID NO: 194448 - DNA, 103 bp, Artificial Sequence
  Synthetic Polynucleotide
taatacgactcactatagggcctgctttgctgctttagctggtggagcctaacagaggagaaggctcatgcagctaaagaacctggcggcagcgcaaaagatg

SEQ ID NO: 194449 - DNA, 103 bp, Artificial Sequence
  Synthetic Polynucleotide
taatacgactcactatagggtcctctatatcctgctttgctgctttagctaacagaggagaagctaaatgagcaaagcaaacctggcggcagcgcaaaagatg

SEQ ID NO: 194450 - DNA, 103 bp, Artificial Sequence
  Synthetic Polynucleotide
taatacgactcactatagggacttgctgtatcctctatatcctgctttgcaacagaggagagcaaagatggatatagagaacctggcggcagcgcaaaagatg

SEQ ID NO: 194451 - DNA, 103 bp, Artificial Sequence
  Synthetic Polynucleotide
taatacgactcactatagggttttggcatcacttgctgtatcctctatataacagaggagaatatagatgatacagcaaaacctggcggcagcgcaaaagatg

SEQ ID NO: 194452 - DNA, 103 bp, Artificial Sequence
  Synthetic Polynucleotide
taatacgactcactatagggccccgtttccttttggcatcacttgctgtaaacagaggagatacagcatgtgatgccaaaacctggcggcagcgcaaaagatg

SEQ ID NO: 194453 - DNA, 103 bp, Artificial Sequence
  Synthetic Polynucleotide
taatacgactcactatagggtcgagggcgcccccgtttccttttggcatcaacagaggagagatgccatgaggaaacggaacctggcggcagcgcaaaagatg

SEQ ID NO: 194454 - DNA, 103 bp, Artificial Sequence
  Synthetic Polynucleotide
taatacgactcactataggggtacatcttgcaggatcccctctactttgtaacagaggagaacaaagatgaggggatccaacctggcggcagcgcaaaagatg

SEQ ID NO: 194455 - DNA, 103 bp, Artificial Sequence
  Synthetic Polynucleotide
taatacgactcactatagggctgacttttttcgagggcgcccccgtttccaacagaggagaggaaacatgggcgccctcaacctggcggcagcgcaaaagatg

SEQ ID NO: 194456 - DNA, 103 bp, Artificial Sequence
  Synthetic Polynucleotide
taatacgactcactatagggccacttccacctgacttttttcgagggcgcaacagaggagagcgcccatgaaaaaagtcaacctggcggcagcgcaaaagatg

SEQ ID NO: 194457 - DNA, 103 bp, Artificial Sequence
  Synthetic Polynucleotide
taatacgactcactatagggattcctttccccacttccacctgactttttaacagaggagaaaaaagatgggtggaagtaacctggcggcagcgcaaaagatg

SEQ ID NO: 194458 - DNA, 103 bp, Artificial Sequence
  Synthetic Polynucleotide
taatacgactcactataggggaggggtagaattcctttccccacttccacaacagaggagagtggaaatggggaaaggaaacctggcggcagcgcaaaagatg

SEQ ID NO: 194459 - DNA, 103 bp, Artificial Sequence
  Synthetic Polynucleotide
taatacgactcactataggggctgacttgagaggggtagaattcctttccaacagaggagaggaaagatgttctaccccaacctggcggcagcgcaaaagatg

SEQ ID NO: 194460 - DNA, 103 bp, Artificial Sequence
  Synthetic Polynucleotide
taatacgactcactatagggcatggcagctgctgacttgagaggggtagaaacagaggagatctaccatgctcaagtcaaacctggcggcagcgcaaaagatg

SEQ ID NO: 194461 - DNA, 103 bp, Artificial Sequence
  Synthetic Polynucleotide
taatacgactcactataggggggcagattccatggcagctgctgacttgaaacagaggagatcaagtatgcagctgccaaacctggcggcagcgcaaaagatg

SEQ ID NO: 194462 - DNA, 103 bp, Artificial Sequence
  Synthetic Polynucleotide
taatacgactcactatagggcttgaggactgggcagattccatggcagctaacagaggagaagctgcatgggaatctgcaacctggcggcagcgcaaaagatg

SEQ ID NO: 194463 - DNA, 103 bp, Artificial Sequence
  Synthetic Polynucleotide
taatacgactcactatagggccatggtaaccttgaggactgggcagattcaacagaggagagaatctatgcagtcctcaaacctggcggcagcgcaaaagatg

SEQ ID NO: 194464 - DNA, 103 bp, Artificial Sequence
  Synthetic Polynucleotide
taatacgactcactatagggcccatgtctcccatggtaaccttgaggactaacagaggagaagtcctatgggttaccataacctggcggcagcgcaaaagatg

SEQ ID NO: 194465 - DNA, 103 bp, Artificial Sequence
  Synthetic Polynucleotide
taatacgactcactataggggaaaatttctgtacatcttgcaggatccccaacagaggagaggggatatggcaagatgtaacctggcggcagcgcaaaagatg

SEQ ID NO: 194466 - DNA, 103 bp, Artificial Sequence
  Synthetic Polynucleotide
taatacgactcactatagggcctcctgagccccatgtctcccatggtaacaacagaggagagttaccatgggagacatgaacctggcggcagcgcaaaagatg

SEQ ID NO: 194467 - DNA, 103 bp, Artificial Sequence
  Synthetic Polynucleotide
taatacgactcactataggggttgccttcccctcctgagccccatgtctcaacagaggagagagacaatgggctcaggaaacctggcggcagcgcaaaagatg

SEQ ID NO: 194468 - DNA, 103 bp, Artificial Sequence
  Synthetic Polynucleotide
taatacgactcactatagggctccagctgagttgccttcccctcctgagcaacagaggagagctcagatggggaaggcaaacctggcggcagcgcaaaagatg

SEQ ID NO: 194469 - DNA, 103 bp, Artificial Sequence
  Synthetic Polynucleotide
taatacgactcactatagggctctctgcccctccagctgagttgccttccaacagaggagaggaaggatgctcagctggaacctggcggcagcgcaaaagatg

SEQ ID NO: 194470 - DNA, 103 bp, Artificial Sequence
  Synthetic Polynucleotide
taatacgactcactatagggtggccctggcctctctgcccctccagctgaaacagaggagatcagctatgggggcagagaacctggcggcagcgcaaaagatg

SEQ ID NO: 194471 - DNA, 103 bp, Artificial Sequence
  Synthetic Polynucleotide
taatacgactcactatagggcctctcccattggccctggcctctctgcccaacagaggagagggcagatgggccagggcaacctggcggcagcgcaaaagatg

SEQ ID NO: 194472 - DNA, 103 bp, Artificial Sequence
  Synthetic Polynucleotide
taatacgactcactatagggcccttttcagcctctcccattggccctggcaacagaggagagccaggatgaatgggagaaacctggcggcagcgcaaaagatg

SEQ ID NO: 194473 - DNA, 103 bp, Artificial Sequence
  Synthetic Polynucleotide
taatacgactcactatagggaagtactgcccccttttcagcctctcccataacagaggagaatgggaatggctgaaaagaacctggcggcagcgcaaaagatg

SEQ ID NO: 194474 - DNA, 103 bp, Artificial Sequence
  Synthetic Polynucleotide
taatacgactcactataggggaccctgggcaagtactgcccccttttcagaacagaggagactgaaaatggggcagtacaacctggcggcagcgcaaaagatg

SEQ ID NO: 194475 - DNA, 103 bp, Artificial Sequence
  Synthetic Polynucleotide
taatacgactcactatagggccatctccctgaccctgggcaagtactgccaacagaggagaggcagtatgtgcccagggaacctggcggcagcgcaaaagatg

SEQ ID NO: 194476 - DNA, 103 bp, Artificial Sequence
  Synthetic Polynucleotide
taatacgactcactataggggtcattgtcagaaaatttctgtacatcttgaacagaggagacaagatatgcagaaatttaacctggcggcagcgcaaaagatg

SEQ ID NO: 194477 - DNA, 103 bp, Artificial Sequence
  Synthetic Polynucleotide
taatacgactcactatagggggaaacagtaccatctccctgaccctgggcaacagaggagagcccagatgcagggagataacctggcggcagcgcaaaagatg

SEQ ID NO: 194478 - DNA, 103 bp, Artificial Sequence
  Synthetic Polynucleotide
taatacgactcactatagggttcctcctttggaaacagtaccatctccctaacagaggagaagggagatggtactgtttaacctggcggcagcgcaaaagatg

SEQ ID NO: 194479 - DNA, 103 bp, Artificial Sequence
  Synthetic Polynucleotide
taatacgactcactatagggccggggccccttcctcctttggaaacagtaaacagaggagatactgtatgcaaaggaggaacctggcggcagcgcaaaagatg

SEQ ID NO: 194480 - DNA, 103 bp, Artificial Sequence
  Synthetic Polynucleotide
taatacgactcactatagggatgctgggaaccggggccccttcctcctttaacagaggagaaaaggaatgaggggccccaacctggcggcagcgcaaaagatg

SEQ ID NO: 194481 - DNA, 103 bp, Artificial Sequence
  Synthetic Polynucleotide
taatacgactcactatagggcttctttggtatgctgggaaccggggccccaacagaggagaggggccatggttcccagcaacctggcggcagcgcaaaagatg

SEQ ID NO: 194482 - DNA, 103 bp, Artificial Sequence
  Synthetic Polynucleotide
taatacgactcactatagggttatcttctgcttctttggtatgctgggaaaacagaggagattcccaatgtaccaaagaaacctggcggcagcgcaaaagatg

SEQ ID NO: 194483 - DNA, 103 bp, Artificial Sequence
  Synthetic Polynucleotide
taatacgactcactatagggcaagggaattttatcttctgcttctttggtaacagaggagaaccaaaatggcagaagataacctggcggcagcgcaaaagatg

SEQ ID NO: 194484 - DNA, 103 bp, Artificial Sequence
  Synthetic Polynucleotide
taatacgactcactatagggttgaggggaccaagggaattttatcttctgaacagaggagacagaagatgaaattccctaacctggcggcagcgcaaaagatg

SEQ ID NO: 194485 - DNA, 103 bp, Artificial Sequence
  Synthetic Polynucleotide
taatacgactcactatagggacactcacttttgaggggaccaagggaattaacagaggagaaattccatgggtcccctcaacctggcggcagcgcaaaagatg

SEQ ID NO: 194486 - DNA, 103 bp, Artificial Sequence
  Synthetic Polynucleotide
taatacgactcactataggggcccttgatgacactcacttttgaggggacaacagaggagagtccccatgaaagtgagtaacctggcggcagcgcaaaagatg

SEQ ID NO: 194487 - DNA, 103 bp, Artificial Sequence
  Synthetic Polynucleotide
taatacgactcactataggggatacagcttgtcattgtcagaaaatttctaacagaggagaagaaatatgctgacaatgaacctggcggcagcgcaaaagatg

SEQ ID NO: 194488 - DNA, 103 bp, Artificial Sequence
  Synthetic Polynucleotide
taatacgactcactatagggggcttctgctgcccttgatgacactcacttaacagaggagaaagtgaatgtcatcaaggaacctggcggcagcgcaaaagatg

SEQ ID NO: 194489 - DNA, 103 bp, Artificial Sequence
  Synthetic Polynucleotide
taatacgactcactataggggcctccttttggcttctgctgcccttgatgaacagaggagacatcaaatgcagcagaagaacctggcggcagcgcaaaagatg

SEQ ID NO: 194490 - DNA, 103 bp, Artificial Sequence
  Synthetic Polynucleotide
taatacgactcactatagggcaaaggaaaagcctccttttggcttctgctaacagaggagaagcagaatgcaaaaggagaacctggcggcagcgcaaaagatg

SEQ ID NO: 194491 - DNA, 103 bp, Artificial Sequence
  Synthetic Polynucleotide
taatacgactcactatagggctccctttgccaaaggaaaagcctccttttaacagaggagaaaaaggatgcttttccttaacctggcggcagcgcaaaagatg

SEQ ID NO: 194492 - DNA, 103 bp, Artificial Sequence
  Synthetic Polynucleotide
taatacgactcactataggggtgtctacctctccctttgccaaaggaaaaaacagaggagattttccatgggcaaagggaacctggcggcagcgcaaaagatg

SEQ ID NO: 194493 - DNA, 103 bp, Artificial Sequence
  Synthetic Polynucleotide
taatacgactcactatagggctgtggtgcagtgtctacctctccctttgcaacagaggagagcaaagatggaggtagacaacctggcggcagcgcaaaagatg

SEQ ID NO: 194494 - DNA, 103 bp, Artificial Sequence
  Synthetic Polynucleotide
taatacgactcactatagggctttattaccctgtggtgcagtgtctacctaacagaggagaaggtagatgctgcaccacaacctggcggcagcgcaaaagatg

SEQ ID NO: 194495 - DNA, 103 bp, Artificial Sequence
  Synthetic Polynucleotide
taatacgactcactatagggtcctttaagtctttattaccctgtggtgcaaacagaggagatgcaccatggggtaataaaacctggcggcagcgcaaaagatg

SEQ ID NO: 194496 - DNA, 103 bp, Artificial Sequence
  Synthetic Polynucleotide
taatacgactcactatagggaagcacatgctcctttaagtctttattaccaacagaggagaggtaatatggacttaaagaacctggcggcagcgcaaaagatg

SEQ ID NO: 194497 - DNA, 103 bp, Artificial Sequence
  Synthetic Polynucleotide
taatacgactcactatagggaggaactttgaagcacatgctcctttaagtaacagaggagaacttaaatgagcatgtgcaacctggcggcagcgcaaaagatg

SEQ ID NO: 194498 - DNA, 103 bp, Artificial Sequence
  Synthetic Polynucleotide
taatacgactcactatagggtgaaggtagagatacagcttgtcattgtcaaacagaggagatgacaaatgcaagctgtaaacctggcggcagcgcaaaagatg

SEQ ID NO: 194499 - DNA, 103 bp, Artificial Sequence
  Synthetic Polynucleotide
taatacgactcactatagggtcctgggataaggaactttgaagcacatgcaacagaggagagcatgtatgtcaaagttcaacctggcggcagcgcaaaagatg

SEQ ID NO: 194500 - DNA, 103 bp, Artificial Sequence
  Synthetic Polynucleotide
taatacgactcactataggggtctttatgctcctgggataaggaactttgaacagaggagacaaagtatgttatcccagaacctggcggcagcgcaaaagatg

SEQ ID NO: 194501 - DNA, 103 bp, Artificial Sequence
  Synthetic Polynucleotide
taatacgactcactatagggttgcttttgggtctttatgctcctgggataaacagaggagatatcccatgagcataaagaacctggcggcagcgcaaaagatg

SEQ ID NO: 194502 - DNA, 103 bp, Artificial Sequence
  Synthetic Polynucleotide
taatacgactcactatagggcatgggggtgttgcttttgggtctttatgcaacagaggagagcataaatgcccaaaagcaacctggcggcagcgcaaaagatg

SEQ ID NO: 194503 - DNA, 103 bp, Artificial Sequence
  Synthetic Polynucleotide
taatacgactcactatagggtgaggggagctgaaggtagagatacagcttaacagaggagaaagctgatgctctaccttaacctggcggcagcgcaaaagatg

SEQ ID NO: 194504 - DNA, 103 bp, Artificial Sequence
  Synthetic Polynucleotide
taatacgactcactatagggcagtcttggggctcttagcatcaggctcataacagaggagaatgagcatgatgctaagaaacctggcggcagcgcaaaagatg

SEQ ID NO: 194505 - DNA, 103 bp, Artificial Sequence
  Synthetic Polynucleotide
taatacgactcactatagggtggtgggtcctgaggggagctgaaggtagaaacagaggagatctaccatgagctcccctaacctggcggcagcgcaaaagatg

SEQ ID NO: 194506 - DNA, 103 bp, Artificial Sequence
  Synthetic Polynucleotide
taatacgactcactatagggttgtctccagtggtgggtcctgaggggagcaacagaggagagctcccatgaggacccacaacctggcggcagcgcaaaagatg

SEQ ID NO: 194507 - DNA, 103 bp, Artificial Sequence
  Synthetic Polynucleotide
taatacgactcactatagggctctgagcttttgtctccagtggtgggtccaacagaggagaggacccatgactggagacaacctggcggcagcgcaaaagatg

SEQ ID NO: 194508 - DNA, 103 bp, Artificial Sequence
  Synthetic Polynucleotide
taatacgactcactataggggtgtacttggctctgagcttttgtctccagaacagaggagactggagatgaaagctcagaacctggcggcagcgcaaaagatg

SEQ ID NO: 194509 - DNA, 103 bp, Artificial Sequence
  Synthetic Polynucleotide
taatacgactcactatagggtcattgctcagtgtacttggctctgagcttaacagaggagaaagctcatggccaagtacaacctggcggcagcgcaaaagatg

SEQ ID NO: 194510 - DNA, 103 bp, Artificial Sequence
  Synthetic Polynucleotide
taatacgactcactatagggcatgtactcctcattgctcagtgtacttggaacagaggagaccaagtatgctgagcaataacctggcggcagcgcaaaagatg

SEQ ID NO: 194511 - DNA, 103 bp, Artificial Sequence
  Synthetic Polynucleotide
taatacgactcactatagggtataggcatacatgtactcctcattgctcaaacagaggagatgagcaatgaggagtacaaacctggcggcagcgcaaaagatg

SEQ ID NO: 194512 - DNA, 103 bp, Artificial Sequence
  Synthetic Polynucleotide
taatacgactcactatagggcggatccacctataggcatacatgtactccaacagaggagaggagtaatggtatgcctaaacctggcggcagcgcaaaagatg

SEQ ID NO: 194513 - DNA, 103 bp, Artificial Sequence
  Synthetic Polynucleotide
taatacgactcactatagggcaggtggttgcggatccacctataggcataaacagaggagatatgccatgaggtggatcaacctggcggcagcgcaaaagatg

SEQ ID NO: 194514 - DNA, 103 bp, Artificial Sequence
  Synthetic Polynucleotide
taatacgactcactatagggtgtgctcttccaggtggttgcggatccaccaacagaggagaggtggaatggcaaccaccaacctggcggcagcgcaaaagatg

SEQ ID NO: 194515 - DNA, 103 bp, Artificial Sequence
  Synthetic Polynucleotide
taatacgactcactataggggcccttcccccagtcttggggctcttagcaaacagaggagatgctaaatgccccaagacaacctggcggcagcgcaaaagatg

SEQ ID NO: 194516 - DNA, 103 bp, Artificial Sequence
  Synthetic Polynucleotide
taatacgactcactatagggcaggtgtcagtgtgctcttccaggtggttgaacagaggagacaaccaatgggaagagcaaacctggcggcagcgcaaaagatg

SEQ ID NO: 194517 - DNA, 103 bp, Artificial Sequence
  Synthetic Polynucleotide
taatacgactcactatagggctttggcagacaggtgtcagtgtgctcttcaacagaggagagaagagatgactgacaccaacctggcggcagcgcaaaagatg

SEQ ID NO: 194518 - DNA, 103 bp, Artificial Sequence
  Synthetic Polynucleotide
taatacgactcactatagggaaacactttgctttggcagacaggtgtcagaacagaggagactgacaatggtctgccaaaacctggcggcagcgcaaaagatg

SEQ ID NO: 194519 - DNA, 103 bp, Artificial Sequence
  Synthetic Polynucleotide
taatacgactcactatagggtaggcatcataaacactttgctttggcagaaacagaggagatctgccatggcaaagtgtaacctggcggcagcgcaaaagatg

SEQ ID NO: 194520 - DNA, 103 bp, Artificial Sequence
  Synthetic Polynucleotide
taatacgactcactataggggtacttccgataggcatcataaacactttgaacagaggagacaaagtatgtatgatgccaacctggcggcagcgcaaaagatg

SEQ ID NO: 194521 - DNA, 103 bp, Artificial Sequence
  Synthetic Polynucleotide
taatacgactcactataggggactctcacagtacttccgataggcatcataacagaggagaatgatgatgatcggaagtaacctggcggcagcgcaaaagatg

SEQ ID NO: 194522 - DNA, 103 bp, Artificial Sequence
  Synthetic Polynucleotide
taatacgactcactatagggcaacaggcaagactctcacagtacttccgaaacagaggagatcggaaatgctgtgagagaacctggcggcagcgcaaaagatg

SEQ ID NO: 194523 - DNA, 103 bp, Artificial Sequence
  Synthetic Polynucleotide
taatacgactcactataggggagtgggcggcaacaggcaagactctcacaaacagaggagatgtgagatgcttgcctgtaacctggcggcagcgcaaaagatg

SEQ ID NO: 194524 - DNA, 103 bp, Artificial Sequence
  Synthetic Polynucleotide
taatacgactcactatagggtggctgtgctgagtgggcggcaacaggcaaaacagaggagattgcctatggccgcccacaacctggcggcagcgcaaaagatg

SEQ ID NO: 194525 - DNA, 103 bp, Artificial Sequence
  Synthetic Polynucleotide
taatacgactcactatagggttgccaaagttggctgtgctgagtgggcggaacagaggagaccgcccatgcagcacagcaacctggcggcagcgcaaaagatg

SEQ ID NO: 194526 - DNA, 103 bp, Artificial Sequence
  Synthetic Polynucleotide
taatacgactcactatagggacctgggggggcccttcccccagtcttgggaacagaggagacccaagatggggggaaggaacctggcggcagcgcaaaagatg

SEQ ID NO: 194527 - DNA, 103 bp, Artificial Sequence
  Synthetic Polynucleotide
taatacgactcactatagggtctgatgatcttgccaaagttggctgtgctaacagaggagaagcacaatgaactttggcaacctggcggcagcgcaaaagatg

SEQ ID NO: 194528 - DNA, 103 bp, Artificial Sequence
  Synthetic Polynucleotide
taatacgactcactatagggggaagatctctctgatgatcttgccaaagtaacagaggagaactttgatgagatcatcaaacctggcggcagcgcaaaagatg

SEQ ID NO: 194529 - DNA, 103 bp, Artificial Sequence
  Synthetic Polynucleotide
taatacgactcactatagggttgatgtcagggaagatctctctgatgatcaacagaggagagatcatatgagagatcttaacctggcggcagcgcaaaagatg

SEQ ID NO: 194530 - DNA, 103 bp, Artificial Sequence
  Synthetic Polynucleotide
taatacgactcactatagggccttcgagctttgatgtcagggaagatctcaacagaggagagagatcatgcctgacatcaacctggcggcagcgcaaaagatg

SEQ ID NO: 194531 - DNA, 103 bp, Artificial Sequence
  Synthetic Polynucleotide
taatacgactcactatagggggccaccaagccttcgagctttgatgtcagaacagaggagactgacaatgaagctcgaaaacctggcggcagcgcaaaagatg

SEQ ID NO: 194532 - DNA, 103 bp, Artificial Sequence
  Synthetic Polynucleotide
taatacgactcactataggggactggccccggccaccaagccttcgagctaacagaggagaagctcgatggcttggtggaacctggcggcagcgcaaaagatg

SEQ ID NO: 194533 - DNA, 103 bp, Artificial Sequence
  Synthetic Polynucleotide
taatacgactcactataggggcaatatttggactggccccggccaccaagaacagaggagacttggtatgcggggccagaacctggcggcagcgcaaaagatg

SEQ ID NO: 194534 - DNA, 103 bp, Artificial Sequence
  Synthetic Polynucleotide
taatacgactcactatagggtgccactgtagcaatatttggactggccccaacagaggagaggggccatgccaaatattaacctggcggcagcgcaaaagatg

SEQ ID NO: 194535 - DNA, 103 bp, Artificial Sequence
  Synthetic Polynucleotide
taatacgactcactatagggttcctccttatgccactgtagcaatatttgaacagaggagacaaataatgctacagtggaacctggcggcagcgcaaaagatg

SEQ ID NO: 194536 - DNA, 103 bp, Artificial Sequence
  Synthetic Polynucleotide
taatacgactcactatagggcaccaaggtcttcctccttatgccactgtaaacagaggagatacagtatgataaggaggaacctggcggcagcgcaaaagatg

SEQ ID NO: 194537 - DNA, 103 bp, Artificial Sequence
  Synthetic Polynucleotide
taatacgactcactatagggcctcagcaccacctgggggggcccttccccaacagaggagaggggaaatgcccccccagaacctggcggcagcgcaaaagatg

SEQ ID NO: 194538 - DNA, 103 bp, Artificial Sequence
  Synthetic Polynucleotide
taatacgactcactataggggtggcatagacaccaaggtcttcctccttaaacagaggagataaggaatgagaccttggaacctggcggcagcgcaaaagatg

SEQ ID NO: 194539 - DNA, 103 bp, Artificial Sequence
  Synthetic Polynucleotide
taatacgactcactatagggccaggcaggggtggcatagacaccaaggtcaacagaggagagaccttatggtctatgccaacctggcggcagcgcaaaagatg

SEQ ID NO: 194540 - DNA, 103 bp, Artificial Sequence
  Synthetic Polynucleotide
taatacgactcactatagggtaggtcaagtccaggcaggggtggcatagaaacagaggagatctatgatgcccctgcctaacctggcggcagcgcaaaagatg

SEQ ID NO: 194541 - DNA, 103 bp, Artificial Sequence
  Synthetic Polynucleotide
taatacgactcactatagggcagaaccctttaggtcaagtccaggcagggaacagaggagaccctgcatggacttgaccaacctggcggcagcgcaaaagatg

SEQ ID NO: 194542 - DNA, 103 bp, Artificial Sequence
  Synthetic Polynucleotide
taatacgactcactatagggtctggactctcagaaccctttaggtcaagtaacagaggagaacttgaatgaaagggttcaacctggcggcagcgcaaaagatg

SEQ ID NO: 194543 - DNA, 103 bp, Artificial Sequence
  Synthetic Polynucleotide
taatacgactcactatagggtgggcccatttctggactctcagaacccttaacagaggagaaagggtatggagagtccaaacctggcggcagcgcaaaagatg

SEQ ID NO: 194544 - DNA, 103 bp, Artificial Sequence
  Synthetic Polynucleotide
taatacgactcactataggggggttacttctgggcccatttctggactctaacagaggagaagagtcatgaaatgggccaacctggcggcagcgcaaaagatg

SEQ ID NO: 194545 - DNA, 103 bp, Artificial Sequence
  Synthetic Polynucleotide
taatacgactcactatagggcgaggtgctggggttacttctgggcccattaacagaggagaaatgggatgagaagtaacaacctggcggcagcgcaaaagatg

SEQ ID NO: 194546 - DNA, 103 bp, Artificial Sequence
  Synthetic Polynucleotide
taatacgactcactatagggcagttcatctcgaggtgctggggttacttcaacagaggagagaagtaatgccagcacctaacctggcggcagcgcaaaagatg

SEQ ID NO: 194547 - DNA, 103 bp, Artificial Sequence
  Synthetic Polynucleotide
taatacgactcactatagggctgcctccaccagttcatctcgaggtgctgaacagaggagacagcacatggagatgaacaacctggcggcagcgcaaaagatg

SEQ ID NO: 194548 - DNA, 103 bp, Artificial Sequence
  Synthetic Polynucleotide
taatacgactcactatagggggttccccagcctcagcaccacctggggggaacagaggagaccccccatgtggtgctgaaacctggcggcagcgcaaaagatg

SEQ ID NO: 194549 - DNA, 103 bp, Artificial Sequence
  Synthetic Polynucleotide
taatacgactcactatagggagggcacacgctgcctccaccagttcatctaacagaggagaagatgaatgggtggaggcaacctggcggcagcgcaaaagatg

SEQ ID NO: 194550 - DNA, 103 bp, Artificial Sequence
  Synthetic Polynucleotide
taatacgactcactataggggtcacaggtcagggcacacgctgcctccacaacagaggagagtggagatggcgtgtgccaacctggcggcagcgcaaaagatg

SEQ ID NO: 194551 - DNA, 103 bp, Artificial Sequence
  Synthetic Polynucleotide
taatacgactcactataggggctctgcccagtcacaggtcagggcacacgaacagaggagacgtgtgatgtgacctgtgaacctggcggcagcgcaaaagatg

SEQ ID NO: 194552 - DNA, 103 bp, Artificial Sequence
  Synthetic Polynucleotide
taatacgactcactatagggttcaggatccgctctgcccagtcacaggtcaacagaggagagacctgatgctgggcagaaacctggcggcagcgcaaaagatg

SEQ ID NO: 194553 - DNA, 103 bp, Artificial Sequence
  Synthetic Polynucleotide
taatacgactcactataggggaaggaccgtttcaggatccgctctgcccaaacagaggagatgggcaatgcggatcctgaacctggcggcagcgcaaaagatg

SEQ ID NO: 194554 - DNA, 103 bp, Artificial Sequence
  Synthetic Polynucleotide
taatacgactcactatagggcgatggaactgaaggaccgtttcaggatccaacagaggagaggatccatgaacggtcctaacctggcggcagcgcaaaagatg

SEQ ID NO: 194555 - DNA, 103 bp, Artificial Sequence
  Synthetic Polynucleotide
taatacgactcactataggggcgacctcaacgatggaactgaaggaccgtaacagaggagaacggtcatgcagttccataacctggcggcagcgcaaaagatg

SEQ ID NO: 194556 - DNA, 103 bp, Artificial Sequence
  Synthetic Polynucleotide
taatacgactcactatagggcaggaagcgggcgacctcaacgatggaactaacagaggagaagttccatggttgaggtcaacctggcggcagcgcaaaagatg

SEQ ID NO: 194557 - DNA, 103 bp, Artificial Sequence
  Synthetic Polynucleotide
taatacgactcactataggggctgctgtagcaggaagcgggcgacctcaaaacagaggagattgaggatgcccgcttccaacctggcggcagcgcaaaagatg

SEQ ID NO: 194558 - DNA, 103 bp, Artificial Sequence
  Synthetic Polynucleotide
taatacgactcactataggggagatgagatgctgctgtagcaggaagcggaacagaggagaccgcttatggctacagcaaacctggcggcagcgcaaaagatg

SEQ ID NO: 194559 - DNA, 103 bp, Artificial Sequence
  Synthetic Polynucleotide
taatacgactcactatagggaagggtggtaggttccccagcctcagcaccaacagaggagaggtgctatggctggggaaaacctggcggcagcgcaaaagatg

SEQ ID NO: 194560 - DNA, 103 bp, Artificial Sequence
  Synthetic Polynucleotide
taatacgactcactatagggagatcgggcagagatgagatgctgctgtagaacagaggagactacagatgcatctcatcaacctggcggcagcgcaaaagatg

SEQ ID NO: 194561 - DNA, 103 bp, Artificial Sequence
  Synthetic Polynucleotide
taatacgactcactataggggggcatgtgcagatcgggcagagatgagataacagaggagaatctcaatgctgcccgataacctggcggcagcgcaaaagatg

SEQ ID NO: 194562 - DNA, 103 bp, Artificial Sequence
  Synthetic Polynucleotide
taatacgactcactatagggttaagcacatgggcatgtgcagatcgggcaaacagaggagatgcccgatgtgcacatgcaacctggcggcagcgcaaaagatg

SEQ ID NO: 194563 - DNA, 103 bp, Artificial Sequence
  Synthetic Polynucleotide
taatacgactcactatagggccccatggccttaagcacatgggcatgtgcaacagaggagagcacatatgcatgtgcttaacctggcggcagcgcaaaagatg

SEQ ID NO: 194564 - DNA, 103 bp, Artificial Sequence
  Synthetic Polynucleotide
taatacgactcactatagggcttcagcgagccccatggccttaagcacataacagaggagaatgtgcatgaggccatggaacctggcggcagcgcaaaagatg

SEQ ID NO: 194565 - DNA, 103 bp, Artificial Sequence
  Synthetic Polynucleotide
taatacgactcactatagggtgttcgtcctcttcagcgagccccatggccaacagaggagaggccatatggctcgctgaaacctggcggcagcgcaaaagatg

SEQ ID NO: 194566 - DNA, 103 bp, Artificial Sequence
  Synthetic Polynucleotide
taatacgactcactatagggccgaggtgcatgttcgtcctcttcagcgagaacagaggagactcgctatggaggacgaaaacctggcggcagcgcaaaagatg

SEQ ID NO: 194567 - DNA, 103 bp, Artificial Sequence
  Synthetic Polynucleotide
taatacgactcactatagggatgaccgttcccgaggtgcatgttcgtcctaacagaggagaaggacgatgatgcacctcaacctggcggcagcgcaaaagatg

SEQ ID NO: 194568 - DNA, 103 bp, Artificial Sequence
  Synthetic Polynucleotide
taatacgactcactatagggtttggtttagatgaccgttcccgaggtgcaaacagaggagatgcaccatgggaacggtcaacctggcggcagcgcaaaagatg

SEQ ID NO: 194569 - DNA, 103 bp, Artificial Sequence
  Synthetic Polynucleotide
taatacgactcactatagggtaaaccattctttggtttagatgaccgttcaacagaggagagaacggatgtctaaaccaaacctggcggcagcgcaaaagatg

SEQ ID NO: 194570 - DNA, 103 bp, Artificial Sequence
  Synthetic Polynucleotide
taatacgactcactataggggcctctgaagaagggtggtaggttccccagaacagaggagactggggatgctaccacccaacctggcggcagcgcaaaagatg

SEQ ID NO: 194571 - DNA, 103 bp, Artificial Sequence
  Synthetic Polynucleotide
taatacgactcactatagggctgggttctctaaaccattctttggtttagaacagaggagactaaacatgagaatggttaacctggcggcagcgcaaaagatg

SEQ ID NO: 194572 - DNA, 103 bp, Artificial Sequence
  Synthetic Polynucleotide
taatacgactcactataggggctccaccctctgggttctctaaaccattcaacagaggagagaatggatgagagaacccaacctggcggcagcgcaaaagatg

SEQ ID NO: 194573 - DNA, 103 bp, Artificial Sequence
  Synthetic Polynucleotide
taatacgactcactatagggcttcttgtgggctccaccctctgggttctcaacagaggagagagaacatggagggtggaaacctggcggcagcgcaaaagatg

SEQ ID NO: 194574 - DNA, 103 bp, Artificial Sequence
  Synthetic Polynucleotide
taatacgactcactataggggtctctctggcttcttgtgggctccaccctaacagaggagaagggtgatgcccacaagaaacctggcggcagcgcaaaagatg

SEQ ID NO: 194575 - DNA, 103 bp, Artificial Sequence
  Synthetic Polynucleotide
taatacgactcactatagggggctgggccagtctctctggcttcttgtggaacagaggagaccacaaatggccagagagaacctggcggcagcgcaaaagatg

SEQ ID NO: 194576 - DNA, 103 bp, Artificial Sequence
  Synthetic Polynucleotide
taatacgactcactatagggatccttaggaggctgggccagtctctctggaacagaggagaccagagatgctggcccagaacctggcggcagcgcaaaagatg

SEQ ID NO: 194577 - DNA, 103 bp, Artificial Sequence
  Synthetic Polynucleotide
taatacgactcactataggggggcttccagatccttaggaggctgggccaaacagaggagatggcccatgctcctaaggaacctggcggcagcgcaaaagatg

SEQ ID NO: 194578 - DNA, 103 bp, Artificial Sequence
  Synthetic Polynucleotide
taatacgactcactataggggccccagttcgggcttccagatccttaggaaacagaggagatcctaaatgtctggaagcaacctggcggcagcgcaaaagatg

SEQ ID NO: 194579 - DNA, 103 bp, Artificial Sequence
  Synthetic Polynucleotide
taatacgactcactataggggagaggaccggccccagttcgggcttccagaacagaggagactggaaatgcgaactgggaacctggcggcagcgcaaaagatg

SEQ ID NO: 194580 - DNA, 103 bp, Artificial Sequence
  Synthetic Polynucleotide
taatacgactcactatagggctccacgtgcgagaggaccggccccagttcaacagaggagagaactgatgccggtcctcaacctggcggcagcgcaaaagatg

SEQ ID NO: 194581 - DNA, 103 bp, Artificial Sequence
  Synthetic Polynucleotide
taatacgactcactataggggtacctcggagcctctgaagaagggtggtaaacagaggagataccacatgtcttcagagaacctggcggcagcgcaaaagatg

SEQ ID NO: 194582 - DNA, 103 bp, Artificial Sequence
  Synthetic Polynucleotide
taatacgactcactatagggttcttccgctctccacgtgcgagaggaccgaacagaggagacggtccatgcgcacgtggaacctggcggcagcgcaaaagatg

SEQ ID NO: 194583 - DNA, 103 bp, Artificial Sequence
  Synthetic Polynucleotide
taatacgactcactatagggaactacactcttcttccgctctccacgtgcaacagaggagagcacgtatggagcggaagaacctggcggcagcgcaaaagatg

SEQ ID NO: 194584 - DNA, 103 bp, Artificial Sequence
  Synthetic Polynucleotide
taatacgactcactatagggccgagctctcaactacactcttcttccgctaacagaggagaagcggaatgagagtgtagaacctggcggcagcgcaaaagatg

SEQ ID NO: 194585 - DNA, 103 bp, Artificial Sequence
  Synthetic Polynucleotide
taatacgactcactataggggctcctggggccgagctctcaactacactcaacagaggagagagtgtatgtgagagctcaacctggcggcagcgcaaaagatg

SEQ ID NO: 194586 - DNA, 103 bp, Artificial Sequence
  Synthetic Polynucleotide
taatacgactcactatagggcaggttattggctcctggggccgagctctcaacagaggagagagagcatggccccaggaaacctggcggcagcgcaaaagatg

SEQ ID NO: 194587 - DNA, 103 bp, Artificial Sequence
  Synthetic Polynucleotide
taatacgactcactatagggcattaacctgcaggttattggctcctggggaacagaggagaccccagatgccaataaccaacctggcggcagcgcaaaagatg

SEQ ID NO: 194588 - DNA, 103 bp, Artificial Sequence
  Synthetic Polynucleotide
taatacgactcactataggggccactagggcattaacctgcaggttattgaacagaggagacaataaatggcaggttaaaacctggcggcagcgcaaaagatg

SEQ ID NO: 194589 - DNA, 103 bp, Artificial Sequence
  Synthetic Polynucleotide
taatacgactcactatagggaggcagccgagccactagggcattaacctgaacagaggagacaggttatggccctagtgaacctggcggcagcgcaaaagatg

SEQ ID NO: 194590 - DNA, 103 bp, Artificial Sequence
  Synthetic Polynucleotide
taatacgactcactataggggaaggagcagaggcagccgagccactagggaacagaggagaccctagatgctcggctgcaacctggcggcagcgcaaaagatg

SEQ ID NO: 194591 - DNA, 103 bp, Artificial Sequence
  Synthetic Polynucleotide
taatacgactcactatagggggggcccggggaaggagcagaggcagccgaaacagaggagatcggctatgtctgctcctaacctggcggcagcgcaaaagatg

SEQ ID NO: 194592 - DNA, 103 bp, Artificial Sequence
  Synthetic Polynucleotide
taatacgactcactatagggggtgtcttccagctccgggaccttggccataacagaggagaatggccatggtcccggagaacctggcggcagcgcaaaagatg

SEQ ID NO: 194593 - DNA, 103 bp, Artificial Sequence
  Synthetic Polynucleotide
taatacgactcactatagggatagactagcaagcccttgcccaggagctgaacagaggagacagctcatgggcaagggcaacctggcggcagcgcaaaagatg

SEQ ID NO: 194594 - DNA, 103 bp, Artificial Sequence
  Synthetic Polynucleotide
taatacgactcactatagggttcaggcatttcttgcattgttgcaggaataacagaggagaattcctatgacaatgcaaaacctggcggcagcgcaaaagatg

SEQ ID NO: 194595 - DNA, 103 bp, Artificial Sequence
  Synthetic Polynucleotide
taatacgactcactatagggctaataagctttcaggcatttcttgcattgaacagaggagacaatgcatgaaatgcctgaacctggcggcagcgcaaaagatg

SEQ ID NO: 194596 - DNA, 103 bp, Artificial Sequence
  Synthetic Polynucleotide
taatacgactcactatagggcttatgtctgctaataagctttcaggcattaacagaggagaaatgccatgaagcttattaacctggcggcagcgcaaaagatg

SEQ ID NO: 194597 - DNA, 103 bp, Artificial Sequence
  Synthetic Polynucleotide
taatacgactcactatagggagcaaaatttcttatgtctgctaataagctaacagaggagaagcttaatggcagacataaacctggcggcagcgcaaaagatg

SEQ ID NO: 194598 - DNA, 103 bp, Artificial Sequence
  Synthetic Polynucleotide
taatacgactcactatagggcccaatttttagcaaaatttcttatgtctgaacagaggagacagacaatggaaattttgaacctggcggcagcgcaaaagatg

SEQ ID NO: 194599 - DNA, 103 bp, Artificial Sequence
  Synthetic Polynucleotide
taatacgactcactatagggacccactgttcccaatttttagcaaaatttaacagaggagaaaatttatgtaaaaattgaacctggcggcagcgcaaaagatg

SEQ ID NO: 194600 - DNA, 103 bp, Artificial Sequence
  Synthetic Polynucleotide
taatacgactcactatagggggatgaaacaacccactgttcccaatttttaacagaggagaaaaaatatggaacagtggaacctggcggcagcgcaaaagatg

SEQ ID NO: 194601 - DNA, 103 bp, Artificial Sequence
  Synthetic Polynucleotide
taatacgactcactatagggagttttccaaggatgaaacaacccactgttaacagaggagaaacagtatgttgtttcataacctggcggcagcgcaaaagatg

SEQ ID NO: 194602 - DNA, 103 bp, Artificial Sequence
  Synthetic Polynucleotide
taatacgactcactataggggcttctggcaagttttccaaggatgaaacaaacagaggagatgtttcatgcttggaaaaaacctggcggcagcgcaaaagatg

SEQ ID NO: 194603 - DNA, 103 bp, Artificial Sequence
  Synthetic Polynucleotide
taatacgactcactataggggtcagttagagcttctggcaagttttccaaaacagaggagattggaaatgttgccagaaaacctggcggcagcgcaaaagatg

SEQ ID NO: 194604 - DNA, 103 bp, Artificial Sequence
  Synthetic Polynucleotide
taatacgactcactatagggtttcttccggatagactagcaagcccttgcaacagaggagagcaaggatgtgctagtctaacctggcggcagcgcaaaagatg

SEQ ID NO: 194605 - DNA, 103 bp, Artificial Sequence
  Synthetic Polynucleotide
taatacgactcactataggggtattttcttgtcagttagagcttctggcaaacagaggagatgccagatgctctaactgaacctggcggcagcgcaaaagatg

SEQ ID NO: 194606 - DNA, 103 bp, Artificial Sequence
  Synthetic Polynucleotide
taatacgactcactatagggcgcacaataggtattttcttgtcagttagaaacagaggagatctaacatgcaagaaaataacctggcggcagcgcaaaagatg

SEQ ID NO: 194607 - DNA, 103 bp, Artificial Sequence
  Synthetic Polynucleotide
taatacgactcactatagggtacaaatcttcgcacaataggtattttcttaacagaggagaaagaaaatgcctattgtgaacctggcggcagcgcaaaagatg

SEQ ID NO: 194608 - DNA, 103 bp, Artificial Sequence
  Synthetic Polynucleotide
taatacgactcactatagggtcagagaagatacaaatcttcgcacaatagaacagaggagactattgatggaagatttgaacctggcggcagcgcaaaagatg

SEQ ID NO: 194609 - DNA, 103 bp, Artificial Sequence
  Synthetic Polynucleotide
taatacgactcactataggggtttgtcgtttcagagaagatacaaatcttaacagaggagaaagattatgatcttctctaacctggcggcagcgcaaaagatg

SEQ ID NO: 194610 - DNA, 103 bp, Artificial Sequence
  Synthetic Polynucleotide
taatacgactcactatagggtaagaaagatgtttgtcgtttcagagaagaaacagaggagatcttctatgaaacgacaaaacctggcggcagcgcaaaagatg

SEQ ID NO: 194611 - DNA, 103 bp, Artificial Sequence
  Synthetic Polynucleotide
taatacgactcactataggggggcaagatgtaagaaagatgtttgtcgttaacagaggagaaacgacatgcatctttctaacctggcggcagcgcaaaagatg

SEQ ID NO: 194612 - DNA, 103 bp, Artificial Sequence
  Synthetic Polynucleotide
taatacgactcactatagggctggcaatctgggcaagatgtaagaaagataacagaggagaatctttatgacatcttgcaacctggcggcagcgcaaaagatg

SEQ ID NO: 194613 - DNA, 103 bp, Artificial Sequence
  Synthetic Polynucleotide
taatacgactcactataggggagagctggtctggcaatctgggcaagatgaacagaggagacatcttatgcagattgccaacctggcggcagcgcaaaagatg

SEQ ID NO: 194614 - DNA, 103 bp, Artificial Sequence
  Synthetic Polynucleotide
taatacgactcactataggggctggtcaaagagagctggtctggcaatctaacagaggagaagattgatggaccagctcaacctggcggcagcgcaaaagatg

SEQ ID NO: 194615 - DNA, 103 bp, Artificial Sequence
  Synthetic Polynucleotide
taatacgactcactatagggaggtacactgtttcttccggatagactagcaacagaggagagctagtatgtccggaagaaacctggcggcagcgcaaaagatg

SEQ ID NO: 194616 - DNA, 103 bp, Artificial Sequence
  Synthetic Polynucleotide
taatacgactcactatagggttaacgacatgctggtcaaagagagctggtaacagaggagaaccagcatgctttgaccaaacctggcggcagcgcaaaagatg

SEQ ID NO: 194617 - DNA, 103 bp, Artificial Sequence
  Synthetic Polynucleotide
taatacgactcactatagggcaccatagaattaacgacatgctggtcaaaaacagaggagatttgacatgcatgtcgttaacctggcggcagcgcaaaagatg

SEQ ID NO: 194618 - DNA, 103 bp, Artificial Sequence
  Synthetic Polynucleotide
taatacgactcactatagggcaatatcagacaccatagaattaacgacataacagaggagaatgtcgatgattctatggaacctggcggcagcgcaaaagatg

SEQ ID NO: 194619 - DNA, 103 bp, Artificial Sequence
  Synthetic Polynucleotide
taatacgactcactatagggtcaaccctttcaatatcagacaccatagaaaacagaggagattctatatggtctgatataacctggcggcagcgcaaaagatg

SEQ ID NO: 194620 - DNA, 103 bp, Artificial Sequence
  Synthetic Polynucleotide
taatacgactcactataggggctgttcaaatcaaccctttcaatatcagaaacagaggagatctgatatggaaagggttaacctggcggcagcgcaaaagatg

SEQ ID NO: 194621 - DNA, 103 bp, Artificial Sequence
  Synthetic Polynucleotide
taatacgactcactataggggagagccaatgctgttcaaatcaaccctttaacagaggagaaaagggatgatttgaacaaacctggcggcagcgcaaaagatg

SEQ ID NO: 194622 - DNA, 103 bp, Artificial Sequence
  Synthetic Polynucleotide
taatacgactcactatagggagaagggcttgagagccaatgctgttcaaaaacagaggagatttgaaatgcattggctcaacctggcggcagcgcaaaagatg

SEQ ID NO: 194623 - DNA, 103 bp, Artificial Sequence
  Synthetic Polynucleotide
taatacgactcactatagggtgaaatggtaagaagggcttgagagccaataacagaggagaattggcatgcaagcccttaacctggcggcagcgcaaaagatg

SEQ ID NO: 194624 - DNA, 103 bp, Artificial Sequence
  Synthetic Polynucleotide
taatacgactcactatagggctgtgctgcctgaaatggtaagaagggcttaacagaggagaaagcccatgttaccatttaacctggcggcagcgcaaaagatg

SEQ ID NO: 194625 - DNA, 103 bp, Artificial Sequence
  Synthetic Polynucleotide
taatacgactcactataggggattcagtgtctgtgctgcctgaaatggtaaacagaggagataccatatgaggcagcacaacctggcggcagcgcaaaagatg

SEQ ID NO: 194626 - DNA, 103 bp, Artificial Sequence
  Synthetic Polynucleotide
taatacgactcactatagggttcggccgccaggtacactgtttcttccggaacagaggagaccggaaatgacagtgtacaacctggcggcagcgcaaaagatg

SEQ ID NO: 194627 - DNA, 103 bp, Artificial Sequence
  Synthetic Polynucleotide
taatacgactcactataggggtagataccagattcagtgtctgtgctgccaacagaggagaggcagcatggacactgaaaacctggcggcagcgcaaaagatg

SEQ ID NO: 194628 - DNA, 103 bp, Artificial Sequence
  Synthetic Polynucleotide
taatacgactcactatagggcatgttcagtgtagataccagattcagtgtaacagaggagaacactgatgctggtatctaacctggcggcagcgcaaaagatg

SEQ ID NO: 194629 - DNA, 103 bp, Artificial Sequence
  Synthetic Polynucleotide
taatacgactcactataggggtgatagagtcatgttcagtgtagataccaaacagaggagatggtatatgcactgaacaaacctggcggcagcgcaaaagatg

SEQ ID NO: 194630 - DNA, 103 bp, Artificial Sequence
  Synthetic Polynucleotide
taatacgactcactatagggttggaacacagtgatagagtcatgttcagtaacagaggagaactgaaatggactctatcaacctggcggcagcgcaaaagatg

SEQ ID NO: 194631 - DNA, 103 bp, Artificial Sequence
  Synthetic Polynucleotide
taatacgactcactatagggccttcagttcttggaacacagtgatagagtaacagaggagaactctaatgctgtgttccaacctggcggcagcgcaaaagatg

SEQ ID NO: 194632 - DNA, 103 bp, Artificial Sequence
  Synthetic Polynucleotide
taatacgactcactatagggttaaggagatccttcagttcttggaacacaaacagaggagatgtgttatgagaactgaaaacctggcggcagcgcaaaagatg

SEQ ID NO: 194633 - DNA, 103 bp, Artificial Sequence
  Synthetic Polynucleotide
taatacgactcactatagggggcattcttcttaaggagatccttcagttcaacagaggagagaactgatggatctccttaacctggcggcagcgcaaaagatg

SEQ ID NO: 194634 - DNA, 103 bp, Artificial Sequence
  Synthetic Polynucleotide
taatacgactcactatagggcctccacagtggcattcttcttaaggagataacagaggagaatctccatgagaagaatgaacctggcggcagcgcaaaagatg

SEQ ID NO: 194635 - DNA, 103 bp, Artificial Sequence
  Synthetic Polynucleotide
taatacgactcactatagggtcaataaaagcctccacagtggcattcttcaacagaggagagaagaaatgcactgtggaaacctggcggcagcgcaaaagatg

SEQ ID NO: 194636 - DNA, 103 bp, Artificial Sequence
  Synthetic Polynucleotide
taatacgactcactatagggatccaaccattcaataaaagcctccacagtaacagaggagaactgtgatggcttttattaacctggcggcagcgcaaaagatg

SEQ ID NO: 194637 - DNA, 103 bp, Artificial Sequence
  Synthetic Polynucleotide
taatacgactcactatagggcgggctgcccttcggccgccaggtacactgaacagaggagacagtgtatgtggcggccgaacctggcggcagcgcaaaagatg

SEQ ID NO: 194638 - DNA, 103 bp, Artificial Sequence
  Synthetic Polynucleotide
taatacgactcactatagggctaccacagtatccaaccattcaataaaagaacagaggagacttttaatgaatggttggaacctggcggcagcgcaaaagatg

SEQ ID NO: 194639 - DNA, 103 bp, Artificial Sequence
  Synthetic Polynucleotide
taatacgactcactatagggactctctgttctaccacagtatccaaccataacagaggagaatggttatgtactgtggtaacctggcggcagcgcaaaagatg

SEQ ID NO: 194640 - DNA, 103 bp, Artificial Sequence
  Synthetic Polynucleotide
taatacgactcactatagggggtcttaataactctctgttctaccacagtaacagaggagaactgtgatggaacagagaaacctggcggcagcgcaaaagatg

SEQ ID NO: 194641 - DNA, 103 bp, Artificial Sequence
  Synthetic Polynucleotide
taatacgactcactatagggtttgtttgctggtcttaataactctctgttaacagaggagaaacagaatgttattaagaaacctggcggcagcgcaaaagatg

SEQ ID NO: 194642 - DNA, 103 bp, Artificial Sequence
  Synthetic Polynucleotide
taatacgactcactataggggaccttccattttgtttgctggtcttaataaacagaggagatattaaatgcagcaaacaaacctggcggcagcgcaaaagatg

SEQ ID NO: 194643 - DNA, 103 bp, Artificial Sequence
  Synthetic Polynucleotide
taatacgactcactatagggcttctttaatgaccttccattttgtttgctaacagaggagaagcaaaatgaatggaaggaacctggcggcagcgcaaaagatg

SEQ ID NO: 194644 - DNA, 103 bp, Artificial Sequence
  Synthetic Polynucleotide
taatacgactcactatagggcttgagctctcttctttaatgaccttccataacagaggagaatggaaatgcattaaagaaacctggcggcagcgcaaaagatg

SEQ ID NO: 194645 - DNA, 103 bp, Artificial Sequence
  Synthetic Polynucleotide
taatacgactcactatagggaacagaaagtcttgagctctcttctttaataacagaggagaattaaaatggagagctcaaacctggcggcagcgcaaaagatg

SEQ ID NO: 194646 - DNA, 103 bp, Artificial Sequence
  Synthetic Polynucleotide
taatacgactcactatagggactccactttaacagaaagtcttgagctctaacagaggagaagagctatggactttctgaacctggcggcagcgcaaaagatg

SEQ ID NO: 194647 - DNA, 103 bp, Artificial Sequence
  Synthetic Polynucleotide
taatacgactcactatagggcaccaaaaaaactccactttaacagaaagtaacagaggagaactttcatgtaaagtggaaacctggcggcagcgcaaaagatg

SEQ ID NO: 194648 - DNA, 103 bp, Artificial Sequence
  Synthetic Polynucleotide
taatacgactcactatagggtgctcgcccccgggctgcccttcggccgccaacagaggagaggcggcatgagggcagccaacctggcggcagcgcaaaagatg

SEQ ID NO: 194649 - DNA, 103 bp, Artificial Sequence
  Synthetic Polynucleotide
taatacgactcactatagggattactcgagcaccaaaaaaactccactttaacagaggagaaaagtgatgtttttttggaacctggcggcagcgcaaaagatg

SEQ ID NO: 194650 - DNA, 103 bp, Artificial Sequence
  Synthetic Polynucleotide
taatacgactcactataggggagattatgcattactcgagcaccaaaaaaaacagaggagattttttatggctcgagtaaacctggcggcagcgcaaaagatg

SEQ ID NO: 194651 - DNA, 103 bp, Artificial Sequence
  Synthetic Polynucleotide
taatacgactcactatagggtgttcaaggtgagattatgcattactcgagaacagaggagactcgagatgtgcataatcaacctggcggcagcgcaaaagatg

SEQ ID NO: 194652 - DNA, 103 bp, Artificial Sequence
  Synthetic Polynucleotide
taatacgactcactatagggctggatgcattgttcaaggtgagattatgcaacagaggagagcataaatgcaccttgaaaacctggcggcagcgcaaaagatg

SEQ ID NO: 194653 - DNA, 103 bp, Artificial Sequence
  Synthetic Polynucleotide
taatacgactcactatagggagaaccaaaactggatgcattgttcaaggtaacagaggagaaccttgatgaatgcatccaacctggcggcagcgcaaaagatg

SEQ ID NO: 194654 - DNA, 103 bp, Artificial Sequence
  Synthetic Polynucleotide
taatacgactcactatagggtcaaatgaaaagaaccaaaactggatgcataacagaggagaatgcatatggttttggttaacctggcggcagcgcaaaagatg

SEQ ID NO: 194655 - DNA, 103 bp, Artificial Sequence
  Synthetic Polynucleotide
taatacgactcactatagggagcattcgaatcaaatgaaaagaaccaaaaaacagaggagattttggatgttttcatttaacctggcggcagcgcaaaagatg

SEQ ID NO: 194656 - DNA, 103 bp, Artificial Sequence
  Synthetic Polynucleotide
taatacgactcactatagggttcatcgagaagcattcgaatcaaatgaaaaacagaggagatttcatatgattcgaatgaacctggcggcagcgcaaaagatg

SEQ ID NO: 194657 - DNA, 103 bp, Artificial Sequence
  Synthetic Polynucleotide
taatacgactcactatagggggagaatgtattcatcgagaagcattcgaaaacagaggagattcgaaatgttctcgatgaacctggcggcagcgcaaaagatg

SEQ ID NO: 194658 - DNA, 103 bp, Artificial Sequence
  Synthetic Polynucleotide
taatacgactcactatagggtccatggccaggagaatgtattcatcgagaaacagaggagatctcgaatgatacattctaacctggcggcagcgcaaaagatg

SEQ ID NO: 194659 - DNA, 103 bp, Artificial Sequence
  Synthetic Polynucleotide
taatacgactcactatagggcccgccgccctgctcgcccccgggctgcccaacagaggagagggcagatggggggcgagaacctggcggcagcgcaaaagatg

SEQ ID NO: 194660 - DNA, 103 bp, Artificial Sequence
  Synthetic Polynucleotide
taatacgactcactatagggaaactgggtctccatggccaggagaatgtaaacagaggagatacattatgctggccatgaacctggcggcagcgcaaaagatg

SEQ ID NO: 194661 - DNA, 103 bp, Artificial Sequence
  Synthetic Polynucleotide
taatacgactcactatagggtgtcattattaaactgggtctccatggccaaacagaggagatggccaatgagacccagtaacctggcggcagcgcaaaagatg

SEQ ID NO: 194662 - DNA, 103 bp, Artificial Sequence
  Synthetic Polynucleotide
taatacgactcactatagggtcctgctctttgtcattattaaactgggtcaacagaggagagacccaatgtaataatgaaacctggcggcagcgcaaaagatg

SEQ ID NO: 194663 - DNA, 103 bp, Artificial Sequence
  Synthetic Polynucleotide
taatacgactcactatagggattctgtaactcctgctctttgtcattattaacagaggagaaataatatgaaagagcagaacctggcggcagcgcaaaagatg

SEQ ID NO: 194664 - DNA, 103 bp, Artificial Sequence
  Synthetic Polynucleotide
taatacgactcactatagggtgtccaataaattctgtaactcctgctcttaacagaggagaaagagcatgagttacagaaacctggcggcagcgcaaaagatg

SEQ ID NO: 194665 - DNA, 103 bp, Artificial Sequence
  Synthetic Polynucleotide
taatacgactcactatagggttcatatacttgtccaataaattctgtaacaacagaggagagttacaatgtttattggaaacctggcggcagcgcaaaagatg

SEQ ID NO: 194666 - DNA, 103 bp, Artificial Sequence
  Synthetic Polynucleotide
taatacgactcactatagggatctgaattcttcatatacttgtccaataaaacagaggagattattgatgaagtatatgaacctggcggcagcgcaaaagatg

SEQ ID NO: 194667 - DNA, 103 bp, Artificial Sequence
  Synthetic Polynucleotide
taatacgactcactatagggctttactcgcatctgaattcttcatatactaacagaggagaagtataatgagaattcagaacctggcggcagcgcaaaagatg

SEQ ID NO: 194668 - DNA, 103 bp, Artificial Sequence
  Synthetic Polynucleotide
taatacgactcactataggggtgaaagcagctttactcgcatctgaattcaacagaggagagaattcatgtgcgagtaaaacctggcggcagcgcaaaagatg

SEQ ID NO: 194669 - DNA, 103 bp, Artificial Sequence
  Synthetic Polynucleotide
taatacgactcactatagggcggagaagcagtgaaagcagctttactcgcaacagaggagagcgagtatggctgctttcaacctggcggcagcgcaaaagatg

SEQ ID NO: 194670 - DNA, 103 bp, Artificial Sequence
  Synthetic Polynucleotide
taatacgactcactatagggcgcctttctccccgccgccctgctcgccccaacagaggagaggggcgatgagggcggcgaacctggcggcagcgcaaaagatg

SEQ ID NO: 194671 - DNA, 103 bp, Artificial Sequence
  Synthetic Polynucleotide
taatacgactcactatagggagcatgaactcggagaagcagtgaaagcagaacagaggagactgcttatgctgcttctcaacctggcggcagcgcaaaagatg

SEQ ID NO: 194672 - DNA, 103 bp, Artificial Sequence
  Synthetic Polynucleotide
taatacgactcactatagggttggccagaaagcatgaactcggagaagcaaacagaggagatgcttcatggagttcatgaacctggcggcagcgcaaaagatg

SEQ ID NO: 194673 - DNA, 103 bp, Artificial Sequence
  Synthetic Polynucleotide
taatacgactcactatagggtttattacggttggccagaaagcatgaactaacagaggagaagttcaatgtttctggccaacctggcggcagcgcaaaagatg

SEQ ID NO: 194674 - DNA, 103 bp, Artificial Sequence
  Synthetic Polynucleotide
taatacgactcactatagggccatgctccctttattacggttggccagaaaacagaggagattctggatgaccgtaataaacctggcggcagcgcaaaagatg

SEQ ID NO: 194675 - DNA, 103 bp, Artificial Sequence
  Synthetic Polynucleotide
taatacgactcactatagggtcgctggaaaccatgctccctttattacggaacagaggagaccgtaaatgagggagcataacctggcggcagcgcaaaagatg

SEQ ID NO: 194676 - DNA, 103 bp, Artificial Sequence
  Synthetic Polynucleotide
taatacgactcactatagggcttcacagcgtcgctggaaaccatgctcccaacagaggagagggagcatggtttccagcaacctggcggcagcgcaaaagatg

SEQ ID NO: 194677 - DNA, 103 bp, Artificial Sequence
  Synthetic Polynucleotide
taatacgactcactatagggggctttcattcttcacagcgtcgctggaaaaacagaggagatttccaatgacgctgtgaaacctggcggcagcgcaaaagatg

SEQ ID NO: 194678 - DNA, 103 bp, Artificial Sequence
  Synthetic Polynucleotide
taatacgactcactataggggtctccacgtggctttcattcttcacagcgaacagaggagacgctgtatggaatgaaagaacctggcggcagcgcaaaagatg

SEQ ID NO: 194679 - DNA, 103 bp, Artificial Sequence
  Synthetic Polynucleotide
taatacgactcactataggggagataggttgtctccacgtggctttcattaacagaggagaaatgaaatgcacgtggagaacctggcggcagcgcaaaagatg

SEQ ID NO: 194680 - DNA, 103 bp, Artificial Sequence
  Synthetic Polynucleotide
taatacgactcactatagggatggcagagggagataggttgtctccacgtaacagaggagaacgtggatgcaacctatcaacctggcggcagcgcaaaagatg

SEQ ID NO: 194681 - DNA, 103 bp, Artificial Sequence
  Synthetic Polynucleotide
taatacgactcactatagggtccgggtcttcgcctttctccccgccgcccaacagaggagagggcggatgggagaaaggaacctggcggcagcgcaaaagatg

SEQ ID NO: 194682 - DNA, 103 bp, Artificial Sequence
  Synthetic Polynucleotide
taatacgactcactatagggggttgactggatggcagagggagataggttaacagaggagaaacctaatgccctctgccaacctggcggcagcgcaaaagatg

SEQ ID NO: 194683 - DNA, 103 bp, Artificial Sequence
  Synthetic Polynucleotide
taatacgactcactatagggtaggcctccaggttgactggatggcagaggaacagaggagacctctgatgtccagtcaaaacctggcggcagcgcaaaagatg

SEQ ID NO: 194684 - DNA, 103 bp, Artificial Sequence
  Synthetic Polynucleotide
taatacgactcactataggggagcagggcctaggcctccaggttgactggaacagaggagaccagtcatgctggaggccaacctggcggcagcgcaaaagatg

SEQ ID NO: 194685 - DNA, 103 bp, Artificial Sequence
  Synthetic Polynucleotide
taatacgactcactatagggaactggtgcagagcagggcctaggcctccaaacagaggagatggaggatgaggccctgcaacctggcggcagcgcaaaagatg

SEQ ID NO: 194686 - DNA, 103 bp, Artificial Sequence
  Synthetic Polynucleotide
taatacgactcactatagggcccagcagggaactggtgcagagcagggccaacagaggagaggccctatgctgcaccagaacctggcggcagcgcaaaagatg

SEQ ID NO: 194687 - DNA, 103 bp, Artificial Sequence
  Synthetic Polynucleotide
taatacgactcactatagggtgtctgtgttcccagcagggaactggtgcaaacagaggagatgcaccatgtccctgctgaacctggcggcagcgcaaaagatg

SEQ ID NO: 194688 - DNA, 103 bp, Artificial Sequence
  Synthetic Polynucleotide
taatacgactcactatagggagcggcatgttgtctgtgttcccagcagggaacagaggagaccctgcatggaacacagaaacctggcggcagcgcaaaagatg

SEQ ID NO: 194689 - DNA, 103 bp, Artificial Sequence
  Synthetic Polynucleotide
taatacgactcactatagggttgacctgtgagcggcatgttgtctgtgttaacagaggagaaacacaatgaacatgccgaacctggcggcagcgcaaaagatg

SEQ ID NO: 194690 - DNA, 103 bp, Artificial Sequence
  Synthetic Polynucleotide
taatacgactcactatagggaaagctccatttgacctgtgagcggcatgtaacagaggagaacatgcatgtcacaggtcaacctggcggcagcgcaaaagatg

SEQ ID NO: 194691 - DNA, 103 bp, Artificial Sequence
  Synthetic Polynucleotide
taatacgactcactataggggcaatctgtgaaagctccatttgacctgtgaacagaggagacacaggatgaatggagctaacctggcggcagcgcaaaagatg

SEQ ID NO: 194692 - DNA, 103 bp, Artificial Sequence
  Synthetic Polynucleotide
taatacgactcactatagggccccggcagctccgggtcttcgcctttctcaacagaggagagagaaaatggaagacccgaacctggcggcagcgcaaaagatg

SEQ ID NO: 194693 - DNA, 103 bp, Artificial Sequence
  Synthetic Polynucleotide
taatacgactcactatagggcagatgaccagcaatctgtgaaagctccataacagaggagaatggagatgtcacagattaacctggcggcagcgcaaaagatg

SEQ ID NO: 194694 - DNA, 103 bp, Artificial Sequence
  Synthetic Polynucleotide
taatacgactcactataggggtggtgtcatcagatgaccagcaatctgtgaacagaggagacacagaatgctggtcatcaacctggcggcagcgcaaaagatg

SEQ ID NO: 194695 - DNA, 103 bp, Artificial Sequence
  Synthetic Polynucleotide
taatacgactcactatagggggagaaatgggtggtgtcatcagatgaccaaacagaggagatggtcaatggatgacaccaacctggcggcagcgcaaaagatg

SEQ ID NO: 194696 - DNA, 103 bp, Artificial Sequence
  Synthetic Polynucleotide
taatacgactcactatagggtgccatggctggagaaatgggtggtgtcataacagaggagaatgacaatgcccatttctaacctggcggcagcgcaaaagatg

SEQ ID NO: 194697 - DNA, 103 bp, Artificial Sequence
  Synthetic Polynucleotide
taatacgactcactatagggttcctcggcttgccatggctggagaaatggaacagaggagaccatttatgcagccatggaacctggcggcagcgcaaaagatg

SEQ ID NO: 194698 - DNA, 103 bp, Artificial Sequence
  Synthetic Polynucleotide
taatacgactcactatagggttaatgacacttcctcggcttgccatggctaacagaggagaagccatatgaagccgaggaacctggcggcagcgcaaaagatg

SEQ ID NO: 194699 - DNA, 103 bp, Artificial Sequence
  Synthetic Polynucleotide
taatacgactcactatagggtggtccttggttaatgacacttcctcggctaacagaggagaagccgaatgagtgtcattaacctggcggcagcgcaaaagatg

SEQ ID NO: 194700 - DNA, 103 bp, Artificial Sequence
  Synthetic Polynucleotide
taatacgactcactatagggtccctgccattggtccttggttaatgacacaacagaggagagtgtcaatgaccaaggacaacctggcggcagcgcaaaagatg

SEQ ID NO: 194701 - DNA, 103 bp, Artificial Sequence
  Synthetic Polynucleotide
taatacgactcactatagggcttgggggcctccctgccattggtccttggaacagaggagaccaaggatgaatggcaggaacctggcggcagcgcaaaagatg

SEQ ID NO: 194702 - DNA, 103 bp, Artificial Sequence
  Synthetic Polynucleotide
taatacgactcactatagggtgggcccacacttgggggcctccctgccataacagaggagaatggcaatgaggcccccaaacctggcggcagcgcaaaagatg

SEQ ID NO: 194703 - DNA, 103 bp, Artificial Sequence
  Synthetic Polynucleotide
taatacgactcactatagggcctgcaggaaggtgtcttccagctccgggaaacagaggagatcccggatgtggaagacaaacctggcggcagcgcaaaagatg

SEQ ID NO: 194704 - DNA, 103 bp, Artificial Sequence
  Synthetic Polynucleotide
taatacgactcactatagggatttcactgcccccggcagctccgggtcttaacagaggagaaagaccatgagctgccggaacctggcggcagcgcaaaagatg

SEQ ID NO: 194705 - DNA, 103 bp, Artificial Sequence
  Synthetic Polynucleotide
taatacgactcactatagggctgacagtactgggcccacacttgggggccaacagaggagaggccccatggtgtgggccaacctggcggcagcgcaaaagatg

SEQ ID NO: 194706 - DNA, 103 bp, Artificial Sequence
  Synthetic Polynucleotide
taatacgactcactatagggtgtgatggagctgacagtactgggcccacaaacagaggagatgtgggatgagtactgtcaacctggcggcagcgcaaaagatg

SEQ ID NO: 194707 - DNA, 103 bp, Artificial Sequence
  Synthetic Polynucleotide
taatacgactcactatagggtgtggagcagtgtgatggagctgacagtacaacagaggagagtactgatggctccatcaaacctggcggcagcgcaaaagatg

SEQ ID NO: 194708 - DNA, 103 bp, Artificial Sequence
  Synthetic Polynucleotide
taatacgactcactataggggctctgggtatgtggagcagtgtgatggagaacagaggagactccatatgactgctccaaacctggcggcagcgcaaaagatg

SEQ ID NO: 194709 - DNA, 103 bp, Artificial Sequence
  Synthetic Polynucleotide
taatacgactcactatagggggataaatgggctctgggtatgtggagcagaacagaggagactgctcatgatacccagaaacctggcggcagcgcaaaagatg

SEQ ID NO: 194710 - DNA, 103 bp, Artificial Sequence
  Synthetic Polynucleotide
taatacgactcactatagggagggagagtgggataaatgggctctgggtaaacagaggagatacccaatgcccatttataacctggcggcagcgcaaaagatg

SEQ ID NO: 194711 - DNA, 103 bp, Artificial Sequence
  Synthetic Polynucleotide
taatacgactcactataggggattggcttgagggagagtgggataaatggaacagaggagaccatttatgccactctccaacctggcggcagcgcaaaagatg

SEQ ID NO: 194712 - DNA, 103 bp, Artificial Sequence
  Synthetic Polynucleotide
taatacgactcactatagggtaaaagtcatgattggcttgagggagagtgaacagaggagacactctatgtcaagccaaaacctggcggcagcgcaaaagatg

SEQ ID NO: 194713 - DNA, 103 bp, Artificial Sequence
  Synthetic Polynucleotide
taatacgactcactataggggctggtgctataaaagtcatgattggcttgaacagaggagacaagccatgcatgactttaacctggcggcagcgcaaaagatg

SEQ ID NO: 194714 - DNA, 103 bp, Artificial Sequence
  Synthetic Polynucleotide
taatacgactcactatagggggtagttagagctggtgctataaaagtcataacagaggagaatgactatgatagcaccaaacctggcggcagcgcaaaagatg

SEQ ID NO: 194715 - DNA, 103 bp, Artificial Sequence
  Synthetic Polynucleotide
taatacgactcactatagggtgcatttctgatttcactgcccccggcagcaacagaggagagctgccatgggcagtgaaaacctggcggcagcgcaaaagatg

SEQ ID NO: 194716 - DNA, 103 bp, Artificial Sequence
  Synthetic Polynucleotide
taatacgactcactatagggaacacagtctggtagttagagctggtgctaaacagaggagatagcacatgctctaactaaacctggcggcagcgcaaaagatg

SEQ ID NO: 194717 - DNA, 103 bp, Artificial Sequence
  Synthetic Polynucleotide
taatacgactcactatagggctgtgccctaaacacagtctggtagttagaaacagaggagatctaacatgcagactgtgaacctggcggcagcgcaaaagatg

SEQ ID NO: 194718 - DNA, 103 bp, Artificial Sequence
  Synthetic Polynucleotide
taatacgactcactatagggtggagtggggctgtgccctaaacacagtctaacagaggagaagactgatgttagggcacaacctggcggcagcgcaaaagatg

SEQ ID NO: 194719 - DNA, 103 bp, Artificial Sequence
  Synthetic Polynucleotide
taatacgactcactatagggagtcctgatgtggagtggggctgtgccctaaacagaggagatagggcatggccccactcaacctggcggcagcgcaaaagatg

SEQ ID NO: 194720 - DNA, 103 bp, Artificial Sequence
  Synthetic Polynucleotide
taatacgactcactatagggatgaggatagagtcctgatgtggagtggggaacagaggagaccccacatgacatcaggaaacctggcggcagcgcaaaagatg

SEQ ID NO: 194721 - DNA, 103 bp, Artificial Sequence
  Synthetic Polynucleotide
taatacgactcactataggggctcggtgtgatgaggatagagtcctgatgaacagaggagacatcagatgtctatcctcaacctggcggcagcgcaaaagatg

SEQ ID NO: 194722 - DNA, 103 bp, Artificial Sequence
  Synthetic Polynucleotide
taatacgactcactatagggcatcgaccatgctcggtgtgatgaggatagaacagaggagactatccatgtcacaccgaaacctggcggcagcgcaaaagatg

SEQ ID NO: 194723 - DNA, 103 bp, Artificial Sequence
  Synthetic Polynucleotide
taatacgactcactatagggccaagccatgcatcgaccatgctcggtgtgaacagaggagacacaccatgcatggtcgaaacctggcggcagcgcaaaagatg

SEQ ID NO: 194724 - DNA, 103 bp, Artificial Sequence
  Synthetic Polynucleotide
taatacgactcactataggggctgttcagtccaagccatgcatcgaccataacagaggagaatggtcatggcatggcttaacctggcggcagcgcaaaagatg

SEQ ID NO: 194725 - DNA, 103 bp, Artificial Sequence
  Synthetic Polynucleotide
taatacgactcactatagggcttgaaagctgctgttcagtccaagccatgaacagaggagacatggcatggactgaacaaacctggcggcagcgcaaaagatg

SEQ ID NO: 194726 - DNA, 103 bp, Artificial Sequence
  Synthetic Polynucleotide
taatacgactcactatagggattgtttaagtgcatttctgatttcactgcaacagaggagagcagtgatgtcagaaatgaacctggcggcagcgcaaaagatg

SEQ ID NO: 194727 - DNA, 103 bp, Artificial Sequence
  Synthetic Polynucleotide
taatacgactcactataggggaagaagtctcttgaaagctgctgttcagtaacagaggagaactgaaatgcagctttcaaacctggcggcagcgcaaaagatg

SEQ ID NO: 194728 - DNA, 103 bp, Artificial Sequence
  Synthetic Polynucleotide
taatacgactcactatagggagctgccactgaagaagtctcttgaaagctaacagaggagaagctttatggagacttctaacctggcggcagcgcaaaagatg

SEQ ID NO: 194729 - DNA, 103 bp, Artificial Sequence
  Synthetic Polynucleotide
taatacgactcactataggggaccccgcacagctgccactgaagaagtctaacagaggagaagacttatgcagtggcagaacctggcggcagcgcaaaagatg

SEQ ID NO: 194730 - DNA, 103 bp, Artificial Sequence
  Synthetic Polynucleotide
taatacgactcactataggggttatatggagaccccgcacagctgccactaacagaggagaagtggcatgtgtgcggggaacctggcggcagcgcaaaagatg

SEQ ID NO: 194731 - DNA, 103 bp, Artificial Sequence
  Synthetic Polynucleotide
taatacgactcactataggggtggccgggagttatatggagaccccgcacaacagaggagagtgcggatgctccatataaacctggcggcagcgcaaaagatg

SEQ ID NO: 194732 - DNA, 103 bp, Artificial Sequence
  Synthetic Polynucleotide
taatacgactcactatagggtagctagacggtggccgggagttatatggaaacagaggagatccataatgctcccggccaacctggcggcagcgcaaaagatg

SEQ ID NO: 194733 - DNA, 103 bp, Artificial Sequence
  Synthetic Polynucleotide
taatacgactcactatagggggatgggccatagctagacggtggccgggaaacagaggagatcccggatgccgtctagcaacctggcggcagcgcaaaagatg

SEQ ID NO: 194734 - DNA, 103 bp, Artificial Sequence
  Synthetic Polynucleotide
taatacgactcactataggggggcttgcagggatgggccatagctagacgaacagaggagacgtctaatgatggcccataacctggcggcagcgcaaaagatg

SEQ ID NO: 194735 - DNA, 103 bp, Artificial Sequence
  Synthetic Polynucleotide
taatacgactcactatagggtgtgaatcctgggcttgcagggatgggccaaacagaggagatggcccatgcctgcaagcaacctggcggcagcgcaaaagatg

SEQ ID NO: 194736 - DNA, 103 bp, Artificial Sequence
  Synthetic Polynucleotide
taatacgactcactatagggctgcatattgtgtgaatcctgggcttgcagaacagaggagactgcaaatgcaggattcaaacctggcggcagcgcaaaagatg

SEQ ID NO: 194737 - DNA, 103 bp, Artificial Sequence
  Synthetic Polynucleotide
taatacgactcactatagggaaaagttaccattgtttaagtgcatttctgaacagaggagacagaaaatgacttaaacaaacctggcggcagcgcaaaagatg

SEQ ID NO: 194738 - DNA, 103 bp, Artificial Sequence
  Synthetic Polynucleotide
taatacgactcactatagggtatttaaaaactgcatattgtgtgaatcctaacagaggagaaggattatgacaatatgcaacctggcggcagcgcaaaagatg

SEQ ID NO: 194739 - DNA, 103 bp, Artificial Sequence
  Synthetic Polynucleotide
taatacgactcactatagggaagcttcctgtatttaaaaactgcatattgaacagaggagacaatatatggtttttaaaaacctggcggcagcgcaaaagatg

SEQ ID NO: 194740 - DNA, 103 bp, Artificial Sequence
  Synthetic Polynucleotide
taatacgactcactatagggcaagaaattgaagcttcctgtatttaaaaaaacagaggagatttttaatgacaggaagcaacctggcggcagcgcaaaagatg

SEQ ID NO: 194741 - DNA, 103 bp, Artificial Sequence
  Synthetic Polynucleotide
taatacgactcactatagggctgtgttgctcaagaaattgaagcttcctgaacagaggagacaggaaatgtcaatttctaacctggcggcagcgcaaaagatg

SEQ ID NO: 194742 - DNA, 103 bp, Artificial Sequence
  Synthetic Polynucleotide
taatacgactcactatagggctggcagctcctgtgttgctcaagaaattgaacagaggagacaatttatggagcaacacaacctggcggcagcgcaaaagatg

SEQ ID NO: 194743 - DNA, 103 bp, Artificial Sequence
  Synthetic Polynucleotide
taatacgactcactatagggtccttggcagctggcagctcctgtgttgctaacagaggagaagcaacatgggagctgccaacctggcggcagcgcaaaagatg

SEQ ID NO: 194744 - DNA, 103 bp, Artificial Sequence
  Synthetic Polynucleotide
taatacgactcactataggggcagtgttgctccttggcagctggcagctcaacagaggagagagctgatggctgccaagaacctggcggcagcgcaaaagatg

SEQ ID NO: 194745 - DNA, 103 bp, Artificial Sequence
  Synthetic Polynucleotide
taatacgactcactataggggaattaggaggcagtgttgctccttggcagaacagaggagactgccaatgagcaacactaacctggcggcagcgcaaaagatg

SEQ ID NO: 194746 - DNA, 103 bp, Artificial Sequence
  Synthetic Polynucleotide
taatacgactcactatagggtccatttggtgaattaggaggcagtgttgcaacagaggagagcaacaatgcctcctaataacctggcggcagcgcaaaagatg

SEQ ID NO: 194747 - DNA, 103 bp, Artificial Sequence
  Synthetic Polynucleotide
taatacgactcactatagggttccatagtatccatttggtgaattaggagaacagaggagactcctaatgcaccaaatgaacctggcggcagcgcaaaagatg

SEQ ID NO: 194748 - DNA, 103 bp, Artificial Sequence
  Synthetic Polynucleotide
taatacgactcactatagggtcttcagaggaaaagttaccattgtttaagaacagaggagacttaaaatgtggtaacttaacctggcggcagcgcaaaagatg

SEQ ID NO: 194749 - DNA, 103 bp, Artificial Sequence
  Synthetic Polynucleotide
taatacgactcactatagggtttatgttgcttccatagtatccatttggtaacagaggagaaccaaaatgatactatggaacctggcggcagcgcaaaagatg

SEQ ID NO: 194750 - DNA, 103 bp, Artificial Sequence
  Synthetic Polynucleotide
taatacgactcactatagggctctgggtagtttatgttgcttccatagtaaacagaggagatactatatgagcaacataaacctggcggcagcgcaaaagatg

SEQ ID NO: 194751 - DNA, 103 bp, Artificial Sequence
  Synthetic Polynucleotide
taatacgactcactataggggcctgtgagactctgggtagtttatgttgcaacagaggagagcaacaatgactacccagaacctggcggcagcgcaaaagatg

SEQ ID NO: 194752 - DNA, 103 bp, Artificial Sequence
  Synthetic Polynucleotide
taatacgactcactatagggattgatccgagcctgtgagactctgggtagaacagaggagactacccatggtctcacagaacctggcggcagcgcaaaagatg

SEQ ID NO: 194753 - DNA, 103 bp, Artificial Sequence
  Synthetic Polynucleotide
taatacgactcactatagggctgattcaccattgatccgagcctgtgagaaacagaggagatctcacatgctcggatcaaacctggcggcagcgcaaaagatg

SEQ ID NO: 194754 - DNA, 103 bp, Artificial Sequence
  Synthetic Polynucleotide
taatacgactcactatagggcagaaacgtgctgattcaccattgatccgaaacagaggagatcggatatgtggtgaatcaacctggcggcagcgcaaaagatg

SEQ ID NO: 194755 - DNA, 103 bp, Artificial Sequence
  Synthetic Polynucleotide
taatacgactcactatagggctgctgatgacagaaacgtgctgattcaccaacagaggagaggtgaaatggcacgtttcaacctggcggcagcgcaaaagatg

SEQ ID NO: 194756 - DNA, 103 bp, Artificial Sequence
  Synthetic Polynucleotide
taatacgactcactatagggtgaacgaatgctgctgatgacagaaacgtgaacagaggagacacgttatggtcatcagcaacctggcggcagcgcaaaagatg

SEQ ID NO: 194757 - DNA, 103 bp, Artificial Sequence
  Synthetic Polynucleotide
taatacgactcactatagggaggggggcagtgaacgaatgctgctgatgaaacagaggagatcatcaatggcattcgttaacctggcggcagcgcaaaagatg

SEQ ID NO: 194758 - DNA, 103 bp, Artificial Sequence
  Synthetic Polynucleotide
taatacgactcactatagggatgtcactgtaggggggcagtgaacgaatgaacagaggagacattcgatgactgcccccaacctggcggcagcgcaaaagatg

SEQ ID NO: 194759 - DNA, 103 bp, Artificial Sequence
  Synthetic Polynucleotide
taatacgactcactatagggggcgtcctcttcttcagaggaaaagttaccaacagaggagaggtaacatgtcctctgaaaacctggcggcagcgcaaaagatg

SEQ ID NO: 194760 - DNA, 103 bp, Artificial Sequence
  Synthetic Polynucleotide
taatacgactcactatagggtggatcgtggatgtcactgtaggggggcagaacagaggagactgcccatgtacagtgacaacctggcggcagcgcaaaagatg

SEQ ID NO: 194761 - DNA, 103 bp, Artificial Sequence
  Synthetic Polynucleotide
taatacgactcactatagggaaatgttaagtggatcgtggatgtcactgtaacagaggagaacagtgatgtccacgatcaacctggcggcagcgcaaaagatg

SEQ ID NO: 194762 - DNA, 103 bp, Artificial Sequence
  Synthetic Polynucleotide
taatacgactcactatagggctgtcatctaaaatgttaagtggatcgtggaacagaggagaccacgaatgacttaacataacctggcggcagcgcaaaagatg

SEQ ID NO: 194763 - DNA, 103 bp, Artificial Sequence
  Synthetic Polynucleotide
taatacgactcactatagggttttctaccactgtcatctaaaatgttaagaacagaggagacttaacatgttagatgacaacctggcggcagcgcaaaagatg

SEQ ID NO: 194764 - DNA, 103 bp, Artificial Sequence
  Synthetic Polynucleotide
taatacgactcactatagggagctggtctgttttctaccactgtcatctaaacagaggagatagatgatggtggtagaaaacctggcggcagcgcaaaagatg

SEQ ID NO: 194765 - DNA, 103 bp, Artificial Sequence
  Synthetic Polynucleotide
taatacgactcactataggggtgtaaaacgagctggtctgttttctaccaaacagaggagatggtagatgacagaccagaacctggcggcagcgcaaaagatg

SEQ ID NO: 194766 - DNA, 103 bp, Artificial Sequence
  Synthetic Polynucleotide
taatacgactcactatagggtgatgtgtctgtgtaaaacgagctggtctgaacagaggagacagaccatgtcgttttacaacctggcggcagcgcaaaagatg

SEQ ID NO: 194767 - DNA, 103 bp, Artificial Sequence
  Synthetic Polynucleotide
taatacgactcactatagggcaactggagatgatgtgtctgtgtaaaacgaacagaggagacgttttatgcagacacataacctggcggcagcgcaaaagatg

SEQ ID NO: 194768 - DNA, 103 bp, Artificial Sequence
  Synthetic Polynucleotide
taatacgactcactataggggttcgacatgcaactggagatgatgtgtctaacagaggagaagacacatgatctccagtaacctggcggcagcgcaaaagatg

SEQ ID NO: 194769 - DNA, 103 bp, Artificial Sequence
  Synthetic Polynucleotide
taatacgactcactatagggtaggactggagttcgacatgcaactggagaaacagaggagatctccaatggcatgtcgaaacctggcggcagcgcaaaagatg

SEQ ID NO: 194770 - DNA, 103 bp, Artificial Sequence
  Synthetic Polynucleotide
taatacgactcactatagggcgtggttgtcggcgtcctcttcttcagaggaacagaggagacctctgatgaagaggacgaacctggcggcagcgcaaaagatg

SEQ ID NO: 194771 - DNA, 103 bp, Artificial Sequence
  Synthetic Polynucleotide
taatacgactcactatagggaactggaagctaggactggagttcgacatgaacagaggagacatgtcatgctccagtccaacctggcggcagcgcaaaagatg

SEQ ID NO: 194772 - DNA, 103 bp, Artificial Sequence
  Synthetic Polynucleotide
taatacgactcactatagggggggtttgcaaactggaagctaggactggaaacagaggagatccagtatgagcttccagaacctggcggcagcgcaaaagatg

SEQ ID NO: 194773 - DNA, 103 bp, Artificial Sequence
  Synthetic Polynucleotide
taatacgactcactatagggagaaggaattggggtttgcaaactggaagcaacagaggagagcttccatgttgcaaaccaacctggcggcagcgcaaaagatg

SEQ ID NO: 194774 - DNA, 103 bp, Artificial Sequence
  Synthetic Polynucleotide
taatacgactcactataggggggatgaggaagaaggaattggggtttgcaaacagaggagatgcaaaatgcaattccttaacctggcggcagcgcaaaagatg

SEQ ID NO: 194775 - DNA, 103 bp, Artificial Sequence
  Synthetic Polynucleotide
taatacgactcactatagggtacatacattgggatgaggaagaaggaattaacagaggagaaattccatgttcctcatcaacctggcggcagcgcaaaagatg

SEQ ID NO: 194776 - DNA, 103 bp, Artificial Sequence
  Synthetic Polynucleotide
taatacgactcactatagggggaagttccatacatacattgggatgaggaaacagaggagatcctcaatgcaatgtatgaacctggcggcagcgcaaaagatg

SEQ ID NO: 194777 - DNA, 103 bp, Artificial Sequence
  Synthetic Polynucleotide
taatacgactcactataggggatactggttggaagttccatacatacattaacagaggagaaatgtaatgatggaacttaacctggcggcagcgcaaaagatg

SEQ ID NO: 194778 - DNA, 103 bp, Artificial Sequence
  Synthetic Polynucleotide
taatacgactcactatagggtcttgagctggatactggttggaagttccaaacagaggagatggaacatgcaaccagtaaacctggcggcagcgcaaaagatg

SEQ ID NO: 194779 - DNA, 103 bp, Artificial Sequence
  Synthetic Polynucleotide
taatacgactcactataggggtccagggtttcttgagctggatactggttaacagaggagaaaccagatgccagctcaaaacctggcggcagcgcaaaagatg

SEQ ID NO: 194780 - DNA, 103 bp, Artificial Sequence
  Synthetic Polynucleotide
taatacgactcactatagggttccatgggagtccagggtttcttgagctgaacagaggagacagctcatgaaaccctggaacctggcggcagcgcaaaagatg

SEQ ID NO: 194781 - DNA, 103 bp, Artificial Sequence
  Synthetic Polynucleotide
taatacgactcactataggggttttgctgtcgtggttgtcggcgtcctctaacagaggagaagaggaatgcgacaaccaaacctggcggcagcgcaaaagatg

SEQ ID NO: 194782 - DNA, 103 bp, Artificial Sequence
  Synthetic Polynucleotide
taatacgactcactatagggctactgcttgttccatgggagtccagggttaacagaggagaaaccctatgctcccatggaacctggcggcagcgcaaaagatg

SEQ ID NO: 194783 - DNA, 103 bp, Artificial Sequence
  Synthetic Polynucleotide
taatacgactcactatagggcaccatttctctactgcttgttccatgggaaacagaggagatcccatatgacaagcagtaacctggcggcagcgcaaaagatg

SEQ ID NO: 194784 - DNA, 103 bp, Artificial Sequence
  Synthetic Polynucleotide
taatacgactcactataggggtaaagaggacaccatttctctactgcttgaacagaggagacaagcaatggagaaatggaacctggcggcagcgcaaaagatg

SEQ ID NO: 194785 - DNA, 103 bp, Artificial Sequence
  Synthetic Polynucleotide
taatacgactcactatagggttgataggtggtaaagaggacaccatttctaacagaggagaagaaatatggtcctctttaacctggcggcagcgcaaaagatg

SEQ ID NO: 194786 - DNA, 103 bp, Artificial Sequence
  Synthetic Polynucleotide
taatacgactcactataggggaacacagtgttgataggtggtaaagaggaaacagaggagatcctctatgccacctatcaacctggcggcagcgcaaaagatg

SEQ ID NO: 194787 - DNA, 103 bp, Artificial Sequence
  Synthetic Polynucleotide
taatacgactcactatagggctgttcccatgaacacagtgttgataggtgaacagaggagacacctaatgacactgtgtaacctggcggcagcgcaaaagatg

SEQ ID NO: 194788 - DNA, 103 bp, Artificial Sequence
  Synthetic Polynucleotide
taatacgactcactatagggcctccagctgctgttcccatgaacacagtgaacagaggagacactgtatgcatgggaacaacctggcggcagcgcaaaagatg

SEQ ID NO: 194789 - DNA, 103 bp, Artificial Sequence
  Synthetic Polynucleotide
taatacgactcactatagggcgctgctttggttttgctgtcgtggttgtcaacagaggagagacaacatggacagcaaaaacctggcggcagcgcaaaagatg

SEQ ID NO: 194790 - DNA, 103 bp, Artificial Sequence
  Synthetic Polynucleotide
taatacgactcactatagggggtattgatccgctgctttggttttgctgtaacagaggagaacagcaatgccaaagcagaacctggcggcagcgcaaaagatg

SEQ ID NO: 194791 - DNA, 103 bp, Artificial Sequence
  Synthetic Polynucleotide
taatacgactcactataggggcaggctgcgcctgcaggaaggtgtcttccaacagaggagaggaagaatgcttcctgcaaacctggcggcagcgcaaaagatg

SEQ ID NO: 194792 - DNA, 103 bp, Artificial Sequence
  Synthetic Polynucleotide
taatacgactcactatagggttctgagacaggtattgatccgctgctttgaacagaggagacaaagcatgggatcaataaacctggcggcagcgcaaaagatg

SEQ ID NO: 194793 - DNA, 103 bp, Artificial Sequence
  Synthetic Polynucleotide
taatacgactcactataggggatggttttcttctgagacaggtattgatcaacagaggagagatcaaatgctgtctcagaacctggcggcagcgcaaaagatg

SEQ ID NO: 194794 - DNA, 103 bp, Artificial Sequence
  Synthetic Polynucleotide
taatacgactcactatagggcaatctgcgtgatggttttcttctgagacaaacagaggagatgtctcatgagaaaaccaaacctggcggcagcgcaaaagatg

SEQ ID NO: 194795 - DNA, 103 bp, Artificial Sequence
  Synthetic Polynucleotide
taatacgactcactatagggttatccttcacaatctgcgtgatggttttcaacagaggagagaaaacatgcacgcagataacctggcggcagcgcaaaagatg

SEQ ID NO: 194796 - DNA, 103 bp, Artificial Sequence
  Synthetic Polynucleotide
taatacgactcactatagggctgcttctttttatccttcacaatctgcgtaacagaggagaacgcagatggtgaaggataacctggcggcagcgcaaaagatg

SEQ ID NO: 194797 - DNA, 103 bp, Artificial Sequence
  Synthetic Polynucleotide
taatacgactcactatagggtgagctgtgtctgcttctttttatccttcaaacagaggagatgaaggatgaaaagaagcaacctggcggcagcgcaaaagatg

SEQ ID NO: 194798 - DNA, 103 bp, Artificial Sequence
  Synthetic Polynucleotide
taatacgactcactatagggcactgcagcgtgagctgtgtctgcttctttaacagaggagaaaagaaatggacacagctaacctggcggcagcgcaaaagatg

SEQ ID NO: 194799 - DNA, 103 bp, Artificial Sequence
  Synthetic Polynucleotide
taatacgactcactatagggctcttcaagccactgcagcgtgagctgtgtaacagaggagaacacagatgacgctgcagaacctggcggcagcgcaaaagatg

SEQ ID NO: 194800 - DNA, 103 bp, Artificial Sequence
  Synthetic Polynucleotide
taatacgactcactatagggcaatgtaattctcttcaagccactgcagcgaacagaggagacgctgcatgggcttgaagaacctggcggcagcgcaaaagatg

SEQ ID NO: 194801 - DNA, 103 bp, Artificial Sequence
  Synthetic Polynucleotide
taatacgactcactatagggccttcacatacaatgtaattctcttcaagcaacagaggagagcttgaatggaattacataacctggcggcagcgcaaaagatg

SEQ ID NO: 194802 - DNA, 103 bp, Artificial Sequence
  Synthetic Polynucleotide
taatacgactcactatagggcagttggggcgcaggctgcgcctgcaggaaaacagaggagattcctgatggcgcagcctaacctggcggcagcgcaaaagatg

SEQ ID NO: 194803 - DNA, 103 bp, Artificial Sequence
  Synthetic Polynucleotide
taatacgactcactatagggtaagcaaactccttcacatacaatgtaattaacagaggagaaattacatggtatgtgaaaacctggcggcagcgcaaaagatg

SEQ ID NO: 194804 - DNA, 103 bp, Artificial Sequence
  Synthetic Polynucleotide
taatacgactcactatagggtgcaccgtggtaagcaaactccttcacataaacagaggagatatgtgatggagtttgctaacctggcggcagcgcaaaagatg

SEQ ID NO: 194805 - DNA, 103 bp, Artificial Sequence
  Synthetic Polynucleotide
taatacgactcactataggggcataaagaatgcaccgtggtaagcaaactaacagaggagaagtttgatgaccacggtgaacctggcggcagcgcaaaagatg

SEQ ID NO: 194806 - DNA, 103 bp, Artificial Sequence
  Synthetic Polynucleotide
taatacgactcactatagggtaagtagtgtgcataaagaatgcaccgtggaacagaggagaccacggatgattctttataacctggcggcagcgcaaaagatg

SEQ ID NO: 194807 - DNA, 103 bp, Artificial Sequence
  Synthetic Polynucleotide
taatacgactcactatagggtacagaaatctaagtagtgtgcataaagaaaacagaggagattctttatgcacactactaacctggcggcagcgcaaaagatg

SEQ ID NO: 194808 - DNA, 103 bp, Artificial Sequence
  Synthetic Polynucleotide
taatacgactcactatagggttctctttcctacagaaatctaagtagtgtaacagaggagaacactaatgagatttctgaacctggcggcagcgcaaaagatg

SEQ ID NO: 194809 - DNA, 103 bp, Artificial Sequence
  Synthetic Polynucleotide
taatacgactcactatagggtggctctaatttctctttcctacagaaatcaacagaggagagatttcatgaggaaagagaacctggcggcagcgcaaaagatg

SEQ ID NO: 194810 - DNA, 103 bp, Artificial Sequence
  Synthetic Polynucleotide
taatacgactcactatagggccgcacaggctggctctaatttctctttccaacagaggagaggaaagatgaattagagcaacctggcggcagcgcaaaagatg

SEQ ID NO: 194811 - DNA, 103 bp, Artificial Sequence
  Synthetic Polynucleotide
taatacgactcactatagggccaaaggtggccgcacaggctggctctaataacagaggagaattagaatgagcctgtgcaacctggcggcagcgcaaaagatg

SEQ ID NO: 194812 - DNA, 103 bp, Artificial Sequence
  Synthetic Polynucleotide
taatacgactcactatagggaattgtctttccaaaggtggccgcacaggcaacagaggagagcctgtatggccacctttaacctggcggcagcgcaaaagatg

SEQ ID NO: 194813 - DNA, 103 bp, Artificial Sequence
  Synthetic Polynucleotide
taatacgactcactatagggtccccggggacagttggggcgcaggctgcgaacagaggagacgcagcatgcgccccaacaacctggcggcagcgcaaaagatg

SEQ ID NO: 194814 - DNA, 103 bp, Artificial Sequence
  Synthetic Polynucleotide
taatacgactcactatagggacttctggcgaattgtctttccaaaggtggaacagaggagaccacctatggaaagacaaaacctggcggcagcgcaaaagatg

SEQ ID NO: 194815 - DNA, 103 bp, Artificial Sequence
  Synthetic Polynucleotide
taatacgactcactatagggaggaggggaaacttctggcgaattgtctttaacagaggagaaaagacatgtcgccagaaaacctggcggcagcgcaaaagatg

SEQ ID NO: 194816 - DNA, 103 bp, Artificial Sequence
  Synthetic Polynucleotide
taatacgactcactatagggccttgttgttaggaggggaaacttctggcgaacagaggagacgccagatgtttcccctcaacctggcggcagcgcaaaagatg

SEQ ID NO: 194817 - DNA, 103 bp, Artificial Sequence
  Synthetic Polynucleotide
taatacgactcactatagggttccaagccgccttgttgttaggaggggaaaacagaggagattccccatgtaacaacaaaacctggcggcagcgcaaaagatg

SEQ ID NO: 194818 - DNA, 103 bp, Artificial Sequence
  Synthetic Polynucleotide
taatacgactcactatagggtggcctcttgttccaagccgccttgttgttaacagaggagaaacaacatggcggcttggaacctggcggcagcgcaaaagatg

SEQ ID NO: 194819 - DNA, 103 bp, Artificial Sequence
  Synthetic Polynucleotide
taatacgactcactatagggatactttgaatggcctcttgttccaagccgaacagaggagacggcttatgacaagaggcaacctggcggcagcgcaaaagatg

SEQ ID NO: 194820 - DNA, 103 bp, Artificial Sequence
  Synthetic Polynucleotide
taatacgactcactatagggcatagtaatgatactttgaatggcctcttgaacagaggagacaagagatgattcaaagtaacctggcggcagcgcaaaagatg

SEQ ID NO: 194821 - DNA, 103 bp, Artificial Sequence
  Synthetic Polynucleotide
taatacgactcactatagggatgccaatcccatagtaatgatactttgaaaacagaggagattcaaaatgtcattactaaacctggcggcagcgcaaaagatg

SEQ ID NO: 194822 - DNA, 103 bp, Artificial Sequence
  Synthetic Polynucleotide
taatacgactcactataggggctctctttgatgccaatcccatagtaatgaacagaggagacattacatggggattggcaacctggcggcagcgcaaaagatg

SEQ ID NO: 194823 - DNA, 103 bp, Artificial Sequence
  Synthetic Polynucleotide
taatacgactcactatagggaatatgcactgctctctttgatgccaatccaacagaggagaggattgatgtcaaagagaaacctggcggcagcgcaaaagatg

SEQ ID NO: 194824 - DNA, 103 bp, Artificial Sequence
  Synthetic Polynucleotide
taatacgactcactatagggtcttcctggatccccggggacagttggggcaacagaggagagccccaatggtccccgggaacctggcggcagcgcaaaagatg

SEQ ID NO: 194825 - DNA, 103 bp, Artificial Sequence
  Synthetic Polynucleotide
taatacgactcactatagggacggagtggtaatatgcactgctctctttgaacagaggagacaaagaatgcagtgcataaacctggcggcagcgcaaaagatg

SEQ ID NO: 194826 - DNA, 103 bp, Artificial Sequence
  Synthetic Polynucleotide
taatacgactcactatagggtccagaataaacggagtggtaatatgcactaacagaggagaagtgcaatgtaccactccaacctggcggcagcgcaaaagatg

SEQ ID NO: 194827 - DNA, 103 bp, Artificial Sequence
  Synthetic Polynucleotide
taatacgactcactatagggtcaagccctttccagaataaacggagtggtaacagaggagaaccactatgtttattctgaacctggcggcagcgcaaaagatg

SEQ ID NO: 194828 - DNA, 103 bp, Artificial Sequence
  Synthetic Polynucleotide
taatacgactcactataggggaaaaccttgtcaagccctttccagaataaaacagaggagattattcatgaaagggcttaacctggcggcagcgcaaaagatg

SEQ ID NO: 194829 - DNA, 103 bp, Artificial Sequence
  Synthetic Polynucleotide
taatacgactcactatagggcttgcttccagaaaaccttgtcaagcccttaacagaggagaaagggcatgacaaggtttaacctggcggcagcgcaaaagatg

SEQ ID NO: 194830 - DNA, 103 bp, Artificial Sequence
  Synthetic Polynucleotide
taatacgactcactatagggcattctttagcttgcttccagaaaaccttgaacagaggagacaaggtatgctggaagcaaacctggcggcagcgcaaaagatg

SEQ ID NO: 194831 - DNA, 103 bp, Artificial Sequence
  Synthetic Polynucleotide
taatacgactcactatagggaagccaccctcattctttagcttgcttccaaacagaggagatggaagatggctaaagaaaacctggcggcagcgcaaaagatg

SEQ ID NO: 194832 - DNA, 103 bp, Artificial Sequence
  Synthetic Polynucleotide
taatacgactcactatagggtttacgagtgaagccaccctcattctttagaacagaggagactaaagatggagggtggcaacctggcggcagcgcaaaagatg

SEQ ID NO: 194833 - DNA, 103 bp, Artificial Sequence
  Synthetic Polynucleotide
taatacgactcactatagggtaagcgaatatttacgagtgaagccaccctaacagaggagaagggtgatgtcactcgtaaacctggcggcagcgcaaaagatg

SEQ ID NO: 194834 - DNA, 103 bp, Artificial Sequence
  Synthetic Polynucleotide
taatacgactcactataggggtttttgagctaagcgaatatttacgagtgaacagaggagacactcgatgatattcgctaacctggcggcagcgcaaaagatg

SEQ ID NO: 194835 - DNA, 103 bp, Artificial Sequence
  Synthetic Polynucleotide
taatacgactcactatagggcacacagcagtcttcctggatccccggggaaacagaggagatccccgatgatccaggaaaacctggcggcagcgcaaaagatg

SEQ ID NO: 194836 - DNA, 103 bp, Artificial Sequence
  Synthetic Polynucleotide
taatacgactcactatagggaagtgttccagtttttgagctaagcgaataaacagaggagatattcgatgagctcaaaaaacctggcggcagcgcaaaagatg

SEQ ID NO: 194837 - DNA, 103 bp, Artificial Sequence
  Synthetic Polynucleotide
taatacgactcactatagggattctggaagaagtgttccagtttttgagcaacagaggagagctcaaatgctggaacacaacctggcggcagcgcaaaagatg

SEQ ID NO: 194838 - DNA, 103 bp, Artificial Sequence
  Synthetic Polynucleotide
taatacgactcactataggggcgctggggaattctggaagaagtgttccaaacagaggagatggaacatgtcttccagaaacctggcggcagcgcaaaagatg

SEQ ID NO: 194839 - DNA, 103 bp, Artificial Sequence
  Synthetic Polynucleotide
taatacgactcactatagggaaggtgttgagcgctggggaattctggaagaacagaggagacttccaatgttccccagcaacctggcggcagcgcaaaagatg

SEQ ID NO: 194840 - DNA, 103 bp, Artificial Sequence
  Synthetic Polynucleotide
taatacgactcactatagggcttggtatacaaggtgttgagcgctggggaaacagaggagatccccaatgctcaacaccaacctggcggcagcgcaaaagatg

SEQ ID NO: 194841 - DNA, 103 bp, Artificial Sequence
  Synthetic Polynucleotide
taatacgactcactataggggaaatgcatccttggtatacaaggtgttgaaacagaggagatcaacaatgtgtataccaaacctggcggcagcgcaaaagatg

SEQ ID NO: 194842 - DNA, 103 bp, Artificial Sequence
  Synthetic Polynucleotide
taatacgactcactatagggcttgtccttagaaatgcatccttggtatacaacagaggagagtatacatgggatgcattaacctggcggcagcgcaaaagatg

SEQ ID NO: 194843 - DNA, 103 bp, Artificial Sequence
  Synthetic Polynucleotide
taatacgactcactataggggcgtatcaaccttgtccttagaaatgcatcaacagaggagagatgcaatgctaaggacaaacctggcggcagcgcaaaagatg

SEQ ID NO: 194844 - DNA, 103 bp, Artificial Sequence
  Synthetic Polynucleotide
taatacgactcactatagggatcattatgagcgtatcaaccttgtccttaaacagaggagataaggaatgggttgatacaacctggcggcagcgcaaaagatg

SEQ ID NO: 194845 - DNA, 103 bp, Artificial Sequence
  Synthetic Polynucleotide
taatacgactcactatagggagttttgtacatcattatgagcgtatcaacaacagaggagagttgatatgctcataatgaacctggcggcagcgcaaaagatg

SEQ ID NO: 194846 - DNA, 103 bp, Artificial Sequence
  Synthetic Polynucleotide
taatacgactcactatagggccaggagctgcacacagcagtcttcctggaaacagaggagatccaggatgactgctgtgaacctggcggcagcgcaaaagatg

SEQ ID NO: 194847 - DNA, 103 bp, Artificial Sequence
  Synthetic Polynucleotide
taatacgactcactatagggactggcagtgagttttgtacatcattatgaaacagaggagatcataaatgtgtacaaaaaacctggcggcagcgcaaaagatg

SEQ ID NO: 194848 - DNA, 103 bp, Artificial Sequence
  Synthetic Polynucleotide
taatacgactcactatagggtccaggatacactggcagtgagttttgtacaacagaggagagtacaaatgtcactgccaaacctggcggcagcgcaaaagatg

SEQ ID NO: 194849 - DNA, 103 bp, Artificial Sequence
  Synthetic Polynucleotide
taatacgactcactatagggaattgcattgtccaggatacactggcagtgaacagaggagacactgcatgtgtatcctgaacctggcggcagcgcaaaagatg

SEQ ID NO: 194850 - DNA, 103 bp, Artificial Sequence
  Synthetic Polynucleotide
taatacgactcactatagggagtttccattaattgcattgtccaggatacaacagaggagagtatccatgacaatgcaaaacctggcggcagcgcaaaagatg

SEQ ID NO: 194851 - DNA, 103 bp, Artificial Sequence
  Synthetic Polynucleotide
taatacgactcactatagggatctcttcaaagtttccattaattgcattgaacagaggagacaatgcatgtaatggaaaaacctggcggcagcgcaaaagatg

SEQ ID NO: 194852 - DNA, 103 bp, Artificial Sequence
  Synthetic Polynucleotide
taatacgactcactatagggaaaatgctggatctcttcaaagtttccattaacagaggagaaatggaatgtttgaagagaacctggcggcagcgcaaaagatg

SEQ ID NO: 194853 - DNA, 103 bp, Artificial Sequence
  Synthetic Polynucleotide
taatacgactcactatagggagtgtaataaaaaatgctggatctcttcaaaacagaggagattgaagatgtccagcattaacctggcggcagcgcaaaagatg

SEQ ID NO: 194854 - DNA, 103 bp, Artificial Sequence
  Synthetic Polynucleotide
taatacgactcactatagggccttgccaaaagtgtaataaaaaatgctggaacagaggagaccagcaatgtttattacaaacctggcggcagcgcaaaagatg

SEQ ID NO: 194855 - DNA, 103 bp, Artificial Sequence
  Synthetic Polynucleotide
taatacgactcactataggggtcaggcattccttgccaaaagtgtaataaaacagaggagattattaatgttttggcaaaacctggcggcagcgcaaaagatg

SEQ ID NO: 194856 - DNA, 103 bp, Artificial Sequence
  Synthetic Polynucleotide
taatacgactcactataggggaaggagatggtcaggcattccttgccaaaaacagaggagatttggcatggaatgcctgaacctggcggcagcgcaaaagatg

SEQ ID NO: 194857 - DNA, 103 bp, Artificial Sequence
  Synthetic Polynucleotide
taatacgactcactatagggaagcccttgcccaggagctgcacacagcagaacagaggagactgctgatggcagctcctaacctggcggcagcgcaaaagatg

SEQ ID NO: 194858 - DNA, 103 bp, Artificial Sequence
  Synthetic Polynucleotide
taatacgactcactatagggtcgagcaggggaaggagatggtcaggcattaacagaggagaaatgccatgccatctcctaacctggcggcagcgcaaaagatg

SEQ ID NO: 194859 - DNA, 103 bp, Artificial Sequence
  Synthetic Polynucleotide
taatacgactcactatagggaacaggattttcgagcaggggaaggagatgaacagaggagacatctcatgcccctgctcaacctggcggcagcgcaaaagatg

SEQ ID NO: 194860 - DNA, 103 bp, Artificial Sequence
  Synthetic Polynucleotide
taatacgactcactatagggtatcaatgataacaggattttcgagcagggaacagaggagaccctgcatgaaaatcctgaacctggcggcagcgcaaaagatg

SEQ ID NO: 194861 - DNA, 103 bp, Artificial Sequence
  Synthetic Polynucleotide
taatacgactcactatagggacacagaaaatatcaatgataacaggatttaacagaggagaaaatccatgtatcattgaaacctggcggcagcgcaaaagatg

SEQ ID NO: 194862 - DNA, 103 bp, Artificial Sequence
  Synthetic Polynucleotide
taatacgactcactatagggtgagtcacaaacacagaaaatatcaatgataacagaggagaatcattatgattttctgtaacctggcggcagcgcaaaagatg

SEQ ID NO: 194863 - DNA, 103 bp, Artificial Sequence
  Synthetic Polynucleotide
taatacgactcactatagggtataaagaattgagtcacaaacacagaaaaaacagaggagattttctatgtttgtgactaacctggcggcagcgcaaaagatg

SEQ ID NO: 194864 - DNA, 103 bp, Artificial Sequence
  Synthetic Polynucleotide
taatacgactcactataggggtaagaaccttataaagaattgagtcacaaaacagaggagattgtgaatgaattctttaaacctggcggcagcgcaaaagatg

SEQ ID NO: 194865 - DNA, 103 bp, Artificial Sequence
  Synthetic Polynucleotide
taatacgactcactataggggagtacatctgtaagaaccttataaagaataacagaggagaattcttatgaaggttcttaacctggcggcagcgcaaaagatg

SEQ ID NO: 194866 - DNA, 103 bp, Artificial Sequence
  Synthetic Polynucleotide
taatacgactcactatagggttgcaggaatgagtacatctgtaagaacctaacagaggagaaggttcatgcagatgtacaacctggcggcagcgcaaaagatg

SEQ ID NO: 194867 - DNA, 103 bp, Artificial Sequence
  Synthetic Polynucleotide
taatacgactcactatagggtcttgcattgttgcaggaatgagtacatctaacagaggagaagatgtatgcattcctgcaacctggcggcagcgcaaaagatg

SEQ ID NO: 194868 - DNA, 103 bp, Artificial Sequence
  Synthetic Polynucleotide
taatacgactcactatagggatgcatttgttgtgcccgactagatgacataacagaggagaatgtcaatgagtcgggcaaacctggcggcagcgcaaaagatg

SEQ ID NO: 194869 - DNA, 103 bp, Artificial Sequence
  Synthetic Polynucleotide
taatacgactcactatagggacaatagctcttgtactcatcatagacttcaacagaggagagaagtcatggatgagtacaacctggcggcagcgcaaaagatg

SEQ ID NO: 194870 - DNA, 103 bp, Artificial Sequence
  Synthetic Polynucleotide
taatacgactcactatagggcgctggtttgggtaagatctgagggtaacgaacagaggagacgttacatgcagatcttaaacctggcggcagcgcaaaagatg

SEQ ID NO: 194871 - DNA, 103 bp, Artificial Sequence
  Synthetic Polynucleotide
taatacgactcactatagggcactggtgttcgctggtttgggtaagatctaacagaggagaagatctatgccaaaccagaacctggcggcagcgcaaaagatg

SEQ ID NO: 194872 - DNA, 103 bp, Artificial Sequence
  Synthetic Polynucleotide
taatacgactcactatagggatggtgagtgcactggtgttcgctggtttgaacagaggagacaaaccatggaacaccagaacctggcggcagcgcaaaagatg

SEQ ID NO: 194873 - DNA, 103 bp, Artificial Sequence
  Synthetic Polynucleotide
taatacgactcactatagggtggagagcgaatggtgagtgcactggtgttaacagaggagaaacaccatggcactcaccaacctggcggcagcgcaaaagatg

SEQ ID NO: 194874 - DNA, 103 bp, Artificial Sequence
  Synthetic Polynucleotide
taatacgactcactatagggggacagtagttggagagcgaatggtgagtgaacagaggagacactcaatgttcgctctcaacctggcggcagcgcaaaagatg

SEQ ID NO: 194875 - DNA, 103 bp, Artificial Sequence
  Synthetic Polynucleotide
taatacgactcactatagggctagtaaagaggacagtagttggagagcgaaacagaggagatcgctcatgaactactgtaacctggcggcagcgcaaaagatg

SEQ ID NO: 194876 - DNA, 103 bp, Artificial Sequence
  Synthetic Polynucleotide
taatacgactcactataggggatgggactactagtaaagaggacagtagtaacagaggagaactactatgctctttactaacctggcggcagcgcaaaagatg

SEQ ID NO: 194877 - DNA, 103 bp, Artificial Sequence
  Synthetic Polynucleotide
taatacgactcactatagggcagcagttttgatgggactactagtaaagaaacagaggagatctttaatggtagtcccaaacctggcggcagcgcaaaagatg

SEQ ID NO: 194878 - DNA, 103 bp, Artificial Sequence
  Synthetic Polynucleotide
taatacgactcactataggggcgggtacaacagcagttttgatgggactaaacagaggagatagtccatgcaaaactgcaacctggcggcagcgcaaaagatg

SEQ ID NO: 194879 - DNA, 103 bp, Artificial Sequence
  Synthetic Polynucleotide
taatacgactcactatagggcatgtgtgaagcgggtacaacagcagttttaacagaggagaaaaactatggttgtacccaacctggcggcagcgcaaaagatg

SEQ ID NO: 194880 - DNA, 103 bp, Artificial Sequence
  Synthetic Polynucleotide
taatacgactcactatagggcaagattgtcacaatagctcttgtactcataacagaggagaatgagtatgagagctattaacctggcggcagcgcaaaagatg

SEQ ID NO: 194881 - DNA, 103 bp, Artificial Sequence
  Synthetic Polynucleotide
taatacgactcactatagggttagagaactcatgtgtgaagcgggtacaaaacagaggagattgtacatgcttcacacaaacctggcggcagcgcaaaagatg

SEQ ID NO: 194882 - DNA, 103 bp, Artificial Sequence
  Synthetic Polynucleotide
taatacgactcactatagggttcaccacatttagagaactcatgtgtgaaaacagaggagattcacaatggagttctctaacctggcggcagcgcaaaagatg

SEQ ID NO: 194883 - DNA, 103 bp, Artificial Sequence
  Synthetic Polynucleotide
taatacgactcactatagggtgttgtcattttcaccacatttagagaactaacagaggagaagttctatgaatgtggtgaacctggcggcagcgcaaaagatg

SEQ ID NO: 194884 - DNA, 103 bp, Artificial Sequence
  Synthetic Polynucleotide
taatacgactcactatagggtgagggatattgttgtcattttcaccacataacagaggagaatgtggatgaaatgacaaaacctggcggcagcgcaaaagatg

SEQ ID NO: 194885 - DNA, 103 bp, Artificial Sequence
  Synthetic Polynucleotide
taatacgactcactatagggttgctgggtgtgagggatattgttgtcattaacagaggagaaatgacatgaatatccctaacctggcggcagcgcaaaagatg

SEQ ID NO: 194886 - DNA, 103 bp, Artificial Sequence
  Synthetic Polynucleotide
taatacgactcactatagggggtgttactgttgctgggtgtgagggatataacagaggagaatatccatgacacccagcaacctggcggcagcgcaaaagatg

SEQ ID NO: 194887 - DNA, 103 bp, Artificial Sequence
  Synthetic Polynucleotide
taatacgactcactataggggtttaagaggggtgttactgttgctgggtgaacagaggagacacccaatgacagtaacaaacctggcggcagcgcaaaagatg

SEQ ID NO: 194888 - DNA, 103 bp, Artificial Sequence
  Synthetic Polynucleotide
taatacgactcactataggggaggcagaatgtttaagaggggtgttactgaacagaggagacagtaaatgccctcttaaaacctggcggcagcgcaaaagatg

SEQ ID NO: 194889 - DNA, 103 bp, Artificial Sequence
  Synthetic Polynucleotide
taatacgactcactatagggactgctgactgaggcagaatgtttaagaggaacagaggagacctcttatgcattctgccaacctggcggcagcgcaaaagatg

SEQ ID NO: 194890 - DNA, 103 bp, Artificial Sequence
  Synthetic Polynucleotide
taatacgactcactatagggttcctgtagcactgctgactgaggcagaataacagaggagaattctgatgcagtcagcaaacctggcggcagcgcaaaagatg

SEQ ID NO: 194891 - DNA, 103 bp, Artificial Sequence
  Synthetic Polynucleotide
taatacgactcactatagggggatggtaaccaagattgtcacaatagctcaacagaggagagagctaatgtgacaatctaacctggcggcagcgcaaaagatg

SEQ ID NO: 194892 - DNA, 103 bp, Artificial Sequence
  Synthetic Polynucleotide
taatacgactcactatagggtcttctgttgttcctgtagcactgctgactaacagaggagaagtcagatgtgctacaggaacctggcggcagcgcaaaagatg

SEQ ID NO: 194893 - DNA, 103 bp, Artificial Sequence
  Synthetic Polynucleotide
taatacgactcactatagggactccttgattcttctgttgttcctgtagcaacagaggagagctacaatgacaacagaaaacctggcggcagcgcaaaagatg

SEQ ID NO: 194894 - DNA, 103 bp, Artificial Sequence
  Synthetic Polynucleotide
taatacgactcactatagggtctgtggaacactccttgattcttctgttgaacagaggagacaacagatgaatcaaggaaacctggcggcagcgcaaaagatg

SEQ ID NO: 194895 - DNA, 103 bp, Artificial Sequence
  Synthetic Polynucleotide
taatacgactcactatagggccattcttgatctgtggaacactccttgataacagaggagaatcaagatgtgttccacaaacctggcggcagcgcaaaagatg

SEQ ID NO: 194896 - DNA, 103 bp, Artificial Sequence
  Synthetic Polynucleotide
taatacgactcactatagggcacgacagaaccattcttgatctgtggaacaacagaggagagttccaatgatcaagaataacctggcggcagcgcaaaagatg

SEQ ID NO: 194897 - DNA, 103 bp, Artificial Sequence
  Synthetic Polynucleotide
taatacgactcactatagggactgaagcgacacgacagaaccattcttgaaacagaggagatcaagaatggttctgtcgaacctggcggcagcgcaaaagatg

SEQ ID NO: 194898 - DNA, 103 bp, Artificial Sequence
  Synthetic Polynucleotide
taatacgactcactataggggacccaggagactgaagcgacacgacagaaaacagaggagattctgtatggtcgcttcaaacctggcggcagcgcaaaagatg

SEQ ID NO: 194899 - DNA, 103 bp, Artificial Sequence
  Synthetic Polynucleotide
taatacgactcactataggggctgctcctggacccaggagactgaagcgaaacagaggagatcgcttatgtctcctgggaacctggcggcagcgcaaaagatg

SEQ ID NO: 194900 - DNA, 103 bp, Artificial Sequence
  Synthetic Polynucleotide
taatacgactcactatagggcccccgcactgctgctcctggacccaggagaacagaggagactcctgatgccaggagcaaacctggcggcagcgcaaaagatg

SEQ ID NO: 194901 - DNA, 103 bp, Artificial Sequence
  Synthetic Polynucleotide
taatacgactcactataggggcagatgttccccccgcactgctgctcctgaacagaggagacaggagatgcagtgcgggaacctggcggcagcgcaaaagatg

SEQ ID NO: 194902 - DNA, 103 bp, Artificial Sequence
  Synthetic Polynucleotide
taatacgactcactatagggagcacttaatggatggtaaccaagattgtcaacagaggagagacaatatgggttaccataacctggcggcagcgcaaaagatg

SEQ ID NO: 194903 - DNA, 103 bp, Artificial Sequence
  Synthetic Polynucleotide
taatacgactcactataggggacttccacagcagatgttccccccgcactaacagaggagaagtgcgatgggaacatctaacctggcggcagcgcaaaagatg

SEQ ID NO: 194904 - DNA, 103 bp, Artificial Sequence
  Synthetic Polynucleotide
taatacgactcactataggggttccactttgacttccacagcagatgttcaacagaggagagaacatatgctgtggaagaacctggcggcagcgcaaaagatg

SEQ ID NO: 194905 - DNA, 103 bp, Artificial Sequence
  Synthetic Polynucleotide
taatacgactcactataggggatgtttcgggttccactttgacttccacaaacagaggagatgtggaatgcaaagtggaaacctggcggcagcgcaaaagatg

SEQ ID NO: 194906 - DNA, 103 bp, Artificial Sequence
  Synthetic Polynucleotide
taatacgactcactatagggctcatctgatgatgtttcgggttccactttaacagaggagaaaagtgatgcccgaaacaaacctggcggcagcgcaaaagatg

SEQ ID NO: 194907 - DNA, 103 bp, Artificial Sequence
  Synthetic Polynucleotide
taatacgactcactataggggtacaggatgctcatctgatgatgtttcggaacagaggagaccgaaaatgcatcagatgaacctggcggcagcgcaaaagatg

SEQ ID NO: 194908 - DNA, 103 bp, Artificial Sequence
  Synthetic Polynucleotide
taatacgactcactatagggtcttggcactgtacaggatgctcatctgataacagaggagaatcagaatggcatcctgtaacctggcggcagcgcaaaagatg

SEQ ID NO: 194909 - DNA, 103 bp, Artificial Sequence
  Synthetic Polynucleotide
taatacgactcactatagggatcagagttctcttggcactgtacaggatgaacagaggagacatcctatgcagtgccaaaacctggcggcagcgcaaaagatg

SEQ ID NO: 194910 - DNA, 103 bp, Artificial Sequence
  Synthetic Polynucleotide
taatacgactcactatagggctttagcctcatcagagttctcttggcactaacagaggagaagtgccatgagaactctgaacctggcggcagcgcaaaagatg

SEQ ID NO: 194911 - DNA, 103 bp, Artificial Sequence
  Synthetic Polynucleotide
taatacgactcactataggggtctggggagctttagcctcatcagagttcaacagaggagagaactcatgtgaggctaaaacctggcggcagcgcaaaagatg

SEQ ID NO: 194912 - DNA, 103 bp, Artificial Sequence
  Synthetic Polynucleotide
taatacgactcactatagggggcactaggtgtctggggagctttagcctcaacagaggagagaggctatggctccccagaacctggcggcagcgcaaaagatg

SEQ ID NO: 194913 - DNA, 103 bp, Artificial Sequence
  Synthetic Polynucleotide
taatacgactcactatagggcaaaatcagcagcacttaatggatggtaacaacagaggagagttaccatgcattaagtgaacctggcggcagcgcaaaagatg

SEQ ID NO: 194914 - DNA, 103 bp, Artificial Sequence
  Synthetic Polynucleotide
taatacgactcactataggggccccaaaagggcactaggtgtctggggagaacagaggagactccccatgcacctagtgaacctggcggcagcgcaaaagatg

SEQ ID NO: 194915 - DNA, 103 bp, Artificial Sequence
  Synthetic Polynucleotide
taatacgactcactatagggttacttttctgccccaaaagggcactaggtaacagaggagaacctagatgccttttgggaacctggcggcagcgcaaaagatg

SEQ ID NO: 194916 - DNA, 103 bp, Artificial Sequence
  Synthetic Polynucleotide
taatacgactcactatagggtccgtctgtattacttttctgccccaaaagaacagaggagacttttgatgcagaaaagtaacctggcggcagcgcaaaagatg

SEQ ID NO: 194917 - DNA, 103 bp, Artificial Sequence
  Synthetic Polynucleotide
taatacgactcactatagggtctgcagtgctccgtctgtattacttttctaacagaggagaagaaaaatgatacagacgaacctggcggcagcgcaaaagatg

SEQ ID NO: 194918 - DNA, 103 bp, Artificial Sequence
  Synthetic Polynucleotide
taatacgactcactatagggtttgaaggtttctgcagtgctccgtctgtaaacagaggagatacagaatgagcactgcaaacctggcggcagcgcaaaagatg

SEQ ID NO: 194919 - DNA, 103 bp, Artificial Sequence
  Synthetic Polynucleotide
taatacgactcactataggggacaccttcatttgaaggtttctgcagtgcaacagaggagagcactgatgaaaccttcaaacctggcggcagcgcaaaagatg

SEQ ID NO: 194920 - DNA, 103 bp, Artificial Sequence
  Synthetic Polynucleotide
taatacgactcactatagggttatttcaatgacaccttcatttgaaggttaacagaggagaaaccttatgatgaaggtgaacctggcggcagcgcaaaagatg

SEQ ID NO: 194921 - DNA, 103 bp, Artificial Sequence
  Synthetic Polynucleotide
taatacgactcactatagggttagttgcttttatttcaatgacaccttcaaacagaggagatgaaggatgcattgaaataacctggcggcagcgcaaaagatg

SEQ ID NO: 194922 - DNA, 103 bp, Artificial Sequence
  Synthetic Polynucleotide
taatacgactcactataggggtcacagaccttagttgcttttatttcaataacagaggagaattgaaatgaaagcaactaacctggcggcagcgcaaaagatg

SEQ ID NO: 194923 - DNA, 103 bp, Artificial Sequence
  Synthetic Polynucleotide
taatacgactcactatagggtggtcctctggtcacagaccttagttgcttaacagaggagaaagcaaatgaggtctgtgaacctggcggcagcgcaaaagatg

SEQ ID NO: 194924 - DNA, 103 bp, Artificial Sequence
  Synthetic Polynucleotide
taatacgactcactatagggatgatctttccaaaatcagcagcacttaataacagaggagaattaagatgtgctgatttaacctggcggcagcgcaaaagatg

SEQ ID NO: 194925 - DNA, 103 bp, Artificial Sequence
  Synthetic Polynucleotide
taatacgactcactatagggcttttacatttggtcctctggtcacagaccaacagaggagaggtctgatgccagaggacaacctggcggcagcgcaaaagatg

SEQ ID NO: 194926 - DNA, 103 bp, Artificial Sequence
  Synthetic Polynucleotide
taatacgactcactatagggattacagcgacttttacatttggtcctctgaacagaggagacagaggatgaaatgtaaaaacctggcggcagcgcaaaagatg

SEQ ID NO: 194927 - DNA, 103 bp, Artificial Sequence
  Synthetic Polynucleotide
taatacgactcactataggggcagcatttcattacagcgacttttacattaacagaggagaaatgtaatggtcgctgtaaacctggcggcagcgcaaaagatg

SEQ ID NO: 194928 - DNA, 103 bp, Artificial Sequence
  Synthetic Polynucleotide
taatacgactcactataggggacgtgcctggcagcatttcattacagcgaaacagaggagatcgctgatgtgaaatgctaacctggcggcagcgcaaaagatg

SEQ ID NO: 194929 - DNA, 103 bp, Artificial Sequence
  Synthetic Polynucleotide
taatacgactcactatagggattgcctgttgacgtgcctggcagcatttcaacagaggagagaaatgatgccaggcacgaacctggcggcagcgcaaaagatg

SEQ ID NO: 194930 - DNA, 103 bp, Artificial Sequence
  Synthetic Polynucleotide
taatacgactcactatagggtgctttgattattgcctgttgacgtgcctgaacagaggagacaggcaatgcaacaggcaaacctggcggcagcgcaaaagatg

SEQ ID NO: 194931 - DNA, 103 bp, Artificial Sequence
  Synthetic Polynucleotide
taatacgactcactatagggagagtgatagtgctttgattattgcctgttaacagaggagaaacaggatgtaatcaaagaacctggcggcagcgcaaaagatg

SEQ ID NO: 194932 - DNA, 103 bp, Artificial Sequence
  Synthetic Polynucleotide
taatacgactcactatagggagcaactgatagagtgatagtgctttgattaacagaggagaaatcaaatgactatcactaacctggcggcagcgcaaaagatg

SEQ ID NO: 194933 - DNA, 103 bp, Artificial Sequence
  Synthetic Polynucleotide
taatacgactcactatagggagttctgagaagcaactgatagagtgatagaacagaggagactatcaatgtatcagttgaacctggcggcagcgcaaaagatg

SEQ ID NO: 194934 - DNA, 103 bp, Artificial Sequence
  Synthetic Polynucleotide
taatacgactcactataggggtgaaagttaagttctgagaagcaactgataacagaggagaatcagtatgttctcagaaaacctggcggcagcgcaaaagatg

SEQ ID NO: 194935 - DNA, 103 bp, Artificial Sequence
  Synthetic Polynucleotide
taatacgactcactataggggacgtttttcatgatctttccaaaatcagcaacagaggagagctgatatgggaaagatcaacctggcggcagcgcaaaagatg

SEQ ID NO: 194936 - DNA, 103 bp, Artificial Sequence
  Synthetic Polynucleotide
taatacgactcactataggggctgctgctggtgaaagttaagttctgagaaacagaggagatctcagatgttaactttcaacctggcggcagcgcaaaagatg

SEQ ID NO: 194937 - DNA, 103 bp, Artificial Sequence
  Synthetic Polynucleotide
taatacgactcactatagggtaggtggtgagctgctgctggtgaaagttaaacagaggagataacttatgccagcagcaaacctggcggcagcgcaaaagatg

SEQ ID NO: 194938 - DNA, 103 bp, Artificial Sequence
  Synthetic Polynucleotide
taatacgactcactataggggagtcaccattaggtggtgagctgctgctgaacagaggagacagcagatgctcaccaccaacctggcggcagcgcaaaagatg

SEQ ID NO: 194939 - DNA, 103 bp, Artificial Sequence
  Synthetic Polynucleotide
taatacgactcactatagggtttattgattgagtcaccattaggtggtgaaacagaggagatcaccaatgaatggtgacaacctggcggcagcgcaaaagatg

SEQ ID NO: 194940 - DNA, 103 bp, Artificial Sequence
  Synthetic Polynucleotide
taatacgactcactatagggatttagggtctttattgattgagtcaccataacagaggagaatggtgatgcaatcaataaacctggcggcagcgcaaaagatg

SEQ ID NO: 194941 - DNA, 103 bp, Artificial Sequence
  Synthetic Polynucleotide
taatacgactcactatagggttagtgcataatttagggtctttattgattaacagaggagaaatcaaatgagaccctaaaacctggcggcagcgcaaaagatg

SEQ ID NO: 194942 - DNA, 103 bp, Artificial Sequence
  Synthetic Polynucleotide
taatacgactcactatagggtcttgggcttttagtgcataatttagggtcaacagaggagagaccctatgttatgcactaacctggcggcagcgcaaaagatg

SEQ ID NO: 194943 - DNA, 103 bp, Artificial Sequence
  Synthetic Polynucleotide
taatacgactcactatagggacagtcgttttcttgggcttttagtgcataaacagaggagatatgcaatgaaagcccaaaacctggcggcagcgcaaaagatg

SEQ ID NO: 194944 - DNA, 103 bp, Artificial Sequence
  Synthetic Polynucleotide
taatacgactcactatagggaatgtagaagacagtcgttttcttgggcttaacagaggagaaagcccatgaaaacgactaacctggcggcagcgcaaaagatg

SEQ ID NO: 194945 - DNA, 103 bp, Artificial Sequence
  Synthetic Polynucleotide
taatacgactcactatagggggtctcctgcaatgtagaagacagtcgtttaacagaggagaaaacgaatgtcttctacaaacctggcggcagcgcaaaagatg

SEQ ID NO: 194946 - DNA, 103 bp, Artificial Sequence
  Synthetic Polynucleotide
taatacgactcactatagggtgtttggaaagacgtttttcatgatctttcaacagaggagagaaagaatgtgaaaaacgaacctggcggcagcgcaaaagatg

SEQ ID NO: 194947 - DNA, 103 bp, Artificial Sequence
  Synthetic Polynucleotide
taatacgactcactataggggaggcacctgggtctcctgcaatgtagaagaacagaggagacttctaatgtgcaggagaaacctggcggcagcgcaaaagatg

SEQ ID NO: 194948 - DNA, 103 bp, Artificial Sequence
  Synthetic Polynucleotide
taatacgactcactatagggttctttacaggaggcacctgggtctcctgcaacagaggagagcaggaatgccaggtgccaacctggcggcagcgcaaaagatg

SEQ ID NO: 194949 - DNA, 103 bp, Artificial Sequence
  Synthetic Polynucleotide
taatacgactcactatagggcacaattggtttctttacaggaggcacctgaacagaggagacaggtgatgcctgtaaagaacctggcggcagcgcaaaagatg

SEQ ID NO: 194950 - DNA, 103 bp, Artificial Sequence
  Synthetic Polynucleotide
taatacgactcactatagggaaagctgttccacaattggtttctttacagaacagaggagactgtaaatgaaccaattgaacctggcggcagcgcaaaagatg

SEQ ID NO: 194951 - DNA, 103 bp, Artificial Sequence
  Synthetic Polynucleotide
taatacgactcactataggggtagctgctgaaagctgttccacaattggtaacagaggagaaccaatatgggaacagctaacctggcggcagcgcaaaagatg

SEQ ID NO: 194952 - DNA, 103 bp, Artificial Sequence
  Synthetic Polynucleotide
taatacgactcactatagggcccttctatggtagctgctgaaagctgttcaacagaggagagaacagatgtcagcagctaacctggcggcagcgcaaaagatg

SEQ ID NO: 194953 - DNA, 103 bp, Artificial Sequence
  Synthetic Polynucleotide
taatacgactcactatagggcttgtttctgcccttctatggtagctgctgaacagaggagacagcagatgccatagaagaacctggcggcagcgcaaaagatg

SEQ ID NO: 194954 - DNA, 103 bp, Artificial Sequence
  Synthetic Polynucleotide
taatacgactcactatagggttaacactgccttgtttctgcccttctatgaacagaggagacatagaatggcagaaacaaacctggcggcagcgcaaaagatg

SEQ ID NO: 194955 - DNA, 103 bp, Artificial Sequence
  Synthetic Polynucleotide
taatacgactcactatagggttggtccttcttaacactgccttgtttctgaacagaggagacagaaaatgggcagtgttaacctggcggcagcgcaaaagatg

SEQ ID NO: 194956 - DNA, 103 bp, Artificial Sequence
  Synthetic Polynucleotide
taatacgactcactataggggtggaaccttttggtccttcttaacactgcaacagaggagagcagtgatgagaaggaccaacctggcggcagcgcaaaagatg

SEQ ID NO: 194957 - DNA, 103 bp, Artificial Sequence
  Synthetic Polynucleotide
taatacgactcactatagggcgtgccttcatgtttggaaagacgtttttcaacagaggagagaaaaaatgctttccaaaaacctggcggcagcgcaaaagatg

SEQ ID NO: 194958 - DNA, 103 bp, Artificial Sequence
  Synthetic Polynucleotide
taatacgactcactatagggttccctgaatgtggaaccttttggtccttcaacagaggagagaaggaatgaaaggttccaacctggcggcagcgcaaaagatg

SEQ ID NO: 194959 - DNA, 103 bp, Artificial Sequence
  Synthetic Polynucleotide
taatacgactcactatagggaccttctgttttccctgaatgtggaaccttaacagaggagaaaggttatgcattcagggaacctggcggcagcgcaaaagatg

SEQ ID NO: 194960 - DNA, 103 bp, Artificial Sequence
  Synthetic Polynucleotide
taatacgactcactatagggctgctgttgaaccttctgttttccctgaataacagaggagaattcagatgaaacagaagaacctggcggcagcgcaaaagatg

SEQ ID NO: 194961 - DNA, 103 bp, Artificial Sequence
  Synthetic Polynucleotide
taatacgactcactatagggatctgagcacctgctgttgaaccttctgttaacagaggagaaacagaatgttcaacagcaacctggcggcagcgcaaaagatg

SEQ ID NO: 194962 - DNA, 103 bp, Artificial Sequence
  Synthetic Polynucleotide
taatacgactcactatagggcttgctaggaatctgagcacctgctgttgaaacagaggagatcaacaatgggtgctcagaacctggcggcagcgcaaaagatg

SEQ ID NO: 194963 - DNA, 103 bp, Artificial Sequence
  Synthetic Polynucleotide
taatacgactcactatagggttactgataccttgctaggaatctgagcacaacagaggagagtgctcatgttcctagcaaacctggcggcagcgcaaaagatg

SEQ ID NO: 194964 - DNA, 103 bp, Artificial Sequence
  Synthetic Polynucleotide
taatacgactcactataggggaactgacatttactgataccttgctaggaaacagaggagatcctagatgggtatcagtaacctggcggcagcgcaaaagatg

SEQ ID NO: 194965 - DNA, 103 bp, Artificial Sequence
  Synthetic Polynucleotide
taatacgactcactatagggtcctatgtgtgaactgacatttactgatacaacagaggagagtatcaatgaatgtcagtaacctggcggcagcgcaaaagatg

SEQ ID NO: 194966 - DNA, 103 bp, Artificial Sequence
  Synthetic Polynucleotide
taatacgactcactataggggttgatttgctcctatgtgtgaactgacataacagaggagaatgtcaatgcacacatagaacctggcggcagcgcaaaagatg

SEQ ID NO: 194967 - DNA, 103 bp, Artificial Sequence
  Synthetic Polynucleotide
taatacgactcactataggggaattcaagggttgatttgctcctatgtgtaacagaggagaacacatatgagcaaatcaaacctggcggcagcgcaaaagatg

SEQ ID NO: 194968 - DNA, 103 bp, Artificial Sequence
  Synthetic Polynucleotide
taatacgactcactataggggcccaaacgacgtgccttcatgtttggaaaaacagaggagatttccaatgatgaaggcaaacctggcggcagcgcaaaagatg

SEQ ID NO: 194969 - DNA, 103 bp, Artificial Sequence
  Synthetic Polynucleotide
taatacgactcactatagggaagggcagaggaattcaagggttgatttgcaacagaggagagcaaatatgcccttgaataacctggcggcagcgcaaaagatg

SEQ ID NO: 194970 - DNA, 103 bp, Artificial Sequence
  Synthetic Polynucleotide
taatacgactcactatagggcactgataacaagggcagaggaattcaaggaacagaggagaccttgaatgcctctgcccaacctggcggcagcgcaaaagatg

SEQ ID NO: 194971 - DNA, 103 bp, Artificial Sequence
  Synthetic Polynucleotide
taatacgactcactatagggaaagctgaatcactgataacaagggcagagaacagaggagactctgcatgtgttatcagaacctggcggcagcgcaaaagatg

SEQ ID NO: 194972 - DNA, 103 bp, Artificial Sequence
  Synthetic Polynucleotide
taatacgactcactatagggttgctgttccaaagctgaatcactgataacaacagaggagagttatcatggattcagctaacctggcggcagcgcaaaagatg

SEQ ID NO: 194973 - DNA, 103 bp, Artificial Sequence
  Synthetic Polynucleotide
taatacgactcactatagggatggggttgtttgctgttccaaagctgaataacagaggagaattcagatgtggaacagcaacctggcggcagcgcaaaagatg

SEQ ID NO: 194974 - DNA, 103 bp, Artificial Sequence
  Synthetic Polynucleotide
taatacgactcactatagggggagatgatgatggggttgtttgctgttccaacagaggagaggaacaatgaacaaccccaacctggcggcagcgcaaaagatg

SEQ ID NO: 194975 - DNA, 103 bp, Artificial Sequence
  Synthetic Polynucleotide
taatacgactcactatagggttttatatctggagatgatgatggggttgtaacagaggagaacaaccatgtcatcatctaacctggcggcagcgcaaaagatg

SEQ ID NO: 194976 - DNA, 103 bp, Artificial Sequence
  Synthetic Polynucleotide
taatacgactcactatagggcaagttttacttttatatctggagatgatgaacagaggagacatcatatgcagatataaaacctggcggcagcgcaaaagatg

SEQ ID NO: 194977 - DNA, 103 bp, Artificial Sequence
  Synthetic Polynucleotide
taatacgactcactatagggacacttccttcaagttttacttttatatctaacagaggagaagatatatgagtaaaactaacctggcggcagcgcaaaagatg

SEQ ID NO: 194978 - DNA, 103 bp, Artificial Sequence
  Synthetic Polynucleotide
taatacgactcactatagggcaagagaaagacacttccttcaagttttacaacagaggagagtaaaaatggaaggaagtaacctggcggcagcgcaaaagatg

SEQ ID NO: 194979 - DNA, 103 bp, Artificial Sequence
  Synthetic Polynucleotide
taatacgactcactatagggaggaaaaggcatgcatttgttgtgcccgacaacagaggagagtcgggatgaacaaatgcaacctggcggcagcgcaaaagatg

SEQ ID NO: 194980 - DNA, 103 bp, Artificial Sequence
  Synthetic Polynucleotide
taatacgactcactatagggtgcctcttgtgcccaaacgacgtgccttcaaacagaggagatgaaggatggtcgtttggaacctggcggcagcgcaaaagatg

SEQ ID NO: 194981 - DNA, 103 bp, Artificial Sequence
  Synthetic Polynucleotide
taatacgactcactatagggaatcactgtccaagagaaagacacttccttaacagaggagaaaggaaatgtctttctctaacctggcggcagcgcaaaagatg

SEQ ID NO: 194982 - DNA, 103 bp, Artificial Sequence
  Synthetic Polynucleotide
taatacgactcactatagggactgactttgaatcactgtccaagagaaagaacagaggagactttctatgggacagtgaaacctggcggcagcgcaaaagatg

SEQ ID NO: 194983 - DNA, 103 bp, Artificial Sequence
  Synthetic Polynucleotide
taatacgactcactatagggaaagctgccaactgactttgaatcactgtcaacagaggagagacagtatgtcaaagtcaaacctggcggcagcgcaaaagatg

SEQ ID NO: 194984 - DNA, 103 bp, Artificial Sequence
  Synthetic Polynucleotide
taatacgactcactatagggcatttggattaaagctgccaactgactttgaacagaggagacaaagtatgttggcagctaacctggcggcagcgcaaaagatg

SEQ ID NO: 194985 - DNA, 103 bp, Artificial Sequence
  Synthetic Polynucleotide
taatacgactcactatagggtgttgccatccatttggattaaagctgccaaacagaggagatggcagatgtaatccaaaaacctggcggcagcgcaaaagatg

SEQ ID NO: 194986 - DNA, 103 bp, Artificial Sequence
  Synthetic Polynucleotide
taatacgactcactatagggtttagtgatttgttgccatccatttggattaacagaggagaaatccaatgggatggcaaaacctggcggcagcgcaaaagatg

SEQ ID NO: 194987 - DNA, 103 bp, Artificial Sequence
  Synthetic Polynucleotide
taatacgactcactatagggactcagaatctttagtgatttgttgccatcaacagaggagagatggcatgaaatcactaaacctggcggcagcgcaaaagatg

SEQ ID NO: 194988 - DNA, 103 bp, Artificial Sequence
  Synthetic Polynucleotide
taatacgactcactataggggcagatataaactcagaatctttagtgattaacagaggagaaatcacatgagattctgaaacctggcggcagcgcaaaagatg

SEQ ID NO: 194989 - DNA, 103 bp, Artificial Sequence
  Synthetic Polynucleotide
taatacgactcactatagggttcacaactggcagatataaactcagaatcaacagaggagagattctatgtttatatctaacctggcggcagcgcaaaagatg

SEQ ID NO: 194990 - DNA, 103 bp, Artificial Sequence
  Synthetic Polynucleotide
taatacgactcactatagggcttgctgttgttcacaactggcagatataaaacagaggagattatatatgccagttgtgaacctggcggcagcgcaaaagatg

SEQ ID NO: 194991 - DNA, 103 bp, Artificial Sequence
  Synthetic Polynucleotide
taatacgactcactatagggtatttagatttgcctcttgtgcccaaacgaaacagaggagatcgtttatgcacaagaggaacctggcggcagcgcaaaagatg

SEQ ID NO: 194992 - DNA, 103 bp, Artificial Sequence
  Synthetic Polynucleotide
taatacgactcactatagggacactgatatcttgctgttgttcacaactgaacagaggagacagttgatgacaacagcaaacctggcggcagcgcaaaagatg

SEQ ID NO: 194993 - DNA, 103 bp, Artificial Sequence
  Synthetic Polynucleotide
taatacgactcactatagggaattgtcataacactgatatcttgctgttgaacagaggagacaacagatggatatcagtaacctggcggcagcgcaaaagatg

SEQ ID NO: 194994 - DNA, 103 bp, Artificial Sequence
  Synthetic Polynucleotide
taatacgactcactatagggagtgctcaggaattgtcataacactgatataacagaggagaatatcaatgttatgacaaaacctggcggcagcgcaaaagatg

SEQ ID NO: 194995 - DNA, 103 bp, Artificial Sequence
  Synthetic Polynucleotide
taatacgactcactatagggttgatatcagagtgctcaggaattgtcataaacagaggagatatgacatgtcctgagcaaacctggcggcagcgcaaaagatg

SEQ ID NO: 194996 - DNA, 103 bp, Artificial Sequence
  Synthetic Polynucleotide
taatacgactcactatagggctctaagtcattgatatcagagtgctcaggaacagaggagacctgagatgtctgatatcaacctggcggcagcgcaaaagatg

SEQ ID NO: 194997 - DNA, 103 bp, Artificial Sequence
  Synthetic Polynucleotide
taatacgactcactatagggaaacagatttctctaagtcattgatatcagaacagaggagactgataatgatgacttagaacctggcggcagcgcaaaagatg

SEQ ID NO: 194998 - DNA, 103 bp, Artificial Sequence
  Synthetic Polynucleotide
taatacgactcactatagggtctaattcccaaacagatttctctaagtcaaacagaggagatgacttatggaaatctgtaacctggcggcagcgcaaaagatg

SEQ ID NO: 194999 - DNA, 103 bp, Artificial Sequence
  Synthetic Polynucleotide
taatacgactcactatagggtggcattccttctaattcccaaacagatttaacagaggagaaaatctatgtgggaattaaacctggcggcagcgcaaaagatg

SEQ ID NO: 195000 - DNA, 103 bp, Artificial Sequence
  Synthetic Polynucleotide
taatacgactcactatagggatgtgtcctgtggcattccttctaattcccaacagaggagagggaatatgaaggaatgcaacctggcggcagcgcaaaagatg

SEQ ID NO: 195001 - DNA, 103 bp, Artificial Sequence
  Synthetic Polynucleotide
taatacgactcactatagggtgctggctatatgtgtcctgtggcattcctaacagaggagaaggaatatgacaggacacaacctggcggcagcgcaaaagatg

SEQ ID NO: 195002 - DNA, 103 bp, Artificial Sequence
  Synthetic Polynucleotide
taatacgactcactatagggactgtagcaatatttagatttgcctcttgtaacagaggagaacaagaatgaaatctaaaaacctggcggcagcgcaaaagatg

SEQ ID NO: 195003 - DNA, 103 bp, Artificial Sequence
  Synthetic Polynucleotide
taatacgactcactataggggctatgtagctgctggctatatgtgtcctgaacagaggagacaggacatgtatagccagaacctggcggcagcgcaaaagatg

SEQ ID NO: 195004 - DNA, 103 bp, Artificial Sequence
  Synthetic Polynucleotide
taatacgactcactatagggcctgtatctggctatgtagctgctggctataacagaggagaatagccatgagctacataaacctggcggcagcgcaaaagatg

SEQ ID NO: 195005 - DNA, 103 bp, Artificial Sequence
  Synthetic Polynucleotide
taatacgactcactatagggaaagaagattcctgtatctggctatgtagcaacagaggagagctacaatgccagatacaaacctggcggcagcgcaaaagatg

SEQ ID NO: 195006 - DNA, 103 bp, Artificial Sequence
  Synthetic Polynucleotide
taatacgactcactatagggtatttgatttaaagaagattcctgtatctgaacagaggagacagataatggaatcttctaacctggcggcagcgcaaaagatg

SEQ ID NO: 195007 - DNA, 103 bp, Artificial Sequence
  Synthetic Polynucleotide
taatacgactcactatagggaatgtgcttgtatttgatttaaagaagattaacagaggagaaatcttatgtaaatcaaaaacctggcggcagcgcaaaagatg

SEQ ID NO: 195008 - DNA, 103 bp, Artificial Sequence
  Synthetic Polynucleotide
taatacgactcactatagggtgatctgaagaatgtgcttgtatttgatttaacagaggagaaaatcaatgacaagcacaaacctggcggcagcgcaaaagatg

SEQ ID NO: 195009 - DNA, 103 bp, Artificial Sequence
  Synthetic Polynucleotide
taatacgactcactatagggcagaggtaactgatctgaagaatgtgcttgaacagaggagacaagcaatgtcttcagataacctggcggcagcgcaaaagatg

SEQ ID NO: 195010 - DNA, 103 bp, Artificial Sequence
  Synthetic Polynucleotide
taatacgactcactataggggttcagattgcagaggtaactgatctgaagaacagaggagacttcagatgagttacctcaacctggcggcagcgcaaaagatg

SEQ ID NO: 195011 - DNA, 103 bp, Artificial Sequence
  Synthetic Polynucleotide
taatacgactcactatagggaactccttcagttcagattgcagaggtaacaacagaggagagttaccatggcaatctgaaacctggcggcagcgcaaaagatg

SEQ ID NO: 195012 - DNA, 103 bp, Artificial Sequence
  Synthetic Polynucleotide
taatacgactcactatagggagaaggctcaaactccttcagttcagattgaacagaggagacaatctatgctgaaggagaacctggcggcagcgcaaaagatg

SEQ ID NO: 195013 - DNA, 103 bp, Artificial Sequence
  Synthetic Polynucleotide
taatacgactcactatagggttcttagtccactgtagcaatatttagattaacagaggagaaatctaatgattgctacaaacctggcggcagcgcaaaagatg

SEQ ID NO: 195014 - DNA, 103 bp, Artificial Sequence
  Synthetic Polynucleotide
taatacgactcactatagggtctgggaaacagaaggctcaaactccttcaaacagaggagatgaaggatgttgagccttaacctggcggcagcgcaaaagatg

SEQ ID NO: 195015 - DNA, 103 bp, Artificial Sequence
  Synthetic Polynucleotide
taatacgactcactatagggctttcatttgtctgggaaacagaaggctcaaacagaggagatgagccatgtgtttcccaaacctggcggcagcgcaaaagatg

SEQ ID NO: 195016 - DNA, 103 bp, Artificial Sequence
  Synthetic Polynucleotide
taatacgactcactatagggaggaaagtagctttcatttgtctgggaaacaacagaggagagtttccatgacaaatgaaaacctggcggcagcgcaaaagatg

SEQ ID NO: 195017 - DNA, 103 bp, Artificial Sequence
  Synthetic Polynucleotide
taatacgactcactatagggcatcatcaaaaggaaagtagctttcatttgaacagaggagacaaatgatggctactttcaacctggcggcagcgcaaaagatg

SEQ ID NO: 195018 - DNA, 103 bp, Artificial Sequence
  Synthetic Polynucleotide
taatacgactcactatagggtgtgtaagttcatcatcaaaaggaaagtagaacagaggagactacttatgttttgatgaaacctggcggcagcgcaaaagatg

SEQ ID NO: 195019 - DNA, 103 bp, Artificial Sequence
  Synthetic Polynucleotide
taatacgactcactatagggaatactatcttgtgtaagttcatcatcaaaaacagaggagatttgatatggaacttacaaacctggcggcagcgcaaaagatg

SEQ ID NO: 195020 - DNA, 103 bp, Artificial Sequence
  Synthetic Polynucleotide
taatacgactcactataggggctcttccacaatactatcttgtgtaagttaacagaggagaaacttaatgaagatagtaaacctggcggcagcgcaaaagatg

SEQ ID NO: 195021 - DNA, 103 bp, Artificial Sequence
  Synthetic Polynucleotide
taatacgactcactatagggataagcaccagctcttccacaatactatctaacagaggagaagatagatgtgtggaagaaacctggcggcagcgcaaaagatg

SEQ ID NO: 195022 - DNA, 103 bp, Artificial Sequence
  Synthetic Polynucleotide
taatacgactcactatagggttgctgctccataagcaccagctcttccacaacagaggagagtggaaatgctggtgcttaacctggcggcagcgcaaaagatg

SEQ ID NO: 195023 - DNA, 103 bp, Artificial Sequence
  Synthetic Polynucleotide
taatacgactcactatagggtcattgacatttgctgctccataagcaccaaacagaggagatggtgcatgtggagcagcaacctggcggcagcgcaaaagatg

SEQ ID NO: 195024 - DNA, 103 bp, Artificial Sequence
  Synthetic Polynucleotide
taatacgactcactatagggaaagctttttttcttagtccactgtagcaaaacagaggagattgctaatgtggactaagaacctggcggcagcgcaaaagatg

SEQ ID NO: 195025 - DNA, 103 bp, Artificial Sequence
  Synthetic Polynucleotide
taatacgactcactatagggtgagaattgttcattgacatttgctgctccaacagaggagaggagcaatgaatgtcaataacctggcggcagcgcaaaagatg

SEQ ID NO: 195026 - DNA, 103 bp, Artificial Sequence
  Synthetic Polynucleotide
taatacgactcactataggggccgtaagaatgagaattgttcattgacataacagaggagaatgtcaatgaacaattctaacctggcggcagcgcaaaagatg

SEQ ID NO: 195027 - DNA, 103 bp, Artificial Sequence
  Synthetic Polynucleotide
taatacgactcactatagggccaaacagttgccgtaagaatgagaattgtaacagaggagaacaattatgattcttacgaacctggcggcagcgcaaaagatg

SEQ ID NO: 195028 - DNA, 103 bp, Artificial Sequence
  Synthetic Polynucleotide
taatacgactcactatagggagggtcattcccaaacagttgccgtaagaaaacagaggagattcttaatgcaactgtttaacctggcggcagcgcaaaagatg

SEQ ID NO: 195029 - DNA, 103 bp, Artificial Sequence
  Synthetic Polynucleotide
taatacgactcactatagggctgactctgaagggtcattcccaaacagttaacagaggagaaactgtatgggaatgaccaacctggcggcagcgcaaaagatg

SEQ ID NO: 195030 - DNA, 103 bp, Artificial Sequence
  Synthetic Polynucleotide
taatacgactcactataggggagttactgactgactctgaagggtcattcaacagaggagagaatgaatgttcagagtcaacctggcggcagcgcaaaagatg

SEQ ID NO: 195031 - DNA, 103 bp, Artificial Sequence
  Synthetic Polynucleotide
taatacgactcactatagggggagctcctggagttactgactgactctgaaacagaggagatcagagatggtcagtaacaacctggcggcagcgcaaaagatg

SEQ ID NO: 195032 - DNA, 103 bp, Artificial Sequence
  Synthetic Polynucleotide
taatacgactcactatagggagatgacattggagctcctggagttactgaaacagaggagatcagtaatgccaggagctaacctggcggcagcgcaaaagatg

SEQ ID NO: 195033 - DNA, 103 bp, Artificial Sequence
  Synthetic Polynucleotide
taatacgactcactatagggtggaagtgtgagatgacattggagctcctgaacagaggagacaggagatgcaatgtcataacctggcggcagcgcaaaagatg

SEQ ID NO: 195034 - DNA, 103 bp, Artificial Sequence
  Synthetic Polynucleotide
taatacgactcactatagggaagtgggtgctggaagtgtgagatgacattaacagaggagaaatgtcatgtcacacttcaacctggcggcagcgcaaaagatg

SEQ ID NO: 195035 - DNA, 103 bp, Artificial Sequence
  Synthetic Polynucleotide
taatacgactcactatagggcatatgaacaaaagctttttttcttagtccaacagaggagaggactaatgaaaaaagctaacctggcggcagcgcaaaagatg

SEQ ID NO: 195036 - DNA, 103 bp, Artificial Sequence
  Synthetic Polynucleotide
taatacgactcactatagggtggatgatagaagtgggtgctggaagtgtgaacagaggagacacactatgagcacccacaacctggcggcagcgcaaaagatg

SEQ ID NO: 195037 - DNA, 103 bp, Artificial Sequence
  Synthetic Polynucleotide
taatacgactcactatagggtgctgtggattggatgatagaagtgggtgcaacagaggagagcacccatgtctatcatcaacctggcggcagcgcaaaagatg

SEQ ID NO: 195038 - DNA, 103 bp, Artificial Sequence
  Synthetic Polynucleotide
taatacgactcactatagggggagtgccattgctgtggattggatgatagaacagaggagactatcaatgaatccacagaacctggcggcagcgcaaaagatg

SEQ ID NO: 195039 - DNA, 103 bp, Artificial Sequence
  Synthetic Polynucleotide
taatacgactcactatagggtgtgtggattggagtgccattgctgtggataacagaggagaatccacatgaatggcactaacctggcggcagcgcaaaagatg

SEQ ID NO: 195040 - DNA, 103 bp, Artificial Sequence
  Synthetic Polynucleotide
taatacgactcactatagggtgggtgtgggtgtgtggattggagtgccataacagaggagaatggcaatgcaatccacaaacctggcggcagcgcaaaagatg

SEQ ID NO: 195041 - DNA, 103 bp, Artificial Sequence
  Synthetic Polynucleotide
taatacgactcactatagggggtgtgggtgtgggtgtgggtgtgtggattaacagaggagaaatccaatgacccacaccaacctggcggcagcgcaaaagatg

SEQ ID NO: 195042 - DNA, 103 bp, Artificial Sequence
  Synthetic Polynucleotide
taatacgactcactatagggagtaggagtgggtgtgggtgtgggtgtgggaacagaggagacccacaatgacacccacaaacctggcggcagcgcaaaagatg

SEQ ID NO: 195043 - DNA, 103 bp, Artificial Sequence
  Synthetic Polynucleotide
taatacgactcactatagggttggggttggagtaggagtgggtgtgggtgaacagaggagacacccaatgccactcctaaacctggcggcagcgcaaaagatg

SEQ ID NO: 195044 - DNA, 103 bp, Artificial Sequence
  Synthetic Polynucleotide
taatacgactcactatagggggggttggggttggggttggagtaggagtgaacagaggagacactccatgtccaaccccaacctggcggcagcgcaaaagatg

SEQ ID NO: 195045 - DNA, 103 bp, Artificial Sequence
  Synthetic Polynucleotide
taatacgactcactatagggttcagatgtcggggttggggttggggttggaacagaggagaccaaccatgaccccaaccaacctggcggcagcgcaaaagatg

SEQ ID NO: 195046 - DNA, 103 bp, Artificial Sequence
  Synthetic Polynucleotide
taatacgactcactataggggcagtgttggcatatgaacaaaagctttttaacagaggagaaaaaagatgttgttcataaacctggcggcagcgcaaaagatg

SEQ ID NO: 195047 - DNA, 103 bp, Artificial Sequence
  Synthetic Polynucleotide
taatacgactcactatagggcagcaatcatttcagatgtcggggttggggaacagaggagaccccaaatgcgacatctgaacctggcggcagcgcaaaagatg

SEQ ID NO: 195048 - DNA, 103 bp, Artificial Sequence
  Synthetic Polynucleotide
taatacgactcactatagggctctgagatccagcaatcatttcagatgtcaacagaggagagacatcatgaatgattgcaacctggcggcagcgcaaaagatg

SEQ ID NO: 195049 - DNA, 103 bp, Artificial Sequence
  Synthetic Polynucleotide
taatacgactcactatagggccgtgacagactctgagatccagcaatcataacagaggagaatgattatgggatctcagaacctggcggcagcgcaaaagatg

SEQ ID NO: 195050 - DNA, 103 bp, Artificial Sequence
  Synthetic Polynucleotide
taatacgactcactatagggaagggctctcccgtgacagactctgagatcaacagaggagagatctcatggtctgtcacaacctggcggcagcgcaaaagatg

SEQ ID NO: 195051 - DNA, 103 bp, Artificial Sequence
  Synthetic Polynucleotide
taatacgactcactatagggagcctggagcaagggctctcccgtgacagaaacagaggagatctgtcatgggagagcccaacctggcggcagcgcaaaagatg

SEQ ID NO: 195052 - DNA, 103 bp, Artificial Sequence
  Synthetic Polynucleotide
taatacgactcactatagggagtctgggctagcctggagcaagggctctcaacagaggagagagagcatgtgctccaggaacctggcggcagcgcaaaagatg

SEQ ID NO: 195053 - DNA, 103 bp, Artificial Sequence
  Synthetic Polynucleotide
taatacgactcactatagggccacaggtgtagtctgggctagcctggagcaacagaggagagctccaatgtagcccagaaacctggcggcagcgcaaaagatg

SEQ ID NO: 195054 - DNA, 103 bp, Artificial Sequence
  Synthetic Polynucleotide
taatacgactcactatagggaaagcactatccacaggtgtagtctgggctaacagaggagaagcccaatgtacacctgtaacctggcggcagcgcaaaagatg

SEQ ID NO: 195055 - DNA, 103 bp, Artificial Sequence
  Synthetic Polynucleotide
taatacgactcactataggggctacttcctaaagcactatccacaggtgtaacagaggagaacacctatggatagtgctaacctggcggcagcgcaaaagatg

SEQ ID NO: 195056 - DNA, 103 bp, Artificial Sequence
  Synthetic Polynucleotide
taatacgactcactataggggtgtatgtcggctacttcctaaagcactataacagaggagaatagtgatgtaggaagtaaacctggcggcagcgcaaaagatg

SEQ ID NO: 195057 - DNA, 103 bp, Artificial Sequence
  Synthetic Polynucleotide
taatacgactcactatagggtcaaggttgggcagtgttggcatatgaacaaacagaggagatgttcaatggccaacactaacctggcggcagcgcaaaagatg

SEQ ID NO: 195058 - DNA, 103 bp, Artificial Sequence
  Synthetic Polynucleotide
taatacgactcactataggggtaccaatgggtgtatgtcggctacttcctaacagaggagaaggaagatgccgacatacaacctggcggcagcgcaaaagatg

SEQ ID NO: 195059 - DNA, 103 bp, Artificial Sequence
  Synthetic Polynucleotide
taatacgactcactatagggagaatgtggagtaccaatgggtgtatgtcgaacagaggagacgacatatgcccattggtaacctggcggcagcgcaaaagatg

SEQ ID NO: 195060 - DNA, 103 bp, Artificial Sequence
  Synthetic Polynucleotide
taatacgactcactatagggtgctgcagttagaatgtggagtaccaatggaacagaggagaccattgatgctccacattaacctggcggcagcgcaaaagatg

SEQ ID NO: 195061 - DNA, 103 bp, Artificial Sequence
  Synthetic Polynucleotide
taatacgactcactataggggggacactactgctgcagttagaatgtggaaacagaggagatccacaatgtaactgcagaacctggcggcagcgcaaaagatg

SEQ ID NO: 195062 - DNA, 103 bp, Artificial Sequence
  Synthetic Polynucleotide
taatacgactcactatagggagggctgggggggacactactgctgcagttaacagaggagaaactgcatgagtagtgtcaacctggcggcagcgcaaaagatg

SEQ ID NO: 195063 - DNA, 103 bp, Artificial Sequence
  Synthetic Polynucleotide
taatacgactcactatagggtgcattcaacagggctgggggggacactacaacagaggagagtagtgatgcccccagccaacctggcggcagcgcaaaagatg

SEQ ID NO: 195064 - DNA, 103 bp, Artificial Sequence
  Synthetic Polynucleotide
taatacgactcactatagggaacggattcctgcattcaacagggctggggaacagaggagaccccagatgtgttgaatgaacctggcggcagcgcaaaagatg

SEQ ID NO: 195065 - DNA, 103 bp, Artificial Sequence
  Synthetic Polynucleotide
taatacgactcactatagggagtgaatgcaaacggattcctgcattcaacaacagaggagagttgaaatgaggaatccgaacctggcggcagcgcaaaagatg

SEQ ID NO: 195066 - DNA, 103 bp, Artificial Sequence
  Synthetic Polynucleotide
taatacgactcactatagggagcttattggagtgaatgcaaacggattccaacagaggagaggaatcatgttgcattcaaacctggcggcagcgcaaaagatg

SEQ ID NO: 195067 - DNA, 103 bp, Artificial Sequence
  Synthetic Polynucleotide
taatacgactcactataggggccatactggagcttattggagtgaatgcaaacagaggagatgcattatgtccaataagaacctggcggcagcgcaaaagatg

SEQ ID NO: 195068 - DNA, 103 bp, Artificial Sequence
  Synthetic Polynucleotide
taatacgactcactatagggtttgtgaaagtcaaggttgggcagtgttggaacagaggagaccaacaatgcccaaccttaacctggcggcagcgcaaaagatg

SEQ ID NO: 195069 - DNA, 103 bp, Artificial Sequence
  Synthetic Polynucleotide
taatacgactcactataggggtcatgatatgccatactggagcttattggaacagaggagaccaataatgtccagtatgaacctggcggcagcgcaaaagatg

SEQ ID NO: 195070 - DNA, 103 bp, Artificial Sequence
  Synthetic Polynucleotide
taatacgactcactatagggcaatgctggcgtcatgatatgccatactggaacagaggagaccagtaatgcatatcatgaacctggcggcagcgcaaaagatg

SEQ ID NO: 195071 - DNA, 103 bp, Artificial Sequence
  Synthetic Polynucleotide
taatacgactcactatagggctacttgagacaatgctggcgtcatgatataacagaggagaatatcaatgcgccagcataacctggcggcagcgcaaaagatg

SEQ ID NO: 195072 - DNA, 103 bp, Artificial Sequence
  Synthetic Polynucleotide
taatacgactcactatagggtttcacaggactacttgagacaatgctggcaacagaggagagccagcatggtctcaagtaacctggcggcagcgcaaaagatg

SEQ ID NO: 195073 - DNA, 103 bp, Artificial Sequence
  Synthetic Polynucleotide
taatacgactcactatagggtttgcatcggtttcacaggactacttgagaaacagaggagatctcaaatggtcctgtgaaacctggcggcagcgcaaaagatg

SEQ ID NO: 195074 - DNA, 103 bp, Artificial Sequence
  Synthetic Polynucleotide
taatacgactcactataggggccatgggtctttgcatcggtttcacaggaaacagaggagatcctgtatgaccgatgcaaacctggcggcagcgcaaaagatg

SEQ ID NO: 195075 - DNA, 103 bp, Artificial Sequence
  Synthetic Polynucleotide
taatacgactcactatagggagggtgtgtggccatgggtctttgcatcggaacagaggagaccgatgatgagacccatgaacctggcggcagcgcaaaagatg

SEQ ID NO: 195076 - DNA, 103 bp, Artificial Sequence
  Synthetic Polynucleotide
taatacgactcactatagggtggttttgtcagggtgtgtggccatgggtcaacagaggagagacccaatgccacacaccaacctggcggcagcgcaaaagatg

SEQ ID NO: 195077 - DNA, 103 bp, Artificial Sequence
  Synthetic Polynucleotide
taatacgactcactatagggcattcaagcttggttttgtcagggtgtgtgaacagaggagacacacaatgtgacaaaacaacctggcggcagcgcaaaagatg

SEQ ID NO: 195078 - DNA, 103 bp, Artificial Sequence
  Synthetic Polynucleotide
taatacgactcactatagggattattcatccattcaagcttggttttgtcaacagaggagagacaaaatgaagcttgaaaacctggcggcagcgcaaaagatg

SEQ ID NO: 195079 - DNA, 103 bp, Artificial Sequence
  Synthetic Polynucleotide
taatacgactcactatagggcatctccagttttgtgaaagtcaaggttggaacagaggagaccaaccatgactttcacaaacctggcggcagcgcaaaagatg

SEQ ID NO: 195080 - DNA, 103 bp, Artificial Sequence
  Synthetic Polynucleotide
taatacgactcactatagggcactatacccattattcatccattcaagctaacagaggagaagcttgatgggatgaataaacctggcggcagcgcaaaagatg

SEQ ID NO: 195081 - DNA, 103 bp, Artificial Sequence
  Synthetic Polynucleotide
taatacgactcactatagggttaccaaccccactatacccattattcatcaacagaggagagatgaaatgtgggtatagaacctggcggcagcgcaaaagatg

SEQ ID NO: 195082 - DNA, 103 bp, Artificial Sequence
  Synthetic Polynucleotide
taatacgactcactatagggaactgatgaattaccaaccccactatacccaacagaggagagggtatatgggggttggtaacctggcggcagcgcaaaagatg

SEQ ID NO: 195083 - DNA, 103 bp, Artificial Sequence
  Synthetic Polynucleotide
taatacgactcactatagggcatggccagaaactgatgaattaccaacccaacagaggagagggttgatgattcatcagaacctggcggcagcgcaaaagatg

SEQ ID NO: 195084 - DNA, 103 bp, Artificial Sequence
  Synthetic Polynucleotide
taatacgactcactataggggggagaataccatggccagaaactgatgaaaacagaggagattcatcatgttctggccaaacctggcggcagcgcaaaagatg

SEQ ID NO: 195085 - DNA, 103 bp, Artificial Sequence
  Synthetic Polynucleotide
taatacgactcactatagggctgatagcttgggagaataccatggccagaaacagaggagatctggcatgggtattctcaacctggcggcagcgcaaaagatg

SEQ ID NO: 195086 - DNA, 103 bp, Artificial Sequence
  Synthetic Polynucleotide
taatacgactcactatagggccactagttcctgatagcttgggagaatacaacagaggagagtattcatgcaagctatcaacctggcggcagcgcaaaagatg

SEQ ID NO: 195087 - DNA, 103 bp, Artificial Sequence
  Synthetic Polynucleotide
taatacgactcactatagggaaacggtcttccactagttcctgatagcttaacagaggagaaagctaatgggaactagtaacctggcggcagcgcaaaagatg

SEQ ID NO: 195088 - DNA, 103 bp, Artificial Sequence
  Synthetic Polynucleotide
taatacgactcactatagggaggtttcctgaaacggtcttccactagttcaacagaggagagaactaatggaagaccgtaacctggcggcagcgcaaaagatg

SEQ ID NO: 195089 - DNA, 103 bp, Artificial Sequence
  Synthetic Polynucleotide
taatacgactcactatagggcaaaagcatgaggtttcctgaaacggtcttaacagaggagaaagaccatgtcaggaaacaacctggcggcagcgcaaaagatg

SEQ ID NO: 195090 - DNA, 103 bp, Artificial Sequence
  Synthetic Polynucleotide
taatacgactcactatagggttccgaatccaggaaaaggcatgcatttgtaacagaggagaacaaatatgtgccttttcaacctggcggcagcgcaaaagatg

SEQ ID NO: 195091 - DNA, 103 bp, Artificial Sequence
  Synthetic Polynucleotide
taatacgactcactatagggccttccaacccatctccagttttgtgaaagaacagaggagactttcaatgaactggagaaacctggcggcagcgcaaaagatg

SEQ ID NO: 195092 - DNA, 103 bp, Artificial Sequence
  Synthetic Polynucleotide
taatacgactcactatagggccaggcacagcaaaagcatgaggtttcctgaacagaggagacaggaaatgtcatgctttaacctggcggcagcgcaaaagatg

SEQ ID NO: 195093 - DNA, 103 bp, Artificial Sequence
  Synthetic Polynucleotide
taatacgactcactatagggataagactgtccaggcacagcaaaagcatgaacagaggagacatgctatggctgtgcctaacctggcggcagcgcaaaagatg

SEQ ID NO: 195094 - DNA, 103 bp, Artificial Sequence
  Synthetic Polynucleotide
taatacgactcactatagggattgagactgataagactgtccaggcacagaacagaggagactgtgcatggacagtcttaacctggcggcagcgcaaaagatg

SEQ ID NO: 195095 - DNA, 103 bp, Artificial Sequence
  Synthetic Polynucleotide
taatacgactcactatagggtgatgtctggattgagactgataagactgtaacagaggagaacagtcatgtcagtctcaaacctggcggcagcgcaaaagatg

SEQ ID NO: 195096 - DNA, 103 bp, Artificial Sequence
  Synthetic Polynucleotide
taatacgactcactatagggatgagtgtcatgatgtctggattgagactgaacagaggagacagtctatgtccagacataacctggcggcagcgcaaaagatg

SEQ ID NO: 195097 - DNA, 103 bp, Artificial Sequence
  Synthetic Polynucleotide
taatacgactcactatagggaacgaccaaaatgagtgtcatgatgtctggaacagaggagaccagacatgatgacactcaacctggcggcagcgcaaaagatg

SEQ ID NO: 195098 - DNA, 103 bp, Artificial Sequence
  Synthetic Polynucleotide
taatacgactcactatagggacaggagtcaaacgaccaaaatgagtgtcaaacagaggagatgacacatgttttggtcgaacctggcggcagcgcaaaagatg

SEQ ID NO: 195099 - DNA, 103 bp, Artificial Sequence
  Synthetic Polynucleotide
taatacgactcactatagggcacaggagagacaggagtcaaacgaccaaaaacagaggagatttggtatgttgactcctaacctggcggcagcgcaaaagatg

SEQ ID NO: 195100 - DNA, 103 bp, Artificial Sequence
  Synthetic Polynucleotide
taatacgactcactatagggcttgatgctgcacaggagagacaggagtcaaacagaggagatgactcatgtctctcctgaacctggcggcagcgcaaaagatg

SEQ ID NO: 195101 - DNA, 103 bp, Artificial Sequence
  Synthetic Polynucleotide
taatacgactcactatagggacagtggcaccttgatgctgcacaggagagaacagaggagactctccatggcagcatcaaacctggcggcagcgcaaaagatg

SEQ ID NO: 195102 - DNA, 103 bp, Artificial Sequence
  Synthetic Polynucleotide
taatacgactcactatagggaggttcagctccttccaacccatctccagtaacagaggagaactggaatggggttggaaaacctggcggcagcgcaaaagatg

SEQ ID NO: 195103 - DNA, 103 bp, Artificial Sequence
  Synthetic Polynucleotide
taatacgactcactatagggggtgttatttacagtggcaccttgatgctgaacagaggagacagcatatgggtgccactaacctggcggcagcgcaaaagatg

SEQ ID NO: 195104 - DNA, 103 bp, Artificial Sequence
  Synthetic Polynucleotide
taatacgactcactatagggcctgtttgttggtgttatttacagtggcacaacagaggagagtgccaatgtaaataacaaacctggcggcagcgcaaaagatg

SEQ ID NO: 195105 - DNA, 103 bp, Artificial Sequence
  Synthetic Polynucleotide
taatacgactcactataggggcaaaaccctcctgtttgttggtgttatttaacagaggagaaaataaatgcaacaaacaaacctggcggcagcgcaaaagatg

SEQ ID NO: 195106 - DNA, 103 bp, Artificial Sequence
  Synthetic Polynucleotide
taatacgactcactatagggggcagggactgcaaaaccctcctgtttgttaacagaggagaaacaaaatggagggttttaacctggcggcagcgcaaaagatg

SEQ ID NO: 195107 - DNA, 103 bp, Artificial Sequence
  Synthetic Polynucleotide
taatacgactcactatagggtatcaagaggggcagggactgcaaaaccctaacagaggagaagggttatgcagtccctgaacctggcggcagcgcaaaagatg

SEQ ID NO: 195108 - DNA, 103 bp, Artificial Sequence
  Synthetic Polynucleotide
taatacgactcactataggggttcctttattatcaagaggggcagggactaacagaggagaagtcccatgccctcttgaaacctggcggcagcgcaaaagatg

SEQ ID NO: 195109 - DNA, 103 bp, Artificial Sequence
  Synthetic Polynucleotide
taatacgactcactatagggagatgaattagttcctttattatcaagaggaacagaggagacctcttatgaataaaggaaacctggcggcagcgcaaaagatg

SEQ ID NO: 195110 - DNA, 103 bp, Artificial Sequence
  Synthetic Polynucleotide
taatacgactcactatagggtgctgctggcagatgaattagttcctttataacagaggagaataaagatgctaattcataacctggcggcagcgcaaaagatg

SEQ ID NO: 195111 - DNA, 103 bp, Artificial Sequence
  Synthetic Polynucleotide
taatacgactcactatagggcatctgaagttgctgctggcagatgaattaaacagaggagataattcatgtgccagcagaacctggcggcagcgcaaaagatg

SEQ ID NO: 195112 - DNA, 103 bp, Artificial Sequence
  Synthetic Polynucleotide
taatacgactcactatagggcacactccggcatctgaagttgctgctggcaacagaggagagccagcatgaacttcagaaacctggcggcagcgcaaaagatg

SEQ ID NO: 195113 - DNA, 103 bp, Artificial Sequence
  Synthetic Polynucleotide
taatacgactcactataggggctgcccagaaggttcagctccttccaaccaacagaggagaggttggatggagctgaacaacctggcggcagcgcaaaagatg

SEQ ID NO: 195114 - DNA, 103 bp, Artificial Sequence
  Synthetic Polynucleotide
taatacgactcactatagggcagcagggctcacactccggcatctgaagtaacagaggagaacttcaatggccggagtgaacctggcggcagcgcaaaagatg

SEQ ID NO: 195115 - DNA, 103 bp, Artificial Sequence
  Synthetic Polynucleotide
taatacgactcactatagggtggcgatgaacagcagggctcacactccggaacagaggagaccggagatggagccctgcaacctggcggcagcgcaaaagatg

SEQ ID NO: 195116 - DNA, 103 bp, Artificial Sequence
  Synthetic Polynucleotide
taatacgactcactatagggaagattacgttggcgatgaacagcagggctaacagaggagaagccctatggttcatcgcaacctggcggcagcgcaaaagatg

SEQ ID NO: 195117 - DNA, 103 bp, Artificial Sequence
  Synthetic Polynucleotide
taatacgactcactatagggtgcttccactaagattacgttggcgatgaaaacagaggagattcatcatgaacgtaatcaacctggcggcagcgcaaaagatg

SEQ ID NO: 195118 - DNA, 103 bp, Artificial Sequence
  Synthetic Polynucleotide
taatacgactcactatagggggatagagggtgcttccactaagattacgtaacagaggagaacgtaaatgtagtggaagaacctggcggcagcgcaaaagatg

SEQ ID NO: 195119 - DNA, 103 bp, Artificial Sequence
  Synthetic Polynucleotide
taatacgactcactatagggattagatactggatagagggtgcttccactaacagaggagaagtggaatgaccctctataacctggcggcagcgcaaaagatg

SEQ ID NO: 195120 - DNA, 103 bp, Artificial Sequence
  Synthetic Polynucleotide
taatacgactcactatagggatcgtgggatattagatactggatagagggaacagaggagaccctctatgcagtatctaaacctggcggcagcgcaaaagatg

SEQ ID NO: 195121 - DNA, 103 bp, Artificial Sequence
  Synthetic Polynucleotide
taatacgactcactataggggtcacattagatcgtgggatattagatactaacagaggagaagtatcatgtatcccacgaacctggcggcagcgcaaaagatg

SEQ ID NO: 195122 - DNA, 103 bp, Artificial Sequence
  Synthetic Polynucleotide
taatacgactcactatagggtccaaagggggtcacattagatcgtgggataacagaggagaatcccaatgtctaatgtgaacctggcggcagcgcaaaagatg

SEQ ID NO: 195123 - DNA, 103 bp, Artificial Sequence
  Synthetic Polynucleotide
taatacgactcactatagggtaactggacttccaaagggggtcacattagaacagaggagactaatgatgccccctttgaacctggcggcagcgcaaaagatg

SEQ ID NO: 195124 - DNA, 103 bp, Artificial Sequence
  Synthetic Polynucleotide
taatacgactcactatagggatattttgaagctgcccagaaggttcagctaacagaggagaagctgaatgttctgggcaaacctggcggcagcgcaaaagatg

SEQ ID NO: 195125 - DNA, 103 bp, Artificial Sequence
  Synthetic Polynucleotide
taatacgactcactatagggacttctggggtaactggacttccaaaggggaacagaggagaccccttatgaagtccagtaacctggcggcagcgcaaaagatg

SEQ ID NO: 195126 - DNA, 103 bp, Artificial Sequence
  Synthetic Polynucleotide
taatacgactcactataggggaaaacatgaacttctggggtaactggactaacagaggagaagtccaatgaccccagaaaacctggcggcagcgcaaaagatg

SEQ ID NO: 195127 - DNA, 103 bp, Artificial Sequence
  Synthetic Polynucleotide
taatacgactcactataggggaacatttgtgaaaacatgaacttctggggaacagaggagaccccagatgttcatgtttaacctggcggcagcgcaaaagatg

SEQ ID NO: 195128 - DNA, 103 bp, Artificial Sequence
  Synthetic Polynucleotide
taatacgactcactataggggcgtctgtgtgaacatttgtgaaaacatgaaacagaggagatcatgtatgcacaaatgtaacctggcggcagcgcaaaagatg

SEQ ID NO: 195129 - DNA, 103 bp, Artificial Sequence
  Synthetic Polynucleotide
taatacgactcactataggggttggcacatgcgtctgtgtgaacatttgtaacagaggagaacaaatatgcacacagacaacctggcggcagcgcaaaagatg

SEQ ID NO: 195130 - DNA, 103 bp, Artificial Sequence
  Synthetic Polynucleotide
taatacgactcactataggggagctatgttgttggcacatgcgtctgtgtaacagaggagaacacagatgcatgtgccaaacctggcggcagcgcaaaagatg

SEQ ID NO: 195131 - DNA, 103 bp, Artificial Sequence
  Synthetic Polynucleotide
taatacgactcactatagggtggcttctttgagctatgttgttggcacataacagaggagaatgtgcatgcaacatagcaacctggcggcagcgcaaaagatg

SEQ ID NO: 195132 - DNA, 103 bp, Artificial Sequence
  Synthetic Polynucleotide
taatacgactcactatagggtggaactgattggcttctttgagctatgttaacagaggagaaacataatgcaaagaagcaacctggcggcagcgcaaaagatg

SEQ ID NO: 195133 - DNA, 103 bp, Artificial Sequence
  Synthetic Polynucleotide
taatacgactcactatagggtgactgtcaatggaactgattggcttctttaacagaggagaaaagaaatgaatcagttcaacctggcggcagcgcaaaagatg

SEQ ID NO: 195134 - DNA, 103 bp, Artificial Sequence
  Synthetic Polynucleotide
taatacgactcactataggggtctgcatcatgactgtcaatggaactgataacagaggagaatcagtatgattgacagtaacctggcggcagcgcaaaagatg

SEQ ID NO: 195135 - DNA, 103 bp, Artificial Sequence
  Synthetic Polynucleotide
taatacgactcactatagggttcttcatcaatattttgaagctgcccagaaacagaggagatctgggatgcttcaaaataacctggcggcagcgcaaaagatg

SEQ ID NO: 195136 - DNA, 103 bp, Artificial Sequence
  Synthetic Polynucleotide
taatacgactcactatagggtgggaaggctgtctgcatcatgactgtcaaaacagaggagattgacaatgatgatgcagaacctggcggcagcgcaaaagatg

SEQ ID NO: 195137 - DNA, 103 bp, Artificial Sequence
  Synthetic Polynucleotide
taatacgactcactataggggaagagcgtttgggaaggctgtctgcatcaaacagaggagatgatgcatgcagccttccaacctggcggcagcgcaaaagatg

SEQ ID NO: 195138 - DNA, 103 bp, Artificial Sequence
  Synthetic Polynucleotide
taatacgactcactataggggcttgcttctgaagagcgtttgggaaggctaacagaggagaagccttatgaaacgctctaacctggcggcagcgcaaaagatg

SEQ ID NO: 195139 - DNA, 103 bp, Artificial Sequence
  Synthetic Polynucleotide
taatacgactcactatagggtttactgtttgcttgcttctgaagagcgttaacagaggagaaacgctatgcagaagcaaaacctggcggcagcgcaaaagatg

SEQ ID NO: 195140 - DNA, 103 bp, Artificial Sequence
  Synthetic Polynucleotide
taatacgactcactatagggtggttatttttttactgtttgcttgcttctaacagaggagaagaagcatgcaaacagtaaacctggcggcagcgcaaaagatg

SEQ ID NO: 195141 - DNA, 103 bp, Artificial Sequence
  Synthetic Polynucleotide
taatacgactcactatagggaacaaaacattggttatttttttactgtttaacagaggagaaaacagatgaaaaataacaacctggcggcagcgcaaaagatg

SEQ ID NO: 195142 - DNA, 103 bp, Artificial Sequence
  Synthetic Polynucleotide
taatacgactcactatagggaagtttactcaacaaaacattggttattttaacagaggagaaaaataatgaatgttttgaacctggcggcagcgcaaaagatg

SEQ ID NO: 195143 - DNA, 103 bp, Artificial Sequence
  Synthetic Polynucleotide
taatacgactcactatagggtgtcggaatcaagtttactcaacaaaacataacagaggagaatgtttatgtgagtaaacaacctggcggcagcgcaaaagatg

SEQ ID NO: 195144 - DNA, 103 bp, Artificial Sequence
  Synthetic Polynucleotide
taatacgactcactataggggcatcatcattgtcggaatcaagtttactcaacagaggagagagtaaatgtgattccgaaacctggcggcagcgcaaaagatg

SEQ ID NO: 195145 - DNA, 103 bp, Artificial Sequence
  Synthetic Polynucleotide
taatacgactcactatagggacctctcactgcatcatcattgtcggaatcaacagaggagagattccatgaatgatgataacctggcggcagcgcaaaagatg

SEQ ID NO: 195146 - DNA, 103 bp, Artificial Sequence
  Synthetic Polynucleotide
taatacgactcactatagggaagagataacttcttcatcaatattttgaaaacagaggagattcaaaatgttgatgaagaacctggcggcagcgcaaaagatg

SEQ ID NO: 195147 - DNA, 103 bp, Artificial Sequence
  Synthetic Polynucleotide
taatacgactcactatagggtcattcccaaacctctcactgcatcatcataacagaggagaatgatgatgcagtgagagaacctggcggcagcgcaaaagatg

SEQ ID NO: 195148 - DNA, 103 bp, Artificial Sequence
  Synthetic Polynucleotide
taatacgactcactatagggggcaggttgttcattcccaaacctctcactaacagaggagaagtgagatgtttgggaataacctggcggcagcgcaaaagatg

SEQ ID NO: 195149 - DNA, 103 bp, Artificial Sequence
  Synthetic Polynucleotide
taatacgactcactatagggataattagagggcaggttgttcattcccaaaacagaggagattgggaatgaacaacctgaacctggcggcagcgcaaaagatg

SEQ ID NO: 195150 - DNA, 103 bp, Artificial Sequence
  Synthetic Polynucleotide
taatacgactcactatagggtccgggctgtataattagagggcaggttgtaacagaggagaacaaccatgcctctaattaacctggcggcagcgcaaaagatg

SEQ ID NO: 195151 - DNA, 103 bp, Artificial Sequence
  Synthetic Polynucleotide
taatacgactcactataggggtgagattcatccgggctgtataattagagaacagaggagactctaaatgtacagcccgaacctggcggcagcgcaaaagatg

SEQ ID NO: 195152 - DNA, 103 bp, Artificial Sequence
  Synthetic Polynucleotide
taatacgactcactatagggcaaaatctgagtgagattcatccgggctgtaacagaggagaacagccatgatgaatctcaacctggcggcagcgcaaaagatg

SEQ ID NO: 195153 - DNA, 103 bp, Artificial Sequence
  Synthetic Polynucleotide
taatacgactcactatagggtggaaggttccaaaatctgagtgagattcaaacagaggagatgaatcatgctcagatttaacctggcggcagcgcaaaagatg

SEQ ID NO: 195154 - DNA, 103 bp, Artificial Sequence
  Synthetic Polynucleotide
taatacgactcactatagggggaaaaacagtggaaggttccaaaatctgaaacagaggagatcagatatgggaaccttcaacctggcggcagcgcaaaagatg

SEQ ID NO: 195155 - DNA, 103 bp, Artificial Sequence
  Synthetic Polynucleotide
taatacgactcactataggggttggcactaggaaaaacagtggaaggttcaacagaggagagaacctatgactgtttttaacctggcggcagcgcaaaagatg

SEQ ID NO: 195156 - DNA, 103 bp, Artificial Sequence
  Synthetic Polynucleotide
taatacgactcactatagggtattttgtgggttggcactaggaaaaacagaacagaggagactgtttatgctagtgccaaacctggcggcagcgcaaaagatg

SEQ ID NO: 195157 - DNA, 103 bp, Artificial Sequence
  Synthetic Polynucleotide
taatacgactcactatagggcggcaagcagaagagataacttcttcatcaaacagaggagatgatgaatgagttatctcaacctggcggcagcgcaaaagatg

SEQ ID NO: 195158 - DNA, 103 bp, Artificial Sequence
  Synthetic Polynucleotide
taatacgactcactataggggaatcgatcatattttgtgggttggcactaaacagaggagatagtgcatgcccacaaaaaacctggcggcagcgcaaaagatg

SEQ ID NO: 195159 - DNA, 103 bp, Artificial Sequence
  Synthetic Polynucleotide
taatacgactcactatagggagaagtgctggaatcgatcatattttgtggaacagaggagaccacaaatgatgatcgataacctggcggcagcgcaaaagatg

SEQ ID NO: 195160 - DNA, 103 bp, Artificial Sequence
  Synthetic Polynucleotide
taatacgactcactatagggactcataaacagaagtgctggaatcgatcaaacagaggagatgatcgatgccagcacttaacctggcggcagcgcaaaagatg

SEQ ID NO: 195161 - DNA, 103 bp, Artificial Sequence
  Synthetic Polynucleotide
taatacgactcactatagggggtgtttggaactcataaacagaagtgctgaacagaggagacagcacatgtgtttatgaaacctggcggcagcgcaaaagatg

SEQ ID NO: 195162 - DNA, 103 bp, Artificial Sequence
  Synthetic Polynucleotide
taatacgactcactataggggaggtaagatggtgtttggaactcataaacaacagaggagagtttatatgttccaaacaaacctggcggcagcgcaaaagatg

SEQ ID NO: 195163 - DNA, 103 bp, Artificial Sequence
  Synthetic Polynucleotide
taatacgactcactatagggtacttttggtgaggtaagatggtgtttggaaacagaggagatccaaaatgcatcttaccaacctggcggcagcgcaaaagatg

SEQ ID NO: 195164 - DNA, 103 bp, Artificial Sequence
  Synthetic Polynucleotide
taatacgactcactatagggccggtgctattacttttggtgaggtaagataacagaggagaatcttaatgcaccaaaagaacctggcggcagcgcaaaagatg

SEQ ID NO: 195165 - DNA, 103 bp, Artificial Sequence
  Synthetic Polynucleotide
taatacgactcactatagggattgatctgaccggtgctattacttttggtaacagaggagaaccaaaatgaatagcaccaacctggcggcagcgcaaaagatg

SEQ ID NO: 195166 - DNA, 103 bp, Artificial Sequence
  Synthetic Polynucleotide
taatacgactcactatagggcaggagaaaaattgatctgaccggtgctataacagaggagaatagcaatggtcagatcaaacctggcggcagcgcaaaagatg

SEQ ID NO: 195167 - DNA, 103 bp, Artificial Sequence
  Synthetic Polynucleotide
taatacgactcactatagggtgattatctccaggagaaaaattgatctgaaacagaggagatcagatatgtttttctccaacctggcggcagcgcaaaagatg

SEQ ID NO: 195168 - DNA, 103 bp, Artificial Sequence
  Synthetic Polynucleotide
taatacgactcactatagggacacacaagacggcaagcagaagagataacaacagaggagagttatcatgtctgcttgcaacctggcggcagcgcaaaagatg

SEQ ID NO: 195169 - DNA, 103 bp, Artificial Sequence
  Synthetic Polynucleotide
taatacgactcactatagggtgattgtgcttgattatctccaggagaaaaaacagaggagattttctatgggagataataacctggcggcagcgcaaaagatg

SEQ ID NO: 195170 - DNA, 103 bp, Artificial Sequence
  Synthetic Polynucleotide
taatacgactcactatagggctccaatttctgattgtgcttgattatctcaacagaggagagagataatgaagcacaataacctggcggcagcgcaaaagatg

SEQ ID NO: 195171 - DNA, 103 bp, Artificial Sequence
  Synthetic Polynucleotide
taatacgactcactatagggaattgttgctctccaatttctgattgtgctaacagaggagaagcacaatgagaaattggaacctggcggcagcgcaaaagatg

SEQ ID NO: 195172 - DNA, 103 bp, Artificial Sequence
  Synthetic Polynucleotide
taatacgactcactatagggattgaaatctaattgttgctctccaatttcaacagaggagagaaattatggagcaacaaaacctggcggcagcgcaaaagatg

SEQ ID NO: 195173 - DNA, 103 bp, Artificial Sequence
  Synthetic Polynucleotide
taatacgactcactatagggtaacagtgctattgaaatctaattgttgctaacagaggagaagcaacatgtagatttcaaacctggcggcagcgcaaaagatg

SEQ ID NO: 195174 - DNA, 103 bp, Artificial Sequence
  Synthetic Polynucleotide
taatacgactcactatagggaacaggtctttaacagtgctattgaaatctaacagaggagaagatttatgtagcactgtaacctggcggcagcgcaaaagatg

SEQ ID NO: 195175 - DNA, 103 bp, Artificial Sequence
  Synthetic Polynucleotide
taatacgactcactataggggtctccactcaacaggtctttaacagtgctaacagaggagaagcactatgaaagacctgaacctggcggcagcgcaaaagatg

SEQ ID NO: 195176 - DNA, 103 bp, Artificial Sequence
  Synthetic Polynucleotide
taatacgactcactatagggtttgcaagctgtctccactcaacaggtcttaacagaggagaaagaccatgtgagtggagaacctggcggcagcgcaaaagatg

SEQ ID NO: 195177 - DNA, 103 bp, Artificial Sequence
  Synthetic Polynucleotide
taatacgactcactatagggtgctggttggtttgcaagctgtctccactcaacagaggagagagtggatgcagcttgcaaacctggcggcagcgcaaaagatg

SEQ ID NO: 195178 - DNA, 103 bp, Artificial Sequence
  Synthetic Polynucleotide
taatacgactcactatagggacctaccagctgctggttggtttgcaagctaacagaggagaagcttgatgaccaaccagaacctggcggcagcgcaaaagatg

SEQ ID NO: 195179 - DNA, 103 bp, Artificial Sequence
  Synthetic Polynucleotide
taatacgactcactataggggggcccactcacacacaagacggcaagcagaacagaggagactgcttatggtcttgtgtaacctggcggcagcgcaaaagatg

SEQ ID NO: 195180 - DNA, 103 bp, Artificial Sequence
  Synthetic Polynucleotide
taatacgactcactatagggatgctccctgacctaccagctgctggttggaacagaggagaccaaccatgagctggtagaacctggcggcagcgcaaaagatg

SEQ ID NO: 195181 - DNA, 103 bp, Artificial Sequence
  Synthetic Polynucleotide
taatacgactcactataggggtgagatcagatgctccctgacctaccagcaacagaggagagctggtatgtcagggagcaacctggcggcagcgcaaaagatg

SEQ ID NO: 195182 - DNA, 103 bp, Artificial Sequence
  Synthetic Polynucleotide
taatacgactcactatagggtgcagtattagtgagatcagatgctccctgaacagaggagacagggaatgtctgatctcaacctggcggcagcgcaaaagatg

SEQ ID NO: 195183 - DNA, 103 bp, Artificial Sequence
  Synthetic Polynucleotide
taatacgactcactatagggagaaatcagatgcagtattagtgagatcagaacagaggagactgatcatgctaatactgaacctggcggcagcgcaaaagatg

SEQ ID NO: 195184 - DNA, 103 bp, Artificial Sequence
  Synthetic Polynucleotide
taatacgactcactatagggatatcgctagagaaatcagatgcagtattaaacagaggagataatacatgatctgatttaacctggcggcagcgcaaaagatg

SEQ ID NO: 195185 - DNA, 103 bp, Artificial Sequence
  Synthetic Polynucleotide
taatacgactcactatagggagacaacctgatatcgctagagaaatcagaaacagaggagatctgatatgtctagcgataacctggcggcagcgcaaaagatg

SEQ ID NO: 195186 - DNA, 103 bp, Artificial Sequence
  Synthetic Polynucleotide
taatacgactcactatagggagagctcagaagacaacctgatatcgctagaacagaggagactagcgatgtcaggttgtaacctggcggcagcgcaaaagatg

SEQ ID NO: 195187 - DNA, 103 bp, Artificial Sequence
  Synthetic Polynucleotide
taatacgactcactatagggatgctgcctgagagctcagaagacaacctgaacagaggagacaggttatgttctgagctaacctggcggcagcgcaaaagatg

SEQ ID NO: 195188 - DNA, 103 bp, Artificial Sequence
  Synthetic Polynucleotide
taatacgactcactatagggcaaatcattgatgctgcctgagagctcagaaacagaggagatctgagatgtcaggcagcaacctggcggcagcgcaaaagatg

SEQ ID NO: 195189 - DNA, 103 bp, Artificial Sequence
  Synthetic Polynucleotide
taatacgactcactatagggctaaagtgttcaaatcattgatgctgcctgaacagaggagacaggcaatgtcaatgattaacctggcggcagcgcaaaagatg

SEQ ID NO: 195190 - DNA, 103 bp, Artificial Sequence
  Synthetic Polynucleotide
taatacgactcactatagggaacactttctgggcccactcacacacaagaaacagaggagatcttgtatgtgagtgggcaacctggcggcagcgcaaaagatg

SEQ ID NO: 195191 - DNA, 103 bp, Artificial Sequence
  Synthetic Polynucleotide
taatacgactcactatagggagatttgggtctaaagtgttcaaatcattgaacagaggagacaatgaatggaacactttaacctggcggcagcgcaaaagatg

SEQ ID NO: 195192 - DNA, 103 bp, Artificial Sequence
  Synthetic Polynucleotide
taatacgactcactatagggatcaaacagtagatttgggtctaaagtgttaacagaggagaaacactatggacccaaataacctggcggcagcgcaaaagatg

SEQ ID NO: 195193 - DNA, 103 bp, Artificial Sequence
  Synthetic Polynucleotide
taatacgactcactataggggacgacctggatcaaacagtagatttgggtaacagaggagaacccaaatgtactgtttgaacctggcggcagcgcaaaagatg

SEQ ID NO: 195194 - DNA, 103 bp, Artificial Sequence
  Synthetic Polynucleotide
taatacgactcactatagggtgtccctgctgacgacctggatcaaacagtaacagaggagaactgttatgtccaggtcgaacctggcggcagcgcaaaagatg

SEQ ID NO: 195195 - DNA, 103 bp, Artificial Sequence
  Synthetic Polynucleotide
taatacgactcactatagggttcatcatcttgtccctgctgacgacctggaacagaggagaccaggtatgcagcagggaaacctggcggcagcgcaaaagatg

SEQ ID NO: 195196 - DNA, 103 bp, Artificial Sequence
  Synthetic Polynucleotide
taatacgactcactatagggccagtgtagcttcatcatcttgtccctgctaacagaggagaagcaggatgaagatgatgaacctggcggcagcgcaaaagatg

SEQ ID NO: 195197 - DNA, 103 bp, Artificial Sequence
  Synthetic Polynucleotide
taatacgactcactatagggtttaattcttccagtgtagcttcatcatctaacagaggagaagatgaatgagctacactaacctggcggcagcgcaaaagatg

SEQ ID NO: 195198 - DNA, 103 bp, Artificial Sequence
  Synthetic Polynucleotide
taatacgactcactatagggtgggtcattctttaattcttccagtgtagcaacagaggagagctacaatggaagaattaaacctggcggcagcgcaaaagatg

SEQ ID NO: 195199 - DNA, 103 bp, Artificial Sequence
  Synthetic Polynucleotide
taatacgactcactataggggttgaaataatgggtcattctttaattcttaacagaggagaaagaatatgagaatgaccaacctggcggcagcgcaaaagatg

SEQ ID NO: 195200 - DNA, 103 bp, Artificial Sequence
  Synthetic Polynucleotide
taatacgactcactatagggctgcaaatttgttgaaataatgggtcattcaacagaggagagaatgaatgattatttcaaacctggcggcagcgcaaaagatg

SEQ ID NO: 195201 - DNA, 103 bp, Artificial Sequence
  Synthetic Polynucleotide
taatacgactcactatagggctctagggtattccgaatccaggaaaaggcaacagaggagagcctttatgtggattcggaacctggcggcagcgcaaaagatg

SEQ ID NO: 195202 - DNA, 103 bp, Artificial Sequence
  Synthetic Polynucleotide
taatacgactcactatagggtggttggcttaacactttctgggcccactcaacagaggagagagtggatgcagaaagtgaacctggcggcagcgcaaaagatg

SEQ ID NO: 195203 - DNA, 103 bp, Artificial Sequence
  Synthetic Polynucleotide
taatacgactcactatagggcatggattcactgcaaatttgttgaaataaaacagaggagattatttatgcaaatttgcaacctggcggcagcgcaaaagatg

SEQ ID NO: 195204 - DNA, 103 bp, Artificial Sequence
  Synthetic Polynucleotide
taatacgactcactatagggtcatagaattcatggattcactgcaaatttaacagaggagaaaatttatggtgaatccaaacctggcggcagcgcaaaagatg

SEQ ID NO: 195205 - DNA, 103 bp, Artificial Sequence
  Synthetic Polynucleotide
taatacgactcactatagggcctgatgaagtcatagaattcatggattcaaacagaggagatgaatcatggaattctataacctggcggcagcgcaaaagatg

SEQ ID NO: 195206 - DNA, 103 bp, Artificial Sequence
  Synthetic Polynucleotide
taatacgactcactatagggccattcaaaacctgatgaagtcatagaattaacagaggagaaattctatgacttcatcaaacctggcggcagcgcaaaagatg

SEQ ID NO: 195207 - DNA, 103 bp, Artificial Sequence
  Synthetic Polynucleotide
taatacgactcactatagggtgctttctatccattcaaaacctgatgaagaacagaggagacttcatatggttttgaataacctggcggcagcgcaaaagatg

SEQ ID NO: 195208 - DNA, 103 bp, Artificial Sequence
  Synthetic Polynucleotide
taatacgactcactatagggggatggtccttgctttctatccattcaaaaaacagaggagattttgaatggatagaaagaacctggcggcagcgcaaaagatg

SEQ ID NO: 195209 - DNA, 103 bp, Artificial Sequence
  Synthetic Polynucleotide
taatacgactcactatagggttcaacagtaggatggtccttgctttctataacagaggagaatagaaatgaaggaccataacctggcggcagcgcaaaagatg

SEQ ID NO: 195210 - DNA, 103 bp, Artificial Sequence
  Synthetic Polynucleotide
taatacgactcactatagggaacccaacatttcaacagtaggatggtcctaacagaggagaaggaccatgctactgttgaacctggcggcagcgcaaaagatg

SEQ ID NO: 195211 - DNA, 103 bp, Artificial Sequence
  Synthetic Polynucleotide
taatacgactcactatagggcggtgtcaaatggttggcttaacactttctaacagaggagaagaaagatgtaagccaacaacctggcggcagcgcaaaagatg

SEQ ID NO: 195212 - DNA, 103 bp, Artificial Sequence
  Synthetic Polynucleotide
taatacgactcactatagggaattccaagacggtgtcaaatggttggcttaacagaggagaaagccaatgatttgacacaacctggcggcagcgcaaaagatg

SEQ ID NO: 195213 - DNA, 103 bp, Artificial Sequence
  Synthetic Polynucleotide
taatacgactcactataggggaagcgggctaattccaagacggtgtcaaaaacagaggagatttgacatggtcttggaaaacctggcggcagcgcaaaagatg

SEQ ID NO: 195214 - DNA, 103 bp, Artificial Sequence
  Synthetic Polynucleotide
taatacgactcactatagggtttttacaaggaagcgggctaattccaagaaacagaggagatcttggatgtagcccgctaacctggcggcagcgcaaaagatg

SEQ ID NO: 195215 - DNA, 103 bp, Artificial Sequence
  Synthetic Polynucleotide
taatacgactcactatagggatatagtgactttttacaaggaagcgggctaacagaggagaagcccgatgccttgtaaaaacctggcggcagcgcaaaagatg

SEQ ID NO: 195216 - DNA, 103 bp, Artificial Sequence
  Synthetic Polynucleotide
taatacgactcactatagggcttggtgcctatatagtgactttttacaagaacagaggagacttgtaatgagtcactataacctggcggcagcgcaaaagatg

SEQ ID NO: 195217 - DNA, 103 bp, Artificial Sequence
  Synthetic Polynucleotide
taatacgactcactatagggctgccattgacttggtgcctatatagtgacaacagaggagagtcactatgtaggcaccaaacctggcggcagcgcaaaagatg

SEQ ID NO: 195218 - DNA, 103 bp, Artificial Sequence
  Synthetic Polynucleotide
taatacgactcactatagggacagttagagctgccattgacttggtgcctaacagaggagaaggcacatggtcaatggcaacctggcggcagcgcaaaagatg

SEQ ID NO: 195219 - DNA, 103 bp, Artificial Sequence
  Synthetic Polynucleotide
taatacgactcactatagggtgctgccattacagttagagctgccattgaaacagaggagatcaatgatggctctaactaacctggcggcagcgcaaaagatg

SEQ ID NO: 195220 - DNA, 103 bp, Artificial Sequence
  Synthetic Polynucleotide
taatacgactcactatagggccggatgttcctctagggtattccgaatccaacagaggagaggattcatgataccctagaacctggcggcagcgcaaaagatg

SEQ ID NO: 195221 - DNA, 103 bp, Artificial Sequence
  Synthetic Polynucleotide
taatacgactcactatagggctgctggtgctgctgccattacagttagagaacagaggagactctaaatgtaatggcagaacctggcggcagcgcaaaagatg

SEQ ID NO: 195222 - DNA, 103 bp, Artificial Sequence
  Synthetic Polynucleotide
taatacgactcactatagggcctttcattcctgctggtgctgctgccattaacagaggagaaatggcatgagcaccagcaacctggcggcagcgcaaaagatg

SEQ ID NO: 195223 - DNA, 103 bp, Artificial Sequence
  Synthetic Polynucleotide
taatacgactcactatagggctgggtaattcctttcattcctgctggtgcaacagaggagagcaccaatgggaatgaaaaacctggcggcagcgcaaaagatg

SEQ ID NO: 195224 - DNA, 103 bp, Artificial Sequence
  Synthetic Polynucleotide
taatacgactcactatagggaagcagaaggctgggtaattcctttcattcaacagaggagagaatgaatggaattacccaacctggcggcagcgcaaaagatg

SEQ ID NO: 195225 - DNA, 103 bp, Artificial Sequence
  Synthetic Polynucleotide
taatacgactcactataggggtaggtataaaagcagaaggctgggtaattaacagaggagaaattacatggccttctgcaacctggcggcagcgcaaaagatg

SEQ ID NO: 195226 - DNA, 103 bp, Artificial Sequence
  Synthetic Polynucleotide
taatacgactcactatagggactttcagctgtaggtataaaagcagaaggaacagaggagaccttctatgtttatacctaacctggcggcagcgcaaaagatg

SEQ ID NO: 195227 - DNA, 103 bp, Artificial Sequence
  Synthetic Polynucleotide
taatacgactcactataggggaaaggaattactttcagctgtaggtataaaacagaggagattatacatgcagctgaaaaacctggcggcagcgcaaaagatg

SEQ ID NO: 195228 - DNA, 103 bp, Artificial Sequence
  Synthetic Polynucleotide
taatacgactcactatagggacctgaggctgaaaggaattactttcagctaacagaggagaagctgaatgtaattccttaacctggcggcagcgcaaaagatg

SEQ ID NO: 195229 - DNA, 103 bp, Artificial Sequence
  Synthetic Polynucleotide
taatacgactcactatagggcaaagtcttcacctgaggctgaaaggaattaacagaggagaaattccatgcagcctcagaacctggcggcagcgcaaaagatg

SEQ ID NO: 195230 - DNA, 103 bp, Artificial Sequence
  Synthetic Polynucleotide
taatacgactcactatagggttggagatggcaaagtcttcacctgaggctaacagaggagaagcctcatgtgaagacttaacctggcggcagcgcaaaagatg

SEQ ID NO: 195231 - DNA, 103 bp, Artificial Sequence
  Synthetic Polynucleotide
taatacgactcactatagggagtgaagtctccggatgttcctctagggtaaacagaggagataccctatgggaacatccaacctggcggcagcgcaaaagatg

SEQ ID NO: 195232 - DNA, 103 bp, Artificial Sequence
  Synthetic Polynucleotide
taatacgactcactatagggttagcatcaattggagatggcaaagtcttcaacagaggagagaagacatggccatctccaacctggcggcagcgcaaaagatg

SEQ ID NO: 195233 - DNA, 103 bp, Artificial Sequence
  Synthetic Polynucleotide
taatacgactcactatagggcaactgctgtttagcatcaattggagatggaacagaggagaccatctatgattgatgctaacctggcggcagcgcaaaagatg

SEQ ID NO: 195234 - DNA, 103 bp, Artificial Sequence
  Synthetic Polynucleotide
taatacgactcactatagggttttccgttgcaactgctgtttagcatcaaaacagaggagattgatgatgaacagcagtaacctggcggcagcgcaaaagatg

SEQ ID NO: 195235 - DNA, 103 bp, Artificial Sequence
  Synthetic Polynucleotide
taatacgactcactatagggttcttctggattttccgttgcaactgctgtaacagaggagaacagcaatggcaacggaaaacctggcggcagcgcaaaagatg

SEQ ID NO: 195236 - DNA, 103 bp, Artificial Sequence
  Synthetic Polynucleotide
taatacgactcactatagggttcttgctgcttcttctggattttccgttgaacagaggagacaacggatgatccagaagaacctggcggcagcgcaaaagatg

SEQ ID NO: 195237 - DNA, 103 bp, Artificial Sequence
  Synthetic Polynucleotide
taatacgactcactataggggtagtttctgttcttgctgcttcttctggaaacagaggagatccagaatgagcagcaagaacctggcggcagcgcaaaagatg

SEQ ID NO: 195238 - DNA, 103 bp, Artificial Sequence
  Synthetic Polynucleotide
taatacgactcactatagggaaaggggattgtagtttctgttcttgctgcaacagaggagagcagcaatgacagaaactaacctggcggcagcgcaaaagatg

SEQ ID NO: 195239 - DNA, 103 bp, Artificial Sequence
  Synthetic Polynucleotide
taatacgactcactatagggttctcctggcaaaggggattgtagtttctgaacagaggagacagaaaatgcaatcccctaacctggcggcagcgcaaaagatg

SEQ ID NO: 195240 - DNA, 103 bp, Artificial Sequence
  Synthetic Polynucleotide
taatacgactcactatagggttgctgcagattctcctggcaaaggggattaacagaggagaaatcccatgtgccaggagaacctggcggcagcgcaaaagatg

SEQ ID NO: 195241 - DNA, 103 bp, Artificial Sequence
  Synthetic Polynucleotide
taatacgactcactatagggtctgacttttttgctgcagattctcctggcaacagaggagagccaggatgatctgcagcaacctggcggcagcgcaaaagatg

SEQ ID NO: 195242 - DNA, 103 bp, Artificial Sequence
  Synthetic Polynucleotide
taatacgactcactatagggctgtttgggcagtgaagtctccggatgttcaacagaggagagaacatatggagacttcaaacctggcggcagcgcaaaagatg

SEQ ID NO: 195243 - DNA, 103 bp, Artificial Sequence
  Synthetic Polynucleotide
taatacgactcactatagggtgtagcactttctgacttttttgctgcagaaacagaggagatctgcaatgaaaaagtcaaacctggcggcagcgcaaaagatg

SEQ ID NO: 195244 - DNA, 103 bp, Artificial Sequence
  Synthetic Polynucleotide
taatacgactcactatagggctccattgcttgtagcactttctgacttttaacagaggagaaaaagtatgaaagtgctaaacctggcggcagcgcaaaagatg

SEQ ID NO: 195245 - DNA, 103 bp, Artificial Sequence
  Synthetic Polynucleotide
taatacgactcactatagggagattagtcactccattgcttgtagcacttaacagaggagaaagtgcatgaagcaatggaacctggcggcagcgcaaaagatg

SEQ ID NO: 195246 - DNA, 103 bp, Artificial Sequence
  Synthetic Polynucleotide
taatacgactcactatagggtccattaggaagattagtcactccattgctaacagaggagaagcaatatggtgactaataacctggcggcagcgcaaaagatg

SEQ ID NO: 195247 - DNA, 103 bp, Artificial Sequence
  Synthetic Polynucleotide
taatacgactcactatagggttgaaggatttccattaggaagattagtcaaacagaggagatgactaatgttcctaatgaacctggcggcagcgcaaaagatg

SEQ ID NO: 195248 - DNA, 103 bp, Artificial Sequence
  Synthetic Polynucleotide
taatacgactcactatagggggagaaaggattgaaggatttccattaggaaacagaggagatcctaaatgaaatccttcaacctggcggcagcgcaaaagatg

SEQ ID NO: 195249 - DNA, 103 bp, Artificial Sequence
  Synthetic Polynucleotide
taatacgactcactatagggaataggttgaggagaaaggattgaaggattaacagaggagaaatcctatgatcctttctaacctggcggcagcgcaaaagatg

SEQ ID NO: 195250 - DNA, 103 bp, Artificial Sequence
  Synthetic Polynucleotide
taatacgactcactatagggcaacgataccaataggttgaggagaaaggaaacagaggagatcctttatgctcaacctaaacctggcggcagcgcaaaagatg

SEQ ID NO: 195251 - DNA, 103 bp, Artificial Sequence
  Synthetic Polynucleotide
taatacgactcactatagggacagctgccacaacgataccaataggttgaaacagaggagatcaaccatgtggtatcgtaacctggcggcagcgcaaaagatg

SEQ ID NO: 195252 - DNA, 103 bp, Artificial Sequence
  Synthetic Polynucleotide
taatacgactcactataggggggactagggacagctgccacaacgataccaacagaggagaggtatcatggtggcagctaacctggcggcagcgcaaaagatg

SEQ ID NO: 195253 - DNA, 103 bp, Artificial Sequence
  Synthetic Polynucleotide
taatacgactcactatagggcatagacttcctgtttgggcagtgaagtctaacagaggagaagacttatgtgcccaaacaacctggcggcagcgcaaaagatg

SEQ ID NO: 195254 - DNA, 103 bp, Artificial Sequence
  Synthetic Polynucleotide
taatacgactcactatagggggaccggaatgggactagggacagctgccaaacagaggagatggcagatgtccctagtcaacctggcggcagcgcaaaagatg

SEQ ID NO: 195255 - DNA, 103 bp, Artificial Sequence
  Synthetic Polynucleotide
taatacgactcactatagggctagtccgctggaccggaatgggactagggaacagaggagaccctagatgcattccggtaacctggcggcagcgcaaaagatg

SEQ ID NO: 195256 - DNA, 103 bp, Artificial Sequence
  Synthetic Polynucleotide
taatacgactcactatagggtaccaattgcctagtccgctggaccggaataacagaggagaattccgatgcagcggactaacctggcggcagcgcaaaagatg

SEQ ID NO: 195257 - DNA, 103 bp, Artificial Sequence
  Synthetic Polynucleotide
taatacgactcactatagggtcggtgaagttaccaattgcctagtccgctaacagaggagaagcggaatgggcaattggaacctggcggcagcgcaaaagatg

SEQ ID NO: 195258 - DNA, 103 bp, Artificial Sequence
  Synthetic Polynucleotide
taatacgactcactatagggctcattggactcggtgaagttaccaattgcaacagaggagagcaattatgaacttcaccaacctggcggcagcgcaaaagatg

SEQ ID NO: 195259 - DNA, 103 bp, Artificial Sequence
  Synthetic Polynucleotide
taatacgactcactataggggtcagaagaactcattggactcggtgaagtaacagaggagaacttcaatgagtccaatgaacctggcggcagcgcaaaagatg

SEQ ID NO: 195260 - DNA, 103 bp, Artificial Sequence
  Synthetic Polynucleotide
taatacgactcactataggggaactttgccgtcagaagaactcattggacaacagaggagagtccaaatggttcttctgaacctggcggcagcgcaaaagatg

SEQ ID NO: 195261 - DNA, 103 bp, Artificial Sequence
  Synthetic Polynucleotide
taatacgactcactatagggttgaggggaagaactttgccgtcagaagaaaacagaggagattcttcatgcggcaaagtaacctggcggcagcgcaaaagatg

SEQ ID NO: 195262 - DNA, 103 bp, Artificial Sequence
  Synthetic Polynucleotide
taatacgactcactatagggcacctgtacattgaggggaagaactttgccaacagaggagaggcaaaatgcttcccctcaacctggcggcagcgcaaaagatg

SEQ ID NO: 195263 - DNA, 103 bp, Artificial Sequence
  Synthetic Polynucleotide
taatacgactcactataggggctgagtgaccacctgtacattgaggggaaaacagaggagattccccatgatgtacaggaacctggcggcagcgcaaaagatg

SEQ ID NO: 195264 - DNA, 103 bp, Artificial Sequence
  Synthetic Polynucleotide
taatacgactcactatagggttgtactcatcatagacttcctgtttgggcaacagaggagagcccaaatgggaagtctaaacctggcggcagcgcaaaagatg

SEQ ID NO: 195265 - DNA, 103 bp, Artificial Sequence
  Synthetic Polynucleotide
taatacgactcactataggggactgcatgtgctgagtgaccacctgtacaaacagaggagatgtacaatgggtcactcaaacctggcggcagcgcaaaagatg

SEQ ID NO: 195266 - DNA, 103 bp, Artificial Sequence
  Synthetic Polynucleotide
taatacgactcactatagggctgtttcacagactgcatgtgctgagtgacaacagaggagagtcactatgcacatgcagaacctggcggcagcgcaaaagatg

SEQ ID NO: 195267 - DNA, 103 bp, Artificial Sequence
  Synthetic Polynucleotide
taatacgactcactatagggtctttggtgcctgtttcacagactgcatgtaacagaggagaacatgcatgctgtgaaacaacctggcggcagcgcaaaagatg

SEQ ID NO: 195268 - DNA, 103 bp, Artificial Sequence
  Synthetic Polynucleotide
taatacgactcactatagggttctggggagtctttggtgcctgtttcacaaacagaggagatgtgaaatgggcaccaaaaacctggcggcagcgcaaaagatg

SEQ ID NO: 195269 - DNA, 103 bp, Artificial Sequence
  Synthetic Polynucleotide
taatacgactcactatagggggctggaacgttctggggagtctttggtgcaacagaggagagcaccaatgactccccagaacctggcggcagcgcaaaagatg

SEQ ID NO: 195270 - DNA, 103 bp, Artificial Sequence
  Synthetic Polynucleotide
taatacgactcactatagggcaccaggactggctggaacgttctggggagaacagaggagactccccatgacgttccagaacctggcggcagcgcaaaagatg

SEQ ID NO: 195271 - DNA, 103 bp, Artificial Sequence
  Synthetic Polynucleotide
taatacgactcactataggggaacgatccccaccaggactggctggaacgaacagaggagacgttccatgcagtcctggaacctggcggcagcgcaaaagatg

SEQ ID NO: 195272 - DNA, 103 bp, Artificial Sequence
  Synthetic Polynucleotide
taatacgactcactataggggtgccgggcagaacgatccccaccaggactaacagaggagaagtcctatgggggatcgtaacctggcggcagcgcaaaagatg

SEQ ID NO: 195273 - DNA, 103 bp, Artificial Sequence
  Synthetic Polynucleotide
taatacgactcactataggggagggtaacggtgccgggcagaacgatcccaacagaggagagggatcatgctgcccggcaacctggcggcagcgcaaaagatg

SEQ ID NO: 195274 - DNA, 103 bp, Artificial Sequence
  Synthetic Polynucleotide
taatacgactcactatagggggtaagatctgagggtaacggtgccgggcaaacagaggagatgcccgatgccgttacccaacctggcggcagcgcaaaagatg

SEQ ID NO: 195275 - DNA, 103 bp, Artificial Sequence
  Synthetic Polynucleotide
taatacgactcactatagggcccacaggtctccacgtaaatctcatacataacagaggagaatgtatatgatttacgtgaacctggcggcagcgcaaaagatg

SEQ ID NO: 195276 - DNA, 103 bp, Artificial Sequence
  Synthetic Polynucleotide
taatacgactcactatagggcaaaggggatccaactgggtctgtcttcataacagaggagaatgaagatggacccagttaacctggcggcagcgcaaaagatg

SEQ ID NO: 195277 - DNA, 103 bp, Artificial Sequence
  Synthetic Polynucleotide
taatacgactcactatagggcatgtcctcctcctcctcttcctcctctagaacagaggagactagagatggaagaggagaacctggcggcagcgcaaaagatg

SEQ ID NO: 195278 - DNA, 103 bp, Artificial Sequence
  Synthetic Polynucleotide
taatacgactcactatagggtgacagtccccatgtcctcctcctcctcttaacagaggagaaagaggatgaggaggacaaacctggcggcagcgcaaaagatg

SEQ ID NO: 195279 - DNA, 103 bp, Artificial Sequence
  Synthetic Polynucleotide
taatacgactcactatagggagcatttccttgacagtccccatgtcctccaacagaggagaggaggaatgggggactgtaacctggcggcagcgcaaaagatg

SEQ ID NO: 195280 - DNA, 103 bp, Artificial Sequence
  Synthetic Polynucleotide
taatacgactcactataggggtcatctggtagcatttccttgacagtcccaacagaggagagggactatgaaggaaatgaacctggcggcagcgcaaaagatg

SEQ ID NO: 195281 - DNA, 103 bp, Artificial Sequence
  Synthetic Polynucleotide
taatacgactcactatagggcgagagtcgggtcatctggtagcatttcctaacagaggagaaggaaaatgtaccagatgaacctggcggcagcgcaaaagatg

SEQ ID NO: 195282 - DNA, 103 bp, Artificial Sequence
  Synthetic Polynucleotide
taatacgactcactatagggtctggctggccgagagtcgggtcatctggtaacagaggagaaccagaatgcccgactctaacctggcggcagcgcaaaagatg

SEQ ID NO: 195283 - DNA, 103 bp, Artificial Sequence
  Synthetic Polynucleotide
taatacgactcactatagggaagtgcctggtctggctggccgagagtcggaacagaggagaccgactatgggccagccaaacctggcggcagcgcaaaagatg

SEQ ID NO: 195284 - DNA, 103 bp, Artificial Sequence
  Synthetic Polynucleotide
taatacgactcactataggggagaatggaaaagtgcctggtctggctggcaacagaggagagccagcatgaccaggcacaacctggcggcagcgcaaaagatg

SEQ ID NO: 195285 - DNA, 103 bp, Artificial Sequence
  Synthetic Polynucleotide
taatacgactcactataggggaggaattcagagaatggaaaagtgcctggaacagaggagaccaggcatgtttccattcaacctggcggcagcgcaaaagatg

SEQ ID NO: 195286 - DNA, 103 bp, Artificial Sequence
  Synthetic Polynucleotide
taatacgactcactatagggctgcgacagtgaggaattcagagaatggaaaacagaggagattccatatgctgaattccaacctggcggcagcgcaaaagatg

SEQ ID NO: 195287 - DNA, 103 bp, Artificial Sequence
  Synthetic Polynucleotide
taatacgactcactatagggtgaattcagacaaaggggatccaactgggtaacagaggagaacccagatggatccccttaacctggcggcagcgcaaaagatg

SEQ ID NO: 195288 - DNA, 103 bp, Artificial Sequence
  Synthetic Polynucleotide
taatacgactcactatagggtggcacacgcctgcgacagtgaggaattcaaacagaggagatgaattatgcactgtcgcaacctggcggcagcgcaaaagatg

SEQ ID NO: 195289 - DNA, 103 bp, Artificial Sequence
  Synthetic Polynucleotide
taatacgactcactatagggatgctggggctggcacacgcctgcgacagtaacagaggagaactgtcatgggcgtgtgcaacctggcggcagcgcaaaagatg

SEQ ID NO: 195290 - DNA, 103 bp, Artificial Sequence
  Synthetic Polynucleotide
taatacgactcactatagggcagtggctccatgctggggctggcacacgcaacagaggagagcgtgtatgagccccagcaacctggcggcagcgcaaaagatg

SEQ ID NO: 195291 - DNA, 103 bp, Artificial Sequence
  Synthetic Polynucleotide
taatacgactcactataggggcatcacccccagtggctccatgctggggcaacagaggagagccccaatgtggagccacaacctggcggcagcgcaaaagatg

SEQ ID NO: 195292 - DNA, 103 bp, Artificial Sequence
  Synthetic Polynucleotide
taatacgactcactatagggatgtgtgtgggcatcacccccagtggctccaacagaggagaggagccatggggggtgataacctggcggcagcgcaaaagatg

SEQ ID NO: 195293 - DNA, 103 bp, Artificial Sequence
  Synthetic Polynucleotide
taatacgactcactataggggccctggcccatgtgtgtgggcatcaccccaacagaggagaggggtgatgcccacacacaacctggcggcagcgcaaaagatg

SEQ ID NO: 195294 - DNA, 103 bp, Artificial Sequence
  Synthetic Polynucleotide
taatacgactcactatagggcgggatatcggccctggcccatgtgtgtggaacagaggagaccacacatgtgggccaggaacctggcggcagcgcaaaagatg

SEQ ID NO: 195295 - DNA, 103 bp, Artificial Sequence
  Synthetic Polynucleotide
taatacgactcactatagggctcacacccacgggatatcggccctggcccaacagaggagagggccaatgccgatatccaacctggcggcagcgcaaaagatg

SEQ ID NO: 195296 - DNA, 103 bp, Artificial Sequence
  Synthetic Polynucleotide
taatacgactcactataggggaccatgttgctcacacccacgggatatcgaacagaggagacgatatatggtgggtgtgaacctggcggcagcgcaaaagatg

SEQ ID NO: 195297 - DNA, 103 bp, Artificial Sequence
  Synthetic Polynucleotide
taatacgactcactatagggggatcctgaggaccatgttgctcacacccaaacagaggagatgggtgatggcaacatggaacctggcggcagcgcaaaagatg

SEQ ID NO: 195298 - DNA, 103 bp, Artificial Sequence
  Synthetic Polynucleotide
taatacgactcactatagggggacatctcctgaattcagacaaaggggataacagaggagaatccccatggtctgaattaacctggcggcagcgcaaaagatg

SEQ ID NO: 195299 - DNA, 103 bp, Artificial Sequence
  Synthetic Polynucleotide
taatacgactcactatagggaggaagcccaggatcctgaggaccatgttgaacagaggagacaacatatgcctcaggataacctggcggcagcgcaaaagatg

SEQ ID NO: 195300 - DNA, 103 bp, Artificial Sequence
  Synthetic Polynucleotide
taatacgactcactatagggagtgtccaccaggaagcccaggatcctgagaacagaggagactcaggatgctgggcttcaacctggcggcagcgcaaaagatg

SEQ ID NO: 195301 - DNA, 103 bp, Artificial Sequence
  Synthetic Polynucleotide
taatacgactcactatagggtgcccatggcagtgtccaccaggaagcccaaacagaggagatgggctatgtggtggacaaacctggcggcagcgcaaaagatg

SEQ ID NO: 195302 - DNA, 103 bp, Artificial Sequence
  Synthetic Polynucleotide
taatacgactcactatagggatgagcttattgcccatggcagtgtccaccaacagaggagaggtggaatgtgccatgggaacctggcggcagcgcaaaagatg

SEQ ID NO: 195303 - DNA, 103 bp, Artificial Sequence
  Synthetic Polynucleotide
taatacgactcactatagggcagcacctggatgagcttattgcccatggcaacagaggagagccatgatgaataagctcaacctggcggcagcgcaaaagatg

SEQ ID NO: 195304 - DNA, 103 bp, Artificial Sequence
  Synthetic Polynucleotide
taatacgactcactatagggcatcttccaacagcacctggatgagcttataacagaggagaataagcatgtccaggtgcaacctggcggcagcgcaaaagatg

SEQ ID NO: 195305 - DNA, 103 bp, Artificial Sequence
  Synthetic Polynucleotide
taatacgactcactatagggtcagtggtttcatcttccaacagcacctggaacagaggagaccaggtatggttggaagaaacctggcggcagcgcaaaagatg

SEQ ID NO: 195306 - DNA, 103 bp, Artificial Sequence
  Synthetic Polynucleotide
taatacgactcactatagggaactgcgctttcagtggtttcatcttccaaaacagaggagattggaaatggaaaccactaacctggcggcagcgcaaaagatg

SEQ ID NO: 195307 - DNA, 103 bp, Artificial Sequence
  Synthetic Polynucleotide
taatacgactcactatagggggctgagtttaactgcgctttcagtggtttaacagaggagaaaaccaatgaaagcgcagaacctggcggcagcgcaaaagatg

SEQ ID NO: 195308 - DNA, 103 bp, Artificial Sequence
  Synthetic Polynucleotide
taatacgactcactatagggcccataggaaggctgagtttaactgcgcttaacagaggagaaagcgcatgtaaactcagaacctggcggcagcgcaaaagatg

SEQ ID NO: 195309 - DNA, 103 bp, Artificial Sequence
  Synthetic Polynucleotide
taatacgactcactatagggctccagaaatggacatctcctgaattcagaaacagaggagatctgaaatgaggagatgtaacctggcggcagcgcaaaagatg

SEQ ID NO: 195310 - DNA, 103 bp, Artificial Sequence
  Synthetic Polynucleotide
taatacgactcactatagggggcttcttgtcccataggaaggctgagtttaacagaggagaaaactcatgcttcctatgaacctggcggcagcgcaaaagatg

SEQ ID NO: 195311 - DNA, 103 bp, Artificial Sequence
  Synthetic Polynucleotide
taatacgactcactataggggggttatgagggcttcttgtcccataggaaaacagaggagattcctaatggacaagaagaacctggcggcagcgcaaaagatg

SEQ ID NO: 195312 - DNA, 103 bp, Artificial Sequence
  Synthetic Polynucleotide
taatacgactcactatagggccatcttttagggttatgagggcttcttgtaacagaggagaacaagaatgcctcataacaacctggcggcagcgcaaaagatg

SEQ ID NO: 195313 - DNA, 103 bp, Artificial Sequence
  Synthetic Polynucleotide
taatacgactcactatagggaaattgttgtccatcttttagggttatgagaacagaggagactcataatgctaaaagataacctggcggcagcgcaaaagatg

SEQ ID NO: 195314 - DNA, 103 bp, Artificial Sequence
  Synthetic Polynucleotide
taatacgactcactatagggtctgaatcacaaattgttgtccatcttttaaacagaggagataaaagatggacaacaataacctggcggcagcgcaaaagatg

SEQ ID NO: 195315 - DNA, 103 bp, Artificial Sequence
  Synthetic Polynucleotide
taatacgactcactatagggacatctgatatctgaatcacaaattgttgtaacagaggagaacaacaatgtgtgattcaaacctggcggcagcgcaaaagatg

SEQ ID NO: 195316 - DNA, 103 bp, Artificial Sequence
  Synthetic Polynucleotide
taatacgactcactataggggctttggggtacatctgatatctgaatcacaacagaggagagtgattatgatatcagataacctggcggcagcgcaaaagatg

SEQ ID NO: 195317 - DNA, 103 bp, Artificial Sequence
  Synthetic Polynucleotide
taatacgactcactatagggtatcttcagagctttggggtacatctgataaacagaggagatatcagatgtaccccaaaaacctggcggcagcgcaaaagatg

SEQ ID NO: 195318 - DNA, 103 bp, Artificial Sequence
  Synthetic Polynucleotide
taatacgactcactatagggctgaaataaatatcttcagagctttggggtaacagaggagaaccccaatgctctgaagaaacctggcggcagcgcaaaagatg

SEQ ID NO: 195319 - DNA, 103 bp, Artificial Sequence
  Synthetic Polynucleotide
taatacgactcactatagggattgttttctctgaaataaatatcttcagaaacagaggagatctgaaatgatttatttcaacctggcggcagcgcaaaagatg

SEQ ID NO: 195320 - DNA, 103 bp, Artificial Sequence
  Synthetic Polynucleotide
taatacgactcactatagggcctgttcttgctccagaaatggacatctccaacagaggagaggagatatgcatttctggaacctggcggcagcgcaaaagatg

SEQ ID NO: 195321 - DNA, 103 bp, Artificial Sequence
  Synthetic Polynucleotide
taatacgactcactatagggacacattagcattgttttctctgaaataaaaacagaggagatttattatggagaaaacaaacctggcggcagcgcaaaagatg

SEQ ID NO: 195322 - DNA, 103 bp, Artificial Sequence
  Synthetic Polynucleotide
taatacgactcactatagggtatttctttgcctgttcttgctccagaaataacagaggagaatttctatggcaagaacaaacctggcggcagcgcaaaagatg

SEQ ID NO: 195323 - DNA, 103 bp, Artificial Sequence
  Synthetic Polynucleotide
taatacgactcactatagggattacaggagtatttctttgcctgttcttgaacagaggagacaagaaatggcaaagaaaaacctggcggcagcgcaaaagatg

SEQ ID NO: 195324 - DNA, 103 bp, Artificial Sequence
  Synthetic Polynucleotide
taatacgactcactatagggaggccatcatattacaggagtatttctttgaacagaggagacaaagaatgactcctgtaaacctggcggcagcgcaaaagatg

SEQ ID NO: 195325 - DNA, 103 bp, Artificial Sequence
  Synthetic Polynucleotide
taatacgactcactatagggtcagcaaggaaggccatcatattacaggagaacagaggagactcctgatgtatgatggcaacctggcggcagcgcaaaagatg

SEQ ID NO: 195326 - DNA, 103 bp, Artificial Sequence
  Synthetic Polynucleotide
taatacgactcactataggggcagtattcgtcagcaaggaaggccatcataacagaggagaatgatgatgttccttgctaacctggcggcagcgcaaaagatg

SEQ ID NO: 195327 - DNA, 103 bp, Artificial Sequence
  Synthetic Polynucleotide
taatacgactcactatagggcagtgttttgcccacaggtctccacgtaaaaacagaggagatttacgatgagacctgtgaacctggcggcagcgcaaaagatg

SEQ ID NO: 195328 - DNA, 103 bp, Artificial Sequence
  Synthetic Polynucleotide
taatacgactcactataggggacaatagttgcagtattcgtcagcaaggaaacagaggagatccttgatgacgaatactaacctggcggcagcgcaaaagatg

SEQ ID NO: 195329 - DNA, 103 bp, Artificial Sequence
  Synthetic Polynucleotide
taatacgactcactatagggaaaatgtctcgacaatagttgcagtattcgaacagaggagacgaataatgcaactattgaacctggcggcagcgcaaaagatg

SEQ ID NO: 195330 - DNA, 103 bp, Artificial Sequence
  Synthetic Polynucleotide
taatacgactcactatagggcacatttcgtaaaatgtctcgacaatagttaacagaggagaaactatatgcgagacattaacctggcggcagcgcaaaagatg

SEQ ID NO: 195331 - DNA, 103 bp, Artificial Sequence
  Synthetic Polynucleotide
taatacgactcactataggggcaagtcctccacatttcgtaaaatgtctcaacagaggagagagacaatgtacgaaatgaacctggcggcagcgcaaaagatg

SEQ ID NO: 195332 - DNA, 103 bp, Artificial Sequence
  Synthetic Polynucleotide
taatacgactcactatagggaaggaagtaagcaagtcctccacatttcgtaacagaggagaacgaaaatgggaggacttaacctggcggcagcgcaaaagatg

SEQ ID NO: 195333 - DNA, 103 bp, Artificial Sequence
  Synthetic Polynucleotide
taatacgactcactatagggagacttccagaaggaagtaagcaagtcctcaacagaggagagaggacatgcttacttccaacctggcggcagcgcaaaagatg

SEQ ID NO: 195334 - DNA, 103 bp, Artificial Sequence
  Synthetic Polynucleotide
taatacgactcactatagggcttgctgcagagacttccagaaggaagtaaaacagaggagattacttatgtctggaagtaacctggcggcagcgcaaaagatg

SEQ ID NO: 195335 - DNA, 103 bp, Artificial Sequence
  Synthetic Polynucleotide
taatacgactcactatagggatgactgtgtcttgctgcagagacttccagaacagaggagactggaaatgtctgcagcaaacctggcggcagcgcaaaagatg

SEQ ID NO: 195336 - DNA, 103 bp, Artificial Sequence
  Synthetic Polynucleotide
taatacgactcactatagggtgacatcagcatgactgtgtcttgctgcagaacagaggagactgcagatggacacagtcaacctggcggcagcgcaaaagatg

SEQ ID NO: 195337 - DNA, 103 bp, Artificial Sequence
  Synthetic Polynucleotide
taatacgactcactatagggcgtcaggcaatgacatcagcatgactgtgtaacagaggagaacacagatgtgctgatgtaacctggcggcagcgcaaaagatg

SEQ ID NO: 195338 - DNA, 103 bp, Artificial Sequence
  Synthetic Polynucleotide
taatacgactcactatagggacttggttctcagtgttttgcccacaggtcaacagaggagagacctgatggcaaaacacaacctggcggcagcgcaaaagatg

SEQ ID NO: 195339 - DNA, 103 bp, Artificial Sequence
  Synthetic Polynucleotide
taatacgactcactatagggagctggcacacgtcaggcaatgacatcagcaacagaggagagctgatatgattgcctgaaacctggcggcagcgcaaaagatg

SEQ ID NO: 195340 - DNA, 103 bp, Artificial Sequence
  Synthetic Polynucleotide
taatacgactcactataggggcatttaaagagctggcacacgtcaggcaaaacagaggagattgcctatggtgtgccagaacctggcggcagcgcaaaagatg

SEQ ID NO: 195341 - DNA, 103 bp, Artificial Sequence
  Synthetic Polynucleotide
taatacgactcactatagggggacgtcgtagcatttaaagagctggcacaaacagaggagatgtgccatgtctttaaataacctggcggcagcgcaaaagatg

SEQ ID NO: 195342 - DNA, 103 bp, Artificial Sequence
  Synthetic Polynucleotide
taatacgactcactatagggttgtacagctggacgtcgtagcatttaaagaacagaggagactttaaatgctacgacgtaacctggcggcagcgcaaaagatg

SEQ ID NO: 195343 - DNA, 103 bp, Artificial Sequence
  Synthetic Polynucleotide
taatacgactcactatagggctcaattcccttgtacagctggacgtcgtaaacagaggagatacgacatgcagctgtacaacctggcggcagcgcaaaagatg

SEQ ID NO: 195344 - DNA, 103 bp, Artificial Sequence
  Synthetic Polynucleotide
taatacgactcactatagggggagaacatcctcaattcccttgtacagctaacagaggagaagctgtatgagggaattgaacctggcggcagcgcaaaagatg

SEQ ID NO: 195345 - DNA, 103 bp, Artificial Sequence
  Synthetic Polynucleotide
taatacgactcactatagggaagtcatgaaggagaacatcctcaattcccaacagaggagagggaatatgggatgttctaacctggcggcagcgcaaaagatg

SEQ ID NO: 195346 - DNA, 103 bp, Artificial Sequence
  Synthetic Polynucleotide
taatacgactcactatagggatcttccaagaagtcatgaaggagaacatcaacagaggagagatgttatgcttcatgacaacctggcggcagcgcaaaagatg

SEQ ID NO: 195347 - DNA, 103 bp, Artificial Sequence
  Synthetic Polynucleotide
taatacgactcactataggggaatagaaacatcttccaagaagtcatgaaaacagaggagattcatgatgtcttggaagaacctggcggcagcgcaaaagatg

SEQ ID NO: 195348 - DNA, 103 bp, Artificial Sequence
  Synthetic Polynucleotide
taatacgactcactatagggttcaggtactgaatagaaacatcttccaagaacagaggagacttggaatgtgtttctataacctggcggcagcgcaaaagatg

SEQ ID NO: 195349 - DNA, 103 bp, Artificial Sequence
  Synthetic Polynucleotide
taatacgactcactatagggggccgggttgacttggttctcagtgttttgaacagaggagacaaaacatggagaaccaaaacctggcggcagcgcaaaagatg

SEQ ID NO: 195350 - DNA, 103 bp, Artificial Sequence
  Synthetic Polynucleotide
taatacgactcactatagggctgcacagatttcaggtactgaatagaaacaacagaggagagtttctatgcagtacctgaacctggcggcagcgcaaaagatg

SEQ ID NO: 195351 - DNA, 103 bp, Artificial Sequence
  Synthetic Polynucleotide
taatacgactcactatagggtactaaataactgcacagatttcaggtactaacagaggagaagtaccatgaatctgtgcaacctggcggcagcgcaaaagatg

SEQ ID NO: 195352 - DNA, 103 bp, Artificial Sequence
  Synthetic Polynucleotide
taatacgactcactatagggttaaatttcttactaaataactgcacagataacagaggagaatctgtatggttatttagaacctggcggcagcgcaaaagatg

SEQ ID NO: 195353 - DNA, 103 bp, Artificial Sequence
  Synthetic Polynucleotide
taatacgactcactataggggagccacagcttaaatttcttactaaataaaacagaggagattatttatgaagaaatttaacctggcggcagcgcaaaagatg

SEQ ID NO: 195354 - DNA, 103 bp, Artificial Sequence
  Synthetic Polynucleotide
taatacgactcactatagggaagcattaaggagccacagcttaaatttctaacagaggagaagaaatatgagctgtggcaacctggcggcagcgcaaaagatg

SEQ ID NO: 195355 - DNA, 103 bp, Artificial Sequence
  Synthetic Polynucleotide
taatacgactcactatagggacaccttccaaagcattaaggagccacagcaacagaggagagctgtgatgccttaatgcaacctggcggcagcgcaaaagatg

SEQ ID NO: 195356 - DNA, 103 bp, Artificial Sequence
  Synthetic Polynucleotide
taatacgactcactataggggagggctggaacaccttccaaagcattaagaacagaggagacttaatatgttggaaggtaacctggcggcagcgcaaaagatg

SEQ ID NO: 195357 - DNA, 103 bp, Artificial Sequence
  Synthetic Polynucleotide
taatacgactcactatagggagatctgcaagagggctggaacaccttccaaacagaggagatggaagatgttccagcccaacctggcggcagcgcaaaagatg

SEQ ID NO: 195358 - DNA, 103 bp, Artificial Sequence
  Synthetic Polynucleotide
taatacgactcactatagggttgagtttggagatctgcaagagggctggaaacagaggagatccagcatgcttgcagataacctggcggcagcgcaaaagatg

SEQ ID NO: 195359 - DNA, 103 bp, Artificial Sequence
  Synthetic Polynucleotide
taatacgactcactatagggagtaacttctttgagtttggagatctgcaaaacagaggagattgcagatgtccaaactcaacctggcggcagcgcaaaagatg

SEQ ID NO: 195360 - DNA, 103 bp, Artificial Sequence
  Synthetic Polynucleotide
taatacgactcactatagggtcccaaaggtggccgggttgacttggttctaacagaggagaagaaccatgtcaacccggaacctggcggcagcgcaaaagatg

SEQ ID NO: 195361 - DNA, 103 bp, Artificial Sequence
  Synthetic Polynucleotide
taatacgactcactatagggtgacaaatagagtaacttctttgagtttggaacagaggagaccaaacatgaagaagttaaacctggcggcagcgcaaaagatg

SEQ ID NO: 195362 - DNA, 103 bp, Artificial Sequence
  Synthetic Polynucleotide
taatacgactcactatagggcttagtcttttgacaaatagagtaacttctaacagaggagaagaagtatgtctatttgtaacctggcggcagcgcaaaagatg

SEQ ID NO: 195363 - DNA, 103 bp, Artificial Sequence
  Synthetic Polynucleotide
taatacgactcactatagggcgtctttcttcttagtcttttgacaaatagaacagaggagactatttatgaaaagactaaacctggcggcagcgcaaaagatg

SEQ ID NO: 195364 - DNA, 103 bp, Artificial Sequence
  Synthetic Polynucleotide
taatacgactcactatagggtggaaaggtacgtctttcttcttagtctttaacagaggagaaaagacatggaagaaagaaacctggcggcagcgcaaaagatg

SEQ ID NO: 195365 - DNA, 103 bp, Artificial Sequence
  Synthetic Polynucleotide
taatacgactcactatagggttagccatgttggaaaggtacgtctttcttaacagaggagaaagaaaatggtacctttcaacctggcggcagcgcaaaagatg

SEQ ID NO: 195366 - DNA, 103 bp, Artificial Sequence
  Synthetic Polynucleotide
taatacgactcactatagggtcgcatagtcttagccatgttggaaaggtaaacagaggagataccttatgaacatggctaacctggcggcagcgcaaaagatg

SEQ ID NO: 195367 - DNA, 103 bp, Artificial Sequence
  Synthetic Polynucleotide
taatacgactcactatagggtcaataccattcgcatagtcttagccatgtaacagaggagaacatggatgagactatgcaacctggcggcagcgcaaaagatg

SEQ ID NO: 195368 - DNA, 103 bp, Artificial Sequence
  Synthetic Polynucleotide
taatacgactcactatagggctcttacttttcaataccattcgcatagtcaacagaggagagactatatgaatggtattaacctggcggcagcgcaaaagatg

SEQ ID NO: 195369 - DNA, 103 bp, Artificial Sequence
  Synthetic Polynucleotide
taatacgactcactataggggctgacacgcctcttacttttcaataccataacagaggagaatggtaatgaaaagtaagaacctggcggcagcgcaaaagatg

SEQ ID NO: 195370 - DNA, 103 bp, Artificial Sequence
  Synthetic Polynucleotide
taatacgactcactatagggacttcaaaacgctgacacgcctcttactttaacagaggagaaaagtaatgggcgtgtcaaacctggcggcagcgcaaaagatg

SEQ ID NO: 195371 - DNA, 103 bp, Artificial Sequence
  Synthetic Polynucleotide
taatacgactcactatagggtcttcacacttcccaaaggtggccgggttgaacagaggagacaacccatgcacctttggaacctggcggcagcgcaaaagatg

SEQ ID NO: 195372 - DNA, 103 bp, Artificial Sequence
  Synthetic Polynucleotide
taatacgactcactatagggtgtagatctgacttcaaaacgctgacacgcaacagaggagagcgtgtatgcgttttgaaaacctggcggcagcgcaaaagatg

SEQ ID NO: 195373 - DNA, 103 bp, Artificial Sequence
  Synthetic Polynucleotide
taatacgactcactataggggatgatggcctgtagatctgacttcaaaacaacagaggagagttttgatgtcagatctaaacctggcggcagcgcaaaagatg

SEQ ID NO: 195374 - DNA, 103 bp, Artificial Sequence
  Synthetic Polynucleotide
taatacgactcactatagggtgccttgattgatgatggcctgtagatctgaacagaggagacagatcatgaggccatcaaacctggcggcagcgcaaaagatg

SEQ ID NO: 195375 - DNA, 103 bp, Artificial Sequence
  Synthetic Polynucleotide
taatacgactcactataggggtagccaaagtgccttgattgatgatggccaacagaggagaggccatatgcaatcaaggaacctggcggcagcgcaaaagatg

SEQ ID NO: 195376 - DNA, 103 bp, Artificial Sequence
  Synthetic Polynucleotide
taatacgactcactatagggtttcttagaagtagccaaagtgccttgattaacagaggagaaatcaaatgactttggctaacctggcggcagcgcaaaagatg

SEQ ID NO: 195377 - DNA, 103 bp, Artificial Sequence
  Synthetic Polynucleotide
taatacgactcactatagggttgccagggctttcttagaagtagccaaagaacagaggagactttggatgcttctaagaaacctggcggcagcgcaaaagatg

SEQ ID NO: 195378 - DNA, 103 bp, Artificial Sequence
  Synthetic Polynucleotide
taatacgactcactatagggctccggtcacttgccagggctttcttagaaaacagaggagattctaaatgagccctggcaacctggcggcagcgcaaaagatg

SEQ ID NO: 195379 - DNA, 103 bp, Artificial Sequence
  Synthetic Polynucleotide
taatacgactcactatagggatctgcgccactccggtcacttgccagggcaacagaggagagccctgatgagtgaccggaacctggcggcagcgcaaaagatg

SEQ ID NO: 195380 - DNA, 103 bp, Artificial Sequence
  Synthetic Polynucleotide
taatacgactcactatagggtctccagttcatctgcgccactccggtcacaacagaggagagtgaccatggtggcgcagaacctggcggcagcgcaaaagatg

SEQ ID NO: 195381 - DNA, 103 bp, Artificial Sequence
  Synthetic Polynucleotide
taatacgactcactatagggtctgggttgttctccagttcatctgcgccaaacagaggagatggcgcatgtgaactggaaacctggcggcagcgcaaaagatg

SEQ ID NO: 195382 - DNA, 103 bp, Artificial Sequence
  Synthetic Polynucleotide
taatacgactcactatagggcggtgaatgatcttcacacttcccaaaggtaacagaggagaacctttatgaagtgtgaaaacctggcggcagcgcaaaagatg

SEQ ID NO: 195383 - DNA, 103 bp, Artificial Sequence
  Synthetic Polynucleotide
taatacgactcactatagggacatttcatctctgggttgttctccagttcaacagaggagagaactgatgaacaacccaaacctggcggcagcgcaaaagatg

SEQ ID NO: 195384 - DNA, 103 bp, Artificial Sequence
  Synthetic Polynucleotide
taatacgactcactatagggagtttcttaaacatttcatctctgggttgtaacagaggagaacaaccatgagatgaaataacctggcggcagcgcaaaagatg

SEQ ID NO: 195385 - DNA, 103 bp, Artificial Sequence
  Synthetic Polynucleotide
taatacgactcactatagggaaagaaattaagtttcttaaacatttcatcaacagaggagagatgaaatgtttaagaaaaacctggcggcagcgcaaaagatg

SEQ ID NO: 195386 - DNA, 103 bp, Artificial Sequence
  Synthetic Polynucleotide
taatacgactcactatagggtgttcccagcaaagaaattaagtttcttaaaacagaggagattaagaatgttaatttctaacctggcggcagcgcaaaagatg

SEQ ID NO: 195387 - DNA, 103 bp, Artificial Sequence
  Synthetic Polynucleotide
taatacgactcactataggggatctgttgatgttcccagcaaagaaattaaacagaggagataatttatgtgctgggaaaacctggcggcagcgcaaaagatg

SEQ ID NO: 195388 - DNA, 103 bp, Artificial Sequence
  Synthetic Polynucleotide
taatacgactcactatagggaataccctgagatctgttgatgttcccagcaacagaggagagctgggatgatcaacagaaacctggcggcagcgcaaaagatg

SEQ ID NO: 195389 - DNA, 103 bp, Artificial Sequence
  Synthetic Polynucleotide
taatacgactcactatagggacagctgaggaataccctgagatctgttgaaacagaggagatcaacaatgctcagggtaaacctggcggcagcgcaaaagatg

SEQ ID NO: 195390 - DNA, 103 bp, Artificial Sequence
  Synthetic Polynucleotide
taatacgactcactataggggtgaagacagacagctgaggaataccctgaaacagaggagatcagggatgtcctcagctaacctggcggcagcgcaaaagatg

SEQ ID NO: 195391 - DNA, 103 bp, Artificial Sequence
  Synthetic Polynucleotide
taatacgactcactataggggcttggagatgtgaagacagacagctgaggaacagaggagacctcagatgtctgtcttcaacctggcggcagcgcaaaagatg

SEQ ID NO: 195392 - DNA, 103 bp, Artificial Sequence
  Synthetic Polynucleotide
taatacgactcactataggggaacacaaatgcttggagatgtgaagacagaacagaggagactgtctatgcatctccaaaacctggcggcagcgcaaaagatg

SEQ ID NO: 195393 - DNA, 103 bp, Artificial Sequence
  Synthetic Polynucleotide
taatacgactcactatagggctgtcttcatcggtgaatgatcttcacactaacagaggagaagtgtgatgatcattcacaacctggcggcagcgcaaaagatg

SEQ ID NO: 195394 - DNA, 103 bp, Artificial Sequence
  Synthetic Polynucleotide
taatacgactcactatagggtgcttgtctggaacacaaatgcttggagataacagaggagaatctccatgcatttgtgtaacctggcggcagcgcaaaagatg

SEQ ID NO: 195395 - DNA, 103 bp, Artificial Sequence
  Synthetic Polynucleotide
taatacgactcactatagggtctttgcttctgcttgtctggaacacaaataacagaggagaatttgtatgccagacaagaacctggcggcagcgcaaaagatg

SEQ ID NO: 195396 - DNA, 103 bp, Artificial Sequence
  Synthetic Polynucleotide
taatacgactcactatagggggtaaactcttctttgcttctgcttgtctgaacagaggagacagacaatgagaagcaaaaacctggcggcagcgcaaaagatg

SEQ ID NO: 195397 - DNA, 103 bp, Artificial Sequence
  Synthetic Polynucleotide
taatacgactcactatagggcggccaatttggtaaactcttctttgcttcaacagaggagagaagcaatgaagagtttaaacctggcggcagcgcaaaagatg

SEQ ID NO: 195398 - DNA, 103 bp, Artificial Sequence
  Synthetic Polynucleotide
taatacgactcactatagggtggaagctggcggccaatttggtaaactctaacagaggagaagagttatgcaaattggcaacctggcggcagcgcaaaagatg

SEQ ID NO: 195399 - DNA, 103 bp, Artificial Sequence
  Synthetic Polynucleotide
taatacgactcactatagggccatctcagctggaagctggcggccaatttaacagaggagaaaattgatggccagcttcaacctggcggcagcgcaaaagatg

SEQ ID NO: 195400 - DNA, 103 bp, Artificial Sequence
  Synthetic Polynucleotide
taatacgactcactataggggaagaagattccatctcagctggaagctggaacagaggagaccagctatgagctgagataacctggcggcagcgcaaaagatg

SEQ ID NO: 195401 - DNA, 103 bp, Artificial Sequence
  Synthetic Polynucleotide
taatacgactcactatagggacagcagtgagaagaagattccatctcagcaacagaggagagctgagatggaatcttctaacctggcggcagcgcaaaagatg

SEQ ID NO: 195402 - DNA, 103 bp, Artificial Sequence
  Synthetic Polynucleotide
taatacgactcactatagggggctttgcttacagcagtgagaagaagattaacagaggagaaatcttatgctcactgctaacctggcggcagcgcaaaagatg

SEQ ID NO: 195403 - DNA, 103 bp, Artificial Sequence
  Synthetic Polynucleotide
taatacgactcactatagggagagggtcatggctttgcttacagcagtgaaacagaggagatcactgatgtaagcaaagaacctggcggcagcgcaaaagatg

SEQ ID NO: 195404 - DNA, 103 bp, Artificial Sequence
  Synthetic Polynucleotide
taatacgactcactatagggccaactgggtctgtcttcatcggtgaatgaaacagaggagatcattcatggatgaagacaacctggcggcagcgcaaaagatg

SEQ ID NO: 195405 - DNA, 103 bp, Artificial Sequence
  Synthetic Polynucleotide
taatacgactcactatagggtctctgtggcagagggtcatggctttgcttaacagaggagaaagcaaatgcatgaccctaacctggcggcagcgcaaaagatg

SEQ ID NO: 195406 - DNA, 103 bp, Artificial Sequence
  Synthetic Polynucleotide
taatacgactcactataggggccaaaactatctctgtggcagagggtcataacagaggagaatgaccatgtgccacagaaacctggcggcagcgcaaaagatg

SEQ ID NO: 195407 - DNA, 103 bp, Artificial Sequence
  Synthetic Polynucleotide
taatacgactcactataggggatgccaggagccaaaactatctctgtggcaacagaggagagccacaatgatagttttgaacctggcggcagcgcaaaagatg

SEQ ID NO: 195408 - DNA, 103 bp, Artificial Sequence
  Synthetic Polynucleotide
taatacgactcactatagggaagtgaaacagatgccaggagccaaaactaaacagaggagatagtttatgctcctggcaaacctggcggcagcgcaaaagatg

SEQ ID NO: 195409 - DNA, 103 bp, Artificial Sequence
  Synthetic Polynucleotide
taatacgactcactatagggcaaaagcaacaagtgaaacagatgccaggaaacagaggagatcctggatgctgtttcacaacctggcggcagcgcaaaagatg

SEQ ID NO: 195410 - DNA, 103 bp, Artificial Sequence
  Synthetic Polynucleotide
taatacgactcactatagggtcatatattccaaaagcaacaagtgaaacaaacagaggagatgtttcatgtgttgctttaacctggcggcagcgcaaaagatg

SEQ ID NO: 195411 - DNA, 103 bp, Artificial Sequence
  Synthetic Polynucleotide
taatacgactcactatagggagtatatgaatcatatattccaaaagcaacaacagaggagagttgctatgggaatatataacctggcggcagcgcaaaagatg

SEQ ID NO: 195412 - DNA, 103 bp, Artificial Sequence
  Synthetic Polynucleotide
taatacgactcactataggggcatgactgaagtatatgaatcatatattcaacagaggagagaatatatgattcatataaacctggcggcagcgcaaaagatg

SEQ ID NO: 195413 - DNA, 103 bp, Artificial Sequence
  Synthetic Polynucleotide
taatacgactcactatagggcctcctctaggcatgactgaagtatatgaaaacagaggagattcataatgttcagtcataacctggcggcagcgcaaaagatg

SEQ ID NO: 195414 - DNA, 103 bp, Artificial Sequence
  Synthetic Polynucleotide
taatacgactcactatagggtcctcctcttcctcctctaggcatgactgaaacagaggagatcagtcatgcctagaggaaacctggcggcagcgcaaaagatg

SEQ ID NO: 195415 - DNA, 103 bp, Artificial Sequence
  Synthetic Polynucleotide
taatacgactcactatagggggcggcggcgttgggggagctcagcggcataacagaggagaatgccgatgagctcccccaacctggcggcagcgcaaaagatg

SEQ ID NO: 195416 - DNA, 103 bp, Artificial Sequence
  Synthetic Polynucleotide
taatacgactcactatagggggcggagcggggcggctgttgccctttgctaacagaggagaagcaaaatgcaacagccgaacctggcggcagcgcaaaagatg

SEQ ID NO: 195417 - DNA, 103 bp, Artificial Sequence
  Synthetic Polynucleotide
taatacgactcactatagggcacctgctccttagaggccagcagcaacttaacagaggagaaagttgatgctggcctctaacctggcggcagcgcaaaagatg

SEQ ID NO: 195418 - DNA, 103 bp, Artificial Sequence
  Synthetic Polynucleotide
taatacgactcactatagggcccggtgcagcacctgctccttagaggccaaacagaggagatggcctatgaggagcaggaacctggcggcagcgcaaaagatg

SEQ ID NO: 195419 - DNA, 103 bp, Artificial Sequence
  Synthetic Polynucleotide
taatacgactcactatagggtccagaactacccggtgcagcacctgctccaacagaggagaggagcaatggctgcaccgaacctggcggcagcgcaaaagatg

SEQ ID NO: 195420 - DNA, 103 bp, Artificial Sequence
  Synthetic Polynucleotide
taatacgactcactatagggtactttctcctccagaactacccggtgcagaacagaggagactgcacatggtagttctgaacctggcggcagcgcaaaagatg

SEQ ID NO: 195421 - DNA, 103 bp, Artificial Sequence
  Synthetic Polynucleotide
taatacgactcactataggggctctagtgctactttctcctccagaactaaacagaggagatagttcatgaggagaaagaacctggcggcagcgcaaaagatg

SEQ ID NO: 195422 - DNA, 103 bp, Artificial Sequence
  Synthetic Polynucleotide
taatacgactcactataggggccagctgctgctctagtgctactttctccaacagaggagaggagaaatgagcactagaaacctggcggcagcgcaaaagatg

SEQ ID NO: 195423 - DNA, 103 bp, Artificial Sequence
  Synthetic Polynucleotide
taatacgactcactatagggcttctcctctgccagctgctgctctagtgcaacagaggagagcactaatgcagcagctgaacctggcggcagcgcaaaagatg

SEQ ID NO: 195424 - DNA, 103 bp, Artificial Sequence
  Synthetic Polynucleotide
taatacgactcactatagggcgggagtgtgcttctcctctgccagctgctaacagaggagaagcagcatgcagaggagaaacctggcggcagcgcaaaagatg

SEQ ID NO: 195425 - DNA, 103 bp, Artificial Sequence
  Synthetic Polynucleotide
taatacgactcactatagggaagcaggactcgggagtgtgcttctcctctaacagaggagaagaggaatggcacactccaacctggcggcagcgcaaaagatg

SEQ ID NO: 195426 - DNA, 103 bp, Artificial Sequence
  Synthetic Polynucleotide
taatacgactcactatagggtgcctcaataaagcaggactcgggagtgtgaacagaggagacacactatggagtcctgcaacctggcggcagcgcaaaagatg

SEQ ID NO: 195427 - DNA, 103 bp, Artificial Sequence
  Synthetic Polynucleotide
taatacgactcactataggggccccgccgaggcggagcggggcggctgttaacagaggagaaacagcatgcccgctccgaacctggcggcagcgcaaaagatg

SEQ ID NO: 195428 - DNA, 103 bp, Artificial Sequence
  Synthetic Polynucleotide
taatacgactcactatagggcctggatagctgcctcaataaagcaggactaacagaggagaagtcctatgttattgaggaacctggcggcagcgcaaaagatg

SEQ ID NO: 195429 - DNA, 103 bp, Artificial Sequence
  Synthetic Polynucleotide
taatacgactcactataggggtcttgagctcctggatagctgcctcaataaacagaggagatattgaatgagctatccaaacctggcggcagcgcaaaagatg

SEQ ID NO: 195430 - DNA, 103 bp, Artificial Sequence
  Synthetic Polynucleotide
taatacgactcactatagggctcttcccgagtcttgagctcctggatagcaacagaggagagctatcatggagctcaagaacctggcggcagcgcaaaagatg

SEQ ID NO: 195431 - DNA, 103 bp, Artificial Sequence
  Synthetic Polynucleotide
taatacgactcactatagggccgacagagcctcttcccgagtcttgagctaacagaggagaagctcaatgctcgggaagaacctggcggcagcgcaaaagatg

SEQ ID NO: 195432 - DNA, 103 bp, Artificial Sequence
  Synthetic Polynucleotide
taatacgactcactatagggccggccaatcccgacagagcctcttcccgaaacagaggagatcgggaatgggctctgtcaacctggcggcagcgcaaaagatg

SEQ ID NO: 195433 - DNA, 103 bp, Artificial Sequence
  Synthetic Polynucleotide
taatacgactcactatagggccttctgcttccggccaatcccgacagagcaacagaggagagctctgatgggattggccaacctggcggcagcgcaaaagatg

SEQ ID NO: 195434 - DNA, 103 bp, Artificial Sequence
  Synthetic Polynucleotide
taatacgactcactatagggcagtgacctcccttctgcttccggccaatcaacagaggagagattggatggaagcagaaaacctggcggcagcgcaaaagatg

SEQ ID NO: 195435 - DNA, 103 bp, Artificial Sequence
  Synthetic Polynucleotide
taatacgactcactataggggccacaacaccagtgacctcccttctgcttaacagaggagaaagcagatgggaggtcacaacctggcggcagcgcaaaagatg

SEQ ID NO: 195436 - DNA, 103 bp, Artificial Sequence
  Synthetic Polynucleotide
taatacgactcactatagggttccagagcagccacaacaccagtgacctcaacagaggagagaggtcatgggtgttgtgaacctggcggcagcgcaaaagatg

SEQ ID NO: 195437 - DNA, 103 bp, Artificial Sequence
  Synthetic Polynucleotide
taatacgactcactataggggcaccagttgttccagagcagccacaacacaacagaggagagtgttgatgctgctctggaacctggcggcagcgcaaaagatg

SEQ ID NO: 195438 - DNA, 103 bp, Artificial Sequence
  Synthetic Polynucleotide
taatacgactcactatagggtcgccggctggccccgccgaggcggagcggaacagaggagaccgctcatgctcggcgggaacctggcggcagcgcaaaagatg

SEQ ID NO: 195439 - DNA, 103 bp, Artificial Sequence
  Synthetic Polynucleotide
taatacgactcactatagggggagccatcagcaccagttgttccagagcaaacagaggagatgctctatgacaactggtaacctggcggcagcgcaaaagatg

SEQ ID NO: 195440 - DNA, 103 bp, Artificial Sequence
  Synthetic Polynucleotide
taatacgactcactatagggcttcgccaagggagccatcagcaccagttgaacagaggagacaactgatgctgatggctaacctggcggcagcgcaaaagatg

SEQ ID NO: 195441 - DNA, 103 bp, Artificial Sequence
  Synthetic Polynucleotide
taatacgactcactatagggaaacagactccttcgccaagggagccatcaaacagaggagatgatggatgccttggcgaaacctggcggcagcgcaaaagatg

SEQ ID NO: 195442 - DNA, 103 bp, Artificial Sequence
  Synthetic Polynucleotide
taatacgactcactatagggctgggttgaaaaacagactccttcgccaagaacagaggagacttggcatgggagtctgtaacctggcggcagcgcaaaagatg

SEQ ID NO: 195443 - DNA, 103 bp, Artificial Sequence
  Synthetic Polynucleotide
taatacgactcactatagggcacacccttcctgggttgaaaaacagactcaacagaggagagagtctatgtttcaacccaacctggcggcagcgcaaaagatg

SEQ ID NO: 195444 - DNA, 103 bp, Artificial Sequence
  Synthetic Polynucleotide
taatacgactcactataggggatactccagcacacccttcctgggttgaaaacagaggagattcaacatgggaagggtgaacctggcggcagcgcaaaagatg

SEQ ID NO: 195445 - DNA, 103 bp, Artificial Sequence
  Synthetic Polynucleotide
taatacgactcactatagggaaggcagacagatactccagcacacccttcaacagaggagagaagggatggctggagtaaacctggcggcagcgcaaaagatg

SEQ ID NO: 195446 - DNA, 103 bp, Artificial Sequence
  Synthetic Polynucleotide
taatacgactcactatagggttcttcatcgaaggcagacagatactccagaacagaggagactggagatgctgtctgccaacctggcggcagcgcaaaagatg

SEQ ID NO: 195447 - DNA, 103 bp, Artificial Sequence
  Synthetic Polynucleotide
taatacgactcactatagggcttccgtggtttcttcatcgaaggcagacaaacagaggagatgtctgatgtcgatgaagaacctggcggcagcgcaaaagatg

SEQ ID NO: 195448 - DNA, 103 bp, Artificial Sequence
  Synthetic Polynucleotide
taatacgactcactatagggagagaacaaacttccgtggtttcttcatcgaacagaggagacgatgaatgaaccacggaaacctggcggcagcgcaaaagatg

SEQ ID NO: 195449 - DNA, 103 bp, Artificial Sequence
  Synthetic Polynucleotide
taatacgactcactataggggggtttagactcgccggctggccccgccgaaacagaggagatcggcgatgccagccggcaacctggcggcagcgcaaaagatg

SEQ ID NO: 195450 - DNA, 103 bp, Artificial Sequence
  Synthetic Polynucleotide
taatacgactcactatagggaggagtgtccagagaacaaacttccgtggtaacagaggagaaccacgatggtttgttctaacctggcggcagcgcaaaagatg

SEQ ID NO: 195451 - DNA, 103 bp, Artificial Sequence
  Synthetic Polynucleotide
taatacgactcactataggggaggtctagaaggagtgtccagagaacaaaaacagaggagatttgttatgtggacactcaacctggcggcagcgcaaaagatg

SEQ ID NO: 195452 - DNA, 103 bp, Artificial Sequence
  Synthetic Polynucleotide
taatacgactcactataggggggagagcaagaggtctagaaggagtgtccaacagaggagaggacacatgttctagaccaacctggcggcagcgcaaaagatg

SEQ ID NO: 195453 - DNA, 103 bp, Artificial Sequence
  Synthetic Polynucleotide
taatacgactcactatagggttctaccagagggagagcaagaggtctagaaacagaggagatctagaatgcttgctctcaacctggcggcagcgcaaaagatg

SEQ ID NO: 195454 - DNA, 103 bp, Artificial Sequence
  Synthetic Polynucleotide
taatacgactcactatagggcttcctcctcttctaccagagggagagcaaaacagaggagattgctcatgctctggtagaacctggcggcagcgcaaaagatg

SEQ ID NO: 195455 - DNA, 103 bp, Artificial Sequence
  Synthetic Polynucleotide
taatacgactcactatagggtcagacactgcttcctcctcttctaccagaaacagaggagatctggtatgagaggaggaaacctggcggcagcgcaaaagatg

SEQ ID NO: 195456 - DNA, 103 bp, Artificial Sequence
  Synthetic Polynucleotide
taatacgactcactatagggaggctctggttcagacactgcttcctcctcaacagaggagagaggagatggcagtgtctaacctggcggcagcgcaaaagatg

SEQ ID NO: 195457 - DNA, 103 bp, Artificial Sequence
  Synthetic Polynucleotide
taatacgactcactataggggcaacccctcaggctctggttcagacactgaacagaggagacagtgtatgaaccagagcaacctggcggcagcgcaaaagatg

SEQ ID NO: 195458 - DNA, 103 bp, Artificial Sequence
  Synthetic Polynucleotide
taatacgactcactatagggcaggcctctggcaacccctcaggctctggtaacagaggagaaccagaatgtgaggggttaacctggcggcagcgcaaaagatg

SEQ ID NO: 195459 - DNA, 103 bp, Artificial Sequence
  Synthetic Polynucleotide
taatacgactcactatagggcaagtcatcacaggcctctggcaacccctcaacagaggagagaggggatgccagaggccaacctggcggcagcgcaaaagatg

SEQ ID NO: 195460 - DNA, 103 bp, Artificial Sequence
  Synthetic Polynucleotide
taatacgactcactatagggcatcgctcttgggtttagactcgccggctgaacagaggagacagccgatgagtctaaacaacctggcggcagcgcaaaagatg

SEQ ID NO: 195461 - DNA, 103 bp, Artificial Sequence
  Synthetic Polynucleotide
taatacgactcactatagggctgctaactccaagtcatcacaggcctctgaacagaggagacagaggatggtgatgactaacctggcggcagcgcaaaagatg

SEQ ID NO: 195462 - DNA, 103 bp, Artificial Sequence
  Synthetic Polynucleotide
taatacgactcactatagggagattgtcatctgctaactccaagtcatcaaacagaggagatgatgaatgggagttagcaacctggcggcagcgcaaaagatg

SEQ ID NO: 195463 - DNA, 103 bp, Artificial Sequence
  Synthetic Polynucleotide
taatacgactcactatagggcccctctttaagattgtcatctgctaactcaacagaggagagagttaatggatgacaataacctggcggcagcgcaaaagatg

SEQ ID NO: 195464 - DNA, 103 bp, Artificial Sequence
  Synthetic Polynucleotide
taatacgactcactatagggtgcaaatggtcccctctttaagattgtcataacagaggagaatgacaatgttaaagaggaacctggcggcagcgcaaaagatg

SEQ ID NO: 195465 - DNA, 103 bp, Artificial Sequence
  Synthetic Polynucleotide
taatacgactcactatagggctggactcagtgcaaatggtcccctctttaaacagaggagataaagaatggaccatttgaacctggcggcagcgcaaaagatg

SEQ ID NO: 195466 - DNA, 103 bp, Artificial Sequence
  Synthetic Polynucleotide
taatacgactcactatagggttcctgctggctggactcagtgcaaatggtaacagaggagaaccattatgactgagtccaacctggcggcagcgcaaaagatg

SEQ ID NO: 195467 - DNA, 103 bp, Artificial Sequence
  Synthetic Polynucleotide
taatacgactcactatagggtggtgatgggttcctgctggctggactcagaacagaggagactgagtatggccagcaggaacctggcggcagcgcaaaagatg

SEQ ID NO: 195468 - DNA, 103 bp, Artificial Sequence
  Synthetic Polynucleotide
taatacgactcactatagggaagcctgacttggtgatgggttcctgctggaacagaggagaccagcaatgacccatcacaacctggcggcagcgcaaaagatg

SEQ ID NO: 195469 - DNA, 103 bp, Artificial Sequence
  Synthetic Polynucleotide
taatacgactcactataggggaggcgtgtgaagcctgacttggtgatgggaacagaggagacccatcatgaagtcaggcaacctggcggcagcgcaaaagatg

SEQ ID NO: 195470 - DNA, 103 bp, Artificial Sequence
  Synthetic Polynucleotide
taatacgactcactataggggagagctgctgaggcgtgtgaagcctgactaacagaggagaagtcagatgtcacacgccaacctggcggcagcgcaaaagatg

SEQ ID NO: 195471 - DNA, 103 bp, Artificial Sequence
  Synthetic Polynucleotide
taatacgactcactataggggagttctttccatcgctcttgggtttagacaacagaggagagtctaaatgcaagagcgaaacctggcggcagcgcaaaagatg

SEQ ID NO: 195472 - DNA, 103 bp, Artificial Sequence
  Synthetic Polynucleotide
taatacgactcactatagggtagtaacaaggagagctgctgaggcgtgtgaacagaggagacacacgatgcagcagctcaacctggcggcagcgcaaaagatg

SEQ ID NO: 195473 - DNA, 103 bp, Artificial Sequence
  Synthetic Polynucleotide
taatacgactcactatagggttggtaaaagtagtaacaaggagagctgctaacagaggagaagcagcatgccttgttacaacctggcggcagcgcaaaagatg

SEQ ID NO: 195474 - DNA, 103 bp, Artificial Sequence
  Synthetic Polynucleotide
taatacgactcactatagggcatcttccgcttggtaaaagtagtaacaagaacagaggagacttgttatgacttttaccaacctggcggcagcgcaaaagatg

SEQ ID NO: 195475 - DNA, 103 bp, Artificial Sequence
  Synthetic Polynucleotide
taatacgactcactatagggatatgctgtccatcttccgcttggtaaaagaacagaggagacttttaatgagcggaagaaacctggcggcagcgcaaaagatg

SEQ ID NO: 195476 - DNA, 103 bp, Artificial Sequence
  Synthetic Polynucleotide
taatacgactcactataggggtgcaggaacatatgctgtccatcttccgcaacagaggagagcggaaatgggacagcataacctggcggcagcgcaaaagatg

SEQ ID NO: 195477 - DNA, 103 bp, Artificial Sequence
  Synthetic Polynucleotide
taatacgactcactatagggcattcacagggtgcaggaacatatgctgtcaacagaggagagacagcatgtgttcctgcaacctggcggcagcgcaaaagatg

SEQ ID NO: 195478 - DNA, 103 bp, Artificial Sequence
  Synthetic Polynucleotide
taatacgactcactatagggaggcagcgcacattcacagggtgcaggaacaacagaggagagttcctatgccctgtgaaaacctggcggcagcgcaaaagatg

SEQ ID NO: 195479 - DNA, 103 bp, Artificial Sequence
  Synthetic Polynucleotide
taatacgactcactatagggctcccgcacgaggcagcgcacattcacaggaacagaggagacctgtgatggtgcgctgcaacctggcggcagcgcaaaagatg

SEQ ID NO: 195480 - DNA, 103 bp, Artificial Sequence
  Synthetic Polynucleotide
taatacgactcactatagggggctgccgtactcccgcacgaggcagcgcaaacagaggagatgcgctatgtcgtgcgggaacctggcggcagcgcaaaagatg

SEQ ID NO: 195481 - DNA, 103 bp, Artificial Sequence
  Synthetic Polynucleotide
taatacgactcactatagggctcctctccaggctgccgtactcccgcacgaacagaggagacgtgcgatggtacggcagaacctggcggcagcgcaaaagatg

SEQ ID NO: 195482 - DNA, 103 bp, Artificial Sequence
  Synthetic Polynucleotide
taatacgactcactatagggggatccactggagttctttccatcgctcttaacagaggagaaagagcatgggaaagaacaacctggcggcagcgcaaaagatg

SEQ ID NO: 195483 - DNA, 103 bp, Artificial Sequence
  Synthetic Polynucleotide
taatacgactcactatagggcttctcggggctcctctccaggctgccgtaaacagaggagatacggcatgctggagaggaacctggcggcagcgcaaaagatg

SEQ ID NO: 195484 - DNA, 103 bp, Artificial Sequence
  Synthetic Polynucleotide
taatacgactcactatagggttgctgagatcttctcggggctcctctccaaacagaggagatggagaatggccccgagaaacctggcggcagcgcaaaagatg

SEQ ID NO: 195485 - DNA, 103 bp, Artificial Sequence
  Synthetic Polynucleotide
taatacgactcactatagggtccaccacagttgctgagatcttctcggggaacagaggagaccccgaatggatctcagcaacctggcggcagcgcaaaagatg

SEQ ID NO: 195486 - DNA, 103 bp, Artificial Sequence
  Synthetic Polynucleotide
taatacgactcactataggggccagcaatctccaccacagttgctgagataacagaggagaatctcaatgactgtggtgaacctggcggcagcgcaaaagatg

SEQ ID NO: 195487 - DNA, 103 bp, Artificial Sequence
  Synthetic Polynucleotide
taatacgactcactatagggacatggagtagccagcaatctccaccacagaacagaggagactgtggatgagattgctgaacctggcggcagcgcaaaagatg

SEQ ID NO: 195488 - DNA, 103 bp, Artificial Sequence
  Synthetic Polynucleotide
taatacgactcactatagggacatcctcagacatggagtagccagcaatcaacagaggagagattgcatgctactccataacctggcggcagcgcaaaagatg

SEQ ID NO: 195489 - DNA, 103 bp, Artificial Sequence
  Synthetic Polynucleotide
taatacgactcactatagggacgctgtcgaacatcctcagacatggagtaaacagaggagatactccatgtctgaggataacctggcggcagcgcaaaagatg

SEQ ID NO: 195490 - DNA, 103 bp, Artificial Sequence
  Synthetic Polynucleotide
taatacgactcactataggggatatctgtgacgctgtcgaacatcctcagaacagaggagactgaggatgttcgacagcaacctggcggcagcgcaaaagatg

SEQ ID NO: 195491 - DNA, 103 bp, Artificial Sequence
  Synthetic Polynucleotide
taatacgactcactatagggaagtgagagagatatctgtgacgctgtcgaaacagaggagatcgacaatgtcacagataaacctggcggcagcgcaaaagatg

SEQ ID NO: 195492 - DNA, 103 bp, Artificial Sequence
  Synthetic Polynucleotide
taatacgactcactatagggggtgagtggcaagtgagagagatatctgtgaacagaggagacacagaatgctctctcacaacctggcggcagcgcaaaagatg

SEQ ID NO: 195493 - DNA, 103 bp, Artificial Sequence
  Synthetic Polynucleotide
taatacgactcactatagggtataacgcttggatccactggagttctttcaacagaggagagaaagaatgccagtggataacctggcggcagcgcaaaagatg

SEQ ID NO: 195494 - DNA, 103 bp, Artificial Sequence
  Synthetic Polynucleotide
taatacgactcactatagggtgaactcacaggtgagtggcaagtgagagaaacagaggagatctctcatgtgccactcaaacctggcggcagcgcaaaagatg

SEQ ID NO: 195495 - DNA, 103 bp, Artificial Sequence
  Synthetic Polynucleotide
taatacgactcactatagggtcacagatgctgaactcacaggtgagtggcaacagaggagagccactatgctgtgagttaacctggcggcagcgcaaaagatg

SEQ ID NO: 195496 - DNA, 103 bp, Artificial Sequence
  Synthetic Polynucleotide
taatacgactcactatagggcaaagccagttcacagatgctgaactcacaaacagaggagatgtgagatgagcatctgtaacctggcggcagcgcaaaagatg

SEQ ID NO: 195497 - DNA, 103 bp, Artificial Sequence
  Synthetic Polynucleotide
taatacgactcactatagggcaggaggttgcaaagccagttcacagatgcaacagaggagagcatctatgaactggcttaacctggcggcagcgcaaaagatg

SEQ ID NO: 195498 - DNA, 103 bp, Artificial Sequence
  Synthetic Polynucleotide
taatacgactcactatagggttagagaccacaggaggttgcaaagccagtaacagaggagaactggcatggcaacctccaacctggcggcagcgcaaaagatg

SEQ ID NO: 195499 - DNA, 103 bp, Artificial Sequence
  Synthetic Polynucleotide
taatacgactcactatagggtagggtttccttagagaccacaggaggttgaacagaggagacaacctatggtggtctctaacctggcggcagcgcaaaagatg

SEQ ID NO: 195500 - DNA, 103 bp, Artificial Sequence
  Synthetic Polynucleotide
taatacgactcactatagggagaacatctctagggtttccttagagaccaaacagaggagatggtctatgaggaaacccaacctggcggcagcgcaaaagatg

SEQ ID NO: 195501 - DNA, 103 bp, Artificial Sequence
  Synthetic Polynucleotide
taatacgactcactatagggatgtcatctgagaacatctctagggtttccaacagaggagaggaaacatgagagatgttaacctggcggcagcgcaaaagatg

SEQ ID NO: 195502 - DNA, 103 bp, Artificial Sequence
  Synthetic Polynucleotide
taatacgactcactatagggcctcttctcaatgtcatctgagaacatctcaacagaggagagagatgatgtcagatgacaacctggcggcagcgcaaaagatg

SEQ ID NO: 195503 - DNA, 103 bp, Artificial Sequence
  Synthetic Polynucleotide
taatacgactcactataggggctgacgtttcctcttctcaatgtcatctgaacagaggagacagatgatgttgagaagaaacctggcggcagcgcaaaagatg

SEQ ID NO: 195504 - DNA, 103 bp, Artificial Sequence
  Synthetic Polynucleotide
taatacgactcactatagggcgtttgcgattataacgcttggatccactgaacagaggagacagtggatgcaagcgttaaacctggcggcagcgcaaaagatg

SEQ ID NO: 195505 - DNA, 103 bp, Artificial Sequence
  Synthetic Polynucleotide
taatacgactcactatagggttcttttggcgctgacgtttcctcttctcaaacagaggagatgagaaatggaaacgtcaaacctggcggcagcgcaaaagatg

SEQ ID NO: 195506 - DNA, 103 bp, Artificial Sequence
  Synthetic Polynucleotide
taatacgactcactatagggctcccgagccttcttttggcgctgacgtttaacagaggagaaaacgtatgcgccaaaagaacctggcggcagcgcaaaagatg

SEQ ID NO: 195507 - DNA, 103 bp, Artificial Sequence
  Synthetic Polynucleotide
taatacgactcactatagggggcggcgttcctcccgagccttcttttggcaacagaggagagccaaaatgaggctcgggaacctggcggcagcgcaaaagatg

SEQ ID NO: 195508 - DNA, 103 bp, Artificial Sequence
  Synthetic Polynucleotide
taatacgactcactatagggctgcgctctcggcggcgttcctcccgagccaacagaggagaggctcgatgggaacgccgaacctggcggcagcgcaaaagatg

SEQ ID NO: 195509 - DNA, 103 bp, Artificial Sequence
  Synthetic Polynucleotide
taatacgactcactatagggtatctcaatcctgcgctctcggcggcgttcaacagaggagagaacgcatgcgagagcgcaacctggcggcagcgcaaaagatg

SEQ ID NO: 195510 - DNA, 103 bp, Artificial Sequence
  Synthetic Polynucleotide
taatacgactcactatagggtgttctcctctatctcaatcctgcgctctcaacagaggagagagagcatgggattgagaaacctggcggcagcgcaaaagatg

SEQ ID NO: 195511 - DNA, 103 bp, Artificial Sequence
  Synthetic Polynucleotide
taatacgactcactatagggccctgtttcttgttctcctctatctcaatcaacagaggagagattgaatgagaggagaaaacctggcggcagcgcaaaagatg

SEQ ID NO: 195512 - DNA, 103 bp, Artificial Sequence
  Synthetic Polynucleotide
taatacgactcactatagggtgggtacttgccctgtttcttgttctcctcaacagaggagagaggagatgaagaaacagaacctggcggcagcgcaaaagatg

SEQ ID NO: 195513 - DNA, 103 bp, Artificial Sequence
  Synthetic Polynucleotide
taatacgactcactatagggtgtggacttctgggtacttgccctgtttctaacagaggagaagaaacatggcaagtaccaacctggcggcagcgcaaaagatg

SEQ ID NO: 195514 - DNA, 103 bp, Artificial Sequence
  Synthetic Polynucleotide
taatacgactcactatagggtcgaggggaatgtggacttctgggtacttgaacagaggagacaagtaatgagaagtccaaacctggcggcagcgcaaaagatg

SEQ ID NO: 195515 - DNA, 103 bp, Artificial Sequence
  Synthetic Polynucleotide
taatacgactcactatagggggaaagttcacgtttgcgattataacgcttaacagaggagaaagcgtatgaatcgcaaaaacctggcggcagcgcaaaagatg

SEQ ID NO: 195516 - DNA, 103 bp, Artificial Sequence
  Synthetic Polynucleotide
taatacgactcactatagggctgtagattctcgaggggaatgtggacttcaacagaggagagaagtcatgattcccctcaacctggcggcagcgcaaaagatg

SEQ ID NO: 195517 - DNA, 103 bp, Artificial Sequence
  Synthetic Polynucleotide
taatacgactcactatagggcaggaaactgctgtagattctcgaggggaaaacagaggagattccccatgagaatctacaacctggcggcagcgcaaaagatg

SEQ ID NO: 195518 - DNA, 103 bp, Artificial Sequence
  Synthetic Polynucleotide
taatacgactcactataggggaattgaaggcaggaaactgctgtagattcaacagaggagagaatctatggcagtttccaacctggcggcagcgcaaaagatg

SEQ ID NO: 195519 - DNA, 103 bp, Artificial Sequence
  Synthetic Polynucleotide
taatacgactcactataggggcaggtataagaattgaaggcaggaaactgaacagaggagacagtttatggccttcaataacctggcggcagcgcaaaagatg

SEQ ID NO: 195520 - DNA, 103 bp, Artificial Sequence
  Synthetic Polynucleotide
taatacgactcactatagggaatcagaggagcaggtataagaattgaaggaacagaggagaccttcaatgcttatacctaacctggcggcagcgcaaaagatg

SEQ ID NO: 195521 - DNA, 103 bp, Artificial Sequence
  Synthetic Polynucleotide
taatacgactcactatagggcccaaagcagaatcagaggagcaggtataaaacagaggagattatacatgctcctctgaaacctggcggcagcgcaaaagatg

SEQ ID NO: 195522 - DNA, 103 bp, Artificial Sequence
  Synthetic Polynucleotide
taatacgactcactataggggctggtgggacccaaagcagaatcagaggaaacagaggagatcctctatgtctgctttgaacctggcggcagcgcaaaagatg

SEQ ID NO: 195523 - DNA, 103 bp, Artificial Sequence
  Synthetic Polynucleotide
taatacgactcactatagggggccctcggtgctggtgggacccaaagcagaacagaggagactgcttatggtcccaccaaacctggcggcagcgcaaaagatg

SEQ ID NO: 195524 - DNA, 103 bp, Artificial Sequence
  Synthetic Polynucleotide
taatacgactcactatagggagggccccatggccctcggtgctggtgggaaacagaggagatcccacatgcaccgagggaacctggcggcagcgcaaaagatg

SEQ ID NO: 195525 - DNA, 103 bp, Artificial Sequence
  Synthetic Polynucleotide
taatacgactcactatagggagaaatggagagggccccatggccctcggtaacagaggagaaccgagatgcatggggccaacctggcggcagcgcaaaagatg

SEQ ID NO: 195526 - DNA, 103 bp, Artificial Sequence
  Synthetic Polynucleotide
taatacgactcactatagggcggaggcggtggcggcggcgttgggggagcaacagaggagagctcccatgacgccgccgaacctggcggcagcgcaaaagatg

SEQ ID NO: 195527 - DNA, 103 bp, Artificial Sequence
  Synthetic Polynucleotide
taatacgactcactatagggttttggggtaggaaagttcacgtttgcgataacagaggagaatcgcaatggtgaactttaacctggcggcagcgcaaaagatg

SEQ ID NO: 195528 - DNA, 103 bp, Artificial Sequence
  Synthetic Polynucleotide
taatacgactcactatagggtgctgagaggagaaatggagagggccccataacagaggagaatggggatgtctccatttaacctggcggcagcgcaaaagatg

SEQ ID NO: 195529 - DNA, 103 bp, Artificial Sequence
  Synthetic Polynucleotide
taatacgactcactatagggcctggacttctgctgagaggagaaatggagaacagaggagactccatatgtcctctcagaacctggcggcagcgcaaaagatg

SEQ ID NO: 195530 - DNA, 103 bp, Artificial Sequence
  Synthetic Polynucleotide
taatacgactcactatagggtgcatgggaacctggacttctgctgagaggaacagaggagacctctcatgagaagtccaaacctggcggcagcgcaaaagatg

SEQ ID NO: 195531 - DNA, 103 bp, Artificial Sequence
  Synthetic Polynucleotide
taatacgactcactataggggcagaaagtctgcatgggaacctggacttcaacagaggagagaagtcatggttcccatgaacctggcggcagcgcaaaagatg

SEQ ID NO: 195532 - DNA, 103 bp, Artificial Sequence
  Synthetic Polynucleotide
taatacgactcactatagggagaggggtcagcagaaagtctgcatgggaaaacagaggagattcccaatgagactttctaacctggcggcagcgcaaaagatg

SEQ ID NO: 195533 - DNA, 103 bp, Artificial Sequence
  Synthetic Polynucleotide
taatacgactcactatagggagtgggtgacagaggggtcagcagaaagtcaacagaggagagactttatgctgacccctaacctggcggcagcgcaaaagatg

SEQ ID NO: 195534 - DNA, 103 bp, Artificial Sequence
  Synthetic Polynucleotide
taatacgactcactatagggcctgactggcagtgggtgacagaggggtcaaacagaggagatgacccatgtgtcacccaaacctggcggcagcgcaaaagatg

SEQ ID NO: 195535 - DNA, 103 bp, Artificial Sequence
  Synthetic Polynucleotide
taatacgactcactataggggagggactgccctgactggcagtgggtgacaacagaggagagtcaccatgtgccagtcaaacctggcggcagcgcaaaagatg

SEQ ID NO: 195536 - DNA, 103 bp, Artificial Sequence
  Synthetic Polynucleotide
taatacgactcactatagggaacgcagaatgagggactgccctgactggcaacagaggagagccagtatgggcagtcccaacctggcggcagcgcaaaagatg

SEQ ID NO: 195537 - DNA, 103 bp, Artificial Sequence
  Synthetic Polynucleotide
taatacgactcactatagggccagactcccaacgcagaatgagggactgcaacagaggagagcagtcatgcattctgcgaacctggcggcagcgcaaaagatg

SEQ ID NO: 195538 - DNA, 103 bp, Artificial Sequence
  Synthetic Polynucleotide
taatacgactcactatagggaaactttcatttttggggtaggaaagttcaaacagaggagatgaactatgctaccccaaaacctggcggcagcgcaaaagatg

SEQ ID NO: 195539 - DNA, 103 bp, Artificial Sequence
  Synthetic Polynucleotide
taatacgactcactataggggagtcttcttccagactcccaacgcagaataacagaggagaattctgatgtgggagtctaacctggcggcagcgcaaaagatg

SEQ ID NO: 195540 - DNA, 103 bp, Artificial Sequence
  Synthetic Polynucleotide
taatacgactcactatagggagggaagggagagtcttcttccagactcccaacagaggagagggagtatggaagaagacaacctggcggcagcgcaaaagatg

SEQ ID NO: 195541 - DNA, 103 bp, Artificial Sequence
  Synthetic Polynucleotide
taatacgactcactataggggggcaaaggaagggaagggagagtcttcttaacagaggagaaagaagatgctcccttccaacctggcggcagcgcaaaagatg

SEQ ID NO: 195542 - DNA, 103 bp, Artificial Sequence
  Synthetic Polynucleotide
taatacgactcactatagggctcagcatctgggcaaaggaagggaagggaaacagaggagatcccttatgttcctttgcaacctggcggcagcgcaaaagatg

SEQ ID NO: 195543 - DNA, 103 bp, Artificial Sequence
  Synthetic Polynucleotide
taatacgactcactatagggttttccaaccctcagcatctgggcaaaggaaacagaggagatcctttatgcagatgctgaacctggcggcagcgcaaaagatg

SEQ ID NO: 195544 - DNA, 103 bp, Artificial Sequence
  Synthetic Polynucleotide
taatacgactcactatagggctgcttttgcttttccaaccctcagcatctaacagaggagaagatgcatggggttggaaaacctggcggcagcgcaaaagatg

SEQ ID NO: 195545 - DNA, 103 bp, Artificial Sequence
  Synthetic Polynucleotide
taatacgactcactatagggggccacacatctgcttttgcttttccaaccaacagaggagaggttggatgagcaaaagcaacctggcggcagcgcaaaagatg

SEQ ID NO: 195546 - DNA, 103 bp, Artificial Sequence
  Synthetic Polynucleotide
taatacgactcactatagggagcagttttgggccacacatctgcttttgcaacagaggagagcaaaaatggatgtgtggaacctggcggcagcgcaaaagatg

SEQ ID NO: 195547 - DNA, 103 bp, Artificial Sequence
  Synthetic Polynucleotide
taatacgactcactatagggctttctttggagcagttttgggccacacataacagaggagaatgtgtatgccaaaactgaacctggcggcagcgcaaaagatg

SEQ ID NO: 195548 - DNA, 103 bp, Artificial Sequence
  Synthetic Polynucleotide
taatacgactcactatagggctgttctcatctttctttggagcagttttgaacagaggagacaaaacatgtccaaagaaaacctggcggcagcgcaaaagatg

SEQ ID NO: 195549 - DNA, 103 bp, Artificial Sequence
  Synthetic Polynucleotide
taatacgactcactatagggctggttgttaaaactttcatttttggggtaaacagaggagataccccatgaatgaaagtaacctggcggcagcgcaaaagatg

SEQ ID NO: 195550 - DNA, 103 bp, Artificial Sequence
  Synthetic Polynucleotide
taatacgactcactatagggaggaactaagctgttctcatctttctttggaacagaggagaccaaagatggatgagaacaacctggcggcagcgcaaaagatg

SEQ ID NO: 195551 - DNA, 103 bp, Artificial Sequence
  Synthetic Polynucleotide
taatacgactcactatagggcaggggcaggaggaactaagctgttctcataacagaggagaatgagaatggcttagttcaacctggcggcagcgcaaaagatg

SEQ ID NO: 195552 - DNA, 103 bp, Artificial Sequence
  Synthetic Polynucleotide
taatacgactcactatagggtcgctgtccacaggggcaggaggaactaagaacagaggagacttagtatgtcctgccccaacctggcggcagcgcaaaagatg

SEQ ID NO: 195553 - DNA, 103 bp, Artificial Sequence
  Synthetic Polynucleotide
taatacgactcactatagggactctccccgtcgctgtccacaggggcaggaacagaggagacctgccatggtggacagcaacctggcggcagcgcaaaagatg

SEQ ID NO: 195554 - DNA, 103 bp, Artificial Sequence
  Synthetic Polynucleotide
taatacgactcactatagggctgaattatcactctccccgtcgctgtccaaacagaggagatggacaatgacggggagaaacctggcggcagcgcaaaagatg

SEQ ID NO: 195555 - DNA, 103 bp, Artificial Sequence
  Synthetic Polynucleotide
taatacgactcactatagggggaacacggtctgaattatcactctccccgaacagaggagacggggaatgtgataattcaacctggcggcagcgcaaaagatg

SEQ ID NO: 195556 - DNA, 103 bp, Artificial Sequence
  Synthetic Polynucleotide
taatacgactcactatagggactgggcacaggaacacggtctgaattatcaacagaggagagataatatggaccgtgttaacctggcggcagcgcaaaagatg

SEQ ID NO: 195557 - DNA, 103 bp, Artificial Sequence
  Synthetic Polynucleotide
taatacgactcactatagggaattttgaaaactgggcacaggaacacggtaacagaggagaaccgtgatgctgtgcccaaacctggcggcagcgcaaaagatg

SEQ ID NO: 195558 - DNA, 103 bp, Artificial Sequence
  Synthetic Polynucleotide
taatacgactcactatagggtggctgaaggaattttgaaaactgggcacaaacagaggagatgtgccatgttttcaaaaaacctggcggcagcgcaaaagatg

SEQ ID NO: 195559 - DNA, 103 bp, Artificial Sequence
  Synthetic Polynucleotide
taatacgactcactatagggttcaatagcttggctgaaggaattttgaaaaacagaggagatttcaaatgtccttcagcaacctggcggcagcgcaaaagatg

SEQ ID NO: 195560 - DNA, 103 bp, Artificial Sequence
  Synthetic Polynucleotide
taatacgactcactatagggagcgacgggactggttgttaaaactttcataacagaggagaatgaaaatgttaacaaccaacctggcggcagcgcaaaagatg

SEQ ID NO: 195561 - DNA, 103 bp, Artificial Sequence
  Synthetic Polynucleotide
taatacgactcactatagggtgaaggctgcttcaatagcttggctgaaggaacagaggagaccttcaatgaagctattgaacctggcggcagcgcaaaagatg

SEQ ID NO: 195562 - DNA, 103 bp, Artificial Sequence
  Synthetic Polynucleotide
taatacgactcactatagggtccagtttcatgaaggctgcttcaatagctaacagaggagaagctatatgagcagccttaacctggcggcagcgcaaaagatg

SEQ ID NO: 195563 - DNA, 103 bp, Artificial Sequence
  Synthetic Polynucleotide
taatacgactcactatagggagctggtgtgtccagtttcatgaaggctgcaacagaggagagcagccatgatgaaactgaacctggcggcagcgcaaaagatg

SEQ ID NO: 195564 - DNA, 103 bp, Artificial Sequence
  Synthetic Polynucleotide
taatacgactcactataggggatctgaagtagctggtgtgtccagtttcaaacagaggagatgaaacatgacacaccagaacctggcggcagcgcaaaagatg

SEQ ID NO: 195565 - DNA, 103 bp, Artificial Sequence
  Synthetic Polynucleotide
taatacgactcactatagggtcagagaggggatctgaagtagctggtgtgaacagaggagacacaccatgtacttcagaaacctggcggcagcgcaaaagatg

SEQ ID NO: 195566 - DNA, 103 bp, Artificial Sequence
  Synthetic Polynucleotide
taatacgactcactatagggtcctttctcttcagagaggggatctgaagtaacagaggagaacttcaatgcccctctctaacctggcggcagcgcaaaagatg

SEQ ID NO: 195567 - DNA, 103 bp, Artificial Sequence
  Synthetic Polynucleotide
taatacgactcactatagggttttctttcctcctttctcttcagagagggaacagaggagaccctctatgaagagaaagaacctggcggcagcgcaaaagatg

SEQ ID NO: 195568 - DNA, 103 bp, Artificial Sequence
  Synthetic Polynucleotide
taatacgactcactatagggtgtttttttcttttctttcctcctttctctaacagaggagaagagaaatgaggaaagaaaacctggcggcagcgcaaaagatg

SEQ ID NO: 195569 - DNA, 103 bp, Artificial Sequence
  Synthetic Polynucleotide
taatacgactcactatagggcttctgtttctgtttttttcttttctttccaacagaggagaggaaagatgagaaaaaaaaacctggcggcagcgcaaaagatg

SEQ ID NO: 195570 - DNA, 103 bp, Artificial Sequence
  Synthetic Polynucleotide
taatacgactcactatagggtgaacaggagcttctgtttctgtttttttcaacagaggagagaaaaaatgagaaacagaaacctggcggcagcgcaaaagatg

SEQ ID NO: 195571 - DNA, 103 bp, Artificial Sequence
  Synthetic Polynucleotide
taatacgactcactatagggtgtgaactggagcgacgggactggttgttaaacagaggagataacaaatggtcccgtcgaacctggcggcagcgcaaaagatg

SEQ ID NO: 195572 - DNA, 103 bp, Artificial Sequence
  Synthetic Polynucleotide
taatacgactcactatagggactgaggtgctgaacaggagcttctgtttcaacagaggagagaaacaatggctcctgttaacctggcggcagcgcaaaagatg

SEQ ID NO: 195573 - DNA, 103 bp, Artificial Sequence
  Synthetic Polynucleotide
taatacgactcactatagggggtgtggacgactgaggtgctgaacaggagaacagaggagactcctgatgagcacctcaaacctggcggcagcgcaaaagatg

SEQ ID NO: 195574 - DNA, 103 bp, Artificial Sequence
  Synthetic Polynucleotide
taatacgactcactatagggcttgcttttctgtgaactggagcgacgggaaacagaggagatcccgtatgtccagttcaaacctggcggcagcgcaaaagatg

SEQ ID NO: 195575 - DNA, 103 bp, Artificial Sequence
  Synthetic Polynucleotide
taatacgactcactatagggtgttaaaagtcttgcttttctgtgaactggaacagaggagaccagttatgagaaaagcaaacctggcggcagcgcaaaagatg

SEQ ID NO: 195576 - DNA, 103 bp, Artificial Sequence
  Synthetic Polynucleotide
taatacgactcactatagggggaggcatcttgttaaaagtcttgcttttcaacagaggagagaaaagatggacttttaaaacctggcggcagcgcaaaagatg

SEQ ID NO: 195577 - DNA, 103 bp, Artificial Sequence
  Synthetic Polynucleotide
taatacgactcactataggggcccctttgaggaggcatcttgttaaaagtaacagaggagaacttttatgaagatgcctaacctggcggcagcgcaaaagatg

SEQ ID NO: 195578 - DNA, 103 bp, Artificial Sequence
  Synthetic Polynucleotide
taatacgactcactatagggtgctgccgccgcccctttgaggaggcatctaacagaggagaagatgcatgctcaaagggaacctggcggcagcgcaaaagatg

SEQ ID NO: 195579 - DNA, 103 bp, Artificial Sequence
  Synthetic Polynucleotide
taatacgactcactatagggttgtccatgtcggaggcggtggcggcggcgaacagaggagacgccgcatgcaccgcctcaacctggcggcagcgcaaaagatg

SEQ ID NO: 195580 - DNA, 103 bp, Artificial Sequence
  Synthetic Polynucleotide
taatacgactcactatagggaagagtttgctgctgccgccgcccctttgaaacagaggagatcaaagatgcggcggcagaacctggcggcagcgcaaaagatg

SEQ ID NO: 195581 - DNA, 103 bp, Artificial Sequence
  Synthetic Polynucleotide
taatacgactcactatagggagaagagctaaagagtttgctgctgccgccaacagaggagaggcggcatgagcaaactcaacctggcggcagcgcaaaagatg

SEQ ID NO: 195582 - DNA, 103 bp, Artificial Sequence
  Synthetic Polynucleotide
taatacgactcactatagggcaccattaaaagaagagctaaagagtttgcaacagaggagagcaaacatgttagctcttaacctggcggcagcgcaaaagatg

SEQ ID NO: 195583 - DNA, 103 bp, Artificial Sequence
  Synthetic Polynucleotide
taatacgactcactatagggtctcgtcttccaccattaaaagaagagctaaacagaggagatagctcatgttttaatggaacctggcggcagcgcaaaagatg

SEQ ID NO: 195584 - DNA, 103 bp, Artificial Sequence
  Synthetic Polynucleotide
taatacgactcactatagggtgctacctcatctcgtcttccaccattaaaaacagaggagatttaatatgggaagacgaaacctggcggcagcgcaaaagatg

SEQ ID NO: 195585 - DNA, 103 bp, Artificial Sequence
  Synthetic Polynucleotide
taatacgactcactataggggttgagcctctgctacctcatctcgtcttcaacagaggagagaagacatgatgaggtagaacctggcggcagcgcaaaagatg

SEQ ID NO: 195586 - DNA, 103 bp, Artificial Sequence
  Synthetic Polynucleotide
taatacgactcactatagggaactctgcccgttgagcctctgctacctcaaacagaggagatgaggtatgagaggctcaaacctggcggcagcgcaaaagatg

SEQ ID NO: 195587 - DNA, 103 bp, Artificial Sequence
  Synthetic Polynucleotide
taatacgactcactatagggggcagggctaaactctgcccgttgagcctcaacagaggagagaggctatgcgggcagagaacctggcggcagcgcaaaagatg

SEQ ID NO: 195588 - DNA, 103 bp, Artificial Sequence
  Synthetic Polynucleotide
taatacgactcactatagggcagagaactgggcagggctaaactctgcccaacagaggagagggcagatgttagccctgaacctggcggcagcgcaaaagatg

SEQ ID NO: 195589 - DNA, 103 bp, Artificial Sequence
  Synthetic Polynucleotide
taatacgactcactatagggttcttaggaccagagaactgggcagggctaaacagaggagatagcccatgccagttctcaacctggcggcagcgcaaaagatg

SEQ ID NO: 195590 - DNA, 103 bp, Artificial Sequence
  Synthetic Polynucleotide
taatacgactcactataggggccgctgttcttgtccatgtcggaggcggtaacagaggagaaccgccatggacatggacaacctggcggcagcgcaaaagatg

SEQ ID NO: 195591 - DNA, 103 bp, Artificial Sequence
  Synthetic Polynucleotide
taatacgactcactatagggcaggttgatcttcttaggaccagagaactgaacagaggagacagttcatgggtcctaagaacctggcggcagcgcaaaagatg

SEQ ID NO: 195592 - DNA, 103 bp, Artificial Sequence
  Synthetic Polynucleotide
taatacgactcactatagggacaagtggttcaggttgatcttcttaggacaacagaggagagtcctaatgagatcaaccaacctggcggcagcgcaaaagatg

SEQ ID NO: 195593 - DNA, 103 bp, Artificial Sequence
  Synthetic Polynucleotide
taatacgactcactataggggtgaaattcaacaagtggttcaggttgatcaacagaggagagatcaaatggaaccacttaacctggcggcagcgcaaaagatg

SEQ ID NO: 195594 - DNA, 103 bp, Artificial Sequence
  Synthetic Polynucleotide
taatacgactcactataggggggttcaaaagtgaaattcaacaagtggttaacagaggagaaaccacatgttgaatttcaacctggcggcagcgcaaaagatg

SEQ ID NO: 195595 - DNA, 103 bp, Artificial Sequence
  Synthetic Polynucleotide
taatacgactcactatagggtctggccacggggttcaaaagtgaaattcaaacagaggagatgaattatgcttttgaacaacctggcggcagcgcaaaagatg

SEQ ID NO: 195596 - DNA, 103 bp, Artificial Sequence
  Synthetic Polynucleotide
taatacgactcactatagggaagtgacccgtctggccacggggttcaaaaaacagaggagattttgaatgccgtggccaaacctggcggcagcgcaaaagatg

SEQ ID NO: 195597 - DNA, 103 bp, Artificial Sequence
  Synthetic Polynucleotide
taatacgactcactatagggactgccttcaaagtgacccgtctggccacgaacagaggagacgtggcatgacgggtcacaacctggcggcagcgcaaaagatg

SEQ ID NO: 195598 - DNA, 103 bp, Artificial Sequence
  Synthetic Polynucleotide
taatacgactcactatagggtaccatgtccactgccttcaaagtgacccgaacagaggagacgggtcatgttgaaggcaaacctggcggcagcgcaaaagatg

SEQ ID NO: 195599 - DNA, 103 bp, Artificial Sequence
  Synthetic Polynucleotide
taatacgactcactatagggtttccccagctaccatgtccactgccttcaaacagaggagatgaaggatgtggacatggaacctggcggcagcgcaaaagatg

SEQ ID NO: 195600 - DNA, 103 bp, Artificial Sequence
  Synthetic Polynucleotide
taatacgactcactatagggcttgttcctctttccccagctaccatgtccaacagaggagaggacatatgagctggggaaacctggcggcagcgcaaaagatg

SEQ ID NO: 195601 - DNA, 103 bp, Artificial Sequence
  Synthetic Polynucleotide
taatacgactcactatagggagctgttggagccgctgttcttgtccatgtaacagaggagaacatggatgagaacagcgaacctggcggcagcgcaaaagatg

SEQ ID NO: 195602 - DNA, 103 bp, Artificial Sequence
  Synthetic Polynucleotide
taatacgactcactatagggtatgtccccacttgttcctctttccccagcaacagaggagagctgggatgagaggaacaaacctggcggcagcgcaaaagatg

SEQ ID NO: 195603 - DNA, 103 bp, Artificial Sequence
  Synthetic Polynucleotide
taatacgactcactatagggttaaaaggcttatgtccccacttgttcctcaacagaggagagaggaaatggtggggacaaacctggcggcagcgcaaaagatg

SEQ ID NO: 195604 - DNA, 103 bp, Artificial Sequence
  Synthetic Polynucleotide
taatacgactcactataggggagttccttgttaaaaggcttatgtccccaaacagaggagatggggaatgaagccttttaacctggcggcagcgcaaaagatg

SEQ ID NO: 195605 - DNA, 103 bp, Artificial Sequence
  Synthetic Polynucleotide
taatacgactcactatagggcctgtaaaaagagttccttgttaaaaggctaacagaggagaagccttatgacaaggaacaacctggcggcagcgcaaaagatg

SEQ ID NO: 195606 - DNA, 103 bp, Artificial Sequence
  Synthetic Polynucleotide
taatacgactcactatagggtggcagttggcctgtaaaaagagttccttgaacagaggagacaaggaatgctttttacaaacctggcggcagcgcaaaagatg

SEQ ID NO: 195607 - DNA, 103 bp, Artificial Sequence
  Synthetic Polynucleotide
taatacgactcactatagggcaccacaaattggcagttggcctgtaaaaaaacagaggagatttttaatggccaactgcaacctggcggcagcgcaaaagatg

SEQ ID NO: 195608 - DNA, 103 bp, Artificial Sequence
  Synthetic Polynucleotide
taatacgactcactatagggggtcttcagacaccacaaattggcagttggaacagaggagaccaactatgaatttgtggaacctggcggcagcgcaaaagatg

SEQ ID NO: 195609 - DNA, 103 bp, Artificial Sequence
  Synthetic Polynucleotide
taatacgactcactataggggtgtagtcttggtcttcagacaccacaaataacagaggagaatttgtatggtctgaagaaacctggcggcagcgcaaaagatg

SEQ ID NO: 195610 - DNA, 103 bp, Artificial Sequence
  Synthetic Polynucleotide
taatacgactcactatagggaaaatgagctgtgtagtcttggtcttcagaaacagaggagatctgaaatgcaagactacaacctggcggcagcgcaaaagatg

SEQ ID NO: 195611 - DNA, 103 bp, Artificial Sequence
  Synthetic Polynucleotide
taatacgactcactatagggcaggatcagcaaaatgagctgtgtagtcttaacagaggagaaagactatgcagctcattaacctggcggcagcgcaaaagatg

SEQ ID NO: 195612 - DNA, 103 bp, Artificial Sequence
  Synthetic Polynucleotide
taatacgactcactataggggaggcggaggagctgttggagccgctgttcaacagaggagagaacagatgctccaacagaacctggcggcagcgcaaaagatg

SEQ ID NO: 195613 - DNA, 103 bp, Artificial Sequence
  Synthetic Polynucleotide
taatacgactcactatagggactaatgtatcaggatcagcaaaatgagctaacagaggagaagctcaatgtgctgatccaacctggcggcagcgcaaaagatg

SEQ ID NO: 195614 - DNA, 103 bp, Artificial Sequence
  Synthetic Polynucleotide
taatacgactcactataggggtcccagttaactaatgtatcaggatcagcaacagaggagagctgatatggatacattaaacctggcggcagcgcaaaagatg

SEQ ID NO: 195615 - DNA, 103 bp, Artificial Sequence
  Synthetic Polynucleotide
taatacgactcactataggggttccacaaagtcccagttaactaatgtataacagaggagaatacatatgttaactgggaacctggcggcagcgcaaaagatg

SEQ ID NO: 195616 - DNA, 103 bp, Artificial Sequence
  Synthetic Polynucleotide
taatacgactcactatagggatgcgcacttgttccacaaagtcccagttaaacagaggagataactgatgctttgtggaaacctggcggcagcgcaaaagatg

SEQ ID NO: 195617 - DNA, 103 bp, Artificial Sequence
  Synthetic Polynucleotide
taatacgactcactatagggatggctacaaatgcgcacttgttccacaaaaacagaggagatttgtgatgcaagtgcgcaacctggcggcagcgcaaaagatg

SEQ ID NO: 195618 - DNA, 103 bp, Artificial Sequence
  Synthetic Polynucleotide
taatacgactcactatagggatggcacttcatggctacaaatgcgcacttaacagaggagaaagtgcatgtttgtagccaacctggcggcagcgcaaaagatg

SEQ ID NO: 195619 - DNA, 103 bp, Artificial Sequence
  Synthetic Polynucleotide
taatacgactcactatagggattgggcaagatggcacttcatggctacaaaacagaggagattgtagatgtgaagtgccaacctggcggcagcgcaaaagatg

SEQ ID NO: 195620 - DNA, 103 bp, Artificial Sequence
  Synthetic Polynucleotide
taatacgactcactatagggatagaggcatattgggcaagatggcacttcaacagaggagagaagtgatgtcttgcccaaacctggcggcagcgcaaaagatg

SEQ ID NO: 195621 - DNA, 103 bp, Artificial Sequence
  Synthetic Polynucleotide
taatacgactcactatagggcagtaggtggatagaggcatattgggcaagaacagaggagacttgccatgtatgcctctaacctggcggcagcgcaaaagatg

SEQ ID NO: 195622 - DNA, 103 bp, Artificial Sequence
  Synthetic Polynucleotide
taatacgactcactatagggatcttggctgcagtaggtggatagaggcataacagaggagaatgcctatgtccacctacaacctggcggcagcgcaaaagatg

SEQ ID NO: 195623 - DNA, 103 bp, Artificial Sequence
  Synthetic Polynucleotide
taatacgactcactataggggctgcccgaagaggcggaggagctgttggaaacagaggagatccaacatgtcctccgccaacctggcggcagcgcaaaagatg

SEQ ID NO: 195624 - DNA, 103 bp, Artificial Sequence
  Synthetic Polynucleotide
taatacgactcactatagggacaacgggttatcttggctgcagtaggtggaacagaggagaccacctatggcagccaagaacctggcggcagcgcaaaagatg

SEQ ID NO: 195625 - DNA, 103 bp, Artificial Sequence
  Synthetic Polynucleotide
taatacgactcactatagggagatgtgtccacaacgggttatcttggctgaacagaggagacagccaatgtaacccgttaacctggcggcagcgcaaaagatg

SEQ ID NO: 195626 - DNA, 103 bp, Artificial Sequence
  Synthetic Polynucleotide
taatacgactcactataggggcccagcagaagatgtgtccacaacgggttaacagaggagaaacccgatgtggacacataacctggcggcagcgcaaaagatg

SEQ ID NO: 195627 - DNA, 103 bp, Artificial Sequence
  Synthetic Polynucleotide
taatacgactcactatagggcaggatgcatgcccagcagaagatgtgtccaacagaggagaggacacatgttctgctggaacctggcggcagcgcaaaagatg

SEQ ID NO: 195628 - DNA, 103 bp, Artificial Sequence
  Synthetic Polynucleotide
taatacgactcactatagggaaagatagtgcaggatgcatgcccagcagaaacagaggagatctgctatgcatgcatccaacctggcggcagcgcaaaagatg

SEQ ID NO: 195629 - DNA, 103 bp, Artificial Sequence
  Synthetic Polynucleotide
taatacgactcactatagggtcactcagtgaaagatagtgcaggatgcataacagaggagaatgcatatggcactatctaacctggcggcagcgcaaaagatg

SEQ ID NO: 195630 - DNA, 103 bp, Artificial Sequence
  Synthetic Polynucleotide
taatacgactcactatagggccacgtcttctcactcagtgaaagatagtgaacagaggagacactatatgtcactgagtaacctggcggcagcgcaaaagatg

SEQ ID NO: 195631 - DNA, 103 bp, Artificial Sequence
  Synthetic Polynucleotide
taatacgactcactataggggacatttactccacgtcttctcactcagtgaacagaggagacactgaatgagaagacgtaacctggcggcagcgcaaaagatg

SEQ ID NO: 195632 - DNA, 103 bp, Artificial Sequence
  Synthetic Polynucleotide
taatacgactcactatagggtaacagatgggacatttactccacgtcttcaacagaggagagaagacatggagtaaatgaacctggcggcagcgcaaaagatg

SEQ ID NO: 195633 - DNA, 103 bp, Artificial Sequence
  Synthetic Polynucleotide
taatacgactcactatagggcacagaactgtaacagatgggacatttactaacagaggagaagtaaaatgcccatctgtaacctggcggcagcgcaaaagatg

SEQ ID NO: 195634 - DNA, 103 bp, Artificial Sequence
  Synthetic Polynucleotide
taatacgactcactataggggccctttgctgctgcccgaagaggcggaggaacagaggagacctccgatgcttcgggcaaacctggcggcagcgcaaaagatg

SEQ ID NO: 195635 - DNA, 103 bp, Artificial Sequence
  Synthetic Polynucleotide
taatacgactcactatagggccttcttatgcacagaactgtaacagatggaacagaggagaccatctatgacagttctgaacctggcggcagcgcaaaagatg

SEQ ID NO: 195636 - DNA, 103 bp, Artificial Sequence
  Synthetic Polynucleotide
taatacgactcactatagggctcttgagatccttcttatgcacagaactgaacagaggagacagttcatggcataagaaaacctggcggcagcgcaaaagatg

SEQ ID NO: 195637 - DNA, 103 bp, Artificial Sequence
  Synthetic Polynucleotide
taatacgactcactatagggggcaacaacactcttgagatccttcttatgaacagaggagacataagatggatctcaagaacctggcggcagcgcaaaagatg

SEQ ID NO: 195638 - DNA, 103 bp, Artificial Sequence
  Synthetic Polynucleotide
taatacgactcactataggggtgactctgtggcaacaacactcttgagataacagaggagaatctcaatggtgttgttgaacctggcggcagcgcaaaagatg

SEQ ID NO: 195639 - DNA, 103 bp, Artificial Sequence
  Synthetic Polynucleotide
taatacgactcactatagggacatactgatgtgactctgtggcaacaacaaacagaggagatgttgtatgcacagagtcaacctggcggcagcgcaaaagatg

SEQ ID NO: 195640 - DNA, 103 bp, Artificial Sequence
  Synthetic Polynucleotide
taatacgactcactatagggatcaccaacaacatactgatgtgactctgtaacagaggagaacagagatgcatcagtataacctggcggcagcgcaaaagatg

SEQ ID NO: 195641 - DNA, 103 bp, Artificial Sequence
  Synthetic Polynucleotide
taatacgactcactatagggtcgtaatggtatcaccaacaacatactgataacagaggagaatcagtatgttgttggtgaacctggcggcagcgcaaaagatg

SEQ ID NO: 195642 - DNA, 103 bp, Artificial Sequence
  Synthetic Polynucleotide
taatacgactcactatagggatcagctgcatcgtaatggtatcaccaacaaacagaggagatgttggatgtaccattacaacctggcggcagcgcaaaagatg

SEQ ID NO: 195643 - DNA, 103 bp, Artificial Sequence
  Synthetic Polynucleotide
taatacgactcactatagggctccctcttcatcagctgcatcgtaatggtaacagaggagaaccattatgatgcagctgaacctggcggcagcgcaaaagatg

SEQ ID NO: 195644 - DNA, 103 bp, Artificial Sequence
  Synthetic Polynucleotide
taatacgactcactatagggacacccctttctccctcttcatcagctgcaaacagaggagatgcagcatgtgaagagggaacctggcggcagcgcaaaagatg

SEQ ID NO: 195645 - DNA, 103 bp, Artificial Sequence
  Synthetic Polynucleotide
taatacgactcactatagggggcggctgttgccctttgctgctgcccgaaaacagaggagattcgggatgcagcaaaggaacctggcggcagcgcaaaagatg

SEQ ID NO: 195646 - DNA, 103 bp, Artificial Sequence
  Synthetic Polynucleotide
taatacgactcactatagggaaagccaccaacacccctttctccctcttcaacagaggagagaagagatggaaaggggtaacctggcggcagcgcaaaagatg

SEQ ID NO: 195647 - DNA, 103 bp, Artificial Sequence
  Synthetic Polynucleotide
taatacgactcactatagggggatttgggcaaagccaccaacacccctttaacagaggagaaaagggatgttggtggctaacctggcggcagcgcaaaagatg

SEQ ID NO: 195648 - DNA, 103 bp, Artificial Sequence
  Synthetic Polynucleotide
taatacgactcactatagggtcatccatttggatttgggcaaagccaccaaacagaggagatggtggatgtgcccaaataacctggcggcagcgcaaaagatg

SEQ ID NO: 195649 - DNA, 103 bp, Artificial Sequence
  Synthetic Polynucleotide
taatacgactcactatagggtggtctacattcatccatttggatttgggcaacagaggagagcccaaatgcaaatggataacctggcggcagcgcaaaagatg

SEQ ID NO: 195650 - DNA, 103 bp, Artificial Sequence
  Synthetic Polynucleotide
taatacgactcactatagggatgaatgggatggtctacattcatccatttaacagaggagaaaatggatgaatgtagacaacctggcggcagcgcaaaagatg

SEQ ID NO: 195651 - DNA, 103 bp, Artificial Sequence
  Synthetic Polynucleotide
taatacgactcactatagggcatctcctagatgaatgggatggtctacataacagaggagaatgtagatgatcccattcaacctggcggcagcgcaaaagatg

SEQ ID NO: 195652 - DNA, 103 bp, Artificial Sequence
  Synthetic Polynucleotide
taatacgactcactatagggctgtgctgttcatctcctagatgaatgggaaacagaggagatcccatatgtctaggagaaacctggcggcagcgcaaaagatg

SEQ ID NO: 195653 - DNA, 103 bp, Artificial Sequence
  Synthetic Polynucleotide
taatacgactcactatagggggagtactggctgtgctgttcatctcctagaacagaggagactaggaatggaacagcacaacctggcggcagcgcaaaagatg

SEQ ID NO: 195654 - DNA, 103 bp, Artificial Sequence
  Synthetic Polynucleotide
taatacgactcactataggggcagcaacttggagtactggctgtgctgttaacagaggagaaacagcatggccagtactaacctggcggcagcgcaaaagatg

SEQ ID NO: 195655 - DNA, 103 bp, Artificial Sequence
  Synthetic Polynucleotide
taatacgactcactatagggttagaggccagcagcaacttggagtactggaacagaggagaccagtaatgcaagttgctaacctggcggcagcgcaaaagatg

SEQ ID NO: 195656 - DNA, 103 bp, Artificial Sequence
  Synthetic Polynucleotide
taatacgactcactataggggtcactgtctcctggggccccctcattcataacagaggagaatgaatatgggggccccaaacctggcggcagcgcaaaagatg

SEQ ID NO: 195657 - DNA, 103 bp, Artificial Sequence
  Synthetic Polynucleotide
taatacgactcactatagggtgcaggtgtgggtgtggcagacattctggcaacagaggagagccagaatgtctgccacaaacctggcggcagcgcaaaagatg

SEQ ID NO: 195658 - DNA, 103 bp, Artificial Sequence
  Synthetic Polynucleotide
taatacgactcactatagggttcttcctgtaaaaaggtctgccacgttataacagaggagaataacgatgcagacctttaacctggcggcagcgcaaaagatg

SEQ ID NO: 195659 - DNA, 103 bp, Artificial Sequence
  Synthetic Polynucleotide
taatacgactcactatagggagttctcaatttcttcctgtaaaaaggtctaacagaggagaagacctatgtacaggaagaacctggcggcagcgcaaaagatg

SEQ ID NO: 195660 - DNA, 103 bp, Artificial Sequence
  Synthetic Polynucleotide
taatacgactcactatagggttgttttgatagttctcaatttcttcctgtaacagaggagaacaggaatgaattgagaaaacctggcggcagcgcaaaagatg

SEQ ID NO: 195661 - DNA, 103 bp, Artificial Sequence
  Synthetic Polynucleotide
taatacgactcactatagggctcccgctgcttgttttgatagttctcaataacagaggagaattgagatgtatcaaaacaacctggcggcagcgcaaaagatg

SEQ ID NO: 195662 - DNA, 103 bp, Artificial Sequence
  Synthetic Polynucleotide
taatacgactcactataggggccacatcacctcccgctgcttgttttgataacagaggagaatcaaaatgagcagcgggaacctggcggcagcgcaaaagatg

SEQ ID NO: 195663 - DNA, 103 bp, Artificial Sequence
  Synthetic Polynucleotide
taatacgactcactataggggcacacaattgccacatcacctcccgctgcaacagaggagagcagcgatgggtgatgtgaacctggcggcagcgcaaaagatg

SEQ ID NO: 195664 - DNA, 103 bp, Artificial Sequence
  Synthetic Polynucleotide
taatacgactcactatagggaattttgatggcacacaattgccacatcacaacagaggagagtgatgatgcaattgtgtaacctggcggcagcgcaaaagatg

SEQ ID NO: 195665 - DNA, 103 bp, Artificial Sequence
  Synthetic Polynucleotide
taatacgactcactatagggtagcttctgtaattttgatggcacacaattaacagaggagaaattgtatgccatcaaaaaacctggcggcagcgcaaaagatg

SEQ ID NO: 195666 - DNA, 103 bp, Artificial Sequence
  Synthetic Polynucleotide
taatacgactcactatagggacatactgtatagcttctgtaattttgatgaacagaggagacatcaaatgtacagaagcaacctggcggcagcgcaaaagatg

SEQ ID NO: 195667 - DNA, 103 bp, Artificial Sequence
  Synthetic Polynucleotide
taatacgactcactatagggaaactccaccacatactgtatagcttctgtaacagaggagaacagaaatgatacagtataacctggcggcagcgcaaaagatg

SEQ ID NO: 195668 - DNA, 103 bp, Artificial Sequence
  Synthetic Polynucleotide
taatacgactcactatagggctccttcacctgcaggtgtgggtgtggcagaacagaggagactgccaatgccacacctgaacctggcggcagcgcaaaagatg

SEQ ID NO: 195669 - DNA, 103 bp, Artificial Sequence
  Synthetic Polynucleotide
taatacgactcactatagggtgcgtttggcaaactccaccacatactgtaaacagaggagatacagtatgtggtggagtaacctggcggcagcgcaaaagatg

SEQ ID NO: 195670 - DNA, 103 bp, Artificial Sequence
  Synthetic Polynucleotide
taatacgactcactatagggaatccatcaatgcgtttggcaaactccaccaacagaggagaggtggaatgtgccaaacgaacctggcggcagcgcaaaagatg

SEQ ID NO: 195671 - DNA, 103 bp, Artificial Sequence
  Synthetic Polynucleotide
taatacgactcactatagggcagttccataaatccatcaatgcgtttggcaacagaggagagccaaaatgattgatggaaacctggcggcagcgcaaaagatg

SEQ ID NO: 195672 - DNA, 103 bp, Artificial Sequence
  Synthetic Polynucleotide
taatacgactcactatagggcattttgacacagttccataaatccatcaaaacagaggagattgatgatgttatggaacaacctggcggcagcgcaaaagatg

SEQ ID NO: 195673 - DNA, 103 bp, Artificial Sequence
  Synthetic Polynucleotide
taatacgactcactatagggacaatttgatcattttgacacagttccataaacagaggagatatggaatggtgtcaaaaaacctggcggcagcgcaaaagatg

SEQ ID NO: 195674 - DNA, 103 bp, Artificial Sequence
  Synthetic Polynucleotide
taatacgactcactatagggttttagaagcacaatttgatcattttgacaaacagaggagatgtcaaatggatcaaattaacctggcggcagcgcaaaagatg

SEQ ID NO: 195675 - DNA, 103 bp, Artificial Sequence
  Synthetic Polynucleotide
taatacgactcactataggggagaacctgcttttagaagcacaatttgataacagaggagaatcaaaatgtgcttctaaaacctggcggcagcgcaaaagatg

SEQ ID NO: 195676 - DNA, 103 bp, Artificial Sequence
  Synthetic Polynucleotide
taatacgactcactatagggaccacctctagagaacctgcttttagaagcaacagaggagagcttctatgagcaggttcaacctggcggcagcgcaaaagatg

SEQ ID NO: 195677 - DNA, 103 bp, Artificial Sequence
  Synthetic Polynucleotide
taatacgactcactatagggtctgataaacaccacctctagagaacctgcaacagaggagagcaggtatgctagaggtgaacctggcggcagcgcaaaagatg

SEQ ID NO: 195678 - DNA, 103 bp, Artificial Sequence
  Synthetic Polynucleotide
taatacgactcactatagggcacggcacattctgataaacaccacctctaaacagaggagatagaggatgtgtttatcaaacctggcggcagcgcaaaagatg

SEQ ID NO: 195679 - DNA, 103 bp, Artificial Sequence
  Synthetic Polynucleotide
taatacgactcactatagggtcccttctggctccttcacctgcaggtgtgaacagaggagacacaccatgaggtgaaggaacctggcggcagcgcaaaagatg

SEQ ID NO: 195680 - DNA, 103 bp, Artificial Sequence
  Synthetic Polynucleotide
taatacgactcactataggggagtcaaaggcacggcacattctgataaacaacagaggagagtttatatgaatgtgccgaacctggcggcagcgcaaaagatg

SEQ ID NO: 195681 - DNA, 103 bp, Artificial Sequence
  Synthetic Polynucleotide
taatacgactcactataggggttgttctgagagtcaaaggcacggcacataacagaggagaatgtgcatggcctttgacaacctggcggcagcgcaaaagatg

SEQ ID NO: 195682 - DNA, 103 bp, Artificial Sequence
  Synthetic Polynucleotide
taatacgactcactatagggagtacacggtgttgttctgagagtcaaaggaacagaggagacctttgatgctcagaacaaacctggcggcagcgcaaaagatg

SEQ ID NO: 195683 - DNA, 103 bp, Artificial Sequence
  Synthetic Polynucleotide
taatacgactcactatagggttcccatcaaagtacacggtgttgttctgaaacagaggagatcagaaatgcaccgtgtaaacctggcggcagcgcaaaagatg

SEQ ID NO: 195684 - DNA, 103 bp, Artificial Sequence
  Synthetic Polynucleotide
taatacgactcactataggggctggcatacttcccatcaaagtacacggtaacagaggagaaccgtgatgtttgatgggaacctggcggcagcgcaaaagatg

SEQ ID NO: 195685 - DNA, 103 bp, Artificial Sequence
  Synthetic Polynucleotide
taatacgactcactatagggagacgtcggggctggcatacttcccatcaaaacagaggagattgatgatgagtatgccaaacctggcggcagcgcaaaagatg

SEQ ID NO: 195686 - DNA, 103 bp, Artificial Sequence
  Synthetic Polynucleotide
taatacgactcactatagggaaggatttgaagacgtcggggctggcatacaacagaggagagtatgcatgccccgacgtaacctggcggcagcgcaaaagatg

SEQ ID NO: 195687 - DNA, 103 bp, Artificial Sequence
  Synthetic Polynucleotide
taatacgactcactatagggttcacaacctaaggatttgaagacgtcgggaacagaggagacccgacatgttcaaatccaacctggcggcagcgcaaaagatg

SEQ ID NO: 195688 - DNA, 103 bp, Artificial Sequence
  Synthetic Polynucleotide
taatacgactcactatagggtaataaagtcttcacaacctaaggatttgaaacagaggagatcaaatatgtaggttgtgaacctggcggcagcgcaaaagatg

SEQ ID NO: 195689 - DNA, 103 bp, Artificial Sequence
  Synthetic Polynucleotide
taatacgactcactatagggaacacaaagctaataaagtcttcacaacctaacagaggagaaggttgatgagactttataacctggcggcagcgcaaaagatg

SEQ ID NO: 195690 - DNA, 103 bp, Artificial Sequence
  Synthetic Polynucleotide
taatacgactcactatagggaaaaagttcatcccttctggctccttcaccaacagaggagaggtgaaatggccagaaggaacctggcggcagcgcaaaagatg

SEQ ID NO: 195691 - DNA, 103 bp, Artificial Sequence
  Synthetic Polynucleotide
taatacgactcactatagggtccaaattcaaacacaaagctaataaagtcaacagaggagagactttatgagctttgtgaacctggcggcagcgcaaaagatg

SEQ ID NO: 195692 - DNA, 103 bp, Artificial Sequence
  Synthetic Polynucleotide
taatacgactcactatagggataaactctttccaaattcaaacacaaagcaacagaggagagctttgatgttgaatttgaacctggcggcagcgcaaaagatg

SEQ ID NO: 195693 - DNA, 103 bp, Artificial Sequence
  Synthetic Polynucleotide
taatacgactcactatagggtgcatagaacataaactctttccaaattcaaacagaggagatgaattatgaaagagtttaacctggcggcagcgcaaaagatg

SEQ ID NO: 195694 - DNA, 103 bp, Artificial Sequence
  Synthetic Polynucleotide
taatacgactcactatagggttcagtcaggtgcatagaacataaactcttaacagaggagaaagagtatgtgttctatgaacctggcggcagcgcaaaagatg

SEQ ID NO: 195695 - DNA, 103 bp, Artificial Sequence
  Synthetic Polynucleotide
taatacgactcactatagggcaatttcatcttcagtcaggtgcatagaacaacagaggagagttctaatgacctgactgaacctggcggcagcgcaaaagatg

SEQ ID NO: 195696 - DNA, 103 bp, Artificial Sequence
  Synthetic Polynucleotide
taatacgactcactataggggaaaataatgcaatttcatcttcagtcaggaacagaggagacctgacatgagatgaaataacctggcggcagcgcaaaagatg

SEQ ID NO: 195697 - DNA, 103 bp, Artificial Sequence
  Synthetic Polynucleotide
taatacgactcactatagggtacaaatgcagaaaataatgcaatttcatcaacagaggagagatgaaatggcattatttaacctggcggcagcgcaaaagatg

SEQ ID NO: 195698 - DNA, 103 bp, Artificial Sequence
  Synthetic Polynucleotide
taatacgactcactatagggctgacatcagtacaaatgcagaaaataatgaacagaggagacattatatgctgcatttgaacctggcggcagcgcaaaagatg

SEQ ID NO: 195699 - DNA, 103 bp, Artificial Sequence
  Synthetic Polynucleotide
taatacgactcactataggggagcgatctgctgacatcagtacaaatgcaaacagaggagatgcattatgactgatgtcaacctggcggcagcgcaaaagatg

SEQ ID NO: 195700 - DNA, 103 bp, Artificial Sequence
  Synthetic Polynucleotide
taatacgactcactatagggttgcagccatgagcgatctgctgacatcagaacagaggagactgatgatggcagatcgcaacctggcggcagcgcaaaagatg

SEQ ID NO: 195701 - DNA, 103 bp, Artificial Sequence
  Synthetic Polynucleotide
taatacgactcactatagggggagaatcccaaaaagttcatcccttctggaacagaggagaccagaaatgatgaactttaacctggcggcagcgcaaaagatg

SEQ ID NO: 195702 - DNA, 103 bp, Artificial Sequence
  Synthetic Polynucleotide
taatacgactcactatagggttaccttttcttgcagccatgagcgatctgaacagaggagacagatcatgcatggctgcaacctggcggcagcgcaaaagatg

SEQ ID NO: 195703 - DNA, 103 bp, Artificial Sequence
  Synthetic Polynucleotide
taatacgactcactatagggttttcaatttttaccttttcttgcagccataacagaggagaatggctatgagaaaaggtaacctggcggcagcgcaaaagatg

SEQ ID NO: 195704 - DNA, 103 bp, Artificial Sequence
  Synthetic Polynucleotide
taatacgactcactatagggctgttgcagtttttcaatttttaccttttcaacagaggagagaaaagatgaaaattgaaaacctggcggcagcgcaaaagatg

SEQ ID NO: 195705 - DNA, 103 bp, Artificial Sequence
  Synthetic Polynucleotide
taatacgactcactataggggctgaattttctgttgcagtttttcaatttaacagaggagaaaattgatgaactgcaacaacctggcggcagcgcaaaagatg

SEQ ID NO: 195706 - DNA, 103 bp, Artificial Sequence
  Synthetic Polynucleotide
taatacgactcactatagggtgaagagctagctgaattttctgttgcagtaacagaggagaactgcaatggaaaattcaaacctggcggcagcgcaaaagatg

SEQ ID NO: 195707 - DNA, 103 bp, Artificial Sequence
  Synthetic Polynucleotide
taatacgactcactatagggtaggacgtgttgaagagctagctgaattttaacagaggagaaaaattatgctagctcttaacctggcggcagcgcaaaagatg

SEQ ID NO: 195708 - DNA, 103 bp, Artificial Sequence
  Synthetic Polynucleotide
taatacgactcactataggggattcttctgtaggacgtgttgaagagctaaacagaggagatagctcatgaacacgtccaacctggcggcagcgcaaaagatg

SEQ ID NO: 195709 - DNA, 103 bp, Artificial Sequence
  Synthetic Polynucleotide
taatacgactcactatagggtcttctcggtgattcttctgtaggacgtgtaacagaggagaacacgtatgacagaagaaaacctggcggcagcgcaaaagatg

SEQ ID NO: 195710 - DNA, 103 bp, Artificial Sequence
  Synthetic Polynucleotide
taatacgactcactatagggtagtattccatcttctcggtgattcttctgaacagaggagacagaagatgcaccgagaaaacctggcggcagcgcaaaagatg

SEQ ID NO: 195711 - DNA, 103 bp, Artificial Sequence
  Synthetic Polynucleotide
taatacgactcactatagggttaactttgttagtattccatcttctcggtaacagaggagaaccgagatgatggaatacaacctggcggcagcgcaaaagatg

SEQ ID NO: 195712 - DNA, 103 bp, Artificial Sequence
  Synthetic Polynucleotide
taatacgactcactatagggtggagtatttggagaatcccaaaaagttcaaacagaggagatgaactatgtgggattctaacctggcggcagcgcaaaagatg

SEQ ID NO: 195713 - DNA, 103 bp, Artificial Sequence
  Synthetic Polynucleotide
taatacgactcactatagggaccttgcatattaactttgttagtattccaaacagaggagatggaatatgaacaaagttaacctggcggcagcgcaaaagatg

SEQ ID NO: 195714 - DNA, 103 bp, Artificial Sequence
  Synthetic Polynucleotide
taatacgactcactatagggtaaggtagacaccttgcatattaactttgtaacagaggagaacaaagatgatatgcaagaacctggcggcagcgcaaaagatg

SEQ ID NO: 195715 - DNA, 103 bp, Artificial Sequence
  Synthetic Polynucleotide
taatacgactcactatagggataaggctcttaaggtagacaccttgcataaacagaggagatatgcaatgtgtctacctaacctggcggcagcgcaaaagatg

SEQ ID NO: 195716 - DNA, 103 bp, Artificial Sequence
  Synthetic Polynucleotide
taatacgactcactatagggtgtcgtccacataaggctcttaaggtagacaacagaggagagtctacatgaagagccttaacctggcggcagcgcaaaagatg

SEQ ID NO: 195717 - DNA, 103 bp, Artificial Sequence
  Synthetic Polynucleotide
taatacgactcactatagggcttttctgtatgtcgtccacataaggctctaacagaggagaagagccatgtgtggacgaaacctggcggcagcgcaaaagatg

SEQ ID NO: 195718 - DNA, 103 bp, Artificial Sequence
  Synthetic Polynucleotide
taatacgactcactatagggatgccattagcttttctgtatgtcgtccacaacagaggagagtggacatgatacagaaaaacctggcggcagcgcaaaagatg

SEQ ID NO: 195719 - DNA, 103 bp, Artificial Sequence
  Synthetic Polynucleotide
taatacgactcactatagggattgctttaaatgccattagcttttctgtaaacagaggagatacagaatggctaatggcaacctggcggcagcgcaaaagatg

SEQ ID NO: 195720 - DNA, 103 bp, Artificial Sequence
  Synthetic Polynucleotide
taatacgactcactataggggtctgggtatattgctttaaatgccattagaacagaggagactaatgatgtttaaagcaaacctggcggcagcgcaaaagatg

SEQ ID NO: 195721 - DNA, 103 bp, Artificial Sequence
  Synthetic Polynucleotide
taatacgactcactataggggtcgcacaatgtctgggtatattgctttaaaacagaggagattaaagatgtatacccagaacctggcggcagcgcaaaagatg

SEQ ID NO: 195722 - DNA, 103 bp, Artificial Sequence
  Synthetic Polynucleotide
taatacgactcactatagggggaaaatgaagtcgcacaatgtctgggtataacagaggagaatacccatgcattgtgcgaacctggcggcagcgcaaaagatg

SEQ ID NO: 195723 - DNA, 103 bp, Artificial Sequence
  Synthetic Polynucleotide
taatacgactcactataggggatacactgatggagtatttggagaatcccaacagaggagagggattatgcaaatactcaacctggcggcagcgcaaaagatg

SEQ ID NO: 195724 - DNA, 103 bp, Artificial Sequence
  Synthetic Polynucleotide
taatacgactcactataggggtataatggaggaaaatgaagtcgcacaataacagaggagaattgtgatgcttcattttaacctggcggcagcgcaaaagatg

SEQ ID NO: 195725 - DNA, 103 bp, Artificial Sequence
  Synthetic Polynucleotide
taatacgactcactatagggacaactccttgtataatggaggaaaatgaaaacagaggagattcattatgctccattataacctggcggcagcgcaaaagatg

SEQ ID NO: 195726 - DNA, 103 bp, Artificial Sequence
  Synthetic Polynucleotide
taatacgactcactatagggtctgaagtgaacaactccttgtataatggaaacagaggagatccattatgcaaggagttaacctggcggcagcgcaaaagatg

SEQ ID NO: 195727 - DNA, 103 bp, Artificial Sequence
  Synthetic Polynucleotide
taatacgactcactatagggtggctcaaattctgaagtgaacaactccttaacagaggagaaaggagatgttcacttcaaacctggcggcagcgcaaaagatg

SEQ ID NO: 195728 - DNA, 103 bp, Artificial Sequence
  Synthetic Polynucleotide
taatacgactcactatagggtttgcattgctggctcaaattctgaagtgaaacagaggagatcacttatgaatttgagcaacctggcggcagcgcaaaagatg

SEQ ID NO: 195729 - DNA, 103 bp, Artificial Sequence
  Synthetic Polynucleotide
taatacgactcactatagggtacccatcaatttgcattgctggctcaaataacagaggagaatttgaatgagcaatgcaaacctggcggcagcgcaaaagatg

SEQ ID NO: 195730 - DNA, 103 bp, Artificial Sequence
  Synthetic Polynucleotide
taatacgactcactatagggctgaagacaggatacactgatggagtatttaacagaggagaaaatacatgatcagtgtaaacctggcggcagcgcaaaagatg

SEQ ID NO: 195731 - DNA, 103 bp, Artificial Sequence
  Synthetic Polynucleotide
taatacgactcactatagggaaagcatcacctgaagacaggatacactgaaacagaggagatcagtgatgcctgtcttcaacctggcggcagcgcaaaagatg

SEQ ID NO: 195732 - DNA, 103 bp, Artificial Sequence
  Synthetic Polynucleotide
taatacgactcactatagggagtaagaacaaaagcatcacctgaagacagaacagaggagactgtctatgggtgatgctaacctggcggcagcgcaaaagatg

SEQ ID NO: 195733 - DNA, 103 bp, Artificial Sequence
  Synthetic Polynucleotide
taatacgactcactatagggcagtctctaagtcactgtctcctggggcccaacagaggagagggcccatggagacagtgaacctggcggcagcgcaaaagatg

SEQ ID NO: 195734 - DNA, 103 bp, Artificial Sequence
  Synthetic Polynucleotide
taatacgactcactatagggaacagacgccagtaagaacaaaagcatcacaacagaggagagtgatgatgttgttcttaaacctggcggcagcgcaaaagatg

SEQ ID NO: 195735 - DNA, 103 bp, Artificial Sequence
  Synthetic Polynucleotide
taatacgactcactatagggctccaggaacaacagacgccagtaagaacaaacagaggagatgttctatgtggcgtctgaacctggcggcagcgcaaaagatg

SEQ ID NO: 195736 - DNA, 103 bp, Artificial Sequence
  Synthetic Polynucleotide
taatacgactcactataggggccattctgcctccaggaacaacagacgccaacagaggagaggcgtcatgtgttcctggaacctggcggcagcgcaaaagatg

SEQ ID NO: 195737 - DNA, 103 bp, Artificial Sequence
  Synthetic Polynucleotide
taatacgactcactatagggatggtggcttgccattctgcctccaggaacaacagaggagagttcctatgggcagaatgaacctggcggcagcgcaaaagatg

SEQ ID NO: 195738 - DNA, 103 bp, Artificial Sequence
  Synthetic Polynucleotide
taatacgactcactatagggttttgtgaatatggtggcttgccattctgcaacagaggagagcagaaatgcaagccaccaacctggcggcagcgcaaaagatg

SEQ ID NO: 195739 - DNA, 103 bp, Artificial Sequence
  Synthetic Polynucleotide
taatacgactcactatagggcttatcttccttttgtgaatatggtggcttaacagaggagaaagccaatgtattcacaaaacctggcggcagcgcaaaagatg

SEQ ID NO: 195740 - DNA, 103 bp, Artificial Sequence
  Synthetic Polynucleotide
taatacgactcactatagggtttgtacttccttatcttccttttgtgaataacagaggagaattcacatgaggaagataaacctggcggcagcgcaaaagatg

SEQ ID NO: 195741 - DNA, 103 bp, Artificial Sequence
  Synthetic Polynucleotide
taatacgactcactatagggatgtatccagtttgtacttccttatcttccaacagaggagaggaagaatgggaagtacaaacctggcggcagcgcaaaagatg

SEQ ID NO: 195742 - DNA, 103 bp, Artificial Sequence
  Synthetic Polynucleotide
taatacgactcactatagggttgagcattcatgtatccagtttgtacttcaacagaggagagaagtaatgactggatacaacctggcggcagcgcaaaagatg

SEQ ID NO: 195743 - DNA, 103 bp, Artificial Sequence
  Synthetic Polynucleotide
taatacgactcactatagggtaatttcaatttgagcattcatgtatccagaacagaggagactggatatgtgaatgctcaacctggcggcagcgcaaaagatg

SEQ ID NO: 195744 - DNA, 103 bp, Artificial Sequence
  Synthetic Polynucleotide
taatacgactcactatagggactcttgcctcagtctctaagtcactgtctaacagaggagaagacagatgcttagagacaacctggcggcagcgcaaaagatg

SEQ ID NO: 195745 - DNA, 103 bp, Artificial Sequence
  Synthetic Polynucleotide
taatacgactcactatagggttgcatggaataatttcaatttgagcattcaacagaggagagaatgcatgaattgaaataacctggcggcagcgcaaaagatg

SEQ ID NO: 195746 - DNA, 103 bp, Artificial Sequence
  Synthetic Polynucleotide
taatacgactcactatagggtccacagatcttgcatggaataatttcaataacagaggagaattgaaatgattccatgcaacctggcggcagcgcaaaagatg

SEQ ID NO: 195747 - DNA, 103 bp, Artificial Sequence
  Synthetic Polynucleotide
taatacgactcactatagggatgatttgtctccacagatcttgcatggaaaacagaggagattccatatgagatctgtgaacctggcggcagcgcaaaagatg

SEQ ID NO: 195748 - DNA, 103 bp, Artificial Sequence
  Synthetic Polynucleotide
taatacgactcactatagggtggattcctgatgatttgtctccacagatcaacagaggagagatctgatgagacaaatcaacctggcggcagcgcaaaagatg

SEQ ID NO: 195749 - DNA, 103 bp, Artificial Sequence
  Synthetic Polynucleotide
taatacgactcactataggggacaccataatggattcctgatgatttgtcaacagaggagagacaaaatgtcaggaatcaacctggcggcagcgcaaaagatg

SEQ ID NO: 195750 - DNA, 103 bp, Artificial Sequence
  Synthetic Polynucleotide
taatacgactcactatagggcacatgtaatgacaccataatggattcctgaacagaggagacaggaaatgattatggtgaacctggcggcagcgcaaaagatg

SEQ ID NO: 195751 - DNA, 103 bp, Artificial Sequence
  Synthetic Polynucleotide
taatacgactcactatagggttgcagccttcacatgtaatgacaccataaaacagaggagattatggatgcattacatgaacctggcggcagcgcaaaagatg

SEQ ID NO: 195752 - DNA, 103 bp, Artificial Sequence
  Synthetic Polynucleotide
taatacgactcactataggggaaaaagcccttgcagccttcacatgtaataacagaggagaattacaatggaaggctgcaacctggcggcagcgcaaaagatg

SEQ ID NO: 195753 - DNA, 103 bp, Artificial Sequence
  Synthetic Polynucleotide
taatacgactcactataggggacttctcctgaaaaagcccttgcagccttaacagaggagaaaggctatgagggcttttaacctggcggcagcgcaaaagatg

SEQ ID NO: 195754 - DNA, 103 bp, Artificial Sequence
  Synthetic Polynucleotide
taatacgactcactatagggttgctttgctgacttctcctgaaaaagcccaacagaggagagggcttatgcaggagaagaacctggcggcagcgcaaaagatg

SEQ ID NO: 195755 - DNA, 103 bp, Artificial Sequence
  Synthetic Polynucleotide
taatacgactcactatagggtgaccacggcactcttgcctcagtctctaaaacagaggagattagagatggaggcaagaaacctggcggcagcgcaaaagatg

SEQ ID NO: 195756 - DNA, 103 bp, Artificial Sequence
  Synthetic Polynucleotide
taatacgactcactataggggtaggtggcattgctttgctgacttctcctaacagaggagaaggagaatgcagcaaagcaacctggcggcagcgcaaaagatg

SEQ ID NO: 195757 - DNA, 103 bp, Artificial Sequence
  Synthetic Polynucleotide
taatacgactcactataggggaggacaggagtaggtggcattgctttgctaacagaggagaagcaaaatgatgccacctaacctggcggcagcgcaaaagatg

SEQ ID NO: 195758 - DNA, 103 bp, Artificial Sequence
  Synthetic Polynucleotide
taatacgactcactatagggttcttctgacgaggacaggagtaggtggcaaacagaggagatgccacatgctcctgtccaacctggcggcagcgcaaaagatg

SEQ ID NO: 195759 - DNA, 103 bp, Artificial Sequence
  Synthetic Polynucleotide
taatacgactcactatagggaatcaaacagttcttctgacgaggacaggaaacagaggagatcctgtatgcgtcagaagaacctggcggcagcgcaaaagatg

SEQ ID NO: 195760 - DNA, 103 bp, Artificial Sequence
  Synthetic Polynucleotide
taatacgactcactatagggtggttcgatcaatcaaacagttcttctgacaacagaggagagtcagaatgactgtttgaaacctggcggcagcgcaaaagatg

SEQ ID NO: 195761 - DNA, 103 bp, Artificial Sequence
  Synthetic Polynucleotide
taatacgactcactatagggcggtttctactggttcgatcaatcaaacagaacagaggagactgtttatgtgatcgaacaacctggcggcagcgcaaaagatg

SEQ ID NO: 195762 - DNA, 103 bp, Artificial Sequence
  Synthetic Polynucleotide
taatacgactcactataggggtgttggcagcggtttctactggttcgatcaacagaggagagatcgaatgagtagaaacaacctggcggcagcgcaaaagatg

SEQ ID NO: 195763 - DNA, 103 bp, Artificial Sequence
  Synthetic Polynucleotide
taatacgactcactataggggtaatcgacagtgttggcagcggtttctacaacagaggagagtagaaatggctgccaacaacctggcggcagcgcaaaagatg

SEQ ID NO: 195764 - DNA, 103 bp, Artificial Sequence
  Synthetic Polynucleotide
taatacgactcactatagggaggcatttctgtaatcgacagtgttggcagaacagaggagactgccaatgctgtcgattaacctggcggcagcgcaaaagatg

SEQ ID NO: 195765 - DNA, 103 bp, Artificial Sequence
  Synthetic Polynucleotide
taatacgactcactatagggccctacggcaaggcatttctgtaatcgacaaacagaggagatgtcgaatgcagaaatgcaacctggcggcagcgcaaaagatg

SEQ ID NO: 195766 - DNA, 103 bp, Artificial Sequence
  Synthetic Polynucleotide
taatacgactcactataggggacccatgattgaccacggcactcttgcctaacagaggagaaggcaaatgtgccgtggtaacctggcggcagcgcaaaagatg

SEQ ID NO: 195767 - DNA, 103 bp, Artificial Sequence
  Synthetic Polynucleotide
taatacgactcactatagggctcgagacatccctacggcaaggcatttctaacagaggagaagaaatatgttgccgtagaacctggcggcagcgcaaaagatg

SEQ ID NO: 195768 - DNA, 103 bp, Artificial Sequence
  Synthetic Polynucleotide
taatacgactcactatagggtttacagcatctcgagacatccctacggcaaacagaggagatgccgtatggatgtctcgaacctggcggcagcgcaaaagatg

SEQ ID NO: 195769 - DNA, 103 bp, Artificial Sequence
  Synthetic Polynucleotide
taatacgactcactatagggtcggccaaattttacagcatctcgagacataacagaggagaatgtctatggatgctgtaaacctggcggcagcgcaaaagatg

SEQ ID NO: 195770 - DNA, 103 bp, Artificial Sequence
  Synthetic Polynucleotide
taatacgactcactatagggtttttgacattcggccaaattttacagcataacagaggagaatgctgatgaatttggccaacctggcggcagcgcaaaagatg

SEQ ID NO: 195771 - DNA, 103 bp, Artificial Sequence
  Synthetic Polynucleotide
taatacgactcactatagggtctctctgcttttttgacattcggccaaataacagaggagaatttggatgaatgtcaaaaacctggcggcagcgcaaaagatg

SEQ ID NO: 195772 - DNA, 103 bp, Artificial Sequence
  Synthetic Polynucleotide
taatacgactcactatagggatacaagctgtctctctgcttttttgacataacagaggagaatgtcaatgaagcagagaaacctggcggcagcgcaaaagatg

SEQ ID NO: 195773 - DNA, 103 bp, Artificial Sequence
  Synthetic Polynucleotide
taatacgactcactataggggtacttctgcatacaagctgtctctctgctaacagaggagaagcagaatgacagcttgtaacctggcggcagcgcaaaagatg

SEQ ID NO: 195774 - DNA, 103 bp, Artificial Sequence
  Synthetic Polynucleotide
taatacgactcactatagggcggtgtttctgtacttctgcatacaagctgaacagaggagacagcttatgtgcagaagtaacctggcggcagcgcaaaagatg

SEQ ID NO: 195775 - DNA, 103 bp, Artificial Sequence
  Synthetic Polynucleotide
taatacgactcactatagggctgctgcatccggtgtttctgtacttctgcaacagaggagagcagaaatgcagaaacacaacctggcggcagcgcaaaagatg

SEQ ID NO: 195776 - DNA, 103 bp, Artificial Sequence
  Synthetic Polynucleotide
taatacgactcactatagggcgcgctgctgctgctgcatccggtgtttctaacagaggagaagaaacatgggatgcagcaacctggcggcagcgcaaaagatg

SEQ ID NO: 195777 - DNA, 103 bp, Artificial Sequence
  Synthetic Polynucleotide
taatacgactcactatagggcgaagacaatgacccatgattgaccacggcaacagaggagagccgtgatgaatcatgggaacctggcggcagcgcaaaagatg

SEQ ID NO: 195778 - DNA, 103 bp, Artificial Sequence
  Synthetic Polynucleotide
taatacgactcactatagggtgctggtggtcgcgctgctgctgctgcatcaacagaggagagatgcaatggcagcagcgaacctggcggcagcgcaaaagatg

SEQ ID NO: 195779 - DNA, 103 bp, Artificial Sequence
  Synthetic Polynucleotide
taatacgactcactatagggtccaggctgctgctggtggtcgcgctgctgaacagaggagacagcagatggaccaccagaacctggcggcagcgcaaaagatg

SEQ ID NO: 195780 - DNA, 103 bp, Artificial Sequence
  Synthetic Polynucleotide
taatacgactcactataggggctcagcctctccaggctgctgctggtggtaacagaggagaaccaccatgagcagcctgaacctggcggcagcgcaaaagatg

SEQ ID NO: 195781 - DNA, 103 bp, Artificial Sequence
  Synthetic Polynucleotide
taatacgactcactatagggggcgtcagcggctcagcctctccaggctgcaacagaggagagcagccatgagaggctgaaacctggcggcagcgcaaaagatg

SEQ ID NO: 195782 - DNA, 103 bp, Artificial Sequence
  Synthetic Polynucleotide
taatacgactcactataggggttgtaggtgggcgtcagcggctcagcctcaacagaggagagaggctatgccgctgacgaacctggcggcagcgcaaaagatg

SEQ ID NO: 195783 - DNA, 103 bp, Artificial Sequence
  Synthetic Polynucleotide
taatacgactcactatagggtggccgagatgttgtaggtgggcgtcagcgaacagaggagacgctgaatgccacctacaaacctggcggcagcgcaaaagatg

SEQ ID NO: 195784 - DNA, 103 bp, Artificial Sequence
  Synthetic Polynucleotide
taatacgactcactataggggtcagcccgttggccgagatgttgtaggtgaacagaggagacacctaatgcatctcggcaacctggcggcagcgcaaaagatg

SEQ ID NO: 195785 - DNA, 103 bp, Artificial Sequence
  Synthetic Polynucleotide
taatacgactcactataggggtgaagttccgtcagcccgttggccgagataacagaggagaatctcgatgaacgggctgaacctggcggcagcgcaaaagatg

SEQ ID NO: 195786 - DNA, 103 bp, Artificial Sequence
  Synthetic Polynucleotide
taatacgactcactatagggtgaggtcgtcgtgaagttccgtcagcccgtaacagaggagaacgggcatgcggaacttcaacctggcggcagcgcaaaagatg

SEQ ID NO: 195787 - DNA, 103 bp, Artificial Sequence
  Synthetic Polynucleotide
taatacgactcactatagggatgtagttactgaggtcgtcgtgaagttccaacagaggagaggaactatgcgacgacctaacctggcggcagcgcaaaagatg

SEQ ID NO: 195788 - DNA, 103 bp, Artificial Sequence
  Synthetic Polynucleotide
taatacgactcactatagggctgtccagttcgaagacaatgacccatgataacagaggagaatcatgatgcattgtcttaacctggcggcagcgcaaaagatg

SEQ ID NO: 195789 - DNA, 103 bp, Artificial Sequence
  Synthetic Polynucleotide
taatacgactcactataggggtgcccgtcaatgtagttactgaggtcgtcaacagaggagagacgacatgagtaactacaacctggcggcagcgcaaaagatg

SEQ ID NO: 195790 - DNA, 103 bp, Artificial Sequence
  Synthetic Polynucleotide
taatacgactcactatagggcctcaggggtgtgcccgtcaatgtagttacaacagaggagagtaactatgttgacgggcaacctggcggcagcgcaaaagatg

SEQ ID NO: 195791 - DNA, 103 bp, Artificial Sequence
  Synthetic Polynucleotide
taatacgactcactataggggccttactcccctcaggggtgtgcccgtcaaacagaggagatgacggatgcacccctgaaacctggcggcagcgcaaaagatg

SEQ ID NO: 195792 - DNA, 103 bp, Artificial Sequence
  Synthetic Polynucleotide
taatacgactcactatagggggcggagtctgccttactcccctcaggggtaacagaggagaacccctatggggagtaagaacctggcggcagcgcaaaagatg

SEQ ID NO: 195793 - DNA, 103 bp, Artificial Sequence
  Synthetic Polynucleotide
taatacgactcactatagggagctgctgacggcggagtctgccttactccaacagaggagaggagtaatgcagactccgaacctggcggcagcgcaaaagatg

SEQ ID NO: 195794 - DNA, 103 bp, Artificial Sequence
  Synthetic Polynucleotide
taatacgactcactatagggtccaggtagaagctgctgacggcggagtctaacagaggagaagactcatgcgtcagcagaacctggcggcagcgcaaaagatg

SEQ ID NO: 195795 - DNA, 103 bp, Artificial Sequence
  Synthetic Polynucleotide
taatacgactcactatagggaggctgtatgtccaggtagaagctgctgacaacagaggagagtcagcatgttctacctgaacctggcggcagcgcaaaagatg

SEQ ID NO: 195796 - DNA, 103 bp, Artificial Sequence
  Synthetic Polynucleotide
taatacgactcactatagggggtctggggaaggctgtatgtccaggtagaaacagaggagatctaccatgacatacagcaacctggcggcagcgcaaaagatg

SEQ ID NO: 195797 - DNA, 103 bp, Artificial Sequence
  Synthetic Polynucleotide
taatacgactcactatagggagacctgactggtctggggaaggctgtatgaacagaggagacatacaatgttccccagaaacctggcggcagcgcaaaagatg

SEQ ID NO: 195798 - DNA, 103 bp, Artificial Sequence
  Synthetic Polynucleotide
taatacgactcactatagggattgatatcaagacctgactggtctggggaaacagaggagatccccaatgcagtcaggtaacctggcggcagcgcaaaagatg

SEQ ID NO: 195799 - DNA, 103 bp, Artificial Sequence
  Synthetic Polynucleotide
taatacgactcactatagggacattctggcctgtccagttcgaagacaataacagaggagaattgtcatggaactggacaacctggcggcagcgcaaaagatg

SEQ ID NO: 195800 - DNA, 103 bp, Artificial Sequence
  Synthetic Polynucleotide
taatacgactcactataggggtttgattccattgatatcaagacctgactaacagaggagaagtcagatgttgatatcaaacctggcggcagcgcaaaagatg

SEQ ID NO: 195801 - DNA, 103 bp, Artificial Sequence
  Synthetic Polynucleotide
taatacgactcactatagggattggttctggtttgattccattgatatcaaacagaggagatgatatatgtggaatcaaaacctggcggcagcgcaaaagatg

SEQ ID NO: 195802 - DNA, 103 bp, Artificial Sequence
  Synthetic Polynucleotide
taatacgactcactataggggtagtcacatattggttctggtttgattccaacagaggagaggaatcatgccagaaccaaacctggcggcagcgcaaaagatg

SEQ ID NO: 195803 - DNA, 103 bp, Artificial Sequence
  Synthetic Polynucleotide
taatacgactcactatagggatgctggtgtgtagtcacatattggttctgaacagaggagacagaacatgtatgtgactaacctggcggcagcgcaaaagatg

SEQ ID NO: 195804 - DNA, 103 bp, Artificial Sequence
  Synthetic Polynucleotide
taatacgactcactatagggaagaagcctgatgctggtgtgtagtcacataacagaggagaatgtgaatgcacaccagcaacctggcggcagcgcaaaagatg

SEQ ID NO: 195805 - DNA, 103 bp, Artificial Sequence
  Synthetic Polynucleotide
taatacgactcactatagggacagtagggaaagaagcctgatgctggtgtaacagaggagaacaccaatgtcaggcttcaacctggcggcagcgcaaaagatg

SEQ ID NO: 195806 - DNA, 103 bp, Artificial Sequence
  Synthetic Polynucleotide
taatacgactcactatagggtggtgaacgaacagtagggaaagaagcctgaacagaggagacaggctatgttccctactaacctggcggcagcgcaaaagatg

SEQ ID NO: 195807 - DNA, 103 bp, Artificial Sequence
  Synthetic Polynucleotide
taatacgactcactataggggtctcgccgttggtgaacgaacagtagggaaacagaggagatccctaatgttcgttcacaacctggcggcagcgcaaaagatg

SEQ ID NO: 195808 - DNA, 103 bp, Artificial Sequence
  Synthetic Polynucleotide
taatacgactcactatagggagttggggaagtctcgccgttggtgaacgaaacagaggagatcgttcatgaacggcgagaacctggcggcagcgcaaaagatg

SEQ ID NO: 195809 - DNA, 103 bp, Artificial Sequence
  Synthetic Polynucleotide
taatacgactcactatagggccatggacacagttggggaagtctcgccgtaacagaggagaacggcgatgcttccccaaaacctggcggcagcgcaaaagatg

SEQ ID NO: 195810 - DNA, 103 bp, Artificial Sequence
  Synthetic Polynucleotide
taatacgactcactatagggggtgtggcagacattctggcctgtccagttaacagaggagaaactggatgggccagaataacctggcggcagcgcaaaagatg

SEQ ID NO: 195811 - DNA, 103 bp, Artificial Sequence
  Synthetic Polynucleotide
taatacgactcactatagggtctaattctgccatggacacagttggggaaaacagaggagattccccatgtgtgtccataacctggcggcagcgcaaaagatg

SEQ ID NO: 195812 - DNA, 103 bp, Artificial Sequence
  Synthetic Polynucleotide
taatacgactcactatagggtgcaaggtgttctaattctgccatggacacaacagaggagagtgtccatggcagaattaaacctggcggcagcgcaaaagatg

SEQ ID NO: 195813 - DNA, 103 bp, Artificial Sequence
  Synthetic Polynucleotide
taatacgactcactatagggatatattctgtgcaaggtgttctaattctgaacagaggagacagaatatgaacaccttgaacctggcggcagcgcaaaagatg

SEQ ID NO: 195814 - DNA, 103 bp, Artificial Sequence
  Synthetic Polynucleotide
taatacgactcactatagggtgcgatttagatatattctgtgcaaggtgtaacagaggagaacacctatgacagaatataacctggcggcagcgcaaaagatg

SEQ ID NO: 195815 - DNA, 103 bp, Artificial Sequence
  Synthetic Polynucleotide
taatacgactcactatagggggtttccagatgcgatttagatatattctgaacagaggagacagaatatgtctaaatcgaacctggcggcagcgcaaaagatg

SEQ ID NO: 195816 - DNA, 103 bp, Artificial Sequence
  Synthetic Polynucleotide
taatacgactcactatagggagtattggcaggtttccagatgcgatttagaacagaggagactaaatatgatctggaaaaacctggcggcagcgcaaaagatg

SEQ ID NO: 195817 - DNA, 103 bp, Artificial Sequence
  Synthetic Polynucleotide
taatacgactcactatagggtcttctctcaagtattggcaggtttccagaaacagaggagatctggaatgctgccaataaacctggcggcagcgcaaaagatg

SEQ ID NO: 195818 - DNA, 103 bp, Artificial Sequence
  Synthetic Polynucleotide
taatacgactcactatagggctgctggagctcttctctcaagtattggcaaacagaggagatgccaaatgttgagagaaaacctggcggcagcgcaaaagatg

SEQ ID NO: 195819 - DNA, 103 bp, Artificial Sequence
  Synthetic Polynucleotide
taatacgactcactataggggccacgttatctgctggagctcttctctcaaacagaggagatgagagatgagctccagcaacctggcggcagcgcaaaagatg

SEQ ID NO: 195820 - DNA, 103 bp, Artificial Sequence
  Synthetic Polynucleotide
taatacgactcactatagggaaaaaggtctgccacgttatctgctggagcaacagaggagagctccaatggataacgtgaacctggcggcagcgcaaaagatg

SEQ ID NO: 195821 - DNA, 103 bp, Artificial Sequence
  Synthetic Polynucleotide
taatacgactcactataggggcatggtatcacttcaatttgtgctcgcataacagaggagaatgcgaatgcaaattgaaaacctggcggcagcgcaaaagatg

SEQ ID NO: 195822 - DNA, 103 bp, Artificial Sequence
  Synthetic Polynucleotide
taatacgactcactataggggttctgctggctcctcctaaagaatcccttaacagaggagaaagggaatgtttaggaggaacctggcggcagcgcaaaagatg

SEQ ID NO: 195823 - DNA, 103 bp, Artificial Sequence
  Synthetic Polynucleotide
taatacgactcactatagggattcactaggtcatcagaacctaaggctttaacagaggagaaaagccatgggttctgataacctggcggcagcgcaaaagatg

SEQ ID NO: 195824 - DNA, 103 bp, Artificial Sequence
  Synthetic Polynucleotide
taatacgactcactatagggcaaatgcttcattcactaggtcatcagaacaacagaggagagttctgatgacctagtgaaacctggcggcagcgcaaaagatg

SEQ ID NO: 195825 - DNA, 103 bp, Artificial Sequence
  Synthetic Polynucleotide
taatacgactcactatagggtttgcaaagtcaaatgcttcattcactaggaacagaggagacctagtatgtgaagcattaacctggcggcagcgcaaaagatg

SEQ ID NO: 195826 - DNA, 103 bp, Artificial Sequence
  Synthetic Polynucleotide
taatacgactcactatagggacacaaattctttgcaaagtcaaatgcttcaacagaggagagaagcaatggactttgcaaacctggcggcagcgcaaaagatg

SEQ ID NO: 195827 - DNA, 103 bp, Artificial Sequence
  Synthetic Polynucleotide
taatacgactcactataggggctgcaaggaacacaaattctttgcaaagtaacagaggagaactttgatgagaatttgtaacctggcggcagcgcaaaagatg

SEQ ID NO: 195828 - DNA, 103 bp, Artificial Sequence
  Synthetic Polynucleotide
taatacgactcactatagggtcctcggtcagctgcaaggaacacaaattcaacagaggagagaatttatgttccttgcaaacctggcggcagcgcaaaagatg

SEQ ID NO: 195829 - DNA, 103 bp, Artificial Sequence
  Synthetic Polynucleotide
taatacgactcactatagggagcgatctcctcctcggtcagctgcaaggaaacagaggagatccttgatgctgaccgagaacctggcggcagcgcaaaagatg

SEQ ID NO: 195830 - DNA, 103 bp, Artificial Sequence
  Synthetic Polynucleotide
taatacgactcactatagggatgagaacaaagcgatctcctcctcggtcaaacagaggagatgaccgatgaggagatcgaacctggcggcagcgcaaaagatg

SEQ ID NO: 195831 - DNA, 103 bp, Artificial Sequence
  Synthetic Polynucleotide
taatacgactcactatagggagaacagcagatgagaacaaagcgatctccaacagaggagaggagatatgtttgttctcaacctggcggcagcgcaaaagatg

SEQ ID NO: 195832 - DNA, 103 bp, Artificial Sequence
  Synthetic Polynucleotide
taatacgactcactatagggtggagatatcagaacagcagatgagaacaaaacagaggagattgttcatgtctgctgttaacctggcggcagcgcaaaagatg

SEQ ID NO: 195833 - DNA, 103 bp, Artificial Sequence
  Synthetic Polynucleotide
taatacgactcactatagggaagaagcattgttctgctggctcctcctaaaacagaggagattaggaatggccagcagaaacctggcggcagcgcaaaagatg

SEQ ID NO: 195834 - DNA, 103 bp, Artificial Sequence
  Synthetic Polynucleotide
taatacgactcactatagggaggctcggtctggagatatcagaacagcagaacagaggagactgctgatgtgatatctcaacctggcggcagcgcaaaagatg

SEQ ID NO: 195835 - DNA, 103 bp, Artificial Sequence
  Synthetic Polynucleotide
taatacgactcactatagggtctataagccaggctcggtctggagatatcaacagaggagagatatcatgagaccgagcaacctggcggcagcgcaaaagatg

SEQ ID NO: 195836 - DNA, 103 bp, Artificial Sequence
  Synthetic Polynucleotide
taatacgactcactatagggtttccttggttctataagccaggctcggtcaacagaggagagaccgaatgtggcttataaacctggcggcagcgcaaaagatg

SEQ ID NO: 195837 - DNA, 103 bp, Artificial Sequence
  Synthetic Polynucleotide
taatacgactcactataggggcttctggactttccttggttctataagccaacagaggagaggcttaatgaaccaaggaaacctggcggcagcgcaaaagatg

SEQ ID NO: 195838 - DNA, 103 bp, Artificial Sequence
  Synthetic Polynucleotide
taatacgactcactatagggttttcctgaagcttctggactttccttggtaacagaggagaaccaagatgagtccagaaaacctggcggcagcgcaaaagatg

SEQ ID NO: 195839 - DNA, 103 bp, Artificial Sequence
  Synthetic Polynucleotide
taatacgactcactatagggaaaataaattttttcctgaagcttctggacaacagaggagagtccagatgcttcaggaaaacctggcggcagcgcaaaagatg

SEQ ID NO: 195840 - DNA, 103 bp, Artificial Sequence
  Synthetic Polynucleotide
taatacgactcactataggggttgaagtgcaaaataaattttttcctgaaaacagaggagattcaggatgaaatttattaacctggcggcagcgcaaaagatg

SEQ ID NO: 195841 - DNA, 103 bp, Artificial Sequence
  Synthetic Polynucleotide
taatacgactcactatagggtgaatcacatgttgaagtgcaaaataaattaacagaggagaaatttaatgtgcacttcaaacctggcggcagcgcaaaagatg

SEQ ID NO: 195842 - DNA, 103 bp, Artificial Sequence
  Synthetic Polynucleotide
taatacgactcactataggggtgattcttctgaatcacatgttgaagtgcaacagaggagagcacttatgcatgtgattaacctggcggcagcgcaaaagatg

SEQ ID NO: 195843 - DNA, 103 bp, Artificial Sequence
  Synthetic Polynucleotide
taatacgactcactatagggcatcatccaggtgattcttctgaatcacataacagaggagaatgtgaatgagaagaatcaacctggcggcagcgcaaaagatg

SEQ ID NO: 195844 - DNA, 103 bp, Artificial Sequence
  Synthetic Polynucleotide
taatacgactcactataggggggcaggaataagaagcattgttctgctggaacagaggagaccagcaatgcaatgcttcaacctggcggcagcgcaaaagatg

SEQ ID NO: 195845 - DNA, 103 bp, Artificial Sequence
  Synthetic Polynucleotide
taatacgactcactataggggccaaggtctcatcatccaggtgattcttcaacagaggagagaagaaatgcctggatgaaacctggcggcagcgcaaaagatg

SEQ ID NO: 195846 - DNA, 103 bp, Artificial Sequence
  Synthetic Polynucleotide
taatacgactcactatagggtattaactttgccaaggtctcatcatccagaacagaggagactggatatggagaccttgaacctggcggcagcgcaaaagatg

SEQ ID NO: 195847 - DNA, 103 bp, Artificial Sequence
  Synthetic Polynucleotide
taatacgactcactataggggtatcttggctattaactttgccaaggtctaacagaggagaagacctatgcaaagttaaaacctggcggcagcgcaaaagatg

SEQ ID NO: 195848 - DNA, 103 bp, Artificial Sequence
  Synthetic Polynucleotide
taatacgactcactataggggtgatggttggtatcttggctattaactttaacagaggagaaaagttatgagccaagataacctggcggcagcgcaaaagatg

SEQ ID NO: 195849 - DNA, 103 bp, Artificial Sequence
  Synthetic Polynucleotide
taatacgactcactataggggcaaactgccgtgatggttggtatcttggcaacagaggagagccaagatgccaaccatcaacctggcggcagcgcaaaagatg

SEQ ID NO: 195850 - DNA, 103 bp, Artificial Sequence
  Synthetic Polynucleotide
taatacgactcactatagggcgtgcaagttgcaaactgccgtgatggttgaacagaggagacaaccaatgcggcagtttaacctggcggcagcgcaaaagatg

SEQ ID NO: 195851 - DNA, 103 bp, Artificial Sequence
  Synthetic Polynucleotide
taatacgactcactatagggagcttctccccgtgcaagttgcaaactgccaacagaggagaggcagtatgcaacttgcaaacctggcggcagcgcaaaagatg

SEQ ID NO: 195852 - DNA, 103 bp, Artificial Sequence
  Synthetic Polynucleotide
taatacgactcactatagggaaatacctgcagcttctccccgtgcaagttaacagaggagaaacttgatgggggagaagaacctggcggcagcgcaaaagatg

SEQ ID NO: 195853 - DNA, 103 bp, Artificial Sequence
  Synthetic Polynucleotide
taatacgactcactataggggagattgcttaaatacctgcagcttctcccaacagaggagagggagaatgtgcaggtataacctggcggcagcgcaaaagatg

SEQ ID NO: 195854 - DNA, 103 bp, Artificial Sequence
  Synthetic Polynucleotide
taatacgactcactatagggatctctggatgagattgcttaaatacctgcaacagaggagagcaggtatgtaagcaatcaacctggcggcagcgcaaaagatg

SEQ ID NO: 195855 - DNA, 103 bp, Artificial Sequence
  Synthetic Polynucleotide
taatacgactcactatagggtctctgccttgggcaggaataagaagcattaacagaggagaaatgctatgtattcctgcaacctggcggcagcgcaaaagatg

SEQ ID NO: 195856 - DNA, 103 bp, Artificial Sequence
  Synthetic Polynucleotide
taatacgactcactatagggtgtattcactatctctggatgagattgcttaacagaggagaaagcaaatgcatccagagaacctggcggcagcgcaaaagatg

SEQ ID NO: 195857 - DNA, 103 bp, Artificial Sequence
  Synthetic Polynucleotide
taatacgactcactataggggaggaaacagtgtattcactatctctggataacagaggagaatccagatgtagtgaataaacctggcggcagcgcaaaagatg

SEQ ID NO: 195858 - DNA, 103 bp, Artificial Sequence
  Synthetic Polynucleotide
taatacgactcactatagggttgtataacggaggaaacagtgtattcactaacagaggagaagtgaaatgactgtttccaacctggcggcagcgcaaaagatg

SEQ ID NO: 195859 - DNA, 103 bp, Artificial Sequence
  Synthetic Polynucleotide
taatacgactcactatagggaaagagctccttgtataacggaggaaacagaacagaggagactgtttatgccgttatacaacctggcggcagcgcaaaagatg

SEQ ID NO: 195860 - DNA, 103 bp, Artificial Sequence
  Synthetic Polynucleotide
taatacgactcactatagggagtcaggattaaagagctccttgtataacgaacagaggagacgttatatgaggagctctaacctggcggcagcgcaaaagatg

SEQ ID NO: 195861 - DNA, 103 bp, Artificial Sequence
  Synthetic Polynucleotide
taatacgactcactatagggccggtggcacagtcaggattaaagagctccaacagaggagaggagctatgtaatcctgaaacctggcggcagcgcaaaagatg

SEQ ID NO: 195862 - DNA, 103 bp, Artificial Sequence
  Synthetic Polynucleotide
taatacgactcactatagggtcatttgcagccggtggcacagtcaggattaacagaggagaaatcctatgtgtgccaccaacctggcggcagcgcaaaagatg

SEQ ID NO: 195863 - DNA, 103 bp, Artificial Sequence
  Synthetic Polynucleotide
taatacgactcactatagggttaaacagtttctctgccttgggcaggaataacagaggagaattcctatgcaaggcagaaacctggcggcagcgcaaaagatg

SEQ ID NO: 195864 - DNA, 103 bp, Artificial Sequence
  Synthetic Polynucleotide
taatacgactcactataggggttctgtcaattaaacagtttctctgccttaacagaggagaaaggcaatgaaactgtttaacctggcggcagcgcaaaagatg

SEQ ID NO: 195865 - DNA, 103 bp, Artificial Sequence
  Synthetic Polynucleotide
taatacgactcactataggggtttctgttcgttctgtcaattaaacagttaacagaggagaaactgtatgattgacagaaacctggcggcagcgcaaaagatg

SEQ ID NO: 195866 - DNA, 103 bp, Artificial Sequence
  Synthetic Polynucleotide
taatacgactcactataggggttggcaacggtttctgttcgttctgtcaaaacagaggagattgacaatgcgaacagaaaacctggcggcagcgcaaaagatg

SEQ ID NO: 195867 - DNA, 103 bp, Artificial Sequence
  Synthetic Polynucleotide
taatacgactcactatagggagtcggcagtgttggcaacggtttctgttcaacagaggagagaacagatgccgttgccaaacctggcggcagcgcaaaagatg

SEQ ID NO: 195868 - DNA, 103 bp, Artificial Sequence
  Synthetic Polynucleotide
taatacgactcactatagggacacttctgcagtcggcagtgttggcaacgaacagaggagacgttgcatgcactgccgaaacctggcggcagcgcaaaagatg

SEQ ID NO: 195869 - DNA, 103 bp, Artificial Sequence
  Synthetic Polynucleotide
taatacgactcactatagggcacaaattttgcatggtatcacttcaatttaacagaggagaaaattgatgtgataccataacctggcggcagcgcaaaagatg

SEQ ID NO: 195870 - DNA, 103 bp, Artificial Sequence
  Synthetic Polynucleotide
taatacgactcactatagggctagggcaagacacttctgcagtcggcagtaacagaggagaactgccatgtgcagaagtaacctggcggcagcgcaaaagatg

SEQ ID NO: 195871 - DNA, 103 bp, Artificial Sequence
  Synthetic Polynucleotide
taatacgactcactatagggcttgacattcctagggcaagacacttctgcaacagaggagagcagaaatgtcttgccctaacctggcggcagcgcaaaagatg

SEQ ID NO: 195872 - DNA, 103 bp, Artificial Sequence
  Synthetic Polynucleotide
taatacgactcactatagggcacagcatctcttgacattcctagggcaagaacagaggagacttgccatgggaatgtcaaacctggcggcagcgcaaaagatg

SEQ ID NO: 195873 - DNA, 103 bp, Artificial Sequence
  Synthetic Polynucleotide
taatacgactcactatagggtcccaaacttcacagcatctcttgacattcaacagaggagagaatgtatggagatgctgaacctggcggcagcgcaaaagatg

SEQ ID NO: 195874 - DNA, 103 bp, Artificial Sequence
  Synthetic Polynucleotide
taatacgactcactatagggttggacatcctcccaaacttcacagcatctaacagaggagaagatgcatggaagtttggaacctggcggcagcgcaaaagatg

SEQ ID NO: 195875 - DNA, 103 bp, Artificial Sequence
  Synthetic Polynucleotide
taatacgactcactatagggcctttgcttcttggacatcctcccaaacttaacagaggagaaagtttatgaggatgtccaacctggcggcagcgcaaaagatg

SEQ ID NO: 195876 - DNA, 103 bp, Artificial Sequence
  Synthetic Polynucleotide
taatacgactcactatagggacaggctgtccctttgcttcttggacatccaacagaggagaggatgtatgagaagcaaaaacctggcggcagcgcaaaagatg

SEQ ID NO: 195877 - DNA, 103 bp, Artificial Sequence
  Synthetic Polynucleotide
taatacgactcactatagggacctcagcatacaggctgtccctttgcttcaacagaggagagaagcaatgggacagcctaacctggcggcagcgcaaaagatg

SEQ ID NO: 195878 - DNA, 103 bp, Artificial Sequence
  Synthetic Polynucleotide
taatacgactcactataggggtgcttctgcacctcagcatacaggctgtcaacagaggagagacagcatgtatgctgagaacctggcggcagcgcaaaagatg

SEQ ID NO: 195879 - DNA, 103 bp, Artificial Sequence
  Synthetic Polynucleotide
taatacgactcactataggggccgctgctggtgcttctgcacctcagcataacagaggagaatgctgatgtgcagaagcaacctggcggcagcgcaaaagatg

SEQ ID NO: 195880 - DNA, 103 bp, Artificial Sequence
  Synthetic Polynucleotide
taatacgactcactataggggacttatcgccacaaattttgcatggtatcaacagaggagagataccatgcaaaatttgaacctggcggcagcgcaaaagatg

SEQ ID NO: 195881 - DNA, 103 bp, Artificial Sequence
  Synthetic Polynucleotide
taatacgactcactatagggtgttcctgcagccgctgctggtgcttctgcaacagaggagagcagaaatgccagcagcgaacctggcggcagcgcaaaagatg

SEQ ID NO: 195882 - DNA, 103 bp, Artificial Sequence
  Synthetic Polynucleotide
taatacgactcactatagggctgctgccgctgttcctgcagccgctgctgaacagaggagacagcagatgctgcaggaaaacctggcggcagcgcaaaagatg

SEQ ID NO: 195883 - DNA, 103 bp, Artificial Sequence
  Synthetic Polynucleotide
taatacgactcactatagggccccactctgctgctgccgctgttcctgcaaacagaggagatgcaggatgagcggcagcaacctggcggcagcgcaaaagatg

SEQ ID NO: 195884 - DNA, 103 bp, Artificial Sequence
  Synthetic Polynucleotide
taatacgactcactataggggcttctgcctccccactctgctgctgccgcaacagaggagagcggcaatggcagagtggaacctggcggcagcgcaaaagatg

SEQ ID NO: 195885 - DNA, 103 bp, Artificial Sequence
  Synthetic Polynucleotide
taatacgactcactatagggcctggcaagggcttctgcctccccactctgaacagaggagacagagtatggaggcagaaaacctggcggcagcgcaaaagatg

SEQ ID NO: 195886 - DNA, 103 bp, Artificial Sequence
  Synthetic Polynucleotide
taatacgactcactatagggtgctgtacaccctggcaagggcttctgcctaacagaggagaaggcagatgcccttgccaaacctggcggcagcgcaaaagatg

SEQ ID NO: 195887 - DNA, 103 bp, Artificial Sequence
  Synthetic Polynucleotide
taatacgactcactatagggctaatgctgctgctgtacaccctggcaaggaacagaggagaccttgcatgggtgtacagaacctggcggcagcgcaaaagatg

SEQ ID NO: 195888 - DNA, 103 bp, Artificial Sequence
  Synthetic Polynucleotide
taatacgactcactatagggcaggccgttgctaatgctgctgctgtacacaacagaggagagtgtacatgagcagcattaacctggcggcagcgcaaaagatg

SEQ ID NO: 195889 - DNA, 103 bp, Artificial Sequence
  Synthetic Polynucleotide
taatacgactcactatagggtcaggttgctcaggccgttgctaatgctgcaacagaggagagcagcaatggcaacggccaacctggcggcagcgcaaaagatg

SEQ ID NO: 195890 - DNA, 103 bp, Artificial Sequence
  Synthetic Polynucleotide
taatacgactcactataggggtctcgttgttcaggttgctcaggccgttgaacagaggagacaacggatggagcaacctaacctggcggcagcgcaaaagatg

SEQ ID NO: 195891 - DNA, 103 bp, Artificial Sequence
  Synthetic Polynucleotide
taatacgactcactataggggatcccagaggacttatcgccacaaattttaacagaggagaaaaattatgggcgataagaacctggcggcagcgcaaaagatg

SEQ ID NO: 195892 - DNA, 103 bp, Artificial Sequence
  Synthetic Polynucleotide
taatacgactcactatagggagtgccgctggtctcgttgttcaggttgctaacagaggagaagcaacatgaacaacgagaacctggcggcagcgcaaaagatg

SEQ ID NO: 195893 - DNA, 103 bp, Artificial Sequence
  Synthetic Polynucleotide
taatacgactcactatagggcgttggcataagtgccgctggtctcgttgtaacagaggagaacaacgatgccagcggcaaacctggcggcagcgcaaaagatg

SEQ ID NO: 195894 - DNA, 103 bp, Artificial Sequence
  Synthetic Polynucleotide
taatacgactcactatagggatgacgtgcccgttggcataagtgccgctgaacagaggagacagcggatgttatgccaaaacctggcggcagcgcaaaagatg

SEQ ID NO: 195895 - DNA, 103 bp, Artificial Sequence
  Synthetic Polynucleotide
taatacgactcactataggggggcaggtcaatgacgtgcccgttggcataaacagaggagatatgccatggggcacgtcaacctggcggcagcgcaaaagatg

SEQ ID NO: 195896 - DNA, 103 bp, Artificial Sequence
  Synthetic Polynucleotide
taatacgactcactatagggcctcagacttgggcaggtcaatgacgtgccaacagaggagaggcacgatgttgacctgcaacctggcggcagcgcaaaagatg

SEQ ID NO: 195897 - DNA, 103 bp, Artificial Sequence
  Synthetic Polynucleotide
taatacgactcactatagggttgtaataaccctcagacttgggcaggtcaaacagaggagatgacctatgcaagtctgaaacctggcggcagcgcaaaagatg

SEQ ID NO: 195898 - DNA, 103 bp, Artificial Sequence
  Synthetic Polynucleotide
taatacgactcactatagggggaatcgacgttgtaataaccctcagacttaacagaggagaaagtctatgggttattacaacctggcggcagcgcaaaagatg

SEQ ID NO: 195899 - DNA, 103 bp, Artificial Sequence
  Synthetic Polynucleotide
taatacgactcactatagggacggctgaccggaatcgacgttgtaataacaacagaggagagttattatgacgtcgattaacctggcggcagcgcaaaagatg

SEQ ID NO: 195900 - DNA, 103 bp, Artificial Sequence
  Synthetic Polynucleotide
taatacgactcactatagggtgatcaggggacggctgaccggaatcgacgaacagaggagacgtcgaatgcggtcagccaacctggcggcagcgcaaaagatg

SEQ ID NO: 195901 - DNA, 103 bp, Artificial Sequence
  Synthetic Polynucleotide
taatacgactcactatagggaagtcctgactgatcaggggacggctgaccaacagaggagaggtcagatgtcccctgataacctggcggcagcgcaaaagatg

SEQ ID NO: 195902 - DNA, 103 bp, Artificial Sequence
  Synthetic Polynucleotide
taatacgactcactatagggctccgtagtggatcccagaggacttatcgcaacagaggagagcgataatgcctctgggaaacctggcggcagcgcaaaagatg

SEQ ID NO: 195903 - DNA, 103 bp, Artificial Sequence
  Synthetic Polynucleotide
taatacgactcactatagggcagtcatgtcaagtcctgactgatcaggggaacagaggagacccctgatgagtcaggacaacctggcggcagcgcaaaagatg

SEQ ID NO: 195904 - DNA, 103 bp, Artificial Sequence
  Synthetic Polynucleotide
taatacgactcactatagggtgtttgattccagtcatgtcaagtcctgacaacagaggagagtcaggatgtgacatgacaacctggcggcagcgcaaaagatg

SEQ ID NO: 195905 - DNA, 103 bp, Artificial Sequence
  Synthetic Polynucleotide
taatacgactcactatagggttgctttatctgtttgattccagtcatgtcaacagaggagagacatgatgggaatcaaaaacctggcggcagcgcaaaagatg

SEQ ID NO: 195906 - DNA, 103 bp, Artificial Sequence
  Synthetic Polynucleotide
taatacgactcactatagggagataggttcttgctttatctgtttgattcaacagaggagagaatcaatgagataaagcaacctggcggcagcgcaaaagatg

SEQ ID NO: 195907 - DNA, 103 bp, Artificial Sequence
  Synthetic Polynucleotide
taatacgactcactataggggtgaggtcatagataggttcttgctttatcaacagaggagagataaaatgagaacctataacctggcggcagcgcaaaagatg

SEQ ID NO: 195908 - DNA, 103 bp, Artificial Sequence
  Synthetic Polynucleotide
taatacgactcactataggggggtacggatgtgaggtcatagataggttcaacagaggagagaacctatgtatgacctcaacctggcggcagcgcaaaagatg

SEQ ID NO: 195909 - DNA, 103 bp, Artificial Sequence
  Synthetic Polynucleotide
taatacgactcactatagggtaaacaagttgggtacggatgtgaggtcataacagaggagaatgaccatgcatccgtacaacctggcggcagcgcaaaagatg

SEQ ID NO: 195910 - DNA, 103 bp, Artificial Sequence
  Synthetic Polynucleotide
taatacgactcactataggggagctataggtaaacaagttgggtacggataacagaggagaatccgtatgcaacttgttaacctggcggcagcgcaaaagatg

SEQ ID NO: 195911 - DNA, 103 bp, Artificial Sequence
  Synthetic Polynucleotide
taatacgactcactatagggattgttgaaagagctataggtaaacaagttaacagaggagaaacttgatgacctatagcaacctggcggcagcgcaaaagatg

SEQ ID NO: 195912 - DNA, 103 bp, Artificial Sequence
  Synthetic Polynucleotide
taatacgactcactatagggctaactgcccattgttgaaagagctataggaacagaggagacctataatgctttcaacaaacctggcggcagcgcaaaagatg

SEQ ID NO: 195913 - DNA, 103 bp, Artificial Sequence
  Synthetic Polynucleotide
taatacgactcactatagggcatgtgatgactccgtagtggatcccagagaacagaggagactctggatgccactacggaacctggcggcagcgcaaaagatg

SEQ ID NO: 195914 - DNA, 103 bp, Artificial Sequence
  Synthetic Polynucleotide
taatacgactcactatagggatccctggtgctaactgcccattgttgaaaaacagaggagatttcaaatgtgggcagttaacctggcggcagcgcaaaagatg

SEQ ID NO: 195915 - DNA, 103 bp, Artificial Sequence
  Synthetic Polynucleotide
taatacgactcactatagggagtcatggttatccctggtgctaactgcccaacagaggagagggcagatggcaccagggaacctggcggcagcgcaaaagatg

SEQ ID NO: 195916 - DNA, 103 bp, Artificial Sequence
  Synthetic Polynucleotide
taatacgactcactatagggggtcgatttcagtcatggttatccctggtgaacagaggagacaccagatgtaaccatgaaacctggcggcagcgcaaaagatg

SEQ ID NO: 195917 - DNA, 103 bp, Artificial Sequence
  Synthetic Polynucleotide
taatacgactcactatagggtgtgcaattcggtcgatttcagtcatggttaacagaggagaaaccatatgtgaaatcgaaacctggcggcagcgcaaaagatg

SEQ ID NO: 195918 - DNA, 103 bp, Artificial Sequence
  Synthetic Polynucleotide
taatacgactcactatagggaatgatgttctgtgcaattcggtcgatttcaacagaggagagaaatcatgcgaattgcaaacctggcggcagcgcaaaagatg

SEQ ID NO: 195919 - DNA, 103 bp, Artificial Sequence
  Synthetic Polynucleotide
taatacgactcactatagggaatgggacttaatgatgttctgtgcaattcaacagaggagagaattgatgagaacatcaaacctggcggcagcgcaaaagatg

SEQ ID NO: 195920 - DNA, 103 bp, Artificial Sequence
  Synthetic Polynucleotide
taatacgactcactatagggcatgtctccaaatgggacttaatgatgttcaacagaggagagaacatatgtaagtcccaaacctggcggcagcgcaaaagatg

SEQ ID NO: 195921 - DNA, 103 bp, Artificial Sequence
  Synthetic Polynucleotide
taatacgactcactatagggggtgtattgacatgtctccaaatgggacttaacagaggagaaagtccatgttggagacaaacctggcggcagcgcaaaagatg

SEQ ID NO: 195922 - DNA, 103 bp, Artificial Sequence
  Synthetic Polynucleotide
taatacgactcactataggggctcttccatggtgtattgacatgtctccaaacagaggagatggagaatggtcaatacaaacctggcggcagcgcaaaagatg

SEQ ID NO: 195923 - DNA, 103 bp, Artificial Sequence
  Synthetic Polynucleotide
taatacgactcactatagggagctggtgcagctcttccatggtgtattgaaacagaggagatcaataatgcatggaagaaacctggcggcagcgcaaaagatg

SEQ ID NO: 195924 - DNA, 103 bp, Artificial Sequence
  Synthetic Polynucleotide
taatacgactcactataggggcagccttcacatgtgatgactccgtagtgaacagaggagacactacatggtcatcacaaacctggcggcagcgcaaaagatg

SEQ ID NO: 195925 - DNA, 103 bp, Artificial Sequence
  Synthetic Polynucleotide
taatacgactcactatagggctgccacgccagctggtgcagctcttccataacagaggagaatggaaatgctgcaccagaacctggcggcagcgcaaaagatg

SEQ ID NO: 195926 - DNA, 103 bp, Artificial Sequence
  Synthetic Polynucleotide
taatacgactcactatagggaggtgtgggtctgccacgccagctggtgcaaacagaggagatgcaccatgtggcgtggcaacctggcggcagcgcaaaagatg

SEQ ID NO: 195927 - DNA, 103 bp, Artificial Sequence
  Synthetic Polynucleotide
taatacgactcactatagggatttcttcataggtgtgggtctgccacgccaacagaggagaggcgtgatggacccacacaacctggcggcagcgcaaaagatg

SEQ ID NO: 195928 - DNA, 103 bp, Artificial Sequence
  Synthetic Polynucleotide
taatacgactcactatagggatatgctttaatttcttcataggtgtgggtaacagaggagaacccacatgtatgaagaaaacctggcggcagcgcaaaagatg

SEQ ID NO: 195929 - DNA, 103 bp, Artificial Sequence
  Synthetic Polynucleotide
taatacgactcactatagggacttgctttgatatgctttaatttcttcataacagaggagaatgaagatgttaaagcataacctggcggcagcgcaaaagatg

SEQ ID NO: 195930 - DNA, 103 bp, Artificial Sequence
  Synthetic Polynucleotide
taatacgactcactataggggcttccctggacttgctttgatatgctttaaacagaggagataaagcatgtcaaagcaaaacctggcggcagcgcaaaagatg

SEQ ID NO: 195931 - DNA, 103 bp, Artificial Sequence
  Synthetic Polynucleotide
taatacgactcactatagggttgccacagtgcttccctggacttgctttgaacagaggagacaaagcatgtccagggaaaacctggcggcagcgcaaaagatg

SEQ ID NO: 195932 - DNA, 103 bp, Artificial Sequence
  Synthetic Polynucleotide
taatacgactcactatagggtggcacattgttgccacagtgcttccctggaacagaggagaccagggatgcactgtggcaacctggcggcagcgcaaaagatg

SEQ ID NO: 195933 - DNA, 103 bp, Artificial Sequence
  Synthetic Polynucleotide
taatacgactcactataggggtgatctggatggcacattgttgccacagtaacagaggagaactgtgatgacaatgtgcaacctggcggcagcgcaaaagatg

SEQ ID NO: 195934 - DNA, 103 bp, Artificial Sequence
  Synthetic Polynucleotide
taatacgactcactataggggatggcgtgagtgatctggatggcacattgaacagaggagacaatgtatgatccagatcaacctggcggcagcgcaaaagatg

SEQ ID NO: 195935 - DNA, 103 bp, Artificial Sequence
  Synthetic Polynucleotide
taatacgactcactatagggagaatcccttgcagccttcacatgtgatgaaacagaggagatcatcaatggtgaaggctaacctggcggcagcgcaaaagatg

SEQ ID NO: 195936 - DNA, 103 bp, Artificial Sequence
  Synthetic Polynucleotide
taatacgactcactatagggccacgtattggatggcgtgagtgatctggaaacagaggagatccagaatgctcacgccaaacctggcggcagcgcaaaagatg

SEQ ID NO: 195937 - DNA, 103 bp, Artificial Sequence
  Synthetic Polynucleotide
taatacgactcactataggggcaaactccaccacgtattggatggcgtgaaacagaggagatcacgcatgccaatacgtaacctggcggcagcgcaaaagatg

SEQ ID NO: 195938 - DNA, 103 bp, Artificial Sequence
  Synthetic Polynucleotide
taatacgactcactatagggtatccgctttgcaaactccaccacgtattgaacagaggagacaatacatggtggagtttaacctggcggcagcgcaaaagatg

SEQ ID NO: 195939 - DNA, 103 bp, Artificial Sequence
  Synthetic Polynucleotide
taatacgactcactatagggtgaagcctgttatccgctttgcaaactccaaacagaggagatggagtatgcaaagcggaaacctggcggcagcgcaaaagatg

SEQ ID NO: 195940 - DNA, 103 bp, Artificial Sequence
  Synthetic Polynucleotide
taatacgactcactatagggcagagctccatgaagcctgttatccgctttaacagaggagaaaagcgatgaacaggcttaacctggcggcagcgcaaaagatg

SEQ ID NO: 195941 - DNA, 103 bp, Artificial Sequence
  Synthetic Polynucleotide
taatacgactcactatagggatcattttgacagagctccatgaagcctgtaacagaggagaacaggcatgatggagctcaacctggcggcagcgcaaaagatg

SEQ ID NO: 195942 - DNA, 103 bp, Artificial Sequence
  Synthetic Polynucleotide
taatacgactcactataggggtagaatttgatcattttgacagagctccaaacagaggagatggagcatggtcaaaatgaacctggcggcagcgcaaaagatg

SEQ ID NO: 195943 - DNA, 103 bp, Artificial Sequence
  Synthetic Polynucleotide
taatacgactcactataggggacttcagaagtagaatttgatcattttgaaacagaggagatcaaaaatgtcaaattctaacctggcggcagcgcaaaagatg

SEQ ID NO: 195944 - DNA, 103 bp, Artificial Sequence
  Synthetic Polynucleotide
taatacgactcactatagggcaagcaacctgacttcagaagtagaatttgaacagaggagacaaattatgcttctgaagaacctggcggcagcgcaaaagatg

SEQ ID NO: 195945 - DNA, 103 bp, Artificial Sequence
  Synthetic Polynucleotide
taatacgactcactatagggaaaccacttccaagcaacctgacttcagaaaacagaggagattctgaatgcaggttgctaacctggcggcagcgcaaaagatg

SEQ ID NO: 195946 - DNA, 103 bp, Artificial Sequence
  Synthetic Polynucleotide
taatacgactcactatagggctcctcctaaagaatcccttgcagccttcaaacagaggagatgaaggatgcaagggattaacctggcggcagcgcaaaagatg

SEQ ID NO: 195947 - DNA, 103 bp, Artificial Sequence
  Synthetic Polynucleotide
taatacgactcactatagggattctcactaaaaccacttccaagcaacctaacagaggagaaggttgatgggaagtggtaacctggcggcagcgcaaaagatg

SEQ ID NO: 195948 - DNA, 103 bp, Artificial Sequence
  Synthetic Polynucleotide
taatacgactcactatagggggcacggcacattctcactaaaaccacttcaacagaggagagaagtgatgttagtgagaaacctggcggcagcgcaaaagatg

SEQ ID NO: 195949 - DNA, 103 bp, Artificial Sequence
  Synthetic Polynucleotide
taatacgactcactatagggatgggttgaaggcacggcacattctcactaaacagaggagatagtgaatgtgtgccgtgaacctggcggcagcgcaaaagatg

SEQ ID NO: 195950 - DNA, 103 bp, Artificial Sequence
  Synthetic Polynucleotide
taatacgactcactataggggtgttgtttaatgggttgaaggcacggcacaacagaggagagtgccgatgcttcaacccaacctggcggcagcgcaaaagatg

SEQ ID NO: 195951 - DNA, 103 bp, Artificial Sequence
  Synthetic Polynucleotide
taatacgactcactatagggaaacagaacagtgttgtttaatgggttgaaaacagaggagattcaacatgttaaacaacaacctggcggcagcgcaaaagatg

SEQ ID NO: 195952 - DNA, 103 bp, Artificial Sequence
  Synthetic Polynucleotide
taatacgactcactatagggattttccttcaaacagaacagtgttgtttaaacagaggagataaacaatgctgttctgtaacctggcggcagcgcaaaagatg

SEQ ID NO: 195953 - DNA, 103 bp, Artificial Sequence
  Synthetic Polynucleotide
taatacgactcactatagggattcctccatattttccttcaaacagaacaaacagaggagatgttctatgtgaaggaaaaacctggcggcagcgcaaaagatg

SEQ ID NO: 195954 - DNA, 103 bp, Artificial Sequence
  Synthetic Polynucleotide
taatacgactcactataggggaacatttgcattcctccatattttccttcaacagaggagagaaggaatgtatggaggaaacctggcggcagcgcaaaagatg

SEQ ID NO: 195955 - DNA, 103 bp, Artificial Sequence
  Synthetic Polynucleotide
taatacgactcactatagggctaaggctttgaacatttgcattcctccataacagaggagaatggagatgtgcaaatgtaacctggcggcagcgcaaaagatg

SEQ ID NO: 195956 - DNA, 103 bp, Artificial Sequence
  Synthetic Polynucleotide
taatacgactcactatagggtcatcagaacctaaggctttgaacatttgcaacagaggagagcaaatatgcaaagccttaacctggcggcagcgcaaaagatg

SEQ ID NO: 195957 - DNA, 103 bp, Artificial Sequence
  Synthetic Polynucleotide
taatacgactcactatagggtcggtgctgtctctgtggggccctgtccataacagaggagaatggacatggccccacagaacctggcggcagcgcaaaagatg

SEQ ID NO: 195958 - DNA, 103 bp, Artificial Sequence
  Synthetic Polynucleotide
taatacgactcactatagggcccagacgacttgtccccacagattttgcaaacagaggagatgcaaaatgtgtggggacaacctggcggcagcgcaaaagatg

SEQ ID NO: 195959 - DNA, 103 bp, Artificial Sequence
  Synthetic Polynucleotide
taatacgactcactataggggcctgagagcctcttggcgaactccaccacaacagaggagagtggtgatgttcgccaagaacctggcggcagcgcaaaagatg

SEQ ID NO: 195960 - DNA, 103 bp, Artificial Sequence
  Synthetic Polynucleotide
taatacgactcactataggggctccataaagcctgagagcctcttggcgaaacagaggagatcgccaatgggctctcagaacctggcggcagcgcaaaagatg

SEQ ID NO: 195961 - DNA, 103 bp, Artificial Sequence
  Synthetic Polynucleotide
taatacgactcactatagggttctggcagagctccataaagcctgagagcaacagaggagagctctcatgctttatggaaacctggcggcagcgcaaaagatg

SEQ ID NO: 195962 - DNA, 103 bp, Artificial Sequence
  Synthetic Polynucleotide
taatacgactcactatagggaatctggtcattctggcagagctccataaaaacagaggagatttatgatgctctgccagaacctggcggcagcgcaaaagatg

SEQ ID NO: 195963 - DNA, 103 bp, Artificial Sequence
  Synthetic Polynucleotide
taatacgactcactatagggtgagaagcacaatctggtcattctggcagaaacagaggagatctgccatgatgaccagaaacctggcggcagcgcaaaagatg

SEQ ID NO: 195964 - DNA, 103 bp, Artificial Sequence
  Synthetic Polynucleotide
taatacgactcactataggggctcctgctttgagaagcacaatctggtcaaacagaggagatgaccaatgtgtgcttctaacctggcggcagcgcaaaagatg

SEQ ID NO: 195965 - DNA, 103 bp, Artificial Sequence
  Synthetic Polynucleotide
taatacgactcactatagggcacttccattgctcctgctttgagaagcacaacagaggagagtgcttatgaaagcaggaaacctggcggcagcgcaaaagatg

SEQ ID NO: 195966 - DNA, 103 bp, Artificial Sequence
  Synthetic Polynucleotide
taatacgactcactatagggtaaccagcaccacttccattgctcctgcttaacagaggagaaagcagatgcaatggaagaacctggcggcagcgcaaaagatg

SEQ ID NO: 195967 - DNA, 103 bp, Artificial Sequence
  Synthetic Polynucleotide
taatacgactcactatagggcggcacatcctaaccagcaccacttccattaacagaggagaaatggaatgggtgctggtaacctggcggcagcgcaaaagatg

SEQ ID NO: 195968 - DNA, 103 bp, Artificial Sequence
  Synthetic Polynucleotide
taatacgactcactatagggattgtaggcccggcacatcctaaccagcacaacagaggagagtgctgatgaggatgtgcaacctggcggcagcgcaaaagatg

SEQ ID NO: 195969 - DNA, 103 bp, Artificial Sequence
  Synthetic Polynucleotide
taatacgactcactatagggcgtagtggatcccagacgacttgtccccacaacagaggagagtggggatgagtcgtctgaacctggcggcagcgcaaaagatg

SEQ ID NO: 195970 - DNA, 103 bp, Artificial Sequence
  Synthetic Polynucleotide
taatacgactcactatagggggttgtcagcattgtaggcccggcacatccaacagaggagaggatgtatggggcctacaaacctggcggcagcgcaaaagatg

SEQ ID NO: 195971 - DNA, 103 bp, Artificial Sequence
  Synthetic Polynucleotide
taatacgactcactatagggaagaccgtgcggttgtcagcattgtaggccaacagaggagaggcctaatgtgctgacaaaacctggcggcagcgcaaaagatg

SEQ ID NO: 195972 - DNA, 103 bp, Artificial Sequence
  Synthetic Polynucleotide
taatacgactcactataggggccttcaaaaaagaccgtgcggttgtcagcaacagaggagagctgacatgcgcacggtcaacctggcggcagcgcaaaagatg

SEQ ID NO: 195973 - DNA, 103 bp, Artificial Sequence
  Synthetic Polynucleotide
taatacgactcactatagggcaccgtatttgccttcaaaaaagaccgtgcaacagaggagagcacggatgtttttgaagaacctggcggcagcgcaaaagatg

SEQ ID NO: 195974 - DNA, 103 bp, Artificial Sequence
  Synthetic Polynucleotide
taatacgactcactatagggagctccatgccaccgtatttgccttcaaaaaacagaggagattttgaatgcaaatacggaacctggcggcagcgcaaaagatg

SEQ ID NO: 195975 - DNA, 103 bp, Artificial Sequence
  Synthetic Polynucleotide
taatacgactcactatagggggctcggaacagctccatgccaccgtatttaacagaggagaaaatacatgggcatggagaacctggcggcagcgcaaaagatg

SEQ ID NO: 195976 - DNA, 103 bp, Artificial Sequence
  Synthetic Polynucleotide
taatacgactcactatagggtgcagcccaaggctcggaacagctccatgcaacagaggagagcatggatgtgttccgagaacctggcggcagcgcaaaagatg

SEQ ID NO: 195977 - DNA, 103 bp, Artificial Sequence
  Synthetic Polynucleotide
taatacgactcactatagggatgagctcgctgcagcccaaggctcggaacaacagaggagagttccgatgcttgggctgaacctggcggcagcgcaaaagatg

SEQ ID NO: 195978 - DNA, 103 bp, Artificial Sequence
  Synthetic Polynucleotide
taatacgactcactataggggatggagctgatgagctcgctgcagcccaaaacagaggagattgggcatgagcgagctcaacctggcggcagcgcaaaagatg

SEQ ID NO: 195979 - DNA, 103 bp, Artificial Sequence
  Synthetic Polynucleotide
taatacgactcactatagggagaagtcaaagatggagctgatgagctcgcaacagaggagagcgagcatgtcagctccaaacctggcggcagcgcaaaagatg

SEQ ID NO: 195980 - DNA, 103 bp, Artificial Sequence
  Synthetic Polynucleotide
taatacgactcactataggggtgataaccccgtagtggatcccagacgacaacagaggagagtcgtcatggatccactaaacctggcggcagcgcaaaagatg

SEQ ID NO: 195981 - DNA, 103 bp, Artificial Sequence
  Synthetic Polynucleotide
taatacgactcactatagggagggagtgggagaagtcaaagatggagctgaacagaggagacagctcatgctttgacttaacctggcggcagcgcaaaagatg

SEQ ID NO: 195982 - DNA, 103 bp, Artificial Sequence
  Synthetic Polynucleotide
taatacgactcactatagggcaaggcacttagggagtgggagaagtcaaaaacagaggagatttgacatgtcccactccaacctggcggcagcgcaaaagatg

SEQ ID NO: 195983 - DNA, 103 bp, Artificial Sequence
  Synthetic Polynucleotide
taatacgactcactatagggcggaaaagtgcaaggcacttagggagtgggaacagaggagacccactatgtaagtgcctaacctggcggcagcgcaaaagatg

SEQ ID NO: 195984 - DNA, 103 bp, Artificial Sequence
  Synthetic Polynucleotide
taatacgactcactatagggatctcatcctcggaaaagtgcaaggcacttaacagaggagaaagtgcatggcacttttcaacctggcggcagcgcaaaagatg

SEQ ID NO: 195985 - DNA, 103 bp, Artificial Sequence
  Synthetic Polynucleotide
taatacgactcactataggggtagagggcaatctcatcctcggaaaagtgaacagaggagacactttatggaggatgagaacctggcggcagcgcaaaagatg

SEQ ID NO: 195986 - DNA, 103 bp, Artificial Sequence
  Synthetic Polynucleotide
taatacgactcactatagggcaagggctgtgtagagggcaatctcatcctaacagaggagaaggatgatgttgccctctaacctggcggcagcgcaaaagatg

SEQ ID NO: 195987 - DNA, 103 bp, Artificial Sequence
  Synthetic Polynucleotide
taatacgactcactatagggttgatgagaacaagggctgtgtagagggcaaacagaggagatgccctatgcacagccctaacctggcggcagcgcaaaagatg

SEQ ID NO: 195988 - DNA, 103 bp, Artificial Sequence
  Synthetic Polynucleotide
taatacgactcactatagggccgatgggcattgatgagaacaagggctgtaacagaggagaacagccatggttctcatcaacctggcggcagcgcaaaagatg

SEQ ID NO: 195989 - DNA, 103 bp, Artificial Sequence
  Synthetic Polynucleotide
taatacgactcactatagggggagccctggccgatgggcattgatgagaaaacagaggagattctcaatgatgcccatcaacctggcggcagcgcaaaagatg

SEQ ID NO: 195990 - DNA, 103 bp, Artificial Sequence
  Synthetic Polynucleotide
taatacgactcactatagggcttttctcttggagccctggccgatgggcaaacagaggagatgcccaatggccagggctaacctggcggcagcgcaaaagatg

SEQ ID NO: 195991 - DNA, 103 bp, Artificial Sequence
  Synthetic Polynucleotide
taatacgactcactatagggcccctcacaggtgataaccccgtagtggataacagaggagaatccacatgggggttatcaacctggcggcagcgcaaaagatg

SEQ ID NO: 195992 - DNA, 103 bp, Artificial Sequence
  Synthetic Polynucleotide
taatacgactcactatagggttctactttccttttctcttggagccctggaacagaggagaccagggatgcaagagaaaaacctggcggcagcgcaaaagatg

SEQ ID NO: 195993 - DNA, 103 bp, Artificial Sequence
  Synthetic Polynucleotide
taatacgactcactatagggactgcagctgttctactttccttttctcttaacagaggagaaagagaatgggaaagtagaacctggcggcagcgcaaaagatg

SEQ ID NO: 195994 - DNA, 103 bp, Artificial Sequence
  Synthetic Polynucleotide
taatacgactcactatagggtccagattgtactgcagctgttctactttcaacagaggagagaaagtatgacagctgcaaacctggcggcagcgcaaaagatg

SEQ ID NO: 195995 - DNA, 103 bp, Artificial Sequence
  Synthetic Polynucleotide
taatacgactcactatagggaaaggccagctccagattgtactgcagctgaacagaggagacagctgatgtacaatctgaacctggcggcagcgcaaaagatg

SEQ ID NO: 195996 - DNA, 103 bp, Artificial Sequence
  Synthetic Polynucleotide
taatacgactcactataggggatgatgatgaaaggccagctccagattgtaacagaggagaacaatcatgagctggcctaacctggcggcagcgcaaaagatg

SEQ ID NO: 195997 - DNA, 103 bp, Artificial Sequence
  Synthetic Polynucleotide
taatacgactcactataggggtcttgcagagatgatgatgaaaggccagcaacagaggagagctggcatgtcatcatcaaacctggcggcagcgcaaaagatg

SEQ ID NO: 195998 - DNA, 103 bp, Artificial Sequence
  Synthetic Polynucleotide
taatacgactcactatagggttggcgatgagtcttgcagagatgatgatgaacagaggagacatcatatgctctgcaagaacctggcggcagcgcaaaagatg

SEQ ID NO: 195999 - DNA, 103 bp, Artificial Sequence
  Synthetic Polynucleotide
taatacgactcactatagggccaggatgctttggcgatgagtcttgcagaaacagaggagatctgcaatgctcatcgccaacctggcggcagcgcaaaagatg

SEQ ID NO: 196000 - DNA, 103 bp, Artificial Sequence
  Synthetic Polynucleotide
taatacgactcactatagggggcagctttgccaggatgctttggcgatgaaacagaggagatcatcgatgaagcatcctaacctggcggcagcgcaaaagatg

SEQ ID NO: 196001 - DNA, 103 bp, Artificial Sequence
  Synthetic Polynucleotide
taatacgactcactatagggccccttgggtggcagctttgccaggatgctaacagaggagaagcatcatggcaaagctgaacctggcggcagcgcaaaagatg

SEQ ID NO: 196002 - DNA, 103 bp, Artificial Sequence
  Synthetic Polynucleotide
taatacgactcactatagggagcccttgcacccctcacaggtgataacccaacagaggagagggttaatgcctgtgaggaacctggcggcagcgcaaaagatg

SEQ ID NO: 196003 - DNA, 103 bp, Artificial Sequence
  Synthetic Polynucleotide
taatacgactcactatagggtccgaagcttccccttgggtggcagctttgaacagaggagacaaagcatgcacccaaggaacctggcggcagcgcaaaagatg

SEQ ID NO: 196004 - DNA, 103 bp, Artificial Sequence
  Synthetic Polynucleotide
taatacgactcactatagggctacacaggctccgaagcttccccttgggtaacagaggagaacccaaatggaagcttcgaacctggcggcagcgcaaaagatg

SEQ ID NO: 196005 - DNA, 103 bp, Artificial Sequence
  Synthetic Polynucleotide
taatacgactcactatagggcacatgctggctacacaggctccgaagcttaacagaggagaaagcttatgagcctgtgtaacctggcggcagcgcaaaagatg

SEQ ID NO: 196006 - DNA, 103 bp, Artificial Sequence
  Synthetic Polynucleotide
taatacgactcactataggggcagcctttccacatgctggctacacaggcaacagaggagagcctgtatggccagcatgaacctggcggcagcgcaaaagatg

SEQ ID NO: 196007 - DNA, 103 bp, Artificial Sequence
  Synthetic Polynucleotide
taatacgactcactatagggtggaagatctgcagcctttccacatgctggaacagaggagaccagcaatgggaaaggctaacctggcggcagcgcaaaagatg

SEQ ID NO: 196008 - DNA, 103 bp, Artificial Sequence
  Synthetic Polynucleotide
taatacgactcactataggggtggaggtgctggaagatctgcagcctttcaacagaggagagaaaggatgcagatcttcaacctggcggcagcgcaaaagatg

SEQ ID NO: 196009 - DNA, 103 bp, Artificial Sequence
  Synthetic Polynucleotide
taatacgactcactatagggccacgatggggtggaggtgctggaagatctaacagaggagaagatctatgagcacctccaacctggcggcagcgcaaaagatg

SEQ ID NO: 196010 - DNA, 103 bp, Artificial Sequence
  Synthetic Polynucleotide
taatacgactcactataggggcggcttggaccacgatggggtggaggtgcaacagaggagagcacctatgccccatcgtaacctggcggcagcgcaaaagatg

SEQ ID NO: 196011 - DNA, 103 bp, Artificial Sequence
  Synthetic Polynucleotide
taatacgactcactatagggtggagggaaagcggcttggaccacgatgggaacagaggagacccatcatggtccaagccaacctggcggcagcgcaaaagatg

SEQ ID NO: 196012 - DNA, 103 bp, Artificial Sequence
  Synthetic Polynucleotide
taatacgactcactatagggccttgtagagtggagggaaagcggcttggaaacagaggagatccaagatgctttccctcaacctggcggcagcgcaaaagatg

SEQ ID NO: 196013 - DNA, 103 bp, Artificial Sequence
  Synthetic Polynucleotide
taatacgactcactatagggcggcggaagaagcccttgcacccctcacagaacagaggagactgtgaatggtgcaagggaacctggcggcagcgcaaaagatg

SEQ ID NO: 196014 - DNA, 103 bp, Artificial Sequence
  Synthetic Polynucleotide
taatacgactcactatagggctgaagagctccttgtagagtggagggaaaaacagaggagatttcccatgactctacaaaacctggcggcagcgcaaaagatg

SEQ ID NO: 196015 - DNA, 103 bp, Artificial Sequence
  Synthetic Polynucleotide
taatacgactcactatagggggtttcagtgctgaagagctccttgtagagaacagaggagactctacatggagctcttcaacctggcggcagcgcaaaagatg

SEQ ID NO: 196016 - DNA, 103 bp, Artificial Sequence
  Synthetic Polynucleotide
taatacgactcactatagggcaggtgactcggtttcagtgctgaagagctaacagaggagaagctctatggcactgaaaaacctggcggcagcgcaaaagatg

SEQ ID NO: 196017 - DNA, 103 bp, Artificial Sequence
  Synthetic Polynucleotide
taatacgactcactataggggacagccccacaggtgactcggtttcagtgaacagaggagacactgaatgcgagtcaccaacctggcggcagcgcaaaagatg

SEQ ID NO: 196018 - DNA, 103 bp, Artificial Sequence
  Synthetic Polynucleotide
taatacgactcactataggggcgctggctccggcggaagaagcccttgcaaacagaggagatgcaagatgttcttccgcaacctggcggcagcgcaaaagatg

SEQ ID NO: 196019 - DNA, 103 bp, Artificial Sequence
  Synthetic Polynucleotide
taatacgactcactatagggccgcgttacagcgctggctccggcggaagaaacagaggagatcttccatgggagccagcaacctggcggcagcgcaaaagatg

SEQ ID NO: 196020 - DNA, 103 bp, Artificial Sequence
  Synthetic Polynucleotide
taatacgactcactatagggcaggagtaggccgcgttacagcgctggctcaacagaggagagagccaatgctgtaacgcaacctggcggcagcgcaaaagatg

SEQ ID NO: 196021 - DNA, 103 bp, Artificial Sequence
  Synthetic Polynucleotide
taatacgactcactatagggctgacgggtgcaggagtaggccgcgttacaaacagaggagatgtaacatggcctactccaacctggcggcagcgcaaaagatg

SEQ ID NO: 196022 - DNA, 103 bp, Artificial Sequence
  Synthetic Polynucleotide
taatacgactcactatagggcccgtgaggctcggtgctgtctctgtggggaacagaggagaccccacatggacagcaccaacctggcggcagcgcaaaagatg

SEQ ID NO: 196023 - DNA, 103 bp, Artificial Sequence
  Synthetic Polynucleotide
taatacgactcactatagggggcagttctgctgacgggtgcaggagtaggaacagaggagacctactatggcacccgtcaacctggcggcagcgcaaaagatg

SEQ ID NO: 196024 - DNA, 103 bp, Artificial Sequence
  Synthetic Polynucleotide
taatacgactcactatagggcggtcgatggggcagttctgctgacgggtgaacagaggagacacccgatggcagaactgaacctggcggcagcgcaaaagatg

SEQ ID NO: 196025 - DNA, 103 bp, Artificial Sequence
  Synthetic Polynucleotide
taatacgactcactatagggtcggctggtgcggtcgatggggcagttctgaacagaggagacagaacatgcccatcgacaacctggcggcagcgcaaaagatg

SEQ ID NO: 196026 - DNA, 103 bp, Artificial Sequence
  Synthetic Polynucleotide
taatacgactcactatagggggcatcggtttcggctggtgcggtcgatggaacagaggagaccatcgatggcaccagccaacctggcggcagcgcaaaagatg

SEQ ID NO: 196027 - DNA, 103 bp, Artificial Sequence
  Synthetic Polynucleotide
taatacgactcactatagggcggcagtgctggcatcggtttcggctggtgaacagaggagacaccagatgaaaccgatgaacctggcggcagcgcaaaagatg

SEQ ID NO: 196028 - DNA, 103 bp, Artificial Sequence
  Synthetic Polynucleotide
taatacgactcactatagggtttctgcaggcggcagtgctggcatcggttaacagaggagaaaccgaatgcagcactgcaacctggcggcagcgcaaaagatg

SEQ ID NO: 196029 - DNA, 103 bp, Artificial Sequence
  Synthetic Polynucleotide
taatacgactcactataggggcgccaggcatttctgcaggcggcagtgctaacagaggagaagcactatggcctgcagaaacctggcggcagcgcaaaagatg

SEQ ID NO: 196030 - DNA, 103 bp, Artificial Sequence
  Synthetic Polynucleotide
taatacgactcactataggggacatgcccagcgccaggcatttctgcaggaacagaggagacctgcaatgatgcctggcaacctggcggcagcgcaaaagatg

SEQ ID NO: 196031 - DNA, 103 bp, Artificial Sequence
  Synthetic Polynucleotide
taatacgactcactatagggagcatctcgggacatgcccagcgccaggcaaacagaggagatgcctgatgctgggcatgaacctggcggcagcgcaaaagatg

SEQ ID NO: 196032 - DNA, 103 bp, Artificial Sequence
  Synthetic Polynucleotide
taatacgactcactatagggcgaacttgacagcatctcgggacatgcccaaacagaggagatgggcaatgcccgagatgaacctggcggcagcgcaaaagatg

SEQ ID NO: 196033 - DNA, 103 bp, Artificial Sequence
  Synthetic Polynucleotide
taatacgactcactataggggccagcagctcccgtgaggctcggtgctgtaacagaggagaacagcaatgagcctcacgaacctggcggcagcgcaaaagatg

SEQ ID NO: 196034 - DNA, 103 bp, Artificial Sequence
  Synthetic Polynucleotide
taatacgactcactataggggacatgcggccgaacttgacagcatctcggaacagaggagaccgagaatgtgtcaagttaacctggcggcagcgcaaaagatg

SEQ ID NO: 196035 - DNA, 103 bp, Artificial Sequence
  Synthetic Polynucleotide
taatacgactcactatagggctgcttcttggacatgcggccgaacttgacaacagaggagagtcaagatgggccgcatgaacctggcggcagcgcaaaagatg

SEQ ID NO: 196036 - DNA, 103 bp, Artificial Sequence
  Synthetic Polynucleotide
taatacgactcactatagggggctgtccctctgcttcttggacatgcggcaacagaggagagccgcaatgccaagaagcaacctggcggcagcgcaaaagatg

SEQ ID NO: 196037 - DNA, 103 bp, Artificial Sequence
  Synthetic Polynucleotide
taatacgactcactatagggtctgcatgcaggctgtccctctgcttcttgaacagaggagacaagaaatggagggacagaacctggcggcagcgcaaaagatg

SEQ ID NO: 196038 - DNA, 103 bp, Artificial Sequence
  Synthetic Polynucleotide
taatacgactcactatagggtttctgcacttctgcatgcaggctgtccctaacagaggagaagggacatgctgcatgcaaacctggcggcagcgcaaaagatg

SEQ ID NO: 196039 - DNA, 103 bp, Artificial Sequence
  Synthetic Polynucleotide
taatacgactcactataggggctgcagctgtttctgcacttctgcatgcaaacagaggagatgcatgatgaagtgcagaaacctggcggcagcgcaaaagatg

SEQ ID NO: 196040 - DNA, 103 bp, Artificial Sequence
  Synthetic Polynucleotide
taatacgactcactatagggtgttgccgctgctgcagctgtttctgcactaacagaggagaagtgcaatgacagctgcaaacctggcggcagcgcaaaagatg

SEQ ID NO: 196041 - DNA, 103 bp, Artificial Sequence
  Synthetic Polynucleotide
taatacgactcactatagggctgttgctgctgttgccgctgctgcagctgaacagaggagacagctgatgcagcggcaaaacctggcggcagcgcaaaagatg

SEQ ID NO: 196042 - DNA, 103 bp, Artificial Sequence
  Synthetic Polynucleotide
taatacgactcactatagggccactggttcctgttgctgctgttgccgctaacagaggagaagcggcatgagcagcaacaacctggcggcagcgcaaaagatg

SEQ ID NO: 196043 - DNA, 103 bp, Artificial Sequence
  Synthetic Polynucleotide
taatacgactcactatagggggggtcttgaccactggttcctgttgctgcaacagaggagagcagcaatgggaaccagtaacctggcggcagcgcaaaagatg

SEQ ID NO: 196044 - DNA, 103 bp, Artificial Sequence
  Synthetic Polynucleotide
taatacgactcactatagggcttctttgcagccagcagctcccgtgaggcaacagaggagagcctcaatggagctgctgaacctggcggcagcgcaaaagatg

SEQ ID NO: 196045 - DNA, 103 bp, Artificial Sequence
  Synthetic Polynucleotide
taatacgactcactatagggccctgctggaggggtcttgaccactggttcaacagaggagagaaccaatggtcaagaccaacctggcggcagcgcaaaagatg

SEQ ID NO: 196046 - DNA, 103 bp, Artificial Sequence
  Synthetic Polynucleotide
taatacgactcactatagggctccttgggcccctgctggaggggtcttgaaacagaggagatcaagaatgctccagcagaacctggcggcagcgcaaaagatg

SEQ ID NO: 196047 - DNA, 103 bp, Artificial Sequence
  Synthetic Polynucleotide
taatacgactcactatagggagggtatctgctccttgggcccctgctggaaacagaggagatccagcatgggcccaaggaacctggcggcagcgcaaaagatg

SEQ ID NO: 196048 - DNA, 103 bp, Artificial Sequence
  Synthetic Polynucleotide
taatacgactcactatagggggtgtaggtgagggtatctgctccttgggcaacagaggagagcccaaatggcagataccaacctggcggcagcgcaaaagatg

SEQ ID NO: 196049 - DNA, 103 bp, Artificial Sequence
  Synthetic Polynucleotide
taatacgactcactatagggggagccccaaggtgtaggtgagggtatctgaacagaggagacagataatgtcacctacaaacctggcggcagcgcaaaagatg

SEQ ID NO: 196050 - DNA, 103 bp, Artificial Sequence
  Synthetic Polynucleotide
taatacgactcactatagggtgcccgtctgggagccccaaggtgtaggtgaacagaggagacacctaatgcttggggctaacctggcggcagcgcaaaagatg

SEQ ID NO: 196051 - DNA, 103 bp, Artificial Sequence
  Synthetic Polynucleotide
taatacgactcactatagggcaggggcagctgcccgtctgggagccccaaaacagaggagattggggatgccagacgggaacctggcggcagcgcaaaagatg

SEQ ID NO: 196052 - DNA, 103 bp, Artificial Sequence
  Synthetic Polynucleotide
taatacgactcactataggggcgaggagcccaggggcagctgcccgtctgaacagaggagacagacgatgagctgccccaacctggcggcagcgcaaaagatg

SEQ ID NO: 196053 - DNA, 103 bp, Artificial Sequence
  Synthetic Polynucleotide
taatacgactcactatagggggcaggtcaggcgaggagcccaggggcagcaacagaggagagctgccatggggctcctcaacctggcggcagcgcaaaagatg

SEQ ID NO: 196054 - DNA, 103 bp, Artificial Sequence
  Synthetic Polynucleotide
taatacgactcactatagggagaagcctcaggcaggtcaggcgaggagccaacagaggagaggctccatgcctgacctgaacctggcggcagcgcaaaagatg

SEQ ID NO: 196055 - DNA, 103 bp, Artificial Sequence
  Synthetic Polynucleotide
taatacgactcactatagggaggtgtgggtcttctttgcagccagcagctaacagaggagaagctgcatgctgcaaagaaacctggcggcagcgcaaaagatg

SEQ ID NO: 196056 - DNA, 103 bp, Artificial Sequence
  Synthetic Polynucleotide
taatacgactcactatagggggggacaggcagaagcctcaggcaggtcagaacagaggagactgaccatgctgaggcttaacctggcggcagcgcaaaagatg

SEQ ID NO: 196057 - DNA, 103 bp, Artificial Sequence
  Synthetic Polynucleotide
taatacgactcactatagggaggaggccagggggacaggcagaagcctcaaacagaggagatgaggcatgtgcctgtccaacctggcggcagcgcaaaagatg

SEQ ID NO: 196058 - DNA, 103 bp, Artificial Sequence
  Synthetic Polynucleotide
taatacgactcactatagggtgaggctttcaggaggccagggggacaggcaacagaggagagcctgtatgcctggcctcaacctggcggcagcgcaaaagatg

SEQ ID NO: 196059 - DNA, 103 bp, Artificial Sequence
  Synthetic Polynucleotide
taatacgactcactataggggcccagagcctgaggctttcaggaggccagaacagaggagactggccatgtgaaagcctaacctggcggcagcgcaaaagatg

SEQ ID NO: 196060 - DNA, 103 bp, Artificial Sequence
  Synthetic Polynucleotide
taatacgactcactataggggaatatgagggcccagagcctgaggctttcaacagaggagagaaagcatgaggctctggaacctggcggcagcgcaaaagatg

SEQ ID NO: 196061 - DNA, 103 bp, Artificial Sequence
  Synthetic Polynucleotide
taatacgactcactatagggcaagttgttggaatatgagggcccagagccaacagaggagaggctctatgccctcatataacctggcggcagcgcaaaagatg

SEQ ID NO: 196062 - DNA, 103 bp, Artificial Sequence
  Synthetic Polynucleotide
taatacgactcactatagggctgccttggccaagttgttggaatatgaggaacagaggagacctcatatgccaacaactaacctggcggcagcgcaaaagatg

SEQ ID NO: 196063 - DNA, 103 bp, Artificial Sequence
  Synthetic Polynucleotide
taatacgactcactatagggccattgagccctgccttggccaagttgttgaacagaggagacaacaaatgggccaaggcaacctggcggcagcgcaaaagatg

SEQ ID NO: 196064 - DNA, 103 bp, Artificial Sequence
  Synthetic Polynucleotide
taatacgactcactataggggcatgaggccccattgagccctgccttggcaacagaggagagccaagatggggctcaataacctggcggcagcgcaaaagatg

SEQ ID NO: 196065 - DNA, 103 bp, Artificial Sequence
  Synthetic Polynucleotide
taatacgactcactatagggattcaaggtggcatgaggccccattgagccaacagaggagaggctcaatggggcctcataacctggcggcagcgcaaaagatg

SEQ ID NO: 196066 - DNA, 103 bp, Artificial Sequence
  Synthetic Polynucleotide
taatacgactcactatagggtcaatttgtgaggtgtgggtcttctttgcaaacagaggagatgcaaaatggacccacacaacctggcggcagcgcaaaagatg

SEQ ID NO: 196067 - DNA, 103 bp, Artificial Sequence
  Synthetic Polynucleotide
taatacgactcactatagggtcagggctgtattcaaggtggcatgaggccaacagaggagaggcctcatgccaccttgaaacctggcggcagcgcaaaagatg

SEQ ID NO: 196068 - DNA, 103 bp, Artificial Sequence
  Synthetic Polynucleotide
taatacgactcactatagggcttgccccgctcagggctgtattcaaggtgaacagaggagacaccttatgtacagccctaacctggcggcagcgcaaaagatg

SEQ ID NO: 196069 - DNA, 103 bp, Artificial Sequence
  Synthetic Polynucleotide
taatacgactcactatagggtgccctcagccttgccccgctcagggctgtaacagaggagaacagccatgagcggggcaaacctggcggcagcgcaaaagatg

SEQ ID NO: 196070 - DNA, 103 bp, Artificial Sequence
  Synthetic Polynucleotide
taatacgactcactatagggaagctctctctgccctcagccttgccccgcaacagaggagagcggggatgggctgagggaacctggcggcagcgcaaaagatg

SEQ ID NO: 196071 - DNA, 103 bp, Artificial Sequence
  Synthetic Polynucleotide
taatacgactcactatagggtgtgctatagaagctctctctgccctcagcaacagaggagagctgagatgagagagagcaacctggcggcagcgcaaaagatg

SEQ ID NO: 196072 - DNA, 103 bp, Artificial Sequence
  Synthetic Polynucleotide
taatacgactcactataggggctggctgcctgtgctatagaagctctctcaacagaggagagagagaatgtctatagcaaacctggcggcagcgcaaaagatg

SEQ ID NO: 196073 - DNA, 103 bp, Artificial Sequence
  Synthetic Polynucleotide
taatacgactcactatagggtcaggggtcagctggctgcctgtgctatagaacagaggagactatagatgaggcagccaaacctggcggcagcgcaaaagatg

SEQ ID NO: 196074 - DNA, 103 bp, Artificial Sequence
  Synthetic Polynucleotide
taatacgactcactatagggtccacatcggtcaggggtcagctggctgccaacagaggagaggcagcatgctgacccctaacctggcggcagcgcaaaagatg

SEQ ID NO: 196075 - DNA, 103 bp, Artificial Sequence
  Synthetic Polynucleotide
taatacgactcactatagggcaaaacgaagtccacatcggtcaggggtcaaacagaggagatgacccatgaccgatgtgaacctggcggcagcgcaaaagatg

SEQ ID NO: 196076 - DNA, 103 bp, Artificial Sequence
  Synthetic Polynucleotide
taatacgactcactatagggctgtgttcctcaaaacgaagtccacatcggaacagaggagaccgatgatgacttcgtttaacctggcggcagcgcaaaagatg

SEQ ID NO: 196077 - DNA, 103 bp, Artificial Sequence
  Synthetic Polynucleotide
taatacgactcactatagggagggatcacttcaatttgtgaggtgtgggtaacagaggagaacccacatgtcacaaattaacctggcggcagcgcaaaagatg

SEQ ID NO: 196078 - DNA, 103 bp, Artificial Sequence
  Synthetic Polynucleotide
taatacgactcactatagggcccaggatgcctgtgttcctcaaaacgaagaacagaggagacttcgtatggaggaacacaacctggcggcagcgcaaaagatg

SEQ ID NO: 196079 - DNA, 103 bp, Artificial Sequence
  Synthetic Polynucleotide
taatacgactcactataggggttccccaagcccaggatgcctgtgttcctaacagaggagaaggaacatgggcatcctgaacctggcggcagcgcaaaagatg

SEQ ID NO: 196080 - DNA, 103 bp, Artificial Sequence
  Synthetic Polynucleotide
taatacgactcactatagggccctgtcccagttccccaagcccaggatgcaacagaggagagcatccatggcttggggaaacctggcggcagcgcaaaagatg

SEQ ID NO: 196081 - DNA, 103 bp, Artificial Sequence
  Synthetic Polynucleotide
taatacgactcactataggggctgtctgggccctgtcccagttccccaagaacagaggagacttgggatgctgggacagaacctggcggcagcgcaaaagatg

SEQ ID NO: 196082 - DNA, 103 bp, Artificial Sequence
  Synthetic Polynucleotide
taatacgactcactatagggggctgccgtagctgtctgggccctgtcccaaacagaggagatgggacatggcccagacaaacctggcggcagcgcaaaagatg

SEQ ID NO: 196083 - DNA, 103 bp, Artificial Sequence
  Synthetic Polynucleotide
taatacgactcactatagggcggaaactggggctgccgtagctgtctgggaacagaggagacccagaatgctacggcagaacctggcggcagcgcaaaagatg

SEQ ID NO: 196084 - DNA, 103 bp, Artificial Sequence
  Synthetic Polynucleotide
taatacgactcactatagggcggtgtgctgcggaaactggggctgccgtaaacagaggagatacggcatgcccagtttcaacctggcggcagcgcaaaagatg

SEQ ID NO: 196085 - DNA, 103 bp, Artificial Sequence
  Synthetic Polynucleotide
taatacgactcactatagggagggtgcctccggtgtgctgcggaaactggaacagaggagaccagttatggcagcacacaacctggcggcagcgcaaaagatg

SEQ ID NO: 196086 - DNA, 103 bp, Artificial Sequence
  Synthetic Polynucleotide
taatacgactcactatagggagggaggcatagggtgcctccggtgtgctgaacagaggagacagcacatgggaggcaccaacctggcggcagcgcaaaagatg

SEQ ID NO: 196087 - DNA, 103 bp, Artificial Sequence
  Synthetic Polynucleotide
taatacgactcactatagggtatctctgtcagggaggcatagggtgcctcaacagaggagagaggcaatgtatgcctccaacctggcggcagcgcaaaagatg

SEQ ID NO: 196088 - DNA, 103 bp, Artificial Sequence
  Synthetic Polynucleotide
taatacgactcactatagggagattttgcaagggatcacttcaatttgtgaacagaggagacacaaaatgaagtgatccaacctggcggcagcgcaaaagatg

SEQ ID NO: 196089 - DNA, 103 bp, Artificial Sequence
  Synthetic Polynucleotide
taatacgactcactatagggccaggtgctctatctctgtcagggaggcataacagaggagaatgcctatgtgacagagaaacctggcggcagcgcaaaagatg

SEQ ID NO: 196090 - DNA, 103 bp, Artificial Sequence
  Synthetic Polynucleotide
taatacgactcactatagggacgctctgcaccaggtgctctatctctgtcaacagaggagagacagaatgagagcacctaacctggcggcagcgcaaaagatg

SEQ ID NO: 196091 - DNA, 103 bp, Artificial Sequence
  Synthetic Polynucleotide
taatacgactcactatagggggacttgcagacgctctgcaccaggtgctcaacagaggagagagcacatggtgcagagcaacctggcggcagcgcaaaagatg

SEQ ID NO: 196092 - DNA, 103 bp, Artificial Sequence
  Synthetic Polynucleotide
taatacgactcactatagggtctccctgtaggacttgcagacgctctgcaaacagaggagatgcagaatgtctgcaagtaacctggcggcagcgcaaaagatg

SEQ ID NO: 196093 - DNA, 103 bp, Artificial Sequence
  Synthetic Polynucleotide
taatacgactcactatagggagctggcatgtctccctgtaggacttgcagaacagaggagactgcaaatgctacagggaaacctggcggcagcgcaaaagatg

SEQ ID NO: 196094 - DNA, 103 bp, Artificial Sequence
  Synthetic Polynucleotide
taatacgactcactatagggctccagccgcagctggcatgtctccctgtaaacagaggagatacaggatgacatgccagaacctggcggcagcgcaaaagatg

SEQ ID NO: 196095 - DNA, 103 bp, Artificial Sequence
  Synthetic Polynucleotide
taatacgactcactataggggcagcaggtcctccagccgcagctggcatgaacagaggagacatgccatgtgcggctggaacctggcggcagcgcaaaagatg

SEQ ID NO: 196096 - DNA, 103 bp, Artificial Sequence
  Synthetic Polynucleotide
taatacgactcactataggggagcgctgccgcagcaggtcctccagccgcaacagaggagagcggctatgggacctgctaacctggcggcagcgcaaaagatg

SEQ ID NO: 196097 - DNA, 103 bp, Artificial Sequence
  Synthetic Polynucleotide
taatacgactcactataggggaagatgttggagcgctgccgcagcaggtcaacagaggagagacctgatgcggcagcgcaacctggcggcagcgcaaaagatg

SEQ ID NO: 196098 - DNA, 103 bp, Artificial Sequence
  Synthetic Polynucleotide
taatacgactcactatagggcctcccgggagaagatgttggagcgctgccaacagaggagaggcagcatgccaacatctaacctggcggcagcgcaaaagatg

SEQ ID NO: 196099 - DNA, 103 bp, Artificial Sequence
  Synthetic Polynucleotide
taatacgactcactatagggttgtccccacagattttgcaagggatcactaacagaggagaagtgatatgttgcaaaataacctggcggcagcgcaaaagatg

SEQ ID NO: 196100 - DNA, 103 bp, Artificial Sequence
  Synthetic Polynucleotide
taatacgactcactatagggccagtcacttcctcccgggagaagatgttgaacagaggagacaacatatgctcccgggaaacctggcggcagcgcaaaagatg

SEQ ID NO: 196101 - DNA, 103 bp, Artificial Sequence
  Synthetic Polynucleotide
taatacgactcactatagggcctctggtagccagtcacttcctcccgggaaacagaggagatcccggatggaagtgactaacctggcggcagcgcaaaagatg

SEQ ID NO: 196102 - DNA, 103 bp, Artificial Sequence
  Synthetic Polynucleotide
taatacgactcactatagggacatggacttcctctggtagccagtcacttaacagaggagaaagtgaatggctaccagaaacctggcggcagcgcaaaagatg

SEQ ID NO: 196103 - DNA, 103 bp, Artificial Sequence
  Synthetic Polynucleotide
taatacgactcactatagggcacatctcccacatggacttcctctggtagaacagaggagactaccaatggaagtccataacctggcggcagcgcaaaagatg

SEQ ID NO: 196104 - DNA, 103 bp, Artificial Sequence
  Synthetic Polynucleotide
taatacgactcactatagggacaccgttcccacatctcccacatggacttaacagaggagaaagtccatgtgggagatgaacctggcggcagcgcaaaagatg

SEQ ID NO: 196105 - DNA, 103 bp, Artificial Sequence
  Synthetic Polynucleotide
taatacgactcactatagggggtggtgggcacaccgttcccacatctcccaacagaggagagggagaatggggaacggtaacctggcggcagcgcaaaagatg

SEQ ID NO: 196106 - DNA, 103 bp, Artificial Sequence
  Synthetic Polynucleotide
taatacgactcactataggggcctcggtgaggtggtgggcacaccgttccaacagaggagaggaacgatgtgcccaccaaacctggcggcagcgcaaaagatg

SEQ ID NO: 196107 - DNA, 103 bp, Artificial Sequence
  Synthetic Polynucleotide
taatacgactcactataggggtactgaatggcctcggtgaggtggtgggcaacagaggagagcccacatgctcaccgagaacctggcggcagcgcaaaagatg

SEQ ID NO: 196108 - DNA, 103 bp, Artificial Sequence
  Synthetic Polynucleotide
taatacgactcactatagggactccaccacgtactgaatggcctcggtgaaacagaggagatcaccgatgccattcagtaacctggcggcagcgcaaaagatg

SEQ ID NO: 196109 - DNA, 103 bp, Artificial Sequence
  Synthetic Polynucleotide
taatacgactcactatagggctcttggcgaactccaccacgtactgaatgaacagaggagacattcaatgcgtggtggaaacctggcggcagcgcaaaagatg

SEQ ID NO: 196110 - DNA, 103 bp, Artificial Sequence
  Synthetic Polynucleotide
taatacgactcactatagggcttcctcttcttggatatttgcactgccataacagaggagaatggcaatgcaaatatccaacctggcggcagcgcaaaagatg

SEQ ID NO: 196111 - DNA, 103 bp, Artificial Sequence
  Synthetic Polynucleotide
taatacgactcactatagggtcgcacctcaactccagagtagccatcttcaacagaggagagaagatatgtactctggaaacctggcggcagcgcaaaagatg

SEQ ID NO: 196112 - DNA, 103 bp, Artificial Sequence
  Synthetic Polynucleotide
taatacgactcactatagggttggtgtaactcgcacctcaactccagagtaacagaggagaactctgatgttgaggtgcaacctggcggcagcgcaaaagatg

SEQ ID NO: 196113 - DNA, 103 bp, Artificial Sequence
  Synthetic Polynucleotide
taatacgactcactatagggtctgtcctggttggtgtaactcgcacctcaaacagaggagatgaggtatgagttacaccaacctggcggcagcgcaaaagatg

SEQ ID NO: 196114 - DNA, 103 bp, Artificial Sequence
  Synthetic Polynucleotide
taatacgactcactataggggataatgatttctgtcctggttggtgtaacaacagaggagagttacaatgaccaggacaaacctggcggcagcgcaaaagatg

SEQ ID NO: 196115 - DNA, 103 bp, Artificial Sequence
  Synthetic Polynucleotide
taatacgactcactatagggtggtggctaagataatgatttctgtcctggaacagaggagaccaggaatgaaatcattaaacctggcggcagcgcaaaagatg

SEQ ID NO: 196116 - DNA, 103 bp, Artificial Sequence
  Synthetic Polynucleotide
taatacgactcactatagggttctgtgttctggtggctaagataatgattaacagaggagaaatcatatgcttagccacaacctggcggcagcgcaaaagatg

SEQ ID NO: 196117 - DNA, 103 bp, Artificial Sequence
  Synthetic Polynucleotide
taatacgactcactatagggaccaagaacattctgtgttctggtggctaaaacagaggagattagccatgagaacacagaacctggcggcagcgcaaaagatg

SEQ ID NO: 196118 - DNA, 103 bp, Artificial Sequence
  Synthetic Polynucleotide
taatacgactcactatagggggcccttctcaccaagaacattctgtgttcaacagaggagagaacacatgatgttcttgaacctggcggcagcgcaaaagatg

SEQ ID NO: 196119 - DNA, 103 bp, Artificial Sequence
  Synthetic Polynucleotide
taatacgactcactatagggcgaatccgccggcccttctcaccaagaacaaacagaggagatgttctatgtgagaagggaacctggcggcagcgcaaaagatg

SEQ ID NO: 196120 - DNA, 103 bp, Artificial Sequence
  Synthetic Polynucleotide
taatacgactcactatagggagtcagttcccgaatccgccggcccttctcaacagaggagagagaagatgcggcggattaacctggcggcagcgcaaaagatg

SEQ ID NO: 196121 - DNA, 103 bp, Artificial Sequence
  Synthetic Polynucleotide
taatacgactcactatagggcagcgacaaacttcctcttcttggatatttaacagaggagaaaatatatgagaagaggaaacctggcggcagcgcaaaagatg

SEQ ID NO: 196122 - DNA, 103 bp, Artificial Sequence
  Synthetic Polynucleotide
taatacgactcactataggggaactacagcagtcagttcccgaatccgccaacagaggagaggcggaatggggaactgaaacctggcggcagcgcaaaagatg

SEQ ID NO: 196123 - DNA, 103 bp, Artificial Sequence
  Synthetic Polynucleotide
taatacgactcactatagggaacctcttctgaactacagcagtcagttccaacagaggagaggaactatgtgctgtagtaacctggcggcagcgcaaaagatg

SEQ ID NO: 196124 - DNA, 103 bp, Artificial Sequence
  Synthetic Polynucleotide
taatacgactcactatagggtggaaagccaaacctcttctgaactacagcaacagaggagagctgtaatgcagaagaggaacctggcggcagcgcaaaagatg

SEQ ID NO: 196125 - DNA, 103 bp, Artificial Sequence
  Synthetic Polynucleotide
taatacgactcactatagggcactgccctctggaaagccaaacctcttctaacagaggagaagaagaatgttggctttcaacctggcggcagcgcaaaagatg

SEQ ID NO: 196126 - DNA, 103 bp, Artificial Sequence
  Synthetic Polynucleotide
taatacgactcactatagggttcaactctacactgccctctggaaagccaaacagaggagatggcttatgagagggcagaacctggcggcagcgcaaaagatg

SEQ ID NO: 196127 - DNA, 103 bp, Artificial Sequence
  Synthetic Polynucleotide
taatacgactcactatagggcaccattattttcaactctacactgccctcaacagaggagagagggcatggtagagttgaacctggcggcagcgcaaaagatg

SEQ ID NO: 196128 - DNA, 103 bp, Artificial Sequence
  Synthetic Polynucleotide
taatacgactcactatagggctgttaccatcaccattattttcaactctaaacagaggagatagagtatgaaataatggaacctggcggcagcgcaaaagatg

SEQ ID NO: 196129 - DNA, 103 bp, Artificial Sequence
  Synthetic Polynucleotide
taatacgactcactatagggaagggatatcctgttaccatcaccattattaacagaggagaaataatatggatggtaacaacctggcggcagcgcaaaagatg

SEQ ID NO: 196130 - DNA, 103 bp, Artificial Sequence
  Synthetic Polynucleotide
taatacgactcactatagggtaaaggaagcaagggatatcctgttaccataacagaggagaatggtaatgggatatcccaacctggcggcagcgcaaaagatg

SEQ ID NO: 196131 - DNA, 103 bp, Artificial Sequence
  Synthetic Polynucleotide
taatacgactcactatagggcataaagctttaaaggaagcaagggatatcaacagaggagagatatcatgtgcttccttaacctggcggcagcgcaaaagatg

SEQ ID NO: 196132 - DNA, 103 bp, Artificial Sequence
  Synthetic Polynucleotide
taatacgactcactatagggaagatgccatcagcgacaaacttcctcttcaacagaggagagaagagatggtttgtcgcaacctggcggcagcgcaaaagatg

SEQ ID NO: 196133 - DNA, 103 bp, Artificial Sequence
  Synthetic Polynucleotide
taatacgactcactatagggaccttttcagcataaagctttaaaggaagcaacagaggagagcttccatgaaagctttaaacctggcggcagcgcaaaagatg

SEQ ID NO: 196134 - DNA, 103 bp, Artificial Sequence
  Synthetic Polynucleotide
taatacgactcactatagggtctagtggccaccttttcagcataaagcttaacagaggagaaagcttatggctgaaaagaacctggcggcagcgcaaaagatg

SEQ ID NO: 196135 - DNA, 103 bp, Artificial Sequence
  Synthetic Polynucleotide
taatacgactcactatagggcacacagacctctagtggccaccttttcagaacagaggagactgaaaatgtggccactaaacctggcggcagcgcaaaagatg

SEQ ID NO: 196136 - DNA, 103 bp, Artificial Sequence
  Synthetic Polynucleotide
taatacgactcactatagggtgggcaatggcacacagacctctagtggccaacagaggagaggccacatgaggtctgtgaacctggcggcagcgcaaaagatg

SEQ ID NO: 196137 - DNA, 103 bp, Artificial Sequence
  Synthetic Polynucleotide
taatacgactcactatagggagactctgcctgggcaatggcacacagaccaacagaggagaggtctgatggccattgccaacctggcggcagcgcaaaagatg

SEQ ID NO: 196138 - DNA, 103 bp, Artificial Sequence
  Synthetic Polynucleotide
taatacgactcactatagggtgtaacgcagagactctgcctgggcaatggaacagaggagaccattgatgaggcagagtaacctggcggcagcgcaaaagatg

SEQ ID NO: 196139 - DNA, 103 bp, Artificial Sequence
  Synthetic Polynucleotide
taatacgactcactatagggcctaggagtttgtaacgcagagactctgccaacagaggagaggcagaatgtctgcgttaaacctggcggcagcgcaaaagatg

SEQ ID NO: 196140 - DNA, 103 bp, Artificial Sequence
  Synthetic Polynucleotide
taatacgactcactatagggagcaagccctcctaggagtttgtaacgcagaacagaggagactgcgtatgaaactcctaaacctggcggcagcgcaaaagatg

SEQ ID NO: 196141 - DNA, 103 bp, Artificial Sequence
  Synthetic Polynucleotide
taatacgactcactatagggccctccgcacagcaagccctcctaggagttaacagaggagaaactccatggagggcttgaacctggcggcagcgcaaaagatg

SEQ ID NO: 196142 - DNA, 103 bp, Artificial Sequence
  Synthetic Polynucleotide
taatacgactcactatagggccatagcaggccctccgcacagcaagccctaacagaggagaagggctatgtgtgcggagaacctggcggcagcgcaaaagatg

SEQ ID NO: 196143 - DNA, 103 bp, Artificial Sequence
  Synthetic Polynucleotide
taatacgactcactatagggttcagctttgaagatgccatcagcgacaaaaacagaggagatttgtcatggatggcatcaacctggcggcagcgcaaaagatg

SEQ ID NO: 196144 - DNA, 103 bp, Artificial Sequence
  Synthetic Polynucleotide
taatacgactcactatagggccgcagcacaccatagcaggccctccgcacaacagaggagagtgcggatggcctgctataacctggcggcagcgcaaaagatg

SEQ ID NO: 196145 - DNA, 103 bp, Artificial Sequence
  Synthetic Polynucleotide
taatacgactcactatagggccatgatgaaccgcagcacaccatagcaggaacagaggagacctgctatggtgtgctgcaacctggcggcagcgcaaaagatg

SEQ ID NO: 196146 - DNA, 103 bp, Artificial Sequence
  Synthetic Polynucleotide
taatacgactcactataggggccccactctccatgatgaaccgcagcacaaacagaggagatgtgctatggttcatcataacctggcggcagcgcaaaagatg

SEQ ID NO: 196147 - DNA, 103 bp, Artificial Sequence
  Synthetic Polynucleotide
taatacgactcactataggggcagcctttggccccactctccatgatgaaaacagaggagattcatcatggagagtgggaacctggcggcagcgcaaaagatg

SEQ ID NO: 196148 - DNA, 103 bp, Artificial Sequence
  Synthetic Polynucleotide
taatacgactcactatagggccacaacctcgcagcctttggccccactctaacagaggagaagagtgatgccaaaggctaacctggcggcagcgcaaaagatg

SEQ ID NO: 196149 - DNA, 103 bp, Artificial Sequence
  Synthetic Polynucleotide
taatacgactcactatagggttcccagacaccacaacctcgcagcctttgaacagaggagacaaaggatgcgaggttgtaacctggcggcagcgcaaaagatg

SEQ ID NO: 196150 - DNA, 103 bp, Artificial Sequence
  Synthetic Polynucleotide
taatacgactcactatagggtcctcggagtttcccagacaccacaacctcaacagaggagagaggttatggtgtctgggaacctggcggcagcgcaaaagatg

SEQ ID NO: 196151 - DNA, 103 bp, Artificial Sequence
  Synthetic Polynucleotide
taatacgactcactatagggtagccctctgtcctcggagtttcccagacaaacagaggagatgtctgatgaactccgagaacctggcggcagcgcaaaagatg

SEQ ID NO: 196152 - DNA, 103 bp, Artificial Sequence
  Synthetic Polynucleotide
taatacgactcactatagggttcatggatttagccctctgtcctcggagtaacagaggagaactccgatgacagagggcaacctggcggcagcgcaaaagatg

SEQ ID NO: 196153 - DNA, 103 bp, Artificial Sequence
  Synthetic Polynucleotide
taatacgactcactatagggatccacaaacttcatggatttagccctctgaacagaggagacagaggatgaaatccatgaacctggcggcagcgcaaaagatg

SEQ ID NO: 196154 - DNA, 103 bp, Artificial Sequence
  Synthetic Polynucleotide
taatacgactcactatagggactcattcagttcagctttgaagatgccataacagaggagaatggcaatgtcaaagctgaacctggcggcagcgcaaaagatg

SEQ ID NO: 196155 - DNA, 103 bp, Artificial Sequence
  Synthetic Polynucleotide
taatacgactcactatagggtcatcaggccatccacaaacttcatggattaacagaggagaaatccaatgagtttgtggaacctggcggcagcgcaaaagatg

SEQ ID NO: 196156 - DNA, 103 bp, Artificial Sequence
  Synthetic Polynucleotide
taatacgactcactatagggccgctgtggatcatcaggccatccacaaacaacagaggagagtttgtatgtggcctgataacctggcggcagcgcaaaagatg

SEQ ID NO: 196157 - DNA, 103 bp, Artificial Sequence
  Synthetic Polynucleotide
taatacgactcactatagggaacagggtctccgctgtggatcatcaggccaacagaggagaggcctgatgatccacagcaacctggcggcagcgcaaaagatg

SEQ ID NO: 196158 - DNA, 103 bp, Artificial Sequence
  Synthetic Polynucleotide
taatacgactcactatagggcgtagtagttaacagggtctccgctgtggaaacagaggagatccacaatggagaccctgaacctggcggcagcgcaaaagatg

SEQ ID NO: 196159 - DNA, 103 bp, Artificial Sequence
  Synthetic Polynucleotide
taatacgactcactataggggcagtgtcaacgtagtagttaacagggtctaacagaggagaagacccatgtaactactaaacctggcggcagcgcaaaagatg

SEQ ID NO: 196160 - DNA, 103 bp, Artificial Sequence
  Synthetic Polynucleotide
taatacgactcactataggggtggcgcacagcagtgtcaacgtagtagttaacagaggagaaactacatggttgacactaacctggcggcagcgcaaaagatg

SEQ ID NO: 196161 - DNA, 103 bp, Artificial Sequence
  Synthetic Polynucleotide
taatacgactcactatagggtgagcaacacgtggcgcacagcagtgtcaaaacagaggagattgacaatgctgtgcgccaacctggcggcagcgcaaaagatg

SEQ ID NO: 196162 - DNA, 103 bp, Artificial Sequence
  Synthetic Polynucleotide
taatacgactcactatagggacaccctgtctgagcaacacgtggcgcacaaacagaggagatgtgcgatgcgtgttgctaacctggcggcagcgcaaaagatg

SEQ ID NO: 196163 - DNA, 103 bp, Artificial Sequence
  Synthetic Polynucleotide
taatacgactcactataggggatgcccagcacaccctgtctgagcaacacaacagaggagagtgttgatgagacagggtaacctggcggcagcgcaaaagatg

SEQ ID NO: 196164 - DNA, 103 bp, Artificial Sequence
  Synthetic Polynucleotide
taatacgactcactatagggtcttcaccttgatgcccagcacaccctgtcaacagaggagagacaggatgtgctgggcaaacctggcggcagcgcaaaagatg

SEQ ID NO: 196165 - DNA, 103 bp, Artificial Sequence
  Synthetic Polynucleotide
taatacgactcactatagggcgagtaagaaactcattcagttcagctttgaacagaggagacaaagcatgactgaatgaaacctggcggcagcgcaaaagatg

SEQ ID NO: 196166 - DNA, 103 bp, Artificial Sequence
  Synthetic Polynucleotide
taatacgactcactatagggggcagcatgatcttcaccttgatgcccagcaacagaggagagctgggatgcaaggtgaaaacctggcggcagcgcaaaagatg

SEQ ID NO: 196167 - DNA, 103 bp, Artificial Sequence
  Synthetic Polynucleotide
taatacgactcactatagggtgggtcccagggcagcatgatcttcaccttaacagaggagaaaggtgatgatcatgctgaacctggcggcagcgcaaaagatg

SEQ ID NO: 196168 - DNA, 103 bp, Artificial Sequence
  Synthetic Polynucleotide
taatacgactcactatagggtcttaccagttgggtcccagggcagcatgaaacagaggagatcatgcatgcctgggaccaacctggcggcagcgcaaaagatg

SEQ ID NO: 196169 - DNA, 103 bp, Artificial Sequence
  Synthetic Polynucleotide
taatacgactcactatagggttagggccaatcttaccagttgggtcccagaacagaggagactgggaatgaactggtaaaacctggcggcagcgcaaaagatg

SEQ ID NO: 196170 - DNA, 103 bp, Artificial Sequence
  Synthetic Polynucleotide
taatacgactcactatagggcaggggcttcttagggccaatcttaccagtaacagaggagaactggtatgattggccctaacctggcggcagcgcaaaagatg

SEQ ID NO: 196171 - DNA, 103 bp, Artificial Sequence
  Synthetic Polynucleotide
taatacgactcactatagggcgtggtcaggcaggggcttcttagggccaaaacagaggagattggccatgagaagccccaacctggcggcagcgcaaaagatg

SEQ ID NO: 196172 - DNA, 103 bp, Artificial Sequence
  Synthetic Polynucleotide
taatacgactcactatagggacaatgctcacgtggtcaggcaggggcttcaacagaggagagaagccatggcctgaccaaacctggcggcagcgcaaaagatg

SEQ ID NO: 196173 - DNA, 103 bp, Artificial Sequence
  Synthetic Polynucleotide
taatacgactcactatagggtttgggttccacaatgctcacgtggtcaggaacagaggagacctgacatggtgagcattaacctggcggcagcgcaaaagatg

SEQ ID NO: 196174 - DNA, 103 bp, Artificial Sequence
  Synthetic Polynucleotide
taatacgactcactataggggtatctcatctttgggttccacaatgctcaaacagaggagatgagcaatgtggaacccaaacctggcggcagcgcaaaagatg

SEQ ID NO: 196175 - DNA, 103 bp, Artificial Sequence
  Synthetic Polynucleotide
taatacgactcactataggggtggtgggcagtatctcatctttgggttccaacagaggagaggaaccatgagatgagataacctggcggcagcgcaaaagatg

SEQ ID NO: 196176 - DNA, 103 bp, Artificial Sequence
  Synthetic Polynucleotide
taatacgactcactatagggagccagctcccgagtaagaaactcattcagaacagaggagactgaatatgtttcttactaacctggcggcagcgcaaaagatg

SEQ ID NO: 196177 - DNA, 103 bp, Artificial Sequence
  Synthetic Polynucleotide
taatacgactcactatagggtgagatgggggtggtgggcagtatctcatcaacagaggagagatgagatgctgcccaccaacctggcggcagcgcaaaagatg

SEQ ID NO: 196178 - DNA, 103 bp, Artificial Sequence
  Synthetic Polynucleotide
taatacgactcactatagggccttctgttctgagatgggggtggtgggcaaacagaggagatgcccaatgcccccatctaacctggcggcagcgcaaaagatg

SEQ ID NO: 196179 - DNA, 103 bp, Artificial Sequence
  Synthetic Polynucleotide
taatacgactcactatagggggcttcccacccttctgttctgagatggggaacagaggagaccccatatgagaacagaaaacctggcggcagcgcaaaagatg

SEQ ID NO: 196180 - DNA, 103 bp, Artificial Sequence
  Synthetic Polynucleotide
taatacgactcactatagggaggcggctctggcttcccacccttctgttcaacagaggagagaacagatgggtgggaagaacctggcggcagcgcaaaagatg

SEQ ID NO: 196181 - DNA, 103 bp, Artificial Sequence
  Synthetic Polynucleotide
taatacgactcactatagggggggcatggcaggcggctctggcttcccacaacagaggagagtgggaatgcagagccgcaacctggcggcagcgcaaaagatg

SEQ ID NO: 196182 - DNA, 103 bp, Artificial Sequence
  Synthetic Polynucleotide
taatacgactcactataggggggactggctggggcatggcaggcggctctaacagaggagaagagccatgtgccatgccaacctggcggcagcgcaaaagatg

SEQ ID NO: 196183 - DNA, 103 bp, Artificial Sequence
  Synthetic Polynucleotide
taatacgactcactatagggttatgctgtggggactggctggggcatggcaacagaggagagccatgatgcagccagtcaacctggcggcagcgcaaaagatg

SEQ ID NO: 196184 - DNA, 103 bp, Artificial Sequence
  Synthetic Polynucleotide
taatacgactcactatagggagccatcttcagccagctcccgagtaagaaaacagaggagattcttaatggggagctggaacctggcggcagcgcaaaagatg

SEQ ID NO: 196185 - DNA, 103 bp, Artificial Sequence
  Synthetic Polynucleotide
taatacgactcactatagggactccagagtagccatcttcagccagctccaacagaggagaggagctatgtgaagatggaacctggcggcagcgcaaaagatg

SEQ ID NO: 196186 - DNA, 103 bp, Artificial Sequence
  Synthetic Polynucleotide
taatacgactcactatagggaagaggcgattgcagcatttcggactccataacagaggagaatggagatggaaatgctgaacctggcggcagcgcaaaagatg

SEQ ID NO: 196187 - DNA, 103 bp, Artificial Sequence
  Synthetic Polynucleotide
taatacgactcactatagggttcaattttctcacagtgcctctttttcataacagaggagaatgaaaatgaggcactgtaacctggcggcagcgcaaaagatg

SEQ ID NO: 196188 - DNA, 103 bp, Artificial Sequence
  Synthetic Polynucleotide
taatacgactcactataggggtcctgtctgaagagcttttggaagagatcaacagaggagagatctcatgcaaaagctcaacctggcggcagcgcaaaagatg

SEQ ID NO: 196189 - DNA, 103 bp, Artificial Sequence
  Synthetic Polynucleotide
taatacgactcactatagggccaccagcaagtcctgtctgaagagcttttaacagaggagaaaaagcatgtcagacaggaacctggcggcagcgcaaaagatg

SEQ ID NO: 196190 - DNA, 103 bp, Artificial Sequence
  Synthetic Polynucleotide
taatacgactcactatagggaacagactagccaccagcaagtcctgtctgaacagaggagacagacaatgcttgctggtaacctggcggcagcgcaaaagatg

SEQ ID NO: 196191 - DNA, 103 bp, Artificial Sequence
  Synthetic Polynucleotide
taatacgactcactatagggaaaatttcgaaacagactagccaccagcaaaacagaggagattgctgatggctagtctgaacctggcggcagcgcaaaagatg

SEQ ID NO: 196192 - DNA, 103 bp, Artificial Sequence
  Synthetic Polynucleotide
taatacgactcactatagggccgccaataaaaaatttcgaaacagactagaacagaggagactagtcatgttcgaaattaacctggcggcagcgcaaaagatg

SEQ ID NO: 196193 - DNA, 103 bp, Artificial Sequence
  Synthetic Polynucleotide
taatacgactcactatagggataatcctttccgccaataaaaaatttcgaaacagaggagatcgaaaatgtttattggcaacctggcggcagcgcaaaagatg

SEQ ID NO: 196194 - DNA, 103 bp, Artificial Sequence
  Synthetic Polynucleotide
taatacgactcactatagggatacgacctcataatcctttccgccaataaaacagaggagattattgatggaaaggattaacctggcggcagcgcaaaagatg

SEQ ID NO: 196195 - DNA, 103 bp, Artificial Sequence
  Synthetic Polynucleotide
taatacgactcactataggggagtgcagttatacgacctcataatcctttaacagaggagaaaaggaatgtgaggtcgtaacctggcggcagcgcaaaagatg

SEQ ID NO: 196196 - DNA, 103 bp, Artificial Sequence
  Synthetic Polynucleotide
taatacgactcactatagggctgctgacgggagtgcagttatacgacctcaacagaggagagaggtcatgtaactgcacaacctggcggcagcgcaaaagatg

SEQ ID NO: 196197 - DNA, 103 bp, Artificial Sequence
  Synthetic Polynucleotide
taatacgactcactatagggcagacgcgggctgctgacgggagtgcagttaacagaggagaaactgcatgcccgtcagcaacctggcggcagcgcaaaagatg

SEQ ID NO: 196198 - DNA, 103 bp, Artificial Sequence
  Synthetic Polynucleotide
taatacgactcactatagggatttggagccttcaattttctcacagtgccaacagaggagaggcactatgagaaaattgaacctggcggcagcgcaaaagatg

SEQ ID NO: 196199 - DNA, 103 bp, Artificial Sequence
  Synthetic Polynucleotide
taatacgactcactatagggacgtgggcggcagacgcgggctgctgacggaacagaggagaccgtcaatggcccgcgtcaacctggcggcagcgcaaaagatg

SEQ ID NO: 196200 - DNA, 103 bp, Artificial Sequence
  Synthetic Polynucleotide
taatacgactcactataggggcgtgcatgtacgtgggcggcagacgcgggaacagaggagacccgcgatggccgcccacaacctggcggcagcgcaaaagatg

SEQ ID NO: 196201 - DNA, 103 bp, Artificial Sequence
  Synthetic Polynucleotide
taatacgactcactatagggttgccacatggcgtgcatgtacgtgggcggaacagaggagaccgcccatgtacatgcacaacctggcggcagcgcaaaagatg

SEQ ID NO: 196202 - DNA, 103 bp, Artificial Sequence
  Synthetic Polynucleotide
taatacgactcactatagggggtcccaggcttgccacatggcgtgcatgtaacagaggagaacatgcatgccatgtggcaacctggcggcagcgcaaaagatg

SEQ ID NO: 196203 - DNA, 103 bp, Artificial Sequence
  Synthetic Polynucleotide
taatacgactcactatagggtcaacagccaggtcccaggcttgccacatgaacagaggagacatgtgatgagcctgggaaacctggcggcagcgcaaaagatg

SEQ ID NO: 196204 - DNA, 103 bp, Artificial Sequence
  Synthetic Polynucleotide
taatacgactcactatagggcagacagatgtcaacagccaggtcccaggcaacagaggagagcctggatgctggctgttaacctggcggcagcgcaaaagatg

SEQ ID NO: 196205 - DNA, 103 bp, Artificial Sequence
  Synthetic Polynucleotide
taatacgactcactataggggcagctgagacagacagatgtcaacagccaaacagaggagatggctgatgacatctgtcaacctggcggcagcgcaaaagatg

SEQ ID NO: 196206 - DNA, 103 bp, Artificial Sequence
  Synthetic Polynucleotide
taatacgactcactatagggatgatcgtcggcagctgagacagacagatgaacagaggagacatctgatggtctcagctaacctggcggcagcgcaaaagatg

SEQ ID NO: 196207 - DNA, 103 bp, Artificial Sequence
  Synthetic Polynucleotide
taatacgactcactataggggccttcctcgatgatcgtcggcagctgagaaacagaggagatctcagatgccgacgatcaacctggcggcagcgcaaaagatg

SEQ ID NO: 196208 - DNA, 103 bp, Artificial Sequence
  Synthetic Polynucleotide
taatacgactcactataggggaaacgcagtgccttcctcgatgatcgtcgaacagaggagacgacgaatgtcgaggaagaacctggcggcagcgcaaaagatg

SEQ ID NO: 196209 - DNA, 103 bp, Artificial Sequence
  Synthetic Polynucleotide
taatacgactcactatagggtgagctaaggatttggagccttcaattttcaacagaggagagaaaatatgaggctccaaaacctggcggcagcgcaaaagatg

SEQ ID NO: 196210 - DNA, 103 bp, Artificial Sequence
  Synthetic Polynucleotide
taatacgactcactataggggggctgtgccgaaacgcagtgccttcctcgaacagaggagacgaggaatgcactgcgttaacctggcggcagcgcaaaagatg

SEQ ID NO: 196211 - DNA, 103 bp, Artificial Sequence
  Synthetic Polynucleotide
taatacgactcactatagggggcgaagaacgggctgtgccgaaacgcagtaacagaggagaactgcgatgcggcacagcaacctggcggcagcgcaaaagatg

SEQ ID NO: 196212 - DNA, 103 bp, Artificial Sequence
  Synthetic Polynucleotide
taatacgactcactatagggtcagctgctcggcgaagaacgggctgtgccaacagaggagaggcacaatgcgttcttcgaacctggcggcagcgcaaaagatg

SEQ ID NO: 196213 - DNA, 103 bp, Artificial Sequence
  Synthetic Polynucleotide
taatacgactcactatagggtggaatgcggtcagctgctcggcgaagaacaacagaggagagttcttatgcgagcagctaacctggcggcagcgcaaaagatg

SEQ ID NO: 196214 - DNA, 103 bp, Artificial Sequence
  Synthetic Polynucleotide
taatacgactcactataggggagccacacctggaatgcggtcagctgctcaacagaggagagagcagatgaccgcattcaacctggcggcagcgcaaaagatg

SEQ ID NO: 196215 - DNA, 103 bp, Artificial Sequence
  Synthetic Polynucleotide
taatacgactcactatagggcgcccatggtgagccacacctggaatgcggaacagaggagaccgcatatgaggtgtggcaacctggcggcagcgcaaaagatg

SEQ ID NO: 196216 - DNA, 103 bp, Artificial Sequence
  Synthetic Polynucleotide
taatacgactcactatagggcggttctccacgcccatggtgagccacaccaacagaggagaggtgtgatgcaccatgggaacctggcggcagcgcaaaagatg

SEQ ID NO: 196217 - DNA, 103 bp, Artificial Sequence
  Synthetic Polynucleotide
taatacgactcactataggggggtgggtttcggttctccacgcccatggtaacagaggagaaccatgatggtggagaacaacctggcggcagcgcaaaagatg

SEQ ID NO: 196218 - DNA, 103 bp, Artificial Sequence
  Synthetic Polynucleotide
taatacgactcactataggggcagctgttcgggtgggtttcggttctccaaacagaggagatggagaatggaaacccacaacctggcggcagcgcaaaagatg

SEQ ID NO: 196219 - DNA, 103 bp, Artificial Sequence
  Synthetic Polynucleotide
taatacgactcactatagggaggacgatgggcagctgttcgggtgggtttaacagaggagaaaacccatgcgaacagctaacctggcggcagcgcaaaagatg

SEQ ID NO: 196220 - DNA, 103 bp, Artificial Sequence
  Synthetic Polynucleotide
taatacgactcactatagggcctccagctctgagctaaggatttggagccaacagaggagaggctccatgtccttagctaacctggcggcagcgcaaaagatg

SEQ ID NO: 196221 - DNA, 103 bp, Artificial Sequence
  Synthetic Polynucleotide
taatacgactcactatagggcagcacctgcaggacgatgggcagctgttcaacagaggagagaacagatgcccatcgtcaacctggcggcagcgcaaaagatg

SEQ ID NO: 196222 - DNA, 103 bp, Artificial Sequence
  Synthetic Polynucleotide
taatacgactcactatagggcttggcttaacagcacctgcaggacgatggaacagaggagaccatcgatgtgcaggtgcaacctggcggcagcgcaaaagatg

SEQ ID NO: 196223 - DNA, 103 bp, Artificial Sequence
  Synthetic Polynucleotide
taatacgactcactatagggagccggtgcacttggcttaacagcacctgcaacagaggagagcaggtatggttaagccaaacctggcggcagcgcaaaagatg

SEQ ID NO: 196224 - DNA, 103 bp, Artificial Sequence
  Synthetic Polynucleotide
taatacgactcactatagggcaatgctctcagccggtgcacttggcttaaaacagaggagattaagcatggtgcaccggaacctggcggcagcgcaaaagatg

SEQ ID NO: 196225 - DNA, 103 bp, Artificial Sequence
  Synthetic Polynucleotide
taatacgactcactatagggcaagcaagtccaatgctctcagccggtgcaaacagaggagatgcaccatgtgagagcataacctggcggcagcgcaaaagatg

SEQ ID NO: 196226 - DNA, 103 bp, Artificial Sequence
  Synthetic Polynucleotide
taatacgactcactatagggaaaaatcttccaagcaagtccaatgctctcaacagaggagagagagcatgggacttgctaacctggcggcagcgcaaaagatg

SEQ ID NO: 196227 - DNA, 103 bp, Artificial Sequence
  Synthetic Polynucleotide
taatacgactcactatagggacccaggtccaaaaatcttccaagcaagtcaacagaggagagacttgatgggaagatttaacctggcggcagcgcaaaagatg

SEQ ID NO: 196228 - DNA, 103 bp, Artificial Sequence
  Synthetic Polynucleotide
taatacgactcactatagggctgcccagggacccaggtccaaaaatcttcaacagaggagagaagatatgtggacctggaacctggcggcagcgcaaaagatg

SEQ ID NO: 196229 - DNA, 103 bp, Artificial Sequence
  Synthetic Polynucleotide
taatacgactcactataggggccaggctcactgcccagggacccaggtccaacagaggagaggacctatgtccctgggcaacctggcggcagcgcaaaagatg

SEQ ID NO: 196230 - DNA, 103 bp, Artificial Sequence
  Synthetic Polynucleotide
taatacgactcactataggggacagacaaggccaggctcactgcccagggaacagaggagaccctggatggtgagcctgaacctggcggcagcgcaaaagatg

SEQ ID NO: 196231 - DNA, 103 bp, Artificial Sequence
  Synthetic Polynucleotide
taatacgactcactataggggatccttcatcctccagctctgagctaaggaacagaggagaccttagatgagagctggaaacctggcggcagcgcaaaagatg

SEQ ID NO: 196232 - DNA, 103 bp, Artificial Sequence
  Synthetic Polynucleotide
taatacgactcactatagggggaagatgccgacagacaaggccaggctcaaacagaggagatgagccatgccttgtctgaacctggcggcagcgcaaaagatg

SEQ ID NO: 196233 - DNA, 103 bp, Artificial Sequence
  Synthetic Polynucleotide
taatacgactcactatagggagcacgtaggggaagatgccgacagacaagaacagaggagacttgtcatgcggcatcttaacctggcggcagcgcaaaagatg

SEQ ID NO: 196234 - DNA, 103 bp, Artificial Sequence
  Synthetic Polynucleotide
taatacgactcactataggggagcagcttcagcacgtaggggaagatgccaacagaggagaggcatcatgccctacgtgaacctggcggcagcgcaaaagatg

SEQ ID NO: 196235 - DNA, 103 bp, Artificial Sequence
  Synthetic Polynucleotide
taatacgactcactatagggccgagctctggagcagcttcagcacgtaggaacagaggagacctacgatgtgaagctgcaacctggcggcagcgcaaaagatg

SEQ ID NO: 196236 - DNA, 103 bp, Artificial Sequence
  Synthetic Polynucleotide
taatacgactcactatagggagctctcgggccgagctctggagcagcttcaacagaggagagaagctatgccagagctcaacctggcggcagcgcaaaagatg

SEQ ID NO: 196237 - DNA, 103 bp, Artificial Sequence
  Synthetic Polynucleotide
taatacgactcactatagggaagtggccgcagctctcgggccgagctctgaacagaggagacagagcatggcccgagagaacctggcggcagcgcaaaagatg

SEQ ID NO: 196238 - DNA, 103 bp, Artificial Sequence
  Synthetic Polynucleotide
taatacgactcactatagggtgaaaacgagaagtggccgcagctctcgggaacagaggagacccgagatgtgcggccacaacctggcggcagcgcaaaagatg

SEQ ID NO: 196239 - DNA, 103 bp, Artificial Sequence
  Synthetic Polynucleotide
taatacgactcactatagggttggcccagatgaaaacgagaagtggccgcaacagaggagagcggccatgtctcgttttaacctggcggcagcgcaaaagatg

SEQ ID NO: 196240 - DNA, 103 bp, Artificial Sequence
  Synthetic Polynucleotide
taatacgactcactatagggtgcgaggatcttggcccagatgaaaacgagaacagaggagactcgttatgatctgggccaacctggcggcagcgcaaaagatg

SEQ ID NO: 196241 - DNA, 103 bp, Artificial Sequence
  Synthetic Polynucleotide
taatacgactcactatagggagctgtccactgcgaggatcttggcccagaaacagaggagatctgggatgagatcctcgaacctggcggcagcgcaaaagatg

SEQ ID NO: 196242 - DNA, 103 bp, Artificial Sequence
  Synthetic Polynucleotide
taatacgactcactataggggtcttcatccgatccttcatcctccagctcaacagaggagagagctgatggatgaaggaaacctggcggcagcgcaaaagatg

SEQ ID NO: 196243 - DNA, 103 bp, Artificial Sequence
  Synthetic Polynucleotide
taatacgactcactataggggcttggcacgagctgtccactgcgaggatcaacagaggagagatcctatgagtggacagaacctggcggcagcgcaaaagatg

SEQ ID NO: 196244 - DNA, 103 bp, Artificial Sequence
  Synthetic Polynucleotide
taatacgactcactatagggcacgaggtccgcttggcacgagctgtccacaacagaggagagtggacatgtcgtgccaaaacctggcggcagcgcaaaagatg

SEQ ID NO: 196245 - DNA, 103 bp, Artificial Sequence
  Synthetic Polynucleotide
taatacgactcactatagggcgttgtccttcacgaggtccgcttggcacgaacagaggagacgtgccatgcggacctcgaacctggcggcagcgcaaaagatg

SEQ ID NO: 196246 - DNA, 103 bp, Artificial Sequence
  Synthetic Polynucleotide
taatacgactcactatagggtacttgtggccgttgtccttcacgaggtccaacagaggagaggacctatggaaggacaaaacctggcggcagcgcaaaagatg

SEQ ID NO: 196247 - DNA, 103 bp, Artificial Sequence
  Synthetic Polynucleotide
taatacgactcactatagggcgacaggaagtacttgtggccgttgtccttaacagaggagaaaggacatgggccacaagaacctggcggcagcgcaaaagatg

SEQ ID NO: 196248 - DNA, 103 bp, Artificial Sequence
  Synthetic Polynucleotide
taatacgactcactatagggccgccaggaccgacaggaagtacttgtggcaacagaggagagccacaatgacttcctgtaacctggcggcagcgcaaaagatg

SEQ ID NO: 196249 - DNA, 103 bp, Artificial Sequence
  Synthetic Polynucleotide
taatacgactcactatagggatgtaggggtccgccaggaccgacaggaagaacagaggagacttcctatgggtcctggcaacctggcggcagcgcaaaagatg

SEQ ID NO: 196250 - DNA, 103 bp, Artificial Sequence
  Synthetic Polynucleotide
taatacgactcactatagggttcagctggcatgtaggggtccgccaggacaacagaggagagtcctgatggacccctacaacctggcggcagcgcaaaagatg

SEQ ID NO: 196251 - DNA, 103 bp, Artificial Sequence
  Synthetic Polynucleotide
taatacgactcactatagggtggtccggtgttcagctggcatgtaggggtaacagaggagaacccctatgtgccagctgaacctggcggcagcgcaaaagatg

SEQ ID NO: 196252 - DNA, 103 bp, Artificial Sequence
  Synthetic Polynucleotide
taatacgactcactatagggaaagccgtcatggtccggtgttcagctggcaacagaggagagccagcatgacaccggacaacctggcggcagcgcaaaagatg

SEQ ID NO: 196253 - DNA, 103 bp, Artificial Sequence
  Synthetic Polynucleotide
taatacgactcactatagggaacactgactgtcttcatccgatccttcataacagaggagaatgaagatgcggatgaagaacctggcggcagcgcaaaagatg

SEQ ID NO: 196254 - DNA, 103 bp, Artificial Sequence
  Synthetic Polynucleotide
taatacgactcactatagggggcgagaatgaaagccgtcatggtccggtgaacagaggagacaccggatgatgacggctaacctggcggcagcgcaaaagatg

SEQ ID NO: 196255 - DNA, 103 bp, Artificial Sequence
  Synthetic Polynucleotide
taatacgactcactatagggtgacgatcacggcgagaatgaaagccgtcaaacagaggagatgacggatgtcattctcgaacctggcggcagcgcaaaagatg

SEQ ID NO: 196256 - DNA, 103 bp, Artificial Sequence
  Synthetic Polynucleotide
taatacgactcactatagggtgatagctgttgacgatcacggcgagaatgaacagaggagacattctatgcgtgatcgtaacctggcggcagcgcaaaagatg

SEQ ID NO: 196257 - DNA, 103 bp, Artificial Sequence
  Synthetic Polynucleotide
taatacgactcactatagggctgccccgtgtgatagctgttgacgatcacaacagaggagagtgatcatgaacagctataacctggcggcagcgcaaaagatg

SEQ ID NO: 196258 - DNA, 103 bp, Artificial Sequence
  Synthetic Polynucleotide
taatacgactcactatagggggcaggcttcctgccccgtgtgatagctgtaacagaggagaacagctatgacacggggcaacctggcggcagcgcaaaagatg

SEQ ID NO: 196259 - DNA, 103 bp, Artificial Sequence
  Synthetic Polynucleotide
taatacgactcactatagggtttccctgaaggcaggcttcctgccccgtgaacagaggagacacgggatgggaagcctgaacctggcggcagcgcaaaagatg

SEQ ID NO: 196260 - DNA, 103 bp, Artificial Sequence
  Synthetic Polynucleotide
taatacgactcactatagggggcaatgaggtttccctgaaggcaggcttcaacagaggagagaagccatgcttcagggaaacctggcggcagcgcaaaagatg

SEQ ID NO: 196261 - DNA, 103 bp, Artificial Sequence
  Synthetic Polynucleotide
taatacgactcactatagggccaggcagatggcaatgaggtttccctgaaaacagaggagattcaggatgacctcattgaacctggcggcagcgcaaaagatg

SEQ ID NO: 196262 - DNA, 103 bp, Artificial Sequence
  Synthetic Polynucleotide
taatacgactcactatagggttgagctgctccaggcagatggcaatgaggaacagaggagacctcatatgcatctgcctaacctggcggcagcgcaaaagatg

SEQ ID NO: 196263 - DNA, 103 bp, Artificial Sequence
  Synthetic Polynucleotide
taatacgactcactataggggtgcgggtcgttgagctgctccaggcagataacagaggagaatctgcatggagcagctcaacctggcggcagcgcaaaagatg

SEQ ID NO: 196264 - DNA, 103 bp, Artificial Sequence
  Synthetic Polynucleotide
taatacgactcactatagggaaactaaggcaacactgactgtcttcatccaacagaggagaggatgaatgcagtcagtgaacctggcggcagcgcaaaagatg

SEQ ID NO: 196265 - DNA, 103 bp, Artificial Sequence
  Synthetic Polynucleotide
taatacgactcactataggggcagcaaggggtgcgggtcgttgagctgctaacagaggagaagcagcatgacgacccgcaacctggcggcagcgcaaaagatg

SEQ ID NO: 196266 - DNA, 103 bp, Artificial Sequence
  Synthetic Polynucleotide
taatacgactcactatagggacccactggcgcagcaaggggtgcgggtcgaacagaggagacgacccatgccccttgctaacctggcggcagcgcaaaagatg

SEQ ID NO: 196267 - DNA, 103 bp, Artificial Sequence
  Synthetic Polynucleotide
taatacgactcactataggggcagatggccacccactggcgcagcaagggaacagaggagacccttgatgcgccagtggaacctggcggcagcgcaaaagatg

SEQ ID NO: 196268 - DNA, 103 bp, Artificial Sequence
  Synthetic Polynucleotide
taatacgactcactatagggtcctgccgaggcagatggccacccactggcaacagaggagagccagtatgtggccatctaacctggcggcagcgcaaaagatg

SEQ ID NO: 196269 - DNA, 103 bp, Artificial Sequence
  Synthetic Polynucleotide
taatacgactcactatagggttctgccagatcctgccgaggcagatggccaacagaggagaggccatatgcctcggcagaacctggcggcagcgcaaaagatg

SEQ ID NO: 196270 - DNA, 103 bp, Artificial Sequence
  Synthetic Polynucleotide
taatacgactcactatagggcgagtcgaagttctgccagatcctgccgagaacagaggagactcggcatgatctggcagaacctggcggcagcgcaaaagatg

SEQ ID NO: 196271 - DNA, 103 bp, Artificial Sequence
  Synthetic Polynucleotide
taatacgactcactatagggaccacctcgccgagtcgaagttctgccagaaacagaggagatctggcatgacttcgactaacctggcggcagcgcaaaagatg

SEQ ID NO: 196272 - DNA, 103 bp, Artificial Sequence
  Synthetic Polynucleotide
taatacgactcactatagggctcacgccgcaccacctcgccgagtcgaagaacagaggagacttcgaatgggcgaggtgaacctggcggcagcgcaaaagatg

SEQ ID NO: 196273 - DNA, 103 bp, Artificial Sequence
  Synthetic Polynucleotide
taatacgactcactatagggagcgctgtccctcacgccgcaccacctcgcaacagaggagagcgaggatgtgcggcgtgaacctggcggcagcgcaaaagatg

SEQ ID NO: 196274 - DNA, 103 bp, Artificial Sequence
  Synthetic Polynucleotide
taatacgactcactataggggcttctcatgagcgctgtccctcacgccgcaacagaggagagcggcgatggggacagcgaacctggcggcagcgcaaaagatg

SEQ ID NO: 196275 - DNA, 103 bp, Artificial Sequence
  Synthetic Polynucleotide
taatacgactcactatagggttcaggcacaaaactaaggcaacactgactaacagaggagaagtcagatgtgccttagtaacctggcggcagcgcaaaagatg

SEQ ID NO: 196276 - DNA, 103 bp, Artificial Sequence
  Synthetic Polynucleotide
taatacgactcactatagggaggctgtagagcttctcatgagcgctgtccaacagaggagaggacagatgtcatgagaaaacctggcggcagcgcaaaagatg

SEQ ID NO: 196277 - DNA, 103 bp, Artificial Sequence
  Synthetic Polynucleotide
taatacgactcactataggggtcggagaggaggctgtagagcttctcatgaacagaggagacatgagatgctctacagcaacctggcggcagcgcaaaagatg

SEQ ID NO: 196278 - DNA, 103 bp, Artificial Sequence
  Synthetic Polynucleotide
taatacgactcactatagggcgggaatggggtcggagaggaggctgtagaaacagaggagatctacaatgtcctctccgaacctggcggcagcgcaaaagatg

SEQ ID NO: 196279 - DNA, 103 bp, Artificial Sequence
  Synthetic Polynucleotide
taatacgactcactatagggcagcggacctcgggaatggggtcggagaggaacagaggagacctctcatgccccattccaacctggcggcagcgcaaaagatg

SEQ ID NO: 196280 - DNA, 103 bp, Artificial Sequence
  Synthetic Polynucleotide
taatacgactcactataggggaccgctgcgcagcggacctcgggaatgggaacagaggagacccattatggaggtccgcaacctggcggcagcgcaaaagatg

SEQ ID NO: 196281 - DNA, 103 bp, Artificial Sequence
  Synthetic Polynucleotide
taatacgactcactatagggcaagggcgaagaccgctgcgcagcggacctaacagaggagaaggtccatggcgcagcggaacctggcggcagcgcaaaagatg

SEQ ID NO: 196282 - DNA, 103 bp, Artificial Sequence
  Synthetic Polynucleotide
taatacgactcactatagggacgaacgtgccaagggcgaagaccgctgcgaacagaggagacgcagcatgcttcgccctaacctggcggcagcgcaaaagatg

SEQ ID NO: 196283 - DNA, 103 bp, Artificial Sequence
  Synthetic Polynucleotide
taatacgactcactatagggagagttgcccacgaacgtgccaagggcgaaaacagaggagattcgccatgggcacgttcaacctggcggcagcgcaaaagatg

SEQ ID NO: 196284 - DNA, 103 bp, Artificial Sequence
  Synthetic Polynucleotide
taatacgactcactatagggtcctctctgcagagttgcccacgaacgtgcaacagaggagagcacgtatgtgggcaactaacctggcggcagcgcaaaagatg

SEQ ID NO: 196285 - DNA, 103 bp, Artificial Sequence
  Synthetic Polynucleotide
taatacgactcactataggggagtggtccgtcctctctgcagagttgcccaacagaggagagggcaaatgtgcagagagaacctggcggcagcgcaaaagatg

SEQ ID NO: 196286 - DNA, 103 bp, Artificial Sequence
  Synthetic Polynucleotide
taatacgactcactatagggcacaccaacattcaggcacaaaactaaggcaacagaggagagccttaatgttgtgcctgaacctggcggcagcgcaaaagatg

SEQ ID NO: 196287 - DNA, 103 bp, Artificial Sequence
  Synthetic Polynucleotide
taatacgactcactataggggatggtggtggagtggtccgtcctctctgcaacagaggagagcagagatgacggaccacaacctggcggcagcgcaaaagatg

SEQ ID NO: 196288 - DNA, 103 bp, Artificial Sequence
  Synthetic Polynucleotide
taatacgactcactatagggcgttgtggtcgatggtggtggagtggtccgaacagaggagacggaccatgccaccaccaaacctggcggcagcgcaaaagatg

SEQ ID NO: 196289 - DNA, 103 bp, Artificial Sequence
  Synthetic Polynucleotide
taatacgactcactatagggatcatggccacgttgtggtcgatggtggtgaacagaggagacaccacatgcgaccacaaaacctggcggcagcgcaaaagatg

SEQ ID NO: 196290 - DNA, 103 bp, Artificial Sequence
  Synthetic Polynucleotide
taatacgactcactatagggctgggccagcatcatggccacgttgtggtcaacagaggagagaccacatggtggccatgaacctggcggcagcgcaaaagatg

SEQ ID NO: 196291 - DNA, 103 bp, Artificial Sequence
  Synthetic Polynucleotide
taatacgactcactatagggcgctgaccagctgggccagcatcatggccaaacagaggagatggccaatgtgctggcccaacctggcggcagcgcaaaagatg

SEQ ID NO: 196292 - DNA, 103 bp, Artificial Sequence
  Synthetic Polynucleotide
taatacgactcactataggggggctcccgtcgctgaccagctgggccagcaacagaggagagctggcatggctggtcagaacctggcggcagcgcaaaagatg

SEQ ID NO: 196293 - DNA, 103 bp, Artificial Sequence
  Synthetic Polynucleotide
taatacgactcactatagggccggaccatggggctcccgtcgctgaccagaacagaggagactggtcatggacgggagcaacctggcggcagcgcaaaagatg

SEQ ID NO: 196294 - DNA, 103 bp, Artificial Sequence
  Synthetic Polynucleotide
taatacgactcactatagggccagctccttccggaccatggggctcccgtaacagaggagaacgggaatgccatggtccaacctggcggcagcgcaaaagatg

SEQ ID NO: 196295 - DNA, 103 bp, Artificial Sequence
  Synthetic Polynucleotide
taatacgactcactatagggagagccaccaccagctccttccggaccatgaacagaggagacatggtatggaaggagctaacctggcggcagcgcaaaagatg

SEQ ID NO: 196296 - DNA, 103 bp, Artificial Sequence
  Synthetic Polynucleotide
taatacgactcactatagggaagatgactcagagccaccaccagctccttaacagaggagaaaggagatggtggtggctaacctggcggcagcgcaaaagatg

SEQ ID NO: 196297 - DNA, 103 bp, Artificial Sequence
  Synthetic Polynucleotide
taatacgactcactatagggccaggcccagaagaggcgattgcagcatttaacagaggagaaaatgcatgaatcgcctcaacctggcggcagcgcaaaagatg

SEQ ID NO: 196298 - DNA, 103 bp, Artificial Sequence
  Synthetic Polynucleotide
taatacgactcactatagggcgggagggtccacaccaacattcaggcacaaacagaggagatgtgccatgatgttggtgaacctggcggcagcgcaaaagatg

SEQ ID NO: 196299 - DNA, 103 bp, Artificial Sequence
  Synthetic Polynucleotide
taatacgactcactatagggactgaaccacaagatgactcagagccaccaaacagaggagatggtggatgtgagtcatcaacctggcggcagcgcaaaagatg

SEQ ID NO: 196300 - DNA, 103 bp, Artificial Sequence
  Synthetic Polynucleotide
taatacgactcactatagggttgctttcatactgaaccacaagatgactcaacagaggagagagtcaatgtgtggttcaaacctggcggcagcgcaaaagatg

SEQ ID NO: 196301 - DNA, 103 bp, Artificial Sequence
  Synthetic Polynucleotide
taatacgactcactatagggggtgcagaaattgctttcatactgaaccacaacagaggagagtggttatgtatgaaagcaacctggcggcagcgcaaaagatg

SEQ ID NO: 196302 - DNA, 103 bp, Artificial Sequence
  Synthetic Polynucleotide
taatacgactcactataggggcagggccacggtgcagaaattgctttcataacagaggagaatgaaaatgatttctgcaaacctggcggcagcgcaaaagatg

SEQ ID NO: 196303 - DNA, 103 bp, Artificial Sequence
  Synthetic Polynucleotide
taatacgactcactatagggtctatgaactgcagggccacggtgcagaaaaacagaggagatttctgatgcgtggccctaacctggcggcagcgcaaaagatg

SEQ ID NO: 196304 - DNA, 103 bp, Artificial Sequence
  Synthetic Polynucleotide
taatacgactcactatagggcttttcctcttctatgaactgcagggccacaacagaggagagtggccatgcagttcataaacctggcggcagcgcaaaagatg

SEQ ID NO: 196305 - DNA, 103 bp, Artificial Sequence
  Synthetic Polynucleotide
taatacgactcactatagggaggcgtagttcttttcctcttctatgaactaacagaggagaagttcaatgaagaggaaaaacctggcggcagcgcaaaagatg

SEQ ID NO: 196306 - DNA, 103 bp, Artificial Sequence
  Synthetic Polynucleotide
taatacgactcactatagggggagaaggcaaggcgtagttcttttcctctaacagaggagaagaggaatggaactacgcaacctggcggcagcgcaaaagatg

SEQ ID NO: 196307 - DNA, 103 bp, Artificial Sequence
  Synthetic Polynucleotide
taatacgactcactatagggtgtggttgctggagaaggcaaggcgtagttaacagaggagaaactacatgttgccttctaacctggcggcagcgcaaaagatg

SEQ ID NO: 196308 - DNA, 103 bp, Artificial Sequence
  Synthetic Polynucleotide
taatacgactcactatagggtccctccctctgtggttgctggagaaggcaaacagaggagatgccttatgcagcaaccaaacctggcggcagcgcaaaagatg

SEQ ID NO: 196309 - DNA, 103 bp, Artificial Sequence
  Synthetic Polynucleotide
taatacgactcactatagggttcaccacatcgggagggtccacaccaacaaacagaggagatgttggatgggaccctccaacctggcggcagcgcaaaagatg

SEQ ID NO: 196310 - DNA, 103 bp, Artificial Sequence
  Synthetic Polynucleotide
taatacgactcactatagggggggtcaaactccctccctctgtggttgctaacagaggagaagcaacatgagagggaggaacctggcggcagcgcaaaagatg

SEQ ID NO: 196311 - DNA, 103 bp, Artificial Sequence
  Synthetic Polynucleotide
taatacgactcactataggggtctcgcactggggtcaaactccctccctcaacagaggagagagggaatgagtttgaccaacctggcggcagcgcaaaagatg

SEQ ID NO: 196312 - DNA, 103 bp, Artificial Sequence
  Synthetic Polynucleotide
taatacgactcactatagggtgcacgggctgtctcgcactggggtcaaacaacagaggagagtttgaatgcagtgcgagaacctggcggcagcgcaaaagatg

SEQ ID NO: 196313 - DNA, 103 bp, Artificial Sequence
  Synthetic Polynucleotide
taatacgactcactatagggagtctgggggtgcacgggctgtctcgcactaacagaggagaagtgcgatgcagcccgtgaacctggcggcagcgcaaaagatg

SEQ ID NO: 196314 - DNA, 103 bp, Artificial Sequence
  Synthetic Polynucleotide
taatacgactcactatagggcacagaacgaagtctgggggtgcacgggctaacagaggagaagcccgatgacccccagaaacctggcggcagcgcaaaagatg

SEQ ID NO: 196315 - DNA, 103 bp, Artificial Sequence
  Synthetic Polynucleotide
taatacgactcactatagggcataggagctcacagaacgaagtctgggggaacagaggagacccccaatgttcgttctgaacctggcggcagcgcaaaagatg

SEQ ID NO: 196316 - DNA, 103 bp, Artificial Sequence
  Synthetic Polynucleotide
taatacgactcactatagggcggatgtttccataggagctcacagaacgaaacagaggagatcgttcatggagctcctaaacctggcggcagcgcaaaagatg

SEQ ID NO: 196317 - DNA, 103 bp, Artificial Sequence
  Synthetic Polynucleotide
taatacgactcactatagggggcgacagcacggatgtttccataggagctaacagaggagaagctccatgggaaacatcaacctggcggcagcgcaaaagatg

SEQ ID NO: 196318 - DNA, 103 bp, Artificial Sequence
  Synthetic Polynucleotide
taatacgactcactatagggtcctggctgtggcgacagcacggatgtttcaacagaggagagaaacaatggtgctgtcgaacctggcggcagcgcaaaagatg

SEQ ID NO: 196319 - DNA, 103 bp, Artificial Sequence
  Synthetic Polynucleotide
taatacgactcactatagggttgttgaggctcctggctgtggcgacagcaaacagaggagatgctgtatgcacagccagaacctggcggcagcgcaaaagatg

SEQ ID NO: 196320 - DNA, 103 bp, Artificial Sequence
  Synthetic Polynucleotide
taatacgactcactataggggggcgtggtcttcaccacatcgggagggtcaacagaggagagaccctatggatgtggtgaacctggcggcagcgcaaaagatg

SEQ ID NO: 196321 - DNA, 103 bp, Artificial Sequence
  Synthetic Polynucleotide
taatacgactcactatagggctgcaaagatttgttgaggctcctggctgtaacagaggagaacagccatgagcctcaacaacctggcggcagcgcaaaagatg

SEQ ID NO: 196322 - DNA, 103 bp, Artificial Sequence
  Synthetic Polynucleotide
taatacgactcactatagggaactcaggttctgcaaagatttgttgaggcaacagaggagagcctcaatgaatctttgcaacctggcggcagcgcaaaagatg

SEQ ID NO: 196323 - DNA, 103 bp, Artificial Sequence
  Synthetic Polynucleotide
taatacgactcactatagggtcctctgtcaaactcaggttctgcaaagataacagaggagaatctttatggaacctgagaacctggcggcagcgcaaaagatg

SEQ ID NO: 196324 - DNA, 103 bp, Artificial Sequence
  Synthetic Polynucleotide
taatacgactcactataggggccaccagattcctctgtcaaactcaggttaacagaggagaaacctgatgttgacagagaacctggcggcagcgcaaaagatg

SEQ ID NO: 196325 - DNA, 103 bp, Artificial Sequence
  Synthetic Polynucleotide
taatacgactcactatagggacgccaccgcgccaccagattcctctgtcaaacagaggagatgacagatgaatctggtgaacctggcggcagcgcaaaagatg

SEQ ID NO: 196326 - DNA, 103 bp, Artificial Sequence
  Synthetic Polynucleotide
taatacgactcactatagggccgggggagaacgccaccgcgccaccagataacagaggagaatctggatgcgcggtggcaacctggcggcagcgcaaaagatg

SEQ ID NO: 196327 - DNA, 103 bp, Artificial Sequence
  Synthetic Polynucleotide
taatacgactcactataggggctgaggtttccgggggagaacgccaccgcaacagaggagagcggtgatgttctcccccaacctggcggcagcgcaaaagatg

SEQ ID NO: 196328 - DNA, 103 bp, Artificial Sequence
  Synthetic Polynucleotide
taatacgactcactatagggtgctgctggtgctgaggtttccgggggagaaacagaggagatctcccatggaaacctcaaacctggcggcagcgcaaaagatg

SEQ ID NO: 196329 - DNA, 103 bp, Artificial Sequence
  Synthetic Polynucleotide
taatacgactcactatagggctgctggcgctgctgctggtgctgaggtttaacagaggagaaaacctatgcaccagcagaacctggcggcagcgcaaaagatg

SEQ ID NO: 196330 - DNA, 103 bp, Artificial Sequence
  Synthetic Polynucleotide
taatacgactcactataggggcccagggtgctgctggcgctgctgctggtaacagaggagaaccagcatgagcgccagcaacctggcggcagcgcaaaagatg

SEQ ID NO: 196331 - DNA, 103 bp, Artificial Sequence
  Synthetic Polynucleotide
taatacgactcactatagggagcgtgcacagggcgtggtcttcaccacataacagaggagaatgtggatgagaccacgcaacctggcggcagcgcaaaagatg

SEQ ID NO: 196332 - DNA, 103 bp, Artificial Sequence
  Synthetic Polynucleotide
taatacgactcactatagggtctcggggctgcccagggtgctgctggcgcaacagaggagagcgccaatggcaccctggaacctggcggcagcgcaaaagatg

SEQ ID NO: 196333 - DNA, 103 bp, Artificial Sequence
  Synthetic Polynucleotide
taatacgactcactatagggtgctcctcattctcggggctgcccagggtgaacagaggagacaccctatgcagccccgaaacctggcggcagcgcaaaagatg

SEQ ID NO: 196334 - DNA, 103 bp, Artificial Sequence
  Synthetic Polynucleotide
taatacgactcactatagggggacaggatatgctcctcattctcggggctaacagaggagaagccccatgaatgaggagaacctggcggcagcgcaaaagatg

SEQ ID NO: 196335 - DNA, 103 bp, Artificial Sequence
  Synthetic Polynucleotide
taatacgactcactatagggtggtctcgaaggacaggatatgctcctcataacagaggagaatgaggatgatatcctgtaacctggcggcagcgcaaaagatg

SEQ ID NO: 196336 - DNA, 103 bp, Artificial Sequence
  Synthetic Polynucleotide
taatacgactcactatagggatcttgtcgatggtctcgaaggacaggataaacagaggagatatcctatgcttcgagacaacctggcggcagcgcaaaagatg

SEQ ID NO: 196337 - DNA, 103 bp, Artificial Sequence
  Synthetic Polynucleotide
taatacgactcactatagggggcgcggcgcatcttgtcgatggtctcgaaaacagaggagattcgagatgatcgacaagaacctggcggcagcgcaaaagatg

SEQ ID NO: 196338 - DNA, 103 bp, Artificial Sequence
  Synthetic Polynucleotide
taatacgactcactatagggagtaggagctggcgcggcgcatcttgtcgaaacagaggagatcgacaatgtgcgccgcgaacctggcggcagcgcaaaagatg

SEQ ID NO: 196339 - DNA, 103 bp, Artificial Sequence
  Synthetic Polynucleotide
taatacgactcactatagggttgagggaggagtaggagctggcgcggcgcaacagaggagagcgccgatgcagctcctaaacctggcggcagcgcaaaagatg

SEQ ID NO: 196340 - DNA, 103 bp, Artificial Sequence
  Synthetic Polynucleotide
taatacgactcactataggggatgagggagttgagggaggagtaggagctaacagaggagaagctccatgtcctccctcaacctggcggcagcgcaaaagatg

SEQ ID NO: 196341 - DNA, 103 bp, Artificial Sequence
  Synthetic Polynucleotide
taatacgactcactatagggaggaaactccgatgagggagttgagggaggaacagaggagacctcccatgactccctcaaacctggcggcagcgcaaaagatg

SEQ ID NO: 196342 - DNA, 103 bp, Artificial Sequence
  Synthetic Polynucleotide
taatacgactcactatagggcagcattccaagcgtgcacagggcgtggtcaacagaggagagaccacatgctgtgcacgaacctggcggcagcgcaaaagatg

SEQ ID NO: 196343 - DNA, 103 bp, Artificial Sequence
  Synthetic Polynucleotide
taatacgactcactatagggacactgttaaaggaaactccgatgagggagaacagaggagactccctatgcggagtttcaacctggcggcagcgcaaaagatg

SEQ ID NO: 196344 - DNA, 103 bp, Artificial Sequence
  Synthetic Polynucleotide
taatacgactcactatagggctgagtgtaaacactgttaaaggaaactccaacagaggagaggagttatgtttaacagtaacctggcggcagcgcaaaagatg

SEQ ID NO: 196345 - DNA, 103 bp, Artificial Sequence
  Synthetic Polynucleotide
taatacgactcactatagggctctccaaatctgagtgtaaacactgttaaaacagaggagattaacaatgtttacactcaacctggcggcagcgcaaaagatg

SEQ ID NO: 196346 - DNA, 103 bp, Artificial Sequence
  Synthetic Polynucleotide
taatacgactcactatagggtgcagcaggactctccaaatctgagtgtaaaacagaggagattacacatggatttggagaacctggcggcagcgcaaaagatg

SEQ ID NO: 196347 - DNA, 103 bp, Artificial Sequence
  Synthetic Polynucleotide
taatacgactcactatagggagcagccaggtgcagcaggactctccaaataacagaggagaatttggatggtcctgctgaacctggcggcagcgcaaaagatg

SEQ ID NO: 196348 - DNA, 103 bp, Artificial Sequence
  Synthetic Polynucleotide
taatacgactcactataggggataggggtcagcagccaggtgcagcaggaaacagaggagatcctgcatgacctggctgaacctggcggcagcgcaaaagatg

SEQ ID NO: 196349 - DNA, 103 bp, Artificial Sequence
  Synthetic Polynucleotide
taatacgactcactataggggagacctctggataggggtcagcagccaggaacagaggagacctggcatgtgacccctaaacctggcggcagcgcaaaagatg

SEQ ID NO: 196350 - DNA, 103 bp, Artificial Sequence
  Synthetic Polynucleotide
taatacgactcactatagggggccacgtccgagacctctggataggggtcaacagaggagagaccccatgccagaggtcaacctggcggcagcgcaaaagatg

SEQ ID NO: 196351 - DNA, 103 bp, Artificial Sequence
  Synthetic Polynucleotide
taatacgactcactataggggtactttcatggccacgtccgagacctctgaacagaggagacagaggatgcggacgtggaacctggcggcagcgcaaaagatg

SEQ ID NO: 196352 - DNA, 103 bp, Artificial Sequence
  Synthetic Polynucleotide
taatacgactcactatagggatgctgttgagtactttcatggccacgtccaacagaggagaggacgtatgcatgaaagtaacctggcggcagcgcaaaagatg

SEQ ID NO: 196353 - DNA, 103 bp, Artificial Sequence
  Synthetic Polynucleotide
taatacgactcactatagggaggatcgatccagcattccaagcgtgcacaaacagaggagatgtgcaatgttggaatgcaacctggcggcagcgcaaaagatg

SEQ ID NO: 196354 - DNA, 103 bp, Artificial Sequence
  Synthetic Polynucleotide
taatacgactcactatagggcttgtaggcgatgctgttgagtactttcataacagaggagaatgaaaatgctcaacagcaacctggcggcagcgcaaaagatg

SEQ ID NO: 196355 - DNA, 103 bp, Artificial Sequence
  Synthetic Polynucleotide
taatacgactcactatagggtcacggtggccttgtaggcgatgctgttgaaacagaggagatcaacaatgtcgcctacaaacctggcggcagcgcaaaagatg

SEQ ID NO: 196356 - DNA, 103 bp, Artificial Sequence
  Synthetic Polynucleotide
taatacgactcactatagggggccgggcgttcacggtggccttgtaggcgaacagaggagacgcctaatgggccaccgtaacctggcggcagcgcaaaagatg

SEQ ID NO: 196357 - DNA, 103 bp, Artificial Sequence
  Synthetic Polynucleotide
taatacgactcactataggggacgcgctgcggccgggcgttcacggtggcaacagaggagagccaccatgaacgcccggaacctggcggcagcgcaaaagatg

SEQ ID NO: 196358 - DNA, 103 bp, Artificial Sequence
  Synthetic Polynucleotide
taatacgactcactatagggaggtgtccaggacgcgctgcggccgggcgtaacagaggagaacgcccatgcgcagcgcgaacctggcggcagcgcaaaagatg

SEQ ID NO: 196359 - DNA, 103 bp, Artificial Sequence
  Synthetic Polynucleotide
taatacgactcactataggggtgagggaggaggtgtccaggacgcgctgcaacagaggagagcagcgatgcctggacacaacctggcggcagcgcaaaagatg

SEQ ID NO: 196360 - DNA, 103 bp, Artificial Sequence
  Synthetic Polynucleotide
taatacgactcactatagggggccgactgcgtgagggaggaggtgtccagaacagaggagactggacatgtcctccctcaacctggcggcagcgcaaaagatg

SEQ ID NO: 196361 - DNA, 103 bp, Artificial Sequence
  Synthetic Polynucleotide
taatacgactcactatagggggctggcgggggccgactgcgtgagggaggaacagaggagacctcccatgcgcagtcggaacctggcggcagcgcaaaagatg

SEQ ID NO: 196362 - DNA, 103 bp, Artificial Sequence
  Synthetic Polynucleotide
taatacgactcactatagggttgttggtggggctggcgggggccgactgcaacagaggagagcagtcatgccccgccagaacctggcggcagcgcaaaagatg

SEQ ID NO: 196363 - DNA, 103 bp, Artificial Sequence
  Synthetic Polynucleotide
taatacgactcactataggggtgcacgcccttgttggtggggctggcgggaacagaggagacccgccatgcccaccaacaacctggcggcagcgcaaaagatg

SEQ ID NO: 196364 - DNA, 103 bp, Artificial Sequence
  Synthetic Polynucleotide
taatacgactcactatagggccatcgacagaggatcgatccagcattccaaacagaggagatggaatatgggatcgatcaacctggcggcagcgcaaaagatg

SEQ ID NO: 196365 - DNA, 103 bp, Artificial Sequence
  Synthetic Polynucleotide
taatacgactcactatagggcctggtggatgtgcacgcccttgttggtggaacagaggagaccaccaatgagggcgtgcaacctggcggcagcgcaaaagatg

SEQ ID NO: 196366 - DNA, 103 bp, Artificial Sequence
  Synthetic Polynucleotide
taatacgactcactataggggagccccccgcctggtggatgtgcacgcccaacagaggagagggcgtatgcatccaccaaacctggcggcagcgcaaaagatg

SEQ ID NO: 196367 - DNA, 103 bp, Artificial Sequence
  Synthetic Polynucleotide
taatacgactcactatagggcgccggaggggagccccccgcctggtggataacagaggagaatccacatggcggggggcaacctggcggcagcgcaaaagatg

SEQ ID NO: 196368 - DNA, 103 bp, Artificial Sequence
  Synthetic Polynucleotide
taatacgactcactatagggtggtgctggacgccggaggggagccccccgaacagaggagacgggggatgcccctccggaacctggcggcagcgcaaaagatg

SEQ ID NO: 196369 - DNA, 103 bp, Artificial Sequence
  Synthetic Polynucleotide
taatacgactcactatagggctggagctgctggtgctggacgccggagggaacagaggagaccctccatggtccagcacaacctggcggcagcgcaaaagatg

SEQ ID NO: 196370 - DNA, 103 bp, Artificial Sequence
  Synthetic Polynucleotide
taatacgactcactataggggttggtcaggctggagctgctggtgctggaaacagaggagatccagcatgagcagctccaacctggcggcagcgcaaaagatg

SEQ ID NO: 196371 - DNA, 103 bp, Artificial Sequence
  Synthetic Polynucleotide
taatacgactcactatagggtggccacatcgttggtcaggctggagctgcaacagaggagagcagctatggcctgaccaaacctggcggcagcgcaaaagatg

SEQ ID NO: 196372 - DNA, 103 bp, Artificial Sequence
  Synthetic Polynucleotide
taatacgactcactatagggaccggctgcttggccacatcgttggtcaggaacagaggagacctgacatgcgatgtggcaacctggcggcagcgcaaaagatg

SEQ ID NO: 196373 - DNA, 103 bp, Artificial Sequence
  Synthetic Polynucleotide
taatacgactcactataggggtctcggctgaccggctgcttggccacatcaacagaggagagatgtgatgaagcagccgaacctggcggcagcgcaaaagatg

SEQ ID NO: 196374 - DNA, 103 bp, Artificial Sequence
  Synthetic Polynucleotide
taatacgactcactatagggcagaaggcaagtctcggctgaccggctgctaacagaggagaagcagcatgtcagccgagaacctggcggcagcgcaaaagatg

SEQ ID NO: 196375 - DNA, 103 bp, Artificial Sequence
  Synthetic Polynucleotide
taatacgactcactatagggttctgaggacccatcgacagaggatcgatcaacagaggagagatcgaatgtctgtcgataacctggcggcagcgcaaaagatg

SEQ ID NO: 196376 - DNA, 103 bp, Artificial Sequence
  Synthetic Polynucleotide
taatacgactcactatagggcccggccggccagaaggcaagtctcggctgaacagaggagacagccgatgcttgccttcaacctggcggcagcgcaaaagatg

SEQ ID NO: 196377 - DNA, 103 bp, Artificial Sequence
  Synthetic Polynucleotide
taatacgactcactataggggcctgtggtgcccggccggccagaaggcaaaacagaggagattgcctatgggccggccgaacctggcggcagcgcaaaagatg

SEQ ID NO: 196378 - DNA, 103 bp, Artificial Sequence
  Synthetic Polynucleotide
taatacgactcactatagggccccagcggggcctgtggtgcccggccggcaacagaggagagccggcatggcaccacagaacctggcggcagcgcaaaagatg

SEQ ID NO: 196379 - DNA, 103 bp, Artificial Sequence
  Synthetic Polynucleotide
taatacgactcactataggggtgtactgcgccccagcggggcctgtggtgaacagaggagacaccacatgccccgctggaacctggcggcagcgcaaaagatg

SEQ ID NO: 196380 - DNA, 103 bp, Artificial Sequence
  Synthetic Polynucleotide
taatacgactcactatagggggagtgaggggtgtactgcgccccagcgggaacagaggagacccgctatggcgcagtacaacctggcggcagcgcaaaagatg

SEQ ID NO: 196381 - DNA, 103 bp, Artificial Sequence
  Synthetic Polynucleotide
taatacgactcactatagggggaactggtgggagtgaggggtgtactgcgaacagaggagacgcagtatgcccctcactaacctggcggcagcgcaaaagatg

SEQ ID NO: 196382 - DNA, 103 bp, Artificial Sequence
  Synthetic Polynucleotide
taatacgactcactatagggcgtgtccgggggaactggtgggagtgagggaacagaggagaccctcaatgccaccagttaacctggcggcagcgcaaaagatg

SEQ ID NO: 196383 - DNA, 103 bp, Artificial Sequence
  Synthetic Polynucleotide
taatacgactcactataggggaacatcttccgtgtccgggggaactggtgaacagaggagacaccagatgccccggacaaacctggcggcagcgcaaaagatg

SEQ ID NO: 196384 - DNA, 103 bp, Artificial Sequence
  Synthetic Polynucleotide
taatacgactcactatagggggcccttgtcgaacatcttccgtgtccgggaacagaggagacccggaatgggaagatgtaacctggcggcagcgcaaaagatg

SEQ ID NO: 196385 - DNA, 103 bp, Artificial Sequence
  Synthetic Polynucleotide
taatacgactcactataggggtctgctctgggcccttgtcgaacatcttcaacagaggagagaagatatgcgacaagggaacctggcggcagcgcaaaagatg

SEQ ID NO: 196386 - DNA, 103 bp, Artificial Sequence
  Synthetic Polynucleotide
taatacgactcactatagggttccagagctttctgaggacccatcgacagaacagaggagactgtcgatgggtcctcagaacctggcggcagcgcaaaagatg

SEQ ID NO: 196387 - DNA, 103 bp, Artificial Sequence
  Synthetic Polynucleotide
taatacgactcactataggggtcgtccgcagtctgctctgggcccttgtcaacagaggagagacaagatgccagagcagaacctggcggcagcgcaaaagatg

SEQ ID NO: 196388 - DNA, 103 bp, Artificial Sequence
  Synthetic Polynucleotide
taatacgactcactatagggcatcgtccgcgtcgtccgcagtctgctctgaacagaggagacagagcatgctgcggacgaacctggcggcagcgcaaaagatg

SEQ ID NO: 196389 - DNA, 103 bp, Artificial Sequence
  Synthetic Polynucleotide
taatacgactcactatagggtgtccagcagcatcgtccgcgtcgtccgcaaacagaggagatgcggaatgcgcggacgaaacctggcggcagcgcaaaagatg

SEQ ID NO: 196390 - DNA, 103 bp, Artificial Sequence
  Synthetic Polynucleotide
taatacgactcactataggggaaacttttgtgtccagcagcatcgtccgcaacagaggagagcggacatggctgctggaaacctggcggcagcgcaaaagatg

SEQ ID NO: 196391 - DNA, 103 bp, Artificial Sequence
  Synthetic Polynucleotide
taatacgactcactatagggtggcggagatgaaacttttgtgtccagcagaacagaggagactgctgatgacaaaagttaacctggcggcagcgcaaaagatg

SEQ ID NO: 196392 - DNA, 103 bp, Artificial Sequence
  Synthetic Polynucleotide
taatacgactcactataggggtctgcaccgtggcggagatgaaacttttgaacagaggagacaaaagatgcatctccgcaacctggcggcagcgcaaaagatg

SEQ ID NO: 196393 - DNA, 103 bp, Artificial Sequence
  Synthetic Polynucleotide
taatacgactcactataggggcagaaccccgtctgcaccgtggcggagataacagaggagaatctccatgacggtgcagaacctggcggcagcgcaaaagatg

SEQ ID NO: 196394 - DNA, 103 bp, Artificial Sequence
  Synthetic Polynucleotide
taatacgactcactatagggcgctccagtcgcagaaccccgtctgcaccgaacagaggagacggtgcatgcggggttctaacctggcggcagcgcaaaagatg

SEQ ID NO: 196395 - DNA, 103 bp, Artificial Sequence
  Synthetic Polynucleotide
taatacgactcactatagggaaatagcgggcgctccagtcgcagaaccccaacagaggagaggggttatgcgactggagaacctggcggcagcgcaaaagatg

SEQ ID NO: 196396 - DNA, 103 bp, Artificial Sequence
  Synthetic Polynucleotide
taatacgactcactataggggggctgggcaaaatagcgggcgctccagtcaacagaggagagactggatggcccgctataacctggcggcagcgcaaaagatg

SEQ ID NO: 196397 - DNA, 103 bp, Artificial Sequence
  Synthetic Polynucleotide
taatacgactcactatagggcaccgatggtttccagagctttctgaggacaacagaggagagtcctcatgaagctctggaacctggcggcagcgcaaaagatg

SEQ ID NO: 196398 - DNA, 103 bp, Artificial Sequence
  Synthetic Polynucleotide
taatacgactcactatagggtcttcatgacgggctgggcaaaatagcgggaacagaggagacccgctatgttgcccagcaacctggcggcagcgcaaaagatg

SEQ ID NO: 196399 - DNA, 103 bp, Artificial Sequence
  Synthetic Polynucleotide
taatacgactcactatagggtcttctgggatcttcatgacgggctgggcaaacagaggagatgcccaatgcgtcatgaaaacctggcggcagcgcaaaagatg

SEQ ID NO: 196400 - DNA, 103 bp, Artificial Sequence
  Synthetic Polynucleotide
taatacgactcactatagggcaggtcgtgctcttctgggatcttcatgacaacagaggagagtcatgatgatcccagaaaacctggcggcagcgcaaaagatg

SEQ ID NO: 196401 - DNA, 103 bp, Artificial Sequence
  Synthetic Polynucleotide
taatacgactcactatagggtctgactctccaggtcgtgctcttctgggaaacagaggagatcccagatgagcacgaccaacctggcggcagcgcaaaagatg

SEQ ID NO: 196402 - DNA, 103 bp, Artificial Sequence
  Synthetic Polynucleotide
taatacgactcactatagggtccttgcggatctgactctccaggtcgtgcaacagaggagagcacgaatgggagagtcaaacctggcggcagcgcaaaagatg

SEQ ID NO: 196403 - DNA, 103 bp, Artificial Sequence
  Synthetic Polynucleotide
taatacgactcactatagggccactcccgctccttgcggatctgactctcaacagaggagagagagtatgatccgcaagaacctggcggcagcgcaaaagatg

SEQ ID NO: 196404 - DNA, 103 bp, Artificial Sequence
  Synthetic Polynucleotide
taatacgactcactataggggcaggaaccgccactcccgctccttgcggaaacagaggagatccgcaatgagcgggagtaacctggcggcagcgcaaaagatg

SEQ ID NO: 196405 - DNA, 103 bp, Artificial Sequence
  Synthetic Polynucleotide
taatacgactcactatagggcggctgtttcgcaggaaccgccactcccgcaacagaggagagcgggaatggcggttcctaacctggcggcagcgcaaaagatg

SEQ ID NO: 196406 - DNA, 103 bp, Artificial Sequence
  Synthetic Polynucleotide
taatacgactcactatagggcctcctgacacggctgtttcgcaggaaccgaacagaggagacggttcatgcgaaacagcaacctggcggcagcgcaaaagatg

SEQ ID NO: 196407 - DNA, 103 bp, Artificial Sequence
  Synthetic Polynucleotide
taatacgactcactataggggctgggcctgcctcctgacacggctgtttcaacagaggagagaaacaatggtgtcaggaaacctggcggcagcgcaaaagatg

SEQ ID NO: 196408 - DNA, 103 bp, Artificial Sequence
  Synthetic Polynucleotide
taatacgactcactatagggtcttcctcccccaggcccagaagaggcgataacagaggagaatcgccatgtctgggcctaacctggcggcagcgcaaaagatg

SEQ ID NO: 196409 - DNA, 103 bp, Artificial Sequence
  Synthetic Polynucleotide
taatacgactcactatagggtgtaaatttgcaccgatggtttccagagctaacagaggagaagctctatgaaccatcggaacctggcggcagcgcaaaagatg

SEQ ID NO: 196410 - DNA, 103 bp, Artificial Sequence
  Synthetic Polynucleotide
taatacgactcactatagggtgaatgacttgctgggcctgcctcctgacaaacagaggagatgtcagatggcaggcccaaacctggcggcagcgcaaaagatg

SEQ ID NO: 196411 - DNA, 103 bp, Artificial Sequence
  Synthetic Polynucleotide
taatacgactcactatagggaatgcccttctgaatgacttgctgggcctgaacagaggagacaggccatgcaagtcattaacctggcggcagcgcaaaagatg

SEQ ID NO: 196412 - DNA, 103 bp, Artificial Sequence
  Synthetic Polynucleotide
taatacgactcactatagggccaatctcgtaatgcccttctgaatgacttaacagaggagaaagtcaatgagaagggcaaacctggcggcagcgcaaaagatg

SEQ ID NO: 196413 - DNA, 103 bp, Artificial Sequence
  Synthetic Polynucleotide
taatacgactcactatagggatttggtcgtccaatctcgtaatgcccttcaacagaggagagaagggatgtacgagattaacctggcggcagcgcaaaagatg

SEQ ID NO: 196414 - DNA, 103 bp, Artificial Sequence
  Synthetic Polynucleotide
taatacgactcactataggggttcagaaatatttggtcgtccaatctcgtaacagaggagaacgagaatggacgaccaaaacctggcggcagcgcaaaagatg

SEQ ID NO: 196415 - DNA, 103 bp, Artificial Sequence
  Synthetic Polynucleotide
taatacgactcactatagggcggggttcctgttcagaaatatttggtcgtaacagaggagaacgaccatgtatttctgaaacctggcggcagcgcaaaagatg

SEQ ID NO: 196416 - DNA, 103 bp, Artificial Sequence
  Synthetic Polynucleotide
taatacgactcactataggggaggggacgccggggttcctgttcagaaataacagaggagaatttctatgcaggaacccaacctggcggcagcgcaaaagatg

SEQ ID NO: 196417 - DNA, 103 bp, Artificial Sequence
  Synthetic Polynucleotide
taatacgactcactatagggtttcaccacagaggggacgccggggttcctaacagaggagaaggaacatgggcgtccccaacctggcggcagcgcaaaagatg

SEQ ID NO: 196418 - DNA, 103 bp, Artificial Sequence
  Synthetic Polynucleotide
taatacgactcactatagggaggggtggaatttcaccacagaggggacgcaacagaggagagcgtccatgctgtggtgaaacctggcggcagcgcaaaagatg

SEQ ID NO: 196419 - DNA, 103 bp, Artificial Sequence
  Synthetic Polynucleotide
taatacgactcactatagggcacggcgtgaaggggtggaatttcaccacaaacagaggagatgtggtatgattccacccaacctggcggcagcgcaaaagatg

SEQ ID NO: 196420 - DNA, 103 bp, Artificial Sequence
  Synthetic Polynucleotide
taatacgactcactataggggtactgcttctgtaaatttgcaccgatggtaacagaggagaaccatcatggcaaatttaaacctggcggcagcgcaaaagatg

SEQ ID NO: 196421 - DNA, 103 bp, Artificial Sequence
  Synthetic Polynucleotide
taatacgactcactatagggtacggcgatgcacggcgtgaaggggtggaaaacagaggagattccacatgttcacgccgaacctggcggcagcgcaaaagatg

SEQ ID NO: 196422 - DNA, 103 bp, Artificial Sequence
  Synthetic Polynucleotide
taatacgactcactatagggccttgtcggctacggcgatgcacggcgtgaaacagaggagatcacgcatggcatcgccgaacctggcggcagcgcaaaagatg

SEQ ID NO: 196423 - DNA, 103 bp, Artificial Sequence
  Synthetic Polynucleotide
taatacgactcactatagggcagatgctgtccttgtcggctacggcgatgaacagaggagacatcgcatgagccgacaaaacctggcggcagcgcaaaagatg

SEQ ID NO: 196424 - DNA, 103 bp, Artificial Sequence
  Synthetic Polynucleotide
taatacgactcactataggggtcccaaaagcagatgctgtccttgtcggcaacagaggagagccgacatggacagcatcaacctggcggcagcgcaaaagatg

SEQ ID NO: 196425 - DNA, 103 bp, Artificial Sequence
  Synthetic Polynucleotide
taatacgactcactatagggctttctcccagtcccaaaagcagatgctgtaacagaggagaacagcaatggcttttgggaacctggcggcagcgcaaaagatg

SEQ ID NO: 196426 - DNA, 103 bp, Artificial Sequence
  Synthetic Polynucleotide
taatacgactcactatagggagcttctcccctttctcccagtcccaaaagaacagaggagacttttgatgctgggagaaaacctggcggcagcgcaaaagatg

SEQ ID NO: 196427 - DNA, 103 bp, Artificial Sequence
  Synthetic Polynucleotide
taatacgactcactataggggaaataatccagcttctcccctttctcccaaacagaggagatgggagatgggggagaagaacctggcggcagcgcaaaagatg

SEQ ID NO: 196428 - DNA, 103 bp, Artificial Sequence
  Synthetic Polynucleotide
taatacgactcactatagggtcccattgtggaaataatccagcttctcccaacagaggagagggagaatgtggattattaacctggcggcagcgcaaaagatg

SEQ ID NO: 196429 - DNA, 103 bp, Artificial Sequence
  Synthetic Polynucleotide
taatacgactcactatagggtaccgagggttcccattgtggaaataatccaacagaggagaggattaatgccacaatggaacctggcggcagcgcaaaagatg

SEQ ID NO: 196430 - DNA, 103 bp, Artificial Sequence
  Synthetic Polynucleotide
taatacgactcactataggggaccctcgtgtaccgagggttcccattgtgaacagaggagacacaatatgaaccctcggaacctggcggcagcgcaaaagatg

SEQ ID NO: 196431 - DNA, 103 bp, Artificial Sequence
  Synthetic Polynucleotide
taatacgactcactataggggccagttctcgtactgcttctgtaaatttgaacagaggagacaaattatgagaagcagtaacctggcggcagcgcaaaagatg

SEQ ID NO: 196432 - DNA, 103 bp, Artificial Sequence
  Synthetic Polynucleotide
taatacgactcactatagggccatggcagtgaccctcgtgtaccgagggtaacagaggagaaccctcatgacacgagggaacctggcggcagcgcaaaagatg

SEQ ID NO: 196433 - DNA, 103 bp, Artificial Sequence
  Synthetic Polynucleotide
taatacgactcactatagggttcagatactccatggcagtgaccctcgtgaacagaggagacacgagatgcactgccataacctggcggcagcgcaaaagatg

SEQ ID NO: 196434 - DNA, 103 bp, Artificial Sequence
  Synthetic Polynucleotide
taatacgactcactataggggtcctggccgttcagatactccatggcagtaacagaggagaactgccatggagtatctgaacctggcggcagcgcaaaagatg

SEQ ID NO: 196435 - DNA, 103 bp, Artificial Sequence
  Synthetic Polynucleotide
taatacgactcactataggggaagcgagcagtcctggccgttcagatactaacagaggagaagtatcatgacggccaggaacctggcggcagcgcaaaagatg

SEQ ID NO: 196436 - DNA, 103 bp, Artificial Sequence
  Synthetic Polynucleotide
taatacgactcactataggggccgtcagcagaagcgagcagtcctggccgaacagaggagacggccaatgctgctcgctaacctggcggcagcgcaaaagatg

SEQ ID NO: 196437 - DNA, 103 bp, Artificial Sequence
  Synthetic Polynucleotide
taatacgactcactatagggatcgtctgtggccgtcagcagaagcgagcaaacagaggagatgctcgatgctgctgacgaacctggcggcagcgcaaaagatg

SEQ ID NO: 196438 - DNA, 103 bp, Artificial Sequence
  Synthetic Polynucleotide
taatacgactcactatagggtgatggcaccatcgtctgtggccgtcagcaaacagaggagatgctgaatgccacagacgaacctggcggcagcgcaaaagatg

SEQ ID NO: 196439 - DNA, 103 bp, Artificial Sequence
  Synthetic Polynucleotide
taatacgactcactatagggttccagaccctgatggcaccatcgtctgtgaacagaggagacacagaatgtggtgccataacctggcggcagcgcaaaagatg

SEQ ID NO: 196440 - DNA, 103 bp, Artificial Sequence
  Synthetic Polynucleotide
taatacgactcactatagggagcaaaattcttccagaccctgatggcaccaacagaggagaggtgccatgagggtctggaacctggcggcagcgcaaaagatg

SEQ ID NO: 196441 - DNA, 103 bp, Artificial Sequence
  Synthetic Polynucleotide
taatacgactcactatagggtttccaaatcagcaaaattcttccagacccaacagaggagagggtctatgagaattttgaacctggcggcagcgcaaaagatg

SEQ ID NO: 196442 - DNA, 103 bp, Artificial Sequence
  Synthetic Polynucleotide
taatacgactcactataggggcccttggctgccagttctcgtactgcttcaacagaggagagaagcaatgcgagaactgaacctggcggcagcgcaaaagatg

SEQ ID NO: 196443 - DNA, 103 bp, Artificial Sequence
  Synthetic Polynucleotide
taatacgactcactatagggtctgggttcttttccaaatcagcaaaattcaacagaggagagaatttatgtgatttggaaacctggcggcagcgcaaaagatg

SEQ ID NO: 196444 - DNA, 103 bp, Artificial Sequence
  Synthetic Polynucleotide
taatacgactcactatagggggtcaccatctctgggttcttttccaaatcaacagaggagagatttgatgaagaacccaaacctggcggcagcgcaaaagatg

SEQ ID NO: 196445 - DNA, 103 bp, Artificial Sequence
  Synthetic Polynucleotide
taatacgactcactatagggcctgccacgcggtcaccatctctgggttctaacagaggagaagaaccatgagatggtgaaacctggcggcagcgcaaaagatg

SEQ ID NO: 196446 - DNA, 103 bp, Artificial Sequence
  Synthetic Polynucleotide
taatacgactcactatagggtccgagagcccctgccacgcggtcaccatcaacagaggagagatggtatgcgcgtggcaaacctggcggcagcgcaaaagatg

SEQ ID NO: 196447 - DNA, 103 bp, Artificial Sequence
  Synthetic Polynucleotide
taatacgactcactatagggtggcagcatgtccgagagcccctgccacgcaacagaggagagcgtggatggggctctcgaacctggcggcagcgcaaaagatg

SEQ ID NO: 196448 - DNA, 103 bp, Artificial Sequence
  Synthetic Polynucleotide
taatacgactcactatagggctcgcgtcgttggcagcatgtccgagagccaacagaggagaggctctatgacatgctgcaacctggcggcagcgcaaaagatg

SEQ ID NO: 196449 - DNA, 103 bp, Artificial Sequence
  Synthetic Polynucleotide
taatacgactcactatagggatcccagctcctcgcgtcgttggcagcatgaacagaggagacatgctatgaacgacgcgaacctggcggcagcgcaaaagatg

SEQ ID NO: 196450 - DNA, 103 bp, Artificial Sequence
  Synthetic Polynucleotide
taatacgactcactataggggtccaccaccatcccagctcctcgcgtcgtaacagaggagaacgacgatgggagctgggaacctggcggcagcgcaaaagatg

SEQ ID NO: 196451 - DNA, 103 bp, Artificial Sequence
  Synthetic Polynucleotide
taatacgactcactatagggcctgctcccagtccaccaccatcccagctcaacagaggagagagctgatgtggtggtggaacctggcggcagcgcaaaagatg

SEQ ID NO: 196452 - DNA, 103 bp, Artificial Sequence
  Synthetic Polynucleotide
taatacgactcactatagggaggccggtctcctgctcccagtccaccaccaacagaggagaggtggtatgctgggagcaaacctggcggcagcgcaaaagatg

SEQ ID NO: 196453 - DNA, 103 bp, Artificial Sequence
  Synthetic Polynucleotide
taatacgactcactatagggcttgtaccgggcccttggctgccagttctcaacagaggagagagaacatgcagccaaggaacctggcggcagcgcaaaagatg

SEQ ID NO: 196454 - DNA, 103 bp, Artificial Sequence
  Synthetic Polynucleotide
taatacgactcactataggggctcatgaggaggccggtctcctgctcccaaacagaggagatgggagatggagaccggcaacctggcggcagcgcaaaagatg

SEQ ID NO: 196455 - DNA, 103 bp, Artificial Sequence
  Synthetic Polynucleotide
taatacgactcactatagggcgtctcctgagctcatgaggaggccggtctaacagaggagaagaccgatgtcctcatgaaacctggcggcagcgcaaaagatg

SEQ ID NO: 196456 - DNA, 103 bp, Artificial Sequence
  Synthetic Polynucleotide
taatacgactcactatagggacgatccgcacgtctcctgagctcatgaggaacagaggagacctcatatgctcaggagaaacctggcggcagcgcaaaagatg

SEQ ID NO: 196457 - DNA, 103 bp, Artificial Sequence
  Synthetic Polynucleotide
taatacgactcactatagggccagatccggacgatccgcacgtctcctgaaacagaggagatcaggaatggtgcggatcaacctggcggcagcgcaaaagatg

SEQ ID NO: 196458 - DNA, 103 bp, Artificial Sequence
  Synthetic Polynucleotide
taatacgactcactatagggggtctgtgtcccagatccggacgatccgcaaacagaggagatgcggaatgtccggatctaacctggcggcagcgcaaaagatg

SEQ ID NO: 196459 - DNA, 103 bp, Artificial Sequence
  Synthetic Polynucleotide
taatacgactcactatagggttcatctcacggtctgtgtcccagatccggaacagaggagaccggatatgggacacagaaacctggcggcagcgcaaaagatg

SEQ ID NO: 196460 - DNA, 103 bp, Artificial Sequence
  Synthetic Polynucleotide
taatacgactcactataggggtcctgcaccttcatctcacggtctgtgtcaacagaggagagacacaatgcgtgagatgaacctggcggcagcgcaaaagatg

SEQ ID NO: 196461 - DNA, 103 bp, Artificial Sequence
  Synthetic Polynucleotide
taatacgactcactatagggccgtagggatgtcctgcaccttcatctcacaacagaggagagtgagaatgaggtgcaggaacctggcggcagcgcaaaagatg

SEQ ID NO: 196462 - DNA, 103 bp, Artificial Sequence
  Synthetic Polynucleotide
taatacgactcactatagggctgtctgcgcccgtagggatgtcctgcaccaacagaggagaggtgcaatgcatccctacaacctggcggcagcgcaaaagatg

SEQ ID NO: 196463 - DNA, 103 bp, Artificial Sequence
  Synthetic Polynucleotide
taatacgactcactatagggcgtcacacagctgtctgcgcccgtagggataacagaggagaatccctatgggcgcagacaacctggcggcagcgcaaaagatg

SEQ ID NO: 196464 - DNA, 103 bp, Artificial Sequence
  Synthetic Polynucleotide
taatacgactcactatagggcaaggctctgcttgtaccgggcccttggctaacagaggagaagccaaatgcccggtacaaacctggcggcagcgcaaaagatg

SEQ ID NO: 196465 - DNA, 103 bp, Artificial Sequence
  Synthetic Polynucleotide
taatacgactcactatagggaggacagactcgtcacacagctgtctgcgcaacagaggagagcgcagatggctgtgtgaaacctggcggcagcgcaaaagatg

SEQ ID NO: 196466 - DNA, 103 bp, Artificial Sequence
  Synthetic Polynucleotide
taatacgactcactatagggtgggaatcacaggacagactcgtcacacagaacagaggagactgtgtatggagtctgtcaacctggcggcagcgcaaaagatg

SEQ ID NO: 196467 - DNA, 103 bp, Artificial Sequence
  Synthetic Polynucleotide
taatacgactcactataggggagtgagcggtgggaatcacaggacagactaacagaggagaagtctgatgtgtgattccaacctggcggcagcgcaaaagatg

SEQ ID NO: 196468 - DNA, 103 bp, Artificial Sequence
  Synthetic Polynucleotide
taatacgactcactatagggcagccacgatgagtgagcggtgggaatcacaacagaggagagtgattatgaccgctcacaacctggcggcagcgcaaaagatg

SEQ ID NO: 196469 - DNA, 103 bp, Artificial Sequence
  Synthetic Polynucleotide
taatacgactcactatagggtcaccgaggccagccacgatgagtgagcggaacagaggagaccgctcatgcatcgtggcaacctggcggcagcgcaaaagatg

SEQ ID NO: 196470 - DNA, 103 bp, Artificial Sequence
  Synthetic Polynucleotide
taatacgactcactataggggatggagccgtcaccgaggccagccacgataacagaggagaatcgtgatgggcctcggtaacctggcggcagcgcaaaagatg

SEQ ID NO: 196471 - DNA, 103 bp, Artificial Sequence
  Synthetic Polynucleotide
taatacgactcactatagggcgtagacgcggatggagccgtcaccgaggcaacagaggagagcctcgatgacggctccaaacctggcggcagcgcaaaagatg

SEQ ID NO: 196472 - DNA, 103 bp, Artificial Sequence
  Synthetic Polynucleotide
taatacgactcactatagggatccttctgtcgtagacgcggatggagccgaacagaggagacggctcatgccgcgtctaaacctggcggcagcgcaaaagatg

SEQ ID NO: 196473 - DNA, 103 bp, Artificial Sequence
  Synthetic Polynucleotide
taatacgactcactataggggctgagtgccatccttctgtcgtagacgcgaacagaggagacgcgtcatggacagaaggaacctggcggcagcgcaaaagatg

SEQ ID NO: 196474 - DNA, 103 bp, Artificial Sequence
  Synthetic Polynucleotide
taatacgactcactatagggcgcggcattcgctgagtgccatccttctgtaacagaggagaacagaaatgtggcactcaaacctggcggcagcgcaaaagatg

SEQ ID NO: 196475 - DNA, 103 bp, Artificial Sequence
  Synthetic Polynucleotide
taatacgactcactatagggacagttgggtcaaggctctgcttgtaccggaacagaggagaccggtaatggcagagcctaacctggcggcagcgcaaaagatg

SEQ ID NO: 196476 - DNA, 103 bp, Artificial Sequence
  Synthetic Polynucleotide
taatacgactcactatagggtacgtcatgacgcggcattcgctgagtgccaacagaggagaggcactatgcgaatgccgaacctggcggcagcgcaaaagatg

SEQ ID NO: 196477 - DNA, 103 bp, Artificial Sequence
  Synthetic Polynucleotide
taatacgactcactataggggtgctcccggtacgtcatgacgcggcattcaacagaggagagaatgcatggtcatgacgaacctggcggcagcgcaaaagatg

SEQ ID NO: 196478 - DNA, 103 bp, Artificial Sequence
  Synthetic Polynucleotide
taatacgactcactatagggcccaggctgtgtgctcccggtacgtcatgaaacagaggagatcatgaatgaccgggagcaacctggcggcagcgcaaaagatg

SEQ ID NO: 196479 - DNA, 103 bp, Artificial Sequence
  Synthetic Polynucleotide
taatacgactcactataggggccttcaccacccaggctgtgtgctcccggaacagaggagaccgggaatgcacagcctgaacctggcggcagcgcaaaagatg

SEQ ID NO: 196480 - DNA, 103 bp, Artificial Sequence
  Synthetic Polynucleotide
taatacgactcactatagggctgcagggaggccttcaccacccaggctgtaacagaggagaacagccatggtggtgaagaacctggcggcagcgcaaaagatg

SEQ ID NO: 196481 - DNA, 103 bp, Artificial Sequence
  Synthetic Polynucleotide
taatacgactcactatagggcgggacgcttctgcagggaggccttcaccaaacagaggagatggtgaatgcctccctgcaacctggcggcagcgcaaaagatg

SEQ ID NO: 196482 - DNA, 103 bp, Artificial Sequence
  Synthetic Polynucleotide
taatacgactcactatagggatgtggccgtcgggacgcttctgcagggagaacagaggagactccctatggaagcgtccaacctggcggcagcgcaaaagatg

SEQ ID NO: 196483 - DNA, 103 bp, Artificial Sequence
  Synthetic Polynucleotide
taatacgactcactatagggcacactcacgatgtggccgtcgggacgcttaacagaggagaaagcgtatggacggccacaacctggcggcagcgcaaaagatg

SEQ ID NO: 196484 - DNA, 103 bp, Artificial Sequence
  Synthetic Polynucleotide
taatacgactcactatagggcattgacgctcacactcacgatgtggccgtaacagaggagaacggccatgtcgtgagtgaacctggcggcagcgcaaaagatg

SEQ ID NO: 196485 - DNA, 103 bp, Artificial Sequence
  Synthetic Polynucleotide
taatacgactcactatagggcgcacatctccattgacgctcacactcacgaacagaggagacgtgagatggagcgtcaaaacctggcggcagcgcaaaagatg

SEQ ID NO: 196486 - DNA, 103 bp, Artificial Sequence
  Synthetic Polynucleotide
taatacgactcactataggggacttcatccacagttgggtcaaggctctgaacagaggagacagagcatggacccaactaacctggcggcagcgcaaaagatg

SEQ ID NO: 196487 - DNA, 103 bp, Artificial Sequence
  Synthetic Polynucleotide
taatacgactcactatagggatcaaagatgcgcacatctccattgacgctaacagaggagaagcgtcatgggagatgtgaacctggcggcagcgcaaaagatg

SEQ ID NO: 196488 - DNA, 103 bp, Artificial Sequence
  Synthetic Polynucleotide
taatacgactcactataggggcatccggggatcaaagatgcgcacatctcaacagaggagagagatgatggcatctttgaacctggcggcagcgcaaaagatg

SEQ ID NO: 196489 - DNA, 103 bp, Artificial Sequence
  Synthetic Polynucleotide
taatacgactcactatagggaccgactcaggcatccggggatcaaagatgaacagaggagacatcttatgtccccggataacctggcggcagcgcaaaagatg

SEQ ID NO: 196490 - DNA, 103 bp, Artificial Sequence
  Synthetic Polynucleotide
taatacgactcactatagggaagcacatttaccgactcaggcatccggggaacagaggagaccccggatgcctgagtcgaacctggcggcagcgcaaaagatg

SEQ ID NO: 196491 - DNA, 103 bp, Artificial Sequence
  Synthetic Polynucleotide
taatacgactcactatagggtcacgatctgaagcacatttaccgactcagaacagaggagactgagtatgtaaatgtgcaacctggcggcagcgcaaaagatg

SEQ ID NO: 196492 - DNA, 103 bp, Artificial Sequence
  Synthetic Polynucleotide
taatacgactcactataggggtcagccccttcacgatctgaagcacatttaacagaggagaaaatgtatgtcagatcgtaacctggcggcagcgcaaaagatg

SEQ ID NO: 196493 - DNA, 103 bp, Artificial Sequence
  Synthetic Polynucleotide
taatacgactcactataggggtccagggccgtcagccccttcacgatctgaacagaggagacagatcatgaaggggctgaacctggcggcagcgcaaaagatg

SEQ ID NO: 196494 - DNA, 103 bp, Artificial Sequence
  Synthetic Polynucleotide
taatacgactcactataggggggggtggatgtccagggccgtcagcccctaacagaggagaaggggcatgcggccctggaacctggcggcagcgcaaaagatg

SEQ ID NO: 196495 - DNA, 103 bp, Artificial Sequence
  Synthetic Polynucleotide
taatacgactcactatagggaggtccgcctgggggtggatgtccagggccaacagaggagaggccctatgcatccacccaacctggcggcagcgcaaaagatg

SEQ ID NO: 196496 - DNA, 103 bp, Artificial Sequence
  Synthetic Polynucleotide
taatacgactcactatagggacatgcgatcaggtccgcctgggggtggataacagaggagaatccacatgcaggcggacaacctggcggcagcgcaaaagatg

SEQ ID NO: 196497 - DNA, 103 bp, Artificial Sequence
  Synthetic Polynucleotide
taatacgactcactatagggagagcttcttgacttcatccacagttgggtaacagaggagaacccaaatgtggatgaagaacctggcggcagcgcaaaagatg

SEQ ID NO: 196498 - DNA, 103 bp, Artificial Sequence
  Synthetic Polynucleotide
taatacgactcactatagggtgacggagccacatgcgatcaggtccgcctaacagaggagaaggcggatgtgatcgcataacctggcggcagcgcaaaagatg

SEQ ID NO: 196499 - DNA, 103 bp, Artificial Sequence
  Synthetic Polynucleotide
taatacgactcactataggggtgaactgattgacggagccacatgcgatcaacagaggagagatcgcatgtggctccgtaacctggcggcagcgcaaaagatg

SEQ ID NO: 196500 - DNA, 103 bp, Artificial Sequence
  Synthetic Polynucleotide
taatacgactcactataggggtagatggcggtgaactgattgacggagccaacagaggagaggctccatgaatcagttcaacctggcggcagcgcaaaagatg

SEQ ID NO: 196501 - DNA, 103 bp, Artificial Sequence
  Synthetic Polynucleotide
taatacgactcactatagggcgctgctgttgtagatggcggtgaactgataacagaggagaatcagtatgccgccatctaacctggcggcagcgcaaaagatg

SEQ ID NO: 196502 - DNA, 103 bp, Artificial Sequence
  Synthetic Polynucleotide
taatacgactcactatagggatgagctctccgctgctgttgtagatggcgaacagaggagacgccatatgcaacagcagaacctggcggcagcgcaaaagatg

SEQ ID NO: 196503 - DNA, 103 bp, Artificial Sequence
  Synthetic Polynucleotide
taatacgactcactataggggatgttgttgatgagctctccgctgctgttaacagaggagaaacagcatgggagagctcaacctggcggcagcgcaaaagatg

SEQ ID NO: 196504 - DNA, 103 bp, Artificial Sequence
  Synthetic Polynucleotide
taatacgactcactatagggcgtagtacttgatgttgttgatgagctctcaacagaggagagagagcatgtcaacaacaaacctggcggcagcgcaaaagatg

SEQ ID NO: 196505 - DNA, 103 bp, Artificial Sequence
  Synthetic Polynucleotide
taatacgactcactatagggatgaagccgtcgtagtacttgatgttgttgaacagaggagacaacaaatgcaagtactaaacctggcggcagcgcaaaagatg

SEQ ID NO: 196506 - DNA, 103 bp, Artificial Sequence
  Synthetic Polynucleotide
taatacgactcactatagggccgctggcccatgaagccgtcgtagtacttaacagaggagaaagtacatggacggcttcaacctggcggcagcgcaaaagatg

SEQ ID NO: 196507 - DNA, 103 bp, Artificial Sequence
  Synthetic Polynucleotide
taatacgactcactatagggtggcgccgacccgctggcccatgaagccgtaacagaggagaacggctatgtgggccagcaacctggcggcagcgcaaaagatg

SEQ ID NO: 196508 - DNA, 103 bp, Artificial Sequence
  Synthetic Polynucleotide
taatacgactcactatagggaaggacgtgcagagcttcttgacttcatccaacagaggagaggatgaatgcaagaagctaacctggcggcagcgcaaaagatg

SEQ ID NO: 196509 - DNA, 103 bp, Artificial Sequence
  Synthetic Polynucleotide
taatacgactcactatagggaggcagctgatggcgccgacccgctggcccaacagaggagagggccaatgggtcggcgcaacctggcggcagcgcaaaagatg

SEQ ID NO: 196510 - DNA, 103 bp, Artificial Sequence
  Synthetic Polynucleotide
taatacgactcactataggggtggaaggccaggcagctgatggcgccgacaacagaggagagtcggcatgatcagctgcaacctggcggcagcgcaaaagatg

SEQ ID NO: 196511 - DNA, 103 bp, Artificial Sequence
  Synthetic Polynucleotide
taatacgactcactataggggccagtgcgggtggaaggccaggcagctgaaacagaggagatcagctatgtggccttccaacctggcggcagcgcaaaagatg

SEQ ID NO: 196512 - DNA, 103 bp, Artificial Sequence
  Synthetic Polynucleotide
taatacgactcactataggggccaggtgaggccagtgcgggtggaaggccaacagaggagaggccttatgcccgcactgaacctggcggcagcgcaaaagatg

SEQ ID NO: 196513 - DNA, 103 bp, Artificial Sequence
  Synthetic Polynucleotide
taatacgactcactataggggcttcccacggccaggtgaggccagtgcggaacagaggagaccgcacatgcctcacctgaacctggcggcagcgcaaaagatg

SEQ ID NO: 196514 - DNA, 103 bp, Artificial Sequence
  Synthetic Polynucleotide
taatacgactcactatagggagtagtcgttgcttcccacggccaggtgagaacagaggagactcaccatgccgtgggaaaacctggcggcagcgcaaaagatg

SEQ ID NO: 196515 - DNA, 103 bp, Artificial Sequence
  Synthetic Polynucleotide
taatacgactcactatagggacggagatgtagtagtcgttgcttcccacgaacagaggagacgtgggatgcaacgactaaacctggcggcagcgcaaaagatg

SEQ ID NO: 196516 - DNA, 103 bp, Artificial Sequence
  Synthetic Polynucleotide
taatacgactcactatagggcaccgagtacacggagatgtagtagtcgttaacagaggagaaacgacatgtacatctccaacctggcggcagcgcaaaagatg

SEQ ID NO: 196517 - DNA, 103 bp, Artificial Sequence
  Synthetic Polynucleotide
taatacgactcactatagggcacgcttctccaccgagtacacggagatgtaacagaggagaacatctatgtgtactcggaacctggcggcagcgcaaaagatg

SEQ ID NO: 196518 - DNA, 103 bp, Artificial Sequence
  Synthetic Polynucleotide
taatacgactcactatagggatcagcctcatcttcctcccccaggcccagaacagaggagactgggcatgggggaggaaaacctggcggcagcgcaaaagatg

SEQ ID NO: 196519 - DNA, 103 bp, Artificial Sequence
  Synthetic Polynucleotide
taatacgactcactataggggttgcgacgtaaggacgtgcagagcttcttaacagaggagaaagaagatgtgcacgtccaacctggcggcagcgcaaaagatg

SEQ ID NO: 196520 - DNA, 103 bp, Artificial Sequence
  Synthetic Polynucleotide
taatacgactcactatagggcctccttggcgttgcgacgtaaggacgtgcaacagaggagagcacgtatgtacgtcgcaaacctggcggcagcgcaaaagatg

SEQ ID NO: 196521 - DNA, 103 bp, Artificial Sequence
  Synthetic Polynucleotide
taatacgactcactatagggaggactcgctcctccttggcgttgcgacgtaacagaggagaacgtcgatgcgccaaggaaacctggcggcagcgcaaaagatg

SEQ ID NO: 196522 - DNA, 103 bp, Artificial Sequence
  Synthetic Polynucleotide
taatacgactcactataggggtagtgaaagaggactcgctcctccttggcaacagaggagagccaagatggagcgagtcaacctggcggcagcgcaaaagatg

SEQ ID NO: 196523 - DNA, 103 bp, Artificial Sequence
  Synthetic Polynucleotide
taatacgactcactatagggcgtggccattgtagtgaaagaggactcgctaacagaggagaagcgagatgtctttcactaacctggcggcagcgcaaaagatg

SEQ ID NO: 196524 - DNA, 103 bp, Artificial Sequence
  Synthetic Polynucleotide
taatacgactcactatagggcggggcaccccgtggccattgtagtgaaagaacagaggagactttcaatgcaatggccaaacctggcggcagcgcaaaagatg

SEQ ID NO: 196525 - DNA, 103 bp, Artificial Sequence
  Synthetic Polynucleotide
taatacgactcactataggggactgtgggccggggcaccccgtggccattaacagaggagaaatggcatgggggtgcccaacctggcggcagcgcaaaagatg

SEQ ID NO: 196526 - DNA, 103 bp, Artificial Sequence
  Synthetic Polynucleotide
taatacgactcactatagggcctccccgttgactgtgggccggggcacccaacagaggagagggtgcatgggcccacagaacctggcggcagcgcaaaagatg

SEQ ID NO: 196527 - DNA, 103 bp, Artificial Sequence
  Synthetic Polynucleotide
taatacgactcactatagggaagacccagacctccccgttgactgtgggcaacagaggagagcccacatgcaacggggaaacctggcggcagcgcaaaagatg

SEQ ID NO: 196528 - DNA, 103 bp, Artificial Sequence
  Synthetic Polynucleotide
taatacgactcactataggggttcttgttgaagacccagacctccccgttaacagaggagaaacgggatggtctgggtcaacctggcggcagcgcaaaagatg

SEQ ID NO: 196529 - DNA, 103 bp, Artificial Sequence
  Synthetic Polynucleotide
taatacgactcactatagggagtctgtaagatcagcctcatcttcctcccaacagaggagagggaggatgatgaggctgaacctggcggcagcgcaaaagatg

SEQ ID NO: 196530 - DNA, 103 bp, Artificial Sequence
  Synthetic Polynucleotide
taatacgactcactatagggactgcgtgtagttcttgttgaagacccagaaacagaggagatctgggatgtcaacaagaaacctggcggcagcgcaaaagatg

SEQ ID NO: 196531 - DNA, 103 bp, Artificial Sequence
  Synthetic Polynucleotide
taatacgactcactatagggagagggatgtactgcgtgtagttcttgttgaacagaggagacaacaaatgctacacgcaaacctggcggcagcgcaaaagatg

SEQ ID NO: 196532 - DNA, 103 bp, Artificial Sequence
  Synthetic Polynucleotide
taatacgactcactatagggatatatggacagagggatgtactgcgtgtaaacagaggagatacacgatgtacatccctaacctggcggcagcgcaaaagatg

SEQ ID NO: 196533 - DNA, 103 bp, Artificial Sequence
  Synthetic Polynucleotide
taatacgactcactatagggtctgcaggtcatatatggacagagggatgtaacagaggagaacatccatgtgtccatataacctggcggcagcgcaaaagatg

SEQ ID NO: 196534 - DNA, 103 bp, Artificial Sequence
  Synthetic Polynucleotide
taatacgactcactatagggcccatccacgtctgcaggtcatatatggacaacagaggagagtccatatgtgacctgcaaacctggcggcagcgcaaaagatg

SEQ ID NO: 196535 - DNA, 103 bp, Artificial Sequence
  Synthetic Polynucleotide
taatacgactcactatagggcgacgggctgcccatccacgtctgcaggtcaacagaggagagacctgatgacgtggatgaacctggcggcagcgcaaaagatg

SEQ ID NO: 196536 - DNA, 103 bp, Artificial Sequence
  Synthetic Polynucleotide
taatacgactcactatagggagacgaagatcgacgggctgcccatccacgaacagaggagacgtggaatggcagcccgtaacctggcggcagcgcaaaagatg

SEQ ID NO: 196537 - DNA, 103 bp, Artificial Sequence
  Synthetic Polynucleotide
taatacgactcactataggggagcagtcgtagacgaagatcgacgggctgaacagaggagacagcccatggatcttcgtaacctggcggcagcgcaaaagatg

SEQ ID NO: 196538 - DNA, 103 bp, Artificial Sequence
  Synthetic Polynucleotide
taatacgactcactataggggccagcattggagcagtcgtagacgaagataacagaggagaatcttcatgtacgactgcaacctggcggcagcgcaaaagatg

SEQ ID NO: 196539 - DNA, 103 bp, Artificial Sequence
  Synthetic Polynucleotide
taatacgactcactatagggtgacgatcaagccagcattggagcagtcgtaacagaggagaacgactatgccaatgctgaacctggcggcagcgcaaaagatg

SEQ ID NO: 196540 - DNA, 103 bp, Artificial Sequence
  Synthetic Polynucleotide
taatacgactcactatagggggtaggttccagtctgtaagatcagcctcaaacagaggagatgaggcatgtcttacagaaacctggcggcagcgcaaaagatg

SEQ ID NO: 196541 - DNA, 103 bp, Artificial Sequence
  Synthetic Polynucleotide
taatacgactcactatagggttgaaggacttgacgatcaagccagcattgaacagaggagacaatgcatgcttgatcgtaacctggcggcagcgcaaaagatg

SEQ ID NO: 196542 - DNA, 103 bp, Artificial Sequence
  Synthetic Polynucleotide
taatacgactcactatagggtgcgaactgcttgaaggacttgacgatcaaaacagaggagattgatcatgaagtccttcaacctggcggcagcgcaaaagatg

SEQ ID NO: 196543 - DNA, 103 bp, Artificial Sequence
  Synthetic Polynucleotide
taatacgactcactatagggcccgctgtagtgcgaactgcttgaaggactaacagaggagaagtcctatgagcagttcgaacctggcggcagcgcaaaagatg

SEQ ID NO: 196544 - DNA, 103 bp, Artificial Sequence
  Synthetic Polynucleotide
taatacgactcactatagggagctcctgctcccgctgtagtgcgaactgcaacagaggagagcagttatgactacagcgaacctggcggcagcgcaaaagatg

SEQ ID NO: 196545 - DNA, 103 bp, Artificial Sequence
  Synthetic Polynucleotide
taatacgactcactatagggagctacctccagctcctgctcccgctgtagaacagaggagactacagatggagcaggagaacctggcggcagcgcaaaagatg

SEQ ID NO: 196546 - DNA, 103 bp, Artificial Sequence
  Synthetic Polynucleotide
taatacgactcactatagggggttgattgcagctacctccagctcctgctaacagaggagaagcaggatgtggaggtagaacctggcggcagcgcaaaagatg

SEQ ID NO: 196547 - DNA, 103 bp, Artificial Sequence
  Synthetic Polynucleotide
taatacgactcactataggggggtgatttgggttgattgcagctacctccaacagaggagaggaggtatgtgcaatcaaaacctggcggcagcgcaaaagatg

SEQ ID NO: 196548 - DNA, 103 bp, Artificial Sequence
  Synthetic Polynucleotide
taatacgactcactatagggctgagcaagagggtgatttgggttgattgcaacagaggagagcaatcatgccaaatcacaacctggcggcagcgcaaaagatg

SEQ ID NO: 196549 - DNA, 103 bp, Artificial Sequence
  Synthetic Polynucleotide
taatacgactcactataggggcaaaggcatctgagcaagagggtgatttgaacagaggagacaaatcatgctcttgctcaacctggcggcagcgcaaaagatg

SEQ ID NO: 196550 - DNA, 103 bp, Artificial Sequence
  Synthetic Polynucleotide
taatacgactcactatagggatcgacggaggcaaaggcatctgagcaagaaacagaggagatcttgcatggatgcctttaacctggcggcagcgcaaaagatg

SEQ ID NO: 196551 - DNA, 103 bp, Artificial Sequence
  Synthetic Polynucleotide
taatacgactcactatagggaaaagccaaaggtaggttccagtctgtaagaacagaggagacttacaatgtggaacctaaacctggcggcagcgcaaaagatg

SEQ ID NO: 196552 - DNA, 103 bp, Artificial Sequence
  Synthetic Polynucleotide
taatacgactcactataggggcagtttttcatcgacggaggcaaaggcataacagaggagaatgcctatgcctccgtcgaacctggcggcagcgcaaaagatg

SEQ ID NO: 196553 - DNA, 103 bp, Artificial Sequence
  Synthetic Polynucleotide
taatacgactcactatagggccagctggatgcagtttttcatcgacggagaacagaggagactccgtatgtgaaaaactaacctggcggcagcgcaaaagatg

SEQ ID NO: 196554 - DNA, 103 bp, Artificial Sequence
  Synthetic Polynucleotide
taatacgactcactatagggtcgcaggctgccagctggatgcagtttttcaacagaggagagaaaaaatgcatccagctaacctggcggcagcgcaaaagatg

SEQ ID NO: 196555 - DNA, 103 bp, Artificial Sequence
  Synthetic Polynucleotide
taatacgactcactatagggctcggtggcctcgcaggctgccagctggataacagaggagaatccagatggcagcctgcaacctggcggcagcgcaaaagatg

SEQ ID NO: 196556 - DNA, 103 bp, Artificial Sequence
  Synthetic Polynucleotide
taatacgactcactatagggtgggcagcagctcggtggcctcgcaggctgaacagaggagacagcctatgaggccaccgaacctggcggcagcgcaaaagatg

SEQ ID NO: 196557 - DNA, 103 bp, Artificial Sequence
  Synthetic Polynucleotide
taatacgactcactatagggtcggggatcatgggcagcagctcggtggccaacagaggagaggccacatggctgctgccaacctggcggcagcgcaaaagatg

SEQ ID NO: 196558 - DNA, 103 bp, Artificial Sequence
  Synthetic Polynucleotide
taatacgactcactatagggagccgggaggtcggggatcatgggcagcagaacagaggagactgctgatgatgatccccaacctggcggcagcgcaaaagatg

SEQ ID NO: 196559 - DNA, 103 bp, Artificial Sequence
  Synthetic Polynucleotide
taatacgactcactatagggtgaataggtcagccgggaggtcggggatcaaacagaggagatgatccatgacctcccggaacctggcggcagcgcaaaagatg

SEQ ID NO: 196560 - DNA, 103 bp, Artificial Sequence
  Synthetic Polynucleotide
taatacgactcactatagggaggcaggaggtgaataggtcagccgggaggaacagaggagacctcccatgtgacctattaacctggcggcagcgcaaaagatg

SEQ ID NO: 196561 - DNA, 103 bp, Artificial Sequence
  Synthetic Polynucleotide
taatacgactcactataggggggggtggtgaggcaggaggtgaataggtcaacagaggagagacctaatgacctcctgcaacctggcggcagcgcaaaagatg

SEQ ID NO: 196562 - DNA, 103 bp, Artificial Sequence
  Synthetic Polynucleotide
taatacgactcactatagggtctttttcataaaagccaaaggtaggttccaacagaggagaggaaccatgctttggcttaacctggcggcagcgcaaaagatg

SEQ ID NO: 196563 - DNA, 103 bp, Artificial Sequence
  Synthetic Polynucleotide
taatacgactcactatagggcgatcttgatgggggtggtgaggcaggaggaacagaggagacctcctatgtcaccacccaacctggcggcagcgcaaaagatg

SEQ ID NO: 196564 - DNA, 103 bp, Artificial Sequence
  Synthetic Polynucleotide
taatacgactcactatagggcagcgcagggcgatcttgatgggggtggtgaacagaggagacaccacatgcatcaagataacctggcggcagcgcaaaagatg

SEQ ID NO: 196565 - DNA, 103 bp, Artificial Sequence
  Synthetic Polynucleotide
taatacgactcactatagggcatgcaaaaccagcgcagggcgatcttgataacagaggagaatcaagatggccctgcgcaacctggcggcagcgcaaaagatg

SEQ ID NO: 196566 - DNA, 103 bp, Artificial Sequence
  Synthetic Polynucleotide
taatacgactcactatagggcacatttctgcatgcaaaaccagcgcagggaacagaggagaccctgcatgggttttgcaaacctggcggcagcgcaaaagatg

SEQ ID NO: 196567 - DNA, 103 bp, Artificial Sequence
  Synthetic Polynucleotide
taatacgactcactatagggaccagactgacacatttctgcatgcaaaacaacagaggagagttttgatggcagaaatgaacctggcggcagcgcaaaagatg

SEQ ID NO: 196568 - DNA, 103 bp, Artificial Sequence
  Synthetic Polynucleotide
taatacgactcactataggggacgccaggcaccagactgacacatttctgaacagaggagacagaaaatggtcagtctgaacctggcggcagcgcaaaagatg

SEQ ID NO: 196569 - DNA, 103 bp, Artificial Sequence
  Synthetic Polynucleotide
taatacgactcactatagggaatccagtgtgacgccaggcaccagactgaaacagaggagatcagtcatgtgcctggcgaacctggcggcagcgcaaaagatg

SEQ ID NO: 196570 - DNA, 103 bp, Artificial Sequence
  Synthetic Polynucleotide
taatacgactcactatagggttttctatcaaatccagtgtgacgccaggcaacagaggagagcctggatgcacactggaaacctggcggcagcgcaaaagatg

SEQ ID NO: 196571 - DNA, 103 bp, Artificial Sequence
  Synthetic Polynucleotide
taatacgactcactataggggccagggatcttttctatcaaatccagtgtaacagaggagaacactgatgttgatagaaaacctggcggcagcgcaaaagatg

SEQ ID NO: 196572 - DNA, 103 bp, Artificial Sequence
  Synthetic Polynucleotide
taatacgactcactatagggcgttcaggcggccagggatcttttctatcaaacagaggagatgatagatgagatccctgaacctggcggcagcgcaaaagatg

SEQ ID NO: 196573 - DNA, 103 bp, Artificial Sequence
  Synthetic Polynucleotide
taatacgactcactatagggtcacagtgcctctttttcataaaagccaaaaacagaggagatttggcatgtatgaaaaaaacctggcggcagcgcaaaagatg

SEQ ID NO: 196574 - DNA, 103 bp, Artificial Sequence
  Synthetic Polynucleotide
taatacgactcactataggggtcctcctgtcgttcaggcggccagggatcaacagaggagagatcccatgccgcctgaaaacctggcggcagcgcaaaagatg

SEQ ID NO: 196575 - DNA, 103 bp, Artificial Sequence
  Synthetic Polynucleotide
taatacgactcactatagggacccaggggcgtcctcctgtcgttcaggcgaacagaggagacgcctgatggacaggaggaacctggcggcagcgcaaaagatg

SEQ ID NO: 196576 - DNA, 103 bp, Artificial Sequence
  Synthetic Polynucleotide
taatacgactcactatagggagttcagttcacccaggggcgtcctcctgtaacagaggagaacaggaatgcgcccctggaacctggcggcagcgcaaaagatg

SEQ ID NO: 196577 - DNA, 103 bp, Artificial Sequence
  Synthetic Polynucleotide
taatacgactcactataggggtgaagatccagttcagttcacccaggggcaacagaggagagcccctatgtgaactgaaaacctggcggcagcgcaaaagatg

SEQ ID NO: 196578 - DNA, 103 bp, Artificial Sequence
  Synthetic Polynucleotide
taatacgactcactatagggtgtgatggctgtgaagatccagttcagttcaacagaggagagaactgatgtggatcttcaacctggcggcagcgcaaaagatg

SEQ ID NO: 196579 - DNA, 103 bp, Artificial Sequence
  Synthetic Polynucleotide
taatacgactcactatagggcgatggtgtctgtgatggctgtgaagatccaacagaggagaggatctatgcagccatcaaacctggcggcagcgcaaaagatg

SEQ ID NO: 196580 - DNA, 103 bp, Artificial Sequence
  Synthetic Polynucleotide
taatacgactcactatagggacgttccacgcgatggtgtctgtgatggctaacagaggagaagccatatgagacaccataacctggcggcagcgcaaaagatg

SEQ ID NO: 196581 - DNA, 103 bp, Artificial Sequence
  Synthetic Polynucleotide
taatacgactcactatagggccgggggagcacgttccacgcgatggtgtcaacagaggagagacaccatggcgtggaacaacctggcggcagcgcaaaagatg

SEQ ID NO: 196582 - DNA, 103 bp, Artificial Sequence
  Synthetic Polynucleotide
taatacgactcactatagggggaagagatcccgggggagcacgttccacgaacagaggagacgtggaatgtgctcccccaacctggcggcagcgcaaaagatg

SEQ ID NO: 196583 - DNA, 103 bp, Artificial Sequence
  Synthetic Polynucleotide
taatacgactcactatagggaagagcttttggaagagatcccgggggagcaacagaggagagctcccatgggatctcttaacctggcggcagcgcaaaagatg

SEQ ID NO: 196584 - DNA, 103 bp, Artificial Sequence
  Synthetic Polynucleotide
taatacgactcactatagggttccaagccagcgggcgaacttgacgtcataacagaggagaatgacgatgagttcgcccaacctggcggcagcgcaaaagatg

SEQ ID NO: 196585 - DNA, 103 bp, Artificial Sequence
  Synthetic Polynucleotide
taatacgactcactataggggatcccctgggggctcccgccattctctgtaacagaggagaacagagatgggcgggagcaacctggcggcagcgcaaaagatg

SEQ ID NO: 196586 - DNA, 103 bp, Artificial Sequence
  Synthetic Polynucleotide
taatacgactcactatagggcgccacatgggtctgcttgtgcagagccagaacagaggagactggctatgcacaagcagaacctggcggcagcgcaaaagatg

SEQ ID NO: 196587 - DNA, 103 bp, Artificial Sequence
  Synthetic Polynucleotide
taatacgactcactatagggcctggtctgccgccacatgggtctgcttgtaacagaggagaacaagcatgcccatgtggaacctggcggcagcgcaaaagatg

SEQ ID NO: 196588 - DNA, 103 bp, Artificial Sequence
  Synthetic Polynucleotide
taatacgactcactatagggttttcttgaccctggtctgccgccacatggaacagaggagaccatgtatgggcagaccaaacctggcggcagcgcaaaagatg

SEQ ID NO: 196589 - DNA, 103 bp, Artificial Sequence
  Synthetic Polynucleotide
taatacgactcactatagggggcctgcggcttttcttgaccctggtctgcaacagaggagagcagacatgggtcaagaaaacctggcggcagcgcaaaagatg

SEQ ID NO: 196590 - DNA, 103 bp, Artificial Sequence
  Synthetic Polynucleotide
taatacgactcactataggggcaggggcgtggcctgcggcttttcttgacaacagaggagagtcaagatgagccgcaggaacctggcggcagcgcaaaagatg

SEQ ID NO: 196591 - DNA, 103 bp, Artificial Sequence
  Synthetic Polynucleotide
taatacgactcactataggggcgtcaccaggcaggggcgtggcctgcggcaacagaggagagccgcaatgcacgcccctaacctggcggcagcgcaaaagatg

SEQ ID NO: 196592 - DNA, 103 bp, Artificial Sequence
  Synthetic Polynucleotide
taatacgactcactatagggctggtccagggcgtcaccaggcaggggcgtaacagaggagaacgcccatgcctggtgacaacctggcggcagcgcaaaagatg

SEQ ID NO: 196593 - DNA, 103 bp, Artificial Sequence
  Synthetic Polynucleotide
taatacgactcactatagggggaagcccttctggtccagggcgtcaccagaacagaggagactggtgatgccctggaccaacctggcggcagcgcaaaagatg

SEQ ID NO: 196594 - DNA, 103 bp, Artificial Sequence
  Synthetic Polynucleotide
taatacgactcactatagggagcaaggccaggaagcccttctggtccaggaacagaggagacctggaatggaagggcttaacctggcggcagcgcaaaagatg

SEQ ID NO: 196595 - DNA, 103 bp, Artificial Sequence
  Synthetic Polynucleotide
taatacgactcactatagggctgcaggccaagcaaggccaggaagcccttaacagaggagaaagggcatgctggccttgaacctggcggcagcgcaaaagatg

SEQ ID NO: 196596 - DNA, 103 bp, Artificial Sequence
  Synthetic Polynucleotide
taatacgactcactatagggagggggacttgatcccctgggggctcccgcaacagaggagagcgggaatgcccaggggaaacctggcggcagcgcaaaagatg

SEQ ID NO: 196597 - DNA, 103 bp, Artificial Sequence
  Synthetic Polynucleotide
taatacgactcactatagggctttggtgtgctgcaggccaagcaaggccaaacagaggagatggcctatgttggcctgcaacctggcggcagcgcaaaagatg

SEQ ID NO: 196598 - DNA, 103 bp, Artificial Sequence
  Synthetic Polynucleotide
taatacgactcactatagggggcctgacgtctttggtgtgctgcaggccaaacagaggagatggcctatggcacaccaaaacctggcggcagcgcaaaagatg

SEQ ID NO: 196599 - DNA, 103 bp, Artificial Sequence
  Synthetic Polynucleotide
taatacgactcactatagggggcgggggcaggcctgacgtctttggtgtgaacagaggagacacaccatggacgtcaggaacctggcggcagcgcaaaagatg

SEQ ID NO: 196600 - DNA, 103 bp, Artificial Sequence
  Synthetic Polynucleotide
taatacgactcactatagggggggctcctcggcgggggcaggcctgacgtaacagaggagaacgtcaatgctgcccccgaacctggcggcagcgcaaaagatg

SEQ ID NO: 196601 - DNA, 103 bp, Artificial Sequence
  Synthetic Polynucleotide
taatacgactcactatagggtcatccggcaggggctcctcggcgggggcaaacagaggagatgccccatgcgaggagccaacctggcggcagcgcaaaagatg

SEQ ID NO: 196602 - DNA, 103 bp, Artificial Sequence
  Synthetic Polynucleotide
taatacgactcactatagggtgcctggttgtcatccggcaggggctcctcaacagaggagagaggagatgctgccggataacctggcggcagcgcaaaagatg

SEQ ID NO: 196603 - DNA, 103 bp, Artificial Sequence
  Synthetic Polynucleotide
taatacgactcactatagggggagctgaattgcctggttgtcatccggcaaacagaggagatgccggatgacaaccaggaacctggcggcagcgcaaaagatg

SEQ ID NO: 196604 - DNA, 103 bp, Artificial Sequence
  Synthetic Polynucleotide
taatacgactcactatagggttgagtgtctggagctgaattgcctggttgaacagaggagacaaccaatgaattcagctaacctggcggcagcgcaaaagatg

SEQ ID NO: 196605 - DNA, 103 bp, Artificial Sequence
  Synthetic Polynucleotide
taatacgactcactatagggtagctgacacttgagtgtctggagctgaataacagaggagaattcagatgcagacactcaacctggcggcagcgcaaaagatg

SEQ ID NO: 196606 - DNA, 103 bp, Artificial Sequence
  Synthetic Polynucleotide
taatacgactcactatagggggtcctgaggtagctgacacttgagtgtctaacagaggagaagacacatgagtgtcagcaacctggcggcagcgcaaaagatg

SEQ ID NO: 196607 - DNA, 103 bp, Artificial Sequence
  Synthetic Polynucleotide
taatacgactcactatagggggaggcttcgagggggacttgatcccctggaacagaggagaccagggatgcaagtccccaacctggcggcagcgcaaaagatg

SEQ ID NO: 196608 - DNA, 103 bp, Artificial Sequence
  Synthetic Polynucleotide
taatacgactcactataggggtgcagccggggtcctgaggtagctgacacaacagaggagagtgtcaatgacctcaggaaacctggcggcagcgcaaaagatg

SEQ ID NO: 196609 - DNA, 103 bp, Artificial Sequence
  Synthetic Polynucleotide
taatacgactcactatagggcagcaggttggtgcagccggggtcctgaggaacagaggagacctcagatgcccggctgcaacctggcggcagcgcaaaagatg

SEQ ID NO: 196610 - DNA, 103 bp, Artificial Sequence
  Synthetic Polynucleotide
taatacgactcactataggggtgacaggctcagcaggttggtgcagccggaacagaggagaccggctatgccaacctgcaacctggcggcagcgcaaaagatg

SEQ ID NO: 196611 - DNA, 103 bp, Artificial Sequence
  Synthetic Polynucleotide
taatacgactcactataggggcttcgaaaggtgacaggctcagcaggttgaacagaggagacaacctatggagcctgtcaacctggcggcagcgcaaaagatg

SEQ ID NO: 196612 - DNA, 103 bp, Artificial Sequence
  Synthetic Polynucleotide
taatacgactcactatagggtagggaagcagcttcgaaaggtgacaggctaacagaggagaagcctgatgcctttcgaaaacctggcggcagcgcaaaagatg

SEQ ID NO: 196613 - DNA, 103 bp, Artificial Sequence
  Synthetic Polynucleotide
taatacgactcactataggggagaaccgcctagggaagcagcttcgaaagaacagaggagactttcgatgctgcttcccaacctggcggcagcgcaaaagatg

SEQ ID NO: 196614 - DNA, 103 bp, Artificial Sequence
  Synthetic Polynucleotide
taatacgactcactatagggagaactgtgagagaaccgcctagggaagcaaacagaggagatgcttcatgaggcggttcaacctggcggcagcgcaaaagatg

SEQ ID NO: 196615 - DNA, 103 bp, Artificial Sequence
  Synthetic Polynucleotide
taatacgactcactatagggggtcgcggggagaactgtgagagaaccgccaacagaggagaggcggtatgctcacagttaacctggcggcagcgcaaaagatg

SEQ ID NO: 196616 - DNA, 103 bp, Artificial Sequence
  Synthetic Polynucleotide
taatacgactcactatagggtgctgtccttggtcgcggggagaactgtgaaacagaggagatcacagatgtccccgcgaaacctggcggcagcgcaaaagatg

SEQ ID NO: 196617 - DNA, 103 bp, Artificial Sequence
  Synthetic Polynucleotide
taatacgactcactatagggaggtgctttatgctgtccttggtcgcggggaacagaggagaccccgcatgcaaggacagaacctggcggcagcgcaaaagatg

SEQ ID NO: 196618 - DNA, 103 bp, Artificial Sequence
  Synthetic Polynucleotide
taatacgactcactatagggatttggtcctggaggcttcgagggggacttaacagaggagaaagtccatgtcgaagcctaacctggcggcagcgcaaaagatg

SEQ ID NO: 196619 - DNA, 103 bp, Artificial Sequence
  Synthetic Polynucleotide
taatacgactcactatagggctgcagggacaggtgctttatgctgtccttaacagaggagaaaggacatgataaagcacaacctggcggcagcgcaaaagatg

SEQ ID NO: 196620 - DNA, 103 bp, Artificial Sequence
  Synthetic Polynucleotide
taatacgactcactatagggtctggaagggctgcagggacaggtgctttaaacagaggagataaagcatgtgtccctgcaacctggcggcagcgcaaaagatg

SEQ ID NO: 196621 - DNA, 103 bp, Artificial Sequence
  Synthetic Polynucleotide
taatacgactcactatagggatgaagcccttctggaagggctgcagggacaacagaggagagtccctatggcccttccaaacctggcggcagcgcaaaagatg

SEQ ID NO: 196622 - DNA, 103 bp, Artificial Sequence
  Synthetic Polynucleotide
taatacgactcactatagggaggctggatgatgaagcccttctggaagggaacagaggagacccttcatgaagggcttcaacctggcggcagcgcaaaagatg

SEQ ID NO: 196623 - DNA, 103 bp, Artificial Sequence
  Synthetic Polynucleotide
taatacgactcactatagggtgctgctgtcaggctggatgatgaagccctaacagaggagaagggctatgtcatccagcaacctggcggcagcgcaaaagatg

SEQ ID NO: 196624 - DNA, 103 bp, Artificial Sequence
  Synthetic Polynucleotide
taatacgactcactatagggttgaccacaatgctgctgtcaggctggatgaacagaggagacatccaatgtgacagcagaacctggcggcagcgcaaaagatg

SEQ ID NO: 196625 - DNA, 103 bp, Artificial Sequence
  Synthetic Polynucleotide
taatacgactcactatagggagagatgggcttgaccacaatgctgctgtcaacagaggagagacagcatgattgtggtcaacctggcggcagcgcaaaagatg

SEQ ID NO: 196626 - DNA, 103 bp, Artificial Sequence
  Synthetic Polynucleotide
taatacgactcactatagggccgactcgccagagatgggcttgaccacaaaacagaggagattgtggatgagcccatctaacctggcggcagcgcaaaagatg

SEQ ID NO: 196627 - DNA, 103 bp, Artificial Sequence
  Synthetic Polynucleotide
taatacgactcactatagggagctcgatggccgactcgccagagatgggcaacagaggagagcccatatgtggcgagtcaacctggcggcagcgcaaaagatg

SEQ ID NO: 196628 - DNA, 103 bp, Artificial Sequence
  Synthetic Polynucleotide
taatacgactcactataggggatgtctgccagctcgatggccgactcgccaacagaggagaggcgagatggccatcgagaacctggcggcagcgcaaaagatg

SEQ ID NO: 196629 - DNA, 103 bp, Artificial Sequence
  Synthetic Polynucleotide
taatacgactcactatagggtgccaatccgatttggtcctggaggcttcgaacagaggagacgaagcatgcaggaccaaaacctggcggcagcgcaaaagatg

SEQ ID NO: 196630 - DNA, 103 bp, Artificial Sequence
  Synthetic Polynucleotide
taatacgactcactataggggaatttgctggatgtctgccagctcgatggaacagaggagaccatcgatgtggcagacaaacctggcggcagcgcaaaagatg

SEQ ID NO: 196631 - DNA, 103 bp, Artificial Sequence
  Synthetic Polynucleotide
taatacgactcactataggggccatcttcagaatttgctggatgtctgccaacagaggagaggcagaatgccagcaaataacctggcggcagcgcaaaagatg

SEQ ID NO: 196632 - DNA, 103 bp, Artificial Sequence
  Synthetic Polynucleotide
taatacgactcactatagggagccgaggctgccatcttcagaatttgctgaacagaggagacagcaaatgctgaagatgaacctggcggcagcgcaaaagatg

SEQ ID NO: 196633 - DNA, 103 bp, Artificial Sequence
  Synthetic Polynucleotide
taatacgactcactatagggtctgagggggagccgaggctgccatcttcaaacagaggagatgaagaatgcagcctcggaacctggcggcagcgcaaaagatg

SEQ ID NO: 196634 - DNA, 103 bp, Artificial Sequence
  Synthetic Polynucleotide
taatacgactcactatagggggaagactgatctgagggggagccgaggctaacagaggagaagcctcatgtccccctcaaacctggcggcagcgcaaaagatg

SEQ ID NO: 196635 - DNA, 103 bp, Artificial Sequence
  Synthetic Polynucleotide
taatacgactcactatagggggagaagggcggaagactgatctgagggggaacagaggagaccccctatgatcagtcttaacctggcggcagcgcaaaagatg

SEQ ID NO: 196636 - DNA, 103 bp, Artificial Sequence
  Synthetic Polynucleotide
taatacgactcactatagggcaggggccttggagaagggcggaagactgaaacagaggagatcagtcatgcgcccttctaacctggcggcagcgcaaaagatg

SEQ ID NO: 196637 - DNA, 103 bp, Artificial Sequence
  Synthetic Polynucleotide
taatacgactcactatagggagtggggcggcaggggccttggagaagggcaacagaggagagcccttatgcaaggccccaacctggcggcagcgcaaaagatg

SEQ ID NO: 196638 - DNA, 103 bp, Artificial Sequence
  Synthetic Polynucleotide
taatacgactcactataggggatcgcctgcagtggggcggcaggggccttaacagaggagaaaggccatggccgccccaaacctggcggcagcgcaaaagatg

SEQ ID NO: 196639 - DNA, 103 bp, Artificial Sequence
  Synthetic Polynucleotide
taatacgactcactatagggtgtgcttgaagatcgcctgcagtggggcggaacagaggagaccgcccatgtgcaggcgaaacctggcggcagcgcaaaagatg

SEQ ID NO: 196640 - DNA, 103 bp, Artificial Sequence
  Synthetic Polynucleotide
taatacgactcactatagggtggttccttctgccaatccgatttggtcctaacagaggagaaggaccatgtcggattggaacctggcggcagcgcaaaagatg

SEQ ID NO: 196641 - DNA, 103 bp, Artificial Sequence
  Synthetic Polynucleotide
taatacgactcactatagggagagggggcatgtgcttgaagatcgcctgcaacagaggagagcaggcatgcttcaagcaaacctggcggcagcgcaaaagatg

SEQ ID NO: 196642 - DNA, 103 bp, Artificial Sequence
  Synthetic Polynucleotide
taatacgactcactatagggctttggcttcagagggggcatgtgcttgaaaacagaggagattcaagatgatgccccctaacctggcggcagcgcaaaagatg

SEQ ID NO: 196643 - DNA, 103 bp, Artificial Sequence
  Synthetic Polynucleotide
taatacgactcactatagggtgaccaggggctttggcttcagagggggcaaacagaggagatgccccatgtgaagccaaaacctggcggcagcgcaaaagatg

SEQ ID NO: 196644 - DNA, 103 bp, Artificial Sequence
  Synthetic Polynucleotide
taatacgactcactataggggtccgtggtgtgaccaggggctttggcttcaacagaggagagaagccatggcccctggtaacctggcggcagcgcaaaagatg

SEQ ID NO: 196645 - DNA, 103 bp, Artificial Sequence
  Synthetic Polynucleotide
taatacgactcactatagggggccaccaccgtccgtggtgtgaccaggggaacagaggagacccctgatgacaccacggaacctggcggcagcgcaaaagatg

SEQ ID NO: 196646 - DNA, 103 bp, Artificial Sequence
  Synthetic Polynucleotide
taatacgactcactataggggcgtggaggtggccaccaccgtccgtggtgaacagaggagacaccacatgcggtggtggaacctggcggcagcgcaaaagatg

SEQ ID NO: 196647 - DNA, 103 bp, Artificial Sequence
  Synthetic Polynucleotide
taatacgactcactatagggagaggcgggggcgtggaggtggccaccaccaacagaggagaggtggtatgcacctccacaacctggcggcagcgcaaaagatg

SEQ ID NO: 196648 - DNA, 103 bp, Artificial Sequence
  Synthetic Polynucleotide
taatacgactcactatagggggcgttgatgagaggcgggggcgtggaggtaacagaggagaacctccatgcccccgcctaacctggcggcagcgcaaaagatg

SEQ ID NO: 196649 - DNA, 103 bp, Artificial Sequence
  Synthetic Polynucleotide
taatacgactcactatagggaagcctgctgggcgttgatgagaggcggggaacagaggagaccccgcatgtcatcaacgaacctggcggcagcgcaaaagatg

SEQ ID NO: 196650 - DNA, 103 bp, Artificial Sequence
  Synthetic Polynucleotide
taatacgactcactatagggcagcccggggaagcctgctgggcgttgatgaacagaggagacatcaaatgccagcaggcaacctggcggcagcgcaaaagatg

SEQ ID NO: 196651 - DNA, 103 bp, Artificial Sequence
  Synthetic Polynucleotide
taatacgactcactatagggtttcgtttcctggttccttctgccaatccgaacagaggagacggattatgagaaggaacaacctggcggcagcgcaaaagatg

SEQ ID NO: 196652 - DNA, 103 bp, Artificial Sequence
  Synthetic Polynucleotide
taatacgactcactatagggggggctgatacagcccggggaagcctgctgaacagaggagacagcagatgtccccgggcaacctggcggcagcgcaaaagatg

SEQ ID NO: 196653 - DNA, 103 bp, Artificial Sequence
  Synthetic Polynucleotide
taatacgactcactataggggcggcaggctggggctgatacagcccggggaacagaggagaccccggatggtatcagccaacctggcggcagcgcaaaagatg

SEQ ID NO: 196654 - DNA, 103 bp, Artificial Sequence
  Synthetic Polynucleotide
taatacgactcactatagggaggggcggtggcggcaggctggggctgataaacagaggagatatcagatgcagcctgccaacctggcggcagcgcaaaagatg

SEQ ID NO: 196655 - DNA, 103 bp, Artificial Sequence
  Synthetic Polynucleotide
taatacgactcactataggggaggagcttcaggggcggtggcggcaggctaacagaggagaagcctgatgccaccgcccaacctggcggcagcgcaaaagatg

SEQ ID NO: 196656 - DNA, 103 bp, Artificial Sequence
  Synthetic Polynucleotide
taatacgactcactatagggctgagcctttgaggagcttcaggggcggtgaacagaggagacaccgcatgtgaagctccaacctggcggcagcgcaaaagatg

SEQ ID NO: 196657 - DNA, 103 bp, Artificial Sequence
  Synthetic Polynucleotide
taatacgactcactataggggccgcctccactgagcctttgaggagcttcaacagaggagagaagctatgcaaaggctcaacctggcggcagcgcaaaagatg

SEQ ID NO: 196658 - DNA, 103 bp, Artificial Sequence
  Synthetic Polynucleotide
taatacgactcactatagggggcgttggaggccgcctccactgagcctttaacagaggagaaaaggcatggtggaggcgaacctggcggcagcgcaaaagatg

SEQ ID NO: 196659 - DNA, 103 bp, Artificial Sequence
  Synthetic Polynucleotide
taatacgactcactataggggcagcaggtgggcgttggaggccgcctccaaacagaggagatggaggatgcctccaacgaacctggcggcagcgcaaaagatg

SEQ ID NO: 196660 - DNA, 103 bp, Artificial Sequence
  Synthetic Polynucleotide
taatacgactcactataggggacttggactgcagcaggtgggcgttggagaacagaggagactccaaatgccacctgctaacctggcggcagcgcaaaagatg

SEQ ID NO: 196661 - DNA, 103 bp, Artificial Sequence
  Synthetic Polynucleotide
taatacgactcactatagggctgggtcccggacttggactgcagcaggtgaacagaggagacacctgatgcagtccaagaacctggcggcagcgcaaaagatg

SEQ ID NO: 196662 - DNA, 103 bp, Artificial Sequence
  Synthetic Polynucleotide
taatacgactcactatagggacttctcctctttcgtttcctggttccttcaacagaggagagaaggaatgaggaaacgaaacctggcggcagcgcaaaagatg

SEQ ID NO: 196663 - DNA, 103 bp, Artificial Sequence
  Synthetic Polynucleotide
taatacgactcactatagggccgcgtggggctgggtcccggacttggactaacagaggagaagtccaatgccgggacccaacctggcggcagcgcaaaagatg

SEQ ID NO: 196664 - DNA, 103 bp, Artificial Sequence
  Synthetic Polynucleotide
taatacgactcactatagggagccgcgtggccgcgtggggctgggtcccgaacagaggagacgggacatggccccacgcaacctggcggcagcgcaaaagatg

SEQ ID NO: 196665 - DNA, 103 bp, Artificial Sequence
  Synthetic Polynucleotide
taatacgactcactatagggctgcagggagagccgcgtggccgcgtggggaacagaggagaccccacatggccacgcggaacctggcggcagcgcaaaagatg

SEQ ID NO: 196666 - DNA, 103 bp, Artificial Sequence
  Synthetic Polynucleotide
taatacgactcactatagggcccgcggctgctgcagggagagccgcgtggaacagaggagaccacgcatgtctccctgcaacctggcggcagcgcaaaagatg

SEQ ID NO: 196667 - DNA, 103 bp, Artificial Sequence
  Synthetic Polynucleotide
taatacgactcactatagggggcagctccgcccgcggctgctgcagggagaacagaggagactccctatggcagccgcgaacctggcggcagcgcaaaagatg

SEQ ID NO: 196668 - DNA, 103 bp, Artificial Sequence
  Synthetic Polynucleotide
taatacgactcactatagggaggctggcccggcagctccgcccgcggctgaacagaggagacagccgatggcggagctgaacctggcggcagcgcaaaagatg

SEQ ID NO: 196669 - DNA, 103 bp, Artificial Sequence
  Synthetic Polynucleotide
taatacgactcactatagggtcttcatctcaggctggcccggcagctccgaacagaggagacggagcatgcgggccagcaacctggcggcagcgcaaaagatg

SEQ ID NO: 196670 - DNA, 103 bp, Artificial Sequence
  Synthetic Polynucleotide
taatacgactcactatagggtccagctgcgtcttcatctcaggctggcccaacagaggagagggccaatgtgagatgaaaacctggcggcagcgcaaaagatg

SEQ ID NO: 196671 - DNA, 103 bp, Artificial Sequence
  Synthetic Polynucleotide
taatacgactcactataggggctgtcctgctccagctgcgtcttcatctcaacagaggagagagatgatgacgcagctgaacctggcggcagcgcaaaagatg

SEQ ID NO: 196672 - DNA, 103 bp, Artificial Sequence
  Synthetic Polynucleotide
taatacgactcactatagggcctcgatgatgctgtcctgctccagctgcgaacagaggagacgcagcatgagcaggacaaacctggcggcagcgcaaaagatg

SEQ ID NO: 196673 - DNA, 103 bp, Artificial Sequence
  Synthetic Polynucleotide
taatacgactcactatagggttataggaagacttctcctctttcgtttccaacagaggagaggaaacatgagaggagaaaacctggcggcagcgcaaaagatg

SEQ ID NO: 196674 - DNA, 103 bp, Artificial Sequence
  Synthetic Polynucleotide
taatacgactcactatagggggcagcagggcctcgatgatgctgtcctgcaacagaggagagcaggaatgcatcatcgaaacctggcggcagcgcaaaagatg

SEQ ID NO: 196675 - DNA, 103 bp, Artificial Sequence
  Synthetic Polynucleotide
taatacgactcactatagggcatgctcagcggcagcagggcctcgatgataacagaggagaatcatcatggccctgctgaacctggcggcagcgcaaaagatg

SEQ ID NO: 196676 - DNA, 103 bp, Artificial Sequence
  Synthetic Polynucleotide
taatacgactcactatagggtcttggcctccatgctcagcggcagcagggaacagaggagaccctgcatgcgctgagcaaacctggcggcagcgcaaaagatg

SEQ ID NO: 196677 - DNA, 103 bp, Artificial Sequence
  Synthetic Polynucleotide
taatacgactcactatagggtcctgcttgatcttggcctccatgctcagcaacagaggagagctgagatgggaggccaaaacctggcggcagcgcaaaagatg

SEQ ID NO: 196678 - DNA, 103 bp, Artificial Sequence
  Synthetic Polynucleotide
taatacgactcactatagggctctgtgatctcctgcttgatcttggcctcaacagaggagagaggccatgatcaagcagaacctggcggcagcgcaaaagatg

SEQ ID NO: 196679 - DNA, 103 bp, Artificial Sequence
  Synthetic Polynucleotide
taatacgactcactatagggtgagttccccctctgtgatctcctgcttgaaacagaggagatcaagcatgagatcacagaacctggcggcagcgcaaaagatg

SEQ ID NO: 196680 - DNA, 103 bp, Artificial Sequence
  Synthetic Polynucleotide
taatacgactcactatagggatgaaggccttgagttccccctctgtgatcaacagaggagagatcacatggggggaactaacctggcggcagcgcaaaagatg

SEQ ID NO: 196681 - DNA, 103 bp, Artificial Sequence
  Synthetic Polynucleotide
taatacgactcactataggggggcgctgtcatgaaggccttgagttccccaacagaggagaggggaaatgaaggccttcaacctggcggcagcgcaaaagatg

SEQ ID NO: 196682 - DNA, 103 bp, Artificial Sequence
  Synthetic Polynucleotide
taatacgactcactatagggtcttgccgccgggcgctgtcatgaaggcctaacagaggagaaggcctatgtgacagcgcaacctggcggcagcgcaaaagatg

SEQ ID NO: 196683 - DNA, 103 bp, Artificial Sequence
  Synthetic Polynucleotide
taatacgactcactataggggcgggcgtcttcttgccgccgggcgctgtcaacagaggagagacagcatgcggcggcaaaacctggcggcagcgcaaaagatg

SEQ ID NO: 196684 - DNA, 103 bp, Artificial Sequence
  Synthetic Polynucleotide
taatacgactcactatagggcagggggcagttataggaagacttctcctcaacagaggagagaggagatgtcttcctataacctggcggcagcgcaaaagatg

SEQ ID NO: 196685 - DNA, 103 bp, Artificial Sequence
  Synthetic Polynucleotide
taatacgactcactatagggcttgcgcatggcgggcgtcttcttgccgccaacagaggagaggcggcatgaagacgcccaacctggcggcagcgcaaaagatg

SEQ ID NO: 196686 - DNA, 103 bp, Artificial Sequence
  Synthetic Polynucleotide
taatacgactcactatagggggtagagcaccttgcgcatggcgggcgtctaacagaggagaagacgcatgccatgcgcaaacctggcggcagcgcaaaagatg

SEQ ID NO: 196687 - DNA, 103 bp, Artificial Sequence
  Synthetic Polynucleotide
taatacgactcactatagggaagcggcaggggtagagcaccttgcgcatgaacagaggagacatgcgatgggtgctctaaacctggcggcagcgcaaaagatg

SEQ ID NO: 196688 - DNA, 103 bp, Artificial Sequence
  Synthetic Polynucleotide
taatacgactcactatagggctggttgcagaagcggcaggggtagagcacaacagaggagagtgctcatgccctgccgcaacctggcggcagcgcaaaagatg

SEQ ID NO: 196689 - DNA, 103 bp, Artificial Sequence
  Synthetic Polynucleotide
taatacgactcactatagggaggcaaacacctggttgcagaagcggcaggaacagaggagacctgccatgtctgcaaccaacctggcggcagcgcaaaagatg

SEQ ID NO: 196690 - DNA, 103 bp, Artificial Sequence
  Synthetic Polynucleotide
taatacgactcactatagggacccccgagaaggcaaacacctggttgcagaacagaggagactgcaaatgggtgtttgcaacctggcggcagcgcaaaagatg

SEQ ID NO: 196691 - DNA, 103 bp, Artificial Sequence
  Synthetic Polynucleotide
taatacgactcactatagggggcacgcaagacccccgagaaggcaaacacaacagaggagagtgtttatgttctcggggaacctggcggcagcgcaaaagatg

SEQ ID NO: 196692 - DNA, 103 bp, Artificial Sequence
  Synthetic Polynucleotide
taatacgactcactatagggagcgcacgtgggcacgcaagacccccgagaaacagaggagatctcggatgtcttgcgtgaacctggcggcagcgcaaaagatg

SEQ ID NO: 196693 - DNA, 103 bp, Artificial Sequence
  Synthetic Polynucleotide
taatacgactcactatagggcccaggtgggagcgcacgtgggcacgcaagaacagaggagacttgcgatgccacgtgcgaacctggcggcagcgcaaaagatg

SEQ ID NO: 196694 - DNA, 103 bp, Artificial Sequence
  Synthetic Polynucleotide
taatacgactcactatagggtggcgagatgcccaggtgggagcgcacgtgaacagaggagacacgtgatgtcccacctgaacctggcggcagcgcaaaagatg

SEQ ID NO: 196695 - DNA, 103 bp, Artificial Sequence
  Synthetic Polynucleotide
taatacgactcactatagggggtctgaaccttccaagccagcgggcgaacaacagaggagagttcgcatgctggcttggaacctggcggcagcgcaaaagatg

SEQ ID NO: 196696 - DNA, 103 bp, Artificial Sequence
  Synthetic Polynucleotide
taatacgactcactatagggtcttctcacacagggggcagttataggaagaacagaggagacttcctatgactgcccccaacctggcggcagcgcaaaagatg

SEQ ID NO: 196697 - DNA, 103 bp, Artificial Sequence
  Synthetic Polynucleotide
taatacgactcactatagggtgcactggtatggcgagatgcccaggtgggaacagaggagacccaccatggcatctcgcaacctggcggcagcgcaaaagatg

SEQ ID NO: 196698 - DNA, 103 bp, Artificial Sequence
  Synthetic Polynucleotide
taatacgactcactatagggtcgcagatgttgcactggtatggcgagatgaacagaggagacatctcatgataccagtgaacctggcggcagcgcaaaagatg

SEQ ID NO: 196699 - DNA, 103 bp, Artificial Sequence
  Synthetic Polynucleotide
taatacgactcactatagggggcgatgtagtcgcagatgttgcactggtaaacagaggagataccagatgaacatctgcaacctggcggcagcgcaaaagatg

SEQ ID NO: 196700 - DNA, 103 bp, Artificial Sequence
  Synthetic Polynucleotide
taatacgactcactatagggccttgtcggcggcgatgtagtcgcagatgtaacagaggagaacatctatgactacatcgaacctggcggcagcgcaaaagatg

SEQ ID NO: 196701 - DNA, 103 bp, Artificial Sequence
  Synthetic Polynucleotide
taatacgactcactatagggatgagcgcggccttgtcggcggcgatgtagaacagaggagactacatatgcgccgacaaaacctggcggcagcgcaaaagatg

SEQ ID NO: 196702 - DNA, 103 bp, Artificial Sequence
  Synthetic Polynucleotide
taatacgactcactatagggcaggtggcggatgagcgcggccttgtcggcaacagaggagagccgacatggccgcgctcaacctggcggcagcgcaaaagatg

SEQ ID NO: 196703 - DNA, 103 bp, Artificial Sequence
  Synthetic Polynucleotide
taatacgactcactatagggtgtgcgtgcgcaggtggcggatgagcgcggaacagaggagaccgcgcatgtccgccaccaacctggcggcagcgcaaaagatg

SEQ ID NO: 196704 - DNA, 103 bp, Artificial Sequence
  Synthetic Polynucleotide
taatacgactcactatagggcgctccccactgtgcgtgcgcaggtggcggaacagaggagaccgccaatggcgcacgcaaacctggcggcagcgcaaaagatg

SEQ ID NO: 196705 - DNA, 103 bp, Artificial Sequence
  Synthetic Polynucleotide
taatacgactcactatagggaatgtagggccgctccccactgtgcgtgcgaacagaggagacgcacgatgagtggggagaacctggcggcagcgcaaaagatg

SEQ ID NO: 196706 - DNA, 103 bp, Artificial Sequence
  Synthetic Polynucleotide
taatacgactcactatagggagatcttgcaaatgtagggccgctccccacaacagaggagagtggggatgggccctacaaacctggcggcagcgcaaaagatg

SEQ ID NO: 196707 - DNA, 103 bp, Artificial Sequence
  Synthetic Polynucleotide
taatacgactcactataggggtagtgcaaatcttctcacacagggggcagaacagaggagactgcccatggtgtgagaaaacctggcggcagcgcaaaagatg

SEQ ID NO: 196708 - DNA, 103 bp, Artificial Sequence
  Synthetic Polynucleotide
taatacgactcactataggggggtagtggcagatcttgcaaatgtagggcaacagaggagagccctaatgttgcaagataacctggcggcagcgcaaaagatg

SEQ ID NO: 196709 - DNA, 103 bp, Artificial Sequence
  Synthetic Polynucleotide
taatacgactcactataggggacagtgaaggggtagtggcagatcttgcaaacagaggagatgcaagatgtgccactacaacctggcggcagcgcaaaagatg

SEQ ID NO: 196710 - DNA, 103 bp, Artificial Sequence
  Synthetic Polynucleotide
taatacgactcactatagggagttggctttgacagtgaaggggtagtggcaacagaggagagccactatgccttcactgaacctggcggcagcgcaaaagatg

SEQ ID NO: 196711 - DNA, 103 bp, Artificial Sequence
  Synthetic Polynucleotide
taatacgactcactatagggtgccgctcgcagttggctttgacagtgaagaacagaggagacttcacatgcaaagccaaaacctggcggcagcgcaaaagatg

SEQ ID NO: 196712 - DNA, 103 bp, Artificial Sequence
  Synthetic Polynucleotide
taatacgactcactatagggcttgcgcaggtgccgctcgcagttggctttaacagaggagaaaagccatgtgcgagcggaacctggcggcagcgcaaaagatg

SEQ ID NO: 196713 - DNA, 103 bp, Artificial Sequence
  Synthetic Polynucleotide
taatacgactcactatagggtgaggtgcttcttgcgcaggtgccgctcgcaacagaggagagcgagcatgacctgcgcaaacctggcggcagcgcaaaagatg

SEQ ID NO: 196714 - DNA, 103 bp, Artificial Sequence
  Synthetic Polynucleotide
taatacgactcactatagggcgggtggccttgaggtgcttcttgcgcaggaacagaggagacctgcgatggaagcacctaacctggcggcagcgcaaaagatg

SEQ ID NO: 196715 - DNA, 103 bp, Artificial Sequence
  Synthetic Polynucleotide
taatacgactcactataggggatatccttgcgggtggccttgaggtgcttaacagaggagaaagcacatgaaggccaccaacctggcggcagcgcaaaagatg

SEQ ID NO: 196716 - DNA, 103 bp, Artificial Sequence
  Synthetic Polynucleotide
taatacgactcactatagggtgttcttctcgatatccttgcgggtggcctaacagaggagaaggccaatggcaaggataaacctggcggcagcgcaaaagatg

SEQ ID NO: 196717 - DNA, 103 bp, Artificial Sequence
  Synthetic Polynucleotide
taatacgactcactatagggacatactcgatgttcttctcgatatccttgaacagaggagacaaggaatgcgagaagaaaacctggcggcagcgcaaaagatg

SEQ ID NO: 196718 - DNA, 103 bp, Artificial Sequence
  Synthetic Polynucleotide
taatacgactcactatagggctggtgctgggtagtgcaaatcttctcacaaacagaggagatgtgagatgatttgcactaacctggcggcagcgcaaaagatg

SEQ ID NO: 196719 - DNA, 103 bp, Artificial Sequence
  Synthetic Polynucleotide
taatacgactcactataggggctgctactcacatactcgatgttcttctcaacagaggagagagaagatgatcgagtataacctggcggcagcgcaaaagatg

SEQ ID NO: 196720 - DNA, 103 bp, Artificial Sequence
  Synthetic Polynucleotide
taatacgactcactataggggctcggccgcgctgctactcacatactcgaaacagaggagatcgagtatgtgagtagcaaacctggcggcagcgcaaaagatg

SEQ ID NO: 196721 - DNA, 103 bp, Artificial Sequence
  Synthetic Polynucleotide
taatacgactcactataggggcgtccaccagctcggccgcgctgctactcaacagaggagagagtagatgcgcggccgaaacctggcggcagcgcaaaagatg

SEQ ID NO: 196722 - DNA, 103 bp, Artificial Sequence
  Synthetic Polynucleotide
taatacgactcactatagggggcgcagaaggcgtccaccagctcggccgcaacagaggagagcggccatgctggtggacaacctggcggcagcgcaaaagatg

SEQ ID NO: 196723 - DNA, 103 bp, Artificial Sequence
  Synthetic Polynucleotide
taatacgactcactatagggcggtgtccggggcgcagaaggcgtccaccaaacagaggagatggtggatgccttctgcgaacctggcggcagcgcaaaagatg

SEQ ID NO: 196724 - DNA, 103 bp, Artificial Sequence
  Synthetic Polynucleotide
taatacgactcactatagggagccggcacacggtgtccggggcgcagaagaacagaggagacttctgatgcccggacacaacctggcggcagcgcaaaagatg

SEQ ID NO: 196725 - DNA, 103 bp, Artificial Sequence
  Synthetic Polynucleotide
taatacgactcactatagggctcgccgcacagccggcacacggtgtccggaacagaggagaccggacatggtgtgccggaacctggcggcagcgcaaaagatg

SEQ ID NO: 196726 - DNA, 103 bp, Artificial Sequence
  Synthetic Polynucleotide
taatacgactcactataggggcttgaggtcctcgccgcacagccggcacaaacagaggagatgtgccatgtgtgcggcgaacctggcggcagcgcaaaagatg

SEQ ID NO: 196727 - DNA, 103 bp, Artificial Sequence
  Synthetic Polynucleotide
taatacgactcactataggggcacgatagtgcttgaggtcctcgccgcacaacagaggagagtgcggatgggacctcaaaacctggcggcagcgcaaaagatg

SEQ ID NO: 196728 - DNA, 103 bp, Artificial Sequence
  Synthetic Polynucleotide
taatacgactcactataggggatgcgcagggcacgatagtgcttgaggtcaacagaggagagacctcatgcactatcgtaacctggcggcagcgcaaaagatg

SEQ ID NO: 196729 - DNA, 103 bp, Artificial Sequence
  Synthetic Polynucleotide
taatacgactcactataggggcatggtcagctggtgctgggtagtgcaaaaacagaggagatttgcaatgcccagcaccaacctggcggcagcgcaaaagatg

SEQ ID NO: 196730 - DNA, 103 bp, Artificial Sequence
  Synthetic Polynucleotide
taatacgactcactatagggtgcgcatgtggatgcgcagggcacgatagtaacagaggagaactatcatgccctgcgcaaacctggcggcagcgcaaaagatg

SEQ ID NO: 196731 - DNA, 103 bp, Artificial Sequence
  Synthetic Polynucleotide
taatacgactcactatagggccgcagtgcgtgcgcatgtggatgcgcaggaacagaggagacctgcgatgccacatgcgaacctggcggcagcgcaaaagatg

SEQ ID NO: 196732 - DNA, 103 bp, Artificial Sequence
  Synthetic Polynucleotide
taatacgactcactatagggcaggccgcggccgcagtgcgtgcgcatgtgaacagaggagacacatgatgacgcactgcaacctggcggcagcgcaaaagatg

SEQ ID NO: 196733 - DNA, 103 bp, Artificial Sequence
  Synthetic Polynucleotide
taatacgactcactatagggggcccccgcccaggccgcggccgcagtgcgaacagaggagacgcactatggccgcggccaacctggcggcagcgcaaaagatg

SEQ ID NO: 196734 - DNA, 103 bp, Artificial Sequence
  Synthetic Polynucleotide
taatacgactcactatagggcggcccttgtggcccccgcccaggccgcggaacagaggagaccgcggatggggcgggggaacctggcggcagcgcaaaagatg

SEQ ID NO: 196735 - DNA, 103 bp, Artificial Sequence
  Synthetic Polynucleotide
taatacgactcactataggggaagggcttgcggcccttgtggcccccgccaacagaggagaggcgggatgcacaagggcaacctggcggcagcgcaaaagatg

SEQ ID NO: 196736 - DNA, 103 bp, Artificial Sequence
  Synthetic Polynucleotide
taatacgactcactatagggccttgcactcgaagggcttgcggcccttgtaacagaggagaacaaggatggcaagccctaacctggcggcagcgcaaaagatg

SEQ ID NO: 196737 - DNA, 103 bp, Artificial Sequence
  Synthetic Polynucleotide
taatacgactcactataggggcgctgcactccttgcactcgaagggcttgaacagaggagacaagccatgcgagtgcaaaacctggcggcagcgcaaaagatg

SEQ ID NO: 196738 - DNA, 103 bp, Artificial Sequence
  Synthetic Polynucleotide
taatacgactcactatagggcgcgaacgcggcgctgcactccttgcactcaacagaggagagagtgcatggagtgcagcaacctggcggcagcgcaaaagatg

SEQ ID NO: 196739 - DNA, 103 bp, Artificial Sequence
  Synthetic Polynucleotide
taatacgactcactatagggtgcgcttggccgcgaacgcggcgctgcactaacagaggagaagtgcaatgccgcgttcgaacctggcggcagcgcaaaagatg

SEQ ID NO: 196740 - DNA, 103 bp, Artificial Sequence
  Synthetic Polynucleotide
taatacgactcactatagggtggcgaatgtgcatggtcagctggtgctggaacagaggagaccagcaatggctgaccataacctggcggcagcgcaaaagatg

SEQ ID NO: 196741 - DNA, 103 bp, Artificial Sequence
  Synthetic Polynucleotide
taatacgactcactatagggtggatgcagttgcgcttggccgcgaacgcgaacagaggagacgcgttatgggccaagcgaacctggcggcagcgcaaaagatg

SEQ ID NO: 196742 - DNA, 103 bp, Artificial Sequence
  Synthetic Polynucleotide
taatacgactcactataggggaggatgtggtggatgcagttgcgcttggcaacagaggagagccaagatgaactgcatcaacctggcggcagcgcaaaagatg

SEQ ID NO: 196743 - DNA, 103 bp, Artificial Sequence
  Synthetic Polynucleotide
taatacgactcactatagggggtgctgcttgaggatgtggtggatgcagtaacagaggagaactgcaatgaccacatccaacctggcggcagcgcaaaagatg

SEQ ID NO: 196744 - DNA, 103 bp, Artificial Sequence
  Synthetic Polynucleotide
taatacgactcactatagggggcacgtgcaggtgctgcttgaggatgtggaacagaggagaccacatatgcaagcagcaaacctggcggcagcgcaaaagatg

SEQ ID NO: 196745 - DNA, 103 bp, Artificial Sequence
  Synthetic Polynucleotide
taatacgactcactataggggtcctgctcgggcacgtgcaggtgctgcttaacagaggagaaagcagatgctgcacgtgaacctggcggcagcgcaaaagatg

SEQ ID NO: 196746 - DNA, 103 bp, Artificial Sequence
  Synthetic Polynucleotide
taatacgactcactatagggagctctcgatgtcctgctcgggcacgtgcaaacagaggagatgcacgatgccgagcaggaacctggcggcagcgcaaaagatg

SEQ ID NO: 196747 - DNA, 103 bp, Artificial Sequence
  Synthetic Polynucleotide
taatacgactcactataggggccagcacgtagctctcgatgtcctgctcgaacagaggagacgagcaatgcatcgagagaacctggcggcagcgcaaaagatg

SEQ ID NO: 196748 - DNA, 103 bp, Artificial Sequence
  Synthetic Polynucleotide
taatacgactcactataggggccgtcggcggccagcacgtagctctcgataacagaggagaatcgagatgtacgtgctgaacctggcggcagcgcaaaagatg

SEQ ID NO: 196749 - DNA, 103 bp, Artificial Sequence
  Synthetic Polynucleotide
taatacgactcactatagggcggggcccaggccgtcggcggccagcacgtaacagaggagaacgtgcatgccgccgacgaacctggcggcagcgcaaaagatg

SEQ ID NO: 196750 - DNA, 103 bp, Artificial Sequence
  Synthetic Polynucleotide
taatacgactcactatagggggcgcctctgcggggcccaggccgtcggcgaacagaggagacgccgaatgcctgggcccaacctggcggcagcgcaaaagatg

SEQ ID NO: 196751 - DNA, 103 bp, Artificial Sequence
  Synthetic Polynucleotide
taatacgactcactatagggtgtgttgtgctggcgaatgtgcatggtcagaacagaggagactgaccatgcacattcgcaacctggcggcagcgcaaaagatg

SEQ ID NO: 196752 - DNA, 103 bp, Artificial Sequence
  Synthetic Polynucleotide
taatacgactcactatagggctcagcggccggcgcctctgcggggcccagaacagaggagactgggcatggcagaggcgaacctggcggcagcgcaaaagatg

SEQ ID NO: 196753 - DNA, 103 bp, Artificial Sequence
  Synthetic Polynucleotide
taatacgactcactataggggccccgacgcctcagcggccggcgcctctgaacagaggagacagaggatgcggccgctgaacctggcggcagcgcaaaagatg

SEQ ID NO: 196754 - DNA, 103 bp, Artificial Sequence
  Synthetic Polynucleotide
taatacgactcactatagggtcctccccgcgccccgacgcctcagcggccaacagaggagaggccgcatgggcgtcgggaacctggcggcagcgcaaaagatg

SEQ ID NO: 196755 - DNA, 103 bp, Artificial Sequence
  Synthetic Polynucleotide
taatacgactcactataggggcagccactgtcctccccgcgccccgacgcaacagaggagagcgtcgatgcgcggggagaacctggcggcagcgcaaaagatg

SEQ ID NO: 196756 - DNA, 103 bp, Artificial Sequence
  Synthetic Polynucleotide
taatacgactcactatagggcaagggcagcgcagccactgtcctccccgcaacagaggagagcggggatgacagtggctaacctggcggcagcgcaaaagatg

SEQ ID NO: 196757 - DNA, 103 bp, Artificial Sequence
  Synthetic Polynucleotide
taatacgactcactatagggttgcagtcaccaagggcagcgcagccactgaacagaggagacagtggatgcgctgccctaacctggcggcagcgcaaaagatg

SEQ ID NO: 196758 - DNA, 103 bp, Artificial Sequence
  Synthetic Polynucleotide
taatacgactcactatagggagtgaggggcttgcagtcaccaagggcagcaacagaggagagctgccatgggtgactgcaacctggcggcagcgcaaaagatg

SEQ ID NO: 196759 - DNA, 103 bp, Artificial Sequence
  Synthetic Polynucleotide
taatacgactcactatagggccaggaaggcagtgaggggcttgcagtcacaacagaggagagtgactatgagcccctcaaacctggcggcagcgcaaaagatg

SEQ ID NO: 196760 - DNA, 103 bp, Artificial Sequence
  Synthetic Polynucleotide
taatacgactcactatagggttctggggttccaggaaggcagtgaggggcaacagaggagagcccctatgtgccttcctaacctggcggcagcgcaaaagatg

SEQ ID NO: 196761 - DNA, 103 bp, Artificial Sequence
  Synthetic Polynucleotide
taatacgactcactatagggaagaaagccgttctggggttccaggaaggcaacagaggagagccttcatggaaccccagaacctggcggcagcgcaaaagatg

SEQ ID NO: 196762 - DNA, 103 bp, Artificial Sequence
  Synthetic Polynucleotide
taatacgactcactatagggctccagtgtctgtgttgtgctggcgaatgtaacagaggagaacattcatgagcacaacaaacctggcggcagcgcaaaagatg

SEQ ID NO: 196763 - DNA, 103 bp, Artificial Sequence
  Synthetic Polynucleotide
taatacgactcactatagggggcccctgtgaagaaagccgttctggggttaacagaggagaaaccccatgacggctttcaacctggcggcagcgcaaaagatg

SEQ ID NO: 196764 - DNA, 103 bp, Artificial Sequence
  Synthetic Polynucleotide
taatacgactcactatagggggctgggtggggcccctgtgaagaaagccgaacagaggagacggcttatgtcacaggggaacctggcggcagcgcaaaagatg

SEQ ID NO: 196765 - DNA, 103 bp, Artificial Sequence
  Synthetic Polynucleotide
taatacgactcactataggggggaggtggaggctgggtggggcccctgtgaacagaggagacacaggatgcccacccagaacctggcggcagcgcaaaagatg

SEQ ID NO: 196766 - DNA, 103 bp, Artificial Sequence
  Synthetic Polynucleotide
taatacgactcactatagggtcgagacatggggaggtggaggctgggtggaacagaggagaccacccatgctccacctcaacctggcggcagcgcaaaagatg

SEQ ID NO: 196767 - DNA, 103 bp, Artificial Sequence
  Synthetic Polynucleotide
taatacgactcactatagggtccaacttgatcgagacatggggaggtggaaacagaggagatccaccatgccatgtctcaacctggcggcagcgcaaaagatg

SEQ ID NO: 196768 - DNA, 103 bp, Artificial Sequence
  Synthetic Polynucleotide
taatacgactcactatagggactggcgggctccaacttgatcgagacatgaacagaggagacatgtcatgatcaagttgaacctggcggcagcgcaaaagatg

SEQ ID NO: 196769 - DNA, 103 bp, Artificial Sequence
  Synthetic Polynucleotide
taatacgactcactatagggccgcaaagctactggcgggctccaacttgaaacagaggagatcaagtatgagcccgccaaacctggcggcagcgcaaaagatg

SEQ ID NO: 196770 - DNA, 103 bp, Artificial Sequence
  Synthetic Polynucleotide
taatacgactcactatagggttgaagtccaccgcaaagctactggcgggcaacagaggagagcccgcatgtagctttgcaacctggcggcagcgcaaaagatg

SEQ ID NO: 196771 - DNA, 103 bp, Artificial Sequence
  Synthetic Polynucleotide
taatacgactcactatagggcaggggctcattgaagtccaccgcaaagctaacagaggagaagctttatggtggacttcaacctggcggcagcgcaaaagatg

SEQ ID NO: 196772 - DNA, 103 bp, Artificial Sequence
  Synthetic Polynucleotide
taatacgactcactataggggcgagaagtccaggggctcattgaagtccaaacagaggagatggactatgatgagccccaacctggcggcagcgcaaaagatg

SEQ ID NO: 196773 - DNA, 103 bp, Artificial Sequence
  Synthetic Polynucleotide
taatacgactcactatagggtggtcggctcctccagtgtctgtgttgtgcaacagaggagagcacaaatgagacactggaacctggcggcagcgcaaaagatg

SEQ ID NO: 196774 - DNA, 103 bp, Artificial Sequence
  Synthetic Polynucleotide
taatacgactcactatagggaggcccttctgcgagaagtccaggggctcaaacagaggagatgagccatgggacttctcaacctggcggcagcgcaaaagatg

SEQ ID NO: 196775 - DNA, 103 bp, Artificial Sequence
  Synthetic Polynucleotide
taatacgactcactataggggaccagggccaggcccttctgcgagaagtcaacagaggagagacttcatgcagaagggcaacctggcggcagcgcaaaagatg

SEQ ID NO: 196776 - DNA, 103 bp, Artificial Sequence
  Synthetic Polynucleotide
taatacgactcactataggggcttcacttggaccagggccaggcccttctaacagaggagaagaaggatgtggccctggaacctggcggcagcgcaaaagatg

SEQ ID NO: 196777 - DNA, 103 bp, Artificial Sequence
  Synthetic Polynucleotide
taatacgactcactatagggatgttttcctgcttcacttggaccagggccaacagaggagaggccctatgccaagtgaaaacctggcggcagcgcaaaagatg

SEQ ID NO: 196778 - DNA, 103 bp, Artificial Sequence
  Synthetic Polynucleotide
taatacgactcactatagggcagaaaggagatgttttcctgcttcacttgaacagaggagacaagtgatgcaggaaaacaacctggcggcagcgcaaaagatg

SEQ ID NO: 196779 - DNA, 103 bp, Artificial Sequence
  Synthetic Polynucleotide
taatacgactcactatagggaagaagggctcagaaaggagatgttttcctaacagaggagaaggaaaatgtctcctttcaacctggcggcagcgcaaaagatg

SEQ ID NO: 196780 - DNA, 103 bp, Artificial Sequence
  Synthetic Polynucleotide
taatacgactcactataggggggaccagggaagaagggctcagaaaggagaacagaggagactccttatggagcccttcaacctggcggcagcgcaaaagatg

SEQ ID NO: 196781 - DNA, 103 bp, Artificial Sequence
  Synthetic Polynucleotide
taatacgactcactataggggcagtcataggggaccagggaagaagggctaacagaggagaagccctatgtccctggtcaacctggcggcagcgcaaaagatg

SEQ ID NO: 196782 - DNA, 103 bp, Artificial Sequence
  Synthetic Polynucleotide
taatacgactcactataggggctccatggagcagtcataggggaccagggaacagaggagaccctggatgcctatgactaacctggcggcagcgcaaaagatg

SEQ ID NO: 196783 - DNA, 103 bp, Artificial Sequence
  Synthetic Polynucleotide
taatacgactcactatagggaggtcgatgggctccatggagcagtcatagaacagaggagactatgaatgctccatggaaacctggcggcagcgcaaaagatg

SEQ ID NO: 196784 - DNA, 103 bp, Artificial Sequence
  Synthetic Polynucleotide
taatacgactcactataggggctgcatgagtggtcggctcctccagtgtcaacagaggagagacactatgggagccgacaacctggcggcagcgcaaaagatg

SEQ ID NO: 196785 - DNA, 103 bp, Artificial Sequence
  Synthetic Polynucleotide
taatacgactcactatagggggggatggacaggtcgatgggctccatggaaacagaggagatccatgatgcccatcgacaacctggcggcagcgcaaaagatg

SEQ ID NO: 196786 - DNA, 103 bp, Artificial Sequence
  Synthetic Polynucleotide
taatacgactcactatagggtgaagttcttggggatggacaggtcgatggaacagaggagaccatcgatgtgtccatccaacctggcggcagcgcaaaagatg

SEQ ID NO: 196787 - DNA, 103 bp, Artificial Sequence
  Synthetic Polynucleotide
taatacgactcactatagggtcccctttcctgaagttcttggggatggacaacagaggagagtccatatgcaagaacttaacctggcggcagcgcaaaagatg

SEQ ID NO: 196788 - DNA, 103 bp, Artificial Sequence
  Synthetic Polynucleotide
taatacgactcactatagggcaaatccttgtcccctttcctgaagttcttaacagaggagaaagaacatgaggaaagggaacctggcggcagcgcaaaagatg

SEQ ID NO: 196789 - DNA, 103 bp, Artificial Sequence
  Synthetic Polynucleotide
taatacgactcactatagggtgggagtggccaaatccttgtcccctttccaacagaggagaggaaagatgacaaggattaacctggcggcagcgcaaaagatg

SEQ ID NO: 196790 - DNA, 103 bp, Artificial Sequence
  Synthetic Polynucleotide
taatacgactcactatagggttggcttcgctgggagtggccaaatccttgaacagaggagacaaggaatgggccactccaacctggcggcagcgcaaaagatg

SEQ ID NO: 196791 - DNA, 103 bp, Artificial Sequence
  Synthetic Polynucleotide
taatacgactcactatagggctcaggcttcttggcttcgctgggagtggcaacagaggagagccactatgagcgaagccaacctggcggcagcgcaaaagatg

SEQ ID NO: 196792 - DNA, 103 bp, Artificial Sequence
  Synthetic Polynucleotide
taatacgactcactatagggccgcctcctcctcaggcttcttggcttcgcaacagaggagagcgaagatgagaagcctgaacctggcggcagcgcaaaagatg

SEQ ID NO: 196793 - DNA, 103 bp, Artificial Sequence
  Synthetic Polynucleotide
taatacgactcactatagggtcgctgctccccgcctcctcctcaggcttcaacagaggagagaagccatgggaggaggcaacctggcggcagcgcaaaagatg

SEQ ID NO: 196794 - DNA, 103 bp, Artificial Sequence
  Synthetic Polynucleotide
taatacgactcactatagggagagggctgctcgctgctccccgcctcctcaacagaggagagaggagatggggagcagcaacctggcggcagcgcaaaagatg

SEQ ID NO: 196795 - DNA, 103 bp, Artificial Sequence
  Synthetic Polynucleotide
taatacgactcactatagggttccgcagatgctgcatgagtggtcggctcaacagaggagagagccgatgactcatgcaaacctggcggcagcgcaaaagatg

SEQ ID NO: 196796 - DNA, 103 bp, Artificial Sequence
  Synthetic Polynucleotide
taatacgactcactatagggctgggcagggagagggctgctcgctgctccaacagaggagaggagcaatgagcagccctaacctggcggcagcgcaaaagatg

SEQ ID NO: 196797 - DNA, 103 bp, Artificial Sequence
  Synthetic Polynucleotide
taatacgactcactataggggggccgggtgctgggcagggagagggctgcaacagaggagagcagccatgtccctgcccaacctggcggcagcgcaaaagatg

SEQ ID NO: 196798 - DNA, 103 bp, Artificial Sequence
  Synthetic Polynucleotide
taatacgactcactatagggaggaagagaagggccgggtgctgggcagggaacagaggagaccctgcatggcacccggcaacctggcggcagcgcaaaagatg

SEQ ID NO: 196799 - DNA, 103 bp, Artificial Sequence
  Synthetic Polynucleotide
taatacgactcactatagggccaaagttacaggaagagaagggccgggtgaacagaggagacacccgatgcttctcttcaacctggcggcagcgcaaaagatg

SEQ ID NO: 196800 - DNA, 103 bp, Artificial Sequence
  Synthetic Polynucleotide
taatacgactcactatagggccgctgggccccaaagttacaggaagagaaaacagaggagattctctatgtgtaactttaacctggcggcagcgcaaaagatg

SEQ ID NO: 196801 - DNA, 103 bp, Artificial Sequence
  Synthetic Polynucleotide
taatacgactcactatagggttccaggattccgctgggccccaaagttacaacagaggagagtaactatggggcccagcaacctggcggcagcgcaaaagatg

SEQ ID NO: 196802 - DNA, 103 bp, Artificial Sequence
  Synthetic Polynucleotide
taatacgactcactatagggccatggggctttccaggattccgctgggccaacagaggagaggcccaatggaatcctggaacctggcggcagcgcaaaagatg

SEQ ID NO: 196803 - DNA, 103 bp, Artificial Sequence
  Synthetic Polynucleotide
taatacgactcactatagggggagcaggggccatggggctttccaggattaacagaggagaaatcctatgaagccccataacctggcggcagcgcaaaagatg

SEQ ID NO: 196804 - DNA, 103 bp, Artificial Sequence
  Synthetic Polynucleotide
taatacgactcactatagggggtggccgccggagcaggggccatggggctaacagaggagaagccccatggcccctgctaacctggcggcagcgcaaaagatg

SEQ ID NO: 196805 - DNA, 103 bp, Artificial Sequence
  Synthetic Polynucleotide
taatacgactcactatagggggggttccggggtggccgccggagcaggggaacagaggagacccctgatgcggcggccaaacctggcggcagcgcaaaagatg

SEQ ID NO: 196806 - DNA, 103 bp, Artificial Sequence
  Synthetic Polynucleotide
taatacgactcactatagggatggaagataggtctgaaccttccaagccaaacagaggagatggcttatgaggttcagaaacctggcggcagcgcaaaagatg

SEQ ID NO: 196807 - DNA, 103 bp, Artificial Sequence
  Synthetic Polynucleotide
taatacgactcactatagggctcagtgactttccgcagatgctgcatgagaacagaggagactcatgatgcatctgcggaacctggcggcagcgcaaaagatg

SEQ ID NO: 196808 - DNA, 103 bp, Artificial Sequence
  Synthetic Polynucleotide
taatacgactcactatagggggctgtgctgggggttccggggtggccgccaacagaggagaggcggcatgcccggaaccaacctggcggcagcgcaaaagatg

SEQ ID NO: 196809 - DNA, 103 bp, Artificial Sequence
  Synthetic Polynucleotide
taatacgactcactataggggccctgcaggggctgtgctgggggttccggaacagaggagaccggaaatgccagcacagaacctggcggcagcgcaaaagatg

SEQ ID NO: 196810 - DNA, 103 bp, Artificial Sequence
  Synthetic Polynucleotide
taatacgactcactataggggctgaacagggccctgcaggggctgtgctgaacagaggagacagcacatgccctgcaggaacctggcggcagcgcaaaagatg

SEQ ID NO: 196811 - DNA, 103 bp, Artificial Sequence
  Synthetic Polynucleotide
taatacgactcactataggggggaccgccagctgaacagggccctgcaggaacagaggagacctgcaatgccctgttcaaacctggcggcagcgcaaaagatg

SEQ ID NO: 196812 - DNA, 103 bp, Artificial Sequence
  Synthetic Polynucleotide
taatacgactcactatagggggagtagattgggaccgccagctgaacaggaacagaggagacctgttatgctggcggtcaacctggcggcagcgcaaaagatg

SEQ ID NO: 196813 - DNA, 103 bp, Artificial Sequence
  Synthetic Polynucleotide
taatacgactcactatagggccagggctgaggagtagattgggaccgccaaacagaggagatggcggatgcaatctactaacctggcggcagcgcaaaagatg

SEQ ID NO: 196814 - DNA, 103 bp, Artificial Sequence
  Synthetic Polynucleotide
taatacgactcactataggggggctgctgaccagggctgaggagtagattaacagaggagaaatctaatgctcagccctaacctggcggcagcgcaaaagatg

SEQ ID NO: 196815 - DNA, 103 bp, Artificial Sequence
  Synthetic Polynucleotide
taatacgactcactatagggcacgagtggagggctgctgaccagggctgaaacagaggagatcagccatggtcagcagcaacctggcggcagcgcaaaagatg

SEQ ID NO: 196816 - DNA, 103 bp, Artificial Sequence
  Synthetic Polynucleotide
taatacgactcactatagggctgagctgcccacgagtggagggctgctgaaacagaggagatcagcaatgctccactcgaacctggcggcagcgcaaaagatg

SEQ ID NO: 196817 - DNA, 103 bp, Artificial Sequence
  Synthetic Polynucleotide
taatacgactcactatagggctcaggagggctgagctgcccacgagtggaaacagaggagatccactatggggcagctcaacctggcggcagcgcaaaagatg

SEQ ID NO: 196818 - DNA, 103 bp, Artificial Sequence
  Synthetic Polynucleotide
taatacgactcactataggggctggccgagctcagtgactttccgcagataacagaggagaatctgcatgaagtcactgaacctggcggcagcgcaaaagatg

SEQ ID NO: 196819 - DNA, 103 bp, Artificial Sequence
  Synthetic Polynucleotide
taatacgactcactatagggggctgtgccactcaggagggctgagctgccaacagaggagaggcagcatggccctcctgaacctggcggcagcgcaaaagatg

SEQ ID NO: 196820 - DNA, 103 bp, Artificial Sequence
  Synthetic Polynucleotide
taatacgactcactataggggacgcagcaaggctgtgccactcaggagggaacagaggagaccctccatggtggcacagaacctggcggcagcgcaaaagatg

SEQ ID NO: 196821 - DNA, 103 bp, Artificial Sequence
  Synthetic Polynucleotide
taatacgactcactatagggggccgcagtggacgcagcaaggctgtgccaaacagaggagatggcacatgcttgctgcgaacctggcggcagcgcaaaagatg

SEQ ID NO: 196822 - DNA, 103 bp, Artificial Sequence
  Synthetic Polynucleotide
taatacgactcactatagggcgggggcttgggccgcagtggacgcagcaaaacagaggagattgctgatgccactgcggaacctggcggcagcgcaaaagatg

SEQ ID NO: 196823 - DNA, 103 bp, Artificial Sequence
  Synthetic Polynucleotide
taatacgactcactataggggcaaaagcagcgggggcttgggccgcagtgaacagaggagacactgcatgccaagccccaacctggcggcagcgcaaaagatg

SEQ ID NO: 196824 - DNA, 103 bp, Artificial Sequence
  Synthetic Polynucleotide
taatacgactcactataggggggggctttggcaaaagcagcgggggcttgaacagaggagacaagccatggctgcttttaacctggcggcagcgcaaaagatg

SEQ ID NO: 196825 - DNA, 103 bp, Artificial Sequence
  Synthetic Polynucleotide
taatacgactcactatagggttctgtcacggggggctttggcaaaagcagaacagaggagactgcttatgccaaagcccaacctggcggcagcgcaaaagatg

SEQ ID NO: 196826 - DNA, 103 bp, Artificial Sequence
  Synthetic Polynucleotide
taatacgactcactatagggggggcagctcttctgtcacggggggctttgaacagaggagacaaagcatgccgtgacagaacctggcggcagcgcaaaagatg

SEQ ID NO: 196827 - DNA, 103 bp, Artificial Sequence
  Synthetic Polynucleotide
taatacgactcactataggggaggccagcgggggcagctcttctgtcacgaacagaggagacgtgacatgagagctgccaacctggcggcagcgcaaaagatg

SEQ ID NO: 196828 - DNA, 103 bp, Artificial Sequence
  Synthetic Polynucleotide
taatacgactcactatagggctgggcaatggaggccagcgggggcagctcaacagaggagagagctgatgccgctggccaacctggcggcagcgcaaaagatg

SEQ ID NO: 196829 - DNA, 103 bp, Artificial Sequence
  Synthetic Polynucleotide
taatacgactcactataggggatcgagggagctggccgagctcagtgactaacagaggagaagtcacatggctcggccaaacctggcggcagcgcaaaagatg

SEQ ID NO: 196830 - DNA, 103 bp, Artificial Sequence
  Synthetic Polynucleotide
taatacgactcactatagggatgagatgatctgggcaatggaggccagcgaacagaggagacgctggatgccattgcccaacctggcggcagcgcaaaagatg

SEQ ID NO: 196831 - DNA, 103 bp, Artificial Sequence
  Synthetic Polynucleotide
taatacgactcactataggggaggatacagatgagatgatctgggcaatgaacagaggagacattgcatggatcatctcaacctggcggcagcgcaaaagatg

SEQ ID NO: 196832 - DNA, 103 bp, Artificial Sequence
  Synthetic Polynucleotide
taatacgactcactatagggggtgggggccgaggatacagatgagatgataacagaggagaatcatcatgtctgtatccaacctggcggcagcgcaaaagatg

SEQ ID NO: 196833 - DNA, 103 bp, Artificial Sequence
  Synthetic Polynucleotide
taatacgactcactatagggttttcagcagggtgggggccgaggatacagaacagaggagactgtatatgcggcccccaaacctggcggcagcgcaaaagatg

SEQ ID NO: 196834 - DNA, 103 bp, Artificial Sequence
  Synthetic Polynucleotide
taatacgactcactataggggccaccttggttttcagcagggtgggggccaacagaggagaggccccatgcctgctgaaaacctggcggcagcgcaaaagatg

SEQ ID NO: 196835 - DNA, 103 bp, Artificial Sequence
  Synthetic Polynucleotide
taatacgactcactatagggccctgggtccgccaccttggttttcagcagaacagaggagactgctgatgaccaaggtgaacctggcggcagcgcaaaagatg

SEQ ID NO: 196836 - DNA, 103 bp, Artificial Sequence
  Synthetic Polynucleotide
taatacgactcactatagggtgcttgcgggccctgggtccgccaccttggaacagaggagaccaaggatgcggacccagaacctggcggcagcgcaaaagatg

SEQ ID NO: 196837 - DNA, 103 bp, Artificial Sequence
  Synthetic Polynucleotide
taatacgactcactatagggttactgccagtgcttgcgggccctgggtccaacagaggagaggacccatggcccgcaagaacctggcggcagcgcaaaagatg

SEQ ID NO: 196838 - DNA, 103 bp, Artificial Sequence
  Synthetic Polynucleotide
taatacgactcactatagggagccgtggtgttactgccagtgcttgcgggaacagaggagacccgcaatgactggcagtaacctggcggcagcgcaaaagatg

SEQ ID NO: 196839 - DNA, 103 bp, Artificial Sequence
  Synthetic Polynucleotide
taatacgactcactatagggagctgtctgaagccgtggtgttactgccagaacagaggagactggcaatgacaccacggaacctggcggcagcgcaaaagatg

SEQ ID NO: 196840 - DNA, 103 bp, Artificial Sequence
  Synthetic Polynucleotide
taatacgactcactatagggagcatgtggcgatcgagggagctggccgagaacagaggagactcggcatgctccctcgaaacctggcggcagcgcaaaagatg

SEQ ID NO: 196841 - DNA, 103 bp, Artificial Sequence
  Synthetic Polynucleotide
taatacgactcactataggggaacctcctaagctgtctgaagccgtggtgaacagaggagacaccacatgttcagacagaacctggcggcagcgcaaaagatg

SEQ ID NO: 196842 - DNA, 103 bp, Artificial Sequence
  Synthetic Polynucleotide
taatacgactcactatagggtttggggacagaacctcctaagctgtctgaaacagaggagatcagacatgttaggaggtaacctggcggcagcgcaaaagatg

SEQ ID NO: 196843 - DNA, 103 bp, Artificial Sequence
  Synthetic Polynucleotide
taatacgactcactatagggtggtggcggctttggggacagaacctcctaaacagaggagataggagatgctgtccccaaacctggcggcagcgcaaaagatg

SEQ ID NO: 196844 - DNA, 103 bp, Artificial Sequence
  Synthetic Polynucleotide
taatacgactcactatagggggggtggcggtggtggcggctttggggacaaacagaggagatgtcccatgagccgccacaacctggcggcagcgcaaaagatg

SEQ ID NO: 196845 - DNA, 103 bp, Artificial Sequence
  Synthetic Polynucleotide
taatacgactcactatagggggtggcagcgggggtggcggtggtggcggcaacagaggagagccgccatgaccgccaccaacctggcggcagcgcaaaagatg

SEQ ID NO: 196846 - DNA, 103 bp, Artificial Sequence
  Synthetic Polynucleotide
taatacgactcactatagggttgggctggtggtggcagcgggggtggcggaacagaggagaccgccaatgccgctgccaaacctggcggcagcgcaaaagatg

SEQ ID NO: 196847 - DNA, 103 bp, Artificial Sequence
  Synthetic Polynucleotide
taatacgactcactatagggctagactcttttgggctggtggtggcagcgaacagaggagacgctgcatgcaccagcccaacctggcggcagcgcaaaagatg

SEQ ID NO: 196848 - DNA, 103 bp, Artificial Sequence
  Synthetic Polynucleotide
taatacgactcactataggggggaggctcactagactcttttgggctggtaacagaggagaaccagcatgaaagagtctaacctggcggcagcgcaaaagatg

SEQ ID NO: 196849 - DNA, 103 bp, Artificial Sequence
  Synthetic Polynucleotide
taatacgactcactatagggtggctggagcgggaggctcactagactcttaacagaggagaaagagtatggtgagcctcaacctggcggcagcgcaaaagatg

SEQ ID NO: 196850 - DNA, 103 bp, Artificial Sequence
  Synthetic Polynucleotide
taatacgactcactatagggtctgggctgctggctggagcgggaggctcaaacagaggagatgagccatgcgctccagcaacctggcggcagcgcaaaagatg

SEQ ID NO: 196851 - DNA, 103 bp, Artificial Sequence
  Synthetic Polynucleotide
taatacgactcactatagggagagtgcaccagcatgtggcgatcgagggaaacagaggagatccctcatgcgccacatgaacctggcggcagcgcaaaagatg

SEQ ID NO: 196852 - DNA, 103 bp, Artificial Sequence
  Synthetic Polynucleotide
taatacgactcactatagggagaggcagcctctgggctgctggctggagcaacagaggagagctccaatgagcagcccaaacctggcggcagcgcaaaagatg

SEQ ID NO: 196853 - DNA, 103 bp, Artificial Sequence
  Synthetic Polynucleotide
taatacgactcactataggggctcggtgggagaggcagcctctgggctgcaacagaggagagcagccatgaggctgcctaacctggcggcagcgcaaaagatg

SEQ ID NO: 196854 - DNA, 103 bp, Artificial Sequence
  Synthetic Polynucleotide
taatacgactcactataggggctgggccctgctcggtgggagaggcagccaacagaggagaggctgcatgtcccaccgaaacctggcggcagcgcaaaagatg

SEQ ID NO: 196855 - DNA, 103 bp, Artificial Sequence
  Synthetic Polynucleotide
taatacgactcactatagggcgacgtgcccgctgggccctgctcggtgggaacagaggagacccaccatgcagggcccaaacctggcggcagcgcaaaagatg

SEQ ID NO: 196856 - DNA, 103 bp, Artificial Sequence
  Synthetic Polynucleotide
taatacgactcactatagggccctcttcttcgacgtgcccgctgggccctaacagaggagaagggccatgcgggcacgtaacctggcggcagcgcaaaagatg

SEQ ID NO: 196857 - DNA, 103 bp, Artificial Sequence
  Synthetic Polynucleotide
taatacgactcactatagggcttttccggcccctcttcttcgacgtgcccaacagaggagagggcacatggaagaagagaacctggcggcagcgcaaaagatg

SEQ ID NO: 196858 - DNA, 103 bp, Artificial Sequence
  Synthetic Polynucleotide
taatacgactcactatagggcctcatcccccttttccggcccctcttcttaacagaggagaaagaagatgggccggaaaaacctggcggcagcgcaaaagatg

SEQ ID NO: 196859 - DNA, 103 bp, Artificial Sequence
  Synthetic Polynucleotide
taatacgactcactatagggggggtcggctcctcatcccccttttccggcaacagaggagagccggaatggggggatgaaacctggcggcagcgcaaaagatg

SEQ ID NO: 196860 - DNA, 103 bp, Artificial Sequence
  Synthetic Polynucleotide
taatacgactcactatagggctgttggcgcggggtcggctcctcatccccaacagaggagaggggatatggagccgaccaacctggcggcagcgcaaaagatg

SEQ ID NO: 196861 - DNA, 103 bp, Artificial Sequence
  Synthetic Polynucleotide
taatacgactcactatagggcaccccgccgctgttggcgcggggtcggctaacagaggagaagccgaatgcgcgccaacaacctggcggcagcgcaaaagatg

SEQ ID NO: 196862 - DNA, 103 bp, Artificial Sequence
  Synthetic Polynucleotide
taatacgactcactataggggcctctcgccagagtgcaccagcatgtggcaacagaggagagccacaatgtggtgcactaacctggcggcagcgcaaaagatg

SEQ ID NO: 196863 - DNA, 103 bp, Artificial Sequence
  Synthetic Polynucleotide
taatacgactcactatagggagtccaggtccaccccgccgctgttggcgcaacagaggagagcgccaatggcggcggggaacctggcggcagcgcaaaagatg

SEQ ID NO: 196864 - DNA, 103 bp, Artificial Sequence
  Synthetic Polynucleotide
taatacgactcactatagggtccccgctggagtccaggtccaccccgccgaacagaggagacggcggatgggacctggaaacctggcggcagcgcaaaagatg

SEQ ID NO: 196865 - DNA, 103 bp, Artificial Sequence
  Synthetic Polynucleotide
taatacgactcactataggggctggcaaactccccgctggagtccaggtcaacagaggagagacctgatgtccagcgggaacctggcggcagcgcaaaagatg

SEQ ID NO: 196866 - DNA, 103 bp, Artificial Sequence
  Synthetic Polynucleotide
taatacgactcactatagggtcttctcgatgctggcaaactccccgctggaacagaggagaccagcgatgagtttgccaaacctggcggcagcgcaaaagatg

SEQ ID NO: 196867 - DNA, 103 bp, Artificial Sequence
  Synthetic Polynucleotide
taatacgactcactataggggtggccagcatcttctcgatgctggcaaacaacagaggagagtttgcatgcatcgagaaaacctggcggcagcgcaaaagatg

SEQ ID NO: 196868 - DNA, 103 bp, Artificial Sequence
  Synthetic Polynucleotide
taatacgactcactatagggggtgtctgtggtggccagcatcttctcgataacagaggagaatcgagatgatgctggccaacctggcggcagcgcaaaagatg

SEQ ID NO: 196869 - DNA, 103 bp, Artificial Sequence
  Synthetic Polynucleotide
taatacgactcactatagggtgaacttgttggtgtctgtggtggccagcaaacagaggagatgctggatgccacagacaaacctggcggcagcgcaaaagatg

SEQ ID NO: 196870 - DNA, 103 bp, Artificial Sequence
  Synthetic Polynucleotide
taatacgactcactatagggagaaacggactgaacttgttggtgtctgtgaacagaggagacacagaatgcaacaagttaacctggcggcagcgcaaaagatg

SEQ ID NO: 196871 - DNA, 103 bp, Artificial Sequence
  Synthetic Polynucleotide
taatacgactcactatagggcgctgtctgcagaaacggactgaacttgttaacagaggagaaacaagatgagtccgtttaacctggcggcagcgcaaaagatg

SEQ ID NO: 196872 - DNA, 103 bp, Artificial Sequence
  Synthetic Polynucleotide
taatacgactcactatagggtgttgtcctccgctgtctgcagaaacggacaacagaggagagtccgtatgtgcagacagaacctggcggcagcgcaaaagatg

SEQ ID NO: 196873 - DNA, 103 bp, Artificial Sequence
  Synthetic Polynucleotide
taatacgactcactatagggcacttgtaaggcctctcgccagagtgcaccaacagaggagaggtgcaatgtggcgagagaacctggcggcagcgcaaaagatg

SEQ ID NO: 196874 - DNA, 103 bp, Artificial Sequence
  Synthetic Polynucleotide
taatacgactcactatagggtcatcctgagtgttgtcctccgctgtctgcaacagaggagagcagacatgggaggacaaaacctggcggcagcgcaaaagatg

SEQ ID NO: 196875 - DNA, 103 bp, Artificial Sequence
  Synthetic Polynucleotide
taatacgactcactatagggtccggccacctcatcctgagtgttgtcctcaacagaggagagaggacatgactcaggataacctggcggcagcgcaaaagatg

SEQ ID NO: 196876 - DNA, 103 bp, Artificial Sequence
  Synthetic Polynucleotide
taatacgactcactatagggcggcaggggctccggccacctcatcctgagaacagaggagactcaggatgaggtggccgaacctggcggcagcgcaaaagatg

SEQ ID NO: 196877 - DNA, 103 bp, Artificial Sequence
  Synthetic Polynucleotide
taatacgactcactatagggccatggtggtcggcaggggctccggccaccaacagaggagaggtggcatgagcccctgcaacctggcggcagcgcaaaagatg

SEQ ID NO: 196878 - DNA, 103 bp, Artificial Sequence
  Synthetic Polynucleotide
taatacgactcactatagggatcactgggcccatggtggtcggcaggggcaacagaggagagcccctatggaccaccataacctggcggcagcgcaaaagatg

SEQ ID NO: 196879 - DNA, 103 bp, Artificial Sequence
  Synthetic Polynucleotide
taatacgactcactatagggcctgctcttcatcactgggcccatggtggtaacagaggagaaccaccatgggcccagtgaacctggcggcagcgcaaaagatg

SEQ ID NO: 196880 - DNA, 103 bp, Artificial Sequence
  Synthetic Polynucleotide
taatacgactcactataggggggggactgccctgctcttcatcactgggcaacagaggagagcccagatgtgaagagcaaacctggcggcagcgcaaaagatg

SEQ ID NO: 196881 - DNA, 103 bp, Artificial Sequence
  Synthetic Polynucleotide
taatacgactcactatagggcttgtcttctgggggactgccctgctcttcaacagaggagagaagagatgggcagtcccaacctggcggcagcgcaaaagatg

SEQ ID NO: 196882 - DNA, 103 bp, Artificial Sequence
  Synthetic Polynucleotide
taatacgactcactatagggccctcagcagcttgtcttctgggggactgcaacagaggagagcagtcatgcagaagacaaacctggcggcagcgcaaaagatg

SEQ ID NO: 196883 - DNA, 103 bp, Artificial Sequence
  Synthetic Polynucleotide
taatacgactcactatagggttccgcttggccctcagcagcttgtcttctaacagaggagaagaagaatggctgctgagaacctggcggcagcgcaaaagatg

SEQ ID NO: 196884 - DNA, 103 bp, Artificial Sequence
  Synthetic Polynucleotide
taatacgactcactatagggacacacagtgcacttgtaaggcctctcgccaacagaggagaggcgagatgccttacaagaacctggcggcagcgcaaaagatg

SEQ ID NO: 196885 - DNA, 103 bp, Artificial Sequence
  Synthetic Polynucleotide
taatacgactcactatagggggtgtacgagttccgcttggccctcagcagaacagaggagactgctgatggccaagcggaacctggcggcagcgcaaaagatg

SEQ ID NO: 196886 - DNA, 103 bp, Artificial Sequence
  Synthetic Polynucleotide
taatacgactcactataggggcaggcagttggtgtacgagttccgcttggaacagaggagaccaagcatgactcgtacaaacctggcggcagcgcaaaagatg

SEQ ID NO: 196887 - DNA, 103 bp, Artificial Sequence
  Synthetic Polynucleotide
taatacgactcactataggggtgatcttctgcaggcagttggtgtacgagaacagaggagactcgtaatgcaactgcctaacctggcggcagcgcaaaagatg

SEQ ID NO: 196888 - DNA, 103 bp, Artificial Sequence
  Synthetic Polynucleotide
taatacgactcactataggggtggggacaggtgatcttctgcaggcagttaacagaggagaaactgcatgcagaagatcaacctggcggcagcgcaaaagatg

SEQ ID NO: 196889 - DNA, 103 bp, Artificial Sequence
  Synthetic Polynucleotide
taatacgactcactatagggcccggggacagtggggacaggtgatcttctaacagaggagaagaagaatgcctgtccccaacctggcggcagcgcaaaagatg

SEQ ID NO: 196890 - DNA, 103 bp, Artificial Sequence
  Synthetic Polynucleotide
taatacgactcactatagggcaagggaaaacccggggacagtggggacagaacagaggagactgtccatgctgtccccgaacctggcggcagcgcaaaagatg

SEQ ID NO: 196891 - DNA, 103 bp, Artificial Sequence
  Synthetic Polynucleotide
taatacgactcactatagggggagctggcccaagggaaaacccggggacaaacagaggagatgtcccatggttttccctaacctggcggcagcgcaaaagatg

SEQ ID NO: 196892 - DNA, 103 bp, Artificial Sequence
  Synthetic Polynucleotide
taatacgactcactataggggcctctgtagggagctggcccaagggaaaaaacagaggagattttccatggggccagctaacctggcggcagcgcaaaagatg

SEQ ID NO: 196893 - DNA, 103 bp, Artificial Sequence
  Synthetic Polynucleotide
taatacgactcactataggggtgagcatgtgcctctgtagggagctggccaacagaggagaggccagatgcctacagagaacctggcggcagcgcaaaagatg

SEQ ID NO: 196894 - DNA, 103 bp, Artificial Sequence
  Synthetic Polynucleotide
taatacgactcactatagggaccagtgtgtgtgagcatgtgcctctgtagaacagaggagactacagatgcacatgctcaacctggcggcagcgcaaaagatg

SEQ ID NO: 196895 - DNA, 103 bp, Artificial Sequence
  Synthetic Polynucleotide
taatacgactcactatagggatgactggccacacacagtgcacttgtaagaacagaggagacttacaatggcactgtgtaacctggcggcagcgcaaaagatg

SEQ ID NO: 196896 - DNA, 103 bp, Artificial Sequence
  Synthetic Polynucleotide
taatacgactcactatagggagggtttctgaccagtgtgtgtgagcatgtaacagaggagaacatgcatgcacacactgaacctggcggcagcgcaaaagatg

SEQ ID NO: 196897 - DNA, 103 bp, Artificial Sequence
  Synthetic Polynucleotide
taatacgactcactatagggtgacaagggaagggtttctgaccagtgtgtaacagaggagaacacacatgtcagaaaccaacctggcggcagcgcaaaagatg

SEQ ID NO: 196898 - DNA, 103 bp, Artificial Sequence
  Synthetic Polynucleotide
taatacgactcactatagggatcgcatttttgacaagggaagggtttctgaacagaggagacagaaaatgttcccttgtaacctggcggcagcgcaaaagatg

SEQ ID NO: 196899 - DNA, 103 bp, Artificial Sequence
  Synthetic Polynucleotide
taatacgactcactatagggaaaagaaggcatcgcatttttgacaagggaaacagaggagatcccttatgaaaaatgcgaacctggcggcagcgcaaaagatg

SEQ ID NO: 196900 - DNA, 103 bp, Artificial Sequence
  Synthetic Polynucleotide
taatacgactcactataggggatttggtagaaaagaaggcatcgcattttaacagaggagaaaaatgatgtgccttcttaacctggcggcagcgcaaaagatg

SEQ ID NO: 196901 - DNA, 103 bp, Artificial Sequence
  Synthetic Polynucleotide
taatacgactcactatagggttcacagttagatttggtagaaaagaaggcaacagaggagagccttcatgtctaccaaaaacctggcggcagcgcaaaagatg

SEQ ID NO: 196902 - DNA, 103 bp, Artificial Sequence
  Synthetic Polynucleotide
taatacgactcactatagggactggtggcgttcacagttagatttggtagaacagaggagactaccaatgctaactgtgaacctggcggcagcgcaaaagatg

SEQ ID NO: 196903 - DNA, 103 bp, Artificial Sequence
  Synthetic Polynucleotide
taatacgactcactatagggtgtttgcgcaactggtggcgttcacagttaaacagaggagataactgatgacgccaccaaacctggcggcagcgcaaaagatg

SEQ ID NO: 196904 - DNA, 103 bp, Artificial Sequence
  Synthetic Polynucleotide
taatacgactcactatagggggtaactccgtgtttgcgcaactggtggcgaacagaggagacgccacatgttgcgcaaaaacctggcggcagcgcaaaagatg

SEQ ID NO: 196905 - DNA, 103 bp, Artificial Sequence
  Synthetic Polynucleotide
taatacgactcactataggggggaacaggtggtaactccgtgtttgcgcaaacagaggagatgcgcaatgacggagttaaacctggcggcagcgcaaaagatg

SEQ ID NO: 196906 - DNA, 103 bp, Artificial Sequence
  Synthetic Polynucleotide
taatacgactcactatagggttggtggtaaatgactggccacacacagtgaacagaggagacactgtatgtggccagtcaacctggcggcagcgcaaaagatg

SEQ ID NO: 196907 - DNA, 103 bp, Artificial Sequence
  Synthetic Polynucleotide
taatacgactcactatagggtttcttctcagggaacaggtggtaactccgaacagaggagacggagtatgcacctgttcaacctggcggcagcgcaaaagatg

SEQ ID NO: 196908 - DNA, 103 bp, Artificial Sequence
  Synthetic Polynucleotide
taatacgactcactataggggataagcccgtttcttctcagggaacaggtaacagaggagaacctgtatgctgagaagaaacctggcggcagcgcaaaagatg

SEQ ID NO: 196909 - DNA, 103 bp, Artificial Sequence
  Synthetic Polynucleotide
taatacgactcactatagggttgactgggggataagcccgtttcttctcaaacagaggagatgagaaatgacgggcttaaacctggcggcagcgcaaaagatg

SEQ ID NO: 196910 - DNA, 103 bp, Artificial Sequence
  Synthetic Polynucleotide
taatacgactcactatagggtcactctcttttgactgggggataagcccgaacagaggagacgggctatgcccccagtcaacctggcggcagcgcaaaagatg

SEQ ID NO: 196911 - DNA, 103 bp, Artificial Sequence
  Synthetic Polynucleotide
taatacgactcactatagggggatccaacatcactctcttttgactggggaacagaggagaccccagatgaaagagagtaacctggcggcagcgcaaaagatg

SEQ ID NO: 196912 - DNA, 103 bp, Artificial Sequence
  Synthetic Polynucleotide
taatacgactcactatagggtgctatcatgggatccaacatcactctcttaacagaggagaaagagaatgatgttggataacctggcggcagcgcaaaagatg

SEQ ID NO: 196913 - DNA, 103 bp, Artificial Sequence
  Synthetic Polynucleotide
taatacgactcactatagggctttcccctgtgctatcatgggatccaacaaacagaggagatgttggatgccatgatagaacctggcggcagcgcaaaagatg

SEQ ID NO: 196914 - DNA, 103 bp, Artificial Sequence
  Synthetic Polynucleotide
taatacgactcactatagggtttgtatggcctttcccctgtgctatcatgaacagaggagacatgatatgacaggggaaaacctggcggcagcgcaaaagatg

SEQ ID NO: 196915 - DNA, 103 bp, Artificial Sequence
  Synthetic Polynucleotide
taatacgactcactatagggaggtctgacatttgtatggcctttcccctgaacagaggagacaggggatgggccatacaaacctggcggcagcgcaaaagatg

SEQ ID NO: 196916 - DNA, 103 bp, Artificial Sequence
  Synthetic Polynucleotide
taatacgactcactataggggttcgctcgcaggtctgacatttgtatggcaacagaggagagccataatgatgtcagacaacctggcggcagcgcaaaagatg

SEQ ID NO: 196917 - DNA, 103 bp, Artificial Sequence
  Synthetic Polynucleotide
taatacgactcactatagggcatggtgttgatggaagataggtctgaaccaacagaggagaggttcaatgctatcttccaacctggcggcagcgcaaaagatg

SEQ ID NO: 196918 - DNA, 103 bp, Artificial Sequence
  Synthetic Polynucleotide
taatacgactcactatagggcatgttcccattggtggtaaatgactggccaacagaggagaggccagatgtttaccaccaacctggcggcagcgcaaaagatg

SEQ ID NO: 196919 - DNA, 103 bp, Artificial Sequence
  Synthetic Polynucleotide
taatacgactcactatagggcaaggtgaaggttcgctcgcaggtctgacaaacagaggagatgtcagatgtgcgagcgaaacctggcggcagcgcaaaagatg

SEQ ID NO: 196920 - DNA, 103 bp, Artificial Sequence
  Synthetic Polynucleotide
taatacgactcactatagggggctgtgcttcaaggtgaaggttcgctcgcaacagaggagagcgagcatgccttcacctaacctggcggcagcgcaaaagatg

SEQ ID NO: 196921 - DNA, 103 bp, Artificial Sequence
  Synthetic Polynucleotide
taatacgactcactatagggtggcgaaccaggctgtgcttcaaggtgaagaacagaggagacttcacatggaagcacagaacctggcggcagcgcaaaagatg

SEQ ID NO: 196922 - DNA, 103 bp, Artificial Sequence
  Synthetic Polynucleotide
taatacgactcactataggggatccgctggtggcgaaccaggctgtgcttaacagaggagaaagcacatgctggttcgcaacctggcggcagcgcaaaagatg

SEQ ID NO: 196923 - DNA, 103 bp, Artificial Sequence
  Synthetic Polynucleotide
taatacgactcactatagggctttctggtggatccgctggtggcgaaccaaacagaggagatggttcatgaccagcggaaacctggcggcagcgcaaaagatg

SEQ ID NO: 196924 - DNA, 103 bp, Artificial Sequence
  Synthetic Polynucleotide
taatacgactcactataggggcatgcctggctttctggtggatccgctggaacagaggagaccagcgatgccaccagaaaacctggcggcagcgcaaaagatg

SEQ ID NO: 196925 - DNA, 103 bp, Artificial Sequence
  Synthetic Polynucleotide
taatacgactcactataggggtggtgtttggcatgcctggctttctggtgaacagaggagacaccagatggccaggcataacctggcggcagcgcaaaagatg

SEQ ID NO: 196926 - DNA, 103 bp, Artificial Sequence
  Synthetic Polynucleotide
taatacgactcactatagggtgtccttcccgtggtgtttggcatgcctggaacagaggagaccaggcatgccaaacaccaacctggcggcagcgcaaaagatg

SEQ ID NO: 196927 - DNA, 103 bp, Artificial Sequence
  Synthetic Polynucleotide
taatacgactcactatagggtccttgtcgctgtccttcccgtggtgtttgaacagaggagacaaacaatgcgggaaggaaacctggcggcagcgcaaaagatg

SEQ ID NO: 196928 - DNA, 103 bp, Artificial Sequence
  Synthetic Polynucleotide
taatacgactcactatagggaccccgctcttccttgtcgctgtccttcccaacagaggagagggaagatgagcgacaagaacctggcggcagcgcaaaagatg

SEQ ID NO: 196929 - DNA, 103 bp, Artificial Sequence
  Synthetic Polynucleotide
taatacgactcactatagggtatgtctgtgcatgttcccattggtggtaaaacagaggagattaccaatgatgggaacaaacctggcggcagcgcaaaagatg

SEQ ID NO: 196930 - DNA, 103 bp, Artificial Sequence
  Synthetic Polynucleotide
taatacgactcactatagggtgtcctcctcaccccgctcttccttgtcgcaacagaggagagcgacaatgaagagcgggaacctggcggcagcgcaaaagatg

SEQ ID NO: 196931 - DNA, 103 bp, Artificial Sequence
  Synthetic Polynucleotide
taatacgactcactatagggtcattctcgctgtcctcctcaccccgctctaacagaggagaagagcgatgtgaggaggaaacctggcggcagcgcaaaagatg

SEQ ID NO: 196932 - DNA, 103 bp, Artificial Sequence
  Synthetic Polynucleotide
taatacgactcactataggggtgggtggactcattctcgctgtcctcctcaacagaggagagaggagatgagcgagaataacctggcggcagcgcaaaagatg

SEQ ID NO: 196933 - DNA, 103 bp, Artificial Sequence
  Synthetic Polynucleotide
taatacgactcactatagggtgttgccgctgtgggtggactcattctcgcaacagaggagagcgagaatgagtccacccaacctggcggcagcgcaaaagatg

SEQ ID NO: 196934 - DNA, 103 bp, Artificial Sequence
  Synthetic Polynucleotide
taatacgactcactataggggagacggcgttgttgccgctgtgggtggacaacagaggagagtccacatgcagcggcaaaacctggcggcagcgcaaaagatg

SEQ ID NO: 196935 - DNA, 103 bp, Artificial Sequence
  Synthetic Polynucleotide
taatacgactcactatagggctcgttctctgagacggcgttgttgccgctaacagaggagaagcggcatgaacgccgtcaacctggcggcagcgcaaaagatg

SEQ ID NO: 196936 - DNA, 103 bp, Artificial Sequence
  Synthetic Polynucleotide
taatacgactcactatagggccagctcagcctcgttctctgagacggcgtaacagaggagaacgccgatgcagagaacgaacctggcggcagcgcaaaagatg

SEQ ID NO: 196937 - DNA, 103 bp, Artificial Sequence
  Synthetic Polynucleotide
taatacgactcactataggggcattgggagccagctcagcctcgttctctaacagaggagaagagaaatgggctgagctaacctggcggcagcgcaaaagatg

SEQ ID NO: 196938 - DNA, 103 bp, Artificial Sequence
  Synthetic Polynucleotide
taatacgactcactataggggtggttgctggcattgggagccagctcagcaacagaggagagctgagatggctcccaataacctggcggcagcgcaaaagatg

SEQ ID NO: 196939 - DNA, 103 bp, Artificial Sequence
  Synthetic Polynucleotide
taatacgactcactatagggtgacagccatgtggttgctggcattgggagaacagaggagactcccaatgccagcaaccaacctggcggcagcgcaaaagatg

SEQ ID NO: 196940 - DNA, 103 bp, Artificial Sequence
  Synthetic Polynucleotide
taatacgactcactatagggtggatcttcatatgtctgtgcatgttcccaaacagaggagatgggaaatggcacagacaaacctggcggcagcgcaaaagatg

SEQ ID NO: 196941 - DNA, 103 bp, Artificial Sequence
  Synthetic Polynucleotide
taatacgactcactatagggcggctccgggtgacagccatgtggttgctgaacagaggagacagcaaatgcatggctgtaacctggcggcagcgcaaaagatg

SEQ ID NO: 196942 - DNA, 103 bp, Artificial Sequence
  Synthetic Polynucleotide
taatacgactcactataggggccctccttccggctccgggtgacagccataacagaggagaatggctatgacccggagcaacctggcggcagcgcaaaagatg

SEQ ID NO: 196943 - DNA, 103 bp, Artificial Sequence
  Synthetic Polynucleotide
taatacgactcactatagggcactggccaagccctccttccggctccgggaacagaggagacccggaatgggaaggaggaacctggcggcagcgcaaaagatg

SEQ ID NO: 196944 - DNA, 103 bp, Artificial Sequence
  Synthetic Polynucleotide
taatacgactcactatagggtccttggtggcactggccaagccctccttcaacagaggagagaaggaatgcttggccagaacctggcggcagcgcaaaagatg

SEQ ID NO: 196945 - DNA, 103 bp, Artificial Sequence
  Synthetic Polynucleotide
taatacgactcactataggggtggctgcagtccttggtggcactggccaaaacagaggagattggccatggccaccaagaacctggcggcagcgcaaaagatg

SEQ ID NO: 196946 - DNA, 103 bp, Artificial Sequence
  Synthetic Polynucleotide
taatacgactcactatagggtctcctccctgtggctgcagtccttggtggaacagaggagaccaccaatgactgcagccaacctggcggcagcgcaaaagatg

SEQ ID NO: 196947 - DNA, 103 bp, Artificial Sequence
  Synthetic Polynucleotide
taatacgactcactataggggccgtgaccttctcctccctgtggctgcagaacagaggagactgcagatgcagggaggaaacctggcggcagcgcaaaagatg

SEQ ID NO: 196948 - DNA, 103 bp, Artificial Sequence
  Synthetic Polynucleotide
taatacgactcactatagggcggccaccctgccgtgaccttctcctccctaacagaggagaagggagatgaaggtcacgaacctggcggcagcgcaaaagatg

SEQ ID NO: 196949 - DNA, 103 bp, Artificial Sequence
  Synthetic Polynucleotide
taatacgactcactatagggcaggctcagacggccaccctgccgtgacctaacagaggagaaggtcaatgcagggtggcaacctggcggcagcgcaaaagatg

SEQ ID NO: 196950 - DNA, 103 bp, Artificial Sequence
  Synthetic Polynucleotide
taatacgactcactatagggtcaccctggccaggctcagacggccaccctaacagaggagaagggtgatggtctgagccaacctggcggcagcgcaaaagatg

SEQ ID NO: 196951 - DNA, 103 bp, Artificial Sequence
  Synthetic Polynucleotide
taatacgactcactataggggtccttctcatggatcttcatatgtctgtgaacagaggagacacagaatgatgaagatcaacctggcggcagcgcaaaagatg

SEQ ID NO: 196952 - DNA, 103 bp, Artificial Sequence
  Synthetic Polynucleotide
taatacgactcactatagggtgggttaaggtcaccctggccaggctcagaaacagaggagatctgagatgggccagggtaacctggcggcagcgcaaaagatg

SEQ ID NO: 196953 - DNA, 103 bp, Artificial Sequence
  Synthetic Polynucleotide
taatacgactcactatagggccgggctctctgggttaaggtcaccctggcaacagaggagagccaggatgaccttaaccaacctggcggcagcgcaaaagatg

SEQ ID NO: 196954 - DNA, 103 bp, Artificial Sequence
  Synthetic Polynucleotide
taatacgactcactatagggcccagggccgccgggctctctgggttaaggaacagaggagaccttaaatgagagagcccaacctggcggcagcgcaaaagatg

SEQ ID NO: 196955 - DNA, 103 bp, Artificial Sequence
  Synthetic Polynucleotide
taatacgactcactatagggcaggtcctgccccagggccgccgggctctcaacagaggagagagagcatggcggccctgaacctggcggcagcgcaaaagatg

SEQ ID NO: 196956 - DNA, 103 bp, Artificial Sequence
  Synthetic Polynucleotide
taatacgactcactataggggcggctccagcaggtcctgccccagggccgaacagaggagacggcccatgggcaggaccaacctggcggcagcgcaaaagatg

SEQ ID NO: 196957 - DNA, 103 bp, Artificial Sequence
  Synthetic Polynucleotide
taatacgactcactatagggctcttgctgcgcggctccagcaggtcctgcaacagaggagagcaggaatggctggagccaacctggcggcagcgcaaaagatg

SEQ ID NO: 196958 - DNA, 103 bp, Artificial Sequence
  Synthetic Polynucleotide
taatacgactcactataggggtgggcaggcctcttgctgcgcggctccagaacagaggagactggagatgcgcagcaagaacctggcggcagcgcaaaagatg

SEQ ID NO: 196959 - DNA, 103 bp, Artificial Sequence
  Synthetic Polynucleotide
taatacgactcactatagggccaggattgggtgggcaggcctcttgctgcaacagaggagagcagcaatgggcctgcccaacctggcggcagcgcaaaagatg

SEQ ID NO: 196960 - DNA, 103 bp, Artificial Sequence
  Synthetic Polynucleotide
taatacgactcactatagggtcagctgtggccaggattgggtgggcaggcaacagaggagagcctgcatgcccaatcctaacctggcggcagcgcaaaagatg

SEQ ID NO: 196961 - DNA, 103 bp, Artificial Sequence
  Synthetic Polynucleotide
taatacgactcactatagggggaggcgccatcagctgtggccaggattggaacagaggagaccaatcatggccacagctaacctggcggcagcgcaaaagatg

SEQ ID NO: 196962 - DNA, 103 bp, Artificial Sequence
  Synthetic Polynucleotide
taatacgactcactatagggcactgttagggtccttctcatggatcttcaaacagaggagatgaagaatgatgagaaggaacctggcggcagcgcaaaagatg

SEQ ID NO: 196963 - DNA, 103 bp, Artificial Sequence
  Synthetic Polynucleotide
taatacgactcactatagggccacgagctgggaggcgccatcagctgtggaacagaggagaccacagatgatggcgcctaacctggcggcagcgcaaaagatg

SEQ ID NO: 196964 - DNA, 103 bp, Artificial Sequence
  Synthetic Polynucleotide
taatacgactcactatagggcactccatccccacgagctgggaggcgccaaacagaggagatggcgcatgccagctcgtaacctggcggcagcgcaaaagatg

SEQ ID NO: 196965 - DNA, 103 bp, Artificial Sequence
  Synthetic Polynucleotide
taatacgactcactataggggtggctgtggcactgttagggtccttctcaaacagaggagatgagaaatgccctaacagaacctggcggcagcgcaaaagatg

SEQ ID NO: 196966 - DNA, 103 bp, Artificial Sequence
  Synthetic Polynucleotide
taatacgactcactatagggtggaggggctgtggctgtggcactgttaggaacagaggagacctaacatggccacagccaacctggcggcagcgcaaaagatg

SEQ ID NO: 196967 - DNA, 103 bp, Artificial Sequence
  Synthetic Polynucleotide
taatacgactcactatagggtcagaggagatggaggggctgtggctgtggaacagaggagaccacagatgcagcccctcaacctggcggcagcgcaaaagatg

SEQ ID NO: 196968 - DNA, 103 bp, Artificial Sequence
  Synthetic Polynucleotide
taatacgactcactatagggcgcctacgtttcagaggagatggaggggctaacagaggagaagccccatgatctcctctaacctggcggcagcgcaaaagatg

SEQ ID NO: 196969 - DNA, 103 bp, Artificial Sequence
  Synthetic Polynucleotide
taatacgactcactatagggggaggacaatcgcctacgtttcagaggagaaacagaggagatctcctatgaaacgtaggaacctggcggcagcgcaaaagatg

SEQ ID NO: 196970 - DNA, 103 bp, Artificial Sequence
  Synthetic Polynucleotide
taatacgactcactatagggccgccgacatcatggtgttgatggaagataaacagaggagatatcttatgtcaacaccaaacctggcggcagcgcaaaagatg

SEQ ID NO: 196971 - DNA, 103 bp, Artificial Sequence
  Synthetic Polynucleotide
taatacgactcactataggggtttcctcttggaggacaatcgcctacgttaacagaggagaaacgtaatggattgtcctaacctggcggcagcgcaaaagatg

SEQ ID NO: 196972 - DNA, 103 bp, Artificial Sequence
  Synthetic Polynucleotide
taatacgactcactatagggtcgtgactcagtttcctcttggaggacaataacagaggagaattgtcatgcaagaggaaaacctggcggcagcgcaaaagatg

SEQ ID NO: 196973 - DNA, 103 bp, Artificial Sequence
  Synthetic Polynucleotide
taatacgactcactatagggtgactcggcatcgtgactcagtttcctcttaacagaggagaaagaggatgctgagtcacaacctggcggcagcgcaaaagatg

SEQ ID NO: 196974 - DNA, 103 bp, Artificial Sequence
  Synthetic Polynucleotide
taatacgactcactatagggcttctctctctgactcggcatcgtgactcaaacagaggagatgagtcatgatgccgagtaacctggcggcagcgcaaaagatg

SEQ ID NO: 196975 - DNA, 103 bp, Artificial Sequence
  Synthetic Polynucleotide
taatacgactcactatagggggtgctgggtcttctctctctgactcggcaaacagaggagatgccgaatgagagagagaaacctggcggcagcgcaaaagatg

SEQ ID NO: 196976 - DNA, 103 bp, Artificial Sequence
  Synthetic Polynucleotide
taatacgactcactatagggctttttagctggtgctgggtcttctctctcaacagaggagagagagaatggacccagcaaacctggcggcagcgcaaaagatg

SEQ ID NO: 196977 - DNA, 103 bp, Artificial Sequence
  Synthetic Polynucleotide
taatacgactcactatagggcttctaccatctttttagctggtgctgggtaacagaggagaacccagatgcagctaaaaaacctggcggcagcgcaaaagatg

SEQ ID NO: 196978 - DNA, 103 bp, Artificial Sequence
  Synthetic Polynucleotide
taatacgactcactataggggactgcccgtcttctaccatctttttagctaacagaggagaagctaaatggatggtagaaacctggcggcagcgcaaaagatg

SEQ ID NO: 196979 - DNA, 103 bp, Artificial Sequence
  Synthetic Polynucleotide
taatacgactcactatagggcaagtcacctgactgcccgtcttctaccataacagaggagaatggtaatggacgggcagaacctggcggcagcgcaaaagatg

SEQ ID NO: 196980 - DNA, 103 bp, Artificial Sequence
  Synthetic Polynucleotide
taatacgactcactatagggctttcttctccaagtcacctgactgcccgtaacagaggagaacgggcatgcaggtgactaacctggcggcagcgcaaaagatg

SEQ ID NO: 196981 - DNA, 103 bp, Artificial Sequence
  Synthetic Polynucleotide
taatacgactcactatagggacactcatgaccgccgacatcatggtgttgaacagaggagacaacacatggatgtcggcaacctggcggcagcgcaaaagatg

SEQ ID NO: 196982 - DNA, 103 bp, Artificial Sequence
  Synthetic Polynucleotide
taatacgactcactatagggacttcatcagctttcttctccaagtcacctaacagaggagaaggtgaatgggagaagaaaacctggcggcagcgcaaaagatg

SEQ ID NO: 196983 - DNA, 103 bp, Artificial Sequence
  Synthetic Polynucleotide
taatacgactcactataggggcagtgaaagacttcatcagctttcttctcaacagaggagagagaagatggctgatgaaaacctggcggcagcgcaaaagatg

SEQ ID NO: 196984 - DNA, 103 bp, Artificial Sequence
  Synthetic Polynucleotide
taatacgactcactatagggaacatactgggcagtgaaagacttcatcagaacagaggagactgatgatgtctttcactaacctggcggcagcgcaaaagatg

SEQ ID NO: 196985 - DNA, 103 bp, Artificial Sequence
  Synthetic Polynucleotide
taatacgactcactatagggaactccttgaaacatactgggcagtgaaagaacagaggagactttcaatgcccagtatgaacctggcggcagcgcaaaagatg

SEQ ID NO: 196986 - DNA, 103 bp, Artificial Sequence
  Synthetic Polynucleotide
taatacgactcactatagggcttgcaaacaaactccttgaaacatactggaacagaggagaccagtaatgttcaaggagaacctggcggcagcgcaaaagatg

SEQ ID NO: 196987 - DNA, 103 bp, Artificial Sequence
  Synthetic Polynucleotide
taatacgactcactatagggccagtccatacttgcaaacaaactccttgaaacagaggagatcaaggatgttgtttgcaaacctggcggcagcgcaaaagatg

SEQ ID NO: 196988 - DNA, 103 bp, Artificial Sequence
  Synthetic Polynucleotide
taatacgactcactatagggatgtgggtctccagtccatacttgcaaacaaacagaggagatgtttgatggtatggactaacctggcggcagcgcaaaagatg

SEQ ID NO: 196989 - DNA, 103 bp, Artificial Sequence
  Synthetic Polynucleotide
taatacgactcactatagggatgggtctccatgtgggtctccagtccataaacagaggagatatggaatggagacccacaacctggcggcagcgcaaaagatg

SEQ ID NO: 196990 - DNA, 103 bp, Artificial Sequence
  Synthetic Polynucleotide
taatacgactcactatagggggttatctgaatgggtctccatgtgggtctaacagaggagaagacccatgtggagacccaacctggcggcagcgcaaaagatg

SEQ ID NO: 196991 - DNA, 103 bp, Artificial Sequence
  Synthetic Polynucleotide
taatacgactcactatagggcatcttagtgggttatctgaatgggtctccaacagaggagaggagacatgttcagataaaacctggcggcagcgcaaaagatg

SEQ ID NO: 196992 - DNA, 103 bp, Artificial Sequence
  Synthetic Polynucleotide
taatacgactcactataggggaccttccctacactcatgaccgccgacataacagaggagaatgtcgatggtcatgagtaacctggcggcagcgcaaaagatg

SEQ ID NO: 196993 - DNA, 103 bp, Artificial Sequence
  Synthetic Polynucleotide
taatacgactcactatagggacaaatgtcacatcttagtgggttatctgaaacagaggagatcagatatgccactaagaaacctggcggcagcgcaaaagatg

SEQ ID NO: 196994 - DNA, 103 bp, Artificial Sequence
  Synthetic Polynucleotide
taatacgactcactatagggaggtgacacaacaaatgtcacatcttagtgaacagaggagacactaaatggtgacatttaacctggcggcagcgcaaaagatg

SEQ ID NO: 196995 - DNA, 103 bp, Artificial Sequence
  Synthetic Polynucleotide
taatacgactcactatagggtgtgttcgaaaggtgacacaacaaatgtcaaacagaggagatgacatatgttgtgtcacaacctggcggcagcgcaaaagatg

SEQ ID NO: 196996 - DNA, 103 bp, Artificial Sequence
  Synthetic Polynucleotide
taatacgactcactatagggcagtcctcgatgtgttcgaaaggtgacacaaacagaggagatgtgtcatgtttcgaacaaacctggcggcagcgcaaaagatg

SEQ ID NO: 196997 - DNA, 103 bp, Artificial Sequence
  Synthetic Polynucleotide
taatacgactcactatagggtgtgacgcagcagtcctcgatgtgttcgaaaacagaggagattcgaaatgatcgaggacaacctggcggcagcgcaaaagatg

SEQ ID NO: 196998 - DNA, 103 bp, Artificial Sequence
  Synthetic Polynucleotide
taatacgactcactatagggacaagcgcgttgtgacgcagcagtcctcgaaacagaggagatcgaggatggctgcgtcaaacctggcggcagcgcaaaagatg

SEQ ID NO: 196999 - DNA, 103 bp, Artificial Sequence
  Synthetic Polynucleotide
taatacgactcactatagggttgtttgtggacaagcgcgttgtgacgcagaacagaggagactgcgtatgaacgcgcttaacctggcggcagcgcaaaagatg

SEQ ID NO: 197000 - DNA, 103 bp, Artificial Sequence
  Synthetic Polynucleotide
taatacgactcactatagggccctgggaagttgtttgtggacaagcgcgtaacagaggagaacgcgcatgtccacaaacaacctggcggcagcgcaaaagatg

SEQ ID NO: 197001 - DNA, 103 bp, Artificial Sequence
  Synthetic Polynucleotide
taatacgactcactatagggcccattgcatccctgggaagttgtttgtggaacagaggagaccacaaatgacttcccagaacctggcggcagcgcaaaagatg

SEQ ID NO: 197002 - DNA, 103 bp, Artificial Sequence
  Synthetic Polynucleotide
taatacgactcactataggggaaaggtctgcccattgcatccctgggaagaacagaggagacttcccatggatgcaatgaacctggcggcagcgcaaaagatg

SEQ ID NO: 197003 - DNA, 103 bp, Artificial Sequence
  Synthetic Polynucleotide
taatacgactcactatagggcattctctgtgaccttccctacactcatgaaacagaggagatcatgaatgtagggaaggaacctggcggcagcgcaaaagatg

SEQ ID NO: 197004 - DNA, 103 bp, Artificial Sequence
  Synthetic Polynucleotide
taatacgactcactatagggtgttctgtatgaaaggtctgcccattgcataacagaggagaatgcaaatggcagaccttaacctggcggcagcgcaaaagatg

SEQ ID NO: 197005 - DNA, 103 bp, Artificial Sequence
  Synthetic Polynucleotide
taatacgactcactatagggattgaagggttgttctgtatgaaaggtctgaacagaggagacagaccatgcatacagaaaacctggcggcagcgcaaaagatg

SEQ ID NO: 197006 - DNA, 103 bp, Artificial Sequence
  Synthetic Polynucleotide
taatacgactcactataggggccagcaggaattgaagggttgttctgtataacagaggagaatacagatgaacccttcaaacctggcggcagcgcaaaagatg

SEQ ID NO: 197007 - DNA, 103 bp, Artificial Sequence
  Synthetic Polynucleotide
taatacgactcactatagggagtcgtggaagccagcaggaattgaagggtaacagaggagaacccttatgttcctgctgaacctggcggcagcgcaaaagatg

SEQ ID NO: 197008 - DNA, 103 bp, Artificial Sequence
  Synthetic Polynucleotide
taatacgactcactataggggtgaatcctaagtcgtggaagccagcaggaaacagaggagatcctgcatgcttccacgaaacctggcggcagcgcaaaagatg

SEQ ID NO: 197009 - DNA, 103 bp, Artificial Sequence
  Synthetic Polynucleotide
taatacgactcactatagggggagaagtccgtgaatcctaagtcgtggaaaacagaggagattccacatgttaggattcaacctggcggcagcgcaaaagatg

SEQ ID NO: 197010 - DNA, 103 bp, Artificial Sequence
  Synthetic Polynucleotide
taatacgactcactatagggacttcctacaggagaagtccgtgaatcctaaacagaggagataggatatgcggacttctaacctggcggcagcgcaaaagatg

SEQ ID NO: 197011 - DNA, 103 bp, Artificial Sequence
  Synthetic Polynucleotide
taatacgactcactatagggatgcgaggaaacttcctacaggagaagtccaacagaggagaggacttatgctgtaggaaaacctggcggcagcgcaaaagatg

SEQ ID NO: 197012 - DNA, 103 bp, Artificial Sequence
  Synthetic Polynucleotide
taatacgactcactatagggggcctgagaaatgcgaggaaacttcctacaaacagaggagatgtaggatgtttcctcgcaacctggcggcagcgcaaaagatg

SEQ ID NO: 197013 - DNA, 103 bp, Artificial Sequence
  Synthetic Polynucleotide
taatacgactcactatagggtttcgcaccaggcctgagaaatgcgaggaaaacagaggagattcctcatgtttctcaggaacctggcggcagcgcaaaagatg

SEQ ID NO: 197014 - DNA, 103 bp, Artificial Sequence
  Synthetic Polynucleotide
taatacgactcactataggggggctcccgccattctctgtgaccttccctaacagaggagaagggaaatgcacagagaaaacctggcggcagcgcaaaagatg

SEQ ID NO: 197015 - DNA, 103 bp, Artificial Sequence
  Synthetic Polynucleotide
taatacgactcactatagggcgcaggtttgtttcgcaccaggcctgagaaaacagaggagattctcaatgctggtgcgaaacctggcggcagcgcaaaagatg

SEQ ID NO: 197016 - DNA, 103 bp, Artificial Sequence
  Synthetic Polynucleotide
taatacgactcactataggggatgcacctccgcaggtttgtttcgcaccaaacagaggagatggtgcatgacaaacctgaacctggcggcagcgcaaaagatg

SEQ ID NO: 197017 - DNA, 103 bp, Artificial Sequence
  Synthetic Polynucleotide
taatacgactcactataggggttgctcgctgatgcacctccgcaggtttgaacagaggagacaaaccatgggaggtgcaaacctggcggcagcgcaaaagatg

SEQ ID NO: 197018 - DNA, 103 bp, Artificial Sequence
  Synthetic Polynucleotide
taatacgactcactatagggacaaaacggtgttgctcgctgatgcacctcaacagaggagagaggtgatgcagcgagcaaacctggcggcagcgcaaaagatg

SEQ ID NO: 197019 - DNA, 103 bp, Artificial Sequence
  Synthetic Polynucleotide
taatacgactcactatagggggtgtcgcagacaaaacggtgttgctcgctaacagaggagaagcgagatgcaccgttttaacctggcggcagcgcaaaagatg

SEQ ID NO: 197020 - DNA, 103 bp, Artificial Sequence
  Synthetic Polynucleotide
taatacgactcactatagggccttgtcacaggtgtcgcagacaaaacggtaacagaggagaaccgttatgtctgcgacaaacctggcggcagcgcaaaagatg

SEQ ID NO: 197021 - DNA, 103 bp, Artificial Sequence
  Synthetic Polynucleotide
taatacgactcactatagggatggggaacgccttgtcacaggtgtcgcagaacagaggagactgcgaatgctgtgacaaaacctggcggcagcgcaaaagatg

SEQ ID NO: 197022 - DNA, 103 bp, Artificial Sequence
  Synthetic Polynucleotide
taatacgactcactatagggtgagcagagcatggggaacgccttgtcacaaacagaggagatgtgacatggcgttccccaacctggcggcagcgcaaaagatg

SEQ ID NO: 197023 - DNA, 103 bp, Artificial Sequence
  Synthetic Polynucleotide
taatacgactcactataggggcagagccagtgagcagagcatggggaacgaacagaggagacgttccatgtgctctgctaacctggcggcagcgcaaaagatg

SEQ ID NO: 197024 - DNA, 103 bp, Artificial Sequence
  Synthetic Polynucleotide
taatacgactcactataggggtctgcttgtgcagagccagtgagcagagcaacagaggagagctctgatgactggctctaacctggcggcagcgcaaaagatg

SEQ ID NO: 197025 - DNA, 103 bp, Artificial Sequence
  Synthetic Polynucleotide
taatacgactcactatagggcaaacgcgtgtgaagcagcggtgccgccataacagaggagaatggcgatgccgctgcttaacctggcggcagcgcaaaagatg

SEQ ID NO: 197026 - DNA, 103 bp, Artificial Sequence
  Synthetic Polynucleotide
taatacgactcactataggggtcattctctaatgcacgcatatttgaaataacagaggagaatttcaatgatgcgtgcaaacctggcggcagcgcaaaagatg

SEQ ID NO: 197027 - DNA, 103 bp, Artificial Sequence
  Synthetic Polynucleotide
taatacgactcactatagggtgttttgccgttatcaaccttaccatctacaacagaggagagtagatatgaaggttgataacctggcggcagcgcaaaagatg

SEQ ID NO: 197028 - DNA, 103 bp, Artificial Sequence
  Synthetic Polynucleotide
taatacgactcactatagggatagatcctttgttttgccgttatcaacctaacagaggagaaggttgatgacggcaaaaaacctggcggcagcgcaaaagatg

SEQ ID NO: 197029 - DNA, 103 bp, Artificial Sequence
  Synthetic Polynucleotide
taatacgactcactatagggaggtcgcgatatagatcctttgttttgccgaacagaggagacggcaaatgaaaggatctaacctggcggcagcgcaaaagatg

SEQ ID NO: 197030 - DNA, 103 bp, Artificial Sequence
  Synthetic Polynucleotide
taatacgactcactataggggatgtttatcaggtcgcgatatagatccttaacagaggagaaaggatatgtatcgcgacaacctggcggcagcgcaaaagatg

SEQ ID NO: 197031 - DNA, 103 bp, Artificial Sequence
  Synthetic Polynucleotide
taatacgactcactataggggtttgtcaaagatgtttatcaggtcgcgataacagaggagaatcgcgatgtgataaacaaacctggcggcagcgcaaaagatg

SEQ ID NO: 197032 - DNA, 103 bp, Artificial Sequence
  Synthetic Polynucleotide
taatacgactcactatagggggcaacaggagtttgtcaaagatgtttatcaacagaggagagataaaatgctttgacaaaacctggcggcagcgcaaaagatg

SEQ ID NO: 197033 - DNA, 103 bp, Artificial Sequence
  Synthetic Polynucleotide
taatacgactcactatagggggcatgggtgggcaacaggagtttgtcaaaaacagaggagatttgacatgctcctgttgaacctggcggcagcgcaaaagatg

SEQ ID NO: 197034 - DNA, 103 bp, Artificial Sequence
  Synthetic Polynucleotide
taatacgactcactatagggcatggcaggaggcatgggtgggcaacaggaaacagaggagatcctgtatgccacccatgaacctggcggcagcgcaaaagatg

SEQ ID NO: 197035 - DNA, 103 bp, Artificial Sequence
  Synthetic Polynucleotide
taatacgactcactatagggaaaaactgtacatggcaggaggcatgggtgaacagaggagacacccaatgctcctgccaaacctggcggcagcgcaaaagatg

SEQ ID NO: 197036 - DNA, 103 bp, Artificial Sequence
  Synthetic Polynucleotide
taatacgactcactataggggtaaaacatgaaaaactgtacatggcaggaaacagaggagatcctgcatggtacagtttaacctggcggcagcgcaaaagatg

SEQ ID NO: 197037 - DNA, 103 bp, Artificial Sequence
  Synthetic Polynucleotide
taatacgactcactatagggaattgaaaaagtcattctctaatgcacgcaaacagaggagatgcgtgatgtagagaatgaacctggcggcagcgcaaaagatg

SEQ ID NO: 197038 - DNA, 103 bp, Artificial Sequence
  Synthetic Polynucleotide
taatacgactcactatagggaactacagaggtaaaacatgaaaaactgtaaacagaggagatacagtatgtcatgttttaacctggcggcagcgcaaaagatg

SEQ ID NO: 197039 - DNA, 103 bp, Artificial Sequence
  Synthetic Polynucleotide
taatacgactcactatagggcccaatttgaaactacagaggtaaaacatgaacagaggagacatgttatgcctctgtagaacctggcggcagcgcaaaagatg

SEQ ID NO: 197040 - DNA, 103 bp, Artificial Sequence
  Synthetic Polynucleotide
taatacgactcactatagggctctgcgaatcccaatttgaaactacagagaacagaggagactctgtatgttcaaattgaacctggcggcagcgcaaaagatg

SEQ ID NO: 197041 - DNA, 103 bp, Artificial Sequence
  Synthetic Polynucleotide
taatacgactcactatagggccaaaaatgcctctgcgaatcccaatttgaaacagaggagatcaaatatggattcgcagaacctggcggcagcgcaaaagatg

SEQ ID NO: 197042 - DNA, 103 bp, Artificial Sequence
  Synthetic Polynucleotide
taatacgactcactatagggcagagatgttccaaaaatgcctctgcgaataacagaggagaattcgcatgggcatttttaacctggcggcagcgcaaaagatg

SEQ ID NO: 197043 - DNA, 103 bp, Artificial Sequence
  Synthetic Polynucleotide
taatacgactcactatagggcaattttttccagagatgttccaaaaatgcaacagaggagagcatttatggaacatctcaacctggcggcagcgcaaaagatg

SEQ ID NO: 197044 - DNA, 103 bp, Artificial Sequence
  Synthetic Polynucleotide
taatacgactcactatagggttgggtcctgcaattttttccagagatgttaacagaggagaaacatcatgggaaaaaataacctggcggcagcgcaaaagatg

SEQ ID NO: 197045 - DNA, 103 bp, Artificial Sequence
  Synthetic Polynucleotide
taatacgactcactataggggcaggattacttgggtcctgcaattttttcaacagaggagagaaaaaatggcaggacccaacctggcggcagcgcaaaagatg

SEQ ID NO: 197046 - DNA, 103 bp, Artificial Sequence
  Synthetic Polynucleotide
taatacgactcactatagggcctgatgatggcaggattacttgggtcctgaacagaggagacaggacatgagtaatcctaacctggcggcagcgcaaaagatg

SEQ ID NO: 197047 - DNA, 103 bp, Artificial Sequence
  Synthetic Polynucleotide
taatacgactcactatagggcagcagcctgcctgatgatggcaggattacaacagaggagagtaatcatgccatcatcaaacctggcggcagcgcaaaagatg

SEQ ID NO: 197048 - DNA, 103 bp, Artificial Sequence
  Synthetic Polynucleotide
taatacgactcactatagggcttgggggagaattgaaaaagtcattctctaacagaggagaagagaaatgctttttcaaaacctggcggcagcgcaaaagatg

SEQ ID NO: 197049 - DNA, 103 bp, Artificial Sequence
  Synthetic Polynucleotide
taatacgactcactatagggatataatttccagcagcctgcctgatgatgaacagaggagacatcatatggcaggctgcaacctggcggcagcgcaaaagatg

SEQ ID NO: 197050 - DNA, 103 bp, Artificial Sequence
  Synthetic Polynucleotide
taatacgactcactatagggaaagcttccaatataatttccagcagcctgaacagaggagacaggctatgggaaattataacctggcggcagcgcaaaagatg

SEQ ID NO: 197051 - DNA, 103 bp, Artificial Sequence
  Synthetic Polynucleotide
taatacgactcactatagggctcttgccaaaaagcttccaatataatttcaacagaggagagaaattatgttggaagctaacctggcggcagcgcaaaagatg

SEQ ID NO: 197052 - DNA, 103 bp, Artificial Sequence
  Synthetic Polynucleotide
taatacgactcactatagggataaatttagctcttgccaaaaagcttccaaacagaggagatggaagatgtttggcaagaacctggcggcagcgcaaaagatg

SEQ ID NO: 197053 - DNA, 103 bp, Artificial Sequence
  Synthetic Polynucleotide
taatacgactcactatagggaataagaggaataaatttagctcttgccaaaacagaggagattggcaatggctaaatttaacctggcggcagcgcaaaagatg

SEQ ID NO: 197054 - DNA, 103 bp, Artificial Sequence
  Synthetic Polynucleotide
taatacgactcactatagggattttacagtaataagaggaataaatttagaacagaggagactaaatatgttcctcttaaacctggcggcagcgcaaaagatg

SEQ ID NO: 197055 - DNA, 103 bp, Artificial Sequence
  Synthetic Polynucleotide
taatacgactcactatagggtctaggcatgattttacagtaataagaggaaacagaggagatcctctatgtactgtaaaaacctggcggcagcgcaaaagatg

SEQ ID NO: 197056 - DNA, 103 bp, Artificial Sequence
  Synthetic Polynucleotide
taatacgactcactatagggaaccaaaagatctaggcatgattttacagtaacagaggagaactgtaatgtcatgcctaaacctggcggcagcgcaaaagatg

SEQ ID NO: 197057 - DNA, 103 bp, Artificial Sequence
  Synthetic Polynucleotide
taatacgactcactataggggcagccagttaaccaaaagatctaggcatgaacagaggagacatgccatgatcttttggaacctggcggcagcgcaaaagatg

SEQ ID NO: 197058 - DNA, 103 bp, Artificial Sequence
  Synthetic Polynucleotide
taatacgactcactatagggaggtatatgtgcagccagttaaccaaaagaaacagaggagatcttttatgtaactggctaacctggcggcagcgcaaaagatg

SEQ ID NO: 197059 - DNA, 103 bp, Artificial Sequence
  Synthetic Polynucleotide
taatacgactcactatagggaacagtttttcttgggggagaattgaaaaaaacagaggagatttttcatgtctcccccaaacctggcggcagcgcaaaagatg

SEQ ID NO: 197060 - DNA, 103 bp, Artificial Sequence
  Synthetic Polynucleotide
taatacgactcactatagggctggttattaaggtatatgtgcagccagttaacagaggagaaactggatgcacatatacaacctggcggcagcgcaaaagatg

SEQ ID NO: 197061 - DNA, 103 bp, Artificial Sequence
  Synthetic Polynucleotide
taatacgactcactatagggttcccgaatcctggttattaaggtatatgtaacagaggagaacatatatgttaataaccaacctggcggcagcgcaaaagatg

SEQ ID NO: 197062 - DNA, 103 bp, Artificial Sequence
  Synthetic Polynucleotide
taatacgactcactatagggaatgcctttgttcccgaatcctggttattaaacagaggagataataaatgggattcgggaacctggcggcagcgcaaaagatg

SEQ ID NO: 197063 - DNA, 103 bp, Artificial Sequence
  Synthetic Polynucleotide
taatacgactcactatagggaacatcgcagaatgcctttgttcccgaatcaacagaggagagattcgatgacaaaggcaaacctggcggcagcgcaaaagatg

SEQ ID NO: 197064 - DNA, 103 bp, Artificial Sequence
  Synthetic Polynucleotide
taatacgactcactatagggcatggagagcaacatcgcagaatgcctttgaacagaggagacaaaggatgtctgcgatgaacctggcggcagcgcaaaagatg

SEQ ID NO: 197065 - DNA, 103 bp, Artificial Sequence
  Synthetic Polynucleotide
taatacgactcactatagggtaaaatggtccatggagagcaacatcgcagaacagaggagactgcgaatgtgctctccaaacctggcggcagcgcaaaagatg

SEQ ID NO: 197066 - DNA, 103 bp, Artificial Sequence
  Synthetic Polynucleotide
taatacgactcactataggggcaggctgagtaaaatggtccatggagagcaacagaggagagctctcatgggaccatttaacctggcggcagcgcaaaagatg

SEQ ID NO: 197067 - DNA, 103 bp, Artificial Sequence
  Synthetic Polynucleotide
taatacgactcactatagggacacagcttggcaggctgagtaaaatggtcaacagaggagagaccatatgactcagcctaacctggcggcagcgcaaaagatg

SEQ ID NO: 197068 - DNA, 103 bp, Artificial Sequence
  Synthetic Polynucleotide
taatacgactcactatagggaaggtgtagaacacagcttggcaggctgagaacagaggagactcagcatgccaagctgtaacctggcggcagcgcaaaagatg

SEQ ID NO: 197069 - DNA, 103 bp, Artificial Sequence
  Synthetic Polynucleotide
taatacgactcactatagggtctaaaaacaaaggtgtagaacacagcttgaacagaggagacaagctatgttctacaccaacctggcggcagcgcaaaagatg

SEQ ID NO: 197070 - DNA, 103 bp, Artificial Sequence
  Synthetic Polynucleotide
taatacgactcactatagggcaccaaaccgaacagtttttcttgggggagaacagaggagactccccatggaaaaactgaacctggcggcagcgcaaaagatg

SEQ ID NO: 197071 - DNA, 103 bp, Artificial Sequence
  Synthetic Polynucleotide
taatacgactcactataggggctgcttgtgtctaaaaacaaaggtgtagaaacagaggagatctacaatgttgtttttaaacctggcggcagcgcaaaagatg

SEQ ID NO: 197072 - DNA, 103 bp, Artificial Sequence
  Synthetic Polynucleotide
taatacgactcactatagggccgctcaaaagctgcttgtgtctaaaaacaaacagaggagatgttttatgacacaagcaaacctggcggcagcgcaaaagatg

SEQ ID NO: 197073 - DNA, 103 bp, Artificial Sequence
  Synthetic Polynucleotide
taatacgactcactatagggtttcaggtttccgctcaaaagctgcttgtgaacagaggagacacaagatgcttttgagcaacctggcggcagcgcaaaagatg

SEQ ID NO: 197074 - DNA, 103 bp, Artificial Sequence
  Synthetic Polynucleotide
taatacgactcactataggggcaaaccttctttcaggtttccgctcaaaaaacagaggagattttgaatggaaacctgaaacctggcggcagcgcaaaagatg

SEQ ID NO: 197075 - DNA, 103 bp, Artificial Sequence
  Synthetic Polynucleotide
taatacgactcactatagggtgaagatactgcaaaccttctttcaggtttaacagaggagaaaacctatgagaaggtttaacctggcggcagcgcaaaagatg

SEQ ID NO: 197076 - DNA, 103 bp, Artificial Sequence
  Synthetic Polynucleotide
taatacgactcactatagggattcagactctgaagatactgcaaaccttcaacagaggagagaaggtatgcagtatcttaacctggcggcagcgcaaaagatg

SEQ ID NO: 197077 - DNA, 103 bp, Artificial Sequence
  Synthetic Polynucleotide
taatacgactcactatagggtccgctcaaaattcagactctgaagatactaacagaggagaagtatcatgagagtctgaaacctggcggcagcgcaaaagatg

SEQ ID NO: 197078 - DNA, 103 bp, Artificial Sequence
  Synthetic Polynucleotide
taatacgactcactatagggctcatcactatccgctcaaaattcagactcaacagaggagagagtctatgttttgagcgaacctggcggcagcgcaaaagatg

SEQ ID NO: 197079 - DNA, 103 bp, Artificial Sequence
  Synthetic Polynucleotide
taatacgactcactatagggatttagctggctcatcactatccgctcaaaaacagaggagatttgagatgatagtgatgaacctggcggcagcgcaaaagatg

SEQ ID NO: 197080 - DNA, 103 bp, Artificial Sequence
  Synthetic Polynucleotide
taatacgactcactatagggtcttcaggggatttagctggctcatcactaaacagaggagatagtgaatggccagctaaaacctggcggcagcgcaaaagatg

SEQ ID NO: 197081 - DNA, 103 bp, Artificial Sequence
  Synthetic Polynucleotide
taatacgactcactataggggtcacagttccaccaaaccgaacagtttttaacagaggagaaaaaacatgtcggtttggaacctggcggcagcgcaaaagatg

SEQ ID NO: 197082 - DNA, 103 bp, Artificial Sequence
  Synthetic Polynucleotide
taatacgactcactatagggggcaggcaaatcttcaggggatttagctggaacagaggagaccagctatgtcccctgaaaacctggcggcagcgcaaaagatg

SEQ ID NO: 197083 - DNA, 103 bp, Artificial Sequence
  Synthetic Polynucleotide
taatacgactcactatagggaaccactgagggcaggcaaatcttcaggggaacagaggagacccctgatgatttgcctgaacctggcggcagcgcaaaagatg

SEQ ID NO: 197084 - DNA, 103 bp, Artificial Sequence
  Synthetic Polynucleotide
taatacgactcactatagggcaaaaaagttaaccactgagggcaggcaaaaacagaggagatttgccatgcctcagtggaacctggcggcagcgcaaaagatg

SEQ ID NO: 197085 - DNA, 103 bp, Artificial Sequence
  Synthetic Polynucleotide
taatacgactcactataggggtgattgcagcaaaaaagttaaccactgagaacagaggagactcagtatgtaactttttaacctggcggcagcgcaaaagatg

SEQ ID NO: 197086 - DNA, 103 bp, Artificial Sequence
  Synthetic Polynucleotide
taatacgactcactataggggtacttatttgtgattgcagcaaaaaagttaacagaggagaaactttatggctgcaatcaacctggcggcagcgcaaaagatg

SEQ ID NO: 197087 - DNA, 103 bp, Artificial Sequence
  Synthetic Polynucleotide
taatacgactcactatagggagacgagctggtacttatttgtgattgcagaacagaggagactgcaaatgcaaataagtaacctggcggcagcgcaaaagatg

SEQ ID NO: 197088 - DNA, 103 bp, Artificial Sequence
  Synthetic Polynucleotide
taatacgactcactataggggtgtagcagaagacgagctggtacttatttaacagaggagaaaataaatgccagctcgtaacctggcggcagcgcaaaagatg

SEQ ID NO: 197089 - DNA, 103 bp, Artificial Sequence
  Synthetic Polynucleotide
taatacgactcactatagggctcaatgatggtgtagcagaagacgagctgaacagaggagacagctcatgttctgctacaacctggcggcagcgcaaaagatg

SEQ ID NO: 197090 - DNA, 103 bp, Artificial Sequence
  Synthetic Polynucleotide
taatacgactcactataggggattgttcctctcaatgatggtgtagcagaaacagaggagatctgctatgccatcattgaacctggcggcagcgcaaaagatg

SEQ ID NO: 197091 - DNA, 103 bp, Artificial Sequence
  Synthetic Polynucleotide
taatacgactcactatagggagcatctggcgattgttcctctcaatgatgaacagaggagacatcatatggaggaacaaaacctggcggcagcgcaaaagatg

SEQ ID NO: 197092 - DNA, 103 bp, Artificial Sequence
  Synthetic Polynucleotide
taatacgactcactatagggcaagacttctgtcacagttccaccaaaccgaacagaggagacggtttatgggaactgtgaacctggcggcagcgcaaaagatg

SEQ ID NO: 197093 - DNA, 103 bp, Artificial Sequence
  Synthetic Polynucleotide
taatacgactcactatagggaatgactggcagcatctggcgattgttcctaacagaggagaaggaacatgcgccagatgaacctggcggcagcgcaaaagatg

SEQ ID NO: 197094 - DNA, 103 bp, Artificial Sequence
  Synthetic Polynucleotide
taatacgactcactatagggcggtactcctaatgactggcagcatctggcaacagaggagagccagaatgtgccagtcaaacctggcggcagcgcaaaagatg

SEQ ID NO: 197095 - DNA, 103 bp, Artificial Sequence
  Synthetic Polynucleotide
taatacgactcactatagggtctcctccagcggtactcctaatgactggcaacagaggagagccagtatgtaggagtacaacctggcggcagcgcaaaagatg

SEQ ID NO: 197096 - DNA, 103 bp, Artificial Sequence
  Synthetic Polynucleotide
taatacgactcactatagggctgcactgagtctcctccagcggtactcctaacagaggagaaggagtatggctggaggaaacctggcggcagcgcaaaagatg

SEQ ID NO: 197097 - DNA, 103 bp, Artificial Sequence
  Synthetic Polynucleotide
taatacgactcactatagggttgtgcagatctgcactgagtctcctccagaacagaggagactggagatgactcagtgcaacctggcggcagcgcaaaagatg

SEQ ID NO: 197098 - DNA, 103 bp, Artificial Sequence
  Synthetic Polynucleotide
taatacgactcactatagggtccagcgggtttgtgcagatctgcactgagaacagaggagactcagtatggatctgcacaacctggcggcagcgcaaaagatg

SEQ ID NO: 197099 - DNA, 103 bp, Artificial Sequence
  Synthetic Polynucleotide
taatacgactcactataggggaagaaggtgtccagcgggtttgtgcagataacagaggagaatctgcatgaacccgctgaacctggcggcagcgcaaaagatg

SEQ ID NO: 197100 - DNA, 103 bp, Artificial Sequence
  Synthetic Polynucleotide
taatacgactcactataggggatcaaaggggaagaaggtgtccagcgggtaacagaggagaacccgcatgacaccttctaacctggcggcagcgcaaaagatg

SEQ ID NO: 197101 - DNA, 103 bp, Artificial Sequence
  Synthetic Polynucleotide
taatacgactcactatagggagcacacagggatcaaaggggaagaaggtgaacagaggagacaccttatgcccctttgaaacctggcggcagcgcaaaagatg

SEQ ID NO: 197102 - DNA, 103 bp, Artificial Sequence
  Synthetic Polynucleotide
taatacgactcactatagggtgacctcttcagcacacagggatcaaagggaacagaggagaccctttatgccctgtgtgaacctggcggcagcgcaaaagatg

SEQ ID NO: 197103 - DNA, 103 bp, Artificial Sequence
  Synthetic Polynucleotide
taatacgactcactatagggtgtacttcagcaagacttctgtcacagttcaacagaggagagaactgatgcagaagtctaacctggcggcagcgcaaaagatg

SEQ ID NO: 197104 - DNA, 103 bp, Artificial Sequence
  Synthetic Polynucleotide
taatacgactcactatagggtgaatttctttgacctcttcagcacacaggaacagaggagacctgtgatgtgaagaggtaacctggcggcagcgcaaaagatg

SEQ ID NO: 197105 - DNA, 103 bp, Artificial Sequence
  Synthetic Polynucleotide
taatacgactcactatagggataggatcaatgaatttctttgacctcttcaacagaggagagaagagatgaaagaaattaacctggcggcagcgcaaaagatg

SEQ ID NO: 197106 - DNA, 103 bp, Artificial Sequence
  Synthetic Polynucleotide
taatacgactcactatagggcacctgataaataggatcaatgaatttcttaacagaggagaaagaaaatgattgatcctaacctggcggcagcgcaaaagatg

SEQ ID NO: 197107 - DNA, 103 bp, Artificial Sequence
  Synthetic Polynucleotide
taatacgactcactatagggtgtcttcccacacctgataaataggatcaaaacagaggagattgatcatgtttatcaggaacctggcggcagcgcaaaagatg

SEQ ID NO: 197108 - DNA, 103 bp, Artificial Sequence
  Synthetic Polynucleotide
taatacgactcactatagggtcagcactcatgtcttcccacacctgataaaacagaggagattatcaatggtgggaagaaacctggcggcagcgcaaaagatg

SEQ ID NO: 197109 - DNA, 103 bp, Artificial Sequence
  Synthetic Polynucleotide
taatacgactcactatagggctgtagctcttcagcactcatgtcttcccaaacagaggagatgggaaatgatgagtgctaacctggcggcagcgcaaaagatg

SEQ ID NO: 197110 - DNA, 103 bp, Artificial Sequence
  Synthetic Polynucleotide
taatacgactcactatagggtcttgaactcctgtagctcttcagcactcaaacagaggagatgagtgatgaagagctacaacctggcggcagcgcaaaagatg

SEQ ID NO: 197111 - DNA, 103 bp, Artificial Sequence
  Synthetic Polynucleotide
taatacgactcactatagggttcatgggtttcttgaactcctgtagctctaacagaggagaagagctatgggagttcaaaacctggcggcagcgcaaaagatg

SEQ ID NO: 197112 - DNA, 103 bp, Artificial Sequence
  Synthetic Polynucleotide
taatacgactcactatagggtatgtcctttttcatgggtttcttgaactcaacagaggagagagttcatgaaacccatgaacctggcggcagcgcaaaagatg

SEQ ID NO: 197113 - DNA, 103 bp, Artificial Sequence
  Synthetic Polynucleotide
taatacgactcactatagggcatcttccactatgtcctttttcatgggttaacagaggagaaacccaatgaaaaggacaaacctggcggcagcgcaaaagatg

SEQ ID NO: 197114 - DNA, 103 bp, Artificial Sequence
  Synthetic Polynucleotide
taatacgactcactatagggtcaccctttttgtacttcagcaagacttctaacagaggagaagaagtatggctgaagtaaacctggcggcagcgcaaaagatg

SEQ ID NO: 197115 - DNA, 103 bp, Artificial Sequence
  Synthetic Polynucleotide
taatacgactcactatagggtcatcatcttcatcttccactatgtcctttaacagaggagaaaaggaatgagtggaagaaacctggcggcagcgcaaaagatg

SEQ ID NO: 197116 - DNA, 103 bp, Artificial Sequence
  Synthetic Polynucleotide
taatacgactcactatagggtttcagaaagtcatcatcttcatcttccacaacagaggagagtggaaatggaagatgataacctggcggcagcgcaaaagatg

SEQ ID NO: 197117 - DNA, 103 bp, Artificial Sequence
  Synthetic Polynucleotide
taatacgactcactataggggcacttcgcctttcagaaagtcatcatcttaacagaggagaaagatgatgactttctgaaacctggcggcagcgcaaaagatg

SEQ ID NO: 197118 - DNA, 103 bp, Artificial Sequence
  Synthetic Polynucleotide
taatacgactcactatagggtcattctggggcacttcgcctttcagaaagaacagaggagactttctatgaggcgaagtaacctggcggcagcgcaaaagatg

SEQ ID NO: 197119 - DNA, 103 bp, Artificial Sequence
  Synthetic Polynucleotide
taatacgactcactatagggaatcacggtatcattctggggcacttcgccaacagaggagaggcgaaatgccccagaataacctggcggcagcgcaaaagatg

SEQ ID NO: 197120 - DNA, 103 bp, Artificial Sequence
  Synthetic Polynucleotide
taatacgactcactataggggtgtgatcccaatcacggtatcattctgggaacagaggagacccagaatgataccgtgaaacctggcggcagcgcaaaagatg

SEQ ID NO: 197121 - DNA, 103 bp, Artificial Sequence
  Synthetic Polynucleotide
taatacgactcactatagggaaggagcttggtgtgatcccaatcacggtaaacagaggagataccgtatgtgggatcacaacctggcggcagcgcaaaagatg

SEQ ID NO: 197122 - DNA, 103 bp, Artificial Sequence
  Synthetic Polynucleotide
taatacgactcactatagggatgcgtgtcaaaggagcttggtgtgatcccaacagaggagagggatcatgccaagctccaacctggcggcagcgcaaaagatg

SEQ ID NO: 197123 - DNA, 103 bp, Artificial Sequence
  Synthetic Polynucleotide
taatacgactcactataggggacttcggaaatgcgtgtcaaaggagcttgaacagaggagacaagctatgttgacacgcaacctggcggcagcgcaaaagatg

SEQ ID NO: 197124 - DNA, 103 bp, Artificial Sequence
  Synthetic Polynucleotide
taatacgactcactatagggctacttgaaggacttcggaaatgcgtgtcaaacagaggagatgacacatgtttccgaagaacctggcggcagcgcaaaagatg

SEQ ID NO: 197125 - DNA, 103 bp, Artificial Sequence
  Synthetic Polynucleotide
taatacgactcactataggggtcatttgtttcaccctttttgtacttcagaacagaggagactgaagatgaaaaagggtaacctggcggcagcgcaaaagatg

SEQ ID NO: 197126 - DNA, 103 bp, Artificial Sequence
  Synthetic Polynucleotide
taatacgactcactatagggggagcccacactacttgaaggacttcggaaaacagaggagattccgaatgccttcaagtaacctggcggcagcgcaaaagatg

SEQ ID NO: 197127 - DNA, 103 bp, Artificial Sequence
  Synthetic Polynucleotide
taatacgactcactatagggacacgggtggggagcccacactacttgaagaacagaggagacttcaaatggtgtgggctaacctggcggcagcgcaaaagatg

SEQ ID NO: 197128 - DNA, 103 bp, Artificial Sequence
  Synthetic Polynucleotide
taatacgactcactatagggtgcatgtacaacacgggtggggagcccacaaacagaggagatgtgggatgcccacccgtaacctggcggcagcgcaaaagatg

SEQ ID NO: 197129 - DNA, 103 bp, Artificial Sequence
  Synthetic Polynucleotide
taatacgactcactataggggggactgggttgcatgtacaacacgggtggaacagaggagaccacccatgttgtacatgaacctggcggcagcgcaaaagatg

SEQ ID NO: 197130 - DNA, 103 bp, Artificial Sequence
  Synthetic Polynucleotide
taatacgactcactatagggcatctcccggcaaacgcgtgtgaagcagcgaacagaggagacgctgcatgacacgcgttaacctggcggcagcgcaaaagatg

SEQ ID NO: 197131 - DNA, 103 bp, Artificial Sequence
  Synthetic Polynucleotide
taatacgactcactatagggacaactcaaagtcatttgtttcacccttttaacagaggagaaaaaggatgaaacaaatgaacctggcggcagcgcaaaagatg

SEQ ID NO: 197132 - DNA, 103 bp, Artificial Sequence
  Synthetic Polynucleotide
taatacgactcactatagggtggttcttcaacaactcaaagtcatttgttaacagaggagaaacaaaatgctttgagttaacctggcggcagcgcaaaagatg

SEQ ID NO: 197133 - DNA, 103 bp, Artificial Sequence
  Synthetic Polynucleotide
taatacgactcactatagggatctaacagctggttcttcaacaactcaaaaacagaggagatttgagatgttgaagaacaacctggcggcagcgcaaaagatg

SEQ ID NO: 197134 - DNA, 103 bp, Artificial Sequence
  Synthetic Polynucleotide
taatacgactcactatagggttatgtctggatctaacagctggttcttcaaacagaggagatgaagaatgagctgttagaacctggcggcagcgcaaaagatg

SEQ ID NO: 197135 - DNA, 103 bp, Artificial Sequence
  Synthetic Polynucleotide
taatacgactcactatagggtggtcatcctttatgtctggatctaacagcaacagaggagagctgttatgtccagacataacctggcggcagcgcaaaagatg

SEQ ID NO: 197136 - DNA, 103 bp, Artificial Sequence
  Synthetic Polynucleotide
taatacgactcactataggggttgatgatctggtcatcctttatgtctggaacagaggagaccagacatgaaggatgacaacctggcggcagcgcaaaagatg

SEQ ID NO: 197137 - DNA, 103 bp, Artificial Sequence
  Synthetic Polynucleotide
taatacgactcactatagggctagcagccagttgatgatctggtcatcctaacagaggagaaggatgatgagatcatcaaacctggcggcagcgcaaaagatg

SEQ ID NO: 197138 - DNA, 103 bp, Artificial Sequence
  Synthetic Polynucleotide
taatacgactcactataggggaacggaattctagcagccagttgatgatcaacagaggagagatcatatgctggctgctaacctggcggcagcgcaaaagatg

SEQ ID NO: 197139 - DNA, 103 bp, Artificial Sequence
  Synthetic Polynucleotide
taatacgactcactatagggcatgatagaagaacggaattctagcagccaaacagaggagatggctgatggaattccgtaacctggcggcagcgcaaaagatg

SEQ ID NO: 197140 - DNA, 103 bp, Artificial Sequence
  Synthetic Polynucleotide
taatacgactcactatagggttgtcaagtacatgatagaagaacggaattaacagaggagaaattccatgcttctatcaaacctggcggcagcgcaaaagatg

SEQ ID NO: 197141 - DNA, 103 bp, Artificial Sequence
  Synthetic Polynucleotide
taatacgactcactataggggaagcggccgcatctcccggcaaacgcgtgaacagaggagacacgcgatggccgggagaaacctggcggcagcgcaaaagatg

SEQ ID NO: 197142 - DNA, 103 bp, Artificial Sequence
  Synthetic Polynucleotide
taatacgactcactatagggtcaaagtcttttgtcaagtacatgatagaaaacagaggagattctatatggtacttgacaacctggcggcagcgcaaaagatg

SEQ ID NO: 197143 - DNA, 103 bp, Artificial Sequence
  Synthetic Polynucleotide
taatacgactcactataggggataagttgctcaaagtcttttgtcaagtaaacagaggagatacttgatgaaagactttaacctggcggcagcgcaaaagatg

SEQ ID NO: 197144 - DNA, 103 bp, Artificial Sequence
  Synthetic Polynucleotide
taatacgactcactatagggatataatactgataagttgctcaaagtcttaacagaggagaaagactatgagcaacttaaacctggcggcagcgcaaaagatg

SEQ ID NO: 197145 - DNA, 103 bp, Artificial Sequence
  Synthetic Polynucleotide
taatacgactcactatagggggcaatcttaatataatactgataagttgcaacagaggagagcaactatgcagtattataacctggcggcagcgcaaaagatg

SEQ ID NO: 197146 - DNA, 103 bp, Artificial Sequence
  Synthetic Polynucleotide
taatacgactcactatagggattcaaccaaggcaatcttaatataatactaacagaggagaagtattatgttaagattgaacctggcggcagcgcaaaagatg

SEQ ID NO: 197147 - DNA, 103 bp, Artificial Sequence
  Synthetic Polynucleotide
taatacgactcactatagggtttgacttctattcaaccaaggcaatcttaaacagaggagataagatatgcttggttgaaacctggcggcagcgcaaaagatg

SEQ ID NO: 197148 - DNA, 103 bp, Artificial Sequence
  Synthetic Polynucleotide
taatacgactcactatagggtccactactgtttgacttctattcaaccaaaacagaggagattggttatgtagaagtcaaacctggcggcagcgcaaaagatg

SEQ ID NO: 197149 - DNA, 103 bp, Artificial Sequence
  Synthetic Polynucleotide
taatacgactcactatagggcaaatactcttccactactgtttgacttctaacagaggagaagaagtatgacagtagtgaacctggcggcagcgcaaaagatg

SEQ ID NO: 197150 - DNA, 103 bp, Artificial Sequence
  Synthetic Polynucleotide
taatacgactcactatagggcaagaaaagccaaatactcttccactactgaacagaggagacagtagatgaagagtattaacctggcggcagcgcaaaagatg

SEQ ID NO: 197151 - DNA, 103 bp, Artificial Sequence
  Synthetic Polynucleotide
taatacgactcactatagggacaagattaccaagaaaagccaaatactctaacagaggagaagagtaatgggcttttctaacctggcggcagcgcaaaagatg

SEQ ID NO: 197152 - DNA, 103 bp, Artificial Sequence
  Synthetic Polynucleotide
taatacgactcactatagggtgcagaggacgaagcggccgcatctcccggaacagaggagaccgggaatggcggccgctaacctggcggcagcgcaaaagatg

SEQ ID NO: 197153 - DNA, 103 bp, Artificial Sequence
  Synthetic Polynucleotide
taatacgactcactatagggctgtgctgatacaagattaccaagaaaagcaacagaggagagcttttatgggtaatcttaacctggcggcagcgcaaaagatg

SEQ ID NO: 197154 - DNA, 103 bp, Artificial Sequence
  Synthetic Polynucleotide
taatacgactcactatagggggaaaacagtctgtgctgatacaagattacaacagaggagagtaatcatgtatcagcacaacctggcggcagcgcaaaagatg

SEQ ID NO: 197155 - DNA, 103 bp, Artificial Sequence
  Synthetic Polynucleotide
taatacgactcactatagggcacggtctgaggaaaacagtctgtgctgataacagaggagaatcagcatggactgttttaacctggcggcagcgcaaaagatg

SEQ ID NO: 197156 - DNA, 103 bp, Artificial Sequence
  Synthetic Polynucleotide
taatacgactcactatagggcatgctgagacacggtctgaggaaaacagtaacagaggagaactgttatgctcagaccgaacctggcggcagcgcaaaagatg

SEQ ID NO: 197157 - DNA, 103 bp, Artificial Sequence
  Synthetic Polynucleotide
taatacgactcactataggggggaagcaatcatgctgagacacggtctgaaacagaggagatcagacatggtctcagcaaacctggcggcagcgcaaaagatg

SEQ ID NO: 197158 - DNA, 103 bp, Artificial Sequence
  Synthetic Polynucleotide
taatacgactcactatagggggcacaaaatgggaagcaatcatgctgagaaacagaggagatctcagatggattgcttcaacctggcggcagcgcaaaagatg

SEQ ID NO: 197159 - DNA, 103 bp, Artificial Sequence
  Synthetic Polynucleotide
taatacgactcactatagggcactcggggaggcacaaaatgggaagcaataacagaggagaattgctatgcattttgtgaacctggcggcagcgcaaaagatg

SEQ ID NO: 197160 - DNA, 103 bp, Artificial Sequence
  Synthetic Polynucleotide
taatacgactcactatagggccttaatgatcactcggggaggcacaaaataacagaggagaattttgatgctccccgagaacctggcggcagcgcaaaagatg

SEQ ID NO: 197161 - DNA, 103 bp, Artificial Sequence
  Synthetic Polynucleotide
taatacgactcactatagggacatcgccttccttaatgatcactcggggaaacagaggagatccccgatggatcattaaaacctggcggcagcgcaaaagatg

SEQ ID NO: 197162 - DNA, 103 bp, Artificial Sequence
  Synthetic Polynucleotide
taatacgactcactatagggtgaaacatctacatcgccttccttaatgataacagaggagaatcattatggaaggcgataacctggcggcagcgcaaaagatg

SEQ ID NO: 197163 - DNA, 103 bp, Artificial Sequence
  Synthetic Polynucleotide
taatacgactcactataggggcttcttaactgcagaggacgaagcggccgaacagaggagacggccgatgcgtcctctgaacctggcggcagcgcaaaagatg

SEQ ID NO: 197164 - DNA, 103 bp, Artificial Sequence
  Synthetic Polynucleotide
taatacgactcactatagggcatcagaatctgaaacatctacatcgccttaacagaggagaaaggcgatgtagatgtttaacctggcggcagcgcaaaagatg

SEQ ID NO: 197165 - DNA, 103 bp, Artificial Sequence
  Synthetic Polynucleotide
taatacgactcactatagggtcatcttcatcatcagaatctgaaacatctaacagaggagaagatgtatgagattctgaaacctggcggcagcgcaaaagatg

SEQ ID NO: 197166 - DNA, 103 bp, Artificial Sequence
  Synthetic Polynucleotide
taatacgactcactatagggaggaagattatcatcttcatcatcagaatcaacagaggagagattctatggatgaagataacctggcggcagcgcaaaagatg

SEQ ID NO: 197167 - DNA, 103 bp, Artificial Sequence
  Synthetic Polynucleotide
taatacgactcactatagggcaaaatttgcaggaagattatcatcttcataacagaggagaatgaagatgataatcttcaacctggcggcagcgcaaaagatg

SEQ ID NO: 197168 - DNA, 103 bp, Artificial Sequence
  Synthetic Polynucleotide
taatacgactcactatagggtgacatgtgtcaaaatttgcaggaagattaaacagaggagataatctatgtgcaaatttaacctggcggcagcgcaaaagatg

SEQ ID NO: 197169 - DNA, 103 bp, Artificial Sequence
  Synthetic Polynucleotide
taatacgactcactatagggcaaggctctgtgacatgtgtcaaaatttgcaacagaggagagcaaatatggacacatgtaacctggcggcagcgcaaaagatg

SEQ ID NO: 197170 - DNA, 103 bp, Artificial Sequence
  Synthetic Polynucleotide
taatacgactcactatagggctattatttgcaaggctctgtgacatgtgtaacagaggagaacacatatgacagagcctaacctggcggcagcgcaaaagatg

SEQ ID NO: 197171 - DNA, 103 bp, Artificial Sequence
  Synthetic Polynucleotide
taatacgactcactatagggacatatcttgctattatttgcaaggctctgaacagaggagacagagcatggcaaataataacctggcggcagcgcaaaagatg

SEQ ID NO: 197172 - DNA, 103 bp, Artificial Sequence
  Synthetic Polynucleotide
taatacgactcactatagggtgtcgatggtacatatcttgctattatttgaacagaggagacaaataatggcaagatataacctggcggcagcgcaaaagatg

SEQ ID NO: 197173 - DNA, 103 bp, Artificial Sequence
  Synthetic Polynucleotide
taatacgactcactataggggaaaccacggtgtcgatggtacatatcttgaacagaggagacaagatatgtaccatcgaaacctggcggcagcgcaaaagatg

SEQ ID NO: 197174 - DNA, 103 bp, Artificial Sequence
  Synthetic Polynucleotide
taatacgactcactataggggacgcgcccagcttcttaactgcagaggacaacagaggagagtcctcatgagttaagaaaacctggcggcagcgcaaaagatg

SEQ ID NO: 197175 - DNA, 103 bp, Artificial Sequence
  Synthetic Polynucleotide
taatacgactcactatagggattggcatgagaaaccacggtgtcgatggtaacagaggagaaccatcatgaccgtggttaacctggcggcagcgcaaaagatg

SEQ ID NO: 197176 - DNA, 103 bp, Artificial Sequence
  Synthetic Polynucleotide
taatacgactcactatagggttccaccagtattggcatgagaaaccacggaacagaggagaccgtggatgctcatgccaaacctggcggcagcgcaaaagatg

SEQ ID NO: 197177 - DNA, 103 bp, Artificial Sequence
  Synthetic Polynucleotide
taatacgactcactatagggatggaaatttttccaccagtattggcatgaaacagaggagatcatgcatgtactggtggaacctggcggcagcgcaaaagatg

SEQ ID NO: 197178 - DNA, 103 bp, Artificial Sequence
  Synthetic Polynucleotide
taatacgactcactatagggtttcgaacaaatggaaatttttccaccagtaacagaggagaactggtatgaaaatttccaacctggcggcagcgcaaaagatg

SEQ ID NO: 197179 - DNA, 103 bp, Artificial Sequence
  Synthetic Polynucleotide
taatacgactcactatagggtctctctgattttcgaacaaatggaaatttaacagaggagaaaatttatgtttgttcgaaacctggcggcagcgcaaaagatg

SEQ ID NO: 197180 - DNA, 103 bp, Artificial Sequence
  Synthetic Polynucleotide
taatacgactcactatagggattccagtgttctctctgattttcgaacaaaacagaggagattgttcatgaatcagagaaacctggcggcagcgcaaaagatg

SEQ ID NO: 197181 - DNA, 103 bp, Artificial Sequence
  Synthetic Polynucleotide
taatacgactcactatagggtgaacgtaacattccagtgttctctctgataacagaggagaatcagaatgaacactggaaacctggcggcagcgcaaaagatg

SEQ ID NO: 197182 - DNA, 103 bp, Artificial Sequence
  Synthetic Polynucleotide
taatacgactcactatagggtagtaagttatgaacgtaacattccagtgtaacagaggagaacactgatgtgttacgttaacctggcggcagcgcaaaagatg

SEQ ID NO: 197183 - DNA, 103 bp, Artificial Sequence
  Synthetic Polynucleotide
taatacgactcactatagggcactaatccttagtaagttatgaacgtaacaacagaggagagttacgatgataacttacaacctggcggcagcgcaaaagatg

SEQ ID NO: 197184 - DNA, 103 bp, Artificial Sequence
  Synthetic Polynucleotide
taatacgactcactatagggggaaaatatacactaatccttagtaagttaaacagaggagataacttatgaaggattagaacctggcggcagcgcaaaagatg

SEQ ID NO: 197185 - DNA, 103 bp, Artificial Sequence
  Synthetic Polynucleotide
taatacgactcactatagggcccagtcctcgacgcgcccagcttcttaacaacagaggagagttaagatgctgggcgcgaacctggcggcagcgcaaaagatg

SEQ ID NO: 197186 - DNA, 103 bp, Artificial Sequence
  Synthetic Polynucleotide
taatacgactcactatagggcctcaaggttggaaaatatacactaatcctaacagaggagaaggattatggtatattttaacctggcggcagcgcaaaagatg

SEQ ID NO: 197187 - DNA, 103 bp, Artificial Sequence
  Synthetic Polynucleotide
taatacgactcactataggggaatttcatgcctcaaggttggaaaatataaacagaggagatatattatgcaaccttgaaacctggcggcagcgcaaaagatg

SEQ ID NO: 197188 - DNA, 103 bp, Artificial Sequence
  Synthetic Polynucleotide
taatacgactcactatagggataagctccagaatttcatgcctcaaggttaacagaggagaaaccttatggcatgaaataacctggcggcagcgcaaaagatg

SEQ ID NO: 197189 - DNA, 103 bp, Artificial Sequence
  Synthetic Polynucleotide
taatacgactcactatagggtttttcaataataagctccagaatttcatgaacagaggagacatgaaatgctggagcttaacctggcggcagcgcaaaagatg

SEQ ID NO: 197190 - DNA, 103 bp, Artificial Sequence
  Synthetic Polynucleotide
taatacgactcactatagggacttgagtagtttttcaataataagctccaaacagaggagatggagcatgttattgaaaaacctggcggcagcgcaaaagatg

SEQ ID NO: 197191 - DNA, 103 bp, Artificial Sequence
  Synthetic Polynucleotide
taatacgactcactatagggttcacatccaacttgagtagtttttcaataaacagaggagatattgaatgactactcaaaacctggcggcagcgcaaaagatg

SEQ ID NO: 197192 - DNA, 103 bp, Artificial Sequence
  Synthetic Polynucleotide
taatacgactcactatagggccgggatgcattcacatccaacttgagtagaacagaggagactactcatgttggatgtgaacctggcggcagcgcaaaagatg

SEQ ID NO: 197193 - DNA, 103 bp, Artificial Sequence
  Synthetic Polynucleotide
taatacgactcactatagggcaataccctgccgggatgcattcacatccaaacagaggagatggatgatgatgcatcccaacctggcggcagcgcaaaagatg

SEQ ID NO: 197194 - DNA, 103 bp, Artificial Sequence
  Synthetic Polynucleotide
taatacgactcactatagggtcagcatcttcaataccctgccgggatgcaaacagaggagatgcatcatggcagggtataacctggcggcagcgcaaaagatg

SEQ ID NO: 197195 - DNA, 103 bp, Artificial Sequence
  Synthetic Polynucleotide
taatacgactcactatagggtgctgtttcttcagcatcttcaataccctgaacagaggagacagggtatggaagatgctaacctggcggcagcgcaaaagatg

SEQ ID NO: 197196 - DNA, 103 bp, Artificial Sequence
  Synthetic Polynucleotide
taatacgactcactatagggtatttgaaatcccagtcctcgacgcgcccaaacagaggagatgggcgatgcgaggactgaacctggcggcagcgcaaaagatg

SEQ ID NO: 197197 - DNA, 103 bp, Artificial Sequence
  Synthetic Polynucleotide
taatacgactcactatagggaagtttgagttgctgtttcttcagcatcttaacagaggagaaagatgatgaagaaacagaacctggcggcagcgcaaaagatg

SEQ ID NO: 197198 - DNA, 103 bp, Artificial Sequence
  Synthetic Polynucleotide
taatacgactcactataggggtcccaccacaagtttgagttgctgtttctaacagaggagaagaaacatgaactcaaacaacctggcggcagcgcaaaagatg

SEQ ID NO: 197199 - DNA, 103 bp, Artificial Sequence
  Synthetic Polynucleotide
taatacgactcactatagggcgtggaatctgtcccaccacaagtttgagtaacagaggagaactcaaatgtgtggtgggaacctggcggcagcgcaaaagatg

SEQ ID NO: 197200 - DNA, 103 bp, Artificial Sequence
  Synthetic Polynucleotide
taatacgactcactatagggacaatccttccgtggaatctgtcccaccacaacagaggagagtggtgatgcagattccaaacctggcggcagcgcaaaagatg

SEQ ID NO: 197201 - DNA, 103 bp, Artificial Sequence
  Synthetic Polynucleotide
taatacgactcactatagggtccatattaaacaatccttccgtggaatctaacagaggagaagattcatgggaaggattaacctggcggcagcgcaaaagatg

SEQ ID NO: 197202 - DNA, 103 bp, Artificial Sequence
  Synthetic Polynucleotide
taatacgactcactatagggttcatcttcatccatattaaacaatccttcaacagaggagagaaggaatgtttaatatgaacctggcggcagcgcaaaagatg

SEQ ID NO: 197203 - DNA, 103 bp, Artificial Sequence
  Synthetic Polynucleotide
taatacgactcactataggggttcagtttcttcatcttcatccatattaaaacagaggagattaataatgatgaagatgaacctggcggcagcgcaaaagatg

SEQ ID NO: 197204 - DNA, 103 bp, Artificial Sequence
  Synthetic Polynucleotide
taatacgactcactatagggtttgtttcatgttcagtttcttcatcttcaaacagaggagatgaagaatgagaaactgaaacctggcggcagcgcaaaagatg

SEQ ID NO: 197205 - DNA, 103 bp, Artificial Sequence
  Synthetic Polynucleotide
taatacgactcactatagggaggaccagcctttgtttcatgttcagtttcaacagaggagagaaactatgcatgaaacaaacctggcggcagcgcaaaagatg

SEQ ID NO: 197206 - DNA, 103 bp, Artificial Sequence
  Synthetic Polynucleotide
taatacgactcactatagggcgagccgttcaggaccagcctttgtttcataacagaggagaatgaaaatgaggctggtcaacctggcggcagcgcaaaagatg

SEQ ID NO: 197207 - DNA, 103 bp, Artificial Sequence
  Synthetic Polynucleotide
taatacgactcactatagggaatgcacgcatatttgaaatcccagtcctcaacagaggagagaggacatggatttcaaaaacctggcggcagcgcaaaagatg

SEQ ID NO: 197208 - DNA, 103 bp, Artificial Sequence
  Synthetic Polynucleotide
taatacgactcactatagggaccatctggtcgagccgttcaggaccagccaacagaggagaggctggatgtgaacggctaacctggcggcagcgcaaaagatg

SEQ ID NO: 197209 - DNA, 103 bp, Artificial Sequence
  Synthetic Polynucleotide
taatacgactcactatagggtacaggatgcaccatctggtcgagccgttcaacagaggagagaacggatggaccagatgaacctggcggcagcgcaaaagatg

SEQ ID NO: 197210 - DNA, 103 bp, Artificial Sequence
  Synthetic Polynucleotide
taatacgactcactatagggggcgctcggctacaggatgcaccatctggtaacagaggagaaccagaatgtgcatcctgaacctggcggcagcgcaaaagatg

SEQ ID NO: 197211 - DNA, 103 bp, Artificial Sequence
  Synthetic Polynucleotide
taatacgactcactatagggaggatgtccaggcgctcggctacaggatgcaacagaggagagcatccatgagccgagcgaacctggcggcagcgcaaaagatg

SEQ ID NO: 197212 - DNA, 103 bp, Artificial Sequence
  Synthetic Polynucleotide
taatacgactcactatagggcaaagacatcaggatgtccaggcgctcggcaacagaggagagccgagatgctggacatcaacctggcggcagcgcaaaagatg

SEQ ID NO: 197213 - DNA, 103 bp, Artificial Sequence
  Synthetic Polynucleotide
taatacgactcactatagggaggacaaaaccaaagacatcaggatgtccaaacagaggagatggacaatgtgatgtcttaacctggcggcagcgcaaaagatg

SEQ ID NO: 197214 - DNA, 103 bp, Artificial Sequence
  Synthetic Polynucleotide
taatacgactcactatagggtccttcatgtaggacaaaaccaaagacatcaacagaggagagatgtcatgggttttgtcaacctggcggcagcgcaaaagatg

SEQ ID NO: 197215 - DNA, 103 bp, Artificial Sequence
  Synthetic Polynucleotide
taatacgactcactatagggatagcagacatccttcatgtaggacaaaacaacagaggagagttttgatgtacatgaagaacctggcggcagcgcaaaagatg

SEQ ID NO: 197216 - DNA, 103 bp, Artificial Sequence
  Synthetic Polynucleotide
taatacgactcactatagggtaccatctacatagcagacatccttcatgtaacagaggagaacatgaatgatgtctgctaacctggcggcagcgcaaaagatg

SEQ ID NO: 197217 - DNA, 103 bp, Artificial Sequence
  Synthetic Polynucleotide
taatacgactcactatagggttatcaaccttaccatctacatagcagacaaacagaggagatgtctgatgtgtagatggaacctggcggcagcgcaaaagatg

SEQ ID NO: 197218 - DNA, 103 bp, Artificial Sequence
  Synthetic Polynucleotide
taatacgactcactatagggaaatgactcaaatatgctgtctgaagccataacagaggagaatggctatggacagcataaacctggcggcagcgcaaaagatg

SEQ ID NO: 197219 - DNA, 103 bp, Artificial Sequence
  Synthetic Polynucleotide
taatacgactcactataggggaagcggcggctcgtgctggcatcgtggacaacagaggagagtccacatggccagcacgaacctggcggcagcgcaaaagatg

SEQ ID NO: 197220 - DNA, 103 bp, Artificial Sequence
  Synthetic Polynucleotide
taatacgactcactataggggggcagcgcggggaactggcgcgggtcgctaacagaggagaagcgacatgcgccagttcaacctggcggcagcgcaaaagatg

SEQ ID NO: 197221 - DNA, 103 bp, Artificial Sequence
  Synthetic Polynucleotide
taatacgactcactatagggcggagatggagggcagcgcggggaactggcaacagaggagagccagtatgccgcgctgcaacctggcggcagcgcaaaagatg

SEQ ID NO: 197222 - DNA, 103 bp, Artificial Sequence
  Synthetic Polynucleotide
taatacgactcactatagggatgcgggggtcggagatggagggcagcgcgaacagaggagacgcgctatgctccatctcaacctggcggcagcgcaaaagatg

SEQ ID NO: 197223 - DNA, 103 bp, Artificial Sequence
  Synthetic Polynucleotide
taatacgactcactatagggtggatagtgcatgcgggggtcggagatggaaacagaggagatccatcatggacccccgcaacctggcggcagcgcaaaagatg

SEQ ID NO: 197224 - DNA, 103 bp, Artificial Sequence
  Synthetic Polynucleotide
taatacgactcactatagggtgaaggcgcctggatagtgcatgcgggggtaacagaggagaacccccatgtgcactatcaacctggcggcagcgcaaaagatg

SEQ ID NO: 197225 - DNA, 103 bp, Artificial Sequence
  Synthetic Polynucleotide
taatacgactcactatagggggggagtaggtgaaggcgcctggatagtgcaacagaggagagcactaatgaggcgccttaacctggcggcagcgcaaaagatg

SEQ ID NO: 197226 - DNA, 103 bp, Artificial Sequence
  Synthetic Polynucleotide
taatacgactcactataggggaccggcgtcggggagtaggtgaaggcgccaacagaggagaggcgccatgacctactccaacctggcggcagcgcaaaagatg

SEQ ID NO: 197227 - DNA, 103 bp, Artificial Sequence
  Synthetic Polynucleotide
taatacgactcactatagggtgcccgaggtgaccggcgtcggggagtaggaacagaggagacctactatgcgacgccggaacctggcggcagcgcaaaagatg

SEQ ID NO: 197228 - DNA, 103 bp, Artificial Sequence
  Synthetic Polynucleotide
taatacgactcactatagggccgatgccgatgcccgaggtgaccggcgtcaacagaggagagacgccatgcacctcgggaacctggcggcagcgcaaaagatg

SEQ ID NO: 197229 - DNA, 103 bp, Artificial Sequence
  Synthetic Polynucleotide
taatacgactcactatagggggccgacatgccgatgccgatgcccgaggtaacagaggagaacctcgatgatcggcatcaacctggcggcagcgcaaaagatg

SEQ ID NO: 197230 - DNA, 103 bp, Artificial Sequence
  Synthetic Polynucleotide
taatacgactcactatagggaaggcggcgtgaagcggcggctcgtgctggaacagaggagaccagcaatggccgccgctaacctggcggcagcgcaaaagatg

SEQ ID NO: 197231 - DNA, 103 bp, Artificial Sequence
  Synthetic Polynucleotide
taatacgactcactatagggccgagcccatggccgacatgccgatgccgaaacagaggagatcggcaatggcatgtcggaacctggcggcagcgcaaaagatg

SEQ ID NO: 197232 - DNA, 103 bp, Artificial Sequence
  Synthetic Polynucleotide
taatacgactcactatagggtagcgcgtggccgagcccatggccgacatgaacagaggagacatgtcatgcatgggctcaacctggcggcagcgcaaaagatg

SEQ ID NO: 197233 - DNA, 103 bp, Artificial Sequence
  Synthetic Polynucleotide
taatacgactcactataggggtaggtgtggtagcgcgtggccgagcccataacagaggagaatgggcatggccacgcgcaacctggcggcagcgcaaaagatg

SEQ ID NO: 197234 - DNA, 103 bp, Artificial Sequence
  Synthetic Polynucleotide
taatacgactcactataggggcggcggcaggtaggtgtggtagcgcgtggaacagaggagaccacgcatgaccacacctaacctggcggcagcgcaaaagatg

SEQ ID NO: 197235 - DNA, 103 bp, Artificial Sequence
  Synthetic Polynucleotide
taatacgactcactatagggccggggtagggcggcggcaggtaggtgtggaacagaggagaccacacatgcctgccgccaacctggcggcagcgcaaaagatg

SEQ ID NO: 197236 - DNA, 103 bp, Artificial Sequence
  Synthetic Polynucleotide
taatacgactcactatagggttgcgacgagccggggtagggcggcggcagaacagaggagactgccgatgccctaccccaacctggcggcagcgcaaaagatg

SEQ ID NO: 197237 - DNA, 103 bp, Artificial Sequence
  Synthetic Polynucleotide
taatacgactcactatagggctccctgcgcttgcgacgagccggggtaggaacagaggagacctaccatggctcgtcgcaacctggcggcagcgcaaaagatg

SEQ ID NO: 197238 - DNA, 103 bp, Artificial Sequence
  Synthetic Polynucleotide
taatacgactcactatagggtggaacgggcctccctgcgcttgcgacgagaacagaggagactcgtcatgagcgcagggaacctggcggcagcgcaaaagatg

SEQ ID NO: 197239 - DNA, 103 bp, Artificial Sequence
  Synthetic Polynucleotide
taatacgactcactatagggcgagctggcttggaacgggcctccctgcgcaacagaggagagcgcagatgggcccgttcaacctggcggcagcgcaaaagatg

SEQ ID NO: 197240 - DNA, 103 bp, Artificial Sequence
  Synthetic Polynucleotide
taatacgactcactatagggggtaggagggcgagctggcttggaacgggcaacagaggagagcccgtatgaagccagctaacctggcggcagcgcaaaagatg

SEQ ID NO: 197241 - DNA, 103 bp, Artificial Sequence
  Synthetic Polynucleotide
taatacgactcactatagggagcgcggtggaaggcggcgtgaagcggcggaacagaggagaccgccgatgcacgccgccaacctggcggcagcgcaaaagatg

SEQ ID NO: 197242 - DNA, 103 bp, Artificial Sequence
  Synthetic Polynucleotide
taatacgactcactatagggtagtacaggtggtaggagggcgagctggctaacagaggagaagccagatggccctcctaaacctggcggcagcgcaaaagatg

SEQ ID NO: 197243 - DNA, 103 bp, Artificial Sequence
  Synthetic Polynucleotide
taatacgactcactatagggcgaggcgccgtagtacaggtggtaggagggaacagaggagaccctccatgcacctgtacaacctggcggcagcgcaaaagatg

SEQ ID NO: 197244 - DNA, 103 bp, Artificial Sequence
  Synthetic Polynucleotide
taatacgactcactatagggaggagccggccgaggcgccgtagtacaggtaacagaggagaacctgtatgacggcgcctaacctggcggcagcgcaaaagatg

SEQ ID NO: 197245 - DNA, 103 bp, Artificial Sequence
  Synthetic Polynucleotide
taatacgactcactataggggagaactggtaggagccggccgaggcgccgaacagaggagacggcgcatgggccggctcaacctggcggcagcgcaaaagatg

SEQ ID NO: 197246 - DNA, 103 bp, Artificial Sequence
  Synthetic Polynucleotide
taatacgactcactataggggcccaccatggagaactggtaggagccggcaacagaggagagccggcatgtaccagttcaacctggcggcagcgcaaaagatg

SEQ ID NO: 197247 - DNA, 103 bp, Artificial Sequence
  Synthetic Polynucleotide
taatacgactcactatagggagcgctcgccgcccaccatggagaactggtaacagaggagaaccagtatgccatggtggaacctggcggcagcgcaaaagatg

SEQ ID NO: 197248 - DNA, 103 bp, Artificial Sequence
  Synthetic Polynucleotide
taatacgactcactatagggcgcggcggcgagcgctcgccgcccaccatgaacagaggagacatggtatgcggcgagcgaacctggcggcagcgcaaaagatg

SEQ ID NO: 197249 - DNA, 103 bp, Artificial Sequence
  Synthetic Polynucleotide
taatacgactcactatagggcggcaggatgcgcggcggcgagcgctcgccaacagaggagaggcgagatgtcgccgccgaacctggcggcagcgcaaaagatg

SEQ ID NO: 197250 - DNA, 103 bp, Artificial Sequence
  Synthetic Polynucleotide
taatacgactcactatagggtggtgcagggcggcaggatgcgcggcggcgaacagaggagacgccgcatggcatcctgcaacctggcggcagcgcaaaagatg

SEQ ID NO: 197251 - DNA, 103 bp, Artificial Sequence
  Synthetic Polynucleotide
taatacgactcactataggggtggaggcgttggtgcagggcggcaggatgaacagaggagacatcctatggccctgcacaacctggcggcagcgcaaaagatg

SEQ ID NO: 197252 - DNA, 103 bp, Artificial Sequence
  Synthetic Polynucleotide
taatacgactcactataggggcctgggctcagcgcggtggaaggcggcgtaacagaggagaacgccgatgtccaccgcgaacctggcggcagcgcaaaagatg

SEQ ID NO: 197253 - DNA, 103 bp, Artificial Sequence
  Synthetic Polynucleotide
taatacgactcactatagggcgcggagccggtggaggcgttggtgcagggaacagaggagaccctgcatgaacgcctccaacctggcggcagcgcaaaagatg

SEQ ID NO: 197254 - DNA, 103 bp, Artificial Sequence
  Synthetic Polynucleotide
taatacgactcactatagggggttgagcagcgcggagccggtggaggcgtaacagaggagaacgcctatgccggctccgaacctggcggcagcgcaaaagatg

SEQ ID NO: 197255 - DNA, 103 bp, Artificial Sequence
  Synthetic Polynucleotide
taatacgactcactataggggggaggctggggttgagcagcgcggagccgaacagaggagacggctcatggctgctcaaaacctggcggcagcgcaaaagatg

SEQ ID NO: 197256 - DNA, 103 bp, Artificial Sequence
  Synthetic Polynucleotide
taatacgactcactataggggctctggttcgggaggctggggttgagcagaacagaggagactgctcatgcccagcctcaacctggcggcagcgcaaaagatg

SEQ ID NO: 197257 - DNA, 103 bp, Artificial Sequence
  Synthetic Polynucleotide
taatacgactcactatagggccaccacgtcgctctggttcgggaggctggaacagaggagaccagccatgcgaaccagaaacctggcggcagcgcaaaagatg

SEQ ID NO: 197258 - DNA, 103 bp, Artificial Sequence
  Synthetic Polynucleotide
taatacgactcactatagggccctcggcctccaccacgtcgctctggttcaacagaggagagaaccaatgcgacgtggtaacctggcggcagcgcaaaagatg

SEQ ID NO: 197259 - DNA, 103 bp, Artificial Sequence
  Synthetic Polynucleotide
taatacgactcactataggggctgtggctgccctcggcctccaccacgtcaacagaggagagacgtgatggaggccgagaacctggcggcagcgcaaaagatg

SEQ ID NO: 197260 - DNA, 103 bp, Artificial Sequence
  Synthetic Polynucleotide
taatacgactcactatagggtgggggagttgctgtggctgccctcggcctaacagaggagaaggccgatggcagccacaaacctggcggcagcgcaaaagatg

SEQ ID NO: 197261 - DNA, 103 bp, Artificial Sequence
  Synthetic Polynucleotide
taatacgactcactataggggccatgttggtgggggagttgctgtggctgaacagaggagacagccaatgcaactccccaacctggcggcagcgcaaaagatg

SEQ ID NO: 197262 - DNA, 103 bp, Artificial Sequence
  Synthetic Polynucleotide
taatacgactcactatagggcgcggagggcgccatgttggtgggggagttaacagaggagaaactccatgaccaacatgaacctggcggcagcgcaaaagatg

SEQ ID NO: 197263 - DNA, 103 bp, Artificial Sequence
  Synthetic Polynucleotide
taatacgactcactatagggcgctcatcttgcctgggctcagcgcggtggaacagaggagaccaccgatgtgagcccagaacctggcggcagcgcaaaagatg

SEQ ID NO: 197264 - DNA, 103 bp, Artificial Sequence
  Synthetic Polynucleotide
taatacgactcactatagggcctccaggcgcgcggagggcgccatgttggaacagaggagaccaacaatgcgccctccgaacctggcggcagcgcaaaagatg

SEQ ID NO: 197265 - DNA, 103 bp, Artificial Sequence
  Synthetic Polynucleotide
taatacgactcactatagggcacacggcctcctccaggcgcgcggagggcaacagaggagagccctcatggcgcctggaaacctggcggcagcgcaaaagatg

SEQ ID NO: 197266 - DNA, 103 bp, Artificial Sequence
  Synthetic Polynucleotide
taatacgactcactataggggtagggcctccacacggcctcctccaggcgaacagaggagacgcctgatggaggccgtgaacctggcggcagcgcaaaagatg

SEQ ID NO: 197267 - DNA, 103 bp, Artificial Sequence
  Synthetic Polynucleotide
taatacgactcactatagggggcaacgcctcgctcatcttgcctgggctcaacagaggagagagcccatgcaagatgagaacctggcggcagcgcaaaagatg

SEQ ID NO: 197268 - DNA, 103 bp, Artificial Sequence
  Synthetic Polynucleotide
taatacgactcactatagggggcgcccagcggcaacgcctcgctcatcttaacagaggagaaagatgatggaggcgttgaacctggcggcagcgcaaaagatg

SEQ ID NO: 197269 - DNA, 103 bp, Artificial Sequence
  Synthetic Polynucleotide
taatacgactcactatagggcggcgtccggggcgcccagcggcaacgcctaacagaggagaaggcgtatgcgctgggcgaacctggcggcagcgcaaaagatg

SEQ ID NO: 197270 - DNA, 103 bp, Artificial Sequence
  Synthetic Polynucleotide
taatacgactcactatagggagggcagcgccggcgtccggggcgcccagcaacagaggagagctgggatgcccggacgcaacctggcggcagcgcaaaagatg

SEQ ID NO: 197271 - DNA, 103 bp, Artificial Sequence
  Synthetic Polynucleotide
taatacgactcactatagggcttgccggccagggcagcgccggcgtccggaacagaggagaccggacatgggcgctgccaacctggcggcagcgcaaaagatg

SEQ ID NO: 197272 - DNA, 103 bp, Artificial Sequence
  Synthetic Polynucleotide
taatacgactcactatagggggtacgaaggaaatgactcaaatatgctgtaacagaggagaacagcaatgttgagtcataacctggcggcagcgcaaaagatg

SEQ ID NO: 197273 - DNA, 103 bp, Artificial Sequence
  Synthetic Polynucleotide
taatacgactcactatagggcgctcctcagcttgccggccagggcagcgcaacagaggagagcgctgatgtggccggcaaacctggcggcagcgcaaaagatg

SEQ ID NO: 197274 - DNA, 103 bp, Artificial Sequence
  Synthetic Polynucleotide
taatacgactcactatagggctgcggtcgccgctcctcagcttgccggccaacagaggagaggccggatggctgaggagaacctggcggcagcgcaaaagatg

SEQ ID NO: 197275 - DNA, 103 bp, Artificial Sequence
  Synthetic Polynucleotide
taatacgactcactatagggctccaccatgctgcggtcgccgctcctcagaacagaggagactgaggatgggcgaccgcaacctggcggcagcgcaaaagatg

SEQ ID NO: 197276 - DNA, 103 bp, Artificial Sequence
  Synthetic Polynucleotide
taatacgactcactatagggcggccagcacctccaccatgctgcggtcgcaacagaggagagcgaccatggcatggtggaacctggcggcagcgcaaaagatg

SEQ ID NO: 197277 - DNA, 103 bp, Artificial Sequence
  Synthetic Polynucleotide
taatacgactcactatagggcccgggtggtcggccagcacctccaccatgaacagaggagacatggtatgggtgctggcaacctggcggcagcgcaaaagatg

SEQ ID NO: 197278 - DNA, 103 bp, Artificial Sequence
  Synthetic Polynucleotide
taatacgactcactatagggcaccagctcgcccgggtggtcggccagcacaacagaggagagtgctgatggaccacccgaacctggcggcagcgcaaaagatg

SEQ ID NO: 197279 - DNA, 103 bp, Artificial Sequence
  Synthetic Polynucleotide
taatacgactcactatagggtgtcggtgcgcaccagctcgcccgggtggtaacagaggagaaccaccatggcgagctggaacctggcggcagcgcaaaagatg

SEQ ID NO: 197280 - DNA, 103 bp, Artificial Sequence
  Synthetic Polynucleotide
taatacgactcactatagggaagttggggctgtcggtgcgcaccagctcgaacagaggagacgagctatggcgcaccgaaacctggcggcagcgcaaaagatg

SEQ ID NO: 197281 - DNA, 103 bp, Artificial Sequence
  Synthetic Polynucleotide
taatacgactcactatagggggagcagaggaagttggggctgtcggtgcgaacagaggagacgcaccatgagccccaacaacctggcggcagcgcaaaagatg

SEQ ID NO: 197282 - DNA, 103 bp, Artificial Sequence
  Synthetic Polynucleotide
taatacgactcactatagggtaggcagcacggagcagaggaagttggggcaacagaggagagccccaatgtcctctgctaacctggcggcagcgcaaaagatg

SEQ ID NO: 197283 - DNA, 103 bp, Artificial Sequence
  Synthetic Polynucleotide
taatacgactcactatagggaagcactgtgggtacgaaggaaatgactcaaacagaggagatgagtcatgtccttcgtaaacctggcggcagcgcaaaagatg

SEQ ID NO: 197284 - DNA, 103 bp, Artificial Sequence
  Synthetic Polynucleotide
taatacgactcactatagggcgccagtgcgtaggcagcacggagcagaggaacagaggagacctctgatgcgtgctgccaacctggcggcagcgcaaaagatg

SEQ ID NO: 197285 - DNA, 103 bp, Artificial Sequence
  Synthetic Polynucleotide
taatacgactcactatagggcttgttgcagcgccagtgcgtaggcagcacaacagaggagagtgctgatgacgcactggaacctggcggcagcgcaaaagatg

SEQ ID NO: 197286 - DNA, 103 bp, Artificial Sequence
  Synthetic Polynucleotide
taatacgactcactatagggtgggcagggtcttgttgcagcgccagtgcgaacagaggagacgcactatggctgcaacaaacctggcggcagcgcaaaagatg

SEQ ID NO: 197287 - DNA, 103 bp, Artificial Sequence
  Synthetic Polynucleotide
taatacgactcactatagggttgaaagcgatgggcagggtcttgttgcagaacagaggagactgcaaatggaccctgccaacctggcggcagcgcaaaagatg

SEQ ID NO: 197288 - DNA, 103 bp, Artificial Sequence
  Synthetic Polynucleotide
taatacgactcactatagggggccaccaccttgaaagcgatgggcagggtaacagaggagaaccctgatgatcgctttcaacctggcggcagcgcaaaagatg

SEQ ID NO: 197289 - DNA, 103 bp, Artificial Sequence
  Synthetic Polynucleotide
taatacgactcactatagggcatcccctagggccaccaccttgaaagcgaaacagaggagatcgcttatgaggtggtggaacctggcggcagcgcaaaagatg

SEQ ID NO: 197290 - DNA, 103 bp, Artificial Sequence
  Synthetic Polynucleotide
taatacgactcactatagggccatctggaacatcccctagggccaccaccaacagaggagaggtggtatgcctaggggaaacctggcggcagcgcaaaagatg

SEQ ID NO: 197291 - DNA, 103 bp, Artificial Sequence
  Synthetic Polynucleotide
taatacgactcactataggggaccagagtgccatctggaacatcccctagaacagaggagactagggatggttccagataacctggcggcagcgcaaaagatg

SEQ ID NO: 197292 - DNA, 103 bp, Artificial Sequence
  Synthetic Polynucleotide
taatacgactcactatagggccatcacagtgaccagagtgccatctggaaaacagaggagattccagatggcactctggaacctggcggcagcgcaaaagatg

SEQ ID NO: 197293 - DNA, 103 bp, Artificial Sequence
  Synthetic Polynucleotide
taatacgactcactatagggtcattgccagccatcacagtgaccagagtgaacagaggagacactctatgcactgtgataacctggcggcagcgcaaaagatg

SEQ ID NO: 197294 - DNA, 103 bp, Artificial Sequence
  Synthetic Polynucleotide
taatacgactcactatagggttctctcatgaagcactgtgggtacgaaggaacagaggagaccttcgatgccacagtgcaacctggcggcagcgcaaaagatg

SEQ ID NO: 197295 - DNA, 103 bp, Artificial Sequence
  Synthetic Polynucleotide
taatacgactcactataggggtagttttcatcattgccagccatcacagtaacagaggagaactgtgatggctggcaataacctggcggcagcgcaaaagatg

SEQ ID NO: 197296 - DNA, 103 bp, Artificial Sequence
  Synthetic Polynucleotide
taatacgactcactataggggctcagccgagtagttttcatcattgccagaacagaggagactggcaatgatgaaaactaacctggcggcagcgcaaaagatg

SEQ ID NO: 197297 - DNA, 103 bp, Artificial Sequence
  Synthetic Polynucleotide
taatacgactcactataggggcatttctcagctcagccgagtagttttcaaacagaggagatgaaaaatgctcggctgaaacctggcggcagcgcaaaagatg

SEQ ID NO: 197298 - DNA, 103 bp, Artificial Sequence
  Synthetic Polynucleotide
taatacgactcactatagggggctgcggtagcatttctcagctcagccgaaacagaggagatcggctatgctgagaaataacctggcggcagcgcaaaagatg

SEQ ID NO: 197299 - DNA, 103 bp, Artificial Sequence
  Synthetic Polynucleotide
taatacgactcactatagggggttcttcatggctgcggtagcatttctcaaacagaggagatgagaaatgctaccgcagaacctggcggcagcgcaaaagatg

SEQ ID NO: 197300 - DNA, 103 bp, Artificial Sequence
  Synthetic Polynucleotide
taatacgactcactatagggcttgcaacctggttcttcatggctgcggtaaacagaggagataccgcatgcatgaagaaaacctggcggcagcgcaaaagatg

SEQ ID NO: 197301 - DNA, 103 bp, Artificial Sequence
  Synthetic Polynucleotide
taatacgactcactataggggtcattaaatcttgcaacctggttcttcataacagaggagaatgaagatgcaggttgcaaacctggcggcagcgcaaaagatg

SEQ ID NO: 197302 - DNA, 103 bp, Artificial Sequence
  Synthetic Polynucleotide
taatacgactcactatagggcaaacctgaggtcattaaatcttgcaacctaacagaggagaaggttgatggatttaatgaacctggcggcagcgcaaaagatg

SEQ ID NO: 197303 - DNA, 103 bp, Artificial Sequence
  Synthetic Polynucleotide
taatacgactcactatagggcttcgaccgacaaacctgaggtcattaaataacagaggagaatttaaatgcctcaggttaacctggcggcagcgcaaaagatg

SEQ ID NO: 197304 - DNA, 103 bp, Artificial Sequence
  Synthetic Polynucleotide
taatacgactcactatagggccctcttccacttcgaccgacaaacctgagaacagaggagactcaggatggtcggtcgaaacctggcggcagcgcaaaagatg

SEQ ID NO: 197305 - DNA, 103 bp, Artificial Sequence
  Synthetic Polynucleotide
taatacgactcactatagggcaagtatgcattctctcatgaagcactgtgaacagaggagacacagtatgtcatgagagaacctggcggcagcgcaaaagatg

SEQ ID NO: 197306 - DNA, 103 bp, Artificial Sequence
  Synthetic Polynucleotide
taatacgactcactatagggtgaagcttttccctcttccacttcgaccgaaacagaggagatcggtcatggtggaagagaacctggcggcagcgcaaaagatg

SEQ ID NO: 197307 - DNA, 103 bp, Artificial Sequence
  Synthetic Polynucleotide
taatacgactcactatagggatggtcagagtgaagcttttccctcttccaaacagaggagatggaagatggaaaagcttaacctggcggcagcgcaaaagatg

SEQ ID NO: 197308 - DNA, 103 bp, Artificial Sequence
  Synthetic Polynucleotide
taatacgactcactataggggaagacagtgatggtcagagtgaagcttttaacagaggagaaaaagcatgactctgaccaacctggcggcagcgcaaaagatg

SEQ ID NO: 197309 - DNA, 103 bp, Artificial Sequence
  Synthetic Polynucleotide
taatacgactcactataggggtgggtttgtgaagacagtgatggtcagagaacagaggagactctgaatgtcactgtctaacctggcggcagcgcaaaagatg

SEQ ID NO: 197310 - DNA, 103 bp, Artificial Sequence
  Synthetic Polynucleotide
taatacgactcactataggggcgacttgcggtgggtttgtgaagacagtgaacagaggagacactgtatgcacaaacccaacctggcggcagcgcaaaagatg

SEQ ID NO: 197311 - DNA, 103 bp, Artificial Sequence
  Synthetic Polynucleotide
taatacgactcactataggggtggtaggtggcgacttgcggtgggtttgtaacagaggagaacaaacatgccgcaagtcaacctggcggcagcgcaaaagatg

SEQ ID NO: 197312 - DNA, 103 bp, Artificial Sequence
  Synthetic Polynucleotide
taatacgactcactatagggtgatggctctgtggtaggtggcgacttgcgaacagaggagacgcaagatgccacctaccaacctggcggcagcgcaaaagatg

SEQ ID NO: 197313 - DNA, 103 bp, Artificial Sequence
  Synthetic Polynucleotide
taatacgactcactatagggactgtgattttgatggctctgtggtaggtgaacagaggagacacctaatgcagagccataacctggcggcagcgcaaaagatg

SEQ ID NO: 197314 - DNA, 103 bp, Artificial Sequence
  Synthetic Polynucleotide
taatacgactcactataggggggcccatccactgtgattttgatggctctaacagaggagaagagccatgaaaatcacaaacctggcggcagcgcaaaagatg

SEQ ID NO: 197315 - DNA, 103 bp, Artificial Sequence
  Synthetic Polynucleotide
taatacgactcactataggggaggttctcggggcccatccactgtgatttaacagaggagaaaatcaatgtggatgggcaacctggcggcagcgcaaaagatg

SEQ ID NO: 197316 - DNA, 103 bp, Artificial Sequence
  Synthetic Polynucleotide
taatacgactcactatagggggattcattccaagtatgcattctctcatgaacagaggagacatgagatgatgcatactaacctggcggcagcgcaaaagatg

SEQ ID NO: 197317 - DNA, 103 bp, Artificial Sequence
  Synthetic Polynucleotide
taatacgactcactatagggcgatgtcttcgaggttctcggggcccatccaacagaggagaggatggatgccgagaaccaacctggcggcagcgcaaaagatg

SEQ ID NO: 197318 - DNA, 103 bp, Artificial Sequence
  Synthetic Polynucleotide
taatacgactcactatagggtagtttctgccgatgtcttcgaggttctcgaacagaggagacgagaaatgcgaagacataacctggcggcagcgcaaaagatg

SEQ ID NO: 197319 - DNA, 103 bp, Artificial Sequence
  Synthetic Polynucleotide
taatacgactcactatagggtctgatcatctagtttctgccgatgtcttcaacagaggagagaagacatgggcagaaacaacctggcggcagcgcaaaagatg

SEQ ID NO: 197320 - DNA, 103 bp, Artificial Sequence
  Synthetic Polynucleotide
taatacgactcactatagggccgggcttggtctgatcatctagtttctgcaacagaggagagcagaaatgagatgatcaaacctggcggcagcgcaaaagatg

SEQ ID NO: 197321 - DNA, 103 bp, Artificial Sequence
  Synthetic Polynucleotide
taatacgactcactatagggggacaagctcccgggcttggtctgatcatcaacagaggagagatgatatgaccaagcccaacctggcggcagcgcaaaagatg

SEQ ID NO: 197322 - DNA, 103 bp, Artificial Sequence
  Synthetic Polynucleotide
taatacgactcactataggggctcggaaaaggacaagctcccgggcttggaacagaggagaccaagcatgggagcttgtaacctggcggcagcgcaaaagatg

SEQ ID NO: 197323 - DNA, 103 bp, Artificial Sequence
  Synthetic Polynucleotide
taatacgactcactatagggtcactgagccgctcggaaaaggacaagctcaacagaggagagagcttatgcttttccgaaacctggcggcagcgcaaaagatg

SEQ ID NO: 197324 - DNA, 103 bp, Artificial Sequence
  Synthetic Polynucleotide
taatacgactcactatagggctgctccagttcactgagccgctcggaaaaaacagaggagattttccatgcggctcagtaacctggcggcagcgcaaaagatg

SEQ ID NO: 197325 - DNA, 103 bp, Artificial Sequence
  Synthetic Polynucleotide
taatacgactcactatagggtgcgccgcagctgctccagttcactgagccaacagaggagaggctcaatgaactggagcaacctggcggcagcgcaaaagatg

SEQ ID NO: 197326 - DNA, 103 bp, Artificial Sequence
  Synthetic Polynucleotide
taatacgactcactatagggctcatggctgtgcgccgcagctgctccagtaacagaggagaactggaatggctgcggcgaacctggcggcagcgcaaaagatg

SEQ ID NO: 197327 - DNA, 103 bp, Artificial Sequence
  Synthetic Polynucleotide
taatacgactcactataggggtctctagaaggattcattccaagtatgcaaacagaggagatgcataatgggaatgaataacctggcggcagcgcaaaagatg

SEQ ID NO: 197328 - DNA, 103 bp, Artificial Sequence
  Synthetic Polynucleotide
taatacgactcactatagggtgggctgaccctcatggctgtgcgccgcagaacagaggagactgcggatgacagccatgaacctggcggcagcgcaaaagatg

SEQ ID NO: 197329 - DNA, 103 bp, Artificial Sequence
  Synthetic Polynucleotide
taatacgactcactatagggctgggtggtgtgggctgaccctcatggctgaacagaggagacagccaatggggtcagccaacctggcggcagcgcaaaagatg

SEQ ID NO: 197330 - DNA, 103 bp, Artificial Sequence
  Synthetic Polynucleotide
taatacgactcactatagggggcgtgggggctgggtggtgtgggctgaccaacagaggagaggtcagatgacaccacccaacctggcggcagcgcaaaagatg

SEQ ID NO: 197331 - DNA, 103 bp, Artificial Sequence
  Synthetic Polynucleotide
taatacgactcactatagggacgagggttgggcgtgggggctgggtggtgaacagaggagacaccacatggcccccacgaacctggcggcagcgcaaaagatg

SEQ ID NO: 197332 - DNA, 103 bp, Artificial Sequence
  Synthetic Polynucleotide
taatacgactcactatagggtcagggaggcacgagggttgggcgtgggggaacagaggagacccccaatgccaaccctcaacctggcggcagcgcaaaagatg

SEQ ID NO: 197333 - DNA, 103 bp, Artificial Sequence
  Synthetic Polynucleotide
taatacgactcactataggggtggagtggttcagggaggcacgagggttgaacagaggagacaacccatgtgcctccctaacctggcggcagcgcaaaagatg

SEQ ID NO: 197334 - DNA, 103 bp, Artificial Sequence
  Synthetic Polynucleotide
taatacgactcactataggggttaaaggcagtggagtggttcagggaggcaacagaggagagcctccatgaaccactccaacctggcggcagcgcaaaagatg

SEQ ID NO: 197335 - DNA, 103 bp, Artificial Sequence
  Synthetic Polynucleotide
taatacgactcactataggggaggctgagggttaaaggcagtggagtggtaacagaggagaaccactatgctgcctttaaacctggcggcagcgcaaaagatg

SEQ ID NO: 197336 - DNA, 103 bp, Artificial Sequence
  Synthetic Polynucleotide
taatacgactcactatagggatctgactctgaggctgagggttaaaggcaaacagaggagatgccttatgccctcagccaacctggcggcagcgcaaaagatg

SEQ ID NO: 197337 - DNA, 103 bp, Artificial Sequence
  Synthetic Polynucleotide
taatacgactcactatagggtgtatcctgcatctgactctgaggctgaggaacagaggagacctcagatgcagagtcagaacctggcggcagcgcaaaagatg

SEQ ID NO: 197338 - DNA, 103 bp, Artificial Sequence
  Synthetic Polynucleotide
taatacgactcactatagggcatcgtggacgtctctagaaggattcattcaacagaggagagaatgaatgcttctagagaacctggcggcagcgcaaaagatg

SEQ ID NO: 197339 - DNA, 103 bp, Artificial Sequence
  Synthetic Polynucleotide
taatacgactcactatagggggatctgccttgtatcctgcatctgactctaacagaggagaagagtcatgtgcaggataaacctggcggcagcgcaaaagatg

SEQ ID NO: 197340 - DNA, 103 bp, Artificial Sequence
  Synthetic Polynucleotide
taatacgactcactatagggggggatggttggatctgccttgtatcctgcaacagaggagagcaggaatgaaggcagataacctggcggcagcgcaaaagatg

SEQ ID NO: 197341 - DNA, 103 bp, Artificial Sequence
  Synthetic Polynucleotide
taatacgactcactatagggggaccacggtggggatggttggatctgcctaacagaggagaaggcagatgcaaccatccaacctggcggcagcgcaaaagatg

SEQ ID NO: 197342 - DNA, 103 bp, Artificial Sequence
  Synthetic Polynucleotide
taatacgactcactatagggactgatcgtaggaccacggtggggatggttaacagaggagaaaccatatgcaccgtggtaacctggcggcagcgcaaaagatg

SEQ ID NO: 197343 - DNA, 103 bp, Artificial Sequence
  Synthetic Polynucleotide
taatacgactcactatagggtattggtaggactgatcgtaggaccacggtaacagaggagaaccgtgatgctacgatcaaacctggcggcagcgcaaaagatg

SEQ ID NO: 197344 - DNA, 103 bp, Artificial Sequence
  Synthetic Polynucleotide
taatacgactcactatagggggatcccaggtattggtaggactgatcgtaaacagaggagatacgatatgtcctaccaaaacctggcggcagcgcaaaagatg

SEQ ID NO: 197345 - DNA, 103 bp, Artificial Sequence
  Synthetic Polynucleotide
taatacgactcactataggggagaggcaatggatcccaggtattggtaggaacagaggagacctaccatgacctgggataacctggcggcagcgcaaaagatg

SEQ ID NO: 197346 - DNA, 103 bp, Artificial Sequence
  Synthetic Polynucleotide
taatacgactcactatagggtgcacagaaggagaggcaatggatcccaggaacagaggagacctgggatgcattgcctcaacctggcggcagcgcaaaagatg

SEQ ID NO: 197347 - DNA, 103 bp, Artificial Sequence
  Synthetic Polynucleotide
taatacgactcactatagggcgttgctgggtgcacagaaggagaggcaataacagaggagaattgccatgccttctgtgaacctggcggcagcgcaaaagatg

SEQ ID NO: 197348 - DNA, 103 bp, Artificial Sequence
  Synthetic Polynucleotide
taatacgactcactataggggtgaaatgggcgttgctgggtgcacagaagaacagaggagacttctgatgacccagcaaaacctggcggcagcgcaaaagatg

SEQ ID NO: 197349 - DNA, 103 bp, Artificial Sequence
  Synthetic Polynucleotide
taatacgactcactatagggctcgtgctggcatcgtggacgtctctagaaaacagaggagattctagatgcgtccacgaaacctggcggcagcgcaaaagatg

SEQ ID NO: 197350 - DNA, 103 bp, Artificial Sequence
  Synthetic Polynucleotide
taatacgactcactataggggcacgtccaggtgaaatgggcgttgctgggaacagaggagacccagcatggcccatttcaacctggcggcagcgcaaaagatg

SEQ ID NO: 197351 - DNA, 103 bp, Artificial Sequence
  Synthetic Polynucleotide
taatacgactcactatagggcatgccgctggcacgtccaggtgaaatgggaacagaggagacccattatgcctggacgtaacctggcggcagcgcaaaagatg

SEQ ID NO: 197352 - DNA, 103 bp, Artificial Sequence
  Synthetic Polynucleotide
taatacgactcactatagggagagggttgtcatgccgctggcacgtccagaacagaggagactggacatgccagcggcaaacctggcggcagcgcaaaagatg

SEQ ID NO: 197353 - DNA, 103 bp, Artificial Sequence
  Synthetic Polynucleotide
taatacgactcactatagggagttctgcagagagggttgtcatgccgctgaacagaggagacagcggatggacaaccctaacctggcggcagcgcaaaagatg

SEQ ID NO: 197354 - DNA, 103 bp, Artificial Sequence
  Synthetic Polynucleotide
taatacgactcactatagggtcgactggaaagttctgcagagagggttgtaacagaggagaacaaccatgtctgcagaaaacctggcggcagcgcaaaagatg

SEQ ID NO: 197355 - DNA, 103 bp, Artificial Sequence
  Synthetic Polynucleotide
taatacgactcactatagggccgttgagagtcgactggaaagttctgcagaacagaggagactgcagatgtttccagtcaacctggcggcagcgcaaaagatg

SEQ ID NO: 197356 - DNA, 103 bp, Artificial Sequence
  Synthetic Polynucleotide
taatacgactcactatagggaggtcgggtgccgttgagagtcgactggaaaacagaggagattccagatgactctcaacaacctggcggcagcgcaaaagatg

SEQ ID NO: 197357 - DNA, 103 bp, Artificial Sequence
  Synthetic Polynucleotide
taatacgactcactataggggaacgctgtcaggtcgggtgccgttgagagaacagaggagactctcaatggcacccgacaacctggcggcagcgcaaaagatg

SEQ ID NO: 197358 - DNA, 103 bp, Artificial Sequence
  Synthetic Polynucleotide
taatacgactcactataggggcgggtcgctgaacgctgtcaggtcgggtgaacagaggagacacccgatgtgacagcgtaacctggcggcagcgcaaaagatg

SEQ ID NO: 197359 - DNA, 103 bp, Artificial Sequence
  Synthetic Polynucleotide
taatacgactcactataggggggaactggcgcgggtcgctgaacgctgtcaacagaggagagacagcatgcagcgacccaacctggcggcagcgcaaaagatg

SEQ ID NO: 197360 - DNA, 103 bp, Artificial Sequence
  Synthetic Polynucleotide
taatacgactcactatagggcactgtgctgaagaggctgtttgatgccataacagaggagaatggcaatgaacagcctcaacctggcggcagcgcaaaagatg

SEQ ID NO: 197361 - DNA, 103 bp, Artificial Sequence
  Synthetic Polynucleotide
taatacgactcactataggggctcattttgccgggctgcaggctgctggaaacagaggagatccagcatgctgcagcccaacctggcggcagcgcaaaagatg

SEQ ID NO: 197362 - DNA, 103 bp, Artificial Sequence
  Synthetic Polynucleotide
taatacgactcactatagggtgaaatgcgcctaggcacatcggtgatggcaacagaggagagccatcatggatgtgcctaacctggcggcagcgcaaaagatg

SEQ ID NO: 197363 - DNA, 103 bp, Artificial Sequence
  Synthetic Polynucleotide
taatacgactcactatagggtgtcatcatctgaaatgcgcctaggcacataacagaggagaatgtgcatgggcgcatttaacctggcggcagcgcaaaagatg

SEQ ID NO: 197364 - DNA, 103 bp, Artificial Sequence
  Synthetic Polynucleotide
taatacgactcactataggggaggtggcagtgtcatcatctgaaatgcgcaacagaggagagcgcatatgagatgatgaaacctggcggcagcgcaaaagatg

SEQ ID NO: 197365 - DNA, 103 bp, Artificial Sequence
  Synthetic Polynucleotide
taatacgactcactataggggcagaagtcagaggtggcagtgtcatcatcaacagaggagagatgatatgactgccaccaacctggcggcagcgcaaaagatg

SEQ ID NO: 197366 - DNA, 103 bp, Artificial Sequence
  Synthetic Polynucleotide
taatacgactcactatagggaaggccagaggcagaagtcagaggtggcagaacagaggagactgccaatgctgacttctaacctggcggcagcgcaaaagatg

SEQ ID NO: 197367 - DNA, 103 bp, Artificial Sequence
  Synthetic Polynucleotide
taatacgactcactatagggctgagagtggaaggccagaggcagaagtcaaacagaggagatgacttatgcctctggccaacctggcggcagcgcaaaagatg

SEQ ID NO: 197368 - DNA, 103 bp, Artificial Sequence
  Synthetic Polynucleotide
taatacgactcactataggggctcttcttactgagagtggaaggccagagaacagaggagactctggatgtccactctcaacctggcggcagcgcaaaagatg

SEQ ID NO: 197369 - DNA, 103 bp, Artificial Sequence
  Synthetic Polynucleotide
taatacgactcactatagggcacctgcctggctcttcttactgagagtggaacagaggagaccactcatggtaagaagaaacctggcggcagcgcaaaagatg

SEQ ID NO: 197370 - DNA, 103 bp, Artificial Sequence
  Synthetic Polynucleotide
taatacgactcactatagggagttctgaagcacctgcctggctcttcttaaacagaggagataagaaatgccaggcaggaacctggcggcagcgcaaaagatg

SEQ ID NO: 197371 - DNA, 103 bp, Artificial Sequence
  Synthetic Polynucleotide
taatacgactcactatagggaaaagggcccagttctgaagcacctgcctgaacagaggagacaggcaatggcttcagaaaacctggcggcagcgcaaaagatg

SEQ ID NO: 197372 - DNA, 103 bp, Artificial Sequence
  Synthetic Polynucleotide
taatacgactcactatagggggctcacgtcgctcattttgccgggctgcaaacagaggagatgcagcatggcaaaatgaaacctggcggcagcgcaaaagatg

SEQ ID NO: 197373 - DNA, 103 bp, Artificial Sequence
  Synthetic Polynucleotide
taatacgactcactatagggtggggtctgaaaaagggcccagttctgaagaacagaggagacttcagatgtgggcccttaacctggcggcagcgcaaaagatg

SEQ ID NO: 197374 - DNA, 103 bp, Artificial Sequence
  Synthetic Polynucleotide
taatacgactcactataggggggaactgcctggggtctgaaaaagggcccaacagaggagagggcccatgttcagacccaacctggcggcagcgcaaaagatg

SEQ ID NO: 197375 - DNA, 103 bp, Artificial Sequence
  Synthetic Polynucleotide
taatacgactcactatagggtgaaatgcttgggaactgcctggggtctgaaacagaggagatcagacatgaggcagttcaacctggcggcagcgcaaaagatg

SEQ ID NO: 197376 - DNA, 103 bp, Artificial Sequence
  Synthetic Polynucleotide
taatacgactcactatagggcagtgagggatgaaatgcttgggaactgccaacagaggagaggcagtatgcaagcatttaacctggcggcagcgcaaaagatg

SEQ ID NO: 197377 - DNA, 103 bp, Artificial Sequence
  Synthetic Polynucleotide
taatacgactcactatagggaagcggctctcagtgagggatgaaatgcttaacagaggagaaagcatatgatccctcacaacctggcggcagcgcaaaagatg

SEQ ID NO: 197378 - DNA, 103 bp, Artificial Sequence
  Synthetic Polynucleotide
taatacgactcactatagggtgggttggagaagcggctctcagtgagggaaacagaggagatccctcatggagagccgcaacctggcggcagcgcaaaagatg

SEQ ID NO: 197379 - DNA, 103 bp, Artificial Sequence
  Synthetic Polynucleotide
taatacgactcactatagggagtgcattcgtgggttggagaagcggctctaacagaggagaagagccatgtctccaaccaacctggcggcagcgcaaaagatg

SEQ ID NO: 197380 - DNA, 103 bp, Artificial Sequence
  Synthetic Polynucleotide
taatacgactcactataggggtggctggatagtgcattcgtgggttggagaacagaggagactccaaatgacgaatgcaaacctggcggcagcgcaaaagatg

SEQ ID NO: 197381 - DNA, 103 bp, Artificial Sequence
  Synthetic Polynucleotide
taatacgactcactataggggtaagtaaaggtggctggatagtgcattcgaacagaggagacgaatgatgtatccagccaacctggcggcagcgcaaaagatg

SEQ ID NO: 197382 - DNA, 103 bp, Artificial Sequence
  Synthetic Polynucleotide
taatacgactcactatagggctggcggggtgtaagtaaaggtggctggataacagaggagaatccagatgcctttacttaacctggcggcagcgcaaaagatg

SEQ ID NO: 197383 - DNA, 103 bp, Artificial Sequence
  Synthetic Polynucleotide
taatacgactcactataggggccaccaccgggctcacgtcgctcattttgaacagaggagacaaaatatgcgacgtgagaacctggcggcagcgcaaaagatg

SEQ ID NO: 197384 - DNA, 103 bp, Artificial Sequence
  Synthetic Polynucleotide
taatacgactcactatagggcctgaggtgactggcggggtgtaagtaaagaacagaggagactttacatgcaccccgccaacctggcggcagcgcaaaagatg

SEQ ID NO: 197385 - DNA, 103 bp, Artificial Sequence
  Synthetic Polynucleotide
taatacgactcactataggggagggacatgcctgaggtgactggcggggtaacagaggagaaccccgatggtcacctcaaacctggcggcagcgcaaaagatg

SEQ ID NO: 197386 - DNA, 103 bp, Artificial Sequence
  Synthetic Polynucleotide
taatacgactcactatagggcggacataccgagggacatgcctgaggtgaaacagaggagatcacctatggcatgtcccaacctggcggcagcgcaaaagatg

SEQ ID NO: 197387 - DNA, 103 bp, Artificial Sequence
  Synthetic Polynucleotide
taatacgactcactatagggtgagtggtggcggacataccgagggacatgaacagaggagacatgtcatgcggtatgtcaacctggcggcagcgcaaaagatg

SEQ ID NO: 197388 - DNA, 103 bp, Artificial Sequence
  Synthetic Polynucleotide
taatacgactcactatagggggtgtggtagtgagtggtggcggacataccaacagaggagaggtatgatggccaccactaacctggcggcagcgcaaaagatg

SEQ ID NO: 197389 - DNA, 103 bp, Artificial Sequence
  Synthetic Polynucleotide
taatacgactcactataggggtggcaggtaggtgtggtagtgagtggtggaacagaggagaccaccaatgactaccacaaacctggcggcagcgcaaaagatg

SEQ ID NO: 197390 - DNA, 103 bp, Artificial Sequence
  Synthetic Polynucleotide
taatacgactcactataggggggtagggtggtggcaggtaggtgtggtagaacagaggagactaccaatgctacctgccaacctggcggcagcgcaaaagatg

SEQ ID NO: 197391 - DNA, 103 bp, Artificial Sequence
  Synthetic Polynucleotide
taatacgactcactatagggggaagagccggggtagggtggtggcaggtaaacagaggagatacctgatgccaccctacaacctggcggcagcgcaaaagatg

SEQ ID NO: 197392 - DNA, 103 bp, Artificial Sequence
  Synthetic Polynucleotide
taatacgactcactatagggtctggctttgggaagagccggggtagggtgaacagaggagacaccctatgccggctcttaacctggcggcagcgcaaaagatg

SEQ ID NO: 197393 - DNA, 103 bp, Artificial Sequence
  Synthetic Polynucleotide
taatacgactcactatagggaagggtccactctggctttgggaagagccgaacagaggagacggctcatgccaaagccaaacctggcggcagcgcaaaagatg

SEQ ID NO: 197394 - DNA, 103 bp, Artificial Sequence
  Synthetic Polynucleotide
taatacgactcactatagggctgttgcgcagccaccaccgggctcacgtcaacagaggagagacgtgatgccggtggtgaacctggcggcagcgcaaaagatg

SEQ ID NO: 197395 - DNA, 103 bp, Artificial Sequence
  Synthetic Polynucleotide
taatacgactcactataggggctggtctggaagggtccactctggctttgaacagaggagacaaagcatgagtggacccaacctggcggcagcgcaaaagatg

SEQ ID NO: 197396 - DNA, 103 bp, Artificial Sequence
  Synthetic Polynucleotide
taatacgactcactatagggatggagtgctgctggtctggaagggtccacaacagaggagagtggacatgtccagaccaaacctggcggcagcgcaaaagatg

SEQ ID NO: 197397 - DNA, 103 bp, Artificial Sequence
  Synthetic Polynucleotide
taatacgactcactatagggtagtagagatatggagtgctgctggtctggaacagaggagaccagacatgcagcactccaacctggcggcagcgcaaaagatg

SEQ ID NO: 197398 - DNA, 103 bp, Artificial Sequence
  Synthetic Polynucleotide
taatacgactcactatagggcgaagtgccatagtagagatatggagtgctaacagaggagaagcactatgtatctctacaacctggcggcagcgcaaaagatg

SEQ ID NO: 197399 - DNA, 103 bp, Artificial Sequence
  Synthetic Polynucleotide
taatacgactcactatagggaggatcctgacgaagtgccatagtagagataacagaggagaatctctatgatggcacttaacctggcggcagcgcaaaagatg

SEQ ID NO: 197400 - DNA, 103 bp, Artificial Sequence
  Synthetic Polynucleotide
taatacgactcactatagggggaaactgataggatcctgacgaagtgccaaacagaggagatggcacatggtcaggatcaacctggcggcagcgcaaaagatg

SEQ ID NO: 197401 - DNA, 103 bp, Artificial Sequence
  Synthetic Polynucleotide
taatacgactcactatagggcggcaccatgggaaactgataggatcctgaaacagaggagatcaggaatgtatcagtttaacctggcggcagcgcaaaagatg

SEQ ID NO: 197402 - DNA, 103 bp, Artificial Sequence
  Synthetic Polynucleotide
taatacgactcactatagggggtctccccccggcaccatgggaaactgataacagaggagaatcagtatgccatggtgcaacctggcggcagcgcaaaagatg

SEQ ID NO: 197403 - DNA, 103 bp, Artificial Sequence
  Synthetic Polynucleotide
taatacgactcactataggggaaggagaccggtctccccccggcaccatgaacagaggagacatggtatgggggggagaaacctggcggcagcgcaaaagatg

SEQ ID NO: 197404 - DNA, 103 bp, Artificial Sequence
  Synthetic Polynucleotide
taatacgactcactatagggaagcattctggaaggagaccggtctcccccaacagaggagagggggaatgcggtctcctaacctggcggcagcgcaaaagatg

SEQ ID NO: 197405 - DNA, 103 bp, Artificial Sequence
  Synthetic Polynucleotide
taatacgactcactataggggttgctgctgctgttgcgcagccaccaccgaacagaggagacggtggatgctgcgcaacaacctggcggcagcgcaaaagatg

SEQ ID NO: 197406 - DNA, 103 bp, Artificial Sequence
  Synthetic Polynucleotide
taatacgactcactatagggtgcatggcggaagcattctggaaggagaccaacagaggagaggtctcatgccagaatgcaacctggcggcagcgcaaaagatg

SEQ ID NO: 197407 - DNA, 103 bp, Artificial Sequence
  Synthetic Polynucleotide
taatacgactcactataggggaggtggtggtgcatggcggaagcattctgaacagaggagacagaatatgtccgccatgaacctggcggcagcgcaaaagatg

SEQ ID NO: 197408 - DNA, 103 bp, Artificial Sequence
  Synthetic Polynucleotide
taatacgactcactataggggctgccattcgaggtggtggtgcatggcggaacagaggagaccgccaatgaccaccaccaacctggcggcagcgcaaaagatg

SEQ ID NO: 197409 - DNA, 103 bp, Artificial Sequence
  Synthetic Polynucleotide
taatacgactcactatagggttaatagcgtgctgccattcgaggtggtggaacagaggagaccaccaatgcgaatggcaaacctggcggcagcgcaaaagatg

SEQ ID NO: 197410 - DNA, 103 bp, Artificial Sequence
  Synthetic Polynucleotide
taatacgactcactatagggaaatttggatttaatagcgtgctgccattcaacagaggagagaatggatgcacgctattaacctggcggcagcgcaaaagatg

SEQ ID NO: 197411 - DNA, 103 bp, Artificial Sequence
  Synthetic Polynucleotide
taatacgactcactatagggctggttaggcaaatttggatttaatagcgtaacagaggagaacgctaatgaatccaaataacctggcggcagcgcaaaagatg

SEQ ID NO: 197412 - DNA, 103 bp, Artificial Sequence
  Synthetic Polynucleotide
taatacgactcactatagggcaccatcattctggttaggcaaatttggataacagaggagaatccaaatgtgcctaaccaacctggcggcagcgcaaaagatg

SEQ ID NO: 197413 - DNA, 103 bp, Artificial Sequence
  Synthetic Polynucleotide
taatacgactcactatagggtcagcgtcaacaccatcattctggttaggcaacagaggagagcctaaatggaatgatggaacctggcggcagcgcaaaagatg

SEQ ID NO: 197414 - DNA, 103 bp, Artificial Sequence
  Synthetic Polynucleotide
taatacgactcactataggggtggcttccatcagcgtcaacaccatcattaacagaggagaaatgatatggttgacgctaacctggcggcagcgcaaaagatg

SEQ ID NO: 197415 - DNA, 103 bp, Artificial Sequence
  Synthetic Polynucleotide
taatacgactcactataggggggaactgctgtggcttccatcagcgtcaaaacagaggagattgacgatgatggaagccaacctggcggcagcgcaaaagatg

SEQ ID NO: 197416 - DNA, 103 bp, Artificial Sequence
  Synthetic Polynucleotide
taatacgactcactatagggtgctgctgctgttgctgctgctgttgcgcaaacagaggagatgcgcaatggcagcagcaaacctggcggcagcgcaaaagatg

SEQ ID NO: 197417 - DNA, 103 bp, Artificial Sequence
  Synthetic Polynucleotide
taatacgactcactatagggaaaacagttggggaactgctgtggcttccaaacagaggagatggaagatgcagcagttcaacctggcggcagcgcaaaagatg

SEQ ID NO: 197418 - DNA, 103 bp, Artificial Sequence
  Synthetic Polynucleotide
taatacgactcactatagggactagaattcaaaacagttggggaactgctaacagaggagaagcagtatgccaactgttaacctggcggcagcgcaaaagatg

SEQ ID NO: 197419 - DNA, 103 bp, Artificial Sequence
  Synthetic Polynucleotide
taatacgactcactatagggccattctgccactagaattcaaaacagttgaacagaggagacaactgatgtgaattctaaacctggcggcagcgcaaaagatg

SEQ ID NO: 197420 - DNA, 103 bp, Artificial Sequence
  Synthetic Polynucleotide
taatacgactcactatagggacagattcatccattctgccactagaattcaacagaggagagaattcatgtggcagaataacctggcggcagcgcaaaagatg

SEQ ID NO: 197421 - DNA, 103 bp, Artificial Sequence
  Synthetic Polynucleotide
taatacgactcactatagggtggtcgccaaacagattcatccattctgccaacagaggagaggcagaatggatgaatctaacctggcggcagcgcaaaagatg

SEQ ID NO: 197422 - DNA, 103 bp, Artificial Sequence
  Synthetic Polynucleotide
taatacgactcactatagggctgctgttgctgctgctgctgttgctgctgaacagaggagacagcagatgcagcagcagaacctggcggcagcgcaaaagatg

SEQ ID NO: 197423 - DNA, 103 bp, Artificial Sequence
  Synthetic Polynucleotide
taatacgactcactataggggctgctgctgctgctgttgctgctgctgctaacagaggagaagcagcatgagcaacagcaacctggcggcagcgcaaaagatg

SEQ ID NO: 197424 - DNA, 103 bp, Artificial Sequence
  Synthetic Polynucleotide
taatacgactcactatagggtgctgttgctgctgctgctgctgctgttgcaacagaggagagcaacaatggcagcagcaaacctggcggcagcgcaaaagatg

SEQ ID NO: 197425 - DNA, 103 bp, Artificial Sequence
  Synthetic Polynucleotide
taatacgactcactatagggctgctgctgctgctgttgctgctgctgctgaacagaggagacagcagatgcagcaacagaacctggcggcagcgcaaaagatg

SEQ ID NO: 197426 - DNA, 103 bp, Artificial Sequence
  Synthetic Polynucleotide
taatacgactcactataggggacatggtgtcactgtgctgaagaggctgtaacagaggagaacagccatgtcagcacagaacctggcggcagcgcaaaagatg

SEQ ID NO: 197427 - DNA, 103 bp, Artificial Sequence
  Synthetic Polynucleotide
taatacgactcactatagggccgcctcctgctgctgctgctgctgttgctaacagaggagaagcaacatgagcagcagcaacctggcggcagcgcaaaagatg

SEQ ID NO: 197428 - DNA, 103 bp, Artificial Sequence
  Synthetic Polynucleotide
taatacgactcactataggggccgccgccgccgcctcctgctgctgctgcaacagaggagagcagcaatggcaggaggcaacctggcggcagcgcaaaagatg

SEQ ID NO: 197429 - DNA, 103 bp, Artificial Sequence
  Synthetic Polynucleotide
taatacgactcactatagggcgccgccgcagccgccgccgccgcctcctgaacagaggagacaggagatggcggcggcgaacctggcggcagcgcaaaagatg

SEQ ID NO: 197430 - DNA, 103 bp, Artificial Sequence
  Synthetic Polynucleotide
taatacgactcactatagggcagccgccgccgccgccgcagccgccgccgaacagaggagacggcggatgctgcggcggaacctggcggcagcgcaaaagatg

SEQ ID NO: 197431 - DNA, 103 bp, Artificial Sequence
  Synthetic Polynucleotide
taatacgactcactataggggccgccgccgcagccgccgccgccgccgcaaacagaggagatgcggcatgggcggcggcaacctggcggcagcgcaaaagatg

SEQ ID NO: 197432 - DNA, 103 bp, Artificial Sequence
  Synthetic Polynucleotide
taatacgactcactatagggcactgcagctgccgccgccgcagccgccgcaacagaggagagcggcgatggcggcggcgaacctggcggcagcgcaaaagatg

SEQ ID NO: 197433 - DNA, 103 bp, Artificial Sequence
  Synthetic Polynucleotide
taatacgactcactataggggcaaccggggcactgcagctgccgccgccgaacagaggagacggcggatgcagctgcagaacctggcggcagcgcaaaagatg

SEQ ID NO: 197434 - DNA, 103 bp, Artificial Sequence
  Synthetic Polynucleotide
taatacgactcactatagggtggggcggccgcaaccggggcactgcagctaacagaggagaagctgcatggccccggttaacctggcggcagcgcaaaagatg

SEQ ID NO: 197435 - DNA, 103 bp, Artificial Sequence
  Synthetic Polynucleotide
taatacgactcactataggggcggttgtcgtggggcggccgcaaccggggaacagaggagaccccggatgcggccgcccaacctggcggcagcgcaaaagatg

SEQ ID NO: 197436 - DNA, 103 bp, Artificial Sequence
  Synthetic Polynucleotide
taatacgactcactatagggccaccatggtgcggttgtcgtggggcggccaacagaggagaggccgcatgacgacaaccaacctggcggcagcgcaaaagatg

SEQ ID NO: 197437 - DNA, 103 bp, Artificial Sequence
  Synthetic Polynucleotide
taatacgactcactatagggaagttttgctgacatggtgtcactgtgctgaacagaggagacagcacatggacaccatgaacctggcggcagcgcaaaagatg

SEQ ID NO: 197438 - DNA, 103 bp, Artificial Sequence
  Synthetic Polynucleotide
taatacgactcactataggggcgatgatctccaccatggtgcggttgtcgaacagaggagacgacaaatgcaccatggtaacctggcggcagcgcaaaagatg

SEQ ID NO: 197439 - DNA, 103 bp, Artificial Sequence
  Synthetic Polynucleotide
taatacgactcactatagggcgggtggtcggcgatgatctccaccatggtaacagaggagaaccatgatggagatcatcaacctggcggcagcgcaaaagatg

SEQ ID NO: 197440 - DNA, 103 bp, Artificial Sequence
  Synthetic Polynucleotide
taatacgactcactatagggcgagttcggccgggtggtcggcgatgatctaacagaggagaagatcaatgccgaccaccaacctggcggcagcgcaaaagatg

SEQ ID NO: 197441 - DNA, 103 bp, Artificial Sequence
  Synthetic Polynucleotide
taatacgactcactatagggtcggtgcggacgagttcggccgggtggtcgaacagaggagacgaccaatgggccgaactaacctggcggcagcgcaaaagatg

SEQ ID NO: 197442 - DNA, 103 bp, Artificial Sequence
  Synthetic Polynucleotide
taatacgactcactataggggttggggctgtcggtgcggacgagttcggcaacagaggagagccgaaatggtccgcaccaacctggcggcagcgcaaaagatg

SEQ ID NO: 197443 - DNA, 103 bp, Artificial Sequence
  Synthetic Polynucleotide
taatacgactcactatagggagcacaggaagttggggctgtcggtgcggaaacagaggagatccgcaatgacagccccaaacctggcggcagcgcaaaagatg

SEQ ID NO: 197444 - DNA, 103 bp, Artificial Sequence
  Synthetic Polynucleotide
taatacgactcactatagggggcagcaccgagcacaggaagttggggctgaacagaggagacagcccatgcttcctgtgaacctggcggcagcgcaaaagatg

SEQ ID NO: 197445 - DNA, 103 bp, Artificial Sequence
  Synthetic Polynucleotide
taatacgactcactatagggccagtgcgagggcagcaccgagcacaggaaaacagaggagattcctgatgtcggtgctgaacctggcggcagcgcaaaagatg

SEQ ID NO: 197446 - DNA, 103 bp, Artificial Sequence
  Synthetic Polynucleotide
taatacgactcactatagggtgttgcagcgccagtgcgagggcagcaccgaacagaggagacggtgcatgcctcgcactaacctggcggcagcgcaaaagatg

SEQ ID NO: 197447 - DNA, 103 bp, Artificial Sequence
  Synthetic Polynucleotide
taatacgactcactatagggggcagggtcttgttgcagcgccagtgcgagaacagaggagactcgcaatggcgctgcaaaacctggcggcagcgcaaaagatg

SEQ ID NO: 197448 - DNA, 103 bp, Artificial Sequence
  Synthetic Polynucleotide
taatacgactcactatagggatcccaaaagaagttttgctgacatggtgtaacagaggagaacaccaatgcagcaaaacaacctggcggcagcgcaaaagatg

SEQ ID NO: 197449 - DNA, 103 bp, Artificial Sequence
  Synthetic Polynucleotide
taatacgactcactataggggaaggccacgggcagggtcttgttgcagcgaacagaggagacgctgcatgaagaccctgaacctggcggcagcgcaaaagatg

SEQ ID NO: 197450 - DNA, 103 bp, Artificial Sequence
  Synthetic Polynucleotide
taatacgactcactatagggctaccaccttgaaggccacgggcagggtctaacagaggagaagacccatgccgtggcctaacctggcggcagcgcaaaagatg

SEQ ID NO: 197451 - DNA, 103 bp, Artificial Sequence
  Synthetic Polynucleotide
taatacgactcactatagggtctccgagggctaccaccttgaaggccacgaacagaggagacgtggcatgcaaggtggtaacctggcggcagcgcaaaagatg

SEQ ID NO: 197452 - DNA, 103 bp, Artificial Sequence
  Synthetic Polynucleotide
taatacgactcactatagggatctggtacctctccgagggctaccaccttaacagaggagaaaggtgatggccctcggaaacctggcggcagcgcaaaagatg

SEQ ID NO: 197453 - DNA, 103 bp, Artificial Sequence
  Synthetic Polynucleotide
taatacgactcactatagggccacagtcccatctggtacctctccgagggaacagaggagaccctcgatgaggtaccagaacctggcggcagcgcaaaagatg

SEQ ID NO: 197454 - DNA, 103 bp, Artificial Sequence
  Synthetic Polynucleotide
taatacgactcactatagggatgacagtaaccacagtcccatctggtaccaacagaggagaggtaccatgtgggactgtaacctggcggcagcgcaaaagatg

SEQ ID NO: 197455 - DNA, 103 bp, Artificial Sequence
  Synthetic Polynucleotide
taatacgactcactataggggttacccgccatgacagtaaccacagtcccaacagaggagagggactatggttactgtcaacctggcggcagcgcaaaagatg

SEQ ID NO: 197456 - DNA, 103 bp, Artificial Sequence
  Synthetic Polynucleotide
taatacgactcactatagggaattttcatcgttacccgccatgacagtaaaacagaggagattactgatgtggcgggtaaacctggcggcagcgcaaaagatg

SEQ ID NO: 197457 - DNA, 103 bp, Artificial Sequence
  Synthetic Polynucleotide
taatacgactcactatagggtcagcagaataattttcatcgttacccgccaacagaggagaggcgggatgcgatgaaaaaacctggcggcagcgcaaaagatg

SEQ ID NO: 197458 - DNA, 103 bp, Artificial Sequence
  Synthetic Polynucleotide
taatacgactcactatagggattccggagctcagcagaataattttcatcaacagaggagagatgaaatgtattctgctaacctggcggcagcgcaaaagatg

SEQ ID NO: 197459 - DNA, 103 bp, Artificial Sequence
  Synthetic Polynucleotide
taatacgactcactatagggtggtgctcggatcccaaaagaagttttgctaacagaggagaagcaaaatgtcttttgggaacctggcggcagcgcaaaagatg

SEQ ID NO: 197460 - DNA, 103 bp, Artificial Sequence
  Synthetic Polynucleotide
taatacgactcactatagggcagcagaggcattccggagctcagcagaataacagaggagaattctgatgagctccggaaacctggcggcagcgcaaaagatg

SEQ ID NO: 197461 - DNA, 103 bp, Artificial Sequence
  Synthetic Polynucleotide
taatacgactcactatagggtttttcataacagcagaggcattccggagcaacagaggagagctccgatgtgcctctgcaacctggcggcagcgcaaaagatg

SEQ ID NO: 197462 - DNA, 103 bp, Artificial Sequence
  Synthetic Polynucleotide
taatacgactcactatagggtgctacttggtttttcataacagcagaggcaacagaggagagcctctatggttatgaaaaacctggcggcagcgcaaaagatg

SEQ ID NO: 197463 - DNA, 103 bp, Artificial Sequence
  Synthetic Polynucleotide
taatacgactcactatagggcgttgaaccttgctacttggtttttcataaaacagaggagattatgaatgaccaagtagaacctggcggcagcgcaaaagatg

SEQ ID NO: 197464 - DNA, 103 bp, Artificial Sequence
  Synthetic Polynucleotide
taatacgactcactatagggaatctcagatcgttgaaccttgctacttggaacagaggagaccaagtatgaaggttcaaaacctggcggcagcgcaaaagatg

SEQ ID NO: 197465 - DNA, 103 bp, Artificial Sequence
  Synthetic Polynucleotide
taatacgactcactatagggccggcccacaaatctcagatcgttgaacctaacagaggagaaggttcatggatctgagaaacctggcggcagcgcaaaagatg

SEQ ID NO: 197466 - DNA, 103 bp, Artificial Sequence
  Synthetic Polynucleotide
taatacgactcactatagggctcgtccactccggcccacaaatctcagataacagaggagaatctgaatgttgtgggccaacctggcggcagcgcaaaagatg

SEQ ID NO: 197467 - DNA, 103 bp, Artificial Sequence
  Synthetic Polynucleotide
taatacgactcactatagggaaactcttgcctcgtccactccggcccacaaacagaggagatgtgggatggagtggacgaacctggcggcagcgcaaaagatg

SEQ ID NO: 197468 - DNA, 103 bp, Artificial Sequence
  Synthetic Polynucleotide
taatacgactcactatagggggtcaaggtgaaactcttgcctcgtccactaacagaggagaagtggaatgggcaagagtaacctggcggcagcgcaaaagatg

SEQ ID NO: 197469 - DNA, 103 bp, Artificial Sequence
  Synthetic Polynucleotide
taatacgactcactatagggagacggttatggtcaaggtgaaactcttgcaacagaggagagcaagaatgtcaccttgaaacctggcggcagcgcaaaagatg

SEQ ID NO: 197470 - DNA, 103 bp, Artificial Sequence
  Synthetic Polynucleotide
taatacgactcactatagggaagcgccggctggtgctcggatcccaaaagaacagaggagacttttgatgtccgagcacaacctggcggcagcgcaaaagatg

SEQ ID NO: 197471 - DNA, 103 bp, Artificial Sequence
  Synthetic Polynucleotide
taatacgactcactatagggggatttgtgaagacggttatggtcaaggtgaacagaggagacaccttatgcataaccgtaacctggcggcagcgcaaaagatg

SEQ ID NO: 197472 - DNA, 103 bp, Artificial Sequence
  Synthetic Polynucleotide
taatacgactcactatagggtacttggggaggatttgtgaagacggttataacagaggagaataaccatgttcacaaataacctggcggcagcgcaaaagatg

SEQ ID NO: 197473 - DNA, 103 bp, Artificial Sequence
  Synthetic Polynucleotide
taatacgactcactataggggataggtagctacttggggaggatttgtgaaacagaggagatcacaaatgctccccaagaacctggcggcagcgcaaaagatg

SEQ ID NO: 197474 - DNA, 103 bp, Artificial Sequence
  Synthetic Polynucleotide
taatacgactcactatagggattgctctgtgataggtagctacttggggaaacagaggagatccccaatgagctacctaaacctggcggcagcgcaaaagatg

SEQ ID NO: 197475 - DNA, 103 bp, Artificial Sequence
  Synthetic Polynucleotide
taatacgactcactatagggtgtaactttaattgctctgtgataggtagcaacagaggagagctaccatgcacagagcaaacctggcggcagcgcaaaagatg

SEQ ID NO: 197476 - DNA, 103 bp, Artificial Sequence
  Synthetic Polynucleotide
taatacgactcactataggggtccatctactgtaactttaattgctctgtaacagaggagaacagagatgttaaagttaaacctggcggcagcgcaaaagatg

SEQ ID NO: 197477 - DNA, 103 bp, Artificial Sequence
  Synthetic Polynucleotide
taatacgactcactatagggggttcccgaggtccatctactgtaactttaaacagaggagataaagtatgagtagatggaacctggcggcagcgcaaaagatg

SEQ ID NO: 197478 - DNA, 103 bp, Artificial Sequence
  Synthetic Polynucleotide
taatacgactcactataggggtgccttctgggttcccgaggtccatctacaacagaggagagtagatatgcctcgggaaaacctggcggcagcgcaaaagatg

SEQ ID NO: 197479 - DNA, 103 bp, Artificial Sequence
  Synthetic Polynucleotide
taatacgactcactataggggcttctgtctgtgccttctgggttcccgagaacagaggagactcgggatgccagaaggcaacctggcggcagcgcaaaagatg

SEQ ID NO: 197480 - DNA, 103 bp, Artificial Sequence
  Synthetic Polynucleotide
taatacgactcactataggggagtcatcaagcttctgtctgtgccttctgaacagaggagacagaagatgcagacagaaaacctggcggcagcgcaaaagatg

SEQ ID NO: 197481 - DNA, 103 bp, Artificial Sequence
  Synthetic Polynucleotide
taatacgactcactataggggggggggctgaagcgccggctggtgctcggaacagaggagaccgagcatgagccggcgcaacctggcggcagcgcaaaagatg

SEQ ID NO: 197482 - DNA, 103 bp, Artificial Sequence
  Synthetic Polynucleotide
taatacgactcactatagggactaggtttagagtcatcaagcttctgtctaacagaggagaagacagatgcttgatgacaacctggcggcagcgcaaaagatg

SEQ ID NO: 197483 - DNA, 103 bp, Artificial Sequence
  Synthetic Polynucleotide
taatacgactcactatagggcagagaacaaactaggtttagagtcatcaaaacagaggagattgatgatgctaaacctaaacctggcggcagcgcaaaagatg

SEQ ID NO: 197484 - DNA, 103 bp, Artificial Sequence
  Synthetic Polynucleotide
taatacgactcactatagggctgaggcggtcagagaacaaactaggtttaaacagaggagataaaccatgtttgttctcaacctggcggcagcgcaaaagatg

SEQ ID NO: 197485 - DNA, 103 bp, Artificial Sequence
  Synthetic Polynucleotide
taatacgactcactatagggccctaaatcactgaggcggtcagagaacaaaacagaggagattgttcatggaccgcctcaacctggcggcagcgcaaaagatg

SEQ ID NO: 197486 - DNA, 103 bp, Artificial Sequence
  Synthetic Polynucleotide
taatacgactcactataggggaggaatgcgccctaaatcactgaggcggtaacagaggagaaccgccatggtgatttagaacctggcggcagcgcaaaagatg

SEQ ID NO: 197487 - DNA, 103 bp, Artificial Sequence
  Synthetic Polynucleotide
taatacgactcactatagggatactgggatgaggaatgcgccctaaatcaaacagaggagatgatttatggcgcattccaacctggcggcagcgcaaaagatg

SEQ ID NO: 197488 - DNA, 103 bp, Artificial Sequence
  Synthetic Polynucleotide
taatacgactcactatagggacctactctcatactgggatgaggaatgcgaacagaggagacgcattatgcatcccagtaacctggcggcagcgcaaaagatg

SEQ ID NO: 197489 - DNA, 103 bp, Artificial Sequence
  Synthetic Polynucleotide
taatacgactcactataggggaggcgggacacctactctcatactgggataacagaggagaatcccaatgtgagagtagaacctggcggcagcgcaaaagatg

SEQ ID NO: 197490 - DNA, 103 bp, Artificial Sequence
  Synthetic Polynucleotide
taatacgactcactatagggcgtgggttctgaggcgggacacctactctcaacagaggagagagagtatgtgtcccgccaacctggcggcagcgcaaaagatg

SEQ ID NO: 197491 - DNA, 103 bp, Artificial Sequence
  Synthetic Polynucleotide
taatacgactcactatagggcagggagggccgtgggttctgaggcgggacaacagaggagagtcccgatgcagaacccaaacctggcggcagcgcaaaagatg

SEQ ID NO: 197492 - DNA, 103 bp, Artificial Sequence
  Synthetic Polynucleotide
taatacgactcactatagggggctgctggagggggggctgaagcgccggcaacagaggagagccggcatgtcagcccccaacctggcggcagcgcaaaagatg

SEQ ID NO: 197493 - DNA, 103 bp, Artificial Sequence
  Synthetic Polynucleotide
taatacgactcactataggggtgcagagttcagggagggccgtgggttctaacagaggagaagaaccatgggccctcccaacctggcggcagcgcaaaagatg

SEQ ID NO: 197494 - DNA, 103 bp, Artificial Sequence
  Synthetic Polynucleotide
taatacgactcactatagggaaaggacttggtgcagagttcagggagggcaacagaggagagccctcatggaactctgcaacctggcggcagcgcaaaagatg

SEQ ID NO: 197495 - DNA, 103 bp, Artificial Sequence
  Synthetic Polynucleotide
taatacgactcactatagggttgtggattaaaaggacttggtgcagagttaacagaggagaaactctatgccaagtcctaacctggcggcagcgcaaaagatg

SEQ ID NO: 197496 - DNA, 103 bp, Artificial Sequence
  Synthetic Polynucleotide
taatacgactcactataggggactctgtccttgtggattaaaaggacttgaacagaggagacaagtcatgttaatccacaacctggcggcagcgcaaaagatg

SEQ ID NO: 197497 - DNA, 103 bp, Artificial Sequence
  Synthetic Polynucleotide
taatacgactcactatagggtctgtaatctgactctgtccttgtggattaaacagaggagataatccatgaggacagagaacctggcggcagcgcaaaagatg

SEQ ID NO: 197498 - DNA, 103 bp, Artificial Sequence
  Synthetic Polynucleotide
taatacgactcactatagggctgcctggggtctgtaatctgactctgtccaacagaggagaggacagatgcagattacaaacctggcggcagcgcaaaagatg

SEQ ID NO: 197499 - DNA, 103 bp, Artificial Sequence
  Synthetic Polynucleotide
taatacgactcactatagggaagactgtgcctgcctggggtctgtaatctaacagaggagaagattaatgaccccaggcaacctggcggcagcgcaaaagatg

SEQ ID NO: 197500 - DNA, 103 bp, Artificial Sequence
  Synthetic Polynucleotide
taatacgactcactatagggcacggcggggaagactgtgcctgcctggggaacagaggagaccccagatgggcacagtcaacctggcggcagcgcaaaagatg

SEQ ID NO: 197501 - DNA, 103 bp, Artificial Sequence
  Synthetic Polynucleotide
taatacgactcactataggggtcataggaccacggcggggaagactgtgcaacagaggagagcacagatgtccccgccgaacctggcggcagcgcaaaagatg

SEQ ID NO: 197502 - DNA, 103 bp, Artificial Sequence
  Synthetic Polynucleotide
taatacgactcactatagggggtaagactggtcataggaccacggcggggaacagaggagaccccgcatgggtcctatgaacctggcggcagcgcaaaagatg

SEQ ID NO: 197503 - DNA, 103 bp, Artificial Sequence
  Synthetic Polynucleotide
taatacgactcactatagggccgggctgcaggctgctggagggggggctgaacagaggagacagcccatgctccagcagaacctggcggcagcgcaaaagatg

SEQ ID NO: 197504 - DNA, 103 bp, Artificial Sequence
  Synthetic Polynucleotide
taatacgactcactatagggaggtaggaggggtaagactggtcataggacaacagaggagagtcctaatgccagtcttaaacctggcggcagcgcaaaagatg

SEQ ID NO: 197505 - DNA, 103 bp, Artificial Sequence
  Synthetic Polynucleotide
taatacgactcactatagggcatctggctcaggtaggaggggtaagactgaacagaggagacagtctatgccctcctacaacctggcggcagcgcaaaagatg

SEQ ID NO: 197506 - DNA, 103 bp, Artificial Sequence
  Synthetic Polynucleotide
taatacgactcactatagggacggggacgtcatctggctcaggtaggaggaacagaggagacctcctatgtgagccagaaacctggcggcagcgcaaaagatg

SEQ ID NO: 197507 - DNA, 103 bp, Artificial Sequence
  Synthetic Polynucleotide
taatacgactcactataggggagtggatggacggggacgtcatctggctcaacagaggagagagccaatggacgtccccaacctggcggcagcgcaaaagatg

SEQ ID NO: 197508 - DNA, 103 bp, Artificial Sequence
  Synthetic Polynucleotide
taatacgactcactatagggcggggtggtagagtggatggacggggacgtaacagaggagaacgtccatgtccatccacaacctggcggcagcgcaaaagatg

SEQ ID NO: 197509 - DNA, 103 bp, Artificial Sequence
  Synthetic Polynucleotide
taatacgactcactatagggtggaagacagcggggtggtagagtggatggaacagaggagaccatccatgctaccacccaacctggcggcagcgcaaaagatg

SEQ ID NO: 197510 - DNA, 103 bp, Artificial Sequence
  Synthetic Polynucleotide
taatacgactcactataggggtgccccgtgtggaagacagcggggtggtaaacagaggagataccacatggctgtcttcaacctggcggcagcgcaaaagatg

SEQ ID NO: 197511 - DNA, 103 bp, Artificial Sequence
  Synthetic Polynucleotide
taatacgactcactatagggaggaagcccagtgccccgtgtggaagacagaacagaggagactgtctatgacacggggcaacctggcggcagcgcaaaagatg

SEQ ID NO: 197512 - DNA, 103 bp, Artificial Sequence
  Synthetic Polynucleotide
taatacgactcactatagggcggtgatggcaggaagcccagtgccccgtgaacagaggagacacgggatgctgggcttcaacctggcggcagcgcaaaagatg

SEQ ID NO: 197513 - DNA, 103 bp, Artificial Sequence
  Synthetic Polynucleotide
taatacgactcactatagggctaggcacatcggtgatggcaggaagcccaaacagaggagatgggctatgtgccatcacaacctggcggcagcgcaaaagatg

SEQ ID NO: 197514 - DNA, 103 bp, Artificial Sequence
  Synthetic Polynucleotide
taatacgactcactataggggaaggagtcgaagatgctgttcgatgccataacagaggagaatggcaatgaacagcatcaacctggcggcagcgcaaaagatg

SEQ ID NO: 197515 - DNA, 103 bp, Artificial Sequence
  Synthetic Polynucleotide
taatacgactcactataggggccgccgccgccgcaggggaaggccggggaaacagaggagatccccgatgttcccctgcaacctggcggcagcgcaaaagatg

SEQ ID NO: 197516 - DNA, 103 bp, Artificial Sequence
  Synthetic Polynucleotide
taatacgactcactataggggttggcctggaagggcccgctctggttctgaacagaggagacagaacatgagcgggcccaacctggcggcagcgcaaaagatg

SEQ ID NO: 197517 - DNA, 103 bp, Artificial Sequence
  Synthetic Polynucleotide
taatacgactcactatagggagggggacgggttggcctggaagggcccgcaacagaggagagcgggcatgtccaggccaaacctggcggcagcgcaaaagatg

SEQ ID NO: 197518 - DNA, 103 bp, Artificial Sequence
  Synthetic Polynucleotide
taatacgactcactatagggtagaggtggtagggggacgggttggcctggaacagaggagaccaggcatgcccgtccccaacctggcggcagcgcaaaagatg

SEQ ID NO: 197519 - DNA, 103 bp, Artificial Sequence
  Synthetic Polynucleotide
taatacgactcactatagggtgtcccgtagtagaggtggtagggggacggaacagaggagaccgtccatgtaccacctcaacctggcggcagcgcaaaagatg

SEQ ID NO: 197520 - DNA, 103 bp, Artificial Sequence
  Synthetic Polynucleotide
taatacgactcactatagggagccagaggatgtcccgtagtagaggtggtaacagaggagaaccaccatgactacgggaaacctggcggcagcgcaaaagatg

SEQ ID NO: 197521 - DNA, 103 bp, Artificial Sequence
  Synthetic Polynucleotide
taatacgactcactatagggaactggtaggagccagaggatgtcccgtagaacagaggagactacggatgatcctctggaacctggcggcagcgcaaaagatg

SEQ ID NO: 197522 - DNA, 103 bp, Artificial Sequence
  Synthetic Polynucleotide
taatacgactcactatagggcaccatggagaactggtaggagccagaggaaacagaggagatcctctatgtcctaccagaacctggcggcagcgcaaaagatg

SEQ ID NO: 197523 - DNA, 103 bp, Artificial Sequence
  Synthetic Polynucleotide
taatacgactcactatagggtgctgccggccaccatggagaactggtaggaacagaggagacctaccatgtctccatggaacctggcggcagcgcaaaagatg

SEQ ID NO: 197524 - DNA, 103 bp, Artificial Sequence
  Synthetic Polynucleotide
taatacgactcactatagggcccccactgctgctgccggccaccatggagaacagaggagactccatatgggccggcagaacctggcggcagcgcaaaagatg

SEQ ID NO: 197525 - DNA, 103 bp, Artificial Sequence
  Synthetic Polynucleotide
taatacgactcactatagggtgagcggtcgcccccactgctgctgccggcaacagaggagagccggcatgagcagtgggaacctggcggcagcgcaaaagatg

SEQ ID NO: 197526 - DNA, 103 bp, Artificial Sequence
  Synthetic Polynucleotide
taatacgactcactatagggccatcttgccgccgccgccgccgcaggggaaacagaggagatcccctatggcggcggcgaacctggcggcagcgcaaaagatg

SEQ ID NO: 197527 - DNA, 103 bp, Artificial Sequence
  Synthetic Polynucleotide
taatacgactcactatagggtgcgggtaggtgagcggtcgcccccactgcaacagaggagagcagtgatggcgaccgctaacctggcggcagcgcaaaagatg

SEQ ID NO: 197528 - DNA, 103 bp, Artificial Sequence
  Synthetic Polynucleotide
taatacgactcactataggggaggccagcatgcgggtaggtgagcggtcgaacagaggagacgaccgatgacctacccgaacctggcggcagcgcaaaagatg

SEQ ID NO: 197529 - DNA, 103 bp, Artificial Sequence
  Synthetic Polynucleotide
taatacgactcactataggggctggtgcaagaggccagcatgcgggtaggaacagaggagacctaccatgatgctggccaacctggcggcagcgcaaaagatg

SEQ ID NO: 197530 - DNA, 103 bp, Artificial Sequence
  Synthetic Polynucleotide
taatacgactcactatagggaggcagcgctgctggtgcaagaggccagcaaacagaggagatgctggatgcttgcaccaaacctggcggcagcgcaaaagatg

SEQ ID NO: 197531 - DNA, 103 bp, Artificial Sequence
  Synthetic Polynucleotide
taatacgactcactataggggcggcgacagaggcagcgctgctggtgcaaaacagaggagattgcacatgcagcgctgcaacctggcggcagcgcaaaagatg

SEQ ID NO: 197532 - DNA, 103 bp, Artificial Sequence
  Synthetic Polynucleotide
taatacgactcactataggggaggttgccggcggcgacagaggcagcgctaacagaggagaagcgctatgtctgtcgccaacctggcggcagcgcaaaagatg

SEQ ID NO: 197533 - DNA, 103 bp, Artificial Sequence
  Synthetic Polynucleotide
taatacgactcactatagggtggggttcatgaggttgccggcggcgacagaacagaggagactgtcgatgccggcaaccaacctggcggcagcgcaaaagatg

SEQ ID NO: 197534 - DNA, 103 bp, Artificial Sequence
  Synthetic Polynucleotide
taatacgactcactatagggccgcccaggctggggttcatgaggttgccgaacagaggagacggcaaatgcatgaacccaacctggcggcagcgcaaaagatg

SEQ ID NO: 197535 - DNA, 103 bp, Artificial Sequence
  Synthetic Polynucleotide
taatacgactcactatagggatcactctggccgcccaggctggggttcataacagaggagaatgaacatgagcctgggcaacctggcggcagcgcaaaagatg

SEQ ID NO: 197536 - DNA, 103 bp, Artificial Sequence
  Synthetic Polynucleotide
taatacgactcactatagggcctccacgccatcactctggccgcccaggcaacagaggagagcctggatggccagagtgaacctggcggcagcgcaaaagatg

SEQ ID NO: 197537 - DNA, 103 bp, Artificial Sequence
  Synthetic Polynucleotide
taatacgactcactatagggctgttctcgcccatcttgccgccgccgccgaacagaggagacggcggatgcggcaagataacctggcggcagcgcaaaagatg

SEQ ID NO: 197538 - DNA, 103 bp, Artificial Sequence
  Synthetic Polynucleotide
taatacgactcactatagggctgccgtcggcctccacgccatcactctggaacagaggagaccagagatgtggcgtggaaacctggcggcagcgcaaaagatg

SEQ ID NO: 197539 - DNA, 103 bp, Artificial Sequence
  Synthetic Polynucleotide
taatacgactcactataggggttgctgtggctgccgtcggcctccacgccaacagaggagaggcgtgatggccgacggcaacctggcggcagcgcaaaagatg

SEQ ID NO: 197540 - DNA, 103 bp, Artificial Sequence
  Synthetic Polynucleotide
taatacgactcactatagggccgtgggtgagttgctgtggctgccgtcggaacagaggagaccgacgatggccacagcaaacctggcggcagcgcaaaagatg

SEQ ID NO: 197541 - DNA, 103 bp, Artificial Sequence
  Synthetic Polynucleotide
taatacgactcactataggggtgctcagggccgtgggtgagttgctgtggaacagaggagaccacagatgctcacccacaacctggcggcagcgcaaaagatg

SEQ ID NO: 197542 - DNA, 103 bp, Artificial Sequence
  Synthetic Polynucleotide
taatacgactcactataggggcggcctggcgtgctcagggccgtgggtgaaacagaggagatcacccatggccctgagcaacctggcggcagcgcaaaagatg

SEQ ID NO: 197543 - DNA, 103 bp, Artificial Sequence
  Synthetic Polynucleotide
taatacgactcactatagggcctcatccatgcggcctggcgtgctcagggaacagaggagaccctgaatgcgccaggccaacctggcggcagcgcaaaagatg

SEQ ID NO: 197544 - DNA, 103 bp, Artificial Sequence
  Synthetic Polynucleotide
taatacgactcactatagggcgccacacggcctcatccatgcggcctggcaacagaggagagccaggatgcatggatgaaacctggcggcagcgcaaaagatg

SEQ ID NO: 197545 - DNA, 103 bp, Artificial Sequence
  Synthetic Polynucleotide
taatacgactcactatagggtcagtagggccgccacacggcctcatccataacagaggagaatggatatggccgtgtggaacctggcggcagcgcaaaagatg

SEQ ID NO: 197546 - DNA, 103 bp, Artificial Sequence
  Synthetic Polynucleotide
taatacgactcactatagggcagcgcgccgctgttctcgcccatcttgccaacagaggagaggcaagatgggcgagaacaacctggcggcagcgcaaaagatg

SEQ ID NO: 197547 - DNA, 103 bp, Artificial Sequence
  Synthetic Polynucleotide
taatacgactcactatagggcctgcgcgctcagcgcgccgctgttctcgcaacagaggagagcgagaatggcggcgcgcaacctggcggcagcgcaaaagatg

SEQ ID NO: 197548 - DNA, 103 bp, Artificial Sequence
  Synthetic Polynucleotide
taatacgactcactatagggcccacggccgcctgcgcgctcagcgcgccgaacagaggagacggcgcatggagcgcgcaaacctggcggcagcgcaaaagatg

SEQ ID NO: 197549 - DNA, 103 bp, Artificial Sequence
  Synthetic Polynucleotide
taatacgactcactatagggccctccgggccccacggccgcctgcgcgctaacagaggagaagcgcgatggcggccgtgaacctggcggcagcgcaaaagatg

SEQ ID NO: 197550 - DNA, 103 bp, Artificial Sequence
  Synthetic Polynucleotide
taatacgactcactataggggccgggcgcgccctccgggccccacggccgaacagaggagacggccgatgggcccggagaacctggcggcagcgcaaaagatg

SEQ ID NO: 197551 - DNA, 103 bp, Artificial Sequence
  Synthetic Polynucleotide
taatacgactcactatagggcgcacctcgggccgggcgcgccctccgggcaacagaggagagcccggatggcgcgcccgaacctggcggcagcgcaaaagatg

SEQ ID NO: 197552 - DNA, 103 bp, Artificial Sequence
  Synthetic Polynucleotide
taatacgactcactatagggcaccatcgagcgcacctcgggccgggcgcgaacagaggagacgcgccatgcccgaggtgaacctggcggcagcgcaaaagatg

SEQ ID NO: 197553 - DNA, 103 bp, Artificial Sequence
  Synthetic Polynucleotide
taatacgactcactatagggagtaggtcgggaaggagtcgaagatgctgtaacagaggagaacagcaatgtcgactcctaacctggcggcagcgcaaaagatg

SEQ ID NO: 197554 - DNA, 103 bp, Artificial Sequence
  Synthetic Polynucleotide
taatacgactcactatagggccagcacgtccaccatcgagcgcacctcggaacagaggagaccgaggatggctcgatggaacctggcggcagcgcaaaagatg

SEQ ID NO: 197555 - DNA, 103 bp, Artificial Sequence
  Synthetic Polynucleotide
taatacgactcactataggggcgtggtccgccagcacgtccaccatcgagaacagaggagactcgatatgggacgtgctaacctggcggcagcgcaaaagatg

SEQ ID NO: 197556 - DNA, 103 bp, Artificial Sequence
  Synthetic Polynucleotide
taatacgactcactataggggagctcgcctgcgtggtccgccagcacgtcaacagaggagagacgtgatggcggaccacaacctggcggcagcgcaaaagatg

SEQ ID NO: 197557 - DNA, 103 bp, Artificial Sequence
  Synthetic Polynucleotide
taatacgactcactatagggcggtgcgcacgagctcgcctgcgtggtccgaacagaggagacggaccatgcaggcgagcaacctggcggcagcgcaaaagatg

SEQ ID NO: 197558 - DNA, 103 bp, Artificial Sequence
  Synthetic Polynucleotide
taatacgactcactatagggttggggctgtcggtgcgcacgagctcgcctaacagaggagaaggcgaatgcgtgcgcacaacctggcggcagcgcaaaagatg

SEQ ID NO: 197559 - DNA, 103 bp, Artificial Sequence
  Synthetic Polynucleotide
taatacgactcactataggggcagaggaagttggggctgtcggtgcgcacaacagaggagagtgcgcatggacagccccaacctggcggcagcgcaaaagatg

SEQ ID NO: 197560 - DNA, 103 bp, Artificial Sequence
  Synthetic Polynucleotide
taatacgactcactataggggcagcacggagcagaggaagttggggctgtaacagaggagaacagccatgacttcctctaacctggcggcagcgcaaaagatg

SEQ ID NO: 197561 - DNA, 103 bp, Artificial Sequence
  Synthetic Polynucleotide
taatacgactcactatagggcagtgcgagggcagcacggagcagaggaagaacagaggagacttcctatgctccgtgctaacctggcggcagcgcaaaagatg

SEQ ID NO: 197562 - DNA, 103 bp, Artificial Sequence
  Synthetic Polynucleotide
taatacgactcactataggggttgcagcgccagtgcgagggcagcacggaaacagaggagatccgtgatgccctcgcacaacctggcggcagcgcaaaagatg

SEQ ID NO: 197563 - DNA, 103 bp, Artificial Sequence
  Synthetic Polynucleotide
taatacgactcactataggggcagcgtcttgttgcagcgccagtgcgaggaacagaggagacctcgcatgggcgctgcaaacctggcggcagcgcaaaagatg

SEQ ID NO: 197564 - DNA, 103 bp, Artificial Sequence
  Synthetic Polynucleotide
taatacgactcactatagggaaggtcggcgagtaggtcgggaaggagtcgaacagaggagacgactcatgcccgacctaaacctggcggcagcgcaaaagatg

SEQ ID NO: 197565 - DNA, 103 bp, Artificial Sequence
  Synthetic Polynucleotide
taatacgactcactatagggaaggcgacgggcagcgtcttgttgcagcgcaacagaggagagcgctgatgcaagacgctaacctggcggcagcgcaaaagatg

SEQ ID NO: 197566 - DNA, 103 bp, Artificial Sequence
  Synthetic Polynucleotide
taatacgactcactatagggcaccaccttgaaggcgacgggcagcgtcttaacagaggagaaagacgatgcccgtcgccaacctggcggcagcgcaaaagatg

SEQ ID NO: 197567 - DNA, 103 bp, Artificial Sequence
  Synthetic Polynucleotide
taatacgactcactatagggcccccaatgccaccaccttgaaggcgacggaacagaggagaccgtcgatgtcaaggtggaacctggcggcagcgcaaaagatg

SEQ ID NO: 197568 - DNA, 103 bp, Artificial Sequence
  Synthetic Polynucleotide
taatacgactcactatagggtccggcacgtcccccaatgccaccaccttgaacagaggagacaaggtatgggcattgggaacctggcggcagcgcaaaagatg

SEQ ID NO: 197569 - DNA, 103 bp, Artificial Sequence
  Synthetic Polynucleotide
taatacgactcactatagggcaccgtaccatccggcacgtcccccaatgcaacagaggagagcattgatggacgtgccgaacctggcggcagcgcaaaagatg

SEQ ID NO: 197570 - DNA, 103 bp, Artificial Sequence
  Synthetic Polynucleotide
taatacgactcactatagggtcacagtcaccaccgtaccatccggcacgtaacagaggagaacgtgcatgatggtacggaacctggcggcagcgcaaaagatg

SEQ ID NO: 197571 - DNA, 103 bp, Artificial Sequence
  Synthetic Polynucleotide
taatacgactcactatagggttgcctgccatcacagtcaccaccgtaccaaacagaggagatggtacatgggtgactgtaacctggcggcagcgcaaaagatg

SEQ ID NO: 197572 - DNA, 103 bp, Artificial Sequence
  Synthetic Polynucleotide
taatacgactcactataggggttctcgtcattgcctgccatcacagtcacaacagaggagagtgactatgatggcaggcaacctggcggcagcgcaaaagatg

SEQ ID NO: 197573 - DNA, 103 bp, Artificial Sequence
  Synthetic Polynucleotide
taatacgactcactatagggcagcggagtagttctcgtcattgcctgccaaacagaggagatggcagatgatgacgagaaacctggcggcagcgcaaaagatg

SEQ ID NO: 197574 - DNA, 103 bp, Artificial Sequence
  Synthetic Polynucleotide
taatacgactcactatagggttgcgcagctcagcggagtagttctcgtcaaacagaggagatgacgaatgctactccgcaacctggcggcagcgcaaaagatg

SEQ ID NO: 197575 - DNA, 103 bp, Artificial Sequence
  Synthetic Polynucleotide
taatacgactcactataggggtcgcggatgaaggtcggcgagtaggtcggaacagaggagaccgaccatgtcgccgaccaacctggcggcagcgcaaaagatg

SEQ ID NO: 197576 - DNA, 103 bp, Artificial Sequence
  Synthetic Polynucleotide
taatacgactcactatagggggccgaggcattgcgcagctcagcggagtaaacagaggagatactccatggagctgcgcaacctggcggcagcgcaaaagatg

SEQ ID NO: 197577 - DNA, 103 bp, Artificial Sequence
  Synthetic Polynucleotide
taatacgactcactatagggtcttcatgacggccgaggcattgcgcagctaacagaggagaagctgcatgatgcctcggaacctggcggcagcgcaaaagatg

SEQ ID NO: 197578 - DNA, 103 bp, Artificial Sequence
  Synthetic Polynucleotide
taatacgactcactataggggccacctggttcttcatgacggccgaggcaaacagaggagatgcctcatgcgtcatgaaaacctggcggcagcgcaaaagatg

SEQ ID NO: 197579 - DNA, 103 bp, Artificial Sequence
  Synthetic Polynucleotide
taatacgactcactataggggttgaacctggccacctggttcttcatgacaacagaggagagtcatgatgaaccaggtgaacctggcggcagcgcaaaagatg

SEQ ID NO: 197580 - DNA, 103 bp, Artificial Sequence
  Synthetic Polynucleotide
taatacgactcactatagggagcgaaggtcgttgaacctggccacctggtaacagaggagaaccaggatgccaggttcaaacctggcggcagcgcaaaagatg

SEQ ID NO: 197581 - DNA, 103 bp, Artificial Sequence
  Synthetic Polynucleotide
taatacgactcactatagggcggcccacgaagcgaaggtcgttgaacctgaacagaggagacaggttatgcgaccttcgaacctggcggcagcgcaaaagatg

SEQ ID NO: 197582 - DNA, 103 bp, Artificial Sequence
  Synthetic Polynucleotide
taatacgactcactatagggtcgcccactgcggcccacgaagcgaaggtcaacagaggagagaccttatgttcgtgggcaacctggcggcagcgcaaaagatg

SEQ ID NO: 197583 - DNA, 103 bp, Artificial Sequence
  Synthetic Polynucleotide
taatacgactcactatagggaactcttccctcgcccactgcggcccacgaaacagaggagatcgtggatggcagtgggcaacctggcggcagcgcaaaagatg

SEQ ID NO: 197584 - DNA, 103 bp, Artificial Sequence
  Synthetic Polynucleotide
taatacgactcactataggggtcagggtgaaactcttccctcgcccactgaacagaggagacagtggatgagggaagagaacctggcggcagcgcaaaagatg

SEQ ID NO: 197585 - DNA, 103 bp, Artificial Sequence
  Synthetic Polynucleotide
taatacgactcactatagggcacagtgatggtcagggtgaaactcttcccaacagaggagagggaagatgttcaccctgaacctggcggcagcgcaaaagatg

SEQ ID NO: 197586 - DNA, 103 bp, Artificial Sequence
  Synthetic Polynucleotide
taatacgactcactatagggtggtgcttgggtcgcggatgaaggtcggcgaacagaggagacgccgaatgtcatccgcgaacctggcggcagcgcaaaagatg

SEQ ID NO: 197587 - DNA, 103 bp, Artificial Sequence
  Synthetic Polynucleotide
taatacgactcactatagggggttggtgaacacagtgatggtcagggtgaaacagaggagatcacccatgccatcactgaacctggcggcagcgcaaaagatg

SEQ ID NO: 197588 - DNA, 103 bp, Artificial Sequence
  Synthetic Polynucleotide
taatacgactcactatagggacttgggtggggttggtgaacacagtgatgaacagaggagacatcacatggttcaccaaaacctggcggcagcgcaaaagatg

SEQ ID NO: 197589 - DNA, 103 bp, Artificial Sequence
  Synthetic Polynucleotide
taatacgactcactataggggtaggtcgccacttgggtggggttggtgaaaacagaggagattcaccatgcccacccaaaacctggcggcagcgcaaaagatg

SEQ ID NO: 197590 - DNA, 103 bp, Artificial Sequence
  Synthetic Polynucleotide
taatacgactcactatagggtggctcggtggtaggtcgccacttgggtggaacagaggagaccacccatgtggcgacctaacctggcggcagcgcaaaagatg

SEQ ID NO: 197591 - DNA, 103 bp, Artificial Sequence
  Synthetic Polynucleotide
taatacgactcactataggggtcaccttgatggctcggtggtaggtcgccaacagaggagaggcgacatgccaccgagcaacctggcggcagcgcaaaagatg

SEQ ID NO: 197592 - DNA, 103 bp, Artificial Sequence
  Synthetic Polynucleotide
taatacgactcactatagggtccgtccacggtcaccttgatggctcggtgaacagaggagacaccgaatgatcaaggtgaacctggcggcagcgcaaaagatg

SEQ ID NO: 197593 - DNA, 103 bp, Artificial Sequence
  Synthetic Polynucleotide
taatacgactcactataggggctcccggggtccgtccacggtcaccttgaaacagaggagatcaaggatgccgtggacgaacctggcggcagcgcaaaagatg

SEQ ID NO: 197594 - DNA, 103 bp, Artificial Sequence
  Synthetic Polynucleotide
taatacgactcactatagggtgccgtctgggctcccggggtccgtccacgaacagaggagacgtggaatgaccccgggaaacctggcggcagcgcaaaagatg

SEQ ID NO: 197595 - DNA, 103 bp, Artificial Sequence
  Synthetic Polynucleotide
taatacgactcactatagggcttctgccggtgccgtctgggctcccggggaacagaggagaccccggatgcccagacggaacctggcggcagcgcaaaagatg

SEQ ID NO: 197596 - DNA, 103 bp, Artificial Sequence
  Synthetic Polynucleotide
taatacgactcactatagggggtcctccagcttctgccggtgccgtctggaacagaggagaccagacatgaccggcagaaacctggcggcagcgcaaaagatg

SEQ ID NO: 197597 - DNA, 103 bp, Artificial Sequence
  Synthetic Polynucleotide
taatacgactcactatagggaagcggcggctggtgcttgggtcgcggatgaacagaggagacatccgatgcccaagcacaacctggcggcagcgcaaaagatg

SEQ ID NO: 197598 - DNA, 103 bp, Artificial Sequence
  Synthetic Polynucleotide
taatacgactcactatagggggcttggtctggtcctccagcttctgccggaacagaggagaccggcaatggctggaggaaacctggcggcagcgcaaaagatg

SEQ ID NO: 197599 - DNA, 103 bp, Artificial Sequence
  Synthetic Polynucleotide
taatacgactcactataggggtcagggaacggcttggtctggtcctccagaacagaggagactggagatgcagaccaagaacctggcggcagcgcaaaagatg

SEQ ID NO: 197600 - DNA, 103 bp, Artificial Sequence
  Synthetic Polynucleotide
taatacgactcactatagggccccaaagcggtcagggaacggcttggtctaacagaggagaagaccaatgcgttccctgaacctggcggcagcgcaaaagatg

SEQ ID NO: 197601 - DNA, 103 bp, Artificial Sequence
  Synthetic Polynucleotide
taatacgactcactatagggcgttccaggtccccaaagcggtcagggaacaacagaggagagttcccatgccgctttggaacctggcggcagcgcaaaagatg

SEQ ID NO: 197602 - DNA, 103 bp, Artificial Sequence
  Synthetic Polynucleotide
taatacgactcactatagggcatgcgcagccgttccaggtccccaaagcgaacagaggagacgctttatggacctggaaaacctggcggcagcgcaaaagatg

SEQ ID NO: 197603 - DNA, 103 bp, Artificial Sequence
  Synthetic Polynucleotide
taatacgactcactataggggtgtcacccgcatgcgcagccgttccaggtaacagaggagaacctggatgggctgcgcaaacctggcggcagcgcaaaagatg

SEQ ID NO: 197604 - DNA, 103 bp, Artificial Sequence
  Synthetic Polynucleotide
taatacgactcactatagggggtgtgctcggtgtcacccgcatgcgcagcaacagaggagagctgcgatggcgggtgacaacctggcggcagcgcaaaagatg

SEQ ID NO: 197605 - DNA, 103 bp, Artificial Sequence
  Synthetic Polynucleotide
taatacgactcactatagggtcgggggctgggtgtgctcggtgtcacccgaacagaggagacgggtgatgccgagcacaaacctggcggcagcgcaaaagatg

SEQ ID NO: 197606 - DNA, 103 bp, Artificial Sequence
  Synthetic Polynucleotide
taatacgactcactatagggtgagtgagcctcgggggctgggtgtgctcgaacagaggagacgagcaatgccagcccccaacctggcggcagcgcaaaagatg

SEQ ID NO: 197607 - DNA, 103 bp, Artificial Sequence
  Synthetic Polynucleotide
taatacgactcactatagggcttgtggtgctgagtgagcctcgggggctgaacagaggagacagcccatgaggctcactaacctggcggcagcgcaaaagatg

SEQ ID NO: 197608 - DNA, 103 bp, Artificial Sequence
  Synthetic Polynucleotide
taatacgactcactataggggggaggtgtgaagcggcggctggtgcttggaacagaggagaccaagcatgagccgccgcaacctggcggcagcgcaaaagatg

SEQ ID NO: 197609 - DNA, 103 bp, Artificial Sequence
  Synthetic Polynucleotide
taatacgactcactataggggctgaagtggcttgtggtgctgagtgagccaacagaggagaggctcaatgagcaccacaaacctggcggcagcgcaaaagatg

SEQ ID NO: 197610 - DNA, 103 bp, Artificial Sequence
  Synthetic Polynucleotide
taatacgactcactatagggggggctggctgctgaagtggcttgtggtgcaacagaggagagcaccaatggccacttcaaacctggcggcagcgcaaaagatg

SEQ ID NO: 197611 - DNA, 103 bp, Artificial Sequence
  Synthetic Polynucleotide
taatacgactcactatagggattggggtctggggctggctgctgaagtggaacagaggagaccacttatgcagccagccaacctggcggcagcgcaaaagatg

SEQ ID NO: 197612 - DNA, 103 bp, Artificial Sequence
  Synthetic Polynucleotide
taatacgactcactatagggggtgccttggattggggtctggggctggctaacagaggagaagccagatgcagaccccaaacctggcggcagcgcaaaagatg

SEQ ID NO: 197613 - DNA, 103 bp, Artificial Sequence
  Synthetic Polynucleotide
taatacgactcactatagggtcagttccgaggtgccttggattggggtctaacagaggagaagacccatgtccaaggcaaacctggcggcagcgcaaaagatg

SEQ ID NO: 197614 - DNA, 103 bp, Artificial Sequence
  Synthetic Polynucleotide
taatacgactcactataggggagaatgggttcagttccgaggtgccttggaacagaggagaccaaggatgctcggaactaacctggcggcagcgcaaaagatg

SEQ ID NO: 197615 - DNA, 103 bp, Artificial Sequence
  Synthetic Polynucleotide
taatacgactcactataggggcgggggtcggagaatgggttcagttccgaaacagaggagatcggaaatgaacccattcaacctggcggcagcgcaaaagatg

SEQ ID NO: 197616 - DNA, 103 bp, Artificial Sequence
  Synthetic Polynucleotide
taatacgactcactatagggggtcaaactggcgggggtcggagaatgggtaacagaggagaacccatatgccgacccccaacctggcggcagcgcaaaagatg

SEQ ID NO: 197617 - DNA, 103 bp, Artificial Sequence
  Synthetic Polynucleotide
taatacgactcactataggggggaaggagcggtcaaactggcgggggtcgaacagaggagacgacccatgccagtttgaaacctggcggcagcgcaaaagatg

SEQ ID NO: 197618 - DNA, 103 bp, Artificial Sequence
  Synthetic Polynucleotide
taatacgactcactatagggtggcagcgtggggaaggagcggtcaaactgaacagaggagacagtttatgcgctccttcaacctggcggcagcgcaaaagatg

SEQ ID NO: 197619 - DNA, 103 bp, Artificial Sequence
  Synthetic Polynucleotide
taatacgactcactatagggaggccggggagggaggtgtgaagcggcggcaacagaggagagccgccatgtcacacctcaacctggcggcagcgcaaaagatg

SEQ ID NO: 197620 - DNA, 103 bp, Artificial Sequence
  Synthetic Polynucleotide
taatacgactcactatagggccgtgagggttggcagcgtggggaaggagcaacagaggagagctcctatgccacgctgcaacctggcggcagcgcaaaagatg

SEQ ID NO: 197621 - DNA, 103 bp, Artificial Sequence
  Synthetic Polynucleotide
taatacgactcactatagggaagcggctctccgtgagggttggcagcgtgaacagaggagacacgctatgaaccctcacaacctggcggcagcgcaaaagatg

SEQ ID NO: 197622 - DNA, 103 bp, Artificial Sequence
  Synthetic Polynucleotide
taatacgactcactatagggggggtctgggaagcggctctccgtgagggtaacagaggagaaccctcatggagagccgcaacctggcggcagcgcaaaagatg

SEQ ID NO: 197623 - DNA, 103 bp, Artificial Sequence
  Synthetic Polynucleotide
taatacgactcactatagggaatgcatcctggggtctgggaagcggctctaacagaggagaagagccatgtcccagaccaacctggcggcagcgcaaaagatg

SEQ ID NO: 197624 - DNA, 103 bp, Artificial Sequence
  Synthetic Polynucleotide
taatacgactcactataggggccccgggataatgcatcctggggtctgggaacagaggagacccagaatgcaggatgcaaacctggcggcagcgcaaaagatg

SEQ ID NO: 197625 - DNA, 103 bp, Artificial Sequence
  Synthetic Polynucleotide
taatacgactcactatagggagctgacatggccccgggataatgcatcctaacagaggagaaggatgatgtatcccgggaacctggcggcagcgcaaaagatg

SEQ ID NO: 197626 - DNA, 103 bp, Artificial Sequence
  Synthetic Polynucleotide
taatacgactcactatagggaggggaaggcagctgacatggccccgggataacagaggagaatcccgatgccatgtcagaacctggcggcagcgcaaaagatg

SEQ ID NO: 197627 - DNA, 103 bp, Artificial Sequence
  Synthetic Polynucleotide
taatacgactcactataggggtggcgctgtaggggaaggcagctgacatgaacagaggagacatgtcatgtgccttcccaacctggcggcagcgcaaaagatg

SEQ ID NO: 197628 - DNA, 103 bp, Artificial Sequence
  Synthetic Polynucleotide
taatacgactcactataggggcccgagggcgtggcgctgtaggggaaggcaacagaggagagccttcatgtacagcgccaacctggcggcagcgcaaaagatg

SEQ ID NO: 197629 - DNA, 103 bp, Artificial Sequence
  Synthetic Polynucleotide
taatacgactcactatagggtgatgctcgtgcccgagggcgtggcgctgtaacagaggagaacagcgatgcgccctcggaacctggcggcagcgcaaaagatg

SEQ ID NO: 197630 - DNA, 103 bp, Artificial Sequence
  Synthetic Polynucleotide
taatacgactcactatagggccgcaggggaaggccggggagggaggtgtgaacagaggagacacaccatgctccccggcaacctggcggcagcgcaaaagatg

SEQ ID NO: 197631 - DNA, 103 bp, Artificial Sequence
  Synthetic Polynucleotide
taatacgactcactatagggctgaggctgctgatgctcgtgcccgagggcaacagaggagagccctcatgcacgagcataacctggcggcagcgcaaaagatg

SEQ ID NO: 197632 - DNA, 103 bp, Artificial Sequence
  Synthetic Polynucleotide
taatacgactcactataggggcccgccacgctgaggctgctgatgctcgtaacagaggagaacgagcatgagcagcctcaacctggcggcagcgcaaaagatg

SEQ ID NO: 197633 - DNA, 103 bp, Artificial Sequence
  Synthetic Polynucleotide
taatacgactcactatagggtggccggcatgcccgccacgctgaggctgcaacagaggagagcagccatggcgtggcggaacctggcggcagcgcaaaagatg

SEQ ID NO: 197634 - DNA, 103 bp, Artificial Sequence
  Synthetic Polynucleotide
taatacgactcactatagggaagcggctggtggccggcatgcccgccacgaacagaggagacgtggcatgcatgccggcaacctggcggcagcgcaaaagatg

SEQ ID NO: 197635 - DNA, 103 bp, Artificial Sequence
  Synthetic Polynucleotide
taatacgactcactatagggggtatggtggaagcggctggtggccggcataacagaggagaatgccgatgaccagccgcaacctggcggcagcgcaaaagatg

SEQ ID NO: 197636 - DNA, 103 bp, Artificial Sequence
  Synthetic Polynucleotide
taatacgactcactataggggcgggaggtaggtatggtggaagcggctggaacagaggagaccagccatgtccaccataaacctggcggcagcgcaaaagatg

SEQ ID NO: 197637 - DNA, 103 bp, Artificial Sequence
  Synthetic Polynucleotide
taatacgactcactataggggggtagggtggcgggaggtaggtatggtggaacagaggagaccaccaatgctacctcccaacctggcggcagcgcaaaagatg

SEQ ID NO: 197638 - DNA, 103 bp, Artificial Sequence
  Synthetic Polynucleotide
taatacgactcactatagggcggggcccccgggtagggtggcgggaggtaaacagaggagatacctcatgccaccctacaacctggcggcagcgcaaaagatg

SEQ ID NO: 197639 - DNA, 103 bp, Artificial Sequence
  Synthetic Polynucleotide
taatacgactcactatagggtctggttctgcggggcccccgggtagggtgaacagaggagacaccctatgcgggggcccaacctggcggcagcgcaaaagatg

SEQ ID NO: 197640 - DNA, 103 bp, Artificial Sequence
  Synthetic Polynucleotide
taatacgactcactatagggaagggcccgctctggttctgcggggcccccaacagaggagagggggcatggcagaaccaaacctggcggcagcgcaaaagatg

SEQ ID NO: 197641 - DNA, 103 bp, Artificial Sequence
  Synthetic Polynucleotide
taatacgactcactataggggactttggttgtggctgtaacggttgccataacagaggagaatggcaatggttacagccaacctggcggcagcgcaaaagatg

SEQ ID NO: 197642 - DNA, 103 bp, Artificial Sequence
  Synthetic Polynucleotide
taatacgactcactatagggccgaggctccaaggcatcgtccagccccagaacagaggagactggggatggacgatgccaacctggcggcagcgcaaaagatg

SEQ ID NO: 197643 - DNA, 103 bp, Artificial Sequence
  Synthetic Polynucleotide
taatacgactcactataggggtagctggtgccccggattcgcgtgatgccaacagaggagaggcatcatgcgaatccggaacctggcggcagcgcaaaagatg

SEQ ID NO: 197644 - DNA, 103 bp, Artificial Sequence
  Synthetic Polynucleotide
taatacgactcactataggggagggctctggtagctggtgccccggattcaacagaggagagaatccatggcaccagctaacctggcggcagcgcaaaagatg

SEQ ID NO: 197645 - DNA, 103 bp, Artificial Sequence
  Synthetic Polynucleotide
taatacgactcactataggggggatgccgtgagggctctggtagctggtgaacagaggagacaccagatgccagagcccaacctggcggcagcgcaaaagatg

SEQ ID NO: 197646 - DNA, 103 bp, Artificial Sequence
  Synthetic Polynucleotide
taatacgactcactatagggcaggtctatggggatgccgtgagggctctgaacagaggagacagagcatgcacggcatcaacctggcggcagcgcaaaagatg

SEQ ID NO: 197647 - DNA, 103 bp, Artificial Sequence
  Synthetic Polynucleotide
taatacgactcactataggggccggtccagcaggtctatggggatgccgtaacagaggagaacggcaatgccatagaccaacctggcggcagcgcaaaagatg

SEQ ID NO: 197648 - DNA, 103 bp, Artificial Sequence
  Synthetic Polynucleotide
taatacgactcactatagggacgataagcagccggtccagcaggtctatgaacagaggagacatagaatggctggaccgaacctggcggcagcgcaaaagatg

SEQ ID NO: 197649 - DNA, 103 bp, Artificial Sequence
  Synthetic Polynucleotide
taatacgactcactatagggggtggtggagacgataagcagccggtccagaacagaggagactggacatgctgcttatcaacctggcggcagcgcaaaagatg

SEQ ID NO: 197650 - DNA, 103 bp, Artificial Sequence
  Synthetic Polynucleotide
taatacgactcactatagggcgctgtagggggtggtggagacgataagcaaacagaggagatgcttaatgtctccaccaaacctggcggcagcgcaaaagatg

SEQ ID NO: 197651 - DNA, 103 bp, Artificial Sequence
  Synthetic Polynucleotide
taatacgactcactataggggtgtctttctcgctgtagggggtggtggagaacagaggagactccacatgcccctacagaacctggcggcagcgcaaaagatg

SEQ ID NO: 197652 - DNA, 103 bp, Artificial Sequence
  Synthetic Polynucleotide
taatacgactcactataggggatctgcttcgtgtctttctcgctgtagggaacagaggagaccctacatggagaaagacaacctggcggcagcgcaaaagatg

SEQ ID NO: 197653 - DNA, 103 bp, Artificial Sequence
  Synthetic Polynucleotide
taatacgactcactataggggcgaagcctgccgaggctccaaggcatcgtaacagaggagaacgatgatgtggagcctcaacctggcggcagcgcaaaagatg

SEQ ID NO: 197654 - DNA, 103 bp, Artificial Sequence
  Synthetic Polynucleotide
taatacgactcactatagggggatgcggaggatctgcttcgtgtctttctaacagaggagaagaaagatgcgaagcagaaacctggcggcagcgcaaaagatg

SEQ ID NO: 197655 - DNA, 103 bp, Artificial Sequence
  Synthetic Polynucleotide
taatacgactcactatagggtcctcgcaccggatgcggaggatctgcttcaacagaggagagaagcaatgcctccgcataacctggcggcagcgcaaaagatg

SEQ ID NO: 197656 - DNA, 103 bp, Artificial Sequence
  Synthetic Polynucleotide
taatacgactcactatagggcacatcttcttcctcgcaccggatgcggagaacagaggagactccgcatgcggtgcgagaacctggcggcagcgcaaaagatg

SEQ ID NO: 197657 - DNA, 103 bp, Artificial Sequence
  Synthetic Polynucleotide
taatacgactcactatagggcactcatctccacatcttcttcctcgcaccaacagaggagaggtgcgatgaagaagatgaacctggcggcagcgcaaaagatg

SEQ ID NO: 197658 - DNA, 103 bp, Artificial Sequence
  Synthetic Polynucleotide
taatacgactcactatagggtaggcgtcctcactcatctccacatcttctaacagaggagaagaagaatgggagatgagaacctggcggcagcgcaaaagatg

SEQ ID NO: 197659 - DNA, 103 bp, Artificial Sequence
  Synthetic Polynucleotide
taatacgactcactatagggcagcaccgtgtaggcgtcctcactcatctcaacagaggagagagatgatggaggacgccaacctggcggcagcgcaaaagatg

SEQ ID NO: 197660 - DNA, 103 bp, Artificial Sequence
  Synthetic Polynucleotide
taatacgactcactatagggcgatgcgggtcagcaccgtgtaggcgtcctaacagaggagaaggacgatgacacggtgcaacctggcggcagcgcaaaagatg

SEQ ID NO: 197661 - DNA, 103 bp, Artificial Sequence
  Synthetic Polynucleotide
taatacgactcactataggggtctccagcccgatgcgggtcagcaccgtgaacagaggagacacggtatggacccgcataacctggcggcagcgcaaaagatg

SEQ ID NO: 197662 - DNA, 103 bp, Artificial Sequence
  Synthetic Polynucleotide
taatacgactcactataggggcgcagtgacgtctccagcccgatgcgggtaacagaggagaacccgcatggggctggagaacctggcggcagcgcaaaagatg

SEQ ID NO: 197663 - DNA, 103 bp, Artificial Sequence
  Synthetic Polynucleotide
taatacgactcactatagggggatggcgtagcgcagtgacgtctccagccaacagaggagaggctggatgcgtcactgcaacctggcggcagcgcaaaagatg

SEQ ID NO: 197664 - DNA, 103 bp, Artificial Sequence
  Synthetic Polynucleotide
taatacgactcactatagggaccatgccttgcgaagcctgccgaggctccaacagaggagaggagccatggcaggcttcaacctggcggcagcgcaaaagatg

SEQ ID NO: 197665 - DNA, 103 bp, Artificial Sequence
  Synthetic Polynucleotide
taatacgactcactataggggtgatgagctggatggcgtagcgcagtgacaacagaggagagtcactatgctacgccataacctggcggcagcgcaaaagatg

SEQ ID NO: 197666 - DNA, 103 bp, Artificial Sequence
  Synthetic Polynucleotide
taatacgactcactataggggctggcagctgtgatgagctggatggcgtaaacagaggagatacgccatgcagctcatcaacctggcggcagcgcaaaagatg

SEQ ID NO: 197667 - DNA, 103 bp, Artificial Sequence
  Synthetic Polynucleotide
taatacgactcactatagggggcacaccaagctggcagctgtgatgagctaacagaggagaagctcaatgcagctgccaaacctggcggcagcgcaaaagatg

SEQ ID NO: 197668 - DNA, 103 bp, Artificial Sequence
  Synthetic Polynucleotide
taatacgactcactatagggttgcgtttccggcacaccaagctggcagctaacagaggagaagctgcatgcttggtgtgaacctggcggcagcgcaaaagatg

SEQ ID NO: 197669 - DNA, 103 bp, Artificial Sequence
  Synthetic Polynucleotide
taatacgactcactatagggttctgtacccttgcgtttccggcacaccaaaacagaggagattggtgatgcggaaacgcaacctggcggcagcgcaaaagatg

SEQ ID NO: 197670 - DNA, 103 bp, Artificial Sequence
  Synthetic Polynucleotide
taatacgactcactatagggccacctgcacttctgtacccttgcgtttccaacagaggagaggaaacatgagggtacagaacctggcggcagcgcaaaagatg

SEQ ID NO: 197671 - DNA, 103 bp, Artificial Sequence
  Synthetic Polynucleotide
taatacgactcactatagggttgatgtcatccacctgcacttctgtacccaacagaggagagggtacatgagtgcaggtaacctggcggcagcgcaaaagatg

SEQ ID NO: 197672 - DNA, 103 bp, Artificial Sequence
  Synthetic Polynucleotide
taatacgactcactataggggtagacccgcttgatgtcatccacctgcacaacagaggagagtgcagatggatgacatcaacctggcggcagcgcaaaagatg

SEQ ID NO: 197673 - DNA, 103 bp, Artificial Sequence
  Synthetic Polynucleotide
taatacgactcactatagggggaagagtgagtagacccgcttgatgtcataacagaggagaatgacaatgagcgggtctaacctggcggcagcgcaaaagatg

SEQ ID NO: 197674 - DNA, 103 bp, Artificial Sequence
  Synthetic Polynucleotide
taatacgactcactataggggactcgtccaggaagagtgagtagacccgcaacagaggagagcgggtatgctcactcttaacctggcggcagcgcaaaagatg

SEQ ID NO: 197675 - DNA, 103 bp, Artificial Sequence
  Synthetic Polynucleotide
taatacgactcactatagggcagctgacccaccatgccttgcgaagcctgaacagaggagacaggctatgcaaggcatgaacctggcggcagcgcaaaagatg

SEQ ID NO: 197676 - DNA, 103 bp, Artificial Sequence
  Synthetic Polynucleotide
taatacgactcactatagggcgtggagcgggactcgtccaggaagagtgaaacagaggagatcactcatgctggacgagaacctggcggcagcgcaaaagatg

SEQ ID NO: 197677 - DNA, 103 bp, Artificial Sequence
  Synthetic Polynucleotide
taatacgactcactatagggtcatgtactgcgtggagcgggactcgtccaaacagaggagatggacgatgcccgctccaaacctggcggcagcgcaaaagatg

SEQ ID NO: 197678 - DNA, 103 bp, Artificial Sequence
  Synthetic Polynucleotide
taatacgactcactatagggtggtactccttcatgtactgcgtggagcggaacagaggagaccgctcatggcagtacataacctggcggcagcgcaaaagatg

SEQ ID NO: 197679 - DNA, 103 bp, Artificial Sequence
  Synthetic Polynucleotide
taatacgactcactataggggaaggcgtcctggtactccttcatgtactgaacagaggagacagtacatgaaggagtacaacctggcggcagcgcaaaagatg

SEQ ID NO: 197680 - DNA, 103 bp, Artificial Sequence
  Synthetic Polynucleotide
taatacgactcactatagggcgttgaagaggaaggcgtcctggtactcctaacagaggagaaggagtatgaggacgcctaacctggcggcagcgcaaaagatg

SEQ ID NO: 197681 - DNA, 103 bp, Artificial Sequence
  Synthetic Polynucleotide
taatacgactcactatagggcctttgagttcgttgaagaggaaggcgtccaacagaggagaggacgcatgcctcttcaaaacctggcggcagcgcaaaagatg

SEQ ID NO: 197682 - DNA, 103 bp, Artificial Sequence
  Synthetic Polynucleotide
taatacgactcactatagggcatggtctcgcctttgagttcgttgaagagaacagaggagactcttcatggaactcaaaaacctggcggcagcgcaaaagatg

SEQ ID NO: 197683 - DNA, 103 bp, Artificial Sequence
  Synthetic Polynucleotide
taatacgactcactatagggaggaggtgtccatggtctcgcctttgagttaacagaggagaaactcaatggcgagaccaaacctggcggcagcgcaaaagatg

SEQ ID NO: 197684 - DNA, 103 bp, Artificial Sequence
  Synthetic Polynucleotide
taatacgactcactataggggccgtgccgccagctgacccaccatgccttaacagaggagaaaggcaatgtgggtcagcaacctggcggcagcgcaaaagatg

SEQ ID NO: 197685 - DNA, 103 bp, Artificial Sequence
  Synthetic Polynucleotide
taatacgactcactatagggccagccgcccgccgtgccgccagctgacccaacagaggagagggtcaatgggcggcacgaacctggcggcagcgcaaaagatg

SEQ ID NO: 197686 - DNA, 103 bp, Artificial Sequence
  Synthetic Polynucleotide
taatacgactcactatagggcagcaccacgccagccgcccgccgtgccgcaacagaggagagcggcaatgcgggcggctaacctggcggcagcgcaaaagatg

SEQ ID NO: 197687 - DNA, 103 bp, Artificial Sequence
  Synthetic Polynucleotide
taatacgactcactatagggggatcatctccagcaccacgccagccgcccaacagaggagagggcggatggcgtggtgcaacctggcggcagcgcaaaagatg

SEQ ID NO: 197688 - DNA, 103 bp, Artificial Sequence
  Synthetic Polynucleotide
taatacgactcactatagggttcccttcccggatcatctccagcaccacgaacagaggagacgtggtatgggagatgataacctggcggcagcgcaaaagatg

SEQ ID NO: 197689 - DNA, 103 bp, Artificial Sequence
  Synthetic Polynucleotide
taatacgactcactatagggaccggcaatcttcccttcccggatcatctcaacagaggagagagatgatgcgggaagggaacctggcggcagcgcaaaagatg

SEQ ID NO: 197690 - DNA, 103 bp, Artificial Sequence
  Synthetic Polynucleotide
taatacgactcactatagggggatctccgggactttggttgtggctgtaaaacagaggagattacagatgcaaccaaagaacctggcggcagcgcaaaagatg

SEQ ID NO: 197691 - DNA, 103 bp, Artificial Sequence
  Synthetic Polynucleotide
taatacgactcactatagggggactgcccgaccggcaatcttcccttcccaacagaggagagggaagatgagattgccgaacctggcggcagcgcaaaagatg

SEQ ID NO: 197692 - DNA, 103 bp, Artificial Sequence
  Synthetic Polynucleotide
taatacgactcactatagggccagcaataaggactgcccgaccggcaatcaacagaggagagattgcatgtcgggcagtaacctggcggcagcgcaaaagatg

SEQ ID NO: 197693 - DNA, 103 bp, Artificial Sequence
  Synthetic Polynucleotide
taatacgactcactataggggcccggctggccagcaataaggactgcccgaacagaggagacgggcaatgcttattgctaacctggcggcagcgcaaaagatg

SEQ ID NO: 197694 - DNA, 103 bp, Artificial Sequence
  Synthetic Polynucleotide
taatacgactcactatagggtcttccccgtgcccggctggccagcaataaaacagaggagattattgatggccagccggaacctggcggcagcgcaaaagatg

SEQ ID NO: 197695 - DNA, 103 bp, Artificial Sequence
  Synthetic Polynucleotide
taatacgactcactataggggcgatggccgtcttccccgtgcccggctggaacagaggagaccagccatgcacggggaaaacctggcggcagcgcaaaagatg

SEQ ID NO: 197696 - DNA, 103 bp, Artificial Sequence
  Synthetic Polynucleotide
taatacgactcactatagggcatgcccatggcgatggccgtcttccccgtaacagaggagaacggggatgacggccatcaacctggcggcagcgcaaaagatg

SEQ ID NO: 197697 - DNA, 103 bp, Artificial Sequence
  Synthetic Polynucleotide
taatacgactcactataggggggcctgcgccatgcccatggcgatggccgaacagaggagacggccaatgccatgggcaaacctggcggcagcgcaaaagatg

SEQ ID NO: 197698 - DNA, 103 bp, Artificial Sequence
  Synthetic Polynucleotide
taatacgactcactatagggtcagggcccagggcctgcgccatgcccatgaacagaggagacatgggatgggcgcaggcaacctggcggcagcgcaaaagatg

SEQ ID NO: 197699 - DNA, 103 bp, Artificial Sequence
  Synthetic Polynucleotide
taatacgactcactataggggaatggcgtgtcagggcccagggcctgcgcaacagaggagagcgcagatgctgggccctaacctggcggcagcgcaaaagatg

SEQ ID NO: 197700 - DNA, 103 bp, Artificial Sequence
  Synthetic Polynucleotide
taatacgactcactatagggcgatggctgtgaatggcgtgtcagggcccaaacagaggagatgggccatgacacgccataacctggcggcagcgcaaaagatg

SEQ ID NO: 197701 - DNA, 103 bp, Artificial Sequence
  Synthetic Polynucleotide
taatacgactcactataggggttacatcacggatctccgggactttggttaacagaggagaaaccaaatgcccggagataacctggcggcagcgcaaaagatg

SEQ ID NO: 197702 - DNA, 103 bp, Artificial Sequence
  Synthetic Polynucleotide
taatacgactcactatagggtcactgccggcgatggctgtgaatggcgtgaacagaggagacacgccatgcacagccataacctggcggcagcgcaaaagatg

SEQ ID NO: 197703 - DNA, 103 bp, Artificial Sequence
  Synthetic Polynucleotide
taatacgactcactatagggggagaagatttcactgccggcgatggctgtaacagaggagaacagccatggccggcagtaacctggcggcagcgcaaaagatg

SEQ ID NO: 197704 - DNA, 103 bp, Artificial Sequence
  Synthetic Polynucleotide
taatacgactcactatagggtcatctccagggagaagatttcactgccggaacagaggagaccggcaatgaaatcttctaacctggcggcagcgcaaaagatg

SEQ ID NO: 197705 - DNA, 103 bp, Artificial Sequence
  Synthetic Polynucleotide
taatacgactcactatagggtcggtcttgctcatctccagggagaagattaacagaggagaaatcttatgcctggagataacctggcggcagcgcaaaagatg

SEQ ID NO: 197706 - DNA, 103 bp, Artificial Sequence
  Synthetic Polynucleotide
taatacgactcactatagggcgtcagcgcctcggtcttgctcatctccagaacagaggagactggagatgagcaagaccaacctggcggcagcgcaaaagatg

SEQ ID NO: 197707 - DNA, 103 bp, Artificial Sequence
  Synthetic Polynucleotide
taatacgactcactatagggggaaggcctgcgtcagcgcctcggtcttgcaacagaggagagcaagaatgaggcgctgaaacctggcggcagcgcaaaagatg

SEQ ID NO: 197708 - DNA, 103 bp, Artificial Sequence
  Synthetic Polynucleotide
taatacgactcactatagggatggaccgccggaaggcctgcgtcagcgccaacagaggagaggcgctatggcaggccttaacctggcggcagcgcaaaagatg

SEQ ID NO: 197709 - DNA, 103 bp, Artificial Sequence
  Synthetic Polynucleotide
taatacgactcactataggggcgaacgccgatggaccgccggaaggcctgaacagaggagacaggccatgcggcggtccaacctggcggcagcgcaaaagatg

SEQ ID NO: 197710 - DNA, 103 bp, Artificial Sequence
  Synthetic Polynucleotide
taatacgactcactatagggcctccttgatgcgaacgccgatggaccgccaacagaggagaggcggtatgtcggcgttcaacctggcggcagcgcaaaagatg

SEQ ID NO: 197711 - DNA, 103 bp, Artificial Sequence
  Synthetic Polynucleotide
taatacgactcactatagggatctccgtctcctccttgatgcgaacgccgaacagaggagacggcgtatgcatcaaggaaacctggcggcagcgcaaaagatg

SEQ ID NO: 197712 - DNA, 103 bp, Artificial Sequence
  Synthetic Polynucleotide
taatacgactcactatagggctcaatccttgttacatcacggatctccggaacagaggagaccggagatgcgtgatgtaaacctggcggcagcgcaaaagatg

SEQ ID NO: 197713 - DNA, 103 bp, Artificial Sequence
  Synthetic Polynucleotide
taatacgactcactatagggcccttcgatgatctccgtctcctccttgataacagaggagaatcaagatggagacggagaacctggcggcagcgcaaaagatg

SEQ ID NO: 197714 - DNA, 103 bp, Artificial Sequence
  Synthetic Polynucleotide
taatacgactcactatagggccaccacctccccttcgatgatctccgtctaacagaggagaagacggatgtcatcgaagaacctggcggcagcgcaaaagatg

SEQ ID NO: 197715 - DNA, 103 bp, Artificial Sequence
  Synthetic Polynucleotide
taatacgactcactatagggatctggatctccaccacctccccttcgatgaacagaggagacatcgaatgggaggtggtaacctggcggcagcgcaaaagatg

SEQ ID NO: 197716 - DNA, 103 bp, Artificial Sequence
  Synthetic Polynucleotide
taatacgactcactatagggtggtcgatcaatctggatctccaccacctcaacagaggagagaggtgatggagatccagaacctggcggcagcgcaaaagatg

SEQ ID NO: 197717 - DNA, 103 bp, Artificial Sequence
  Synthetic Polynucleotide
taatacgactcactatagggtccctgttgctggtcgatcaatctggatctaacagaggagaagatccatgttgatcgacaacctggcggcagcgcaaaagatg

SEQ ID NO: 197718 - DNA, 103 bp, Artificial Sequence
  Synthetic Polynucleotide
taatacgactcactatagggttggagcccgtccctgttgctggtcgatcaaacagaggagatgatcgatgagcaacaggaacctggcggcagcgcaaaagatg

SEQ ID NO: 197719 - DNA, 103 bp, Artificial Sequence
  Synthetic Polynucleotide
taatacgactcactatagggtttgcccaccttggagcccgtccctgttgcaacagaggagagcaacaatgacgggctccaacctggcggcagcgcaaaagatg

SEQ ID NO: 197720 - DNA, 103 bp, Artificial Sequence
  Synthetic Polynucleotide
taatacgactcactatagggtgagggtcagtttgcccaccttggagcccgaacagaggagacgggctatgaggtgggcaaacctggcggcagcgcaaaagatg

SEQ ID NO: 197721 - DNA, 103 bp, Artificial Sequence
  Synthetic Polynucleotide
taatacgactcactatagggtctgtggtcttgagggtcagtttgcccaccaacagaggagaggtgggatgactgaccctaacctggcggcagcgcaaaagatg

SEQ ID NO: 197722 - DNA, 103 bp, Artificial Sequence
  Synthetic Polynucleotide
taatacgactcactatagggggtctccatctctgtggtcttgagggtcagaacagaggagactgaccatgaagaccacaaacctggcggcagcgcaaaagatg

SEQ ID NO: 197723 - DNA, 103 bp, Artificial Sequence
  Synthetic Polynucleotide
taatacgactcactatagggcaccgattcgctcaatccttgttacatcacaacagaggagagtgatgatgcaaggattgaacctggcggcagcgcaaaagatg

SEQ ID NO: 197724 - DNA, 103 bp, Artificial Sequence
  Synthetic Polynucleotide
taatacgactcactatagggggtcgtagatggtctccatctctgtggtctaacagaggagaagaccaatgagatggagaaacctggcggcagcgcaaaagatg

SEQ ID NO: 197725 - DNA, 103 bp, Artificial Sequence
  Synthetic Polynucleotide
taatacgactcactatagggttggtgcccaggtcgtagatggtctccatcaacagaggagagatggaatgcatctacgaaacctggcggcagcgcaaaagatg

SEQ ID NO: 197726 - DNA, 103 bp, Artificial Sequence
  Synthetic Polynucleotide
taatacgactcactatagggctcaatcatcttggtgcccaggtcgtagataacagaggagaatctacatgctgggcaccaacctggcggcagcgcaaaagatg

SEQ ID NO: 197727 - DNA, 103 bp, Artificial Sequence
  Synthetic Polynucleotide
taatacgactcactatagggtggtcagggactcaatcatcttggtgcccaaacagaggagatgggcaatgagatgattgaacctggcggcagcgcaaaagatg

SEQ ID NO: 197728 - DNA, 103 bp, Artificial Sequence
  Synthetic Polynucleotide
taatacgactcactatagggaccttgtccttggtcagggactcaatcatcaacagaggagagatgatatggtccctgacaacctggcggcagcgcaaaagatg

SEQ ID NO: 197729 - DNA, 103 bp, Artificial Sequence
  Synthetic Polynucleotide
taatacgactcactatagggcccggcctggaccttgtccttggtcagggaaacagaggagatccctgatgaaggacaagaacctggcggcagcgcaaaagatg

SEQ ID NO: 197730 - DNA, 103 bp, Artificial Sequence
  Synthetic Polynucleotide
taatacgactcactatagggtgatcacgtccccggcctggaccttgtcctaacagaggagaaggacaatgtccaggccgaacctggcggcagcgcaaaagatg

SEQ ID NO: 197731 - DNA, 103 bp, Artificial Sequence
  Synthetic Polynucleotide
taatacgactcactatagggttgtcgatggtgatcacgtccccggcctggaacagaggagaccaggcatgggacgtgataacctggcggcagcgcaaaagatg

SEQ ID NO: 197732 - DNA, 103 bp, Artificial Sequence
  Synthetic Polynucleotide
taatacgactcactataggggcccgtcgccttgtcgatggtgatcacgtcaacagaggagagacgtgatgaccatcgacaacctggcggcagcgcaaaagatg

SEQ ID NO: 197733 - DNA, 103 bp, Artificial Sequence
  Synthetic Polynucleotide
taatacgactcactatagggtggagatcttgcccgtcgccttgtcgatggaacagaggagaccatcgatgaggcgacggaacctggcggcagcgcaaaagatg

SEQ ID NO: 197734 - DNA, 103 bp, Artificial Sequence
  Synthetic Polynucleotide
taatacgactcactatagggtgggagtgggcaccgattcgctcaatccttaacagaggagaaaggatatggcgaatcggaacctggcggcagcgcaaaagatg

SEQ ID NO: 197735 - DNA, 103 bp, Artificial Sequence
  Synthetic Polynucleotide
taatacgactcactatagggcggcccagcttggagatcttgcccgtcgccaacagaggagaggcgacatgcaagatctcaacctggcggcagcgcaaaagatg

SEQ ID NO: 197736 - DNA, 103 bp, Artificial Sequence
  Synthetic Polynucleotide
taatacgactcactatagggtgtgaaggagcggcccagcttggagatcttaacagaggagaaagatcatgaagctgggcaacctggcggcagcgcaaaagatg

SEQ ID NO: 197737 - DNA, 103 bp, Artificial Sequence
  Synthetic Polynucleotide
taatacgactcactatagggcgcgggcgcgtgtgaaggagcggcccagctaacagaggagaagctggatggctccttcaaacctggcggcagcgcaaaagatg

SEQ ID NO: 197738 - DNA, 103 bp, Artificial Sequence
  Synthetic Polynucleotide
taatacgactcactataggggcgtcgtagtcgcgggcgcgtgtgaaggagaacagaggagactccttatgacgcgcccgaacctggcggcagcgcaaaagatg

SEQ ID NO: 197739 - DNA, 103 bp, Artificial Sequence
  Synthetic Polynucleotide
taatacgactcactatagggggagcccatagcgtcgtagtcgcgggcgcgaacagaggagacgcgccatggactacgacaacctggcggcagcgcaaaagatg

SEQ ID NO: 197740 - DNA, 103 bp, Artificial Sequence
  Synthetic Polynucleotide
taatacgactcactatagggacttggtctgggagcccatagcgtcgtagtaacagaggagaactacgatgctatgggctaacctggcggcagcgcaaaagatg

SEQ ID NO: 197741 - DNA, 103 bp, Artificial Sequence
  Synthetic Polynucleotide
taatacgactcactatagggcactgcacgaacttggtctgggagcccataaacagaggagatatgggatgccagaccaaaacctggcggcagcgcaaaagatg

SEQ ID NO: 197742 - DNA, 103 bp, Artificial Sequence
  Synthetic Polynucleotide
taatacgactcactatagggcccatctgggcactgcacgaacttggtctgaacagaggagacagaccatgttcgtgcagaacctggcggcagcgcaaaagatg

SEQ ID NO: 197743 - DNA, 103 bp, Artificial Sequence
  Synthetic Polynucleotide
taatacgactcactatagggtctggagctccccatctgggcactgcacgaaacagaggagatcgtgcatggcccagatgaacctggcggcagcgcaaaagatg

SEQ ID NO: 197744 - DNA, 103 bp, Artificial Sequence
  Synthetic Polynucleotide
taatacgactcactatagggtccttgcgtttctggagctccccatctgggaacagaggagacccagaatgggagctccaaacctggcggcagcgcaaaagatg

SEQ ID NO: 197745 - DNA, 103 bp, Artificial Sequence
  Synthetic Polynucleotide
taatacgactcactatagggtccccggatgtgggagtgggcaccgattcgaacagaggagacgaatcatggcccactccaacctggcggcagcgcaaaagatg

SEQ ID NO: 197746 - DNA, 103 bp, Artificial Sequence
  Synthetic Polynucleotide
taatacgactcactataggggtgcaccacctccttgcgtttctggagctcaacagaggagagagctcatgaaacgcaagaacctggcggcagcgcaaaagatg

SEQ ID NO: 197747 - DNA, 103 bp, Artificial Sequence
  Synthetic Polynucleotide
taatacgactcactataggggggacacggtgtgcaccacctccttgcgttaacagaggagaaacgcaatgaggtggtgcaacctggcggcagcgcaaaagatg

SEQ ID NO: 197748 - DNA, 103 bp, Artificial Sequence
  Synthetic Polynucleotide
taatacgactcactatagggatctcgtgcagggacacggtgtgcaccaccaacagaggagaggtggtatgcaccgtgtcaacctggcggcagcgcaaaagatg

SEQ ID NO: 197749 - DNA, 103 bp, Artificial Sequence
  Synthetic Polynucleotide
taatacgactcactataggggatgacgtcgatctcgtgcagggacacggtaacagaggagaaccgtgatgctgcacgagaacctggcggcagcgcaaaagatg

SEQ ID NO: 197750 - DNA, 103 bp, Artificial Sequence
  Synthetic Polynucleotide
taatacgactcactatagggtgcgagagttgatgacgtcgatctcgtgcaaacagaggagatgcacgatgtcgacgtcaaacctggcggcagcgcaaaagatg

SEQ ID NO: 197751 - DNA, 103 bp, Artificial Sequence
  Synthetic Polynucleotide
taatacgactcactatagggaagccctgggtgcgagagttgatgacgtcgaacagaggagacgacgtatgcaactctcgaacctggcggcagcgcaaaagatg

SEQ ID NO: 197752 - DNA, 103 bp, Artificial Sequence
  Synthetic Polynucleotide
taatacgactcactataggggagcgccaggaagccctgggtgcgagagttaacagaggagaaactctatgacccagggcaacctggcggcagcgcaaaagatg

SEQ ID NO: 197753 - DNA, 103 bp, Artificial Sequence
  Synthetic Polynucleotide
taatacgactcactatagggcacctgagaagagcgccaggaagccctgggaacagaggagacccaggatgtcctggcgcaacctggcggcagcgcaaaagatg

SEQ ID NO: 197754 - DNA, 103 bp, Artificial Sequence
  Synthetic Polynucleotide
taatacgactcactatagggtcccctgtgtcacctgagaagagcgccaggaacagaggagacctggcatgcttctcaggaacctggcggcagcgcaaaagatg

SEQ ID NO: 197755 - DNA, 103 bp, Artificial Sequence
  Synthetic Polynucleotide
taatacgactcactatagggtgacttgatctcccctgtgtcacctgagaaaacagaggagattctcaatggacacagggaacctggcggcagcgcaaaagatg

SEQ ID NO: 197756 - DNA, 103 bp, Artificial Sequence
  Synthetic Polynucleotide
taatacgactcactatagggccagccccagtccccggatgtgggagtgggaacagaggagacccactatgacatccgggaacctggcggcagcgcaaaagatg

SEQ ID NO: 197757 - DNA, 103 bp, Artificial Sequence
  Synthetic Polynucleotide
taatacgactcactatagggcacggacttctgacttgatctcccctgtgtaacagaggagaacacagatgagatcaagtaacctggcggcagcgcaaaagatg

SEQ ID NO: 197758 - DNA, 103 bp, Artificial Sequence
  Synthetic Polynucleotide
taatacgactcactatagggttgatctgctcacggacttctgacttgatcaacagaggagagatcaaatgagaagtccgaacctggcggcagcgcaaaagatg

SEQ ID NO: 197759 - DNA, 103 bp, Artificial Sequence
  Synthetic Polynucleotide
taatacgactcactatagggcaccttggcattgatctgctcacggacttcaacagaggagagaagtcatggagcagatcaacctggcggcagcgcaaaagatg

SEQ ID NO: 197760 - DNA, 103 bp, Artificial Sequence
  Synthetic Polynucleotide
taatacgactcactataggggccactcagccaccttggcattgatctgctaacagaggagaagcagaatgatgccaaggaacctggcggcagcgcaaaagatg

SEQ ID NO: 197761 - DNA, 103 bp, Artificial Sequence
  Synthetic Polynucleotide
taatacgactcactatagggccctcctcgcgccactcagccaccttggcaaacagaggagatgccaaatgggctgagtgaacctggcggcagcgcaaaagatg

SEQ ID NO: 197762 - DNA, 103 bp, Artificial Sequence
  Synthetic Polynucleotide
taatacgactcactatagggctccgccttgccctcctcgcgccactcagcaacagaggagagctgagatgcgcgaggagaacctggcggcagcgcaaaagatg

SEQ ID NO: 197763 - DNA, 103 bp, Artificial Sequence
  Synthetic Polynucleotide
taatacgactcactatagggcagggatgatctccgccttgccctcctcgcaacagaggagagcgaggatggcaaggcggaacctggcggcagcgcaaaagatg

SEQ ID NO: 197764 - DNA, 103 bp, Artificial Sequence
  Synthetic Polynucleotide
taatacgactcactatagggaacagcactccagggatgatctccgccttgaacagaggagacaaggcatggatcatcccaacctggcggcagcgcaaaagatg

SEQ ID NO: 197765 - DNA, 103 bp, Artificial Sequence
  Synthetic Polynucleotide
taatacgactcactatagggctcgtcgatgaacagcactccagggatgataacagaggagaatcatcatgggagtgctgaacctggcggcagcgcaaaagatg

SEQ ID NO: 197766 - DNA, 103 bp, Artificial Sequence
  Synthetic Polynucleotide
taatacgactcactataggggcatgtggacctcgtcgatgaacagcactcaacagaggagagagtgcatgtcatcgacgaacctggcggcagcgcaaaagatg

SEQ ID NO: 197767 - DNA, 103 bp, Artificial Sequence
  Synthetic Polynucleotide
taatacgactcactatagggaaggcatcgtccagccccagtccccggatgaacagaggagacatccgatgactggggctaacctggcggcagcgcaaaagatg

SEQ ID NO: 197768 - DNA, 103 bp, Artificial Sequence
  Synthetic Polynucleotide
taatacgactcactatagggtcgatgtccagcatgtggacctcgtcgatgaacagaggagacatcgaatgggtccacataacctggcggcagcgcaaaagatg

SEQ ID NO: 197769 - DNA, 103 bp, Artificial Sequence
  Synthetic Polynucleotide
taatacgactcactatagggggagaagctctcgatgtccagcatgtggacaacagaggagagtccacatgctggacatcaacctggcggcagcgcaaaagatg

SEQ ID NO: 197770 - DNA, 103 bp, Artificial Sequence
  Synthetic Polynucleotide
taatacgactcactatagggggttgaggaaggagaagctctcgatgtccaaacagaggagatggacaatgagagcttctaacctggcggcagcgcaaaagatg

SEQ ID NO: 197771 - DNA, 103 bp, Artificial Sequence
  Synthetic Polynucleotide
taatacgactcactatagggtccagggcccggttgaggaaggagaagctcaacagaggagagagcttatgcttcctcaaaacctggcggcagcgcaaaagatg

SEQ ID NO: 197772 - DNA, 103 bp, Artificial Sequence
  Synthetic Polynucleotide
taatacgactcactatagggcatgtcactctccagggcccggttgaggaaaacagaggagattcctcatgcgggccctgaacctggcggcagcgcaaaagatg

SEQ ID NO: 197773 - DNA, 103 bp, Artificial Sequence
  Synthetic Polynucleotide
taatacgactcactatagggggacaggcgccatgtcactctccagggcccaacagaggagagggcccatgagagtgacaaacctggcggcagcgcaaaagatg

SEQ ID NO: 197774 - DNA, 103 bp, Artificial Sequence
  Synthetic Polynucleotide
taatacgactcactataggggccatgatcaggacaggcgccatgtcactcaacagaggagagagtgaatgggcgcctgtaacctggcggcagcgcaaaagatg

SEQ ID NO: 197775 - DNA, 103 bp, Artificial Sequence
  Synthetic Polynucleotide
taatacgactcactatagggacggttggtggccatgatcaggacaggcgcaacagaggagagcgcctatgctgatcatgaacctggcggcagcgcaaaagatg

SEQ ID NO: 197776 - DNA, 103 bp, Artificial Sequence
  Synthetic Polynucleotide
taatacgactcactataggggcgtgatgccacggttggtggccatgatcaaacagaggagatgatcaatgccaccaaccaacctggcggcagcgcaaaagatg

SEQ ID NO: 197777 - DNA, 103 bp, Artificial Sequence
  Synthetic Polynucleotide
taatacgactcactatagggccccggattcgcgtgatgccacggttggtgaacagaggagacaccaaatgtggcatcacaacctggcggcagcgcaaaagatg

SEQ ID NO: 197778 - DNA, 103 bp, Artificial Sequence
  Synthetic Polynucleotide
taatacgactcactatagggatcgagcggcaggaaatgtttggtgtccataacagaggagaatggacatgaaacatttcaacctggcggcagcgcaaaagatg

SEQ ID NO: 197779 - DNA, 103 bp, Artificial Sequence
  Synthetic Polynucleotide
taatacgactcactataggggccaggccccagggacgggtgcagcgagggaacagaggagaccctcgatgcacccgtccaacctggcggcagcgcaaaagatg

SEQ ID NO: 197780 - DNA, 103 bp, Artificial Sequence
  Synthetic Polynucleotide
taatacgactcactatagggtgcgctgtgggcgctgttccggtggacgtgaacagaggagacacgtcatgcggaacagcaacctggcggcagcgcaaaagatg

SEQ ID NO: 197781 - DNA, 103 bp, Artificial Sequence
  Synthetic Polynucleotide
taatacgactcactatagggcgcccacccctgcgctgtgggcgctgttccaacagaggagaggaacaatgcccacagcgaacctggcggcagcgcaaaagatg

SEQ ID NO: 197782 - DNA, 103 bp, Artificial Sequence
  Synthetic Polynucleotide
taatacgactcactatagggtcaaagatggcgcccacccctgcgctgtggaacagaggagaccacagatgaggggtgggaacctggcggcagcgcaaaagatg

SEQ ID NO: 197783 - DNA, 103 bp, Artificial Sequence
  Synthetic Polynucleotide
taatacgactcactatagggcagcaccctgtcaaagatggcgcccaccccaacagaggagaggggtgatggccatctttaacctggcggcagcgcaaaagatg

SEQ ID NO: 197784 - DNA, 103 bp, Artificial Sequence
  Synthetic Polynucleotide
taatacgactcactatagggcaagctccgtcagcaccctgtcaaagatggaacagaggagaccatctatgacagggtgcaacctggcggcagcgcaaaagatg

SEQ ID NO: 197785 - DNA, 103 bp, Artificial Sequence
  Synthetic Polynucleotide
taatacgactcactatagggatcttggacacaagctccgtcagcaccctgaacagaggagacagggtatggacggagctaacctggcggcagcgcaaaagatg

SEQ ID NO: 197786 - DNA, 103 bp, Artificial Sequence
  Synthetic Polynucleotide
taatacgactcactatagggcatgtcccgcatcttggacacaagctccgtaacagaggagaacggagatggtgtccaagaacctggcggcagcgcaaaagatg

SEQ ID NO: 197787 - DNA, 103 bp, Artificial Sequence
  Synthetic Polynucleotide
taatacgactcactatagggtgtccatctgcatgtcccgcatcttggacaaacagaggagatgtccaatgtgcgggacaaacctggcggcagcgcaaaagatg

SEQ ID NO: 197788 - DNA, 103 bp, Artificial Sequence
  Synthetic Polynucleotide
taatacgactcactatagggagctccgtcttgtccatctgcatgtcccgcaacagaggagagcgggaatggcagatggaaacctggcggcagcgcaaaagatg

SEQ ID NO: 197789 - DNA, 103 bp, Artificial Sequence
  Synthetic Polynucleotide
taatacgactcactatagggcaggcagcccagctccgtcttgtccatctgaacagaggagacagatgatgaagacggagaacctggcggcagcgcaaaagatg

SEQ ID NO: 197790 - DNA, 103 bp, Artificial Sequence
  Synthetic Polynucleotide
taatacgactcactataggggggagccgatgccaggccccagggacgggtaacagaggagaacccgtatgtggggcctgaacctggcggcagcgcaaaagatg

SEQ ID NO: 197791 - DNA, 103 bp, Artificial Sequence
  Synthetic Polynucleotide
taatacgactcactatagggcgatggcgcgcaggcagcccagctccgtctaacagaggagaagacggatgtgggctgccaacctggcggcagcgcaaaagatg

SEQ ID NO: 197792 - DNA, 103 bp, Artificial Sequence
  Synthetic Polynucleotide
taatacgactcactatagggttaaagaggacgatggcgcgcaggcagcccaacagaggagagggctgatggcgcgccataacctggcggcagcgcaaaagatg

SEQ ID NO: 197793 - DNA, 103 bp, Artificial Sequence
  Synthetic Polynucleotide
taatacgactcactatagggggagtcagggttaaagaggacgatggcgcgaacagaggagacgcgccatggtcctctttaacctggcggcagcgcaaaagatg

SEQ ID NO: 197794 - DNA, 103 bp, Artificial Sequence
  Synthetic Polynucleotide
taatacgactcactatagggagagccccttggagtcagggttaaagaggaaacagaggagatcctctatgaccctgactaacctggcggcagcgcaaaagatg

SEQ ID NO: 197795 - DNA, 103 bp, Artificial Sequence
  Synthetic Polynucleotide
taatacgactcactataggggccgggttcgagagccccttggagtcagggaacagaggagaccctgaatgcaaggggctaacctggcggcagcgcaaaagatg

SEQ ID NO: 197796 - DNA, 103 bp, Artificial Sequence
  Synthetic Polynucleotide
taatacgactcactatagggctccacctcggccgggttcgagagccccttaacagaggagaaaggggatgtcgaacccgaacctggcggcagcgcaaaagatg

SEQ ID NO: 197797 - DNA, 103 bp, Artificial Sequence
  Synthetic Polynucleotide
taatacgactcactatagggccctcagcgcctccacctcggccgggttcgaacagaggagacgaaccatgccgaggtggaacctggcggcagcgcaaaagatg

SEQ ID NO: 197798 - DNA, 103 bp, Artificial Sequence
  Synthetic Polynucleotide
taatacgactcactatagggtagaccttctccctcagcgcctccacctcgaacagaggagacgaggtatgggcgctgagaacctggcggcagcgcaaaagatg

SEQ ID NO: 197799 - DNA, 103 bp, Artificial Sequence
  Synthetic Polynucleotide
taatacgactcactatagggcaaggacgcatagaccttctccctcagcgcaacagaggagagcgctgatggagaaggtcaacctggcggcagcgcaaaagatg

SEQ ID NO: 197800 - DNA, 103 bp, Artificial Sequence
  Synthetic Polynucleotide
taatacgactcactatagggagtaggcctccaaggacgcatagaccttctaacagaggagaagaaggatgatgcgtcctaacctggcggcagcgcaaaagatg

SEQ ID NO: 197801 - DNA, 103 bp, Artificial Sequence
  Synthetic Polynucleotide
taatacgactcactatagggagctgtcccggggagccgatgccaggccccaacagaggagaggggccatgcatcggctcaacctggcggcagcgcaaaagatg

SEQ ID NO: 197802 - DNA, 103 bp, Artificial Sequence
  Synthetic Polynucleotide
taatacgactcactatagggttgtgcttgcagtaggcctccaaggacgcaaacagaggagatgcgtcatgggaggcctaaacctggcggcagcgcaaaagatg

SEQ ID NO: 197803 - DNA, 103 bp, Artificial Sequence
  Synthetic Polynucleotide
taatacgactcactatagggctctgggtacttgtgcttgcagtaggcctcaacagaggagagaggccatgtgcaagcacaacctggcggcagcgcaaaagatg

SEQ ID NO: 197804 - DNA, 103 bp, Artificial Sequence
  Synthetic Polynucleotide
taatacgactcactatagggttcccggctgctctgggtacttgtgcttgcaacagaggagagcaagcatgagtacccagaacctggcggcagcgcaaaagatg

SEQ ID NO: 197805 - DNA, 103 bp, Artificial Sequence
  Synthetic Polynucleotide
taatacgactcactatagggttagcgaaccttcccggctgctctgggtacaacagaggagagtacccatggcagccgggaacctggcggcagcgcaaaagatg

SEQ ID NO: 197806 - DNA, 103 bp, Artificial Sequence
  Synthetic Polynucleotide
taatacgactcactataggggagcaagagcttagcgaaccttcccggctgaacagaggagacagccgatgaggttcgctaacctggcggcagcgcaaaagatg

SEQ ID NO: 197807 - DNA, 103 bp, Artificial Sequence
  Synthetic Polynucleotide
taatacgactcactatagggccggcaggcggagcaagagcttagcgaaccaacagaggagaggttcgatgagctcttgcaacctggcggcagcgcaaaagatg

SEQ ID NO: 197808 - DNA, 103 bp, Artificial Sequence
  Synthetic Polynucleotide
taatacgactcactataggggagcgcagagccggcaggcggagcaagagcaacagaggagagctcttatgccgcctgccaacctggcggcagcgcaaaagatg

SEQ ID NO: 197809 - DNA, 103 bp, Artificial Sequence
  Synthetic Polynucleotide
taatacgactcactataggggagcccgatggagcgcagagccggcaggcgaacagaggagacgcctgatggctctgcgcaacctggcggcagcgcaaaagatg

SEQ ID NO: 197810 - DNA, 103 bp, Artificial Sequence
  Synthetic Polynucleotide
taatacgactcactatagggccaggcatttgagcccgatggagcgcagagaacagaggagactctgcatgccatcgggcaacctggcggcagcgcaaaagatg

SEQ ID NO: 197811 - DNA, 103 bp, Artificial Sequence
  Synthetic Polynucleotide
taatacgactcactatagggaagagatgttccaggcatttgagcccgatgaacagaggagacatcggatgcaaatgcctaacctggcggcagcgcaaaagatg

SEQ ID NO: 197812 - DNA, 103 bp, Artificial Sequence
  Synthetic Polynucleotide
taatacgactcactataggggggagaatgcagctgtcccggggagccgataacagaggagaatcggcatgccgggacagaacctggcggcagcgcaaaagatg

SEQ ID NO: 197813 - DNA, 103 bp, Artificial Sequence
  Synthetic Polynucleotide
taatacgactcactatagggcttgaagaagaagagatgttccaggcatttaacagaggagaaaatgcatggaacatctcaacctggcggcagcgcaaaagatg

SEQ ID NO: 197814 - DNA, 103 bp, Artificial Sequence
  Synthetic Polynucleotide
taatacgactcactatagggccccgatgagcttgaagaagaagagatgttaacagaggagaaacatcatgtcttcttcaaacctggcggcagcgcaaaagatg

SEQ ID NO: 197815 - DNA, 103 bp, Artificial Sequence
  Synthetic Polynucleotide
taatacgactcactatagggatgggtgtgtccccgatgagcttgaagaagaacagaggagacttcttatggctcatcggaacctggcggcagcgcaaaagatg

SEQ ID NO: 197816 - DNA, 103 bp, Artificial Sequence
  Synthetic Polynucleotide
taatacgactcactataggggaaggtgtcaatgggtgtgtccccgatgagaacagaggagactcatcatggacacacccaacctggcggcagcgcaaaagatg

SEQ ID NO: 197817 - DNA, 103 bp, Artificial Sequence
  Synthetic Polynucleotide
taatacgactcactatagggtctccataaggaaggtgtcaatgggtgtgtaacagaggagaacacacatgttgacacctaacctggcggcagcgcaaaagatg

SEQ ID NO: 197818 - DNA, 103 bp, Artificial Sequence
  Synthetic Polynucleotide
taatacgactcactataggggcctccagcatctccataaggaaggtgtcaaacagaggagatgacacatgccttatggaaacctggcggcagcgcaaaagatg

SEQ ID NO: 197819 - DNA, 103 bp, Artificial Sequence
  Synthetic Polynucleotide
taatacgactcactatagggttggtgcggcgcctccagcatctccataagaacagaggagacttatgatgatgctggagaacctggcggcagcgcaaaagatg

SEQ ID NO: 197820 - DNA, 103 bp, Artificial Sequence
  Synthetic Polynucleotide
taatacgactcactataggggggtgctgatgggagaatgcagctgtcccgaacagaggagacgggacatgtgcattctcaacctggcggcagcgcaaaagatg

SEQ ID NO: 197821 - DNA, 103 bp, Artificial Sequence
  Synthetic Polynucleotide
taatacgactcactatagggggggagctcagggtgctgatgggagaatgcaacagaggagagcattcatgcatcagcacaacctggcggcagcgcaaaagatg

SEQ ID NO: 197822 - DNA, 103 bp, Artificial Sequence
  Synthetic Polynucleotide
taatacgactcactataggggccgttgatgggggagctcagggtgctgataacagaggagaatcagcatgctgagctccaacctggcggcagcgcaaaagatg

SEQ ID NO: 197823 - DNA, 103 bp, Artificial Sequence
  Synthetic Polynucleotide
taatacgactcactataggggcgggcccatgccgttgatgggggagctcaaacagaggagatgagctatgccatcaacgaacctggcggcagcgcaaaagatg

SEQ ID NO: 197824 - DNA, 103 bp, Artificial Sequence
  Synthetic Polynucleotide
taatacgactcactatagggaccgagaaaggcgggcccatgccgttgatgaacagaggagacatcaaatgcatgggcccaacctggcggcagcgcaaaagatg

SEQ ID NO: 197825 - DNA, 103 bp, Artificial Sequence
  Synthetic Polynucleotide
taatacgactcactatagggggagctgatgaccgagaaaggcgggcccataacagaggagaatgggcatgcctttctcgaacctggcggcagcgcaaaagatg

SEQ ID NO: 197826 - DNA, 103 bp, Artificial Sequence
  Synthetic Polynucleotide
taatacgactcactataggggggtggagaaatcgagcggcaggaaatgttaacagaggagaaacattatgtgccgctcgaacctggcggcagcgcaaaagatg

SEQ ID NO: 197827 - DNA, 103 bp, Artificial Sequence
  Synthetic Polynucleotide
taatacgactcactatagggggcccatgggggagctgatgaccgagaaagaacagaggagactttctatgtcatcagctaacctggcggcagcgcaaaagatg

SEQ ID NO: 197828 - DNA, 103 bp, Artificial Sequence
  Synthetic Polynucleotide
taatacgactcactatagggatggagtgggggcccatgggggagctgatgaacagaggagacatcagatgccccatgggaacctggcggcagcgcaaaagatg

SEQ ID NO: 197829 - DNA, 103 bp, Artificial Sequence
  Synthetic Polynucleotide
taatacgactcactataggggggcaccgacatggagtgggggcccatgggaacagaggagacccatgatgccccactccaacctggcggcagcgcaaaagatg

SEQ ID NO: 197830 - DNA, 103 bp, Artificial Sequence
  Synthetic Polynucleotide
taatacgactcactatagggtgggtgtggtgggcaccgacatggagtgggaacagaggagacccactatgtgtcggtgcaacctggcggcagcgcaaaagatg

SEQ ID NO: 197831 - DNA, 103 bp, Artificial Sequence
  Synthetic Polynucleotide
taatacgactcactatagggaagcccagggtgggtgtggtgggcaccgacaacagaggagagtcggtatgcaccacaccaacctggcggcagcgcaaaagatg

SEQ ID NO: 197832 - DNA, 103 bp, Artificial Sequence
  Synthetic Polynucleotide
taatacgactcactataggggccagtgctgaagcccagggtgggtgtggtaacagaggagaaccacaatgaccctgggcaacctggcggcagcgcaaaagatg

SEQ ID NO: 197833 - DNA, 103 bp, Artificial Sequence
  Synthetic Polynucleotide
taatacgactcactataggggctgggggctgccagtgctgaagcccagggaacagaggagaccctggatgtcagcactgaacctggcggcagcgcaaaagatg

SEQ ID NO: 197834 - DNA, 103 bp, Artificial Sequence
  Synthetic Polynucleotide
taatacgactcactatagggggtgagctgagctgggggctgccagtgctgaacagaggagacagcacatgcagcccccaaacctggcggcagcgcaaaagatg

SEQ ID NO: 197835 - DNA, 103 bp, Artificial Sequence
  Synthetic Polynucleotide
taatacgactcactatagggggggttcataggtgagctgagctgggggctaacagaggagaagccccatgctcagctcaaacctggcggcagcgcaaaagatg

SEQ ID NO: 197836 - DNA, 103 bp, Artificial Sequence
  Synthetic Polynucleotide
taatacgactcactatagggtgctgctgacggggttcataggtgagctgaaacagaggagatcagctatgctatgaaccaacctggcggcagcgcaaaagatg

SEQ ID NO: 197837 - DNA, 103 bp, Artificial Sequence
  Synthetic Polynucleotide
taatacgactcactataggggagttcacctgggtggagaaatcgagcggcaacagaggagagccgctatgtttctccacaacctggcggcagcgcaaaagatg

SEQ ID NO: 197838 - DNA, 103 bp, Artificial Sequence
  Synthetic Polynucleotide
taatacgactcactatagggatgtcctcgctgctgctgacggggttcataaacagaggagatatgaaatgcgtcagcagaacctggcggcagcgcaaaagatg

SEQ ID NO: 197839 - DNA, 103 bp, Artificial Sequence
  Synthetic Polynucleotide
taatacgactcactatagggggggggcttgatgtcctcgctgctgctgacaacagaggagagtcagcatgagcgaggacaacctggcggcagcgcaaaagatg

SEQ ID NO: 197840 - DNA, 103 bp, Artificial Sequence
  Synthetic Polynucleotide
taatacgactcactatagggtgaggcccagggggggcttgatgtcctcgcaacagaggagagcgaggatgtcaagccccaacctggcggcagcgcaaaagatg

SEQ ID NO: 197841 - DNA, 103 bp, Artificial Sequence
  Synthetic Polynucleotide
taatacgactcactatagggaggacgccattgaggcccagggggggcttgaacagaggagacaagccatgcctgggcctaacctggcggcagcgcaaaagatg

SEQ ID NO: 197842 - DNA, 103 bp, Artificial Sequence
  Synthetic Polynucleotide
taatacgactcactatagggggggaccttgaggacgccattgaggcccagaacagaggagactgggcatgaatggcgtcaacctggcggcagcgcaaaagatg

SEQ ID NO: 197843 - DNA, 103 bp, Artificial Sequence
  Synthetic Polynucleotide
taatacgactcactatagggaggggtgggcggggaccttgaggacgccataacagaggagaatggcgatgtcaaggtccaacctggcggcagcgcaaaagatg

SEQ ID NO: 197844 - DNA, 103 bp, Artificial Sequence
  Synthetic Polynucleotide
taatacgactcactatagggatgtttcctgaggggtgggcggggaccttgaacagaggagacaaggtatgcgcccacccaacctggcggcagcgcaaaagatg

SEQ ID NO: 197845 - DNA, 103 bp, Artificial Sequence
  Synthetic Polynucleotide
taatacgactcactataggggaaggaagccatgtttcctgaggggtgggcaacagaggagagcccacatgtcaggaaacaacctggcggcagcgcaaaagatg

SEQ ID NO: 197846 - DNA, 103 bp, Artificial Sequence
  Synthetic Polynucleotide
taatacgactcactatagggtgtgcttggtgaaggaagccatgtttcctgaacagaggagacaggaaatgtggcttcctaacctggcggcagcgcaaaagatg

SEQ ID NO: 197847 - DNA, 103 bp, Artificial Sequence
  Synthetic Polynucleotide
taatacgactcactatagggatggcgcagatgtgcttggtgaaggaagccaacagaggagaggcttcatgcaccaagcaaacctggcggcagcgcaaaagatg

SEQ ID NO: 197848 - DNA, 103 bp, Artificial Sequence
  Synthetic Polynucleotide
taatacgactcactatagggggtgagggaggagttcacctgggtggagaaaacagaggagattctccatgcaggtgaacaacctggcggcagcgcaaaagatg

SEQ ID NO: 197849 - DNA, 103 bp, Artificial Sequence
  Synthetic Polynucleotide
taatacgactcactataggggtccccgcagatggcgcagatgtgcttggtaacagaggagaaccaagatgatctgcgccaacctggcggcagcgcaaaagatg

SEQ ID NO: 197850 - DNA, 103 bp, Artificial Sequence
  Synthetic Polynucleotide
taatacgactcactatagggctgaggagcggtccccgcagatggcgcagaaacagaggagatctgcgatgtctgcggggaacctggcggcagcgcaaaagatg

SEQ ID NO: 197851 - DNA, 103 bp, Artificial Sequence
  Synthetic Polynucleotide
taatacgactcactatagggtagtgcttgcctgaggagcggtccccgcagaacagaggagactgcggatgccgctcctcaacctggcggcagcgcaaaagatg

SEQ ID NO: 197852 - DNA, 103 bp, Artificial Sequence
  Synthetic Polynucleotide
taatacgactcactataggggtacactccatagtgcttgcctgaggagcgaacagaggagacgctccatgggcaagcacaacctggcggcagcgcaaaagatg

SEQ ID NO: 197853 - DNA, 103 bp, Artificial Sequence
  Synthetic Polynucleotide
taatacgactcactatagggcctcgcagctgtacactccatagtgcttgcaacagaggagagcaagcatgatggagtgtaacctggcggcagcgcaaaagatg

SEQ ID NO: 197854 - DNA, 103 bp, Artificial Sequence
  Synthetic Polynucleotide
taatacgactcactatagggcccttgcacccctcgcagctgtacactccaaacagaggagatggagtatgcagctgcgaaacctggcggcagcgcaaaagatg

SEQ ID NO: 197855 - DNA, 103 bp, Artificial Sequence
  Synthetic Polynucleotide
taatacgactcactatagggcttgaagaagcccttgcacccctcgcagctaacagaggagaagctgcatggggtgcaagaacctggcggcagcgcaaaagatg

SEQ ID NO: 197856 - DNA, 103 bp, Artificial Sequence
  Synthetic Polynucleotide
taatacgactcactataggggcaccgtccgcttgaagaagcccttgcaccaacagaggagaggtgcaatggcttcttcaaacctggcggcagcgcaaaagatg

SEQ ID NO: 197857 - DNA, 103 bp, Artificial Sequence
  Synthetic Polynucleotide
taatacgactcactatagggaggtccttgcgcaccgtccgcttgaagaagaacagaggagacttcttatggcggacggtaacctggcggcagcgcaaaagatg

SEQ ID NO: 197858 - DNA, 103 bp, Artificial Sequence
  Synthetic Polynucleotide
taatacgactcactatagggggtgtaggtcaggtccttgcgcaccgtccgaacagaggagacggacgatgcgcaaggacaacctggcggcagcgcaaaagatg

SEQ ID NO: 197859 - DNA, 103 bp, Artificial Sequence
  Synthetic Polynucleotide
taatacgactcactatagggccgtcggggaggtgagggaggagttcacctaacagaggagaaggtgaatgcctccctcaaacctggcggcagcgcaaaagatg

SEQ ID NO: 197860 - DNA, 103 bp, Artificial Sequence
  Synthetic Polynucleotide
taatacgactcactatagggtgtcgcggcaggtgtaggtcaggtccttgcaacagaggagagcaaggatgtgacctacaaacctggcggcagcgcaaaagatg

SEQ ID NO: 197861 - DNA, 103 bp, Artificial Sequence
  Synthetic Polynucleotide
taatacgactcactatagggcagtccttgttgtcgcggcaggtgtaggtcaacagaggagagacctaatgctgccgcgaaacctggcggcagcgcaaaagatg

SEQ ID NO: 197862 - DNA, 103 bp, Artificial Sequence
  Synthetic Polynucleotide
taatacgactcactataggggtcaatcaggcagtccttgttgtcgcggcaaacagaggagatgccgcatgaacaaggacaacctggcggcagcgcaaaagatg

SEQ ID NO: 197863 - DNA, 103 bp, Artificial Sequence
  Synthetic Polynucleotide
taatacgactcactataggggctgccgcttgtcaatcaggcagtccttgtaacagaggagaacaaggatggcctgattgaacctggcggcagcgcaaaagatg

SEQ ID NO: 197864 - DNA, 103 bp, Artificial Sequence
  Synthetic Polynucleotide
taatacgactcactatagggcaccggttccgctgccgcttgtcaatcaggaacagaggagacctgatatgcaagcggcaaacctggcggcagcgcaaaagatg

SEQ ID NO: 197865 - DNA, 103 bp, Artificial Sequence
  Synthetic Polynucleotide
taatacgactcactataggggcagtactggcaccggttccgctgccgcttaacagaggagaaagcggatgcggaaccggaacctggcggcagcgcaaaagatg

SEQ ID NO: 197866 - DNA, 103 bp, Artificial Sequence
  Synthetic Polynucleotide
taatacgactcactatagggtctggtagcggcagtactggcaccggttccaacagaggagaggaaccatggccagtactaacctggcggcagcgcaaaagatg

SEQ ID NO: 197867 - DNA, 103 bp, Artificial Sequence
  Synthetic Polynucleotide
taatacgactcactataggggccaggcacttctggtagcggcagtactggaacagaggagaccagtaatgccgctaccaaacctggcggcagcgcaaaagatg

SEQ ID NO: 197868 - DNA, 103 bp, Artificial Sequence
  Synthetic Polynucleotide
taatacgactcactatagggcatgcccatggccaggcacttctggtagcgaacagaggagacgctacatgaagtgcctgaacctggcggcagcgcaaaagatg

SEQ ID NO: 197869 - DNA, 103 bp, Artificial Sequence
  Synthetic Polynucleotide
taatacgactcactatagggcttcccgcttcatgcccatggccaggcactaacagaggagaagtgccatgccatgggcaaacctggcggcagcgcaaaagatg

SEQ ID NO: 197870 - DNA, 103 bp, Artificial Sequence
  Synthetic Polynucleotide
taatacgactcactataggggagcctcgccccgtcggggaggtgagggagaacagaggagactccctatgctccccgacaacctggcggcagcgcaaaagatg

SEQ ID NO: 197871 - DNA, 103 bp, Artificial Sequence
  Synthetic Polynucleotide
taatacgactcactatagggtcctgcacggcttcccgcttcatgcccatgaacagaggagacatgggatggaagcgggaaacctggcggcagcgcaaaagatg

SEQ ID NO: 197872 - DNA, 103 bp, Artificial Sequence
  Synthetic Polynucleotide
taatacgactcactatagggctgccgctcctcctgcacggcttcccgcttaacagaggagaaagcggatggccgtgcagaacctggcggcagcgcaaaagatg

SEQ ID NO: 197873 - DNA, 103 bp, Artificial Sequence
  Synthetic Polynucleotide
taatacgactcactatagggccttgccacgctgccgctcctcctgcacggaacagaggagaccgtgcatgaggagcggcaacctggcggcagcgcaaaagatg

SEQ ID NO: 197874 - DNA, 103 bp, Artificial Sequence
  Synthetic Polynucleotide
taatacgactcactatagggtcgttccggtccttgccacgctgccgctccaacagaggagaggagcgatggcgtggcaaaacctggcggcagcgcaaaagatg

SEQ ID NO: 197875 - DNA, 103 bp, Artificial Sequence
  Synthetic Polynucleotide
taatacgactcactatagggcacctcattctcgttccggtccttgccacgaacagaggagacgtggcatggaccggaacaacctggcggcagcgcaaaagatg

SEQ ID NO: 197876 - DNA, 103 bp, Artificial Sequence
  Synthetic Polynucleotide
taatacgactcactatagggtggtcgactccacctcattctcgttccggtaacagaggagaaccggaatgagaatgaggaacctggcggcagcgcaaaagatg

SEQ ID NO: 197877 - DNA, 103 bp, Artificial Sequence
  Synthetic Polynucleotide
taatacgactcactatagggttggcgctgctggtcgactccacctcattcaacagaggagagaatgaatgggagtcgacaacctggcggcagcgcaaaagatg

SEQ ID NO: 197878 - DNA, 103 bp, Artificial Sequence
  Synthetic Polynucleotide
taatacgactcactatagggcatgtcctcgttggcgctgctggtcgactcaacagaggagagagtcgatgagcagcgccaacctggcggcagcgcaaaagatg

SEQ ID NO: 197879 - DNA, 103 bp, Artificial Sequence
  Synthetic Polynucleotide
taatacgactcactatagggtctccaccggcatgtcctcgttggcgctgcaacagaggagagcagcgatgacgaggacaaacctggcggcagcgcaaaagatg

SEQ ID NO: 197880 - DNA, 103 bp, Artificial Sequence
  Synthetic Polynucleotide
taatacgactcactatagggtccaggatcctctccaccggcatgtcctcgaacagaggagacgaggaatggccggtggaaacctggcggcagcgcaaaagatg

SEQ ID NO: 197881 - DNA, 103 bp, Artificial Sequence
  Synthetic Polynucleotide
taatacgactcactatagggggcagccatggagcctcgccccgtcggggaaacagaggagatccccgatggggcgaggcaacctggcggcagcgcaaaagatg

SEQ ID NO: 197882 - DNA, 103 bp, Artificial Sequence
  Synthetic Polynucleotide
taatacgactcactatagggcagctcagcctccaggatcctctccaccggaacagaggagaccggtgatgaggatcctgaacctggcggcagcgcaaaagatg

SEQ ID NO: 197883 - DNA, 103 bp, Artificial Sequence
  Synthetic Polynucleotide
taatacgactcactataggggctccacggccagctcagcctccaggatccaacagaggagaggatccatgaggctgagcaacctggcggcagcgcaaaagatg

SEQ ID NO: 197884 - DNA, 103 bp, Artificial Sequence
  Synthetic Polynucleotide
taatacgactcactatagggtcggtcttgggctccacggccagctcagccaacagaggagaggctgaatgggccgtggaaacctggcggcagcgcaaaagatg

SEQ ID NO: 197885 - DNA, 103 bp, Artificial Sequence
  Synthetic Polynucleotide
taatacgactcactatagggcacgtaggtctcggtcttgggctccacggcaacagaggagagccgtgatgcccaagaccaacctggcggcagcgcaaaagatg

SEQ ID NO: 197886 - DNA, 103 bp, Artificial Sequence
  Synthetic Polynucleotide
taatacgactcactatagggtgtttgcctccacgtaggtctcggtcttggaacagaggagaccaagaatgagacctacgaacctggcggcagcgcaaaagatg

SEQ ID NO: 197887 - DNA, 103 bp, Artificial Sequence
  Synthetic Polynucleotide
taatacgactcactatagggttcagccccatgtttgcctccacgtaggtcaacagaggagagacctaatgggaggcaaaaacctggcggcagcgcaaaagatg

SEQ ID NO: 197888 - DNA, 103 bp, Artificial Sequence
  Synthetic Polynucleotide
taatacgactcactatagggcgagctggggttcagccccatgtttgcctcaacagaggagagaggcaatgatggggctgaacctggcggcagcgcaaaagatg

SEQ ID NO: 197889 - DNA, 103 bp, Artificial Sequence
  Synthetic Polynucleotide
taatacgactcactatagggggtcgttcggcgagctggggttcagccccaaacagaggagatggggcatgaccccagctaacctggcggcagcgcaaaagatg

SEQ ID NO: 197890 - DNA, 103 bp, Artificial Sequence
  Synthetic Polynucleotide
taatacgactcactatagggttggtgacagggtcgttcggcgagctggggaacagaggagaccccagatggccgaacgaaacctggcggcagcgcaaaagatg

SEQ ID NO: 197891 - DNA, 103 bp, Artificial Sequence
  Synthetic Polynucleotide
taatacgactcactatagggttggcaaatgttggtgacagggtcgttcggaacagaggagaccgaacatgcctgtcaccaacctggcggcagcgcaaaagatg

SEQ ID NO: 197892 - DNA, 103 bp, Artificial Sequence
  Synthetic Polynucleotide
taatacgactcactataggggcagcgagggggcagccatggagcctcgccaacagaggagaggcgagatgccatggctgaacctggcggcagcgcaaaagatg

SEQ ID NO: 197893 - DNA, 103 bp, Artificial Sequence
  Synthetic Polynucleotide
taatacgactcactatagggtgtcggctgcttggcaaatgttggtgacagaacagaggagactgtcaatgacatttgccaacctggcggcagcgcaaaagatg

SEQ ID NO: 197894 - DNA, 103 bp, Artificial Sequence
  Synthetic Polynucleotide
taatacgactcactatagggaaaagctgtttgtcggctgcttggcaaatgaacagaggagacatttgatgagcagccgaaacctggcggcagcgcaaaagatg

SEQ ID NO: 197895 - DNA, 103 bp, Artificial Sequence
  Synthetic Polynucleotide
taatacgactcactatagggcaccagggtgaaaagctgtttgtcggctgcaacagaggagagcagccatgaaacagcttaacctggcggcagcgcaaaagatg

SEQ ID NO: 197896 - DNA, 103 bp, Artificial Sequence
  Synthetic Polynucleotide
taatacgactcactatagggtggcccactccaccagggtgaaaagctgttaacagaggagaaacagcatgtcaccctggaacctggcggcagcgcaaaagatg

SEQ ID NO: 197897 - DNA, 103 bp, Artificial Sequence
  Synthetic Polynucleotide
taatacgactcactataggggggatccgcttggcccactccaccagggtgaacagaggagacaccctatgggagtgggcaacctggcggcagcgcaaaagatg

SEQ ID NO: 197898 - DNA, 103 bp, Artificial Sequence
  Synthetic Polynucleotide
taatacgactcactatagggtgagaagtgtgggatccgcttggcccactcaacagaggagagagtggatgaagcggatcaacctggcggcagcgcaaaagatg

SEQ ID NO: 197899 - DNA, 103 bp, Artificial Sequence
  Synthetic Polynucleotide
taatacgactcactatagggggggcagctctgagaagtgtgggatccgctaacagaggagaagcggaatgcacacttctaacctggcggcagcgcaaaagatg

SEQ ID NO: 197900 - DNA, 103 bp, Artificial Sequence
  Synthetic Polynucleotide
taatacgactcactatagggtggtcgtccaggggcagctctgagaagtgtaacagaggagaacacttatgagagctgccaacctggcggcagcgcaaaagatg

SEQ ID NO: 197901 - DNA, 103 bp, Artificial Sequence
  Synthetic Polynucleotide
taatacgactcactatagggcaggatgacctggtcgtccaggggcagctcaacagaggagagagctgatgctggacgacaacctggcggcagcgcaaaagatg

SEQ ID NO: 197902 - DNA, 103 bp, Artificial Sequence
  Synthetic Polynucleotide
taatacgactcactatagggctgcccgcagcaggatgacctggtcgtccaaacagaggagatggacgatgaggtcatccaacctggcggcagcgcaaaagatg

SEQ ID NO: 197903 - DNA, 103 bp, Artificial Sequence
  Synthetic Polynucleotide
taatacgactcactatagggagggacgggtgcagcgagggggcagccatgaacagaggagacatggcatgcccctcgctaacctggcggcagcgcaaaagatg

SEQ ID NO: 197904 - DNA, 103 bp, Artificial Sequence
  Synthetic Polynucleotide
taatacgactcactatagggtcattccagcctgcccgcagcaggatgaccaacagaggagaggtcatatggctgcgggcaacctggcggcagcgcaaaagatg

SEQ ID NO: 197905 - DNA, 103 bp, Artificial Sequence
  Synthetic Polynucleotide
taatacgactcactataggggatgagcagctcattccagcctgcccgcagaacagaggagactgcggatgggctggaataacctggcggcagcgcaaaagatg

SEQ ID NO: 197906 - DNA, 103 bp, Artificial Sequence
  Synthetic Polynucleotide
taatacgactcactatagggagaaggaggcgatgagcagctcattccagcaacagaggagagctggaatgagctgctcaaacctggcggcagcgcaaaagatg

SEQ ID NO: 197907 - DNA, 103 bp, Artificial Sequence
  Synthetic Polynucleotide
taatacgactcactataggggagcggtgggagaaggaggcgatgagcagcaacagaggagagctgctatgcgcctccttaacctggcggcagcgcaaaagatg

SEQ ID NO: 197908 - DNA, 103 bp, Artificial Sequence
  Synthetic Polynucleotide
taatacgactcactatagggcacggcgatggagcggtgggagaaggaggcaacagaggagagcctccatgtcccaccgcaacctggcggcagcgcaaaagatg

SEQ ID NO: 197909 - DNA, 103 bp, Artificial Sequence
  Synthetic Polynucleotide
taatacgactcactatagggtcccgtccttcacggcgatggagcggtgggaacagaggagacccaccatgccatcgccgaacctggcggcagcgcaaaagatg

SEQ ID NO: 197910 - DNA, 103 bp, Artificial Sequence
  Synthetic Polynucleotide
taatacgactcactataggggccaggaggatcccgtccttcacggcgatgaacagaggagacatcgcatggaaggacggaacctggcggcagcgcaaaagatg

SEQ ID NO: 197911 - DNA, 103 bp, Artificial Sequence
  Synthetic Polynucleotide
taatacgactcactatagggcagcccggtggccaggaggatcccgtccttaacagaggagaaaggacatgatcctcctgaacctggcggcagcgcaaaagatg

SEQ ID NO: 197912 - DNA, 103 bp, Artificial Sequence
  Synthetic Polynucleotide
taatacgactcactatagggggtggacgtgcagcccggtggccaggaggaaacagaggagatcctccatgccaccgggcaacctggcggcagcgcaaaagatg

SEQ ID NO: 197913 - DNA, 103 bp, Artificial Sequence
  Synthetic Polynucleotide
taatacgactcactataggggcgctgttccggtggacgtgcagcccggtgaacagaggagacaccggatggcacgtccaaacctggcggcagcgcaaaagatg

SEQ ID NO: 197914 - DNA, 103 bp, Artificial Sequence
  Synthetic Polynucleotide
taatacgactcactataggggaggaagggcgggcgagcggcccaagacataacagaggagaatgtctatggccgctcgcaacctggcggcagcgcaaaagatg

SEQ ID NO: 197915 - DNA, 103 bp, Artificial Sequence
  Synthetic Polynucleotide
taatacgactcactatagggccgtcgccgccgccaccgggacgcgaccccaacagaggagaggggtcatgtcccggtggaacctggcggcagcgcaaaagatg

SEQ ID NO: 197916 - DNA, 103 bp, Artificial Sequence
  Synthetic Polynucleotide
taatacgactcactatagggacagatgttagtcacagggtcatttgggctaacagaggagaagcccaatggaccctgtgaacctggcggcagcgcaaaagatg

SEQ ID NO: 197917 - DNA, 103 bp, Artificial Sequence
  Synthetic Polynucleotide
taatacgactcactatagggcagctgcctgacagatgttagtcacagggtaacagaggagaaccctgatgctaacatctaacctggcggcagcgcaaaagatg

SEQ ID NO: 197918 - DNA, 103 bp, Artificial Sequence
  Synthetic Polynucleotide
taatacgactcactatagggagctgtttgtcagctgcctgacagatgttaaacagaggagataacatatgtcaggcagcaacctggcggcagcgcaaaagatg

SEQ ID NO: 197919 - DNA, 103 bp, Artificial Sequence
  Synthetic Polynucleotide
taatacgactcactatagggaagcgtgaatagctgtttgtcagctgcctgaacagaggagacaggcaatggacaaacagaacctggcggcagcgcaaaagatg

SEQ ID NO: 197920 - DNA, 103 bp, Artificial Sequence
  Synthetic Polynucleotide
taatacgactcactatagggcccactcaacaagcgtgaatagctgtttgtaacagaggagaacaaacatgtattcacgcaacctggcggcagcgcaaaagatg

SEQ ID NO: 197921 - DNA, 103 bp, Artificial Sequence
  Synthetic Polynucleotide
taatacgactcactatagggatcctcttcgcccactcaacaagcgtgaataacagaggagaattcacatgtgttgagtgaacctggcggcagcgcaaaagatg

SEQ ID NO: 197922 - DNA, 103 bp, Artificial Sequence
  Synthetic Polynucleotide
taatacgactcactatagggaaagtgtgggatcctcttcgcccactcaacaacagaggagagttgagatggcgaagaggaacctggcggcagcgcaaaagatg

SEQ ID NO: 197923 - DNA, 103 bp, Artificial Sequence
  Synthetic Polynucleotide
taatacgactcactataggggcaaggaggaaaagtgtgggatcctcttcgaacagaggagacgaagaatgtcccacactaacctggcggcagcgcaaaagatg

SEQ ID NO: 197924 - DNA, 103 bp, Artificial Sequence
  Synthetic Polynucleotide
taatacgactcactatagggtcatccagaggcaaggaggaaaagtgtgggaacagaggagacccacaatgttcctccttaacctggcggcagcgcaaaagatg

SEQ ID NO: 197925 - DNA, 103 bp, Artificial Sequence
  Synthetic Polynucleotide
taatacgactcactatagggtatgacctgatcatccagaggcaaggaggaaacagaggagatcctccatgcctctggataacctggcggcagcgcaaaagatg

SEQ ID NO: 197926 - DNA, 103 bp, Artificial Sequence
  Synthetic Polynucleotide
taatacgactcactatagggccagccagggccgtcgccgccgccaccgggaacagaggagacccggtatgggcggcgacaacctggcggcagcgcaaaagatg

SEQ ID NO: 197927 - DNA, 103 bp, Artificial Sequence
  Synthetic Polynucleotide
taatacgactcactatagggcccgcagcaatatgacctgatcatccagagaacagaggagactctggatgatcaggtcaaacctggcggcagcgcaaaagatg

SEQ ID NO: 197928 - DNA, 103 bp, Artificial Sequence
  Synthetic Polynucleotide
taatacgactcactatagggttccagcctgcccgcagcaatatgacctgaaacagaggagatcaggtatgattgctgcgaacctggcggcagcgcaaaagatg

SEQ ID NO: 197929 - DNA, 103 bp, Artificial Sequence
  Synthetic Polynucleotide
taatacgactcactataggggaggagttcattccagcctgcccgcagcaaaacagaggagattgctgatggcaggctggaacctggcggcagcgcaaaagatg

SEQ ID NO: 197930 - DNA, 103 bp, Artificial Sequence
  Synthetic Polynucleotide
taatacgactcactatagggaggaggcaatgaggagttcattccagcctgaacagaggagacaggctatgatgaactccaacctggcggcagcgcaaaagatg

SEQ ID NO: 197931 - DNA, 103 bp, Artificial Sequence
  Synthetic Polynucleotide
taatacgactcactatagggcggtgtgagaaggaggcaatgaggagttcaaacagaggagatgaactatgcattgcctcaacctggcggcagcgcaaaagatg

SEQ ID NO: 197932 - DNA, 103 bp, Artificial Sequence
  Synthetic Polynucleotide
taatacgactcactatagggatcaatggatcggtgtgagaaggaggcaataacagaggagaattgccatgttctcacacaacctggcggcagcgcaaaagatg

SEQ ID NO: 197933 - DNA, 103 bp, Artificial Sequence
  Synthetic Polynucleotide
taatacgactcactatagggcatctcgaacatcaatggatcggtgtgagaaacagaggagatctcacatggatccattgaacctggcggcagcgcaaaagatg

SEQ ID NO: 197934 - DNA, 103 bp, Artificial Sequence
  Synthetic Polynucleotide
taatacgactcactatagggaggaggatgccatctcgaacatcaatggataacagaggagaatccatatgtgttcgagaaacctggcggcagcgcaaaagatg

SEQ ID NO: 197935 - DNA, 103 bp, Artificial Sequence
  Synthetic Polynucleotide
taatacgactcactatagggacctgtggcaaggaggatgccatctcgaacaacagaggagagttcgaatgggcatcctcaacctggcggcagcgcaaaagatg

SEQ ID NO: 197936 - DNA, 103 bp, Artificial Sequence
  Synthetic Polynucleotide
taatacgactcactataggggcacgtgaagacctgtggcaaggaggatgcaacagaggagagcatccatgttgccacagaacctggcggcagcgcaaaagatg

SEQ ID NO: 197937 - DNA, 103 bp, Artificial Sequence
  Synthetic Polynucleotide
taatacgactcactataggggctgcgggatccagccagggccgtcgccgcaacagaggagagcggcgatggccctggctaacctggcggcagcgcaaaagatg

SEQ ID NO: 197938 - DNA, 103 bp, Artificial Sequence
  Synthetic Polynucleotide
taatacgactcactataggggagttgcggtgcacgtgaagacctgtggcaaacagaggagatgccacatgtcttcacgtaacctggcggcagcgcaaaagatg

SEQ ID NO: 197939 - DNA, 103 bp, Artificial Sequence
  Synthetic Polynucleotide
taatacgactcactatagggtgaatgggctgagttgcggtgcacgtgaagaacagaggagacttcacatgcaccgcaacaacctggcggcagcgcaaaagatg

SEQ ID NO: 197940 - DNA, 103 bp, Artificial Sequence
  Synthetic Polynucleotide
taatacgactcactatagggctactcctgctgaatgggctgagttgcggtaacagaggagaaccgcaatgcagcccattaacctggcggcagcgcaaaagatg

SEQ ID NO: 197941 - DNA, 103 bp, Artificial Sequence
  Synthetic Polynucleotide
taatacgactcactatagggaagatggctcctactcctgctgaatgggctaacagaggagaagcccaatgagcaggagtaacctggcggcagcgcaaaagatg

SEQ ID NO: 197942 - DNA, 103 bp, Artificial Sequence
  Synthetic Polynucleotide
taatacgactcactatagggcacccgatcaaagatggctcctactcctgcaacagaggagagcaggaatgggagccatcaacctggcggcagcgcaaaagatg

SEQ ID NO: 197943 - DNA, 103 bp, Artificial Sequence
  Synthetic Polynucleotide
taatacgactcactataggggctctgtcagcacccgatcaaagatggctcaacagaggagagagccaatgttgatcgggaacctggcggcagcgcaaaagatg

SEQ ID NO: 197944 - DNA, 103 bp, Artificial Sequence
  Synthetic Polynucleotide
taatacgactcactatagggttggacactagctctgtcagcacccgatcaaacagaggagatgatcgatggctgacagaaacctggcggcagcgcaaaagatg

SEQ ID NO: 197945 - DNA, 103 bp, Artificial Sequence
  Synthetic Polynucleotide
taatacgactcactataggggtcacgcattttggacactagctctgtcagaacagaggagactgacaatgctagtgtccaacctggcggcagcgcaaaagatg

SEQ ID NO: 197946 - DNA, 103 bp, Artificial Sequence
  Synthetic Polynucleotide
taatacgactcactatagggccatcctcatgtcacgcattttggacactaaacagaggagatagtgtatgaaatgcgtgaacctggcggcagcgcaaaagatg

SEQ ID NO: 197947 - DNA, 103 bp, Artificial Sequence
  Synthetic Polynucleotide
taatacgactcactatagggtctgtcttgtccatcctcatgtcacgcattaacagaggagaaatgcgatgcatgaggataacctggcggcagcgcaaaagatg

SEQ ID NO: 197948 - DNA, 103 bp, Artificial Sequence
  Synthetic Polynucleotide
taatacgactcactatagggcgccgccgccgctgcgggatccagccagggaacagaggagaccctggatggatcccgcaaacctggcggcagcgcaaaagatg

SEQ ID NO: 197949 - DNA, 103 bp, Artificial Sequence
  Synthetic Polynucleotide
taatacgactcactataggggcagccaagctctgtcttgtccatcctcataacagaggagaatgaggatggacaagacaaacctggcggcagcgcaaaagatg

SEQ ID NO: 197950 - DNA, 103 bp, Artificial Sequence
  Synthetic Polynucleotide
taatacgactcactatagggttgccctcaggcagccaagctctgtcttgtaacagaggagaacaagaatgagcttggctaacctggcggcagcgcaaaagatg

SEQ ID NO: 197951 - DNA, 103 bp, Artificial Sequence
  Synthetic Polynucleotide
taatacgactcactatagggaacagaatgattgccctcaggcagccaagcaacagaggagagcttggatgcctgagggcaacctggcggcagcgcaaaagatg

SEQ ID NO: 197952 - DNA, 103 bp, Artificial Sequence
  Synthetic Polynucleotide
taatacgactcactatagggatctggattaaacagaatgattgccctcagaacagaggagactgaggatgatcattctgaacctggcggcagcgcaaaagatg

SEQ ID NO: 197953 - DNA, 103 bp, Artificial Sequence
  Synthetic Polynucleotide
taatacgactcactatagggggcccttggcatctggattaaacagaatgaaacagaggagatcattcatgttaatccagaacctggcggcagcgcaaaagatg

SEQ ID NO: 197954 - DNA, 103 bp, Artificial Sequence
  Synthetic Polynucleotide
taatacgactcactataggggggttggagaggcccttggcatctggattaaacagaggagataatccatgtgccaagggaacctggcggcagcgcaaaagatg

SEQ ID NO: 197955 - DNA, 103 bp, Artificial Sequence
  Synthetic Polynucleotide
taatacgactcactatagggcacctcactagggttggagaggcccttggcaacagaggagagccaagatgctctccaacaacctggcggcagcgcaaaagatg

SEQ ID NO: 197956 - DNA, 103 bp, Artificial Sequence
  Synthetic Polynucleotide
taatacgactcactataggggcaggacctccacctcactagggttggagaaacagaggagatctccaatgctagtgaggaacctggcggcagcgcaaaagatg

SEQ ID NO: 197957 - DNA, 103 bp, Artificial Sequence
  Synthetic Polynucleotide
taatacgactcactatagggactttctcccgcaggacctccacctcactaaacagaggagatagtgaatgggaggtcctaacctggcggcagcgcaaaagatg

SEQ ID NO: 197958 - DNA, 103 bp, Artificial Sequence
  Synthetic Polynucleotide
taatacgactcactatagggtgatgcatacactttctcccgcaggacctcaacagaggagagaggtcatgcgggagaaaaacctggcggcagcgcaaaagatg

SEQ ID NO: 197959 - DNA, 103 bp, Artificial Sequence
  Synthetic Polynucleotide
taatacgactcactatagggccaccgccgccgccgccgccgctgcgggataacagaggagaatcccgatgcggcggcggaacctggcggcagcgcaaaagatg

SEQ ID NO: 197960 - DNA, 103 bp, Artificial Sequence
  Synthetic Polynucleotide
taatacgactcactatagggaggtctccagtgatgcatacactttctcccaacagaggagagggagaatgtgtatgcataacctggcggcagcgcaaaagatg

SEQ ID NO: 197961 - DNA, 103 bp, Artificial Sequence
  Synthetic Polynucleotide
taatacgactcactatagggtgtttgcagtaggtctccagtgatgcatacaacagaggagagtatgcatgactggagacaacctggcggcagcgcaaaagatg

SEQ ID NO: 197962 - DNA, 103 bp, Artificial Sequence
  Synthetic Polynucleotide
taatacgactcactatagggagggtacttctgtttgcagtaggtctccagaacagaggagactggagatgtactgcaaaaacctggcggcagcgcaaaagatg

SEQ ID NO: 197963 - DNA, 103 bp, Artificial Sequence
  Synthetic Polynucleotide
taatacgactcactatagggcctgctgctcagggtacttctgtttgcagtaacagaggagaactgcaatgagaagtaccaacctggcggcagcgcaaaagatg

SEQ ID NO: 197964 - DNA, 103 bp, Artificial Sequence
  Synthetic Polynucleotide
taatacgactcactataggggcaaaccgtccctgctgctcagggtacttcaacagaggagagaagtaatgtgagcagcaaacctggcggcagcgcaaaagatg

SEQ ID NO: 197965 - DNA, 103 bp, Artificial Sequence
  Synthetic Polynucleotide
taatacgactcactatagggcagcagcttggcaaaccgtccctgctgctcaacagaggagagagcagatgggacggtttaacctggcggcagcgcaaaagatg

SEQ ID NO: 197966 - DNA, 103 bp, Artificial Sequence
  Synthetic Polynucleotide
taatacgactcactataggggaagacgtagcagcagcttggcaaaccgtcaacagaggagagacggtatgccaagctgcaacctggcggcagcgcaaaagatg

SEQ ID NO: 197967 - DNA, 103 bp, Artificial Sequence
  Synthetic Polynucleotide
taatacgactcactatagggcggagggcaggaagacgtagcagcagcttgaacagaggagacaagctatggctacgtctaacctggcggcagcgcaaaagatg

SEQ ID NO: 197968 - DNA, 103 bp, Artificial Sequence
  Synthetic Polynucleotide
taatacgactcactataggggccaatggaccggagggcaggaagacgtagaacagaggagactacgtatgcctgccctcaacctggcggcagcgcaaaagatg

SEQ ID NO: 197969 - DNA, 103 bp, Artificial Sequence
  Synthetic Polynucleotide
taatacgactcactataggggacacttaaggccaatggaccggagggcagaacagaggagactgcccatgggtccattgaacctggcggcagcgcaaaagatg

SEQ ID NO: 197970 - DNA, 103 bp, Artificial Sequence
  Synthetic Polynucleotide
taatacgactcactatagggtctccgcctgccaccgccgccgccgccgccaacagaggagaggcggcatgggcggcggtaacctggcggcagcgcaaaagatg

SEQ ID NO: 197971 - DNA, 103 bp, Artificial Sequence
  Synthetic Polynucleotide
taatacgactcactatagggagatgctctagacacttaaggccaatggacaacagaggagagtccatatgccttaagtgaacctggcggcagcgcaaaagatg

SEQ ID NO: 197972 - DNA, 103 bp, Artificial Sequence
  Synthetic Polynucleotide
taatacgactcactataggggaagaaaaacagatgctctagacacttaagaacagaggagacttaagatgctagagcataacctggcggcagcgcaaaagatg

SEQ ID NO: 197973 - DNA, 103 bp, Artificial Sequence
  Synthetic Polynucleotide
taatacgactcactatagggcaatgagcttgaagaaaaacagatgctctaaacagaggagatagagcatgtgtttttctaacctggcggcagcgcaaaagatg

SEQ ID NO: 197974 - DNA, 103 bp, Artificial Sequence
  Synthetic Polynucleotide
taatacgactcactatagggggggtgtcaccaatgagcttgaagaaaaacaacagaggagagtttttatgcaagctcataacctggcggcagcgcaaaagatg

SEQ ID NO: 197975 - DNA, 103 bp, Artificial Sequence
  Synthetic Polynucleotide
taatacgactcactatagggggtgtcgatgggggtgtcaccaatgagcttaacagaggagaaagctcatgggtgacaccaacctggcggcagcgcaaaagatg

SEQ ID NO: 197976 - DNA, 103 bp, Artificial Sequence
  Synthetic Polynucleotide
taatacgactcactatagggccatgaggaaggtgtcgatgggggtgtcacaacagaggagagtgacaatgccatcgacaaacctggcggcagcgcaaaagatg

SEQ ID NO: 197977 - DNA, 103 bp, Artificial Sequence
  Synthetic Polynucleotide
taatacgactcactatagggtcaagcatctccatgaggaaggtgtcgatgaacagaggagacatcgaatgcttcctcataacctggcggcagcgcaaaagatg

SEQ ID NO: 197978 - DNA, 103 bp, Artificial Sequence
  Synthetic Polynucleotide
taatacgactcactatagggatggggagcctcaagcatctccatgaggaaaacagaggagattcctcatggagatgcttaacctggcggcagcgcaaaagatg

SEQ ID NO: 197979 - DNA, 103 bp, Artificial Sequence
  Synthetic Polynucleotide
taatacgactcactatagggaggccagttgatggggagcctcaagcatctaacagaggagaagatgcatgaggctccccaacctggcggcagcgcaaaagatg

SEQ ID NO: 197980 - DNA, 103 bp, Artificial Sequence
  Synthetic Polynucleotide
taatacgactcactatagggggtttgttgttctccgcctgccaccgccgcaacagaggagagcggcgatggcaggcggaaacctggcggcagcgcaaaagatg

SEQ ID NO: 197981 - DNA, 103 bp, Artificial Sequence
  Synthetic Polynucleotide
taatacgactcactatagggccggctccggggtttgttgttctccgcctgaacagaggagacaggcgatgaacaacaaaaacctggcggcagcgcaaaagatg

SEQ ID NO: 197982 - DNA, 103 bp, Artificial Sequence
  Synthetic Polynucleotide
taatacgactcactatagggtcccctggctccggctccggggtttgttgtaacagaggagaacaacaatgcccggagccaacctggcggcagcgcaaaagatg

SEQ ID NO: 197983 - DNA, 103 bp, Artificial Sequence
  Synthetic Polynucleotide
taatacgactcactatagggccgtccagcctcccctggctccggctccggaacagaggagaccggagatggagccagggaacctggcggcagcgcaaaagatg

SEQ ID NO: 197984 - DNA, 103 bp, Artificial Sequence
  Synthetic Polynucleotide
taatacgactcactataggggccgctgagggaggaagggcgggcgagcggaacagaggagaccgctcatgcgcccttccaacctggcggcagcgcaaaagatg

SEQ ID NO: 197985 - DNA, 103 bp, Artificial Sequence
  Synthetic Polynucleotide
taatacgactcactatagggccatcccgtcccgtccagcctcccctggctaacagaggagaagccagatgaggctggacaacctggcggcagcgcaaaagatg

SEQ ID NO: 197986 - DNA, 103 bp, Artificial Sequence
  Synthetic Polynucleotide
taatacgactcactatagggccgctgtcgcccatcccgtcccgtccagccaacagaggagaggctggatgggacgggataacctggcggcagcgcaaaagatg

SEQ ID NO: 197987 - DNA, 103 bp, Artificial Sequence
  Synthetic Polynucleotide
taatacgactcactatagggggagtcccgcccgctgtcgcccatcccgtcaacagaggagagacgggatgggcgacagcaacctggcggcagcgcaaaagatg

SEQ ID NO: 197988 - DNA, 103 bp, Artificial Sequence
  Synthetic Polynucleotide
taatacgactcactatagggctgggcttcgggagtcccgcccgctgtcgcaacagaggagagcgacaatgggcgggactaacctggcggcagcgcaaaagatg

SEQ ID NO: 197989 - DNA, 103 bp, Artificial Sequence
  Synthetic Polynucleotide
taatacgactcactataggggaggagctgtctgggcttcgggagtcccgcaacagaggagagcgggaatgccgaagcccaacctggcggcagcgcaaaagatg

SEQ ID NO: 197990 - DNA, 103 bp, Artificial Sequence
  Synthetic Polynucleotide
taatacgactcactataggggggatttggggaggagctgtctgggcttcgaacagaggagacgaagcatggacagctccaacctggcggcagcgcaaaagatg

SEQ ID NO: 197991 - DNA, 103 bp, Artificial Sequence
  Synthetic Polynucleotide
taatacgactcactatagggcctggggaaggggatttggggaggagctgtaacagaggagaacagctatgccccaaatcaacctggcggcagcgcaaaagatg

SEQ ID NO: 197992 - DNA, 103 bp, Artificial Sequence
  Synthetic Polynucleotide
taatacgactcactatagggggagggactccctggggaaggggatttgggaacagaggagacccaaaatgccttccccaaacctggcggcagcgcaaaagatg

SEQ ID NO: 197993 - DNA, 103 bp, Artificial Sequence
  Synthetic Polynucleotide
taatacgactcactatagggaggagaagggggagggactccctggggaagaacagaggagacttcccatgggagtccctaacctggcggcagcgcaaaagatg

SEQ ID NO: 197994 - DNA, 103 bp, Artificial Sequence
  Synthetic Polynucleotide
taatacgactcactataggggtggcccaggaggagaagggggagggactcaacagaggagagagtccatgccccttctcaacctggcggcagcgcaaaagatg

SEQ ID NO: 197995 - DNA, 103 bp, Artificial Sequence
  Synthetic Polynucleotide
taatacgactcactatagggcctgcggcatgccgctgagggaggaagggcaacagaggagagcccttatgccctcagcgaacctggcggcagcgcaaaagatg

SEQ ID NO: 197996 - DNA, 103 bp, Artificial Sequence
  Synthetic Polynucleotide
taatacgactcactataggggggggtaggggtggcccaggaggagaagggaacagaggagacccttcatgtcctgggccaacctggcggcagcgcaaaagatg

SEQ ID NO: 197997 - DNA, 103 bp, Artificial Sequence
  Synthetic Polynucleotide
taatacgactcactatagggagctgttgaagggggtaggggtggcccaggaacagaggagacctgggatgcccctacccaacctggcggcagcgcaaaagatg

SEQ ID NO: 197998 - DNA, 103 bp, Artificial Sequence
  Synthetic Polynucleotide
taatacgactcactatagggcaagggatggagctgttgaagggggtagggaacagaggagaccctacatgcttcaacagaacctggcggcagcgcaaaagatg

SEQ ID NO: 197999 - DNA, 103 bp, Artificial Sequence
  Synthetic Polynucleotide
taatacgactcactatagggccagagcctccaagggatggagctgttgaaaacagaggagattcaacatgtccatccctaacctggcggcagcgcaaaagatg

SEQ ID NO: 198000 - DNA, 103 bp, Artificial Sequence
  Synthetic Polynucleotide
taatacgactcactataggggggtggggccccagagcctccaagggatggaacagaggagaccatccatgggaggctctaacctggcggcagcgcaaaagatg

SEQ ID NO: 198001 - DNA, 103 bp, Artificial Sequence
  Synthetic Polynucleotide
taatacgactcactatagggtcgggggtgggggtggggccccagagcctcaacagaggagagaggctatggggccccacaacctggcggcagcgcaaaagatg

SEQ ID NO: 198002 - DNA, 103 bp, Artificial Sequence
  Synthetic Polynucleotide
taatacgactcactatagggggtggtggcatcgggggtgggggtggggccaacagaggagaggccccatgcccacccccaacctggcggcagcgcaaaagatg

SEQ ID NO: 198003 - DNA, 103 bp, Artificial Sequence
  Synthetic Polynucleotide
taatacgactcactataggggcccagtgggggtggtggcatcgggggtggaacagaggagaccacccatgatgccaccaaacctggcggcagcgcaaaagatg

SEQ ID NO: 198004 - DNA, 103 bp, Artificial Sequence
  Synthetic Polynucleotide
taatacgactcactataggggaaagggagagcccagtgggggtggtggcaaacagaggagatgccacatgccccactggaacctggcggcagcgcaaaagatg

SEQ ID NO: 198005 - DNA, 103 bp, Artificial Sequence
  Synthetic Polynucleotide
taatacgactcactatagggctgatgactggaaagggagagcccagtgggaacagaggagacccactatgctctcccttaacctggcggcagcgcaaaagatg

SEQ ID NO: 198006 - DNA, 103 bp, Artificial Sequence
  Synthetic Polynucleotide
taatacgactcactatagggcccacactgccctgcggcatgccgctgaggaacagaggagacctcagatgcatgccgcaaacctggcggcagcgcaaaagatg

SEQ ID NO: 198007 - DNA, 103 bp, Artificial Sequence
  Synthetic Polynucleotide
taatacgactcactatagggcatggaagaactgatgactggaaagggagaaacagaggagatctcccatgccagtcatcaacctggcggcagcgcaaaagatg

SEQ ID NO: 198008 - DNA, 103 bp, Artificial Sequence
  Synthetic Polynucleotide
taatacgactcactatagggcaggggaccccatggaagaactgatgactgaacagaggagacagtcaatggttcttccaaacctggcggcagcgcaaaagatg

SEQ ID NO: 198009 - DNA, 103 bp, Artificial Sequence
  Synthetic Polynucleotide
taatacgactcactataggggggggcagaccaggggaccccatggaagaaaacagaggagattcttcatgggggtccccaacctggcggcagcgcaaaagatg

SEQ ID NO: 198010 - DNA, 103 bp, Artificial Sequence
  Synthetic Polynucleotide
taatacgactcactataggggggagctggagggggcagaccaggggacccaacagaggagagggtccatgggtctgcccaacctggcggcagcgcaaaagatg

SEQ ID NO: 198011 - DNA, 103 bp, Artificial Sequence
  Synthetic Polynucleotide
taatacgactcactatagggagaatcctgggggagctggagggggcagacaacagaggagagtctgcatgctccagctcaacctggcggcagcgcaaaagatg

SEQ ID NO: 198012 - DNA, 103 bp, Artificial Sequence
  Synthetic Polynucleotide
taatacgactcactatagggacaggcccggagaatcctgggggagctggaaacagaggagatccagcatgcccaggattaacctggcggcagcgcaaaagatg

SEQ ID NO: 198013 - DNA, 103 bp, Artificial Sequence
  Synthetic Polynucleotide
taatacgactcactatagggggggctgctgacaggcccggagaatcctggaacagaggagaccaggaatgtccgggcctaacctggcggcagcgcaaaagatg

SEQ ID NO: 198014 - DNA, 103 bp, Artificial Sequence
  Synthetic Polynucleotide
taatacgactcactatagggagttaatctgggggctgctgacaggcccggaacagaggagaccgggcatgtcagcagccaacctggcggcagcgcaaaagatg

SEQ ID NO: 198015 - DNA, 103 bp, Artificial Sequence
  Synthetic Polynucleotide
taatacgactcactataggggacactgttgagttaatctgggggctgctgaacagaggagacagcagatgccagattaaaacctggcggcagcgcaaaagatg

SEQ ID NO: 198016 - DNA, 103 bp, Artificial Sequence
  Synthetic Polynucleotide
taatacgactcactatagggcccagggagtgacactgttgagttaatctgaacagaggagacagattatgtcaacagtgaacctggcggcagcgcaaaagatg

SEQ ID NO: 198017 - DNA, 103 bp, Artificial Sequence
  Synthetic Polynucleotide
taatacgactcactatagggcccccaccggcccacactgccctgcggcataacagaggagaatgccgatgggcagtgtgaacctggcggcagcgcaaaagatg

SEQ ID NO: 198018 - DNA, 103 bp, Artificial Sequence
  Synthetic Polynucleotide
taatacgactcactatagggcagacccacccccagggagtgacactgttgaacagaggagacaacagatgcactccctgaacctggcggcagcgcaaaagatg

SEQ ID NO: 198019 - DNA, 103 bp, Artificial Sequence
  Synthetic Polynucleotide
taatacgactcactatagggtcaggggggccagacccacccccagggagtaacagaggagaactcccatggggtgggtcaacctggcggcagcgcaaaagatg

SEQ ID NO: 198020 - DNA, 103 bp, Artificial Sequence
  Synthetic Polynucleotide
taatacgactcactatagggcttcacatcttcaggggggccagacccaccaacagaggagaggtgggatgggcccccctaacctggcggcagcgcaaaagatg

SEQ ID NO: 198021 - DNA, 103 bp, Artificial Sequence
  Synthetic Polynucleotide
taatacgactcactatagggagactggtggcttcacatcttcaggggggcaacagaggagagcccccatgaagatgtgaaacctggcggcagcgcaaaagatg

SEQ ID NO: 198022 - DNA, 103 bp, Artificial Sequence
  Synthetic Polynucleotide
taatacgactcactatagggcggacccctaagactggtggcttcacatctaacagaggagaagatgtatggccaccagtaacctggcggcagcgcaaaagatg

SEQ ID NO: 198023 - DNA, 103 bp, Artificial Sequence
  Synthetic Polynucleotide
taatacgactcactataggggtgcaggccccggacccctaagactggtggaacagaggagaccaccaatgttaggggtcaacctggcggcagcgcaaaagatg

SEQ ID NO: 198024 - DNA, 103 bp, Artificial Sequence
  Synthetic Polynucleotide
taatacgactcactatagggggggtggacagtgcaggccccggacccctaaacagaggagataggggatgggggcctgcaacctggcggcagcgcaaaagatg

SEQ ID NO: 198025 - DNA, 103 bp, Artificial Sequence
  Synthetic Polynucleotide
taatacgactcactatagggccacctggagggggtggacagtgcaggcccaacagaggagagggcctatgctgtccaccaacctggcggcagcgcaaaagatg

SEQ ID NO: 198026 - DNA, 103 bp, Artificial Sequence
  Synthetic Polynucleotide
taatacgactcactatagggagccccagggccacctggagggggtggacaaacagaggagatgtccaatgcctccaggtaacctggcggcagcgcaaaagatg

SEQ ID NO: 198027 - DNA, 103 bp, Artificial Sequence
  Synthetic Polynucleotide
taatacgactcactataggggccgtttgccagccccagggccacctggagaacagaggagactccagatggccctggggaacctggcggcagcgcaaaagatg

SEQ ID NO: 198028 - DNA, 103 bp, Artificial Sequence
  Synthetic Polynucleotide
taatacgactcactatagggtcttttcgcacccccaccggcccacactgcaacagaggagagcagtgatggccggtgggaacctggcggcagcgcaaaagatg

SEQ ID NO: 198029 - DNA, 103 bp, Artificial Sequence
  Synthetic Polynucleotide
taatacgactcactatagggattgcacatagccgtttgccagccccagggaacagaggagaccctggatgtggcaaacgaacctggcggcagcgcaaaagatg

SEQ ID NO: 198030 - DNA, 103 bp, Artificial Sequence
  Synthetic Polynucleotide
taatacgactcactataggggtccccgcagattgcacatagccgtttgccaacagaggagaggcaaaatgctatgtgcaaacctggcggcagcgcaaaagatg

SEQ ID NO: 198031 - DNA, 103 bp, Artificial Sequence
  Synthetic Polynucleotide
taatacgactcactatagggctgagcttctgtccccgcagattgcacataaacagaggagatatgtgatgtctgcggggaacctggcggcagcgcaaaagatg

SEQ ID NO: 198032 - DNA, 103 bp, Artificial Sequence
  Synthetic Polynucleotide
taatacgactcactatagggtagtgtttgcctgagcttctgtccccgcagaacagaggagactgcggatgcagaagctcaacctggcggcagcgcaaaagatg

SEQ ID NO: 198033 - DNA, 103 bp, Artificial Sequence
  Synthetic Polynucleotide
taatacgactcactataggggtaaaccccgtagtgtttgcctgagcttctaacagaggagaagaagcatgggcaaacacaacctggcggcagcgcaaaagatg

SEQ ID NO: 198034 - DNA, 103 bp, Artificial Sequence
  Synthetic Polynucleotide
taatacgactcactatagggcctcacagctgtaaaccccgtagtgtttgcaacagaggagagcaaacatgacggggtttaacctggcggcagcgcaaaagatg

SEQ ID NO: 198035 - DNA, 103 bp, Artificial Sequence
  Synthetic Polynucleotide
taatacgactcactatagggcccttgcaaccctcacagctgtaaaccccgaacagaggagacggggtatgcagctgtgaaacctggcggcagcgcaaaagatg

SEQ ID NO: 198036 - DNA, 103 bp, Artificial Sequence
  Synthetic Polynucleotide
taatacgactcactatagggtttgaagaagcccttgcaaccctcacagctaacagaggagaagctgtatgggttgcaagaacctggcggcagcgcaaaagatg

SEQ ID NO: 198037 - DNA, 103 bp, Artificial Sequence
  Synthetic Polynucleotide
taatacgactcactatagggggatggtgcgtttgaagaagcccttgcaacaacagaggagagttgcaatggcttcttcaaacctggcggcagcgcaaaagatg

SEQ ID NO: 198038 - DNA, 103 bp, Artificial Sequence
  Synthetic Polynucleotide
taatacgactcactatagggaggtctttgcggatggtgcgtttgaagaagaacagaggagacttcttatgacgcaccataacctggcggcagcgcaaaagatg

SEQ ID NO: 198039 - DNA, 103 bp, Artificial Sequence
  Synthetic Polynucleotide
taatacgactcactatagggacaatgcatttcttttcgcacccccaccggaacagaggagaccggtgatggtgcgaaaaaacctggcggcagcgcaaaagatg

SEQ ID NO: 198040 - DNA, 103 bp, Artificial Sequence
  Synthetic Polynucleotide
taatacgactcactatagggagagtatgtaaggtctttgcggatggtgcgaacagaggagacgcaccatgcgcaaagacaacctggcggcagcgcaaaagatg

SEQ ID NO: 198041 - DNA, 103 bp, Artificial Sequence
  Synthetic Polynucleotide
taatacgactcactatagggtgtcccggcaagagtatgtaaggtctttgcaacagaggagagcaaagatgttacatactaacctggcggcagcgcaaaagatg

SEQ ID NO: 198042 - DNA, 103 bp, Artificial Sequence
  Synthetic Polynucleotide
taatacgactcactatagggcagtctttgttgtcccggcaagagtatgtaaacagaggagatacataatgttgccgggaaacctggcggcagcgcaaaagatg

SEQ ID NO: 198043 - DNA, 103 bp, Artificial Sequence
  Synthetic Polynucleotide
taatacgactcactataggggtccactgtgcagtctttgttgtcccggcaaacagaggagatgccggatgaacaaagacaacctggcggcagcgcaaaagatg

SEQ ID NO: 198044 - DNA, 103 bp, Artificial Sequence
  Synthetic Polynucleotide
taatacgactcactataggggctggcgcttgtccactgtgcagtctttgtaacagaggagaacaaagatggcacagtggaacctggcggcagcgcaaaagatg

SEQ ID NO: 198045 - DNA, 103 bp, Artificial Sequence
  Synthetic Polynucleotide
taatacgactcactatagggcagcggttccgctggcgcttgtccactgtgaacagaggagacacagtatgcaagcgccaaacctggcggcagcgcaaaagatg

SEQ ID NO: 198046 - DNA, 103 bp, Artificial Sequence
  Synthetic Polynucleotide
taatacgactcactataggggcagtactgacagcggttccgctggcgcttaacagaggagaaagcgcatgcggaaccgcaacctggcggcagcgcaaaagatg

SEQ ID NO: 198047 - DNA, 103 bp, Artificial Sequence
  Synthetic Polynucleotide
taatacgactcactatagggtctgatagcggcagtactgacagcggttccaacagaggagaggaaccatggtcagtactaacctggcggcagcgcaaaagatg

SEQ ID NO: 198048 - DNA, 103 bp, Artificial Sequence
  Synthetic Polynucleotide
taatacgactcactataggggccaggcacttctgatagcggcagtactgaaacagaggagatcagtaatgccgctatcaaacctggcggcagcgcaaaagatg

SEQ ID NO: 198049 - DNA, 103 bp, Artificial Sequence
  Synthetic Polynucleotide
taatacgactcactatagggcatgccagtggccaggcacttctgatagcgaacagaggagacgctatatgaagtgcctgaacctggcggcagcgcaaaagatg

SEQ ID NO: 198050 - DNA, 103 bp, Artificial Sequence
  Synthetic Polynucleotide
taatacgactcactatagggacgcgaccccacaatgcatttcttttcgcaaacagaggagatgcgaaatgaaatgcattaacctggcggcagcgcaaaagatg

SEQ ID NO: 198051 - DNA, 103 bp, Artificial Sequence
  Synthetic Polynucleotide
taatacgactcactatagggcctccctcttcatgccagtggccaggcactaacagaggagaagtgccatgccactggcaaacctggcggcagcgcaaaagatg

SEQ ID NO: 198052 - DNA, 103 bp, Artificial Sequence
  Synthetic Polynucleotide
taatacgactcactatagggtcctgtaccgcctccctcttcatgccagtgaacagaggagacactggatggaagagggaaacctggcggcagcgcaaaagatg

SEQ ID NO: 198053 - DNA, 103 bp, Artificial Sequence
  Synthetic Polynucleotide
taatacgactcactatagggctgacgctcctcctgtaccgcctccctcttaacagaggagaaagaggatggcggtacagaacctggcggcagcgcaaaagatg

SEQ ID NO: 198054 - DNA, 103 bp, Artificial Sequence
  Synthetic Polynucleotide
taatacgactcactatagggcctttccccgctgacgctcctcctgtaccgaacagaggagacggtacatgaggagcgtcaacctggcggcagcgcaaaagatg

SEQ ID NO: 198055 - DNA, 103 bp, Artificial Sequence
  Synthetic Polynucleotide
taatacgactcactatagggccatccttgtcctttccccgctgacgctccaacagaggagaggagcgatggcggggaaaaacctggcggcagcgcaaaagatg

SEQ ID NO: 198056 - DNA, 103 bp, Artificial Sequence
  Synthetic Polynucleotide
taatacgactcactatagggctccccatccccatccttgtcctttccccgaacagaggagacggggaatggacaaggataacctggcggcagcgcaaaagatg

SEQ ID NO: 198057 - DNA, 103 bp, Artificial Sequence
  Synthetic Polynucleotide
taatacgactcactatagggccccagccccctccccatccccatccttgtaacagaggagaacaaggatggggatggggaacctggcggcagcgcaaaagatg

SEQ ID NO: 198058 - DNA, 103 bp, Artificial Sequence
  Synthetic Polynucleotide
taatacgactcactatagggtcgggggctcccccagccccctccccatccaacagaggagaggatggatggggggctggaacctggcggcagcgcaaaagatg

SEQ ID NO: 198059 - DNA, 103 bp, Artificial Sequence
  Synthetic Polynucleotide
taatacgactcactatagggaggcatctcctcgggggctcccccagccccaacagaggagaggggctatgggagcccccaacctggcggcagcgcaaaagatg

SEQ ID NO: 198060 - DNA, 103 bp, Artificial Sequence
  Synthetic Polynucleotide
taatacgactcactatagggtcctgtccacaggcatctcctcgggggctcaacagaggagagagcccatgaggagatgcaacctggcggcagcgcaaaagatg

SEQ ID NO: 198061 - DNA, 103 bp, Artificial Sequence
  Synthetic Polynucleotide
taatacgactcactatagggcgccaccgggacgcgaccccacaatgcattaacagaggagaaatgcaatgtggggtcgcaacctggcggcagcgcaaaagatg

SEQ ID NO: 198062 - DNA, 103 bp, Artificial Sequence
  Synthetic Polynucleotide
taatacgactcactataggggcctccaggatcctgtccacaggcatctccaacagaggagaggagatatgtgtggacagaacctggcggcagcgcaaaagatg

SEQ ID NO: 198063 - DNA, 103 bp, Artificial Sequence
  Synthetic Polynucleotide
taatacgactcactatagggagcaagctctgcctccaggatcctgtccacaacagaggagagtggacatgatcctggagaacctggcggcagcgcaaaagatg

SEQ ID NO: 198064 - DNA, 103 bp, Artificial Sequence
  Synthetic Polynucleotide
taatacgactcactatagggtctgttccacagcaagctctgcctccaggaaacagaggagatcctggatgcagagcttgaacctggcggcagcgcaaaagatg

SEQ ID NO: 198065 - DNA, 103 bp, Artificial Sequence
  Synthetic Polynucleotide
taatacgactcactatagggtggtcactcttctgttccacagcaagctctaacagaggagaagagctatgtgtggaacaaacctggcggcagcgcaaaagatg

SEQ ID NO: 198066 - DNA, 103 bp, Artificial Sequence
  Synthetic Polynucleotide
taatacgactcactatagggctcaacgccctggtcactcttctgttccacaacagaggagagtggaaatgaagagtgacaacctggcggcagcgcaaaagatg

SEQ ID NO: 198067 - DNA, 103 bp, Artificial Sequence
  Synthetic Polynucleotide
taatacgactcactatagggccccaggaccctcaacgccctggtcactctaacagaggagaagagtgatgagggcgttgaacctggcggcagcgcaaaagatg

SEQ ID NO: 198068 - DNA, 103 bp, Artificial Sequence
  Synthetic Polynucleotide
taatacgactcactatagggcccccggttcccccaggaccctcaacgcccaacagaggagagggcgtatggggtcctggaacctggcggcagcgcaaaagatg

SEQ ID NO: 198069 - DNA, 103 bp, Artificial Sequence
  Synthetic Polynucleotide
taatacgactcactataggggctgccgctacccccggttcccccaggaccaacagaggagaggtcctatgggaaccgggaacctggcggcagcgcaaaagatg

SEQ ID NO: 198070 - DNA, 103 bp, Artificial Sequence
  Synthetic Polynucleotide
taatacgactcactatagggcatttgggctgctgccgctacccccggttcaacagaggagagaaccgatggtagcggcaaacctggcggcagcgcaaaagatg

SEQ ID NO: 198071 - DNA, 103 bp, Artificial Sequence
  Synthetic Polynucleotide
taatacgactcactataggggtcacagggtcatttgggctgctgccgctaaacagaggagatagcggatgcagcccaaaaacctggcggcagcgcaaaagatg

SEQ ID NO: 198072 - DNA, 103 bp, Artificial Sequence
  Synthetic Polynucleotide
taatacgactcactatagggatcacctaggcctgacagagtctccgccataacagaggagaatggcgatgactctgtcaaacctggcggcagcgcaaaagatg

SEQ ID NO: 198073 - DNA, 103 bp, Artificial Sequence
  Synthetic Polynucleotide
taatacgactcactatagggccgcagatcgatcactcgcaggtcgctgagaacagaggagactcagcatgctgcgagtgaacctggcggcagcgcaaaagatg

SEQ ID NO: 198074 - DNA, 103 bp, Artificial Sequence
  Synthetic Polynucleotide
taatacgactcactatagggcgtgggtgcttctgcgagctcctcgctagaaacagaggagatctagcatggagctcgcaaacctggcggcagcgcaaaagatg

SEQ ID NO: 198075 - DNA, 103 bp, Artificial Sequence
  Synthetic Polynucleotide
taatacgactcactatagggttggggcttccgtgggtgcttctgcgagctaacagaggagaagctcgatgaagcacccaaacctggcggcagcgcaaaagatg

SEQ ID NO: 198076 - DNA, 103 bp, Artificial Sequence
  Synthetic Polynucleotide
taatacgactcactataggggcttctgggcttggggcttccgtgggtgctaacagaggagaagcaccatgggaagccccaacctggcggcagcgcaaaagatg

SEQ ID NO: 198077 - DNA, 103 bp, Artificial Sequence
  Synthetic Polynucleotide
taatacgactcactataggggctatctctggcttctgggcttggggcttcaacagaggagagaagccatgagcccagaaaacctggcggcagcgcaaaagatg

SEQ ID NO: 198078 - DNA, 103 bp, Artificial Sequence
  Synthetic Polynucleotide
taatacgactcactatagggcgtcttctttgctatctctggcttctgggcaacagaggagagcccagatgccagagataaacctggcggcagcgcaaaagatg

SEQ ID NO: 198079 - DNA, 103 bp, Artificial Sequence
  Synthetic Polynucleotide
taatacgactcactatagggaacttcctcccgtcttctttgctatctctgaacagaggagacagagaatgcaaagaagaaacctggcggcagcgcaaaagatg

SEQ ID NO: 198080 - DNA, 103 bp, Artificial Sequence
  Synthetic Polynucleotide
taatacgactcactataggggtcaaaatcaaacttcctcccgtcttctttaacagaggagaaaagaaatggggaggaagaacctggcggcagcgcaaaagatg

SEQ ID NO: 198081 - DNA, 103 bp, Artificial Sequence
  Synthetic Polynucleotide
taatacgactcactatagggcattacaagcgtcaaaatcaaacttcctccaacagaggagaggaggaatgttgattttgaacctggcggcagcgcaaaagatg

SEQ ID NO: 198082 - DNA, 103 bp, Artificial Sequence
  Synthetic Polynucleotide
taatacgactcactatagggggagggacttcattacaagcgtcaaaatcaaacagaggagatgatttatgcgcttgtaaaacctggcggcagcgcaaaagatg

SEQ ID NO: 198083 - DNA, 103 bp, Artificial Sequence
  Synthetic Polynucleotide
taatacgactcactatagggtttaggagccggagggacttcattacaagcaacagaggagagcttgtatggaagtccctaacctggcggcagcgcaaaagatg

SEQ ID NO: 198084 - DNA, 103 bp, Artificial Sequence
  Synthetic Polynucleotide
taatacgactcactatagggtcagctccgcccgcagatcgatcactcgcaaacagaggagatgcgagatgtcgatctgcaacctggcggcagcgcaaaagatg

SEQ ID NO: 198085 - DNA, 103 bp, Artificial Sequence
  Synthetic Polynucleotide
taatacgactcactatagggttgaggactctttaggagccggagggacttaacagaggagaaagtccatgcggctcctaaacctggcggcagcgcaaaagatg

SEQ ID NO: 198086 - DNA, 103 bp, Artificial Sequence
  Synthetic Polynucleotide
taatacgactcactatagggccctcactggttgaggactctttaggagccaacagaggagaggctccatgagagtcctcaacctggcggcagcgcaaaagatg

SEQ ID NO: 198087 - DNA, 103 bp, Artificial Sequence
  Synthetic Polynucleotide
taatacgactcactatagggctgatcagcgccctcactggttgaggactcaacagaggagagagtccatgaccagtgagaacctggcggcagcgcaaaagatg

SEQ ID NO: 198088 - DNA, 103 bp, Artificial Sequence
  Synthetic Polynucleotide
taatacgactcactatagggaactcattttctgatcagcgccctcactggaacagaggagaccagtgatggcgctgatcaacctggcggcagcgcaaaagatg

SEQ ID NO: 198089 - DNA, 103 bp, Artificial Sequence
  Synthetic Polynucleotide
taatacgactcactatagggtcttcgggagaactcattttctgatcagcgaacagaggagacgctgaatggaaaatgagaacctggcggcagcgcaaaagatg

SEQ ID NO: 198090 - DNA, 103 bp, Artificial Sequence
  Synthetic Polynucleotide
taatacgactcactatagggatccgagtcatcttcgggagaactcattttaacagaggagaaaaatgatgtctcccgaaaacctggcggcagcgcaaaagatg

SEQ ID NO: 198091 - DNA, 103 bp, Artificial Sequence
  Synthetic Polynucleotide
taatacgactcactataggggcctttttgtatccgagtcatcttcgggagaacagaggagactcccgatgatgactcggaacctggcggcagcgcaaaagatg

SEQ ID NO: 198092 - DNA, 103 bp, Artificial Sequence
  Synthetic Polynucleotide
taatacgactcactatagggtctttggaaagcctttttgtatccgagtcaaacagaggagatgactcatgtacaaaaagaacctggcggcagcgcaaaagatg

SEQ ID NO: 198093 - DNA, 103 bp, Artificial Sequence
  Synthetic Polynucleotide
taatacgactcactatagggacccttttcctctttggaaagcctttttgtaacagaggagaacaaaaatgctttccaaaaacctggcggcagcgcaaaagatg

SEQ ID NO: 198094 - DNA, 103 bp, Artificial Sequence
  Synthetic Polynucleotide
taatacgactcactatagggaactgctgcgacccttttcctctttggaaaaacagaggagatttccaatgaggaaaaggaacctggcggcagcgcaaaagatg

SEQ ID NO: 198095 - DNA, 103 bp, Artificial Sequence
  Synthetic Polynucleotide
taatacgactcactatagggttccgtttcctcagctccgcccgcagatcgaacagaggagacgatctatgggcggagctaacctggcggcagcgcaaaagatg

SEQ ID NO: 198096 - DNA, 103 bp, Artificial Sequence
  Synthetic Polynucleotide
taatacgactcactatagggtttctaccacaactgctgcgacccttttccaacagaggagaggaaaaatgtcgcagcagaacctggcggcagcgcaaaagatg

SEQ ID NO: 198097 - DNA, 103 bp, Artificial Sequence
  Synthetic Polynucleotide
taatacgactcactatagggaacccagaaatttctaccacaactgctgcgaacagaggagacgcagcatgtgtggtagaaacctggcggcagcgcaaaagatg

SEQ ID NO: 198098 - DNA, 103 bp, Artificial Sequence
  Synthetic Polynucleotide
taatacgactcactatagggagagtccactaacccagaaatttctaccacaacagaggagagtggtaatgatttctgggaacctggcggcagcgcaaaagatg

SEQ ID NO: 198099 - DNA, 103 bp, Artificial Sequence
  Synthetic Polynucleotide
taatacgactcactataggggttgtagaagagagtccactaacccagaaaaacagaggagatttctgatgtagtggactaacctggcggcagcgcaaaagatg

SEQ ID NO: 198100 - DNA, 103 bp, Artificial Sequence
  Synthetic Polynucleotide
taatacgactcactatagggtgtagctctggttgtagaagagagtccactaacagaggagaagtggaatgtcttctacaaacctggcggcagcgcaaaagatg

SEQ ID NO: 198101 - DNA, 103 bp, Artificial Sequence
  Synthetic Polynucleotide
taatacgactcactatagggtcttcaaatctgtagctctggttgtagaagaacagaggagacttctaatgccagagctaaacctggcggcagcgcaaaagatg

SEQ ID NO: 198102 - DNA, 103 bp, Artificial Sequence
  Synthetic Polynucleotide
taatacgactcactatagggctgaaaagattcttcaaatctgtagctctgaacagaggagacagagcatgagatttgaaaacctggcggcagcgcaaaagatg

SEQ ID NO: 198103 - DNA, 103 bp, Artificial Sequence
  Synthetic Polynucleotide
taatacgactcactatagggcccatatttgctgaaaagattcttcaaatcaacagaggagagatttgatgaatcttttcaacctggcggcagcgcaaaagatg

SEQ ID NO: 198104 - DNA, 103 bp, Artificial Sequence
  Synthetic Polynucleotide
taatacgactcactatagggccaccaccttcccatatttgctgaaaagataacagaggagaatctttatggcaaatatgaacctggcggcagcgcaaaagatg

SEQ ID NO: 198105 - DNA, 103 bp, Artificial Sequence
  Synthetic Polynucleotide
taatacgactcactatagggaccttggcgcccaccaccttcccatatttgaacagaggagacaaataatggaaggtggtaacctggcggcagcgcaaaagatg

SEQ ID NO: 198106 - DNA, 103 bp, Artificial Sequence
  Synthetic Polynucleotide
taatacgactcactatagggcgagtccacattccgtttcctcagctccgcaacagaggagagcggagatgaggaaacggaacctggcggcagcgcaaaagatg

SEQ ID NO: 198107 - DNA, 103 bp, Artificial Sequence
  Synthetic Polynucleotide
taatacgactcactatagggatttgtcacaaccttggcgcccaccaccttaacagaggagaaaggtgatgggcgccaagaacctggcggcagcgcaaaagatg

SEQ ID NO: 198108 - DNA, 103 bp, Artificial Sequence
  Synthetic Polynucleotide
taatacgactcactataggggactccgggcatttgtcacaaccttggcgcaacagaggagagcgccaatgttgtgacaaaacctggcggcagcgcaaaagatg

SEQ ID NO: 198109 - DNA, 103 bp, Artificial Sequence
  Synthetic Polynucleotide
taatacgactcactatagggcgagctccaggactccgggcatttgtcacaaacagaggagatgtgacatgtgcccggagaacctggcggcagcgcaaaagatg

SEQ ID NO: 198110 - DNA, 103 bp, Artificial Sequence
  Synthetic Polynucleotide
taatacgactcactatagggaccgtaacagcgagctccaggactccgggcaacagaggagagcccggatgcctggagctaacctggcggcagcgcaaaagatg

SEQ ID NO: 198111 - DNA, 103 bp, Artificial Sequence
  Synthetic Polynucleotide
taatacgactcactatagggtcgtgacaaaaccgtaacagcgagctccagaacagaggagactggagatggctgttacgaacctggcggcagcgcaaaagatg

SEQ ID NO: 198112 - DNA, 103 bp, Artificial Sequence
  Synthetic Polynucleotide
taatacgactcactataggggctgtggacatcgtgacaaaaccgtaacagaacagaggagactgttaatgttttgtcacaacctggcggcagcgcaaaagatg

SEQ ID NO: 198113 - DNA, 103 bp, Artificial Sequence
  Synthetic Polynucleotide
taatacgactcactatagggggcctcttctgctgtggacatcgtgacaaaaacagaggagatttgtcatgatgtccacaaacctggcggcagcgcaaaagatg

SEQ ID NO: 198114 - DNA, 103 bp, Artificial Sequence
  Synthetic Polynucleotide
taatacgactcactatagggtgcattttgtggcctcttctgctgtggacaaacagaggagatgtccaatgcagaagaggaacctggcggcagcgcaaaagatg

SEQ ID NO: 198115 - DNA, 103 bp, Artificial Sequence
  Synthetic Polynucleotide
taatacgactcactatagggaggtggttaatgcattttgtggcctcttctaacagaggagaagaagaatgcacaaaatgaacctggcggcagcgcaaaagatg

SEQ ID NO: 198116 - DNA, 103 bp, Artificial Sequence
  Synthetic Polynucleotide
taatacgactcactatagggcgtcttgtgcaggtggttaatgcattttgtaacagaggagaacaaaaatgattaaccacaacctggcggcagcgcaaaagatg

SEQ ID NO: 198117 - DNA, 103 bp, Artificial Sequence
  Synthetic Polynucleotide
taatacgactcactatagggtgttgccgctcgagtccacattccgtttccaacagaggagaggaaacatgatgtggactaacctggcggcagcgcaaaagatg

SEQ ID NO: 198118 - DNA, 103 bp, Artificial Sequence
  Synthetic Polynucleotide
taatacgactcactatagggcgtggagctccgtcttgtgcaggtggttaaaacagaggagattaaccatgtgcacaagaaacctggcggcagcgcaaaagatg

SEQ ID NO: 198119 - DNA, 103 bp, Artificial Sequence
  Synthetic Polynucleotide
taatacgactcactatagggatcatctttccgtggagctccgtcttgtgcaacagaggagagcacaaatgggagctccaaacctggcggcagcgcaaaagatg

SEQ ID NO: 198120 - DNA, 103 bp, Artificial Sequence
  Synthetic Polynucleotide
taatacgactcactatagggctccacggagatcatctttccgtggagctcaacagaggagagagctcatgggaaagatgaacctggcggcagcgcaaaagatg

SEQ ID NO: 198121 - DNA, 103 bp, Artificial Sequence
  Synthetic Polynucleotide
taatacgactcactatagggttttggctttctccacggagatcatctttcaacagaggagagaaagaatgtctccgtggaacctggcggcagcgcaaaagatg

SEQ ID NO: 198122 - DNA, 103 bp, Artificial Sequence
  Synthetic Polynucleotide
taatacgactcactatagggacaggttcatttttggctttctccacggagaacagaggagactccgtatggaaagccaaaacctggcggcagcgcaaaagatg

SEQ ID NO: 198123 - DNA, 103 bp, Artificial Sequence
  Synthetic Polynucleotide
taatacgactcactatagggtttctttcccacaggttcatttttggctttaacagaggagaaaagccatgaatgaacctaacctggcggcagcgcaaaagatg

SEQ ID NO: 198124 - DNA, 103 bp, Artificial Sequence
  Synthetic Polynucleotide
taatacgactcactatagggtgtcagaggttttctttcccacaggttcataacagaggagaatgaacatgtgggaaagaaacctggcggcagcgcaaaagatg

SEQ ID NO: 198125 - DNA, 103 bp, Artificial Sequence
  Synthetic Polynucleotide
taatacgactcactatagggctgtctcttttgtcagaggttttctttcccaacagaggagagggaaaatgaacctctgaaacctggcggcagcgcaaaagatg

SEQ ID NO: 198126 - DNA, 103 bp, Artificial Sequence
  Synthetic Polynucleotide
taatacgactcactatagggtttcccgtcactgtctcttttgtcagaggtaacagaggagaacctctatgaaaagagacaacctggcggcagcgcaaaagatg

SEQ ID NO: 198127 - DNA, 103 bp, Artificial Sequence
  Synthetic Polynucleotide
taatacgactcactatagggacttctcctttttcccgtcactgtctctttaacagaggagaaaagagatggtgacgggaaacctggcggcagcgcaaaagatg

SEQ ID NO: 198128 - DNA, 103 bp, Artificial Sequence
  Synthetic Polynucleotide
taatacgactcactatagggaaaacgctcttgttgccgctcgagtccacaaacagaggagatgtggaatggagcggcaaaacctggcggcagcgcaaaagatg

SEQ ID NO: 198129 - DNA, 103 bp, Artificial Sequence
  Synthetic Polynucleotide
taatacgactcactatagggctgttgctcgacttctcctttttcccgtcaaacagaggagatgacggatgaaaggagaaaacctggcggcagcgcaaaagatg

SEQ ID NO: 198130 - DNA, 103 bp, Artificial Sequence
  Synthetic Polynucleotide
taatacgactcactatagggagatctgtcactgttgctcgacttctccttaacagaggagaaaggagatgtcgagcaacaacctggcggcagcgcaaaagatg

SEQ ID NO: 198131 - DNA, 103 bp, Artificial Sequence
  Synthetic Polynucleotide
taatacgactcactatagggtaaggtttgtagatctgtcactgttgctcgaacagaggagacgagcaatggtgacagataacctggcggcagcgcaaaagatg

SEQ ID NO: 198132 - DNA, 103 bp, Artificial Sequence
  Synthetic Polynucleotide
taatacgactcactatagggtcatccctcttaaggtttgtagatctgtcaaacagaggagatgacagatgtacaaacctaacctggcggcagcgcaaaagatg

SEQ ID NO: 198133 - DNA, 103 bp, Artificial Sequence
  Synthetic Polynucleotide
taatacgactcactataggggtcacatttatcatccctcttaaggtttgtaacagaggagaacaaacatgaagagggataacctggcggcagcgcaaaagatg

SEQ ID NO: 198134 - DNA, 103 bp, Artificial Sequence
  Synthetic Polynucleotide
taatacgactcactatagggcatcttttctgtcacatttatcatccctctaacagaggagaagagggatgataaatgtgaacctggcggcagcgcaaaagatg

SEQ ID NO: 198135 - DNA, 103 bp, Artificial Sequence
  Synthetic Polynucleotide
taatacgactcactatagggttcttagcatcatcttttctgtcacatttaaacagaggagataaatgatgcagaaaagaaacctggcggcagcgcaaaagatg

SEQ ID NO: 198136 - DNA, 103 bp, Artificial Sequence
  Synthetic Polynucleotide
taatacgactcactataggggtcgtcacccttcttagcatcatcttttctaacagaggagaagaaaaatggatgctaagaacctggcggcagcgcaaaagatg

SEQ ID NO: 198137 - DNA, 103 bp, Artificial Sequence
  Synthetic Polynucleotide
taatacgactcactatagggctccacttccgtcgtcacccttcttagcataacagaggagaatgctaatgagggtgacgaacctggcggcagcgcaaaagatg

SEQ ID NO: 198138 - DNA, 103 bp, Artificial Sequence
  Synthetic Polynucleotide
taatacgactcactatagggttactcttttctccacttccgtcgtcacccaacagaggagagggtgaatgcggaagtggaacctggcggcagcgcaaaagatg

SEQ ID NO: 198139 - DNA, 103 bp, Artificial Sequence
  Synthetic Polynucleotide
taatacgactcactatagggccgctccatcaaaacgctcttgttgccgctaacagaggagaagcggcatgaagagcgttaacctggcggcagcgcaaaagatg

SEQ ID NO: 198140 - DNA, 103 bp, Artificial Sequence
  Synthetic Polynucleotide
taatacgactcactatagggatcttggtccttactcttttctccacttccaacagaggagaggaagtatggaaaagagtaacctggcggcagcgcaaaagatg

SEQ ID NO: 198141 - DNA, 103 bp, Artificial Sequence
  Synthetic Polynucleotide
taatacgactcactataggggtttctgatcatcttggtccttactcttttaacagaggagaaaaagaatgaggaccaagaacctggcggcagcgcaaaagatg

SEQ ID NO: 198142 - DNA, 103 bp, Artificial Sequence
  Synthetic Polynucleotide
taatacgactcactataggggaggggccaggtttctgatcatcttggtccaacagaggagaggaccaatgtgatcagaaaacctggcggcagcgcaaaagatg

SEQ ID NO: 198143 - DNA, 103 bp, Artificial Sequence
  Synthetic Polynucleotide
taatacgactcactatagggagatcgctctgaggggccaggtttctgatcaacagaggagagatcagatgcctggccccaacctggcggcagcgcaaaagatg

SEQ ID NO: 198144 - DNA, 103 bp, Artificial Sequence
  Synthetic Polynucleotide
taatacgactcactatagggttgtggctcgagatcgctctgaggggccagaacagaggagactggccatgcagagcgataacctggcggcagcgcaaaagatg

SEQ ID NO: 198145 - DNA, 103 bp, Artificial Sequence
  Synthetic Polynucleotide
taatacgactcactatagggcttcctgactttgtggctcgagatcgctctaacagaggagaagagcgatgtcgagccacaacctggcggcagcgcaaaagatg

SEQ ID NO: 198146 - DNA, 103 bp, Artificial Sequence
  Synthetic Polynucleotide
taatacgactcactatagggggtccctcgacttcctgactttgtggctcgaacagaggagacgagccatgaagtcaggaaacctggcggcagcgcaaaagatg

SEQ ID NO: 198147 - DNA, 103 bp, Artificial Sequence
  Synthetic Polynucleotide
taatacgactcactatagggcagtccgttcggtccctcgacttcctgactaacagaggagaagtcagatggtcgagggaaacctggcggcagcgcaaaagatg

SEQ ID NO: 198148 - DNA, 103 bp, Artificial Sequence
  Synthetic Polynucleotide
taatacgactcactatagggtccattactacagtccgttcggtccctcgaaacagaggagatcgaggatgcgaacggacaacctggcggcagcgcaaaagatg

SEQ ID NO: 198149 - DNA, 103 bp, Artificial Sequence
  Synthetic Polynucleotide
taatacgactcactatagggtttggatttatccattactacagtccgttcaacagaggagagaacggatggtagtaatgaacctggcggcagcgcaaaagatg

SEQ ID NO: 198150 - DNA, 103 bp, Artificial Sequence
  Synthetic Polynucleotide
taatacgactcactatagggccttcttcagccgctccatcaaaacgctctaacagaggagaagagcgatgtgatggagcaacctggcggcagcgcaaaagatg

SEQ ID NO: 198151 - DNA, 103 bp, Artificial Sequence
  Synthetic Polynucleotide
taatacgactcactatagggcaggcacccctttggatttatccattactaaacagaggagatagtaaatgataaatccaaacctggcggcagcgcaaaagatg

SEQ ID NO: 198152 - DNA, 103 bp, Artificial Sequence
  Synthetic Polynucleotide
taatacgactcactatagggacactaatcacaggcacccctttggatttaaacagaggagataaatcatgaggggtgccaacctggcggcagcgcaaaagatg

SEQ ID NO: 198153 - DNA, 103 bp, Artificial Sequence
  Synthetic Polynucleotide
taatacgactcactatagggggacgtttttacactaatcacaggcaccccaacagaggagaggggtgatggtgattagtaacctggcggcagcgcaaaagatg

SEQ ID NO: 198154 - DNA, 103 bp, Artificial Sequence
  Synthetic Polynucleotide
taatacgactcactatagggctttggacccggacgtttttacactaatcaaacagaggagatgattaatgtaaaaacgtaacctggcggcagcgcaaaagatg

SEQ ID NO: 198155 - DNA, 103 bp, Artificial Sequence
  Synthetic Polynucleotide
taatacgactcactataggggaagctctctctttggacccggacgtttttaacagaggagaaaaaacatgcgggtccaaaacctggcggcagcgcaaaagatg

SEQ ID NO: 198156 - DNA, 103 bp, Artificial Sequence
  Synthetic Polynucleotide
taatacgactcactatagggctggcttttggaagctctctctttggacccaacagaggagagggtccatggagagagctaacctggcggcagcgcaaaagatg

SEQ ID NO: 198157 - DNA, 103 bp, Artificial Sequence
  Synthetic Polynucleotide
taatacgactcactatagggatttgcgatcctggcttttggaagctctctaacagaggagaagagagatgccaaaagccaacctggcggcagcgcaaaagatg

SEQ ID NO: 198158 - DNA, 103 bp, Artificial Sequence
  Synthetic Polynucleotide
taatacgactcactatagggctgctggctgatttgcgatcctggcttttgaacagaggagacaaaagatgggatcgcaaaacctggcggcagcgcaaaagatg

SEQ ID NO: 198159 - DNA, 103 bp, Artificial Sequence
  Synthetic Polynucleotide
taatacgactcactatagggccgcttctctctgctggctgatttgcgatcaacagaggagagatcgcatgtcagccagcaacctggcggcagcgcaaaagatg

SEQ ID NO: 198160 - DNA, 103 bp, Artificial Sequence
  Synthetic Polynucleotide
taatacgactcactatagggacacgacggaccgcttctctctgctggctgaacagaggagacagccaatggagagaagcaacctggcggcagcgcaaaagatg

SEQ ID NO: 198161 - DNA, 103 bp, Artificial Sequence
  Synthetic Polynucleotide
taatacgactcactatagggtcttcaattgccttcttcagccgctccatcaacagaggagagatggaatggctgaagaaaacctggcggcagcgcaaaagatg

SEQ ID NO: 198162 - DNA, 103 bp, Artificial Sequence
  Synthetic Polynucleotide
taatacgactcactatagggttatcaaaggacacgacggaccgcttctctaacagaggagaagagaaatggtccgtcgtaacctggcggcagcgcaaaagatg

SEQ ID NO: 198163 - DNA, 103 bp, Artificial Sequence
  Synthetic Polynucleotide
taatacgactcactatagggctccttgaccttatcaaaggacacgacggaaacagaggagatccgtcatgtcctttgataacctggcggcagcgcaaaagatg

SEQ ID NO: 198164 - DNA, 103 bp, Artificial Sequence
  Synthetic Polynucleotide
taatacgactcactatagggacttccgaggctccttgaccttatcaaaggaacagaggagacctttgatgaggtcaaggaacctggcggcagcgcaaaagatg

SEQ ID NO: 198165 - DNA, 103 bp, Artificial Sequence
  Synthetic Polynucleotide
taatacgactcactataggggagtctcttgacttccgaggctccttgaccaacagaggagaggtcaaatggcctcggaaaacctggcggcagcgcaaaagatg

SEQ ID NO: 198166 - DNA, 103 bp, Artificial Sequence
  Synthetic Polynucleotide
taatacgactcactatagggatgggactctgagtctcttgacttccgaggaacagaggagacctcggatgtcaagagacaacctggcggcagcgcaaaagatg

SEQ ID NO: 198167 - DNA, 103 bp, Artificial Sequence
  Synthetic Polynucleotide
taatacgactcactataggggcaccctgctatgggactctgagtctcttgaacagaggagacaagagatgcagagtcccaacctggcggcagcgcaaaagatg

SEQ ID NO: 198168 - DNA, 103 bp, Artificial Sequence
  Synthetic Polynucleotide
taatacgactcactatagggctgcgttcacgcaccctgctatgggactctaacagaggagaagagtcatgtagcagggtaacctggcggcagcgcaaaagatg

SEQ ID NO: 198169 - DNA, 103 bp, Artificial Sequence
  Synthetic Polynucleotide
taatacgactcactatagggttcgcgttcactgcgttcacgcaccctgctaacagaggagaagcaggatgcgtgaacgcaacctggcggcagcgcaaaagatg

SEQ ID NO: 198170 - DNA, 103 bp, Artificial Sequence
  Synthetic Polynucleotide
taatacgactcactataggggcatgcgttgttcgcgttcactgcgttcacaacagaggagagtgaacatggtgaacgcgaacctggcggcagcgcaaaagatg

SEQ ID NO: 198171 - DNA, 103 bp, Artificial Sequence
  Synthetic Polynucleotide
taatacgactcactatagggcactgcgcctgcatgcgttgttcgcgttcaaacagaggagatgaacgatgacaacgcataacctggcggcagcgcaaaagatg

SEQ ID NO: 198172 - DNA, 103 bp, Artificial Sequence
  Synthetic Polynucleotide
taatacgactcactatagggaccaccttcatcttcaattgccttcttcagaacagaggagactgaagatggcaattgaaaacctggcggcagcgcaaaagatg

SEQ ID NO: 198173 - DNA, 103 bp, Artificial Sequence
  Synthetic Polynucleotide
taatacgactcactatagggctcgcgctcccactgcgcctgcatgcgttgaacagaggagacaacgcatgcaggcgcagaacctggcggcagcgcaaaagatg

SEQ ID NO: 198174 - DNA, 103 bp, Artificial Sequence
  Synthetic Polynucleotide
taatacgactcactataggggctcacgctcctcgcgctcccactgcgcctaacagaggagaaggcgcatggggagcgcgaacctggcggcagcgcaaaagatg

SEQ ID NO: 198175 - DNA, 103 bp, Artificial Sequence
  Synthetic Polynucleotide
taatacgactcactatagggatctccagccgctcacgctcctcgcgctccaacagaggagaggagcgatgggagcgtgaaacctggcggcagcgcaaaagatg

SEQ ID NO: 198176 - DNA, 103 bp, Artificial Sequence
  Synthetic Polynucleotide
taatacgactcactatagggctctcgggcaatctccagccgctcacgctcaacagaggagagagcgtatgcggctggagaacctggcggcagcgcaaaagatg

SEQ ID NO: 198177 - DNA, 103 bp, Artificial Sequence
  Synthetic Polynucleotide
taatacgactcactatagggaggccagcctctctcgggcaatctccagccaacagaggagaggctggatgttgcccgagaacctggcggcagcgcaaaagatg

SEQ ID NO: 198178 - DNA, 103 bp, Artificial Sequence
  Synthetic Polynucleotide
taatacgactcactatagggtggcgctggaaggccagcctctctcgggcaaacagaggagatgcccgatggaggctggcaacctggcggcagcgcaaaagatg

SEQ ID NO: 198179 - DNA, 103 bp, Artificial Sequence
  Synthetic Polynucleotide
taatacgactcactatagggctccagccgctggcgctggaaggccagcctaacagaggagaaggctgatgttccagcgcaacctggcggcagcgcaaaagatg

SEQ ID NO: 198180 - DNA, 103 bp, Artificial Sequence
  Synthetic Polynucleotide
taatacgactcactatagggtgcgctcccgctccagccgctggcgctggaaacagaggagatccagcatgagcggctggaacctggcggcagcgcaaaagatg

SEQ ID NO: 198181 - DNA, 103 bp, Artificial Sequence
  Synthetic Polynucleotide
taatacgactcactatagggtcccgctccatgcgctcccgctccagccgcaacagaggagagcggctatggcgggagcgaacctggcggcagcgcaaaagatg

SEQ ID NO: 198182 - DNA, 103 bp, Artificial Sequence
  Synthetic Polynucleotide
taatacgactcactatagggctccagccgttcccgctccatgcgctcccgaacagaggagacgggagatgatggagcggaacctggcggcagcgcaaaagatg

SEQ ID NO: 198183 - DNA, 103 bp, Artificial Sequence
  Synthetic Polynucleotide
taatacgactcactatagggccgctccagaatcacctaggcctgacagagaacagaggagactctgtatggcctaggtgaacctggcggcagcgcaaaagatg

SEQ ID NO: 198184 - DNA, 103 bp, Artificial Sequence
  Synthetic Polynucleotide
taatacgactcactatagggcgtcaggattaccaccttcatcttcaattgaacagaggagacaattgatgatgaaggtgaacctggcggcagcgcaaaagatg

SEQ ID NO: 198185 - DNA, 103 bp, Artificial Sequence
  Synthetic Polynucleotide
taatacgactcactatagggtgcgttcgcgctccagccgttcccgctccaaacagaggagatggagcatgaacggctggaacctggcggcagcgcaaaagatg

SEQ ID NO: 198186 - DNA, 103 bp, Artificial Sequence
  Synthetic Polynucleotide
taatacgactcactatagggtccacgtgcatgcgttcgcgctccagccgtaacagaggagaacggctatggcgcgaacgaacctggcggcagcgcaaaagatg

SEQ ID NO: 198187 - DNA, 103 bp, Artificial Sequence
  Synthetic Polynucleotide
taatacgactcactataggggcgctcgtgctccacgtgcatgcgttcgcgaacagaggagacgcgaaatgatgcacgtgaacctggcggcagcgcaaaagatg

SEQ ID NO: 198188 - DNA, 103 bp, Artificial Sequence
  Synthetic Polynucleotide
taatacgactcactataggggctcgcgcctgcgctcgtgctccacgtgcaaacagaggagatgcacgatgagcacgagcaacctggcggcagcgcaaaagatg

SEQ ID NO: 198189 - DNA, 103 bp, Artificial Sequence
  Synthetic Polynucleotide
taatacgactcactatagggatgcgctcctgctcgcgcctgcgctcgtgcaacagaggagagcacgaatgcaggcgcgaaacctggcggcagcgcaaaagatg

SEQ ID NO: 198190 - DNA, 103 bp, Artificial Sequence
  Synthetic Polynucleotide
taatacgactcactatagggctcacggtggatgcgctcctgctcgcgcctaacagaggagaaggcgcatgcaggagcgcaacctggcggcagcgcaaaagatg

SEQ ID NO: 198191 - DNA, 103 bp, Artificial Sequence
  Synthetic Polynucleotide
taatacgactcactataggggctcctcgcgctcacggtggatgcgctcctaacagaggagaaggagcatgtccaccgtgaacctggcggcagcgcaaaagatg

SEQ ID NO: 198192 - DNA, 103 bp, Artificial Sequence
  Synthetic Polynucleotide
taatacgactcactatagggtggcgcctcagctcctcgcgctcacggtggaacagaggagaccaccgatggcgcgaggaaacctggcggcagcgcaaaagatg

SEQ ID NO: 198193 - DNA, 103 bp, Artificial Sequence
  Synthetic Polynucleotide
taatacgactcactatagggcagttcctgctggcgcctcagctcctcgcgaacagaggagacgcgagatgctgaggcgcaacctggcggcagcgcaaaagatg

SEQ ID NO: 198194 - DNA, 103 bp, Artificial Sequence
  Synthetic Polynucleotide
taatacgactcactataggggctcatagcgcagttcctgctggcgcctcaaacagaggagatgaggcatgagcaggaacaacctggcggcagcgcaaaagatg

SEQ ID NO: 198195 - DNA, 103 bp, Artificial Sequence
  Synthetic Polynucleotide
taatacgactcactatagggatttcaatttcgtcaggattaccaccttcaaacagaggagatgaaggatgtaatcctgaaacctggcggcagcgcaaaagatg

SEQ ID NO: 198196 - DNA, 103 bp, Artificial Sequence
  Synthetic Polynucleotide
taatacgactcactatagggcgccgctcctgctcatagcgcagttcctgcaacagaggagagcaggaatggcgctatgaaacctggcggcagcgcaaaagatg

SEQ ID NO: 198197 - DNA, 103 bp, Artificial Sequence
  Synthetic Polynucleotide
taatacgactcactatagggcaccgcgggccgccgctcctgctcatagcgaacagaggagacgctatatgcaggagcggaacctggcggcagcgcaaaagatg

SEQ ID NO: 198198 - DNA, 103 bp, Artificial Sequence
  Synthetic Polynucleotide
taatacgactcactatagggagggccgccgcaccgcgggccgccgctcctaacagaggagaaggagcatgggcccgcggaacctggcggcagcgcaaaagatg

SEQ ID NO: 198199 - DNA, 103 bp, Artificial Sequence
  Synthetic Polynucleotide
taatacgactcactatagggtccaggtcgtagggccgccgcaccgcgggcaacagaggagagcccgcatggcggcggccaacctggcggcagcgcaaaagatg

SEQ ID NO: 198200 - DNA, 103 bp, Artificial Sequence
  Synthetic Polynucleotide
taatacgactcactatagggatctcgccggtccaggtcgtagggccgccgaacagaggagacggcggatgtacgacctgaacctggcggcagcgcaaaagatg

SEQ ID NO: 198201 - DNA, 103 bp, Artificial Sequence
  Synthetic Polynucleotide
taatacgactcactatagggaataggcatcatctcgccggtccaggtcgtaacagaggagaacgaccatgaccggcgagaacctggcggcagcgcaaaagatg

SEQ ID NO: 198202 - DNA, 103 bp, Artificial Sequence
  Synthetic Polynucleotide
taatacgactcactataggggcttccggccaataggcatcatctcgccggaacagaggagaccggcgatgtgatgcctaaacctggcggcagcgcaaaagatg

SEQ ID NO: 198203 - DNA, 103 bp, Artificial Sequence
  Synthetic Polynucleotide
taatacgactcactatagggggcccgcttggcttccggccaataggcatcaacagaggagagatgccatgtggccggaaaacctggcggcagcgcaaaagatg

SEQ ID NO: 198204 - DNA, 103 bp, Artificial Sequence
  Synthetic Polynucleotide
taatacgactcactatagggcatccagggcggcccgcttggcttccggccaacagaggagaggccggatgccaagcgggaacctggcggcagcgcaaaagatg

SEQ ID NO: 198205 - DNA, 103 bp, Artificial Sequence
  Synthetic Polynucleotide
taatacgactcactatagggtggtagcgctcatccagggcggcccgcttgaacagaggagacaagcgatgcgccctggaaacctggcggcagcgcaaaagatg

SEQ ID NO: 198206 - DNA, 103 bp, Artificial Sequence
  Synthetic Polynucleotide
taatacgactcactatagggctcggaggtaatttcaatttcgtcaggattaacagaggagaaatcctatggaaattgaaaacctggcggcagcgcaaaagatg

SEQ ID NO: 198207 - DNA, 103 bp, Artificial Sequence
  Synthetic Polynucleotide
taatacgactcactatagggaaagtcagaatggtagcgctcatccagggcaacagaggagagccctgatggagcgctacaacctggcggcagcgcaaaagatg

SEQ ID NO: 198208 - DNA, 103 bp, Artificial Sequence
  Synthetic Polynucleotide
taatacgactcactatagggcctggcggttaaagtcagaatggtagcgctaacagaggagaagcgctatgattctgactaacctggcggcagcgcaaaagatg

SEQ ID NO: 198209 - DNA, 103 bp, Artificial Sequence
  Synthetic Polynucleotide
taatacgactcactatagggtggaagcggtcctggcggttaaagtcagaaaacagaggagattctgaatgtaaccgccaaacctggcggcagcgcaaaagatg

SEQ ID NO: 198210 - DNA, 103 bp, Artificial Sequence
  Synthetic Polynucleotide
taatacgactcactataggggtcaaagtcgtggaagcggtcctggcggttaacagaggagaaaccgcatggaccgcttcaacctggcggcagcgcaaaagatg

SEQ ID NO: 198211 - DNA, 103 bp, Artificial Sequence
  Synthetic Polynucleotide
taatacgactcactatagggggtccctgtggtcaaagtcgtggaagcggtaacagaggagaaccgctatgacgactttgaacctggcggcagcgcaaaagatg

SEQ ID NO: 198212 - DNA, 103 bp, Artificial Sequence
  Synthetic Polynucleotide
taatacgactcactatagggtagcggccgcggtccctgtggtcaaagtcgaacagaggagacgacttatgccacagggaaacctggcggcagcgcaaaagatg

SEQ ID NO: 198213 - DNA, 103 bp, Artificial Sequence
  Synthetic Polynucleotide
taatacgactcactataggggtggtcggggtagcggccgcggtccctgtgaacagaggagacacaggatgcgcggccgcaacctggcggcagcgcaaaagatg

SEQ ID NO: 198214 - DNA, 103 bp, Artificial Sequence
  Synthetic Polynucleotide
taatacgactcactatagggtgtccaccgagtggtcggggtagcggccgcaacagaggagagcggccatgaccccgaccaacctggcggcagcgcaaaagatg

SEQ ID NO: 198215 - DNA, 103 bp, Artificial Sequence
  Synthetic Polynucleotide
taatacgactcactatagggccttctctcctgtccaccgagtggtcggggaacagaggagaccccgaatgctcggtggaaacctggcggcagcgcaaaagatg

SEQ ID NO: 198216 - DNA, 103 bp, Artificial Sequence
  Synthetic Polynucleotide
taatacgactcactatagggtgaccttgaaccttctctcctgtccaccgaaacagaggagatcggtgatgaggagagaaaacctggcggcagcgcaaaagatg

SEQ ID NO: 198217 - DNA, 103 bp, Artificial Sequence
  Synthetic Polynucleotide
taatacgactcactatagggtcttgtttccctcggaggtaatttcaatttaacagaggagaaaattgatgttacctccgaacctggcggcagcgcaaaagatg

SEQ ID NO: 198218 - DNA, 103 bp, Artificial Sequence
  Synthetic Polynucleotide
taatacgactcactatagggctcccatcattgaccttgaaccttctctccaacagaggagaggagagatggttcaaggtaacctggcggcagcgcaaaagatg

SEQ ID NO: 198219 - DNA, 103 bp, Artificial Sequence
  Synthetic Polynucleotide
taatacgactcactatagggccttctcgttctcccatcattgaccttgaaaacagaggagattcaagatgaatgatgggaacctggcggcagcgcaaaagatg

SEQ ID NO: 198220 - DNA, 103 bp, Artificial Sequence
  Synthetic Polynucleotide
taatacgactcactataggggtaatgctgtccttctcgttctcccatcataacagaggagaatgatgatggaacgagaaaacctggcggcagcgcaaaagatg

SEQ ID NO: 198221 - DNA, 103 bp, Artificial Sequence
  Synthetic Polynucleotide
taatacgactcactatagggggcgttctgggtaatgctgtccttctcgttaacagaggagaaacgagatggacagcattaacctggcggcagcgcaaaagatg

SEQ ID NO: 198222 - DNA, 103 bp, Artificial Sequence
  Synthetic Polynucleotide
taatacgactcactatagggggtcctccatggcgttctgggtaatgctgtaacagaggagaacagcaatgcccagaacgaacctggcggcagcgcaaaagatg

SEQ ID NO: 198223 - DNA, 103 bp, Artificial Sequence
  Synthetic Polynucleotide
taatacgactcactataggggtggcgctctggtcctccatggcgttctggaacagaggagaccagaaatgcatggaggaaacctggcggcagcgcaaaagatg

SEQ ID NO: 198224 - DNA, 103 bp, Artificial Sequence
  Synthetic Polynucleotide
taatacgactcactatagggagtcccggccgtggcgctctggtcctccataacagaggagaatggagatgcagagcgccaacctggcggcagcgcaaaagatg

SEQ ID NO: 198225 - DNA, 103 bp, Artificial Sequence
  Synthetic Polynucleotide
taatacgactcactatagggccatcgcgggagtcccggccgtggcgctctaacagaggagaagagcgatgcggccgggaaacctggcggcagcgcaaaagatg

SEQ ID NO: 198226 - DNA, 103 bp, Artificial Sequence
  Synthetic Polynucleotide
taatacgactcactataggggcccccccagccatcgcgggagtcccggccaacagaggagaggccggatgtcccgcgataacctggcggcagcgcaaaagatg

SEQ ID NO: 198227 - DNA, 103 bp, Artificial Sequence
  Synthetic Polynucleotide
taatacgactcactatagggcagagccatagcccccccagccatcgcgggaacagaggagacccgcgatggctggggggaacctggcggcagcgcaaaagatg

SEQ ID NO: 198228 - DNA, 103 bp, Artificial Sequence
  Synthetic Polynucleotide
taatacgactcactatagggtttgatgttttcttgtttccctcggaggtaaacagaggagatacctcatggggaaacaaaacctggcggcagcgcaaaagatg

SEQ ID NO: 198229 - DNA, 103 bp, Artificial Sequence
  Synthetic Polynucleotide
taatacgactcactatagggatcctcttgtcagagccatagcccccccagaacagaggagactggggatgctatggctcaacctggcggcagcgcaaaagatg

SEQ ID NO: 198230 - DNA, 103 bp, Artificial Sequence
  Synthetic Polynucleotide
taatacgactcactataggggccctcgctcatcctcttgtcagagccataaacagaggagatatggcatggacaagaggaacctggcggcagcgcaaaagatg

SEQ ID NO: 198231 - DNA, 103 bp, Artificial Sequence
  Synthetic Polynucleotide
taatacgactcactataggggcagcccccggccctcgctcatcctcttgtaacagaggagaacaagaatgtgagcgaggaacctggcggcagcgcaaaagatg

SEQ ID NO: 198232 - DNA, 103 bp, Artificial Sequence
  Synthetic Polynucleotide
taatacgactcactataggggggggaggaggcagcccccggccctcgctcaacagaggagagagcgaatgccgggggctaacctggcggcagcgcaaaagatg

SEQ ID NO: 198233 - DNA, 103 bp, Artificial Sequence
  Synthetic Polynucleotide
taatacgactcactataggggtcacgtctggggggaggaggcagcccccgaacagaggagacgggggatgcctcctcccaacctggcggcagcgcaaaagatg

SEQ ID NO: 198234 - DNA, 103 bp, Artificial Sequence
  Synthetic Polynucleotide
taatacgactcactatagggggtccccccagtcacgtctggggggaggagaacagaggagactcctcatgccagacgtgaacctggcggcagcgcaaaagatg

SEQ ID NO: 198235 - DNA, 103 bp, Artificial Sequence
  Synthetic Polynucleotide
taatacgactcactatagggcttcggccatggtccccccagtcacgtctgaacagaggagacagacgatgctggggggaaacctggcggcagcgcaaaagatg

SEQ ID NO: 198236 - DNA, 103 bp, Artificial Sequence
  Synthetic Polynucleotide
taatacgactcactataggggtcatcctctcttcggccatggtccccccaaacagaggagatgggggatgcatggccgaaacctggcggcagcgcaaaagatg

SEQ ID NO: 198237 - DNA, 103 bp, Artificial Sequence
  Synthetic Polynucleotide
taatacgactcactataggggccatgaccggtcatcctctcttcggccataacagaggagaatggccatggagaggatgaacctggcggcagcgcaaaagatg

SEQ ID NO: 198238 - DNA, 103 bp, Artificial Sequence
  Synthetic Polynucleotide
taatacgactcactataggggccgtgccctgccatgaccggtcatcctctaacagaggagaagaggaatgccggtcatgaacctggcggcagcgcaaaagatg

SEQ ID NO: 198239 - DNA, 103 bp, Artificial Sequence
  Synthetic Polynucleotide
taatacgactcactataggggctagacctctttgatgttttcttgtttccaacagaggagaggaaacatgaaaacatcaaacctggcggcagcgcaaaagatg

SEQ ID NO: 198240 - DNA, 103 bp, Artificial Sequence
  Synthetic Polynucleotide
taatacgactcactataggggcccccgtcggccgtgccctgccatgaccgaacagaggagacggtcaatgcagggcacgaacctggcggcagcgcaaaagatg

SEQ ID NO: 198241 - DNA, 103 bp, Artificial Sequence
  Synthetic Polynucleotide
taatacgactcactatagggtgtccatcatgcccccgtcggccgtgccctaacagaggagaagggcaatgccgacggggaacctggcggcagcgcaaaagatg

SEQ ID NO: 198242 - DNA, 103 bp, Artificial Sequence
  Synthetic Polynucleotide
taatacgactcactatagggttgtgatccctgtccatcatgcccccgtcgaacagaggagacgacggatgcatgatggaaacctggcggcagcgcaaaagatg

SEQ ID NO: 198243 - DNA, 103 bp, Artificial Sequence
  Synthetic Polynucleotide
taatacgactcactatagggttgccacctcttgtgatccctgtccatcataacagaggagaatgatgatgagggatcacaacctggcggcagcgcaaaagatg

SEQ ID NO: 198244 - DNA, 103 bp, Artificial Sequence
  Synthetic Polynucleotide
taatacgactcactatagggtctcgccaccttgccacctcttgtgatcccaacagaggagagggatcatgagaggtggcaacctggcggcagcgcaaaagatg

SEQ ID NO: 198245 - DNA, 103 bp, Artificial Sequence
  Synthetic Polynucleotide
taatacgactcactataggggacatgcttctctcgccaccttgccacctcaacagaggagagaggtgatgaggtggcgaaacctggcggcagcgcaaaagatg

SEQ ID NO: 198246 - DNA, 103 bp, Artificial Sequence
  Synthetic Polynucleotide
taatacgactcactatagggggagtgaccggacatgcttctctcgccaccaacagaggagaggtggcatgagaagcatgaacctggcggcagcgcaaaagatg

SEQ ID NO: 198247 - DNA, 103 bp, Artificial Sequence
  Synthetic Polynucleotide
taatacgactcactatagggggccaggcccggagtgaccggacatgcttcaacagaggagagaagcaatgccggtcactaacctggcggcagcgcaaaagatg

SEQ ID NO: 198248 - DNA, 103 bp, Artificial Sequence
  Synthetic Polynucleotide
taatacgactcactatagggttcatcatgtggccaggcccggagtgaccgaacagaggagacggtcaatgcgggcctggaacctggcggcagcgcaaaagatg

SEQ ID NO: 198249 - DNA, 103 bp, Artificial Sequence
  Synthetic Polynucleotide
taatacgactcactatagggtcctcctcggttcatcatgtggccaggcccaacagaggagagggcctatgcacatgatgaacctggcggcagcgcaaaagatg

SEQ ID NO: 198250 - DNA, 103 bp, Artificial Sequence
  Synthetic Polynucleotide
taatacgactcactatagggtgcgccctttgctagacctctttgatgtttaacagaggagaaaacatatgagaggtctaaacctggcggcagcgcaaaagatg

SEQ ID NO: 198251 - DNA, 103 bp, Artificial Sequence
  Synthetic Polynucleotide
taatacgactcactataggggccctgacattcctcctcggttcatcatgtaacagaggagaacatgaatgaccgaggagaacctggcggcagcgcaaaagatg

SEQ ID NO: 198252 - DNA, 103 bp, Artificial Sequence
  Synthetic Polynucleotide
taatacgactcactatagggaagctgccgcgccctgacattcctcctcggaacagaggagaccgaggatgaatgtcaggaacctggcggcagcgcaaaagatg

SEQ ID NO: 198253 - DNA, 103 bp, Artificial Sequence
  Synthetic Polynucleotide
taatacgactcactataggggcctggggcaaagctgccgcgccctgacataacagaggagaatgtcaatgcgcggcagcaacctggcggcagcgcaaaagatg

SEQ ID NO: 198254 - DNA, 103 bp, Artificial Sequence
  Synthetic Polynucleotide
taatacgactcactataggggggaggccccgcctggggcaaagctgccgcaacagaggagagcggcaatgttgccccagaacctggcggcagcgcaaaagatg

SEQ ID NO: 198255 - DNA, 103 bp, Artificial Sequence
  Synthetic Polynucleotide
taatacgactcactataggggggtggccccgggaggccccgcctggggcaaacagaggagatgccccatgcggggcctcaacctggcggcagcgcaaaagatg

SEQ ID NO: 198256 - DNA, 103 bp, Artificial Sequence
  Synthetic Polynucleotide
taatacgactcactataggggtgtgggatggggtggccccgggaggccccaacagaggagaggggccatgcggggccacaacctggcggcagcgcaaaagatg

SEQ ID NO: 198257 - DNA, 103 bp, Artificial Sequence
  Synthetic Polynucleotide
taatacgactcactataggggcatgccaccgtgtgggatggggtggccccaacagaggagaggggccatgccatcccacaacctggcggcagcgcaaaagatg

SEQ ID NO: 198258 - DNA, 103 bp, Artificial Sequence
  Synthetic Polynucleotide
taatacgactcactatagggaacccgccctgcatgccaccgtgtgggatgaacagaggagacatcccatgcggtggcataacctggcggcagcgcaaaagatg

SEQ ID NO: 198259 - DNA, 103 bp, Artificial Sequence
  Synthetic Polynucleotide
taatacgactcactatagggctggcctccaaacccgccctgcatgccaccaacagaggagaggtggcatgcagggcgggaacctggcggcagcgcaaaagatg

SEQ ID NO: 198260 - DNA, 103 bp, Artificial Sequence
  Synthetic Polynucleotide
taatacgactcactatagggtcccccggctctggcctccaaacccgccctaacagaggagaagggcgatgttggaggccaacctggcggcagcgcaaaagatg

SEQ ID NO: 198261 - DNA, 103 bp, Artificial Sequence
  Synthetic Polynucleotide
taatacgactcactatagggtcttctggtttgcgccctttgctagacctcaacagaggagagaggtcatgcaaagggcgaacctggcggcagcgcaaaagatg

SEQ ID NO: 198262 - DNA, 103 bp, Artificial Sequence
  Synthetic Polynucleotide
taatacgactcactatagggctgggcctgctcccccggctctggcctccaaacagaggagatggaggatggagccggggaacctggcggcagcgcaaaagatg

SEQ ID NO: 198263 - DNA, 103 bp, Artificial Sequence
  Synthetic Polynucleotide
taatacgactcactataggggcgggcatcgctgggcctgctcccccggctaacagaggagaagccggatgagcaggcccaacctggcggcagcgcaaaagatg

SEQ ID NO: 198264 - DNA, 103 bp, Artificial Sequence
  Synthetic Polynucleotide
taatacgactcactatagggggcgagtgaagcgggcatcgctgggcctgcaacagaggagagcaggcatggcgatgcccaacctggcggcagcgcaaaagatg

SEQ ID NO: 198265 - DNA, 103 bp, Artificial Sequence
  Synthetic Polynucleotide
taatacgactcactatagggcacaccctcttcttctggtttgcgccctttaacagaggagaaaagggatgaaaccagaaaacctggcggcagcgcaaaagatg

SEQ ID NO: 198266 - DNA, 103 bp, Artificial Sequence
  Synthetic Polynucleotide
taatacgactcactatagggcgttatcttccacaccctcttcttctggttaacagaggagaaaccagatgaagagggtgaacctggcggcagcgcaaaagatg

SEQ ID NO: 198267 - DNA, 103 bp, Artificial Sequence
  Synthetic Polynucleotide
taatacgactcactataggggccgcgcccgccgctccagaatcacctaggaacagaggagacctaggatgttctggagcaacctggcggcagcgcaaaagatg

SEQ ID NO: 198268 - DNA, 103 bp, Artificial Sequence
  Synthetic Polynucleotide
taatacgactcactatagggtcctccagcccgttatcttccacaccctctaacagaggagaagagggatgggaagataaaacctggcggcagcgcaaaagatg

SEQ ID NO: 198269 - DNA, 103 bp, Artificial Sequence
  Synthetic Polynucleotide
taatacgactcactatagggcccagagttttcctccagcccgttatcttcaacagaggagagaagatatggggctggagaacctggcggcagcgcaaaagatg

SEQ ID NO: 198270 - DNA, 103 bp, Artificial Sequence
  Synthetic Polynucleotide
taatacgactcactatagggcctgtccatccccagagttttcctccagccaacagaggagaggctggatgaaaactctgaacctggcggcagcgcaaaagatg

SEQ ID NO: 198271 - DNA, 103 bp, Artificial Sequence
  Synthetic Polynucleotide
taatacgactcactatagggtcaacatcctcctgtccatccccagagtttaacagaggagaaaactcatgggatggacaaacctggcggcagcgcaaaagatg

SEQ ID NO: 198272 - DNA, 103 bp, Artificial Sequence
  Synthetic Polynucleotide
taatacgactcactatagggcagactggtctcaacatcctcctgtccatcaacagaggagagatggaatggaggatgttaacctggcggcagcgcaaaagatg

SEQ ID NO: 198273 - DNA, 103 bp, Artificial Sequence
  Synthetic Polynucleotide
taatacgactcactataggggcaagttctccagactggtctcaacatcctaacagaggagaaggatgatgagaccagtcaacctggcggcagcgcaaaagatg

SEQ ID NO: 198274 - DNA, 103 bp, Artificial Sequence
  Synthetic Polynucleotide
taatacgactcactatagggtcgatgtcctgcaagttctccagactggtcaacagaggagagaccagatgggagaacttaacctggcggcagcgcaaaagatg

SEQ ID NO: 198275 - DNA, 103 bp, Artificial Sequence
  Synthetic Polynucleotide
taatacgactcactatagggatccatgatgtcgatgtcctgcaagttctcaacagaggagagagaacatgcaggacatcaacctggcggcagcgcaaaagatg

SEQ ID NO: 198276 - DNA, 103 bp, Artificial Sequence
  Synthetic Polynucleotide
taatacgactcactatagggacacactgatatccatgatgtcgatgtcctaacagaggagaaggacaatgacatcatggaacctggcggcagcgcaaaagatg

SEQ ID NO: 198277 - DNA, 103 bp, Artificial Sequence
  Synthetic Polynucleotide
taatacgactcactataggggcttcatccaacacactgatatccatgatgaacagaggagacatcatatgtatcagtgtaacctggcggcagcgcaaaagatg

SEQ ID NO: 198278 - DNA, 103 bp, Artificial Sequence
  Synthetic Polynucleotide
taatacgactcactataggggctcagagccgccgcgcccgccgctccagaaacagaggagatctggaatggcgggcgcgaacctggcggcagcgcaaaagatg

SEQ ID NO: 198279 - DNA, 103 bp, Artificial Sequence
  Synthetic Polynucleotide
taatacgactcactatagggatcaatttctgcttcatccaacacactgataacagaggagaatcagtatgttggatgaaaacctggcggcagcgcaaaagatg

SEQ ID NO: 198280 - DNA, 103 bp, Artificial Sequence
  Synthetic Polynucleotide
taatacgactcactatagggcgcttccattatcaatttctgcttcatccaaacagaggagatggatgatgcagaaattgaacctggcggcagcgcaaaagatg

SEQ ID NO: 198281 - DNA, 103 bp, Artificial Sequence
  Synthetic Polynucleotide
taatacgactcactatagggcaatctgcaacgcttccattatcaatttctaacagaggagaagaaatatgtaatggaagaacctggcggcagcgcaaaagatg

SEQ ID NO: 198282 - DNA, 103 bp, Artificial Sequence
  Synthetic Polynucleotide
taatacgactcactataggggtcttcgacacaatctgcaacgcttccattaacagaggagaaatggaatggttgcagataacctggcggcagcgcaaaagatg

SEQ ID NO: 198283 - DNA, 103 bp, Artificial Sequence
  Synthetic Polynucleotide
taatacgactcactatagggcagcatcatcgtcttcgacacaatctgcaaaacagaggagattgcagatggtgtcgaagaacctggcggcagcgcaaaagatg

SEQ ID NO: 198284 - DNA, 103 bp, Artificial Sequence
  Synthetic Polynucleotide
taatacgactcactatagggtggaggttatcagcatcatcgtcttcgacaaacagaggagatgtcgaatgcgatgatgcaacctggcggcagcgcaaaagatg

SEQ ID NO: 198285 - DNA, 103 bp, Artificial Sequence
  Synthetic Polynucleotide
taatacgactcactatagggcagggactcctggaggttatcagcatcatcaacagaggagagatgatatggataacctcaacctggcggcagcgcaaaagatg

SEQ ID NO: 198286 - DNA, 103 bp, Artificial Sequence
  Synthetic Polynucleotide
taatacgactcactatagggtactatccgacagggactcctggaggttataacagaggagaataaccatgaggagtcccaacctggcggcagcgcaaaagatg

SEQ ID NO: 198287 - DNA, 103 bp, Artificial Sequence
  Synthetic Polynucleotide
taatacgactcactatagggactagctctctactatccgacagggactccaacagaggagaggagtcatggtcggatagaacctggcggcagcgcaaaagatg

SEQ ID NO: 198288 - DNA, 103 bp, Artificial Sequence
  Synthetic Polynucleotide
taatacgactcactatagggttccccctcgactagctctctactatccgaaacagaggagatcggatatgagagagctaaacctggcggcagcgcaaaagatg

SEQ ID NO: 198289 - DNA, 103 bp, Artificial Sequence
  Synthetic Polynucleotide
taatacgactcactatagggacgaggcggagctcagagccgccgcgcccgaacagaggagacgggcgatgcggctctgaaacctggcggcagcgcaaaagatg

SEQ ID NO: 198290 - DNA, 103 bp, Artificial Sequence
  Synthetic Polynucleotide
taatacgactcactataggggctctttcatttccccctcgactagctctcaacagaggagagagagcatgtcgagggggaacctggcggcagcgcaaaagatg

SEQ ID NO: 198291 - DNA, 103 bp, Artificial Sequence
  Synthetic Polynucleotide
taatacgactcactatagggtgctccggaagctctttcatttccccctcgaacagaggagacgagggatgaatgaaagaaacctggcggcagcgcaaaagatg

SEQ ID NO: 198292 - DNA, 103 bp, Artificial Sequence
  Synthetic Polynucleotide
taatacgactcactatagggttcctgaagctgctccggaagctctttcataacagaggagaatgaaaatgcttccggagaacctggcggcagcgcaaaagatg

SEQ ID NO: 198293 - DNA, 103 bp, Artificial Sequence
  Synthetic Polynucleotide
taatacgactcactatagggctatagcatgttcctgaagctgctccggaaaacagaggagattccggatgagcttcaggaacctggcggcagcgcaaaagatg

SEQ ID NO: 198294 - DNA, 103 bp, Artificial Sequence
  Synthetic Polynucleotide
taatacgactcactatagggtctttgtcctctatagcatgttcctgaagcaacagaggagagcttcaatgacatgctataacctggcggcagcgcaaaagatg

SEQ ID NO: 198295 - DNA, 103 bp, Artificial Sequence
  Synthetic Polynucleotide
taatacgactcactataggggtttatagtttctttgtcctctatagcatgaacagaggagacatgctatggaggacaaaaacctggcggcagcgcaaaagatg

SEQ ID NO: 198296 - DNA, 103 bp, Artificial Sequence
  Synthetic Polynucleotide
taatacgactcactatagggtatctaaattgtttatagtttctttgtcctaacagaggagaaggacaatgaaactataaaacctggcggcagcgcaaaagatg

SEQ ID NO: 198297 - DNA, 103 bp, Artificial Sequence
  Synthetic Polynucleotide
taatacgactcactataggggatgatgaagtatctaaattgtttatagttaacagaggagaaactatatgcaatttagaaacctggcggcagcgcaaaagatg

SEQ ID NO: 198298 - DNA, 103 bp, Artificial Sequence
  Synthetic Polynucleotide
taatacgactcactatagggagtgaagtcagatgatgaagtatctaaattaacagaggagaaatttaatgacttcatcaaacctggcggcagcgcaaaagatg

SEQ ID NO: 198299 - DNA, 103 bp, Artificial Sequence
  Synthetic Polynucleotide
taatacgactcactatagggcctgtaatatagtgaagtcagatgatgaagaacagaggagacttcatatgctgacttcaaacctggcggcagcgcaaaagatg

SEQ ID NO: 198300 - DNA, 103 bp, Artificial Sequence
  Synthetic Polynucleotide
taatacgactcactatagggccggtctctgacgaggcggagctcagagccaacagaggagaggctctatgctccgcctcaacctggcggcagcgcaaaagatg

SEQ ID NO: 198301 - DNA, 103 bp, Artificial Sequence
  Synthetic Polynucleotide
taatacgactcactatagggtcttcaatttcctgtaatatagtgaagtcaaacagaggagatgacttatgtatattacaaacctggcggcagcgcaaaagatg

SEQ ID NO: 198302 - DNA, 103 bp, Artificial Sequence
  Synthetic Polynucleotide
taatacgactcactatagggcagggatggctcttcaatttcctgtaatataacagaggagaatattaatggaaattgaaaacctggcggcagcgcaaaagatg

SEQ ID NO: 198303 - DNA, 103 bp, Artificial Sequence
  Synthetic Polynucleotide
taatacgactcactatagggtttctggctccagggatggctcttcaatttaacagaggagaaaattgatgagccatcccaacctggcggcagcgcaaaagatg

SEQ ID NO: 198304 - DNA, 103 bp, Artificial Sequence
  Synthetic Polynucleotide
taatacgactcactatagggattttctcattttctggctccagggatggcaacagaggagagccatcatgggagccagaaacctggcggcagcgcaaaagatg

SEQ ID NO: 198305 - DNA, 103 bp, Artificial Sequence
  Synthetic Polynucleotide
taatacgactcactatagggaatgtcgagtattttctcattttctggctcaacagaggagagagccaatgaatgagaaaaacctggcggcagcgcaaaagatg

SEQ ID NO: 198306 - DNA, 103 bp, Artificial Sequence
  Synthetic Polynucleotide
taatacgactcactatagggtttcccccaaaatgtcgagtattttctcataacagaggagaatgagaatgtactcgacaaacctggcggcagcgcaaaagatg

SEQ ID NO: 198307 - DNA, 103 bp, Artificial Sequence
  Synthetic Polynucleotide
taatacgactcactataggggatttacaagtttcccccaaaatgtcgagtaacagaggagaactcgaatgtttgggggaaacctggcggcagcgcaaaagatg

SEQ ID NO: 198308 - DNA, 103 bp, Artificial Sequence
  Synthetic Polynucleotide
taatacgactcactatagggtactggctcagatttacaagtttcccccaaaacagaggagattggggatgacttgtaaaaacctggcggcagcgcaaaagatg

SEQ ID NO: 198309 - DNA, 103 bp, Artificial Sequence
  Synthetic Polynucleotide
taatacgactcactatagggtttcttcttttactggctcagatttacaagaacagaggagacttgtaatgctgagccagaacctggcggcagcgcaaaagatg

SEQ ID NO: 198310 - DNA, 103 bp, Artificial Sequence
  Synthetic Polynucleotide
taatacgactcactatagggagctcggaactttcttcttttactggctcaaacagaggagatgagccatgaaaagaagaaacctggcggcagcgcaaaagatg

SEQ ID NO: 198311 - DNA, 103 bp, Artificial Sequence
  Synthetic Polynucleotide
taatacgactcactataggggcgccgcgtcccggtctctgacgaggcggaaacagaggagatccgccatgtcagagaccaacctggcggcagcgcaaaagatg

SEQ ID NO: 198312 - DNA, 103 bp, Artificial Sequence
  Synthetic Polynucleotide
taatacgactcactatagggtggctgctccagctcggaactttcttctttaacagaggagaaaagaaatgagttccgagaacctggcggcagcgcaaaagatg

SEQ ID NO: 198313 - DNA, 103 bp, Artificial Sequence
  Synthetic Polynucleotide
taatacgactcactatagggcctgtgcaaatggctgctccagctcggaacaacagaggagagttccgatgtggagcagcaacctggcggcagcgcaaaagatg

SEQ ID NO: 198314 - DNA, 103 bp, Artificial Sequence
  Synthetic Polynucleotide
taatacgactcactatagggctacttgtgtcctgtgcaaatggctgctccaacagaggagaggagcaatgatttgcacaaacctggcggcagcgcaaaagatg

SEQ ID NO: 198315 - DNA, 103 bp, Artificial Sequence
  Synthetic Polynucleotide
taatacgactcactatagggtggccccacgctacttgtgtcctgtgcaaaaacagaggagatttgcaatggacacaagtaacctggcggcagcgcaaaagatg

SEQ ID NO: 198316 - DNA, 103 bp, Artificial Sequence
  Synthetic Polynucleotide
taatacgactcactataggggctttctgtctggccccacgctacttgtgtaacagaggagaacacaaatggcgtggggcaacctggcggcagcgcaaaagatg

SEQ ID NO: 198317 - DNA, 103 bp, Artificial Sequence
  Synthetic Polynucleotide
taatacgactcactatagggtcctccgcaagctttctgtctggccccacgaacagaggagacgtgggatgagacagaaaaacctggcggcagcgcaaaagatg

SEQ ID NO: 198318 - DNA, 103 bp, Artificial Sequence
  Synthetic Polynucleotide
taatacgactcactatagggtaggtcctcttcctccgcaagctttctgtcaacagaggagagacagaatgcttgcggagaacctggcggcagcgcaaaagatg

SEQ ID NO: 198319 - DNA, 103 bp, Artificial Sequence
  Synthetic Polynucleotide
taatacgactcactatagggcgctgtcaaataggtcctcttcctccgcaaaacagaggagattgcggatgaagaggaccaacctggcggcagcgcaaaagatg

SEQ ID NO: 198320 - DNA, 103 bp, Artificial Sequence
  Synthetic Polynucleotide
taatacgactcactatagggtccggatgggcgctgtcaaataggtcctctaacagaggagaagaggaatgatttgacagaacctggcggcagcgcaaaagatg

SEQ ID NO: 198321 - DNA, 103 bp, Artificial Sequence
  Synthetic Polynucleotide
taatacgactcactatagggatcaccctcttccggatgggcgctgtcaaaaacagaggagatttgacatggcccatccgaacctggcggcagcgcaaaagatg

SEQ ID NO: 198322 - DNA, 103 bp, Artificial Sequence
  Synthetic Polynucleotide
taatacgactcactatagggggtcgctgaggcgccgcgtcccggtctctgaacagaggagacagagaatgggacgcggcaacctggcggcagcgcaaaagatg

SEQ ID NO: 198323 - DNA, 103 bp, Artificial Sequence
  Synthetic Polynucleotide
taatacgactcactatagggccaaatctaaatcaccctcttccggatgggaacagaggagacccatcatgaagagggtgaacctggcggcagcgcaaaagatg

SEQ ID NO: 198324 - DNA, 103 bp, Artificial Sequence
  Synthetic Polynucleotide
taatacgactcactataggggactcgctggccaaatctaaatcaccctctaacagaggagaagagggatgtttagatttaacctggcggcagcgcaaaagatg

SEQ ID NO: 198325 - DNA, 103 bp, Artificial Sequence
  Synthetic Polynucleotide
taatacgactcactataggggtgtgctgttgactcgctggccaaatctaaaacagaggagattagatatggccagcgagaacctggcggcagcgcaaaagatg

SEQ ID NO: 198326 - DNA, 103 bp, Artificial Sequence
  Synthetic Polynucleotide
taatacgactcactatagggtcgactgagcgtgtgctgttgactcgctggaacagaggagaccagcgatgcaacagcacaacctggcggcagcgcaaaagatg

SEQ ID NO: 198327 - DNA, 103 bp, Artificial Sequence
  Synthetic Polynucleotide
taatacgactcactatagggtctgccttgctcgactgagcgtgtgctgttaacagaggagaaacagcatgcgctcagtcaacctggcggcagcgcaaaagatg

SEQ ID NO: 198328 - DNA, 103 bp, Artificial Sequence
  Synthetic Polynucleotide
taatacgactcactatagggtaacaggctgtctgccttgctcgactgagcaacagaggagagctcagatgagcaaggcaaacctggcggcagcgcaaaagatg

SEQ ID NO: 198329 - DNA, 103 bp, Artificial Sequence
  Synthetic Polynucleotide
taatacgactcactatagggtcactaccgctaacaggctgtctgccttgcaacagaggagagcaaggatgacagcctgtaacctggcggcagcgcaaaagatg

SEQ ID NO: 198330 - DNA, 103 bp, Artificial Sequence
  Synthetic Polynucleotide
taatacgactcactatagggggctcccttttcactaccgctaacaggctgaacagaggagacagcctatgagcggtagtaacctggcggcagcgcaaaagatg

SEQ ID NO: 198331 - DNA, 103 bp, Artificial Sequence
  Synthetic Polynucleotide
taatacgactcactatagggctgctccgcgggctcccttttcactaccgcaacagaggagagcggtaatgaaaagggagaacctggcggcagcgcaaaagatg

SEQ ID NO: 198332 - DNA, 103 bp, Artificial Sequence
  Synthetic Polynucleotide
taatacgactcactatagggcatcgcctggctgctccgcgggctccctttaacagaggagaaaagggatgccgcggagcaacctggcggcagcgcaaaagatg

SEQ ID NO: 198333 - DNA, 103 bp, Artificial Sequence
  Synthetic Polynucleotide
taatacgactcactatagggatcactcgcaggtcgctgaggcgccgcgtcaacagaggagagacgcgatgcctcagcgaaacctggcggcagcgcaaaagatg

SEQ ID NO: 198334 - DNA, 103 bp, Artificial Sequence
  Synthetic Polynucleotide
taatacgactcactataggggtcctctcgccatcgcctggctgctccgcgaacagaggagacgcggaatggccaggcgaaacctggcggcagcgcaaaagatg

SEQ ID NO: 198335 - DNA, 103 bp, Artificial Sequence
  Synthetic Polynucleotide
taatacgactcactatagggctcacagtccgtcctctcgccatcgcctggaacagaggagaccaggcatgggcgagaggaacctggcggcagcgcaaaagatg

SEQ ID NO: 198336 - DNA, 103 bp, Artificial Sequence
  Synthetic Polynucleotide
taatacgactcactataggggccctacaggctcacagtccgtcctctcgcaacagaggagagcgagaatgcggactgtgaacctggcggcagcgcaaaagatg

SEQ ID NO: 198337 - DNA, 103 bp, Artificial Sequence
  Synthetic Polynucleotide
taatacgactcactataggggccggctctagccctacaggctcacagtccaacagaggagaggactgatggcctgtaggaacctggcggcagcgcaaaagatg

SEQ ID NO: 198338 - DNA, 103 bp, Artificial Sequence
  Synthetic Polynucleotide
taatacgactcactatagggctgctcaactgccggctctagccctacaggaacagaggagacctgtaatgctagagccgaacctggcggcagcgcaaaagatg

SEQ ID NO: 198339 - DNA, 103 bp, Artificial Sequence
  Synthetic Polynucleotide
taatacgactcactatagggccgcactactctgctcaactgccggctctaaacagaggagatagagcatgcagttgagcaacctggcggcagcgcaaaagatg

SEQ ID NO: 198340 - DNA, 103 bp, Artificial Sequence
  Synthetic Polynucleotide
taatacgactcactatagggagctcggaggccgcactactctgctcaactaacagaggagaagttgaatggagtagtgcaacctggcggcagcgcaaaagatg

SEQ ID NO: 198341 - DNA, 103 bp, Artificial Sequence
  Synthetic Polynucleotide
taatacgactcactatagggggcctccgcgagctcggaggccgcactactaacagaggagaagtagtatggcctccgagaacctggcggcagcgcaaaagatg

SEQ ID NO: 198342 - DNA, 103 bp, Artificial Sequence
  Synthetic Polynucleotide
taatacgactcactatagggcctcgctagaggcctccgcgagctcggaggaacagaggagacctccgatgtcgcggaggaacctggcggcagcgcaaaagatg

SEQ ID NO: 198343 - DNA, 103 bp, Artificial Sequence
  Synthetic Polynucleotide
taatacgactcactatagggtctgcgagctcctcgctagaggcctccgcgaacagaggagacgcggaatgctctagcgaaacctggcggcagcgcaaaagatg

SEQ ID NO: 198344 - DNA, 103 bp, Artificial Sequence
  Synthetic Polynucleotide
taatacgactcactatagggttgaggcttcgcttgcttcctccgcgacataacagaggagaatgtcgatgaggaagcaaaacctggcggcagcgcaaaagatg

SEQ ID NO: 198345 - DNA, 103 bp, Artificial Sequence
  Synthetic Polynucleotide
taatacgactcactatagggcttgctcttagtagggcgactcggttgaccaacagaggagaggtcaaatgagtcgccctaacctggcggcagcgcaaaagatg

SEQ ID NO: 198346 - DNA, 103 bp, Artificial Sequence
  Synthetic Polynucleotide
taatacgactcactatagggattgggagaagagccgctgttggatggaataacagaggagaattccaatgaacagcggcaacctggcggcagcgcaaaagatg

SEQ ID NO: 198347 - DNA, 103 bp, Artificial Sequence
  Synthetic Polynucleotide
taatacgactcactatagggatatgttcatattgggagaagagccgctgtaacagaggagaacagcgatgcttctcccaaacctggcggcagcgcaaaagatg

SEQ ID NO: 198348 - DNA, 103 bp, Artificial Sequence
  Synthetic Polynucleotide
taatacgactcactataggggccgctgccaatatgttcatattgggagaaaacagaggagattctccatgtatgaacataacctggcggcagcgcaaaagatg

SEQ ID NO: 198349 - DNA, 103 bp, Artificial Sequence
  Synthetic Polynucleotide
taatacgactcactatagggggtggtaactgccgctgccaatatgttcataacagaggagaatgaacatgttggcagcgaacctggcggcagcgcaaaagatg

SEQ ID NO: 198350 - DNA, 103 bp, Artificial Sequence
  Synthetic Polynucleotide
taatacgactcactatagggcagaggacggggtggtaactgccgctgccaaacagaggagatggcagatgcagttaccaaacctggcggcagcgcaaaagatg

SEQ ID NO: 198351 - DNA, 103 bp, Artificial Sequence
  Synthetic Polynucleotide
taatacgactcactataggggccactttttcagaggacggggtggtaactaacagaggagaagttacatgcccgtcctcaacctggcggcagcgcaaaagatg

SEQ ID NO: 198352 - DNA, 103 bp, Artificial Sequence
  Synthetic Polynucleotide
taatacgactcactatagggagcacttgaagccactttttcagaggacggaacagaggagaccgtccatggaaaaagtgaacctggcggcagcgcaaaagatg

SEQ ID NO: 198353 - DNA, 103 bp, Artificial Sequence
  Synthetic Polynucleotide
taatacgactcactataggggggaggccccagcacttgaagccactttttaacagaggagaaaaaagatgcttcaagtgaacctggcggcagcgcaaaagatg

SEQ ID NO: 198354 - DNA, 103 bp, Artificial Sequence
  Synthetic Polynucleotide
taatacgactcactatagggttgctgacatgggaggccccagcacttgaaaacagaggagattcaagatgtggggcctcaacctggcggcagcgcaaaagatg

SEQ ID NO: 198355 - DNA, 103 bp, Artificial Sequence
  Synthetic Polynucleotide
taatacgactcactataggggaccgctgggttgctgacatgggaggccccaacagaggagaggggccatgcatgtcagcaacctggcggcagcgcaaaagatg

SEQ ID NO: 198356 - DNA, 103 bp, Artificial Sequence
  Synthetic Polynucleotide
taatacgactcactatagggcgtgggcatccttgctcttagtagggcgacaacagaggagagtcgccatgctaagagcaaacctggcggcagcgcaaaagatg

SEQ ID NO: 198357 - DNA, 103 bp, Artificial Sequence
  Synthetic Polynucleotide
taatacgactcactatagggacgatgatgagaccgctgggttgctgacataacagaggagaatgtcaatgacccagcggaacctggcggcagcgcaaaagatg

SEQ ID NO: 198358 - DNA, 103 bp, Artificial Sequence
  Synthetic Polynucleotide
taatacgactcactataggggctggtgaggacgatgatgagaccgctgggaacagaggagacccagcatgctcatcatcaacctggcggcagcgcaaaagatg

SEQ ID NO: 198359 - DNA, 103 bp, Artificial Sequence
  Synthetic Polynucleotide
taatacgactcactatagggtattgcaaaagctggtgaggacgatgatgaaacagaggagatcatcaatgtcctcaccaaacctggcggcagcgcaaaagatg

SEQ ID NO: 198360 - DNA, 103 bp, Artificial Sequence
  Synthetic Polynucleotide
taatacgactcactatagggataaactgcttattgcaaaagctggtgaggaacagaggagacctcacatgcttttgcaaaacctggcggcagcgcaaaagatg

SEQ ID NO: 198361 - DNA, 103 bp, Artificial Sequence
  Synthetic Polynucleotide
taatacgactcactataggggcaggacttaataaactgcttattgcaaaaaacagaggagattttgcatgaagcagtttaacctggcggcagcgcaaaagatg

SEQ ID NO: 198362 - DNA, 103 bp, Artificial Sequence
  Synthetic Polynucleotide
taatacgactcactatagggtggattagacgcaggacttaataaactgctaacagaggagaagcagtatgttaagtcctaacctggcggcagcgcaaaagatg

SEQ ID NO: 198363 - DNA, 103 bp, Artificial Sequence
  Synthetic Polynucleotide
taatacgactcactataggggaggtagaagtggattagacgcaggacttaaacagaggagataagtcatgcgtctaatcaacctggcggcagcgcaaaagatg

SEQ ID NO: 198364 - DNA, 103 bp, Artificial Sequence
  Synthetic Polynucleotide
taatacgactcactataggggaggcttgctgaggtagaagtggattagacaacagaggagagtctaaatgacttctaccaacctggcggcagcgcaaaagatg

SEQ ID NO: 198365 - DNA, 103 bp, Artificial Sequence
  Synthetic Polynucleotide
taatacgactcactatagggcgagttagcggaggcttgctgaggtagaagaacagaggagacttctaatgcagcaagccaacctggcggcagcgcaaaagatg

SEQ ID NO: 198366 - DNA, 103 bp, Artificial Sequence
  Synthetic Polynucleotide
taatacgactcactatagggtggggaaaaccgagttagcggaggcttgctaacagaggagaagcaagatgccgctaactaacctggcggcagcgcaaaagatg

SEQ ID NO: 198367 - DNA, 103 bp, Artificial Sequence
  Synthetic Polynucleotide
taatacgactcactatagggcggccacagacgtgggcatccttgctcttaaacagaggagataagagatgggatgcccaaacctggcggcagcgcaaaagatg

SEQ ID NO: 198368 - DNA, 103 bp, Artificial Sequence
  Synthetic Polynucleotide
taatacgactcactatagggggcaaagggctggggaaaaccgagttagcgaacagaggagacgctaaatgggttttcccaacctggcggcagcgcaaaagatg

SEQ ID NO: 198369 - DNA, 103 bp, Artificial Sequence
  Synthetic Polynucleotide
taatacgactcactatagggtccgatgttgggcaaagggctggggaaaacaacagaggagagttttcatgagccctttgaacctggcggcagcgcaaaagatg

SEQ ID NO: 198370 - DNA, 103 bp, Artificial Sequence
  Synthetic Polynucleotide
taatacgactcactatagggctgcagttgttccgatgttgggcaaagggcaacagaggagagcccttatgccaacatcgaacctggcggcagcgcaaaagatg

SEQ ID NO: 198371 - DNA, 103 bp, Artificial Sequence
  Synthetic Polynucleotide
taatacgactcactatagggtttaaatcctctgcagttgttccgatgttgaacagaggagacaacatatgaacaactgcaacctggcggcagcgcaaaagatg

SEQ ID NO: 198372 - DNA, 103 bp, Artificial Sequence
  Synthetic Polynucleotide
taatacgactcactatagggagacaaggagtttaaatcctctgcagttgtaacagaggagaacaactatggaggatttaaacctggcggcagcgcaaaagatg

SEQ ID NO: 198373 - DNA, 103 bp, Artificial Sequence
  Synthetic Polynucleotide
taatacgactcactataggggggccaaggcagacaaggagtttaaatcctaacagaggagaaggattatgactccttgtaacctggcggcagcgcaaaagatg

SEQ ID NO: 198374 - DNA, 103 bp, Artificial Sequence
  Synthetic Polynucleotide
taatacgactcactatagggtttctttgctgggccaaggcagacaaggagaacagaggagactccttatgtgccttggcaacctggcggcagcgcaaaagatg

SEQ ID NO: 198375 - DNA, 103 bp, Artificial Sequence
  Synthetic Polynucleotide
taatacgactcactatagggtggcttgctttttctttgctgggccaaggcaacagaggagagccttgatgcagcaaagaaacctggcggcagcgcaaaagatg

SEQ ID NO: 198376 - DNA, 103 bp, Artificial Sequence
  Synthetic Polynucleotide
taatacgactcactatagggtgacatttggtggcttgctttttctttgctaacagaggagaagcaaaatgaaagcaagcaacctggcggcagcgcaaaagatg

SEQ ID NO: 198377 - DNA, 103 bp, Artificial Sequence
  Synthetic Polynucleotide
taatacgactcactatagggtcaaaggcagtgacatttggtggcttgcttaacagaggagaaagcaaatgaccaaatgtaacctggcggcagcgcaaaagatg

SEQ ID NO: 198378 - DNA, 103 bp, Artificial Sequence
  Synthetic Polynucleotide
taatacgactcactatagggggcacagcaccggccacagacgtgggcatcaacagaggagagatgccatggtctgtggcaacctggcggcagcgcaaaagatg

SEQ ID NO: 198379 - DNA, 103 bp, Artificial Sequence
  Synthetic Polynucleotide
taatacgactcactatagggacttttcgcttcaaaggcagtgacatttggaacagaggagaccaaatatgactgcctttaacctggcggcagcgcaaaagatg

SEQ ID NO: 198380 - DNA, 103 bp, Artificial Sequence
  Synthetic Polynucleotide
taatacgactcactatagggcatcggaagtacttttcgcttcaaaggcagaacagaggagactgcctatgaagcgaaaaaacctggcggcagcgcaaaagatg

SEQ ID NO: 198381 - DNA, 103 bp, Artificial Sequence
  Synthetic Polynucleotide
taatacgactcactatagggaagaatgcctcatcggaagtacttttcgctaacagaggagaagcgaaatgtacttccgaaacctggcggcagcgcaaaagatg

SEQ ID NO: 198382 - DNA, 103 bp, Artificial Sequence
  Synthetic Polynucleotide
taatacgactcactatagggcttgtgtttgaagaatgcctcatcggaagtaacagaggagaacttccatggaggcattcaacctggcggcagcgcaaaagatg

SEQ ID NO: 198383 - DNA, 103 bp, Artificial Sequence
  Synthetic Polynucleotide
taatacgactcactatagggagaacctgcacttgtgtttgaagaatgcctaacagaggagaaggcatatgtcaaacacaaacctggcggcagcgcaaaagatg

SEQ ID NO: 198384 - DNA, 103 bp, Artificial Sequence
  Synthetic Polynucleotide
taatacgactcactatagggaccttcgcgcagaacctgcacttgtgtttgaacagaggagacaaacaatggtgcaggttaacctggcggcagcgcaaaagatg

SEQ ID NO: 198385 - DNA, 103 bp, Artificial Sequence
  Synthetic Polynucleotide
taatacgactcactatagggactcccaaagaccttcgcgcagaacctgcaaacagaggagatgcaggatgtgcgcgaagaacctggcggcagcgcaaaagatg

SEQ ID NO: 198386 - DNA, 103 bp, Artificial Sequence
  Synthetic Polynucleotide
taatacgactcactatagggaggcactgtcactcccaaagaccttcgcgcaacagaggagagcgcgaatgtctttgggaaacctggcggcagcgcaaaagatg

SEQ ID NO: 198387 - DNA, 103 bp, Artificial Sequence
  Synthetic Polynucleotide
taatacgactcactatagggtggatctgcaaggcactgtcactcccaaagaacagaggagactttggatgtgacagtgcaacctggcggcagcgcaaaagatg

SEQ ID NO: 198388 - DNA, 103 bp, Artificial Sequence
  Synthetic Polynucleotide
taatacgactcactatagggggaacgcaagtggatctgcaaggcactgtcaacagaggagagacagtatgttgcagatcaacctggcggcagcgcaaaagatg

SEQ ID NO: 198389 - DNA, 103 bp, Artificial Sequence
  Synthetic Polynucleotide
taatacgactcactatagggcaaagaactcggcacagcaccggccacagaaacagaggagatctgtgatgggtgctgtgaacctggcggcagcgcaaaagatg

SEQ ID NO: 198390 - DNA, 103 bp, Artificial Sequence
  Synthetic Polynucleotide
taatacgactcactatagggctccggtatgggaacgcaagtggatctgcaaacagaggagatgcagaatgacttgcgttaacctggcggcagcgcaaaagatg

SEQ ID NO: 198391 - DNA, 103 bp, Artificial Sequence
  Synthetic Polynucleotide
taatacgactcactatagggaatggcctctctccggtatgggaacgcaagaacagaggagacttgcgatgccataccggaacctggcggcagcgcaaaagatg

SEQ ID NO: 198392 - DNA, 103 bp, Artificial Sequence
  Synthetic Polynucleotide
taatacgactcactataggggttgcacttgaatggcctctctccggtatgaacagaggagacataccatggagaggccaaacctggcggcagcgcaaaagatg

SEQ ID NO: 198393 - DNA, 103 bp, Artificial Sequence
  Synthetic Polynucleotide
taatacgactcactatagggtcccgcagatgttgcacttgaatggcctctaacagaggagaagaggcatgtcaagtgcaaacctggcggcagcgcaaaagatg

SEQ ID NO: 198394 - DNA, 103 bp, Artificial Sequence
  Synthetic Polynucleotide
taatacgactcactataggggagaacctgttcccgcagatgttgcacttgaacagaggagacaagtgatgcatctgcggaacctggcggcagcgcaaaagatg

SEQ ID NO: 198395 - DNA, 103 bp, Artificial Sequence
  Synthetic Polynucleotide
taatacgactcactatagggccccttggtggagaacctgttcccgcagataacagaggagaatctgcatgaacaggttcaacctggcggcagcgcaaaagatg

SEQ ID NO: 198396 - DNA, 103 bp, Artificial Sequence
  Synthetic Polynucleotide
taatacgactcactatagggctttcagattccccttggtggagaacctgtaacagaggagaacaggtatgccaccaaggaacctggcggcagcgcaaaagatg

SEQ ID NO: 198397 - DNA, 103 bp, Artificial Sequence
  Synthetic Polynucleotide
taatacgactcactatagggtgaaagtggactttcagattccccttggtgaacagaggagacaccaaatggaatctgaaaacctggcggcagcgcaaaagatg

SEQ ID NO: 198398 - DNA, 103 bp, Artificial Sequence
  Synthetic Polynucleotide
taatacgactcactatagggtttgtggcgctgaaagtggactttcagattaacagaggagaaatctgatggtccactttaacctggcggcagcgcaaaagatg

SEQ ID NO: 198399 - DNA, 103 bp, Artificial Sequence
  Synthetic Polynucleotide
taatacgactcactatagggggtatttctctttgtggcgctgaaagtggaaacagaggagatccactatgagcgccacaaacctggcggcagcgcaaaagatg

SEQ ID NO: 198400 - DNA, 103 bp, Artificial Sequence
  Synthetic Polynucleotide
taatacgactcactatagggtctgataattcaaagaactcggcacagcacaacagaggagagtgctgatgcgagttcttaacctggcggcagcgcaaaagatg

SEQ ID NO: 198401 - DNA, 103 bp, Artificial Sequence
  Synthetic Polynucleotide
taatacgactcactatagggtggatatgagggtatttctctttgtggcgcaacagaggagagcgccaatgagagaaataaacctggcggcagcgcaaaagatg

SEQ ID NO: 198402 - DNA, 103 bp, Artificial Sequence
  Synthetic Polynucleotide
taatacgactcactatagggggggttcatctggatatgagggtatttctcaacagaggagagagaaaatgcctcatatcaacctggcggcagcgcaaaagatg

SEQ ID NO: 198403 - DNA, 103 bp, Artificial Sequence
  Synthetic Polynucleotide
taatacgactcactataggggcacaggataggggttcatctggatatgagaacagaggagactcataatgagatgaaccaacctggcggcagcgcaaaagatg

SEQ ID NO: 198404 - DNA, 103 bp, Artificial Sequence
  Synthetic Polynucleotide
taatacgactcactatagggaaatgctcaggcacaggataggggttcatcaacagaggagagatgaaatgctatcctgtaacctggcggcagcgcaaaagatg

SEQ ID NO: 198405 - DNA, 103 bp, Artificial Sequence
  Synthetic Polynucleotide
taatacgactcactataggggatattgtccaaatgctcaggcacaggataaacagaggagatatcctatgcctgagcataacctggcggcagcgcaaaagatg

SEQ ID NO: 198406 - DNA, 103 bp, Artificial Sequence
  Synthetic Polynucleotide
taatacgactcactatagggtactcgtggggatattgtccaaatgctcagaacagaggagactgagcatgtggacaataaacctggcggcagcgcaaaagatg

SEQ ID NO: 198407 - DNA, 103 bp, Artificial Sequence
  Synthetic Polynucleotide
taatacgactcactataggggggatgccagtactcgtggggatattgtccaacagaggagaggacaaatgccccacgagaacctggcggcagcgcaaaagatg

SEQ ID NO: 198408 - DNA, 103 bp, Artificial Sequence
  Synthetic Polynucleotide
taatacgactcactatagggcatgccatatgggatgccagtactcgtgggaacagaggagacccacgatgactggcatcaacctggcggcagcgcaaaagatg

SEQ ID NO: 198409 - DNA, 103 bp, Artificial Sequence
  Synthetic Polynucleotide
taatacgactcactataggggagggatggacatgccatatgggatgccagaacagaggagactggcaatgcatatggcaaacctggcggcagcgcaaaagatg

SEQ ID NO: 198410 - DNA, 103 bp, Artificial Sequence
  Synthetic Polynucleotide
taatacgactcactatagggggcttctctggagggatggacatgccatataacagaggagaatatggatggtccatcccaacctggcggcagcgcaaaagatg

SEQ ID NO: 198411 - DNA, 103 bp, Artificial Sequence
  Synthetic Polynucleotide
taatacgactcactataggggagcagaagatctgataattcaaagaactcaacagaggagagagttcatggaattatcaaacctggcggcagcgcaaaagatg

SEQ ID NO: 198412 - DNA, 103 bp, Artificial Sequence
  Synthetic Polynucleotide
taatacgactcactataggggctggtgactggcttctctggagggatggaaacagaggagatccatcatgccagagaagaacctggcggcagcgcaaaagatg

SEQ ID NO: 198413 - DNA, 103 bp, Artificial Sequence
  Synthetic Polynucleotide
taatacgactcactatagggtgtctagccagctggtgactggcttctctgaacagaggagacagagaatgcagtcaccaaacctggcggcagcgcaaaagatg

SEQ ID NO: 198414 - DNA, 103 bp, Artificial Sequence
  Synthetic Polynucleotide
taatacgactcactatagggactggtttggtgtctagccagctggtgactaacagaggagaagtcacatgctggctagaaacctggcggcagcgcaaaagatg

SEQ ID NO: 198415 - DNA, 103 bp, Artificial Sequence
  Synthetic Polynucleotide
taatacgactcactatagggagtaggcaggactggtttggtgtctagccaaacagaggagatggctaatgaccaaaccaaacctggcggcagcgcaaaagatg

SEQ ID NO: 198416 - DNA, 103 bp, Artificial Sequence
  Synthetic Polynucleotide
taatacgactcactatagggaagtggtcagagtaggcaggactggtttggaacagaggagaccaaacatgtcctgcctaaacctggcggcagcgcaaaagatg

SEQ ID NO: 198417 - DNA, 103 bp, Artificial Sequence
  Synthetic Polynucleotide
taatacgactcactatagggaggccgactgaagtggtcagagtaggcaggaacagaggagacctgccatgtctgaccacaacctggcggcagcgcaaaagatg

SEQ ID NO: 198418 - DNA, 103 bp, Artificial Sequence
  Synthetic Polynucleotide
taatacgactcactataggggggcaacggcaggccgactgaagtggtcagaacagaggagactgaccatgtcagtcggcaacctggcggcagcgcaaaagatg

SEQ ID NO: 198419 - DNA, 103 bp, Artificial Sequence
  Synthetic Polynucleotide
taatacgactcactatagggggagggttgggggcaacggcaggccgactgaacagaggagacagtcgatgtgccgttgcaacctggcggcagcgcaaaagatg

SEQ ID NO: 198420 - DNA, 103 bp, Artificial Sequence
  Synthetic Polynucleotide
taatacgactcactatagggatgaggcttgggagggttgggggcaacggcaacagaggagagccgttatgcccaaccctaacctggcggcagcgcaaaagatg

SEQ ID NO: 198421 - DNA, 103 bp, Artificial Sequence
  Synthetic Polynucleotide
taatacgactcactataggggatgaagggtatgaggcttgggagggttggaacagaggagaccaaccatgccaagcctcaacctggcggcagcgcaaaagatg

SEQ ID NO: 198422 - DNA, 103 bp, Artificial Sequence
  Synthetic Polynucleotide
taatacgactcactatagggtcttcttgtggagcagaagatctgataattaacagaggagaaattatatgatcttctgcaacctggcggcagcgcaaaagatg

SEQ ID NO: 198423 - DNA, 103 bp, Artificial Sequence
  Synthetic Polynucleotide
taatacgactcactatagggcttccgtcttgatgaagggtatgaggcttgaacagaggagacaagccatgtacccttcaaacctggcggcagcgcaaaagatg

SEQ ID NO: 198424 - DNA, 103 bp, Artificial Sequence
  Synthetic Polynucleotide
taatacgactcactatagggggggctggctcttccgtcttgatgaagggtaacagaggagaacccttatgcaagacggaaacctggcggcagcgcaaaagatg

SEQ ID NO: 198425 - DNA, 103 bp, Artificial Sequence
  Synthetic Polynucleotide
taatacgactcactataggggatggggatgggggctggctcttccgtcttaacagaggagaaagacgatggagccagccaacctggcggcagcgcaaaagatg

SEQ ID NO: 198426 - DNA, 103 bp, Artificial Sequence
  Synthetic Polynucleotide
taatacgactcactatagggcagaatggctgatggggatgggggctggctaacagaggagaagccagatgccatccccaaacctggcggcagcgcaaaagatg

SEQ ID NO: 198427 - DNA, 103 bp, Artificial Sequence
  Synthetic Polynucleotide
taatacgactcactataggggggctggtggcagaatggctgatggggatgaacagaggagacatcccatgcagccattcaacctggcggcagcgcaaaagatg

SEQ ID NO: 198428 - DNA, 103 bp, Artificial Sequence
  Synthetic Polynucleotide
taatacgactcactatagggtgagcctggggggctggtggcagaatggctaacagaggagaagccatatggccaccagcaacctggcggcagcgcaaaagatg

SEQ ID NO: 198429 - DNA, 103 bp, Artificial Sequence
  Synthetic Polynucleotide
taatacgactcactatagggcacttttgactgagcctggggggctggtggaacagaggagaccaccaatgccccaggctaacctggcggcagcgcaaaagatg

SEQ ID NO: 198430 - DNA, 103 bp, Artificial Sequence
  Synthetic Polynucleotide
taatacgactcactatagggcccccggagtcacttttgactgagcctgggaacagaggagacccaggatgagtcaaaagaacctggcggcagcgcaaaagatg

SEQ ID NO: 198431 - DNA, 103 bp, Artificial Sequence
  Synthetic Polynucleotide
taatacgactcactatagggtgactcagggcccccggagtcacttttgacaacagaggagagtcaaaatggactccgggaacctggcggcagcgcaaaagatg

SEQ ID NO: 198432 - DNA, 103 bp, Artificial Sequence
  Synthetic Polynucleotide
taatacgactcactatagggttcttgtggctgactcagggcccccggagtaacagaggagaactccgatggccctgagtaacctggcggcagcgcaaaagatg

SEQ ID NO: 198433 - DNA, 103 bp, Artificial Sequence
  Synthetic Polynucleotide
taatacgactcactatagggttagtacagttcttcttgtggagcagaagaaacagaggagatcttctatgccacaagaaaacctggcggcagcgcaaaagatg

SEQ ID NO: 198434 - DNA, 103 bp, Artificial Sequence
  Synthetic Polynucleotide
taatacgactcactatagggccacctaggtttcttgtggctgactcagggaacagaggagaccctgaatgagccacaagaacctggcggcagcgcaaaagatg

SEQ ID NO: 198435 - DNA, 103 bp, Artificial Sequence
  Synthetic Polynucleotide
taatacgactcactatagggctctgggagcccacctaggtttcttgtggcaacagaggagagccacaatgaacctaggtaacctggcggcagcgcaaaagatg

SEQ ID NO: 198436 - DNA, 103 bp, Artificial Sequence
  Synthetic Polynucleotide
taatacgactcactatagggcttcggcttcctctgggagcccacctaggtaacagaggagaacctagatgggctcccagaacctggcggcagcgcaaaagatg

SEQ ID NO: 198437 - DNA, 103 bp, Artificial Sequence
  Synthetic Polynucleotide
taatacgactcactatagggagagtggacccttcggcttcctctgggagcaacagaggagagctcccatgggaagccgaaacctggcggcagcgcaaaagatg

SEQ ID NO: 198438 - DNA, 103 bp, Artificial Sequence
  Synthetic Polynucleotide
taatacgactcactatagggagagggtggcagagtggacccttcggcttcaacagaggagagaagccatggggtccactaacctggcggcagcgcaaaagatg

SEQ ID NO: 198439 - DNA, 103 bp, Artificial Sequence
  Synthetic Polynucleotide
taatacgactcactatagggttttgccaccagagggtggcagagtggaccaacagaggagaggtccaatgtgccaccctaacctggcggcagcgcaaaagatg

SEQ ID NO: 198440 - DNA, 103 bp, Artificial Sequence
  Synthetic Polynucleotide
taatacgactcactatagggctctcttcgcttttgccaccagagggtggcaacagaggagagccaccatgtggtggcaaaacctggcggcagcgcaaaagatg

SEQ ID NO: 198441 - DNA, 103 bp, Artificial Sequence
  Synthetic Polynucleotide
taatacgactcactataggggaccatgccactctcttcgcttttgccaccaacagaggagaggtggcatgagcgaagagaacctggcggcagcgcaaaagatg

SEQ ID NO: 198442 - DNA, 103 bp, Artificial Sequence
  Synthetic Polynucleotide
taatacgactcactatagggctgagttggtgaccatgccactctcttcgcaacagaggagagcgaagatggtggcatggaacctggcggcagcgcaaaagatg

SEQ ID NO: 198443 - DNA, 103 bp, Artificial Sequence
  Synthetic Polynucleotide
taatacgactcactataggggccgtcgggactgagttggtgaccatgccaaacagaggagatggcatatgcaccaactcaacctggcggcagcgcaaaagatg

SEQ ID NO: 198444 - DNA, 103 bp, Artificial Sequence
  Synthetic Polynucleotide
taatacgactcactatagggtaattgatttttagtacagttcttcttgtgaacagaggagacacaagatgaactgtactaacctggcggcagcgcaaaagatg

SEQ ID NO: 198445 - DNA, 103 bp, Artificial Sequence
  Synthetic Polynucleotide
taatacgactcactataggggctactgctcgccgtcgggactgagttggtaacagaggagaaccaacatggtcccgacgaacctggcggcagcgcaaaagatg

SEQ ID NO: 198446 - DNA, 103 bp, Artificial Sequence
  Synthetic Polynucleotide
taatacgactcactatagggagctcaggacgctactgctcgccgtcgggaaacagaggagatcccgaatgcgagcagtaaacctggcggcagcgcaaaagatg

SEQ ID NO: 198447 - DNA, 103 bp, Artificial Sequence
  Synthetic Polynucleotide
taatacgactcactataggggccgctggggagctcaggacgctactgctcaacagaggagagagcagatgcgtcctgagaacctggcggcagcgcaaaagatg

SEQ ID NO: 198448 - DNA, 103 bp, Artificial Sequence
  Synthetic Polynucleotide
taatacgactcactataggggccgcagtctgccgctggggagctcaggacaacagaggagagtcctgatgtccccagcgaacctggcggcagcgcaaaagatg

SEQ ID NO: 198449 - DNA, 103 bp, Artificial Sequence
  Synthetic Polynucleotide
taatacgactcactatagggtgcccgcggggccgcagtctgccgctggggaacagaggagaccccagatgcagactgcgaacctggcggcagcgcaaaagatg

SEQ ID NO: 198450 - DNA, 103 bp, Artificial Sequence
  Synthetic Polynucleotide
taatacgactcactataggggtggtggcactgcccgcggggccgcagtctaacagaggagaagactgatgccccgcgggaacctggcggcagcgcaaaagatg

SEQ ID NO: 198451 - DNA, 103 bp, Artificial Sequence
  Synthetic Polynucleotide
taatacgactcactataggggttggtgaaggtggtggcactgcccgcgggaacagaggagacccgcgatgagtgccaccaacctggcggcagcgcaaaagatg

SEQ ID NO: 198452 - DNA, 103 bp, Artificial Sequence
  Synthetic Polynucleotide
taatacgactcactataggggcaacaaagggttggtgaaggtggtggcacaacagaggagagtgccaatgccttcaccaaacctggcggcagcgcaaaagatg

SEQ ID NO: 198453 - DNA, 103 bp, Artificial Sequence
  Synthetic Polynucleotide
taatacgactcactataggggacatgagcggcaacaaagggttggtgaagaacagaggagacttcacatgccctttgttaacctggcggcagcgcaaaagatg

SEQ ID NO: 198454 - DNA, 103 bp, Artificial Sequence
  Synthetic Polynucleotide
taatacgactcactataggggaactgctcggacatgagcggcaacaaaggaacagaggagacctttgatgccgctcatgaacctggcggcagcgcaaaagatg

SEQ ID NO: 198455 - DNA, 103 bp, Artificial Sequence
  Synthetic Polynucleotide
taatacgactcactatagggattggaaatgttgaggcttcgcttgcttccaacagaggagaggaagcatgcgaagcctcaacctggcggcagcgcaaaagatg

SEQ ID NO: 198456 - DNA, 103 bp, Artificial Sequence
  Synthetic Polynucleotide
taatacgactcactatagggcgattaaaactaattgatttttagtacagtaacagaggagaactgtaatgaaaatcaataacctggcggcagcgcaaaagatg

SEQ ID NO: 198457 - DNA, 103 bp, Artificial Sequence
  Synthetic Polynucleotide
taatacgactcactatagggacttggccttgaactgctcggacatgagcgaacagaggagacgctcaatgccgagcagtaacctggcggcagcgcaaaagatg

SEQ ID NO: 198458 - DNA, 103 bp, Artificial Sequence
  Synthetic Polynucleotide
taatacgactcactatagggccaaaaggaaacttggccttgaactgctcgaacagaggagacgagcaatgcaaggccaaaacctggcggcagcgcaaaagatg

SEQ ID NO: 198459 - DNA, 103 bp, Artificial Sequence
  Synthetic Polynucleotide
taatacgactcactatagggcaggagtcccccaaaaggaaacttggccttaacagaggagaaaggccatgtttccttttaacctggcggcagcgcaaaagatg

SEQ ID NO: 198460 - DNA, 103 bp, Artificial Sequence
  Synthetic Polynucleotide
taatacgactcactataggggagctgagtccaggagtcccccaaaaggaaaacagaggagattccttatgggggactccaacctggcggcagcgcaaaagatg

SEQ ID NO: 198461 - DNA, 103 bp, Artificial Sequence
  Synthetic Polynucleotide
taatacgactcactatagggtctgatgcctgagctgagtccaggagtcccaacagaggagagggactatgggactcagcaacctggcggcagcgcaaaagatg

SEQ ID NO: 198462 - DNA, 103 bp, Artificial Sequence
  Synthetic Polynucleotide
taatacgactcactatagggcttggacgtctctgatgcctgagctgagtcaacagaggagagactcaatgcaggcatcaaacctggcggcagcgcaaaagatg

SEQ ID NO: 198463 - DNA, 103 bp, Artificial Sequence
  Synthetic Polynucleotide
taatacgactcactataggggttgctgaagcttggacgtctctgatgcctaacagaggagaaggcatatgagacgtccaaacctggcggcagcgcaaaagatg

SEQ ID NO: 198464 - DNA, 103 bp, Artificial Sequence
  Synthetic Polynucleotide
taatacgactcactatagggttttctaccagttgctgaagcttggacgtcaacagaggagagacgtcatggcttcagcaaacctggcggcagcgcaaaagatg

SEQ ID NO: 198465 - DNA, 103 bp, Artificial Sequence
  Synthetic Polynucleotide
taatacgactcactatagggcttgtcaatgttttctaccagttgctgaagaacagaggagacttcagatgctggtagaaaacctggcggcagcgcaaaagatg

SEQ ID NO: 198466 - DNA, 103 bp, Artificial Sequence
  Synthetic Polynucleotide
taatacgactcactatagggcagtggccttcttgtcaatgttttctaccaaacagaggagatggtagatgacattgacaaacctggcggcagcgcaaaagatg

SEQ ID NO: 198467 - DNA, 103 bp, Artificial Sequence
  Synthetic Polynucleotide
taatacgactcactatagggttttcatttacgattaaaactaattgatttaacagaggagaaaatcaatgagttttaataacctggcggcagcgcaaaagatg

SEQ ID NO: 198468 - DNA, 103 bp, Artificial Sequence
  Synthetic Polynucleotide
taatacgactcactatagggtcattggggtcagtggccttcttgtcaatgaacagaggagacattgaatggaaggccacaacctggcggcagcgcaaaagatg

SEQ ID NO: 198469 - DNA, 103 bp, Artificial Sequence
  Synthetic Polynucleotide
taatacgactcactataggggatgatgcactcattggggtcagtggccttaacagaggagaaaggccatggaccccaataacctggcggcagcgcaaaagatg

SEQ ID NO: 198470 - DNA, 103 bp, Artificial Sequence
  Synthetic Polynucleotide
taatacgactcactatagggcccggtggcagatgatgcactcattggggtaacagaggagaaccccaatgagtgcatcaaacctggcggcagcgcaaaagatg

SEQ ID NO: 198471 - DNA, 103 bp, Artificial Sequence
  Synthetic Polynucleotide
taatacgactcactatagggcagctgagaacccggtggcagatgatgcacaacagaggagagtgcatatgctgccaccgaacctggcggcagcgcaaaagatg

SEQ ID NO: 198472 - DNA, 103 bp, Artificial Sequence
  Synthetic Polynucleotide
taatacgactcactatagggggcgctctggcagctgagaacccggtggcaaacagaggagatgccacatggttctcagcaacctggcggcagcgcaaaagatg

SEQ ID NO: 198473 - DNA, 103 bp, Artificial Sequence
  Synthetic Polynucleotide
taatacgactcactataggggcattttcaaggcgctctggcagctgagaaaacagaggagattctcaatggccagagcgaacctggcggcagcgcaaaagatg

SEQ ID NO: 198474 - DNA, 103 bp, Artificial Sequence
  Synthetic Polynucleotide
taatacgactcactataggggtcctgtagtgcattttcaaggcgctctggaacagaggagaccagagatgcttgaaaataacctggcggcagcgcaaaagatg

SEQ ID NO: 198475 - DNA, 103 bp, Artificial Sequence
  Synthetic Polynucleotide
taatacgactcactatagggcccagtgtgtgtcctgtagtgcattttcaaaacagaggagattgaaaatgcactacaggaacctggcggcagcgcaaaagatg

SEQ ID NO: 198476 - DNA, 103 bp, Artificial Sequence
  Synthetic Polynucleotide
taatacgactcactatagggagggcctctccccagtgtgtgtcctgtagtaacagaggagaactacaatgcacacactgaacctggcggcagcgcaaaagatg

SEQ ID NO: 198477 - DNA, 103 bp, Artificial Sequence
  Synthetic Polynucleotide
taatacgactcactatagggttacacttaaagggcctctccccagtgtgtaacagaggagaacacacatgggagaggccaacctggcggcagcgcaaaagatg

SEQ ID NO: 198478 - DNA, 103 bp, Artificial Sequence
  Synthetic Polynucleotide
taatacgactcactatagggggaggctggattttcatttacgattaaaacaacagaggagagttttaatggtaaatgaaaacctggcggcagcgcaaaagatg

SEQ ID NO: 198479 - DNA, 103 bp, Artificial Sequence
  Synthetic Polynucleotide
taatacgactcactataggggccacagatcttacacttaaagggcctctcaacagaggagagagaggatgtttaagtgtaacctggcggcagcgcaaaagatg

SEQ ID NO: 198480 - DNA, 103 bp, Artificial Sequence
  Synthetic Polynucleotide
taatacgactcactatagggtgaaagcccggccacagatcttacacttaaaacagaggagattaagtatgagatctgtgaacctggcggcagcgcaaaagatg

SEQ ID NO: 198481 - DNA, 103 bp, Artificial Sequence
  Synthetic Polynucleotide
taatacgactcactatagggcctttcgtggtgaaagcccggccacagatcaacagaggagagatctgatgccgggctttaacctggcggcagcgcaaaagatg

SEQ ID NO: 198482 - DNA, 103 bp, Artificial Sequence
  Synthetic Polynucleotide
taatacgactcactatagggtttaagattccctttcgtggtgaaagcccgaacagaggagacgggctatgaccacgaaaaacctggcggcagcgcaaaagatg

SEQ ID NO: 198483 - DNA, 103 bp, Artificial Sequence
  Synthetic Polynucleotide
taatacgactcactatagggtgtagtgggttttaagattccctttcgtggaacagaggagaccacgaatgggaatcttaaacctggcggcagcgcaaaagatg

SEQ ID NO: 198484 - DNA, 103 bp, Artificial Sequence
  Synthetic Polynucleotide
taatacgactcactatagggcgatggacactgtagtgggttttaagattcaacagaggagagaatctatgaacccactaaacctggcggcagcgcaaaagatg

SEQ ID NO: 198485 - DNA, 103 bp, Artificial Sequence
  Synthetic Polynucleotide
taatacgactcactataggggggcatagcacgatggacactgtagtgggtaacagaggagaacccacatgagtgtccataacctggcggcagcgcaaaagatg

SEQ ID NO: 198486 - DNA, 103 bp, Artificial Sequence
  Synthetic Polynucleotide
taatacgactcactatagggctctgagcgggggcatagcacgatggacacaacagaggagagtgtccatggtgctatgcaacctggcggcagcgcaaaagatg

SEQ ID NO: 198487 - DNA, 103 bp, Artificial Sequence
  Synthetic Polynucleotide
taatacgactcactataggggaatgctggactctgagcgggggcatagcaaacagaggagatgctatatgcccgctcagaacctggcggcagcgcaaaagatg

SEQ ID NO: 198488 - DNA, 103 bp, Artificial Sequence
  Synthetic Polynucleotide
taatacgactcactataggggatggggcaggaatgctggactctgagcggaacagaggagaccgctcatggtccagcataacctggcggcagcgcaaaagatg

SEQ ID NO: 198489 - DNA, 103 bp, Artificial Sequence
  Synthetic Polynucleotide
taatacgactcactatagggtttcgggtggggaggctggattttcatttaaacagaggagataaatgatgatccagcctaacctggcggcagcgcaaaagatg

SEQ ID NO: 198490 - DNA, 103 bp, Artificial Sequence
  Synthetic Polynucleotide
taatacgactcactatagggtcttctggcagatggggcaggaatgctggaaacagaggagatccagcatgcctgccccaaacctggcggcagcgcaaaagatg

SEQ ID NO: 198491 - DNA, 103 bp, Artificial Sequence
  Synthetic Polynucleotide
taatacgactcactatagggttcgtgaacttcttctggcagatggggcagaacagaggagactgcccatgctgccagaaaacctggcggcagcgcaaaagatg

SEQ ID NO: 198492 - DNA, 103 bp, Artificial Sequence
  Synthetic Polynucleotide
taatacgactcactataggggaccacagcgttcgtgaacttcttctggcaaacagaggagatgccagatgaagttcacgaacctggcggcagcgcaaaagatg

SEQ ID NO: 198493 - DNA, 103 bp, Artificial Sequence
  Synthetic Polynucleotide
taatacgactcactataggggctgctgcaggaccacagcgttcgtgaactaacagaggagaagttcaatgacgctgtggaacctggcggcagcgcaaaagatg

SEQ ID NO: 198494 - DNA, 103 bp, Artificial Sequence
  Synthetic Polynucleotide
taatacgactcactatagggattcggatgtgctgctgcaggaccacagcgaacagaggagacgctgtatgcctgcagcaaacctggcggcagcgcaaaagatg

SEQ ID NO: 198495 - DNA, 103 bp, Artificial Sequence
  Synthetic Polynucleotide
taatacgactcactatagggtcccatatgcattcggatgtgctgctgcagaacagaggagactgcagatgcacatccgaaacctggcggcagcgcaaaagatg

SEQ ID NO: 198496 - DNA, 103 bp, Artificial Sequence
  Synthetic Polynucleotide
taatacgactcactatagggggatctggcctcccatatgcattcggatgtaacagaggagaacatccatgtgcatatggaacctggcggcagcgcaaaagatg

SEQ ID NO: 198497 - DNA, 103 bp, Artificial Sequence
  Synthetic Polynucleotide
taatacgactcactatagggggggtgttggggatctggcctcccatatgcaacagaggagagcatatatgaggccagataacctggcggcagcgcaaaagatg

SEQ ID NO: 198498 - DNA, 103 bp, Artificial Sequence
  Synthetic Polynucleotide
taatacgactcactataggggtcggggactggggtgttggggatctggccaacagaggagaggccagatgcccaacaccaacctggcggcagcgcaaaagatg

SEQ ID NO: 198499 - DNA, 103 bp, Artificial Sequence
  Synthetic Polynucleotide
taatacgactcactatagggcagagtagctgtcggggactggggtgttggaacagaggagaccaacaatgcagtccccgaacctggcggcagcgcaaaagatg

SEQ ID NO: 198500 - DNA, 103 bp, Artificial Sequence
  Synthetic Polynucleotide
taatacgactcactatagggggggagaaggtttcgggtggggaggctggaaacagaggagatccagcatgcccacccgaaacctggcggcagcgcaaaagatg

SEQ ID NO: 198501 - DNA, 103 bp, Artificial Sequence
  Synthetic Polynucleotide
taatacgactcactatagggtccatggactcagagtagctgtcggggactaacagaggagaagtcccatgcagctactcaacctggcggcagcgcaaaagatg

SEQ ID NO: 198502 - DNA, 103 bp, Artificial Sequence
  Synthetic Polynucleotide
taatacgactcactatagggtgtgtcagactccatggactcagagtagctaacagaggagaagctacatggagtccatgaacctggcggcagcgcaaaagatg

SEQ ID NO: 198503 - DNA, 103 bp, Artificial Sequence
  Synthetic Polynucleotide
taatacgactcactatagggcaaaggaacctgtgtcagactccatggactaacagaggagaagtccaatgagtctgacaaacctggcggcagcgcaaaagatg

SEQ ID NO: 198504 - DNA, 103 bp, Artificial Sequence
  Synthetic Polynucleotide
taatacgactcactatagggtttttctcatcaaaggaacctgtgtcagacaacagaggagagtctgaatgaggttccttaacctggcggcagcgcaaaagatg

SEQ ID NO: 198505 - DNA, 103 bp, Artificial Sequence
  Synthetic Polynucleotide
taatacgactcactataggggtcatcaaaatttttctcatcaaaggaaccaacagaggagaggttccatggatgagaaaaacctggcggcagcgcaaaagatg

SEQ ID NO: 198506 - DNA, 103 bp, Artificial Sequence
  Synthetic Polynucleotide
taatacgactcactatagggagttgtctaggtcatcaaaatttttctcataacagaggagaatgagaatgattttgatgaacctggcggcagcgcaaaagatg

SEQ ID NO: 198507 - DNA, 103 bp, Artificial Sequence
  Synthetic Polynucleotide
taatacgactcactatagggtcatcagagaagttgtctaggtcatcaaaaaacagaggagattttgaatgcctagacaaaacctggcggcagcgcaaaagatg

SEQ ID NO: 198508 - DNA, 103 bp, Artificial Sequence
  Synthetic Polynucleotide
taatacgactcactatagggttccatgttttcatcagagaagttgtctagaacagaggagactagacatgttctctgataacctggcggcagcgcaaaagatg

SEQ ID NO: 198509 - DNA, 103 bp, Artificial Sequence
  Synthetic Polynucleotide
taatacgactcactatagggcaggacagtcttccatgttttcatcagagaaacagaggagatctctgatgaaaacatggaacctggcggcagcgcaaaagatg

SEQ ID NO: 198510 - DNA, 103 bp, Artificial Sequence
  Synthetic Polynucleotide
taatacgactcactatagggatgctgccctcaggacagtcttccatgtttaacagaggagaaaacatatgagactgtccaacctggcggcagcgcaaaagatg

SEQ ID NO: 198511 - DNA, 103 bp, Artificial Sequence
  Synthetic Polynucleotide
taatacgactcactatagggaggggggctgggggagaaggtttcgggtggaacagaggagaccacccatgaccttctccaacctggcggcagcgcaaaagatg

SEQ ID NO: 198512 - DNA, 103 bp, Artificial Sequence
  Synthetic Polynucleotide
taatacgactcactatagggtgtatcagggatgctgccctcaggacagtcaacagaggagagactgtatggagggcagcaacctggcggcagcgcaaaagatg

SEQ ID NO: 198513 - DNA, 103 bp, Artificial Sequence
  Synthetic Polynucleotide
taatacgactcactatagggcagacttaggtgtatcagggatgctgccctaacagaggagaagggcaatgtccctgataaacctggcggcagcgcaaaagatg

SEQ ID NO: 198514 - DNA, 103 bp, Artificial Sequence
  Synthetic Polynucleotide
taatacgactcactataggggaggcgtctgcagacttaggtgtatcagggaacagaggagaccctgaatgacctaagtcaacctggcggcagcgcaaaagatg

SEQ ID NO: 198515 - DNA, 103 bp, Artificial Sequence
  Synthetic Polynucleotide
taatacgactcactataggggctgtcttgggaggcgtctgcagacttaggaacagaggagacctaagatggcagacgccaacctggcggcagcgcaaaagatg

SEQ ID NO: 198516 - DNA, 103 bp, Artificial Sequence
  Synthetic Polynucleotide
taatacgactcactatagggaagaggataagctgtcttgggaggcgtctgaacagaggagacagacgatgcccaagacaaacctggcggcagcgcaaaagatg

SEQ ID NO: 198517 - DNA, 103 bp, Artificial Sequence
  Synthetic Polynucleotide
taatacgactcactatagggggcaaaggcgaagaggataagctgtcttggaacagaggagaccaagaatgcttatcctcaacctggcggcagcgcaaaagatg

SEQ ID NO: 198518 - DNA, 103 bp, Artificial Sequence
  Synthetic Polynucleotide
taatacgactcactatagggcatctcgaggggcaaaggcgaagaggataaaacagaggagattatccatgtcgcctttgaacctggcggcagcgcaaaagatg

SEQ ID NO: 198519 - DNA, 103 bp, Artificial Sequence
  Synthetic Polynucleotide
taatacgactcactatagggcgatgctcgacatctcgaggggcaaaggcgaacagaggagacgccttatgccctcgagaaacctggcggcagcgcaaaagatg

SEQ ID NO: 198520 - DNA, 103 bp, Artificial Sequence
  Synthetic Polynucleotide
taatacgactcactatagggtccaaagcagcgatgctcgacatctcgaggaacagaggagacctcgaatggtcgagcataacctggcggcagcgcaaaagatg

SEQ ID NO: 198521 - DNA, 103 bp, Artificial Sequence
  Synthetic Polynucleotide
taatacgactcactatagggcatctgattttccaaagcagcgatgctcgaaacagaggagatcgagcatggctgctttgaacctggcggcagcgcaaaagatg

SEQ ID NO: 198522 - DNA, 103 bp, Artificial Sequence
  Synthetic Polynucleotide
taatacgactcactataggggattatcaggaggggggctgggggagaaggaacagaggagaccttctatgccagcccccaacctggcggcagcgcaaaagatg

SEQ ID NO: 198523 - DNA, 103 bp, Artificial Sequence
  Synthetic Polynucleotide
taatacgactcactatagggtgatcatcttcatctgattttccaaagcagaacagaggagactgcttatgaaaatcagaaacctggcggcagcgcaaaagatg

SEQ ID NO: 198524 - DNA, 103 bp, Artificial Sequence
  Synthetic Polynucleotide
taatacgactcactatagggaggccagcattgatcatcttcatctgatttaacagaggagaaaatcaatggaagatgataacctggcggcagcgcaaaagatg

SEQ ID NO: 198525 - DNA, 103 bp, Artificial Sequence
  Synthetic Polynucleotide
taatacgactcactatagggctgctctgccaggccagcattgatcatcttaacagaggagaaagatgatgaatgctggcaacctggcggcagcgcaaaagatg

SEQ ID NO: 198526 - DNA, 103 bp, Artificial Sequence
  Synthetic Polynucleotide
taatacgactcactatagggtggcctgtagctgctctgccaggccagcataacagaggagaatgctgatgtggcagagcaacctggcggcagcgcaaaagatg

SEQ ID NO: 198527 - DNA, 103 bp, Artificial Sequence
  Synthetic Polynucleotide
taatacgactcactataggggacttcaggctggcctgtagctgctctgccaacagaggagaggcagaatggctacaggcaacctggcggcagcgcaaaagatg

SEQ ID NO: 198528 - DNA, 103 bp, Artificial Sequence
  Synthetic Polynucleotide
taatacgactcactatagggattctccactgacttcaggctggcctgtagaacagaggagactacagatgagcctgaagaacctggcggcagcgcaaaagatg

SEQ ID NO: 198529 - DNA, 103 bp, Artificial Sequence
  Synthetic Polynucleotide
taatacgactcactatagggcgatggacccattctccactgacttcaggcaacagaggagagcctgaatgcagtggagaaacctggcggcagcgcaaaagatg

SEQ ID NO: 198530 - DNA, 103 bp, Artificial Sequence
  Synthetic Polynucleotide
taatacgactcactatagggacatccccctcgatggacccattctccactaacagaggagaagtggaatgtgggtccataacctggcggcagcgcaaaagatg

SEQ ID NO: 198531 - DNA, 103 bp, Artificial Sequence
  Synthetic Polynucleotide
taatacgactcactatagggattggtcaggacatccccctcgatggacccaacagaggagagggtccatggagggggataacctggcggcagcgcaaaagatg

SEQ ID NO: 198532 - DNA, 103 bp, Artificial Sequence
  Synthetic Polynucleotide
taatacgactcactatagggaggatgaatcattggtcaggacatccccctaacagaggagaagggggatgtcctgaccaaacctggcggcagcgcaaaagatg

SEQ ID NO: 198533 - DNA, 103 bp, Artificial Sequence
  Synthetic Polynucleotide
taatacgactcactatagggtgttcatcaggattatcaggaggggggctgaacagaggagacagcccatgtcctgataaaacctggcggcagcgcaaaagatg

SEQ ID NO: 198534 - DNA, 103 bp, Artificial Sequence
  Synthetic Polynucleotide
taatacgactcactatagggccacccactgaggatgaatcattggtcaggaacagaggagacctgacatgtgattcatcaacctggcggcagcgcaaaagatg

SEQ ID NO: 198535 - DNA, 103 bp, Artificial Sequence
  Synthetic Polynucleotide
taatacgactcactatagggttccatgtcaccacccactgaggatgaatcaacagaggagagattcaatgtcagtgggtaacctggcggcagcgcaaaagatg

SEQ ID NO: 198536 - DNA, 103 bp, Artificial Sequence
  Synthetic Polynucleotide
taatacgactcactatagggcactttggctttccatgtcaccacccactgaacagaggagacagtggatggtgacatggaacctggcggcagcgcaaaagatg

SEQ ID NO: 198537 - DNA, 103 bp, Artificial Sequence
  Synthetic Polynucleotide
taatacgactcactataggggggctgccagcactttggctttccatgtcaaacagaggagatgacatatgaagccaaagaacctggcggcagcgcaaaagatg

SEQ ID NO: 198538 - DNA, 103 bp, Artificial Sequence
  Synthetic Polynucleotide
taatacgactcactatagggtgagatggctgggctgccagcactttggctaacagaggagaagccaaatggctggcagcaacctggcggcagcgcaaaagatg

SEQ ID NO: 198539 - DNA, 103 bp, Artificial Sequence
  Synthetic Polynucleotide
taatacgactcactatagggaggtagactctgagatggctgggctgccagaacagaggagactggcaatgcagccatctaacctggcggcagcgcaaaagatg

SEQ ID NO: 198540 - DNA, 103 bp, Artificial Sequence
  Synthetic Polynucleotide
taatacgactcactatagggtgcatggaagaggtagactctgagatggctaacagaggagaagccatatgagagtctacaacctggcggcagcgcaaaagatg

SEQ ID NO: 198541 - DNA, 103 bp, Artificial Sequence
  Synthetic Polynucleotide
taatacgactcactatagggggacagagcctgcatggaagaggtagactcaacagaggagagagtctatgtcttccatgaacctggcggcagcgcaaaagatg

SEQ ID NO: 198542 - DNA, 103 bp, Artificial Sequence
  Synthetic Polynucleotide
taatacgactcactatagggtgttggacggggacagagcctgcatggaagaacagaggagacttccaatgaggctctgtaacctggcggcagcgcaaaagatg

SEQ ID NO: 198543 - DNA, 103 bp, Artificial Sequence
  Synthetic Polynucleotide
taatacgactcactatagggtcctgcgtgctgttggacggggacagagccaacagaggagaggctctatgcccgtccaaaacctggcggcagcgcaaaagatg

SEQ ID NO: 198544 - DNA, 103 bp, Artificial Sequence
  Synthetic Polynucleotide
taatacgactcactataggggtcattcatttgttcatcaggattatcaggaacagaggagacctgatatgcctgatgaaaacctggcggcagcgcaaaagatg

SEQ ID NO: 198545 - DNA, 103 bp, Artificial Sequence
  Synthetic Polynucleotide
taatacgactcactatagggcttgtggaactcctgcgtgctgttggacggaacagaggagaccgtccatgagcacgcagaacctggcggcagcgcaaaagatg

SEQ ID NO: 198546 - DNA, 103 bp, Artificial Sequence
  Synthetic Polynucleotide
taatacgactcactatagggtgctgggtgacttgtggaactcctgcgtgcaacagaggagagcacgcatgagttccacaaacctggcggcagcgcaaaagatg

SEQ ID NO: 198547 - DNA, 103 bp, Artificial Sequence
  Synthetic Polynucleotide
taatacgactcactatagggttctcctcaatgctgggtgacttgtggaacaacagaggagagttccaatggtcacccagaacctggcggcagcgcaaaagatg

SEQ ID NO: 198548 - DNA, 103 bp, Artificial Sequence
  Synthetic Polynucleotide
taatacgactcactatagggtctctgtggtttctcctcaatgctgggtgaaacagaggagatcacccatgattgaggagaacctggcggcagcgcaaaagatg

SEQ ID NO: 198549 - DNA, 103 bp, Artificial Sequence
  Synthetic Polynucleotide
taatacgactcactatagggttgggaccgctctctgtggtttctcctcaaaacagaggagattgaggatgaaccacagaaacctggcggcagcgcaaaagatg

SEQ ID NO: 198550 - DNA, 103 bp, Artificial Sequence
  Synthetic Polynucleotide
taatacgactcactataggggcaaactcgcttgggaccgctctctgtggtaacagaggagaaccacaatgagcggtcccaacctggcggcagcgcaaaagatg

SEQ ID NO: 198551 - DNA, 103 bp, Artificial Sequence
  Synthetic Polynucleotide
taatacgactcactatagggcaaaccattggcaaactcgcttgggaccgcaacagaggagagcggtcatgagcgagtttaacctggcggcagcgcaaaagatg

SEQ ID NO: 198552 - DNA, 103 bp, Artificial Sequence
  Synthetic Polynucleotide
taatacgactcactataggggggtgggagacaaaccattggcaaactcgcaacagaggagagcgagtatgccaatggttaacctggcggcagcgcaaaagatg

SEQ ID NO: 198553 - DNA, 103 bp, Artificial Sequence
  Synthetic Polynucleotide
taatacgactcactatagggccattcactggggtgggagacaaaccattgaacagaggagacaatggatggtctcccacaacctggcggcagcgcaaaagatg

SEQ ID NO: 198554 - DNA, 103 bp, Artificial Sequence
  Synthetic Polynucleotide
taatacgactcactatagggcaaagccccaccattcactggggtgggagaaacagaggagatctcccatgccagtgaataacctggcggcagcgcaaaagatg

SEQ ID NO: 198555 - DNA, 103 bp, Artificial Sequence
  Synthetic Polynucleotide
taatacgactcactatagggtgttaactgtgtcattcatttgttcatcagaacagaggagactgatgatgaaatgaatgaacctggcggcagcgcaaaagatg

SEQ ID NO: 198556 - DNA, 103 bp, Artificial Sequence
  Synthetic Polynucleotide
taatacgactcactatagggatgtcaaatccaaagccccaccattcactgaacagaggagacagtgaatggtggggcttaacctggcggcagcgcaaaagatg

SEQ ID NO: 198557 - DNA, 103 bp, Artificial Sequence
  Synthetic Polynucleotide
taatacgactcactataggggcgtgactagatgtcaaatccaaagccccaaacagaggagatggggcatgggatttgacaacctggcggcagcgcaaaagatg

SEQ ID NO: 198558 - DNA, 103 bp, Artificial Sequence
  Synthetic Polynucleotide
taatacgactcactataggggattttctctgcgtgactagatgtcaaatcaacagaggagagatttgatgtctagtcacaacctggcggcagcgcaaaagatg

SEQ ID NO: 198559 - DNA, 103 bp, Artificial Sequence
  Synthetic Polynucleotide
taatacgactcactatagggcttctttgatgattttctctgcgtgactagaacagaggagactagtcatgcagagaaaaaacctggcggcagcgcaaaagatg

SEQ ID NO: 198560 - DNA, 103 bp, Artificial Sequence
  Synthetic Polynucleotide
taatacgactcactatagggcccaaagaatcttctttgatgattttctctaacagaggagaagagaaatgcatcaaagaaacctggcggcagcgcaaaagatg

SEQ ID NO: 198561 - DNA, 103 bp, Artificial Sequence
  Synthetic Polynucleotide
taatacgactcactataggggaagaggatccccaaagaatcttctttgataacagaggagaatcaaaatggattctttgaacctggcggcagcgcaaaagatg

SEQ ID NO: 198562 - DNA, 103 bp, Artificial Sequence
  Synthetic Polynucleotide
taatacgactcactatagggctctaaaagggaagaggatccccaaagaataacagaggagaattcttatgggatcctctaacctggcggcagcgcaaaagatg

SEQ ID NO: 198563 - DNA, 103 bp, Artificial Sequence
  Synthetic Polynucleotide
taatacgactcactatagggttaccccggtctctaaaagggaagaggatcaacagaggagagatcctatgcccttttagaacctggcggcagcgcaaaagatg

SEQ ID NO: 198564 - DNA, 103 bp, Artificial Sequence
  Synthetic Polynucleotide
taatacgactcactataggggtttttaaatttaccccggtctctaaaaggaacagaggagaccttttatggaccggggtaacctggcggcagcgcaaaagatg

SEQ ID NO: 198565 - DNA, 103 bp, Artificial Sequence
  Synthetic Polynucleotide
taatacgactcactatagggcacaagcagtgtttttaaatttaccccggtaacagaggagaaccgggatgaatttaaaaaacctggcggcagcgcaaaagatg

SEQ ID NO: 198566 - DNA, 103 bp, Artificial Sequence
  Synthetic Polynucleotide
taatacgactcactatagggtcggggtcggattggaaatgttgaggcttcaacagaggagagaagccatgacatttccaaacctggcggcagcgcaaaagatg

SEQ ID NO: 198567 - DNA, 103 bp, Artificial Sequence
  Synthetic Polynucleotide
taatacgactcactatagggtgatctgttttgttaactgtgtcattcattaacagaggagaaatgaaatgcacagttaaaacctggcggcagcgcaaaagatg

SEQ ID NO: 198568 - DNA, 103 bp, Artificial Sequence
  Synthetic Polynucleotide
taatacgactcactatagggccacaaatgtcacaagcagtgtttttaaataacagaggagaatttaaatgcactgcttgaacctggcggcagcgcaaaagatg

SEQ ID NO: 198569 - DNA, 103 bp, Artificial Sequence
  Synthetic Polynucleotide
taatacgactcactatagggaaatgttttgccacaaatgtcacaagcagtaacagaggagaactgctatggacatttgtaacctggcggcagcgcaaaagatg

SEQ ID NO: 198570 - DNA, 103 bp, Artificial Sequence
  Synthetic Polynucleotide
taatacgactcactatagggtctgacaagcaaatgttttgccacaaatgtaacagaggagaacatttatggcaaaacataacctggcggcagcgcaaaagatg

SEQ ID NO: 198571 - DNA, 103 bp, Artificial Sequence
  Synthetic Polynucleotide
taatacgactcactatagggtccaaggcactctgacaagcaaatgttttgaacagaggagacaaaacatgtgcttgtcaaacctggcggcagcgcaaaagatg

SEQ ID NO: 198572 - DNA, 103 bp, Artificial Sequence
  Synthetic Polynucleotide
taatacgactcactatagggatagtgaatgtccaaggcactctgacaagcaacagaggagagcttgtatgagtgccttgaacctggcggcagcgcaaaagatg

SEQ ID NO: 198573 - DNA, 103 bp, Artificial Sequence
  Synthetic Polynucleotide
taatacgactcactatagggtatgacttctatagtgaatgtccaaggcacaacagaggagagtgcctatgacattcactaacctggcggcagcgcaaaagatg

SEQ ID NO: 198574 - DNA, 103 bp, Artificial Sequence
  Synthetic Polynucleotide
taatacgactcactatagggctctctttggtatgacttctatagtgaatgaacagaggagacattcaatgtagaagtcaaacctggcggcagcgcaaaagatg

SEQ ID NO: 198575 - DNA, 103 bp, Artificial Sequence
  Synthetic Polynucleotide
taatacgactcactatagggaataaatggtctctctttggtatgacttctaacagaggagaagaagtatgaccaaagagaacctggcggcagcgcaaaagatg

SEQ ID NO: 198576 - DNA, 103 bp, Artificial Sequence
  Synthetic Polynucleotide
taatacgactcactatagggaaactgtgcaaataaatggtctctctttggaacagaggagaccaaagatggaccatttaaacctggcggcagcgcaaaagatg

SEQ ID NO: 198577 - DNA, 103 bp, Artificial Sequence
  Synthetic Polynucleotide
taatacgactcactatagggccacgattgcaaactgtgcaaataaatggtaacagaggagaaccattatgttgcacagtaacctggcggcagcgcaaaagatg

SEQ ID NO: 198578 - DNA, 103 bp, Artificial Sequence
  Synthetic Polynucleotide
taatacgactcactataggggcagtccacttgatctgttttgttaactgtaacagaggagaacagttatgaaaacagataacctggcggcagcgcaaaagatg

SEQ ID NO: 198579 - DNA, 103 bp, Artificial Sequence
  Synthetic Polynucleotide
taatacgactcactatagggtgtggaaaagccacgattgcaaactgtgcaaacagaggagatgcacaatgtgcaatcgtaacctggcggcagcgcaaaagatg

SEQ ID NO: 198580 - DNA, 103 bp, Artificial Sequence
  Synthetic Polynucleotide
taatacgactcactatagggaattaccctttgtggaaaagccacgattgcaacagaggagagcaatcatggcttttccaaacctggcggcagcgcaaaagatg

SEQ ID NO: 198581 - DNA, 103 bp, Artificial Sequence
  Synthetic Polynucleotide
taatacgactcactatagggtgctgcttcaaattaccctttgtggaaaagaacagaggagacttttcatgaaagggtaaaacctggcggcagcgcaaaagatg

SEQ ID NO: 198582 - DNA, 103 bp, Artificial Sequence
  Synthetic Polynucleotide
taatacgactcactatagggtgtcaacatgtgctgcttcaaattacccttaacagaggagaaagggtatgttgaagcagaacctggcggcagcgcaaaagatg

SEQ ID NO: 198583 - DNA, 103 bp, Artificial Sequence
  Synthetic Polynucleotide
taatacgactcactataggggcatctgatgtgtcaacatgtgctgcttcaaacagaggagatgaagcatgacatgttgaaacctggcggcagcgcaaaagatg

SEQ ID NO: 198584 - DNA, 103 bp, Artificial Sequence
  Synthetic Polynucleotide
taatacgactcactatagggggcagatctcgcatctgatgtgtcaacatgaacagaggagacatgttatgacatcagataacctggcggcagcgcaaaagatg

SEQ ID NO: 198585 - DNA, 103 bp, Artificial Sequence
  Synthetic Polynucleotide
taatacgactcactataggggagctgggatggcagatctcgcatctgatgaacagaggagacatcagatgcgagatctgaacctggcggcagcgcaaaagatg

SEQ ID NO: 198586 - DNA, 103 bp, Artificial Sequence
  Synthetic Polynucleotide
taatacgactcactatagggtgggctcaaagagctgggatggcagatctcaacagaggagagagatcatgcatcccagcaacctggcggcagcgcaaaagatg

SEQ ID NO: 198587 - DNA, 103 bp, Artificial Sequence
  Synthetic Polynucleotide
taatacgactcactatagggaggttggaactgggctcaaagagctgggataacagaggagaatcccaatgctttgagccaacctggcggcagcgcaaaagatg

SEQ ID NO: 198588 - DNA, 103 bp, Artificial Sequence
  Synthetic Polynucleotide
taatacgactcactatagggattggggccaaggttggaactgggctcaaaaacagaggagatttgagatgagttccaacaacctggcggcagcgcaaaagatg

SEQ ID NO: 198589 - DNA, 103 bp, Artificial Sequence
  Synthetic Polynucleotide
taatacgactcactatagggaaaggtcgctgcagtccacttgatctgtttaacagaggagaaaacagatgaagtggactaacctggcggcagcgcaaaagatg

SEQ ID NO: 198590 - DNA, 103 bp, Artificial Sequence
  Synthetic Polynucleotide
taatacgactcactatagggctgagttctgattggggccaaggttggaacaacagaggagagttccaatgttggccccaaacctggcggcagcgcaaaagatg

SEQ ID NO: 198591 - DNA, 103 bp, Artificial Sequence
  Synthetic Polynucleotide
taatacgactcactatagggggaatcaccgctgagttctgattggggccaaacagaggagatggcccatgtcagaactcaacctggcggcagcgcaaaagatg

SEQ ID NO: 198592 - DNA, 103 bp, Artificial Sequence
  Synthetic Polynucleotide
taatacgactcactatagggcgagttggcgggaatcaccgctgagttctgaacagaggagacagaacatggcggtgattaacctggcggcagcgcaaaagatg

SEQ ID NO: 198593 - DNA, 103 bp, Artificial Sequence
  Synthetic Polynucleotide
taatacgactcactataggggagatgacaacgagttggcgggaatcaccgaacagaggagacggtgaatgccgccaactaacctggcggcagcgcaaaagatg

SEQ ID NO: 198594 - DNA, 103 bp, Artificial Sequence
  Synthetic Polynucleotide
taatacgactcactataggggtcttgatgagagatgacaacgagttggcgaacagaggagacgccaaatggttgtcatcaacctggcggcagcgcaaaagatg

SEQ ID NO: 198595 - DNA, 103 bp, Artificial Sequence
  Synthetic Polynucleotide
taatacgactcactataggggttgacctctgtcttgatgagagatgacaaaacagaggagattgtcaatgctcatcaagaacctggcggcagcgcaaaagatg

SEQ ID NO: 198596 - DNA, 103 bp, Artificial Sequence
  Synthetic Polynucleotide
taatacgactcactataggggcacgaagccgttgacctctgtcttgatgaaacagaggagatcatcaatgcagaggtcaaacctggcggcagcgcaaaagatg

SEQ ID NO: 198597 - DNA, 103 bp, Artificial Sequence
  Synthetic Polynucleotide
taatacgactcactatagggggagaaacatgcacgaagccgttgacctctaacagaggagaagaggtatgcggcttcgtaacctggcggcagcgcaaaagatg

SEQ ID NO: 198598 - DNA, 103 bp, Artificial Sequence
  Synthetic Polynucleotide
taatacgactcactatagggactgtcctgaggagaaacatgcacgaagccaacagaggagaggcttcatgcatgtttctaacctggcggcagcgcaaaagatg

SEQ ID NO: 198599 - DNA, 103 bp, Artificial Sequence
  Synthetic Polynucleotide
taatacgactcactataggggggtgtccttactgtcctgaggagaaacataacagaggagaatgtttatgctcaggacaaacctggcggcagcgcaaaagatg

SEQ ID NO: 198600 - DNA, 103 bp, Artificial Sequence
  Synthetic Polynucleotide
taatacgactcactatagggttgtgttctgaaaggtcgctgcagtccactaacagaggagaagtggaatgcagcgacctaacctggcggcagcgcaaaagatg

SEQ ID NO: 198601 - DNA, 103 bp, Artificial Sequence
  Synthetic Polynucleotide
taatacgactcactatagggtgactggtgggggtgtccttactgtcctgaaacagaggagatcaggaatgtaaggacacaacctggcggcagcgcaaaagatg

SEQ ID NO: 198602 - DNA, 103 bp, Artificial Sequence
  Synthetic Polynucleotide
taatacgactcactatagggagacgggacgtgactggtgggggtgtccttaacagaggagaaaggacatgcccaccagtaacctggcggcagcgcaaaagatg

SEQ ID NO: 198603 - DNA, 103 bp, Artificial Sequence
  Synthetic Polynucleotide
taatacgactcactatagggacagaggcccagacgggacgtgactggtggaacagaggagaccaccaatgacgtcccgtaacctggcggcagcgcaaaagatg

SEQ ID NO: 198604 - DNA, 103 bp, Artificial Sequence
  Synthetic Polynucleotide
taatacgactcactataggggcagaggaagacagaggcccagacgggacgaacagaggagacgtcccatgtgggcctctaacctggcggcagcgcaaaagatg

SEQ ID NO: 198605 - DNA, 103 bp, Artificial Sequence
  Synthetic Polynucleotide
taatacgactcactatagggtggggatgtggcagaggaagacagaggcccaacagaggagagggcctatgtcttcctctaacctggcggcagcgcaaaagatg

SEQ ID NO: 198606 - DNA, 103 bp, Artificial Sequence
  Synthetic Polynucleotide
taatacgactcactatagggggagcagaactggggatgtggcagaggaagaacagaggagacttcctatgccacatcccaacctggcggcagcgcaaaagatg

SEQ ID NO: 198607 - DNA, 103 bp, Artificial Sequence
  Synthetic Polynucleotide
taatacgactcactatagggggcagagcagggagcagaactggggatgtgaacagaggagacacatcatgagttctgctaacctggcggcagcgcaaaagatg

SEQ ID NO: 198608 - DNA, 103 bp, Artificial Sequence
  Synthetic Polynucleotide
taatacgactcactatagggagttctcctgggcagagcagggagcagaacaacagaggagagttctgatgcctgctctgaacctggcggcagcgcaaaagatg

SEQ ID NO: 198609 - DNA, 103 bp, Artificial Sequence
  Synthetic Polynucleotide
taatacgactcactataggggctgcttgggagttctcctgggcagagcagaacagaggagactgctcatgccaggagaaaacctggcggcagcgcaaaagatg

SEQ ID NO: 198610 - DNA, 103 bp, Artificial Sequence
  Synthetic Polynucleotide
taatacgactcactatagggttgcagtagtgctgcttgggagttctcctgaacagaggagacaggagatgtcccaagcaaacctggcggcagcgcaaaagatg

SEQ ID NO: 198611 - DNA, 103 bp, Artificial Sequence
  Synthetic Polynucleotide
taatacgactcactataggggtcaagtccgttgtgttctgaaaggtcgctaacagaggagaagcgacatgtcagaacacaacctggcggcagcgcaaaagatg

SEQ ID NO: 198612 - DNA, 103 bp, Artificial Sequence
  Synthetic Polynucleotide
taatacgactcactataggggccacatgtgttgcagtagtgctgcttgggaacagaggagacccaagatgcactactgcaacctggcggcagcgcaaaagatg

SEQ ID NO: 198613 - DNA, 103 bp, Artificial Sequence
  Synthetic Polynucleotide
taatacgactcactatagggagaaggttttgccacatgtgttgcagtagtaacagaggagaactactatgacacatgtgaacctggcggcagcgcaaaagatg

SEQ ID NO: 198614 - DNA, 103 bp, Artificial Sequence
  Synthetic Polynucleotide
taatacgactcactatagggctcgatgaggagaaggttttgccacatgtgaacagaggagacacatgatgcaaaaccttaacctggcggcagcgcaaaagatg

SEQ ID NO: 198615 - DNA, 103 bp, Artificial Sequence
  Synthetic Polynucleotide
taatacgactcactatagggctgcagggcactcgatgaggagaaggttttaacagaggagaaaaaccatgtcctcatcgaacctggcggcagcgcaaaagatg

SEQ ID NO: 198616 - DNA, 103 bp, Artificial Sequence
  Synthetic Polynucleotide
taatacgactcactatagggtctcgtgaatctgcagggcactcgatgaggaacagaggagacctcatatggtgccctgcaacctggcggcagcgcaaaagatg

SEQ ID NO: 198617 - DNA, 103 bp, Artificial Sequence
  Synthetic Polynucleotide
taatacgactcactataggggtgtgagttctctcgtgaatctgcagggcaaacagaggagatgccctatggattcacgaaacctggcggcagcgcaaaagatg

SEQ ID NO: 198618 - DNA, 103 bp, Artificial Sequence
  Synthetic Polynucleotide
taatacgactcactatagggtttctctccagtgtgagttctctcgtgaataacagaggagaattcacatgagaactcacaacctggcggcagcgcaaaagatg

SEQ ID NO: 198619 - DNA, 103 bp, Artificial Sequence
  Synthetic Polynucleotide
taatacgactcactatagggaagcaaagggtttctctccagtgtgagttcaacagaggagagaactcatgctggagagaaacctggcggcagcgcaaaagatg

SEQ ID NO: 198620 - DNA, 103 bp, Artificial Sequence
  Synthetic Polynucleotide
taatacgactcactatagggcaaatagtgcaagcaaagggtttctctccaaacagaggagatggagaatgaccctttgcaacctggcggcagcgcaaaagatg

SEQ ID NO: 198621 - DNA, 103 bp, Artificial Sequence
  Synthetic Polynucleotide
taatacgactcactatagggagctcttccacaaatagtgcaagcaaagggaacagaggagaccctttatgtgcactattaacctggcggcagcgcaaaagatg

SEQ ID NO: 198622 - DNA, 103 bp, Artificial Sequence
  Synthetic Polynucleotide
taatacgactcactatagggactcttccctgtcaagtccgttgtgttctgaacagaggagacagaacatgacggacttgaacctggcggcagcgcaaaagatg

SEQ ID NO: 198623 - DNA, 103 bp, Artificial Sequence
  Synthetic Polynucleotide
taatacgactcactatagggtagtcgtgaaagctcttccacaaatagtgcaacagaggagagcactaatggtggaagagaacctggcggcagcgcaaaagatg

SEQ ID NO: 198624 - DNA, 103 bp, Artificial Sequence
  Synthetic Polynucleotide
taatacgactcactatagggagattgcctttagtcgtgaaagctcttccaaacagaggagatggaagatgtttcacgacaacctggcggcagcgcaaaagatg

SEQ ID NO: 198625 - DNA, 103 bp, Artificial Sequence
  Synthetic Polynucleotide
taatacgactcactataggggtgtaccttaagattgcctttagtcgtgaaaacagaggagattcacgatgaaaggcaataacctggcggcagcgcaaaagatg

SEQ ID NO: 198626 - DNA, 103 bp, Artificial Sequence
  Synthetic Polynucleotide
taatacgactcactataggggagtgcccatgtgtaccttaagattgccttaacagaggagaaaggcaatgttaaggtacaacctggcggcagcgcaaaagatg

SEQ ID NO: 198627 - DNA, 103 bp, Artificial Sequence
  Synthetic Polynucleotide
taatacgactcactatagggttccacatgtgagtgcccatgtgtaccttaaacagaggagataaggtatgcatgggcacaacctggcggcagcgcaaaagatg

SEQ ID NO: 198628 - DNA, 103 bp, Artificial Sequence
  Synthetic Polynucleotide
taatacgactcactatagggaggggtgctattccacatgtgagtgcccataacagaggagaatgggcatgcacatgtggaacctggcggcagcgcaaaagatg

SEQ ID NO: 198629 - DNA, 103 bp, Artificial Sequence
  Synthetic Polynucleotide
taatacgactcactatagggcccgtcgtgcaggggtgctattccacatgtaacagaggagaacatgtatgatagcacccaacctggcggcagcgcaaaagatg

SEQ ID NO: 198630 - DNA, 103 bp, Artificial Sequence
  Synthetic Polynucleotide
taatacgactcactatagggagccgccgaccccgtcgtgcaggggtgctaaacagaggagatagcacatgtgcacgacgaacctggcggcagcgcaaaagatg

SEQ ID NO: 198631 - DNA, 103 bp, Artificial Sequence
  Synthetic Polynucleotide
taatacgactcactatagggatccacagagagccgccgaccccgtcgtgcaacagaggagagcacgaatgggtcggcggaacctggcggcagcgcaaaagatg

SEQ ID NO: 198632 - DNA, 103 bp, Artificial Sequence
  Synthetic Polynucleotide
taatacgactcactatagggtcatggggccatccacagagagccgccgacaacagaggagagtcggcatgtctctgtggaacctggcggcagcgcaaaagatg

SEQ ID NO: 198633 - DNA, 103 bp, Artificial Sequence
  Synthetic Polynucleotide
taatacgactcactatagggacctccatggactcttccctgtcaagtccgaacagaggagacggactatgcagggaagaaacctggcggcagcgcaaaagatg

SEQ ID NO: 198634 - DNA, 103 bp, Artificial Sequence
  Synthetic Polynucleotide
taatacgactcactatagggcctagaaatgtcatggggccatccacagagaacagaggagactctgtatgtggccccataacctggcggcagcgcaaaagatg

SEQ ID NO: 198635 - DNA, 103 bp, Artificial Sequence
  Synthetic Polynucleotide
taatacgactcactataggggggattgcctcctagaaatgtcatggggccaacagaggagaggccccatgacatttctaaacctggcggcagcgcaaaagatg

SEQ ID NO: 198636 - DNA, 103 bp, Artificial Sequence
  Synthetic Polynucleotide
taatacgactcactatagggggaacttgacgggattgcctcctagaaatgaacagaggagacatttcatggaggcaatcaacctggcggcagcgcaaaagatg

SEQ ID NO: 198637 - DNA, 103 bp, Artificial Sequence
  Synthetic Polynucleotide
taatacgactcactatagggaacatttctgggaacttgacgggattgcctaacagaggagaaggcaaatgcgtcaagttaacctggcggcagcgcaaaagatg

SEQ ID NO: 198638 - DNA, 103 bp, Artificial Sequence
  Synthetic Polynucleotide
taatacgactcactatagggatccttctggaacatttctgggaacttgacaacagaggagagtcaagatgccagaaatgaacctggcggcagcgcaaaagatg

SEQ ID NO: 198639 - DNA, 103 bp, Artificial Sequence
  Synthetic Polynucleotide
taatacgactcactatagggttgccgccaaatccttctggaacatttctgaacagaggagacagaaaatgtccagaaggaacctggcggcagcgcaaaagatg

SEQ ID NO: 198640 - DNA, 103 bp, Artificial Sequence
  Synthetic Polynucleotide
taatacgactcactatagggcttcctgatcttgccgccaaatccttctggaacagaggagaccagaaatgtttggcggcaacctggcggcagcgcaaaagatg

SEQ ID NO: 198641 - DNA, 103 bp, Artificial Sequence
  Synthetic Polynucleotide
taatacgactcactatagggaggatccccacttcctgatcttgccgccaaaacagaggagattggcgatgagatcaggaaacctggcggcagcgcaaaagatg

SEQ ID NO: 198642 - DNA, 103 bp, Artificial Sequence
  Synthetic Polynucleotide
taatacgactcactatagggagaagctggaaggatccccacttcctgatcaacagaggagagatcagatggtggggatcaacctggcggcagcgcaaaagatg

SEQ ID NO: 198643 - DNA, 103 bp, Artificial Sequence
  Synthetic Polynucleotide
taatacgactcactatagggtactgattccagaagctggaaggatccccaaacagaggagatggggaatgttccagcttaacctggcggcagcgcaaaagatg

SEQ ID NO: 198644 - DNA, 103 bp, Artificial Sequence
  Synthetic Polynucleotide
taatacgactcactatagggcggggcctccacctccatggactcttccctaacagaggagaagggaaatgtccatggagaacctggcggcagcgcaaaagatg

SEQ ID NO: 198645 - DNA, 103 bp, Artificial Sequence
  Synthetic Polynucleotide
taatacgactcactatagggcgctgctgcatactgattccagaagctggaaacagaggagatccagcatgtggaatcagaacctggcggcagcgcaaaagatg

SEQ ID NO: 198646 - DNA, 103 bp, Artificial Sequence
  Synthetic Polynucleotide
taatacgactcactatagggcgttggagagcgctgctgcatactgattccaacagaggagaggaatcatgatgcagcagaacctggcggcagcgcaaaagatg

SEQ ID NO: 198647 - DNA, 103 bp, Artificial Sequence
  Synthetic Polynucleotide
taatacgactcactatagggatcgccagcccgttggagagcgctgctgcaaacagaggagatgcagcatggctctccaaaacctggcggcagcgcaaaagatg

SEQ ID NO: 198648 - DNA, 103 bp, Artificial Sequence
  Synthetic Polynucleotide
taatacgactcactataggggttggccttcatcgccagcccgttggagagaacagaggagactctccatggggctggcgaacctggcggcagcgcaaaagatg

SEQ ID NO: 198649 - DNA, 103 bp, Artificial Sequence
  Synthetic Polynucleotide
taatacgactcactatagggcggagatctcgttggccttcatcgccagccaacagaggagaggctggatgtgaaggccaaacctggcggcagcgcaaaagatg

SEQ ID NO: 198650 - DNA, 103 bp, Artificial Sequence
  Synthetic Polynucleotide
taatacgactcactatagggttctgaatgacggagatctcgttggccttcaacagaggagagaaggcatgcgagatctcaacctggcggcagcgcaaaagatg

SEQ ID NO: 198651 - DNA, 103 bp, Artificial Sequence
  Synthetic Polynucleotide
taatacgactcactataggggatgccaccgttctgaatgacggagatctcaacagaggagagagatcatggtcattcagaacctggcggcagcgcaaaagatg

SEQ ID NO: 198652 - DNA, 103 bp, Artificial Sequence
  Synthetic Polynucleotide
taatacgactcactataggggaattggagggatgccaccgttctgaatgaaacagaggagatcattcatgacggtggcaaacctggcggcagcgcaaaagatg

SEQ ID NO: 198653 - DNA, 103 bp, Artificial Sequence
  Synthetic Polynucleotide
taatacgactcactatagggaggcttccaggaattggagggatgccaccgaacagaggagacggtggatgccctccaataacctggcggcagcgcaaaagatg

SEQ ID NO: 198654 - DNA, 103 bp, Artificial Sequence
  Synthetic Polynucleotide
taatacgactcactatagggcccactgccgaggcttccaggaattggaggaacagaggagacctccaatgcctggaagcaacctggcggcagcgcaaaagatg

SEQ ID NO: 198655 - DNA, 103 bp, Artificial Sequence
  Synthetic Polynucleotide
taatacgactcactatagggtgttagcaaccggggcctccacctccatggaacagaggagaccatggatgtggaggcccaacctggcggcagcgcaaaagatg

SEQ ID NO: 198656 - DNA, 103 bp, Artificial Sequence
  Synthetic Polynucleotide
taatacgactcactataggggtgagctgttcccactgccgaggcttccagaacagaggagactggaaatgtcggcagtgaacctggcggcagcgcaaaagatg

SEQ ID NO: 198657 - DNA, 103 bp, Artificial Sequence
  Synthetic Polynucleotide
taatacgactcactatagggccactaacaggtgagctgttcccactgccgaacagaggagacggcagatggaacagctcaacctggcggcagcgcaaaagatg

SEQ ID NO: 198658 - DNA, 103 bp, Artificial Sequence
  Synthetic Polynucleotide
taatacgactcactatagggtcccgtcagcccactaacaggtgagctgttaacagaggagaaacagcatgcctgttagtaacctggcggcagcgcaaaagatg

SEQ ID NO: 198659 - DNA, 103 bp, Artificial Sequence
  Synthetic Polynucleotide
taatacgactcactatagggtctccaggtttcccgtcagcccactaacagaacagaggagactgttaatgggctgacggaacctggcggcagcgcaaaagatg

SEQ ID NO: 198660 - DNA, 103 bp, Artificial Sequence
  Synthetic Polynucleotide
taatacgactcactatagggttctggagcctctccaggtttcccgtcagcaacagaggagagctgacatgaaacctggaaacctggcggcagcgcaaaagatg

SEQ ID NO: 198661 - DNA, 103 bp, Artificial Sequence
  Synthetic Polynucleotide
taatacgactcactataggggggctctgagttctggagcctctccaggttaacagaggagaaacctgatgaggctccagaacctggcggcagcgcaaaagatg

SEQ ID NO: 198662 - DNA, 103 bp, Artificial Sequence
  Synthetic Polynucleotide
taatacgactcactatagggggggagcattgggctctgagttctggagccaacagaggagaggctccatgactcagagcaacctggcggcagcgcaaaagatg

SEQ ID NO: 198663 - DNA, 103 bp, Artificial Sequence
  Synthetic Polynucleotide
taatacgactcactatagggaggccggccaggggagcattgggctctgagaacagaggagactcagaatgcaatgctccaacctggcggcagcgcaaaagatg

SEQ ID NO: 198664 - DNA, 103 bp, Artificial Sequence
  Synthetic Polynucleotide
taatacgactcactatagggcattttctccaggccggccaggggagcattaacagaggagaaatgctatgctggccggcaacctggcggcagcgcaaaagatg

SEQ ID NO: 198665 - DNA, 103 bp, Artificial Sequence
  Synthetic Polynucleotide
taatacgactcactatagggcactgcttgccattttctccaggccggccaaacagaggagatggccgatgtggagaaaaaacctggcggcagcgcaaaagatg

SEQ ID NO: 198666 - DNA, 103 bp, Artificial Sequence
  Synthetic Polynucleotide
taatacgactcactatagggctgccgcttttgttagcaaccggggcctccaacagaggagaggaggcatgggttgctaaaacctggcggcagcgcaaaagatg

SEQ ID NO: 198667 - DNA, 103 bp, Artificial Sequence
  Synthetic Polynucleotide
taatacgactcactataggggttccgttctcactgcttgccattttctccaacagaggagaggagaaatgggcaagcagaacctggcggcagcgcaaaagatg

SEQ ID NO: 198668 - DNA, 103 bp, Artificial Sequence
  Synthetic Polynucleotide
taatacgactcactataggggcggaagttggttccgttctcactgcttgcaacagaggagagcaagcatggagaacggaaacctggcggcagcgcaaaagatg

SEQ ID NO: 198669 - DNA, 103 bp, Artificial Sequence
  Synthetic Polynucleotide
taatacgactcactatagggagcgggtgaagcggaagttggttccgttctaacagaggagaagaacgatgccaacttccaacctggcggcagcgcaaaagatg

SEQ ID NO: 198670 - DNA, 103 bp, Artificial Sequence
  Synthetic Polynucleotide
taatacgactcactatagggtcctccacgaagcgggtgaagcggaagttgaacagaggagacaacttatgcttcacccgaacctggcggcagcgcaaaagatg

SEQ ID NO: 198671 - DNA, 103 bp, Artificial Sequence
  Synthetic Polynucleotide
taatacgactcactatagggctccttgctgtcctccacgaagcgggtgaaaacagaggagattcaccatgttcgtggagaacctggcggcagcgcaaaagatg

SEQ ID NO: 198672 - DNA, 103 bp, Artificial Sequence
  Synthetic Polynucleotide
taatacgactcactatagggtcgtgacgatctccttgctgtcctccacgaaacagaggagatcgtggatgacagcaaggaacctggcggcagcgcaaaagatg

SEQ ID NO: 198673 - DNA, 103 bp, Artificial Sequence
  Synthetic Polynucleotide
taatacgactcactatagggcgaggccacttcggggtcggattggaaatgaacagaggagacatttcatgtccgaccccaacctggcggcagcgcaaaagatg

SEQ ID NO: 198674 - DNA, 103 bp, Artificial Sequence
  Synthetic Polynucleotide
taatacgactcactatagggggaagtgccgctgccgcttttgttagcaacaacagaggagagttgctatgaaaagcggcaacctggcggcagcgcaaaagatg

SEQ ID NO: 198675 - DNA, 103 bp, Artificial Sequence
  Synthetic Polynucleotide
taatacgactcactatagggggctgccgctggaagtgccgctgccgctttaacagaggagaaaagcgatggcggcacttaacctggcggcagcgcaaaagatg

SEQ ID NO: 198676 - DNA, 103 bp, Artificial Sequence
  Synthetic Polynucleotide
taatacgactcactataggggtactgctgtggctgccgctggaagtgccgaacagaggagacggcacatgcagcggcagaacctggcggcagcgcaaaagatg

SEQ ID NO: 198677 - DNA, 103 bp, Artificial Sequence
  Synthetic Polynucleotide
taatacgactcactataggggcttggggcggtactgctgtggctgccgctaacagaggagaagcggcatgcacagcagtaacctggcggcagcgcaaaagatg

SEQ ID NO: 198678 - DNA, 103 bp, Artificial Sequence
  Synthetic Polynucleotide
taatacgactcactatagggtgctgctgctgcttggggcggtactgctgtaacagaggagaacagcaatgccgccccaaaacctggcggcagcgcaaaagatg

SEQ ID NO: 198679 - DNA, 103 bp, Artificial Sequence
  Synthetic Polynucleotide
taatacgactcactatagggctgctgctgctgctgctgctgcttggggcgaacagaggagacgccccatgcagcagcagaacctggcggcagcgcaaaagatg

SEQ ID NO: 198680 - DNA, 103 bp, Artificial Sequence
  Synthetic Polynucleotide
taatacgactcactataggggccgctgctgctgctgctgctgctgctgctaacagaggagaagcagcatgagcagcagcaacctggcggcagcgcaaaagatg

SEQ ID NO: 198681 - DNA, 103 bp, Artificial Sequence
  Synthetic Polynucleotide
taatacgactcactatagggtgccgccgccgccgctgctgctgctgctgcaacagaggagagcagcaatggcagcagcgaacctggcggcagcgcaaaagatg

SEQ ID NO: 198682 - DNA, 103 bp, Artificial Sequence
  Synthetic Polynucleotide
taatacgactcactataggggtggaggagctgccgccgccgccgctgctgaacagaggagacagcagatgcggcggcggaacctggcggcagcgcaaaagatg

SEQ ID NO: 198683 - DNA, 103 bp, Artificial Sequence
  Synthetic Polynucleotide
taatacgactcactatagggtgaggtacctgtggaggagctgccgccgccaacagaggagaggcggcatgagctcctccaacctggcggcagcgcaaaagatg

SEQ ID NO: 198684 - DNA, 103 bp, Artificial Sequence
  Synthetic Polynucleotide
taatacgactcactataggggccgggggagcgaggccacttcggggtcggaacagaggagaccgaccatgaagtggcctaacctggcggcagcgcaaaagatg

SEQ ID NO: 198685 - DNA, 103 bp, Artificial Sequence
  Synthetic Polynucleotide
taatacgactcactatagggttgtgatcgctgaggtacctgtggaggagcaacagaggagagctcctatgcaggtacctaacctggcggcagcgcaaaagatg

SEQ ID NO: 198686 - DNA, 103 bp, Artificial Sequence
  Synthetic Polynucleotide
taatacgactcactatagggggtagagaggttgtgatcgctgaggtacctaacagaggagaaggtacatgagcgatcacaacctggcggcagcgcaaaagatg

SEQ ID NO: 198687 - DNA, 103 bp, Artificial Sequence
  Synthetic Polynucleotide
taatacgactcactatagggcccgagttgaggtagagaggttgtgatcgcaacagaggagagcgatcatgacctctctaaacctggcggcagcgcaaaagatg

SEQ ID NO: 198688 - DNA, 103 bp, Artificial Sequence
  Synthetic Polynucleotide
taatacgactcactatagggttgtcaggtccccgagttgaggtagagaggaacagaggagacctctcatgctcaactcgaacctggcggcagcgcaaaagatg

SEQ ID NO: 198689 - DNA, 103 bp, Artificial Sequence
  Synthetic Polynucleotide
taatacgactcactatagggttgcccagtgttgtcaggtccccgagttgaaacagaggagatcaactatgggacctgacaacctggcggcagcgcaaaagatg

SEQ ID NO: 198690 - DNA, 103 bp, Artificial Sequence
  Synthetic Polynucleotide
taatacgactcactatagggtacggagaagttgcccagtgttgtcaggtcaacagaggagagacctgatgacactgggcaacctggcggcagcgcaaaagatg

SEQ ID NO: 198691 - DNA, 103 bp, Artificial Sequence
  Synthetic Polynucleotide
taatacgactcactatagggtgctgttgattacggagaagttgcccagtgaacagaggagacactggatgacttctccgaacctggcggcagcgcaaaagatg

SEQ ID NO: 198692 - DNA, 103 bp, Artificial Sequence
  Synthetic Polynucleotide
taatacgactcactatagggatgatgacgttgctgttgattacggagaagaacagaggagacttctcatgaatcaacagaacctggcggcagcgcaaaagatg

SEQ ID NO: 198693 - DNA, 103 bp, Artificial Sequence
  Synthetic Polynucleotide
taatacgactcactataggggaggttctcgatgatgacgttgctgttgataacagaggagaatcaacatgaacgtcatcaacctggcggcagcgcaaaagatg

SEQ ID NO: 198694 - DNA, 103 bp, Artificial Sequence
  Synthetic Polynucleotide
taatacgactcactatagggtggtgctctggaggttctcgatgatgacgtaacagaggagaacgtcaatgtcgagaaccaacctggcggcagcgcaaaagatg

SEQ ID NO: 198695 - DNA, 103 bp, Artificial Sequence
  Synthetic Polynucleotide
taatacgactcactatagggtctccatctcgccgggggagcgaggccactaacagaggagaagtggcatggctcccccgaacctggcggcagcgcaaaagatg

SEQ ID NO: 198696 - DNA, 103 bp, Artificial Sequence
  Synthetic Polynucleotide
taatacgactcactatagggaccgccaccttggtgctctggaggttctcgaacagaggagacgagaaatgccagagcacaacctggcggcagcgcaaaagatg

SEQ ID NO: 198697 - DNA, 103 bp, Artificial Sequence
  Synthetic Polynucleotide
taatacgactcactataggggaactgggccaccgccaccttggtgctctgaacagaggagacagagcatgaaggtggcgaacctggcggcagcgcaaaagatg

SEQ ID NO: 198698 - DNA, 103 bp, Artificial Sequence
  Synthetic Polynucleotide
taatacgactcactatagggcttcctgggagaactgggccaccgccacctaacagaggagaaggtggatgtggcccagtaacctggcggcagcgcaaaagatg

SEQ ID NO: 198699 - DNA, 103 bp, Artificial Sequence
  Synthetic Polynucleotide
taatacgactcactatagggccgcacctcgcttcctgggagaactgggccaacagaggagaggcccaatgctcccaggaaacctggcggcagcgcaaaagatg

SEQ ID NO: 198700 - DNA, 103 bp, Artificial Sequence
  Synthetic Polynucleotide
taatacgactcactatagggagaggccccgccgcacctcgcttcctgggaaacagaggagatcccagatggcgaggtgcaacctggcggcagcgcaaaagatg

SEQ ID NO: 198701 - DNA, 103 bp, Artificial Sequence
  Synthetic Polynucleotide
taatacgactcactataggggcttgcccccagaggccccgccgcacctcgaacagaggagacgaggtatggcggggcctaacctggcggcagcgcaaaagatg

SEQ ID NO: 198702 - DNA, 103 bp, Artificial Sequence
  Synthetic Polynucleotide
taatacgactcactataggggggacggccagcttgcccccagaggccccgaacagaggagacggggcatgtgggggcaaaacctggcggcagcgcaaaagatg

SEQ ID NO: 198703 - DNA, 103 bp, Artificial Sequence
  Synthetic Polynucleotide
taatacgactcactatagggcatgagggctgggacggccagcttgcccccaacagaggagagggggcatgctggccgtcaacctggcggcagcgcaaaagatg

SEQ ID NO: 198704 - DNA, 103 bp, Artificial Sequence
  Synthetic Polynucleotide
taatacgactcactatagggggagttgttccatgagggctgggacggccaaacagaggagatggccgatgcagccctcaaacctggcggcagcgcaaaagatg

SEQ ID NO: 198705 - DNA, 103 bp, Artificial Sequence
  Synthetic Polynucleotide
taatacgactcactatagggtgcagagctaggagttgttccatgagggctaacagaggagaagccctatgggaacaactaacctggcggcagcgcaaaagatg

SEQ ID NO: 198706 - DNA, 103 bp, Artificial Sequence
  Synthetic Polynucleotide
taatacgactcactatagggcttttctgtgtctccatctcgccgggggagaacagaggagactccccatgcgagatggaaacctggcggcagcgcaaaagatg

SEQ ID NO: 198707 - DNA, 103 bp, Artificial Sequence
  Synthetic Polynucleotide
taatacgactcactatagggctgctgctgctgcagagctaggagttgttcaacagaggagagaacaaatgctagctctgaacctggcggcagcgcaaaagatg

SEQ ID NO: 198708 - DNA, 103 bp, Artificial Sequence
  Synthetic Polynucleotide
taatacgactcactataggggctggtggatctgctgctgctgcagagctaaacagaggagatagctcatgagcagcagcaacctggcggcagcgcaaaagatg

SEQ ID NO: 198709 - DNA, 103 bp, Artificial Sequence
  Synthetic Polynucleotide
taatacgactcactatagggatcaattgcagctggtggatctgctgctgcaacagaggagagcagcaatggatccaccaaacctggcggcagcgcaaaagatg

SEQ ID NO: 198710 - DNA, 103 bp, Artificial Sequence
  Synthetic Polynucleotide
taatacgactcactatagggaatctgttcgatcaattgcagctggtggataacagaggagaatccacatgctgcaattgaacctggcggcagcgcaaaagatg

SEQ ID NO: 198711 - DNA, 103 bp, Artificial Sequence
  Synthetic Polynucleotide
taatacgactcactatagggtttggtgacgaatctgttcgatcaattgcaaacagaggagatgcaatatgtcgaacagaaacctggcggcagcgcaaaagatg

SEQ ID NO: 198712 - DNA, 103 bp, Artificial Sequence
  Synthetic Polynucleotide
taatacgactcactatagggaacagcaatatttggtgacgaatctgttcgaacagaggagacgaacaatgtcgtcaccaaacctggcggcagcgcaaaagatg

SEQ ID NO: 198713 - DNA, 103 bp, Artificial Sequence
  Synthetic Polynucleotide
taatacgactcactatagggctgagaagccaacagcaatatttggtgacgaacagaggagacgtcacatgatattgctgaacctggcggcagcgcaaaagatg

SEQ ID NO: 198714 - DNA, 103 bp, Artificial Sequence
  Synthetic Polynucleotide
taatacgactcactatagggagtctgcattctgagaagccaacagcaataaacagaggagatattgcatgtggcttctcaacctggcggcagcgcaaaagatg

SEQ ID NO: 198715 - DNA, 103 bp, Artificial Sequence
  Synthetic Polynucleotide
taatacgactcactataggggatgttggcaagtctgcattctgagaagccaacagaggagaggcttcatggaatgcagaaacctggcggcagcgcaaaagatg

SEQ ID NO: 198716 - DNA, 103 bp, Artificial Sequence
  Synthetic Polynucleotide
taatacgactcactatagggaggactagaagatgttggcaagtctgcattaacagaggagaaatgcaatgttgccaacaaacctggcggcagcgcaaaagatg

SEQ ID NO: 198717 - DNA, 103 bp, Artificial Sequence
  Synthetic Polynucleotide
taatacgactcactatagggtcggttgacccttttctgtgtctccatctcaacagaggagagagatgatgacacagaaaaacctggcggcagcgcaaaagatg

SEQ ID NO: 198718 - DNA, 103 bp, Artificial Sequence
  Synthetic Polynucleotide
taatacgactcactatagggtaccttgagaaggactagaagatgttggcaaacagaggagatgccaaatgcttctagtcaacctggcggcagcgcaaaagatg

SEQ ID NO: 198719 - DNA, 103 bp, Artificial Sequence
  Synthetic Polynucleotide
taatacgactcactataggggttcgtaaagtaccttgagaaggactagaaaacagaggagattctagatgttctcaaggaacctggcggcagcgcaaaagatg

SEQ ID NO: 198720 - DNA, 103 bp, Artificial Sequence
  Synthetic Polynucleotide
taatacgactcactataggggttggcagatgttcgtaaagtaccttgagaaacagaggagatctcaaatgactttacgaaacctggcggcagcgcaaaagatg

SEQ ID NO: 198721 - DNA, 103 bp, Artificial Sequence
  Synthetic Polynucleotide
taatacgactcactatagggtggacaaggggttggcagatgttcgtaaagaacagaggagactttacatgcatctgccaaacctggcggcagcgcaaaagatg

SEQ ID NO: 198722 - DNA, 103 bp, Artificial Sequence
  Synthetic Polynucleotide
taatacgactcactataggggaacttagcgtggacaaggggttggcagataacagaggagaatctgcatgccccttgtcaacctggcggcagcgcaaaagatg

SEQ ID NO: 198723 - DNA, 103 bp, Artificial Sequence
  Synthetic Polynucleotide
taatacgactcactatagggagataaatgggaacttagcgtggacaagggaacagaggagacccttgatgacgctaagtaacctggcggcagcgcaaaagatg

SEQ ID NO: 198724 - DNA, 103 bp, Artificial Sequence
  Synthetic Polynucleotide
taatacgactcactatagggccagctgctgagataaatgggaacttagcgaacagaggagacgctaaatgcccatttataacctggcggcagcgcaaaagatg

SEQ ID NO: 198725 - DNA, 103 bp, Artificial Sequence
  Synthetic Polynucleotide
taatacgactcactataggggctgctgctgccagctgctgagataaatggaacagaggagaccatttatgtcagcagctaacctggcggcagcgcaaaagatg

SEQ ID NO: 198726 - DNA, 103 bp, Artificial Sequence
  Synthetic Polynucleotide
taatacgactcactatagggtgccaatccagctgctgctgccagctgctgaacagaggagacagcagatggcagcagcaaacctggcggcagcgcaaaagatg

SEQ ID NO: 198727 - DNA, 103 bp, Artificial Sequence
  Synthetic Polynucleotide
taatacgactcactatagggcgaggctctgtgccaatccagctgctgctgaacagaggagacagcagatgctggattggaacctggcggcagcgcaaaagatg

SEQ ID NO: 198728 - DNA, 103 bp, Artificial Sequence
  Synthetic Polynucleotide
taatacgactcactataggggtagggcgactcggttgacccttttctgtgaacagaggagacacagaatggggtcaaccaacctggcggcagcgcaaaagatg

SEQ ID NO: 198729 - DNA, 103 bp, Artificial Sequence
  Synthetic Polynucleotide
taatacgactcactataggggattggctggcgaggctctgtgccaatccaaacagaggagatggattatgacagagcctaacctggcggcagcgcaaaagatg

SEQ ID NO: 198730 - DNA, 103 bp, Artificial Sequence
  Synthetic Polynucleotide
taatacgactcactatagggaatgctggcagattggctggcgaggctctgaacagaggagacagagcatggccagccaaaacctggcggcagcgcaaaagatg

SEQ ID NO: 198731 - DNA, 103 bp, Artificial Sequence
  Synthetic Polynucleotide
taatacgactcactatagggtcacaccactaatgctggcagattggctggaacagaggagaccagccatgctgccagcaaacctggcggcagcgcaaaagatg

SEQ ID NO: 198732 - DNA, 103 bp, Artificial Sequence
  Synthetic Polynucleotide
taatacgactcactatagggggtagctgtttcacaccactaatgctggcaaacagaggagatgccagatgtagtggtgtaacctggcggcagcgcaaaagatg

SEQ ID NO: 198733 - DNA, 103 bp, Artificial Sequence
  Synthetic Polynucleotide
taatacgactcactatagggctggattgggggtagctgtttcacaccactaacagaggagaagtggtatgaaacagctaaacctggcggcagcgcaaaagatg

SEQ ID NO: 198734 - DNA, 103 bp, Artificial Sequence
  Synthetic Polynucleotide
taatacgactcactatagggtctgaggtagctggattgggggtagctgttaacagaggagaaacagcatgccccaatccaacctggcggcagcgcaaaagatg

SEQ ID NO: 198735 - DNA, 103 bp, Artificial Sequence
  Synthetic Polynucleotide
taatacgactcactatagggccagaactgctctgaggtagctggattgggaacagaggagacccaatatggctacctcaaacctggcggcagcgcaaaagatg

SEQ ID NO: 198736 - DNA, 103 bp, Artificial Sequence
  Synthetic Polynucleotide
taatacgactcactataggggatggtgttgccagaactgctctgaggtagaacagaggagactacctatgagcagttctaacctggcggcagcgcaaaagatg

SEQ ID NO: 198737 - DNA, 103 bp, Artificial Sequence
  Synthetic Polynucleotide
taatacgactcactatagggtggatggaatgatggtgttgccagaactgcaacagaggagagcagttatggcaacaccaaacctggcggcagcgcaaaagatg

SEQ ID NO: 198738 - DNA, 103 bp, Artificial Sequence
  Synthetic Polynucleotide
taatacgactcactataggggagccgctgttggatggaatgatggtgttgaacagaggagacaacacatgcattccatcaacctggcggcagcgcaaaagatg

SEQ ID NO: 198739 - DNA, 103 bp, Artificial Sequence
  Synthetic Polynucleotide
taatacgactcactatagggttggggtttccgctgctttcgccgagacataacagaggagaatgtctatgcgaaagcagaacctggcggcagcgcaaaagatg

SEQ ID NO: 198740 - DNA, 103 bp, Artificial Sequence
  Synthetic Polynucleotide
taatacgactcactataggggcagcacttggcacagacttgggggtgatcaacagaggagagatcacatgcaagtctgtaacctggcggcagcgcaaaagatg

SEQ ID NO: 198741 - DNA, 103 bp, Artificial Sequence
  Synthetic Polynucleotide
taatacgactcactatagggctcaaggcctcgggctgccccaagacactgaacagaggagacagtgtatgggggcagccaacctggcggcagcgcaaaagatg

SEQ ID NO: 198742 - DNA, 103 bp, Artificial Sequence
  Synthetic Polynucleotide
taatacgactcactatagggaggcagtggcctcaaggcctcgggctgcccaacagaggagagggcagatggaggccttgaacctggcggcagcgcaaaagatg

SEQ ID NO: 198743 - DNA, 103 bp, Artificial Sequence
  Synthetic Polynucleotide
taatacgactcactatagggagccctggggaggcagtggcctcaaggcctaacagaggagaaggcctatgggccactgcaacctggcggcagcgcaaaagatg

SEQ ID NO: 198744 - DNA, 103 bp, Artificial Sequence
  Synthetic Polynucleotide
taatacgactcactatagggtggcttcaggagccctggggaggcagtggcaacagaggagagccactatgtccccagggaacctggcggcagcgcaaaagatg

SEQ ID NO: 198745 - DNA, 103 bp, Artificial Sequence
  Synthetic Polynucleotide
taatacgactcactatagggttccattctttggcttcaggagccctggggaacagaggagaccccagatgtcctgaagcaacctggcggcagcgcaaaagatg

SEQ ID NO: 198746 - DNA, 103 bp, Artificial Sequence
  Synthetic Polynucleotide
taatacgactcactatagggagctcaccacttccattctttggcttcaggaacagaggagacctgaaatgaaagaatggaacctggcggcagcgcaaaagatg

SEQ ID NO: 198747 - DNA, 103 bp, Artificial Sequence
  Synthetic Polynucleotide
taatacgactcactatagggtccgtagctcagctcaccacttccattcttaacagaggagaaagaatatgagtggtgagaacctggcggcagcgcaaaagatg

SEQ ID NO: 198748 - DNA, 103 bp, Artificial Sequence
  Synthetic Polynucleotide
taatacgactcactatagggccatcacttctccgtagctcagctcaccacaacagaggagagtggtgatgtgagctacgaacctggcggcagcgcaaaagatg

SEQ ID NO: 198749 - DNA, 103 bp, Artificial Sequence
  Synthetic Polynucleotide
taatacgactcactatagggtccaagggacccatcacttctccgtagctcaacagaggagagagctaatgagaagtgataacctggcggcagcgcaaaagatg

SEQ ID NO: 198750 - DNA, 103 bp, Artificial Sequence
  Synthetic Polynucleotide
taatacgactcactatagggaccaggcttctccaagggacccatcacttcaacagaggagagaagtgatgggtcccttgaacctggcggcagcgcaaaagatg

SEQ ID NO: 198751 - DNA, 103 bp, Artificial Sequence
  Synthetic Polynucleotide
taatacgactcactatagggtgaattgtgcgcagcacttggcacagacttaacagaggagaaagtctatgccaagtgctaacctggcggcagcgcaaaagatg

SEQ ID NO: 198752 - DNA, 103 bp, Artificial Sequence
  Synthetic Polynucleotide
taatacgactcactatagggtgtgccttccaccaggcttctccaagggacaacagaggagagtccctatgagaagcctgaacctggcggcagcgcaaaagatg

SEQ ID NO: 198753 - DNA, 103 bp, Artificial Sequence
  Synthetic Polynucleotide
taatacgactcactatagggaagcggcatttgtgccttccaccaggcttcaacagaggagagaagccatgtggaaggcaaacctggcggcagcgcaaaagatg

SEQ ID NO: 198754 - DNA, 103 bp, Artificial Sequence
  Synthetic Polynucleotide
taatacgactcactatagggtttggcacagaagcggcatttgtgccttccaacagaggagaggaaggatgaaatgccgcaacctggcggcagcgcaaaagatg

SEQ ID NO: 198755 - DNA, 103 bp, Artificial Sequence
  Synthetic Polynucleotide
taatacgactcactatagggtgccaaatactttggcacagaagcggcattaacagaggagaaatgccatgtctgtgccaaacctggcggcagcgcaaaagatg

SEQ ID NO: 198756 - DNA, 103 bp, Artificial Sequence
  Synthetic Polynucleotide
taatacgactcactataggggcactgtcactgccaaatactttggcacagaacagaggagactgtgcatgagtatttggaacctggcggcagcgcaaaagatg

SEQ ID NO: 198757 - DNA, 103 bp, Artificial Sequence
  Synthetic Polynucleotide
taatacgactcactataggggatctgcagggcactgtcactgccaaatacaacagaggagagtatttatgagtgacagtaacctggcggcagcgcaaaagatg

SEQ ID NO: 198758 - DNA, 103 bp, Artificial Sequence
  Synthetic Polynucleotide
taatacgactcactatagggaacgaaggtggatctgcagggcactgtcacaacagaggagagtgacaatgccctgcagaaacctggcggcagcgcaaaagatg

SEQ ID NO: 198759 - DNA, 103 bp, Artificial Sequence
  Synthetic Polynucleotide
taatacgactcactatagggcccgtgtgggaacgaaggtggatctgcaggaacagaggagacctgcaatgccaccttcgaacctggcggcagcgcaaaagatg

SEQ ID NO: 198760 - DNA, 103 bp, Artificial Sequence
  Synthetic Polynucleotide
taatacgactcactataggggggcctctcacccgtgtgggaacgaaggtgaacagaggagacaccttatgtcccacacgaacctggcggcagcgcaaaagatg

SEQ ID NO: 198761 - DNA, 103 bp, Artificial Sequence
  Synthetic Polynucleotide
taatacgactcactatagggtgcacttatagggcctctcacccgtgtgggaacagaggagacccacaatggtgagaggcaacctggcggcagcgcaaaagatg

SEQ ID NO: 198762 - DNA, 103 bp, Artificial Sequence
  Synthetic Polynucleotide
taatacgactcactataggggttgggtcagtgaattgtgcgcagcacttgaacagaggagacaagtgatgcgcacaattaacctggcggcagcgcaaaagatg

SEQ ID NO: 198763 - DNA, 103 bp, Artificial Sequence
  Synthetic Polynucleotide
taatacgactcactatagggccacagacattgcacttatagggcctctcaaacagaggagatgagagatgctataagtgaacctggcggcagcgcaaaagatg

SEQ ID NO: 198764 - DNA, 103 bp, Artificial Sequence
  Synthetic Polynucleotide
taatacgactcactatagggaaaacggtttccacagacattgcacttataaacagaggagatataagatgaatgtctgtaacctggcggcagcgcaaaagatg

SEQ ID NO: 198765 - DNA, 103 bp, Artificial Sequence
  Synthetic Polynucleotide
taatacgactcactatagggcacgggtggtaaaacggtttccacagacataacagaggagaatgtctatggaaaccgttaacctggcggcagcgcaaaagatg

SEQ ID NO: 198766 - DNA, 103 bp, Artificial Sequence
  Synthetic Polynucleotide
taatacgactcactatagggttgaggttgccacgggtggtaaaacggtttaacagaggagaaaaccgatgtaccacccgaacctggcggcagcgcaaaagatg

SEQ ID NO: 198767 - DNA, 103 bp, Artificial Sequence
  Synthetic Polynucleotide
taatacgactcactataggggaaatgcactttgaggttgccacgggtggtaacagaggagaaccaccatgggcaacctcaacctggcggcagcgcaaaagatg

SEQ ID NO: 198768 - DNA, 103 bp, Artificial Sequence
  Synthetic Polynucleotide
taatacgactcactataggggatgccggtggaaatgcactttgaggttgcaacagaggagagcaaccatgaagtgcattaacctggcggcagcgcaaaagatg

SEQ ID NO: 198769 - DNA, 103 bp, Artificial Sequence
  Synthetic Polynucleotide
taatacgactcactatagggtacttctcacgatgccggtggaaatgcactaacagaggagaagtgcaatgccaccggcaaacctggcggcagcgcaaaagatg

SEQ ID NO: 198770 - DNA, 103 bp, Artificial Sequence
  Synthetic Polynucleotide
taatacgactcactatagggcacatgtgggtacttctcacgatgccggtgaacagaggagacaccggatgcgtgagaagaacctggcggcagcgcaaaagatg

SEQ ID NO: 198771 - DNA, 103 bp, Artificial Sequence
  Synthetic Polynucleotide
taatacgactcactatagggggttcatctgcacatgtgggtacttctcacaacagaggagagtgagaatgacccacatgaacctggcggcagcgcaaaagatg

SEQ ID NO: 198772 - DNA, 103 bp, Artificial Sequence
  Synthetic Polynucleotide
taatacgactcactatagggactgggtgtgggttcatctgcacatgtgggaacagaggagacccacaatggcagatgaaaacctggcggcagcgcaaaagatg

SEQ ID NO: 198773 - DNA, 103 bp, Artificial Sequence
  Synthetic Polynucleotide
taatacgactcactataggggaggaattcagttgggtcagtgaattgtgcaacagaggagagcacaaatgactgacccaaacctggcggcagcgcaaaagatg

SEQ ID NO: 198774 - DNA, 103 bp, Artificial Sequence
  Synthetic Polynucleotide
taatacgactcactataggggtgctctggtactgggtgtgggttcatctgaacagaggagacagatgatgccacacccaaacctggcggcagcgcaaaagatg

SEQ ID NO: 198775 - DNA, 103 bp, Artificial Sequence
  Synthetic Polynucleotide
taatacgactcactatagggcatagtctaggtgctctggtactgggtgtgaacagaggagacacaccatgtaccagagcaacctggcggcagcgcaaaagatg

SEQ ID NO: 198776 - DNA, 103 bp, Artificial Sequence
  Synthetic Polynucleotide
taatacgactcactatagggctggtaatgacatagtctaggtgctctggtaacagaggagaaccagaatgcctagactaaacctggcggcagcgcaaaagatg

SEQ ID NO: 198777 - DNA, 103 bp, Artificial Sequence
  Synthetic Polynucleotide
taatacgactcactatagggcaagccactgctggtaatgacatagtctagaacagaggagactagacatggtcattaccaacctggcggcagcgcaaaagatg

SEQ ID NO: 198778 - DNA, 103 bp, Artificial Sequence
  Synthetic Polynucleotide
taatacgactcactatagggtaccataaggcaagccactgctggtaatgaaacagaggagatcattaatggcagtggctaacctggcggcagcgcaaaagatg

SEQ ID NO: 198779 - DNA, 103 bp, Artificial Sequence
  Synthetic Polynucleotide
taatacgactcactatagggggcacggacataccataaggcaagccactgaacagaggagacagtggatggccttatggaacctggcggcagcgcaaaagatg

SEQ ID NO: 198780 - DNA, 103 bp, Artificial Sequence
  Synthetic Polynucleotide
taatacgactcactatagggcttctctggtggcacggacataccataaggaacagaggagaccttatatgatgtccgtgaacctggcggcagcgcaaaagatg

SEQ ID NO: 198781 - DNA, 103 bp, Artificial Sequence
  Synthetic Polynucleotide
taatacgactcactatagggcctcctcggccttctctggtggcacggacaaacagaggagatgtccgatgcaccagagaaacctggcggcagcgcaaaagatg

SEQ ID NO: 198782 - DNA, 103 bp, Artificial Sequence
  Synthetic Polynucleotide
taatacgactcactataggggtggctgcctcctcctcggccttctctggtaacagaggagaaccagaatgggccgaggaaacctggcggcagcgcaaaagatg

SEQ ID NO: 198783 - DNA, 103 bp, Artificial Sequence
  Synthetic Polynucleotide
taatacgactcactatagggtccacctggagtggctgcctcctcctcggcaacagaggagagccgagatggaggcagccaacctggcggcagcgcaaaagatg

SEQ ID NO: 198784 - DNA, 103 bp, Artificial Sequence
  Synthetic Polynucleotide
taatacgactcactatagggtctggtgggcgaggaattcagttgggtcagaacagaggagactgaccatgctgaattccaacctggcggcagcgcaaaagatg

SEQ ID NO: 198785 - DNA, 103 bp, Artificial Sequence
  Synthetic Polynucleotide
taatacgactcactataggggctcaacccctccacctggagtggctgcctaacagaggagaaggcagatgctccaggtgaacctggcggcagcgcaaaagatg

SEQ ID NO: 198786 - DNA, 103 bp, Artificial Sequence
  Synthetic Polynucleotide
taatacgactcactatagggagaggcttgcgctcaacccctccacctggaaacagaggagatccaggatgaggggttgaaacctggcggcagcgcaaaagatg

SEQ ID NO: 198787 - DNA, 103 bp, Artificial Sequence
  Synthetic Polynucleotide
taatacgactcactatagggggaggccaccagaggcttgcgctcaaccccaacagaggagaggggttatgcgcaagcctaacctggcggcagcgcaaaagatg

SEQ ID NO: 198788 - DNA, 103 bp, Artificial Sequence
  Synthetic Polynucleotide
taatacgactcactataggggtgctgttgtggaggccaccagaggcttgcaacagaggagagcaagcatgtggtggcctaacctggcggcagcgcaaaagatg

SEQ ID NO: 198789 - DNA, 103 bp, Artificial Sequence
  Synthetic Polynucleotide
taatacgactcactataggggtggcactgagtgctgttgtggaggccaccaacagaggagaggtggcatgcacaacagcaacctggcggcagcgcaaaagatg

SEQ ID NO: 198790 - DNA, 103 bp, Artificial Sequence
  Synthetic Polynucleotide
taatacgactcactatagggcaggctctctgtggcactgagtgctgttgtaacagaggagaacaacaatgctcagtgccaacctggcggcagcgcaaaagatg

SEQ ID NO: 198791 - DNA, 103 bp, Artificial Sequence
  Synthetic Polynucleotide
taatacgactcactatagggagagcagagtcaggctctctgtggcactgaaacagaggagatcagtgatgcagagagccaacctggcggcagcgcaaaagatg

SEQ ID NO: 198792 - DNA, 103 bp, Artificial Sequence
  Synthetic Polynucleotide
taatacgactcactataggggcactggtggagagcagagtcaggctctctaacagaggagaagagagatggactctgctaacctggcggcagcgcaaaagatg

SEQ ID NO: 198793 - DNA, 103 bp, Artificial Sequence
  Synthetic Polynucleotide
taatacgactcactatagggggctgtgcctgcactggtggagagcagagtaacagaggagaactctgatgtccaccagtaacctggcggcagcgcaaaagatg

SEQ ID NO: 198794 - DNA, 103 bp, Artificial Sequence
  Synthetic Polynucleotide
taatacgactcactatagggctggagccgtggctgtgcctgcactggtggaacagaggagaccaccaatgcaggcacagaacctggcggcagcgcaaaagatg

SEQ ID NO: 198795 - DNA, 103 bp, Artificial Sequence
  Synthetic Polynucleotide
taatacgactcactataggggaacatgcgttctggtgggcgaggaattcaaacagaggagatgaattatgcgcccaccaaacctggcggcagcgcaaaagatg

SEQ ID NO: 198796 - DNA, 103 bp, Artificial Sequence
  Synthetic Polynucleotide
taatacgactcactataggggcagggagtcctggagccgtggctgtgcctaacagaggagaaggcacatgcacggctccaacctggcggcagcgcaaaagatg

SEQ ID NO: 198797 - DNA, 103 bp, Artificial Sequence
  Synthetic Polynucleotide
taatacgactcactatagggcttattgaaagcagggagtcctggagccgtaacagaggagaacggctatgggactccctaacctggcggcagcgcaaaagatg

SEQ ID NO: 198798 - DNA, 103 bp, Artificial Sequence
  Synthetic Polynucleotide
taatacgactcactatagggtgagcacaaacttattgaaagcagggagtcaacagaggagagactccatgctttcaataaacctggcggcagcgcaaaagatg

SEQ ID NO: 198799 - DNA, 103 bp, Artificial Sequence
  Synthetic Polynucleotide
taatacgactcactatagggactgctttcatgagcacaaacttattgaaaaacagaggagatttcaaatggtttgtgctaacctggcggcagcgcaaaagatg

SEQ ID NO: 198800 - DNA, 103 bp, Artificial Sequence
  Synthetic Polynucleotide
taatacgactcactatagggcttgggttccactgctttcatgagcacaaaaacagaggagatttgtgatgatgaaagcaaacctggcggcagcgcaaaagatg

SEQ ID NO: 198801 - DNA, 103 bp, Artificial Sequence
  Synthetic Polynucleotide
taatacgactcactatagggcagctttattcttgggttccactgctttcaaacagaggagatgaaagatgtggaacccaaacctggcggcagcgcaaaagatg

SEQ ID NO: 198802 - DNA, 103 bp, Artificial Sequence
  Synthetic Polynucleotide
taatacgactcactataggggtgttttcatcagctttattcttgggttccaacagaggagaggaaccatggaataaagcaacctggcggcagcgcaaaagatg

SEQ ID NO: 198803 - DNA, 103 bp, Artificial Sequence
  Synthetic Polynucleotide
taatacgactcactatagggccctgggggggtgttttcatcagctttattaacagaggagaaataaaatggatgaaaacaacctggcggcagcgcaaaagatg

SEQ ID NO: 198804 - DNA, 103 bp, Artificial Sequence
  Synthetic Polynucleotide
taatacgactcactatagggagccctcactccctgggggggtgttttcataacagaggagaatgaaaatgcccccccagaacctggcggcagcgcaaaagatg

SEQ ID NO: 198805 - DNA, 103 bp, Artificial Sequence
  Synthetic Polynucleotide
taatacgactcactatagggctgatggctgagccctcactccctggggggaacagaggagaccccccatggagtgagggaacctggcggcagcgcaaaagatg

SEQ ID NO: 198806 - DNA, 103 bp, Artificial Sequence
  Synthetic Polynucleotide
taatacgactcactatagggagggtcagtagaacatgcgttctggtgggcaacagaggagagcccacatgaacgcatgtaacctggcggcagcgcaaaagatg

SEQ ID NO: 198807 - DNA, 103 bp, Artificial Sequence
  Synthetic Polynucleotide
taatacgactcactatagggtgccactccactgatggctgagccctcactaacagaggagaagtgagatgtcagccatcaacctggcggcagcgcaaaagatg

SEQ ID NO: 198808 - DNA, 103 bp, Artificial Sequence
  Synthetic Polynucleotide
taatacgactcactatagggtgctactttctgccactccactgatggctgaacagaggagacagccaatggtggagtggaacctggcggcagcgcaaaagatg

SEQ ID NO: 198809 - DNA, 103 bp, Artificial Sequence
  Synthetic Polynucleotide
taatacgactcactatagggcgagttgccgtgctactttctgccactccaaacagaggagatggagtatgagaaagtagaacctggcggcagcgcaaaagatg

SEQ ID NO: 198810 - DNA, 103 bp, Artificial Sequence
  Synthetic Polynucleotide
taatacgactcactatagggtagttgcatgcgagttgccgtgctactttcaacagaggagagaaagtatgacggcaactaacctggcggcagcgcaaaagatg

SEQ ID NO: 198811 - DNA, 103 bp, Artificial Sequence
  Synthetic Polynucleotide
taatacgactcactatagggccaacttacttagttgcatgcgagttgccgaacagaggagacggcaaatggcatgcaacaacctggcggcagcgcaaaagatg

SEQ ID NO: 198812 - DNA, 103 bp, Artificial Sequence
  Synthetic Polynucleotide
taatacgactcactatagggagtgaagtcaccaacttacttagttgcatgaacagaggagacatgcaatgaagtaagttaacctggcggcagcgcaaaagatg

SEQ ID NO: 198813 - DNA, 103 bp, Artificial Sequence
  Synthetic Polynucleotide
taatacgactcactatagggccagcttggtagtgaagtcaccaacttactaacagaggagaagtaagatggtgacttcaaacctggcggcagcgcaaaagatg

SEQ ID NO: 198814 - DNA, 103 bp, Artificial Sequence
  Synthetic Polynucleotide
taatacgactcactatagggtaagcagtgcccagcttggtagtgaagtcaaacagaggagatgacttatgtaccaagctaacctggcggcagcgcaaaagatg

SEQ ID NO: 198815 - DNA, 103 bp, Artificial Sequence
  Synthetic Polynucleotide
taatacgactcactatagggaagtggttggtaagcagtgcccagcttggtaacagaggagaaccaagatgggcactgctaacctggcggcagcgcaaaagatg

SEQ ID NO: 198816 - DNA, 103 bp, Artificial Sequence
  Synthetic Polynucleotide
taatacgactcactatagggagtggacttgaagtggttggtaagcagtgcaacagaggagagcactgatgaccaaccacaacctggcggcagcgcaaaagatg

SEQ ID NO: 198817 - DNA, 103 bp, Artificial Sequence
  Synthetic Polynucleotide
taatacgactcactatagggccattacaggagggtcagtagaacatgcgtaacagaggagaacgcatatgctactgaccaacctggcggcagcgcaaaagatg

SEQ ID NO: 198818 - DNA, 103 bp, Artificial Sequence
  Synthetic Polynucleotide
taatacgactcactatagggggaagctgccagtggacttgaagtggttggaacagaggagaccaaccatgtcaagtccaaacctggcggcagcgcaaaagatg

SEQ ID NO: 198819 - DNA, 103 bp, Artificial Sequence
  Synthetic Polynucleotide
taatacgactcactatagggtaggggaaggggaagctgccagtggacttgaacagaggagacaagtcatgtggcagcttaacctggcggcagcgcaaaagatg

SEQ ID NO: 198820 - DNA, 103 bp, Artificial Sequence
  Synthetic Polynucleotide
taatacgactcactatagggctctagcacataggggaaggggaagctgccaacagaggagaggcagcatgcccttccccaacctggcggcagcgcaaaagatg

SEQ ID NO: 198821 - DNA, 103 bp, Artificial Sequence
  Synthetic Polynucleotide
taatacgactcactatagggcccccaagggctctagcacataggggaaggaacagaggagaccttccatgatgtgctagaacctggcggcagcgcaaaagatg

SEQ ID NO: 198822 - DNA, 103 bp, Artificial Sequence
  Synthetic Polynucleotide
taatacgactcactataggggagggtgaggcccccaagggctctagcacaaacagaggagatgtgctatggcccttgggaacctggcggcagcgcaaaagatg

SEQ ID NO: 198823 - DNA, 103 bp, Artificial Sequence
  Synthetic Polynucleotide
taatacgactcactatagggtgatgtctcagagggtgaggcccccaagggaacagaggagacccttgatggcctcacccaacctggcggcagcgcaaaagatg

SEQ ID NO: 198824 - DNA, 103 bp, Artificial Sequence
  Synthetic Polynucleotide
taatacgactcactataggggctgcagctttgatgtctcagagggtgaggaacagaggagacctcacatgctgagacataacctggcggcagcgcaaaagatg

SEQ ID NO: 198825 - DNA, 103 bp, Artificial Sequence
  Synthetic Polynucleotide
taatacgactcactatagggtctaccagttgctgcagctttgatgtctcaaacagaggagatgagacatgaaagctgcaaacctggcggcagcgcaaaagatg

SEQ ID NO: 198826 - DNA, 103 bp, Artificial Sequence
  Synthetic Polynucleotide
taatacgactcactataggggtcaatcttttctaccagttgctgcagcttaacagaggagaaagctgatgcaactggtaaacctggcggcagcgcaaaagatg

SEQ ID NO: 198827 - DNA, 103 bp, Artificial Sequence
  Synthetic Polynucleotide
taatacgactcactatagggctccttgccggtcaatcttttctaccagttaacagaggagaaactggatgaaaagattgaacctggcggcagcgcaaaagatg

SEQ ID NO: 198828 - DNA, 103 bp, Artificial Sequence
  Synthetic Polynucleotide
taatacgactcactatagggccaattatcaccattacaggagggtcagtaaacagaggagatactgaatgtcctgtaataacctggcggcagcgcaaaagatg

SEQ ID NO: 198829 - DNA, 103 bp, Artificial Sequence
  Synthetic Polynucleotide
taatacgactcactatagggaccgccacagctccttgccggtcaatctttaacagaggagaaaagatatgccggcaaggaacctggcggcagcgcaaaagatg

SEQ ID NO: 198830 - DNA, 103 bp, Artificial Sequence
  Synthetic Polynucleotide
taatacgactcactatagggagctgaggtcaccgccacagctccttgccgaacagaggagacggcaaatggctgtggcgaacctggcggcagcgcaaaagatg

SEQ ID NO: 198831 - DNA, 103 bp, Artificial Sequence
  Synthetic Polynucleotide
taatacgactcactatagggctcctgaggcagctgaggtcaccgccacagaacagaggagactgtggatgtgacctcagaacctggcggcagcgcaaaagatg

SEQ ID NO: 198832 - DNA, 103 bp, Artificial Sequence
  Synthetic Polynucleotide
taatacgactcactataggggtggtgggggctcctgaggcagctgaggtcaacagaggagagacctcatgtgcctcaggaacctggcggcagcgcaaaagatg

SEQ ID NO: 198833 - DNA, 103 bp, Artificial Sequence
  Synthetic Polynucleotide
taatacgactcactatagggaggggcagaggtggtgggggctcctgaggcaacagaggagagcctcaatggcccccaccaacctggcggcagcgcaaaagatg

SEQ ID NO: 198834 - DNA, 103 bp, Artificial Sequence
  Synthetic Polynucleotide
taatacgactcactatagggatgaaggtgcaggggcagaggtggtgggggaacagaggagacccccaatgcctctgcccaacctggcggcagcgcaaaagatg

SEQ ID NO: 198835 - DNA, 103 bp, Artificial Sequence
  Synthetic Polynucleotide
taatacgactcactataggggaggctgaggatgaaggtgcaggggcagagaacagaggagactctgcatgtgcaccttcaacctggcggcagcgcaaaagatg

SEQ ID NO: 198836 - DNA, 103 bp, Artificial Sequence
  Synthetic Polynucleotide
taatacgactcactatagggaggtccagaagaggctgaggatgaaggtgcaacagaggagagcacctatgtcctcagccaacctggcggcagcgcaaaagatg

SEQ ID NO: 198837 - DNA, 103 bp, Artificial Sequence
  Synthetic Polynucleotide
taatacgactcactatagggcacactggttaggtccagaagaggctgaggaacagaggagacctcagatgcttctggacaacctggcggcagcgcaaaagatg

SEQ ID NO: 198838 - DNA, 103 bp, Artificial Sequence
  Synthetic Polynucleotide
taatacgactcactatagggagacagatgacacactggttaggtccagaaaacagaggagattctggatgtaaccagtgaacctggcggcagcgcaaaagatg

SEQ ID NO: 198839 - DNA, 103 bp, Artificial Sequence
  Synthetic Polynucleotide
taatacgactcactatagggctcctggcccccaattatcaccattacaggaacagaggagacctgtaatggtgataattaacctggcggcagcgcaaaagatg

SEQ ID NO: 198840 - DNA, 103 bp, Artificial Sequence
  Synthetic Polynucleotide
taatacgactcactatagggaagcactcggagacagatgacacactggttaacagaggagaaaccagatggtcatctgtaacctggcggcagcgcaaaagatg

SEQ ID NO: 198841 - DNA, 103 bp, Artificial Sequence
  Synthetic Polynucleotide
taatacgactcactataggggaggacagctaagcactcggagacagatgaaacagaggagatcatctatgtccgagtgcaacctggcggcagcgcaaaagatg

SEQ ID NO: 198842 - DNA, 103 bp, Artificial Sequence
  Synthetic Polynucleotide
taatacgactcactatagggcgtagggcccgaggacagctaagcactcggaacagaggagaccgagtatgtagctgtccaacctggcggcagcgcaaaagatg

SEQ ID NO: 198843 - DNA, 103 bp, Artificial Sequence
  Synthetic Polynucleotide
taatacgactcactatagggataatgaaggcgtagggcccgaggacagctaacagaggagaagctgtatgcgggccctaaacctggcggcagcgcaaaagatg

SEQ ID NO: 198844 - DNA, 103 bp, Artificial Sequence
  Synthetic Polynucleotide
taatacgactcactatagggcatgttggccataatgaaggcgtagggcccaacagaggagagggcccatggccttcattaacctggcggcagcgcaaaagatg

SEQ ID NO: 198845 - DNA, 103 bp, Artificial Sequence
  Synthetic Polynucleotide
taatacgactcactatagggctctcacctccatgttggccataatgaaggaacagaggagaccttcaatgtggccaacaaacctggcggcagcgcaaaagatg

SEQ ID NO: 198846 - DNA, 103 bp, Artificial Sequence
  Synthetic Polynucleotide
taatacgactcactatagggtttgaagggcctctcacctccatgttggccaacagaggagaggccaaatgggaggtgagaacctggcggcagcgcaaaagatg

SEQ ID NO: 198847 - DNA, 103 bp, Artificial Sequence
  Synthetic Polynucleotide
taatacgactcactatagggacactttgcatttgaagggcctctcacctcaacagaggagagaggtgatgggcccttcaaacctggcggcagcgcaaaagatg

SEQ ID NO: 198848 - DNA, 103 bp, Artificial Sequence
  Synthetic Polynucleotide
taatacgactcactataggggctctgccacacactttgcatttgaagggcaacagaggagagcccttatgatgcaaagtaacctggcggcagcgcaaaagatg

SEQ ID NO: 198849 - DNA, 103 bp, Artificial Sequence
  Synthetic Polynucleotide
taatacgactcactatagggggtggagaaggctctgccacacactttgcaaacagaggagatgcaaaatgtgtggcagaaacctggcggcagcgcaaaagatg

SEQ ID NO: 198850 - DNA, 103 bp, Artificial Sequence
  Synthetic Polynucleotide
taatacgactcactatagggagattaactgttggggtttccgctgctttcaacagaggagagaaagcatgggaaaccccaacctggcggcagcgcaaaagatg

SEQ ID NO: 198851 - DNA, 103 bp, Artificial Sequence
  Synthetic Polynucleotide
taatacgactcactatagggtgttggggttctcctggcccccaattatcaaacagaggagatgataaatgggggccaggaacctggcggcagcgcaaaagatg

SEQ ID NO: 198852 - DNA, 103 bp, Artificial Sequence
  Synthetic Polynucleotide
taatacgactcactataggggattacccctggtggagaaggctctgccacaacagaggagagtggcaatgccttctccaaacctggcggcagcgcaaaagatg

SEQ ID NO: 198853 - DNA, 103 bp, Artificial Sequence
  Synthetic Polynucleotide
taatacgactcactatagggtgtgcacgcagattacccctggtggagaagaacagaggagacttctcatgcaggggtaaaacctggcggcagcgcaaaagatg

SEQ ID NO: 198854 - DNA, 103 bp, Artificial Sequence
  Synthetic Polynucleotide
taatacgactcactataggggcccacgaaatgtgcacgcagattacccctaacagaggagaaggggtatgctgcgtgcaaacctggcggcagcgcaaaagatg

SEQ ID NO: 198855 - DNA, 103 bp, Artificial Sequence
  Synthetic Polynucleotide
taatacgactcactatagggtggccttgtggcccacgaaatgtgcacgcaaacagaggagatgcgtgatgatttcgtggaacctggcggcagcgcaaaagatg

SEQ ID NO: 198856 - DNA, 103 bp, Artificial Sequence
  Synthetic Polynucleotide
taatacgactcactataggggcagctggactggccttgtggcccacgaaaaacagaggagatttcgtatgccacaaggcaacctggcggcagcgcaaaagatg

SEQ ID NO: 198857 - DNA, 103 bp, Artificial Sequence
  Synthetic Polynucleotide
taatacgactcactatagggctgtgcccgggcagctggactggccttgtgaacagaggagacacaagatgagtccagctaacctggcggcagcgcaaaagatg

SEQ ID NO: 198858 - DNA, 103 bp, Artificial Sequence
  Synthetic Polynucleotide
taatacgactcactatagggggcaggaattctgtgcccgggcagctggacaacagaggagagtccagatgcccgggcacaacctggcggcagcgcaaaagatg

SEQ ID NO: 198859 - DNA, 103 bp, Artificial Sequence
  Synthetic Polynucleotide
taatacgactcactatagggtggcagatggggcaggaattctgtgcccggaacagaggagaccgggcatggaattcctgaacctggcggcagcgcaaaagatg

SEQ ID NO: 198860 - DNA, 103 bp, Artificial Sequence
  Synthetic Polynucleotide
taatacgactcactataggggaacttcttctggcagatggggcaggaattaacagaggagaaattccatgcccatctgcaacctggcggcagcgcaaaagatg

SEQ ID NO: 198861 - DNA, 103 bp, Artificial Sequence
  Synthetic Polynucleotide
taatacgactcactatagggcagcattggtgaacttcttctggcagatggaacagaggagaccatctatgagaagaagtaacctggcggcagcgcaaaagatg

SEQ ID NO: 198862 - DNA, 103 bp, Artificial Sequence
  Synthetic Polynucleotide
taatacgactcactataggggccgaagagttgttggggttctcctggcccaacagaggagagggccaatggaaccccaaaacctggcggcagcgcaaaagatg

SEQ ID NO: 198863 - DNA, 103 bp, Artificial Sequence
  Synthetic Polynucleotide
taatacgactcactatagggtgcagagtgacagcattggtgaacttcttcaacagaggagagaagaaatgcaccaatgcaacctggcggcagcgcaaaagatg

SEQ ID NO: 198864 - DNA, 103 bp, Artificial Sequence
  Synthetic Polynucleotide
taatacgactcactataggggacatgctgctgcagagtgacagcattggtaacagaggagaaccaatatggtcactctgaacctggcggcagcgcaaaagatg

SEQ ID NO: 198865 - DNA, 103 bp, Artificial Sequence
  Synthetic Polynucleotide
taatacgactcactatagggggtgcatccggacatgctgctgcagagtgaaacagaggagatcactcatgagcagcatgaacctggcggcagcgcaaaagatg

SEQ ID NO: 198866 - DNA, 103 bp, Artificial Sequence
  Synthetic Polynucleotide
taatacgactcactatagggtggccccccaggtgcatccggacatgctgcaacagaggagagcagcaatgccggatgcaaacctggcggcagcgcaaaagatg

SEQ ID NO: 198867 - DNA, 103 bp, Artificial Sequence
  Synthetic Polynucleotide
taatacgactcactataggggttggggatctggccccccaggtgcatccgaacagaggagacggatgatgctggggggcaacctggcggcagcgcaaaagatg

SEQ ID NO: 198868 - DNA, 103 bp, Artificial Sequence
  Synthetic Polynucleotide
taatacgactcactatagggcagtaccaccgttggggatctggccccccaaacagaggagatgggggatgagatccccaaacctggcggcagcgcaaaagatg

SEQ ID NO: 198869 - DNA, 103 bp, Artificial Sequence
  Synthetic Polynucleotide
taatacgactcactatagggtcagggagtgcagtaccaccgttggggatcaacagaggagagatcccatgcggtggtacaacctggcggcagcgcaaaagatg

SEQ ID NO: 198870 - DNA, 103 bp, Artificial Sequence
  Synthetic Polynucleotide
taatacgactcactatagggtcctccaccttcagggagtgcagtaccaccaacagaggagaggtggtatggcactccctaacctggcggcagcgcaaaagatg

SEQ ID NO: 198871 - DNA, 103 bp, Artificial Sequence
  Synthetic Polynucleotide
taatacgactcactatagggcctgagcagctcctccaccttcagggagtgaacagaggagacactccatgaaggtggagaacctggcggcagcgcaaaagatg

SEQ ID NO: 198872 - DNA, 103 bp, Artificial Sequence
  Synthetic Polynucleotide
taatacgactcactataggggagccattctcctgagcagctcctccacctaacagaggagaaggtggatgagctgctcaaacctggcggcagcgcaaaagatg

SEQ ID NO: 198873 - DNA, 103 bp, Artificial Sequence
  Synthetic Polynucleotide
taatacgactcactatagggttcagaggaggccgaagagttgttggggttaacagaggagaaaccccatgaactcttcgaacctggcggcagcgcaaaagatg

SEQ ID NO: 198874 - DNA, 103 bp, Artificial Sequence
  Synthetic Polynucleotide
taatacgactcactatagggagattgctcggagccattctcctgagcagcaacagaggagagctgctatggagaatggcaacctggcggcagcgcaaaagatg

SEQ ID NO: 198875 - DNA, 103 bp, Artificial Sequence
  Synthetic Polynucleotide
taatacgactcactatagggcggagactgtagattgctcggagccattctaacagaggagaagaatgatgccgagcaataacctggcggcagcgcaaaagatg

SEQ ID NO: 198876 - DNA, 103 bp, Artificial Sequence
  Synthetic Polynucleotide
taatacgactcactatagggctccgtgccccggagactgtagattgctcgaacagaggagacgagcaatgtacagtctcaacctggcggcagcgcaaaagatg

SEQ ID NO: 198877 - DNA, 103 bp, Artificial Sequence
  Synthetic Polynucleotide
taatacgactcactatagggctgggggaaactccgtgccccggagactgtaacagaggagaacagtcatgggggcacggaacctggcggcagcgcaaaagatg

SEQ ID NO: 198878 - DNA, 103 bp, Artificial Sequence
  Synthetic Polynucleotide
taatacgactcactataggggggactgctgctgggggaaactccgtgcccaacagaggagagggcacatggtttcccccaacctggcggcagcgcaaaagatg

SEQ ID NO: 198879 - DNA, 103 bp, Artificial Sequence
  Synthetic Polynucleotide
taatacgactcactataggggatggctgctgggactgctgctgggggaaaaacagaggagatttcccatggcagcagtcaacctggcggcagcgcaaaagatg

SEQ ID NO: 198880 - DNA, 103 bp, Artificial Sequence
  Synthetic Polynucleotide
taatacgactcactatagggctcttccggtgatggctgctgggactgctgaacagaggagacagcagatgcagcagccaaacctggcggcagcgcaaaagatg

SEQ ID NO: 198881 - DNA, 103 bp, Artificial Sequence
  Synthetic Polynucleotide
taatacgactcactatagggcagacaactcctcttccggtgatggctgctaacagaggagaagcagcatgcaccggaagaacctggcggcagcgcaaaagatg

SEQ ID NO: 198882 - DNA, 103 bp, Artificial Sequence
  Synthetic Polynucleotide
taatacgactcactatagggtcctcctcctcagacaactcctcttccggtaacagaggagaaccggaatgggagttgtcaacctggcggcagcgcaaaagatg

SEQ ID NO: 198883 - DNA, 103 bp, Artificial Sequence
  Synthetic Polynucleotide
taatacgactcactatagggatcctcctcttcctcctcctcagacaactcaacagaggagagagttgatggaggaggagaacctggcggcagcgcaaaagatg

SEQ ID NO: 198884 - DNA, 103 bp, Artificial Sequence
  Synthetic Polynucleotide
taatacgactcactatagggcaggccggggttcagaggaggccgaagagtaacagaggagaactcttatgcctcctctgaacctggcggcagcgcaaaagatg

SEQ ID NO: 198885 - DNA, 103 bp, Artificial Sequence
  Synthetic Polynucleotide
taatacgactcactatagggcttcttcctcatcctcctcttcctcctcctaacagaggagaaggaggatgaagaggaggaacctggcggcagcgcaaaagatg

SEQ ID NO: 198886 - DNA, 103 bp, Artificial Sequence
  Synthetic Polynucleotide
taatacgactcactatagggacatcttcctcttcttcctcatcctcctctaacagaggagaagaggaatgtgaggaagaaacctggcggcagcgcaaaagatg

SEQ ID NO: 198887 - DNA, 103 bp, Artificial Sequence
  Synthetic Polynucleotide
taatacgactcactatagggttcatcagtcacatcttcctcttcttcctcaacagaggagagaggaaatggaggaagataacctggcggcagcgcaaaagatg

SEQ ID NO: 198888 - DNA, 103 bp, Artificial Sequence
  Synthetic Polynucleotide
taatacgactcactatagggccagggaatcttcatcagtcacatcttcctaacagaggagaaggaagatgtgactgatgaacctggcggcagcgcaaaagatg

SEQ ID NO: 198889 - DNA, 103 bp, Artificial Sequence
  Synthetic Polynucleotide
taatacgactcactatagggcctctccctgccagggaatcttcatcagtcaacagaggagagactgaatgagattccctaacctggcggcagcgcaaaagatg

SEQ ID NO: 198890 - DNA, 103 bp, Artificial Sequence
  Synthetic Polynucleotide
taatacgactcactatagggactctctgagcctctccctgccagggaatcaacagaggagagattccatggcagggagaaacctggcggcagcgcaaaagatg

SEQ ID NO: 198891 - DNA, 103 bp, Artificial Sequence
  Synthetic Polynucleotide
taatacgactcactatagggtctcacctccactctctgagcctctccctgaacagaggagacagggaatggctcagagaaacctggcggcagcgcaaaagatg

SEQ ID NO: 198892 - DNA, 103 bp, Artificial Sequence
  Synthetic Polynucleotide
taatacgactcactataggggatattgccttctcacctccactctctgagaacagaggagactcagaatgtggaggtgaaacctggcggcagcgcaaaagatg

SEQ ID NO: 198893 - DNA, 103 bp, Artificial Sequence
  Synthetic Polynucleotide
taatacgactcactatagggacctctcactgatattgccttctcacctccaacagaggagaggaggtatgaaggcaataaacctggcggcagcgcaaaagatg

SEQ ID NO: 198894 - DNA, 103 bp, Artificial Sequence
  Synthetic Polynucleotide
taatacgactcactatagggcttctgaatcacctctcactgatattgcctaacagaggagaaggcaaatgcagtgagagaacctggcggcagcgcaaaagatg

SEQ ID NO: 198895 - DNA, 103 bp, Artificial Sequence
  Synthetic Polynucleotide
taatacgactcactatagggttgtgaccctcaggccggggttcagaggagaacagaggagactcctcatgaccccggccaacctggcggcagcgcaaaagatg

SEQ ID NO: 198896 - DNA, 103 bp, Artificial Sequence
  Synthetic Polynucleotide
taatacgactcactatagggccagatgcctcttctgaatcacctctcactaacagaggagaagtgagatgtgattcagaaacctggcggcagcgcaaaagatg

SEQ ID NO: 198897 - DNA, 103 bp, Artificial Sequence
  Synthetic Polynucleotide
taatacgactcactatagggctcctctgccccagatgcctcttctgaatcaacagaggagagattcaatggaggcatctaacctggcggcagcgcaaaagatg

SEQ ID NO: 198898 - DNA, 103 bp, Artificial Sequence
  Synthetic Polynucleotide
taatacgactcactatagggtccccacctcctcctctgccccagatgcctaacagaggagaaggcatatggggcagaggaacctggcggcagcgcaaaagatg

SEQ ID NO: 198899 - DNA, 103 bp, Artificial Sequence
  Synthetic Polynucleotide
taatacgactcactataggggccgccactgtccccacctcctcctctgccaacagaggagaggcagaatgggaggtgggaacctggcggcagcgcaaaagatg

SEQ ID NO: 198900 - DNA, 103 bp, Artificial Sequence
  Synthetic Polynucleotide
taatacgactcactatagggtgtggctgctgccgccactgtccccacctcaacagaggagagaggtgatgacagtggcgaacctggcggcagcgcaaaagatg

SEQ ID NO: 198901 - DNA, 103 bp, Artificial Sequence
  Synthetic Polynucleotide
taatacgactcactatagggccttcccagctgtggctgctgccgccactgaacagaggagacagtggatgcagcagccaaacctggcggcagcgcaaaagatg

SEQ ID NO: 198902 - DNA, 103 bp, Artificial Sequence
  Synthetic Polynucleotide
taatacgactcactatagggctgtccatctccttcccagctgtggctgctaacagaggagaagcagcatgagctgggaaaacctggcggcagcgcaaaagatg

SEQ ID NO: 198903 - DNA, 103 bp, Artificial Sequence
  Synthetic Polynucleotide
taatacgactcactatagggtttctcattactgtccatctccttcccagcaacagaggagagctgggatggagatggacaacctggcggcagcgcaaaagatg

SEQ ID NO: 198904 - DNA, 103 bp, Artificial Sequence
  Synthetic Polynucleotide
taatacgactcactataggggttgagtagttttctcattactgtccatctaacagaggagaagatggatggtaatgagaaacctggcggcagcgcaaaagatg

SEQ ID NO: 198905 - DNA, 103 bp, Artificial Sequence
  Synthetic Polynucleotide
taatacgactcactatagggaaagaagactgttgagtagttttctcattaaacagaggagataatgaatgaactactcaaacctggcggcagcgcaaaagatg

SEQ ID NO: 198906 - DNA, 103 bp, Artificial Sequence
  Synthetic Polynucleotide
taatacgactcactatagggctgaggattattgtgaccctcaggccggggaacagaggagaccccggatggagggtcacaacctggcggcagcgcaaaagatg

SEQ ID NO: 198907 - DNA, 103 bp, Artificial Sequence
  Synthetic Polynucleotide
taatacgactcactatagggtggtggtggcaaagaagactgttgagtagtaacagaggagaactactatgcagtcttctaacctggcggcagcgcaaaagatg

SEQ ID NO: 198908 - DNA, 103 bp, Artificial Sequence
  Synthetic Polynucleotide
taatacgactcactatagggcaggtggtggtggtggtggcaaagaagactaacagaggagaagtcttatgtgccaccacaacctggcggcagcgcaaaagatg

SEQ ID NO: 198909 - DNA, 103 bp, Artificial Sequence
  Synthetic Polynucleotide
taatacgactcactatagggtccaggctgtcaggtggtggtggtggtggcaacagaggagagccaccatgaccaccaccaacctggcggcagcgcaaaagatg

SEQ ID NO: 198910 - DNA, 103 bp, Artificial Sequence
  Synthetic Polynucleotide
taatacgactcactatagggctgaggctgatccaggctgtcaggtggtggaacagaggagaccaccaatggacagcctgaacctggcggcagcgcaaaagatg

SEQ ID NO: 198911 - DNA, 103 bp, Artificial Sequence
  Synthetic Polynucleotide
taatacgactcactataggggctccattggctgaggctgatccaggctgtaacagaggagaacagccatgatcagcctcaacctggcggcagcgcaaaagatg

SEQ ID NO: 198912 - DNA, 103 bp, Artificial Sequence
  Synthetic Polynucleotide
taatacgactcactatagggctgcttccctgctccattggctgaggctgaaacagaggagatcagccatggccaatggaaacctggcggcagcgcaaaagatg

SEQ ID NO: 198913 - DNA, 103 bp, Artificial Sequence
  Synthetic Polynucleotide
taatacgactcactatagggtaaaacaccactgcttccctgctccattggaacagaggagaccaatgatgcagggaagcaacctggcggcagcgcaaaagatg

SEQ ID NO: 198914 - DNA, 103 bp, Artificial Sequence
  Synthetic Polynucleotide
taatacgactcactatagggccttgcctcctaaaacaccactgcttccctaacagaggagaagggaaatggtggtgtttaacctggcggcagcgcaaaagatg

SEQ ID NO: 198915 - DNA, 103 bp, Artificial Sequence
  Synthetic Polynucleotide
taatacgactcactatagggcccccctcttccttgcctcctaaaacaccaaacagaggagatggtgtatgaggaggcaaaacctggcggcagcgcaaaagatg

SEQ ID NO: 198916 - DNA, 103 bp, Artificial Sequence
  Synthetic Polynucleotide
taatacgactcactatagggctccggtttgcccccctcttccttgcctccaacagaggagaggaggcatggaagaggggaacctggcggcagcgcaaaagatg

SEQ ID NO: 198917 - DNA, 103 bp, Artificial Sequence
  Synthetic Polynucleotide
taatacgactcactatagggtgtccatgacctgaggattattgtgaccctaacagaggagaagggtcatgataatcctcaacctggcggcagcgcaaaagatg

SEQ ID NO: 198918 - DNA, 103 bp, Artificial Sequence
  Synthetic Polynucleotide
taatacgactcactatagggttgagcttctctccggtttgcccccctcttaacagaggagaaagaggatggcaaaccggaacctggcggcagcgcaaaagatg

SEQ ID NO: 198919 - DNA, 103 bp, Artificial Sequence
  Synthetic Polynucleotide
taatacgactcactataggggatgccggacttgagcttctctccggtttgaacagaggagacaaaccatggagaagctcaacctggcggcagcgcaaaagatg

SEQ ID NO: 198920 - DNA, 103 bp, Artificial Sequence
  Synthetic Polynucleotide
taatacgactcactatagggggtgagtgctgatgccggacttgagcttctaacagaggagaagaagcatgagtccggcaaacctggcggcagcgcaaaagatg

SEQ ID NO: 198921 - DNA, 103 bp, Artificial Sequence
  Synthetic Polynucleotide
taatacgactcactatagggccccttctggggtgagtgctgatgccggacaacagaggagagtccggatgcagcactcaaacctggcggcagcgcaaaagatg

SEQ ID NO: 198922 - DNA, 103 bp, Artificial Sequence
  Synthetic Polynucleotide
taatacgactcactatagggctggtggcttccccttctggggtgagtgctaacagaggagaagcactatgcccagaaggaacctggcggcagcgcaaaagatg

SEQ ID NO: 198923 - DNA, 103 bp, Artificial Sequence
  Synthetic Polynucleotide
taatacgactcactatagggcaaggtcacgctggtggcttccccttctggaacagaggagaccagaaatggaagccaccaacctggcggcagcgcaaaagatg

SEQ ID NO: 198924 - DNA, 103 bp, Artificial Sequence
  Synthetic Polynucleotide
taatacgactcactataggggctcctctaccaaggtcacgctggtggcttaacagaggagaaagccaatggcgtgacctaacctggcggcagcgcaaaagatg

SEQ ID NO: 198925 - DNA, 103 bp, Artificial Sequence
  Synthetic Polynucleotide
taatacgactcactatagggtgcaggctcagctcctctaccaaggtcacgaacagaggagacgtgacatgggtagaggaaacctggcggcagcgcaaaagatg

SEQ ID NO: 198926 - DNA, 103 bp, Artificial Sequence
  Synthetic Polynucleotide
taatacgactcactatagggcattgcctcctgcaggctcagctcctctacaacagaggagagtagagatgctgagcctgaacctggcggcagcgcaaaagatg

SEQ ID NO: 198927 - DNA, 103 bp, Artificial Sequence
  Synthetic Polynucleotide
taatacgactcactataggggctcctttctcattgcctcctgcaggctcaaacagaggagatgagccatgaggaggcaaaacctggcggcagcgcaaaagatg

SEQ ID NO: 198928 - DNA, 103 bp, Artificial Sequence
  Synthetic Polynucleotide
taatacgactcactatagggctatgctctgtgtccatgacctgaggattaaacagaggagataatccatgggtcatggaaacctggcggcagcgcaaaagatg

SEQ ID NO: 198929 - DNA, 103 bp, Artificial Sequence
  Synthetic Polynucleotide
taatacgactcactatagggctctctcctggctcctttctcattgcctccaacagaggagaggaggcatggagaaaggaaacctggcggcagcgcaaaagatg

SEQ ID NO: 198930 - DNA, 103 bp, Artificial Sequence
  Synthetic Polynucleotide
taatacgactcactatagggtctgctgctgctctctcctggctcctttctaacagaggagaagaaagatgccaggagagaacctggcggcagcgcaaaagatg

SEQ ID NO: 198931 - DNA, 103 bp, Artificial Sequence
  Synthetic Polynucleotide
taatacgactcactatagggcgcaggcctttctgctgctgctctctcctgaacagaggagacaggagatggcagcagcaaacctggcggcagcgcaaaagatg

SEQ ID NO: 198932 - DNA, 103 bp, Artificial Sequence
  Synthetic Polynucleotide
taatacgactcactatagggccacacacttcgcaggcctttctgctgctgaacagaggagacagcagatgaaaggcctgaacctggcggcagcgcaaaagatg

SEQ ID NO: 198933 - DNA, 103 bp, Artificial Sequence
  Synthetic Polynucleotide
taatacgactcactatagggaaaggcctggccacacacttcgcaggccttaacagaggagaaaggccatggaagtgtgtaacctggcggcagcgcaaaagatg

SEQ ID NO: 198934 - DNA, 103 bp, Artificial Sequence
  Synthetic Polynucleotide
taatacgactcactatagggcctgggagggaaaggcctggccacacacttaacagaggagaaagtgtatggccaggcctaacctggcggcagcgcaaaagatg

SEQ ID NO: 198935 - DNA, 103 bp, Artificial Sequence
  Synthetic Polynucleotide
taatacgactcactatagggtccagagctgcctgggagggaaaggcctggaacagaggagaccaggcatgtccctcccaaacctggcggcagcgcaaaagatg

SEQ ID NO: 198936 - DNA, 103 bp, Artificial Sequence
  Synthetic Polynucleotide
taatacgactcactatagggctgatgctcctccagagctgcctgggagggaacagaggagaccctccatggcagctctgaacctggcggcagcgcaaaagatg

SEQ ID NO: 198937 - DNA, 103 bp, Artificial Sequence
  Synthetic Polynucleotide
taatacgactcactatagggggtgggtcttctgatgctcctccagagctgaacagaggagacagctcatgaggagcatcaacctggcggcagcgcaaaagatg

SEQ ID NO: 198938 - DNA, 103 bp, Artificial Sequence
  Synthetic Polynucleotide
taatacgactcactatagggccctccttggggtgggtcttctgatgctccaacagaggagaggagcaatggaagacccaaacctggcggcagcgcaaaagatg

SEQ ID NO: 198939 - DNA, 103 bp, Artificial Sequence
  Synthetic Polynucleotide
taatacgactcactatagggtggggggttgctatgctctgtgtccatgacaacagaggagagtcatgatgacagagcataacctggcggcagcgcaaaagatg

SEQ ID NO: 198940 - DNA, 103 bp, Artificial Sequence
  Synthetic Polynucleotide
taatacgactcactataggggaagagcggcccctccttggggtgggtcttaacagaggagaaagaccatgcccaaggagaacctggcggcagcgcaaaagatg

SEQ ID NO: 198941 - DNA, 103 bp, Artificial Sequence
  Synthetic Polynucleotide
taatacgactcactatagggaaacacaagtgaagagcggcccctccttggaacagaggagaccaaggatgggccgctctaacctggcggcagcgcaaaagatg

SEQ ID NO: 198942 - DNA, 103 bp, Artificial Sequence
  Synthetic Polynucleotide
taatacgactcactatagggtgcctgcagaaaacacaagtgaagagcggcaacagaggagagccgctatgcacttgtgtaacctggcggcagcgcaaaagatg

SEQ ID NO: 198943 - DNA, 103 bp, Artificial Sequence
  Synthetic Polynucleotide
taatacgactcactatagggaagaaagccctgcctgcagaaaacacaagtaacagaggagaacttgtatgttctgcaggaacctggcggcagcgcaaaagatg

SEQ ID NO: 198944 - DNA, 103 bp, Artificial Sequence
  Synthetic Polynucleotide
taatacgactcactatagggtagcccgctcaagaaagccctgcctgcagaaacagaggagatctgcaatgagggctttcaacctggcggcagcgcaaaagatg

SEQ ID NO: 198945 - DNA, 103 bp, Artificial Sequence
  Synthetic Polynucleotide
taatacgactcactatagggttcttgagggtagcccgctcaagaaagcccaacagaggagagggcttatgtgagcgggcaacctggcggcagcgcaaaagatg

SEQ ID NO: 198946 - DNA, 103 bp, Artificial Sequence
  Synthetic Polynucleotide
taatacgactcactataggggagcatatgcttcttgagggtagcccgctcaacagaggagagagcggatgaccctcaagaacctggcggcagcgcaaaagatg

SEQ ID NO: 198947 - DNA, 103 bp, Artificial Sequence
  Synthetic Polynucleotide
taatacgactcactatagggggtgtgccaggagcatatgcttcttgagggaacagaggagaccctcaatgagcatatgcaacctggcggcagcgcaaaagatg

SEQ ID NO: 198948 - DNA, 103 bp, Artificial Sequence
  Synthetic Polynucleotide
taatacgactcactatagggtgtacctggtggtgtgccaggagcatatgcaacagaggagagcatatatgcctggcacaaacctggcggcagcgcaaaagatg

SEQ ID NO: 198949 - DNA, 103 bp, Artificial Sequence
  Synthetic Polynucleotide
taatacgactcactatagggggcaaagggctgtacctggtggtgtgccagaacagaggagactggcaatgcaccaggtaaacctggcggcagcgcaaaagatg

SEQ ID NO: 198950 - DNA, 103 bp, Artificial Sequence
  Synthetic Polynucleotide
taatacgactcactatagggacccagaatctggggggttgctatgctctgaacagaggagacagagcatggcaacccccaacctggcggcagcgcaaaagatg

SEQ ID NO: 198951 - DNA, 103 bp, Artificial Sequence
  Synthetic Polynucleotide
taatacgactcactatagggggccatggggggcaaagggctgtacctggtaacagaggagaaccaggatgagccctttgaacctggcggcagcgcaaaagatg

SEQ ID NO: 198952 - DNA, 103 bp, Artificial Sequence
  Synthetic Polynucleotide
taatacgactcactatagggatattctgagggccatggggggcaaagggcaacagaggagagcccttatgcccccatggaacctggcggcagcgcaaaagatg

SEQ ID NO: 198953 - DNA, 103 bp, Artificial Sequence
  Synthetic Polynucleotide
taatacgactcactatagggaagagcagcaatattctgagggccatggggaacagaggagaccccatatgcctcagaataacctggcggcagcgcaaaagatg

SEQ ID NO: 198954 - DNA, 103 bp, Artificial Sequence
  Synthetic Polynucleotide
taatacgactcactatagggggactagagaaagagcagcaatattctgagaacagaggagactcagaatgttgctgctcaacctggcggcagcgcaaaagatg

SEQ ID NO: 198955 - DNA, 103 bp, Artificial Sequence
  Synthetic Polynucleotide
taatacgactcactataggggaacagccagggactagagaaagagcagcaaacagaggagatgctgcatgttctctagtaacctggcggcagcgcaaaagatg

SEQ ID NO: 198956 - DNA, 103 bp, Artificial Sequence
  Synthetic Polynucleotide
taatacgactcactataggggatggaaggcgaacagccagggactagagaaacagaggagatctctaatgcctggctgtaacctggcggcagcgcaaaagatg

SEQ ID NO: 198957 - DNA, 103 bp, Artificial Sequence
  Synthetic Polynucleotide
taatacgactcactatagggctgtggaggtgatggaaggcgaacagccagaacagaggagactggctatgcgccttccaaacctggcggcagcgcaaaagatg

SEQ ID NO: 198958 - DNA, 103 bp, Artificial Sequence
  Synthetic Polynucleotide
taatacgactcactatagggggggagagccctgtggaggtgatggaaggcaacagaggagagccttcatgcacctccacaacctggcggcagcgcaaaagatg

SEQ ID NO: 198959 - DNA, 103 bp, Artificial Sequence
  Synthetic Polynucleotide
taatacgactcactatagggtcggggaaagggggagagccctgtggaggtaacagaggagaacctccatggggctctccaacctggcggcagcgcaaaagatg

SEQ ID NO: 198960 - DNA, 103 bp, Artificial Sequence
  Synthetic Polynucleotide
taatacgactcactatagggggtcatcttttcggggaaagggggagagccaacagaggagaggctctatgcctttccccaacctggcggcagcgcaaaagatg

SEQ ID NO: 198961 - DNA, 103 bp, Artificial Sequence
  Synthetic Polynucleotide
taatacgactcactatagggtcgcagtccgagattaactgttggggtttcaacagaggagagaaaccatgacagttaataacctggcggcagcgcaaaagatg

SEQ ID NO: 198962 - DNA, 103 bp, Artificial Sequence
  Synthetic Polynucleotide
taatacgactcactatagggggcacggaggacccagaatctggggggttgaacagaggagacaacccatgagattctggaacctggcggcagcgcaaaagatg

SEQ ID NO: 198963 - DNA, 103 bp, Artificial Sequence
  Synthetic Polynucleotide
taatacgactcactataggggggatcgtggggtcatcttttcggggaaagaacagaggagactttccatgaaaagatgaaacctggcggcagcgcaaaagatg

SEQ ID NO: 198964 - DNA, 103 bp, Artificial Sequence
  Synthetic Polynucleotide
taatacgactcactataggggggatccgtgggcacggaggacccagaatcaacagaggagagattctatgtcctccgtgaacctggcggcagcgcaaaagatg

SEQ ID NO: 198965 - DNA, 103 bp, Artificial Sequence
  Synthetic Polynucleotide
taatacgactcactatagggggccccaggtgggatccgtgggcacggaggaacagaggagacctccgatgccacggatcaacctggcggcagcgcaaaagatg

SEQ ID NO: 198966 - DNA, 103 bp, Artificial Sequence
  Synthetic Polynucleotide
taatacgactcactatagggctcctctctgggccccaggtgggatccgtgaacagaggagacacggaatgcacctggggaacctggcggcagcgcaaaagatg

SEQ ID NO: 198967 - DNA, 103 bp, Artificial Sequence
  Synthetic Polynucleotide
taatacgactcactatagggctcctctcctctcctctctgggccccaggtaacagaggagaacctggatgccagagaggaacctggcggcagcgcaaaagatg

SEQ ID NO: 198968 - DNA, 103 bp, Artificial Sequence
  Synthetic Polynucleotide
taatacgactcactataggggccctgaagactcctctcctctcctctctgaacagaggagacagagaatggaggagaggaacctggcggcagcgcaaaagatg

SEQ ID NO: 198969 - DNA, 103 bp, Artificial Sequence
  Synthetic Polynucleotide
taatacgactcactatagggaccaggaaatgccctgaagactcctctcctaacagaggagaaggagaatggtcttcaggaacctggcggcagcgcaaaagatg

SEQ ID NO: 198970 - DNA, 103 bp, Artificial Sequence
  Synthetic Polynucleotide
taatacgactcactatagggtgtggcagcgaccaggaaatgccctgaagaaacagaggagatcttcaatgcatttcctgaacctggcggcagcgcaaaagatg

SEQ ID NO: 198971 - DNA, 103 bp, Artificial Sequence
  Synthetic Polynucleotide
taatacgactcactatagggccgctgtacctgtggcagcgaccaggaaataacagaggagaatttccatgtcgctgccaaacctggcggcagcgcaaaagatg

SEQ ID NO: 198972 - DNA, 103 bp, Artificial Sequence
  Synthetic Polynucleotide
taatacgactcactatagggcctcccccagccgctgtacctgtggcagcgaacagaggagacgctgcatgaggtacagcaacctggcggcagcgcaaaagatg

SEQ ID NO: 198973 - DNA, 103 bp, Artificial Sequence
  Synthetic Polynucleotide
taatacgactcactataggggctgggaccttcgcagtccgagattaactgaacagaggagacagttaatgtcggactgcaacctggcggcagcgcaaaagatg

SEQ ID NO: 198974 - DNA, 103 bp, Artificial Sequence
  Synthetic Polynucleotide
taatacgactcactatagggcaggcccccgcctcccccagccgctgtaccaacagaggagaggtacaatggctgggggaaacctggcggcagcgcaaaagatg

SEQ ID NO: 198975 - DNA, 103 bp, Artificial Sequence
  Synthetic Polynucleotide
taatacgactcactatagggtggccaagatcaggcccccgcctcccccagaacagaggagactggggatggcgggggccaacctggcggcagcgcaaaagatg

SEQ ID NO: 198976 - DNA, 103 bp, Artificial Sequence
  Synthetic Polynucleotide
taatacgactcactatagggagcttgggactggccaagatcaggcccccgaacagaggagacgggggatggatcttggcaacctggcggcagcgcaaaagatg

SEQ ID NO: 198977 - DNA, 103 bp, Artificial Sequence
  Synthetic Polynucleotide
taatacgactcactatagggggttgctcccagcttgggactggccaagataacagaggagaatcttgatgagtcccaagaacctggcggcagcgcaaaagatg

SEQ ID NO: 198978 - DNA, 103 bp, Artificial Sequence
  Synthetic Polynucleotide
taatacgactcactataggggaggtaatggggttgctcccagcttgggacaacagaggagagtcccaatgtgggagcaaaacctggcggcagcgcaaaagatg

SEQ ID NO: 198979 - DNA, 103 bp, Artificial Sequence
  Synthetic Polynucleotide
taatacgactcactataggggtcgattctggaggtaatggggttgctcccaacagaggagagggagcatgcccattaccaacctggcggcagcgcaaaagatg

SEQ ID NO: 198980 - DNA, 103 bp, Artificial Sequence
  Synthetic Polynucleotide
taatacgactcactataggggggtgcaggggtcgattctggaggtaatggaacagaggagaccattaatgccagaatcgaacctggcggcagcgcaaaagatg

SEQ ID NO: 198981 - DNA, 103 bp, Artificial Sequence
  Synthetic Polynucleotide
taatacgactcactataggggaggaggagggggtgcaggggtcgattctgaacagaggagacagaatatgcccctgcacaacctggcggcagcgcaaaagatg

SEQ ID NO: 198982 - DNA, 103 bp, Artificial Sequence
  Synthetic Polynucleotide
taatacgactcactataggggggggtggtggaggaggagggggtgcagggaacagaggagaccctgcatgccctcctccaacctggcggcagcgcaaaagatg

SEQ ID NO: 198983 - DNA, 103 bp, Artificial Sequence
  Synthetic Polynucleotide
taatacgactcactatagggtgggggcggagggggtggtggaggaggaggaacagaggagacctcctatgccaccacccaacctggcggcagcgcaaaagatg

SEQ ID NO: 198984 - DNA, 103 bp, Artificial Sequence
  Synthetic Polynucleotide
taatacgactcactatagggtctcagacgcgctgggaccttcgcagtccgaacagaggagacggactatgaaggtcccaaacctggcggcagcgcaaaagatg

SEQ ID NO: 198985 - DNA, 103 bp, Artificial Sequence
  Synthetic Polynucleotide
taatacgactcactatagggtgcctacccctgggggcggagggggtggtgaacagaggagacaccacatgctccgccccaacctggcggcagcgcaaaagatg

SEQ ID NO: 198986 - DNA, 103 bp, Artificial Sequence
  Synthetic Polynucleotide
taatacgactcactatagggaagtggccactgcctacccctgggggcggaaacagaggagatccgccatgaggggtaggaacctggcggcagcgcaaaagatg

SEQ ID NO: 198987 - DNA, 103 bp, Artificial Sequence
  Synthetic Polynucleotide
taatacgactcactatagggggggatattcaagtggccactgcctaccccaacagaggagaggggtaatgagtggccacaacctggcggcagcgcaaaagatg

SEQ ID NO: 198988 - DNA, 103 bp, Artificial Sequence
  Synthetic Polynucleotide
taatacgactcactatagggccaagatcagggggatattcaagtggccacaacagaggagagtggccatgtgaatatccaacctggcggcagcgcaaaagatg

SEQ ID NO: 198989 - DNA, 103 bp, Artificial Sequence
  Synthetic Polynucleotide
taatacgactcactatagggcgtagctcttccaagatcagggggatattcaacagaggagagaatatatgcctgatcttaacctggcggcagcgcaaaagatg

SEQ ID NO: 198990 - DNA, 103 bp, Artificial Sequence
  Synthetic Polynucleotide
taatacgactcactatagggctgcagcacccgtagctcttccaagatcagaacagaggagactgatcatggaagagctaaacctggcggcagcgcaaaagatg

SEQ ID NO: 198991 - DNA, 103 bp, Artificial Sequence
  Synthetic Polynucleotide
taatacgactcactatagggtctgccgctgctgcagcacccgtagctcttaacagaggagaaagagcatggggtgctgcaacctggcggcagcgcaaaagatg

SEQ ID NO: 198992 - DNA, 103 bp, Artificial Sequence
  Synthetic Polynucleotide
taatacgactcactatagggatctgatggatctgccgctgctgcagcaccaacagaggagaggtgctatggcagcggcaaacctggcggcagcgcaaaagatg

SEQ ID NO: 198993 - DNA, 103 bp, Artificial Sequence
  Synthetic Polynucleotide
taatacgactcactatagggagtcatctgcatctgatggatctgccgctgaacagaggagacagcggatgatccatcagaacctggcggcagcgcaaaagatg

SEQ ID NO: 198994 - DNA, 103 bp, Artificial Sequence
  Synthetic Polynucleotide
taatacgactcactatagggagatttgctcagtcatctgcatctgatggaaacagaggagatccatcatgtgcagatgaaacctggcggcagcgcaaaagatg

SEQ ID NO: 198995 - DNA, 103 bp, Artificial Sequence
  Synthetic Polynucleotide
taatacgactcactataggggcatcaccgttctcagacgcgctgggacctaacagaggagaaggtccatgcgcgtctgaaacctggcggcagcgcaaaagatg

SEQ ID NO: 198996 - DNA, 103 bp, Artificial Sequence
  Synthetic Polynucleotide
taatacgactcactatagggacctgcctgcagatttgctcagtcatctgcaacagaggagagcagatatgtgagcaaataacctggcggcagcgcaaaagatg

SEQ ID NO: 198997 - DNA, 103 bp, Artificial Sequence
  Synthetic Polynucleotide
taatacgactcactatagggaagcaacagcacctgcctgcagatttgctcaacagaggagagagcaaatgtgcaggcagaacctggcggcagcgcaaaagatg

SEQ ID NO: 198998 - DNA, 103 bp, Artificial Sequence
  Synthetic Polynucleotide
taatacgactcactatagggctaaggagccaagcaacagcacctgcctgcaacagaggagagcaggcatgtgctgttgcaacctggcggcagcgcaaaagatg

SEQ ID NO: 198999 - DNA, 103 bp, Artificial Sequence
  Synthetic Polynucleotide
taatacgactcactatagggaccgtctggcctaaggagccaagcaacagcaacagaggagagctgttatgtggctccttaacctggcggcagcgcaaaagatg

SEQ ID NO: 199000 - DNA, 103 bp, Artificial Sequence
  Synthetic Polynucleotide
taatacgactcactatagggaggggcacccaccgtctggcctaaggagccaacagaggagaggctccatgggccagacgaacctggcggcagcgcaaaagatg

SEQ ID NO: 199001 - DNA, 103 bp, Artificial Sequence
  Synthetic Polynucleotide
taatacgactcactatagggagggactggcaggggcacccaccgtctggcaacagaggagagccagaatgtgggtgcccaacctggcggcagcgcaaaagatg

SEQ ID NO: 199002 - DNA, 103 bp, Artificial Sequence
  Synthetic Polynucleotide
taatacgactcactatagggggtagctctgagggactggcaggggcacccaacagaggagagggtgcatgtgccagtccaacctggcggcagcgcaaaagatg

SEQ ID NO: 199003 - DNA, 103 bp, Artificial Sequence
  Synthetic Polynucleotide
taatacgactcactatagggccctgtcccaggtagctctgagggactggcaacagaggagagccagtatgtcagagctaaacctggcggcagcgcaaaagatg

SEQ ID NO: 199004 - DNA, 103 bp, Artificial Sequence
  Synthetic Polynucleotide
taatacgactcactatagggaagaggcagtccctgtcccaggtagctctgaacagaggagacagagcatgctgggacagaacctggcggcagcgcaaaagatg

SEQ ID NO: 199005 - DNA, 103 bp, Artificial Sequence
  Synthetic Polynucleotide
taatacgactcactatagggggcttggtggaagaggcagtccctgtcccaaacagaggagatgggacatggactgcctcaacctggcggcagcgcaaaagatg

SEQ ID NO: 199006 - DNA, 103 bp, Artificial Sequence
  Synthetic Polynucleotide
taatacgactcactatagggctcctcgctagcatcaccgttctcagacgcaacagaggagagcgtctatgaacggtgataacctggcggcagcgcaaaagatg

SEQ ID NO: 199007 - DNA, 103 bp, Artificial Sequence
  Synthetic Polynucleotide
taatacgactcactataggggggtagtaggggcttggtggaagaggcagtaacagaggagaactgccatgtccaccaagaacctggcggcagcgcaaaagatg

SEQ ID NO: 199008 - DNA, 103 bp, Artificial Sequence
  Synthetic Polynucleotide
taatacgactcactatagggggctgaagaggggtagtaggggcttggtggaacagaggagaccaccaatgccctactacaacctggcggcagcgcaaaagatg

SEQ ID NO: 199009 - DNA, 103 bp, Artificial Sequence
  Synthetic Polynucleotide
taatacgactcactatagggggcttgatggggctgaagaggggtagtaggaacagaggagacctactatgcctcttcagaacctggcggcagcgcaaaagatg

SEQ ID NO: 199010 - DNA, 103 bp, Artificial Sequence
  Synthetic Polynucleotide
taatacgactcactatagggggtttggacaggcttgatggggctgaagagaacagaggagactcttcatgcccatcaagaacctggcggcagcgcaaaagatg

SEQ ID NO: 199011 - DNA, 103 bp, Artificial Sequence
  Synthetic Polynucleotide
taatacgactcactataggggtgtcttgctggtttggacaggcttgatggaacagaggagaccatcaatgctgtccaaaaacctggcggcagcgcaaaagatg

SEQ ID NO: 199012 - DNA, 103 bp, Artificial Sequence
  Synthetic Polynucleotide
taatacgactcactataggggaagatgccagtgtcttgctggtttggacaaacagaggagatgtccaatgcagcaagacaacctggcggcagcgcaaaagatg

SEQ ID NO: 199013 - DNA, 103 bp, Artificial Sequence
  Synthetic Polynucleotide
taatacgactcactatagggggaggaggaggaagatgccagtgtcttgctaacagaggagaagcaagatgctggcatctaacctggcggcagcgcaaaagatg

SEQ ID NO: 199014 - DNA, 103 bp, Artificial Sequence
  Synthetic Polynucleotide
taatacgactcactatagggaggaagaggaggaggaggaggaagatgccaaacagaggagatggcatatgcctcctcctaacctggcggcagcgcaaaagatg

SEQ ID NO: 199015 - DNA, 103 bp, Artificial Sequence
  Synthetic Polynucleotide
taatacgactcactataggggcccctgaagaggaagaggaggaggaggagaacagaggagactcctcatgctcctcttcaacctggcggcagcgcaaaagatg

SEQ ID NO: 199016 - DNA, 103 bp, Artificial Sequence
  Synthetic Polynucleotide
taatacgactcactataggggggcgtttctgcccctgaagaggaagaggaaacagaggagatcctctatgtcttcagggaacctggcggcagcgcaaaagatg

SEQ ID NO: 199017 - DNA, 103 bp, Artificial Sequence
  Synthetic Polynucleotide
taatacgactcactataggggggggtgatcctcctcgctagcatcaccgtaacagaggagaacggtgatgctagcgaggaacctggcggcagcgcaaaagatg

SEQ ID NO: 199018 - DNA, 103 bp, Artificial Sequence
  Synthetic Polynucleotide
taatacgactcactatagggaggcctgcttgggcgtttctgcccctgaagaacagaggagacttcagatgcagaaacgcaacctggcggcagcgcaaaagatg

SEQ ID NO: 199019 - DNA, 103 bp, Artificial Sequence
  Synthetic Polynucleotide
taatacgactcactatagggaggtggaagaaggcctgcttgggcgtttctaacagaggagaagaaacatgcaagcaggcaacctggcggcagcgcaaaagatg

SEQ ID NO: 199020 - DNA, 103 bp, Artificial Sequence
  Synthetic Polynucleotide
taatacgactcactatagggtgggtggtaaaggtggaagaaggcctgcttaacagaggagaaagcagatgttcttccacaacctggcggcagcgcaaaagatg

SEQ ID NO: 199021 - DNA, 103 bp, Artificial Sequence
  Synthetic Polynucleotide
taatacgactcactataggggtgaccccagtgggtggtaaaggtggaagaaacagaggagatcttccatgtttaccaccaacctggcggcagcgcaaaagatg

SEQ ID NO: 199022 - DNA, 103 bp, Artificial Sequence
  Synthetic Polynucleotide
taatacgactcactatagggaaaggatgctgtgaccccagtgggtggtaaaacagaggagattaccaatgactggggtcaacctggcggcagcgcaaaagatg

SEQ ID NO: 199023 - DNA, 103 bp, Artificial Sequence
  Synthetic Polynucleotide
taatacgactcactatagggtccagcagagaaaggatgctgtgaccccagaacagaggagactggggatgcagcatcctaacctggcggcagcgcaaaagatg

SEQ ID NO: 199024 - DNA, 103 bp, Artificial Sequence
  Synthetic Polynucleotide
taatacgactcactataggggcccaacccctccagcagagaaaggatgctaacagaggagaagcatcatgtctctgctgaacctggcggcagcgcaaaagatg

SEQ ID NO: 199025 - DNA, 103 bp, Artificial Sequence
  Synthetic Polynucleotide
taatacgactcactatagggttgtggcttcgcccaacccctccagcagagaacagaggagactctgcatgaggggttggaacctggcggcagcgcaaaagatg

SEQ ID NO: 199026 - DNA, 103 bp, Artificial Sequence
  Synthetic Polynucleotide
taatacgactcactatagggaggggtgggtttgtggcttcgcccaaccccaacagaggagaggggttatgcgaagccacaacctggcggcagcgcaaaagatg

SEQ ID NO: 199027 - DNA, 103 bp, Artificial Sequence
  Synthetic Polynucleotide
taatacgactcactataggggggaaggggcaggggtgggtttgtggcttcaacagaggagagaagccatgaacccacccaacctggcggcagcgcaaaagatg

SEQ ID NO: 199028 - DNA, 103 bp, Artificial Sequence
  Synthetic Polynucleotide
taatacgactcactataggggcacagacttgggggtgatcctcctcgctaaacagaggagatagcgaatgggatcacccaacctggcggcagcgcaaaagatg

SEQ ID NO: 199029 - DNA, 103 bp, Artificial Sequence
  Synthetic Polynucleotide
taatacgactcactatagggggcaaggctggggaaggggcaggggtgggtaacagaggagaacccacatgtgccccttcaacctggcggcagcgcaaaagatg

SEQ ID NO: 199030 - DNA, 103 bp, Artificial Sequence
  Synthetic Polynucleotide
taatacgactcactatagggtgtgctgcctggcaaggctggggaaggggcaacagaggagagcccctatgccagccttgaacctggcggcagcgcaaaagatg

SEQ ID NO: 199031 - DNA, 103 bp, Artificial Sequence
  Synthetic Polynucleotide
taatacgactcactatagggtcagctgatctgtgctgcctggcaaggctgaacagaggagacagcctatgcaggcagcaaacctggcggcagcgcaaaagatg

SEQ ID NO: 199032 - DNA, 103 bp, Artificial Sequence
  Synthetic Polynucleotide
taatacgactcactatagggggcgaggcaatcagctgatctgtgctgcctaacagaggagaaggcagatgagatcagctaacctggcggcagcgcaaaagatg

SEQ ID NO: 199033 - DNA, 103 bp, Artificial Sequence
  Synthetic Polynucleotide
taatacgactcactatagggtgccagatgaggcgaggcaatcagctgatcaacagaggagagatcagatgattgcctcgaacctggcggcagcgcaaaagatg

SEQ ID NO: 199034 - DNA, 103 bp, Artificial Sequence
  Synthetic Polynucleotide
taatacgactcactatagggtgcttgggaatgccagatgaggcgaggcaaaacagaggagattgcctatgctcatctggaacctggcggcagcgcaaaagatg

SEQ ID NO: 199035 - DNA, 103 bp, Artificial Sequence
  Synthetic Polynucleotide
taatacgactcactatagggagtcccgtggtgcttgggaatgccagatgaaacagaggagatcatctatgattcccaagaacctggcggcagcgcaaaagatg

SEQ ID NO: 199036 - DNA, 103 bp, Artificial Sequence
  Synthetic Polynucleotide
taatacgactcactatagggtgctgccagtagtcccgtggtgcttgggaaaacagaggagattcccaatgaccacgggaaacctggcggcagcgcaaaagatg

SEQ ID NO: 199037 - DNA, 103 bp, Artificial Sequence
  Synthetic Polynucleotide
taatacgactcactatagggcaagacactgtgctgccagtagtcccgtggaacagaggagaccacggatgtactggcagaacctggcggcagcgcaaaagatg

SEQ ID NO: 199038 - DNA, 103 bp, Artificial Sequence
  Synthetic Polynucleotide
taatacgactcactatagggcgggctgccccaagacactgtgctgccagtaacagaggagaactggcatgacagtgtctaacctggcggcagcgcaaaagatg

SEQ ID NO: 199039 - DNA, 103 bp, Artificial Sequence
  Synthetic Polynucleotide
taatacgactcactatagggcacccgaaacaaatccagatccagcaccataacagaggagaatggtgatggatctggataacctggcggcagcgcaaaagatg

SEQ ID NO: 199040 - DNA, 103 bp, Artificial Sequence
  Synthetic Polynucleotide
taatacgactcactataggggtctgccttcaccagctggtccactagtccaacagaggagaggactaatggaccagctgaacctggcggcagcgcaaaagatg

SEQ ID NO: 199041 - DNA, 103 bp, Artificial Sequence
  Synthetic Polynucleotide
taatacgactcactatagggcatctcccatgacttgttgtcatggggtgaaacagaggagatcacccatggacaacaagaacctggcggcagcgcaaaagatg

SEQ ID NO: 199042 - DNA, 103 bp, Artificial Sequence
  Synthetic Polynucleotide
taatacgactcactatagggtctcttcaaacatctcccatgacttgttgtaacagaggagaacaacaatgcatgggagaaacctggcggcagcgcaaaagatg

SEQ ID NO: 199043 - DNA, 103 bp, Artificial Sequence
  Synthetic Polynucleotide
taatacgactcactataggggtggtaatcatctcttcaaacatctcccataacagaggagaatgggaatggtttgaagaaacctggcggcagcgcaaaagatg

SEQ ID NO: 199044 - DNA, 103 bp, Artificial Sequence
  Synthetic Polynucleotide
taatacgactcactatagggctcctctgcggtggtaatcatctcttcaaaaacagaggagatttgaaatgatgattaccaacctggcggcagcgcaaaagatg

SEQ ID NO: 199045 - DNA, 103 bp, Artificial Sequence
  Synthetic Polynucleotide
taatacgactcactatagggactggtagaactcctctgcggtggtaatcaaacagaggagatgattaatgccgcagaggaacctggcggcagcgcaaaagatg

SEQ ID NO: 199046 - DNA, 103 bp, Artificial Sequence
  Synthetic Polynucleotide
taatacgactcactatagggatccccagggactggtagaactcctctgcgaacagaggagacgcagaatggttctaccaaacctggcggcagcgcaaaagatg

SEQ ID NO: 199047 - DNA, 103 bp, Artificial Sequence
  Synthetic Polynucleotide
taatacgactcactataggggtggtaaggaatccccagggactggtagaaaacagaggagattctacatgtccctggggaacctggcggcagcgcaaaagatg

SEQ ID NO: 199048 - DNA, 103 bp, Artificial Sequence
  Synthetic Polynucleotide
taatacgactcactatagggtattcacaatgtggtaaggaatccccagggaacagaggagaccctggatgttccttaccaacctggcggcagcgcaaaagatg

SEQ ID NO: 199049 - DNA, 103 bp, Artificial Sequence
  Synthetic Polynucleotide
taatacgactcactatagggcctgagacaatattcacaatgtggtaaggaaacagaggagatccttaatgcattgtgaaaacctggcggcagcgcaaaagatg

SEQ ID NO: 199050 - DNA, 103 bp, Artificial Sequence
  Synthetic Polynucleotide
taatacgactcactatagggattcaaagaacctgagacaatattcacaataacagaggagaattgtgatgattgtctcaaacctggcggcagcgcaaaagatg

SEQ ID NO: 199051 - DNA, 103 bp, Artificial Sequence
  Synthetic Polynucleotide
taatacgactcactataggggccactcgctgtctgccttcaccagctggtaacagaggagaaccagcatgtgaaggcagaacctggcggcagcgcaaaagatg

SEQ ID NO: 199052 - DNA, 103 bp, Artificial Sequence
  Synthetic Polynucleotide
taatacgactcactatagggtggcagcatgattcaaagaacctgagacaaaacagaggagattgtctatggttctttgaaacctggcggcagcgcaaaagatg

SEQ ID NO: 199053 - DNA, 103 bp, Artificial Sequence
  Synthetic Polynucleotide
taatacgactcactatagggagcttcttactggcagcatgattcaaagaaaacagaggagattctttatgtcatgctgcaacctggcggcagcgcaaaagatg

SEQ ID NO: 199054 - DNA, 103 bp, Artificial Sequence
  Synthetic Polynucleotide
taatacgactcactatagggctccaggtcaagcttcttactggcagcatgaacagaggagacatgctatgagtaagaagaacctggcggcagcgcaaaagatg

SEQ ID NO: 199055 - DNA, 103 bp, Artificial Sequence
  Synthetic Polynucleotide
taatacgactcactataggggaaaccaggcctccaggtcaagcttcttacaacagaggagagtaagaatgttgacctggaacctggcggcagcgcaaaagatg

SEQ ID NO: 199056 - DNA, 103 bp, Artificial Sequence
  Synthetic Polynucleotide
taatacgactcactatagggcctgagcccggaaaccaggcctccaggtcaaacagaggagatgacctatgggcctggttaacctggcggcagcgcaaaagatg

SEQ ID NO: 199057 - DNA, 103 bp, Artificial Sequence
  Synthetic Polynucleotide
taatacgactcactatagggacggaaggctcctgagcccggaaaccaggcaacagaggagagcctggatgccgggctcaaacctggcggcagcgcaaaagatg

SEQ ID NO: 199058 - DNA, 103 bp, Artificial Sequence
  Synthetic Polynucleotide
taatacgactcactatagggagaccaactcacggaaggctcctgagcccgaacagaggagacgggctatggagccttccaacctggcggcagcgcaaaagatg

SEQ ID NO: 199059 - DNA, 103 bp, Artificial Sequence
  Synthetic Polynucleotide
taatacgactcactatagggttagaacaggagaccaactcacggaaggctaacagaggagaagccttatgtgagttggtaacctggcggcagcgcaaaagatg

SEQ ID NO: 199060 - DNA, 103 bp, Artificial Sequence
  Synthetic Polynucleotide
taatacgactcactatagggatccgtgcaattagaacaggagaccaactcaacagaggagagagttgatgtcctgttctaacctggcggcagcgcaaaagatg

SEQ ID NO: 199061 - DNA, 103 bp, Artificial Sequence
  Synthetic Polynucleotide
taatacgactcactataggggagcctggtaatccgtgcaattagaacaggaacagaggagacctgttatgattgcacggaacctggcggcagcgcaaaagatg

SEQ ID NO: 199062 - DNA, 103 bp, Artificial Sequence
  Synthetic Polynucleotide
taatacgactcactatagggctacatcgtcgccactcgctgtctgccttcaacagaggagagaaggcatgcagcgagtgaacctggcggcagcgcaaaagatg

SEQ ID NO: 199063 - DNA, 103 bp, Artificial Sequence
  Synthetic Polynucleotide
taatacgactcactatagggcgaagccggcgagcctggtaatccgtgcaaaacagaggagattgcacatgttaccaggcaacctggcggcagcgcaaaagatg

SEQ ID NO: 199064 - DNA, 103 bp, Artificial Sequence
  Synthetic Polynucleotide
taatacgactcactatagggatatcggattcgaagccggcgagcctggtaaacagaggagataccagatgcgccggcttaacctggcggcagcgcaaaagatg

SEQ ID NO: 199065 - DNA, 103 bp, Artificial Sequence
  Synthetic Polynucleotide
taatacgactcactatagggtggtttgcccatatcggattcgaagccggcaacagaggagagccggcatggaatccgataacctggcggcagcgcaaaagatg

SEQ ID NO: 199066 - DNA, 103 bp, Artificial Sequence
  Synthetic Polynucleotide
taatacgactcactatagggatcatcttcttggtttgcccatatcggattaacagaggagaaatccgatgtgggcaaacaacctggcggcagcgcaaaagatg

SEQ ID NO: 199067 - DNA, 103 bp, Artificial Sequence
  Synthetic Polynucleotide
taatacgactcactatagggcaccttgtccatcatcttcttggtttgcccaacagaggagagggcaaatgaagaagatgaacctggcggcagcgcaaaagatg

SEQ ID NO: 199068 - DNA, 103 bp, Artificial Sequence
  Synthetic Polynucleotide
taatacgactcactatagggggacaaactccaccttgtccatcatcttctaacagaggagaagaagaatgtggacaaggaacctggcggcagcgcaaaagatg

SEQ ID NO: 199069 - DNA, 103 bp, Artificial Sequence
  Synthetic Polynucleotide
taatacgactcactatagggttgagcatatggacaaactccaccttgtccaacagaggagaggacaaatgggagtttgtaacctggcggcagcgcaaaagatg

SEQ ID NO: 199070 - DNA, 103 bp, Artificial Sequence
  Synthetic Polynucleotide
taatacgactcactatagggcatggtagcattgagcatatggacaaactcaacagaggagagagtttatgcatatgctcaacctggcggcagcgcaaaagatg

SEQ ID NO: 199071 - DNA, 103 bp, Artificial Sequence
  Synthetic Polynucleotide
taatacgactcactatagggtagtggcgcacatggtagcattgagcatataacagaggagaatatgcatgatgctaccaaacctggcggcagcgcaaaagatg

SEQ ID NO: 199072 - DNA, 103 bp, Artificial Sequence
  Synthetic Polynucleotide
taatacgactcactatagggatggtacgggtagtggcgcacatggtagcaaacagaggagatgctacatggtgcgccacaacctggcggcagcgcaaaagatg

SEQ ID NO: 199073 - DNA, 103 bp, Artificial Sequence
  Synthetic Polynucleotide
taatacgactcactatagggtgcccgaaatctacatcgtcgccactcgctaacagaggagaagcgagatgcgacgatgtaacctggcggcagcgcaaaagatg

SEQ ID NO: 199074 - DNA, 103 bp, Artificial Sequence
  Synthetic Polynucleotide
taatacgactcactataggggatggcgcagatggtacgggtagtggcgcaaacagaggagatgcgccatgacccgtaccaacctggcggcagcgcaaaagatg

SEQ ID NO: 199075 - DNA, 103 bp, Artificial Sequence
  Synthetic Polynucleotide
taatacgactcactatagggagttctccaggatggcgcagatggtacgggaacagaggagacccgtaatgtctgcgccaaacctggcggcagcgcaaaagatg

SEQ ID NO: 199076 - DNA, 103 bp, Artificial Sequence
  Synthetic Polynucleotide
taatacgactcactatagggtctgtctggtagttctccaggatggcgcagaacagaggagactgcgcatgcctggagaaaacctggcggcagcgcaaaagatg

SEQ ID NO: 199077 - DNA, 103 bp, Artificial Sequence
  Synthetic Polynucleotide
taatacgactcactataggggatgcccttctctgtctggtagttctccagaacagaggagactggagatgtaccagacaaacctggcggcagcgcaaaagatg

SEQ ID NO: 199078 - DNA, 103 bp, Artificial Sequence
  Synthetic Polynucleotide
taatacgactcactatagggcaggcacagtgatgcccttctctgtctggtaacagaggagaaccagaatgagaagggcaaacctggcggcagcgcaaaagatg

SEQ ID NO: 199079 - DNA, 103 bp, Artificial Sequence
  Synthetic Polynucleotide
taatacgactcactatagggttcaatttctcaggcacagtgatgcccttcaacagaggagagaagggatgcactgtgccaacctggcggcagcgcaaaagatg

SEQ ID NO: 199080 - DNA, 103 bp, Artificial Sequence
  Synthetic Polynucleotide
taatacgactcactatagggcatgaactccttcaatttctcaggcacagtaacagaggagaactgtgatggagaaattgaacctggcggcagcgcaaaagatg

SEQ ID NO: 199081 - DNA, 103 bp, Artificial Sequence
  Synthetic Polynucleotide
taatacgactcactataggggtcctggcggcatgaactccttcaatttctaacagaggagaagaaatatgaggagttcaaacctggcggcagcgcaaaagatg

SEQ ID NO: 199082 - DNA, 103 bp, Artificial Sequence
  Synthetic Polynucleotide
taatacgactcactatagggagttcttgcagtcctggcggcatgaactccaacagaggagaggagttatggccgccaggaacctggcggcagcgcaaaagatg

SEQ ID NO: 199083 - DNA, 103 bp, Artificial Sequence
  Synthetic Polynucleotide
taatacgactcactatagggaaaggggatcagttcttgcagtcctggcggaacagaggagaccgccaatgctgcaagaaaacctggcggcagcgcaaaagatg

SEQ ID NO: 199084 - DNA, 103 bp, Artificial Sequence
  Synthetic Polynucleotide
taatacgactcactatagggtcaagttgtctgcccgaaatctacatcgtcaacagaggagagacgatatggatttcgggaacctggcggcagcgcaaaagatg

SEQ ID NO: 199085 - DNA, 103 bp, Artificial Sequence
  Synthetic Polynucleotide
taatacgactcactatagggcaggcttcacaaaggggatcagttcttgcaaacagaggagatgcaagatgtgatcccctaacctggcggcagcgcaaaagatg

SEQ ID NO: 199086 - DNA, 103 bp, Artificial Sequence
  Synthetic Polynucleotide
taatacgactcactatagggtcaatgggcgcaggcttcacaaaggggatcaacagaggagagatcccatgtgtgaagccaacctggcggcagcgcaaaagatg

SEQ ID NO: 199087 - DNA, 103 bp, Artificial Sequence
  Synthetic Polynucleotide
taatacgactcactatagggtggctcctgctcaatgggcgcaggcttcacaacagaggagagtgaagatggcgcccattaacctggcggcagcgcaaaagatg

SEQ ID NO: 199088 - DNA, 103 bp, Artificial Sequence
  Synthetic Polynucleotide
taatacgactcactataggggcttctttgatggctcctgctcaatgggcgaacagaggagacgcccaatgagcaggagcaacctggcggcagcgcaaaagatg

SEQ ID NO: 199089 - DNA, 103 bp, Artificial Sequence
  Synthetic Polynucleotide
taatacgactcactatagggtgcttcttctgcttctttgatggctcctgcaacagaggagagcaggaatgatcaaagaaaacctggcggcagcgcaaaagatg

SEQ ID NO: 199090 - DNA, 103 bp, Artificial Sequence
  Synthetic Polynucleotide
taatacgactcactataggggccctcatgttgcttcttctgcttctttgaaacagaggagatcaaagatgcagaagaagaacctggcggcagcgcaaaagatg

SEQ ID NO: 199091 - DNA, 103 bp, Artificial Sequence
  Synthetic Polynucleotide
taatacgactcactatagggtctttttgctgccctcatgttgcttcttctaacagaggagaagaagaatgaacatgaggaacctggcggcagcgcaaaagatg

SEQ ID NO: 199092 - DNA, 103 bp, Artificial Sequence
  Synthetic Polynucleotide
taatacgactcactataggggctgctgctttctttttgctgccctcatgtaacagaggagaacatgaatgcagcaaaaaaacctggcggcagcgcaaaagatg

SEQ ID NO: 199093 - DNA, 103 bp, Artificial Sequence
  Synthetic Polynucleotide
taatacgactcactataggggacgtctcttgctgctgctttctttttgctaacagaggagaagcaaaatgaaagcagcaaacctggcggcagcgcaaaagatg

SEQ ID NO: 199094 - DNA, 103 bp, Artificial Sequence
  Synthetic Polynucleotide
taatacgactcactatagggtttctagggtgacgtctcttgctgctgcttaacagaggagaaagcagatgcaagagacgaacctggcggcagcgcaaaagatg

SEQ ID NO: 199095 - DNA, 103 bp, Artificial Sequence
  Synthetic Polynucleotide
taatacgactcactatagggttcagcttgttcaagttgtctgcccgaaataacagaggagaatttcgatgagacaacttaacctggcggcagcgcaaaagatg

SEQ ID NO: 199096 - DNA, 103 bp, Artificial Sequence
  Synthetic Polynucleotide
taatacgactcactatagggtgcagcctgttttctagggtgacgtctcttaacagaggagaaagagaatgcaccctagaaacctggcggcagcgcaaaagatg

SEQ ID NO: 199097 - DNA, 103 bp, Artificial Sequence
  Synthetic Polynucleotide
taatacgactcactatagggctccatgttctgcagcctgttttctagggtaacagaggagaaccctaatgaacaggctgaacctggcggcagcgcaaaagatg

SEQ ID NO: 199098 - DNA, 103 bp, Artificial Sequence
  Synthetic Polynucleotide
taatacgactcactatagggcatcggtgacctccatgttctgcagcctgtaacagaggagaacaggcatgagaacatggaacctggcggcagcgcaaaagatg

SEQ ID NO: 199099 - DNA, 103 bp, Artificial Sequence
  Synthetic Polynucleotide
taatacgactcactataggggcataggttcttcagcttgttcaagttgtcaacagaggagagacaacatgaacaagctgaacctggcggcagcgcaaaagatg

SEQ ID NO: 199100 - DNA, 103 bp, Artificial Sequence
  Synthetic Polynucleotide
taatacgactcactatagggttgtcttgctgcataggttcttcagcttgtaacagaggagaacaagcatgagaacctataacctggcggcagcgcaaaagatg

SEQ ID NO: 199101 - DNA, 103 bp, Artificial Sequence
  Synthetic Polynucleotide
taatacgactcactatagggttctctccgattgtcttgctgcataggttcaacagaggagagaacctatgcagcaagacaacctggcggcagcgcaaaagatg

SEQ ID NO: 199102 - DNA, 103 bp, Artificial Sequence
  Synthetic Polynucleotide
taatacgactcactatagggtttcttcattttctctccgattgtcttgctaacagaggagaagcaagatgatcggagagaacctggcggcagcgcaaaagatg

SEQ ID NO: 199103 - DNA, 103 bp, Artificial Sequence
  Synthetic Polynucleotide
taatacgactcactatagggctcctttatccacccgaaacaaatccagataacagaggagaatctggatgtgtttcgggaacctggcggcagcgcaaaagatg

SEQ ID NO: 199104 - DNA, 103 bp, Artificial Sequence
  Synthetic Polynucleotide
taatacgactcactatagggctggctcttttttcttcattttctctccgaaacagaggagatcggagatgaaatgaagaaacctggcggcagcgcaaaagatg

SEQ ID NO: 199105 - DNA, 103 bp, Artificial Sequence
  Synthetic Polynucleotide
taatacgactcactatagggtcatctcccactggctcttttttcttcattaacagaggagaaatgaaatgaaaagagccaacctggcggcagcgcaaaagatg

SEQ ID NO: 199106 - DNA, 103 bp, Artificial Sequence
  Synthetic Polynucleotide
taatacgactcactataggggacagactcatcatctcccactggctctttaacagaggagaaaagagatggtgggagataacctggcggcagcgcaaaagatg

SEQ ID NO: 199107 - DNA, 103 bp, Artificial Sequence
  Synthetic Polynucleotide
taatacgactcactatagggcattctctgggacagactcatcatctcccaaacagaggagatgggagatgatgagtctgaacctggcggcagcgcaaaagatg

SEQ ID NO: 199108 - DNA, 103 bp, Artificial Sequence
  Synthetic Polynucleotide
taatacgactcactatagggaaactcagcacattctctgggacagactcaaacagaggagatgagtcatgcccagagaaaacctggcggcagcgcaaaagatg

SEQ ID NO: 199109 - DNA, 103 bp, Artificial Sequence
  Synthetic Polynucleotide
taatacgactcactatagggaaggtcatcgaaactcagcacattctctggaacagaggagaccagagatggtgctgagtaacctggcggcagcgcaaaagatg

SEQ ID NO: 199110 - DNA, 103 bp, Artificial Sequence
  Synthetic Polynucleotide
taatacgactcactatagggcgtctgcagtaaggtcatcgaaactcagcaaacagaggagatgctgaatgtcgatgaccaacctggcggcagcgcaaaagatg

SEQ ID NO: 199111 - DNA, 103 bp, Artificial Sequence
  Synthetic Polynucleotide
taatacgactcactatagggttagctaaagcgtctgcagtaaggtcatcgaacagaggagacgatgaatgtactgcagaaacctggcggcagcgcaaaagatg

SEQ ID NO: 199112 - DNA, 103 bp, Artificial Sequence
  Synthetic Polynucleotide
taatacgactcactataggggactttcaggttagctaaagcgtctgcagtaacagaggagaactgcaatggctttagctaacctggcggcagcgcaaaagatg

SEQ ID NO: 199113 - DNA, 103 bp, Artificial Sequence
  Synthetic Polynucleotide
taatacgactcactatagggtgatttgtgagactttcaggttagctaaagaacagaggagactttagatgacctgaaagaacctggcggcagcgcaaaagatg

SEQ ID NO: 199114 - DNA, 103 bp, Artificial Sequence
  Synthetic Polynucleotide
taatacgactcactataggggctgggtcccctcctttatccacccgaaacaacagaggagagtttcgatgggataaaggaacctggcggcagcgcaaaagatg

SEQ ID NO: 199115 - DNA, 103 bp, Artificial Sequence
  Synthetic Polynucleotide
taatacgactcactatagggcggacttttttgatttgtgagactttcaggaacagaggagacctgaaatgctcacaaataacctggcggcagcgcaaaagatg

SEQ ID NO: 199116 - DNA, 103 bp, Artificial Sequence
  Synthetic Polynucleotide
taatacgactcactatagggaatgaggagtcggacttttttgatttgtgaaacagaggagatcacaaatgaaaaaagtcaacctggcggcagcgcaaaagatg

SEQ ID NO: 199117 - DNA, 103 bp, Artificial Sequence
  Synthetic Polynucleotide
taatacgactcactatagggtggcttcatcaatgaggagtcggactttttaacagaggagaaaaaagatggactcctcaaacctggcggcagcgcaaaagatg

SEQ ID NO: 199118 - DNA, 103 bp, Artificial Sequence
  Synthetic Polynucleotide
taatacgactcactatagggcacttcaggatggcttcatcaatgaggagtaacagaggagaactcctatgtgatgaagcaacctggcggcagcgcaaaagatg

SEQ ID NO: 199119 - DNA, 103 bp, Artificial Sequence
  Synthetic Polynucleotide
taatacgactcactatagggctccgcgtcacacttcaggatggcttcatcaacagaggagagatgaaatgatcctgaagaacctggcggcagcgcaaaagatg

SEQ ID NO: 199120 - DNA, 103 bp, Artificial Sequence
  Synthetic Polynucleotide
taatacgactcactatagggactttatccgctccgcgtcacacttcaggaaacagaggagatcctgaatggtgacgcggaacctggcggcagcgcaaaagatg

SEQ ID NO: 199121 - DNA, 103 bp, Artificial Sequence
  Synthetic Polynucleotide
taatacgactcactatagggtctgcttccaactttatccgctccgcgtcaaacagaggagatgacgcatggcggataaaaacctggcggcagcgcaaaagatg

SEQ ID NO: 199122 - DNA, 103 bp, Artificial Sequence
  Synthetic Polynucleotide
taatacgactcactatagggctcaaaccgctctgcttccaactttatccgaacagaggagacggataatgttggaagcaaacctggcggcagcgcaaaagatg

SEQ ID NO: 199123 - DNA, 103 bp, Artificial Sequence
  Synthetic Polynucleotide
taatacgactcactatagggctcggaggttctcaaaccgctctgcttccaaacagaggagatggaagatgagcggtttgaacctggcggcagcgcaaaagatg

SEQ ID NO: 199124 - DNA, 103 bp, Artificial Sequence
  Synthetic Polynucleotide
taatacgactcactatagggttcccaatctctcggaggttctcaaaccgcaacagaggagagcggttatggaacctccgaacctggcggcagcgcaaaagatg

SEQ ID NO: 199125 - DNA, 103 bp, Artificial Sequence
  Synthetic Polynucleotide
taatacgactcactatagggtcggatgagggctgggtcccctcctttatcaacagaggagagataaaatgggggacccaaacctggcggcagcgcaaaagatg

SEQ ID NO: 199126 - DNA, 103 bp, Artificial Sequence
  Synthetic Polynucleotide
taatacgactcactataggggtgcagaaggttcccaatctctcggaggttaacagaggagaaacctcatggagattgggaacctggcggcagcgcaaaagatg

SEQ ID NO: 199127 - DNA, 103 bp, Artificial Sequence
  Synthetic Polynucleotide
taatacgactcactataggggtacagaagggtgcagaaggttcccaatctaacagaggagaagattgatgaccttctgcaacctggcggcagcgcaaaagatg

SEQ ID NO: 199128 - DNA, 103 bp, Artificial Sequence
  Synthetic Polynucleotide
taatacgactcactatagggttactgatgggtacagaagggtgcagaaggaacagaggagaccttctatgcccttctgtaacctggcggcagcgcaaaagatg

SEQ ID NO: 199129 - DNA, 103 bp, Artificial Sequence
  Synthetic Polynucleotide
taatacgactcactatagggatcctcatcgttactgatgggtacagaaggaacagaggagaccttctatgcccatcagtaacctggcggcagcgcaaaagatg

SEQ ID NO: 199130 - DNA, 103 bp, Artificial Sequence
  Synthetic Polynucleotide
taatacgactcactatagggtgttgtccacatcctcatcgttactgatggaacagaggagaccatcaatgacgatgaggaacctggcggcagcgcaaaagatg

SEQ ID NO: 199131 - DNA, 103 bp, Artificial Sequence
  Synthetic Polynucleotide
taatacgactcactatagggctctctactttgttgtccacatcctcatcgaacagaggagacgatgaatgtgtggacaaaacctggcggcagcgcaaaagatg

SEQ ID NO: 199132 - DNA, 103 bp, Artificial Sequence
  Synthetic Polynucleotide
taatacgactcactatagggaccccaaatcctctctactttgttgtccacaacagaggagagtggacatgaaagtagagaacctggcggcagcgcaaaagatg

SEQ ID NO: 199133 - DNA, 103 bp, Artificial Sequence
  Synthetic Polynucleotide
taatacgactcactatagggctgtacaatcaccccaaatcctctctacttaacagaggagaaagtagatgggatttgggaacctggcggcagcgcaaaagatg

SEQ ID NO: 199134 - DNA, 103 bp, Artificial Sequence
  Synthetic Polynucleotide
taatacgactcactatagggttcttcctgactgtacaatcaccccaaatcaacagaggagagatttgatgtgattgtacaacctggcggcagcgcaaaagatg

SEQ ID NO: 199135 - DNA, 103 bp, Artificial Sequence
  Synthetic Polynucleotide
taatacgactcactatagggatgagagtacttcttcctgactgtacaatcaacagaggagagattgtatggtcaggaagaacctggcggcagcgcaaaagatg

SEQ ID NO: 199136 - DNA, 103 bp, Artificial Sequence
  Synthetic Polynucleotide
taatacgactcactatagggcctgcgtctctcggatgagggctgggtcccaacagaggagagggaccatgccctcatccaacctggcggcagcgcaaaagatg

SEQ ID NO: 199137 - DNA, 103 bp, Artificial Sequence
  Synthetic Polynucleotide
taatacgactcactatagggccaggtccacatgagagtacttcttcctgaaacagaggagatcaggaatgagtactctcaacctggcggcagcgcaaaagatg

SEQ ID NO: 199138 - DNA, 103 bp, Artificial Sequence
  Synthetic Polynucleotide
taatacgactcactatagggaccatcaccaccaggtccacatgagagtacaacagaggagagtactcatgtgtggacctaacctggcggcagcgcaaaagatg

SEQ ID NO: 199139 - DNA, 103 bp, Artificial Sequence
  Synthetic Polynucleotide
taatacgactcactatagggaaagccatctaccatcaccaccaggtccacaacagaggagagtggacatggtggtgatgaacctggcggcagcgcaaaagatg

SEQ ID NO: 199140 - DNA, 103 bp, Artificial Sequence
  Synthetic Polynucleotide
taatacgactcactatagggtttcgccttcaaagccatctaccatcaccaaacagaggagatggtgaatgtagatggctaacctggcggcagcgcaaaagatg

SEQ ID NO: 199141 - DNA, 103 bp, Artificial Sequence
  Synthetic Polynucleotide
taatacgactcactatagggacggcccccttttcgccttcaaagccatctaacagaggagaagatggatgtgaaggcgaaacctggcggcagcgcaaaagatg

SEQ ID NO: 199142 - DNA, 103 bp, Artificial Sequence
  Synthetic Polynucleotide
taatacgactcactatagggcccagccaccacggcccccttttcgccttcaacagaggagagaaggcatgaagggggccaacctggcggcagcgcaaaagatg

SEQ ID NO: 199143 - DNA, 103 bp, Artificial Sequence
  Synthetic Polynucleotide
taatacgactcactatagggaccctcgactcccagccaccacggccccctaacagaggagaagggggatgtggtggctgaacctggcggcagcgcaaaagatg

SEQ ID NO: 199144 - DNA, 103 bp, Artificial Sequence
  Synthetic Polynucleotide
taatacgactcactatagggttcaagaagtaccctcgactcccagccaccaacagaggagaggtggcatggagtcgaggaacctggcggcagcgcaaaagatg

SEQ ID NO: 199145 - DNA, 103 bp, Artificial Sequence
  Synthetic Polynucleotide
taatacgactcactatagggcaggacccccttcaagaagtaccctcgactaacagaggagaagtcgaatgtacttcttgaacctggcggcagcgcaaaagatg

SEQ ID NO: 199146 - DNA, 103 bp, Artificial Sequence
  Synthetic Polynucleotide
taatacgactcactatagggccaggaacaccaggacccccttcaagaagtaacagaggagaacttctatgagggggtccaacctggcggcagcgcaaaagatg

SEQ ID NO: 199147 - DNA, 103 bp, Artificial Sequence
  Synthetic Polynucleotide
taatacgactcactatagggaagcgcttctcctgcgtctctcggatgaggaacagaggagacctcatatgagagacgcaaacctggcggcagcgcaaaagatg

SEQ ID NO: 199148 - DNA, 103 bp, Artificial Sequence
  Synthetic Polynucleotide
taatacgactcactatagggagagcctgttccaggaacaccaggacccccaacagaggagagggggtatgggtgttcctaacctggcggcagcgcaaaagatg

SEQ ID NO: 199149 - DNA, 103 bp, Artificial Sequence
  Synthetic Polynucleotide
taatacgactcactatagggatactggatgagagcctgttccaggaacacaacagaggagagtgttcatggaacaggctaacctggcggcagcgcaaaagatg

SEQ ID NO: 199150 - DNA, 103 bp, Artificial Sequence
  Synthetic Polynucleotide
taatacgactcactatagggtgcgaagggcatactggatgagagcctgttaacagaggagaaacaggatgtcatccagtaacctggcggcagcgcaaaagatg

SEQ ID NO: 199151 - DNA, 103 bp, Artificial Sequence
  Synthetic Polynucleotide
taatacgactcactatagggcttcccaaggtgcgaagggcatactggatgaacagaggagacatccaatgtgcccttcgaacctggcggcagcgcaaaagatg

SEQ ID NO: 199152 - DNA, 103 bp, Artificial Sequence
  Synthetic Polynucleotide
taatacgactcactataggggtagccccgacttcccaaggtgcgaagggcaacagaggagagcccttatgaccttgggaaacctggcggcagcgcaaaagatg

SEQ ID NO: 199153 - DNA, 103 bp, Artificial Sequence
  Synthetic Polynucleotide
taatacgactcactatagggaaatgggaatgtagccccgacttcccaaggaacagaggagaccttggatggtcggggctaacctggcggcagcgcaaaagatg

SEQ ID NO: 199154 - DNA, 103 bp, Artificial Sequence
  Synthetic Polynucleotide
taatacgactcactatagggaagggggtataaatgggaatgtagccccgaaacagaggagatcggggatgcattcccataacctggcggcagcgcaaaagatg

SEQ ID NO: 199155 - DNA, 103 bp, Artificial Sequence
  Synthetic Polynucleotide
taatacgactcactatagggcctcatgaaaaagggggtataaatgggaataacagaggagaattcccatgtatacccccaacctggcggcagcgcaaaagatg

SEQ ID NO: 199156 - DNA, 103 bp, Artificial Sequence
  Synthetic Polynucleotide
taatacgactcactatagggtgacctccttcctcatgaaaaagggggtataacagaggagaatacccatgttttcatgaaacctggcggcagcgcaaaagatg

SEQ ID NO: 199157 - DNA, 103 bp, Artificial Sequence
  Synthetic Polynucleotide
taatacgactcactatagggacctcctgcatgacctccttcctcatgaaaaacagaggagatttcatatggaaggaggtaacctggcggcagcgcaaaagatg

SEQ ID NO: 199158 - DNA, 103 bp, Artificial Sequence
  Synthetic Polynucleotide
taatacgactcactatagggcgggtccttgaagcgcttctcctgcgtctcaacagaggagagagacgatggagaagcgcaacctggcggcagcgcaaaagatg

SEQ ID NO: 199159 - DNA, 103 bp, Artificial Sequence
  Synthetic Polynucleotide
taatacgactcactataggggagctgtgccacctcctgcatgacctccttaacagaggagaaaggagatgatgcaggagaacctggcggcagcgcaaaagatg

SEQ ID NO: 199160 - DNA, 103 bp, Artificial Sequence
  Synthetic Polynucleotide
taatacgactcactatagggcaaactggctgagctgtgccacctcctgcaaacagaggagatgcaggatgtggcacagcaacctggcggcagcgcaaaagatg

SEQ ID NO: 199161 - DNA, 103 bp, Artificial Sequence
  Synthetic Polynucleotide
taatacgactcactatagggagttcttcatcaaactggctgagctgtgccaacagaggagaggcacaatgcagccagttaacctggcggcagcgcaaaagatg

SEQ ID NO: 199162 - DNA, 103 bp, Artificial Sequence
  Synthetic Polynucleotide
taatacgactcactatagggcaccttataaagttcttcatcaaactggctaacagaggagaagccagatggatgaagaaaacctggcggcagcgcaaaagatg

SEQ ID NO: 199163 - DNA, 103 bp, Artificial Sequence
  Synthetic Polynucleotide
taatacgactcactatagggctttgccaatcaccttataaagttcttcataacagaggagaatgaagatgtttataaggaacctggcggcagcgcaaaagatg

SEQ ID NO: 199164 - DNA, 103 bp, Artificial Sequence
  Synthetic Polynucleotide
taatacgactcactatagggttttcactgcctttgccaatcaccttataaaacagaggagattataaatggattggcaaaacctggcggcagcgcaaaagatg

SEQ ID NO: 199165 - DNA, 103 bp, Artificial Sequence
  Synthetic Polynucleotide
taatacgactcactataggggtcatcagacttttcactgcctttgccaataacagaggagaattggcatgggcagtgaaaacctggcggcagcgcaaaagatg

SEQ ID NO: 199166 - DNA, 103 bp, Artificial Sequence
  Synthetic Polynucleotide
taatacgactcactatagggcataggagttgtcatcagacttttcactgcaacagaggagagcagtgatgagtctgatgaacctggcggcagcgcaaaagatg

SEQ ID NO: 199167 - DNA, 103 bp, Artificial Sequence
  Synthetic Polynucleotide
taatacgactcactatagggtacttctcatcataggagttgtcatcagacaacagaggagagtctgaatgcaactcctaaacctggcggcagcgcaaaagatg

SEQ ID NO: 199168 - DNA, 103 bp, Artificial Sequence
  Synthetic Polynucleotide
taatacgactcactatagggggcaatcaggtacttctcatcataggagttaacagaggagaaactccatggatgagaagaacctggcggcagcgcaaaagatg

SEQ ID NO: 199169 - DNA, 103 bp, Artificial Sequence
  Synthetic Polynucleotide
taatacgactcactatagggccactagtcccgggtccttgaagcgcttctaacagaggagaagaagcatgtcaaggaccaacctggcggcagcgcaaaagatg

SEQ ID NO: 199170 - DNA, 103 bp, Artificial Sequence
  Synthetic Polynucleotide
taatacgactcactataggggctctgaggtggcaatcaggtacttctcataacagaggagaatgagaatgacctgattgaacctggcggcagcgcaaaagatg

SEQ ID NO: 199171 - DNA, 103 bp, Artificial Sequence
  Synthetic Polynucleotide
taatacgactcactataggggcaatgggctgctctgaggtggcaatcaggaacagaggagacctgatatgcacctcagaaacctggcggcagcgcaaaagatg

SEQ ID NO: 199172 - DNA, 103 bp, Artificial Sequence
  Synthetic Polynucleotide
taatacgactcactataggggtgcagggcagcaatgggctgctctgaggtaacagaggagaacctcaatgcagcccattaacctggcggcagcgcaaaagatg

SEQ ID NO: 199173 - DNA, 103 bp, Artificial Sequence
  Synthetic Polynucleotide
taatacgactcactatagggactcatcccggtgcagggcagcaatgggctaacagaggagaagcccaatgctgccctgcaacctggcggcagcgcaaaagatg

SEQ ID NO: 199174 - DNA, 103 bp, Artificial Sequence
  Synthetic Polynucleotide
taatacgactcactatagggggccggagccactcatcccggtgcagggcaaacagaggagatgccctatgccgggatgaaacctggcggcagcgcaaaagatg

SEQ ID NO: 199175 - DNA, 103 bp, Artificial Sequence
  Synthetic Polynucleotide
taatacgactcactatagggcaggtcctccggccggagccactcatcccgaacagaggagacgggatatgtggctccggaacctggcggcagcgcaaaagatg

SEQ ID NO: 199176 - DNA, 103 bp, Artificial Sequence
  Synthetic Polynucleotide
taatacgactcactatagggacttgatgggcaggtcctccggccggagccaacagaggagaggctccatgcggaggaccaacctggcggcagcgcaaaagatg

SEQ ID NO: 199177 - DNA, 103 bp, Artificial Sequence
  Synthetic Polynucleotide
taatacgactcactatagggaggccagcatacttgatgggcaggtcctccaacagaggagaggaggaatggcccatcaaaacctggcggcagcgcaaaagatg

SEQ ID NO: 199178 - DNA, 103 bp, Artificial Sequence
  Synthetic Polynucleotide
taatacgactcactataggggcaggtagacaggccagcatacttgatgggaacagaggagacccatcatgtatgctggcaacctggcggcagcgcaaaagatg

SEQ ID NO: 199179 - DNA, 103 bp, Artificial Sequence
  Synthetic Polynucleotide
taatacgactcactatagggcctgacggaagcaggtagacaggccagcataacagaggagaatgctgatgtgtctacctaacctggcggcagcgcaaaagatg

SEQ ID NO: 199180 - DNA, 103 bp, Artificial Sequence
  Synthetic Polynucleotide
taatacgactcactatagggaccagctggtccactagtcccgggtccttgaacagaggagacaaggaatggggactagtaacctggcggcagcgcaaaagatg

SEQ ID NO: 199181 - DNA, 103 bp, Artificial Sequence
  Synthetic Polynucleotide
taatacgactcactataggggagcccacctcctgacggaagcaggtagacaacagaggagagtctacatgcttccgtcaaacctggcggcagcgcaaaagatg

SEQ ID NO: 199182 - DNA, 103 bp, Artificial Sequence
  Synthetic Polynucleotide
taatacgactcactatagggacggccatgggagcccacctcctgacggaaaacagaggagattccgtatggaggtgggcaacctggcggcagcgcaaaagatg

SEQ ID NO: 199183 - DNA, 103 bp, Artificial Sequence
  Synthetic Polynucleotide
taatacgactcactatagggcacgggtgtcacggccatgggagcccacctaacagaggagaaggtggatgcccatggccaacctggcggcagcgcaaaagatg

SEQ ID NO: 199184 - DNA, 103 bp, Artificial Sequence
  Synthetic Polynucleotide
taatacgactcactatagggcggaagatgccacgggtgtcacggccatggaacagaggagaccatggatgtgacacccgaacctggcggcagcgcaaaagatg

SEQ ID NO: 199185 - DNA, 103 bp, Artificial Sequence
  Synthetic Polynucleotide
taatacgactcactatagggctgatggactcggaagatgccacgggtgtcaacagaggagagacaccatgggcatcttcaacctggcggcagcgcaaaagatg

SEQ ID NO: 199186 - DNA, 103 bp, Artificial Sequence
  Synthetic Polynucleotide
taatacgactcactatagggtcttctcaaactgatggactcggaagatgcaacagaggagagcatctatggagtccatcaacctggcggcagcgcaaaagatg

SEQ ID NO: 199187 - DNA, 103 bp, Artificial Sequence
  Synthetic Polynucleotide
taatacgactcactatagggaactgttcaatcttctcaaactgatggactaacagaggagaagtccaatggtttgagaaaacctggcggcagcgcaaaagatg

SEQ ID NO: 199188 - DNA, 103 bp, Artificial Sequence
  Synthetic Polynucleotide
taatacgactcactatagggtgagtacacaaactgttcaatcttctcaaaaacagaggagatttgagatgattgaacagaacctggcggcagcgcaaaagatg

SEQ ID NO: 199189 - DNA, 103 bp, Artificial Sequence
  Synthetic Polynucleotide
taatacgactcactatagggcatggggtgatgagtacacaaactgttcaaaacagaggagattgaacatgttgtgtactaacctggcggcagcgcaaaagatg

SEQ ID NO: 199190 - DNA, 103 bp, Artificial Sequence
  Synthetic Polynucleotide
taatacgactcactataggggacttgttgtcatggggtgatgagtacacaaacagaggagatgtgtaatgatcaccccaaacctggcggcagcgcaaaagatg

SEQ ID NO: 199191 - DNA, 103 bp, Artificial Sequence
  Synthetic Polynucleotide
taatacgactcactatagggcccctgagttgcctcgttcaaatgatccataacagaggagaatggatatgttgaacgagaacctggcggcagcgcaaaagatg

SEQ ID NO: 199192 - DNA, 103 bp, Artificial Sequence
  Synthetic Polynucleotide
taatacgactcactatagggtagcgggctcccgttctgctccaggcgggcaacagaggagagcccgcatggagcagaacaacctggcggcagcgcaaaagatg

SEQ ID NO: 199193 - DNA, 103 bp, Artificial Sequence
  Synthetic Polynucleotide
taatacgactcactatagggctgctgggctaaaagtctattcactgcataaacagaggagatatgcaatgaatagacttaacctggcggcagcgcaaaagatg

SEQ ID NO: 199194 - DNA, 103 bp, Artificial Sequence
  Synthetic Polynucleotide
taatacgactcactatagggggtttaaggactgctgggctaaaagtctataacagaggagaatagacatgtagcccagcaacctggcggcagcgcaaaagatg

SEQ ID NO: 199195 - DNA, 103 bp, Artificial Sequence
  Synthetic Polynucleotide
taatacgactcactatagggaagtattgttggtttaaggactgctgggctaacagaggagaagcccaatggtccttaaaaacctggcggcagcgcaaaagatg

SEQ ID NO: 199196 - DNA, 103 bp, Artificial Sequence
  Synthetic Polynucleotide
taatacgactcactatagggagggtggttcaagtattgttggtttaaggaaacagaggagatccttaatgcaacaatacaacctggcggcagcgcaaaagatg

SEQ ID NO: 199197 - DNA, 103 bp, Artificial Sequence
  Synthetic Polynucleotide
taatacgactcactatagggtgacagggggagggtggttcaagtattgttaacagaggagaaacaatatgtgaaccaccaacctggcggcagcgcaaaagatg

SEQ ID NO: 199198 - DNA, 103 bp, Artificial Sequence
  Synthetic Polynucleotide
taatacgactcactatagggatagatctactgacagggggagggtggttcaacagaggagagaaccaatgtccccctgtaacctggcggcagcgcaaaagatg

SEQ ID NO: 199199 - DNA, 103 bp, Artificial Sequence
  Synthetic Polynucleotide
taatacgactcactatagggaggcttattcatagatctactgacagggggaacagaggagaccccctatgagtagatctaacctggcggcagcgcaaaagatg

SEQ ID NO: 199200 - DNA, 103 bp, Artificial Sequence
  Synthetic Polynucleotide
taatacgactcactataggggttgctccaaaggcttattcatagatctacaacagaggagagtagatatgtgaataagcaacctggcggcagcgcaaaagatg

SEQ ID NO: 199201 - DNA, 103 bp, Artificial Sequence
  Synthetic Polynucleotide
taatacgactcactataggggtcgaaacctgttgctccaaaggcttattcaacagaggagagaataaatgtttggagcaaacctggcggcagcgcaaaagatg

SEQ ID NO: 199202 - DNA, 103 bp, Artificial Sequence
  Synthetic Polynucleotide
taatacgactcactatagggctctgtgttggtcgaaacctgttgctccaaaacagaggagattggagatgcaggtttcgaacctggcggcagcgcaaaagatg

SEQ ID NO: 199203 - DNA, 103 bp, Artificial Sequence
  Synthetic Polynucleotide
taatacgactcactatagggttcctcttcctagcgggctcccgttctgctaacagaggagaagcagaatgggagcccgcaacctggcggcagcgcaaaagatg

SEQ ID NO: 199204 - DNA, 103 bp, Artificial Sequence
  Synthetic Polynucleotide
taatacgactcactatagggcggaagacacctctgtgttggtcgaaacctaacagaggagaaggtttatgccaacacagaacctggcggcagcgcaaaagatg

SEQ ID NO: 199205 - DNA, 103 bp, Artificial Sequence
  Synthetic Polynucleotide
taatacgactcactatagggtggtagatttcggaagacacctctgtgttgaacagaggagacaacacatgggtgtcttcaacctggcggcagcgcaaaagatg

SEQ ID NO: 199206 - DNA, 103 bp, Artificial Sequence
  Synthetic Polynucleotide
taatacgactcactataggggcgtacccactggtagatttcggaagacacaacagaggagagtgtctatggaaatctacaacctggcggcagcgcaaaagatg

SEQ ID NO: 199207 - DNA, 103 bp, Artificial Sequence
  Synthetic Polynucleotide
taatacgactcactatagggtcagttcatcgcgtacccactggtagatttaacagaggagaaaatctatgagtgggtacaacctggcggcagcgcaaaagatg

SEQ ID NO: 199208 - DNA, 103 bp, Artificial Sequence
  Synthetic Polynucleotide
taatacgactcactatagggcctgctcgtttcagttcatcgcgtacccacaacagaggagagtgggtatgcgatgaactaacctggcggcagcgcaaaagatg

SEQ ID NO: 199209 - DNA, 103 bp, Artificial Sequence
  Synthetic Polynucleotide
taatacgactcactatagggctgggagattcctgctcgtttcagttcatcaacagaggagagatgaaatgaaacgagcaaacctggcggcagcgcaaaagatg

SEQ ID NO: 199210 - DNA, 103 bp, Artificial Sequence
  Synthetic Polynucleotide
taatacgactcactatagggcaaataccgcctgggagattcctgctcgttaacagaggagaaacgagatggaatctcccaacctggcggcagcgcaaaagatg

SEQ ID NO: 199211 - DNA, 103 bp, Artificial Sequence
  Synthetic Polynucleotide
taatacgactcactataggggccacacgtgcaaataccgcctgggagattaacagaggagaaatctcatgggcggtattaacctggcggcagcgcaaaagatg

SEQ ID NO: 199212 - DNA, 103 bp, Artificial Sequence
  Synthetic Polynucleotide
taatacgactcactatagggtctgttaaaagccacacgtgcaaataccgcaacagaggagagcggtaatggcacgtgtgaacctggcggcagcgcaaaagatg

SEQ ID NO: 199213 - DNA, 103 bp, Artificial Sequence
  Synthetic Polynucleotide
taatacgactcactatagggagccctgagttctgttaaaagccacacgtgaacagaggagacacgtgatgcttttaacaaacctggcggcagcgcaaaagatg

SEQ ID NO: 199214 - DNA, 103 bp, Artificial Sequence
  Synthetic Polynucleotide
taatacgactcactatagggctcccaagccttcctcttcctagcgggctcaacagaggagagagcccatgaggaagaggaacctggcggcagcgcaaaagatg

SEQ ID NO: 199215 - DNA, 103 bp, Artificial Sequence
  Synthetic Polynucleotide
taatacgactcactatagggtctgaaagcaagccctgagttctgttaaaaaacagaggagattttaaatgaactcagggaacctggcggcagcgcaaaagatg

SEQ ID NO: 199216 - DNA, 103 bp, Artificial Sequence
  Synthetic Polynucleotide
taatacgactcactatagggtcggaggatttctgaaagcaagccctgagtaacagaggagaactcagatgttgctttcaaacctggcggcagcgcaaaagatg

SEQ ID NO: 199217 - DNA, 103 bp, Artificial Sequence
  Synthetic Polynucleotide
taatacgactcactatagggcctcttcctttcggaggatttctgaaagcaaacagaggagatgctttatgaaatcctccaacctggcggcagcgcaaaagatg

SEQ ID NO: 199218 - DNA, 103 bp, Artificial Sequence
  Synthetic Polynucleotide
taatacgactcactataggggtcttggggtcctcttcctttcggaggattaacagaggagaaatcctatgaaaggaagaaacctggcggcagcgcaaaagatg

SEQ ID NO: 199219 - DNA, 103 bp, Artificial Sequence
  Synthetic Polynucleotide
taatacgactcactatagggctgggatgcagtcttggggtcctcttccttaacagaggagaaaggaaatggaccccaagaacctggcggcagcgcaaaagatg

SEQ ID NO: 199220 - DNA, 103 bp, Artificial Sequence
  Synthetic Polynucleotide
taatacgactcactatagggccagcaaagactgggatgcagtcttggggtaacagaggagaaccccaatgctgcatcccaacctggcggcagcgcaaaagatg

SEQ ID NO: 199221 - DNA, 103 bp, Artificial Sequence
  Synthetic Polynucleotide
taatacgactcactatagggcgaaggtttaccagcaaagactgggatgcaaacagaggagatgcatcatggtctttgctaacctggcggcagcgcaaaagatg

SEQ ID NO: 199222 - DNA, 103 bp, Artificial Sequence
  Synthetic Polynucleotide
taatacgactcactatagggctgcatagcccgaaggtttaccagcaaagaaacagaggagatctttgatggtaaaccttaacctggcggcagcgcaaaagatg

SEQ ID NO: 199223 - DNA, 103 bp, Artificial Sequence
  Synthetic Polynucleotide
taatacgactcactataggggcaagaaattctgcatagcccgaaggtttaaacagaggagataaaccatggggctatgcaacctggcggcagcgcaaaagatg

SEQ ID NO: 199224 - DNA, 103 bp, Artificial Sequence
  Synthetic Polynucleotide
taatacgactcactatagggtccggtaactgcaagaaattctgcatagccaacagaggagaggctatatggaatttcttaacctggcggcagcgcaaaagatg

SEQ ID NO: 199225 - DNA, 103 bp, Artificial Sequence
  Synthetic Polynucleotide
taatacgactcactatagggtgcacctgtactcccaagccttcctcttccaacagaggagaggaagaatgaggcttgggaacctggcggcagcgcaaaagatg

SEQ ID NO: 199226 - DNA, 103 bp, Artificial Sequence
  Synthetic Polynucleotide
taatacgactcactatagggtctttcagcttccggtaactgcaagaaattaacagaggagaaatttcatgcagttaccgaacctggcggcagcgcaaaagatg

SEQ ID NO: 199227 - DNA, 103 bp, Artificial Sequence
  Synthetic Polynucleotide
taatacgactcactatagggatattcggtctctttcagcttccggtaactaacagaggagaagttacatgaagctgaaaaacctggcggcagcgcaaaagatg

SEQ ID NO: 199228 - DNA, 103 bp, Artificial Sequence
  Synthetic Polynucleotide
taatacgactcactatagggtcgtcctggtatattcggtctctttcagctaacagaggagaagctgaatgagaccgaataacctggcggcagcgcaaaagatg

SEQ ID NO: 199229 - DNA, 103 bp, Artificial Sequence
  Synthetic Polynucleotide
taatacgactcactatagggcctttccctttcgtcctggtatattcggtcaacagaggagagaccgaatgtaccaggacaacctggcggcagcgcaaaagatg

SEQ ID NO: 199230 - DNA, 103 bp, Artificial Sequence
  Synthetic Polynucleotide
taatacgactcactatagggcattcaagctcctttccctttcgtcctggtaacagaggagaaccaggatgaaagggaaaaacctggcggcagcgcaaaagatg

SEQ ID NO: 199231 - DNA, 103 bp, Artificial Sequence
  Synthetic Polynucleotide
taatacgactcactataggggccgaggcagcattcaagctcctttcccttaacagaggagaaagggaatggagcttgaaaacctggcggcagcgcaaaagatg

SEQ ID NO: 199232 - DNA, 103 bp, Artificial Sequence
  Synthetic Polynucleotide
taatacgactcactatagggaggacccatggccgaggcagcattcaagctaacagaggagaagcttgatggctgcctcgaacctggcggcagcgcaaaagatg

SEQ ID NO: 199233 - DNA, 103 bp, Artificial Sequence
  Synthetic Polynucleotide
taatacgactcactatagggtgaggggggcaggacccatggccgaggcagaacagaggagactgcctatgccatgggtcaacctggcggcagcgcaaaagatg

SEQ ID NO: 199234 - DNA, 103 bp, Artificial Sequence
  Synthetic Polynucleotide
taatacgactcactatagggggtgtgctgatgaggggggcaggacccatgaacagaggagacatgggatgtgcccccctaacctggcggcagcgcaaaagatg

SEQ ID NO: 199235 - DNA, 103 bp, Artificial Sequence
  Synthetic Polynucleotide
taatacgactcactatagggacggctgggtggtgtgctgatgaggggggcaacagaggagagcccccatgatcagcacaaacctggcggcagcgcaaaagatg

SEQ ID NO: 199236 - DNA, 103 bp, Artificial Sequence
  Synthetic Polynucleotide
taatacgactcactatagggcctgcatttttgcacctgtactcccaagccaacagaggagaggcttgatggtacaggtgaacctggcggcagcgcaaaagatg

SEQ ID NO: 199237 - DNA, 103 bp, Artificial Sequence
  Synthetic Polynucleotide
taatacgactcactatagggcctggggaggacggctgggtggtgtgctgaaacagaggagatcagcaatgcacccagccaacctggcggcagcgcaaaagatg

SEQ ID NO: 199238 - DNA, 103 bp, Artificial Sequence
  Synthetic Polynucleotide
taatacgactcactataggggctgttttcacctggggaggacggctgggtaacagaggagaacccagatgtcctccccaaacctggcggcagcgcaaaagatg

SEQ ID NO: 199239 - DNA, 103 bp, Artificial Sequence
  Synthetic Polynucleotide
taatacgactcactatagggggcaatagtagctgttttcacctggggaggaacagaggagacctcccatggtgaaaacaaacctggcggcagcgcaaaagatg

SEQ ID NO: 199240 - DNA, 103 bp, Artificial Sequence
  Synthetic Polynucleotide
taatacgactcactatagggtcctttcagtggcaatagtagctgttttcaaacagaggagatgaaaaatgctactattgaacctggcggcagcgcaaaagatg

SEQ ID NO: 199241 - DNA, 103 bp, Artificial Sequence
  Synthetic Polynucleotide
taatacgactcactatagggggtttcccattcctttcagtggcaatagtaaacagaggagatactatatgcactgaaagaacctggcggcagcgcaaaagatg

SEQ ID NO: 199242 - DNA, 103 bp, Artificial Sequence
  Synthetic Polynucleotide
taatacgactcactatagggattgttctctggtttcccattcctttcagtaacagaggagaactgaaatgaatgggaaaaacctggcggcagcgcaaaagatg

SEQ ID NO: 199243 - DNA, 103 bp, Artificial Sequence
  Synthetic Polynucleotide
taatacgactcactatagggtgttcatggtattgttctctggtttcccataacagaggagaatgggaatgcagagaacaaacctggcggcagcgcaaaagatg

SEQ ID NO: 199244 - DNA, 103 bp, Artificial Sequence
  Synthetic Polynucleotide
taatacgactcactataggggaagcattaatgttcatggtattgttctctaacagaggagaagagaaatgtaccatgaaaacctggcggcagcgcaaaagatg

SEQ ID NO: 199245 - DNA, 103 bp, Artificial Sequence
  Synthetic Polynucleotide
taatacgactcactatagggatcataaatggaagcattaatgttcatggtaacagaggagaaccatgatgattaatgctaacctggcggcagcgcaaaagatg

SEQ ID NO: 199246 - DNA, 103 bp, Artificial Sequence
  Synthetic Polynucleotide
taatacgactcactataggggctgaatctcatcataaatggaagcattaaaacagaggagattaatgatgccatttatgaacctggcggcagcgcaaaagatg

SEQ ID NO: 199247 - DNA, 103 bp, Artificial Sequence
  Synthetic Polynucleotide
taatacgactcactatagggaaaggcactccctgcatttttgcacctgtaaacagaggagatacaggatgaaaaatgcaaacctggcggcagcgcaaaagatg

SEQ ID NO: 199248 - DNA, 103 bp, Artificial Sequence
  Synthetic Polynucleotide
taatacgactcactatagggttcatttcctgctgaatctcatcataaatgaacagaggagacatttaatgtgagattcaaacctggcggcagcgcaaaagatg

SEQ ID NO: 199249 - DNA, 103 bp, Artificial Sequence
  Synthetic Polynucleotide
taatacgactcactatagggtttagcacgcttcatttcctgctgaatctcaacagaggagagagattatgcaggaaatgaacctggcggcagcgcaaaagatg

SEQ ID NO: 199250 - DNA, 103 bp, Artificial Sequence
  Synthetic Polynucleotide
taatacgactcactatagggcttgagacactttagcacgcttcatttcctaacagaggagaaggaaaatgagcgtgctaaacctggcggcagcgcaaaagatg

SEQ ID NO: 199251 - DNA, 103 bp, Artificial Sequence
  Synthetic Polynucleotide
taatacgactcactataggggcaaacagtgcttgagacactttagcacgcaacagaggagagcgtgcatgagtgtctcaaacctggcggcagcgcaaaagatg

SEQ ID NO: 199252 - DNA, 103 bp, Artificial Sequence
  Synthetic Polynucleotide
taatacgactcactatagggtgcaacctttgcaaacagtgcttgagacacaacagaggagagtgtctatggcactgtttaacctggcggcagcgcaaaagatg

SEQ ID NO: 199253 - DNA, 103 bp, Artificial Sequence
  Synthetic Polynucleotide
taatacgactcactatagggttttggttgctgcaacctttgcaaacagtgaacagaggagacactgtatgcaaaggttgaacctggcggcagcgcaaaagatg

SEQ ID NO: 199254 - DNA, 103 bp, Artificial Sequence
  Synthetic Polynucleotide
taatacgactcactatagggcatccctggcttttggttgctgcaacctttaacagaggagaaaaggtatgagcaaccaaaacctggcggcagcgcaaaagatg

SEQ ID NO: 199255 - DNA, 103 bp, Artificial Sequence
  Synthetic Polynucleotide
taatacgactcactatagggctcgcacaaccatccctggcttttggttgcaacagaggagagcaaccatgagccagggaaacctggcggcagcgcaaaagatg

SEQ ID NO: 199256 - DNA, 103 bp, Artificial Sequence
  Synthetic Polynucleotide
taatacgactcactatagggagcgtaacagctcgcacaaccatccctggcaacagaggagagccaggatgggttgtgcgaacctggcggcagcgcaaaagatg

SEQ ID NO: 199257 - DNA, 103 bp, Artificial Sequence
  Synthetic Polynucleotide
taatacgactcactatagggtcttctttccagcgtaacagctcgcacaacaacagaggagagttgtgatggctgttacgaacctggcggcagcgcaaaagatg

SEQ ID NO: 199258 - DNA, 103 bp, Artificial Sequence
  Synthetic Polynucleotide
taatacgactcactatagggcgagtgttttaaaggcactccctgcattttaacagaggagaaaaatgatgggagtgcctaacctggcggcagcgcaaaagatg

SEQ ID NO: 199259 - DNA, 103 bp, Artificial Sequence
  Synthetic Polynucleotide
taatacgactcactatagggtggagaaggatcttctttccagcgtaacagaacagaggagactgttaatgtggaaagaaaacctggcggcagcgcaaaagatg

SEQ ID NO: 199260 - DNA, 103 bp, Artificial Sequence
  Synthetic Polynucleotide
taatacgactcactatagggttctgttttctggagaaggatcttctttccaacagaggagaggaaagatgatccttctcaacctggcggcagcgcaaaagatg

SEQ ID NO: 199261 - DNA, 103 bp, Artificial Sequence
  Synthetic Polynucleotide
taatacgactcactatagggtcccacagggttctgttttctggagaaggaaacagaggagatccttcatgagaaaacagaacctggcggcagcgcaaaagatg

SEQ ID NO: 199262 - DNA, 103 bp, Artificial Sequence
  Synthetic Polynucleotide
taatacgactcactatagggggagaggttctcccacagggttctgttttcaacagaggagagaaaacatgaccctgtggaacctggcggcagcgcaaaagatg

SEQ ID NO: 199263 - DNA, 103 bp, Artificial Sequence
  Synthetic Polynucleotide
taatacgactcactatagggttcggatcatggagaggttctcccacagggaacagaggagaccctgtatgagaacctctaacctggcggcagcgcaaaagatg

SEQ ID NO: 199264 - DNA, 103 bp, Artificial Sequence
  Synthetic Polynucleotide
taatacgactcactatagggctgaggaaccttcggatcatggagaggttcaacagaggagagaacctatgcatgatccgaacctggcggcagcgcaaaagatg

SEQ ID NO: 199265 - DNA, 103 bp, Artificial Sequence
  Synthetic Polynucleotide
taatacgactcactatagggctgaggaagactgaggaaccttcggatcataacagaggagaatgatcatgaggttcctcaacctggcggcagcgcaaaagatg

SEQ ID NO: 199266 - DNA, 103 bp, Artificial Sequence
  Synthetic Polynucleotide
taatacgactcactatagggcacgttctggctgaggaagactgaggaaccaacagaggagaggttccatggtcttcctcaacctggcggcagcgcaaaagatg

SEQ ID NO: 199267 - DNA, 103 bp, Artificial Sequence
  Synthetic Polynucleotide
taatacgactcactatagggtaaatggcatcacgttctggctgaggaagaaacagaggagatcttccatggccagaacgaacctggcggcagcgcaaaagatg

SEQ ID NO: 199268 - DNA, 103 bp, Artificial Sequence
  Synthetic Polynucleotide
taatacgactcactatagggctcctgttcataaatggcatcacgttctggaacagaggagaccagaaatggatgccattaacctggcggcagcgcaaaagatg

SEQ ID NO: 199269 - DNA, 103 bp, Artificial Sequence
  Synthetic Polynucleotide
taatacgactcactatagggtcagatggcccgagtgttttaaaggcactcaacagaggagagagtgcatgtaaaacactaacctggcggcagcgcaaaagatg

SEQ ID NO: 199270 - DNA, 103 bp, Artificial Sequence
  Synthetic Polynucleotide
taatacgactcactatagggccgcgttgctctcctgttcataaatggcataacagaggagaatgccaatgatgaacaggaacctggcggcagcgcaaaagatg

SEQ ID NO: 199271 - DNA, 103 bp, Artificial Sequence
  Synthetic Polynucleotide
taatacgactcactatagggtggtgatgcaccgcgttgctctcctgttcaaacagaggagatgaacaatggagcaacgcaacctggcggcagcgcaaaagatg

SEQ ID NO: 199272 - DNA, 103 bp, Artificial Sequence
  Synthetic Polynucleotide
taatacgactcactatagggcctgtcgccatggtgatgcaccgcgttgctaacagaggagaagcaacatggtgcatcacaacctggcggcagcgcaaaagatg

SEQ ID NO: 199273 - DNA, 103 bp, Artificial Sequence
  Synthetic Polynucleotide
taatacgactcactatagggtgtggggcggcctgtcgccatggtgatgcaaacagaggagatgcatcatgatggcgacaaacctggcggcagcgcaaaagatg

SEQ ID NO: 199274 - DNA, 103 bp, Artificial Sequence
  Synthetic Polynucleotide
taatacgactcactatagggacatggataatgtggggcggcctgtcgccaaacagaggagatggcgaatggccgccccaaacctggcggcagcgcaaaagatg

SEQ ID NO: 199275 - DNA, 103 bp, Artificial Sequence
  Synthetic Polynucleotide
taatacgactcactatagggctctgctggaacatggataatgtggggcggaacagaggagaccgcccatgattatccataacctggcggcagcgcaaaagatg

SEQ ID NO: 199276 - DNA, 103 bp, Artificial Sequence
  Synthetic Polynucleotide
taatacgactcactataggggctgaatctgctctgctggaacatggataaaacagaggagattatccatgttccagcagaacctggcggcagcgcaaaagatg

SEQ ID NO: 199277 - DNA, 103 bp, Artificial Sequence
  Synthetic Polynucleotide
taatacgactcactatagggtgctgctgttgctgaatctgctctgctggaaacagaggagatccagcatggcagattcaaacctggcggcagcgcaaaagatg

SEQ ID NO: 199278 - DNA, 103 bp, Artificial Sequence
  Synthetic Polynucleotide
taatacgactcactatagggttgctgttgctgctgctgttgctgaatctgaacagaggagacagattatgcaacagcagaacctggcggcagcgcaaaagatg

SEQ ID NO: 199279 - DNA, 103 bp, Artificial Sequence
  Synthetic Polynucleotide
taatacgactcactataggggctgctgctgttgctgttgctgctgctgttaacagaggagaaacagcatgagcaacagcaacctggcggcagcgcaaaagatg

SEQ ID NO: 199280 - DNA, 103 bp, Artificial Sequence
  Synthetic Polynucleotide
taatacgactcactatagggttggttttcatcagatggcccgagtgttttaacagaggagaaaaacaatggggccatctaacctggcggcagcgcaaaagatg

SEQ ID NO: 199281 - DNA, 103 bp, Artificial Sequence
  Synthetic Polynucleotide
taatacgactcactatagggtgctgctgctgctgctgctgttgctgttgcaacagaggagagcaacaatgacagcagcaaacctggcggcagcgcaaaagatg

SEQ ID NO: 199282 - DNA, 103 bp, Artificial Sequence
  Synthetic Polynucleotide
taatacgactcactatagggcggcggtgcctgctgctgctgctgctgctgaacagaggagacagcagatgcagcagcagaacctggcggcagcgcaaaagatg

SEQ ID NO: 199283 - DNA, 103 bp, Artificial Sequence
  Synthetic Polynucleotide
taatacgactcactataggggctgtggaggcggcggtgcctgctgctgctaacagaggagaagcagcatgaggcaccgcaacctggcggcagcgcaaaagatg

SEQ ID NO: 199284 - DNA, 103 bp, Artificial Sequence
  Synthetic Polynucleotide
taatacgactcactatagggtgctgctgtggctgtggaggcggcggtgccaacagaggagaggcaccatggcctccacaaacctggcggcagcgcaaaagatg

SEQ ID NO: 199285 - DNA, 103 bp, Artificial Sequence
  Synthetic Polynucleotide
taatacgactcactatagggtgtctgtggctgctgctgtggctgtggaggaacagaggagacctccaatgccacagcagaacctggcggcagcgcaaaagatg

SEQ ID NO: 199286 - DNA, 103 bp, Artificial Sequence
  Synthetic Polynucleotide
taatacgactcactataggggccgagggcctgtctgtggctgctgctgtgaacagaggagacacagcatgagccacagaaacctggcggcagcgcaaaagatg

SEQ ID NO: 199287 - DNA, 103 bp, Artificial Sequence
  Synthetic Polynucleotide
taatacgactcactatagggcgtggggggagccgagggcctgtctgtggcaacagaggagagccacaatgaggccctcgaacctggcggcagcgcaaaagatg

SEQ ID NO: 199288 - DNA, 103 bp, Artificial Sequence
  Synthetic Polynucleotide
taatacgactcactatagggcgtgggttgccgtggggggagccgagggccaacagaggagaggccctatgctccccccaaacctggcggcagcgcaaaagatg

SEQ ID NO: 199289 - DNA, 103 bp, Artificial Sequence
  Synthetic Polynucleotide
taatacgactcactataggggagaggccaccgtgggttgccgtggggggaaacagaggagatcccccatgggcaacccaaacctggcggcagcgcaaaagatg

SEQ ID NO: 199290 - DNA, 103 bp, Artificial Sequence
  Synthetic Polynucleotide
taatacgactcactataggggactctgctggagaggccaccgtgggttgcaacagaggagagcaaccatgggtggcctcaacctggcggcagcgcaaaagatg

SEQ ID NO: 199291 - DNA, 103 bp, Artificial Sequence
  Synthetic Polynucleotide
taatacgactcactatagggtttcctaaggttggttttcatcagatggccaacagaggagaggccatatgatgaaaaccaacctggcggcagcgcaaaagatg

SEQ ID NO: 199292 - DNA, 103 bp, Artificial Sequence
  Synthetic Polynucleotide
taatacgactcactatagggttcctcatctgactctgctggagaggccacaacagaggagagtggccatgccagcagagaacctggcggcagcgcaaaagatg

SEQ ID NO: 199293 - DNA, 103 bp, Artificial Sequence
  Synthetic Polynucleotide
taatacgactcactatagggtctgtcggttttcctcatctgactctgctgaacagaggagacagcagatgcagatgaggaacctggcggcagcgcaaaagatg

SEQ ID NO: 199294 - DNA, 103 bp, Artificial Sequence
  Synthetic Polynucleotide
taatacgactcactatagggggccgggtcttctgtcggttttcctcatctaacagaggagaagatgaatgaaaccgacaaacctggcggcagcgcaaaagatg

SEQ ID NO: 199295 - DNA, 103 bp, Artificial Sequence
  Synthetic Polynucleotide
taatacgactcactatagggttttgttcgtggccgggtcttctgtcggttaacagaggagaaaccgaatgaagacccggaacctggcggcagcgcaaaagatg

SEQ ID NO: 199296 - DNA, 103 bp, Artificial Sequence
  Synthetic Polynucleotide
taatacgactcactatagggccactgaaatttttgttcgtggccgggtctaacagaggagaagacccatgcacgaacaaaacctggcggcagcgcaaaagatg

SEQ ID NO: 199297 - DNA, 103 bp, Artificial Sequence
  Synthetic Polynucleotide
taatacgactcactatagggcccaaggcttccactgaaatttttgttcgtaacagaggagaacgaacatgaatttcagtaacctggcggcagcgcaaaagatg

SEQ ID NO: 199298 - DNA, 103 bp, Artificial Sequence
  Synthetic Polynucleotide
taatacgactcactatagggctggaggattcccaaggcttccactgaaataacagaggagaatttcaatggaagccttgaacctggcggcagcgcaaaagatg

SEQ ID NO: 199299 - DNA, 103 bp, Artificial Sequence
  Synthetic Polynucleotide
taatacgactcactataggggtatgaaactctggaggattcccaaggcttaacagaggagaaagcctatggaatcctccaacctggcggcagcgcaaaagatg

SEQ ID NO: 199300 - DNA, 103 bp, Artificial Sequence
  Synthetic Polynucleotide
taatacgactcactatagggcccacgtcttgtatgaaactctggaggattaacagaggagaaatcctatggagtttcataacctggcggcagcgcaaaagatg

SEQ ID NO: 199301 - DNA, 103 bp, Artificial Sequence
  Synthetic Polynucleotide
taatacgactcactatagggagggtacaggcccacgtcttgtatgaaactaacagaggagaagtttcatgcaagacgtgaacctggcggcagcgcaaaagatg

SEQ ID NO: 199302 - DNA, 103 bp, Artificial Sequence
  Synthetic Polynucleotide
taatacgactcactatagggaatgttctttcccctgagttgcctcgttcaaacagaggagatgaacgatgcaactcaggaacctggcggcagcgcaaaagatg

SEQ ID NO: 199303 - DNA, 103 bp, Artificial Sequence
  Synthetic Polynucleotide
taatacgactcactataggggcatggttcctttcctaaggttggttttcaaacagaggagatgaaaaatgaccttaggaaacctggcggcagcgcaaaagatg

SEQ ID NO: 199304 - DNA, 103 bp, Artificial Sequence
  Synthetic Polynucleotide
taatacgactcactatagggcctcttcgtcagggtacaggcccacgtcttaacagaggagaaagacgatggcctgtaccaacctggcggcagcgcaaaagatg

SEQ ID NO: 199305 - DNA, 103 bp, Artificial Sequence
  Synthetic Polynucleotide
taatacgactcactataggggtctggatggcctcttcgtcagggtacaggaacagaggagacctgtaatgtgacgaagaaacctggcggcagcgcaaaagatg

SEQ ID NO: 199306 - DNA, 103 bp, Artificial Sequence
  Synthetic Polynucleotide
taatacgactcactatagggggcagacagagtctggatggcctcttcgtcaacagaggagagacgaaatggccatccagaacctggcggcagcgcaaaagatg

SEQ ID NO: 199307 - DNA, 103 bp, Artificial Sequence
  Synthetic Polynucleotide
taatacgactcactatagggggtcgagctgggcagacagagtctggatggaacagaggagaccatccatgctctgtctgaacctggcggcagcgcaaaagatg

SEQ ID NO: 199308 - DNA, 103 bp, Artificial Sequence
  Synthetic Polynucleotide
taatacgactcactatagggtacttgggaaggtcgagctgggcagacagaaacagaggagatctgtcatgccagctcgaaacctggcggcagcgcaaaagatg

SEQ ID NO: 199309 - DNA, 103 bp, Artificial Sequence
  Synthetic Polynucleotide
taatacgactcactataggggatgatggtgtacttgggaaggtcgagctgaacagaggagacagctcatgcttcccaagaacctggcggcagcgcaaaagatg

SEQ ID NO: 199310 - DNA, 103 bp, Artificial Sequence
  Synthetic Polynucleotide
taatacgactcactataggggaaagaacttgatgatggtgtacttgggaaaacagaggagattcccaatgacaccatcaaacctggcggcagcgcaaaagatg

SEQ ID NO: 199311 - DNA, 103 bp, Artificial Sequence
  Synthetic Polynucleotide
taatacgactcactatagggcgctggttctgaaagaacttgatgatggtgaacagaggagacaccatatgcaagttcttaacctggcggcagcgcaaaagatg

SEQ ID NO: 199312 - DNA, 103 bp, Artificial Sequence
  Synthetic Polynucleotide
taatacgactcactataggggagatagtaccgctggttctgaaagaacttaacagaggagaaagttcatgcagaaccagaacctggcggcagcgcaaaagatg

SEQ ID NO: 199313 - DNA, 103 bp, Artificial Sequence
  Synthetic Polynucleotide
taatacgactcactatagggcgtggtgcttgagatagtaccgctggttctaacagaggagaagaaccatgggtactatcaacctggcggcagcgcaaaagatg

SEQ ID NO: 199314 - DNA, 103 bp, Artificial Sequence
  Synthetic Polynucleotide
taatacgactcactatagggaaaactggcagcatggttcctttcctaaggaacagaggagaccttagatgaggaaccataacctggcggcagcgcaaaagatg

SEQ ID NO: 199315 - DNA, 103 bp, Artificial Sequence
  Synthetic Polynucleotide
taatacgactcactatagggttcagtttgccgtggtgcttgagatagtacaacagaggagagtactaatgcaagcaccaaacctggcggcagcgcaaaagatg

SEQ ID NO: 199316 - DNA, 103 bp, Artificial Sequence
  Synthetic Polynucleotide
taatacgactcactatagggggaattgtccttcagtttgccgtggtgcttaacagaggagaaagcacatgggcaaactgaacctggcggcagcgcaaaagatg

SEQ ID NO: 199317 - DNA, 103 bp, Artificial Sequence
  Synthetic Polynucleotide
taatacgactcactatagggcctctaaaccggaattgtccttcagtttgcaacagaggagagcaaacatgaggacaattaacctggcggcagcgcaaaagatg

SEQ ID NO: 199318 - DNA, 103 bp, Artificial Sequence
  Synthetic Polynucleotide
taatacgactcactataggggccacatcgacctctaaaccggaattgtccaacagaggagaggacaaatgcggtttagaaacctggcggcagcgcaaaagatg

SEQ ID NO: 199319 - DNA, 103 bp, Artificial Sequence
  Synthetic Polynucleotide
taatacgactcactatagggtttatattctgccacatcgacctctaaaccaacagaggagaggtttaatggtcgatgtgaacctggcggcagcgcaaaagatg

SEQ ID NO: 199320 - DNA, 103 bp, Artificial Sequence
  Synthetic Polynucleotide
taatacgactcactataggggctcctcttctttatattctgccacatcgaaacagaggagatcgatgatgcagaatataaacctggcggcagcgcaaaagatg

SEQ ID NO: 199321 - DNA, 103 bp, Artificial Sequence
  Synthetic Polynucleotide
taatacgactcactatagggtccttcagcagctcctcttctttatattctaacagaggagaagaataatgagaagaggaaacctggcggcagcgcaaaagatg

SEQ ID NO: 199322 - DNA, 103 bp, Artificial Sequence
  Synthetic Polynucleotide
taatacgactcactatagggctcttccaaatccttcagcagctcctcttcaacagaggagagaagagatgctgctgaagaacctggcggcagcgcaaaagatg

SEQ ID NO: 199323 - DNA, 103 bp, Artificial Sequence
  Synthetic Polynucleotide
taatacgactcactatagggcttggacactctcttccaaatccttcagcaaacagaggagatgctgaatgatttggaagaacctggcggcagcgcaaaagatg

SEQ ID NO: 199324 - DNA, 103 bp, Artificial Sequence
  Synthetic Polynucleotide
taatacgactcactataggggtatttttatcttggacactctcttccaaaaacagaggagatttggaatggagtgtccaaacctggcggcagcgcaaaagatg

SEQ ID NO: 199325 - DNA, 103 bp, Artificial Sequence
  Synthetic Polynucleotide
taatacgactcactatagggcaccacacagaaaactggcagcatggttccaacagaggagaggaaccatgctgccagttaacctggcggcagcgcaaaagatg

SEQ ID NO: 199326 - DNA, 103 bp, Artificial Sequence
  Synthetic Polynucleotide
taatacgactcactatagggaagggtgttagtatttttatcttggacactaacagaggagaagtgtcatggataaaaataacctggcggcagcgcaaaagatg

SEQ ID NO: 199327 - DNA, 103 bp, Artificial Sequence
  Synthetic Polynucleotide
taatacgactcactatagggtcactgaaaaaagggtgttagtatttttataacagaggagaataaaaatgctaacacccaacctggcggcagcgcaaaagatg

SEQ ID NO: 199328 - DNA, 103 bp, Artificial Sequence
  Synthetic Polynucleotide
taatacgactcactatagggtcttctagtttcactgaaaaaagggtgttaaacagaggagataacacatgtttttcagtaacctggcggcagcgcaaaagatg

SEQ ID NO: 199329 - DNA, 103 bp, Artificial Sequence
  Synthetic Polynucleotide
taatacgactcactatagggtgacagctcttcttctagtttcactgaaaaaacagaggagattttcaatgaaactagaaaacctggcggcagcgcaaaagatg

SEQ ID NO: 199330 - DNA, 103 bp, Artificial Sequence
  Synthetic Polynucleotide
taatacgactcactatagggttccttccactgacagctcttcttctagttaacagaggagaaactagatgaagagctgtaacctggcggcagcgcaaaagatg

SEQ ID NO: 199331 - DNA, 103 bp, Artificial Sequence
  Synthetic Polynucleotide
taatacgactcactatagggatgtctgtgtttccttccactgacagctctaacagaggagaagagctatgagtggaaggaacctggcggcagcgcaaaagatg

SEQ ID NO: 199332 - DNA, 103 bp, Artificial Sequence
  Synthetic Polynucleotide
taatacgactcactatagggatcagtattaatgtctgtgtttccttccacaacagaggagagtggaaatgaacacagacaacctggcggcagcgcaaaagatg

SEQ ID NO: 199333 - DNA, 103 bp, Artificial Sequence
  Synthetic Polynucleotide
taatacgactcactatagggagtctttcaaatcagtattaatgtctgtgtaacagaggagaacacagatgttaatactgaacctggcggcagcgcaaaagatg

SEQ ID NO: 199334 - DNA, 103 bp, Artificial Sequence
  Synthetic Polynucleotide
taatacgactcactatagggcataatgttccaccacacagaaaactggcaaacagaggagatgccagatgtctgtgtggaacctggcggcagcgcaaaagatg

SEQ ID NO: 199335 - DNA, 103 bp, Artificial Sequence
  Synthetic Polynucleotide
taatacgactcactatagggatggcgttttcataatgttccaccacacagaacagaggagactgtgtatgggaacattaaacctggcggcagcgcaaaagatg

SEQ ID NO: 199336 - DNA, 103 bp, Artificial Sequence
  Synthetic Polynucleotide
taatacgactcactatagggatcatattcaatggcgttttcataatgttcaacagaggagagaacatatggaaaacgccaacctggcggcagcgcaaaagatg

SEQ ID NO: 199337 - DNA, 103 bp, Artificial Sequence
  Synthetic Polynucleotide
taatacgactcactatagggcctccttgcaatcatattcaatggcgttttaacagaggagaaaaacgatgttgaatatgaacctggcggcagcgcaaaagatg

SEQ ID NO: 199338 - DNA, 103 bp, Artificial Sequence
  Synthetic Polynucleotide
taatacgactcactatagggtctgcatgctcctccttgcaatcatattcaaacagaggagatgaataatgttgcaaggaaacctggcggcagcgcaaaagatg

SEQ ID NO: 199339 - DNA, 103 bp, Artificial Sequence
  Synthetic Polynucleotide
taatacgactcactatagggcagcacaaattctgcatgctcctccttgcaaacagaggagatgcaagatggagcatgcaaacctggcggcagcgcaaaagatg

SEQ ID NO: 199340 - DNA, 103 bp, Artificial Sequence
  Synthetic Polynucleotide
taatacgactcactatagggcctttctcaccagcacaaattctgcatgctaacagaggagaagcatgatgaatttgtgcaacctggcggcagcgcaaaagatg

SEQ ID NO: 199341 - DNA, 103 bp, Artificial Sequence
  Synthetic Polynucleotide
taatacgactcactataggggacatttctgaatgttctttcccctgagttaacagaggagaaactcaatggaaagaacaaacctggcggcagcgcaaaagatg

SEQ ID NO: 199342 - DNA, 103 bp, Artificial Sequence
  Synthetic Polynucleotide
taatacgactcactatagggaaaagcatatcctttctcaccagcacaaataacagaggagaatttgtatgggtgagaaaaacctggcggcagcgcaaaagatg

SEQ ID NO: 199343 - DNA, 103 bp, Artificial Sequence
  Synthetic Polynucleotide
taatacgactcactatagggcagctggttgaaaagcatatcctttctcacaacagaggagagtgagaatggatatgcttaacctggcggcagcgcaaaagatg

SEQ ID NO: 199344 - DNA, 103 bp, Artificial Sequence
  Synthetic Polynucleotide
taatacgactcactatagggccatttcgatcagctggttgaaaagcatataacagaggagaatatgcatgtcaaccagcaacctggcggcagcgcaaaagatg

SEQ ID NO: 199345 - DNA, 103 bp, Artificial Sequence
  Synthetic Polynucleotide
taatacgactcactataggggacagcaatgccatttcgatcagctggttgaacagaggagacaaccaatggatcgaaataacctggcggcagcgcaaaagatg

SEQ ID NO: 199346 - DNA, 103 bp, Artificial Sequence
  Synthetic Polynucleotide
taatacgactcactatagggataacctagagacagcaatgccatttcgataacagaggagaatcgaaatggcattgctgaacctggcggcagcgcaaaagatg

SEQ ID NO: 199347 - DNA, 103 bp, Artificial Sequence
  Synthetic Polynucleotide
taatacgactcactatagggagctatgtgaataacctagagacagcaatgaacagaggagacattgcatgctctaggttaacctggcggcagcgcaaaagatg

SEQ ID NO: 199348 - DNA, 103 bp, Artificial Sequence
  Synthetic Polynucleotide
taatacgactcactatagggtgggcagcagagctatgtgaataacctagaaacagaggagatctaggatgttcacatagaacctggcggcagcgcaaaagatg

SEQ ID NO: 199349 - DNA, 103 bp, Artificial Sequence
  Synthetic Polynucleotide
taatacgactcactatagggccctttggcctgggcagcagagctatgtgaaacagaggagatcacatatgtctgctgccaacctggcggcagcgcaaaagatg

SEQ ID NO: 199350 - DNA, 103 bp, Artificial Sequence
  Synthetic Polynucleotide
taatacgactcactatagggcctggattagccctttggcctgggcagcagaacagaggagactgctgatgaggccaaagaacctggcggcagcgcaaaagatg

SEQ ID NO: 199351 - DNA, 103 bp, Artificial Sequence
  Synthetic Polynucleotide
taatacgactcactatagggcactttccaacctggattagccctttggccaacagaggagaggccaaatggctaatccaaacctggcggcagcgcaaaagatg

SEQ ID NO: 199352 - DNA, 103 bp, Artificial Sequence
  Synthetic Polynucleotide
taatacgactcactatagggcacattgttagacatttctgaatgttctttaacagaggagaaaagaaatgtcagaaatgaacctggcggcagcgcaaaagatg

SEQ ID NO: 199353 - DNA, 103 bp, Artificial Sequence
  Synthetic Polynucleotide
taatacgactcactatagggaactggattccactttccaacctggattagaacagaggagactaatcatggttggaaagaacctggcggcagcgcaaaagatg

SEQ ID NO: 199354 - DNA, 103 bp, Artificial Sequence
  Synthetic Polynucleotide
taatacgactcactatagggaagacagtggaactggattccactttccaaaacagaggagattggaaatgggaatccagaacctggcggcagcgcaaaagatg

SEQ ID NO: 199355 - DNA, 103 bp, Artificial Sequence
  Synthetic Polynucleotide
taatacgactcactatagggtctgtcacgtaagacagtggaactggattcaacagaggagagaatccatgtccactgtcaacctggcggcagcgcaaaagatg

SEQ ID NO: 199356 - DNA, 103 bp, Artificial Sequence
  Synthetic Polynucleotide
taatacgactcactatagggatcaggggcatctgtcacgtaagacagtggaacagaggagaccactgatgtacgtgacaaacctggcggcagcgcaaaagatg

SEQ ID NO: 199357 - DNA, 103 bp, Artificial Sequence
  Synthetic Polynucleotide
taatacgactcactatagggctactgtagcatcaggggcatctgtcacgtaacagaggagaacgtgaatgatgcccctgaacctggcggcagcgcaaaagatg

SEQ ID NO: 199358 - DNA, 103 bp, Artificial Sequence
  Synthetic Polynucleotide
taatacgactcactatagggagcatatctgctactgtagcatcaggggcaaacagaggagatgccccatgtgctacagtaacctggcggcagcgcaaaagatg

SEQ ID NO: 199359 - DNA, 103 bp, Artificial Sequence
  Synthetic Polynucleotide
taatacgactcactatagggcacatcttgaagcatatctgctactgtagcaacagaggagagctacaatggcagatatgaacctggcggcagcgcaaaagatg

SEQ ID NO: 199360 - DNA, 103 bp, Artificial Sequence
  Synthetic Polynucleotide
taatacgactcactatagggccacatgatacacatcttgaagcatatctgaacagaggagacagataatgttcaagatgaacctggcggcagcgcaaaagatg

SEQ ID NO: 199361 - DNA, 103 bp, Artificial Sequence
  Synthetic Polynucleotide
taatacgactcactatagggttcaatgtgaccacatgatacacatcttgaaacagaggagatcaagaatggtatcatgtaacctggcggcagcgcaaaagatg

SEQ ID NO: 199362 - DNA, 103 bp, Artificial Sequence
  Synthetic Polynucleotide
taatacgactcactatagggtaactgaattttcaatgtgaccacatgataaacagaggagatatcatatggtcacattgaacctggcggcagcgcaaaagatg

SEQ ID NO: 199363 - DNA, 103 bp, Artificial Sequence
  Synthetic Polynucleotide
taatacgactcactatagggtcggatcactcacattgttagacatttctgaacagaggagacagaaaatgctaacaatgaacctggcggcagcgcaaaagatg

SEQ ID NO: 199364 - DNA, 103 bp, Artificial Sequence
  Synthetic Polynucleotide
taatacgactcactatagggggcaactgtgtaactgaattttcaatgtgaaacagaggagatcacatatgaaattcagtaacctggcggcagcgcaaaagatg

SEQ ID NO: 199365 - DNA, 103 bp, Artificial Sequence
  Synthetic Polynucleotide
taatacgactcactatagggtctagtttggggcaactgtgtaactgaattaacagaggagaaattcaatgacacagttgaacctggcggcagcgcaaaagatg

SEQ ID NO: 199366 - DNA, 103 bp, Artificial Sequence
  Synthetic Polynucleotide
taatacgactcactatagggaggcaagtcttctagtttggggcaactgtgaacagaggagacacagtatgcccaaactaaacctggcggcagcgcaaaagatg

SEQ ID NO: 199367 - DNA, 103 bp, Artificial Sequence
  Synthetic Polynucleotide
taatacgactcactatagggattgttcgggaggcaagtcttctagtttggaacagaggagaccaaacatgaagacttgcaacctggcggcagcgcaaaagatg

SEQ ID NO: 199368 - DNA, 103 bp, Artificial Sequence
  Synthetic Polynucleotide
taatacgactcactataggggtgtgcgaccattgttcgggaggcaagtctaacagaggagaagacttatgtcccgaacaaacctggcggcagcgcaaaagatg

SEQ ID NO: 199369 - DNA, 103 bp, Artificial Sequence
  Synthetic Polynucleotide
taatacgactcactatagggcctcactgtggtgtgcgaccattgttcgggaacagaggagacccgaaatgtggtcgcacaacctggcggcagcgcaaaagatg

SEQ ID NO: 199370 - DNA, 103 bp, Artificial Sequence
  Synthetic Polynucleotide
taatacgactcactatagggtcagagcattcctcactgtggtgtgcgaccaacagaggagaggtcgcatgccacagtgaaacctggcggcagcgcaaaagatg

SEQ ID NO: 199371 - DNA, 103 bp, Artificial Sequence
  Synthetic Polynucleotide
taatacgactcactatagggagtaagtccttcagagcattcctcactgtgaacagaggagacacagtatggaatgctctaacctggcggcagcgcaaaagatg

SEQ ID NO: 199372 - DNA, 103 bp, Artificial Sequence
  Synthetic Polynucleotide
taatacgactcactatagggcatatctttcagtaagtccttcagagcattaacagaggagaaatgctatgaaggacttaaacctggcggcagcgcaaaagatg

SEQ ID NO: 199373 - DNA, 103 bp, Artificial Sequence
  Synthetic Polynucleotide
taatacgactcactatagggaactctgattcatatctttcagtaagtcctaacagaggagaaggactatgtgaaagataaacctggcggcagcgcaaaagatg

SEQ ID NO: 199374 - DNA, 103 bp, Artificial Sequence
  Synthetic Polynucleotide
taatacgactcactatagggggtggacccttcggatcactcacattgttaaacagaggagataacaaatggagtgatccaacctggcggcagcgcaaaagatg

SEQ ID NO: 199375 - DNA, 103 bp, Artificial Sequence
  Synthetic Polynucleotide
taatacgactcactatagggttggccaatgaactctgattcatatctttcaacagaggagagaaagaatggaatcagagaacctggcggcagcgcaaaagatg

SEQ ID NO: 199376 - DNA, 103 bp, Artificial Sequence
  Synthetic Polynucleotide
taatacgactcactatagggggggcactccttggccaatgaactctgattaacagaggagaaatcagatgtcattggccaacctggcggcagcgcaaaagatg

SEQ ID NO: 199377 - DNA, 103 bp, Artificial Sequence
  Synthetic Polynucleotide
taatacgactcactatagggtctgtgaaagggggcactccttggccaatgaacagaggagacattggatgaggagtgccaacctggcggcagcgcaaaagatg

SEQ ID NO: 199378 - DNA, 103 bp, Artificial Sequence
  Synthetic Polynucleotide
taatacgactcactataggggaaatcatactctgtgaaagggggcactccaacagaggagaggagtgatgcctttcacaaacctggcggcagcgcaaaagatg

SEQ ID NO: 199379 - DNA, 103 bp, Artificial Sequence
  Synthetic Polynucleotide
taatacgactcactatagggcacaatggaagaaatcatactctgtgaaagaacagaggagactttcaatgagtatgattaacctggcggcagcgcaaaagatg

SEQ ID NO: 199380 - DNA, 103 bp, Artificial Sequence
  Synthetic Polynucleotide
taatacgactcactatagggaagtactgttcacaatggaagaaatcatacaacagaggagagtatgaatgcttccattgaacctggcggcagcgcaaaagatg

SEQ ID NO: 199381 - DNA, 103 bp, Artificial Sequence
  Synthetic Polynucleotide
taatacgactcactatagggtttgcatagtaagtactgttcacaatggaaaacagaggagattccatatggaacagtacaacctggcggcagcgcaaaagatg

SEQ ID NO: 199382 - DNA, 103 bp, Artificial Sequence
  Synthetic Polynucleotide
taatacgactcactatagggtgctgagacatttgcatagtaagtactgttaacagaggagaaacagtatgtactatgcaaacctggcggcagcgcaaaagatg

SEQ ID NO: 199383 - DNA, 103 bp, Artificial Sequence
  Synthetic Polynucleotide
taatacgactcactataggggacattttgctgctgagacatttgcatagtaacagaggagaactatgatgatgtctcagaacctggcggcagcgcaaaagatg

SEQ ID NO: 199384 - DNA, 103 bp, Artificial Sequence
  Synthetic Polynucleotide
taatacgactcactatagggccaaattcttgacattttgctgctgagacaaacagaggagatgtctcatgagcaaaatgaacctggcggcagcgcaaaagatg

SEQ ID NO: 199385 - DNA, 103 bp, Artificial Sequence
  Synthetic Polynucleotide
taatacgactcactatagggaatcttggctggtggacccttcggatcactaacagaggagaagtgatatgaagggtccaaacctggcggcagcgcaaaagatg

SEQ ID NO: 199386 - DNA, 103 bp, Artificial Sequence
  Synthetic Polynucleotide
taatacgactcactataggggtaccaccttccaaattcttgacattttgcaacagaggagagcaaaaatgcaagaatttaacctggcggcagcgcaaaagatg

SEQ ID NO: 199387 - DNA, 103 bp, Artificial Sequence
  Synthetic Polynucleotide
taatacgactcactatagggtgaaatgtttgtaccaccttccaaattcttaacagaggagaaagaatatggaaggtggtaacctggcggcagcgcaaaagatg

SEQ ID NO: 199388 - DNA, 103 bp, Artificial Sequence
  Synthetic Polynucleotide
taatacgactcactatagggtttgtcttcttgaaatgtttgtaccaccttaacagaggagaaaggtgatgcaaacatttaacctggcggcagcgcaaaagatg

SEQ ID NO: 199389 - DNA, 103 bp, Artificial Sequence
  Synthetic Polynucleotide
taatacgactcactatagggcatcatatcttttgtcttcttgaaatgtttaacagaggagaaaacatatgaagaagacaaacctggcggcagcgcaaaagatg

SEQ ID NO: 199390 - DNA, 103 bp, Artificial Sequence
  Synthetic Polynucleotide
taatacgactcactatagggccatttcaaccatcatatcttttgtcttctaacagaggagaagaagaatgaagatatgaaacctggcggcagcgcaaaagatg

SEQ ID NO: 199391 - DNA, 103 bp, Artificial Sequence
  Synthetic Polynucleotide
taatacgactcactataggggaaagactatccatttcaaccatcatatctaacagaggagaagatatatgggttgaaataacctggcggcagcgcaaaagatg

SEQ ID NO: 199392 - DNA, 103 bp, Artificial Sequence
  Synthetic Polynucleotide
taatacgactcactatagggggatagctcagaaagactatccatttcaacaacagaggagagttgaaatggatagtcttaacctggcggcagcgcaaaagatg

SEQ ID NO: 199393 - DNA, 103 bp, Artificial Sequence
  Synthetic Polynucleotide
taatacgactcactatagggcgccttgctgggatagctcagaaagactataacagaggagaatagtcatgctgagctataacctggcggcagcgcaaaagatg

SEQ ID NO: 199394 - DNA, 103 bp, Artificial Sequence
  Synthetic Polynucleotide
taatacgactcactatagggacatgattggcgccttgctgggatagctcaaacagaggagatgagctatgccagcaaggaacctggcggcagcgcaaaagatg

SEQ ID NO: 199395 - DNA, 103 bp, Artificial Sequence
  Synthetic Polynucleotide
taatacgactcactataggggccaaaattgacatgattggcgccttgctgaacagaggagacagcaaatggccaatcataacctggcggcagcgcaaaagatg

SEQ ID NO: 199396 - DNA, 103 bp, Artificial Sequence
  Synthetic Polynucleotide
taatacgactcactatagggccaggcgggcaatcttggctggtggaccctaacagaggagaagggtcatgcagccaagaaacctggcggcagcgcaaaagatg

SEQ ID NO: 199397 - DNA, 103 bp, Artificial Sequence
  Synthetic Polynucleotide
taatacgactcactatagggctggttgctggccaaaattgacatgattggaacagaggagaccaatcatgtcaattttgaacctggcggcagcgcaaaagatg

SEQ ID NO: 199398 - DNA, 103 bp, Artificial Sequence
  Synthetic Polynucleotide
taatacgactcactatagggttccctggaactggttgctggccaaaattgaacagaggagacaatttatgccagcaaccaacctggcggcagcgcaaaagatg

SEQ ID NO: 199399 - DNA, 103 bp, Artificial Sequence
  Synthetic Polynucleotide
taatacgactcactatagggctcggctgtgttccctggaactggttgctgaacagaggagacagcaaatggttccagggaacctggcggcagcgcaaaagatg

SEQ ID NO: 199400 - DNA, 103 bp, Artificial Sequence
  Synthetic Polynucleotide
taatacgactcactatagggatggaggctgctcggctgtgttccctggaaaacagaggagattccagatgacacagccgaacctggcggcagcgcaaaagatg

SEQ ID NO: 199401 - DNA, 103 bp, Artificial Sequence
  Synthetic Polynucleotide
taatacgactcactatagggtgcgcaggggatggaggctgctcggctgtgaacagaggagacacagcatggcagcctccaacctggcggcagcgcaaaagatg

SEQ ID NO: 199402 - DNA, 103 bp, Artificial Sequence
  Synthetic Polynucleotide
taatacgactcactatagggatgggagagctgcgcaggggatggaggctgaacagaggagacagcctatgtcccctgcgaacctggcggcagcgcaaaagatg

SEQ ID NO: 199403 - DNA, 103 bp, Artificial Sequence
  Synthetic Polynucleotide
taatacgactcactataggggctggctgccatgggagagctgcgcaggggaacagaggagacccctgatgagctctcccaacctggcggcagcgcaaaagatg

SEQ ID NO: 199404 - DNA, 103 bp, Artificial Sequence
  Synthetic Polynucleotide
taatacgactcactatagggcggacagagggctggctgccatgggagagcaacagaggagagctctcatgtggcagccaaacctggcggcagcgcaaaagatg

SEQ ID NO: 199405 - DNA, 103 bp, Artificial Sequence
  Synthetic Polynucleotide
taatacgactcactatagggaagaggtgtccggacagagggctggctgccaacagaggagaggcagcatgccctctgtcaacctggcggcagcgcaaaagatg

SEQ ID NO: 199406 - DNA, 103 bp, Artificial Sequence
  Synthetic Polynucleotide
taatacgactcactataggggcaggtttggaagaggtgtccggacagaggaacagaggagacctctgatgggacacctcaacctggcggcagcgcaaaagatg

SEQ ID NO: 199407 - DNA, 103 bp, Artificial Sequence
  Synthetic Polynucleotide
taatacgactcactatagggccgttctgctccaggcgggcaatcttggctaacagaggagaagccaaatgtgcccgcctaacctggcggcagcgcaaaagatg

SEQ ID NO: 199408 - DNA, 103 bp, Artificial Sequence
  Synthetic Polynucleotide
taatacgactcactatagggagcccagggtgcaggtttggaagaggtgtcaacagaggagagacaccatgtccaaacctaacctggcggcagcgcaaaagatg

SEQ ID NO: 199409 - DNA, 103 bp, Artificial Sequence
  Synthetic Polynucleotide
taatacgactcactatagggtgttgatacgagcccagggtgcaggtttggaacagaggagaccaaacatgcaccctgggaacctggcggcagcgcaaaagatg

SEQ ID NO: 199410 - DNA, 103 bp, Artificial Sequence
  Synthetic Polynucleotide
taatacgactcactataggggactgataggtgttgatacgagcccagggtaacagaggagaaccctgatgtcgtatcaaaacctggcggcagcgcaaaagatg

SEQ ID NO: 199411 - DNA, 103 bp, Artificial Sequence
  Synthetic Polynucleotide
taatacgactcactatagggaccaattgaggactgataggtgttgatacgaacagaggagacgtatcatgacctatcagaacctggcggcagcgcaaaagatg

SEQ ID NO: 199412 - DNA, 103 bp, Artificial Sequence
  Synthetic Polynucleotide
taatacgactcactatagggctgctggttgaccaattgaggactgataggaacagaggagacctatcatgcctcaattgaacctggcggcagcgcaaaagatg

SEQ ID NO: 199413 - DNA, 103 bp, Artificial Sequence
  Synthetic Polynucleotide
taatacgactcactatagggccatcaccagctgctggttgaccaattgagaacagaggagactcaatatgtcaaccagcaacctggcggcagcgcaaaagatg

SEQ ID NO: 199414 - DNA, 103 bp, Artificial Sequence
  Synthetic Polynucleotide
taatacgactcactatagggagcagctgagccatcaccagctgctggttgaacagaggagacaaccaatggctggtgataacctggcggcagcgcaaaagatg

SEQ ID NO: 199415 - DNA, 103 bp, Artificial Sequence
  Synthetic Polynucleotide
taatacgactcactatagggctgctggttcagcagctgagccatcaccagaacagaggagactggtgatggctcagctgaacctggcggcagcgcaaaagatg

SEQ ID NO: 199416 - DNA, 103 bp, Artificial Sequence
  Synthetic Polynucleotide
taatacgactcactatagggtcactgcatactgctggttcagcagctgagaacagaggagactcagcatgtgaaccagcaacctggcggcagcgcaaaagatg

SEQ ID NO: 199417 - DNA, 103 bp, Artificial Sequence
  Synthetic Polynucleotide
taatacgactcactatagggaaaagtctattcactgcatactgctggttcaacagaggagagaaccaatggtatgcagtaacctggcggcagcgcaaaagatg

SEQ ID NO: 199418 - DNA, 103 bp, Artificial Sequence
  Synthetic Polynucleotide
taatacgactcactatagggcagacacgggctctcgctccgccgctccataacagaggagaatggagatgcggagcgagaacctggcggcagcgcaaaagatg

SEQ ID NO: 199419 - DNA, 103 bp, Artificial Sequence
  Synthetic Polynucleotide
taatacgactcactatagggggggctgccgttctgctccagccgggccacaacagaggagagtggccatgctggagcagaacctggcggcagcgcaaaagatg

SEQ ID NO: 199420 - DNA, 103 bp, Artificial Sequence
  Synthetic Polynucleotide
taatacgactcactatagggcaggaactgctggttgatggcttgaggatgaacagaggagacatcctatggccatcaacaacctggcggcagcgcaaaagatg

SEQ ID NO: 199421 - DNA, 103 bp, Artificial Sequence
  Synthetic Polynucleotide
taatacgactcactataggggtggatggttcaggaactgctggttgatggaacagaggagaccatcaatgagcagttccaacctggcggcagcgcaaaagatg

SEQ ID NO: 199422 - DNA, 103 bp, Artificial Sequence
  Synthetic Polynucleotide
taatacgactcactatagggctggggatgggtggatggttcaggaactgcaacagaggagagcagttatggaaccatccaacctggcggcagcgcaaaagatg

SEQ ID NO: 199423 - DNA, 103 bp, Artificial Sequence
  Synthetic Polynucleotide
taatacgactcactatagggcttaactgctctggggatgggtggatggttaacagaggagaaaccatatgcccatccccaacctggcggcagcgcaaaagatg

SEQ ID NO: 199424 - DNA, 103 bp, Artificial Sequence
  Synthetic Polynucleotide
taatacgactcactatagggttggctctggcttaactgctctggggatggaacagaggagaccatccatggagcagttaaacctggcggcagcgcaaaagatg

SEQ ID NO: 199425 - DNA, 103 bp, Artificial Sequence
  Synthetic Polynucleotide
taatacgactcactataggggaagagttggttggctctggcttaactgctaacagaggagaagcagtatggccagagccaacctggcggcagcgcaaaagatg

SEQ ID NO: 199426 - DNA, 103 bp, Artificial Sequence
  Synthetic Polynucleotide
taatacgactcactataggggacttccacggaagagttggttggctctggaacagaggagaccagagatgaccaactctaacctggcggcagcgcaaaagatg

SEQ ID NO: 199427 - DNA, 103 bp, Artificial Sequence
  Synthetic Polynucleotide
taatacgactcactatagggtatctggagagacttccacggaagagttggaacagaggagaccaactatgccgtggaagaacctggcggcagcgcaaaagatg

SEQ ID NO: 199428 - DNA, 103 bp, Artificial Sequence
  Synthetic Polynucleotide
taatacgactcactatagggtgctggtagatatctggagagacttccacgaacagaggagacgtggaatgctctccagaaacctggcggcagcgcaaaagatg

SEQ ID NO: 199429 - DNA, 103 bp, Artificial Sequence
  Synthetic Polynucleotide
taatacgactcactatagggatctctgacttgctggtagatatctggagaaacagaggagatctccaatgatctaccagaacctggcggcagcgcaaaagatg

SEQ ID NO: 199430 - DNA, 103 bp, Artificial Sequence
  Synthetic Polynucleotide
taatacgactcactataggggggctcccatggggctgccgttctgctccaaacagaggagatggagcatgacggcagccaacctggcggcagcgcaaaagatg

SEQ ID NO: 199431 - DNA, 103 bp, Artificial Sequence
  Synthetic Polynucleotide
taatacgactcactatagggtcttcagctcatctctgacttgctggtagaaacagaggagatctaccatgaagtcagagaacctggcggcagcgcaaaagatg

SEQ ID NO: 199432 - DNA, 103 bp, Artificial Sequence
  Synthetic Polynucleotide
taatacgactcactatagggacactggccctcttcagctcatctctgactaacagaggagaagtcagatgtgagctgaaaacctggcggcagcgcaaaagatg

SEQ ID NO: 199433 - DNA, 103 bp, Artificial Sequence
  Synthetic Polynucleotide
taatacgactcactatagggagcttgggacacactggccctcttcagctcaacagaggagagagctgatgagggccagtaacctggcggcagcgcaaaagatg

SEQ ID NO: 199434 - DNA, 103 bp, Artificial Sequence
  Synthetic Polynucleotide
taatacgactcactatagggttgcaaagacagcttgggacacactggcccaacagaggagagggccaatgtgtcccaagaacctggcggcagcgcaaaagatg

SEQ ID NO: 199435 - DNA, 103 bp, Artificial Sequence
  Synthetic Polynucleotide
taatacgactcactatagggaatgccactcttgcaaagacagcttgggacaacagaggagagtcccaatgtgtctttgcaacctggcggcagcgcaaaagatg

SEQ ID NO: 199436 - DNA, 103 bp, Artificial Sequence
  Synthetic Polynucleotide
taatacgactcactatagggtgtgcggttgaatgccactcttgcaaagacaacagaggagagtctttatgagagtggcaaacctggcggcagcgcaaaagatg

SEQ ID NO: 199437 - DNA, 103 bp, Artificial Sequence
  Synthetic Polynucleotide
taatacgactcactatagggacaatccctgtgtgcggttgaatgccactcaacagaggagagagtggatgtcaaccgcaaacctggcggcagcgcaaaagatg

SEQ ID NO: 199438 - DNA, 103 bp, Artificial Sequence
  Synthetic Polynucleotide
taatacgactcactatagggatctcagacaacaatccctgtgtgcggttgaacagaggagacaaccgatgacagggattaacctggcggcagcgcaaaagatg

SEQ ID NO: 199439 - DNA, 103 bp, Artificial Sequence
  Synthetic Polynucleotide
taatacgactcactatagggcttacgcagaatctcagacaacaatccctgaacagaggagacagggaatgttgtctgagaacctggcggcagcgcaaaagatg

SEQ ID NO: 199440 - DNA, 103 bp, Artificial Sequence
  Synthetic Polynucleotide
taatacgactcactatagggggtcttcttccttacgcagaatctcagacaaacagaggagatgtctgatgttctgcgtaaacctggcggcagcgcaaaagatg

SEQ ID NO: 199441 - DNA, 103 bp, Artificial Sequence
  Synthetic Polynucleotide
taatacgactcactatagggggcctcccgcgggctcccatggggctgccgaacagaggagacggcagatgcatgggagcaacctggcggcagcgcaaaagatg

SEQ ID NO: 199442 - DNA, 103 bp, Artificial Sequence
  Synthetic Polynucleotide
taatacgactcactataggggctgtccgagggtcttcttccttacgcagaaacagaggagatctgcgatgggaagaagaaacctggcggcagcgcaaaagatg

SEQ ID NO: 199443 - DNA, 103 bp, Artificial Sequence
  Synthetic Polynucleotide
taatacgactcactatagggagactgagaggctgtccgagggtcttcttcaacagaggagagaagaaatgcctcggacaaacctggcggcagcgcaaaagatg

SEQ ID NO: 199444 - DNA, 103 bp, Artificial Sequence
  Synthetic Polynucleotide
taatacgactcactatagggttactagaagagactgagaggctgtccgagaacagaggagactcggaatgcctctcagtaacctggcggcagcgcaaaagatg

SEQ ID NO: 199445 - DNA, 103 bp, Artificial Sequence
  Synthetic Polynucleotide
taatacgactcactataggggccctcaggtttactagaagagactgagagaacagaggagactctcaatgtcttctagtaacctggcggcagcgcaaaagatg

SEQ ID NO: 199446 - DNA, 103 bp, Artificial Sequence
  Synthetic Polynucleotide
taatacgactcactatagggattctgcatggccctcaggtttactagaagaacagaggagacttctaatgaacctgaggaacctggcggcagcgcaaaagatg

SEQ ID NO: 199447 - DNA, 103 bp, Artificial Sequence
  Synthetic Polynucleotide
taatacgactcactataggggattgaggaaattctgcatggccctcaggtaacagaggagaacctgaatgccatgcagaaacctggcggcagcgcaaaagatg

SEQ ID NO: 199448 - DNA, 103 bp, Artificial Sequence
  Synthetic Polynucleotide
taatacgactcactatagggacttctggcagattgaggaaattctgcatgaacagaggagacatgcaatgtttcctcaaaacctggcggcagcgcaaaagatg

SEQ ID NO: 199449 - DNA, 103 bp, Artificial Sequence
  Synthetic Polynucleotide
taatacgactcactatagggatctcgctccacttctggcagattgaggaaaacagaggagattcctcatgctgccagaaaacctggcggcagcgcaaaagatg

SEQ ID NO: 199450 - DNA, 103 bp, Artificial Sequence
  Synthetic Polynucleotide
taatacgactcactatagggggtagatgcgatctcgctccacttctggcaaacagaggagatgccagatgtggagcgagaacctggcggcagcgcaaaagatg

SEQ ID NO: 199451 - DNA, 103 bp, Artificial Sequence
  Synthetic Polynucleotide
taatacgactcactatagggctctcatcctggtagatgcgatctcgctccaacagaggagaggagcgatgtcgcatctaaacctggcggcagcgcaaaagatg

SEQ ID NO: 199452 - DNA, 103 bp, Artificial Sequence
  Synthetic Polynucleotide
taatacgactcactatagggggcgccgttgggcctcccgcgggctcccataacagaggagaatgggaatgcgcgggaggaacctggcggcagcgcaaaagatg

SEQ ID NO: 199453 - DNA, 103 bp, Artificial Sequence
  Synthetic Polynucleotide
taatacgactcactataggggctccgctccctctcatcctggtagatgcgaacagaggagacgcatcatgcaggatgagaacctggcggcagcgcaaaagatg

SEQ ID NO: 199454 - DNA, 103 bp, Artificial Sequence
  Synthetic Polynucleotide
taatacgactcactatagggtgggattcatgctccgctccctctcatcctaacagaggagaaggatgatggggagcggaaacctggcggcagcgcaaaagatg

SEQ ID NO: 199455 - DNA, 103 bp, Artificial Sequence
  Synthetic Polynucleotide
taatacgactcactatagggatgctcacattgggattcatgctccgctccaacagaggagaggagcgatgcatgaatccaacctggcggcagcgcaaaagatg

SEQ ID NO: 199456 - DNA, 103 bp, Artificial Sequence
  Synthetic Polynucleotide
taatacgactcactatagggcgaggagaccatgctcacattgggattcataacagaggagaatgaatatgaatgtgagcaacctggcggcagcgcaaaagatg

SEQ ID NO: 199457 - DNA, 103 bp, Artificial Sequence
  Synthetic Polynucleotide
taatacgactcactatagggtgctggaggccgaggagaccatgctcacataacagaggagaatgtgaatgtggtctcctaacctggcggcagcgcaaaagatg

SEQ ID NO: 199458 - DNA, 103 bp, Artificial Sequence
  Synthetic Polynucleotide
taatacgactcactataggggagctgggactgctggaggccgaggagaccaacagaggagaggtctcatgggcctccagaacctggcggcagcgcaaaagatg

SEQ ID NO: 199459 - DNA, 103 bp, Artificial Sequence
  Synthetic Polynucleotide
taatacgactcactatagggggttcgggaggagctgggactgctggaggcaacagaggagagcctccatgagtcccagcaacctggcggcagcgcaaaagatg

SEQ ID NO: 199460 - DNA, 103 bp, Artificial Sequence
  Synthetic Polynucleotide
taatacgactcactatagggtggcctgaggggttcgggaggagctgggacaacagaggagagtcccaatgcctcccgaaaacctggcggcagcgcaaaagatg

SEQ ID NO: 199461 - DNA, 103 bp, Artificial Sequence
  Synthetic Polynucleotide
taatacgactcactataggggtcgaggttttggcctgaggggttcgggagaacagaggagactcccgatgccctcaggcaacctggcggcagcgcaaaagatg

SEQ ID NO: 199462 - DNA, 103 bp, Artificial Sequence
  Synthetic Polynucleotide
taatacgactcactatagggtgttgtcggtgtcgaggttttggcctgaggaacagaggagacctcagatgaaaacctcgaacctggcggcagcgcaaaagatg

SEQ ID NO: 199463 - DNA, 103 bp, Artificial Sequence
  Synthetic Polynucleotide
taatacgactcactatagggccttggccacggcgccgttgggcctcccgcaacagaggagagcgggaatgccaacggcgaacctggcggcagcgcaaaagatg

SEQ ID NO: 199464 - DNA, 103 bp, Artificial Sequence
  Synthetic Polynucleotide
taatacgactcactatagggtagggaggtctgttgtcggtgtcgaggtttaacagaggagaaaacctatgcaccgacaaaacctggcggcagcgcaaaagatg

SEQ ID NO: 199465 - DNA, 103 bp, Artificial Sequence
  Synthetic Polynucleotide
taatacgactcactatagggtccaccttaatagggaggtctgttgtcggtaacagaggagaaccgacatgagacctcccaacctggcggcagcgcaaaagatg

SEQ ID NO: 199466 - DNA, 103 bp, Artificial Sequence
  Synthetic Polynucleotide
taatacgactcactataggggttggcgccgtccaccttaatagggaggtcaacagaggagagacctcatgattaaggtgaacctggcggcagcgcaaaagatg

SEQ ID NO: 199467 - DNA, 103 bp, Artificial Sequence
  Synthetic Polynucleotide
taatacgactcactatagggtgatgttgatgttggcgccgtccaccttaaaacagaggagattaaggatgacggcgccaaacctggcggcagcgcaaaagatg

SEQ ID NO: 199468 - DNA, 103 bp, Artificial Sequence
  Synthetic Polynucleotide
taatacgactcactatagggatggcagctgtgatgttgatgttggcgccgaacagaggagacggcgcatgcatcaacataacctggcggcagcgcaaaagatg

SEQ ID NO: 199469 - DNA, 103 bp, Artificial Sequence
  Synthetic Polynucleotide
taatacgactcactatagggctcgtcataaatggcagctgtgatgttgataacagaggagaatcaacatgacagctgccaacctggcggcagcgcaaaagatg

SEQ ID NO: 199470 - DNA, 103 bp, Artificial Sequence
  Synthetic Polynucleotide
taatacgactcactatagggcctgttggatctcgtcataaatggcagctgaacagaggagacagctgatgtttatgacgaacctggcggcagcgcaaaagatg

SEQ ID NO: 199471 - DNA, 103 bp, Artificial Sequence
  Synthetic Polynucleotide
taatacgactcactatagggcttttcatctcctgttggatctcgtcataaaacagaggagattatgaatggatccaacaaacctggcggcagcgcaaaagatg

SEQ ID NO: 199472 - DNA, 103 bp, Artificial Sequence
  Synthetic Polynucleotide
taatacgactcactatagggcaccttggcccttttcatctcctgttggataacagaggagaatccaaatggagatgaaaaacctggcggcagcgcaaaagatg

SEQ ID NO: 199473 - DNA, 103 bp, Artificial Sequence
  Synthetic Polynucleotide
taatacgactcactataggggggcttgagacaccttggcccttttcatctaacagaggagaagatgaatggggccaaggaacctggcggcagcgcaaaagatg

SEQ ID NO: 199474 - DNA, 103 bp, Artificial Sequence
  Synthetic Polynucleotide
taatacgactcactatagggcctcccacggccttggccacggcgccgttgaacagaggagacaacggatgcgtggccaaaacctggcggcagcgcaaaagatg

SEQ ID NO: 199475 - DNA, 103 bp, Artificial Sequence
  Synthetic Polynucleotide
taatacgactcactatagggttggcaaacagggcttgagacaccttggccaacagaggagaggccaaatggtctcaagcaacctggcggcagcgcaaaagatg

SEQ ID NO: 199476 - DNA, 103 bp, Artificial Sequence
  Synthetic Polynucleotide
taatacgactcactatagggtgcagccactttggcaaacagggcttgagaaacagaggagatctcaaatgctgtttgccaacctggcggcagcgcaaaagatg

SEQ ID NO: 199477 - DNA, 103 bp, Artificial Sequence
  Synthetic Polynucleotide
taatacgactcactataggggacttttatttgcagccactttggcaaacaaacagaggagatgtttgatgaagtggctgaacctggcggcagcgcaaaagatg

SEQ ID NO: 199478 - DNA, 103 bp, Artificial Sequence
  Synthetic Polynucleotide
taatacgactcactatagggagccagccctgacttttatttgcagccactaacagaggagaagtggcatgaaataaaagaacctggcggcagcgcaaaagatg

SEQ ID NO: 199479 - DNA, 103 bp, Artificial Sequence
  Synthetic Polynucleotide
taatacgactcactatagggcagttcacacagccagccctgacttttattaacagaggagaaataaaatgcagggctggaacctggcggcagcgcaaaagatg

SEQ ID NO: 199480 - DNA, 103 bp, Artificial Sequence
  Synthetic Polynucleotide
taatacgactcactatagggtccagcggagcagttcacacagccagccctaacagaggagaagggctatgtgtgtgaacaacctggcggcagcgcaaaagatg

SEQ ID NO: 199481 - DNA, 103 bp, Artificial Sequence
  Synthetic Polynucleotide
taatacgactcactataggggggttctccttccagcggagcagttcacacaacagaggagagtgtgaatggctccgctgaacctggcggcagcgcaaaagatg

SEQ ID NO: 199482 - DNA, 103 bp, Artificial Sequence
  Synthetic Polynucleotide
taatacgactcactatagggttctgggcttgggttctccttccagcggagaacagaggagactccgcatgaaggagaacaacctggcggcagcgcaaaagatg

SEQ ID NO: 199483 - DNA, 103 bp, Artificial Sequence
  Synthetic Polynucleotide
taatacgactcactataggggggtgcggttttctgggcttgggttctcctaacagaggagaaggagaatgcaagcccagaacctggcggcagcgcaaaagatg

SEQ ID NO: 199484 - DNA, 103 bp, Artificial Sequence
  Synthetic Polynucleotide
taatacgactcactatagggttttcccagagggtgcggttttctgggcttaacagaggagaaagcccatgaaaccgcacaacctggcggcagcgcaaaagatg

SEQ ID NO: 199485 - DNA, 103 bp, Artificial Sequence
  Synthetic Polynucleotide
taatacgactcactatagggaatcatcaaacctcccacggccttggccacaacagaggagagtggccatggccgtgggaaacctggcggcagcgcaaaagatg

SEQ ID NO: 199486 - DNA, 103 bp, Artificial Sequence
  Synthetic Polynucleotide
taatacgactcactatagggggtacagaggttttcccagagggtgcggttaacagaggagaaaccgcatgctctgggaaaacctggcggcagcgcaaaagatg

SEQ ID NO: 199487 - DNA, 103 bp, Artificial Sequence
  Synthetic Polynucleotide
taatacgactcactatagggagcgacggatggtacagaggttttcccagaaacagaggagatctgggatgacctctgtaaacctggcggcagcgcaaaagatg

SEQ ID NO: 199488 - DNA, 103 bp, Artificial Sequence
  Synthetic Polynucleotide
taatacgactcactatagggaggttcaggaagcgacggatggtacagaggaacagaggagacctctgatgcatccgtcgaacctggcggcagcgcaaaagatg

SEQ ID NO: 199489 - DNA, 103 bp, Artificial Sequence
  Synthetic Polynucleotide
taatacgactcactatagggatgctggggaaggttcaggaagcgacggataacagaggagaatccgtatgttcctgaacaacctggcggcagcgcaaaagatg

SEQ ID NO: 199490 - DNA, 103 bp, Artificial Sequence
  Synthetic Polynucleotide
taatacgactcactatagggcatccctctcatgctggggaaggttcaggaaacagaggagatcctgaatgttccccagcaacctggcggcagcgcaaaagatg

SEQ ID NO: 199491 - DNA, 103 bp, Artificial Sequence
  Synthetic Polynucleotide
taatacgactcactatagggtcatagatgacatccctctcatgctggggaaacagaggagatccccaatgtgagagggaaacctggcggcagcgcaaaagatg

SEQ ID NO: 199492 - DNA, 103 bp, Artificial Sequence
  Synthetic Polynucleotide
taatacgactcactatagggtgactcctcctcatagatgacatccctctcaacagaggagagagaggatggtcatctataacctggcggcagcgcaaaagatg

SEQ ID NO: 199493 - DNA, 103 bp, Artificial Sequence
  Synthetic Polynucleotide
taatacgactcactatagggggtgatgccttgactcctcctcatagatgaaacagaggagatcatctatgaggaggagtaacctggcggcagcgcaaaagatg

SEQ ID NO: 199494 - DNA, 103 bp, Artificial Sequence
  Synthetic Polynucleotide
taatacgactcactatagggcgttcgctgtggtgatgccttgactcctccaacagaggagaggaggaatgaaggcatcaaacctggcggcagcgcaaaagatg

SEQ ID NO: 199495 - DNA, 103 bp, Artificial Sequence
  Synthetic Polynucleotide
taatacgactcactataggggtgttgcatgcgttcgctgtggtgatgcctaacagaggagaaggcatatgcacagcgaaaacctggcggcagcgcaaaagatg

SEQ ID NO: 199496 - DNA, 103 bp, Artificial Sequence
  Synthetic Polynucleotide
taatacgactcactatagggaaaagacaggaatcatcaaacctcccacggaacagaggagaccgtggatggtttgatgaaacctggcggcagcgcaaaagatg

SEQ ID NO: 199497 - DNA, 103 bp, Artificial Sequence
  Synthetic Polynucleotide
taatacgactcactataggggctggaccacgtgttgcatgcgttcgctgtaacagaggagaacagcgatggcatgcaacaacctggcggcagcgcaaaagatg

SEQ ID NO: 199498 - DNA, 103 bp, Artificial Sequence
  Synthetic Polynucleotide
taatacgactcactatagggtcagggggaagctggaccacgtgttgcatgaacagaggagacatgcaatgcgtggtccaaacctggcggcagcgcaaaagatg

SEQ ID NO: 199499 - DNA, 103 bp, Artificial Sequence
  Synthetic Polynucleotide
taatacgactcactatagggctgcaccggctcagggggaagctggaccacaacagaggagagtggtcatgcttccccctaacctggcggcagcgcaaaagatg

SEQ ID NO: 199500 - DNA, 103 bp, Artificial Sequence
  Synthetic Polynucleotide
taatacgactcactatagggtatgaagtacctgcaccggctcagggggaaaacagaggagattccccatgagccggtgcaacctggcggcagcgcaaaagatg

SEQ ID NO: 199501 - DNA, 103 bp, Artificial Sequence
  Synthetic Polynucleotide
taatacgactcactataggggactgctgtctatgaagtacctgcaccggcaacagaggagagccggtatgggtacttcaaacctggcggcagcgcaaaagatg

SEQ ID NO: 199502 - DNA, 103 bp, Artificial Sequence
  Synthetic Polynucleotide
taatacgactcactatagggggctggctgagactgctgtctatgaagtacaacagaggagagtacttatgagacagcagaacctggcggcagcgcaaaagatg

SEQ ID NO: 199503 - DNA, 103 bp, Artificial Sequence
  Synthetic Polynucleotide
taatacgactcactatagggaactctccttggctggctgagactgctgtcaacagaggagagacagcatgctcagccagaacctggcggcagcgcaaaagatg

SEQ ID NO: 199504 - DNA, 103 bp, Artificial Sequence
  Synthetic Polynucleotide
taatacgactcactatagggctgggaggggaactctccttggctggctgaaacagaggagatcagccatgcaaggagagaacctggcggcagcgcaaaagatg

SEQ ID NO: 199505 - DNA, 103 bp, Artificial Sequence
  Synthetic Polynucleotide
taatacgactcactatagggcgcttcttctctgggaggggaactctccttaacagaggagaaaggagatgtcccctcccaacctggcggcagcgcaaaagatg

SEQ ID NO: 199506 - DNA, 103 bp, Artificial Sequence
  Synthetic Polynucleotide
taatacgactcactataggggtgggggaggcgcttcttctctgggaggggaacagaggagacccctcatggagaagaagaacctggcggcagcgcaaaagatg

SEQ ID NO: 199507 - DNA, 103 bp, Artificial Sequence
  Synthetic Polynucleotide
taatacgactcactatagggtccacgacacaaaagacaggaatcatcaaaaacagaggagatttgatatgtcctgtcttaacctggcggcagcgcaaaagatg

SEQ ID NO: 199508 - DNA, 103 bp, Artificial Sequence
  Synthetic Polynucleotide
taatacgactcactataggggtcggaggaggtgggggaggcgcttcttctaacagaggagaagaagaatggcctcccccaacctggcggcagcgcaaaagatg

SEQ ID NO: 199509 - DNA, 103 bp, Artificial Sequence
  Synthetic Polynucleotide
taatacgactcactatagggactgtcttcagtcggaggaggtgggggaggaacagaggagacctcccatgcctcctccgaacctggcggcagcgcaaaagatg

SEQ ID NO: 199510 - DNA, 103 bp, Artificial Sequence
  Synthetic Polynucleotide
taatacgactcactatagggttttggcacaactgtcttcagtcggaggagaacagaggagactcctcatgctgaagacaaacctggcggcagcgcaaaagatg

SEQ ID NO: 199511 - DNA, 103 bp, Artificial Sequence
  Synthetic Polynucleotide
taatacgactcactataggggaccggggctttttggcacaactgtcttcaaacagaggagatgaagaatgttgtgccaaaacctggcggcagcgcaaaagatg

SEQ ID NO: 199512 - DNA, 103 bp, Artificial Sequence
  Synthetic Polynucleotide
taatacgactcactatagggctttgtgcgagaccggggctttttggcacaaacagaggagatgtgccatgaagccccggaacctggcggcagcgcaaaagatg

SEQ ID NO: 199513 - DNA, 103 bp, Artificial Sequence
  Synthetic Polynucleotide
taatacgactcactatagggctaaggagatctttgtgcgagaccggggctaacagaggagaagccccatgctcgcacaaaacctggcggcagcgcaaaagatg

SEQ ID NO: 199514 - DNA, 103 bp, Artificial Sequence
  Synthetic Polynucleotide
taatacgactcactatagggcccagggcttctaaggagatctttgtgcgaaacagaggagatcgcacatggatctccttaacctggcggcagcgcaaaagatg

SEQ ID NO: 199515 - DNA, 103 bp, Artificial Sequence
  Synthetic Polynucleotide
taatacgactcactatagggttggaggatccccagggcttctaaggagataacagaggagaatctccatggaagccctgaacctggcggcagcgcaaaagatg

SEQ ID NO: 199516 - DNA, 103 bp, Artificial Sequence
  Synthetic Polynucleotide
taatacgactcactataggggaataaagctttggaggatccccagggcttaacagaggagaaagcccatgggatcctccaacctggcggcagcgcaaaagatg

SEQ ID NO: 199517 - DNA, 103 bp, Artificial Sequence
  Synthetic Polynucleotide
taatacgactcactatagggcctacatcatgaataaagctttggaggatcaacagaggagagatcctatgaagctttataacctggcggcagcgcaaaagatg

SEQ ID NO: 199518 - DNA, 103 bp, Artificial Sequence
  Synthetic Polynucleotide
taatacgactcactataggggtccaactgctccacgacacaaaagacaggaacagaggagacctgtcatgtgtgtcgtgaacctggcggcagcgcaaaagatg

SEQ ID NO: 199519 - DNA, 103 bp, Artificial Sequence
  Synthetic Polynucleotide
taatacgactcactatagggtgggtacaggcctacatcatgaataaagctaacagaggagaagctttatgcatgatgtaaacctggcggcagcgcaaaagatg

SEQ ID NO: 199520 - DNA, 103 bp, Artificial Sequence
  Synthetic Polynucleotide
taatacgactcactatagggcttcctggtctgggtacaggcctacatcataacagaggagaatgatgatggcctgtaccaacctggcggcagcgcaaaagatg

SEQ ID NO: 199521 - DNA, 103 bp, Artificial Sequence
  Synthetic Polynucleotide
taatacgactcactataggggtgtggatggcttcctggtctgggtacaggaacagaggagacctgtaatgagaccaggaaacctggcggcagcgcaaaagatg

SEQ ID NO: 199522 - DNA, 103 bp, Artificial Sequence
  Synthetic Polynucleotide
taatacgactcactatagggagccgaaagagtgtggatggcttcctggtcaacagaggagagaccagatggccatccacaacctggcggcagcgcaaaagatg

SEQ ID NO: 199523 - DNA, 103 bp, Artificial Sequence
  Synthetic Polynucleotide
taatacgactcactataggggatccagctgagccgaaagagtgtggatggaacagaggagaccatccatgctctttcggaacctggcggcagcgcaaaagatg

SEQ ID NO: 199524 - DNA, 103 bp, Artificial Sequence
  Synthetic Polynucleotide
taatacgactcactatagggtgtttggggagatccagctgagccgaaagaaacagaggagatctttcatgtcagctggaaacctggcggcagcgcaaaagatg

SEQ ID NO: 199525 - DNA, 103 bp, Artificial Sequence
  Synthetic Polynucleotide
taatacgactcactataggggatgatggtgtgtttggggagatccagctgaacagaggagacagctgatgctccccaaaaacctggcggcagcgcaaaagatg

SEQ ID NO: 199526 - DNA, 103 bp, Artificial Sequence
  Synthetic Polynucleotide
taatacgactcactatagggggaagaacttgatgatggtgtgtttggggaaacagaggagatccccaatgacaccatcaaacctggcggcagcgcaaaagatg

SEQ ID NO: 199527 - DNA, 103 bp, Artificial Sequence
  Synthetic Polynucleotide
taatacgactcactatagggcgctggttctggaagaacttgatgatggtgaacagaggagacaccatatgcaagttcttaacctggcggcagcgcaaaagatg

SEQ ID NO: 199528 - DNA, 103 bp, Artificial Sequence
  Synthetic Polynucleotide
taatacgactcactatagggcacgtggtaccgctggttctggaagaacttaacagaggagaaagttcatgcagaaccagaacctggcggcagcgcaaaagatg

SEQ ID NO: 199529 - DNA, 103 bp, Artificial Sequence
  Synthetic Polynucleotide
taatacgactcactatagggggctgtcccgcagacacgggctctcgctccaacagaggagaggagcgatggcccgtgtcaacctggcggcagcgcaaaagatg

SEQ ID NO: 199530 - DNA, 103 bp, Artificial Sequence
  Synthetic Polynucleotide
taatacgactcactatagggcaagagagccgtccaactgctccacgacacaacagaggagagtgtcgatgagcagttggaacctggcggcagcgcaaaagatg

SEQ ID NO: 199531 - DNA, 103 bp, Artificial Sequence
  Synthetic Polynucleotide
taatacgactcactatagggcgtggtgcttcacgtggtaccgctggttctaacagaggagaagaaccatgggtaccacgaacctggcggcagcgcaaaagatg

SEQ ID NO: 199532 - DNA, 103 bp, Artificial Sequence
  Synthetic Polynucleotide
taatacgactcactatagggttcagcttcccgtggtgcttcacgtggtacaacagaggagagtaccaatggaagcaccaaacctggcggcagcgcaaaagatg

SEQ ID NO: 199533 - DNA, 103 bp, Artificial Sequence
  Synthetic Polynucleotide
taatacgactcactatagggcaggtgctctttcagcttcccgtggtgcttaacagaggagaaagcacatggggaagctgaacctggcggcagcgcaaaagatg

SEQ ID NO: 199534 - DNA, 103 bp, Artificial Sequence
  Synthetic Polynucleotide
taatacgactcactatagggccgcggagcccaggtgctctttcagcttccaacagaggagaggaagcatgaagagcaccaacctggcggcagcgcaaaagatg

SEQ ID NO: 199535 - DNA, 103 bp, Artificial Sequence
  Synthetic Polynucleotide
taatacgactcactataggggccacgtccaccgcggagcccaggtgctctaacagaggagaagagcaatggggctccgcaacctggcggcagcgcaaaagatg

SEQ ID NO: 199536 - DNA, 103 bp, Artificial Sequence
  Synthetic Polynucleotide
taatacgactcactatagggcttatattcagccacgtccaccgcggagccaacagaggagaggctccatggtggacgtgaacctggcggcagcgcaaaagatg

SEQ ID NO: 199537 - DNA, 103 bp, Artificial Sequence
  Synthetic Polynucleotide
taatacgactcactataggggctcctcgtccttatattcagccacgtccaaacagaggagatggacgatgctgaatataaacctggcggcagcgcaaaagatg

SEQ ID NO: 199538 - DNA, 103 bp, Artificial Sequence
  Synthetic Polynucleotide
taatacgactcactatagggtcggtcagcagctcctcgtccttatattcaaacagaggagatgaataatgggacgaggaaacctggcggcagcgcaaaagatg

SEQ ID NO: 199539 - DNA, 103 bp, Artificial Sequence
  Synthetic Polynucleotide
taatacgactcactatagggctcctctgactcggtcagcagctcctcgtcaacagaggagagacgagatgctgctgaccaacctggcggcagcgcaaaagatg

SEQ ID NO: 199540 - DNA, 103 bp, Artificial Sequence
  Synthetic Polynucleotide
taatacgactcactatagggcgctgtcgttctcctctgactcggtcagcaaacagaggagatgctgaatgagtcagaggaacctggcggcagcgcaaaagatg

SEQ ID NO: 199541 - DNA, 103 bp, Artificial Sequence
  Synthetic Polynucleotide
taatacgactcactatagggttgtcatattcaagagagccgtccaactgcaacagaggagagcagttatgcggctctctaacctggcggcagcgcaaaagatg

SEQ ID NO: 199542 - DNA, 103 bp, Artificial Sequence
  Synthetic Polynucleotide
taatacgactcactataggggagccttcctcgctgtcgttctcctctgacaacagaggagagtcagaatggaacgacagaacctggcggcagcgcaaaagatg

SEQ ID NO: 199543 - DNA, 103 bp, Artificial Sequence
  Synthetic Polynucleotide
taatacgactcactatagggcatctcctcggagccttcctcgctgtcgttaacagaggagaaacgacatggaggaaggcaacctggcggcagcgcaaaagatg

SEQ ID NO: 199544 - DNA, 103 bp, Artificial Sequence
  Synthetic Polynucleotide
taatacgactcactatagggccactttgtacatctcctcggagccttcctaacagaggagaaggaagatgccgaggagaaacctggcggcagcgcaaaagatg

SEQ ID NO: 199545 - DNA, 103 bp, Artificial Sequence
  Synthetic Polynucleotide
taatacgactcactatagggtcctcagcctccactttgtacatctcctcgaacagaggagacgaggaatggtacaaagtaacctggcggcagcgcaaaagatg

SEQ ID NO: 199546 - DNA, 103 bp, Artificial Sequence
  Synthetic Polynucleotide
taatacgactcactatagggagcattttcctcctcagcctccactttgtaaacagaggagatacaaaatggaggctgagaacctggcggcagcgcaaaagatg

SEQ ID NO: 199547 - DNA, 103 bp, Artificial Sequence
  Synthetic Polynucleotide
taatacgactcactatagggtgcttttgtcagcattttcctcctcagcctaacagaggagaaggctgatgaggaaaatgaacctggcggcagcgcaaaagatg

SEQ ID NO: 199548 - DNA, 103 bp, Artificial Sequence
  Synthetic Polynucleotide
taatacgactcactatagggggtgctgccttgcttttgtcagcattttccaacagaggagaggaaaaatgtgacaaaagaacctggcggcagcgcaaaagatg

SEQ ID NO: 199549 - DNA, 103 bp, Artificial Sequence
  Synthetic Polynucleotide
taatacgactcactatagggaatttcggcaggtgctgccttgcttttgtcaacagaggagagacaaaatgaaggcagcaaacctggcggcagcgcaaaagatg

SEQ ID NO: 199550 - DNA, 103 bp, Artificial Sequence
  Synthetic Polynucleotide
taatacgactcactatagggatctctggtcaatttcggcaggtgctgcctaacagaggagaaggcagatgctgccgaaaaacctggcggcagcgcaaaagatg

SEQ ID NO: 199551 - DNA, 103 bp, Artificial Sequence
  Synthetic Polynucleotide
taatacgactcactatagggttcttctctgttgtcatattcaagagagccaacagaggagaggctctatggaatatgacaacctggcggcagcgcaaaagatg

SEQ ID NO: 199552 - DNA, 103 bp, Artificial Sequence
  Synthetic Polynucleotide
taatacgactcactatagggactcggcgtgttcttctctgttgtcatattaacagaggagaaatatgatgacagagaagaacctggcggcagcgcaaaagatg

SEQ ID NO: 199553 - DNA, 103 bp, Artificial Sequence
  Synthetic Polynucleotide
taatacgactcactatagggaccaggacaaactcggcgtgttcttctctgaacagaggagacagagaatgacacgccgaaacctggcggcagcgcaaaagatg

SEQ ID NO: 199554 - DNA, 103 bp, Artificial Sequence
  Synthetic Polynucleotide
taatacgactcactatagggatctttccgcaccaggacaaactcggcgtgaacagaggagacacgccatgtttgtcctgaacctggcggcagcgcaaaagatg

SEQ ID NO: 199555 - DNA, 103 bp, Artificial Sequence
  Synthetic Polynucleotide
taatacgactcactatagggtaaaaagcacatctttccgcaccaggacaaaacagaggagattgtccatgtgcggaaagaacctggcggcagcgcaaaagatg

SEQ ID NO: 199556 - DNA, 103 bp, Artificial Sequence
  Synthetic Polynucleotide
taatacgactcactatagggaccagctggctaaaaagcacatctttccgcaacagaggagagcggaaatgtgtgcttttaacctggcggcagcgcaaaagatg

SEQ ID NO: 199557 - DNA, 103 bp, Artificial Sequence
  Synthetic Polynucleotide
taatacgactcactatagggcgcagtctccaccagctggctaaaaagcacaacagaggagagtgcttatgagccagctgaacctggcggcagcgcaaaagatg

SEQ ID NO: 199558 - DNA, 103 bp, Artificial Sequence
  Synthetic Polynucleotide
taatacgactcactataggggggccaggagcgcagtctccaccagctggcaacagaggagagccagcatgtggagactgaacctggcggcagcgcaaaagatg

SEQ ID NO: 199559 - DNA, 103 bp, Artificial Sequence
  Synthetic Polynucleotide
taatacgactcactatagggcgccggtcggggctgtcccgcagacacgggaacagaggagacccgtgatggcgggacagaacctggcggcagcgcaaaagatg

SEQ ID NO: 199560 - DNA, 103 bp, Artificial Sequence
  Synthetic Polynucleotide
taatacgactcactataggggaataccccagggccaggagcgcagtctccaacagaggagaggagacatggctcctggcaacctggcggcagcgcaaaagatg

SEQ ID NO: 199561 - DNA, 103 bp, Artificial Sequence
  Synthetic Polynucleotide
taatacgactcactatagggagagctgtgagaataccccagggccaggagaacagaggagactcctgatgctggggtataacctggcggcagcgcaaaagatg

SEQ ID NO: 199562 - DNA, 103 bp, Artificial Sequence
  Synthetic Polynucleotide
taatacgactcactatagggcctgggccgcagagctgtgagaataccccaaacagaggagatggggtatgctcacagctaacctggcggcagcgcaaaagatg

SEQ ID NO: 199563 - DNA, 103 bp, Artificial Sequence
  Synthetic Polynucleotide
taatacgactcactatagggattccttgggcctgggccgcagagctgtgaaacagaggagatcacagatgtgcggcccaaacctggcggcagcgcaaaagatg

SEQ ID NO: 199564 - DNA, 103 bp, Artificial Sequence
  Synthetic Polynucleotide
taatacgactcactatagggcagcttgattattccttgggcctgggccgcaacagaggagagcggccatggcccaaggaaacctggcggcagcgcaaaagatg

SEQ ID NO: 199565 - DNA, 103 bp, Artificial Sequence
  Synthetic Polynucleotide
taatacgactcactatagggtccaccttcccagcttgattattccttgggaacagaggagacccaagatgtaatcaagcaacctggcggcagcgcaaaagatg

SEQ ID NO: 199566 - DNA, 103 bp, Artificial Sequence
  Synthetic Polynucleotide
taatacgactcactataggggggagagggttccaccttcccagcttgattaacagaggagaaatcaaatggggaaggtgaacctggcggcagcgcaaaagatg

SEQ ID NO: 199567 - DNA, 103 bp, Artificial Sequence
  Synthetic Polynucleotide
taatacgactcactatagggataactgagggggagagggttccaccttccaacagaggagaggaaggatgaaccctctcaacctggcggcagcgcaaaagatg

SEQ ID NO: 199568 - DNA, 103 bp, Artificial Sequence
  Synthetic Polynucleotide
taatacgactcactatagggcatctgtcacataactgagggggagagggtaacagaggagaaccctcatgccctcagttaacctggcggcagcgcaaaagatg

SEQ ID NO: 199569 - DNA, 103 bp, Artificial Sequence
  Synthetic Polynucleotide
taatacgactcactataggggcgtcgggtgcatctgtcacataactgaggaacagaggagacctcagatgtgtgacagaaacctggcggcagcgcaaaagatg

SEQ ID NO: 199570 - DNA, 103 bp, Artificial Sequence
  Synthetic Polynucleotide
taatacgactcactataggggctgccgctccgccggtcggggctgtcccgaacagaggagacgggacatgcccgaccggaacctggcggcagcgcaaaagatg

SEQ ID NO: 199571 - DNA, 103 bp, Artificial Sequence
  Synthetic Polynucleotide
taatacgactcactatagggggccactgtcgcgtcgggtgcatctgtcacaacagaggagagtgacaatggcacccgacaacctggcggcagcgcaaaagatg

SEQ ID NO: 199572 - DNA, 103 bp, Artificial Sequence
  Synthetic Polynucleotide
taatacgactcactataggggtagcatgtcggccactgtcgcgtcgggtgaacagaggagacacccgatgcgacagtggaacctggcggcagcgcaaaagatg

SEQ ID NO: 199573 - DNA, 103 bp, Artificial Sequence
  Synthetic Polynucleotide
taatacgactcactatagggtagacatcttgtagcatgtcggccactgtcaacagaggagagacagtatgcgacatgctaacctggcggcagcgcaaaagatg

SEQ ID NO: 199574 - DNA, 103 bp, Artificial Sequence
  Synthetic Polynucleotide
taatacgactcactatagggcacaacatgatagacatcttgtagcatgtcaacagaggagagacatgatgcaagatgtcaacctggcggcagcgcaaaagatg

SEQ ID NO: 199575 - DNA, 103 bp, Artificial Sequence
  Synthetic Polynucleotide
taatacgactcactatagggttttcaacgtcacaacatgatagacatcttaacagaggagaaagatgatgatcatgttgaacctggcggcagcgcaaaagatg

SEQ ID NO: 199576 - DNA, 103 bp, Artificial Sequence
  Synthetic Polynucleotide
taatacgactcactatagggtgtaattggattttcaacgtcacaacatgaaacagaggagatcatgtatggacgttgaaaacctggcggcagcgcaaaagatg

SEQ ID NO: 199577 - DNA, 103 bp, Artificial Sequence
  Synthetic Polynucleotide
taatacgactcactatagggtgaacaactttgtaattggattttcaacgtaacagaggagaacgttgatgatccaattaaacctggcggcagcgcaaaagatg

SEQ ID NO: 199578 - DNA, 103 bp, Artificial Sequence
  Synthetic Polynucleotide
taatacgactcactatagggcttccaactttgaacaactttgtaattggaaacagaggagatccaatatgaaagttgttaacctggcggcagcgcaaaagatg

SEQ ID NO: 199579 - DNA, 103 bp, Artificial Sequence
  Synthetic Polynucleotide
taatacgactcactataggggcaggcaagtcttccaactttgaacaacttaacagaggagaaagttgatgaaagttggaaacctggcggcagcgcaaaagatg

SEQ ID NO: 199580 - DNA, 103 bp, Artificial Sequence
  Synthetic Polynucleotide
taatacgactcactatagggccactgctccgcaggcaagtcttccaacttaacagaggagaaagttgatggacttgcctaacctggcggcagcgcaaaagatg

SEQ ID NO: 199581 - DNA, 103 bp, Artificial Sequence
  Synthetic Polynucleotide
taatacgactcactatagggtgacgtccgggctgccgctccgccggtcggaacagaggagaccgaccatgggagcggcaaacctggcggcagcgcaaaagatg

SEQ ID NO: 199582 - DNA, 103 bp, Artificial Sequence
  Synthetic Polynucleotide
taatacgactcactatagggtggcatggttccactgctccgcaggcaagtaacagaggagaacttgcatgcggagcagtaacctggcggcagcgcaaaagatg

SEQ ID NO: 199583 - DNA, 103 bp, Artificial Sequence
  Synthetic Polynucleotide
taatacgactcactatagggttgcggactgtggcatggttccactgctccaacagaggagaggagcaatggaaccatgcaacctggcggcagcgcaaaagatg

SEQ ID NO: 199584 - DNA, 103 bp, Artificial Sequence
  Synthetic Polynucleotide
taatacgactcactatagggctttaaggcattgcggactgtggcatggttaacagaggagaaaccatatgacagtccgcaacctggcggcagcgcaaaagatg

SEQ ID NO: 199585 - DNA, 103 bp, Artificial Sequence
  Synthetic Polynucleotide
taatacgactcactatagggtgagcagttcctttaaggcattgcggactgaacagaggagacagtccatgatgccttaaaacctggcggcagcgcaaaagatg

SEQ ID NO: 199586 - DNA, 103 bp, Artificial Sequence
  Synthetic Polynucleotide
taatacgactcactatagggttcatctctttgagcagttcctttaaggcaaacagaggagatgccttatgggaactgctaacctggcggcagcgcaaaagatg

SEQ ID NO: 199587 - DNA, 103 bp, Artificial Sequence
  Synthetic Polynucleotide
taatacgactcactatagggtgtgctctggttcatctctttgagcagttcaacagaggagagaactgatgaaagagatgaacctggcggcagcgcaaaagatg

SEQ ID NO: 199588 - DNA, 103 bp, Artificial Sequence
  Synthetic Polynucleotide
taatacgactcactatagggctttggctaatgtgctctggttcatctcttaacagaggagaaagagaatgaccagagcaaacctggcggcagcgcaaaagatg

SEQ ID NO: 199589 - DNA, 103 bp, Artificial Sequence
  Synthetic Polynucleotide
taatacgactcactatagggagagggcattctttggctaatgtgctctggaacagaggagaccagagatgattagccaaaacctggcggcagcgcaaaagatg

SEQ ID NO: 199590 - DNA, 103 bp, Artificial Sequence
  Synthetic Polynucleotide
taatacgactcactatagggactctgggagagagggcattctttggctaaaacagaggagattagccatggaatgccctaacctggcggcagcgcaaaagatg

SEQ ID NO: 199591 - DNA, 103 bp, Artificial Sequence
  Synthetic Polynucleotide
taatacgactcactatagggatgaaatcatactctgggagagagggcattaacagaggagaaatgccatgtctcccagaaacctggcggcagcgcaaaagatg

SEQ ID NO: 199592 - DNA, 103 bp, Artificial Sequence
  Synthetic Polynucleotide
taatacgactcactatagggggaggccccttgacgtccgggctgccgctcaacagaggagagagcggatgcccggacgtaacctggcggcagcgcaaaagatg

SEQ ID NO: 199593 - DNA, 103 bp, Artificial Sequence
  Synthetic Polynucleotide
taatacgactcactatagggtttacaatggatgaaatcatactctgggagaacagaggagactcccaatgtatgatttcaacctggcggcagcgcaaaagatg

SEQ ID NO: 199594 - DNA, 103 bp, Artificial Sequence
  Synthetic Polynucleotide
taatacgactcactatagggatatgtgctatttacaatggatgaaatcataacagaggagaatgattatgtccattgtaaacctggcggcagcgcaaaagatg

SEQ ID NO: 199595 - DNA, 103 bp, Artificial Sequence
  Synthetic Polynucleotide
taatacgactcactatagggcattggcataatatgtgctatttacaatggaacagaggagaccattgatgatagcacataacctggcggcagcgcaaaagatg

SEQ ID NO: 199596 - DNA, 103 bp, Artificial Sequence
  Synthetic Polynucleotide
taatacgactcactataggggttgctgacacattggcataatatgtgctaaacagaggagatagcacatgttatgccaaaacctggcggcagcgcaaaagatg

SEQ ID NO: 199597 - DNA, 103 bp, Artificial Sequence
  Synthetic Polynucleotide
taatacgactcactatagggctggcacttggttgctgacacattggcataaacagaggagatatgccatggtgtcagcaaacctggcggcagcgcaaaagatg

SEQ ID NO: 199598 - DNA, 103 bp, Artificial Sequence
  Synthetic Polynucleotide
taatacgactcactatagggtcccaaactcctggcacttggttgctgacaaacagaggagatgtcagatgccaagtgccaacctggcggcagcgcaaaagatg

SEQ ID NO: 199599 - DNA, 103 bp, Artificial Sequence
  Synthetic Polynucleotide
taatacgactcactatagggttataccatctcccaaactcctggcacttgaacagaggagacaagtgatgggagtttggaacctggcggcagcgcaaaagatg

SEQ ID NO: 199600 - DNA, 103 bp, Artificial Sequence
  Synthetic Polynucleotide
taatacgactcactatagggcttgtactttttataccatctcccaaactcaacagaggagagagtttatgagatggtataacctggcggcagcgcaaaagatg

SEQ ID NO: 199601 - DNA, 103 bp, Artificial Sequence
  Synthetic Polynucleotide
taatacgactcactatagggctttaatcttcttgtactttttataccatcaacagaggagagatggtatgaaaagtacaaacctggcggcagcgcaaaagatg

SEQ ID NO: 199602 - DNA, 103 bp, Artificial Sequence
  Synthetic Polynucleotide
taatacgactcactatagggactctttccactttaatcttcttgtactttaacagaggagaaaagtaatggaagattaaaacctggcggcagcgcaaaagatg

SEQ ID NO: 199603 - DNA, 103 bp, Artificial Sequence
  Synthetic Polynucleotide
taatacgactcactatagggcttcactgggggaggccccttgacgtccggaacagaggagaccggacatgaaggggcctaacctggcggcagcgcaaaagatg

SEQ ID NO: 199604 - DNA, 103 bp, Artificial Sequence
  Synthetic Polynucleotide
taatacgactcactatagggttctcgttccactctttccactttaatcttaacagaggagaaagattatggtggaaagaaacctggcggcagcgcaaaagatg

SEQ ID NO: 199605 - DNA, 103 bp, Artificial Sequence
  Synthetic Polynucleotide
taatacgactcactatagggctgaaaggttttctcgttccactctttccaaacagaggagatggaaaatgtggaacgagaacctggcggcagcgcaaaagatg

SEQ ID NO: 199606 - DNA, 103 bp, Artificial Sequence
  Synthetic Polynucleotide
taatacgactcactatagggacacaatagtctgaaaggttttctcgttccaacagaggagaggaacgatgaaacctttcaacctggcggcagcgcaaaagatg

SEQ ID NO: 199607 - DNA, 103 bp, Artificial Sequence
  Synthetic Polynucleotide
taatacgactcactatagggctggcccagaacacaatagtctgaaaggttaacagaggagaaaccttatggactattgtaacctggcggcagcgcaaaagatg

SEQ ID NO: 199608 - DNA, 103 bp, Artificial Sequence
  Synthetic Polynucleotide
taatacgactcactataggggcattggacgctggcccagaacacaatagtaacagaggagaactattatgttctgggccaacctggcggcagcgcaaaagatg

SEQ ID NO: 199609 - DNA, 103 bp, Artificial Sequence
  Synthetic Polynucleotide
taatacgactcactatagggtttggtaaatgcattggacgctggcccagaaacagaggagatctgggatggcgtccaataacctggcggcagcgcaaaagatg

SEQ ID NO: 199610 - DNA, 103 bp, Artificial Sequence
  Synthetic Polynucleotide
taatacgactcactatagggctggttcatatttggtaaatgcattggacgaacagaggagacgtccaatgcatttaccaaacctggcggcagcgcaaaagatg

SEQ ID NO: 199611 - DNA, 103 bp, Artificial Sequence
  Synthetic Polynucleotide
taatacgactcactataggggggatgccagctggttcatatttggtaaataacagaggagaatttacatgatatgaaccaacctggcggcagcgcaaaagatg

SEQ ID NO: 199612 - DNA, 103 bp, Artificial Sequence
  Synthetic Polynucleotide
taatacgactcactataggggttttccccagggatgccagctggttcataaacagaggagatatgaaatggctggcatcaacctggcggcagcgcaaaagatg

SEQ ID NO: 199613 - DNA, 103 bp, Artificial Sequence
  Synthetic Polynucleotide
taatacgactcactatagggctgttcgttggttttccccagggatgccagaacagaggagactggcaatgctggggaaaaacctggcggcagcgcaaaagatg

SEQ ID NO: 199614 - DNA, 103 bp, Artificial Sequence
  Synthetic Polynucleotide
taatacgactcactataggggccgggccaccttcactgggggaggcccctaacagaggagaaggggcatgccccagtgaaacctggcggcagcgcaaaagatg

SEQ ID NO: 199615 - DNA, 103 bp, Artificial Sequence
  Synthetic Polynucleotide
taatacgactcactatagggtgtgaggagactgttcgttggttttccccaaacagaggagatggggaatgccaacgaacaacctggcggcagcgcaaaagatg

SEQ ID NO: 199616 - DNA, 103 bp, Artificial Sequence
  Synthetic Polynucleotide
taatacgactcactatagggtgaatttggctgtgaggagactgttcgttgaacagaggagacaacgaatggtctcctcaaacctggcggcagcgcaaaagatg

SEQ ID NO: 199617 - DNA, 103 bp, Artificial Sequence
  Synthetic Polynucleotide
taatacgactcactatagggagtactgtggtgaatttggctgtgaggagaaacagaggagatctcctatgagccaaattaacctggcggcagcgcaaaagatg

SEQ ID NO: 199618 - DNA, 103 bp, Artificial Sequence
  Synthetic Polynucleotide
taatacgactcactatagggttcggattggagtactgtggtgaatttggcaacagaggagagccaaaatgaccacagtaaacctggcggcagcgcaaaagatg

SEQ ID NO: 199619 - DNA, 103 bp, Artificial Sequence
  Synthetic Polynucleotide
taatacgactcactatagggggcacttggtttcggattggagtactgtggaacagaggagaccacagatgtccaatccgaacctggcggcagcgcaaaagatg

SEQ ID NO: 199620 - DNA, 103 bp, Artificial Sequence
  Synthetic Polynucleotide
taatacgactcactatagggctgtaatgcgggcacttggtttcggattggaacagaggagaccaatcatgaaccaagtgaacctggcggcagcgcaaaagatg

SEQ ID NO: 199621 - DNA, 103 bp, Artificial Sequence
  Synthetic Polynucleotide
taatacgactcactatagggtcatgatgggctgtaatgcgggcacttggtaacagaggagaaccaagatgccgcattacaacctggcggcagcgcaaaagatg

SEQ ID NO: 199622 - DNA, 103 bp, Artificial Sequence
  Synthetic Polynucleotide
taatacgactcactatagggagaccagggctcatgatgggctgtaatgcgaacagaggagacgcattatggcccatcataacctggcggcagcgcaaaagatg

SEQ ID NO: 199623 - DNA, 103 bp, Artificial Sequence
  Synthetic Polynucleotide
taatacgactcactataggggggagaaagaagaccagggctcatgatgggaacagaggagacccatcatgagccctggtaacctggcggcagcgcaaaagatg

SEQ ID NO: 199624 - DNA, 103 bp, Artificial Sequence
  Synthetic Polynucleotide
taatacgactcactataggggactaagctggggagaaagaagaccagggcaacagaggagagccctgatgttctttctcaacctggcggcagcgcaaaagatg

SEQ ID NO: 199625 - DNA, 103 bp, Artificial Sequence
  Synthetic Polynucleotide
taatacgactcactatagggttctgctccagccgggccaccttcactgggaacagaggagacccagtatgggtggcccgaacctggcggcagcgcaaaagatg

SEQ ID NO: 199626 - DNA, 103 bp, Artificial Sequence
  Synthetic Polynucleotide
taatacgactcactatagggacaagttgtggactaagctggggagaaagaaacagaggagatctttcatgccagcttagaacctggcggcagcgcaaaagatg

SEQ ID NO: 199627 - DNA, 103 bp, Artificial Sequence
  Synthetic Polynucleotide
taatacgactcactatagggttgttgccttacaagttgtggactaagctgaacagaggagacagcttatgccacaacttaacctggcggcagcgcaaaagatg

SEQ ID NO: 199628 - DNA, 103 bp, Artificial Sequence
  Synthetic Polynucleotide
taatacgactcactatagggccatggctatttgttgccttacaagttgtgaacagaggagacacaacatgtaaggcaacaacctggcggcagcgcaaaagatg

SEQ ID NO: 199629 - DNA, 103 bp, Artificial Sequence
  Synthetic Polynucleotide
taatacgactcactatagggatcagatgggccatggctatttgttgccttaacagaggagaaaggcaatgaatagccataacctggcggcagcgcaaaagatg

SEQ ID NO: 199630 - DNA, 103 bp, Artificial Sequence
  Synthetic Polynucleotide
taatacgactcactatagggctgttggtttatcagatgggccatggctataacagaggagaatagccatggcccatctgaacctggcggcagcgcaaaagatg

SEQ ID NO: 199631 - DNA, 103 bp, Artificial Sequence
  Synthetic Polynucleotide
taatacgactcactatagggtaacggcaatctgttggtttatcagatgggaacagaggagacccatcatgtaaaccaacaacctggcggcagcgcaaaagatg

SEQ ID NO: 199632 - DNA, 103 bp, Artificial Sequence
  Synthetic Polynucleotide
taatacgactcactatagggaggagccggctaacggcaatctgttggtttaacagaggagaaaaccaatggattgccgtaacctggcggcagcgcaaaagatg

SEQ ID NO: 199633 - DNA, 103 bp, Artificial Sequence
  Synthetic Polynucleotide
taatacgactcactatagggctggtgagccaggagccggctaacggcaataacagaggagaattgccatgagccggctcaacctggcggcagcgcaaaagatg

SEQ ID NO: 199634 - DNA, 103 bp, Artificial Sequence
  Synthetic Polynucleotide
taatacgactcactatagggcttgaggatgctggtgagccaggagccggcaacagaggagagccggcatgtggctcaccaacctggcggcagcgcaaaagatg

SEQ ID NO: 199635 - DNA, 103 bp, Artificial Sequence
  Synthetic Polynucleotide
taatacgactcactatagggtggttgatggcttgaggatgctggtgagccaacagaggagaggctcaatggcatcctcaaacctggcggcagcgcaaaagatg

SEQ ID NO: 199636 - DNA, 103 bp, Artificial Sequence
  Synthetic Polynucleotide
taatacgactcactataggggaccttcttgaccaggaaggacctgggcataacagaggagaatgcccatgtccttcctgaacctggcggcagcgcaaaagatg

SEQ ID NO: 199637 - DNA, 103 bp, Artificial Sequence
  Synthetic Polynucleotide
taatacgactcactataggggtaccctttatcgtgcagtggcgcgccgagaacagaggagactcggcatgccactgcacaacctggcggcagcgcaaaagatg

SEQ ID NO: 199638 - DNA, 103 bp, Artificial Sequence
  Synthetic Polynucleotide
taatacgactcactatagggcggcgcaggagccgcggggcctccggcgccaacagaggagaggcgccatgggccccgcgaacctggcggcagcgcaaaagatg

SEQ ID NO: 199639 - DNA, 103 bp, Artificial Sequence
  Synthetic Polynucleotide
taatacgactcactatagggtgagctgtggcggcgcaggagccgcggggcaacagaggagagccccgatgctcctgcgcaacctggcggcagcgcaaaagatg

SEQ ID NO: 199640 - DNA, 103 bp, Artificial Sequence
  Synthetic Polynucleotide
taatacgactcactatagggtgcacagggctgagctgtggcggcgcaggaaacagaggagatcctgcatggccacagctaacctggcggcagcgcaaaagatg

SEQ ID NO: 199641 - DNA, 103 bp, Artificial Sequence
  Synthetic Polynucleotide
taatacgactcactatagggagtcgctgaggtaccctttatcgtgcagtgaacagaggagacactgcatgataaagggtaacctggcggcagcgcaaaagatg

SEQ ID NO: 199642 - DNA, 103 bp, Artificial Sequence
  Synthetic Polynucleotide
taatacgactcactatagggggccccacgtagtcgctgaggtaccctttaaacagaggagataaaggatgcctcagcgaaacctggcggcagcgcaaaagatg

SEQ ID NO: 199643 - DNA, 103 bp, Artificial Sequence
  Synthetic Polynucleotide
taatacgactcactataggggacggacgagggccccacgtagtcgctgagaacagaggagactcagcatgtacgtggggaacctggcggcagcgcaaaagatg

SEQ ID NO: 199644 - DNA, 103 bp, Artificial Sequence
  Synthetic Polynucleotide
taatacgactcactatagggcgccatcgtagacggacgagggccccacgtaacagaggagaacgtggatgcctcgtccgaacctggcggcagcgcaaaagatg

SEQ ID NO: 199645 - DNA, 103 bp, Artificial Sequence
  Synthetic Polynucleotide
taatacgactcactataggggcctcggcgtcgccatcgtagacggacgagaacagaggagactcgtcatgctacgatggaacctggcggcagcgcaaaagatg

SEQ ID NO: 199646 - DNA, 103 bp, Artificial Sequence
  Synthetic Polynucleotide
taatacgactcactataggggagcagcgcagcctcggcgtcgccatcgtaaacagaggagatacgatatggacgccgagaacctggcggcagcgcaaaagatg

SEQ ID NO: 199647 - DNA, 103 bp, Artificial Sequence
  Synthetic Polynucleotide
taatacgactcactatagggacggccctttgagcagcgcagcctcggcgtaacagaggagaacgccgatgctgcgctgcaacctggcggcagcgcaaaagatg

SEQ ID NO: 199648 - DNA, 103 bp, Artificial Sequence
  Synthetic Polynucleotide
taatacgactcactatagggggctccggcgacggccctttgagcagcgcaaacagaggagatgcgctatgcaaagggccaacctggcggcagcgcaaaagatg

SEQ ID NO: 199649 - DNA, 103 bp, Artificial Sequence
  Synthetic Polynucleotide
taatacgactcactatagggtgcgtacatgggctccggcgacggccctttaacagaggagaaaagggatgtcgccggagaacctggcggcagcgcaaaagatg

SEQ ID NO: 199650 - DNA, 103 bp, Artificial Sequence
  Synthetic Polynucleotide
taatacgactcactatagggcgtcaagtttgaccttcttgaccaggaaggaacagaggagaccttccatgtcaagaaggaacctggcggcagcgcaaaagatg

SEQ ID NO: 199651 - DNA, 103 bp, Artificial Sequence
  Synthetic Polynucleotide
taatacgactcactataggggcacagctgctgcgtacatgggctccggcgaacagaggagacgccggatgccatgtacgaacctggcggcagcgcaaaagatg

SEQ ID NO: 199652 - DNA, 103 bp, Artificial Sequence
  Synthetic Polynucleotide
taatacgactcactatagggagctctccacgcacagctgctgcgtacatgaacagaggagacatgtaatgagcagctgtaacctggcggcagcgcaaaagatg

SEQ ID NO: 199653 - DNA, 103 bp, Artificial Sequence
  Synthetic Polynucleotide
taatacgactcactatagggcgccggacccagctctccacgcacagctgcaacagaggagagcagctatgcgtggagagaacctggcggcagcgcaaaagatg

SEQ ID NO: 199654 - DNA, 103 bp, Artificial Sequence
  Synthetic Polynucleotide
taatacgactcactatagggaccctgcagccgccggacccagctctccacaacagaggagagtggagatgtgggtccggaacctggcggcagcgcaaaagatg

SEQ ID NO: 199655 - DNA, 103 bp, Artificial Sequence
  Synthetic Polynucleotide
taatacgactcactatagggggcggcgcagaccctgcagccgccggacccaacagaggagagggtccatgggctgcaggaacctggcggcagcgcaaaagatg

SEQ ID NO: 199656 - DNA, 103 bp, Artificial Sequence
  Synthetic Polynucleotide
taatacgactcactatagggcggggtgggcggcggcgcagaccctgcagcaacagaggagagctgcaatgtctgcgccgaacctggcggcagcgcaaaagatg

SEQ ID NO: 199657 - DNA, 103 bp, Artificial Sequence
  Synthetic Polynucleotide
taatacgactcactataggggctccgggcgcggggtgggcggcggcgcagaacagaggagactgcgcatgcgcccacccaacctggcggcagcgcaaaagatg

SEQ ID NO: 199658 - DNA, 103 bp, Artificial Sequence
  Synthetic Polynucleotide
taatacgactcactataggggcggtggccagctccgggcgcggggtgggcaacagaggagagcccacatggcgcccggaaacctggcggcagcgcaaaagatg

SEQ ID NO: 199659 - DNA, 103 bp, Artificial Sequence
  Synthetic Polynucleotide
taatacgactcactataggggccgcccgcagcggtggccagctccgggcgaacagaggagacgcccgatgctggccaccaacctggcggcagcgcaaaagatg

SEQ ID NO: 199660 - DNA, 103 bp, Artificial Sequence
  Synthetic Polynucleotide
taatacgactcactatagggcgttgatgtagccgcccgcagcggtggccaaacagaggagatggccaatgctgcgggcgaacctggcggcagcgcaaaagatg

SEQ ID NO: 199661 - DNA, 103 bp, Artificial Sequence
  Synthetic Polynucleotide
taatacgactcactataggggaagagaacgcgtcaagtttgaccttcttgaacagaggagacaagaaatgcaaacttgaaacctggcggcagcgcaaaagatg

SEQ ID NO: 199662 - DNA, 103 bp, Artificial Sequence
  Synthetic Polynucleotide
taatacgactcactataggggccgcgtcgccgttgatgtagccgcccgcaaacagaggagatgcgggatgctacatcaaaacctggcggcagcgcaaaagatg

SEQ ID NO: 199663 - DNA, 103 bp, Artificial Sequence
  Synthetic Polynucleotide
taatacgactcactatagggctcgctgacggccgcgtcgccgttgatgtaaacagaggagatacatcatgggcgacgcgaacctggcggcagcgcaaaagatg

SEQ ID NO: 199664 - DNA, 103 bp, Artificial Sequence
  Synthetic Polynucleotide
taatacgactcactatagggccgcgtagccctcgctgacggccgcgtcgcaacagaggagagcgacgatgccgtcagcgaacctggcggcagcgcaaaagatg

SEQ ID NO: 199665 - DNA, 103 bp, Artificial Sequence
  Synthetic Polynucleotide
taatacgactcactatagggaaggcgtccgccgcgtagccctcgctgacgaacagaggagacgtcagatggggctacgcaacctggcggcagcgcaaaagatg

SEQ ID NO: 199666 - DNA, 103 bp, Artificial Sequence
  Synthetic Polynucleotide
taatacgactcactatagggggtgatgaagaaggcgtccgccgcgtagccaacagaggagaggctacatggcggacgccaacctggcggcagcgcaaaagatg

SEQ ID NO: 199667 - DNA, 103 bp, Artificial Sequence
  Synthetic Polynucleotide
taatacgactcactatagggagcgcccgtcggtgatgaagaaggcgtccgaacagaggagacggacgatgtcttcatcaaacctggcggcagcgcaaaagatg

SEQ ID NO: 199668 - DNA, 103 bp, Artificial Sequence
  Synthetic Polynucleotide
taatacgactcactatagggttacgccgcgagcgcccgtcggtgatgaagaacagaggagacttcatatgcgacgggcgaacctggcggcagcgcaaaagatg

SEQ ID NO: 199669 - DNA, 103 bp, Artificial Sequence
  Synthetic Polynucleotide
taatacgactcactatagggattggaagccttacgccgcgagcgcccgtcaacagaggagagacgggatgtcgcggcgtaacctggcggcagcgcaaaagatg

SEQ ID NO: 199670 - DNA, 103 bp, Artificial Sequence
  Synthetic Polynucleotide
taatacgactcactatagggcagcgccggcattggaagccttacgccgcgaacagaggagacgcggcatgaggcttccaaacctggcggcagcgcaaaagatg

SEQ ID NO: 199671 - DNA, 103 bp, Artificial Sequence
  Synthetic Polynucleotide
taatacgactcactatagggggagcggcggcagcgccggcattggaagccaacagaggagaggcttcatgtgccggcgcaacctggcggcagcgcaaaagatg

SEQ ID NO: 199672 - DNA, 103 bp, Artificial Sequence
  Synthetic Polynucleotide
taatacgactcactatagggcaggtcggccgaagagaacgcgtcaagtttaacagaggagaaaacttatggcgttctctaacctggcggcagcgcaaaagatg

SEQ ID NO: 199673 - DNA, 103 bp, Artificial Sequence
  Synthetic Polynucleotide
taatacgactcactatagggggctgtggagggagcggcggcagcgccggcaacagaggagagccggcatggccgccgctaacctggcggcagcgcaaaagatg

SEQ ID NO: 199674 - DNA, 103 bp, Artificial Sequence
  Synthetic Polynucleotide
taatacgactcactatagggccgccgccgaggctgtggagggagcggcggaacagaggagaccgccgatgcctccacagaacctggcggcagcgcaaaagatg

SEQ ID NO: 199675 - DNA, 103 bp, Artificial Sequence
  Synthetic Polynucleotide
taatacgactcactatagggccgtcgggggccgccgccgaggctgtggagaacagaggagactccacatgctcggcggcaacctggcggcagcgcaaaagatg

SEQ ID NO: 199676 - DNA, 103 bp, Artificial Sequence
  Synthetic Polynucleotide
taatacgactcactatagggtccggcgtcgccgtcgggggccgccgccgaaacagaggagatcggcgatggcccccgacaacctggcggcagcgcaaaagatg

SEQ ID NO: 199677 - DNA, 103 bp, Artificial Sequence
  Synthetic Polynucleotide
taatacgactcactatagggcgcccccgcctccggcgtcgccgtcgggggaacagaggagacccccgatggcgacgccgaacctggcggcagcgcaaaagatg

SEQ ID NO: 199678 - DNA, 103 bp, Artificial Sequence
  Synthetic Polynucleotide
taatacgactcactatagggccgcccgccccgcccccgcctccggcgtcgaacagaggagacgacgcatgaggcgggggaacctggcggcagcgcaaaagatg

SEQ ID NO: 199679 - DNA, 103 bp, Artificial Sequence
  Synthetic Polynucleotide
taatacgactcactatagggcaagctgcgcccgcccgccccgcccccgccaacagaggagaggcgggatgggggcgggcaacctggcggcagcgcaaaagatg

SEQ ID NO: 199680 - DNA, 103 bp, Artificial Sequence
  Synthetic Polynucleotide
taatacgactcactataggggcccggatcccaagctgcgcccgcccgcccaacagaggagagggcggatgggcgcagctaacctggcggcagcgcaaaagatg

SEQ ID NO: 199681 - DNA, 103 bp, Artificial Sequence
  Synthetic Polynucleotide
taatacgactcactatagggcggccccccggcccggatcccaagctgcgcaacagaggagagcgcagatggggatccggaacctggcggcagcgcaaaagatg

SEQ ID NO: 199682 - DNA, 103 bp, Artificial Sequence
  Synthetic Polynucleotide
taatacgactcactatagggcgtgccgccccggccccccggcccggatccaacagaggagaggatccatgccggggggcaacctggcggcagcgcaaaagatg

SEQ ID NO: 199683 - DNA, 103 bp, Artificial Sequence
  Synthetic Polynucleotide
taatacgactcactatagggaggcgctctccaggtcggccgaagagaacgaacagaggagacgttctatgcggccgaccaacctggcggcagcgcaaaagatg

SEQ ID NO: 199684 - DNA, 103 bp, Artificial Sequence
  Synthetic Polynucleotide
taatacgactcactatagggcccccgcgcgcgtgccgccccggccccccgaacagaggagacgggggatgggggcggcaaacctggcggcagcgcaaaagatg

SEQ ID NO: 199685 - DNA, 103 bp, Artificial Sequence
  Synthetic Polynucleotide
taatacgactcactatagggtcggtgcctgcccccgcgcgcgtgccgcccaacagaggagagggcggatggcgcgcgggaacctggcggcagcgcaaaagatg

SEQ ID NO: 199686 - DNA, 103 bp, Artificial Sequence
  Synthetic Polynucleotide
taatacgactcactatagggcgcgcgcgcctcggtgcctgcccccgcgcgaacagaggagacgcgcgatggcaggcaccaacctggcggcagcgcaaaagatg

SEQ ID NO: 199687 - DNA, 103 bp, Artificial Sequence
  Synthetic Polynucleotide
taatacgactcactatagggcccctggccccgcgcgcgcctcggtgcctgaacagaggagacaggcaatgaggcgcgcgaacctggcggcagcgcaaaagatg

SEQ ID NO: 199688 - DNA, 103 bp, Artificial Sequence
  Synthetic Polynucleotide
taatacgactcactataggggcacctgcggcccctggccccgcgcgcgccaacagaggagaggcgcgatgggggccaggaacctggcggcagcgcaaaagatg

SEQ ID NO: 199689 - DNA, 103 bp, Artificial Sequence
  Synthetic Polynucleotide
taatacgactcactatagggccggccgccagcacctgcggcccctggcccaacagaggagagggccaatggccgcaggtaacctggcggcagcgcaaaagatg

SEQ ID NO: 199690 - DNA, 103 bp, Artificial Sequence
  Synthetic Polynucleotide
taatacgactcactatagggcgcacgcgtgccggccgccagcacctgcggaacagaggagaccgcagatgctggcggccaacctggcggcagcgcaaaagatg

SEQ ID NO: 199691 - DNA, 103 bp, Artificial Sequence
  Synthetic Polynucleotide
taatacgactcactatagggccgcactcgccgcacgcgtgccggccgccaaacagaggagatggcggatggcacgcgtgaacctggcggcagcgcaaaagatg

SEQ ID NO: 199692 - DNA, 103 bp, Artificial Sequence
  Synthetic Polynucleotide
taatacgactcactataggggtatgttttgccgcactcgccgcacgcgtgaacagaggagacacgcgatgggcgagtgcaacctggcggcagcgcaaaagatg

SEQ ID NO: 199693 - DNA, 103 bp, Artificial Sequence
  Synthetic Polynucleotide
taatacgactcactatagggacgacgtggcgtatgttttgccgcactcgcaacagaggagagcgagtatggcaaaacataacctggcggcagcgcaaaagatg

SEQ ID NO: 199694 - DNA, 103 bp, Artificial Sequence
  Synthetic Polynucleotide
taatacgactcactataggggcgcgtccgtaggcgctctccaggtcggccaacagaggagaggccgaatgggagagcgcaacctggcggcagcgcaaaagatg

SEQ ID NO: 199695 - DNA, 103 bp, Artificial Sequence
  Synthetic Polynucleotide
taatacgactcactatagggctcaggttcgacgacgtggcgtatgttttgaacagaggagacaaaacatgcgccacgtcaacctggcggcagcgcaaaagatg

SEQ ID NO: 199696 - DNA, 103 bp, Artificial Sequence
  Synthetic Polynucleotide
taatacgactcactatagggcttgtggcggctcaggttcgacgacgtggcaacagaggagagccacgatgtcgaacctgaacctggcggcagcgcaaaagatg

SEQ ID NO: 199697 - DNA, 103 bp, Artificial Sequence
  Synthetic Polynucleotide
taatacgactcactatagggggtgcgtctgcttgtggcggctcaggttcgaacagaggagacgaaccatggccgccacaaacctggcggcagcgcaaaagatg

SEQ ID NO: 199698 - DNA, 103 bp, Artificial Sequence
  Synthetic Polynucleotide
taatacgactcactatagggtccaggctgcggtgcgtctgcttgtggcggaacagaggagaccgccaatggcagacgcaaacctggcggcagcgcaaaagatg

SEQ ID NO: 199699 - DNA, 103 bp, Artificial Sequence
  Synthetic Polynucleotide
taatacgactcactatagggcagctggctgtccaggctgcggtgcgtctgaacagaggagacagacgatgcgcagcctgaacctggcggcagcgcaaaagatg

SEQ ID NO: 199700 - DNA, 103 bp, Artificial Sequence
  Synthetic Polynucleotide
taatacgactcactatagggagcgccgcgccagctggctgtccaggctgcaacagaggagagcagccatgacagccagcaacctggcggcagcgcaaaagatg

SEQ ID NO: 199701 - DNA, 103 bp, Artificial Sequence
  Synthetic Polynucleotide
taatacgactcactatagggcacgtcgggcagcgccgcgccagctggctgaacagaggagacagccaatgggcgcggcgaacctggcggcagcgcaaaagatg

SEQ ID NO: 199702 - DNA, 103 bp, Artificial Sequence
  Synthetic Polynucleotide
taatacgactcactatagggcaccttgccgcacgtcgggcagcgccgcgcaacagaggagagcgcggatgtgcccgacgaacctggcggcagcgcaaaagatg

SEQ ID NO: 199703 - DNA, 103 bp, Artificial Sequence
  Synthetic Polynucleotide
taatacgactcactatagggtggacacgtacaccttgccgcacgtcgggcaacagaggagagcccgaatggcggcaaggaacctggcggcagcgcaaaagatg

SEQ ID NO: 199704 - DNA, 103 bp, Artificial Sequence
  Synthetic Polynucleotide
taatacgactcactatagggatggccggcatggacacgtacaccttgccgaacagaggagacggcaaatggtacgtgtcaacctggcggcagcgcaaaagatg

SEQ ID NO: 199705 - DNA, 103 bp, Artificial Sequence
  Synthetic Polynucleotide
taatacgactcactataggggtcgctgcgggcgcgtccgtaggcgctctcaacagaggagagagagcatgtacggacgcaacctggcggcagcgcaaaagatg

SEQ ID NO: 199706 - DNA, 103 bp, Artificial Sequence
  Synthetic Polynucleotide
taatacgactcactataggggtgcatggccatggccggcatggacacgtaaacagaggagatacgtgatgatgccggccaacctggcggcagcgcaaaagatg

SEQ ID NO: 199707 - DNA, 103 bp, Artificial Sequence
  Synthetic Polynucleotide
taatacgactcactataggggcgtgagcaggtgcatggccatggccggcaaacagaggagatgccggatgtggccatgcaacctggcggcagcgcaaaagatg

SEQ ID NO: 199708 - DNA, 103 bp, Artificial Sequence
  Synthetic Polynucleotide
taatacgactcactatagggcgcaggtcgtgcgtgagcaggtgcatggccaacagaggagaggccatatgcctgctcacaacctggcggcagcgcaaaagatg

SEQ ID NO: 199709 - DNA, 103 bp, Artificial Sequence
  Synthetic Polynucleotide
taatacgactcactataggggcacttgtggcgcaggtcgtgcgtgagcagaacagaggagactgctcatgcacgacctgaacctggcggcagcgcaaaagatg

SEQ ID NO: 199710 - DNA, 103 bp, Artificial Sequence
  Synthetic Polynucleotide
taatacgactcactatagggcgcacacgccgcacttgtggcgcaggtcgtaacagaggagaacgaccatggccacaagtaacctggcggcagcgcaaaagatg

SEQ ID NO: 199711 - DNA, 103 bp, Artificial Sequence
  Synthetic Polynucleotide
taatacgactcactatagggaaggctttgccgcacacgccgcacttgtggaacagaggagaccacaaatgcggcgtgtgaacctggcggcagcgcaaaagatg

SEQ ID NO: 199712 - DNA, 103 bp, Artificial Sequence
  Synthetic Polynucleotide
taatacgactcactataggggggccgcgagaaggctttgccgcacacgccaacagaggagaggcgtgatgggcaaagccaacctggcggcagcgcaaaagatg

SEQ ID NO: 199713 - DNA, 103 bp, Artificial Sequence
  Synthetic Polynucleotide
taatacgactcactataggggcagcagccagggccgcgagaaggctttgcaacagaggagagcaaagatgtctcgcggcaacctggcggcagcgcaaaagatg

SEQ ID NO: 199714 - DNA, 103 bp, Artificial Sequence
  Synthetic Polynucleotide
taatacgactcactatagggatgtggccctgcagcagccagggccgcgagaacagaggagactcgcgatgctggctgctaacctggcggcagcgcaaaagatg

SEQ ID NO: 199715 - DNA, 103 bp, Artificial Sequence
  Synthetic Polynucleotide
taatacgactcactataggggtgcgagcgcatgtggccctgcagcagccaaacagaggagatggctgatgcagggccacaacctggcggcagcgcaaaagatg

SEQ ID NO: 199716 - DNA, 103 bp, Artificial Sequence
  Synthetic Polynucleotide
taatacgactcactataggggcgcgccgaggtcgctgcgggcgcgtccgtaacagaggagaacggacatgcccgcagcgaacctggcggcagcgcaaaagatg

SEQ ID NO: 199717 - DNA, 103 bp, Artificial Sequence
  Synthetic Polynucleotide
taatacgactcactatagggtctcgccggtgtgcgagcgcatgtggccctaacagaggagaagggccatgtgcgctcgcaacctggcggcagcgcaaaagatg

SEQ ID NO: 199718 - DNA, 103 bp, Artificial Sequence
  Synthetic Polynucleotide
taatacgactcactatagggccgaagggtttctcgccggtgtgcgagcgcaacagaggagagcgctcatgcaccggcgaaacctggcggcagcgcaaaagatg

SEQ ID NO: 199719 - DNA, 103 bp, Artificial Sequence
  Synthetic Polynucleotide
taatacgactcactataggggtgcgcgcagccgaagggtttctcgccggtaacagaggagaaccggcatgaaacccttcaacctggcggcagcgcaaaagatg

SEQ ID NO: 199720 - DNA, 103 bp, Artificial Sequence
  Synthetic Polynucleotide
taatacgactcactatagggccttgccgcagtgcgcgcagccgaagggttaacagaggagaaaccctatggctgcgcgcaacctggcggcagcgcaaaagatg

SEQ ID NO: 199721 - DNA, 103 bp, Artificial Sequence
  Synthetic Polynucleotide
taatacgactcactatagggtcggcgaaggccttgccgcagtgcgcgcagaacagaggagactgcgcatgctgcggcaaaacctggcggcagcgcaaaagatg

SEQ ID NO: 199722 - DNA, 103 bp, Artificial Sequence
  Synthetic Polynucleotide
taatacgactcactataggggttggagcggtcggcgaaggccttgccgcaaacagaggagatgcggcatggccttcgccaacctggcggcagcgcaaaagatg

SEQ ID NO: 199723 - DNA, 103 bp, Artificial Sequence
  Synthetic Polynucleotide
taatacgactcactataggggcgcgcgcaggttggagcggtcggcgaaggaacagaggagaccttcgatgaccgctccaaacctggcggcagcgcaaaagatg

SEQ ID NO: 199724 - DNA, 103 bp, Artificial Sequence
  Synthetic Polynucleotide
taatacgactcactataggggtctgcatgtgcgcgcgcaggttggagcggaacagaggagaccgctcatgcctgcgcgcaacctggcggcagcgcaaaagatg

SEQ ID NO: 199725 - DNA, 103 bp, Artificial Sequence
  Synthetic Polynucleotide
taatacgactcactatagggggccgaatgcgtctgcatgtgcgcgcgcagaacagaggagactgcgcatgcacatgcagaacctggcggcagcgcaaaagatg

SEQ ID NO: 199726 - DNA, 103 bp, Artificial Sequence
  Synthetic Polynucleotide
taatacgactcactatagggagtgcttgaaggccgaatgcgtctgcatgtaacagaggagaacatgcatgcgcattcggaacctggcggcagcgcaaaagatg

SEQ ID NO: 199727 - DNA, 103 bp, Artificial Sequence
  Synthetic Polynucleotide
taatacgactcactatagggtcgtgcagtggcgcgccgaggtcgctgcggaacagaggagaccgcagatgcctcggcgcaacctggcggcagcgcaaaagatg

SEQ ID NO: 199728 - DNA, 103 bp, Artificial Sequence
  Synthetic Polynucleotide
taatacgactcactatagggttgcactggaagtgcttgaaggccgaatgcaacagaggagagcattcatgcttcaagcaaacctggcggcagcgcaaaagatg

SEQ ID NO: 199729 - DNA, 103 bp, Artificial Sequence
  Synthetic Polynucleotide
taatacgactcactatagggcttgcagcgcttgcactggaagtgcttgaaaacagaggagattcaagatgttccagtgcaacctggcggcagcgcaaaagatg

SEQ ID NO: 199730 - DNA, 103 bp, Artificial Sequence
  Synthetic Polynucleotide
taatacgactcactatagggcgaagctcttcttgcagcgcttgcactggaaacagaggagatccagtatgagcgctgcaaacctggcggcagcgcaaaagatg

SEQ ID NO: 199731 - DNA, 103 bp, Artificial Sequence
  Synthetic Polynucleotide
taatacgactcactataggggacttgagcgcgaagctcttcttgcagcgcaacagaggagagcgctgatggaagagcttaacctggcggcagcgcaaaagatg

SEQ ID NO: 199732 - DNA, 103 bp, Artificial Sequence
  Synthetic Polynucleotide
taatacgactcactataggggttgagataggacttgagcgcgaagctcttaacagaggagaaagagcatggcgctcaagaacctggcggcagcgcaaaagatg

SEQ ID NO: 199733 - DNA, 103 bp, Artificial Sequence
  Synthetic Polynucleotide
taatacgactcactatagggcgtagtgcttgttgagataggacttgagcgaacagaggagacgctcaatgcctatctcaaacctggcggcagcgcaaaagatg

SEQ ID NO: 199734 - DNA, 103 bp, Artificial Sequence
  Synthetic Polynucleotide
taatacgactcactatagggcaggccgactcgtagtgcttgttgagatagaacagaggagactatctatgcaagcactaaacctggcggcagcgcaaaagatg

SEQ ID NO: 199735 - DNA, 103 bp, Artificial Sequence
  Synthetic Polynucleotide
taatacgactcactataggggcccttgaagcaggccgactcgtagtgcttaacagaggagaaagcacatggagtcggccaacctggcggcagcgcaaaagatg

SEQ ID NO: 199736 - DNA, 103 bp, Artificial Sequence
  Synthetic Polynucleotide
taatacgactcactatagggctccggcgccgcccttgaagcaggccgactaacagaggagaagtcggatggcttcaaggaacctggcggcagcgcaaaagatg

SEQ ID NO: 199737 - DNA, 103 bp, Artificial Sequence
  Synthetic Polynucleotide
taatacgactcactataggggccgcggggcctccggcgccgcccttgaagaacagaggagacttcaaatgcggcgccggaacctggcggcagcgcaaaagatg

SEQ ID NO: 199738 - DNA, 103 bp, Artificial Sequence
  Synthetic Polynucleotide
taatacgactcactataggggatcttctttaccaggaaggagcgcggcataacagaggagaatgccgatgtccttcctgaacctggcggcagcgcaaaagatg

SEQ ID NO: 199739 - DNA, 103 bp, Artificial Sequence
  Synthetic Polynucleotide
taatacgactcactatagggaggcccccgggcgccaggcagcacgtaggcaacagaggagagcctacatgctgcctggcaacctggcggcagcgcaaaagatg

SEQ ID NO: 199740 - DNA, 103 bp, Artificial Sequence
  Synthetic Polynucleotide
taatacgactcactatagggtgtccccgggaggcccccgggcgccaggcaaacagaggagatgcctgatgcccgggggcaacctggcggcagcgcaaaagatg

SEQ ID NO: 199741 - DNA, 103 bp, Artificial Sequence
  Synthetic Polynucleotide
taatacgactcactataggggcgtacccgttgtccccgggaggcccccggaacagaggagaccggggatgtcccggggaaacctggcggcagcgcaaaagatg

SEQ ID NO: 199742 - DNA, 103 bp, Artificial Sequence
  Synthetic Polynucleotide
taatacgactcactataggggcggtgcggggcgtacccgttgtccccgggaacagaggagacccgggatgaacgggtacaacctggcggcagcgcaaaagatg

SEQ ID NO: 199743 - DNA, 103 bp, Artificial Sequence
  Synthetic Polynucleotide
taatacgactcactatagggtcgggggcaggcggtgcggggcgtacccgtaacagaggagaacgggtatgccccgcaccaacctggcggcagcgcaaaagatg

SEQ ID NO: 199744 - DNA, 103 bp, Artificial Sequence
  Synthetic Polynucleotide
taatacgactcactatagggtcgtagctgctcgggggcaggcggtgcgggaacagaggagacccgcaatgcctgcccccaacctggcggcagcgcaaaagatg

SEQ ID NO: 199745 - DNA, 103 bp, Artificial Sequence
  Synthetic Polynucleotide
taatacgactcactatagggctggtccgcatcgtagctgctcgggggcagaacagaggagactgcccatgagcagctacaacctggcggcagcgcaaaagatg

SEQ ID NO: 199746 - DNA, 103 bp, Artificial Sequence
  Synthetic Polynucleotide
taatacgactcactatagggggcccggcttctggtccgcatcgtagctgcaacagaggagagcagctatgatgcggaccaacctggcggcagcgcaaaagatg

SEQ ID NO: 199747 - DNA, 103 bp, Artificial Sequence
  Synthetic Polynucleotide
taatacgactcactataggggccagctccaggcccggcttctggtccgcaaacagaggagatgcggaatggaagccgggaacctggcggcagcgcaaaagatg

SEQ ID NO: 199748 - DNA, 103 bp, Artificial Sequence
  Synthetic Polynucleotide
taatacgactcactatagggctcggccggggccagctccaggcccggcttaacagaggagaaagccgatgctggagctgaacctggcggcagcgcaaaagatg

SEQ ID NO: 199749 - DNA, 103 bp, Artificial Sequence
  Synthetic Polynucleotide
taatacgactcactatagggcgtcccctttgatcttctttaccaggaaggaacagaggagaccttccatgtaaagaagaaacctggcggcagcgcaaaagatg

SEQ ID NO: 199750 - DNA, 103 bp, Artificial Sequence
  Synthetic Polynucleotide
taatacgactcactatagggggtacgcgggctcggccggggccagctccaaacagaggagatggagcatgccccggccgaacctggcggcagcgcaaaagatg

SEQ ID NO: 199751 - DNA, 103 bp, Artificial Sequence
  Synthetic Polynucleotide
taatacgactcactataggggccgccggcgggtacgcgggctcggccgggaacagaggagacccggcatggcccgcgtaaacctggcggcagcgcaaaagatg

SEQ ID NO: 199752 - DNA, 103 bp, Artificial Sequence
  Synthetic Polynucleotide
taatacgactcactatagggctcctccggcgccgccggcgggtacgcgggaacagaggagacccgcgatgccgccggcgaacctggcggcagcgcaaaagatg

SEQ ID NO: 199753 - DNA, 103 bp, Artificial Sequence
  Synthetic Polynucleotide
taatacgactcactatagggggtcgctgtactcctccggcgccgccggcgaacagaggagacgccggatgcgccggaggaacctggcggcagcgcaaaagatg

SEQ ID NO: 199754 - DNA, 103 bp, Artificial Sequence
  Synthetic Polynucleotide
taatacgactcactataggggggctttcggggtcgctgtactcctccggcaacagaggagagccggaatggtacagcgaaacctggcggcagcgcaaaagatg

SEQ ID NO: 199755 - DNA, 103 bp, Artificial Sequence
  Synthetic Polynucleotide
taatacgactcactataggggctcgactgcgggctttcggggtcgctgtaaacagaggagatacagcatgcccgaaagcaacctggcggcagcgcaaaagatg

SEQ ID NO: 199756 - DNA, 103 bp, Artificial Sequence
  Synthetic Polynucleotide
taatacgactcactataggggcgccgacaggctcgactgcgggctttcggaacagaggagaccgaaaatgcgcagtcgaaacctggcggcagcgcaaaagatg

SEQ ID NO: 199757 - DNA, 103 bp, Artificial Sequence
  Synthetic Polynucleotide
taatacgactcactatagggcggaagtagcgcgccgacaggctcgactgcaacagaggagagcagtcatgcctgtcggcaacctggcggcagcgcaaaagatg

SEQ ID NO: 199758 - DNA, 103 bp, Artificial Sequence
  Synthetic Polynucleotide
taatacgactcactatagggcgcctcccctcggaagtagcgcgccgacagaacagaggagactgtcgatgcgctacttcaacctggcggcagcgcaaaagatg

SEQ ID NO: 199759 - DNA, 103 bp, Artificial Sequence
  Synthetic Polynucleotide
taatacgactcactatagggcggtcactgccgcctcccctcggaagtagcaacagaggagagctactatggaggggaggaacctggcggcagcgcaaaagatg

SEQ ID NO: 199760 - DNA, 103 bp, Artificial Sequence
  Synthetic Polynucleotide
taatacgactcactatagggcactggaagccgtcccctttgatcttctttaacagaggagaaaagaaatgcaaaggggaaacctggcggcagcgcaaaagatg

SEQ ID NO: 199761 - DNA, 103 bp, Artificial Sequence
  Synthetic Polynucleotide
taatacgactcactataggggagtagctgtcggtcactgccgcctcccctaacagaggagaaggggaatgggcagtgacaacctggcggcagcgcaaaagatg

SEQ ID NO: 199762 - DNA, 103 bp, Artificial Sequence
  Synthetic Polynucleotide
taatacgactcactatagggggcgtccatggagtagctgtcggtcactgcaacagaggagagcagtgatggacagctacaacctggcggcagcgcaaaagatg

SEQ ID NO: 199763 - DNA, 103 bp, Artificial Sequence
  Synthetic Polynucleotide
taatacgactcactatagggagatgaagaaggcgtccatggagtagctgtaacagaggagaacagctatgccatggacgaacctggcggcagcgcaaaagatg

SEQ ID NO: 199764 - DNA, 103 bp, Artificial Sequence
  Synthetic Polynucleotide
taatacgactcactatagggcgcccgtccgagatgaagaaggcgtccatgaacagaggagacatggaatgcttcttcataacctggcggcagcgcaaaagatg

SEQ ID NO: 199765 - DNA, 103 bp, Artificial Sequence
  Synthetic Polynucleotide
taatacgactcactatagggccgccgcgagcgcccgtccgagatgaagaaaacagaggagattcttcatgtcggacgggaacctggcggcagcgcaaaagatg

SEQ ID NO: 199766 - DNA, 103 bp, Artificial Sequence
  Synthetic Polynucleotide
taatacgactcactatagggcgccccgccgccgccgcgagcgcccgtccgaacagaggagacggacgatggctcgcggcaacctggcggcagcgcaaaagatg

SEQ ID NO: 199767 - DNA, 103 bp, Artificial Sequence
  Synthetic Polynucleotide
taatacgactcactatagggccgccgcccccgccccgccgccgccgcgagaacagaggagactcgcgatggcggcggggaacctggcggcagcgcaaaagatg

SEQ ID NO: 199768 - DNA, 103 bp, Artificial Sequence
  Synthetic Polynucleotide
taatacgactcactatagggccccgcgtccccgccgcccccgccccgccgaacagaggagacggcggatggggggcggcaacctggcggcagcgcaaaagatg

SEQ ID NO: 199769 - DNA, 103 bp, Artificial Sequence
  Synthetic Polynucleotide
taatacgactcactatagggctcccgagccccccgcgtccccgccgccccaacagaggagaggggcgatggggacgcggaacctggcggcagcgcaaaagatg

SEQ ID NO: 199770 - DNA, 103 bp, Artificial Sequence
  Synthetic Polynucleotide
taatacgactcactatagggccccccgcgtctcccgagccccccgcgtccaacagaggagaggacgcatggggctcgggaacctggcggcagcgcaaaagatg

SEQ ID NO: 199771 - DNA, 103 bp, Artificial Sequence
  Synthetic Polynucleotide
taatacgactcactatagggcaccccgctgcactggaagccgtcccctttaacagaggagaaaagggatgggcttccagaacctggcggcagcgcaaaagatg

SEQ ID NO: 199772 - DNA, 103 bp, Artificial Sequence
  Synthetic Polynucleotide
taatacgactcactatagggccccccggcgccccccgcgtctcccgagccaacagaggagaggctcgatggacgcggggaacctggcggcagcgcaaaagatg

SEQ ID NO: 199773 - DNA, 103 bp, Artificial Sequence
  Synthetic Polynucleotide
taatacgactcactataggggccccgcgcgccccccggcgccccccgcgtaacagaggagaacgcggatggcgccggggaacctggcggcagcgcaaaagatg

SEQ ID NO: 199774 - DNA, 103 bp, Artificial Sequence
  Synthetic Polynucleotide
taatacgactcactataggggcccccgcgcgccccgcgcgccccccggcgaacagaggagacgccggatggcgcgcgggaacctggcggcagcgcaaaagatg

SEQ ID NO: 199775 - DNA, 103 bp, Artificial Sequence
  Synthetic Polynucleotide
taatacgactcactataggggcccgcctgcgcccccgcgcgccccgcgcgaacagaggagacgcgcgatgcgcgcggggaacctggcggcagcgcaaaagatg

SEQ ID NO: 199776 - DNA, 103 bp, Artificial Sequence
  Synthetic Polynucleotide
taatacgactcactatagggggtgcccgccgcccgcctgcgcccccgcgcaacagaggagagcgcggatgcgcaggcggaacctggcggcagcgcaaaagatg

SEQ ID NO: 199777 - DNA, 103 bp, Artificial Sequence
  Synthetic Polynucleotide
taatacgactcactatagggcacgcgtgccggtgcccgccgcccgcctgcaacagaggagagcaggcatgcggcgggcaaacctggcggcagcgcaaaagatg

SEQ ID NO: 199778 - DNA, 103 bp, Artificial Sequence
  Synthetic Polynucleotide
taatacgactcactataggggcactcggcgcacgcgtgccggtgcccgccaacagaggagaggcgggatgcggcacgcgaacctggcggcagcgcaaaagatg

SEQ ID NO: 199779 - DNA, 103 bp, Artificial Sequence
  Synthetic Polynucleotide
taatacgactcactatagggaggtcttgccgcactcggcgcacgcgtgccaacagaggagaggcacgatggcgccgagtaacctggcggcagcgcaaaagatg

SEQ ID NO: 199780 - DNA, 103 bp, Artificial Sequence
  Synthetic Polynucleotide
taatacgactcactataggggacgtggcgtaggtcttgccgcactcggcgaacagaggagacgccgaatgcggcaagacaacctggcggcagcgcaaaagatg

SEQ ID NO: 199781 - DNA, 103 bp, Artificial Sequence
  Synthetic Polynucleotide
taatacgactcactatagggcaggttcgacgacgtggcgtaggtcttgccaacagaggagaggcaagatgtacgccacgaacctggcggcagcgcaaaagatg

SEQ ID NO: 199782 - DNA, 103 bp, Artificial Sequence
  Synthetic Polynucleotide
taatacgactcactatagggtgggggccggcaccccgctgcactggaagcaacagaggagagcttccatggcagcggggaacctggcggcagcgcaaaagatg

SEQ ID NO: 199783 - DNA, 103 bp, Artificial Sequence
  Synthetic Polynucleotide
taatacgactcactatagggtgtggcggctcaggttcgacgacgtggcgtaacagaggagaacgccaatgcgtcgaaccaacctggcggcagcgcaaaagatg

SEQ ID NO: 199784 - DNA, 103 bp, Artificial Sequence
  Synthetic Polynucleotide
taatacgactcactatagggtgcgtctgcttgtggcggctcaggttcgacaacagaggagagtcgaaatggagccgccaaacctggcggcagcgcaaaagatg

SEQ ID NO: 199785 - DNA, 103 bp, Artificial Sequence
  Synthetic Polynucleotide
taatacgactcactatagggcaggctgcggtgcgtctgcttgtggcggctaacagaggagaagccgcatgaagcagacgaacctggcggcagcgcaaaagatg

SEQ ID NO: 199786 - DNA, 103 bp, Artificial Sequence
  Synthetic Polynucleotide
taatacgactcactataggggctggctgtccaggctgcggtgcgtctgctaacagaggagaagcagaatgaccgcagccaacctggcggcagcgcaaaagatg

SEQ ID NO: 199787 - DNA, 103 bp, Artificial Sequence
  Synthetic Polynucleotide
taatacgactcactatagggttgcgcgccagctggctgtccaggctgcggaacagaggagaccgcagatgggacagccaaacctggcggcagcgcaaaagatg

SEQ ID NO: 199788 - DNA, 103 bp, Artificial Sequence
  Synthetic Polynucleotide
taatacgactcactatagggcgtcgggcatttgcgcgccagctggctgtcaacagaggagagacagcatgctggcgcgcaacctggcggcagcgcaaaagatg

SEQ ID NO: 199789 - DNA, 103 bp, Artificial Sequence
  Synthetic Polynucleotide
taatacgactcactatagggccttgccgcacgtcgggcatttgcgcgccaaacagaggagatggcgcatgaatgcccgaaacctggcggcagcgcaaaagatg

SEQ ID NO: 199790 - DNA, 103 bp, Artificial Sequence
  Synthetic Polynucleotide
taatacgactcactataggggacacgtaggccttgccgcacgtcgggcataacagaggagaatgcccatggtgcggcaaaacctggcggcagcgcaaaagatg

SEQ ID NO: 199791 - DNA, 103 bp, Artificial Sequence
  Synthetic Polynucleotide
taatacgactcactatagggcgcgggcatggacacgtaggccttgccgcaaacagaggagatgcggcatggcctacgtgaacctggcggcagcgcaaaagatg

SEQ ID NO: 199792 - DNA, 103 bp, Artificial Sequence
  Synthetic Polynucleotide
taatacgactcactataggggcatggcgagcgcgggcatggacacgtaggaacagaggagacctacgatgccatgcccgaacctggcggcagcgcaaaagatg

SEQ ID NO: 199793 - DNA, 103 bp, Artificial Sequence
  Synthetic Polynucleotide
taatacgactcactataggggggtggtaggtgggggccggcaccccgctgaacagaggagacagcggatggccggccccaacctggcggcagcgcaaaagatg

SEQ ID NO: 199794 - DNA, 103 bp, Artificial Sequence
  Synthetic Polynucleotide
taatacgactcactataggggtgagcaggtgcatggcgagcgcgggcatgaacagaggagacatgccatggctcgccataacctggcggcagcgcaaaagatg

SEQ ID NO: 199795 - DNA, 103 bp, Artificial Sequence
  Synthetic Polynucleotide
taatacgactcactatagggcaggttgtgcgtgagcaggtgcatggcgagaacagaggagactcgccatgcacctgctcaacctggcggcagcgcaaaagatg

SEQ ID NO: 199796 - DNA, 103 bp, Artificial Sequence
  Synthetic Polynucleotide
taatacgactcactatagggacttgtggcgcaggttgtgcgtgagcaggtaacagaggagaacctgcatgcgcacaaccaacctggcggcagcgcaaaagatg

SEQ ID NO: 199797 - DNA, 103 bp, Artificial Sequence
  Synthetic Polynucleotide
taatacgactcactatagggcagacgccgcacttgtggcgcaggttgtgcaacagaggagagcacaaatggcgccacaaaacctggcggcagcgcaaaagatg

SEQ ID NO: 199798 - DNA, 103 bp, Artificial Sequence
  Synthetic Polynucleotide
taatacgactcactatagggggccttgccgcagacgccgcacttgtggcgaacagaggagacgccacatgtgcggcgtcaacctggcggcagcgcaaaagatg

SEQ ID NO: 199799 - DNA, 103 bp, Artificial Sequence
  Synthetic Polynucleotide
taatacgactcactataggggccgcgagaaggccttgccgcagacgccgcaacagaggagagcggcgatggcggcaaggaacctggcggcagcgcaaaagatg

SEQ ID NO: 199800 - DNA, 103 bp, Artificial Sequence
  Synthetic Polynucleotide
taatacgactcactatagggagcagccagggccgcgagaaggccttgccgaacagaggagacggcaaatgcttctcgcgaacctggcggcagcgcaaaagatg

SEQ ID NO: 199801 - DNA, 103 bp, Artificial Sequence
  Synthetic Polynucleotide
taatacgactcactataggggtgaccctgcagcagccagggccgcgagaaaacagaggagattctcgatgccctggctgaacctggcggcagcgcaaaagatg

SEQ ID NO: 199802 - DNA, 103 bp, Artificial Sequence
  Synthetic Polynucleotide
taatacgactcactataggggcgagcgcatgtgaccctgcagcagccaggaacagaggagacctggcatgtgcagggtcaacctggcggcagcgcaaaagatg

SEQ ID NO: 199803 - DNA, 103 bp, Artificial Sequence
  Synthetic Polynucleotide
taatacgactcactatagggtcgccggtgtgcgagcgcatgtgaccctgcaacagaggagagcagggatgcatgcgctcaacctggcggcagcgcaaaagatg

SEQ ID NO: 199804 - DNA, 103 bp, Artificial Sequence
  Synthetic Polynucleotide
taatacgactcactatagggtgtctccaaggggtggtaggtgggggccggaacagaggagaccggccatgacctaccacaacctggcggcagcgcaaaagatg

SEQ ID NO: 199805 - DNA, 103 bp, Artificial Sequence
  Synthetic Polynucleotide
taatacgactcactataggggaacggcttttcgccggtgtgcgagcgcataacagaggagaatgcgcatgcacaccggcaacctggcggcagcgcaaaagatg

SEQ ID NO: 199806 - DNA, 103 bp, Artificial Sequence
  Synthetic Polynucleotide
taatacgactcactataggggcgcgcagccgaacggcttttcgccggtgtaacagaggagaacaccgatgaaaagccgtaacctggcggcagcgcaaaagatg

SEQ ID NO: 199807 - DNA, 103 bp, Artificial Sequence
  Synthetic Polynucleotide
taatacgactcactatagggttgccgcagtgcgcgcagccgaacggctttaacagaggagaaaagccatgcggctgcgcaacctggcggcagcgcaaaagatg

SEQ ID NO: 199808 - DNA, 103 bp, Artificial Sequence
  Synthetic Polynucleotide
taatacgactcactatagggggcgaaggccttgccgcagtgcgcgcagccaacagaggagaggctgcatgcactgcggcaacctggcggcagcgcaaaagatg

SEQ ID NO: 199809 - DNA, 103 bp, Artificial Sequence
  Synthetic Polynucleotide
taatacgactcactatagggtggagcggtcggcgaaggccttgccgcagtaacagaggagaactgcgatgaggccttcgaacctggcggcagcgcaaaagatg

SEQ ID NO: 199810 - DNA, 103 bp, Artificial Sequence
  Synthetic Polynucleotide
taatacgactcactataggggcgcgcaggttggagcggtcggcgaaggccaacagaggagaggccttatgcgaccgctcaacctggcggcagcgcaaaagatg

SEQ ID NO: 199811 - DNA, 103 bp, Artificial Sequence
  Synthetic Polynucleotide
taatacgactcactatagggctgcatgtgcgcgcgcaggttggagcggtcaacagaggagagaccgcatgaacctgcgcaacctggcggcagcgcaaaagatg

SEQ ID NO: 199812 - DNA, 103 bp, Artificial Sequence
  Synthetic Polynucleotide
taatacgactcactatagggccgagtgcgtctgcatgtgcgcgcgcaggtaacagaggagaacctgcatgcgcacatgcaacctggcggcagcgcaaaagatg

SEQ ID NO: 199813 - DNA, 103 bp, Artificial Sequence
  Synthetic Polynucleotide
taatacgactcactatagggtgcttgaaggccgagtgcgtctgcatgtgcaacagaggagagcacatatggacgcactcaacctggcggcagcgcaaaagatg

SEQ ID NO: 199814 - DNA, 103 bp, Artificial Sequence
  Synthetic Polynucleotide
taatacgactcactataggggcagcggtagtgcttgaaggccgagtgcgtaacagaggagaacgcacatggccttcaagaacctggcggcagcgcaaaagatg

SEQ ID NO: 199815 - DNA, 103 bp, Artificial Sequence
  Synthetic Polynucleotide
taatacgactcactataggggcacgtaggctgtctccaaggggtggtaggaacagaggagacctaccatgccttggagaaacctggcggcagcgcaaaagatg

SEQ ID NO: 199816 - DNA, 103 bp, Artificial Sequence
  Synthetic Polynucleotide
taatacgactcactatagggcgcactggcggcagcggtagtgcttgaaggaacagaggagaccttcaatgactaccgctaacctggcggcagcgcaaaagatg

SEQ ID NO: 199817 - DNA, 103 bp, Artificial Sequence
  Synthetic Polynucleotide
taatacgactcactatagggaagctcttgtcgcactggcggcagcggtagaacagaggagactaccgatgccgccagtgaacctggcggcagcgcaaaagatg

SEQ ID NO: 199818 - DNA, 103 bp, Artificial Sequence
  Synthetic Polynucleotide
taatacgactcactatagggcttgagcgcgaagctcttgtcgcactggcgaacagaggagacgccagatggacaagagcaacctggcggcagcgcaaaagatg

SEQ ID NO: 199819 - DNA, 103 bp, Artificial Sequence
  Synthetic Polynucleotide
taatacgactcactatagggggaggtaggacttgagcgcgaagctcttgtaacagaggagaacaagaatgtcgcgctcaaacctggcggcagcgcaaaagatg

SEQ ID NO: 199820 - DNA, 103 bp, Artificial Sequence
  Synthetic Polynucleotide
taatacgactcactatagggcagtgcttgtggaggtaggacttgagcgcgaacagaggagacgcgctatggtcctacctaacctggcggcagcgcaaaagatg

SEQ ID NO: 199821 - DNA, 103 bp, Artificial Sequence
  Synthetic Polynucleotide
taatacgactcactatagggggccgcctcgcagtgcttgtggaggtaggaaacagaggagatcctacatgcacaagcacaacctggcggcagcgcaaaagatg

SEQ ID NO: 199822 - DNA, 103 bp, Artificial Sequence
  Synthetic Polynucleotide
taatacgactcactatagggccttggcgcaggccgcctcgcagtgcttgtaacagaggagaacaagcatggcgaggcggaacctggcggcagcgcaaaagatg

SEQ ID NO: 199823 - DNA, 103 bp, Artificial Sequence
  Synthetic Polynucleotide
taatacgactcactatagggggctcggccgccttggcgcaggccgcctcgaacagaggagacgaggcatgctgcgccaaaacctggcggcagcgcaaaagatg

SEQ ID NO: 199824 - DNA, 103 bp, Artificial Sequence
  Synthetic Polynucleotide
taatacgactcactatagggcggcgggggtggctcggccgccttggcgcaaacagaggagatgcgccatggcggccgagaacctggcggcagcgcaaaagatg

SEQ ID NO: 199825 - DNA, 103 bp, Artificial Sequence
  Synthetic Polynucleotide
taatacgactcactatagggcggcgggggtcggcgggggtggctcggccgaacagaggagacggccgatgcacccccgcaacctggcggcagcgcaaaagatg

SEQ ID NO: 199826 - DNA, 103 bp, Artificial Sequence
  Synthetic Polynucleotide
taatacgactcactataggggcgccaggcagcacgtaggctgtctccaagaacagaggagacttggaatgagcctacgtaacctggcggcagcgcaaaagatg

SEQ ID NO: 199827 - DNA, 103 bp, Artificial Sequence
  Synthetic Polynucleotide
taatacgactcactatagggctggccgggccggcgggggtcggcgggggtaacagaggagaacccccatggacccccgcaacctggcggcagcgcaaaagatg

SEQ ID NO: 199828 - DNA, 103 bp, Artificial Sequence
  Synthetic Polynucleotide
taatacgactcactatagggcggcgccgggcgcagcgtggcgaaggacataacagaggagaatgtccatggccacgctgaacctggcggcagcgcaaaagatg

SEQ ID NO: 199829 - DNA, 103 bp, Artificial Sequence
  Synthetic Polynucleotide
taatacgactcactatagggacagggtttctcgtcggagcccgagctgtcaacagaggagagacagcatgggctccgacaacctggcggcagcgcaaaagatg

SEQ ID NO: 199830 - DNA, 103 bp, Artificial Sequence
  Synthetic Polynucleotide
taatacgactcactatagggcgtgcacgcgacagggtttctcgtcggagcaacagaggagagctccgatgagaaaccctaacctggcggcagcgcaaaagatg

SEQ ID NO: 199831 - DNA, 103 bp, Artificial Sequence
  Synthetic Polynucleotide
taatacgactcactatagggcagcgcgccgcgtgcacgcgacagggtttcaacagaggagagaaaccatgtcgcgtgcaaacctggcggcagcgcaaaagatg

SEQ ID NO: 199832 - DNA, 103 bp, Artificial Sequence
  Synthetic Polynucleotide
taatacgactcactatagggctggaggccgcagcgcgccgcgtgcacgcgaacagaggagacgcgtgatggcggcgcgcaacctggcggcagcgcaaaagatg

SEQ ID NO: 199833 - DNA, 103 bp, Artificial Sequence
  Synthetic Polynucleotide
taatacgactcactataggggccgggcgccctggaggccgcagcgcgccgaacagaggagacggcgcatggcggcctccaacctggcggcagcgcaaaagatg

SEQ ID NO: 199834 - DNA, 103 bp, Artificial Sequence
  Synthetic Polynucleotide
taatacgactcactatagggcccgccctccgccgggcgccctggaggccgaacagaggagacggcctatggggcgcccgaacctggcggcagcgcaaaagatg

SEQ ID NO: 199835 - DNA, 103 bp, Artificial Sequence
  Synthetic Polynucleotide
taatacgactcactatagggccgccggccccccgccctccgccgggcgccaacagaggagaggcgccatgcggagggcgaacctggcggcagcgcaaaagatg

SEQ ID NO: 199836 - DNA, 103 bp, Artificial Sequence
  Synthetic Polynucleotide
taatacgactcactatagggcgcccccggcccgccggccccccgccctccaacagaggagaggagggatgggggccggcaacctggcggcagcgcaaaagatg

SEQ ID NO: 199837 - DNA, 103 bp, Artificial Sequence
  Synthetic Polynucleotide
taatacgactcactatagggcctggccccccgcccccggcccgccggcccaacagaggagagggccgatgggccgggggaacctggcggcagcgcaaaagatg

SEQ ID NO: 199838 - DNA, 103 bp, Artificial Sequence
  Synthetic Polynucleotide
taatacgactcactatagggtggccggccccctggccccccgcccccggcaacagaggagagccgggatgggggggccaaacctggcggcagcgcaaaagatg

SEQ ID NO: 199839 - DNA, 103 bp, Artificial Sequence
  Synthetic Polynucleotide
taatacgactcactatagggagcggcccggcggcgccgggcgcagcgtggaacagaggagaccacgcatggcccggcgcaacctggcggcagcgcaaaagatg

SEQ ID NO: 199840 - DNA, 103 bp, Artificial Sequence
  Synthetic Polynucleotide
taatacgactcactataggggctcacggcctggccggccccctggcccccaacagaggagagggggcatgggggccggcaacctggcggcagcgcaaaagatg

SEQ ID NO: 199841 - DNA, 103 bp, Artificial Sequence
  Synthetic Polynucleotide
taatacgactcactatagggcgctgccggggctcacggcctggccggcccaacagaggagagggccgatgaggccgtgaaacctggcggcagcgcaaaagatg

SEQ ID NO: 199842 - DNA, 103 bp, Artificial Sequence
  Synthetic Polynucleotide
taatacgactcactatagggcgccgtgtgccgctgccggggctcacggccaacagaggagaggccgtatgccccggcagaacctggcggcagcgcaaaagatg

SEQ ID NO: 199843 - DNA, 103 bp, Artificial Sequence
  Synthetic Polynucleotide
taatacgactcactatagggcgcgcgcgttcgccgtgtgccgctgccgggaacagaggagacccggcatgggcacacggaacctggcggcagcgcaaaagatg

SEQ ID NO: 199844 - DNA, 103 bp, Artificial Sequence
  Synthetic Polynucleotide
taatacgactcactatagggcggtctcgctcgcgcgcgttcgccgtgtgcaacagaggagagcacacatggaacgcgcgaacctggcggcagcgcaaaagatg

SEQ ID NO: 199845 - DNA, 103 bp, Artificial Sequence
  Synthetic Polynucleotide
taatacgactcactataggggctgttggtgcggtctcgctcgcgcgcgttaacagaggagaaacgcgatggagcgagacaacctggcggcagcgcaaaagatg

SEQ ID NO: 199846 - DNA, 103 bp, Artificial Sequence
  Synthetic Polynucleotide
taatacgactcactatagggccgtgttcacgctgttggtgcggtctcgctaacagaggagaagcgagatggcaccaacaaacctggcggcagcgcaaaagatg

SEQ ID NO: 199847 - DNA, 103 bp, Artificial Sequence
  Synthetic Polynucleotide
taatacgactcactataggggccgtgaaggccgtgttcacgctgttggtgaacagaggagacaccaaatgcgtgaacacaacctggcggcagcgcaaaagatg

SEQ ID NO: 199848 - DNA, 103 bp, Artificial Sequence
  Synthetic Polynucleotide
taatacgactcactatagggcgtgcgcagcgccgtgaaggccgtgttcacaacagaggagagtgaacatggccttcacgaacctggcggcagcgcaaaagatg

SEQ ID NO: 199849 - DNA, 103 bp, Artificial Sequence
  Synthetic Polynucleotide
taatacgactcactatagggtggggatcagcgtgcgcagcgccgtgaaggaacagaggagaccttcaatgcgctgcgcaaacctggcggcagcgcaaaagatg

SEQ ID NO: 199850 - DNA, 103 bp, Artificial Sequence
  Synthetic Polynucleotide
taatacgactcactataggggggtacaggtagcggcccggcggcgccgggaacagaggagacccggcatggccgggccgaacctggcggcagcgcaaaagatg

SEQ ID NO: 199851 - DNA, 103 bp, Artificial Sequence
  Synthetic Polynucleotide
taatacgactcactataggggcgggctcggtggggatcagcgtgcgcagcaacagaggagagctgcgatggctgatcccaacctggcggcagcgcaaaagatg

SEQ ID NO: 199852 - DNA, 103 bp, Artificial Sequence
  Synthetic Polynucleotide
taatacgactcactatagggcttgcggtcggcgggctcggtggggatcagaacagaggagactgatcatgaccgagcccaacctggcggcagcgcaaaagatg

SEQ ID NO: 199853 - DNA, 103 bp, Artificial Sequence
  Synthetic Polynucleotide
taatacgactcactatagggtcttggagagcttgcggtcggcgggctcggaacagaggagaccgagcatgccgaccgcaaacctggcggcagcgcaaaagatg

SEQ ID NO: 199854 - DNA, 103 bp, Artificial Sequence
  Synthetic Polynucleotide
taatacgactcactatagggagcgtctcaatcttggagagcttgcggtcgaacagaggagacgaccgatggctctccaaaacctggcggcagcgcaaaagatg

SEQ ID NO: 199855 - DNA, 103 bp, Artificial Sequence
  Synthetic Polynucleotide
taatacgactcactatagggggccaggcgcagcgtctcaatcttggagagaacagaggagactctccatgattgagacgaacctggcggcagcgcaaaagatg

SEQ ID NO: 199856 - DNA, 103 bp, Artificial Sequence
  Synthetic Polynucleotide
taatacgactcactatagggtgtagctggaggccaggcgcagcgtctcaaaacagaggagattgagaatgtgcgcctggaacctggcggcagcgcaaaagatg

SEQ ID NO: 199857 - DNA, 103 bp, Artificial Sequence
  Synthetic Polynucleotide
taatacgactcactatagggaggtgcgagatgtagctggaggccaggcgcaacagaggagagcgcctatgctccagctaaacctggcggcagcgcaaaagatg

SEQ ID NO: 199858 - DNA, 103 bp, Artificial Sequence
  Synthetic Polynucleotide
taatacgactcactatagggcacgttgcccaggtgcgagatgtagctggaaacagaggagatccagcatgatctcgcacaacctggcggcagcgcaaaagatg

SEQ ID NO: 199859 - DNA, 103 bp, Artificial Sequence
  Synthetic Polynucleotide
taatacgactcactatagggccgccagcagcacgttgcccaggtgcgagaaacagaggagatctcgcatgtgggcaacgaacctggcggcagcgcaaaagatg

SEQ ID NO: 199860 - DNA, 103 bp, Artificial Sequence
  Synthetic Polynucleotide
taatacgactcactatagggcaggcctcgcccgccagcagcacgttgcccaacagaggagagggcaaatggctgctggcaacctggcggcagcgcaaaagatg

SEQ ID NO: 199861 - DNA, 103 bp, Artificial Sequence
  Synthetic Polynucleotide
taatacgactcactataggggctcacctcggggtacaggtagcggcccggaacagaggagaccgggcatgtacctgtacaacctggcggcagcgcaaaagatg

SEQ ID NO: 199862 - DNA, 103 bp, Artificial Sequence
  Synthetic Polynucleotide
taatacgactcactatagggtccgtcgccgcaggcctcgcccgccagcagaacagaggagactgctgatgggcgaggccaacctggcggcagcgcaaaagatg

SEQ ID NO: 199863 - DNA, 103 bp, Artificial Sequence
  Synthetic Polynucleotide
taatacgactcactatagggggcagggctgtccgtcgccgcaggcctcgcaacagaggagagcgaggatggcggcgacgaacctggcggcagcgcaaaagatg

SEQ ID NO: 199864 - DNA, 103 bp, Artificial Sequence
  Synthetic Polynucleotide
taatacgactcactatagggggcccggagtggcagggctgtccgtcgccgaacagaggagacggcgaatgacagccctgaacctggcggcagcgcaaaagatg

SEQ ID NO: 199865 - DNA, 103 bp, Artificial Sequence
  Synthetic Polynucleotide
taatacgactcactataggggaagaaggcgggcccggagtggcagggctgaacagaggagacagcccatgcactccgggaacctggcggcagcgcaaaagatg

SEQ ID NO: 199866 - DNA, 103 bp, Artificial Sequence
  Synthetic Polynucleotide
taatacgactcactataggggcgccgcgtggaagaaggcgggcccggagtaacagaggagaactccgatgccgccttctaacctggcggcagcgcaaaagatg

SEQ ID NO: 199867 - DNA, 103 bp, Artificial Sequence
  Synthetic Polynucleotide
taatacgactcactatagggctgccggcgcgcgccgcgtggaagaaggcgaacagaggagacgccttatgccacgcggcaacctggcggcagcgcaaaagatg

SEQ ID NO: 199868 - DNA, 103 bp, Artificial Sequence
  Synthetic Polynucleotide
taatacgactcactatagggcggcggggggctgccggcgcgcgccgcgtgaacagaggagacacgcgatgcgcgccggcaacctggcggcagcgcaaaagatg

SEQ ID NO: 199869 - DNA, 103 bp, Artificial Sequence
  Synthetic Polynucleotide
taatacgactcactataggggcgggggcggcggcggggggctgccggcgcaacagaggagagcgccgatggccccccgcaacctggcggcagcgcaaaagatg

SEQ ID NO: 199870 - DNA, 103 bp, Artificial Sequence
  Synthetic Polynucleotide
taatacgactcactataggggcgggaggcggcgggggcggcggcggggggaacagaggagaccccccatggccgcccccaacctggcggcagcgcaaaagatg

SEQ ID NO: 199871 - DNA, 103 bp, Artificial Sequence
  Synthetic Polynucleotide
taatacgactcactataggggccgtcgcgggcgggaggcggcgggggcggaacagaggagaccgcccatgccgcctcccaacctggcggcagcgcaaaagatg

SEQ ID NO: 199872 - DNA, 103 bp, Artificial Sequence
  Synthetic Polynucleotide
taatacgactcactatagggccgacagcgggctcacctcggggtacaggtaacagaggagaacctgtatgccgaggtgaaacctggcggcagcgcaaaagatg

SEQ ID NO: 199873 - DNA, 103 bp, Artificial Sequence
  Synthetic Polynucleotide
taatacgactcactataggggggtgttctcgccgtcgcgggcgggaggcgaacagaggagacgcctcatgcccgcgacgaacctggcggcagcgcaaaagatg

SEQ ID NO: 199874 - DNA, 103 bp, Artificial Sequence
  Synthetic Polynucleotide
taatacgactcactatagggtgtttgggctgggtgttctcgccgtcgcggaacagaggagaccgcgaatgcgagaacacaacctggcggcagcgcaaaagatg

SEQ ID NO: 199875 - DNA, 103 bp, Artificial Sequence
  Synthetic Polynucleotide
taatacgactcactatagggggtgcagatctgtttgggctgggtgttctcaacagaggagagagaacatgcagcccaaaaacctggcggcagcgcaaaagatg

SEQ ID NO: 199876 - DNA, 103 bp, Artificial Sequence
  Synthetic Polynucleotide
taatacgactcactatagggtgaggcagaaggtgcagatctgtttgggctaacagaggagaagcccaatgagatctgcaaacctggcggcagcgcaaaagatg

SEQ ID NO: 199877 - DNA, 103 bp, Artificial Sequence
  Synthetic Polynucleotide
taatacgactcactatagggctctggttgctgaggcagaaggtgcagatcaacagaggagagatctgatgcttctgcctaacctggcggcagcgcaaaagatg

SEQ ID NO: 199878 - DNA, 103 bp, Artificial Sequence
  Synthetic Polynucleotide
taatacgactcactataggggctcaactttctctggttgctgaggcagaaaacagaggagattctgcatgagcaaccagaacctggcggcagcgcaaaagatg

SEQ ID NO: 199879 - DNA, 103 bp, Artificial Sequence
  Synthetic Polynucleotide
taatacgactcactatagggcgcggtccttgctcaactttctctggttgcaacagaggagagcaaccatggaaagttgaaacctggcggcagcgcaaaagatg

SEQ ID NO: 199880 - DNA, 103 bp, Artificial Sequence
  Synthetic Polynucleotide
taatacgactcactataggggtctttctgtcgcggtccttgctcaactttaacagaggagaaaagttatgcaaggaccgaacctggcggcagcgcaaaagatg

SEQ ID NO: 199881 - DNA, 103 bp, Artificial Sequence
  Synthetic Polynucleotide
taatacgactcactataggggcgaatcgctgtctttctgtcgcggtccttaacagaggagaaaggacatggacagaaagaacctggcggcagcgcaaaagatg

SEQ ID NO: 199882 - DNA, 103 bp, Artificial Sequence
  Synthetic Polynucleotide
taatacgactcactatagggtcctcgtcctccgacagcgggctcacctcgaacagaggagacgaggtatgcccgctgtcaacctggcggcagcgcaaaagatg

SEQ ID NO: 199883 - DNA, 103 bp, Artificial Sequence
  Synthetic Polynucleotide
taatacgactcactataggggctgccgcggtcctcgtcctccgacagcggaacagaggagaccgctgatggaggacgagaacctggcggcagcgcaaaagatg

SEQ ID NO: 199884 - DNA, 103 bp, Artificial Sequence
  Synthetic Polynucleotide
taatacgactcactatagggccgagctgtcgctgccgcggtcctcgtcctaacagaggagaaggacgatgaccgcggcaaacctggcggcagcgcaaaagatg

SEQ ID NO: 199885 - DNA, 103 bp, Artificial Sequence
  Synthetic Polynucleotide
taatacgactcactatagggtcgtcggagcccgagctgtcgctgccgcggaacagaggagaccgcggatgcgacagctcaacctggcggcagcgcaaaagatg

SEQ ID NO: 199886 - DNA, 103 bp, Artificial Sequence
  Synthetic Polynucleotide
taatacgactcactatagggacctggcgtacaccaacaacatgtgctcataacagaggagaatgagcatgtgttgttggaacctggcggcagcgcaaaagatg

SEQ ID NO: 199887 - DNA, 103 bp, Artificial Sequence
  Synthetic Polynucleotide
taatacgactcactataggggcagtagcagaggtcttcgtcggctgtttgaacagaggagacaaacaatggacgaagacaacctggcggcagcgcaaaagatg

SEQ ID NO: 199888 - DNA, 103 bp, Artificial Sequence
  Synthetic Polynucleotide
taatacgactcactatagggtaacttggtccttacagagctgttccgtataacagaggagaatacggatgagctctgtaaacctggcggcagcgcaaaagatg

SEQ ID NO: 199889 - DNA, 103 bp, Artificial Sequence
  Synthetic Polynucleotide
taatacgactcactatagggactccggttctaacttggtccttacagagcaacagaggagagctctgatgggaccaagtaacctggcggcagcgcaaaagatg

SEQ ID NO: 199890 - DNA, 103 bp, Artificial Sequence
  Synthetic Polynucleotide
taatacgactcactatagggtccaaataggactccggttctaacttggtcaacagaggagagaccaaatgagaaccggaaacctggcggcagcgcaaaagatg

SEQ ID NO: 199891 - DNA, 103 bp, Artificial Sequence
  Synthetic Polynucleotide
taatacgactcactatagggcaccatatcatccaaataggactccggttcaacagaggagagaaccgatgtcctatttgaacctggcggcagcgcaaaagatg

SEQ ID NO: 199892 - DNA, 103 bp, Artificial Sequence
  Synthetic Polynucleotide
taatacgactcactatagggggctgcaagtcaccatatcatccaaataggaacagaggagacctattatgatgatatggaacctggcggcagcgcaaaagatg

SEQ ID NO: 199893 - DNA, 103 bp, Artificial Sequence
  Synthetic Polynucleotide
taatacgactcactatagggtatacgatctggctgcaagtcaccatatcaaacagaggagatgatatatggacttgcagaacctggcggcagcgcaaaagatg

SEQ ID NO: 199894 - DNA, 103 bp, Artificial Sequence
  Synthetic Polynucleotide
taatacgactcactatagggattataattgtatacgatctggctgcaagtaacagaggagaacttgcatgcagatcgtaaacctggcggcagcgcaaaagatg

SEQ ID NO: 199895 - DNA, 103 bp, Artificial Sequence
  Synthetic Polynucleotide
taatacgactcactatagggtcttttcaggattataattgtatacgatctaacagaggagaagatcgatgacaattataaacctggcggcagcgcaaaagatg

SEQ ID NO: 199896 - DNA, 103 bp, Artificial Sequence
  Synthetic Polynucleotide
taatacgactcactatagggtcctttttggtcttttcaggattataattgaacagaggagacaattaatgtcctgaaaaaacctggcggcagcgcaaaagatg

SEQ ID NO: 199897 - DNA, 103 bp, Artificial Sequence
  Synthetic Polynucleotide
taatacgactcactatagggccatccagaatcctttttggtcttttcaggaacagaggagacctgaaatgaccaaaaagaacctggcggcagcgcaaaagatg

SEQ ID NO: 199898 - DNA, 103 bp, Artificial Sequence
  Synthetic Polynucleotide
taatacgactcactatagggcacactccaagcagtagcagaggtcttcgtaacagaggagaacgaagatgtctgctactaacctggcggcagcgcaaaagatg

SEQ ID NO: 199899 - DNA, 103 bp, Artificial Sequence
  Synthetic Polynucleotide
taatacgactcactatagggtggctgttctccatccagaatcctttttggaacagaggagaccaaaaatgattctggataacctggcggcagcgcaaaagatg

SEQ ID NO: 199900 - DNA, 103 bp, Artificial Sequence
  Synthetic Polynucleotide
taatacgactcactatagggtctgggcaaatggctgttctccatccagaaaacagaggagattctggatggagaacagcaacctggcggcagcgcaaaagatg

SEQ ID NO: 199901 - DNA, 103 bp, Artificial Sequence
  Synthetic Polynucleotide
taatacgactcactatagggaggacaataatctgggcaaatggctgttctaacagaggagaagaacaatgatttgcccaaacctggcggcagcgcaaaagatg

SEQ ID NO: 199902 - DNA, 103 bp, Artificial Sequence
  Synthetic Polynucleotide
taatacgactcactatagggcatacatgttaggacaataatctgggcaaaaacagaggagatttgccatgattattgtcaacctggcggcagcgcaaaagatg

SEQ ID NO: 199903 - DNA, 103 bp, Artificial Sequence
  Synthetic Polynucleotide
taatacgactcactatagggtccatttcttcatacatgttaggacaataaaacagaggagattattgatgtaacatgtaaacctggcggcagcgcaaaagatg

SEQ ID NO: 199904 - DNA, 103 bp, Artificial Sequence
  Synthetic Polynucleotide
taatacgactcactatagggggctaatgtttccatttcttcatacatgttaacagaggagaaacatgatggaagaaatgaacctggcggcagcgcaaaagatg

SEQ ID NO: 199905 - DNA, 103 bp, Artificial Sequence
  Synthetic Polynucleotide
taatacgactcactataggggaagtacactggctaatgtttccatttcttaacagaggagaaagaaaatgaaacattagaacctggcggcagcgcaaaagatg

SEQ ID NO: 199906 - DNA, 103 bp, Artificial Sequence
  Synthetic Polynucleotide
taatacgactcactatagggatatctgactgaagtacactggctaatgttaacagaggagaaacattatgcagtgtactaacctggcggcagcgcaaaagatg

SEQ ID NO: 199907 - DNA, 103 bp, Artificial Sequence
  Synthetic Polynucleotide
taatacgactcactataggggtcttgaccaatatctgactgaagtacactaacagaggagaagtgtaatgcagtcagataacctggcggcagcgcaaaagatg

SEQ ID NO: 199908 - DNA, 103 bp, Artificial Sequence
  Synthetic Polynucleotide
taatacgactcactataggggaacacgcatgtcttgaccaatatctgactaacagaggagaagtcagatgttggtcaagaacctggcggcagcgcaaaagatg

SEQ ID NO: 199909 - DNA, 103 bp, Artificial Sequence
  Synthetic Polynucleotide
taatacgactcactatagggtactcagccacacactccaagcagtagcagaacagaggagactgctaatgcttggagtgaacctggcggcagcgcaaaagatg

SEQ ID NO: 199910 - DNA, 103 bp, Artificial Sequence
  Synthetic Polynucleotide
taatacgactcactataggggtgctgttatgaacacgcatgtcttgaccaaacagaggagatggtcaatgcatgcgtgtaacctggcggcagcgcaaaagatg

SEQ ID NO: 199911 - DNA, 103 bp, Artificial Sequence
  Synthetic Polynucleotide
taatacgactcactatagggccatagaaatgtgctgttatgaacacgcataacagaggagaatgcgtatgcataacagcaacctggcggcagcgcaaaagatg

SEQ ID NO: 199912 - DNA, 103 bp, Artificial Sequence
  Synthetic Polynucleotide
taatacgactcactatagggaagggatgaaccatagaaatgtgctgttataacagaggagaataacaatgcatttctataacctggcggcagcgcaaaagatg

SEQ ID NO: 199913 - DNA, 103 bp, Artificial Sequence
  Synthetic Polynucleotide
taatacgactcactataggggactggacaaaagggatgaaccatagaaataacagaggagaatttctatggttcatcccaacctggcggcagcgcaaaagatg

SEQ ID NO: 199914 - DNA, 103 bp, Artificial Sequence
  Synthetic Polynucleotide
taatacgactcactatagggatccatgagggactggacaaaagggatgaaaacagaggagattcatcatgtttgtccagaacctggcggcagcgcaaaagatg

SEQ ID NO: 199915 - DNA, 103 bp, Artificial Sequence
  Synthetic Polynucleotide
taatacgactcactatagggaatccttaagatccatgagggactggacaaaacagaggagattgtccatgccctcatggaacctggcggcagcgcaaaagatg

SEQ ID NO: 199916 - DNA, 103 bp, Artificial Sequence
  Synthetic Polynucleotide
taatacgactcactataggggccacacccaaatccttaagatccatgaggaacagaggagacctcatatgtcttaaggaaacctggcggcagcgcaaaagatg

SEQ ID NO: 199917 - DNA, 103 bp, Artificial Sequence
  Synthetic Polynucleotide
taatacgactcactatagggtgctatgtaagccacacccaaatccttaagaacagaggagacttaagatgttgggtgtgaacctggcggcagcgcaaaagatg

SEQ ID NO: 199918 - DNA, 103 bp, Artificial Sequence
  Synthetic Polynucleotide
taatacgactcactatagggtaacaacctgtgctatgtaagccacacccaaacagaggagatgggtgatgcttacatagaacctggcggcagcgcaaaagatg

SEQ ID NO: 199919 - DNA, 103 bp, Artificial Sequence
  Synthetic Polynucleotide
taatacgactcactatagggtacagatgattaacaacctgtgctatgtaaaacagaggagattacatatgacaggttgtaacctggcggcagcgcaaaagatg

SEQ ID NO: 199920 - DNA, 103 bp, Artificial Sequence
  Synthetic Polynucleotide
taatacgactcactatagggtgctttgtggtactcagccacacactccaaaacagaggagattggagatggtggctgagaacctggcggcagcgcaaaagatg

SEQ ID NO: 199921 - DNA, 103 bp, Artificial Sequence
  Synthetic Polynucleotide
taatacgactcactataggggacttcagagtacagatgattaacaacctgaacagaggagacaggttatgaatcatctgaacctggcggcagcgcaaaagatg

SEQ ID NO: 199922 - DNA, 103 bp, Artificial Sequence
  Synthetic Polynucleotide
taatacgactcactatagggggacttctttgacttcagagtacagatgataacagaggagaatcatcatgactctgaagaacctggcggcagcgcaaaagatg

SEQ ID NO: 199923 - DNA, 103 bp, Artificial Sequence
  Synthetic Polynucleotide
taatacgactcactataggggtttggttgaggacttctttgacttcagagaacagaggagactctgaatgcaaagaagtaacctggcggcagcgcaaaagatg

SEQ ID NO: 199924 - DNA, 103 bp, Artificial Sequence
  Synthetic Polynucleotide
taatacgactcactatagggcacagcatctgtttggttgaggacttctttaacagaggagaaaagaaatgctcaaccaaaacctggcggcagcgcaaaagatg

SEQ ID NO: 199925 - DNA, 103 bp, Artificial Sequence
  Synthetic Polynucleotide
taatacgactcactatagggctttgtcacacacagcatctgtttggttgaaacagaggagatcaaccatgcagatgctgaacctggcggcagcgcaaaagatg

SEQ ID NO: 199926 - DNA, 103 bp, Artificial Sequence
  Synthetic Polynucleotide
taatacgactcactatagggaattcagtgactttgtcacacacagcatctaacagaggagaagatgcatggtgtgacaaaacctggcggcagcgcaaaagatg

SEQ ID NO: 199927 - DNA, 103 bp, Artificial Sequence
  Synthetic Polynucleotide
taatacgactcactatagggtagaagaaaaaattcagtgactttgtcacaaacagaggagatgtgacatggtcactgaaaacctggcggcagcgcaaaagatg

SEQ ID NO: 199928 - DNA, 103 bp, Artificial Sequence
  Synthetic Polynucleotide
taatacgactcactatagggataccaaaattagaagaaaaaattcagtgaaacagaggagatcactgatgtttttcttcaacctggcggcagcgcaaaagatg

SEQ ID NO: 199929 - DNA, 103 bp, Artificial Sequence
  Synthetic Polynucleotide
taatacgactcactatagggtcaatcactgataccaaaattagaagaaaaaacagaggagattttctatgaattttggtaacctggcggcagcgcaaaagatg

SEQ ID NO: 199930 - DNA, 103 bp, Artificial Sequence
  Synthetic Polynucleotide
taatacgactcactatagggtctatgcagttcaatcactgataccaaaataacagaggagaattttgatgtcagtgattaacctggcggcagcgcaaaagatg

SEQ ID NO: 199931 - DNA, 103 bp, Artificial Sequence
  Synthetic Polynucleotide
taatacgactcactatagggattcatctcttgctttgtggtactcagccaaacagaggagatggctgatgaccacaaagaacctggcggcagcgcaaaagatg

SEQ ID NO: 199932 - DNA, 103 bp, Artificial Sequence
  Synthetic Polynucleotide
taatacgactcactatagggattttttatttctatgcagttcaatcactgaacagaggagacagtgaatgaactgcataaacctggcggcagcgcaaaagatg

SEQ ID NO: 199933 - DNA, 103 bp, Artificial Sequence
  Synthetic Polynucleotide
taatacgactcactatagggaaatgcaaacattttttatttctatgcagtaacagaggagaactgcaatgaaataaaaaaacctggcggcagcgcaaaagatg

SEQ ID NO: 199934 - DNA, 103 bp, Artificial Sequence
  Synthetic Polynucleotide
taatacgactcactatagggtacccacagcaaatgcaaacattttttattaacagaggagaaataaaatgtgtttgcataacctggcggcagcgcaaaagatg

SEQ ID NO: 199935 - DNA, 103 bp, Artificial Sequence
  Synthetic Polynucleotide
taatacgactcactataggggctgggaacttacccacagcaaatgcaaacaacagaggagagtttgcatgtgctgtgggaacctggcggcagcgcaaaagatg

SEQ ID NO: 199936 - DNA, 103 bp, Artificial Sequence
  Synthetic Polynucleotide
taatacgactcactatagggtccacccattgctgggaacttacccacagcaacagaggagagctgtgatgaagttcccaaacctggcggcagcgcaaaagatg

SEQ ID NO: 199937 - DNA, 103 bp, Artificial Sequence
  Synthetic Polynucleotide
taatacgactcactataggggacgacggcttccacccattgctgggaactaacagaggagaagttccatgcaatgggtgaacctggcggcagcgcaaaagatg

SEQ ID NO: 199938 - DNA, 103 bp, Artificial Sequence
  Synthetic Polynucleotide
taatacgactcactatagggtggcacatttgacgacggcttccacccattaacagaggagaaatgggatgaagccgtcgaacctggcggcagcgcaaaagatg

SEQ ID NO: 199939 - DNA, 103 bp, Artificial Sequence
  Synthetic Polynucleotide
taatacgactcactataggggtaggaagcttggcacatttgacgacggctaacagaggagaagccgtatgcaaatgtgcaacctggcggcagcgcaaaagatg

SEQ ID NO: 199940 - DNA, 103 bp, Artificial Sequence
  Synthetic Polynucleotide
taatacgactcactatagggaaacgcagtggtaggaagcttggcacatttaacagaggagaaaatgtatgaagcttcctaacctggcggcagcgcaaaagatg

SEQ ID NO: 199941 - DNA, 103 bp, Artificial Sequence
  Synthetic Polynucleotide
taatacgactcactatagggaactccgtgtaaacgcagtggtaggaagctaacagaggagaagcttcatgccactgcgtaacctggcggcagcgcaaaagatg

SEQ ID NO: 199942 - DNA, 103 bp, Artificial Sequence
  Synthetic Polynucleotide
taatacgactcactatagggaagaatggcaattcatctcttgctttgtggaacagaggagaccacaaatgaagagatgaaacctggcggcagcgcaaaagatg

SEQ ID NO: 199943 - DNA, 103 bp, Artificial Sequence
  Synthetic Polynucleotide
taatacgactcactataggggatttctcagaactccgtgtaaacgcagtgaacagaggagacactgcatgtacacggagaacctggcggcagcgcaaaagatg

SEQ ID NO: 199944 - DNA, 103 bp, Artificial Sequence
  Synthetic Polynucleotide
taatacgactcactatagggatttccagatgatttctcagaactccgtgtaacagaggagaacacggatgtctgagaaaaacctggcggcagcgcaaaagatg

SEQ ID NO: 199945 - DNA, 103 bp, Artificial Sequence
  Synthetic Polynucleotide
taatacgactcactatagggctttggagcaatttccagatgatttctcagaacagaggagactgagaatgcatctggaaaacctggcggcagcgcaaaagatg

SEQ ID NO: 199946 - DNA, 103 bp, Artificial Sequence
  Synthetic Polynucleotide
taatacgactcactatagggattgctgttcctttggagcaatttccagataacagaggagaatctggatgttgctccaaaacctggcggcagcgcaaaagatg

SEQ ID NO: 199947 - DNA, 103 bp, Artificial Sequence
  Synthetic Polynucleotide
taatacgactcactatagggtgaagatatcattgctgttcctttggagcaaacagaggagatgctccatgggaacagcaaacctggcggcagcgcaaaagatg

SEQ ID NO: 199948 - DNA, 103 bp, Artificial Sequence
  Synthetic Polynucleotide
taatacgactcactataggggcaatgacagtgaagatatcattgctgttcaacagaggagagaacagatgtgatatcttaacctggcggcagcgcaaaagatg

SEQ ID NO: 199949 - DNA, 103 bp, Artificial Sequence
  Synthetic Polynucleotide
taatacgactcactatagggggcatggaatgcaatgacagtgaagatatcaacagaggagagatatcatgactgtcattaacctggcggcagcgcaaaagatg

SEQ ID NO: 199950 - DNA, 103 bp, Artificial Sequence
  Synthetic Polynucleotide
taatacgactcactatagggagagttagatggcatggaatgcaatgacagaacagaggagactgtcaatgcattccatgaacctggcggcagcgcaaaagatg

SEQ ID NO: 199951 - DNA, 103 bp, Artificial Sequence
  Synthetic Polynucleotide
taatacgactcactatagggcaagttgtacagagttagatggcatggaataacagaggagaattccaatgcatctaactaacctggcggcagcgcaaaagatg

SEQ ID NO: 199952 - DNA, 103 bp, Artificial Sequence
  Synthetic Polynucleotide
taatacgactcactatagggtgcacataagcaagttgtacagagttagataacagaggagaatctaaatgtgtacaactaacctggcggcagcgcaaaagatg

SEQ ID NO: 199953 - DNA, 103 bp, Artificial Sequence
  Synthetic Polynucleotide
taatacgactcactatagggaacctcatgcaagaatggcaattcatctctaacagaggagaagagatatgttgccattcaacctggcggcagcgcaaaagatg

SEQ ID NO: 199954 - DNA, 103 bp, Artificial Sequence
  Synthetic Polynucleotide
taatacgactcactatagggtctaatcagctgcacataagcaagttgtacaacagaggagagtacaaatggcttatgtgaacctggcggcagcgcaaaagatg

SEQ ID NO: 199955 - DNA, 103 bp, Artificial Sequence
  Synthetic Polynucleotide
taatacgactcactatagggtaaggagacttctaatcagctgcacataagaacagaggagacttatgatgagctgattaaacctggcggcagcgcaaaagatg

SEQ ID NO: 199956 - DNA, 103 bp, Artificial Sequence
  Synthetic Polynucleotide
taatacgactcactatagggtaaccttctttaaggagacttctaatcagcaacagaggagagctgatatgaagtctcctaacctggcggcagcgcaaaagatg

SEQ ID NO: 199957 - DNA, 103 bp, Artificial Sequence
  Synthetic Polynucleotide
taatacgactcactatagggcccaagctgataaccttctttaaggagactaacagaggagaagtctcatgaaagaaggtaacctggcggcagcgcaaaagatg

SEQ ID NO: 199958 - DNA, 103 bp, Artificial Sequence
  Synthetic Polynucleotide
taatacgactcactataggggagactgctgcccaagctgataaccttcttaacagaggagaaagaagatgatcagcttgaacctggcggcagcgcaaaagatg

SEQ ID NO: 199959 - DNA, 103 bp, Artificial Sequence
  Synthetic Polynucleotide
taatacgactcactatagggcgcttgcaaagagactgctgcccaagctgaaacagaggagatcagctatggcagcagtcaacctggcggcagcgcaaaagatg

SEQ ID NO: 199960 - DNA, 103 bp, Artificial Sequence
  Synthetic Polynucleotide
taatacgactcactatagggatcccagaatcgcttgcaaagagactgctgaacagaggagacagcagatgctttgcaagaacctggcggcagcgcaaaagatg

SEQ ID NO: 199961 - DNA, 103 bp, Artificial Sequence
  Synthetic Polynucleotide
taatacgactcactatagggagttgagcttatcccagaatcgcttgcaaaaacagaggagatttgcaatggattctgggaacctggcggcagcgcaaaagatg

SEQ ID NO: 199962 - DNA, 103 bp, Artificial Sequence
  Synthetic Polynucleotide
taatacgactcactatagggctaaggaataagttgagcttatcccagaataacagaggagaattctgatgtaagctcaaaacctggcggcagcgcaaaagatg

SEQ ID NO: 199963 - DNA, 103 bp, Artificial Sequence
  Synthetic Polynucleotide
taatacgactcactatagggtaaatttcctctaaggaataagttgagcttaacagaggagaaagctcatgttattccttaacctggcggcagcgcaaaagatg

SEQ ID NO: 199964 - DNA, 103 bp, Artificial Sequence
  Synthetic Polynucleotide
taatacgactcactatagggattcccataaaacctcatgcaagaatggcaaacagaggagatgccatatgtgcatgaggaacctggcggcagcgcaaaagatg

SEQ ID NO: 199965 - DNA, 103 bp, Artificial Sequence
  Synthetic Polynucleotide
taatacgactcactatagggaacctagagataaatttcctctaaggaataaacagaggagatattccatggaggaaattaacctggcggcagcgcaaaagatg

SEQ ID NO: 199966 - DNA, 103 bp, Artificial Sequence
  Synthetic Polynucleotide
taatacgactcactataggggtcaactgccaacctagagataaatttcctaacagaggagaaggaaaatgatctctaggaacctggcggcagcgcaaaagatg

SEQ ID NO: 199967 - DNA, 103 bp, Artificial Sequence
  Synthetic Polynucleotide
taatacgactcactatagggttcctgactagtcaactgccaacctagagaaacagaggagatctctaatgtggcagttgaacctggcggcagcgcaaaagatg

SEQ ID NO: 199968 - DNA, 103 bp, Artificial Sequence
  Synthetic Polynucleotide
taatacgactcactataggggctcatgggtttcctgactagtcaactgccaacagaggagaggcagtatgctagtcaggaacctggcggcagcgcaaaagatg

SEQ ID NO: 199969 - DNA, 103 bp, Artificial Sequence
  Synthetic Polynucleotide
taatacgactcactatagggcaactttgtagctcatgggtttcctgactaaacagaggagatagtcaatgaacccatgaaacctggcggcagcgcaaaagatg

SEQ ID NO: 199970 - DNA, 103 bp, Artificial Sequence
  Synthetic Polynucleotide
taatacgactcactatagggttgctttaagcaactttgtagctcatgggtaacagaggagaacccatatgctacaaagtaacctggcggcagcgcaaaagatg

SEQ ID NO: 199971 - DNA, 103 bp, Artificial Sequence
  Synthetic Polynucleotide
taatacgactcactatagggttctaataatttgctttaagcaactttgtaaacagaggagatacaaaatggcttaaagcaacctggcggcagcgcaaaagatg

SEQ ID NO: 199972 - DNA, 103 bp, Artificial Sequence
  Synthetic Polynucleotide
taatacgactcactatagggaattttatgtttctaataatttgctttaagaacagaggagacttaaaatgaattattagaacctggcggcagcgcaaaagatg

SEQ ID NO: 199973 - DNA, 103 bp, Artificial Sequence
  Synthetic Polynucleotide
taatacgactcactatagggaggtgctttgaattttatgtttctaataataacagaggagaattattatgaacataaaaaacctggcggcagcgcaaaagatg

SEQ ID NO: 199974 - DNA, 103 bp, Artificial Sequence
  Synthetic Polynucleotide
taatacgactcactatagggtgttacatggaggtgctttgaattttatgtaacagaggagaacataaatgtcaaagcacaacctggcggcagcgcaaaagatg

SEQ ID NO: 199975 - DNA, 103 bp, Artificial Sequence
  Synthetic Polynucleotide
taatacgactcactatagggaaggtttctaattcccataaaacctcatgcaacagaggagagcatgaatgtttatgggaaacctggcggcagcgcaaaagatg

SEQ ID NO: 199976 - DNA, 103 bp, Artificial Sequence
  Synthetic Polynucleotide
taatacgactcactatagggtccacaaaagtgttacatggaggtgctttgaacagaggagacaaagcatgtccatgtaaaacctggcggcagcgcaaaagatg

SEQ ID NO: 199977 - DNA, 103 bp, Artificial Sequence
  Synthetic Polynucleotide
taatacgactcactatagggagaagtcagatccacaaaagtgttacatggaacagaggagaccatgtatgacttttgtgaacctggcggcagcgcaaaagatg

SEQ ID NO: 199978 - DNA, 103 bp, Artificial Sequence
  Synthetic Polynucleotide
taatacgactcactatagggttttacatgcagaagtcagatccacaaaagaacagaggagacttttgatgatctgacttaacctggcggcagcgcaaaagatg

SEQ ID NO: 199979 - DNA, 103 bp, Artificial Sequence
  Synthetic Polynucleotide
taatacgactcactataggggcaggagagattttacatgcagaagtcagaaacagaggagatctgacatgtgcatgtaaaacctggcggcagcgcaaaagatg

SEQ ID NO: 199980 - DNA, 103 bp, Artificial Sequence
  Synthetic Polynucleotide
taatacgactcactatagggattataagatgcaggagagattttacatgcaacagaggagagcatgtatgatctctcctaacctggcggcagcgcaaaagatg

SEQ ID NO: 199981 - DNA, 103 bp, Artificial Sequence
  Synthetic Polynucleotide
taatacgactcactatagggtttcttctttattataagatgcaggagagaaacagaggagatctctcatgcatcttataaacctggcggcagcgcaaaagatg

SEQ ID NO: 199982 - DNA, 103 bp, Artificial Sequence
  Synthetic Polynucleotide
taatacgactcactatagggatttgttcactttcttctttattataagataacagaggagaatcttaatgtaaagaagaaacctggcggcagcgcaaaagatg

SEQ ID NO: 199983 - DNA, 103 bp, Artificial Sequence
  Synthetic Polynucleotide
taatacgactcactatagggcgtcttccccatttgttcactttcttctttaacagaggagaaaagaaatgagtgaacaaaacctggcggcagcgcaaaagatg

SEQ ID NO: 199984 - DNA, 103 bp, Artificial Sequence
  Synthetic Polynucleotide
taatacgactcactatagggcttttctagacgtcttccccatttgttcacaacagaggagagtgaacatgtggggaagaaacctggcggcagcgcaaaagatg

SEQ ID NO: 199985 - DNA, 103 bp, Artificial Sequence
  Synthetic Polynucleotide
taatacgactcactatagggcaatgcatatcttttctagacgtcttccccaacagaggagaggggaaatggtctagaaaaacctggcggcagcgcaaaagatg

SEQ ID NO: 199986 - DNA, 103 bp, Artificial Sequence
  Synthetic Polynucleotide
taatacgactcactatagggtatgagacgtaaggtttctaattcccataaaacagaggagattatggatgttagaaaccaacctggcggcagcgcaaaagatg

SEQ ID NO: 199987 - DNA, 103 bp, Artificial Sequence
  Synthetic Polynucleotide
taatacgactcactatagggagcttccaaacaatgcatatcttttctagaaacagaggagatctagaatggatatgcataacctggcggcagcgcaaaagatg

SEQ ID NO: 199988 - DNA, 103 bp, Artificial Sequence
  Synthetic Polynucleotide
taatacgactcactatagggttgggctggaagcttccaaacaatgcatataacagaggagaatatgcatggtttggaagaacctggcggcagcgcaaaagatg

SEQ ID NO: 199989 - DNA, 103 bp, Artificial Sequence
  Synthetic Polynucleotide
taatacgactcactatagggttagaaaatgttgggctggaagcttccaaaaacagaggagatttggaatgttccagcccaacctggcggcagcgcaaaagatg

SEQ ID NO: 199990 - DNA, 103 bp, Artificial Sequence
  Synthetic Polynucleotide
taatacgactcactatagggcattggttctttagaaaatgttgggctggaaacagaggagatccagcatgacattttctaacctggcggcagcgcaaaagatg

SEQ ID NO: 199991 - DNA, 103 bp, Artificial Sequence
  Synthetic Polynucleotide
taatacgactcactatagggcttgcactttcattggttctttagaaaatgaacagaggagacattttatgaagaaccaaaacctggcggcagcgcaaaagatg

SEQ ID NO: 199992 - DNA, 103 bp, Artificial Sequence
  Synthetic Polynucleotide
taatacgactcactatagggaatacactgtcttgcactttcattggttctaacagaggagaagaaccatggaaagtgcaaacctggcggcagcgcaaaagatg

SEQ ID NO: 199993 - DNA, 103 bp, Artificial Sequence
  Synthetic Polynucleotide
taatacgactcactatagggtgctttgatcaatacactgtcttgcactttaacagaggagaaaagtgatggacagtgtaaacctggcggcagcgcaaaagatg

SEQ ID NO: 199994 - DNA, 103 bp, Artificial Sequence
  Synthetic Polynucleotide
taatacgactcactatagggtagtgttatctgctttgatcaatacactgtaacagaggagaacagtgatgtgatcaaagaacctggcggcagcgcaaaagatg

SEQ ID NO: 199995 - DNA, 103 bp, Artificial Sequence
  Synthetic Polynucleotide
taatacgactcactatagggtcaccttctatagtgttatctgctttgatcaacagaggagagatcaaatgagataacacaacctggcggcagcgcaaaagatg

SEQ ID NO: 199996 - DNA, 103 bp, Artificial Sequence
  Synthetic Polynucleotide
taatacgactcactatagggctcattattgtcaccttctatagtgttatcaacagaggagagataacatgatagaaggtaacctggcggcagcgcaaaagatg

SEQ ID NO: 199997 - DNA, 103 bp, Artificial Sequence
  Synthetic Polynucleotide
taatacgactcactatagggtggaagcaccacctggcgtacaccaacaacaacagaggagagttgttatggtacgccagaacctggcggcagcgcaaaagatg

SEQ ID NO: 199998 - DNA, 103 bp, Artificial Sequence
  Synthetic Polynucleotide
taatacgactcactatagggcaaagtgatttatgagacgtaaggtttctaaacagaggagatagaaaatgtacgtctcaaacctggcggcagcgcaaaagatg

SEQ ID NO: 199999 - DNA, 103 bp, Artificial Sequence
  Synthetic Polynucleotide
taatacgactcactatagggtataattttgctcattattgtcaccttctaaacagaggagatagaagatgacaataatgaacctggcggcagcgcaaaagatg

SEQ ID NO: 200000 - DNA, 103 bp, Artificial Sequence
  Synthetic Polynucleotide
taatacgactcactatagggacatcctttatataattttgctcattattgaacagaggagacaataaatggcaaaattaaacctggcggcagcgcaaaagatg

SEQ ID NO: 200001 - DNA, 103 bp, Artificial Sequence
  Synthetic Polynucleotide
taatacgactcactatagggctctagtttcacatcctttatataattttgaacagaggagacaaaatatgataaaggataacctggcggcagcgcaaaagatg

SEQ ID NO: 200002 - DNA, 103 bp, Artificial Sequence
  Synthetic Polynucleotide
taatacgactcactatagggagagatggtcctctagtttcacatcctttaaacagaggagataaaggatgtgaaactagaacctggcggcagcgcaaaagatg

SEQ ID NO: 200003 - DNA, 103 bp, Artificial Sequence
  Synthetic Polynucleotide
taatacgactcactataggggacccagctaagagatggtcctctagtttcaacagaggagagaaactatgggaccatctaacctggcggcagcgcaaaagatg

SEQ ID NO: 200004 - DNA, 103 bp, Artificial Sequence
  Synthetic Polynucleotide
taatacgactcactatagggctttaagcatgacccagctaagagatggtcaacagaggagagaccatatgttagctgggaacctggcggcagcgcaaaagatg

SEQ ID NO: 200005 - DNA, 103 bp, Artificial Sequence
  Synthetic Polynucleotide
taatacgactcactatagggtactactctgctttaagcatgacccagctaaacagaggagatagctgatgcatgcttaaaacctggcggcagcgcaaaagatg

SEQ ID NO: 200006 - DNA, 103 bp, Artificial Sequence
  Synthetic Polynucleotide
taatacgactcactatagggaaaatgtttttactactctgctttaagcataacagaggagaatgcttatggcagagtagaacctggcggcagcgcaaaagatg

SEQ ID NO: 200007 - DNA, 103 bp, Artificial Sequence
  Synthetic Polynucleotide
taatacgactcactatagggtctttcagtaaaaatgtttttactactctgaacagaggagacagagtatgaaaaacattaacctggcggcagcgcaaaagatg

SEQ ID NO: 200008 - DNA, 103 bp, Artificial Sequence
  Synthetic Polynucleotide
taatacgactcactataggggatcttcagctctttcagtaaaaatgttttaacagaggagaaaaacaatgttactgaaaaacctggcggcagcgcaaaagatg

SEQ ID NO: 200009 - DNA, 103 bp, Artificial Sequence
  Synthetic Polynucleotide
taatacgactcactatagggatggatttttcaaagtgatttatgagacgtaacagaggagaacgtctatgaaatcacttaacctggcggcagcgcaaaagatg

SEQ ID NO: 200010 - DNA, 103 bp, Artificial Sequence
  Synthetic Polynucleotide
taatacgactcactatagggattttaatttgatcttcagctctttcagtaaacagaggagatactgaatgagctgaagaaacctggcggcagcgcaaaagatg

SEQ ID NO: 200011 - DNA, 103 bp, Artificial Sequence
  Synthetic Polynucleotide
taatacgactcactatagggccttgtacttattttaatttgatcttcagcaacagaggagagctgaaatgcaaattaaaaacctggcggcagcgcaaaagatg

SEQ ID NO: 200012 - DNA, 103 bp, Artificial Sequence
  Synthetic Polynucleotide
taatacgactcactatagggacttctgcttccttgtacttattttaatttaacagaggagaaaattaatgtaagtacaaaacctggcggcagcgcaaaagatg

SEQ ID NO: 200013 - DNA, 103 bp, Artificial Sequence
  Synthetic Polynucleotide
taatacgactcactatagggtcttttacagacttctgcttccttgtacttaacagaggagaaagtacatggaagcagaaaacctggcggcagcgcaaaagatg

SEQ ID NO: 200014 - DNA, 103 bp, Artificial Sequence
  Synthetic Polynucleotide
taatacgactcactatagggtgaagagatctcttttacagacttctgcttaacagaggagaaagcagatgtctgtaaaaaacctggcggcagcgcaaaagatg

SEQ ID NO: 200015 - DNA, 103 bp, Artificial Sequence
  Synthetic Polynucleotide
taatacgactcactatagggttggtgtatatgaagagatctcttttacagaacagaggagactgtaaatgagatctcttaacctggcggcagcgcaaaagatg

SEQ ID NO: 200016 - DNA, 103 bp, Artificial Sequence
  Synthetic Polynucleotide
taatacgactcactataggggtacagtcctttggtgtatatgaagagatcaacagaggagagatctcatgatatacaccaacctggcggcagcgcaaaagatg

SEQ ID NO: 200017 - DNA, 103 bp, Artificial Sequence
  Synthetic Polynucleotide
taatacgactcactatagggatttcttgaagtacagtcctttggtgtataaacagaggagatatacaatgaaggactgtaacctggcggcagcgcaaaagatg

SEQ ID NO: 200018 - DNA, 103 bp, Artificial Sequence
  Synthetic Polynucleotide
taatacgactcactatagggtttctggaccatttcttgaagtacagtcctaacagaggagaaggactatgcttcaagaaaacctggcggcagcgcaaaagatg

SEQ ID NO: 200019 - DNA, 103 bp, Artificial Sequence
  Synthetic Polynucleotide
taatacgactcactatagggtcacatcccctttctggaccatttcttgaaaacagaggagattcaagatgtggtccagaaacctggcggcagcgcaaaagatg

SEQ ID NO: 200020 - DNA, 103 bp, Artificial Sequence
  Synthetic Polynucleotide
taatacgactcactatagggttctgccttcatggatttttcaaagtgattaacagaggagaaatcacatggaaaaatccaacctggcggcagcgcaaaagatg

SEQ ID NO: 200021 - DNA, 103 bp, Artificial Sequence
  Synthetic Polynucleotide
taatacgactcactatagggtattcctctgtcacatcccctttctggaccaacagaggagaggtccaatgaggggatgtaacctggcggcagcgcaaaagatg

SEQ ID NO: 200022 - DNA, 103 bp, Artificial Sequence
  Synthetic Polynucleotide
taatacgactcactatagggttgatactattattcctctgtcacatccccaacagaggagaggggatatgacagaggaaaacctggcggcagcgcaaaagatg

SEQ ID NO: 200023 - DNA, 103 bp, Artificial Sequence
  Synthetic Polynucleotide
taatacgactcactatagggaacaaacgtgttgatactattattcctctgaacagaggagacagaggatgaatagtatcaacctggcggcagcgcaaaagatg

SEQ ID NO: 200024 - DNA, 103 bp, Artificial Sequence
  Synthetic Polynucleotide
taatacgactcactatagggagaatcagtcaacaaacgtgttgatactataacagaggagaatagtaatgacacgtttgaacctggcggcagcgcaaaagatg

SEQ ID NO: 200025 - DNA, 103 bp, Artificial Sequence
  Synthetic Polynucleotide
taatacgactcactatagggcatcagtgctagaatcagtcaacaaacgtgaacagaggagacacgttatgtgactgattaacctggcggcagcgcaaaagatg

SEQ ID NO: 200026 - DNA, 103 bp, Artificial Sequence
  Synthetic Polynucleotide
taatacgactcactatagggttttccaaagcatcagtgctagaatcagtcaacagaggagagactgaatgtagcactgaaacctggcggcagcgcaaaagatg

SEQ ID NO: 200027 - DNA, 103 bp, Artificial Sequence
  Synthetic Polynucleotide
taatacgactcactatagggtgtggacactttttccaaagcatcagtgctaacagaggagaagcactatggctttggaaaacctggcggcagcgcaaaagatg

SEQ ID NO: 200028 - DNA, 103 bp, Artificial Sequence
  Synthetic Polynucleotide
taatacgactcactatagggcttcattcgatgtggacactttttccaaagaacagaggagactttggatgaagtgtccaaacctggcggcagcgcaaaagatg

SEQ ID NO: 200029 - DNA, 103 bp, Artificial Sequence
  Synthetic Polynucleotide
taatacgactcactatagggaaagagaaatcttcattcgatgtggacactaacagaggagaagtgtcatgatcgaatgaaacctggcggcagcgcaaaagatg

SEQ ID NO: 200030 - DNA, 103 bp, Artificial Sequence
  Synthetic Polynucleotide
taatacgactcactatagggatcatcctttaaagagaaatcttcattcgaaacagaggagatcgaatatggatttctctaacctggcggcagcgcaaaagatg

SEQ ID NO: 200031 - DNA, 103 bp, Artificial Sequence
  Synthetic Polynucleotide
taatacgactcactatagggcatctccaatttctgccttcatggatttttaacagaggagaaaaaatatgtgaaggcagaacctggcggcagcgcaaaagatg

SEQ ID NO: 200032 - DNA, 103 bp, Artificial Sequence
  Synthetic Polynucleotide
taatacgactcactatagggtagcaagagcatcatcctttaaagagaaataacagaggagaatttctatgtaaaggatgaacctggcggcagcgcaaaagatg

SEQ ID NO: 200033 - DNA, 103 bp, Artificial Sequence
  Synthetic Polynucleotide
taatacgactcactatagggtttgaggttttagcaagagcatcatcctttaacagaggagaaaaggaatgtgctcttgcaacctggcggcagcgcaaaagatg

SEQ ID NO: 200034 - DNA, 103 bp, Artificial Sequence
  Synthetic Polynucleotide
taatacgactcactatagggagtttttcgttttgaggttttagcaagagcaacagaggagagctcttatgaaaacctcaaacctggcggcagcgcaaaagatg

SEQ ID NO: 200035 - DNA, 103 bp, Artificial Sequence
  Synthetic Polynucleotide
taatacgactcactatagggtctgtaccttagtttttcgttttgaggtttaacagaggagaaaacctatgaacgaaaaaaacctggcggcagcgcaaaagatg

SEQ ID NO: 200036 - DNA, 103 bp, Artificial Sequence
  Synthetic Polynucleotide
taatacgactcactatagggatttcatctttctgtaccttagtttttcgtaacagaggagaacgaaaatgtaaggtacaaacctggcggcagcgcaaaagatg

SEQ ID NO: 200037 - DNA, 103 bp, Artificial Sequence
  Synthetic Polynucleotide
taatacgactcactatagggctttgcacagatttcatctttctgtaccttaacagaggagaaaggtaatgaaagatgaaaacctggcggcagcgcaaaagatg

SEQ ID NO: 200038 - DNA, 103 bp, Artificial Sequence
  Synthetic Polynucleotide
taatacgactcactatagggcatgtgataactttgcacagatttcatcttaacagaggagaaagatgatgtctgtgcaaaacctggcggcagcgcaaaagatg

SEQ ID NO: 200039 - DNA, 103 bp, Artificial Sequence
  Synthetic Polynucleotide
taatacgactcactatagggttctttattacatgtgataactttgcacagaacagaggagactgtgcatggttatcacaaacctggcggcagcgcaaaagatg

SEQ ID NO: 200040 - DNA, 103 bp, Artificial Sequence
  Synthetic Polynucleotide
taatacgactcactatagggcctgtgttgcttctttattacatgtgataaaacagaggagattatcaatggtaataaagaacctggcggcagcgcaaaagatg

SEQ ID NO: 200041 - DNA, 103 bp, Artificial Sequence
  Synthetic Polynucleotide
taatacgactcactatagggaagtactcttcctgtgttgcttctttattaaacagaggagataataaatgagcaacacaaacctggcggcagcgcaaaagatg

SEQ ID NO: 200042 - DNA, 103 bp, Artificial Sequence
  Synthetic Polynucleotide
taatacgactcactatagggaactcatcatcatctccaatttctgccttcaacagaggagagaaggcatgaattggagaaacctggcggcagcgcaaaagatg

SEQ ID NO: 200043 - DNA, 103 bp, Artificial Sequence
  Synthetic Polynucleotide
taatacgactcactatagggttatcgaccaaagtactcttcctgtgttgcaacagaggagagcaacaatggaagagtacaacctggcggcagcgcaaaagatg

SEQ ID NO: 200044 - DNA, 103 bp, Artificial Sequence
  Synthetic Polynucleotide
taatacgactcactatagggattgatagtattatcgaccaaagtactcttaacagaggagaaagagtatgttggtcgataacctggcggcagcgcaaaagatg

SEQ ID NO: 200045 - DNA, 103 bp, Artificial Sequence
  Synthetic Polynucleotide
taatacgactcactatagggtttcatctaaattgatagtattatcgaccaaacagaggagatggtcgatgatactatcaaacctggcggcagcgcaaaagatg

SEQ ID NO: 200046 - DNA, 103 bp, Artificial Sequence
  Synthetic Polynucleotide
taatacgactcactatagggacagtcaaattttcatctaaattgatagtaaacagaggagatactatatgtttagatgaaacctggcggcagcgcaaaagatg

SEQ ID NO: 200047 - DNA, 103 bp, Artificial Sequence
  Synthetic Polynucleotide
taatacgactcactatagggaatgttagatacagtcaaattttcatctaaaacagaggagattagatatgaatttgactaacctggcggcagcgcaaaagatg

SEQ ID NO: 200048 - DNA, 103 bp, Artificial Sequence
  Synthetic Polynucleotide
taatacgactcactatagggagaaactctcaatgttagatacagtcaaataacagaggagaatttgaatgtatctaacaaacctggcggcagcgcaaaagatg

SEQ ID NO: 200049 - DNA, 103 bp, Artificial Sequence
  Synthetic Polynucleotide
taatacgactcactatagggttccttgaatagaaactctcaatgttagataacagaggagaatctaaatgtgagagtttaacctggcggcagcgcaaaagatg

SEQ ID NO: 200050 - DNA, 103 bp, Artificial Sequence
  Synthetic Polynucleotide
taatacgactcactatagggtcctgtatctttccttgaatagaaactctcaacagaggagagagagtatgtattcaaggaacctggcggcagcgcaaaagatg

SEQ ID NO: 200051 - DNA, 103 bp, Artificial Sequence
  Synthetic Polynucleotide
taatacgactcactatagggctttctgaactcctgtatctttccttgaataacagaggagaattcaaatgaagatacagaacctggcggcagcgcaaaagatg

SEQ ID NO: 200052 - DNA, 103 bp, Artificial Sequence
  Synthetic Polynucleotide
taatacgactcactatagggaaaccatctcctttctgaactcctgtatctaacagaggagaagatacatgagttcagaaaacctggcggcagcgcaaaagatg

SEQ ID NO: 200053 - DNA, 103 bp, Artificial Sequence
  Synthetic Polynucleotide
taatacgactcactatagggtactatatataactcatcatcatctccaataacagaggagaattggaatggatgatgagaacctggcggcagcgcaaaagatg

SEQ ID NO: 200054 - DNA, 103 bp, Artificial Sequence
  Synthetic Polynucleotide
taatacgactcactatagggattgtgtatgaaaccatctcctttctgaacaacagaggagagttcagatgggagatggtaacctggcggcagcgcaaaagatg

SEQ ID NO: 200055 - DNA, 103 bp, Artificial Sequence
  Synthetic Polynucleotide
taatacgactcactatagggctaaagaaagattgtgtatgaaaccatctcaacagaggagagagatgatgtcatacacaaacctggcggcagcgcaaaagatg

SEQ ID NO: 200056 - DNA, 103 bp, Artificial Sequence
  Synthetic Polynucleotide
taatacgactcactatagggccactagggtctaaagaaagattgtgtatgaacagaggagacatacaatgtctttctttaacctggcggcagcgcaaaagatg

SEQ ID NO: 200057 - DNA, 103 bp, Artificial Sequence
  Synthetic Polynucleotide
taatacgactcactatagggatccagaacaccactagggtctaaagaaagaacagaggagactttctatggaccctagtaacctggcggcagcgcaaaagatg

SEQ ID NO: 200058 - DNA, 103 bp, Artificial Sequence
  Synthetic Polynucleotide
taatacgactcactatagggcattcttatcatccagaacaccactagggtaacagaggagaaccctaatggtgttctggaacctggcggcagcgcaaaagatg

SEQ ID NO: 200059 - DNA, 103 bp, Artificial Sequence
  Synthetic Polynucleotide
taatacgactcactatagggttttgttctccattcttatcatccagaacaaacagaggagatgttctatgtgataagaaaacctggcggcagcgcaaaagatg

SEQ ID NO: 200060 - DNA, 103 bp, Artificial Sequence
  Synthetic Polynucleotide
taatacgactcactataggggttttgagatttttgttctccattcttatcaacagaggagagataagatgggagaacaaaacctggcggcagcgcaaaagatg

SEQ ID NO: 200061 - DNA, 103 bp, Artificial Sequence
  Synthetic Polynucleotide
taatacgactcactataggggcaatacattgttttgagatttttgttctcaacagaggagagagaacatgaatctcaaaaacctggcggcagcgcaaaagatg

SEQ ID NO: 200062 - DNA, 103 bp, Artificial Sequence
  Synthetic Polynucleotide
taatacgactcactatagggttctcttttggcaatacattgttttgagataacagaggagaatctcaatgcaatgtattaacctggcggcagcgcaaaagatg

SEQ ID NO: 200063 - DNA, 103 bp, Artificial Sequence
  Synthetic Polynucleotide
taatacgactcactatagggctttaattgtttctcttttggcaatacattaacagaggagaaatgtaatgccaaaagagaacctggcggcagcgcaaaagatg

SEQ ID NO: 200064 - DNA, 103 bp, Artificial Sequence
  Synthetic Polynucleotide
taatacgactcactatagggcattattgtctactatatataactcatcataacagaggagaatgatgatgtatatatagaacctggcggcagcgcaaaagatg

SEQ ID NO: 200065 - DNA, 103 bp, Artificial Sequence
  Synthetic Polynucleotide
taatacgactcactatagggattcttcattctttaattgtttctcttttgaacagaggagacaaaagatgaacaattaaaacctggcggcagcgcaaaagatg

SEQ ID NO: 200066 - DNA, 103 bp, Artificial Sequence
  Synthetic Polynucleotide
taatacgactcactatagggaaaataactaattcttcattctttaattgtaacagaggagaacaattatggaatgaagaaacctggcggcagcgcaaaagatg

SEQ ID NO: 200067 - DNA, 103 bp, Artificial Sequence
  Synthetic Polynucleotide
taatacgactcactatagggatggaaagagaaaataactaattcttcattaacagaggagaaatgaaatgttagttattaacctggcggcagcgcaaaagatg

SEQ ID NO: 200068 - DNA, 103 bp, Artificial Sequence
  Synthetic Polynucleotide
taatacgactcactatagggaattgttttcatggaaagagaaaataactaaacagaggagatagttaatgtctctttccaacctggcggcagcgcaaaagatg

SEQ ID NO: 200069 - DNA, 103 bp, Artificial Sequence
  Synthetic Polynucleotide
taatacgactcactatagggtgtattttacaattgttttcatggaaagagaacagaggagactctttatgtgaaaacaaaacctggcggcagcgcaaaagatg

SEQ ID NO: 200070 - DNA, 103 bp, Artificial Sequence
  Synthetic Polynucleotide
taatacgactcactatagggatgaaattcctgtattttacaattgttttcaacagaggagagaaaacatgtgtaaaataaacctggcggcagcgcaaaagatg

SEQ ID NO: 200071 - DNA, 103 bp, Artificial Sequence
  Synthetic Polynucleotide
taatacgactcactatagggtaccatcaacatgaaattcctgtattttacaacagaggagagtaaaaatgaggaatttcaacctggcggcagcgcaaaagatg

SEQ ID NO: 200072 - DNA, 103 bp, Artificial Sequence
  Synthetic Polynucleotide
taatacgactcactatagggatcaattctttaccatcaacatgaaattccaacagaggagaggaattatgtgttgatggaacctggcggcagcgcaaaagatg

SEQ ID NO: 200073 - DNA, 103 bp, Artificial Sequence
  Synthetic Polynucleotide
taatacgactcactatagggtgtaaaagggatcaattctttaccatcaacaacagaggagagttgatatgaaagaattgaacctggcggcagcgcaaaagatg

SEQ ID NO: 200074 - DNA, 103 bp, Artificial Sequence
  Synthetic Polynucleotide
taatacgactcactatagggtggtcatttctgtaaaagggatcaattcttaacagaggagaaagaatatgtcccttttaaacctggcggcagcgcaaaagatg

SEQ ID NO: 200075 - DNA, 103 bp, Artificial Sequence
  Synthetic Polynucleotide
taatacgactcactatagggggcatctctccattattgtctactatatataacagaggagaatatatatgagacaataaaacctggcggcagcgcaaaagatg

SEQ ID NO: 200076 - DNA, 103 bp, Artificial Sequence
  Synthetic Polynucleotide
taatacgactcactatagggtctgaagcattggtcatttctgtaaaagggaacagaggagaccctttatgagaaatgacaacctggcggcagcgcaaaagatg

SEQ ID NO: 200077 - DNA, 103 bp, Artificial Sequence
  Synthetic Polynucleotide
taatacgactcactatagggtgatttcttctctgaagcattggtcatttcaacagaggagagaaatgatgaatgcttcaaacctggcggcagcgcaaaagatg

SEQ ID NO: 200078 - DNA, 103 bp, Artificial Sequence
  Synthetic Polynucleotide
taatacgactcactatagggtaaagggagatgatttcttctctgaagcataacagaggagaatgcttatgagaagaaataacctggcggcagcgcaaaagatg

SEQ ID NO: 200079 - DNA, 103 bp, Artificial Sequence
  Synthetic Polynucleotide
taatacgactcactatagggataagatctttaaagggagatgatttcttcaacagaggagagaagaaatgatctcccttaacctggcggcagcgcaaaagatg

SEQ ID NO: 200080 - DNA, 103 bp, Artificial Sequence
  Synthetic Polynucleotide
taatacgactcactatagggaggtacagtcataagatctttaaagggagaaacagaggagatctcccatgaaagatcttaacctggcggcagcgcaaaagatg

SEQ ID NO: 200081 - DNA, 103 bp, Artificial Sequence
  Synthetic Polynucleotide
taatacgactcactatagggctcttgattcaggtacagtcataagatcttaacagaggagaaagatcatgtgactgtacaacctggcggcagcgcaaaagatg

SEQ ID NO: 200082 - DNA, 103 bp, Artificial Sequence
  Synthetic Polynucleotide
taatacgactcactatagggatctcctcatctcttgattcaggtacagtcaacagaggagagactgtatgtgaatcaagaacctggcggcagcgcaaaagatg

SEQ ID NO: 200083 - DNA, 103 bp, Artificial Sequence
  Synthetic Polynucleotide
taatacgactcactatagggactattactcatctcctcatctcttgattcaacagaggagagaatcaatggatgaggagaacctggcggcagcgcaaaagatg

SEQ ID NO: 200084 - DNA, 103 bp, Artificial Sequence
  Synthetic Polynucleotide
taatacgactcactatagggtcacactggtactattactcatctcctcataacagaggagaatgaggatgtgagtaataaacctggcggcagcgcaaaagatg

SEQ ID NO: 200085 - DNA, 103 bp, Artificial Sequence
  Synthetic Polynucleotide
taatacgactcactatagggttagaataaatcacactggtactattactcaacagaggagagagtaaatgtaccagtgtaacctggcggcagcgcaaaagatg

SEQ ID NO: 200086 - DNA, 103 bp, Artificial Sequence
  Synthetic Polynucleotide
taatacgactcactataggggtcaaacagtggcatctctccattattgtcaacagaggagagacaatatgggagagatgaacctggcggcagcgcaaaagatg

SEQ ID NO: 200087 - DNA, 103 bp, Artificial Sequence
  Synthetic Polynucleotide
taatacgactcactatagggtcttgtcaagttagaataaatcacactggtaacagaggagaaccagtatgatttattctaacctggcggcagcgcaaaagatg

SEQ ID NO: 200088 - DNA, 103 bp, Artificial Sequence
  Synthetic Polynucleotide
taatacgactcactataggggggcctgttctcttgtcaagttagaataaaaacagaggagatttattatgacttgacaaaacctggcggcagcgcaaaagatg

SEQ ID NO: 200089 - DNA, 103 bp, Artificial Sequence
  Synthetic Polynucleotide
taatacgactcactatagggctgatgtcaggggcctgttctcttgtcaagaacagaggagacttgacatgagaacaggcaacctggcggcagcgcaaaagatg

SEQ ID NO: 200090 - DNA, 103 bp, Artificial Sequence
  Synthetic Polynucleotide
taatacgactcactatagggagatttaggactgatgtcaggggcctgttcaacagaggagagaacagatgcctgacatcaacctggcggcagcgcaaaagatg

SEQ ID NO: 200091 - DNA, 103 bp, Artificial Sequence
  Synthetic Polynucleotide
taatacgactcactatagggttaaggtgtcagatttaggactgatgtcagaacagaggagactgacaatggtcctaaataacctggcggcagcgcaaaagatg

SEQ ID NO: 200092 - DNA, 103 bp, Artificial Sequence
  Synthetic Polynucleotide
taatacgactcactatagggtgagaatccgttaaggtgtcagatttaggaaacagaggagatcctaaatgtgacaccttaacctggcggcagcgcaaaagatg

SEQ ID NO: 200093 - DNA, 103 bp, Artificial Sequence
  Synthetic Polynucleotide
taatacgactcactatagggtctgtctatctgagaatccgttaaggtgtcaacagaggagagacaccatgacggattctaacctggcggcagcgcaaaagatg

SEQ ID NO: 200094 - DNA, 103 bp, Artificial Sequence
  Synthetic Polynucleotide
taatacgactcactatagggtgtgaaggtctctgtctatctgagaatccgaacagaggagacggattatgagatagacaaacctggcggcagcgcaaaagatg

SEQ ID NO: 200095 - DNA, 103 bp, Artificial Sequence
  Synthetic Polynucleotide
taatacgactcactatagggaaagataatttgtgaaggtctctgtctatcaacagaggagagatagaatgagaccttcaaacctggcggcagcgcaaaagatg

SEQ ID NO: 200096 - DNA, 103 bp, Artificial Sequence
  Synthetic Polynucleotide
taatacgactcactatagggttgagctagtaaagataatttgtgaaggtcaacagaggagagaccttatgaaattatctaacctggcggcagcgcaaaagatg

SEQ ID NO: 200097 - DNA, 103 bp, Artificial Sequence
  Synthetic Polynucleotide
taatacgactcactataggggcccagtgatgtcaaacagtggcatctctcaacagaggagagagagaatgcactgtttgaacctggcggcagcgcaaaagatg

SEQ ID NO: 200098 - DNA, 103 bp, Artificial Sequence
  Synthetic Polynucleotide
taatacgactcactatagggtaacactggcttgagctagtaaagataattaacagaggagaaattatatgtactagctcaacctggcggcagcgcaaaagatg

SEQ ID NO: 200099 - DNA, 103 bp, Artificial Sequence
  Synthetic Polynucleotide
taatacgactcactataggggggaacgtaataacactggcttgagctagtaacagaggagaactagcatgagccagtgtaacctggcggcagcgcaaaagatg

SEQ ID NO: 200100 - DNA, 103 bp, Artificial Sequence
  Synthetic Polynucleotide
taatacgactcactatagggtgaatcggatgggaacgtaataacactggcaacagaggagagccagtatgattacgttcaacctggcggcagcgcaaaagatg

SEQ ID NO: 200101 - DNA, 103 bp, Artificial Sequence
  Synthetic Polynucleotide
taatacgactcactatagggagttctgaggtgaatcggatgggaacgtaaaacagaggagattacgtatgcatccgattaacctggcggcagcgcaaaagatg

SEQ ID NO: 200102 - DNA, 103 bp, Artificial Sequence
  Synthetic Polynucleotide
taatacgactcactatagggagctgcgatgagttctgaggtgaatcggataacagaggagaatccgaatgacctcagaaaacctggcggcagcgcaaaagatg

SEQ ID NO: 200103 - DNA, 103 bp, Artificial Sequence
  Synthetic Polynucleotide
taatacgactcactatagggtttcctttgcagctgcgatgagttctgaggaacagaggagacctcagatgtcatcgcagaacctggcggcagcgcaaaagatg

SEQ ID NO: 200104 - DNA, 103 bp, Artificial Sequence
  Synthetic Polynucleotide
taatacgactcactatagggcttcttttactttcctttgcagctgcgatgaacagaggagacatcgcatgtgcaaaggaaacctggcggcagcgcaaaagatg

SEQ ID NO: 200105 - DNA, 103 bp, Artificial Sequence
  Synthetic Polynucleotide
taatacgactcactatagggcatcttttatcttcttttactttcctttgcaacagaggagagcaaagatgagtaaaagaaacctggcggcagcgcaaaagatg

SEQ ID NO: 200106 - DNA, 103 bp, Artificial Sequence
  Synthetic Polynucleotide
taatacgactcactatagggagctgtgaaacatcttttatcttcttttacaacagaggagagtaaaaatggataaaagaaacctggcggcagcgcaaaagatg

SEQ ID NO: 200107 - DNA, 103 bp, Artificial Sequence
  Synthetic Polynucleotide
taatacgactcactatagggtattttggttagctgtgaaacatcttttataacagaggagaataaaaatggtttcacagaacctggcggcagcgcaaaagatg

SEQ ID NO: 200108 - DNA, 103 bp, Artificial Sequence
  Synthetic Polynucleotide
taatacgactcactatagggaagtcaatggtggaagcaccacctggcgtaaacagaggagatacgccatgtggtgcttcaacctggcggcagcgcaaaagatg

SEQ ID NO: 200109 - DNA, 103 bp, Artificial Sequence
  Synthetic Polynucleotide
taatacgactcactatagggtcaaagtcttgcccagtgatgtcaaacagtaacagaggagaactgttatgcatcactggaacctggcggcagcgcaaaagatg

SEQ ID NO: 200110 - DNA, 103 bp, Artificial Sequence
  Synthetic Polynucleotide
taatacgactcactatagggtctccaacattattttggttagctgtgaaaaacagaggagatttcacatgtaaccaaaaaacctggcggcagcgcaaaagatg

SEQ ID NO: 200111 - DNA, 103 bp, Artificial Sequence
  Synthetic Polynucleotide
taatacgactcactatagggacgggaggtatctccaacattattttggttaacagaggagaaaccaaatgaatgttggaaacctggcggcagcgcaaaagatg

SEQ ID NO: 200112 - DNA, 103 bp, Artificial Sequence
  Synthetic Polynucleotide
taatacgactcactatagggtaacctgtccacgggaggtatctccaacataacagaggagaatgttgatgatacctcccaacctggcggcagcgcaaaagatg

SEQ ID NO: 200113 - DNA, 103 bp, Artificial Sequence
  Synthetic Polynucleotide
taatacgactcactataggggaaataataataacctgtccacgggaggtaaacagaggagatacctcatgtggacaggtaacctggcggcagcgcaaaagatg

SEQ ID NO: 200114 - DNA, 103 bp, Artificial Sequence
  Synthetic Polynucleotide
taatacgactcactatagggatcagaatctgaaataataataacctgtccaacagaggagaggacagatgattattattaacctggcggcagcgcaaaagatg

SEQ ID NO: 200115 - DNA, 103 bp, Artificial Sequence
  Synthetic Polynucleotide
taatacgactcactatagggcatcatcatcatcagaatctgaaataataaaacagaggagattattaatgcagattctgaacctggcggcagcgcaaaagatg

SEQ ID NO: 200116 - DNA, 103 bp, Artificial Sequence
  Synthetic Polynucleotide
taatacgactcactatagggattctttcatcatcatcatcatcagaatctaacagaggagaagattcatgtgatgatgaaacctggcggcagcgcaaaagatg

SEQ ID NO: 200117 - DNA, 103 bp, Artificial Sequence
  Synthetic Polynucleotide
taatacgactcactatagggaagactcaggattctttcatcatcatcatcaacagaggagagatgatatggatgaaagaaacctggcggcagcgcaaaagatg

SEQ ID NO: 200118 - DNA, 103 bp, Artificial Sequence
  Synthetic Polynucleotide
taatacgactcactatagggtgagtttctcaagactcaggattctttcataacagaggagaatgaaaatgtcctgagtcaacctggcggcagcgcaaaagatg

SEQ ID NO: 200119 - DNA, 103 bp, Artificial Sequence
  Synthetic Polynucleotide
taatacgactcactatagggtcctgtttagtgagtttctcaagactcaggaacagaggagacctgagatgtgagaaactaacctggcggcagcgcaaaagatg

SEQ ID NO: 200120 - DNA, 103 bp, Artificial Sequence
  Synthetic Polynucleotide
taatacgactcactatagggaagcttattttcaaagtcttgcccagtgataacagaggagaatcactatgcaagactttaacctggcggcagcgcaaaagatg

SEQ ID NO: 200121 - DNA, 103 bp, Artificial Sequence
  Synthetic Polynucleotide
taatacgactcactataggggcatattttgtcctgtttagtgagtttctcaacagaggagagagaaaatgactaaacagaacctggcggcagcgcaaaagatg

SEQ ID NO: 200122 - DNA, 103 bp, Artificial Sequence
  Synthetic Polynucleotide
taatacgactcactatagggccctctcaaggcatattttgtcctgtttagaacagaggagactaaacatgacaaaatataacctggcggcagcgcaaaagatg

SEQ ID NO: 200123 - DNA, 103 bp, Artificial Sequence
  Synthetic Polynucleotide
taatacgactcactatagggtctggatgttccctctcaaggcatattttgaacagaggagacaaaatatgccttgagagaacctggcggcagcgcaaaagatg

SEQ ID NO: 200124 - DNA, 103 bp, Artificial Sequence
  Synthetic Polynucleotide
taatacgactcactatagggaacgtgctgctctggatgttccctctcaagaacagaggagacttgagatggaacatccaaacctggcggcagcgcaaaagatg

SEQ ID NO: 200125 - DNA, 103 bp, Artificial Sequence
  Synthetic Polynucleotide
taatacgactcactatagggtaactgttgaaacgtgctgctctggatgttaacagaggagaaacatcatgagcagcacgaacctggcggcagcgcaaaagatg

SEQ ID NO: 200126 - DNA, 103 bp, Artificial Sequence
  Synthetic Polynucleotide
taatacgactcactatagggtccttactattaactgttgaaacgtgctgcaacagaggagagcagcaatgttcaacagtaacctggcggcagcgcaaaagatg

SEQ ID NO: 200127 - DNA, 103 bp, Artificial Sequence
  Synthetic Polynucleotide
taatacgactcactatagggattcttttcctccttactattaactgttgaaacagaggagatcaacaatgaatagtaagaacctggcggcagcgcaaaagatg

SEQ ID NO: 200128 - DNA, 103 bp, Artificial Sequence
  Synthetic Polynucleotide
taatacgactcactatagggcctttactggattcttttcctccttactataacagaggagaatagtaatgaggaaaagaaacctggcggcagcgcaaaagatg

SEQ ID NO: 200129 - DNA, 103 bp, Artificial Sequence
  Synthetic Polynucleotide
taatacgactcactataggggtcttttcttcctttactggattcttttccaacagaggagaggaaaaatgtccagtaaaaacctggcggcagcgcaaaagatg

SEQ ID NO: 200130 - DNA, 103 bp, Artificial Sequence
  Synthetic Polynucleotide
taatacgactcactatagggaagagtctctgtcttttcttcctttactggaacagaggagaccagtaatggaagaaaagaacctggcggcagcgcaaaagatg

SEQ ID NO: 200131 - DNA, 103 bp, Artificial Sequence
  Synthetic Polynucleotide
taatacgactcactataggggaggaactcgaagcttattttcaaagtcttaacagaggagaaagactatgaaaataagcaacctggcggcagcgcaaaagatg

SEQ ID NO: 200132 - DNA, 103 bp, Artificial Sequence
  Synthetic Polynucleotide
taatacgactcactatagggcaaactgaaaaagagtctctgtcttttcttaacagaggagaaagaaaatgcagagactcaacctggcggcagcgcaaaagatg

SEQ ID NO: 200133 - DNA, 103 bp, Artificial Sequence
  Synthetic Polynucleotide
taatacgactcactatagggtcagattcctcaaactgaaaaagagtctctaacagaggagaagagacatgttttcagttaacctggcggcagcgcaaaagatg

SEQ ID NO: 200134 - DNA, 103 bp, Artificial Sequence
  Synthetic Polynucleotide
taatacgactcactatagggacactgagaatcagattcctcaaactgaaaaacagaggagatttcagatggaggaatctaacctggcggcagcgcaaaagatg

SEQ ID NO: 200135 - DNA, 103 bp, Artificial Sequence
  Synthetic Polynucleotide
taatacgactcactatagggcaaactcaaaacactgagaatcagattcctaacagaggagaaggaatatgattctcagtaacctggcggcagcgcaaaagatg

SEQ ID NO: 200136 - DNA, 103 bp, Artificial Sequence
  Synthetic Polynucleotide
taatacgactcactataggggatgaactttcaaactcaaaacactgagaaaacagaggagattctcaatgttttgagttaacctggcggcagcgcaaaagatg

SEQ ID NO: 200137 - DNA, 103 bp, Artificial Sequence
  Synthetic Polynucleotide
taatacgactcactatagggaaacacttcagatgaactttcaaactcaaaaacagaggagatttgagatggaaagttcaaacctggcggcagcgcaaaagatg

SEQ ID NO: 200138 - DNA, 103 bp, Artificial Sequence
  Synthetic Polynucleotide
taatacgactcactataggggccaaactgaaaacacttcagatgaactttaacagaggagaaaagttatgctgaagtgtaacctggcggcagcgcaaaagatg

SEQ ID NO: 200139 - DNA, 103 bp, Artificial Sequence
  Synthetic Polynucleotide
taatacgactcactatagggggatgatcttgccaaactgaaaacacttcaaacagaggagatgaagtatgttcagtttgaacctggcggcagcgcaaaagatg

SEQ ID NO: 200140 - DNA, 103 bp, Artificial Sequence
  Synthetic Polynucleotide
taatacgactcactatagggattatcgtctggatgatcttgccaaactgaaacagaggagatcagttatgcaagatcataacctggcggcagcgcaaaagatg

SEQ ID NO: 200141 - DNA, 103 bp, Artificial Sequence
  Synthetic Polynucleotide
taatacgactcactataggggaactgaattattatcgtctggatgatcttaacagaggagaaagatcatgcagacgataaacctggcggcagcgcaaaagatg

SEQ ID NO: 200142 - DNA, 103 bp, Artificial Sequence
  Synthetic Polynucleotide
taatacgactcactatagggatttcaagaagaggaactcgaagcttatttaacagaggagaaaataaatgtcgagttccaacctggcggcagcgcaaaagatg

SEQ ID NO: 200143 - DNA, 103 bp, Artificial Sequence
  Synthetic Polynucleotide
taatacgactcactatagggtcaccatcttgaactgaattattatcgtctaacagaggagaagacgaatgtaattcagtaacctggcggcagcgcaaaagatg

SEQ ID NO: 200144 - DNA, 103 bp, Artificial Sequence
  Synthetic Polynucleotide
taatacgactcactatagggacattttttctcaccatcttgaactgaattaacagaggagaaattcaatgcaagatggtaacctggcggcagcgcaaaagatg

SEQ ID NO: 200145 - DNA, 103 bp, Artificial Sequence
  Synthetic Polynucleotide
taatacgactcactatagggtaggagccaaacattttttctcaccatcttaacagaggagaaagatgatgagaaaaaataacctggcggcagcgcaaaagatg

SEQ ID NO: 200146 - DNA, 103 bp, Artificial Sequence
  Synthetic Polynucleotide
taatacgactcactataggggtattggctataggagccaaacattttttcaacagaggagagaaaaaatgtttggctccaacctggcggcagcgcaaaagatg

SEQ ID NO: 200147 - DNA, 103 bp, Artificial Sequence
  Synthetic Polynucleotide
taatacgactcactatagggaccatttgtagtattggctataggagccaaaacagaggagattggctatgatagccaataacctggcggcagcgcaaaagatg

SEQ ID NO: 200148 - DNA, 103 bp, Artificial Sequence
  Synthetic Polynucleotide
taatacgactcactatagggtacaaccctgaccatttgtagtattggctaaacagaggagatagccaatgctacaaatgaacctggcggcagcgcaaaagatg

SEQ ID NO: 200149 - DNA, 103 bp, Artificial Sequence
  Synthetic Polynucleotide
taatacgactcactatagggacataatctgtacaaccctgaccatttgtaaacagaggagatacaaaatgtcagggttgaacctggcggcagcgcaaaagatg

SEQ ID NO: 200150 - DNA, 103 bp, Artificial Sequence
  Synthetic Polynucleotide
taatacgactcactatagggaacttcagatacataatctgtacaaccctgaacagaggagacagggtatgacagattataacctggcggcagcgcaaaagatg

SEQ ID NO: 200151 - DNA, 103 bp, Artificial Sequence
  Synthetic Polynucleotide
taatacgactcactatagggcttttttaacaacttcagatacataatctgaacagaggagacagattatgtatctgaagaacctggcggcagcgcaaaagatg

SEQ ID NO: 200152 - DNA, 103 bp, Artificial Sequence
  Synthetic Polynucleotide
taatacgactcactatagggccctctgctccttttttaacaacttcagataacagaggagaatctgaatgtgttaaaaaaacctggcggcagcgcaaaagatg

SEQ ID NO: 200153 - DNA, 103 bp, Artificial Sequence
  Synthetic Polynucleotide
taatacgactcactatagggatatttcagtatttcaagaagaggaactcgaacagaggagacgagttatgcttcttgaaaacctggcggcagcgcaaaagatg

SEQ ID NO: 200154 - DNA, 103 bp, Artificial Sequence
  Synthetic Polynucleotide
taatacgactcactatagggttcttcaatgccctctgctccttttttaacaacagaggagagttaaaatgggagcagagaacctggcggcagcgcaaaagatg

SEQ ID NO: 200155 - DNA, 103 bp, Artificial Sequence
  Synthetic Polynucleotide
taatacgactcactataggggtcttgtgtgttcttcaatgccctctgctcaacagaggagagagcagatggcattgaagaacctggcggcagcgcaaaagatg

SEQ ID NO: 200156 - DNA, 103 bp, Artificial Sequence
  Synthetic Polynucleotide
taatacgactcactatagggatactccgtggtcttgtgtgttcttcaatgaacagaggagacattgaatgacacacaagaacctggcggcagcgcaaaagatg

SEQ ID NO: 200157 - DNA, 103 bp, Artificial Sequence
  Synthetic Polynucleotide
taatacgactcactatagggttcaacagaaatactccgtggtcttgtgtgaacagaggagacacacaatgccacggagtaacctggcggcagcgcaaaagatg

SEQ ID NO: 200158 - DNA, 103 bp, Artificial Sequence
  Synthetic Polynucleotide
taatacgactcactatagggcacaaaattcttcaacagaaatactccgtgaacagaggagacacggaatgtttctgttgaacctggcggcagcgcaaaagatg

SEQ ID NO: 200159 - DNA, 103 bp, Artificial Sequence
  Synthetic Polynucleotide
taatacgactcactatagggacttcaatttcacaaaattcttcaacagaaaacagaggagattctgtatgagaattttgaacctggcggcagcgcaaaagatg

SEQ ID NO: 200160 - DNA, 103 bp, Artificial Sequence
  Synthetic Polynucleotide
taatacgactcactatagggaggcttttttacttcaatttcacaaaattcaacagaggagagaatttatggaaattgaaaacctggcggcagcgcaaaagatg

SEQ ID NO: 200161 - DNA, 103 bp, Artificial Sequence
  Synthetic Polynucleotide
taatacgactcactataggggttttctcttaggcttttttacttcaatttaacagaggagaaaattgatgtaaaaaagcaacctggcggcagcgcaaaagatg

SEQ ID NO: 200162 - DNA, 103 bp, Artificial Sequence
  Synthetic Polynucleotide
taatacgactcactatagggttttcagatcgttttctcttaggcttttttaacagaggagaaaaaaaatgtaagagaaaaacctggcggcagcgcaaaagatg

SEQ ID NO: 200163 - DNA, 103 bp, Artificial Sequence
  Synthetic Polynucleotide
taatacgactcactatagggagccattggtttttcagatcgttttctcttaacagaggagaaagagaatgcgatctgaaaacctggcggcagcgcaaaagatg

SEQ ID NO: 200164 - DNA, 103 bp, Artificial Sequence
  Synthetic Polynucleotide
taatacgactcactataggggcaagtaaggatatttcagtatttcaagaaaacagaggagattcttgatgtactgaaataacctggcggcagcgcaaaagatg

SEQ ID NO: 200165 - DNA, 103 bp, Artificial Sequence
  Synthetic Polynucleotide
taatacgactcactatagggcaggatcttcagccattggtttttcagatcaacagaggagagatctgatgaaccaatggaacctggcggcagcgcaaaagatg

SEQ ID NO: 200166 - DNA, 103 bp, Artificial Sequence
  Synthetic Polynucleotide
taatacgactcactataggggaaggcctcacaggatcttcagccattggtaacagaggagaaccaatatgtgaagatccaacctggcggcagcgcaaaagatg

SEQ ID NO: 200167 - DNA, 103 bp, Artificial Sequence
  Synthetic Polynucleotide
taatacgactcactataggggacagaagatgaaggcctcacaggatcttcaacagaggagagaagatatggtgaggcctaacctggcggcagcgcaaaagatg

SEQ ID NO: 200168 - DNA, 103 bp, Artificial Sequence
  Synthetic Polynucleotide
taatacgactcactatagggcctcatttctgacagaagatgaaggcctcaaacagaggagatgaggcatgcatcttctgaacctggcggcagcgcaaaagatg

SEQ ID NO: 200169 - DNA, 103 bp, Artificial Sequence
  Synthetic Polynucleotide
taatacgactcactatagggtcagactggccctcatttctgacagaagataacagaggagaatcttcatgcagaaatgaaacctggcggcagcgcaaaagatg

SEQ ID NO: 200170 - DNA, 103 bp, Artificial Sequence
  Synthetic Polynucleotide
taatacgactcactatagggcttattagtatcagactggccctcatttctaacagaggagaagaaatatgggccagtctaacctggcggcagcgcaaaagatg

SEQ ID NO: 200171 - DNA, 103 bp, Artificial Sequence
  Synthetic Polynucleotide
taatacgactcactatagggcaagatctctcttattagtatcagactggcaacagaggagagccagtatgatactaataaacctggcggcagcgcaaaagatg

SEQ ID NO: 200172 - DNA, 103 bp, Artificial Sequence
  Synthetic Polynucleotide
taatacgactcactatagggtcatttcccacaagatctctcttattagtaaacagaggagatactaaatggagagatctaacctggcggcagcgcaaaagatg

SEQ ID NO: 200173 - DNA, 103 bp, Artificial Sequence
  Synthetic Polynucleotide
taatacgactcactatagggacttttaaaatcatttcccacaagatctctaacagaggagaagagatatggtgggaaataacctggcggcagcgcaaaagatg

SEQ ID NO: 200174 - DNA, 103 bp, Artificial Sequence
  Synthetic Polynucleotide
taatacgactcactatagggttctatcaatacttttaaaatcatttcccaaacagaggagatgggaaatgattttaaaaaacctggcggcagcgcaaaagatg

SEQ ID NO: 200175 - DNA, 103 bp, Artificial Sequence
  Synthetic Polynucleotide
taatacgactcactatagggtcatgtagaagcaagtaaggatatttcagtaacagaggagaactgaaatgtccttacttaacctggcggcagcgcaaaagatg

SEQ ID NO: 200176 - DNA, 103 bp, Artificial Sequence
  Synthetic Polynucleotide
taatacgactcactataggggttgaagtccttctatcaatacttttaaaaaacagaggagattttaaatgtattgatagaacctggcggcagcgcaaaagatg

SEQ ID NO: 200177 - DNA, 103 bp, Artificial Sequence
  Synthetic Polynucleotide
taatacgactcactatagggtgaattgggagttgaagtccttctatcaataacagaggagaattgatatgaggacttcaaacctggcggcagcgcaaaagatg

SEQ ID NO: 200178 - DNA, 103 bp, Artificial Sequence
  Synthetic Polynucleotide
taatacgactcactatagggtctgaatacgtgaattgggagttgaagtccaacagaggagaggacttatgctcccaattaacctggcggcagcgcaaaagatg

SEQ ID NO: 200179 - DNA, 103 bp, Artificial Sequence
  Synthetic Polynucleotide
taatacgactcactataggggtagtggctctctgaatacgtgaattgggaaacagaggagatcccaaatgacgtattcaaacctggcggcagcgcaaaagatg

SEQ ID NO: 200180 - DNA, 103 bp, Artificial Sequence
  Synthetic Polynucleotide
taatacgactcactatagggttgtgaaaccgtagtggctctctgaatacgaacagaggagacgtattatgagagccactaacctggcggcagcgcaaaagatg

SEQ ID NO: 200181 - DNA, 103 bp, Artificial Sequence
  Synthetic Polynucleotide
taatacgactcactatagggaagacttcttttgtgaaaccgtagtggctcaacagaggagagagccaatgcggtttcacaacctggcggcagcgcaaaagatg

SEQ ID NO: 200182 - DNA, 103 bp, Artificial Sequence
  Synthetic Polynucleotide
taatacgactcactatagggcaaagctttgaagacttcttttgtgaaaccaacagaggagaggtttcatgaaagaagtcaacctggcggcagcgcaaaagatg

SEQ ID NO: 200183 - DNA, 103 bp, Artificial Sequence
  Synthetic Polynucleotide
taatacgactcactatagggtgtacaagtacaaagctttgaagacttcttaacagaggagaaagaagatgtcaaagcttaacctggcggcagcgcaaaagatg

SEQ ID NO: 200184 - DNA, 103 bp, Artificial Sequence
  Synthetic Polynucleotide
taatacgactcactatagggtgatgggttctgtacaagtacaaagctttgaacagaggagacaaagcatggtacttgtaaacctggcggcagcgcaaaagatg

SEQ ID NO: 200185 - DNA, 103 bp, Artificial Sequence
  Synthetic Polynucleotide
taatacgactcactatagggggaactttcctgatgggttctgtacaagtaaacagaggagatacttgatgagaacccataacctggcggcagcgcaaaagatg

SEQ ID NO: 200186 - DNA, 103 bp, Artificial Sequence
  Synthetic Polynucleotide
taatacgactcactataggggttaacacgttcatgtagaagcaagtaaggaacagaggagaccttacatgcttctacataacctggcggcagcgcaaaagatg

SEQ ID NO: 200187 - DNA, 103 bp, Artificial Sequence
  Synthetic Polynucleotide
taatacgactcactatagggcttagaaactggaactttcctgatgggttcaacagaggagagaacccatgaggaaagttaacctggcggcagcgcaaaagatg

SEQ ID NO: 200188 - DNA, 103 bp, Artificial Sequence
  Synthetic Polynucleotide
taatacgactcactatagggtcttaggggtcttagaaactggaactttccaacagaggagaggaaagatgcagtttctaaacctggcggcagcgcaaaagatg

SEQ ID NO: 200189 - DNA, 103 bp, Artificial Sequence
  Synthetic Polynucleotide
taatacgactcactataggggaatgagttttcttaggggtcttagaaactaacagaggagaagtttcatggacccctaaaacctggcggcagcgcaaaagatg

SEQ ID NO: 200190 - DNA, 103 bp, Artificial Sequence
  Synthetic Polynucleotide
taatacgactcactatagggtttggcatctgaatgagttttcttaggggtaacagaggagaacccctatgaaaactcataacctggcggcagcgcaaaagatg

SEQ ID NO: 200191 - DNA, 103 bp, Artificial Sequence
  Synthetic Polynucleotide
taatacgactcactatagggtctgtccttttttggcatctgaatgagtttaacagaggagaaaactcatgcagatgccaaacctggcggcagcgcaaaagatg

SEQ ID NO: 200192 - DNA, 103 bp, Artificial Sequence
  Synthetic Polynucleotide
taatacgactcactataggggaacttctattctgtccttttttggcatctaacagaggagaagatgcatgaaaaggacaaacctggcggcagcgcaaaagatg

SEQ ID NO: 200193 - DNA, 103 bp, Artificial Sequence
  Synthetic Polynucleotide
taatacgactcactatagggtaggtaatttgaacttctattctgtcctttaacagaggagaaaaggaatgaatagaagtaacctggcggcagcgcaaaagatg

SEQ ID NO: 200194 - DNA, 103 bp, Artificial Sequence
  Synthetic Polynucleotide
taatacgactcactatagggttctacaacttaggtaatttgaacttctataacagaggagaatagaaatgcaaattaccaacctggcggcagcgcaaaagatg

SEQ ID NO: 200195 - DNA, 103 bp, Artificial Sequence
  Synthetic Polynucleotide
taatacgactcactataggggcaggagttgttctacaacttaggtaatttaacagaggagaaaattaatgaagttgtagaacctggcggcagcgcaaaagatg

SEQ ID NO: 200196 - DNA, 103 bp, Artificial Sequence
  Synthetic Polynucleotide
taatacgactcactatagggcggcactatagcaggagttgttctacaactaacagaggagaagttgtatgacaactcctaacctggcggcagcgcaaaagatg

SEQ ID NO: 200197 - DNA, 103 bp, Artificial Sequence
  Synthetic Polynucleotide
taatacgactcactatagggcacataactcgttaacacgttcatgtagaaaacagaggagattctacatgaacgtgttaaacctggcggcagcgcaaaagatg

SEQ ID NO: 200198 - DNA, 103 bp, Artificial Sequence
  Synthetic Polynucleotide
taatacgactcactatagggatttctttggcggcactatagcaggagttgaacagaggagacaactcatgctatagtgcaacctggcggcagcgcaaaagatg

SEQ ID NO: 200199 - DNA, 103 bp, Artificial Sequence
  Synthetic Polynucleotide
taatacgactcactatagggcactgacgaaatttctttggcggcactataaacagaggagatatagtatggccaaagaaaacctggcggcagcgcaaaagatg

SEQ ID NO: 200200 - DNA, 103 bp, Artificial Sequence
  Synthetic Polynucleotide
taatacgactcactatagggtggctcaggacactgacgaaatttctttggaacagaggagaccaaagatgtttcgtcagaacctggcggcagcgcaaaagatg

SEQ ID NO: 200201 - DNA, 103 bp, Artificial Sequence
  Synthetic Polynucleotide
taatacgactcactatagggctgttgaagttggctcaggacactgacgaaaacagaggagattcgtcatggtcctgagcaacctggcggcagcgcaaaagatg

SEQ ID NO: 200202 - DNA, 103 bp, Artificial Sequence
  Synthetic Polynucleotide
taatacgactcactatagggagtttctcagctgttgaagttggctcaggaaacagaggagatcctgaatgaacttcaacaacctggcggcagcgcaaaagatg

SEQ ID NO: 200203 - DNA, 103 bp, Artificial Sequence
  Synthetic Polynucleotide
taatacgactcactatagggtttcaggccaagtttctcagctgttgaagtaacagaggagaacttcaatggctgagaaaaacctggcggcagcgcaaaagatg

SEQ ID NO: 200204 - DNA, 103 bp, Artificial Sequence
  Synthetic Polynucleotide
taatacgactcactataggggaggaccctttttcaggccaagtttctcagaacagaggagactgagaatgttggcctgaaacctggcggcagcgcaaaagatg

SEQ ID NO: 200205 - DNA, 103 bp, Artificial Sequence
  Synthetic Polynucleotide
taatacgactcactatagggtatgccttacgaggaccctttttcaggccaaacagaggagatggcctatgaaagggtccaacctggcggcagcgcaaaagatg

SEQ ID NO: 200206 - DNA, 103 bp, Artificial Sequence
  Synthetic Polynucleotide
taatacgactcactatagggggacaactcatatgccttacgaggacccttaacagaggagaaagggtatgcgtaaggcaaacctggcggcagcgcaaaagatg

SEQ ID NO: 200207 - DNA, 103 bp, Artificial Sequence
  Synthetic Polynucleotide
taatacgactcactatagggaagaccgctgggacaactcatatgccttacaacagaggagagtaaggatgatgagttgtaacctggcggcagcgcaaaagatg

SEQ ID NO: 200208 - DNA, 103 bp, Artificial Sequence
  Synthetic Polynucleotide
taatacgactcactatagggagtgcttcaacacataactcgttaacacgtaacagaggagaacgtgtatgcgagttatgaacctggcggcagcgcaaaagatg

SEQ ID NO: 200209 - DNA, 103 bp, Artificial Sequence
  Synthetic Polynucleotide
taatacgactcactatagggacataatccaaagaccgctgggacaactcaaacagaggagatgagttatgccagcggtcaacctggcggcagcgcaaaagatg

SEQ ID NO: 200210 - DNA, 103 bp, Artificial Sequence
  Synthetic Polynucleotide
taatacgactcactatagggtaattgagctacataatccaaagaccgctgaacagaggagacagcggatgttggattataacctggcggcagcgcaaaagatg

SEQ ID NO: 200211 - DNA, 103 bp, Artificial Sequence
  Synthetic Polynucleotide
taatacgactcactatagggcatgatcacgtaattgagctacataatccaaacagaggagatggattatgtagctcaataacctggcggcagcgcaaaagatg

SEQ ID NO: 200212 - DNA, 103 bp, Artificial Sequence
  Synthetic Polynucleotide
taatacgactcactatagggacagttttgccatgatcacgtaattgagctaacagaggagaagctcaatgacgtgatcaaacctggcggcagcgcaaaagatg

SEQ ID NO: 200213 - DNA, 103 bp, Artificial Sequence
  Synthetic Polynucleotide
taatacgactcactatagggaactactccaacagttttgccatgatcacgaacagaggagacgtgatatgggcaaaactaacctggcggcagcgcaaaagatg

SEQ ID NO: 200214 - DNA, 103 bp, Artificial Sequence
  Synthetic Polynucleotide
taatacgactcactatagggttcgggtatcaactactccaacagttttgcaacagaggagagcaaaaatgttggagtagaacctggcggcagcgcaaaagatg

SEQ ID NO: 200215 - DNA, 103 bp, Artificial Sequence
  Synthetic Polynucleotide
taatacgactcactatagggttagtcttttttcgggtatcaactactccaaacagaggagatggagtatgtgatacccgaacctggcggcagcgcaaaagatg

SEQ ID NO: 200216 - DNA, 103 bp, Artificial Sequence
  Synthetic Polynucleotide
taatacgactcactatagggagaaattaatttagtcttttttcgggtatcaacagaggagagataccatgaaaaagactaacctggcggcagcgcaaaagatg

SEQ ID NO: 200217 - DNA, 103 bp, Artificial Sequence
  Synthetic Polynucleotide
taatacgactcactatagggggttctgaggagaaattaatttagtcttttaacagaggagaaaaagaatgaattaatttaacctggcggcagcgcaaaagatg

SEQ ID NO: 200218 - DNA, 103 bp, Artificial Sequence
  Synthetic Polynucleotide
taatacgactcactatagggctgacagacaggttctgaggagaaattaataacagaggagaattaatatgtcctcagaaaacctggcggcagcgcaaaagatg

SEQ ID NO: 200219 - DNA, 103 bp, Artificial Sequence
  Synthetic Polynucleotide
taatacgactcactataggggcgctttaggaagtcaatggtggaagcaccaacagaggagaggtgctatgaccattgacaacctggcggcagcgcaaaagatg

SEQ ID NO: 200220 - DNA, 103 bp, Artificial Sequence
  Synthetic Polynucleotide
taatacgactcactatagggcatccgacaaagtgcttcaacacataactcaacagaggagagagttaatggttgaagcaaacctggcggcagcgcaaaagatg

SEQ ID NO: 200221 - DNA, 103 bp, Artificial Sequence
  Synthetic Polynucleotide
taatacgactcactatagggcttattatttctgacagacaggttctgaggaacagaggagacctcagatgctgtctgtcaacctggcggcagcgcaaaagatg

SEQ ID NO: 200222 - DNA, 103 bp, Artificial Sequence
  Synthetic Polynucleotide
taatacgactcactatagggtcagaagtttcttattatttctgacagacaaacagaggagatgtctgatggaaataataaacctggcggcagcgcaaaagatg

SEQ ID NO: 200223 - DNA, 103 bp, Artificial Sequence
  Synthetic Polynucleotide
taatacgactcactatagggtcttgactagtcagaagtttcttattatttaacagaggagaaaataaatggaaacttctaacctggcggcagcgcaaaagatg

SEQ ID NO: 200224 - DNA, 103 bp, Artificial Sequence
  Synthetic Polynucleotide
taatacgactcactatagggcatctgaagttcttgactagtcagaagtttaacagaggagaaaacttatgactagtcaaaacctggcggcagcgcaaaagatg

SEQ ID NO: 200225 - DNA, 103 bp, Artificial Sequence
  Synthetic Polynucleotide
taatacgactcactatagggtctgcctttgcatctgaagttcttgactagaacagaggagactagtcatgaacttcagaaacctggcggcagcgcaaaagatg

SEQ ID NO: 200226 - DNA, 103 bp, Artificial Sequence
  Synthetic Polynucleotide
taatacgactcactatagggttgggtctgatctgcctttgcatctgaagtaacagaggagaacttcaatggcaaaggcaaacctggcggcagcgcaaaagatg

SEQ ID NO: 200227 - DNA, 103 bp, Artificial Sequence
  Synthetic Polynucleotide
taatacgactcactatagggtttttgtgatttgggtctgatctgcctttgaacagaggagacaaaggatgatcagacccaacctggcggcagcgcaaaagatg

SEQ ID NO: 200228 - DNA, 103 bp, Artificial Sequence
  Synthetic Polynucleotide
taatacgactcactatagggttcgtctatttttttgtgatttgggtctgaaacagaggagatcagacatgaatcacaaaaacctggcggcagcgcaaaagatg

SEQ ID NO: 200229 - DNA, 103 bp, Artificial Sequence
  Synthetic Polynucleotide
taatacgactcactatagggtcagaaagtcttcgtctatttttttgtgataacagaggagaatcacaatgaaatagacgaacctggcggcagcgcaaaagatg

SEQ ID NO: 200230 - DNA, 103 bp, Artificial Sequence
  Synthetic Polynucleotide
taatacgactcactatagggactttcacaatcagaaagtcttcgtctattaacagaggagaaatagaatgagactttctaacctggcggcagcgcaaaagatg

SEQ ID NO: 200231 - DNA, 103 bp, Artificial Sequence
  Synthetic Polynucleotide
taatacgactcactatagggtggcttgttccatccgacaaagtgcttcaaaacagaggagattgaagatgtttgtcggaaacctggcggcagcgcaaaagatg

SEQ ID NO: 200232 - DNA, 103 bp, Artificial Sequence
  Synthetic Polynucleotide
taatacgactcactatagggtaacatctgtactttcacaatcagaaagtcaacagaggagagactttatgattgtgaaaaacctggcggcagcgcaaaagatg

SEQ ID NO: 200233 - DNA, 103 bp, Artificial Sequence
  Synthetic Polynucleotide
taatacgactcactatagggcctgctcttttaacatctgtactttcacaaaacagaggagattgtgaatgtacagatgtaacctggcggcagcgcaaaagatg

SEQ ID NO: 200234 - DNA, 103 bp, Artificial Sequence
  Synthetic Polynucleotide
taatacgactcactatagggtgtatgtgaccctgctcttttaacatctgtaacagaggagaacagatatgaaaagagcaaacctggcggcagcgcaaaagatg

SEQ ID NO: 200235 - DNA, 103 bp, Artificial Sequence
  Synthetic Polynucleotide
taatacgactcactatagggaattctgtgctgtatgtgaccctgctctttaacagaggagaaaagagatgggtcacataaacctggcggcagcgcaaaagatg

SEQ ID NO: 200236 - DNA, 103 bp, Artificial Sequence
  Synthetic Polynucleotide
taatacgactcactatagggaatatgtcagaattctgtgctgtatgtgacaacagaggagagtcacaatgagcacagaaaacctggcggcagcgcaaaagatg

SEQ ID NO: 200237 - DNA, 103 bp, Artificial Sequence
  Synthetic Polynucleotide
taatacgactcactatagggttctggtacaaatatgtcagaattctgtgcaacagaggagagcacagatgtctgacataaacctggcggcagcgcaaaagatg

SEQ ID NO: 200238 - DNA, 103 bp, Artificial Sequence
  Synthetic Polynucleotide
taatacgactcactatagggacctatcagattctggtacaaatatgtcagaacagaggagactgacaatgttgtaccagaacctggcggcagcgcaaaagatg

SEQ ID NO: 200239 - DNA, 103 bp, Artificial Sequence
  Synthetic Polynucleotide
taatacgactcactatagggttataatctgacctatcagattctggtacaaacagaggagatgtaccatgatctgatagaacctggcggcagcgcaaaagatg

SEQ ID NO: 200240 - DNA, 103 bp, Artificial Sequence
  Synthetic Polynucleotide
taatacgactcactatagggtcctgtacaattataatctgacctatcagaaacagaggagatctgatatgtcagattataacctggcggcagcgcaaaagatg

SEQ ID NO: 200241 - DNA, 103 bp, Artificial Sequence
  Synthetic Polynucleotide
taatacgactcactatagggcctcagttcctcctgtacaattataatctgaacagaggagacagattatgattgtacagaacctggcggcagcgcaaaagatg

SEQ ID NO: 200242 - DNA, 103 bp, Artificial Sequence
  Synthetic Polynucleotide
taatacgactcactatagggaaggagcaattggcttgttccatccgacaaaacagaggagattgtcgatgggaacaagcaacctggcggcagcgcaaaagatg

SEQ ID NO: 200243 - DNA, 103 bp, Artificial Sequence
  Synthetic Polynucleotide
taatacgactcactatagggttggcaagtacctcagttcctcctgtacaaaacagaggagattgtacatgaggaactgaaacctggcggcagcgcaaaagatg

SEQ ID NO: 200244 - DNA, 103 bp, Artificial Sequence
  Synthetic Polynucleotide
taatacgactcactatagggtctgttactgttggcaagtacctcagttccaacagaggagaggaactatggtacttgccaacctggcggcagcgcaaaagatg

SEQ ID NO: 200245 - DNA, 103 bp, Artificial Sequence
  Synthetic Polynucleotide
taatacgactcactatagggttaactgttttctgttactgttggcaagtaaacagaggagatacttgatgacagtaacaaacctggcggcagcgcaaaagatg

SEQ ID NO: 200246 - DNA, 103 bp, Artificial Sequence
  Synthetic Polynucleotide
taatacgactcactatagggatgcattttattaactgttttctgttactgaacagaggagacagtaaatgaaaacagttaacctggcggcagcgcaaaagatg

SEQ ID NO: 200247 - DNA, 103 bp, Artificial Sequence
  Synthetic Polynucleotide
taatacgactcactatagggttcagaaggcatgcattttattaactgtttaacagaggagaaaacagatgataaaatgcaacctggcggcagcgcaaaagatg

SEQ ID NO: 200248 - DNA, 103 bp, Artificial Sequence
  Synthetic Polynucleotide
taatacgactcactatagggtggtttctggttcagaaggcatgcattttaaacagaggagataaaatatgtgccttctgaacctggcggcagcgcaaaagatg

SEQ ID NO: 200249 - DNA, 103 bp, Artificial Sequence
  Synthetic Polynucleotide
taatacgactcactatagggtttgcttttatggtttctggttcagaaggcaacagaggagagccttcatgaccagaaacaacctggcggcagcgcaaaagatg

SEQ ID NO: 200250 - DNA, 103 bp, Artificial Sequence
  Synthetic Polynucleotide
taatacgactcactatagggagacccatgttttgcttttatggtttctggaacagaggagaccagaaatgataaaagcaaacctggcggcagcgcaaaagatg

SEQ ID NO: 200251 - DNA, 103 bp, Artificial Sequence
  Synthetic Polynucleotide
taatacgactcactatagggcagttgctggagacccatgttttgcttttaaacagaggagataaaagatgaacatgggtaacctggcggcagcgcaaaagatg

SEQ ID NO: 200252 - DNA, 103 bp, Artificial Sequence
  Synthetic Polynucleotide
taatacgactcactatagggcaagcatcatcagttgctggagacccatgtaacagaggagaacatggatgtccagcaacaacctggcggcagcgcaaaagatg

SEQ ID NO: 200253 - DNA, 103 bp, Artificial Sequence
  Synthetic Polynucleotide
taatacgactcactatagggaaacacctgaaaggagcaattggcttgttcaacagaggagagaacaaatgaattgctccaacctggcggcagcgcaaaagatg

SEQ ID NO: 200254 - DNA, 103 bp, Artificial Sequence
  Synthetic Polynucleotide
taatacgactcactataggggttcaaagggcaagcatcatcagttgctggaacagaggagaccagcaatggatgatgctaacctggcggcagcgcaaaagatg

SEQ ID NO: 200255 - DNA, 103 bp, Artificial Sequence
  Synthetic Polynucleotide
taatacgactcactatagggaatcacactggttcaaagggcaagcatcataacagaggagaatgatgatggccctttgaaacctggcggcagcgcaaaagatg

SEQ ID NO: 200256 - DNA, 103 bp, Artificial Sequence
  Synthetic Polynucleotide
taatacgactcactatagggaacactacagaatcacactggttcaaagggaacagaggagaccctttatgccagtgtgaaacctggcggcagcgcaaaagatg

SEQ ID NO: 200257 - DNA, 103 bp, Artificial Sequence
  Synthetic Polynucleotide
taatacgactcactatagggtgttccatttaacactacagaatcacactgaacagaggagacagtgtatgtctgtagtgaacctggcggcagcgcaaaagatg

SEQ ID NO: 200258 - DNA, 103 bp, Artificial Sequence
  Synthetic Polynucleotide
taatacgactcactatagggttgttggtactgttccatttaacactacagaacagaggagactgtagatgtaaatggaaaacctggcggcagcgcaaaagatg

SEQ ID NO: 200259 - DNA, 103 bp, Artificial Sequence
  Synthetic Polynucleotide
taatacgactcactatagggattacttcatttgttggtactgttccatttaacagaggagaaaatggatgagtaccaacaacctggcggcagcgcaaaagatg

SEQ ID NO: 200260 - DNA, 103 bp, Artificial Sequence
  Synthetic Polynucleotide
taatacgactcactatagggagtggagacaattacttcatttgttggtacaacagaggagagtaccaatgaatgaagtaaacctggcggcagcgcaaaagatg

SEQ ID NO: 200261 - DNA, 103 bp, Artificial Sequence
  Synthetic Polynucleotide
taatacgactcactatagggggtcttctgaagtggagacaattacttcataacagaggagaatgaagatgttgtctccaaacctggcggcagcgcaaaagatg

SEQ ID NO: 200262 - DNA, 103 bp, Artificial Sequence
  Synthetic Polynucleotide
taatacgactcactatagggccacccagagggtcttctgaagtggagacaaacagaggagatgtctcatgttcagaagaaacctggcggcagcgcaaaagatg

SEQ ID NO: 200263 - DNA, 103 bp, Artificial Sequence
  Synthetic Polynucleotide
taatacgactcactatagggtggatcacctccacccagagggtcttctgaaacagaggagatcagaaatgcctctgggtaacctggcggcagcgcaaaagatg

SEQ ID NO: 200264 - DNA, 103 bp, Artificial Sequence
  Synthetic Polynucleotide
taatacgactcactataggggatgtttatcaaacacctgaaaggagcaataacagaggagaattgctatgttcaggtgtaacctggcggcagcgcaaaagatg

SEQ ID NO: 200265 - DNA, 103 bp, Artificial Sequence
  Synthetic Polynucleotide
taatacgactcactataggggacgtgctgttggatcacctccacccagagaacagaggagactctggatggaggtgatcaacctggcggcagcgcaaaagatg

SEQ ID NO: 200266 - DNA, 103 bp, Artificial Sequence
  Synthetic Polynucleotide
taatacgactcactatagggatctctatatgacgtgctgttggatcacctaacagaggagaaggtgaatgaacagcacgaacctggcggcagcgcaaaagatg

SEQ ID NO: 200267 - DNA, 103 bp, Artificial Sequence
  Synthetic Polynucleotide
taatacgactcactatagggcaaagctgccatctctatatgacgtgctgtaacagaggagaacagcaatgcatatagagaacctggcggcagcgcaaaagatg

SEQ ID NO: 200268 - DNA, 103 bp, Artificial Sequence
  Synthetic Polynucleotide
taatacgactcactatagggctccttctttcaaagctgccatctctatataacagaggagaatatagatgtggcagcttaacctggcggcagcgcaaaagatg

SEQ ID NO: 200269 - DNA, 103 bp, Artificial Sequence
  Synthetic Polynucleotide
taatacgactcactataggggagtcaggctctccttctttcaaagctgccaacagaggagaggcagcatggaaagaaggaacctggcggcagcgcaaaagatg

SEQ ID NO: 200270 - DNA, 103 bp, Artificial Sequence
  Synthetic Polynucleotide
taatacgactcactatagggatcactgctggagtcaggctctccttctttaacagaggagaaaagaaatggagcctgacaacctggcggcagcgcaaaagatg

SEQ ID NO: 200271 - DNA, 103 bp, Artificial Sequence
  Synthetic Polynucleotide
taatacgactcactatagggcttcctctgcatcactgctggagtcaggctaacagaggagaagcctgatgccagcagtgaacctggcggcagcgcaaaagatg

SEQ ID NO: 200272 - DNA, 103 bp, Artificial Sequence
  Synthetic Polynucleotide
taatacgactcactatagggaataagttatcttcctctgcatcactgctgaacagaggagacagcagatgtgcagaggaaacctggcggcagcgcaaaagatg

SEQ ID NO: 200273 - DNA, 103 bp, Artificial Sequence
  Synthetic Polynucleotide
taatacgactcactatagggttgggttaaaaataagttatcttcctctgcaacagaggagagcagagatggataacttaaacctggcggcagcgcaaaagatg

SEQ ID NO: 200274 - DNA, 103 bp, Artificial Sequence
  Synthetic Polynucleotide
taatacgactcactatagggcaggatcattttgggttaaaaataagttataacagaggagaataactatgttttaacccaacctggcggcagcgcaaaagatg

SEQ ID NO: 200275 - DNA, 103 bp, Artificial Sequence
  Synthetic Polynucleotide
taatacgactcactatagggtagatccctggatgtttatcaaacacctgaaacagaggagatcaggtatgtgataaacaaacctggcggcagcgcaaaagatg

SEQ ID NO: 200276 - DNA, 103 bp, Artificial Sequence
  Synthetic Polynucleotide
taatacgactcactatagggtccatatcttcaggatcattttgggttaaaaacagaggagatttaacatgaaatgatccaacctggcggcagcgcaaaagatg

SEQ ID NO: 200277 - DNA, 103 bp, Artificial Sequence
  Synthetic Polynucleotide
taatacgactcactatagggtgaacataaatccatatcttcaggatcattaacagaggagaaatgatatggaagatatgaacctggcggcagcgcaaaagatg

SEQ ID NO: 200278 - DNA, 103 bp, Artificial Sequence
  Synthetic Polynucleotide
taatacgactcactatagggtctccatttgtgaacataaatccatatcttaacagaggagaaagataatgatttatgttaacctggcggcagcgcaaaagatg

SEQ ID NO: 200279 - DNA, 103 bp, Artificial Sequence
  Synthetic Polynucleotide
taatacgactcactatagggtaattgtcattctccatttgtgaacataaaaacagaggagatttatgatgacaaatggaaacctggcggcagcgcaaaagatg

SEQ ID NO: 200280 - DNA, 103 bp, Artificial Sequence
  Synthetic Polynucleotide
taatacgactcactatagggaatgagtttataattgtcattctccatttgaacagaggagacaaatgatgaatgacaataacctggcggcagcgcaaaagatg

SEQ ID NO: 200281 - DNA, 103 bp, Artificial Sequence
  Synthetic Polynucleotide
taatacgactcactataggggaattagttcaatgagtttataattgtcataacagaggagaatgacaatgataaactcaaacctggcggcagcgcaaaagatg

SEQ ID NO: 200282 - DNA, 103 bp, Artificial Sequence
  Synthetic Polynucleotide
taatacgactcactatagggtcttttccatgaattagttcaatgagtttaaacagaggagataaactatgtgaactaataacctggcggcagcgcaaaagatg

SEQ ID NO: 200283 - DNA, 103 bp, Artificial Sequence
  Synthetic Polynucleotide
taatacgactcactatagggctcaactgtatcttttccatgaattagttcaacagaggagagaactaatgcatggaaaaaacctggcggcagcgcaaaagatg

SEQ ID NO: 200284 - DNA, 103 bp, Artificial Sequence
  Synthetic Polynucleotide
taatacgactcactatagggcttcttcaacctcaactgtatcttttccataacagaggagaatggaaatgatacagttgaacctggcggcagcgcaaaagatg

SEQ ID NO: 200285 - DNA, 103 bp, Artificial Sequence
  Synthetic Polynucleotide
taatacgactcactatagggcttacagaatcttcttcaacctcaactgtaaacagaggagatacagtatgggttgaagaaacctggcggcagcgcaaaagatg

SEQ ID NO: 200286 - DNA, 103 bp, Artificial Sequence
  Synthetic Polynucleotide
taatacgactcactatagggtaaaaacaaatagatccctggatgtttatcaacagaggagagataaaatgccagggatcaacctggcggcagcgcaaaagatg

SEQ ID NO: 200287 - DNA, 103 bp, Artificial Sequence
  Synthetic Polynucleotide
taatacgactcactatagggctgaggccgacttacagaatcttcttcaacaacagaggagagttgaaatggattctgtaaacctggcggcagcgcaaaagatg

SEQ ID NO: 200288 - DNA, 103 bp, Artificial Sequence
  Synthetic Polynucleotide
taatacgactcactatagggaagattccaactgaggccgacttacagaataacagaggagaattctgatggtcggcctcaacctggcggcagcgcaaaagatg

SEQ ID NO: 200289 - DNA, 103 bp, Artificial Sequence
  Synthetic Polynucleotide
taatacgactcactataggggtgccactcaaagattccaactgaggccgaaacagaggagatcggccatggttggaatcaacctggcggcagcgcaaaagatg

SEQ ID NO: 200290 - DNA, 103 bp, Artificial Sequence
  Synthetic Polynucleotide
taatacgactcactatagggcttacactttgtgccactcaaagattccaaaacagaggagattggaaatgttgagtggcaacctggcggcagcgcaaaagatg

SEQ ID NO: 200291 - DNA, 103 bp, Artificial Sequence
  Synthetic Polynucleotide
taatacgactcactatagggaatctttgtacttacactttgtgccactcaaacagaggagatgagtgatgcaaagtgtaaacctggcggcagcgcaaaagatg

SEQ ID NO: 200292 - DNA, 103 bp, Artificial Sequence
  Synthetic Polynucleotide
taatacgactcactataggggtttcaagacaatctttgtacttacactttaacagaggagaaaagtgatggtacaaagaaacctggcggcagcgcaaaagatg

SEQ ID NO: 200293 - DNA, 103 bp, Artificial Sequence
  Synthetic Polynucleotide
taatacgactcactataggggttttttgtggtttcaagacaatctttgtaaacagaggagatacaaaatgtgtcttgaaaacctggcggcagcgcaaaagatg

SEQ ID NO: 200294 - DNA, 103 bp, Artificial Sequence
  Synthetic Polynucleotide
taatacgactcactatagggattcaccctggttttttgtggtttcaagacaacagaggagagtcttgatgccacaaaaaaacctggcggcagcgcaaaagatg

SEQ ID NO: 200295 - DNA, 103 bp, Artificial Sequence
  Synthetic Polynucleotide
taatacgactcactatagggtttgggcagtattcaccctggttttttgtgaacagaggagacacaaaatgccagggtgaaacctggcggcagcgcaaaagatg

SEQ ID NO: 200296 - DNA, 103 bp, Artificial Sequence
  Synthetic Polynucleotide
taatacgactcactatagggttcagagtgttttgggcagtattcaccctgaacagaggagacagggtatgtactgcccaaacctggcggcagcgcaaaagatg

SEQ ID NO: 200297 - DNA, 103 bp, Artificial Sequence
  Synthetic Polynucleotide
taatacgactcactatagggtgggatggactaaaaacaaatagatccctgaacagaggagacagggaatgatttgttttaacctggcggcagcgcaaaagatg

SEQ ID NO: 200298 - DNA, 103 bp, Artificial Sequence
  Synthetic Polynucleotide
taatacgactcactatagggctgctttcacttcagagtgttttgggcagtaacagaggagaactgccatgaacactctgaacctggcggcagcgcaaaagatg

SEQ ID NO: 200299 - DNA, 103 bp, Artificial Sequence
  Synthetic Polynucleotide
taatacgactcactatagggtcttcatctgctgctttcacttcagagtgtaacagaggagaacactcatgagtgaaagcaacctggcggcagcgcaaaagatg

SEQ ID NO: 200300 - DNA, 103 bp, Artificial Sequence
  Synthetic Polynucleotide
taatacgactcactatagggacgaaatacatcttcatctgctgctttcacaacagaggagagtgaaaatggcagatgaaaacctggcggcagcgcaaaagatg

SEQ ID NO: 200301 - DNA, 103 bp, Artificial Sequence
  Synthetic Polynucleotide
taatacgactcactatagggagccaggtttacgaaatacatcttcatctgaacagaggagacagatgatgatgtatttcaacctggcggcagcgcaaaagatg

SEQ ID NO: 200302 - DNA, 103 bp, Artificial Sequence
  Synthetic Polynucleotide
taatacgactcactatagggggaggaggcaagccaggtttacgaaatacaaacagaggagatgtattatgtaaacctggaacctggcggcagcgcaaaagatg

SEQ ID NO: 200303 - DNA, 103 bp, Artificial Sequence
  Synthetic Polynucleotide
taatacgactcactatagggtttagatgcaggaggaggcaagccaggtttaacagaggagaaaacctatgttgcctcctaacctggcggcagcgcaaaagatg

SEQ ID NO: 200304 - DNA, 103 bp, Artificial Sequence
  Synthetic Polynucleotide
taatacgactcactataggggtctcaaaggtttagatgcaggaggaggcaaacagaggagatgcctcatgctgcatctaaacctggcggcagcgcaaaagatg

SEQ ID NO: 200305 - DNA, 103 bp, Artificial Sequence
  Synthetic Polynucleotide
taatacgactcactatagggttagtggtaggtctcaaaggtttagatgcaaacagaggagatgcatcatgacctttgagaacctggcggcagcgcaaaagatg

SEQ ID NO: 200306 - DNA, 103 bp, Artificial Sequence
  Synthetic Polynucleotide
taatacgactcactataggggctaaaaatcttagtggtaggtctcaaaggaacagaggagacctttgatgcctaccactaacctggcggcagcgcaaaagatg

SEQ ID NO: 200307 - DNA, 103 bp, Artificial Sequence
  Synthetic Polynucleotide
taatacgactcactatagggtactctttgagctaaaaatcttagtggtagaacagaggagactaccaatgagatttttaaacctggcggcagcgcaaaagatg

SEQ ID NO: 200308 - DNA, 103 bp, Artificial Sequence
  Synthetic Polynucleotide
taatacgactcactatagggaccatttcattgggatggactaaaaacaaaaacagaggagatttgttatgagtccatccaacctggcggcagcgcaaaagatg

SEQ ID NO: 200309 - DNA, 103 bp, Artificial Sequence
  Synthetic Polynucleotide
taatacgactcactatagggattcgtgaagtactctttgagctaaaaatcaacagaggagagattttatgctcaaagagaacctggcggcagcgcaaaagatg

SEQ ID NO: 200310 - DNA, 103 bp, Artificial Sequence
  Synthetic Polynucleotide
taatacgactcactatagggaagaccagcaattcgtgaagtactctttgaaacagaggagatcaaagatgacttcacgaaacctggcggcagcgcaaaagatg

SEQ ID NO: 200311 - DNA, 103 bp, Artificial Sequence
  Synthetic Polynucleotide
taatacgactcactatagggaagatttagaaagaccagcaattcgtgaagaacagaggagacttcacatgttgctggtcaacctggcggcagcgcaaaagatg

SEQ ID NO: 200312 - DNA, 103 bp, Artificial Sequence
  Synthetic Polynucleotide
taatacgactcactataggggaagtttccaaagatttagaaagaccagcaaacagaggagatgctggatgttctaaatcaacctggcggcagcgcaaaagatg

SEQ ID NO: 200313 - DNA, 103 bp, Artificial Sequence
  Synthetic Polynucleotide
taatacgactcactatagggaagtgctgaagaagtttccaaagatttagaaacagaggagatctaaaatgttggaaactaacctggcggcagcgcaaaagatg

SEQ ID NO: 200314 - DNA, 103 bp, Artificial Sequence
  Synthetic Polynucleotide
taatacgactcactataggggagacggtgaaagtgctgaagaagtttccaaacagaggagatggaaaatgcttcagcacaacctggcggcagcgcaaaagatg

SEQ ID NO: 200315 - DNA, 103 bp, Artificial Sequence
  Synthetic Polynucleotide
taatacgactcactatagggttattttttagagacggtgaaagtgctgaaaacagaggagattcagcatgttcaccgtcaacctggcggcagcgcaaaagatg

SEQ ID NO: 200316 - DNA, 103 bp, Artificial Sequence
  Synthetic Polynucleotide
taatacgactcactatagggcccctttgacttattttttagagacggtgaaacagaggagatcaccgatgctaaaaaataacctggcggcagcgcaaaagatg

SEQ ID NO: 200317 - DNA, 103 bp, Artificial Sequence
  Synthetic Polynucleotide
taatacgactcactatagggtcgactgtatcccctttgacttattttttaaacagaggagataaaaaatgagtcaaaggaacctggcggcagcgcaaaagatg

SEQ ID NO: 200318 - DNA, 103 bp, Artificial Sequence
  Synthetic Polynucleotide
taatacgactcactatagggactttcaaaatcgactgtatcccctttgacaacagaggagagtcaaaatggatacagtcaacctggcggcagcgcaaaagatg

SEQ ID NO: 200319 - DNA, 103 bp, Artificial Sequence
  Synthetic Polynucleotide
taatacgactcactatagggccaacgccgaaccatttcattgggatggacaacagaggagagtccatatgaatgaaatgaacctggcggcagcgcaaaagatg

SEQ ID NO: 200320 - DNA, 103 bp, Artificial Sequence
  Synthetic Polynucleotide
taatacgactcactatagggtggctgtggtactttcaaaatcgactgtataacagaggagaatacagatgattttgaaaaacctggcggcagcgcaaaagatg

SEQ ID NO: 200321 - DNA, 103 bp, Artificial Sequence
  Synthetic Polynucleotide
taatacgactcactatagggtgaggggaactggctgtggtactttcaaaaaacagaggagattttgaatgtaccacagcaacctggcggcagcgcaaaagatg

SEQ ID NO: 200322 - DNA, 103 bp, Artificial Sequence
  Synthetic Polynucleotide
taatacgactcactatagggttctgagctatgaggggaactggctgtggtaacagaggagaaccacaatgagttcccctaacctggcggcagcgcaaaagatg

SEQ ID NO: 200323 - DNA, 103 bp, Artificial Sequence
  Synthetic Polynucleotide
taatacgactcactatagggaccaactggcttctgagctatgaggggaacaacagaggagagttcccatgatagctcagaacctggcggcagcgcaaaagatg

SEQ ID NO: 200324 - DNA, 103 bp, Artificial Sequence
  Synthetic Polynucleotide
taatacgactcactatagggtcttcatttcaccaactggcttctgagctaaacagaggagatagctcatgagccagttgaacctggcggcagcgcaaaagatg

SEQ ID NO: 200325 - DNA, 103 bp, Artificial Sequence
  Synthetic Polynucleotide
taatacgactcactatagggttgcacgaattcttcatttcaccaactggcaacagaggagagccagtatgtgaaatgaaaacctggcggcagcgcaaaagatg

SEQ ID NO: 200326 - DNA, 103 bp, Artificial Sequence
  Synthetic Polynucleotide
taatacgactcactatagggatgaagaacattgcacgaattcttcatttcaacagaggagagaaatgatgaattcgtgcaacctggcggcagcgcaaaagatg

SEQ ID NO: 200327 - DNA, 103 bp, Artificial Sequence
  Synthetic Polynucleotide
taatacgactcactataggggagactgaggatgaagaacattgcacgaataacagaggagaattcgtatgatgttcttcaacctggcggcagcgcaaaagatg

SEQ ID NO: 200328 - DNA, 103 bp, Artificial Sequence
  Synthetic Polynucleotide
taatacgactcactataggggaattattcggagactgaggatgaagaacaaacagaggagatgttctatgtcctcagtcaacctggcggcagcgcaaaagatg

SEQ ID NO: 200329 - DNA, 103 bp, Artificial Sequence
  Synthetic Polynucleotide
taatacgactcactatagggttgcctgttggaattattcggagactgaggaacagaggagacctcagatgccgaataataacctggcggcagcgcaaaagatg

SEQ ID NO: 200330 - DNA, 103 bp, Artificial Sequence
  Synthetic Polynucleotide
taatacgactcactatagggtggaagcatagcgctttaggaagtcaatggaacagaggagaccattgatgtcctaaagcaacctggcggcagcgcaaaagatg

SEQ ID NO: 200331 - DNA, 103 bp, Artificial Sequence
  Synthetic Polynucleotide
taatacgactcactatagggtcaagatagcccaacgccgaaccatttcataacagaggagaatgaaaatgttcggcgttaacctggcggcagcgcaaaagatg

SEQ ID NO: 200332 - DNA, 103 bp, Artificial Sequence
  Synthetic Polynucleotide
taatacgactcactatagggctttgcaaccttgcctgttggaattattcgaacagaggagacgaataatgccaacaggcaacctggcggcagcgcaaaagatg

SEQ ID NO: 200333 - DNA, 103 bp, Artificial Sequence
  Synthetic Polynucleotide
taatacgactcactatagggccaaatggaactttgcaaccttgcctgttgaacagaggagacaacagatgaggttgcaaaacctggcggcagcgcaaaagatg

SEQ ID NO: 200334 - DNA, 103 bp, Artificial Sequence
  Synthetic Polynucleotide
taatacgactcactatagggtttgctttcaccaaatggaactttgcaaccaacagaggagaggttgcatggttccatttaacctggcggcagcgcaaaagatg

SEQ ID NO: 200335 - DNA, 103 bp, Artificial Sequence
  Synthetic Polynucleotide
taatacgactcactatagggatggaaaatatttgctttcaccaaatggaaaacagaggagattccatatggtgaaagcaaacctggcggcagcgcaaaagatg

SEQ ID NO: 200336 - DNA, 103 bp, Artificial Sequence
  Synthetic Polynucleotide
taatacgactcactatagggggagaggaagatggaaaatatttgctttcaaacagaggagatgaaagatgatattttccaacctggcggcagcgcaaaagatg

SEQ ID NO: 200337 - DNA, 103 bp, Artificial Sequence
  Synthetic Polynucleotide
taatacgactcactatagggaatgtttactggagaggaagatggaaaataaacagaggagatattttatgtcttcctctaacctggcggcagcgcaaaagatg

SEQ ID NO: 200338 - DNA, 103 bp, Artificial Sequence
  Synthetic Polynucleotide
taatacgactcactatagggatgacaaaagaatgtttactggagaggaagaacagaggagacttcctatgcagtaaacaaacctggcggcagcgcaaaagatg

SEQ ID NO: 200339 - DNA, 103 bp, Artificial Sequence
  Synthetic Polynucleotide
taatacgactcactatagggacagactgtgatgacaaaagaatgtttactaacagaggagaagtaaaatgtcttttgtcaacctggcggcagcgcaaaagatg

SEQ ID NO: 200340 - DNA, 103 bp, Artificial Sequence
  Synthetic Polynucleotide
taatacgactcactatagggggtgtcagagacagactgtgatgacaaaagaacagaggagacttttgatgtcacagtctaacctggcggcagcgcaaaagatg

SEQ ID NO: 200341 - DNA, 103 bp, Artificial Sequence
  Synthetic Polynucleotide
taatacgactcactatagggctttaacgaaggtgtcagagacagactgtgaacagaggagacacagtatgtctctgacaaacctggcggcagcgcaaaagatg

SEQ ID NO: 200342 - DNA, 103 bp, Artificial Sequence
  Synthetic Polynucleotide
taatacgactcactatagggtttcttgcagtcaagatagcccaacgccgaaacagaggagatcggcgatgggctatcttaacctggcggcagcgcaaaagatg

SEQ ID NO: 200343 - DNA, 103 bp, Artificial Sequence
  Synthetic Polynucleotide
taatacgactcactatagggtttaagacctctttaacgaaggtgtcagagaacagaggagactctgaatgcttcgttaaaacctggcggcagcgcaaaagatg

SEQ ID NO: 200344 - DNA, 103 bp, Artificial Sequence
  Synthetic Polynucleotide
taatacgactcactatagggatatttccattttaagacctctttaacgaaaacagaggagattcgttatggaggtcttaaacctggcggcagcgcaaaagatg

SEQ ID NO: 200345 - DNA, 103 bp, Artificial Sequence
  Synthetic Polynucleotide
taatacgactcactatagggaaaacatttcatatttccattttaagacctaacagaggagaaggtctatgaatggaaataacctggcggcagcgcaaaagatg

SEQ ID NO: 200346 - DNA, 103 bp, Artificial Sequence
  Synthetic Polynucleotide
taatacgactcactatagggccaaagttcaaaaacatttcatatttccataacagaggagaatggaaatgtgaaatgttaacctggcggcagcgcaaaagatg

SEQ ID NO: 200347 - DNA, 103 bp, Artificial Sequence
  Synthetic Polynucleotide
taatacgactcactatagggcccacactgaccaaagttcaaaaacatttcaacagaggagagaaatgatgttgaactttaacctggcggcagcgcaaaagatg

SEQ ID NO: 200348 - DNA, 103 bp, Artificial Sequence
  Synthetic Polynucleotide
taatacgactcactatagggttgcagggggcccacactgaccaaagttcaaacagaggagatgaactatggtcagtgtgaacctggcggcagcgcaaaagatg

SEQ ID NO: 200349 - DNA, 103 bp, Artificial Sequence
  Synthetic Polynucleotide
taatacgactcactatagggtgacaaagacttgcagggggcccacactgaaacagaggagatcagtgatggccccctgcaacctggcggcagcgcaaaagatg

SEQ ID NO: 200350 - DNA, 103 bp, Artificial Sequence
  Synthetic Polynucleotide
taatacgactcactatagggtgagatggactgacaaagacttgcagggggaacagaggagaccccctatgagtctttgtaacctggcggcagcgcaaaagatg

SEQ ID NO: 200351 - DNA, 103 bp, Artificial Sequence
  Synthetic Polynucleotide
taatacgactcactataggggcacaggtcttgagatggactgacaaagacaacagaggagagtctttatgagtccatctaacctggcggcagcgcaaaagatg

SEQ ID NO: 200352 - DNA, 103 bp, Artificial Sequence
  Synthetic Polynucleotide
taatacgactcactatagggaatctgacaggcacaggtcttgagatggacaacagaggagagtccatatgaagacctgtaacctggcggcagcgcaaaagatg

SEQ ID NO: 200353 - DNA, 103 bp, Artificial Sequence
  Synthetic Polynucleotide
taatacgactcactatagggtttccccaagtttcttgcagtcaagatagcaacagaggagagctatcatgactgcaagaaacctggcggcagcgcaaaagatg

SEQ ID NO: 200354 - DNA, 103 bp, Artificial Sequence
  Synthetic Polynucleotide
taatacgactcactatagggataattgtgaaatctgacaggcacaggtctaacagaggagaagacctatgcctgtcagaaacctggcggcagcgcaaaagatg

SEQ ID NO: 200355 - DNA, 103 bp, Artificial Sequence
  Synthetic Polynucleotide
taatacgactcactatagggaataatctccataattgtgaaatctgacagaacagaggagactgtcaatgttcacaattaacctggcggcagcgcaaaagatg

SEQ ID NO: 200356 - DNA, 103 bp, Artificial Sequence
  Synthetic Polynucleotide
taatacgactcactatagggaaaacattaaaataatctccataattgtgaaacagaggagatcacaaatgtggagattaaacctggcggcagcgcaaaagatg

SEQ ID NO: 200357 - DNA, 103 bp, Artificial Sequence
  Synthetic Polynucleotide
taatacgactcactatagggcaaagggaaaaaaacattaaaataatctccaacagaggagaggagatatgtttaatgttaacctggcggcagcgcaaaagatg

SEQ ID NO: 200358 - DNA, 103 bp, Artificial Sequence
  Synthetic Polynucleotide
taatacgactcactatagggtcaataccatcaaagggaaaaaaacattaaaacagaggagattaatgatgttttcccttaacctggcggcagcgcaaaagatg

SEQ ID NO: 200359 - DNA, 103 bp, Artificial Sequence
  Synthetic Polynucleotide
taatacgactcactatagggtcaaaagtattcaataccatcaaagggaaaaacagaggagatttcccatggatggtattaacctggcggcagcgcaaaagatg

SEQ ID NO: 200360 - DNA, 103 bp, Artificial Sequence
  Synthetic Polynucleotide
taatacgactcactatagggtgccactgtttcaaaagtattcaataccataacagaggagaatggtaatgaatacttttaacctggcggcagcgcaaaagatg

SEQ ID NO: 200361 - DNA, 103 bp, Artificial Sequence
  Synthetic Polynucleotide
taatacgactcactataggggccattcttgtgccactgtttcaaaagtataacagaggagaatacttatgaaacagtggaacctggcggcagcgcaaaagatg

SEQ ID NO: 200362 - DNA, 103 bp, Artificial Sequence
  Synthetic Polynucleotide
taatacgactcactatagggggagagttgagccattcttgtgccactgttaacagaggagaaacagtatgacaagaatgaacctggcggcagcgcaaaagatg

SEQ ID NO: 200363 - DNA, 103 bp, Artificial Sequence
  Synthetic Polynucleotide
taatacgactcactatagggctctctatttggagagttgagccattcttgaacagaggagacaagaaatgctcaactctaacctggcggcagcgcaaaagatg

SEQ ID NO: 200364 - DNA, 103 bp, Artificial Sequence
  Synthetic Polynucleotide
taatacgactcactatagggctctgtccactttccccaagtttcttgcagaacagaggagactgcaaatgacttggggaaacctggcggcagcgcaaaagatg

SEQ ID NO: 200365 - DNA, 103 bp, Artificial Sequence
  Synthetic Polynucleotide
taatacgactcactataggggatagaaattctctctatttggagagttgaaacagaggagatcaactatgcaaatagagaacctggcggcagcgcaaaagatg

SEQ ID NO: 200366 - DNA, 103 bp, Artificial Sequence
  Synthetic Polynucleotide
taatacgactcactatagggacttgcaactgatagaaattctctctatttaacagaggagaaaatagatggaatttctaaacctggcggcagcgcaaaagatg

SEQ ID NO: 200367 - DNA, 103 bp, Artificial Sequence
  Synthetic Polynucleotide
taatacgactcactatagggaaattttcgtacttgcaactgatagaaattaacagaggagaaatttcatgcagttgcaaaacctggcggcagcgcaaaagatg

SEQ ID NO: 200368 - DNA, 103 bp, Artificial Sequence
  Synthetic Polynucleotide
taatacgactcactatagggaatcggcaggaaattttcgtacttgcaactaacagaggagaagttgcatgtacgaaaataacctggcggcagcgcaaaagatg

SEQ ID NO: 200369 - DNA, 103 bp, Artificial Sequence
  Synthetic Polynucleotide
taatacgactcactatagggtattttatataatcggcaggaaattttcgtaacagaggagaacgaaaatgtcctgccgaaacctggcggcagcgcaaaagatg

SEQ ID NO: 200370 - DNA, 103 bp, Artificial Sequence
  Synthetic Polynucleotide
taatacgactcactatagggaaactcccagtattttatataatcggcaggaacagaggagacctgccatgtatataaaaaacctggcggcagcgcaaaagatg

SEQ ID NO: 200371 - DNA, 103 bp, Artificial Sequence
  Synthetic Polynucleotide
taatacgactcactataggggataaactgcaaactcccagtattttatataacagaggagaatataaatgactgggagtaacctggcggcagcgcaaaagatg

SEQ ID NO: 200372 - DNA, 103 bp, Artificial Sequence
  Synthetic Polynucleotide
taatacgactcactatagggcattcttccagataaactgcaaactcccagaacagaggagactgggaatgtgcagtttaaacctggcggcagcgcaaaagatg

SEQ ID NO: 200373 - DNA, 103 bp, Artificial Sequence
  Synthetic Polynucleotide
taatacgactcactatagggagccagttcacattcttccagataaactgcaacagaggagagcagttatgctggaagaaaacctggcggcagcgcaaaagatg

SEQ ID NO: 200374 - DNA, 103 bp, Artificial Sequence
  Synthetic Polynucleotide
taatacgactcactatagggaaagctgtttagccagttcacattcttccaaacagaggagatggaagatggtgaactggaacctggcggcagcgcaaaagatg

SEQ ID NO: 200375 - DNA, 103 bp, Artificial Sequence
  Synthetic Polynucleotide
taatacgactcactatagggtaataatcatctctgtccactttccccaagaacagaggagacttgggatgagtggacagaacctggcggcagcgcaaaagatg

SEQ ID NO: 200376 - DNA, 103 bp, Artificial Sequence
  Synthetic Polynucleotide
taatacgactcactatagggtcctttggataaagctgtttagccagttcaaacagaggagatgaactatgtaaacagctaacctggcggcagcgcaaaagatg

SEQ ID NO: 200377 - DNA, 103 bp, Artificial Sequence
  Synthetic Polynucleotide
taatacgactcactatagggcaaatcgttttcctttggataaagctgtttaacagaggagaaaacagatgtatccaaagaacctggcggcagcgcaaaagatg

SEQ ID NO: 200378 - DNA, 103 bp, Artificial Sequence
  Synthetic Polynucleotide
taatacgactcactatagggctaaaaacaccaaatcgttttcctttggataacagaggagaatccaaatgaaaacgattaacctggcggcagcgcaaaagatg

SEQ ID NO: 200379 - DNA, 103 bp, Artificial Sequence
  Synthetic Polynucleotide
taatacgactcactatagggctctcaggagctaaaaacaccaaatcgtttaacagaggagaaaacgaatgggtgtttttaacctggcggcagcgcaaaagatg

SEQ ID NO: 200380 - DNA, 103 bp, Artificial Sequence
  Synthetic Polynucleotide
taatacgactcactatagggttcatttattctctcaggagctaaaaacacaacagaggagagtgtttatggctcctgagaacctggcggcagcgcaaaagatg

SEQ ID NO: 200381 - DNA, 103 bp, Artificial Sequence
  Synthetic Polynucleotide
taatacgactcactatagggctttcttctcttcatttattctctcaggagaacagaggagactcctgatggaataaatgaacctggcggcagcgcaaaagatg

SEQ ID NO: 200382 - DNA, 103 bp, Artificial Sequence
  Synthetic Polynucleotide
taatacgactcactatagggctctctgtatctttcttctcttcatttattaacagaggagaaataaaatgagagaagaaaacctggcggcagcgcaaaagatg

SEQ ID NO: 200383 - DNA, 103 bp, Artificial Sequence
  Synthetic Polynucleotide
taatacgactcactatagggtatgtcatttctctctgtatctttcttctcaacagaggagagagaagatggatacagagaacctggcggcagcgcaaaagatg

SEQ ID NO: 200384 - DNA, 103 bp, Artificial Sequence
  Synthetic Polynucleotide
taatacgactcactatagggggagatcttgtatgtcatttctctctgtataacagaggagaatacagatggaaatgacaaacctggcggcagcgcaaaagatg

SEQ ID NO: 200385 - DNA, 103 bp, Artificial Sequence
  Synthetic Polynucleotide
taatacgactcactatagggtgatattcgtggagatcttgtatgtcatttaacagaggagaaaatgaatgacaagatctaacctggcggcagcgcaaaagatg

SEQ ID NO: 200386 - DNA, 103 bp, Artificial Sequence
  Synthetic Polynucleotide
taatacgactcactatagggttgtaagtcataataatcatctctgtccacaacagaggagagtggacatggatgattataacctggcggcagcgcaaaagatg

SEQ ID NO: 200387 - DNA, 103 bp, Artificial Sequence
  Synthetic Polynucleotide
taatacgactcactatagggataaccagaatgatattcgtggagatcttgaacagaggagacaagatatgcacgaatataacctggcggcagcgcaaaagatg

SEQ ID NO: 200388 - DNA, 103 bp, Artificial Sequence
  Synthetic Polynucleotide
taatacgactcactatagggatttatgaacataaccagaatgatattcgtaacagaggagaacgaatatgattctggttaacctggcggcagcgcaaaagatg

SEQ ID NO: 200389 - DNA, 103 bp, Artificial Sequence
  Synthetic Polynucleotide
taatacgactcactataggggtgcggcgaaatttatgaacataaccagaaaacagaggagattctggatgtgttcataaaacctggcggcagcgcaaaagatg

SEQ ID NO: 200390 - DNA, 103 bp, Artificial Sequence
  Synthetic Polynucleotide
taatacgactcactatagggcatgactgacgtgcggcgaaatttatgaacaacagaggagagttcatatgtttcgccgcaacctggcggcagcgcaaaagatg

SEQ ID NO: 200391 - DNA, 103 bp, Artificial Sequence
  Synthetic Polynucleotide
taatacgactcactatagggtcccattacgcatgactgacgtgcggcgaaaacagaggagattcgccatgcgtcagtcaaacctggcggcagcgcaaaagatg

SEQ ID NO: 200392 - DNA, 103 bp, Artificial Sequence
  Synthetic Polynucleotide
taatacgactcactatagggcactcagttttcccattacgcatgactgacaacagaggagagtcagtatggcgtaatggaacctggcggcagcgcaaaagatg

SEQ ID NO: 200393 - DNA, 103 bp, Artificial Sequence
  Synthetic Polynucleotide
taatacgactcactatagggggaaaggtaacactcagttttcccattacgaacagaggagacgtaatatgaaaactgagaacctggcggcagcgcaaaagatg

SEQ ID NO: 200394 - DNA, 103 bp, Artificial Sequence
  Synthetic Polynucleotide
taatacgactcactataggggagtctggatggaaaggtaacactcagtttaacagaggagaaaactgatggttacctttaacctggcggcagcgcaaaagatg

SEQ ID NO: 200395 - DNA, 103 bp, Artificial Sequence
  Synthetic Polynucleotide
taatacgactcactatagggaagttctcttgagtctggatggaaaggtaaaacagaggagattacctatgcatccagacaacctggcggcagcgcaaaagatg

SEQ ID NO: 200396 - DNA, 103 bp, Artificial Sequence
  Synthetic Polynucleotide
taatacgactcactatagggattggccggaaagttctcttgagtctggataacagaggagaatccagatgcaagagaacaacctggcggcagcgcaaaagatg

SEQ ID NO: 200397 - DNA, 103 bp, Artificial Sequence
  Synthetic Polynucleotide
taatacgactcactataggggtaaaacttcttgtaagtcataataatcataacagaggagaatgattatgatgacttacaacctggcggcagcgcaaaagatg

SEQ ID NO: 200398 - DNA, 103 bp, Artificial Sequence
  Synthetic Polynucleotide
taatacgactcactataggggttcgtttaaattggccggaaagttctcttaacagaggagaaagagaatgttccggccaaacctggcggcagcgcaaaagatg

SEQ ID NO: 200399 - DNA, 103 bp, Artificial Sequence
  Synthetic Polynucleotide
taatacgactcactatagggcaattcacaagttcgtttaaattggccggaaacagaggagatccggcatgtttaaacgaaacctggcggcagcgcaaaagatg

SEQ ID NO: 200400 - DNA, 103 bp, Artificial Sequence
  Synthetic Polynucleotide
taatacgactcactataggggattacaatacaattcacaagttcgtttaaaacagaggagattaaacatgcttgtgaataacctggcggcagcgcaaaagatg

SEQ ID NO: 200401 - DNA, 103 bp, Artificial Sequence
  Synthetic Polynucleotide
taatacgactcactatagggccagagaactgattacaatacaattcacaaaacagaggagattgtgaatggtattgtaaaacctggcggcagcgcaaaagatg

SEQ ID NO: 200402 - DNA, 103 bp, Artificial Sequence
  Synthetic Polynucleotide
taatacgactcactatagggtgtgtagttaccagagaactgattacaataaacagaggagatattgtatgcagttctctaacctggcggcagcgcaaaagatg

SEQ ID NO: 200403 - DNA, 103 bp, Artificial Sequence
  Synthetic Polynucleotide
taatacgactcactatagggcaacttcctttgtgtagttaccagagaactaacagaggagaagttctatggtaactacaaacctggcggcagcgcaaaagatg

SEQ ID NO: 200404 - DNA, 103 bp, Artificial Sequence
  Synthetic Polynucleotide
taatacgactcactatagggacatggctttcaacttcctttgtgtagttaaacagaggagataactaatgaaaggaagtaacctggcggcagcgcaaaagatg

SEQ ID NO: 200405 - DNA, 103 bp, Artificial Sequence
  Synthetic Polynucleotide
taatacgactcactatagggcccaacagagacatggctttcaacttccttaacagaggagaaaggaaatggaaagccataacctggcggcagcgcaaaagatg

SEQ ID NO: 200406 - DNA, 103 bp, Artificial Sequence
  Synthetic Polynucleotide
taatacgactcactataggggttccgactacccaacagagacatggctttaacagaggagaaaagccatgtctctgttgaacctggcggcagcgcaaaagatg

SEQ ID NO: 200407 - DNA, 103 bp, Artificial Sequence
  Synthetic Polynucleotide
taatacgactcactatagggtagccagttggttccgactacccaacagagaacagaggagactctgtatggtagtcggaaacctggcggcagcgcaaaagatg

SEQ ID NO: 200408 - DNA, 103 bp, Artificial Sequence
  Synthetic Polynucleotide
taatacgactcactatagggaaaaggcaaagtaaaacttcttgtaagtcaaacagaggagatgacttatgagaagttttaacctggcggcagcgcaaaagatg

SEQ ID NO: 200409 - DNA, 103 bp, Artificial Sequence
  Synthetic Polynucleotide
taatacgactcactatagggagaacagctctagccagttggttccgactaaacagaggagatagtcgatgccaactggcaacctggcggcagcgcaaaagatg

SEQ ID NO: 200410 - DNA, 103 bp, Artificial Sequence
  Synthetic Polynucleotide
taatacgactcactataggggtttggattcagaacagctctagccagttgaacagaggagacaactgatgagagctgttaacctggcggcagcgcaaaagatg

SEQ ID NO: 200411 - DNA, 103 bp, Artificial Sequence
  Synthetic Polynucleotide
taatacgactcactatagggagtccatagggtttggattcagaacagctcaacagaggagagagctgatgtgaatccaaaacctggcggcagcgcaaaagatg

SEQ ID NO: 200412 - DNA, 103 bp, Artificial Sequence
  Synthetic Polynucleotide
taatacgactcactatagggtttgtacagaagtccatagggtttggattcaacagaggagagaatccatgccctatggaaacctggcggcagcgcaaaagatg

SEQ ID NO: 200413 - DNA, 103 bp, Artificial Sequence
  Synthetic Polynucleotide
taatacgactcactatagggcagtaaatcttttgtacagaagtccataggaacagaggagacctatgatgttctgtacaaacctggcggcagcgcaaaagatg

SEQ ID NO: 200414 - DNA, 103 bp, Artificial Sequence
  Synthetic Polynucleotide
taatacgactcactatagggatgttgtagtcagtaaatcttttgtacagaaacagaggagatctgtaatgaagatttacaacctggcggcagcgcaaaagatg

SEQ ID NO: 200415 - DNA, 103 bp, Artificial Sequence
  Synthetic Polynucleotide
taatacgactcactatagggattctctcagatgttgtagtcagtaaatctaacagaggagaagatttatggactacaacaacctggcggcagcgcaaaagatg

SEQ ID NO: 200416 - DNA, 103 bp, Artificial Sequence
  Synthetic Polynucleotide
taatacgactcactataggggtacgcaataattctctcagatgttgtagtaacagaggagaactacaatgtctgagagaaacctggcggcagcgcaaaagatg

SEQ ID NO: 200417 - DNA, 103 bp, Artificial Sequence
  Synthetic Polynucleotide
taatacgactcactatagggaatctcttaagtacgcaataattctctcagaacagaggagactgagaatgttattgcgtaacctggcggcagcgcaaaagatg

SEQ ID NO: 200418 - DNA, 103 bp, Artificial Sequence
  Synthetic Polynucleotide
taatacgactcactatagggtcttcattgaaatctcttaagtacgcaataaacagaggagatattgcatgcttaagagaaacctggcggcagcgcaaaagatg

SEQ ID NO: 200419 - DNA, 103 bp, Artificial Sequence
  Synthetic Polynucleotide
taatacgactcactatagggaatgactttaaaaaggcaaagtaaaacttcaacagaggagagaagttatgctttgccttaacctggcggcagcgcaaaagatg

SEQ ID NO: 200420 - DNA, 103 bp, Artificial Sequence
  Synthetic Polynucleotide
taatacgactcactatagggtttcttttgatcttcattgaaatctcttaaaacagaggagattaagaatgttcaatgaaaacctggcggcagcgcaaaagatg

SEQ ID NO: 200421 - DNA, 103 bp, Artificial Sequence
  Synthetic Polynucleotide
taatacgactcactatagggtttctattgctttcttttgatcttcattgaaacagaggagatcaatgatgatcaaaagaaacctggcggcagcgcaaaagatg

SEQ ID NO: 200422 - DNA, 103 bp, Artificial Sequence
  Synthetic Polynucleotide
taatacgactcactataggggcatatgcagtttctattgctttcttttgaaacagaggagatcaaaaatgagcaatagaaacctggcggcagcgcaaaagatg

SEQ ID NO: 200423 - DNA, 103 bp, Artificial Sequence
  Synthetic Polynucleotide
taatacgactcactatagggtttcaccatagcatatgcagtttctattgcaacagaggagagcaataatgactgcatataacctggcggcagcgcaaaagatg

SEQ ID NO: 200424 - DNA, 103 bp, Artificial Sequence
  Synthetic Polynucleotide
taatacgactcactatagggatggtgagtgtttcaccatagcatatgcagaacagaggagactgcatatgctatggtgaaacctggcggcagcgcaaaagatg

SEQ ID NO: 200425 - DNA, 103 bp, Artificial Sequence
  Synthetic Polynucleotide
taatacgactcactatagggttggcaactgatggtgagtgtttcaccataaacagaggagatatggtatgacactcaccaacctggcggcagcgcaaaagatg

SEQ ID NO: 200426 - DNA, 103 bp, Artificial Sequence
  Synthetic Polynucleotide
taatacgactcactatagggcaagcagattttggcaactgatggtgagtgaacagaggagacactcaatgtcagttgccaacctggcggcagcgcaaaagatg

SEQ ID NO: 200427 - DNA, 103 bp, Artificial Sequence
  Synthetic Polynucleotide
taatacgactcactataggggtccatgaatcaagcagattttggcaactgaacagaggagacagttgatgaaatctgctaacctggcggcagcgcaaaagatg

SEQ ID NO: 200428 - DNA, 103 bp, Artificial Sequence
  Synthetic Polynucleotide
taatacgactcactataggggttccaggtggtccatgaatcaagcagattaacagaggagaaatctgatggattcatggaacctggcggcagcgcaaaagatg

SEQ ID NO: 200429 - DNA, 103 bp, Artificial Sequence
  Synthetic Polynucleotide
taatacgactcactatagggtgattttcctgttccaggtggtccatgaataacagaggagaattcatatgccacctggaaacctggcggcagcgcaaaagatg

SEQ ID NO: 200430 - DNA, 103 bp, Artificial Sequence
  Synthetic Polynucleotide
taatacgactcactataggggccccaactcaatgactttaaaaaggcaaaaacagaggagatttgccatgttaaagtcaaacctggcggcagcgcaaaagatg

SEQ ID NO: 200431 - DNA, 103 bp, Artificial Sequence
  Synthetic Polynucleotide
taatacgactcactatagggcaatagtttttgattttcctgttccaggtgaacagaggagacacctgatgcaggaaaataacctggcggcagcgcaaaagatg

SEQ ID NO: 200432 - DNA, 103 bp, Artificial Sequence
  Synthetic Polynucleotide
taatacgactcactatagggaggaggccaacaatagtttttgattttcctaacagaggagaaggaaaatgaaaaactataacctggcggcagcgcaaaagatg

SEQ ID NO: 200433 - DNA, 103 bp, Artificial Sequence
  Synthetic Polynucleotide
taatacgactcactatagggtagacgatagaggaggccaacaatagttttaacagaggagaaaaactatggttggcctcaacctggcggcagcgcaaaagatg

SEQ ID NO: 200434 - DNA, 103 bp, Artificial Sequence
  Synthetic Polynucleotide
taatacgactcactatagggtctctgtcagtagacgatagaggaggccaaaacagaggagattggccatgtctatcgtcaacctggcggcagcgcaaaagatg

SEQ ID NO: 200435 - DNA, 103 bp, Artificial Sequence
  Synthetic Polynucleotide
taatacgactcactatagggttcctctggttctctgtcagtagacgatagaacagaggagactatcgatgactgacagaaacctggcggcagcgcaaaagatg

SEQ ID NO: 200436 - DNA, 103 bp, Artificial Sequence
  Synthetic Polynucleotide
taatacgactcactatagggtgaatgccccttcctctggttctctgtcagaacagaggagactgacaatgaaccagaggaacctggcggcagcgcaaaagatg

SEQ ID NO: 200437 - DNA, 103 bp, Artificial Sequence
  Synthetic Polynucleotide
taatacgactcactatagggagttttcgtctgaatgccccttcctctggtaacagaggagaaccagaatgaggggcattaacctggcggcagcgcaaaagatg

SEQ ID NO: 200438 - DNA, 103 bp, Artificial Sequence
  Synthetic Polynucleotide
taatacgactcactatagggttggcattggagttttcgtctgaatgccccaacagaggagaggggcaatgagacgaaaaaacctggcggcagcgcaaaagatg

SEQ ID NO: 200439 - DNA, 103 bp, Artificial Sequence
  Synthetic Polynucleotide
taatacgactcactatagggttgtttgattttggcattggagttttcgtcaacagaggagagacgaaatgtccaatgccaacctggcggcagcgcaaaagatg

SEQ ID NO: 200440 - DNA, 103 bp, Artificial Sequence
  Synthetic Polynucleotide
taatacgactcactatagggggacacggttttgtttgattttggcattggaacagaggagaccaatgatgaaatcaaacaacctggcggcagcgcaaaagatg

SEQ ID NO: 200441 - DNA, 103 bp, Artificial Sequence
  Synthetic Polynucleotide
taatacgactcactataggggacggagtgttggaagcatagcgctttaggaacagaggagacctaaaatgctatgcttcaacctggcggcagcgcaaaagatg

SEQ ID NO: 200442 - DNA, 103 bp, Artificial Sequence
  Synthetic Polynucleotide
taatacgactcactatagggctctctaaaagccccaactcaatgactttaaacagaggagataaagtatgtgagttgggaacctggcggcagcgcaaaagatg

SEQ ID NO: 200443 - DNA, 103 bp, Artificial Sequence
  Synthetic Polynucleotide
taatacgactcactataggggcacacacgaggacacggttttgtttgattaacagaggagaaatcaaatgaaaccgtgtaacctggcggcagcgcaaaagatg

SEQ ID NO: 200444 - DNA, 103 bp, Artificial Sequence
  Synthetic Polynucleotide
taatacgactcactatagggattggaaggtgcacacacgaggacacggttaacagaggagaaaccgtatgctcgtgtgtaacctggcggcagcgcaaaagatg

SEQ ID NO: 200445 - DNA, 103 bp, Artificial Sequence
  Synthetic Polynucleotide
taatacgactcactatagggcaacagctgcattggaaggtgcacacacgaaacagaggagatcgtgtatgcaccttccaaacctggcggcagcgcaaaagatg

SEQ ID NO: 200446 - DNA, 103 bp, Artificial Sequence
  Synthetic Polynucleotide
taatacgactcactatagggatgagttcatcaacagctgcattggaaggtaacagaggagaaccttcatgtgcagctgtaacctggcggcagcgcaaaagatg

SEQ ID NO: 200447 - DNA, 103 bp, Artificial Sequence
  Synthetic Polynucleotide
taatacgactcactatagggaatttttttcatgagttcatcaacagctgcaacagaggagagcagctatggatgaactcaacctggcggcagcgcaaaagatg

SEQ ID NO: 200448 - DNA, 103 bp, Artificial Sequence
  Synthetic Polynucleotide
taatacgactcactatagggattcaaggataatttttttcatgagttcataacagaggagaatgaacatgtgaaaaaaaaacctggcggcagcgcaaaagatg

SEQ ID NO: 200449 - DNA, 103 bp, Artificial Sequence
  Synthetic Polynucleotide
taatacgactcactatagggttttctttgaattcaaggataatttttttcaacagaggagagaaaaaatgtatccttgaaacctggcggcagcgcaaaagatg

SEQ ID NO: 200450 - DNA, 103 bp, Artificial Sequence
  Synthetic Polynucleotide
taatacgactcactataggggtctttacatttttctttgaattcaaggataacagaggagaatccttatgttcaaagaaaacctggcggcagcgcaaaagatg

SEQ ID NO: 200451 - DNA, 103 bp, Artificial Sequence
  Synthetic Polynucleotide
taatacgactcactataggggattcttcttgtctttacatttttctttgaaacagaggagatcaaagatgaatgtaaagaacctggcggcagcgcaaaagatg

SEQ ID NO: 200452 - DNA, 103 bp, Artificial Sequence
  Synthetic Polynucleotide
taatacgactcactatagggtttcctaaaggattcttcttgtctttacataacagaggagaatgtaaatgcaagaagaaaacctggcggcagcgcaaaagatg

SEQ ID NO: 200453 - DNA, 103 bp, Artificial Sequence
  Synthetic Polynucleotide
taatacgactcactatagggaatgtctggactctctaaaagccccaactcaacagaggagagagttgatgcttttagagaacctggcggcagcgcaaaagatg

SEQ ID NO: 200454 - DNA, 103 bp, Artificial Sequence
  Synthetic Polynucleotide
taatacgactcactatagggatctccacagtttcctaaaggattcttcttaacagaggagaaagaagatgcctttaggaaacctggcggcagcgcaaaagatg

SEQ ID NO: 200455 - DNA, 103 bp, Artificial Sequence
  Synthetic Polynucleotide
taatacgactcactatagggctaaatttatatctccacagtttcctaaagaacagaggagactttagatgactgtggagaacctggcggcagcgcaaaagatg

SEQ ID NO: 200456 - DNA, 103 bp, Artificial Sequence
  Synthetic Polynucleotide
taatacgactcactatagggcccagtcgtactaaatttatatctccacagaacagaggagactgtggatgtataaatttaacctggcggcagcgcaaaagatg

SEQ ID NO: 200457 - DNA, 103 bp, Artificial Sequence
  Synthetic Polynucleotide
taatacgactcactatagggcttttctggacccagtcgtactaaatttataacagaggagaataaatatggtacgactgaacctggcggcagcgcaaaagatg

SEQ ID NO: 200458 - DNA, 103 bp, Artificial Sequence
  Synthetic Polynucleotide
taatacgactcactatagggtattaatagacttttctggacccagtcgtaaacagaggagatacgacatggtccagaaaaacctggcggcagcgcaaaagatg

SEQ ID NO: 200459 - DNA, 103 bp, Artificial Sequence
  Synthetic Polynucleotide
taatacgactcactatagggagaacctcactattaatagacttttctggaaacagaggagatccagaatggtctattaaaacctggcggcagcgcaaaagatg

SEQ ID NO: 200460 - DNA, 103 bp, Artificial Sequence
  Synthetic Polynucleotide
taatacgactcactatagggactgaactttagaacctcactattaatagaaacagaggagatctattatgagtgaggttaacctggcggcagcgcaaaagatg

SEQ ID NO: 200461 - DNA, 103 bp, Artificial Sequence
  Synthetic Polynucleotide
taatacgactcactatagggggctgtccaaactgaactttagaacctcacaacagaggagagtgaggatgtaaagttcaaacctggcggcagcgcaaaagatg

SEQ ID NO: 200462 - DNA, 103 bp, Artificial Sequence
  Synthetic Polynucleotide
taatacgactcactatagggtggtttacttggctgtccaaactgaactttaacagaggagaaaagttatgtttggacagaacctggcggcagcgcaaaagatg

SEQ ID NO: 200463 - DNA, 103 bp, Artificial Sequence
  Synthetic Polynucleotide
taatacgactcactatagggtttcattctgtggtttacttggctgtccaaaacagaggagattggacatgcaagtaaacaacctggcggcagcgcaaaagatg

SEQ ID NO: 200464 - DNA, 103 bp, Artificial Sequence
  Synthetic Polynucleotide
taatacgactcactatagggaagaagtataaatgtctggactctctaaaaaacagaggagattttagatggtccagacaaacctggcggcagcgcaaaagatg

SEQ ID NO: 200465 - DNA, 103 bp, Artificial Sequence
  Synthetic Polynucleotide
taatacgactcactataggggtaactcttttttcattctgtggtttacttaacagaggagaaagtaaatgacagaatgaaacctggcggcagcgcaaaagatg

SEQ ID NO: 200466 - DNA, 103 bp, Artificial Sequence
  Synthetic Polynucleotide
taatacgactcactatagggacatgagaaggtaactcttttttcattctgaacagaggagacagaatatgaaaagagttaacctggcggcagcgcaaaagatg

SEQ ID NO: 200467 - DNA, 103 bp, Artificial Sequence
  Synthetic Polynucleotide
taatacgactcactatagggcatcgcctgaacatgagaaggtaactctttaacagaggagaaaagagatgccttctcataacctggcggcagcgcaaaagatg

SEQ ID NO: 200468 - DNA, 103 bp, Artificial Sequence
  Synthetic Polynucleotide
taatacgactcactatagggttcttttatgcatcgcctgaacatgagaagaacagaggagacttctcatgttcaggcgaaacctggcggcagcgcaaaagatg

SEQ ID NO: 200469 - DNA, 103 bp, Artificial Sequence
  Synthetic Polynucleotide
taatacgactcactatagggagaaattcctttcttttatgcatcgcctgaaacagaggagatcaggcatggcataaaagaacctggcggcagcgcaaaagatg

SEQ ID NO: 200470 - DNA, 103 bp, Artificial Sequence
  Synthetic Polynucleotide
taatacgactcactatagggctgataatctagaaattcctttcttttatgaacagaggagacataaaatgaaggaatttaacctggcggcagcgcaaaagatg

SEQ ID NO: 200471 - DNA, 103 bp, Artificial Sequence
  Synthetic Polynucleotide
taatacgactcactataggggctcatccagctgataatctagaaattcctaacagaggagaaggaatatgtagattatcaacctggcggcagcgcaaaagatg

SEQ ID NO: 200472 - DNA, 103 bp, Artificial Sequence
  Synthetic Polynucleotide
taatacgactcactatagggtgccgggaaagctcatccagctgataatctaacagaggagaagattaatggctggatgaaacctggcggcagcgcaaaagatg

SEQ ID NO: 200473 - DNA, 103 bp, Artificial Sequence
  Synthetic Polynucleotide
taatacgactcactatagggtagagctcgctgccgggaaagctcatccagaacagaggagactggatatgctttcccggaacctggcggcagcgcaaaagatg

SEQ ID NO: 200474 - DNA, 103 bp, Artificial Sequence
  Synthetic Polynucleotide
taatacgactcactatagggcacctcggcatagagctcgctgccgggaaaaacagaggagatttcccatgagcgagctcaacctggcggcagcgcaaaagatg

SEQ ID NO: 200475 - DNA, 103 bp, Artificial Sequence
  Synthetic Polynucleotide
taatacgactcactatagggtctaggacagaagaagtataaatgtctggaaacagaggagatccagaatgttatacttcaacctggcggcagcgcaaaagatg

SEQ ID NO: 200476 - DNA, 103 bp, Artificial Sequence
  Synthetic Polynucleotide
taatacgactcactatagggatttcccgtccacctcggcatagagctcgcaacagaggagagcgagcatgatgccgaggaacctggcggcagcgcaaaagatg

SEQ ID NO: 200477 - DNA, 103 bp, Artificial Sequence
  Synthetic Polynucleotide
taatacgactcactatagggttgcctctgtatttcccgtccacctcggcaaacagaggagatgccgaatgggacgggaaaacctggcggcagcgcaaaagatg

SEQ ID NO: 200478 - DNA, 103 bp, Artificial Sequence
  Synthetic Polynucleotide
taatacgactcactatagggcatctaattcttgcctctgtatttcccgtcaacagaggagagacgggatgtacagaggcaacctggcggcagcgcaaaagatg

SEQ ID NO: 200479 - DNA, 103 bp, Artificial Sequence
  Synthetic Polynucleotide
taatacgactcactataggggaaatgttttcatctaattcttgcctctgtaacagaggagaacagagatgagaattagaaacctggcggcagcgcaaaagatg

SEQ ID NO: 200480 - DNA, 103 bp, Artificial Sequence
  Synthetic Polynucleotide
taatacgactcactatagggagaaactttggaaatgttttcatctaattcaacagaggagagaattaatggaaaacattaacctggcggcagcgcaaaagatg

SEQ ID NO: 200481 - DNA, 103 bp, Artificial Sequence
  Synthetic Polynucleotide
taatacgactcactataggggcctttccttagaaactttggaaatgttttaacagaggagaaaaacaatgccaaagtttaacctggcggcagcgcaaaagatg

SEQ ID NO: 200482 - DNA, 103 bp, Artificial Sequence
  Synthetic Polynucleotide
taatacgactcactataggggcaagttcctgcctttccttagaaactttgaacagaggagacaaagtatgtaaggaaagaacctggcggcagcgcaaaagatg

SEQ ID NO: 200483 - DNA, 103 bp, Artificial Sequence
  Synthetic Polynucleotide
taatacgactcactatagggaattttagaagcaagttcctgcctttccttaacagaggagaaaggaaatgcaggaacttaacctggcggcagcgcaaaagatg

SEQ ID NO: 200484 - DNA, 103 bp, Artificial Sequence
  Synthetic Polynucleotide
taatacgactcactataggggaacctctttaattttagaagcaagttcctaacagaggagaaggaacatgcttctaaaaaacctggcggcagcgcaaaagatg

SEQ ID NO: 200485 - DNA, 103 bp, Artificial Sequence
  Synthetic Polynucleotide
taatacgactcactataggggggcgtccttgaacctctttaattttagaaaacagaggagattctaaatgtaaagaggtaacctggcggcagcgcaaaagatg

SEQ ID NO: 200486 - DNA, 103 bp, Artificial Sequence
  Synthetic Polynucleotide
taatacgactcactatagggtttacccttctctaggacagaagaagtataaacagaggagatatactatgtctgtcctaaacctggcggcagcgcaaaagatg

SEQ ID NO: 200487 - DNA, 103 bp, Artificial Sequence
  Synthetic Polynucleotide
taatacgactcactatagggtgttttctgtgggcgtccttgaacctctttaacagaggagaaaagagatgcaaggacgcaacctggcggcagcgcaaaagatg

SEQ ID NO: 200488 - DNA, 103 bp, Artificial Sequence
  Synthetic Polynucleotide
taatacgactcactatagggtgatactctgtgttttctgtgggcgtccttaacagaggagaaaggacatgcacagaaaaaacctggcggcagcgcaaaagatg

SEQ ID NO: 200489 - DNA, 103 bp, Artificial Sequence
  Synthetic Polynucleotide
taatacgactcactatagggtctaagatgatgatactctgtgttttctgtaacagaggagaacagaaatgacagagtataacctggcggcagcgcaaaagatg

SEQ ID NO: 200490 - DNA, 103 bp, Artificial Sequence
  Synthetic Polynucleotide
taatacgactcactataggggatatgggactctaagatgatgatactctgaacagaggagacagagtatgatcatcttaaacctggcggcagcgcaaaagatg

SEQ ID NO: 200491 - DNA, 103 bp, Artificial Sequence
  Synthetic Polynucleotide
taatacgactcactatagggtgcagcagatgatatgggactctaagatgaaacagaggagatcatctatgagtcccataaacctggcggcagcgcaaaagatg

SEQ ID NO: 200492 - DNA, 103 bp, Artificial Sequence
  Synthetic Polynucleotide
taatacgactcactataggggtgctcaacgtgcagcagatgatatgggacaacagaggagagtcccaatgcatctgctgaacctggcggcagcgcaaaagatg

SEQ ID NO: 200493 - DNA, 103 bp, Artificial Sequence
  Synthetic Polynucleotide
taatacgactcactatagggaccaccacttgtgctcaacgtgcagcagataacagaggagaatctgcatgacgttgagcaacctggcggcagcgcaaaagatg

SEQ ID NO: 200494 - DNA, 103 bp, Artificial Sequence
  Synthetic Polynucleotide
taatacgactcactatagggcaagtagtaaaccaccacttgtgctcaacgaacagaggagacgttgaatgcaagtggtgaacctggcggcagcgcaaaagatg

SEQ ID NO: 200495 - DNA, 103 bp, Artificial Sequence
  Synthetic Polynucleotide
taatacgactcactatagggaaagcagactcaagtagtaaaccaccacttaacagaggagaaagtggatgtttactactaacctggcggcagcgcaaaagatg

SEQ ID NO: 200496 - DNA, 103 bp, Artificial Sequence
  Synthetic Polynucleotide
taatacgactcactatagggttgcccacggaaagcagactcaagtagtaaaacagaggagattactaatggagtctgctaacctggcggcagcgcaaaagatg

SEQ ID NO: 200497 - DNA, 103 bp, Artificial Sequence
  Synthetic Polynucleotide
taatacgactcactataggggaagaatcagtttacccttctctaggacagaacagaggagactgtccatgagaagggtaaacctggcggcagcgcaaaagatg

SEQ ID NO: 200498 - DNA, 103 bp, Artificial Sequence
  Synthetic Polynucleotide
taatacgactcactatagggggacacccccttgcccacggaaagcagactaacagaggagaagtctgatgtccgtgggcaacctggcggcagcgcaaaagatg

SEQ ID NO: 200499 - DNA, 103 bp, Artificial Sequence
  Synthetic Polynucleotide
taatacgactcactatagggcagctgaaggggacacccccttgcccacggaacagaggagaccgtggatgagggggtgtaacctggcggcagcgcaaaagatg

SEQ ID NO: 200500 - DNA, 103 bp, Artificial Sequence
  Synthetic Polynucleotide
taatacgactcactatagggaacaatgacacagctgaaggggacacccccaacagaggagagggggtatgcccttcagcaacctggcggcagcgcaaaagatg

SEQ ID NO: 200501 - DNA, 103 bp, Artificial Sequence
  Synthetic Polynucleotide
taatacgactcactatagggcagcctcatcaacaatgacacagctgaaggaacagaggagaccttcaatggtgtcattgaacctggcggcagcgcaaaagatg

SEQ ID NO: 200502 - DNA, 103 bp, Artificial Sequence
  Synthetic Polynucleotide
taatacgactcactatagggcaagactgtccagcctcatcaacaatgacaaacagaggagatgtcatatgtgatgaggcaacctggcggcagcgcaaaagatg

SEQ ID NO: 200503 - DNA, 103 bp, Artificial Sequence
  Synthetic Polynucleotide
taatacgactcactatagggctcaatttcacaagactgtccagcctcatcaacagaggagagatgagatgggacagtctaacctggcggcagcgcaaaagatg

SEQ ID NO: 200504 - DNA, 103 bp, Artificial Sequence
  Synthetic Polynucleotide
taatacgactcactataggggagtaagagtctcaatttcacaagactgtcaacagaggagagacagtatggtgaaattgaacctggcggcagcgcaaaagatg

SEQ ID NO: 200505 - DNA, 103 bp, Artificial Sequence
  Synthetic Polynucleotide
taatacgactcactatagggtggatgagtggagtaagagtctcaatttcaaacagaggagatgaaatatggactcttacaacctggcggcagcgcaaaagatg

SEQ ID NO: 200506 - DNA, 103 bp, Artificial Sequence
  Synthetic Polynucleotide
taatacgactcactatagggattgcagcgatggatgagtggagtaagagtaacagaggagaactcttatgccactcatcaacctggcggcagcgcaaaagatg

SEQ ID NO: 200507 - DNA, 103 bp, Artificial Sequence
  Synthetic Polynucleotide
taatacgactcactatagggggatgagcttattgcagcgatggatgagtgaacagaggagacactcaatgatcgctgcaaacctggcggcagcgcaaaagatg

SEQ ID NO: 200508 - DNA, 103 bp, Artificial Sequence
  Synthetic Polynucleotide
taatacgactcactatagggtgtgagggcagaagaatcagtttacccttcaacagaggagagaagggatgactgattctaacctggcggcagcgcaaaagatg

SEQ ID NO: 200509 - DNA, 103 bp, Artificial Sequence
  Synthetic Polynucleotide
taatacgactcactatagggtctcctactaggatgagcttattgcagcgaaacagaggagatcgctgatgtaagctcataacctggcggcagcgcaaaagatg

SEQ ID NO: 200510 - DNA, 103 bp, Artificial Sequence
  Synthetic Polynucleotide
taatacgactcactatagggctgcttaggatctcctactaggatgagcttaacagaggagaaagctcatgctagtaggaaacctggcggcagcgcaaaagatg

SEQ ID NO: 200511 - DNA, 103 bp, Artificial Sequence
  Synthetic Polynucleotide
taatacgactcactatagggtcggagggagctgcttaggatctcctactaaacagaggagatagtagatgatcctaagcaacctggcggcagcgcaaaagatg

SEQ ID NO: 200512 - DNA, 103 bp, Artificial Sequence
  Synthetic Polynucleotide
taatacgactcactataggggagatgactgtcggagggagctgcttaggaaacagaggagatcctaaatggctccctccaacctggcggcagcgcaaaagatg

SEQ ID NO: 200513 - DNA, 103 bp, Artificial Sequence
  Synthetic Polynucleotide
taatacgactcactatagggtgctttcatagagatgactgtcggagggagaacagaggagactccctatgacagtcatcaacctggcggcagcgcaaaagatg

SEQ ID NO: 200514 - DNA, 103 bp, Artificial Sequence
  Synthetic Polynucleotide
taatacgactcactatagggcatactcctgtgctttcatagagatgactgaacagaggagacagtcaatgctatgaaagaacctggcggcagcgcaaaagatg

SEQ ID NO: 200515 - DNA, 103 bp, Artificial Sequence
  Synthetic Polynucleotide
taatacgactcactatagggtggtcgtagccatactcctgtgctttcataaacagaggagatatgaaatgacaggagtaaacctggcggcagcgcaaaagatg

SEQ ID NO: 200516 - DNA, 103 bp, Artificial Sequence
  Synthetic Polynucleotide
taatacgactcactatagggcatcattgactggtcgtagccatactcctgaacagaggagacaggagatgggctacgacaacctggcggcagcgcaaaagatg

SEQ ID NO: 200517 - DNA, 103 bp, Artificial Sequence
  Synthetic Polynucleotide
taatacgactcactatagggagaagcgagccatcattgactggtcgtagcaacagaggagagctacgatgagtcaatgaaacctggcggcagcgcaaaagatg

SEQ ID NO: 200518 - DNA, 103 bp, Artificial Sequence
  Synthetic Polynucleotide
taatacgactcactatagggagcagtctgcagaagcgagccatcattgacaacagaggagagtcaatatgggctcgcttaacctggcggcagcgcaaaagatg

SEQ ID NO: 200519 - DNA, 103 bp, Artificial Sequence
  Synthetic Polynucleotide
taatacgactcactatagggatcatacatgtgtgagggcagaagaatcagaacagaggagactgattatgctgccctcaaacctggcggcagcgcaaaagatg

SEQ ID NO: 200520 - DNA, 103 bp, Artificial Sequence
  Synthetic Polynucleotide
taatacgactcactatagggattctcttccagcagtctgcagaagcgagcaacagaggagagctcgcatgtgcagactgaacctggcggcagcgcaaaagatg

SEQ ID NO: 200521 - DNA, 103 bp, Artificial Sequence
  Synthetic Polynucleotide
taatacgactcactatagggtgtgttctacattctcttccagcagtctgcaacagaggagagcagacatgtggaagagaaacctggcggcagcgcaaaagatg

SEQ ID NO: 200522 - DNA, 103 bp, Artificial Sequence
  Synthetic Polynucleotide
taatacgactcactatagggctgatcatgttgtgttctacattctcttccaacagaggagaggaagaatgtgtagaacaaacctggcggcagcgcaaaagatg

SEQ ID NO: 200523 - DNA, 103 bp, Artificial Sequence
  Synthetic Polynucleotide
taatacgactcactataggggggcagcctgctgatcatgttgtgttctacaacagaggagagtagaaatgaacatgatcaacctggcggcagcgcaaaagatg

SEQ ID NO: 200524 - DNA, 103 bp, Artificial Sequence
  Synthetic Polynucleotide
taatacgactcactataggggctgtagaatgggcagcctgctgatcatgtaacagaggagaacatgaatggcaggctgcaacctggcggcagcgcaaaagatg

SEQ ID NO: 200525 - DNA, 103 bp, Artificial Sequence
  Synthetic Polynucleotide
taatacgactcactatagggtgaacagtgagctgtagaatgggcagcctgaacagaggagacaggctatgcattctacaaacctggcggcagcgcaaaagatg

SEQ ID NO: 200526 - DNA, 103 bp, Artificial Sequence
  Synthetic Polynucleotide
taatacgactcactatagggcatcctgtactgaacagtgagctgtagaataacagaggagaattctaatgctcactgttaacctggcggcagcgcaaaagatg

SEQ ID NO: 200527 - DNA, 103 bp, Artificial Sequence
  Synthetic Polynucleotide
taatacgactcactatagggtgtctggatgcatcctgtactgaacagtgaaacagaggagatcactgatgagtacaggaaacctggcggcagcgcaaaagatg

SEQ ID NO: 200528 - DNA, 103 bp, Artificial Sequence
  Synthetic Polynucleotide
taatacgactcactatagggaagaggcatatgtctggatgcatcctgtacaacagaggagagtacagatggcatccagaaacctggcggcagcgcaaaagatg

SEQ ID NO: 200529 - DNA, 103 bp, Artificial Sequence
  Synthetic Polynucleotide
taatacgactcactatagggattagaagggaagaggcatatgtctggatgaacagaggagacatccaatgatatgcctcaacctggcggcagcgcaaaagatg

SEQ ID NO: 200530 - DNA, 103 bp, Artificial Sequence
  Synthetic Polynucleotide
taatacgactcactatagggagttggtagtatcatacatgtgtgagggcaaacagaggagatgccctatgacatgtatgaacctggcggcagcgcaaaagatg

SEQ ID NO: 200531 - DNA, 103 bp, Artificial Sequence
  Synthetic Polynucleotide
taatacgactcactatagggtataaacataattagaagggaagaggcataaacagaggagatatgccatgtcccttctaaacctggcggcagcgcaaaagatg

SEQ ID NO: 200532 - DNA, 103 bp, Artificial Sequence
  Synthetic Polynucleotide
taatacgactcactatagggaagtttctgttataaacataattagaagggaacagaggagacccttcatgttatgtttaaacctggcggcagcgcaaaagatg

SEQ ID NO: 200533 - DNA, 103 bp, Artificial Sequence
  Synthetic Polynucleotide
taatacgactcactatagggatttgtttttaagtttctgttataaacataaacagaggagatatgttatgaacagaaacaacctggcggcagcgcaaaagatg

SEQ ID NO: 200534 - DNA, 103 bp, Artificial Sequence
  Synthetic Polynucleotide
taatacgactcactatagggctgtctgtctatttgtttttaagtttctgtaacagaggagaacagaaatgtaaaaacaaaacctggcggcagcgcaaaagatg

SEQ ID NO: 200535 - DNA, 103 bp, Artificial Sequence
  Synthetic Polynucleotide
taatacgactcactatagggcgaatggcttctgtctgtctatttgtttttaacagaggagaaaaaacatgtagacagacaacctggcggcagcgcaaaagatg

SEQ ID NO: 200536 - DNA, 103 bp, Artificial Sequence
  Synthetic Polynucleotide
taatacgactcactatagggtgatgaacatcgaatggcttctgtctgtctaacagaggagaagacagatggaagccattaacctggcggcagcgcaaaagatg

SEQ ID NO: 200537 - DNA, 103 bp, Artificial Sequence
  Synthetic Polynucleotide
taatacgactcactatagggatggccaatctgatgaacatcgaatggcttaacagaggagaaagccaatggatgttcataacctggcggcagcgcaaaagatg

SEQ ID NO: 200538 - DNA, 103 bp, Artificial Sequence
  Synthetic Polynucleotide
taatacgactcactatagggtatggctgaaatggccaatctgatgaacataacagaggagaatgttcatgagattggccaacctggcggcagcgcaaaagatg

SEQ ID NO: 200539 - DNA, 103 bp, Artificial Sequence
  Synthetic Polynucleotide
taatacgactcactatagggaaacacaaggtatggctgaaatggccaatcaacagaggagagattggatgtttcagccaaacctggcggcagcgcaaaagatg

SEQ ID NO: 200540 - DNA, 103 bp, Artificial Sequence
  Synthetic Polynucleotide
taatacgactcactatagggctccaacatcaaacacaaggtatggctgaaaacagaggagattcagcatgaccttgtgtaacctggcggcagcgcaaaagatg

SEQ ID NO: 200541 - DNA, 103 bp, Artificial Sequence
  Synthetic Polynucleotide
taatacgactcactatagggtagcttttgtagttggtagtatcatacatgaacagaggagacatgtaatgtactaccaaaacctggcggcagcgcaaaagatg

SEQ ID NO: 200542 - DNA, 103 bp, Artificial Sequence
  Synthetic Polynucleotide
taatacgactcactatagggtctgaaccatctccaacatcaaacacaaggaacagaggagaccttgtatgtgatgttggaacctggcggcagcgcaaaagatg

SEQ ID NO: 200543 - DNA, 103 bp, Artificial Sequence
  Synthetic Polynucleotide
taatacgactcactatagggatcccgtctttctgaaccatctccaacatcaacagaggagagatgttatggatggttcaaacctggcggcagcgcaaaagatg

SEQ ID NO: 200544 - DNA, 103 bp, Artificial Sequence
  Synthetic Polynucleotide
taatacgactcactatagggatgagtcattatcccgtctttctgaaccataacagaggagaatggttatgaaagacgggaacctggcggcagcgcaaaagatg

SEQ ID NO: 200545 - DNA, 103 bp, Artificial Sequence
  Synthetic Polynucleotide
taatacgactcactatagggacatttatatatgagtcattatcccgtcttaacagaggagaaagacgatgtaatgactcaacctggcggcagcgcaaaagatg

SEQ ID NO: 200546 - DNA, 103 bp, Artificial Sequence
  Synthetic Polynucleotide
taatacgactcactatagggtatttcttgaacatttatatatgagtcattaacagaggagaaatgacatgtatataaataacctggcggcagcgcaaaagatg

SEQ ID NO: 200547 - DNA, 103 bp, Artificial Sequence
  Synthetic Polynucleotide
taatacgactcactatagggtcaccagttttatttcttgaacatttatataacagaggagaatataaatgttcaagaaaaacctggcggcagcgcaaaagatg

SEQ ID NO: 200548 - DNA, 103 bp, Artificial Sequence
  Synthetic Polynucleotide
taatacgactcactatagggattatttccatcaccagttttatttcttgaaacagaggagatcaagaatgaaaactggtaacctggcggcagcgcaaaagatg

SEQ ID NO: 200549 - DNA, 103 bp, Artificial Sequence
  Synthetic Polynucleotide
taatacgactcactatagggaataagcttaattatttccatcaccagtttaacagaggagaaaactgatgatggaaataaacctggcggcagcgcaaaagatg

SEQ ID NO: 200550 - DNA, 103 bp, Artificial Sequence
  Synthetic Polynucleotide
taatacgactcactatagggttttgtctttaataagcttaattatttccaaacagaggagatggaaaatgttaagcttaaacctggcggcagcgcaaaagatg

SEQ ID NO: 200551 - DNA, 103 bp, Artificial Sequence
  Synthetic Polynucleotide
taatacgactcactatagggacatcctttcttttgtctttaataagcttaaacagaggagataagctatgtaaagacaaaacctggcggcagcgcaaaagatg

SEQ ID NO: 200552 - DNA, 103 bp, Artificial Sequence
  Synthetic Polynucleotide
taatacgactcactatagggaaattcaccggacggagtgttggaagcataaacagaggagatatgctatgaacactccgaacctggcggcagcgcaaaagatg

SEQ ID NO: 200553 - DNA, 103 bp, Artificial Sequence
  Synthetic Polynucleotide
taatacgactcactatagggacctaaccaatagcttttgtagttggtagtaacagaggagaactaccatgtacaaaagcaacctggcggcagcgcaaaagatg

SEQ ID NO: 200554 - DNA, 103 bp, Artificial Sequence
  Synthetic Polynucleotide
taatacgactcactatagggtcgaaaactaacatcctttcttttgtctttaacagaggagaaaagacatgagaaaggataacctggcggcagcgcaaaagatg

SEQ ID NO: 200555 - DNA, 103 bp, Artificial Sequence
  Synthetic Polynucleotide
taatacgactcactatagggtgccaatgtttcgaaaactaacatcctttcaacagaggagagaaaggatgttagttttcaacctggcggcagcgcaaaagatg

SEQ ID NO: 200556 - DNA, 103 bp, Artificial Sequence
  Synthetic Polynucleotide
taatacgactcactatagggtgagttattatgccaatgtttcgaaaactaaacagaggagatagtttatgaaacattggaacctggcggcagcgcaaaagatg

SEQ ID NO: 200557 - DNA, 103 bp, Artificial Sequence
  Synthetic Polynucleotide
taatacgactcactatagggggccttgtaatgagttattatgccaatgttaacagaggagaaacattatgataataactaacctggcggcagcgcaaaagatg

SEQ ID NO: 200558 - DNA, 103 bp, Artificial Sequence
  Synthetic Polynucleotide
taatacgactcactatagggtcgtcttctgggccttgtaatgagttattaaacagaggagataataaatgattacaaggaacctggcggcagcgcaaaagatg

SEQ ID NO: 200559 - DNA, 103 bp, Artificial Sequence
  Synthetic Polynucleotide
taatacgactcactatagggttctgaatcatcgtcttctgggccttgtaaaacagaggagattacaaatgccagaagacaacctggcggcagcgcaaaagatg

SEQ ID NO: 200560 - DNA, 103 bp, Artificial Sequence
  Synthetic Polynucleotide
taatacgactcactataggggtccaaatccttctgaatcatcgtcttctgaacagaggagacagaagatgatgattcagaacctggcggcagcgcaaaagatg

SEQ ID NO: 200561 - DNA, 103 bp, Artificial Sequence
  Synthetic Polynucleotide
taatacgactcactatagggcgaactctttgtccaaatccttctgaatcaaacagaggagatgattcatgaggatttggaacctggcggcagcgcaaaagatg

SEQ ID NO: 200562 - DNA, 103 bp, Artificial Sequence
  Synthetic Polynucleotide
taatacgactcactatagggccttttctatcgaactctttgtccaaatccaacagaggagaggatttatgcaaagagttaacctggcggcagcgcaaaagatg

SEQ ID NO: 200563 - DNA, 103 bp, Artificial Sequence
  Synthetic Polynucleotide
taatacgactcactatagggttctgctggtccttttctatcgaactctttaacagaggagaaaagagatggatagaaaaaacctggcggcagcgcaaaagatg

SEQ ID NO: 200564 - DNA, 103 bp, Artificial Sequence
  Synthetic Polynucleotide
taatacgactcactatagggacatgcaaatacctaaccaatagcttttgtaacagaggagaacaaaaatgattggttagaacctggcggcagcgcaaaagatg

SEQ ID NO: 200565 - DNA, 103 bp, Artificial Sequence
  Synthetic Polynucleotide
taatacgactcactatagggcagtgtctacttctgctggtccttttctataacagaggagaatagaaatggaccagcagaacctggcggcagcgcaaaagatg

SEQ ID NO: 200566 - DNA, 103 bp, Artificial Sequence
  Synthetic Polynucleotide
taatacgactcactatagggaatgcatccacagtgtctacttctgctggtaacagaggagaaccagcatgagtagacacaacctggcggcagcgcaaaagatg

SEQ ID NO: 200567 - DNA, 103 bp, Artificial Sequence
  Synthetic Polynucleotide
taatacgactcactatagggccgaccctggaatgcatccacagtgtctacaacagaggagagtagacatggtggatgcaaacctggcggcagcgcaaaagatg

SEQ ID NO: 200568 - DNA, 103 bp, Artificial Sequence
  Synthetic Polynucleotide
taatacgactcactatagggaatccttctgccgaccctggaatgcatccaaacagaggagatggatgatgtccagggtcaacctggcggcagcgcaaaagatg

SEQ ID NO: 200569 - DNA, 103 bp, Artificial Sequence
  Synthetic Polynucleotide
taatacgactcactatagggacaataacacaatccttctgccgaccctggaacagaggagaccagggatggcagaaggaaacctggcggcagcgcaaaagatg

SEQ ID NO: 200570 - DNA, 103 bp, Artificial Sequence
  Synthetic Polynucleotide
taatacgactcactataggggacacacgtaacaataacacaatccttctgaacagaggagacagaagatgtgtgttattaacctggcggcagcgcaaaagatg

SEQ ID NO: 200571 - DNA, 103 bp, Artificial Sequence
  Synthetic Polynucleotide
taatacgactcactatagggtatttgctctgacacacgtaacaataacacaacagaggagagtgttaatgttacgtgtgaacctggcggcagcgcaaaagatg

SEQ ID NO: 200572 - DNA, 103 bp, Artificial Sequence
  Synthetic Polynucleotide
taatacgactcactatagggccttggatgctatttgctctgacacacgtaaacagaggagatacgtgatgcagagcaaaaacctggcggcagcgcaaaagatg

SEQ ID NO: 200573 - DNA, 103 bp, Artificial Sequence
  Synthetic Polynucleotide
taatacgactcactatagggtccaattgaaccttggatgctatttgctctaacagaggagaagagcaatgagcatccaaaacctggcggcagcgcaaaagatg

SEQ ID NO: 200574 - DNA, 103 bp, Artificial Sequence
  Synthetic Polynucleotide
taatacgactcactatagggttgccaggaatccaattgaaccttggatgcaacagaggagagcatccatggttcaattgaacctggcggcagcgcaaaagatg

SEQ ID NO: 200575 - DNA, 103 bp, Artificial Sequence
  Synthetic Polynucleotide
taatacgactcactatagggatggtcagcaacatgcaaatacctaaccaaaacagaggagattggttatgtatttgcataacctggcggcagcgcaaaagatg

SEQ ID NO: 200576 - DNA, 103 bp, Artificial Sequence
  Synthetic Polynucleotide
taatacgactcactatagggctctgcaaacttgccaggaatccaattgaaaacagaggagattcaatatgattcctggcaacctggcggcagcgcaaaagatg

SEQ ID NO: 200577 - DNA, 103 bp, Artificial Sequence
  Synthetic Polynucleotide
taatacgactcactataggggacattcaatctctgcaaacttgccaggaaaacagaggagattcctgatgagtttgcagaacctggcggcagcgcaaaagatg

SEQ ID NO: 200578 - DNA, 103 bp, Artificial Sequence
  Synthetic Polynucleotide
taatacgactcactataggggtgtgatggtgacattcaatctctgcaaacaacagaggagagtttgcatggattgaatgaacctggcggcagcgcaaaagatg

SEQ ID NO: 200579 - DNA, 103 bp, Artificial Sequence
  Synthetic Polynucleotide
taatacgactcactatagggtacttggctcgtgtgatggtgacattcaataacagaggagaattgaaatgcaccatcacaacctggcggcagcgcaaaagatg

SEQ ID NO: 200580 - DNA, 103 bp, Artificial Sequence
  Synthetic Polynucleotide
taatacgactcactataggggaagaggctgtacttggctcgtgtgatggtaacagaggagaaccatcatgcgagccaagaacctggcggcagcgcaaaagatg

SEQ ID NO: 200581 - DNA, 103 bp, Artificial Sequence
  Synthetic Polynucleotide
taatacgactcactataggggtccgaggatgaagaggctgtacttggctcaacagaggagagagccaatgacagcctctaacctggcggcagcgcaaaagatg

SEQ ID NO: 200582 - DNA, 103 bp, Artificial Sequence
  Synthetic Polynucleotide
taatacgactcactataggggtcctcaaatgtccgaggatgaagaggctgaacagaggagacagcctatgcatcctcggaacctggcggcagcgcaaaagatg

SEQ ID NO: 200583 - DNA, 103 bp, Artificial Sequence
  Synthetic Polynucleotide
taatacgactcactatagggttccatcagggtcctcaaatgtccgaggataacagaggagaatcctcatgcatttgaggaacctggcggcagcgcaaaagatg

SEQ ID NO: 200584 - DNA, 103 bp, Artificial Sequence
  Synthetic Polynucleotide
taatacgactcactatagggaatgctggttttccatcagggtcctcaaataacagaggagaatttgaatgccctgatggaacctggcggcagcgcaaaagatg

SEQ ID NO: 200585 - DNA, 103 bp, Artificial Sequence
  Synthetic Polynucleotide
taatacgactcactatagggagctgattccaatgctggttttccatcaggaacagaggagacctgatatgaaaccagcaaacctggcggcagcgcaaaagatg

SEQ ID NO: 200586 - DNA, 103 bp, Artificial Sequence
  Synthetic Polynucleotide
taatacgactcactatagggttcctcaagaatggtcagcaacatgcaaataacagaggagaatttgcatgttgctgaccaacctggcggcagcgcaaaagatg

SEQ ID NO: 200587 - DNA, 103 bp, Artificial Sequence
  Synthetic Polynucleotide
taatacgactcactatagggatcctgaatcagctgattccaatgctggttaacagaggagaaaccagatgtggaatcagaacctggcggcagcgcaaaagatg

SEQ ID NO: 200588 - DNA, 103 bp, Artificial Sequence
  Synthetic Polynucleotide
taatacgactcactataggggcttctgagcatcctgaatcagctgattccaacagaggagaggaatcatgtgattcaggaacctggcggcagcgcaaaagatg

SEQ ID NO: 200589 - DNA, 103 bp, Artificial Sequence
  Synthetic Polynucleotide
taatacgactcactatagggatggcaccacgcttctgagcatcctgaatcaacagaggagagattcaatgtgctcagaaaacctggcggcagcgcaaaagatg

SEQ ID NO: 200590 - DNA, 103 bp, Artificial Sequence
  Synthetic Polynucleotide
taatacgactcactatagggggtcttaataatggcaccacgcttctgagcaacagaggagagctcagatgcgtggtgccaacctggcggcagcgcaaaagatg

SEQ ID NO: 200591 - DNA, 103 bp, Artificial Sequence
  Synthetic Polynucleotide
taatacgactcactatagggttttgtcacaggtcttaataatggcaccacaacagaggagagtggtgatgttattaagaaacctggcggcagcgcaaaagatg

SEQ ID NO: 200592 - DNA, 103 bp, Artificial Sequence
  Synthetic Polynucleotide
taatacgactcactatagggtgtctatagtttttgtcacaggtcttaataaacagaggagatattaaatgctgtgacaaaacctggcggcagcgcaaaagatg

SEQ ID NO: 200593 - DNA, 103 bp, Artificial Sequence
  Synthetic Polynucleotide
taatacgactcactatagggcactgcatcatgtctatagtttttgtcacaaacagaggagatgtgacatgaactatagaaacctggcggcagcgcaaaagatg

SEQ ID NO: 200594 - DNA, 103 bp, Artificial Sequence
  Synthetic Polynucleotide
taatacgactcactatagggtcagaatcttcactgcatcatgtctatagtaacagaggagaactataatgatgatgcagaacctggcggcagcgcaaaagatg

SEQ ID NO: 200595 - DNA, 103 bp, Artificial Sequence
  Synthetic Polynucleotide
taatacgactcactatagggggcttgagtttcagaatcttcactgcatcaaacagaggagatgatgcatggaagattctaacctggcggcagcgcaaaagatg

SEQ ID NO: 200596 - DNA, 103 bp, Artificial Sequence
  Synthetic Polynucleotide
taatacgactcactatagggctgcagcacaggcttgagtttcagaatcttaacagaggagaaagattatgaaactcaagaacctggcggcagcgcaaaagatg

SEQ ID NO: 200597 - DNA, 103 bp, Artificial Sequence
  Synthetic Polynucleotide
taatacgactcactatagggccatggcttgttcctcaagaatggtcagcaaacagaggagatgctgaatgttcttgaggaacctggcggcagcgcaaaagatg

SEQ ID NO: 200598 - DNA, 103 bp, Artificial Sequence
  Synthetic Polynucleotide
taatacgactcactatagggtgagacttctctgcagcacaggcttgagttaacagaggagaaactcaatgctgtgctgcaacctggcggcagcgcaaaagatg

SEQ ID NO: 200599 - DNA, 103 bp, Artificial Sequence
  Synthetic Polynucleotide
taatacgactcactatagggggagggtgagtgagacttctctgcagcacaaacagaggagatgtgctatggagaagtctaacctggcggcagcgcaaaagatg

SEQ ID NO: 200600 - DNA, 103 bp, Artificial Sequence
  Synthetic Polynucleotide
taatacgactcactatagggggctatggtaggagggtgagtgagacttctaacagaggagaagaagtatgactcaccctaacctggcggcagcgcaaaagatg

SEQ ID NO: 200601 - DNA, 103 bp, Artificial Sequence
  Synthetic Polynucleotide
taatacgactcactatagggacccctctggggctatggtaggagggtgagaacagaggagactcaccatgctaccatagaacctggcggcagcgcaaaagatg

SEQ ID NO: 200602 - DNA, 103 bp, Artificial Sequence
  Synthetic Polynucleotide
taatacgactcactatagggtggggtctggacccctctggggctatggtaaacagaggagataccatatgcccagagggaacctggcggcagcgcaaaagatg

SEQ ID NO: 200603 - DNA, 103 bp, Artificial Sequence
  Synthetic Polynucleotide
taatacgactcactatagggcaaaccaccctggggtctggacccctctggaacagaggagaccagagatgtccagacccaacctggcggcagcgcaaaagatg

SEQ ID NO: 200604 - DNA, 103 bp, Artificial Sequence
  Synthetic Polynucleotide
taatacgactcactatagggtgctgctgggcaaaccaccctggggtctggaacagaggagaccagacatgagggtggttaacctggcggcagcgcaaaagatg

SEQ ID NO: 200605 - DNA, 103 bp, Artificial Sequence
  Synthetic Polynucleotide
taatacgactcactatagggctgtctagcttgctgctgggcaaaccacccaacagaggagagggtggatggcccagcagaacctggcggcagcgcaaaagatg

SEQ ID NO: 200606 - DNA, 103 bp, Artificial Sequence
  Synthetic Polynucleotide
taatacgactcactatagggggcaaatccactgtctagcttgctgctgggaacagaggagacccagcatgaagctagacaacctggcggcagcgcaaaagatg

SEQ ID NO: 200607 - DNA, 103 bp, Artificial Sequence
  Synthetic Polynucleotide
taatacgactcactatagggcagatgtcttggcaaatccactgtctagctaacagaggagaagctagatggtggatttgaacctggcggcagcgcaaaagatg

SEQ ID NO: 200608 - DNA, 103 bp, Artificial Sequence
  Synthetic Polynucleotide
taatacgactcactatagggaacagggaatccatggcttgttcctcaagaaacagaggagatcttgaatgacaagccataacctggcggcagcgcaaaagatg

SEQ ID NO: 200609 - DNA, 103 bp, Artificial Sequence
  Synthetic Polynucleotide
taatacgactcactataggggaagcagcaacagatgtcttggcaaatccaaacagaggagatggattatgcaagacatcaacctggcggcagcgcaaaagatg

SEQ ID NO: 200610 - DNA, 103 bp, Artificial Sequence
  Synthetic Polynucleotide
taatacgactcactataggggtggtatagagaagcagcaacagatgtcttaacagaggagaaagacaatggttgctgctaacctggcggcagcgcaaaagatg

SEQ ID NO: 200611 - DNA, 103 bp, Artificial Sequence
  Synthetic Polynucleotide
taatacgactcactatagggcagagggtgtgtggtatagagaagcagcaaaacagaggagattgctgatgctctataccaacctggcggcagcgcaaaagatg

SEQ ID NO: 200612 - DNA, 103 bp, Artificial Sequence
  Synthetic Polynucleotide
taatacgactcactatagggtccttggagtcagagggtgtgtggtatagaaacagaggagatctataatgcacaccctcaacctggcggcagcgcaaaagatg

SEQ ID NO: 200613 - DNA, 103 bp, Artificial Sequence
  Synthetic Polynucleotide
taatacgactcactatagggaagagtaatttccttggagtcagagggtgtaacagaggagaacacccatggactccaagaacctggcggcagcgcaaaagatg

SEQ ID NO: 200614 - DNA, 103 bp, Artificial Sequence
  Synthetic Polynucleotide
taatacgactcactatagggaagtaacagtaagagtaatttccttggagtaacagaggagaactccaatgaaattactcaacctggcggcagcgcaaaagatg

SEQ ID NO: 200615 - DNA, 103 bp, Artificial Sequence
  Synthetic Polynucleotide
taatacgactcactataggggggtcctttgaagtaacagtaagagtaattaacagaggagaaattacatgtactgttacaacctggcggcagcgcaaaagatg

SEQ ID NO: 200616 - DNA, 103 bp, Artificial Sequence
  Synthetic Polynucleotide
taatacgactcactatagggaggtctttcagggtcctttgaagtaacagtaacagaggagaactgttatgtcaaaggacaacctggcggcagcgcaaaagatg

SEQ ID NO: 200617 - DNA, 103 bp, Artificial Sequence
  Synthetic Polynucleotide
taatacgactcactatagggcatgaacaggaggtctttcagggtcctttgaacagaggagacaaaggatgctgaaagacaacctggcggcagcgcaaaagatg

SEQ ID NO: 200618 - DNA, 103 bp, Artificial Sequence
  Synthetic Polynucleotide
taatacgactcactatagggtgaagttggtcatgaacaggaggtctttcaaacagaggagatgaaagatgtcctgttcaaacctggcggcagcgcaaaagatg

SEQ ID NO: 200619 - DNA, 103 bp, Artificial Sequence
  Synthetic Polynucleotide
taatacgactcactatagggtgagcccaacaacagggaatccatggcttgaacagaggagacaagccatggattccctgaacctggcggcagcgcaaaagatg

SEQ ID NO: 200620 - DNA, 103 bp, Artificial Sequence
  Synthetic Polynucleotide
taatacgactcactatagggtcgtgggtcctgaagttggtcatgaacaggaacagaggagacctgttatggaccaacttaacctggcggcagcgcaaaagatg

SEQ ID NO: 200621 - DNA, 103 bp, Artificial Sequence
  Synthetic Polynucleotide
taatacgactcactatagggtcttcagcagtcgtgggtcctgaagttggtaacagaggagaaccaacatgaggacccacaacctggcggcagcgcaaaagatg

SEQ ID NO: 200622 - DNA, 103 bp, Artificial Sequence
  Synthetic Polynucleotide
taatacgactcactatagggatgcccatcctcttcagcagtcgtgggtccaacagaggagaggacccatgactgctgaaaacctggcggcagcgcaaaagatg

SEQ ID NO: 200623 - DNA, 103 bp, Artificial Sequence
  Synthetic Polynucleotide
taatacgactcactatagggtttgacctcaatgcccatcctcttcagcagaacagaggagactgctgatgaggatgggcaacctggcggcagcgcaaaagatg

SEQ ID NO: 200624 - DNA, 103 bp, Artificial Sequence
  Synthetic Polynucleotide
taatacgactcactatagggatattcctcctttgacctcaatgcccatccaacagaggagaggatggatgttgaggtcaaacctggcggcagcgcaaaagatg

SEQ ID NO: 200625 - DNA, 103 bp, Artificial Sequence
  Synthetic Polynucleotide
taatacgactcactatagggtcccaaaggaatattcctcctttgacctcaaacagaggagatgaggtatgaggaggaataacctggcggcagcgcaaaagatg

SEQ ID NO: 200626 - DNA, 103 bp, Artificial Sequence
  Synthetic Polynucleotide
taatacgactcactataggggggttgtggatcccaaaggaatattcctccaacagaggagaggaggaatgttcctttggaacctggcggcagcgcaaaagatg

SEQ ID NO: 200627 - DNA, 103 bp, Artificial Sequence
  Synthetic Polynucleotide
taatacgactcactataggggggggctcgagggttgtggatcccaaaggaaacagaggagatcctttatgatccacaacaacctggcggcagcgcaaaagatg

SEQ ID NO: 200628 - DNA, 103 bp, Artificial Sequence
  Synthetic Polynucleotide
taatacgactcactatagggccaggatgctgggggctcgagggttgtggaaacagaggagatccacaatgctcgagcccaacctggcggcagcgcaaaagatg

SEQ ID NO: 200629 - DNA, 103 bp, Artificial Sequence
  Synthetic Polynucleotide
taatacgactcactatagggaggtgttgctccaggatgctgggggctcgaaacagaggagatcgagcatgcagcatcctaacctggcggcagcgcaaaagatg

SEQ ID NO: 200630 - DNA, 103 bp, Artificial Sequence
  Synthetic Polynucleotide
taatacgactcactatagggtttgtttgtctgagcccaacaacagggaataacagaggagaattcccatgtgttgggctaacctggcggcagcgcaaaagatg

SEQ ID NO: 200631 - DNA, 103 bp, Artificial Sequence
  Synthetic Polynucleotide
taatacgactcactatagggcgcccgtaggaggtgttgctccaggatgctaacagaggagaagcatcatggagcaacacaacctggcggcagcgcaaaagatg

SEQ ID NO: 200632 - DNA, 103 bp, Artificial Sequence
  Synthetic Polynucleotide
taatacgactcactatagggaagcccggctcgcccgtaggaggtgttgctaacagaggagaagcaacatgtcctacgggaacctggcggcagcgcaaaagatg

SEQ ID NO: 200633 - DNA, 103 bp, Artificial Sequence
  Synthetic Polynucleotide
taatacgactcactatagggaacgacagggaagcccggctcgcccgtaggaacagaggagacctacgatggagccgggcaacctggcggcagcgcaaaagatg

SEQ ID NO: 200634 - DNA, 103 bp, Artificial Sequence
  Synthetic Polynucleotide
taatacgactcactatagggggtcctggtgaacgacagggaagcccggctaacagaggagaagccggatgtccctgtcgaacctggcggcagcgcaaaagatg

SEQ ID NO: 200635 - DNA, 103 bp, Artificial Sequence
  Synthetic Polynucleotide
taatacgactcactatagggatatggctcaggtcctggtgaacgacagggaacagaggagaccctgtatgtcaccaggaaacctggcggcagcgcaaaagatg

SEQ ID NO: 200636 - DNA, 103 bp, Artificial Sequence
  Synthetic Polynucleotide
taatacgactcactataggggggctgctgtatatggctcaggtcctggtgaacagaggagacaccagatgctgagccataacctggcggcagcgcaaaagatg

SEQ ID NO: 200637 - DNA, 103 bp, Artificial Sequence
  Synthetic Polynucleotide
taatacgactcactatagggctacagcagcgggctgctgtatatggctcaaacagaggagatgagccatgtacagcagcaacctggcggcagcgcaaaagatg

SEQ ID NO: 200638 - DNA, 103 bp, Artificial Sequence
  Synthetic Polynucleotide
taatacgactcactatagggagagcagccactacagcagcgggctgctgtaacagaggagaacagcaatgcgctgctgtaacctggcggcagcgcaaaagatg

SEQ ID NO: 200639 - DNA, 103 bp, Artificial Sequence
  Synthetic Polynucleotide
taatacgactcactataggggtggctgctcagagcagccactacagcagcaacagaggagagctgctatggtggctgctaacctggcggcagcgcaaaagatg

SEQ ID NO: 200640 - DNA, 103 bp, Artificial Sequence
  Synthetic Polynucleotide
taatacgactcactatagggcgggaggtttgtggctgctcagagcagccaaacagaggagatggctgatgtgagcagccaacctggcggcagcgcaaaagatg

SEQ ID NO: 200641 - DNA, 103 bp, Artificial Sequence
  Synthetic Polynucleotide
taatacgactcactatagggataaaatcattttgtttgtctgagcccaacaacagaggagagttgggatgagacaaacaaacctggcggcagcgcaaaagatg

SEQ ID NO: 200642 - DNA, 103 bp, Artificial Sequence
  Synthetic Polynucleotide
taatacgactcactatagggtcgccccgcacgggaggtttgtggctgctcaacagaggagagagcagatgcaaacctccaacctggcggcagcgcaaaagatg

SEQ ID NO: 200643 - DNA, 103 bp, Artificial Sequence
  Synthetic Polynucleotide
taatacgactcactatagggagctggaggttcgccccgcacgggaggtttaacagaggagaaaacctatggtgcggggcaacctggcggcagcgcaaaagatg

SEQ ID NO: 200644 - DNA, 103 bp, Artificial Sequence
  Synthetic Polynucleotide
taatacgactcactatagggcgggactggcagctggaggttcgccccgcaaacagaggagatgcgggatgaacctccagaacctggcggcagcgcaaaagatg

SEQ ID NO: 200645 - DNA, 103 bp, Artificial Sequence
  Synthetic Polynucleotide
taatacgactcactataggggtggaagcctcgggactggcagctggaggtaacagaggagaacctccatgtgccagtccaacctggcggcagcgcaaaagatg

SEQ ID NO: 200646 - DNA, 103 bp, Artificial Sequence
  Synthetic Polynucleotide
taatacgactcactataggggctctgacacgtggaagcctcgggactggcaacagaggagagccagtatggaggcttccaacctggcggcagcgcaaaagatg

SEQ ID NO: 200647 - DNA, 103 bp, Artificial Sequence
  Synthetic Polynucleotide
taatacgactcactatagggcatcacatttgctctgacacgtggaagcctaacagaggagaaggcttatgcgtgtcagaaacctggcggcagcgcaaaagatg

SEQ ID NO: 200648 - DNA, 103 bp, Artificial Sequence
  Synthetic Polynucleotide
taatacgactcactatagggtcttccgggtcatcacatttgctctgacacaacagaggagagtgtcaatgcaaatgtgaaacctggcggcagcgcaaaagatg

SEQ ID NO: 200649 - DNA, 103 bp, Artificial Sequence
  Synthetic Polynucleotide
taatacgactcactatagggacagagctcctcttccgggtcatcacatttaacagaggagaaaatgtatggacccggaaaacctggcggcagcgcaaaagatg

SEQ ID NO: 200650 - DNA, 103 bp, Artificial Sequence
  Synthetic Polynucleotide
taatacgactcactatagggctctcctgtgacagagctcctcttccgggtaacagaggagaacccggatgaggagctctaacctggcggcagcgcaaaagatg

SEQ ID NO: 200651 - DNA, 103 bp, Artificial Sequence
  Synthetic Polynucleotide
taatacgactcactataggggccctggcctctctcctgtgacagagctccaacagaggagaggagctatgtcacaggagaacctggcggcagcgcaaaagatg

SEQ ID NO: 200652 - DNA, 103 bp, Artificial Sequence
  Synthetic Polynucleotide
taatacgactcactatagggtatcgattgcataaaatcattttgtttgtcaacagaggagagacaaaatgaatgattttaacctggcggcagcgcaaaagatg

SEQ ID NO: 200653 - DNA, 103 bp, Artificial Sequence
  Synthetic Polynucleotide
taatacgactcactatagggttcactgaaagccctggcctctctcctgtgaacagaggagacacaggatggaggccaggaacctggcggcagcgcaaaagatg

SEQ ID NO: 200654 - DNA, 103 bp, Artificial Sequence
  Synthetic Polynucleotide
taatacgactcactatagggcctgctccccttcactgaaagccctggcctaacagaggagaaggccaatgctttcagtgaacctggcggcagcgcaaaagatg

SEQ ID NO: 200655 - DNA, 103 bp, Artificial Sequence
  Synthetic Polynucleotide
taatacgactcactatagggccacacttctcctgctccccttcactgaaaaacagaggagatttcagatgaggggagcaaacctggcggcagcgcaaaagatg

SEQ ID NO: 200656 - DNA, 103 bp, Artificial Sequence
  Synthetic Polynucleotide
taatacgactcactatagggggtctcggaaccacacttctcctgctccccaacagaggagaggggagatggagaagtgtaacctggcggcagcgcaaaagatg

SEQ ID NO: 200657 - DNA, 103 bp, Artificial Sequence
  Synthetic Polynucleotide
taatacgactcactatagggtggtgtgatgggtctcggaaccacacttctaacagaggagaagaagtatggttccgagaaacctggcggcagcgcaaaagatg

SEQ ID NO: 200658 - DNA, 103 bp, Artificial Sequence
  Synthetic Polynucleotide
taatacgactcactataggggagttcctcctggtgtgatgggtctcggaaaacagaggagattccgaatgccatcacacaacctggcggcagcgcaaaagatg

SEQ ID NO: 200659 - DNA, 103 bp, Artificial Sequence
  Synthetic Polynucleotide
taatacgactcactataggggtcccacctagagttcctcctggtgtgatgaacagaggagacatcacatgaggaggaacaacctggcggcagcgcaaaagatg

SEQ ID NO: 200660 - DNA, 103 bp, Artificial Sequence
  Synthetic Polynucleotide
taatacgactcactataggggtgtcctcttgtcccacctagagttcctccaacagaggagaggaggaatgctaggtgggaacctggcggcagcgcaaaagatg

SEQ ID NO: 200661 - DNA, 103 bp, Artificial Sequence
  Synthetic Polynucleotide
taatacgactcactatagggtcctgctccagtgtcctcttgtcccacctaaacagaggagataggtgatgcaagaggacaacctggcggcagcgcaaaagatg

SEQ ID NO: 200662 - DNA, 103 bp, Artificial Sequence
  Synthetic Polynucleotide
taatacgactcactatagggactgctgtcctcctgctccagtgtcctcttaacagaggagaaagaggatgctggagcagaacctggcggcagcgcaaaagatg

SEQ ID NO: 200663 - DNA, 103 bp, Artificial Sequence
  Synthetic Polynucleotide
taatacgactcactatagggcggctgtttgaaattcaccggacggagtgtaacagaggagaacactcatgccggtgaataacctggcggcagcgcaaaagatg

SEQ ID NO: 200664 - DNA, 103 bp, Artificial Sequence
  Synthetic Polynucleotide
taatacgactcactatagggtagtgtgaagtatcgattgcataaaatcataacagaggagaatgattatgtgcaatcgaaacctggcggcagcgcaaaagatg

SEQ ID NO: 200665 - DNA, 103 bp, Artificial Sequence
  Synthetic Polynucleotide
taatacgactcactatagggttttcttggaactgctgtcctcctgctccaaacagaggagatggagcatgaggacagcaaacctggcggcagcgcaaaagatg

SEQ ID NO: 200666 - DNA, 103 bp, Artificial Sequence
  Synthetic Polynucleotide
taatacgactcactatagggaaaagctttcttttcttggaactgctgtccaacagaggagaggacagatgttccaagaaaacctggcggcagcgcaaaagatg

SEQ ID NO: 200667 - DNA, 103 bp, Artificial Sequence
  Synthetic Polynucleotide
taatacgactcactatagggtccctctccatagtgtgaagtatcgattgcaacagaggagagcaatcatgacttcacacaacctggcggcagcgcaaaagatg

SEQ ID NO: 200668 - DNA, 103 bp, Artificial Sequence
  Synthetic Polynucleotide
taatacgactcactatagggatcatctgcttccctctccatagtgtgaagaacagaggagacttcacatgatggagaggaacctggcggcagcgcaaaagatg

SEQ ID NO: 200669 - DNA, 103 bp, Artificial Sequence
  Synthetic Polynucleotide
taatacgactcactatagggccacactatcatcatctgcttccctctccaaacagaggagatggagaatgaagcagatgaacctggcggcagcgcaaaagatg

SEQ ID NO: 200670 - DNA, 103 bp, Artificial Sequence
  Synthetic Polynucleotide
taatacgactcactatagggcagaaaggatccacactatcatcatctgctaacagaggagaagcagaatgtgatagtgtaacctggcggcagcgcaaaagatg

SEQ ID NO: 200671 - DNA, 103 bp, Artificial Sequence
  Synthetic Polynucleotide
taatacgactcactatagggtaacgctggccagaaaggatccacactatcaacagaggagagatagtatggatcctttcaacctggcggcagcgcaaaagatg

SEQ ID NO: 200672 - DNA, 103 bp, Artificial Sequence
  Synthetic Polynucleotide
taatacgactcactatagggtaaaacagtgtaacgctggccagaaaggataacagaggagaatccttatgggccagcgtaacctggcggcagcgcaaaagatg

SEQ ID NO: 200673 - DNA, 103 bp, Artificial Sequence
  Synthetic Polynucleotide
taatacgactcactatagggagaatcaccataaaacagtgtaacgctggcaacagaggagagccagcatgacactgtttaacctggcggcagcgcaaaagatg

SEQ ID NO: 200674 - DNA, 103 bp, Artificial Sequence
  Synthetic Polynucleotide
taatacgactcactatagggaaggcgatccagaatcaccataaaacagtgaacagaggagacactgtatgatggtgattaacctggcggcagcgcaaaagatg

SEQ ID NO: 200675 - DNA, 103 bp, Artificial Sequence
  Synthetic Polynucleotide
taatacgactcactatagggccttagatccaaggcgatccagaatcaccaaacagaggagatggtgaatgtggatcgccaacctggcggcagcgcaaaagatg

SEQ ID NO: 200676 - DNA, 103 bp, Artificial Sequence
  Synthetic Polynucleotide
taatacgactcactatagggaggtcttcgtcggctgtttgaaattcaccgaacagaggagacggtgaatgtcaaacagcaacctggcggcagcgcaaaagatg

SEQ ID NO: 200677 - DNA, 103 bp, Artificial Sequence
  Synthetic Polynucleotide
taatacgactcactatagggtgaccccagaccttagatccaaggcgatccaacagaggagaggatcgatgtggatctaaaacctggcggcagcgcaaaagatg

SEQ ID NO: 200678 - DNA, 103 bp, Artificial Sequence
  Synthetic Polynucleotide
taatacgactcactatagggatccataagttgaccccagaccttagatccaacagaggagaggatctatggtctggggtaacctggcggcagcgcaaaagatg

SEQ ID NO: 200679 - DNA, 103 bp, Artificial Sequence
  Synthetic Polynucleotide
taatacgactcactatagggccacaataggatccataagttgaccccagaaacagaggagatctgggatgaacttatggaacctggcggcagcgcaaaagatg

SEQ ID NO: 200680 - DNA, 103 bp, Artificial Sequence
  Synthetic Polynucleotide
taatacgactcactataggggtttgaaatgccacaataggatccataagtaacagaggagaacttatatgtcctattgtaacctggcggcagcgcaaaagatg

SEQ ID NO: 200681 - DNA, 103 bp, Artificial Sequence
  Synthetic Polynucleotide
taatacgactcactataggggttgataatggtttgaaatgccacaataggaacagaggagacctattatggcatttcaaaacctggcggcagcgcaaaagatg

SEQ ID NO: 200682 - DNA, 103 bp, Artificial Sequence
  Synthetic Polynucleotide
taatacgactcactatagggagcttgcgttgttgataatggtttgaaatgaacagaggagacatttcatgccattatcaaacctggcggcagcgcaaaagatg

SEQ ID NO: 200683 - DNA, 103 bp, Artificial Sequence
  Synthetic Polynucleotide
taatacgactcactatagggtctctattgtagcttgcgttgttgataatgaacagaggagacattatatgcaacgcaagaacctggcggcagcgcaaaagatg

SEQ ID NO: 200684 - DNA, 103 bp, Artificial Sequence
  Synthetic Polynucleotide
taatacgactcactatagggatgtcggatctctctattgtagcttgcgttaacagaggagaaacgcaatgtacaatagaaacctggcggcagcgcaaaagatg

SEQ ID NO: 200685 - DNA, 103 bp, Artificial Sequence
  Synthetic Polynucleotide
taatacgactcactatagggtgttccgtatatgtcggatctctctattgtaacagaggagaacaataatgagatccgacaacctggcggcagcgcaaaagatg

SEQ ID NO: 200686 - DNA, 103 bp, Artificial Sequence
  Synthetic Polynucleotide
taatacgactcactatagggcttacagagctgttccgtatatgtcggatcaacagaggagagatccgatgtatacggaaaacctggcggcagcgcaaaagatg

SEQ ID NO: 200687 - DNA, 103 bp, Artificial Sequence
  Synthetic Polynucleotide
taatacgactcactataggggccacgactccggaaccgatcccgagacataacagaggagaatgtctatggatcggttcaacctggcggcagcgcaaaagatg

SEQ ID NO: 200688 - DNA, 103 bp, Artificial Sequence
  Synthetic Polynucleotide
taatacgactcactataggggaggcccatgccgggcggcggagaacggaaaacagaggagattccgtatgccgccgcccaacctggcggcagcgcaaaagatg

SEQ ID NO: 200689 - DNA, 103 bp, Artificial Sequence
  Synthetic Polynucleotide
taatacgactcactatagggttcaagcttaataaatccgaatcctttgccaacagaggagaggcaaaatgttcggatttaacctggcggcagcgcaaaagatg

SEQ ID NO: 200690 - DNA, 103 bp, Artificial Sequence
  Synthetic Polynucleotide
taatacgactcactatagggaagctctagattcaagcttaataaatccgaaacagaggagatcggatatgttaagcttgaacctggcggcagcgcaaaagatg

SEQ ID NO: 200691 - DNA, 103 bp, Artificial Sequence
  Synthetic Polynucleotide
taatacgactcactatagggatttcagccaaagctctagattcaagcttaaacagaggagataagctatgatctagagcaacctggcggcagcgcaaaagatg

SEQ ID NO: 200692 - DNA, 103 bp, Artificial Sequence
  Synthetic Polynucleotide
taatacgactcactatagggggctttggcaatttcagccaaagctctagaaacagaggagatctagaatgttggctgaaaacctggcggcagcgcaaaagatg

SEQ ID NO: 200693 - DNA, 103 bp, Artificial Sequence
  Synthetic Polynucleotide
taatacgactcactatagggcatccagttcggctttggcaatttcagccaaacagaggagatggctgatgttgccaaagaacctggcggcagcgcaaaagatg

SEQ ID NO: 200694 - DNA, 103 bp, Artificial Sequence
  Synthetic Polynucleotide
taatacgactcactatagggatgggtgtatcatccagttcggctttggcaaacagaggagatgccaaatgcgaactggaaacctggcggcagcgcaaaagatg

SEQ ID NO: 200695 - DNA, 103 bp, Artificial Sequence
  Synthetic Polynucleotide
taatacgactcactatagggtctacctctcatgggtgtatcatccagttcaacagaggagagaactgatggatacacccaacctggcggcagcgcaaaagatg

SEQ ID NO: 200696 - DNA, 103 bp, Artificial Sequence
  Synthetic Polynucleotide
taatacgactcactatagggctcgaagctgtctacctctcatgggtgtataacagaggagaatacacatgtgagaggtaaacctggcggcagcgcaaaagatg

SEQ ID NO: 200697 - DNA, 103 bp, Artificial Sequence
  Synthetic Polynucleotide
taatacgactcactataggggcaaagcgaactcgaagctgtctacctctcaacagaggagagagaggatgacagcttcgaacctggcggcagcgcaaaagatg

SEQ ID NO: 200698 - DNA, 103 bp, Artificial Sequence
  Synthetic Polynucleotide
taatacgactcactatagggagcatgtgtggcaaagcgaactcgaagctgaacagaggagacagcttatggttcgctttaacctggcggcagcgcaaaagatg

SEQ ID NO: 200699 - DNA, 103 bp, Artificial Sequence
  Synthetic Polynucleotide
taatacgactcactataggggattctgattgaggcccatgccgggcggcgaacagaggagacgccgcatggcatgggccaacctggcggcagcgcaaaagatg

SEQ ID NO: 200700 - DNA, 103 bp, Artificial Sequence
  Synthetic Polynucleotide
taatacgactcactatagggaaagggcagcagcatgtgtggcaaagcgaaaacagaggagattcgctatgccacacatgaacctggcggcagcgcaaaagatg

SEQ ID NO: 200701 - DNA, 103 bp, Artificial Sequence
  Synthetic Polynucleotide
taatacgactcactatagggttacgaacagaaagggcagcagcatgtgtgaacagaggagacacacaatgtgctgccctaacctggcggcagcgcaaaagatg

SEQ ID NO: 200702 - DNA, 103 bp, Artificial Sequence
  Synthetic Polynucleotide
taatacgactcactatagggaggtgaaagattacgaacagaaagggcagcaacagaggagagctgccatgtctgttcgtaacctggcggcagcgcaaaagatg

SEQ ID NO: 200703 - DNA, 103 bp, Artificial Sequence
  Synthetic Polynucleotide
taatacgactcactatagggtggaaacataaggtgaaagattacgaacagaacagaggagactgttcatgatctttcacaacctggcggcagcgcaaaagatg

SEQ ID NO: 200704 - DNA, 103 bp, Artificial Sequence
  Synthetic Polynucleotide
taatacgactcactatagggaacagttcattggaaacataaggtgaaagaaacagaggagatctttcatgttatgtttcaacctggcggcagcgcaaaagatg

SEQ ID NO: 200705 - DNA, 103 bp, Artificial Sequence
  Synthetic Polynucleotide
taatacgactcactatagggggcttcttccaacagttcattggaaacataaacagaggagatatgttatgaatgaactgaacctggcggcagcgcaaaagatg

SEQ ID NO: 200706 - DNA, 103 bp, Artificial Sequence
  Synthetic Polynucleotide
taatacgactcactatagggattggctaaaggcttcttccaacagttcataacagaggagaatgaacatgtggaagaagaacctggcggcagcgcaaaagatg

SEQ ID NO: 200707 - DNA, 103 bp, Artificial Sequence
  Synthetic Polynucleotide
taatacgactcactatagggataggaccaaattggctaaaggcttcttccaacagaggagaggaagaatgctttagccaaacctggcggcagcgcaaaagatg

SEQ ID NO: 200708 - DNA, 103 bp, Artificial Sequence
  Synthetic Polynucleotide
taatacgactcactatagggagccctttcaataggaccaaattggctaaaaacagaggagatttagcatgtttggtcctaacctggcggcagcgcaaaagatg

SEQ ID NO: 200709 - DNA, 103 bp, Artificial Sequence
  Synthetic Polynucleotide
taatacgactcactatagggctattacaacagccctttcaataggaccaaaacagaggagattggtcatgttgaaagggaacctggcggcagcgcaaaagatg

SEQ ID NO: 200710 - DNA, 103 bp, Artificial Sequence
  Synthetic Polynucleotide
taatacgactcactatagggatggggccgcgattctgattgaggcccatgaacagaggagacatgggatgcaatcagaaaacctggcggcagcgcaaaagatg

SEQ ID NO: 200711 - DNA, 103 bp, Artificial Sequence
  Synthetic Polynucleotide
taatacgactcactatagggcgatcatccactattacaacagccctttcaaacagaggagatgaaagatgtgttgtaataacctggcggcagcgcaaaagatg

SEQ ID NO: 200712 - DNA, 103 bp, Artificial Sequence
  Synthetic Polynucleotide
taatacgactcactatagggagatcttccacgatcatccactattacaacaacagaggagagttgtaatggtggatgataacctggcggcagcgcaaaagatg

SEQ ID NO: 200713 - DNA, 103 bp, Artificial Sequence
  Synthetic Polynucleotide
taatacgactcactatagggctttccctgtagatcttccacgatcatccaaacagaggagatggatgatggtggaagataacctggcggcagcgcaaaagatg

SEQ ID NO: 200714 - DNA, 103 bp, Artificial Sequence
  Synthetic Polynucleotide
taatacgactcactatagggtcaacaatgcctttccctgtagatcttccaaacagaggagatggaagatgtacagggaaaacctggcggcagcgcaaaagatg

SEQ ID NO: 200715 - DNA, 103 bp, Artificial Sequence
  Synthetic Polynucleotide
taatacgactcactatagggagaagcaaattcaacaatgcctttccctgtaacagaggagaacagggatgggcattgttaacctggcggcagcgcaaaagatg

SEQ ID NO: 200716 - DNA, 103 bp, Artificial Sequence
  Synthetic Polynucleotide
taatacgactcactatagggctgctggcttagaagcaaattcaacaatgcaacagaggagagcattgatgaatttgcttaacctggcggcagcgcaaaagatg

SEQ ID NO: 200717 - DNA, 103 bp, Artificial Sequence
  Synthetic Polynucleotide
taatacgactcactataggggcctttcttgctgctggcttagaagcaaataacagaggagaatttgcatgtaagccagcaacctggcggcagcgcaaaagatg

SEQ ID NO: 200718 - DNA, 103 bp, Artificial Sequence
  Synthetic Polynucleotide
taatacgactcactatagggtcgttcaaatgcctttcttgctgctggcttaacagaggagaaagccaatggcaagaaagaacctggcggcagcgcaaaagatg

SEQ ID NO: 200719 - DNA, 103 bp, Artificial Sequence
  Synthetic Polynucleotide
taatacgactcactatagggcttcactgcatcgttcaaatgcctttcttgaacagaggagacaagaaatgcatttgaacaacctggcggcagcgcaaaagatg

SEQ ID NO: 200720 - DNA, 103 bp, Artificial Sequence
  Synthetic Polynucleotide
taatacgactcactatagggaagaaaacaccttcactgcatcgttcaaataacagaggagaatttgaatgatgcagtgaaacctggcggcagcgcaaaagatg

SEQ ID NO: 200721 - DNA, 103 bp, Artificial Sequence
  Synthetic Polynucleotide
taatacgactcactataggggccaggacccatggggccgcgattctgattaacagaggagaaatcagatgcgcggccccaacctggcggcagcgcaaaagatg

SEQ ID NO: 200722 - DNA, 103 bp, Artificial Sequence
  Synthetic Polynucleotide
taatacgactcactatagggtgtcgtcagtaagaaaacaccttcactgcaaacagaggagatgcagtatgggtgttttcaacctggcggcagcgcaaaagatg

SEQ ID NO: 200723 - DNA, 103 bp, Artificial Sequence
  Synthetic Polynucleotide
taatacgactcactataggggacgaggagttgtcgtcagtaagaaaacacaacagaggagagtgtttatgtactgacgaaacctggcggcagcgcaaaagatg

SEQ ID NO: 200724 - DNA, 103 bp, Artificial Sequence
  Synthetic Polynucleotide
taatacgactcactatagggacaatgactggacgaggagttgtcgtcagtaacagaggagaactgacatgaactcctcgaacctggcggcagcgcaaaagatg

SEQ ID NO: 200725 - DNA, 103 bp, Artificial Sequence
  Synthetic Polynucleotide
taatacgactcactatagggaagtggttccacaatgactggacgaggagtaacagaggagaactcctatgccagtcattaacctggcggcagcgcaaaagatg

SEQ ID NO: 200726 - DNA, 103 bp, Artificial Sequence
  Synthetic Polynucleotide
taatacgactcactatagggctagttgttcaagtggttccacaatgactgaacagaggagacagtcaatgtggaaccacaacctggcggcagcgcaaaagatg

SEQ ID NO: 200727 - DNA, 103 bp, Artificial Sequence
  Synthetic Polynucleotide
taatacgactcactatagggtcttcatcatctagttgttcaagtggttccaacagaggagaggaaccatgtgaacaactaacctggcggcagcgcaaaagatg

SEQ ID NO: 200728 - DNA, 103 bp, Artificial Sequence
  Synthetic Polynucleotide
taatacgactcactatagggaggaagaccatcttcatcatctagttgttcaacagaggagagaacaaatggatgatgaaaacctggcggcagcgcaaaagatg

SEQ ID NO: 200729 - DNA, 103 bp, Artificial Sequence
  Synthetic Polynucleotide
taatacgactcactatagggcaagtttttcaggaagaccatcttcatcataacagaggagaatgatgatgatggtcttcaacctggcggcagcgcaaaagatg

SEQ ID NO: 200730 - DNA, 103 bp, Artificial Sequence
  Synthetic Polynucleotide
taatacgactcactatagggttcttctgggcaagtttttcaggaagaccaaacagaggagatggtctatgtgaaaaactaacctggcggcagcgcaaaagatg

SEQ ID NO: 200731 - DNA, 103 bp, Artificial Sequence
  Synthetic Polynucleotide
taatacgactcactatagggatacattggattcttctgggcaagtttttcaacagaggagagaaaaaatggcccagaagaacctggcggcagcgcaaaagatg

SEQ ID NO: 200732 - DNA, 103 bp, Artificial Sequence
  Synthetic Polynucleotide
taatacgactcactatagggtctggcccgggccaggacccatggggccgcaacagaggagagcggccatgtgggtcctgaacctggcggcagcgcaaaagatg

SEQ ID NO: 200733 - DNA, 103 bp, Artificial Sequence
  Synthetic Polynucleotide
taatacgactcactatagggtctccttttgatacattggattcttctgggaacagaggagacccagaatgatccaatgtaacctggcggcagcgcaaaagatg

SEQ ID NO: 200734 - DNA, 103 bp, Artificial Sequence
  Synthetic Polynucleotide
taatacgactcactatagggggggtttctctctccttttgatacattggaaacagaggagatccaatatgtcaaaaggaaacctggcggcagcgcaaaagatg

SEQ ID NO: 200735 - DNA, 103 bp, Artificial Sequence
  Synthetic Polynucleotide
taatacgactcactatagggaaaacgaggaggggtttctctctccttttgaacagaggagacaaaagatgagagaaaccaacctggcggcagcgcaaaagatg

SEQ ID NO: 200736 - DNA, 103 bp, Artificial Sequence
  Synthetic Polynucleotide
taatacgactcactatagggcatgctgggcaaaacgaggaggggtttctcaacagaggagagagaaaatgctcctcgttaacctggcggcagcgcaaaagatg

SEQ ID NO: 200737 - DNA, 103 bp, Artificial Sequence
  Synthetic Polynucleotide
taatacgactcactatagggtcaaacgtgccatgctgggcaaaacgaggaaacagaggagatcctcgatgtgcccagcaaacctggcggcagcgcaaaagatg

SEQ ID NO: 200738 - DNA, 103 bp, Artificial Sequence
  Synthetic Polynucleotide
taatacgactcactatagggatattcgtactcaaacgtgccatgctgggcaacagaggagagcccagatgggcacgtttaacctggcggcagcgcaaaagatg

SEQ ID NO: 200739 - DNA, 103 bp, Artificial Sequence
  Synthetic Polynucleotide
taatacgactcactatagggatcgctgagaatattcgtactcaaacgtgcaacagaggagagcacgtatgagtacgaataacctggcggcagcgcaaaagatg

SEQ ID NO: 200740 - DNA, 103 bp, Artificial Sequence
  Synthetic Polynucleotide
taatacgactcactatagggaaagacttccatcgctgagaatattcgtacaacagaggagagtacgaatgttctcagcgaacctggcggcagcgcaaaagatg

SEQ ID NO: 200741 - DNA, 103 bp, Artificial Sequence
  Synthetic Polynucleotide
taatacgactcactatagggcatttcatccaaagacttccatcgctgagaaacagaggagatctcagatgtggaagtctaacctggcggcagcgcaaaagatg

SEQ ID NO: 200742 - DNA, 103 bp, Artificial Sequence
  Synthetic Polynucleotide
taatacgactcactataggggctgtttttccatttcatccaaagacttccaacagaggagaggaagtatgtggatgaaaaacctggcggcagcgcaaaagatg

SEQ ID NO: 200743 - DNA, 103 bp, Artificial Sequence
  Synthetic Polynucleotide
taatacgactcactatagggttagggccgctctggcccgggccaggacccaacagaggagagggtccatgcccgggccaaacctggcggcagcgcaaaagatg

SEQ ID NO: 200744 - DNA, 103 bp, Artificial Sequence
  Synthetic Polynucleotide
taatacgactcactatagggtgttccctttgctgtttttccatttcatccaacagaggagaggatgaatgggaaaaacaaacctggcggcagcgcaaaagatg

SEQ ID NO: 200745 - DNA, 103 bp, Artificial Sequence
  Synthetic Polynucleotide
taatacgactcactatagggtttttcaacttgttccctttgctgtttttcaacagaggagagaaaaaatgcaaagggaaaacctggcggcagcgcaaaagatg

SEQ ID NO: 200746 - DNA, 103 bp, Artificial Sequence
  Synthetic Polynucleotide
taatacgactcactatagggctttcatgtttttttcaacttgttccctttaacagaggagaaaagggatgaagttgaaaaacctggcggcagcgcaaaagatg

SEQ ID NO: 200747 - DNA, 103 bp, Artificial Sequence
  Synthetic Polynucleotide
taatacgactcactatagggtcttttgcatctttcatgtttttttcaactaacagaggagaagttgaatgaaacatgaaaacctggcggcagcgcaaaagatg

SEQ ID NO: 200748 - DNA, 103 bp, Artificial Sequence
  Synthetic Polynucleotide
taatacgactcactatagggttccaatttgtcttttgcatctttcatgttaacagaggagaaacatgatggatgcaaaaaacctggcggcagcgcaaaagatg

SEQ ID NO: 200749 - DNA, 103 bp, Artificial Sequence
  Synthetic Polynucleotide
taatacgactcactatagggccatttcactttccaatttgtcttttgcataacagaggagaatgcaaatgacaaattggaacctggcggcagcgcaaaagatg

SEQ ID NO: 200750 - DNA, 103 bp, Artificial Sequence
  Synthetic Polynucleotide
taatacgactcactatagggtaggcatcttccatttcactttccaatttgaacagaggagacaaattatgaagtgaaataacctggcggcagcgcaaaagatg

SEQ ID NO: 200751 - DNA, 103 bp, Artificial Sequence
  Synthetic Polynucleotide
taatacgactcactatagggatgttcatgataggcatcttccatttcactaacagaggagaagtgaaatggaagatgccaacctggcggcagcgcaaaagatg

SEQ ID NO: 200752 - DNA, 103 bp, Artificial Sequence
  Synthetic Polynucleotide
taatacgactcactataggggatttgcctgatgttcatgataggcatcttaacagaggagaaagatgatgatcatgaacaacctggcggcagcgcaaaagatg

SEQ ID NO: 200753 - DNA, 103 bp, Artificial Sequence
  Synthetic Polynucleotide
taatacgactcactatagggtggcgcaaaagatttgcctgatgttcatgaaacagaggagatcatgaatgtcaggcaaaaacctggcggcagcgcaaaagatg

SEQ ID NO: 200754 - DNA, 103 bp, Artificial Sequence
  Synthetic Polynucleotide
taatacgactcactataggggatcggaggcttagggccgctctggcccggaacagaggagaccgggcatgagcggccctaacctggcggcagcgcaaaagatg

SEQ ID NO: 200755 - DNA, 103 bp, Artificial Sequence
  Synthetic Polynucleotide
taatacgactcactatagggcatcagatcttggcgcaaaagatttgcctgaacagaggagacaggcaatgcttttgcgcaacctggcggcagcgcaaaagatg

SEQ ID NO: 200756 - DNA, 103 bp, Artificial Sequence
  Synthetic Polynucleotide
taatacgactcactatagggcctgtcgtctcatcagatcttggcgcaaaaaacagaggagattttgcatgaagatctgaaacctggcggcagcgcaaaagatg

SEQ ID NO: 200757 - DNA, 103 bp, Artificial Sequence
  Synthetic Polynucleotide
taatacgactcactatagggcttaattcttcctgtcgtctcatcagatctaacagaggagaagatctatggagacgacaaacctggcggcagcgcaaaagatg

SEQ ID NO: 200758 - DNA, 103 bp, Artificial Sequence
  Synthetic Polynucleotide
taatacgactcactatagggttccatgcgtcttaattcttcctgtcgtctaacagaggagaagacgaatggaagaattaaacctggcggcagcgcaaaagatg

SEQ ID NO: 200759 - DNA, 103 bp, Artificial Sequence
  Synthetic Polynucleotide
taatacgactcactatagggtgtgaagttcttccatgcgtcttaattcttaacagaggagaaagaatatggacgcatggaacctggcggcagcgcaaaagatg

SEQ ID NO: 200760 - DNA, 103 bp, Artificial Sequence
  Synthetic Polynucleotide
taatacgactcactatagggatttcttgattgtgaagttcttccatgcgtaacagaggagaacgcatatgagaacttcaaacctggcggcagcgcaaaagatg

SEQ ID NO: 200761 - DNA, 103 bp, Artificial Sequence
  Synthetic Polynucleotide
taatacgactcactatagggacgtttctgcatttcttgattgtgaagttcaacagaggagagaacttatgaatcaagaaaacctggcggcagcgcaaaagatg

SEQ ID NO: 200762 - DNA, 103 bp, Artificial Sequence
  Synthetic Polynucleotide
taatacgactcactataggggcatttctttacgtttctgcatttcttgataacagaggagaatcaagatgtgcagaaacaacctggcggcagcgcaaaagatg

SEQ ID NO: 200763 - DNA, 103 bp, Artificial Sequence
  Synthetic Polynucleotide
taatacgactcactatagggtgcctcaattgcatttctttacgtttctgcaacagaggagagcagaaatgtaaagaaataacctggcggcagcgcaaaagatg

SEQ ID NO: 200764 - DNA, 103 bp, Artificial Sequence
  Synthetic Polynucleotide
taatacgactcactatagggttcctcctcttgcctcaattgcatttctttaacagaggagaaaagaaatgcaattgaggaacctggcggcagcgcaaaagatg

SEQ ID NO: 200765 - DNA, 103 bp, Artificial Sequence
  Synthetic Polynucleotide
taatacgactcactataggggcggtggcgggatcggaggcttagggccgcaacagaggagagcggccatgagcctccgaaacctggcggcagcgcaaaagatg

SEQ ID NO: 200766 - DNA, 103 bp, Artificial Sequence
  Synthetic Polynucleotide
taatacgactcactatagggttctacgtcgttcctcctcttgcctcaattaacagaggagaaattgaatgaagaggaggaacctggcggcagcgcaaaagatg

SEQ ID NO: 200767 - DNA, 103 bp, Artificial Sequence
  Synthetic Polynucleotide
taatacgactcactatagggtcttcctctcttctacgtcgttcctcctctaacagaggagaagaggaatgacgacgtagaacctggcggcagcgcaaaagatg

SEQ ID NO: 200768 - DNA, 103 bp, Artificial Sequence
  Synthetic Polynucleotide
taatacgactcactatagggaatcatcatctcttcctctcttctacgtcgaacagaggagacgacgtatgagagaggaaaacctggcggcagcgcaaaagatg

SEQ ID NO: 200769 - DNA, 103 bp, Artificial Sequence
  Synthetic Polynucleotide
taatacgactcactatagggcacgttgacgaatcatcatctcttcctctcaacagaggagagagaggatgagatgatgaaacctggcggcagcgcaaaagatg

SEQ ID NO: 200770 - DNA, 103 bp, Artificial Sequence
  Synthetic Polynucleotide
taatacgactcactatagggtcttccatctcacgttgacgaatcatcatcaacagaggagagatgatatgtcgtcaacgaacctggcggcagcgcaaaagatg

SEQ ID NO: 200771 - DNA, 103 bp, Artificial Sequence
  Synthetic Polynucleotide
taatacgactcactatagggcctcatttgttcttccatctcacgttgacgaacagaggagacgtcaaatggagatggaaaacctggcggcagcgcaaaagatg

SEQ ID NO: 200772 - DNA, 103 bp, Artificial Sequence
  Synthetic Polynucleotide
taatacgactcactatagggctctttggcgcctcatttgttcttccatctaacagaggagaagatggatgaacaaatgaaacctggcggcagcgcaaaagatg

SEQ ID NO: 200773 - DNA, 103 bp, Artificial Sequence
  Synthetic Polynucleotide
taatacgactcactatagggtaactttcctctctttggcgcctcatttgtaacagaggagaacaaatatggcgccaaagaacctggcggcagcgcaaaagatg

SEQ ID NO: 200774 - DNA, 103 bp, Artificial Sequence
  Synthetic Polynucleotide
taatacgactcactatagggcattcggctgtaactttcctctctttggcgaacagaggagacgccaaatggaggaaagtaacctggcggcagcgcaaaagatg

SEQ ID NO: 200775 - DNA, 103 bp, Artificial Sequence
  Synthetic Polynucleotide
taatacgactcactatagggccatgtagcccattcggctgtaactttcctaacagaggagaaggaaaatgacagccgaaaacctggcggcagcgcaaaagatg

SEQ ID NO: 200776 - DNA, 103 bp, Artificial Sequence
  Synthetic Polynucleotide
taatacgactcactatagggtggtgtggaggcggtggcgggatcggaggcaacagaggagagcctccatgcccgccaccaacctggcggcagcgcaaaagatg

SEQ ID NO: 200777 - DNA, 103 bp, Artificial Sequence
  Synthetic Polynucleotide
taatacgactcactatagggtcccgtggatccatgtagcccattcggctgaacagaggagacagccgatggggctacataacctggcggcagcgcaaaagatg

SEQ ID NO: 200778 - DNA, 103 bp, Artificial Sequence
  Synthetic Polynucleotide
taatacgactcactatagggcatgtctctttcccgtggatccatgtagccaacagaggagaggctacatggatccacggaacctggcggcagcgcaaaagatg

SEQ ID NO: 200779 - DNA, 103 bp, Artificial Sequence
  Synthetic Polynucleotide
taatacgactcactatagggcacccattcgcatgtctctttcccgtggataacagaggagaatccacatgaaagagacaaacctggcggcagcgcaaaagatg

SEQ ID NO: 200780 - DNA, 103 bp, Artificial Sequence
  Synthetic Polynucleotide
taatacgactcactataggggctcctccgccacccattcgcatgtctcttaacagaggagaaagagaatggcgaatgggaacctggcggcagcgcaaaagatg

SEQ ID NO: 200781 - DNA, 103 bp, Artificial Sequence
  Synthetic Polynucleotide
taatacgactcactatagggcatgttcattgctcctccgccacccattcgaacagaggagacgaatgatgggcggaggaaacctggcggcagcgcaaaagatg

SEQ ID NO: 200782 - DNA, 103 bp, Artificial Sequence
  Synthetic Polynucleotide
taatacgactcactatagggagggatctcccatgttcattgctcctccgcaacagaggagagcggagatgcaatgaacaaacctggcggcagcgcaaaagatg

SEQ ID NO: 200783 - DNA, 103 bp, Artificial Sequence
  Synthetic Polynucleotide
taatacgactcactatagggcctgaaccatagggatctcccatgttcattaacagaggagaaatgaaatggggagatccaacctggcggcagcgcaaaagatg

SEQ ID NO: 200784 - DNA, 103 bp, Artificial Sequence
  Synthetic Polynucleotide
taatacgactcactatagggtttctggcctcctgaaccatagggatctccaacagaggagaggagatatgtatggttcaaacctggcggcagcgcaaaagatg

SEQ ID NO: 200785 - DNA, 103 bp, Artificial Sequence
  Synthetic Polynucleotide
taatacgactcactataggggaggtggaaatttctggcctcctgaaccataacagaggagaatggttatggaggccagaaacctggcggcagcgcaaaagatg

SEQ ID NO: 200786 - DNA, 103 bp, Artificial Sequence
  Synthetic Polynucleotide
taatacgactcactatagggccacctcctagaggtggaaatttctggcctaacagaggagaaggccaatgatttccaccaacctggcggcagcgcaaaagatg

SEQ ID NO: 200787 - DNA, 103 bp, Artificial Sequence
  Synthetic Polynucleotide
taatacgactcactatagggttgctgctgttggtgtggaggcggtggcggaacagaggagaccgccaatgcctccacacaacctggcggcagcgcaaaagatg

SEQ ID NO: 200788 - DNA, 103 bp, Artificial Sequence
  Synthetic Polynucleotide
taatacgactcactatagggtatgccaccaccacctcctagaggtggaaaaacagaggagatttccaatgctaggaggtaacctggcggcagcgcaaaagatg

SEQ ID NO: 200789 - DNA, 103 bp, Artificial Sequence
  Synthetic Polynucleotide
taatacgactcactatagggcttcataacctatgccaccaccacctcctaaacagaggagataggagatggtggtggcaaacctggcggcagcgcaaaagatg

SEQ ID NO: 200790 - DNA, 103 bp, Artificial Sequence
  Synthetic Polynucleotide
taatacgactcactatagggccaggattagcttcataacctatgccaccaaacagaggagatggtggatgaggttatgaaacctggcggcagcgcaaaagatg

SEQ ID NO: 200791 - DNA, 103 bp, Artificial Sequence
  Synthetic Polynucleotide
taatacgactcactatagggtggtggaacgccaggattagcttcataaccaacagaggagaggttatatggctaatcctaacctggcggcagcgcaaaagatg

SEQ ID NO: 200792 - DNA, 103 bp, Artificial Sequence
  Synthetic Polynucleotide
taatacgactcactatagggtcatggttgctggtggaacgccaggattagaacagaggagactaatcatggcgttccacaacctggcggcagcgcaaaagatg

SEQ ID NO: 200793 - DNA, 103 bp, Artificial Sequence
  Synthetic Polynucleotide
taatacgactcactatagggatggaaccactcatggttgctggtggaacgaacagaggagacgttccatgagcaaccataacctggcggcagcgcaaaagatg

SEQ ID NO: 200794 - DNA, 103 bp, Artificial Sequence
  Synthetic Polynucleotide
taatacgactcactatagggacttcccatcatggaaccactcatggttgcaacagaggagagcaaccatgagtggttccaacctggcggcagcgcaaaagatg

SEQ ID NO: 200795 - DNA, 103 bp, Artificial Sequence
  Synthetic Polynucleotide
taatacgactcactatagggtacgcatgtcacttcccatcatggaaccacaacagaggagagtggttatgtgatgggaaaacctggcggcagcgcaaaagatg

SEQ ID NO: 200796 - DNA, 103 bp, Artificial Sequence
  Synthetic Polynucleotide
taatacgactcactatagggaagcgctcagtacgcatgtcacttcccatcaacagaggagagatgggatgtgacatgcgaacctggcggcagcgcaaaagatg

SEQ ID NO: 200797 - DNA, 103 bp, Artificial Sequence
  Synthetic Polynucleotide
taatacgactcactatagggtccctgcccaaagcgctcagtacgcatgtcaacagaggagagacatgatgactgagcgcaacctggcggcagcgcaaaagatg

SEQ ID NO: 200798 - DNA, 103 bp, Artificial Sequence
  Synthetic Polynucleotide
taatacgactcactatagggcaccgccaccgccacgactccggaaccgataacagaggagaatcggtatgggagtcgtgaacctggcggcagcgcaaaagatg

SEQ ID NO: 200799 - DNA, 103 bp, Artificial Sequence
  Synthetic Polynucleotide
taatacgactcactataggggtggtggctgttgctgctgttggtgtggagaacagaggagactccacatgaacagcagcaacctggcggcagcgcaaaagatg

SEQ ID NO: 200800 - DNA, 103 bp, Artificial Sequence
  Synthetic Polynucleotide
taatacgactcactataggggccccgcacctccctgcccaaagcgctcagaacagaggagactgagcatgttgggcaggaacctggcggcagcgcaaaagatg

SEQ ID NO: 200801 - DNA, 103 bp, Artificial Sequence
  Synthetic Polynucleotide
taatacgactcactatagggccacccacaggccccgcacctccctgcccaaacagaggagatgggcaatgaggtgcgggaacctggcggcagcgcaaaagatg

SEQ ID NO: 200802 - DNA, 103 bp, Artificial Sequence
  Synthetic Polynucleotide
taatacgactcactatagggaggaccctgtccacccacaggccccgcaccaacagaggagaggtgcgatgcctgtgggtaacctggcggcagcgcaaaagatg

SEQ ID NO: 200803 - DNA, 103 bp, Artificial Sequence
  Synthetic Polynucleotide
taatacgactcactatagggccattcctctaggaccctgtccacccacagaacagaggagactgtggatggacagggtcaacctggcggcagcgcaaaagatg

SEQ ID NO: 200804 - DNA, 103 bp, Artificial Sequence
  Synthetic Polynucleotide
taatacgactcactataggggttccaggccccattcctctaggaccctgtaacagaggagaacagggatgtagaggaataacctggcggcagcgcaaaagatg

SEQ ID NO: 200805 - DNA, 103 bp, Artificial Sequence
  Synthetic Polynucleotide
taatacgactcactatagggtcctgctggagttccaggccccattcctctaacagaggagaagaggaatggggcctggaaacctggcggcagcgcaaaagatg

SEQ ID NO: 200806 - DNA, 103 bp, Artificial Sequence
  Synthetic Polynucleotide
taatacgactcactatagggctctaccatatcctgctggagttccaggccaacagaggagaggcctgatgctccagcagaacctggcggcagcgcaaaagatg

SEQ ID NO: 200807 - DNA, 103 bp, Artificial Sequence
  Synthetic Polynucleotide
taatacgactcactatagggtcttctctccctctaccatatcctgctggaaacagaggagatccagcatgatatggtagaacctggcggcagcgcaaaagatg

SEQ ID NO: 200808 - DNA, 103 bp, Artificial Sequence
  Synthetic Polynucleotide
taatacgactcactataggggccttcgtactcttctctccctctaccataaacagaggagatatggtatggggagagaaaacctggcggcagcgcaaaagatg

SEQ ID NO: 200809 - DNA, 103 bp, Artificial Sequence
  Synthetic Polynucleotide
taatacgactcactatagggttttgtttgggccttcgtactcttctctccaacagaggagaggagagatgagtacgaagaacctggcggcagcgcaaaagatg

SEQ ID NO: 200810 - DNA, 103 bp, Artificial Sequence
  Synthetic Polynucleotide
taatacgactcactatagggggctgctgcggtggtggctgttgctgctgtaacagaggagaacagcaatgacagccaccaacctggcggcagcgcaaaagatg

SEQ ID NO: 200811 - DNA, 103 bp, Artificial Sequence
  Synthetic Polynucleotide
taatacgactcactatagggaatcggggttttttgtttgggccttcgtacaacagaggagagtacgaatgcccaaacaaaacctggcggcagcgcaaaagatg

SEQ ID NO: 200812 - DNA, 103 bp, Artificial Sequence
  Synthetic Polynucleotide
taatacgactcactatagggctgcggcggtggctgctgcggtggtggctgaacagaggagacagccaatgccgcagcagaacctggcggcagcgcaaaagatg

SEQ ID NO: 200813 - DNA, 103 bp, Artificial Sequence
  Synthetic Polynucleotide
taatacgactcactataggggtggcggctgctgcggcggtggctgctgcgaacagaggagacgcagcatgcaccgccgcaacctggcggcagcgcaaaagatg

SEQ ID NO: 200814 - DNA, 103 bp, Artificial Sequence
  Synthetic Polynucleotide
taatacgactcactatagggggctgatgcggtggcggctgctgcggcggtaacagaggagaaccgccatggcagccgccaacctggcggcagcgcaaaagatg

SEQ ID NO: 200815 - DNA, 103 bp, Artificial Sequence
  Synthetic Polynucleotide
taatacgactcactatagggatgcggcggcggctgatgcggtggcggctgaacagaggagacagccgatgccgcatcagaacctggcggcagcgcaaaagatg

SEQ ID NO: 200816 - DNA, 103 bp, Artificial Sequence
  Synthetic Polynucleotide
taatacgactcactataggggcggctgtggatgcggcggcggctgatgcgaacagaggagacgcatcatgcgccgccgcaacctggcggcagcgcaaaagatg

SEQ ID NO: 200817 - DNA, 103 bp, Artificial Sequence
  Synthetic Polynucleotide
taatacgactcactatagggtgctgctgatgcggctgtggatgcggcggcaacagaggagagccgccatgtccacagccaacctggcggcagcgcaaaagatg

SEQ ID NO: 200818 - DNA, 103 bp, Artificial Sequence
  Synthetic Polynucleotide
taatacgactcactatagggcggcggctgctgctgctgatgcggctgtggaacagaggagaccacagatgcatcagcagaacctggcggcagcgcaaaagatg

SEQ ID NO: 200819 - DNA, 103 bp, Artificial Sequence
  Synthetic Polynucleotide
taatacgactcactataggggcggcggtggcggcggctgctgctgctgataacagaggagaatcagcatgagcagccgcaacctggcggcagcgcaaaagatg

SEQ ID NO: 200820 - DNA, 103 bp, Artificial Sequence
  Synthetic Polynucleotide
taatacgactcactatagggtggaagccaccaccgccaccgccacgactcaacagaggagagagtcgatgcggtggcggaacctggcggcagcgcaaaagatg

SEQ ID NO: 200821 - DNA, 103 bp, Artificial Sequence
  Synthetic Polynucleotide
taatacgactcactataggggaagagtcctgcggcggtggcggcggctgcaacagaggagagcagccatggccaccgccaacctggcggcagcgcaaaagatg

SEQ ID NO: 200822 - DNA, 103 bp, Artificial Sequence
  Synthetic Polynucleotide
taatacgactcactataggggacgggcttggaagagtcctgcggcggtggaacagaggagaccaccgatgcaggactctaacctggcggcagcgcaaaagatg

SEQ ID NO: 200823 - DNA, 103 bp, Artificial Sequence
  Synthetic Polynucleotide
taatacgactcactatagggcctgagcaacgacgggcttggaagagtcctaacagaggagaaggactatgccaagcccgaacctggcggcagcgcaaaagatg

SEQ ID NO: 200824 - DNA, 103 bp, Artificial Sequence
  Synthetic Polynucleotide
taatacgactcactataggggggccgggtccctgagcaacgacgggcttgaacagaggagacaagccatgcgttgctcaaacctggcggcagcgcaaaagatg

SEQ ID NO: 200825 - DNA, 103 bp, Artificial Sequence
  Synthetic Polynucleotide
taatacgactcactatagggtccgggagcggggccgggtccctgagcaacaacagaggagagttgctatgggacccggcaacctggcggcagcgcaaaagatg

SEQ ID NO: 200826 - DNA, 103 bp, Artificial Sequence
  Synthetic Polynucleotide
taatacgactcactatagggcgctgcctactccgggagcggggccgggtcaacagaggagagacccgatgccgctcccgaacctggcggcagcgcaaaagatg

SEQ ID NO: 200827 - DNA, 103 bp, Artificial Sequence
  Synthetic Polynucleotide
taatacgactcactataggggctggtggtgcgctgcctactccgggagcgaacagaggagacgctccatgagtaggcagaacctggcggcagcgcaaaagatg

SEQ ID NO: 200828 - DNA, 103 bp, Artificial Sequence
  Synthetic Polynucleotide
taatacgactcactatagggcgagctggaggctggtggtgcgctgcctacaacagaggagagtaggcatggcaccaccaaacctggcggcagcgcaaaagatg

SEQ ID NO: 200829 - DNA, 103 bp, Artificial Sequence
  Synthetic Polynucleotide
taatacgactcactatagggcgggcggggccgagctggaggctggtggtgaacagaggagacaccacatgcctccagctaacctggcggcagcgcaaaagatg

SEQ ID NO: 200830 - DNA, 103 bp, Artificial Sequence
  Synthetic Polynucleotide
taatacgactcactatagggggtggagtggcgggcggggccgagctggagaacagaggagactccagatgggccccgccaacctggcggcagcgcaaaagatg

SEQ ID NO: 200831 - DNA, 103 bp, Artificial Sequence
  Synthetic Polynucleotide
taatacgactcactatagggtccacgcctgtggaagccaccaccgccaccaacagaggagaggtggcatgggtggcttcaacctggcggcagcgcaaaagatg

SEQ ID NO: 200832 - DNA, 103 bp, Artificial Sequence
  Synthetic Polynucleotide
taatacgactcactatagggccccgaggttggtggagtggcgggcggggcaacagaggagagccccgatggccactccaaacctggcggcagcgcaaaagatg

SEQ ID NO: 200833 - DNA, 103 bp, Artificial Sequence
  Synthetic Polynucleotide
taatacgactcactatagggctggcggggcccccgaggttggtggagtggaacagaggagaccactcatgcaacctcggaacctggcggcagcgcaaaagatg

SEQ ID NO: 200834 - DNA, 103 bp, Artificial Sequence
  Synthetic Polynucleotide
taatacgactcactatagggggcccggaccctggcggggcccccgaggttaacagaggagaaacctcatgggccccgccaacctggcggcagcgcaaaagatg

SEQ ID NO: 200835 - DNA, 103 bp, Artificial Sequence
  Synthetic Polynucleotide
taatacgactcactatagggagtcgggcctggcccggaccctggcggggcaacagaggagagccccgatggggtccgggaacctggcggcagcgcaaaagatg

SEQ ID NO: 200836 - DNA, 103 bp, Artificial Sequence
  Synthetic Polynucleotide
taatacgactcactataggggcggggtcggagtcgggcctggcccggaccaacagaggagaggtccgatgcaggcccgaaacctggcggcagcgcaaaagatg

SEQ ID NO: 200837 - DNA, 103 bp, Artificial Sequence
  Synthetic Polynucleotide
taatacgactcactatagggactgcaggcggcggggtcggagtcgggcctaacagaggagaaggcccatgtccgaccccaacctggcggcagcgcaaaagatg

SEQ ID NO: 200838 - DNA, 103 bp, Artificial Sequence
  Synthetic Polynucleotide
taatacgactcactatagggggccgaggtgactgcaggcggcggggtcggaacagaggagaccgaccatgccgcctgcaaacctggcggcagcgcaaaagatg

SEQ ID NO: 200839 - DNA, 103 bp, Artificial Sequence
  Synthetic Polynucleotide
taatacgactcactatagggccccgggaggggccgaggtgactgcaggcgaacagaggagacgcctgatgtcacctcggaacctggcggcagcgcaaaagatg

SEQ ID NO: 200840 - DNA, 103 bp, Artificial Sequence
  Synthetic Polynucleotide
taatacgactcactatagggggtggcggcgccccgggaggggccgaggtgaacagaggagacacctcatgccctcccggaacctggcggcagcgcaaaagatg

SEQ ID NO: 200841 - DNA, 103 bp, Artificial Sequence
  Synthetic Polynucleotide
taatacgactcactatagggtggcggggtgggtggcggcgccccgggaggaacagaggagacctcccatggcgccgccaaacctggcggcagcgcaaaagatg

SEQ ID NO: 200842 - DNA, 103 bp, Artificial Sequence
  Synthetic Polynucleotide
taatacgactcactatagggcgccgcctcctccacgcctgtggaagccacaacagaggagagtggctatgacaggcgtgaacctggcggcagcgcaaaagatg

SEQ ID NO: 200843 - DNA, 103 bp, Artificial Sequence
  Synthetic Polynucleotide
taatacgactcactatagggccccgctgcttggcggggtgggtggcggcgaacagaggagacgccgcatgccaccccgcaacctggcggcagcgcaaaagatg

SEQ ID NO: 200844 - DNA, 103 bp, Artificial Sequence
  Synthetic Polynucleotide
taatacgactcactataggggtggtagggaccccgctgcttggcggggtgaacagaggagacaccccatgaagcagcggaacctggcggcagcgcaaaagatg

SEQ ID NO: 200845 - DNA, 103 bp, Artificial Sequence
  Synthetic Polynucleotide
taatacgactcactatagggctgaggaggtgtggtagggaccccgctgctaacagaggagaagcagcatggtccctaccaacctggcggcagcgcaaaagatg

SEQ ID NO: 200846 - DNA, 103 bp, Artificial Sequence
  Synthetic Polynucleotide
taatacgactcactatagggggcctccggcctgaggaggtgtggtagggaaacagaggagatccctaatgcacctcctcaacctggcggcagcgcaaaagatg

SEQ ID NO: 200847 - DNA, 103 bp, Artificial Sequence
  Synthetic Polynucleotide
taatacgactcactatagggggaggcggcgggcctccggcctgaggaggtaacagaggagaacctccatgggccggaggaacctggcggcagcgcaaaagatg

SEQ ID NO: 200848 - DNA, 103 bp, Artificial Sequence
  Synthetic Polynucleotide
taatacgactcactatagggtgccgcgggcggaggcggcgggcctccggcaacagaggagagccggaatgccgccgcctaacctggcggcagcgcaaaagatg

SEQ ID NO: 200849 - DNA, 103 bp, Artificial Sequence
  Synthetic Polynucleotide
taatacgactcactatagggggcccgggactgccgcgggcggaggcggcgaacagaggagacgccgcatgcgcccgcggaacctggcggcagcgcaaaagatg

SEQ ID NO: 200850 - DNA, 103 bp, Artificial Sequence
  Synthetic Polynucleotide
taatacgactcactatagggcctggacccgggcccgggactgccgcgggcaacagaggagagcccgcatgagtcccgggaacctggcggcagcgcaaaagatg

SEQ ID NO: 200851 - DNA, 103 bp, Artificial Sequence
  Synthetic Polynucleotide
taatacgactcactatagggctgcttaggccctggacccgggcccgggacaacagaggagagtcccgatgccgggtccaaacctggcggcagcgcaaaagatg

SEQ ID NO: 200852 - DNA, 103 bp, Artificial Sequence
  Synthetic Polynucleotide
taatacgactcactataggggacctgggccctgcttaggccctggacccgaacagaggagacgggtcatgggcctaagcaacctggcggcagcgcaaaagatg

SEQ ID NO: 200853 - DNA, 103 bp, Artificial Sequence
  Synthetic Polynucleotide
taatacgactcactatagggccgccgcggccgccgcctcctccacgcctgaacagaggagacaggcgatgaggaggcggaacctggcggcagcgcaaaagatg

SEQ ID NO: 200854 - DNA, 103 bp, Artificial Sequence
  Synthetic Polynucleotide
taatacgactcactatagggggaccacccggacctgggccctgcttaggcaacagaggagagcctaaatggggcccaggaacctggcggcagcgcaaaagatg

SEQ ID NO: 200855 - DNA, 103 bp, Artificial Sequence
  Synthetic Polynucleotide
taatacgactcactataggggccgcctttgggaccacccggacctgggccaacagaggagaggcccaatgccgggtggtaacctggcggcagcgcaaaagatg

SEQ ID NO: 200856 - DNA, 103 bp, Artificial Sequence
  Synthetic Polynucleotide
taatacgactcactatagggcaggcattttgccgcctttgggaccacccgaacagaggagacgggtgatgccaaaggcgaacctggcggcagcgcaaaagatg

SEQ ID NO: 200857 - DNA, 103 bp, Artificial Sequence
  Synthetic Polynucleotide
taatacgactcactatagggttcggcccgccaggcattttgccgcctttgaacagaggagacaaaggatgcaaaatgccaacctggcggcagcgcaaaagatg

SEQ ID NO: 200858 - DNA, 103 bp, Artificial Sequence
  Synthetic Polynucleotide
taatacgactcactataggggccacctggcttcggcccgccaggcattttaacagaggagaaaaatgatgggcgggccgaacctggcggcagcgcaaaagatg

SEQ ID NO: 200859 - DNA, 103 bp, Artificial Sequence
  Synthetic Polynucleotide
taatacgactcactatagggggcccgggccgccacctggcttcggcccgcaacagaggagagcgggcatgagccaggtgaacctggcggcagcgcaaaagatg

SEQ ID NO: 200860 - DNA, 103 bp, Artificial Sequence
  Synthetic Polynucleotide
taatacgactcactatagggggcgtacttaggcccgggccgccacctggcaacagaggagagccaggatgcggcccgggaacctggcggcagcgcaaaagatg

SEQ ID NO: 200861 - DNA, 103 bp, Artificial Sequence
  Synthetic Polynucleotide
taatacgactcactataggggtggccgccaggcgtacttaggcccgggccaacagaggagaggcccgatgctaagtacgaacctggcggcagcgcaaaagatg

SEQ ID NO: 200862 - DNA, 103 bp, Artificial Sequence
  Synthetic Polynucleotide
taatacgactcactataggggcggcttggggtggccgccaggcgtacttaaacagaggagataagtaatgctggcggccaacctggcggcagcgcaaaagatg

SEQ ID NO: 200863 - DNA, 103 bp, Artificial Sequence
  Synthetic Polynucleotide
taatacgactcactatagggcctcgatgcggcggcttggggtggccgccaaacagaggagatggcggatgccccaagccaacctggcggcagcgcaaaagatg

SEQ ID NO: 200864 - DNA, 103 bp, Artificial Sequence
  Synthetic Polynucleotide
taatacgactcactataggggtcgtggaggccgccgcggccgccgcctccaacagaggagaggaggcatgggccgcggcaacctggcggcagcgcaaaagatg

SEQ ID NO: 200865 - DNA, 103 bp, Artificial Sequence
  Synthetic Polynucleotide
taatacgactcactatagggctccccgccgcctcgatgcggcggcttgggaacagaggagacccaagatgccgcatcgaaacctggcggcagcgcaaaagatg

SEQ ID NO: 200866 - DNA, 103 bp, Artificial Sequence
  Synthetic Polynucleotide
taatacgactcactatagggccccgcggggctccccgccgcctcgatgcgaacagaggagacgcatcatggcggcggggaacctggcggcagcgcaaaagatg

SEQ ID NO: 200867 - DNA, 103 bp, Artificial Sequence
  Synthetic Polynucleotide
taatacgactcactatagggtgctggcggcccccgcggggctccccgccgaacagaggagacggcggatggccccgcggaacctggcggcagcgcaaaagatg

SEQ ID NO: 200868 - DNA, 103 bp, Artificial Sequence
  Synthetic Polynucleotide
taatacgactcactataggggggcgggtggtgctggcggcccccgcggggaacagaggagaccccgcatgggccgccagaacctggcggcagcgcaaaagatg

SEQ ID NO: 200869 - DNA, 103 bp, Artificial Sequence
  Synthetic Polynucleotide
taatacgactcactataggggctggtggtagggcgggtggtgctggcggcaacagaggagagccgccatgaccacccgcaacctggcggcagcgcaaaagatg

SEQ ID NO: 200870 - DNA, 103 bp, Artificial Sequence
  Synthetic Polynucleotide
taatacgactcactatagggtggtgatgctgctggtggtagggcgggtggaacagaggagaccacccatgctaccaccaaacctggcggcagcgcaaaagatg

SEQ ID NO: 200871 - DNA, 103 bp, Artificial Sequence
  Synthetic Polynucleotide
taatacgactcactatagggcgggggcccctggtgatgctgctggtggtaaacagaggagataccacatgcagcatcacaacctggcggcagcgcaaaagatg

SEQ ID NO: 200872 - DNA, 103 bp, Artificial Sequence
  Synthetic Polynucleotide
taatacgactcactataggggcccgccgggcgggggcccctggtgatgctaacagaggagaagcatcatgaggggccccaacctggcggcagcgcaaaagatg

SEQ ID NO: 200873 - DNA, 103 bp, Artificial Sequence
  Synthetic Polynucleotide
taatacgactcactatagggcggccgccgggcccgccgggcgggggccccaacagaggagaggggccatggcccggcggaacctggcggcagcgcaaaagatg

SEQ ID NO: 200874 - DNA, 103 bp, Artificial Sequence
  Synthetic Polynucleotide
taatacgactcactatagggctcctcgctgcggccgccgggcccgccgggaacagaggagacccggcatgcccggcggcaacctggcggcagcgcaaaagatg

SEQ ID NO: 200875 - DNA, 103 bp, Artificial Sequence
  Synthetic Polynucleotide
taatacgactcactataggggagaacggaagtcgtggaggccgccgcggcaacagaggagagccgcgatggcctccacgaacctggcggcagcgcaaaagatg

SEQ ID NO: 200876 - DNA, 103 bp, Artificial Sequence
  Synthetic Polynucleotide
taatacgactcactatagggccgagatcttctcctcgctgcggccgccggaacagaggagaccggcgatggcagcgaggaacctggcggcagcgcaaaagatg

SEQ ID NO: 200877 - DNA, 103 bp, Artificial Sequence
  Synthetic Polynucleotide
taatacgactcactatagggccctccgagtccgagatcttctcctcgctgaacagaggagacagcgaatggaagatctcaacctggcggcagcgcaaaagatg

SEQ ID NO: 200878 - DNA, 103 bp, Artificial Sequence
  Synthetic Polynucleotide
taatacgactcactatagggggctttaaacccctccgagtccgagatcttaacagaggagaaagatcatggactcggagaacctggcggcagcgcaaaagatg

SEQ ID NO: 200879 - DNA, 103 bp, Artificial Sequence
  Synthetic Polynucleotide
taatacgactcactataggggagacaaattggctttaaacccctccgagtaacagaggagaactcggatgggtttaaagaacctggcggcagcgcaaaagatg

SEQ ID NO: 200880 - DNA, 103 bp, Artificial Sequence
  Synthetic Polynucleotide
taatacgactcactatagggctcctcaagagagacaaattggctttaaacaacagaggagagtttaaatgcaatttgtcaacctggcggcagcgcaaaagatg

SEQ ID NO: 200881 - DNA, 103 bp, Artificial Sequence
  Synthetic Polynucleotide
taatacgactcactatagggctctccaggcctcctcaagagagacaaattaacagaggagaaatttgatgctcttgaggaacctggcggcagcgcaaaagatg

SEQ ID NO: 200882 - DNA, 103 bp, Artificial Sequence
  Synthetic Polynucleotide
taatacgactcactatagggtgtaagttttctctccaggcctcctcaagaaacagaggagatcttgaatgggcctggagaacctggcggcagcgcaaaagatg

SEQ ID NO: 200883 - DNA, 103 bp, Artificial Sequence
  Synthetic Polynucleotide
taatacgactcactatagggcatcgctgtgtgtaagttttctctccaggcaacagaggagagcctggatggaaaacttaaacctggcggcagcgcaaaagatg

SEQ ID NO: 200884 - DNA, 103 bp, Artificial Sequence
  Synthetic Polynucleotide
taatacgactcactatagggaaacaaccgacatcgctgtgtgtaagttttaacagaggagaaaaactatgacacagcgaaacctggcggcagcgcaaaagatg

SEQ ID NO: 200885 - DNA, 103 bp, Artificial Sequence
  Synthetic Polynucleotide
taatacgactcactataggggattcccaacaaacaaccgacatcgctgtgaacagaggagacacagcatggtcggttgtaacctggcggcagcgcaaaagatg

SEQ ID NO: 200886 - DNA, 103 bp, Artificial Sequence
  Synthetic Polynucleotide
taatacgactcactatagggccgggcggcggagaacggaagtcgtggaggaacagaggagacctccaatgcttccgttcaacctggcggcagcgcaaaagatg

SEQ ID NO: 200887 - DNA, 103 bp, Artificial Sequence
  Synthetic Polynucleotide
taatacgactcactatagggtcagcaggtagattcccaacaaacaaccgaaacagaggagatcggttatgtgttgggaaaacctggcggcagcgcaaaagatg

SEQ ID NO: 200888 - DNA, 103 bp, Artificial Sequence
  Synthetic Polynucleotide
taatacgactcactatagggctccgtgatatcagcaggtagattcccaacaacagaggagagttgggatgctacctgctaacctggcggcagcgcaaaagatg

SEQ ID NO: 200889 - DNA, 103 bp, Artificial Sequence
  Synthetic Polynucleotide
taatacgactcactatagggtgaattcatcctccgtgatatcagcaggtaaacagaggagatacctgatgatatcacggaacctggcggcagcgcaaaagatg

SEQ ID NO: 200890 - DNA, 103 bp, Artificial Sequence
  Synthetic Polynucleotide
taatacgactcactatagggaatagtcttttgaattcatcctccgtgataaacagaggagatatcacatgggatgaattaacctggcggcagcgcaaaagatg

SEQ ID NO: 200891 - DNA, 103 bp, Artificial Sequence
  Synthetic Polynucleotide
taatacgactcactatagggatatttagcaaatagtcttttgaattcatcaacagaggagagatgaaatgaaaagactaaacctggcggcagcgcaaaagatg

SEQ ID NO: 200892 - DNA, 103 bp, Artificial Sequence
  Synthetic Polynucleotide
taatacgactcactatagggctggttctccatatttagcaaatagtctttaacagaggagaaaagacatgttgctaaataacctggcggcagcgcaaaagatg

SEQ ID NO: 200893 - DNA, 103 bp, Artificial Sequence
  Synthetic Polynucleotide
taatacgactcactatagggaaaacttctcctggttctccatatttagcaaacagaggagatgctaaatgtggagaaccaacctggcggcagcgcaaaagatg

SEQ ID NO: 200894 - DNA, 103 bp, Artificial Sequence
  Synthetic Polynucleotide
taatacgactcactatagggtttgttgataaaaacttctcctggttctccaacagaggagaggagaaatgggagaagttaacctggcggcagcgcaaaagatg

SEQ ID NO: 200895 - DNA, 103 bp, Artificial Sequence
  Synthetic Polynucleotide
taatacgactcactatagggatcctttgcctttgttgataaaaacttctcaacagaggagagagaagatgttatcaacaaacctggcggcagcgcaaaagatg

SEQ ID NO: 200896 - DNA, 103 bp, Artificial Sequence
  Synthetic Polynucleotide
taatacgactcactatagggataaatccgaatcctttgcctttgttgataaacagaggagatatcaaatgaggcaaaggaacctggcggcagcgcaaaagatg

SEQ ID NO: 200897 - DNA, 103 bp, Artificial Sequence
  Synthetic Polynucleotide
taatacgactcactatagggtgactcctggtcatccaaacgccgcttcataacagaggagaatgaagatgcgtttggataacctggcggcagcgcaaaagatg

SEQ ID NO: 200898 - DNA, 103 bp, Artificial Sequence
  Synthetic Polynucleotide
taatacgactcactatagggcacaggaggggcaggggcaagcacccggtgaacagaggagacaccggatgcttgcccctaacctggcggcagcgcaaaagatg

SEQ ID NO: 200899 - DNA, 103 bp, Artificial Sequence
  Synthetic Polynucleotide
taatacgactcactatagggtctctgctctttctgatatgtgtgcaaaataacagaggagaattttgatgacatatcagaacctggcggcagcgcaaaagatg

SEQ ID NO: 200900 - DNA, 103 bp, Artificial Sequence
  Synthetic Polynucleotide
taatacgactcactatagggccttggcatttctctgctctttctgatatgaacagaggagacatatcatgaagagcagaaacctggcggcagcgcaaaagatg

SEQ ID NO: 200901 - DNA, 103 bp, Artificial Sequence
  Synthetic Polynucleotide
taatacgactcactatagggcctccagcttccttggcatttctctgctctaacagaggagaagagcaatgaaatgccaaaacctggcggcagcgcaaaagatg

SEQ ID NO: 200902 - DNA, 103 bp, Artificial Sequence
  Synthetic Polynucleotide
taatacgactcactatagggagtgtagtttcctccagcttccttggcattaacagaggagaaatgccatggaagctggaaacctggcggcagcgcaaaagatg

SEQ ID NO: 200903 - DNA, 103 bp, Artificial Sequence
  Synthetic Polynucleotide
taatacgactcactatagggtcaatgctggagtgtagtttcctccagcttaacagaggagaaagctgatggaaactacaaacctggcggcagcgcaaaagatg

SEQ ID NO: 200904 - DNA, 103 bp, Artificial Sequence
  Synthetic Polynucleotide
taatacgactcactatagggtcctgctctgtcaatgctggagtgtagtttaacagaggagaaaactaatgtccagcattaacctggcggcagcgcaaaagatg

SEQ ID NO: 200905 - DNA, 103 bp, Artificial Sequence
  Synthetic Polynucleotide
taatacgactcactatagggggcatacacctcctgctctgtcaatgctggaacagaggagaccagcaatgacagagcagaacctggcggcagcgcaaaagatg

SEQ ID NO: 200906 - DNA, 103 bp, Artificial Sequence
  Synthetic Polynucleotide
taatacgactcactataggggagcaacctgggcatacacctcctgctctgaacagaggagacagagcatgaggtgtatgaacctggcggcagcgcaaaagatg

SEQ ID NO: 200907 - DNA, 103 bp, Artificial Sequence
  Synthetic Polynucleotide
taatacgactcactatagggttaaagagacgagcaacctgggcatacaccaacagaggagaggtgtaatgccaggttgcaacctggcggcagcgcaaaagatg

SEQ ID NO: 200908 - DNA, 103 bp, Artificial Sequence
  Synthetic Polynucleotide
taatacgactcactatagggttcctggtttttaaagagacgagcaacctgaacagaggagacaggttatgcgtctctttaacctggcggcagcgcaaaagatg

SEQ ID NO: 200909 - DNA, 103 bp, Artificial Sequence
  Synthetic Polynucleotide
taatacgactcactatagggctgcttcatacacaggaggggcaggggcaaaacagaggagattgcccatgcccctcctgaacctggcggcagcgcaaaagatg

SEQ ID NO: 200910 - DNA, 103 bp, Artificial Sequence
  Synthetic Polynucleotide
taatacgactcactatagggacaacaaatcttcctggtttttaaagagacaacagaggagagtctctatgaaaaccaggaacctggcggcagcgcaaaagatg

SEQ ID NO: 200911 - DNA, 103 bp, Artificial Sequence
  Synthetic Polynucleotide
taatacgactcactatagggccaaactctgacaacaaatcttcctggtttaacagaggagaaaaccaatgagatttgttaacctggcggcagcgcaaaagatg

SEQ ID NO: 200912 - DNA, 103 bp, Artificial Sequence
  Synthetic Polynucleotide
taatacgactcactatagggtaggaattgtccaaactctgacaacaaatcaacagaggagagatttgatgtcagagtttaacctggcggcagcgcaaaagatg

SEQ ID NO: 200913 - DNA, 103 bp, Artificial Sequence
  Synthetic Polynucleotide
taatacgactcactatagggtggcatctggtaggaattgtccaaactctgaacagaggagacagagtatggacaattccaacctggcggcagcgcaaaagatg

SEQ ID NO: 200914 - DNA, 103 bp, Artificial Sequence
  Synthetic Polynucleotide
taatacgactcactatagggacggagctgttggcatctggtaggaattgtaacagaggagaacaattatgaccagatgcaacctggcggcagcgcaaaagatg

SEQ ID NO: 200915 - DNA, 103 bp, Artificial Sequence
  Synthetic Polynucleotide
taatacgactcactataggggcttaaaagcacggagctgttggcatctggaacagaggagaccagatatgaacagctccaacctggcggcagcgcaaaagatg

SEQ ID NO: 200916 - DNA, 103 bp, Artificial Sequence
  Synthetic Polynucleotide
taatacgactcactatagggcagttgttttgcttaaaagcacggagctgtaacagaggagaacagctatgtgcttttaaaacctggcggcagcgcaaaagatg

SEQ ID NO: 200917 - DNA, 103 bp, Artificial Sequence
  Synthetic Polynucleotide
taatacgactcactatagggaccttctcagcagttgttttgcttaaaagcaacagaggagagcttttatgcaaaacaacaacctggcggcagcgcaaaagatg

SEQ ID NO: 200918 - DNA, 103 bp, Artificial Sequence
  Synthetic Polynucleotide
taatacgactcactatagggcacagaatcaaccttctcagcagttgttttaacagaggagaaaaacaatggctgagaagaacctggcggcagcgcaaaagatg

SEQ ID NO: 200919 - DNA, 103 bp, Artificial Sequence
  Synthetic Polynucleotide
taatacgactcactataggggatcatttctcacagaatcaaccttctcagaacagaggagactgagaatgttgattctgaacctggcggcagcgcaaaagatg

SEQ ID NO: 200920 - DNA, 103 bp, Artificial Sequence
  Synthetic Polynucleotide
taatacgactcactataggggtctcagacactgcttcatacacaggagggaacagaggagaccctccatggtatgaagcaacctggcggcagcgcaaaagatg

SEQ ID NO: 200921 - DNA, 103 bp, Artificial Sequence
  Synthetic Polynucleotide
taatacgactcactataggggtgcctccatgatcatttctcacagaatcaaacagaggagatgattcatggagaaatgaaacctggcggcagcgcaaaagatg

SEQ ID NO: 200922 - DNA, 103 bp, Artificial Sequence
  Synthetic Polynucleotide
taatacgactcactatagggcttcttgacagtgcctccatgatcatttctaacagaggagaagaaatatgcatggaggcaacctggcggcagcgcaaaagatg

SEQ ID NO: 200923 - DNA, 103 bp, Artificial Sequence
  Synthetic Polynucleotide
taatacgactcactatagggtcagttggggcttcttgacagtgcctccataacagaggagaatggagatgctgtcaagaaacctggcggcagcgcaaaagatg

SEQ ID NO: 200924 - DNA, 103 bp, Artificial Sequence
  Synthetic Polynucleotide
taatacgactcactatagggggcttgttgttcagttggggcttcttgacaaacagaggagatgtcaaatggccccaactaacctggcggcagcgcaaaagatg

SEQ ID NO: 200925 - DNA, 103 bp, Artificial Sequence
  Synthetic Polynucleotide
taatacgactcactataggggggcctctgcggcttgttgttcagttggggaacagaggagaccccaaatgaacaacaagaacctggcggcagcgcaaaagatg

SEQ ID NO: 200926 - DNA, 103 bp, Artificial Sequence
  Synthetic Polynucleotide
taatacgactcactatagggcattctggctgggcctctgcggcttgttgtaacagaggagaacaacaatgcgcagaggcaacctggcggcagcgcaaaagatg

SEQ ID NO: 200927 - DNA, 103 bp, Artificial Sequence
  Synthetic Polynucleotide
taatacgactcactatagggatctggcagccattctggctgggcctctgcaacagaggagagcagagatgcagccagaaaacctggcggcagcgcaaaagatg

SEQ ID NO: 200928 - DNA, 103 bp, Artificial Sequence
  Synthetic Polynucleotide
taatacgactcactatagggatgtctgcggatctggcagccattctggctaacagaggagaagccagatgggctgccagaacctggcggcagcgcaaaagatg

SEQ ID NO: 200929 - DNA, 103 bp, Artificial Sequence
  Synthetic Polynucleotide
taatacgactcactatagggttcctgtaggatgtctgcggatctggcagcaacagaggagagctgccatgtccgcagacaacctggcggcagcgcaaaagatg

SEQ ID NO: 200930 - DNA, 103 bp, Artificial Sequence
  Synthetic Polynucleotide
taatacgactcactatagggggaggggtggttcctgtaggatgtctgcggaacagaggagaccgcagatgtcctacaggaacctggcggcagcgcaaaagatg

SEQ ID NO: 200931 - DNA, 103 bp, Artificial Sequence
  Synthetic Polynucleotide
taatacgactcactatagggtgactgcatggtctcagacactgcttcataaacagaggagatatgaaatggtgtctgagaacctggcggcagcgcaaaagatg

SEQ ID NO: 200932 - DNA, 103 bp, Artificial Sequence
  Synthetic Polynucleotide
taatacgactcactatagggcttcttaactggaggggtggttcctgtaggaacagaggagacctacaatgaccacccctaacctggcggcagcgcaaaagatg

SEQ ID NO: 200933 - DNA, 103 bp, Artificial Sequence
  Synthetic Polynucleotide
taatacgactcactataggggtttgggtttcttcttaactggaggggtggaacagaggagaccacccatgcagttaagaaacctggcggcagcgcaaaagatg

SEQ ID NO: 200934 - DNA, 103 bp, Artificial Sequence
  Synthetic Polynucleotide
taatacgactcactatagggagattgagcagtttgggtttcttcttaactaacagaggagaagttaaatggaaacccaaaacctggcggcagcgcaaaagatg

SEQ ID NO: 200935 - DNA, 103 bp, Artificial Sequence
  Synthetic Polynucleotide
taatacgactcactatagggagaatccttcagattgagcagtttgggtttaacagaggagaaaacccatgctgctcaataacctggcggcagcgcaaaagatg

SEQ ID NO: 200936 - DNA, 103 bp, Artificial Sequence
  Synthetic Polynucleotide
taatacgactcactatagggctgccatagaagaatccttcagattgagcaaacagaggagatgctcaatgtgaaggattaacctggcggcagcgcaaaagatg

SEQ ID NO: 200937 - DNA, 103 bp, Artificial Sequence
  Synthetic Polynucleotide
taatacgactcactatagggttgctggcatctgccatagaagaatccttcaacagaggagagaaggaatgttctatggcaacctggcggcagcgcaaaagatg

SEQ ID NO: 200938 - DNA, 103 bp, Artificial Sequence
  Synthetic Polynucleotide
taatacgactcactatagggaccaccatgtttgctggcatctgccatagaaacagaggagatctatgatggatgccagcaacctggcggcagcgcaaaagatg

SEQ ID NO: 200939 - DNA, 103 bp, Artificial Sequence
  Synthetic Polynucleotide
taatacgactcactatagggattctgttccaccaccatgtttgctggcataacagaggagaatgccaatgaacatggtgaacctggcggcagcgcaaaagatg

SEQ ID NO: 200940 - DNA, 103 bp, Artificial Sequence
  Synthetic Polynucleotide
taatacgactcactatagggaaaaataacgattctgttccaccaccatgtaacagaggagaacatggatgtggaacagaaacctggcggcagcgcaaaagatg

SEQ ID NO: 200941 - DNA, 103 bp, Artificial Sequence
  Synthetic Polynucleotide
taatacgactcactataggggaccttatcaaaaaataacgattctgttccaacagaggagaggaacaatgtcgttatttaacctggcggcagcgcaaaagatg

SEQ ID NO: 200942 - DNA, 103 bp, Artificial Sequence
  Synthetic Polynucleotide
taatacgactcactatagggttcccgtagctgactgcatggtctcagacaaacagaggagatgtctgatgccatgcagtaacctggcggcagcgcaaaagatg

SEQ ID NO: 200943 - DNA, 103 bp, Artificial Sequence
  Synthetic Polynucleotide
taatacgactcactataggggagcctttcggaccttatcaaaaaataacgaacagaggagacgttatatgttgataaggaacctggcggcagcgcaaaagatg

SEQ ID NO: 200944 - DNA, 103 bp, Artificial Sequence
  Synthetic Polynucleotide
taatacgactcactataggggcactccgaagagcctttcggaccttatcaaacagaggagatgataaatgccgaaaggcaacctggcggcagcgcaaaagatg

SEQ ID NO: 200945 - DNA, 103 bp, Artificial Sequence
  Synthetic Polynucleotide
taatacgactcactataggggtaggcttctgcactccgaagagcctttcgaacagaggagacgaaagatgcttcggagtaacctggcggcagcgcaaaagatg

SEQ ID NO: 200946 - DNA, 103 bp, Artificial Sequence
  Synthetic Polynucleotide
taatacgactcactatagggggaaattttcgtaggcttctgcactccgaaaacagaggagattcggaatgcagaagcctaacctggcggcagcgcaaaagatg

SEQ ID NO: 200947 - DNA, 103 bp, Artificial Sequence
  Synthetic Polynucleotide
taatacgactcactatagggagacagcgtaggaaattttcgtaggcttctaacagaggagaagaagcatgcgaaaatttaacctggcggcagcgcaaaagatg

SEQ ID NO: 200948 - DNA, 103 bp, Artificial Sequence
  Synthetic Polynucleotide
taatacgactcactatagggaaaaataacaagacagcgtaggaaattttcaacagaggagagaaaatatgctacgctgtaacctggcggcagcgcaaaagatg

SEQ ID NO: 200949 - DNA, 103 bp, Artificial Sequence
  Synthetic Polynucleotide
taatacgactcactatagggcctcctggttaaaaataacaagacagcgtaaacagaggagatacgctatgttgttatttaacctggcggcagcgcaaaagatg

SEQ ID NO: 200950 - DNA, 103 bp, Artificial Sequence
  Synthetic Polynucleotide
taatacgactcactatagggcgagagatcacctcctggttaaaaataacaaacagaggagatgttatatgtaaccaggaaacctggcggcagcgcaaaagatg

SEQ ID NO: 200951 - DNA, 103 bp, Artificial Sequence
  Synthetic Polynucleotide
taatacgactcactatagggaagctcagcacgagagatcacctcctggttaacagaggagaaaccagatggtgatctctaacctggcggcagcgcaaaagatg

SEQ ID NO: 200952 - DNA, 103 bp, Artificial Sequence
  Synthetic Polynucleotide
taatacgactcactatagggctagttgcacaagctcagcacgagagatcaaacagaggagatgatctatggtgctgagcaacctggcggcagcgcaaaagatg

SEQ ID NO: 200953 - DNA, 103 bp, Artificial Sequence
  Synthetic Polynucleotide
taatacgactcactataggggagtactgaattcccgtagctgactgcatgaacagaggagacatgcaatgagctacgggaacctggcggcagcgcaaaagatg

SEQ ID NO: 200954 - DNA, 103 bp, Artificial Sequence
  Synthetic Polynucleotide
taatacgactcactatagggaaaggagagactagttgcacaagctcagcaaacagaggagatgctgaatgtgtgcaactaacctggcggcagcgcaaaagatg

SEQ ID NO: 200955 - DNA, 103 bp, Artificial Sequence
  Synthetic Polynucleotide
taatacgactcactatagggtttccccaggaaaggagagactagttgcacaacagaggagagtgcaaatggtctctcctaacctggcggcagcgcaaaagatg

SEQ ID NO: 200956 - DNA, 103 bp, Artificial Sequence
  Synthetic Polynucleotide
taatacgactcactatagggactcagggaatttccccaggaaaggagagaaacagaggagatctctcatgtcctggggaaacctggcggcagcgcaaaagatg

SEQ ID NO: 200957 - DNA, 103 bp, Artificial Sequence
  Synthetic Polynucleotide
taatacgactcactatagggcaattaaacaactcagggaatttccccaggaacagaggagacctgggatgattccctgaaacctggcggcagcgcaaaagatg

SEQ ID NO: 200958 - DNA, 103 bp, Artificial Sequence
  Synthetic Polynucleotide
taatacgactcactataggggtttttaaaccaattaaacaactcagggaaaacagaggagattccctatgttgtttaataacctggcggcagcgcaaaagatg

SEQ ID NO: 200959 - DNA, 103 bp, Artificial Sequence
  Synthetic Polynucleotide
taatacgactcactatagggagcccagaaagtttttaaaccaattaaacaaacagaggagatgtttaatgggtttaaaaaacctggcggcagcgcaaaagatg

SEQ ID NO: 200960 - DNA, 103 bp, Artificial Sequence
  Synthetic Polynucleotide
taatacgactcactataggggactccttatagcccagaaagtttttaaacaacagaggagagtttaaatgctttctgggaacctggcggcagcgcaaaagatg

SEQ ID NO: 200961 - DNA, 103 bp, Artificial Sequence
  Synthetic Polynucleotide
taatacgactcactatagggcagatgtacagactccttatagcccagaaaaacagaggagatttctgatgtataaggagaacctggcggcagcgcaaaagatg

SEQ ID NO: 200962 - DNA, 103 bp, Artificial Sequence
  Synthetic Polynucleotide
taatacgactcactataggggataagtttccagatgtacagactccttataacagaggagaataaggatgctgtacatcaacctggcggcagcgcaaaagatg

SEQ ID NO: 200963 - DNA, 103 bp, Artificial Sequence
  Synthetic Polynucleotide
taatacgactcactatagggcgctcctttggataagtttccagatgtacaaacagaggagatgtacaatgggaaacttaaacctggcggcagcgcaaaagatg

SEQ ID NO: 200964 - DNA, 103 bp, Artificial Sequence
  Synthetic Polynucleotide
taatacgactcactataggggggtgttacagagtactgaattcccgtagcaacagaggagagctacgatgattcagtacaacctggcggcagcgcaaaagatg

SEQ ID NO: 200965 - DNA, 103 bp, Artificial Sequence
  Synthetic Polynucleotide
taatacgactcactatagggctctgtggctcgctcctttggataagtttcaacagaggagagaaactatgccaaaggagaacctggcggcagcgcaaaagatg

SEQ ID NO: 200966 - DNA, 103 bp, Artificial Sequence
  Synthetic Polynucleotide
taatacgactcactatagggtagcaatgccctctgtggctcgctcctttgaacagaggagacaaaggatggagccacagaacctggcggcagcgcaaaagatg

SEQ ID NO: 200967 - DNA, 103 bp, Artificial Sequence
  Synthetic Polynucleotide
taatacgactcactatagggtctatctccatagcaatgccctctgtggctaacagaggagaagccacatggggcattgcaacctggcggcagcgcaaaagatg

SEQ ID NO: 200968 - DNA, 103 bp, Artificial Sequence
  Synthetic Polynucleotide
taatacgactcactatagggagaagcataatctatctccatagcaatgccaacagaggagaggcattatgatggagataaacctggcggcagcgcaaaagatg

SEQ ID NO: 200969 - DNA, 103 bp, Artificial Sequence
  Synthetic Polynucleotide
taatacgactcactatagggatcgtttacaagaagcataatctatctccaaacagaggagatggagaatgattatgcttaacctggcggcagcgcaaaagatg

SEQ ID NO: 200970 - DNA, 103 bp, Artificial Sequence
  Synthetic Polynucleotide
taatacgactcactatagggctggagcccaatcgtttacaagaagcataaaacagaggagattatgcatgttgtaaacgaacctggcggcagcgcaaaagatg

SEQ ID NO: 200971 - DNA, 103 bp, Artificial Sequence
  Synthetic Polynucleotide
taatacgactcactatagggggctcgatagctggagcccaatcgtttacaaacagaggagatgtaaaatgttgggctccaacctggcggcagcgcaaaagatg

SEQ ID NO: 200972 - DNA, 103 bp, Artificial Sequence
  Synthetic Polynucleotide
taatacgactcactatagggtctttggtaaggctcgatagctggagcccaaacagaggagatgggctatggctatcgagaacctggcggcagcgcaaaagatg

SEQ ID NO: 200973 - DNA, 103 bp, Artificial Sequence
  Synthetic Polynucleotide
taatacgactcactatagggtgctggtaactctttggtaaggctcgatagaacagaggagactatcgatgcttaccaaaaacctggcggcagcgcaaaagatg

SEQ ID NO: 200974 - DNA, 103 bp, Artificial Sequence
  Synthetic Polynucleotide
taatacgactcactatagggacacttgggctgctggtaactctttggtaaaacagaggagattaccaatgagttaccagaacctggcggcagcgcaaaagatg

SEQ ID NO: 200975 - DNA, 103 bp, Artificial Sequence
  Synthetic Polynucleotide
taatacgactcactatagggcctggtagctgggtgttacagagtactgaaaacagaggagattcagtatgctgtaacacaacctggcggcagcgcaaaagatg

SEQ ID NO: 200976 - DNA, 103 bp, Artificial Sequence
  Synthetic Polynucleotide
taatacgactcactatagggtccgtcctgtacacttgggctgctggtaacaacagaggagagttaccatgagcccaagtaacctggcggcagcgcaaaagatg

SEQ ID NO: 200977 - DNA, 103 bp, Artificial Sequence
  Synthetic Polynucleotide
taatacgactcactatagggcagagaggagtccgtcctgtacacttgggcaacagaggagagcccaaatgtacaggacgaacctggcggcagcgcaaaagatg

SEQ ID NO: 200978 - DNA, 103 bp, Artificial Sequence
  Synthetic Polynucleotide
taatacgactcactatagggaacctctttacagagaggagtccgtcctgtaacagaggagaacaggaatgactcctctcaacctggcggcagcgcaaaagatg

SEQ ID NO: 200979 - DNA, 103 bp, Artificial Sequence
  Synthetic Polynucleotide
taatacgactcactatagggtatcatttaaaacctctttacagagaggagaacagaggagactcctcatggtaaagaggaacctggcggcagcgcaaaagatg

SEQ ID NO: 200980 - DNA, 103 bp, Artificial Sequence
  Synthetic Polynucleotide
taatacgactcactataggggaaacccaggtatcatttaaaacctctttaaacagaggagataaagaatgtttaaatgaaacctggcggcagcgcaaaagatg

SEQ ID NO: 200981 - DNA, 103 bp, Artificial Sequence
  Synthetic Polynucleotide
taatacgactcactatagggcgaagggaaggaaacccaggtatcatttaaaacagaggagattaaatatgacctgggttaacctggcggcagcgcaaaagatg

SEQ ID NO: 200982 - DNA, 103 bp, Artificial Sequence
  Synthetic Polynucleotide
taatacgactcactatagggcctcagaccacgaagggaaggaaacccaggaacagaggagacctgggatgccttcccttaacctggcggcagcgcaaaagatg

SEQ ID NO: 200983 - DNA, 103 bp, Artificial Sequence
  Synthetic Polynucleotide
taatacgactcactatagggaaggtagagtcctcagaccacgaagggaagaacagaggagacttcccatggtggtctgaaacctggcggcagcgcaaaagatg

SEQ ID NO: 200984 - DNA, 103 bp, Artificial Sequence
  Synthetic Polynucleotide
taatacgactcactatagggggaactcacaaaggtagagtcctcagaccaaacagaggagatggtctatggactctaccaacctggcggcagcgcaaaagatg

SEQ ID NO: 200985 - DNA, 103 bp, Artificial Sequence
  Synthetic Polynucleotide
taatacgactcactataggggagtcttcttggaactcacaaaggtagagtaacagaggagaactctaatgttgtgagttaacctggcggcagcgcaaaagatg

SEQ ID NO: 200986 - DNA, 103 bp, Artificial Sequence
  Synthetic Polynucleotide
taatacgactcactatagggatggctgaaacctggtagctgggtgttacaaacagaggagatgtaacatgcagctaccaaacctggcggcagcgcaaaagatg

SEQ ID NO: 200987 - DNA, 103 bp, Artificial Sequence
  Synthetic Polynucleotide
taatacgactcactatagggtcttcatattgagtcttcttggaactcacaaacagaggagatgtgagatgcaagaagacaacctggcggcagcgcaaaagatg

SEQ ID NO: 200988 - DNA, 103 bp, Artificial Sequence
  Synthetic Polynucleotide
taatacgactcactatagggataaatatgttcttcatattgagtcttcttaacagaggagaaagaagatgcaatatgaaaacctggcggcagcgcaaaagatg

SEQ ID NO: 200989 - DNA, 103 bp, Artificial Sequence
  Synthetic Polynucleotide
taatacgactcactatagggcttcacaacgataaatatgttcttcatattaacagaggagaaatatgatgaacatatttaacctggcggcagcgcaaaagatg

SEQ ID NO: 200990 - DNA, 103 bp, Artificial Sequence
  Synthetic Polynucleotide
taatacgactcactatagggaagcgttcatcttcacaacgataaatatgtaacagaggagaacatatatgtcgttgtgaaacctggcggcagcgcaaaagatg

SEQ ID NO: 200991 - DNA, 103 bp, Artificial Sequence
  Synthetic Polynucleotide
taatacgactcactatagggatcaagctcaaagcgttcatcttcacaacgaacagaggagacgttgtatggatgaacgcaacctggcggcagcgcaaaagatg

SEQ ID NO: 200992 - DNA, 103 bp, Artificial Sequence
  Synthetic Polynucleotide
taatacgactcactatagggctaaaactacatcaagctcaaagcgttcataacagaggagaatgaacatgttgagcttgaacctggcggcagcgcaaaagatg

SEQ ID NO: 200993 - DNA, 103 bp, Artificial Sequence
  Synthetic Polynucleotide
taatacgactcactatagggagattggtctctaaaactacatcaagctcaaacagaggagatgagctatgtgtagttttaacctggcggcagcgcaaaagatg

SEQ ID NO: 200994 - DNA, 103 bp, Artificial Sequence
  Synthetic Polynucleotide
taatacgactcactataggggattgttgccagattggtctctaaaactacaacagaggagagtagttatggagaccaataacctggcggcagcgcaaaagatg

SEQ ID NO: 200995 - DNA, 103 bp, Artificial Sequence
  Synthetic Polynucleotide
taatacgactcactatagggccagaacccggattgttgccagattggtctaacagaggagaagaccaatgtggcaacaaaacctggcggcagcgcaaaagatg

SEQ ID NO: 200996 - DNA, 103 bp, Artificial Sequence
  Synthetic Polynucleotide
taatacgactcactatagggtgtattgcttccagaacccggattgttgccaacagaggagaggcaacatgccgggttctaacctggcggcagcgcaaaagatg

SEQ ID NO: 200997 - DNA, 103 bp, Artificial Sequence
  Synthetic Polynucleotide
taatacgactcactataggggctctgtggcatggctgaaacctggtagctaacagaggagaagctacatggtttcagccaacctggcggcagcgcaaaagatg

SEQ ID NO: 200998 - DNA, 103 bp, Artificial Sequence
  Synthetic Polynucleotide
taatacgactcactatagggaagcttcttctgtattgcttccagaacccgaacagaggagacgggttatggaagcaataaacctggcggcagcgcaaaagatg

SEQ ID NO: 200999 - DNA, 103 bp, Artificial Sequence
  Synthetic Polynucleotide
taatacgactcactatagggacaagcgggaaagcttcttctgtattgcttaacagaggagaaagcaaatgagaagaagcaacctggcggcagcgcaaaagatg

SEQ ID NO: 201000 - DNA, 103 bp, Artificial Sequence
  Synthetic Polynucleotide
taatacgactcactatagggtcttcagcagacaagcgggaaagcttcttcaacagaggagagaagaaatgttcccgcttaacctggcggcagcgcaaaagatg

SEQ ID NO: 201001 - DNA, 103 bp, Artificial Sequence
  Synthetic Polynucleotide
taatacgactcactatagggtttggcttgttcttcagcagacaagcgggaaacagaggagatcccgcatgtctgctgaaaacctggcggcagcgcaaaagatg

SEQ ID NO: 201002 - DNA, 103 bp, Artificial Sequence
  Synthetic Polynucleotide
taatacgactcactatagggccaagcgaaatttggcttgttcttcagcagaacagaggagactgctgatgaacaagccaaacctggcggcagcgcaaaagatg

SEQ ID NO: 201003 - DNA, 103 bp, Artificial Sequence
  Synthetic Polynucleotide
taatacgactcactatagggagggtgttgtccaagcgaaatttggcttgtaacagaggagaacaagcatgatttcgcttaacctggcggcagcgcaaaagatg

SEQ ID NO: 201004 - DNA, 103 bp, Artificial Sequence
  Synthetic Polynucleotide
taatacgactcactatagggtgtgcccccaagggtgttgtccaagcgaaaaacagaggagatttcgcatggacaacaccaacctggcggcagcgcaaaagatg

SEQ ID NO: 201005 - DNA, 103 bp, Artificial Sequence
  Synthetic Polynucleotide
taatacgactcactatagggtgacttctgatgtgcccccaagggtgttgtaacagaggagaacaacaatgttgggggcaaacctggcggcagcgcaaaagatg

SEQ ID NO: 201006 - DNA, 103 bp, Artificial Sequence
  Synthetic Polynucleotide
taatacgactcactatagggtttctatggatgacttctgatgtgcccccaaacagaggagatgggggatgatcagaagtaacctggcggcagcgcaaaagatg

SEQ ID NO: 201007 - DNA, 103 bp, Artificial Sequence
  Synthetic Polynucleotide
taatacgactcactatagggctggagtgcttttctatggatgacttctgaaacagaggagatcagaaatgatccatagaaacctggcggcagcgcaaaagatg

SEQ ID NO: 201008 - DNA, 103 bp, Artificial Sequence
  Synthetic Polynucleotide
taatacgactcactatagggcatacaccggtgactcctggtcatccaaacaacagaggagagtttggatgaccaggagtaacctggcggcagcgcaaaagatg

SEQ ID NO: 201009 - DNA, 103 bp, Artificial Sequence
  Synthetic Polynucleotide
taatacgactcactataggggactgccggagctctgtggcatggctgaaaaacagaggagatttcagatgtgccacagaaacctggcggcagcgcaaaagatg

SEQ ID NO: 201010 - DNA, 103 bp, Artificial Sequence
  Synthetic Polynucleotide
taatacgactcactatagggcatatatcctctggagtgcttttctatggaaacagaggagatccataatgaagcactccaacctggcggcagcgcaaaagatg

SEQ ID NO: 201011 - DNA, 103 bp, Artificial Sequence
  Synthetic Polynucleotide
taatacgactcactataggggctttatcagcatatatcctctggagtgctaacagaggagaagcactatggaggatataaacctggcggcagcgcaaaagatg

SEQ ID NO: 201012 - DNA, 103 bp, Artificial Sequence
  Synthetic Polynucleotide
taatacgactcactataggggatgtcagctgctttatcagcatatatcctaacagaggagaaggataatggctgataaaaacctggcggcagcgcaaaagatg

SEQ ID NO: 201013 - DNA, 103 bp, Artificial Sequence
  Synthetic Polynucleotide
taatacgactcactataggggaccatcaatgatgtcagctgctttatcagaacagaggagactgataatgcagctgacaaacctggcggcagcgcaaaagatg

SEQ ID NO: 201014 - DNA, 103 bp, Artificial Sequence
  Synthetic Polynucleotide
taatacgactcactatagggttctttctcagaccatcaatgatgtcagctaacagaggagaagctgaatgcattgatggaacctggcggcagcgcaaaagatg

SEQ ID NO: 201015 - DNA, 103 bp, Artificial Sequence
  Synthetic Polynucleotide
taatacgactcactatagggaatggagggattctttctcagaccatcaataacagaggagaattgatatgctgagaaagaacctggcggcagcgcaaaagatg

SEQ ID NO: 201016 - DNA, 103 bp, Artificial Sequence
  Synthetic Polynucleotide
taatacgactcactatagggttggaacagcaatggagggattctttctcaaacagaggagatgagaaatgatccctccaaacctggcggcagcgcaaaagatg

SEQ ID NO: 201017 - DNA, 103 bp, Artificial Sequence
  Synthetic Polynucleotide
taatacgactcactatagggttaaggacaattggaacagcaatggagggaaacagaggagatccctcatgtgctgttccaacctggcggcagcgcaaaagatg

SEQ ID NO: 201018 - DNA, 103 bp, Artificial Sequence
  Synthetic Polynucleotide
taatacgactcactatagggcttcaaccttttaaggacaattggaacagcaacagaggagagctgttatgattgtccttaacctggcggcagcgcaaaagatg

SEQ ID NO: 201019 - DNA, 103 bp, Artificial Sequence
  Synthetic Polynucleotide
taatacgactcactatagggcctctttcatcttcaaccttttaaggacaaaacagaggagattgtccatgaaaggttgaaacctggcggcagcgcaaaagatg

SEQ ID NO: 201020 - DNA, 103 bp, Artificial Sequence
  Synthetic Polynucleotide
taatacgactcactataggggcgggcccatgactgccggagctctgtggcaacagaggagagccacaatgctccggcagaacctggcggcagcgcaaaagatg

SEQ ID NO: 201021 - DNA, 103 bp, Artificial Sequence
  Synthetic Polynucleotide
taatacgactcactatagggcgccattcttcctctttcatcttcaaccttaacagaggagaaaggttatggatgaaagaaacctggcggcagcgcaaaagatg

SEQ ID NO: 201022 - DNA, 103 bp, Artificial Sequence
  Synthetic Polynucleotide
taatacgactcactatagggctgagcttctcgccattcttcctctttcataacagaggagaatgaaaatggaagaatggaacctggcggcagcgcaaaagatg

SEQ ID NO: 201023 - DNA, 103 bp, Artificial Sequence
  Synthetic Polynucleotide
taatacgactcactatagggtaaagcctctctgagcttctcgccattcttaacagaggagaaagaatatggagaagctcaacctggcggcagcgcaaaagatg

SEQ ID NO: 201024 - DNA, 103 bp, Artificial Sequence
  Synthetic Polynucleotide
taatacgactcactatagggcatactttgttaaagcctctctgagcttctaacagaggagaagaagcatggagaggcttaacctggcggcagcgcaaaagatg

SEQ ID NO: 201025 - DNA, 103 bp, Artificial Sequence
  Synthetic Polynucleotide
taatacgactcactatagggttgttctcgccatactttgttaaagcctctaacagaggagaagaggcatgaacaaagtaaacctggcggcagcgcaaaagatg

SEQ ID NO: 201026 - DNA, 103 bp, Artificial Sequence
  Synthetic Polynucleotide
taatacgactcactatagggatttctcattttgttctcgccatactttgtaacagaggagaacaaagatgggcgagaacaacctggcggcagcgcaaaagatg

SEQ ID NO: 201027 - DNA, 103 bp, Artificial Sequence
  Synthetic Polynucleotide
taatacgactcactatagggttcaagtagtatttctcattttgttctcgcaacagaggagagcgagaatgaaatgagaaaacctggcggcagcgcaaaagatg

SEQ ID NO: 201028 - DNA, 103 bp, Artificial Sequence
  Synthetic Polynucleotide
taatacgactcactataggggtccagagacttcaagtagtatttctcattaacagaggagaaatgagatgtactacttgaacctggcggcagcgcaaaagatg

SEQ ID NO: 201029 - DNA, 103 bp, Artificial Sequence
  Synthetic Polynucleotide
taatacgactcactatagggtcccctggtggtccagagacttcaagtagtaacagaggagaactactatgagtctctggaacctggcggcagcgcaaaagatg

SEQ ID NO: 201030 - DNA, 103 bp, Artificial Sequence
  Synthetic Polynucleotide
taatacgactcactatagggttaaagttgatcccctggtggtccagagacaacagaggagagtctctatgccaccagggaacctggcggcagcgcaaaagatg

SEQ ID NO: 201031 - DNA, 103 bp, Artificial Sequence
  Synthetic Polynucleotide
taatacgactcactatagggtgctgctatagcgggcccatgactgccggaaacagaggagatccggcatgcatgggcccaacctggcggcagcgcaaaagatg

SEQ ID NO: 201032 - DNA, 103 bp, Artificial Sequence
  Synthetic Polynucleotide
taatacgactcactataggggtcattctgtttaaagttgatcccctggtgaacagaggagacaccagatgatcaactttaacctggcggcagcgcaaaagatg

SEQ ID NO: 201033 - DNA, 103 bp, Artificial Sequence
  Synthetic Polynucleotide
taatacgactcactatagggggaccttggtgtcattctgtttaaagttgaaacagaggagatcaactatgaacagaatgaacctggcggcagcgcaaaagatg

SEQ ID NO: 201034 - DNA, 103 bp, Artificial Sequence
  Synthetic Polynucleotide
taatacgactcactatagggttagacctcaggaccttggtgtcattctgtaacagaggagaacagaaatgcaccaaggtaacctggcggcagcgcaaaagatg

SEQ ID NO: 201035 - DNA, 103 bp, Artificial Sequence
  Synthetic Polynucleotide
taatacgactcactataggggagtaagctcttagacctcaggaccttggtaacagaggagaaccaagatgctgaggtctaacctggcggcagcgcaaaagatg

SEQ ID NO: 201036 - DNA, 103 bp, Artificial Sequence
  Synthetic Polynucleotide
taatacgactcactatagggcaatctcattgagtaagctcttagacctcaaacagaggagatgaggtatgagagcttacaacctggcggcagcgcaaaagatg

SEQ ID NO: 201037 - DNA, 103 bp, Artificial Sequence
  Synthetic Polynucleotide
taatacgactcactatagggtagatactctcaatctcattgagtaagctcaacagaggagagagcttatgcaatgagataacctggcggcagcgcaaaagatg

SEQ ID NO: 201038 - DNA, 103 bp, Artificial Sequence
  Synthetic Polynucleotide
taatacgactcactatagggcctctcatcatagatactctcaatctcattaacagaggagaaatgagatggagagtatcaacctggcggcagcgcaaaagatg

SEQ ID NO: 201039 - DNA, 103 bp, Artificial Sequence
  Synthetic Polynucleotide
taatacgactcactatagggcctgctcttgcctctcatcatagatactctaacagaggagaagagtaatgatgatgagaaacctggcggcagcgcaaaagatg

SEQ ID NO: 201040 - DNA, 103 bp, Artificial Sequence
  Synthetic Polynucleotide
taatacgactcactatagggtcctccgtagcctgctcttgcctctcatcaaacagaggagatgatgaatggcaagagcaaacctggcggcagcgcaaaagatg

SEQ ID NO: 201041 - DNA, 103 bp, Artificial Sequence
  Synthetic Polynucleotide
taatacgactcactatagggaccagcattctcctccgtagcctgctcttgaacagaggagacaagagatggctacggagaacctggcggcagcgcaaaagatg

SEQ ID NO: 201042 - DNA, 103 bp, Artificial Sequence
  Synthetic Polynucleotide
taatacgactcactatagggtgctatgaactgctgctatagcgggcccataacagaggagaatgggcatgctatagcagaacctggcggcagcgcaaaagatg

SEQ ID NO: 201043 - DNA, 103 bp, Artificial Sequence
  Synthetic Polynucleotide
taatacgactcactatagggcaacaggtacaccagcattctcctccgtagaacagaggagactacggatgagaatgctgaacctggcggcagcgcaaaagatg

SEQ ID NO: 201044 - DNA, 103 bp, Artificial Sequence
  Synthetic Polynucleotide
taatacgactcactatagggaggtgtgggccaacaggtacaccagcattcaacagaggagagaatgcatgtgtacctgtaacctggcggcagcgcaaaagatg

SEQ ID NO: 201045 - DNA, 103 bp, Artificial Sequence
  Synthetic Polynucleotide
taatacgactcactatagggcgcaagtgagaggtgtgggccaacaggtacaacagaggagagtacctatgggcccacacaacctggcggcagcgcaaaagatg

SEQ ID NO: 201046 - DNA, 103 bp, Artificial Sequence
  Synthetic Polynucleotide
taatacgactcactatagggtgtcttcatacgcaagtgagaggtgtgggcaacagaggagagcccacatgtctcacttgaacctggcggcagcgcaaaagatg

SEQ ID NO: 201047 - DNA, 103 bp, Artificial Sequence
  Synthetic Polynucleotide
taatacgactcactatagggagtatttgtttgtcttcatacgcaagtgagaacagaggagactcactatggtatgaagaaacctggcggcagcgcaaaagatg

SEQ ID NO: 201048 - DNA, 103 bp, Artificial Sequence
  Synthetic Polynucleotide
taatacgactcactatagggagcatcttccagtatttgtttgtcttcataaacagaggagatatgaaatgaaacaaataaacctggcggcagcgcaaaagatg

SEQ ID NO: 201049 - DNA, 103 bp, Artificial Sequence
  Synthetic Polynucleotide
taatacgactcactatagggtcagagcagcagcatcttccagtatttgttaacagaggagaaacaaaatgtggaagatgaacctggcggcagcgcaaaagatg

SEQ ID NO: 201050 - DNA, 103 bp, Artificial Sequence
  Synthetic Polynucleotide
taatacgactcactatagggtggtggataatcagagcagcagcatcttccaacagaggagaggaagaatgtgctgctctaacctggcggcagcgcaaaagatg

SEQ ID NO: 201051 - DNA, 103 bp, Artificial Sequence
  Synthetic Polynucleotide
taatacgactcactatagggcctcttcacatggtggataatcagagcagcaacagaggagagctgctatgattatccacaacctggcggcagcgcaaaagatg

SEQ ID NO: 201052 - DNA, 103 bp, Artificial Sequence
  Synthetic Polynucleotide
taatacgactcactatagggtgcctgtctgcctcttcacatggtggataaaacagaggagattatccatgatgtgaagaaacctggcggcagcgcaaaagatg

SEQ ID NO: 201053 - DNA, 103 bp, Artificial Sequence
  Synthetic Polynucleotide
taatacgactcactatagggtgatgatggctgctatgaactgctgctataaacagaggagatatagcatgagttcatagaacctggcggcagcgcaaaagatg

SEQ ID NO: 201054 - DNA, 103 bp, Artificial Sequence
  Synthetic Polynucleotide
taatacgactcactatagggtccttctgaatgcctgtctgcctcttcacaaacagaggagatgtgaaatggcagacaggaacctggcggcagcgcaaaagatg

SEQ ID NO: 201055 - DNA, 103 bp, Artificial Sequence
  Synthetic Polynucleotide
taatacgactcactatagggatatttgtcctccttctgaatgcctgtctgaacagaggagacagacaatgattcagaagaacctggcggcagcgcaaaagatg

SEQ ID NO: 201056 - DNA, 103 bp, Artificial Sequence
  Synthetic Polynucleotide
taatacgactcactataggggttttatcttatatttgtcctccttctgaaaacagaggagattcagaatgaggacaaataacctggcggcagcgcaaaagatg

SEQ ID NO: 201057 - DNA, 103 bp, Artificial Sequence
  Synthetic Polynucleotide
taatacgactcactatagggtgcatgatttgttttatcttatatttgtccaacagaggagaggacaaatgtaagataaaaacctggcggcagcgcaaaagatg

SEQ ID NO: 201058 - DNA, 103 bp, Artificial Sequence
  Synthetic Polynucleotide
taatacgactcactatagggaataaaatgatgcatgatttgttttatcttaacagaggagaaagataatgcaaatcatgaacctggcggcagcgcaaaagatg

SEQ ID NO: 201059 - DNA, 103 bp, Artificial Sequence
  Synthetic Polynucleotide
taatacgactcactataggggcaaatctggaataaaatgatgcatgatttaacagaggagaaaatcaatgatcattttaaacctggcggcagcgcaaaagatg

SEQ ID NO: 201060 - DNA, 103 bp, Artificial Sequence
  Synthetic Polynucleotide
taatacgactcactatagggtgggcaaagagcaaatctggaataaaatgaaacagaggagatcatttatgtccagatttaacctggcggcagcgcaaaagatg

SEQ ID NO: 201061 - DNA, 103 bp, Artificial Sequence
  Synthetic Polynucleotide
taatacgactcactatagggatcacctctttgggcaaagagcaaatctggaacagaggagaccagatatgctctttgccaacctggcggcagcgcaaaagatg

SEQ ID NO: 201062 - DNA, 103 bp, Artificial Sequence
  Synthetic Polynucleotide
taatacgactcactatagggcatctgagagatcacctctttgggcaaagaaacagaggagatctttgatgaaagaggtgaacctggcggcagcgcaaaagatg

SEQ ID NO: 201063 - DNA, 103 bp, Artificial Sequence
  Synthetic Polynucleotide
taatacgactcactatagggtcttcctccacatctgagagatcacctcttaacagaggagaaagaggatgtctctcagaaacctggcggcagcgcaaaagatg

SEQ ID NO: 201064 - DNA, 103 bp, Artificial Sequence
  Synthetic Polynucleotide
taatacgactcactatagggcgctgttgggtgatgatggctgctatgaacaacagaggagagttcatatgagccatcataacctggcggcagcgcaaaagatg

SEQ ID NO: 201065 - DNA, 103 bp, Artificial Sequence
  Synthetic Polynucleotide
taatacgactcactatagggttcttcttcctcttcctccacatctgagagaacagaggagactctcaatggtggaggaaaacctggcggcagcgcaaaagatg

SEQ ID NO: 201066 - DNA, 103 bp, Artificial Sequence
  Synthetic Polynucleotide
taatacgactcactatagggcatccatctcttcttcttcctcttcctccaaacagaggagatggaggatgaggaagaagaacctggcggcagcgcaaaagatg

SEQ ID NO: 201067 - DNA, 103 bp, Artificial Sequence
  Synthetic Polynucleotide
taatacgactcactataggggcttcatctacatccatctcttcttcttccaacagaggagaggaagaatgagagatggaaacctggcggcagcgcaaaagatg

SEQ ID NO: 201068 - DNA, 103 bp, Artificial Sequence
  Synthetic Polynucleotide
taatacgactcactatagggtgcccctgtggcttcatctacatccatctcaacagaggagagagatgatggtagatgaaaacctggcggcagcgcaaaagatg

SEQ ID NO: 201069 - DNA, 103 bp, Artificial Sequence
  Synthetic Polynucleotide
taatacgactcactataggggcttcttaactgcccctgtggcttcatctaaacagaggagatagatgatgccacaggggaacctggcggcagcgcaaaagatg

SEQ ID NO: 201070 - DNA, 103 bp, Artificial Sequence
  Synthetic Polynucleotide
taatacgactcactatagggacaccattgtgcttcttaactgcccctgtgaacagaggagacacaggatgagttaagaaaacctggcggcagcgcaaaagatg

SEQ ID NO: 201071 - DNA, 103 bp, Artificial Sequence
  Synthetic Polynucleotide
taatacgactcactatagggactgcccccaacaccattgtgcttcttaacaacagaggagagttaagatgcacaatggtaacctggcggcagcgcaaaagatg

SEQ ID NO: 201072 - DNA, 103 bp, Artificial Sequence
  Synthetic Polynucleotide
taatacgactcactatagggacttagggggactgcccccaacaccattgtaacagaggagaacaatgatgttgggggcaaacctggcggcagcgcaaaagatg

SEQ ID NO: 201073 - DNA, 103 bp, Artificial Sequence
  Synthetic Polynucleotide
taatacgactcactatagggagtaacttggacttagggggactgcccccaaacagaggagatgggggatgtccccctaaaacctggcggcagcgcaaaagatg

SEQ ID NO: 201074 - DNA, 103 bp, Artificial Sequence
  Synthetic Polynucleotide
taatacgactcactataggggttactaaacagtaacttggacttagggggaacagaggagaccccctatgtccaagttaaacctggcggcagcgcaaaagatg

SEQ ID NO: 201075 - DNA, 103 bp, Artificial Sequence
  Synthetic Polynucleotide
taatacgactcactatagggggggctgcaccgctgttgggtgatgatggcaacagaggagagccatcatgacccaacagaacctggcggcagcgcaaaagatg

SEQ ID NO: 201076 - DNA, 103 bp, Artificial Sequence
  Synthetic Polynucleotide
taatacgactcactataggggagctgctgtgttactaaacagtaacttggaacagaggagaccaagtatgtgtttagtaaacctggcggcagcgcaaaagatg

SEQ ID NO: 201077 - DNA, 103 bp, Artificial Sequence
  Synthetic Polynucleotide
taatacgactcactatagggcttaatttttgagctgctgtgttactaaacaacagaggagagtttagatgcacagcagcaacctggcggcagcgcaaaagatg

SEQ ID NO: 201078 - DNA, 103 bp, Artificial Sequence
  Synthetic Polynucleotide
taatacgactcactatagggatccattcctcttaatttttgagctgctgtaacagaggagaacagcaatgcaaaaattaaacctggcggcagcgcaaaagatg

SEQ ID NO: 201079 - DNA, 103 bp, Artificial Sequence
  Synthetic Polynucleotide
taatacgactcactatagggtgtatacttcatccattcctcttaatttttaacagaggagaaaaaatatggaggaatggaacctggcggcagcgcaaaagatg

SEQ ID NO: 201080 - DNA, 103 bp, Artificial Sequence
  Synthetic Polynucleotide
taatacgactcactatagggtagaagaggttgtatacttcatccattcctaacagaggagaaggaatatgtgaagtataaacctggcggcagcgcaaaagatg

SEQ ID NO: 201081 - DNA, 103 bp, Artificial Sequence
  Synthetic Polynucleotide
taatacgactcactataggggttgttgacatagaagaggttgtatacttcaacagaggagagaagtaatgaacctcttcaacctggcggcagcgcaaaagatg

SEQ ID NO: 201082 - DNA, 103 bp, Artificial Sequence
  Synthetic Polynucleotide
taatacgactcactatagggtataccagttgttgttgacatagaagaggtaacagaggagaacctctatgatgtcaacaaacctggcggcagcgcaaaagatg

SEQ ID NO: 201083 - DNA, 103 bp, Artificial Sequence
  Synthetic Polynucleotide
taatacgactcactatagggcgcataaaaatataccagttgttgttgacaaacagaggagatgtcaaatgcaactggtaaacctggcggcagcgcaaaagatg

SEQ ID NO: 201084 - DNA, 103 bp, Artificial Sequence
  Synthetic Polynucleotide
taatacgactcactatagggctggtgcagtcgcataaaaatataccagttaacagaggagaaactggatgatttttatgaacctggcggcagcgcaaaagatg

SEQ ID NO: 201085 - DNA, 103 bp, Artificial Sequence
  Synthetic Polynucleotide
taatacgactcactatagggggcagagaatctggtgcagtcgcataaaaaaacagaggagatttttaatggactgcaccaacctggcggcagcgcaaaagatg

SEQ ID NO: 201086 - DNA, 103 bp, Artificial Sequence
  Synthetic Polynucleotide
taatacgactcactatagggtggcctccgtggggctgcaccgctgttgggaacagaggagacccaacatgggtgcagccaacctggcggcagcgcaaaagatg

SEQ ID NO: 201087 - DNA, 103 bp, Artificial Sequence
  Synthetic Polynucleotide
taatacgactcactatagggagcagcctcaggcagagaatctggtgcagtaacagaggagaactgcaatggattctctgaacctggcggcagcgcaaaagatg

SEQ ID NO: 201088 - DNA, 103 bp, Artificial Sequence
  Synthetic Polynucleotide
taatacgactcactatagggacaaatccgtagcagcctcaggcagagaataacagaggagaattctcatgctgaggctgaacctggcggcagcgcaaaagatg

SEQ ID NO: 201089 - DNA, 103 bp, Artificial Sequence
  Synthetic Polynucleotide
taatacgactcactatagggcggcttgggaacaaatccgtagcagcctcaaacagaggagatgaggcatgtacggatttaacctggcggcagcgcaaaagatg

SEQ ID NO: 201090 - DNA, 103 bp, Artificial Sequence
  Synthetic Polynucleotide
taatacgactcactatagggatttgccgttcggcttgggaacaaatccgtaacagaggagaacggatatgttcccaagcaacctggcggcagcgcaaaagatg

SEQ ID NO: 201091 - DNA, 103 bp, Artificial Sequence
  Synthetic Polynucleotide
taatacgactcactatagggttcttcttcaatttgccgttcggcttgggaaacagaggagatcccaaatggaacggcaaaacctggcggcagcgcaaaagatg

SEQ ID NO: 201092 - DNA, 103 bp, Artificial Sequence
  Synthetic Polynucleotide
taatacgactcactatagggtctctcggttttcttcttcaatttgccgttaacagaggagaaacggcatgttgaagaagaacctggcggcagcgcaaaagatg

SEQ ID NO: 201093 - DNA, 103 bp, Artificial Sequence
  Synthetic Polynucleotide
taatacgactcactatagggtcccattctctctctcggttttcttcttcaaacagaggagatgaagaatgaaaccgagaaacctggcggcagcgcaaaagatg

SEQ ID NO: 201094 - DNA, 103 bp, Artificial Sequence
  Synthetic Polynucleotide
taatacgactcactatagggcacttcccgttcccattctctctctcggttaacagaggagaaaccgaatgagagaatggaacctggcggcagcgcaaaagatg

SEQ ID NO: 201095 - DNA, 103 bp, Artificial Sequence
  Synthetic Polynucleotide
taatacgactcactatagggttatgcccagcacttcccgttcccattctcaacagaggagagagaatatgaacgggaagaacctggcggcagcgcaaaagatg

SEQ ID NO: 201096 - DNA, 103 bp, Artificial Sequence
  Synthetic Polynucleotide
taatacgactcactatagggttgtctcgctttatgcccagcacttcccgtaacagaggagaacgggaatggctgggcataacctggcggcagcgcaaaagatg

SEQ ID NO: 201097 - DNA, 103 bp, Artificial Sequence
  Synthetic Polynucleotide
taatacgactcactatagggctggaccacctggcctccgtggggctgcacaacagaggagagtgcagatgcacggaggcaacctggcggcagcgcaaaagatg

SEQ ID NO: 201098 - DNA, 103 bp, Artificial Sequence
  Synthetic Polynucleotide
taatacgactcactataggggctgtcactcttgtctcgctttatgcccagaacagaggagactgggcatgaagcgagacaacctggcggcagcgcaaaagatg

SEQ ID NO: 201099 - DNA, 103 bp, Artificial Sequence
  Synthetic Polynucleotide
taatacgactcactataggggaatggcagggctgtcactcttgtctcgctaacagaggagaagcgagatgagagtgacaaacctggcggcagcgcaaaagatg

SEQ ID NO: 201100 - DNA, 103 bp, Artificial Sequence
  Synthetic Polynucleotide
taatacgactcactatagggagacgtagctgaatggcagggctgtcactcaacagaggagagagtgaatgccctgccataacctggcggcagcgcaaaagatg

SEQ ID NO: 201101 - DNA, 103 bp, Artificial Sequence
  Synthetic Polynucleotide
taatacgactcactatagggaggttctttgagacgtagctgaatggcaggaacagaggagacctgccatgcagctacgtaacctggcggcagcgcaaaagatg

SEQ ID NO: 201102 - DNA, 103 bp, Artificial Sequence
  Synthetic Polynucleotide
taatacgactcactatagggcaacatccataggttctttgagacgtagctaacagaggagaagctacatgtcaaagaacaacctggcggcagcgcaaaagatg

SEQ ID NO: 201103 - DNA, 103 bp, Artificial Sequence
  Synthetic Polynucleotide
taatacgactcactatagggtcttctacatcaacatccataggttctttgaacagaggagacaaagaatgtatggatgtaacctggcggcagcgcaaaagatg

SEQ ID NO: 201104 - DNA, 103 bp, Artificial Sequence
  Synthetic Polynucleotide
taatacgactcactatagggtgggtaataatcttctacatcaacatccataacagaggagaatggatatggatgtagaaaacctggcggcagcgcaaaagatg

SEQ ID NO: 201105 - DNA, 103 bp, Artificial Sequence
  Synthetic Polynucleotide
taatacgactcactatagggccaggaaagctgggtaataatcttctacataacagaggagaatgtagatgattattaccaacctggcggcagcgcaaaagatg

SEQ ID NO: 201106 - DNA, 103 bp, Artificial Sequence
  Synthetic Polynucleotide
taatacgactcactatagggcgcaccatgtccaggaaagctgggtaataaaacagaggagattattaatgagctttcctaacctggcggcagcgcaaaagatg

SEQ ID NO: 201107 - DNA, 103 bp, Artificial Sequence
  Synthetic Polynucleotide
taatacgactcactatagggcagcaggctccgcaccatgtccaggaaagcaacagaggagagctttcatggacatggtgaacctggcggcagcgcaaaagatg

SEQ ID NO: 201108 - DNA, 103 bp, Artificial Sequence
  Synthetic Polynucleotide
taatacgactcactataggggagcatgactctggaccacctggcctccgtaacagaggagaacggagatgaggtggtccaacctggcggcagcgcaaaagatg

SEQ ID NO: 201109 - DNA, 103 bp, Artificial Sequence
  Synthetic Polynucleotide
taatacgactcactatagggtgttgccatccagcaggctccgcaccatgtaacagaggagaacatggatgggagcctgcaacctggcggcagcgcaaaagatg

SEQ ID NO: 201110 - DNA, 103 bp, Artificial Sequence
  Synthetic Polynucleotide
taatacgactcactataggggatgagtctatgttgccatccagcaggctcaacagaggagagagcctatgggatggcaaaacctggcggcagcgcaaaagatg

SEQ ID NO: 201111 - DNA, 103 bp, Artificial Sequence
  Synthetic Polynucleotide
taatacgactcactatagggttcatactgtgatgagtctatgttgccatcaacagaggagagatggcatgatagactcaaacctggcggcagcgcaaaagatg

SEQ ID NO: 201112 - DNA, 103 bp, Artificial Sequence
  Synthetic Polynucleotide
taatacgactcactatagggtcagtgaatcttcatactgtgatgagtctaaacagaggagatagactatgcacagtatgaacctggcggcagcgcaaaagatg

SEQ ID NO: 201113 - DNA, 103 bp, Artificial Sequence
  Synthetic Polynucleotide
taatacgactcactatagggaacatctctctcagtgaatcttcatactgtaacagaggagaacagtaatgagattcactaacctggcggcagcgcaaaagatg

SEQ ID NO: 201114 - DNA, 103 bp, Artificial Sequence
  Synthetic Polynucleotide
taatacgactcactatagggatgaatggtgaacatctctctcagtgaatcaacagaggagagattcaatgagagagatgaacctggcggcagcgcaaaagatg

SEQ ID NO: 201115 - DNA, 103 bp, Artificial Sequence
  Synthetic Polynucleotide
taatacgactcactatagggcaatgtaggcatgaatggtgaacatctctcaacagaggagagagagaatgtcaccattcaacctggcggcagcgcaaaagatg

SEQ ID NO: 201116 - DNA, 103 bp, Artificial Sequence
  Synthetic Polynucleotide
taatacgactcactatagggatggtaaaggcaatgtaggcatgaatggtgaacagaggagacaccatatgtgcctacataacctggcggcagcgcaaaagatg

SEQ ID NO: 201117 - DNA, 103 bp, Artificial Sequence
  Synthetic Polynucleotide
taatacgactcactatagggcagtttgtccatggtaaaggcaatgtaggcaacagaggagagcctacatggcctttaccaacctggcggcagcgcaaaagatg

SEQ ID NO: 201118 - DNA, 103 bp, Artificial Sequence
  Synthetic Polynucleotide
taatacgactcactatagggtgctctggatcagtttgtccatggtaaaggaacagaggagacctttaatgtggacaaacaacctggcggcagcgcaaaagatg

SEQ ID NO: 201119 - DNA, 103 bp, Artificial Sequence
  Synthetic Polynucleotide
taatacgactcactatagggtgctgggctgcatacaccggtgactcctggaacagaggagaccaggaatgaccggtgtaaacctggcggcagcgcaaaagatg

SEQ ID NO: 201120 - DNA, 103 bp, Artificial Sequence
  Synthetic Polynucleotide
taatacgactcactatagggggggctggatgagcatgactctggaccaccaacagaggagaggtggtatggagtcatgcaacctggcggcagcgcaaaagatg

SEQ ID NO: 201121 - DNA, 103 bp, Artificial Sequence
  Synthetic Polynucleotide
taatacgactcactatagggtgtctgacaatgctctggatcagtttgtccaacagaggagaggacaaatggatccagagaacctggcggcagcgcaaaagatg

SEQ ID NO: 201122 - DNA, 103 bp, Artificial Sequence
  Synthetic Polynucleotide
taatacgactcactatagggatgctgcagctgtctgacaatgctctggataacagaggagaatccagatgattgtcagaaacctggcggcagcgcaaaagatg

SEQ ID NO: 201123 - DNA, 103 bp, Artificial Sequence
  Synthetic Polynucleotide
taatacgactcactatagggcactcacgatatgctgcagctgtctgacaaaacagaggagattgtcaatgagctgcagcaacctggcggcagcgcaaaagatg

SEQ ID NO: 201124 - DNA, 103 bp, Artificial Sequence
  Synthetic Polynucleotide
taatacgactcactatagggcagatctcatcactcacgatatgctgcagcaacagaggagagctgcaatgtatcgtgagaacctggcggcagcgcaaaagatg

SEQ ID NO: 201125 - DNA, 103 bp, Artificial Sequence
  Synthetic Polynucleotide
taatacgactcactatagggcacctgcacacagatctcatcactcacgataacagaggagaatcgtgatggatgagatcaacctggcggcagcgcaaaagatg

SEQ ID NO: 201126 - DNA, 103 bp, Artificial Sequence
  Synthetic Polynucleotide
taatacgactcactatagggaaaggtcagtcacctgcacacagatctcataacagaggagaatgagaatggtgtgcaggaacctggcggcagcgcaaaagatg

SEQ ID NO: 201127 - DNA, 103 bp, Artificial Sequence
  Synthetic Polynucleotide
taatacgactcactatagggtctgccaggtaaaggtcagtcacctgcacaaacagaggagatgtgcaatggactgacctaacctggcggcagcgcaaaagatg

SEQ ID NO: 201128 - DNA, 103 bp, Artificial Sequence
  Synthetic Polynucleotide
taatacgactcactatagggattattattttctgccaggtaaaggtcagtaacagaggagaactgacatgtacctggcaaacctggcggcagcgcaaaagatg

SEQ ID NO: 201129 - DNA, 103 bp, Artificial Sequence
  Synthetic Polynucleotide
taatacgactcactatagggcggtggccccattattattttctgccaggtaacagaggagaacctggatgaaaataataaacctggcggcagcgcaaaagatg

SEQ ID NO: 201130 - DNA, 103 bp, Artificial Sequence
  Synthetic Polynucleotide
taatacgactcactatagggagctggcctccggtggccccattattatttaacagaggagaaaataaatgtggggccacaacctggcggcagcgcaaaagatg

SEQ ID NO: 201131 - DNA, 103 bp, Artificial Sequence
  Synthetic Polynucleotide
taatacgactcactatagggtgcaactggtggggctggatgagcatgactaacagaggagaagtcatatgcatccagccaacctggcggcagcgcaaaagatg

SEQ ID NO: 201132 - DNA, 103 bp, Artificial Sequence
  Synthetic Polynucleotide
taatacgactcactatagggctgtgtgttcagctggcctccggtggccccaacagaggagaggggccatgggaggccagaacctggcggcagcgcaaaagatg

SEQ ID NO: 201133 - DNA, 103 bp, Artificial Sequence
  Synthetic Polynucleotide
taatacgactcactatagggtccttgagttctgtgtgttcagctggcctcaacagaggagagaggccatgtgaacacacaacctggcggcagcgcaaaagatg

SEQ ID NO: 201134 - DNA, 103 bp, Artificial Sequence
  Synthetic Polynucleotide
taatacgactcactatagggtccaggaggctccttgagttctgtgtgttcaacagaggagagaacacatggaactcaagaacctggcggcagcgcaaaagatg

SEQ ID NO: 201135 - DNA, 103 bp, Artificial Sequence
  Synthetic Polynucleotide
taatacgactcactatagggatacgttgactccaggaggctccttgagttaacagaggagaaactcaatgagcctcctgaacctggcggcagcgcaaaagatg

SEQ ID NO: 201136 - DNA, 103 bp, Artificial Sequence
  Synthetic Polynucleotide
taatacgactcactatagggctttccgctgatacgttgactccaggaggcaacagaggagagcctccatgagtcaacgtaacctggcggcagcgcaaaagatg

SEQ ID NO: 201137 - DNA, 103 bp, Artificial Sequence
  Synthetic Polynucleotide
taatacgactcactatagggagctgctcagctttccgctgatacgttgacaacagaggagagtcaacatgtcagcggaaaacctggcggcagcgcaaaagatg

SEQ ID NO: 201138 - DNA, 103 bp, Artificial Sequence
  Synthetic Polynucleotide
taatacgactcactatagggatctgacattagctgctcagctttccgctgaacagaggagacagcggatggctgagcagaacctggcggcagcgcaaaagatg

SEQ ID NO: 201139 - DNA, 103 bp, Artificial Sequence
  Synthetic Polynucleotide
taatacgactcactatagggagcaattctcatctgacattagctgctcagaacagaggagactgagcatgtaatgtcagaacctggcggcagcgcaaaagatg

SEQ ID NO: 201140 - DNA, 103 bp, Artificial Sequence
  Synthetic Polynucleotide
taatacgactcactatagggataagcttaaagcaattctcatctgacattaacagaggagaaatgtcatgtgagaattgaacctggcggcagcgcaaaagatg

SEQ ID NO: 201141 - DNA, 103 bp, Artificial Sequence
  Synthetic Polynucleotide
taatacgactcactatagggctgaataaacataagcttaaagcaattctcaacagaggagagagaatatgtttaagcttaacctggcggcagcgcaaaagatg

SEQ ID NO: 201142 - DNA, 103 bp, Artificial Sequence
  Synthetic Polynucleotide
taatacgactcactatagggcctgcactggtgcaactggtggggctggataacagaggagaatccagatgcaccagttgaacctggcggcagcgcaaaagatg

SEQ ID NO: 201143 - DNA, 103 bp, Artificial Sequence
  Synthetic Polynucleotide
taatacgactcactatagggggccttggctctgaataaacataagcttaaaacagaggagattaagcatgtgtttattcaacctggcggcagcgcaaaagatg

SEQ ID NO: 201144 - DNA, 103 bp, Artificial Sequence
  Synthetic Polynucleotide
taatacgactcactatagggagctggacctggccttggctctgaataaacaacagaggagagtttatatggagccaaggaacctggcggcagcgcaaaagatg

SEQ ID NO: 201145 - DNA, 103 bp, Artificial Sequence
  Synthetic Polynucleotide
taatacgactcactatagggctcaatagtcagctggacctggccttggctaacagaggagaagccaaatgcaggtccagaacctggcggcagcgcaaaagatg

SEQ ID NO: 201146 - DNA, 103 bp, Artificial Sequence
  Synthetic Polynucleotide
taatacgactcactatagggtgtccagaagctcaatagtcagctggacctaacagaggagaaggtccatgtgactattgaacctggcggcagcgcaaaagatg

SEQ ID NO: 201147 - DNA, 103 bp, Artificial Sequence
  Synthetic Polynucleotide
taatacgactcactatagggtcctcttctgtgtccagaagctcaatagtcaacagaggagagactatatggcttctggaaacctggcggcagcgcaaaagatg

SEQ ID NO: 201148 - DNA, 103 bp, Artificial Sequence
  Synthetic Polynucleotide
taatacgactcactatagggatccgaattctcctcttctgtgtccagaagaacagaggagacttctgatgacagaagagaacctggcggcagcgcaaaagatg

SEQ ID NO: 201149 - DNA, 103 bp, Artificial Sequence
  Synthetic Polynucleotide
taatacgactcactatagggccacagggtcatccgaattctcctcttctgaacagaggagacagaagatgagaattcggaacctggcggcagcgcaaaagatg

SEQ ID NO: 201150 - DNA, 103 bp, Artificial Sequence
  Synthetic Polynucleotide
taatacgactcactatagggcgctctgcttccacagggtcatccgaattcaacagaggagagaattcatgtgaccctgtaacctggcggcagcgcaaaagatg

SEQ ID NO: 201151 - DNA, 103 bp, Artificial Sequence
  Synthetic Polynucleotide
taatacgactcactataggggtctgaccagcgctctgcttccacagggtcaacagaggagagaccctatggaagcagagaacctggcggcagcgcaaaagatg

SEQ ID NO: 201152 - DNA, 103 bp, Artificial Sequence
  Synthetic Polynucleotide
taatacgactcactataggggctccacgtagtctgaccagcgctctgcttaacagaggagaaagcagatggctggtcagaacctggcggcagcgcaaaagatg

SEQ ID NO: 201153 - DNA, 103 bp, Artificial Sequence
  Synthetic Polynucleotide
taatacgactcactatagggtgctgctgtccctgcactggtgcaactggtaacagaggagaaccagtatgaccagtgcaaacctggcggcagcgcaaaagatg

SEQ ID NO: 201154 - DNA, 103 bp, Artificial Sequence
  Synthetic Polynucleotide
taatacgactcactatagggttcatgtatcgctccacgtagtctgaccagaacagaggagactggtcatgctacgtggaaacctggcggcagcgcaaaagatg

SEQ ID NO: 201155 - DNA, 103 bp, Artificial Sequence
  Synthetic Polynucleotide
taatacgactcactatagggagtatctgaattcatgtatcgctccacgtaaacagaggagatacgtgatgcgatacatgaacctggcggcagcgcaaaagatg

SEQ ID NO: 201156 - DNA, 103 bp, Artificial Sequence
  Synthetic Polynucleotide
taatacgactcactatagggcaggcgaggtagtatctgaattcatgtatcaacagaggagagatacaatgattcagataaacctggcggcagcgcaaaagatg

SEQ ID NO: 201157 - DNA, 103 bp, Artificial Sequence
  Synthetic Polynucleotide
taatacgactcactatagggtcacgaagctcaggcgaggtagtatctgaaaacagaggagattcagaatgtacctcgccaacctggcggcagcgcaaaagatg

SEQ ID NO: 201158 - DNA, 103 bp, Artificial Sequence
  Synthetic Polynucleotide
taatacgactcactatagggtgctagatgttcacgaagctcaggcgaggtaacagaggagaacctcgatggagcttcgtaacctggcggcagcgcaaaagatg

SEQ ID NO: 201159 - DNA, 103 bp, Artificial Sequence
  Synthetic Polynucleotide
taatacgactcactatagggctggtttctgtgctagatgttcacgaagctaacagaggagaagcttcatgaacatctagaacctggcggcagcgcaaaagatg

SEQ ID NO: 201160 - DNA, 103 bp, Artificial Sequence
  Synthetic Polynucleotide
taatacgactcactataggggggagaaatactggtttctgtgctagatgtaacagaggagaacatctatgacagaaaccaacctggcggcagcgcaaaagatg

SEQ ID NO: 201161 - DNA, 103 bp, Artificial Sequence
  Synthetic Polynucleotide
taatacgactcactatagggtagattcctggggagaaatactggtttctgaacagaggagacagaaaatggtatttctcaacctggcggcagcgcaaaagatg

SEQ ID NO: 201162 - DNA, 103 bp, Artificial Sequence
  Synthetic Polynucleotide
taatacgactcactatagggggatccgccgtagattcctggggagaaataaacagaggagatatttcatgccaggaatcaacctggcggcagcgcaaaagatg

SEQ ID NO: 201163 - DNA, 103 bp, Artificial Sequence
  Synthetic Polynucleotide
taatacgactcactatagggtgacacttccggatccgccgtagattcctgaacagaggagacaggaaatgacggcggataacctggcggcagcgcaaaagatg

SEQ ID NO: 201164 - DNA, 103 bp, Artificial Sequence
  Synthetic Polynucleotide
taatacgactcactatagggcctctgaaattgctgctgtccctgcactggaacagaggagaccagtgatgggacagcagaacctggcggcagcgcaaaagatg

SEQ ID NO: 201165 - DNA, 103 bp, Artificial Sequence
  Synthetic Polynucleotide
taatacgactcactatagggtcgaccacgttgacacttccggatccgccgaacagaggagacggcggatgcggaagtgtaacctggcggcagcgcaaaagatg

SEQ ID NO: 201166 - DNA, 103 bp, Artificial Sequence
  Synthetic Polynucleotide
taatacgactcactatagggcctgctgctctcgaccacgttgacacttccaacagaggagaggaagtatgaacgtggtcaacctggcggcagcgcaaaagatg

SEQ ID NO: 201167 - DNA, 103 bp, Artificial Sequence
  Synthetic Polynucleotide
taatacgactcactatagggccttccttttcctgctgctctcgaccacgtaacagaggagaacgtggatgagagcagcaaacctggcggcagcgcaaaagatg

SEQ ID NO: 201168 - DNA, 103 bp, Artificial Sequence
  Synthetic Polynucleotide
taatacgactcactatagggtccttccttcccttccttttcctgctgctcaacagaggagagagcagatggaaaaggaaaacctggcggcagcgcaaaagatg

SEQ ID NO: 201169 - DNA, 103 bp, Artificial Sequence
  Synthetic Polynucleotide
taatacgactcactatagggtcttgctgtttccttccttcccttccttttaacagaggagaaaaaggatgggaaggaagaacctggcggcagcgcaaaagatg

SEQ ID NO: 201170 - DNA, 103 bp, Artificial Sequence
  Synthetic Polynucleotide
taatacgactcactatagggtccatggtcttcttgctgtttccttccttcaacagaggagagaaggaatgaaacagcaaaacctggcggcagcgcaaaagatg

SEQ ID NO: 201171 - DNA, 103 bp, Artificial Sequence
  Synthetic Polynucleotide
taatacgactcactatagggatccacattctccatggtcttcttgctgttaacagaggagaaacagcatgaagaccatgaacctggcggcagcgcaaaagatg

SEQ ID NO: 201172 - DNA, 103 bp, Artificial Sequence
  Synthetic Polynucleotide
taatacgactcactatagggtatccagactatccacattctccatggtctaacagaggagaagaccaatgagaatgtggaacctggcggcagcgcaaaagatg

SEQ ID NO: 201173 - DNA, 103 bp, Artificial Sequence
  Synthetic Polynucleotide
taatacgactcactatagggcactccagcttatccagactatccacattcaacagaggagagaatgtatgtagtctggaaacctggcggcagcgcaaaagatg

SEQ ID NO: 201174 - DNA, 103 bp, Artificial Sequence
  Synthetic Polynucleotide
taatacgactcactatagggcttgaatctacactccagcttatccagactaacagaggagaagtctgatgaagctggagaacctggcggcagcgcaaaagatg

SEQ ID NO: 201175 - DNA, 103 bp, Artificial Sequence
  Synthetic Polynucleotide
taatacgactcactatagggccaccttcagcctctgaaattgctgctgtcaacagaggagagacagcatgaatttcagaaacctggcggcagcgcaaaagatg

SEQ ID NO: 201176 - DNA, 103 bp, Artificial Sequence
  Synthetic Polynucleotide
taatacgactcactatagggaggaattcagcttgaatctacactccagctaacagaggagaagctggatggtagattcaaacctggcggcagcgcaaaagatg

SEQ ID NO: 201177 - DNA, 103 bp, Artificial Sequence
  Synthetic Polynucleotide
taatacgactcactatagggaccatcttgtaggaattcagcttgaatctaaacagaggagatagattatggctgaattcaacctggcggcagcgcaaaagatg

SEQ ID NO: 201178 - DNA, 103 bp, Artificial Sequence
  Synthetic Polynucleotide
taatacgactcactataggggatcacatacaccatcttgtaggaattcagaacagaggagactgaatatgtacaagatgaacctggcggcagcgcaaaagatg

SEQ ID NO: 201179 - DNA, 103 bp, Artificial Sequence
  Synthetic Polynucleotide
taatacgactcactatagggcctctgatttgatcacatacaccatcttgtaacagaggagaacaagaatgtgtatgtgaaacctggcggcagcgcaaaagatg

SEQ ID NO: 201180 - DNA, 103 bp, Artificial Sequence
  Synthetic Polynucleotide
taatacgactcactatagggtacatatagtcctctgatttgatcacatacaacagaggagagtatgtatgcaaatcagaaacctggcggcagcgcaaaagatg

SEQ ID NO: 201181 - DNA, 103 bp, Artificial Sequence
  Synthetic Polynucleotide
taatacgactcactatagggggtcctccgatacatatagtcctctgatttaacagaggagaaaatcaatggactatatgaacctggcggcagcgcaaaagatg

SEQ ID NO: 201182 - DNA, 103 bp, Artificial Sequence
  Synthetic Polynucleotide
taatacgactcactatagggggagcagggcggtcctccgatacatatagtaacagaggagaactataatgatcggaggaaacctggcggcagcgcaaaagatg

SEQ ID NO: 201183 - DNA, 103 bp, Artificial Sequence
  Synthetic Polynucleotide
taatacgactcactatagggtgatgagcccggagcagggcggtcctccgaaacagaggagatcggagatgcgccctgctaacctggcggcagcgcaaaagatg

SEQ ID NO: 201184 - DNA, 103 bp, Artificial Sequence
  Synthetic Polynucleotide
taatacgactcactatagggctcatgggactgatgagcccggagcagggcaacagaggagagccctgatgcgggctcataacctggcggcagcgcaaaagatg

SEQ ID NO: 201185 - DNA, 103 bp, Artificial Sequence
  Synthetic Polynucleotide
taatacgactcactatagggtgcttacacgctcatgggactgatgagcccaacagaggagagggctcatgagtcccatgaacctggcggcagcgcaaaagatg

SEQ ID NO: 201186 - DNA, 103 bp, Artificial Sequence
  Synthetic Polynucleotide
taatacgactcactatagggagcgcatcctccaccttcagcctctgaaataacagaggagaatttcaatggctgaaggtaacctggcggcagcgcaaaagatg

SEQ ID NO: 201187 - DNA, 103 bp, Artificial Sequence
  Synthetic Polynucleotide
taatacgactcactatagggtgtagacgcttgcttacacgctcatgggacaacagaggagagtcccaatggcgtgtaagaacctggcggcagcgcaaaagatg

SEQ ID NO: 201188 - DNA, 103 bp, Artificial Sequence
  Synthetic Polynucleotide
taatacgactcactataggggaatctctgatgtagacgcttgcttacacgaacagaggagacgtgtaatgaagcgtctaaacctggcggcagcgcaaaagatg

SEQ ID NO: 201189 - DNA, 103 bp, Artificial Sequence
  Synthetic Polynucleotide
taatacgactcactatagggcccaggcctggaatctctgatgtagacgctaacagaggagaagcgtcatgatcagagataacctggcggcagcgcaaaagatg

SEQ ID NO: 201190 - DNA, 103 bp, Artificial Sequence
  Synthetic Polynucleotide
taatacgactcactatagggcatttatctacccaggcctggaatctctgaaacagaggagatcagagatgccaggcctgaacctggcggcagcgcaaaagatg

SEQ ID NO: 201191 - DNA, 103 bp, Artificial Sequence
  Synthetic Polynucleotide
taatacgactcactatagggctccttggtccatttatctacccaggcctgaacagaggagacaggccatggtagataaaaacctggcggcagcgcaaaagatg

SEQ ID NO: 201192 - DNA, 103 bp, Artificial Sequence
  Synthetic Polynucleotide
taatacgactcactatagggggggcacatgctccttggtccatttatctaaacagaggagatagataatgggaccaaggaacctggcggcagcgcaaaagatg

SEQ ID NO: 201193 - DNA, 103 bp, Artificial Sequence
  Synthetic Polynucleotide
taatacgactcactataggggccatttcacggggcacatgctccttggtcaacagaggagagaccaaatggcatgtgccaacctggcggcagcgcaaaagatg

SEQ ID NO: 201194 - DNA, 103 bp, Artificial Sequence
  Synthetic Polynucleotide
taatacgactcactatagggggtctctgctgccatttcacggggcacatgaacagaggagacatgtgatgcgtgaaatgaacctggcggcagcgcaaaagatg

SEQ ID NO: 201195 - DNA, 103 bp, Artificial Sequence
  Synthetic Polynucleotide
taatacgactcactataggggccacttgctggtctctgctgccatttcacaacagaggagagtgaaaatgcagcagagaaacctggcggcagcgcaaaagatg

SEQ ID NO: 201196 - DNA, 103 bp, Artificial Sequence
  Synthetic Polynucleotide
taatacgactcactatagggtcacccatgagccacttgctggtctctgctaacagaggagaagcagaatgcagcaagtgaacctggcggcagcgcaaaagatg

SEQ ID NO: 201197 - DNA, 103 bp, Artificial Sequence
  Synthetic Polynucleotide
taatacgactcactatagggaagataagatagcgcatcctccaccttcagaacagaggagactgaagatggaggatgcgaacctggcggcagcgcaaaagatg

SEQ ID NO: 201198 - DNA, 103 bp, Artificial Sequence
  Synthetic Polynucleotide
taatacgactcactatagggctccagcccctcacccatgagccacttgctaacagaggagaagcaagatgctcatgggtaacctggcggcagcgcaaaagatg

SEQ ID NO: 201199 - DNA, 103 bp, Artificial Sequence
  Synthetic Polynucleotide
taatacgactcactataggggcaccaggccctccagcccctcacccatgaaacagaggagatcatggatgaggggctggaacctggcggcagcgcaaaagatg

SEQ ID NO: 201200 - DNA, 103 bp, Artificial Sequence
  Synthetic Polynucleotide
taatacgactcactataggggtggtacagggcaccaggccctccagccccaacagaggagaggggctatggggcctggtaacctggcggcagcgcaaaagatg

SEQ ID NO: 201201 - DNA, 103 bp, Artificial Sequence
  Synthetic Polynucleotide
taatacgactcactatagggatcacaggtggtggtacagggcaccaggccaacagaggagaggcctgatgccctgtaccaacctggcggcagcgcaaaagatg

SEQ ID NO: 201202 - DNA, 103 bp, Artificial Sequence
  Synthetic Polynucleotide
taatacgactcactataggggggtctctgtatcacaggtggtggtacaggaacagaggagacctgtaatgccacctgtgaacctggcggcagcgcaaaagatg

SEQ ID NO: 201203 - DNA, 103 bp, Artificial Sequence
  Synthetic Polynucleotide
taatacgactcactatagggacaaaatgcagggtctctgtatcacaggtgaacagaggagacacctgatgtacagagacaacctggcggcagcgcaaaagatg

SEQ ID NO: 201204 - DNA, 103 bp, Artificial Sequence
  Synthetic Polynucleotide
taatacgactcactataggggttaatgctcacaaaatgcagggtctctgtaacagaggagaacagagatgctgcattttaacctggcggcagcgcaaaagatg

SEQ ID NO: 201205 - DNA, 103 bp, Artificial Sequence
  Synthetic Polynucleotide
taatacgactcactatagggcacgatacttgttaatgctcacaaaatgcaaacagaggagatgcattatgtgagcattaaacctggcggcagcgcaaaagatg

SEQ ID NO: 201206 - DNA, 103 bp, Artificial Sequence
  Synthetic Polynucleotide
taatacgactcactatagggccgtatttgacacgatacttgttaatgctcaacagaggagagagcatatgcaagtatcgaacctggcggcagcgcaaaagatg

SEQ ID NO: 201207 - DNA, 103 bp, Artificial Sequence
  Synthetic Polynucleotide
taatacgactcactataggggaatactgtgccgtatttgacacgatacttaacagaggagaaagtatatggtcaaatacaacctggcggcagcgcaaaagatg

SEQ ID NO: 201208 - DNA, 103 bp, Artificial Sequence
  Synthetic Polynucleotide
taatacgactcactatagggtcacctggtcaagataagatagcgcatcctaacagaggagaaggatgatgtatcttatcaacctggcggcagcgcaaaagatg

SEQ ID NO: 201209 - DNA, 103 bp, Artificial Sequence
  Synthetic Polynucleotide
taatacgactcactatagggaaggggctttgaatactgtgccgtatttgaaacagaggagatcaaatatggcacagtataacctggcggcagcgcaaaagatg

SEQ ID NO: 201210 - DNA, 103 bp, Artificial Sequence
  Synthetic Polynucleotide
taatacgactcactatagggaactgcagcttcacctggtcaagataagataacagaggagaatcttaatgtgaccaggtaacctggcggcagcgcaaaagatg

SEQ ID NO: 201211 - DNA, 103 bp, Artificial Sequence
  Synthetic Polynucleotide
taatacgactcactataggggatccgacgctgctgggctgcatacaccggaacagaggagaccggtgatggcagcccagaacctggcggcagcgcaaaagatg

SEQ ID NO: 201212 - DNA, 103 bp, Artificial Sequence
  Synthetic Polynucleotide
taatacgactcactatagggctgactaccaaactgcagcttcacctggtcaacagaggagagaccagatgaagctgcagaacctggcggcagcgcaaaagatg

SEQ ID NO: 201213 - DNA, 103 bp, Artificial Sequence
  Synthetic Polynucleotide
taatacgactcactatagggagacctgaggctgactaccaaactgcagctaacagaggagaagctgcatgttggtagtcaacctggcggcagcgcaaaagatg

SEQ ID NO: 201214 - DNA, 103 bp, Artificial Sequence
  Synthetic Polynucleotide
taatacgactcactatagggaaatcattgtagacctgaggctgactaccaaacagaggagatggtagatggcctcaggtaacctggcggcagcgcaaaagatg

SEQ ID NO: 201215 - DNA, 103 bp, Artificial Sequence
  Synthetic Polynucleotide
taatacgactcactataggggatgtcaaggaaatcattgtagacctgaggaacagaggagacctcagatgtacaatgataacctggcggcagcgcaaaagatg

SEQ ID NO: 201216 - DNA, 103 bp, Artificial Sequence
  Synthetic Polynucleotide
taatacgactcactatagggattccttcatgatgtcaaggaaatcattgtaacagaggagaacaatgatgtccttgacaaacctggcggcagcgcaaaagatg

SEQ ID NO: 201217 - DNA, 103 bp, Artificial Sequence
  Synthetic Polynucleotide
taatacgactcactatagggtgagatttaaattccttcatgatgtcaaggaacagaggagaccttgaatgcatgaaggaaacctggcggcagcgcaaaagatg

SEQ ID NO: 201218 - DNA, 103 bp, Artificial Sequence
  Synthetic Polynucleotide
taatacgactcactataggggtcgatgctctgagatttaaattccttcataacagaggagaatgaagatgtttaaatctaacctggcggcagcgcaaaagatg

SEQ ID NO: 201219 - DNA, 103 bp, Artificial Sequence
  Synthetic Polynucleotide
taatacgactcactatagggctcctggggtgtcgatgctctgagatttaaaacagaggagattaaatatgagagcatcgaacctggcggcagcgcaaaagatg

SEQ ID NO: 201220 - DNA, 103 bp, Artificial Sequence
  Synthetic Polynucleotide
taatacgactcactatagggcgactaatcactcctggggtgtcgatgctcaacagaggagagagcatatgcaccccaggaacctggcggcagcgcaaaagatg

SEQ ID NO: 201221 - DNA, 103 bp, Artificial Sequence
  Synthetic Polynucleotide
taatacgactcactatagggctgggacacacgactaatcactcctggggtaacagaggagaaccccaatggtgattagtaacctggcggcagcgcaaaagatg

SEQ ID NO: 201222 - DNA, 103 bp, Artificial Sequence
  Synthetic Polynucleotide
taatacgactcactatagggtgctgccagggatccgacgctgctgggctgaacagaggagacagcccatgagcgtcggaaacctggcggcagcgcaaaagatg

SEQ ID NO: 201223 - DNA, 103 bp, Artificial Sequence
  Synthetic Polynucleotide
taatacgactcactatagggctttgaatagctgggacacacgactaatcaaacagaggagatgattaatggtgtgtcccaacctggcggcagcgcaaaagatg

SEQ ID NO: 201224 - DNA, 103 bp, Artificial Sequence
  Synthetic Polynucleotide
taatacgactcactatagggtcggggtggcctttgaatagctgggacacaaacagaggagatgtgtcatggctattcaaaacctggcggcagcgcaaaagatg

SEQ ID NO: 201225 - DNA, 103 bp, Artificial Sequence
  Synthetic Polynucleotide
taatacgactcactatagggcattatcagatcggggtggcctttgaatagaacagaggagactattcatgggccaccccaacctggcggcagcgcaaaagatg

SEQ ID NO: 201226 - DNA, 103 bp, Artificial Sequence
  Synthetic Polynucleotide
taatacgactcactatagggtgttgaatcccattatcagatcggggtggcaacagaggagagccaccatgatctgataaaacctggcggcagcgcaaaagatg

SEQ ID NO: 201227 - DNA, 103 bp, Artificial Sequence
  Synthetic Polynucleotide
taatacgactcactatagggggcaagaaggtgttgaatcccattatcagaaacagaggagatctgatatggggattcaaaacctggcggcagcgcaaaagatg

SEQ ID NO: 201228 - DNA, 103 bp, Artificial Sequence
  Synthetic Polynucleotide
taatacgactcactataggggtagccagggggcaagaaggtgttgaatccaacagaggagaggattcatgaccttcttgaacctggcggcagcgcaaaagatg

SEQ ID NO: 201229 - DNA, 103 bp, Artificial Sequence
  Synthetic Polynucleotide
taatacgactcactatagggcctcaattttgtagccagggggcaagaaggaacagaggagaccttctatgcccctggctaacctggcggcagcgcaaaagatg

SEQ ID NO: 201230 - DNA, 103 bp, Artificial Sequence
  Synthetic Polynucleotide
taatacgactcactatagggttggtttgcacctcaattttgtagccagggaacagaggagaccctggatgcaaaattgaaacctggcggcagcgcaaaagatg

SEQ ID NO: 201231 - DNA, 103 bp, Artificial Sequence
  Synthetic Polynucleotide
taatacgactcactatagggcaccatgtcattggtttgcacctcaattttaacagaggagaaaaattatggtgcaaaccaacctggcggcagcgcaaaagatg

SEQ ID NO: 201232 - DNA, 103 bp, Artificial Sequence
  Synthetic Polynucleotide
taatacgactcactatagggttgtcacattcaccatgtcattggtttgcaaacagaggagatgcaaaatgatgacatggaacctggcggcagcgcaaaagatg

SEQ ID NO: 201233 - DNA, 103 bp, Artificial Sequence
  Synthetic Polynucleotide
taatacgactcactatagggaaagcctctgtgctgccagggatccgacgcaacagaggagagcgtcgatgccctggcagaacctggcggcagcgcaaaagatg

SEQ ID NO: 201234 - DNA, 103 bp, Artificial Sequence
  Synthetic Polynucleotide
taatacgactcactatagggtggccaggagttgtcacattcaccatgtcaaacagaggagatgacatatggaatgtgacaacctggcggcagcgcaaaagatg

SEQ ID NO: 201235 - DNA, 103 bp, Artificial Sequence
  Synthetic Polynucleotide
taatacgactcactatagggctgatgaacctggccaggagttgtcacattaacagaggagaaatgtgatgactcctggcaacctggcggcagcgcaaaagatg

SEQ ID NO: 201236 - DNA, 103 bp, Artificial Sequence
  Synthetic Polynucleotide
taatacgactcactataggggggtgggaatctgatgaacctggccaggagaacagaggagactcctgatgaggttcatcaacctggcggcagcgcaaaagatg

SEQ ID NO: 201237 - DNA, 103 bp, Artificial Sequence
  Synthetic Polynucleotide
taatacgactcactatagggtggatgccatgggtgggaatctgatgaaccaacagaggagaggttcaatggattcccacaacctggcggcagcgcaaaagatg

SEQ ID NO: 201238 - DNA, 103 bp, Artificial Sequence
  Synthetic Polynucleotide
taatacgactcactatagggaggctgtggctggatgccatgggtgggaataacagaggagaattcccatgcatggcatcaacctggcggcagcgcaaaagatg

SEQ ID NO: 201239 - DNA, 103 bp, Artificial Sequence
  Synthetic Polynucleotide
taatacgactcactataggggtggtggttgaggctgtggctggatgccataacagaggagaatggcaatgagccacagcaacctggcggcagcgcaaaagatg

SEQ ID NO: 201240 - DNA, 103 bp, Artificial Sequence
  Synthetic Polynucleotide
taatacgactcactatagggggatgttggggtggtggttgaggctgtggcaacagaggagagccacaatgtcaaccaccaacctggcggcagcgcaaaagatg

SEQ ID NO: 201241 - DNA, 103 bp, Artificial Sequence
  Synthetic Polynucleotide
taatacgactcactatagggaggctgggaaggatgttggggtggtggttgaacagaggagacaaccaatgccccaacataacctggcggcagcgcaaaagatg

SEQ ID NO: 201242 - DNA, 103 bp, Artificial Sequence
  Synthetic Polynucleotide
taatacgactcactatagggactgggctgaaggctgggaaggatgttgggaacagaggagacccaacatgcttcccagcaacctggcggcagcgcaaaagatg

SEQ ID NO: 201243 - DNA, 103 bp, Artificial Sequence
  Synthetic Polynucleotide
taatacgactcactataggggctggggctgactgggctgaaggctgggaaaacagaggagattcccaatgttcagcccaaacctggcggcagcgcaaaagatg

SEQ ID NO: 201244 - DNA, 103 bp, Artificial Sequence
  Synthetic Polynucleotide
taatacgactcactatagggctggtgaggaaaagcctctgtgctgccaggaacagaggagacctggcatgacagaggctaacctggcggcagcgcaaaagatg

SEQ ID NO: 201245 - DNA, 103 bp, Artificial Sequence
  Synthetic Polynucleotide
taatacgactcactatagggctgggcaggagctggggctgactgggctgaaacagaggagatcagccatgtcagccccaaacctggcggcagcgcaaaagatg

SEQ ID NO: 201246 - DNA, 103 bp, Artificial Sequence
  Synthetic Polynucleotide
taatacgactcactataggggaggagctggctgggcaggagctggggctgaacagaggagacagcccatgctcctgcccaacctggcggcagcgcaaaagatg

SEQ ID NO: 201247 - DNA, 103 bp, Artificial Sequence
  Synthetic Polynucleotide
taatacgactcactatagggggtgggggctgaggagctggctgggcaggaaacagaggagatcctgcatggccagctccaacctggcggcagcgcaaaagatg

SEQ ID NO: 201248 - DNA, 103 bp, Artificial Sequence
  Synthetic Polynucleotide
taatacgactcactataggggactttggcaggtgggggctgaggagctggaacagaggagaccagctatgcagcccccaaacctggcggcagcgcaaaagatg

SEQ ID NO: 201249 - DNA, 103 bp, Artificial Sequence
  Synthetic Polynucleotide
taatacgactcactatagggagggcttgctgactttggcaggtgggggctaacagaggagaagccccatgctgccaaagaacctggcggcagcgcaaaagatg

SEQ ID NO: 201250 - DNA, 103 bp, Artificial Sequence
  Synthetic Polynucleotide
taatacgactcactatagggtgcagttgggagggcttgctgactttggcaaacagaggagatgccaaatgcagcaagccaacctggcggcagcgcaaaagatg

SEQ ID NO: 201251 - DNA, 103 bp, Artificial Sequence
  Synthetic Polynucleotide
taatacgactcactatagggagtatgtgcttgcagttgggagggcttgctaacagaggagaagcaagatgtcccaactgaacctggcggcagcgcaaaagatg

SEQ ID NO: 201252 - DNA, 103 bp, Artificial Sequence
  Synthetic Polynucleotide
taatacgactcactataggggactggccggagtatgtgcttgcagttgggaacagaggagacccaacatgaagcacataaacctggcggcagcgcaaaagatg

SEQ ID NO: 201253 - DNA, 103 bp, Artificial Sequence
  Synthetic Polynucleotide
taatacgactcactatagggggagtctgctgactggccggagtatgtgctaacagaggagaagcacaatgtccggccagaacctggcggcagcgcaaaagatg

SEQ ID NO: 201254 - DNA, 103 bp, Artificial Sequence
  Synthetic Polynucleotide
taatacgactcactatagggtggaagtgggggagtctgctgactggccggaacagaggagaccggccatgcagcagactaacctggcggcagcgcaaaagatg

SEQ ID NO: 201255 - DNA, 103 bp, Artificial Sequence
  Synthetic Polynucleotide
taatacgactcactataggggcacccggtgctggtgaggaaaagcctctgaacagaggagacagaggatgttcctcaccaacctggcggcagcgcaaaagatg

SEQ ID NO: 201256 - DNA, 103 bp, Artificial Sequence
  Synthetic Polynucleotide
taatacgactcactatagggatgcatacggtggaagtgggggagtctgctaacagaggagaagcagaatgccccacttcaacctggcggcagcgcaaaagatg

SEQ ID NO: 201257 - DNA, 103 bp, Artificial Sequence
  Synthetic Polynucleotide
taatacgactcactataggggaacgtggggatgcatacggtggaagtgggaacagaggagacccactatgaccgtatgcaacctggcggcagcgcaaaagatg

SEQ ID NO: 201258 - DNA, 103 bp, Artificial Sequence
  Synthetic Polynucleotide
taatacgactcactataggggaccggcggagaacgtggggatgcatacggaacagaggagaccgtatatgtccccacgtaacctggcggcagcgcaaaagatg

SEQ ID NO: 201259 - DNA, 103 bp, Artificial Sequence
  Synthetic Polynucleotide
taatacgactcactatagggtgtgaggctggaccggcggagaacgtggggaacagaggagaccccacatgctccgccggaacctggcggcagcgcaaaagatg

SEQ ID NO: 201260 - DNA, 103 bp, Artificial Sequence
  Synthetic Polynucleotide
taatacgactcactataggggtcactggtgtgtgaggctggaccggcggaaacagaggagatccgccatgccagcctcaaacctggcggcagcgcaaaagatg

SEQ ID NO: 201261 - DNA, 103 bp, Artificial Sequence
  Synthetic Polynucleotide
taatacgactcactatagggcaacgagattgtcactggtgtgtgaggctgaacagaggagacagcctatgacaccagtgaacctggcggcagcgcaaaagatg

SEQ ID NO: 201262 - DNA, 103 bp, Artificial Sequence
  Synthetic Polynucleotide
taatacgactcactataggggggccgttcccaacgagattgtcactggtgaacagaggagacaccagatgcaatctcgtaacctggcggcagcgcaaaagatg

SEQ ID NO: 201263 - DNA, 103 bp, Artificial Sequence
  Synthetic Polynucleotide
taatacgactcactatagggtgcaaggatggggccgttcccaacgagattaacagaggagaaatctcatggggaacggcaacctggcggcagcgcaaaagatg

SEQ ID NO: 201264 - DNA, 103 bp, Artificial Sequence
  Synthetic Polynucleotide
taatacgactcactatagggttgattgttctgcaaggatggggccgttccaacagaggagaggaacgatgccatccttgaacctggcggcagcgcaaaagatg

SEQ ID NO: 201265 - DNA, 103 bp, Artificial Sequence
  Synthetic Polynucleotide
taatacgactcactatagggactccacaggttgattgttctgcaaggatgaacagaggagacatcctatgagaacaatcaacctggcggcagcgcaaaagatg

SEQ ID NO: 201266 - DNA, 103 bp, Artificial Sequence
  Synthetic Polynucleotide
taatacgactcactataggggcaggggcaagcacccggtgctggtgaggaaacagaggagatcctcaatggcaccgggtaacctggcggcagcgcaaaagatg

SEQ ID NO: 201267 - DNA, 103 bp, Artificial Sequence
  Synthetic Polynucleotide
taatacgactcactataggggcatgattaaactccacaggttgattgttcaacagaggagagaacaaatgacctgtggaaacctggcggcagcgcaaaagatg

SEQ ID NO: 201268 - DNA, 103 bp, Artificial Sequence
  Synthetic Polynucleotide
taatacgactcactatagggatagttgatggcatgattaaactccacaggaacagaggagacctgtgatgtttaatcataacctggcggcagcgcaaaagatg

SEQ ID NO: 201269 - DNA, 103 bp, Artificial Sequence
  Synthetic Polynucleotide
taatacgactcactatagggtcttattaacatagttgatggcatgattaaaacagaggagattaatcatgccatcaactaacctggcggcagcgcaaaagatg

SEQ ID NO: 201270 - DNA, 103 bp, Artificial Sequence
  Synthetic Polynucleotide
taatacgactcactatagggctgttcttgatcttattaacatagttgatgaacagaggagacatcaaatgtgttaataaaacctggcggcagcgcaaaagatg

SEQ ID NO: 201271 - DNA, 103 bp, Artificial Sequence
  Synthetic Polynucleotide
taatacgactcactataggggccctgaaatctgttcttgatcttattaacaacagaggagagttaatatgatcaagaacaacctggcggcagcgcaaaagatg

SEQ ID NO: 201272 - DNA, 103 bp, Artificial Sequence
  Synthetic Polynucleotide
taatacgactcactatagggtgtctggttggccctgaaatctgttcttgaaacagaggagatcaagaatggatttcaggaacctggcggcagcgcaaaagatg

SEQ ID NO: 201273 - DNA, 103 bp, Artificial Sequence
  Synthetic Polynucleotide
taatacgactcactataggggctttgtagatgtctggttggccctgaaataacagaggagaatttcaatgccaaccagaaacctggcggcagcgcaaaagatg

SEQ ID NO: 201274 - DNA, 103 bp, Artificial Sequence
  Synthetic Polynucleotide
taatacgactcactatagggctccaggaatgctttgtagatgtctggttgaacagaggagacaaccaatgatctacaaaaacctggcggcagcgcaaaagatg

SEQ ID NO: 201275 - DNA, 103 bp, Artificial Sequence
  Synthetic Polynucleotide
taatacgactcactatagggtgtgcaaaatctccaggaatgctttgtagaaacagaggagatctacaatgcattcctggaacctggcggcagcgcaaaagatg

SEQ ID NO: 201276 - DNA, 103 bp, Artificial Sequence
  Synthetic Polynucleotide
taatacgactcactatagggttctgatatgtgtgcaaaatctccaggaataacagaggagaattcctatggattttgcaaacctggcggcagcgcaaaagatg

SEQ ID NO: 201277 - DNA, 103 bp, Artificial Sequence
  Synthetic Polynucleotide
taatacgactcactatagggctgaagggcgagggccgcctcgtccgccataacagaggagaatggcgatggaggcggccaacctggcggcagcgcaaaagatg

SEQ ID NO: 201278 - DNA, 103 bp, Artificial Sequence
  Synthetic Polynucleotide
taatacgactcactatagggatctctccgcggcctcttgcggagcggctcaacagaggagagagccgatgcgcaagaggaacctggcggcagcgcaaaagatg

SEQ ID NO: 201279 - DNA, 103 bp, Artificial Sequence
  Synthetic Polynucleotide
taatacgactcactatagggaagtagttttccttccttatctgacaaggcaacagaggagagccttgatggataaggaaaacctggcggcagcgcaaaagatg

SEQ ID NO: 201280 - DNA, 103 bp, Artificial Sequence
  Synthetic Polynucleotide
taatacgactcactatagggtatagttgcgaagtagttttccttccttataacagaggagaataaggatggaaaactacaacctggcggcagcgcaaaagatg

SEQ ID NO: 201281 - DNA, 103 bp, Artificial Sequence
  Synthetic Polynucleotide
taatacgactcactatagggatgttctgggtatagttgcgaagtagttttaacagaggagaaaaactatgtcgcaactaaacctggcggcagcgcaaaagatg

SEQ ID NO: 201282 - DNA, 103 bp, Artificial Sequence
  Synthetic Polynucleotide
taatacgactcactatagggcagcgtgtctatgttctgggtatagttgcgaacagaggagacgcaacatgacccagaacaacctggcggcagcgcaaaagatg

SEQ ID NO: 201283 - DNA, 103 bp, Artificial Sequence
  Synthetic Polynucleotide
taatacgactcactatagggcaacctgttccagcgtgtctatgttctgggaacagaggagacccagaatgtagacacgcaacctggcggcagcgcaaaagatg

SEQ ID NO: 201284 - DNA, 103 bp, Artificial Sequence
  Synthetic Polynucleotide
taatacgactcactatagggtggattcccgcaacctgttccagcgtgtctaacagaggagaagacacatgggaacaggtaacctggcggcagcgcaaaagatg

SEQ ID NO: 201285 - DNA, 103 bp, Artificial Sequence
  Synthetic Polynucleotide
taatacgactcactatagggaattatcctttggattcccgcaacctgttcaacagaggagagaacagatggcgggaatcaacctggcggcagcgcaaaagatg

SEQ ID NO: 201286 - DNA, 103 bp, Artificial Sequence
  Synthetic Polynucleotide
taatacgactcactatagggcatgacactgaattatcctttggattcccgaacagaggagacgggaaatgaaaggataaaacctggcggcagcgcaaaagatg

SEQ ID NO: 201287 - DNA, 103 bp, Artificial Sequence
  Synthetic Polynucleotide
taatacgactcactataggggcaaaggaaccatgacactgaattatccttaacagaggagaaaggatatgtcagtgtcaaacctggcggcagcgcaaaagatg

SEQ ID NO: 201288 - DNA, 103 bp, Artificial Sequence
  Synthetic Polynucleotide
taatacgactcactatagggagatgctgttgcaaaggaaccatgacactgaacagaggagacagtgtatgggttcctttaacctggcggcagcgcaaaagatg

SEQ ID NO: 201289 - DNA, 103 bp, Artificial Sequence
  Synthetic Polynucleotide
taatacgactcactatagggggccgggaccatctctccgcggcctcttgcaacagaggagagcaagaatgcgcggagagaacctggcggcagcgcaaaagatg

SEQ ID NO: 201290 - DNA, 103 bp, Artificial Sequence
  Synthetic Polynucleotide
taatacgactcactatagggaaatcaggcaagatgctgttgcaaaggaacaacagaggagagttcctatgcaacagcataacctggcggcagcgcaaaagatg

SEQ ID NO: 201291 - DNA, 103 bp, Artificial Sequence
  Synthetic Polynucleotide
taatacgactcactatagggttgtatttacaaatcaggcaagatgctgttaacagaggagaaacagcatgttgcctgataacctggcggcagcgcaaaagatg

SEQ ID NO: 201292 - DNA, 103 bp, Artificial Sequence
  Synthetic Polynucleotide
taatacgactcactatagggacagtcaactttgtatttacaaatcaggcaaacagaggagatgcctgatgtgtaaatacaacctggcggcagcgcaaaagatg

SEQ ID NO: 201293 - DNA, 103 bp, Artificial Sequence
  Synthetic Polynucleotide
taatacgactcactataggggtacagcttcacagtcaactttgtatttacaacagaggagagtaaatatgaagttgactaacctggcggcagcgcaaaagatg

SEQ ID NO: 201294 - DNA, 103 bp, Artificial Sequence
  Synthetic Polynucleotide
taatacgactcactatagggatatctcctcgtacagcttcacagtcaactaacagaggagaagttgaatgtgaagctgtaacctggcggcagcgcaaaagatg

SEQ ID NO: 201295 - DNA, 103 bp, Artificial Sequence
  Synthetic Polynucleotide
taatacgactcactatagggctgattaaaaatatctcctcgtacagcttcaacagaggagagaagctatgcgaggagataacctggcggcagcgcaaaagatg

SEQ ID NO: 201296 - DNA, 103 bp, Artificial Sequence
  Synthetic Polynucleotide
taatacgactcactataggggaggaactacctgattaaaaatatctcctcaacagaggagagaggagatgtttttaatcaacctggcggcagcgcaaaagatg

SEQ ID NO: 201297 - DNA, 103 bp, Artificial Sequence
  Synthetic Polynucleotide
taatacgactcactatagggctaggacatcgaggaactacctgattaaaaaacagaggagattttaaatgggtagttccaacctggcggcagcgcaaaagatg

SEQ ID NO: 201298 - DNA, 103 bp, Artificial Sequence
  Synthetic Polynucleotide
taatacgactcactatagggagctgggcacctaggacatcgaggaactacaacagaggagagtagttatgcgatgtcctaacctggcggcagcgcaaaagatg

SEQ ID NO: 201299 - DNA, 103 bp, Artificial Sequence
  Synthetic Polynucleotide
taatacgactcactataggggcggttcatcagctgggcacctaggacatcaacagaggagagatgtcatgggtgcccagaacctggcggcagcgcaaaagatg

SEQ ID NO: 201300 - DNA, 103 bp, Artificial Sequence
  Synthetic Polynucleotide
taatacgactcactatagggctccgctcgaggccgggaccatctctccgcaacagaggagagcggagatgtggtcccggaacctggcggcagcgcaaaagatg

SEQ ID NO: 201301 - DNA, 103 bp, Artificial Sequence
  Synthetic Polynucleotide
taatacgactcactatagggatgatagcaagcggttcatcagctgggcacaacagaggagagtgcccatgtgatgaaccaacctggcggcagcgcaaaagatg

SEQ ID NO: 201302 - DNA, 103 bp, Artificial Sequence
  Synthetic Polynucleotide
taatacgactcactatagggctctggtttcatgatagcaagcggttcatcaacagaggagagatgaaatgcttgctatcaacctggcggcagcgcaaaagatg

SEQ ID NO: 201303 - DNA, 103 bp, Artificial Sequence
  Synthetic Polynucleotide
taatacgactcactatagggaaaacacaatctctggtttcatgatagcaaaacagaggagattgctaatgtgaaaccagaacctggcggcagcgcaaaagatg

SEQ ID NO: 201304 - DNA, 103 bp, Artificial Sequence
  Synthetic Polynucleotide
taatacgactcactatagggttttcaccaaaaaacacaatctctggtttcaacagaggagagaaaccatggattgtgttaacctggcggcagcgcaaaagatg

SEQ ID NO: 201305 - DNA, 103 bp, Artificial Sequence
  Synthetic Polynucleotide
taatacgactcactatagggttctggtaaattttcaccaaaaaacacaataacagaggagaattgtgatgtttggtgaaaacctggcggcagcgcaaaagatg

SEQ ID NO: 201306 - DNA, 103 bp, Artificial Sequence
  Synthetic Polynucleotide
taatacgactcactatagggtatgaaactgttctggtaaattttcaccaaaacagaggagattggtgatgatttaccagaacctggcggcagcgcaaaagatg

SEQ ID NO: 201307 - DNA, 103 bp, Artificial Sequence
  Synthetic Polynucleotide
taatacgactcactatagggttcatggctctatgaaactgttctggtaaaaacagaggagatttaccatgacagtttcaaacctggcggcagcgcaaaagatg

SEQ ID NO: 201308 - DNA, 103 bp, Artificial Sequence
  Synthetic Polynucleotide
taatacgactcactatagggtttgtcatacttcatggctctatgaaactgaacagaggagacagtttatgagagccatgaacctggcggcagcgcaaaagatg

SEQ ID NO: 201309 - DNA, 103 bp, Artificial Sequence
  Synthetic Polynucleotide
taatacgactcactatagggcaacttcatctttgtcatacttcatggctcaacagaggagagagccaatgagtatgacaaacctggcggcagcgcaaaagatg

SEQ ID NO: 201310 - DNA, 103 bp, Artificial Sequence
  Synthetic Polynucleotide
taatacgactcactatagggatgaggaggtcaacttcatctttgtcatacaacagaggagagtatgaatgagatgaagtaacctggcggcagcgcaaaagatg

SEQ ID NO: 201311 - DNA, 103 bp, Artificial Sequence
  Synthetic Polynucleotide
taatacgactcactatagggctcgcccgggctccgctcgaggccgggaccaacagaggagaggtcccatgctcgagcggaacctggcggcagcgcaaaagatg

SEQ ID NO: 201312 - DNA, 103 bp, Artificial Sequence
  Synthetic Polynucleotide
taatacgactcactatagggcccaataacaatgaggaggtcaacttcatcaacagaggagagatgaaatggacctcctcaacctggcggcagcgcaaaagatg

SEQ ID NO: 201313 - DNA, 103 bp, Artificial Sequence
  Synthetic Polynucleotide
taatacgactcactatagggtgagggaagacccaataacaatgaggaggtaacagaggagaacctccatgttgttattgaacctggcggcagcgcaaaagatg

SEQ ID NO: 201314 - DNA, 103 bp, Artificial Sequence
  Synthetic Polynucleotide
taatacgactcactatagggggtcttactttgagggaagacccaataacaaacagaggagatgttatatggtcttccctaacctggcggcagcgcaaaagatg

SEQ ID NO: 201315 - DNA, 103 bp, Artificial Sequence
  Synthetic Polynucleotide
taatacgactcactatagggtagtgctactggtcttactttgagggaagaaacagaggagatcttccatgaaagtaagaaacctggcggcagcgcaaaagatg

SEQ ID NO: 201316 - DNA, 103 bp, Artificial Sequence
  Synthetic Polynucleotide
taatacgactcactatagggaacttggaattagtgctactggtcttacttaacagaggagaaagtaaatgcagtagcacaacctggcggcagcgcaaaagatg

SEQ ID NO: 201317 - DNA, 103 bp, Artificial Sequence
  Synthetic Polynucleotide
taatacgactcactatagggtggggtatggaacttggaattagtgctactaacagaggagaagtagcatgaattccaagaacctggcggcagcgcaaaagatg

SEQ ID NO: 201318 - DNA, 103 bp, Artificial Sequence
  Synthetic Polynucleotide
taatacgactcactatagggaggcacttcatggggtatggaacttggaataacagaggagaattccaatgtccatacccaacctggcggcagcgcaaaagatg

SEQ ID NO: 201319 - DNA, 103 bp, Artificial Sequence
  Synthetic Polynucleotide
taatacgactcactatagggttaatatctgaggcacttcatggggtatggaacagaggagaccatacatgatgaagtgcaacctggcggcagcgcaaaagatg

SEQ ID NO: 201320 - DNA, 103 bp, Artificial Sequence
  Synthetic Polynucleotide
taatacgactcactatagggtctctattaattaatatctgaggcacttcaaacagaggagatgaagtatgtcagatattaacctggcggcagcgcaaaagatg

SEQ ID NO: 201321 - DNA, 103 bp, Artificial Sequence
  Synthetic Polynucleotide
taatacgactcactatagggaggcaaaggttctctattaattaatatctgaacagaggagacagataatgattaatagaaacctggcggcagcgcaaaagatg

SEQ ID NO: 201322 - DNA, 103 bp, Artificial Sequence
  Synthetic Polynucleotide
taatacgactcactatagggccccaccgggctcgcccgggctccgctcgaaacagaggagatcgagcatggcccgggcgaacctggcggcagcgcaaaagatg

SEQ ID NO: 201323 - DNA, 103 bp, Artificial Sequence
  Synthetic Polynucleotide
taatacgactcactatagggaatgcagatgaggcaaaggttctctattaaaacagaggagattaataatgaacctttgcaacctggcggcagcgcaaaagatg

SEQ ID NO: 201324 - DNA, 103 bp, Artificial Sequence
  Synthetic Polynucleotide
taatacgactcactatagggtctacatcaaaatgcagatgaggcaaaggtaacagaggagaacctttatgtcatctgcaaacctggcggcagcgcaaaagatg

SEQ ID NO: 201325 - DNA, 103 bp, Artificial Sequence
  Synthetic Polynucleotide
taatacgactcactatagggtccaagaagctctacatcaaaatgcagatgaacagaggagacatctgatgtttgatgtaaacctggcggcagcgcaaaagatg

SEQ ID NO: 201326 - DNA, 103 bp, Artificial Sequence
  Synthetic Polynucleotide
taatacgactcactatagggcatcacagtctccaagaagctctacatcaaaacagaggagattgatgatgagcttcttgaacctggcggcagcgcaaaagatg

SEQ ID NO: 201327 - DNA, 103 bp, Artificial Sequence
  Synthetic Polynucleotide
taatacgactcactatagggttaattatgacatcacagtctccaagaagcaacagaggagagcttctatgagactgtgaaacctggcggcagcgcaaaagatg

SEQ ID NO: 201328 - DNA, 103 bp, Artificial Sequence
  Synthetic Polynucleotide
taatacgactcactatagggacacaattcattaattatgacatcacagtcaacagaggagagactgtatggtcataattaacctggcggcagcgcaaaagatg

SEQ ID NO: 201329 - DNA, 103 bp, Artificial Sequence
  Synthetic Polynucleotide
taatacgactcactatagggctaacctatgacacaattcattaattatgaaacagaggagatcataaatgatgaattgtaacctggcggcagcgcaaaagatg

SEQ ID NO: 201330 - DNA, 103 bp, Artificial Sequence
  Synthetic Polynucleotide
taatacgactcactatagggtattcaccacctaacctatgacacaattcaaacagaggagatgaattatgtcataggttaacctggcggcagcgcaaaagatg

SEQ ID NO: 201331 - DNA, 103 bp, Artificial Sequence
  Synthetic Polynucleotide
taatacgactcactatagggaagtttggcatattcaccacctaacctatgaacagaggagacataggatgggtggtgaaaacctggcggcagcgcaaaagatg

SEQ ID NO: 201332 - DNA, 103 bp, Artificial Sequence
  Synthetic Polynucleotide
taatacgactcactatagggggttacagcaaagtttggcatattcaccacaacagaggagagtggtgatgatgccaaacaacctggcggcagcgcaaaagatg

SEQ ID NO: 201333 - DNA, 103 bp, Artificial Sequence
  Synthetic Polynucleotide
taatacgactcactatagggtctggggccgccccaccgggctcgcccgggaacagaggagacccgggatggcccggtggaacctggcggcagcgcaaaagatg

SEQ ID NO: 201334 - DNA, 103 bp, Artificial Sequence
  Synthetic Polynucleotide
taatacgactcactatagggagctttacagggttacagcaaagtttggcaaacagaggagatgccaaatgttgctgtaaaacctggcggcagcgcaaaagatg

SEQ ID NO: 201335 - DNA, 103 bp, Artificial Sequence
  Synthetic Polynucleotide
taatacgactcactatagggaatttctgaaagctttacagggttacagcaaacagaggagatgctgtatgcctgtaaagaacctggcggcagcgcaaaagatg

SEQ ID NO: 201336 - DNA, 103 bp, Artificial Sequence
  Synthetic Polynucleotide
taatacgactcactataggggtttttcagtaatttctgaaagctttacagaacagaggagactgtaaatgtttcagaaaaacctggcggcagcgcaaaagatg

SEQ ID NO: 201337 - DNA, 103 bp, Artificial Sequence
  Synthetic Polynucleotide
taatacgactcactataggggttcgtggaggtttttcagtaatttctgaaaacagaggagattcagaatgtactgaaaaaacctggcggcagcgcaaaagatg

SEQ ID NO: 201338 - DNA, 103 bp, Artificial Sequence
  Synthetic Polynucleotide
taatacgactcactatagggttctttttgtgttcgtggaggtttttcagtaacagaggagaactgaaatgcctccacgaaacctggcggcagcgcaaaagatg

SEQ ID NO: 201339 - DNA, 103 bp, Artificial Sequence
  Synthetic Polynucleotide
taatacgactcactatagggaataagccaattctttttgtgttcgtggagaacagaggagactccacatgcacaaaaagaacctggcggcagcgcaaaagatg

SEQ ID NO: 201340 - DNA, 103 bp, Artificial Sequence
  Synthetic Polynucleotide
taatacgactcactatagggaactctgacaaataagccaattctttttgtaacagaggagaacaaaaatgattggcttaaacctggcggcagcgcaaaagatg

SEQ ID NO: 201341 - DNA, 103 bp, Artificial Sequence
  Synthetic Polynucleotide
taatacgactcactatagggtgtgggtggcaactctgacaaataagccaaaacagaggagattggctatgttgtcagagaacctggcggcagcgcaaaagatg

SEQ ID NO: 201342 - DNA, 103 bp, Artificial Sequence
  Synthetic Polynucleotide
taatacgactcactatagggcatgaagaggtgtgggtggcaactctgacaaacagaggagatgtcagatgtgccacccaaacctggcggcagcgcaaaagatg

SEQ ID NO: 201343 - DNA, 103 bp, Artificial Sequence
  Synthetic Polynucleotide
taatacgactcactatagggtcttctgaaacatgaagaggtgtgggtggcaacagaggagagccaccatgacctcttcaaacctggcggcagcgcaaaagatg

SEQ ID NO: 201344 - DNA, 103 bp, Artificial Sequence
  Synthetic Polynucleotide
taatacgactcactatagggcacctcacgctctggggccgccccaccgggaacagaggagacccggtatggcggccccaaacctggcggcagcgcaaaagatg

SEQ ID NO: 201345 - DNA, 103 bp, Artificial Sequence
  Synthetic Polynucleotide
taatacgactcactatagggtgaacttgagtcttctgaaacatgaagaggaacagaggagacctcttatggtttcagaaaacctggcggcagcgcaaaagatg

SEQ ID NO: 201346 - DNA, 103 bp, Artificial Sequence
  Synthetic Polynucleotide
taatacgactcactatagggttctttctggtgaacttgagtcttctgaaaaacagaggagatttcagatgactcaagttaacctggcggcagcgcaaaagatg

SEQ ID NO: 201347 - DNA, 103 bp, Artificial Sequence
  Synthetic Polynucleotide
taatacgactcactatagggggtggtgaagttctttctggtgaacttgagaacagaggagactcaagatgaccagaaagaacctggcggcagcgcaaaagatg

SEQ ID NO: 201348 - DNA, 103 bp, Artificial Sequence
  Synthetic Polynucleotide
taatacgactcactatagggtgaagaatctggtggtgaagttctttctggaacagaggagaccagaaatgacttcaccaaacctggcggcagcgcaaaagatg

SEQ ID NO: 201349 - DNA, 103 bp, Artificial Sequence
  Synthetic Polynucleotide
taatacgactcactatagggtgacaatcactgaagaatctggtggtgaagaacagaggagacttcacatgcagattcttaacctggcggcagcgcaaaagatg

SEQ ID NO: 201350 - DNA, 103 bp, Artificial Sequence
  Synthetic Polynucleotide
taatacgactcactatagggtctaaaagtgtgacaatcactgaagaatctaacagaggagaagattcatgagtgattgtaacctggcggcagcgcaaaagatg

SEQ ID NO: 201351 - DNA, 103 bp, Artificial Sequence
  Synthetic Polynucleotide
taatacgactcactatagggagctgcttggtctaaaagtgtgacaatcacaacagaggagagtgattatgacacttttaaacctggcggcagcgcaaaagatg

SEQ ID NO: 201352 - DNA, 103 bp, Artificial Sequence
  Synthetic Polynucleotide
taatacgactcactatagggcattactcttagctgcttggtctaaaagtgaacagaggagacactttatgaccaagcagaacctggcggcagcgcaaaagatg

SEQ ID NO: 201353 - DNA, 103 bp, Artificial Sequence
  Synthetic Polynucleotide
taatacgactcactatagggtctaaatcatcattactcttagctgcttggaacagaggagaccaagcatgtaagagtaaaacctggcggcagcgcaaaagatg

SEQ ID NO: 201354 - DNA, 103 bp, Artificial Sequence
  Synthetic Polynucleotide
taatacgactcactatagggttcagacacatctaaatcatcattactcttaacagaggagaaagagtatggatgatttaaacctggcggcagcgcaaaagatg

SEQ ID NO: 201355 - DNA, 103 bp, Artificial Sequence
  Synthetic Polynucleotide
taatacgactcactatagggccgccgccggcacctcacgctctggggccgaacagaggagacggcccatgagcgtgaggaacctggcggcagcgcaaaagatg

SEQ ID NO: 201356 - DNA, 103 bp, Artificial Sequence
  Synthetic Polynucleotide
taatacgactcactatagggaaccttttgattcagacacatctaaatcataacagaggagaatgattatgatgtgtctgaacctggcggcagcgcaaaagatg

SEQ ID NO: 201357 - DNA, 103 bp, Artificial Sequence
  Synthetic Polynucleotide
taatacgactcactatagggtcttccatacaaccttttgattcagacacaaacagaggagatgtgtcatgatcaaaaggaacctggcggcagcgcaaaagatg

SEQ ID NO: 201358 - DNA, 103 bp, Artificial Sequence
  Synthetic Polynucleotide
taatacgactcactatagggctgtggtttttcttccatacaaccttttgaaacagaggagatcaaaaatgtgtatggaaaacctggcggcagcgcaaaagatg

SEQ ID NO: 201359 - DNA, 103 bp, Artificial Sequence
  Synthetic Polynucleotide
taatacgactcactatagggtttgtacttcctgtggtttttcttccatacaacagaggagagtatggatgaaaaaccacaacctggcggcagcgcaaaagatg

SEQ ID NO: 201360 - DNA, 103 bp, Artificial Sequence
  Synthetic Polynucleotide
taatacgactcactatagggttcctagaagtttgtacttcctgtggttttaacagaggagaaaaaccatgggaagtacaaacctggcggcagcgcaaaagatg

SEQ ID NO: 201361 - DNA, 103 bp, Artificial Sequence
  Synthetic Polynucleotide
taatacgactcactatagggactttcaacattcctagaagtttgtacttcaacagaggagagaagtaatgacttctaggaacctggcggcagcgcaaaagatg

SEQ ID NO: 201362 - DNA, 103 bp, Artificial Sequence
  Synthetic Polynucleotide
taatacgactcactataggggttcagcaatactttcaacattcctagaagaacagaggagacttctaatgatgttgaaaaacctggcggcagcgcaaaagatg

SEQ ID NO: 201363 - DNA, 103 bp, Artificial Sequence
  Synthetic Polynucleotide
taatacgactcactatagggttttccatctgttcagcaatactttcaacaaacagaggagatgttgaatgtattgctgaaacctggcggcagcgcaaaagatg

SEQ ID NO: 201364 - DNA, 103 bp, Artificial Sequence
  Synthetic Polynucleotide
taatacgactcactatagggcaaatccggattttccatctgttcagcaataacagaggagaattgctatgcagatggaaaacctggcggcagcgcaaaagatg

SEQ ID NO: 201365 - DNA, 103 bp, Artificial Sequence
  Synthetic Polynucleotide
taatacgactcactatagggcaacattcttcaaatccggattttccatctaacagaggagaagatggatgatccggattaacctggcggcagcgcaaaagatg

SEQ ID NO: 201366 - DNA, 103 bp, Artificial Sequence
  Synthetic Polynucleotide
taatacgactcactatagggcagcccctggccgccgccggcacctcacgcaacagaggagagcgtgaatggccggcggcaacctggcggcagcgcaaaagatg

SEQ ID NO: 201367 - DNA, 103 bp, Artificial Sequence
  Synthetic Polynucleotide
taatacgactcactataggggtactagaaccaacattcttcaaatccggaaacagaggagatccggaatggaagaatgtaacctggcggcagcgcaaaagatg

SEQ ID NO: 201368 - DNA, 103 bp, Artificial Sequence
  Synthetic Polynucleotide
taatacgactcactatagggtttctccccagtactagaaccaacattcttaacagaggagaaagaatatgggttctagtaacctggcggcagcgcaaaagatg

SEQ ID NO: 201369 - DNA, 103 bp, Artificial Sequence
  Synthetic Polynucleotide
taatacgactcactatagggttctttcatttttctccccagtactagaacaacagaggagagttctaatgctggggagaaacctggcggcagcgcaaaagatg

SEQ ID NO: 201370 - DNA, 103 bp, Artificial Sequence
  Synthetic Polynucleotide
taatacgactcactataggggccactgaagttctttcatttttctccccaaacagaggagatggggaatgaaatgaaagaacctggcggcagcgcaaaagatg

SEQ ID NO: 201371 - DNA, 103 bp, Artificial Sequence
  Synthetic Polynucleotide
taatacgactcactatagggcactgttccagccactgaagttctttcattaacagaggagaaatgaaatgacttcagtgaacctggcggcagcgcaaaagatg

SEQ ID NO: 201372 - DNA, 103 bp, Artificial Sequence
  Synthetic Polynucleotide
taatacgactcactatagggagcattttctcactgttccagccactgaagaacagaggagacttcagatgctggaacagaacctggcggcagcgcaaaagatg

SEQ ID NO: 201373 - DNA, 103 bp, Artificial Sequence
  Synthetic Polynucleotide
taatacgactcactatagggctattaggccagcattttctcactgttccaaacagaggagatggaacatggagaaaatgaacctggcggcagcgcaaaagatg

SEQ ID NO: 201374 - DNA, 103 bp, Artificial Sequence
  Synthetic Polynucleotide
taatacgactcactatagggctttgccactctattaggccagcattttctaacagaggagaagaaaaatgtggcctaataacctggcggcagcgcaaaagatg

SEQ ID NO: 201375 - DNA, 103 bp, Artificial Sequence
  Synthetic Polynucleotide
taatacgactcactatagggtaatctgctcctttgccactctattaggccaacagaggagaggcctaatggagtggcaaaacctggcggcagcgcaaaagatg

SEQ ID NO: 201376 - DNA, 103 bp, Artificial Sequence
  Synthetic Polynucleotide
taatacgactcactatagggagccgcctactaatctgctcctttgccactaacagaggagaagtggcatgggagcagataacctggcggcagcgcaaaagatg

SEQ ID NO: 201377 - DNA, 103 bp, Artificial Sequence
  Synthetic Polynucleotide
taatacgactcactatagggcgcacccgggcagcccctggccgccgccggaacagaggagaccggcgatggccaggggcaacctggcggcagcgcaaaagatg

SEQ ID NO: 201378 - DNA, 103 bp, Artificial Sequence
  Synthetic Polynucleotide
taatacgactcactatagggattaccatcaagccgcctactaatctgctcaacagaggagagagcagatgagtaggcggaacctggcggcagcgcaaaagatg

SEQ ID NO: 201379 - DNA, 103 bp, Artificial Sequence
  Synthetic Polynucleotide
taatacgactcactatagggacagatactgattaccatcaagccgcctacaacagaggagagtaggcatgttgatggtaaacctggcggcagcgcaaaagatg

SEQ ID NO: 201380 - DNA, 103 bp, Artificial Sequence
  Synthetic Polynucleotide
taatacgactcactatagggggtggcaaaaacagatactgattaccatcaaacagaggagatgatggatgtcagtatctaacctggcggcagcgcaaaagatg

SEQ ID NO: 201381 - DNA, 103 bp, Artificial Sequence
  Synthetic Polynucleotide
taatacgactcactataggggtaacgatttggtggcaaaaacagatactgaacagaggagacagtatatgtttttgccaaacctggcggcagcgcaaaagatg

SEQ ID NO: 201382 - DNA, 103 bp, Artificial Sequence
  Synthetic Polynucleotide
taatacgactcactatagggcatggaaaatgtaacgatttggtggcaaaaaacagaggagattttgcatgcaaatcgttaacctggcggcagcgcaaaagatg

SEQ ID NO: 201383 - DNA, 103 bp, Artificial Sequence
  Synthetic Polynucleotide
taatacgactcactatagggacctcagcgccatggaaaatgtaacgatttaacagaggagaaaatcgatgcattttccaaacctggcggcagcgcaaaagatg

SEQ ID NO: 201384 - DNA, 103 bp, Artificial Sequence
  Synthetic Polynucleotide
taatacgactcactataggggtctgaatatacctcagcgccatggaaaataacagaggagaattttcatgggcgctgagaacctggcggcagcgcaaaagatg

SEQ ID NO: 201385 - DNA, 103 bp, Artificial Sequence
  Synthetic Polynucleotide
taatacgactcactatagggcatcttcagagtctgaatatacctcagcgcaacagaggagagcgctgatgtatattcagaacctggcggcagcgcaaaagatg

SEQ ID NO: 201386 - DNA, 103 bp, Artificial Sequence
  Synthetic Polynucleotide
taatacgactcactataggggataagacgtcatcttcagagtctgaatataacagaggagaatattcatgctctgaagaaacctggcggcagcgcaaaagatg

SEQ ID NO: 201387 - DNA, 103 bp, Artificial Sequence
  Synthetic Polynucleotide
taatacgactcactatagggagaactagaggataagacgtcatcttcagaaacagaggagatctgaaatggacgtcttaaacctggcggcagcgcaaaagatg

SEQ ID NO: 201388 - DNA, 103 bp, Artificial Sequence
  Synthetic Polynucleotide
taatacgactcactatagggagccgccgggctgaagggcgagggccgcctaacagaggagaaggcggatgtcgcccttcaacctggcggcagcgcaaaagatg

SEQ ID NO: 201389 - DNA, 103 bp, Artificial Sequence
  Synthetic Polynucleotide
taatacgactcactatagggccgccgccgccgcacccgggcagcccctggaacagaggagaccagggatggcccgggtgaacctggcggcagcgcaaaagatg

SEQ ID NO: 201390 - DNA, 103 bp, Artificial Sequence
  Synthetic Polynucleotide
taatacgactcactatagggtactgccacaagaactagaggataagacgtaacagaggagaacgtctatgcctctagttaacctggcggcagcgcaaaagatg

SEQ ID NO: 201391 - DNA, 103 bp, Artificial Sequence
  Synthetic Polynucleotide
taatacgactcactatagggctatcactgttactgccacaagaactagagaacagaggagactctagatgttgtggcagaacctggcggcagcgcaaaagatg

SEQ ID NO: 201392 - DNA, 103 bp, Artificial Sequence
  Synthetic Polynucleotide
taatacgactcactataggggcatgtcccactatcactgttactgccacaaacagaggagatgtggcatgaacagtgataacctggcggcagcgcaaaagatg

SEQ ID NO: 201393 - DNA, 103 bp, Artificial Sequence
  Synthetic Polynucleotide
taatacgactcactatagggttggactctggcatgtcccactatcactgtaacagaggagaacagtgatggtgggacataacctggcggcagcgcaaaagatg

SEQ ID NO: 201394 - DNA, 103 bp, Artificial Sequence
  Synthetic Polynucleotide
taatacgactcactatagggtcttctaaacttggactctggcatgtcccaaacagaggagatgggacatgccagagtccaacctggcggcagcgcaaaagatg

SEQ ID NO: 201395 - DNA, 103 bp, Artificial Sequence
  Synthetic Polynucleotide
taatacgactcactatagggctccatgggttcttctaaacttggactctgaacagaggagacagagtatgagtttagaaaacctggcggcagcgcaaaagatg

SEQ ID NO: 201396 - DNA, 103 bp, Artificial Sequence
  Synthetic Polynucleotide
taatacgactcactatagggcactttcatcctccatgggttcttctaaacaacagaggagagtttagatgaacccatggaacctggcggcagcgcaaaagatg

SEQ ID NO: 201397 - DNA, 103 bp, Artificial Sequence
  Synthetic Polynucleotide
taatacgactcactatagggtcttcaatttcactttcatcctccatgggtaacagaggagaacccatatgggatgaaagaacctggcggcagcgcaaaagatg

SEQ ID NO: 201398 - DNA, 103 bp, Artificial Sequence
  Synthetic Polynucleotide
taatacgactcactatagggattgtagaattcttcaatttcactttcatcaacagaggagagatgaaatggaaattgaaaacctggcggcagcgcaaaagatg

SEQ ID NO: 201399 - DNA, 103 bp, Artificial Sequence
  Synthetic Polynucleotide
taatacgactcactatagggcttctaagccattgtagaattcttcaatttaacagaggagaaaattgatgaattctacaaacctggcggcagcgcaaaagatg

SEQ ID NO: 201400 - DNA, 103 bp, Artificial Sequence
  Synthetic Polynucleotide
taatacgactcactatagggcgccacagcgccgccgccgccgcacccgggaacagaggagacccgggatgggcggcggcaacctggcggcagcgcaaaagatg

SEQ ID NO: 201401 - DNA, 103 bp, Artificial Sequence
  Synthetic Polynucleotide
taatacgactcactatagggtcaggctcatcttctaagccattgtagaataacagaggagaattctaatgtggcttagaaacctggcggcagcgcaaaagatg

SEQ ID NO: 201402 - DNA, 103 bp, Artificial Sequence
  Synthetic Polynucleotide
taatacgactcactatagggctctggaacatcaggctcatcttctaagccaacagaggagaggcttaatggatgagcctaacctggcggcagcgcaaaagatg

SEQ ID NO: 201403 - DNA, 103 bp, Artificial Sequence
  Synthetic Polynucleotide
taatacgactcactatagggctccagctctctctggaacatcaggctcataacagaggagaatgagcatgatgttccagaacctggcggcagcgcaaaagatg

SEQ ID NO: 201404 - DNA, 103 bp, Artificial Sequence
  Synthetic Polynucleotide
taatacgactcactatagggaatccagctcctccagctctctctggaacaaacagaggagatgttccatggagagctggaacctggcggcagcgcaaaagatg

SEQ ID NO: 201405 - DNA, 103 bp, Artificial Sequence
  Synthetic Polynucleotide
taatacgactcactatagggatcagtcccaaatccagctcctccagctctaacagaggagaagagctatgggagctggaaacctggcggcagcgcaaaagatg

SEQ ID NO: 201406 - DNA, 103 bp, Artificial Sequence
  Synthetic Polynucleotide
taatacgactcactataggggatcatctccatcagtcccaaatccagctcaacagaggagagagctgatgttgggactgaacctggcggcagcgcaaaagatg

SEQ ID NO: 201407 - DNA, 103 bp, Artificial Sequence
  Synthetic Polynucleotide
taatacgactcactatagggattgcctcttgatcatctccatcagtcccaaacagaggagatgggacatgtggagatgaaacctggcggcagcgcaaaagatg

SEQ ID NO: 201408 - DNA, 103 bp, Artificial Sequence
  Synthetic Polynucleotide
taatacgactcactatagggagcttcattaattgcctcttgatcatctccaacagaggagaggagatatgcaagaggcaaacctggcggcagcgcaaaagatg

SEQ ID NO: 201409 - DNA, 103 bp, Artificial Sequence
  Synthetic Polynucleotide
taatacgactcactatagggtcacagatatagcttcattaattgcctcttaacagaggagaaagaggatgttaatgaagaacctggcggcagcgcaaaagatg

SEQ ID NO: 201410 - DNA, 103 bp, Artificial Sequence
  Synthetic Polynucleotide
taatacgactcactatagggacttcctgtttcacagatatagcttcattaaacagaggagataatgaatgtatatctgtaacctggcggcagcgcaaaagatg

SEQ ID NO: 201411 - DNA, 103 bp, Artificial Sequence
  Synthetic Polynucleotide
taatacgactcactatagggctccgcctcccgccacagcgccgccgccgcaacagaggagagcggcgatggcgctgtggaacctggcggcagcgcaaaagatg

SEQ ID NO: 201412 - DNA, 103 bp, Artificial Sequence
  Synthetic Polynucleotide
taatacgactcactatagggcatgtctgttacttcctgtttcacagatataacagaggagaatatctatgaaacaggaaaacctggcggcagcgcaaaagatg

SEQ ID NO: 201413 - DNA, 103 bp, Artificial Sequence
  Synthetic Polynucleotide
taatacgactcactatagggatggatagttcatgtctgttacttcctgttaacagaggagaaacaggatgtaacagacaaacctggcggcagcgcaaaagatg

SEQ ID NO: 201414 - DNA, 103 bp, Artificial Sequence
  Synthetic Polynucleotide
taatacgactcactataggggatttgtttgatggatagttcatgtctgttaacagaggagaaacagaatggaactatccaacctggcggcagcgcaaaagatg

SEQ ID NO: 201415 - DNA, 103 bp, Artificial Sequence
  Synthetic Polynucleotide
taatacgactcactatagggccgcctctgcctccgcctcccgccacagcgaacagaggagacgctgtatggggaggcggaacctggcggcagcgcaaaagatg

SEQ ID NO: 201416 - DNA, 103 bp, Artificial Sequence
  Synthetic Polynucleotide
taatacgactcactatagggcctgccgccgccgcctctgcctccgcctccaacagaggagaggaggcatgggcagaggcaacctggcggcagcgcaaaagatg

SEQ ID NO: 201417 - DNA, 103 bp, Artificial Sequence
  Synthetic Polynucleotide
taatacgactcactatagggttgctccccgcctgccgccgccgcctctgcaacagaggagagcagagatggcggcggcaaacctggcggcagcgcaaaagatg

SEQ ID NO: 201418 - DNA, 103 bp, Artificial Sequence
  Synthetic Polynucleotide
taatacgactcactatagggcctgggcctcttgctccccgcctgccgccgaacagaggagacggcggatggcggggagcaacctggcggcagcgcaaaagatg

SEQ ID NO: 201419 - DNA, 103 bp, Artificial Sequence
  Synthetic Polynucleotide
taatacgactcactataggggccgcagtcgcctgggcctcttgctccccgaacagaggagacggggaatgagaggcccaaacctggcggcagcgcaaaagatg

SEQ ID NO: 201420 - DNA, 103 bp, Artificial Sequence
  Synthetic Polynucleotide
taatacgactcactatagggttccccagccgccgcagtcgcctgggcctcaacagaggagagaggccatggcgactgcgaacctggcggcagcgcaaaagatg

SEQ ID NO: 201421 - DNA, 103 bp, Artificial Sequence
  Synthetic Polynucleotide
taatacgactcactatagggcattgtctccttccccagccgccgcagtcgaacagaggagacgactgatgcggctggggaacctggcggcagcgcaaaagatg

SEQ ID NO: 201422 - DNA, 103 bp, Artificial Sequence
  Synthetic Polynucleotide
taatacgactcactataggggccgagggggagccgccgggctgaagggcgaacagaggagacgccctatggcccggcggaacctggcggcagcgcaaaagatg

SEQ ID NO: 201423 - DNA, 103 bp, Artificial Sequence
  Synthetic Polynucleotide
taatacgactcactatagggaggcccggcccattgtctccttccccagccaacagaggagaggctggatgaggagacaaaacctggcggcagcgcaaaagatg

SEQ ID NO: 201424 - DNA, 103 bp, Artificial Sequence
  Synthetic Polynucleotide
taatacgactcactatagggtgggccctgcaggcccggcccattgtctccaacagaggagaggagacatggggccgggcaacctggcggcagcgcaaaagatg

SEQ ID NO: 201425 - DNA, 103 bp, Artificial Sequence
  Synthetic Polynucleotide
taatacgactcactataggggctcccgagatgggccctgcaggcccggccaacagaggagaggccggatgtgcagggccaacctggcggcagcgcaaaagatg

SEQ ID NO: 201426 - DNA, 103 bp, Artificial Sequence
  Synthetic Polynucleotide
taatacgactcactataggggccagcggtggctcccgagatgggccctgcaacagaggagagcagggatgatctcgggaaacctggcggcagcgcaaaagatg

SEQ ID NO: 201427 - DNA, 103 bp, Artificial Sequence
  Synthetic Polynucleotide
taatacgactcactatagggcaagttgtcggccagcggtggctcccgagaaacagaggagatctcggatgccaccgctgaacctggcggcagcgcaaaagatg

SEQ ID NO: 201428 - DNA, 103 bp, Artificial Sequence
  Synthetic Polynucleotide
taatacgactcactatagggcttcgtcgtacaagttgtcggccagcggtgaacagaggagacaccgcatgccgacaactaacctggcggcagcgcaaaagatg

SEQ ID NO: 201429 - DNA, 103 bp, Artificial Sequence
  Synthetic Polynucleotide
taatacgactcactatagggtcgtcgtcgtcttcgtcgtacaagttgtcgaacagaggagacgacaaatggtacgacgaaacctggcggcagcgcaaaagatg

SEQ ID NO: 201430 - DNA, 103 bp, Artificial Sequence
  Synthetic Polynucleotide
taatacgactcactatagggctcgccctcgtcgtcgtcgtcttcgtcgtaaacagaggagatacgacatggacgacgacaacctggcggcagcgcaaaagatg

SEQ ID NO: 201431 - DNA, 103 bp, Artificial Sequence
  Synthetic Polynucleotide
taatacgactcactatagggcttcctcctcctcgccctcgtcgtcgtcgtaacagaggagaacgacgatgacgagggcgaacctggcggcagcgcaaaagatg

SEQ ID NO: 201432 - DNA, 103 bp, Artificial Sequence
  Synthetic Polynucleotide
taatacgactcactataggggccgccgcctcttcctcctcctcgccctcgaacagaggagacgagggatgggaggaggaaacctggcggcagcgcaaaagatg

SEQ ID NO: 201433 - DNA, 103 bp, Artificial Sequence
  Synthetic Polynucleotide
taatacgactcactatagggggcccccgccgccgagggggagccgccgggaacagaggagacccggcatgtccccctcgaacctggcggcagcgcaaaagatg

SEQ ID NO: 201434 - DNA, 103 bp, Artificial Sequence
  Synthetic Polynucleotide
taatacgactcactatagggaatcgccgccgccgccgcctcttcctcctcaacagaggagagaggagatggaggcggcgaacctggcggcagcgcaaaagatg

SEQ ID NO: 201435 - DNA, 103 bp, Artificial Sequence
  Synthetic Polynucleotide
taatacgactcactatagggctcggtacccaatcgccgccgccgccgcctaacagaggagaaggcggatgcggcggcgaaacctggcggcagcgcaaaagatg

SEQ ID NO: 201436 - DNA, 103 bp, Artificial Sequence
  Synthetic Polynucleotide
taatacgactcactatagggagaaggttatctcggtacccaatcgccgccaacagaggagaggcggcatgtgggtaccgaacctggcggcagcgcaaaagatg

SEQ ID NO: 201437 - DNA, 103 bp, Artificial Sequence
  Synthetic Polynucleotide
taatacgactcactatagggatcaccgaacagaaggttatctcggtacccaacagaggagagggtacatggataaccttaacctggcggcagcgcaaaagatg

SEQ ID NO: 201438 - DNA, 103 bp, Artificial Sequence
  Synthetic Polynucleotide
taatacgactcactatagggtgataatttcatcaccgaacagaaggttataacagaggagaataaccatgtgttcggtgaacctggcggcagcgcaaaagatg

SEQ ID NO: 201439 - DNA, 103 bp, Artificial Sequence
  Synthetic Polynucleotide
taatacgactcactatagggaaaccattagtgataatttcatcaccgaacaacagaggagagttcggatgtgaaattataacctggcggcagcgcaaaagatg

SEQ ID NO: 201440 - DNA, 103 bp, Artificial Sequence
  Synthetic Polynucleotide
taatacgactcactatagggacaggaatgaaaaccattagtgataatttcaacagaggagagaaattatgactaatggtaacctggcggcagcgcaaaagatg

SEQ ID NO: 201441 - DNA, 103 bp, Artificial Sequence
  Synthetic Polynucleotide
taatacgactcactatagggcatcactttcacaggaatgaaaaccattagaacagaggagactaatgatgttcattcctaacctggcggcagcgcaaaagatg

SEQ ID NO: 201442 - DNA, 103 bp, Artificial Sequence
  Synthetic Polynucleotide
taatacgactcactatagggctatcctcctcatcactttcacaggaatgaaacagaggagatcattcatgtgaaagtgaaacctggcggcagcgcaaaagatg

SEQ ID NO: 201443 - DNA, 103 bp, Artificial Sequence
  Synthetic Polynucleotide
taatacgactcactatagggatgtgaggctctatcctcctcatcactttcaacagaggagagaaagtatggaggaggataacctggcggcagcgcaaaagatg

SEQ ID NO: 201444 - DNA, 103 bp, Artificial Sequence
  Synthetic Polynucleotide
taatacgactcactatagggcctccctgtcggcccccgccgccgagggggaacagaggagaccccctatgcggcgggggaacctggcggcagcgcaaaagatg

SEQ ID NO: 201445 - DNA, 103 bp, Artificial Sequence
  Synthetic Polynucleotide
taatacgactcactatagggtagagcttgcatgtgaggctctatcctcctaacagaggagaaggaggatggagcctcacaacctggcggcagcgcaaaagatg

SEQ ID NO: 201446 - DNA, 103 bp, Artificial Sequence
  Synthetic Polynucleotide
taatacgactcactataggggtccagtcactagagcttgcatgtgaggctaacagaggagaagcctcatgtgcaagctcaacctggcggcagcgcaaaagatg

SEQ ID NO: 201447 - DNA, 103 bp, Artificial Sequence
  Synthetic Polynucleotide
taatacgactcactatagggtggccttggagtccagtcactagagcttgcaacagaggagagcaagcatgagtgactggaacctggcggcagcgcaaaagatg

SEQ ID NO: 201448 - DNA, 103 bp, Artificial Sequence
  Synthetic Polynucleotide
taatacgactcactataggggacctatccgtggccttggagtccagtcacaacagaggagagtgactatgctccaaggcaacctggcggcagcgcaaaagatg

SEQ ID NO: 201449 - DNA, 103 bp, Artificial Sequence
  Synthetic Polynucleotide
taatacgactcactatagggaaagtatatggacctatccgtggccttggaaacagaggagatccaagatgacggataggaacctggcggcagcgcaaaagatg

SEQ ID NO: 201450 - DNA, 103 bp, Artificial Sequence
  Synthetic Polynucleotide
taatacgactcactatagggttgctgaacaaaagtatatggacctatccgaacagaggagacggataatgccatatactaacctggcggcagcgcaaaagatg

SEQ ID NO: 201451 - DNA, 103 bp, Artificial Sequence
  Synthetic Polynucleotide
taatacgactcactatagggtcataagatgttgctgaacaaaagtatatgaacagaggagacatataatgttgttcagcaacctggcggcagcgcaaaagatg

SEQ ID NO: 201452 - DNA, 103 bp, Artificial Sequence
  Synthetic Polynucleotide
taatacgactcactatagggtctgtgccaatcataagatgttgctgaacaaacagaggagatgttcaatgacatcttataacctggcggcagcgcaaaagatg

SEQ ID NO: 201453 - DNA, 103 bp, Artificial Sequence
  Synthetic Polynucleotide
taatacgactcactatagggtgttcgaggatctgtgccaatcataagatgaacagaggagacatcttatgattggcacaaacctggcggcagcgcaaaagatg

SEQ ID NO: 201454 - DNA, 103 bp, Artificial Sequence
  Synthetic Polynucleotide
taatacgactcactatagggctttaagaattgttcgaggatctgtgccaaaacagaggagattggcaatgatcctcgaaaacctggcggcagcgcaaaagatg

SEQ ID NO: 201455 - DNA, 103 bp, Artificial Sequence
  Synthetic Polynucleotide
taatacgactcactataggggacgacgcggcctccctgtcggcccccgccaacagaggagaggcgggatgcgacagggaaacctggcggcagcgcaaaagatg

SEQ ID NO: 201456 - DNA, 103 bp, Artificial Sequence
  Synthetic Polynucleotide
taatacgactcactatagggggcaataaatctttaagaattgttcgaggaaacagaggagatcctcgatgaattcttaaaacctggcggcagcgcaaaagatg

SEQ ID NO: 201457 - DNA, 103 bp, Artificial Sequence
  Synthetic Polynucleotide
taatacgactcactatagggtattgtttccggcaataaatctttaagaataacagaggagaattcttatggatttattgaacctggcggcagcgcaaaagatg

SEQ ID NO: 201458 - DNA, 103 bp, Artificial Sequence
  Synthetic Polynucleotide
taatacgactcactatagggcaggtggaggtattgtttccggcaataaataacagaggagaatttatatgcggaaacaaaacctggcggcagcgcaaaagatg

SEQ ID NO: 201459 - DNA, 103 bp, Artificial Sequence
  Synthetic Polynucleotide
taatacgactcactatagggtcatccaactcaggtggaggtattgtttccaacagaggagaggaaacatgacctccaccaacctggcggcagcgcaaaagatg

SEQ ID NO: 201460 - DNA, 103 bp, Artificial Sequence
  Synthetic Polynucleotide
taatacgactcactatagggcagtgtcatatcatccaactcaggtggaggaacagaggagacctccaatggagttggataacctggcggcagcgcaaaagatg

SEQ ID NO: 201461 - DNA, 103 bp, Artificial Sequence
  Synthetic Polynucleotide
taatacgactcactatagggcaatctgccacagtgtcatatcatccaactaacagaggagaagttggatgatatgacacaacctggcggcagcgcaaaagatg

SEQ ID NO: 201462 - DNA, 103 bp, Artificial Sequence
  Synthetic Polynucleotide
taatacgactcactatagggatattaataacaatctgccacagtgtcataaacagaggagatatgacatggtggcagataacctggcggcagcgcaaaagatg

SEQ ID NO: 201463 - DNA, 103 bp, Artificial Sequence
  Synthetic Polynucleotide
taatacgactcactatagggttctgaaaggatattaataacaatctgccaaacagaggagatggcagatggttattaataacctggcggcagcgcaaaagatg

SEQ ID NO: 201464 - DNA, 103 bp, Artificial Sequence
  Synthetic Polynucleotide
taatacgactcactatagggtttttggtggttctgaaaggatattaataaaacagaggagattattaatgtcctttcagaacctggcggcagcgcaaaagatg

SEQ ID NO: 201465 - DNA, 103 bp, Artificial Sequence
  Synthetic Polynucleotide
taatacgactcactatagggctttttttcctttttggtggttctgaaaggaacagaggagacctttcatgaccaccaaaaacctggcggcagcgcaaaagatg

SEQ ID NO: 201466 - DNA, 103 bp, Artificial Sequence
  Synthetic Polynucleotide
taatacgactcactatagggcccggcgggggacgacgcggcctccctgtcaacagaggagagacaggatggccgcgtcgaacctggcggcagcgcaaaagatg

SEQ ID NO: 201467 - DNA, 103 bp, Artificial Sequence
  Synthetic Polynucleotide
taatacgactcactatagggaatatcttttctttttttcctttttggtggaacagaggagaccaccaatgaggaaaaaaaacctggcggcagcgcaaaagatg

SEQ ID NO: 201468 - DNA, 103 bp, Artificial Sequence
  Synthetic Polynucleotide
taatacgactcactatagggcaattgtattaatatcttttctttttttccaacagaggagaggaaaaatggaaaagataaacctggcggcagcgcaaaagatg

SEQ ID NO: 201469 - DNA, 103 bp, Artificial Sequence
  Synthetic Polynucleotide
taatacgactcactatagggacagcatcttcaattgtattaatatcttttaacagaggagaaaaagaatgtaatacaataacctggcggcagcgcaaaagatg

SEQ ID NO: 201470 - DNA, 103 bp, Artificial Sequence
  Synthetic Polynucleotide
taatacgactcactatagggcagtaatttcacagcatcttcaattgtattaacagaggagaaatacaatggaagatgctaacctggcggcagcgcaaaagatg

SEQ ID NO: 201471 - DNA, 103 bp, Artificial Sequence
  Synthetic Polynucleotide
taatacgactcactatagggtgcactcttgcagtaatttcacagcatcttaacagaggagaaagatgatgtgaaattacaacctggcggcagcgcaaaagatg

SEQ ID NO: 201472 - DNA, 103 bp, Artificial Sequence
  Synthetic Polynucleotide
taatacgactcactatagggataatttttttgcactcttgcagtaatttcaacagaggagagaaattatggcaagagtgaacctggcggcagcgcaaaagatg

SEQ ID NO: 201473 - DNA, 103 bp, Artificial Sequence
  Synthetic Polynucleotide
taatacgactcactatagggagttagaactataatttttttgcactcttgaacagaggagacaagagatgaaaaaaattaacctggcggcagcgcaaaagatg

SEQ ID NO: 201474 - DNA, 103 bp, Artificial Sequence
  Synthetic Polynucleotide
taatacgactcactatagggccccagctccagttagaactataattttttaacagaggagaaaaaaaatgtagttctaaaacctggcggcagcgcaaaagatg

SEQ ID NO: 201475 - DNA, 103 bp, Artificial Sequence
  Synthetic Polynucleotide
taatacgactcactataggggaaacagacaccccagctccagttagaactaacagaggagaagttctatgtggagctggaacctggcggcagcgcaaaagatg

SEQ ID NO: 201476 - DNA, 103 bp, Artificial Sequence
  Synthetic Polynucleotide
taatacgactcactatagggtattccacatgaaacagacaccccagctccaacagaggagaggagctatggtgtctgttaacctggcggcagcgcaaaagatg

SEQ ID NO: 201477 - DNA, 103 bp, Artificial Sequence
  Synthetic Polynucleotide
taatacgactcactatagggggagcggctccccggcgggggacgacgcggaacagaggagaccgcgtatgcccccgccgaacctggcggcagcgcaaaagatg

SEQ ID NO: 201478 - DNA, 103 bp, Artificial Sequence
  Synthetic Polynucleotide
taatacgactcactatagggtgaagtcaggtattccacatgaaacagacaaacagaggagatgtctgatgcatgtggaaaacctggcggcagcgcaaaagatg

SEQ ID NO: 201479 - DNA, 103 bp, Artificial Sequence
  Synthetic Polynucleotide
taatacgactcactatagggtcccttgacctgaagtcaggtattccacataacagaggagaatgtggatgacctgacttaacctggcggcagcgcaaaagatg

SEQ ID NO: 201480 - DNA, 103 bp, Artificial Sequence
  Synthetic Polynucleotide
taatacgactcactatagggataaataccatcccttgacctgaagtcaggaacagaggagacctgacatgaggtcaaggaacctggcggcagcgcaaaagatg

SEQ ID NO: 201481 - DNA, 103 bp, Artificial Sequence
  Synthetic Polynucleotide
taatacgactcactatagggcaaggcgagcataaataccatcccttgaccaacagaggagaggtcaaatgatggtatttaacctggcggcagcgcaaaagatg

SEQ ID NO: 201482 - DNA, 103 bp, Artificial Sequence
  Synthetic Polynucleotide
taatacgactcactatagggaagtctacagcaaggcgagcataaataccaaacagaggagatggtatatgtgctcgcctaacctggcggcagcgcaaaagatg

SEQ ID NO: 201483 - DNA, 103 bp, Artificial Sequence
  Synthetic Polynucleotide
taatacgactcactatagggaagatctgggaagtctacagcaaggcgagcaacagaggagagctcgcatggctgtagacaacctggcggcagcgcaaaagatg

SEQ ID NO: 201484 - DNA, 103 bp, Artificial Sequence
  Synthetic Polynucleotide
taatacgactcactataggggaggatctggaagatctgggaagtctacagaacagaggagactgtagatgtcccagatcaacctggcggcagcgcaaaagatg

SEQ ID NO: 201485 - DNA, 103 bp, Artificial Sequence
  Synthetic Polynucleotide
taatacgactcactatagggaacatcgcttgaggatctggaagatctgggaacagaggagacccagaatgtccagatccaacctggcggcagcgcaaaagatg

SEQ ID NO: 201486 - DNA, 103 bp, Artificial Sequence
  Synthetic Polynucleotide
taatacgactcactatagggttcaatatcaaacatcgcttgaggatctggaacagaggagaccagatatgcaagcgatgaacctggcggcagcgcaaaagatg

SEQ ID NO: 201487 - DNA, 103 bp, Artificial Sequence
  Synthetic Polynucleotide
taatacgactcactatagggttctgaaatattcaatatcaaacatcgcttaacagaggagaaagcgaatgttgatattgaacctggcggcagcgcaaaagatg

SEQ ID NO: 201488 - DNA, 103 bp, Artificial Sequence
  Synthetic Polynucleotide
taatacgactcactatagggggcctcttgcggagcggctccccggcggggaacagaggagaccccgcatgggagccgctaacctggcggcagcgcaaaagatg

SEQ ID NO: 201489 - DNA, 103 bp, Artificial Sequence
  Synthetic Polynucleotide
taatacgactcactatagggcttggatcttttctgaaatattcaatatcaaacagaggagatgatatatgatatttcagaacctggcggcagcgcaaaagatg

SEQ ID NO: 201490 - DNA, 103 bp, Artificial Sequence
  Synthetic Polynucleotide
taatacgactcactataggggaagaatggtcttggatcttttctgaaataaacagaggagatatttcatgaaagatccaaacctggcggcagcgcaaaagatg

SEQ ID NO: 201491 - DNA, 103 bp, Artificial Sequence
  Synthetic Polynucleotide
taatacgactcactatagggttgcaaacttgaagaatggtcttggatcttaacagaggagaaagatcatggaccattctaacctggcggcagcgcaaaagatg

SEQ ID NO: 201492 - DNA, 103 bp, Artificial Sequence
  Synthetic Polynucleotide
taatacgactcactatagggtatatttcctttgcaaacttgaagaatggtaacagaggagaaccattatgcaagtttgcaacctggcggcagcgcaaaagatg

SEQ ID NO: 201493 - DNA, 103 bp, Artificial Sequence
  Synthetic Polynucleotide
taatacgactcactatagggttgtccaggatatatttcctttgcaaacttaacagaggagaaagtttatgaaggaaataaacctggcggcagcgcaaaagatg

SEQ ID NO: 201494 - DNA, 103 bp, Artificial Sequence
  Synthetic Polynucleotide
taatacgactcactatagggatggctggaattgtccaggatatatttcctaacagaggagaaggaaaatgatcctggacaacctggcggcagcgcaaaagatg

SEQ ID NO: 201495 - DNA, 103 bp, Artificial Sequence
  Synthetic Polynucleotide
taatacgactcactatagggtgacagagagatggctggaattgtccaggaaacagaggagatcctggatgattccagccaacctggcggcagcgcaaaagatg

SEQ ID NO: 201496 - DNA, 103 bp, Artificial Sequence
  Synthetic Polynucleotide
taatacgactcactatagggtatgaatttgtgacagagagatggctggaaaacagaggagattccagatgtctctctgtaacctggcggcagcgcaaaagatg

SEQ ID NO: 201497 - DNA, 103 bp, Artificial Sequence
  Synthetic Polynucleotide
taatacgactcactatagggctgacaaggctatgaatttgtgacagagagaacagaggagactctctatgacaaattcaaacctggcggcagcgcaaaagatg

SEQ ID NO: 201498 - DNA, 103 bp, Artificial Sequence
  Synthetic Polynucleotide
taatacgactcactatagggccttccttatctgacaaggctatgaatttgaacagaggagacaaattatgagccttgtcaacctggcggcagcgcaaaagatg

SEQ ID NO: 201499 - DNA, 103 bp, Artificial Sequence
  Synthetic Polynucleotide
taatacgactcactatagggcgtaaagccaaacgacggcagcatcgacataacagaggagaatgtcgatgctgccgtcgaacctggcggcagcgcaaaagatg

SEQ ID NO: 201500 - DNA, 103 bp, Artificial Sequence
  Synthetic Polynucleotide
taatacgactcactataggggcaggcgggcagtgaccacaggaacctgccaacagaggagaggcaggatgctgtggtcaaacctggcggcagcgcaaaagatg

SEQ ID NO: 201501 - DNA, 103 bp, Artificial Sequence
  Synthetic Polynucleotide
taatacgactcactataggggcaggtggtcgcaggcgggcagtgaccacaaacagaggagatgtggtatgtgcccgcctaacctggcggcagcgcaaaagatg

SEQ ID NO: 201502 - DNA, 103 bp, Artificial Sequence
  Synthetic Polynucleotide
taatacgactcactatagggtcgttcttgtgcaggtggtcgcaggcgggcaacagaggagagcccgcatgcgaccacctaacctggcggcagcgcaaaagatg

SEQ ID NO: 201503 - DNA, 103 bp, Artificial Sequence
  Synthetic Polynucleotide
taatacgactcactataggggagtacgctctcgttcttgtgcaggtggtcaacagaggagagaccacatgcacaagaacaacctggcggcagcgcaaaagatg

SEQ ID NO: 201504 - DNA, 103 bp, Artificial Sequence
  Synthetic Polynucleotide
taatacgactcactatagggccttggccttgagtacgctctcgttcttgtaacagaggagaacaagaatgagagcgtacaacctggcggcagcgcaaaagatg

SEQ ID NO: 201505 - DNA, 103 bp, Artificial Sequence
  Synthetic Polynucleotide
taatacgactcactataggggcgaccaccgccttggccttgagtacgctcaacagaggagagagcgtatgcaaggccaaaacctggcggcagcgcaaaagatg

SEQ ID NO: 201506 - DNA, 103 bp, Artificial Sequence
  Synthetic Polynucleotide
taatacgactcactataggggcggtggaaggcgaccaccgccttggccttaacagaggagaaaggccatggcggtggtcaacctggcggcagcgcaaaagatg

SEQ ID NO: 201507 - DNA, 103 bp, Artificial Sequence
  Synthetic Polynucleotide
taatacgactcactatagggggaagttgccgcggtggaaggcgaccaccgaacagaggagacggtggatgccttccaccaacctggcggcagcgcaaaagatg

SEQ ID NO: 201508 - DNA, 103 bp, Artificial Sequence
  Synthetic Polynucleotide
taatacgactcactatagggtagagctcacggaagttgccgcggtggaagaacagaggagacttccaatgcggcaacttaacctggcggcagcgcaaaagatg

SEQ ID NO: 201509 - DNA, 103 bp, Artificial Sequence
  Synthetic Polynucleotide
taatacgactcactatagggcaggatcttgtagagctcacggaagttgccaacagaggagaggcaacatgcgtgagctcaacctggcggcagcgcaaaagatg

SEQ ID NO: 201510 - DNA, 103 bp, Artificial Sequence
  Synthetic Polynucleotide
taatacgactcactatagggcttgctcctgcgtaaagccaaacgacggcaaacagaggagatgccgtatgttggctttaaacctggcggcagcgcaaaagatg

SEQ ID NO: 201511 - DNA, 103 bp, Artificial Sequence
  Synthetic Polynucleotide
taatacgactcactatagggggtggctctccaggatcttgtagagctcacaacagaggagagtgagcatgacaagatccaacctggcggcagcgcaaaagatg

SEQ ID NO: 201512 - DNA, 103 bp, Artificial Sequence
  Synthetic Polynucleotide
taatacgactcactatagggggcgagaactggtggctctccaggatcttgaacagaggagacaagatatgggagagccaaacctggcggcagcgcaaaagatg

SEQ ID NO: 201513 - DNA, 103 bp, Artificial Sequence
  Synthetic Polynucleotide
taatacgactcactataggggtggttgtgaggcgagaactggtggctctcaacagaggagagagagcatgcagttctcgaacctggcggcagcgcaaaagatg

SEQ ID NO: 201514 - DNA, 103 bp, Artificial Sequence
  Synthetic Polynucleotide
taatacgactcactataggggcagtttggggtggttgtgaggcgagaactaacagaggagaagttctatgctcacaaccaacctggcggcagcgcaaaagatg

SEQ ID NO: 201515 - DNA, 103 bp, Artificial Sequence
  Synthetic Polynucleotide
taatacgactcactatagggcacagttgctgcagtttggggtggttgtgaaacagaggagatcacaaatgccccaaactaacctggcggcagcgcaaaagatg

SEQ ID NO: 201516 - DNA, 103 bp, Artificial Sequence
  Synthetic Polynucleotide
taatacgactcactatagggcgccttcagccacagttgctgcagtttgggaacagaggagacccaaaatgcagcaactgaacctggcggcagcgcaaaagatg

SEQ ID NO: 201517 - DNA, 103 bp, Artificial Sequence
  Synthetic Polynucleotide
taatacgactcactatagggccacgtaatgcgccttcagccacagttgctaacagaggagaagcaacatgggctgaaggaacctggcggcagcgcaaaagatg

SEQ ID NO: 201518 - DNA, 103 bp, Artificial Sequence
  Synthetic Polynucleotide
taatacgactcactatagggttctcggcctccacgtaatgcgccttcagcaacagaggagagctgaaatggcattacgtaacctggcggcagcgcaaaagatg

SEQ ID NO: 201519 - DNA, 103 bp, Artificial Sequence
  Synthetic Polynucleotide
taatacgactcactataggggccgcgcagcttctcggcctccacgtaatgaacagaggagacattacatggaggccgagaacctggcggcagcgcaaaagatg

SEQ ID NO: 201520 - DNA, 103 bp, Artificial Sequence
  Synthetic Polynucleotide
taatacgactcactatagggccaggggtcggccgcgcagcttctcggcctaacagaggagaaggccgatgagctgcgcgaacctggcggcagcgcaaaagatg

SEQ ID NO: 201521 - DNA, 103 bp, Artificial Sequence
  Synthetic Polynucleotide
taatacgactcactatagggacgcacgccacttgctcctgcgtaaagccaaacagaggagatggcttatggcaggagcaaacctggcggcagcgcaaaagatg

SEQ ID NO: 201522 - DNA, 103 bp, Artificial Sequence
  Synthetic Polynucleotide
taatacgactcactatagggcccacggcgcccaggggtcggccgcgcagcaacagaggagagctgcgatgccgacccctaacctggcggcagcgcaaaagatg

SEQ ID NO: 201523 - DNA, 103 bp, Artificial Sequence
  Synthetic Polynucleotide
taatacgactcactatagggccgatatttgcccacggcgcccaggggtcgaacagaggagacgacccatgggcgccgtgaacctggcggcagcgcaaaagatg

SEQ ID NO: 201524 - DNA, 103 bp, Artificial Sequence
  Synthetic Polynucleotide
taatacgactcactatagggttcggcgcacccgatatttgcccacggcgcaacagaggagagcgccgatggcaaatatcaacctggcggcagcgcaaaagatg

SEQ ID NO: 201525 - DNA, 103 bp, Artificial Sequence
  Synthetic Polynucleotide
taatacgactcactatagggagtggaaattttcggcgcacccgatatttgaacagaggagacaaataatgggtgcgccgaacctggcggcagcgcaaaagatg

SEQ ID NO: 201526 - DNA, 103 bp, Artificial Sequence
  Synthetic Polynucleotide
taatacgactcactatagggggtgcgcggcagtggaaattttcggcgcacaacagaggagagtgcgcatgaaatttccaaacctggcggcagcgcaaaagatg

SEQ ID NO: 201527 - DNA, 103 bp, Artificial Sequence
  Synthetic Polynucleotide
taatacgactcactatagggcgtcccagatggtgcgcggcagtggaaattaacagaggagaaatttcatgtgccgcgcaaacctggcggcagcgcaaaagatg

SEQ ID NO: 201528 - DNA, 103 bp, Artificial Sequence
  Synthetic Polynucleotide
taatacgactcactataggggtctcctcgccgtcccagatggtgcgcggcaacagaggagagccgcgatgcatctgggaaacctggcggcagcgcaaaagatg

SEQ ID NO: 201529 - DNA, 103 bp, Artificial Sequence
  Synthetic Polynucleotide
taatacgactcactataggggcagtagctggtctcctcgccgtcccagataacagaggagaatctggatgggcgaggagaacctggcggcagcgcaaaagatg

SEQ ID NO: 201530 - DNA, 103 bp, Artificial Sequence
  Synthetic Polynucleotide
taatacgactcactatagggtctccttgaagcagtagctggtctcctcgcaacagaggagagcgaggatgccagctactaacctggcggcagcgcaaaagatg

SEQ ID NO: 201531 - DNA, 103 bp, Artificial Sequence
  Synthetic Polynucleotide
taatacgactcactatagggcccctcgacttctccttgaagcagtagctgaacagaggagacagctaatgcttcaaggaaacctggcggcagcgcaaaagatg

SEQ ID NO: 201532 - DNA, 103 bp, Artificial Sequence
  Synthetic Polynucleotide
taatacgactcactatagggaacctcgcacacgcacgccacttgctcctgaacagaggagacaggagatggtggcgtgcaacctggcggcagcgcaaaagatg

SEQ ID NO: 201533 - DNA, 103 bp, Artificial Sequence
  Synthetic Polynucleotide
taatacgactcactatagggccgcaggacacccctcgacttctccttgaaaacagaggagattcaagatgaagtcgaggaacctggcggcagcgcaaaagatg

SEQ ID NO: 201534 - DNA, 103 bp, Artificial Sequence
  Synthetic Polynucleotide
taatacgactcactatagggcgtaccactcccgcaggacacccctcgactaacagaggagaagtcgaatggtgtcctgcaacctggcggcagcgcaaaagatg

SEQ ID NO: 201535 - DNA, 103 bp, Artificial Sequence
  Synthetic Polynucleotide
taatacgactcactatagggggattgtgcgcgtaccactcccgcaggacaaacagaggagatgtcctatgggagtggtaaacctggcggcagcgcaaaagatg

SEQ ID NO: 201536 - DNA, 103 bp, Artificial Sequence
  Synthetic Polynucleotide
taatacgactcactatagggcgatgggtagggattgtgcgcgtaccactcaacagaggagagagtggatggcgcacaataacctggcggcagcgcaaaagatg

SEQ ID NO: 201537 - DNA, 103 bp, Artificial Sequence
  Synthetic Polynucleotide
taatacgactcactatagggtctcacgcggcgatgggtagggattgtgcgaacagaggagacgcacaatgcctacccataacctggcggcagcgcaaaagatg

SEQ ID NO: 201538 - DNA, 103 bp, Artificial Sequence
  Synthetic Polynucleotide
taatacgactcactatagggagctcccgcttctcacgcggcgatgggtagaacagaggagactacccatggccgcgtgaaacctggcggcagcgcaaaagatg

SEQ ID NO: 201539 - DNA, 103 bp, Artificial Sequence
  Synthetic Polynucleotide
taatacgactcactatagggggcctcggccagctcccgcttctcacgcggaacagaggagaccgcgtatgaagcgggagaacctggcggcagcgcaaaagatg

SEQ ID NO: 201540 - DNA, 103 bp, Artificial Sequence
  Synthetic Polynucleotide
taatacgactcactatagggtgaggccggtggcctcggccagctcccgctaacagaggagaagcgggatgtggccgaggaacctggcggcagcgcaaaagatg

SEQ ID NO: 201541 - DNA, 103 bp, Artificial Sequence
  Synthetic Polynucleotide
taatacgactcactatagggtgggtggtggtgaggccggtggcctcggccaacagaggagaggccgaatgcaccggcctaacctggcggcagcgcaaaagatg

SEQ ID NO: 201542 - DNA, 103 bp, Artificial Sequence
  Synthetic Polynucleotide
taatacgactcactataggggttgctgacctgggtggtggtgaggccggtaacagaggagaaccggcatgaccaccaccaacctggcggcagcgcaaaagatg

SEQ ID NO: 201543 - DNA, 103 bp, Artificial Sequence
  Synthetic Polynucleotide
taatacgactcactatagggcttgctgcagaacctcgcacacgcacgccaaacagaggagatggcgtatgtgtgcgaggaacctggcggcagcgcaaaagatg

SEQ ID NO: 201544 - DNA, 103 bp, Artificial Sequence
  Synthetic Polynucleotide
taatacgactcactatagggtcttaaaccagttgctgacctgggtggtggaacagaggagaccaccaatgaggtcagcaaacctggcggcagcgcaaaagatg

SEQ ID NO: 201545 - DNA, 103 bp, Artificial Sequence
  Synthetic Polynucleotide
taatacgactcactatagggtgcctccggttcttaaaccagttgctgaccaacagaggagaggtcagatgctggtttaaaacctggcggcagcgcaaaagatg

SEQ ID NO: 201546 - DNA, 103 bp, Artificial Sequence
  Synthetic Polynucleotide
taatacgactcactatagggccggtctctttgcctccggttcttaaaccaaacagaggagatggtttatgaaccggaggaacctggcggcagcgcaaaagatg

SEQ ID NO: 201547 - DNA, 103 bp, Artificial Sequence
  Synthetic Polynucleotide
taatacgactcactatagggcctccgcggcccggtctctttgcctccggtaacagaggagaaccggaatgaaagagaccaacctggcggcagcgcaaaagatg

SEQ ID NO: 201548 - DNA, 103 bp, Artificial Sequence
  Synthetic Polynucleotide
taatacgactcactatagggctttccttggcctccgcggcccggtctcttaacagaggagaaagagaatgggccgcggaaacctggcggcagcgcaaaagatg

SEQ ID NO: 201549 - DNA, 103 bp, Artificial Sequence
  Synthetic Polynucleotide
taatacgactcactatagggggtgttctccctttccttggcctccgcggcaacagaggagagccgcgatggccaaggaaaacctggcggcagcgcaaaagatg

SEQ ID NO: 201550 - DNA, 103 bp, Artificial Sequence
  Synthetic Polynucleotide
taatacgactcactatagggtattgttttcggtgttctccctttccttggaacagaggagaccaaggatggggagaacaaacctggcggcagcgcaaaagatg

SEQ ID NO: 201551 - DNA, 103 bp, Artificial Sequence
  Synthetic Polynucleotide
taatacgactcactataggggaggaggagttattgttttcggtgttctccaacagaggagaggagaaatgcgaaaacaaaacctggcggcagcgcaaaagatg

SEQ ID NO: 201552 - DNA, 103 bp, Artificial Sequence
  Synthetic Polynucleotide
taatacgactcactatagggctgcttgttggaggaggagttattgttttcaacagaggagagaaaacatgaactcctccaacctggcggcagcgcaaaagatg

SEQ ID NO: 201553 - DNA, 103 bp, Artificial Sequence
  Synthetic Polynucleotide
taatacgactcactatagggagagttggttctgcttgttggaggaggagtaacagaggagaactcctatgccaacaagcaacctggcggcagcgcaaaagatg

SEQ ID NO: 201554 - DNA, 103 bp, Artificial Sequence
  Synthetic Polynucleotide
taatacgactcactatagggaggtttccgccttgctgcagaacctcgcacaacagaggagagtgcgaatgtctgcagcaaacctggcggcagcgcaaaagatg

SEQ ID NO: 201555 - DNA, 103 bp, Artificial Sequence
  Synthetic Polynucleotide
taatacgactcactatagggtccagaggagagagttggttctgcttgttgaacagaggagacaacaaatggaaccaactaacctggcggcagcgcaaaagatg

SEQ ID NO: 201556 - DNA, 103 bp, Artificial Sequence
  Synthetic Polynucleotide
taatacgactcactatagggcttgcccccttccagaggagagagttggttaacagaggagaaaccaaatgtctcctctgaacctggcggcagcgcaaaagatg

SEQ ID NO: 201557 - DNA, 103 bp, Artificial Sequence
  Synthetic Polynucleotide
taatacgactcactatagggacatgagcggcttgcccccttccagaggagaacagaggagactcctcatgaagggggcaaacctggcggcagcgcaaaagatg

SEQ ID NO: 201558 - DNA, 103 bp, Artificial Sequence
  Synthetic Polynucleotide
taatacgactcactatagggtctgagctggacatgagcggcttgccccctaacagaggagaagggggatggccgctcataacctggcggcagcgcaaaagatg

SEQ ID NO: 201559 - DNA, 103 bp, Artificial Sequence
  Synthetic Polynucleotide
taatacgactcactataggggaattcctcttctgagctggacatgagcggaacagaggagaccgctcatgtccagctcaaacctggcggcagcgcaaaagatg

SEQ ID NO: 201560 - DNA, 103 bp, Artificial Sequence
  Synthetic Polynucleotide
taatacgactcactatagggggggaggtgagaattcctcttctgagctggaacagaggagaccagctatgaagaggaataacctggcggcagcgcaaaagatg

SEQ ID NO: 201561 - DNA, 103 bp, Artificial Sequence
  Synthetic Polynucleotide
taatacgactcactatagggtctggactttggggaggtgagaattcctctaacagaggagaagaggaatgctcacctccaacctggcggcagcgcaaaagatg

SEQ ID NO: 201562 - DNA, 103 bp, Artificial Sequence
  Synthetic Polynucleotide
taatacgactcactatagggcgagttctggtctggactttggggaggtgaaacagaggagatcacctatgcaaagtccaaacctggcggcagcgcaaaagatg

SEQ ID NO: 201563 - DNA, 103 bp, Artificial Sequence
  Synthetic Polynucleotide
taatacgactcactataggggcagaaggaccgagttctggtctggactttaacagaggagaaaagtcatgaccagaactaacctggcggcagcgcaaaagatg

SEQ ID NO: 201564 - DNA, 103 bp, Artificial Sequence
  Synthetic Polynucleotide
taatacgactcactatagggttgccctgcagcagaaggaccgagttctggaacagaggagaccagaaatgggtccttctaacctggcggcagcgcaaaagatg

SEQ ID NO: 201565 - DNA, 103 bp, Artificial Sequence
  Synthetic Polynucleotide
taatacgactcactatagggcaggcgctccaggtttccgccttgctgcagaacagaggagactgcagatgggcggaaacaacctggcggcagcgcaaaagatg

SEQ ID NO: 201566 - DNA, 103 bp, Artificial Sequence
  Synthetic Polynucleotide
taatacgactcactataggggtggcccatattgccctgcagcagaaggacaacagaggagagtccttatgctgcagggcaacctggcggcagcgcaaaagatg

SEQ ID NO: 201567 - DNA, 103 bp, Artificial Sequence
  Synthetic Polynucleotide
taatacgactcactatagggagctcctggcgtggcccatattgccctgcaaacagaggagatgcaggatgatatgggccaacctggcggcagcgcaaaagatg

SEQ ID NO: 201568 - DNA, 103 bp, Artificial Sequence
  Synthetic Polynucleotide
taatacgactcactataggggaatagtttgagctcctggcgtggcccataaacagaggagatatgggatgcgccaggagaacctggcggcagcgcaaaagatg

SEQ ID NO: 201569 - DNA, 103 bp, Artificial Sequence
  Synthetic Polynucleotide
taatacgactcactataggggcccgggagagaatagtttgagctcctggcaacagaggagagccaggatgtcaaactataacctggcggcagcgcaaaagatg

SEQ ID NO: 201570 - DNA, 103 bp, Artificial Sequence
  Synthetic Polynucleotide
taatacgactcactatagggaggctgttaagcccgggagagaatagtttgaacagaggagacaaactatgctctcccggaacctggcggcagcgcaaaagatg

SEQ ID NO: 201571 - DNA, 103 bp, Artificial Sequence
  Synthetic Polynucleotide
taatacgactcactatagggctgggctgcgaggctgttaagcccgggagaaacagaggagatctcccatgcttaacagcaacctggcggcagcgcaaaagatg

SEQ ID NO: 201572 - DNA, 103 bp, Artificial Sequence
  Synthetic Polynucleotide
taatacgactcactatagggcaggccgtgactgggctgcgaggctgttaaaacagaggagattaacaatgtcgcagcccaacctggcggcagcgcaaaagatg

SEQ ID NO: 201573 - DNA, 103 bp, Artificial Sequence
  Synthetic Polynucleotide
taatacgactcactatagggggtgggtctgcaggccgtgactgggctgcgaacagaggagacgcagcatggtcacggccaacctggcggcagcgcaaaagatg

SEQ ID NO: 201574 - DNA, 103 bp, Artificial Sequence
  Synthetic Polynucleotide
taatacgactcactatagggagctgatgctggtgggtctgcaggccgtgaaacagaggagatcacggatggcagacccaaacctggcggcagcgcaaaagatg

SEQ ID NO: 201575 - DNA, 103 bp, Artificial Sequence
  Synthetic Polynucleotide
taatacgactcactatagggagagtcttggagctgatgctggtgggtctgaacagaggagacagaccatgcagcatcagaacctggcggcagcgcaaaagatg

SEQ ID NO: 201576 - DNA, 103 bp, Artificial Sequence
  Synthetic Polynucleotide
taatacgactcactatagggggaacctgcccaggcgctccaggtttccgcaacagaggagagcggaaatgtggagcgccaacctggcggcagcgcaaaagatg

SEQ ID NO: 201577 - DNA, 103 bp, Artificial Sequence
  Synthetic Polynucleotide
taatacgactcactatagggggccgagcagagagtcttggagctgatgctaacagaggagaagcatcatgtccaagactaacctggcggcagcgcaaaagatg

SEQ ID NO: 201578 - DNA, 103 bp, Artificial Sequence
  Synthetic Polynucleotide
taatacgactcactataggggaggtgagggggccgagcagagagtcttggaacagaggagaccaagaatgtctgctcggaacctggcggcagcgcaaaagatg

SEQ ID NO: 201579 - DNA, 103 bp, Artificial Sequence
  Synthetic Polynucleotide
taatacgactcactatagggcaccagactggaggtgagggggccgagcagaacagaggagactgctcatgcccctcaccaacctggcggcagcgcaaaagatg

SEQ ID NO: 201580 - DNA, 103 bp, Artificial Sequence
  Synthetic Polynucleotide
taatacgactcactatagggaccccaagtccaccagactggaggtgagggaacagaggagaccctcaatgccagtctggaacctggcggcagcgcaaaagatg

SEQ ID NO: 201581 - DNA, 103 bp, Artificial Sequence
  Synthetic Polynucleotide
taatacgactcactatagggagtgaccacaggaacctgcccaggcgctccaacagaggagaggagcgatggggcaggttaacctggcggcagcgcaaaagatg

SEQ ID NO: 201582 - DNA, 103 bp, Artificial Sequence
  Synthetic Polynucleotide
taatacgactcactatagggcgtgaagccgaaggtgggcagcatggacataacagaggagaatgtccatgctgcccaccaacctggcggcagcgcaaaagatg

SEQ ID NO: 201583 - DNA, 103 bp, Artificial Sequence
  Synthetic Polynucleotide
taatacgactcactataggggcaggcgggcagcgaccacaggaagcggccaacagaggagaggccgcatgctgtggtcgaacctggcggcagcgcaaaagatg

SEQ ID NO: 201584 - DNA, 103 bp, Artificial Sequence
  Synthetic Polynucleotide
taatacgactcactataggggaaggtgctcgcaggcgggcagcgaccacaaacagaggagatgtggtatgtgcccgcctaacctggcggcagcgcaaaagatg

SEQ ID NO: 201585 - DNA, 103 bp, Artificial Sequence
  Synthetic Polynucleotide
taatacgactcactatagggtcattcttgtgaaggtgctcgcaggcgggcaacagaggagagcccgcatgcgagcacctaacctggcggcagcgcaaaagatg

SEQ ID NO: 201586 - DNA, 103 bp, Artificial Sequence
  Synthetic Polynucleotide
taatacgactcactataggggagcacgctttcattcttgtgaaggtgctcaacagaggagagagcacatgcacaagaataacctggcggcagcgcaaaagatg

SEQ ID NO: 201587 - DNA, 103 bp, Artificial Sequence
  Synthetic Polynucleotide
taatacgactcactatagggccttggccttgagcacgctttcattcttgtaacagaggagaacaagaatgaaagcgtgcaacctggcggcagcgcaaaagatg

SEQ ID NO: 201588 - DNA, 103 bp, Artificial Sequence
  Synthetic Polynucleotide
taatacgactcactataggggccaccacggccttggccttgagcacgcttaacagaggagaaagcgtatgcaaggccaaaacctggcggcagcgcaaaagatg

SEQ ID NO: 201589 - DNA, 103 bp, Artificial Sequence
  Synthetic Polynucleotide
taatacgactcactataggggcggtggaaggccaccacggccttggccttaacagaggagaaaggccatggccgtggtgaacctggcggcagcgcaaaagatg

SEQ ID NO: 201590 - DNA, 103 bp, Artificial Sequence
  Synthetic Polynucleotide
taatacgactcactatagggggaagttgccgcggtggaaggccaccacggaacagaggagaccgtggatgccttccaccaacctggcggcagcgcaaaagatg

SEQ ID NO: 201591 - DNA, 103 bp, Artificial Sequence
  Synthetic Polynucleotide
taatacgactcactatagggtagagctcgcggaagttgccgcggtggaagaacagaggagacttccaatgcggcaacttaacctggcggcagcgcaaaagatg

SEQ ID NO: 201592 - DNA, 103 bp, Artificial Sequence
  Synthetic Polynucleotide
taatacgactcactatagggcaggatcttgtagagctcgcggaagttgccaacagaggagaggcaacatgcgcgagctcaacctggcggcagcgcaaaagatg

SEQ ID NO: 201593 - DNA, 103 bp, Artificial Sequence
  Synthetic Polynucleotide
taatacgactcactatagggcttgctcctgcgtgaagccgaaggtgggcaaacagaggagatgcccaatgtcggcttcaaacctggcggcagcgcaaaagatg

SEQ ID NO: 201594 - DNA, 103 bp, Artificial Sequence
  Synthetic Polynucleotide
taatacgactcactatagggggtggctctccaggatcttgtagagctcgcaacagaggagagcgagcatgacaagatccaacctggcggcagcgcaaaagatg

SEQ ID NO: 201595 - DNA, 103 bp, Artificial Sequence; identical to SEQ ID NO: 201512
  Synthetic Polynucleotide

SEQ ID NO: 201596 - DNA, 103 bp, Artificial Sequence
  Synthetic Polynucleotide
taatacgactcactataggggtggttgtgcggcgagaactggtggctctcaacagaggagagagagcatgcagttctcgaacctggcggcagcgcaaaagatg

SEQ ID NO: 201597 - DNA, 103 bp, Artificial Sequence
  Synthetic Polynucleotide
taatacgactcactataggggcagcttggcgtggttgtgcggcgagaactaacagaggagaagttctatgcgcacaaccaacctggcggcagcgcaaaagatg

SEQ ID NO: 201598 - DNA, 103 bp, Artificial Sequence
  Synthetic Polynucleotide
taatacgactcactatagggcacagctgctgcagcttggcgtggttgtgcaacagaggagagcacaaatgcgccaagctaacctggcggcagcgcaaaagatg

SEQ ID NO: 201599 - DNA, 103 bp, Artificial Sequence
  Synthetic Polynucleotide
taatacgactcactatagggtgccttgagccacagctgctgcagcttggcaacagaggagagccaagatgcagcagctgaacctggcggcagcgcaaaagatg

SEQ ID NO: 201600 - DNA, 103 bp, Artificial Sequence
  Synthetic Polynucleotide
taatacgactcactatagggcgatgtagtgtgccttgagccacagctgctaacagaggagaagcagcatgggctcaaggaacctggcggcagcgcaaaagatg

SEQ ID NO: 201601 - DNA, 103 bp, Artificial Sequence
  Synthetic Polynucleotide
taatacgactcactatagggttctccgcctcgatgtagtgtgccttgagcaacagaggagagctcaaatgacactacataacctggcggcagcgcaaaagatg

SEQ ID NO: 201602 - DNA, 103 bp, Artificial Sequence
  Synthetic Polynucleotide
taatacgactcactataggggccgcgcagcttctccgcctcgatgtagtgaacagaggagacactacatggaggcggagaacctggcggcagcgcaaaagatg

SEQ ID NO: 201603 - DNA, 103 bp, Artificial Sequence
  Synthetic Polynucleotide
taatacgactcactatagggccaggggtcggccgcgcagcttctccgcctaacagaggagaaggcggatgagctgcgcgaacctggcggcagcgcaaaagatg

SEQ ID NO: 201604 - DNA, 103 bp, Artificial Sequence
  Synthetic Polynucleotide
taatacgactcactatagggacgcacgccacttgctcctgcgtgaagccgaacagaggagacggcttatggcaggagcaaacctggcggcagcgcaaaagatg

SEQ ID NO: 201605 - DNA, 103 bp, Artificial Sequence; identical to SEQ ID NO: 201522
  Synthetic Polynucleotide

SEQ ID NO: 201606 - DNA, 103 bp, Artificial Sequence
  Synthetic Polynucleotide
taatacgactcactataggggcggtatttgcccacggcgcccaggggtcgaacagaggagacgacccatgggcgccgtgaacctggcggcagcgcaaaagatg

SEQ ID NO: 201607 - DNA, 103 bp, Artificial Sequence
  Synthetic Polynucleotide
taatacgactcactatagggtgcggcgcacgcggtatttgcccacggcgcaacagaggagagcgccgatggcaaataccaacctggcggcagcgcaaaagatg

SEQ ID NO: 201608 - DNA, 103 bp, Artificial Sequence
  Synthetic Polynucleotide
taatacgactcactatagggagcgggaatttgcggcgcacgcggtatttgaacagaggagacaaataatgcgtgcgccgaacctggcggcagcgcaaaagatg

SEQ ID NO: 201609 - DNA, 103 bp, Artificial Sequence
  Synthetic Polynucleotide
taatacgactcactatagggggagcgcggcagcgggaatttgcggcgcacaacagaggagagtgcgcatgaaattcccgaacctggcggcagcgcaaaagatg

SEQ ID NO: 201610 - DNA, 103 bp, Artificial Sequence
  Synthetic Polynucleotide
taatacgactcactatagggcgtcccagatggagcgcggcagcgggaattaacagaggagaaattccatgtgccgcgctaacctggcggcagcgcaaaagatg

SEQ ID NO: 201611 - DNA, 103 bp, Artificial Sequence
  Synthetic Polynucleotide
taatacgactcactataggggtctcctcgccgtcccagatggagcgcggcaacagaggagagccgcgatgcatctgggaaacctggcggcagcgcaaaagatg

SEQ ID NO: 201612 - DNA, 103 bp, Artificial Sequence; identical to SEQ ID NO: 201529
  Synthetic Polynucleotide

SEQ ID NO: 201613 - DNA, 103 bp, Artificial Sequence
  Synthetic Polynucleotide
taatacgactcactatagggtttccttgaagcagtagctggtctcctcgcaacagaggagagcgaggatgccagctactaacctggcggcagcgcaaaagatg

SEQ ID NO: 201614 - DNA, 103 bp, Artificial Sequence
  Synthetic Polynucleotide
taatacgactcactatagggctgcgactcttttccttgaagcagtagctgaacagaggagacagctaatgcttcaaggaaacctggcggcagcgcaaaagatg

SEQ ID NO: 201615 - DNA, 103 bp, Artificial Sequence
  Synthetic Polynucleotide
taatacgactcactatagggcacctcgcacacgcacgccacttgctcctgaacagaggagacaggagatggtggcgtgcaacctggcggcagcgcaaaagatg

SEQ ID NO: 201616 - DNA, 103 bp, Artificial Sequence
  Synthetic Polynucleotide
taatacgactcactataggggcgcagcacgctgcgactcttttccttgaaaacagaggagattcaagatgaagagtcgcaacctggcggcagcgcaaaagatg

SEQ ID NO: 201617 - DNA, 103 bp, Artificial Sequence
  Synthetic Polynucleotide
taatacgactcactatagggcgtaccactcgcgcagcacgctgcgactctaacagaggagaagagtcatggcgtgctgcaacctggcggcagcgcaaaagatg

SEQ ID NO: 201618 - DNA, 103 bp, Artificial Sequence
  Synthetic Polynucleotide
taatacgactcactataggggggttgtgcgcgtaccactcgcgcagcacgaacagaggagacgtgctatgcgagtggtaaacctggcggcagcgcaaaagatg

SEQ ID NO: 201619 - DNA, 103 bp, Artificial Sequence
  Synthetic Polynucleotide
taatacgactcactatagggtgaagggtaggggttgtgcgcgtaccactcaacagaggagagagtggatggcgcacaacaacctggcggcagcgcaaaagatg

SEQ ID NO: 201620 - DNA, 103 bp, Artificial Sequence
  Synthetic Polynucleotide
taatacgactcactatagggtctcgcggggtgaagggtaggggttgtgcgaacagaggagacgcacaatgcctacccttaacctggcggcagcgcaaaagatg

SEQ ID NO: 201621 - DNA, 103 bp, Artificial Sequence
  Synthetic Polynucleotide
taatacgactcactatagggagctcacgcttctcgcggggtgaagggtagaacagaggagactacccatgaccccgcgaaacctggcggcagcgcaaaagatg

SEQ ID NO: 201622 - DNA, 103 bp, Artificial Sequence
  Synthetic Polynucleotide
taatacgactcactatagggggcctccgccagctcacgcttctcgcggggaacagaggagaccccgcatgaagcgtgagaacctggcggcagcgcaaaagatg

SEQ ID NO: 201623 - DNA, 103 bp, Artificial Sequence
  Synthetic Polynucleotide
taatacgactcactatagggtgaggcccgtggcctccgccagctcacgctaacagaggagaagcgtgatgtggcggaggaacctggcggcagcgcaaaagatg

SEQ ID NO: 201624 - DNA, 103 bp, Artificial Sequence
  Synthetic Polynucleotide
taatacgactcactatagggtgtgtggtggtgaggcccgtggcctccgccaacagaggagaggcggaatgcacgggcctaacctggcggcagcgcaaaagatg

SEQ ID NO: 201625 - DNA, 103 bp, Artificial Sequence
  Synthetic Polynucleotide
taatacgactcactataggggttgctgacctgtgtggtggtgaggcccgtaacagaggagaacgggcatgaccaccacaaacctggcggcagcgcaaaagatg

SEQ ID NO: 201626 - DNA, 103 bp, Artificial Sequence
  Synthetic Polynucleotide
taatacgactcactatagggcctgctgcagcacctcgcacacgcacgccaaacagaggagatggcgtatgtgtgcgaggaacctggcggcagcgcaaaagatg

SEQ ID NO: 201627 - DNA, 103 bp, Artificial Sequence
  Synthetic Polynucleotide
taatacgactcactatagggtcttgaaccagttgctgacctgtgtggtggaacagaggagaccaccaatgaggtcagcaaacctggcggcagcgcaaaagatg

SEQ ID NO: 201628 - DNA, 103 bp, Artificial Sequence
  Synthetic Polynucleotide
taatacgactcactatagggtgccgccggttcttgaaccagttgctgaccaacagaggagaggtcagatgctggttcaaaacctggcggcagcgcaaaagatg

SEQ ID NO: 201629 - DNA, 103 bp, Artificial Sequence
  Synthetic Polynucleotide
taatacgactcactatagggccggtcgcgctgccgccggttcttgaaccaaacagaggagatggttcatgaaccggcggaacctggcggcagcgcaaaagatg

SEQ ID NO: 201630 - DNA, 103 bp, Artificial Sequence
  Synthetic Polynucleotide
taatacgactcactatagggcctcggccgcccggtcgcgctgccgccggtaacagaggagaaccggcatgagcgcgaccaacctggcggcagcgcaaaagatg

SEQ ID NO: 201631 - DNA, 103 bp, Artificial Sequence
  Synthetic Polynucleotide
taatacgactcactatagggctttccttggcctcggccgcccggtcgcgcaacagaggagagcgcgaatgggcggccgaaacctggcggcagcgcaaaagatg

SEQ ID NO: 201632 - DNA, 103 bp, Artificial Sequence
  Synthetic Polynucleotide
taatacgactcactataggggttgttctccctttccttggcctcggccgcaacagaggagagcggccatggccaaggaaaacctggcggcagcgcaaaagatg

SEQ ID NO: 201633 - DNA, 103 bp, Artificial Sequence
  Synthetic Polynucleotide
taatacgactcactatagggtggagttctcgttgttctccctttccttggaacagaggagaccaaggatggggagaacaaacctggcggcagcgcaaaagatg

SEQ ID NO: 201634 - DNA, 103 bp, Artificial Sequence
  Synthetic Polynucleotide
taatacgactcactatagggctgttagaattggagttctcgttgttctccaacagaggagaggagaaatgcgagaactcaacctggcggcagcgcaaaagatg

SEQ ID NO: 201635 - DNA, 103 bp, Artificial Sequence
  Synthetic Polynucleotide
taatacgactcactatagggcgggttgtggctgttagaattggagttctcaacagaggagagagaacatgaattctaacaacctggcggcagcgcaaaagatg

SEQ ID NO: 201636 - DNA, 103 bp, Artificial Sequence
  Synthetic Polynucleotide
taatacgactcactatagggtgccattcagcgggttgtggctgttagaataacagaggagaattctaatggccacaaccaacctggcggcagcgcaaaagatg

SEQ ID NO: 201637 - DNA, 103 bp, Artificial Sequence
  Synthetic Polynucleotide
taatacgactcactatagggatgttgccgccctgctgcagcacctcgcacaacagaggagagtgcgaatggctgcagcaaacctggcggcagcgcaaaagatg

SEQ ID NO: 201638 - DNA, 103 bp, Artificial Sequence
  Synthetic Polynucleotide
taatacgactcactataggggacttgccgctgccattcagcgggttgtggaacagaggagaccacaaatggctgaatggaacctggcggcagcgcaaaagatg

SEQ ID NO: 201639 - DNA, 103 bp, Artificial Sequence
  Synthetic Polynucleotide
taatacgactcactataggggcctaacaccgacttgccgctgccattcagaacagaggagactgaatatgagcggcaagaacctggcggcagcgcaaaagatg

SEQ ID NO: 201640 - DNA, 103 bp, Artificial Sequence
  Synthetic Polynucleotide
taatacgactcactatagggcctccgagctgcctaacaccgacttgccgcaacagaggagagcggcaatgcggtgttagaacctggcggcagcgcaaaagatg

SEQ ID NO: 201641 - DNA, 103 bp, Artificial Sequence
  Synthetic Polynucleotide
taatacgactcactataggggtcttctcatcctccgagctgcctaacaccaacagaggagaggtgttatgcagctcggaaacctggcggcagcgcaaaagatg

SEQ ID NO: 201642 - DNA, 103 bp, Artificial Sequence
  Synthetic Polynucleotide
taatacgactcactatagggccccgatggagtcttctcatcctccgagctaacagaggagaagctcgatggatgagaagaacctggcggcagcgcaaaagatg

SEQ ID NO: 201643 - DNA, 103 bp, Artificial Sequence
  Synthetic Polynucleotide
taatacgactcactatagggggtctggcgtccccgatggagtcttctcataacagaggagaatgagaatgctccatcggaacctggcggcagcgcaaaagatg

SEQ ID NO: 201644 - DNA, 103 bp, Artificial Sequence
  Synthetic Polynucleotide
taatacgactcactataggggatgatgagtggtctggcgtccccgatggaaacagaggagatccatcatggacgccagaaacctggcggcagcgcaaaagatg

SEQ ID NO: 201645 - DNA, 103 bp, Artificial Sequence
  Synthetic Polynucleotide
taatacgactcactatagggtgcggggctggatgatgagtggtctggcgtaacagaggagaacgccaatgcactcatcaaacctggcggcagcgcaaaagatg

SEQ ID NO: 201646 - DNA, 103 bp, Artificial Sequence
  Synthetic Polynucleotide
taatacgactcactatagggtgaggagcagtgcggggctggatgatgagtaacagaggagaactcatatgccagccccgaacctggcggcagcgcaaaagatg

SEQ ID NO: 201647 - DNA, 103 bp, Artificial Sequence
  Synthetic Polynucleotide
taatacgactcactatagggggcggcgggctgaggagcagtgcggggctgaacagaggagacagcccatgactgctcctaacctggcggcagcgcaaaagatg

SEQ ID NO: 201648 - DNA, 103 bp, Artificial Sequence
  Synthetic Polynucleotide
taatacgactcactatagggcagccgctcgatgttgccgccctgctgcagaacagaggagactgcagatgggcggcaacaacctggcggcagcgcaaaagatg

SEQ ID NO: 201649 - DNA, 103 bp, Artificial Sequence
  Synthetic Polynucleotide
taatacgactcactatagggcagcccagggggcggcgggctgaggagcagaacagaggagactgctcatgagcccgccgaacctggcggcagcgcaaaagatg

SEQ ID NO: 201650 - DNA, 103 bp, Artificial Sequence
  Synthetic Polynucleotide
taatacgactcactataggggcagggacggcagcccagggggcggcgggcaacagaggagagcccgcatgcccctgggcaacctggcggcagcgcaaaagatg

SEQ ID NO: 201651 - DNA, 103 bp, Artificial Sequence
  Synthetic Polynucleotide
taatacgactcactatagggcccaggctgtgcagggacggcagcccagggaacagaggagaccctggatggccgtccctaacctggcggcagcgcaaaagatg

SEQ ID NO: 201652 - DNA, 103 bp, Artificial Sequence
  Synthetic Polynucleotide
taatacgactcactatagggcggagggtggcccaggctgtgcagggacggaacagaggagaccgtccatgcacagcctgaacctggcggcagcgcaaaagatg

SEQ ID NO: 201653 - DNA, 103 bp, Artificial Sequence
  Synthetic Polynucleotide
taatacgactcactatagggcgctggggcccggagggtggcccaggctgtaacagaggagaacagccatggccaccctcaacctggcggcagcgcaaaagatg

SEQ ID NO: 201654 - DNA, 103 bp, Artificial Sequence
  Synthetic Polynucleotide
taatacgactcactatagggactggcactgcgctggggcccggagggtggaacagaggagaccacccatggggccccagaacctggcggcagcgcaaaagatg

SEQ ID NO: 201655 - DNA, 103 bp, Artificial Sequence
  Synthetic Polynucleotide
taatacgactcactatagggtggcaccggcactggcactgcgctggggccaacagaggagaggccccatggcagtgccaaacctggcggcagcgcaaaagatg

SEQ ID NO: 201656 - DNA, 103 bp, Artificial Sequence
  Synthetic Polynucleotide
taatacgactcactatagggcacctccgcctggcaccggcactggcactgaacagaggagacagtgcatgtgccggtgcaacctggcggcagcgcaaaagatg

SEQ ID NO: 201657 - DNA, 103 bp, Artificial Sequence
  Synthetic Polynucleotide
taatacgactcactataggggggtccgctccacctccgcctggcaccggcaacagaggagagccggtatgaggcggaggaacctggcggcagcgcaaaagatg

SEQ ID NO: 201658 - DNA, 103 bp, Artificial Sequence
  Synthetic Polynucleotide
taatacgactcactataggggtgttgcagtgggtccgctccacctccgccaacagaggagaggcggaatgggagcggacaacctggcggcagcgcaaaagatg

SEQ ID NO: 201659 - DNA, 103 bp, Artificial Sequence
  Synthetic Polynucleotide
taatacgactcactatagggggaagcggcccagccgctcgatgttgccgcaacagaggagagcggcaatgtcgagcggcaacctggcggcagcgcaaaagatg

SEQ ID NO: 201660 - DNA, 103 bp, Artificial Sequence
  Synthetic Polynucleotide
taatacgactcactatagggggccatggtggtgttgcagtgggtccgctcaacagaggagagagcggatgcactgcaacaacctggcggcagcgcaaaagatg

SEQ ID NO: 201661 - DNA, 103 bp, Artificial Sequence
  Synthetic Polynucleotide
taatacgactcactataggggagtcctgcaggccatggtggtgttgcagtaacagaggagaactgcaatgccaccatggaacctggcggcagcgcaaaagatg

SEQ ID NO: 201662 - DNA, 103 bp, Artificial Sequence
  Synthetic Polynucleotide
taatacgactcactataggggttgaggatggagtcctgcaggccatggtgaacagaggagacaccatatgctgcaggacaacctggcggcagcgcaaaagatg

SEQ ID NO: 201663 - DNA, 103 bp, Artificial Sequence
  Synthetic Polynucleotide
taatacgactcactatagggctgacatggggttgaggatggagtcctgcaaacagaggagatgcaggatgccatcctcaaacctggcggcagcgcaaaagatg

SEQ ID NO: 201664 - DNA, 103 bp, Artificial Sequence
  Synthetic Polynucleotide
taatacgactcactatagggacgaggttggctgacatggggttgaggatgaacagaggagacatcctatgccccatgtcaacctggcggcagcgcaaaagatg

SEQ ID NO: 201665 - DNA, 103 bp, Artificial Sequence
  Synthetic Polynucleotide
taatacgactcactataggggcccaggtccacgaggttggctgacatgggaacagaggagacccatgatggccaacctcaacctggcggcagcgcaaaagatg

SEQ ID NO: 201666 - DNA, 103 bp, Artificial Sequence
  Synthetic Polynucleotide
taatacgactcactatagggagcgaccacaggaagcggcccagccgctcgaacagaggagacgagcgatggggccgcttaacctggcggcagcgcaaaagatg

SEQ ID NO: 201667 - DNA, 103 bp, Artificial Sequence
  Synthetic Polynucleotide
taatacgactcactatagggatagaggtctaggggggagcggaataccataacagaggagaatggtaatgcgctcccccaacctggcggcagcgcaaaagatg

SEQ ID NO: 201668 - DNA, 103 bp, Artificial Sequence
  Synthetic Polynucleotide
taatacgactcactataggggcctcccgcaccgttcccgccgccgctactaacagaggagaagtagcatgggcgggaacaacctggcggcagcgcaaaagatg

SEQ ID NO: 201669 - DNA, 103 bp, Artificial Sequence
  Synthetic Polynucleotide
taatacgactcactatagggcgccgccgccgcctcccgcaccgttcccgcaacagaggagagcgggaatggtgcgggagaacctggcggcagcgcaaaagatg

SEQ ID NO: 201670 - DNA, 103 bp, Artificial Sequence
  Synthetic Polynucleotide
taatacgactcactatagggccgcctcccgcgccgccgccgcctcccgcaaacagaggagatgcgggatgcggcggcggaacctggcggcagcgcaaaagatg

SEQ ID NO: 201671 - DNA, 103 bp, Artificial Sequence
  Synthetic Polynucleotide
taatacgactcactataggggccgccgctgccgcctcccgcgccgccgccaacagaggagaggcggcatggcgggaggcaacctggcggcagcgcaaaagatg

SEQ ID NO: 201672 - DNA, 103 bp, Artificial Sequence
  Synthetic Polynucleotide
taatacgactcactatagggcaccgttcccgccgccgctgccgcctcccgaacagaggagacgggagatggcagcggcgaacctggcggcagcgcaaaagatg

SEQ ID NO: 201673 - DNA, 103 bp, Artificial Sequence
  Synthetic Polynucleotide
taatacgactcactatagggccgcctcccgcaccgttcccgccgccgctgaacagaggagacagcggatgcgggaacggaacctggcggcagcgcaaaagatg

SEQ ID NO: 201674 - DNA, 103 bp, Artificial Sequence
  Synthetic Polynucleotide
taatacgactcactataggggccagcaccgccgcctcccgcaccgttcccaacagaggagagggaacatggcgggaggcaacctggcggcagcgcaaaagatg

SEQ ID NO: 201675 - DNA, 103 bp, Artificial Sequence
  Synthetic Polynucleotide
taatacgactcactatagggcgcctgctccgccagcaccgccgcctcccgaacagaggagacgggagatggcggtgctgaacctggcggcagcgcaaaagatg

SEQ ID NO: 201676 - DNA, 103 bp, Artificial Sequence
  Synthetic Polynucleotide
taatacgactcactatagggccgccgccgccgcctgctccgccagcaccgaacagaggagacggtgcatgcggagcaggaacctggcggcagcgcaaaagatg

SEQ ID NO: 201677 - DNA, 103 bp, Artificial Sequence
  Synthetic Polynucleotide
taatacgactcactatagggggagccgccgccgccgccgccgcctgctccaacagaggagaggagcaatgggcggcggcaacctggcggcagcgcaaaagatg

SEQ ID NO: 201678 - DNA, 103 bp, Artificial Sequence
  Synthetic Polynucleotide
taatacgactcactatagggagtgggaggaatagaggtctaggggggagcaacagaggagagctcccatgtagacctctaacctggcggcagcgcaaaagatg

SEQ ID NO: 201679 - DNA, 103 bp, Artificial Sequence
  Synthetic Polynucleotide
taatacgactcactatagggggggggccctggagccgccgccgccgccgcaacagaggagagcggcgatggcggcggctaacctggcggcagcgcaaaagatg

SEQ ID NO: 201680 - DNA, 103 bp, Artificial Sequence
  Synthetic Polynucleotide
taatacgactcactatagggaactcttccgggggggccctggagccgccgaacagaggagacggcggatgcagggccccaacctggcggcagcgcaaaagatg

SEQ ID NO: 201681 - DNA, 103 bp, Artificial Sequence
  Synthetic Polynucleotide
taatacgactcactataggggaacatggacaactcttccgggggggccctaacagaggagaagggccatgccggaagagaacctggcggcagcgcaaaagatg

SEQ ID NO: 201682 - DNA, 103 bp, Artificial Sequence
  Synthetic Polynucleotide
taatacgactcactatagggtgggcagctggaacatggacaactcttccgaacagaggagacggaagatgtgtccatgtaacctggcggcagcgcaaaagatg

SEQ ID NO: 201683 - DNA, 103 bp, Artificial Sequence
  Synthetic Polynucleotide
taatacgactcactatagggaagttgagggtgggcagctggaacatggacaacagaggagagtccatatgccagctgccaacctggcggcagcgcaaaagatg

SEQ ID NO: 201684 - DNA, 103 bp, Artificial Sequence
  Synthetic Polynucleotide
taatacgactcactatagggctccggcgagaagttgagggtgggcagctgaacagaggagacagctgatgaccctcaacaacctggcggcagcgcaaaagatg

SEQ ID NO: 201685 - DNA, 103 bp, Artificial Sequence
  Synthetic Polynucleotide
taatacgactcactatagggtggccacctgctccggcgagaagttgagggaacagaggagaccctcaatgtctcgccggaacctggcggcagcgcaaaagatg

SEQ ID NO: 201686 - DNA, 103 bp, Artificial Sequence
  Synthetic Polynucleotide
taatacgactcactatagggtcacagacgctggccacctgctccggcgagaacagaggagactcgccatggcaggtggcaacctggcggcagcgcaaaagatg

SEQ ID NO: 201687 - DNA, 103 bp, Artificial Sequence
  Synthetic Polynucleotide
taatacgactcactatagggctccagcgtctcacagacgctggccacctgaacagaggagacaggtgatgagcgtctgtaacctggcggcagcgcaaaagatg

SEQ ID NO: 201688 - DNA, 103 bp, Artificial Sequence
  Synthetic Polynucleotide
taatacgactcactatagggcgcccgtctcctccagcgtctcacagacgcaacagaggagagcgtctatgagacgctggaacctggcggcagcgcaaaagatg

SEQ ID NO: 201689 - DNA, 103 bp, Artificial Sequence
  Synthetic Polynucleotide
taatacgactcactatagggggcaacaagaagtgggaggaatagaggtctaacagaggagaagacctatgttcctcccaaacctggcggcagcgcaaaagatg

SEQ ID NO: 201690 - DNA, 103 bp, Artificial Sequence
  Synthetic Polynucleotide
taatacgactcactatagggcgctcgatgtcgcccgtctcctccagcgtcaacagaggagagacgctatgggagacgggaacctggcggcagcgcaaaagatg

SEQ ID NO: 201691 - DNA, 103 bp, Artificial Sequence
  Synthetic Polynucleotide
taatacgactcactataggggcggcccagccgctcgatgtcgcccgtctcaacagaggagagagacgatggacatcgagaacctggcggcagcgcaaaagatg

SEQ ID NO: 201692 - DNA, 103 bp, Artificial Sequence
  Synthetic Polynucleotide
taatacgactcactatagggaccagaggaagcggcccagccgctcgatgtaacagaggagaacatcgatgggctgggccaacctggcggcagcgcaaaagatg

SEQ ID NO: 201693 - DNA, 103 bp, Artificial Sequence
  Synthetic Polynucleotide
taatacgactcactatagggacgggcagcgaccagaggaagcggcccagcaacagaggagagctgggatgcttcctctgaacctggcggcagcgcaaaagatg

SEQ ID NO: 201694 - DNA, 103 bp, Artificial Sequence
  Synthetic Polynucleotide
taatacgactcactatagggcccgggggccacgggcagcgaccagaggaaaacagaggagattcctcatgtcgctgcccaacctggcggcagcgcaaaagatg

SEQ ID NO: 201695 - DNA, 103 bp, Artificial Sequence
  Synthetic Polynucleotide
taatacgactcactatagggcctcgcacgccccgggggccacgggcagcgaacagaggagacgctgcatgtggcccccgaacctggcggcagcgcaaaagatg

SEQ ID NO: 201696 - DNA, 103 bp, Artificial Sequence
  Synthetic Polynucleotide
taatacgactcactatagggttgttgatggcctcgcacgccccgggggccaacagaggagaggccccatgggcgtgcgaaacctggcggcagcgcaaaagatg

SEQ ID NO: 201697 - DNA, 103 bp, Artificial Sequence
  Synthetic Polynucleotide
taatacgactcactatagggcgactcgtgtttgttgatggcctcgcacgcaacagaggagagcgtgcatggccatcaacaacctggcggcagcgcaaaagatg

SEQ ID NO: 201698 - DNA, 103 bp, Artificial Sequence
  Synthetic Polynucleotide
taatacgactcactatagggcgcgcaggatcgactcgtgtttgttgatggaacagaggagaccatcaatgaacacgagtaacctggcggcagcgcaaaagatg

SEQ ID NO: 201699 - DNA, 103 bp, Artificial Sequence
  Synthetic Polynucleotide
taatacgactcactatagggacggcgcgcgcgcgcaggatcgactcgtgtaacagaggagaacacgaatggatcctgcgaacctggcggcagcgcaaaagatg

SEQ ID NO: 201700 - DNA, 103 bp, Artificial Sequence
  Synthetic Polynucleotide
taatacgactcactatagggggcgaagtttggcaacaagaagtgggaggaaacagaggagatcctccatgttcttgttgaacctggcggcagcgcaaaagatg

SEQ ID NO: 201701 - DNA, 103 bp, Artificial Sequence
  Synthetic Polynucleotide
taatacgactcactataggggaaggcgaccacggcgcgcgcgcgcaggataacagaggagaatcctgatggcgcgcgccaacctggcggcagcgcaaaagatg

SEQ ID NO: 201702 - DNA, 103 bp, Artificial Sequence
  Synthetic Polynucleotide
taatacgactcactatagggtgcccgtgtggaaggcgaccacggcgcgcgaacagaggagacgcgcgatgtggtcgcctaacctggcggcagcgcaaaagatg

SEQ ID NO: 201703 - DNA, 103 bp, Artificial Sequence
  Synthetic Polynucleotide
taatacgactcactatagggtcgcggaagttgcccgtgtggaaggcgaccaacagaggagaggtcgcatgccacacgggaacctggcggcagcgcaaaagatg

SEQ ID NO: 201704 - DNA, 103 bp, Artificial Sequence
  Synthetic Polynucleotide
taatacgactcactataggggtggtagaggtcgcggaagttgcccgtgtgaacagaggagacacacgatgaacttccgcaacctggcggcagcgcaaaagatg

SEQ ID NO: 201705 - DNA, 103 bp, Artificial Sequence
  Synthetic Polynucleotide
taatacgactcactatagggtctcaaggatgtggtagaggtcgcggaagtaacagaggagaacttccatgacctctaccaacctggcggcagcgcaaaagatg

SEQ ID NO: 201706 - DNA, 103 bp, Artificial Sequence
  Synthetic Polynucleotide
taatacgactcactatagggaacttgtggttctcaaggatgtggtagaggaacagaggagacctctaatgcatccttgaaacctggcggcagcgcaaaagatg

SEQ ID NO: 201707 - DNA, 103 bp, Artificial Sequence
  Synthetic Polynucleotide
taatacgactcactatagggctccttggtgaacttgtggttctcaaggataacagaggagaatccttatgaaccacaagaacctggcggcagcgcaaaagatg

SEQ ID NO: 201708 - DNA, 103 bp, Artificial Sequence
  Synthetic Polynucleotide
taatacgactcactatagggtgccgtgagactccttggtgaacttgtggtaacagaggagaaccacaatgtcaccaaggaacctggcggcagcgcaaaagatg

SEQ ID NO: 201709 - DNA, 103 bp, Artificial Sequence
  Synthetic Polynucleotide
taatacgactcactataggggcctgcagcttgccgtgagactccttggtgaacagaggagacaccaaatggtctcacggaacctggcggcagcgcaaaagatg

SEQ ID NO: 201710 - DNA, 103 bp, Artificial Sequence
  Synthetic Polynucleotide
taatacgactcactataggggagccacatggcctgcagcttgccgtgagaaacagaggagatctcacatgaagctgcagaacctggcggcagcgcaaaagatg

SEQ ID NO: 201711 - DNA, 103 bp, Artificial Sequence
  Synthetic Polynucleotide
taatacgactcactatagggggtgagaatcggcgaagtttggcaacaagaaacagaggagatcttgtatgcaaacttcgaacctggcggcagcgcaaaagatg

SEQ ID NO: 201712 - DNA, 103 bp, Artificial Sequence
  Synthetic Polynucleotide
taatacgactcactatagggagtgcgcctcgagccacatggcctgcagctaacagaggagaagctgcatgccatgtggcaacctggcggcagcgcaaaagatg

SEQ ID NO: 201713 - DNA, 103 bp, Artificial Sequence
  Synthetic Polynucleotide
taatacgactcactataggggcctcctggtagtgcgcctcgagccacatgaacagaggagacatgtgatgcgaggcgcaaacctggcggcagcgcaaaagatg

SEQ ID NO: 201714 - DNA, 103 bp, Artificial Sequence
  Synthetic Polynucleotide
taatacgactcactatagggcagcttctcggcctcctggtagtgcgcctcaacagaggagagaggcgatgtaccaggagaacctggcggcagcgcaaaagatg

SEQ ID NO: 201715 - DNA, 103 bp, Artificial Sequence
  Synthetic Polynucleotide
taatacgactcactatagggggcggccgcgcagcttctcggcctcctggtaacagaggagaaccaggatgccgagaagcaacctggcggcagcgcaaaagatg

SEQ ID NO: 201716 - DNA, 103 bp, Artificial Sequence
  Synthetic Polynucleotide
taatacgactcactataggggggccgagtgggcggccgcgcagcttctcgaacagaggagacgagaaatggcgcggccgaacctggcggcagcgcaaaagatg

SEQ ID NO: 201717 - DNA, 103 bp, Artificial Sequence
  Synthetic Polynucleotide
taatacgactcactatagggcttgtccaccgggccgagtgggcggccgcgaacagaggagacgcggcatgccactcggcaacctggcggcagcgcaaaagatg

SEQ ID NO: 201718 - DNA, 103 bp, Artificial Sequence
  Synthetic Polynucleotide
taatacgactcactataggggcacgcggtacttgtccaccgggccgagtgaacagaggagacactcgatgcggtggacaaacctggcggcagcgcaaaagatg

SEQ ID NO: 201719 - DNA, 103 bp, Artificial Sequence
  Synthetic Polynucleotide
taatacgactcactatagggaacttcttgcgcacgcggtacttgtccaccaacagaggagaggtggaatggtaccgcgtaacctggcggcagcgcaaaagatg

SEQ ID NO: 201720 - DNA, 103 bp, Artificial Sequence
  Synthetic Polynucleotide
taatacgactcactatagggtggcagcgggaacttcttgcgcacgcggtaaacagaggagataccgcatgcgcaagaagaacctggcggcagcgcaaaagatg

SEQ ID NO: 201721 - DNA, 103 bp, Artificial Sequence
  Synthetic Polynucleotide
taatacgactcactatagggagatggtgcgtggcagcgggaacttcttgcaacagaggagagcaagaatgtcccgctgcaacctggcggcagcgcaaaagatg

SEQ ID NO: 201722 - DNA, 103 bp, Artificial Sequence
  Synthetic Polynucleotide
taatacgactcactatagggatggagcggtggtgagaatcggcgaagtttaacagaggagaaaacttatgcgattctcaaacctggcggcagcgcaaaagatg

SEQ ID NO: 201723 - DNA, 103 bp, Artificial Sequence
  Synthetic Polynucleotide
taatacgactcactatagggtcgccgtcccagatggtgcgtggcagcgggaacagaggagacccgctatgacgcaccataacctggcggcagcgcaaaagatg

SEQ ID NO: 201724 - DNA, 103 bp, Artificial Sequence
  Synthetic Polynucleotide
taatacgactcactatagggcgtcttctgctcgccgtcccagatggtgcgaacagaggagacgcaccatgtgggacggcaacctggcggcagcgcaaaagatg

SEQ ID NO: 201725 - DNA, 103 bp, Artificial Sequence
  Synthetic Polynucleotide
taatacgactcactatagggtgaagcaatgcgtcttctgctcgccgtcccaacagaggagagggacgatgagcagaagaaacctggcggcagcgcaaaagatg

SEQ ID NO: 201726 - DNA, 103 bp, Artificial Sequence
  Synthetic Polynucleotide
taatacgactcactataggggtccgctccttgaagcaatgcgtcttctgcaacagaggagagcagaaatggcattgcttaacctggcggcagcgcaaaagatg

SEQ ID NO: 201727 - DNA, 103 bp, Artificial Sequence
  Synthetic Polynucleotide
taatacgactcactatagggcaggctccgagtccgctccttgaagcaatgaacagaggagacattgcatgaaggagcggaacctggcggcagcgcaaaagatg

SEQ ID NO: 201728 - DNA, 103 bp, Artificial Sequence
  Synthetic Polynucleotide
taatacgactcactatagggactcccgcaacaggctccgagtccgctcctaacagaggagaaggagcatgctcggagccaacctggcggcagcgcaaaagatg

SEQ ID NO: 201729 - DNA, 103 bp, Artificial Sequence
  Synthetic Polynucleotide
taatacgactcactatagggtgtaggtaccactcccgcaacaggctccgaaacagaggagatcggagatggttgcgggaaacctggcggcagcgcaaaagatg

SEQ ID NO: 201730 - DNA, 103 bp, Artificial Sequence
  Synthetic Polynucleotide
taatacgactcactataggggtaggggtcctgtaggtaccactcccgcaaaacagaggagattgcggatgtggtacctaaacctggcggcagcgcaaaagatg

SEQ ID NO: 201731 - DNA, 103 bp, Artificial Sequence
  Synthetic Polynucleotide
taatacgactcactatagggtggggttggggtaggggtcctgtaggtaccaacagaggagaggtaccatgaggacccctaacctggcggcagcgcaaaagatg

SEQ ID NO: 201732 - DNA, 103 bp, Artificial Sequence
  Synthetic Polynucleotide
taatacgactcactatagggcgtttcttgctggggttggggtaggggtccaacagaggagaggacccatgccccaacccaacctggcggcagcgcaaaagatg

SEQ ID NO: 201733 - DNA, 103 bp, Artificial Sequence
  Synthetic Polynucleotide
taatacgactcactatagggcgccagaagtatggagcggtggtgagaatcaacagaggagagattctatgcaccgctccaacctggcggcagcgcaaaagatg

SEQ ID NO: 201734 - DNA, 103 bp, Artificial Sequence
  Synthetic Polynucleotide
taatacgactcactatagggcgccagttcgcgtttcttgctggggttgggaacagaggagacccaacatgagcaagaaaaacctggcggcagcgcaaaagatg

SEQ ID NO: 201735 - DNA, 103 bp, Artificial Sequence
  Synthetic Polynucleotide
taatacgactcactatagggcggtggcctgcgccagttcgcgtttcttgcaacagaggagagcaagaatggcgaactggaacctggcggcagcgcaaaagatg

SEQ ID NO: 201736 - DNA, 103 bp, Artificial Sequence
  Synthetic Polynucleotide
taatacgactcactatagggggagtgaggccggtggcctgcgccagttcgaacagaggagacgaactatggcaggccacaacctggcggcagcgcaaaagatg

SEQ ID NO: 201737 - DNA, 103 bp, Artificial Sequence
  Synthetic Polynucleotide
taatacgactcactatagggtacttgtgtgggagtgaggccggtggcctgaacagaggagacaggccatgggcctcactaacctggcggcagcgcaaaagatg

SEQ ID NO: 201738 - DNA, 103 bp, Artificial Sequence
  Synthetic Polynucleotide
taatacgactcactatagggaccagttgcctacttgtgtgggagtgaggcaacagaggagagcctcaatgccacacaagaacctggcggcagcgcaaaagatg

SEQ ID NO: 201739 - DNA, 103 bp, Artificial Sequence
  Synthetic Polynucleotide
taatacgactcactatagggcggttcttaaaccagttgcctacttgtgtgaacagaggagacacacaatgaggcaactgaacctggcggcagcgcaaaagatg

SEQ ID NO: 201740 - DNA, 103 bp, Artificial Sequence
  Synthetic Polynucleotide
taatacgactcactataggggcgctgccgccggttcttaaaccagttgccaacagaggagaggcaacatgtttaagaacaacctggcggcagcgcaaaagatg

SEQ ID NO: 201741 - DNA, 103 bp, Artificial Sequence
  Synthetic Polynucleotide
taatacgactcactatagggcggcgcggtcgcgctgccgccggttcttaaaacagaggagattaagaatgggcggcagcaacctggcggcagcgcaaaagatg

SEQ ID NO: 201742 - DNA, 103 bp, Artificial Sequence
  Synthetic Polynucleotide
taatacgactcactatagggttggccgccgcggcgcggtcgcgctgccgcaacagaggagagcggcaatgcgaccgcgcaacctggcggcagcgcaaaagatg

SEQ ID NO: 201743 - DNA, 103 bp, Artificial Sequence
  Synthetic Polynucleotide
taatacgactcactataggggagcctgttcttggccgccgcggcgcggtcaacagaggagagaccgcatggcggcggccaacctggcggcagcgcaaaagatg

SEQ ID NO: 201744 - DNA, 103 bp, Artificial Sequence
  Synthetic Polynucleotide
taatacgactcactatagggcgccgctactcgccagaagtatggagcggtaacagaggagaaccgctatgtacttctggaacctggcggcagcgcaaaagatg

SEQ ID NO: 201745 - DNA, 103 bp, Artificial Sequence
  Synthetic Polynucleotide
taatacgactcactatagggcctggtgctggagcctgttcttggccgccgaacagaggagacggcggatgagaacaggcaacctggcggcagcgcaaaagatg

SEQ ID NO: 201746 - DNA, 103 bp, Artificial Sequence
  Synthetic Polynucleotide
taatacgactcactatagggggtccaatggcctggtgctggagcctgttcaacagaggagagaacagatgccagcaccaaacctggcggcagcgcaaaagatg

SEQ ID NO: 201747 - DNA, 103 bp, Artificial Sequence
  Synthetic Polynucleotide
taatacgactcactatagggcatgccgctcggtccaatggcctggtgctgaacagaggagacagcacatggccattggaaacctggcggcagcgcaaaagatg

SEQ ID NO: 201748 - DNA, 103 bp, Artificial Sequence
  Synthetic Polynucleotide
taatacgactcactatagggccagcgagcgcatgccgctcggtccaatggaacagaggagaccattgatgcgagcggcaaacctggcggcagcgcaaaagatg

SEQ ID NO: 201749 - DNA, 103 bp, Artificial Sequence
  Synthetic Polynucleotide
taatacgactcactatagggccgggctcggccagcgagcgcatgccgctcaacagaggagagagcggatggcgctcgctaacctggcggcagcgcaaaagatg

SEQ ID NO: 201750 - DNA, 103 bp, Artificial Sequence
  Synthetic Polynucleotide
taatacgactcactatagggcgtggggcagccgggctcggccagcgagcgaacagaggagacgctcgatggccgagcccaacctggcggcagcgcaaaagatg

SEQ ID NO: 201751 - DNA, 103 bp, Artificial Sequence
  Synthetic Polynucleotide
taatacgactcactatagggccgagccgtgcgtggggcagccgggctcggaacagaggagaccgagcatggctgccccaaacctggcggcagcgcaaaagatg

SEQ ID NO: 201752 - DNA, 103 bp, Artificial Sequence
  Synthetic Polynucleotide
taatacgactcactatagggggcgactctgccgagccgtgcgtggggcagaacagaggagactgcccatggcacggctcaacctggcggcagcgcaaaagatg

SEQ ID NO: 201753 - DNA, 103 bp, Artificial Sequence
  Synthetic Polynucleotide
taatacgactcactatagggcgccgtggacggcgactctgccgagccgtgaacagaggagacacggcatggcagagtcgaacctggcggcagcgcaaaagatg

SEQ ID NO: 201754 - DNA, 103 bp, Artificial Sequence
  Synthetic Polynucleotide
taatacgactcactatagggtcgggctggccgccgtggacggcgactctgaacagaggagacagagtatgcgtccacggaacctggcggcagcgcaaaagatg

SEQ ID NO: 201755 - DNA, 103 bp, Artificial Sequence
  Synthetic Polynucleotide
taatacgactcactatagggccgttcccgccgccgctactcgccagaagtaacagaggagaacttctatggagtagcggaacctggcggcagcgcaaaagatg

SEQ ID NO: 201756 - DNA, 103 bp, Artificial Sequence
  Synthetic Polynucleotide
taatacgactcactatagggacgctggtggtcgggctggccgccgtggacaacagaggagagtccacatgggccagcccaacctggcggcagcgcaaaagatg

SEQ ID NO: 201757 - DNA, 103 bp, Artificial Sequence
  Synthetic Polynucleotide
taatacgactcactatagggcaggctggacacgctggtggtcgggctggcaacagaggagagccagcatgaccaccagcaacctggcggcagcgcaaaagatg

SEQ ID NO: 201758 - DNA, 103 bp, Artificial Sequence
  Synthetic Polynucleotide
taatacgactcactatagggcgcgctccgtcaggctggacacgctggtggaacagaggagaccaccaatgtgtccagccaacctggcggcagcgcaaaagatg

SEQ ID NO: 201759 - DNA, 103 bp, Artificial Sequence
  Synthetic Polynucleotide
taatacgactcactatagggccggtgtctgcgcgctccgtcaggctggacaacagaggagagtccagatggacggagcgaacctggcggcagcgcaaaagatg

SEQ ID NO: 201760 - DNA, 103 bp, Artificial Sequence
  Synthetic Polynucleotide
taatacgactcactataggggatggaggtgccggtgtctgcgcgctccgtaacagaggagaacggagatggcagacaccaacctggcggcagcgcaaaagatg

SEQ ID NO: 201761 - DNA, 103 bp, Artificial Sequence
  Synthetic Polynucleotide
taatacgactcactatagggttaccgagaggatggaggtgccggtgtctgaacagaggagacagacaatggcacctccaaacctggcggcagcgcaaaagatg

SEQ ID NO: 201762 - DNA, 103 bp, Artificial Sequence
  Synthetic Polynucleotide
taatacgactcactatagggtcgctggaggttaccgagaggatggaggtgaacagaggagacacctcatgcctctcggtaacctggcggcagcgcaaaagatg

SEQ ID NO: 201763 - DNA, 103 bp, Artificial Sequence
  Synthetic Polynucleotide
taatacgactcactatagggacattccgagtcgctggaggttaccgagagaacagaggagactctcgatgacctccagcaacctggcggcagcgcaaaagatg

SEQ ID NO: 201764 - DNA, 103 bp, Artificial Sequence
  Synthetic Polynucleotide
taatacgactcactataggggatctgcccggtgggggaggaagaggacataacagaggagaatgtccatgtcctcccccaacctggcggcagcgcaaaagatg

SEQ ID NO: 201765 - DNA, 103 bp, Artificial Sequence
  Synthetic Polynucleotide
taatacgactcactatagggcgccgcgccccccgccacttctcggtgcgcaacagaggagagcgcacatggaagtggcgaacctggcggcagcgcaaaagatg

SEQ ID NO: 201766 - DNA, 103 bp, Artificial Sequence
  Synthetic Polynucleotide
taatacgactcactatagggcttagcatttccaatttgttgcatatatacaacagaggagagtatatatgcaacaaattaacctggcggcagcgcaaaagatg

SEQ ID NO: 201767 - DNA, 103 bp, Artificial Sequence
  Synthetic Polynucleotide
taatacgactcactatagggttaatgatatcttagcatttccaatttgttaacagaggagaaacaaaatggaaatgctaaacctggcggcagcgcaaaagatg

SEQ ID NO: 201768 - DNA, 103 bp, Artificial Sequence
  Synthetic Polynucleotide
taatacgactcactatagggccagaagagcttaatgatatcttagcatttaacagaggagaaaatgcatggatatcattaacctggcggcagcgcaaaagatg

SEQ ID NO: 201769 - DNA, 103 bp, Artificial Sequence
  Synthetic Polynucleotide
taatacgactcactatagggcaacagaactccagaagagcttaatgatataacagaggagaatatcaatgagctcttctaacctggcggcagcgcaaaagatg

SEQ ID NO: 201770 - DNA, 103 bp, Artificial Sequence
  Synthetic Polynucleotide
taatacgactcactatagggagcttccattcaacagaactccagaagagcaacagaggagagctcttatggagttctgtaacctggcggcagcgcaaaagatg

SEQ ID NO: 201771 - DNA, 103 bp, Artificial Sequence
  Synthetic Polynucleotide
taatacgactcactataggggcaggtaccaagcttccattcaacagaactaacagaggagaagttctatggaatggaagaacctggcggcagcgcaaaagatg

SEQ ID NO: 201772 - DNA, 103 bp, Artificial Sequence
  Synthetic Polynucleotide
taatacgactcactatagggtgaagtacttgcaggtaccaagcttccattaacagaggagaaatggaatgttggtacctaacctggcggcagcgcaaaagatg

SEQ ID NO: 201773 - DNA, 103 bp, Artificial Sequence
  Synthetic Polynucleotide
taatacgactcactatagggggaagacaggtgaagtacttgcaggtaccaaacagaggagatggtacatgcaagtacttaacctggcggcagcgcaaaagatg

SEQ ID NO: 201774 - DNA, 103 bp, Artificial Sequence
  Synthetic Polynucleotide
taatacgactcactatagggtttccattaaggaagacaggtgaagtacttaacagaggagaaagtacatgacctgtcttaacctggcggcagcgcaaaagatg

SEQ ID NO: 201775 - DNA, 103 bp, Artificial Sequence
  Synthetic Polynucleotide
taatacgactcactatagggaataaaagaatttccattaaggaagacaggaacagaggagacctgtcatgcttaatggaaacctggcggcagcgcaaaagatg

SEQ ID NO: 201776 - DNA, 103 bp, Artificial Sequence
  Synthetic Polynucleotide
taatacgactcactatagggtcagccctaccgccgcgccccccgccacttaacagaggagaaagtggatgggggcgcggaacctggcggcagcgcaaaagatg

SEQ ID NO: 201777 - DNA, 103 bp, Artificial Sequence
  Synthetic Polynucleotide
taatacgactcactatagggtgggtccctgaataaaagaatttccattaaaacagaggagattaatgatgattcttttaaacctggcggcagcgcaaaagatg

SEQ ID NO: 201778 - DNA, 103 bp, Artificial Sequence
  Synthetic Polynucleotide
taatacgactcactatagggataactccactgggtccctgaataaaagaaaacagaggagattctttatgtcagggaccaacctggcggcagcgcaaaagatg

SEQ ID NO: 201779 - DNA, 103 bp, Artificial Sequence
  Synthetic Polynucleotide
taatacgactcactatagggtccattaaggataactccactgggtccctgaacagaggagacagggaatgagtggagttaacctggcggcagcgcaaaagatg

SEQ ID NO: 201780 - DNA, 103 bp, Artificial Sequence
  Synthetic Polynucleotide
taatacgactcactatagggccacatttaatccattaaggataactccacaacagaggagagtggagatgtccttaatgaacctggcggcagcgcaaaagatg

SEQ ID NO: 201781 - DNA, 103 bp, Artificial Sequence
  Synthetic Polynucleotide
taatacgactcactatagggtgtgtatttcccacatttaatccattaaggaacagaggagaccttaaatgattaaatgtaacctggcggcagcgcaaaagatg

SEQ ID NO: 201782 - DNA, 103 bp, Artificial Sequence
  Synthetic Polynucleotide
taatacgactcactatagggtgccactgcctgtgtatttcccacatttaaaacagaggagattaaatatgggaaatacaaacctggcggcagcgcaaaagatg

SEQ ID NO: 201783 - DNA, 103 bp, Artificial Sequence
  Synthetic Polynucleotide
taatacgactcactataggggtgggttcaatgccactgcctgtgtatttcaacagaggagagaaataatgaggcagtggaacctggcggcagcgcaaaagatg

SEQ ID NO: 201784 - DNA, 103 bp, Artificial Sequence
  Synthetic Polynucleotide
taatacgactcactataggggacatttttggtgggttcaatgccactgccaacagaggagaggcagtatgattgaacccaacctggcggcagcgcaaaagatg

SEQ ID NO: 201785 - DNA, 103 bp, Artificial Sequence
  Synthetic Polynucleotide
taatacgactcactatagggaatgtttgatgacatttttggtgggttcaaaacagaggagattgaacatgccaaaaatgaacctggcggcagcgcaaaagatg

SEQ ID NO: 201786 - DNA, 103 bp, Artificial Sequence
  Synthetic Polynucleotide
taatacgactcactatagggcattgctcacaatgtttgatgacatttttgaacagaggagacaaaaaatgcatcaaacaaacctggcggcagcgcaaaagatg

SEQ ID NO: 201787 - DNA, 103 bp, Artificial Sequence
  Synthetic Polynucleotide
taatacgactcactataggggccggggggctcagccctaccgccgcgcccaacagaggagagggcgcatgggtagggctaacctggcggcagcgcaaaagatg

SEQ ID NO: 201788 - DNA, 103 bp, Artificial Sequence
  Synthetic Polynucleotide
taatacgactcactatagggatggatataccattgctcacaatgtttgataacagaggagaatcaaaatgtgtgagcaaaacctggcggcagcgcaaaagatg

SEQ ID NO: 201789 - DNA, 103 bp, Artificial Sequence
  Synthetic Polynucleotide
taatacgactcactatagggtatgtcagtcatggatataccattgctcacaacagaggagagtgagcatgggtatatccaacctggcggcagcgcaaaagatg

SEQ ID NO: 201790 - DNA, 103 bp, Artificial Sequence
  Synthetic Polynucleotide
taatacgactcactatagggtagaccccagtatgtcagtcatggatatacaacagaggagagtatatatgtgactgacaaacctggcggcagcgcaaaagatg

SEQ ID NO: 201791 - DNA, 103 bp, Artificial Sequence
  Synthetic Polynucleotide
taatacgactcactatagggtcctgggaagtagaccccagtatgtcagtcaacagaggagagactgaatgactggggtcaacctggcggcagcgcaaaagatg

SEQ ID NO: 201792 - DNA, 103 bp, Artificial Sequence
  Synthetic Polynucleotide
taatacgactcactatagggttccttcacgtcctgggaagtagaccccagaacagaggagactggggatgacttcccagaacctggcggcagcgcaaaagatg

SEQ ID NO: 201793 - DNA, 103 bp, Artificial Sequence
  Synthetic Polynucleotide
taatacgactcactatagggggactttgaattccttcacgtcctgggaagaacagaggagacttcccatgacgtgaaggaacctggcggcagcgcaaaagatg

SEQ ID NO: 201794 - DNA, 103 bp, Artificial Sequence
  Synthetic Polynucleotide
taatacgactcactataggggaactctggaggactttgaattccttcacgaacagaggagacgtgaaatgattcaaagtaacctggcggcagcgcaaaagatg

SEQ ID NO: 201795 - DNA, 103 bp, Artificial Sequence
  Synthetic Polynucleotide
taatacgactcactatagggtgagttagcagaactctggaggactttgaaaacagaggagattcaaaatgctccagagtaacctggcggcagcgcaaaagatg

SEQ ID NO: 201796 - DNA, 103 bp, Artificial Sequence
  Synthetic Polynucleotide
taatacgactcactatagggtggtggttgctgagttagcagaactctggaaacagaggagatccagaatgctgctaactaacctggcggcagcgcaaaagatg

SEQ ID NO: 201797 - DNA, 103 bp, Artificial Sequence
  Synthetic Polynucleotide
taatacgactcactatagggctgtaggacgtggtggttgctgagttagcaaacagaggagatgctaaatgagcaaccacaacctggcggcagcgcaaaagatg

SEQ ID NO: 201798 - DNA, 103 bp, Artificial Sequence
  Synthetic Polynucleotide
taatacgactcactatagggaggggctggagccggggggctcagccctacaacagaggagagtagggatgagccccccgaacctggcggcagcgcaaaagatg

SEQ ID NO: 201799 - DNA, 103 bp, Artificial Sequence
  Synthetic Polynucleotide
taatacgactcactataggggacactggggctgtaggacgtggtggttgcaacagaggagagcaaccatgacgtcctacaacctggcggcagcgcaaaagatg

SEQ ID NO: 201800 - DNA, 103 bp, Artificial Sequence
  Synthetic Polynucleotide
taatacgactcactatagggatgagacagggacactggggctgtaggacgaacagaggagacgtcctatggccccagtgaacctggcggcagcgcaaaagatg

SEQ ID NO: 201801 - DNA, 103 bp, Artificial Sequence
  Synthetic Polynucleotide
taatacgactcactatagggaggcctgggaatgagacagggacactggggaacagaggagaccccagatgccctgtctcaacctggcggcagcgcaaaagatg

SEQ ID NO: 201802 - DNA, 103 bp, Artificial Sequence
  Synthetic Polynucleotide
taatacgactcactataggggctgggtatcaggcctgggaatgagacaggaacagaggagacctgtcatgttcccaggcaacctggcggcagcgcaaaagatg

SEQ ID NO: 201803 - DNA, 103 bp, Artificial Sequence
  Synthetic Polynucleotide
taatacgactcactatagggtcacctcagtgctgggtatcaggcctgggaaacagaggagatcccagatgtgatacccaaacctggcggcagcgcaaaagatg

SEQ ID NO: 201804 - DNA, 103 bp, Artificial Sequence
  Synthetic Polynucleotide
taatacgactcactatagggccttctcttttcacctcagtgctgggtatcaacagaggagagataccatgcactgaggtaacctggcggcagcgcaaaagatg

SEQ ID NO: 201805 - DNA, 103 bp, Artificial Sequence
  Synthetic Polynucleotide
taatacgactcactatagggtgtttgaatgccttctcttttcacctcagtaacagaggagaactgagatgaaaagagaaaacctggcggcagcgcaaaagatg

SEQ ID NO: 201806 - DNA, 103 bp, Artificial Sequence
  Synthetic Polynucleotide
taatacgactcactataggggggaagccactgtttgaatgccttctctttaacagaggagaaaagagatggcattcaaaaacctggcggcagcgcaaaagatg

SEQ ID NO: 201807 - DNA, 103 bp, Artificial Sequence
  Synthetic Polynucleotide
taatacgactcactatagggcctccatcttgggaagccactgtttgaatgaacagaggagacattcaatgagtggcttcaacctggcggcagcgcaaaagatg

SEQ ID NO: 201808 - DNA, 103 bp, Artificial Sequence
  Synthetic Polynucleotide
taatacgactcactatagggcactacagaccctccatcttgggaagccacaacagaggagagtggctatgcaagatggaaacctggcggcagcgcaaaagatg

SEQ ID NO: 201809 - DNA, 103 bp, Artificial Sequence
  Synthetic Polynucleotide
taatacgactcactatagggccaggggaaaaggggctggagccggggggcaacagaggagagcccccatgctccagcccaacctggcggcagcgcaaaagatg

SEQ ID NO: 201810 - DNA, 103 bp, Artificial Sequence
  Synthetic Polynucleotide
taatacgactcactatagggtagtaaaagtcactacagaccctccatcttaacagaggagaaagatgatgggtctgtagaacctggcggcagcgcaaaagatg

SEQ ID NO: 201811 - DNA, 103 bp, Artificial Sequence
  Synthetic Polynucleotide
taatacgactcactatagggtgcactggtgtagtaaaagtcactacagacaacagaggagagtctgtatggacttttacaacctggcggcagcgcaaaagatg

SEQ ID NO: 201812 - DNA, 103 bp, Artificial Sequence
  Synthetic Polynucleotide
taatacgactcactatagggctggttaatttgcactggtgtagtaaaagtaacagaggagaacttttatgacaccagtgaacctggcggcagcgcaaaagatg

SEQ ID NO: 201813 - DNA, 103 bp, Artificial Sequence
  Synthetic Polynucleotide
taatacgactcactatagggcaatgccatactggttaatttgcactggtgaacagaggagacaccagatgaaattaaccaacctggcggcagcgcaaaagatg

SEQ ID NO: 201814 - DNA, 103 bp, Artificial Sequence
  Synthetic Polynucleotide
taatacgactcactataggggggatctggacaatgccatactggttaattaacagaggagaaattaaatggtatggcataacctggcggcagcgcaaaagatg

SEQ ID NO: 201815 - DNA, 103 bp, Artificial Sequence
  Synthetic Polynucleotide
taatacgactcactatagggtccggaattggggatctggacaatgccataaacagaggagatatggcatggtccagatcaacctggcggcagcgcaaaagatg

SEQ ID NO: 201816 - DNA, 103 bp, Artificial Sequence
  Synthetic Polynucleotide
taatacgactcactatagggggctgtttgctccggaattggggatctggaaacagaggagatccagaatgccaattccgaacctggcggcagcgcaaaagatg

SEQ ID NO: 201817 - DNA, 103 bp, Artificial Sequence
  Synthetic Polynucleotide
taatacgactcactatagggttaaggaactggctgtttgctccggaattgaacagaggagacaattcatgagcaaacagaacctggcggcagcgcaaaagatg

SEQ ID NO: 201818 - DNA, 103 bp, Artificial Sequence
  Synthetic Polynucleotide
taatacgactcactatagggaatgctcccattaaggaactggctgtttgcaacagaggagagcaaacatgcagttccttaacctggcggcagcgcaaaagatg

SEQ ID NO: 201819 - DNA, 103 bp, Artificial Sequence
  Synthetic Polynucleotide
taatacgactcactataggggagagaatccaatgctcccattaaggaactaacagaggagaagttccatgatgggagcaaacctggcggcagcgcaaaagatg

SEQ ID NO: 201820 - DNA, 103 bp, Artificial Sequence
  Synthetic Polynucleotide
taatacgactcactatagggtcccccggctccaggggaaaaggggctggaaacagaggagatccagcatgttttcccctaacctggcggcagcgcaaaagatg

SEQ ID NO: 201821 - DNA, 103 bp, Artificial Sequence
  Synthetic Polynucleotide
taatacgactcactatagggagctgcagtggagagaatccaatgctcccaaacagaggagatgggagatgtggattctcaacctggcggcagcgcaaaagatg

SEQ ID NO: 201822 - DNA, 103 bp, Artificial Sequence
  Synthetic Polynucleotide
taatacgactcactatagggcacagggggcagctgcagtggagagaatccaacagaggagaggattcatgccactgcagaacctggcggcagcgcaaaagatg

SEQ ID NO: 201823 - DNA, 103 bp, Artificial Sequence
  Synthetic Polynucleotide
taatacgactcactatagggctgccactgacacagggggcagctgcagtgaacagaggagacactgcatgtgccccctgaacctggcggcagcgcaaaagatg

SEQ ID NO: 201824 - DNA, 103 bp, Artificial Sequence
  Synthetic Polynucleotide
taatacgactcactatagggccttgtgaagctgccactgacacagggggcaacagaggagagcccccatggtcagtggcaacctggcggcagcgcaaaagatg

SEQ ID NO: 201825 - DNA, 103 bp, Artificial Sequence
  Synthetic Polynucleotide
taatacgactcactatagggtgagatattaccttgtgaagctgccactgaaacagaggagatcagtgatggcttcacaaaacctggcggcagcgcaaaagatg

SEQ ID NO: 201826 - DNA, 103 bp, Artificial Sequence
  Synthetic Polynucleotide
taatacgactcactatagggttgagcttactgagatattaccttgtgaagaacagaggagacttcacatggtaatatctaacctggcggcagcgcaaaagatg

SEQ ID NO: 201827 - DNA, 103 bp, Artificial Sequence
  Synthetic Polynucleotide
taatacgactcactatagggtctgaagtgcttgagcttactgagatattaaacagaggagataatatatgagtaagctcaacctggcggcagcgcaaaagatg

SEQ ID NO: 201828 - DNA, 103 bp, Artificial Sequence
  Synthetic Polynucleotide
taatacgactcactatagggtgtgcttccatctgaagtgcttgagcttacaacagaggagagtaagcatgagcacttcaaacctggcggcagcgcaaaagatg

SEQ ID NO: 201829 - DNA, 103 bp, Artificial Sequence
  Synthetic Polynucleotide
taatacgactcactatagggcacttgtaaatgtgcttccatctgaagtgcaacagaggagagcacttatgatggaagcaaacctggcggcagcgcaaaagatg

SEQ ID NO: 201830 - DNA, 103 bp, Artificial Sequence
  Synthetic Polynucleotide
taatacgactcactataggggtggtagactcacttgtaaatgtgcttccaaacagaggagatggaagatgatttacaagaacctggcggcagcgcaaaagatg

SEQ ID NO: 201831 - DNA, 103 bp, Artificial Sequence
  Synthetic Polynucleotide
taatacgactcactatagggggtcgcggcgtcccccggctccaggggaaaaacagaggagatttcccatggagccggggaacctggcggcagcgcaaaagatg

SEQ ID NO: 201832 - DNA, 103 bp, Artificial Sequence
  Synthetic Polynucleotide
taatacgactcactatagggttgctggactgtggtagactcacttgtaaaaacagaggagatttacaatggagtctaccaacctggcggcagcgcaaaagatg

SEQ ID NO: 201833 - DNA, 103 bp, Artificial Sequence
  Synthetic Polynucleotide
taatacgactcactatagggaaacctttccttgctggactgtggtagactaacagaggagaagtctaatgcagtccagcaacctggcggcagcgcaaaagatg

SEQ ID NO: 201834 - DNA, 103 bp, Artificial Sequence
  Synthetic Polynucleotide
taatacgactcactataggggagctcaagaaaacctttccttgctggactaacagaggagaagtccaatgaggaaaggtaacctggcggcagcgcaaaagatg

SEQ ID NO: 201835 - DNA, 103 bp, Artificial Sequence
  Synthetic Polynucleotide
taatacgactcactataggggggagcaagagagctcaagaaaacctttccaacagaggagaggaaagatgttcttgagcaacctggcggcagcgcaaaagatg

SEQ ID NO: 201836 - DNA, 103 bp, Artificial Sequence
  Synthetic Polynucleotide
taatacgactcactatagggccactgcactgggagcaagagagctcaagaaacagaggagatcttgaatgctcttgctcaacctggcggcagcgcaaaagatg

SEQ ID NO: 201837 - DNA, 103 bp, Artificial Sequence
  Synthetic Polynucleotide
taatacgactcactatagggaccgtgtataccactgcactgggagcaagaaacagaggagatcttgcatgcagtgcagtaacctggcggcagcgcaaaagatg

SEQ ID NO: 201838 - DNA, 103 bp, Artificial Sequence
  Synthetic Polynucleotide
taatacgactcactatagggtgtattaggaaccgtgtataccactgcactaacagaggagaagtgcaatggtatacacgaacctggcggcagcgcaaaagatg

SEQ ID NO: 201839 - DNA, 103 bp, Artificial Sequence
  Synthetic Polynucleotide
taatacgactcactatagggtagtctggcctgtattaggaaccgtgtataaacagaggagatatacaatgttcctaataaacctggcggcagcgcaaaagatg

SEQ ID NO: 201840 - DNA, 103 bp, Artificial Sequence
  Synthetic Polynucleotide
taatacgactcactatagggacagatcctatagtctggcctgtattaggaaacagaggagatcctaaatgaggccagacaacctggcggcagcgcaaaagatg

SEQ ID NO: 201841 - DNA, 103 bp, Artificial Sequence
  Synthetic Polynucleotide
taatacgactcactatagggttcctgtttcacagatcctatagtctggccaacagaggagaggccagatgataggatctaacctggcggcagcgcaaaagatg

SEQ ID NO: 201842 - DNA, 103 bp, Artificial Sequence
  Synthetic Polynucleotide
taatacgactcactatagggtggcggcagcggtcgcggcgtcccccggctaacagaggagaagccggatgacgccgcgaaacctggcggcagcgcaaaagatg

SEQ ID NO: 201843 - DNA, 103 bp, Artificial Sequence
  Synthetic Polynucleotide
taatacgactcactatagggtttccaagccttcctgtttcacagatcctaaacagaggagataggatatgtgaaacaggaacctggcggcagcgcaaaagatg

SEQ ID NO: 201844 - DNA, 103 bp, Artificial Sequence
  Synthetic Polynucleotide
taatacgactcactatagggaccaggctcctttccaagccttcctgtttcaacagaggagagaaacaatgaggcttggaaacctggcggcagcgcaaaagatg

SEQ ID NO: 201845 - DNA, 103 bp, Artificial Sequence
  Synthetic Polynucleotide
taatacgactcactatagggctgagaaaataccaggctcctttccaagccaacagaggagaggcttgatgaggagcctgaacctggcggcagcgcaaaagatg

SEQ ID NO: 201846 - DNA, 103 bp, Artificial Sequence
  Synthetic Polynucleotide
taatacgactcactatagggcaggcatcaactgagaaaataccaggctccaacagaggagaggagccatgtattttctcaacctggcggcagcgcaaaagatg

SEQ ID NO: 201847 - DNA, 103 bp, Artificial Sequence
  Synthetic Polynucleotide
taatacgactcactatagggttctgattgacaggcatcaactgagaaaataacagaggagaattttcatggttgatgccaacctggcggcagcgcaaaagatg

SEQ ID NO: 201848 - DNA, 103 bp, Artificial Sequence
  Synthetic Polynucleotide
taatacgactcactatagggtacttgtgcattctgattgacaggcatcaaaacagaggagattgatgatggtcaatcagaacctggcggcagcgcaaaagatg

SEQ ID NO: 201849 - DNA, 103 bp, Artificial Sequence
  Synthetic Polynucleotide
taatacgactcactatagggggtttgcatttacttgtgcattctgattgaaacagaggagatcaatcatgatgcacaagaacctggcggcagcgcaaaagatg

SEQ ID NO: 201850 - DNA, 103 bp, Artificial Sequence
  Synthetic Polynucleotide
taatacgactcactatagggtcagaagacaggtttgcatttacttgtgcaaacagaggagatgcacaatgaaatgcaaaaacctggcggcagcgcaaaagatg

SEQ ID NO: 201851 - DNA, 103 bp, Artificial Sequence
  Synthetic Polynucleotide
taatacgactcactatagggcgagatgttttcagaagacaggtttgcattaacagaggagaaatgcaatgctgtcttctaacctggcggcagcgcaaaagatg

SEQ ID NO: 201852 - DNA, 103 bp, Artificial Sequence
  Synthetic Polynucleotide
taatacgactcactatagggggccactccccgagatgttttcagaagacaaacagaggagatgtcttatgaaaacatctaacctggcggcagcgcaaaagatg

SEQ ID NO: 201853 - DNA, 103 bp, Artificial Sequence
  Synthetic Polynucleotide
taatacgactcactatagggccgctcaccctggcggcagcggtcgcggcgaacagaggagacgccgcatgcgctgccgcaacctggcggcagcgcaaaagatg

SEQ ID NO: 201854 - DNA, 103 bp, Artificial Sequence
  Synthetic Polynucleotide
taatacgactcactatagggagtggatgcaggccactccccgagatgtttaacagaggagaaaacatatgggggagtggaacctggcggcagcgcaaaagatg

SEQ ID NO: 201855 - DNA, 103 bp, Artificial Sequence
  Synthetic Polynucleotide
taatacgactcactatagggtgaggaggccagtggatgcaggccactcccaacagaggagagggagtatgctgcatccaaacctggcggcagcgcaaaagatg

SEQ ID NO: 201856 - DNA, 103 bp, Artificial Sequence
  Synthetic Polynucleotide
taatacgactcactatagggcattaactaatgaggaggccagtggatgcaaacagaggagatgcatcatgtggcctcctaacctggcggcagcgcaaaagatg

SEQ ID NO: 201857 - DNA, 103 bp, Artificial Sequence
  Synthetic Polynucleotide
taatacgactcactataggggttggagatacattaactaatgaggaggccaacagaggagaggcctcatgattagttaaaacctggcggcagcgcaaaagatg

SEQ ID NO: 201858 - DNA, 103 bp, Artificial Sequence
  Synthetic Polynucleotide
taatacgactcactatagggaaaattgtgagttggagatacattaactaaaacagaggagattagttatggtatctccaaacctggcggcagcgcaaaagatg

SEQ ID NO: 201859 - DNA, 103 bp, Artificial Sequence
  Synthetic Polynucleotide
taatacgactcactataggggactgagagaaaaattgtgagttggagataaacagaggagatatctcatgctcacaattaacctggcggcagcgcaaaagatg

SEQ ID NO: 201860 - DNA, 103 bp, Artificial Sequence
  Synthetic Polynucleotide
taatacgactcactatagggagtgtagagggactgagagaaaaattgtgaaacagaggagatcacaaatgttctctcagaacctggcggcagcgcaaaagatg

SEQ ID NO: 201861 - DNA, 103 bp, Artificial Sequence
  Synthetic Polynucleotide
taatacgactcactataggggggatttagtagtgtagagggactgagagaaacagaggagatctctcatgccctctacaaacctggcggcagcgcaaaagatg

SEQ ID NO: 201862 - DNA, 103 bp, Artificial Sequence
  Synthetic Polynucleotide
taatacgactcactatagggttagctcagtgggatttagtagtgtagaggaacagaggagacctctaatgtactaaatcaacctggcggcagcgcaaaagatg

SEQ ID NO: 201863 - DNA, 103 bp, Artificial Sequence
  Synthetic Polynucleotide
taatacgactcactatagggatgtcgcggtttagctcagtgggatttagtaacagaggagaactaaaatgcactgagctaacctggcggcagcgcaaaagatg

SEQ ID NO: 201864 - DNA, 103 bp, Artificial Sequence
  Synthetic Polynucleotide
taatacgactcactatagggcccttcctctccgctcaccctggcggcagcaacagaggagagctgccatgagggtgagcaacctggcggcagcgcaaaagatg

SEQ ID NO: 201865 - DNA, 103 bp, Artificial Sequence
  Synthetic Polynucleotide
taatacgactcactataggggctatcggcaatgtcgcggtttagctcagtaacagaggagaactgagatgaaccgcgacaacctggcggcagcgcaaaagatg

SEQ ID NO: 201866 - DNA, 103 bp, Artificial Sequence
  Synthetic Polynucleotide
taatacgactcactatagggacattggttggctatcggcaatgtcgcggtaacagaggagaaccgcgatgttgccgataaacctggcggcagcgcaaaagatg

SEQ ID NO: 201867 - DNA, 103 bp, Artificial Sequence
  Synthetic Polynucleotide
taatacgactcactatagggaccggtgcagacattggttggctatcggcaaacagaggagatgccgaatgccaaccaataacctggcggcagcgcaaaagatg

SEQ ID NO: 201868 - DNA, 103 bp, Artificial Sequence
  Synthetic Polynucleotide
taatacgactcactatagggtttgcttgccaccggtgcagacattggttgaacagaggagacaaccaatgtctgcaccgaacctggcggcagcgcaaaagatg

SEQ ID NO: 201869 - DNA, 103 bp, Artificial Sequence
  Synthetic Polynucleotide
taatacgactcactatagggtcacagtagatttgcttgccaccggtgcagaacagaggagactgcacatgtggcaagcaaacctggcggcagcgcaaaagatg

SEQ ID NO: 201870 - DNA, 103 bp, Artificial Sequence
  Synthetic Polynucleotide
taatacgactcactatagggctgacagatgtcacagtagatttgcttgccaacagaggagaggcaagatgatctactgtaacctggcggcagcgcaaaagatg

SEQ ID NO: 201871 - DNA, 103 bp, Artificial Sequence
  Synthetic Polynucleotide
taatacgactcactataggggttagtgttgctgacagatgtcacagtagaaacagaggagatctactatgacatctgtcaacctggcggcagcgcaaaagatg

SEQ ID NO: 201872 - DNA, 103 bp, Artificial Sequence
  Synthetic Polynucleotide
taatacgactcactataggggagttgcatagttagtgttgctgacagatgaacagaggagacatctgatggcaacactaaacctggcggcagcgcaaaagatg

SEQ ID NO: 201873 - DNA, 103 bp, Artificial Sequence
  Synthetic Polynucleotide
taatacgactcactatagggcagttctgaagagttgcatagttagtgttgaacagaggagacaacacatgctatgcaacaacctggcggcagcgcaaaagatg

SEQ ID NO: 201874 - DNA, 103 bp, Artificial Sequence
  Synthetic Polynucleotide
taatacgactcactatagggaataagggagcagttctgaagagttgcataaacagaggagatatgcaatgcttcagaacaacctggcggcagcgcaaaagatg

SEQ ID NO: 201875 - DNA, 103 bp, Artificial Sequence
  Synthetic Polynucleotide
taatacgactcactatagggccgcacttgcgatctgcccggtgggggaggaacagaggagacctcccatgccgggcagaaacctggcggcagcgcaaaagatg

SEQ ID NO: 201876 - DNA, 103 bp, Artificial Sequence
  Synthetic Polynucleotide
taatacgactcactatagggccgccactgccccttcctctccgctcacccaacagaggagagggtgaatggagaggaagaacctggcggcagcgcaaaagatg

SEQ ID NO: 201877 - DNA, 103 bp, Artificial Sequence
  Synthetic Polynucleotide
taatacgactcactatagggcttgaccagtaataagggagcagttctgaaaacagaggagattcagaatggctcccttaaacctggcggcagcgcaaaagatg

SEQ ID NO: 201878 - DNA, 103 bp, Artificial Sequence
  Synthetic Polynucleotide
taatacgactcactataggggacaataggtcttgaccagtaataagggagaacagaggagactccctatgtactggtcaaacctggcggcagcgcaaaagatg

SEQ ID NO: 201879 - DNA, 103 bp, Artificial Sequence
  Synthetic Polynucleotide
taatacgactcactatagggcatagggactgacaataggtcttgaccagtaacagaggagaactggtatggacctattgaacctggcggcagcgcaaaagatg

SEQ ID NO: 201880 - DNA, 103 bp, Artificial Sequence
  Synthetic Polynucleotide
taatacgactcactatagggcagcctgagtcatagggactgacaataggtaacagaggagaacctatatgcagtccctaaacctggcggcagcgcaaaagatg

SEQ ID NO: 201881 - DNA, 103 bp, Artificial Sequence
  Synthetic Polynucleotide
taatacgactcactatagggtccccaagggcagcctgagtcatagggactaacagaggagaagtcccatggactcaggcaacctggcggcagcgcaaaagatg

SEQ ID NO: 201882 - DNA, 103 bp, Artificial Sequence
  Synthetic Polynucleotide
taatacgactcactatagggaggaactatttccccaagggcagcctgagtaacagaggagaactcagatggcccttgggaacctggcggcagcgcaaaagatg

SEQ ID NO: 201883 - DNA, 103 bp, Artificial Sequence
  Synthetic Polynucleotide
taatacgactcactatagggcttcagctgtaggaactatttccccaagggaacagaggagacccttgatgaaatagttcaacctggcggcagcgcaaaagatg

SEQ ID NO: 201884 - DNA, 103 bp, Artificial Sequence
  Synthetic Polynucleotide
taatacgactcactatagggcctacctgatcttcagctgtaggaactattaacagaggagaaatagtatgtacagctgaaacctggcggcagcgcaaaagatg

SEQ ID NO: 201885 - DNA, 103 bp, Artificial Sequence
  Synthetic Polynucleotide
taatacgactcactatagggggaggggtgacctacctgatcttcagctgtaacagaggagaacagctatggatcaggtaaacctggcggcagcgcaaaagatg

SEQ ID NO: 201886 - DNA, 103 bp, Artificial Sequence
  Synthetic Polynucleotide
taatacgactcactataggggtactgctggggaggggtgacctacctgataacagaggagaatcaggatggtcacccctaacctggcggcagcgcaaaagatg

SEQ ID NO: 201887 - DNA, 103 bp, Artificial Sequence
  Synthetic Polynucleotide
taatacgactcactataggggccgccgccgccgccactgccccttcctctaacagaggagaagaggaatgggcagtggcaacctggcggcagcgcaaaagatg

SEQ ID NO: 201888 - DNA, 103 bp, Artificial Sequence
  Synthetic Polynucleotide
taatacgactcactatagggaaatcctgatgtactgctggggaggggtgaaacagaggagatcacccatgcccagcagtaacctggcggcagcgcaaaagatg

SEQ ID NO: 201889 - DNA, 103 bp, Artificial Sequence
  Synthetic Polynucleotide
taatacgactcactatagggttcttggacaaaatcctgatgtactgctggaacagaggagaccagcaatgcatcaggataacctggcggcagcgcaaaagatg

SEQ ID NO: 201890 - DNA, 103 bp, Artificial Sequence
  Synthetic Polynucleotide
taatacgactcactatagggccaaacgatgttcttggacaaaatcctgataacagaggagaatcaggatgttgtccaagaacctggcggcagcgcaaaagatg

SEQ ID NO: 201891 - DNA, 103 bp, Artificial Sequence
  Synthetic Polynucleotide
taatacgactcactataggggattgcagaaccaaacgatgttcttggacaaacagaggagatgtccaatgacatcgtttaacctggcggcagcgcaaaagatg

SEQ ID NO: 201892 - DNA, 103 bp, Artificial Sequence
  Synthetic Polynucleotide
taatacgactcactataggggttagctaccgattgcagaaccaaacgatgaacagaggagacatcgtatggttctgcaaaacctggcggcagcgcaaaagatg

SEQ ID NO: 201893 - DNA, 103 bp, Artificial Sequence
  Synthetic Polynucleotide
taatacgactcactatagggtctctttcatgttagctaccgattgcagaaaacagaggagattctgcatgcggtagctaaacctggcggcagcgcaaaagatg

SEQ ID NO: 201894 - DNA, 103 bp, Artificial Sequence
  Synthetic Polynucleotide
taatacgactcactataggggataagaaattctctttcatgttagctaccaacagaggagaggtagcatgcatgaaagaaacctggcggcagcgcaaaagatg

SEQ ID NO: 201895 - DNA, 103 bp, Artificial Sequence
  Synthetic Polynucleotide
taatacgactcactatagggctcagaatttgataagaaattctctttcataacagaggagaatgaaaatgaatttcttaaacctggcggcagcgcaaaagatg

SEQ ID NO: 201896 - DNA, 103 bp, Artificial Sequence
  Synthetic Polynucleotide
taatacgactcactatagggttgctttgctctcagaatttgataagaaataacagaggagaatttctatgcaaattctgaacctggcggcagcgcaaaagatg

SEQ ID NO: 201897 - DNA, 103 bp, Artificial Sequence
  Synthetic Polynucleotide
taatacgactcactatagggaagctacttgttgctttgctctcagaatttaacagaggagaaaattcatggagcaaagcaacctggcggcagcgcaaaagatg

SEQ ID NO: 201898 - DNA, 103 bp, Artificial Sequence
  Synthetic Polynucleotide
taatacgactcactatagggcgccgctccggccgccgccgccgccactgcaacagaggagagcagtgatggcggcggcgaacctggcggcagcgcaaaagatg

SEQ ID NO: 201899 - DNA, 103 bp, Artificial Sequence
  Synthetic Polynucleotide
taatacgactcactatagggcagcatcattaagctacttgttgctttgctaacagaggagaagcaaaatgacaagtagcaacctggcggcagcgcaaaagatg

SEQ ID NO: 201900 - DNA, 103 bp, Artificial Sequence
  Synthetic Polynucleotide
taatacgactcactatagggatttagagtccagcatcattaagctacttgaacagaggagacaagtaatgtaatgatgcaacctggcggcagcgcaaaagatg

SEQ ID NO: 201901 - DNA, 103 bp, Artificial Sequence
  Synthetic Polynucleotide
taatacgactcactatagggacatacttggatttagagtccagcatcattaacagaggagaaatgatatgggactctaaaacctggcggcagcgcaaaagatg

SEQ ID NO: 201902 - DNA, 103 bp, Artificial Sequence
  Synthetic Polynucleotide
taatacgactcactataggggccatctaagacatacttggatttagagtcaacagaggagagactctatgtccaagtataacctggcggcagcgcaaaagatg

SEQ ID NO: 201903 - DNA, 103 bp, Artificial Sequence
  Synthetic Polynucleotide
taatacgactcactatagggtatcaaccatgccatctaagacatacttggaacagaggagaccaagtatgtcttagatgaacctggcggcagcgcaaaagatg

SEQ ID NO: 201904 - DNA, 103 bp, Artificial Sequence
  Synthetic Polynucleotide
taatacgactcactatagggtcacagacagtatcaaccatgccatctaagaacagaggagacttagaatgcatggttgaaacctggcggcagcgcaaaagatg

SEQ ID NO: 201905 - DNA, 103 bp, Artificial Sequence
  Synthetic Polynucleotide
taatacgactcactatagggttccaggtcttcacagacagtatcaaccataacagaggagaatggttatgactgtctgtaacctggcggcagcgcaaaagatg

SEQ ID NO: 201906 - DNA, 103 bp, Artificial Sequence
  Synthetic Polynucleotide
taatacgactcactatagggttttgtctgtttccaggtcttcacagacagaacagaggagactgtctatgaagacctggaacctggcggcagcgcaaaagatg

SEQ ID NO: 201907 - DNA, 103 bp, Artificial Sequence
  Synthetic Polynucleotide
taatacgactcactataggggcaagctcttttttgtctgtttccaggtctaacagaggagaagacctatgaacagacaaaacctggcggcagcgcaaaagatg

SEQ ID NO: 201908 - DNA, 103 bp, Artificial Sequence
  Synthetic Polynucleotide
taatacgactcactatagggctggagcttggcaagctcttttttgtctgtaacagaggagaacagacatgaaagagcttaacctggcggcagcgcaaaagatg

SEQ ID NO: 201909 - DNA, 103 bp, Artificial Sequence
  Synthetic Polynucleotide
taatacgactcactatagggcctgatccgccgccgctccggccgccgccgaacagaggagacggcggatgccggagcggaacctggcggcagcgcaaaagatg

SEQ ID NO: 201910 - DNA, 103 bp, Artificial Sequence
  Synthetic Polynucleotide
taatacgactcactataggggctggacagtctggagcttggcaagctcttaacagaggagaaagagcatgccaagctccaacctggcggcagcgcaaaagatg

SEQ ID NO: 201911 - DNA, 103 bp, Artificial Sequence
  Synthetic Polynucleotide
taatacgactcactatagggtcttcatccagctggacagtctggagcttgaacagaggagacaagctatggactgtccaaacctggcggcagcgcaaaagatg

SEQ ID NO: 201912 - DNA, 103 bp, Artificial Sequence
  Synthetic Polynucleotide
taatacgactcactataggggtcttgcatatcttcatccagctggacagtaacagaggagaactgtcatgctggatgaaaacctggcggcagcgcaaaagatg

SEQ ID NO: 201913 - DNA, 103 bp, Artificial Sequence
  Synthetic Polynucleotide
taatacgactcactatagggtggagttgtacctgatccgccgccgctccgaacagaggagacggagcatgggcggatcaaacctggcggcagcgcaaaagatg

SEQ ID NO: 201914 - DNA, 103 bp, Artificial Sequence
  Synthetic Polynucleotide
taatacgactcactatagggaagttccgagtggagttgtacctgatccgcaacagaggagagcggatatggtacaactcaacctggcggcagcgcaaaagatg

SEQ ID NO: 201915 - DNA, 103 bp, Artificial Sequence
  Synthetic Polynucleotide
taatacgactcactataggggcctgcccagaagttccgagtggagttgtaaacagaggagatacaacatgactcggaacaacctggcggcagcgcaaaagatg

SEQ ID NO: 201916 - DNA, 103 bp, Artificial Sequence
  Synthetic Polynucleotide
taatacgactcactataggggcgtggtggtgcctgcccagaagttccgagaacagaggagactcggaatgtctgggcagaacctggcggcagcgcaaaagatg

SEQ ID NO: 201917 - DNA, 103 bp, Artificial Sequence
  Synthetic Polynucleotide
taatacgactcactatagggggcggcggcggcgtggtggtgcctgcccagaacagaggagactgggcatgcaccaccacaacctggcggcagcgcaaaagatg

SEQ ID NO: 201918 - DNA, 103 bp, Artificial Sequence
  Synthetic Polynucleotide
taatacgactcactatagggtctgcgcggcggcggcggcggcgtggtggtaacagaggagaaccaccatgccgccgccgaacctggcggcagcgcaaaagatg

SEQ ID NO: 201919 - DNA, 103 bp, Artificial Sequence
  Synthetic Polynucleotide
taatacgactcactatagggttgatgtccgccgcacttgcgatctgcccgaacagaggagacgggcaatgcgcaagtgcaacctggcggcagcgcaaaagatg

SEQ ID NO: 201920 - DNA, 103 bp, Artificial Sequence
  Synthetic Polynucleotide
taatacgactcactataggggccagcggggtctgcgcggcggcggcggcgaacagaggagacgccgcatgcgccgcgcaaacctggcggcagcgcaaaagatg

SEQ ID NO: 201921 - DNA, 103 bp, Artificial Sequence
  Synthetic Polynucleotide
taatacgactcactataggggggcgagaaggccagcggggtctgcgcggcaacagaggagagccgcgatgaccccgctgaacctggcggcagcgcaaaagatg

SEQ ID NO: 201922 - DNA, 103 bp, Artificial Sequence
  Synthetic Polynucleotide
taatacgactcactatagggcgacgtggtcgggcgagaaggccagcggggaacagaggagaccccgcatgccttctcgcaacctggcggcagcgcaaaagatg

SEQ ID NO: 201923 - DNA, 103 bp, Artificial Sequence
  Synthetic Polynucleotide
taatacgactcactatagggcacacgcaggcgacgtggtcgggcgagaagaacagaggagacttctcatgcgaccacgtaacctggcggcagcgcaaaagatg

SEQ ID NO: 201924 - DNA, 103 bp, Artificial Sequence
  Synthetic Polynucleotide
taatacgactcactatagggcagtgcctcgcacacgcaggcgacgtggtcaacagaggagagaccacatggcctgcgtgaacctggcggcagcgcaaaagatg

SEQ ID NO: 201925 - DNA, 103 bp, Artificial Sequence
  Synthetic Polynucleotide
taatacgactcactatagggccccctgctgcagtgcctcgcacacgcaggaacagaggagacctgcgatggcgaggcacaacctggcggcagcgcaaaagatg

SEQ ID NO: 201926 - DNA, 103 bp, Artificial Sequence
  Synthetic Polynucleotide
taatacgactcactatagggtccaggttgcccccctgctgcagtgcctcgaacagaggagacgaggcatggcagcagggaacctggcggcagcgcaaaagatg

SEQ ID NO: 201927 - DNA, 103 bp, Artificial Sequence
  Synthetic Polynucleotide
taatacgactcactatagggggccaggcggtccaggttgcccccctgctgaacagaggagacagcagatgggcaacctgaacctggcggcagcgcaaaagatg

SEQ ID NO: 201928 - DNA, 103 bp, Artificial Sequence
  Synthetic Polynucleotide
taatacgactcactatagggacaggaaccgggccaggcggtccaggttgcaacagaggagagcaaccatgaccgcctggaacctggcggcagcgcaaaagatg

SEQ ID NO: 201929 - DNA, 103 bp, Artificial Sequence
  Synthetic Polynucleotide
taatacgactcactatagggggcagggaccacaggaaccgggccaggcggaacagaggagaccgcctatgccggttcctaacctggcggcagcgcaaaagatg

SEQ ID NO: 201930 - DNA, 103 bp, Artificial Sequence
  Synthetic Polynucleotide
taatacgactcactatagggattctcttgcttgatgtccgccgcacttgcaacagaggagagcaagtatggcggacatcaacctggcggcagcgcaaaagatg

SEQ ID NO: 201931 - DNA, 103 bp, Artificial Sequence
  Synthetic Polynucleotide
taatacgactcactataggggtcgctctggggcagggaccacaggaaccgaacagaggagacggttcatgtggtccctgaacctggcggcagcgcaaaagatg

SEQ ID NO: 201932 - DNA, 103 bp, Artificial Sequence
  Synthetic Polynucleotide
taatacgactcactatagggcacgtagcaggtcgctctggggcagggaccaacagaggagaggtcccatgcccagagcgaacctggcggcagcgcaaaagatg

SEQ ID NO: 201933 - DNA, 103 bp, Artificial Sequence
  Synthetic Polynucleotide
taatacgactcactatagggctctcgttgccacgtagcaggtcgctctggaacagaggagaccagagatgcctgctacgaacctggcggcagcgcaaaagatg

SEQ ID NO: 201934 - DNA, 103 bp, Artificial Sequence
  Synthetic Polynucleotide
taatacgactcactatagggcttcagcaggctctcgttgccacgtagcagaacagaggagactgctaatgggcaacgagaacctggcggcagcgcaaaagatg

SEQ ID NO: 201935 - DNA, 103 bp, Artificial Sequence
  Synthetic Polynucleotide
taatacgactcactataggggcgcccgcgccttcagcaggctctcgttgcaacagaggagagcaacgatggcctgctgaaacctggcggcagcgcaaaagatg

SEQ ID NO: 201936 - DNA, 103 bp, Artificial Sequence
  Synthetic Polynucleotide
taatacgactcactatagggaaggccacgagcgcccgcgccttcagcaggaacagaggagacctgctatgggcgcgggcaacctggcggcagcgcaaaagatg

SEQ ID NO: 201937 - DNA, 103 bp, Artificial Sequence
  Synthetic Polynucleotide
taatacgactcactataggggccctggtggaaggccacgagcgcccgcgcaacagaggagagcgcggatgctcgtggccaacctggcggcagcgcaaaagatg

SEQ ID NO: 201938 - DNA, 103 bp, Artificial Sequence
  Synthetic Polynucleotide
taatacgactcactatagggcggggtagatgccctggtggaaggccacgaaacagaggagatcgtggatgtccaccaggaacctggcggcagcgcaaaagatg

SEQ ID NO: 201939 - DNA, 103 bp, Artificial Sequence
  Synthetic Polynucleotide
taatacgactcactatagggctgtagagctcggggtagatgccctggtggaacagaggagaccaccaatgcatctacccaacctggcggcagcgcaaaagatg

SEQ ID NO: 201940 - DNA, 103 bp, Artificial Sequence
  Synthetic Polynucleotide
taatacgactcactatagggctcgaggatgctgtagagctcggggtagataacagaggagaatctacatggagctctacaacctggcggcagcgcaaaagatg

SEQ ID NO: 201941 - DNA, 103 bp, Artificial Sequence
  Synthetic Polynucleotide
taatacgactcactatagggtttccatcccattctcttgcttgatgtccgaacagaggagacggacaatgagcaagagaaacctggcggcagcgcaaaagatg

SEQ ID NO: 201942 - DNA, 103 bp, Artificial Sequence
  Synthetic Polynucleotide
taatacgactcactatagggagctgtggctctcgaggatgctgtagagctaacagaggagaagctctatggcatcctcgaacctggcggcagcgcaaaagatg

SEQ ID NO: 201943 - DNA, 103 bp, Artificial Sequence
  Synthetic Polynucleotide
taatacgactcactataggggccgactcgaagctgtggctctcgaggatgaacagaggagacatcctatggagccacagaacctggcggcagcgcaaaagatg

SEQ ID NO: 201944 - DNA, 103 bp, Artificial Sequence
  Synthetic Polynucleotide
taatacgactcactatagggcgggtggttggccgactcgaagctgtggctaacagaggagaagccacatgttcgagtcgaacctggcggcagcgcaaaagatg

SEQ ID NO: 201945 - DNA, 103 bp, Artificial Sequence
  Synthetic Polynucleotide
taatacgactcactataggggctgcagcagcgggtggttggccgactcgaaacagaggagatcgagtatgccaaccaccaacctggcggcagcgcaaaagatg

SEQ ID NO: 201946 - DNA, 103 bp, Artificial Sequence
  Synthetic Polynucleotide
taatacgactcactatagggtaccagagctgctgcagcagcgggtggttgaacagaggagacaaccaatggctgctgcaaacctggcggcagcgcaaaagatg

SEQ ID NO: 201947 - DNA, 103 bp, Artificial Sequence
  Synthetic Polynucleotide
taatacgactcactataggggcgcgccttgtaccagagctgctgcagcagaacagaggagactgctgatgcagctctggaacctggcggcagcgcaaaagatg

SEQ ID NO: 201948 - DNA, 103 bp, Artificial Sequence
  Synthetic Polynucleotide
taatacgactcactatagggcctcggtgtagcgcgccttgtaccagagctaacagaggagaagctctatgacaaggcgcaacctggcggcagcgcaaaagatg

SEQ ID NO: 201949 - DNA, 103 bp, Artificial Sequence
  Synthetic Polynucleotide
taatacgactcactataggggctcgctcggcctcggtgtagcgcgccttgaacagaggagacaaggcatgctacaccgaaacctggcggcagcgcaaaagatg

SEQ ID NO: 201950 - DNA, 103 bp, Artificial Sequence
  Synthetic Polynucleotide
taatacgactcactatagggccggccgcgggctcgctcggcctcggtgtaaacagaggagatacaccatggccgagcgaaacctggcggcagcgcaaaagatg

SEQ ID NO: 201951 - DNA, 103 bp, Artificial Sequence
  Synthetic Polynucleotide
taatacgactcactatagggctcccagcggccggccgcgggctcgctcggaacagaggagaccgagcatgcccgcggccaacctggcggcagcgcaaaagatg

SEQ ID NO: 201952 - DNA, 103 bp, Artificial Sequence
  Synthetic Polynucleotide
taatacgactcactatagggtccgaggcgctttccatcccattctcttgcaacagaggagagcaagaatgtgggatggaaacctggcggcagcgcaaaagatg

SEQ ID NO: 201953 - DNA, 103 bp, Artificial Sequence
  Synthetic Polynucleotide
taatacgactcactatagggttgtctacggctcccagcggccggccgcggaacagaggagaccgcggatggccgctgggaacctggcggcagcgcaaaagatg

SEQ ID NO: 201954 - DNA, 103 bp, Artificial Sequence
  Synthetic Polynucleotide
taatacgactcactatagggcagccggtacttgtctacggctcccagcggaacagaggagaccgctgatggccgtagacaacctggcggcagcgcaaaagatg

SEQ ID NO: 201955 - DNA, 103 bp, Artificial Sequence
  Synthetic Polynucleotide
taatacgactcactatagggatttcctgcgcagccggtacttgtctacggaacagaggagaccgtagatgagtaccggcaacctggcggcagcgcaaaagatg

SEQ ID NO: 201956 - DNA, 103 bp, Artificial Sequence
  Synthetic Polynucleotide
taatacgactcactatagggggcagggggaatttcctgcgcagccggtacaacagaggagagtaccgatggcgcaggaaaacctggcggcagcgcaaaagatg

SEQ ID NO: 201957 - DNA, 103 bp, Artificial Sequence
  Synthetic Polynucleotide
taatacgactcactataggggatggtgcggggcagggggaatttcctgcgaacagaggagacgcaggatgttccccctgaacctggcggcagcgcaaaagatg

SEQ ID NO: 201958 - DNA, 103 bp, Artificial Sequence
  Synthetic Polynucleotide
taatacgactcactatagggcgccgtcccagatggtgcggggcagggggaaacagaggagatcccccatgcccgcaccaaacctggcggcagcgcaaaagatg

SEQ ID NO: 201959 - DNA, 103 bp, Artificial Sequence
  Synthetic Polynucleotide
taatacgactcactatagggaccgtctcctcgccgtcccagatggtgcggaacagaggagaccgcacatgctgggacggaacctggcggcagcgcaaaagatg

SEQ ID NO: 201960 - DNA, 103 bp, Artificial Sequence
  Synthetic Polynucleotide
taatacgactcactataggggaaacaatacaccgtctcctcgccgtcccaaacagaggagatgggacatggaggagacgaacctggcggcagcgcaaaagatg

SEQ ID NO: 201961 - DNA, 103 bp, Artificial Sequence
  Synthetic Polynucleotide
taatacgactcactatagggacttctccttgaaacaatacaccgtctcctaacagaggagaaggagaatgtgtattgttaacctggcggcagcgcaaaagatg

SEQ ID NO: 201962 - DNA, 103 bp, Artificial Sequence
  Synthetic Polynucleotide
taatacgactcactataggggcgttgcgcgacttctccttgaaacaatacaacagaggagagtattgatgcaaggagaaaacctggcggcagcgcaaaagatg

SEQ ID NO: 201963 - DNA, 103 bp, Artificial Sequence
  Synthetic Polynucleotide
taatacgactcactatagggctcctgcccttccgaggcgctttccatcccaacagaggagagggatgatgagcgcctcgaacctggcggcagcgcaaaagatg

SEQ ID NO: 201964 - DNA, 103 bp, Artificial Sequence
  Synthetic Polynucleotide
taatacgactcactatagggctccttgagcgcgttgcgcgacttctccttaacagaggagaaaggagatgtcgcgcaacaacctggcggcagcgcaaaagatg

SEQ ID NO: 201965 - DNA, 103 bp, Artificial Sequence
  Synthetic Polynucleotide
taatacgactcactataggggcttgtagagctccttgagcgcgttgcgcgaacagaggagacgcgcaatgcgctcaaggaacctggcggcagcgcaaaagatg

SEQ ID NO: 201966 - DNA, 103 bp, Artificial Sequence
  Synthetic Polynucleotide
taatacgactcactatagggtagcgattctgcttgtagagctccttgagcaacagaggagagctcaaatggctctacaaaacctggcggcagcgcaaaagatg

SEQ ID NO: 201967 - DNA, 103 bp, Artificial Sequence
  Synthetic Polynucleotide
taatacgactcactataggggggcgaagggtagcgattctgcttgtagagaacagaggagactctacatgcagaatcgcaacctggcggcagcgcaaaagatg

SEQ ID NO: 201968 - DNA, 103 bp, Artificial Sequence
  Synthetic Polynucleotide
taatacgactcactataggggcttctcggcgggcgaagggtagcgattctaacagaggagaagaatcatgacccttcgcaacctggcggcagcgcaaaagatg

SEQ ID NO: 201969 - DNA, 103 bp, Artificial Sequence
  Synthetic Polynucleotide
taatacgactcactataggggccaggtgccgcttctcggcgggcgaagggaacagaggagacccttcatgcgccgagaaaacctggcggcagcgcaaaagatg

SEQ ID NO: 201970 - DNA, 103 bp, Artificial Sequence
  Synthetic Polynucleotide
taatacgactcactatagggggtgatcttggccaggtgccgcttctcggcaacagaggagagccgagatgcggcacctgaacctggcggcagcgcaaaagatg

SEQ ID NO: 201971 - DNA, 103 bp, Artificial Sequence
  Synthetic Polynucleotide
taatacgactcactataggggggagaggccggtgatcttggccaggtgccaacagaggagaggcaccatgccaagatcaaacctggcggcagcgcaaaagatg

SEQ ID NO: 201972 - DNA, 103 bp, Artificial Sequence
  Synthetic Polynucleotide
taatacgactcactatagggacctgggtgagggagaggccggtgatcttgaacagaggagacaagatatgcggcctctcaacctggcggcagcgcaaaagatg

SEQ ID NO: 201973 - DNA, 103 bp, Artificial Sequence
  Synthetic Polynucleotide
taatacgactcactatagggccagttgctgacctgggtgagggagaggccaacagaggagaggcctcatgctcacccagaacctggcggcagcgcaaaagatg

SEQ ID NO: 201974 - DNA, 103 bp, Artificial Sequence
  Synthetic Polynucleotide
taatacgactcactatagggctcggtgcgcctcctgcccttccgaggcgcaacagaggagagcgcctatgaagggcaggaacctggcggcagcgcaaaagatg

SEQ ID NO: 201975 - DNA, 103 bp, Artificial Sequence
  Synthetic Polynucleotide
taatacgactcactatagggggttcttgaaccagttgctgacctgggtgaaacagaggagatcacccatgtcagcaactaacctggcggcagcgcaaaagatg

SEQ ID NO: 201976 - DNA, 103 bp, Artificial Sequence
  Synthetic Polynucleotide
taatacgactcactatagggcgctgccggcggttcttgaaccagttgctgaacagaggagacagcaaatggttcaagaaaacctggcggcagcgcaaaagatg

SEQ ID NO: 201977 - DNA, 103 bp, Artificial Sequence
  Synthetic Polynucleotide
taatacgactcactataggggttcctgtcgcgctgccggcggttcttgaaaacagaggagattcaagatgcgccggcagaacctggcggcagcgcaaaagatg

SEQ ID NO: 201978 - DNA, 103 bp, Artificial Sequence
  Synthetic Polynucleotide
taatacgactcactatagggtctcggaggggttcctgtcgcgctgccggcaacagaggagagccggcatggcgacaggaaacctggcggcagcgcaaaagatg

SEQ ID NO: 201979 - DNA, 103 bp, Artificial Sequence
  Synthetic Polynucleotide
taatacgactcactatagggttggactgggtctcggaggggttcctgtcgaacagaggagacgacagatgcccctccgaaacctggcggcagcgcaaaagatg

SEQ ID NO: 201980 - DNA, 103 bp, Artificial Sequence
  Synthetic Polynucleotide
taatacgactcactatagggtgactcacttttggactgggtctcggagggaacagaggagaccctccatgacccagtccaacctggcggcagcgcaaaagatg

SEQ ID NO: 201981 - DNA, 103 bp, Artificial Sequence
  Synthetic Polynucleotide
taatacgactcactatagggggttgccatctgactcacttttggactgggaacagaggagacccagtatgaaagtgagtaacctggcggcagcgcaaaagatg

SEQ ID NO: 201982 - DNA, 103 bp, Artificial Sequence
  Synthetic Polynucleotide
taatacgactcactatagggtcagtgctggggttgccatctgactcacttaacagaggagaaagtgaatgagatggcaaaacctggcggcagcgcaaaagatg

SEQ ID NO: 201983 - DNA, 103 bp, Artificial Sequence
  Synthetic Polynucleotide
taatacgactcactatagggggattcatcttcagtgctggggttgccatcaacagaggagagatggcatgcccagcactaacctggcggcagcgcaaaagatg

SEQ ID NO: 201984 - DNA, 103 bp, Artificial Sequence
  Synthetic Polynucleotide
taatacgactcactataggggtcccttgctggattcatcttcagtgctggaacagaggagaccagcaatgaagatgaataacctggcggcagcgcaaaagatg

SEQ ID NO: 201985 - DNA, 103 bp, Artificial Sequence
  Synthetic Polynucleotide
taatacgactcactatagggcccgccacttctcggtgcgcctcctgccctaacagaggagaagggcaatgggcgcaccgaacctggcggcagcgcaaaagatg

SEQ ID NO: 201986 - DNA, 103 bp, Artificial Sequence
  Synthetic Polynucleotide
taatacgactcactatagggaaatcctcatgtcccttgctggattcatctaacagaggagaagatgaatgcagcaagggaacctggcggcagcgcaaaagatg

SEQ ID NO: 201987 - DNA, 103 bp, Artificial Sequence
  Synthetic Polynucleotide
taatacgactcactataggggtgaggagataaatcctcatgtcccttgctaacagaggagaagcaagatgcatgaggataacctggcggcagcgcaaaagatg

SEQ ID NO: 201988 - DNA, 103 bp, Artificial Sequence
  Synthetic Polynucleotide
taatacgactcactatagggtggagagtgggtgaggagataaatcctcataacagaggagaatgaggatgtatctcctcaacctggcggcagcgcaaaagatg

SEQ ID NO: 201989 - DNA, 103 bp, Artificial Sequence
  Synthetic Polynucleotide
taatacgactcactatagggtcagatgaactggagagtgggtgaggagataacagaggagaatctccatgcccactctcaacctggcggcagcgcaaaagatg

SEQ ID NO: 201990 - DNA, 103 bp, Artificial Sequence
  Synthetic Polynucleotide
taatacgactcactatagggggtgatgccatcagatgaactggagagtggaacagaggagaccactcatgagttcatctaacctggcggcagcgcaaaagatg

SEQ ID NO: 201991 - DNA, 103 bp, Artificial Sequence
  Synthetic Polynucleotide
taatacgactcactatagggggctgaggttggtgatgccatcagatgaacaacagaggagagttcatatgatggcatcaaacctggcggcagcgcaaaagatg

SEQ ID NO: 201992 - DNA, 103 bp, Artificial Sequence
  Synthetic Polynucleotide
taatacgactcactatagggtgactggaaaggctgaggttggtgatgccaaacagaggagatggcatatgcaacctcagaacctggcggcagcgcaaaagatg

SEQ ID NO: 201993 - DNA, 103 bp, Artificial Sequence
  Synthetic Polynucleotide
taatacgactcactatagggtggctccatatgactggaaaggctgaggttaacagaggagaaacctcatgctttccagtaacctggcggcagcgcaaaagatg

SEQ ID NO: 201994 - DNA, 103 bp, Artificial Sequence
  Synthetic Polynucleotide
taatacgactcactataggggcatatatactggctccatatgactggaaaaacagaggagatttccaatgatatggagcaacctggcggcagcgcaaaagatg

SEQ ID NO: 201995 - DNA, 103 bp, Artificial Sequence
  Synthetic Polynucleotide
taatacgactcactatagggccaatttgttgcatatatactggctccataaacagaggagatatggaatgagtatatataacctggcggcagcgcaaaagatg

SEQ ID NO: 201996 - DNA, 103 bp, Artificial Sequence
  Synthetic Polynucleotide
taatacgactcactatagggcgcgctcggctccgcaggcaaggtagccataacagaggagaatggctatgttgcctgcgaacctggcggcagcgcaaaagatg

SEQ ID NO: 201997 - DNA, 103 bp, Artificial Sequence
  Synthetic Polynucleotide
taatacgactcactatagggctgcaaagtctgcaagagctggcgcgcttcaacagaggagagaagcgatgcagctcttgaacctggcggcagcgcaaaagatg

SEQ ID NO: 201998 - DNA, 103 bp, Artificial Sequence
  Synthetic Polynucleotide
taatacgactcactatagggcccgttgaggagcactgctggggagccgctaacagaggagaagcggcatgccagcagtgaacctggcggcagcgcaaaagatg

SEQ ID NO: 201999 - DNA, 103 bp, Artificial Sequence
  Synthetic Polynucleotide
taatacgactcactatagggtgacggggcccccgttgaggagcactgctgaacagaggagacagcagatgtcctcaacgaacctggcggcagcgcaaaagatg

SEQ ID NO: 202000 - DNA, 103 bp, Artificial Sequence
  Synthetic Polynucleotide
taatacgactcactatagggccgttgatgatgacggggcccccgttgaggaacagaggagacctcaaatggggccccgtaacctggcggcagcgcaaaagatg

SEQ ID NO: 202001 - DNA, 103 bp, Artificial Sequence
  Synthetic Polynucleotide
taatacgactcactatagggcagggccaggccgttgatgatgacggggccaacagaggagaggccccatgatcatcaacaacctggcggcagcgcaaaagatg

SEQ ID NO: 202002 - DNA, 103 bp, Artificial Sequence
  Synthetic Polynucleotide
taatacgactcactatagggaggcctcgcccagggccaggccgttgatgaaacagaggagatcatcaatggcctggcccaacctggcggcagcgcaaaagatg

SEQ ID NO: 202003 - DNA, 103 bp, Artificial Sequence
  Synthetic Polynucleotide
taatacgactcactatagggcccaggctggaggcctcgcccagggccaggaacagaggagacctggcatggggcgaggcaacctggcggcagcgcaaaagatg

SEQ ID NO: 202004 - DNA, 103 bp, Artificial Sequence
  Synthetic Polynucleotide
taatacgactcactatagggcagcagcgggcccaggctggaggcctcgccaacagaggagaggcgagatgtccagcctgaacctggcggcagcgcaaaagatg

SEQ ID NO: 202005 - DNA, 103 bp, Artificial Sequence
  Synthetic Polynucleotide
taatacgactcactatagggccccagtgagcagcagcgggcccaggctggaacagaggagaccagccatggcccgctgcaacctggcggcagcgcaaaagatg

SEQ ID NO: 202006 - DNA, 103 bp, Artificial Sequence
  Synthetic Polynucleotide
taatacgactcactataggggcacccccgcccccagtgagcagcagcgggaacagaggagacccgctatggctcactggaacctggcggcagcgcaaaagatg

SEQ ID NO: 202007 - DNA, 103 bp, Artificial Sequence
  Synthetic Polynucleotide
taatacgactcactatagggcggtggaggggcacccccgcccccagtgagaacagaggagactcactatgggcgggggtaacctggcggcagcgcaaaagatg

SEQ ID NO: 202008 - DNA, 103 bp, Artificial Sequence
  Synthetic Polynucleotide
taatacgactcactatagggcctcggccgcctgcaaagtctgcaagagctaacagaggagaagctctatgagactttgcaacctggcggcagcgcaaaagatg

SEQ ID NO: 202009 - DNA, 103 bp, Artificial Sequence
  Synthetic Polynucleotide
taatacgactcactatagggggctgggctgcggtggaggggcacccccgcaacagaggagagcggggatgcccctccacaacctggcggcagcgcaaaagatg

SEQ ID NO: 202010 - DNA, 103 bp, Artificial Sequence
  Synthetic Polynucleotide
taatacgactcactataggggccccctgagggctgggctgcggtggagggaacagaggagaccctccatggcagcccagaacctggcggcagcgcaaaagatg

SEQ ID NO: 202011 - DNA, 103 bp, Artificial Sequence
  Synthetic Polynucleotide
taatacgactcactatagggggtctcgctggccccctgagggctgggctgaacagaggagacagcccatgcctcaggggaacctggcggcagcgcaaaagatg

SEQ ID NO: 202012 - DNA, 103 bp, Artificial Sequence
  Synthetic Polynucleotide
taatacgactcactataggggagaggtcttggtctcgctggccccctgagaacagaggagactcaggatgccagcgagaaacctggcggcagcgcaaaagatg

SEQ ID NO: 202013 - DNA, 103 bp, Artificial Sequence
  Synthetic Polynucleotide
taatacgactcactatagggtccaggaccagagaggtcttggtctcgctgaacagaggagacagcgaatgcaagacctcaacctggcggcagcgcaaaagatg

SEQ ID NO: 202014 - DNA, 103 bp, Artificial Sequence
  Synthetic Polynucleotide
taatacgactcactatagggtgtctgagggtccaggaccagagaggtcttaacagaggagaaagaccatgctggtcctgaacctggcggcagcgcaaaagatg

SEQ ID NO: 202015 - DNA, 103 bp, Artificial Sequence
  Synthetic Polynucleotide
taatacgactcactataggggcacctcccctgtctgagggtccaggaccaaacagaggagatggtccatgaccctcagaaacctggcggcagcgcaaaagatg

SEQ ID NO: 202016 - DNA, 103 bp, Artificial Sequence
  Synthetic Polynucleotide
taatacgactcactatagggtcctccagccgcacctcccctgtctgagggaacagaggagaccctcaatgaggggaggtaacctggcggcagcgcaaaagatg

SEQ ID NO: 202017 - DNA, 103 bp, Artificial Sequence
  Synthetic Polynucleotide
taatacgactcactatagggcgactgagcctcctccagccgcacctccccaacagaggagaggggagatgcggctggagaacctggcggcagcgcaaaagatg

SEQ ID NO: 202018 - DNA, 103 bp, Artificial Sequence
  Synthetic Polynucleotide
taatacgactcactatagggcaggggcctccgactgagcctcctccagccaacagaggagaggctggatgaggctcagtaacctggcggcagcgcaaaagatg

SEQ ID NO: 202019 - DNA, 103 bp, Artificial Sequence
  Synthetic Polynucleotide
taatacgactcactataggggccgcctcaccctcggccgcctgcaaagtcaacagaggagagactttatgggcggccgaaacctggcggcagcgcaaaagatg

SEQ ID NO: 202020 - DNA, 103 bp, Artificial Sequence
  Synthetic Polynucleotide
taatacgactcactatagggcctttggtctcaggggcctccgactgagccaacagaggagaggctcaatgggaggccccaacctggcggcagcgcaaaagatg

SEQ ID NO: 202021 - DNA, 103 bp, Artificial Sequence
  Synthetic Polynucleotide
taatacgactcactatagggcacctgggcccctttggtctcaggggcctcaacagaggagagaggccatggagaccaaaaacctggcggcagcgcaaaagatg

SEQ ID NO: 202022 - DNA, 103 bp, Artificial Sequence
  Synthetic Polynucleotide
taatacgactcactatagggccggagcagccacctgggcccctttggtctaacagaggagaagaccaatggggcccaggaacctggcggcagcgcaaaagatg

SEQ ID NO: 202023 - DNA, 103 bp, Artificial Sequence
  Synthetic Polynucleotide
taatacgactcactatagggagggctggtcccggagcagccacctgggccaacagaggagaggcccaatgggctgctccaacctggcggcagcgcaaaagatg

SEQ ID NO: 202024 - DNA, 103 bp, Artificial Sequence
  Synthetic Polynucleotide
taatacgactcactatagggctcctctccaagggctggtcccggagcagcaacagaggagagctgctatgggaccagccaacctggcggcagcgcaaaagatg

SEQ ID NO: 202025 - DNA, 103 bp, Artificial Sequence
  Synthetic Polynucleotide
taatacgactcactataggggccccaggacctcctctccaagggctggtcaacagaggagagaccagatgttggagaggaacctggcggcagcgcaaaagatg

SEQ ID NO: 202026 - DNA, 103 bp, Artificial Sequence
  Synthetic Polynucleotide
taatacgactcactatagggtgggccaggggccccaggacctcctctccaaacagaggagatggagaatgggtcctgggaacctggcggcagcgcaaaagatg

SEQ ID NO: 202027 - DNA, 103 bp, Artificial Sequence
  Synthetic Polynucleotide
taatacgactcactatagggaggcaccacttgggccaggggccccaggacaacagaggagagtcctgatgcccctggccaacctggcggcagcgcaaaagatg

SEQ ID NO: 202028 - DNA, 103 bp, Artificial Sequence
  Synthetic Polynucleotide
taatacgactcactatagggtcggggggccaggcaccacttgggccagggaacagaggagaccctggatgaagtggtgcaacctggcggcagcgcaaaagatg

SEQ ID NO: 202029 - DNA, 103 bp, Artificial Sequence
  Synthetic Polynucleotide
taatacgactcactataggggtggcagccgtcggggggccaggcaccactaacagaggagaagtggtatgtggccccccaacctggcggcagcgcaaaagatg

SEQ ID NO: 202030 - DNA, 103 bp, Artificial Sequence
  Synthetic Polynucleotide
taatacgactcactatagggggccgccgccgccgcctcaccctcggccgcaacagaggagagcggccatgggtgaggcgaacctggcggcagcgcaaaagatg

SEQ ID NO: 202031 - DNA, 103 bp, Artificial Sequence
  Synthetic Polynucleotide
taatacgactcactatagggcagaggaaaggtggcagccgtcggggggccaacagaggagaggccccatgacggctgccaacctggcggcagcgcaaaagatg

SEQ ID NO: 202032 - DNA, 103 bp, Artificial Sequence
  Synthetic Polynucleotide
taatacgactcactataggggccccgggggcagaggaaaggtggcagccgaacagaggagacggctgatgcctttcctcaacctggcggcagcgcaaaagatg

SEQ ID NO: 202033 - DNA, 103 bp, Artificial Sequence
  Synthetic Polynucleotide
taatacgactcactataggggcaggcactggccccgggggcagaggaaagaacagaggagactttccatggcccccgggaacctggcggcagcgcaaaagatg

SEQ ID NO: 202034 - DNA, 103 bp, Artificial Sequence
  Synthetic Polynucleotide
taatacgactcactatagggggcagccacagcaggcactggccccgggggaacagaggagacccccgatgccagtgcctaacctggcggcagcgcaaaagatg

SEQ ID NO: 202035 - DNA, 103 bp, Artificial Sequence
  Synthetic Polynucleotide
taatacgactcactatagggccacttgtggggcagccacagcaggcactgaacagaggagacagtgcatgctgtggctgaacctggcggcagcgcaaaagatg

SEQ ID NO: 202036 - DNA, 103 bp, Artificial Sequence
  Synthetic Polynucleotide
taatacgactcactataggggagagcggtaccacttgtggggcagccacaaacagaggagatgtggcatgcccacaagtaacctggcggcagcgcaaaagatg

SEQ ID NO: 202037 - DNA, 103 bp, Artificial Sequence
  Synthetic Polynucleotide
taatacgactcactatagggcgggggtggggagagcggtaccacttgtggaacagaggagaccacaaatggtaccgctcaacctggcggcagcgcaaaagatg

SEQ ID NO: 202038 - DNA, 103 bp, Artificial Sequence
  Synthetic Polynucleotide
taatacgactcactatagggtgggataccccgggggtggggagagcggtaaacagaggagataccgcatgccccaccccaacctggcggcagcgcaaaagatg

SEQ ID NO: 202039 - DNA, 103 bp, Artificial Sequence
  Synthetic Polynucleotide
taatacgactcactatagggctcaggcccgtgggataccccgggggtgggaacagaggagacccaccatgggggtatccaacctggcggcagcgcaaaagatg

SEQ ID NO: 202040 - DNA, 103 bp, Artificial Sequence
  Synthetic Polynucleotide
taatacgactcactatagggggaggtggggctcaggcccgtgggatacccaacagaggagagggtatatgacgggcctgaacctggcggcagcgcaaaagatg

SEQ ID NO: 202041 - DNA, 103 bp, Artificial Sequence
  Synthetic Polynucleotide
taatacgactcactatagggccccggccccggccgccgccgccgcctcacaacagaggagagtgaggatgcggcggcggaacctggcggcagcgcaaaagatg

SEQ ID NO: 202042 - DNA, 103 bp, Artificial Sequence
  Synthetic Polynucleotide
taatacgactcactatagggtcaatagtggggaggtggggctcaggcccgaacagaggagacgggccatggccccacctaacctggcggcagcgcaaaagatg

SEQ ID NO: 202043 - DNA, 103 bp, Artificial Sequence
  Synthetic Polynucleotide
taatacgactcactatagggtggggcaggttcaatagtggggaggtggggaacagaggagaccccacatgcccactattaacctggcggcagcgcaaaagatg

SEQ ID NO: 202044 - DNA, 103 bp, Artificial Sequence
  Synthetic Polynucleotide
taatacgactcactataggggggtactacctggggcaggttcaatagtggaacagaggagaccactaatgaacctgcccaacctggcggcagcgcaaaagatg

SEQ ID NO: 202045 - DNA, 103 bp, Artificial Sequence
  Synthetic Polynucleotide
taatacgactcactatagggcctgtgaggtgggtactacctggggcaggtaacagaggagaacctgcatgaggtagtacaacctggcggcagcgcaaaagatg

SEQ ID NO: 202046 - DNA, 103 bp, Artificial Sequence
  Synthetic Polynucleotide
taatacgactcactatagggagggtcaccacctgtgaggtgggtactaccaacagaggagaggtagtatgcacctcacaaacctggcggcagcgcaaaagatg

SEQ ID NO: 202047 - DNA, 103 bp, Artificial Sequence
  Synthetic Polynucleotide
taatacgactcactatagggagcctggggcagggtcaccacctgtgaggtaacagaggagaacctcaatggtggtgaccaacctggcggcagcgcaaaagatg

SEQ ID NO: 202048 - DNA, 103 bp, Artificial Sequence
  Synthetic Polynucleotide
taatacgactcactatagggggggccccacagcctggggcagggtcaccaaacagaggagatggtgaatgtgccccaggaacctggcggcagcgcaaaagatg

SEQ ID NO: 202049 - DNA, 103 bp, Artificial Sequence
  Synthetic Polynucleotide
taatacgactcactatagggaacagctgcaggggccccacagcctggggcaacagaggagagccccaatgtgtggggccaacctggcggcagcgcaaaagatg

SEQ ID NO: 202050 - DNA, 103 bp, Artificial Sequence
  Synthetic Polynucleotide
taatacgactcactatagggcccggctgccaacagctgcaggggccccacaacagaggagagtggggatgctgcagctgaacctggcggcagcgcaaaagatg

SEQ ID NO: 202051 - DNA, 103 bp, Artificial Sequence
  Synthetic Polynucleotide
taatacgactcactatagggggctgcctggcccggctgccaacagctgcaaacagaggagatgcagcatgtggcagccgaacctggcggcagcgcaaaagatg

SEQ ID NO: 202052 - DNA, 103 bp, Artificial Sequence
  Synthetic Polynucleotide
taatacgactcactataggggctgcgcccgccccggccccggccgccgccaacagaggagaggcggcatgcggggccggaacctggcggcagcgcaaaagatg

SEQ ID NO: 202053 - DNA, 103 bp, Artificial Sequence
  Synthetic Polynucleotide
taatacgactcactatagggaccttcacagggctgcctggcccggctgccaacagaggagaggcagcatggccaggcagaacctggcggcagcgcaaaagatg

SEQ ID NO: 202054 - DNA, 103 bp, Artificial Sequence
  Synthetic Polynucleotide
taatacgactcactatagggtgcagctgccaccttcacagggctgcctggaacagaggagaccaggcatgcctgtgaagaacctggcggcagcgcaaaagatg

SEQ ID NO: 202055 - DNA, 103 bp, Artificial Sequence
  Synthetic Polynucleotide
taatacgactcactatagggcagggcctgctgcagctgccaccttcacagaacagaggagactgtgaatgtggcagctgaacctggcggcagcgcaaaagatg

SEQ ID NO: 202056 - DNA, 103 bp, Artificial Sequence
  Synthetic Polynucleotide
taatacgactcactatagggtgcacattggcagggcctgctgcagctgccaacagaggagaggcagcatgagcaggcccaacctggcggcagcgcaaaagatg

SEQ ID NO: 202057 - DNA, 103 bp, Artificial Sequence
  Synthetic Polynucleotide
taatacgactcactataggggttgatgaggtgcacattggcagggcctgcaacagaggagagcaggcatggccaatgtgaacctggcggcagcgcaaaagatg

SEQ ID NO: 202058 - DNA, 103 bp, Artificial Sequence
  Synthetic Polynucleotide
taatacgactcactatagggccaccccggagttgatgaggtgcacattggaacagaggagaccaatgatgacctcatcaaacctggcggcagcgcaaaagatg

SEQ ID NO: 202059 - DNA, 103 bp, Artificial Sequence
  Synthetic Polynucleotide
taatacgactcactataggggcagtcacgcccaccccggagttgatgaggaacagaggagacctcatatgctccggggtaacctggcggcagcgcaaaagatg

SEQ ID NO: 202060 - DNA, 103 bp, Artificial Sequence
  Synthetic Polynucleotide
taatacgactcactatagggcagctgcagggcagtcacgcccaccccggaaacagaggagatccgggatgggcgtgactaacctggcggcagcgcaaaagatg

SEQ ID NO: 202061 - DNA, 103 bp, Artificial Sequence
  Synthetic Polynucleotide
taatacgactcactatagggtggccgaaggcagctgcagggcagtcacgcaacagaggagagcgtgaatgccctgcagcaacctggcggcagcgcaaaagatg

SEQ ID NO: 202062 - DNA, 103 bp, Artificial Sequence
  Synthetic Polynucleotide
taatacgactcactatagggcctggggcagtggccgaaggcagctgcaggaacagaggagacctgcaatggccttcggcaacctggcggcagcgcaaaagatg

SEQ ID NO: 202063 - DNA, 103 bp, Artificial Sequence
  Synthetic Polynucleotide
taatacgactcactatagggtcccgcagccgctgcgcccgccccggccccaacagaggagaggggccatggcgggcgcaaacctggcggcagcgcaaaagatg

SEQ ID NO: 202064 - DNA, 103 bp, Artificial Sequence
  Synthetic Polynucleotide
taatacgactcactataggggaggaagtttcctggggcagtggccgaaggaacagaggagaccttcgatgactgccccaaacctggcggcagcgcaaaagatg

SEQ ID NO: 202065 - DNA, 103 bp, Artificial Sequence
  Synthetic Polynucleotide
taatacgactcactatagggggttggccaggaggaagtttcctggggcagaacagaggagactgcccatggaaacttccaacctggcggcagcgcaaaagatg

SEQ ID NO: 202066 - DNA, 103 bp, Artificial Sequence
  Synthetic Polynucleotide
taatacgactcactatagggccagacacagggttggccaggaggaagtttaacagaggagaaaacttatgcctggccaaaacctggcggcagcgcaaaagatg

SEQ ID NO: 202067 - DNA, 103 bp, Artificial Sequence
  Synthetic Polynucleotide
taatacgactcactataggggatggggctgccagacacagggttggccagaacagaggagactggccatgcctgtgtctaacctggcggcagcgcaaaagatg

SEQ ID NO: 202068 - DNA, 103 bp, Artificial Sequence
  Synthetic Polynucleotide
taatacgactcactatagggcacccgtcacgatggggctgccagacacagaacagaggagactgtgtatggcagccccaaacctggcggcagcgcaaaagatg

SEQ ID NO: 202069 - DNA, 103 bp, Artificial Sequence
  Synthetic Polynucleotide
taatacgactcactatagggtgcagggccacacccgtcacgatggggctgaacagaggagacagcccatgcgtgacgggaacctggcggcagcgcaaaagatg

SEQ ID NO: 202070 - DNA, 103 bp, Artificial Sequence
  Synthetic Polynucleotide
taatacgactcactatagggcttgccctgctgcagggccacacccgtcacaacagaggagagtgacgatggtggccctgaacctggcggcagcgcaaaagatg

SEQ ID NO: 202071 - DNA, 103 bp, Artificial Sequence
  Synthetic Polynucleotide
taatacgactcactatagggtgaggatgatcttgccctgctgcagggccaaacagaggagatggcccatgagcagggcaaacctggcggcagcgcaaaagatg

SEQ ID NO: 202072 - DNA, 103 bp, Artificial Sequence
  Synthetic Polynucleotide
taatacgactcactatagggaaggtggcggtgaggatgatcttgccctgcaacagaggagagcagggatggatcatcctaacctggcggcagcgcaaaagatg

SEQ ID NO: 202073 - DNA, 103 bp, Artificial Sequence
  Synthetic Polynucleotide
taatacgactcactataggggctggtggggaaggtggcggtgaggatgataacagaggagaatcatcatgaccgccaccaacctggcggcagcgcaaaagatg

SEQ ID NO: 202074 - DNA, 103 bp, Artificial Sequence
  Synthetic Polynucleotide
taatacgactcactatagggggccctcagctcccgcagccgctgcgcccgaacagaggagacgggcgatgcggctgcggaacctggcggcagcgcaaaagatg

SEQ ID NO: 202075 - DNA, 103 bp, Artificial Sequence
  Synthetic Polynucleotide
taatacgactcactatagggagacgagcatgctggtggggaaggtggcggaacagaggagaccgccaatgtccccaccaaacctggcggcagcgcaaaagatg

SEQ ID NO: 202076 - DNA, 103 bp, Artificial Sequence
  Synthetic Polynucleotide
taatacgactcactatagggaggacctgggagacgagcatgctggtggggaacagaggagaccccacatgcatgctcgtaacctggcggcagcgcaaaagatg

SEQ ID NO: 202077 - DNA, 103 bp, Artificial Sequence
  Synthetic Polynucleotide
taatacgactcactatagggggctggcggcaggacctgggagacgagcataacagaggagaatgctcatgtcccaggtcaacctggcggcagcgcaaaagatg

SEQ ID NO: 202078 - DNA, 103 bp, Artificial Sequence
  Synthetic Polynucleotide
taatacgactcactatagggccaggccgggggctggcggcaggacctgggaacagaggagacccaggatgtgccgccagaacctggcggcagcgcaaaagatg

SEQ ID NO: 202079 - DNA, 103 bp, Artificial Sequence
  Synthetic Polynucleotide
taatacgactcactatagggagtggcagggccaggccgggggctggcggcaacagaggagagccgccatgccccggcctaacctggcggcagcgcaaaagatg

SEQ ID NO: 202080 - DNA, 103 bp, Artificial Sequence
  Synthetic Polynucleotide
taatacgactcactatagggctctggcttcagtggcagggccaggccgggaacagaggagacccggcatggccctgccaaacctggcggcagcgcaaaagatg

SEQ ID NO: 202081 - DNA, 103 bp, Artificial Sequence
  Synthetic Polynucleotide
taatacgactcactatagggagatggccgtctctggcttcagtggcagggaacagaggagaccctgcatgtgaagccagaacctggcggcagcgcaaaagatg

SEQ ID NO: 202082 - DNA, 103 bp, Artificial Sequence
  Synthetic Polynucleotide
taatacgactcactatagggtcaggcacggagatggccgtctctggcttcaacagaggagagaagccatggacggccataacctggcggcagcgcaaaagatg

SEQ ID NO: 202083 - DNA, 103 bp, Artificial Sequence
  Synthetic Polynucleotide
taatacgactcactataggggaggcctccctcaggcacggagatggccgtaacagaggagaacggccatgtccgtgcctaacctggcggcagcgcaaaagatg

SEQ ID NO: 202084 - DNA, 103 bp, Artificial Sequence
  Synthetic Polynucleotide
taatacgactcactataggggggccaccgggaggcctccctcaggcacggaacagaggagaccgtgcatgagggaggccaacctggcggcagcgcaaaagatg

SEQ ID NO: 202085 - DNA, 103 bp, Artificial Sequence
  Synthetic Polynucleotide
taatacgactcactatagggggggatcccgggccctcagctcccgcagccaacagaggagaggctgcatgagctgagggaacctggcggcagcgcaaaagatg

SEQ ID NO: 202086 - DNA, 103 bp, Artificial Sequence
  Synthetic Polynucleotide
taatacgactcactataggggcagggctgggggccaccgggaggcctcccaacagaggagagggaggatgcccggtggcaacctggcggcagcgcaaaagatg

SEQ ID NO: 202087 - DNA, 103 bp, Artificial Sequence
  Synthetic Polynucleotide
taatacgactcactatagggctctgggagagcagggctgggggccaccggaacagaggagaccggtgatgcccagccctaacctggcggcagcgcaaaagatg

SEQ ID NO: 202088 - DNA, 103 bp, Artificial Sequence
  Synthetic Polynucleotide
taatacgactcactataggggggcgtgagcctctgggagagcagggctggaacagaggagaccagccatgctctcccagaacctggcggcagcgcaaaagatg

SEQ ID NO: 202089 - DNA, 103 bp, Artificial Sequence
  Synthetic Polynucleotide
taatacgactcactatagggagggtgcctagggcgtgagcctctgggagaaacagaggagatctcccatgggctcacgcaacctggcggcagcgcaaaagatg

SEQ ID NO: 202090 - DNA, 103 bp, Artificial Sequence
  Synthetic Polynucleotide
taatacgactcactatagggctgtgcagaaagggtgcctagggcgtgagcaacagaggagagctcacatgctaggcaccaacctggcggcagcgcaaaagatg

SEQ ID NO: 202091 - DNA, 103 bp, Artificial Sequence
  Synthetic Polynucleotide
taatacgactcactatagggggggtggctgctgtgcagaaagggtgcctaaacagaggagataggcaatgtttctgcacaacctggcggcagcgcaaaagatg

SEQ ID NO: 202092 - DNA, 103 bp, Artificial Sequence
  Synthetic Polynucleotide
taatacgactcactataggggcagcggcggggggtggctgctgtgcagaaaacagaggagattctgcatggcagccaccaacctggcggcagcgcaaaagatg

SEQ ID NO: 202093 - DNA, 103 bp, Artificial Sequence
  Synthetic Polynucleotide
taatacgactcactatagggggaggtggtggcagcggcggggggtggctgaacagaggagacagccaatgcccgccgctaacctggcggcagcgcaaaagatg

SEQ ID NO: 202094 - DNA, 103 bp, Artificial Sequence
  Synthetic Polynucleotide
taatacgactcactatagggggctggtgctggaggtggtggcagcggcggaacagaggagaccgccgatgccaccacctaacctggcggcagcgcaaaagatg

SEQ ID NO: 202095 - DNA, 103 bp, Artificial Sequence
  Synthetic Polynucleotide
taatacgactcactataggggagaagggcaggctggtgctggaggtggtgaacagaggagacaccacatgcagcaccagaacctggcggcagcgcaaaagatg

SEQ ID NO: 202096 - DNA, 103 bp, Artificial Sequence
  Synthetic Polynucleotide
taatacgactcactatagggggggacgcccggggatcccgggccctcagcaacagaggagagctgagatgccgggatccaacctggcggcagcgcaaaagatg

SEQ ID NO: 202097 - DNA, 103 bp, Artificial Sequence
  Synthetic Polynucleotide
taatacgactcactatagggggagtcaggggagaagggcaggctggtgctaacagaggagaagcaccatgctgcccttcaacctggcggcagcgcaaaagatg

SEQ ID NO: 202098 - DNA, 103 bp, Artificial Sequence
  Synthetic Polynucleotide
taatacgactcactatagggggaggccaggggagtcaggggagaagggcaaacagaggagatgccctatgcccctgactaacctggcggcagcgcaaaagatg

SEQ ID NO: 202099 - DNA, 103 bp, Artificial Sequence
  Synthetic Polynucleotide
taatacgactcactatagggaagttgggcaggaggccaggggagtcagggaacagaggagaccctgaatgccctggcctaacctggcggcagcgcaaaagatg

SEQ ID NO: 202100 - DNA, 103 bp, Artificial Sequence
  Synthetic Polynucleotide
taatacgactcactataggggggcgccgggaagttgggcaggaggccaggaacagaggagacctggcatgctgcccaacaacctggcggcagcgcaaaagatg

SEQ ID NO: 202101 - DNA, 103 bp, Artificial Sequence
  Synthetic Polynucleotide
taatacgactcactatagggcctctggtgggggcgccgggaagttgggcaaacagaggagatgcccaatgtcccggcgcaacctggcggcagcgcaaaagatg

SEQ ID NO: 202102 - DNA, 103 bp, Artificial Sequence
  Synthetic Polynucleotide
taatacgactcactatagggaacatcagcccctctggtgggggcgccgggaacagaggagacccggcatgcccaccagaaacctggcggcagcgcaaaagatg

SEQ ID NO: 202103 - DNA, 103 bp, Artificial Sequence
  Synthetic Polynucleotide
taatacgactcactatagggcgcgggtgacaacatcagcccctctggtggaacagaggagaccaccaatggggctgatgaacctggcggcagcgcaaaagatg

SEQ ID NO: 202104 - DNA, 103 bp, Artificial Sequence
  Synthetic Polynucleotide
taatacgactcactatagggcaggcacggccgcgggtgacaacatcagccaacagaggagaggctgaatgtgtcacccgaacctggcggcagcgcaaaagatg

SEQ ID NO: 202105 - DNA, 103 bp, Artificial Sequence
  Synthetic Polynucleotide
taatacgactcactataggggctgaccagacaggcacggccgcgggtgacaacagaggagagtcaccatgggccgtgccaacctggcggcagcgcaaaagatg

SEQ ID NO: 202106 - DNA, 103 bp, Artificial Sequence
  Synthetic Polynucleotide
taatacgactcactatagggttccagccctgctgaccagacaggcacggcaacagaggagagccgtgatggtctggtcaaacctggcggcagcgcaaaagatg

SEQ ID NO: 202107 - DNA, 103 bp, Artificial Sequence
  Synthetic Polynucleotide
taatacgactcactatagggccgccggccccgcgctcggctccgcaggcaaacagaggagatgcctgatgagccgagcgaacctggcggcagcgcaaaagatg

SEQ ID NO: 202108 - DNA, 103 bp, Artificial Sequence
  Synthetic Polynucleotide
taatacgactcactatagggggggcgacccggggacgcccggggatcccgaacagaggagacgggatatgcgggcgtccaacctggcggcagcgcaaaagatg

SEQ ID NO: 202109 - DNA, 103 bp, Artificial Sequence
  Synthetic Polynucleotide
taatacgactcactatagggctgcgcttagttccagccctgctgaccagaaacagaggagatctggtatgcagggctggaacctggcggcagcgcaaaagatg

SEQ ID NO: 202110 - DNA, 103 bp, Artificial Sequence
  Synthetic Polynucleotide
taatacgactcactatagggccctctgttcctgcgcttagttccagccctaacagaggagaagggctatgactaagcgcaacctggcggcagcgcaaaagatg

SEQ ID NO: 202111 - DNA, 103 bp, Artificial Sequence
  Synthetic Polynucleotide
taatacgactcactatagggttccagcagcccctctgttcctgcgcttagaacagaggagactaagcatgggaacagagaacctggcggcagcgcaaaagatg

SEQ ID NO: 202112 - DNA, 103 bp, Artificial Sequence
  Synthetic Polynucleotide
taatacgactcactatagggccttttccgcttccagcagcccctctgttcaacagaggagagaacagatgggctgctggaacctggcggcagcgcaaaagatg

SEQ ID NO: 202113 - DNA, 103 bp, Artificial Sequence
  Synthetic Polynucleotide
taatacgactcactataggggtccccagccccttttccgcttccagcagcaacagaggagagctgctatgagcggaaaaaacctggcggcagcgcaaaagatg

SEQ ID NO: 202114 - DNA, 103 bp, Artificial Sequence
  Synthetic Polynucleotide
taatacgactcactataggggggggcctgtgtccccagccccttttccgcaacagaggagagcggaaatggggctggggaacctggcggcagcgcaaaagatg

SEQ ID NO: 202115 - DNA, 103 bp, Artificial Sequence
  Synthetic Polynucleotide
taatacgactcactataggggcacggtgtggggggcctgtgtccccagccaacagaggagaggctggatgcacaggcccaacctggcggcagcgcaaaagatg

SEQ ID NO: 202116 - DNA, 103 bp, Artificial Sequence
  Synthetic Polynucleotide
taatacgactcactatagggggcagcctcagcacggtgtggggggcctgtaacagaggagaacaggcatgccacaccgtaacctggcggcagcgcaaaagatg

SEQ ID NO: 202117 - DNA, 103 bp, Artificial Sequence
  Synthetic Polynucleotide
taatacgactcactataggggtcggggtctggcagcctcagcacggtgtgaacagaggagacacaccatgctgaggctgaacctggcggcagcgcaaaagatg

SEQ ID NO: 202118 - DNA, 103 bp, Artificial Sequence
  Synthetic Polynucleotide
taatacgactcactataggggcccctcagggtcggggtctggcagcctcaaacagaggagatgaggcatgcagaccccgaacctggcggcagcgcaaaagatg

SEQ ID NO: 202119 - DNA, 103 bp, Artificial Sequence
  Synthetic Polynucleotide
taatacgactcactataggggcggcctcggggggcgacccggggacgcccaacagaggagagggcgtatgcgggtcgccaacctggcggcagcgcaaaagatg

SEQ ID NO: 202120 - DNA, 103 bp, Artificial Sequence
  Synthetic Polynucleotide
taatacgactcactatagggcccaggagcagcccctcagggtcggggtctaacagaggagaagacccatgccctgagggaacctggcggcagcgcaaaagatg

SEQ ID NO: 202121 - DNA, 103 bp, Artificial Sequence
  Synthetic Polynucleotide
taatacgactcactatagggtgcggtggcccccaggagcagcccctcaggaacagaggagacctgagatgctgctcctgaacctggcggcagcgcaaaagatg

SEQ ID NO: 202122 - DNA, 103 bp, Artificial Sequence
  Synthetic Polynucleotide
taatacgactcactatagggcctcaccccctgcggtggcccccaggagcaaacagaggagatgctccatggggccaccgaacctggcggcagcgcaaaagatg

SEQ ID NO: 202123 - DNA, 103 bp, Artificial Sequence
  Synthetic Polynucleotide
taatacgactcactatagggccctcgtcaacctcaccccctgcggtggccaacagaggagaggccacatgagggggtgaaacctggcggcagcgcaaaagatg

SEQ ID NO: 202124 - DNA, 103 bp, Artificial Sequence
  Synthetic Polynucleotide
taatacgactcactatagggagcttccaacccctcgtcaacctcacccccaacagaggagagggggtatggttgacgagaacctggcggcagcgcaaaagatg

SEQ ID NO: 202125 - DNA, 103 bp, Artificial Sequence
  Synthetic Polynucleotide
taatacgactcactatagggccttggcctcagcttccaacccctcgtcaaaacagaggagattgacgatgggttggaagaacctggcggcagcgcaaaagatg

SEQ ID NO: 202126 - DNA, 103 bp, Artificial Sequence
  Synthetic Polynucleotide
taatacgactcactatagggtgggtcagaaccttggcctcagcttccaacaacagaggagagttggaatgtgaggccaaaacctggcggcagcgcaaaagatg

SEQ ID NO: 202127 - DNA, 103 bp, Artificial Sequence
  Synthetic Polynucleotide
taatacgactcactatagggcgactggagctgggtcagaaccttggcctcaacagaggagagaggccatggttctgaccaacctggcggcagcgcaaaagatg

SEQ ID NO: 202128 - DNA, 103 bp, Artificial Sequence
  Synthetic Polynucleotide
taatacgactcactatagggccacaggcaccgactggagctgggtcagaaaacagaggagattctgaatgagctccagtaacctggcggcagcgcaaaagatg

SEQ ID NO: 202129 - DNA, 103 bp, Artificial Sequence
  Synthetic Polynucleotide
taatacgactcactatagggaagggctcctccacaggcaccgactggagcaacagaggagagctccaatgggtgcctgtaacctggcggcagcgcaaaagatg

SEQ ID NO: 202130 - DNA, 103 bp, Artificial Sequence
  Synthetic Polynucleotide
taatacgactcactatagggcggttcggaagcggcctcggggggcgacccaacagaggagagggtcgatgcccgaggccaacctggcggcagcgcaaaagatg

SEQ ID NO: 202131 - DNA, 103 bp, Artificial Sequence
  Synthetic Polynucleotide
taatacgactcactatagggtcacagttccaagggctcctccacaggcacaacagaggagagtgcctatggaggagcccaacctggcggcagcgcaaaagatg

SEQ ID NO: 202132 - DNA, 103 bp, Artificial Sequence
  Synthetic Polynucleotide
taatacgactcactatagggggcccgtgggcggttcggaagcggcctcggaacagaggagaccgaggatgcttccgaacaacctggcggcagcgcaaaagatg

SEQ ID NO: 202133 - DNA, 103 bp, Artificial Sequence
  Synthetic Polynucleotide
taatacgactcactataggggagaagcggaggcccgtgggcggttcggaaaacagaggagattccgaatggcccacgggaacctggcggcagcgcaaaagatg

SEQ ID NO: 202134 - DNA, 103 bp, Artificial Sequence
  Synthetic Polynucleotide
taatacgactcactatagggctgctcgggcgagaagcggaggcccgtgggaacagaggagacccacgatgctccgcttcaacctggcggcagcgcaaaagatg

SEQ ID NO: 202135 - DNA, 103 bp, Artificial Sequence
  Synthetic Polynucleotide
taatacgactcactatagggcgcacgccacctgctcgggcgagaagcggaaacagaggagatccgctatgcgcccgagcaacctggcggcagcgcaaaagatg

SEQ ID NO: 202136 - DNA, 103 bp, Artificial Sequence
  Synthetic Polynucleotide
taatacgactcactataggggcctcgcagacgcacgccacctgctcgggcaacagaggagagcccgaatgggtggcgtgaacctggcggcagcgcaaaagatg

SEQ ID NO: 202137 - DNA, 103 bp, Artificial Sequence
  Synthetic Polynucleotide
taatacgactcactatagggctggagcagcgcctcgcagacgcacgccacaacagaggagagtggcgatggtctgcgagaacctggcggcagcgcaaaagatg

SEQ ID NO: 202138 - DNA, 103 bp, Artificial Sequence
  Synthetic Polynucleotide
taatacgactcactatagggcgtggcccgcctggagcagcgcctcgcagaaacagaggagatctgcgatgcgctgctccaacctggcggcagcgcaaaagatg

SEQ ID NO: 202139 - DNA, 103 bp, Artificial Sequence
  Synthetic Polynucleotide
taatacgactcactatagggtcccccccagccgccggccccgcgctcggcaacagaggagagccgagatgggggccggcaacctggcggcagcgcaaaagatg

SEQ ID NO: 202140 - DNA, 103 bp, Artificial Sequence
  Synthetic Polynucleotide
taatacgactcactatagggaagcggccggcgtggcccgcctggagcagcaacagaggagagctgctatgggcgggccaaacctggcggcagcgcaaaagatg

SEQ ID NO: 202141 - DNA, 103 bp, Artificial Sequence
  Synthetic Polynucleotide
taatacgactcactataggggaagcggctcaagcggccggcgtggcccgcaacagaggagagcgggcatggccggccgcaacctggcggcagcgcaaaagatg

SEQ ID NO: 202142 - DNA, 103 bp, Artificial Sequence
  Synthetic Polynucleotide
taatacgactcactataggggtgcgcccaggaagcggctcaagcggccggaacagaggagaccggccatgtgagccgctaacctggcggcagcgcaaaagatg

SEQ ID NO: 202143 - DNA, 103 bp, Artificial Sequence
  Synthetic Polynucleotide
taatacgactcactataggggccgggggcagtgcgcccaggaagcggctcaacagaggagagagccgatgcctgggcgcaacctggcggcagcgcaaaagatg

SEQ ID NO: 202144 - DNA, 103 bp, Artificial Sequence
  Synthetic Polynucleotide
taatacgactcactatagggtaggcgctcggccgggggcagtgcgcccagaacagaggagactgggcatgctgcccccgaacctggcggcagcgcaaaagatg

SEQ ID NO: 202145 - DNA, 103 bp, Artificial Sequence
  Synthetic Polynucleotide
taatacgactcactatagggcgctgccacgtaggcgctcggccgggggcaaacagaggagatgccccatgccgagcgccaacctggcggcagcgcaaaagatg

SEQ ID NO: 202146 - DNA, 103 bp, Artificial Sequence
  Synthetic Polynucleotide
taatacgactcactatagggaacaccgggtcgctgccacgtaggcgctcgaacagaggagacgagcgatgacgtggcagaacctggcggcagcgcaaaagatg

SEQ ID NO: 202147 - DNA, 103 bp, Artificial Sequence
  Synthetic Polynucleotide
taatacgactcactatagggccgcgcgcgcaacaccgggtcgctgccacgaacagaggagacgtggcatggacccggtgaacctggcggcagcgcaaaagatg

SEQ ID NO: 202148 - DNA, 103 bp, Artificial Sequence
  Synthetic Polynucleotide
taatacgactcactatagggccaccagggcccgcgcgcgcaacaccgggtaacagaggagaacccggatgtgcgcgcgcaacctggcggcagcgcaaaagatg

SEQ ID NO: 202149 - DNA, 103 bp, Artificial Sequence
  Synthetic Polynucleotide
taatacgactcactatagggcgctggaaggccaccagggcccgcgcgcgcaacagaggagagcgcgcatgggccctggtaacctggcggcagcgcaaaagatg

SEQ ID NO: 202150 - DNA, 103 bp, Artificial Sequence
  Synthetic Polynucleotide
taatacgactcactatagggcgccaccgcctcccccccagccgccggcccaacagaggagagggccgatggctggggggaacctggcggcagcgcaaaagatg

SEQ ID NO: 202151 - DNA, 103 bp, Artificial Sequence
  Synthetic Polynucleotide
taatacgactcactataggggtactcgccccgctggaaggccaccagggcaacagaggagagccctgatggccttccagaacctggcggcagcgcaaaagatg

SEQ ID NO: 202152 - DNA, 103 bp, Artificial Sequence
  Synthetic Polynucleotide
taatacgactcactatagggagagctcggcgtactcgccccgctggaaggaacagaggagaccttccatgggggcgagtaacctggcggcagcgcaaaagatg

SEQ ID NO: 202153 - DNA, 103 bp, Artificial Sequence
  Synthetic Polynucleotide
taatacgactcactatagggagtagccggtagagctcggcgtactcgcccaacagaggagagggcgaatgcgccgagctaacctggcggcagcgcaaaagatg

SEQ ID NO: 202154 - DNA, 103 bp, Artificial Sequence
  Synthetic Polynucleotide
taatacgactcactataggggcggctctcgagtagccggtagagctcggcaacagaggagagccgagatgtaccggctaaacctggcggcagcgcaaaagatg

SEQ ID NO: 202155 - DNA, 103 bp, Artificial Sequence
  Synthetic Polynucleotide
taatacgactcactatagggcggggaaggggcggctctcgagtagccggtaacagaggagaaccggcatgtcgagagccaacctggcggcagcgcaaaagatg

SEQ ID NO: 202156 - DNA, 103 bp, Artificial Sequence
  Synthetic Polynucleotide
taatacgactcactatagggtggtgggcggcggggaaggggcggctctcgaacagaggagacgagagatgccccttcccaacctggcggcagcgcaaaagatg

SEQ ID NO: 202157 - DNA, 103 bp, Artificial Sequence
  Synthetic Polynucleotide
taatacgactcactatagggcaggaaggcgtggtgggcggcggggaagggaacagaggagacccttcatggccgcccacaacctggcggcagcgcaaaagatg

SEQ ID NO: 202158 - DNA, 103 bp, Artificial Sequence
  Synthetic Polynucleotide
taatacgactcactatagggagaggtcctgcaggaaggcgtggtgggcggaacagaggagaccgcccatgacgccttccaacctggcggcagcgcaaaagatg

SEQ ID NO: 202159 - DNA, 103 bp, Artificial Sequence
  Synthetic Polynucleotide
taatacgactcactataggggcgcgcaggtagaggtcctgcaggaaggcgaacagaggagacgccttatggcaggacctaacctggcggcagcgcaaaagatg

SEQ ID NO: 202160 - DNA, 103 bp, Artificial Sequence
  Synthetic Polynucleotide
taatacgactcactatagggatggtagcgcgcgcgcaggtagaggtcctgaacagaggagacaggacatgtacctgcgcaacctggcggcagcgcaaaagatg

SEQ ID NO: 202161 - DNA, 103 bp, Artificial Sequence
  Synthetic Polynucleotide
taatacgactcactatagggccgccgccgccgccaccgcctcccccccagaacagaggagactggggatgaggcggtggaacctggcggcagcgcaaaagatg

SEQ ID NO: 202162 - DNA, 103 bp, Artificial Sequence
  Synthetic Polynucleotide
taatacgactcactataggggctcggcctcatggtagcgcgcgcgcaggtaacagaggagaacctgcatgcgcgctaccaacctggcggcagcgcaaaagatg

SEQ ID NO: 202163 - DNA, 103 bp, Artificial Sequence
  Synthetic Polynucleotide
taatacgactcactatagggccgcgggcccgctcggcctcatggtagcgcaacagaggagagcgctaatgtgaggccgaaacctggcggcagcgcaaaagatg

SEQ ID NO: 202164 - DNA, 103 bp, Artificial Sequence
  Synthetic Polynucleotide
taatacgactcactatagggaagcgcgcggccgcgggcccgctcggcctcaacagaggagagaggccatgcgggcccgcaacctggcggcagcgcaaaagatg

SEQ ID NO: 202165 - DNA, 103 bp, Artificial Sequence
  Synthetic Polynucleotide
taatacgactcactatagggccactgcgccaagcgcgcggccgcgggcccaacagaggagagggcccatggccgcgcgcaacctggcggcagcgcaaaagatg

SEQ ID NO: 202166 - DNA, 103 bp, Artificial Sequence
  Synthetic Polynucleotide
taatacgactcactatagggcgatacttgtccactgcgccaagcgcgcggaacagaggagaccgcgcatgtggcgcagtaacctggcggcagcgcaaaagatg

SEQ ID NO: 202167 - DNA, 103 bp, Artificial Sequence
  Synthetic Polynucleotide
taatacgactcactatagggcttgcgcagtcgatacttgtccactgcgccaacagaggagaggcgcaatggacaagtataacctggcggcagcgcaaaagatg

SEQ ID NO: 202168 - DNA, 103 bp, Artificial Sequence
  Synthetic Polynucleotide
taatacgactcactataggggcgggaacttcttgcgcagtcgatacttgtaacagaggagaacaagtatggactgcgcaaacctggcggcagcgcaaaagatg

SEQ ID NO: 202169 - DNA, 103 bp, Artificial Sequence
  Synthetic Polynucleotide
taatacgactcactataggggtcttgggcagcgggaacttcttgcgcagtaacagaggagaactgcgatggaagttcccaacctggcggcagcgcaaaagatg

SEQ ID NO: 202170 - DNA, 103 bp, Artificial Sequence
  Synthetic Polynucleotide
taatacgactcactataggggtcccagatggtcttgggcagcgggaacttaacagaggagaaagttcatgctgcccaagaacctggcggcagcgcaaaagatg

SEQ ID NO: 202171 - DNA, 103 bp, Artificial Sequence
  Synthetic Polynucleotide
taatacgactcactatagggtctcctcgccgtcccagatggtcttgggcaaacagaggagatgcccaatgccatctgggaacctggcggcagcgcaaaagatg

SEQ ID NO: 202172 - DNA, 103 bp, Artificial Sequence
  Synthetic Polynucleotide
taatacgactcactatagggtcttcggtcgccgccgccgccgccaccgccaacagaggagaggcggtatgggcggcggcaacctggcggcagcgcaaaagatg

SEQ ID NO: 202173 - DNA, 103 bp, Artificial Sequence
  Synthetic Polynucleotide
taatacgactcactatagggcagtagactgtctcctcgccgtcccagatgaacagaggagacatctgatgcggcgaggaaacctggcggcagcgcaaaagatg

SEQ ID NO: 202174 - DNA, 103 bp, Artificial Sequence
  Synthetic Polynucleotide
taatacgactcactatagggctccttgaagcagtagactgtctcctcgccaacagaggagaggcgagatgacagtctacaacctggcggcagcgcaaaagatg

SEQ ID NO: 202175 - DNA, 103 bp, Artificial Sequence
  Synthetic Polynucleotide
taatacgactcactatagggcgcgggagcgctccttgaagcagtagactgaacagaggagacagtctatggcttcaaggaacctggcggcagcgcaaaagatg

SEQ ID NO: 202176 - DNA, 103 bp, Artificial Sequence
  Synthetic Polynucleotide
taatacgactcactatagggttgagcgctgcgcgggagcgctccttgaagaacagaggagacttcaaatggcgctcccgaacctggcggcagcgcaaaagatg

SEQ ID NO: 202177 - DNA, 103 bp, Artificial Sequence
  Synthetic Polynucleotide
taatacgactcactataggggtagcaggccttgagcgctgcgcgggagcgaacagaggagacgctccatggcagcgctcaacctggcggcagcgcaaaagatg

SEQ ID NO: 202178 - DNA, 103 bp, Artificial Sequence
  Synthetic Polynucleotide
taatacgactcactatagggggttgccgcggtagcaggccttgagcgctgaacagaggagacagcgcatgaggcctgctaacctggcggcagcgcaaaagatg

SEQ ID NO: 202179 - DNA, 103 bp, Artificial Sequence
  Synthetic Polynucleotide
taatacgactcactataggggtggggtagcggttgccgcggtagcaggccaacagaggagaggcctgatgccgcggcaaaacctggcggcagcgcaaaagatg

SEQ ID NO: 202180 - DNA, 103 bp, Artificial Sequence
  Synthetic Polynucleotide
taatacgactcactatagggctcgtccggcgtggggtagcggttgccgcgaacagaggagacgcggcatgcgctaccccaacctggcggcagcgcaaaagatg

SEQ ID NO: 202181 - DNA, 103 bp, Artificial Sequence
  Synthetic Polynucleotide
taatacgactcactatagggggcggcgcttctcgtccggcgtggggtagcaacagaggagagctaccatgcgccggacgaacctggcggcagcgcaaaagatg

SEQ ID NO: 202182 - DNA, 103 bp, Artificial Sequence
  Synthetic Polynucleotide
taatacgactcactatagggagtgtggccaggcggcgcttctcgtccggcaacagaggagagccggaatggaagcgccgaacctggcggcagcgcaaaagatg

SEQ ID NO: 202183 - DNA, 103 bp, Artificial Sequence
  Synthetic Polynucleotide
taatacgactcactatagggctcctcctcctcttcggtcgccgccgccgcaacagaggagagcggcgatggcgaccgaaaacctggcggcagcgcaaaagatg

SEQ ID NO: 202184 - DNA, 103 bp, Artificial Sequence
  Synthetic Polynucleotide
taatacgactcactatagggcaggccggtgagtgtggccaggcggcgcttaacagaggagaaagcgcatgctggccacaaacctggcggcagcgcaaaagatg

SEQ ID NO: 202185 - DNA, 103 bp, Artificial Sequence
  Synthetic Polynucleotide
taatacgactcactataggggcgtgagcgacaggccggtgagtgtggccaaacagaggagatggccaatgtcaccggccaacctggcggcagcgcaaaagatg

SEQ ID NO: 202186 - DNA, 103 bp, Artificial Sequence
  Synthetic Polynucleotide
taatacgactcactatagggttgctgacctgcgtgagcgacaggccggtgaacagaggagacaccggatggtcgctcacaacctggcggcagcgcaaaagatg

SEQ ID NO: 202187 - DNA, 103 bp, Artificial Sequence
  Synthetic Polynucleotide
taatacgactcactatagggcttgaaccagttgctgacctgcgtgagcgaaacagaggagatcgctcatgcaggtcagcaacctggcggcagcgcaaaagatg

SEQ ID NO: 202188 - DNA, 103 bp, Artificial Sequence
  Synthetic Polynucleotide
taatacgactcactataggggtcgccggttcttgaaccagttgctgacctaacagaggagaaggtcaatgactggttcaaacctggcggcagcgcaaaagatg

SEQ ID NO: 202189 - DNA, 103 bp, Artificial Sequence
  Synthetic Polynucleotide
taatacgactcactatagggcggtcgcgctgtcgccggttcttgaaccagaacagaggagactggttatggaaccggcgaacctggcggcagcgcaaaagatg

SEQ ID NO: 202190 - DNA, 103 bp, Artificial Sequence
  Synthetic Polynucleotide
taatacgactcactatagggggccccggtccggtcgcgctgtcgccggttaacagaggagaaaccggatgcagcgcgacaacctggcggcagcgcaaaagatg

SEQ ID NO: 202191 - DNA, 103 bp, Artificial Sequence
  Synthetic Polynucleotide
taatacgactcactatagggcgccgcctccggccccggtccggtcgcgctaacagaggagaagcgcgatgggaccggggaacctggcggcagcgcaaaagatg

SEQ ID NO: 202192 - DNA, 103 bp, Artificial Sequence
  Synthetic Polynucleotide
taatacgactcactatagggttgcagggcgcgccgcctccggccccggtcaacagaggagagaccggatgcggaggcggaacctggcggcagcgcaaaagatg

SEQ ID NO: 202193 - DNA, 103 bp, Artificial Sequence
  Synthetic Polynucleotide
taatacgactcactatagggagactcgctcttgcagggcgcgccgcctccaacagaggagaggaggcatggcgccctgcaacctggcggcagcgcaaaagatg

SEQ ID NO: 202194 - DNA, 103 bp, Artificial Sequence
  Synthetic Polynucleotide
taatacgactcactatagggggcgcgcttcctcctcctcctcttcggtcgaacagaggagacgaccgatgaggaggaggaacctggcggcagcgcaaaagatg

SEQ ID NO: 202195 - DNA, 103 bp, Artificial Sequence
  Synthetic Polynucleotide
taatacgactcactataggggattcccatcagactcgctcttgcagggcgaacagaggagacgccctatgagagcgagtaacctggcggcagcgcaaaagatg

SEQ ID NO: 202196 - DNA, 103 bp, Artificial Sequence
  Synthetic Polynucleotide
taatacgactcactatagggtcagtcgtgggattcccatcagactcgctcaacagaggagagagcgaatgtgatgggaaaacctggcggcagcgcaaaagatg

SEQ ID NO: 202197 - DNA, 103 bp, Artificial Sequence
  Synthetic Polynucleotide
taatacgactcactatagggggactcgtcctcagtcgtgggattcccatcaacagaggagagatgggatgcccacgactaacctggcggcagcgcaaaagatg

SEQ ID NO: 202198 - DNA, 103 bp, Artificial Sequence
  Synthetic Polynucleotide
taatacgactcactataggggacttcggctggactcgtcctcagtcgtggaacagaggagaccacgaatgaggacgagtaacctggcggcagcgcaaaagatg

SEQ ID NO: 202199 - DNA, 103 bp, Artificial Sequence
  Synthetic Polynucleotide
taatacgactcactatagggaggtcctcaggacttcggctggactcgtccaacagaggagaggacgaatgcagccgaagaacctggcggcagcgcaaaagatg

SEQ ID NO: 202200 - DNA, 103 bp, Artificial Sequence
  Synthetic Polynucleotide
taatacgactcactatagggccctctctccaggtcctcaggacttcggctaacagaggagaagccgaatgcctgaggacaacctggcggcagcgcaaaagatg

SEQ ID NO: 202201 - DNA, 103 bp, Artificial Sequence
  Synthetic Polynucleotide
taatacgactcactatagggctggggccgcccctctctccaggtcctcagaacagaggagactgaggatgtggagagagaacctggcggcagcgcaaaagatg

SEQ ID NO: 202202 - DNA, 103 bp, Artificial Sequence
  Synthetic Polynucleotide
taatacgactcactatagggtcggcggacactggggccgcccctctctccaacagaggagaggagagatgggcggccccaacctggcggcagcgcaaaagatg

SEQ ID NO: 202203 - DNA, 103 bp, Artificial Sequence
  Synthetic Polynucleotide
taatacgactcactatagggggcagcggcctcggcggacactggggccgcaacagaggagagcggccatggtgtccgccaacctggcggcagcgcaaaagatg

SEQ ID NO: 202204 - DNA, 103 bp, Artificial Sequence
  Synthetic Polynucleotide
taatacgactcactatagggtggagccctgggcagcggcctcggcggacaaacagaggagatgtccgatgaggccgctgaacctggcggcagcgcaaaagatg

SEQ ID NO: 202205 - DNA, 103 bp, Artificial Sequence
  Synthetic Polynucleotide
taatacgactcactatagggtgcaagagctggcgcgcttcctcctcctccaacagaggagaggaggaatgggaagcgcgaacctggcggcagcgcaaaagatg

SEQ ID NO: 202206 - DNA, 103 bp, Artificial Sequence
  Synthetic Polynucleotide
taatacgactcactataggggccaggaatatggagccctgggcagcggccaacagaggagaggccgcatgccagggctcaacctggcggcagcgcaaaagatg

SEQ ID NO: 202207 - DNA, 103 bp, Artificial Sequence
  Synthetic Polynucleotide
taatacgactcactataggggccggtccctgccaggaatatggagccctgaacagaggagacagggcatgatattcctgaacctggcggcagcgcaaaagatg

SEQ ID NO: 202208 - DNA, 103 bp, Artificial Sequence
  Synthetic Polynucleotide
taatacgactcactataggggcgcgggagggccggtccctgccaggaataaacagaggagatattccatgcagggaccgaacctggcggcagcgcaaaagatg

SEQ ID NO: 202209 - DNA, 103 bp, Artificial Sequence
  Synthetic Polynucleotide
taatacgactcactataggggccgggcaaggcgcgggagggccggtccctaacagaggagaagggacatgccctcccgcaacctggcggcagcgcaaaagatg

SEQ ID NO: 202210 - DNA, 103 bp, Artificial Sequence
  Synthetic Polynucleotide
taatacgactcactatagggggaggaggaagccgggcaaggcgcgggaggaacagaggagacctcccatgccttgcccgaacctggcggcagcgcaaaagatg

SEQ ID NO: 202211 - DNA, 103 bp, Artificial Sequence
  Synthetic Polynucleotide
taatacgactcactatagggtcaccaggatggaggaggaagccgggcaagaacagaggagacttgccatgcttcctcctaacctggcggcagcgcaaaagatg

SEQ ID NO: 202212 - DNA, 103 bp, Artificial Sequence
  Synthetic Polynucleotide
taatacgactcactatagggaagctcccgttcaccaggatggaggaggaaaacagaggagattcctcatgcatcctggtaacctggcggcagcgcaaaagatg

SEQ ID NO: 202213 - DNA, 103 bp, Artificial Sequence
  Synthetic Polynucleotide
taatacgactcactatagggggctgccaggaagctcccgttcaccaggataacagaggagaatcctgatgaacgggagcaacctggcggcagcgcaaaagatg

SEQ ID NO: 202214 - DNA, 103 bp, Artificial Sequence
  Synthetic Polynucleotide
taatacgactcactataggggggagccgctggctgccaggaagctcccgtaacagaggagaacgggaatgtcctggcagaacctggcggcagcgcaaaagatg

SEQ ID NO: 202215 - DNA, 103 bp, Artificial Sequence
  Synthetic Polynucleotide
taatacgactcactatagggagcactgctggggagccgctggctgccaggaacagaggagacctggcatgcagcggctcaacctggcggcagcgcaaaagatg

SEQ ID NO: 202216 - DNA, 103 bp, Artificial Sequence
  Synthetic Polynucleotide
taatacgactcactataggggctgaaattcaagatgggcagctggaacataacagaggagaatgttcatgctgcccatcaacctggcggcagcgcaaaagatg

SEQ ID NO: 202217 - DNA, 103 bp, Artificial Sequence
  Synthetic Polynucleotide
taatacgactcactatagggggccacgggcagcgaccagaggaagcgaccaacagaggagaggtcgcatgctctggtcgaacctggcggcagcgcaaaagatg

SEQ ID NO: 202218 - DNA, 103 bp, Artificial Sequence
  Synthetic Polynucleotide
taatacgactcactatagggaggccgcaggggccacgggcagcgaccagaaacagaggagatctggtatgtgcccgtggaacctggcggcagcgcaaaagatg

SEQ ID NO: 202219 - DNA, 103 bp, Artificial Sequence
  Synthetic Polynucleotide
taatacgactcactatagggagggcctcgcaggccgcaggggccacgggcaacagaggagagcccgtatgccctgcggcaacctggcggcagcgcaaaagatg

SEQ ID NO: 202220 - DNA, 103 bp, Artificial Sequence
  Synthetic Polynucleotide
taatacgactcactatagggattcttgttgagggcctcgcaggccgcaggaacagaggagacctgcgatgtgcgaggccaacctggcggcagcgcaaaagatg

SEQ ID NO: 202221 - DNA, 103 bp, Artificial Sequence
  Synthetic Polynucleotide
taatacgactcactataggggcaccgactcattcttgttgagggcctcgcaacagaggagagcgaggatgtcaacaagaaacctggcggcagcgcaaaagatg

SEQ ID NO: 202222 - DNA, 103 bp, Artificial Sequence
  Synthetic Polynucleotide
taatacgactcactatagggcgtgcgcgtagcaccgactcattcttgttgaacagaggagacaacaaatgtgagtcggtaacctggcggcagcgcaaaagatg

SEQ ID NO: 202223 - DNA, 103 bp, Artificial Sequence
  Synthetic Polynucleotide
taatacgactcactatagggcacgatggctcgtgcgcgtagcaccgactcaacagaggagagagtcgatgctacgcgcaaacctggcggcagcgcaaaagatg

SEQ ID NO: 202224 - DNA, 103 bp, Artificial Sequence
  Synthetic Polynucleotide
taatacgactcactatagggcgtgaaaggccacgatggctcgtgcgcgtaaacagaggagatacgcgatggagccatcgaacctggcggcagcgcaaaagatg

SEQ ID NO: 202225 - DNA, 103 bp, Artificial Sequence
  Synthetic Polynucleotide
taatacgactcactatagggtagttgccaccgtgaaaggccacgatggctaacagaggagaagccatatgggcctttcaaacctggcggcagcgcaaaagatg

SEQ ID NO: 202226 - DNA, 103 bp, Artificial Sequence
  Synthetic Polynucleotide
taatacgactcactataggggagctcgcggtagttgccaccgtgaaaggcaacagaggagagcctttatgggtggcaacaacctggcggcagcgcaaaagatg

SEQ ID NO: 202227 - DNA, 103 bp, Artificial Sequence
  Synthetic Polynucleotide
taatacgactcactatagggcttgctgggggctgaaattcaagatgggcaaacagaggagatgcccaatgtgaatttcaaacctggcggcagcgcaaaagatg

SEQ ID NO: 202228 - DNA, 103 bp, Artificial Sequence
  Synthetic Polynucleotide
taatacgactcactatagggggatatgatagagctcgcggtagttgccacaacagaggagagtggcaatgaccgcgagcaacctggcggcagcgcaaaagatg

SEQ ID NO: 202229 - DNA, 103 bp, Artificial Sequence
  Synthetic Polynucleotide
taatacgactcactatagggtggttttccaggatatgatagagctcgcggaacagaggagaccgcgaatgctatcatataacctggcggcagcgcaaaagatg

SEQ ID NO: 202230 - DNA, 103 bp, Artificial Sequence
  Synthetic Polynucleotide
taatacgactcactatagggggtgaacttgtggttttccaggatatgataaacagaggagatatcatatgctggaaaacaacctggcggcagcgcaaaagatg

SEQ ID NO: 202231 - DNA, 103 bp, Artificial Sequence
  Synthetic Polynucleotide
taatacgactcactataggggcgactccttggtgaacttgtggttttccaaacagaggagatggaaaatgacaagttcaaacctggcggcagcgcaaaagatg

SEQ ID NO: 202232 - DNA, 103 bp, Artificial Sequence
  Synthetic Polynucleotide
taatacgactcactatagggagcttggcgtgcgactccttggtgaacttgaacagaggagacaagttatgcaaggagtcaacctggcggcagcgcaaaagatg

SEQ ID NO: 202233 - DNA, 103 bp, Artificial Sequence
  Synthetic Polynucleotide
taatacgactcactatagggcagcgcctgcagcttggcgtgcgactccttaacagaggagaaaggagatgcacgccaagaacctggcggcagcgcaaaagatg

SEQ ID NO: 202234 - DNA, 103 bp, Artificial Sequence
  Synthetic Polynucleotide
taatacgactcactatagggcttcaagccacagcgcctgcagcttggcgtaacagaggagaacgccaatgtgcaggcgcaacctggcggcagcgcaaaagatg

SEQ ID NO: 202235 - DNA, 103 bp, Artificial Sequence
  Synthetic Polynucleotide
taatacgactcactatagggtggtagtgtgcttcaagccacagcgcctgcaacagaggagagcaggcatggtggcttgaaacctggcggcagcgcaaaagatg

SEQ ID NO: 202236 - DNA, 103 bp, Artificial Sequence
  Synthetic Polynucleotide
taatacgactcactatagggctcagcctcctggtagtgtgcttcaagccaaacagaggagatggcttatggcacactacaacctggcggcagcgcaaaagatg

SEQ ID NO: 202237 - DNA, 103 bp, Artificial Sequence
  Synthetic Polynucleotide
taatacgactcactatagggcacgcagcttctcagcctcctggtagtgtgaacagaggagacacactatgaggaggctgaacctggcggcagcgcaaaagatg

SEQ ID NO: 202238 - DNA, 103 bp, Artificial Sequence
  Synthetic Polynucleotide
taatacgactcactatagggaccccggccacttgctgggggctgaaattcaacagaggagagaatttatgcccccagcaaacctggcggcagcgcaaaagatg

SEQ ID NO: 202239 - DNA, 103 bp, Artificial Sequence
  Synthetic Polynucleotide
taatacgactcactatagggaggggtcttccacgcagcttctcagcctccaacagaggagaggaggcatggaagctgcgaacctggcggcagcgcaaaagatg

SEQ ID NO: 202240 - DNA, 103 bp, Artificial Sequence
  Synthetic Polynucleotide
taatacgactcactatagggcacaggtcccaggggtcttccacgcagcttaacagaggagaaagctgatgggaagacccaacctggcggcagcgcaaaagatg

SEQ ID NO: 202241 - DNA, 103 bp, Artificial Sequence
  Synthetic Polynucleotide
taatacgactcactatagggggtacttgtccacaggtcccaggggtcttcaacagaggagagaagacatgtgggacctgaacctggcggcagcgcaaaagatg

SEQ ID NO: 202242 - DNA, 103 bp, Artificial Sequence
  Synthetic Polynucleotide
taatacgactcactatagggttccttactcggtacttgtccacaggtcccaacagaggagagggaccatgggacaagtaaacctggcggcagcgcaaaagatg

SEQ ID NO: 202243 - DNA, 103 bp, Artificial Sequence
  Synthetic Polynucleotide
taatacgactcactatagggcgggaacttcttccttactcggtacttgtcaacagaggagagacaagatgcgagtaaggaacctggcggcagcgcaaaagatg

SEQ ID NO: 202244 - DNA, 103 bp, Artificial Sequence
  Synthetic Polynucleotide
taatacgactcactatagggtgcgcggcagcgggaacttcttccttactcaacagaggagagagtaaatgagaagttccaacctggcggcagcgcaaaagatg

SEQ ID NO: 202245 - DNA, 103 bp, Artificial Sequence
  Synthetic Polynucleotide
taatacgactcactatagggtcccaaatggtgcgcggcagcgggaacttcaacagaggagagaagttatggctgccgcgaacctggcggcagcgcaaaagatg

SEQ ID NO: 202246 - DNA, 103 bp, Artificial Sequence
  Synthetic Polynucleotide
taatacgactcactatagggctgttcgccgtcccaaatggtgcgcggcagaacagaggagactgccgatgaccatttggaacctggcggcagcgcaaaagatg

SEQ ID NO: 202247 - DNA, 103 bp, Artificial Sequence
  Synthetic Polynucleotide
taatacgactcactatagggagtgtgtcttctgttcgccgtcccaaatggaacagaggagaccatttatgacggcgaacaacctggcggcagcgcaaaagatg

SEQ ID NO: 202248 - DNA, 103 bp, Artificial Sequence
  Synthetic Polynucleotide
taatacgactcactatagggtccttgaagcagtgtgtcttctgttcgccgaacagaggagacggcgaatggaagacacaaacctggcggcagcgcaaaagatg

SEQ ID NO: 202249 - DNA, 103 bp, Artificial Sequence
  Synthetic Polynucleotide
taatacgactcactatagggggtctcacataccccggccacttgctggggaacagaggagaccccagatggtggccgggaacctggcggcagcgcaaaagatg

SEQ ID NO: 202250 - DNA, 103 bp, Artificial Sequence
  Synthetic Polynucleotide
taatacgactcactatagggccgcgtgcgctccttgaagcagtgtgtcttaacagaggagaaagacaatgtgcttcaagaacctggcggcagcgcaaaagatg

SEQ ID NO: 202251 - DNA, 103 bp, Artificial Sequence
  Synthetic Polynucleotide
taatacgactcactataggggtagcaggtgccgcgtgcgctccttgaagcaacagaggagagcttcaatgagcgcacgcaacctggcggcagcgcaaaagatg

SEQ ID NO: 202252 - DNA, 103 bp, Artificial Sequence
  Synthetic Polynucleotide
taatacgactcactatagggtaccactcgcgtagcaggtgccgcgtgcgcaacagaggagagcgcacatggcacctgctaacctggcggcagcgcaaaagatg

SEQ ID NO: 202253 - DNA, 103 bp, Artificial Sequence
  Synthetic Polynucleotide
taatacgactcactatagggatcctgcaggtaccactcgcgtagcaggtgaacagaggagacacctgatgcgcgagtggaacctggcggcagcgcaaaagatg

SEQ ID NO: 202254 - DNA, 103 bp, Artificial Sequence
  Synthetic Polynucleotide
taatacgactcactatagggtagggtatggatcctgcaggtaccactcgcaacagaggagagcgagtatgacctgcaggaacctggcggcagcgcaaaagatg

SEQ ID NO: 202255 - DNA, 103 bp, Artificial Sequence
  Synthetic Polynucleotide
taatacgactcactatagggttgctggggttagggtatggatcctgcaggaacagaggagacctgcaatgtccatacccaacctggcggcagcgcaaaagatg

SEQ ID NO: 202256 - DNA, 103 bp, Artificial Sequence
  Synthetic Polynucleotide
taatacgactcactatagggctcacgttttttgctggggttagggtatggaacagaggagaccatacatgaaccccagcaacctggcggcagcgcaaaagatg

SEQ ID NO: 202257 - DNA, 103 bp, Artificial Sequence
  Synthetic Polynucleotide
taatacgactcactatagggcctgggcgagctcacgttttttgctggggtaacagaggagaaccccaatgaaaaacgtgaacctggcggcagcgcaaaagatg

SEQ ID NO: 202258 - DNA, 103 bp, Artificial Sequence
  Synthetic Polynucleotide
taatacgactcactatagggagtccggttgcctgggcgagctcacgttttaacagaggagaaaaacgatggctcgcccaaacctggcggcagcgcaaaagatg

SEQ ID NO: 202259 - DNA, 103 bp, Artificial Sequence
  Synthetic Polynucleotide
taatacgactcactatagggcgtaggggtcagtccggttgcctgggcgagaacagaggagactcgccatggcaaccggaaacctggcggcagcgcaaaagatg

SEQ ID NO: 202260 - DNA, 103 bp, Artificial Sequence
  Synthetic Polynucleotide
taatacgactcactatagggtctcttccagggtctcacataccccggccaaacagaggagatggccgatgtatgtgagaaacctggcggcagcgcaaaagatg

SEQ ID NO: 202261 - DNA, 103 bp, Artificial Sequence
  Synthetic Polynucleotide
taatacgactcactatagggtgcccacctgcgtaggggtcagtccggttgaacagaggagacaaccgatgtgacccctaaacctggcggcagcgcaaaagatg

SEQ ID NO: 202262 - DNA, 103 bp, Artificial Sequence
  Synthetic Polynucleotide
taatacgactcactatagggttgaaccagttgcccacctgcgtaggggtcaacagaggagagaccccatggcaggtgggaacctggcggcagcgcaaaagatg

SEQ ID NO: 202263 - DNA, 103 bp, Artificial Sequence
  Synthetic Polynucleotide
taatacgactcactatagggtcggcggtttttgaaccagttgcccacctgaacagaggagacaggtgatgaactggttcaacctggcggcagcgcaaaagatg

SEQ ID NO: 202264 - DNA, 103 bp, Artificial Sequence
  Synthetic Polynucleotide
taatacgactcactatagggggtccctttgtcggcggtttttgaaccagtaacagaggagaactggtatgaaaaccgccaacctggcggcagcgcaaaagatg

SEQ ID NO: 202265 - DNA, 103 bp, Artificial Sequence
  Synthetic Polynucleotide
taatacgactcactataggggcagccgctcggtccctttgtcggcggtttaacagaggagaaaaccgatgacaaagggaaacctggcggcagcgcaaaagatg

SEQ ID NO: 202266 - DNA, 103 bp, Artificial Sequence
  Synthetic Polynucleotide
taatacgactcactataggggttcttggctgcagccgctcggtccctttgaacagaggagacaaaggatgcgagcggctaacctggcggcagcgcaaaagatg

SEQ ID NO: 202267 - DNA, 103 bp, Artificial Sequence
  Synthetic Polynucleotide
taatacgactcactataggggctggagtctgttcttggctgcagccgctcaacagaggagagagcggatgcagccaagaaacctggcggcagcgcaaaagatg

SEQ ID NO: 202268 - DNA, 103 bp, Artificial Sequence
  Synthetic Polynucleotide
taatacgactcactatagggaggacctgctgctggagtctgttcttggctaacagaggagaagccaaatgcagactccaaacctggcggcagcgcaaaagatg

SEQ ID NO: 202269 - DNA, 103 bp, Artificial Sequence
  Synthetic Polynucleotide
taatacgactcactatagggaccctgtgacaggacctgctgctggagtctaacagaggagaagactcatgcagcaggtcaacctggcggcagcgcaaaagatg

SEQ ID NO: 202270 - DNA, 103 bp, Artificial Sequence
  Synthetic Polynucleotide
taatacgactcactatagggcccgcccggaaccctgtgacaggacctgctaacagaggagaagcaggatgtgtcacaggaacctggcggcagcgcaaaagatg

SEQ ID NO: 202271 - DNA, 103 bp, Artificial Sequence
  Synthetic Polynucleotide
taatacgactcactatagggacatcgccgctctcttccagggtctcacataacagaggagaatgtgaatgcctggaagaaacctggcggcagcgcaaaagatg

SEQ ID NO: 202272 - DNA, 103 bp, Artificial Sequence
  Synthetic Polynucleotide
taatacgactcactataggggcccgtagtgcccgcccggaaccctgtgacaacagaggagagtcacaatgttccgggcgaacctggcggcagcgcaaaagatg

SEQ ID NO: 202273 - DNA, 103 bp, Artificial Sequence
  Synthetic Polynucleotide
taatacgactcactataggggtcgccctccgcccgtagtgcccgcccggaaacagaggagatccgggatggcactacggaacctggcggcagcgcaaaagatg

SEQ ID NO: 202274 - DNA, 103 bp, Artificial Sequence
  Synthetic Polynucleotide
taatacgactcactatagggctggcgtgccgtcgccctccgcccgtagtgaacagaggagacactacatgcggagggcgaacctggcggcagcgcaaaagatg

SEQ ID NO: 202275 - DNA, 103 bp, Artificial Sequence
  Synthetic Polynucleotide
taatacgactcactatagggcccagcacctctggcgtgccgtcgccctccaacagaggagaggagggatgcggcacgccaacctggcggcagcgcaaaagatg

SEQ ID NO: 202276 - DNA, 103 bp, Artificial Sequence
  Synthetic Polynucleotide
taatacgactcactatagggggtggcgacgcccagcacctctggcgtgccaacagaggagaggcacgatggaggtgctgaacctggcggcagcgcaaaagatg

SEQ ID NO: 202277 - DNA, 103 bp, Artificial Sequence
  Synthetic Polynucleotide
taatacgactcactatagggcggccgggctggtggcgacgcccagcacctaacagaggagaaggtgcatggcgtcgccaaacctggcggcagcgcaaaagatg

SEQ ID NO: 202278 - DNA, 103 bp, Artificial Sequence
  Synthetic Polynucleotide
taatacgactcactataggggatagactggcggccgggctggtggcgacgaacagaggagacgtcgcatgcagcccggcaacctggcggcagcgcaaaagatg

SEQ ID NO: 202279 - DNA, 103 bp, Artificial Sequence
  Synthetic Polynucleotide
taatacgactcactatagggcgccttgctggatagactggcggccgggctaacagaggagaagcccgatggccagtctaaacctggcggcagcgcaaaagatg

SEQ ID NO: 202280 - DNA, 103 bp, Artificial Sequence
  Synthetic Polynucleotide
taatacgactcactatagggctgaagtggccgccttgctggatagactggaacagaggagaccagtcatgccagcaaggaacctggcggcagcgcaaaagatg

SEQ ID NO: 202281 - DNA, 103 bp, Artificial Sequence
  Synthetic Polynucleotide
taatacgactcactatagggatggagatggctgaagtggccgccttgctgaacagaggagacagcaaatgggccacttcaacctggcggcagcgcaaaagatg

SEQ ID NO: 202282 - DNA, 103 bp, Artificial Sequence
  Synthetic Polynucleotide
taatacgactcactatagggcaggcgctccacatcgccgctctcttccagaacagaggagactggaaatgagcggcgataacctggcggcagcgcaaaagatg

SEQ ID NO: 202283 - DNA, 103 bp, Artificial Sequence
  Synthetic Polynucleotide
taatacgactcactataggggctggacgtgatggagatggctgaagtggcaacagaggagagccactatggccatctccaacctggcggcagcgcaaaagatg

SEQ ID NO: 202284 - DNA, 103 bp, Artificial Sequence
  Synthetic Polynucleotide
taatacgactcactatagggactcgctgtcgctggacgtgatggagatggaacagaggagaccatctatgtcacgtccaaacctggcggcagcgcaaaagatg

SEQ ID NO: 202285 - DNA, 103 bp, Artificial Sequence
  Synthetic Polynucleotide
taatacgactcactatagggcagatgtcgcactcgctgtcgctggacgtgaacagaggagacacgtcatgcgacagcgaaacctggcggcagcgcaaaagatg

SEQ ID NO: 202286 - DNA, 103 bp, Artificial Sequence
  Synthetic Polynucleotide
taatacgactcactatagggggaagcgacccaggcgctccacatcgccgcaacagaggagagcggcgatgtggagcgccaacctggcggcagcgcaaaagatg

SEQ ID NO: 202287 - DNA, 103 bp, Artificial Sequence
  Synthetic Polynucleotide
taatacgactcactatagggagcgaccagaggaagcgacccaggcgctccaacagaggagaggagcgatggggtcgcttaacctggcggcagcgcaaaagatg

SEQ ID NO: 202288 - DNA, 103 bp, Artificial Sequence
  Synthetic Polynucleotide
taatacgactcactatagggcaaggagaaatttgtctggaggttttccataacagaggagaatggaaatgctccagacaaacctggcggcagcgcaaaagatg

SEQ ID NO: 202289 - DNA, 103 bp, Artificial Sequence
  Synthetic Polynucleotide
taatacgactcactatagggtccatttgcatgaatgtccgttatcattttaacagaggagaaaaatgatgacggacattaacctggcggcagcgcaaaagatg

SEQ ID NO: 202290 - DNA, 103 bp, Artificial Sequence
  Synthetic Polynucleotide
taatacgactcactatagggttcaggtgttcctaagtatttttggttcacaacagaggagagtgaacatgaaatacttaaacctggcggcagcgcaaaagatg

SEQ ID NO: 202291 - DNA, 103 bp, Artificial Sequence
  Synthetic Polynucleotide
taatacgactcactataggggtttcttttcttcaggtgttcctaagtattaacagaggagaaatactatggaacacctgaacctggcggcagcgcaaaagatg

SEQ ID NO: 202292 - DNA, 103 bp, Artificial Sequence
  Synthetic Polynucleotide
taatacgactcactatagggattatcttcagtttcttttcttcaggtgttaacagaggagaaacaccatgagaaaagaaaacctggcggcagcgcaaaagatg

SEQ ID NO: 202293 - DNA, 103 bp, Artificial Sequence
  Synthetic Polynucleotide
taatacgactcactatagggttcttctaaaattatcttcagtttcttttcaacagaggagagaaaagatgctgaagataaacctggcggcagcgcaaaagatg

SEQ ID NO: 202294 - DNA, 103 bp, Artificial Sequence
  Synthetic Polynucleotide
taatacgactcactatagggtctccttcatttcttctaaaattatcttcaaacagaggagatgaagaatgttttagaagaacctggcggcagcgcaaaagatg

SEQ ID NO: 202295 - DNA, 103 bp, Artificial Sequence
  Synthetic Polynucleotide
taatacgactcactatagggatgctaaacttctccttcatttcttctaaaaacagaggagatttagaatgaatgaaggaaacctggcggcagcgcaaaagatg

SEQ ID NO: 202296 - DNA, 103 bp, Artificial Sequence
  Synthetic Polynucleotide
taatacgactcactatagggtccacttctcatgctaaacttctccttcataacagaggagaatgaagatgaagtttagcaacctggcggcagcgcaaaagatg

SEQ ID NO: 202297 - DNA, 103 bp, Artificial Sequence
  Synthetic Polynucleotide
taatacgactcactataggggatttctctttccacttctcatgctaaactaacagaggagaagtttaatgtgagaagtgaacctggcggcagcgcaaaagatg

SEQ ID NO: 202298 - DNA, 103 bp, Artificial Sequence
  Synthetic Polynucleotide
taatacgactcactataggggtcttggattgatttctctttccacttctcaacagaggagagagaagatgaaagagaaaaacctggcggcagcgcaaaagatg

SEQ ID NO: 202299 - DNA, 103 bp, Artificial Sequence
  Synthetic Polynucleotide
taatacgactcactatagggtggtgcatctgtcttggattgatttctcttaacagaggagaaagagaatgcaatccaagaacctggcggcagcgcaaaagatg

SEQ ID NO: 202300 - DNA, 103 bp, Artificial Sequence
  Synthetic Polynucleotide
taatacgactcactatagggttatcgtttttccatttgcatgaatgtccgaacagaggagacggacaatgatgcaaatgaacctggcggcagcgcaaaagatg

SEQ ID NO: 202301 - DNA, 103 bp, Artificial Sequence
  Synthetic Polynucleotide
taatacgactcactatagggccattcctgatggtgcatctgtcttggattaacagaggagaaatccaatgcagatgcacaacctggcggcagcgcaaaagatg

SEQ ID NO: 202302 - DNA, 103 bp, Artificial Sequence
  Synthetic Polynucleotide
taatacgactcactataggggactgtaattccattcctgatggtgcatctaacagaggagaagatgcatgatcaggaataacctggcggcagcgcaaaagatg

SEQ ID NO: 202303 - DNA, 103 bp, Artificial Sequence
  Synthetic Polynucleotide
taatacgactcactatagggaggataccatgactgtaattccattcctgaaacagaggagatcaggaatggaattacagaacctggcggcagcgcaaaagatg

SEQ ID NO: 202304 - DNA, 103 bp, Artificial Sequence
  Synthetic Polynucleotide
taatacgactcactataggggctttataacaggataccatgactgtaattaacagaggagaaattacatgcatggtatcaacctggcggcagcgcaaaagatg

SEQ ID NO: 202305 - DNA, 103 bp, Artificial Sequence
  Synthetic Polynucleotide
taatacgactcactatagggtcaccttcctgctttataacaggataccataacagaggagaatggtaatgtgttataaaaacctggcggcagcgcaaaagatg

SEQ ID NO: 202306 - DNA, 103 bp, Artificial Sequence
  Synthetic Polynucleotide
taatacgactcactatagggagaaacatggtcaccttcctgctttataacaacagaggagagttataatgcaggaaggtaacctggcggcagcgcaaaagatg

SEQ ID NO: 202307 - DNA, 103 bp, Artificial Sequence
  Synthetic Polynucleotide
taatacgactcactatagggaatgtgtctgagaaacatggtcaccttcctaacagaggagaaggaagatgaccatgtttaacctggcggcagcgcaaaagatg

SEQ ID NO: 202308 - DNA, 103 bp, Artificial Sequence
  Synthetic Polynucleotide
taatacgactcactatagggtgtaaaaatgaatgtgtctgagaaacatggaacagaggagaccatgtatgtcagacacaaacctggcggcagcgcaaaagatg

SEQ ID NO: 202309 - DNA, 103 bp, Artificial Sequence
  Synthetic Polynucleotide
taatacgactcactataggggtagctggggtgtaaaaatgaatgtgtctgaacagaggagacagacaatgtcatttttaaacctggcggcagcgcaaaagatg

SEQ ID NO: 202310 - DNA, 103 bp, Artificial Sequence
  Synthetic Polynucleotide
taatacgactcactatagggtgtataagtagtagctggggtgtaaaaatgaacagaggagacattttatgaccccagctaacctggcggcagcgcaaaagatg

SEQ ID NO: 202311 - DNA, 103 bp, Artificial Sequence
  Synthetic Polynucleotide
taatacgactcactatagggggcaccttgtttatcgtttttccatttgcaaacagaggagatgcaaaatgaaaaacgataacctggcggcagcgcaaaagatg

SEQ ID NO: 202312 - DNA, 103 bp, Artificial Sequence
  Synthetic Polynucleotide
taatacgactcactatagggttatcacacatgtataagtagtagctggggaacagaggagaccccagatgctacttataaacctggcggcagcgcaaaagatg

SEQ ID NO: 202313 - DNA, 103 bp, Artificial Sequence
  Synthetic Polynucleotide
taatacgactcactatagggggcaaccactttatcacacatgtataagtaaacagaggagatacttaatgatgtgtgataacctggcggcagcgcaaaagatg

SEQ ID NO: 202314 - DNA, 103 bp, Artificial Sequence
  Synthetic Polynucleotide
taatacgactcactatagggacacatttggggcaaccactttatcacacaaacagaggagatgtgtgatgaagtggttgaacctggcggcagcgcaaaagatg

SEQ ID NO: 202315 - DNA, 103 bp, Artificial Sequence
  Synthetic Polynucleotide
taatacgactcactataggggaagtaagtgacacatttggggcaaccactaacagaggagaagtggtatgcccaaatgtaacctggcggcagcgcaaaagatg

SEQ ID NO: 202316 - DNA, 103 bp, Artificial Sequence
  Synthetic Polynucleotide
taatacgactcactatagggggatacagcagaagtaagtgacacatttggaacagaggagaccaaatatgtcacttactaacctggcggcagcgcaaaagatg

SEQ ID NO: 202317 - DNA, 103 bp, Artificial Sequence
  Synthetic Polynucleotide
taatacgactcactatagggctttagactgggatacagcagaagtaagtgaacagaggagacacttaatgctgctgtataacctggcggcagcgcaaaagatg

SEQ ID NO: 202318 - DNA, 103 bp, Artificial Sequence
  Synthetic Polynucleotide
taatacgactcactatagggtttgtgagctctttagactgggatacagcaaacagaggagatgctgtatgccagtctaaaacctggcggcagcgcaaaagatg

SEQ ID NO: 202319 - DNA, 103 bp, Artificial Sequence
  Synthetic Polynucleotide
taatacgactcactatagggtgcctctgtctttgtgagctctttagactgaacagaggagacagtctatggagctcacaaacctggcggcagcgcaaaagatg

SEQ ID NO: 202320 - DNA, 103 bp, Artificial Sequence
  Synthetic Polynucleotide
taatacgactcactatagggtggacttacttgcctctgtctttgtgagctaacagaggagaagctcaatgagacagaggaacctggcggcagcgcaaaagatg

SEQ ID NO: 202321 - DNA, 103 bp, Artificial Sequence
  Synthetic Polynucleotide
taatacgactcactatagggtgtcttgatatggacttacttgcctctgtcaacagaggagagacagaatgaagtaagtcaacctggcggcagcgcaaaagatg

SEQ ID NO: 202322 - DNA, 103 bp, Artificial Sequence
  Synthetic Polynucleotide
taatacgactcactatagggcttaactgttggcaccttgtttatcgttttaacagaggagaaaaacgatgaacaaggtgaacctggcggcagcgcaaaagatg

SEQ ID NO: 202323 - DNA, 103 bp, Artificial Sequence
  Synthetic Polynucleotide
taatacgactcactatagggcttctctgactgtcttgatatggacttactaacagaggagaagtaagatgatatcaagaaacctggcggcagcgcaaaagatg

SEQ ID NO: 202324 - DNA, 103 bp, Artificial Sequence
  Synthetic Polynucleotide
taatacgactcactatagggtactgtgagccttctctgactgtcttgataaacagaggagatatcaaatgagtcagagaaacctggcggcagcgcaaaagatg

SEQ ID NO: 202325 - DNA, 103 bp, Artificial Sequence
  Synthetic Polynucleotide
taatacgactcactatagggagtttaccactactgtgagccttctctgacaacagaggagagtcagaatgggctcacagaacctggcggcagcgcaaaagatg

SEQ ID NO: 202326 - DNA, 103 bp, Artificial Sequence
  Synthetic Polynucleotide
taatacgactcactatagggtgttttttgaagtttaccactactgtgagcaacagaggagagctcacatgagtggtaaaaacctggcggcagcgcaaaagatg

SEQ ID NO: 202327 - DNA, 103 bp, Artificial Sequence
  Synthetic Polynucleotide
taatacgactcactataggggataagacactgttttttgaagtttaccacaacagaggagagtggtaatgttcaaaaaaaacctggcggcagcgcaaaagatg

SEQ ID NO: 202328 - DNA, 103 bp, Artificial Sequence
  Synthetic Polynucleotide
taatacgactcactataggggagacatctggataagacactgttttttgaaacagaggagatcaaaaatgagtgtcttaaacctggcggcagcgcaaaagatg

SEQ ID NO: 202329 - DNA, 103 bp, Artificial Sequence
  Synthetic Polynucleotide
taatacgactcactatagggttcctcaagtgagacatctggataagacacaacagaggagagtgtctatgccagatgtcaacctggcggcagcgcaaaagatg

SEQ ID NO: 202330 - DNA, 103 bp, Artificial Sequence
  Synthetic Polynucleotide
taatacgactcactatagggttttctcctgttcctcaagtgagacatctgaacagaggagacagatgatgcacttgaggaacctggcggcagcgcaaaagatg

SEQ ID NO: 202331 - DNA, 103 bp, Artificial Sequence
  Synthetic Polynucleotide
taatacgactcactatagggtttaaatccattttctcctgttcctcaagtaacagaggagaacttgaatgacaggagaaaacctggcggcagcgcaaaagatg

SEQ ID NO: 202332 - DNA, 103 bp, Artificial Sequence
  Synthetic Polynucleotide
taatacgactcactatagggtctacttgtttttaaatccattttctcctgaacagaggagacaggagatgatggatttaaacctggcggcagcgcaaaagatg

SEQ ID NO: 202333 - DNA, 103 bp, Artificial Sequence
  Synthetic Polynucleotide
taatacgactcactatagggagtgttccttcttaactgttggcaccttgtaacagaggagaacaaggatgcaacagttaaacctggcggcagcgcaaaagatg

SEQ ID NO: 202334 - DNA, 103 bp, Artificial Sequence
  Synthetic Polynucleotide
taatacgactcactatagggtacataattctctacttgtttttaaatccaaacagaggagatggattatgaaacaagtaaacctggcggcagcgcaaaagatg

SEQ ID NO: 202335 - DNA, 103 bp, Artificial Sequence
  Synthetic Polynucleotide
taatacgactcactatagggtctaaacggctacataattctctacttgttaacagaggagaaacaagatgagaattatgaacctggcggcagcgcaaaagatg

SEQ ID NO: 202336 - DNA, 103 bp, Artificial Sequence
  Synthetic Polynucleotide
taatacgactcactataggggattgatgcatctaaacggctacataattcaacagaggagagaattaatgagccgtttaaacctggcggcagcgcaaaagatg

SEQ ID NO: 202337 - DNA, 103 bp, Artificial Sequence
  Synthetic Polynucleotide
taatacgactcactatagggaattatttgagattgatgcatctaaacggcaacagaggagagccgttatgatgcatcaaaacctggcggcagcgcaaaagatg

SEQ ID NO: 202338 - DNA, 103 bp, Artificial Sequence
  Synthetic Polynucleotide
taatacgactcactatagggttacttgtagaattatttgagattgatgcaaacagaggagatgcatcatgctcaaataaaacctggcggcagcgcaaaagatg

SEQ ID NO: 202339 - DNA, 103 bp, Artificial Sequence
  Synthetic Polynucleotide
taatacgactcactatagggagatttccttttacttgtagaattatttgaaacagaggagatcaaatatgtctacaagtaacctggcggcagcgcaaaagatg

SEQ ID NO: 202340 - DNA, 103 bp, Artificial Sequence
  Synthetic Polynucleotide
taatacgactcactatagggtggcagactcagatttccttttacttgtagaacagaggagactacaaatgaaaggaaataacctggcggcagcgcaaaagatg

SEQ ID NO: 202341 - DNA, 103 bp, Artificial Sequence
  Synthetic Polynucleotide
taatacgactcactatagggaagttgcaagtggcagactcagatttccttaacagaggagaaaggaaatgtgagtctgcaacctggcggcagcgcaaaagatg

SEQ ID NO: 202342 - DNA, 103 bp, Artificial Sequence
  Synthetic Polynucleotide
taatacgactcactataggggtctctgactaagttgcaagtggcagactcaacagaggagagagtctatgacttgcaacaacctggcggcagcgcaaaagatg

SEQ ID NO: 202343 - DNA, 103 bp, Artificial Sequence
  Synthetic Polynucleotide
taatacgactcactatagggctttgtttatgtctctgactaagttgcaagaacagaggagacttgcaatgtagtcagagaacctggcggcagcgcaaaagatg

SEQ ID NO: 202344 - DNA, 103 bp, Artificial Sequence
  Synthetic Polynucleotide
taatacgactcactatagggtagtcatccaagtgttccttcttaactgttaacagaggagaaacagtatggaaggaacaaacctggcggcagcgcaaaagatg

SEQ ID NO: 202345 - DNA, 103 bp, Artificial Sequence
  Synthetic Polynucleotide
taatacgactcactatagggccaattcccactttgtttatgtctctgactaacagaggagaagtcagatgcataaacaaaacctggcggcagcgcaaaagatg

SEQ ID NO: 202346 - DNA, 103 bp, Artificial Sequence
  Synthetic Polynucleotide
taatacgactcactatagggagcaacaaggccaattcccactttgtttataacagaggagaataaacatggtgggaattaacctggcggcagcgcaaaagatg

SEQ ID NO: 202347 - DNA, 103 bp, Artificial Sequence
  Synthetic Polynucleotide
taatacgactcactatagggatgaagcggcagcaacaaggccaattcccaaacagaggagatgggaaatggccttgttgaacctggcggcagcgcaaaagatg

SEQ ID NO: 202348 - DNA, 103 bp, Artificial Sequence
  Synthetic Polynucleotide
taatacgactcactatagggagaagcggagatgaagcggcagcaacaaggaacagaggagaccttgtatgtgccgcttcaacctggcggcagcgcaaaagatg

SEQ ID NO: 202349 - DNA, 103 bp, Artificial Sequence
  Synthetic Polynucleotide
taatacgactcactatagggatctttcacaagaagcggagatgaagcggcaacagaggagagccgctatgtctccgcttaacctggcggcagcgcaaaagatg

SEQ ID NO: 202350 - DNA, 103 bp, Artificial Sequence
  Synthetic Polynucleotide
taatacgactcactatagggcacaaatgacatctttcacaagaagcggagaacagaggagactccgcatgttgtgaaagaacctggcggcagcgcaaaagatg

SEQ ID NO: 202351 - DNA, 103 bp, Artificial Sequence
  Synthetic Polynucleotide
taatacgactcactatagggttatcatcctcacaaatgacatctttcacaaacagaggagatgtgaaatgtgtcatttgaacctggcggcagcgcaaaagatg

SEQ ID NO: 202352 - DNA, 103 bp, Artificial Sequence
  Synthetic Polynucleotide
taatacgactcactataggggatttttcccttatcatcctcacaaatgacaacagaggagagtcattatggaggatgataacctggcggcagcgcaaaagatg

SEQ ID NO: 202353 - DNA, 103 bp, Artificial Sequence
  Synthetic Polynucleotide
taatacgactcactatagggcttcttccatgatttttcccttatcatcctaacagaggagaaggatgatgagggaaaaaaacctggcggcagcgcaaaagatg

SEQ ID NO: 202354 - DNA, 103 bp, Artificial Sequence
  Synthetic Polynucleotide
taatacgactcactataggggttctcattacttcttccatgatttttcccaacagaggagagggaaaatgcatggaagaaacctggcggcagcgcaaaagatg

SEQ ID NO: 202355 - DNA, 103 bp, Artificial Sequence
  Synthetic Polynucleotide
taatacgactcactatagggtgcttctccatagtcatccaagtgttccttaacagaggagaaaggaaatgttggatgacaacctggcggcagcgcaaaagatg

SEQ ID NO: 202356 - DNA, 103 bp, Artificial Sequence
  Synthetic Polynucleotide
taatacgactcactatagggttttaaataagttctcattacttcttccataacagaggagaatggaaatggtaatgagaaacctggcggcagcgcaaaagatg

SEQ ID NO: 202357 - DNA, 103 bp, Artificial Sequence
  Synthetic Polynucleotide
taatacgactcactatagggtttcctgttgttttaaataagttctcattaaacagaggagataatgaatgcttatttaaaacctggcggcagcgcaaaagatg

SEQ ID NO: 202358 - DNA, 103 bp, Artificial Sequence
  Synthetic Polynucleotide
taatacgactcactatagggaagtttagtttttcctgttgttttaaataaaacagaggagattatttatgacaacaggaaacctggcggcagcgcaaaagatg

SEQ ID NO: 202359 - DNA, 103 bp, Artificial Sequence
  Synthetic Polynucleotide
taatacgactcactatagggttgcaaaatcaagtttagtttttcctgttgaacagaggagacaacagatgaaactaaacaacctggcggcagcgcaaaagatg

SEQ ID NO: 202360 - DNA, 103 bp, Artificial Sequence
  Synthetic Polynucleotide
taatacgactcactataggggttgcttcttttgcaaaatcaagtttagttaacagaggagaaactaaatgtgattttgcaacctggcggcagcgcaaaagatg

SEQ ID NO: 202361 - DNA, 103 bp, Artificial Sequence
  Synthetic Polynucleotide
taatacgactcactatagggatctgaagttgttgcttcttttgcaaaatcaacagaggagagattttatgaaagaagcaaacctggcggcagcgcaaaagatg

SEQ ID NO: 202362 - DNA, 103 bp, Artificial Sequence
  Synthetic Polynucleotide
taatacgactcactatagggttttacttccatctgaagttgttgcttcttaacagaggagaaagaagatgcaacttcagaacctggcggcagcgcaaaagatg

SEQ ID NO: 202363 - DNA, 103 bp, Artificial Sequence
  Synthetic Polynucleotide
taatacgactcactatagggtactcaacatttttacttccatctgaagttaacagaggagaaacttcatgtggaagtaaaacctggcggcagcgcaaaagatg

SEQ ID NO: 202364 - DNA, 103 bp, Artificial Sequence
  Synthetic Polynucleotide
taatacgactcactataggggattttgaactactcaacatttttacttccaacagaggagaggaagtatgaatgttgagaacctggcggcagcgcaaaagatg

SEQ ID NO: 202365 - DNA, 103 bp, Artificial Sequence
  Synthetic Polynucleotide
taatacgactcactatagggttccttcatagattttgaactactcaacataacagaggagaatgttgatgagttcaaaaaacctggcggcagcgcaaaagatg

SEQ ID NO: 202366 - DNA, 103 bp, Artificial Sequence
  Synthetic Polynucleotide
taatacgactcactatagggtttccactggtgcttctccatagtcatccaaacagaggagatggatgatgatggagaagaacctggcggcagcgcaaaagatg

SEQ ID NO: 202367 - DNA, 103 bp, Artificial Sequence
  Synthetic Polynucleotide
taatacgactcactatagggcttcagtgagttccttcatagattttgaacaacagaggagagttcaaatgctatgaaggaacctggcggcagcgcaaaagatg

SEQ ID NO: 202368 - DNA, 103 bp, Artificial Sequence
  Synthetic Polynucleotide
taatacgactcactatagggttctgctgttcttcagtgagttccttcataaacagaggagatatgaaatgactcactgaaacctggcggcagcgcaaaagatg

SEQ ID NO: 202369 - DNA, 103 bp, Artificial Sequence
  Synthetic Polynucleotide
taatacgactcactatagggtttctgtaaattctgctgttcttcagtgagaacagaggagactcactatggaacagcagaacctggcggcagcgcaaaagatg

SEQ ID NO: 202370 - DNA, 103 bp, Artificial Sequence
  Synthetic Polynucleotide
taatacgactcactatagggattcaagctctttctgtaaattctgctgttaacagaggagaaacagcatgatttacagaaacctggcggcagcgcaaaagatg

SEQ ID NO: 202371 - DNA, 103 bp, Artificial Sequence
  Synthetic Polynucleotide
taatacgactcactatagggttctgcaaagattcaagctctttctgtaaaaacagaggagatttacaatgagagcttgaaacctggcggcagcgcaaaagatg

SEQ ID NO: 202372 - DNA, 103 bp, Artificial Sequence
  Synthetic Polynucleotide
taatacgactcactatagggagcatgttcattctgcaaagattcaagctcaacagaggagagagcttatgtctttgcagaacctggcggcagcgcaaaagatg

SEQ ID NO: 202373 - DNA, 103 bp, Artificial Sequence
  Synthetic Polynucleotide
taatacgactcactatagggccattctttgagcatgttcattctgcaaagaacagaggagactttgcatgatgaacatgaacctggcggcagcgcaaaagatg

SEQ ID NO: 202374 - DNA, 103 bp, Artificial Sequence
  Synthetic Polynucleotide
taatacgactcactatagggtaaaattcttccattctttgagcatgttcaaacagaggagatgaacaatgtcaaagaataacctggcggcagcgcaaaagatg

SEQ ID NO: 202375 - DNA, 103 bp, Artificial Sequence
  Synthetic Polynucleotide
taatacgactcactatagggctgttcaacataaaattcttccattctttgaacagaggagacaaagaatggaagaatttaacctggcggcagcgcaaaagatg

SEQ ID NO: 202376 - DNA, 103 bp, Artificial Sequence
  Synthetic Polynucleotide
taatacgactcactatagggctaagtctttctgttcaacataaaattcttaacagaggagaaagaatatgatgttgaacaacctggcggcagcgcaaaagatg

SEQ ID NO: 202377 - DNA, 103 bp, Artificial Sequence
  Synthetic Polynucleotide
taatacgactcactatagggtctccatcagtttccactggtgcttctccaaacagaggagatggagaatgaccagtggaaacctggcggcagcgcaaaagatg

SEQ ID NO: 202378 - DNA, 103 bp, Artificial Sequence
  Synthetic Polynucleotide
taatacgactcactatagggaattttttctctaagtctttctgttcaacaaacagaggagatgttgaatggaaagacttaacctggcggcagcgcaaaagatg

SEQ ID NO: 202379 - DNA, 103 bp, Artificial Sequence
  Synthetic Polynucleotide
taatacgactcactatagggtatctgctccaattttttctctaagtctttaacagaggagaaaagacatggagaaaaaaaacctggcggcagcgcaaaagatg

SEQ ID NO: 202380 - DNA, 103 bp, Artificial Sequence
  Synthetic Polynucleotide
taatacgactcactatagggtttgcttcattatctgctccaattttttctaacagaggagaagaaaaatgtggagcagaaacctggcggcagcgcaaaagatg

SEQ ID NO: 202381 - DNA, 103 bp, Artificial Sequence
  Synthetic Polynucleotide
taatacgactcactatagggcaggtacatttttgcttcattatctgctccaacagaggagaggagcaatgaatgaagcaaacctggcggcagcgcaaaagatg

SEQ ID NO: 202382 - DNA, 103 bp, Artificial Sequence
  Synthetic Polynucleotide
taatacgactcactatagggatttgagtcacaggtacatttttgcttcataacagaggagaatgaagatgaaatgtaccaacctggcggcagcgcaaaagatg

SEQ ID NO: 202383 - DNA, 103 bp, Artificial Sequence
  Synthetic Polynucleotide
taatacgactcactatagggctttttctaaatttgagtcacaggtacattaacagaggagaaatgtaatggtgactcaaaacctggcggcagcgcaaaagatg

SEQ ID NO: 202384 - DNA, 103 bp, Artificial Sequence
  Synthetic Polynucleotide
taatacgactcactataggggcctctttgtctttttctaaatttgagtcaaacagaggagatgactcatgtttagaaaaaacctggcggcagcgcaaaagatg

SEQ ID NO: 202385 - DNA, 103 bp, Artificial Sequence
  Synthetic Polynucleotide
taatacgactcactatagggtgcatattcagcctctttgtctttttctaaaacagaggagattagaaatggacaaagagaacctggcggcagcgcaaaagatg

SEQ ID NO: 202386 - DNA, 103 bp, Artificial Sequence
  Synthetic Polynucleotide
taatacgactcactatagggccaactgtcctgcatattcagcctctttgtaacagaggagaacaaagatgctgaatatgaacctggcggcagcgcaaaagatg

SEQ ID NO: 202387 - DNA, 103 bp, Artificial Sequence
  Synthetic Polynucleotide
taatacgactcactatagggctcagttctgccaactgtcctgcatattcaaacagaggagatgaataatgaggacagttaacctggcggcagcgcaaaagatg

SEQ ID NO: 202388 - DNA, 103 bp, Artificial Sequence
  Synthetic Polynucleotide
taatacgactcactatagggcttaacatgctctccatcagtttccactggaacagaggagaccagtgatgactgatggaaacctggcggcagcgcaaaagatg

SEQ ID NO: 202389 - DNA, 103 bp, Artificial Sequence
  Synthetic Polynucleotide
taatacgactcactatagggcaatctctgcctcagttctgccaactgtccaacagaggagaggacagatggcagaactgaacctggcggcagcgcaaaagatg

SEQ ID NO: 202390 - DNA, 103 bp, Artificial Sequence
  Synthetic Polynucleotide
taatacgactcactatagggcagcatggtccaatctctgcctcagttctgaacagaggagacagaacatgggcagagataacctggcggcagcgcaaaagatg

SEQ ID NO: 202391 - DNA, 103 bp, Artificial Sequence
  Synthetic Polynucleotide
taatacgactcactatagggctatcggcctcagcatggtccaatctctgcaacagaggagagcagagatgggaccatgcaacctggcggcagcgcaaaagatg

SEQ ID NO: 202392 - DNA, 103 bp, Artificial Sequence
  Synthetic Polynucleotide
taatacgactcactataggggagttcttgcctatcggcctcagcatggtcaacagaggagagaccatatggaggccgataacctggcggcagcgcaaaagatg

SEQ ID NO: 202393 - DNA, 103 bp, Artificial Sequence
  Synthetic Polynucleotide
taatacgactcactataggggttcatcttggagttcttgcctatcggcctaacagaggagaaggccgatgggcaagaacaacctggcggcagcgcaaaagatg

SEQ ID NO: 202394 - DNA, 103 bp, Artificial Sequence
  Synthetic Polynucleotide
taatacgactcactatagggtcctgtctgagttcatcttggagttcttgcaacagaggagagcaagaatgccaagatgaaacctggcggcagcgcaaaagatg

SEQ ID NO: 202395 - DNA, 103 bp, Artificial Sequence
  Synthetic Polynucleotide
taatacgactcactatagggtgcttcccgttcctgtctgagttcatcttgaacagaggagacaagatatgctcagacagaacctggcggcagcgcaaaagatg

SEQ ID NO: 202396 - DNA, 103 bp, Artificial Sequence
  Synthetic Polynucleotide
taatacgactcactatagggacttctgtcttgcttcccgttcctgtctgaaacagaggagatcagacatgaacgggaagaacctggcggcagcgcaaaagatg

SEQ ID NO: 202397 - DNA, 103 bp, Artificial Sequence
  Synthetic Polynucleotide
taatacgactcactatagggatcatctctaacttctgtcttgcttcccgtaacagaggagaacgggaatgaagacagaaaacctggcggcagcgcaaaagatg

SEQ ID NO: 202398 - DNA, 103 bp, Artificial Sequence
  Synthetic Polynucleotide
taatacgactcactatagggctcttttatcatcatctctaacttctgtctaacagaggagaagacagatgttagagatgaacctggcggcagcgcaaaagatg

SEQ ID NO: 202399 - DNA, 103 bp, Artificial Sequence
  Synthetic Polynucleotide
taatacgactcactatagggagccctgaaccaaggagaaatttgtctggaaacagaggagatccagaatgatttctcctaacctggcggcagcgcaaaagatg

SEQ ID NO: 202400 - DNA, 103 bp, Artificial Sequence
  Synthetic Polynucleotide
taatacgactcactatagggtacaggttcgcttaacatgctctccatcagaacagaggagactgatgatgagcatgttaaacctggcggcagcgcaaaagatg

SEQ ID NO: 202401 - DNA, 103 bp, Artificial Sequence
  Synthetic Polynucleotide
taatacgactcactataggggcagctttagctcttttatcatcatctctaaacagaggagatagagaatgtgataaaagaacctggcggcagcgcaaaagatg

SEQ ID NO: 202402 - DNA, 103 bp, Artificial Sequence
  Synthetic Polynucleotide
taatacgactcactatagggttcagaatttgcagctttagctcttttatcaacagaggagagataaaatggctaaagctaacctggcggcagcgcaaaagatg

SEQ ID NO: 202403 - DNA, 103 bp, Artificial Sequence
  Synthetic Polynucleotide
taatacgactcactatagggctttgatgatttcagaatttgcagctttagaacagaggagactaaagatgcaaattctgaacctggcggcagcgcaaaagatg

SEQ ID NO: 202404 - DNA, 103 bp, Artificial Sequence
  Synthetic Polynucleotide
taatacgactcactatagggctttagcagtctttgatgatttcagaatttaacagaggagaaaattcatgaatcatcaaaacctggcggcagcgcaaaagatg

SEQ ID NO: 202405 - DNA, 103 bp, Artificial Sequence
  Synthetic Polynucleotide
taatacgactcactatagggggaacagaagtacaggttcgcttaacatgcaacagaggagagcatgtatggcgaacctgaacctggcggcagcgcaaaagatg

SEQ ID NO: 202406 - DNA, 103 bp, Artificial Sequence
  Synthetic Polynucleotide
taatacgactcactatagggcaaagtttcaggaacagaagtacaggttcgaacagaggagacgaaccatgacttctgttaacctggcggcagcgcaaaagatg

SEQ ID NO: 202407 - DNA, 103 bp, Artificial Sequence
  Synthetic Polynucleotide
taatacgactcactataggggatttaaatgcaaagtttcaggaacagaagaacagaggagacttctgatgctgaaacttaacctggcggcagcgcaaaagatg

SEQ ID NO: 202408 - DNA, 103 bp, Artificial Sequence
  Synthetic Polynucleotide
taatacgactcactatagggttcaaactgggatttaaatgcaaagtttcaaacagaggagatgaaacatggcatttaaaaacctggcggcagcgcaaaagatg

SEQ ID NO: 202409 - DNA, 103 bp, Artificial Sequence
  Synthetic Polynucleotide
taatacgactcactatagggcaatgtgtgtttcaaactgggatttaaatgaacagaggagacatttaatgcccagtttgaacctggcggcagcgcaaaagatg

SEQ ID NO: 202410 - DNA, 103 bp, Artificial Sequence
  Synthetic Polynucleotide
taatacgactcactatagggggaattgtgccaatgtgtgtttcaaactggaacagaggagaccagttatgaacacacataacctggcggcagcgcaaaagatg

SEQ ID NO: 202411 - DNA, 103 bp, Artificial Sequence
  Synthetic Polynucleotide
taatacgactcactatagggctacttaaatggaattgtgccaatgtgtgtaacagaggagaacacacatgggcacaattaacctggcggcagcgcaaaagatg

SEQ ID NO: 202412 - DNA, 103 bp, Artificial Sequence
  Synthetic Polynucleotide
taatacgactcactatagggcgagctctgactacttaaatggaattgtgcaacagaggagagcacaaatgcatttaagtaacctggcggcagcgcaaaagatg

SEQ ID NO: 202413 - DNA, 103 bp, Artificial Sequence
  Synthetic Polynucleotide
taatacgactcactataggggtccacccagcgagctctgactacttaaataacagaggagaatttaaatggtcagagctaacctggcggcagcgcaaaagatg

SEQ ID NO: 202414 - DNA, 103 bp, Artificial Sequence
  Synthetic Polynucleotide
taatacgactcactatagggtttttagttgagccctgaaccaaggagaaaaacagaggagatttctcatgggttcagggaacctggcggcagcgcaaaagatg

SEQ ID NO: 202415 - DNA, 103 bp, Artificial Sequence
  Synthetic Polynucleotide
taatacgactcactatagggaatgctgctggtccacccagcgagctctgaaacagaggagatcagagatggctgggtggaacctggcggcagcgcaaaagatg

SEQ ID NO: 202416 - DNA, 103 bp, Artificial Sequence
  Synthetic Polynucleotide
taatacgactcactatagggccgagcagaaaatgctgctggtccacccagaacagaggagactgggtatgccagcagcaaacctggcggcagcgcaaaagatg

SEQ ID NO: 202417 - DNA, 103 bp, Artificial Sequence
  Synthetic Polynucleotide
taatacgactcactatagggcttgggaatgccgagcagaaaatgctgctgaacagaggagacagcagatgtttctgctcaacctggcggcagcgcaaaagatg

SEQ ID NO: 202418 - DNA, 103 bp, Artificial Sequence
  Synthetic Polynucleotide
taatacgactcactataggggacatgctttcttgggaatgccgagcagaaaacagaggagattctgcatggcattcccaaacctggcggcagcgcaaaagatg

SEQ ID NO: 202419 - DNA, 103 bp, Artificial Sequence
  Synthetic Polynucleotide
taatacgactcactatagggtacagtaggcgacatgctttcttgggaatgaacagaggagacattccatggaaagcatgaacctggcggcagcgcaaaagatg

SEQ ID NO: 202420 - DNA, 103 bp, Artificial Sequence
  Synthetic Polynucleotide
taatacgactcactataggggaggcagaaatacagtaggcgacatgctttaacagaggagaaaagcaatgcgcctactgaacctggcggcagcgcaaaagatg

SEQ ID NO: 202421 - DNA, 103 bp, Artificial Sequence
  Synthetic Polynucleotide
taatacgactcactatagggggtgatggaagaggcagaaatacagtaggcaacagaggagagcctacatgatttctgccaacctggcggcagcgcaaaagatg

SEQ ID NO: 202422 - DNA, 103 bp, Artificial Sequence
  Synthetic Polynucleotide
taatacgactcactatagggaagaacctgaggtgatggaagaggcagaaaaacagaggagatttctgatgcttccatcaaacctggcggcagcgcaaaagatg

SEQ ID NO: 202423 - DNA, 103 bp, Artificial Sequence
  Synthetic Polynucleotide
taatacgactcactatagggatgggccaggaagaacctgaggtgatggaaaacagaggagattccatatgctcaggttcaacctggcggcagcgcaaaagatg

SEQ ID NO: 202424 - DNA, 103 bp, Artificial Sequence
  Synthetic Polynucleotide
taatacgactcactataggggggatgagcaatgggccaggaagaacctgaaacagaggagatcaggtatgtcctggcccaacctggcggcagcgcaaaagatg

SEQ ID NO: 202425 - DNA, 103 bp, Artificial Sequence
  Synthetic Polynucleotide
taatacgactcactatagggcccattcagttttttagttgagccctgaacaacagaggagagttcagatgtcaactaaaaacctggcggcagcgcaaaagatg

SEQ ID NO: 202426 - DNA, 103 bp, Artificial Sequence
  Synthetic Polynucleotide
taatacgactcactataggggctatctgaagggatgagcaatgggccaggaacagaggagacctggcatgttgctcatcaacctggcggcagcgcaaaagatg

SEQ ID NO: 202427 - DNA, 103 bp, Artificial Sequence
  Synthetic Polynucleotide
taatacgactcactataggggttctgtggagctatctgaagggatgagcaaacagaggagatgctcaatgcttcagataaacctggcggcagcgcaaaagatg

SEQ ID NO: 202428 - DNA, 103 bp, Artificial Sequence
  Synthetic Polynucleotide
taatacgactcactataggggtctgagtgagttctgtggagctatctgaaaacagaggagattcagaatgctccacagaaacctggcggcagcgcaaaagatg

SEQ ID NO: 202429 - DNA, 103 bp, Artificial Sequence
  Synthetic Polynucleotide
taatacgactcactatagggttccaacacagtctgagtgagttctgtggaaacagaggagatccacaatgctcactcagaacctggcggcagcgcaaaagatg

SEQ ID NO: 202430 - DNA, 103 bp, Artificial Sequence
  Synthetic Polynucleotide
taatacgactcactatagggtagattccccttccaacacagtctgagtgaaacagaggagatcactcatgctgtgttggaacctggcggcagcgcaaaagatg

SEQ ID NO: 202431 - DNA, 103 bp, Artificial Sequence
  Synthetic Polynucleotide
taatacgactcactatagggaaacaagaaatagattccccttccaacacaaacagaggagatgtgttatgaggggaatcaacctggcggcagcgcaaaagatg

SEQ ID NO: 202432 - DNA, 103 bp, Artificial Sequence
  Synthetic Polynucleotide
taatacgactcactatagggtccaacttgaaaacaagaaatagattccccaacagaggagaggggaaatgatttcttgtaacctggcggcagcgcaaaagatg

SEQ ID NO: 202433 - DNA, 103 bp, Artificial Sequence
  Synthetic Polynucleotide
taatacgactcactatagggtcttttctcctccaacttgaaaacaagaaaaacagaggagatttcttatgttcaagttgaacctggcggcagcgcaaaagatg

SEQ ID NO: 202434 - DNA, 103 bp, Artificial Sequence
  Synthetic Polynucleotide
taatacgactcactatagggaaacagagtctcttttctcctccaacttgaaacagaggagatcaagtatgaggagaaaaaacctggcggcagcgcaaaagatg

SEQ ID NO: 202435 - DNA, 103 bp, Artificial Sequence
  Synthetic Polynucleotide
taatacgactcactataggggacttggggcaaacagagtctcttttctccaacagaggagaggagaaatgagactctgtaacctggcggcagcgcaaaagatg

SEQ ID NO: 202436 - DNA, 103 bp, Artificial Sequence
  Synthetic Polynucleotide
taatacgactcactatagggcatctcccatcccattcagttttttagttgaacagaggagacaactaatgaactgaatgaacctggcggcagcgcaaaagatg

SEQ ID NO: 202437 - DNA, 103 bp, Artificial Sequence
  Synthetic Polynucleotide
taatacgactcactatagggcagaatttaagacttggggcaaacagagtcaacagaggagagactctatgtgccccaagaacctggcggcagcgcaaaagatg

SEQ ID NO: 202438 - DNA, 103 bp, Artificial Sequence
  Synthetic Polynucleotide
taatacgactcactatagggtctcggagaacagaatttaagacttggggcaacagaggagagccccaatgcttaaattcaacctggcggcagcgcaaaagatg

SEQ ID NO: 202439 - DNA, 103 bp, Artificial Sequence
  Synthetic Polynucleotide
taatacgactcactataggggagtgtaaattctcggagaacagaatttaaaacagaggagattaaatatggttctccgaaacctggcggcagcgcaaaagatg

SEQ ID NO: 202440 - DNA, 103 bp, Artificial Sequence
  Synthetic Polynucleotide
taatacgactcactatagggttatttgctggagtgtaaattctcggagaaaacagaggagattctccatgaatttacacaacctggcggcagcgcaaaagatg

SEQ ID NO: 202441 - DNA, 103 bp, Artificial Sequence
  Synthetic Polynucleotide
taatacgactcactatagggcacactgtatttatttgctggagtgtaaataacagaggagaatttacatgccagcaaataacctggcggcagcgcaaaagatg

SEQ ID NO: 202442 - DNA, 103 bp, Artificial Sequence
  Synthetic Polynucleotide
taatacgactcactatagggcagttcatcacacactgtatttatttgctgaacagaggagacagcaaatgaatacagtgaacctggcggcagcgcaaaagatg

SEQ ID NO: 202443 - DNA, 103 bp, Artificial Sequence
  Synthetic Polynucleotide
taatacgactcactatagggaatatatgtacagttcatcacacactgtataacagaggagaatacagatggtgatgaacaacctggcggcagcgcaaaagatg

SEQ ID NO: 202444 - DNA, 103 bp, Artificial Sequence
  Synthetic Polynucleotide
taatacgactcactatagggcaccttgaacaatatatgtacagttcatcaaacagaggagatgatgaatggtacatataaacctggcggcagcgcaaaagatg

SEQ ID NO: 202445 - DNA, 103 bp, Artificial Sequence
  Synthetic Polynucleotide
taatacgactcactataggggtctgaagtacaccttgaacaatatatgtaaacagaggagatacataatgtgttcaaggaacctggcggcagcgcaaaagatg

SEQ ID NO: 202446 - DNA, 103 bp, Artificial Sequence
  Synthetic Polynucleotide
taatacgactcactatagggtatgaagctggtctgaagtacaccttgaacaacagaggagagttcaaatggtacttcagaacctggcggcagcgcaaaagatg

SEQ ID NO: 202447 - DNA, 103 bp, Artificial Sequence
  Synthetic Polynucleotide
taatacgactcactataggggggctgccatcatctcccatcccattcagtaacagaggagaactgaaatggatgggagaaacctggcggcagcgcaaaagatg

SEQ ID NO: 202448 - DNA, 103 bp, Artificial Sequence
  Synthetic Polynucleotide
taatacgactcactatagggacctttaagatatgaagctggtctgaagtaaacagaggagatacttcatgccagcttcaaacctggcggcagcgcaaaagatg

SEQ ID NO: 202449 - DNA, 103 bp, Artificial Sequence
  Synthetic Polynucleotide
taatacgactcactatagggtatgcccagtacctttaagatatgaagctgaacagaggagacagcttatgatcttaaagaacctggcggcagcgcaaaagatg

SEQ ID NO: 202450 - DNA, 103 bp, Artificial Sequence
  Synthetic Polynucleotide
taatacgactcactatagggtgaatggaagtatgcccagtacctttaagaaacagaggagatcttaaatgtactgggcaaacctggcggcagcgcaaaagatg

SEQ ID NO: 202451 - DNA, 103 bp, Artificial Sequence
  Synthetic Polynucleotide
taatacgactcactataggggatggggcattgaatggaagtatgcccagtaacagaggagaactgggatgacttccattaacctggcggcagcgcaaaagatg

SEQ ID NO: 202452 - DNA, 103 bp, Artificial Sequence
  Synthetic Polynucleotide
taatacgactcactatagggcagcccacaggatggggcattgaatggaagaacagaggagacttccaatgaatgccccaaacctggcggcagcgcaaaagatg

SEQ ID NO: 202453 - DNA, 103 bp, Artificial Sequence
  Synthetic Polynucleotide
taatacgactcactatagggttaatgtaatcagcccacaggatggggcataacagaggagaatgcccatgcctgtgggcaacctggcggcagcgcaaaagatg

SEQ ID NO: 202454 - DNA, 103 bp, Artificial Sequence
  Synthetic Polynucleotide
taatacgactcactatagggtgtgcatcagttaatgtaatcagcccacagaacagaggagactgtggatggattacattaacctggcggcagcgcaaaagatg

SEQ ID NO: 202455 - DNA, 103 bp, Artificial Sequence
  Synthetic Polynucleotide
taatacgactcactatagggacataatctttgtgcatcagttaatgtaataacagaggagaattacaatgactgatgcaaacctggcggcagcgcaaaagatg

SEQ ID NO: 202456 - DNA, 103 bp, Artificial Sequence
  Synthetic Polynucleotide
taatacgactcactatagggataaagcattacataatctttgtgcatcagaacagaggagactgatgatgaaagattataacctggcggcagcgcaaaagatg

SEQ ID NO: 202457 - DNA, 103 bp, Artificial Sequence
  Synthetic Polynucleotide
taatacgactcactatagggcgtggccgcaataaagcattacataatcttaacagaggagaaagattatgtaatgctttaacctggcggcagcgcaaaagatg

SEQ ID NO: 202458 - DNA, 103 bp, Artificial Sequence
  Synthetic Polynucleotide
taatacgactcactatagggtttcgctggggggctgccatcatctcccataacagaggagaatgggaatggatggcagcaacctggcggcagcgcaaaagatg

SEQ ID NO: 202459 - DNA, 103 bp, Artificial Sequence
  Synthetic Polynucleotide
taatacgactcactatagggaggaaaagttcgtggccgcaataaagcattaacagaggagaaatgctatgttgcggccaaacctggcggcagcgcaaaagatg

SEQ ID NO: 202460 - DNA, 103 bp, Artificial Sequence
  Synthetic Polynucleotide
taatacgactcactatagggtaccattttgaggaaaagttcgtggccgcaaacagaggagatgcggcatggaacttttcaacctggcggcagcgcaaaagatg

SEQ ID NO: 202461 - DNA, 103 bp, Artificial Sequence
  Synthetic Polynucleotide
taatacgactcactatagggggaagtacgctaccattttgaggaaaagttaacagaggagaaactttatgtcaaaatggaacctggcggcagcgcaaaagatg

SEQ ID NO: 202462 - DNA, 103 bp, Artificial Sequence
  Synthetic Polynucleotide
taatacgactcactataggggcttttagcaggaagtacgctaccattttgaacagaggagacaaaatatgagcgtacttaacctggcggcagcgcaaaagatg

SEQ ID NO: 202463 - DNA, 103 bp, Artificial Sequence
  Synthetic Polynucleotide
taatacgactcactataggggggccaatgagcttttagcaggaagtacgcaacagaggagagcgtacatgctgctaaaaaacctggcggcagcgcaaaagatg

SEQ ID NO: 202464 - DNA, 103 bp, Artificial Sequence
  Synthetic Polynucleotide
taatacgactcactatagggtcctttaactgggccaatgagcttttagcaaacagaggagatgctaaatgctcattggcaacctggcggcagcgcaaaagatg

SEQ ID NO: 202465 - DNA, 103 bp, Artificial Sequence
  Synthetic Polynucleotide
taatacgactcactatagggactgccagtttcctttaactgggccaatgaaacagaggagatcattgatgcagttaaagaacctggcggcagcgcaaaagatg

SEQ ID NO: 202466 - DNA, 103 bp, Artificial Sequence
  Synthetic Polynucleotide
taatacgactcactatagggcttcaaaggcactgccagtttcctttaactaacagaggagaagttaaatgaaactggcaaacctggcggcagcgcaaaagatg

SEQ ID NO: 202467 - DNA, 103 bp, Artificial Sequence
  Synthetic Polynucleotide
taatacgactcactatagggtcatgctccacttcaaaggcactgccagttaacagaggagaaactggatgtgcctttgaaacctggcggcagcgcaaaagatg

SEQ ID NO: 202468 - DNA, 103 bp, Artificial Sequence
  Synthetic Polynucleotide
taatacgactcactataggggcctaggcattcatgctccacttcaaaggcaacagaggagagcctttatggtggagcataacctggcggcagcgcaaaagatg

SEQ ID NO: 202469 - DNA, 103 bp, Artificial Sequence
  Synthetic Polynucleotide
taatacgactcactatagggttatcatttttttcgctggggggctgccataacagaggagaatggcaatgccccagcgaaacctggcggcagcgcaaaagatg

SEQ ID NO: 202470 - DNA, 103 bp, Artificial Sequence
  Synthetic Polynucleotide
taatacgactcactatagggcctgacatttgcctaggcattcatgctccaaacagaggagatggagcatgaatgcctagaacctggcggcagcgcaaaagatg

SEQ ID NO: 202471 - DNA, 103 bp, Artificial Sequence
  Synthetic Polynucleotide
taatacgactcactataggggcaaataaaccctgacatttgcctaggcataacagaggagaatgcctatgcaaatgtcaaacctggcggcagcgcaaaagatg

SEQ ID NO: 202472 - DNA, 103 bp, Artificial Sequence
  Synthetic Polynucleotide
taatacgactcactatagggaaactggggtgcaaataaaccctgacatttaacagaggagaaaatgtatgggtttatttaacctggcggcagcgcaaaagatg

SEQ ID NO: 202473 - DNA, 103 bp, Artificial Sequence
  Synthetic Polynucleotide
taatacgactcactataggggctgaacataaaactggggtgcaaataaacaacagaggagagtttatatgcaccccagtaacctggcggcagcgcaaaagatg

SEQ ID NO: 202474 - DNA, 103 bp, Artificial Sequence
  Synthetic Polynucleotide
taatacgactcactatagggggagcatcaggctgaacataaaactggggtaacagaggagaaccccaatgttatgttcaaacctggcggcagcgcaaaagatg

SEQ ID NO: 202475 - DNA, 103 bp, Artificial Sequence
  Synthetic Polynucleotide
taatacgactcactatagggttgaatacacggagcatcaggctgaacataaacagaggagatatgttatgcctgatgctaacctggcggcagcgcaaaagatg

SEQ ID NO: 202476 - DNA, 103 bp, Artificial Sequence
  Synthetic Polynucleotide
taatacgactcactatagggactccagacattgaatacacggagcatcagaacagaggagactgatgatgcgtgtattcaacctggcggcagcgcaaaagatg

SEQ ID NO: 202477 - DNA, 103 bp, Artificial Sequence
  Synthetic Polynucleotide
taatacgactcactatagggattccacaacactccagacattgaatacacaacagaggagagtgtatatgatgtctggaaacctggcggcagcgcaaaagatg

SEQ ID NO: 202478 - DNA, 103 bp, Artificial Sequence
  Synthetic Polynucleotide
taatacgactcactataggggggtgcaaacattccacaacactccagacaaacagaggagatgtctgatgtgttgtggaaacctggcggcagcgcaaaagatg

SEQ ID NO: 202479 - DNA, 103 bp, Artificial Sequence
  Synthetic Polynucleotide
taatacgactcactatagggcaaacgtctggggtgcaaacattccacaacaacagaggagagttgtgatgtgtttgcacaacctggcggcagcgcaaaagatg

SEQ ID NO: 202480 - DNA, 103 bp, Artificial Sequence
  Synthetic Polynucleotide
taatacgactcactatagggtgaatgtccgttatcatttttttcgctgggaacagaggagacccagcatgaaaaatgataacctggcggcagcgcaaaagatg

SEQ ID NO: 202481 - DNA, 103 bp, Artificial Sequence
  Synthetic Polynucleotide
taatacgactcactataggggaatgcatcacaaacgtctggggtgcaaacaacagaggagagtttgcatgccagacgttaacctggcggcagcgcaaaagatg

SEQ ID NO: 202482 - DNA, 103 bp, Artificial Sequence
  Synthetic Polynucleotide
taatacgactcactatagggtgatctgtgagaatgcatcacaaacgtctgaacagaggagacagacgatggtgatgcataacctggcggcagcgcaaaagatg

SEQ ID NO: 202483 - DNA, 103 bp, Artificial Sequence
  Synthetic Polynucleotide
taatacgactcactatagggttttgtcaggtgatctgtgagaatgcatcaaacagaggagatgatgcatgctcacagataacctggcggcagcgcaaaagatg

SEQ ID NO: 202484 - DNA, 103 bp, Artificial Sequence
  Synthetic Polynucleotide
taatacgactcactatagggtggcaagttcttttgtcaggtgatctgtgaaacagaggagatcacagatgacctgacaaaacctggcggcagcgcaaaagatg

SEQ ID NO: 202485 - DNA, 103 bp, Artificial Sequence
  Synthetic Polynucleotide
taatacgactcactatagggaaagccccagtggcaagttcttttgtcaggaacagaggagacctgacatgagaacttgcaacctggcggcagcgcaaaagatg

SEQ ID NO: 202486 - DNA, 103 bp, Artificial Sequence
  Synthetic Polynucleotide
taatacgactcactatagggtagctgattcaaagccccagtggcaagttcaacagaggagagaacttatgactggggctaacctggcggcagcgcaaaagatg

SEQ ID NO: 202487 - DNA, 103 bp, Artificial Sequence
  Synthetic Polynucleotide
taatacgactcactatagggcaatgccatttagctgattcaaagccccagaacagaggagactggggatgtgaatcagcaacctggcggcagcgcaaaagatg

SEQ ID NO: 202488 - DNA, 103 bp, Artificial Sequence
  Synthetic Polynucleotide
taatacgactcactatagggatgaagatagcaatgccatttagctgattcaacagaggagagaatcaatgaaatggcataacctggcggcagcgcaaaagatg

SEQ ID NO: 202489 - DNA, 103 bp, Artificial Sequence
  Synthetic Polynucleotide
taatacgactcactatagggtttggttcacatgaagatagcaatgccattaacagaggagaaatggcatggctatcttcaacctggcggcagcgcaaaagatg

SEQ ID NO: 202490 - DNA, 103 bp, Artificial Sequence
  Synthetic Polynucleotide
taatacgactcactatagggcctaagtatttttggttcacatgaagatagaacagaggagactatctatgtgtgaaccaaacctggcggcagcgcaaaagatg

SEQ ID NO: 202491 - DNA, 103 bp, Artificial Sequence
  Synthetic Polynucleotide
taatacgactcactatagggtgtaaaggaaaataaacttgtcacattcataacagaggagaatgaatatgacaagtttaaacctggcggcagcgcaaaagatg

SEQ ID NO: 202492 - DNA, 103 bp, Artificial Sequence
  Synthetic Polynucleotide
taatacgactcactatagggttttttcaccaaagcatcaacagctttctcaacagaggagagagaaaatggttgatgctaacctggcggcagcgcaaaagatg

SEQ ID NO: 202493 - DNA, 103 bp, Artificial Sequence
  Synthetic Polynucleotide
taatacgactcactatagggtccaacataataaagatgaactccttttccaacagaggagaggaaaaatggttcatcttaacctggcggcagcgcaaaagatg

SEQ ID NO: 202494 - DNA, 103 bp, Artificial Sequence
  Synthetic Polynucleotide
taatacgactcactatagggacacctcccctccaacataataaagatgaaaacagaggagattcatcatgattatgttgaacctggcggcagcgcaaaagatg

SEQ ID NO: 202495 - DNA, 103 bp, Artificial Sequence
  Synthetic Polynucleotide
taatacgactcactatagggcattcggcatacacctcccctccaacataaaacagaggagattatgtatgaggggaggtaacctggcggcagcgcaaaagatg

SEQ ID NO: 202496 - DNA, 103 bp, Artificial Sequence
  Synthetic Polynucleotide
taatacgactcactataggggtcactaaggcattcggcatacacctccccaacagaggagaggggagatgtatgccgaaaacctggcggcagcgcaaaagatg

SEQ ID NO: 202497 - DNA, 103 bp, Artificial Sequence
  Synthetic Polynucleotide
taatacgactcactatagggagatgctactgtcactaaggcattcggcataacagaggagaatgccgatggccttagtgaacctggcggcagcgcaaaagatg

SEQ ID NO: 202498 - DNA, 103 bp, Artificial Sequence
  Synthetic Polynucleotide
taatacgactcactatagggctttgcacaaagatgctactgtcactaaggaacagaggagaccttagatgcagtagcataacctggcggcagcgcaaaagatg

SEQ ID NO: 202499 - DNA, 103 bp, Artificial Sequence
  Synthetic Polynucleotide
taatacgactcactataggggcagttccgactttgcacaaagatgctactaacagaggagaagtagcatgtttgtgcaaaacctggcggcagcgcaaaagatg

SEQ ID NO: 202500 - DNA, 103 bp, Artificial Sequence
  Synthetic Polynucleotide
taatacgactcactataggggatggtagttgcagttccgactttgcacaaaacagaggagattgtgcatggtcggaactaacctggcggcagcgcaaaagatg

SEQ ID NO: 202501 - DNA, 103 bp, Artificial Sequence
  Synthetic Polynucleotide
taatacgactcactatagggtgaaatccatgatggtagttgcagttccgaaacagaggagatcggaaatgcaactaccaaacctggcggcagcgcaaaagatg

SEQ ID NO: 202502 - DNA, 103 bp, Artificial Sequence
  Synthetic Polynucleotide
taatacgactcactatagggagtagtaggatgaaatccatgatggtagttaacagaggagaaactacatgcatggatttaacctggcggcagcgcaaaagatg

SEQ ID NO: 202503 - DNA, 103 bp, Artificial Sequence
  Synthetic Polynucleotide
taatacgactcactatagggttttcttcagttttttcaccaaagcatcaaaacagaggagattgatgatgtggtgaaaaaacctggcggcagcgcaaaagatg

SEQ ID NO: 202504 - DNA, 103 bp, Artificial Sequence
  Synthetic Polynucleotide
taatacgactcactatagggtcttgcaaacagtagtaggatgaaatccataacagaggagaatggatatgatcctactaaacctggcggcagcgcaaaagatg

SEQ ID NO: 202505 - DNA, 103 bp, Artificial Sequence
  Synthetic Polynucleotide
taatacgactcactatagggccactagggatcttgcaaacagtagtaggaaacagaggagatcctacatgtgtttgcaaaacctggcggcagcgcaaaagatg

SEQ ID NO: 202506 - DNA, 103 bp, Artificial Sequence
  Synthetic Polynucleotide
taatacgactcactatagggcagactacacccactagggatcttgcaaacaacagaggagagtttgcatgatccctagtaacctggcggcagcgcaaaagatg

SEQ ID NO: 202507 - DNA, 103 bp, Artificial Sequence
  Synthetic Polynucleotide
taatacgactcactatagggtaaaaattttcagactacacccactagggaaacagaggagatccctaatgggtgtagtcaacctggcggcagcgcaaaagatg

SEQ ID NO: 202508 - DNA, 103 bp, Artificial Sequence
  Synthetic Polynucleotide
taatacgactcactatagggtcttggttgttaaaaattttcagactacacaacagaggagagtgtagatggaaaattttaacctggcggcagcgcaaaagatg

SEQ ID NO: 202509 - DNA, 103 bp, Artificial Sequence
  Synthetic Polynucleotide
taatacgactcactatagggctgagcaaattcttggttgttaaaaattttaacagaggagaaaaattatgaacaaccaaaacctggcggcagcgcaaaagatg

SEQ ID NO: 202510 - DNA, 103 bp, Artificial Sequence
  Synthetic Polynucleotide
taatacgactcactataggggtgccaataactgagcaaattcttggttgtaacagaggagaacaaccatgaatttgctcaacctggcggcagcgcaaaagatg

SEQ ID NO: 202511 - DNA, 103 bp, Artificial Sequence
  Synthetic Polynucleotide
taatacgactcactatagggttcacagactgtgccaataactgagcaaataacagaggagaatttgcatggttattggcaacctggcggcagcgcaaaagatg

SEQ ID NO: 202512 - DNA, 103 bp, Artificial Sequence
  Synthetic Polynucleotide
taatacgactcactatagggaaatccatggttcacagactgtgccaataaaacagaggagattattgatgcagtctgtgaacctggcggcagcgcaaaagatg

SEQ ID NO: 202513 - DNA, 103 bp, Artificial Sequence
  Synthetic Polynucleotide
taatacgactcactatagggagactgtctcaaatccatggttcacagactaacagaggagaagtctgatgaccatggataacctggcggcagcgcaaaagatg

SEQ ID NO: 202514 - DNA, 103 bp, Artificial Sequence
  Synthetic Polynucleotide
taatacgactcactataggggcacctttctttttcttcagttttttcaccaacagaggagaggtgaaatgactgaagaaaacctggcggcagcgcaaaagatg

SEQ ID NO: 202515 - DNA, 103 bp, Artificial Sequence
  Synthetic Polynucleotide
taatacgactcactataggggtaagctcatagactgtctcaaatccatggaacagaggagaccatggatgtgagacagtaacctggcggcagcgcaaaagatg

SEQ ID NO: 202516 - DNA, 103 bp, Artificial Sequence
  Synthetic Polynucleotide
taatacgactcactatagggacacatttttgtaagctcatagactgtctcaacagaggagagagacaatgtatgagcttaacctggcggcagcgcaaaagatg

SEQ ID NO: 202517 - DNA, 103 bp, Artificial Sequence
  Synthetic Polynucleotide
taatacgactcactatagggtacgtatagtacacatttttgtaagctcataacagaggagaatgagcatgcaaaaatgtaacctggcggcagcgcaaaagatg

SEQ ID NO: 202518 - DNA, 103 bp, Artificial Sequence
  Synthetic Polynucleotide
taatacgactcactatagggacaaagctcatacgtatagtacacatttttaacagaggagaaaaaatatgtactatacgaacctggcggcagcgcaaaagatg

SEQ ID NO: 202519 - DNA, 103 bp, Artificial Sequence
  Synthetic Polynucleotide
taatacgactcactatagggccagcccttcacaaagctcatacgtatagtaacagaggagaactataatgatgagctttaacctggcggcagcgcaaaagatg

SEQ ID NO: 202520 - DNA, 103 bp, Artificial Sequence
  Synthetic Polynucleotide
taatacgactcactatagggattctgctccccagcccttcacaaagctcaaacagaggagatgagctatgtgaagggctaacctggcggcagcgcaaaagatg

SEQ ID NO: 202521 - DNA, 103 bp, Artificial Sequence
  Synthetic Polynucleotide
taatacgactcactatagggtggcggtggtattctgctccccagcccttcaacagaggagagaagggatggggagcagaaacctggcggcagcgcaaaagatg

SEQ ID NO: 202522 - DNA, 103 bp, Artificial Sequence
  Synthetic Polynucleotide
taatacgactcactatagggagtaacatcctggcggtggtattctgctccaacagaggagaggagcaatgtaccaccgcaacctggcggcagcgcaaaagatg

SEQ ID NO: 202523 - DNA, 103 bp, Artificial Sequence
  Synthetic Polynucleotide
taatacgactcactatagggagggggtgctagtaacatcctggcggtggtaacagaggagaaccaccatgaggatgttaaacctggcggcagcgcaaaagatg

SEQ ID NO: 202524 - DNA, 103 bp, Artificial Sequence
  Synthetic Polynucleotide
taatacgactcactatagggtcaatccagcagggggtgctagtaacatccaacagaggagaggatgtatgtagcaccccaacctggcggcagcgcaaaagatg

SEQ ID NO: 202525 - DNA, 103 bp, Artificial Sequence
  Synthetic Polynucleotide
taatacgactcactatagggttcctccatggcacctttctttttcttcagaacagaggagactgaagatgaagaaaggtaacctggcggcagcgcaaaagatg

SEQ ID NO: 202526 - DNA, 103 bp, Artificial Sequence
  Synthetic Polynucleotide
taatacgactcactatagggcagatgtatctcaatccagcagggggtgctaacagaggagaagcaccatgtgctggattaacctggcggcagcgcaaaagatg

SEQ ID NO: 202527 - DNA, 103 bp, Artificial Sequence
  Synthetic Polynucleotide
taatacgactcactataggggggggccgtgcagatgtatctcaatccagcaacagaggagagctggaatgagatacatcaacctggcggcagcgcaaaagatg

SEQ ID NO: 202528 - DNA, 103 bp, Artificial Sequence
  Synthetic Polynucleotide
taatacgactcactatagggagccactggagggggccgtgcagatgtatcaacagaggagagatacaatggcacggcccaacctggcggcagcgcaaaagatg

SEQ ID NO: 202529 - DNA, 103 bp, Artificial Sequence
  Synthetic Polynucleotide
taatacgactcactatagggaactttatccagccactggagggggccgtgaacagaggagacacggcatgctccagtggaacctggcggcagcgcaaaagatg

SEQ ID NO: 202530 - DNA, 103 bp, Artificial Sequence
  Synthetic Polynucleotide
taatacgactcactatagggtttgagtaagaactttatccagccactggaaacagaggagatccagtatgtggataaagaacctggcggcagcgcaaaagatg

SEQ ID NO: 202531 - DNA, 103 bp, Artificial Sequence
  Synthetic Polynucleotide
taatacgactcactatagggggtgaacccatttgagtaagaactttatccaacagaggagaggataaatgtcttactcaaacctggcggcagcgcaaaagatg

SEQ ID NO: 202532 - DNA, 103 bp, Artificial Sequence
  Synthetic Polynucleotide
taatacgactcactatagggaggattatgaggtgaacccatttgagtaagaacagaggagacttactatgatgggttcaaacctggcggcagcgcaaaagatg

SEQ ID NO: 202533 - DNA, 103 bp, Artificial Sequence
  Synthetic Polynucleotide
taatacgactcactatagggcagatgaaataggattatgaggtgaacccaaacagaggagatgggttatgctcataatcaacctggcggcagcgcaaaagatg

SEQ ID NO: 202534 - DNA, 103 bp, Artificial Sequence
  Synthetic Polynucleotide
taatacgactcactatagggccttttccagttcctccatggcacctttctaacagaggagaagaaagatgccatggaggaacctggcggcagcgcaaaagatg

SEQ ID NO: 202535 - DNA, 103 bp, Artificial Sequence
  Synthetic Polynucleotide
taatacgactcactatagggcagctcaaggccttttccagttcctccatgaacagaggagacatggaatgactggaaaaaacctggcggcagcgcaaaagatg

SEQ ID NO: 202536 - DNA, 103 bp, Artificial Sequence
  Synthetic Polynucleotide
taatacgactcactatagggttgccctgggcagctcaaggccttttccagaacagaggagactggaaatggccttgagcaacctggcggcagcgcaaaagatg

SEQ ID NO: 202537 - DNA, 103 bp, Artificial Sequence
  Synthetic Polynucleotide
taatacgactcactatagggagttactcggttgccctgggcagctcaaggaacagaggagaccttgaatggcccagggcaacctggcggcagcgcaaaagatg

SEQ ID NO: 202538 - DNA, 103 bp, Artificial Sequence
  Synthetic Polynucleotide
taatacgactcactatagggatggtgacacagttactcggttgccctgggaacagaggagacccaggatgaccgagtaaaacctggcggcagcgcaaaagatg

SEQ ID NO: 202539 - DNA, 103 bp, Artificial Sequence
  Synthetic Polynucleotide
taatacgactcactatagggagagcggggaatggtgacacagttactcggaacagaggagaccgagtatgtgtgtcaccaacctggcggcagcgcaaaagatg

SEQ ID NO: 202540 - DNA, 103 bp, Artificial Sequence
  Synthetic Polynucleotide
taatacgactcactatagggcagctggacttgtaaaggaaaataaacttgaacagaggagacaagttatgtttcctttaaacctggcggcagcgcaaaagatg

SEQ ID NO: 202541 - DNA, 103 bp, Artificial Sequence
  Synthetic Polynucleotide
taatacgactcactatagggtgccatccagagagcggggaatggtgacacaacagaggagagtgtcaatgttccccgctaacctggcggcagcgcaaaagatg

SEQ ID NO: 202542 - DNA, 103 bp, Artificial Sequence
  Synthetic Polynucleotide
taatacgactcactatagggacttgcagcctgccatccagagagcggggaaacagaggagatccccgatgtctggatggaacctggcggcagcgcaaaagatg

SEQ ID NO: 202543 - DNA, 103 bp, Artificial Sequence
  Synthetic Polynucleotide
taatacgactcactatagggccggtgggagacttgcagcctgccatccagaacagaggagactggatatgaggctgcaaaacctggcggcagcgcaaaagatg

SEQ ID NO: 202544 - DNA, 103 bp, Artificial Sequence
  Synthetic Polynucleotide
taatacgactcactataggggcagtcccttccggtgggagacttgcagccaacagaggagaggctgcatgtctcccaccaacctggcggcagcgcaaaagatg

SEQ ID NO: 202545 - DNA, 103 bp, Artificial Sequence
  Synthetic Polynucleotide
taatacgactcactatagggatgacatgaggcagtcccttccggtgggagaacagaggagactcccaatggaagggactaacctggcggcagcgcaaaagatg

SEQ ID NO: 202546 - DNA, 103 bp, Artificial Sequence
  Synthetic Polynucleotide
taatacgactcactatagggacggcagtaaatgacatgaggcagtcccttaacagaggagaaagggaatgcctcatgtcaacctggcggcagcgcaaaagatg

SEQ ID NO: 202547 - DNA, 103 bp, Artificial Sequence
  Synthetic Polynucleotide
taatacgactcactatagggagcgccacacacggcagtaaatgacatgagaacagaggagactcatgatgtttactgccaacctggcggcagcgcaaaagatg

SEQ ID NO: 202548 - DNA, 103 bp, Artificial Sequence
  Synthetic Polynucleotide
taatacgactcactatagggagatcgggccagcgccacacacggcagtaaaacagaggagattactgatgtgtgtggcgaacctggcggcagcgcaaaagatg

SEQ ID NO: 202549 - DNA, 103 bp, Artificial Sequence
  Synthetic Polynucleotide
taatacgactcactataggggtggctctgaagatcgggccagcgccacacaacagaggagagtgtggatgtggcccgataacctggcggcagcgcaaaagatg

SEQ ID NO: 202550 - DNA, 103 bp, Artificial Sequence
  Synthetic Polynucleotide
taatacgactcactatagggttagttcatggtggctctgaagatcgggccaacagaggagaggcccgatgttcagagccaacctggcggcagcgcaaaagatg

SEQ ID NO: 202551 - DNA, 103 bp, Artificial Sequence
  Synthetic Polynucleotide
taatacgactcactatagggagtctcttcacagctggacttgtaaaggaaaacagaggagattccttatgaagtccagcaacctggcggcagcgcaaaagatg

SEQ ID NO: 202552 - DNA, 103 bp, Artificial Sequence
  Synthetic Polynucleotide
taatacgactcactatagggtccagtggttttagttcatggtggctctgaaacagaggagatcagagatgccatgaactaacctggcggcagcgcaaaagatg

SEQ ID NO: 202553 - DNA, 103 bp, Artificial Sequence
  Synthetic Polynucleotide
taatacgactcactatagggctcacagcattccagtggttttagttcatgaacagaggagacatgaaatgaaaccactgaacctggcggcagcgcaaaagatg

SEQ ID NO: 202554 - DNA, 103 bp, Artificial Sequence
  Synthetic Polynucleotide
taatacgactcactatagggcaaaaggaaactcacagcattccagtggttaacagaggagaaaccacatgaatgctgtgaacctggcggcagcgcaaaagatg

SEQ ID NO: 202555 - DNA, 103 bp, Artificial Sequence
  Synthetic Polynucleotide
taatacgactcactatagggtgcttggaaccaaaaggaaactcacagcataacagaggagaatgctgatggtttcctttaacctggcggcagcgcaaaagatg

SEQ ID NO: 202556 - DNA, 103 bp, Artificial Sequence
  Synthetic Polynucleotide
taatacgactcactataggggacctccttctgcttggaaccaaaaggaaaaacagaggagatttcctatgggttccaagaacctggcggcagcgcaaaagatg

SEQ ID NO: 202557 - DNA, 103 bp, Artificial Sequence
  Synthetic Polynucleotide
taatacgactcactataggggattgatgcagacctccttctgcttggaacaacagaggagagttccaatgagaaggaggaacctggcggcagcgcaaaagatg

SEQ ID NO: 202558 - DNA, 103 bp, Artificial Sequence
  Synthetic Polynucleotide
taatacgactcactatagggtagtggtagggattgatgcagacctccttcaacagaggagagaaggaatgctgcatcaaaacctggcggcagcgcaaaagatg

SEQ ID NO: 202559 - DNA, 103 bp, Artificial Sequence
  Synthetic Polynucleotide
taatacgactcactatagggtactctcttatagtggtagggattgatgcaaacagaggagatgcatcatgccctaccacaacctggcggcagcgcaaaagatg

SEQ ID NO: 202560 - DNA, 103 bp, Artificial Sequence
  Synthetic Polynucleotide
taatacgactcactatagggcagggctttctactctcttatagtggtaggaacagaggagacctaccatgataagagagaacctggcggcagcgcaaaagatg

SEQ ID NO: 202561 - DNA, 103 bp, Artificial Sequence
  Synthetic Polynucleotide
taatacgactcactatagggggaggaagtacagggctttctactctcttaaacagaggagataagagatgagaaagcccaacctggcggcagcgcaaaagatg

SEQ ID NO: 202562 - DNA, 103 bp, Artificial Sequence
  Synthetic Polynucleotide
taatacgactcactatagggccacccaagaagtctcttcacagctggactaacagaggagaagtccaatggtgaagagaaacctggcggcagcgcaaaagatg

SEQ ID NO: 202563 - DNA, 103 bp, Artificial Sequence
  Synthetic Polynucleotide
taatacgactcactatagggaaccagcacaggaggaagtacagggctttcaacagaggagagaaagcatggtacttcctaacctggcggcagcgcaaaagatg

SEQ ID NO: 202564 - DNA, 103 bp, Artificial Sequence
  Synthetic Polynucleotide
taatacgactcactatagggtgtgtcttggaaccagcacaggaggaagtaaacagaggagatacttcatgctgtgctggaacctggcggcagcgcaaaagatg

SEQ ID NO: 202565 - DNA, 103 bp, Artificial Sequence
  Synthetic Polynucleotide
taatacgactcactatagggttatattcgctgtgtcttggaaccagcacaaacagaggagatgtgctatgtccaagacaaacctggcggcagcgcaaaagatg

SEQ ID NO: 202566 - DNA, 103 bp, Artificial Sequence
  Synthetic Polynucleotide
taatacgactcactataggggtgctgaggattatattcgctgtgtcttggaacagaggagaccaagaatgagcgaatataacctggcggcagcgcaaaagatg

SEQ ID NO: 202567 - DNA, 103 bp, Artificial Sequence
  Synthetic Polynucleotide
taatacgactcactatagggctaagaggctgtgctgaggattatattcgcaacagaggagagcgaatatgatcctcagcaacctggcggcagcgcaaaagatg

SEQ ID NO: 202568 - DNA, 103 bp, Artificial Sequence
  Synthetic Polynucleotide
taatacgactcactatagggcggaactgagctaagaggctgtgctgaggaaacagaggagatcctcaatgcagcctcttaacctggcggcagcgcaaaagatg

SEQ ID NO: 202569 - DNA, 103 bp, Artificial Sequence
  Synthetic Polynucleotide
taatacgactcactatagggtcctaagttacggaactgagctaagaggctaacagaggagaagcctcatggctcagttcaacctggcggcagcgcaaaagatg

SEQ ID NO: 202570 - DNA, 103 bp, Artificial Sequence
  Synthetic Polynucleotide
taatacgactcactataggggctcattttgtcctaagttacggaactgagaacagaggagactcagtatggtaacttagaacctggcggcagcgcaaaagatg

SEQ ID NO: 202571 - DNA, 103 bp, Artificial Sequence
  Synthetic Polynucleotide
taatacgactcactatagggggcatgtgaggctcattttgtcctaagttaaacagaggagataacttatgacaaaatgaaacctggcggcagcgcaaaagatg

SEQ ID NO: 202572 - DNA, 103 bp, Artificial Sequence
  Synthetic Polynucleotide
taatacgactcactatagggggcgttgagtggcatgtgaggctcattttgaacagaggagacaaaatatgcctcacatgaacctggcggcagcgcaaaagatg

SEQ ID NO: 202573 - DNA, 103 bp, Artificial Sequence
  Synthetic Polynucleotide
taatacgactcactatagggcgccctgtttccacccaagaagtctcttcaaacagaggagatgaagaatgttcttgggtaacctggcggcagcgcaaaagatg

SEQ ID NO: 202574 - DNA, 103 bp, Artificial Sequence
  Synthetic Polynucleotide
taatacgactcactatagggctggaaaagtggcgttgagtggcatgtgagaacagaggagactcacaatgcactcaacgaacctggcggcagcgcaaaagatg

SEQ ID NO: 202575 - DNA, 103 bp, Artificial Sequence
  Synthetic Polynucleotide
taatacgactcactatagggtggaaagaatctggaaaagtggcgttgagtaacagaggagaactcaaatgcacttttccaacctggcggcagcgcaaaagatg

SEQ ID NO: 202576 - DNA, 103 bp, Artificial Sequence
  Synthetic Polynucleotide
taatacgactcactataggggttgggttgctggaaagaatctggaaaagtaacagaggagaacttttatggattctttcaacctggcggcagcgcaaaagatg

SEQ ID NO: 202577 - DNA, 103 bp, Artificial Sequence
  Synthetic Polynucleotide
taatacgactcactatagggacgggtggctgttgggttgctggaaagaataacagaggagaattcttatgagcaacccaaacctggcggcagcgcaaaagatg

SEQ ID NO: 202578 - DNA, 103 bp, Artificial Sequence
  Synthetic Polynucleotide
taatacgactcactataggggagtgaggaaacgggtggctgttgggttgcaacagaggagagcaaccatgcagccacccaacctggcggcagcgcaaaagatg

SEQ ID NO: 202579 - DNA, 103 bp, Artificial Sequence
  Synthetic Polynucleotide
taatacgactcactataggggctattgggagagtgaggaaacgggtggctaacagaggagaagccacatgtttcctcacaacctggcggcagcgcaaaagatg

SEQ ID NO: 202580 - DNA, 103 bp, Artificial Sequence
  Synthetic Polynucleotide
taatacgactcactatagggttgggtaactgctattgggagagtgaggaaaacagaggagattcctcatgctcccaataaacctggcggcagcgcaaaagatg

SEQ ID NO: 202581 - DNA, 103 bp, Artificial Sequence
  Synthetic Polynucleotide
taatacgactcactatagggccaggagagtttgggtaactgctattgggaaacagaggagatcccaaatgcagttacccaacctggcggcagcgcaaaagatg

SEQ ID NO: 202582 - DNA, 103 bp, Artificial Sequence
  Synthetic Polynucleotide
taatacgactcactataggggctgctgctcccaggagagtttgggtaactaacagaggagaagttacatgaactctcctaacctggcggcagcgcaaaagatg

SEQ ID NO: 202583 - DNA, 103 bp, Artificial Sequence
  Synthetic Polynucleotide
taatacgactcactatagggggtaggtgctgctgctgctcccaggagagtaacagaggagaactctcatgggagcagcaaacctggcggcagcgcaaaagatg

SEQ ID NO: 202584 - DNA, 103 bp, Artificial Sequence
  Synthetic Polynucleotide
taatacgactcactatagggtcttcttcatcgccctgtttccacccaagaaacagaggagatcttggatggaaacagggaacctggcggcagcgcaaaagatg

SEQ ID NO: 202585 - DNA, 103 bp, Artificial Sequence
  Synthetic Polynucleotide
taatacgactcactatagggggagagtgagggtaggtgctgctgctgctcaacagaggagagagcagatgcagcacctaaacctggcggcagcgcaaaagatg

SEQ ID NO: 202586 - DNA, 103 bp, Artificial Sequence
  Synthetic Polynucleotide
taatacgactcactatagggtgagctggtgggagagtgagggtaggtgctaacagaggagaagcaccatgcctcactctaacctggcggcagcgcaaaagatg

SEQ ID NO: 202587 - DNA, 103 bp, Artificial Sequence
  Synthetic Polynucleotide
taatacgactcactatagggttcctgggtctgagctggtgggagagtgagaacagaggagactcactatgccaccagctaacctggcggcagcgcaaaagatg

SEQ ID NO: 202588 - DNA, 103 bp, Artificial Sequence
  Synthetic Polynucleotide
taatacgactcactatagggtggaaagggcttcctgggtctgagctggtgaacagaggagacaccagatgagacccaggaacctggcggcagcgcaaaagatg

SEQ ID NO: 202589 - DNA, 103 bp, Artificial Sequence
  Synthetic Polynucleotide
taatacgactcactatagggagctggcatctggaaagggcttcctgggtcaacagaggagagacccaatgagccctttcaacctggcggcagcgcaaaagatg

SEQ ID NO: 202590 - DNA, 103 bp, Artificial Sequence
  Synthetic Polynucleotide
taatacgactcactatagggggggcgtatcagctggcatctggaaagggcaacagaggagagcccttatgagatgccagaacctggcggcagcgcaaaagatg

SEQ ID NO: 202591 - DNA, 103 bp, Artificial Sequence
  Synthetic Polynucleotide
taatacgactcactatagggtaagcaggtgggggcgtatcagctggcatcaacagaggagagatgccatgtgatacgccaacctggcggcagcgcaaaagatg

SEQ ID NO: 202592 - DNA, 103 bp, Artificial Sequence
  Synthetic Polynucleotide
taatacgactcactatagggaggaggcaggtaagcaggtgggggcgtatcaacagaggagagatacgatgccacctgctaacctggcggcagcgcaaaagatg

SEQ ID NO: 202593 - DNA, 103 bp, Artificial Sequence
  Synthetic Polynucleotide
taatacgactcactatagggtggggtcttcaggaggcaggtaagcaggtgaacagaggagacacctgatgacctgcctcaacctggcggcagcgcaaaagatg

SEQ ID NO: 202594 - DNA, 103 bp, Artificial Sequence
  Synthetic Polynucleotide
taatacgactcactatagggtcctgggtcatggggtcttcaggaggcaggaacagaggagacctgccatgtgaagacccaacctggcggcagcgcaaaagatg

SEQ ID NO: 202595 - DNA, 103 bp, Artificial Sequence
  Synthetic Polynucleotide
taatacgactcactatagggtgcccatttttcttcttcatcgccctgtttaacagaggagaaaacagatggatgaagaaaacctggcggcagcgcaaaagatg

SEQ ID NO: 202596 - DNA, 103 bp, Artificial Sequence
  Synthetic Polynucleotide
taatacgactcactatagggctgagagccatcctgggtcatggggtcttcaacagaggagagaagacatgatgacccagaacctggcggcagcgcaaaagatg

SEQ ID NO: 202597 - DNA, 103 bp, Artificial Sequence
  Synthetic Polynucleotide
taatacgactcactatagggtgtccatcggctgagagccatcctgggtcaaacagaggagatgacccatgatggctctcaacctggcggcagcgcaaaagatg

SEQ ID NO: 202598 - DNA, 103 bp, Artificial Sequence
  Synthetic Polynucleotide
taatacgactcactatagggatcatgtttgtgtccatcggctgagagccaaacagaggagatggctcatggccgatggaaacctggcggcagcgcaaaagatg

SEQ ID NO: 202599 - DNA, 103 bp, Artificial Sequence
  Synthetic Polynucleotide
taatacgactcactataggggggaggcgccatcatgtttgtgtccatcggaacagaggagaccgatgatgacaaacatgaacctggcggcagcgcaaaagatg

SEQ ID NO: 202600 - DNA, 103 bp, Artificial Sequence
  Synthetic Polynucleotide
taatacgactcactatagggctgagggcaggggaggcgccatcatgtttgaacagaggagacaaacaatgtggcgcctcaacctggcggcagcgcaaaagatg

SEQ ID NO: 202601 - DNA, 103 bp, Artificial Sequence
  Synthetic Polynucleotide
taatacgactcactatagggctgttgatttctgagggcaggggaggcgccaacagaggagaggcgccatgcctgccctcaacctggcggcagcgcaaaagatg

SEQ ID NO: 202602 - DNA, 103 bp, Artificial Sequence
  Synthetic Polynucleotide
taatacgactcactatagggaacatctcctctgttgatttctgagggcagaacagaggagactgcccatggaaatcaacaacctggcggcagcgcaaaagatg

SEQ ID NO: 202603 - DNA, 103 bp, Artificial Sequence
  Synthetic Polynucleotide
taatacgactcactatagggcaaccgcctgaacatctcctctgttgatttaacagaggagaaaatcaatggaggagatgaacctggcggcagcgcaaaagatg

SEQ ID NO: 202604 - DNA, 103 bp, Artificial Sequence
  Synthetic Polynucleotide
taatacgactcactatagggtcctcataagcaaccgcctgaacatctcctaacagaggagaaggagaatgtcaggcggtaacctggcggcagcgcaaaagatg

SEQ ID NO: 202605 - DNA, 103 bp, Artificial Sequence
  Synthetic Polynucleotide
taatacgactcactataggggtgttttggttcctcataagcaaccgcctgaacagaggagacaggcgatggcttatgagaacctggcggcagcgcaaaagatg

SEQ ID NO: 202606 - DNA, 103 bp, Artificial Sequence
  Synthetic Polynucleotide
taatacgactcactatagggcagctttctctgcccatttttcttcttcataacagaggagaatgaagatgaaaaatgggaacctggcggcagcgcaaaagatg

SEQ ID NO: 202607 - DNA, 103 bp, Artificial Sequence
  Synthetic Polynucleotide
taatacgactcactatagggtagagcaccagtgttttggttcctcataagaacagaggagacttatgatgaaccaaaacaacctggcggcagcgcaaaagatg

SEQ ID NO: 202608 - DNA, 103 bp, Artificial Sequence
  Synthetic Polynucleotide
taatacgactcactatagggtagtagacaatagagcaccagtgttttggtaacagaggagaaccaaaatgctggtgctcaacctggcggcagcgcaaaagatg

SEQ ID NO: 202609 - DNA, 103 bp, Artificial Sequence
  Synthetic Polynucleotide
taatacgactcactataggggttgagctcatagtagacaatagagcaccaaacagaggagatggtgcatgattgtctacaacctggcggcagcgcaaaagatg

SEQ ID NO: 202610 - DNA, 103 bp, Artificial Sequence
  Synthetic Polynucleotide
taatacgactcactatagggccacacgattgttgagctcatagtagacaaaacagaggagattgtctatgatgagctcaaacctggcggcagcgcaaaagatg

SEQ ID NO: 202611 - DNA, 103 bp, Artificial Sequence
  Synthetic Polynucleotide
taatacgactcactatagggaacgcttcacccacacgattgttgagctcaaacagaggagatgagctatgcaatcgtgtaacctggcggcagcgcaaaagatg

SEQ ID NO: 202612 - DNA, 103 bp, Artificial Sequence
  Synthetic Polynucleotide
taatacgactcactatagggggaggcatggaacgcttcacccacacgattaacagaggagaaatcgtatgggtgaagcgaacctggcggcagcgcaaaagatg

SEQ ID NO: 202613 - DNA, 103 bp, Artificial Sequence
  Synthetic Polynucleotide
taatacgactcactatagggcacttgtggaggaggcatggaacgcttcacaacagaggagagtgaagatgtccatgcctaacctggcggcagcgcaaaagatg

SEQ ID NO: 202614 - DNA, 103 bp, Artificial Sequence
  Synthetic Polynucleotide
taatacgactcactatagggtccaccaacacacttgtggaggaggcatggaacagaggagaccatgcatgctccacaagaacctggcggcagcgcaaaagatg

SEQ ID NO: 202615 - DNA, 103 bp, Artificial Sequence
  Synthetic Polynucleotide
taatacgactcactatagggagtgaaaccatccaccaacacacttgtggaaacagaggagatccacaatggtgttggtgaacctggcggcagcgcaaaagatg

SEQ ID NO: 202616 - DNA, 103 bp, Artificial Sequence
  Synthetic Polynucleotide
taatacgactcactatagggtggaaggatcagtgaaaccatccaccaacaaacagaggagatgttggatgatggtttcaaacctggcggcagcgcaaaagatg

SEQ ID NO: 202617 - DNA, 103 bp, Artificial Sequence
  Synthetic Polynucleotide
taatacgactcactatagggaaagcatcaacagctttctctgcccattttaacagaggagaaaaatgatgagagaaagcaacctggcggcagcgcaaaagatg

SEQ ID NO: 202618 - DNA, 103 bp, Artificial Sequence
  Synthetic Polynucleotide
taatacgactcactatagggttcttattgttggaaggatcagtgaaaccaaacagaggagatggtttatgtgatccttcaacctggcggcagcgcaaaagatg

SEQ ID NO: 202619 - DNA, 103 bp, Artificial Sequence
  Synthetic Polynucleotide
taatacgactcactataggggcagaaacggttcttattgttggaaggatcaacagaggagagatcctatgaacaataagaacctggcggcagcgcaaaagatg

SEQ ID NO: 202620 - DNA, 103 bp, Artificial Sequence
  Synthetic Polynucleotide
taatacgactcactataggggcagcccaaggcagaaacggttcttattgtaacagaggagaacaataatgaccgtttctaacctggcggcagcgcaaaagatg

SEQ ID NO: 202621 - DNA, 103 bp, Artificial Sequence
  Synthetic Polynucleotide
taatacgactcactatagggacattggagagcagcccaaggcagaaacggaacagaggagaccgtttatgccttgggctaacctggcggcagcgcaaaagatg

SEQ ID NO: 202622 - DNA, 103 bp, Artificial Sequence
  Synthetic Polynucleotide
taatacgactcactatagggattccggttaacattggagagcagcccaagaacagaggagacttgggatgctctccaataacctggcggcagcgcaaaagatg

SEQ ID NO: 202623 - DNA, 103 bp, Artificial Sequence
  Synthetic Polynucleotide
taatacgactcactatagggcaatagtggaattccggttaacattggagaaacagaggagatctccaatgttaaccggaaacctggcggcagcgcaaaagatg

SEQ ID NO: 202624 - DNA, 103 bp, Artificial Sequence
  Synthetic Polynucleotide
taatacgactcactatagggctggtgttttcaatagtggaattccggttaaacagaggagataaccgatgttccactataacctggcggcagcgcaaaagatg

SEQ ID NO: 202625 - DNA, 103 bp, Artificial Sequence
  Synthetic Polynucleotide
taatacgactcactatagggaatatgccgcctggtgttttcaatagtggaaacagaggagatccactatggaaaacaccaacctggcggcagcgcaaaagatg

SEQ ID NO: 202626 - DNA, 103 bp, Artificial Sequence
  Synthetic Polynucleotide
taatacgactcactatagggctccttttccaatatgccgcctggtgttttaacagaggagaaaaacaatgggcggcataaacctggcggcagcgcaaaagatg

SEQ ID NO: 202627 - DNA, 103 bp, Artificial Sequence
  Synthetic Polynucleotide
taatacgactcactatagggtaaagatgaactccttttccaatatgccgcaacagaggagagcggcaatgtggaaaaggaacctggcggcagcgcaaaagatg

SEQ ID NO: 202628 - DNA, 103 bp, Artificial Sequence
  Synthetic Polynucleotide
taatacgactcactatagggtggcggcgtgaatggcaagatggacgacataacagaggagaatgtcgatgatcttgccaaacctggcggcagcgcaaaagatg

SEQ ID NO: 202629 - DNA, 103 bp, Artificial Sequence
  Synthetic Polynucleotide
taatacgactcactatagggccacttttcttcctgcccattctgctctccaacagaggagaggagagatgaatgggcagaacctggcggcagcgcaaaagatg

SEQ ID NO: 202630 - DNA, 103 bp, Artificial Sequence
  Synthetic Polynucleotide
taatacgactcactataggggtagtataagcgcactcctcttcctatatgaacagaggagacatataatgagaggagtgaacctggcggcagcgcaaaagatg

SEQ ID NO: 202631 - DNA, 103 bp, Artificial Sequence
  Synthetic Polynucleotide
taatacgactcactatagggccccacctatgtagtataagcgcactcctcaacagaggagagaggagatggcttatactaacctggcggcagcgcaaaagatg

SEQ ID NO: 202632 - DNA, 103 bp, Artificial Sequence
  Synthetic Polynucleotide
taatacgactcactataggggcaaaaacttccccacctatgtagtataagaacagaggagacttataatgcataggtggaacctggcggcagcgcaaaagatg

SEQ ID NO: 202633 - DNA, 103 bp, Artificial Sequence
  Synthetic Polynucleotide
taatacgactcactatagggtaggcactcagcaaaaacttccccacctataacagaggagaataggtatggaagtttttaacctggcggcagcgcaaaagatg

SEQ ID NO: 202634 - DNA, 103 bp, Artificial Sequence
  Synthetic Polynucleotide
taatacgactcactatagggcactatcacttaggcactcagcaaaaacttaacagaggagaaagtttatgctgagtgccaacctggcggcagcgcaaaagatg

SEQ ID NO: 202635 - DNA, 103 bp, Artificial Sequence
  Synthetic Polynucleotide
taatacgactcactatagggacaaagattgcactatcacttaggcactcaaacagaggagatgagtgatgaagtgatagaacctggcggcagcgcaaaagatg

SEQ ID NO: 202636 - DNA, 103 bp, Artificial Sequence
  Synthetic Polynucleotide
taatacgactcactatagggggggctctgcacaaagattgcactatcactaacagaggagaagtgatatggcaatctttaacctggcggcagcgcaaaagatg

SEQ ID NO: 202637 - DNA, 103 bp, Artificial Sequence
  Synthetic Polynucleotide
taatacgactcactataggggattacaattggggctctgcacaaagattgaacagaggagacaatctatgtgcagagccaacctggcggcagcgcaaaagatg

SEQ ID NO: 202638 - DNA, 103 bp, Artificial Sequence
  Synthetic Polynucleotide
taatacgactcactatagggccatatctctgattacaattggggctctgcaacagaggagagcagagatgcaattgtaaaacctggcggcagcgcaaaagatg

SEQ ID NO: 202639 - DNA, 103 bp, Artificial Sequence
  Synthetic Polynucleotide
taatacgactcactatagggagggtgccagccatatctctgattacaattaacagaggagaaattgtatgcagagatataacctggcggcagcgcaaaagatg

SEQ ID NO: 202640 - DNA, 103 bp, Artificial Sequence
  Synthetic Polynucleotide
taatacgactcactatagggctttctcacaccacttttcttcctgcccataacagaggagaatgggcatgaagaaaagtaacctggcggcagcgcaaaagatg

SEQ ID NO: 202641 - DNA, 103 bp, Artificial Sequence
  Synthetic Polynucleotide
taatacgactcactatagggacactgttgcagggtgccagccatatctctaacagaggagaagagatatggctggcaccaacctggcggcagcgcaaaagatg

SEQ ID NO: 202642 - DNA, 103 bp, Artificial Sequence
  Synthetic Polynucleotide
taatacgactcactatagggggaattttacacactgttgcagggtgccagaacagaggagactggcaatgtgcaacagtaacctggcggcagcgcaaaagatg

SEQ ID NO: 202643 - DNA, 103 bp, Artificial Sequence
  Synthetic Polynucleotide
taatacgactcactatagggacagcctggtggaattttacacactgttgcaacagaggagagcaacaatgtgtaaaattaacctggcggcagcgcaaaagatg

SEQ ID NO: 202644 - DNA, 103 bp, Artificial Sequence
  Synthetic Polynucleotide
taatacgactcactatagggtcttcagattacagcctggtggaattttacaacagaggagagtaaaaatgcaccaggctaacctggcggcagcgcaaaagatg

SEQ ID NO: 202645 - DNA, 103 bp, Artificial Sequence
  Synthetic Polynucleotide
taatacgactcactatagggttgttgaagatcttcagattacagcctggtaacagaggagaaccaggatgtaatctgaaaacctggcggcagcgcaaaagatg

SEQ ID NO: 202646 - DNA, 103 bp, Artificial Sequence
  Synthetic Polynucleotide
taatacgactcactatagggaaattcctggttgttgaagatcttcagattaacagaggagaaatctgatgatcttcaacaacctggcggcagcgcaaaagatg

SEQ ID NO: 202647 - DNA, 103 bp, Artificial Sequence
  Synthetic Polynucleotide
taatacgactcactataggggaagagcagcaaattcctggttgttgaagaaacagaggagatcttcaatgaccaggaataacctggcggcagcgcaaaagatg

SEQ ID NO: 202648 - DNA, 103 bp, Artificial Sequence
  Synthetic Polynucleotide
taatacgactcactataggggactgagccagaagagcagcaaattcctggaacagaggagaccaggaatgtgctgctctaacctggcggcagcgcaaaagatg

SEQ ID NO: 202649 - DNA, 103 bp, Artificial Sequence
  Synthetic Polynucleotide
taatacgactcactatagggctgattaacagactgagccagaagagcagcaacagaggagagctgctatgctggctcagaacctggcggcagcgcaaaagatg

SEQ ID NO: 202650 - DNA, 103 bp, Artificial Sequence
  Synthetic Polynucleotide
taatacgactcactatagggcttcaaaaccctgattaacagactgagccaaacagaggagatggctcatgctgttaatcaacctggcggcagcgcaaaagatg

SEQ ID NO: 202651 - DNA, 103 bp, Artificial Sequence
  Synthetic Polynucleotide
taatacgactcactatagggcttttcactgctttctcacaccacttttctaacagaggagaagaaaaatggtgtgagaaaacctggcggcagcgcaaaagatg

SEQ ID NO: 202652 - DNA, 103 bp, Artificial Sequence
  Synthetic Polynucleotide
taatacgactcactatagggtgatagacggcttcaaaaccctgattaacaaacagaggagatgttaaatggggttttgaaacctggcggcagcgcaaaagatg

SEQ ID NO: 202653 - DNA, 103 bp, Artificial Sequence
  Synthetic Polynucleotide
taatacgactcactatagggtctagttagctgatagacggcttcaaaaccaacagaggagaggttttatggccgtctataacctggcggcagcgcaaaagatg

SEQ ID NO: 202654 - DNA, 103 bp, Artificial Sequence
  Synthetic Polynucleotide
taatacgactcactatagggtggtgcacattctagttagctgatagacggaacagaggagaccgtctatgagctaactaaacctggcggcagcgcaaaagatg

SEQ ID NO: 202655 - DNA, 103 bp, Artificial Sequence
  Synthetic Polynucleotide
taatacgactcactatagggctcattcttatggtgcacattctagttagcaacagaggagagctaacatgaatgtgcacaacctggcggcagcgcaaaagatg

SEQ ID NO: 202656 - DNA, 103 bp, Artificial Sequence
  Synthetic Polynucleotide
taatacgactcactatagggtttcacaaaactcattcttatggtgcacataacagaggagaatgtgcatgataagaatgaacctggcggcagcgcaaaagatg

SEQ ID NO: 202657 - DNA, 103 bp, Artificial Sequence
  Synthetic Polynucleotide
taatacgactcactatagggctccccaccctttcacaaaactcattcttaaacagaggagataagaaatggttttgtgaaacctggcggcagcgcaaaagatg

SEQ ID NO: 202658 - DNA, 103 bp, Artificial Sequence
  Synthetic Polynucleotide
taatacgactcactatagggcggtattctgctccccaccctttcacaaaaaacagaggagattttgtatgagggtggggaacctggcggcagcgcaaaagatg

SEQ ID NO: 202659 - DNA, 103 bp, Artificial Sequence
  Synthetic Polynucleotide
taatacgactcactatagggcgtctgccttcggtattctgctccccacccaacagaggagagggtggatggcagaatacaacctggcggcagcgcaaaagatg

SEQ ID NO: 202660 - DNA, 103 bp, Artificial Sequence
  Synthetic Polynucleotide
taatacgactcactatagggtacttgttaccgtctgccttcggtattctgaacagaggagacagaatatggaaggcagaaacctggcggcagcgcaaaagatg

SEQ ID NO: 202661 - DNA, 103 bp, Artificial Sequence
  Synthetic Polynucleotide
taatacgactcactatagggcagcaaggagtacttgttaccgtctgccttaacagaggagaaaggcaatgggtaacaagaacctggcggcagcgcaaaagatg

SEQ ID NO: 202662 - DNA, 103 bp, Artificial Sequence
  Synthetic Polynucleotide
taatacgactcactatagggcttcaccagacttttcactgctttctcacaaacagaggagatgtgagatggcagtgaaaaacctggcggcagcgcaaaagatg

SEQ ID NO: 202663 - DNA, 103 bp, Artificial Sequence
  Synthetic Polynucleotide
taatacgactcactatagggaagttcaatccagcaaggagtacttgttacaacagaggagagtaacaatgactccttgcaacctggcggcagcgcaaaagatg

SEQ ID NO: 202664 - DNA, 103 bp, Artificial Sequence
  Synthetic Polynucleotide
taatacgactcactatagggcattcagatgaagttcaatccagcaaggagaacagaggagactccttatgggattgaacaacctggcggcagcgcaaaagatg

SEQ ID NO: 202665 - DNA, 103 bp, Artificial Sequence
  Synthetic Polynucleotide
taatacgactcactatagggtgtagaggtccattcagatgaagttcaatcaacagaggagagattgaatgtcatctgaaaacctggcggcagcgcaaaagatg

SEQ ID NO: 202666 - DNA, 103 bp, Artificial Sequence
  Synthetic Polynucleotide
taatacgactcactataggggtccaaccactgtagaggtccattcagatgaacagaggagacatctgatgggacctctaaacctggcggcagcgcaaaagatg

SEQ ID NO: 202667 - DNA, 103 bp, Artificial Sequence
  Synthetic Polynucleotide
taatacgactcactatagggttaatactttgtccaaccactgtagaggtcaacagaggagagacctcatgagtggttggaacctggcggcagcgcaaaagatg

SEQ ID NO: 202668 - DNA, 103 bp, Artificial Sequence
  Synthetic Polynucleotide
taatacgactcactatagggcccatctgagttaatactttgtccaaccacaacagaggagagtggttatgcaaagtattaacctggcggcagcgcaaaagatg

SEQ ID NO: 202669 - DNA, 103 bp, Artificial Sequence
  Synthetic Polynucleotide
taatacgactcactatagggtgaaggggatcccatctgagttaatactttaacagaggagaaaagtaatgactcagatgaacctggcggcagcgcaaaagatg

SEQ ID NO: 202670 - DNA, 103 bp, Artificial Sequence
  Synthetic Polynucleotide
taatacgactcactatagggagcaacgcactgaaggggatcccatctgagaacagaggagactcagaatggatccccttaacctggcggcagcgcaaaagatg

SEQ ID NO: 202671 - DNA, 103 bp, Artificial Sequence
  Synthetic Polynucleotide
taatacgactcactataggggacatgcttgagcaacgcactgaaggggataacagaggagaatccccatgagtgcgttgaacctggcggcagcgcaaaagatg

SEQ ID NO: 202672 - DNA, 103 bp, Artificial Sequence
  Synthetic Polynucleotide
taatacgactcactatagggtctttagcttcttcaccagacttttcactgaacagaggagacagtgaatggtctggtgaaacctggcggcagcgcaaaagatg

SEQ ID NO: 202673 - DNA, 103 bp, Artificial Sequence
  Synthetic Polynucleotide
taatacgactcactatagggcgtcctgttttctttagcttcttcaccagaaacagaggagatctggtatggaagctaaaaacctggcggcagcgcaaaagatg

SEQ ID NO: 202674 - DNA, 103 bp, Artificial Sequence
  Synthetic Polynucleotide
taatacgactcactatagggctcatctaatcgtcctgttttctttagcttaacagaggagaaagctaatgaaaacaggaaacctggcggcagcgcaaaagatg

SEQ ID NO: 202675 - DNA, 103 bp, Artificial Sequence
  Synthetic Polynucleotide
taatacgactcactatagggctttctcaagctcatctaatcgtcctgtttaacagaggagaaaacagatggattagatgaacctggcggcagcgcaaaagatg

SEQ ID NO: 202676 - DNA, 103 bp, Artificial Sequence
  Synthetic Polynucleotide
taatacgactcactataggggtggtgatggctttctcaagctcatctaataacagaggagaattagaatggcttgagaaaacctggcggcagcgcaaaagatg

SEQ ID NO: 202677 - DNA, 103 bp, Artificial Sequence
  Synthetic Polynucleotide
taatacgactcactatagggacagttttgagtggtgatggctttctcaagaacagaggagacttgagatggccatcaccaacctggcggcagcgcaaaagatg

SEQ ID NO: 202678 - DNA, 103 bp, Artificial Sequence
  Synthetic Polynucleotide
taatacgactcactatagggtcttcacaactggcggcgtgaatggcaagaaacagaggagatcttgcatgtcacgccgcaacctggcggcagcgcaaaagatg

SEQ ID NO: 202679 - DNA, 103 bp, Artificial Sequence
  Synthetic Polynucleotide
taatacgactcactatagggatttagtattacagttttgagtggtgatggaacagaggagaccatcaatgctcaaaactaacctggcggcagcgcaaaagatg

SEQ ID NO: 202680 - DNA, 103 bp, Artificial Sequence
  Synthetic Polynucleotide
taatacgactcactatagggatggtaacacatttagtattacagttttgaaacagaggagatcaaaaatgtaatactaaaacctggcggcagcgcaaaagatg

SEQ ID NO: 202681 - DNA, 103 bp, Artificial Sequence
  Synthetic Polynucleotide
taatacgactcactatagggagtgcttggtatggtaacacatttagtattaacagaggagaaatactatgtgtgttaccaacctggcggcagcgcaaaagatg

SEQ ID NO: 202682 - DNA, 103 bp, Artificial Sequence
  Synthetic Polynucleotide
taatacgactcactatagggtttcagagcaagtgcttggtatggtaacacaacagaggagagtgttaatgtaccaagcaaacctggcggcagcgcaaaagatg

SEQ ID NO: 202683 - DNA, 103 bp, Artificial Sequence
  Synthetic Polynucleotide
taatacgactcactatagggagtccccaaatttcagagcaagtgcttggtaacagaggagaaccaagatgttgctctgaaacctggcggcagcgcaaaagatg

SEQ ID NO: 202684 - DNA, 103 bp, Artificial Sequence
  Synthetic Polynucleotide
taatacgactcactatagggtggtgtactcagtccccaaatttcagagcaaacagaggagatgctctatgatttggggaaacctggcggcagcgcaaaagatg

SEQ ID NO: 202685 - DNA, 103 bp, Artificial Sequence
  Synthetic Polynucleotide
taatacgactcactatagggctatcgtatttggtgtactcagtccccaaaaacagaggagatttgggatgtgagtacacaacctggcggcagcgcaaaagatg

SEQ ID NO: 202686 - DNA, 103 bp, Artificial Sequence
  Synthetic Polynucleotide
taatacgactcactatagggtcccactgatctatcgtatttggtgtactcaacagaggagagagtacatgaaatacgataacctggcggcagcgcaaaagatg

SEQ ID NO: 202687 - DNA, 103 bp, Artificial Sequence
  Synthetic Polynucleotide
taatacgactcactataggggcctgttgtatcccactgatctatcgtattaacagaggagaaatacgatggatcagtggaacctggcggcagcgcaaaagatg

SEQ ID NO: 202688 - DNA, 103 bp, Artificial Sequence
  Synthetic Polynucleotide
taatacgactcactatagggagctgtaaaggcctgttgtatcccactgataacagaggagaatcagtatgatacaacagaacctggcggcagcgcaaaagatg

SEQ ID NO: 202689 - DNA, 103 bp, Artificial Sequence
  Synthetic Polynucleotide
taatacgactcactatagggcccagcagtctcttcacaactggcggcgtgaacagaggagacacgccatgagttgtgaaaacctggcggcagcgcaaaagatg

SEQ ID NO: 202690 - DNA, 103 bp, Artificial Sequence
  Synthetic Polynucleotide
taatacgactcactatagggtgttcagagaagctgtaaaggcctgttgtaaacagaggagatacaacatgcctttacagaacctggcggcagcgcaaaagatg

SEQ ID NO: 202691 - DNA, 103 bp, Artificial Sequence
  Synthetic Polynucleotide
taatacgactcactatagggagacctggtttgttcagagaagctgtaaagaacagaggagactttacatgttctctgaaaacctggcggcagcgcaaaagatg

SEQ ID NO: 202692 - DNA, 103 bp, Artificial Sequence
  Synthetic Polynucleotide
taatacgactcactataggggaccatcaagagacctggtttgttcagagaaacagaggagatctctgatgaaaccaggtaacctggcggcagcgcaaaagatg

SEQ ID NO: 202693 - DNA, 103 bp, Artificial Sequence
  Synthetic Polynucleotide
taatacgactcactatagggacctggagacgaccatcaagagacctggttaacagaggagaaaccagatgtcttgatggaacctggcggcagcgcaaaagatg

SEQ ID NO: 202694 - DNA, 103 bp, Artificial Sequence
  Synthetic Polynucleotide
taatacgactcactatagggtcgatgggatacctggagacgaccatcaagaacagaggagacttgatatgcgtctccagaacctggcggcagcgcaaaagatg

SEQ ID NO: 202695 - DNA, 103 bp, Artificial Sequence
  Synthetic Polynucleotide
taatacgactcactataggggcaatccttttcgatgggatacctggagacaacagaggagagtctccatgtatcccatcaacctggcggcagcgcaaaagatg

SEQ ID NO: 202696 - DNA, 103 bp, Artificial Sequence
  Synthetic Polynucleotide
taatacgactcactatagggataacatgtggcaatccttttcgatgggataacagaggagaatcccaatgaaaaggattaacctggcggcagcgcaaaagatg

SEQ ID NO: 202697 - DNA, 103 bp, Artificial Sequence
  Synthetic Polynucleotide
taatacgactcactatagggtcggcaatatataacatgtggcaatcctttaacagaggagaaaaggaatgccacatgttaacctggcggcagcgcaaaagatg

SEQ ID NO: 202698 - DNA, 103 bp, Artificial Sequence
  Synthetic Polynucleotide
taatacgactcactatagggagcgccataatcggcaatatataacatgtgaacagaggagacacatgatgtatattgccaacctggcggcagcgcaaaagatg

SEQ ID NO: 202699 - DNA, 103 bp, Artificial Sequence
  Synthetic Polynucleotide
taatacgactcactatagggagatcaggccagcgccataatcggcaatataacagaggagaatattgatgattatggcgaacctggcggcagcgcaaaagatg

SEQ ID NO: 202700 - DNA, 103 bp, Artificial Sequence
  Synthetic Polynucleotide
taatacgactcactatagggcttcttccatcccagcagtctcttcacaacaacagaggagagttgtgatgagactgctgaacctggcggcagcgcaaaagatg

SEQ ID NO: 202701 - DNA, 103 bp, Artificial Sequence
  Synthetic Polynucleotide
taatacgactcactatagggatgactgtgaagatcaggccagcgccataaaacagaggagattatggatgtggcctgataacctggcggcagcgcaaaagatg

SEQ ID NO: 202702 - DNA, 103 bp, Artificial Sequence
  Synthetic Polynucleotide
taatacgactcactatagggtgagttcatgatgactgtgaagatcaggccaacagaggagaggcctgatgttcacagtcaacctggcggcagcgcaaaagatg

SEQ ID NO: 202703 - DNA, 103 bp, Artificial Sequence
  Synthetic Polynucleotide
taatacgactcactatagggtcaattgccttgagttcatgatgactgtgaaacagaggagatcacagatgtcatgaactaacctggcggcagcgcaaaagatg

SEQ ID NO: 202704 - DNA, 103 bp, Artificial Sequence
  Synthetic Polynucleotide
taatacgactcactatagggttcgcagttttcaattgccttgagttcatgaacagaggagacatgaaatgaaggcaattaacctggcggcagcgcaaaagatg

SEQ ID NO: 202705 - DNA, 103 bp, Artificial Sequence
  Synthetic Polynucleotide
taatacgactcactatagggtaaaagcatattcgcagttttcaattgcctaacagaggagaaggcaaatgaaaactgcgaacctggcggcagcgcaaaagatg

SEQ ID NO: 202706 - DNA, 103 bp, Artificial Sequence
  Synthetic Polynucleotide
taatacgactcactatagggtttttaagattaaaagcatattcgcagtttaacagaggagaaaactgatgatatgctttaacctggcggcagcgcaaaagatg

SEQ ID NO: 202707 - DNA, 103 bp, Artificial Sequence
  Synthetic Polynucleotide
taatacgactcactatagggtacttcatcctttttaagattaaaagcataaacagaggagatatgctatgaatcttaaaaacctggcggcagcgcaaaagatg

SEQ ID NO: 202708 - DNA, 103 bp, Artificial Sequence
  Synthetic Polynucleotide
taatacgactcactatagggggtttacacatacttcatcctttttaagataacagaggagaatcttaatgaggatgaagaacctggcggcagcgcaaaagatg

SEQ ID NO: 202709 - DNA, 103 bp, Artificial Sequence
  Synthetic Polynucleotide
taatacgactcactatagggtagtggtaagggtttacacatacttcatccaacagaggagaggatgaatgatgtgtaaaaacctggcggcagcgcaaaagatg

SEQ ID NO: 202710 - DNA, 103 bp, Artificial Sequence
  Synthetic Polynucleotide
taatacgactcactatagggaactctctgatagtggtaagggtttacacaaacagaggagatgtgtaatgccttaccacaacctggcggcagcgcaaaagatg

SEQ ID NO: 202711 - DNA, 103 bp, Artificial Sequence
  Synthetic Polynucleotide
taatacgactcactatagggcaccagctgacttcttccatcccagcagtcaacagaggagagactgcatggatggaagaaacctggcggcagcgcaaaagatg

SEQ ID NO: 202712 - DNA, 103 bp, Artificial Sequence
  Synthetic Polynucleotide
taatacgactcactatagggctggtgtctcaactctctgatagtggtaagaacagaggagacttaccatgatcagagagaacctggcggcagcgcaaaagatg

SEQ ID NO: 202713 - DNA, 103 bp, Artificial Sequence
  Synthetic Polynucleotide
taatacgactcactatagggggaggcaaaactggtgtctcaactctctgaaacagaggagatcagagatgtgagacaccaacctggcggcagcgcaaaagatg

SEQ ID NO: 202714 - DNA, 103 bp, Artificial Sequence
  Synthetic Polynucleotide
taatacgactcactatagggcactaatactggaggcaaaactggtgtctcaacagaggagagagacaatggttttgcctaacctggcggcagcgcaaaagatg

SEQ ID NO: 202715 - DNA, 103 bp, Artificial Sequence
  Synthetic Polynucleotide
taatacgactcactatagggtgtgtcggggcactaatactggaggcaaaaaacagaggagattttgcatgcagtattagaacctggcggcagcgcaaaagatg

SEQ ID NO: 202716 - DNA, 103 bp, Artificial Sequence
  Synthetic Polynucleotide
taatacgactcactatagggaggatctcggtgtgtcggggcactaatactaacagaggagaagtattatggccccgacaaacctggcggcagcgcaaaagatg

SEQ ID NO: 202717 - DNA, 103 bp, Artificial Sequence
  Synthetic Polynucleotide
taatacgactcactatagggaagttctgttaggatctcggtgtgtcggggaacagaggagaccccgaatgaccgagatcaacctggcggcagcgcaaaagatg

SEQ ID NO: 202718 - DNA, 103 bp, Artificial Sequence
  Synthetic Polynucleotide
taatacgactcactatagggccagaggcggaagttctgttaggatctcggaacagaggagaccgagaatgtaacagaacaacctggcggcagcgcaaaagatg

SEQ ID NO: 202719 - DNA, 103 bp, Artificial Sequence
  Synthetic Polynucleotide
taatacgactcactataggggtatagtcatccagaggcggaagttctgttaacagaggagaaacagaatgtccgcctctaacctggcggcagcgcaaaagatg

SEQ ID NO: 202720 - DNA, 103 bp, Artificial Sequence
  Synthetic Polynucleotide
taatacgactcactatagggaatggagtgagtatagtcatccagaggcggaacagaggagaccgcctatggatgactataacctggcggcagcgcaaaagatg

SEQ ID NO: 202721 - DNA, 103 bp, Artificial Sequence
  Synthetic Polynucleotide
taatacgactcactatagggtgttttctggaatggagtgagtatagtcataacagaggagaatgactatgctcactccaaacctggcggcagcgcaaaagatg

SEQ ID NO: 202722 - DNA, 103 bp, Artificial Sequence
  Synthetic Polynucleotide
taatacgactcactatagggcctccagacccaccagctgacttcttccataacagaggagaatggaaatggtcagctggaacctggcggcagcgcaaaagatg

SEQ ID NO: 202723 - DNA, 103 bp, Artificial Sequence
  Synthetic Polynucleotide
taatacgactcactataggggggaagttagtgttttctggaatggagtgaaacagaggagatcactcatgtccagaaaaaacctggcggcagcgcaaaagatg

SEQ ID NO: 202724 - DNA, 103 bp, Artificial Sequence
  Synthetic Polynucleotide
taatacgactcactatagggaattcctgctgggaagttagtgttttctggaacagaggagaccagaaatgactaacttcaacctggcggcagcgcaaaagatg

SEQ ID NO: 202725 - DNA, 103 bp, Artificial Sequence
  Synthetic Polynucleotide
taatacgactcactatagggtctgtggctcaattcctgctgggaagttagaacagaggagactaactatgcagcaggaaaacctggcggcagcgcaaaagatg

SEQ ID NO: 202726 - DNA, 103 bp, Artificial Sequence
  Synthetic Polynucleotide
taatacgactcactatagggatataattactctgtggctcaattcctgctaacagaggagaagcaggatgtgagccacaaacctggcggcagcgcaaaagatg

SEQ ID NO: 202727 - DNA, 103 bp, Artificial Sequence
  Synthetic Polynucleotide
taatacgactcactatagggcgtttctggaatataattactctgtggctcaacagaggagagagccaatgagtaattataacctggcggcagcgcaaaagatg

SEQ ID NO: 202728 - DNA, 103 bp, Artificial Sequence
  Synthetic Polynucleotide
taatacgactcactatagggcaggaggtggcgtttctggaatataattacaacagaggagagtaattatgttccagaaaaacctggcggcagcgcaaaagatg

SEQ ID NO: 202729 - DNA, 103 bp, Artificial Sequence
  Synthetic Polynucleotide
taatacgactcactatagggctgatatatccaggaggtggcgtttctggaaacagaggagatccagaatggccacctccaacctggcggcagcgcaaaagatg

SEQ ID NO: 202730 - DNA, 103 bp, Artificial Sequence
  Synthetic Polynucleotide
taatacgactcactatagggtccatcttcactgatatatccaggaggtggaacagaggagaccacctatgggatatatcaacctggcggcagcgcaaaagatg

SEQ ID NO: 202731 - DNA, 103 bp, Artificial Sequence
  Synthetic Polynucleotide
taatacgactcactatagggcacttgtttctccatcttcactgatatatcaacagaggagagatataatggtgaagatgaacctggcggcagcgcaaaagatg

SEQ ID NO: 202732 - DNA, 103 bp, Artificial Sequence
  Synthetic Polynucleotide
taatacgactcactatagggaactgttggtcacttgtttctccatcttcaaacagaggagatgaagaatgagaaacaagaacctggcggcagcgcaaaagatg

SEQ ID NO: 202733 - DNA, 103 bp, Artificial Sequence
  Synthetic Polynucleotide
taatacgactcactatagggtccgcctgctcctccagacccaccagctgaaacagaggagatcagctatggggtctggaaacctggcggcagcgcaaaagatg

SEQ ID NO: 202734 - DNA, 103 bp, Artificial Sequence
  Synthetic Polynucleotide
taatacgactcactatagggactttgattcaactgttggtcacttgtttcaacagaggagagaaacaatggaccaacagaacctggcggcagcgcaaaagatg

SEQ ID NO: 202735 - DNA, 103 bp, Artificial Sequence
  Synthetic Polynucleotide
taatacgactcactatagggctgtgtccatactttgattcaactgttggtaacagaggagaaccaacatgtgaatcaaaaacctggcggcagcgcaaaagatg

SEQ ID NO: 202736 - DNA, 103 bp, Artificial Sequence
  Synthetic Polynucleotide
taatacgactcactataggggctggagagcctgtgtccatactttgattcaacagaggagagaatcaatgtatggacacaacctggcggcagcgcaaaagatg

SEQ ID NO: 202737 - DNA, 103 bp, Artificial Sequence
  Synthetic Polynucleotide
taatacgactcactatagggagatagttctgctggagagcctgtgtccataacagaggagaatggacatgggctctccaaacctggcggcagcgcaaaagatg

SEQ ID NO: 202738 - DNA, 103 bp, Artificial Sequence
  Synthetic Polynucleotide
taatacgactcactataggggagtagtaggagatagttctgctggagagcaacagaggagagctctcatgcagaactataacctggcggcagcgcaaaagatg

SEQ ID NO: 202739 - DNA, 103 bp, Artificial Sequence
  Synthetic Polynucleotide
taatacgactcactatagggacaggggaaagagtagtaggagatagttctaacagaggagaagaactatgtcctactacaacctggcggcagcgcaaaagatg

SEQ ID NO: 202740 - DNA, 103 bp, Artificial Sequence
  Synthetic Polynucleotide
taatacgactcactataggggctatgattaacaggggaaagagtagtaggaacagaggagacctactatgctttcccctaacctggcggcagcgcaaaagatg

SEQ ID NO: 202741 - DNA, 103 bp, Artificial Sequence
  Synthetic Polynucleotide
taatacgactcactataggggtaaatccaagctatgattaacaggggaaaaacagaggagatttcccatgttaatcataaacctggcggcagcgcaaaagatg

SEQ ID NO: 202742 - DNA, 103 bp, Artificial Sequence
  Synthetic Polynucleotide
taatacgactcactataggggtaactggctgtaaatccaagctatgattaaacagaggagataatcaatgcttggatttaacctggcggcagcgcaaaagatg

SEQ ID NO: 202743 - DNA, 103 bp, Artificial Sequence
  Synthetic Polynucleotide
taatacgactcactatagggttctgagtaagtaactggctgtaaatccaaaacagaggagattggatatgcagccagttaacctggcggcagcgcaaaagatg

SEQ ID NO: 202744 - DNA, 103 bp, Artificial Sequence
  Synthetic Polynucleotide
taatacgactcactatagggtctgctctcctccgcctgctcctccagaccaacagaggagaggtctgatggagcaggcgaacctggcggcagcgcaaaagatg

SEQ ID NO: 202745 - DNA, 103 bp, Artificial Sequence
  Synthetic Polynucleotide
taatacgactcactatagggaaaatgcaggttctgagtaagtaactggctaacagaggagaagccagatgcttactcagaacctggcggcagcgcaaaagatg

SEQ ID NO: 202746 - DNA, 103 bp, Artificial Sequence
  Synthetic Polynucleotide
taatacgactcactatagggatcgaacaccaaaatgcaggttctgagtaaaacagaggagattactcatgacctgcattaacctggcggcagcgcaaaagatg

SEQ ID NO: 202747 - DNA, 103 bp, Artificial Sequence
  Synthetic Polynucleotide
taatacgactcactatagggataatatgctatcgaacaccaaaatgcaggaacagaggagacctgcaatgtggtgttcgaacctggcggcagcgcaaaagatg

SEQ ID NO: 202748 - DNA, 103 bp, Artificial Sequence
  Synthetic Polynucleotide
taatacgactcactataggggatttaattcataatatgctatcgaacaccaacagaggagaggtgttatgtagcatattaacctggcggcagcgcaaaagatg

SEQ ID NO: 202749 - DNA, 103 bp, Artificial Sequence
  Synthetic Polynucleotide
taatacgactcactatagggccaaccctctgatttaattcataatatgctaacagaggagaagcataatgtgaattaaaaacctggcggcagcgcaaaagatg

SEQ ID NO: 202750 - DNA, 103 bp, Artificial Sequence
  Synthetic Polynucleotide
taatacgactcactataggggaaggtttctccaaccctctgatttaattcaacagaggagagaattaatgcagagggttaacctggcggcagcgcaaaagatg

SEQ ID NO: 202751 - DNA, 103 bp, Artificial Sequence
  Synthetic Polynucleotide
taatacgactcactataggggtgatgcatggaaggtttctccaaccctctaacagaggagaagagggatggagaaacctaacctggcggcagcgcaaaagatg

SEQ ID NO: 202752 - DNA, 103 bp, Artificial Sequence
  Synthetic Polynucleotide
taatacgactcactatagggagtgagggctgtgatgcatggaaggtttctaacagaggagaagaaacatgccatgcatcaacctggcggcagcgcaaaagatg

SEQ ID NO: 202753 - DNA, 103 bp, Artificial Sequence
  Synthetic Polynucleotide
taatacgactcactatagggatctacagtgagtgagggctgtgatgcatgaacagaggagacatgcaatgcagccctcaaacctggcggcagcgcaaaagatg

SEQ ID NO: 202754 - DNA, 103 bp, Artificial Sequence
  Synthetic Polynucleotide
taatacgactcactatagggctgtaaagccatctacagtgagtgagggctaacagaggagaagccctatgtcactgtagaacctggcggcagcgcaaaagatg

SEQ ID NO: 202755 - DNA, 103 bp, Artificial Sequence
  Synthetic Polynucleotide
taatacgactcactatagggtcctgcccattctgctctcctccgcctgctaacagaggagaagcaggatgaggagagcaaacctggcggcagcgcaaaagatg

SEQ ID NO: 202756 - DNA, 103 bp, Artificial Sequence
  Synthetic Polynucleotide
taatacgactcactatagggtttgatgggtctgtaaagccatctacagtgaacagaggagacactgtatgtggctttacaacctggcggcagcgcaaaagatg

SEQ ID NO: 202757 - DNA, 103 bp, Artificial Sequence
  Synthetic Polynucleotide
taatacgactcactatagggcctctctgaatttgatgggtctgtaaagccaacagaggagaggctttatggacccatcaaacctggcggcagcgcaaaagatg

SEQ ID NO: 202758 - DNA, 103 bp, Artificial Sequence
  Synthetic Polynucleotide
taatacgactcactatagggctaagcagaacctctctgaatttgatgggtaacagaggagaacccatatgattcagagaaacctggcggcagcgcaaaagatg

SEQ ID NO: 202759 - DNA, 103 bp, Artificial Sequence
  Synthetic Polynucleotide
taatacgactcactataggggagagtaaacctaagcagaacctctctgaaaacagaggagattcagaatggttctgcttaacctggcggcagcgcaaaagatg

SEQ ID NO: 202760 - DNA, 103 bp, Artificial Sequence
  Synthetic Polynucleotide
taatacgactcactataggggttaacattggagagtaaacctaagcagaaaacagaggagattctgcatgggtttactcaacctggcggcagcgcaaaagatg

SEQ ID NO: 202761 - DNA, 103 bp, Artificial Sequence
  Synthetic Polynucleotide
taatacgactcactatagggtggcatttcggttaacattggagagtaaacaacagaggagagtttacatgccaatgttaaacctggcggcagcgcaaaagatg

SEQ ID NO: 202762 - DNA, 103 bp, Artificial Sequence
  Synthetic Polynucleotide
taatacgactcactatagggatttctaccgtggcatttcggttaacattgaacagaggagacaatgtatgccgaaatgcaacctggcggcagcgcaaaagatg

SEQ ID NO: 202763 - DNA, 103 bp, Artificial Sequence
  Synthetic Polynucleotide
taatacgactcactatagggccttcttgtcatttctaccgtggcatttcgaacagaggagacgaaatatgacggtagaaaacctggcggcagcgcaaaagatg

SEQ ID NO: 202764 - DNA, 103 bp, Artificial Sequence
  Synthetic Polynucleotide
taatacgactcactatagggttcctatatgccttcttgtcatttctaccgaacagaggagacggtagatgtgacaagaaaacctggcggcagcgcaaaagatg

SEQ ID NO: 202765 - DNA, 103 bp, Artificial Sequence
  Synthetic Polynucleotide
taatacgactcactatagggcgcactcctcttcctatatgccttcttgtcaacagaggagagacaagatggcatataggaacctggcggcagcgcaaaagatg

SEQ ID NO: 202766 - DNA, 103 bp, Artificial Sequence
  Synthetic Polynucleotide
taatacgactcactatagggcgggggagtgaaaggcaggatggacgacataacagaggagaatgtcgatgatcctgcctaacctggcggcagcgcaaaagatg

SEQ ID NO: 202767 - DNA, 103 bp, Artificial Sequence
  Synthetic Polynucleotide
taatacgactcactatagggcttgaccaggctcttgaccgccttctcgcaaacagaggagatgcgagatggcggtcaagaacctggcggcagcgcaaaagatg

SEQ ID NO: 202768 - DNA, 103 bp, Artificial Sequence
  Synthetic Polynucleotide
taatacgactcactatagggcaggttgcatcctggtgggatcttgcagacaacagaggagagtctgcatgatcccaccaaacctggcggcagcgcaaaagatg

SEQ ID NO: 202769 - DNA, 103 bp, Artificial Sequence
  Synthetic Polynucleotide
taatacgactcactatagggtgaagatcttcaggttgcatcctggtgggaaacagaggagatcccacatggatgcaaccaacctggcggcagcgcaaaagatg

SEQ ID NO: 202770 - DNA, 103 bp, Artificial Sequence
  Synthetic Polynucleotide
taatacgactcactatagggtcctggttgttgaagatcttcaggttgcataacagaggagaatgcaaatggaagatcttaacctggcggcagcgcaaaagatg

SEQ ID NO: 202771 - DNA, 103 bp, Artificial Sequence
  Synthetic Polynucleotide
taatacgactcactatagggggcagcgaactcctggttgttgaagatcttaacagaggagaaagatcatgaacaaccagaacctggcggcagcgcaaaagatg

SEQ ID NO: 202772 - DNA, 103 bp, Artificial Sequence
  Synthetic Polynucleotide
taatacgactcactataggggggccaggagggcagcgaactcctggttgtaacagaggagaacaaccatgagttcgctgaacctggcggcagcgcaaaagatg

SEQ ID NO: 202773 - DNA, 103 bp, Artificial Sequence
  Synthetic Polynucleotide
taatacgactcactatagggttgaccgactgggccaggagggcagcgaacaacagaggagagttcgcatgcctcctggcaacctggcggcagcgcaaaagatg

SEQ ID NO: 202774 - DNA, 103 bp, Artificial Sequence
  Synthetic Polynucleotide
taatacgactcactatagggaaagccctggttgaccgactgggccaggagaacagaggagactcctgatgcagtcggtcaacctggcggcagcgcaaaagatg

SEQ ID NO: 202775 - DNA, 103 bp, Artificial Sequence
  Synthetic Polynucleotide
taatacgactcactatagggagacagcctcaaagccctggttgaccgactaacagaggagaagtcggatgaccagggctaacctggcggcagcgcaaaagatg

SEQ ID NO: 202776 - DNA, 103 bp, Artificial Sequence
  Synthetic Polynucleotide
taatacgactcactataggggtcaactggtagacagcctcaaagccctggaacagaggagaccagggatgtgaggctgtaacctggcggcagcgcaaaagatg

SEQ ID NO: 202777 - DNA, 103 bp, Artificial Sequence
  Synthetic Polynucleotide
taatacgactcactataggggcacattcgggtcaactggtagacagcctcaacagaggagagaggctatgtaccagttgaacctggcggcagcgcaaaagatg

SEQ ID NO: 202778 - DNA, 103 bp, Artificial Sequence
  Synthetic Polynucleotide
taatacgactcactatagggtcttgagtttcttgaccaggctcttgaccgaacagaggagacggtcaatggcctggtcaaacctggcggcagcgcaaaagatg

SEQ ID NO: 202779 - DNA, 103 bp, Artificial Sequence
  Synthetic Polynucleotide
taatacgactcactatagggtgcggatggtgcacattcgggtcaactggtaacagaggagaaccagtatgcccgaatgtaacctggcggcagcgcaaaagatg

SEQ ID NO: 202780 - DNA, 103 bp, Artificial Sequence
  Synthetic Polynucleotide
taatacgactcactatagggacgaagctcatgcggatggtgcacattcggaacagaggagaccgaatatgcaccatccgaacctggcggcagcgcaaaagatg

SEQ ID NO: 202781 - DNA, 103 bp, Artificial Sequence
  Synthetic Polynucleotide
taatacgactcactatagggccagcctttgacgaagctcatgcggatggtaacagaggagaaccatcatgatgagcttcaacctggcggcagcgcaaaagatg

SEQ ID NO: 202782 - DNA, 103 bp, Artificial Sequence
  Synthetic Polynucleotide
taatacgactcactatagggactccgctccccagcctttgacgaagctcaaacagaggagatgagctatgtcaaaggctaacctggcggcagcgcaaaagatg

SEQ ID NO: 202783 - DNA, 103 bp, Artificial Sequence
  Synthetic Polynucleotide
taatacgactcactatagggtgtctcctgtactccgctccccagcctttgaacagaggagacaaaggatggggagcggaaacctggcggcagcgcaaaagatg

SEQ ID NO: 202784 - DNA, 103 bp, Artificial Sequence
  Synthetic Polynucleotide
taatacgactcactatagggggtcacagtctgtctcctgtactccgctccaacagaggagaggagcgatgtacaggagaaacctggcggcagcgcaaaagatg

SEQ ID NO: 202785 - DNA, 103 bp, Artificial Sequence
  Synthetic Polynucleotide
taatacgactcactatagggagggggtactggtcacagtctgtctcctgtaacagaggagaacaggaatgagactgtgaaacctggcggcagcgcaaaagatg

SEQ ID NO: 202786 - DNA, 103 bp, Artificial Sequence
  Synthetic Polynucleotide
taatacgactcactatagggtcaatccagcagggggtactggtcacagtcaacagaggagagactgtatgcagtaccccaacctggcggcagcgcaaaagatg

SEQ ID NO: 202787 - DNA, 103 bp, Artificial Sequence
  Synthetic Polynucleotide
taatacgactcactatagggcaggtgcagctcaatccagcagggggtactaacagaggagaagtaccatgtgctggattaacctggcggcagcgcaaaagatg

SEQ ID NO: 202788 - DNA, 103 bp, Artificial Sequence
  Synthetic Polynucleotide
taatacgactcactatagggaaggcccattcaggtgcagctcaatccagcaacagaggagagctggaatgagctgcaccaacctggcggcagcgcaaaagatg

SEQ ID NO: 202789 - DNA, 103 bp, Artificial Sequence
  Synthetic Polynucleotide
taatacgactcactatagggtgccccgtcttcttgagtttcttgaccaggaacagaggagacctggtatggaaactcaaaacctggcggcagcgcaaaagatg

SEQ ID NO: 202790 - DNA, 103 bp, Artificial Sequence
  Synthetic Polynucleotide
taatacgactcactatagggagccactgcaaaggcccattcaggtgcagcaacagaggagagctgcaatggaatgggccaacctggcggcagcgcaaaagatg

SEQ ID NO: 202791 - DNA, 103 bp, Artificial Sequence
  Synthetic Polynucleotide
taatacgactcactataggggaccttgtcaagccactgcaaaggcccattaacagaggagaaatgggatgttgcagtggaacctggcggcagcgcaaaagatg

SEQ ID NO: 202792 - DNA, 103 bp, Artificial Sequence
  Synthetic Polynucleotide
taatacgactcactatagggtctgggtgaggaccttgtcaagccactgcaaacagaggagatgcagtatgttgacaaggaacctggcggcagcgcaaaagatg

SEQ ID NO: 202793 - DNA, 103 bp, Artificial Sequence
  Synthetic Polynucleotide
taatacgactcactatagggggggagcccatctgggtgaggaccttgtcaaacagaggagatgacaaatgcctcacccaaacctggcggcagcgcaaaagatg

SEQ ID NO: 202794 - DNA, 103 bp, Artificial Sequence
  Synthetic Polynucleotide
taatacgactcactataggggcggatgcttggggagcccatctgggtgagaacagaggagactcaccatgatgggctccaacctggcggcagcgcaaaagatg

SEQ ID NO: 202795 - DNA, 103 bp, Artificial Sequence
  Synthetic Polynucleotide
taatacgactcactatagggcactggaacagcggatgcttggggagcccaaacagaggagatgggctatgcaagcatccaacctggcggcagcgcaaaagatg

SEQ ID NO: 202796 - DNA, 103 bp, Artificial Sequence
  Synthetic Polynucleotide
taatacgactcactatagggctcgtccagctgccccgtcttcttgagtttaacagaggagaaaactcatgaagacggggaacctggcggcagcgcaaaagatg

SEQ ID NO: 202797 - DNA, 103 bp, Artificial Sequence
  Synthetic Polynucleotide
taatacgactcactatagggccttctccagctcgtccagctgccccgtctaacagaggagaagacggatgagctggacgaacctggcggcagcgcaaaagatg

SEQ ID NO: 202798 - DNA, 103 bp, Artificial Sequence
  Synthetic Polynucleotide
taatacgactcactataggggtggtgatggccttctccagctcgtccagcaacagaggagagctggaatggctggagaaaacctggcggcagcgcaaaagatg

SEQ ID NO: 202799 - DNA, 103 bp, Artificial Sequence
  Synthetic Polynucleotide
taatacgactcactataggggacgttctgcgtggtgatggccttctccagaacagaggagactggagatggccatcaccaacctggcggcagcgcaaaagatg

SEQ ID NO: 202800 - DNA, 103 bp, Artificial Sequence
  Synthetic Polynucleotide
taatacgactcactatagggacttggtgttgacgttctgcgtggtgatggaacagaggagaccatcaatgcgcagaacgaacctggcggcagcgcaaaagatg

SEQ ID NO: 202801 - DNA, 103 bp, Artificial Sequence
  Synthetic Polynucleotide
taatacgactcactatagggatggtgatgcacttggtgttgacgttctgcaacagaggagagcagaaatgcaacaccaaaacctggcggcagcgcaaaagatg

SEQ ID NO: 202802 - DNA, 103 bp, Artificial Sequence
  Synthetic Polynucleotide
taatacgactcactatagggggacctggggatggtgatgcacttggtgttaacagaggagaaacaccatgtgcatcaccaacctggcggcagcgcaaaagatg

SEQ ID NO: 202803 - DNA, 103 bp, Artificial Sequence
  Synthetic Polynucleotide
taatacgactcactataggggcttcacgatcgggggagtgaaaggcaggaaacagaggagatcctgcatgtcactccccaacctggcggcagcgcaaaagatg

SEQ ID NO: 202804 - DNA, 103 bp, Artificial Sequence
  Synthetic Polynucleotide
taatacgactcactatagggggccatccagggacctggggatggtgatgcaacagaggagagcatcaatgtccccaggtaacctggcggcagcgcaaaagatg

SEQ ID NO: 202805 - DNA, 103 bp, Artificial Sequence
  Synthetic Polynucleotide
taatacgactcactatagggacctgcaaccggccatccagggacctggggaacagaggagaccccagatgcctggatggaacctggcggcagcgcaaaagatg

SEQ ID NO: 202806 - DNA, 103 bp, Artificial Sequence
  Synthetic Polynucleotide
taatacgactcactatagggccgatgggacacctgcaaccggccatccagaacagaggagactggatatgcggttgcagaacctggcggcagcgcaaaagatg

SEQ ID NO: 202807 - DNA, 103 bp, Artificial Sequence
  Synthetic Polynucleotide
taatacgactcactatagggggagccccttccgatgggacacctgcaaccaacagaggagaggttgcatgtgtcccatcaacctggcggcagcgcaaaagatg

SEQ ID NO: 202808 - DNA, 103 bp, Artificial Sequence
  Synthetic Polynucleotide
taatacgactcactatagggatgacatgagggagccccttccgatgggacaacagaggagagtcccaatggaaggggctaacctggcggcagcgcaaaagatg

SEQ ID NO: 202809 - DNA, 103 bp, Artificial Sequence
  Synthetic Polynucleotide
taatacgactcactataggggcggcagtagatgacatgagggagccccttaacagaggagaaaggggatgcctcatgtcaacctggcggcagcgcaaaagatg

SEQ ID NO: 202810 - DNA, 103 bp, Artificial Sequence
  Synthetic Polynucleotide
taatacgactcactatagggatcgccacaggcggcagtagatgacatgagaacagaggagactcatgatgtctactgccaacctggcggcagcgcaaaagatg

SEQ ID NO: 202811 - DNA, 103 bp, Artificial Sequence
  Synthetic Polynucleotide
taatacgactcactatagggaggtctggccatcgccacaggcggcagtagaacagaggagactactgatgcctgtggcgaacctggcggcagcgcaaaagatg

SEQ ID NO: 202812 - DNA, 103 bp, Artificial Sequence
  Synthetic Polynucleotide
taatacgactcactataggggtggctgtgcaggtctggccatcgccacagaacagaggagactgtggatgtggccagacaacctggcggcagcgcaaaagatg

SEQ ID NO: 202813 - DNA, 103 bp, Artificial Sequence
  Synthetic Polynucleotide
taatacgactcactataggggtagctcgtggtggctgtgcaggtctggccaacagaggagaggccagatgtgcacagccaacctggcggcagcgcaaaagatg

SEQ ID NO: 202814 - DNA, 103 bp, Artificial Sequence
  Synthetic Polynucleotide
taatacgactcactatagggcccagcaggcgcttcacgatcgggggagtgaacagaggagacactccatggatcgtgaaaacctggcggcagcgcaaaagatg

SEQ ID NO: 202815 - DNA, 103 bp, Artificial Sequence
  Synthetic Polynucleotide
taatacgactcactatagggtccatggcccgtagctcgtggtggctgtgcaacagaggagagcacagatgccacgagctaacctggcggcagcgcaaaagatg

SEQ ID NO: 202816 - DNA, 103 bp, Artificial Sequence
  Synthetic Polynucleotide
taatacgactcactatagggctcacacagctccatggcccgtagctcgtgaacagaggagacacgagatgcgggccatgaacctggcggcagcgcaaaagatg

SEQ ID NO: 202817 - DNA, 103 bp, Artificial Sequence
  Synthetic Polynucleotide
taatacgactcactatagggtgaaggcgaactcacacagctccatggcccaacagaggagagggccaatgagctgtgtgaacctggcggcagcgcaaaagatg

SEQ ID NO: 202818 - DNA, 103 bp, Artificial Sequence
  Synthetic Polynucleotide
taatacgactcactatagggttcttcatattgaaggcgaactcacacagcaacagaggagagctgtgatggttcgccttaacctggcggcagcgcaaaagatg

SEQ ID NO: 202819 - DNA, 103 bp, Artificial Sequence
  Synthetic Polynucleotide
taatacgactcactataggggacctcgtccttcttcatattgaaggcgaaaacagaggagattcgccatgaatatgaagaacctggcggcagcgcaaaagatg

SEQ ID NO: 202820 - DNA, 103 bp, Artificial Sequence
  Synthetic Polynucleotide
taatacgactcactataggggattcacgcagacctcgtccttcttcatataacagaggagaatatgaatgaggacgaggaacctggcggcagcgcaaaagatg

SEQ ID NO: 202821 - DNA, 103 bp, Artificial Sequence
  Synthetic Polynucleotide
taatacgactcactatagggtagtggtagggattcacgcagacctcgtccaacagaggagaggacgaatgctgcgtgaaaacctggcggcagcgcaaaagatg

SEQ ID NO: 202822 - DNA, 103 bp, Artificial Sequence
  Synthetic Polynucleotide
taatacgactcactatagggtactctctggtagtggtagggattcacgcaaacagaggagatgcgtgatgccctaccacaacctggcggcagcgcaaaagatg

SEQ ID NO: 202823 - DNA, 103 bp, Artificial Sequence
  Synthetic Polynucleotide
taatacgactcactatagggctggtgtctctactctctggtagtggtaggaacagaggagacctaccatgaccagagagaacctggcggcagcgcaaaagatg

SEQ ID NO: 202824 - DNA, 103 bp, Artificial Sequence
  Synthetic Polynucleotide
taatacgactcactatagggggaggtagaactggtgtctctactctctggaacagaggagaccagagatgagagacaccaacctggcggcagcgcaaaagatg

SEQ ID NO: 202825 - DNA, 103 bp, Artificial Sequence
  Synthetic Polynucleotide
taatacgactcactatagggcttcttccagcccagcaggcgcttcacgataacagaggagaatcgtgatgcgcctgctgaacctggcggcagcgcaaaagatg

SEQ ID NO: 202826 - DNA, 103 bp, Artificial Sequence
  Synthetic Polynucleotide
taatacgactcactatagggcaccaacacaggaggtagaactggtgtctcaacagaggagagagacaatggttctacctaacctggcggcagcgcaaaagatg

SEQ ID NO: 202827 - DNA, 103 bp, Artificial Sequence
  Synthetic Polynucleotide
taatacgactcactatagggtgtggcgtggcaccaacacaggaggtagaaaacagaggagattctacatgctgtgttggaacctggcggcagcgcaaaagatg

SEQ ID NO: 202828 - DNA, 103 bp, Artificial Sequence
  Synthetic Polynucleotide
taatacgactcactataggggggatctctgtgtggcgtggcaccaacacaaacagaggagatgtgttatggccacgccaaacctggcggcagcgcaaaagatg

SEQ ID NO: 202829 - DNA, 103 bp, Artificial Sequence
  Synthetic Polynucleotide
taatacgactcactataggggaactcggccgggatctctgtgtggcgtggaacagaggagaccacgcatgacagagatcaacctggcggcagcgcaaaagatg

SEQ ID NO: 202830 - DNA, 103 bp, Artificial Sequence
  Synthetic Polynucleotide
taatacgactcactatagggccagtggggggaactcggccgggatctctgaacagaggagacagagaatgcggccgagtaacctggcggcagcgcaaaagatg

SEQ ID NO: 202831 - DNA, 103 bp, Artificial Sequence
  Synthetic Polynucleotide
taatacgactcactatagggctgtagtcgtccagtggggggaactcggccaacagaggagaggccgaatgccccccactaacctggcggcagcgcaaaagatg

SEQ ID NO: 202832 - DNA, 103 bp, Artificial Sequence
  Synthetic Polynucleotide
taatacgactcactataggggatggaatggctgtagtcgtccagtgggggaacagaggagacccccaatggacgactacaacctggcggcagcgcaaaagatg

SEQ ID NO: 202833 - DNA, 103 bp, Artificial Sequence
  Synthetic Polynucleotide
taatacgactcactatagggtgttttcggggatggaatggctgtagtcgtaacagaggagaacgactatggccattccaaacctggcggcagcgcaaaagatg

SEQ ID NO: 202834 - DNA, 103 bp, Artificial Sequence
  Synthetic Polynucleotide
taatacgactcactataggggggaagttagtgttttcggggatggaatggaacagaggagaccattcatgccccgaaaaaacctggcggcagcgcaaaagatg

SEQ ID NO: 202835 - DNA, 103 bp, Artificial Sequence
  Synthetic Polynucleotide
taatacgactcactataggggatgcctgcggggaagttagtgttttcgggaacagaggagacccgaaatgactaacttcaacctggcggcagcgcaaaagatg

SEQ ID NO: 202836 - DNA, 103 bp, Artificial Sequence
  Synthetic Polynucleotide
taatacgactcactatagggtctgctcgcccttcttccagcccagcaggcaacagaggagagcctgcatggctggaagaaacctggcggcagcgcaaaagatg

SEQ ID NO: 202837 - DNA, 103 bp, Artificial Sequence
  Synthetic Polynucleotide
taatacgactcactatagggtctggggctcgatgcctgcggggaagttagaacagaggagactaactatgccgcaggcaaacctggcggcagcgcaaaagatg

SEQ ID NO: 202838 - DNA, 103 bp, Artificial Sequence
  Synthetic Polynucleotide
taatacgactcactatagggggaatattgctctggggctcgatgcctgcgaacagaggagacgcaggatgcgagccccaaacctggcggcagcgcaaaagatg

SEQ ID NO: 202839 - DNA, 103 bp, Artificial Sequence
  Synthetic Polynucleotide
taatacgactcactatagggtggggtctctggaatattgctctggggctcaacagaggagagagcccatgagcaatattaacctggcggcagcgcaaaagatg

SEQ ID NO: 202840 - DNA, 103 bp, Artificial Sequence
  Synthetic Polynucleotide
taatacgactcactatagggagccagggggtggggtctctggaatattgcaacagaggagagcaataatgcagagacccaacctggcggcagcgcaaaagatg

SEQ ID NO: 202841 - DNA, 103 bp, Artificial Sequence
  Synthetic Polynucleotide
taatacgactcactatagggtcactcaggtagccagggggtggggtctctaacagaggagaagagacatgaccccctggaacctggcggcagcgcaaaagatg

SEQ ID NO: 202842 - DNA, 103 bp, Artificial Sequence
  Synthetic Polynucleotide
taatacgactcactatagggttctccatcttcactcaggtagccagggggaacagaggagaccccctatgtacctgagtaacctggcggcagcgcaaaagatg

SEQ ID NO: 202843 - DNA, 103 bp, Artificial Sequence
  Synthetic Polynucleotide
taatacgactcactatagggggtcactggtttctccatcttcactcaggtaacagaggagaacctgaatgaagatggagaacctggcggcagcgcaaaagatg

SEQ ID NO: 202844 - DNA, 103 bp, Artificial Sequence
  Synthetic Polynucleotide
taatacgactcactatagggttcatctggtggtcactggtttctccatctaacagaggagaagatggatgaaccagtgaaacctggcggcagcgcaaaagatg

SEQ ID NO: 202845 - DNA, 103 bp, Artificial Sequence
  Synthetic Polynucleotide
taatacgactcactatagggcatgctgtggttcatctggtggtcactggtaacagaggagaaccagtatgcaccagatgaacctggcggcagcgcaaaagatg

SEQ ID NO: 202846 - DNA, 103 bp, Artificial Sequence
  Synthetic Polynucleotide
taatacgactcactatagggaacctgcgtccatgctgtggttcatctggtaacagaggagaaccagaatgaccacagcaaacctggcggcagcgcaaaagatg

SEQ ID NO: 202847 - DNA, 103 bp, Artificial Sequence
  Synthetic Polynucleotide
taatacgactcactatagggtcctgcccgttctgctcgcccttcttccagaacagaggagactggaaatggggcgagcaaacctggcggcagcgcaaaagatg

SEQ ID NO: 202848 - DNA, 103 bp, Artificial Sequence
  Synthetic Polynucleotide
taatacgactcactatagggaggtttggagaacctgcgtccatgctgtggaacagaggagaccacagatgggacgcaggaacctggcggcagcgcaaaagatg

SEQ ID NO: 202849 - DNA, 103 bp, Artificial Sequence
  Synthetic Polynucleotide
taatacgactcactatagggattcggggataggtttggagaacctgcgtcaacagaggagagacgcaatgtctccaaacaacctggcggcagcgcaaaagatg

SEQ ID NO: 202850 - DNA, 103 bp, Artificial Sequence
  Synthetic Polynucleotide
taatacgactcactataggggggacatcggattcggggataggtttggagaacagaggagactccaaatgtatccccgaaacctggcggcagcgcaaaagatg

SEQ ID NO: 202851 - DNA, 103 bp, Artificial Sequence
  Synthetic Polynucleotide
taatacgactcactatagggttatgtgctggggacatcggattcggggataacagaggagaatccccatgtccgatgtcaacctggcggcagcgcaaaagatg

SEQ ID NO: 202852 - DNA, 103 bp, Artificial Sequence
  Synthetic Polynucleotide
taatacgactcactataggggtccaagttattatgtgctggggacatcggaacagaggagaccgatgatgccagcacataacctggcggcagcgcaaaagatg

SEQ ID NO: 202853 - DNA, 103 bp, Artificial Sequence
  Synthetic Polynucleotide
taatacgactcactatagggctggctgcaggtccaagttattatgtgctgaacagaggagacagcacatgataacttggaacctggcggcagcgcaaaagatg

SEQ ID NO: 202854 - DNA, 103 bp, Artificial Sequence
  Synthetic Polynucleotide
taatacgactcactatagggcagtaggtaactggctgcaggtccaagttaaacagaggagataacttatgcctgcagccaacctggcggcagcgcaaaagatg

SEQ ID NO: 202855 - DNA, 103 bp, Artificial Sequence
  Synthetic Polynucleotide
taatacgactcactatagggggccggctcgcagtaggtaactggctgcagaacagaggagactgcagatggttacctacaacctggcggcagcgcaaaagatg

SEQ ID NO: 202856 - DNA, 103 bp, Artificial Sequence
  Synthetic Polynucleotide
taatacgactcactatagggagcaccagaaggccggctcgcagtaggtaaaacagaggagattacctatggcgagccggaacctggcggcagcgcaaaagatg

SEQ ID NO: 202857 - DNA, 103 bp, Artificial Sequence
  Synthetic Polynucleotide
taatacgactcactatagggtaggagatggagcaccagaaggccggctcgaacagaggagacgagccatgcttctggtgaacctggcggcagcgcaaaagatg

SEQ ID NO: 202858 - DNA, 103 bp, Artificial Sequence
  Synthetic Polynucleotide
taatacgactcactatagggccatttctcctcctgcccgttctgctcgccaacagaggagaggcgagatgaacgggcagaacctggcggcagcgcaaaagatg

SEQ ID NO: 202859 - DNA, 103 bp, Artificial Sequence
  Synthetic Polynucleotide
taatacgactcactatagggcagctcgtagtaggagatggagcaccagaaaacagaggagattctggatgtccatctccaacctggcggcagcgcaaaagatg

SEQ ID NO: 202860 - DNA, 103 bp, Artificial Sequence
  Synthetic Polynucleotide
taatacgactcactatagggcgcgctggttcagctcgtagtaggagatggaacagaggagaccatctatgactacgagcaacctggcggcagcgcaaaagatg

SEQ ID NO: 202861 - DNA, 103 bp, Artificial Sequence
  Synthetic Polynucleotide
taatacgactcactataggggtctccccgacgcgctggttcagctcgtagaacagaggagactacgaatggaaccagcgaacctggcggcagcgcaaaagatg

SEQ ID NO: 202862 - DNA, 103 bp, Artificial Sequence
  Synthetic Polynucleotide
taatacgactcactatagggggcgtggaatgtctccccgacgcgctggttaacagaggagaaaccagatggtcggggagaacctggcggcagcgcaaaagatg

SEQ ID NO: 202863 - DNA, 103 bp, Artificial Sequence
  Synthetic Polynucleotide
taatacgactcactatagggatggctgcgaggcgtggaatgtctccccgaaacagaggagatcggggatgcattccacgaacctggcggcagcgcaaaagatg

SEQ ID NO: 202864 - DNA, 103 bp, Artificial Sequence
  Synthetic Polynucleotide
taatacgactcactatagggacagtcatggatggctgcgaggcgtggaataacagaggagaattccaatgctcgcagccaacctggcggcagcgcaaaagatg

SEQ ID NO: 202865 - DNA, 103 bp, Artificial Sequence
  Synthetic Polynucleotide
taatacgactcactataggggaagccatccacagtcatggatggctgcgaaacagaggagatcgcagatgtccatgactaacctggcggcagcgcaaaagatg

SEQ ID NO: 202866 - DNA, 103 bp, Artificial Sequence
  Synthetic Polynucleotide
taatacgactcactatagggaggggtcggtgaagccatccacagtcatggaacagaggagaccatgaatgtggatggctaacctggcggcagcgcaaaagatg

SEQ ID NO: 202867 - DNA, 103 bp, Artificial Sequence
  Synthetic Polynucleotide
taatacgactcactatagggtccgaattggaggggtcggtgaagccatccaacagaggagaggatggatgcaccgacccaacctggcggcagcgcaaaagatg

SEQ ID NO: 202868 - DNA, 103 bp, Artificial Sequence
  Synthetic Polynucleotide
taatacgactcactataggggcagaagcgctccgaattggaggggtcggtaacagaggagaaccgacatgtccaattcgaacctggcggcagcgcaaaagatg

SEQ ID NO: 202869 - DNA, 103 bp, Artificial Sequence
  Synthetic Polynucleotide
taatacgactcactatagggccttctcgcaccatttctcctcctgcccgtaacagaggagaacgggcatgaggagaaataacctggcggcagcgcaaaagatg

SEQ ID NO: 202870 - DNA, 103 bp, Artificial Sequence
  Synthetic Polynucleotide
taatacgactcactataggggcagccctaggcagaagcgctccgaattggaacagaggagaccaattatgagcgcttctaacctggcggcagcgcaaaagatg

SEQ ID NO: 202871 - DNA, 103 bp, Artificial Sequence
  Synthetic Polynucleotide
taatacgactcactatagggacattggagagcagccctaggcagaagcgcaacagaggagagcgcttatgcctagggctaacctggcggcagcgcaaaagatg

SEQ ID NO: 202872 - DNA, 103 bp, Artificial Sequence
  Synthetic Polynucleotide
taatacgactcactatagggattcctgttgacattggagagcagccctagaacagaggagactagggatgctctccaataacctggcggcagcgcaaaagatg

SEQ ID NO: 202873 - DNA, 103 bp, Artificial Sequence
  Synthetic Polynucleotide
taatacgactcactatagggccactgctgcattcctgttgacattggagaaacagaggagatctccaatgtcaacaggaaacctggcggcagcgcaaaagatg

SEQ ID NO: 202874 - DNA, 103 bp, Artificial Sequence
  Synthetic Polynucleotide
taatacgactcactatagggcgtgtcagctccactgctgcattcctgttgaacagaggagacaacagatgtgcagcagtaacctggcggcagcgcaaaagatg

SEQ ID NO: 202875 - DNA, 103 bp, Artificial Sequence
  Synthetic Polynucleotide
taatacgactcactataggggatgtgtctccgtgtcagctccactgctgcaacagaggagagcagcaatggagctgacaaacctggcggcagcgcaaaagatg

SEQ ID NO: 202876 - DNA, 103 bp, Artificial Sequence
  Synthetic Polynucleotide
taatacgactcactatagggcgcctcttccgatgtgtctccgtgtcagctaacagaggagaagctgaatgggagacacaaacctggcggcagcgcaaaagatg

SEQ ID NO: 202877 - DNA, 103 bp, Artificial Sequence
  Synthetic Polynucleotide
taatacgactcactatagggtagagccgcacgcctcttccgatgtgtctcaacagaggagagagacaatgcggaagaggaacctggcggcagcgcaaaagatg

SEQ ID NO: 202878 - DNA, 103 bp, Artificial Sequence
  Synthetic Polynucleotide
taatacgactcactatagggtccgatgtagtagagccgcacgcctcttccaacagaggagaggaagaatggtgcggctcaacctggcggcagcgcaaaagatg

SEQ ID NO: 202879 - DNA, 103 bp, Artificial Sequence
  Synthetic Polynucleotide
taatacgactcactatagggagacctcccctccgatgtagtagagccgcaaacagaggagatgcggcatgactacatcgaacctggcggcagcgcaaaagatg

SEQ ID NO: 202880 - DNA, 103 bp, Artificial Sequence
  Synthetic Polynucleotide
taatacgactcactatagggctcttgaccgccttctcgcaccatttctccaacagaggagaggagaaatggtgcgagaaaacctggcggcagcgcaaaagatg

SEQ ID NO: 202881 - DNA, 103 bp, Artificial Sequence
  Synthetic Polynucleotide
taatacgactcactatagggcactctgcgaagacctcccctccgatgtagaacagaggagactacatatgaggggaggtaacctggcggcagcgcaaaagatg

SEQ ID NO: 202882 - DNA, 103 bp, Artificial Sequence
  Synthetic Polynucleotide
taatacgactcactataggggtcactgaggcactctgcgaagacctccccaacagaggagaggggagatgttcgcagagaacctggcggcagcgcaaaagatg

SEQ ID NO: 202883 - DNA, 103 bp, Artificial Sequence
  Synthetic Polynucleotide
taatacgactcactatagggaaatagcgctgtcactgaggcactctgcgaaacagaggagatcgcagatggcctcagtgaacctggcggcagcgcaaaagatg

SEQ ID NO: 202884 - DNA, 103 bp, Artificial Sequence
  Synthetic Polynucleotide
taatacgactcactataggggactggacaaaaatagcgctgtcactgaggaacagaggagacctcagatgcagcgctataacctggcggcagcgcaaaagatg

SEQ ID NO: 202885 - DNA, 103 bp, Artificial Sequence
  Synthetic Polynucleotide
taatacgactcactatagggacagttgggagactggacaaaaatagcgctaacagaggagaagcgctatgtttgtccagaacctggcggcagcgcaaaagatg

SEQ ID NO: 202886 - DNA, 103 bp, Artificial Sequence
  Synthetic Polynucleotide
taatacgactcactatagggagcgctggttacagttgggagactggacaaaacagaggagattgtccatgctcccaactaacctggcggcagcgcaaaagatg

SEQ ID NO: 202887 - DNA, 103 bp, Artificial Sequence
  Synthetic Polynucleotide
taatacgactcactatagggtgccagccatagcgctggttacagttgggaaacagaggagatcccaaatgtaaccagcgaacctggcggcagcgcaaaagatg

SEQ ID NO: 202888 - DNA, 103 bp, Artificial Sequence
  Synthetic Polynucleotide
taatacgactcactatagggggtggccgggtgccagccatagcgctggttaacagaggagaaaccagatgtatggctggaacctggcggcagcgcaaaagatg

SEQ ID NO: 202889 - DNA, 103 bp, Artificial Sequence
  Synthetic Polynucleotide
taatacgactcactatagggtcttgcagacggtggccgggtgccagccataacagaggagaatggctatgacccggccaaacctggcggcagcgcaaaagatg

SEQ ID NO: 202890 - DNA, 103 bp, Artificial Sequence
  Synthetic Polynucleotide
taatacgactcactatagggcctggtgggatcttgcagacggtggccgggaacagaggagacccggcatgcgtctgcaaaacctggcggcagcgcaaaagatg

SEQ ID NO: 202891 - DNA, 103 bp, Artificial Sequence
  Synthetic Polynucleotide
taatacgactcactatagggtggtgtattcgtaatagacatattgtccataacagaggagaatggacatgatgtctattaacctggcggcagcgcaaaagatg

SEQ ID NO: 202892 - DNA, 103 bp, Artificial Sequence
  Synthetic Polynucleotide
taatacgactcactatagggaattgctctttttgcaaatgtttcactctcaacagaggagagagagtatgacatttgcaaacctggcggcagcgcaaaagatg

SEQ ID NO: 202893 - DNA, 103 bp, Artificial Sequence
  Synthetic Polynucleotide
taatacgactcactatagggcttaaatgtctctcctacctgaacatccataacagaggagaatggatatgcaggtaggaaacctggcggcagcgcaaaagatg

SEQ ID NO: 202894 - DNA, 103 bp, Artificial Sequence
  Synthetic Polynucleotide
taatacgactcactatagggttgaaggaaccttaaatgtctctcctacctaacagaggagaaggtagatgagacatttaaacctggcggcagcgcaaaagatg

SEQ ID NO: 202895 - DNA, 103 bp, Artificial Sequence
  Synthetic Polynucleotide
taatacgactcactatagggatagggcagcttgaaggaaccttaaatgtcaacagaggagagacattatgggttccttcaacctggcggcagcgcaaaagatg

SEQ ID NO: 202896 - DNA, 103 bp, Artificial Sequence
  Synthetic Polynucleotide
taatacgactcactatagggaacagtaacaatagggcagcttgaaggaacaacagaggagagttcctatgagctgccctaacctggcggcagcgcaaaagatg

SEQ ID NO: 202897 - DNA, 103 bp, Artificial Sequence
  Synthetic Polynucleotide
taatacgactcactatagggcgtatccatcaacagtaacaatagggcagcaacagaggagagctgccatgttgttactgaacctggcggcagcgcaaaagatg

SEQ ID NO: 202898 - DNA, 103 bp, Artificial Sequence
  Synthetic Polynucleotide
taatacgactcactataggggaagggtccacgtatccatcaacagtaacaaacagaggagatgttacatgtgatggataaacctggcggcagcgcaaaagatg

SEQ ID NO: 202899 - DNA, 103 bp, Artificial Sequence
  Synthetic Polynucleotide
taatacgactcactatagggatctcctccagaagggtccacgtatccatcaacagaggagagatggaatggtggaccctaacctggcggcagcgcaaaagatg

SEQ ID NO: 202900 - DNA, 103 bp, Artificial Sequence
  Synthetic Polynucleotide
taatacgactcactatagggaacaaaagcgatctcctccagaagggtccaaacagaggagatggaccatgctggaggagaacctggcggcagcgcaaaagatg

SEQ ID NO: 202901 - DNA, 103 bp, Artificial Sequence
  Synthetic Polynucleotide
taatacgactcactatagggagttgacccaaacaaaagcgatctcctccaaacagaggagatggaggatgtcgcttttgaacctggcggcagcgcaaaagatg

SEQ ID NO: 202902 - DNA, 103 bp, Artificial Sequence
  Synthetic Polynucleotide
taatacgactcactataggggacattggagagttgacccaaacaaaagcgaacagaggagacgctttatgttgggtcaaaacctggcggcagcgcaaaagatg

SEQ ID NO: 202903 - DNA, 103 bp, Artificial Sequence
  Synthetic Polynucleotide
taatacgactcactatagggccaaactttcaattgctctttttgcaaatgaacagaggagacatttgatgaaagagcaaaacctggcggcagcgcaaaagatg

SEQ ID NO: 202904 - DNA, 103 bp, Artificial Sequence
  Synthetic Polynucleotide
taatacgactcactatagggctgtcctgtggacattggagagttgacccaaacagaggagatgggtcatgtctccaatgaacctggcggcagcgcaaaagatg

SEQ ID NO: 202905 - DNA, 103 bp, Artificial Sequence
  Synthetic Polynucleotide
taatacgactcactatagggtcaatggcttctgtcctgtggacattggagaacagaggagactccaaatgccacaggacaacctggcggcagcgcaaaagatg

SEQ ID NO: 202906 - DNA, 103 bp, Artificial Sequence
  Synthetic Polynucleotide
taatacgactcactatagggccttgctctctcaatggcttctgtcctgtgaacagaggagacacaggatggaagccattaacctggcggcagcgcaaaagatg

SEQ ID NO: 202907 - DNA, 103 bp, Artificial Sequence
  Synthetic Polynucleotide
taatacgactcactatagggctatgtgcaaccttgctctctcaatggcttaacagaggagaaagccaatgagagagcaaaacctggcggcagcgcaaaagatg

SEQ ID NO: 202908 - DNA, 103 bp, Artificial Sequence
  Synthetic Polynucleotide
taatacgactcactatagggacacctttgcctatgtgcaaccttgctctcaacagaggagagagagcatggttgcacataacctggcggcagcgcaaaagatg

SEQ ID NO: 202909 - DNA, 103 bp, Artificial Sequence
  Synthetic Polynucleotide
taatacgactcactatagggttccaactgcacacctttgcctatgtgcaaaacagaggagattgcacatgggcaaaggtaacctggcggcagcgcaaaagatg

SEQ ID NO: 202910 - DNA, 103 bp, Artificial Sequence
  Synthetic Polynucleotide
taatacgactcactatagggcacctttacattccaactgcacacctttgcaacagaggagagcaaagatgtgcagttggaacctggcggcagcgcaaaagatg

SEQ ID NO: 202911 - DNA, 103 bp, Artificial Sequence
  Synthetic Polynucleotide
taatacgactcactatagggacatcaccttcacctttacattccaactgcaacagaggagagcagttatgatgtaaaggaacctggcggcagcgcaaaagatg

SEQ ID NO: 202912 - DNA, 103 bp, Artificial Sequence
  Synthetic Polynucleotide
taatacgactcactatagggcctgacccaaacatcaccttcacctttacaaacagaggagatgtaaaatggaaggtgataacctggcggcagcgcaaaagatg

SEQ ID NO: 202913 - DNA, 103 bp, Artificial Sequence
  Synthetic Polynucleotide
taatacgactcactatagggcactaaggcacctgacccaaacatcaccttaacagaggagaaaggtgatgtttgggtcaaacctggcggcagcgcaaaagatg

SEQ ID NO: 202914 - DNA, 103 bp, Artificial Sequence
  Synthetic Polynucleotide
taatacgactcactatagggagcttctttaccaaactttcaattgctcttaacagaggagaaagagcatgtgaaagtttaacctggcggcagcgcaaaagatg

SEQ ID NO: 202915 - DNA, 103 bp, Artificial Sequence
  Synthetic Polynucleotide
taatacgactcactatagggaccgcgtggtcactaaggcacctgacccaaaacagaggagattgggtatggtgccttagaacctggcggcagcgcaaaagatg

SEQ ID NO: 202916 - DNA, 103 bp, Artificial Sequence
  Synthetic Polynucleotide
taatacgactcactatagggctgtacaaagaccgcgtggtcactaaggcaaacagaggagatgccttatggaccacgcgaacctggcggcagcgcaaaagatg

SEQ ID NO: 202917 - DNA, 103 bp, Artificial Sequence
  Synthetic Polynucleotide
taatacgactcactatagggagtagtaactctgtacaaagaccgcgtggtaacagaggagaaccacgatgtctttgtacaacctggcggcagcgcaaaagatg

SEQ ID NO: 202918 - DNA, 103 bp, Artificial Sequence
  Synthetic Polynucleotide
taatacgactcactatagggtctctgtctaagtagtaactctgtacaaagaacagaggagactttgtatggagttactaaacctggcggcagcgcaaaagatg

SEQ ID NO: 202919 - DNA, 103 bp, Artificial Sequence
  Synthetic Polynucleotide
taatacgactcactatagggacgcccagcttctctgtctaagtagtaactaacagaggagaagttacatgttagacagaaacctggcggcagcgcaaaagatg

SEQ ID NO: 202920 - DNA, 103 bp, Artificial Sequence
  Synthetic Polynucleotide
taatacgactcactatagggctccaggtgcacgcccagcttctctgtctaaacagaggagatagacaatgaagctgggcaacctggcggcagcgcaaaagatg

SEQ ID NO: 202921 - DNA, 103 bp, Artificial Sequence
  Synthetic Polynucleotide
taatacgactcactatagggtgaacagcatctccaggtgcacgcccagctaacagaggagaagctggatgtgcacctggaacctggcggcagcgcaaaagatg

SEQ ID NO: 202922 - DNA, 103 bp, Artificial Sequence
  Synthetic Polynucleotide
taatacgactcactataggggtagatcttatgaacagcatctccaggtgcaacagaggagagcacctatggatgctgttaacctggcggcagcgcaaaagatg

SEQ ID NO: 202923 - DNA, 103 bp, Artificial Sequence
  Synthetic Polynucleotide
taatacgactcactatagggatgcacttgggtagatcttatgaacagcataacagaggagaatgctgatgataagatctaacctggcggcagcgcaaaagatg

SEQ ID NO: 202924 - DNA, 103 bp, Artificial Sequence
  Synthetic Polynucleotide
taatacgactcactatagggacctttatatatgcacttgggtagatcttaaacagaggagataagatatgcccaagtgcaacctggcggcagcgcaaaagatg

SEQ ID NO: 202925 - DNA, 103 bp, Artificial Sequence
  Synthetic Polynucleotide
taatacgactcactatagggtttctccttcagcttctttaccaaactttcaacagaggagagaaagtatggtaaagaagaacctggcggcagcgcaaaagatg

SEQ ID NO: 202926 - DNA, 103 bp, Artificial Sequence
  Synthetic Polynucleotide
taatacgactcactatagggcaaatcaaagacctttatatatgcacttggaacagaggagaccaagtatgtatataaagaacctggcggcagcgcaaaagatg

SEQ ID NO: 202927 - DNA, 103 bp, Artificial Sequence
  Synthetic Polynucleotide
taatacgactcactataggggacactgacgcaaatcaaagacctttatataacagaggagaatataaatgtctttgattaacctggcggcagcgcaaaagatg

SEQ ID NO: 202928 - DNA, 103 bp, Artificial Sequence
  Synthetic Polynucleotide
taatacgactcactatagggatctgtcgatgacactgacgcaaatcaaagaacagaggagactttgaatggcgtcagtgaacctggcggcagcgcaaaagatg

SEQ ID NO: 202929 - DNA, 103 bp, Artificial Sequence
  Synthetic Polynucleotide
taatacgactcactatagggctgctgctgcatctgtcgatgacactgacgaacagaggagacgtcagatgcatcgacagaacctggcggcagcgcaaaagatg

SEQ ID NO: 202930 - DNA, 103 bp, Artificial Sequence
  Synthetic Polynucleotide
taatacgactcactatagggcagtagccgcctgctgctgcatctgtcgataacagaggagaatcgacatgtgcagcagcaacctggcggcagcgcaaaagatg

SEQ ID NO: 202931 - DNA, 103 bp, Artificial Sequence
  Synthetic Polynucleotide
taatacgactcactataggggcagcttgtgcagtagccgcctgctgctgcaacagaggagagcagcaatgggcggctacaacctggcggcagcgcaaaagatg

SEQ ID NO: 202932 - DNA, 103 bp, Artificial Sequence
  Synthetic Polynucleotide
taatacgactcactatagggggcagctgctgcagcttgtgcagtagccgcaacagaggagagcggctatggcacaagctaacctggcggcagcgcaaaagatg

SEQ ID NO: 202933 - DNA, 103 bp, Artificial Sequence
  Synthetic Polynucleotide
taatacgactcactatagggctgctgcctgggcagctgctgcagcttgtgaacagaggagacacaagatgcagcagctgaacctggcggcagcgcaaaagatg

SEQ ID NO: 202934 - DNA, 103 bp, Artificial Sequence
  Synthetic Polynucleotide
taatacgactcactatagggcctgccacggctgctgcctgggcagctgctaacagaggagaagcagcatgccaggcagcaacctggcggcagcgcaaaagatg

SEQ ID NO: 202935 - DNA, 103 bp, Artificial Sequence
  Synthetic Polynucleotide
taatacgactcactatagggagggatgtttcctgccacggctgctgcctgaacagaggagacaggcaatggccgtggcaaacctggcggcagcgcaaaagatg

SEQ ID NO: 202936 - DNA, 103 bp, Artificial Sequence
  Synthetic Polynucleotide
taatacgactcactatagggattcatcttttttctccttcagcttctttaaacagaggagataaagaatgtgaaggagaaacctggcggcagcgcaaaagatg

SEQ ID NO: 202937 - DNA, 103 bp, Artificial Sequence
  Synthetic Polynucleotide
taatacgactcactatagggatcctgggccagggatgtttcctgccacggaacagaggagaccgtggatggaaacatccaacctggcggcagcgcaaaagatg

SEQ ID NO: 202938 - DNA, 103 bp, Artificial Sequence
  Synthetic Polynucleotide
taatacgactcactatagggccacctactgatcctgggccagggatgtttaacagaggagaaaacatatgtggcccaggaacctggcggcagcgcaaaagatg

SEQ ID NO: 202939 - DNA, 103 bp, Artificial Sequence
  Synthetic Polynucleotide
taatacgactcactatagggtggagctattccacctactgatcctgggccaacagaggagaggcccaatgtcagtaggtaacctggcggcagcgcaaaagatg

SEQ ID NO: 202940 - DNA, 103 bp, Artificial Sequence
  Synthetic Polynucleotide
taatacgactcactataggggactgatagctggagctattccacctactgaacagaggagacagtagatggaatagctcaacctggcggcagcgcaaaagatg

SEQ ID NO: 202941 - DNA, 103 bp, Artificial Sequence
  Synthetic Polynucleotide
taatacgactcactataggggcagctgacagactgatagctggagctattaacagaggagaaatagcatgagctatcagaacctggcggcagcgcaaaagatg

SEQ ID NO: 202942 - DNA, 103 bp, Artificial Sequence
  Synthetic Polynucleotide
taatacgactcactatagggaattccagcagcagctgacagactgatagcaacagaggagagctatcatgctgtcagctaacctggcggcagcgcaaaagatg

SEQ ID NO: 202943 - DNA, 103 bp, Artificial Sequence
  Synthetic Polynucleotide
taatacgactcactatagggcatcaacaccaattccagcagcagctgacaaacagaggagatgtcagatgctgctggaaaacctggcggcagcgcaaaagatg

SEQ ID NO: 202944 - DNA, 103 bp, Artificial Sequence
  Synthetic Polynucleotide
taatacgactcactatagggcgacgaaggtcatcaacaccaattccagcaaacagaggagatgctggatgtggtgttgaaacctggcggcagcgcaaaagatg

SEQ ID NO: 202945 - DNA, 103 bp, Artificial Sequence
  Synthetic Polynucleotide
taatacgactcactatagggtatgcataagcgacgaaggtcatcaacaccaacagaggagaggtgttatggaccttcgtaacctggcggcagcgcaaaagatg

SEQ ID NO: 202946 - DNA, 103 bp, Artificial Sequence
  Synthetic Polynucleotide
taatacgactcactatagggtcatcctgagtatgcataagcgacgaaggtaacagaggagaaccttcatggcttatgcaaacctggcggcagcgcaaaagatg

SEQ ID NO: 202947 - DNA, 103 bp, Artificial Sequence
  Synthetic Polynucleotide
taatacgactcactatagggaaagaatccaattcatcttttttctccttcaacagaggagagaaggaatgaaaagatgaaacctggcggcagcgcaaaagatg

SEQ ID NO: 202948 - DNA, 103 bp, Artificial Sequence
  Synthetic Polynucleotide
taatacgactcactatagggttcacaaaactcatcctgagtatgcataagaacagaggagacttatgatgactcaggataacctggcggcagcgcaaaagatg

SEQ ID NO: 202949 - DNA, 103 bp, Artificial Sequence
  Synthetic Polynucleotide
taatacgactcactatagggtccccagcctttcacaaaactcatcctgagaacagaggagactcaggatgagttttgtgaacctggcggcagcgcaaaagatg

SEQ ID NO: 202950 - DNA, 103 bp, Artificial Sequence
  Synthetic Polynucleotide
taatacgactcactatagggggtaatccggtccccagcctttcacaaaacaacagaggagagttttgatgaaggctgggaacctggcggcagcgcaaaagatg

SEQ ID NO: 202951 - DNA, 103 bp, Artificial Sequence
  Synthetic Polynucleotide
taatacgactcactatagggctctgtcttgggtaatccggtccccagcctaacagaggagaaggctgatgaccggattaaacctggcggcagcgcaaaagatg

SEQ ID NO: 202952 - DNA, 103 bp, Artificial Sequence
  Synthetic Polynucleotide
taatacgactcactatagggttctttgatgctctgtcttgggtaatccggaacagaggagaccggatatgccaagacagaacctggcggcagcgcaaaagatg

SEQ ID NO: 202953 - DNA, 103 bp, Artificial Sequence
  Synthetic Polynucleotide
taatacgactcactatagggagcaaggtgtttctttgatgctctgtcttgaacagaggagacaagacatggcatcaaagaacctggcggcagcgcaaaagatg

SEQ ID NO: 202954 - DNA, 103 bp, Artificial Sequence
  Synthetic Polynucleotide
taatacgactcactatagggatttcaatccagcaaggtgtttctttgatgaacagaggagacatcaaatgaacaccttgaacctggcggcagcgcaaaagatg

SEQ ID NO: 202955 - DNA, 103 bp, Artificial Sequence
  Synthetic Polynucleotide
taatacgactcactataggggtgtaagtgaatttcaatccagcaaggtgtaacagaggagaacacctatgtggattgaaaacctggcggcagcgcaaaagatg

SEQ ID NO: 202956 - DNA, 103 bp, Artificial Sequence
  Synthetic Polynucleotide
taatacgactcactatagggggagggcccggtgtaagtgaatttcaatccaacagaggagaggattgatgttcacttacaacctggcggcagcgcaaaagatg

SEQ ID NO: 202957 - DNA, 103 bp, Artificial Sequence
  Synthetic Polynucleotide
taatacgactcactatagggtctaggagctggagggcccggtgtaagtgaaacagaggagatcacttatgccgggccctaacctggcggcagcgcaaaagatg

SEQ ID NO: 202958 - DNA, 103 bp, Artificial Sequence
  Synthetic Polynucleotide
taatacgactcactatagggagctgttattaaagaatccaattcatctttaacagaggagaaaagatatgttggattctaacctggcggcagcgcaaaagatg

SEQ ID NO: 202959 - DNA, 103 bp, Artificial Sequence
  Synthetic Polynucleotide
taatacgactcactatagggaagtacttcgtctaggagctggagggcccgaacagaggagacgggccatgcagctcctaaacctggcggcagcgcaaaagatg

SEQ ID NO: 202960 - DNA, 103 bp, Artificial Sequence
  Synthetic Polynucleotide
taatacgactcactataggggcatggtatgaagtacttcgtctaggagctaacagaggagaagctccatgacgaagtacaacctggcggcagcgcaaaagatg

SEQ ID NO: 202961 - DNA, 103 bp, Artificial Sequence
  Synthetic Polynucleotide
taatacgactcactatagggtctgcaatcggcatggtatgaagtacttcgaacagaggagacgaagtatgtcataccataacctggcggcagcgcaaaagatg

SEQ ID NO: 202962 - DNA, 103 bp, Artificial Sequence
  Synthetic Polynucleotide
taatacgactcactatagggaggttgtgggtctgcaatcggcatggtatgaacagaggagacataccatgccgattgcaaacctggcggcagcgcaaaagatg

SEQ ID NO: 202963 - DNA, 103 bp, Artificial Sequence
  Synthetic Polynucleotide
taatacgactcactatagggttgtagttatagctgttattaaagaatccaaacagaggagatggattatgtaataacagaacctggcggcagcgcaaaagatg

SEQ ID NO: 202964 - DNA, 103 bp, Artificial Sequence
  Synthetic Polynucleotide
taatacgactcactatagggtgagctccatttgtagttatagctgttattaacagaggagaaataacatgtataactacaacctggcggcagcgcaaaagatg

SEQ ID NO: 202965 - DNA, 103 bp, Artificial Sequence
  Synthetic Polynucleotide
taatacgactcactatagggtttactaggatgagctccatttgtagttataacagaggagaataactatgaatggagctaacctggcggcagcgcaaaagatg

SEQ ID NO: 202966 - DNA, 103 bp, Artificial Sequence
  Synthetic Polynucleotide
taatacgactcactatagggcattacttgttggtgtattcgtaatagacaaacagaggagatgtctaatgcgaatacacaacctggcggcagcgcaaaagatg

SEQ ID NO: 202967 - DNA, 103 bp, Artificial Sequence
  Synthetic Polynucleotide
taatacgactcactatagggtggtaacacatttactaggatgagctccataacagaggagaatggagatgatcctagtaaacctggcggcagcgcaaaagatg

SEQ ID NO: 202968 - DNA, 103 bp, Artificial Sequence
  Synthetic Polynucleotide
taatacgactcactataggggttctctgtatggtaacacatttactaggaaacagaggagatcctagatgatgtgttacaacctggcggcagcgcaaaagatg

SEQ ID NO: 202969 - DNA, 103 bp, Artificial Sequence
  Synthetic Polynucleotide
taatacgactcactatagggcccatccaatgttctctgtatggtaacacaaacagaggagatgtgttatgatacagagaaacctggcggcagcgcaaaagatg

SEQ ID NO: 202970 - DNA, 103 bp, Artificial Sequence
  Synthetic Polynucleotide
taatacgactcactatagggcctgaagcctcccatccaatgttctctgtaaacagaggagatacagaatgcattggatgaacctggcggcagcgcaaaagatg

SEQ ID NO: 202971 - DNA, 103 bp, Artificial Sequence
  Synthetic Polynucleotide
taatacgactcactatagggcgaccagccacctgaagcctcccatccaataacagaggagaattggaatggaggcttcaaacctggcggcagcgcaaaagatg

SEQ ID NO: 202972 - DNA, 103 bp, Artificial Sequence
  Synthetic Polynucleotide
taatacgactcactatagggaaatcctttccgaccagccacctgaagcctaacagaggagaaggcttatggtggctggtaacctggcggcagcgcaaaagatg

SEQ ID NO: 202973 - DNA, 103 bp, Artificial Sequence
  Synthetic Polynucleotide
taatacgactcactatagggtcacatgaggaaatcctttccgaccagccaaacagaggagatggctgatgggaaaggataacctggcggcagcgcaaaagatg

SEQ ID NO: 202974 - DNA, 103 bp, Artificial Sequence
  Synthetic Polynucleotide
taatacgactcactatagggcgggcatagatcacatgaggaaatcctttcaacagaggagagaaaggatgtcctcatgtaacctggcggcagcgcaaaagatg

SEQ ID NO: 202975 - DNA, 103 bp, Artificial Sequence
  Synthetic Polynucleotide
taatacgactcactatagggcctccagagacgggcatagatcacatgaggaacagaggagacctcatatgatctatgccaacctggcggcagcgcaaaagatg

SEQ ID NO: 202976 - DNA, 103 bp, Artificial Sequence
  Synthetic Polynucleotide
taatacgactcactataggggatcaggccacctccagagacgggcatagaaacagaggagatctatgatggtctctggaaacctggcggcagcgcaaaagatg

SEQ ID NO: 202977 - DNA, 103 bp, Artificial Sequence
  Synthetic Polynucleotide
taatacgactcactatagggagacaggcatcattacttgttggtgtattcaacagaggagagaatacatgaacaagtaaaacctggcggcagcgcaaaagatg

SEQ ID NO: 202978 - DNA, 103 bp, Artificial Sequence
  Synthetic Polynucleotide
taatacgactcactatagggtttttgtgaagatcaggccacctccagagaaacagaggagatctctgatggtggcctgaaacctggcggcagcgcaaaagatg

SEQ ID NO: 202979 - DNA, 103 bp, Artificial Sequence
  Synthetic Polynucleotide
taatacgactcactatagggttttagttcatttttgtgaagatcaggccaaacagaggagatggcctatgcttcacaaaaacctggcggcagcgcaaaagatg

SEQ ID NO: 202980 - DNA, 103 bp, Artificial Sequence
  Synthetic Polynucleotide
taatacgactcactatagggatttaacatgttttagttcatttttgtgaaaacagaggagattcacaatgatgaactaaaacctggcggcagcgcaaaagatg

SEQ ID NO: 202981 - DNA, 103 bp, Artificial Sequence
  Synthetic Polynucleotide
taatacgactcactatagggtactgacaatatttaacatgttttagttcaaacagaggagatgaactatgacatgttaaaacctggcggcagcgcaaaagatg

SEQ ID NO: 202982 - DNA, 103 bp, Artificial Sequence
  Synthetic Polynucleotide
taatacgactcactataggggtcaaacgcatactgacaatatttaacatgaacagaggagacatgttatgtattgtcagaacctggcggcagcgcaaaagatg

SEQ ID NO: 202983 - DNA, 103 bp, Artificial Sequence
  Synthetic Polynucleotide
taatacgactcactatagggcacattttaagtcaaacgcatactgacaataacagaggagaattgtcatgatgcgtttgaacctggcggcagcgcaaaagatg

SEQ ID NO: 202984 - DNA, 103 bp, Artificial Sequence
  Synthetic Polynucleotide
taatacgactcactatagggcagacactatcacattttaagtcaaacgcaaacagaggagatgcgttatgcttaaaatgaacctggcggcagcgcaaaagatg

SEQ ID NO: 202985 - DNA, 103 bp, Artificial Sequence
  Synthetic Polynucleotide
taatacgactcactatagggtggattcacacagacactatcacattttaaaacagaggagattaaaaatggatagtgtcaacctggcggcagcgcaaaagatg

SEQ ID NO: 202986 - DNA, 103 bp, Artificial Sequence
  Synthetic Polynucleotide
taatacgactcactatagggcgtagtgatatggattcacacagacactataacagaggagaatagtgatggtgtgaatcaacctggcggcagcgcaaaagatg

SEQ ID NO: 202987 - DNA, 103 bp, Artificial Sequence
  Synthetic Polynucleotide
taatacgactcactatagggacaactcgttcgtagtgatatggattcacaaacagaggagatgtgaaatgatatcactaaacctggcggcagcgcaaaagatg

SEQ ID NO: 202988 - DNA, 103 bp, Artificial Sequence
  Synthetic Polynucleotide
taatacgactcactatagggcacaatgctcagacaggcatcattacttgtaacagaggagaacaagtatggatgcctgtaacctggcggcagcgcaaaagatg

SEQ ID NO: 202989 - DNA, 103 bp, Artificial Sequence
  Synthetic Polynucleotide
taatacgactcactatagggtccaggtgatacaactcgttcgtagtgataaacagaggagatatcacatggaacgagttaacctggcggcagcgcaaaagatg

SEQ ID NO: 202990 - DNA, 103 bp, Artificial Sequence
  Synthetic Polynucleotide
taatacgactcactatagggagagatcaattccaggtgatacaactcgttaacagaggagaaacgagatgtatcacctgaacctggcggcagcgcaaaagatg

SEQ ID NO: 202991 - DNA, 103 bp, Artificial Sequence
  Synthetic Polynucleotide
taatacgactcactataggggttaatcctgagagatcaattccaggtgataacagaggagaatcaccatgaattgatctaacctggcggcagcgcaaaagatg

SEQ ID NO: 202992 - DNA, 103 bp, Artificial Sequence
  Synthetic Polynucleotide
taatacgactcactatagggactctgcagtgttaatcctgagagatcaataacagaggagaattgatatgtcaggattaaacctggcggcagcgcaaaagatg

SEQ ID NO: 202993 - DNA, 103 bp, Artificial Sequence
  Synthetic Polynucleotide
taatacgactcactatagggatggagcattactctgcagtgttaatcctgaacagaggagacaggatatgcactgcagaaacctggcggcagcgcaaaagatg

SEQ ID NO: 202994 - DNA, 103 bp, Artificial Sequence
  Synthetic Polynucleotide
taatacgactcactatagggatcatacttgatggagcattactctgcagtaacagaggagaactgcaatgtaatgctccaacctggcggcagcgcaaaagatg

SEQ ID NO: 202995 - DNA, 103 bp, Artificial Sequence
  Synthetic Polynucleotide
taatacgactcactatagggatccttcaccatcatacttgatggagcattaacagaggagaaatgctatgtcaagtatgaacctggcggcagcgcaaaagatg

SEQ ID NO: 202996 - DNA, 103 bp, Artificial Sequence
  Synthetic Polynucleotide
taatacgactcactataggggcacatattcatccttcaccatcatacttgaacagaggagacaagtaatgtggtgaaggaacctggcggcagcgcaaaagatg

SEQ ID NO: 202997 - DNA, 103 bp, Artificial Sequence
  Synthetic Polynucleotide
taatacgactcactatagggtcaaagtcatgcacatattcatccttcaccaacagaggagaggtgaaatgtgaatatgtaacctggcggcagcgcaaaagatg

SEQ ID NO: 202998 - DNA, 103 bp, Artificial Sequence
  Synthetic Polynucleotide
taatacgactcactatagggtggctgtccctcaaagtcatgcacatattcaacagaggagagaatatatgcatgactttaacctggcggcagcgcaaaagatg

SEQ ID NO: 202999 - DNA, 103 bp, Artificial Sequence
  Synthetic Polynucleotide
taatacgactcactatagggtcaaactatgcacaatgctcagacaggcataacagaggagaatgcctatgtgagcattgaacctggcggcagcgcaaaagatg

SEQ ID NO: 203000 - DNA, 103 bp, Artificial Sequence
  Synthetic Polynucleotide
taatacgactcactatagggtggacaacgatggctgtccctcaaagtcataacagaggagaatgactatgagggacagcaacctggcggcagcgcaaaagatg

SEQ ID NO: 203001 - DNA, 103 bp, Artificial Sequence
  Synthetic Polynucleotide
taatacgactcactatagggtgtccttcagtggacaacgatggctgtcccaacagaggagagggacaatgatcgttgtcaacctggcggcagcgcaaaagatg

SEQ ID NO: 203002 - DNA, 103 bp, Artificial Sequence
  Synthetic Polynucleotide
taatacgactcactatagggttgaattgaatgtccttcagtggacaacgaaacagaggagatcgttgatgactgaaggaaacctggcggcagcgcaaaagatg

SEQ ID NO: 203003 - DNA, 103 bp, Artificial Sequence
  Synthetic Polynucleotide
taatacgactcactataggggctggatggtttgaattgaatgtccttcagaacagaggagactgaagatgattcaattcaacctggcggcagcgcaaaagatg

SEQ ID NO: 203004 - DNA, 103 bp, Artificial Sequence
  Synthetic Polynucleotide
taatacgactcactatagggcttggtggatgctggatggtttgaattgaaaacagaggagattcaatatgaaccatccaaacctggcggcagcgcaaaagatg

SEQ ID NO: 203005 - DNA, 103 bp, Artificial Sequence
  Synthetic Polynucleotide
taatacgactcactatagggtgcacgattacttggtggatgctggatggtaacagaggagaaccatcatgcatccaccaaacctggcggcagcgcaaaagatg

SEQ ID NO: 203006 - DNA, 103 bp, Artificial Sequence
  Synthetic Polynucleotide
taatacgactcactatagggtctctgtcgatgcacgattacttggtggataacagaggagaatccacatggtaatcgtgaacctggcggcagcgcaaaagatg

SEQ ID NO: 203007 - DNA, 103 bp, Artificial Sequence
  Synthetic Polynucleotide
taatacgactcactataggggtgctgtatgtctctgtcgatgcacgattaaacagaggagataatcgatgatcgacagaaacctggcggcagcgcaaaagatg

SEQ ID NO: 203008 - DNA, 103 bp, Artificial Sequence
  Synthetic Polynucleotide
taatacgactcactatagggcagagctggggtgctgtatgtctctgtcgaaacagaggagatcgacaatgacatacagcaacctggcggcagcgcaaaagatg

SEQ ID NO: 203009 - DNA, 103 bp, Artificial Sequence
  Synthetic Polynucleotide
taatacgactcactatagggatggggctaacagagctggggtgctgtatgaacagaggagacatacaatgccccagctcaacctggcggcagcgcaaaagatg

SEQ ID NO: 203010 - DNA, 103 bp, Artificial Sequence
  Synthetic Polynucleotide
taatacgactcactatagggctatggcacatcaaactatgcacaatgctcaacagaggagagagcatatggcatagtttaacctggcggcagcgcaaaagatg

SEQ ID NO: 203011 - DNA, 103 bp, Artificial Sequence
  Synthetic Polynucleotide
taatacgactcactatagggttagactcagatggggctaacagagctgggaacagaggagacccagcatggttagccccaacctggcggcagcgcaaaagatg

SEQ ID NO: 203012 - DNA, 103 bp, Artificial Sequence
  Synthetic Polynucleotide
taatacgactcactataggggctggtagcattagactcagatggggctaaaacagaggagattagccatgtctgagtctaacctggcggcagcgcaaaagatg

SEQ ID NO: 203013 - DNA, 103 bp, Artificial Sequence
  Synthetic Polynucleotide
taatacgactcactatagggagttggcagtgctggtagcattagactcagaacagaggagactgagtatgatgctaccaaacctggcggcagcgcaaaagatg

SEQ ID NO: 203014 - DNA, 103 bp, Artificial Sequence
  Synthetic Polynucleotide
taatacgactcactatagggatgttgggaaagttggcagtgctggtagcaaacagaggagatgctacatgcactgccaaaacctggcggcagcgcaaaagatg

SEQ ID NO: 203015 - DNA, 103 bp, Artificial Sequence
  Synthetic Polynucleotide
taatacgactcactatagggagccacaggaatgttgggaaagttggcagtaacagaggagaactgccatgtttcccaacaacctggcggcagcgcaaaagatg

SEQ ID NO: 203016 - DNA, 103 bp, Artificial Sequence
  Synthetic Polynucleotide
taatacgactcactataggggacttgtggaagccacaggaatgttgggaaaacagaggagattcccaatgttcctgtggaacctggcggcagcgcaaaagatg

SEQ ID NO: 203017 - DNA, 103 bp, Artificial Sequence
  Synthetic Polynucleotide
taatacgactcactatagggctggcaggctgacttgtggaagccacaggaaacagaggagatcctgtatgttccacaagaacctggcggcagcgcaaaagatg

SEQ ID NO: 203018 - DNA, 103 bp, Artificial Sequence
  Synthetic Polynucleotide
taatacgactcactatagggccccagtatactggcaggctgacttgtggaaacagaggagatccacaatgcagcctgccaacctggcggcagcgcaaaagatg

SEQ ID NO: 203019 - DNA, 103 bp, Artificial Sequence
  Synthetic Polynucleotide
taatacgactcactatagggtatggctgccccccagtatactggcaggctaacagaggagaagcctgatggtatactggaacctggcggcagcgcaaaagatg

SEQ ID NO: 203020 - DNA, 103 bp, Artificial Sequence
  Synthetic Polynucleotide
taatacgactcactatagggagtccttcactatggctgccccccagtataaacagaggagatatactatggggcagccaaacctggcggcagcgcaaaagatg

SEQ ID NO: 203021 - DNA, 103 bp, Artificial Sequence
  Synthetic Polynucleotide
taatacgactcactatagggtccaccttgtctatggcacatcaaactatgaacagaggagacatagtatgatgtgccataacctggcggcagcgcaaaagatg

SEQ ID NO: 203022 - DNA, 103 bp, Artificial Sequence
  Synthetic Polynucleotide
taatacgactcactatagggtatctgcaacagtccttcactatggctgccaacagaggagaggcagcatgagtgaaggaaacctggcggcagcgcaaaagatg

SEQ ID NO: 203023 - DNA, 103 bp, Artificial Sequence
  Synthetic Polynucleotide
taatacgactcactataggggccctgatgctatctgcaacagtccttcacaacagaggagagtgaagatgtgttgcagaaacctggcggcagcgcaaaagatg

SEQ ID NO: 203024 - DNA, 103 bp, Artificial Sequence
  Synthetic Polynucleotide
taatacgactcactatagggcctggctgaggccctgatgctatctgcaacaacagaggagagttgcaatgagcatcaggaacctggcggcagcgcaaaagatg

SEQ ID NO: 203025 - DNA, 103 bp, Artificial Sequence
  Synthetic Polynucleotide
taatacgactcactatagggctgctgctgtcctggctgaggccctgatgcaacagaggagagcatcaatgcctcagccaaacctggcggcagcgcaaaagatg

SEQ ID NO: 203026 - DNA, 103 bp, Artificial Sequence
  Synthetic Polynucleotide
taatacgactcactatagggtaaatccattctgctgctgtcctggctgagaacagaggagactcagcatggacagcagcaacctggcggcagcgcaaaagatg

SEQ ID NO: 203027 - DNA, 103 bp, Artificial Sequence
  Synthetic Polynucleotide
taatacgactcactatagggggctgaccagtaaatccattctgctgctgtaacagaggagaacagcaatggaatggattaacctggcggcagcgcaaaagatg

SEQ ID NO: 203028 - DNA, 103 bp, Artificial Sequence
  Synthetic Polynucleotide
taatacgactcactataggggtaagtagctggctgaccagtaaatccattaacagaggagaaatggaatgactggtcagaacctggcggcagcgcaaaagatg

SEQ ID NO: 203029 - DNA, 103 bp, Artificial Sequence
  Synthetic Polynucleotide
taatacgactcactatagggtgttatgatggtaagtagctggctgaccagaacagaggagactggtcatgcagctacttaacctggcggcagcgcaaaagatg

SEQ ID NO: 203030 - DNA, 103 bp, Artificial Sequence
  Synthetic Polynucleotide
taatacgactcactataggggtggtagtgctgttatgatggtaagtagctaacagaggagaagctacatgccatcataaaacctggcggcagcgcaaaagatg

SEQ ID NO: 203031 - DNA, 103 bp, Artificial Sequence
  Synthetic Polynucleotide
taatacgactcactatagggtccagtccaggtggtagtgctgttatgatgaacagaggagacatcatatgagcactaccaacctggcggcagcgcaaaagatg

SEQ ID NO: 203032 - DNA, 103 bp, Artificial Sequence
  Synthetic Polynucleotide
taatacgactcactatagggtttcactctctccaccttgtctatggcacaaacagaggagatgtgccatggacaaggtgaacctggcggcagcgcaaaagatg

SEQ ID NO: 203033 - DNA, 103 bp, Artificial Sequence
  Synthetic Polynucleotide
taatacgactcactatagggcagtcctacttccagtccaggtggtagtgcaacagaggagagcactaatgcctggactgaacctggcggcagcgcaaaagatg

SEQ ID NO: 203034 - DNA, 103 bp, Artificial Sequence
  Synthetic Polynucleotide
taatacgactcactataggggtgtatggtgcagtcctacttccagtccagaacagaggagactggacatgaagtaggacaacctggcggcagcgcaaaagatg

SEQ ID NO: 203035 - DNA, 103 bp, Artificial Sequence
  Synthetic Polynucleotide
taatacgactcactatagggcaaattaggtgtgtatggtgcagtcctactaacagaggagaagtaggatggcaccatacaacctggcggcagcgcaaaagatg

SEQ ID NO: 203036 - DNA, 103 bp, Artificial Sequence
  Synthetic Polynucleotide
taatacgactcactatagggggtggtgaggcaaattaggtgtgtatggtgaacagaggagacaccatatgcacctaattaacctggcggcagcgcaaaagatg

SEQ ID NO: 203037 - DNA, 103 bp, Artificial Sequence
  Synthetic Polynucleotide
taatacgactcactatagggtggccgttttggtggtgaggcaaattaggtaacagaggagaacctaaatggcctcaccaaacctggcggcagcgcaaaagatg

SEQ ID NO: 203038 - DNA, 103 bp, Artificial Sequence
  Synthetic Polynucleotide
taatacgactcactataggggtgctgaagatggccgttttggtggtgaggaacagaggagacctcacatgcaaaacggcaacctggcggcagcgcaaaagatg

SEQ ID NO: 203039 - DNA, 103 bp, Artificial Sequence
  Synthetic Polynucleotide
taatacgactcactatagggtaggcgggtggtgctgaagatggccgttttaacagaggagaaaaacgatgatcttcagcaacctggcggcagcgcaaaagatg

SEQ ID NO: 203040 - DNA, 103 bp, Artificial Sequence
  Synthetic Polynucleotide
taatacgactcactatagggtggggcggcataggcgggtggtgctgaagaaacagaggagatcttcaatgccacccgccaacctggcggcagcgcaaaagatg

SEQ ID NO: 203041 - DNA, 103 bp, Artificial Sequence
  Synthetic Polynucleotide
taatacgactcactatagggatgtccgggatggggcggcataggcgggtgaacagaggagacacccgatgatgccgcccaacctggcggcagcgcaaaagatg

SEQ ID NO: 203042 - DNA, 103 bp, Artificial Sequence
  Synthetic Polynucleotide
taatacgactcactatagggcaggccagtaatgtccgggatggggcggcaaacagaggagatgccgcatgatcccggacaacctggcggcagcgcaaaagatg

SEQ ID NO: 203043 - DNA, 103 bp, Artificial Sequence
  Synthetic Polynucleotide
taatacgactcactatagggtttgcaaatgtttcactctctccaccttgtaacagaggagaacaaggatgagagagtgaaacctggcggcagcgcaaaagatg

SEQ ID NO: 203044 - DNA, 103 bp, Artificial Sequence
  Synthetic Polynucleotide
taatacgactcactatagggtcattgtgaacaggccagtaatgtccgggaaacagaggagatcccggatgttactggccaacctggcggcagcgcaaaagatg

SEQ ID NO: 203045 - DNA, 103 bp, Artificial Sequence
  Synthetic Polynucleotide
taatacgactcactataggggaatgcaagctcattgtgaacaggccagtaaacagaggagatactggatggttcacaataacctggcggcagcgcaaaagatg

SEQ ID NO: 203046 - DNA, 103 bp, Artificial Sequence
  Synthetic Polynucleotide
taatacgactcactatagggtgggaggctggaatgcaagctcattgtgaaaacagaggagattcacaatgagcttgcataacctggcggcagcgcaaaagatg

SEQ ID NO: 203047 - DNA, 103 bp, Artificial Sequence
  Synthetic Polynucleotide
taatacgactcactatagggtgattggaaatgggaggctggaatgcaagcaacagaggagagcttgcatgccagcctccaacctggcggcagcgcaaaagatg

SEQ ID NO: 203048 - DNA, 103 bp, Artificial Sequence
  Synthetic Polynucleotide
taatacgactcactatagggaggagcaggatgattggaaatgggaggctgaacagaggagacagcctatgatttccaataacctggcggcagcgcaaaagatg

SEQ ID NO: 203049 - DNA, 103 bp, Artificial Sequence
  Synthetic Polynucleotide
taatacgactcactatagggaccaatactcaggagcaggatgattggaaaaacagaggagatttccaatgatcctgctcaacctggcggcagcgcaaaagatg

SEQ ID NO: 203050 - DNA, 103 bp, Artificial Sequence
  Synthetic Polynucleotide
taatacgactcactataggggcaatggaacaccaatactcaggagcaggaaacagaggagatcctgcatgtgagtattgaacctggcggcagcgcaaaagatg

SEQ ID NO: 203051 - DNA, 103 bp, Artificial Sequence
  Synthetic Polynucleotide
taatacgactcactatagggttcaaagtaagcaatggaacaccaatactcaacagaggagagagtatatgtgttccattaacctggcggcagcgcaaaagatg

SEQ ID NO: 203052 - DNA, 103 bp, Artificial Sequence
  Synthetic Polynucleotide
taatacgactcactataggggaacatccatttcaaagtaagcaatggaacaacagaggagagttccaatgcttactttgaacctggcggcagcgcaaaagatg

SEQ ID NO: 203053 - DNA, 103 bp, Artificial Sequence
  Synthetic Polynucleotide
taatacgactcactatagggtctcctacctgaacatccatttcaaagtaaaacagaggagattacttatgaatggatgtaacctggcggcagcgcaaaagatg

SEQ ID NO: 203054 - DNA, 103 bp, Artificial Sequence
  Synthetic Polynucleotide
taatacgactcactatagggaaaagaaaacaagctggccattgacgtcataacagaggagaatgacgatgatggccagcaacctggcggcagcgcaaaagatg

SEQ ID NO: 203055 - DNA, 103 bp, Artificial Sequence
  Synthetic Polynucleotide
taatacgactcactatagggcttcaccaaagcatcaactgccttttctgcaacagaggagagcagaaatggcagttgataacctggcggcagcgcaaaagatg

SEQ ID NO: 203056 - DNA, 103 bp, Artificial Sequence
  Synthetic Polynucleotide
taatacgactcactatagggaccaacatagtacagatgaacaccttttccaacagaggagaggaaaaatggttcatctgaacctggcggcagcgcaaaagatg

SEQ ID NO: 203057 - DNA, 103 bp, Artificial Sequence
  Synthetic Polynucleotide
taatacgactcactatagggacacctctccaccaacatagtacagatgaaaacagaggagattcatcatgactatgttgaacctggcggcagcgcaaaagatg

SEQ ID NO: 203058 - DNA, 103 bp, Artificial Sequence
  Synthetic Polynucleotide
taatacgactcactatagggcattccgcatacacctctccaccaacatagaacagaggagactatgtatgtggagaggtaacctggcggcagcgcaaaagatg

SEQ ID NO: 203059 - DNA, 103 bp, Artificial Sequence
  Synthetic Polynucleotide
taatacgactcactataggggtcactgaggcattccgcatacacctctccaacagaggagaggagagatgtatgcggaaaacctggcggcagcgcaaaagatg

SEQ ID NO: 203060 - DNA, 103 bp, Artificial Sequence
  Synthetic Polynucleotide
taatacgactcactatagggatatgctgctgtcactgaggcattccgcataacagaggagaatgcggatggcctcagtgaacctggcggcagcgcaaaagatg

SEQ ID NO: 203061 - DNA, 103 bp, Artificial Sequence
  Synthetic Polynucleotide
taatacgactcactatagggctctgtacaaatatgctgctgtcactgaggaacagaggagacctcagatgcagcagcataacctggcggcagcgcaaaagatg

SEQ ID NO: 203062 - DNA, 103 bp, Artificial Sequence
  Synthetic Polynucleotide
taatacgactcactataggggcagttcctactctgtacaaatatgctgctaacagaggagaagcagcatgtttgtacagaacctggcggcagcgcaaaagatg

SEQ ID NO: 203063 - DNA, 103 bp, Artificial Sequence
  Synthetic Polynucleotide
taatacgactcactataggggatgaaagttgcagttcctactctgtacaaaacagaggagattgtacatggtaggaactaacctggcggcagcgcaaaagatg

SEQ ID NO: 203064 - DNA, 103 bp, Artificial Sequence
  Synthetic Polynucleotide
taatacgactcactatagggtgaaagccatgatgaaagttgcagttcctaaacagaggagataggaaatgcaactttcaaacctggcggcagcgcaaaagatg

SEQ ID NO: 203065 - DNA, 103 bp, Artificial Sequence
  Synthetic Polynucleotide
taatacgactcactatagggagtggtgggatgaaagccatgatgaaagttaacagaggagaaactttatgcatggctttaacctggcggcagcgcaaaagatg

SEQ ID NO: 203066 - DNA, 103 bp, Artificial Sequence
  Synthetic Polynucleotide
taatacgactcactatagggtttttagtttcttcaccaaagcatcaactgaacagaggagacagttgatgctttggtgaaacctggcggcagcgcaaaagatg

SEQ ID NO: 203067 - DNA, 103 bp, Artificial Sequence
  Synthetic Polynucleotide
taatacgactcactatagggtcttacagacagtggtgggatgaaagccataacagaggagaatggctatgatcccaccaaacctggcggcagcgcaaaagatg

SEQ ID NO: 203068 - DNA, 103 bp, Artificial Sequence
  Synthetic Polynucleotide
taatacgactcactatagggctgctgggaatcttacagacagtggtgggaaacagaggagatcccacatgtgtctgtaaaacctggcggcagcgcaaaagatg

SEQ ID NO: 203069 - DNA, 103 bp, Artificial Sequence
  Synthetic Polynucleotide
taatacgactcactataggggaggctgcagctgctgggaatcttacagacaacagaggagagtctgtatgattcccagcaacctggcggcagcgcaaaagatg

SEQ ID NO: 203070 - DNA, 103 bp, Artificial Sequence
  Synthetic Polynucleotide
taatacgactcactatagggtaaaaattttgaggctgcagctgctgggaaaacagaggagattcccaatggctgcagccaacctggcggcagcgcaaaagatg

SEQ ID NO: 203071 - DNA, 103 bp, Artificial Sequence
  Synthetic Polynucleotide
taatacgactcactatagggtcctgattgttaaaaattttgaggctgcagaacagaggagactgcagatgcaaaattttaacctggcggcagcgcaaaagatg

SEQ ID NO: 203072 - DNA, 103 bp, Artificial Sequence
  Synthetic Polynucleotide
taatacgactcactatagggctgagcaaactcctgattgttaaaaattttaacagaggagaaaaattatgaacaatcagaacctggcggcagcgcaaaagatg

SEQ ID NO: 203073 - DNA, 103 bp, Artificial Sequence
  Synthetic Polynucleotide
taatacgactcactataggggagccagaagctgagcaaactcctgattgtaacagaggagaacaatcatgagtttgctcaacctggcggcagcgcaaaagatg

SEQ ID NO: 203074 - DNA, 103 bp, Artificial Sequence
  Synthetic Polynucleotide
taatacgactcactatagggttgacagattgagccagaagctgagcaaacaacagaggagagtttgcatggcttctggcaacctggcggcagcgcaaaagatg

SEQ ID NO: 203075 - DNA, 103 bp, Artificial Sequence
  Synthetic Polynucleotide
taatacgactcactatagggaaacccatggttgacagattgagccagaagaacagaggagacttctgatgcaatctgtcaacctggcggcagcgcaaaagatg

SEQ ID NO: 203076 - DNA, 103 bp, Artificial Sequence
  Synthetic Polynucleotide
taatacgactcactatagggatactgcctcaaacccatggttgacagattaacagaggagaaatctgatgaccatgggtaacctggcggcagcgcaaaagatg

SEQ ID NO: 203077 - DNA, 103 bp, Artificial Sequence
  Synthetic Polynucleotide
taatacgactcactatagggccctttttcttttttagtttcttcaccaaaaacagaggagatttggtatggaaactaaaaacctggcggcagcgcaaaagatg

SEQ ID NO: 203078 - DNA, 103 bp, Artificial Sequence
  Synthetic Polynucleotide
taatacgactcactataggggtgagctcatatactgcctcaaacccatggaacagaggagaccatggatgtgaggcagtaacctggcggcagcgcaaaagatg

SEQ ID NO: 203079 - DNA, 103 bp, Artificial Sequence
  Synthetic Polynucleotide
taatacgactcactatagggacacattttggtgagctcatatactgcctcaacagaggagagaggcaatgtatgagctcaacctggcggcagcgcaaaagatg

SEQ ID NO: 203080 - DNA, 103 bp, Artificial Sequence
  Synthetic Polynucleotide
taatacgactcactatagggtccgaatggtacacattttggtgagctcataacagaggagaatgagcatgccaaaatgtaacctggcggcagcgcaaaagatg

SEQ ID NO: 203081 - DNA, 103 bp, Artificial Sequence
  Synthetic Polynucleotide
taatacgactcactatagggacaaaactcatccgaatggtacacattttgaacagaggagacaaaatatgtaccattcgaacctggcggcagcgcaaaagatg

SEQ ID NO: 203082 - DNA, 103 bp, Artificial Sequence
  Synthetic Polynucleotide
taatacgactcactatagggccaacccttgacaaaactcatccgaatggtaacagaggagaaccattatgatgagttttaacctggcggcagcgcaaaagatg

SEQ ID NO: 203083 - DNA, 103 bp, Artificial Sequence
  Synthetic Polynucleotide
taatacgactcactatagggattctgctccccaacccttgacaaaactcaaacagaggagatgagttatgtcaagggttaacctggcggcagcgcaaaagatg

SEQ ID NO: 203084 - DNA, 103 bp, Artificial Sequence
  Synthetic Polynucleotide
taatacgactcactatagggtgccggtgatattctgctccccaacccttgaacagaggagacaagggatggggagcagaaacctggcggcagcgcaaaagatg

SEQ ID NO: 203085 - DNA, 103 bp, Artificial Sequence
  Synthetic Polynucleotide
taatacgactcactatagggggttacatcctgccggtgatattctgctccaacagaggagaggagcaatgtatcaccggaacctggcggcagcgcaaaagatg

SEQ ID NO: 203086 - DNA, 103 bp, Artificial Sequence
  Synthetic Polynucleotide
taatacgactcactatagggatggggtgctggttacatcctgccggtgataacagaggagaatcaccatgaggatgtaaaacctggcggcagcgcaaaagatg

SEQ ID NO: 203087 - DNA, 103 bp, Artificial Sequence
  Synthetic Polynucleotide
taatacgactcactatagggtcaatccaacatggggtgctggttacatccaacagaggagaggatgtatgcagcaccccaacctggcggcagcgcaaaagatg

SEQ ID NO: 203088 - DNA, 103 bp, Artificial Sequence
  Synthetic Polynucleotide
taatacgactcactatagggctccatggcaccctttttcttttttagtttaacagaggagaaaactaatgaagaaaaagaacctggcggcagcgcaaaagatg

SEQ ID NO: 203089 - DNA, 103 bp, Artificial Sequence
  Synthetic Polynucleotide
taatacgactcactatagggaagatgaatctcaatccaacatggggtgctaacagaggagaagcaccatgtgttggattaacctggcggcagcgcaaaagatg

SEQ ID NO: 203090 - DNA, 103 bp, Artificial Sequence
  Synthetic Polynucleotide
taatacgactcactataggggaggcccatgaagatgaatctcaatccaacaacagaggagagttggaatgagattcatcaacctggcggcagcgcaaaagatg

SEQ ID NO: 203091 - DNA, 103 bp, Artificial Sequence
  Synthetic Polynucleotide
taatacgactcactatagggagccactgaagaggcccatgaagatgaatcaacagaggagagattcaatgtcatgggccaacctggcggcagcgcaaaagatg

SEQ ID NO: 203092 - DNA, 103 bp, Artificial Sequence
  Synthetic Polynucleotide
taatacgactcactataggggactttatccagccactgaagaggcccatgaacagaggagacatgggatgcttcagtggaacctggcggcagcgcaaaagatg

SEQ ID NO: 203093 - DNA, 103 bp, Artificial Sequence
  Synthetic Polynucleotide
taatacgactcactatagggtctgagtaaggactttatccagccactgaaaacagaggagattcagtatgtggataaagaacctggcggcagcgcaaaagatg

SEQ ID NO: 203094 - DNA, 103 bp, Artificial Sequence
  Synthetic Polynucleotide
taatacgactcactatagggggggagcccatctgagtaaggactttatccaacagaggagaggataaatgccttactcaaacctggcggcagcgcaaaagatg

SEQ ID NO: 203095 - DNA, 103 bp, Artificial Sequence
  Synthetic Polynucleotide
taatacgactcactatagggggggttcagaggggagcccatctgagtaagaacagaggagacttactatgatgggctccaacctggcggcagcgcaaaagatg

SEQ ID NO: 203096 - DNA, 103 bp, Artificial Sequence
  Synthetic Polynucleotide
taatacgactcactatagggcagaagatatggggttcagaggggagcccaaacagaggagatgggctatgctctgaaccaacctggcggcagcgcaaaagatg

SEQ ID NO: 203097 - DNA, 103 bp, Artificial Sequence
  Synthetic Polynucleotide
taatacgactcactatagggtctccagttcctccatggcaccctttttctaacagaggagaagaaaaatggtgccatggaacctggcggcagcgcaaaagatg

SEQ ID NO: 203098 - DNA, 103 bp, Artificial Sequence
  Synthetic Polynucleotide
taatacgactcactatagggctcaaggctttctccagttcctccatggcaaacagaggagatgccatatgggaactggaaacctggcggcagcgcaaaagatg

SEQ ID NO: 203099 - DNA, 103 bp, Artificial Sequence
  Synthetic Polynucleotide
taatacgactcactatagggtcctggactgctcaaggctttctccagttcaacagaggagagaactgatgaaagccttgaacctggcggcagcgcaaaagatg

SEQ ID NO: 203100 - DNA, 103 bp, Artificial Sequence
  Synthetic Polynucleotide
taatacgactcactatagggtactcggctgtcctggactgctcaaggcttaacagaggagaaagcctatggcagtccagaacctggcggcagcgcaaaagatg

SEQ ID NO: 203101 - DNA, 103 bp, Artificial Sequence
  Synthetic Polynucleotide
taatacgactcactataggggtgacacatttactcggctgtcctggactgaacagaggagacagtccatgacagccgagaacctggcggcagcgcaaaagatg

SEQ ID NO: 203102 - DNA, 103 bp, Artificial Sequence
  Synthetic Polynucleotide
taatacgactcactatagggtctgggaatagtgacacatttactcggctgaacagaggagacagccgatgaaatgtgtcaacctggcggcagcgcaaaagatg

SEQ ID NO: 203103 - DNA, 103 bp, Artificial Sequence
  Synthetic Polynucleotide
taatacgactcactatagggctggactagtaaaagaaaacaagctggccaaacagaggagatggccaatgtgttttcttaacctggcggcagcgcaaaagatg

SEQ ID NO: 203104 - DNA, 103 bp, Artificial Sequence
  Synthetic Polynucleotide
taatacgactcactatagggcatctaaagatctgggaatagtgacacattaacagaggagaaatgtgatgctattcccaaacctggcggcagcgcaaaagatg

SEQ ID NO: 203105 - DNA, 103 bp, Artificial Sequence
  Synthetic Polynucleotide
taatacgactcactatagggtgcaggcgtccatctaaagatctgggaataaacagaggagatattccatgatctttagaaacctggcggcagcgcaaaagatg

SEQ ID NO: 203106 - DNA, 103 bp, Artificial Sequence
  Synthetic Polynucleotide
taatacgactcactataggggtgagaaacctgcaggcgtccatctaaagaaacagaggagatctttaatgggacgcctgaacctggcggcagcgcaaaagatg

SEQ ID NO: 203107 - DNA, 103 bp, Artificial Sequence
  Synthetic Polynucleotide
taatacgactcactatagggagccttttctgtgagaaacctgcaggcgtcaacagaggagagacgccatgaggtttctcaacctggcggcagcgcaaaagatg

SEQ ID NO: 203108 - DNA, 103 bp, Artificial Sequence
  Synthetic Polynucleotide
taatacgactcactatagggacatggggtaagccttttctgtgagaaaccaacagaggagaggtttcatgcagaaaaggaacctggcggcagcgcaaaagatg

SEQ ID NO: 203109 - DNA, 103 bp, Artificial Sequence
  Synthetic Polynucleotide
taatacgactcactatagggacaatatataacatggggtaagccttttctaacagaggagaagaaaaatgttaccccataacctggcggcagcgcaaaagatg

SEQ ID NO: 203110 - DNA, 103 bp, Artificial Sequence
  Synthetic Polynucleotide
taatacgactcactataggggccaaacacgacaatatataacatggggtaaacagaggagataccccatgttatatattaacctggcggcagcgcaaaagatg

SEQ ID NO: 203111 - DNA, 103 bp, Artificial Sequence
  Synthetic Polynucleotide
taatacgactcactatagggtccggccagcgccaaacacgacaatatataaacagaggagatatataatgtcgtgtttgaacctggcggcagcgcaaaagatg

SEQ ID NO: 203112 - DNA, 103 bp, Artificial Sequence
  Synthetic Polynucleotide
taatacgactcactatagggactctgcaaatccggccagcgccaaacacgaacagaggagacgtgttatgcgctggccgaacctggcggcagcgcaaaagatg

SEQ ID NO: 203113 - DNA, 103 bp, Artificial Sequence
  Synthetic Polynucleotide
taatacgactcactataggggctcatgatgactctgcaaatccggccagcaacagaggagagctggcatgatttgcagaaacctggcggcagcgcaaaagatg

SEQ ID NO: 203114 - DNA, 103 bp, Artificial Sequence
  Synthetic Polynucleotide
taatacgactcactatagggcgctttactgctggactagtaaaagaaaacaacagaggagagttttcatgtactagtccaacctggcggcagcgcaaaagatg

SEQ ID NO: 203115 - DNA, 103 bp, Artificial Sequence
  Synthetic Polynucleotide
taatacgactcactatagggaacggctttagctcatgatgactctgcaaaaacagaggagatttgcaatgtcatcatgaaacctggcggcagcgcaaaagatg

SEQ ID NO: 203116 - DNA, 103 bp, Artificial Sequence
  Synthetic Polynucleotide
taatacgactcactatagggacaaatatccaacggctttagctcatgatgaacagaggagacatcatatgctaaagccgaacctggcggcagcgcaaaagatg

SEQ ID NO: 203117 - DNA, 103 bp, Artificial Sequence
  Synthetic Polynucleotide
taatacgactcactatagggaaggaaattcacaaatatccaacggctttaaacagaggagataaagcatgtggatatttaacctggcggcagcgcaaaagatg

SEQ ID NO: 203118 - DNA, 103 bp, Artificial Sequence
  Synthetic Polynucleotide
taatacgactcactatagggttagatccaaaaggaaattcacaaatatccaacagaggagaggatatatgtgaatttccaacctggcggcagcgcaaaagatg

SEQ ID NO: 203119 - DNA, 103 bp, Artificial Sequence
  Synthetic Polynucleotide
taatacgactcactatagggttctttttgcttagatccaaaaggaaattcaacagaggagagaatttatgtttggatctaacctggcggcagcgcaaaagatg

SEQ ID NO: 203120 - DNA, 103 bp, Artificial Sequence
  Synthetic Polynucleotide
taatacgactcactatagggtgatacaaacttctttttgcttagatccaaaacagaggagattggatatgagcaaaaagaacctggcggcagcgcaaaagatg

SEQ ID NO: 203121 - DNA, 103 bp, Artificial Sequence
  Synthetic Polynucleotide
taatacgactcactatagggtggtatgggttgatacaaacttctttttgcaacagaggagagcaaaaatgagtttgtataacctggcggcagcgcaaaagatg

SEQ ID NO: 203122 - DNA, 103 bp, Artificial Sequence
  Synthetic Polynucleotide
taatacgactcactatagggtctcttatagtggtatgggttgatacaaacaacagaggagagtttgtatgaacccatacaacctggcggcagcgcaaaagatg

SEQ ID NO: 203123 - DNA, 103 bp, Artificial Sequence
  Synthetic Polynucleotide
taatacgactcactataggggactctccactctcttatagtggtatgggtaacagaggagaacccatatgactataagaaacctggcggcagcgcaaaagatg

SEQ ID NO: 203124 - DNA, 103 bp, Artificial Sequence
  Synthetic Polynucleotide
taatacgactcactatagggggtaagactggactctccactctcttatagaacagaggagactataaatgagtggagagaacctggcggcagcgcaaaagatg

SEQ ID NO: 203125 - DNA, 103 bp, Artificial Sequence
  Synthetic Polynucleotide
taatacgactcactataggggcccaacaatcgctttactgctggactagtaacagaggagaactagtatggcagtaaagaacctggcggcagcgcaaaagatg

SEQ ID NO: 203126 - DNA, 103 bp, Artificial Sequence
  Synthetic Polynucleotide
taatacgactcactatagggtaatactggaggtaagactggactctccacaacagaggagagtggagatgccagtcttaaacctggcggcagcgcaaaagatg

SEQ ID NO: 203127 - DNA, 103 bp, Artificial Sequence
  Synthetic Polynucleotide
taatacgactcactataggggacgaggcactaatactggaggtaagactgaacagaggagacagtctatgctccagtataacctggcggcagcgcaaaagatg

SEQ ID NO: 203128 - DNA, 103 bp, Artificial Sequence
  Synthetic Polynucleotide
taatacgactcactatagggaattcattatgacgaggcactaatactggaaacagaggagatccagtatgagtgcctcgaacctggcggcagcgcaaaagatg

SEQ ID NO: 203129 - DNA, 103 bp, Artificial Sequence
  Synthetic Polynucleotide
taatacgactcactatagggttgtggattgaattcattatgacgaggcacaacagaggagagtgcctatgcataatgaaaacctggcggcagcgcaaaagatg

SEQ ID NO: 203130 - DNA, 103 bp, Artificial Sequence
  Synthetic Polynucleotide
taatacgactcactataggggaaggctgtgttgtggattgaattcattataacagaggagaataatgatgtcaatccacaacctggcggcagcgcaaaagatg

SEQ ID NO: 203131 - DNA, 103 bp, Artificial Sequence
  Synthetic Polynucleotide
taatacgactcactatagggaactgaaccagaaggctgtgttgtggattgaacagaggagacaatccatgacacagcctaacctggcggcagcgcaaaagatg

SEQ ID NO: 203132 - DNA, 103 bp, Artificial Sequence
  Synthetic Polynucleotide
taatacgactcactatagggcaggttcctaaactgaaccagaaggctgtgaacagaggagacacagcatgctggttcagaacctggcggcagcgcaaaagatg

SEQ ID NO: 203133 - DNA, 103 bp, Artificial Sequence
  Synthetic Polynucleotide
taatacgactcactatagggcattgtggctcaggttcctaaactgaaccaaacagaggagatggttcatgttaggaaccaacctggcggcagcgcaaaagatg

SEQ ID NO: 203134 - DNA, 103 bp, Artificial Sequence
  Synthetic Polynucleotide
taatacgactcactatagggatgtgtggttcattgtggctcaggttcctaaacagaggagataggaaatggagccacaaaacctggcggcagcgcaaaagatg

SEQ ID NO: 203135 - DNA, 103 bp, Artificial Sequence
  Synthetic Polynucleotide
taatacgactcactatagggattttgtggcatgtgtggttcattgtggctaacagaggagaagccacatggaaccacacaacctggcggcagcgcaaaagatg

SEQ ID NO: 203136 - DNA, 103 bp, Artificial Sequence
  Synthetic Polynucleotide
taatacgactcactatagggcttgtttccagcccaacaatcgctttactgaacagaggagacagtaaatggattgttggaacctggcggcagcgcaaaagatg

SEQ ID NO: 203137 - DNA, 103 bp, Artificial Sequence
  Synthetic Polynucleotide
taatacgactcactataggggaaacgtggcattttgtggcatgtgtggttaacagaggagaaaccacatgtgccacaaaaacctggcggcagcgcaaaagatg

SEQ ID NO: 203138 - DNA, 103 bp, Artificial Sequence
  Synthetic Polynucleotide
taatacgactcactatagggaaagaatctggaaacgtggcattttgtggcaacagaggagagccacaatgtgccacgttaacctggcggcagcgcaaaagatg

SEQ ID NO: 203139 - DNA, 103 bp, Artificial Sequence
  Synthetic Polynucleotide
taatacgactcactataggggggctggtggaaagaatctggaaacgtggcaacagaggagagccacgatgccagattctaacctggcggcagcgcaaaagatg

SEQ ID NO: 203140 - DNA, 103 bp, Artificial Sequence
  Synthetic Polynucleotide
taatacgactcactataggggagtgttgttgggctggtggaaagaatctgaacagaggagacagattatgtccaccagcaacctggcggcagcgcaaaagatg

SEQ ID NO: 203141 - DNA, 103 bp, Artificial Sequence
  Synthetic Polynucleotide
taatacgactcactatagggaagggaaaaggagtgttgttgggctggtggaacagaggagaccaccaatgcaacaacacaacctggcggcagcgcaaaagatg

SEQ ID NO: 203142 - DNA, 103 bp, Artificial Sequence
  Synthetic Polynucleotide
taatacgactcactataggggtttggagataagggaaaaggagtgttgttaacagaggagaaacaacatgccttttcccaacctggcggcagcgcaaaagatg

SEQ ID NO: 203143 - DNA, 103 bp, Artificial Sequence
  Synthetic Polynucleotide
taatacgactcactataggggataagggctgtttggagataagggaaaagaacagaggagacttttcatgtatctccaaaacctggcggcagcgcaaaagatg

SEQ ID NO: 203144 - DNA, 103 bp, Artificial Sequence
  Synthetic Polynucleotide
taatacgactcactatagggggagaagggggataagggctgtttggagataacagaggagaatctccatgcagcccttaaacctggcggcagcgcaaaagatg

SEQ ID NO: 203145 - DNA, 103 bp, Artificial Sequence
  Synthetic Polynucleotide
taatacgactcactataggggctgctagcaggagaagggggataagggctaacagaggagaagccctatgcccccttctaacctggcggcagcgcaaaagatg

SEQ ID NO: 203146 - DNA, 103 bp, Artificial Sequence
  Synthetic Polynucleotide
taatacgactcactatagggtgggatatgtgctgctagcaggagaaggggaacagaggagaccccttatgctgctagcaaacctggcggcagcgcaaaagatg

SEQ ID NO: 203147 - DNA, 103 bp, Artificial Sequence
  Synthetic Polynucleotide
taatacgactcactatagggtcctcatcaccttgtttccagcccaacaataacagaggagaattgttatgctggaaacaaacctggcggcagcgcaaaagatg

SEQ ID NO: 203148 - DNA, 103 bp, Artificial Sequence
  Synthetic Polynucleotide
taatacgactcactataggggctggggagttgggatatgtgctgctagcaaacagaggagatgctagatgcacatatccaacctggcggcagcgcaaaagatg

SEQ ID NO: 203149 - DNA, 103 bp, Artificial Sequence
  Synthetic Polynucleotide
taatacgactcactatagggtccagaacttgctggggagttgggatatgtaacagaggagaacatatatgaactccccaaacctggcggcagcgcaaaagatg

SEQ ID NO: 203150 - DNA, 103 bp, Artificial Sequence
  Synthetic Polynucleotide
taatacgactcactataggggacttcctggtccagaacttgctggggagtaacagaggagaactcccatgcaagttctgaacctggcggcagcgcaaaagatg

SEQ ID NO: 203151 - DNA, 103 bp, Artificial Sequence
  Synthetic Polynucleotide
taatacgactcactatagggagctgaaatggacttcctggtccagaacttaacagaggagaaagttcatgaccaggaagaacctggcggcagcgcaaaagatg

SEQ ID NO: 203152 - DNA, 103 bp, Artificial Sequence
  Synthetic Polynucleotide
taatacgactcactatagggatcagctgggagctgaaatggacttcctggaacagaggagaccaggaatgccatttcagaacctggcggcagcgcaaaagatg

SEQ ID NO: 203153 - DNA, 103 bp, Artificial Sequence
  Synthetic Polynucleotide
taatacgactcactataggggaggaggcgtatcagctgggagctgaaatgaacagaggagacatttcatgtcccagctgaacctggcggcagcgcaaaagatg

SEQ ID NO: 203154 - DNA, 103 bp, Artificial Sequence
  Synthetic Polynucleotide
taatacgactcactatagggatataggcaggaggaggcgtatcagctgggaacagaggagacccagcatgtacgcctccaacctggcggcagcgcaaaagatg

SEQ ID NO: 203155 - DNA, 103 bp, Artificial Sequence
  Synthetic Polynucleotide
taatacgactcactatagggatcaggtggcatataggcaggaggaggcgtaacagaggagaacgcctatgcctgcctataacctggcggcagcgcaaaagatg

SEQ ID NO: 203156 - DNA, 103 bp, Artificial Sequence
  Synthetic Polynucleotide
taatacgactcactatagggccatctgatcatcaggtggcatataggcagaacagaggagactgcctatgtgccacctgaacctggcggcagcgcaaaagatg

SEQ ID NO: 203157 - DNA, 103 bp, Artificial Sequence
  Synthetic Polynucleotide
taatacgactcactatagggttatcttgacccatctgatcatcaggtggcaacagaggagagccaccatgtgatcagataacctggcggcagcgcaaaagatg

SEQ ID NO: 203158 - DNA, 103 bp, Artificial Sequence
  Synthetic Polynucleotide
taatacgactcactatagggccatttctcctcctcatcaccttgtttccaaacagaggagatggaaaatgggtgatgagaacctggcggcagcgcaaaagatg

SEQ ID NO: 203159 - DNA, 103 bp, Artificial Sequence
  Synthetic Polynucleotide
taatacgactcactatagggaggctgggaattatcttgacccatctgatcaacagaggagagatcagatgggtcaagataacctggcggcagcgcaaaagatg

SEQ ID NO: 203160 - DNA, 103 bp, Artificial Sequence
  Synthetic Polynucleotide
taatacgactcactatagggttgtatccataggctgggaattatcttgacaacagaggagagtcaagatgattcccagcaacctggcggcagcgcaaaagatg

SEQ ID NO: 203161 - DNA, 103 bp, Artificial Sequence
  Synthetic Polynucleotide
taatacgactcactatagggatattattgcttgtatccataggctgggaaaacagaggagattcccaatgtatggatacaacctggcggcagcgcaaaagatg

SEQ ID NO: 203162 - DNA, 103 bp, Artificial Sequence
  Synthetic Polynucleotide
taatacgactcactatagggctgaggaatcatattattgcttgtatccataacagaggagaatggatatgagcaataataacctggcggcagcgcaaaagatg

SEQ ID NO: 203163 - DNA, 103 bp, Artificial Sequence
  Synthetic Polynucleotide
taatacgactcactatagggtgggcataatctgaggaatcatattattgcaacagaggagagcaataatgtgattcctcaacctggcggcagcgcaaaagatg

SEQ ID NO: 203164 - DNA, 103 bp, Artificial Sequence
  Synthetic Polynucleotide
taatacgactcactatagggctggatatactgggcataatctgaggaatcaacagaggagagattccatggattatgccaacctggcggcagcgcaaaagatg

SEQ ID NO: 203165 - DNA, 103 bp, Artificial Sequence
  Synthetic Polynucleotide
taatacgactcactatagggaacatccctgctggatatactgggcataataacagaggagaattatgatgagtatatccaacctggcggcagcgcaaaagatg

SEQ ID NO: 203166 - DNA, 103 bp, Artificial Sequence
  Synthetic Polynucleotide
taatacgactcactatagggcaacaggctgaacatccctgctggatatacaacagaggagagtatatatggcagggatgaacctggcggcagcgcaaaagatg

SEQ ID NO: 203167 - DNA, 103 bp, Artificial Sequence
  Synthetic Polynucleotide
taatacgactcactatagggtcttcataggcaacaggctgaacatccctgaacagaggagacagggaatgtcagcctgtaacctggcggcagcgcaaaagatg

SEQ ID NO: 203168 - DNA, 103 bp, Artificial Sequence
  Synthetic Polynucleotide
taatacgactcactatagggatgtttaggctcttcataggcaacaggctgaacagaggagacagcctatggcctatgaaaacctggcggcagcgcaaaagatg

SEQ ID NO: 203169 - DNA, 103 bp, Artificial Sequence
  Synthetic Polynucleotide
taatacgactcactatagggccttttctgcccatttctcctcctcatcacaacagaggagagtgatgatgaggagaaataacctggcggcagcgcaaaagatg

SEQ ID NO: 203170 - DNA, 103 bp, Artificial Sequence
  Synthetic Polynucleotide
taatacgactcactatagggttgaacaccaatgtttaggctcttcataggaacagaggagacctatgatgagcctaaacaacctggcggcagcgcaaaagatg

SEQ ID NO: 203171 - DNA, 103 bp, Artificial Sequence
  Synthetic Polynucleotide
taatacgactcactatagggtagtagactattgaacaccaatgtttaggcaacagaggagagcctaaatgttggtgttcaacctggcggcagcgcaaaagatg

SEQ ID NO: 203172 - DNA, 103 bp, Artificial Sequence
  Synthetic Polynucleotide
taatacgactcactataggggtttaattcatagtagactattgaacaccaaacagaggagatggtgtatgatagtctacaacctggcggcagcgcaaaagatg

SEQ ID NO: 203173 - DNA, 103 bp, Artificial Sequence
  Synthetic Polynucleotide
taatacgactcactatagggcaacacgattgtttaattcatagtagactaaacagaggagatagtctatgatgaattaaaacctggcggcagcgcaaaagatg

SEQ ID NO: 203174 - DNA, 103 bp, Artificial Sequence
  Synthetic Polynucleotide
taatacgactcactatagggaaagcttctccaacacgattgtttaattcaaacagaggagatgaattatgcaatcgtgtaacctggcggcagcgcaaaagatg

SEQ ID NO: 203175 - DNA, 103 bp, Artificial Sequence
  Synthetic Polynucleotide
taatacgactcactatagggagatgcatgaaaagcttctccaacacgattaacagaggagaaatcgtatgggagaagctaacctggcggcagcgcaaaagatg

SEQ ID NO: 203176 - DNA, 103 bp, Artificial Sequence
  Synthetic Polynucleotide
taatacgactcactatagggcactagtagaagatgcatgaaaagcttctcaacagaggagagagaagatgttcatgcataacctggcggcagcgcaaaagatg

SEQ ID NO: 203177 - DNA, 103 bp, Artificial Sequence
  Synthetic Polynucleotide
taatacgactcactatagggtctactaacacactagtagaagatgcatgaaacagaggagatcatgcatgttctactagaacctggcggcagcgcaaaagatg

SEQ ID NO: 203178 - DNA, 103 bp, Artificial Sequence
  Synthetic Polynucleotide
taatacgactcactatagggtgtgaatccatctactaacacactagtagaaacagaggagatctactatggtgttagtaaacctggcggcagcgcaaaagatg

SEQ ID NO: 203179 - DNA, 103 bp, Artificial Sequence
  Synthetic Polynucleotide
taatacgactcactatagggttgaaggatctgtgaatccatctactaacaaacagaggagatgttagatgatggattcaaacctggcggcagcgcaaaagatg

SEQ ID NO: 203180 - DNA, 103 bp, Artificial Sequence
  Synthetic Polynucleotide
taatacgactcactataggggcatcaactgccttttctgcccatttctccaacagaggagaggagaaatgggcagaaaaaacctggcggcagcgcaaaagatg

SEQ ID NO: 203181 - DNA, 103 bp, Artificial Sequence
  Synthetic Polynucleotide
taatacgactcactatagggcttttgttatttgaaggatctgtgaatccaaacagaggagatggattatgagatccttcaacctggcggcagcgcaaaagatg

SEQ ID NO: 203182 - DNA, 103 bp, Artificial Sequence
  Synthetic Polynucleotide
taatacgactcactataggggcagaatctacttttgttatttgaaggatcaacagaggagagatcctatgaataacaaaaacctggcggcagcgcaaaagatg

SEQ ID NO: 203183 - DNA, 103 bp, Artificial Sequence
  Synthetic Polynucleotide
taatacgactcactatagggacaaacccaagcagaatctacttttgttataacagaggagaataacaatggtagattctaacctggcggcagcgcaaaagatg

SEQ ID NO: 203184 - DNA, 103 bp, Artificial Sequence
  Synthetic Polynucleotide
taatacgactcactatagggacatttgacaacaaacccaagcagaatctaaacagaggagatagattatgcttgggtttaacctggcggcagcgcaaaagatg

SEQ ID NO: 203185 - DNA, 103 bp, Artificial Sequence
  Synthetic Polynucleotide
taatacgactcactatagggattacgattaacatttgacaacaaacccaaaacagaggagattgggtatgttgtcaaataacctggcggcagcgcaaaagatg

SEQ ID NO: 203186 - DNA, 103 bp, Artificial Sequence
  Synthetic Polynucleotide
taatacgactcactatagggcaattgtcgaattacgattaacatttgacaaacagaggagatgtcaaatgttaatcgtaaacctggcggcagcgcaaaagatg

SEQ ID NO: 203187 - DNA, 103 bp, Artificial Sequence
  Synthetic Polynucleotide
taatacgactcactatagggctagtgttttcaattgtcgaattacgattaaacagaggagataatcgatgttcgacaataacctggcggcagcgcaaaagatg

SEQ ID NO: 203188 - DNA, 103 bp, Artificial Sequence
  Synthetic Polynucleotide
taatacgactcactatagggaatatgtcgcctagtgttttcaattgtcgaaacagaggagatcgacaatggaaaacactaacctggcggcagcgcaaaagatg

SEQ ID NO: 203189 - DNA, 103 bp, Artificial Sequence
  Synthetic Polynucleotide
taatacgactcactatagggcaccttttccaatatgtcgcctagtgttttaacagaggagaaaaacaatgggcgacataaacctggcggcagcgcaaaagatg

SEQ ID NO: 203190 - DNA, 103 bp, Artificial Sequence
  Synthetic Polynucleotide
taatacgactcactatagggtacagatgaacaccttttccaatatgtcgcaacagaggagagcgacaatgtggaaaaggaacctggcggcagcgcaaaagatg

SEQ ID NO: 203191 - DNA, 103 bp, Artificial Sequence
  Synthetic Polynucleotide
taatacgactcactatagggcaccagccccgagcgtttggacctgaacataacagaggagaatgttcatgtccaaacgcaacctggcggcagcgcaaaagatg

SEQ ID NO: 203192 - DNA, 103 bp, Artificial Sequence
  Synthetic Polynucleotide
taatacgactcactataggggcccaagctcccatcctcgtcgccgccaccaacagaggagaggtggcatggacgaggataacctggcggcagcgcaaaagatg

SEQ ID NO: 203193 - DNA, 103 bp, Artificial Sequence
  Synthetic Polynucleotide
taatacgactcactatagggccggtgctcccagtacgccacgctgcaccaaacagaggagatggtgcatggtggcgtacaacctggcggcagcgcaaaagatg

SEQ ID NO: 203194 - DNA, 103 bp, Artificial Sequence
  Synthetic Polynucleotide
taatacgactcactatagggccacgcgcgtccggtgctcccagtacgccaaacagaggagatggcgtatggggagcaccaacctggcggcagcgcaaaagatg

SEQ ID NO: 203195 - DNA, 103 bp, Artificial Sequence
  Synthetic Polynucleotide
taatacgactcactatagggtagaggcggcccacgcgcgtccggtgctccaacagaggagaggagcaatggacgcgcgtaacctggcggcagcgcaaaagatg

SEQ ID NO: 203196 - DNA, 103 bp, Artificial Sequence
  Synthetic Polynucleotide
taatacgactcactataggggtacaccgcatagaggcggcccacgcgcgtaacagaggagaacgcgcatgggccgcctcaacctggcggcagcgcaaaagatg

SEQ ID NO: 203197 - DNA, 103 bp, Artificial Sequence
  Synthetic Polynucleotide
taatacgactcactatagggcggcctggtcgtacaccgcatagaggcggcaacagaggagagccgccatgatgcggtgtaacctggcggcagcgcaaaagatg

SEQ ID NO: 203198 - DNA, 103 bp, Artificial Sequence
  Synthetic Polynucleotide
taatacgactcactatagggaagatgctgacggcctggtcgtacaccgcaaacagaggagatgcggtatgcgaccaggcaacctggcggcagcgcaaaagatg

SEQ ID NO: 203199 - DNA, 103 bp, Artificial Sequence
  Synthetic Polynucleotide
taatacgactcactatagggtaggtcgtagaagatgctgacggcctggtcaacagaggagagaccagatggtcagcatcaacctggcggcagcgcaaaagatg

SEQ ID NO: 203200 - DNA, 103 bp, Artificial Sequence
  Synthetic Polynucleotide
taatacgactcactatagggtgccctgaggtaggtcgtagaagatgctgaaacagaggagatcagcaatgtctacgaccaacctggcggcagcgcaaaagatg

SEQ ID NO: 203201 - DNA, 103 bp, Artificial Sequence
  Synthetic Polynucleotide
taatacgactcactatagggcagaagccgctgccctgaggtaggtcgtagaacagaggagactacgaatgacctcagggaacctggcggcagcgcaaaagatg

SEQ ID NO: 203202 - DNA, 103 bp, Artificial Sequence
  Synthetic Polynucleotide
taatacgactcactatagggctggcccaggcagaagccgctgccctgaggaacagaggagacctcagatgagcggcttcaacctggcggcagcgcaaaagatg

SEQ ID NO: 203203 - DNA, 103 bp, Artificial Sequence
  Synthetic Polynucleotide
taatacgactcactatagggcagctcggctgcccaagctcccatcctcgtaacagaggagaacgaggatgggagcttggaacctggcggcagcgcaaaagatg

SEQ ID NO: 203204 - DNA, 103 bp, Artificial Sequence
  Synthetic Polynucleotide
taatacgactcactatagggccaggttgagctggcccaggcagaagccgcaacagaggagagcggctatggcctgggccaacctggcggcagcgcaaaagatg

SEQ ID NO: 203205 - DNA, 103 bp, Artificial Sequence
  Synthetic Polynucleotide
taatacgactcactatagggctgcgctgctccaggttgagctggcccaggaacagaggagacctgggatggctcaacctaacctggcggcagcgcaaaagatg

SEQ ID NO: 203206 - DNA, 103 bp, Artificial Sequence
  Synthetic Polynucleotide
taatacgactcactatagggcaccgactcgctgcgctgctccaggttgagaacagaggagactcaacatggagcagcgcaacctggcggcagcgcaaaagatg

SEQ ID NO: 203207 - DNA, 103 bp, Artificial Sequence
  Synthetic Polynucleotide
taatacgactcactataggggcgttcgccgcaccgactcgctgcgctgctaacagaggagaagcagcatggcgagtcggaacctggcggcagcgcaaaagatg

SEQ ID NO: 203208 - DNA, 103 bp, Artificial Sequence
  Synthetic Polynucleotide
taatacgactcactatagggatcttgctgcgcgttcgccgcaccgactcgaacagaggagacgagtcatggcggcgaacaacctggcggcagcgcaaaagatg

SEQ ID NO: 203209 - DNA, 103 bp, Artificial Sequence
  Synthetic Polynucleotide
taatacgactcactataggggccgaagccgatcttgctgcgcgttcgccgaacagaggagacggcgaatgcgcagcaagaacctggcggcagcgcaaaagatg

SEQ ID NO: 203210 - DNA, 103 bp, Artificial Sequence
  Synthetic Polynucleotide
taatacgactcactatagggtgagcaggatgccgaagccgatcttgctgcaacagaggagagcagcaatgtcggcttcgaacctggcggcagcgcaaaagatg

SEQ ID NO: 203211 - DNA, 103 bp, Artificial Sequence
  Synthetic Polynucleotide
taatacgactcactatagggggctccttgctgagcaggatgccgaagccgaacagaggagacggcttatgcatcctgctaacctggcggcagcgcaaaagatg

SEQ ID NO: 203212 - DNA, 103 bp, Artificial Sequence
  Synthetic Polynucleotide
taatacgactcactatagggcacgccgtcgggctccttgctgagcaggataacagaggagaatcctgatgagcaaggagaacctggcggcagcgcaaaagatg

SEQ ID NO: 203213 - DNA, 103 bp, Artificial Sequence
  Synthetic Polynucleotide
taatacgactcactatagggtgtaggcccacacgccgtcgggctccttgcaacagaggagagcaaggatgccgacggcgaacctggcggcagcgcaaaagatg

SEQ ID NO: 203214 - DNA, 103 bp, Artificial Sequence
  Synthetic Polynucleotide
taatacgactcactatagggggggccggctcagctcggctgcccaagctcaacagaggagagagcttatgcagccgagcaacctggcggcagcgcaaaagatg

SEQ ID NO: 203215 - DNA, 103 bp, Artificial Sequence
  Synthetic Polynucleotide
taatacgactcactatagggtcgccgcggttgtaggcccacacgccgtcgaacagaggagacgacggatggtgggcctaaacctggcggcagcgcaaaagatg

SEQ ID NO: 203216 - DNA, 103 bp, Artificial Sequence
  Synthetic Polynucleotide
taatacgactcactataggggatggggtgctcgccgcggttgtaggcccaaacagaggagatgggccatgaaccgcggcaacctggcggcagcgcaaaagatg

SEQ ID NO: 203217 - DNA, 103 bp, Artificial Sequence
  Synthetic Polynucleotide
taatacgactcactatagggagttgacgaagatggggtgctcgccgcggtaacagaggagaaccgcgatgagcaccccaaacctggcggcagcgcaaaagatg

SEQ ID NO: 203218 - DNA, 103 bp, Artificial Sequence
  Synthetic Polynucleotide
taatacgactcactatagggagcgtcggggagttgacgaagatggggtgcaacagaggagagcacccatgcttcgtcaaaacctggcggcagcgcaaaagatg

SEQ ID NO: 203219 - DNA, 103 bp, Artificial Sequence
  Synthetic Polynucleotide
taatacgactcactataggggggcgcgtccagcgtcggggagttgacgaaaacagaggagattcgtcatgtccccgacgaacctggcggcagcgcaaaagatg

SEQ ID NO: 203220 - DNA, 103 bp, Artificial Sequence
  Synthetic Polynucleotide
taatacgactcactatagggcgcggccgccgggcgcgtccagcgtcggggaacagaggagaccccgaatgtggacgcgcaacctggcggcagcgcaaaagatg

SEQ ID NO: 203221 - DNA, 103 bp, Artificial Sequence
  Synthetic Polynucleotide
taatacgactcactatagggacgaccagggcgcggccgccgggcgcgtccaacagaggagaggacgcatgcggcggccgaacctggcggcagcgcaaaagatg

SEQ ID NO: 203222 - DNA, 103 bp, Artificial Sequence
  Synthetic Polynucleotide
taatacgactcactatagggcaccttgcgcacgaccagggcgcggccgccaacagaggagaggcggcatggccctggtcaacctggcggcagcgcaaaagatg

SEQ ID NO: 203223 - DNA, 103 bp, Artificial Sequence
  Synthetic Polynucleotide
taatacgactcactatagggagccggggggcaccttgcgcacgaccagggaacagaggagaccctggatgtgcgcaaggaacctggcggcagcgcaaaagatg

SEQ ID NO: 203224 - DNA, 103 bp, Artificial Sequence
  Synthetic Polynucleotide
taatacgactcactatagggttgatggagtagccggggggcaccttgcgcaacagaggagagcgcaaatggccccccggaacctggcggcagcgcaaaagatg

SEQ ID NO: 203225 - DNA, 103 bp, Artificial Sequence
  Synthetic Polynucleotide
taatacgactcactatagggtcttgcccgcggggccggctcagctcggctaacagaggagaagccgaatggagccggccaacctggcggcagcgcaaaagatg

SEQ ID NO: 203226 - DNA, 103 bp, Artificial Sequence
  Synthetic Polynucleotide
taatacgactcactataggggtcgaacaccttgatggagtagccggggggaacagaggagaccccccatgtactccatcaacctggcggcagcgcaaaagatg

SEQ ID NO: 203227 - DNA, 103 bp, Artificial Sequence
  Synthetic Polynucleotide
taatacgactcactatagggagcgctcgaagtcgaacaccttgatggagtaacagaggagaactccaatgaggtgttcgaacctggcggcagcgcaaaagatg

SEQ ID NO: 203228 - DNA, 103 bp, Artificial Sequence
  Synthetic Polynucleotide
taatacgactcactatagggtgcaggcccgagcgctcgaagtcgaacaccaacagaggagaggtgttatgcttcgagcgaacctggcggcagcgcaaaagatg

SEQ ID NO: 203229 - DNA, 103 bp, Artificial Sequence
  Synthetic Polynucleotide
taatacgactcactataggggggcgcgtgctgcaggcccgagcgctcgaaaacagaggagattcgagatgtcgggcctgaacctggcggcagcgcaaaagatg

SEQ ID NO: 203230 - DNA, 103 bp, Artificial Sequence
  Synthetic Polynucleotide
taatacgactcactatagggcgtcgggctcgggcgcgtgctgcaggcccgaacagaggagacgggccatgagcacgcgcaacctggcggcagcgcaaaagatg

SEQ ID NO: 203231 - DNA, 103 bp, Artificial Sequence
  Synthetic Polynucleotide
taatacgactcactatagggccgtcggcggcgtcgggctcgggcgcgtgcaacagaggagagcacgcatgcgagcccgaaacctggcggcagcgcaaaagatg

SEQ ID NO: 203232 - DNA, 103 bp, Artificial Sequence
  Synthetic Polynucleotide
taatacgactcactataggggtcgtaggggccgtcggcggcgtcgggctcaacagaggagagagcccatggccgccgacaacctggcggcagcgcaaaagatg

SEQ ID NO: 203233 - DNA, 103 bp, Artificial Sequence
  Synthetic Polynucleotide
taatacgactcactatagggcgctgttggggtcgtaggggccgtcggcggaacagaggagaccgccgatggcccctacgaacctggcggcagcgcaaaagatg

SEQ ID NO: 203234 - DNA, 103 bp, Artificial Sequence
  Synthetic Polynucleotide
taatacgactcactatagggctgatgcggacgctgttggggtcgtaggggaacagaggagacccctaatgccccaacagaacctggcggcagcgcaaaagatg

SEQ ID NO: 203235 - DNA, 103 bp, Artificial Sequence
  Synthetic Polynucleotide
taatacgactcactatagggcttggcgaagctgatgcggacgctgttgggaacagaggagacccaacatggtccgcatcaacctggcggcagcgcaaaagatg

SEQ ID NO: 203236 - DNA, 103 bp, Artificial Sequence
  Synthetic Polynucleotide
taatacgactcactatagggctccgccctctcttgcccgcggggccggctaacagaggagaagccggatgcgcgggcaaaacctggcggcagcgcaaaagatg

SEQ ID NO: 203237 - DNA, 103 bp, Artificial Sequence
  Synthetic Polynucleotide
taatacgactcactataggggcccccagcccttggcgaagctgatgcggaaacagaggagatccgcaatggcttcgccaaacctggcggcagcgcaaaagatg

SEQ ID NO: 203238 - DNA, 103 bp, Artificial Sequence
  Synthetic Polynucleotide
taatacgactcactataggggagtagcagggcccccagcccttggcgaagaacagaggagacttcgcatggggctggggaacctggcggcagcgcaaaagatg

SEQ ID NO: 203239 - DNA, 103 bp, Artificial Sequence
  Synthetic Polynucleotide
taatacgactcactataggggaactgccgggagtagcagggcccccagccaacagaggagaggctggatgccctgctacaacctggcggcagcgcaaaagatg

SEQ ID NO: 203240 - DNA, 103 bp, Artificial Sequence
  Synthetic Polynucleotide
taatacgactcactatagggaggaggtgatgaactgccgggagtagcaggaacagaggagacctgctatgcccggcagtaacctggcggcagcgcaaaagatg

SEQ ID NO: 203241 - DNA, 103 bp, Artificial Sequence
  Synthetic Polynucleotide
taatacgactcactatagggcagcaggggcaggaggtgatgaactgccggaacagaggagaccggcaatgcatcacctcaacctggcggcagcgcaaaagatg

SEQ ID NO: 203242 - DNA, 103 bp, Artificial Sequence
  Synthetic Polynucleotide
taatacgactcactataggggatctccagccagcaggggcaggaggtgataacagaggagaatcaccatgtgcccctgcaacctggcggcagcgcaaaagatg

SEQ ID NO: 203243 - DNA, 103 bp, Artificial Sequence
  Synthetic Polynucleotide
taatacgactcactatagggtgttgaggaggatctccagccagcaggggcaacagaggagagcccctatgggctggagaaacctggcggcagcgcaaaagatg

SEQ ID NO: 203244 - DNA, 103 bp, Artificial Sequence
  Synthetic Polynucleotide
taatacgactcactatagggtatctggggttgttgaggaggatctccagcaacagaggagagctggaatgcctcctcaaaacctggcggcagcgcaaaagatg

SEQ ID NO: 203245 - DNA, 103 bp, Artificial Sequence
  Synthetic Polynucleotide
taatacgactcactatagggcggccgcagcctccgccctctcttgcccgcaacagaggagagcgggcatgagagggcggaacctggcggcagcgcaaaagatg

SEQ ID NO: 203246 - DNA, 103 bp, Artificial Sequence
  Synthetic Polynucleotide
taatacgactcactataggggacttcggagcggccgcagcctccgccctcaacagaggagagagggcatgggctgcggcaacctggcggcagcgcaaaagatg

SEQ ID NO: 203247 - DNA, 103 bp, Artificial Sequence
  Synthetic Polynucleotide
taatacgactcactatagggctaccgggcggacttcggagcggccgcagcaacagaggagagctgcgatggctccgaagaacctggcggcagcgcaaaagatg

SEQ ID NO: 203248 - DNA, 103 bp, Artificial Sequence
  Synthetic Polynucleotide
taatacgactcactatagggcgccgcggggctaccgggcggacttcggagaacagaggagactccgaatgccgcccggtaacctggcggcagcgcaaaagatg

SEQ ID NO: 203249 - DNA, 103 bp, Artificial Sequence
  Synthetic Polynucleotide
taatacgactcactataggggtcccggggccgccgcggggctaccgggcgaacagaggagacgcccgatggccccgcggaacctggcggcagcgcaaaagatg

SEQ ID NO: 203250 - DNA, 103 bp, Artificial Sequence
  Synthetic Polynucleotide
taatacgactcactatagggaaagtcgccgcaccagccccgagcgtttggaacagaggagaccaaacatgcggggctggaacctggcggcagcgcaaaagatg

SEQ ID NO: 203251 - DNA, 103 bp, Artificial Sequence
  Synthetic Polynucleotide
taatacgactcactataggggtcccactgcgtcccggggccgccgcggggaacagaggagaccccgcatgggccccgggaacctggcggcagcgcaaaagatg

SEQ ID NO: 203252 - DNA, 103 bp, Artificial Sequence
  Synthetic Polynucleotide
taatacgactcactataggggcgcctcgctgtcccactgcgtcccggggcaacagaggagagccccgatgcgcagtgggaacctggcggcagcgcaaaagatg

SEQ ID NO: 203253 - DNA, 103 bp, Artificial Sequence
  Synthetic Polynucleotide
taatacgactcactatagggcgcgccctgggcgcctcgctgtcccactgcaacagaggagagcagtgatgcagcgaggcaacctggcggcagcgcaaaagatg

SEQ ID NO: 203254 - DNA, 103 bp, Artificial Sequence
  Synthetic Polynucleotide
taatacgactcactatagggggcgcctccccgcgccctgggcgcctcgctaacagaggagaagcgagatgcccagggcgaacctggcggcagcgcaaaagatg

SEQ ID NO: 203255 - DNA, 103 bp, Artificial Sequence
  Synthetic Polynucleotide
taatacgactcactatagggcctgcgcgccggcgcctccccgcgccctggaacagaggagaccagggatgggggaggcgaacctggcggcagcgcaaaagatg

SEQ ID NO: 203256 - DNA, 103 bp, Artificial Sequence
  Synthetic Polynucleotide
taatacgactcactatagggcggggggccccctgcgcgccggcgcctcccaacagaggagagggaggatgcggcgcgcaaacctggcggcagcgcaaaagatg

SEQ ID NO: 203257 - DNA, 103 bp, Artificial Sequence
  Synthetic Polynucleotide
taatacgactcactatagggacatgggcctcggggggccccctgcgcgccaacagaggagaggcgcgatgggggcccccaacctggcggcagcgcaaaagatg

SEQ ID NO: 203258 - DNA, 103 bp, Artificial Sequence
  Synthetic Polynucleotide
taatacgactcactatagggcctggctccgacatgggcctcggggggcccaacagaggagagggcccatggaggcccataacctggcggcagcgcaaaagatg

SEQ ID NO: 203259 - DNA, 103 bp, Artificial Sequence
  Synthetic Polynucleotide
taatacgactcactatagggagcgccggcccctggctccgacatgggcctaacagaggagaaggcccatgtcggagccaaacctggcggcagcgcaaaagatg

SEQ ID NO: 203260 - DNA, 103 bp, Artificial Sequence
  Synthetic Polynucleotide
taatacgactcactataggggggagctcccagcgccggcccctggctccgaacagaggagacggagcatggggccggcgaacctggcggcagcgcaaaagatg

SEQ ID NO: 203261 - DNA, 103 bp, Artificial Sequence
  Synthetic Polynucleotide
taatacgactcactatagggcgacttcgccaaagtcgccgcaccagccccaacagaggagaggggctatggcggcgactaacctggcggcagcgcaaaagatg

SEQ ID NO: 203262 - DNA, 103 bp, Artificial Sequence
  Synthetic Polynucleotide
taatacgactcactatagggacgtccagcagggagctcccagcgccggccaacagaggagaggccggatgtgggagctcaacctggcggcagcgcaaaagatg

SEQ ID NO: 203263 - DNA, 103 bp, Artificial Sequence
  Synthetic Polynucleotide
taatacgactcactatagggcggctccgccacgtccagcagggagctcccaacagaggagagggagcatgctgctggacaacctggcggcagcgcaaaagatg

SEQ ID NO: 203264 - DNA, 103 bp, Artificial Sequence
  Synthetic Polynucleotide
taatacgactcactatagggccgggcctcccggctccgccacgtccagcaaacagaggagatgctggatgtggcggagcaacctggcggcagcgcaaaagatg

SEQ ID NO: 203265 - DNA, 103 bp, Artificial Sequence
  Synthetic Polynucleotide
taatacgactcactatagggggcagccagcccgggcctcccggctccgccaacagaggagaggcggaatggggaggcccaacctggcggcagcgcaaaagatg

SEQ ID NO: 203266 - DNA, 103 bp, Artificial Sequence
  Synthetic Polynucleotide
taatacgactcactataggggtcactctcgggcagccagcccgggcctccaacagaggagaggaggcatgggctggctgaacctggcggcagcgcaaaagatg

SEQ ID NO: 203267 - DNA, 103 bp, Artificial Sequence
  Synthetic Polynucleotide
taatacgactcactatagggccgtctcgcagtcactctcgggcagccagcaacagaggagagctggcatgccgagagtgaacctggcggcagcgcaaaagatg

SEQ ID NO: 203268 - DNA, 103 bp, Artificial Sequence
  Synthetic Polynucleotide
taatacgactcactatagggcagcaggtcaccgtctcgcagtcactctcgaacagaggagacgagagatgctgcgagacaacctggcggcagcgcaaaagatg

SEQ ID NO: 203269 - DNA, 103 bp, Artificial Sequence
  Synthetic Polynucleotide
taatacgactcactatagggcgaaaagagacagcaggtcaccgtctcgcaaacagaggagatgcgagatggtgacctgcaacctggcggcagcgcaaaagatg

SEQ ID NO: 203270 - DNA, 103 bp, Artificial Sequence
  Synthetic Polynucleotide
taatacgactcactatagggcgtcccgctccgaaaagagacagcaggtcaaacagaggagatgacctatggtctcttttaacctggcggcagcgcaaaagatg

SEQ ID NO: 203271 - DNA, 103 bp, Artificial Sequence
  Synthetic Polynucleotide
taatacgactcactataggggcgccggcggcgtcccgctccgaaaagagaaacagaggagatctcttatgggagcgggaaacctggcggcagcgcaaaagatg

SEQ ID NO: 203272 - DNA, 103 bp, Artificial Sequence
  Synthetic Polynucleotide
taatacgactcactatagggggggaccacacgacttcgccaaagtcgccgaacagaggagacggcgaatgtggcgaagtaacctggcggcagcgcaaaagatg

SEQ ID NO: 203273 - DNA, 103 bp, Artificial Sequence
  Synthetic Polynucleotide
taatacgactcactataggggtcccggggcgcgccggcggcgtcccgctcaacagaggagagagcggatggccgccggcaacctggcggcagcgcaaaagatg

SEQ ID NO: 203274 - DNA, 103 bp, Artificial Sequence
  Synthetic Polynucleotide
taatacgactcactatagggggtcgctggcgtcccggggcgcgccggcggaacagaggagaccgccgatgcgccccgggaacctggcggcagcgcaaaagatg

SEQ ID NO: 203275 - DNA, 103 bp, Artificial Sequence
  Synthetic Polynucleotide
taatacgactcactatagggccggccagggggtcgctggcgtcccggggcaacagaggagagccccgatgcgccagcgaaacctggcggcagcgcaaaagatg

SEQ ID NO: 203276 - DNA, 103 bp, Artificial Sequence
  Synthetic Polynucleotide
taatacgactcactatagggcagggccgccccggccagggggtcgctggcaacagaggagagccagcatgcccctggccaacctggcggcagcgcaaaagatg

SEQ ID NO: 203277 - DNA, 103 bp, Artificial Sequence
  Synthetic Polynucleotide
taatacgactcactatagggccgccggctccagggccgccccggccagggaacagaggagaccctggatggggcggcccaacctggcggcagcgcaaaagatg

SEQ ID NO: 203278 - DNA, 103 bp, Artificial Sequence
  Synthetic Polynucleotide
taatacgactcactatagggcgcccgccgcccgccggctccagggccgccaacagaggagaggcggcatgggagccggcaacctggcggcagcgcaaaagatg

SEQ ID NO: 203279 - DNA, 103 bp, Artificial Sequence
  Synthetic Polynucleotide
taatacgactcactatagggttcgcgactccgcccgccgcccgccggctcaacagaggagagagccgatgggcggcgggaacctggcggcagcgcaaaagatg

SEQ ID NO: 203280 - DNA, 103 bp, Artificial Sequence
  Synthetic Polynucleotide
taatacgactcactataggggcgagcgcgcttcgcgactccgcccgccgcaacagaggagagcggcgatgggagtcgcgaacctggcggcagcgcaaaagatg

SEQ ID NO: 203281 - DNA, 103 bp, Artificial Sequence
  Synthetic Polynucleotide
taatacgactcactatagggagcagcagccgcgagcgcgcttcgcgactcaacagaggagagagtcgatgagcgcgctcaacctggcggcagcgcaaaagatg

SEQ ID NO: 203282 - DNA, 103 bp, Artificial Sequence
  Synthetic Polynucleotide
taatacgactcactatagggctgctccagcagcagcagccgcgagcgcgcaacagaggagagcgcgcatgcggctgctgaacctggcggcagcgcaaaagatg

SEQ ID NO: 203283 - DNA, 103 bp, Artificial Sequence
  Synthetic Polynucleotide
taatacgactcactatagggcctcccggtcggggaccacacgacttcgccaacagaggagaggcgaaatggtgtggtccaacctggcggcagcgcaaaagatg

SEQ ID NO: 203284 - DNA, 103 bp, Artificial Sequence
  Synthetic Polynucleotide
taatacgactcactatagggttttgagttcctgctccagcagcagcagccaacagaggagaggctgcatgtgctggagcaacctggcggcagcgcaaaagatg

SEQ ID NO: 203285 - DNA, 103 bp, Artificial Sequence
  Synthetic Polynucleotide
taatacgactcactatagggtacgtgacggttttgagttcctgctccagcaacagaggagagctggaatgggaactcaaaacctggcggcagcgcaaaagatg

SEQ ID NO: 203286 - DNA, 103 bp, Artificial Sequence
  Synthetic Polynucleotide
taatacgactcactatagggcagcagcgagtacgtgacggttttgagttcaacagaggagagaactcatgaccgtcacgaacctggcggcagcgcaaaagatg

SEQ ID NO: 203287 - DNA, 103 bp, Artificial Sequence
  Synthetic Polynucleotide
taatacgactcactatagggtgagccgcttcagcagcgagtacgtgacggaacagaggagaccgtcaatgactcgctgcaacctggcggcagcgcaaaagatg

SEQ ID NO: 203288 - DNA, 103 bp, Artificial Sequence
  Synthetic Polynucleotide
taatacgactcactataggggagcgctccttgagccgcttcagcagcgagaacagaggagactcgctatggaagcggctaacctggcggcagcgcaaaagatg

SEQ ID NO: 203289 - DNA, 103 bp, Artificial Sequence
  Synthetic Polynucleotide
taatacgactcactatagggcgtgtccagcgagcgctccttgagccgcttaacagaggagaaagcggatgaaggagcgcaacctggcggcagcgcaaaagatg

SEQ ID NO: 203290 - DNA, 103 bp, Artificial Sequence
  Synthetic Polynucleotide
taatacgactcactatagggcctccagcagcgtgtccagcgagcgctcctaacagaggagaaggagcatgcgctggacaaacctggcggcagcgcaaaagatg

SEQ ID NO: 203291 - DNA, 103 bp, Artificial Sequence
  Synthetic Polynucleotide
taatacgactcactataggggactccaccgcctccagcagcgtgtccagcaacagaggagagctggaatggctgctggaaacctggcggcagcgcaaaagatg

SEQ ID NO: 203292 - DNA, 103 bp, Artificial Sequence
  Synthetic Polynucleotide
taatacgactcactataggggccgccgcgggactccaccgcctccagcagaacagaggagactgctgatggcggtggagaacctggcggcagcgcaaaagatg

SEQ ID NO: 203293 - DNA, 103 bp, Artificial Sequence
  Synthetic Polynucleotide
taatacgactcactatagggcgcccggcacgccgccgcgggactccaccgaacagaggagacggtggatgcccgcggcgaacctggcggcagcgcaaaagatg

SEQ ID NO: 203294 - DNA, 103 bp, Artificial Sequence
  Synthetic Polynucleotide
taatacgactcactatagggctgccgccttcctcccggtcggggaccacaaacagaggagatgtggtatgcgaccgggaaacctggcggcagcgcaaaagatg

SEQ ID NO: 203295 - DNA, 103 bp, Artificial Sequence
  Synthetic Polynucleotide
taatacgactcactatagggagcacgcagccgcccggcacgccgccgcggaacagaggagaccgcggatgcgtgccgggaacctggcggcagcgcaaaagatg

SEQ ID NO: 203296 - DNA, 103 bp, Artificial Sequence
  Synthetic Polynucleotide
taatacgactcactataggggcgcggcaccagcacgcagccgcccggcacaacagaggagagtgccgatgggctgcgtgaacctggcggcagcgcaaaagatg

SEQ ID NO: 203297 - DNA, 103 bp, Artificial Sequence
  Synthetic Polynucleotide
taatacgactcactatagggggaggtcggcgcgcggcaccagcacgcagcaacagaggagagctgcgatgtggtgccgcaacctggcggcagcgcaaaagatg

SEQ ID NO: 203298 - DNA, 103 bp, Artificial Sequence
  Synthetic Polynucleotide
taatacgactcactatagggccgcccaggcggaggtcggcgcgcggcaccaacagaggagaggtgccatgcgccgacctaacctggcggcagcgcaaaagatg

SEQ ID NO: 203299 - DNA, 103 bp, Artificial Sequence
  Synthetic Polynucleotide
taatacgactcactatagggcgcgggctggccgcccaggcggaggtcggcaacagaggagagccgacatgcgcctgggcaacctggcggcagcgcaaaagatg

SEQ ID NO: 203300 - DNA, 103 bp, Artificial Sequence
  Synthetic Polynucleotide
taatacgactcactataggggctgcggcggcgcgggctggccgcccaggcaacagaggagagcctggatggccagcccgaacctggcggcagcgcaaaagatg

SEQ ID NO: 203301 - DNA, 103 bp, Artificial Sequence
  Synthetic Polynucleotide
taatacgactcactatagggccgagcagcagctgcggcggcgcgggctggaacagaggagaccagccatggccgccgcaaacctggcggcagcgcaaaagatg

SEQ ID NO: 203302 - DNA, 103 bp, Artificial Sequence
  Synthetic Polynucleotide
taatacgactcactatagggaaagaggcggccgagcagcagctgcggcggaacagaggagaccgccgatgctgctgctcaacctggcggcagcgcaaaagatg

SEQ ID NO: 203303 - DNA, 103 bp, Artificial Sequence
  Synthetic Polynucleotide
taatacgactcactatagggcgggccagcgaaagaggcggccgagcagcaaacagaggagatgctgcatggccgcctctaacctggcggcagcgcaaaagatg

SEQ ID NO: 203304 - DNA, 103 bp, Artificial Sequence
  Synthetic Polynucleotide
taatacgactcactatagggtgctgcaggtcgggccagcgaaagaggcggaacagaggagaccgcctatgtcgctggccaacctggcggcagcgcaaaagatg

SEQ ID NO: 203305 - DNA, 103 bp, Artificial Sequence
  Synthetic Polynucleotide
taatacgactcactataggggccgccgccgctgccgccttcctcccggtcaacagaggagagaccggatggaaggcggcaacctggcggcagcgcaaaagatg

SEQ ID NO: 203306 - DNA, 103 bp, Artificial Sequence
  Synthetic Polynucleotide
taatacgactcactatagggctccacggcgtgctgcaggtcgggccagcgaacagaggagacgctggatggacctgcagaacctggcggcagcgcaaaagatg

SEQ ID NO: 203307 - DNA, 103 bp, Artificial Sequence
  Synthetic Polynucleotide
taatacgactcactatagggggggcttcagctccacggcgtgctgcaggtaacagaggagaacctgcatgacgccgtggaacctggcggcagcgcaaaagatg

SEQ ID NO: 203308 - DNA, 103 bp, Artificial Sequence
  Synthetic Polynucleotide
taatacgactcactatagggcagccgcacaggggcttcagctccacggcgaacagaggagacgccgtatggctgaagccaacctggcggcagcgcaaaagatg

SEQ ID NO: 203309 - DNA, 103 bp, Artificial Sequence
  Synthetic Polynucleotide
taatacgactcactataggggaagctgtggcagccgcacaggggcttcagaacagaggagactgaagatgctgtgcggcaacctggcggcagcgcaaaagatg

SEQ ID NO: 203310 - DNA, 103 bp, Artificial Sequence
  Synthetic Polynucleotide
taatacgactcactatagggcggcggcggcgaagctgtggcagccgcacaaacagaggagatgtgcgatggccacagctaacctggcggcagcgcaaaagatg

SEQ ID NO: 203311 - DNA, 103 bp, Artificial Sequence
  Synthetic Polynucleotide
taatacgactcactataggggggccgtcggcggcggcggcgaagctgtggaacagaggagaccacagatgcgccgccgcaacctggcggcagcgcaaaagatg

SEQ ID NO: 203312 - DNA, 103 bp, Artificial Sequence
  Synthetic Polynucleotide
taatacgactcactataggggcacacggtagggccgtcggcggcggcggcaacagaggagagccgccatggccgacggcaacctggcggcagcgcaaaagatg

SEQ ID NO: 203313 - DNA, 103 bp, Artificial Sequence
  Synthetic Polynucleotide
taatacgactcactatagggaggggttgcagcacacggtagggccgtcggaacagaggagaccgacgatgctaccgtgtaacctggcggcagcgcaaaagatg

SEQ ID NO: 203314 - DNA, 103 bp, Artificial Sequence
  Synthetic Polynucleotide
taatacgactcactatagggctgaagtggtaggggttgcagcacacggtaaacagaggagataccgtatgctgcaacccaacctggcggcagcgcaaaagatg

SEQ ID NO: 203315 - DNA, 103 bp, Artificial Sequence
  Synthetic Polynucleotide
taatacgactcactataggggcagagccggctgaagtggtaggggttgcaaacagaggagatgcaacatgtaccacttcaacctggcggcagcgcaaaagatg

SEQ ID NO: 203316 - DNA, 103 bp, Artificial Sequence
  Synthetic Polynucleotide
taatacgactcactatagggcgccgccaccgccgccgccgctgccgccttaacagaggagaaaggcgatggcggcggcgaacctggcggcagcgcaaaagatg

SEQ ID NO: 203317 - DNA, 103 bp, Artificial Sequence
  Synthetic Polynucleotide
taatacgactcactatagggattcgggcccgcagagccggctgaagtggtaacagaggagaaccactatggccggctctaacctggcggcagcgcaaaagatg

SEQ ID NO: 203318 - DNA, 103 bp, Artificial Sequence
  Synthetic Polynucleotide
taatacgactcactatagggggtggcggagattcgggcccgcagagccggaacagaggagaccggctatgcgggcccgaaacctggcggcagcgcaaaagatg

SEQ ID NO: 203319 - DNA, 103 bp, Artificial Sequence
  Synthetic Polynucleotide
taatacgactcactatagggagagtagggaggtggcggagattcgggcccaacagaggagagggcccatgtctccgccaaacctggcggcagcgcaaaagatg

SEQ ID NO: 203320 - DNA, 103 bp, Artificial Sequence
  Synthetic Polynucleotide
taatacgactcactataggggagacagccgagagtagggaggtggcggagaacagaggagactccgcatgctccctactaacctggcggcagcgcaaaagatg

SEQ ID NO: 203321 - DNA, 103 bp, Artificial Sequence
  Synthetic Polynucleotide
taatacgactcactatagggtcgtcgcgaggagacagccgagagtagggaaacagaggagatccctaatgtcggctgtcaacctggcggcagcgcaaaagatg

SEQ ID NO: 203322 - DNA, 103 bp, Artificial Sequence
  Synthetic Polynucleotide
taatacgactcactatagggtggcttgtactcgtcgcgaggagacagccgaacagaggagacggctgatgcctcgcgacaacctggcggcagcgcaaaagatg

SEQ ID NO: 203323 - DNA, 103 bp, Artificial Sequence
  Synthetic Polynucleotide
taatacgactcactatagggacagatccagtggcttgtactcgtcgcgagaacagaggagactcgcgatgagtacaagcaacctggcggcagcgcaaaagatg

SEQ ID NO: 203324 - DNA, 103 bp, Artificial Sequence
  Synthetic Polynucleotide
taatacgactcactataggggtggaatcggacagatccagtggcttgtacaacagaggagagtacaaatgactggatctaacctggcggcagcgcaaaagatg

SEQ ID NO: 203325 - DNA, 103 bp, Artificial Sequence
  Synthetic Polynucleotide
taatacgactcactataggggtaagacaatgtggaatcggacagatccagaacagaggagactggatatgtccgattccaacctggcggcagcgcaaaagatg

SEQ ID NO: 203326 - DNA, 103 bp, Artificial Sequence
  Synthetic Polynucleotide
taatacgactcactatagggccgtttcagtgtaagacaatgtggaatcggaacagaggagaccgattatgcattgtcttaacctggcggcagcgcaaaagatg

SEQ ID NO: 203327 - DNA, 103 bp, Artificial Sequence
  Synthetic Polynucleotide
taatacgactcactatagggccatcctcgtcgccgccaccgccgccgccgaacagaggagacggcggatgcggtggcggaacctggcggcagcgcaaaagatg

SEQ ID NO: 203328 - DNA, 103 bp, Artificial Sequence
  Synthetic Polynucleotide
taatacgactcactatagggttggtagcctccgtttcagtgtaagacaataacagaggagaattgtcatgcactgaaacaacctggcggcagcgcaaaagatg

SEQ ID NO: 203329 - DNA, 103 bp, Artificial Sequence
  Synthetic Polynucleotide
taatacgactcactataggggatgagggagttggtagcctccgtttcagtaacagaggagaactgaaatggaggctaccaacctggcggcagcgcaaaagatg

SEQ ID NO: 203330 - DNA, 103 bp, Artificial Sequence
  Synthetic Polynucleotide
taatacgactcactatagggccggagcagtgatgagggagttggtagcctaacagaggagaaggctaatgactccctcaaacctggcggcagcgcaaaagatg

SEQ ID NO: 203331 - DNA, 103 bp, Artificial Sequence
  Synthetic Polynucleotide
taatacgactcactataggggagaattcacccggagcagtgatgagggagaacagaggagactccctatgcactgctccaacctggcggcagcgcaaaagatg

SEQ ID NO: 203332 - DNA, 103 bp, Artificial Sequence
  Synthetic Polynucleotide
taatacgactcactataggggctggcgtctgagaattcacccggagcagtaacagaggagaactgctatgggtgaattcaacctggcggcagcgcaaaagatg

SEQ ID NO: 203333 - DNA, 103 bp, Artificial Sequence
  Synthetic Polynucleotide
taatacgactcactatagggccggagacatgctggcgtctgagaattcacaacagaggagagtgaatatgcagacgccaaacctggcggcagcgcaaaagatg

SEQ ID NO: 203334 - DNA, 103 bp, Artificial Sequence
  Synthetic Polynucleotide
taatacgactcactatagggttggtggcgtccggagacatgctggcgtctaacagaggagaagacgcatgcatgtctccaacctggcggcagcgcaaaagatg

SEQ ID NO: 203335 - DNA, 103 bp, Artificial Sequence
  Synthetic Polynucleotide
taatacgactcactataggggtggctcggcttggtggcgtccggagacataacagaggagaatgtctatggacgccaccaacctggcggcagcgcaaaagatg

SEQ ID NO: 203336 - DNA, 103 bp, Artificial Sequence
  Synthetic Polynucleotide
taatacgactcactatagggcgctgcaccagtggctcggcttggtggcgtaacagaggagaacgccaatgagccgagccaacctggcggcagcgcaaaagatg

SEQ ID NO: 203337 - DNA, 103 bp, Artificial Sequence
  Synthetic Polynucleotide
taatacgactcactatagggcagtacgccacgctgcaccagtggctcggcaacagaggagagccgagatgctggtgcagaacctggcggcagcgcaaaagatg

SEQ ID NO: 203338 - DNA, 103 bp, Artificial Sequence
  Synthetic Polynucleotide
taatacgactcactataggggacgagcgcagatcgtttggtcctgaacataacagaggagaatgttcatgaccaaacgaaacctggcggcagcgcaaaagatg

SEQ ID NO: 203339 - DNA, 103 bp, Artificial Sequence
  Synthetic Polynucleotide
taatacgactcactatagggttctccccgcagctcgcctcctcctccaccaacagaggagaggtggaatgggaggcgagaacctggcggcagcgcaaaagatg

SEQ ID NO: 203340 - DNA, 103 bp, Artificial Sequence
  Synthetic Polynucleotide
taatacgactcactataggggatggggtaactgctgcggttgtacacccaaacagaggagatgggtgatgaaccgcagcaacctggcggcagcgcaaaagatg

SEQ ID NO: 203341 - DNA, 103 bp, Artificial Sequence
  Synthetic Polynucleotide
taatacgactcactatagggacttgatgaagatggggtaactgctgcggtaacagaggagaaccgcaatggttaccccaaacctggcggcagcgcaaaagatg

SEQ ID NO: 203342 - DNA, 103 bp, Artificial Sequence
  Synthetic Polynucleotide
taatacgactcactatagggagtgtggcggacttgatgaagatggggtaaaacagaggagattacccatgcttcatcaaaacctggcggcagcgcaaaagatg

SEQ ID NO: 203343 - DNA, 103 bp, Artificial Sequence
  Synthetic Polynucleotide
taatacgactcactatagggcgggttgtccagtgtggcggacttgatgaaaacagaggagattcatcatgtccgccacaaacctggcggcagcgcaaaagatg

SEQ ID NO: 203344 - DNA, 103 bp, Artificial Sequence
  Synthetic Polynucleotide
taatacgactcactatagggtcctggagtccgggttgtccagtgtggcggaacagaggagaccgccaatgtggacaaccaacctggcggcagcgcaaaagatg

SEQ ID NO: 203345 - DNA, 103 bp, Artificial Sequence
  Synthetic Polynucleotide
taatacgactcactatagggaccaacagcgtcctggagtccgggttgtccaacagaggagaggacaaatgggactccagaacctggcggcagcgcaaaagatg

SEQ ID NO: 203346 - DNA, 103 bp, Artificial Sequence
  Synthetic Polynucleotide
taatacgactcactatagggcaccttgtgtaccaacagcgtcctggagtcaacagaggagagactccatgacgctgttgaacctggcggcagcgcaaaagatg

SEQ ID NO: 203347 - DNA, 103 bp, Artificial Sequence
  Synthetic Polynucleotide
taatacgactcactatagggaaccggggaacaccttgtgtaccaacagcgaacagaggagacgctgtatgtacacaaggaacctggcggcagcgcaaaagatg

SEQ ID NO: 203348 - DNA, 103 bp, Artificial Sequence
  Synthetic Polynucleotide
taatacgactcactatagggttgatggagaaaccggggaacaccttgtgtaacagaggagaacacaaatggttccccggaacctggcggcagcgcaaaagatg

SEQ ID NO: 203349 - DNA, 103 bp, Artificial Sequence
  Synthetic Polynucleotide
taatacgactcactataggggtcgaaagccttgatggagaaaccggggaaaacagaggagattccccatgttctccatcaacctggcggcagcgcaaaagatg

SEQ ID NO: 203350 - DNA, 103 bp, Artificial Sequence
  Synthetic Polynucleotide
taatacgactcactatagggccgtcgccccttctccccgcagctcgcctcaacagaggagagaggcgatgtgcggggagaacctggcggcagcgcaaaagatg

SEQ ID NO: 203351 - DNA, 103 bp, Artificial Sequence
  Synthetic Polynucleotide
taatacgactcactatagggccttctcgtagtcgaaagccttgatggagaaacagaggagatctccaatgaggctttcgaacctggcggcagcgcaaaagatg

SEQ ID NO: 203352 - DNA, 103 bp, Artificial Sequence
  Synthetic Polynucleotide
taatacgactcactatagggaggctgtacgccttctcgtagtcgaaagccaacagaggagaggctttatgctacgagaaaacctggcggcagcgcaaaagatg

SEQ ID NO: 203353 - DNA, 103 bp, Artificial Sequence
  Synthetic Polynucleotide
taatacgactcactataggggggccgctgcaggctgtacgccttctcgtaaacagaggagatacgagatggcgtacagcaacctggcggcagcgcaaaagatg

SEQ ID NO: 203354 - DNA, 103 bp, Artificial Sequence
  Synthetic Polynucleotide
taatacgactcactatagggcgtggtcattgggccgctgcaggctgtacgaacagaggagacgtacaatgtgcagcggcaacctggcggcagcgcaaaagatg

SEQ ID NO: 203355 - DNA, 103 bp, Artificial Sequence
  Synthetic Polynucleotide
taatacgactcactatagggtgcataaactcgtggtcattgggccgctgcaacagaggagagcagcgatgcaatgaccaaacctggcggcagcgcaaaagatg

SEQ ID NO: 203356 - DNA, 103 bp, Artificial Sequence
  Synthetic Polynucleotide
taatacgactcactatagggccacggctgctgcataaactcgtggtcattaacagaggagaaatgacatggagtttatgaacctggcggcagcgcaaaagatg

SEQ ID NO: 203357 - DNA, 103 bp, Artificial Sequence
  Synthetic Polynucleotide
taatacgactcactatagggtaaagcccgtccacggctgctgcataaactaacagaggagaagtttaatgagcagccgtaacctggcggcagcgcaaaagatg

SEQ ID NO: 203358 - DNA, 103 bp, Artificial Sequence
  Synthetic Polynucleotide
taatacgactcactatagggatctgcacggtaaagcccgtccacggctgcaacagaggagagcagccatggacgggcttaacctggcggcagcgcaaaagatg

SEQ ID NO: 203359 - DNA, 103 bp, Artificial Sequence
  Synthetic Polynucleotide
taatacgactcactatagggcacaaagctgatctgcacggtaaagcccgtaacagaggagaacgggcatgaccgtgcagaacctggcggcagcgcaaaagatg

SEQ ID NO: 203360 - DNA, 103 bp, Artificial Sequence
  Synthetic Polynucleotide
taatacgactcactatagggcccagcccttcacaaagctgatctgcacggaacagaggagaccgtgcatgtcagctttgaacctggcggcagcgcaaaagatg

SEQ ID NO: 203361 - DNA, 103 bp, Artificial Sequence
  Synthetic Polynucleotide
taatacgactcactataggggctcggctgtccgtcgccccttctccccgcaacagaggagagcggggatgaggggcgacaacctggcggcagcgcaaaagatg

SEQ ID NO: 203362 - DNA, 103 bp, Artificial Sequence
  Synthetic Polynucleotide
taatacgactcactatagggtagcactggccccagcccttcacaaagctgaacagaggagacagcttatggaagggctgaacctggcggcagcgcaaaagatg

SEQ ID NO: 203363 - DNA, 103 bp, Artificial Sequence
  Synthetic Polynucleotide
taatacgactcactatagggctggcgggtgtagcactggccccagcccttaacagaggagaaagggcatgggccagtgcaacctggcggcagcgcaaaagatg

SEQ ID NO: 203364 - DNA, 103 bp, Artificial Sequence
  Synthetic Polynucleotide
taatacgactcactatagggtgctgatgaactggcgggtgtagcactggcaacagaggagagccagtatgacacccgccaacctggcggcagcgcaaaagatg

SEQ ID NO: 203365 - DNA, 103 bp, Artificial Sequence
  Synthetic Polynucleotide
taatacgactcactatagggcacgggcagctgctgatgaactggcgggtgaacagaggagacacccgatggttcatcagaacctggcggcagcgcaaaagatg

SEQ ID NO: 203366 - DNA, 103 bp, Artificial Sequence
  Synthetic Polynucleotide
taatacgactcactatagggctctagccagcacgggcagctgctgatgaaaacagaggagattcatcatgagctgcccgaacctggcggcagcgcaaaagatg

SEQ ID NO: 203367 - DNA, 103 bp, Artificial Sequence
  Synthetic Polynucleotide
taatacgactcactatagggtgaagatgacctctagccagcacgggcagcaacagaggagagctgccatggctggctagaacctggcggcagcgcaaaagatg

SEQ ID NO: 203368 - DNA, 103 bp, Artificial Sequence
  Synthetic Polynucleotide
taatacgactcactatagggtaccggctgttgaagatgacctctagccagaacagaggagactggctatgggtcatcttaacctggcggcagcgcaaaagatg

SEQ ID NO: 203369 - DNA, 103 bp, Artificial Sequence
  Synthetic Polynucleotide
taatacgactcactatagggggccccatgcgctcggctgtccgtcgccccaacagaggagaggggcgatggacagccgaaacctggcggcagcgcaaaagatg

SEQ ID NO: 203370 - DNA, 103 bp, Artificial Sequence
  Synthetic Polynucleotide
taatacgactcactatagggcgccgccaccggccccatgcgctcggctgtaacagaggagaacagccatgcgcatggggaacctggcggcagcgcaaaagatg

SEQ ID NO: 203371 - DNA, 103 bp, Artificial Sequence
  Synthetic Polynucleotide
taatacgactcactatagggctgcccgggccgccgccaccggccccatgcaacagaggagagcatggatgcggtggcggaacctggcggcagcgcaaaagatg

SEQ ID NO: 203372 - DNA, 103 bp, Artificial Sequence
  Synthetic Polynucleotide
taatacgactcactataggggcatccagccctgcccgggccgccgccaccaacagaggagaggtggcatgggcccgggcaacctggcggcagcgcaaaagatg

SEQ ID NO: 203373 - DNA, 103 bp, Artificial Sequence
  Synthetic Polynucleotide
taatacgactcactatagggtgcccaggcagcatccagccctgcccgggcaacagaggagagcccggatggggctggataacctggcggcagcgcaaaagatg

SEQ ID NO: 203374 - DNA, 103 bp, Artificial Sequence
  Synthetic Polynucleotide
taatacgactcactatagggcgcaccgccttgcccaggcagcatccagccaacagaggagaggctggatgctgcctgggaacctggcggcagcgcaaaagatg

SEQ ID NO: 203375 - DNA, 103 bp, Artificial Sequence
  Synthetic Polynucleotide
taatacgactcactatagggtttggcacctcgcaccgccttgcccaggcaaacagaggagatgcctgatgaaggcggtgaacctggcggcagcgcaaaagatg

SEQ ID NO: 203376 - DNA, 103 bp, Artificial Sequence
  Synthetic Polynucleotide
taatacgactcactatagggagagacgccggacgagcgcagatcgtttggaacagaggagaccaaacatgctgcgctcgaacctggcggcagcgcaaaagatg

SEQ ID NO: 203377 - DNA, 103 bp, Artificial Sequence
  Synthetic Polynucleotide
taatacgactcactatagggggtggtgacctttggcacctcgcaccgcctaacagaggagaaggcggatggaggtgccaaacctggcggcagcgcaaaagatg

SEQ ID NO: 203378 - DNA, 103 bp, Artificial Sequence
  Synthetic Polynucleotide
taatacgactcactataggggggtggggatggtggtgacctttggcacctaacagaggagaaggtgcatgaggtcaccaaacctggcggcagcgcaaaagatg

SEQ ID NO: 203379 - DNA, 103 bp, Artificial Sequence
  Synthetic Polynucleotide
taatacgactcactatagggcgcggctggcgggtggggatggtggtgaccaacagaggagaggtcacatgcatccccacaacctggcggcagcgcaaaagatg

SEQ ID NO: 203380 - DNA, 103 bp, Artificial Sequence
  Synthetic Polynucleotide
taatacgactcactatagggcgccggcgcccgcggctggcgggtggggataacagaggagaatccccatgcgccagccgaacctggcggcagcgcaaaagatg

SEQ ID NO: 203381 - DNA, 103 bp, Artificial Sequence
  Synthetic Polynucleotide
taatacgactcactatagggcccccggccgcgccggcgcccgcggctggcaacagaggagagccagcatggggcgccggaacctggcggcagcgcaaaagatg

SEQ ID NO: 203382 - DNA, 103 bp, Artificial Sequence
  Synthetic Polynucleotide
taatacgactcactatagggcgcctcggcgcccccggccgcgccggcgccaacagaggagaggcgccatggcggccgggaacctggcggcagcgcaaaagatg

SEQ ID NO: 203383 - DNA, 103 bp, Artificial Sequence
  Synthetic Polynucleotide
taatacgactcactatagggccttcagatccgcctcggcgcccccggccgaacagaggagacggccgatggcgccgaggaacctggcggcagcgcaaaagatg

SEQ ID NO: 203384 - DNA, 103 bp, Artificial Sequence
  Synthetic Polynucleotide
taatacgactcactatagggtgcgtgagcgccttcagatccgcctcggcgaacagaggagacgccgaatgggatctgaaaacctggcggcagcgcaaaagatg

SEQ ID NO: 203385 - DNA, 103 bp, Artificial Sequence
  Synthetic Polynucleotide
taatacgactcactataggggagcaccgagtgcgtgagcgccttcagatcaacagaggagagatctgatggcgctcacgaacctggcggcagcgcaaaagatg

SEQ ID NO: 203386 - DNA, 103 bp, Artificial Sequence
  Synthetic Polynucleotide
taatacgactcactatagggtcagtttcttgagcaccgagtgcgtgagcgaacagaggagacgctcaatgactcggtgcaacctggcggcagcgcaaaagatg

SEQ ID NO: 203387 - DNA, 103 bp, Artificial Sequence
  Synthetic Polynucleotide
taatacgactcactatagggcggctcctccagagacgccggacgagcgcaaacagaggagatgcgctatgccggcgtctaacctggcggcagcgcaaaagatg

SEQ ID NO: 203388 - DNA, 103 bp, Artificial Sequence
  Synthetic Polynucleotide
taatacgactcactatagggtgccgctccttcagtttcttgagcaccgagaacagaggagactcggtatgcaagaaactaacctggcggcagcgcaaaagatg

SEQ ID NO: 203389 - DNA, 103 bp, Artificial Sequence
  Synthetic Polynucleotide
taatacgactcactatagggcagctccagctgccgctccttcagtttcttaacagaggagaaagaaaatgaaggagcggaacctggcggcagcgcaaaagatg

SEQ ID NO: 203390 - DNA, 103 bp, Artificial Sequence
  Synthetic Polynucleotide
taatacgactcactatagggcctggagcagcagctccagctgccgctcctaacagaggagaaggagcatgagctggagcaacctggcggcagcgcaaaagatg

SEQ ID NO: 203391 - DNA, 103 bp, Artificial Sequence
  Synthetic Polynucleotide
taatacgactcactataggggactccacggcctggagcagcagctccagcaacagaggagagctggaatggctgctccaaacctggcggcagcgcaaaagatg

SEQ ID NO: 203392 - DNA, 103 bp, Artificial Sequence
  Synthetic Polynucleotide
taatacgactcactatagggcccgccgcgggactccacggcctggagcagaacagaggagactgctcatggccgtggagaacctggcggcagcgcaaaagatg

SEQ ID NO: 203393 - DNA, 103 bp, Artificial Sequence
  Synthetic Polynucleotide
taatacgactcactatagggcggtgcgcgtcccgccgcgggactccacggaacagaggagaccgtggatgcccgcggcgaacctggcggcagcgcaaaagatg

SEQ ID NO: 203394 - DNA, 103 bp, Artificial Sequence
  Synthetic Polynucleotide
taatacgactcactatagggaggaggcacgcggtgcgcgtcccgccgcggaacagaggagaccgcggatggacgcgcacaacctggcggcagcgcaaaagatg

SEQ ID NO: 203395 - DNA, 103 bp, Artificial Sequence
  Synthetic Polynucleotide
taatacgactcactataggggccgggcagcaggaggcacgcggtgcgcgtaacagaggagaacgcgcatggcgtgcctcaacctggcggcagcgcaaaagatg

SEQ ID NO: 203396 - DNA, 103 bp, Artificial Sequence
  Synthetic Polynucleotide
taatacgactcactatagggagtccaggcggccgggcagcaggaggcacgaacagaggagacgtgccatgtgctgcccgaacctggcggcagcgcaaaagatg

SEQ ID NO: 203397 - DNA, 103 bp, Artificial Sequence
  Synthetic Polynucleotide
taatacgactcactatagggcccagcctgcagtccaggcggccgggcagcaacagaggagagctgccatgccgcctggaaacctggcggcagcgcaaaagatg

SEQ ID NO: 203398 - DNA, 103 bp, Artificial Sequence
  Synthetic Polynucleotide
taatacgactcactataggggccgggcgcacggctcctccagagacgccgaacagaggagacggcgtatgtggaggagcaacctggcggcagcgcaaaagatg

SEQ ID NO: 203399 - DNA, 103 bp, Artificial Sequence
  Synthetic Polynucleotide
taatacgactcactatagggcgcccccgggcccagcctgcagtccaggcgaacagaggagacgcctgatgtgcaggctgaacctggcggcagcgcaaaagatg

SEQ ID NO: 203400 - DNA, 103 bp, Artificial Sequence
  Synthetic Polynucleotide
taatacgactcactatagggcgccggcgggcgcccccgggcccagcctgcaacagaggagagcaggcatggcccgggggaacctggcggcagcgcaaaagatg

SEQ ID NO: 203401 - DNA, 103 bp, Artificial Sequence
  Synthetic Polynucleotide
taatacgactcactataggggcaggctgcgcgccggcgggcgcccccgggaacagaggagacccgggatggcccgccggaacctggcggcagcgcaaaagatg

SEQ ID NO: 203402 - DNA, 103 bp, Artificial Sequence
  Synthetic Polynucleotide
taatacgactcactataggggggcggctgcgcaggctgcgcgccggcgggaacagaggagacccgccatggcgcagcctaacctggcggcagcgcaaaagatg

SEQ ID NO: 203403 - DNA, 103 bp, Artificial Sequence
  Synthetic Polynucleotide
taatacgactcactatagggagtaggacgagggcggctgcgcaggctgcgaacagaggagacgcagcatgcgcagccgcaacctggcggcagcgcaaaagatg

SEQ ID NO: 203404 - DNA, 103 bp, Artificial Sequence
  Synthetic Polynucleotide
taatacgactcactatagggagggggagcgagtaggacgagggcggctgcaacagaggagagcagccatgctcgtcctaaacctggcggcagcgcaaaagatg

SEQ ID NO: 203405 - DNA, 103 bp, Artificial Sequence
  Synthetic Polynucleotide
taatacgactcactataggggcacagcaggagggggagcgagtaggacgaaacagaggagatcgtccatgtcgctccccaacctggcggcagcgcaaaagatg

SEQ ID NO: 203406 - DNA, 103 bp, Artificial Sequence
  Synthetic Polynucleotide
taatacgactcactatagggtgaacactttgcacagcaggagggggagcgaacagaggagacgctccatgtcctgctgtaacctggcggcagcgcaaaagatg

SEQ ID NO: 203407 - DNA, 103 bp, Artificial Sequence
  Synthetic Polynucleotide
taatacgactcactatagggtccggccacctgaacactttgcacagcaggaacagaggagacctgctatgcaaagtgttaacctggcggcagcgcaaaagatg

SEQ ID NO: 203408 - DNA, 103 bp, Artificial Sequence
  Synthetic Polynucleotide
taatacgactcactatagggatgcctgagatccggccacctgaacactttaacagaggagaaaagtgatgaggtggccgaacctggcggcagcgcaaaagatg

SEQ ID NO: 203409 - DNA, 103 bp, Artificial Sequence
  Synthetic Polynucleotide
taatacgactcactatagggcgtcctcgccgccgggcgcacggctcctccaacagaggagaggaggaatggtgcgcccgaacctggcggcagcgcaaaagatg

SEQ ID NO: 203410 - DNA, 103 bp, Artificial Sequence
  Synthetic Polynucleotide
taatacgactcactatagggcttccgaggaatgcctgagatccggccaccaacagaggagaggtggcatgatctcaggcaacctggcggcagcgcaaaagatg

SEQ ID NO: 203411 - DNA, 103 bp, Artificial Sequence
  Synthetic Polynucleotide
taatacgactcactatagggagcctcttgacttccgaggaatgcctgagaaacagaggagatctcagatgttcctcggaaacctggcggcagcgcaaaagatg

SEQ ID NO: 203412 - DNA, 103 bp, Artificial Sequence
  Synthetic Polynucleotide
taatacgactcactatagggacagcaacacagcctcttgacttccgaggaaacagaggagatcctcgatggtcaagaggaacctggcggcagcgcaaaagatg

SEQ ID NO: 203413 - DNA, 103 bp, Artificial Sequence
  Synthetic Polynucleotide
taatacgactcactatagggcgtaagattcacagcaacacagcctcttgaaacagaggagatcaagaatgtgtgttgctaacctggcggcagcgcaaaagatg

SEQ ID NO: 203414 - DNA, 103 bp, Artificial Sequence
  Synthetic Polynucleotide
taatacgactcactatagggttgatcttcccgtaagattcacagcaacacaacagaggagagtgttgatgtgaatcttaaacctggcggcagcgcaaaagatg

SEQ ID NO: 203415 - DNA, 103 bp, Artificial Sequence
  Synthetic Polynucleotide
taatacgactcactatagggcagctcggggttgatcttcccgtaagattcaacagaggagagaatctatggggaagatcaacctggcggcagcgcaaaagatg

SEQ ID NO: 203416 - DNA, 103 bp, Artificial Sequence
  Synthetic Polynucleotide
taatacgactcactatagggtgcagcacaccagctcggggttgatcttccaacagaggagaggaagaatgaccccgagcaacctggcggcagcgcaaaagatg

SEQ ID NO: 203417 - DNA, 103 bp, Artificial Sequence
  Synthetic Polynucleotide
taatacgactcactatagggtgatgggggttgcagcacaccagctcggggaacagaggagaccccgaatgggtgtgctgaacctggcggcagcgcaaaagatg

SEQ ID NO: 203418 - DNA, 103 bp, Artificial Sequence
  Synthetic Polynucleotide
taatacgactcactatagggtcggctaaggtgatgggggttgcagcacacaacagaggagagtgtgcatgaacccccataacctggcggcagcgcaaaagatg

SEQ ID NO: 203419 - DNA, 103 bp, Artificial Sequence
  Synthetic Polynucleotide
taatacgactcactataggggttcgcagagtcggctaaggtgatgggggtaacagaggagaacccccatgaccttagccaacctggcggcagcgcaaaagatg

SEQ ID NO: 203420 - DNA, 103 bp, Artificial Sequence
  Synthetic Polynucleotide
taatacgactcactatagggccctcctcctcgtcctcgccgccgggcgcaaacagaggagatgcgccatgcggcgaggaaacctggcggcagcgcaaaagatg

SEQ ID NO: 203421 - DNA, 103 bp, Artificial Sequence
  Synthetic Polynucleotide
taatacgactcactatagggggagactctagttcgcagagtcggctaaggaacagaggagaccttagatgactctgcgaaacctggcggcagcgcaaaagatg

SEQ ID NO: 203422 - DNA, 103 bp, Artificial Sequence
  Synthetic Polynucleotide
taatacgactcactatagggaggaggggggggagactctagttcgcagagaacagaggagactctgcatgctagagtctaacctggcggcagcgcaaaagatg

SEQ ID NO: 203423 - DNA, 103 bp, Artificial Sequence
  Synthetic Polynucleotide
taatacgactcactatagggatctggagtaaggaggggggggagactctaaacagaggagatagagtatgccccccctcaacctggcggcagcgcaaaagatg

SEQ ID NO: 203424 - DNA, 103 bp, Artificial Sequence
  Synthetic Polynucleotide
taatacgactcactatagggtccatcgggtatctggagtaaggaggggggaacagaggagaccccccatgttactccagaacctggcggcagcgcaaaagatg

SEQ ID NO: 203425 - DNA, 103 bp, Artificial Sequence
  Synthetic Polynucleotide
taatacgactcactatagggtttgagaaaatccatcgggtatctggagtaaacagaggagatactccatgtacccgatgaacctggcggcagcgcaaaagatg

SEQ ID NO: 203426 - DNA, 103 bp, Artificial Sequence
  Synthetic Polynucleotide
taatacgactcactatagggctgcagttggtttgagaaaatccatcgggtaacagaggagaacccgaatgattttctcaaacctggcggcagcgcaaaagatg

SEQ ID NO: 203427 - DNA, 103 bp, Artificial Sequence
  Synthetic Polynucleotide
taatacgactcactatagggtctggacagtctgcagttggtttgagaaaaaacagaggagattttctatgaccaactgcaacctggcggcagcgcaaaagatg

SEQ ID NO: 203428 - DNA, 103 bp, Artificial Sequence
  Synthetic Polynucleotide
taatacgactcactatagggaggcacagcatctggacagtctgcagttggaacagaggagaccaactatggactgtccaaacctggcggcagcgcaaaagatg

SEQ ID NO: 203429 - DNA, 103 bp, Artificial Sequence
  Synthetic Polynucleotide
taatacgactcactatagggcagcggaggaaggcacagcatctggacagtaacagaggagaactgtcatgatgctgtgcaacctggcggcagcgcaaaagatg

SEQ ID NO: 203430 - DNA, 103 bp, Artificial Sequence
  Synthetic Polynucleotide
taatacgactcactatagggccccctgtttcagcggaggaaggcacagcaaacagaggagatgctgtatgttcctccgcaacctggcggcagcgcaaaagatg

SEQ ID NO: 203431 - DNA, 103 bp, Artificial Sequence
  Synthetic Polynucleotide
taatacgactcactatagggtccccctgcgccctcctcctcgtcctcgccaacagaggagaggcgagatggaggaggagaacctggcggcagcgcaaaagatg

SEQ ID NO: 203432 - DNA, 103 bp, Artificial Sequence
  Synthetic Polynucleotide
taatacgactcactatagggataattcgttccccctgtttcagcggaggaaacagaggagatcctccatggaaacagggaacctggcggcagcgcaaaagatg

SEQ ID NO: 203433 - DNA, 103 bp, Artificial Sequence
  Synthetic Polynucleotide
taatacgactcactatagggcaggggccagataattcgttccccctgtttaacagaggagaaaacagatggaacgaattaacctggcggcagcgcaaaagatg

SEQ ID NO: 203434 - DNA, 103 bp, Artificial Sequence
  Synthetic Polynucleotide
taatacgactcactataggggaaagccccccaggggccagataattcgttaacagaggagaaacgaaatgtctggccccaacctggcggcagcgcaaaagatg

SEQ ID NO: 203435 - DNA, 103 bp, Artificial Sequence
  Synthetic Polynucleotide
taatacgactcactatagggttgggaatctgaaagccccccaggggccagaacagaggagactggccatgggggggcttaacctggcggcagcgcaaaagatg

SEQ ID NO: 203436 - DNA, 103 bp, Artificial Sequence
  Synthetic Polynucleotide
taatacgactcactatagggccagaagaagttgggaatctgaaagcccccaacagaggagagggggcatgcagattcccaacctggcggcagcgcaaaagatg

SEQ ID NO: 203437 - DNA, 103 bp, Artificial Sequence
  Synthetic Polynucleotide
taatacgactcactatagggtccccaggctccagaagaagttgggaatctaacagaggagaagattcatgacttcttctaacctggcggcagcgcaaaagatg

SEQ ID NO: 203438 - DNA, 103 bp, Artificial Sequence
  Synthetic Polynucleotide
taatacgactcactataggggtgtgaccgatccccaggctccagaagaagaacagaggagacttcttatggagcctgggaacctggcggcagcgcaaaagatg

SEQ ID NO: 203439 - DNA, 103 bp, Artificial Sequence
  Synthetic Polynucleotide
taatacgactcactatagggccacgcaccagtgtgaccgatccccaggctaacagaggagaagcctgatgatcggtcacaacctggcggcagcgcaaaagatg

SEQ ID NO: 203440 - DNA, 103 bp, Artificial Sequence
  Synthetic Polynucleotide
taatacgactcactatagggcagtatgccaccacgcaccagtgtgaccgaaacagaggagatcggtcatgctggtgcgtaacctggcggcagcgcaaaagatg

SEQ ID NO: 203441 - DNA, 103 bp, Artificial Sequence
  Synthetic Polynucleotide
taatacgactcactatagggcttctcctcccagtatgccaccacgcaccaaacagaggagatggtgcatggtggcatacaacctggcggcagcgcaaaagatg

SEQ ID NO: 203442 - DNA, 103 bp, Artificial Sequence
  Synthetic Polynucleotide
taatacgactcactatagggctcctccacctccccctgcgccctcctcctaacagaggagaaggaggatggcgcaggggaacctggcggcagcgcaaaagatg

SEQ ID NO: 203443 - DNA, 103 bp, Artificial Sequence
  Synthetic Polynucleotide
taatacgactcactatagggccactctcgtcttctcctcccagtatgccaaacagaggagatggcatatggggaggagaaacctggcggcagcgcaaaagatg

SEQ ID NO: 203444 - DNA, 103 bp, Artificial Sequence
  Synthetic Polynucleotide
taatacgactcactatagggtagagcctccccactctcgtcttctcctccaacagaggagaggaggaatggacgagagtaacctggcggcagcgcaaaagatg

SEQ ID NO: 203445 - DNA, 103 bp, Artificial Sequence
  Synthetic Polynucleotide
taatacgactcactatagggctggacacagtagagcctccccactctcgtaacagaggagaacgagaatggggaggctcaacctggcggcagcgcaaaagatg

SEQ ID NO: 203446 - DNA, 103 bp, Artificial Sequence
  Synthetic Polynucleotide
taatacgactcactataggggagagggctcctggacacagtagagcctccaacagaggagaggaggcatgactgtgtccaacctggcggcagcgcaaaagatg

SEQ ID NO: 203447 - DNA, 103 bp, Artificial Sequence
  Synthetic Polynucleotide
taatacgactcactatagggaagatatccagagagggctcctggacacagaacagaggagactgtgtatgggagccctcaacctggcggcagcgcaaaagatg

SEQ ID NO: 203448 - DNA, 103 bp, Artificial Sequence
  Synthetic Polynucleotide
taatacgactcactatagggtagatcatagaagatatccagagagggctcaacagaggagagagcccatgctggatatcaacctggcggcagcgcaaaagatg

SEQ ID NO: 203449 - DNA, 103 bp, Artificial Sequence
  Synthetic Polynucleotide
taatacgactcactatagggtcccctgaggtagatcatagaagatatccaaacagaggagatggataatgtctatgatcaacctggcggcagcgcaaaagatg

SEQ ID NO: 203450 - DNA, 103 bp, Artificial Sequence
  Synthetic Polynucleotide
taatacgactcactatagggcaaaagccattcccctgaggtagatcatagaacagaggagactatgaatgacctcagggaacctggcggcagcgcaaaagatg

SEQ ID NO: 203451 - DNA, 103 bp, Artificial Sequence
  Synthetic Polynucleotide
taatacgactcactatagggctgtccgaggcaaaagccattcccctgaggaacagaggagacctcagatgaatggctttaacctggcggcagcgcaaaagatg

SEQ ID NO: 203452 - DNA, 103 bp, Artificial Sequence
  Synthetic Polynucleotide
taatacgactcactatagggccgaattgagctgtccgaggcaaaagccataacagaggagaatggctatggcctcggacaacctggcggcagcgcaaaagatg

SEQ ID NO: 203453 - DNA, 103 bp, Artificial Sequence
  Synthetic Polynucleotide
taatacgactcactatagggagctcgcctcctcctccacctccccctgcgaacagaggagacgcaggatgaggtggaggaacctggcggcagcgcaaaagatg

SEQ ID NO: 203454 - DNA, 103 bp, Artificial Sequence
  Synthetic Polynucleotide
taatacgactcactatagggctcttgttgtccgaattgagctgtccgaggaacagaggagacctcggatggctcaattcaacctggcggcagcgcaaaagatg

SEQ ID NO: 203455 - DNA, 103 bp, Artificial Sequence
  Synthetic Polynucleotide
taatacgactcactatagggcaccagctgactcttgttgtccgaattgagaacagaggagactcaatatggacaacaagaacctggcggcagcgcaaaagatg

SEQ ID NO: 203456 - DNA, 103 bp, Artificial Sequence
  Synthetic Polynucleotide
taatacgactcactataggggcaccttctgcaccagctgactcttgttgtaacagaggagaacaacaatggtcagctggaacctggcggcagcgcaaaagatg

SEQ ID NO: 203457 - DNA, 103 bp, Artificial Sequence
  Synthetic Polynucleotide
taatacgactcactatagggattttgctccgcaccttctgcaccagctgaaacagaggagatcagctatggcagaaggtaacctggcggcagcgcaaaagatg

SEQ ID NO: 203458 - DNA, 103 bp, Artificial Sequence
  Synthetic Polynucleotide
taatacgactcactataggggccgcagccgattttgctccgcaccttctgaacagaggagacagaagatgcggagcaaaaacctggcggcagcgcaaaagatg

SEQ ID NO: 203459 - DNA, 103 bp, Artificial Sequence
  Synthetic Polynucleotide
taatacgactcactatagggtcagctggatgccgcagccgattttgctccaacagaggagaggagcaatgtcggctgcgaacctggcggcagcgcaaaagatg

SEQ ID NO: 203460 - DNA, 103 bp, Artificial Sequence
  Synthetic Polynucleotide
taatacgactcactatagggacctcccgcgtcagctggatgccgcagccgaacagaggagacggctgatgcatccagctaacctggcggcagcgcaaaagatg

SEQ ID NO: 203461 - DNA, 103 bp, Artificial Sequence
  Synthetic Polynucleotide
taatacgactcactatagggcacaccatccacctcccgcgtcagctggataacagaggagaatccagatgacgcgggagaacctggcggcagcgcaaaagatg

SEQ ID NO: 203462 - DNA, 103 bp, Artificial Sequence
  Synthetic Polynucleotide
taatacgactcactatagggtgtacacccacacaccatccacctcccgcgaacagaggagacgcgggatgtggatggtgaacctggcggcagcgcaaaagatg

SEQ ID NO: 203463 - DNA, 103 bp, Artificial Sequence
  Synthetic Polynucleotide
taatacgactcactatagggctgctgcggttgtacacccacacaccatccaacagaggagaggatggatggtgggtgtaaacctggcggcagcgcaaaagatg

SEQ ID NO: 203464 - DNA, 103 bp, Artificial Sequence
  Synthetic Polynucleotide
taatacgactcactatagggcatcgcaccagggtctgtgggcgtggacataacagaggagaatgtccatgcccacagacaacctggcggcagcgcaaaagatg

SEQ ID NO: 203465 - DNA, 103 bp, Artificial Sequence
  Synthetic Polynucleotide
taatacgactcactataggggacggaacctggggatggtcctggtcctggaacagaggagaccaggaatgggaccatccaacctggcggcagcgcaaaagatg

SEQ ID NO: 203466 - DNA, 103 bp, Artificial Sequence
  Synthetic Polynucleotide
taatacgactcactatagggcacggggtccaggccttgcggtttctggataacagaggagaatccagatgccgcaaggcaacctggcggcagcgcaaaagatg

SEQ ID NO: 203467 - DNA, 103 bp, Artificial Sequence
  Synthetic Polynucleotide
taatacgactcactataggggcagaatttccacggggtccaggccttgcgaacagaggagacgcaagatgtggaccccgaacctggcggcagcgcaaaagatg

SEQ ID NO: 203468 - DNA, 103 bp, Artificial Sequence
  Synthetic Polynucleotide
taatacgactcactatagggtcccgctcttgcagaatttccacggggtccaacagaggagaggacccatgggaaattctaacctggcggcagcgcaaaagatg

SEQ ID NO: 203469 - DNA, 103 bp, Artificial Sequence
  Synthetic Polynucleotide
taatacgactcactatagggaagtctgtattcccgctcttgcagaatttcaacagaggagagaaattatgcaagagcggaacctggcggcagcgcaaaagatg

SEQ ID NO: 203470 - DNA, 103 bp, Artificial Sequence
  Synthetic Polynucleotide
taatacgactcactatagggtgcgggcctgaagtctgtattcccgctcttaacagaggagaaagagcatgaatacagacaacctggcggcagcgcaaaagatg

SEQ ID NO: 203471 - DNA, 103 bp, Artificial Sequence
  Synthetic Polynucleotide
taatacgactcactatagggctatgagctatgcgggcctgaagtctgtataacagaggagaatacagatgtcaggcccgaacctggcggcagcgcaaaagatg

SEQ ID NO: 203472 - DNA, 103 bp, Artificial Sequence
  Synthetic Polynucleotide
taatacgactcactatagggttcttgtatcctatgagctatgcgggcctgaacagaggagacaggccatgatagctcataacctggcggcagcgcaaaagatg

SEQ ID NO: 203473 - DNA, 103 bp, Artificial Sequence
  Synthetic Polynucleotide
taatacgactcactataggggattttccagttcttgtatcctatgagctaaacagaggagatagctcatgggatacaagaacctggcggcagcgcaaaagatg

SEQ ID NO: 203474 - DNA, 103 bp, Artificial Sequence
  Synthetic Polynucleotide
taatacgactcactataggggagccaggcagattttccagttcttgtatcaacagaggagagatacaatgactggaaaaaacctggcggcagcgcaaaagatg

SEQ ID NO: 203475 - DNA, 103 bp, Artificial Sequence
  Synthetic Polynucleotide
taatacgactcactatagggtggtggcaaagagccaggcagattttccagaacagaggagactggaaatgctgcctggcaacctggcggcagcgcaaaagatg

SEQ ID NO: 203476 - DNA, 103 bp, Artificial Sequence
  Synthetic Polynucleotide
taatacgactcactatagggtcatgctgtggacggaacctggggatggtcaacagaggagagaccatatgcaggttccgaacctggcggcagcgcaaaagatg

SEQ ID NO: 203477 - DNA, 103 bp, Artificial Sequence
  Synthetic Polynucleotide
taatacgactcactatagggttcttaaatctggtggcaaagagccaggcaaacagaggagatgcctgatgctttgccacaacctggcggcagcgcaaaagatg

SEQ ID NO: 203478 - DNA, 103 bp, Artificial Sequence
  Synthetic Polynucleotide
taatacgactcactataggggttgctttggttcttaaatctggtggcaaaaacagaggagatttgccatgagatttaagaacctggcggcagcgcaaaagatg

SEQ ID NO: 203479 - DNA, 103 bp, Artificial Sequence
  Synthetic Polynucleotide
taatacgactcactatagggtagttccacggttgctttggttcttaaatcaacagaggagagatttaatgaccaaagcaaacctggcggcagcgcaaaagatg

SEQ ID NO: 203480 - DNA, 103 bp, Artificial Sequence
  Synthetic Polynucleotide
taatacgactcactataggggaagtgcttttagttccacggttgctttggaacagaggagaccaaagatgccgtggaacaacctggcggcagcgcaaaagatg

SEQ ID NO: 203481 - DNA, 103 bp, Artificial Sequence
  Synthetic Polynucleotide
taatacgactcactatagggttgagtaaccgaagtgcttttagttccacgaacagaggagacgtggaatgaaaagcactaacctggcggcagcgcaaaagatg

SEQ ID NO: 203482 - DNA, 103 bp, Artificial Sequence
  Synthetic Polynucleotide
taatacgactcactatagggacgctggaaattgagtaaccgaagtgctttaacagaggagaaaagcaatgcggttactcaacctggcggcagcgcaaaagatg

SEQ ID NO: 203483 - DNA, 103 bp, Artificial Sequence
  Synthetic Polynucleotide
taatacgactcactataggggtctcagctgacgctggaaattgagtaaccaacagaggagaggttacatgatttccagcaacctggcggcagcgcaaaagatg

SEQ ID NO: 203484 - DNA, 103 bp, Artificial Sequence
  Synthetic Polynucleotide
taatacgactcactatagggaccacctcctgtctcagctgacgctggaaaaacagaggagatttccaatgtcagctgagaacctggcggcagcgcaaaagatg

SEQ ID NO: 203485 - DNA, 103 bp, Artificial Sequence
  Synthetic Polynucleotide
taatacgactcactatagggcatgcaggccaccacctcctgtctcagctgaacagaggagacagctgatgcaggaggtgaacctggcggcagcgcaaaagatg

SEQ ID NO: 203486 - DNA, 103 bp, Artificial Sequence
  Synthetic Polynucleotide
taatacgactcactatagggtgtccctgcgcatgcaggccaccacctcctaacagaggagaaggaggatgtggcctgcaaacctggcggcagcgcaaaagatg

SEQ ID NO: 203487 - DNA, 103 bp, Artificial Sequence
  Synthetic Polynucleotide
taatacgactcactatagggcttggccccatcatgctgtggacggaacctaacagaggagaaggttcatgccacagcataacctggcggcagcgcaaaagatg

SEQ ID NO: 203488 - DNA, 103 bp, Artificial Sequence
  Synthetic Polynucleotide
taatacgactcactatagggtccagggtcgtgtccctgcgcatgcaggccaacagaggagaggcctgatggcgcagggaaacctggcggcagcgcaaaagatg

SEQ ID NO: 203489 - DNA, 103 bp, Artificial Sequence
  Synthetic Polynucleotide
taatacgactcactataggggagagccgtctccagggtcgtgtccctgcgaacagaggagacgcaggatgacgaccctgaacctggcggcagcgcaaaagatg

SEQ ID NO: 203490 - DNA, 103 bp, Artificial Sequence
  Synthetic Polynucleotide
taatacgactcactatagggctttggagttgagagccgtctccagggtcgaacagaggagacgacccatgagacggctcaacctggcggcagcgcaaaagatg

SEQ ID NO: 203491 - DNA, 103 bp, Artificial Sequence
  Synthetic Polynucleotide
taatacgactcactatagggcgtttgtatgctttggagttgagagccgtcaacagaggagagacggcatgcaactccaaaacctggcggcagcgcaaaagatg

SEQ ID NO: 203492 - DNA, 103 bp, Artificial Sequence
  Synthetic Polynucleotide
taatacgactcactataggggcgcttgctccgtttgtatgctttggagttaacagaggagaaactccatggcatacaaaaacctggcggcagcgcaaaagatg

SEQ ID NO: 203493 - DNA, 103 bp, Artificial Sequence
  Synthetic Polynucleotide
taatacgactcactatagggtcagagtctggcgcttgctccgtttgtatgaacagaggagacatacaatgggagcaagcaacctggcggcagcgcaaaagatg

SEQ ID NO: 203494 - DNA, 103 bp, Artificial Sequence
  Synthetic Polynucleotide
taatacgactcactatagggcgagcttctctcagagtctggcgcttgctcaacagaggagagagcaaatgccagactctaacctggcggcagcgcaaaagatg

SEQ ID NO: 203495 - DNA, 103 bp, Artificial Sequence
  Synthetic Polynucleotide
taatacgactcactatagggctcggtcatgcgagcttctctcagagtctgaacagaggagacagactatgagagaagctaacctggcggcagcgcaaaagatg

SEQ ID NO: 203496 - DNA, 103 bp, Artificial Sequence
  Synthetic Polynucleotide
taatacgactcactatagggtctccagcttctcggtcatgcgagcttctcaacagaggagagagaagatggcatgaccgaacctggcggcagcgcaaaagatg

SEQ ID NO: 203497 - DNA, 103 bp, Artificial Sequence
  Synthetic Polynucleotide
taatacgactcactatagggttctgctgcttctccagcttctcggtcatgaacagaggagacatgacatggaagctggaaacctggcggcagcgcaaaagatg

SEQ ID NO: 203498 - DNA, 103 bp, Artificial Sequence
  Synthetic Polynucleotide
taatacgactcactatagggaggtccaggacttggccccatcatgctgtgaacagaggagacacagcatgatggggccaaacctggcggcagcgcaaaagatg

SEQ ID NO: 203499 - DNA, 103 bp, Artificial Sequence
  Synthetic Polynucleotide
taatacgactcactatagggctgctcaatcttctgctgcttctccagcttaacagaggagaaagctgatgaagcagcagaacctggcggcagcgcaaaagatg

SEQ ID NO: 203500 - DNA, 103 bp, Artificial Sequence
  Synthetic Polynucleotide
taatacgactcactataggggtttcctctcctgctcaatcttctgctgctaacagaggagaagcagcatgagattgagcaacctggcggcagcgcaaaagatg

SEQ ID NO: 203501 - DNA, 103 bp, Artificial Sequence
  Synthetic Polynucleotide
taatacgactcactatagggttctgacggcgtttcctctcctgctcaatcaacagaggagagattgaatgggagaggaaaacctggcggcagcgcaaaagatg

SEQ ID NO: 203502 - DNA, 103 bp, Artificial Sequence
  Synthetic Polynucleotide
taatacgactcactatagggttcctggtgtttctgacggcgtttcctctcaacagaggagagagaggatgcgccgtcagaacctggcggcagcgcaaaagatg

SEQ ID NO: 203503 - DNA, 103 bp, Artificial Sequence
  Synthetic Polynucleotide
taatacgactcactatagggtgttcaggtattcctggtgtttctgacggcaacagaggagagccgtcatgaacaccaggaacctggcggcagcgcaaaagatg

SEQ ID NO: 203504 - DNA, 103 bp, Artificial Sequence
  Synthetic Polynucleotide
taatacgactcactatagggtgcaaaatactgttcaggtattcctggtgtaacagaggagaacaccaatgatacctgaaaacctggcggcagcgcaaaagatg

SEQ ID NO: 203505 - DNA, 103 bp, Artificial Sequence
  Synthetic Polynucleotide
taatacgactcactatagggttttgcatgttgcaaaatactgttcaggtaaacagaggagatacctgatgagtattttgaacctggcggcagcgcaaaagatg

SEQ ID NO: 203506 - DNA, 103 bp, Artificial Sequence
  Synthetic Polynucleotide
taatacgactcactatagggccttaaaatcttttgcatgttgcaaaatacaacagaggagagtatttatgaacatgcaaaacctggcggcagcgcaaaagatg

SEQ ID NO: 203507 - DNA, 103 bp, Artificial Sequence
  Synthetic Polynucleotide
taatacgactcactatagggcgatgatattccttaaaatcttttgcatgtaacagaggagaacatgcatgagattttaaaacctggcggcagcgcaaaagatg

SEQ ID NO: 203508 - DNA, 103 bp, Artificial Sequence
  Synthetic Polynucleotide
taatacgactcactatagggggccacagaccgatgatattccttaaaatcaacagaggagagattttatggaatatcataacctggcggcagcgcaaaagatg

SEQ ID NO: 203509 - DNA, 103 bp, Artificial Sequence
  Synthetic Polynucleotide
taatacgactcactatagggagacacttggaggtccaggacttggccccaaacagaggagatggggcatggtcctggacaacctggcggcagcgcaaaagatg

SEQ ID NO: 203510 - DNA, 103 bp, Artificial Sequence
  Synthetic Polynucleotide
taatacgactcactatagggggatctttccggccacagaccgatgatattaacagaggagaaatatcatgggtctgtggaacctggcggcagcgcaaaagatg

SEQ ID NO: 203511 - DNA, 103 bp, Artificial Sequence
  Synthetic Polynucleotide
taatacgactcactataggggagagcttctggatctttccggccacagacaacagaggagagtctgtatgcggaaagataacctggcggcagcgcaaaagatg

SEQ ID NO: 203512 - DNA, 103 bp, Artificial Sequence
  Synthetic Polynucleotide
taatacgactcactatagggcactgctttggagagcttctggatctttccaacagaggagaggaaagatgcagaagctcaacctggcggcagcgcaaaagatg

SEQ ID NO: 203513 - DNA, 103 bp, Artificial Sequence
  Synthetic Polynucleotide
taatacgactcactataggggccaagttgccactgctttggagagcttctaacagaggagaagaagcatgccaaagcagaacctggcggcagcgcaaaagatg

SEQ ID NO: 203514 - DNA, 103 bp, Artificial Sequence
  Synthetic Polynucleotide
taatacgactcactataggggtgttggcatgccaagttgccactgctttgaacagaggagacaaagcatgggcaacttgaacctggcggcagcgcaaaagatg

SEQ ID NO: 203515 - DNA, 103 bp, Artificial Sequence
  Synthetic Polynucleotide
taatacgactcactatagggctctctttcagtgttggcatgccaagttgcaacagaggagagcaactatgcatgccaacaacctggcggcagcgcaaaagatg

SEQ ID NO: 203516 - DNA, 103 bp, Artificial Sequence
  Synthetic Polynucleotide
taatacgactcactatagggccttcttctgctctctttcagtgttggcataacagaggagaatgccaatgctgaaagagaacctggcggcagcgcaaaagatg

SEQ ID NO: 203517 - DNA, 103 bp, Artificial Sequence
  Synthetic Polynucleotide
taatacgactcactatagggcgctctgtctccttcttctgctctctttcaaacagaggagatgaaagatggcagaagaaaacctggcggcagcgcaaaagatg

SEQ ID NO: 203518 - DNA, 103 bp, Artificial Sequence
  Synthetic Polynucleotide
taatacgactcactatagggcttttcaatccgctctgtctccttcttctgaacagaggagacagaagatggagacagagaacctggcggcagcgcaaaagatg

SEQ ID NO: 203519 - DNA, 103 bp, Artificial Sequence
  Synthetic Polynucleotide
taatacgactcactataggggcattctctccttttcaatccgctctgtctaacagaggagaagacagatgggattgaaaaacctggcggcagcgcaaaagatg

SEQ ID NO: 203520 - DNA, 103 bp, Artificial Sequence
  Synthetic Polynucleotide
taatacgactcactatagggataggatgggagacacttggaggtccaggaaacagaggagatcctggatgtccaagtgtaacctggcggcagcgcaaaagatg

SEQ ID NO: 203521 - DNA, 103 bp, Artificial Sequence
  Synthetic Polynucleotide
taatacgactcactatagggatcagtcgccgcattctctccttttcaatcaacagaggagagattgaatgggagagaataacctggcggcagcgcaaaagatg

SEQ ID NO: 203522 - DNA, 103 bp, Artificial Sequence
  Synthetic Polynucleotide
taatacgactcactatagggatcttcagccatcagtcgccgcattctctcaacagaggagagagagaatgcggcgactgaacctggcggcagcgcaaaagatg

SEQ ID NO: 203523 - DNA, 103 bp, Artificial Sequence
  Synthetic Polynucleotide
taatacgactcactatagggaaccctcctcatcttcagccatcagtcgccaacagaggagaggcgacatgtggctgaagaacctggcggcagcgcaaaagatg

SEQ ID NO: 203524 - DNA, 103 bp, Artificial Sequence
  Synthetic Polynucleotide
taatacgactcactatagggagttttctataaccctcctcatcttcagccaacagaggagaggctgaatgtgaggagggaacctggcggcagcgcaaaagatg

SEQ ID NO: 203525 - DNA, 103 bp, Artificial Sequence
  Synthetic Polynucleotide
taatacgactcactatagggttgatcaatcagttttctataaccctcctcaacagaggagagaggagatgtatagaaaaaacctggcggcagcgcaaaagatg

SEQ ID NO: 203526 - DNA, 103 bp, Artificial Sequence
  Synthetic Polynucleotide
taatacgactcactatagggtgtctttcttttgatcaatcagttttctataacagaggagaatagaaatgtgattgatcaacctggcggcagcgcaaaagatg

SEQ ID NO: 203527 - DNA, 103 bp, Artificial Sequence
  Synthetic Polynucleotide
taatacgactcactataggggctaaacgcctgtctttcttttgatcaatcaacagaggagagattgaatgaaagaaagaaacctggcggcagcgcaaaagatg

SEQ ID NO: 203528 - DNA, 103 bp, Artificial Sequence
  Synthetic Polynucleotide
taatacgactcactatagggcaaaaggtaagctaaacgcctgtctttcttaacagaggagaaagaaaatgaggcgtttaaacctggcggcagcgcaaaagatg

SEQ ID NO: 203529 - DNA, 103 bp, Artificial Sequence
  Synthetic Polynucleotide
taatacgactcactatagggcggtctgctgcaaaaggtaagctaaacgccaacagaggagaggcgttatgcttacctttaacctggcggcagcgcaaaagatg

SEQ ID NO: 203530 - DNA, 103 bp, Artificial Sequence
  Synthetic Polynucleotide
taatacgactcactatagggacatactcatcggtctgctgcaaaaggtaaaacagaggagattacctatggcagcagacaacctggcggcagcgcaaaagatg

SEQ ID NO: 203531 - DNA, 103 bp, Artificial Sequence
  Synthetic Polynucleotide
taatacgactcactatagggcatcgtcggcataggatgggagacacttggaacagaggagaccaagtatgtcccatcctaacctggcggcagcgcaaaagatg

SEQ ID NO: 203532 - DNA, 103 bp, Artificial Sequence
  Synthetic Polynucleotide
taatacgactcactatagggcagattggctacatactcatcggtctgctgaacagaggagacagcagatggatgagtataacctggcggcagcgcaaaagatg

SEQ ID NO: 203533 - DNA, 103 bp, Artificial Sequence
  Synthetic Polynucleotide
taatacgactcactatagggccagattggtcagattggctacatactcataacagaggagaatgagtatgtagccaatcaacctggcggcagcgcaaaagatg

SEQ ID NO: 203534 - DNA, 103 bp, Artificial Sequence
  Synthetic Polynucleotide
taatacgactcactatagggtgctcccaaaccagattggtcagattggctaacagaggagaagccaaatggaccaatctaacctggcggcagcgcaaaagatg

SEQ ID NO: 203535 - DNA, 103 bp, Artificial Sequence
  Synthetic Polynucleotide
taatacgactcactatagggggcttgcttgtgctcccaaaccagattggtaacagaggagaaccaatatggtttgggagaacctggcggcagcgcaaaagatg

SEQ ID NO: 203536 - DNA, 103 bp, Artificial Sequence
  Synthetic Polynucleotide
taatacgactcactatagggtggctgcctgggcttgcttgtgctcccaaaaacagaggagatttgggatgacaagcaagaacctggcggcagcgcaaaagatg

SEQ ID NO: 203537 - DNA, 103 bp, Artificial Sequence
  Synthetic Polynucleotide
taatacgactcactatagggttcttctctttggctgcctgggcttgcttgaacagaggagacaagcaatgccaggcagcaacctggcggcagcgcaaaagatg

SEQ ID NO: 203538 - DNA, 103 bp, Artificial Sequence
  Synthetic Polynucleotide
taatacgactcactatagggcctcctcttcttcttctctttggctgcctgaacagaggagacaggcaatgaaagagaagaacctggcggcagcgcaaaagatg

SEQ ID NO: 203539 - DNA, 103 bp, Artificial Sequence
  Synthetic Polynucleotide
taatacgactcactatagggtcttcctcctcctcctcttcttcttctcttaacagaggagaaagagaatgagaagaggaaacctggcggcagcgcaaaagatg

SEQ ID NO: 203540 - DNA, 103 bp, Artificial Sequence
  Synthetic Polynucleotide
taatacgactcactatagggtcagccttcttcttcctcctcctcctcttcaacagaggagagaagagatggaggaggaaaacctggcggcagcgcaaaagatg

SEQ ID NO: 203541 - DNA, 103 bp, Artificial Sequence
  Synthetic Polynucleotide
taatacgactcactatagggtgcattctcctcagccttcttcttcctcctaacagaggagaaggaggatgaagaaggctaacctggcggcagcgcaaaagatg

SEQ ID NO: 203542 - DNA, 103 bp, Artificial Sequence
  Synthetic Polynucleotide
taatacgactcactatagggctgtggaccccatcgtcggcataggatgggaacagaggagacccatcatgtgccgacgaaacctggcggcagcgcaaaagatg

SEQ ID NO: 203543 - DNA, 103 bp, Artificial Sequence
  Synthetic Polynucleotide
taatacgactcactatagggccccaccctctgcattctcctcagccttctaacagaggagaagaaggatgaggagaatgaacctggcggcagcgcaaaagatg

SEQ ID NO: 203544 - DNA, 103 bp, Artificial Sequence
  Synthetic Polynucleotide
taatacgactcactatagggagggcagactccccaccctctgcattctccaacagaggagaggagaaatgagagggtggaacctggcggcagcgcaaaagatg

SEQ ID NO: 203545 - DNA, 103 bp, Artificial Sequence
  Synthetic Polynucleotide
taatacgactcactatagggatccggtcccagggcagactccccaccctcaacagaggagagagggtatggagtctgccaacctggcggcagcgcaaaagatg

SEQ ID NO: 203546 - DNA, 103 bp, Artificial Sequence
  Synthetic Polynucleotide
taatacgactcactatagggtgggctctccatccggtcccagggcagactaacagaggagaagtctgatgtgggaccggaacctggcggcagcgcaaaagatg

SEQ ID NO: 203547 - DNA, 103 bp, Artificial Sequence
  Synthetic Polynucleotide
taatacgactcactatagggctctcatctatgggctctccatccggtcccaacagaggagagggaccatgtggagagccaacctggcggcagcgcaaaagatg

SEQ ID NO: 203548 - DNA, 103 bp, Artificial Sequence
  Synthetic Polynucleotide
taatacgactcactatagggcatctggctgctctcatctatgggctctccaacagaggagaggagagatgatagatgagaacctggcggcagcgcaaaagatg

SEQ ID NO: 203549 - DNA, 103 bp, Artificial Sequence
  Synthetic Polynucleotide
taatacgactcactatagggggaggtcactcatctggctgctctcatctaaacagaggagatagatgatggcagccagaaacctggcggcagcgcaaaagatg

SEQ ID NO: 203550 - DNA, 103 bp, Artificial Sequence
  Synthetic Polynucleotide
taatacgactcactatagggactttgacagggaggtcactcatctggctgaacagaggagacagccaatggagtgacctaacctggcggcagcgcaaaagatg

SEQ ID NO: 203551 - DNA, 103 bp, Artificial Sequence
  Synthetic Polynucleotide
taatacgactcactatagggtgtgtgagtcactttgacagggaggtcactaacagaggagaagtgacatgcctgtcaaaaacctggcggcagcgcaaaagatg

SEQ ID NO: 203552 - DNA, 103 bp, Artificial Sequence
  Synthetic Polynucleotide
taatacgactcactatagggtgccggtttctgtgtgagtcactttgacagaacagaggagactgtcaatgtgactcacaaacctggcggcagcgcaaaagatg

SEQ ID NO: 203553 - DNA, 103 bp, Artificial Sequence
  Synthetic Polynucleotide
taatacgactcactatagggtgtgggaagtctgtggaccccatcgtcggcaacagaggagagccgacatgggggtccacaacctggcggcagcgcaaaagatg

SEQ ID NO: 203554 - DNA, 103 bp, Artificial Sequence
  Synthetic Polynucleotide
taatacgactcactatagggaacagaaccttgccggtttctgtgtgagtcaacagaggagagactcaatgagaaaccggaacctggcggcagcgcaaaagatg

SEQ ID NO: 203555 - DNA, 103 bp, Artificial Sequence
  Synthetic Polynucleotide
taatacgactcactatagggttctggtccgaacagaaccttgccggtttcaacagaggagagaaaccatgaaggttctgaacctggcggcagcgcaaaagatg

SEQ ID NO: 203556 - DNA, 103 bp, Artificial Sequence
  Synthetic Polynucleotide
taatacgactcactatagggctttgggtgcttctggtccgaacagaacctaacagaggagaaggttcatgtcggaccagaacctggcggcagcgcaaaagatg

SEQ ID NO: 203557 - DNA, 103 bp, Artificial Sequence
  Synthetic Polynucleotide
taatacgactcactatagggagctgacttgctttgggtgcttctggtccgaacagaggagacggaccatgagcacccaaaacctggcggcagcgcaaaagatg

SEQ ID NO: 203558 - DNA, 103 bp, Artificial Sequence
  Synthetic Polynucleotide
taatacgactcactatagggccaggcgtccagctgacttgctttgggtgcaacagaggagagcacccatggcaagtcagaacctggcggcagcgcaaaagatg

SEQ ID NO: 203559 - DNA, 103 bp, Artificial Sequence
  Synthetic Polynucleotide
taatacgactcactatagggtcatttccagccaggcgtccagctgacttgaacagaggagacaagtcatgtggacgcctaacctggcggcagcgcaaaagatg

SEQ ID NO: 203560 - DNA, 103 bp, Artificial Sequence
  Synthetic Polynucleotide
taatacgactcactatagggtaaccaggattcatttccagccaggcgtccaacagaggagaggacgcatggctggaaataacctggcggcagcgcaaaagatg

SEQ ID NO: 203561 - DNA, 103 bp, Artificial Sequence
  Synthetic Polynucleotide
taatacgactcactatagggggcaacttcataaccaggattcatttccagaacagaggagactggaaatgaatcctggtaacctggcggcagcgcaaaagatg

SEQ ID NO: 203562 - DNA, 103 bp, Artificial Sequence
  Synthetic Polynucleotide
taatacgactcactatagggcagatctaggggcaacttcataaccaggataacagaggagaatcctgatgatgaagttgaacctggcggcagcgcaaaagatg

SEQ ID NO: 203563 - DNA, 103 bp, Artificial Sequence
  Synthetic Polynucleotide
taatacgactcactatagggtcttcactgtcagatctaggggcaacttcaaacagaggagatgaagtatgccctagatcaacctggcggcagcgcaaaagatg

SEQ ID NO: 203564 - DNA, 103 bp, Artificial Sequence
  Synthetic Polynucleotide
taatacgactcactatagggcatgccttcctgtgggaagtctgtggacccaacagaggagagggtccatggacttcccaaacctggcggcagcgcaaaagatg

SEQ ID NO: 203565 - DNA, 103 bp, Artificial Sequence
  Synthetic Polynucleotide
taatacgactcactatagggagaatcactctcttcactgtcagatctaggaacagaggagacctagaatggacagtgaaaacctggcggcagcgcaaaagatg

SEQ ID NO: 203566 - DNA, 103 bp, Artificial Sequence
  Synthetic Polynucleotide
taatacgactcactatagggcctcataatcagaatcactctcttcactgtaacagaggagaacagtgatgagagtgattaacctggcggcagcgcaaaagatg

SEQ ID NO: 203567 - DNA, 103 bp, Artificial Sequence
  Synthetic Polynucleotide
taatacgactcactatagggtcatcctcttcctcataatcagaatcactcaacagaggagagagtgaatgtgattatgaaacctggcggcagcgcaaaagatg

SEQ ID NO: 203568 - DNA, 103 bp, Artificial Sequence
  Synthetic Polynucleotide
taatacgactcactatagggctcttcttcctcatcctcttcctcataatcaacagaggagagattatatggaagaggataacctggcggcagcgcaaaagatg

SEQ ID NO: 203569 - DNA, 103 bp, Artificial Sequence
  Synthetic Polynucleotide
taatacgactcactataggggcctactggactcttcttcctcatcctcttaacagaggagaaagaggatgaggaagaagaacctggcggcagcgcaaaagatg

SEQ ID NO: 203570 - DNA, 103 bp, Artificial Sequence
  Synthetic Polynucleotide
taatacgactcactatagggtcggtttcctgcctactggactcttcttccaacagaggagaggaagaatggtccagtagaacctggcggcagcgcaaaagatg

SEQ ID NO: 203571 - DNA, 103 bp, Artificial Sequence
  Synthetic Polynucleotide
taatacgactcactatagggtattttctcttcggtttcctgcctactggaaacagaggagatccagtatgcaggaaaccaacctggcggcagcgcaaaagatg

SEQ ID NO: 203572 - DNA, 103 bp, Artificial Sequence
  Synthetic Polynucleotide
taatacgactcactataggggatccaggagtattttctcttcggtttcctaacagaggagaaggaaaatgaagagaaaaaacctggcggcagcgcaaaagatg

SEQ ID NO: 203573 - DNA, 103 bp, Artificial Sequence
  Synthetic Polynucleotide
taatacgactcactatagggtcgctatttggatccaggagtattttctctaacagaggagaagagaaatgactcctggaaacctggcggcagcgcaaaagatg

SEQ ID NO: 203574 - DNA, 103 bp, Artificial Sequence
  Synthetic Polynucleotide
taatacgactcactatagggagaaacttcttcgctatttggatccaggagaacagaggagactcctgatgccaaatagcaacctggcggcagcgcaaaagatg

SEQ ID NO: 203575 - DNA, 103 bp, Artificial Sequence
  Synthetic Polynucleotide
taatacgactcactatagggctgggtggggcatcgcaccagggtctgtggaacagaggagaccacagatgctggtgcgaaacctggcggcagcgcaaaagatg

SEQ ID NO: 203576 - DNA, 103 bp, Artificial Sequence
  Synthetic Polynucleotide
taatacgactcactataggggcatttgatgcatgccttcctgtgggaagtaacagaggagaacttccatgaggaaggcaaacctggcggcagcgcaaaagatg

SEQ ID NO: 203577 - DNA, 103 bp, Artificial Sequence
  Synthetic Polynucleotide
taatacgactcactatagggcatccttctcagaaacttcttcgctatttgaacagaggagacaaataatgaagaagtttaacctggcggcagcgcaaaagatg

SEQ ID NO: 203578 - DNA, 103 bp, Artificial Sequence
  Synthetic Polynucleotide
taatacgactcactatagggatctgcttagcatccttctcagaaacttctaacagaggagaagaagtatgtgagaaggaaacctggcggcagcgcaaaagatg

SEQ ID NO: 203579 - DNA, 103 bp, Artificial Sequence
  Synthetic Polynucleotide
taatacgactcactatagggtgtctcaatgatctgcttagcatccttctcaacagaggagagagaagatggctaagcagaacctggcggcagcgcaaaagatg

SEQ ID NO: 203580 - DNA, 103 bp, Artificial Sequence
  Synthetic Polynucleotide
taatacgactcactatagggcttgcttagctgtctcaatgatctgcttagaacagaggagactaagcatgtcattgagaaacctggcggcagcgcaaaagatg

SEQ ID NO: 203581 - DNA, 103 bp, Artificial Sequence
  Synthetic Polynucleotide
taatacgactcactatagggtcatccacgtcttgcttagctgtctcaatgaacagaggagacattgaatgagctaagcaaacctggcggcagcgcaaaagatg

SEQ ID NO: 203582 - DNA, 103 bp, Artificial Sequence
  Synthetic Polynucleotide
taatacgactcactataggggctgtattcatcatccacgtcttgcttagcaacagaggagagctaagatggacgtggataacctggcggcagcgcaaaagatg

SEQ ID NO: 203583 - DNA, 103 bp, Artificial Sequence
  Synthetic Polynucleotide
taatacgactcactatagggtgtactgcatgctgtattcatcatccacgtaacagaggagaacgtggatgatgaatacaaacctggcggcagcgcaaaagatg

SEQ ID NO: 203584 - DNA, 103 bp, Artificial Sequence
  Synthetic Polynucleotide
taatacgactcactatagggcccctggcactgtactgcatgctgtattcaaacagaggagatgaataatgcatgcagtaaacctggcggcagcgcaaaagatg

SEQ ID NO: 203585 - DNA, 103 bp, Artificial Sequence
  Synthetic Polynucleotide
taatacgactcactatagggggactgggagcccctggcactgtactgcataacagaggagaatgcagatgagtgccaggaacctggcggcagcgcaaaagatg

SEQ ID NO: 203586 - DNA, 103 bp, Artificial Sequence
  Synthetic Polynucleotide
taatacgactcactatagggcggtgtagtaggactgggagcccctggcacaacagaggagagtgccaatggctcccagtaacctggcggcagcgcaaaagatg

SEQ ID NO: 203587 - DNA, 103 bp, Artificial Sequence
  Synthetic Polynucleotide
taatacgactcactatagggatgggcttatgcatttgatgcatgccttccaacagaggagaggaaggatggcatcaaataacctggcggcagcgcaaaagatg

SEQ ID NO: 203588 - DNA, 103 bp, Artificial Sequence
  Synthetic Polynucleotide
taatacgactcactataggggcatgagccacggtgtagtaggactgggagaacagaggagactcccaatgctactacacaacctggcggcagcgcaaaagatg

SEQ ID NO: 203589 - DNA, 103 bp, Artificial Sequence
  Synthetic Polynucleotide
taatacgactcactatagggctccgagatggcatgagccacggtgtagtaaacagaggagatactacatggtggctcataacctggcggcagcgcaaaagatg

SEQ ID NO: 203590 - DNA, 103 bp, Artificial Sequence
  Synthetic Polynucleotide
taatacgactcactatagggtctccaccctctccgagatggcatgagccaaacagaggagatggctcatgccatctcggaacctggcggcagcgcaaaagatg

SEQ ID NO: 203591 - DNA, 103 bp, Artificial Sequence
  Synthetic Polynucleotide
taatacgactcactataggggcagactgtttctccaccctctccgagatgaacagaggagacatctcatggagggtggaaacctggcggcagcgcaaaagatg

SEQ ID NO: 203592 - DNA, 103 bp, Artificial Sequence
  Synthetic Polynucleotide
taatacgactcactatagggaattaggagggcagactgtttctccaccctaacagaggagaagggtgatgaaacagtctaacctggcggcagcgcaaaagatg

SEQ ID NO: 203593 - DNA, 103 bp, Artificial Sequence
  Synthetic Polynucleotide
taatacgactcactataggggggtcccattaattaggagggcagactgttaacagaggagaaacagtatgccctcctaaaacctggcggcagcgcaaaagatg

SEQ ID NO: 203594 - DNA, 103 bp, Artificial Sequence
  Synthetic Polynucleotide
taatacgactcactatagggtaatgctttagggtcccattaattaggaggaacagaggagacctcctatgtaatgggacaacctggcggcagcgcaaaagatg

SEQ ID NO: 203595 - DNA, 103 bp, Artificial Sequence
  Synthetic Polynucleotide
taatacgactcactatagggctggagctggtaatgctttagggtcccattaacagaggagaaatgggatgctaaagcataacctggcggcagcgcaaaagatg

SEQ ID NO: 203596 - DNA, 103 bp, Artificial Sequence
  Synthetic Polynucleotide
taatacgactcactatagggattccaggccctggagctggtaatgctttaaacagaggagataaagcatgaccagctccaacctggcggcagcgcaaaagatg

SEQ ID NO: 203597 - DNA, 103 bp, Artificial Sequence
  Synthetic Polynucleotide
taatacgactcactataggggaaaccatccattccaggccctggagctggaacagaggagaccagctatggggcctggaaacctggcggcagcgcaaaagatg

SEQ ID NO: 203598 - DNA, 103 bp, Artificial Sequence
  Synthetic Polynucleotide
taatacgactcactatagggtataccatcgatgggcttatgcatttgatgaacagaggagacatcaaatgcataagcccaacctggcggcagcgcaaaagatg

SEQ ID NO: 203599 - DNA, 103 bp, Artificial Sequence
  Synthetic Polynucleotide
taatacgactcactatagggattatacagggaaaccatccattccaggccaacagaggagaggcctgatgtggatggttaacctggcggcagcgcaaaagatg

SEQ ID NO: 203600 - DNA, 103 bp, Artificial Sequence
  Synthetic Polynucleotide
taatacgactcactatagggtcaagttgttattatacagggaaaccatccaacagaggagaggatggatgccctgtataaacctggcggcagcgcaaaagatg

SEQ ID NO: 203601 - DNA, 103 bp, Artificial Sequence
  Synthetic Polynucleotide
taatacgactcactatagggaagattccgttcaagttgttattatacaggaacagaggagacctgtaatgtaacaacttaacctggcggcagcgcaaaagatg

SEQ ID NO: 203602 - DNA, 103 bp, Artificial Sequence
  Synthetic Polynucleotide
taatacgactcactatagggttcatcggctaagattccgttcaagttgttaacagaggagaaacaacatgaacggaatcaacctggcggcagcgcaaaagatg

SEQ ID NO: 203603 - DNA, 103 bp, Artificial Sequence
  Synthetic Polynucleotide
taatacgactcactatagggcaagccccatttcatcggctaagattccgtaacagaggagaacggaaatgtagccgatgaacctggcggcagcgcaaaagatg

SEQ ID NO: 203604 - DNA, 103 bp, Artificial Sequence
  Synthetic Polynucleotide
taatacgactcactatagggatggtctttccaagccccatttcatcggctaacagaggagaagccgaatgaatggggctaacctggcggcagcgcaaaagatg

SEQ ID NO: 203605 - DNA, 103 bp, Artificial Sequence
  Synthetic Polynucleotide
taatacgactcactatagggaatggtctgtatggtctttccaagccccataacagaggagaatggggatgggaaagaccaacctggcggcagcgcaaaagatg

SEQ ID NO: 203606 - DNA, 103 bp, Artificial Sequence
  Synthetic Polynucleotide
taatacgactcactatagggtgatgagtgcaatggtctgtatggtctttcaacagaggagagaaagaatgtacagaccaaacctggcggcagcgcaaaagatg

SEQ ID NO: 203607 - DNA, 103 bp, Artificial Sequence
  Synthetic Polynucleotide
taatacgactcactatagggatcagataagtgatgagtgcaatggtctgtaacagaggagaacagacatgtgcactcataacctggcggcagcgcaaaagatg

SEQ ID NO: 203608 - DNA, 103 bp, Artificial Sequence
  Synthetic Polynucleotide
taatacgactcactatagggtttgtgctccatcagataagtgatgagtgcaacagaggagagcactcatgacttatctgaacctggcggcagcgcaaaagatg

SEQ ID NO: 203609 - DNA, 103 bp, Artificial Sequence
  Synthetic Polynucleotide
taatacgactcactatagggccttgtcatgtataccatcgatgggcttataacagaggagaataagcatgtcgatggtaaacctggcggcagcgcaaaagatg

SEQ ID NO: 203610 - DNA, 103 bp, Artificial Sequence
  Synthetic Polynucleotide
taatacgactcactatagggcattgagtcttttgtgctccatcagataagaacagaggagacttatcatgtggagcacaaacctggcggcagcgcaaaagatg

SEQ ID NO: 203611 - DNA, 103 bp, Artificial Sequence
  Synthetic Polynucleotide
taatacgactcactatagggagataggggccattgagtcttttgtgctccaacagaggagaggagcaatgaagactcaaaacctggcggcagcgcaaaagatg

SEQ ID NO: 203612 - DNA, 103 bp, Artificial Sequence
  Synthetic Polynucleotide
taatacgactcactatagggaacaatgatgagataggggccattgagtctaacagaggagaagactcatgggcccctataacctggcggcagcgcaaaagatg

SEQ ID NO: 203613 - DNA, 103 bp, Artificial Sequence
  Synthetic Polynucleotide
taatacgactcactatagggtcgaaaggggaacaatgatgagataggggcaacagaggagagcccctatgtcatcattgaacctggcggcagcgcaaaagatg

SEQ ID NO: 203614 - DNA, 103 bp, Artificial Sequence
  Synthetic Polynucleotide
taatacgactcactatagggttagatagagtcgaaaggggaacaatgatgaacagaggagacatcatatgtcccctttcaacctggcggcagcgcaaaagatg

SEQ ID NO: 203615 - DNA, 103 bp, Artificial Sequence
  Synthetic Polynucleotide
taatacgactcactatagggatatgtccagttagatagagtcgaaaggggaacagaggagaccccttatgactctatctaacctggcggcagcgcaaaagatg

SEQ ID NO: 203616 - DNA, 103 bp, Artificial Sequence
  Synthetic Polynucleotide
taatacgactcactatagggtgtcaaattcatatgtccagttagatagagaacagaggagactctatatgactggacataacctggcggcagcgcaaaagatg

SEQ ID NO: 203617 - DNA, 103 bp, Artificial Sequence
  Synthetic Polynucleotide
taatacgactcactatagggggagcccatttgtcaaattcatatgtccagaacagaggagactggacatgtgaatttgaaacctggcggcagcgcaaaagatg

SEQ ID NO: 203618 - DNA, 103 bp, Artificial Sequence
  Synthetic Polynucleotide
taatacgactcactatagggcaccacagaaggagcccatttgtcaaattcaacagaggagagaatttatgaaatgggctaacctggcggcagcgcaaaagatg

SEQ ID NO: 203619 - DNA, 103 bp, Artificial Sequence
  Synthetic Polynucleotide
taatacgactcactatagggaagaaatcttcaccacagaaggagcccattaacagaggagaaatgggatgcttctgtggaacctggcggcagcgcaaaagatg

SEQ ID NO: 203620 - DNA, 103 bp, Artificial Sequence
  Synthetic Polynucleotide
taatacgactcactatagggtctacaatccccttgtcatgtataccatcgaacagaggagacgatggatgacatgacaaaacctggcggcagcgcaaaagatg

SEQ ID NO: 203621 - DNA, 103 bp, Artificial Sequence
  Synthetic Polynucleotide
taatacgactcactataggggtacccttgtaagaaatcttcaccacagaaaacagaggagattctgtatggaagatttcaacctggcggcagcgcaaaagatg

SEQ ID NO: 203622 - DNA, 103 bp, Artificial Sequence
  Synthetic Polynucleotide
taatacgactcactatagggcatggcaggagtacccttgtaagaaatcttaacagaggagaaagattatgtacaagggtaacctggcggcagcgcaaaagatg

SEQ ID NO: 203623 - DNA, 103 bp, Artificial Sequence
  Synthetic Polynucleotide
taatacgactcactataggggggagcgacgcatggcaggagtacccttgtaacagaggagaacaaggatgctcctgccaaacctggcggcagcgcaaaagatg

SEQ ID NO: 203624 - DNA, 103 bp, Artificial Sequence
  Synthetic Polynucleotide
taatacgactcactatagggtgggggacaagggagcgacgcatggcaggaaacagaggagatcctgcatggcgtcgctcaacctggcggcagcgcaaaagatg

SEQ ID NO: 203625 - DNA, 103 bp, Artificial Sequence
  Synthetic Polynucleotide
taatacgactcactatagggactccgtagctgggggacaagggagcgacgaacagaggagacgtcgcatgcttgtccccaacctggcggcagcgcaaaagatg

SEQ ID NO: 203626 - DNA, 103 bp, Artificial Sequence
  Synthetic Polynucleotide
taatacgactcactatagggtgaatttgccactccgtagctgggggacaaaacagaggagattgtccatgagctacggaaacctggcggcagcgcaaaagatg

SEQ ID NO: 203627 - DNA, 103 bp, Artificial Sequence
  Synthetic Polynucleotide
taatacgactcactatagggaagaggacattgaatttgccactccgtagcaacagaggagagctacgatgtggcaaattaacctggcggcagcgcaaaagatg

SEQ ID NO: 203628 - DNA, 103 bp, Artificial Sequence
  Synthetic Polynucleotide
taatacgactcactatagggataagtagtcaagaggacattgaatttgccaacagaggagaggcaaaatgaatgtcctcaacctggcggcagcgcaaaagatg

SEQ ID NO: 203629 - DNA, 103 bp, Artificial Sequence
  Synthetic Polynucleotide
taatacgactcactatagggtaatatactcataagtagtcaagaggacataacagaggagaatgtccatgtgactacttaacctggcggcagcgcaaaagatg

SEQ ID NO: 203630 - DNA, 103 bp, Artificial Sequence
  Synthetic Polynucleotide
taatacgactcactatagggttgtcttttataatatactcataagtagtcaacagaggagagactacatgtgagtatataacctggcggcagcgcaaaagatg

SEQ ID NO: 203631 - DNA, 103 bp, Artificial Sequence
  Synthetic Polynucleotide
taatacgactcactatagggatggatgtcttctacaatccccttgtcatgaacagaggagacatgacatggggattgtaaacctggcggcagcgcaaaagatg

SEQ ID NO: 203632 - DNA, 103 bp, Artificial Sequence
  Synthetic Polynucleotide
taatacgactcactatagggaagaatgtgcttgtcttttataatatactcaacagaggagagagtatatgataaaagacaacctggcggcagcgcaaaagatg

SEQ ID NO: 203633 - DNA, 103 bp, Artificial Sequence
  Synthetic Polynucleotide
taatacgactcactataggggaatctttgcaagaatgtgcttgtcttttaaacagaggagataaaagatgagcacattcaacctggcggcagcgcaaaagatg

SEQ ID NO: 203634 - DNA, 103 bp, Artificial Sequence
  Synthetic Polynucleotide
taatacgactcactatagggtatttccaccgaatctttgcaagaatgtgcaacagaggagagcacatatgtgcaaagataacctggcggcagcgcaaaagatg

SEQ ID NO: 203635 - DNA, 103 bp, Artificial Sequence
  Synthetic Polynucleotide
taatacgactcactatagggcactatcatgtatttccaccgaatctttgcaacagaggagagcaaagatgcggtggaaaaacctggcggcagcgcaaaagatg

SEQ ID NO: 203636 - DNA, 103 bp, Artificial Sequence
  Synthetic Polynucleotide
taatacgactcactatagggggccttcgtccactatcatgtatttccaccaacagaggagaggtggaatgacatgatagaacctggcggcagcgcaaaagatg

SEQ ID NO: 203637 - DNA, 103 bp, Artificial Sequence
  Synthetic Polynucleotide
taatacgactcactatagggttcattcggtggccttcgtccactatcatgaacagaggagacatgatatgggacgaaggaacctggcggcagcgcaaaagatg

SEQ ID NO: 203638 - DNA, 103 bp, Artificial Sequence
  Synthetic Polynucleotide
taatacgactcactataggggtggtgattcttcattcggtggccttcgtcaacagaggagagacgaaatgcaccgaatgaacctggcggcagcgcaaaagatg

SEQ ID NO: 203639 - DNA, 103 bp, Artificial Sequence
  Synthetic Polynucleotide
taatacgactcactatagggtcagcttgcagtggtgattcttcattcggtaacagaggagaaccgaaatgagaatcaccaacctggcggcagcgcaaaagatg

SEQ ID NO: 203640 - DNA, 103 bp, Artificial Sequence
  Synthetic Polynucleotide
taatacgactcactatagggaagacctgagtcagcttgcagtggtgattcaacagaggagagaatcaatgctgcaagctaacctggcggcagcgcaaaagatg

SEQ ID NO: 203641 - DNA, 103 bp, Artificial Sequence
  Synthetic Polynucleotide
taatacgactcactataggggtgagtgttcaagacctgagtcagcttgcaaacagaggagatgcaagatgactcaggtcaacctggcggcagcgcaaaagatg

SEQ ID NO: 203642 - DNA, 103 bp, Artificial Sequence
  Synthetic Polynucleotide
taatacgactcactatagggtggatccacaatggatgtcttctacaatccaacagaggagaggattgatgaagacatccaacctggcggcagcgcaaaagatg

SEQ ID NO: 203643 - DNA, 103 bp, Artificial Sequence
  Synthetic Polynucleotide
taatacgactcactataggggggccacatagtgagtgttcaagacctgagaacagaggagactcaggatgtgaacactcaacctggcggcagcgcaaaagatg

SEQ ID NO: 203644 - DNA, 103 bp, Artificial Sequence
  Synthetic Polynucleotide
taatacgactcactatagggatccttctgggggccacatagtgagtgttcaacagaggagagaacacatgctatgtggcaacctggcggcagcgcaaaagatg

SEQ ID NO: 203645 - DNA, 103 bp, Artificial Sequence
  Synthetic Polynucleotide
taatacgactcactatagggagtcaagaggatccttctgggggccacataaacagaggagatatgtgatgcccagaaggaacctggcggcagcgcaaaagatg

SEQ ID NO: 203646 - DNA, 103 bp, Artificial Sequence
  Synthetic Polynucleotide
taatacgactcactataggggcggggtcccagtcaagaggatccttctggaacagaggagaccagaaatgtcctcttgaaacctggcggcagcgcaaaagatg

SEQ ID NO: 203647 - DNA, 103 bp, Artificial Sequence
  Synthetic Polynucleotide
taatacgactcactatagggttattctgcagcggggtcccagtcaagaggaacagaggagacctcttatgtgggaccccaacctggcggcagcgcaaaagatg

SEQ ID NO: 203648 - DNA, 103 bp, Artificial Sequence
  Synthetic Polynucleotide
taatacgactcactatagggttcagggagcttattctgcagcggggtcccaacagaggagagggaccatgctgcagaataacctggcggcagcgcaaaagatg

SEQ ID NO: 203649 - DNA, 103 bp, Artificial Sequence
  Synthetic Polynucleotide
taatacgactcactataggggggcccagagttcagggagcttattctgcaaacagaggagatgcagaatgagctccctgaacctggcggcagcgcaaaagatg

SEQ ID NO: 203650 - DNA, 103 bp, Artificial Sequence
  Synthetic Polynucleotide
taatacgactcactatagggaagttgaggagggcccagagttcagggagcaacagaggagagctcccatgactctgggcaacctggcggcagcgcaaaagatg

SEQ ID NO: 203651 - DNA, 103 bp, Artificial Sequence
  Synthetic Polynucleotide
taatacgactcactatagggtgggaggaggaagttgaggagggcccagagaacagaggagactctggatgctcctcaacaacctggcggcagcgcaaaagatg

SEQ ID NO: 203652 - DNA, 103 bp, Artificial Sequence
  Synthetic Polynucleotide
taatacgactcactatagggtaaaaattgttgggaggaggaagttgaggaaacagaggagatcctcaatgtcctcctccaacctggcggcagcgcaaaagatg

SEQ ID NO: 203653 - DNA, 103 bp, Artificial Sequence
  Synthetic Polynucleotide
taatacgactcactataggggtgcccttcatggatccacaatggatgtctaacagaggagaagacatatgttgtggatcaacctggcggcagcgcaaaagatg

SEQ ID NO: 203654 - DNA, 103 bp, Artificial Sequence
  Synthetic Polynucleotide
taatacgactcactatagggctgcagctcttaaaaattgttgggaggaggaacagaggagacctcctatgaacaattttaacctggcggcagcgcaaaagatg

SEQ ID NO: 203655 - DNA, 103 bp, Artificial Sequence
  Synthetic Polynucleotide
taatacgactcactatagggttcaaatgtgctgcagctcttaaaaattgtaacagaggagaacaattatgaagagctgcaacctggcggcagcgcaaaagatg

SEQ ID NO: 203656 - DNA, 103 bp, Artificial Sequence
  Synthetic Polynucleotide
taatacgactcactatagggtgaaccattgttcaaatgtgctgcagctctaacagaggagaagagctatggcacatttgaacctggcggcagcgcaaaagatg

SEQ ID NO: 203657 - DNA, 103 bp, Artificial Sequence
  Synthetic Polynucleotide
taatacgactcactatagggaatggagcattgaaccattgttcaaatgtgaacagaggagacacattatgacaatggttaacctggcggcagcgcaaaagatg

SEQ ID NO: 203658 - DNA, 103 bp, Artificial Sequence
  Synthetic Polynucleotide
taatacgactcactatagggagtcatggcaaatggagcattgaaccattgaacagaggagacaatggatgaatgctccaaacctggcggcagcgcaaaagatg

SEQ ID NO: 203659 - DNA, 103 bp, Artificial Sequence
  Synthetic Polynucleotide
taatacgactcactatagggccctttcaccagtcatggcaaatggagcataacagaggagaatgctcatgttgccatgaaacctggcggcagcgcaaaagatg

SEQ ID NO: 203660 - DNA, 103 bp, Artificial Sequence
  Synthetic Polynucleotide
taatacgactcactatagggtttaagtccaccctttcaccagtcatggcaaacagaggagatgccatatgtggtgaaagaacctggcggcagcgcaaaagatg

SEQ ID NO: 203661 - DNA, 103 bp, Artificial Sequence
  Synthetic Polynucleotide
taatacgactcactatagggttcttcttcatttaagtccaccctttcaccaacagaggagaggtgaaatggtggacttaaacctggcggcagcgcaaaagatg

SEQ ID NO: 203662 - DNA, 103 bp, Artificial Sequence
  Synthetic Polynucleotide
taatacgactcactatagggtcaatatagtttcttcttcatttaagtccaaacagaggagatggactatgatgaagaagaacctggcggcagcgcaaaagatg

SEQ ID NO: 203663 - DNA, 103 bp, Artificial Sequence
  Synthetic Polynucleotide
taatacgactcactatagggcgcctgatgatcaatatagtttcttcttcaaacagaggagatgaagaatgaactatattaacctggcggcagcgcaaaagatg

SEQ ID NO: 203664 - DNA, 103 bp, Artificial Sequence
  Synthetic Polynucleotide
taatacgactcactatagggtcgcataccagtgcccttcatggatccacaaacagaggagatgtggaatgatgaagggcaacctggcggcagcgcaaaagatg

SEQ ID NO: 203665 - DNA, 103 bp, Artificial Sequence
  Synthetic Polynucleotide
taatacgactcactatagggcttatgtagacgcctgatgatcaatatagtaacagaggagaactataatgatcatcaggaacctggcggcagcgcaaaagatg

SEQ ID NO: 203666 - DNA, 103 bp, Artificial Sequence
  Synthetic Polynucleotide
taatacgactcactataggggtcttaacaccttatgtagacgcctgatgaaacagaggagatcatcaatggtctacataaacctggcggcagcgcaaaagatg

SEQ ID NO: 203667 - DNA, 103 bp, Artificial Sequence
  Synthetic Polynucleotide
taatacgactcactatagggagtaaaaatggtcttaacaccttatgtagaaacagaggagatctacaatgggtgttaagaacctggcggcagcgcaaaagatg

SEQ ID NO: 203668 - DNA, 103 bp, Artificial Sequence
  Synthetic Polynucleotide
taatacgactcactatagggcagtctccttagtaaaaatggtcttaacacaacagaggagagtgttaatgccatttttaaacctggcggcagcgcaaaagatg

SEQ ID NO: 203669 - DNA, 103 bp, Artificial Sequence
  Synthetic Polynucleotide
taatacgactcactatagggcttctttcttcagtctccttagtaaaaatgaacagaggagacattttatgtaaggagacaacctggcggcagcgcaaaagatg

SEQ ID NO: 203670 - DNA, 103 bp, Artificial Sequence
  Synthetic Polynucleotide
taatacgactcactatagggtgggattcaacttctttcttcagtctccttaacagaggagaaaggagatggaagaaagaaacctggcggcagcgcaaaagatg

SEQ ID NO: 203671 - DNA, 103 bp, Artificial Sequence
  Synthetic Polynucleotide
taatacgactcactatagggttcgggaagctgggattcaacttctttcttaacagaggagaaagaaaatggttgaatccaacctggcggcagcgcaaaagatg

SEQ ID NO: 203672 - DNA, 103 bp, Artificial Sequence
  Synthetic Polynucleotide
taatacgactcactatagggattccactttttcgggaagctgggattcaaaacagaggagattgaatatgagcttcccgaacctggcggcagcgcaaaagatg

SEQ ID NO: 203673 - DNA, 103 bp, Artificial Sequence
  Synthetic Polynucleotide
taatacgactcactatagggttgatcacatattccactttttcgggaagcaacagaggagagcttccatgaaaagtggaaacctggcggcagcgcaaaagatg

SEQ ID NO: 203674 - DNA, 103 bp, Artificial Sequence
  Synthetic Polynucleotide
taatacgactcactatagggcatgtcacacttgatcacatattccactttaacagaggagaaaagtgatgtatgtgatcaacctggcggcagcgcaaaagatg

SEQ ID NO: 203675 - DNA, 103 bp, Artificial Sequence
  Synthetic Polynucleotide
taatacgactcactatagggggtgaggtggtcgcataccagtgcccttcaaacagaggagatgaaggatgctggtatgcaacctggcggcagcgcaaaagatg

SEQ ID NO: 203676 - DNA, 103 bp, Artificial Sequence
  Synthetic Polynucleotide
taatacgactcactataggggcagagctgacatgtcacacttgatcacataacagaggagaatgtgaatgagtgtgacaaacctggcggcagcgcaaaagatg

SEQ ID NO: 203677 - DNA, 103 bp, Artificial Sequence
  Synthetic Polynucleotide
taatacgactcactatagggagaatcttctgcagagctgacatgtcacacaacagaggagagtgtgaatggtcagctctaacctggcggcagcgcaaaagatg

SEQ ID NO: 203678 - DNA, 103 bp, Artificial Sequence
  Synthetic Polynucleotide
taatacgactcactatagggatggcgatacagaatcttctgcagagctgaaacagaggagatcagctatgcagaagattaacctggcggcagcgcaaaagatg

SEQ ID NO: 203679 - DNA, 103 bp, Artificial Sequence
  Synthetic Polynucleotide
taatacgactcactatagggtggcttgcatatggcgatacagaatcttctaacagaggagaagaagaatgtgtatcgccaacctggcggcagcgcaaaagatg

SEQ ID NO: 203680 - DNA, 103 bp, Artificial Sequence
  Synthetic Polynucleotide
taatacgactcactatagggaggatccccttggcttgcatatggcgatacaacagaggagagtatcgatgtatgcaagcaacctggcggcagcgcaaaagatg

SEQ ID NO: 203681 - DNA, 103 bp, Artificial Sequence
  Synthetic Polynucleotide
taatacgactcactatagggatctgtgagaaggatccccttggcttgcataacagaggagaatgcaaatgaaggggatcaacctggcggcagcgcaaaagatg

SEQ ID NO: 203682 - DNA, 103 bp, Artificial Sequence
  Synthetic Polynucleotide
taatacgactcactatagggtctcagaaccatctgtgagaaggatcccctaacagaggagaaggggaatgttctcacagaacctggcggcagcgcaaaagatg

SEQ ID NO: 203683 - DNA, 103 bp, Artificial Sequence
  Synthetic Polynucleotide
taatacgactcactatagggttcttatctttctcagaaccatctgtgagaaacagaggagatctcacatgtggttctgaaacctggcggcagcgcaaaagatg

SEQ ID NO: 203684 - DNA, 103 bp, Artificial Sequence
  Synthetic Polynucleotide
taatacgactcactatagggtcctttccccttcttatctttctcagaaccaacagaggagaggttctatgaaagataagaacctggcggcagcgcaaaagatg

SEQ ID NO: 203685 - DNA, 103 bp, Artificial Sequence
  Synthetic Polynucleotide
taatacgactcactatagggtcttagcacctcctttccccttcttatcttaacagaggagaaagataatgaggggaaagaacctggcggcagcgcaaaagatg

SEQ ID NO: 203686 - DNA, 103 bp, Artificial Sequence
  Synthetic Polynucleotide
taatacgactcactatagggggcgaaggccctgggtggggcatcgcaccaaacagaggagatggtgcatggccccacccaacctggcggcagcgcaaaagatg

SEQ ID NO: 203687 - DNA, 103 bp, Artificial Sequence
  Synthetic Polynucleotide
taatacgactcactatagggcccatgcctgggtgaggtggtcgcataccaaacagaggagatggtatatgaccacctcaaacctggcggcagcgcaaaagatg

SEQ ID NO: 203688 - DNA, 103 bp, Artificial Sequence
  Synthetic Polynucleotide
taatacgactcactatagggttcataagtgtcttagcacctcctttccccaacagaggagaggggaaatgaggtgctaaaacctggcggcagcgcaaaagatg

SEQ ID NO: 203689 - DNA, 103 bp, Artificial Sequence
  Synthetic Polynucleotide
taatacgactcactatagggcataatagtgttcataagtgtcttagcaccaacagaggagaggtgctatgacacttatgaacctggcggcagcgcaaaagatg

SEQ ID NO: 203690 - DNA, 103 bp, Artificial Sequence
  Synthetic Polynucleotide
taatacgactcactatagggttctcaactgcataatagtgttcataagtgaacagaggagacacttaatgacactattaaacctggcggcagcgcaaaagatg

SEQ ID NO: 203691 - DNA, 103 bp, Artificial Sequence
  Synthetic Polynucleotide
taatacgactcactatagggttgcagatttttctcaactgcataatagtgaacagaggagacactatatggcagttgagaacctggcggcagcgcaaaagatg

SEQ ID NO: 203692 - DNA, 103 bp, Artificial Sequence
  Synthetic Polynucleotide
taatacgactcactatagggatatgggtggttgcagatttttctcaactgaacagaggagacagttgatgaaaatctgcaacctggcggcagcgcaaaagatg

SEQ ID NO: 203693 - DNA, 103 bp, Artificial Sequence
  Synthetic Polynucleotide
taatacgactcactataggggctgaaacatatatgggtggttgcagatttaacagaggagaaaatctatgaccacccataacctggcggcagcgcaaaagatg

SEQ ID NO: 203694 - DNA, 103 bp, Artificial Sequence
  Synthetic Polynucleotide
taatacgactcactatagggtcctcaatgtgctgaaacatatatgggtggaacagaggagaccacccatgtatgtttcaaacctggcggcagcgcaaaagatg

SEQ ID NO: 203695 - DNA, 103 bp, Artificial Sequence
  Synthetic Polynucleotide
taatacgactcactatagggagcaaaggattcctcaatgtgctgaaacataacagaggagaatgtttatgcacattgagaacctggcggcagcgcaaaagatg

SEQ ID NO: 203696 - DNA, 103 bp, Artificial Sequence
  Synthetic Polynucleotide
taatacgactcactatagggctaggtgttcagcaaaggattcctcaatgtaacagaggagaacattgatgaatcctttgaacctggcggcagcgcaaaagatg

SEQ ID NO: 203697 - DNA, 103 bp, Artificial Sequence
  Synthetic Polynucleotide
taatacgactcactatagggtttgaatagcctaggtgttcagcaaaggataacagaggagaatccttatgtgaacacctaacctggcggcagcgcaaaagatg

SEQ ID NO: 203698 - DNA, 103 bp, Artificial Sequence
  Synthetic Polynucleotide
taatacgactcactatagggctggggagggcccatgcctgggtgaggtggaacagaggagaccacctatgccaggcatgaacctggcggcagcgcaaaagatg

SEQ ID NO: 203699 - DNA, 103 bp, Artificial Sequence
  Synthetic Polynucleotide
taatacgactcactataggggatgaccccatttgaatagcctaggtgttcaacagaggagagaacacatgggctattcaaacctggcggcagcgcaaaagatg

SEQ ID NO: 203700 - DNA, 103 bp, Artificial Sequence
  Synthetic Polynucleotide
taatacgactcactatagggcagccccattgatgaccccatttgaatagcaacagaggagagctattatgatggggtcaaacctggcggcagcgcaaaagatg

SEQ ID NO: 203701 - DNA, 103 bp, Artificial Sequence
  Synthetic Polynucleotide
taatacgactcactatagggcgatacagttcagccccattgatgaccccaaacagaggagatggggtatgcaatggggcaacctggcggcagcgcaaaagatg

SEQ ID NO: 203702 - DNA, 103 bp, Artificial Sequence
  Synthetic Polynucleotide
taatacgactcactatagggccctgaggcccgatacagttcagccccattaacagaggagaaatgggatggaactgtataacctggcggcagcgcaaaagatg

SEQ ID NO: 203703 - DNA, 103 bp, Artificial Sequence
  Synthetic Polynucleotide
taatacgactcactataggggctcaaacttccctgaggcccgatacagttaacagaggagaaactgtatggggcctcagaacctggcggcagcgcaaaagatg

SEQ ID NO: 203704 - DNA, 103 bp, Artificial Sequence
  Synthetic Polynucleotide
taatacgactcactatagggcgatcaagcagctcaaacttccctgaggccaacagaggagaggcctcatggaagtttgaaacctggcggcagcgcaaaagatg

SEQ ID NO: 203705 - DNA, 103 bp, Artificial Sequence
  Synthetic Polynucleotide
taatacgactcactatagggtggcagaatacgatcaagcagctcaaacttaacagaggagaaagtttatgctgcttgataacctggcggcagcgcaaaagatg

SEQ ID NO: 203706 - DNA, 103 bp, Artificial Sequence
  Synthetic Polynucleotide
taatacgactcactatagggctctcaattttggcagaatacgatcaagcaaacagaggagatgcttgatggtattctgcaacctggcggcagcgcaaaagatg

SEQ ID NO: 203707 - DNA, 103 bp, Artificial Sequence
  Synthetic Polynucleotide
taatacgactcactatagggtgattagtcgctctcaattttggcagaataaacagaggagatattctatgaaaattgagaacctggcggcagcgcaaaagatg

SEQ ID NO: 203708 - DNA, 103 bp, Artificial Sequence
  Synthetic Polynucleotide
taatacgactcactatagggcagcactcggtgattagtcgctctcaatttaacagaggagaaaattgatggcgactaataacctggcggcagcgcaaaagatg

SEQ ID NO: 203709 - DNA, 103 bp, Artificial Sequence
  Synthetic Polynucleotide
taatacgactcactatagggccattggactctggggagggcccatgcctgaacagaggagacaggcaatggccctccccaacctggcggcagcgcaaaagatg

SEQ ID NO: 203710 - DNA, 103 bp, Artificial Sequence
  Synthetic Polynucleotide
taatacgactcactatagggggcagaaaagcagcactcggtgattagtcgaacagaggagacgactaatgaccgagtgcaacctggcggcagcgcaaaagatg

SEQ ID NO: 203711 - DNA, 103 bp, Artificial Sequence
  Synthetic Polynucleotide
taatacgactcactataggggatgtcatctggcagaaaagcagcactcggaacagaggagaccgagtatggcttttctgaacctggcggcagcgcaaaagatg

SEQ ID NO: 203712 - DNA, 103 bp, Artificial Sequence
  Synthetic Polynucleotide
taatacgactcactatagggggtcatgagagatgtcatctggcagaaaagaacagaggagacttttcatgcagatgacaaacctggcggcagcgcaaaagatg

SEQ ID NO: 203713 - DNA, 103 bp, Artificial Sequence
  Synthetic Polynucleotide
taatacgactcactatagggcctccatgatggtcatgagagatgtcatctaacagaggagaagatgaatgctctcatgaaacctggcggcagcgcaaaagatg

SEQ ID NO: 203714 - DNA, 103 bp, Artificial Sequence
  Synthetic Polynucleotide
taatacgactcactataggggcaaaataatcctccatgatggtcatgagaaacagaggagatctcatatgcatcatggaaacctggcggcagcgcaaaagatg

SEQ ID NO: 203715 - DNA, 103 bp, Artificial Sequence
  Synthetic Polynucleotide
taatacgactcactataggggttccgaaaagcaaaataatcctccatgataacagaggagaatcatgatggattattttaacctggcggcagcgcaaaagatg

SEQ ID NO: 203716 - DNA, 103 bp, Artificial Sequence
  Synthetic Polynucleotide
taatacgactcactatagggggtaaaggaagttccgaaaagcaaaataataacagaggagaattattatgcttttcggaaacctggcggcagcgcaaaagatg

SEQ ID NO: 203717 - DNA, 103 bp, Artificial Sequence
  Synthetic Polynucleotide
taatacgactcactatagggtcaaggcgtaggtaaaggaagttccgaaaaaacagaggagattttcgatgcttcctttaaacctggcggcagcgcaaaagatg

SEQ ID NO: 203718 - DNA, 103 bp, Artificial Sequence
  Synthetic Polynucleotide
taatacgactcactatagggggtggtgccatcaaggcgtaggtaaaggaaaacagaggagattccttatgctacgccttaacctggcggcagcgcaaaagatg

SEQ ID NO: 203719 - DNA, 103 bp, Artificial Sequence
  Synthetic Polynucleotide
taatacgactcactatagggcttcagacttggtggtgccatcaaggcgtaaacagaggagatacgccatgatggcaccaaacctggcggcagcgcaaaagatg

SEQ ID NO: 203720 - DNA, 103 bp, Artificial Sequence
  Synthetic Polynucleotide
taatacgactcactatagggctgtgttgatccattggactctggggagggaacagaggagaccctccatggagtccaataacctggcggcagcgcaaaagatg

SEQ ID NO: 203721 - DNA, 103 bp, Artificial Sequence
  Synthetic Polynucleotide
taatacgactcactataggggcagcacgatcttcagacttggtggtgccaaacagaggagatggcacatgcaagtctgaaacctggcggcagcgcaaaagatg

SEQ ID NO: 203722 - DNA, 103 bp, Artificial Sequence
  Synthetic Polynucleotide
taatacgactcactatagggcttcagcaaagcagcacgatcttcagacttaacagaggagaaagtctatggatcgtgctaacctggcggcagcgcaaaagatg

SEQ ID NO: 203723 - DNA, 103 bp, Artificial Sequence
  Synthetic Polynucleotide
taatacgactcactatagggcattgaatttcttcagcaaagcagcacgataacagaggagaatcgtgatgctttgctgaaacctggcggcagcgcaaaagatg

SEQ ID NO: 203724 - DNA, 103 bp, Artificial Sequence
  Synthetic Polynucleotide
taatacgactcactataggggatccaggttcattgaatttcttcagcaaaaacagaggagatttgctatggaaattcaaaacctggcggcagcgcaaaagatg

SEQ ID NO: 203725 - DNA, 103 bp, Artificial Sequence
  Synthetic Polynucleotide
taatacgactcactataggggaaatactgggatccaggttcattgaatttaacagaggagaaaattcatggaacctggaaacctggcggcagcgcaaaagatg

SEQ ID NO: 203726 - DNA, 103 bp, Artificial Sequence
  Synthetic Polynucleotide
taatacgactcactataggggcaagaaaatgaaatactgggatccaggttaacagaggagaaacctgatgcccagtattaacctggcggcagcgcaaaagatg

SEQ ID NO: 203727 - DNA, 103 bp, Artificial Sequence
  Synthetic Polynucleotide
taatacgactcactatagggcttgtgctcagcaagaaaatgaaatactggaacagaggagaccagtaatgcattttcttaacctggcggcagcgcaaaagatg

SEQ ID NO: 203728 - DNA, 103 bp, Artificial Sequence
  Synthetic Polynucleotide
taatacgactcactataggggccaccagctcttgtgctcagcaagaaaataacagaggagaattttcatgctgagcacaaacctggcggcagcgcaaaagatg

SEQ ID NO: 203729 - DNA, 103 bp, Artificial Sequence
  Synthetic Polynucleotide
taatacgactcactatagggttaagcccaggccaccagctcttgtgctcaaacagaggagatgagcaatggagctggtgaacctggcggcagcgcaaaagatg

SEQ ID NO: 203730 - DNA, 103 bp, Artificial Sequence
  Synthetic Polynucleotide
taatacgactcactataggggcctgaagatttaagcccaggccaccagctaacagaggagaagctggatgcctgggcttaacctggcggcagcgcaaaagatg

SEQ ID NO: 203731 - DNA, 103 bp, Artificial Sequence
  Synthetic Polynucleotide
taatacgactcactatagggataaccttggctgtgttgatccattggactaacagaggagaagtccaatggatcaacacaacctggcggcagcgcaaaagatg

SEQ ID NO: 203732 - DNA, 103 bp, Artificial Sequence
  Synthetic Polynucleotide
taatacgactcactatagggtgtatcagctgcctgaagatttaagcccagaacagaggagactgggcatgaatcttcagaacctggcggcagcgcaaaagatg

SEQ ID NO: 203733 - DNA, 103 bp, Artificial Sequence
  Synthetic Polynucleotide
taatacgactcactatagggagatgaccactgtatcagctgcctgaagataacagaggagaatcttcatgcagctgataaacctggcggcagcgcaaaagatg

SEQ ID NO: 203734 - DNA, 103 bp, Artificial Sequence
  Synthetic Polynucleotide
taatacgactcactatagggtcgctgtcaaagatgaccactgtatcagctaacagaggagaagctgaatgagtggtcataacctggcggcagcgcaaaagatg

SEQ ID NO: 203735 - DNA, 103 bp, Artificial Sequence
  Synthetic Polynucleotide
taatacgactcactatagggaggattccagtcgctgtcaaagatgaccacaacagaggagagtggtcatgtttgacagcaacctggcggcagcgcaaaagatg

SEQ ID NO: 203736 - DNA, 103 bp, Artificial Sequence
  Synthetic Polynucleotide
taatacgactcactataggggatcctgatgaggattccagtcgctgtcaaaacagaggagattgacaatgactggaatcaacctggcggcagcgcaaaagatg

SEQ ID NO: 203737 - DNA, 103 bp, Artificial Sequence
  Synthetic Polynucleotide
taatacgactcactatagggtgggcctgcagatcctgatgaggattccagaacagaggagactggaaatgtcatcaggaaacctggcggcagcgcaaaagatg

SEQ ID NO: 203738 - DNA, 103 bp, Artificial Sequence
  Synthetic Polynucleotide
taatacgactcactatagggagctcggtcttgggcctgcagatcctgatgaacagaggagacatcagatgctgcaggccaacctggcggcagcgcaaaagatg

SEQ ID NO: 203739 - DNA, 103 bp, Artificial Sequence
  Synthetic Polynucleotide
taatacgactcactatagggcgatgcggtgagctcggtcttgggcctgcaaacagaggagatgcaggatgaagaccgagaacctggcggcagcgcaaaagatg

SEQ ID NO: 203740 - DNA, 103 bp, Artificial Sequence
  Synthetic Polynucleotide
taatacgactcactatagggttctgctgcccgatgcggtgagctcggtctaacagaggagaagaccgatgtcaccgcataacctggcggcagcgcaaaagatg

SEQ ID NO: 203741 - DNA, 103 bp, Artificial Sequence
  Synthetic Polynucleotide
taatacgactcactatagggccggacctcgttctgctgcccgatgcggtgaacagaggagacaccgcatggggcagcagaacctggcggcagcgcaaaagatg

SEQ ID NO: 203742 - DNA, 103 bp, Artificial Sequence
  Synthetic Polynucleotide
taatacgactcactataggggtggtgacatataaccttggctgtgttgataacagaggagaatcaacatggccaaggttaacctggcggcagcgcaaaagatg

SEQ ID NO: 203743 - DNA, 103 bp, Artificial Sequence
  Synthetic Polynucleotide
taatacgactcactataggggcctcagtacccggacctcgttctgctgccaacagaggagaggcagcatgacgaggtccaacctggcggcagcgcaaaagatg

SEQ ID NO: 203744 - DNA, 103 bp, Artificial Sequence
  Synthetic Polynucleotide
taatacgactcactatagggacggtacagagcctcagtacccggacctcgaacagaggagacgaggtatgggtactgagaacctggcggcagcgcaaaagatg

SEQ ID NO: 203745 - DNA, 103 bp, Artificial Sequence
  Synthetic Polynucleotide
taatacgactcactatagggcacgctgttcacggtacagagcctcagtacaacagaggagagtactgatgctctgtaccaacctggcggcagcgcaaaagatg

SEQ ID NO: 203746 - DNA, 103 bp, Artificial Sequence
  Synthetic Polynucleotide
taatacgactcactatagggtcttttcctccacgctgttcacggtacagaaacagaggagatctgtaatgtgaacagcgaacctggcggcagcgcaaaagatg

SEQ ID NO: 203747 - DNA, 103 bp, Artificial Sequence
  Synthetic Polynucleotide
taatacgactcactataggggccgcgaggatcttttcctccacgctgttcaacagaggagagaacagatgggaggaaaaaacctggcggcagcgcaaaagatg

SEQ ID NO: 203748 - DNA, 103 bp, Artificial Sequence
  Synthetic Polynucleotide
taatacgactcactataggggtattttgcggccgcgaggatcttttcctcaacagaggagagaggaaatgatcctcgcgaacctggcggcagcgcaaaagatg

SEQ ID NO: 203749 - DNA, 103 bp, Artificial Sequence
  Synthetic Polynucleotide
taatacgactcactatagggcgttcagcttgtattttgcggccgcgaggaaacagaggagatcctcgatgccgcaaaataacctggcggcagcgcaaaagatg

SEQ ID NO: 203750 - DNA, 103 bp, Artificial Sequence
  Synthetic Polynucleotide
taatacgactcactatagggttctgatccacgttcagcttgtattttgcgaacagaggagacgcaaaatgcaagctgaaaacctggcggcagcgcaaaagatg

SEQ ID NO: 203751 - DNA, 103 bp, Artificial Sequence
  Synthetic Polynucleotide
taatacgactcactatagggctggatcactttctgatccacgttcagcttaacagaggagaaagctgatggtggatcagaacctggcggcagcgcaaaagatg

SEQ ID NO: 203752 - DNA, 103 bp, Artificial Sequence
  Synthetic Polynucleotide
taatacgactcactatagggacatgcccgcctggatcactttctgatccaaacagaggagatggatcatgaagtgatccaacctggcggcagcgcaaaagatg

SEQ ID NO: 203753 - DNA, 103 bp, Artificial Sequence
  Synthetic Polynucleotide
taatacgactcactatagggggagatgggtgtggtgacatataaccttggaacagaggagaccaaggatgtatgtcaccaacctggcggcagcgcaaaagatg

SEQ ID NO: 203754 - DNA, 103 bp, Artificial Sequence
  Synthetic Polynucleotide
taatacgactcactatagggttttggtcaaacatgcccgcctggatcactaacagaggagaagtgatatgggcgggcataacctggcggcagcgcaaaagatg

SEQ ID NO: 203755 - DNA, 103 bp, Artificial Sequence
  Synthetic Polynucleotide
taatacgactcactataggggcttgaagacttttggtcaaacatgcccgcaacagaggagagcgggcatgtttgaccaaaacctggcggcagcgcaaaagatg

SEQ ID NO: 203756 - DNA, 103 bp, Artificial Sequence
  Synthetic Polynucleotide
taatacgactcactatagggtccgctcgtggcttgaagacttttggtcaaaacagaggagattgaccatgagtcttcaaaacctggcggcagcgcaaaagatg

SEQ ID NO: 203757 - DNA, 103 bp, Artificial Sequence
  Synthetic Polynucleotide
taatacgactcactatagggaggaatgccctccgctcgtggcttgaagacaacagaggagagtcttcatgccacgagcgaacctggcggcagcgcaaaagatg

SEQ ID NO: 203758 - DNA, 103 bp, Artificial Sequence
  Synthetic Polynucleotide
taatacgactcactataggggatggcctgcaggaatgccctccgctcgtgaacagaggagacacgagatgagggcattcaacctggcggcagcgcaaaagatg

SEQ ID NO: 203759 - DNA, 103 bp, Artificial Sequence
  Synthetic Polynucleotide
taatacgactcactatagggcatgctccaagatggcctgcaggaatgcccaacagaggagagggcatatgtgcaggccaaacctggcggcagcgcaaaagatg

SEQ ID NO: 203760 - DNA, 103 bp, Artificial Sequence
  Synthetic Polynucleotide
taatacgactcactatagggttttcctcctcatgctccaagatggcctgcaacagaggagagcaggcatgcttggagcaaacctggcggcagcgcaaaagatg

SEQ ID NO: 203761 - DNA, 103 bp, Artificial Sequence
  Synthetic Polynucleotide
taatacgactcactatagggttcttcctcattttcctcctcatgctccaaaacagaggagattggagatggaggaggaaaacctggcggcagcgcaaaagatg

SEQ ID NO: 203762 - DNA, 103 bp, Artificial Sequence
  Synthetic Polynucleotide
taatacgactcactataggggtacttcatcttcttcctcattttcctcctaacagaggagaaggaggatgatgaggaagaacctggcggcagcgcaaaagatg

SEQ ID NO: 203763 - DNA, 103 bp, Artificial Sequence
  Synthetic Polynucleotide
taatacgactcactatagggtcatcgtccggtacttcatcttcttcctcaaacagaggagatgaggaatgagatgaagtaacctggcggcagcgcaaaagatg

SEQ ID NO: 203764 - DNA, 103 bp, Artificial Sequence
  Synthetic Polynucleotide
taatacgactcactatagggggctcctaatggagatgggtgtggtgacataacagaggagaatgtcaatgcacccatctaacctggcggcagcgcaaaagatg

SEQ ID NO: 203765 - DNA, 103 bp, Artificial Sequence
  Synthetic Polynucleotide
taatacgactcactataggggttcagagtctcatcgtccggtacttcatcaacagaggagagatgaaatgccggacgataacctggcggcagcgcaaaagatg

SEQ ID NO: 203766 - DNA, 103 bp, Artificial Sequence
  Synthetic Polynucleotide
taatacgactcactatagggcaatcatttggttcagagtctcatcgtccgaacagaggagacggacgatgagactctgaaacctggcggcagcgcaaaagatg

SEQ ID NO: 203767 - DNA, 103 bp, Artificial Sequence
  Synthetic Polynucleotide
taatacgactcactatagggtctcgtcgagcaatcatttggttcagagtcaacagaggagagactctatgccaaatgataacctggcggcagcgcaaaagatg

SEQ ID NO: 203768 - DNA, 103 bp, Artificial Sequence
  Synthetic Polynucleotide
taatacgactcactatagggaaattcttcttctcgtcgagcaatcatttgaacagaggagacaaatgatggctcgacgaaacctggcggcagcgcaaaagatg

SEQ ID NO: 203769 - DNA, 103 bp, Artificial Sequence
  Synthetic Polynucleotide
taatacgactcactatagggtaaaaaggtcaaattcttcttctcgtcgagaacagaggagactcgacatgaagaagaataacctggcggcagcgcaaaagatg

SEQ ID NO: 203770 - DNA, 103 bp, Artificial Sequence
  Synthetic Polynucleotide
taatacgactcactatagggtccatccgcataaaaaggtcaaattcttctaacagaggagaagaagaatgtgaccttttaacctggcggcagcgcaaaagatg

SEQ ID NO: 203771 - DNA, 103 bp, Artificial Sequence
  Synthetic Polynucleotide
taatacgactcactatagggccggtccatgtccatccgcataaaaaggtcaacagaggagagaccttatgatgcggatgaacctggcggcagcgcaaaagatg

SEQ ID NO: 203772 - DNA, 103 bp, Artificial Sequence
  Synthetic Polynucleotide
taatacgactcactatagggcttccctccgccggtccatgtccatccgcaaacagaggagatgcggaatgacatggaccaacctggcggcagcgcaaaagatg

SEQ ID NO: 203773 - DNA, 103 bp, Artificial Sequence
  Synthetic Polynucleotide
taatacgactcactatagggttccgggcatcttccctccgccggtccatgaacagaggagacatggaatggcggagggaaacctggcggcagcgcaaaagatg

SEQ ID NO: 203774 - DNA, 103 bp, Artificial Sequence
  Synthetic Polynucleotide
taatacgactcactatagggccgtttcgggttccgggcatcttccctccgaacagaggagacggaggatggatgcccggaacctggcggcagcgcaaaagatg

SEQ ID NO: 203775 - DNA, 103 bp, Artificial Sequence
  Synthetic Polynucleotide
taatacgactcactatagggcgtgctctggggctcctaatggagatgggtaacagaggagaacccatatgcattaggagaacctggcggcagcgcaaaagatg

SEQ ID NO: 203776 - DNA, 103 bp, Artificial Sequence
  Synthetic Polynucleotide
taatacgactcactatagggaacggggcttccgtttcgggttccgggcataacagaggagaatgcccatgacccgaaacaacctggcggcagcgcaaaagatg

SEQ ID NO: 203777 - DNA, 103 bp, Artificial Sequence
  Synthetic Polynucleotide
taatacgactcactatagggtcctccattaaacggggcttccgtttcgggaacagaggagacccgaaatggaagccccgaacctggcggcagcgcaaaagatg

SEQ ID NO: 203778 - DNA, 103 bp, Artificial Sequence
  Synthetic Polynucleotide
taatacgactcactatagggcagctcatcctcctccattaaacggggcttaacagaggagaaagcccatgttaatggagaacctggcggcagcgcaaaagatg

SEQ ID NO: 203779 - DNA, 103 bp, Artificial Sequence
  Synthetic Polynucleotide
taatacgactcactatagggtccaggagggcagctcatcctcctccattaaacagaggagataatggatgaggatgagcaacctggcggcagcgcaaaagatg

SEQ ID NO: 203780 - DNA, 103 bp, Artificial Sequence
  Synthetic Polynucleotide
taatacgactcactatagggtccttaatgatccaggagggcagctcatccaacagaggagaggatgaatggccctcctgaacctggcggcagcgcaaaagatg

SEQ ID NO: 203781 - DNA, 103 bp, Artificial Sequence
  Synthetic Polynucleotide
taatacgactcactatagggttcagcgtcatccttaatgatccaggagggaacagaggagaccctccatgatcattaagaacctggcggcagcgcaaaagatg

SEQ ID NO: 203782 - DNA, 103 bp, Artificial Sequence
  Synthetic Polynucleotide
taatacgactcactataggggcctttctacttcagcgtcatccttaatgaaacagaggagatcattaatgatgacgctgaacctggcggcagcgcaaaagatg

SEQ ID NO: 203783 - DNA, 103 bp, Artificial Sequence
  Synthetic Polynucleotide
taatacgactcactatagggtcacaggtgagcctttctacttcagcgtcaaacagaggagatgacgcatgagtagaaagaacctggcggcagcgcaaaagatg

SEQ ID NO: 203784 - DNA, 103 bp, Artificial Sequence
  Synthetic Polynucleotide
taatacgactcactatagggctcctcttcttcacaggtgagcctttctacaacagaggagagtagaaatgctcacctgtaacctggcggcagcgcaaaagatg

SEQ ID NO: 203785 - DNA, 103 bp, Artificial Sequence
  Synthetic Polynucleotide
taatacgactcactatagggatattttctcctcctcttcttcacaggtgaaacagaggagatcacctatgaagaagaggaacctggcggcagcgcaaaagatg

SEQ ID NO: 203786 - DNA, 103 bp, Artificial Sequence
  Synthetic Polynucleotide
taatacgactcactataggggggctggagacgtgctctggggctcctaataacagaggagaattaggatgcccagagcaaacctggcggcagcgcaaaagatg

SEQ ID NO: 203787 - DNA, 103 bp, Artificial Sequence
  Synthetic Polynucleotide
taatacgactcactatagggcccctcccaaatattttctcctcctcttctaacagaggagaagaagaatgggagaaaataacctggcggcagcgcaaaagatg

SEQ ID NO: 203788 - DNA, 103 bp, Artificial Sequence
  Synthetic Polynucleotide
taatacgactcactatagggctggcgggaccccctcccaaatattttctcaacagaggagagagaaaatgtttgggaggaacctggcggcagcgcaaaagatg

SEQ ID NO: 203789 - DNA, 103 bp, Artificial Sequence
  Synthetic Polynucleotide
taatacgactcactatagggcgtcacggcgctggcgggaccccctcccaaaacagaggagattgggaatgggtcccgccaacctggcggcagcgcaaaagatg

SEQ ID NO: 203790 - DNA, 103 bp, Artificial Sequence
  Synthetic Polynucleotide
taatacgactcactatagggctgtagtccacgtcacggcgctggcgggacaacagaggagagtcccgatggcgccgtgaaacctggcggcagcgcaaaagatg

SEQ ID NO: 203791 - DNA, 103 bp, Artificial Sequence
  Synthetic Polynucleotide
taatacgactcactataggggagggcgtcactgtagtccacgtcacggcgaacagaggagacgccgtatggtggactacaacctggcggcagcgcaaaagatg

SEQ ID NO: 203792 - DNA, 103 bp, Artificial Sequence
  Synthetic Polynucleotide
taatacgactcactataggggcttctccgtgagggcgtcactgtagtccaaacagaggagatggactatggtgacgcccaacctggcggcagcgcaaaagatg

SEQ ID NO: 203793 - DNA, 103 bp, Artificial Sequence
  Synthetic Polynucleotide
taatacgactcactatagggcttagccactgcttctccgtgagggcgtcaaacagaggagatgacgcatgcacggagaaaacctggcggcagcgcaaaagatg

SEQ ID NO: 203794 - DNA, 103 bp, Artificial Sequence
  Synthetic Polynucleotide
taatacgactcactatagggttcgatggcccttagccactgcttctccgtaacagaggagaacggagatgcagtggctaaacctggcggcagcgcaaaagatg

SEQ ID NO: 203795 - DNA, 103 bp, Artificial Sequence
  Synthetic Polynucleotide
taatacgactcactatagggaattgccgtcttcgatggcccttagccactaacagaggagaagtggcatggggccatcgaacctggcggcagcgcaaaagatg

SEQ ID NO: 203796 - DNA, 103 bp, Artificial Sequence
  Synthetic Polynucleotide
taatacgactcactatagggatttcctccaaattgccgtcttcgatggccaacagaggagaggccatatgagacggcaaaacctggcggcagcgcaaaagatg

SEQ ID NO: 203797 - DNA, 103 bp, Artificial Sequence
  Synthetic Polynucleotide
taatacgactcactatagggcccaggccccggcgaaggccctgggtggggaacagaggagaccccacatggggccttcgaacctggcggcagcgcaaaagatg

SEQ ID NO: 203798 - DNA, 103 bp, Artificial Sequence
  Synthetic Polynucleotide
taatacgactcactatagggtccagacatagggctggagacgtgctctggaacagaggagaccagagatggtctccagcaacctggcggcagcgcaaaagatg

SEQ ID NO: 203799 - DNA, 103 bp, Artificial Sequence
  Synthetic Polynucleotide
taatacgactcactatagggttcctcttccatttcctccaaattgccgtcaacagaggagagacggcatgttggaggaaaacctggcggcagcgcaaaagatg

SEQ ID NO: 203800 - DNA, 103 bp, Artificial Sequence
  Synthetic Polynucleotide
taatacgactcactatagggtaagccgtacttcctcttccatttcctccaaacagaggagatggaggatgtggaagaggaacctggcggcagcgcaaaagatg

SEQ ID NO: 203801 - DNA, 103 bp, Artificial Sequence
  Synthetic Polynucleotide
taatacgactcactatagggtttcgcttcttaagccgtacttcctcttccaacagaggagaggaagaatgagtacggctaacctggcggcagcgcaaaagatg

SEQ ID NO: 203802 - DNA, 103 bp, Artificial Sequence
  Synthetic Polynucleotide
taatacgactcactatagggtcttcgtctttttcgcttcttaagccgtacaacagaggagagtacggatgaagaagcgaaacctggcggcagcgcaaaagatg

SEQ ID NO: 203803 - DNA, 103 bp, Artificial Sequence
  Synthetic Polynucleotide
taatacgactcactatagggtatccacatttcttcgtctttttcgcttctaacagaggagaagaagcatgaaagacgaaaacctggcggcagcgcaaaagatg

SEQ ID NO: 203804 - DNA, 103 bp, Artificial Sequence
  Synthetic Polynucleotide
taatacgactcactataggggcaggatctttatccacatttcttcgtcttaacagaggagaaagacgatgaaatgtggaaacctggcggcagcgcaaaagatg

SEQ ID NO: 203805 - DNA, 103 bp, Artificial Sequence
  Synthetic Polynucleotide
taatacgactcactatagggatcttcttttgcaggatctttatccacattaacagaggagaaatgtgatgaaagatcctaacctggcggcagcgcaaaagatg

SEQ ID NO: 203806 - DNA, 103 bp, Artificial Sequence
  Synthetic Polynucleotide
taatacgactcactatagggctttttccacatcttcttttgcaggatcttaacagaggagaaagatcatgcaaaagaagaacctggcggcagcgcaaaagatg

SEQ ID NO: 203807 - DNA, 103 bp, Artificial Sequence
  Synthetic Polynucleotide
taatacgactcactatagggctcttcttagctttttccacatcttcttttaacagaggagaaaaagaatgtgtggaaaaaacctggcggcagcgcaaaagatg

SEQ ID NO: 203808 - DNA, 103 bp, Artificial Sequence
  Synthetic Polynucleotide
taatacgactcactataggggcggcctcttctcttcttagctttttccacaacagaggagagtggaaatggctaagaagaacctggcggcagcgcaaaagatg

SEQ ID NO: 203809 - DNA, 103 bp, Artificial Sequence
  Synthetic Polynucleotide
taatacgactcactatagggttgggcctcctccagacatagggctggagaaacagaggagatctccaatgctatgtctgaacctggcggcagcgcaaaagatg

SEQ ID NO: 203810 - DNA, 103 bp, Artificial Sequence
  Synthetic Polynucleotide
taatacgactcactatagggcagcgggagggcggcctcttctcttcttagaacagaggagactaagaatggaagaggccaacctggcggcagcgcaaaagatg

SEQ ID NO: 203811 - DNA, 103 bp, Artificial Sequence
  Synthetic Polynucleotide
taatacgactcactataggggacagtttctcagcgggagggcggcctcttaacagaggagaaagaggatgccctcccgcaacctggcggcagcgcaaaagatg

SEQ ID NO: 203812 - DNA, 103 bp, Artificial Sequence
  Synthetic Polynucleotide
taatacgactcactataggggggatttggtgacagtttctcagcgggaggaacagaggagacctcccatggagaaactgaacctggcggcagcgcaaaagatg

SEQ ID NO: 203813 - DNA, 103 bp, Artificial Sequence
  Synthetic Polynucleotide
taatacgactcactatagggtcagtttggggggatttggtgacagtttctaacagaggagaagaaacatgcaccaaatcaacctggcggcagcgcaaaagatg

SEQ ID NO: 203814 - DNA, 103 bp, Artificial Sequence
  Synthetic Polynucleotide
taatacgactcactatagggatctgctttgtcagtttggggggatttggtaacagaggagaaccaaaatgccccaaactaacctggcggcagcgcaaaagatg

SEQ ID NO: 203815 - DNA, 103 bp, Artificial Sequence
  Synthetic Polynucleotide
taatacgactcactataggggatagcgttcatctgctttgtcagtttgggaacagaggagacccaaaatgacaaagcagaacctggcggcagcgcaaaagatg

SEQ ID NO: 203816 - DNA, 103 bp, Artificial Sequence
  Synthetic Polynucleotide
taatacgactcactatagggcagtatcgatgatagcgttcatctgctttgaacagaggagacaaagcatgtgaacgctaaacctggcggcagcgcaaaagatg

SEQ ID NO: 203817 - DNA, 103 bp, Artificial Sequence
  Synthetic Polynucleotide
taatacgactcactatagggtagtttatcacagtatcgatgatagcgttcaacagaggagagaacgcatgcatcgatacaacctggcggcagcgcaaaagatg

SEQ ID NO: 203818 - DNA, 103 bp, Artificial Sequence
  Synthetic Polynucleotide
taatacgactcactatagggcctatctttgtagtttatcacagtatcgataacagaggagaatcgatatggtgataaacaacctggcggcagcgcaaaagatg

SEQ ID NO: 203819 - DNA, 103 bp, Artificial Sequence
  Synthetic Polynucleotide
taatacgactcactatagggccacgttacacctatctttgtagtttatcaaacagaggagatgataaatgacaaagataaacctggcggcagcgcaaaagatg

SEQ ID NO: 203820 - DNA, 103 bp, Artificial Sequence
  Synthetic Polynucleotide
taatacgactcactatagggtgaggtggagttgggcctcctccagacataaacagaggagatatgtcatgaggaggcccaacctggcggcagcgcaaaagatg

SEQ ID NO: 203821 - DNA, 103 bp, Artificial Sequence
  Synthetic Polynucleotide
taatacgactcactatagggggcaccttctccacgttacacctatctttgaacagaggagacaaagaatggtgtaacgtaacctggcggcagcgcaaaagatg

SEQ ID NO: 203822 - DNA, 103 bp, Artificial Sequence
  Synthetic Polynucleotide
taatacgactcactatagggagaattactgggcaccttctccacgttacaaacagaggagatgtaacatggagaaggtgaacctggcggcagcgcaaaagatg

SEQ ID NO: 203823 - DNA, 103 bp, Artificial Sequence
  Synthetic Polynucleotide
taatacgactcactatagggtttccaactgagaattactgggcaccttctaacagaggagaagaaggatgccagtaattaacctggcggcagcgcaaaagatg

SEQ ID NO: 203824 - DNA, 103 bp, Artificial Sequence
  Synthetic Polynucleotide
taatacgactcactatagggtttccttctatttccaactgagaattactgaacagaggagacagtaaatgtcagttggaaacctggcggcagcgcaaaagatg

SEQ ID NO: 203825 - DNA, 103 bp, Artificial Sequence
  Synthetic Polynucleotide
taatacgactcactatagggccctgaactgtttccttctatttccaactgaacagaggagacagttgatgatagaaggaaacctggcggcagcgcaaaagatg

SEQ ID NO: 203826 - DNA, 103 bp, Artificial Sequence
  Synthetic Polynucleotide
taatacgactcactatagggtgagctgtcgccctgaactgtttccttctaaacagaggagatagaagatgacagttcagaacctggcggcagcgcaaaagatg

SEQ ID NO: 203827 - DNA, 103 bp, Artificial Sequence
  Synthetic Polynucleotide
taatacgactcactatagggaagacttcactgagctgtcgccctgaactgaacagaggagacagttcatggcgacagctaacctggcggcagcgcaaaagatg

SEQ ID NO: 203828 - DNA, 103 bp, Artificial Sequence
  Synthetic Polynucleotide
taatacgactcactatagggtaactgaatgaagacttcactgagctgtcgaacagaggagacgacagatgagtgaagtcaacctggcggcagcgcaaaagatg

SEQ ID NO: 203829 - DNA, 103 bp, Artificial Sequence
  Synthetic Polynucleotide
taatacgactcactatagggtccttgaaggtaactgaatgaagacttcacaacagaggagagtgaagatgtcattcagtaacctggcggcagcgcaaaagatg

SEQ ID NO: 203830 - DNA, 103 bp, Artificial Sequence
  Synthetic Polynucleotide
taatacgactcactatagggggtaattctttccttgaaggtaactgaatgaacagaggagacattcaatgaccttcaagaacctggcggcagcgcaaaagatg

SEQ ID NO: 203831 - DNA, 103 bp, Artificial Sequence
  Synthetic Polynucleotide
taatacgactcactatagggtggtggcatctgaggtggagttgggcctccaacagaggagaggaggcatgactccacctaacctggcggcagcgcaaaagatg

SEQ ID NO: 203832 - DNA, 103 bp, Artificial Sequence
  Synthetic Polynucleotide
taatacgactcactatagggatagtattctggtaattctttccttgaaggaacagaggagaccttcaatgaaagaattaaacctggcggcagcgcaaaagatg

SEQ ID NO: 203833 - DNA, 103 bp, Artificial Sequence
  Synthetic Polynucleotide
taatacgactcactatagggtaattaattcatagtattctggtaattcttaacagaggagaaagaatatgcagaatactaacctggcggcagcgcaaaagatg

SEQ ID NO: 203834 - DNA, 103 bp, Artificial Sequence
  Synthetic Polynucleotide
taatacgactcactatagggactggcttcctaattaattcatagtattctaacagaggagaagaataatgtgaattaataacctggcggcagcgcaaaagatg

SEQ ID NO: 203835 - DNA, 103 bp, Artificial Sequence
  Synthetic Polynucleotide
taatacgactcactatagggtttgaaatccactggcttcctaattaattcaacagaggagagaattaatgaggaagccaaacctggcggcagcgcaaaagatg

SEQ ID NO: 203836 - DNA, 103 bp, Artificial Sequence
  Synthetic Polynucleotide
taatacgactcactatagggcctttatttttttgaaatccactggcttccaacagaggagaggaagcatgtggatttcaaacctggcggcagcgcaaaagatg

SEQ ID NO: 203837 - DNA, 103 bp, Artificial Sequence
  Synthetic Polynucleotide
taatacgactcactatagggcgaatcctttcctttatttttttgaaatccaacagaggagaggatttatgaaaaataaaaacctggcggcagcgcaaaagatg

SEQ ID NO: 203838 - DNA, 103 bp, Artificial Sequence
  Synthetic Polynucleotide
taatacgactcactatagggcttatgattacgaatcctttcctttattttaacagaggagaaaaataatggaaaggattaacctggcggcagcgcaaaagatg

SEQ ID NO: 203839 - DNA, 103 bp, Artificial Sequence
  Synthetic Polynucleotide
taatacgactcactatagggggctccggtacttatgattacgaatcctttaacagaggagaaaaggaatggtaatcataaacctggcggcagcgcaaaagatg

SEQ ID NO: 203840 - DNA, 103 bp, Artificial Sequence
  Synthetic Polynucleotide
taatacgactcactatagggaggtcgcctaggctccggtacttatgattaaacagaggagataatcaatggtaccggagaacctggcggcagcgcaaaagatg

SEQ ID NO: 203841 - DNA, 103 bp, Artificial Sequence
  Synthetic Polynucleotide
taatacgactcactatagggatccttctccaggtcgcctaggctccggtaaacagaggagataccggatgctaggcgacaacctggcggcagcgcaaaagatg

SEQ ID NO: 203842 - DNA, 103 bp, Artificial Sequence
  Synthetic Polynucleotide
taatacgactcactatagggccggctggcttggtggcatctgaggtggagaacagaggagactccacatgagatgccacaacctggcggcagcgcaaaagatg

SEQ ID NO: 203843 - DNA, 103 bp, Artificial Sequence
  Synthetic Polynucleotide
taatacgactcactataggggaagcatgacatccttctccaggtcgcctaaacagaggagataggcgatgtggagaaggaacctggcggcagcgcaaaagatg

SEQ ID NO: 203844 - DNA, 103 bp, Artificial Sequence
  Synthetic Polynucleotide
taatacgactcactatagggttgtgacagagaagcatgacatccttctccaacagaggagaggagaaatgtgtcatgctaacctggcggcagcgcaaaagatg

SEQ ID NO: 203845 - DNA, 103 bp, Artificial Sequence
  Synthetic Polynucleotide
taatacgactcactatagggcgtctgagcgttgtgacagagaagcatgacaacagaggagagtcatgatgctctgtcacaacctggcggcagcgcaaaagatg

SEQ ID NO: 203846 - DNA, 103 bp, Artificial Sequence
  Synthetic Polynucleotide
taatacgactcactatagggccaggttgaacgtctgagcgttgtgacagaaacagaggagatctgtcatgacgctcagaaacctggcggcagcgcaaaagatg

SEQ ID NO: 203847 - DNA, 103 bp, Artificial Sequence
  Synthetic Polynucleotide
taatacgactcactatagggtgggatccctccaggttgaacgtctgagcgaacagaggagacgctcaatggttcaacctaacctggcggcagcgcaaaagatg

SEQ ID NO: 203848 - DNA, 103 bp, Artificial Sequence
  Synthetic Polynucleotide
taatacgactcactatagggttcatagatctgggatccctccaggttgaaaacagaggagattcaacatggagggatccaacctggcggcagcgcaaaagatg

SEQ ID NO: 203849 - DNA, 103 bp, Artificial Sequence
  Synthetic Polynucleotide
taatacgactcactatagggcgatggagtcttcatagatctgggatccctaacagaggagaagggatatgagatctatgaacctggcggcagcgcaaaagatg

SEQ ID NO: 203850 - DNA, 103 bp, Artificial Sequence
  Synthetic Polynucleotide
taatacgactcactataggggactgtaagacgatggagtcttcatagatcaacagaggagagatctaatgagactccataacctggcggcagcgcaaaagatg

SEQ ID NO: 203851 - DNA, 103 bp, Artificial Sequence
  Synthetic Polynucleotide
taatacgactcactatagggcttaaacactgactgtaagacgatggagtcaacagaggagagactccatggtcttacagaacctggcggcagcgcaaaagatg

SEQ ID NO: 203852 - DNA, 103 bp, Artificial Sequence
  Synthetic Polynucleotide
taatacgactcactataggggccgggcactcttaaacactgactgtaagaaacagaggagatcttacatgcagtgtttaaacctggcggcagcgcaaaagatg

SEQ ID NO: 203853 - DNA, 103 bp, Artificial Sequence
  Synthetic Polynucleotide
taatacgactcactatagggatgagggcccccggctggcttggtggcatcaacagaggagagatgccatgaagccagccaacctggcggcagcgcaaaagatg

SEQ ID NO: 203854 - DNA, 103 bp, Artificial Sequence
  Synthetic Polynucleotide
taatacgactcactataggggcaattttctgccgggcactcttaaacactaacagaggagaagtgttatggagtgcccgaacctggcggcagcgcaaaagatg

SEQ ID NO: 203855 - DNA, 103 bp, Artificial Sequence
  Synthetic Polynucleotide
taatacgactcactatagggttcctctttggcaattttctgccgggcactaacagaggagaagtgccatgcagaaaattaacctggcggcagcgcaaaagatg

SEQ ID NO: 203856 - DNA, 103 bp, Artificial Sequence
  Synthetic Polynucleotide
taatacgactcactatagggcctcactctcttcctctttggcaattttctaacagaggagaagaaaaatgccaaagaggaacctggcggcagcgcaaaagatg

SEQ ID NO: 203857 - DNA, 103 bp, Artificial Sequence
  Synthetic Polynucleotide
taatacgactcactatagggttgctttcatcctcactctcttcctctttgaacagaggagacaaagaatgagagagtgaaacctggcggcagcgcaaaagatg

SEQ ID NO: 203858 - DNA, 103 bp, Artificial Sequence
  Synthetic Polynucleotide
taatacgactcactatagggctcctcttcattgctttcatcctcactctcaacagaggagagagagtatggatgaaagcaacctggcggcagcgcaaaagatg

SEQ ID NO: 203859 - DNA, 103 bp, Artificial Sequence
  Synthetic Polynucleotide
taatacgactcactatagggcttcctcttcctcctcttcattgctttcataacagaggagaatgaaaatgatgaagaggaacctggcggcagcgcaaaagatg

SEQ ID NO: 203860 - DNA, 103 bp, Artificial Sequence
  Synthetic Polynucleotide
taatacgactcactatagggtcttcttcatcttcctcttcctcctcttcaaacagaggagatgaagaatgggaagaggaaacctggcggcagcgcaaaagatg

SEQ ID NO: 203861 - DNA, 103 bp, Artificial Sequence
  Synthetic Polynucleotide
taatacgactcactatagggggactctgactcttcttcatcttcctcttcaacagaggagagaagagatggatgaagaaaacctggcggcagcgcaaaagatg

SEQ ID NO: 203862 - DNA, 103 bp, Artificial Sequence
  Synthetic Polynucleotide
taatacgactcactatagggattttgcctcggactctgactcttcttcataacagaggagaatgaagatgagtcagagtaacctggcggcagcgcaaaagatg

SEQ ID NO: 203863 - DNA, 103 bp, Artificial Sequence
  Synthetic Polynucleotide
taatacgactcactatagggaccttgactgattttgcctcggactctgacaacagaggagagtcagaatgcgaggcaaaaacctggcggcagcgcaaaagatg

SEQ ID NO: 203864 - DNA, 103 bp, Artificial Sequence
  Synthetic Polynucleotide
taatacgactcactatagggatcacctgggatgagggcccccggctggctaacagaggagaagccagatgggggccctcaacctggcggcagcgcaaaagatg

SEQ ID NO: 203865 - DNA, 103 bp, Artificial Sequence
  Synthetic Polynucleotide
taatacgactcactatagggcttaattttcaccttgactgattttgcctcaacagaggagagaggcaatgtcagtcaagaacctggcggcagcgcaaaagatg

SEQ ID NO: 203866 - DNA, 103 bp, Artificial Sequence
  Synthetic Polynucleotide
taatacgactcactatagggttttattgagcttaattttcaccttgactgaacagaggagacagtcaatgtgaaaattaaacctggcggcagcgcaaaagatg

SEQ ID NO: 203867 - DNA, 103 bp, Artificial Sequence
  Synthetic Polynucleotide
taatacgactcactatagggttgtcatcttttttattgagcttaattttcaacagaggagagaaaatatggctcaataaaacctggcggcagcgcaaaagatg

SEQ ID NO: 203868 - DNA, 103 bp, Artificial Sequence
  Synthetic Polynucleotide
taatacgactcactataggggtcccggcctttgtcatcttttttattgagaacagaggagactcaatatgaaagatgacaacctggcggcagcgcaaaagatg

SEQ ID NO: 203869 - DNA, 103 bp, Artificial Sequence
  Synthetic Polynucleotide
taatacgactcactatagggctttccctttgtcccggcctttgtcatcttaacagaggagaaagatgatgaaggccgggaacctggcggcagcgcaaaagatg

SEQ ID NO: 203870 - DNA, 103 bp, Artificial Sequence
  Synthetic Polynucleotide
taatacgactcactatagggcttttcttgcctttccctttgtcccggcctaacagaggagaaggccgatgcaaagggaaaacctggcggcagcgcaaaagatg

SEQ ID NO: 203871 - DNA, 103 bp, Artificial Sequence
  Synthetic Polynucleotide
taatacgactcactatagggtcgatttggccttttcttgcctttccctttaacagaggagaaaagggatgggcaagaaaaacctggcggcagcgcaaaagatg

SEQ ID NO: 203872 - DNA, 103 bp, Artificial Sequence
  Synthetic Polynucleotide
taatacgactcactatagggtggcttttcctcgatttggccttttcttgcaacagaggagagcaagaatgggccaaatcaacctggcggcagcgcaaaagatg

SEQ ID NO: 203873 - DNA, 103 bp, Artificial Sequence
  Synthetic Polynucleotide
taatacgactcactatagggactacaggtttggcttttcctcgatttggcaacagaggagagccaaaatgaggaaaagcaacctggcggcagcgcaaaagatg

SEQ ID NO: 203874 - DNA, 103 bp, Artificial Sequence
  Synthetic Polynucleotide
taatacgactcactatagggaaaatcgctcactacaggtttggcttttccaacagaggagaggaaaaatgaaacctgtaaacctggcggcagcgcaaaagatg

SEQ ID NO: 203875 - DNA, 103 bp, Artificial Sequence
  Synthetic Polynucleotide
taatacgactcactatagggtggcctgcggatcacctgggatgagggcccaacagaggagagggcccatgtcccaggtgaacctggcggcagcgcaaaagatg

SEQ ID NO: 203876 - DNA, 103 bp, Artificial Sequence
  Synthetic Polynucleotide
taatacgactcactatagggcatcgctgtcaaaatcgctcactacaggttaacagaggagaaacctgatgtgagcgattaacctggcggcagcgcaaaagatg

SEQ ID NO: 203877 - DNA, 103 bp, Artificial Sequence
  Synthetic Polynucleotide
taatacgactcactatagggtcctgctcctcatcgctgtcaaaatcgctcaacagaggagagagcgaatgtgacagcgaaacctggcggcagcgcaaaagatg

SEQ ID NO: 203878 - DNA, 103 bp, Artificial Sequence
  Synthetic Polynucleotide
taatacgactcactatagggttcacgttcatcctgctcctcatcgctgtcaacagaggagagacagcatggaggagcagaacctggcggcagcgcaaaagatg

SEQ ID NO: 203879 - DNA, 103 bp, Artificial Sequence
  Synthetic Polynucleotide
taatacgactcactatagggcttctgactgttcacgttcatcctgctcctaacagaggagaaggagcatgatgaacgtgaacctggcggcagcgcaaaagatg

SEQ ID NO: 203880 - DNA, 103 bp, Artificial Sequence
  Synthetic Polynucleotide
taatacgactcactataggggtcccacttccttctgactgttcacgttcaaacagaggagatgaacgatgacagtcagaaacctggcggcagcgcaaaagatg

SEQ ID NO: 203881 - DNA, 103 bp, Artificial Sequence
  Synthetic Polynucleotide
taatacgactcactatagggctcatcatccgtcccacttccttctgactgaacagaggagacagtcaatgggaagtgggaacctggcggcagcgcaaaagatg

SEQ ID NO: 203882 - DNA, 103 bp, Artificial Sequence
  Synthetic Polynucleotide
taatacgactcactatagggggctggctcatggcctgcggatcacctgggaacagaggagacccaggatgtccgcaggcaacctggcggcagcgcaaaagatg

SEQ ID NO: 203883 - DNA, 103 bp, Artificial Sequence
  Synthetic Polynucleotide
taatacgactcactatagggacctctgttgggctggctcatggcctgcggaacagaggagaccgcagatgatgagccagaacctggcggcagcgcaaaagatg

SEQ ID NO: 203884 - DNA, 103 bp, Artificial Sequence
  Synthetic Polynucleotide
taatacgactcactatagggcaggggaaggcccaggccccggcgaaggccaacagaggagaggccttatgcggggcctgaacctggcggcagcgcaaaagatg

SEQ ID NO: 203885 - DNA, 103 bp, Artificial Sequence
  Synthetic Polynucleotide
taatacgactcactatagggaaggtgagggacctctgttgggctggctcaaacagaggagatgagccatgccaacagagaacctggcggcagcgcaaaagatg

SEQ ID NO: 203886 - DNA, 103 bp, Artificial Sequence
  Synthetic Polynucleotide
taatacgactcactatagggacaggactgaaaggtgagggacctctgttgaacagaggagacaacagatgtccctcaccaacctggcggcagcgcaaaagatg

SEQ ID NO: 203887 - DNA, 103 bp, Artificial Sequence
  Synthetic Polynucleotide
taatacgactcactatagggatgcagctggacaggactgaaaggtgagggaacagaggagaccctcaatgttcagtcctaacctggcggcagcgcaaaagatg

SEQ ID NO: 203888 - DNA, 103 bp, Artificial Sequence
  Synthetic Polynucleotide
taatacgactcactatagggctcgaagctgatgcagctggacaggactgaaacagaggagatcagtcatgtccagctgcaacctggcggcagcgcaaaagatg

SEQ ID NO: 203889 - DNA, 103 bp, Artificial Sequence
  Synthetic Polynucleotide
taatacgactcactatagggaaaatctgagctcgaagctgatgcagctggaacagaggagaccagctatgtcagcttcgaacctggcggcagcgcaaaagatg

SEQ ID NO: 203890 - DNA, 103 bp, Artificial Sequence
  Synthetic Polynucleotide
taatacgactcactatagggtttataagctaaaatctgagctcgaagctgaacagaggagacagcttatggctcagattaacctggcggcagcgcaaaagatg

SEQ ID NO: 203891 - DNA, 103 bp, Artificial Sequence
  Synthetic Polynucleotide
taatacgactcactataggggggccagcattttataagctaaaatctgagaacagaggagactcagaatgtagcttataaacctggcggcagcgcaaaagatg

SEQ ID NO: 203892 - DNA, 103 bp, Artificial Sequence
  Synthetic Polynucleotide
taatacgactcactatagggggctggcctcgggccagcattttataagctaacagaggagaagcttaatgaatgctggcaacctggcggcagcgcaaaagatg

SEQ ID NO: 203893 - DNA, 103 bp, Artificial Sequence
  Synthetic Polynucleotide
taatacgactcactatagggttcggggaggggctggcctcgggccagcataacagaggagaatgctgatgcgaggccagaacctggcggcagcgcaaaagatg

SEQ ID NO: 203894 - DNA, 103 bp, Artificial Sequence
  Synthetic Polynucleotide
taatacgactcactataggggctgcagcgtttcggggaggggctggcctcaacagaggagagaggccatgccctccccgaacctggcggcagcgcaaaagatg

SEQ ID NO: 203895 - DNA, 103 bp, Artificial Sequence
  Synthetic Polynucleotide
taatacgactcactatagggagaattggcccaggggaaggcccaggccccaacagaggagaggggccatggccttccccaacctggcggcagcgcaaaagatg

SEQ ID NO: 203896 - DNA, 103 bp, Artificial Sequence
  Synthetic Polynucleotide
taatacgactcactatagggtggactgcaagctgcagcgtttcggggaggaacagaggagacctcccatgaacgctgcaaacctggcggcagcgcaaaagatg

SEQ ID NO: 203897 - DNA, 103 bp, Artificial Sequence
  Synthetic Polynucleotide
taatacgactcactatagggccttttcccctggactgcaagctgcagcgtaacagaggagaacgctgatgcttgcagtcaacctggcggcagcgcaaaagatg

SEQ ID NO: 203898 - DNA, 103 bp, Artificial Sequence
  Synthetic Polynucleotide
taatacgactcactatagggcaggcaacgtccttttcccctggactgcaaaacagaggagattgcagatgaggggaaaaaacctggcggcagcgcaaaagatg

SEQ ID NO: 203899 - DNA, 103 bp, Artificial Sequence
  Synthetic Polynucleotide
taatacgactcactatagggtgctgcaagccaggcaacgtccttttccccaacagaggagaggggaaatggacgttgccaacctggcggcagcgcaaaagatg

SEQ ID NO: 203900 - DNA, 103 bp, Artificial Sequence
  Synthetic Polynucleotide
taatacgactcactatagggctgctgttgttgctgcaagccaggcaacgtaacagaggagaacgttgatgggcttgcagaacctggcggcagcgcaaaagatg

SEQ ID NO: 203901 - DNA, 103 bp, Artificial Sequence
  Synthetic Polynucleotide
taatacgactcactataggggctgttgctgctgctgttgttgctgcaagcaacagaggagagcttgcatgaacaacagcaacctggcggcagcgcaaaagatg

SEQ ID NO: 203902 - DNA, 103 bp, Artificial Sequence
  Synthetic Polynucleotide
taatacgactcactatagggtgctgctgctgctgttgctgctgctgttgtaacagaggagaacaacaatggcagcaacaaacctggcggcagcgcaaaagatg

SEQ ID NO: 203903 - DNA, 103 bp, Artificial Sequence
  Synthetic Polynucleotide
taatacgactcactatagggctgctgctgctgctgctgctgctgttgctgaacagaggagacagcaaatgcagcagcagaacctggcggcagcgcaaaagatg

SEQ ID NO: 203904 - DNA, 103 bp, Artificial Sequence; identical to SEQ ID NO: 88576
  Synthetic Polynucleotide

SEQ ID NO: 203905 - DNA, 103 bp, Artificial Sequence
  Synthetic Polynucleotide
taatacgactcactatagggtgttgctgctgctgctgctgctgctgctgcaacagaggagagcagcaatggcagcagcaaacctggcggcagcgcaaaagatg

SEQ ID NO: 203906 - DNA, 103 bp, Artificial Sequence
  Synthetic Polynucleotide
taatacgactcactatagggactaggcccaagaattggcccaggggaaggaacagaggagaccttccatggggccaattaacctggcggcagcgcaaaagatg

SEQ ID NO: 203907 - DNA, 103 bp, Artificial Sequence
  Synthetic Polynucleotide
taatacgactcactatagggctgcggctgctgttgctgctgctgctgctgaacagaggagacagcagatgcagcagcaaaacctggcggcagcgcaaaagatg

SEQ ID NO: 203908 - DNA, 103 bp, Artificial Sequence
  Synthetic Polynucleotide
taatacgactcactataggggcggctgctgctgcggctgctgttgctgctaacagaggagaagcagcatgagcagccgcaacctggcggcagcgcaaaagatg

SEQ ID NO: 203909 - DNA, 103 bp, Artificial Sequence
  Synthetic Polynucleotide
taatacgactcactatagggtgtggttgcggcggctgctgctgcggctgcaacagaggagagcagccatggcagcagccaacctggcggcagcgcaaaagatg

SEQ ID NO: 203910 - DNA, 103 bp, Artificial Sequence
  Synthetic Polynucleotide
taatacgactcactatagggttgctgcgtctgtggttgcggcggctgctgaacagaggagacagcagatgccgcaaccaaacctggcggcagcgcaaaagatg

SEQ ID NO: 203911 - DNA, 103 bp, Artificial Sequence
  Synthetic Polynucleotide
taatacgactcactataggggctgctgttgttgctgcgtctgtggttgcgaacagaggagacgcaacatgagacgcagcaacctggcggcagcgcaaaagatg

SEQ ID NO: 203912 - DNA, 103 bp, Artificial Sequence
  Synthetic Polynucleotide
taatacgactcactatagggacaagggccggctgctgttgttgctgcgtcaacagaggagagacgcaatgacaacagcaaacctggcggcagcgcaaaagatg

SEQ ID NO: 203913 - DNA, 103 bp, Artificial Sequence
  Synthetic Polynucleotide
taatacgactcactataggggttgtagttaacaagggccggctgctgttgaacagaggagacaacagatgccggcccttaacctggcggcagcgcaaaagatg

SEQ ID NO: 203914 - DNA, 103 bp, Artificial Sequence
  Synthetic Polynucleotide
taatacgactcactatagggcagatggtctgttgtagttaacaagggccgaacagaggagacggcccatgttaactacaaacctggcggcagcgcaaaagatg

SEQ ID NO: 203915 - DNA, 103 bp, Artificial Sequence
  Synthetic Polynucleotide
taatacgactcactatagggggccccgggccagatggtctgttgtagttaaacagaggagataactaatgcagaccatcaacctggcggcagcgcaaaagatg

SEQ ID NO: 203916 - DNA, 103 bp, Artificial Sequence
  Synthetic Polynucleotide
taatacgactcactataggggctcagctccggccccgggccagatggtctaacagaggagaagaccaatgggcccggggaacctggcggcagcgcaaaagatg

SEQ ID NO: 203917 - DNA, 103 bp, Artificial Sequence
  Synthetic Polynucleotide
taatacgactcactatagggctggtcctggactaggcccaagaattggccaacagaggagaggccaaatgttgggcctaaacctggcggcagcgcaaaagatg

SEQ ID NO: 203918 - DNA, 103 bp, Artificial Sequence
  Synthetic Polynucleotide
taatacgactcactatagggtgctcgggccgctcagctccggccccgggcaacagaggagagcccggatgcggagctgaaacctggcggcagcgcaaaagatg

SEQ ID NO: 203919 - DNA, 103 bp, Artificial Sequence
  Synthetic Polynucleotide
taatacgactcactatagggttctgcggggtgctcgggccgctcagctccaacagaggagaggagctatgcggcccgagaacctggcggcagcgcaaaagatg

SEQ ID NO: 203920 - DNA, 103 bp, Artificial Sequence
  Synthetic Polynucleotide
taatacgactcactatagggcaccggcagcttctgcggggtgctcgggccaacagaggagaggcccgatgaccccgcagaacctggcggcagcgcaaaagatg

SEQ ID NO: 203921 - DNA, 103 bp, Artificial Sequence
  Synthetic Polynucleotide
taatacgactcactatagggcgggcgcgggcaccggcagcttctgcggggaacagaggagaccccgcatgagctgccggaacctggcggcagcgcaaaagatg

SEQ ID NO: 203922 - DNA, 103 bp, Artificial Sequence
  Synthetic Polynucleotide
taatacgactcactatagggggccggccgccgggcgcgggcaccggcagcaacagaggagagctgccatggcccgcgccaacctggcggcagcgcaaaagatg

SEQ ID NO: 203923 - DNA, 103 bp, Artificial Sequence
  Synthetic Polynucleotide
taatacgactcactatagggcgcgggcgagggccggccgccgggcgcgggaacagaggagacccgcgatgggcggccggaacctggcggcagcgcaaaagatg

SEQ ID NO: 203924 - DNA, 103 bp, Artificial Sequence
  Synthetic Polynucleotide
taatacgactcactatagggctgcggggggcgcgggcgagggccggccgcaacagaggagagcggccatgcctcgcccgaacctggcggcagcgcaaaagatg

SEQ ID NO: 203925 - DNA, 103 bp, Artificial Sequence
  Synthetic Polynucleotide
taatacgactcactatagggggctgcgcggctgcggggggcgcgggcgagaacagaggagactcgccatggccccccgcaacctggcggcagcgcaaaagatg

SEQ ID NO: 203926 - DNA, 103 bp, Artificial Sequence
  Synthetic Polynucleotide
taatacgactcactatagggggccgcgggcggctgcgcggctgcggggggaacagaggagaccccccatggccgcgcagaacctggcggcagcgcaaaagatg

SEQ ID NO: 203927 - DNA, 103 bp, Artificial Sequence
  Synthetic Polynucleotide
taatacgactcactatagggcgggcactgcggccgcgggcggctgcgcggaacagaggagaccgcgcatgcgcccgcggaacctggcggcagcgcaaaagatg

SEQ ID NO: 203928 - DNA, 103 bp, Artificial Sequence
  Synthetic Polynucleotide
taatacgactcactatagggggggatggtcctggtcctggactaggcccaaacagaggagatgggccatgtccaggaccaacctggcggcagcgcaaaagatg

SEQ ID NO: 203929 - DNA, 103 bp, Artificial Sequence
  Synthetic Polynucleotide
taatacgactcactatagggactgagggcccgggcactgcggccgcgggcaacagaggagagcccgcatgcgcagtgccaacctggcggcagcgcaaaagatg

SEQ ID NO: 203930 - DNA, 103 bp, Artificial Sequence
  Synthetic Polynucleotide
taatacgactcactatagggcggctgcggcactgagggcccgggcactgcaacagaggagagcagtgatggggccctcaaacctggcggcagcgcaaaagatg

SEQ ID NO: 203931 - DNA, 103 bp, Artificial Sequence
  Synthetic Polynucleotide
taatacgactcactataggggccccggggccggctgcggcactgagggccaacagaggagaggccctatgtgccgcagcaacctggcggcagcgcaaaagatg

SEQ ID NO: 203932 - DNA, 103 bp, Artificial Sequence
  Synthetic Polynucleotide
taatacgactcactatagggggcgagggctgccccggggccggctgcggcaacagaggagagccgcaatgggccccgggaacctggcggcagcgcaaaagatg

SEQ ID NO: 203933 - DNA, 103 bp, Artificial Sequence
  Synthetic Polynucleotide
taatacgactcactatagggctggaggacgggcgagggctgccccggggcaacagaggagagccccgatgcagccctcgaacctggcggcagcgcaaaagatg

SEQ ID NO: 203934 - DNA, 103 bp, Artificial Sequence
  Synthetic Polynucleotide
taatacgactcactatagggtctgctgcagctggaggacgggcgagggctaacagaggagaagccctatgccgtcctccaacctggcggcagcgcaaaagatg

SEQ ID NO: 203935 - DNA, 103 bp, Artificial Sequence
  Synthetic Polynucleotide
taatacgactcactatagggcggctctgcttctgctgcagctggaggacgaacagaggagacgtcctatggctgcagcaaacctggcggcagcgcaaaagatg

SEQ ID NO: 203936 - DNA, 103 bp, Artificial Sequence
  Synthetic Polynucleotide
taatacgactcactatagggggggctgatgcggctctgcttctgctgcagaacagaggagactgcagatgaagcagagcaacctggcggcagcgcaaaagatg

SEQ ID NO: 203937 - DNA, 103 bp, Artificial Sequence
  Synthetic Polynucleotide
taatacgactcactataggggtttctggatggggctgatgcggctctgctaacagaggagaagcagaatggcatcagccaacctggcggcagcgcaaaagatg

SEQ ID NO: 203938 - DNA, 103 bp, Artificial Sequence
  Synthetic Polynucleotide
taatacgactcactatagggaggccttgcggtttctggatggggctgatgaacagaggagacatcagatgcatccagaaaacctggcggcagcgcaaaagatg

SEQ ID NO: 203939 - DNA, 103 bp, Artificial Sequence
  Synthetic Polynucleotide
taatacgactcactatagggtccgcccaggggtgggtctggagtggacataacagaggagaatgtccatgccagacccaaacctggcggcagcgcaaaagatg

SEQ ID NO: 203940 - DNA, 103 bp, Artificial Sequence
  Synthetic Polynucleotide
taatacgactcactataggggtgggcggagcccggcgagggacccgggctaacagaggagaagcccgatgccctcgccgaacctggcggcagcgcaaaagatg

SEQ ID NO: 203941 - DNA, 103 bp, Artificial Sequence
  Synthetic Polynucleotide
taatacgactcactatagggcgcgggctgggccggctgcccgggggactgaacagaggagacagtccatggggcagccgaacctggcggcagcgcaaaagatg

SEQ ID NO: 203942 - DNA, 103 bp, Artificial Sequence
  Synthetic Polynucleotide
taatacgactcactataggggcaccatgggcgcgggctgggccggctgccaacagaggagaggcagcatgcccagcccgaacctggcggcagcgcaaaagatg

SEQ ID NO: 203943 - DNA, 103 bp, Artificial Sequence
  Synthetic Polynucleotide
taatacgactcactatagggtggtgcagtggcaccatgggcgcgggctggaacagaggagaccagccatggcccatggtaacctggcggcagcgcaaaagatg

SEQ ID NO: 203944 - DNA, 103 bp, Artificial Sequence
  Synthetic Polynucleotide
taatacgactcactataggggctctgcttctggtgcagtggcaccatgggaacagaggagacccatgatgccactgcacaacctggcggcagcgcaaaagatg

SEQ ID NO: 203945 - DNA, 103 bp, Artificial Sequence
  Synthetic Polynucleotide
taatacgactcactataggggggtgatgcggctctgcttctggtgcagtgaacagaggagacactgcatgagaagcagaaacctggcggcagcgcaaaagatg

SEQ ID NO: 203946 - DNA, 103 bp, Artificial Sequence
  Synthetic Polynucleotide
taatacgactcactatagggttctggatgggggtgatgcggctctgcttcaacagaggagagaagcaatgccgcatcacaacctggcggcagcgcaaaagatg

SEQ ID NO: 203947 - DNA, 103 bp, Artificial Sequence
  Synthetic Polynucleotide
taatacgactcactataggggccccgcggcttctggatgggggtgatgcgaacagaggagacgcatcatgcccatccagaacctggcggcagcgcaaaagatg

SEQ ID NO: 203948 - DNA, 103 bp, Artificial Sequence
  Synthetic Polynucleotide
taatacgactcactatagggcagggtcgaggccccgcggcttctggatggaacagaggagaccatccatgagccgcgggaacctggcggcagcgcaaaagatg

SEQ ID NO: 203949 - DNA, 103 bp, Artificial Sequence
  Synthetic Polynucleotide
taatacgactcactatagggaggatctccacagggtcgaggccccgcggcaacagaggagagccgcgatgcctcgacccaacctggcggcagcgcaaaagatg

SEQ ID NO: 203950 - DNA, 103 bp, Artificial Sequence
  Synthetic Polynucleotide
taatacgactcactataggggcgctcctgcaggatctccacagggtcgagaacagaggagactcgacatggtggagatcaacctggcggcagcgcaaaagatg

SEQ ID NO: 203951 - DNA, 103 bp, Artificial Sequence
  Synthetic Polynucleotide
taatacgactcactatagggccatcatgctgtgggcggagcccggcgaggaacagaggagacctcgcatggctccgcccaacctggcggcagcgcaaaagatg

SEQ ID NO: 203952 - DNA, 103 bp, Artificial Sequence
  Synthetic Polynucleotide
taatacgactcactataggggcctgtactcgcgctcctgcaggatctccaaacagaggagatggagaatgtgcaggagcaacctggcggcagcgcaaaagatg

SEQ ID NO: 203953 - DNA, 103 bp, Artificial Sequence
  Synthetic Polynucleotide
taatacgactcactatagggcgagcctgcagcctgtactcgcgctcctgcaacagaggagagcaggaatgcgagtacagaacctggcggcagcgcaaaagatg

SEQ ID NO: 203954 - DNA, 103 bp, Artificial Sequence
  Synthetic Polynucleotide
taatacgactcactataggggtgtgcgatgcgagcctgcagcctgtactcaacagaggagagagtacatgctgcaggctaacctggcggcagcgcaaaagatg

SEQ ID NO: 203955 - DNA, 103 bp, Artificial Sequence
  Synthetic Polynucleotide
taatacgactcactatagggcctgaattcggtgtgcgatgcgagcctgcaaacagaggagatgcaggatggcatcgcacaacctggcggcagcgcaaaagatg

SEQ ID NO: 203956 - DNA, 103 bp, Artificial Sequence
  Synthetic Polynucleotide
taatacgactcactatagggttttcaagttcctgaattcggtgtgcgatgaacagaggagacatcgcatgccgaattcaaacctggcggcagcgcaaaagatg

SEQ ID NO: 203957 - DNA, 103 bp, Artificial Sequence
  Synthetic Polynucleotide
taatacgactcactatagggcccgggaaggttttcaagttcctgaattcgaacagaggagacgaattatggaacttgaaaacctggcggcagcgcaaaagatg

SEQ ID NO: 203958 - DNA, 103 bp, Artificial Sequence
  Synthetic Polynucleotide
taatacgactcactatagggcggccagggacccgggaaggttttcaagttaacagaggagaaacttgatgaccttcccgaacctggcggcagcgcaaaagatg

SEQ ID NO: 203959 - DNA, 103 bp, Artificial Sequence
  Synthetic Polynucleotide
taatacgactcactatagggcgcaaatccccggccagggacccgggaaggaacagaggagaccttccatggtccctggcaacctggcggcagcgcaaaagatg

SEQ ID NO: 203960 - DNA, 103 bp, Artificial Sequence
  Synthetic Polynucleotide
taatacgactcactatagggcgctttggttcgcaaatccccggccagggaaacagaggagatccctgatgggggatttgaacctggcggcagcgcaaaagatg

SEQ ID NO: 203961 - DNA, 103 bp, Artificial Sequence
  Synthetic Polynucleotide
taatacgactcactataggggctcaatggtcgctttggttcgcaaatcccaacagaggagagggattatggaaccaaagaacctggcggcagcgcaaaagatg

SEQ ID NO: 203962 - DNA, 103 bp, Artificial Sequence
  Synthetic Polynucleotide
taatacgactcactataggggggctgggccccatcatgctgtgggcggagaacagaggagactccgcatgcagcatgataacctggcggcagcgcaaaagatg

SEQ ID NO: 203963 - DNA, 103 bp, Artificial Sequence
  Synthetic Polynucleotide
taatacgactcactatagggagggccttgagctcaatggtcgctttggttaacagaggagaaaccaaatggaccattgaaacctggcggcagcgcaaaagatg

SEQ ID NO: 203964 - DNA, 103 bp, Artificial Sequence
  Synthetic Polynucleotide
taatacgactcactatagggcagcagcctgagggccttgagctcaatggtaacagaggagaaccattatgctcaaggccaacctggcggcagcgcaaaagatg

SEQ ID NO: 203965 - DNA, 103 bp, Artificial Sequence
  Synthetic Polynucleotide
taatacgactcactatagggtctggaagttcagcagcctgagggccttgaaacagaggagatcaaggatgtcaggctgcaacctggcggcagcgcaaaagatg

SEQ ID NO: 203966 - DNA, 103 bp, Artificial Sequence
  Synthetic Polynucleotide
taatacgactcactatagggcgcagctgcctctggaagttcagcagcctgaacagaggagacaggctatggaacttccaaacctggcggcagcgcaaaagatg

SEQ ID NO: 203967 - DNA, 103 bp, Artificial Sequence
  Synthetic Polynucleotide
taatacgactcactatagggcacctcctggcgcagctgcctctggaagttaacagaggagaaacttcatgaggcagctgaacctggcggcagcgcaaaagatg

SEQ ID NO: 203968 - DNA, 103 bp, Artificial Sequence
  Synthetic Polynucleotide
taatacgactcactatagggtgcacaccaccacctcctggcgcagctgccaacagaggagaggcagcatggccaggaggaacctggcggcagcgcaaaagatg

SEQ ID NO: 203969 - DNA, 103 bp, Artificial Sequence
  Synthetic Polynucleotide
taatacgactcactatagggtccctccgcatgcacaccaccacctcctggaacagaggagaccaggaatgggtggtgtgaacctggcggcagcgcaaaagatg

SEQ ID NO: 203970 - DNA, 103 bp, Artificial Sequence
  Synthetic Polynucleotide
taatacgactcactatagggcagcgctgtgtccctccgcatgcacaccacaacagaggagagtggtgatgatgcggaggaacctggcggcagcgcaaaagatg

SEQ ID NO: 203971 - DNA, 103 bp, Artificial Sequence
  Synthetic Polynucleotide
taatacgactcactataggggggctgtctccagcgctgtgtccctccgcaaacagaggagatgcggaatgacacagcgcaacctggcggcagcgcaaaagatg

SEQ ID NO: 203972 - DNA, 103 bp, Artificial Sequence
  Synthetic Polynucleotide
taatacgactcactatagggttagcattgagggctgtctccagcgctgtgaacagaggagacacagcatgggagacagcaacctggcggcagcgcaaaagatg

SEQ ID NO: 203973 - DNA, 103 bp, Artificial Sequence
  Synthetic Polynucleotide
taatacgactcactataggggggcggccctgggctgggccccatcatgctaacagaggagaagcatgatggggcccagcaacctggcggcagcgcaaaagatg

SEQ ID NO: 203974 - DNA, 103 bp, Artificial Sequence
  Synthetic Polynucleotide
taatacgactcactatagggcttgtaggccttagcattgagggctgtctcaacagaggagagagacaatgctcaatgctaacctggcggcagcgcaaaagatg

SEQ ID NO: 203975 - DNA, 103 bp, Artificial Sequence
  Synthetic Polynucleotide
taatacgactcactataggggcttgctgcgcttgtaggccttagcattgaaacagaggagatcaatgatgaggcctacaaacctggcggcagcgcaaaagatg

SEQ ID NO: 203976 - DNA, 103 bp, Artificial Sequence
  Synthetic Polynucleotide
taatacgactcactatagggagggactggcgcttgctgcgcttgtaggccaacagaggagaggcctaatggcgcagcaaaacctggcggcagcgcaaaagatg

SEQ ID NO: 203977 - DNA, 103 bp, Artificial Sequence
  Synthetic Polynucleotide
taatacgactcactatagggggcctcgcgcagggactggcgcttgctgcgaacagaggagacgcagcatgcgccagtccaacctggcggcagcgcaaaagatg

SEQ ID NO: 203978 - DNA, 103 bp, Artificial Sequence
  Synthetic Polynucleotide
taatacgactcactatagggcagtgatgcgggcctcgcgcagggactggcaacagaggagagccagtatgtgcgcgaggaacctggcggcagcgcaaaagatg

SEQ ID NO: 203979 - DNA, 103 bp, Artificial Sequence
  Synthetic Polynucleotide
taatacgactcactatagggtccagcttctcagtgatgcgggcctcgcgcaacagaggagagcgcgaatgccgcatcacaacctggcggcagcgcaaaagatg

SEQ ID NO: 203980 - DNA, 103 bp, Artificial Sequence
  Synthetic Polynucleotide
taatacgactcactatagggctgctgcttctccagcttctcagtgatgcgaacagaggagacgcatcatggagaagctgaacctggcggcagcgcaaaagatg

SEQ ID NO: 203981 - DNA, 103 bp, Artificial Sequence
  Synthetic Polynucleotide
taatacgactcactataggggctcgatcttctgctgcttctccagcttctaacagaggagaagaagcatgagaagcagcaacctggcggcagcgcaaaagatg

SEQ ID NO: 203982 - DNA, 103 bp, Artificial Sequence
  Synthetic Polynucleotide
taatacgactcactatagggttgcgctcctgctcgatcttctgctgcttcaacagaggagagaagcaatggaagatcgaaacctggcggcagcgcaaaagatg

SEQ ID NO: 203983 - DNA, 103 bp, Artificial Sequence
  Synthetic Polynucleotide
taatacgactcactatagggctgccggcgcttgcgctcctgctcgatcttaacagaggagaaagatcatgcaggagcgcaacctggcggcagcgcaaaagatg

SEQ ID NO: 203984 - DNA, 103 bp, Artificial Sequence
  Synthetic Polynucleotide
taatacgactcactataggggtcctgctgagggcggccctgggctgggccaacagaggagaggcccaatgcagggccgcaacctggcggcagcgcaaaagatg

SEQ ID NO: 203985 - DNA, 103 bp, Artificial Sequence
  Synthetic Polynucleotide
taatacgactcactatagggcctggtgcttctgccggcgcttgcgctcctaacagaggagaaggagcatgagcgccggcaacctggcggcagcgcaaaagatg

SEQ ID NO: 203986 - DNA, 103 bp, Artificial Sequence
  Synthetic Polynucleotide
taatacgactcactatagggttgaggtattcctggtgcttctgccggcgcaacagaggagagcgccgatggaagcaccaaacctggcggcagcgcaaaagatg

SEQ ID NO: 203987 - DNA, 103 bp, Artificial Sequence
  Synthetic Polynucleotide
taatacgactcactataggggagaatgctattgaggtattcctggtgcttaacagaggagaaagcacatggaatacctcaacctggcggcagcgcaaaagatg

SEQ ID NO: 203988 - DNA, 103 bp, Artificial Sequence
  Synthetic Polynucleotide
taatacgactcactatagggtggcatgctggagaatgctattgaggtattaacagaggagaaataccatgatagcattcaacctggcggcagcgcaaaagatg

SEQ ID NO: 203989 - DNA, 103 bp, Artificial Sequence
  Synthetic Polynucleotide
taatacgactcactatagggttgaaatccttggcatgctggagaatgctaaacagaggagatagcatatgccagcatgcaacctggcggcagcgcaaaagatg

SEQ ID NO: 203990 - DNA, 103 bp, Artificial Sequence
  Synthetic Polynucleotide
taatacgactcactataggggtgatattccttgaaatccttggcatgctgaacagaggagacagcatatgaaggatttcaacctggcggcagcgcaaaagatg

SEQ ID NO: 203991 - DNA, 103 bp, Artificial Sequence
  Synthetic Polynucleotide
taatacgactcactatagggtgacggatctgtgatattccttgaaatcctaacagaggagaaggattatgaggaatatcaacctggcggcagcgcaaaagatg

SEQ ID NO: 203992 - DNA, 103 bp, Artificial Sequence
  Synthetic Polynucleotide
taatacgactcactatagggattttgcctgtgacggatctgtgatattccaacagaggagaggaataatgcagatccgtaacctggcggcagcgcaaaagatg

SEQ ID NO: 203993 - DNA, 103 bp, Artificial Sequence
  Synthetic Polynucleotide
taatacgactcactatagggcagcttctggattttgcctgtgacggatctaacagaggagaagatccatgacaggcaaaaacctggcggcagcgcaaaagatg

SEQ ID NO: 203994 - DNA, 103 bp, Artificial Sequence
  Synthetic Polynucleotide
taatacgactcactatagggctgccttggtcagcttctggattttgcctgaacagaggagacaggcaatgtccagaagcaacctggcggcagcgcaaaagatg

SEQ ID NO: 203995 - DNA, 103 bp, Artificial Sequence
  Synthetic Polynucleotide
taatacgactcactataggggggatggggtgtcctgctgagggcggccctaacagaggagaagggccatgctcagcaggaacctggcggcagcgcaaaagatg

SEQ ID NO: 203996 - DNA, 103 bp, Artificial Sequence
  Synthetic Polynucleotide
taatacgactcactatagggtacgtggccactgccttggtcagcttctggaacagaggagaccagaaatggaccaaggcaacctggcggcagcgcaaaagatg

SEQ ID NO: 203997 - DNA, 103 bp, Artificial Sequence
  Synthetic Polynucleotide
taatacgactcactataggggttggcatggtacgtggccactgccttggtaacagaggagaaccaagatggtggccacgaacctggcggcagcgcaaaagatg

SEQ ID NO: 203998 - DNA, 103 bp, Artificial Sequence
  Synthetic Polynucleotide
taatacgactcactatagggcccgctccgtgttggcatggtacgtggccaaacagaggagatggccaatgaccatgccaaacctggcggcagcgcaaaagatg

SEQ ID NO: 203999 - DNA, 103 bp, Artificial Sequence
  Synthetic Polynucleotide
taatacgactcactatagggttcttctgctcccgctccgtgttggcatggaacagaggagaccatgcatgcacggagcgaacctggcggcagcgcaaaagatg

SEQ ID NO: 204000 - DNA, 103 bp, Artificial Sequence
  Synthetic Polynucleotide
taatacgactcactatagggctcgttctctttcttctgctcccgctccgtaacagaggagaacggagatggagcagaagaacctggcggcagcgcaaaagatg

SEQ ID NO: 204001 - DNA, 103 bp, Artificial Sequence
  Synthetic Polynucleotide
taatacgactcactatagggtctcgatccgctcgttctctttcttctgctaacagaggagaagcagaatgaagagaacgaacctggcggcagcgcaaaagatg

SEQ ID NO: 204002 - DNA, 103 bp, Artificial Sequence
  Synthetic Polynucleotide
taatacgactcactatagggatgcgctccttctcgatccgctcgttctctaacagaggagaagagaaatggcggatcgaaacctggcggcagcgcaaaagatg

SEQ ID NO: 204003 - DNA, 103 bp, Artificial Sequence
  Synthetic Polynucleotide
taatacgactcactataggggagcctccgcatgcgctccttctcgatccgaacagaggagacggatcatgaaggagcgcaacctggcggcagcgcaaaagatg

SEQ ID NO: 204004 - DNA, 103 bp, Artificial Sequence
  Synthetic Polynucleotide
taatacgactcactatagggcttcagccatgagcctccgcatgcgctcctaacagaggagaaggagcatgtgcggaggcaacctggcggcagcgcaaaagatg

SEQ ID NO: 204005 - DNA, 103 bp, Artificial Sequence
  Synthetic Polynucleotide
taatacgactcactatagggccctcctcatcttcagccatgagcctccgcaacagaggagagcggagatgcatggctgaaacctggcggcagcgcaaaagatg

SEQ ID NO: 204006 - DNA, 103 bp, Artificial Sequence
  Synthetic Polynucleotide
taatacgactcactatagggcccctgggtggggatggggtgtcctgctgaaacagaggagatcagcaatgcaccccatcaacctggcggcagcgcaaaagatg

SEQ ID NO: 204007 - DNA, 103 bp, Artificial Sequence
  Synthetic Polynucleotide
taatacgactcactatagggcttgcggtacccctcctcatcttcagccataacagaggagaatggctatggatgaggagaacctggcggcagcgcaaaagatg

SEQ ID NO: 204008 - DNA, 103 bp, Artificial Sequence
  Synthetic Polynucleotide
taatacgactcactatagggggtcgatgagcttgcggtacccctcctcataacagaggagaatgaggatgggtaccgcaaacctggcggcagcgcaaaagatg

SEQ ID NO: 204009 - DNA, 103 bp, Artificial Sequence
  Synthetic Polynucleotide
taatacgactcactatagggtccttcttctggtcgatgagcttgcggtacaacagaggagagtaccgatggctcatcgaaacctggcggcagcgcaaaagatg

SEQ ID NO: 204010 - DNA, 103 bp, Artificial Sequence
  Synthetic Polynucleotide
taatacgactcactatagggcaggcgcttgtccttcttctggtcgatgagaacagaggagactcatcatgcagaagaagaacctggcggcagcgcaaaagatg

SEQ ID NO: 204011 - DNA, 103 bp, Artificial Sequence
  Synthetic Polynucleotide
taatacgactcactatagggagaggtaggccaggcgcttgtccttcttctaacagaggagaagaagaatgacaagcgccaacctggcggcagcgcaaaagatg

SEQ ID NO: 204012 - DNA, 103 bp, Artificial Sequence
  Synthetic Polynucleotide
taatacgactcactataggggtctgctgcaagaggtaggccaggcgcttgaacagaggagacaagcgatgggcctacctaacctggcggcagcgcaaaagatg

SEQ ID NO: 204013 - DNA, 103 bp, Artificial Sequence
  Synthetic Polynucleotide
taatacgactcactataggggtactcgtctgtctgctgcaagaggtaggcaacagaggagagcctacatgttgcagcagaacctggcggcagcgcaaaagatg

SEQ ID NO: 204014 - DNA, 103 bp, Artificial Sequence
  Synthetic Polynucleotide
taatacgactcactatagggggttagccacgtactcgtctgtctgctgcaaacagaggagatgcagcatgcagacgagtaacctggcggcagcgcaaaagatg

SEQ ID NO: 204015 - DNA, 103 bp, Artificial Sequence
  Synthetic Polynucleotide
taatacgactcactatagggagctccgtgaggttagccacgtactcgtctaacagaggagaagacgaatgcgtggctaaaacctggcggcagcgcaaaagatg

SEQ ID NO: 204016 - DNA, 103 bp, Artificial Sequence
  Synthetic Polynucleotide
taatacgactcactatagggctgccgcaccagctccgtgaggttagccacaacagaggagagtggctatgctcacggagaacctggcggcagcgcaaaagatg

SEQ ID NO: 204017 - DNA, 103 bp, Artificial Sequence
  Synthetic Polynucleotide
taatacgactcactatagggaccctccaggcccctgggtggggatggggtaacagaggagaaccccaatgccacccaggaacctggcggcagcgcaaaagatg

SEQ ID NO: 204018 - DNA, 103 bp, Artificial Sequence
  Synthetic Polynucleotide
taatacgactcactatagggcagccttgtgctgccgcaccagctccgtgaaacagaggagatcacggatgtggtgcggcaacctggcggcagcgcaaaagatg

SEQ ID NO: 204019 - DNA, 103 bp, Artificial Sequence
  Synthetic Polynucleotide
taatacgactcactataggggcgacctgggcagccttgtgctgccgcaccaacagaggagaggtgcgatggcacaaggcaacctggcggcagcgcaaaagatg

SEQ ID NO: 204020 - DNA, 103 bp, Artificial Sequence
  Synthetic Polynucleotide
taatacgactcactatagggtttctccttggcgacctgggcagccttgtgaacagaggagacacaagatggcccaggtcaacctggcggcagcgcaaaagatg

SEQ ID NO: 204021 - DNA, 103 bp, Artificial Sequence
  Synthetic Polynucleotide
taatacgactcactatagggttttcttctttttctccttggcgacctgggaacagaggagacccaggatgccaaggagaaacctggcggcagcgcaaaagatg

SEQ ID NO: 204022 - DNA, 103 bp, Artificial Sequence
  Synthetic Polynucleotide
taatacgactcactatagggttctttttctttttcttctttttctccttgaacagaggagacaaggaatgaaagaagaaaacctggcggcagcgcaaaagatg

SEQ ID NO: 204023 - DNA, 103 bp, Artificial Sequence
  Synthetic Polynucleotide
taatacgactcactatagggttctgccttcttctttttctttttcttcttaacagaggagaaagaagatgaagaaaaagaacctggcggcagcgcaaaagatg

SEQ ID NO: 204024 - DNA, 103 bp, Artificial Sequence
  Synthetic Polynucleotide
taatacgactcactatagggcttctgcattttctgccttcttctttttctaacagaggagaagaaaaatgagaaggcagaacctggcggcagcgcaaaagatg

SEQ ID NO: 204025 - DNA, 103 bp, Artificial Sequence
  Synthetic Polynucleotide
taatacgactcactatagggggcgtctgtccttctgcattttctgccttcaacagaggagagaaggcatgaaatgcagaaacctggcggcagcgcaaaagatg

SEQ ID NO: 204026 - DNA, 103 bp, Artificial Sequence
  Synthetic Polynucleotide
taatacgactcactatagggcccaatggcaggcgtctgtccttctgcattaacagaggagaaatgcaatgggacagacgaacctggcggcagcgcaaaagatg

SEQ ID NO: 204027 - DNA, 103 bp, Artificial Sequence
  Synthetic Polynucleotide
taatacgactcactatagggcgccatccggcccaatggcaggcgtctgtcaacagaggagagacagaatgctgccattgaacctggcggcagcgcaaaagatg

SEQ ID NO: 204028 - DNA, 103 bp, Artificial Sequence
  Synthetic Polynucleotide
taatacgactcactatagggtcctgagggtaccctccaggcccctgggtgaacagaggagacacccaatggcctggaggaacctggcggcagcgcaaaagatg

SEQ ID NO: 204029 - DNA, 103 bp, Artificial Sequence
  Synthetic Polynucleotide
taatacgactcactatagggtccagaggctcgccatccggcccaatggcaaacagaggagatgccatatggccggatggaacctggcggcagcgcaaaagatg

SEQ ID NO: 204030 - DNA, 103 bp, Artificial Sequence
  Synthetic Polynucleotide
taatacgactcactataggggctggtctcgtccagaggctcgccatccggaacagaggagaccggatatggagcctctgaacctggcggcagcgcaaaagatg

SEQ ID NO: 204031 - DNA, 103 bp, Artificial Sequence
  Synthetic Polynucleotide
taatacgactcactatagggcgctcatctggctggtctcgtccagaggctaacagaggagaagcctcatgacgagaccaaacctggcggcagcgcaaaagatg

SEQ ID NO: 204032 - DNA, 103 bp, Artificial Sequence
  Synthetic Polynucleotide
taatacgactcactatagggaccgggaggtcgctcatctggctggtctcgaacagaggagacgagacatgccagatgagaacctggcggcagcgcaaaagatg

SEQ ID NO: 204033 - DNA, 103 bp, Artificial Sequence
  Synthetic Polynucleotide
taatacgactcactataggggatcaccttcaccgggaggtcgctcatctgaacagaggagacagatgatggacctcccgaacctggcggcagcgcaaaagatg

SEQ ID NO: 204034 - DNA, 103 bp, Artificial Sequence
  Synthetic Polynucleotide
taatacgactcactatagggtctccacgtggatcaccttcaccgggaggtaacagaggagaacctccatgtgaaggtgaaacctggcggcagcgcaaaagatg

SEQ ID NO: 204035 - DNA, 103 bp, Artificial Sequence
  Synthetic Polynucleotide
taatacgactcactatagggatcttcccactctccacgtggatcaccttcaacagaggagagaaggtatgccacgtggaaacctggcggcagcgcaaaagatg

SEQ ID NO: 204036 - DNA, 103 bp, Artificial Sequence
  Synthetic Polynucleotide
taatacgactcactataggggcctgtgaggatcttcccactctccacgtgaacagaggagacacgtgatgagtgggaagaacctggcggcagcgcaaaagatg

SEQ ID NO: 204037 - DNA, 103 bp, Artificial Sequence
  Synthetic Polynucleotide
taatacgactcactataggggggcatctgtgcctgtgaggatcttcccacaacagaggagagtgggaatgtcctcacagaacctggcggcagcgcaaaagatg

SEQ ID NO: 204038 - DNA, 103 bp, Artificial Sequence
  Synthetic Polynucleotide
taatacgactcactatagggccggctttgggggcatctgtgcctgtgaggaacagaggagacctcacatgcacagatgcaacctggcggcagcgcaaaagatg

SEQ ID NO: 204039 - DNA, 103 bp, Artificial Sequence
  Synthetic Polynucleotide
taatacgactcactataggggtgcatgttgtcctgagggtaccctccaggaacagaggagacctggaatgtaccctcagaacctggcggcagcgcaaaagatg

SEQ ID NO: 204040 - DNA, 103 bp, Artificial Sequence
  Synthetic Polynucleotide
taatacgactcactatagggctccagctgcccggctttgggggcatctgtaacagaggagaacagatatgcccaaagccaacctggcggcagcgcaaaagatg

SEQ ID NO: 204041 - DNA, 103 bp, Artificial Sequence
  Synthetic Polynucleotide
taatacgactcactatagggcgagccaggcctccagctgcccggctttggaacagaggagaccaaagatgggcagctggaacctggcggcagcgcaaaagatg

SEQ ID NO: 204042 - DNA, 103 bp, Artificial Sequence
  Synthetic Polynucleotide
taatacgactcactataggggggttcatctcgagccaggcctccagctgcaacagaggagagcagctatgggcctggctaacctggcggcagcgcaaaagatg

SEQ ID NO: 204043 - DNA, 103 bp, Artificial Sequence
  Synthetic Polynucleotide
taatacgactcactatagggttcataccccgggttcatctcgagccaggcaacagaggagagcctggatggagatgaacaacctggcggcagcgcaaaagatg

SEQ ID NO: 204044 - DNA, 103 bp, Artificial Sequence
  Synthetic Polynucleotide
taatacgactcactatagggtcggagctacttcataccccgggttcatctaacagaggagaagatgaatgcggggtatgaacctggcggcagcgcaaaagatg

SEQ ID NO: 204045 - DNA, 103 bp, Artificial Sequence
  Synthetic Polynucleotide
taatacgactcactatagggctatcagacctcggagctacttcataccccaacagaggagaggggtaatgagtagctccaacctggcggcagcgcaaaagatg

SEQ ID NO: 204046 - DNA, 103 bp, Artificial Sequence
  Synthetic Polynucleotide
taatacgactcactatagggactttcttcactatcagacctcggagctacaacagaggagagtagctatgaggtctgataacctggcggcagcgcaaaagatg

SEQ ID NO: 204047 - DNA, 103 bp, Artificial Sequence
  Synthetic Polynucleotide
taatacgactcactatagggcttctgagccactttcttcactatcagaccaacagaggagaggtctgatggtgaagaaaaacctggcggcagcgcaaaagatg

SEQ ID NO: 204048 - DNA, 103 bp, Artificial Sequence
  Synthetic Polynucleotide
taatacgactcactatagggtcttcctcttcttctgagccactttcttcaaacagaggagatgaagaatgtggctcagaaacctggcggcagcgcaaaagatg

SEQ ID NO: 204049 - DNA, 103 bp, Artificial Sequence
  Synthetic Polynucleotide
taatacgactcactatagggctcctcctcctcttcctcttcttctgagccaacagaggagaggctcaatggaagaggaaaacctggcggcagcgcaaaagatg

SEQ ID NO: 204050 - DNA, 103 bp, Artificial Sequence
  Synthetic Polynucleotide
taatacgactcactataggggccgaggagttccgcccaggggtgggtctgaacagaggagacagaccatgccctgggcgaacctggcggcagcgcaaaagatg

SEQ ID NO: 204051 - DNA, 103 bp, Artificial Sequence
  Synthetic Polynucleotide
taatacgactcactatagggtgtgcatctggtgcatgttgtcctgagggtaacagaggagaaccctcatgacaacatgcaacctggcggcagcgcaaaagatg

SEQ ID NO: 204052 - DNA, 103 bp, Artificial Sequence
  Synthetic Polynucleotide
taatacgactcactataggggctgctcttcctcctcctcctcttcctcttaacagaggagaaagaggatgaggaggaggaacctggcggcagcgcaaaagatg

SEQ ID NO: 204053 - DNA, 103 bp, Artificial Sequence
  Synthetic Polynucleotide
taatacgactcactataggggctgcctgcggctgctcttcctcctcctccaacagaggagaggaggaatgggaagagcaaacctggcggcagcgcaaaagatg

SEQ ID NO: 204054 - DNA, 103 bp, Artificial Sequence
  Synthetic Polynucleotide
taatacgactcactataggggggaggctgtgctgcctgcggctgctcttcaacagaggagagaagagatgccgcaggcaaacctggcggcagcgcaaaagatg

SEQ ID NO: 204055 - DNA, 103 bp, Artificial Sequence
  Synthetic Polynucleotide
taatacgactcactatagggcgggcagggtgggaggctgtgctgcctgcgaacagaggagacgcaggatgcacagcctcaacctggcggcagcgcaaaagatg

SEQ ID NO: 204056 - DNA, 103 bp, Artificial Sequence
  Synthetic Polynucleotide
taatacgactcactatagggttctcctccacgggcagggtgggaggctgtaacagaggagaacagccatgcaccctgccaacctggcggcagcgcaaaagatg

SEQ ID NO: 204057 - DNA, 103 bp, Artificial Sequence
  Synthetic Polynucleotide
taatacgactcactatagggaatcttcttcttctcctccacgggcagggtaacagaggagaaccctgatggtggaggagaacctggcggcagcgcaaaagatg

SEQ ID NO: 204058 - DNA, 103 bp, Artificial Sequence
  Synthetic Polynucleotide
taatacgactcactatagggctggatctggaatcttcttcttctcctccaaacagaggagatggaggatgagaagaagaaacctggcggcagcgcaaaagatg

SEQ ID NO: 204059 - DNA, 103 bp, Artificial Sequence
  Synthetic Polynucleotide
taatacgactcactatagggtcatcgctgtctggatctggaatcttcttcaacagaggagagaagaaatgtccagatccaacctggcggcagcgcaaaagatg

SEQ ID NO: 204060 - DNA, 103 bp, Artificial Sequence
  Synthetic Polynucleotide
taatacgactcactatagggctcagagacgtcatcgctgtctggatctggaacagaggagaccagatatggacagcgataacctggcggcagcgcaaaagatg

SEQ ID NO: 204061 - DNA, 103 bp, Artificial Sequence
  Synthetic Polynucleotide
taatacgactcactataggggcgcgtccacctcagagacgtcatcgctgtaacagaggagaacagcgatgacgtctctgaacctggcggcagcgcaaaagatg

SEQ ID NO: 204062 - DNA, 103 bp, Artificial Sequence
  Synthetic Polynucleotide
taatacgactcactatagggtccatgggcttgtgcatctggtgcatgttgaacagaggagacaacatatgccagatgcaaacctggcggcagcgcaaaagatg

SEQ ID NO: 204063 - DNA, 103 bp, Artificial Sequence
  Synthetic Polynucleotide
taatacgactcactatagggatgatgtgccgcgcgtccacctcagagacgaacagaggagacgtctcatgggtggacgcaacctggcggcagcgcaaaagatg

SEQ ID NO: 204064 - DNA, 103 bp, Artificial Sequence
  Synthetic Polynucleotide
taatacgactcactatagggggcattctcaatgatgtgccgcgcgtccacaacagaggagagtggacatgcggcacatcaacctggcggcagcgcaaaagatg

SEQ ID NO: 204065 - DNA, 103 bp, Artificial Sequence
  Synthetic Polynucleotide
taatacgactcactatagggcatcttgcttggcattctcaatgatgtgccaacagaggagaggcacaatgttgagaatgaacctggcggcagcgcaaaagatg

SEQ ID NO: 204066 - DNA, 103 bp, Artificial Sequence
  Synthetic Polynucleotide
taatacgactcactatagggtcatcatcgacatcttgcttggcattctcaaacagaggagatgagaaatgcaagcaagaaacctggcggcagcgcaaaagatg

SEQ ID NO: 204067 - DNA, 103 bp, Artificial Sequence
  Synthetic Polynucleotide
taatacgactcactatagggcacgccatattcatcatcgacatcttgcttaacagaggagaaagcaaatggtcgatgataacctggcggcagcgcaaaagatg

SEQ ID NO: 204068 - DNA, 103 bp, Artificial Sequence
  Synthetic Polynucleotide
taatacgactcactataggggggcctgggacacgccatattcatcatcgaaacagaggagatcgatgatgaatatggcgaacctggcggcagcgcaaaagatg

SEQ ID NO: 204069 - DNA, 103 bp, Artificial Sequence
  Synthetic Polynucleotide
taatacgactcactatagggccacgtgcaagggcctgggacacgccatataacagaggagaatatggatggtcccaggcaacctggcggcagcgcaaaagatg

SEQ ID NO: 204070 - DNA, 103 bp, Artificial Sequence
  Synthetic Polynucleotide
taatacgactcactatagggggactgcaggccacgtgcaagggcctgggaaacagaggagatcccagatgcttgcacgtaacctggcggcagcgcaaaagatg

SEQ ID NO: 204071 - DNA, 103 bp, Artificial Sequence
  Synthetic Polynucleotide
taatacgactcactatagggcggcatagtaggactgcaggccacgtgcaaaacagaggagattgcacatggcctgcagtaacctggcggcagcgcaaaagatg

SEQ ID NO: 204072 - DNA, 103 bp, Artificial Sequence
  Synthetic Polynucleotide
taatacgactcactataggggcatgggccacggcatagtaggactgcaggaacagaggagacctgcaatgctactatgcaacctggcggcagcgcaaaagatg

SEQ ID NO: 204073 - DNA, 103 bp, Artificial Sequence
  Synthetic Polynucleotide
taatacgactcactatagggatgcatggactccatgggcttgtgcatctgaacagaggagacagatgatgaagcccatgaacctggcggcagcgcaaaagatg

SEQ ID NO: 204074 - DNA, 103 bp, Artificial Sequence
  Synthetic Polynucleotide
taatacgactcactatagggctcagtgacagcatgggccacggcatagtaaacagaggagatactatatggtggcccataacctggcggcagcgcaaaagatg

SEQ ID NO: 204075 - DNA, 103 bp, Artificial Sequence
  Synthetic Polynucleotide
taatacgactcactatagggtgtccactctctcagtgacagcatgggccaaacagaggagatggcccatgctgtcactgaacctggcggcagcgcaaaagatg

SEQ ID NO: 204076 - DNA, 103 bp, Artificial Sequence
  Synthetic Polynucleotide
taatacgactcactataggggctgactgcttgtccactctctcagtgacaaacagaggagatgtcacatggagagtggaaacctggcggcagcgcaaaagatg

SEQ ID NO: 204077 - DNA, 103 bp, Artificial Sequence
  Synthetic Polynucleotide
taatacgactcactataggggaccataagcgctgactgcttgtccactctaacagaggagaagagtgatgaagcagtcaaacctggcggcagcgcaaaagatg

SEQ ID NO: 204078 - DNA, 103 bp, Artificial Sequence
  Synthetic Polynucleotide
taatacgactcactatagggggacaccattgaccataagcgctgactgctaacagaggagaagcagtatgcgcttatggaacctggcggcagcgcaaaagatg

SEQ ID NO: 204079 - DNA, 103 bp, Artificial Sequence
  Synthetic Polynucleotide
taatacgactcactatagggtactgtttgaggacaccattgaccataagcaacagaggagagcttatatgcaatggtgtaacctggcggcagcgcaaaagatg

SEQ ID NO: 204080 - DNA, 103 bp, Artificial Sequence
  Synthetic Polynucleotide
taatacgactcactatagggtttgatctggtactgtttgaggacaccattaacagaggagaaatggtatgctcaaacagaacctggcggcagcgcaaaagatg

SEQ ID NO: 204081 - DNA, 103 bp, Artificial Sequence
  Synthetic Polynucleotide
taatacgactcactatagggactccaaacctttgatctggtactgtttgaaacagaggagatcaaacatgaccagatcaaacctggcggcagcgcaaaagatg

SEQ ID NO: 204082 - DNA, 103 bp, Artificial Sequence
  Synthetic Polynucleotide
taatacgactcactataggggacaccagccactccaaacctttgatctggaacagaggagaccagatatgaggtttggaaacctggcggcagcgcaaaagatg

SEQ ID NO: 204083 - DNA, 103 bp, Artificial Sequence
  Synthetic Polynucleotide
taatacgactcactataggggttgtacagggacaccagccactccaaaccaacagaggagaggtttgatgtggctggtgaacctggcggcagcgcaaaagatg

SEQ ID NO: 204084 - DNA, 103 bp, Artificial Sequence
  Synthetic Polynucleotide
taatacgactcactatagggtgcccttctcatgcatggactccatgggctaacagaggagaagcccaatgagtccatgcaacctggcggcagcgcaaaagatg

SEQ ID NO: 204085 - DNA, 103 bp, Artificial Sequence
  Synthetic Polynucleotide
taatacgactcactatagggtcaggttgttgttgtacagggacaccagccaacagaggagaggctggatgccctgtacaaacctggcggcagcgcaaaagatg

SEQ ID NO: 204086 - DNA, 103 bp, Artificial Sequence
  Synthetic Polynucleotide
taatacgactcactatagggaggatgccgttcaggttgttgttgtacaggaacagaggagacctgtaatgcaacaacctaacctggcggcagcgcaaaagatg

SEQ ID NO: 204087 - DNA, 103 bp, Artificial Sequence
  Synthetic Polynucleotide
taatacgactcactatagggctcgtcggccaggatgccgttcaggttgttaacagaggagaaacaacatgaacggcatcaacctggcggcagcgcaaaagatg

SEQ ID NO: 204088 - DNA, 103 bp, Artificial Sequence
  Synthetic Polynucleotide
taatacgactcactatagggccaggcccatctcgtcggccaggatgccgtaacagaggagaacggcaatgtggccgacgaacctggcggcagcgcaaaagatg

SEQ ID NO: 204089 - DNA, 103 bp, Artificial Sequence
  Synthetic Polynucleotide
taatacgactcactatagggatggtcttccccaggcccatctcgtcggccaacagaggagaggccgaatggatgggcctaacctggcggcagcgcaaaagatg

SEQ ID NO: 204090 - DNA, 103 bp, Artificial Sequence
  Synthetic Polynucleotide
taatacgactcactataggggatggtctggatggtcttccccaggcccataacagaggagaatgggcatggggaagaccaacctggcggcagcgcaaaagatg

SEQ ID NO: 204091 - DNA, 103 bp, Artificial Sequence
  Synthetic Polynucleotide
taatacgactcactatagggtgatgagcgcgatggtctggatggtcttccaacagaggagaggaagaatgtccagaccaaacctggcggcagcgcaaaagatg

SEQ ID NO: 204092 - DNA, 103 bp, Artificial Sequence
  Synthetic Polynucleotide
taatacgactcactatagggatgaggtacgtgatgagcgcgatggtctggaacagaggagaccagacatgcgcgctcataacctggcggcagcgcaaaagatg

SEQ ID NO: 204093 - DNA, 103 bp, Artificial Sequence
  Synthetic Polynucleotide
taatacgactcactatagggtttgtgctccatgaggtacgtgatgagcgcaacagaggagagcgctcatgacgtacctcaacctggcggcagcgcaaaagatg

SEQ ID NO: 204094 - DNA, 103 bp, Artificial Sequence
  Synthetic Polynucleotide
taatacgactcactatagggcattgatgcgtttgtgctccatgaggtacgaacagaggagacgtaccatgtggagcacaaacctggcggcagcgcaaaagatg

SEQ ID NO: 204095 - DNA, 103 bp, Artificial Sequence
  Synthetic Polynucleotide
taatacgactcactatagggtcgtccgacatgcccttctcatgcatggacaacagaggagagtccatatgtgagaagggaacctggcggcagcgcaaaagatg

SEQ ID NO: 204096 - DNA, 103 bp, Artificial Sequence
  Synthetic Polynucleotide
taatacgactcactatagggaggaagggcccattgatgcgtttgtgctccaacagaggagaggagcaatgacgcatcaaaacctggcggcagcgcaaaagatg

SEQ ID NO: 204097 - DNA, 103 bp, Artificial Sequence
  Synthetic Polynucleotide
taatacgactcactatagggcacgatgatgaggaagggcccattgatgcgaacagaggagacgcatcatggggcccttcaacctggcggcagcgcaaaagatg

SEQ ID NO: 204098 - DNA, 103 bp, Artificial Sequence
  Synthetic Polynucleotide
taatacgactcactatagggttgagagaggcacgatgatgaggaagggccaacagaggagaggccctatgtcatcatcgaacctggcggcagcgcaaaagatg

SEQ ID NO: 204099 - DNA, 103 bp, Artificial Sequence
  Synthetic Polynucleotide
taatacgactcactatagggttggacagcgttgagagaggcacgatgatgaacagaggagacatcatatggcctctctcaacctggcggcagcgcaaaagatg

SEQ ID NO: 204100 - DNA, 103 bp, Artificial Sequence
  Synthetic Polynucleotide
taatacgactcactataggggtacgcccagttggacagcgttgagagaggaacagaggagacctctcatgacgctgtccaacctggcggcagcgcaaaagatg

SEQ ID NO: 204101 - DNA, 103 bp, Artificial Sequence
  Synthetic Polynucleotide
taatacgactcactatagggtgtcaaactcgtacgcccagttggacagcgaacagaggagacgctgtatgactgggcgtaacctggcggcagcgcaaaagatg

SEQ ID NO: 204102 - DNA, 103 bp, Artificial Sequence
  Synthetic Polynucleotide
taatacgactcactatagggggggcccacttgtcaaactcgtacgcccagaacagaggagactgggcatgcgagtttgaaacctggcggcagcgcaaaagatg

SEQ ID NO: 204103 - DNA, 103 bp, Artificial Sequence
  Synthetic Polynucleotide
taatacgactcactatagggcaccacggagggggcccacttgtcaaactcaacagaggagagagtttatgaagtgggccaacctggcggcagcgcaaaagatg

SEQ ID NO: 204104 - DNA, 103 bp, Artificial Sequence
  Synthetic Polynucleotide
taatacgactcactatagggaagacaccttcaccacggagggggcccactaacagaggagaagtgggatgcctccgtggaacctggcggcagcgcaaaagatg

SEQ ID NO: 204105 - DNA, 103 bp, Artificial Sequence
  Synthetic Polynucleotide
taatacgactcactataggggatcccttgtaagacaccttcaccacggagaacagaggagactccgtatggaaggtgtcaacctggcggcagcgcaaaagatg

SEQ ID NO: 204106 - DNA, 103 bp, Artificial Sequence
  Synthetic Polynucleotide
taatacgactcactataggggtagcgcgggtcgtccgacatgcccttctcaacagaggagagagaagatgatgtcggacaacctggcggcagcgcaaaagatg

SEQ ID NO: 204107 - DNA, 103 bp, Artificial Sequence
  Synthetic Polynucleotide
taatacgactcactatagggtgctgctggggatcccttgtaagacaccttaacagaggagaaaggtgatgtacaagggaaacctggcggcagcgcaaaagatg

SEQ ID NO: 204108 - DNA, 103 bp, Artificial Sequence
  Synthetic Polynucleotide
taatacgactcactatagggaggcccgtcttgctgctggggatcccttgtaacagaggagaacaaggatgccccagcagaacctggcggcagcgcaaaagatg

SEQ ID NO: 204109 - DNA, 103 bp, Artificial Sequence
  Synthetic Polynucleotide
taatacgactcactatagggtgggggacaaaggcccgtcttgctgctgggaacagaggagacccagcatgaagacgggcaacctggcggcagcgcaaaagatg

SEQ ID NO: 204110 - DNA, 103 bp, Artificial Sequence
  Synthetic Polynucleotide
taatacgactcactatagggactccggagctgggggacaaaggcccgtctaacagaggagaagacggatgtttgtccccaacctggcggcagcgcaaaagatg

SEQ ID NO: 204111 - DNA, 103 bp, Artificial Sequence
  Synthetic Polynucleotide
taatacgactcactatagggtgaacttcccactccggagctgggggacaaaacagaggagattgtccatgagctccggaaacctggcggcagcgcaaaagatg

SEQ ID NO: 204112 - DNA, 103 bp, Artificial Sequence
  Synthetic Polynucleotide
taatacgactcactatagggagcaagacgttgaacttcccactccggagcaacagaggagagctccgatgtgggaagttaacctggcggcagcgcaaaagatg

SEQ ID NO: 204113 - DNA, 103 bp, Artificial Sequence
  Synthetic Polynucleotide
taatacgactcactataggggtacgtcgtcagcaagacgttgaacttcccaacagaggagagggaagatgaacgtcttgaacctggcggcagcgcaaaagatg

SEQ ID NO: 204114 - DNA, 103 bp, Artificial Sequence
  Synthetic Polynucleotide
taatacgactcactatagggtgatgtactcgtacgtcgtcagcaagacgtaacagaggagaacgtctatgtgacgacgtaacctggcggcagcgcaaaagatg

SEQ ID NO: 204115 - DNA, 103 bp, Artificial Sequence
  Synthetic Polynucleotide
taatacgactcactatagggttgtctttgatgatgtactcgtacgtcgtcaacagaggagagacgacatgcgagtacataacctggcggcagcgcaaaagatg

SEQ ID NO: 204116 - DNA, 103 bp, Artificial Sequence
  Synthetic Polynucleotide
taatacgactcactataggggaggatgtgcttgtctttgatgatgtactcaacagaggagagagtacatgatcaaagacaacctggcggcagcgcaaaagatg

SEQ ID NO: 204117 - DNA, 103 bp, Artificial Sequence
  Synthetic Polynucleotide
taatacgactcactatagggtcatctggttgtagcgcgggtcgtccgacaaacagaggagatgtcggatgacccgcgctaacctggcggcagcgcaaaagatg

SEQ ID NO: 204118 - DNA, 103 bp, Artificial Sequence
  Synthetic Polynucleotide
taatacgactcactatagggggatcttggcgaggatgtgcttgtctttgaaacagaggagatcaaagatgagcacatccaacctggcggcagcgcaaaagatg

SEQ ID NO: 204119 - DNA, 103 bp, Artificial Sequence
  Synthetic Polynucleotide
taatacgactcactatagggtacttccaacggatcttggcgaggatgtgcaacagaggagagcacatatgcgccaagataacctggcggcagcgcaaaagatg

SEQ ID NO: 204120 - DNA, 103 bp, Artificial Sequence
  Synthetic Polynucleotide
taatacgactcactatagggcacaatcatgtacttccaacggatcttggcaacagaggagagccaagatgcgttggaagaacctggcggcagcgcaaaagatg

SEQ ID NO: 204121 - DNA, 103 bp, Artificial Sequence
  Synthetic Polynucleotide
taatacgactcactataggggaccttcgtccacaatcatgtacttccaacaacagaggagagttggaatgacatgattgaacctggcggcagcgcaaaagatg

SEQ ID NO: 204122 - DNA, 103 bp, Artificial Sequence
  Synthetic Polynucleotide
taatacgactcactatagggttcatgcggtgaccttcgtccacaatcatgaacagaggagacatgatatgggacgaaggaacctggcggcagcgcaaaagatg

SEQ ID NO: 204123 - DNA, 103 bp, Artificial Sequence
  Synthetic Polynucleotide
taatacgactcactataggggtggtggttcttcatgcggtgaccttcgtcaacagaggagagacgaaatgcaccgcatgaacctggcggcagcgcaaaagatg

SEQ ID NO: 204124 - DNA, 103 bp, Artificial Sequence
  Synthetic Polynucleotide
taatacgactcactatagggtcagcttgcagtggtggttcttcatgcggtaacagaggagaaccgcaatgagaaccaccaacctggcggcagcgcaaaagatg

SEQ ID NO: 204125 - DNA, 103 bp, Artificial Sequence
  Synthetic Polynucleotide
taatacgactcactatagggagcacctgcgtcagcttgcagtggtggttcaacagaggagagaaccaatgctgcaagctaacctggcggcagcgcaaaagatg

SEQ ID NO: 204126 - DNA, 103 bp, Artificial Sequence
  Synthetic Polynucleotide
taatacgactcactataggggtgcgtgttgagcacctgcgtcagcttgcaaacagaggagatgcaagatgacgcaggtgaacctggcggcagcgcaaaagatg

SEQ ID NO: 204127 - DNA, 103 bp, Artificial Sequence
  Synthetic Polynucleotide
taatacgactcactataggggtgccacatagtgcgtgttgagcacctgcgaacagaggagacgcaggatgtcaacacgcaacctggcggcagcgcaaaagatg

SEQ ID NO: 204128 - DNA, 103 bp, Artificial Sequence
  Synthetic Polynucleotide
taatacgactcactatagggcccattcctttcatctggttgtagcgcgggaacagaggagacccgcgatgcaaccagataacctggcggcagcgcaaaagatg

SEQ ID NO: 204129 - DNA, 103 bp, Artificial Sequence
  Synthetic Polynucleotide
taatacgactcactatagggaggcggcggggtgccacatagtgcgtgttgaacagaggagacaacacatgctatgtggcaacctggcggcagcgcaaaagatg

SEQ ID NO: 204130 - DNA, 103 bp, Artificial Sequence
  Synthetic Polynucleotide
taatacgactcactatagggcgtcagcagcaggcggcggggtgccacataaacagaggagatatgtgatgccccgccgcaacctggcggcagcgcaaaagatg

SEQ ID NO: 204131 - DNA, 103 bp, Artificial Sequence
  Synthetic Polynucleotide
taatacgactcactataggggcggtgtgcccgtcagcagcaggcggcgggaacagaggagacccgccatgtgctgctgaaacctggcggcagcgcaaaagatg

SEQ ID NO: 204132 - DNA, 103 bp, Artificial Sequence
  Synthetic Polynucleotide
taatacgactcactatagggttgttctgcagcggtgtgcccgtcagcagcaacagaggagagctgctatggggcacaccaacctggcggcagcgcaaaagatg

SEQ ID NO: 204133 - DNA, 103 bp, Artificial Sequence
  Synthetic Polynucleotide
taatacgactcactatagggctcgggaagcttgttctgcagcggtgtgccaacagaggagaggcacaatgctgcagaacaacctggcggcagcgcaaaagatg

SEQ ID NO: 204134 - DNA, 103 bp, Artificial Sequence
  Synthetic Polynucleotide
taatacgactcactataggggcgcccagagctcgggaagcttgttctgcaaacagaggagatgcagaatgagcttcccgaacctggcggcagcgcaaaagatg

SEQ ID NO: 204135 - DNA, 103 bp, Artificial Sequence
  Synthetic Polynucleotide
taatacgactcactatagggaagttgagcagcgcccagagctcgggaagcaacagaggagagcttccatggctctgggcaacctggcggcagcgcaaaagatg

SEQ ID NO: 204136 - DNA, 103 bp, Artificial Sequence
  Synthetic Polynucleotide
taatacgactcactataggggggcagcaggaagttgagcagcgcccagagaacagaggagactctggatgctgctcaacaacctggcggcagcgcaaaagatg

SEQ ID NO: 204137 - DNA, 103 bp, Artificial Sequence
  Synthetic Polynucleotide
taatacgactcactatagggtgaagatggtgggcagcaggaagttgagcaaacagaggagatgctcaatgtcctgctgcaacctggcggcagcgcaaaagatg

SEQ ID NO: 204138 - DNA, 103 bp, Artificial Sequence
  Synthetic Polynucleotide
taatacgactcactatagggctgcagctcttgaagatggtgggcagcaggaacagaggagacctgctatgcaccatcttaacctggcggcagcgcaaaagatg

SEQ ID NO: 204139 - DNA, 103 bp, Artificial Sequence
  Synthetic Polynucleotide
taatacgactcactatagggtgaccgcatccccattcctttcatctggttaacagaggagaaaccagatgaaaggaatgaacctggcggcagcgcaaaagatg

SEQ ID NO: 204140 - DNA, 103 bp, Artificial Sequence
  Synthetic Polynucleotide
taatacgactcactatagggctcgaaggtgctgcagctcttgaagatggtaacagaggagaaccatcatgaagagctgcaacctggcggcagcgcaaaagatg

SEQ ID NO: 204141 - DNA, 103 bp, Artificial Sequence
  Synthetic Polynucleotide
taatacgactcactatagggtaaaccactgctcgaaggtgctgcagctctaacagaggagaagagctatggcaccttcgaacctggcggcagcgcaaaagatg

SEQ ID NO: 204142 - DNA, 103 bp, Artificial Sequence
  Synthetic Polynucleotide
taatacgactcactatagggaagggtgcgttaaaccactgctcgaaggtgaacagaggagacaccttatggcagtggttaacctggcggcagcgcaaaagatg

SEQ ID NO: 204143 - DNA, 103 bp, Artificial Sequence
  Synthetic Polynucleotide
taatacgactcactatagggggtcatggcaaagggtgcgttaaaccactgaacagaggagacagtggatgaacgcacccaacctggcggcagcgcaaaagatg

SEQ ID NO: 204144 - DNA, 103 bp, Artificial Sequence
  Synthetic Polynucleotide
taatacgactcactatagggccttttccccggtcatggcaaagggtgcgtaacagaggagaacgcacatgttgccatgaaacctggcggcagcgcaaaagatg

SEQ ID NO: 204145 - DNA, 103 bp, Artificial Sequence
  Synthetic Polynucleotide
taatacgactcactatagggttcaggtccaccttttccccggtcatggcaaacagaggagatgccatatgcggggaaaaaacctggcggcagcgcaaaagatg

SEQ ID NO: 204146 - DNA, 103 bp, Artificial Sequence
  Synthetic Polynucleotide
taatacgactcactatagggttcctcctcattcaggtccaccttttccccaacagaggagaggggaaatggtggacctgaacctggcggcagcgcaaaagatg

SEQ ID NO: 204147 - DNA, 103 bp, Artificial Sequence
  Synthetic Polynucleotide
taatacgactcactatagggtgagaatggtttcctcctcattcaggtccaaacagaggagatggaccatgatgaggaggaacctggcggcagcgcaaaagatg

SEQ ID NO: 204148 - DNA, 103 bp, Artificial Sequence
  Synthetic Polynucleotide
taatacgactcactatagggcgccggatgatgagaatggtttcctcctcaaacagaggagatgaggaatgaaccattctaacctggcggcagcgcaaaagatg

SEQ ID NO: 204149 - DNA, 103 bp, Artificial Sequence
  Synthetic Polynucleotide
taatacgactcactatagggtttgtggagacgccggatgatgagaatggtaacagaggagaaccattatgatcatccggaacctggcggcagcgcaaaagatg

SEQ ID NO: 204150 - DNA, 103 bp, Artificial Sequence
  Synthetic Polynucleotide
taatacgactcactatagggcatggccccctgaccgcatccccattccttaacagaggagaaaggaaatgggatgcggtaacctggcggcagcgcaaaagatg

SEQ ID NO: 204151 - DNA, 103 bp, Artificial Sequence
  Synthetic Polynucleotide
taatacgactcactataggggccgcagcactttgtggagacgccggatgaaacagaggagatcatccatggtctccacaaacctggcggcagcgcaaaagatg

SEQ ID NO: 204152 - DNA, 103 bp, Artificial Sequence
  Synthetic Polynucleotide
taatacgactcactatagggagcaagaagggccgcagcactttgtggagaaacagaggagatctccaatgagtgctgcgaacctggcggcagcgcaaaagatg

SEQ ID NO: 204153 - DNA, 103 bp, Artificial Sequence
  Synthetic Polynucleotide
taatacgactcactataggggagtcgtcggagcaagaagggccgcagcacaacagaggagagtgctgatgcccttcttgaacctggcggcagcgcaaaagatg

SEQ ID NO: 204154 - DNA, 103 bp, Artificial Sequence
  Synthetic Polynucleotide
taatacgactcactatagggcttccttcttgagtcgtcggagcaagaaggaacagaggagaccttctatgtccgacgacaacctggcggcagcgcaaaagatg

SEQ ID NO: 204155 - DNA, 103 bp, Artificial Sequence
  Synthetic Polynucleotide
taatacgactcactatagggtgggcctcgacttccttcttgagtcgtcggaacagaggagaccgacgatgcaagaaggaaacctggcggcagcgcaaaagatg

SEQ ID NO: 204156 - DNA, 103 bp, Artificial Sequence
  Synthetic Polynucleotide
taatacgactcactatagggttcgggcaactgggcctcgacttccttcttaacagaggagaaagaagatggtcgaggccaacctggcggcagcgcaaaagatg

SEQ ID NO: 204157 - DNA, 103 bp, Artificial Sequence
  Synthetic Polynucleotide
taatacgactcactatagggactccaccttttcgggcaactgggcctcgaaacagaggagatcgaggatgagttgcccgaacctggcggcagcgcaaaagatg

SEQ ID NO: 204158 - DNA, 103 bp, Artificial Sequence
  Synthetic Polynucleotide
taatacgactcactatagggttgatgacgtactccaccttttcgggcaacaacagaggagagttgccatgaaaggtggaaacctggcggcagcgcaaaagatg

SEQ ID NO: 204159 - DNA, 103 bp, Artificial Sequence
  Synthetic Polynucleotide
taatacgactcactatagggcatgtcgcacttgatgacgtactccaccttaacagaggagaaaggtgatgtacgtcatcaacctggcggcagcgcaaaagatg

SEQ ID NO: 204160 - DNA, 103 bp, Artificial Sequence
  Synthetic Polynucleotide
taatacgactcactataggggcagcgcagacatgtcgcacttgatgacgtaacagaggagaacgtcaatgagtgcgacaaacctggcggcagcgcaaaagatg

SEQ ID NO: 204161 - DNA, 103 bp, Artificial Sequence
  Synthetic Polynucleotide
taatacgactcactataggggaaggacctggccgaggagttccgcccaggaacagaggagacctgggatgaactcctcgaacctggcggcagcgcaaaagatg

SEQ ID NO: 204162 - DNA, 103 bp, Artificial Sequence
  Synthetic Polynucleotide
taatacgactcactatagggcccatcccagcatggccccctgaccgcatcaacagaggagagatgcgatgagggggccaaacctggcggcagcgcaaaagatg

SEQ ID NO: 204163 - DNA, 103 bp, Artificial Sequence
  Synthetic Polynucleotide
taatacgactcactatagggagcactcgctgcagcgcagacatgtcgcacaacagaggagagtgcgaatggtctgcgctaacctggcggcagcgcaaaagatg

SEQ ID NO: 204164 - DNA, 103 bp, Artificial Sequence
  Synthetic Polynucleotide
taatacgactcactataggggtggcggtagagcactcgctgcagcgcagaaacagaggagatctgcgatgcagcgagtgaacctggcggcagcgcaaaagatg

SEQ ID NO: 204165 - DNA, 103 bp, Artificial Sequence
  Synthetic Polynucleotide
taatacgactcactatagggtggcctgcatgtggcggtagagcactcgctaacagaggagaagcgagatgtctaccgccaacctggcggcagcgcaaaagatg

SEQ ID NO: 204166 - DNA, 103 bp, Artificial Sequence
  Synthetic Polynucleotide
taatacgactcactatagggagcacgcccttggcctgcatgtggcggtagaacagaggagactaccgatgcatgcaggcaacctggcggcagcgcaaaagatg

SEQ ID NO: 204167 - DNA, 103 bp, Artificial Sequence
  Synthetic Polynucleotide
taatacgactcactatagggatcagtcagcagcacgcccttggcctgcataacagaggagaatgcagatgaagggcgtgaacctggcggcagcgcaaaagatg

SEQ ID NO: 204168 - DNA, 103 bp, Artificial Sequence
  Synthetic Polynucleotide
taatacgactcactatagggtctcggagccatcagtcagcagcacgccctaacagaggagaagggcgatgtgctgactgaacctggcggcagcgcaaaagatg

SEQ ID NO: 204169 - DNA, 103 bp, Artificial Sequence
  Synthetic Polynucleotide
taatacgactcactatagggttcttgtccttctcggagccatcagtcagcaacagaggagagctgacatgtggctccgaaacctggcggcagcgcaaaagatg

SEQ ID NO: 204170 - DNA, 103 bp, Artificial Sequence
  Synthetic Polynucleotide
taatacgactcactataggggcctttgcccttcttgtccttctcggagccaacagaggagaggctccatgaaggacaagaacctggcggcagcgcaaaagatg

SEQ ID NO: 204171 - DNA, 103 bp, Artificial Sequence
  Synthetic Polynucleotide
taatacgactcactatagggtcttggtgccgcctttgcccttcttgtcctaacagaggagaaggacaatgagggcaaagaacctggcggcagcgcaaaagatg

SEQ ID NO: 204172 - DNA, 103 bp, Artificial Sequence
  Synthetic Polynucleotide
taatacgactcactatagggttcatcagggtcttggtgccgcctttgcccaacagaggagagggcaaatgcggcaccaaaacctggcggcagcgcaaaagatg

SEQ ID NO: 204173 - DNA, 103 bp, Artificial Sequence
  Synthetic Polynucleotide
taatacgactcactataggggggcgggggccccatcccagcatggcccccaacagaggagagggggcatggctgggatgaacctggcggcagcgcaaaagatg

SEQ ID NO: 204174 - DNA, 103 bp, Artificial Sequence
  Synthetic Polynucleotide
taatacgactcactatagggcatgatggtgttcatcagggtcttggtgccaacagaggagaggcaccatgaccctgatgaacctggcggcagcgcaaaagatg

SEQ ID NO: 204175 - DNA, 103 bp, Artificial Sequence
  Synthetic Polynucleotide
taatacgactcactatagggtccgcagctgcatgatggtgttcatcagggaacagaggagaccctgaatgacaccatcaaacctggcggcagcgcaaaagatg

SEQ ID NO: 204176 - DNA, 103 bp, Artificial Sequence
  Synthetic Polynucleotide
taatacgactcactatagggttgcagatcttccgcagctgcatgatggtgaacagaggagacaccatatggcagctgcgaacctggcggcagcgcaaaagatg

SEQ ID NO: 204177 - DNA, 103 bp, Artificial Sequence
  Synthetic Polynucleotide
taatacgactcactataggggtaggggtggttgcagatcttccgcagctgaacagaggagacagctgatgaagatctgcaacctggcggcagcgcaaaagatg

SEQ ID NO: 204178 - DNA, 103 bp, Artificial Sequence
  Synthetic Polynucleotide
taatacgactcactataggggctggaacatgtaggggtggttgcagatctaacagaggagaagatctatgaccacccctaacctggcggcagcgcaaaagatg

SEQ ID NO: 204179 - DNA, 103 bp, Artificial Sequence
  Synthetic Polynucleotide
taatacgactcactatagggtcctcgatgtgctggaacatgtaggggtggaacagaggagaccacccatgcatgttccaaacctggcggcagcgcaaaagatg

SEQ ID NO: 204180 - DNA, 103 bp, Artificial Sequence
  Synthetic Polynucleotide
taatacgactcactatagggggaaaaggactcctcgatgtgctggaacataacagaggagaatgttcatgcacatcgagaacctggcggcagcgcaaaagatg

SEQ ID NO: 204181 - DNA, 103 bp, Artificial Sequence
  Synthetic Polynucleotide
taatacgactcactatagggccaagtgctcggaaaaggactcctcgatgtaacagaggagaacatcgatgagtccttttaacctggcggcagcgcaaaagatg

SEQ ID NO: 204182 - DNA, 103 bp, Artificial Sequence
  Synthetic Polynucleotide
taatacgactcactatagggccagtgaaccccaagtgctcggaaaaggacaacagaggagagtccttatgcgagcacttaacctggcggcagcgcaaaagatg

SEQ ID NO: 204183 - DNA, 103 bp, Artificial Sequence
  Synthetic Polynucleotide
taatacgactcactataggggacaatgccgccagtgaaccccaagtgctcaacagaggagagagcacatggggttcactaacctggcggcagcgcaaaagatg

SEQ ID NO: 204184 - DNA, 103 bp, Artificial Sequence
  Synthetic Polynucleotide
taatacgactcactatagggccatggggctgggcgggggccccatcccagaacagaggagactgggaatgggcccccgcaacctggcggcagcgcaaaagatg

SEQ ID NO: 204185 - DNA, 103 bp, Artificial Sequence
  Synthetic Polynucleotide
taatacgactcactatagggccagcccttggacaatgccgccagtgaaccaacagaggagaggttcaatggcggcattgaacctggcggcagcgcaaaagatg

SEQ ID NO: 204186 - DNA, 103 bp, Artificial Sequence
  Synthetic Polynucleotide
taatacgactcactatagggcggtacaggtccagcccttggacaatgccgaacagaggagacggcatatgccaagggctaacctggcggcagcgcaaaagatg

SEQ ID NO: 204187 - DNA, 103 bp, Artificial Sequence
  Synthetic Polynucleotide
taatacgactcactatagggacccgaggctcggtacaggtccagcccttgaacagaggagacaagggatggacctgtacaacctggcggcagcgcaaaagatg

SEQ ID NO: 204188 - DNA, 103 bp, Artificial Sequence
  Synthetic Polynucleotide
taatacgactcactataggggctcaaatttacccgaggctcggtacaggtaacagaggagaacctgtatggagcctcggaacctggcggcagcgcaaaagatg

SEQ ID NO: 204189 - DNA, 103 bp, Artificial Sequence
  Synthetic Polynucleotide
taatacgactcactatagggctatcaagaagctcaaatttacccgaggctaacagaggagaagcctcatgtaaatttgaaacctggcggcagcgcaaaagatg

SEQ ID NO: 204190 - DNA, 103 bp, Artificial Sequence
  Synthetic Polynucleotide
taatacgactcactataggggggaagaattctatcaagaagctcaaatttaacagaggagaaaatttatgcttcttgataacctggcggcagcgcaaaagatg

SEQ ID NO: 204191 - DNA, 103 bp, Artificial Sequence
  Synthetic Polynucleotide
taatacgactcactatagggctcggagtttgggaagaattctatcaagaaaacagaggagattcttgatggaattcttcaacctggcggcagcgcaaaagatg

SEQ ID NO: 204192 - DNA, 103 bp, Artificial Sequence
  Synthetic Polynucleotide
taatacgactcactatagggtggttggttgctcggagtttgggaagaattaacagaggagaaattctatgcaaactccgaacctggcggcagcgcaaaagatg

SEQ ID NO: 204193 - DNA, 103 bp, Artificial Sequence
  Synthetic Polynucleotide
taatacgactcactatagggcagcactttgtggttggttgctcggagtttaacagaggagaaaactcatggcaaccaacaacctggcggcagcgcaaaagatg

SEQ ID NO: 204194 - DNA, 103 bp, Artificial Sequence
  Synthetic Polynucleotide
taatacgactcactatagggggcagaacagcagcactttgtggttggttgaacagaggagacaaccaatgacaaagtgcaacctggcggcagcgcaaaagatg

SEQ ID NO: 204195 - DNA, 103 bp, Artificial Sequence
  Synthetic Polynucleotide
taatacgactcactataggggagtgctggtccatggggctgggcgggggcaacagaggagagcccccatgcagccccataacctggcggcagcgcaaaagatg

SEQ ID NO: 204196 - DNA, 103 bp, Artificial Sequence
  Synthetic Polynucleotide
taatacgactcactataggggaggtcatttggcagaacagcagcactttgaacagaggagacaaagtatggctgttctgaacctggcggcagcgcaaaagatg

SEQ ID NO: 204197 - DNA, 103 bp, Artificial Sequence
  Synthetic Polynucleotide
taatacgactcactatagggggtcatgagggaggtcatttggcagaacagaacagaggagactgttcatgcaaatgaccaacctggcggcagcgcaaaagatg

SEQ ID NO: 204198 - DNA, 103 bp, Artificial Sequence
  Synthetic Polynucleotide
taatacgactcactatagggcttccatgatggtcatgagggaggtcatttaacagaggagaaaatgaatgccctcatgaaacctggcggcagcgcaaaagatg

SEQ ID NO: 204199 - DNA, 103 bp, Artificial Sequence
  Synthetic Polynucleotide
taatacgactcactataggggcaaagtaatcttccatgatggtcatgaggaacagaggagacctcatatgcatcatggaaacctggcggcagcgcaaaagatg

SEQ ID NO: 204200 - DNA, 103 bp, Artificial Sequence
  Synthetic Polynucleotide
taatacgactcactataggggccgcgatacgcaaagtaatcttccatgataacagaggagaatcatgatggattactttaacctggcggcagcgcaaaagatg

SEQ ID NO: 204201 - DNA, 103 bp, Artificial Sequence
  Synthetic Polynucleotide
taatacgactcactatagggggtatttaaagccgcgatacgcaaagtaataacagaggagaattactatgcgtatcgcgaacctggcggcagcgcaaaagatg

SEQ ID NO: 204202 - DNA, 103 bp, Artificial Sequence
  Synthetic Polynucleotide
taatacgactcactatagggtcaagcctgaggtatttaaagccgcgatacaacagaggagagtatcgatgctttaaataaacctggcggcagcgcaaaagatg

SEQ ID NO: 204203 - DNA, 103 bp, Artificial Sequence
  Synthetic Polynucleotide
taatacgactcactatagggcgtggttccatcaagcctgaggtatttaaaaacagaggagatttaaaatgctcaggcttaacctggcggcagcgcaaaagatg

SEQ ID NO: 204204 - DNA, 103 bp, Artificial Sequence
  Synthetic Polynucleotide
taatacgactcactatagggcctccgccttcgtggttccatcaagcctgaaacagaggagatcaggcatgatggaaccaaacctggcggcagcgcaaaagatg

SEQ ID NO: 204205 - DNA, 103 bp, Artificial Sequence
  Synthetic Polynucleotide
taatacgactcactatagggatgccccggtcctccgccttcgtggttccaaacagaggagatggaacatggaaggcggaaacctggcggcagcgcaaaagatg

SEQ ID NO: 204206 - DNA, 103 bp, Artificial Sequence
  Synthetic Polynucleotide
taatacgactcactataggggtaaccttgggagtgctggtccatggggctaacagaggagaagccccatggaccagcacaacctggcggcagcgcaaaagatg

SEQ ID NO: 204207 - DNA, 103 bp, Artificial Sequence
  Synthetic Polynucleotide
taatacgactcactatagggtttcagcagcatgccccggtcctccgccttaacagaggagaaaggcgatggaccggggcaacctggcggcagcgcaaaagatg

SEQ ID NO: 204208 - DNA, 103 bp, Artificial Sequence
  Synthetic Polynucleotide
taatacgactcactatagggcgttgaaggttttcagcagcatgccccggtaacagaggagaaccgggatgtgctgctgaaacctggcggcagcgcaaaagatg

SEQ ID NO: 204209 - DNA, 103 bp, Artificial Sequence
  Synthetic Polynucleotide
taatacgactcactataggggagccgggctcgttgaaggttttcagcagcaacagaggagagctgctatgaaccttcaaaacctggcggcagcgcaaaagatg

SEQ ID NO: 204210 - DNA, 103 bp, Artificial Sequence
  Synthetic Polynucleotide
taatacgactcactataggggaagtactcagagccgggctcgttgaaggtaacagaggagaaccttcatggagcccggcaacctggcggcagcgcaaaagatg

SEQ ID NO: 204211 - DNA, 103 bp, Artificial Sequence
  Synthetic Polynucleotide
taatacgactcactataggggcaggaagatgaagtactcagagccgggctaacagaggagaagcccgatgctgagtactaacctggcggcagcgcaaaagatg

SEQ ID NO: 204212 - DNA, 103 bp, Artificial Sequence
  Synthetic Polynucleotide
taatacgactcactatagggcgggtgctgagcaggaagatgaagtactcaaacagaggagatgagtaatgcatcttcctaacctggcggcagcgcaaaagatg

SEQ ID NO: 204213 - DNA, 103 bp, Artificial Sequence
  Synthetic Polynucleotide
taatacgactcactatagggccccccagcccgggtgctgagcaggaagataacagaggagaatcttcatgctcagcaccaacctggcggcagcgcaaaagatg

SEQ ID NO: 204214 - DNA, 103 bp, Artificial Sequence
  Synthetic Polynucleotide
taatacgactcactatagggtcaggccgagccccccagcccgggtgctgaaacagaggagatcagcaatggggctggggaacctggcggcagcgcaaaagatg

SEQ ID NO: 204215 - DNA, 103 bp, Artificial Sequence
  Synthetic Polynucleotide
taatacgactcactataggggactggaggttcaggccgagccccccagccaacagaggagaggctggatggctcggcctaacctggcggcagcgcaaaagatg

SEQ ID NO: 204216 - DNA, 103 bp, Artificial Sequence
  Synthetic Polynucleotide
taatacgactcactatagggagtgtctgccgactggaggttcaggccgagaacagaggagactcggcatgaacctccagaacctggcggcagcgcaaaagatg

SEQ ID NO: 204217 - DNA, 103 bp, Artificial Sequence
  Synthetic Polynucleotide
taatacgactcactatagggggggcgaggggtaaccttgggagtgctggtaacagaggagaaccagcatgcccaaggttaacctggcggcagcgcaaaagatg

SEQ ID NO: 204218 - DNA, 103 bp, Artificial Sequence
  Synthetic Polynucleotide
taatacgactcactatagggaaatgatcacagtgtctgccgactggaggtaacagaggagaacctccatgcggcagacaaacctggcggcagcgcaaaagatg

SEQ ID NO: 204219 - DNA, 103 bp, Artificial Sequence
  Synthetic Polynucleotide
taatacgactcactatagggtcgctgtcaaaaatgatcacagtgtctgccaacagaggagaggcagaatgtgtgatcataacctggcggcagcgcaaaagatg

SEQ ID NO: 204220 - DNA, 103 bp, Artificial Sequence
  Synthetic Polynucleotide
taatacgactcactatagggaggattccagtcgctgtcaaaaatgatcacaacagaggagagtgatcatgtttgacagcaacctggcggcagcgcaaaagatg

SEQ ID NO: 204221 - DNA, 103 bp, Artificial Sequence
  Synthetic Polynucleotide
taatacgactcactatagggggtcctggtgaggattccagtcgctgtcaaaacagaggagattgacaatgactggaatcaacctggcggcagcgcaaaagatg

SEQ ID NO: 204222 - DNA, 103 bp, Artificial Sequence
  Synthetic Polynucleotide
taatacgactcactatagggtgcgcttgcaggtcctggtgaggattccagaacagaggagactggaaatgtcaccaggaaacctggcggcagcgcaaaagatg

SEQ ID NO: 204223 - DNA, 103 bp, Artificial Sequence
  Synthetic Polynucleotide
taatacgactcactatagggggctcggtcctgcgcttgcaggtcctggtgaacagaggagacaccagatgctgcaagcgaacctggcggcagcgcaaaagatg

SEQ ID NO: 204224 - DNA, 103 bp, Artificial Sequence
  Synthetic Polynucleotide
taatacgactcactatagggcgatgcggtgggctcggtcctgcgcttgcaaacagaggagatgcaagatgaggaccgagaacctggcggcagcgcaaaagatg

SEQ ID NO: 204225 - DNA, 103 bp, Artificial Sequence
  Synthetic Polynucleotide
taatacgactcactatagggttctgctgcccgatgcggtgggctcggtccaacagaggagaggaccgatgccaccgcataacctggcggcagcgcaaaagatg

SEQ ID NO: 204226 - DNA, 103 bp, Artificial Sequence
  Synthetic Polynucleotide
taatacgactcactatagggacgcacctcgttctgctgcccgatgcggtgaacagaggagacaccgcatggggcagcagaacctggcggcagcgcaaaagatg

SEQ ID NO: 204227 - DNA, 103 bp, Artificial Sequence
  Synthetic Polynucleotide
taatacgactcactatagggggcggagcacacgcacctcgttctgctgccaacagaggagaggcagcatgacgaggtgcaacctggcggcagcgcaaaagatg

SEQ ID NO: 204228 - DNA, 103 bp, Artificial Sequence
  Synthetic Polynucleotide
taatacgactcactataggggagccacccaggggcgaggggtaaccttggaacagaggagaccaaggatgcccctcgccaacctggcggcagcgcaaaagatg

SEQ ID NO: 204229 - DNA, 103 bp, Artificial Sequence
  Synthetic Polynucleotide
taatacgactcactatagggacggtgcagaggcggagcacacgcacctcgaacagaggagacgaggtatgtgtgctccgaacctggcggcagcgcaaaagatg

SEQ ID NO: 204230 - DNA, 103 bp, Artificial Sequence
  Synthetic Polynucleotide
taatacgactcactatagggcacgctgttgacggtgcagaggcggagcacaacagaggagagtgctcatgctctgcaccaacctggcggcagcgcaaaagatg

SEQ ID NO: 204231 - DNA, 103 bp, Artificial Sequence
  Synthetic Polynucleotide
taatacgactcactatagggtcttctcctccacgctgttgacggtgcagaaacagaggagatctgcaatgtcaacagcgaacctggcggcagcgcaaaagatg

SEQ ID NO: 204232 - DNA, 103 bp, Artificial Sequence
  Synthetic Polynucleotide
taatacgactcactataggggcagctaggatcttctcctccacgctgttgaacagaggagacaacagatgggaggagaaaacctggcggcagcgcaaaagatg

SEQ ID NO: 204233 - DNA, 103 bp, Artificial Sequence
  Synthetic Polynucleotide
taatacgactcactataggggtacttggctgcagctaggatcttctcctcaacagaggagagaggagatgatcctagctaacctggcggcagcgcaaaagatg

SEQ ID NO: 204234 - DNA, 103 bp, Artificial Sequence
  Synthetic Polynucleotide
taatacgactcactatagggcgttgagcttgtacttggctgcagctaggaaacagaggagatcctagatgcagccaagtaacctggcggcagcgcaaaagatg

SEQ ID NO: 204235 - DNA, 103 bp, Artificial Sequence
  Synthetic Polynucleotide
taatacgactcactatagggttctggtccacgttgagcttgtacttggctaacagaggagaagccaaatgcaagctcaaaacctggcggcagcgcaaaagatg

SEQ ID NO: 204236 - DNA, 103 bp, Artificial Sequence
  Synthetic Polynucleotide
taatacgactcactatagggctggatcaccttctggtccacgttgagcttaacagaggagaaagctcatggtggaccagaacctggcggcagcgcaaaagatg

SEQ ID NO: 204237 - DNA, 103 bp, Artificial Sequence
  Synthetic Polynucleotide
taatacgactcactatagggacatgccggcctggatcaccttctggtccaaacagaggagatggaccatgaggtgatccaacctggcggcagcgcaaaagatg

SEQ ID NO: 204238 - DNA, 103 bp, Artificial Sequence
  Synthetic Polynucleotide
taatacgactcactatagggttctggtcgaacatgccggcctggatcaccaacagaggagaggtgatatgggccggcataacctggcggcagcgcaaaagatg

SEQ ID NO: 204239 - DNA, 103 bp, Artificial Sequence
  Synthetic Polynucleotide
taatacgactcactatagggggcatgctcagagccacccaggggcgagggaacagaggagaccctcgatgctgggtggcaacctggcggcagcgcaaaagatg

SEQ ID NO: 204240 - DNA, 103 bp, Artificial Sequence
  Synthetic Polynucleotide
taatacgactcactataggggctggaggacttctggtcgaacatgccggcaacagaggagagccggcatgttcgaccagaacctggcggcagcgcaaaagatg

SEQ ID NO: 204241 - DNA, 103 bp, Artificial Sequence
  Synthetic Polynucleotide
taatacgactcactataggggccgctcatggctggaggacttctggtcgaaacagaggagatcgaccatgagtcctccaaacctggcggcagcgcaaaagatg

SEQ ID NO: 204242 - DNA, 103 bp, Artificial Sequence
  Synthetic Polynucleotide
taatacgactcactatagggaggaaggcgcgccgctcatggctggaggacaacagaggagagtcctcatgccatgagcgaacctggcggcagcgcaaaagatg

SEQ ID NO: 204243 - DNA, 103 bp, Artificial Sequence
  Synthetic Polynucleotide
taatacgactcactataggggatggcctgcaggaaggcgcgccgctcatgaacagaggagacatgagatgcgcgccttcaacctggcggcagcgcaaaagatg

SEQ ID NO: 204244 - DNA, 103 bp, Artificial Sequence
  Synthetic Polynucleotide
taatacgactcactatagggcgtgctccaggatggcctgcaggaaggcgcaacagaggagagcgcctatgtgcaggccaaacctggcggcagcgcaaaagatg

SEQ ID NO: 204245 - DNA, 103 bp, Artificial Sequence
  Synthetic Polynucleotide
taatacgactcactatagggtcctgctcctcgtgctccaggatggcctgcaacagaggagagcaggcatgcctggagcaaacctggcggcagcgcaaaagatg

SEQ ID NO: 204246 - DNA, 103 bp, Artificial Sequence
  Synthetic Polynucleotide
taatacgactcactatagggtctgctctcatcctgctcctcgtgctccagaacagaggagactggagatggaggagcagaacctggcggcagcgcaaaagatg

SEQ ID NO: 204247 - DNA, 103 bp, Artificial Sequence
  Synthetic Polynucleotide
taatacgactcactatagggtgctgcagtgtctgctctcatcctgctcctaacagaggagaaggagcatgatgagagcaaacctggcggcagcgcaaaagatg

SEQ ID NO: 204248 - DNA, 103 bp, Artificial Sequence
  Synthetic Polynucleotide
taatacgactcactatagggccgctgcccgtgctgcagtgtctgctctcaaacagaggagatgagagatgacactgcagaacctggcggcagcgcaaaagatg

SEQ ID NO: 204249 - DNA, 103 bp, Artificial Sequence
  Synthetic Polynucleotide
taatacgactcactataggggctggcactgccgctgcccgtgctgcagtgaacagaggagacactgcatgacgggcagcaacctggcggcagcgcaaaagatg

SEQ ID NO: 204250 - DNA, 103 bp, Artificial Sequence
  Synthetic Polynucleotide
taatacgactcactatagggctggactagaggcatgctcagagccacccaaacagaggagatgggtgatgctgagcatgaacctggcggcagcgcaaaagatg

SEQ ID NO: 204251 - DNA, 103 bp, Artificial Sequence
  Synthetic Polynucleotide
taatacgactcactatagggtgtgggcgaagctggcactgccgctgcccgaacagaggagacgggcaatggcagtgccaaacctggcggcagcgcaaaagatg

SEQ ID NO: 204252 - DNA, 103 bp, Artificial Sequence
  Synthetic Polynucleotide
taatacgactcactatagggggaggggcagtgtgggcgaagctggcactgaacagaggagacagtgcatgcttcgcccaaacctggcggcagcgcaaaagatg

SEQ ID NO: 204253 - DNA, 103 bp, Artificial Sequence
  Synthetic Polynucleotide
taatacgactcactataggggcccgctggcggaggggcagtgtgggcgaaaacagaggagattcgccatgactgcccctaacctggcggcagcgcaaaagatg

SEQ ID NO: 204254 - DNA, 103 bp, Artificial Sequence
  Synthetic Polynucleotide
taatacgactcactatagggcggggttgacgcccgctggcggaggggcagaacagaggagactgcccatgcgccagcggaacctggcggcagcgcaaaagatg

SEQ ID NO: 204255 - DNA, 103 bp, Artificial Sequence
  Synthetic Polynucleotide
taatacgactcactatagggtcctccaagtcggggttgacgcccgctggcaacagaggagagccagcatgcgtcaacccaacctggcggcagcgcaaaagatg

SEQ ID NO: 204256 - DNA, 103 bp, Artificial Sequence
  Synthetic Polynucleotide
taatacgactcactatagggtagaggtggctcctccaagtcggggttgacaacagaggagagtcaacatggacttggagaacctggcggcagcgcaaaagatg

SEQ ID NO: 204257 - DNA, 103 bp, Artificial Sequence
  Synthetic Polynucleotide
taatacgactcactatagggcttcctcctttagaggtggctcctccaagtaacagaggagaacttggatgagccacctcaacctggcggcagcgcaaaagatg

SEQ ID NO: 204258 - DNA, 103 bp, Artificial Sequence
  Synthetic Polynucleotide
taatacgactcactatagggggcacctcgtcttcctcctttagaggtggcaacagaggagagccaccatgaaaggaggaaacctggcggcagcgcaaaagatg

SEQ ID NO: 204259 - DNA, 103 bp, Artificial Sequence
  Synthetic Polynucleotide
taatacgactcactatagggctcgtcgtcgggcacctcgtcttcctccttaacagaggagaaaggagatggacgaggtgaacctggcggcagcgcaaaagatg

SEQ ID NO: 204260 - DNA, 103 bp, Artificial Sequence
  Synthetic Polynucleotide
taatacgactcactatagggggttgacggtctcgtcgtcgggcacctcgtaacagaggagaacgaggatgccgacgacgaacctggcggcagcgcaaaagatg

SEQ ID NO: 204261 - DNA, 103 bp, Artificial Sequence
  Synthetic Polynucleotide
taatacgactcactatagggctggctggaactggactagaggcatgctcaaacagaggagatgagcaatgctctagtccaacctggcggcagcgcaaaagatg

SEQ ID NO: 204262 - DNA, 103 bp, Artificial Sequence
  Synthetic Polynucleotide
taatacgactcactataggggcgatcatctggttgacggtctcgtcgtcgaacagaggagacgacgaatggaccgtcaaaacctggcggcagcgcaaaagatg

SEQ ID NO: 204263 - DNA, 103 bp, Artificial Sequence
  Synthetic Polynucleotide
taatacgactcactatagggctcgtgccgggcgatcatctggttgacggtaacagaggagaaccgtcatgcagatgatcaacctggcggcagcgcaaaagatg

SEQ ID NO: 204264 - DNA, 103 bp, Artificial Sequence
  Synthetic Polynucleotide
taatacgactcactatagggcaaactcctcctcgtgccgggcgatcatctaacagaggagaagatgaatgcccggcacgaacctggcggcagcgcaaaagatg

SEQ ID NO: 204265 - DNA, 103 bp, Artificial Sequence
  Synthetic Polynucleotide
taatacgactcactatagggatgaacagatcaaactcctcctcgtgccggaacagaggagaccggcaatgggaggagttaacctggcggcagcgcaaaagatg

SEQ ID NO: 204266 - DNA, 103 bp, Artificial Sequence
  Synthetic Polynucleotide
taatacgactcactataggggtccatgcgcatgaacagatcaaactcctcaacagaggagagaggagatggatctgttcaacctggcggcagcgcaaaagatg

SEQ ID NO: 204267 - DNA, 103 bp, Artificial Sequence
  Synthetic Polynucleotide
taatacgactcactatagggtgcggtccaggtccatgcgcatgaacagataacagaggagaatctgtatgtgcgcatggaacctggcggcagcgcaaaagatg

SEQ ID NO: 204268 - DNA, 103 bp, Artificial Sequence
  Synthetic Polynucleotide
taatacgactcactatagggtcctcgcgcctgcggtccaggtccatgcgcaacagaggagagcgcatatgcctggaccgaacctggcggcagcgcaaaagatg

SEQ ID NO: 204269 - DNA, 103 bp, Artificial Sequence
  Synthetic Polynucleotide
taatacgactcactataggggttgcgggcctcctcgcgcctgcggtccagaacagaggagactggacatgaggcgcgagaacctggcggcagcgcaaaagatg

SEQ ID NO: 204270 - DNA, 103 bp, Artificial Sequence
  Synthetic Polynucleotide
taatacgactcactatagggtccgcttggggttgcgggcctcctcgcgccaacagaggagaggcgcgatgaggcccgcaaacctggcggcagcgcaaaagatg

SEQ ID NO: 204271 - DNA, 103 bp, Artificial Sequence
  Synthetic Polynucleotide
taatacgactcactatagggaggcgcggcttccgcttggggttgcgggccaacagaggagaggcccgatgccccaagcgaacctggcggcagcgcaaaagatg

SEQ ID NO: 204272 - DNA, 103 bp, Artificial Sequence
  Synthetic Polynucleotide
taatacgactcactatagggagggcccggggaaggacctggccgaggagtaacagaggagaactcctatgccaggtcctaacctggcggcagcgcaaaagatg

SEQ ID NO: 204273 - DNA, 103 bp, Artificial Sequence
  Synthetic Polynucleotide
taatacgactcactatagggagacgggccactggctggaactggactagaaacagaggagatctagtatggttccagccaacctggcggcagcgcaaaagatg

SEQ ID NO: 204274 - DNA, 103 bp, Artificial Sequence
  Synthetic Polynucleotide
taatacgactcactatagggctcctccatgaggcgcggcttccgcttgggaacagaggagacccaagatgaagccgcgcaacctggcggcagcgcaaaagatg

SEQ ID NO: 204275 - DNA, 103 bp, Artificial Sequence
  Synthetic Polynucleotide
taatacgactcactatagggggagctcgtcctcctccatgaggcgcggctaacagaggagaagccgcatgtcatggaggaacctggcggcagcgcaaaagatg

SEQ ID NO: 204276 - DNA, 103 bp, Artificial Sequence
  Synthetic Polynucleotide
taatacgactcactatagggatccacgaggggagctcgtcctcctccatgaacagaggagacatggaatgggacgagctaacctggcggcagcgcaaaagatg

SEQ ID NO: 204277 - DNA, 103 bp, Artificial Sequence
  Synthetic Polynucleotide
taatacgactcactataggggtccttgatgatccacgaggggagctcgtcaacagaggagagacgagatgccctcgtggaacctggcggcagcgcaaaagatg

SEQ ID NO: 204278 - DNA, 103 bp, Artificial Sequence
  Synthetic Polynucleotide
taatacgactcactatagggcctccgcgtcgtccttgatgatccacgaggaacagaggagacctcgtatgtcatcaaggaacctggcggcagcgcaaaagatg

SEQ ID NO: 204279 - DNA, 103 bp, Artificial Sequence
  Synthetic Polynucleotide
taatacgactcactatagggagccgctccacctccgcgtcgtccttgatgaacagaggagacatcaaatgcgacgcggaaacctggcggcagcgcaaaagatg

SEQ ID NO: 204280 - DNA, 103 bp, Artificial Sequence
  Synthetic Polynucleotide
taatacgactcactatagggctcacaggtcagccgctccacctccgcgtcaacagaggagagacgcgatggtggagcggaacctggcggcagcgcaaaagatg

SEQ ID NO: 204281 - DNA, 103 bp, Artificial Sequence
  Synthetic Polynucleotide
taatacgactcactatagggcctcctcctcctcacaggtcagccgctccaaacagaggagatggagcatgtgacctgtgaacctggcggcagcgcaaaagatg

SEQ ID NO: 204282 - DNA, 103 bp, Artificial Sequence
  Synthetic Polynucleotide
taatacgactcactatagggaacatcttctcctcctcctcctcacaggtcaacagaggagagacctgatgggaggaggaaacctggcggcagcgcaaaagatg

SEQ ID NO: 204283 - DNA, 103 bp, Artificial Sequence
  Synthetic Polynucleotide
taatacgactcactataggggccacggccgaacatcttctcctcctcctcaacagaggagagaggagatggagaagatgaacctggcggcagcgcaaaagatg

SEQ ID NO: 204284 - DNA, 103 bp, Artificial Sequence
  Synthetic Polynucleotide
taatacgactcactatagggggggccccgaagacgggccactggctggaaaacagaggagattccagatggtggcccgtaacctggcggcagcgcaaaagatg

SEQ ID NO: 204285 - DNA, 103 bp, Artificial Sequence
  Synthetic Polynucleotide
taatacgactcactatagggggtggcgggagccacggccgaacatcttctaacagaggagaagaagaatgtcggccgtgaacctggcggcagcgcaaaagatg

SEQ ID NO: 204286 - DNA, 103 bp, Artificial Sequence
  Synthetic Polynucleotide
taatacgactcactatagggacctccttgcggtggcgggagccacggccgaacagaggagacggccgatgctcccgccaaacctggcggcagcgcaaaagatg

SEQ ID NO: 204287 - DNA, 103 bp, Artificial Sequence
  Synthetic Polynucleotide
taatacgactcactataggggctgtagtccacctccttgcggtggcgggaaacagaggagatcccgcatgcgcaaggagaacctggcggcagcgcaaaagatg

SEQ ID NO: 204288 - DNA, 103 bp, Artificial Sequence
  Synthetic Polynucleotide
taatacgactcactatagggtcagtgagtcgctgtagtccacctccttgcaacagaggagagcaaggatgtggactacaaacctggcggcagcgcaaaagatg

SEQ ID NO: 204289 - DNA, 103 bp, Artificial Sequence
  Synthetic Polynucleotide
taatacgactcactatagggtgcttctccgtcagtgagtcgctgtagtccaacagaggagaggactaatgcgactcactaacctggcggcagcgcaaaagatg

SEQ ID NO: 204290 - DNA, 103 bp, Artificial Sequence
  Synthetic Polynucleotide
taatacgactcactatagggcttgagccactgcttctccgtcagtgagtcaacagaggagagactcaatgacggagaagaacctggcggcagcgcaaaagatg

SEQ ID NO: 204291 - DNA, 103 bp, Artificial Sequence
  Synthetic Polynucleotide
taatacgactcactatagggcctcgatggccttgagccactgcttctccgaacagaggagacggagaatgagtggctcaaacctggcggcagcgcaaaagatg

SEQ ID NO: 204292 - DNA, 103 bp, Artificial Sequence
  Synthetic Polynucleotide
taatacgactcactatagggagcgtgccctcctcgatggccttgagccacaacagaggagagtggctatgggccatcgaaacctggcggcagcgcaaaagatg

SEQ ID NO: 204293 - DNA, 103 bp, Artificial Sequence
  Synthetic Polynucleotide
taatacgactcactataggggatctcctccagcgtgccctcctcgatggcaacagaggagagccatcatggagggcacgaacctggcggcagcgcaaaagatg

SEQ ID NO: 204294 - DNA, 103 bp, Artificial Sequence
  Synthetic Polynucleotide
taatacgactcactatagggcctcctcttcgatctcctccagcgtgccctaacagaggagaagggcaatgtggaggagaaacctggcggcagcgcaaaagatg

SEQ ID NO: 204295 - DNA, 103 bp, Artificial Sequence
  Synthetic Polynucleotide
taatacgactcactataggggaagacatctggggccccgaagacgggccaaacagaggagatggcccatgttcggggccaacctggcggcagcgcaaaagatg

SEQ ID NO: 204296 - DNA, 103 bp, Artificial Sequence
  Synthetic Polynucleotide
taatacgactcactatagggttctgccggacctcctcttcgatctcctccaacagaggagaggaggaatgcgaagaggaaacctggcggcagcgcaaaagatg

SEQ ID NO: 204297 - DNA, 103 bp, Artificial Sequence
  Synthetic Polynucleotide
taatacgactcactatagggtgatgatttcttctgccggacctcctcttcaacagaggagagaagagatggtccggcagaacctggcggcagcgcaaaagatg

SEQ ID NO: 204298 - DNA, 103 bp, Artificial Sequence
  Synthetic Polynucleotide
taatacgactcactatagggtgcgcttccgtgatgatttcttctgccggaaacagaggagatccggcatgagaaatcataacctggcggcagcgcaaaagatg

SEQ ID NO: 204299 - DNA, 103 bp, Artificial Sequence
  Synthetic Polynucleotide
taatacgactcactatagggctgtctcgcttgcgcttccgtgatgatttcaacagaggagagaaatcatgacggaagcgaacctggcggcagcgcaaaagatg

SEQ ID NO: 204300 - DNA, 103 bp, Artificial Sequence
  Synthetic Polynucleotide
taatacgactcactataggggccggcgtcgctgtctcgcttgcgcttccgaacagaggagacggaagatgaagcgagacaacctggcggcagcgcaaaagatg

SEQ ID NO: 204301 - DNA, 103 bp, Artificial Sequence
  Synthetic Polynucleotide
taatacgactcactataggggggtggaggagccggcgtcgctgtctcgctaacagaggagaagcgagatggcgacgccgaacctggcggcagcgcaaaagatg

SEQ ID NO: 204302 - DNA, 103 bp, Artificial Sequence
  Synthetic Polynucleotide
taatacgactcactatagggctggtggtcggggtggaggagccggcgtcgaacagaggagacgacgcatgctcctccacaacctggcggcagcgcaaaagatg

SEQ ID NO: 204303 - DNA, 103 bp, Artificial Sequence
  Synthetic Polynucleotide
taatacgactcactataggggctgcgggtgctggtggtcggggtggaggaaacagaggagatcctccatgccgaccaccaacctggcggcagcgcaaaagatg

SEQ ID NO: 204304 - DNA, 103 bp, Artificial Sequence
  Synthetic Polynucleotide
taatacgactcactatagggccttgtcgcggctgcgggtgctggtggtcgaacagaggagacgaccaatggcacccgcaaacctggcggcagcgcaaaagatg

SEQ ID NO: 204305 - DNA, 103 bp, Artificial Sequence
  Synthetic Polynucleotide
taatacgactcactatagggctctcgtcgtccttgtcgcggctgcgggtgaacagaggagacacccgatgccgcgacaaaacctggcggcagcgcaaaagatg

SEQ ID NO: 204306 - DNA, 103 bp, Artificial Sequence
  Synthetic Polynucleotide
taatacgactcactatagggtcctggcccggaagacatctggggccccgaaacagaggagatcggggatgcagatgtctaacctggcggcagcgcaaaagatg

SEQ ID NO: 204307 - DNA, 103 bp, Artificial Sequence
  Synthetic Polynucleotide
taatacgactcactatagggctgcttcttgctctcgtcgtccttgtcgcgaacagaggagacgcgacatggacgacgagaacctggcggcagcgcaaaagatg

SEQ ID NO: 204308 - DNA, 103 bp, Artificial Sequence
  Synthetic Polynucleotide
taatacgactcactatagggcgcgcttcttctgcttcttgctctcgtcgtaacagaggagaacgacgatggcaagaagcaacctggcggcagcgcaaaagatg

SEQ ID NO: 204309 - DNA, 103 bp, Artificial Sequence
  Synthetic Polynucleotide
taatacgactcactatagggggcggccgcccgcgcttcttctgcttcttgaacagaggagacaagaaatggaagaagcgaacctggcggcagcgcaaaagatg

SEQ ID NO: 204310 - DNA, 103 bp, Artificial Sequence
  Synthetic Polynucleotide
taatacgactcactatagggtttctcggcaggcggccgcccgcgcttcttaacagaggagaaagaagatggggcggccgaacctggcggcagcgcaaaagatg

SEQ ID NO: 204311 - DNA, 103 bp, Artificial Sequence
  Synthetic Polynucleotide
taatacgactcactatagggtaggggagagtttctcggcaggcggccgccaacagaggagaggcggcatgctgccgagaaacctggcggcagcgcaaaagatg

SEQ ID NO: 204312 - DNA, 103 bp, Artificial Sequence
  Synthetic Polynucleotide
taatacgactcactatagggttgggtgggttaggggagagtttctcggcaaacagaggagatgccgaatgactctccccaacctggcggcagcgcaaaagatg

SEQ ID NO: 204313 - DNA, 103 bp, Artificial Sequence
  Synthetic Polynucleotide
taatacgactcactatagggcttggtgaggttgggtgggttaggggagagaacagaggagactctccatgaacccacccaacctggcggcagcgcaaaagatg

SEQ ID NO: 204314 - DNA, 103 bp, Artificial Sequence
  Synthetic Polynucleotide
taatacgactcactatagggtcttcatcttcttggtgaggttgggtgggtaacagaggagaacccacatgacctcaccaaacctggcggcagcgcaaaagatg

SEQ ID NO: 204315 - DNA, 103 bp, Artificial Sequence
  Synthetic Polynucleotide
taatacgactcactatagggtccacaatcttcttcatcttcttggtgaggaacagaggagacctcacatggaagatgaaaacctggcggcagcgcaaaagatg

SEQ ID NO: 204316 - DNA, 103 bp, Artificial Sequence
  Synthetic Polynucleotide
taatacgactcactataggggatcacggcatccacaatcttcttcatcttaacagaggagaaagatgatgaagattgtgaacctggcggcagcgcaaaagatg

SEQ ID NO: 204317 - DNA, 103 bp, Artificial Sequence
  Synthetic Polynucleotide
taatacgactcactataggggcggggcacctcctggcccggaagacatctaacagaggagaagatgtatgccgggccagaacctggcggcagcgcaaaagatg

SEQ ID NO: 204318 - DNA, 103 bp, Artificial Sequence
  Synthetic Polynucleotide
taatacgactcactatagggccttgtacttgatcacggcatccacaatctaacagaggagaagattgatgatgccgtgaaacctggcggcagcgcaaaagatg

SEQ ID NO: 204319 - DNA, 103 bp, Artificial Sequence
  Synthetic Polynucleotide
taatacgactcactatagggctgctgctgtccttgtacttgatcacggcaaacagaggagatgccgtatgcaagtacaaaacctggcggcagcgcaaaagatg

SEQ ID NO: 204320 - DNA, 103 bp, Artificial Sequence
  Synthetic Polynucleotide
taatacgactcactatagggctgacgtccactgctgctgtccttgtacttaacagaggagaaagtacatggacagcagcaacctggcggcagcgcaaaagatg

SEQ ID NO: 204321 - DNA, 103 bp, Artificial Sequence
  Synthetic Polynucleotide
taatacgactcactatagggcctcgctgagctgacgtccactgctgctgtaacagaggagaacagcaatggtggacgtcaacctggcggcagcgcaaaagatg

SEQ ID NO: 204322 - DNA, 103 bp, Artificial Sequence
  Synthetic Polynucleotide
taatacgactcactatagggtggatgaagacctcgctgagctgacgtccaaacagaggagatggacgatggctcagcgaaacctggcggcagcgcaaaagatg

SEQ ID NO: 204323 - DNA, 103 bp, Artificial Sequence
  Synthetic Polynucleotide
taatacgactcactatagggcgagggcagctggatgaagacctcgctgagaacagaggagactcagcatggtcttcatcaacctggcggcagcgcaaaagatg

SEQ ID NO: 204324 - DNA, 103 bp, Artificial Sequence
  Synthetic Polynucleotide
taatacgactcactataggggctcctttcgcgagggcagctggatgaagaaacagaggagatcttcaatgagctgccctaacctggcggcagcgcaaaagatg

SEQ ID NO: 204325 - DNA, 103 bp, Artificial Sequence
  Synthetic Polynucleotide
taatacgactcactatagggtactcgggcagctcctttcgcgagggcagcaacagaggagagctgccatggcgaaaggaaacctggcggcagcgcaaaagatg

SEQ ID NO: 204326 - DNA, 103 bp, Artificial Sequence
  Synthetic Polynucleotide
taatacgactcactataggggagctcgtagtactcgggcagctcctttcgaacagaggagacgaaagatgctgcccgagaacctggcggcagcgcaaaagatg

SEQ ID NO: 204327 - DNA, 103 bp, Artificial Sequence
  Synthetic Polynucleotide
taatacgactcactataggggcttgcggatgagctcgtagtactcgggcaaacagaggagatgcccgatgactacgagcaacctggcggcagcgcaaaagatg

SEQ ID NO: 204328 - DNA, 103 bp, Artificial Sequence
  Synthetic Polynucleotide
taatacgactcactataggggcaccatccagcggggcacctcctggcccgaacagaggagacgggccatgaggtgccccaacctggcggcagcgcaaaagatg

SEQ ID NO: 204329 - DNA, 103 bp, Artificial Sequence
  Synthetic Polynucleotide
taatacgactcactatagggaagtccacgggcttgcggatgagctcgtagaacagaggagactacgaatgcatccgcaaaacctggcggcagcgcaaaagatg

SEQ ID NO: 204330 - DNA, 103 bp, Artificial Sequence
  Synthetic Polynucleotide
taatacgactcactatagggtatcttcttgaagtccacgggcttgcggataacagaggagaatccgcatgcccgtggacaacctggcggcagcgcaaaagatg

SEQ ID NO: 204331 - DNA, 103 bp, Artificial Sequence
  Synthetic Polynucleotide
taatacgactcactatagggtgcgctcctttatcttcttgaagtccacggaacagaggagaccgtggatgtcaagaagaaacctggcggcagcgcaaaagatg

SEQ ID NO: 204332 - DNA, 103 bp, Artificial Sequence
  Synthetic Polynucleotide
taatacgactcactatagggtggttgcgaatgcgctcctttatcttcttgaacagaggagacaagaaatgaaaggagcgaacctggcggcagcgcaaaagatg

SEQ ID NO: 204333 - DNA, 103 bp, Artificial Sequence
  Synthetic Polynucleotide
taatacgactcactataggggcggtacttgtggttgcgaatgcgctccttaacagaggagaaaggagatgattcgcaacaacctggcggcagcgcaaaagatg

SEQ ID NO: 204334 - DNA, 103 bp, Artificial Sequence
  Synthetic Polynucleotide
taatacgactcactatagggcgttgaggctgcggtacttgtggttgcgaaaacagaggagattcgcaatgacaagtaccaacctggcggcagcgcaaaagatg

SEQ ID NO: 204335 - DNA, 103 bp, Artificial Sequence
  Synthetic Polynucleotide
taatacgactcactatagggttctctaggtcgttgaggctgcggtacttgaacagaggagacaagtaatgcagcctcaaaacctggcggcagcgcaaaagatg

SEQ ID NO: 204336 - DNA, 103 bp, Artificial Sequence
  Synthetic Polynucleotide
taatacgactcactatagggcatgacgtccttctctaggtcgttgaggctaacagaggagaagcctcatggacctagagaacctggcggcagcgcaaaagatg

SEQ ID NO: 204337 - DNA, 103 bp, Artificial Sequence
  Synthetic Polynucleotide
taatacgactcactatagggggcacaggagcatgacgtccttctctaggtaacagaggagaacctagatgaggacgtcaaacctggcggcagcgcaaaagatg

SEQ ID NO: 204338 - DNA, 103 bp, Artificial Sequence
  Synthetic Polynucleotide
taatacgactcactatagggtgtgcgttctggcacaggagcatgacgtccaacagaggagaggacgtatggctcctgtgaacctggcggcagcgcaaaagatg

SEQ ID NO: 204339 - DNA, 103 bp, Artificial Sequence
  Synthetic Polynucleotide
taatacgactcactatagggctgggggtcagcaccatccagcggggcaccaacagaggagaggtgccatgctggatggtaacctggcggcagcgcaaaagatg

SEQ ID NO: 204340 - DNA, 103 bp, Artificial Sequence
  Synthetic Polynucleotide
taatacgactcactataggggttgaaggtctgtgcgttctggcacaggagaacagaggagactcctgatgcagaacgcaaacctggcggcagcgcaaaagatg

SEQ ID NO: 204341 - DNA, 103 bp, Artificial Sequence
  Synthetic Polynucleotide
taatacgactcactatagggagccctccaggttgaaggtctgtgcgttctaacagaggagaagaacgatgagaccttcaaacctggcggcagcgcaaaagatg

SEQ ID NO: 204342 - DNA, 103 bp, Artificial Sequence
  Synthetic Polynucleotide
taatacgactcactatagggtagatcagggagccctccaggttgaaggtcaacagaggagagaccttatgcctggagggaacctggcggcagcgcaaaagatg

SEQ ID NO: 204343 - DNA, 103 bp, Artificial Sequence
  Synthetic Polynucleotide
taatacgactcactatagggggagtcttcatagatcagggagccctccagaacagaggagactggagatgtccctgatcaacctggcggcagcgcaaaagatg

SEQ ID NO: 204344 - DNA, 103 bp, Artificial Sequence
  Synthetic Polynucleotide
taatacgactcactataggggcaagacgatggagtcttcatagatcagggaacagaggagaccctgaatgatgaagactaacctggcggcagcgcaaaagatg

SEQ ID NO: 204345 - DNA, 103 bp, Artificial Sequence
  Synthetic Polynucleotide
taatacgactcactatagggaagaccgactgcaagacgatggagtcttcaaacagaggagatgaagaatgcatcgtcttaacctggcggcagcgcaaaagatg

SEQ ID NO: 204346 - DNA, 103 bp, Artificial Sequence
  Synthetic Polynucleotide
taatacgactcactatagggcacgctggtgaagaccgactgcaagacgataacagaggagaatcgtcatgcagtcggtcaacctggcggcagcgcaaaagatg

SEQ ID NO: 204347 - DNA, 103 bp, Artificial Sequence
  Synthetic Polynucleotide
taatacgactcactatagggttttctgccgcacgctggtgaagaccgactaacagaggagaagtcggatgtcaccagcgaacctggcggcagcgcaaaagatg

SEQ ID NO: 204348 - DNA, 103 bp, Artificial Sequence
  Synthetic Polynucleotide
taatacgactcactatagggtccttctcgattttctgccgcacgctggtgaacagaggagacaccagatggcggcagaaaacctggcggcagcgcaaaagatg

SEQ ID NO: 204349 - DNA, 103 bp, Artificial Sequence
  Synthetic Polynucleotide
taatacgactcactatagggactgtcatcctccttctcgattttctgccgaacagaggagacggcagatgatcgagaagaacctggcggcagcgcaaaagatg

SEQ ID NO: 204350 - DNA, 103 bp, Artificial Sequence
  Synthetic Polynucleotide
taatacgactcactataggggccccaaggcctgggggtcagcaccatccaaacagaggagatggatgatgctgacccccaacctggcggcagcgcaaaagatg

SEQ ID NO: 204351 - DNA, 103 bp, Artificial Sequence
  Synthetic Polynucleotide
taatacgactcactatagggcctcgccttcactgtcatcctccttctcgaaacagaggagatcgagaatgaggatgacaaacctggcggcagcgcaaaagatg

SEQ ID NO: 204352 - DNA, 103 bp, Artificial Sequence
  Synthetic Polynucleotide
taatacgactcactatagggtcctcactctcctcgccttcactgtcatccaacagaggagaggatgaatgtgaaggcgaaacctggcggcagcgcaaaagatg

SEQ ID NO: 204353 - DNA, 103 bp, Artificial Sequence
  Synthetic Polynucleotide
taatacgactcactatagggctcttcctcctcctcactctcctcgccttcaacagaggagagaaggcatggagagtgagaacctggcggcagcgcaaaagatg

SEQ ID NO: 204354 - DNA, 103 bp, Artificial Sequence
  Synthetic Polynucleotide
taatacgactcactatagggcctcctcgccctcttcctcctcctcactctaacagaggagaagagtgatgaggaggaagaacctggcggcagcgcaaaagatg

SEQ ID NO: 204355 - DNA, 103 bp, Artificial Sequence
  Synthetic Polynucleotide
taatacgactcactatagggtcggagccttcctcctcgccctcttcctccaacagaggagaggaggaatggggcgaggaaacctggcggcagcgcaaaagatg

SEQ ID NO: 204356 - DNA, 103 bp, Artificial Sequence
  Synthetic Polynucleotide
taatacgactcactatagggagattcggattcggagccttcctcctcgccaacagaggagaggcgagatggaaggctccaacctggcggcagcgcaaaagatg

SEQ ID NO: 204357 - DNA, 103 bp, Artificial Sequence
  Synthetic Polynucleotide
taatacgactcactatagggtgacggaccgagattcggattcggagccttaacagaggagaaaggctatgaatccgaataacctggcggcagcgcaaaagatg

SEQ ID NO: 204358 - DNA, 103 bp, Artificial Sequence
  Synthetic Polynucleotide
taatacgactcactatagggatcttcactttgacggaccgagattcggataacagaggagaatccgaatgtcggtccgtaacctggcggcagcgcaaaagatg

SEQ ID NO: 204359 - DNA, 103 bp, Artificial Sequence
  Synthetic Polynucleotide
taatacgactcactataggggccaagcttgatcttcactttgacggaccgaacagaggagacggtccatgaaagtgaagaacctggcggcagcgcaaaagatg

SEQ ID NO: 204360 - DNA, 103 bp, Artificial Sequence
  Synthetic Polynucleotide
taatacgactcactatagggtctccttccggccaagcttgatcttcacttaacagaggagaaagtgaatgtcaagcttgaacctggcggcagcgcaaaagatg

SEQ ID NO: 204361 - DNA, 103 bp, Artificial Sequence
  Synthetic Polynucleotide
taatacgactcactatagggcggttctgctgccccaaggcctgggggtcaaacagaggagatgacccatgggccttgggaacctggcggcagcgcaaaagatg

SEQ ID NO: 204362 - DNA, 103 bp, Artificial Sequence
  Synthetic Polynucleotide
taatacgactcactatagggtcctgtgccttctccttccggccaagcttgaacagaggagacaagctatgccggaaggaaacctggcggcagcgcaaaagatg

SEQ ID NO: 204363 - DNA, 103 bp, Artificial Sequence
  Synthetic Polynucleotide
taatacgactcactatagggcttcagccggtcctgtgccttctccttccgaacagaggagacggaagatgaaggcacagaacctggcggcagcgcaaaagatg

SEQ ID NO: 204364 - DNA, 103 bp, Artificial Sequence
  Synthetic Polynucleotide
taatacgactcactataggggccggccgcccttcagccggtcctgtgcctaacagaggagaaggcacatgaccggctgaaacctggcggcagcgcaaaagatg

SEQ ID NO: 204365 - DNA, 103 bp, Artificial Sequence
  Synthetic Polynucleotide
taatacgactcactatagggctcggccgccgccggccgcccttcagccggaacagaggagaccggctatggggcggccgaacctggcggcagcgcaaaagatg

SEQ ID NO: 204366 - DNA, 103 bp, Artificial Sequence
  Synthetic Polynucleotide
taatacgactcactatagggggaccctcggctcggccgccgccggccgccaacagaggagaggcggcatgcggcggccgaacctggcggcagcgcaaaagatg

SEQ ID NO: 204367 - DNA, 103 bp, Artificial Sequence
  Synthetic Polynucleotide
taatacgactcactataggggcttggctcgggaccctcggctcggccgccaacagaggagaggcggcatggccgagggtaacctggcggcagcgcaaaagatg

SEQ ID NO: 204368 - DNA, 103 bp, Artificial Sequence
  Synthetic Polynucleotide
taatacgactcactatagggctcacgaccggcttggctcgggaccctcggaacagaggagaccgaggatgccgagccaaaacctggcggcagcgcaaaagatg

SEQ ID NO: 204369 - DNA, 103 bp, Artificial Sequence
  Synthetic Polynucleotide
taatacgactcactataggggtcatcgtcactcacgaccggcttggctcgaacagaggagacgagccatgccggtcgtgaacctggcggcagcgcaaaagatg

SEQ ID NO: 204370 - DNA, 103 bp, Artificial Sequence
  Synthetic Polynucleotide
taatacgactcactatagggcctcctcactgtcatcgtcactcacgaccgaacagaggagacggtcgatggtgacgatgaacctggcggcagcgcaaaagatg

SEQ ID NO: 204371 - DNA, 103 bp, Artificial Sequence
  Synthetic Polynucleotide
taatacgactcactatagggtcctcttgttcctcctcactgtcatcgtcaaacagaggagatgacgaatgcagtgaggaaacctggcggcagcgcaaaagatg

SEQ ID NO: 204372 - DNA, 103 bp, Artificial Sequence
  Synthetic Polynucleotide
taatacgactcactatagggggttgggccccggttctgctgccccaaggcaacagaggagagccttgatgcagcagaacaacctggcggcagcgcaaaagatg

SEQ ID NO: 204373 - DNA, 103 bp, Artificial Sequence
  Synthetic Polynucleotide
taatacgactcactatagggtgagcggtcctcctcttgttcctcctcactaacagaggagaagtgagatggaacaagagaacctggcggcagcgcaaaagatg

SEQ ID NO: 204374 - DNA, 103 bp, Artificial Sequence
  Synthetic Polynucleotide
taatacgactcactatagggtgccacttcctgagcggtcctcctcttgttaacagaggagaaacaagatgaggaccgctaacctggcggcagcgcaaaagatg

SEQ ID NO: 204375 - DNA, 103 bp, Artificial Sequence
  Synthetic Polynucleotide
taatacgactcactatagggtcttcttcgctgccacttcctgagcggtccaacagaggagaggaccgatgaggaagtggaacctggcggcagcgcaaaagatg

SEQ ID NO: 204376 - DNA, 103 bp, Artificial Sequence
  Synthetic Polynucleotide
taatacgactcactataggggggaagggccagggcccggggaaggacctgaacagaggagacaggtcatgccccgggccaacctggcggcagcgcaaaagatg

SEQ ID NO: 204377 - DNA, 103 bp, Artificial Sequence
  Synthetic Polynucleotide
taatacgactcactatagggggttaaatggggttgggccccggttctgctaacagaggagaagcagaatgggggcccaaaacctggcggcagcgcaaaagatg

SEQ ID NO: 204378 - DNA, 103 bp, Artificial Sequence
  Synthetic Polynucleotide
taatacgactcactatagggagctggttctggttaaatggggttgggcccaacagaggagagggcccatgcccatttaaaacctggcggcagcgcaaaagatg

SEQ ID NO: 204379 - DNA, 103 bp, Artificial Sequence
  Synthetic Polynucleotide
taatacgactcactataggggagctggtgcagctggttctggttaaatggaacagaggagaccatttatgcagaaccagaacctggcggcagcgcaaaagatg

SEQ ID NO: 204380 - DNA, 103 bp, Artificial Sequence
  Synthetic Polynucleotide
taatacgactcactatagggtctgagctctgagctggtgcagctggttctaacagaggagaagaaccatgtgcaccagcaacctggcggcagcgcaaaagatg

SEQ ID NO: 204381 - DNA, 103 bp, Artificial Sequence
  Synthetic Polynucleotide
taatacgactcactatagggtaggccatgatctgagctctgagctggtgcaacagaggagagcaccaatgcagagctcaaacctggcggcagcgcaaaagatg

SEQ ID NO: 204382 - DNA, 103 bp, Artificial Sequence
  Synthetic Polynucleotide
taatacgactcactatagggcagcatcttgtaggccatgatctgagctctaacagaggagaagagctatgatcatggccaacctggcggcagcgcaaaagatg

SEQ ID NO: 204383 - DNA, 103 bp, Artificial Sequence
  Synthetic Polynucleotide
taatacgactcactataggggccccctggccagcatcttgtaggccatgaaacagaggagatcatggatgacaagatgcaacctggcggcagcgcaaaagatg

SEQ ID NO: 204384 - DNA, 103 bp, Artificial Sequence
  Synthetic Polynucleotide
taatacgactcactataggggggaggggctgccccctggccagcatcttgaacagaggagacaagatatgggccaggggaacctggcggcagcgcaaaagatg

SEQ ID NO: 204385 - DNA, 103 bp, Artificial Sequence
  Synthetic Polynucleotide
taatacgactcactatagggcaggtggtcggggaggggctgccccctggcaacagaggagagccaggatgcagcccctcaacctggcggcagcgcaaaagatg

SEQ ID NO: 204386 - DNA, 103 bp, Artificial Sequence
  Synthetic Polynucleotide
taatacgactcactatagggccgccatctgcaggtggtcggggaggggctaacagaggagaagccccatgccgaccaccaacctggcggcagcgcaaaagatg

SEQ ID NO: 204387 - DNA, 103 bp, Artificial Sequence
  Synthetic Polynucleotide
taatacgactcactatagggatggctccaggggaagggccagggcccgggaacagaggagacccgggatgtggcccttcaacctggcggcagcgcaaaagatg

SEQ ID NO: 204388 - DNA, 103 bp, Artificial Sequence
  Synthetic Polynucleotide
taatacgactcactatagggttgccctgcaccgccatctgcaggtggtcgaacagaggagacgaccaatggcagatggcaacctggcggcagcgcaaaagatg

SEQ ID NO: 204389 - DNA, 103 bp, Artificial Sequence
  Synthetic Polynucleotide
taatacgactcactatagggcatcggccgcttgccctgcaccgccatctgaacagaggagacagatgatggtgcagggcaacctggcggcagcgcaaaagatg

SEQ ID NO: 204390 - DNA, 103 bp, Artificial Sequence
  Synthetic Polynucleotide
taatacgactcactataggggcatcccgggcatcggccgcttgccctgcaaacagaggagatgcaggatgagcggccgaaacctggcggcagcgcaaaagatg

SEQ ID NO: 204391 - DNA, 103 bp, Artificial Sequence
  Synthetic Polynucleotide
taatacgactcactatagggatctgctgctgcatcccgggcatcggccgcaacagaggagagcggccatggcccgggataacctggcggcagcgcaaaagatg

SEQ ID NO: 204392 - DNA, 103 bp, Artificial Sequence
  Synthetic Polynucleotide
taatacgactcactatagggtagcgttggcatctgctgctgcatcccgggaacagaggagacccgggatgcagcagcagaacctggcggcagcgcaaaagatg

SEQ ID NO: 204393 - DNA, 103 bp, Artificial Sequence
  Synthetic Polynucleotide
taatacgactcactatagggagggtggaggtagcgttggcatctgctgctaacagaggagaagcagcatgtgccaacgcaacctggcggcagcgcaaaagatg

SEQ ID NO: 204394 - DNA, 103 bp, Artificial Sequence
  Synthetic Polynucleotide
taatacgactcactataggggcggacaccgagggtggaggtagcgttggcaacagaggagagccaacatgacctccaccaacctggcggcagcgcaaaagatg

SEQ ID NO: 204395 - DNA, 103 bp, Artificial Sequence
  Synthetic Polynucleotide
taatacgactcactataggggggtcctgttgcggacaccgagggtggaggaacagaggagacctccaatgtcggtgtccaacctggcggcagcgcaaaagatg

SEQ ID NO: 204396 - DNA, 103 bp, Artificial Sequence
  Synthetic Polynucleotide
taatacgactcactatagggggccagggccgggtcctgttgcggacaccgaacagaggagacggtgtatgcaacaggacaacctggcggcagcgcaaaagatg

SEQ ID NO: 204397 - DNA, 103 bp, Artificial Sequence
  Synthetic Polynucleotide
taatacgactcactatagggccagggccagggccagggccgggtcctgttaacagaggagaaacaggatgcggccctggaacctggcggcagcgcaaaagatg

SEQ ID NO: 204398 - DNA, 103 bp, Artificial Sequence
  Synthetic Polynucleotide
taatacgactcactatagggagggcccagcatggctccaggggaagggccaacagaggagaggccctatgcctggagccaacctggcggcagcgcaaaagatg

SEQ ID NO: 204399 - DNA, 103 bp, Artificial Sequence
  Synthetic Polynucleotide
taatacgactcactatagggcgggccggggccagggccagggccagggccaacagaggagaggccctatgcctggccctaacctggcggcagcgcaaaagatg

SEQ ID NO: 204400 - DNA, 103 bp, Artificial Sequence
  Synthetic Polynucleotide
taatacgactcactatagggggccgggacccgggccggggccagggccagaacagaggagactggccatggccccggccaacctggcggcagcgcaaaagatg

SEQ ID NO: 204401 - DNA, 103 bp, Artificial Sequence
  Synthetic Polynucleotide
taatacgactcactatagggggaggtgccgggccgggacccgggccggggaacagaggagaccccggatggggtcccggaacctggcggcagcgcaaaagatg

SEQ ID NO: 204402 - DNA, 103 bp, Artificial Sequence
  Synthetic Polynucleotide
taatacgactcactataggggctgtaatttggaggtgccgggccgggaccaacagaggagaggtcccatgccggcacctaacctggcggcagcgcaaaagatg

SEQ ID NO: 204403 - DNA, 103 bp, Artificial Sequence
  Synthetic Polynucleotide
taatacgactcactatagggcatgaggcctgctgtaatttggaggtgccgaacagaggagacggcacatgcaaattacaaacctggcggcagcgcaaaagatg

SEQ ID NO: 204404 - DNA, 103 bp, Artificial Sequence
  Synthetic Polynucleotide
taatacgactcactatagggcctcccataccatgaggcctgctgtaatttaacagaggagaaaattaatgcaggcctcaaacctggcggcagcgcaaaagatg

SEQ ID NO: 204405 - DNA, 103 bp, Artificial Sequence
  Synthetic Polynucleotide
taatacgactcactatagggcatgttgggccctcccataccatgaggcctaacagaggagaaggcctatgggtatgggaaacctggcggcagcgcaaaagatg

SEQ ID NO: 204406 - DNA, 103 bp, Artificial Sequence
  Synthetic Polynucleotide
taatacgactcactatagggctgggggaggcatgttgggccctcccatacaacagaggagagtatggatgggcccaacaaacctggcggcagcgcaaaagatg

SEQ ID NO: 204407 - DNA, 103 bp, Artificial Sequence
  Synthetic Polynucleotide
taatacgactcactatagggcccgagggtcctgggggaggcatgttgggcaacagaggagagcccaaatggcctcccccaacctggcggcagcgcaaaagatg

SEQ ID NO: 204408 - DNA, 103 bp, Artificial Sequence
  Synthetic Polynucleotide
taatacgactcactatagggggggggcacgcccgagggtcctgggggaggaacagaggagacctcccatgggaccctcgaacctggcggcagcgcaaaagatg

SEQ ID NO: 204409 - DNA, 103 bp, Artificial Sequence
  Synthetic Polynucleotide
taatacgactcactataggggacccgggctagggcccagcatggctccagaacagaggagactggagatgtgctgggccaacctggcggcagcgcaaaagatg

SEQ ID NO: 204410 - DNA, 103 bp, Artificial Sequence
  Synthetic Polynucleotide
taatacgactcactatagggctggcatcccggggggcacgcccgagggtcaacagaggagagaccctatggcgtgccccaacctggcggcagcgcaaaagatg

SEQ ID NO: 204411 - DNA, 103 bp, Artificial Sequence
  Synthetic Polynucleotide
taatacgactcactatagggggaggctggcctggcatcccggggggcacgaacagaggagacgtgccatgcgggatgccaacctggcggcagcgcaaaagatg

SEQ ID NO: 204412 - DNA, 103 bp, Artificial Sequence
  Synthetic Polynucleotide
taatacgactcactatagggaggccctccaggaggctggcctggcatcccaacagaggagagggatgatgggccagcctaacctggcggcagcgcaaaagatg

SEQ ID NO: 204413 - DNA, 103 bp, Artificial Sequence
  Synthetic Polynucleotide
taatacgactcactatagggagggcttgggaggccctccaggaggctggcaacagaggagagccagcatgctggagggcaacctggcggcagcgcaaaagatg

SEQ ID NO: 204414 - DNA, 103 bp, Artificial Sequence
  Synthetic Polynucleotide
taatacgactcactatagggccttcaggccagggcttgggaggccctccaaacagaggagatggaggatgtcccaagccaacctggcggcagcgcaaaagatg

SEQ ID NO: 204415 - DNA, 103 bp, Artificial Sequence
  Synthetic Polynucleotide
taatacgactcactatagggcgccatgggtccttcaggccagggcttgggaacagaggagacccaagatgtggcctgaaaacctggcggcagcgcaaaagatg

SEQ ID NO: 204416 - DNA, 103 bp, Artificial Sequence
  Synthetic Polynucleotide
taatacgactcactatagggcagcagcattcgccatgggtccttcaggccaacagaggagaggcctgatggacccatggaacctggcggcagcgcaaaagatg

SEQ ID NO: 204417 - DNA, 103 bp, Artificial Sequence
  Synthetic Polynucleotide
taatacgactcactatagggctcgtgggggcagcagcattcgccatgggtaacagaggagaacccatatggaatgctgcaacctggcggcagcgcaaaagatg

SEQ ID NO: 204418 - DNA, 103 bp, Artificial Sequence
  Synthetic Polynucleotide
taatacgactcactatagggctgaggggtgctcgtgggggcagcagcattaacagaggagaaatgctatggcccccacgaacctggcggcagcgcaaaagatg

SEQ ID NO: 204419 - DNA, 103 bp, Artificial Sequence
  Synthetic Polynucleotide
taatacgactcactataggggaatcagcttctgaggggtgctcgtgggggaacagaggagacccccaatggcacccctcaacctggcggcagcgcaaaagatg

SEQ ID NO: 204420 - DNA, 103 bp, Artificial Sequence
  Synthetic Polynucleotide
taatacgactcactatagggcccggcgagggacccgggctagggcccagcaacagaggagagctgggatgtagcccgggaacctggcggcagcgcaaaagatg

SEQ ID NO: 204421 - DNA, 103 bp, Artificial Sequence
  Synthetic Polynucleotide
taatacgactcactatagggggctgcgggggaatcagcttctgaggggtgaacagaggagacaccccatggaagctgataacctggcggcagcgcaaaagatg

SEQ ID NO: 204422 - DNA, 103 bp, Artificial Sequence
  Synthetic Polynucleotide
taatacgactcactataggggcggcccgttggctgcgggggaatcagcttaacagaggagaaagctgatgcccccgcagaacctggcggcagcgcaaaagatg

SEQ ID NO: 204423 - DNA, 103 bp, Artificial Sequence
  Synthetic Polynucleotide
taatacgactcactatagggcgggggaagggcggcccgttggctgcggggaacagaggagaccccgcatgcaacgggccaacctggcggcagcgcaaaagatg

SEQ ID NO: 204424 - DNA, 103 bp, Artificial Sequence
  Synthetic Polynucleotide
taatacgactcactataggggcagggggcgcgggggaagggcggcccgttaacagaggagaaacgggatgcccttccccaacctggcggcagcgcaaaagatg

SEQ ID NO: 204425 - DNA, 103 bp, Artificial Sequence
  Synthetic Polynucleotide
taatacgactcactataggggggtgggacggcagggggcgcgggggaaggaacagaggagaccttccatggcgccccctaacctggcggcagcgcaaaagatg

SEQ ID NO: 204426 - DNA, 103 bp, Artificial Sequence
  Synthetic Polynucleotide
taatacgactcactataggggcgaggcggcgggtgggacggcagggggcgaacagaggagacgccccatgccgtcccacaacctggcggcagcgcaaaagatg

SEQ ID NO: 204427 - DNA, 103 bp, Artificial Sequence
  Synthetic Polynucleotide
taatacgactcactatagggggcatcacgggcgaggcggcgggtgggacgaacagaggagacgtcccatgcgccgcctcaacctggcggcagcgcaaaagatg

SEQ ID NO: 204428 - DNA, 103 bp, Artificial Sequence
  Synthetic Polynucleotide
taatacgactcactatagggggtctgcggtggcatcacgggcgaggcggcaacagaggagagccgccatgcccgtgatgaacctggcggcagcgcaaaagatg

SEQ ID NO: 204429 - DNA, 103 bp, Artificial Sequence
  Synthetic Polynucleotide
taatacgactcactatagggcgggggactgggtctgcggtggcatcacggaacagaggagaccgtgaatgcaccgcagaaacctggcggcagcgcaaaagatg

SEQ ID NO: 204430 - DNA, 103 bp, Artificial Sequence
  Synthetic Polynucleotide
taatacgactcactataggggccggctgcccgggggactgggtctgcggtaacagaggagaaccgcaatgccagtccccaacctggcggcagcgcaaaagatg

SEQ ID NO: 204431 - DNA, 103 bp, Artificial Sequence
  Synthetic Polynucleotide
taatacgactcactataggggaaggtcttgctcagcgccatcatcatcataacagaggagaatgatgatgatggcgctgaacctggcggcagcgcaaaagatg

SEQ ID NO: 204432 - DNA, 103 bp, Artificial Sequence
  Synthetic Polynucleotide
taatacgactcactatagggtcggaacatacggaggtagtttcccacctcaacagaggagagaggtgatgaactacctcaacctggcggcagcgcaaaagatg

SEQ ID NO: 204433 - DNA, 103 bp, Artificial Sequence
  Synthetic Polynucleotide
taatacgactcactatagggccactggtccgcatcgcccgtgttccggataacagaggagaatccggatgacgggcgataacctggcggcagcgcaaaagatg

SEQ ID NO: 204434 - DNA, 103 bp, Artificial Sequence
  Synthetic Polynucleotide
taatacgactcactataggggcagtgggcaccactggtccgcatcgcccgaacagaggagacgggcgatgcggaccagtaacctggcggcagcgcaaaagatg

SEQ ID NO: 204435 - DNA, 103 bp, Artificial Sequence
  Synthetic Polynucleotide
taatacgactcactatagggagagtctccagcagtgggcaccactggtccaacagaggagaggaccaatggtgcccactaacctggcggcagcgcaaaagatg

SEQ ID NO: 204436 - DNA, 103 bp, Artificial Sequence
  Synthetic Polynucleotide
taatacgactcactatagggagcgtctgtcagagtctccagcagtgggcaaacagaggagatgcccaatgctggagactaacctggcggcagcgcaaaagatg

SEQ ID NO: 204437 - DNA, 103 bp, Artificial Sequence
  Synthetic Polynucleotide
taatacgactcactatagggtctccatctcagcgtctgtcagagtctccaaacagaggagatggagaatgtgacagacgaacctggcggcagcgcaaaagatg

SEQ ID NO: 204438 - DNA, 103 bp, Artificial Sequence
  Synthetic Polynucleotide
taatacgactcactatagggcggatcttcttctccatctcagcgtctgtcaacagaggagagacagaatgtgagatggaaacctggcggcagcgcaaaagatg

SEQ ID NO: 204439 - DNA, 103 bp, Artificial Sequence
  Synthetic Polynucleotide
taatacgactcactataggggtcctggtcgcggatcttcttctccatctcaacagaggagagagatgatgaagaagatcaacctggcggcagcgcaaaagatg

SEQ ID NO: 204440 - DNA, 103 bp, Artificial Sequence
  Synthetic Polynucleotide
taatacgactcactatagggtcgtgttcctgtcctggtcgcggatcttctaacagaggagaagaagaatggcgaccaggaacctggcggcagcgcaaaagatg

SEQ ID NO: 204441 - DNA, 103 bp, Artificial Sequence
  Synthetic Polynucleotide
taatacgactcactatagggctcatccgcctcgtgttcctgtcctggtcgaacagaggagacgaccaatgcaggaacacaacctggcggcagcgcaaaagatg

SEQ ID NO: 204442 - DNA, 103 bp, Artificial Sequence
  Synthetic Polynucleotide
taatacgactcactatagggggcaagacgcctcatccgcctcgtgttcctaacagaggagaaggaacatgaggcggatgaacctggcggcagcgcaaaagatg

SEQ ID NO: 204443 - DNA, 103 bp, Artificial Sequence
  Synthetic Polynucleotide
taatacgactcactatagggacagagaacctcggaacatacggaggtagtaacagaggagaactaccatggtatgttccaacctggcggcagcgcaaaagatg

SEQ ID NO: 204444 - DNA, 103 bp, Artificial Sequence
  Synthetic Polynucleotide
taatacgactcactataggggggccgtgttggcaagacgcctcatccgccaacagaggagaggcggaatgggcgtcttgaacctggcggcagcgcaaaagatg

SEQ ID NO: 204445 - DNA, 103 bp, Artificial Sequence
  Synthetic Polynucleotide
taatacgactcactatagggtaccaggccggggccgtgttggcaagacgcaacagaggagagcgtctatgcaacacggcaacctggcggcagcgcaaaagatg

SEQ ID NO: 204446 - DNA, 103 bp, Artificial Sequence
  Synthetic Polynucleotide
taatacgactcactatagggtatctcttgtacagagaacctcggaacataaacagaggagatatgttatgaggttctctaacctggcggcagcgcaaaagatg

SEQ ID NO: 204447 - DNA, 103 bp, Artificial Sequence
  Synthetic Polynucleotide
taatacgactcactataggggagtgaggggtatctcttgtacagagaaccaacagaggagaggttctatgtacaagagaaacctggcggcagcgcaaaagatg

SEQ ID NO: 204448 - DNA, 103 bp, Artificial Sequence
  Synthetic Polynucleotide
taatacgactcactataggggtcgcctccagagtgaggggtatctcttgtaacagaggagaacaagaatgacccctcacaacctggcggcagcgcaaaagatg

SEQ ID NO: 204449 - DNA, 103 bp, Artificial Sequence
  Synthetic Polynucleotide
taatacgactcactatagggacagtggctagtcgcctccagagtgaggggaacagaggagacccctcatgctggaggcgaacctggcggcagcgcaaaagatg

SEQ ID NO: 204450 - DNA, 103 bp, Artificial Sequence
  Synthetic Polynucleotide
taatacgactcactatagggcctctcttccacagtggctagtcgcctccaaacagaggagatggaggatgctagccactaacctggcggcagcgcaaaagatg

SEQ ID NO: 204451 - DNA, 103 bp, Artificial Sequence
  Synthetic Polynucleotide
taatacgactcactatagggctattttcttcctctcttccacagtggctaaacagaggagatagccaatgtggaagagaaacctggcggcagcgcaaaagatg

SEQ ID NO: 204452 - DNA, 103 bp, Artificial Sequence
  Synthetic Polynucleotide
taatacgactcactataggggacgatgcaactattttcttcctctcttccaacagaggagaggaagaatggaagaaaataacctggcggcagcgcaaaagatg

SEQ ID NO: 204453 - DNA, 103 bp, Artificial Sequence
  Synthetic Polynucleotide
taatacgactcactataggggtgatcatgtgacgatgcaactattttcttaacagaggagaaagaaaatggttgcatcgaacctggcggcagcgcaaaagatg

SEQ ID NO: 204454 - DNA, 103 bp, Artificial Sequence
  Synthetic Polynucleotide
taatacgactcactataggggcttctgcccgaaggtcttgctcagcgccaaacagaggagatggcgcatggcaagacctaacctggcggcagcgcaaaagatg

SEQ ID NO: 204455 - DNA, 103 bp, Artificial Sequence
  Synthetic Polynucleotide
taatacgactcactatagggtcgtgtatccgtgatcatgtgacgatgcaaaacagaggagattgcatatgcacatgatcaacctggcggcagcgcaaaagatg

SEQ ID NO: 204456 - DNA, 103 bp, Artificial Sequence
  Synthetic Polynucleotide
taatacgactcactataggggtggctagagtcgtgtatccgtgatcatgtaacagaggagaacatgaatgcggatacacaacctggcggcagcgcaaaagatg

SEQ ID NO: 204457 - DNA, 103 bp, Artificial Sequence
  Synthetic Polynucleotide
taatacgactcactatagggggtcacactggtggctagagtcgtgtatccaacagaggagaggatacatgactctagccaacctggcggcagcgcaaaagatg

SEQ ID NO: 204458 - DNA, 103 bp, Artificial Sequence
  Synthetic Polynucleotide
taatacgactcactatagggcttttaacagggtcacactggtggctagagaacagaggagactctagatgccagtgtgaaacctggcggcagcgcaaaagatg

SEQ ID NO: 204459 - DNA, 103 bp, Artificial Sequence
  Synthetic Polynucleotide
taatacgactcactatagggacttccgaggcttttaacagggtcacactgaacagaggagacagtgtatgcctgttaaaaacctggcggcagcgcaaaagatg

SEQ ID NO: 204460 - DNA, 103 bp, Artificial Sequence
  Synthetic Polynucleotide
taatacgactcactatagggaatctcttccacttccgaggcttttaacagaacagaggagactgttaatggcctcggaaaacctggcggcagcgcaaaagatg

SEQ ID NO: 204461 - DNA, 103 bp, Artificial Sequence
  Synthetic Polynucleotide
taatacgactcactatagggtgccatccagaatctcttccacttccgaggaacagaggagacctcggatgtggaagagaaacctggcggcagcgcaaaagatg

SEQ ID NO: 204462 - DNA, 103 bp, Artificial Sequence
  Synthetic Polynucleotide
taatacgactcactatagggttctcatcgttgccatccagaatctcttccaacagaggagaggaagaatgtctggatggaacctggcggcagcgcaaaagatg

SEQ ID NO: 204463 - DNA, 103 bp, Artificial Sequence
  Synthetic Polynucleotide
taatacgactcactatagggagccttgtacttctcatcgttgccatccagaacagaggagactggatatgaacgatgagaacctggcggcagcgcaaaagatg

SEQ ID NO: 204464 - DNA, 103 bp, Artificial Sequence
  Synthetic Polynucleotide
taatacgactcactatagggtgatggacacagccttgtacttctcatcgtaacagaggagaacgatgatgagtacaaggaacctggcggcagcgcaaaagatg

SEQ ID NO: 204465 - DNA, 103 bp, Artificial Sequence
  Synthetic Polynucleotide
taatacgactcactatagggaacttcacgggcttctgcccgaaggtcttgaacagaggagacaagacatgcgggcagaaaacctggcggcagcgcaaaagatg

SEQ ID NO: 204466 - DNA, 103 bp, Artificial Sequence
  Synthetic Polynucleotide
taatacgactcactatagggggctctgtgctgatggacacagccttgtacaacagaggagagtacaaatgtgtgtccataacctggcggcagcgcaaaagatg

SEQ ID NO: 204467 - DNA, 103 bp, Artificial Sequence
  Synthetic Polynucleotide
taatacgactcactataggggtaggtggggggctctgtgctgatggacacaacagaggagagtgtccatgagcacagagaacctggcggcagcgcaaaagatg

SEQ ID NO: 204468 - DNA, 103 bp, Artificial Sequence
  Synthetic Polynucleotide
taatacgactcactataggggttccctgaggtaggtggggggctctgtgcaacagaggagagcacagatgcccccacctaacctggcggcagcgcaaaagatg

SEQ ID NO: 204469 - DNA, 103 bp, Artificial Sequence
  Synthetic Polynucleotide
taatacgactcactatagggttggccttctgttccctgaggtaggtggggaacagaggagaccccacatgcctcagggaaacctggcggcagcgcaaaagatg

SEQ ID NO: 204470 - DNA, 103 bp, Artificial Sequence
  Synthetic Polynucleotide
taatacgactcactataggggctgttcctcttggccttctgttccctgagaacagaggagactcaggatgcagaaggccaacctggcggcagcgcaaaagatg

SEQ ID NO: 204471 - DNA, 103 bp, Artificial Sequence
  Synthetic Polynucleotide
taatacgactcactataggggtacccactggctgttcctcttggccttctaacagaggagaagaaggatgagaggaacaaacctggcggcagcgcaaaagatg

SEQ ID NO: 204472 - DNA, 103 bp, Artificial Sequence
  Synthetic Polynucleotide
taatacgactcactatagggggcagggtgggtacccactggctgttcctcaacagaggagagaggaaatgccagtgggtaacctggcggcagcgcaaaagatg

SEQ ID NO: 204473 - DNA, 103 bp, Artificial Sequence
  Synthetic Polynucleotide
taatacgactcactatagggggagctgttgggcagggtgggtacccactgaacagaggagacagtggatgcccaccctgaacctggcggcagcgcaaaagatg

SEQ ID NO: 204474 - DNA, 103 bp, Artificial Sequence
  Synthetic Polynucleotide
taatacgactcactatagggctaagtggtgggagctgttgggcagggtggaacagaggagaccacccatgccaacagctaacctggcggcagcgcaaaagatg

SEQ ID NO: 204475 - DNA, 103 bp, Artificial Sequence
  Synthetic Polynucleotide
taatacgactcactatagggggcacggcatctaagtggtgggagctgttgaacagaggagacaacagatgccaccacttaacctggcggcagcgcaaaagatg

SEQ ID NO: 204476 - DNA, 103 bp, Artificial Sequence
  Synthetic Polynucleotide
taatacgactcactatagggctccagctggaacttcacgggcttctgcccaacagaggagagggcagatgcccgtgaagaacctggcggcagcgcaaaagatg

SEQ ID NO: 204477 - DNA, 103 bp, Artificial Sequence
  Synthetic Polynucleotide
taatacgactcactatagggtgtggagcatggcacggcatctaagtggtgaacagaggagacaccacatggatgccgtgaacctggcggcagcgcaaaagatg

SEQ ID NO: 204478 - DNA, 103 bp, Artificial Sequence
  Synthetic Polynucleotide
taatacgactcactatagggtgttgatggttgtggagcatggcacggcataacagaggagaatgccgatgcatgctccaaacctggcggcagcgcaaaagatg

SEQ ID NO: 204479 - DNA, 103 bp, Artificial Sequence
  Synthetic Polynucleotide
taatacgactcactatagggatgcggttcctgttgatggttgtggagcataacagaggagaatgctcatgaaccatcaaaacctggcggcagcgcaaaagatg

SEQ ID NO: 204480 - DNA, 103 bp, Artificial Sequence
  Synthetic Polynucleotide
taatacgactcactataggggtctcggcccatgcggttcctgttgatggtaacagaggagaaccatcatgaggaaccgcaacctggcggcagcgcaaaagatg

SEQ ID NO: 204481 - DNA, 103 bp, Artificial Sequence
  Synthetic Polynucleotide
taatacgactcactatagggttctcttcttgtctcggcccatgcggttccaacagaggagaggaaccatgtgggccgagaacctggcggcagcgcaaaagatg

SEQ ID NO: 204482 - DNA, 103 bp, Artificial Sequence
  Synthetic Polynucleotide
taatacgactcactatagggagggggaaggttctcttcttgtctcggcccaacagaggagagggccgatgcaagaagagaacctggcggcagcgcaaaagatg

SEQ ID NO: 204483 - DNA, 103 bp, Artificial Sequence
  Synthetic Polynucleotide
taatacgactcactatagggatcaaagcaaagggggaaggttctcttcttaacagaggagaaagaagatgaccttccccaacctggcggcagcgcaaaagatg

SEQ ID NO: 204484 - DNA, 103 bp, Artificial Sequence
  Synthetic Polynucleotide
taatacgactcactatagggggtcatggtcatcaaagcaaagggggaaggaacagaggagaccttccatgtttgctttgaacctggcggcagcgcaaaagatg

SEQ ID NO: 204485 - DNA, 103 bp, Artificial Sequence
  Synthetic Polynucleotide
taatacgactcactatagggatcacagctgggtcatggtcatcaaagcaaaacagaggagattgcttatgtgaccatgaaacctggcggcagcgcaaaagatg

SEQ ID NO: 204486 - DNA, 103 bp, Artificial Sequence
  Synthetic Polynucleotide
taatacgactcactataggggttctcatggatcacagctgggtcatggtcaacagaggagagaccatatgccagctgtgaacctggcggcagcgcaaaagatg

SEQ ID NO: 204487 - DNA, 103 bp, Artificial Sequence
  Synthetic Polynucleotide
taatacgactcactatagggcgccgtcgtcctccagctggaacttcacggaacagaggagaccgtgaatgtccagctggaacctggcggcagcgcaaaagatg

SEQ ID NO: 204488 - DNA, 103 bp, Artificial Sequence
  Synthetic Polynucleotide
taatacgactcactataggggctgagatgcgttctcatggatcacagctgaacagaggagacagctgatgtccatgagaaacctggcggcagcgcaaaagatg

SEQ ID NO: 204489 - DNA, 103 bp, Artificial Sequence
  Synthetic Polynucleotide
taatacgactcactatagggagcacctcgggctgagatgcgttctcatggaacagaggagaccatgaatgcgcatctcaaacctggcggcagcgcaaaagatg

SEQ ID NO: 204490 - DNA, 103 bp, Artificial Sequence
  Synthetic Polynucleotide
taatacgactcactataggggatggggaccagcacctcgggctgagatgcaacagaggagagcatctatgcccgaggtgaacctggcggcagcgcaaaagatg

SEQ ID NO: 204491 - DNA, 103 bp, Artificial Sequence
  Synthetic Polynucleotide
taatacgactcactatagggtgtccagccggatggggaccagcacctcggaacagaggagaccgaggatgtggtccccaaacctggcggcagcgcaaaagatg

SEQ ID NO: 204492 - DNA, 103 bp, Artificial Sequence
  Synthetic Polynucleotide
taatacgactcactatagggtcgatctccatgtccagccggatggggaccaacagaggagaggtcccatgccggctggaaacctggcggcagcgcaaaagatg

SEQ ID NO: 204493 - DNA, 103 bp, Artificial Sequence
  Synthetic Polynucleotide
taatacgactcactatagggcttctgcccatcgatctccatgtccagccgaacagaggagacggctgatgatggagatcaacctggcggcagcgcaaaagatg

SEQ ID NO: 204494 - DNA, 103 bp, Artificial Sequence
  Synthetic Polynucleotide
taatacgactcactatagggcgtctcgcagcttctgcccatcgatctccaaacagaggagatggagaatgatgggcagaaacctggcggcagcgcaaaagatg

SEQ ID NO: 204495 - DNA, 103 bp, Artificial Sequence
  Synthetic Polynucleotide
taatacgactcactatagggcaggtgaaggcgtctcgcagcttctgcccaaacagaggagatgggcaatggctgcgagaaacctggcggcagcgcaaaagatg

SEQ ID NO: 204496 - DNA, 103 bp, Artificial Sequence
  Synthetic Polynucleotide
taatacgactcactatagggattcatgttccaggtgaaggcgtctcgcagaacagaggagactgcgaatggccttcaccaacctggcggcagcgcaaaagatg

SEQ ID NO: 204497 - DNA, 103 bp, Artificial Sequence
  Synthetic Polynucleotide
taatacgactcactatagggtcaacttctcattcatgttccaggtgaaggaacagaggagaccttcaatgggaacatgaaacctggcggcagcgcaaaagatg

SEQ ID NO: 204498 - DNA, 103 bp, Artificial Sequence
  Synthetic Polynucleotide
taatacgactcactatagggatgtagaactcgccgtcgtcctccagctggaacagaggagaccagctatgggacgacggaacctggcggcagcgcaaaagatg

SEQ ID NO: 204499 - DNA, 103 bp, Artificial Sequence
  Synthetic Polynucleotide
taatacgactcactatagggtcaggcgtcatcaacttctcattcatgttcaacagaggagagaacatatgtgagaagttaacctggcggcagcgcaaaagatg

SEQ ID NO: 204500 - DNA, 103 bp, Artificial Sequence
  Synthetic Polynucleotide
taatacgactcactatagggtgaaaacatctcaggcgtcatcaacttctcaacagaggagagagaagatgatgacgcctaacctggcggcagcgcaaaagatg

SEQ ID NO: 204501 - DNA, 103 bp, Artificial Sequence
  Synthetic Polynucleotide
taatacgactcactatagggagaggatttctgaaaacatctcaggcgtcaaacagaggagatgacgcatgagatgttttaacctggcggcagcgcaaaagatg

SEQ ID NO: 204502 - DNA, 103 bp, Artificial Sequence
  Synthetic Polynucleotide
taatacgactcactatagggagatcgtcacagaggatttctgaaaacatcaacagaggagagatgttatgagaaatcctaacctggcggcagcgcaaaagatg

SEQ ID NO: 204503 - DNA, 103 bp, Artificial Sequence
  Synthetic Polynucleotide
taatacgactcactataggggttcaaatccagatcgtcacagaggatttcaacagaggagagaaatcatgtgtgacgataacctggcggcagcgcaaaagatg

SEQ ID NO: 204504 - DNA, 103 bp, Artificial Sequence
  Synthetic Polynucleotide
taatacgactcactatagggacgtcagcgggttcaaatccagatcgtcacaacagaggagagtgacgatgtggatttgaaacctggcggcagcgcaaaagatg

SEQ ID NO: 204505 - DNA, 103 bp, Artificial Sequence
  Synthetic Polynucleotide
taatacgactcactataggggctggcacaaacgtcagcgggttcaaatccaacagaggagaggatttatgcccgctgacaacctggcggcagcgcaaaagatg

SEQ ID NO: 204506 - DNA, 103 bp, Artificial Sequence
  Synthetic Polynucleotide
taatacgactcactatagggagaggcgatggctggcacaaacgtcagcggaacagaggagaccgctgatgtttgtgccaaacctggcggcagcgcaaaagatg

SEQ ID NO: 204507 - DNA, 103 bp, Artificial Sequence
  Synthetic Polynucleotide
taatacgactcactataggggtctgatggcagaggcgatggctggcacaaaacagaggagattgtgcatgccatcgcctaacctggcggcagcgcaaaagatg

SEQ ID NO: 204508 - DNA, 103 bp, Artificial Sequence
  Synthetic Polynucleotide
taatacgactcactatagggtcgatctgctgtctgatggcagaggcgatgaacagaggagacatcgcatgtgccatcagaacctggcggcagcgcaaaagatg

SEQ ID NO: 204509 - DNA, 103 bp, Artificial Sequence
  Synthetic Polynucleotide
taatacgactcactatagggggagccgatcatgtagaactcgccgtcgtcaacagaggagagacgacatggagttctacaacctggcggcagcgcaaaagatg

SEQ ID NO: 204510 - DNA, 103 bp, Artificial Sequence
  Synthetic Polynucleotide
taatacgactcactatagggggggtaggactcgatctgctgtctgatggcaacagaggagagccatcatgcagcagatcaacctggcggcagcgcaaaagatg

SEQ ID NO: 204511 - DNA, 103 bp, Artificial Sequence
  Synthetic Polynucleotide
taatacgactcactatagggtgctgtccgtggggtaggactcgatctgctaacagaggagaagcagaatgagtcctaccaacctggcggcagcgcaaaagatg

SEQ ID NO: 204512 - DNA, 103 bp, Artificial Sequence
  Synthetic Polynucleotide
taatacgactcactatagggtcctccaggatgctgtccgtggggtaggacaacagaggagagtcctaatgcacggacagaacctggcggcagcgcaaaagatg

SEQ ID NO: 204513 - DNA, 103 bp, Artificial Sequence
  Synthetic Polynucleotide
taatacgactcactataggggtctgactggtcctccaggatgctgtccgtaacagaggagaacggacatgatcctggagaacctggcggcagcgcaaaagatg

SEQ ID NO: 204514 - DNA, 103 bp, Artificial Sequence
  Synthetic Polynucleotide
taatacgactcactatagggtgacgcgctggtctgactggtcctccaggaaacagaggagatcctggatgaccagtcagaacctggcggcagcgcaaaagatg

SEQ ID NO: 204515 - DNA, 103 bp, Artificial Sequence
  Synthetic Polynucleotide
taatacgactcactatagggagcttgatgatgacgcgctggtctgactggaacagaggagaccagtcatgccagcgcgtaacctggcggcagcgcaaaagatg

SEQ ID NO: 204516 - DNA, 103 bp, Artificial Sequence
  Synthetic Polynucleotide
taatacgactcactatagggatggatgttcagcttgatgatgacgcgctgaacagaggagacagcgcatgatcatcaagaacctggcggcagcgcaaaagatg

SEQ ID NO: 204517 - DNA, 103 bp, Artificial Sequence
  Synthetic Polynucleotide
taatacgactcactatagggtgtttcccacatggatgttcagcttgatgaaacagaggagatcatcaatgtgaacatccaacctggcggcagcgcaaaagatg

SEQ ID NO: 204518 - DNA, 103 bp, Artificial Sequence
  Synthetic Polynucleotide
taatacgactcactatagggaccagggaaatgtttcccacatggatgttcaacagaggagagaacatatgtgtgggaaaaacctggcggcagcgcaaaagatg

SEQ ID NO: 204519 - DNA, 103 bp, Artificial Sequence
  Synthetic Polynucleotide
taatacgactcactatagggaaactggtccaccagggaaatgtttcccacaacagaggagagtgggaatgatttccctgaacctggcggcagcgcaaaagatg

SEQ ID NO: 204520 - DNA, 103 bp, Artificial Sequence
  Synthetic Polynucleotide
taatacgactcactatagggttcccacctcggagccgatcatgtagaactaacagaggagaagttctatgtgatcggctaacctggcggcagcgcaaaagatg

SEQ ID NO: 204521 - DNA, 103 bp, Artificial Sequence
  Synthetic Polynucleotide
taatacgactcactatagggtgtcccactcaaactggtccaccagggaaaaacagaggagatttcccatgtggaccagtaacctggcggcagcgcaaaagatg

SEQ ID NO: 204522 - DNA, 103 bp, Artificial Sequence
  Synthetic Polynucleotide
taatacgactcactatagggttctctgacatgtcccactcaaactggtccaacagaggagaggaccaatgtgagtgggaaacctggcggcagcgcaaaagatg

SEQ ID NO: 204523 - DNA, 103 bp, Artificial Sequence
  Synthetic Polynucleotide
taatacgactcactatagggtgagttctccttctctgacatgtcccactcaacagaggagagagtggatgatgtcagagaacctggcggcagcgcaaaagatg

SEQ ID NO: 204524 - DNA, 103 bp, Artificial Sequence
  Synthetic Polynucleotide
taatacgactcactatagggacttctctggtgagttctccttctctgacaaacagaggagatgtcagatgaggagaactaacctggcggcagcgcaaaagatg

SEQ ID NO: 204525 - DNA, 103 bp, Artificial Sequence
  Synthetic Polynucleotide
taatacgactcactatagggttcagggcaaacttctctggtgagttctccaacagaggagaggagaaatgaccagagaaaacctggcggcagcgcaaaagatg

SEQ ID NO: 204526 - DNA, 103 bp, Artificial Sequence
  Synthetic Polynucleotide
taatacgactcactatagggcgagcacagcttcagggcaaacttctctggaacagaggagaccagagatgtttgccctgaacctggcggcagcgcaaaagatg

SEQ ID NO: 204527 - DNA, 103 bp, Artificial Sequence
  Synthetic Polynucleotide
taatacgactcactatagggaccccagctccgagcacagcttcagggcaaaacagaggagattgcccatgagctgtgctaacctggcggcagcgcaaaagatg

SEQ ID NO: 204528 - DNA, 103 bp, Artificial Sequence
  Synthetic Polynucleotide
taatacgactcactatagggtccccgcccaaccccagctccgagcacagcaacagaggagagctgtgatgggagctgggaacctggcggcagcgcaaaagatg

SEQ ID NO: 204529 - DNA, 103 bp, Artificial Sequence
  Synthetic Polynucleotide
taatacgactcactatagggggtgacaaactccccgcccaaccccagctcaacagaggagagagctgatgttgggcgggaacctggcggcagcgcaaaagatg

SEQ ID NO: 204530 - DNA, 103 bp, Artificial Sequence
  Synthetic Polynucleotide
taatacgactcactatagggatgcgatggtggtgacaaactccccgcccaaacagaggagatgggcgatgagtttgtcaaacctggcggcagcgcaaaagatg

SEQ ID NO: 204531 - DNA, 103 bp, Artificial Sequence
  Synthetic Polynucleotide
taatacgactcactatagggcggaggtagtttcccacctcggagccgatcaacagaggagagatcggatgcgaggtgggaacctggcggcagcgcaaaagatg

SEQ ID NO: 204532 - DNA, 103 bp, Artificial Sequence
  Synthetic Polynucleotide
taatacgactcactatagggcggatgctgtatgcgatggtggtgacaaacaacagaggagagtttgtatgcaccatcgcaacctggcggcagcgcaaaagatg

SEQ ID NO: 204533 - DNA, 103 bp, Artificial Sequence
  Synthetic Polynucleotide
taatacgactcactatagggcagctgtccccggatgctgtatgcgatggtaacagaggagaaccatcatgtacagcatcaacctggcggcagcgcaaaagatg

SEQ ID NO: 204534 - DNA, 103 bp, Artificial Sequence
  Synthetic Polynucleotide
taatacgactcactataggggatgccagctcagctgtccccggatgctgtaacagaggagaacagcaatgggggacagcaacctggcggcagcgcaaaagatg

SEQ ID NO: 204535 - DNA, 103 bp, Artificial Sequence
  Synthetic Polynucleotide
taatacgactcactatagggtaggtcttctgatgccagctcagctgtcccaacagaggagagggacaatggagctggcaaacctggcggcagcgcaaaagatg

SEQ ID NO: 204536 - DNA, 103 bp, Artificial Sequence
  Synthetic Polynucleotide
taatacgactcactataggggctgaaggcgtaggtcttctgatgccagctaacagaggagaagctggatgcagaagaccaacctggcggcagcgcaaaagatg

SEQ ID NO: 204537 - DNA, 103 bp, Artificial Sequence
  Synthetic Polynucleotide
taatacgactcactataggggagggttctcgctgaaggcgtaggtcttctaacagaggagaagaagaatgacgccttcaaacctggcggcagcgcaaaagatg

SEQ ID NO: 204538 - DNA, 103 bp, Artificial Sequence
  Synthetic Polynucleotide
taatacgactcactatagggactgtgggcagagggttctcgctgaaggcgaacagaggagacgccttatgcgagaacccaacctggcggcagcgcaaaagatg

SEQ ID NO: 204539 - DNA, 103 bp, Artificial Sequence
  Synthetic Polynucleotide
taatacgactcactatagggggcaatctccactgtgggcagagggttctcaacagaggagagagaacatgctgcccacaaacctggcggcagcgcaaaagatg

SEQ ID NO: 204540 - DNA, 103 bp, Artificial Sequence
  Synthetic Polynucleotide
taatacgactcactatagggtgttccggatggcaatctccactgtgggcaaacagaggagatgcccaatgtggagattgaacctggcggcagcgcaaaagatg

SEQ ID NO: 204541 - DNA, 103 bp, Artificial Sequence
  Synthetic Polynucleotide
taatacgactcactataggggcatcgcccgtgttccggatggcaatctccaacagaggagaggagatatgcatccggaaaacctggcggcagcgcaaaagatg

SEQ ID NO: 204542 - DNA, 103 bp, Artificial Sequence
  Synthetic Polynucleotide
taatacgactcactatagggcggcccgccgccgcccgccgctgcggccataacagaggagaatggccatggcggcgggcaacctggcggcagcgcaaaagatg

SEQ ID NO: 204543 - DNA, 103 bp, Artificial Sequence
  Synthetic Polynucleotide
taatacgactcactatagggggtggccgggcccccatccttccgtcgataaacagaggagatatcgaatgaaggatgggaacctggcggcagcgcaaaagatg

SEQ ID NO: 204544 - DNA, 103 bp, Artificial Sequence
  Synthetic Polynucleotide
taatacgactcactatagggccgtgattctgttggtgtcggagggggaggaacagaggagacctcccatgccgacaccaaacctggcggcagcgcaaaagatg

SEQ ID NO: 204545 - DNA, 103 bp, Artificial Sequence
  Synthetic Polynucleotide
taatacgactcactatagggcactcttcttccgtgattctgttggtgtcgaacagaggagacgacacatgcagaatcacaacctggcggcagcgcaaaagatg

SEQ ID NO: 204546 - DNA, 103 bp, Artificial Sequence
  Synthetic Polynucleotide
taatacgactcactatagggcctttcttcccactcttcttccgtgattctaacagaggagaagaatcatggaagaagagaacctggcggcagcgcaaaagatg

SEQ ID NO: 204547 - DNA, 103 bp, Artificial Sequence
  Synthetic Polynucleotide
taatacgactcactataggggctagcttggcctttcttcccactcttcttaacagaggagaaagaagatggggaagaaaaacctggcggcagcgcaaaagatg

SEQ ID NO: 204548 - DNA, 103 bp, Artificial Sequence
  Synthetic Polynucleotide
taatacgactcactatagggtcccataaaggctagcttggcctttcttccaacagaggagaggaagaatggccaagctaaacctggcggcagcgcaaaagatg

SEQ ID NO: 204549 - DNA, 103 bp, Artificial Sequence
  Synthetic Polynucleotide
taatacgactcactatagggcttctgcgcttcccataaaggctagcttggaacagaggagaccaagcatgcctttatggaacctggcggcagcgcaaaagatg

SEQ ID NO: 204550 - DNA, 103 bp, Artificial Sequence
  Synthetic Polynucleotide
taatacgactcactatagggctctttctgacttctgcgcttcccataaagaacagaggagactttatatgaagcgcagaaacctggcggcagcgcaaaagatg

SEQ ID NO: 204551 - DNA, 103 bp, Artificial Sequence
  Synthetic Polynucleotide
taatacgactcactataggggctcatcttcctctttctgacttctgcgctaacagaggagaagcgcaatggtcagaaagaacctggcggcagcgcaaaagatg

SEQ ID NO: 204552 - DNA, 103 bp, Artificial Sequence
  Synthetic Polynucleotide
taatacgactcactatagggagatcttcttgctcatcttcctctttctgaaacagaggagatcagaaatgggaagatgaaacctggcggcagcgcaaaagatg

SEQ ID NO: 204553 - DNA, 103 bp, Artificial Sequence
  Synthetic Polynucleotide
taatacgactcactatagggatccttggttagatcttcttgctcatcttcaacagaggagagaagatatgcaagaagataacctggcggcagcgcaaaagatg

SEQ ID NO: 204554 - DNA, 103 bp, Artificial Sequence
  Synthetic Polynucleotide
taatacgactcactatagggcccaaaacttggtggccgggcccccatcctaacagaggagaaggatgatggcccggccaaacctggcggcagcgcaaaagatg

SEQ ID NO: 204555 - DNA, 103 bp, Artificial Sequence
  Synthetic Polynucleotide
taatacgactcactatagggggtcttccatatccttggttagatcttcttaacagaggagaaagaagatgtaaccaaggaacctggcggcagcgcaaaagatg

SEQ ID NO: 204556 - DNA, 103 bp, Artificial Sequence
  Synthetic Polynucleotide
taatacgactcactatagggacaggtgttgggtcttccatatccttggttaacagaggagaaaccaaatgtatggaagaaacctggcggcagcgcaaaagatg

SEQ ID NO: 204557 - DNA, 103 bp, Artificial Sequence
  Synthetic Polynucleotide
taatacgactcactatagggtatattgggtacaggtgttgggtcttccataacagaggagaatggaaatgccaacacctaacctggcggcagcgcaaaagatg

SEQ ID NO: 204558 - DNA, 103 bp, Artificial Sequence
  Synthetic Polynucleotide
taatacgactcactatagggctacttcttctatattgggtacaggtgttgaacagaggagacaacacatgtacccaataaacctggcggcagcgcaaaagatg

SEQ ID NO: 204559 - DNA, 103 bp, Artificial Sequence
  Synthetic Polynucleotide
taatacgactcactatagggttgggaagtactacttcttctatattgggtaacagaggagaacccaaatgagaagaagtaacctggcggcagcgcaaaagatg

SEQ ID NO: 204560 - DNA, 103 bp, Artificial Sequence
  Synthetic Polynucleotide
taatacgactcactataggggttcacatttttgggaagtactacttcttcaacagaggagagaagaaatggtacttcccaacctggcggcagcgcaaaagatg

SEQ ID NO: 204561 - DNA, 103 bp, Artificial Sequence
  Synthetic Polynucleotide
taatacgactcactatagggctttctttaggttcacatttttgggaagtaaacagaggagatacttcatgaaaatgtgaaacctggcggcagcgcaaaagatg

SEQ ID NO: 204562 - DNA, 103 bp, Artificial Sequence
  Synthetic Polynucleotide
taatacgactcactatagggttttcactatctttctttaggttcacatttaacagaggagaaaatgtatgcctaaagaaaacctggcggcagcgcaaaagatg

SEQ ID NO: 204563 - DNA, 103 bp, Artificial Sequence
  Synthetic Polynucleotide
taatacgactcactatagggaacaggtgtattttcactatctttctttagaacagaggagactaaagatggatagtgaaaacctggcggcagcgcaaaagatg

SEQ ID NO: 204564 - DNA, 103 bp, Artificial Sequence
  Synthetic Polynucleotide
taatacgactcactatagggttcctcctttaacaggtgtattttcactataacagaggagaatagtgatgatacacctgaacctggcggcagcgcaaaagatg

SEQ ID NO: 204565 - DNA, 103 bp, Artificial Sequence
  Synthetic Polynucleotide
taatacgactcactatagggtccgggctctcccaaaacttggtggccgggaacagaggagacccggcatgcaagttttgaacctggcggcagcgcaaaagatg

SEQ ID NO: 204566 - DNA, 103 bp, Artificial Sequence
  Synthetic Polynucleotide
taatacgactcactatagggtccgctacagttcctcctttaacaggtgtaaacagaggagatacaccatgtaaaggaggaacctggcggcagcgcaaaagatg

SEQ ID NO: 204567 - DNA, 103 bp, Artificial Sequence
  Synthetic Polynucleotide
taatacgactcactatagggctcatctagatccgctacagttcctcctttaacagaggagaaaaggaatgactgtagcgaacctggcggcagcgcaaaagatg

SEQ ID NO: 204568 - DNA, 103 bp, Artificial Sequence
  Synthetic Polynucleotide
taatacgactcactatagggcttcatcctgctcatctagatccgctacagaacagaggagactgtagatgatctagatgaacctggcggcagcgcaaaagatg

SEQ ID NO: 204569 - DNA, 103 bp, Artificial Sequence
  Synthetic Polynucleotide
taatacgactcactataggggtgactgtttcttcatcctgctcatctagaaacagaggagatctagaatggcaggatgaaacctggcggcagcgcaaaagatg

SEQ ID NO: 204570 - DNA, 103 bp, Artificial Sequence
  Synthetic Polynucleotide
taatacgactcactatagggtcctcctgctgtgactgtttcttcatcctgaacagaggagacaggatatggaaacagtcaacctggcggcagcgcaaaagatg

SEQ ID NO: 204571 - DNA, 103 bp, Artificial Sequence
  Synthetic Polynucleotide
taatacgactcactatagggcatcttcctttcctcctgctgtgactgtttaacagaggagaaaacagatgcagcaggagaacctggcggcagcgcaaaagatg

SEQ ID NO: 204572 - DNA, 103 bp, Artificial Sequence
  Synthetic Polynucleotide
taatacgactcactataggggcaggatcttcatcttcctttcctcctgctaacagaggagaagcaggatgaaaggaagaaacctggcggcagcgcaaaagatg

SEQ ID NO: 204573 - DNA, 103 bp, Artificial Sequence
  Synthetic Polynucleotide
taatacgactcactatagggatcacctttggcaggatcttcatcttccttaacagaggagaaaggaaatggaagatcctaacctggcggcagcgcaaaagatg

SEQ ID NO: 204574 - DNA, 103 bp, Artificial Sequence
  Synthetic Polynucleotide
taatacgactcactatagggatcgactctgatcacctttggcaggatcttaacagaggagaaagatcatgccaaaggtgaacctggcggcagcgcaaaagatg

SEQ ID NO: 204575 - DNA, 103 bp, Artificial Sequence
  Synthetic Polynucleotide
taatacgactcactatagggaggtcaactgatcgactctgatcacctttgaacagaggagacaaaggatgtcagagtcgaacctggcggcagcgcaaaagatg

SEQ ID NO: 204576 - DNA, 103 bp, Artificial Sequence
  Synthetic Polynucleotide
taatacgactcactatagggggacaccgtctccgggctctcccaaaacttaacagaggagaaagtttatggagagcccgaacctggcggcagcgcaaaagatg

SEQ ID NO: 204577 - DNA, 103 bp, Artificial Sequence
  Synthetic Polynucleotide
taatacgactcactatagggatcttccccaaggtcaactgatcgactctgaacagaggagacagagtatgtcagttgacaacctggcggcagcgcaaaagatg

SEQ ID NO: 204578 - DNA, 103 bp, Artificial Sequence
  Synthetic Polynucleotide
taatacgactcactatagggctgtcacattatcttccccaaggtcaactgaacagaggagacagttgatgttggggaagaacctggcggcagcgcaaaagatg

SEQ ID NO: 204579 - DNA, 103 bp, Artificial Sequence
  Synthetic Polynucleotide
taatacgactcactatagggttggtctgctctgtcacattatcttccccaaacagaggagatggggaatgtaatgtgacaacctggcggcagcgcaaaagatg

SEQ ID NO: 204580 - DNA, 103 bp, Artificial Sequence
  Synthetic Polynucleotide
taatacgactcactatagggaataatgtgattggtctgctctgtcacattaacagaggagaaatgtgatggagcagaccaacctggcggcagcgcaaaagatg

SEQ ID NO: 204581 - DNA, 103 bp, Artificial Sequence
  Synthetic Polynucleotide
taatacgactcactatagggaactaggaataataatgtgattggtctgctaacagaggagaagcagaatgatcacattaaacctggcggcagcgcaaaagatg

SEQ ID NO: 204582 - DNA, 103 bp, Artificial Sequence
  Synthetic Polynucleotide
taatacgactcactatagggcatgatgcataactaggaataataatgtgaaacagaggagatcacatatgtattcctagaacctggcggcagcgcaaaagatg

SEQ ID NO: 204583 - DNA, 103 bp, Artificial Sequence
  Synthetic Polynucleotide
taatacgactcactatagggataatcaaaccatgatgcataactaggaataacagaggagaattcctatgtatgcatcaaacctggcggcagcgcaaaagatg

SEQ ID NO: 204584 - DNA, 103 bp, Artificial Sequence
  Synthetic Polynucleotide
taatacgactcactataggggaatacagttataatcaaaccatgatgcataacagaggagaatgcatatgggtttgattaacctggcggcagcgcaaaagatg

SEQ ID NO: 204585 - DNA, 103 bp, Artificial Sequence
  Synthetic Polynucleotide
taatacgactcactatagggtcaatcacatgaatacagttataatcaaacaacagaggagagtttgaatgtaactgtataacctggcggcagcgcaaaagatg

SEQ ID NO: 204586 - DNA, 103 bp, Artificial Sequence
  Synthetic Polynucleotide
taatacgactcactatagggagcacgccgttcaatcacatgaatacagttaacagaggagaaactgtatgcatgtgattaacctggcggcagcgcaaaagatg

SEQ ID NO: 204587 - DNA, 103 bp, Artificial Sequence
  Synthetic Polynucleotide
taatacgactcactatagggaatccagctgggacaccgtctccgggctctaacagaggagaagagccatgagacggtgtaacctggcggcagcgcaaaagatg

SEQ ID NO: 204588 - DNA, 103 bp, Artificial Sequence
  Synthetic Polynucleotide
taatacgactcactatagggactcaggaagagcacgccgttcaatcacataacagaggagaatgtgaatgaacggcgtgaacctggcggcagcgcaaaagatg

SEQ ID NO: 204589 - DNA, 103 bp, Artificial Sequence
  Synthetic Polynucleotide
taatacgactcactatagggccattgaagaactcaggaagagcacgccgtaacagaggagaacggcgatgtcttcctgaaacctggcggcagcgcaaaagatg

SEQ ID NO: 204590 - DNA, 103 bp, Artificial Sequence
  Synthetic Polynucleotide
taatacgactcactatagggtttgttttttccattgaagaactcaggaagaacagaggagacttcctatgttcttcaataacctggcggcagcgcaaaagatg

SEQ ID NO: 204591 - DNA, 103 bp, Artificial Sequence
  Synthetic Polynucleotide
taatacgactcactataggggagtcttggatttgttttttccattgaagaaacagaggagatcttcaatggaaaaaacaaacctggcggcagcgcaaaagatg

SEQ ID NO: 204592 - DNA, 103 bp, Artificial Sequence
  Synthetic Polynucleotide
taatacgactcactatagggtatatttctggagtcttggatttgttttttaacagaggagaaaaaaaatgatccaagacaacctggcggcagcgcaaaagatg

SEQ ID NO: 204593 - DNA, 103 bp, Artificial Sequence
  Synthetic Polynucleotide
taatacgactcactatagggatatgccaagtatatttctggagtcttggaaacagaggagatccaagatgccagaaataaacctggcggcagcgcaaaagatg

SEQ ID NO: 204594 - DNA, 103 bp, Artificial Sequence
  Synthetic Polynucleotide
taatacgactcactatagggtaaaatttcgatatgccaagtatatttctgaacagaggagacagaaaatgacttggcataacctggcggcagcgcaaaagatg

SEQ ID NO: 204595 - DNA, 103 bp, Artificial Sequence
  Synthetic Polynucleotide
taatacgactcactataggggtgtcaatcataaaatttcgatatgccaagaacagaggagacttggcatgtcgaaatttaacctggcggcagcgcaaaagatg

SEQ ID NO: 204596 - DNA, 103 bp, Artificial Sequence
  Synthetic Polynucleotide
taatacgactcactatagggtagacgatacgtgtcaatcataaaatttcgaacagaggagacgaaatatgatgattgacaacctggcggcagcgcaaaagatg

SEQ ID NO: 204597 - DNA, 103 bp, Artificial Sequence
  Synthetic Polynucleotide
taatacgactcactatagggcttgggggtttagacgatacgtgtcaatcaaacagaggagatgattgatgcgtatcgtcaacctggcggcagcgcaaaagatg

SEQ ID NO: 204598 - DNA, 103 bp, Artificial Sequence
  Synthetic Polynucleotide
taatacgactcactatagggacccgcaccgaatccagctgggacaccgtcaacagaggagagacggtatgccagctggaaacctggcggcagcgcaaaagatg

SEQ ID NO: 204599 - DNA, 103 bp, Artificial Sequence
  Synthetic Polynucleotide
taatacgactcactataggggttaaatactcttgggggtttagacgatacaacagaggagagtatcgatgaaacccccaaacctggcggcagcgcaaaagatg

SEQ ID NO: 204600 - DNA, 103 bp, Artificial Sequence
  Synthetic Polynucleotide
taatacgactcactatagggagcagtgctagttaaatactcttgggggttaacagaggagaaaccccatggagtatttaaacctggcggcagcgcaaaagatg

SEQ ID NO: 204601 - DNA, 103 bp, Artificial Sequence
  Synthetic Polynucleotide
taatacgactcactatagggtcctccgacaagcagtgctagttaaatactaacagaggagaagtattatgctagcactgaacctggcggcagcgcaaaagatg

SEQ ID NO: 204602 - DNA, 103 bp, Artificial Sequence
  Synthetic Polynucleotide
taatacgactcactatagggccagtcaagttcctccgacaagcagtgctaaacagaggagatagcacatgttgtcggagaacctggcggcagcgcaaaagatg

SEQ ID NO: 204603 - DNA, 103 bp, Artificial Sequence
  Synthetic Polynucleotide
taatacgactcactatagggacacacatctccagtcaagttcctccgacaaacagaggagatgtcggatgaacttgactaacctggcggcagcgcaaaagatg

SEQ ID NO: 204604 - DNA, 103 bp, Artificial Sequence
  Synthetic Polynucleotide
taatacgactcactatagggtcatcacagcacacacatctccagtcaagtaacagaggagaacttgaatggagatgtgtaacctggcggcagcgcaaaagatg

SEQ ID NO: 204605 - DNA, 103 bp, Artificial Sequence
  Synthetic Polynucleotide
taatacgactcactataggggcatggaccctcatcacagcacacacatctaacagaggagaagatgtatgtgctgtgataacctggcggcagcgcaaaagatg

SEQ ID NO: 204606 - DNA, 103 bp, Artificial Sequence
  Synthetic Polynucleotide
taatacgactcactatagggctctaaaaaggcatggaccctcatcacagcaacagaggagagctgtgatgagggtccataacctggcggcagcgcaaaagatg

SEQ ID NO: 204607 - DNA, 103 bp, Artificial Sequence
  Synthetic Polynucleotide
taatacgactcactataggggtccccactgctctaaaaaggcatggacccaacagaggagagggtccatgcctttttagaacctggcggcagcgcaaaagatg

SEQ ID NO: 204608 - DNA, 103 bp, Artificial Sequence
  Synthetic Polynucleotide
taatacgactcactatagggtaattaacgagtccccactgctctaaaaagaacagaggagactttttatggcagtggggaacctggcggcagcgcaaaagatg

SEQ ID NO: 204609 - DNA, 103 bp, Artificial Sequence
  Synthetic Polynucleotide
taatacgactcactataggggcccagccagacccgcaccgaatccagctgaacagaggagacagctgatgtcggtgcggaacctggcggcagcgcaaaagatg

SEQ ID NO: 204610 - DNA, 103 bp, Artificial Sequence
  Synthetic Polynucleotide
taatacgactcactataggggtcaacttggtaattaacgagtccccactgaacagaggagacagtggatgctcgttaataacctggcggcagcgcaaaagatg

SEQ ID NO: 204611 - DNA, 103 bp, Artificial Sequence
  Synthetic Polynucleotide
taatacgactcactatagggtactttccgggtcaacttggtaattaacgaaacagaggagatcgttaatgaccaagttgaacctggcggcagcgcaaaagatg

SEQ ID NO: 204612 - DNA, 103 bp, Artificial Sequence
  Synthetic Polynucleotide
taatacgactcactataggggccatgggtctactttccgggtcaacttggaacagaggagaccaagtatgcccggaaagaacctggcggcagcgcaaaagatg

SEQ ID NO: 204613 - DNA, 103 bp, Artificial Sequence
  Synthetic Polynucleotide
taatacgactcactatagggaggtcccattgccatgggtctactttccggaacagaggagaccggaaatgagacccatgaacctggcggcagcgcaaaagatg

SEQ ID NO: 204614 - DNA, 103 bp, Artificial Sequence
  Synthetic Polynucleotide
taatacgactcactataggggagtaggaggaggtcccattgccatgggtcaacagaggagagacccaatgcaatgggacaacctggcggcagcgcaaaagatg

SEQ ID NO: 204615 - DNA, 103 bp, Artificial Sequence
  Synthetic Polynucleotide
taatacgactcactatagggttaaaatgaggagtaggaggaggtcccattaacagaggagaaatgggatgtcctcctacaacctggcggcagcgcaaaagatg

SEQ ID NO: 204616 - DNA, 103 bp, Artificial Sequence
  Synthetic Polynucleotide
taatacgactcactatagggagctaatacattaaaatgaggagtaggaggaacagaggagacctcctatgcctcattttaacctggcggcagcgcaaaagatg

SEQ ID NO: 204617 - DNA, 103 bp, Artificial Sequence
  Synthetic Polynucleotide
taatacgactcactatagggagggggtatcagctaatacattaaaatgagaacagaggagactcattatgatgtattagaacctggcggcagcgcaaaagatg

SEQ ID NO: 204618 - DNA, 103 bp, Artificial Sequence
  Synthetic Polynucleotide
taatacgactcactatagggacaagcccagagggggtatcagctaatacaaacagaggagatgtattatgtgataccccaacctggcggcagcgcaaaagatg

SEQ ID NO: 204619 - DNA, 103 bp, Artificial Sequence
  Synthetic Polynucleotide
taatacgactcactatagggatgcagaggcacaagcccagagggggtatcaacagaggagagataccatgtctgggcttaacctggcggcagcgcaaaagatg

SEQ ID NO: 204620 - DNA, 103 bp, Artificial Sequence
  Synthetic Polynucleotide
taatacgactcactatagggtgtagtgcttgcccagccagacccgcaccgaacagaggagacggtgcatgtctggctggaacctggcggcagcgcaaaagatg

SEQ ID NO: 204621 - DNA, 103 bp, Artificial Sequence
  Synthetic Polynucleotide
taatacgactcactataggggtgatcgaagatgcagaggcacaagcccagaacagaggagactgggcatgtgcctctgcaacctggcggcagcgcaaaagatg

SEQ ID NO: 204622 - DNA, 103 bp, Artificial Sequence
  Synthetic Polynucleotide
taatacgactcactatagggggaacctgaggtgatcgaagatgcagaggcaacagaggagagcctctatgtcttcgatcaacctggcggcagcgcaaaagatg

SEQ ID NO: 204623 - DNA, 103 bp, Artificial Sequence
  Synthetic Polynucleotide
taatacgactcactatagggttgagcagcaggaacctgaggtgatcgaagaacagaggagacttcgaatgcctcaggttaacctggcggcagcgcaaaagatg

SEQ ID NO: 204624 - DNA, 103 bp, Artificial Sequence
  Synthetic Polynucleotide
taatacgactcactatagggttagcatctgttgagcagcaggaacctgagaacagaggagactcaggatgctgctgctcaacctggcggcagcgcaaaagatg

SEQ ID NO: 204625 - DNA, 103 bp, Artificial Sequence
  Synthetic Polynucleotide
taatacgactcactatagggtcaggaaaatttagcatctgttgagcagcaaacagaggagatgctgcatgacagatgctaacctggcggcagcgcaaaagatg

SEQ ID NO: 204626 - DNA, 103 bp, Artificial Sequence
  Synthetic Polynucleotide
taatacgactcactatagggcttgtttttctcaggaaaatttagcatctgaacagaggagacagatgatgaattttcctaacctggcggcagcgcaaaagatg

SEQ ID NO: 204627 - DNA, 103 bp, Artificial Sequence
  Synthetic Polynucleotide
taatacgactcactatagggctggtttttccttgtttttctcaggaaaataacagaggagaattttcatgagaaaaacaaacctggcggcagcgcaaaagatg

SEQ ID NO: 204628 - DNA, 103 bp, Artificial Sequence
  Synthetic Polynucleotide
taatacgactcactatagggtgcaaatcaactggtttttccttgtttttcaacagaggagagaaaaaatgggaaaaaccaacctggcggcagcgcaaaagatg

SEQ ID NO: 204629 - DNA, 103 bp, Artificial Sequence
  Synthetic Polynucleotide
taatacgactcactatagggaccaaagttctgcaaatcaactggtttttcaacagaggagagaaaaaatggttgatttgaacctggcggcagcgcaaaagatg

SEQ ID NO: 204630 - DNA, 103 bp, Artificial Sequence
  Synthetic Polynucleotide
taatacgactcactatagggcagtacggagaccaaagttctgcaaatcaaaacagaggagattgattatgagaactttgaacctggcggcagcgcaaaagatg

SEQ ID NO: 204631 - DNA, 103 bp, Artificial Sequence
  Synthetic Polynucleotide
taatacgactcactatagggacatacttcttgtagtgcttgcccagccagaacagaggagactggctatgcaagcactaaacctggcggcagcgcaaaagatg

SEQ ID NO: 204632 - DNA, 103 bp, Artificial Sequence
  Synthetic Polynucleotide
taatacgactcactataggggagtaaatgtcagtacggagaccaaagttcaacagaggagagaacttatgtctccgtacaacctggcggcagcgcaaaagatg

SEQ ID NO: 204633 - DNA, 103 bp, Artificial Sequence
  Synthetic Polynucleotide
taatacgactcactatagggtgttttcttggagtaaatgtcagtacggagaacagaggagactccgtatggacatttacaacctggcggcagcgcaaaagatg

SEQ ID NO: 204634 - DNA, 103 bp, Artificial Sequence
  Synthetic Polynucleotide
taatacgactcactatagggtctttgctaatgttttcttggagtaaatgtaacagaggagaacatttatgccaagaaaaaacctggcggcagcgcaaaagatg

SEQ ID NO: 204635 - DNA, 103 bp, Artificial Sequence
  Synthetic Polynucleotide
taatacgactcactataggggcacctttactctttgctaatgttttcttgaacagaggagacaagaaatgattagcaaaaacctggcggcagcgcaaaagatg

SEQ ID NO: 204636 - DNA, 103 bp, Artificial Sequence
  Synthetic Polynucleotide
taatacgactcactatagggtccagcactagcacctttactctttgctaaaacagaggagattagcaatgagtaaaggtaacctggcggcagcgcaaaagatg

SEQ ID NO: 204637 - DNA, 103 bp, Artificial Sequence
  Synthetic Polynucleotide
taatacgactcactatagggtccattctcttccagcactagcacctttacaacagaggagagtaaagatgctagtgctgaacctggcggcagcgcaaaagatg

SEQ ID NO: 204638 - DNA, 103 bp, Artificial Sequence
  Synthetic Polynucleotide
taatacgactcactatagggtcctgttcagtccattctcttccagcactaaacagaggagatagtgcatgaagagaatgaacctggcggcagcgcaaaagatg

SEQ ID NO: 204639 - DNA, 103 bp, Artificial Sequence
  Synthetic Polynucleotide
taatacgactcactatagggtagaagggtctcctgttcagtccattctctaacagaggagaagagaaatgactgaacagaacctggcggcagcgcaaaagatg

SEQ ID NO: 204640 - DNA, 103 bp, Artificial Sequence
  Synthetic Polynucleotide
taatacgactcactatagggcctccaggagtagaagggtctcctgttcagaacagaggagactgaacatgagacccttcaacctggcggcagcgcaaaagatg

SEQ ID NO: 204641 - DNA, 103 bp, Artificial Sequence
  Synthetic Polynucleotide
taatacgactcactatagggatctccagggcctccaggagtagaagggtcaacagaggagagaccctatgactcctggaaacctggcggcagcgcaaaagatg

SEQ ID NO: 204642 - DNA, 103 bp, Artificial Sequence
  Synthetic Polynucleotide
taatacgactcactatagggatccgcatgaacatacttcttgtagtgcttaacagaggagaaagcacatgaagaagtataacctggcggcagcgcaaaagatg

SEQ ID NO: 204643 - DNA, 103 bp, Artificial Sequence
  Synthetic Polynucleotide
taatacgactcactatagggatccttgtacatctccagggcctccaggagaacagaggagactcctgatggccctggagaacctggcggcagcgcaaaagatg

SEQ ID NO: 204644 - DNA, 103 bp, Artificial Sequence
  Synthetic Polynucleotide
taatacgactcactatagggtgttccaatcatccttgtacatctccagggaacagaggagaccctggatgtgtacaaggaacctggcggcagcgcaaaagatg

SEQ ID NO: 204645 - DNA, 103 bp, Artificial Sequence
  Synthetic Polynucleotide
taatacgactcactatagggtccgacactttgttccaatcatccttgtacaacagaggagagtacaaatgtgattggaaaacctggcggcagcgcaaaagatg

SEQ ID NO: 204646 - DNA, 103 bp, Artificial Sequence
  Synthetic Polynucleotide
taatacgactcactatagggtccaacatgttccgacactttgttccaatcaacagaggagagattggatgaaagtgtcgaacctggcggcagcgcaaaagatg

SEQ ID NO: 204647 - DNA, 103 bp, Artificial Sequence
  Synthetic Polynucleotide
taatacgactcactataggggagtacgacttccaacatgttccgacacttaacagaggagaaagtgtatgaacatgttgaacctggcggcagcgcaaaagatg

SEQ ID NO: 204648 - DNA, 103 bp, Artificial Sequence
  Synthetic Polynucleotide
taatacgactcactatagggcattcatcctgagtacgacttccaacatgtaacagaggagaacatgtatgaagtcgtacaacctggcggcagcgcaaaagatg

SEQ ID NO: 204649 - DNA, 103 bp, Artificial Sequence
  Synthetic Polynucleotide
taatacgactcactataggggtggaggatgcattcatcctgagtacgactaacagaggagaagtcgtatgcaggatgaaaacctggcggcagcgcaaaagatg

SEQ ID NO: 204650 - DNA, 103 bp, Artificial Sequence
  Synthetic Polynucleotide
taatacgactcactataggggtctcaaaaagtggaggatgcattcatcctaacagaggagaaggatgatggcatcctccaacctggcggcagcgcaaaagatg

SEQ ID NO: 204651 - DNA, 103 bp, Artificial Sequence
  Synthetic Polynucleotide
taatacgactcactatagggtcaatgggaagtctcaaaaagtggaggatgaacagaggagacatcctatgctttttgagaacctggcggcagcgcaaaagatg

SEQ ID NO: 204652 - DNA, 103 bp, Artificial Sequence
  Synthetic Polynucleotide
taatacgactcactataggggtatgggtcctcaatgggaagtctcaaaaaaacagaggagatttttgatgcttcccattaacctggcggcagcgcaaaagatg

SEQ ID NO: 204653 - DNA, 103 bp, Artificial Sequence
  Synthetic Polynucleotide
taatacgactcactatagggccgctgtccccggcccgccgccgcccgccgaacagaggagacggcggatggcggcgggcaacctggcggcagcgcaaaagatg

SEQ ID NO: 204654 - DNA, 103 bp, Artificial Sequence
  Synthetic Polynucleotide
taatacgactcactatagggtggtaggagcatccgcatgaacatacttctaacagaggagaagaagtatgttcatgcggaacctggcggcagcgcaaaagatg

SEQ ID NO: 204655 - DNA, 103 bp, Artificial Sequence
  Synthetic Polynucleotide
taatacgactcactatagggaattctcaaggtatgggtcctcaatgggaaaacagaggagattcccaatgaggacccataacctggcggcagcgcaaaagatg

SEQ ID NO: 204656 - DNA, 103 bp, Artificial Sequence
  Synthetic Polynucleotide
taatacgactcactataggggaagcatctgaattctcaaggtatgggtccaacagaggagaggacccatgccttgagaaaacctggcggcagcgcaaaagatg

SEQ ID NO: 204657 - DNA, 103 bp, Artificial Sequence
  Synthetic Polynucleotide
taatacgactcactatagggaggcccaagggaagcatctgaattctcaagaacagaggagacttgagatgtcagatgctaacctggcggcagcgcaaaagatg

SEQ ID NO: 204658 - DNA, 103 bp, Artificial Sequence
  Synthetic Polynucleotide
taatacgactcactatagggggtaggccaaaggcccaagggaagcatctgaacagaggagacagatgatgcccttgggcaacctggcggcagcgcaaaagatg

SEQ ID NO: 204659 - DNA, 103 bp, Artificial Sequence
  Synthetic Polynucleotide
taatacgactcactataggggggacaggctggtaggccaaaggcccaaggaacagaggagaccttggatgtttggcctaaacctggcggcagcgcaaaagatg

SEQ ID NO: 204660 - DNA, 103 bp, Artificial Sequence
  Synthetic Polynucleotide
taatacgactcactatagggctgactgaaggggacaggctggtaggccaaaacagaggagattggccatgcagcctgtcaacctggcggcagcgcaaaagatg

SEQ ID NO: 204661 - DNA, 103 bp, Artificial Sequence
  Synthetic Polynucleotide
taatacgactcactataggggatttcctgactgactgaaggggacaggctaacagaggagaagcctgatgccttcagtcaacctggcggcagcgcaaaagatg

SEQ ID NO: 204662 - DNA, 103 bp, Artificial Sequence
  Synthetic Polynucleotide
taatacgactcactatagggctcataactggatttcctgactgactgaagaacagaggagacttcagatggtcaggaaaaacctggcggcagcgcaaaagatg

SEQ ID NO: 204663 - DNA, 103 bp, Artificial Sequence
  Synthetic Polynucleotide
taatacgactcactatagggagcaacagtactcataactggatttcctgaaacagaggagatcaggaatgccagttatgaacctggcggcagcgcaaaagatg

SEQ ID NO: 204664 - DNA, 103 bp, Artificial Sequence
  Synthetic Polynucleotide
taatacgactcactatagggatgccaaaaaagcaacagtactcataactgaacagaggagacagttaatggtactgttgaacctggcggcagcgcaaaagatg

SEQ ID NO: 204665 - DNA, 103 bp, Artificial Sequence
  Synthetic Polynucleotide
taatacgactcactatagggagtgttttattggtaggagcatccgcatgaaacagaggagatcatgcatgtgctcctacaacctggcggcagcgcaaaagatg

SEQ ID NO: 204666 - DNA, 103 bp, Artificial Sequence
  Synthetic Polynucleotide
taatacgactcactatagggtccaccacagatgccaaaaaagcaacagtaaacagaggagatactgtatgttttttggcaacctggcggcagcgcaaaagatg

SEQ ID NO: 204667 - DNA, 103 bp, Artificial Sequence
  Synthetic Polynucleotide
taatacgactcactatagggcacgcgagggtccaccacagatgccaaaaaaacagaggagatttttgatgtctgtggtgaacctggcggcagcgcaaaagatg

SEQ ID NO: 204668 - DNA, 103 bp, Artificial Sequence
  Synthetic Polynucleotide
taatacgactcactatagggcagcagatgccacgcgagggtccaccacagaacagaggagactgtggatgaccctcgcgaacctggcggcagcgcaaaagatg

SEQ ID NO: 204669 - DNA, 103 bp, Artificial Sequence
  Synthetic Polynucleotide
taatacgactcactataggggcttttgctgcagcagatgccacgcgagggaacagaggagaccctcgatgggcatctgcaacctggcggcagcgcaaaagatg

SEQ ID NO: 204670 - DNA, 103 bp, Artificial Sequence
  Synthetic Polynucleotide
taatacgactcactatagggctccaaagccgcttttgctgcagcagatgcaacagaggagagcatctatggcagcaaaaaacctggcggcagcgcaaaagatg

SEQ ID NO: 204671 - DNA, 103 bp, Artificial Sequence
  Synthetic Polynucleotide
taatacgactcactataggggagaaaactcctccaaagccgcttttgctgaacagaggagacagcaaatgcggctttggaacctggcggcagcgcaaaagatg

SEQ ID NO: 204672 - DNA, 103 bp, Artificial Sequence
  Synthetic Polynucleotide
taatacgactcactatagggtcccggacccgagaaaactcctccaaagccaacagaggagaggctttatgggagttttcaacctggcggcagcgcaaaagatg

SEQ ID NO: 204673 - DNA, 103 bp, Artificial Sequence
  Synthetic Polynucleotide
taatacgactcactatagggtggtacctcctcccggacccgagaaaactcaacagaggagagagtttatgcgggtccggaacctggcggcagcgcaaaagatg

SEQ ID NO: 204674 - DNA, 103 bp, Artificial Sequence
  Synthetic Polynucleotide
taatacgactcactatagggccaattccagtggtacctcctcccggacccaacagaggagagggtccatgaggaggtacaacctggcggcagcgcaaaagatg

SEQ ID NO: 204675 - DNA, 103 bp, Artificial Sequence
  Synthetic Polynucleotide
taatacgactcactatagggtgagcttcaaccaattccagtggtacctccaacagaggagaggaggtatgactggaattaacctggcggcagcgcaaaagatg

SEQ ID NO: 204676 - DNA, 103 bp, Artificial Sequence
  Synthetic Polynucleotide
taatacgactcactatagggcagcccagccagtgttttattggtaggagcaacagaggagagctcctatgaataaaacaaacctggcggcagcgcaaaagatg

SEQ ID NO: 204677 - DNA, 103 bp, Artificial Sequence
  Synthetic Polynucleotide
taatacgactcactatagggtttcttgacatgagcttcaaccaattccagaacagaggagactggaaatggttgaagctaacctggcggcagcgcaaaagatg

SEQ ID NO: 204678 - DNA, 103 bp, Artificial Sequence
  Synthetic Polynucleotide
taatacgactcactatagggcttcttgtactttcttgacatgagcttcaaaacagaggagattgaagatgatgtcaagaaacctggcggcagcgcaaaagatg

SEQ ID NO: 204679 - DNA, 103 bp, Artificial Sequence
  Synthetic Polynucleotide
taatacgactcactataggggctcgtgctgcttcttgtactttcttgacaaacagaggagatgtcaaatgagtacaagaaacctggcggcagcgcaaaagatg

SEQ ID NO: 204680 - DNA, 103 bp, Artificial Sequence
  Synthetic Polynucleotide
taatacgactcactatagggtttcccagaggctcgtgctgcttcttgtacaacagaggagagtacaaatggcagcacgaaacctggcggcagcgcaaaagatg

SEQ ID NO: 204681 - DNA, 103 bp, Artificial Sequence
  Synthetic Polynucleotide
taatacgactcactatagggtgggatccactttcccagaggctcgtgctgaacagaggagacagcacatgcctctgggaaacctggcggcagcgcaaaagatg

SEQ ID NO: 204682 - DNA, 103 bp, Artificial Sequence
  Synthetic Polynucleotide
taatacgactcactatagggagaccgtaggtgggatccactttcccagagaacagaggagactctggatgagtggatccaacctggcggcagcgcaaaagatg

SEQ ID NO: 204683 - DNA, 103 bp, Artificial Sequence
  Synthetic Polynucleotide
taatacgactcactataggggctgctctccagaccgtaggtgggatccacaacagaggagagtggatatgacctacggtaacctggcggcagcgcaaaagatg

SEQ ID NO: 204684 - DNA, 103 bp, Artificial Sequence
  Synthetic Polynucleotide
taatacgactcactatagggctgcaatgcagctgctctccagaccgtaggaacagaggagacctacgatgtggagagcaaacctggcggcagcgcaaaagatg

SEQ ID NO: 204685 - DNA, 103 bp, Artificial Sequence
  Synthetic Polynucleotide
taatacgactcactatagggggccctgtgcctgcaatgcagctgctctccaacagaggagaggagagatgctgcattgcaacctggcggcagcgcaaaagatg

SEQ ID NO: 204686 - DNA, 103 bp, Artificial Sequence
  Synthetic Polynucleotide
taatacgactcactatagggtggctcatcgggccctgtgcctgcaatgcaaacagaggagatgcattatgggcacagggaacctggcggcagcgcaaaagatg

SEQ ID NO: 204687 - DNA, 103 bp, Artificial Sequence
  Synthetic Polynucleotide
taatacgactcactataggggctgcaccaccagcccagccagtgttttataacagaggagaataaaaatgtggctgggcaacctggcggcagcgcaaaagatg

SEQ ID NO: 204688 - DNA, 103 bp, Artificial Sequence
  Synthetic Polynucleotide
taatacgactcactatagggcaagcttctctggctcatcgggccctgtgcaacagaggagagcacagatgccgatgagcaacctggcggcagcgcaaaagatg

SEQ ID NO: 204689 - DNA, 103 bp, Artificial Sequence
  Synthetic Polynucleotide
taatacgactcactatagggtcagctccttcaagcttctctggctcatcgaacagaggagacgatgaatgagagaagctaacctggcggcagcgcaaaagatg

SEQ ID NO: 204690 - DNA, 103 bp, Artificial Sequence
  Synthetic Polynucleotide
taatacgactcactatagggtttttcctcttcagctccttcaagcttctcaacagaggagagagaagatggaaggagctaacctggcggcagcgcaaaagatg

SEQ ID NO: 204691 - DNA, 103 bp, Artificial Sequence
  Synthetic Polynucleotide
taatacgactcactatagggcggcttccattttttcctcttcagctccttaacagaggagaaaggagatgaagaggaaaaacctggcggcagcgcaaaagatg

SEQ ID NO: 204692 - DNA, 103 bp, Artificial Sequence
  Synthetic Polynucleotide
taatacgactcactatagggccatcagggtcggcttccattttttcctctaacagaggagaagaggaatgaatggaagcaacctggcggcagcgcaaaagatg

SEQ ID NO: 204693 - DNA, 103 bp, Artificial Sequence
  Synthetic Polynucleotide
taatacgactcactatagggaggctgctgaccatcagggtcggcttccataacagaggagaatggaaatggaccctgataacctggcggcagcgcaaaagatg

SEQ ID NO: 204694 - DNA, 103 bp, Artificial Sequence
  Synthetic Polynucleotide
taatacgactcactatagggctgccttttcaggctgctgaccatcagggtaacagaggagaaccctgatggtcagcagcaacctggcggcagcgcaaaagatg

SEQ ID NO: 204695 - DNA, 103 bp, Artificial Sequence
  Synthetic Polynucleotide
taatacgactcactatagggactttattttctgccttttcaggctgctgaaacagaggagatcagcaatgtgaaaaggcaacctggcggcagcgcaaaagatg

SEQ ID NO: 204696 - DNA, 103 bp, Artificial Sequence
  Synthetic Polynucleotide
taatacgactcactatagggttcattttccactttattttctgccttttcaacagaggagagaaaagatggaaaataaaaacctggcggcagcgcaaaagatg

SEQ ID NO: 204697 - DNA, 103 bp, Artificial Sequence
  Synthetic Polynucleotide
taatacgactcactatagggcttcatccgtttcattttccactttattttaacagaggagaaaaataatgtggaaaatgaacctggcggcagcgcaaaagatg

SEQ ID NO: 204698 - DNA, 103 bp, Artificial Sequence
  Synthetic Polynucleotide
taatacgactcactatagggaactgaagaagctgcaccaccagcccagccaacagaggagaggctggatgggtggtgcaaacctggcggcagcgcaaaagatg

SEQ ID NO: 204699 - DNA, 103 bp, Artificial Sequence
  Synthetic Polynucleotide
taatacgactcactataggggctttatcaccttcatccgtttcattttccaacagaggagaggaaaaatgaacggatgaaacctggcggcagcgcaaaagatg

SEQ ID NO: 204700 - DNA, 103 bp, Artificial Sequence
  Synthetic Polynucleotide
taatacgactcactatagggtccatcttgtgctttatcaccttcatccgtaacagaggagaacggatatgggtgataaaaacctggcggcagcgcaaaagatg

SEQ ID NO: 204701 - DNA, 103 bp, Artificial Sequence
  Synthetic Polynucleotide
taatacgactcactatagggtttcattttctccatcttgtgctttatcacaacagaggagagtgataatgcacaagatgaacctggcggcagcgcaaaagatg

SEQ ID NO: 204702 - DNA, 103 bp, Artificial Sequence
  Synthetic Polynucleotide
taatacgactcactatagggtcactatttttttcattttctccatcttgtaacagaggagaacaagaatgagaaaatgaaacctggcggcagcgcaaaagatg

SEQ ID NO: 204703 - DNA, 103 bp, Artificial Sequence
  Synthetic Polynucleotide
taatacgactcactatagggctgttccttttcactatttttttcattttcaacagaggagagaaaatatgaaaaatagtaacctggcggcagcgcaaaagatg

SEQ ID NO: 204704 - DNA, 103 bp, Artificial Sequence
  Synthetic Polynucleotide
taatacgactcactatagggcttcactatcctgttccttttcactattttaacagaggagaaaaataatgaaaaggaacaacctggcggcagcgcaaaagatg

SEQ ID NO: 204705 - DNA, 103 bp, Artificial Sequence
  Synthetic Polynucleotide
taatacgactcactatagggtcctcactcacttcactatcctgttcctttaacagaggagaaaaggaatgggatagtgaaacctggcggcagcgcaaaagatg

SEQ ID NO: 204706 - DNA, 103 bp, Artificial Sequence
  Synthetic Polynucleotide
taatacgactcactatagggtgatttggtatcctcactcacttcactatcaacagaggagagatagtatggtgagtgagaacctggcggcagcgcaaaagatg

SEQ ID NO: 204707 - DNA, 103 bp, Artificial Sequence
  Synthetic Polynucleotide
taatacgactcactatagggccttttcttctgatttggtatcctcactcaaacagaggagatgagtgatgataccaaataacctggcggcagcgcaaaagatg

SEQ ID NO: 204708 - DNA, 103 bp, Artificial Sequence
  Synthetic Polynucleotide
taatacgactcactatagggtcttcagtctccttttcttctgatttggtaaacagaggagataccaaatgagaagaaaaaacctggcggcagcgcaaaagatg

SEQ ID NO: 204709 - DNA, 103 bp, Artificial Sequence
  Synthetic Polynucleotide
taatacgactcactatagggatcttcctggaactgaagaagctgcaccacaacagaggagagtggtgatgcttcttcagaacctggcggcagcgcaaaagatg

SEQ ID NO: 204710 - DNA, 103 bp, Artificial Sequence
  Synthetic Polynucleotide
taatacgactcactatagggttctttgttctcttcagtctccttttcttcaacagaggagagaagaaatggagactgaaaacctggcggcagcgcaaaagatg

SEQ ID NO: 204711 - DNA, 103 bp, Artificial Sequence
  Synthetic Polynucleotide
taatacgactcactatagggtatcagtgagttctttgttctcttcagtctaacagaggagaagactgatgagaacaaagaacctggcggcagcgcaaaagatg

SEQ ID NO: 204712 - DNA, 103 bp, Artificial Sequence
  Synthetic Polynucleotide
taatacgactcactatagggtctttacatgtatcagtgagttctttgttcaacagaggagagaacaaatgactcactgaaacctggcggcagcgcaaaagatg

SEQ ID NO: 204713 - DNA, 103 bp, Artificial Sequence
  Synthetic Polynucleotide
taatacgactcactatagggactttctctttctttacatgtatcagtgagaacagaggagactcactatgacatgtaaaaacctggcggcagcgcaaaagatg

SEQ ID NO: 204714 - DNA, 103 bp, Artificial Sequence
  Synthetic Polynucleotide
taatacgactcactatagggtcccagtatcactttctctttctttacatgaacagaggagacatgtaatgaaagagaaaaacctggcggcagcgcaaaagatg

SEQ ID NO: 204715 - DNA, 103 bp, Artificial Sequence
  Synthetic Polynucleotide
taatacgactcactatagggactttcttcttcccagtatcactttctcttaacagaggagaaagagaatgtgatactggaacctggcggcagcgcaaaagatg

SEQ ID NO: 204716 - DNA, 103 bp, Artificial Sequence
  Synthetic Polynucleotide
taatacgactcactatagggttcatgttctactttcttcttcccagtatcaacagaggagagatactatgaagaagaaaaacctggcggcagcgcaaaagatg

SEQ ID NO: 204717 - DNA, 103 bp, Artificial Sequence
  Synthetic Polynucleotide
taatacgactcactatagggcttcggaaatttcatgttctactttcttctaacagaggagaagaagaatgtagaacatgaacctggcggcagcgcaaaagatg

SEQ ID NO: 204718 - DNA, 103 bp, Artificial Sequence
  Synthetic Polynucleotide
taatacgactcactataggggcaacatttccttcggaaatttcatgttctaacagaggagaagaacaatgaatttccgaaacctggcggcagcgcaaaagatg

SEQ ID NO: 204719 - DNA, 103 bp, Artificial Sequence
  Synthetic Polynucleotide
taatacgactcactatagggtgcggctgtggcaacatttccttcggaaataacagaggagaatttccatgggaaatgttaacctggcggcagcgcaaaagatg

SEQ ID NO: 204720 - DNA, 103 bp, Artificial Sequence
  Synthetic Polynucleotide
taatacgactcactatagggtcccaaaggcatcttcctggaactgaagaaaacagaggagattcttcatgtccaggaagaacctggcggcagcgcaaaagatg

SEQ ID NO: 204721 - DNA, 103 bp, Artificial Sequence
  Synthetic Polynucleotide
taatacgactcactataggggagcagctgctgcggctgtggcaacatttcaacagaggagagaaatgatgccacagccgaacctggcggcagcgcaaaagatg

SEQ ID NO: 204722 - DNA, 103 bp, Artificial Sequence
  Synthetic Polynucleotide
taatacgactcactataggggctgaggcaagagcagctgctgcggctgtgaacagaggagacacagcatgagcagctgcaacctggcggcagcgcaaaagatg

SEQ ID NO: 204723 - DNA, 103 bp, Artificial Sequence
  Synthetic Polynucleotide
taatacgactcactatagggtttggtagccgctgaggcaagagcagctgcaacagaggagagcagctatgcttgcctcaaacctggcggcagcgcaaaagatg

SEQ ID NO: 204724 - DNA, 103 bp, Artificial Sequence
  Synthetic Polynucleotide
taatacgactcactatagggggtgcttggctttggtagccgctgaggcaaaacagaggagattgcctatgcggctaccaaacctggcggcagcgcaaaagatg

SEQ ID NO: 204725 - DNA, 103 bp, Artificial Sequence
  Synthetic Polynucleotide
taatacgactcactatagggactgcagccaggtgcttggctttggtagccaacagaggagaggctacatgagccaagcaaacctggcggcagcgcaaaagatg

SEQ ID NO: 204726 - DNA, 103 bp, Artificial Sequence
  Synthetic Polynucleotide
taatacgactcactatagggtctttcttccactgcagccaggtgcttggcaacagaggagagccaagatgctggctgcaaacctggcggcagcgcaaaagatg

SEQ ID NO: 204727 - DNA, 103 bp, Artificial Sequence
  Synthetic Polynucleotide
taatacgactcactatagggacttgatctttctttcttccactgcagccaaacagaggagatggctgatgtggaagaaaaacctggcggcagcgcaaaagatg

SEQ ID NO: 204728 - DNA, 103 bp, Artificial Sequence
  Synthetic Polynucleotide
taatacgactcactataggggctaccagggacttgatctttctttcttccaacagaggagaggaagaatgaaagatcaaaacctggcggcagcgcaaaagatg

SEQ ID NO: 204729 - DNA, 103 bp, Artificial Sequence
  Synthetic Polynucleotide
taatacgactcactatagggaaccaagagagctaccagggacttgatcttaacagaggagaaagatcatgtccctggtaaacctggcggcagcgcaaaagatg

SEQ ID NO: 204730 - DNA, 103 bp, Artificial Sequence
  Synthetic Polynucleotide
taatacgactcactatagggtttgtgtctcaaccaagagagctaccagggaacagaggagaccctggatgctctcttggaacctggcggcagcgcaaaagatg

SEQ ID NO: 204731 - DNA, 103 bp, Artificial Sequence
  Synthetic Polynucleotide
taatacgactcactataggggtgacatgcttcccaaaggcatcttcctggaacagaggagaccaggaatgtgcctttggaacctggcggcagcgcaaaagatg

SEQ ID NO: 204732 - DNA, 103 bp, Artificial Sequence
  Synthetic Polynucleotide
taatacgactcactatagggagtttcttcatttgtgtctcaaccaagagaaacagaggagatctcttatgtgagacacaaacctggcggcagcgcaaaagatg

SEQ ID NO: 204733 - DNA, 103 bp, Artificial Sequence
  Synthetic Polynucleotide
taatacgactcactatagggtttgatctctagtttcttcatttgtgtctcaacagaggagagagacaatgatgaagaaaaacctggcggcagcgcaaaagatg

SEQ ID NO: 204734 - DNA, 103 bp, Artificial Sequence
  Synthetic Polynucleotide
taatacgactcactatagggaatgtcgaagtttgatctctagtttcttcaaacagaggagatgaagaatgtagagatcaaacctggcggcagcgcaaaagatg

SEQ ID NO: 204735 - DNA, 103 bp, Artificial Sequence
  Synthetic Polynucleotide
taatacgactcactatagggagctcttcaaaatgtcgaagtttgatctctaacagaggagaagagatatgacttcgacaaacctggcggcagcgcaaaagatg

SEQ ID NO: 204736 - DNA, 103 bp, Artificial Sequence
  Synthetic Polynucleotide
taatacgactcactataggggatagtttccagctcttcaaaatgtcgaagaacagaggagacttcgaatgtttgaagagaacctggcggcagcgcaaaagatg

SEQ ID NO: 204737 - DNA, 103 bp, Artificial Sequence
  Synthetic Polynucleotide
taatacgactcactatagggctctgtccatgatagtttccagctcttcaaaacagaggagattgaagatgtggaaactaaacctggcggcagcgcaaaagatg

SEQ ID NO: 204738 - DNA, 103 bp, Artificial Sequence
  Synthetic Polynucleotide
taatacgactcactataggggcttctttctctctgtccatgatagtttccaacagaggagaggaaacatgcatggacagaacctggcggcagcgcaaaagatg

SEQ ID NO: 204739 - DNA, 103 bp, Artificial Sequence
  Synthetic Polynucleotide
taatacgactcactatagggttgttctagagcttctttctctctgtccataacagaggagaatggacatggagaaagaaaacctggcggcagcgcaaaagatg

SEQ ID NO: 204740 - DNA, 103 bp, Artificial Sequence
  Synthetic Polynucleotide
taatacgactcactataggggctgcctctgttgttctagagcttctttctaacagaggagaagaaagatgctctagaacaacctggcggcagcgcaaaagatg

SEQ ID NO: 204741 - DNA, 103 bp, Artificial Sequence
  Synthetic Polynucleotide
taatacgactcactataggggtaagcaactgctgcctctgttgttctagaaacagaggagatctagaatgacagaggcaaacctggcggcagcgcaaaagatg

SEQ ID NO: 204742 - DNA, 103 bp, Artificial Sequence
  Synthetic Polynucleotide
taatacgactcactatagggggccgggttggtgacatgcttcccaaaggcaacagaggagagcctttatgaagcatgtcaacctggcggcagcgcaaaagatg

SEQ ID NO: 204743 - DNA, 103 bp, Artificial Sequence
  Synthetic Polynucleotide
taatacgactcactatagggttggcgttcagtaagcaactgctgcctctgaacagaggagacagaggatgcagttgcttaacctggcggcagcgcaaaagatg

SEQ ID NO: 204744 - DNA, 103 bp, Artificial Sequence
  Synthetic Polynucleotide
taatacgactcactatagggtgtggaagttttggcgttcagtaagcaactaacagaggagaagttgcatgctgaacgccaacctggcggcagcgcaaaagatg

SEQ ID NO: 204745 - DNA, 103 bp, Artificial Sequence
  Synthetic Polynucleotide
taatacgactcactatagggagctgttccatgtggaagttttggcgttcaaacagaggagatgaacgatgaaacttccaaacctggcggcagcgcaaaagatg

SEQ ID NO: 204746 - DNA, 103 bp, Artificial Sequence
  Synthetic Polynucleotide
taatacgactcactatagggagcatacttcagctgttccatgtggaagttaacagaggagaaacttcatgatggaacagaacctggcggcagcgcaaaagatg

SEQ ID NO: 204747 - DNA, 103 bp, Artificial Sequence
  Synthetic Polynucleotide
taatacgactcactatagggctcgtaattcagcatacttcagctgttccaaacagaggagatggaacatgtgaagtatgaacctggcggcagcgcaaaagatg

SEQ ID NO: 204748 - DNA, 103 bp, Artificial Sequence
  Synthetic Polynucleotide
taatacgactcactatagggtgctgtcgtgctcgtaattcagcatacttcaacagaggagagaagtaatgtgaattacgaacctggcggcagcgcaaaagatg

SEQ ID NO: 204749 - DNA, 103 bp, Artificial Sequence
  Synthetic Polynucleotide
taatacgactcactatagggctgttccatttgctgtcgtgctcgtaattcaacagaggagagaattaatggcacgacagaacctggcggcagcgcaaaagatg

SEQ ID NO: 204750 - DNA, 103 bp, Artificial Sequence
  Synthetic Polynucleotide
taatacgactcactatagggcatgctgctgctgttccatttgctgtcgtgaacagaggagacacgacatgaaatggaacaacctggcggcagcgcaaaagatg

SEQ ID NO: 204751 - DNA, 103 bp, Artificial Sequence
  Synthetic Polynucleotide
taatacgactcactataggggggttctggccatgctgctgctgttccattaacagaggagaaatggaatggcagcagcaaacctggcggcagcgcaaaagatg

SEQ ID NO: 204752 - DNA, 103 bp, Artificial Sequence
  Synthetic Polynucleotide
taatacgactcactatagggtgcctgttgagggttctggccatgctgctgaacagaggagacagcagatgggccagaacaacctggcggcagcgcaaaagatg

SEQ ID NO: 204753 - DNA, 103 bp, Artificial Sequence
  Synthetic Polynucleotide
taatacgactcactataggggtttggtgaaggccgggttggtgacatgctaacagaggagaagcatgatgccaacccggaacctggcggcagcgcaaaagatg

SEQ ID NO: 204754 - DNA, 103 bp, Artificial Sequence
  Synthetic Polynucleotide
taatacgactcactatagggagtgctggtgtgcctgttgagggttctggcaacagaggagagccagaatgctcaacaggaacctggcggcagcgcaaaagatg

SEQ ID NO: 204755 - DNA, 103 bp, Artificial Sequence
  Synthetic Polynucleotide
taatacgactcactatagggggtcctcctgagtgctggtgtgcctgttgaaacagaggagatcaacaatgacaccagcaaacctggcggcagcgcaaaagatg

SEQ ID NO: 204756 - DNA, 103 bp, Artificial Sequence
  Synthetic Polynucleotide
taatacgactcactatagggggccaggccaggtcctcctgagtgctggtgaacagaggagacaccagatgtcaggaggaaacctggcggcagcgcaaaagatg

SEQ ID NO: 204757 - DNA, 103 bp, Artificial Sequence
  Synthetic Polynucleotide
taatacgactcactatagggctccaagtggggccaggccaggtcctcctgaacagaggagacaggagatgctggcctggaacctggcggcagcgcaaaagatg

SEQ ID NO: 204758 - DNA, 103 bp, Artificial Sequence
  Synthetic Polynucleotide
taatacgactcactatagggtgccctgctgctccaagtggggccaggccaaacagaggagatggcctatgcccacttggaacctggcggcagcgcaaaagatg

SEQ ID NO: 204759 - DNA, 103 bp, Artificial Sequence
  Synthetic Polynucleotide
taatacgactcactatagggcatgccagggtgccctgctgctccaagtggaacagaggagaccacttatggcagcagggaacctggcggcagcgcaaaagatg

SEQ ID NO: 204760 - DNA, 103 bp, Artificial Sequence
  Synthetic Polynucleotide
taatacgactcactataggggatgaggcatcatgccagggtgccctgctgaacagaggagacagcagatgaccctggcaaacctggcggcagcgcaaaagatg

SEQ ID NO: 204761 - DNA, 103 bp, Artificial Sequence
  Synthetic Polynucleotide
taatacgactcactataggggggggctgttgatgaggcatcatgccagggaacagaggagaccctggatggatgcctcaaacctggcggcagcgcaaaagatg

SEQ ID NO: 204762 - DNA, 103 bp, Artificial Sequence
  Synthetic Polynucleotide
taatacgactcactatagggagggtagggagggggctgttgatgaggcataacagaggagaatgcctatgcaacagcccaacctggcggcagcgcaaaagatg

SEQ ID NO: 204763 - DNA, 103 bp, Artificial Sequence
  Synthetic Polynucleotide
taatacgactcactatagggggtgcatcagagggtagggagggggctgttaacagaggagaaacagcatgctccctaccaacctggcggcagcgcaaaagatg

SEQ ID NO: 204764 - DNA, 103 bp, Artificial Sequence
  Synthetic Polynucleotide
taatacgactcactataggggtggcgcctaccgctgtccccggcccgccgaacagaggagacggcggatgggggacagcaacctggcggcagcgcaaaagatg

SEQ ID NO: 204765 - DNA, 103 bp, Artificial Sequence
  Synthetic Polynucleotide
taatacgactcactatagggtttgcagggagtttggtgaaggccgggttgaacagaggagacaacccatgcttcaccaaaacctggcggcagcgcaaaagatg

SEQ ID NO: 204766 - DNA, 103 bp, Artificial Sequence
  Synthetic Polynucleotide
taatacgactcactatagggggcatctggtggtgcatcagagggtagggaaacagaggagatccctaatgtctgatgcaaacctggcggcagcgcaaaagatg

SEQ ID NO: 204767 - DNA, 103 bp, Artificial Sequence
  Synthetic Polynucleotide
taatacgactcactatagggatgaggtggtggcatctggtggtgcatcagaacagaggagactgatgatgcaccagatgaacctggcggcagcgcaaaagatg

SEQ ID NO: 204768 - DNA, 103 bp, Artificial Sequence
  Synthetic Polynucleotide
taatacgactcactataggggctggggtggatgaggtggtggcatctggtaacagaggagaaccagaatgcaccacctcaacctggcggcagcgcaaaagatg

SEQ ID NO: 204769 - DNA, 103 bp, Artificial Sequence
  Synthetic Polynucleotide
taatacgactcactatagggatctgacctggctggggtggatgaggtggtaacagaggagaaccaccatgtccaccccaaacctggcggcagcgcaaaagatg

SEQ ID NO: 204770 - DNA, 103 bp, Artificial Sequence
  Synthetic Polynucleotide
taatacgactcactatagggtgggcctggtatctgacctggctggggtggaacagaggagaccacccatgccaggtcagaacctggcggcagcgcaaaagatg

SEQ ID NO: 204771 - DNA, 103 bp, Artificial Sequence
  Synthetic Polynucleotide
taatacgactcactatagggtcatggaacctgggcctggtatctgacctgaacagaggagacaggtcatgtaccaggccaacctggcggcagcgcaaaagatg

SEQ ID NO: 204772 - DNA, 103 bp, Artificial Sequence
  Synthetic Polynucleotide
taatacgactcactatagggtgcccgggcatcatggaacctgggcctggtaacagaggagaaccaggatgaggttccataacctggcggcagcgcaaaagatg

SEQ ID NO: 204773 - DNA, 103 bp, Artificial Sequence
  Synthetic Polynucleotide
taatacgactcactatagggtggcatgtgctgcccgggcatcatggaaccaacagaggagaggttccatgatgcccgggaacctggcggcagcgcaaaagatg

SEQ ID NO: 204774 - DNA, 103 bp, Artificial Sequence
  Synthetic Polynucleotide
taatacgactcactatagggtcatgcggcctggcatgtgctgcccgggcaaacagaggagatgcccgatgagcacatgcaacctggcggcagcgcaaaagatg

SEQ ID NO: 204775 - DNA, 103 bp, Artificial Sequence
  Synthetic Polynucleotide
taatacgactcactatagggacagtgggaatcatgcggcctggcatgtgcaacagaggagagcacatatgaggccgcataacctggcggcagcgcaaaagatg

SEQ ID NO: 204776 - DNA, 103 bp, Artificial Sequence
  Synthetic Polynucleotide
taatacgactcactatagggcatgaaacactttgcagggagtttggtgaaaacagaggagattcaccatgctccctgcaaacctggcggcagcgcaaaagatg

SEQ ID NO: 204777 - DNA, 103 bp, Artificial Sequence
  Synthetic Polynucleotide
taatacgactcactataggggttggctgcaacagtgggaatcatgcggccaacagaggagaggccgcatgattcccactaacctggcggcagcgcaaaagatg

SEQ ID NO: 204778 - DNA, 103 bp, Artificial Sequence
  Synthetic Polynucleotide
taatacgactcactatagggaggggtggatgttggctgcaacagtgggaaaacagaggagattcccaatgttgcagccaaacctggcggcagcgcaaaagatg

SEQ ID NO: 204779 - DNA, 103 bp, Artificial Sequence
  Synthetic Polynucleotide
taatacgactcactatagggccactcccagaggggtggatgttggctgcaaacagaggagatgcagcatgcatccacccaacctggcggcagcgcaaaagatg

SEQ ID NO: 204780 - DNA, 103 bp, Artificial Sequence
  Synthetic Polynucleotide
taatacgactcactatagggaggggtagggccactcccagaggggtggataacagaggagaatccacatgtctgggagtaacctggcggcagcgcaaaagatg

SEQ ID NO: 204781 - DNA, 103 bp, Artificial Sequence
  Synthetic Polynucleotide
taatacgactcactataggggcatgccaggaggggtagggccactcccagaacagaggagactgggaatggccctacccaacctggcggcagcgcaaaagatg

SEQ ID NO: 204782 - DNA, 103 bp, Artificial Sequence
  Synthetic Polynucleotide
taatacgactcactatagggggcattggtggcatgccaggaggggtagggaacagaggagaccctacatgtcctggcataacctggcggcagcgcaaaagatg

SEQ ID NO: 204783 - DNA, 103 bp, Artificial Sequence
  Synthetic Polynucleotide
taatacgactcactataggggatgtttcctggcattggtggcatgccaggaacagaggagacctggcatgccaccaatgaacctggcggcagcgcaaaagatg

SEQ ID NO: 204784 - DNA, 103 bp, Artificial Sequence
  Synthetic Polynucleotide
taatacgactcactatagggggggtcctaagatgtttcctggcattggtgaacagaggagacaccaaatgcaggaaacaaacctggcggcagcgcaaaagatg

SEQ ID NO: 204785 - DNA, 103 bp, Artificial Sequence
  Synthetic Polynucleotide
taatacgactcactatagggaggggtacccggggtcctaagatgtttcctaacagaggagaaggaaaatgcttaggaccaacctggcggcagcgcaaaagatg

SEQ ID NO: 204786 - DNA, 103 bp, Artificial Sequence
  Synthetic Polynucleotide
taatacgactcactatagggaggtgctgtcaggggtacccggggtcctaaaacagaggagattaggaatgcgggtacccaacctggcggcagcgcaaaagatg

SEQ ID NO: 204787 - DNA, 103 bp, Artificial Sequence
  Synthetic Polynucleotide
taatacgactcactatagggctttgaaatccatgaaacactttgcagggaaacagaggagatccctgatgagtgtttcaaacctggcggcagcgcaaaagatg

SEQ ID NO: 204788 - DNA, 103 bp, Artificial Sequence
  Synthetic Polynucleotide
taatacgactcactatagggacatgccgttaggtgctgtcaggggtacccaacagaggagagggtacatgtgacagcacaacctggcggcagcgcaaaagatg

SEQ ID NO: 204789 - DNA, 103 bp, Artificial Sequence
  Synthetic Polynucleotide
taatacgactcactatagggggagggggatacatgccgttaggtgctgtcaacagaggagagacagcatgtaacggcataacctggcggcagcgcaaaagatg

SEQ ID NO: 204790 - DNA, 103 bp, Artificial Sequence
  Synthetic Polynucleotide
taatacgactcactatagggctgctgtggtggagggggatacatgccgttaacagaggagaaacggcatgtatccccctaacctggcggcagcgcaaaagatg

SEQ ID NO: 204791 - DNA, 103 bp, Artificial Sequence
  Synthetic Polynucleotide
taatacgactcactataggggcggtggctgctgctgtggtggagggggataacagaggagaatccccatgcaccacagcaacctggcggcagcgcaaaagatg

SEQ ID NO: 204792 - DNA, 103 bp, Artificial Sequence
  Synthetic Polynucleotide
taatacgactcactatagggggtggtggtggcggtggctgctgctgtggtaacagaggagaaccacaatggcagccaccaacctggcggcagcgcaaaagatg

SEQ ID NO: 204793 - DNA, 103 bp, Artificial Sequence
  Synthetic Polynucleotide
taatacgactcactatagggcccatctgcaggtggtggtggcggtggctgaacagaggagacagccaatgccaccaccaaacctggcggcagcgcaaaagatg

SEQ ID NO: 204794 - DNA, 103 bp, Artificial Sequence
  Synthetic Polynucleotide
taatacgactcactataggggcggagggaccccatctgcaggtggtggtgaacagaggagacaccacatgctgcagatgaacctggcggcagcgcaaaagatg

SEQ ID NO: 204795 - DNA, 103 bp, Artificial Sequence
  Synthetic Polynucleotide
taatacgactcactatagggggagcaggaggcggagggaccccatctgcaaacagaggagatgcagaatgggtccctccaacctggcggcagcgcaaaagatg

SEQ ID NO: 204796 - DNA, 103 bp, Artificial Sequence
  Synthetic Polynucleotide
taatacgactcactatagggtggcgggccaggagcaggaggcggagggacaacagaggagagtccctatgcctcctgctaacctggcggcagcgcaaaagatg

SEQ ID NO: 204797 - DNA, 103 bp, Artificial Sequence
  Synthetic Polynucleotide
taatacgactcactatagggcagctgaggctggcgggccaggagcaggagaacagaggagactcctgatgctggcccgcaacctggcggcagcgcaaaagatg

SEQ ID NO: 204798 - DNA, 103 bp, Artificial Sequence
  Synthetic Polynucleotide
taatacgactcactataggggcgcctccagctttgaaatccatgaaacacaacagaggagagtgtttatgggatttcaaaacctggcggcagcgcaaaagatg

SEQ ID NO: 204799 - DNA, 103 bp, Artificial Sequence
  Synthetic Polynucleotide
taatacgactcactataggggtgacataaggcgcctccagctttgaaatcaacagaggagagatttcatggctggaggcaacctggcggcagcgcaaaagatg

SEQ ID NO: 204800 - DNA, 103 bp, Artificial Sequence
  Synthetic Polynucleotide
taatacgactcactatagggccccaagaatgtgacataaggcgcctccagaacagaggagactggagatgccttatgtcaacctggcggcagcgcaaaagatg

SEQ ID NO: 204801 - DNA, 103 bp, Artificial Sequence
  Synthetic Polynucleotide
taatacgactcactatagggttgtaagcagccccaagaatgtgacataagaacagaggagacttatgatgcattcttggaacctggcggcagcgcaaaagatg

SEQ ID NO: 204802 - DNA, 103 bp, Artificial Sequence
  Synthetic Polynucleotide
taatacgactcactatagggatttttatacttgtaagcagccccaagaataacagaggagaattcttatggctgcttacaacctggcggcagcgcaaaagatg

SEQ ID NO: 204803 - DNA, 103 bp, Artificial Sequence
  Synthetic Polynucleotide
taatacgactcactatagggatccctgttcatttttatacttgtaagcagaacagaggagactgcttatgagtataaaaaacctggcggcagcgcaaaagatg

SEQ ID NO: 204804 - DNA, 103 bp, Artificial Sequence
  Synthetic Polynucleotide
taatacgactcactatagggaacctccgccatccctgttcatttttatacaacagaggagagtataaatgtgaacagggaacctggcggcagcgcaaaagatg

SEQ ID NO: 204805 - DNA, 103 bp, Artificial Sequence
  Synthetic Polynucleotide
taatacgactcactatagggccccgagcccgtggcgcctaccgctgtcccaacagaggagagggacaatggtaggcgccaacctggcggcagcgcaaaagatg

SEQ ID NO: 204806 - DNA, 103 bp, Artificial Sequence
  Synthetic Polynucleotide
taatacgactcactatagggctgtaggtcaaacctccgccatccctgttcaacagaggagagaacagatgtggcggaggaacctggcggcagcgcaaaagatg

SEQ ID NO: 204807 - DNA, 103 bp, Artificial Sequence
  Synthetic Polynucleotide
taatacgactcactataggggagatgggttctgtaggtcaaacctccgccaacagaggagaggcggaatgttgacctacaacctggcggcagcgcaaaagatg

SEQ ID NO: 204808 - DNA, 103 bp, Artificial Sequence
  Synthetic Polynucleotide
taatacgactcactatagggcgatccattcgagatgggttctgtaggtcaaacagaggagatgacctatggaacccatcaacctggcggcagcgcaaaagatg

SEQ ID NO: 204809 - DNA, 103 bp, Artificial Sequence
  Synthetic Polynucleotide
taatacgactcactatagggttccacattacgatccattcgagatgggttaacagaggagaaacccaatgcgaatggataacctggcggcagcgcaaaagatg

SEQ ID NO: 204810 - DNA, 103 bp, Artificial Sequence
  Synthetic Polynucleotide
taatacgactcactatagggtcataaacatttccacattacgatccattcaacagaggagagaatggatggtaatgtggaacctggcggcagcgcaaaagatg

SEQ ID NO: 204811 - DNA, 103 bp, Artificial Sequence
  Synthetic Polynucleotide
taatacgactcactatagggttttcaatgttcataaacatttccacattaaacagaggagataatgtatgaatgtttataacctggcggcagcgcaaaagatg

SEQ ID NO: 204812 - DNA, 103 bp, Artificial Sequence
  Synthetic Polynucleotide
taatacgactcactatagggcaccaatgttttttcaatgttcataaacataacagaggagaatgtttatgaacattgaaaacctggcggcagcgcaaaagatg

SEQ ID NO: 204813 - DNA, 103 bp, Artificial Sequence
  Synthetic Polynucleotide
taatacgactcactatagggaattgttctgcaccaatgttttttcaatgtaacagaggagaacattgatgaaacattggaacctggcggcagcgcaaaagatg

SEQ ID NO: 204814 - DNA, 103 bp, Artificial Sequence
  Synthetic Polynucleotide
taatacgactcactatagggctggtcaaacaattgttctgcaccaatgttaacagaggagaaacattatggcagaacaaaacctggcggcagcgcaaaagatg

SEQ ID NO: 204815 - DNA, 103 bp, Artificial Sequence
  Synthetic Polynucleotide
taatacgactcactataggggatgttgggtctggtcaaacaattgttctgaacagaggagacagaacatgtgtttgaccaacctggcggcagcgcaaaagatg

SEQ ID NO: 204816 - DNA, 103 bp, Artificial Sequence
  Synthetic Polynucleotide
taatacgactcactatagggccgccgcaatccccgagcccgtggcgcctaaacagaggagataggcgatgcgggctcggaacctggcggcagcgcaaaagatg

SEQ ID NO: 204817 - DNA, 103 bp, Artificial Sequence
  Synthetic Polynucleotide
taatacgactcactataggggaatgaggtagatgttgggtctggtcaaacaacagaggagagtttgaatggacccaacaaacctggcggcagcgcaaaagatg

SEQ ID NO: 204818 - DNA, 103 bp, Artificial Sequence
  Synthetic Polynucleotide
taatacgactcactatagggtcaatgtctggaatgaggtagatgttgggtaacagaggagaacccaaatgctacctcataacctggcggcagcgcaaaagatg

SEQ ID NO: 204819 - DNA, 103 bp, Artificial Sequence
  Synthetic Polynucleotide
taatacgactcactatagggcaacttcagatcaatgtctggaatgaggtaaacagaggagatacctcatgccagacattaacctggcggcagcgcaaaagatg

SEQ ID NO: 204820 - DNA, 103 bp, Artificial Sequence
  Synthetic Polynucleotide
taatacgactcactatagggatttgttagccaacttcagatcaatgtctgaacagaggagacagacaatgatctgaagtaacctggcggcagcgcaaaagatg

SEQ ID NO: 204821 - DNA, 103 bp, Artificial Sequence
  Synthetic Polynucleotide
taatacgactcactatagggatatctttcaatttgttagccaacttcagaaacagaggagatctgaaatgggctaacaaaacctggcggcagcgcaaaagatg

SEQ ID NO: 204822 - DNA, 103 bp, Artificial Sequence
  Synthetic Polynucleotide
taatacgactcactatagggtcgtttgatgatatctttcaatttgttagcaacagaggagagctaacatgttgaaagataacctggcggcagcgcaaaagatg

SEQ ID NO: 204823 - DNA, 103 bp, Artificial Sequence
  Synthetic Polynucleotide
taatacgactcactatagggttccctgatgtcgtttgatgatatctttcaaacagaggagatgaaagatgtcatcaaacaacctggcggcagcgcaaaagatg

SEQ ID NO: 204824 - DNA, 103 bp, Artificial Sequence
  Synthetic Polynucleotide
taatacgactcactatagggtccgtaaatgttccctgatgtcgtttgatgaacagaggagacatcaaatgacatcagggaacctggcggcagcgcaaaagatg

SEQ ID NO: 204825 - DNA, 103 bp, Artificial Sequence
  Synthetic Polynucleotide
taatacgactcactatagggtgacttctcatccgtaaatgttccctgatgaacagaggagacatcagatgacatttacgaacctggcggcagcgcaaaagatg

SEQ ID NO: 204826 - DNA, 103 bp, Artificial Sequence
  Synthetic Polynucleotide
taatacgactcactataggggggaagcttttgacttctcatccgtaaatgaacagaggagacatttaatgatgagaagtaacctggcggcagcgcaaaagatg

SEQ ID NO: 204827 - DNA, 103 bp, Artificial Sequence
  Synthetic Polynucleotide
taatacgactcactatagggcctgcggctgccgccgcaatccccgagcccaacagaggagagggctcatggattgcggcaacctggcggcagcgcaaaagatg

SEQ ID NO: 204828 - DNA, 103 bp, Artificial Sequence
  Synthetic Polynucleotide
taatacgactcactatagggtaaatgtggtgggaagcttttgacttctcaaacagaggagatgagaaatgaaaagcttcaacctggcggcagcgcaaaagatg

SEQ ID NO: 204829 - DNA, 103 bp, Artificial Sequence
  Synthetic Polynucleotide
taatacgactcactatagggagaatatgggtaaatgtggtgggaagctttaacagaggagaaaagctatgcaccacattaacctggcggcagcgcaaaagatg

SEQ ID NO: 204830 - DNA, 103 bp, Artificial Sequence
  Synthetic Polynucleotide
taatacgactcactatagggcttgtgaggaagaatatgggtaaatgtggtaacagaggagaaccacaatgacccatattaacctggcggcagcgcaaaagatg

SEQ ID NO: 204831 - DNA, 103 bp, Artificial Sequence
  Synthetic Polynucleotide
taatacgactcactatagggtcttcatcgtcttgtgaggaagaatatgggaacagaggagacccataatgttcctcacaaacctggcggcagcgcaaaagatg

SEQ ID NO: 204832 - DNA, 103 bp, Artificial Sequence
  Synthetic Polynucleotide
taatacgactcactatagggtctcaaccattcttcatcgtcttgtgaggaaacagaggagatcctcaatggacgatgaaaacctggcggcagcgcaaaagatg

SEQ ID NO: 204833 - DNA, 103 bp, Artificial Sequence
  Synthetic Polynucleotide
taatacgactcactatagggtcatcaccggtctcaaccattcttcatcgtaacagaggagaacgatgatgaatggttgaaacctggcggcagcgcaaaagatg

SEQ ID NO: 204834 - DNA, 103 bp, Artificial Sequence
  Synthetic Polynucleotide
taatacgactcactatagggttctcttttctcatcaccggtctcaaccataacagaggagaatggttatgaccggtgataacctggcggcagcgcaaaagatg

SEQ ID NO: 204835 - DNA, 103 bp, Artificial Sequence
  Synthetic Polynucleotide
taatacgactcactatagggtaacacttgcttctcttttctcatcaccggaacagaggagaccggtgatgagaaaagagaacctggcggcagcgcaaaagatg

SEQ ID NO: 204836 - DNA, 103 bp, Artificial Sequence
  Synthetic Polynucleotide
taatacgactcactatagggcccaatgcactaacacttgcttctcttttcaacagaggagagaaaagatgagcaagtgtaacctggcggcagcgcaaaagatg

SEQ ID NO: 204837 - DNA, 103 bp, Artificial Sequence
  Synthetic Polynucleotide
taatacgactcactataggggggtaaaagccccaatgcactaacacttgcaacagaggagagcaagtatgagtgcattgaacctggcggcagcgcaaaagatg

SEQ ID NO: 204838 - DNA, 103 bp, Artificial Sequence
  Synthetic Polynucleotide
taatacgactcactatagggaacagctaggcctgcggctgccgccgcaataacagaggagaattgcgatggcagccgcaaacctggcggcagcgcaaaagatg

SEQ ID NO: 204839 - DNA, 103 bp, Artificial Sequence
  Synthetic Polynucleotide
taatacgactcactatagggatagctgtctgggtaaaagccccaatgcacaacagaggagagtgcatatgggcttttacaacctggcggcagcgcaaaagatg

SEQ ID NO: 204840 - DNA, 103 bp, Artificial Sequence
  Synthetic Polynucleotide
taatacgactcactatagggcccaagtatcatagctgtctgggtaaaagcaacagaggagagcttttatgcagacagctaacctggcggcagcgcaaaagatg

SEQ ID NO: 204841 - DNA, 103 bp, Artificial Sequence
  Synthetic Polynucleotide
taatacgactcactatagggttactatggacccaagtatcatagctgtctaacagaggagaagacagatgtgatacttgaacctggcggcagcgcaaaagatg

SEQ ID NO: 204842 - DNA, 103 bp, Artificial Sequence
  Synthetic Polynucleotide
taatacgactcactatagggatcaacatcattactatggacccaagtatcaacagaggagagatactatggtccatagtaacctggcggcagcgcaaaagatg

SEQ ID NO: 204843 - DNA, 103 bp, Artificial Sequence
  Synthetic Polynucleotide
taatacgactcactatagggcaatttcagcatcaacatcattactatggaaacagaggagatccataatgatgatgttgaacctggcggcagcgcaaaagatg

SEQ ID NO: 204844 - DNA, 103 bp, Artificial Sequence
  Synthetic Polynucleotide
taatacgactcactatagggggtggatcttcaatttcagcatcaacatcaaacagaggagatgatgtatgtgctgaaataacctggcggcagcgcaaaagatg

SEQ ID NO: 204845 - DNA, 103 bp, Artificial Sequence
  Synthetic Polynucleotide
taatacgactcactatagggttctggaattggtggatcttcaatttcagcaacagaggagagctgaaatggaagatccaaacctggcggcagcgcaaaagatg

SEQ ID NO: 204846 - DNA, 103 bp, Artificial Sequence
  Synthetic Polynucleotide
taatacgactcactatagggtccatggtttttctggaattggtggatcttaacagaggagaaagatcatgcaattccagaacctggcggcagcgcaaaagatg

SEQ ID NO: 204847 - DNA, 103 bp, Artificial Sequence
  Synthetic Polynucleotide
taatacgactcactatagggacatgaaccttccatggtttttctggaattaacagaggagaaattccatgaaaaccatgaacctggcggcagcgcaaaagatg

SEQ ID NO: 204848 - DNA, 103 bp, Artificial Sequence
  Synthetic Polynucleotide
taatacgactcactatagggaatccatttcacatgaaccttccatggtttaacagaggagaaaaccaatgaaggttcataacctggcggcagcgcaaaagatg

SEQ ID NO: 204849 - DNA, 103 bp, Artificial Sequence
  Synthetic Polynucleotide
taatacgactcactatagggtccgtcgataaacagctaggcctgcggctgaacagaggagacagccgatggcctagctgaacctggcggcagcgcaaaagatg

SEQ ID NO: 204850 - DNA, 103 bp, Artificial Sequence
  Synthetic Polynucleotide
taatacgactcactatagggcagtgtccaaaatccatttcacatgaacctaacagaggagaaggttcatgtgaaatggaaacctggcggcagcgcaaaagatg

SEQ ID NO: 204851 - DNA, 103 bp, Artificial Sequence
  Synthetic Polynucleotide
taatacgactcactatagggttgaaaatatcagtgtccaaaatccatttcaacagaggagagaaatgatgtttggacacaacctggcggcagcgcaaaagatg

SEQ ID NO: 204852 - DNA, 103 bp, Artificial Sequence
  Synthetic Polynucleotide
taatacgactcactatagggcatccattcattgaaaatatcagtgtccaaaacagaggagattggacatggatattttcaacctggcggcagcgcaaaagatg

SEQ ID NO: 204853 - DNA, 103 bp, Artificial Sequence
  Synthetic Polynucleotide
taatacgactcactatagggcctcctcattcatccattcattgaaaatataacagaggagaatatttatgatgaatggaaacctggcggcagcgcaaaagatg

SEQ ID NO: 204854 - DNA, 103 bp, Artificial Sequence
  Synthetic Polynucleotide
taatacgactcactatagggacctcataatcctcctcattcatccattcaaacagaggagatgaatgatggaatgaggaaacctggcggcagcgcaaaagatg

SEQ ID NO: 204855 - DNA, 103 bp, Artificial Sequence
  Synthetic Polynucleotide
taatacgactcactatagggattttcatccacctcataatcctcctcattaacagaggagaaatgagatggattatgagaacctggcggcagcgcaaaagatg

SEQ ID NO: 204856 - DNA, 103 bp, Artificial Sequence
  Synthetic Polynucleotide
taatacgactcactatagggcaggcttcctattttcatccacctcataataacagaggagaattatgatgtggatgaaaaacctggcggcagcgcaaaagatg

SEQ ID NO: 204857 - DNA, 103 bp, Artificial Sequence
  Synthetic Polynucleotide
taatacgactcactatagggcgaaaactcacaggcttcctattttcatccaacagaggagaggatgaatgtaggaagccaacctggcggcagcgcaaaagatg

SEQ ID NO: 204858 - DNA, 103 bp, Artificial Sequence
  Synthetic Polynucleotide
taatacgactcactatagggaatccgctgacgaaaactcacaggcttcctaacagaggagaaggaagatggtgagttttaacctggcggcagcgcaaaagatg

SEQ ID NO: 204859 - DNA, 103 bp, Artificial Sequence
  Synthetic Polynucleotide
taatacgactcactatagggtcttggttgaaatccgctgacgaaaactcaaacagaggagatgagttatggtcagcggaaacctggcggcagcgcaaaagatg

SEQ ID NO: 204860 - DNA, 103 bp, Artificial Sequence
  Synthetic Polynucleotide
taatacgactcactatagggcccccatccttccgtcgataaacagctaggaacagaggagacctagcatgttatcgacgaacctggcggcagcgcaaaagatg

SEQ ID NO: 204861 - DNA, 103 bp, Artificial Sequence
  Synthetic Polynucleotide
taatacgactcactatagggggctcttcattcttggttgaaatccgctgaaacagaggagatcagcgatgttcaaccaaaacctggcggcagcgcaaaagatg

SEQ ID NO: 204862 - DNA, 103 bp, Artificial Sequence
  Synthetic Polynucleotide
taatacgactcactatagggacttctgactggctcttcattcttggttgaaacagaggagatcaaccatgaatgaagagaacctggcggcagcgcaaaagatg

SEQ ID NO: 204863 - DNA, 103 bp, Artificial Sequence
  Synthetic Polynucleotide
taatacgactcactatagggttctttctggacttctgactggctcttcataacagaggagaatgaagatgcagtcagaaaacctggcggcagcgcaaaagatg

SEQ ID NO: 204864 - DNA, 103 bp, Artificial Sequence
  Synthetic Polynucleotide
taatacgactcactatagggtttctatctcttctttctggacttctgactaacagaggagaagtcagatgtccagaaagaacctggcggcagcgcaaaagatg

SEQ ID NO: 204865 - DNA, 103 bp, Artificial Sequence
  Synthetic Polynucleotide
taatacgactcactatagggagctgatgcttttctatctcttctttctggaacagaggagaccagaaatgagagatagaaacctggcggcagcgcaaaagatg

SEQ ID NO: 204866 - DNA, 103 bp, Artificial Sequence
  Synthetic Polynucleotide
taatacgactcactatagggttcgagcattagctgatgcttttctatctcaacagaggagagagataatgaagcatcagaacctggcggcagcgcaaaagatg

SEQ ID NO: 204867 - DNA, 103 bp, Artificial Sequence
  Synthetic Polynucleotide
taatacgactcactatagggtgtttcctctttcgagcattagctgatgctaacagaggagaagcatcatgtaatgctcgaacctggcggcagcgcaaaagatg

SEQ ID NO: 204868 - DNA, 103 bp, Artificial Sequence
  Synthetic Polynucleotide
taatacgactcactatagggcgaaggcgaatgtttcctctttcgagcattaacagaggagaaatgctatgaagaggaaaaacctggcggcagcgcaaaagatg

SEQ ID NO: 204869 - DNA, 103 bp, Artificial Sequence
  Synthetic Polynucleotide
taatacgactcactataggggagggggaggcgaaggcgaatgtttcctctaacagaggagaagaggaatgattcgccttaacctggcggcagcgcaaaagatg

SEQ ID NO: 204870 - DNA, 103 bp, Artificial Sequence
  Synthetic Polynucleotide
taatacgactcactataggggttggtgtcggagggggaggcgaaggcgaaaacagaggagattcgccatggcctcccccaacctggcggcagcgcaaaagatg

SEQ ID NO: 204871 - DNA, 103 bp, Artificial Sequence
  Synthetic Polynucleotide
taatacgactcactatagggggggccgccgtccttcttccgcaccgccataacagaggagaatggcgatgcggaagaagaacctggcggcagcgcaaaagatg

SEQ ID NO: 204872 - DNA, 103 bp, Artificial Sequence
  Synthetic Polynucleotide
taatacgactcactatagggttgtatatacttcttgtagttcttgccgagaacagaggagactcggcatgaactacaagaacctggcggcagcgcaaaagatg

SEQ ID NO: 204873 - DNA, 103 bp, Artificial Sequence
  Synthetic Polynucleotide
taatacgactcactatagggtgtcaggtcttcttgctcctcttctctgtgaacagaggagacacagaatggaggagcaaaacctggcggcagcgcaaaagatg

SEQ ID NO: 204874 - DNA, 103 bp, Artificial Sequence
  Synthetic Polynucleotide
taatacgactcactatagggccatgtcctttgtcaggtcttcttgctcctaacagaggagaaggagcatgaagacctgaaacctggcggcagcgcaaaagatg

SEQ ID NO: 204875 - DNA, 103 bp, Artificial Sequence
  Synthetic Polynucleotide
taatacgactcactataggggagggctcgtccatgtcctttgtcaggtctaacagaggagaagacctatgaaaggacataacctggcggcagcgcaaaagatg

SEQ ID NO: 204876 - DNA, 103 bp, Artificial Sequence
  Synthetic Polynucleotide
taatacgactcactatagggggggactggtgagggctcgtccatgtccttaacagaggagaaaggacatggacgagcccaacctggcggcagcgcaaaagatg

SEQ ID NO: 204877 - DNA, 103 bp, Artificial Sequence
  Synthetic Polynucleotide
taatacgactcactatagggcttctacattggggactggtgagggctcgtaacagaggagaacgagcatgcaccagtccaacctggcggcagcgcaaaagatg

SEQ ID NO: 204878 - DNA, 103 bp, Artificial Sequence
  Synthetic Polynucleotide
taatacgactcactatagggagtgtcacctcttctacattggggactggtaacagaggagaaccagtatgcaatgtagaaacctggcggcagcgcaaaagatg

SEQ ID NO: 204879 - DNA, 103 bp, Artificial Sequence
  Synthetic Polynucleotide
taatacgactcactatagggtgttttgggaagtgtcacctcttctacattaacagaggagaaatgtaatggaggtgacaaacctggcggcagcgcaaaagatg

SEQ ID NO: 204880 - DNA, 103 bp, Artificial Sequence
  Synthetic Polynucleotide
taatacgactcactatagggttgtgttgactgttttgggaagtgtcacctaacagaggagaaggtgaatgttcccaaaaaacctggcggcagcgcaaaagatg

SEQ ID NO: 204881 - DNA, 103 bp, Artificial Sequence
  Synthetic Polynucleotide
taatacgactcactataggggagtctttctttgtgttgactgttttgggaaacagaggagatcccaaatgagtcaacacaacctggcggcagcgcaaaagatg

SEQ ID NO: 204882 - DNA, 103 bp, Artificial Sequence
  Synthetic Polynucleotide
taatacgactcactatagggggccgactctgagtctttctttgtgttgacaacagaggagagtcaacatgaagaaagacaacctggcggcagcgcaaaagatg

SEQ ID NO: 204883 - DNA, 103 bp, Artificial Sequence
  Synthetic Polynucleotide
taatacgactcactataggggtggttcagcttgtatatacttcttgtagtaacagaggagaactacaatgagtatatacaacctggcggcagcgcaaaagatg

SEQ ID NO: 204884 - DNA, 103 bp, Artificial Sequence
  Synthetic Polynucleotide
taatacgactcactatagggctttgactggggccgactctgagtctttctaacagaggagaagaaagatgcagagtcggaacctggcggcagcgcaaaagatg

SEQ ID NO: 204885 - DNA, 103 bp, Artificial Sequence
  Synthetic Polynucleotide
taatacgactcactatagggatggtgccgcctttgactggggccgactctaacagaggagaagagtcatgcccagtcaaaacctggcggcagcgcaaaagatg

SEQ ID NO: 204886 - DNA, 103 bp, Artificial Sequence
  Synthetic Polynucleotide
taatacgactcactatagggcaggtcggtcatggtgccgcctttgactggaacagaggagaccagtcatgggcggcaccaacctggcggcagcgcaaaagatg

SEQ ID NO: 204887 - DNA, 103 bp, Artificial Sequence
  Synthetic Polynucleotide
taatacgactcactatagggcctgttcatccaggtcggtcatggtgccgcaacagaggagagcggcaatgtgaccgaccaacctggcggcagcgcaaaagatg

SEQ ID NO: 204888 - DNA, 103 bp, Artificial Sequence
  Synthetic Polynucleotide
taatacgactcactatagggctttcatcttcctgttcatccaggtcggtcaacagaggagagaccgaatgggatgaacaaacctggcggcagcgcaaaagatg

SEQ ID NO: 204889 - DNA, 103 bp, Artificial Sequence
  Synthetic Polynucleotide
taatacgactcactatagggcgtctccatgctttcatcttcctgttcatcaacagaggagagatgaaatggaagatgaaaacctggcggcagcgcaaaagatg

SEQ ID NO: 204890 - DNA, 103 bp, Artificial Sequence
  Synthetic Polynucleotide
taatacgactcactatagggccttgcccgtcgtctccatgctttcatcttaacagaggagaaagatgatggcatggagaaacctggcggcagcgcaaaagatg

SEQ ID NO: 204891 - DNA, 103 bp, Artificial Sequence
  Synthetic Polynucleotide
taatacgactcactatagggtcatcctcatccttgcccgtcgtctccatgaacagaggagacatggaatggacgggcaaaacctggcggcagcgcaaaagatg

SEQ ID NO: 204892 - DNA, 103 bp, Artificial Sequence
  Synthetic Polynucleotide
taatacgactcactatagggcgtactgttctcatcctcatccttgcccgtaacagaggagaacgggcatggatgaggataacctggcggcagcgcaaaagatg

SEQ ID NO: 204893 - DNA, 103 bp, Artificial Sequence
  Synthetic Polynucleotide
taatacgactcactatagggccttgttccccgtactgttctcatcctcataacagaggagaatgaggatgagaacagtaaacctggcggcagcgcaaaagatg

SEQ ID NO: 204894 - DNA, 103 bp, Artificial Sequence
  Synthetic Polynucleotide
taatacgactcactatagggttgttggtgggtggttcagcttgtatatacaacagaggagagtatatatgagctgaaccaacctggcggcagcgcaaaagatg

SEQ ID NO: 204895 - DNA, 103 bp, Artificial Sequence
  Synthetic Polynucleotide
taatacgactcactataggggtctgctctcccttgttccccgtactgttcaacagaggagagaacagatgggggaacaaaacctggcggcagcgcaaaagatg

SEQ ID NO: 204896 - DNA, 103 bp, Artificial Sequence
  Synthetic Polynucleotide
taatacgactcactatagggtggattcttggtctgctctcccttgttcccaacagaggagagggaacatgggagagcagaacctggcggcagcgcaaaagatg

SEQ ID NO: 204897 - DNA, 103 bp, Artificial Sequence
  Synthetic Polynucleotide
taatacgactcactatagggcatgcaggtctggattcttggtctgctctcaacagaggagagagagcatgccaagaatcaacctggcggcagcgcaaaagatg

SEQ ID NO: 204898 - DNA, 103 bp, Artificial Sequence
  Synthetic Polynucleotide
taatacgactcactatagggacattgtcctcatgcaggtctggattcttgaacagaggagacaagaaatgagacctgcaaacctggcggcagcgcaaaagatg

SEQ ID NO: 204899 - DNA, 103 bp, Artificial Sequence
  Synthetic Polynucleotide
taatacgactcactatagggctgttcagtcacattgtcctcatgcaggtcaacagaggagagacctgatggaggacaataacctggcggcagcgcaaaagatg

SEQ ID NO: 204900 - DNA, 103 bp, Artificial Sequence
  Synthetic Polynucleotide
taatacgactcactatagggtgtggtgggtctgttcagtcacattgtcctaacagaggagaaggacaatgtgactgaacaacctggcggcagcgcaaaagatg

SEQ ID NO: 204901 - DNA, 103 bp, Artificial Sequence
  Synthetic Polynucleotide
taatacgactcactatagggggaatgatgatgtggtgggtctgttcagtcaacagaggagagactgaatggacccaccaaacctggcggcagcgcaaaagatg

SEQ ID NO: 204902 - DNA, 103 bp, Artificial Sequence
  Synthetic Polynucleotide
taatacgactcactatagggagcgtagctgggaatgatgatgtggtgggtaacagaggagaacccacatgatcatcattaacctggcggcagcgcaaaagatg

SEQ ID NO: 204903 - DNA, 103 bp, Artificial Sequence
  Synthetic Polynucleotide
taatacgactcactatagggcaaaccaggcagcgtagctgggaatgatgaaacagaggagatcatcaatgccagctacgaacctggcggcagcgcaaaagatg

SEQ ID NO: 204904 - DNA, 103 bp, Artificial Sequence
  Synthetic Polynucleotide
taatacgactcactatagggctattgtagtcaaaccaggcagcgtagctgaacagaggagacagctaatgtgcctggttaacctggcggcagcgcaaaagatg

SEQ ID NO: 204905 - DNA, 103 bp, Artificial Sequence
  Synthetic Polynucleotide
taatacgactcactatagggagacagggacttgttggtgggtggttcagcaacagaggagagctgaaatgcccaccaacaacctggcggcagcgcaaaagatg

SEQ ID NO: 204906 - DNA, 103 bp, Artificial Sequence
  Synthetic Polynucleotide
taatacgactcactatagggggcatgaacactattgtagtcaaaccaggcaacagaggagagcctggatggactacaataacctggcggcagcgcaaaagatg

SEQ ID NO: 204907 - DNA, 103 bp, Artificial Sequence
  Synthetic Polynucleotide
taatacgactcactatagggtccgctcaatggcatgaacactattgtagtaacagaggagaactacaatggtgttcatgaacctggcggcagcgcaaaagatg

SEQ ID NO: 204908 - DNA, 103 bp, Artificial Sequence
  Synthetic Polynucleotide
taatacgactcactataggggggagagccctccgctcaatggcatgaacaaacagaggagatgttcaatgcattgagcgaacctggcggcagcgcaaaagatg

SEQ ID NO: 204909 - DNA, 103 bp, Artificial Sequence
  Synthetic Polynucleotide
taatacgactcactataggggaagaactcggggagagccctccgctcaataacagaggagaattgagatgagggctctcaacctggcggcagcgcaaaagatg

SEQ ID NO: 204910 - DNA, 103 bp, Artificial Sequence
  Synthetic Polynucleotide
taatacgactcactatagggtcttgccgttgaagaactcggggagagcccaacagaggagagggctcatgccgagttctaacctggcggcagcgcaaaagatg

SEQ ID NO: 204911 - DNA, 103 bp, Artificial Sequence
  Synthetic Polynucleotide
taatacgactcactatagggttggacttgttcttgccgttgaagaactcgaacagaggagacgagttatgcaacggcaaaacctggcggcagcgcaaaagatg

SEQ ID NO: 204912 - DNA, 103 bp, Artificial Sequence
  Synthetic Polynucleotide
taatacgactcactatagggctctggagtcttggacttgttcttgccgttaacagaggagaaacggcatgaacaagtccaacctggcggcagcgcaaaagatg

SEQ ID NO: 204913 - DNA, 103 bp, Artificial Sequence
  Synthetic Polynucleotide
taatacgactcactatagggccaggtagatctctggagtcttggacttgtaacagaggagaacaagtatgagactccagaacctggcggcagcgcaaaagatg

SEQ ID NO: 204914 - DNA, 103 bp, Artificial Sequence
  Synthetic Polynucleotide
taatacgactcactatagggtttcgataggccaggtagatctctggagtcaacagaggagagactccatggatctacctaacctggcggcagcgcaaaagatg

SEQ ID NO: 204915 - DNA, 103 bp, Artificial Sequence
  Synthetic Polynucleotide
taatacgactcactatagggaatcataaagtttcgataggccaggtagataacagaggagaatctacatggcctatcgaaacctggcggcagcgcaaaagatg

SEQ ID NO: 204916 - DNA, 103 bp, Artificial Sequence
  Synthetic Polynucleotide
taatacgactcactatagggcaaccaggctagacagggacttgttggtggaacagaggagaccaccaatgagtccctgtaacctggcggcagcgcaaaagatg

SEQ ID NO: 204917 - DNA, 103 bp, Artificial Sequence
  Synthetic Polynucleotide
taatacgactcactatagggggtaagtgtcaatcataaagtttcgataggaacagaggagacctatcatgactttatgaaacctggcggcagcgcaaaagatg

SEQ ID NO: 204918 - DNA, 103 bp, Artificial Sequence
  Synthetic Polynucleotide
taatacgactcactataggggggttcagtcggtaagtgtcaatcataaagaacagaggagactttatatgtgacacttaaacctggcggcagcgcaaaagatg

SEQ ID NO: 204919 - DNA, 103 bp, Artificial Sequence
  Synthetic Polynucleotide
taatacgactcactatagggatactcttgggggttcagtcggtaagtgtcaacagaggagagacactatgcgactgaacaacctggcggcagcgcaaaagatg

SEQ ID NO: 204920 - DNA, 103 bp, Artificial Sequence
  Synthetic Polynucleotide
taatacgactcactatagggtagaggtaagatactcttgggggttcagtcaacagaggagagactgaatgcccaagagtaacctggcggcagcgcaaaagatg

SEQ ID NO: 204921 - DNA, 103 bp, Artificial Sequence
  Synthetic Polynucleotide
taatacgactcactatagggcggcaggcggtagaggtaagatactcttggaacagaggagaccaagaatgtcttacctcaacctggcggcagcgcaaaagatg

SEQ ID NO: 204922 - DNA, 103 bp, Artificial Sequence
  Synthetic Polynucleotide
taatacgactcactatagggtaggtttcggcggcaggcggtagaggtaagaacagaggagacttaccatgaccgcctgcaacctggcggcagcgcaaaagatg

SEQ ID NO: 204923 - DNA, 103 bp, Artificial Sequence
  Synthetic Polynucleotide
taatacgactcactatagggcatcacccgctaggtttcggcggcaggcggaacagaggagaccgcctatggccgaaaccaacctggcggcagcgcaaaagatg

SEQ ID NO: 204924 - DNA, 103 bp, Artificial Sequence
  Synthetic Polynucleotide
taatacgactcactatagggatggcacagacatcacccgctaggtttcggaacagaggagaccgaaaatgagcgggtgaaacctggcggcagcgcaaaagatg

SEQ ID NO: 204925 - DNA, 103 bp, Artificial Sequence
  Synthetic Polynucleotide
taatacgactcactataggggaccctcatgatggcacagacatcacccgcaacagaggagagcgggtatggtctgtgccaacctggcggcagcgcaaaagatg

SEQ ID NO: 204926 - DNA, 103 bp, Artificial Sequence
  Synthetic Polynucleotide
taatacgactcactatagggggaaggcatggaccctcatgatggcacagaaacagaggagatctgtgatgtcatgagggaacctggcggcagcgcaaaagatg

SEQ ID NO: 204927 - DNA, 103 bp, Artificial Sequence
  Synthetic Polynucleotide
taatacgactcactatagggagcaactgtacaaccaggctagacagggacaacagaggagagtccctatgtagcctggtaacctggcggcagcgcaaaagatg

SEQ ID NO: 204928 - DNA, 103 bp, Artificial Sequence
  Synthetic Polynucleotide
taatacgactcactatagggcactgttctaggaaggcatggaccctcatgaacagaggagacatgagatgccatgccttaacctggcggcagcgcaaaagatg

SEQ ID NO: 204929 - DNA, 103 bp, Artificial Sequence
  Synthetic Polynucleotide
taatacgactcactatagggaataagaccccactgttctaggaaggcatgaacagaggagacatgccatgctagaacagaacctggcggcagcgcaaaagatg

SEQ ID NO: 204930 - DNA, 103 bp, Artificial Sequence
  Synthetic Polynucleotide
taatacgactcactatagggcctggtagttaataagaccccactgttctaaacagaggagatagaacatgggggtcttaaacctggcggcagcgcaaaagatg

SEQ ID NO: 204931 - DNA, 103 bp, Artificial Sequence
  Synthetic Polynucleotide
taatacgactcactatagggtcagcatccacctggtagttaataagacccaacagaggagagggtctatgtaactaccaaacctggcggcagcgcaaaagatg

SEQ ID NO: 204932 - DNA, 103 bp, Artificial Sequence
  Synthetic Polynucleotide
taatacgactcactatagggtggtcgactctcagcatccacctggtagttaacagaggagaaactacatggtggatgctaacctggcggcagcgcaaaagatg

SEQ ID NO: 204933 - DNA, 103 bp, Artificial Sequence
  Synthetic Polynucleotide
taatacgactcactatagggccattggggttggtcgactctcagcatccaaacagaggagatggatgatgagagtcgacaacctggcggcagcgcaaaagatg

SEQ ID NO: 204934 - DNA, 103 bp, Artificial Sequence
  Synthetic Polynucleotide
taatacgactcactatagggggcggaggccccattggggttggtcgactcaacagaggagagagtcgatgaaccccaataacctggcggcagcgcaaaagatg

SEQ ID NO: 204935 - DNA, 103 bp, Artificial Sequence
  Synthetic Polynucleotide
taatacgactcactataggggtgagaggtaggcggaggccccattggggtaacagaggagaaccccaatggggcctccgaacctggcggcagcgcaaaagatg

SEQ ID NO: 204936 - DNA, 103 bp, Artificial Sequence
  Synthetic Polynucleotide
taatacgactcactatagggagacatggaagtgagaggtaggcggaggccaacagaggagaggcctcatgctacctctcaacctggcggcagcgcaaaagatg

SEQ ID NO: 204937 - DNA, 103 bp, Artificial Sequence
  Synthetic Polynucleotide
taatacgactcactataggggtgtcagccaagacatggaagtgagaggtaaacagaggagatacctcatgcttccatgtaacctggcggcagcgcaaaagatg

SEQ ID NO: 204938 - DNA, 103 bp, Artificial Sequence
  Synthetic Polynucleotide
taatacgactcactatagggctgaaattgtagcaactgtacaaccaggctaacagaggagaagcctgatggtacagttgaacctggcggcagcgcaaaagatg

SEQ ID NO: 204939 - DNA, 103 bp, Artificial Sequence
  Synthetic Polynucleotide
taatacgactcactatagggccctgatggtgtgtcagccaagacatggaaaacagaggagattccatatgttggctgacaacctggcggcagcgcaaaagatg

SEQ ID NO: 204940 - DNA, 103 bp, Artificial Sequence
  Synthetic Polynucleotide
taatacgactcactataggggaggcaccagccctgatggtgtgtcagccaaacagaggagatggctgatgcaccatcagaacctggcggcagcgcaaaagatg

SEQ ID NO: 204941 - DNA, 103 bp, Artificial Sequence
  Synthetic Polynucleotide
taatacgactcactatagggttgggctgcagaggcaccagccctgatggtaacagaggagaaccatcatggctggtgccaacctggcggcagcgcaaaagatg

SEQ ID NO: 204942 - DNA, 103 bp, Artificial Sequence
  Synthetic Polynucleotide
taatacgactcactatagggctgaggtgtcttgggctgcagaggcaccagaacagaggagactggtgatgctgcagcccaacctggcggcagcgcaaaagatg

SEQ ID NO: 204943 - DNA, 103 bp, Artificial Sequence
  Synthetic Polynucleotide
taatacgactcactatagggcagaggtctgctgaggtgtcttgggctgcaaacagaggagatgcagcatgagacacctcaacctggcggcagcgcaaaagatg

SEQ ID NO: 204944 - DNA, 103 bp, Artificial Sequence
  Synthetic Polynucleotide
taatacgactcactatagggtgttgggaagcagaggtctgctgaggtgtcaacagaggagagacaccatggcagacctcaacctggcggcagcgcaaaagatg

SEQ ID NO: 204945 - DNA, 103 bp, Artificial Sequence
  Synthetic Polynucleotide
taatacgactcactataggggttgagcatttgttgggaagcagaggtctgaacagaggagacagaccatggcttcccaaaacctggcggcagcgcaaaagatg

SEQ ID NO: 204946 - DNA, 103 bp, Artificial Sequence
  Synthetic Polynucleotide
taatacgactcactatagggtgtcaggaaagttgagcatttgttgggaagaacagaggagacttcccatgaaatgctcaaacctggcggcagcgcaaaagatg

SEQ ID NO: 204947 - DNA, 103 bp, Artificial Sequence
  Synthetic Polynucleotide
taatacgactcactatagggtctttgcctttgtcaggaaagttgagcattaacagaggagaaatgctatgctttcctgaaacctggcggcagcgcaaaagatg

SEQ ID NO: 204948 - DNA, 103 bp, Artificial Sequence
  Synthetic Polynucleotide
taatacgactcactatagggtgttggtttctctttgcctttgtcaggaaaaacagaggagatttcctatgaaaggcaaaaacctggcggcagcgcaaaagatg

SEQ ID NO: 204949 - DNA, 103 bp, Artificial Sequence
  Synthetic Polynucleotide
taatacgactcactatagggaaacttcttcctgaaattgtagcaactgtaaacagaggagatacagtatgtacaatttcaacctggcggcagcgcaaaagatg

SEQ ID NO: 204950 - DNA, 103 bp, Artificial Sequence
  Synthetic Polynucleotide
taatacgactcactatagggtttgcatgtctgttggtttctctttgccttaacagaggagaaaggcaatgagaaaccaaaacctggcggcagcgcaaaagatg

SEQ ID NO: 204951 - DNA, 103 bp, Artificial Sequence
  Synthetic Polynucleotide
taatacgactcactatagggagcccaaagttttgcatgtctgttggtttcaacagaggagagaaaccatgagacatgcaaacctggcggcagcgcaaaagatg

SEQ ID NO: 204952 - DNA, 103 bp, Artificial Sequence
  Synthetic Polynucleotide
taatacgactcactataggggtctgtgcgcagcccaaagttttgcatgtcaacagaggagagacatgatgaactttgggaacctggcggcagcgcaaaagatg

SEQ ID NO: 204953 - DNA, 103 bp, Artificial Sequence
  Synthetic Polynucleotide
taatacgactcactatagggttgtgtacatgtctgtgcgcagcccaaagtaacagaggagaactttgatgtgcgcacagaacctggcggcagcgcaaaagatg

SEQ ID NO: 204954 - DNA, 103 bp, Artificial Sequence
  Synthetic Polynucleotide
taatacgactcactatagggacattcttttttgtgtacatgtctgtgcgcaacagaggagagcgcacatgcatgtacacaacctggcggcagcgcaaaagatg

SEQ ID NO: 204955 - DNA, 103 bp, Artificial Sequence
  Synthetic Polynucleotide
taatacgactcactatagggcttggagggaacattcttttttgtgtacataacagaggagaatgtacatgaaaaagaataacctggcggcagcgcaaaagatg

SEQ ID NO: 204956 - DNA, 103 bp, Artificial Sequence
  Synthetic Polynucleotide
taatacgactcactatagggcagccttgctcttggagggaacattcttttaacagaggagaaaaagaatgttccctccaaacctggcggcagcgcaaaagatg

SEQ ID NO: 204957 - DNA, 103 bp, Artificial Sequence
  Synthetic Polynucleotide
taatacgactcactataggggcactggctgcagccttgctcttggagggaaacagaggagatccctcatggagcaaggcaacctggcggcagcgcaaaagatg

SEQ ID NO: 204958 - DNA, 103 bp, Artificial Sequence
  Synthetic Polynucleotide
taatacgactcactatagggctcacgagtggcactggctgcagccttgctaacagaggagaagcaagatggcagccagtaacctggcggcagcgcaaaagatg

SEQ ID NO: 204959 - DNA, 103 bp, Artificial Sequence
  Synthetic Polynucleotide
taatacgactcactataggggttctgtccactcacgagtggcactggctgaacagaggagacagccaatgccactcgtgaacctggcggcagcgcaaaagatg

SEQ ID NO: 204960 - DNA, 103 bp, Artificial Sequence
  Synthetic Polynucleotide
taatacgactcactatagggtgtttgccaaaaacttcttcctgaaattgtaacagaggagaacaattatgggaagaagtaacctggcggcagcgcaaaagatg

SEQ ID NO: 204961 - DNA, 103 bp, Artificial Sequence
  Synthetic Polynucleotide
taatacgactcactatagggagggtttcctgttctgtccactcacgagtgaacagaggagacactcgatggtggacagaaacctggcggcagcgcaaaagatg

SEQ ID NO: 204962 - DNA, 103 bp, Artificial Sequence
  Synthetic Polynucleotide
taatacgactcactatagggcaggagaagcagggtttcctgttctgtccaaacagaggagatggacaatgcaggaaaccaacctggcggcagcgcaaaagatg

SEQ ID NO: 204963 - DNA, 103 bp, Artificial Sequence
  Synthetic Polynucleotide
taatacgactcactatagggccagtgcctccaggagaagcagggtttcctaacagaggagaaggaaaatgtgcttctccaacctggcggcagcgcaaaagatg

SEQ ID NO: 204964 - DNA, 103 bp, Artificial Sequence
  Synthetic Polynucleotide
taatacgactcactatagggttgtacatttccagtgcctccaggagaagcaacagaggagagcttctatgggaggcactaacctggcggcagcgcaaaagatg

SEQ ID NO: 204965 - DNA, 103 bp, Artificial Sequence
  Synthetic Polynucleotide
taatacgactcactatagggccagtcatctttgtacatttccagtgcctcaacagaggagagaggcaatggaaatgtacaacctggcggcagcgcaaaagatg

SEQ ID NO: 204966 - DNA, 103 bp, Artificial Sequence
  Synthetic Polynucleotide
taatacgactcactatagggacactttgttccagtcatctttgtacatttaacagaggagaaaatgtatgaagatgactaacctggcggcagcgcaaaagatg

SEQ ID NO: 204967 - DNA, 103 bp, Artificial Sequence
  Synthetic Polynucleotide
taatacgactcactatagggacatgctcggacactttgttccagtcatctaacagaggagaagatgaatggaacaaagtaacctggcggcagcgcaaaagatg

SEQ ID NO: 204968 - DNA, 103 bp, Artificial Sequence
  Synthetic Polynucleotide
taatacgactcactataggggcggcttcccacatgctcggacactttgttaacagaggagaaacaaaatgtccgagcataacctggcggcagcgcaaaagatg

SEQ ID NO: 204969 - DNA, 103 bp, Artificial Sequence
  Synthetic Polynucleotide
taatacgactcactatagggcgtcctgtgtgcggcttcccacatgctcggaacagaggagaccgagcatgtgggaagccaacctggcggcagcgcaaaagatg

SEQ ID NO: 204970 - DNA, 103 bp, Artificial Sequence
  Synthetic Polynucleotide
taatacgactcactatagggaagatgcactcgtcctgtgtgcggcttcccaacagaggagagggaagatgcacacaggaaacctggcggcagcgcaaaagatg

SEQ ID NO: 204971 - DNA, 103 bp, Artificial Sequence
  Synthetic Polynucleotide
taatacgactcactatagggattgctgacatgtttgccaaaaacttcttcaacagaggagagaagaaatgtttggcaaaaacctggcggcagcgcaaaagatg

SEQ ID NO: 204972 - DNA, 103 bp, Artificial Sequence
  Synthetic Polynucleotide
taatacgactcactatagggaagaaaatgcaagatgcactcgtcctgtgtaacagaggagaacacagatggagtgcatcaacctggcggcagcgcaaaagatg

SEQ ID NO: 204973 - DNA, 103 bp, Artificial Sequence
  Synthetic Polynucleotide
taatacgactcactatagggtgggaagacgaagaaaatgcaagatgcactaacagaggagaagtgcaatgtgcattttcaacctggcggcagcgcaaaagatg

SEQ ID NO: 204974 - DNA, 103 bp, Artificial Sequence
  Synthetic Polynucleotide
taatacgactcactataggggggtcttcaatgggaagacgaagaaaatgcaacagaggagagcatttatgtcgtcttccaacctggcggcagcgcaaaagatg

SEQ ID NO: 204975 - DNA, 103 bp, Artificial Sequence
  Synthetic Polynucleotide
taatacgactcactatagggctccaggtatgggtcttcaatgggaagacgaacagaggagacgtcttatgattgaagacaacctggcggcagcgcaaaagatg

SEQ ID NO: 204976 - DNA, 103 bp, Artificial Sequence
  Synthetic Polynucleotide
taatacgactcactatagggcctctgagtcctccaggtatgggtcttcaaaacagaggagattgaagatgcatacctggaacctggcggcagcgcaaaagatg

SEQ ID NO: 204977 - DNA, 103 bp, Artificial Sequence
  Synthetic Polynucleotide
taatacgactcactatagggcctagggaggcctctgagtcctccaggtataacagaggagaatacctatgggactcagaaacctggcggcagcgcaaaagatg

SEQ ID NO: 204978 - DNA, 103 bp, Artificial Sequence
  Synthetic Polynucleotide
taatacgactcactatagggggccagggggcctagggaggcctctgagtcaacagaggagagactcaatggcctccctaaacctggcggcagcgcaaaagatg

SEQ ID NO: 204979 - DNA, 103 bp, Artificial Sequence
  Synthetic Polynucleotide
taatacgactcactatagggtgggttggtaggccagggggcctagggaggaacagaggagacctcccatggccccctggaacctggcggcagcgcaaaagatg

SEQ ID NO: 204980 - DNA, 103 bp, Artificial Sequence
  Synthetic Polynucleotide
taatacgactcactatagggctgaaggggatgggttggtaggccagggggaacagaggagaccccctatgctaccaaccaacctggcggcagcgcaaaagatg

SEQ ID NO: 204981 - DNA, 103 bp, Artificial Sequence
  Synthetic Polynucleotide
taatacgactcactataggggcccgactgactgaaggggatgggttggtaaacagaggagataccaaatgatccccttcaacctggcggcagcgcaaaagatg

SEQ ID NO: 204982 - DNA, 103 bp, Artificial Sequence
  Synthetic Polynucleotide
taatacgactcactatagggacttcacgttggggccgccgtccttcttccaacagaggagaggaagaatgacggcggccaacctggcggcagcgcaaaagatg

SEQ ID NO: 204983 - DNA, 103 bp, Artificial Sequence
  Synthetic Polynucleotide
taatacgactcactatagggtgagcggtgcattgctgacatgtttgccaaaacagaggagattggcaatgatgtcagcaaacctggcggcagcgcaaaagatg

SEQ ID NO: 204984 - DNA, 103 bp, Artificial Sequence
  Synthetic Polynucleotide
taatacgactcactatagggtaacagggttgcccgactgactgaaggggaaacagaggagatcccctatggtcagtcggaacctggcggcagcgcaaaagatg

SEQ ID NO: 204985 - DNA, 103 bp, Artificial Sequence
  Synthetic Polynucleotide
taatacgactcactatagggacagtgctcataacagggttgcccgactgaaacagaggagatcagtcatgcaaccctgtaacctggcggcagcgcaaaagatg

SEQ ID NO: 204986 - DNA, 103 bp, Artificial Sequence
  Synthetic Polynucleotide
taatacgactcactatagggcaggaaggcaacagtgctcataacagggttaacagaggagaaaccctatgatgagcactaacctggcggcagcgcaaaagatg

SEQ ID NO: 204987 - DNA, 103 bp, Artificial Sequence
  Synthetic Polynucleotide
taatacgactcactatagggcgacagaggccaggaaggcaacagtgctcaaacagaggagatgagcaatgttgccttccaacctggcggcagcgcaaaagatg

SEQ ID NO: 204988 - DNA, 103 bp, Artificial Sequence
  Synthetic Polynucleotide
taatacgactcactatagggcggggatcgacgacagaggccaggaaggcaaacagaggagatgccttatgggcctctgtaacctggcggcagcgcaaaagatg

SEQ ID NO: 204989 - DNA, 103 bp, Artificial Sequence
  Synthetic Polynucleotide
taatacgactcactatagggagaggcgactcggggatcgacgacagaggcaacagaggagagcctctatggtcgatcccaacctggcggcagcgcaaaagatg

SEQ ID NO: 204990 - DNA, 103 bp, Artificial Sequence
  Synthetic Polynucleotide
taatacgactcactatagggttgcagcagcagaggcgactcggggatcgaaacagaggagatcgatcatggagtcgcctaacctggcggcagcgcaaaagatg

SEQ ID NO: 204991 - DNA, 103 bp, Artificial Sequence
  Synthetic Polynucleotide
taatacgactcactatagggagggctgactttgcagcagcagaggcgactaacagaggagaagtcgcatgtgctgctgcaacctggcggcagcgcaaaagatg

SEQ ID NO: 204992 - DNA, 103 bp, Artificial Sequence
  Synthetic Polynucleotide
taatacgactcactataggggaactcctctagggctgactttgcagcagcaacagaggagagctgctatgaagtcagccaacctggcggcagcgcaaaagatg

SEQ ID NO: 204993 - DNA, 103 bp, Artificial Sequence
  Synthetic Polynucleotide
taatacgactcactatagggtcattttggagaactcctctagggctgactaacagaggagaagtcagatgtagaggagtaacctggcggcagcgcaaaagatg

SEQ ID NO: 204994 - DNA, 103 bp, Artificial Sequence
  Synthetic Polynucleotide
taatacgactcactatagggggcagtttagtgagcggtgcattgctgacaaacagaggagatgtcagatgtgcaccgctaacctggcggcagcgcaaaagatg

SEQ ID NO: 204995 - DNA, 103 bp, Artificial Sequence
  Synthetic Polynucleotide
taatacgactcactatagggacctcttccttcattttggagaactcctctaacagaggagaagaggaatgctccaaaataacctggcggcagcgcaaaagatg

SEQ ID NO: 204996 - DNA, 103 bp, Artificial Sequence
  Synthetic Polynucleotide
taatacgactcactatagggggccgtgggtacctcttccttcattttggaaacagaggagatccaaaatgaaggaagagaacctggcggcagcgcaaaagatg

SEQ ID NO: 204997 - DNA, 103 bp, Artificial Sequence
  Synthetic Polynucleotide
taatacgactcactatagggcctccaccaaggccgtgggtacctcttcctaacagaggagaaggaagatgtacccacggaacctggcggcagcgcaaaagatg

SEQ ID NO: 204998 - DNA, 103 bp, Artificial Sequence
  Synthetic Polynucleotide
taatacgactcactatagggcgaacatgggcctccaccaaggccgtgggtaacagaggagaacccacatgcttggtggaaacctggcggcagcgcaaaagatg

SEQ ID NO: 204999 - DNA, 103 bp, Artificial Sequence
  Synthetic Polynucleotide
taatacgactcactatagggttccacttttcgaacatgggcctccaccaaaacagaggagattggtgatggcccatgttaacctggcggcagcgcaaaagatg

SEQ ID NO: 205000 - DNA, 103 bp, Artificial Sequence
  Synthetic Polynucleotide
taatacgactcactatagggtggctgcttcttccacttttcgaacatgggaacagaggagacccatgatggaaaagtggaacctggcggcagcgcaaaagatg

SEQ ID NO: 205001 - DNA, 103 bp, Artificial Sequence
  Synthetic Polynucleotide
taatacgactcactatagggcctgttactttggctgcttcttccacttttaacagaggagaaaaagtatgagaagcagcaacctggcggcagcgcaaaagatg

SEQ ID NO: 205002 - DNA, 103 bp, Artificial Sequence
  Synthetic Polynucleotide
taatacgactcactataggggtccgccttgcctgttactttggctgcttcaacagaggagagaagcaatgaaagtaacaaacctggcggcagcgcaaaagatg

SEQ ID NO: 205003 - DNA, 103 bp, Artificial Sequence
  Synthetic Polynucleotide
taatacgactcactatagggcgaaggcagggtccgccttgcctgttacttaacagaggagaaagtaaatggcaaggcggaacctggcggcagcgcaaaagatg

SEQ ID NO: 205004 - DNA, 103 bp, Artificial Sequence
  Synthetic Polynucleotide
taatacgactcactatagggctttccagaccgaaggcagggtccgccttgaacagaggagacaaggcatgccctgccttaacctggcggcagcgcaaaagatg

SEQ ID NO: 205005 - DNA, 103 bp, Artificial Sequence
  Synthetic Polynucleotide
taatacgactcactatagggacatttgatcggcagtttagtgagcggtgcaacagaggagagcaccgatgactaaactgaacctggcggcagcgcaaaagatg

SEQ ID NO: 205006 - DNA, 103 bp, Artificial Sequence
  Synthetic Polynucleotide
taatacgactcactatagggaatgccactgctttccagaccgaaggcaggaacagaggagacctgccatgggtctggaaaacctggcggcagcgcaaaagatg

SEQ ID NO: 205007 - DNA, 103 bp, Artificial Sequence
  Synthetic Polynucleotide
taatacgactcactatagggtggttcctgcaatgccactgctttccagacaacagaggagagtctggatggcagtggcaaacctggcggcagcgcaaaagatg

SEQ ID NO: 205008 - DNA, 103 bp, Artificial Sequence
  Synthetic Polynucleotide
taatacgactcactatagggtcatcagaggtggttcctgcaatgccactgaacagaggagacagtggatgtgcaggaacaacctggcggcagcgcaaaagatg

SEQ ID NO: 205009 - DNA, 103 bp, Artificial Sequence
  Synthetic Polynucleotide
taatacgactcactatagggccgctcaggctcatcagaggtggttcctgcaacagaggagagcaggaatgacctctgataacctggcggcagcgcaaaagatg

SEQ ID NO: 205010 - DNA, 103 bp, Artificial Sequence
  Synthetic Polynucleotide
taatacgactcactatagggtctcctcaatccgctcaggctcatcagaggaacagaggagacctctgatgagcctgagcaacctggcggcagcgcaaaagatg

SEQ ID NO: 205011 - DNA, 103 bp, Artificial Sequence
  Synthetic Polynucleotide
taatacgactcactatagggtcattcccgctctcctcaatccgctcaggcaacagaggagagcctgaatggattgaggaaacctggcggcagcgcaaaagatg

SEQ ID NO: 205012 - DNA, 103 bp, Artificial Sequence
  Synthetic Polynucleotide
taatacgactcactatagggccgagcctcgtcattcccgctctcctcaataacagaggagaattgagatgagcgggaataacctggcggcagcgcaaaagatg

SEQ ID NO: 205013 - DNA, 103 bp, Artificial Sequence
  Synthetic Polynucleotide
taatacgactcactatagggggccttccacccgagcctcgtcattcccgcaacagaggagagcgggaatgacgaggctcaacctggcggcagcgcaaaagatg

SEQ ID NO: 205014 - DNA, 103 bp, Artificial Sequence
  Synthetic Polynucleotide
taatacgactcactatagggtctgtggcctggccttccacccgagcctcgaacagaggagacgaggcatgggtggaaggaacctggcggcagcgcaaaagatg

SEQ ID NO: 205015 - DNA, 103 bp, Artificial Sequence
  Synthetic Polynucleotide
taatacgactcactatagggcttcttctcatctgtggcctggccttccacaacagaggagagtggaaatgcaggccacaaacctggcggcagcgcaaaagatg

SEQ ID NO: 205016 - DNA, 103 bp, Artificial Sequence
  Synthetic Polynucleotide
taatacgactcactatagggaatctaggaaacatttgatcggcagtttagaacagaggagactaaacatgcgatcaaataacctggcggcagcgcaaaagatg

SEQ ID NO: 205017 - DNA, 103 bp, Artificial Sequence
  Synthetic Polynucleotide
taatacgactcactatagggccttgggctccttcttctcatctgtggcctaacagaggagaaggccaatgatgagaagaaacctggcggcagcgcaaaagatg

SEQ ID NO: 205018 - DNA, 103 bp, Artificial Sequence
  Synthetic Polynucleotide
taatacgactcactatagggtctcggggttccttgggctccttcttctcaaacagaggagatgagaaatgggagcccaaaacctggcggcagcgcaaaagatg

SEQ ID NO: 205019 - DNA, 103 bp, Artificial Sequence
  Synthetic Polynucleotide
taatacgactcactatagggaccccctccttctcggggttccttgggctcaacagaggagagagcccatggaaccccgaaacctggcggcagcgcaaaagatg

SEQ ID NO: 205020 - DNA, 103 bp, Artificial Sequence
  Synthetic Polynucleotide
taatacgactcactatagggcctctatagcaccccctccttctcggggttaacagaggagaaaccccatgaaggaggggaacctggcggcagcgcaaaagatg

SEQ ID NO: 205021 - DNA, 103 bp, Artificial Sequence
  Synthetic Polynucleotide
taatacgactcactatagggtttgcttcctcctctatagcaccccctcctaacagaggagaaggaggatgtgctatagaaacctggcggcagcgcaaaagatg

SEQ ID NO: 205022 - DNA, 103 bp, Artificial Sequence
  Synthetic Polynucleotide
taatacgactcactatagggggttttctcttttgcttcctcctctatagcaacagaggagagctataatggaggaagcaaacctggcggcagcgcaaaagatg

SEQ ID NO: 205023 - DNA, 103 bp, Artificial Sequence
  Synthetic Polynucleotide
taatacgactcactataggggagcctcgctggttttctcttttgcttcctaacagaggagaaggaagatgaagagaaaaaacctggcggcagcgcaaaagatg

SEQ ID NO: 205024 - DNA, 103 bp, Artificial Sequence
  Synthetic Polynucleotide
taatacgactcactatagggtccttcttgggagcctcgctggttttctctaacagaggagaagagaaatgcagcgaggcaacctggcggcagcgcaaaagatg

SEQ ID NO: 205025 - DNA, 103 bp, Artificial Sequence
  Synthetic Polynucleotide
taatacgactcactatagggtttctcctcatccttcttgggagcctcgctaacagaggagaagcgagatgcccaagaagaacctggcggcagcgcaaaagatg

SEQ ID NO: 205026 - DNA, 103 bp, Artificial Sequence
  Synthetic Polynucleotide
taatacgactcactatagggcttctttccctttctcctcatccttcttggaacagaggagaccaagaatgatgaggagaaacctggcggcagcgcaaaagatg

SEQ ID NO: 205027 - DNA, 103 bp, Artificial Sequence
  Synthetic Polynucleotide
taatacgactcactatagggcccgctttgaaatctaggaaacatttgatcaacagaggagagatcaaatgtttcctagaaacctggcggcagcgcaaaagatg

SEQ ID NO: 205028 - DNA, 103 bp, Artificial Sequence
  Synthetic Polynucleotide
taatacgactcactatagggtcactgtcgccttctttccctttctcctcaaacagaggagatgaggaatgagggaaagaaacctggcggcagcgcaaaagatg

SEQ ID NO: 205029 - DNA, 103 bp, Artificial Sequence
  Synthetic Polynucleotide
taatacgactcactatagggggactccttctcactgtcgccttctttcccaacagaggagagggaaaatgggcgacagtaacctggcggcagcgcaaaagatg

SEQ ID NO: 205030 - DNA, 103 bp, Artificial Sequence
  Synthetic Polynucleotide
taatacgactcactatagggcactcttctcggactccttctcactgtcgcaacagaggagagcgacaatgagaaggagtaacctggcggcagcgcaaaagatg

SEQ ID NO: 205031 - DNA, 103 bp, Artificial Sequence
  Synthetic Polynucleotide
taatacgactcactataggggggtctccatcactcttctcggactccttcaacagaggagagaaggaatgcgagaagagaacctggcggcagcgcaaaagatg

SEQ ID NO: 205032 - DNA, 103 bp, Artificial Sequence
  Synthetic Polynucleotide
taatacgactcactatagggatcgactattgggtctccatcactcttctcaacagaggagagagaagatggatggagacaacctggcggcagcgcaaaagatg

SEQ ID NO: 205033 - DNA, 103 bp, Artificial Sequence
  Synthetic Polynucleotide
taatacgactcactatagggccttctcaggatcgactattgggtctccataacagaggagaatggagatgcaatagtcgaacctggcggcagcgcaaaagatg

SEQ ID NO: 205034 - DNA, 103 bp, Artificial Sequence
  Synthetic Polynucleotide
taatacgactcactatagggggctccttctccttctcaggatcgactattaacagaggagaaatagtatgtcctgagaaaacctggcggcagcgcaaaagatg

SEQ ID NO: 205035 - DNA, 103 bp, Artificial Sequence
  Synthetic Polynucleotide
taatacgactcactatagggcccttcctttggctccttctccttctcaggaacagaggagacctgagatggagaaggagaacctggcggcagcgcaaaagatg

SEQ ID NO: 205036 - DNA, 103 bp, Artificial Sequence
  Synthetic Polynucleotide
taatacgactcactatagggcttcctcctgcccttcctttggctccttctaacagaggagaagaaggatgcaaaggaagaacctggcggcagcgcaaaagatg

SEQ ID NO: 205037 - DNA, 103 bp, Artificial Sequence
  Synthetic Polynucleotide
taatacgactcactatagggtccttcagcacttcctcctgcccttcctttaacagaggagaaaaggaatggcaggaggaaacctggcggcagcgcaaaagatg

SEQ ID NO: 205038 - DNA, 103 bp, Artificial Sequence
  Synthetic Polynucleotide
taatacgactcactatagggcaaggagcctcccgctttgaaatctaggaaaacagaggagattcctaatgttcaaagcgaacctggcggcagcgcaaaagatg

SEQ ID NO: 205039 - DNA, 103 bp, Artificial Sequence
  Synthetic Polynucleotide
taatacgactcactatagggctccaccacttccttcagcacttcctcctgaacagaggagacaggagatggtgctgaagaacctggcggcagcgcaaaagatg

SEQ ID NO: 205040 - DNA, 103 bp, Artificial Sequence
  Synthetic Polynucleotide
taatacgactcactatagggccccctcagactccaccacttccttcagcaaacagaggagatgctgaatgaagtggtggaacctggcggcagcgcaaaagatg

SEQ ID NO: 205041 - DNA, 103 bp, Artificial Sequence
  Synthetic Polynucleotide
taatacgactcactataggggtcttcctttccccctcagactccaccactaacagaggagaagtggtatggtctgagggaacctggcggcagcgcaaaagatg

SEQ ID NO: 205042 - DNA, 103 bp, Artificial Sequence
  Synthetic Polynucleotide
taatacgactcactatagggctccacctttgtcttcctttccccctcagaaacagaggagatctgagatggaaaggaagaacctggcggcagcgcaaaagatg

SEQ ID NO: 205043 - DNA, 103 bp, Artificial Sequence
  Synthetic Polynucleotide
taatacgactcactatagggcaatgtcccgctccacctttgtcttcctttaacagaggagaaaaggaatgcaaaggtggaacctggcggcagcgcaaaagatg

SEQ ID NO: 205044 - DNA, 103 bp, Artificial Sequence
  Synthetic Polynucleotide
taatacgactcactatagggttgccctcgccaatgtcccgctccacctttaacagaggagaaaaggtatggcgggacataacctggcggcagcgcaaaagatg

SEQ ID NO: 205045 - DNA, 103 bp, Artificial Sequence
  Synthetic Polynucleotide
taatacgactcactatagggggtggagaggttgccctcgccaatgtcccgaacagaggagacgggacatgggcgagggcaacctggcggcagcgcaaaagatg

SEQ ID NO: 205046 - DNA, 103 bp, Artificial Sequence
  Synthetic Polynucleotide
taatacgactcactatagggcggcagcagcggtggagaggttgccctcgcaacagaggagagcgaggatgacctctccaaacctggcggcagcgcaaaagatg

SEQ ID NO: 205047 - DNA, 103 bp, Artificial Sequence
  Synthetic Polynucleotide
taatacgactcactataggggccagggcggcggcagcagcggtggagaggaacagaggagacctctcatgcgctgctgcaacctggcggcagcgcaaaagatg

SEQ ID NO: 205048 - DNA, 103 bp, Artificial Sequence
  Synthetic Polynucleotide
taatacgactcactatagggtgcggcggcggccagggcggcggcagcagcaacagaggagagctgctatggccgccctgaacctggcggcagcgcaaaagatg

SEQ ID NO: 205049 - DNA, 103 bp, Artificial Sequence
  Synthetic Polynucleotide
taatacgactcactataggggaatgtggcacaaggagcctcccgctttgaaacagaggagatcaaagatggaggctcctaacctggcggcagcgcaaaagatg

SEQ ID NO: 205050 - DNA, 103 bp, Artificial Sequence
  Synthetic Polynucleotide
taatacgactcactatagggtagctttcactgcggcggcggccagggcggaacagaggagaccgcccatgccgccgccgaacctggcggcagcgcaaaagatg

SEQ ID NO: 205051 - DNA, 103 bp, Artificial Sequence
  Synthetic Polynucleotide
taatacgactcactataggggccaagtgcttagctttcactgcggcggcgaacagaggagacgccgcatgagtgaaagcaacctggcggcagcgcaaaagatg

SEQ ID NO: 205052 - DNA, 103 bp, Artificial Sequence
  Synthetic Polynucleotide
taatacgactcactatagggctcaacagcagccaagtgcttagctttcacaacagaggagagtgaaaatgaagcacttgaacctggcggcagcgcaaaagatg

SEQ ID NO: 205053 - DNA, 103 bp, Artificial Sequence
  Synthetic Polynucleotide
taatacgactcactatagggtcttcctttcctcaacagcagccaagtgctaacagaggagaagcactatgctgctgttgaacctggcggcagcgcaaaagatg

SEQ ID NO: 205054 - DNA, 103 bp, Artificial Sequence
  Synthetic Polynucleotide
taatacgactcactatagggaaagatttgatcttcctttcctcaacagcaaacagaggagatgctgtatgggaaaggaaaacctggcggcagcgcaaaagatg

SEQ ID NO: 205055 - DNA, 103 bp, Artificial Sequence
  Synthetic Polynucleotide
taatacgactcactatagggcagggccaccaaagatttgatcttcctttcaacagaggagagaaaggatgatcaaatctaacctggcggcagcgcaaaagatg

SEQ ID NO: 205056 - DNA, 103 bp, Artificial Sequence
  Synthetic Polynucleotide
taatacgactcactatagggtctccaccagcagggccaccaaagatttgaaacagaggagatcaaatatgtggtggcccaacctggcggcagcgcaaaagatg

SEQ ID NO: 205057 - DNA, 103 bp, Artificial Sequence
  Synthetic Polynucleotide
taatacgactcactatagggttcatctgggtctccaccagcagggccaccaacagaggagaggtggcatggctggtggaaacctggcggcagcgcaaaagatg

SEQ ID NO: 205058 - DNA, 103 bp, Artificial Sequence
  Synthetic Polynucleotide
taatacgactcactatagggctccaactttttcatctgggtctccaccagaacagaggagactggtgatgacccagatgaacctggcggcagcgcaaaagatg

SEQ ID NO: 205059 - DNA, 103 bp, Artificial Sequence
  Synthetic Polynucleotide
taatacgactcactataggggaagtttgatctccaactttttcatctgggaacagaggagacccagaatgaaaagttggaacctggcggcagcgcaaaagatg

SEQ ID NO: 205060 - DNA, 103 bp, Artificial Sequence
  Synthetic Polynucleotide
taatacgactcactataggggcagctgcaagaatgtggcacaaggagcctaacagaggagaaggctcatggtgccacataacctggcggcagcgcaaaagatg

SEQ ID NO: 205061 - DNA, 103 bp, Artificial Sequence
  Synthetic Polynucleotide
taatacgactcactatagggtcaaagtgccgaagtttgatctccaactttaacagaggagaaaagttatggatcaaactaacctggcggcagcgcaaaagatg

SEQ ID NO: 205062 - DNA, 103 bp, Artificial Sequence
  Synthetic Polynucleotide
taatacgactcactatagggctccagctcctcaaagtgccgaagtttgataacagaggagaatcaaaatgcggcactttaacctggcggcagcgcaaaagatg

SEQ ID NO: 205063 - DNA, 103 bp, Artificial Sequence
  Synthetic Polynucleotide
taatacgactcactatagggccatgatagtctccagctcctcaaagtgccaacagaggagaggcactatgaggagctggaacctggcggcagcgcaaaagatg

SEQ ID NO: 205064 - DNA, 103 bp, Artificial Sequence
  Synthetic Polynucleotide
taatacgactcactatagggcgctcccggtccatgatagtctccagctccaacagaggagaggagctatggactatcataacctggcggcagcgcaaaagatg

SEQ ID NO: 205065 - DNA, 103 bp, Artificial Sequence
  Synthetic Polynucleotide
taatacgactcactatagggcagtgcttctcgctcccggtccatgatagtaacagaggagaactatcatggaccgggagaacctggcggcagcgcaaaagatg

SEQ ID NO: 205066 - DNA, 103 bp, Artificial Sequence
  Synthetic Polynucleotide
taatacgactcactatagggtctgatactccagtgcttctcgctcccggtaacagaggagaaccgggatggagaagcacaacctggcggcagcgcaaaagatg

SEQ ID NO: 205067 - DNA, 103 bp, Artificial Sequence
  Synthetic Polynucleotide
taatacgactcactatagggagctgctgcctctgatactccagtgcttctaacagaggagaagaagcatgggagtatcaaacctggcggcagcgcaaaagatg

SEQ ID NO: 205068 - DNA, 103 bp, Artificial Sequence
  Synthetic Polynucleotide
taatacgactcactataggggtcggccaggagctgctgcctctgatactcaacagaggagagagtatatgaggcagcagaacctggcggcagcgcaaaagatg

SEQ ID NO: 205069 - DNA, 103 bp, Artificial Sequence
  Synthetic Polynucleotide
taatacgactcactatagggaggcttgtctgtcggccaggagctgctgccaacagaggagaggcagcatgtcctggccgaacctggcggcagcgcaaaagatg

SEQ ID NO: 205070 - DNA, 103 bp, Artificial Sequence
  Synthetic Polynucleotide
taatacgactcactatagggtccatgtggaaggcttgtctgtcggccaggaacagaggagacctggcatgcagacaagcaacctggcggcagcgcaaaagatg

SEQ ID NO: 205071 - DNA, 103 bp, Artificial Sequence
  Synthetic Polynucleotide
taatacgactcactataggggaatttgtaggcagctgcaagaatgtggcaaacagaggagatgccacatgcttgcagctaacctggcggcagcgcaaaagatg

SEQ ID NO: 205072 - DNA, 103 bp, Artificial Sequence
  Synthetic Polynucleotide
taatacgactcactatagggcttcagctgctccatgtggaaggcttgtctaacagaggagaagacaaatgttccacatgaacctggcggcagcgcaaaagatg

SEQ ID NO: 205073 - DNA, 103 bp, Artificial Sequence
  Synthetic Polynucleotide
taatacgactcactatagggtctccgcatacttcagctgctccatgtggaaacagaggagatccacaatgagcagctgaaacctggcggcagcgcaaaagatg

SEQ ID NO: 205074 - DNA, 103 bp, Artificial Sequence
  Synthetic Polynucleotide
taatacgactcactatagggcgagccctcatctccgcatacttcagctgcaacagaggagagcagctatggtatgcggaaacctggcggcagcgcaaaagatg

SEQ ID NO: 205075 - DNA, 103 bp, Artificial Sequence
  Synthetic Polynucleotide
taatacgactcactataggggtgctgctgccgagccctcatctccgcataaacagaggagatatgcgatgatgagggctaacctggcggcagcgcaaaagatg

SEQ ID NO: 205076 - DNA, 103 bp, Artificial Sequence
  Synthetic Polynucleotide
taatacgactcactatagggtctgttggaagtgctgctgccgagccctcaaacagaggagatgagggatgggcagcagcaacctggcggcagcgcaaaagatg

SEQ ID NO: 205077 - DNA, 103 bp, Artificial Sequence
  Synthetic Polynucleotide
taatacgactcactatagggtgttggtgcatctgttggaagtgctgctgcaacagaggagagcagcaatgcttccaacaaacctggcggcagcgcaaaagatg

SEQ ID NO: 205078 - DNA, 103 bp, Artificial Sequence
  Synthetic Polynucleotide
taatacgactcactatagggctgctgctgctgttggtgcatctgttggaaaacagaggagattccaaatgatgcaccaaaacctggcggcagcgcaaaagatg

SEQ ID NO: 205079 - DNA, 103 bp, Artificial Sequence
  Synthetic Polynucleotide
taatacgactcactatagggctggtggtggctgctgctgctgttggtgcaaacagaggagatgcaccatgagcagcagcaacctggcggcagcgcaaaagatg

SEQ ID NO: 205080 - DNA, 103 bp, Artificial Sequence
  Synthetic Polynucleotide
taatacgactcactataggggggggcagggctggtggtggctgctgctgcaacagaggagagcagcaatggccaccaccaacctggcggcagcgcaaaagatg

SEQ ID NO: 205081 - DNA, 103 bp, Artificial Sequence
  Synthetic Polynucleotide
taatacgactcactatagggctgggagcctgggggcagggctggtggtggaacagaggagaccaccaatggccctgcccaacctggcggcagcgcaaaagatg

SEQ ID NO: 205082 - DNA, 103 bp, Artificial Sequence
  Synthetic Polynucleotide
taatacgactcactatagggggtcactcttgaatttgtaggcagctgcaaaacagaggagattgcagatgcctacaaataacctggcggcagcgcaaaagatg

SEQ ID NO: 205083 - DNA, 103 bp, Artificial Sequence
  Synthetic Polynucleotide
taatacgactcactataggggggggataggctgggagcctgggggcagggaacagaggagaccctgcatgcaggctcccaacctggcggcagcgcaaaagatg

SEQ ID NO: 205084 - DNA, 103 bp, Artificial Sequence
  Synthetic Polynucleotide
taatacgactcactataggggcccctgttggggggataggctgggagcctaacagaggagaaggctcatggcctatcccaacctggcggcagcgcaaaagatg

SEQ ID NO: 205085 - DNA, 103 bp, Artificial Sequence
  Synthetic Polynucleotide
taatacgactcactatagggtggcccagcagcccctgttggggggataggaacagaggagacctatcatgccaacagggaacctggcggcagcgcaaaagatg

SEQ ID NO: 205086 - DNA, 103 bp, Artificial Sequence
  Synthetic Polynucleotide
taatacgactcactatagggggactgcgggtggcccagcagcccctgttgaacagaggagacaacagatgctgctgggcaacctggcggcagcgcaaaagatg

SEQ ID NO: 205087 - DNA, 103 bp, Artificial Sequence
  Synthetic Polynucleotide
taatacgactcactataggggccaagccatggactgcgggtggcccagcaaacagaggagatgctggatgacccgcagtaacctggcggcagcgcaaaagatg

SEQ ID NO: 205088 - DNA, 103 bp, Artificial Sequence
  Synthetic Polynucleotide
taatacgactcactatagggtggagccacagccaagccatggactgcgggaacagaggagacccgcaatgcatggcttgaacctggcggcagcgcaaaagatg

SEQ ID NO: 205089 - DNA, 103 bp, Artificial Sequence
  Synthetic Polynucleotide
taatacgactcactatagggctacagaggctggagccacagccaagccataacagaggagaatggctatgctgtggctcaacctggcggcagcgcaaaagatg

SEQ ID NO: 205090 - DNA, 103 bp, Artificial Sequence
  Synthetic Polynucleotide
taatacgactcactatagggggagcagggactacagaggctggagccacaaacagaggagatgtggcatgagcctctgtaacctggcggcagcgcaaaagatg

SEQ ID NO: 205091 - DNA, 103 bp, Artificial Sequence
  Synthetic Polynucleotide
taatacgactcactatagggactgccagcaggagcagggactacagaggcaacagaggagagcctctatggtccctgctaacctggcggcagcgcaaaagatg

SEQ ID NO: 205092 - DNA, 103 bp, Artificial Sequence
  Synthetic Polynucleotide
taatacgactcactataggggaggggccccactgccagcaggagcagggaaacagaggagatccctgatgctgctggcaaacctggcggcagcgcaaaagatg

SEQ ID NO: 205093 - DNA, 103 bp, Artificial Sequence
  Synthetic Polynucleotide
taatacgactcactataggggcctcgtagtacttcacgttggggccgccgaacagaggagacggcggatgcaacgtgaaaacctggcggcagcgcaaaagatg

SEQ ID NO: 205094 - DNA, 103 bp, Artificial Sequence
  Synthetic Polynucleotide
taatacgactcactatagggcgccatccctggtcactcttgaatttgtagaacagaggagactacaaatgcaagagtgaaacctggcggcagcgcaaaagatg

SEQ ID NO: 205095 - DNA, 103 bp, Artificial Sequence
  Synthetic Polynucleotide
taatacgactcactatagggaaacttcctggaggggccccactgccagcaaacagaggagatgctggatgtggggccccaacctggcggcagcgcaaaagatg

SEQ ID NO: 205096 - DNA, 103 bp, Artificial Sequence
  Synthetic Polynucleotide
taatacgactcactatagggagaagggcccaaacttcctggaggggccccaacagaggagaggggccatgccaggaagtaacctggcggcagcgcaaaagatg

SEQ ID NO: 205097 - DNA, 103 bp, Artificial Sequence
  Synthetic Polynucleotide
taatacgactcactatagggcaatctgttcagaagggcccaaacttcctgaacagaggagacaggaaatgtgggcccttaacctggcggcagcgcaaaagatg

SEQ ID NO: 205098 - DNA, 103 bp, Artificial Sequence
  Synthetic Polynucleotide
taatacgactcactatagggcctgcctgcccaatctgttcagaagggcccaacagaggagagggcccatgtgaacagataacctggcggcagcgcaaaagatg

SEQ ID NO: 205099 - DNA, 103 bp, Artificial Sequence
  Synthetic Polynucleotide
taatacgactcactatagggtgcagttgaccctgcctgcccaatctgttcaacagaggagagaacagatggggcaggcaaacctggcggcagcgcaaaagatg

SEQ ID NO: 205100 - DNA, 103 bp, Artificial Sequence
  Synthetic Polynucleotide
taatacgactcactataggggctgtggccctgcagttgaccctgcctgccaacagaggagaggcaggatgggtcaactgaacctggcggcagcgcaaaagatg

SEQ ID NO: 205101 - DNA, 103 bp, Artificial Sequence
  Synthetic Polynucleotide
taatacgactcactatagggggttgctgctgctgtggccctgcagttgacaacagaggagagtcaacatgagggccacaaacctggcggcagcgcaaaagatg

SEQ ID NO: 205102 - DNA, 103 bp, Artificial Sequence
  Synthetic Polynucleotide
taatacgactcactatagggggctccagctggttgctgctgctgtggcccaacagaggagagggccaatgcagcagcaaaacctggcggcagcgcaaaagatg

SEQ ID NO: 205103 - DNA, 103 bp, Artificial Sequence
  Synthetic Polynucleotide
taatacgactcactatagggcaggctggggggctccagctggttgctgctaacagaggagaagcagcatgcagctggagaacctggcggcagcgcaaaagatg

SEQ ID NO: 205104 - DNA, 103 bp, Artificial Sequence
  Synthetic Polynucleotide
taatacgactcactataggggggactgccccaggctggggggctccagctaacagaggagaagctggatgcccccagccaacctggcggcagcgcaaaagatg

SEQ ID NO: 205105 - DNA, 103 bp, Artificial Sequence
  Synthetic Polynucleotide
taatacgactcactatagggatcgtaacgccgccatccctggtcactcttaacagaggagaaagagtatgcagggatggaacctggcggcagcgcaaaagatg

SEQ ID NO: 205106 - DNA, 103 bp, Artificial Sequence
  Synthetic Polynucleotide
taatacgactcactatagggaacccctggtgggactgccccaggctggggaacagaggagaccccagatgggggcagtcaacctggcggcagcgcaaaagatg

SEQ ID NO: 205107 - DNA, 103 bp, Artificial Sequence
  Synthetic Polynucleotide
taatacgactcactatagggcaggggggggaacccctggtgggactgcccaacagaggagagggcagatgcaccaggggaacctggcggcagcgcaaaagatg

SEQ ID NO: 205108 - DNA, 103 bp, Artificial Sequence
  Synthetic Polynucleotide
taatacgactcactatagggccatggggtccaggggggggaacccctggtaacagaggagaaccaggatgtccccccccaacctggcggcagcgcaaaagatg

SEQ ID NO: 205109 - DNA, 103 bp, Artificial Sequence
  Synthetic Polynucleotide
taatacgactcactatagggcggtgaggggccatggggtccaggggggggaacagaggagaccccccatgggaccccataacctggcggcagcgcaaaagatg

SEQ ID NO: 205110 - DNA, 103 bp, Artificial Sequence
  Synthetic Polynucleotide
taatacgactcactatagggggttggggaacggtgaggggccatggggtcaacagaggagagaccccatggcccctcacaacctggcggcagcgcaaaagatg

SEQ ID NO: 205111 - DNA, 103 bp, Artificial Sequence
  Synthetic Polynucleotide
taatacgactcactatagggggagtttgttggttggggaacggtgaggggaacagaggagacccctcatggttccccaaaacctggcggcagcgcaaaagatg

SEQ ID NO: 205112 - DNA, 103 bp, Artificial Sequence
  Synthetic Polynucleotide
taatacgactcactatagggcattgagggaggagtttgttggttggggaaaacagaggagattccccatgcaacaaactaacctggcggcagcgcaaaagatg

SEQ ID NO: 205113 - DNA, 103 bp, Artificial Sequence
  Synthetic Polynucleotide
taatacgactcactatagggcccctggcatcattgagggaggagtttgttaacagaggagaaacaaaatgctccctcaaaacctggcggcagcgcaaaagatg

SEQ ID NO: 205114 - DNA, 103 bp, Artificial Sequence
  Synthetic Polynucleotide
taatacgactcactatagggcctggcactgcccctggcatcattgagggaaacagaggagatccctcatggatgccaggaacctggcggcagcgcaaaagatg

SEQ ID NO: 205115 - DNA, 103 bp, Artificial Sequence
  Synthetic Polynucleotide
taatacgactcactataggggtgcccgctgcctggcactgcccctggcataacagaggagaatgccaatggcagtgccaaacctggcggcagcgcaaaagatg

SEQ ID NO: 205116 - DNA, 103 bp, Artificial Sequence
  Synthetic Polynucleotide
taatacgactcactataggggattctggaaatcgtaacgccgccatccctaacagaggagaagggatatgggcgttacgaacctggcggcagcgcaaaagatg

SEQ ID NO: 205117 - DNA, 103 bp, Artificial Sequence
  Synthetic Polynucleotide
taatacgactcactatagggccacgcctgggtgcccgctgcctggcactgaacagaggagacagtgcatggcagcgggcaacctggcggcagcgcaaaagatg

SEQ ID NO: 205118 - DNA, 103 bp, Artificial Sequence
  Synthetic Polynucleotide
taatacgactcactataggggcattacccgccacgcctgggtgcccgctgaacagaggagacagcggatgcccaggcgtaacctggcggcagcgcaaaagatg

SEQ ID NO: 205119 - DNA, 103 bp, Artificial Sequence
  Synthetic Polynucleotide
taatacgactcactatagggacccaaaggagcattacccgccacgcctggaacagaggagaccaggcatggcgggtaataacctggcggcagcgcaaaagatg

SEQ ID NO: 205120 - DNA, 103 bp, Artificial Sequence
  Synthetic Polynucleotide
taatacgactcactatagggcaaaaggcaaacccaaaggagcattacccgaacagaggagacgggtaatgctcctttggaacctggcggcagcgcaaaagatg

SEQ ID NO: 205121 - DNA, 103 bp, Artificial Sequence
  Synthetic Polynucleotide
taatacgactcactatagggggcggcatgccaaaaggcaaacccaaaggaaacagaggagatcctttatgtttgcctttaacctggcggcagcgcaaaagatg

SEQ ID NO: 205122 - DNA, 103 bp, Artificial Sequence
  Synthetic Polynucleotide
taatacgactcactatagggaggaggaggaggcggcatgccaaaaggcaaaacagaggagattgcctatgggcatgccgaacctggcggcagcgcaaaagatg

SEQ ID NO: 205123 - DNA, 103 bp, Artificial Sequence
  Synthetic Polynucleotide
taatacgactcactataggggagcaggaggaggaggaggaggcggcatgcaacagaggagagcatgcatgctcctcctcaacctggcggcagcgcaaaagatg

SEQ ID NO: 205124 - DNA, 103 bp, Artificial Sequence
  Synthetic Polynucleotide
taatacgactcactatagggatgatggatggagcaggaggaggaggaggaaacagaggagatcctccatgtcctcctgcaacctggcggcagcgcaaaagatg

SEQ ID NO: 205125 - DNA, 103 bp, Artificial Sequence
  Synthetic Polynucleotide
taatacgactcactatagggaccaaatgggatgatggatggagcaggaggaacagaggagacctcctatgccatccatcaacctggcggcagcgcaaaagatg

SEQ ID NO: 205126 - DNA, 103 bp, Artificial Sequence
  Synthetic Polynucleotide
taatacgactcactatagggcagctagactaccaaatgggatgatggatgaacagaggagacatccaatgtcccatttgaacctggcggcagcgcaaaagatg

SEQ ID NO: 205127 - DNA, 103 bp, Artificial Sequence
  Synthetic Polynucleotide
taatacgactcactatagggatgcgtgatggattctggaaatcgtaacgcaacagaggagagcgttaatgtttccagaaaacctggcggcagcgcaaaagatg

SEQ ID NO: 205128 - DNA, 103 bp, Artificial Sequence
  Synthetic Polynucleotide
taatacgactcactatagggctgatggagtcagctagactaccaaatgggaacagaggagacccattatgtagtctagcaacctggcggcagcgcaaaagatg

SEQ ID NO: 205129 - DNA, 103 bp, Artificial Sequence
  Synthetic Polynucleotide
taatacgactcactataggggaggttaatactgatggagtcagctagactaacagaggagaagtctaatggactccatcaacctggcggcagcgcaaaagatg

SEQ ID NO: 205130 - DNA, 103 bp, Artificial Sequence
  Synthetic Polynucleotide
taatacgactcactataggggaggagcggggaggttaatactgatggagtaacagaggagaactccaatggtattaaccaacctggcggcagcgcaaaagatg

SEQ ID NO: 205131 - DNA, 103 bp, Artificial Sequence
  Synthetic Polynucleotide
taatacgactcactatagggtgcaggttaggaggagcggggaggttaataaacagaggagatattaaatgccccgctccaacctggcggcagcgcaaaagatg

SEQ ID NO: 205132 - DNA, 103 bp, Artificial Sequence
  Synthetic Polynucleotide
taatacgactcactataggggtgatgcccatgcaggttaggaggagcgggaacagaggagacccgctatgcctaacctgaacctggcggcagcgcaaaagatg

SEQ ID NO: 205133 - DNA, 103 bp, Artificial Sequence
  Synthetic Polynucleotide
taatacgactcactatagggggagatggtggtgatgcccatgcaggttagaacagaggagactaaccatgatgggcatcaacctggcggcagcgcaaaagatg

SEQ ID NO: 205134 - DNA, 103 bp, Artificial Sequence
  Synthetic Polynucleotide
taatacgactcactatagggggggcgaacgggagatggtggtgatgcccaaacagaggagatgggcaatgccaccatctaacctggcggcagcgcaaaagatg

SEQ ID NO: 205135 - DNA, 103 bp, Artificial Sequence
  Synthetic Polynucleotide
taatacgactcactataggggagagtgcccggggcgaacgggagatggtgaacagaggagacaccatatgccgttcgccaacctggcggcagcgcaaaagatg

SEQ ID NO: 205136 - DNA, 103 bp, Artificial Sequence
  Synthetic Polynucleotide
taatacgactcactatagggtaggtggggggagagtgcccggggcgaacgaacagaggagacgttcgatgcgggcactcaacctggcggcagcgcaaaagatg

SEQ ID NO: 205137 - DNA, 103 bp, Artificial Sequence
  Synthetic Polynucleotide
taatacgactcactatagggacaggcaggttaggtggggggagagtgcccaacagaggagagggcacatgccccccaccaacctggcggcagcgcaaaagatg

SEQ ID NO: 205138 - DNA, 103 bp, Artificial Sequence
  Synthetic Polynucleotide
taatacgactcactatagggattgcggtccatgcgtgatggattctggaaaacagaggagattccagatgccatcacgcaacctggcggcagcgcaaaagatg

SEQ ID NO: 205139 - DNA, 103 bp, Artificial Sequence
  Synthetic Polynucleotide
taatacgactcactatagggcgccatggacacaggcaggttaggtgggggaacagaggagacccccaatgaacctgcctaacctggcggcagcgcaaaagatg

SEQ ID NO: 205140 - DNA, 103 bp, Artificial Sequence
  Synthetic Polynucleotide
taatacgactcactataggggtagagggttcgccatggacacaggcaggtaacagaggagaacctgcatgtgtccatggaacctggcggcagcgcaaaagatg

SEQ ID NO: 205141 - DNA, 103 bp, Artificial Sequence
  Synthetic Polynucleotide
taatacgactcactatagggaggttaggatgtagagggttcgccatggacaacagaggagagtccatatggaaccctctaacctggcggcagcgcaaaagatg

SEQ ID NO: 205142 - DNA, 103 bp, Artificial Sequence
  Synthetic Polynucleotide
taatacgactcactatagggggtcgccggcaggttaggatgtagagggttaacagaggagaaaccctatgcatcctaacaacctggcggcagcgcaaaagatg

SEQ ID NO: 205143 - DNA, 103 bp, Artificial Sequence
  Synthetic Polynucleotide
taatacgactcactataggggcatggtggtggtcgccggcaggttaggataacagaggagaatcctaatgtgccggcgaaacctggcggcagcgcaaaagatg

SEQ ID NO: 205144 - DNA, 103 bp, Artificial Sequence
  Synthetic Polynucleotide
taatacgactcactatagggaaggaagatggcatggtggtggtcgccggcaacagaggagagccggcatgcaccaccataacctggcggcagcgcaaaagatg

SEQ ID NO: 205145 - DNA, 103 bp, Artificial Sequence
  Synthetic Polynucleotide
taatacgactcactatagggcccgagaggcaaggaagatggcatggtggtaacagaggagaaccaccatgccatcttccaacctggcggcagcgcaaaagatg

SEQ ID NO: 205146 - DNA, 103 bp, Artificial Sequence
  Synthetic Polynucleotide
taatacgactcactatagggcgagccccggcccgagaggcaaggaagatgaacagaggagacatcttatgtgcctctcgaacctggcggcagcgcaaaagatg

SEQ ID NO: 205147 - DNA, 103 bp, Artificial Sequence
  Synthetic Polynucleotide
taatacgactcactataggggcggcggatccgagccccggcccgagaggcaacagaggagagcctctatggccggggctaacctggcggcagcgcaaaagatg

SEQ ID NO: 205148 - DNA, 103 bp, Artificial Sequence
  Synthetic Polynucleotide
taatacgactcactataggggctttgggctgcggcggatccgagccccggaacagaggagaccggggatgggatccgccaacctggcggcagcgcaaaagatg

SEQ ID NO: 205149 - DNA, 103 bp, Artificial Sequence
  Synthetic Polynucleotide
taatacgactcactatagggacatttccacattgcggtccatgcgtgatgaacagaggagacatcacatgtggaccgcaaacctggcggcagcgcaaaagatg

SEQ ID NO: 205150 - DNA, 103 bp, Artificial Sequence
  Synthetic Polynucleotide
taatacgactcactatagggcaatggcagggctttgggctgcggcggatcaacagaggagagatccgatgcagcccaaaaacctggcggcagcgcaaaagatg

SEQ ID NO: 205151 - DNA, 103 bp, Artificial Sequence
  Synthetic Polynucleotide
taatacgactcactatagggacagctgccacaatggcagggctttgggctaacagaggagaagcccaatgccctgccataacctggcggcagcgcaaaagatg

SEQ ID NO: 205152 - DNA, 103 bp, Artificial Sequence
  Synthetic Polynucleotide
taatacgactcactataggggttgccctgaacagctgccacaatggcaggaacagaggagacctgccatggtggcagctaacctggcggcagcgcaaaagatg

SEQ ID NO: 205153 - DNA, 103 bp, Artificial Sequence
  Synthetic Polynucleotide
taatacgactcactatagggtgggcaggaggttgccctgaacagctgccaaacagaggagatggcagatgttcagggcaaacctggcggcagcgcaaaagatg

SEQ ID NO: 205154 - DNA, 103 bp, Artificial Sequence
  Synthetic Polynucleotide
taatacgactcactataggggggctggcactgggcaggaggttgccctgaaacagaggagatcagggatgcctcctgccaacctggcggcagcgcaaaagatg

SEQ ID NO: 205155 - DNA, 103 bp, Artificial Sequence
  Synthetic Polynucleotide
taatacgactcactataggggtctggcagtgggctggcactgggcaggagaacagaggagactcctgatgagtgccagcaacctggcggcagcgcaaaagatg

SEQ ID NO: 205156 - DNA, 103 bp, Artificial Sequence
  Synthetic Polynucleotide
taatacgactcactataggggggtgcctgggtctggcagtgggctggcacaacagaggagagtgccaatgcactgccagaacctggcggcagcgcaaaagatg

SEQ ID NO: 205157 - DNA, 103 bp, Artificial Sequence
  Synthetic Polynucleotide
taatacgactcactatagggggaggcaggggggtgcctgggtctggcagtaacagaggagaactgccatgcccaggcacaacctggcggcagcgcaaaagatg

SEQ ID NO: 205158 - DNA, 103 bp, Artificial Sequence
  Synthetic Polynucleotide
taatacgactcactatagggtgtggggtctggaggcaggggggtgcctggaacagaggagaccaggcatgcccctgcctaacctggcggcagcgcaaaagatg

SEQ ID NO: 205159 - DNA, 103 bp, Artificial Sequence
  Synthetic Polynucleotide
taatacgactcactatagggggctcggggctgtggggtctggaggcagggaacagaggagaccctgcatgcagaccccaaacctggcggcagcgcaaaagatg

SEQ ID NO: 205160 - DNA, 103 bp, Artificial Sequence
  Synthetic Polynucleotide
taatacgactcactatagggatggtcataaacatttccacattgcggtccaacagaggagaggaccgatgtgtggaaataacctggcggcagcgcaaaagatg

SEQ ID NO: 205161 - DNA, 103 bp, Artificial Sequence
  Synthetic Polynucleotide
taatacgactcactatagggaccgtgcctgggctcggggctgtggggtctaacagaggagaagacccatgagccccgagaacctggcggcagcgcaaaagatg

SEQ ID NO: 205162 - DNA, 103 bp, Artificial Sequence
  Synthetic Polynucleotide
taatacgactcactatagggcacaggggtgaccgtgcctgggctcggggcaacagaggagagccccgatgccaggcacgaacctggcggcagcgcaaaagatg

SEQ ID NO: 205163 - DNA, 103 bp, Artificial Sequence
  Synthetic Polynucleotide
taatacgactcactataggggtggaggtggcacaggggtgaccgtgcctgaacagaggagacaggcaatgtcacccctgaacctggcggcagcgcaaaagatg

SEQ ID NO: 205164 - DNA, 103 bp, Artificial Sequence
  Synthetic Polynucleotide
taatacgactcactatagggggacttctcaatggtcataaacatttccacaacagaggagagtggaaatgtttatgaccaacctggcggcagcgcaaaagatg

SEQ ID NO: 205165 - DNA, 103 bp, Artificial Sequence
  Synthetic Polynucleotide
taatacgactcactatagggtctgcaccaaggacttctcaatggtcataaaacagaggagattatgaatgttgagaagtaacctggcggcagcgcaaaagatg

SEQ ID NO: 205166 - DNA, 103 bp, Artificial Sequence
  Synthetic Polynucleotide
taatacgactcactatagggaggcaattattctgcaccaaggacttctcaaacagaggagatgagaaatgcttggtgcaaacctggcggcagcgcaaaagatg

SEQ ID NO: 205167 - DNA, 103 bp, Artificial Sequence
  Synthetic Polynucleotide
taatacgactcactatagggggtgtccgcggcctcgtagtacttcacgttaacagaggagaaacgtgatgtactacgagaacctggcggcagcgcaaaagatg

SEQ ID NO: 205168 - DNA, 103 bp, Artificial Sequence
  Synthetic Polynucleotide
taatacgactcactatagggaggtcgagacaggcaattattctgcaccaaaacagaggagattggtgatgaataattgcaacctggcggcagcgcaaaagatg

SEQ ID NO: 205169 - DNA, 103 bp, Artificial Sequence
  Synthetic Polynucleotide
taatacgactcactataggggaaaaatgttaggtcgagacaggcaattataacagaggagaataattatgtgtctcgacaacctggcggcagcgcaaaagatg

SEQ ID NO: 205170 - DNA, 103 bp, Artificial Sequence
  Synthetic Polynucleotide
taatacgactcactatagggtctgggcacagaaaaatgttaggtcgagacaacagaggagagtctcgatgtaacattttaacctggcggcagcgcaaaagatg

SEQ ID NO: 205171 - DNA, 103 bp, Artificial Sequence
  Synthetic Polynucleotide
taatacgactcactataggggggctcaatttctgggcacagaaaaatgttaacagaggagaaacattatgctgtgcccaaacctggcggcagcgcaaaagatg

SEQ ID NO: 205172 - DNA, 103 bp, Artificial Sequence
  Synthetic Polynucleotide
taatacgactcactatagggctagtagtttgggctcaatttctgggcacaaacagaggagatgtgccatgaaattgagcaacctggcggcagcgcaaaagatg

SEQ ID NO: 205173 - DNA, 103 bp, Artificial Sequence
  Synthetic Polynucleotide
taatacgactcactatagggtttaatttccctagtagtttgggctcaattaacagaggagaaattgaatgcaaactactaacctggcggcagcgcaaaagatg

SEQ ID NO: 205174 - DNA, 103 bp, Artificial Sequence
  Synthetic Polynucleotide
taatacgactcactataggggataatgtcctttaatttccctagtagtttaacagaggagaaaactaatggggaaattaaacctggcggcagcgcaaaagatg

SEQ ID NO: 205175 - DNA, 103 bp, Artificial Sequence
  Synthetic Polynucleotide
taatacgactcactatagggggtgtctcttgataatgtcctttaatttccaacagaggagaggaaatatgaggacattaaacctggcggcagcgcaaaagatg

SEQ ID NO: 205176 - DNA, 103 bp, Artificial Sequence
  Synthetic Polynucleotide
taatacgactcactatagggactgttccctggtgtctcttgataatgtccaacagaggagaggacatatgcaagagacaaacctggcggcagcgcaaaagatg

SEQ ID NO: 205177 - DNA, 103 bp, Artificial Sequence
  Synthetic Polynucleotide
taatacgactcactatagggatcctcagtgactgttccctggtgtctcttaacagaggagaaagagaatgcagggaacaaacctggcggcagcgcaaaagatg

SEQ ID NO: 205178 - DNA, 103 bp, Artificial Sequence
  Synthetic Polynucleotide
taatacgactcactatagggactgggtcacggtgtccgcggcctcgtagtaacagaggagaactacgatgccgcggacaaacctggcggcagcgcaaaagatg

SEQ ID NO: 205179 - DNA, 103 bp, Artificial Sequence
  Synthetic Polynucleotide
taatacgactcactatagggcattgttcttatcctcagtgactgttccctaacagaggagaagggaaatgtcactgaggaacctggcggcagcgcaaaagatg

SEQ ID NO: 205180 - DNA, 103 bp, Artificial Sequence
  Synthetic Polynucleotide
taatacgactcactatagggacatgggaggcattgttcttatcctcagtgaacagaggagacactgaatgtaagaacaaaacctggcggcagcgcaaaagatg

SEQ ID NO: 205181 - DNA, 103 bp, Artificial Sequence
  Synthetic Polynucleotide
taatacgactcactatagggaggatacacaacatgggaggcattgttcttaacagaggagaaagaacatggcctcccataacctggcggcagcgcaaaagatg

SEQ ID NO: 205182 - DNA, 103 bp, Artificial Sequence
  Synthetic Polynucleotide
taatacgactcactatagggtccccgggacaggatacacaacatgggaggaacagaggagacctcccatgttgtgtatcaacctggcggcagcgcaaaagatg

SEQ ID NO: 205183 - DNA, 103 bp, Artificial Sequence
  Synthetic Polynucleotide
taatacgactcactatagggtcttctagattccccgggacaggatacacaaacagaggagatgtgtaatgtgtcccgggaacctggcggcagcgcaaaagatg

SEQ ID NO: 205184 - DNA, 103 bp, Artificial Sequence
  Synthetic Polynucleotide
taatacgactcactatagggccattcctcttcttctagattccccgggacaacagaggagagtcccgatgaatctagaaaacctggcggcagcgcaaaagatg

SEQ ID NO: 205185 - DNA, 103 bp, Artificial Sequence
  Synthetic Polynucleotide
taatacgactcactatagggctggtcgtacccattcctcttcttctagataacagaggagaatctagatgaagaggaataacctggcggcagcgcaaaagatg

SEQ ID NO: 205186 - DNA, 103 bp, Artificial Sequence
  Synthetic Polynucleotide
taatacgactcactatagggctcttcatgactggtcgtacccattcctctaacagaggagaagaggaatgggtacgaccaacctggcggcagcgcaaaagatg

SEQ ID NO: 205187 - DNA, 103 bp, Artificial Sequence
  Synthetic Polynucleotide
taatacgactcactatagggctgcttatccctcttcatgactggtcgtacaacagaggagagtacgaatggtcatgaagaacctggcggcagcgcaaaagatg

SEQ ID NO: 205188 - DNA, 103 bp, Artificial Sequence
  Synthetic Polynucleotide
taatacgactcactataggggcagaagaacctgcttatccctcttcatgaaacagaggagatcatgaatggggataagcaacctggcggcagcgcaaaagatg

SEQ ID NO: 205189 - DNA, 103 bp, Artificial Sequence
  Synthetic Polynucleotide
taatacgactcactatagggacgttgtcgaactgggtcacggtgtccgcgaacagaggagacgcggaatgcgtgacccaaacctggcggcagcgcaaaagatg

SEQ ID NO: 205190 - DNA, 103 bp, Artificial Sequence
  Synthetic Polynucleotide
taatacgactcactatagggtagccccagtgcagaagaacctgcttatccaacagaggagaggataaatgggttcttctaacctggcggcagcgcaaaagatg

SEQ ID NO: 205191 - DNA, 103 bp, Artificial Sequence
  Synthetic Polynucleotide
taatacgactcactataggggtcaggatagtagccccagtgcagaagaacaacagaggagagttcttatgcactggggcaacctggcggcagcgcaaaagatg

SEQ ID NO: 205192 - DNA, 103 bp, Artificial Sequence
  Synthetic Polynucleotide
taatacgactcactatagggtgtcgtaactgtcaggatagtagccccagtaacagaggagaactgggatgactatcctgaacctggcggcagcgcaaaagatg

SEQ ID NO: 205193 - DNA, 103 bp, Artificial Sequence
  Synthetic Polynucleotide
taatacgactcactataggggggatccacgtgtcgtaactgtcaggatagaacagaggagactatccatgcagttacgaaacctggcggcagcgcaaaagatg

SEQ ID NO: 205194 - DNA, 103 bp, Artificial Sequence
  Synthetic Polynucleotide
taatacgactcactatagggttcactcgctgggatccacgtgtcgtaactaacagaggagaagttacatgacgtggatcaacctggcggcagcgcaaaagatg

SEQ ID NO: 205195 - DNA, 103 bp, Artificial Sequence
  Synthetic Polynucleotide
taatacgactcactatagggatgcctcaatttcactcgctgggatccacgaacagaggagacgtggaatgcagcgagtgaacctggcggcagcgcaaaagatg

SEQ ID NO: 205196 - DNA, 103 bp, Artificial Sequence
  Synthetic Polynucleotide
taatacgactcactatagggtcttccacagatgcctcaatttcactcgctaacagaggagaagcgagatgaattgaggcaacctggcggcagcgcaaaagatg

SEQ ID NO: 205197 - DNA, 103 bp, Artificial Sequence
  Synthetic Polynucleotide
taatacgactcactatagggagttggagcatcttccacagatgcctcaataacagaggagaattgagatgtctgtggaaaacctggcggcagcgcaaaagatg

SEQ ID NO: 205198 - DNA, 103 bp, Artificial Sequence
  Synthetic Polynucleotide
taatacgactcactataggggtttctcaggagttggagcatcttccacagaacagaggagactgtggatgatgctccaaaacctggcggcagcgcaaaagatg

SEQ ID NO: 205199 - DNA, 103 bp, Artificial Sequence
  Synthetic Polynucleotide
taatacgactcactatagggaccttcctaggtttctcaggagttggagcaaacagaggagatgctccatgtcctgagaaaacctggcggcagcgcaaaagatg

SEQ ID NO: 205200 - DNA, 103 bp, Artificial Sequence
  Synthetic Polynucleotide
taatacgactcactatagggccacagccgcacgttgtcgaactgggtcacaacagaggagagtgaccatgttcgacaacaacctggcggcagcgcaaaagatg

SEQ ID NO: 205201 - DNA, 103 bp, Artificial Sequence
  Synthetic Polynucleotide
taatacgactcactatagggctttgcatgaaccttcctaggtttctcaggaacagaggagacctgagatgcctaggaagaacctggcggcagcgcaaaagatg

SEQ ID NO: 205202 - DNA, 103 bp, Artificial Sequence
  Synthetic Polynucleotide
taatacgactcactatagggccaggatccactttgcatgaaccttcctagaacagaggagactaggaatgttcatgcaaaacctggcggcagcgcaaaagatg

SEQ ID NO: 205203 - DNA, 103 bp, Artificial Sequence
  Synthetic Polynucleotide
taatacgactcactataggggtgtcggtgtccaggatccactttgcatgaaacagaggagatcatgcatggtggatcctaacctggcggcagcgcaaaagatg

SEQ ID NO: 205204 - DNA, 103 bp, Artificial Sequence
  Synthetic Polynucleotide
taatacgactcactatagggttcattgaaggtgtcggtgtccaggatccaaacagaggagatggatcatggacaccgacaacctggcggcagcgcaaaagatg

SEQ ID NO: 205205 - DNA, 103 bp, Artificial Sequence
  Synthetic Polynucleotide
taatacgactcactatagggcattcatccattcattgaaggtgtcggtgtaacagaggagaacaccgatgccttcaatgaacctggcggcagcgcaaaagatg

SEQ ID NO: 205206 - DNA, 103 bp, Artificial Sequence
  Synthetic Polynucleotide
taatacgactcactatagggtagtcttcctcattcatccattcattgaagaacagaggagacttcaaatgatggatgaaaacctggcggcagcgcaaaagatg

SEQ ID NO: 205207 - DNA, 103 bp, Artificial Sequence
  Synthetic Polynucleotide
taatacgactcactatagggatttacttcatagtcttcctcattcatccaaacagaggagatggatgatggaggaagacaacctggcggcagcgcaaaagatg

SEQ ID NO: 205208 - DNA, 103 bp, Artificial Sequence
  Synthetic Polynucleotide
taatacgactcactatagggttttgtcatcatttacttcatagtcttcctaacagaggagaaggaagatgatgaagtaaaacctggcggcagcgcaaaagatg

SEQ ID NO: 205209 - DNA, 103 bp, Artificial Sequence
  Synthetic Polynucleotide
taatacgactcactataggggagacagggtttttgtcatcatttacttcaaacagaggagatgaagtatgtgatgacaaaacctggcggcagcgcaaaagatg

SEQ ID NO: 205210 - DNA, 103 bp, Artificial Sequence
  Synthetic Polynucleotide
taatacgactcactatagggctttcggcgggagacagggtttttgtcatcaacagaggagagatgacatgaaccctgtcaacctggcggcagcgcaaaagatg

SEQ ID NO: 205211 - DNA, 103 bp, Artificial Sequence
  Synthetic Polynucleotide
taatacgactcactatagggtcttgccgagccacagccgcacgttgtcgaaacagaggagatcgacaatgtgcggctgtaacctggcggcagcgcaaaagatg

SEQ ID NO: 205212 - DNA, 103 bp, Artificial Sequence
  Synthetic Polynucleotide
taatacgactcactatagggctgaaatcttctttcggcgggagacagggtaacagaggagaaccctgatgcccgccgaaaacctggcggcagcgcaaaagatg

SEQ ID NO: 205213 - DNA, 103 bp, Artificial Sequence
  Synthetic Polynucleotide
taatacgactcactatagggagtgtcttggctgaaatcttctttcggcggaacagaggagaccgccgatggaagatttcaacctggcggcagcgcaaaagatg

SEQ ID NO: 205214 - DNA, 103 bp, Artificial Sequence
  Synthetic Polynucleotide
taatacgactcactatagggctcatctgtcagtgtcttggctgaaatcttaacagaggagaaagattatggccaagacaaacctggcggcagcgcaaaagatg

SEQ ID NO: 205215 - DNA, 103 bp, Artificial Sequence
  Synthetic Polynucleotide
taatacgactcactatagggggctgttcacctcatctgtcagtgtcttggaacagaggagaccaagaatgtgacagatgaacctggcggcagcgcaaaagatg

SEQ ID NO: 205216 - DNA, 103 bp, Artificial Sequence
  Synthetic Polynucleotide
taatacgactcactatagggtctgaatctgggctgttcacctcatctgtcaacagaggagagacagaatgggtgaacagaacctggcggcagcgcaaaagatg

SEQ ID NO: 205217 - DNA, 103 bp, Artificial Sequence
  Synthetic Polynucleotide
taatacgactcactataggggtcccgtcgatctgaatctgggctgttcacaacagaggagagtgaacatgccagattcaaacctggcggcagcgcaaaagatg

SEQ ID NO: 205218 - DNA, 103 bp, Artificial Sequence
  Synthetic Polynucleotide
taatacgactcactatagggcccccttcttgtcccgtcgatctgaatctgaacagaggagacagattatgatcgacgggaacctggcggcagcgcaaaagatg

SEQ ID NO: 205219 - DNA, 103 bp, Artificial Sequence
  Synthetic Polynucleotide
taatacgactcactatagggttatagtttccccccttcttgtcccgtcgaaacagaggagatcgacgatgcaagaagggaacctggcggcagcgcaaaagatg

SEQ ID NO: 205220 - DNA, 103 bp, Artificial Sequence
  Synthetic Polynucleotide
taatacgactcactatagggcttcctcttcttatagtttccccccttcttaacagaggagaaagaagatgggaaactataacctggcggcagcgcaaaagatg

SEQ ID NO: 205221 - DNA, 103 bp, Artificial Sequence
  Synthetic Polynucleotide
taatacgactcactatagggagggggagcgcttcctcttcttatagtttcaacagaggagagaaactatgagaagaggaaacctggcggcagcgcaaaagatg

SEQ ID NO: 205222 - DNA, 103 bp, Artificial Sequence
  Synthetic Polynucleotide
taatacgactcactatagggttcttgtagttcttgccgagccacagccgcaacagaggagagcggctatggctcggcaaaacctggcggcagcgcaaaagatg

SEQ ID NO: 205223 - DNA, 103 bp, Artificial Sequence
  Synthetic Polynucleotide
taatacgactcactatagggggtgaaggagagggggagcgcttcctcttcaacagaggagagaagagatggcgctccccaacctggcggcagcgcaaaagatg

SEQ ID NO: 205224 - DNA, 103 bp, Artificial Sequence
  Synthetic Polynucleotide
taatacgactcactatagggttctggggttggtgaaggagagggggagcgaacagaggagacgctccatgtctccttcaaacctggcggcagcgcaaaagatg

SEQ ID NO: 205225 - DNA, 103 bp, Artificial Sequence
  Synthetic Polynucleotide
taatacgactcactatagggtcttctttgcttctggggttggtgaaggagaacagaggagactccttatgcaaccccagaacctggcggcagcgcaaaagatg

SEQ ID NO: 205226 - DNA, 103 bp, Artificial Sequence
  Synthetic Polynucleotide
taatacgactcactatagggttagcatttttcttctttgcttctggggttaacagaggagaaaccccatgagcaaagaaaacctggcggcagcgcaaaagatg

SEQ ID NO: 205227 - DNA, 103 bp, Artificial Sequence
  Synthetic Polynucleotide
taatacgactcactataggggggacctttcttagcatttttcttctttgcaacagaggagagcaaagatgaaaaatgctaacctggcggcagcgcaaaagatg

SEQ ID NO: 205228 - DNA, 103 bp, Artificial Sequence
  Synthetic Polynucleotide
taatacgactcactatagggaaggtgttgagggacctttcttagcattttaacagaggagaaaaatgatgagaaaggtcaacctggcggcagcgcaaaagatg

SEQ ID NO: 205229 - DNA, 103 bp, Artificial Sequence
  Synthetic Polynucleotide
taatacgactcactataggggacttagtgtaaggtgttgagggacctttcaacagaggagagaaaggatgctcaacaccaacctggcggcagcgcaaaagatg

SEQ ID NO: 205230 - DNA, 103 bp, Artificial Sequence
  Synthetic Polynucleotide
taatacgactcactataggggccacgctttgacttagtgtaaggtgttgaaacagaggagatcaacaatgtacactaagaacctggcggcagcgcaaaagatg

SEQ ID NO: 205231 - DNA, 103 bp, Artificial Sequence
  Synthetic Polynucleotide
taatacgactcactatagggcttctctgtggccacgctttgacttagtgtaacagaggagaacactaatgcaaagcgtgaacctggcggcagcgcaaaagatg

SEQ ID NO: 205232 - DNA, 103 bp, Artificial Sequence
  Synthetic Polynucleotide
taatacgactcactatagggtcttgctcctcttctctgtggccacgctttaacagaggagaaaagcgatgccacagagaaacctggcggcagcgcaaaagatg

SEQ ID NO: 205233 - DNA, 103 bp, Artificial Sequence
  Synthetic Polynucleotide
taatacgactcactatagggagtcacctccacccccacccgcctccccataacagaggagaatggggatgcgggtggggaacctggcggcagcgcaaaagatg

SEQ ID NO: 205234 - DNA, 103 bp, Artificial Sequence
  Synthetic Polynucleotide
taatacgactcactatagggctgcaagccagccatgggcatccggttcccaacagaggagagggaacatgatgcccatgaacctggcggcagcgcaaaagatg

SEQ ID NO: 205235 - DNA, 103 bp, Artificial Sequence
  Synthetic Polynucleotide
taatacgactcactataggggacaatggggtctggatgctgcagcaacccaacagaggagagggttgatgcagcatccaaacctggcggcagcgcaaaagatg

SEQ ID NO: 205236 - DNA, 103 bp, Artificial Sequence
  Synthetic Polynucleotide
taatacgactcactatagggcatggttgatgacaatggggtctggatgctaacagaggagaagcatcatgaccccattgaacctggcggcagcgcaaaagatg

SEQ ID NO: 205237 - DNA, 103 bp, Artificial Sequence
  Synthetic Polynucleotide
taatacgactcactatagggacactaatgacatggttgatgacaatggggaacagaggagaccccatatgcatcaaccaaacctggcggcagcgcaaaagatg

SEQ ID NO: 205238 - DNA, 103 bp, Artificial Sequence
  Synthetic Polynucleotide
taatacgactcactataggggttagggtcgacactaatgacatggttgataacagaggagaatcaacatggtcattagtaacctggcggcagcgcaaaagatg

SEQ ID NO: 205239 - DNA, 103 bp, Artificial Sequence
  Synthetic Polynucleotide
taatacgactcactatagggtcttctggtcgttagggtcgacactaatgaaacagaggagatcattaatgtcgaccctaaacctggcggcagcgcaaaagatg

SEQ ID NO: 205240 - DNA, 103 bp, Artificial Sequence
  Synthetic Polynucleotide
taatacgactcactatagggcaggctgtcttcttctggtcgttagggtcgaacagaggagacgacccatgcgaccagaaaacctggcggcagcgcaaaagatg

SEQ ID NO: 205241 - DNA, 103 bp, Artificial Sequence
  Synthetic Polynucleotide
taatacgactcactataggggatgtcgtaacaggctgtcttcttctggtcaacagaggagagaccagatgaagacagccaacctggcggcagcgcaaaagatg

SEQ ID NO: 205242 - DNA, 103 bp, Artificial Sequence
  Synthetic Polynucleotide
taatacgactcactatagggcctccacatcgatgtcgtaacaggctgtctaacagaggagaagacagatggttacgacaaacctggcggcagcgcaaaagatg

SEQ ID NO: 205243 - DNA, 103 bp, Artificial Sequence
  Synthetic Polynucleotide
taatacgactcactataggggggtcgtccacctccacatcgatgtcgtaaaacagaggagattacgaatgcgatgtggaaacctggcggcagcgcaaaagatg

SEQ ID NO: 205244 - DNA, 103 bp, Artificial Sequence
  Synthetic Polynucleotide
taatacgactcactatagggggccttcagtgggtcgtccacctccacatcaacagaggagagatgtgatggtggacgacaacctggcggcagcgcaaaagatg

SEQ ID NO: 205245 - DNA, 103 bp, Artificial Sequence
  Synthetic Polynucleotide
taatacgactcactatagggggggtcccacctgcaagccagccatgggcaaacagaggagatgcccaatgctggcttgcaacctggcggcagcgcaaaagatg

SEQ ID NO: 205246 - DNA, 103 bp, Artificial Sequence
  Synthetic Polynucleotide
taatacgactcactatagggtgctcatttgggccttcagtgggtcgtccaaacagaggagatggacgatgcactgaaggaacctggcggcagcgcaaaagatg

SEQ ID NO: 205247 - DNA, 103 bp, Artificial Sequence
  Synthetic Polynucleotide
taatacgactcactataggggccagaaaattgctcatttgggccttcagtaacagaggagaactgaaatgccaaatgagaacctggcggcagcgcaaaagatg

SEQ ID NO: 205248 - DNA, 103 bp, Artificial Sequence
  Synthetic Polynucleotide
taatacgactcactatagggggtggtagaggccagaaaattgctcatttgaacagaggagacaaatgatgaattttctgaacctggcggcagcgcaaaagatg

SEQ ID NO: 205249 - DNA, 103 bp, Artificial Sequence
  Synthetic Polynucleotide
taatacgactcactatagggcctgctgattggtggtagaggccagaaaataacagaggagaattttcatgcctctaccaaacctggcggcagcgcaaaagatg

SEQ ID NO: 205250 - DNA, 103 bp, Artificial Sequence
  Synthetic Polynucleotide
taatacgactcactataggggaggcgatctcctgctgattggtggtagagaacagaggagactctacatgcaatcagcaaacctggcggcagcgcaaaagatg

SEQ ID NO: 205251 - DNA, 103 bp, Artificial Sequence
  Synthetic Polynucleotide
taatacgactcactataggggacatcaagggaggcgatctcctgctgattaacagaggagaaatcagatggagatcgccaacctggcggcagcgcaaaagatg

SEQ ID NO: 205252 - DNA, 103 bp, Artificial Sequence
  Synthetic Polynucleotide
taatacgactcactatagggcatggatcttgacatcaagggaggcgatctaacagaggagaagatcgatgcccttgatgaacctggcggcagcgcaaaagatg

SEQ ID NO: 205253 - DNA, 103 bp, Artificial Sequence
  Synthetic Polynucleotide
taatacgactcactatagggtcaatggtctcatggatcttgacatcaaggaacagaggagaccttgaatgcaagatccaaacctggcggcagcgcaaaagatg

SEQ ID NO: 205254 - DNA, 103 bp, Artificial Sequence
  Synthetic Polynucleotide
taatacgactcactataggggttgatggactcaatggtctcatggatcttaacagaggagaaagatcatggagaccattaacctggcggcagcgcaaaagatg

SEQ ID NO: 205255 - DNA, 103 bp, Artificial Sequence
  Synthetic Polynucleotide
taatacgactcactatagggtcttcagctggttgatggactcaatggtctaacagaggagaagaccaatgagtccatcaaacctggcggcagcgcaaaagatg

SEQ ID NO: 205256 - DNA, 103 bp, Artificial Sequence
  Synthetic Polynucleotide
taatacgactcactataggggagccagcagggggtcccacctgcaagccaaacagaggagatggcttatgggtgggaccaacctggcggcagcgcaaaagatg

SEQ ID NO: 205257 - DNA, 103 bp, Artificial Sequence
  Synthetic Polynucleotide
taatacgactcactatagggtctctctgggtcttcagctggttgatggacaacagaggagagtccatatgccagctgaaaacctggcggcagcgcaaaagatg

SEQ ID NO: 205258 - DNA, 103 bp, Artificial Sequence
  Synthetic Polynucleotide
taatacgactcactataggggagcatgaaatctctctgggtcttcagctgaacagaggagacagctgatgacccagagaaacctggcggcagcgcaaaagatg

SEQ ID NO: 205259 - DNA, 103 bp, Artificial Sequence
  Synthetic Polynucleotide
taatacgactcactatagggtgctaaaactgagcatgaaatctctctgggaacagaggagacccagaatgatttcatgcaacctggcggcagcgcaaaagatg

SEQ ID NO: 205260 - DNA, 103 bp, Artificial Sequence
  Synthetic Polynucleotide
taatacgactcactatagggtgggggtcggtgctaaaactgagcatgaaaaacagaggagatttcatatgcagttttagaacctggcggcagcgcaaaagatg

SEQ ID NO: 205261 - DNA, 103 bp, Artificial Sequence
  Synthetic Polynucleotide
taatacgactcactataggggatgaagtcctgggggtcggtgctaaaactaacagaggagaagttttatgaccgaccccaacctggcggcagcgcaaaagatg

SEQ ID NO: 205262 - DNA, 103 bp, Artificial Sequence
  Synthetic Polynucleotide
taatacgactcactataggggccattcctggatgaagtcctgggggtcggaacagaggagaccgaccatgaggacttcaaacctggcggcagcgcaaaagatg

SEQ ID NO: 205263 - DNA, 103 bp, Artificial Sequence
  Synthetic Polynucleotide
taatacgactcactatagggtgggaacggagccattcctggatgaagtccaacagaggagaggacttatgccaggaatgaacctggcggcagcgcaaaagatg

SEQ ID NO: 205264 - DNA, 103 bp, Artificial Sequence
  Synthetic Polynucleotide
taatacgactcactataggggtctcggcgctgggaacggagccattcctgaacagaggagacaggaaatgctccgttccaacctggcggcagcgcaaaagatg

SEQ ID NO: 205265 - DNA, 103 bp, Artificial Sequence
  Synthetic Polynucleotide
taatacgactcactatagggtgatcttgaggtctcggcgctgggaacggaaacagaggagatccgttatgagcgccgagaacctggcggcagcgcaaaagatg

SEQ ID NO: 205266 - DNA, 103 bp, Artificial Sequence
  Synthetic Polynucleotide
taatacgactcactatagggacatcagtgatgatcttgaggtctcggcgcaacagaggagagcgccgatgcctcaagataacctggcggcagcgcaaaagatg

SEQ ID NO: 205267 - DNA, 103 bp, Artificial Sequence
  Synthetic Polynucleotide
taatacgactcactatagggaccaaatggggagccagcagggggtcccacaacagaggagagtgggaatgcctgctggcaacctggcggcagcgcaaaagatg

SEQ ID NO: 205268 - DNA, 103 bp, Artificial Sequence
  Synthetic Polynucleotide
taatacgactcactatagggatttccaatcacatcagtgatgatcttgagaacagaggagactcaagatgatcactgataacctggcggcagcgcaaaagatg

SEQ ID NO: 205269 - DNA, 103 bp, Artificial Sequence
  Synthetic Polynucleotide
taatacgactcactatagggcctcctcaggatttccaatcacatcagtgaaacagaggagatcactgatgtgattggaaaacctggcggcagcgcaaaagatg

SEQ ID NO: 205270 - DNA, 103 bp, Artificial Sequence
  Synthetic Polynucleotide
taatacgactcactataggggctcgtctctcctcctcaggatttccaatcaacagaggagagattggatgtcctgaggaaacctggcggcagcgcaaaagatg

SEQ ID NO: 205271 - DNA, 103 bp, Artificial Sequence
  Synthetic Polynucleotide
taatacgactcactataggggtagaaagcagctcgtctctcctcctcaggaacagaggagacctgagatggagagacgaaacctggcggcagcgcaaaagatg

SEQ ID NO: 205272 - DNA, 103 bp, Artificial Sequence
  Synthetic Polynucleotide
taatacgactcactatagggagggctggtggtagaaagcagctcgtctctaacagaggagaagagacatgctgctttctaacctggcggcagcgcaaaagatg

SEQ ID NO: 205273 - DNA, 103 bp, Artificial Sequence
  Synthetic Polynucleotide
taatacgactcactatagggtcctgggcccagggctggtggtagaaagcaaacagaggagatgctttatgccaccagccaacctggcggcagcgcaaaagatg

SEQ ID NO: 205274 - DNA, 103 bp, Artificial Sequence
  Synthetic Polynucleotide
taatacgactcactataggggcctactgcttcctgggcccagggctggtgaacagaggagacaccagatgtgggcccagaacctggcggcagcgcaaaagatg

SEQ ID NO: 205275 - DNA, 103 bp, Artificial Sequence
  Synthetic Polynucleotide
taatacgactcactatagggagatgtgcctgcctactgcttcctgggcccaacagaggagagggcccatgaagcagtagaacctggcggcagcgcaaaagatg

SEQ ID NO: 205276 - DNA, 103 bp, Artificial Sequence
  Synthetic Polynucleotide
taatacgactcactatagggaccttggcaaagatgtgcctgcctactgctaacagaggagaagcagtatgcaggcacataacctggcggcagcgcaaaagatg

SEQ ID NO: 205277 - DNA, 103 bp, Artificial Sequence
  Synthetic Polynucleotide
taatacgactcactatagggtcgctgctgcaccttggcaaagatgtgcctaacagaggagaaggcacatgtttgccaagaacctggcggcagcgcaaaagatg

SEQ ID NO: 205278 - DNA, 103 bp, Artificial Sequence
  Synthetic Polynucleotide
taatacgactcactataggggagctgctgcaccaaatggggagccagcagaacagaggagactgctgatgccccatttgaacctggcggcagcgcaaaagatg

SEQ ID NO: 205279 - DNA, 103 bp, Artificial Sequence
  Synthetic Polynucleotide
taatacgactcactataggggttcctgccttcgctgctgcaccttggcaaaacagaggagattgccaatgtgcagcagcaacctggcggcagcgcaaaagatg

SEQ ID NO: 205280 - DNA, 103 bp, Artificial Sequence
  Synthetic Polynucleotide
taatacgactcactatagggacctgttccagttcctgccttcgctgctgcaacagaggagagcagcaatgaaggcaggaaacctggcggcagcgcaaaagatg

SEQ ID NO: 205281 - DNA, 103 bp, Artificial Sequence
  Synthetic Polynucleotide
taatacgactcactatagggaattcccagcacctgttccagttcctgcctaacagaggagaaggcagatgctggaacagaacctggcggcagcgcaaaagatg

SEQ ID NO: 205282 - DNA, 103 bp, Artificial Sequence
  Synthetic Polynucleotide
taatacgactcactatagggaggtcaggcgaattcccagcacctgttccaaacagaggagatggaacatgtgctgggaaaacctggcggcagcgcaaaagatg

SEQ ID NO: 205283 - DNA, 103 bp, Artificial Sequence
  Synthetic Polynucleotide
taatacgactcactatagggggtcgaagcggagctgctgcaccaaatgggaacagaggagacccattatgtgcagcagcaacctggcggcagcgcaaaagatg

SEQ ID NO: 205284 - DNA, 103 bp, Artificial Sequence
  Synthetic Polynucleotide
taatacgactcactatagggtggcatgccaggtcgaagcggagctgctgcaacagaggagagcagcaatgccgcttcgaaacctggcggcagcgcaaaagatg

SEQ ID NO: 205285 - DNA, 103 bp, Artificial Sequence
  Synthetic Polynucleotide
taatacgactcactatagggtcatggtgggtggcatgccaggtcgaagcgaacagaggagacgcttcatgctggcatgcaacctggcggcagcgcaaaagatg

SEQ ID NO: 205286 - DNA, 103 bp, Artificial Sequence
  Synthetic Polynucleotide
taatacgactcactatagggaatggatccatcatggtgggtggcatgccaaacagaggagatggcatatgacccaccataacctggcggcagcgcaaaagatg

SEQ ID NO: 205287 - DNA, 103 bp, Artificial Sequence
  Synthetic Polynucleotide
taatacgactcactataggggcgttttcggaatggatccatcatggtgggaacagaggagacccaccatgatggatccaaacctggcggcagcgcaaaagatg

SEQ ID NO: 205288 - DNA, 103 bp, Artificial Sequence
  Synthetic Polynucleotide
taatacgactcactatagggcccatctgggagtcacctccacccccacccaacagaggagagggtggatgtggaggtgaaacctggcggcagcgcaaaagatg

SEQ ID NO: 205289 - DNA, 103 bp, Artificial Sequence
  Synthetic Polynucleotide
taatacgactcactataggggcacaagcaggcgttttcggaatggatccaaacagaggagatggatcatgtccgaaaacaacctggcggcagcgcaaaagatg

SEQ ID NO: 205290 - DNA, 103 bp, Artificial Sequence
  Synthetic Polynucleotide
taatacgactcactatagggtgcgcctggggcacaagcaggcgttttcggaacagaggagaccgaaaatgcctgcttgtaacctggcggcagcgcaaaagatg

SEQ ID NO: 205291 - DNA, 103 bp, Artificial Sequence
  Synthetic Polynucleotide
taatacgactcactatagggcatgggaggctgcgcctggggcacaagcagaacagaggagactgcttatgccccaggcgaacctggcggcagcgcaaaagatg

SEQ ID NO: 205292 - DNA, 103 bp, Artificial Sequence
  Synthetic Polynucleotide
taatacgactcactataggggctgggcaggcatgggaggctgcgcctgggaacagaggagacccaggatgagcctcccaaacctggcggcagcgcaaaagatg

SEQ ID NO: 205293 - DNA, 103 bp, Artificial Sequence
  Synthetic Polynucleotide
taatacgactcactatagggaacccccggcgctgggcaggcatgggaggcaacagaggagagcctccatggcctgcccaaacctggcggcagcgcaaaagatg

SEQ ID NO: 205294 - DNA, 103 bp, Artificial Sequence
  Synthetic Polynucleotide
taatacgactcactatagggcctcctctttaacccccggcgctgggcaggaacagaggagacctgccatgcgccgggggaacctggcggcagcgcaaaagatg

SEQ ID NO: 205295 - DNA, 103 bp, Artificial Sequence
  Synthetic Polynucleotide
taatacgactcactatagggctgccatcttcctcctctttaacccccggcaacagaggagagccgggatgtaaagaggaaacctggcggcagcgcaaaagatg

SEQ ID NO: 205296 - DNA, 103 bp, Artificial Sequence
  Synthetic Polynucleotide
taatacgactcactatagggagaaccttatctgccatcttcctcctctttaacagaggagaaaagagatggaagatggcaacctggcggcagcgcaaaagatg

SEQ ID NO: 205297 - DNA, 103 bp, Artificial Sequence
  Synthetic Polynucleotide
taatacgactcactatagggtcgctgaggtagaaccttatctgccatcttaacagaggagaaagatgatggataaggttaacctggcggcagcgcaaaagatg

SEQ ID NO: 205298 - DNA, 103 bp, Artificial Sequence
  Synthetic Polynucleotide
taatacgactcactataggggctcccggattcgctgaggtagaaccttataacagaggagaataaggatgtacctcagcaacctggcggcagcgcaaaagatg

SEQ ID NO: 205299 - DNA, 103 bp, Artificial Sequence
  Synthetic Polynucleotide
taatacgactcactatagggttctgtggagcccatctgggagtcacctccaacagaggagaggaggtatgtcccagatgaacctggcggcagcgcaaaagatg

SEQ ID NO: 205300 - DNA, 103 bp, Artificial Sequence
  Synthetic Polynucleotide
taatacgactcactatagggtctggaacaagctcccggattcgctgaggtaacagaggagaacctcaatgaatccgggaaacctggcggcagcgcaaaagatg

SEQ ID NO: 205301 - DNA, 103 bp, Artificial Sequence
  Synthetic Polynucleotide
taatacgactcactatagggcgcctgagactctggaacaagctcccggataacagaggagaatccggatgcttgttccaaacctggcggcagcgcaaaagatg

SEQ ID NO: 205302 - DNA, 103 bp, Artificial Sequence
  Synthetic Polynucleotide
taatacgactcactataggggatccatgtacgcctgagactctggaacaaaacagaggagattgttcatgagtctcaggaacctggcggcagcgcaaaagatg

SEQ ID NO: 205303 - DNA, 103 bp, Artificial Sequence
  Synthetic Polynucleotide
taatacgactcactatagggaaagccaagagatccatgtacgcctgagacaacagaggagagtctcaatggtacatggaaacctggcggcagcgcaaaagatg

SEQ ID NO: 205304 - DNA, 103 bp, Artificial Sequence
  Synthetic Polynucleotide
taatacgactcactatagggcttccgctcaaaagccaagagatccatgtaaacagaggagatacatgatgctcttggctaacctggcggcagcgcaaaagatg

SEQ ID NO: 205305 - DNA, 103 bp, Artificial Sequence
  Synthetic Polynucleotide
taatacgactcactatagggtctggtccagcttccgctcaaaagccaagaaacagaggagatcttggatgttgagcggaaacctggcggcagcgcaaaagatg

SEQ ID NO: 205306 - DNA, 103 bp, Artificial Sequence
  Synthetic Polynucleotide
taatacgactcactatagggcgagcaatggtctggtccagcttccgctcaaacagaggagatgagcgatggctggaccaaacctggcggcagcgcaaaagatg

SEQ ID NO: 205307 - DNA, 103 bp, Artificial Sequence
  Synthetic Polynucleotide
taatacgactcactatagggcatccgcttgcgagcaatggtctggtccagaacagaggagactggacatgaccattgctaacctggcggcagcgcaaaagatg

SEQ ID NO: 205308 - DNA, 103 bp, Artificial Sequence
  Synthetic Polynucleotide
taatacgactcactatagggcctggatctccatccgcttgcgagcaatggaacagaggagaccattgatggcaagcggaaacctggcggcagcgcaaaagatg

SEQ ID NO: 205309 - DNA, 103 bp, Artificial Sequence
  Synthetic Polynucleotide
taatacgactcactatagggttgatggcctcctggatctccatccgcttgaacagaggagacaagcgatgggagatccaaacctggcggcagcgcaaaagatg

SEQ ID NO: 205310 - DNA, 103 bp, Artificial Sequence
  Synthetic Polynucleotide
taatacgactcactatagggtccctgacatttctgtggagcccatctgggaacagaggagacccagaatggctccacagaacctggcggcagcgcaaaagatg

SEQ ID NO: 205311 - DNA, 103 bp, Artificial Sequence
  Synthetic Polynucleotide
taatacgactcactatagggcagaggctttttgatggcctcctggatctcaacagaggagagagatcatggaggccatcaacctggcggcagcgcaaaagatg

SEQ ID NO: 205312 - DNA, 103 bp, Artificial Sequence
  Synthetic Polynucleotide
taatacgactcactataggggcttttgtgtcagaggctttttgatggcctaacagaggagaaggccaatgaaaagcctcaacctggcggcagcgcaaaagatg

SEQ ID NO: 205313 - DNA, 103 bp, Artificial Sequence
  Synthetic Polynucleotide
taatacgactcactatagggcgaagctttcgcttttgtgtcagaggctttaacagaggagaaaagccatggacacaaaaaacctggcggcagcgcaaaagatg

SEQ ID NO: 205314 - DNA, 103 bp, Artificial Sequence
  Synthetic Polynucleotide
taatacgactcactatagggaatgtagatccgaagctttcgcttttgtgtaacagaggagaacacaaatgcgaaagcttaacctggcggcagcgcaaaagatg

SEQ ID NO: 205315 - DNA, 103 bp, Artificial Sequence
  Synthetic Polynucleotide
taatacgactcactatagggacgtattggaaatgtagatccgaagctttcaacagaggagagaaagcatgggatctacaaacctggcggcagcgcaaaagatg

SEQ ID NO: 205316 - DNA, 103 bp, Artificial Sequence
  Synthetic Polynucleotide
taatacgactcactatagggctgggactgaacgtattggaaatgtagatcaacagaggagagatctaatgttccaatacaacctggcggcagcgcaaaagatg

SEQ ID NO: 205317 - DNA, 103 bp, Artificial Sequence
  Synthetic Polynucleotide
taatacgactcactatagggttccgccttgctgggactgaacgtattggaaacagaggagatccaatatgttcagtcccaacctggcggcagcgcaaaagatg

SEQ ID NO: 205318 - DNA, 103 bp, Artificial Sequence
  Synthetic Polynucleotide
taatacgactcactatagggcactatcgccttccgccttgctgggactgaaacagaggagatcagtcatggcaaggcggaacctggcggcagcgcaaaagatg

SEQ ID NO: 205319 - DNA, 103 bp, Artificial Sequence
  Synthetic Polynucleotide
taatacgactcactataggggcagttcctgcactatcgccttccgccttgaacagaggagacaaggcatgaggcgatagaacctggcggcagcgcaaaagatg

SEQ ID NO: 205320 - DNA, 103 bp, Artificial Sequence
  Synthetic Polynucleotide
taatacgactcactatagggaggggtccctgcagttcctgcactatcgccaacagaggagaggcgatatggcaggaactaacctggcggcagcgcaaaagatg

SEQ ID NO: 205321 - DNA, 103 bp, Artificial Sequence
  Synthetic Polynucleotide
taatacgactcactataggggaggccttgctccctgacatttctgtggagaacagaggagactccacatgaatgtcaggaacctggcggcagcgcaaaagatg

SEQ ID NO: 205322 - DNA, 103 bp, Artificial Sequence
  Synthetic Polynucleotide
taatacgactcactataggggggttcccccaggggtccctgcagttcctgaacagaggagacaggaaatgcagggacccaacctggcggcagcgcaaaagatg

SEQ ID NO: 205323 - DNA, 103 bp, Artificial Sequence
  Synthetic Polynucleotide
taatacgactcactatagggtcccctgctggggttcccccaggggtccctaacagaggagaagggacatgtgggggaacaacctggcggcagcgcaaaagatg

SEQ ID NO: 205324 - DNA, 103 bp, Artificial Sequence
  Synthetic Polynucleotide
taatacgactcactatagggagccaccttgtcccctgctggggttcccccaacagaggagagggggaatgccagcagggaacctggcggcagcgcaaaagatg

SEQ ID NO: 205325 - DNA, 103 bp, Artificial Sequence
  Synthetic Polynucleotide
taatacgactcactataggggttcccaggaagccaccttgtcccctgctgaacagaggagacagcagatgacaaggtggaacctggcggcagcgcaaaagatg

SEQ ID NO: 205326 - DNA, 103 bp, Artificial Sequence
  Synthetic Polynucleotide
taatacgactcactatagggtccactcggagttcccaggaagccaccttgaacagaggagacaaggtatgttcctgggaaacctggcggcagcgcaaaagatg

SEQ ID NO: 205327 - DNA, 103 bp, Artificial Sequence
  Synthetic Polynucleotide
taatacgactcactatagggcagttttccttccactcggagttcccaggaaacagaggagatcctggatgctccgagtgaacctggcggcagcgcaaaagatg

SEQ ID NO: 205328 - DNA, 103 bp, Artificial Sequence
  Synthetic Polynucleotide
taatacgactcactataggggatcatccagcagttttccttccactcggaaacagaggagatccgagatgaaggaaaacaacctggcggcagcgcaaaagatg

SEQ ID NO: 205329 - DNA, 103 bp, Artificial Sequence
  Synthetic Polynucleotide
taatacgactcactatagggtgtttgctaggatcatccagcagttttcctaacagaggagaaggaaaatggctggatgaaacctggcggcagcgcaaaagatg

SEQ ID NO: 205330 - DNA, 103 bp, Artificial Sequence
  Synthetic Polynucleotide
taatacgactcactatagggcttcctcttctgtttgctaggatcatccagaacagaggagactggatatgcctagcaaaaacctggcggcagcgcaaaagatg

SEQ ID NO: 205331 - DNA, 103 bp, Artificial Sequence
  Synthetic Polynucleotide
taatacgactcactatagggatgaagaaaacttcctcttctgtttgctagaacagaggagactagcaatgagaagaggaaacctggcggcagcgcaaaagatg

SEQ ID NO: 205332 - DNA, 103 bp, Artificial Sequence
  Synthetic Polynucleotide
taatacgactcactatagggccaggtcgctgaggccttgctccctgacataacagaggagaatgtcaatgagcaaggccaacctggcggcagcgcaaaagatg

SEQ ID NO: 205333 - DNA, 103 bp, Artificial Sequence
  Synthetic Polynucleotide
taatacgactcactatagggctcttaaagaatgaagaaaacttcctcttcaacagaggagagaagagatggttttcttcaacctggcggcagcgcaaaagatg

SEQ ID NO: 205334 - DNA, 103 bp, Artificial Sequence
  Synthetic Polynucleotide
taatacgactcactatagggaatgacgaggctcttaaagaatgaagaaaaaacagaggagattttctatgttctttaagaacctggcggcagcgcaaaagatg

SEQ ID NO: 205335 - DNA, 103 bp, Artificial Sequence
  Synthetic Polynucleotide
taatacgactcactatagggtgtccagctcaatgacgaggctcttaaagaaacagaggagatctttaatggcctcgtcaaacctggcggcagcgcaaaagatg

SEQ ID NO: 205336 - DNA, 103 bp, Artificial Sequence
  Synthetic Polynucleotide
taatacgactcactatagggtacagctccttgtccagctcaatgacgaggaacagaggagacctcgtatgtgagctggaaacctggcggcagcgcaaaagatg

SEQ ID NO: 205337 - DNA, 103 bp, Artificial Sequence
  Synthetic Polynucleotide
taatacgactcactataggggtcaggcccgtacagctccttgtccagctcaacagaggagagagctgatgaaggagctgaacctggcggcagcgcaaaagatg

SEQ ID NO: 205338 - DNA, 103 bp, Artificial Sequence
  Synthetic Polynucleotide
taatacgactcactatagggccaggtgattgtcaggcccgtacagctcctaacagaggagaaggagcatgacgggcctgaacctggcggcagcgcaaaagatg

SEQ ID NO: 205339 - DNA, 103 bp, Artificial Sequence
  Synthetic Polynucleotide
taatacgactcactatagggtgccactccaccaggtgattgtcaggcccgaacagaggagacgggccatgcaatcacctaacctggcggcagcgcaaaagatg

SEQ ID NO: 205340 - DNA, 103 bp, Artificial Sequence
  Synthetic Polynucleotide
taatacgactcactataggggggcatccggtgccactccaccaggtgattaacagaggagaaatcacatggtggagtggaacctggcggcagcgcaaaagatg

SEQ ID NO: 205341 - DNA, 103 bp, Artificial Sequence
  Synthetic Polynucleotide
taatacgactcactatagggcctgggtggtgggcatccggtgccactccaaacagaggagatggagtatgaccggatgcaacctggcggcagcgcaaaagatg

SEQ ID NO: 205342 - DNA, 103 bp, Artificial Sequence
  Synthetic Polynucleotide
taatacgactcactatagggccatctgtctcctgggtggtgggcatccggaacagaggagaccggatatgcaccacccaaacctggcggcagcgcaaaagatg

SEQ ID NO: 205343 - DNA, 103 bp, Artificial Sequence
  Synthetic Polynucleotide
taatacgactcactatagggtggtgacatgccaggtcgctgaggccttgcaacagaggagagcaaggatgcagcgacctaacctggcggcagcgcaaaagatg

SEQ ID NO: 205344 - DNA, 103 bp, Artificial Sequence
  Synthetic Polynucleotide
taatacgactcactatagggtacttggaagccatctgtctcctgggtggtaacagaggagaaccaccatggagacagataacctggcggcagcgcaaaagatg

SEQ ID NO: 205345 - DNA, 103 bp, Artificial Sequence
  Synthetic Polynucleotide
taatacgactcactatagggcaggccgttttacttggaagccatctgtctaacagaggagaagacagatggcttccaagaacctggcggcagcgcaaaagatg

SEQ ID NO: 205346 - DNA, 103 bp, Artificial Sequence
  Synthetic Polynucleotide
taatacgactcactatagggttgaggtctccaggccgttttacttggaagaacagaggagacttccaatgaaaacggccaacctggcggcagcgcaaaagatg

SEQ ID NO: 205347 - DNA, 103 bp, Artificial Sequence
  Synthetic Polynucleotide
taatacgactcactataggggcacttgacgttgaggtctccaggccgtttaacagaggagaaaacggatgggagacctcaacctggcggcagcgcaaaagatg

SEQ ID NO: 205348 - DNA, 103 bp, Artificial Sequence
  Synthetic Polynucleotide
taatacgactcactataggggcaggagggtgcacttgacgttgaggtctcaacagaggagagagaccatgacgtcaagtaacctggcggcagcgcaaaagatg

SEQ ID NO: 205349 - DNA, 103 bp, Artificial Sequence
  Synthetic Polynucleotide
taatacgactcactatagggtccagcatgagcaggagggtgcacttgacgaacagaggagacgtcaaatgcaccctcctaacctggcggcagcgcaaaagatg

SEQ ID NO: 205350 - DNA, 103 bp, Artificial Sequence
  Synthetic Polynucleotide
taatacgactcactatagggaggctgatgatccagcatgagcaggagggtaacagaggagaaccctcatgctcatgctgaacctggcggcagcgcaaaagatg

SEQ ID NO: 205351 - DNA, 103 bp, Artificial Sequence
  Synthetic Polynucleotide
taatacgactcactatagggtgtactggggaggctgatgatccagcatgaaacagaggagatcatgcatgatcatcagcaacctggcggcagcgcaaaagatg

SEQ ID NO: 205352 - DNA, 103 bp, Artificial Sequence
  Synthetic Polynucleotide
taatacgactcactataggggggtccaatttgtactggggaggctgatgaaacagaggagatcatcaatgtccccagtaaacctggcggcagcgcaaaagatg

SEQ ID NO: 205353 - DNA, 103 bp, Artificial Sequence
  Synthetic Polynucleotide
taatacgactcactatagggtgccaatcgggggtccaatttgtactggggaacagaggagaccccagatgaaattggacaacctggcggcagcgcaaaagatg

SEQ ID NO: 205354 - DNA, 103 bp, Artificial Sequence
  Synthetic Polynucleotide
taatacgactcactatagggtccggttccctggtgacatgccaggtcgctaacagaggagaagcgacatggcatgtcacaacctggcggcagcgcaaaagatg

SEQ ID NO: 205355 - DNA, 103 bp, Artificial Sequence
  Synthetic Polynucleotide
taatacgactcactatagggccagcagccttgccaatcgggggtccaattaacagaggagaaattggatgcccgattggaacctggcggcagcgcaaaagatg

SEQ ID NO: 205356 - DNA, 103 bp, Artificial Sequence
  Synthetic Polynucleotide
taatacgactcactataggggtgtgcactcccagcagccttgccaatcggaacagaggagaccgattatgaaggctgctaacctggcggcagcgcaaaagatg

SEQ ID NO: 205357 - DNA, 103 bp, Artificial Sequence
  Synthetic Polynucleotide
taatacgactcactatagggcctcgtctgcgtgtgcactcccagcagcctaacagaggagaaggctgatgggagtgcacaacctggcggcagcgcaaaagatg

SEQ ID NO: 205358 - DNA, 103 bp, Artificial Sequence
  Synthetic Polynucleotide
taatacgactcactatagggtgatggcggccctcgtctgcgtgtgcactcaacagaggagagagtgcatgcgcagacgaaacctggcggcagcgcaaaagatg

SEQ ID NO: 205359 - DNA, 103 bp, Artificial Sequence
  Synthetic Polynucleotide
taatacgactcactatagggagggcctgcatgatggcggccctcgtctgcaacagaggagagcagacatgggccgccataacctggcggcagcgcaaaagatg

SEQ ID NO: 205360 - DNA, 103 bp, Artificial Sequence
  Synthetic Polynucleotide
taatacgactcactataggggtaaagccacagggcctgcatgatggcggcaacagaggagagccgccatgatgcaggccaacctggcggcagcgcaaaagatg

SEQ ID NO: 205361 - DNA, 103 bp, Artificial Sequence
  Synthetic Polynucleotide
taatacgactcactatagggtgtgcttgatgtaaagccacagggcctgcaaacagaggagatgcaggatgtgtggctttaacctggcggcagcgcaaaagatg

SEQ ID NO: 205362 - DNA, 103 bp, Artificial Sequence
  Synthetic Polynucleotide
taatacgactcactatagggtgcagctggttgtgcttgatgtaaagccacaacagaggagagtggctatgcatcaagcaaacctggcggcagcgcaaaagatg

SEQ ID NO: 205363 - DNA, 103 bp, Artificial Sequence
  Synthetic Polynucleotide
taatacgactcactataggggtgcccatcctgcagctggttgtgcttgataacagaggagaatcaagatgaaccagctgaacctggcggcagcgcaaaagatg

SEQ ID NO: 205364 - DNA, 103 bp, Artificial Sequence
  Synthetic Polynucleotide
taatacgactcactatagggactcccgctcgtgcccatcctgcagctggtaacagaggagaaccagcatgaggatgggcaacctggcggcagcgcaaaagatg

SEQ ID NO: 205365 - DNA, 103 bp, Artificial Sequence
  Synthetic Polynucleotide
taatacgactcactataggggccatgggcatccggttccctggtgacatgaacagaggagacatgtcatgagggaaccgaacctggcggcagcgcaaaagatg

SEQ ID NO: 205366 - DNA, 103 bp, Artificial Sequence
  Synthetic Polynucleotide
taatacgactcactatagggcagttgatgtactcccgctcgtgcccatccaacagaggagaggatggatgcgagcgggaaacctggcggcagcgcaaaagatg

SEQ ID NO: 205367 - DNA, 103 bp, Artificial Sequence
  Synthetic Polynucleotide
taatacgactcactataggggtaacggttgcagttgatgtactcccgctcaacagaggagagagcggatgtacatcaacaacctggcggcagcgcaaaagatg

SEQ ID NO: 205368 - DNA, 103 bp, Artificial Sequence
  Synthetic Polynucleotide
taatacgactcactatagggtctggcggaagtaacggttgcagttgatgtaacagaggagaacatcaatggcaaccgttaacctggcggcagcgcaaaagatg

SEQ ID NO: 205369 - DNA, 103 bp, Artificial Sequence
  Synthetic Polynucleotide
taatacgactcactatagggcaactgaagatctggcggaagtaacggttgaacagaggagacaaccgatgcttccgccaaacctggcggcagcgcaaaagatg

SEQ ID NO: 205370 - DNA, 103 bp, Artificial Sequence
  Synthetic Polynucleotide
taatacgactcactataggggagtcggccacaactgaagatctggcggaaaacagaggagattccgcatgatcttcagtaacctggcggcagcgcaaaagatg

SEQ ID NO: 205371 - DNA, 103 bp, Artificial Sequence
  Synthetic Polynucleotide
taatacgactcactatagggcggagaaacggagtcggccacaactgaagaaacagaggagatcttcaatggtggccgacaacctggcggcagcgcaaaagatg

SEQ ID NO: 205372 - DNA, 103 bp, Artificial Sequence
  Synthetic Polynucleotide
taatacgactcactatagggatgggaatctcggagaaacggagtcggccaaacagaggagatggccgatgccgtttctcaacctggcggcagcgcaaaagatg

SEQ ID NO: 205373 - DNA, 103 bp, Artificial Sequence
  Synthetic Polynucleotide
taatacgactcactatagggtgccagcttcatgggaatctcggagaaacgaacagaggagacgtttcatggagattcccaacctggcggcagcgcaaaagatg

SEQ ID NO: 205374 - DNA, 103 bp, Artificial Sequence
  Synthetic Polynucleotide
taatacgactcactataggggcagcaaccctgccagcttcatgggaatctaacagaggagaagattcatgtgaagctggaacctggcggcagcgcaaaagatg

SEQ ID NO: 205375 - DNA, 103 bp, Artificial Sequence
  Synthetic Polynucleotide
taatacgactcactatagggtctggatgctgcagcaaccctgccagcttcaacagaggagagaagctatgagggttgctaacctggcggcagcgcaaaagatg

SEQ ID NO: 205376 - DNA, 103 bp, Artificial Sequence
  Synthetic Polynucleotide
taatacgactcactatagggaggtggggcataagatggtctttttgacataacagaggagaatgtcaatgagaccatctaacctggcggcagcgcaaaagatg

SEQ ID NO: 205377 - DNA, 103 bp, Artificial Sequence
  Synthetic Polynucleotide
taatacgactcactatagggcctgtagttgttgtaggcgagatgactgtaaacagaggagatacagtatgctcgcctacaacctggcggcagcgcaaaagatg

SEQ ID NO: 205378 - DNA, 103 bp, Artificial Sequence
  Synthetic Polynucleotide
taatacgactcactatagggcatcggaatgttctcgtcgtctttcttctcaacagaggagagagaagatggacgacgagaacctggcggcagcgcaaaagatg

SEQ ID NO: 205379 - DNA, 103 bp, Artificial Sequence
  Synthetic Polynucleotide
taatacgactcactatagggtttctgtctccatcggaatgttctcgtcgtaacagaggagaacgacgatgacattccgaaacctggcggcagcgcaaaagatg

SEQ ID NO: 205380 - DNA, 103 bp, Artificial Sequence
  Synthetic Polynucleotide
taatacgactcactatagggtggcaatttttttctgtctccatcggaatgaacagaggagacattccatgggagacagaaacctggcggcagcgcaaaagatg

SEQ ID NO: 205381 - DNA, 103 bp, Artificial Sequence
  Synthetic Polynucleotide
taatacgactcactatagggaggacagagctggcaatttttttctgtctcaacagaggagagagacaatgaaaaattgcaacctggcggcagcgcaaaagatg

SEQ ID NO: 205382 - DNA, 103 bp, Artificial Sequence
  Synthetic Polynucleotide
taatacgactcactataggggggtttttctaggacagagctggcaattttaacagaggagaaaaattatgagctctgtcaacctggcggcagcgcaaaagatg

SEQ ID NO: 205383 - DNA, 103 bp, Artificial Sequence
  Synthetic Polynucleotide
taatacgactcactatagggctagaagtaagggtttttctaggacagagcaacagaggagagctctgatgtagaaaaacaacctggcggcagcgcaaaagatg

SEQ ID NO: 205384 - DNA, 103 bp, Artificial Sequence
  Synthetic Polynucleotide
taatacgactcactatagggatcagtatacctagaagtaagggtttttctaacagaggagaagaaaaatgcttacttctaacctggcggcagcgcaaaagatg

SEQ ID NO: 205385 - DNA, 103 bp, Artificial Sequence
  Synthetic Polynucleotide
taatacgactcactatagggaatcaggaaaatcagtatacctagaagtaaaacagaggagattacttatgggtatactgaacctggcggcagcgcaaaagatg

SEQ ID NO: 205386 - DNA, 103 bp, Artificial Sequence
  Synthetic Polynucleotide
taatacgactcactatagggtccctcccagcctgtagttgttgtaggcgaaacagaggagatcgcctatgacaactacaaacctggcggcagcgcaaaagatg

SEQ ID NO: 205387 - DNA, 103 bp, Artificial Sequence
  Synthetic Polynucleotide
taatacgactcactataggggtgcccgggttccctcccagcctgtagttgaacagaggagacaactaatggctgggaggaacctggcggcagcgcaaaagatg

SEQ ID NO: 205388 - DNA, 103 bp, Artificial Sequence
  Synthetic Polynucleotide
taatacgactcactatagggccggctgttggtgcccgggttccctcccagaacagaggagactgggaatgaacccgggcaacctggcggcagcgcaaaagatg

SEQ ID NO: 205389 - DNA, 103 bp, Artificial Sequence
  Synthetic Polynucleotide
taatacgactcactatagggatgccgtgacccggctgttggtgcccgggtaacagaggagaacccggatgccaacagccaacctggcggcagcgcaaaagatg

SEQ ID NO: 205390 - DNA, 103 bp, Artificial Sequence
  Synthetic Polynucleotide
taatacgactcactatagggataccagaggatgccgtgacccggctgttgaacagaggagacaacagatgggtcacggcaacctggcggcagcgcaaaagatg

SEQ ID NO: 205391 - DNA, 103 bp, Artificial Sequence
  Synthetic Polynucleotide
taatacgactcactatagggtggaatcgtgataccagaggatgccgtgacaacagaggagagtcacgatgtcctctggtaacctggcggcagcgcaaaagatg

SEQ ID NO: 205392 - DNA, 103 bp, Artificial Sequence
  Synthetic Polynucleotide
taatacgactcactatagggttgggggttttggaatcgtgataccagaggaacagaggagacctctgatgtcacgattcaacctggcggcagcgcaaaagatg

SEQ ID NO: 205393 - DNA, 103 bp, Artificial Sequence
  Synthetic Polynucleotide
taatacgactcactatagggtctggtggctttgggggttttggaatcgtgaacagaggagacacgatatgaaaacccccaacctggcggcagcgcaaaagatg

SEQ ID NO: 205394 - DNA, 103 bp, Artificial Sequence
  Synthetic Polynucleotide
taatacgactcactatagggcagcggcttatctggtggctttgggggtttaacagaggagaaaacccatgaagccaccaaacctggcggcagcgcaaaagatg

SEQ ID NO: 205395 - DNA, 103 bp, Artificial Sequence
  Synthetic Polynucleotide
taatacgactcactatagggctggggtgggaggtggggcataagatggtcaacagaggagagaccatatgatgccccacaacctggcggcagcgcaaaagatg

SEQ ID NO: 205396 - DNA, 103 bp, Artificial Sequence
  Synthetic Polynucleotide
taatacgactcactatagggtgtagggcatcagcggcttatctggtggctaacagaggagaagccacatgataagccgcaacctggcggcagcgcaaaagatg

SEQ ID NO: 205397 - DNA, 103 bp, Artificial Sequence
  Synthetic Polynucleotide
taatacgactcactatagggctgtacctcatgtagggcatcagcggcttaaacagaggagataagccatggatgccctaaacctggcggcagcgcaaaagatg

SEQ ID NO: 205398 - DNA, 103 bp, Artificial Sequence
  Synthetic Polynucleotide
taatacgactcactataggggacctttctgctgtacctcatgtagggcataacagaggagaatgcccatgatgaggtacaacctggcggcagcgcaaaagatg

SEQ ID NO: 205399 - DNA, 103 bp, Artificial Sequence
  Synthetic Polynucleotide
taatacgactcactatagggcttggtcccagacctttctgctgtacctcaaacagaggagatgaggtatggcagaaaggaacctggcggcagcgcaaaagatg

SEQ ID NO: 205400 - DNA, 103 bp, Artificial Sequence
  Synthetic Polynucleotide
taatacgactcactataggggaagcctttacttggtcccagacctttctgaacagaggagacagaaaatgctgggaccaaacctggcggcagcgcaaaagatg

SEQ ID NO: 205401 - DNA, 103 bp, Artificial Sequence
  Synthetic Polynucleotide
taatacgactcactataggggtcagggttggaagcctttacttggtcccaaacagaggagatgggacatggtaaaggctaacctggcggcagcgcaaaagatg

SEQ ID NO: 205402 - DNA, 103 bp, Artificial Sequence
  Synthetic Polynucleotide
taatacgactcactatagggacaactttaggtcagggttggaagcctttaaacagaggagataaaggatgccaaccctgaacctggcggcagcgcaaaagatg

SEQ ID NO: 205403 - DNA, 103 bp, Artificial Sequence
  Synthetic Polynucleotide
taatacgactcactatagggccaatctcccacaactttaggtcagggttgaacagaggagacaacccatgcctaaagttaacctggcggcagcgcaaaagatg

SEQ ID NO: 205404 - DNA, 103 bp, Artificial Sequence
  Synthetic Polynucleotide
taatacgactcactatagggaataatcttgccaatctcccacaactttagaacagaggagactaaagatgtgggagattaacctggcggcagcgcaaaagatg

SEQ ID NO: 205405 - DNA, 103 bp, Artificial Sequence
  Synthetic Polynucleotide
taatacgactcactatagggacatgccaccaataatcttgccaatctcccaacagaggagagggagaatggcaagattaaacctggcggcagcgcaaaagatg

SEQ ID NO: 205406 - DNA, 103 bp, Artificial Sequence
  Synthetic Polynucleotide
taatacgactcactataggggttgcaggagctggggtgggaggtggggcaaacagaggagatgccccatgtcccaccccaacctggcggcagcgcaaaagatg

SEQ ID NO: 205407 - DNA, 103 bp, Artificial Sequence
  Synthetic Polynucleotide
taatacgactcactatagggagatctcgccacatgccaccaataatcttgaacagaggagacaagatatgtggtggcataacctggcggcagcgcaaaagatg

SEQ ID NO: 205408 - DNA, 103 bp, Artificial Sequence
  Synthetic Polynucleotide
taatacgactcactatagggttcatcagtgagatctcgccacatgccaccaacagaggagaggtggcatgtggcgagataacctggcggcagcgcaaaagatg

SEQ ID NO: 205409 - DNA, 103 bp, Artificial Sequence
  Synthetic Polynucleotide
taatacgactcactatagggcttgtttttcttcatcagtgagatctcgccaacagaggagaggcgagatgtcactgatgaacctggcggcagcgcaaaagatg

SEQ ID NO: 205410 - DNA, 103 bp, Artificial Sequence
  Synthetic Polynucleotide
taatacgactcactatagggtttaaatattcttgtttttcttcatcagtgaacagaggagacactgaatgagaaaaacaaacctggcggcagcgcaaaagatg

SEQ ID NO: 205411 - DNA, 103 bp, Artificial Sequence
  Synthetic Polynucleotide
taatacgactcactatagggttcgtattcgtttaaatattcttgtttttcaacagaggagagaaaaaatggaatatttaaacctggcggcagcgcaaaagatg

SEQ ID NO: 205412 - DNA, 103 bp, Artificial Sequence
  Synthetic Polynucleotide
taatacgactcactatagggtcttttctgcttcgtattcgtttaaatattaacagaggagaaatattatgacgaatacgaacctggcggcagcgcaaaagatg

SEQ ID NO: 205413 - DNA, 103 bp, Artificial Sequence
  Synthetic Polynucleotide
taatacgactcactatagggttgtactctatcttttctgcttcgtattcgaacagaggagacgaataatgagcagaaaaaacctggcggcagcgcaaaagatg

SEQ ID NO: 205414 - DNA, 103 bp, Artificial Sequence
  Synthetic Polynucleotide
taatacgactcactatagggcatagattcattgtactctatcttttctgcaacagaggagagcagaaatgatagagtacaacctggcggcagcgcaaaagatg

SEQ ID NO: 205415 - DNA, 103 bp, Artificial Sequence
  Synthetic Polynucleotide
taatacgactcactataggggataggccttcatagattcattgtactctaaacagaggagatagagtatgatgaatctaaacctggcggcagcgcaaaagatg

SEQ ID NO: 205416 - DNA, 103 bp, Artificial Sequence
  Synthetic Polynucleotide
taatacgactcactatagggggggaattatgataggccttcatagattcaaacagaggagatgaatcatggaaggcctaaacctggcggcagcgcaaaagatg

SEQ ID NO: 205417 - DNA, 103 bp, Artificial Sequence
  Synthetic Polynucleotide
taatacgactcactataggggggcatttgtgttgcaggagctggggtgggaacagaggagacccaccatggctcctgcaaacctggcggcagcgcaaaagatg

SEQ ID NO: 205418 - DNA, 103 bp, Artificial Sequence
  Synthetic Polynucleotide
taatacgactcactatagggaaggtacgcgggggaattatgataggccttaacagaggagaaaggccatgcataattccaacctggcggcagcgcaaaagatg

SEQ ID NO: 205419 - DNA, 103 bp, Artificial Sequence
  Synthetic Polynucleotide
taatacgactcactatagggttatgtaagcaaggtacgcgggggaattataacagaggagaataattatgccgcgtaccaacctggcggcagcgcaaaagatg

SEQ ID NO: 205420 - DNA, 103 bp, Artificial Sequence
  Synthetic Polynucleotide
taatacgactcactatagggctttttgcatttatgtaagcaaggtacgcgaacagaggagacgcgtaatgtgcttacataacctggcggcagcgcaaaagatg

SEQ ID NO: 205421 - DNA, 103 bp, Artificial Sequence
  Synthetic Polynucleotide
taatacgactcactatagggttctgcacgactttttgcatttatgtaagcaacagaggagagcttacatgaatgcaaaaaacctggcggcagcgcaaaagatg

SEQ ID NO: 205422 - DNA, 103 bp, Artificial Sequence
  Synthetic Polynucleotide
taatacgactcactatagggctaaagcagcttctgcacgactttttgcataacagaggagaatgcaaatggtcgtgcagaacctggcggcagcgcaaaagatg

SEQ ID NO: 205423 - DNA, 103 bp, Artificial Sequence
  Synthetic Polynucleotide
taatacgactcactatagggctttcttcctctaaagcagcttctgcacgaaacagaggagatcgtgcatgagctgctttaacctggcggcagcgcaaaagatg

SEQ ID NO: 205424 - DNA, 103 bp, Artificial Sequence
  Synthetic Polynucleotide
taatacgactcactatagggtctctgtcgactttcttcctctaaagcagcaacagaggagagctgctatggaggaagaaaacctggcggcagcgcaaaagatg

SEQ ID NO: 205425 - DNA, 103 bp, Artificial Sequence
  Synthetic Polynucleotide
taatacgactcactatagggtgcgagattgtctctgtcgactttcttcctaacagaggagaaggaagatggtcgacagaaacctggcggcagcgcaaaagatg

SEQ ID NO: 205426 - DNA, 103 bp, Artificial Sequence
  Synthetic Polynucleotide
taatacgactcactatagggcctttctccatgcgagattgtctctgtcgaaacagaggagatcgacaatgacaatctcgaacctggcggcagcgcaaaagatg

SEQ ID NO: 205427 - DNA, 103 bp, Artificial Sequence
  Synthetic Polynucleotide
taatacgactcactataggggtacggttctcctttctccatgcgagattgaacagaggagacaatctatgatggagaaaaacctggcggcagcgcaaaagatg

SEQ ID NO: 205428 - DNA, 103 bp, Artificial Sequence
  Synthetic Polynucleotide
taatacgactcactatagggctggtgtgctgggcatttgtgttgcaggagaacagaggagactcctgatgcacaaatgcaacctggcggcagcgcaaaagatg

SEQ ID NO: 205429 - DNA, 103 bp, Artificial Sequence
  Synthetic Polynucleotide
taatacgactcactataggggaatgctcatgtacggttctcctttctccaaacagaggagatggagaatggagaaccgtaacctggcggcagcgcaaaagatg
